United States Patent 7,901,882 (ANALYSIS OF METHYLATION USING NUCLEIC ACID ARRAYS) - sequence listing, part 19

SEQ ID NO: 690612 - DNA, 25 bp, Artificial sequence
  Synthetic oligonucleotide
ggccatagaccaaacatacgatcag

SEQ ID NO: 690613 - DNA, 25 bp, Artificial sequence
  Synthetic oligonucleotide
acaccacattttgaccttgtagggg

SEQ ID NO: 690614 - DNA, 25 bp, Artificial sequence
  Synthetic oligonucleotide
acaccacattttcaccttgtagggg

SEQ ID NO: 690615 - DNA, 25 bp, Artificial sequence
  Synthetic oligonucleotide
acaaccggtttctcagaagctgatt

SEQ ID NO: 690616 - DNA, 25 bp, Artificial sequence
  Synthetic oligonucleotide
ggccatagaccatacatacgatcag

SEQ ID NO: 690617 - DNA, 25 bp, Artificial sequence
  Synthetic oligonucleotide
ttagagcacggactccgtccagttg

SEQ ID NO: 690618 - DNA, 25 bp, Artificial sequence
  Synthetic oligonucleotide
attatctgatgtgatgcctgttgag

SEQ ID NO: 690619 - DNA, 25 bp, Artificial sequence
  Synthetic oligonucleotide
attatctgatgtcatgcctgttgag

SEQ ID NO: 690620 - DNA, 25 bp, Artificial sequence
  Synthetic oligonucleotide
acaaccggatgtgttgattgattta

SEQ ID NO: 690621 - DNA, 25 bp, Artificial sequence
  Synthetic oligonucleotide
acaaccggatgtcttgattgattta

SEQ ID NO: 690622 - DNA, 25 bp, Artificial sequence
  Synthetic oligonucleotide
tcttgattgattaaacaacgcccga

SEQ ID NO: 690623 - DNA, 25 bp, Artificial sequence
  Synthetic oligonucleotide
tcttgattgatttaacaacgcccga

SEQ ID NO: 690624 - DNA, 25 bp, Artificial sequence
  Synthetic oligonucleotide
ttagagcacggagtccgtccagttg

SEQ ID NO: 690625 - DNA, 25 bp, Artificial sequence
  Synthetic oligonucleotide
tgaagattgatcagcttgtgtatgg

SEQ ID NO: 690626 - DNA, 25 bp, Artificial sequence
  Synthetic oligonucleotide
gaaaattgctttgatcgcgcatgac

SEQ ID NO: 690627 - DNA, 25 bp, Artificial sequence
  Synthetic oligonucleotide
gaaaattgctttcatcgcgcatgac

SEQ ID NO: 690628 - DNA, 25 bp, Artificial sequence
  Synthetic oligonucleotide
aaagaatcatgatctatacgcaacc

SEQ ID NO: 690629 - DNA, 25 bp, Artificial sequence
  Synthetic oligonucleotide
gcggaaattcttctgcgcacacttg

SEQ ID NO: 690630 - DNA, 25 bp, Artificial sequence
  Synthetic oligonucleotide
aaagaatcatgaactatacgcaacc

SEQ ID NO: 690631 - DNA, 25 bp, Artificial sequence
  Synthetic oligonucleotide
tgaaccggatgtctcggcattaatc

SEQ ID NO: 690632 - DNA, 25 bp, Artificial sequence
  Synthetic oligonucleotide
gtcatttttttgggcgacccgctga

SEQ ID NO: 690633 - DNA, 25 bp, Artificial sequence
  Synthetic oligonucleotide
gtcatttttttgcgcgacccgctga

SEQ ID NO: 690634 - DNA, 25 bp, Artificial sequence
  Synthetic oligonucleotide
tgaagattgatctgcttgtgtatgg

SEQ ID NO: 690635 - DNA, 25 bp, Artificial sequence
  Synthetic oligonucleotide
ccgaatgtataaagctgacgttctt

SEQ ID NO: 690636 - DNA, 25 bp, Artificial sequence
  Synthetic oligonucleotide
ccgaatgtataatgctgacgttctt

SEQ ID NO: 690637 - DNA, 25 bp, Artificial sequence
  Synthetic oligonucleotide
ctgcggaaattcttgtgcgcacact

SEQ ID NO: 690638 - DNA, 25 bp, Artificial sequence
  Synthetic oligonucleotide
cccacagtgatgttgtcgagatcgg

SEQ ID NO: 690639 - DNA, 25 bp, Artificial sequence
  Synthetic oligonucleotide
cccacagtgatgatgtcgagatcgg

SEQ ID NO: 690640 - DNA, 25 bp, Artificial sequence
  Synthetic oligonucleotide
atgaaggtgttttcgaattccgtga

SEQ ID NO: 690641 - DNA, 25 bp, Artificial sequence
  Synthetic oligonucleotide
atgaaggtgtttacgaattccgtga

SEQ ID NO: 690642 - DNA, 25 bp, Artificial sequence
  Synthetic oligonucleotide
gcggaaattcttgtgcgcacacttg

SEQ ID NO: 690643 - DNA, 25 bp, Artificial sequence
  Synthetic oligonucleotide
ctgcggaaattcatgtgcgcacact

SEQ ID NO: 690644 - DNA, 25 bp, Artificial sequence
  Synthetic oligonucleotide
ccgtttatgtgaagtgtattccatt

SEQ ID NO: 690645 - DNA, 25 bp, Artificial sequence
  Synthetic oligonucleotide
ccgtttatgtgatgtgtattccatt

SEQ ID NO: 690646 - DNA, 25 bp, Artificial sequence
  Synthetic oligonucleotide
tgaaccggatgtgtcggcattaatc

SEQ ID NO: 690647 - DNA, 25 bp, Artificial sequence
  Synthetic oligonucleotide
ttcatttgtatcgaaggtgctgaat

SEQ ID NO: 690648 - DNA, 25 bp, Artificial sequence
  Synthetic oligonucleotide
tcatgccactgattacgttgaaaaa

SEQ ID NO: 690649 - DNA, 25 bp, Artificial sequence
  Synthetic oligonucleotide
cgggccgttctctcgtgggagacgc

SEQ ID NO: 690650 - DNA, 25 bp, Artificial sequence
  Synthetic oligonucleotide
gaaccgggccgttctctcgtgggag

SEQ ID NO: 690651 - DNA, 25 bp, Artificial sequence
  Synthetic oligonucleotide
gaaccgggccgtactctcgtgggag

SEQ ID NO: 690652 - DNA, 25 bp, Artificial sequence
  Synthetic oligonucleotide
atgccactgaattcgttgaaaaaat

SEQ ID NO: 690653 - DNA, 25 bp, Artificial sequence
  Synthetic oligonucleotide
atgccactgaatacgttgaaaaaat

SEQ ID NO: 690654 - DNA, 25 bp, Artificial sequence
  Synthetic oligonucleotide
atacggccggttttgtgttagcagc

SEQ ID NO: 690655 - DNA, 25 bp, Artificial sequence
  Synthetic oligonucleotide
tcatgccactgaatacgttgaaaaa

SEQ ID NO: 690656 - DNA, 25 bp, Artificial sequence
  Synthetic oligonucleotide
cgggccgttctcacgtgggagacgc

SEQ ID NO: 690657 - DNA, 25 bp, Artificial sequence
  Synthetic oligonucleotide
gtgctgaatcttggaggaggtttcg

SEQ ID NO: 690658 - DNA, 25 bp, Artificial sequence
  Synthetic oligonucleotide
ggccggttttgtgttagcagcggaa

SEQ ID NO: 690659 - DNA, 25 bp, Artificial sequence
  Synthetic oligonucleotide
ttgtatccaaggtgctgaatcttgg

SEQ ID NO: 690660 - DNA, 25 bp, Artificial sequence
  Synthetic oligonucleotide
ttcatttgtatccaaggtgctgaat

SEQ ID NO: 690661 - DNA, 25 bp, Artificial sequence
  Synthetic oligonucleotide
tattcatttgtaaccaaggtgctga

SEQ ID NO: 690662 - DNA, 25 bp, Artificial sequence
  Synthetic oligonucleotide
tattcatttgtatccaaggtgctga

SEQ ID NO: 690663 - DNA, 25 bp, Artificial sequence
  Synthetic oligonucleotide
gttttgtgttagcagcggaaaaaat

SEQ ID NO: 690664 - DNA, 25 bp, Artificial sequence
  Synthetic oligonucleotide
gttttgtgttaggagcggaaaaaat

SEQ ID NO: 690665 - DNA, 25 bp, Artificial sequence
  Synthetic oligonucleotide
ggccggttttgtcttagcagcggaa

SEQ ID NO: 690666 - DNA, 25 bp, Artificial sequence
  Synthetic oligonucleotide
atacggccggttatgtgttagcagc

SEQ ID NO: 690667 - DNA, 25 bp, Artificial sequence
  Synthetic oligonucleotide
gtgctgaatcttcgaggaggtttcg

SEQ ID NO: 690668 - DNA, 25 bp, Artificial sequence
  Synthetic oligonucleotide
ttgtatccaaggagctgaatcttgg

SEQ ID NO: 690669 - DNA, 25 bp, Artificial sequence
  Synthetic oligonucleotide
cacctctttacgaatatgatgtggc

SEQ ID NO: 690670 - DNA, 25 bp, Artificial sequence
  Synthetic oligonucleotide
ggagaaatatggtacacctctttac

SEQ ID NO: 690671 - DNA, 25 bp, Artificial sequence
  Synthetic oligonucleotide
ggactttctttagatgtcgtatccg

SEQ ID NO: 690672 - DNA, 25 bp, Artificial sequence
  Synthetic oligonucleotide
atcagtcgcaatcattcagctcgct

SEQ ID NO: 690673 - DNA, 25 bp, Artificial sequence
  Synthetic oligonucleotide
atcagtcgcaatgattcagctcgct

SEQ ID NO: 690674 - DNA, 25 bp, Artificial sequence
  Synthetic oligonucleotide
gcaggcgtttatatctgcagggctg

SEQ ID NO: 690675 - DNA, 25 bp, Artificial sequence
  Synthetic oligonucleotide
gcaggcgtttatttctgcagggctg

SEQ ID NO: 690676 - DNA, 25 bp, Artificial sequence
  Synthetic oligonucleotide
ggctttaatacgtgagcgtgctaaa

SEQ ID NO: 690677 - DNA, 25 bp, Artificial sequence
  Synthetic oligonucleotide
ggctttaatacgagagcgtgctaaa

SEQ ID NO: 690678 - DNA, 25 bp, Artificial sequence
  Synthetic oligonucleotide
gagagctatatacggctgttgcagc

SEQ ID NO: 690679 - DNA, 25 bp, Artificial sequence
  Synthetic oligonucleotide
tacacctctttacgtatatgatgtg

SEQ ID NO: 690680 - DNA, 25 bp, Artificial sequence
  Synthetic oligonucleotide
gagagctatatagggctgttgcagc

SEQ ID NO: 690681 - DNA, 25 bp, Artificial sequence
  Synthetic oligonucleotide
ggagaaatatggaacacctctttac

SEQ ID NO: 690682 - DNA, 25 bp, Artificial sequence
  Synthetic oligonucleotide
tagaaatcggaggtgtggatgctct

SEQ ID NO: 690683 - DNA, 25 bp, Artificial sequence
  Synthetic oligonucleotide
agcggagaaatatggtacacctctt

SEQ ID NO: 690684 - DNA, 25 bp, Artificial sequence
  Synthetic oligonucleotide
agcggagaaataaggtacacctctt

SEQ ID NO: 690685 - DNA, 25 bp, Artificial sequence
  Synthetic oligonucleotide
ggatgctctctaattagcggagaaa

SEQ ID NO: 690686 - DNA, 25 bp, Artificial sequence
  Synthetic oligonucleotide
ggatgctctctatttagcggagaaa

SEQ ID NO: 690687 - DNA, 25 bp, Artificial sequence
  Synthetic oligonucleotide
tagaaatcggagctgtggatgctct

SEQ ID NO: 690688 - DNA, 25 bp, Artificial sequence
  Synthetic oligonucleotide
tacacctctttaggtatatgatgtg

SEQ ID NO: 690689 - DNA, 25 bp, Artificial sequence
  Synthetic oligonucleotide
cacctctttacgtatatgatgtggc

SEQ ID NO: 690690 - DNA, 25 bp, Artificial sequence
  Synthetic oligonucleotide
ggactttctttacatgtcgtatccg

SEQ ID NO: 690691 - DNA, 25 bp, Artificial sequence
  Synthetic oligonucleotide
gactacattacaacgggccaggaag

SEQ ID NO: 690692 - DNA, 25 bp, Artificial sequence
  Synthetic oligonucleotide
gaacgcatccactttcatggaaaca

SEQ ID NO: 690693 - DNA, 25 bp, Artificial sequence
  Synthetic oligonucleotide
tccattgccatatcggctcgcaaat

SEQ ID NO: 690694 - DNA, 25 bp, Artificial sequence
  Synthetic oligonucleotide
tccattgccataacggctcgcaaat

SEQ ID NO: 690695 - DNA, 25 bp, Artificial sequence
  Synthetic oligonucleotide
ctgaacgggccattgaacaagtatt

SEQ ID NO: 690696 - DNA, 25 bp, Artificial sequence
  Synthetic oligonucleotide
ctgaacgggccaatgaacaagtatt

SEQ ID NO: 690697 - DNA, 25 bp, Artificial sequence
  Synthetic oligonucleotide
actgaacgggccattgaacaagtat

SEQ ID NO: 690698 - DNA, 25 bp, Artificial sequence
  Synthetic oligonucleotide
actgaacgggcctttgaacaagtat

SEQ ID NO: 690699 - DNA, 25 bp, Artificial sequence
  Synthetic oligonucleotide
tttcgatcttcataacggacaaact

SEQ ID NO: 690700 - DNA, 25 bp, Artificial sequence
  Synthetic oligonucleotide
tttcgatcttcaaaacggacaaact

SEQ ID NO: 690701 - DNA, 25 bp, Artificial sequence
  Synthetic oligonucleotide
agtttggtttcgatcttcataacgg

SEQ ID NO: 690702 - DNA, 25 bp, Artificial sequence
  Synthetic oligonucleotide
gcttcttgaagagctatgtaaagaa

SEQ ID NO: 690703 - DNA, 25 bp, Artificial sequence
  Synthetic oligonucleotide
gactacattacatcgggccaggaag

SEQ ID NO: 690704 - DNA, 25 bp, Artificial sequence
  Synthetic oligonucleotide
tgactacattacaacgggccaggaa

SEQ ID NO: 690705 - DNA, 25 bp, Artificial sequence
  Synthetic oligonucleotide
tgactacattactacgggccaggaa

SEQ ID NO: 690706 - DNA, 25 bp, Artificial sequence
  Synthetic oligonucleotide
tacgcatgactacattacaacgggc

SEQ ID NO: 690707 - DNA, 25 bp, Artificial sequence
  Synthetic oligonucleotide
tacgcatgactagattacaacgggc

SEQ ID NO: 690708 - DNA, 25 bp, Artificial sequence
  Synthetic oligonucleotide
cttcggatcacggccggagtagaag

SEQ ID NO: 690709 - DNA, 25 bp, Artificial sequence
  Synthetic oligonucleotide
cttcggatcacgcccggagtagaag

SEQ ID NO: 690710 - DNA, 25 bp, Artificial sequence
  Synthetic oligonucleotide
gaacgcatccacattcatggaaaca

SEQ ID NO: 690711 - DNA, 25 bp, Artificial sequence
  Synthetic oligonucleotide
gcttcttgaagacctatgtaaagaa

SEQ ID NO: 690712 - DNA, 25 bp, Artificial sequence
  Synthetic oligonucleotide
agtttggtttcgttcttcataacgg

SEQ ID NO: 690713 - DNA, 25 bp, Artificial sequence
  Synthetic oligonucleotide
gtctgcattttcatggagaaattta

SEQ ID NO: 690714 - DNA, 25 bp, Artificial sequence
  Synthetic oligonucleotide
tccggggcgctggatagagtgctgt

SEQ ID NO: 690715 - DNA, 25 bp, Artificial sequence
  Synthetic oligonucleotide
gaccatcccgaggtgaatatcgggg

SEQ ID NO: 690716 - DNA, 25 bp, Artificial sequence
  Synthetic oligonucleotide
gaccatcccgagctgaatatcgggg

SEQ ID NO: 690717 - DNA, 25 bp, Artificial sequence
  Synthetic oligonucleotide
atcggggtcattgccaatgatatgg

SEQ ID NO: 690718 - DNA, 25 bp, Artificial sequence
  Synthetic oligonucleotide
atcggggtcattcccaatgatatgg

SEQ ID NO: 690719 - DNA, 25 bp, Artificial sequence
  Synthetic oligonucleotide
ctgtctcccgatgaaaacatatctt

SEQ ID NO: 690720 - DNA, 25 bp, Artificial sequence
  Synthetic oligonucleotide
ctgtctcccgatcaaaacatatctt

SEQ ID NO: 690721 - DNA, 25 bp, Artificial sequence
  Synthetic oligonucleotide
gagctctaggccgaaaacgacctta

SEQ ID NO: 690722 - DNA, 25 bp, Artificial sequence
  Synthetic oligonucleotide
gagctctaggcccaaaacgacctta

SEQ ID NO: 690723 - DNA, 25 bp, Artificial sequence
  Synthetic oligonucleotide
cctgtcaaaaattgagtcacgtccg

SEQ ID NO: 690724 - DNA, 25 bp, Artificial sequence
  Synthetic oligonucleotide
atggtcatgctgccgcaggatgatc

SEQ ID NO: 690725 - DNA, 25 bp, Artificial sequence
  Synthetic oligonucleotide
gagtcacgtccgactaaaaccggat

SEQ ID NO: 690726 - DNA, 25 bp, Artificial sequence
  Synthetic oligonucleotide
tccggggcgctgcatagagtgctgt

SEQ ID NO: 690727 - DNA, 25 bp, Artificial sequence
  Synthetic oligonucleotide
gtctgcattttcttggagaaattta

SEQ ID NO: 690728 - DNA, 25 bp, Artificial sequence
  Synthetic oligonucleotide
cctgtcaaaaatagagtcacgtccg

SEQ ID NO: 690729 - DNA, 25 bp, Artificial sequence
  Synthetic oligonucleotide
ctgtcaaaaattcagtcacgtccga

SEQ ID NO: 690730 - DNA, 25 bp, Artificial sequence
  Synthetic oligonucleotide
ctgtcaaaaattgagtcacgtccga

SEQ ID NO: 690731 - DNA, 25 bp, Artificial sequence
  Synthetic oligonucleotide
tcaaaaattgagtcacgtccgacta

SEQ ID NO: 690732 - DNA, 25 bp, Artificial sequence
  Synthetic oligonucleotide
tcaaaaattgagacacgtccgacta

SEQ ID NO: 690733 - DNA, 25 bp, Artificial sequence
  Synthetic oligonucleotide
gagtcacgtccgtctaaaaccggat

SEQ ID NO: 690734 - DNA, 25 bp, Artificial sequence
  Synthetic oligonucleotide
atggtcatgctggcgcaggatgatc

SEQ ID NO: 690735 - DNA, 25 bp, Artificial sequence
  Synthetic oligonucleotide
ggaggataggtcaggtgcgttatct

SEQ ID NO: 690736 - DNA, 25 bp, Artificial sequence
  Synthetic oligonucleotide
ctggaagcaacgttctttccattca

SEQ ID NO: 690737 - DNA, 25 bp, Artificial sequence
  Synthetic oligonucleotide
tttggaggataggtcaggtgcgtta

SEQ ID NO: 690738 - DNA, 25 bp, Artificial sequence
  Synthetic oligonucleotide
gattcagtagcacatgccgttcaaa

SEQ ID NO: 690739 - DNA, 25 bp, Artificial sequence
  Synthetic oligonucleotide
tgacactgtctaacagtacgtcggc

SEQ ID NO: 690740 - DNA, 25 bp, Artificial sequence
  Synthetic oligonucleotide
tgacactgtctatcagtacgtcggc

SEQ ID NO: 690741 - DNA, 25 bp, Artificial sequence
  Synthetic oligonucleotide
tatcagtacgtcggcaatggaagaa

SEQ ID NO: 690742 - DNA, 25 bp, Artificial sequence
  Synthetic oligonucleotide
gtgacactgtctttcagtacgtcgg

SEQ ID NO: 690743 - DNA, 25 bp, Artificial sequence
  Synthetic oligonucleotide
tatcagtacgtccgcaatggaagaa

SEQ ID NO: 690744 - DNA, 25 bp, Artificial sequence
  Synthetic oligonucleotide
ctggaagcaacgatctttccattca

SEQ ID NO: 690745 - DNA, 25 bp, Artificial sequence
  Synthetic oligonucleotide
gtagctgattctcgaagcaacgttc

SEQ ID NO: 690746 - DNA, 25 bp, Artificial sequence
  Synthetic oligonucleotide
gtagctgattctggaagcaacgttc

SEQ ID NO: 690747 - DNA, 25 bp, Artificial sequence
  Synthetic oligonucleotide
gcagatgccgttcaaaaggtcgatt

SEQ ID NO: 690748 - DNA, 25 bp, Artificial sequence
  Synthetic oligonucleotide
gattcagtagcagatgccgttcaaa

SEQ ID NO: 690749 - DNA, 25 bp, Artificial sequence
  Synthetic oligonucleotide
gtgacactgtctatcagtacgtcgg

SEQ ID NO: 690750 - DNA, 25 bp, Artificial sequence
  Synthetic oligonucleotide
gcagatgccgttgaaaaggtcgatt

SEQ ID NO: 690751 - DNA, 25 bp, Artificial sequence
  Synthetic oligonucleotide
aggtcgatttaactagaagtgcgtt

SEQ ID NO: 690752 - DNA, 25 bp, Artificial sequence
  Synthetic oligonucleotide
aggtcgatttaagtagaagtgcgtt

SEQ ID NO: 690753 - DNA, 25 bp, Artificial sequence
  Synthetic oligonucleotide
ttttccattctagaccatggtaaaa

SEQ ID NO: 690754 - DNA, 25 bp, Artificial sequence
  Synthetic oligonucleotide
ttttccattctacaccatggtaaaa

SEQ ID NO: 690755 - DNA, 25 bp, Artificial sequence
  Synthetic oligonucleotide
tttggaggatagctcaggtgcgtta

SEQ ID NO: 690756 - DNA, 25 bp, Artificial sequence
  Synthetic oligonucleotide
ggaggataggtctggtgcgttatct

SEQ ID NO: 690757 - DNA, 25 bp, Artificial sequence
  Synthetic oligonucleotide
ggagtgtatagatgcagccgttgca

SEQ ID NO: 690758 - DNA, 25 bp, Artificial sequence
  Synthetic oligonucleotide
atttcttcatcgacattttccttcc

SEQ ID NO: 690759 - DNA, 25 bp, Artificial sequence
  Synthetic oligonucleotide
atatgaatacgccaattctaccggg

SEQ ID NO: 690760 - DNA, 25 bp, Artificial sequence
  Synthetic oligonucleotide
gctcgacaaaatatactcacattca

SEQ ID NO: 690761 - DNA, 25 bp, Artificial sequence
  Synthetic oligonucleotide
gctcgacaaaatttactcacattca

SEQ ID NO: 690762 - DNA, 25 bp, Artificial sequence
  Synthetic oligonucleotide
aatcgtgggtgaaatgacgttgccg

SEQ ID NO: 690763 - DNA, 25 bp, Artificial sequence
  Synthetic oligonucleotide
tcggttatttaggtccagcagctac

SEQ ID NO: 690764 - DNA, 25 bp, Artificial sequence
  Synthetic oligonucleotide
aatcgtgggtgatatgacgttgccg

SEQ ID NO: 690765 - DNA, 25 bp, Artificial sequence
  Synthetic oligonucleotide
gttgcaggcgaacttgattttgctt

SEQ ID NO: 690766 - DNA, 25 bp, Artificial sequence
  Synthetic oligonucleotide
gttgcaggcgaagttgattttgctt

SEQ ID NO: 690767 - DNA, 25 bp, Artificial sequence
  Synthetic oligonucleotide
atttcttcatcgtcattttccttcc

SEQ ID NO: 690768 - DNA, 25 bp, Artificial sequence
  Synthetic oligonucleotide
ggagtgtatagaagcagccgttgca

SEQ ID NO: 690769 - DNA, 25 bp, Artificial sequence
  Synthetic oligonucleotide
gaacatgttgcttaccgcaccattc

SEQ ID NO: 690770 - DNA, 25 bp, Artificial sequence
  Synthetic oligonucleotide
gaacatgttgctaaccgcaccattc

SEQ ID NO: 690771 - DNA, 25 bp, Artificial sequence
  Synthetic oligonucleotide
ccgaacatgttggttaccgcaccat

SEQ ID NO: 690772 - DNA, 25 bp, Artificial sequence
  Synthetic oligonucleotide
ccgaacatgttgcttaccgcaccat

SEQ ID NO: 690773 - DNA, 25 bp, Artificial sequence
  Synthetic oligonucleotide
tacatttacacaactagcagtcagt

SEQ ID NO: 690774 - DNA, 25 bp, Artificial sequence
  Synthetic oligonucleotide
tacatttacacatctagcagtcagt

SEQ ID NO: 690775 - DNA, 25 bp, Artificial sequence
  Synthetic oligonucleotide
ctacatttacacttctagcagtcag

SEQ ID NO: 690776 - DNA, 25 bp, Artificial sequence
  Synthetic oligonucleotide
tcggttatttagctccagcagctac

SEQ ID NO: 690777 - DNA, 25 bp, Artificial sequence
  Synthetic oligonucleotide
atatgaatacgcgaattctaccggg

SEQ ID NO: 690778 - DNA, 25 bp, Artificial sequence
  Synthetic oligonucleotide
ctacatttacacatctagcagtcag

SEQ ID NO: 690779 - DNA, 25 bp, Artificial sequence
  Synthetic oligonucleotide
gtgatcggcctggatgaggatgacg

SEQ ID NO: 690780 - DNA, 25 bp, Artificial sequence
  Synthetic oligonucleotide
acgcgagagacgagcttccgaagga

SEQ ID NO: 690781 - DNA, 25 bp, Artificial sequence
  Synthetic oligonucleotide
gacgagacccaattgatccgcgtcc

SEQ ID NO: 690782 - DNA, 25 bp, Artificial sequence
  Synthetic oligonucleotide
gtgatcggcctgcatgaggatgacg

SEQ ID NO: 690783 - DNA, 25 bp, Artificial sequence
  Synthetic oligonucleotide
gacgagacccaaatgatccgcgtcc

SEQ ID NO: 690784 - DNA, 25 bp, Artificial sequence
  Synthetic oligonucleotide
aaagaacagctcccgcttcatttcc

SEQ ID NO: 690785 - DNA, 25 bp, Artificial sequence
  Synthetic oligonucleotide
gacgtagtcgttctcattccttttt

SEQ ID NO: 690786 - DNA, 25 bp, Artificial sequence
  Synthetic oligonucleotide
acgcgagagacgtgcttccgaagga

SEQ ID NO: 690787 - DNA, 25 bp, Artificial sequence
  Synthetic oligonucleotide
gaaggagtttccttatgccgatgcc

SEQ ID NO: 690788 - DNA, 25 bp, Artificial sequence
  Synthetic oligonucleotide
gaaggagtttccatatgccgatgcc

SEQ ID NO: 690789 - DNA, 25 bp, Artificial sequence
  Synthetic oligonucleotide
tcctcattgctgcgatcatgtccaa

SEQ ID NO: 690790 - DNA, 25 bp, Artificial sequence
  Synthetic oligonucleotide
atgcttgtgcctcagctgtcaaaag

SEQ ID NO: 690791 - DNA, 25 bp, Artificial sequence
  Synthetic oligonucleotide
gacgtagtcgttgtcattccttttt

SEQ ID NO: 690792 - DNA, 25 bp, Artificial sequence
  Synthetic oligonucleotide
aaagaacagctcgcgcttcatttcc

SEQ ID NO: 690793 - DNA, 25 bp, Artificial sequence
  Synthetic oligonucleotide
tcctcattgctgggatcatgtccaa

SEQ ID NO: 690794 - DNA, 25 bp, Artificial sequence
  Synthetic oligonucleotide
gaagggcgcatatggaacggctctc

SEQ ID NO: 690795 - DNA, 25 bp, Artificial sequence
  Synthetic oligonucleotide
atgcttgtgcctgagctgtcaaaag

SEQ ID NO: 690796 - DNA, 25 bp, Artificial sequence
  Synthetic oligonucleotide
gaaggatatgttccatcagccgtac

SEQ ID NO: 690797 - DNA, 25 bp, Artificial sequence
  Synthetic oligonucleotide
gaaggatatgttgcatcagccgtac

SEQ ID NO: 690798 - DNA, 25 bp, Artificial sequence
  Synthetic oligonucleotide
ggattggccgctagtcgggaaaatc

SEQ ID NO: 690799 - DNA, 25 bp, Artificial sequence
  Synthetic oligonucleotide
ggattggccgcttgtcgggaaaatc

SEQ ID NO: 690800 - DNA, 25 bp, Artificial sequence
  Synthetic oligonucleotide
gaagggcgcataaggaacggctctc

SEQ ID NO: 690801 - DNA, 25 bp, Artificial sequence
  Synthetic oligonucleotide
gacggaaactttgacgatgcgctta

SEQ ID NO: 690802 - DNA, 25 bp, Artificial sequence
  Synthetic oligonucleotide
caggccttccgataatgcgcggctt

SEQ ID NO: 690803 - DNA, 25 bp, Artificial sequence
  Synthetic oligonucleotide
gtcaacccttacggcattgaaggcc

SEQ ID NO: 690804 - DNA, 25 bp, Artificial sequence
  Synthetic oligonucleotide
gatgcgcttaaaattgtccgttcca

SEQ ID NO: 690805 - DNA, 25 bp, Artificial sequence
  Synthetic oligonucleotide
gatgcgcttaaatttgtccgttcca

SEQ ID NO: 690806 - DNA, 25 bp, Artificial sequence
  Synthetic oligonucleotide
gtcaacccttaccgcattgaaggcc

SEQ ID NO: 690807 - DNA, 25 bp, Artificial sequence
  Synthetic oligonucleotide
aaactgctgccttcgaagtgtgcga

SEQ ID NO: 690808 - DNA, 25 bp, Artificial sequence
  Synthetic oligonucleotide
aaactgctgcctacgaagtgtgcga

SEQ ID NO: 690809 - DNA, 25 bp, Artificial sequence
  Synthetic oligonucleotide
agcgcctgatgtattagcgatcccg

SEQ ID NO: 690810 - DNA, 25 bp, Artificial sequence
  Synthetic oligonucleotide
gtaacagatcaatcaccggcgctaa

SEQ ID NO: 690811 - DNA, 25 bp, Artificial sequence
  Synthetic oligonucleotide
agcgcctgatgttttagcgatcccg

SEQ ID NO: 690812 - DNA, 25 bp, Artificial sequence
  Synthetic oligonucleotide
gacggaaactttcacgatgcgctta

SEQ ID NO: 690813 - DNA, 25 bp, Artificial sequence
  Synthetic oligonucleotide
aactcgctcaagctgtcatgtacgg

SEQ ID NO: 690814 - DNA, 25 bp, Artificial sequence
  Synthetic oligonucleotide
aactcgctcaaggtgtcatgtacgg

SEQ ID NO: 690815 - DNA, 25 bp, Artificial sequence
  Synthetic oligonucleotide
gaaatgcattgtgatcatcccgaac

SEQ ID NO: 690816 - DNA, 25 bp, Artificial sequence
  Synthetic oligonucleotide
gaaatgcattgtcatcatcccgaac

SEQ ID NO: 690817 - DNA, 25 bp, Artificial sequence
  Synthetic oligonucleotide
gcatatgcagcccgtgctaacatga

SEQ ID NO: 690818 - DNA, 25 bp, Artificial sequence
  Synthetic oligonucleotide
gcatatgcagccggtgctaacatga

SEQ ID NO: 690819 - DNA, 25 bp, Artificial sequence
  Synthetic oligonucleotide
caggccttccgaaaatgcgcggctt

SEQ ID NO: 690820 - DNA, 25 bp, Artificial sequence
  Synthetic oligonucleotide
gtcaacaggtaagacttccgctgct

SEQ ID NO: 690821 - DNA, 25 bp, Artificial sequence
  Synthetic oligonucleotide
gtaacagatcaaacaccggcgctaa

SEQ ID NO: 690822 - DNA, 25 bp, Artificial sequence
  Synthetic oligonucleotide
gtcaacaggtaacacttccgctgct

SEQ ID NO: 690823 - DNA, 25 bp, Artificial sequence
  Synthetic oligonucleotide
gaacgaagccgagatgctgttctct

SEQ ID NO: 690824 - DNA, 25 bp, Artificial sequence
  Synthetic oligonucleotide
gaacgaagccgacatgctgttctct

SEQ ID NO: 690825 - DNA, 25 bp, Artificial sequence
  Synthetic oligonucleotide
aaatgcctcctgaccatgtgaaggt

SEQ ID NO: 690826 - DNA, 25 bp, Artificial sequence
  Synthetic oligonucleotide
aaatgcctcctgtccatgtgaaggt

SEQ ID NO: 690827 - DNA, 25 bp, Artificial sequence
  Synthetic oligonucleotide
gataacctgatctaccaagtggcta

SEQ ID NO: 690828 - DNA, 25 bp, Artificial sequence
  Synthetic oligonucleotide
gataacctgatcaaccaagtggcta

SEQ ID NO: 690829 - DNA, 25 bp, Artificial sequence
  Synthetic oligonucleotide
tcagtcggaatgccgctcagcagat

SEQ ID NO: 690830 - DNA, 25 bp, Artificial sequence
  Synthetic oligonucleotide
tcagtcggaatggcgctcagcagat

SEQ ID NO: 690831 - DNA, 25 bp, Artificial sequence
  Synthetic oligonucleotide
gccccggctttgtttcagtcggaat

SEQ ID NO: 690832 - DNA, 25 bp, Artificial sequence
  Synthetic oligonucleotide
gccccggctttgattcagtcggaat

SEQ ID NO: 690833 - DNA, 25 bp, Artificial sequence
  Synthetic oligonucleotide
aaatcaagcctgtcacattgccgac

SEQ ID NO: 690834 - DNA, 25 bp, Artificial sequence
  Synthetic oligonucleotide
tctgtcactgttcccggaagcacag

SEQ ID NO: 690835 - DNA, 25 bp, Artificial sequence
  Synthetic oligonucleotide
tgaaatccttcacgcatatcagctg

SEQ ID NO: 690836 - DNA, 25 bp, Artificial sequence
  Synthetic oligonucleotide
aaatcaagcctgacacattgccgac

SEQ ID NO: 690837 - DNA, 25 bp, Artificial sequence
  Synthetic oligonucleotide
agatccgaacactgcggtcgacatt

SEQ ID NO: 690838 - DNA, 25 bp, Artificial sequence
  Synthetic oligonucleotide
agatccgaacacagcggtcgacatt

SEQ ID NO: 690839 - DNA, 25 bp, Artificial sequence
  Synthetic oligonucleotide
gttcttgcgcgtgtatcgcaggagt

SEQ ID NO: 690840 - DNA, 25 bp, Artificial sequence
  Synthetic oligonucleotide
gttcttgcgcgtctatcgcaggagt

SEQ ID NO: 690841 - DNA, 25 bp, Artificial sequence
  Synthetic oligonucleotide
tatcagctgatcccccgtgtagaag

SEQ ID NO: 690842 - DNA, 25 bp, Artificial sequence
  Synthetic oligonucleotide
tatcagctgatcgcccgtgtagaag

SEQ ID NO: 690843 - DNA, 25 bp, Artificial sequence
  Synthetic oligonucleotide
tgaaatccttcaggcatatcagctg

SEQ ID NO: 690844 - DNA, 25 bp, Artificial sequence
  Synthetic oligonucleotide
tctgtcactgttgccggaagcacag

SEQ ID NO: 690845 - DNA, 25 bp, Artificial sequence
  Synthetic oligonucleotide
gcaaactcgattttctacggttgca

SEQ ID NO: 690846 - DNA, 25 bp, Artificial sequence
  Synthetic oligonucleotide
tgccaacctcttacgtgcgcctttc

SEQ ID NO: 690847 - DNA, 25 bp, Artificial sequence
  Synthetic oligonucleotide
caacctcttacgagcgcctttctgc

SEQ ID NO: 690848 - DNA, 25 bp, Artificial sequence
  Synthetic oligonucleotide
caacctcttacgtgcgcctttctgc

SEQ ID NO: 690849 - DNA, 25 bp, Artificial sequence
  Synthetic oligonucleotide
gaacagactcagccgatgtgcttta

SEQ ID NO: 690850 - DNA, 25 bp, Artificial sequence
  Synthetic oligonucleotide
gaacagactcaggcgatgtgcttta

SEQ ID NO: 690851 - DNA, 25 bp, Artificial sequence
  Synthetic oligonucleotide
agactcaggcgatgtgctttatggc

SEQ ID NO: 690852 - DNA, 25 bp, Artificial sequence
  Synthetic oligonucleotide
agactcaggcgaagtgctttatggc

SEQ ID NO: 690853 - DNA, 25 bp, Artificial sequence
  Synthetic oligonucleotide
tatggcaggcgcaaactcgattttc

SEQ ID NO: 690854 - DNA, 25 bp, Artificial sequence
  Synthetic oligonucleotide
tgccaacctctttcgtgcgcctttc

SEQ ID NO: 690855 - DNA, 25 bp, Artificial sequence
  Synthetic oligonucleotide
gcaaactcgattatctacggttgca

SEQ ID NO: 690856 - DNA, 25 bp, Artificial sequence
  Synthetic oligonucleotide
acaacagcaacgacttgaacaggcg

SEQ ID NO: 690857 - DNA, 25 bp, Artificial sequence
  Synthetic oligonucleotide
tttctacggttggaaactgctgacc

SEQ ID NO: 690858 - DNA, 25 bp, Artificial sequence
  Synthetic oligonucleotide
tttctacggttgcaaactgctgacc

SEQ ID NO: 690859 - DNA, 25 bp, Artificial sequence
  Synthetic oligonucleotide
gcaaactggggcaaaatccgcagca

SEQ ID NO: 690860 - DNA, 25 bp, Artificial sequence
  Synthetic oligonucleotide
gcaaactggggctaaatccgcagca

SEQ ID NO: 690861 - DNA, 25 bp, Artificial sequence
  Synthetic oligonucleotide
actggggctaaaaccgcagcaaact

SEQ ID NO: 690862 - DNA, 25 bp, Artificial sequence
  Synthetic oligonucleotide
actggggctaaatccgcagcaaact

SEQ ID NO: 690863 - DNA, 25 bp, Artificial sequence
  Synthetic oligonucleotide
gggataacgaacaacagcaacgtct

SEQ ID NO: 690864 - DNA, 25 bp, Artificial sequence
  Synthetic oligonucleotide
gggataacgaactacagcaacgtct

SEQ ID NO: 690865 - DNA, 25 bp, Artificial sequence
  Synthetic oligonucleotide
acaacagcaacgtcttgaacaggcg

SEQ ID NO: 690866 - DNA, 25 bp, Artificial sequence
  Synthetic oligonucleotide
tatggcaggcgctaactcgattttc

SEQ ID NO: 690867 - DNA, 25 bp, Artificial sequence
  Synthetic oligonucleotide
gctggatctgctctttgaagcgcag

SEQ ID NO: 690868 - DNA, 25 bp, Artificial sequence
  Synthetic oligonucleotide
aagccgagcggttgatggaagttga

SEQ ID NO: 690869 - DNA, 25 bp, Artificial sequence
  Synthetic oligonucleotide
ctggatctgctgattgaagcgcagc

SEQ ID NO: 690870 - DNA, 25 bp, Artificial sequence
  Synthetic oligonucleotide
cggcaggatcgacgcgcttctgtat

SEQ ID NO: 690871 - DNA, 25 bp, Artificial sequence
  Synthetic oligonucleotide
cggcaggatcgaggcgcttctgtat

SEQ ID NO: 690872 - DNA, 25 bp, Artificial sequence
  Synthetic oligonucleotide
gagcggttgatgcaagttgaacagg

SEQ ID NO: 690873 - DNA, 25 bp, Artificial sequence
  Synthetic oligonucleotide
aagccgagcggtagatggaagttga

SEQ ID NO: 690874 - DNA, 25 bp, Artificial sequence
  Synthetic oligonucleotide
cgcgctacaaaagcgggctggaagc

SEQ ID NO: 690875 - DNA, 25 bp, Artificial sequence
  Synthetic oligonucleotide
cgcgctacaaaaccgggctggaagc

SEQ ID NO: 690876 - DNA, 25 bp, Artificial sequence
  Synthetic oligonucleotide
tcgcgctacaaatccgggctggaag

SEQ ID NO: 690877 - DNA, 25 bp, Artificial sequence
  Synthetic oligonucleotide
tcgcgctacaaaaccgggctggaag

SEQ ID NO: 690878 - DNA, 25 bp, Artificial sequence
  Synthetic oligonucleotide
ctggatctgctgtttgaagcgcagc

SEQ ID NO: 690879 - DNA, 25 bp, Artificial sequence
  Synthetic oligonucleotide
tcgatcctcgtcaggtgcaggtcag

SEQ ID NO: 690880 - DNA, 25 bp, Artificial sequence
  Synthetic oligonucleotide
ttcgatcctcgtcaggtgcaggtca

SEQ ID NO: 690881 - DNA, 25 bp, Artificial sequence
  Synthetic oligonucleotide
ttcgatcctcgtgaggtgcaggtca

SEQ ID NO: 690882 - DNA, 25 bp, Artificial sequence
  Synthetic oligonucleotide
tttcgatcctcgtcaggtgcaggtc

SEQ ID NO: 690883 - DNA, 25 bp, Artificial sequence
  Synthetic oligonucleotide
gctggatctgctgtttgaagcgcag

SEQ ID NO: 690884 - DNA, 25 bp, Artificial sequence
  Synthetic oligonucleotide
tttcgatcctcgacaggtgcaggtc

SEQ ID NO: 690885 - DNA, 25 bp, Artificial sequence
  Synthetic oligonucleotide
catttcgatcctggtcaggtgcagg

SEQ ID NO: 690886 - DNA, 25 bp, Artificial sequence
  Synthetic oligonucleotide
catttcgatcctcgtcaggtgcagg

SEQ ID NO: 690887 - DNA, 25 bp, Artificial sequence
  Synthetic oligonucleotide
tcgatcctcgtctggtgcaggtcag

SEQ ID NO: 690888 - DNA, 25 bp, Artificial sequence
  Synthetic oligonucleotide
gagcggttgatggaagttgaacagg

SEQ ID NO: 690889 - DNA, 25 bp, Artificial sequence
  Synthetic oligonucleotide
ccgggatcaaagactgttctggcgg

SEQ ID NO: 690890 - DNA, 25 bp, Artificial sequence
  Synthetic oligonucleotide
tgccgggatcaaagtctgttctggc

SEQ ID NO: 690891 - DNA, 25 bp, Artificial sequence
  Synthetic oligonucleotide
tgccgggatcaatgtctgttctggc

SEQ ID NO: 690892 - DNA, 25 bp, Artificial sequence
  Synthetic oligonucleotide
cacgcacttatcaggaacgcctcga

SEQ ID NO: 690893 - DNA, 25 bp, Artificial sequence
  Synthetic oligonucleotide
cacgcacttatctggaacgcctcga

SEQ ID NO: 690894 - DNA, 25 bp, Artificial sequence
  Synthetic oligonucleotide
gctgggcacgttcagtgaatctcag

SEQ ID NO: 690895 - DNA, 25 bp, Artificial sequence
  Synthetic oligonucleotide
gctgggcacgttgagtgaatctcag

SEQ ID NO: 690896 - DNA, 25 bp, Artificial sequence
  Synthetic oligonucleotide
tgtatgacgctgcgcacgttgagtg

SEQ ID NO: 690897 - DNA, 25 bp, Artificial sequence
  Synthetic oligonucleotide
cgggatcaaagtgtgttctggcggc

SEQ ID NO: 690898 - DNA, 25 bp, Artificial sequence
  Synthetic oligonucleotide
cgggatcaaagtctgttctggcggc

SEQ ID NO: 690899 - DNA, 25 bp, Artificial sequence
  Synthetic oligonucleotide
tgtatgacgctgggcacgttgagtg

SEQ ID NO: 690900 - DNA, 25 bp, Artificial sequence
  Synthetic oligonucleotide
cggaaagcgtgcgaatcaacatgct

SEQ ID NO: 690901 - DNA, 25 bp, Artificial sequence
  Synthetic oligonucleotide
gcattgtgggctaaggcgaaacggt

SEQ ID NO: 690902 - DNA, 25 bp, Artificial sequence
  Synthetic oligonucleotide
gcattgtgggcttaggcgaaacggt

SEQ ID NO: 690903 - DNA, 25 bp, Artificial sequence
  Synthetic oligonucleotide
aaaagatcgcgcgggattattgctg

SEQ ID NO: 690904 - DNA, 25 bp, Artificial sequence
  Synthetic oligonucleotide
aaaagatcgcgccggattattgctg

SEQ ID NO: 690905 - DNA, 25 bp, Artificial sequence
  Synthetic oligonucleotide
agatcgcgccggattattgctgcaa

SEQ ID NO: 690906 - DNA, 25 bp, Artificial sequence
  Synthetic oligonucleotide
agatcgcgccggtttattgctgcaa

SEQ ID NO: 690907 - DNA, 25 bp, Artificial sequence
  Synthetic oligonucleotide
ccggattattgcagcaactggcaaa

SEQ ID NO: 690908 - DNA, 25 bp, Artificial sequence
  Synthetic oligonucleotide
ccggattattgctgcaactggcaaa

SEQ ID NO: 690909 - DNA, 25 bp, Artificial sequence
  Synthetic oligonucleotide
cggaaagcgtgccaatcaacatgct

SEQ ID NO: 690910 - DNA, 25 bp, Artificial sequence
  Synthetic oligonucleotide
ccgggatcaaagtctgttctggcgg

SEQ ID NO: 690911 - DNA, 25 bp, Artificial sequence
  Synthetic oligonucleotide
cacgctgtggttagatgatgcgctc

SEQ ID NO: 690912 - DNA, 25 bp, Artificial sequence
  Synthetic oligonucleotide
cacgctgtggtttgatgatgcgctc

SEQ ID NO: 690913 - DNA, 25 bp, Artificial sequence
  Synthetic oligonucleotide
agtgccatgcgtacgctgaaaggca

SEQ ID NO: 690914 - DNA, 25 bp, Artificial sequence
  Synthetic oligonucleotide
agtgccatgcgttcgctgaaaggca

SEQ ID NO: 690915 - DNA, 25 bp, Artificial sequence
  Synthetic oligonucleotide
cggtgccacgcatcttcatgaaggg

SEQ ID NO: 690916 - DNA, 25 bp, Artificial sequence
  Synthetic oligonucleotide
cggtgccacgcaacttcatgaaggg

SEQ ID NO: 690917 - DNA, 25 bp, Artificial sequence
  Synthetic oligonucleotide
tattaacgcgttcgcagttgcagcg

SEQ ID NO: 690918 - DNA, 25 bp, Artificial sequence
  Synthetic oligonucleotide
tcatattcagccgatcacgctgtgg

SEQ ID NO: 690919 - DNA, 25 bp, Artificial sequence
  Synthetic oligonucleotide
cagcgattgcaactggcctggccgc

SEQ ID NO: 690920 - DNA, 25 bp, Artificial sequence
  Synthetic oligonucleotide
accgccagatgatatcgaacagtcg

SEQ ID NO: 690921 - DNA, 25 bp, Artificial sequence
  Synthetic oligonucleotide
tattaacgcgttggcagttgcagcg

SEQ ID NO: 690922 - DNA, 25 bp, Artificial sequence
  Synthetic oligonucleotide
tcatattcagcccatcacgctgtgg

SEQ ID NO: 690923 - DNA, 25 bp, Artificial sequence
  Synthetic oligonucleotide
atcaacatcataatcagcccatcac

SEQ ID NO: 690924 - DNA, 25 bp, Artificial sequence
  Synthetic oligonucleotide
atcaacatcatattcagcccatcac

SEQ ID NO: 690925 - DNA, 25 bp, Artificial sequence
  Synthetic oligonucleotide
gaacggcgtgcaatatcaacatcat

SEQ ID NO: 690926 - DNA, 25 bp, Artificial sequence
  Synthetic oligonucleotide
cagcgattgcaagtggcctggccgc

SEQ ID NO: 690927 - DNA, 25 bp, Artificial sequence
  Synthetic oligonucleotide
accgccagatgaaatcgaacagtcg

SEQ ID NO: 690928 - DNA, 25 bp, Artificial sequence
  Synthetic oligonucleotide
gtggacgagcgtccgcatgctaatc

SEQ ID NO: 690929 - DNA, 25 bp, Artificial sequence
  Synthetic oligonucleotide
gtggacgagcgtgcgcatgctaatc

SEQ ID NO: 690930 - DNA, 25 bp, Artificial sequence
  Synthetic oligonucleotide
cgctggtgcaggcatcgttacccga

SEQ ID NO: 690931 - DNA, 25 bp, Artificial sequence
  Synthetic oligonucleotide
cgctggtgcagggatcgttacccga

SEQ ID NO: 690932 - DNA, 25 bp, Artificial sequence
  Synthetic oligonucleotide
gaacggcgtgcattatcaacatcat

SEQ ID NO: 690933 - DNA, 25 bp, Artificial sequence
  Synthetic oligonucleotide
ctgccgttagcgtctgcgacgttcg

SEQ ID NO: 690934 - DNA, 25 bp, Artificial sequence
  Synthetic oligonucleotide
gcatggagcaatctcgcagtgcagt

SEQ ID NO: 690935 - DNA, 25 bp, Artificial sequence
  Synthetic oligonucleotide
acgttcgatcttgcatggagcaatc

SEQ ID NO: 690936 - DNA, 25 bp, Artificial sequence
  Synthetic oligonucleotide
cacggcactccgcgagctgtatcgg

SEQ ID NO: 690937 - DNA, 25 bp, Artificial sequence
  Synthetic oligonucleotide
cacggcactccgggagctgtatcgg

SEQ ID NO: 690938 - DNA, 25 bp, Artificial sequence
  Synthetic oligonucleotide
atggagcaatctcgcagtgcagtgg

SEQ ID NO: 690939 - DNA, 25 bp, Artificial sequence
  Synthetic oligonucleotide
gcatggagcaatgtcgcagtgcagt

SEQ ID NO: 690940 - DNA, 25 bp, Artificial sequence
  Synthetic oligonucleotide
acgttcgatcttccatggagcaatc

SEQ ID NO: 690941 - DNA, 25 bp, Artificial sequence
  Synthetic oligonucleotide
ctgccgttagcgactgcgacgttcg

SEQ ID NO: 690942 - DNA, 25 bp, Artificial sequence
  Synthetic oligonucleotide
aggatgccgcagaccattatctggc

SEQ ID NO: 690943 - DNA, 25 bp, Artificial sequence
  Synthetic oligonucleotide
aggatgccgcagtccattatctggc

SEQ ID NO: 690944 - DNA, 25 bp, Artificial sequence
  Synthetic oligonucleotide
atgcagatctactgcgccagagtgc

SEQ ID NO: 690945 - DNA, 25 bp, Artificial sequence
  Synthetic oligonucleotide
ccagaaggatgccgcagaccattat

SEQ ID NO: 690946 - DNA, 25 bp, Artificial sequence
  Synthetic oligonucleotide
cgccgccaatgcttgttcaggcacg

SEQ ID NO: 690947 - DNA, 25 bp, Artificial sequence
  Synthetic oligonucleotide
cgccgccaatgcatgttcaggcacg

SEQ ID NO: 690948 - DNA, 25 bp, Artificial sequence
  Synthetic oligonucleotide
acgcgggttgtgcacctggctggat

SEQ ID NO: 690949 - DNA, 25 bp, Artificial sequence
  Synthetic oligonucleotide
acgcgggttgtggacctggctggat

SEQ ID NO: 690950 - DNA, 25 bp, Artificial sequence
  Synthetic oligonucleotide
atgcagatctacagcgccagagtgc

SEQ ID NO: 690951 - DNA, 25 bp, Artificial sequence
  Synthetic oligonucleotide
gtaaatacacccacgtactggacgc

SEQ ID NO: 690952 - DNA, 25 bp, Artificial sequence
  Synthetic oligonucleotide
gtaaatacaccctcgtactggacgc

SEQ ID NO: 690953 - DNA, 25 bp, Artificial sequence
  Synthetic oligonucleotide
ccagaaggatgcggcagaccattat

SEQ ID NO: 690954 - DNA, 25 bp, Artificial sequence
  Synthetic oligonucleotide
atggagcaatctggcagtgcagtgg

SEQ ID NO: 690955 - DNA, 25 bp, Artificial sequence
  Synthetic oligonucleotide
ttctgacactttcacttttgcagat

SEQ ID NO: 690956 - DNA, 25 bp, Artificial sequence
  Synthetic oligonucleotide
cacaggtaatactacacgccggact

SEQ ID NO: 690957 - DNA, 25 bp, Artificial sequence
  Synthetic oligonucleotide
acaacacgccggactgactctggcg

SEQ ID NO: 690958 - DNA, 25 bp, Artificial sequence
  Synthetic oligonucleotide
acaacacgccggtctgactctggcg

SEQ ID NO: 690959 - DNA, 25 bp, Artificial sequence
  Synthetic oligonucleotide
gtcacgctgaatttatgaccacgct

SEQ ID NO: 690960 - DNA, 25 bp, Artificial sequence
  Synthetic oligonucleotide
gtcacgctgaatatatgaccacgct

SEQ ID NO: 690961 - DNA, 25 bp, Artificial sequence
  Synthetic oligonucleotide
tcacgctgaataaatgaccacgctc

SEQ ID NO: 690962 - DNA, 25 bp, Artificial sequence
  Synthetic oligonucleotide
tcacgctgaatatatgaccacgctc

SEQ ID NO: 690963 - DNA, 25 bp, Artificial sequence
  Synthetic oligonucleotide
cacaggtaatacaacacgccggact

SEQ ID NO: 690964 - DNA, 25 bp, Artificial sequence
  Synthetic oligonucleotide
tgacactttcacttttgcagattgg

SEQ ID NO: 690965 - DNA, 25 bp, Artificial sequence
  Synthetic oligonucleotide
tgctgggagagaacccctggcttgc

SEQ ID NO: 690966 - DNA, 25 bp, Artificial sequence
  Synthetic oligonucleotide
ttctgacactttgacttttgcagat

SEQ ID NO: 690967 - DNA, 25 bp, Artificial sequence
  Synthetic oligonucleotide
aactcggctgtattaatcacgcgat

SEQ ID NO: 690968 - DNA, 25 bp, Artificial sequence
  Synthetic oligonucleotide
aactcggctgtaataatcacgcgat

SEQ ID NO: 690969 - DNA, 25 bp, Artificial sequence
  Synthetic oligonucleotide
gccggtgatactggtagttggtgtg

SEQ ID NO: 690970 - DNA, 25 bp, Artificial sequence
  Synthetic oligonucleotide
gccggtgatactcgtagttggtgtg

SEQ ID NO: 690971 - DNA, 25 bp, Artificial sequence
  Synthetic oligonucleotide
aacaactgccggagatactggtagt

SEQ ID NO: 690972 - DNA, 25 bp, Artificial sequence
  Synthetic oligonucleotide
aacaactgccggtgatactggtagt

SEQ ID NO: 690973 - DNA, 25 bp, Artificial sequence
  Synthetic oligonucleotide
acttttgcagattgggtaacacagg

SEQ ID NO: 690974 - DNA, 25 bp, Artificial sequence
  Synthetic oligonucleotide
tgctgggagagatcccctggcttgc

SEQ ID NO: 690975 - DNA, 25 bp, Artificial sequence
  Synthetic oligonucleotide
tgacactttcacatttgcagattgg

SEQ ID NO: 690976 - DNA, 25 bp, Artificial sequence
  Synthetic oligonucleotide
acttttgcagatagggtaacacagg

SEQ ID NO: 690977 - DNA, 25 bp, Artificial sequence
  Synthetic oligonucleotide
acgcaacagtaattccttacacctt

SEQ ID NO: 690978 - DNA, 25 bp, Artificial sequence
  Synthetic oligonucleotide
acgcaacagtaaatccttacacctt

SEQ ID NO: 690979 - DNA, 25 bp, Artificial sequence
  Synthetic oligonucleotide
gcagcaggctaccggacggcaggtt

SEQ ID NO: 690980 - DNA, 25 bp, Artificial sequence
  Synthetic oligonucleotide
gcagcaggctacgggacggcaggtt

SEQ ID NO: 690981 - DNA, 25 bp, Artificial sequence
  Synthetic oligonucleotide
cctctggcagcgtaaagaccccgga

SEQ ID NO: 690982 - DNA, 25 bp, Artificial sequence
  Synthetic oligonucleotide
cctctggcagcgaaaagaccccgga

SEQ ID NO: 690983 - DNA, 25 bp, Artificial sequence
  Synthetic oligonucleotide
ctggcagcgaaaagaccccggaagg

SEQ ID NO: 690984 - DNA, 25 bp, Artificial sequence
  Synthetic oligonucleotide
ctggcagcgaaatgaccccggaagg

SEQ ID NO: 690985 - DNA, 25 bp, Artificial sequence
  Synthetic oligonucleotide
agcctgcagctgcattacgcaacag

SEQ ID NO: 690986 - DNA, 25 bp, Artificial sequence
  Synthetic oligonucleotide
agcctgcagctggattacgcaacag

SEQ ID NO: 690987 - DNA, 25 bp, Artificial sequence
  Synthetic oligonucleotide
cgcaacagtaaaaccttacaccttc

SEQ ID NO: 690988 - DNA, 25 bp, Artificial sequence
  Synthetic oligonucleotide
cctgcagctggattacgcaacagta

SEQ ID NO: 690989 - DNA, 25 bp, Artificial sequence
  Synthetic oligonucleotide
gaatcattggtattgagcgccggat

SEQ ID NO: 690990 - DNA, 25 bp, Artificial sequence
  Synthetic oligonucleotide
cgcaacagtaaatccttacaccttc

SEQ ID NO: 690991 - DNA, 25 bp, Artificial sequence
  Synthetic oligonucleotide
gtaaatccttacaccttcgcagaac

SEQ ID NO: 690992 - DNA, 25 bp, Artificial sequence
  Synthetic oligonucleotide
gtaaatccttactccttcgcagaac

SEQ ID NO: 690993 - DNA, 25 bp, Artificial sequence
  Synthetic oligonucleotide
cttacaccttcggagaacccacttc

SEQ ID NO: 690994 - DNA, 25 bp, Artificial sequence
  Synthetic oligonucleotide
cttacaccttcgcagaacccacttc

SEQ ID NO: 690995 - DNA, 25 bp, Artificial sequence
  Synthetic oligonucleotide
gggcagaccgattgaatcattggta

SEQ ID NO: 690996 - DNA, 25 bp, Artificial sequence
  Synthetic oligonucleotide
gggcagaccgatagaatcattggta

SEQ ID NO: 690997 - DNA, 25 bp, Artificial sequence
  Synthetic oligonucleotide
gaatcattggtaatgagcgccggat

SEQ ID NO: 690998 - DNA, 25 bp, Artificial sequence
  Synthetic oligonucleotide
cctgcagctggaatacgcaacagta

SEQ ID NO: 690999 - DNA, 25 bp, Artificial sequence
  Synthetic oligonucleotide
tagctgatgatccgaataactacct

SEQ ID NO: 691000 - DNA, 25 bp, Artificial sequence
  Synthetic oligonucleotide
ccagctatcaactcgcgccctggaa

SEQ ID NO: 691001 - DNA, 25 bp, Artificial sequence
  Synthetic oligonucleotide
aaaaaatggtgttgccgcgccatct

SEQ ID NO: 691002 - DNA, 25 bp, Artificial sequence
  Synthetic oligonucleotide
aaaaaatggtgtagccgcgccatct

SEQ ID NO: 691003 - DNA, 25 bp, Artificial sequence
  Synthetic oligonucleotide
ctgttttgccgggtcagaaaaaatg

SEQ ID NO: 691004 - DNA, 25 bp, Artificial sequence
  Synthetic oligonucleotide
ctgttttgccggctcagaaaaaatg

SEQ ID NO: 691005 - DNA, 25 bp, Artificial sequence
  Synthetic oligonucleotide
ataactacctgttttgccgggtcag

SEQ ID NO: 691006 - DNA, 25 bp, Artificial sequence
  Synthetic oligonucleotide
ataactacctgtattgccgggtcag

SEQ ID NO: 691007 - DNA, 25 bp, Artificial sequence
  Synthetic oligonucleotide
atgatccgaataactacctgttttg

SEQ ID NO: 691008 - DNA, 25 bp, Artificial sequence
  Synthetic oligonucleotide
ccagctatcaacacgcgccctggaa

SEQ ID NO: 691009 - DNA, 25 bp, Artificial sequence
  Synthetic oligonucleotide
tagctgatgatcggaataactacct

SEQ ID NO: 691010 - DNA, 25 bp, Artificial sequence
  Synthetic oligonucleotide
aagatatctcacctactgacggtgg

SEQ ID NO: 691011 - DNA, 25 bp, Artificial sequence
  Synthetic oligonucleotide
ggtcgagcgatgcatttccgtctct

SEQ ID NO: 691012 - DNA, 25 bp, Artificial sequence
  Synthetic oligonucleotide
ggtcgagcgatggatttccgtctct

SEQ ID NO: 691013 - DNA, 25 bp, Artificial sequence
  Synthetic oligonucleotide
cgctggttagcaccgcaggtgtaga

SEQ ID NO: 691014 - DNA, 25 bp, Artificial sequence
  Synthetic oligonucleotide
cgctggttagcagcgcaggtgtaga

SEQ ID NO: 691015 - DNA, 25 bp, Artificial sequence
  Synthetic oligonucleotide
aacgaaaacgctcgttagcaccgca

SEQ ID NO: 691016 - DNA, 25 bp, Artificial sequence
  Synthetic oligonucleotide
aacgaaaacgctggttagcaccgca

SEQ ID NO: 691017 - DNA, 25 bp, Artificial sequence
  Synthetic oligonucleotide
gttaatccatattggcagaacgaaa

SEQ ID NO: 691018 - DNA, 25 bp, Artificial sequence
  Synthetic oligonucleotide
gttaatccatataggcagaacgaaa

SEQ ID NO: 691019 - DNA, 25 bp, Artificial sequence
  Synthetic oligonucleotide
aagatatctcacgtactgacggtgg

SEQ ID NO: 691020 - DNA, 25 bp, Artificial sequence
  Synthetic oligonucleotide
atgatccgaatatctacctgttttg

SEQ ID NO: 691021 - DNA, 25 bp, Artificial sequence
  Synthetic oligonucleotide
gctgtttcactgcttatgcggcgga

SEQ ID NO: 691022 - DNA, 25 bp, Artificial sequence
  Synthetic oligonucleotide
gcaaaacaggctgtagcgttcgaac

SEQ ID NO: 691023 - DNA, 25 bp, Artificial sequence
  Synthetic oligonucleotide
ttgggccagctatacatgcttcatc

SEQ ID NO: 691024 - DNA, 25 bp, Artificial sequence
  Synthetic oligonucleotide
gggattgcttataacaccctgttac

SEQ ID NO: 691025 - DNA, 25 bp, Artificial sequence
  Synthetic oligonucleotide
gggattgcttattacaccctgttac

SEQ ID NO: 691026 - DNA, 25 bp, Artificial sequence
  Synthetic oligonucleotide
atcgctgccaggatatacgtaatct

SEQ ID NO: 691027 - DNA, 25 bp, Artificial sequence
  Synthetic oligonucleotide
atcgctgccaggttatacgtaatct

SEQ ID NO: 691028 - DNA, 25 bp, Artificial sequence
  Synthetic oligonucleotide
gatcgccaggcgatttctgagcata

SEQ ID NO: 691029 - DNA, 25 bp, Artificial sequence
  Synthetic oligonucleotide
gcactgatttcgaccaggttcgttc

SEQ ID NO: 691030 - DNA, 25 bp, Artificial sequence
  Synthetic oligonucleotide
gcaaaacaggctctagcgttcgaac

SEQ ID NO: 691031 - DNA, 25 bp, Artificial sequence
  Synthetic oligonucleotide
gccggtgaacgtccaaaacaggctc

SEQ ID NO: 691032 - DNA, 25 bp, Artificial sequence
  Synthetic oligonucleotide
gccggtgaacgtgcaaaacaggctc

SEQ ID NO: 691033 - DNA, 25 bp, Artificial sequence
  Synthetic oligonucleotide
tctgtccgtttgccggtcgtgggcg

SEQ ID NO: 691034 - DNA, 25 bp, Artificial sequence
  Synthetic oligonucleotide
gctgtttcactggttatgcggcgga

SEQ ID NO: 691035 - DNA, 25 bp, Artificial sequence
  Synthetic oligonucleotide
ttgggccagctaaacatgcttcatc

SEQ ID NO: 691036 - DNA, 25 bp, Artificial sequence
  Synthetic oligonucleotide
gatgttcgcgataatcttctatatc

SEQ ID NO: 691037 - DNA, 25 bp, Artificial sequence
  Synthetic oligonucleotide
gatgttcgcgattatcttctatatc

SEQ ID NO: 691038 - DNA, 25 bp, Artificial sequence
  Synthetic oligonucleotide
cggaaatggtttgccgcagaacctg

SEQ ID NO: 691039 - DNA, 25 bp, Artificial sequence
  Synthetic oligonucleotide
cggaaatggtttcccgcagaacctg

SEQ ID NO: 691040 - DNA, 25 bp, Artificial sequence
  Synthetic oligonucleotide
tctgtccgtttggcggtcgtgggcg

SEQ ID NO: 691041 - DNA, 25 bp, Artificial sequence
  Synthetic oligonucleotide
gatcgccaggcgttttctgagcata

SEQ ID NO: 691042 - DNA, 25 bp, Artificial sequence
  Synthetic oligonucleotide
gcactgatttcgtccaggttcgttc

SEQ ID NO: 691043 - DNA, 25 bp, Artificial sequence
  Synthetic oligonucleotide
ggttaagccgctattagcgtgtgtg

SEQ ID NO: 691044 - DNA, 25 bp, Artificial sequence
  Synthetic oligonucleotide
ggttaagccgcttttagcgtgtgtg

SEQ ID NO: 691045 - DNA, 25 bp, Artificial sequence
  Synthetic oligonucleotide
atgacttatccatagtcctaagtcc

SEQ ID NO: 691046 - DNA, 25 bp, Artificial sequence
  Synthetic oligonucleotide
atgacttatccaaagtcctaagtcc

SEQ ID NO: 691047 - DNA, 25 bp, Artificial sequence
  Synthetic oligonucleotide
tgtcgtatgggagtttcaagtacct

SEQ ID NO: 691048 - DNA, 25 bp, Artificial sequence
  Synthetic oligonucleotide
tgtcgtatgggactttcaagtacct

SEQ ID NO: 691049 - DNA, 25 bp, Artificial sequence
  Synthetic oligonucleotide
aacttgtcgtatgggactttcaagt

SEQ ID NO: 691050 - DNA, 25 bp, Artificial sequence
  Synthetic oligonucleotide
ccaatgaccataaacggcgtattaa

SEQ ID NO: 691051 - DNA, 25 bp, Artificial sequence
  Synthetic oligonucleotide
gttcacggctataaaacagcgtcat

SEQ ID NO: 691052 - DNA, 25 bp, Artificial sequence
  Synthetic oligonucleotide
aacttgtcgtatcggactttcaagt

SEQ ID NO: 691053 - DNA, 25 bp, Artificial sequence
  Synthetic oligonucleotide
tctacgatggcatgtcgtgcctcgt

SEQ ID NO: 691054 - DNA, 25 bp, Artificial sequence
  Synthetic oligonucleotide
tctacgatggcaagtcgtgcctcgt

SEQ ID NO: 691055 - DNA, 25 bp, Artificial sequence
  Synthetic oligonucleotide
ttctcgtgtagattatcagctaata

SEQ ID NO: 691056 - DNA, 25 bp, Artificial sequence
  Synthetic oligonucleotide
ttctcgtgtagaatatcagctaata

SEQ ID NO: 691057 - DNA, 25 bp, Artificial sequence
  Synthetic oligonucleotide
gtagaatatcaggtaatagggtcgg

SEQ ID NO: 691058 - DNA, 25 bp, Artificial sequence
  Synthetic oligonucleotide
gtagaatatcagctaatagggtcgg

SEQ ID NO: 691059 - DNA, 25 bp, Artificial sequence
  Synthetic oligonucleotide
tgacgttcgtcaagagtcgcataat

SEQ ID NO: 691060 - DNA, 25 bp, Artificial sequence
  Synthetic oligonucleotide
tgacgttcgtcatgagtcgcataat

SEQ ID NO: 691061 - DNA, 25 bp, Artificial sequence
  Synthetic oligonucleotide
ccaatgaccatatacggcgtattaa

SEQ ID NO: 691062 - DNA, 25 bp, Artificial sequence
  Synthetic oligonucleotide
tcaagagtcgcaaaatctcagaatc

SEQ ID NO: 691063 - DNA, 25 bp, Artificial sequence
  Synthetic oligonucleotide
gttcacggctattaaacagcgtcat

SEQ ID NO: 691064 - DNA, 25 bp, Artificial sequence
  Synthetic oligonucleotide
tcaagagtcgcataatctcagaatc

SEQ ID NO: 691065 - DNA, 25 bp, Artificial sequence
  Synthetic oligonucleotide
tctacgatggcatgtcgtgcctcgt

SEQ ID NO: 691066 - DNA, 25 bp, Artificial sequence
  Synthetic oligonucleotide
tctacgatggcaagtcgtgcctcgt

SEQ ID NO: 691067 - DNA, 25 bp, Artificial sequence
  Synthetic oligonucleotide
ccaatgaccataaacggcgtattaa

SEQ ID NO: 691068 - DNA, 25 bp, Artificial sequence
  Synthetic oligonucleotide
ccaatgaccatatacggcgtattaa

SEQ ID NO: 691069 - DNA, 25 bp, Artificial sequence
  Synthetic oligonucleotide
aacttgtcgtatcggactttcaagt

SEQ ID NO: 691070 - DNA, 25 bp, Artificial sequence
  Synthetic oligonucleotide
aacttgtcgtatgggactttcaagt

SEQ ID NO: 691071 - DNA, 25 bp, Artificial sequence
  Synthetic oligonucleotide
tgtcgtatgggactttcaagtacct

SEQ ID NO: 691072 - DNA, 25 bp, Artificial sequence
  Synthetic oligonucleotide
tgtcgtatgggagtttcaagtacct

SEQ ID NO: 691073 - DNA, 25 bp, Artificial sequence
  Synthetic oligonucleotide
atgacttatccaaagtcctaagtcc

SEQ ID NO: 691074 - DNA, 25 bp, Artificial sequence
  Synthetic oligonucleotide
atgacttatccatagtcctaagtcc

SEQ ID NO: 691075 - DNA, 25 bp, Artificial sequence
  Synthetic oligonucleotide
ttctcgtgtagaatatcagctaata

SEQ ID NO: 691076 - DNA, 25 bp, Artificial sequence
  Synthetic oligonucleotide
ggttaagccgcttttagcgtgtgtg

SEQ ID NO: 691077 - DNA, 25 bp, Artificial sequence
  Synthetic oligonucleotide
gttcacggctattaaacagcgtcat

SEQ ID NO: 691078 - DNA, 25 bp, Artificial sequence
  Synthetic oligonucleotide
ttctcgtgtagattatcagctaata

SEQ ID NO: 691079 - DNA, 25 bp, Artificial sequence
  Synthetic oligonucleotide
gtagaatatcaggtaatagggtcgg

SEQ ID NO: 691080 - DNA, 25 bp, Artificial sequence
  Synthetic oligonucleotide
gtagaatatcagctaatagggtcgg

SEQ ID NO: 691081 - DNA, 25 bp, Artificial sequence
  Synthetic oligonucleotide
tgacgttcgtcaagagtcgcataat

SEQ ID NO: 691082 - DNA, 25 bp, Artificial sequence
  Synthetic oligonucleotide
tgacgttcgtcatgagtcgcataat

SEQ ID NO: 691083 - DNA, 25 bp, Artificial sequence
  Synthetic oligonucleotide
tcaagagtcgcataatctcagaatc

SEQ ID NO: 691084 - DNA, 25 bp, Artificial sequence
  Synthetic oligonucleotide
tcaagagtcgcaaaatctcagaatc

SEQ ID NO: 691085 - DNA, 25 bp, Artificial sequence
  Synthetic oligonucleotide
gttcacggctataaaacagcgtcat

SEQ ID NO: 691086 - DNA, 25 bp, Artificial sequence
  Synthetic oligonucleotide
ggttaagccgctattagcgtgtgtg

SEQ ID NO: 691087 - DNA, 25 bp, Artificial sequence
  Synthetic oligonucleotide
actccgagaactagcatctaagcac

SEQ ID NO: 691088 - DNA, 25 bp, Artificial sequence
  Synthetic oligonucleotide
gaactagcatcttagcactcggctc

SEQ ID NO: 691089 - DNA, 25 bp, Artificial sequence
  Synthetic oligonucleotide
tattgaccaaactgcggtgcgatta

SEQ ID NO: 691090 - DNA, 25 bp, Artificial sequence
  Synthetic oligonucleotide
cggtgcgattaactcgactgccgcg

SEQ ID NO: 691091 - DNA, 25 bp, Artificial sequence
  Synthetic oligonucleotide
cggtgcgattaagtcgactgccgcg

SEQ ID NO: 691092 - DNA, 25 bp, Artificial sequence
  Synthetic oligonucleotide
acatatcctaattcaggcgcgacga

SEQ ID NO: 691093 - DNA, 25 bp, Artificial sequence
  Synthetic oligonucleotide
acatatcctaatacaggcgcgacga

SEQ ID NO: 691094 - DNA, 25 bp, Artificial sequence
  Synthetic oligonucleotide
cgacgaaccttatactcgatggaag

SEQ ID NO: 691095 - DNA, 25 bp, Artificial sequence
  Synthetic oligonucleotide
cgacgaaccttaaactcgatggaag

SEQ ID NO: 691096 - DNA, 25 bp, Artificial sequence
  Synthetic oligonucleotide
tattgaccaaacagcggtgcgatta

SEQ ID NO: 691097 - DNA, 25 bp, Artificial sequence
  Synthetic oligonucleotide
actccgagaacttgcatctaagcac

SEQ ID NO: 691098 - DNA, 25 bp, Artificial sequence
  Synthetic oligonucleotide
gaactagcatctaagcactcggctc

SEQ ID NO: 691099 - DNA, 25 bp, Artificial sequence
  Synthetic oligonucleotide
tcggctctaatgttaagtgctcgac

SEQ ID NO: 691100 - DNA, 25 bp, Artificial sequence
  Synthetic oligonucleotide
aatgttaagtgcacgaccacagatc

SEQ ID NO: 691101 - DNA, 25 bp, Artificial sequence
  Synthetic oligonucleotide
aatgttaagtgctcgaccacagatc

SEQ ID NO: 691102 - DNA, 25 bp, Artificial sequence
  Synthetic oligonucleotide
gtgccaagtacgatggctcacgtct

SEQ ID NO: 691103 - DNA, 25 bp, Artificial sequence
  Synthetic oligonucleotide
gtgccaagtacgttggctcacgtct

SEQ ID NO: 691104 - DNA, 25 bp, Artificial sequence
  Synthetic oligonucleotide
ttatttgggccggcagagttatgtt

SEQ ID NO: 691105 - DNA, 25 bp, Artificial sequence
  Synthetic oligonucleotide
ttatttgggccgccagagttatgtt

SEQ ID NO: 691106 - DNA, 25 bp, Artificial sequence
  Synthetic oligonucleotide
ctcgatggaagagagttatacccat

SEQ ID NO: 691107 - DNA, 25 bp, Artificial sequence
  Synthetic oligonucleotide
ctcgatggaagacagttatacccat

SEQ ID NO: 691108 - DNA, 25 bp, Artificial sequence
  Synthetic oligonucleotide
tcggctctaatgataagtgctcgac

SEQ ID NO: 691109 - DNA, 25 bp, Artificial sequence
  Synthetic oligonucleotide
tattgaccaaactgcggtgcgatta

SEQ ID NO: 691110 - DNA, 25 bp, Artificial sequence
  Synthetic oligonucleotide
tattgaccaaacagcggtgcgatta

SEQ ID NO: 691111 - DNA, 25 bp, Artificial sequence
  Synthetic oligonucleotide
ttatttgggccgccagagttatgtt

SEQ ID NO: 691112 - DNA, 25 bp, Artificial sequence
  Synthetic oligonucleotide
cggtgcgattaagtcgactgccgcg

SEQ ID NO: 691113 - DNA, 25 bp, Artificial sequence
  Synthetic oligonucleotide
cggtgcgattaactcgactgccgcg

SEQ ID NO: 691114 - DNA, 25 bp, Artificial sequence
  Synthetic oligonucleotide
acatatcctaatacaggcgcgacga

SEQ ID NO: 691115 - DNA, 25 bp, Artificial sequence
  Synthetic oligonucleotide
acatatcctaattcaggcgcgacga

SEQ ID NO: 691116 - DNA, 25 bp, Artificial sequence
  Synthetic oligonucleotide
cgacgaaccttatactcgatggaag

SEQ ID NO: 691117 - DNA, 25 bp, Artificial sequence
  Synthetic oligonucleotide
cgacgaaccttaaactcgatggaag

SEQ ID NO: 691118 - DNA, 25 bp, Artificial sequence
  Synthetic oligonucleotide
ctcgatggaagacagttatacccat

SEQ ID NO: 691119 - DNA, 25 bp, Artificial sequence
  Synthetic oligonucleotide
ctcgatggaagagagttatacccat

SEQ ID NO: 691120 - DNA, 25 bp, Artificial sequence
  Synthetic oligonucleotide
gtgccaagtacgttggctcacgtct

SEQ ID NO: 691121 - DNA, 25 bp, Artificial sequence
  Synthetic oligonucleotide
gtgccaagtacgatggctcacgtct

SEQ ID NO: 691122 - DNA, 25 bp, Artificial sequence
  Synthetic oligonucleotide
aatgttaagtgcacgaccacagatc

SEQ ID NO: 691123 - DNA, 25 bp, Artificial sequence
  Synthetic oligonucleotide
aatgttaagtgctcgaccacagatc

SEQ ID NO: 691124 - DNA, 25 bp, Artificial sequence
  Synthetic oligonucleotide
tcggctctaatgttaagtgctcgac

SEQ ID NO: 691125 - DNA, 25 bp, Artificial sequence
  Synthetic oligonucleotide
tcggctctaatgataagtgctcgac

SEQ ID NO: 691126 - DNA, 25 bp, Artificial sequence
  Synthetic oligonucleotide
gaactagcatctaagcactcggctc

SEQ ID NO: 691127 - DNA, 25 bp, Artificial sequence
  Synthetic oligonucleotide
actccgagaactagcatctaagcac

SEQ ID NO: 691128 - DNA, 25 bp, Artificial sequence
  Synthetic oligonucleotide
actccgagaacttgcatctaagcac

SEQ ID NO: 691129 - DNA, 25 bp, Artificial sequence
  Synthetic oligonucleotide
gaactagcatcttagcactcggctc

SEQ ID NO: 691130 - DNA, 25 bp, Artificial sequence
  Synthetic oligonucleotide
ttatttgggccggcagagttatgtt

SEQ ID NO: 691131 - DNA, 25 bp, Artificial sequence
  Synthetic oligonucleotide
ttcgacgaggcgttacatattctga

SEQ ID NO: 691132 - DNA, 25 bp, Artificial sequence
  Synthetic oligonucleotide
tataccctcgggatacgaattatgg

SEQ ID NO: 691133 - DNA, 25 bp, Artificial sequence
  Synthetic oligonucleotide
tataccctcgggttacgaattatgg

SEQ ID NO: 691134 - DNA, 25 bp, Artificial sequence
  Synthetic oligonucleotide
gtcgatacgtccgattaagcgacgt

SEQ ID NO: 691135 - DNA, 25 bp, Artificial sequence
  Synthetic oligonucleotide
gtcgatacgtcccattaagcgacgt

SEQ ID NO: 691136 - DNA, 25 bp, Artificial sequence
  Synthetic oligonucleotide
tatatcgtggacgcaaagtcgatac

SEQ ID NO: 691137 - DNA, 25 bp, Artificial sequence
  Synthetic oligonucleotide
ttcgacgaggcgatacatattctga

SEQ ID NO: 691138 - DNA, 25 bp, Artificial sequence
  Synthetic oligonucleotide
atggctgtgcctaacgaatctggga

SEQ ID NO: 691139 - DNA, 25 bp, Artificial sequence
  Synthetic oligonucleotide
ggttacgatgacagctaagccatta

SEQ ID NO: 691140 - DNA, 25 bp, Artificial sequence
  Synthetic oligonucleotide
gtgataatttcgacgaggcgttaca

SEQ ID NO: 691141 - DNA, 25 bp, Artificial sequence
  Synthetic oligonucleotide
tatatcgtggacccaaagtcgatac

SEQ ID NO: 691142 - DNA, 25 bp, Artificial sequence
  Synthetic oligonucleotide
atggctgtgccttacgaatctggga

SEQ ID NO: 691143 - DNA, 25 bp, Artificial sequence
  Synthetic oligonucleotide
ccgtcctattggttactattccgtg

SEQ ID NO: 691144 - DNA, 25 bp, Artificial sequence
  Synthetic oligonucleotide
ccgtcctattggatactattccgtg

SEQ ID NO: 691145 - DNA, 25 bp, Artificial sequence
  Synthetic oligonucleotide
ccgtcactatgttacgcttgacgta

SEQ ID NO: 691146 - DNA, 25 bp, Artificial sequence
  Synthetic oligonucleotide
taggcttacgcgcatgagctctagg

SEQ ID NO: 691147 - DNA, 25 bp, Artificial sequence
  Synthetic oligonucleotide
ggttacgatgactgctaagccatta

SEQ ID NO: 691148 - DNA, 25 bp, Artificial sequence
  Synthetic oligonucleotide
ttacgcgacattgtgcaaagttacg

SEQ ID NO: 691149 - DNA, 25 bp, Artificial sequence
  Synthetic oligonucleotide
ttacgcgacattctgcaaagttacg

SEQ ID NO: 691150 - DNA, 25 bp, Artificial sequence
  Synthetic oligonucleotide
taggcttacgcggatgagctctagg

SEQ ID NO: 691151 - DNA, 25 bp, Artificial sequence
  Synthetic oligonucleotide
gtgataatttcgtcgaggcgttaca

SEQ ID NO: 691152 - DNA, 25 bp, Artificial sequence
  Synthetic oligonucleotide
ccgtcactatgtaacgcttgacgta

SEQ ID NO: 691153 - DNA, 25 bp, Artificial sequence
  Synthetic oligonucleotide
atggctgtgccttacgaatctggga

SEQ ID NO: 691154 - DNA, 25 bp, Artificial sequence
  Synthetic oligonucleotide
gtgataatttcgtcgaggcgttaca

SEQ ID NO: 691155 - DNA, 25 bp, Artificial sequence
  Synthetic oligonucleotide
ccgtcctattggttactattccgtg

SEQ ID NO: 691156 - DNA, 25 bp, Artificial sequence
  Synthetic oligonucleotide
gtgataatttcgacgaggcgttaca

SEQ ID NO: 691157 - DNA, 25 bp, Artificial sequence
  Synthetic oligonucleotide
taggcttacgcgcatgagctctagg

SEQ ID NO: 691158 - DNA, 25 bp, Artificial sequence
  Synthetic oligonucleotide
ttcgacgaggcgatacatattctga

SEQ ID NO: 691159 - DNA, 25 bp, Artificial sequence
  Synthetic oligonucleotide
ttcgacgaggcgttacatattctga

SEQ ID NO: 691160 - DNA, 25 bp, Artificial sequence
  Synthetic oligonucleotide
tatatcgtggacccaaagtcgatac

SEQ ID NO: 691161 - DNA, 25 bp, Artificial sequence
  Synthetic oligonucleotide
tatatcgtggacgcaaagtcgatac

SEQ ID NO: 691162 - DNA, 25 bp, Artificial sequence
  Synthetic oligonucleotide
gtcgatacgtcccattaagcgacgt

SEQ ID NO: 691163 - DNA, 25 bp, Artificial sequence
  Synthetic oligonucleotide
gtcgatacgtccgattaagcgacgt

SEQ ID NO: 691164 - DNA, 25 bp, Artificial sequence
  Synthetic oligonucleotide
tataccctcgggatacgaattatgg

SEQ ID NO: 691165 - DNA, 25 bp, Artificial sequence
  Synthetic oligonucleotide
tataccctcgggttacgaattatgg

SEQ ID NO: 691166 - DNA, 25 bp, Artificial sequence
  Synthetic oligonucleotide
ttacgcgacattgtgcaaagttacg

SEQ ID NO: 691167 - DNA, 25 bp, Artificial sequence
  Synthetic oligonucleotide
atggctgtgcctaacgaatctggga

SEQ ID NO: 691168 - DNA, 25 bp, Artificial sequence
  Synthetic oligonucleotide
ttacgcgacattctgcaaagttacg

SEQ ID NO: 691169 - DNA, 25 bp, Artificial sequence
  Synthetic oligonucleotide
ggttacgatgactgctaagccatta

SEQ ID NO: 691170 - DNA, 25 bp, Artificial sequence
  Synthetic oligonucleotide
ggttacgatgacagctaagccatta

SEQ ID NO: 691171 - DNA, 25 bp, Artificial sequence
  Synthetic oligonucleotide
ccgtcactatgttacgcttgacgta

SEQ ID NO: 691172 - DNA, 25 bp, Artificial sequence
  Synthetic oligonucleotide
ccgtcactatgtaacgcttgacgta

SEQ ID NO: 691173 - DNA, 25 bp, Artificial sequence
  Synthetic oligonucleotide
ccgtcctattggatactattccgtg

SEQ ID NO: 691174 - DNA, 25 bp, Artificial sequence
  Synthetic oligonucleotide
taggcttacgcggatgagctctagg

SEQ ID NO: 691175 - DNA, 25 bp, Artificial sequence
  Synthetic oligonucleotide
cataggtaacctattcgtgactagc

SEQ ID NO: 691176 - DNA, 25 bp, Artificial sequence
  Synthetic oligonucleotide
tcttattagcgacgagcatttcgtg

SEQ ID NO: 691177 - DNA, 25 bp, Artificial sequence
  Synthetic oligonucleotide
aacgtatgccgcttattcggaacgt

SEQ ID NO: 691178 - DNA, 25 bp, Artificial sequence
  Synthetic oligonucleotide
cataggtaaccttttcgtgactagc

SEQ ID NO: 691179 - DNA, 25 bp, Artificial sequence
  Synthetic oligonucleotide
tatctaattcgtcagtcgggtacta

SEQ ID NO: 691180 - DNA, 25 bp, Artificial sequence
  Synthetic oligonucleotide
tatctaattcgtgagtcgggtacta

SEQ ID NO: 691181 - DNA, 25 bp, Artificial sequence
  Synthetic oligonucleotide
atgacgcggagtcaacctgataacc

SEQ ID NO: 691182 - DNA, 25 bp, Artificial sequence
  Synthetic oligonucleotide
gtatccgaagtcctagtgataatat

SEQ ID NO: 691183 - DNA, 25 bp, Artificial sequence
  Synthetic oligonucleotide
gtatccgaagtcgtagtgataatat

SEQ ID NO: 691184 - DNA, 25 bp, Artificial sequence
  Synthetic oligonucleotide
aacgtatgccgcatattcggaacgt

SEQ ID NO: 691185 - DNA, 25 bp, Artificial sequence
  Synthetic oligonucleotide
ccacctagatcgtaattatcggaac

SEQ ID NO: 691186 - DNA, 25 bp, Artificial sequence
  Synthetic oligonucleotide
gaactcgtcgctaatttacgaacct

SEQ ID NO: 691187 - DNA, 25 bp, Artificial sequence
  Synthetic oligonucleotide
agtctggtttctaattagcgaggag

SEQ ID NO: 691188 - DNA, 25 bp, Artificial sequence
  Synthetic oligonucleotide
aatatcgtaagacatccgcgagcga

SEQ ID NO: 691189 - DNA, 25 bp, Artificial sequence
  Synthetic oligonucleotide
tcttattagcgaggagcatttcgtg

SEQ ID NO: 691190 - DNA, 25 bp, Artificial sequence
  Synthetic oligonucleotide
atactgagccgaatatcgtaagaca

SEQ ID NO: 691191 - DNA, 25 bp, Artificial sequence
  Synthetic oligonucleotide
atactgagccgattatcgtaagaca

SEQ ID NO: 691192 - DNA, 25 bp, Artificial sequence
  Synthetic oligonucleotide
aatatcgtaagagatccgcgagcga

SEQ ID NO: 691193 - DNA, 25 bp, Artificial sequence
  Synthetic oligonucleotide
atgacgcggagtgaacctgataacc

SEQ ID NO: 691194 - DNA, 25 bp, Artificial sequence
  Synthetic oligonucleotide
ccacctagatcgaaattatcggaac

SEQ ID NO: 691195 - DNA, 25 bp, Artificial sequence
  Synthetic oligonucleotide
agtctggtttcttattagcgaggag

SEQ ID NO: 691196 - DNA, 25 bp, Artificial sequence
  Synthetic oligonucleotide
gaactcgtcgcttatttacgaacct

SEQ ID NO: 691197 - DNA, 25 bp, Artificial sequence
  Synthetic oligonucleotide
cataggtaacctattcgtgactagc

SEQ ID NO: 691198 - DNA, 25 bp, Artificial sequence
  Synthetic oligonucleotide
cataggtaaccttttcgtgactagc

SEQ ID NO: 691199 - DNA, 25 bp, Artificial sequence
  Synthetic oligonucleotide
tatctaattcgtgagtcgggtacta

SEQ ID NO: 691200 - DNA, 25 bp, Artificial sequence
  Synthetic oligonucleotide
tatctaattcgtcagtcgggtacta

SEQ ID NO: 691201 - DNA, 25 bp, Artificial sequence
  Synthetic oligonucleotide
gtatccgaagtcctagtgataatat

SEQ ID NO: 691202 - DNA, 25 bp, Artificial sequence
  Synthetic oligonucleotide
gtatccgaagtcgtagtgataatat

SEQ ID NO: 691203 - DNA, 25 bp, Artificial sequence
  Synthetic oligonucleotide
aacgtatgccgcatattcggaacgt

SEQ ID NO: 691204 - DNA, 25 bp, Artificial sequence
  Synthetic oligonucleotide
aacgtatgccgcttattcggaacgt

SEQ ID NO: 691205 - DNA, 25 bp, Artificial sequence
  Synthetic oligonucleotide
atgacgcggagtgaacctgataacc

SEQ ID NO: 691206 - DNA, 25 bp, Artificial sequence
  Synthetic oligonucleotide
ccacctagatcgtaattatcggaac

SEQ ID NO: 691207 - DNA, 25 bp, Artificial sequence
  Synthetic oligonucleotide
tcttattagcgaggagcatttcgtg

SEQ ID NO: 691208 - DNA, 25 bp, Artificial sequence
  Synthetic oligonucleotide
aatatcgtaagacatccgcgagcga

SEQ ID NO: 691209 - DNA, 25 bp, Artificial sequence
  Synthetic oligonucleotide
atgacgcggagtcaacctgataacc

SEQ ID NO: 691210 - DNA, 25 bp, Artificial sequence
  Synthetic oligonucleotide
atactgagccgattatcgtaagaca

SEQ ID NO: 691211 - DNA, 25 bp, Artificial sequence
  Synthetic oligonucleotide
aatatcgtaagagatccgcgagcga

SEQ ID NO: 691212 - DNA, 25 bp, Artificial sequence
  Synthetic oligonucleotide
tcttattagcgacgagcatttcgtg

SEQ ID NO: 691213 - DNA, 25 bp, Artificial sequence
  Synthetic oligonucleotide
agtctggtttcttattagcgaggag

SEQ ID NO: 691214 - DNA, 25 bp, Artificial sequence
  Synthetic oligonucleotide
agtctggtttctaattagcgaggag

SEQ ID NO: 691215 - DNA, 25 bp, Artificial sequence
  Synthetic oligonucleotide
gaactcgtcgcttatttacgaacct

SEQ ID NO: 691216 - DNA, 25 bp, Artificial sequence
  Synthetic oligonucleotide
gaactcgtcgctaatttacgaacct

SEQ ID NO: 691217 - DNA, 25 bp, Artificial sequence
  Synthetic oligonucleotide
ccacctagatcgaaattatcggaac

SEQ ID NO: 691218 - DNA, 25 bp, Artificial sequence
  Synthetic oligonucleotide
atactgagccgaatatcgtaagaca

SEQ ID NO: 691219 - DNA, 25 bp, Artificial sequence
  Synthetic oligonucleotide
cgaccatgtcgtctagcttaatacc

SEQ ID NO: 691220 - DNA, 25 bp, Artificial sequence
  Synthetic oligonucleotide
cgaccatgtcgtgtagcttaatacc

SEQ ID NO: 691221 - DNA, 25 bp, Artificial sequence
  Synthetic oligonucleotide
gtcacgtttaggactatgtcgaagc

SEQ ID NO: 691222 - DNA, 25 bp, Artificial sequence
  Synthetic oligonucleotide
gtcacgtttaggtctatgtcgaagc

SEQ ID NO: 691223 - DNA, 25 bp, Artificial sequence
  Synthetic oligonucleotide
accgagctgacgtcgcgttagacag

SEQ ID NO: 691224 - DNA, 25 bp, Artificial sequence
  Synthetic oligonucleotide
accgagctgacgacgcgttagacag

SEQ ID NO: 691225 - DNA, 25 bp, Artificial sequence
  Synthetic oligonucleotide
tatacttacacagcaggcgatcacg

SEQ ID NO: 691226 - DNA, 25 bp, Artificial sequence
  Synthetic oligonucleotide
ggttgacttagtaatgcgaggttcg

SEQ ID NO: 691227 - DNA, 25 bp, Artificial sequence
  Synthetic oligonucleotide
tcgctggagatcgaatacgcccagc

SEQ ID NO: 691228 - DNA, 25 bp, Artificial sequence
  Synthetic oligonucleotide
ggttgacttagttatgcgaggttcg

SEQ ID NO: 691229 - DNA, 25 bp, Artificial sequence
  Synthetic oligonucleotide
tatacttacacaccaggcgatcacg

SEQ ID NO: 691230 - DNA, 25 bp, Artificial sequence
  Synthetic oligonucleotide
caggcgatcacgttagatccactgc

SEQ ID NO: 691231 - DNA, 25 bp, Artificial sequence
  Synthetic oligonucleotide
caggcgatcacgatagatccactgc

SEQ ID NO: 691232 - DNA, 25 bp, Artificial sequence
  Synthetic oligonucleotide
acatgatcgatcggattacaggccg

SEQ ID NO: 691233 - DNA, 25 bp, Artificial sequence
  Synthetic oligonucleotide
acatgatcgatccgattacaggccg

SEQ ID NO: 691234 - DNA, 25 bp, Artificial sequence
  Synthetic oligonucleotide
gatccgattacaggccgatccatcg

SEQ ID NO: 691235 - DNA, 25 bp, Artificial sequence
  Synthetic oligonucleotide
tcgctggagatccaatacgcccagc

SEQ ID NO: 691236 - DNA, 25 bp, Artificial sequence
  Synthetic oligonucleotide
tcgacctagcgttaggatccacgat

SEQ ID NO: 691237 - DNA, 25 bp, Artificial sequence
  Synthetic oligonucleotide
tacggcggttgacttagttatgcga

SEQ ID NO: 691238 - DNA, 25 bp, Artificial sequence
  Synthetic oligonucleotide
tacggcggttgagttagttatgcga

SEQ ID NO: 691239 - DNA, 25 bp, Artificial sequence
  Synthetic oligonucleotide
gatccgattacacgccgatccatcg

SEQ ID NO: 691240 - DNA, 25 bp, Artificial sequence
  Synthetic oligonucleotide
tcgacctagcgtaaggatccacgat

SEQ ID NO: 691241 - DNA, 25 bp, Artificial sequence
  Synthetic oligonucleotide
tacggcggttgacttagttatgcga

SEQ ID NO: 691242 - DNA, 25 bp, Artificial sequence
  Synthetic oligonucleotide
tcgacctagcgttaggatccacgat

SEQ ID NO: 691243 - DNA, 25 bp, Artificial sequence
  Synthetic oligonucleotide
tacggcggttgagttagttatgcga

SEQ ID NO: 691244 - DNA, 25 bp, Artificial sequence
  Synthetic oligonucleotide
ggttgacttagttatgcgaggttcg

SEQ ID NO: 691245 - DNA, 25 bp, Artificial sequence
  Synthetic oligonucleotide
ggttgacttagtaatgcgaggttcg

SEQ ID NO: 691246 - DNA, 25 bp, Artificial sequence
  Synthetic oligonucleotide
accgagctgacgacgcgttagacag

SEQ ID NO: 691247 - DNA, 25 bp, Artificial sequence
  Synthetic oligonucleotide
accgagctgacgtcgcgttagacag

SEQ ID NO: 691248 - DNA, 25 bp, Artificial sequence
  Synthetic oligonucleotide
gtcacgtttaggtctatgtcgaagc

SEQ ID NO: 691249 - DNA, 25 bp, Artificial sequence
  Synthetic oligonucleotide
gtcacgtttaggactatgtcgaagc

SEQ ID NO: 691250 - DNA, 25 bp, Artificial sequence
  Synthetic oligonucleotide
cgaccatgtcgtgtagcttaatacc

SEQ ID NO: 691251 - DNA, 25 bp, Artificial sequence
  Synthetic oligonucleotide
cgaccatgtcgtctagcttaatacc

SEQ ID NO: 691252 - DNA, 25 bp, Artificial sequence
  Synthetic oligonucleotide
gatccgattacacgccgatccatcg

SEQ ID NO: 691253 - DNA, 25 bp, Artificial sequence
  Synthetic oligonucleotide
tatacttacacaccaggcgatcacg

SEQ ID NO: 691254 - DNA, 25 bp, Artificial sequence
  Synthetic oligonucleotide
tcgctggagatcgaatacgcccagc

SEQ ID NO: 691255 - DNA, 25 bp, Artificial sequence
  Synthetic oligonucleotide
tcgacctagcgtaaggatccacgat

SEQ ID NO: 691256 - DNA, 25 bp, Artificial sequence
  Synthetic oligonucleotide
gatccgattacaggccgatccatcg

SEQ ID NO: 691257 - DNA, 25 bp, Artificial sequence
  Synthetic oligonucleotide
acatgatcgatccgattacaggccg

SEQ ID NO: 691258 - DNA, 25 bp, Artificial sequence
  Synthetic oligonucleotide
acatgatcgatcggattacaggccg

SEQ ID NO: 691259 - DNA, 25 bp, Artificial sequence
  Synthetic oligonucleotide
caggcgatcacgttagatccactgc

SEQ ID NO: 691260 - DNA, 25 bp, Artificial sequence
  Synthetic oligonucleotide
caggcgatcacgatagatccactgc

SEQ ID NO: 691261 - DNA, 25 bp, Artificial sequence
  Synthetic oligonucleotide
tatacttacacagcaggcgatcacg

SEQ ID NO: 691262 - DNA, 25 bp, Artificial sequence
  Synthetic oligonucleotide
tcgctggagatccaatacgcccagc

SEQ ID NO: 691263 - DNA, 25 bp, Artificial sequence
  Synthetic oligonucleotide
ggcctggacgacaataattcggcgg

SEQ ID NO: 691264 - DNA, 25 bp, Artificial sequence
  Synthetic oligonucleotide
ggcctggacgactataattcggcgg

SEQ ID NO: 691265 - DNA, 25 bp, Artificial sequence
  Synthetic oligonucleotide
cggcctggacgacaataattcggcg

SEQ ID NO: 691266 - DNA, 25 bp, Artificial sequence
  Synthetic oligonucleotide
cggcctggacgagaataattcggcg

SEQ ID NO: 691267 - DNA, 25 bp, Artificial sequence
  Synthetic oligonucleotide
gacatggacgtttagtatccggcct

SEQ ID NO: 691268 - DNA, 25 bp, Artificial sequence
  Synthetic oligonucleotide
gacatggacgttaagtatccggcct

SEQ ID NO: 691269 - DNA, 25 bp, Artificial sequence
  Synthetic oligonucleotide
attagaccggatcacccggacatgg

SEQ ID NO: 691270 - DNA, 25 bp, Artificial sequence
  Synthetic oligonucleotide
gacgacaataattcggcggtgcctc

SEQ ID NO: 691271 - DNA, 25 bp, Artificial sequence
  Synthetic oligonucleotide
ctagttatggcgtcggattagaccg

SEQ ID NO: 691272 - DNA, 25 bp, Artificial sequence
  Synthetic oligonucleotide
tcgcctgttacttggttagacagtc

SEQ ID NO: 691273 - DNA, 25 bp, Artificial sequence
  Synthetic oligonucleotide
attagaccggatgacccggacatgg

SEQ ID NO: 691274 - DNA, 25 bp, Artificial sequence
  Synthetic oligonucleotide
gacgacaataatacggcggtgcctc

SEQ ID NO: 691275 - DNA, 25 bp, Artificial sequence
  Synthetic oligonucleotide
tcacaatattccgagaactctgcat

SEQ ID NO: 691276 - DNA, 25 bp, Artificial sequence
  Synthetic oligonucleotide
tcacaatattcccagaactctgcat

SEQ ID NO: 691277 - DNA, 25 bp, Artificial sequence
  Synthetic oligonucleotide
gtacatgagtcatagtccgaatagc

SEQ ID NO: 691278 - DNA, 25 bp, Artificial sequence
  Synthetic oligonucleotide
cgtgacgactgcttagtggtcggtc

SEQ ID NO: 691279 - DNA, 25 bp, Artificial sequence
  Synthetic oligonucleotide
tcgcctgttactaggttagacagtc

SEQ ID NO: 691280 - DNA, 25 bp, Artificial sequence
  Synthetic oligonucleotide
ggttagactgatcgtcaacgaccta

SEQ ID NO: 691281 - DNA, 25 bp, Artificial sequence
  Synthetic oligonucleotide
ggttagactgatggtcaacgaccta

SEQ ID NO: 691282 - DNA, 25 bp, Artificial sequence
  Synthetic oligonucleotide
cgtgacgactgcatagtggtcggtc

SEQ ID NO: 691283 - DNA, 25 bp, Artificial sequence
  Synthetic oligonucleotide
ctagttatggcgacggattagaccg

SEQ ID NO: 691284 - DNA, 25 bp, Artificial sequence
  Synthetic oligonucleotide
gtacatgagtcaaagtccgaatagc

SEQ ID NO: 691285 - DNA, 25 bp, Artificial sequence
  Synthetic oligonucleotide
cggcctggacgagaataattcggcg

SEQ ID NO: 691286 - DNA, 25 bp, Artificial sequence
  Synthetic oligonucleotide
ctagttatggcgtcggattagaccg

SEQ ID NO: 691287 - DNA, 25 bp, Artificial sequence
  Synthetic oligonucleotide
cgtgacgactgcttagtggtcggtc

SEQ ID NO: 691288 - DNA, 25 bp, Artificial sequence
  Synthetic oligonucleotide
attagaccggatgacccggacatgg

SEQ ID NO: 691289 - DNA, 25 bp, Artificial sequence
  Synthetic oligonucleotide
attagaccggatcacccggacatgg

SEQ ID NO: 691290 - DNA, 25 bp, Artificial sequence
  Synthetic oligonucleotide
gacatggacgttaagtatccggcct

SEQ ID NO: 691291 - DNA, 25 bp, Artificial sequence
  Synthetic oligonucleotide
ctagttatggcgacggattagaccg

SEQ ID NO: 691292 - DNA, 25 bp, Artificial sequence
  Synthetic oligonucleotide
cggcctggacgacaataattcggcg

SEQ ID NO: 691293 - DNA, 25 bp, Artificial sequence
  Synthetic oligonucleotide
ggcctggacgacaataattcggcgg

SEQ ID NO: 691294 - DNA, 25 bp, Artificial sequence
  Synthetic oligonucleotide
ggcctggacgactataattcggcgg

SEQ ID NO: 691295 - DNA, 25 bp, Artificial sequence
  Synthetic oligonucleotide
gacgacaataatacggcggtgcctc

SEQ ID NO: 691296 - DNA, 25 bp, Artificial sequence
  Synthetic oligonucleotide
ggttagactgatggtcaacgaccta

SEQ ID NO: 691297 - DNA, 25 bp, Artificial sequence
  Synthetic oligonucleotide
gacatggacgtttagtatccggcct

SEQ ID NO: 691298 - DNA, 25 bp, Artificial sequence
  Synthetic oligonucleotide
cgtgacgactgcatagtggtcggtc

SEQ ID NO: 691299 - DNA, 25 bp, Artificial sequence
  Synthetic oligonucleotide
gacgacaataattcggcggtgcctc

SEQ ID NO: 691300 - DNA, 25 bp, Artificial sequence
  Synthetic oligonucleotide
ggttagactgatcgtcaacgaccta

SEQ ID NO: 691301 - DNA, 25 bp, Artificial sequence
  Synthetic oligonucleotide
tcgcctgttacttggttagacagtc

SEQ ID NO: 691302 - DNA, 25 bp, Artificial sequence
  Synthetic oligonucleotide
tcgcctgttactaggttagacagtc

SEQ ID NO: 691303 - DNA, 25 bp, Artificial sequence
  Synthetic oligonucleotide
gtacatgagtcatagtccgaatagc

SEQ ID NO: 691304 - DNA, 25 bp, Artificial sequence
  Synthetic oligonucleotide
gtacatgagtcaaagtccgaatagc

SEQ ID NO: 691305 - DNA, 25 bp, Artificial sequence
  Synthetic oligonucleotide
tcacaatattccgagaactctgcat

SEQ ID NO: 691306 - DNA, 25 bp, Artificial sequence
  Synthetic oligonucleotide
tcacaatattcccagaactctgcat

SEQ ID NO: 691307 - DNA, 25 bp, Artificial sequence
  Synthetic oligonucleotide
ccgaccatatatcggtcttgctgat

SEQ ID NO: 691308 - DNA, 25 bp, Artificial sequence
  Synthetic oligonucleotide
tcgaatgtgtaaacgtcaactcgta

SEQ ID NO: 691309 - DNA, 25 bp, Artificial sequence
  Synthetic oligonucleotide
atgagactactctgtactagatggt

SEQ ID NO: 691310 - DNA, 25 bp, Artificial sequence
  Synthetic oligonucleotide
gtgaagtgctaggctagtattgaca

SEQ ID NO: 691311 - DNA, 25 bp, Artificial sequence
  Synthetic oligonucleotide
gtgaagtgctagcctagtattgaca

SEQ ID NO: 691312 - DNA, 25 bp, Artificial sequence
  Synthetic oligonucleotide
ctaggctagtattgacatctacggg

SEQ ID NO: 691313 - DNA, 25 bp, Artificial sequence
  Synthetic oligonucleotide
ctaggctagtatagacatctacggg

SEQ ID NO: 691314 - DNA, 25 bp, Artificial sequence
  Synthetic oligonucleotide
ggctagtattgacatctacgggcgg

SEQ ID NO: 691315 - DNA, 25 bp, Artificial sequence
  Synthetic oligonucleotide
ggctagtattgagatctacgggcgg

SEQ ID NO: 691316 - DNA, 25 bp, Artificial sequence
  Synthetic oligonucleotide
atgagactactcagtactagatggt

SEQ ID NO: 691317 - DNA, 25 bp, Artificial sequence
  Synthetic oligonucleotide
ccgaccatatatgggtcttgctgat

SEQ ID NO: 691318 - DNA, 25 bp, Artificial sequence
  Synthetic oligonucleotide
actggtccacatatagacatacttc

SEQ ID NO: 691319 - DNA, 25 bp, Artificial sequence
  Synthetic oligonucleotide
actggtccacatttagacatacttc

SEQ ID NO: 691320 - DNA, 25 bp, Artificial sequence
  Synthetic oligonucleotide
agcgtgctcctacatagcacgagcg

SEQ ID NO: 691321 - DNA, 25 bp, Artificial sequence
  Synthetic oligonucleotide
agcgtgctcctagatagcacgagcg

SEQ ID NO: 691322 - DNA, 25 bp, Artificial sequence
  Synthetic oligonucleotide
tcttatcgctgaatgtctaggattc

SEQ ID NO: 691323 - DNA, 25 bp, Artificial sequence
  Synthetic oligonucleotide
tcttatcgctgattgtctaggattc

SEQ ID NO: 691324 - DNA, 25 bp, Artificial sequence
  Synthetic oligonucleotide
gattctcgtcaatgatctacgatcc

SEQ ID NO: 691325 - DNA, 25 bp, Artificial sequence
  Synthetic oligonucleotide
gattctcgtcaaagatctacgatcc

SEQ ID NO: 691326 - DNA, 25 bp, Artificial sequence
  Synthetic oligonucleotide
cctgaggatttattcacctgactcg

SEQ ID NO: 691327 - DNA, 25 bp, Artificial sequence
  Synthetic oligonucleotide
cctgaggatttaatcacctgactcg

SEQ ID NO: 691328 - DNA, 25 bp, Artificial sequence
  Synthetic oligonucleotide
tcgaatgtgtaatcgtcaactcgta

SEQ ID NO: 691329 - DNA, 25 bp, Artificial sequence
  Synthetic oligonucleotide
atgagactactcagtactagatggt

SEQ ID NO: 691330 - DNA, 25 bp, Artificial sequence
  Synthetic oligonucleotide
atgagactactctgtactagatggt

SEQ ID NO: 691331 - DNA, 25 bp, Artificial sequence
  Synthetic oligonucleotide
tcgaatgtgtaatcgtcaactcgta

SEQ ID NO: 691332 - DNA, 25 bp, Artificial sequence
  Synthetic oligonucleotide
tcgaatgtgtaaacgtcaactcgta

SEQ ID NO: 691333 - DNA, 25 bp, Artificial sequence
  Synthetic oligonucleotide
gtgaagtgctaggctagtattgaca

SEQ ID NO: 691334 - DNA, 25 bp, Artificial sequence
  Synthetic oligonucleotide
gtgaagtgctagcctagtattgaca

SEQ ID NO: 691335 - DNA, 25 bp, Artificial sequence
  Synthetic oligonucleotide
ctaggctagtattgacatctacggg

SEQ ID NO: 691336 - DNA, 25 bp, Artificial sequence
  Synthetic oligonucleotide
ctaggctagtatagacatctacggg

SEQ ID NO: 691337 - DNA, 25 bp, Artificial sequence
  Synthetic oligonucleotide
ggctagtattgacatctacgggcgg

SEQ ID NO: 691338 - DNA, 25 bp, Artificial sequence
  Synthetic oligonucleotide
ggctagtattgagatctacgggcgg

SEQ ID NO: 691339 - DNA, 25 bp, Artificial sequence
  Synthetic oligonucleotide
tcttatcgctgaatgtctaggattc

SEQ ID NO: 691340 - DNA, 25 bp, Artificial sequence
  Synthetic oligonucleotide
cctgaggatttaatcacctgactcg

SEQ ID NO: 691341 - DNA, 25 bp, Artificial sequence
  Synthetic oligonucleotide
ccgaccatatatgggtcttgctgat

SEQ ID NO: 691342 - DNA, 25 bp, Artificial sequence
  Synthetic oligonucleotide
gattctcgtcaatgatctacgatcc

SEQ ID NO: 691343 - DNA, 25 bp, Artificial sequence
  Synthetic oligonucleotide
cctgaggatttattcacctgactcg

SEQ ID NO: 691344 - DNA, 25 bp, Artificial sequence
  Synthetic oligonucleotide
tcttatcgctgattgtctaggattc

SEQ ID NO: 691345 - DNA, 25 bp, Artificial sequence
  Synthetic oligonucleotide
agcgtgctcctacatagcacgagcg

SEQ ID NO: 691346 - DNA, 25 bp, Artificial sequence
  Synthetic oligonucleotide
agcgtgctcctagatagcacgagcg

SEQ ID NO: 691347 - DNA, 25 bp, Artificial sequence
  Synthetic oligonucleotide
actggtccacatatagacatacttc

SEQ ID NO: 691348 - DNA, 25 bp, Artificial sequence
  Synthetic oligonucleotide
actggtccacatttagacatacttc

SEQ ID NO: 691349 - DNA, 25 bp, Artificial sequence
  Synthetic oligonucleotide
ccgaccatatatcggtcttgctgat

SEQ ID NO: 691350 - DNA, 25 bp, Artificial sequence
  Synthetic oligonucleotide
gattctcgtcaaagatctacgatcc

SEQ ID NO: 691351 - DNA, 25 bp, Artificial sequence
  Synthetic oligonucleotide
gtacggataggccacggcatgtacg

SEQ ID NO: 691352 - DNA, 25 bp, Artificial sequence
  Synthetic oligonucleotide
atcgctcctcgaaatgtacggatag

SEQ ID NO: 691353 - DNA, 25 bp, Artificial sequence
  Synthetic oligonucleotide
atcgctcctcgatatgtacggatag

SEQ ID NO: 691354 - DNA, 25 bp, Artificial sequence
  Synthetic oligonucleotide
catatagccatctaagcgctcgata

SEQ ID NO: 691355 - DNA, 25 bp, Artificial sequence
  Synthetic oligonucleotide
catatagccatcaaagcgctcgata

SEQ ID NO: 691356 - DNA, 25 bp, Artificial sequence
  Synthetic oligonucleotide
cgctatctcgtatggggtccgtctg

SEQ ID NO: 691357 - DNA, 25 bp, Artificial sequence
  Synthetic oligonucleotide
gtacggataggcgacggcatgtacg

SEQ ID NO: 691358 - DNA, 25 bp, Artificial sequence
  Synthetic oligonucleotide
tcaggtcatatgacgcgggttctgc

SEQ ID NO: 691359 - DNA, 25 bp, Artificial sequence
  Synthetic oligonucleotide
cgcttaaatcatctgcgtgtcttag

SEQ ID NO: 691360 - DNA, 25 bp, Artificial sequence
  Synthetic oligonucleotide
cgctatctcgtaaggggtccgtctg

SEQ ID NO: 691361 - DNA, 25 bp, Artificial sequence
  Synthetic oligonucleotide
ataggccacggcatgtacgagcata

SEQ ID NO: 691362 - DNA, 25 bp, Artificial sequence
  Synthetic oligonucleotide
ataggccacggcttgtacgagcata

SEQ ID NO: 691363 - DNA, 25 bp, Artificial sequence
  Synthetic oligonucleotide
gcataagccgaagtgcacgagcata

SEQ ID NO: 691364 - DNA, 25 bp, Artificial sequence
  Synthetic oligonucleotide
gcataagccgaactgcacgagcata

SEQ ID NO: 691365 - DNA, 25 bp, Artificial sequence
  Synthetic oligonucleotide
gacactgatctgagagtcgcttaaa

SEQ ID NO: 691366 - DNA, 25 bp, Artificial sequence
  Synthetic oligonucleotide
cgcttaaatcatgtgcgtgtcttag

SEQ ID NO: 691367 - DNA, 25 bp, Artificial sequence
  Synthetic oligonucleotide
tcttagagcttaacgccatgtctgt

SEQ ID NO: 691368 - DNA, 25 bp, Artificial sequence
  Synthetic oligonucleotide
tcttagagcttatcgccatgtctgt

SEQ ID NO: 691369 - DNA, 25 bp, Artificial sequence
  Synthetic oligonucleotide
aggcaatgtgtccgaacggcgagct

SEQ ID NO: 691370 - DNA, 25 bp, Artificial sequence
  Synthetic oligonucleotide
aggcaatgtgtcggaacggcgagct

SEQ ID NO: 691371 - DNA, 25 bp, Artificial sequence
  Synthetic oligonucleotide
gacactgatctgtgagtcgcttaaa

SEQ ID NO: 691372 - DNA, 25 bp, Artificial sequence
  Synthetic oligonucleotide
tcaggtcatatgtcgcgggttctgc

SEQ ID NO: 691373 - DNA, 25 bp, Artificial sequence
  Synthetic oligonucleotide
aggcaatgtgtcggaacggcgagct

SEQ ID NO: 691374 - DNA, 25 bp, Artificial sequence
  Synthetic oligonucleotide
aggcaatgtgtccgaacggcgagct

SEQ ID NO: 691375 - DNA, 25 bp, Artificial sequence
  Synthetic oligonucleotide
tcaggtcatatgacgcgggttctgc

SEQ ID NO: 691376 - DNA, 25 bp, Artificial sequence
  Synthetic oligonucleotide
tcaggtcatatgtcgcgggttctgc

SEQ ID NO: 691377 - DNA, 25 bp, Artificial sequence
  Synthetic oligonucleotide
cgctatctcgtatggggtccgtctg

SEQ ID NO: 691378 - DNA, 25 bp, Artificial sequence
  Synthetic oligonucleotide
cgctatctcgtaaggggtccgtctg

SEQ ID NO: 691379 - DNA, 25 bp, Artificial sequence
  Synthetic oligonucleotide
catatagccatcaaagcgctcgata

SEQ ID NO: 691380 - DNA, 25 bp, Artificial sequence
  Synthetic oligonucleotide
catatagccatctaagcgctcgata

SEQ ID NO: 691381 - DNA, 25 bp, Artificial sequence
  Synthetic oligonucleotide
atcgctcctcgatatgtacggatag

SEQ ID NO: 691382 - DNA, 25 bp, Artificial sequence
  Synthetic oligonucleotide
atcgctcctcgaaatgtacggatag

SEQ ID NO: 691383 - DNA, 25 bp, Artificial sequence
  Synthetic oligonucleotide
gtacggataggcgacggcatgtacg

SEQ ID NO: 691384 - DNA, 25 bp, Artificial sequence
  Synthetic oligonucleotide
tcttagagcttaacgccatgtctgt

SEQ ID NO: 691385 - DNA, 25 bp, Artificial sequence
  Synthetic oligonucleotide
ataggccacggcttgtacgagcata

SEQ ID NO: 691386 - DNA, 25 bp, Artificial sequence
  Synthetic oligonucleotide
ataggccacggcatgtacgagcata

SEQ ID NO: 691387 - DNA, 25 bp, Artificial sequence
  Synthetic oligonucleotide
gcataagccgaagtgcacgagcata

SEQ ID NO: 691388 - DNA, 25 bp, Artificial sequence
  Synthetic oligonucleotide
gcataagccgaactgcacgagcata

SEQ ID NO: 691389 - DNA, 25 bp, Artificial sequence
  Synthetic oligonucleotide
gacactgatctgagagtcgcttaaa

SEQ ID NO: 691390 - DNA, 25 bp, Artificial sequence
  Synthetic oligonucleotide
gacactgatctgtgagtcgcttaaa

SEQ ID NO: 691391 - DNA, 25 bp, Artificial sequence
  Synthetic oligonucleotide
cgcttaaatcatgtgcgtgtcttag

SEQ ID NO: 691392 - DNA, 25 bp, Artificial sequence
  Synthetic oligonucleotide
cgcttaaatcatctgcgtgtcttag

SEQ ID NO: 691393 - DNA, 25 bp, Artificial sequence
  Synthetic oligonucleotide
tcttagagcttatcgccatgtctgt

SEQ ID NO: 691394 - DNA, 25 bp, Artificial sequence
  Synthetic oligonucleotide
gtacggataggccacggcatgtacg

SEQ ID NO: 691395 - DNA, 25 bp, Artificial sequence
  Synthetic oligonucleotide
gatcgctagtacgagttagagatgc

SEQ ID NO: 691396 - DNA, 25 bp, Artificial sequence
  Synthetic oligonucleotide
gatcgctagtaccagttagagatgc

SEQ ID NO: 691397 - DNA, 25 bp, Artificial sequence
  Synthetic oligonucleotide
gcagtctatcagatcgctagtacga

SEQ ID NO: 691398 - DNA, 25 bp, Artificial sequence
  Synthetic oligonucleotide
gcagtctatcagttcgctagtacga

SEQ ID NO: 691399 - DNA, 25 bp, Artificial sequence
  Synthetic oligonucleotide
ctaacgacgctggtagcagtctatc

SEQ ID NO: 691400 - DNA, 25 bp, Artificial sequence
  Synthetic oligonucleotide
ctaacgacgctgctagcagtctatc

SEQ ID NO: 691401 - DNA, 25 bp, Artificial sequence
  Synthetic oligonucleotide
tacggtataacaaggcgtgctacgg

SEQ ID NO: 691402 - DNA, 25 bp, Artificial sequence
  Synthetic oligonucleotide
gcactcgcgtaatgacgctgcatcg

SEQ ID NO: 691403 - DNA, 25 bp, Artificial sequence
  Synthetic oligonucleotide
tggtgttcgatagccggatcgggtt

SEQ ID NO: 691404 - DNA, 25 bp, Artificial sequence
  Synthetic oligonucleotide
gctctaaatcatcatgcgacagtct

SEQ ID NO: 691405 - DNA, 25 bp, Artificial sequence
  Synthetic oligonucleotide
tacggtataacatggcgtgctacgg

SEQ ID NO: 691406 - DNA, 25 bp, Artificial sequence
  Synthetic oligonucleotide
gcactcgcgtaaagacgctgcatcg

SEQ ID NO: 691407 - DNA, 25 bp, Artificial sequence
  Synthetic oligonucleotide
cgctcagtatgatccatgagcgccg

SEQ ID NO: 691408 - DNA, 25 bp, Artificial sequence
  Synthetic oligonucleotide
cgctcagtatgaaccatgagcgccg

SEQ ID NO: 691409 - DNA, 25 bp, Artificial sequence
  Synthetic oligonucleotide
tcacatgatacaacgctctaaatca

SEQ ID NO: 691410 - DNA, 25 bp, Artificial sequence
  Synthetic oligonucleotide
tctgagacactgatcgagcattaag

SEQ ID NO: 691411 - DNA, 25 bp, Artificial sequence
  Synthetic oligonucleotide
gctctaaatcatgatgcgacagtct

SEQ ID NO: 691412 - DNA, 25 bp, Artificial sequence
  Synthetic oligonucleotide
catgctcgactcagagacactgatc

SEQ ID NO: 691413 - DNA, 25 bp, Artificial sequence
  Synthetic oligonucleotide
catgctcgactctgagacactgatc

SEQ ID NO: 691414 - DNA, 25 bp, Artificial sequence
  Synthetic oligonucleotide
tctgagacactgttcgagcattaag

SEQ ID NO: 691415 - DNA, 25 bp, Artificial sequence
  Synthetic oligonucleotide
tggtgttcgatacccggatcgggtt

SEQ ID NO: 691416 - DNA, 25 bp, Artificial sequence
  Synthetic oligonucleotide
tcacatgatacatcgctctaaatca

SEQ ID NO: 691417 - DNA, 25 bp, Artificial sequence
  Synthetic oligonucleotide
tggtgttcgatagccggatcgggtt

SEQ ID NO: 691418 - DNA, 25 bp, Artificial sequence
  Synthetic oligonucleotide
gcagtctatcagttcgctagtacga

SEQ ID NO: 691419 - DNA, 25 bp, Artificial sequence
  Synthetic oligonucleotide
tacggtataacaaggcgtgctacgg

SEQ ID NO: 691420 - DNA, 25 bp, Artificial sequence
  Synthetic oligonucleotide
tctgagacactgatcgagcattaag

SEQ ID NO: 691421 - DNA, 25 bp, Artificial sequence
  Synthetic oligonucleotide
tacggtataacatggcgtgctacgg

SEQ ID NO: 691422 - DNA, 25 bp, Artificial sequence
  Synthetic oligonucleotide
tggtgttcgatacccggatcgggtt

SEQ ID NO: 691423 - DNA, 25 bp, Artificial sequence
  Synthetic oligonucleotide
ctaacgacgctgctagcagtctatc

SEQ ID NO: 691424 - DNA, 25 bp, Artificial sequence
  Synthetic oligonucleotide
gcagtctatcagatcgctagtacga

SEQ ID NO: 691425 - DNA, 25 bp, Artificial sequence
  Synthetic oligonucleotide
gatcgctagtaccagttagagatgc

SEQ ID NO: 691426 - DNA, 25 bp, Artificial sequence
  Synthetic oligonucleotide
gatcgctagtacgagttagagatgc

SEQ ID NO: 691427 - DNA, 25 bp, Artificial sequence
  Synthetic oligonucleotide
gcactcgcgtaatgacgctgcatcg

SEQ ID NO: 691428 - DNA, 25 bp, Artificial sequence
  Synthetic oligonucleotide
gctctaaatcatgatgcgacagtct

SEQ ID NO: 691429 - DNA, 25 bp, Artificial sequence
  Synthetic oligonucleotide
tctgagacactgttcgagcattaag

SEQ ID NO: 691430 - DNA, 25 bp, Artificial sequence
  Synthetic oligonucleotide
ctaacgacgctggtagcagtctatc

SEQ ID NO: 691431 - DNA, 25 bp, Artificial sequence
  Synthetic oligonucleotide
gcactcgcgtaaagacgctgcatcg

SEQ ID NO: 691432 - DNA, 25 bp, Artificial sequence
  Synthetic oligonucleotide
catgctcgactcagagacactgatc

SEQ ID NO: 691433 - DNA, 25 bp, Artificial sequence
  Synthetic oligonucleotide
catgctcgactctgagacactgatc

SEQ ID NO: 691434 - DNA, 25 bp, Artificial sequence
  Synthetic oligonucleotide
gctctaaatcatcatgcgacagtct

SEQ ID NO: 691435 - DNA, 25 bp, Artificial sequence
  Synthetic oligonucleotide
tcacatgatacatcgctctaaatca

SEQ ID NO: 691436 - DNA, 25 bp, Artificial sequence
  Synthetic oligonucleotide
tcacatgatacaacgctctaaatca

SEQ ID NO: 691437 - DNA, 25 bp, Artificial sequence
  Synthetic oligonucleotide
cgctcagtatgaaccatgagcgccg

SEQ ID NO: 691438 - DNA, 25 bp, Artificial sequence
  Synthetic oligonucleotide
cgctcagtatgatccatgagcgccg

SEQ ID NO: 691439 - DNA, 25 bp, Artificial sequence
  Synthetic oligonucleotide
actcgttgatagtcaaccaagctcg

SEQ ID NO: 691440 - DNA, 25 bp, Artificial sequence
  Synthetic oligonucleotide
gggcacgttgtttaactgttgccgc

SEQ ID NO: 691441 - DNA, 25 bp, Artificial sequence
  Synthetic oligonucleotide
ccaattcaagataagtccagctcgt

SEQ ID NO: 691442 - DNA, 25 bp, Artificial sequence
  Synthetic oligonucleotide
gggcacgttgttaaactgttgccgc

SEQ ID NO: 691443 - DNA, 25 bp, Artificial sequence
  Synthetic oligonucleotide
ccaattcaagattagtccagctcgt

SEQ ID NO: 691444 - DNA, 25 bp, Artificial sequence
  Synthetic oligonucleotide
gatacttcgatagcgttgtgaatag

SEQ ID NO: 691445 - DNA, 25 bp, Artificial sequence
  Synthetic oligonucleotide
gatacttcgataccgttgtgaatag

SEQ ID NO: 691446 - DNA, 25 bp, Artificial sequence
  Synthetic oligonucleotide
agtcatcgtgagaagtatgaacgtg

SEQ ID NO: 691447 - DNA, 25 bp, Artificial sequence
  Synthetic oligonucleotide
atgtactatggagcggtcaatgtca

SEQ ID NO: 691448 - DNA, 25 bp, Artificial sequence
  Synthetic oligonucleotide
actagttgacttggagtatgccatg

SEQ ID NO: 691449 - DNA, 25 bp, Artificial sequence
  Synthetic oligonucleotide
agtcatcgtgagtagtatgaacgtg

SEQ ID NO: 691450 - DNA, 25 bp, Artificial sequence
  Synthetic oligonucleotide
actcgttgatagacaaccaagctcg

SEQ ID NO: 691451 - DNA, 25 bp, Artificial sequence
  Synthetic oligonucleotide
tacgagatgagcaacgtaactacag

SEQ ID NO: 691452 - DNA, 25 bp, Artificial sequence
  Synthetic oligonucleotide
tacgagatgagctacgtaactacag

SEQ ID NO: 691453 - DNA, 25 bp, Artificial sequence
  Synthetic oligonucleotide
atgagctacgtaactacagtgatag

SEQ ID NO: 691454 - DNA, 25 bp, Artificial sequence
  Synthetic oligonucleotide
atgagctacgtatctacagtgatag

SEQ ID NO: 691455 - DNA, 25 bp, Artificial sequence
  Synthetic oligonucleotide
ctacagtgataggatatagggtacg

SEQ ID NO: 691456 - DNA, 25 bp, Artificial sequence
  Synthetic oligonucleotide
ctacagtgatagcatatagggtacg

SEQ ID NO: 691457 - DNA, 25 bp, Artificial sequence
  Synthetic oligonucleotide
aggtcgtagtcgtattagtcaggtt

SEQ ID NO: 691458 - DNA, 25 bp, Artificial sequence
  Synthetic oligonucleotide
actagttgacttcgagtatgccatg

SEQ ID NO: 691459 - DNA, 25 bp, Artificial sequence
  Synthetic oligonucleotide
atgtactatggaccggtcaatgtca

SEQ ID NO: 691460 - DNA, 25 bp, Artificial sequence
  Synthetic oligonucleotide
aggtcgtagtcgaattagtcaggtt

SEQ ID NO: 691461 - DNA, 25 bp, Artificial sequence
  Synthetic oligonucleotide
actcgttgatagtcaaccaagctcg

SEQ ID NO: 691462 - DNA, 25 bp, Artificial sequence
  Synthetic oligonucleotide
gatacttcgataccgttgtgaatag

SEQ ID NO: 691463 - DNA, 25 bp, Artificial sequence
  Synthetic oligonucleotide
actagttgacttcgagtatgccatg

SEQ ID NO: 691464 - DNA, 25 bp, Artificial sequence
  Synthetic oligonucleotide
tacgagatgagctacgtaactacag

SEQ ID NO: 691465 - DNA, 25 bp, Artificial sequence
  Synthetic oligonucleotide
atgtactatggaccggtcaatgtca

SEQ ID NO: 691466 - DNA, 25 bp, Artificial sequence
  Synthetic oligonucleotide
atgtactatggagcggtcaatgtca

SEQ ID NO: 691467 - DNA, 25 bp, Artificial sequence
  Synthetic oligonucleotide
agtcatcgtgagaagtatgaacgtg

SEQ ID NO: 691468 - DNA, 25 bp, Artificial sequence
  Synthetic oligonucleotide
gatacttcgatagcgttgtgaatag

SEQ ID NO: 691469 - DNA, 25 bp, Artificial sequence
  Synthetic oligonucleotide
gggcacgttgtttaactgttgccgc

SEQ ID NO: 691470 - DNA, 25 bp, Artificial sequence
  Synthetic oligonucleotide
gggcacgttgttaaactgttgccgc

SEQ ID NO: 691471 - DNA, 25 bp, Artificial sequence
  Synthetic oligonucleotide
ccaattcaagattagtccagctcgt

SEQ ID NO: 691472 - DNA, 25 bp, Artificial sequence
  Synthetic oligonucleotide
aggtcgtagtcgaattagtcaggtt

SEQ ID NO: 691473 - DNA, 25 bp, Artificial sequence
  Synthetic oligonucleotide
actcgttgatagacaaccaagctcg

SEQ ID NO: 691474 - DNA, 25 bp, Artificial sequence
  Synthetic oligonucleotide
tacgagatgagcaacgtaactacag

SEQ ID NO: 691475 - DNA, 25 bp, Artificial sequence
  Synthetic oligonucleotide
atgagctacgtaactacagtgatag

SEQ ID NO: 691476 - DNA, 25 bp, Artificial sequence
  Synthetic oligonucleotide
actagttgacttggagtatgccatg

SEQ ID NO: 691477 - DNA, 25 bp, Artificial sequence
  Synthetic oligonucleotide
atgagctacgtatctacagtgatag

SEQ ID NO: 691478 - DNA, 25 bp, Artificial sequence
  Synthetic oligonucleotide
ctacagtgataggatatagggtacg

SEQ ID NO: 691479 - DNA, 25 bp, Artificial sequence
  Synthetic oligonucleotide
ctacagtgatagcatatagggtacg

SEQ ID NO: 691480 - DNA, 25 bp, Artificial sequence
  Synthetic oligonucleotide
ccaattcaagataagtccagctcgt

SEQ ID NO: 691481 - DNA, 25 bp, Artificial sequence
  Synthetic oligonucleotide
aggtcgtagtcgtattagtcaggtt

SEQ ID NO: 691482 - DNA, 25 bp, Artificial sequence
  Synthetic oligonucleotide
agtcatcgtgagtagtatgaacgtg

SEQ ID NO: 691483 - DNA, 25 bp, Artificial sequence
  Synthetic oligonucleotide
cttacttacgagcctactattcgat

SEQ ID NO: 691484 - DNA, 25 bp, Artificial sequence
  Synthetic oligonucleotide
tgctacatcagtcgcgatgttcgta

SEQ ID NO: 691485 - DNA, 25 bp, Artificial sequence
  Synthetic oligonucleotide
tgctacatcagtggcgatgttcgta

SEQ ID NO: 691486 - DNA, 25 bp, Artificial sequence
  Synthetic oligonucleotide
tgctcgatacgggaaatatagctcc

SEQ ID NO: 691487 - DNA, 25 bp, Artificial sequence
  Synthetic oligonucleotide
tgctcgatacggcaaatatagctcc

SEQ ID NO: 691488 - DNA, 25 bp, Artificial sequence
  Synthetic oligonucleotide
gatacgggcgatttaatgctcgata

SEQ ID NO: 691489 - DNA, 25 bp, Artificial sequence
  Synthetic oligonucleotide
ggtgtctaatacatcgtgatacggg

SEQ ID NO: 691490 - DNA, 25 bp, Artificial sequence
  Synthetic oligonucleotide
cttacttacgaggctactattcgat

SEQ ID NO: 691491 - DNA, 25 bp, Artificial sequence
  Synthetic oligonucleotide
ccctgtggtcgtataatcgagcgcg

SEQ ID NO: 691492 - DNA, 25 bp, Artificial sequence
  Synthetic oligonucleotide
gatacgggcgatataatgctcgata

SEQ ID NO: 691493 - DNA, 25 bp, Artificial sequence
  Synthetic oligonucleotide
ctatctggtaattactgcggtgatc

SEQ ID NO: 691494 - DNA, 25 bp, Artificial sequence
  Synthetic oligonucleotide
ctatctggtaataactgcggtgatc

SEQ ID NO: 691495 - DNA, 25 bp, Artificial sequence
  Synthetic oligonucleotide
atctggtaataactgcggtgatctg

SEQ ID NO: 691496 - DNA, 25 bp, Artificial sequence
  Synthetic oligonucleotide
cctggtagcaaaaacggcgagctgg

SEQ ID NO: 691497 - DNA, 25 bp, Artificial sequence
  Synthetic oligonucleotide
caatataacacggagtcgtcaatca

SEQ ID NO: 691498 - DNA, 25 bp, Artificial sequence
  Synthetic oligonucleotide
caatataacacgcagtcgtcaatca

SEQ ID NO: 691499 - DNA, 25 bp, Artificial sequence
  Synthetic oligonucleotide
ccacctctggtcaaatatagcgccc

SEQ ID NO: 691500 - DNA, 25 bp, Artificial sequence
  Synthetic oligonucleotide
ggtgtctaatacttcgtgatacggg

SEQ ID NO: 691501 - DNA, 25 bp, Artificial sequence
  Synthetic oligonucleotide
ccctgtggtcgtttaatcgagcgcg

SEQ ID NO: 691502 - DNA, 25 bp, Artificial sequence
  Synthetic oligonucleotide
atctggtaataagtgcggtgatctg

SEQ ID NO: 691503 - DNA, 25 bp, Artificial sequence
  Synthetic oligonucleotide
ccacctctggtctaatatagcgccc

SEQ ID NO: 691504 - DNA, 25 bp, Artificial sequence
  Synthetic oligonucleotide
cctggtagcaaatacggcgagctgg

SEQ ID NO: 691505 - DNA, 25 bp, Artificial sequence
  Synthetic oligonucleotide
tgctcgatacggcaaatatagctcc

SEQ ID NO: 691506 - DNA, 25 bp, Artificial sequence
  Synthetic oligonucleotide
ggtgtctaatacatcgtgatacggg

SEQ ID NO: 691507 - DNA, 25 bp, Artificial sequence
  Synthetic oligonucleotide
ggtgtctaatacttcgtgatacggg

SEQ ID NO: 691508 - DNA, 25 bp, Artificial sequence
  Synthetic oligonucleotide
gatacgggcgatttaatgctcgata

SEQ ID NO: 691509 - DNA, 25 bp, Artificial sequence
  Synthetic oligonucleotide
ccctgtggtcgtttaatcgagcgcg

SEQ ID NO: 691510 - DNA, 25 bp, Artificial sequence
  Synthetic oligonucleotide
tgctcgatacgggaaatatagctcc

SEQ ID NO: 691511 - DNA, 25 bp, Artificial sequence
  Synthetic oligonucleotide
tgctacatcagtggcgatgttcgta

SEQ ID NO: 691512 - DNA, 25 bp, Artificial sequence
  Synthetic oligonucleotide
tgctacatcagtcgcgatgttcgta

SEQ ID NO: 691513 - DNA, 25 bp, Artificial sequence
  Synthetic oligonucleotide
cttacttacgagcctactattcgat

SEQ ID NO: 691514 - DNA, 25 bp, Artificial sequence
  Synthetic oligonucleotide
cttacttacgaggctactattcgat

SEQ ID NO: 691515 - DNA, 25 bp, Artificial sequence
  Synthetic oligonucleotide
caatataacacggagtcgtcaatca

SEQ ID NO: 691516 - DNA, 25 bp, Artificial sequence
  Synthetic oligonucleotide
gatacgggcgatataatgctcgata

SEQ ID NO: 691517 - DNA, 25 bp, Artificial sequence
  Synthetic oligonucleotide
ccctgtggtcgtataatcgagcgcg

SEQ ID NO: 691518 - DNA, 25 bp, Artificial sequence
  Synthetic oligonucleotide
ctatctggtaattactgcggtgatc

SEQ ID NO: 691519 - DNA, 25 bp, Artificial sequence
  Synthetic oligonucleotide
caatataacacgcagtcgtcaatca

SEQ ID NO: 691520 - DNA, 25 bp, Artificial sequence
  Synthetic oligonucleotide
ccacctctggtcaaatatagcgccc

SEQ ID NO: 691521 - DNA, 25 bp, Artificial sequence
  Synthetic oligonucleotide
cctggtagcaaatacggcgagctgg

SEQ ID NO: 691522 - DNA, 25 bp, Artificial sequence
  Synthetic oligonucleotide
cctggtagcaaaaacggcgagctgg

SEQ ID NO: 691523 - DNA, 25 bp, Artificial sequence
  Synthetic oligonucleotide
atctggtaataagtgcggtgatctg

SEQ ID NO: 691524 - DNA, 25 bp, Artificial sequence
  Synthetic oligonucleotide
atctggtaataactgcggtgatctg

SEQ ID NO: 691525 - DNA, 25 bp, Artificial sequence
  Synthetic oligonucleotide
ctatctggtaataactgcggtgatc

SEQ ID NO: 691526 - DNA, 25 bp, Artificial sequence
  Synthetic oligonucleotide
ccacctctggtctaatatagcgccc

SEQ ID NO: 691527 - DNA, 25 bp, Artificial sequence
  Synthetic oligonucleotide
atcgagtgagtagatgattcgtcag

SEQ ID NO: 691528 - DNA, 25 bp, Artificial sequence
  Synthetic oligonucleotide
ctcatacagcgtaacggtcgctgcg

SEQ ID NO: 691529 - DNA, 25 bp, Artificial sequence
  Synthetic oligonucleotide
tcatcggtccgatcaattagtctag

SEQ ID NO: 691530 - DNA, 25 bp, Artificial sequence
  Synthetic oligonucleotide
tcatcggtccgaacaattagtctag

SEQ ID NO: 691531 - DNA, 25 bp, Artificial sequence
  Synthetic oligonucleotide
ctcatacagcgttacggtcgctgcg

SEQ ID NO: 691532 - DNA, 25 bp, Artificial sequence
  Synthetic oligonucleotide
atcatataggatgcggcgatctcat

SEQ ID NO: 691533 - DNA, 25 bp, Artificial sequence
  Synthetic oligonucleotide
atcatataggatccggcgatctcat

SEQ ID NO: 691534 - DNA, 25 bp, Artificial sequence
  Synthetic oligonucleotide
tgtcgtccatgtatagacagtgcgc

SEQ ID NO: 691535 - DNA, 25 bp, Artificial sequence
  Synthetic oligonucleotide
tgtatatcgaggagagtctatctgg

SEQ ID NO: 691536 - DNA, 25 bp, Artificial sequence
  Synthetic oligonucleotide
cacgactgaatcgagcttaagagcc

SEQ ID NO: 691537 - DNA, 25 bp, Artificial sequence
  Synthetic oligonucleotide
tgtcgtccatgtttagacagtgcgc

SEQ ID NO: 691538 - DNA, 25 bp, Artificial sequence
  Synthetic oligonucleotide
atcgagtgagtacatgattcgtcag

SEQ ID NO: 691539 - DNA, 25 bp, Artificial sequence
  Synthetic oligonucleotide
tgtggatcaatttcagttaggccgc

SEQ ID NO: 691540 - DNA, 25 bp, Artificial sequence
  Synthetic oligonucleotide
tgtggatcaattacagttaggccgc

SEQ ID NO: 691541 - DNA, 25 bp, Artificial sequence
  Synthetic oligonucleotide
ccgctgacacataagtaacgtcggc

SEQ ID NO: 691542 - DNA, 25 bp, Artificial sequence
  Synthetic oligonucleotide
ccgctgacacattagtaacgtcggc

SEQ ID NO: 691543 - DNA, 25 bp, Artificial sequence
  Synthetic oligonucleotide
tgtgattctcgagcgatttatacat

SEQ ID NO: 691544 - DNA, 25 bp, Artificial sequence
  Synthetic oligonucleotide
tgtgattctcgaccgatttatacat

SEQ ID NO: 691545 - DNA, 25 bp, Artificial sequence
  Synthetic oligonucleotide
ctgacagactggttggttatccaat

SEQ ID NO: 691546 - DNA, 25 bp, Artificial sequence
  Synthetic oligonucleotide
tgtatatcgaggtgagtctatctgg

SEQ ID NO: 691547 - DNA, 25 bp, Artificial sequence
  Synthetic oligonucleotide
cacgactgaatccagcttaagagcc

SEQ ID NO: 691548 - DNA, 25 bp, Artificial sequence
  Synthetic oligonucleotide
ctgacagactggatggttatccaat

SEQ ID NO: 691549 - DNA, 25 bp, Artificial sequence
  Synthetic oligonucleotide
atcgagtgagtagatgattcgtcag

SEQ ID NO: 691550 - DNA, 25 bp, Artificial sequence
  Synthetic oligonucleotide
tcatcggtccgaacaattagtctag

SEQ ID NO: 691551 - DNA, 25 bp, Artificial sequence
  Synthetic oligonucleotide
tgtatatcgaggtgagtctatctgg

SEQ ID NO: 691552 - DNA, 25 bp, Artificial sequence
  Synthetic oligonucleotide
tgtatatcgaggagagtctatctgg

SEQ ID NO: 691553 - DNA, 25 bp, Artificial sequence
  Synthetic oligonucleotide
tgtcgtccatgtatagacagtgcgc

SEQ ID NO: 691554 - DNA, 25 bp, Artificial sequence
  Synthetic oligonucleotide
tgtcgtccatgtttagacagtgcgc

SEQ ID NO: 691555 - DNA, 25 bp, Artificial sequence
  Synthetic oligonucleotide
atcatataggatgcggcgatctcat

SEQ ID NO: 691556 - DNA, 25 bp, Artificial sequence
  Synthetic oligonucleotide
atcatataggatccggcgatctcat

SEQ ID NO: 691557 - DNA, 25 bp, Artificial sequence
  Synthetic oligonucleotide
ctcatacagcgttacggtcgctgcg

SEQ ID NO: 691558 - DNA, 25 bp, Artificial sequence
  Synthetic oligonucleotide
tgtggatcaattacagttaggccgc

SEQ ID NO: 691559 - DNA, 25 bp, Artificial sequence
  Synthetic oligonucleotide
tcatcggtccgatcaattagtctag

SEQ ID NO: 691560 - DNA, 25 bp, Artificial sequence
  Synthetic oligonucleotide
cacgactgaatcgagcttaagagcc

SEQ ID NO: 691561 - DNA, 25 bp, Artificial sequence
  Synthetic oligonucleotide
atcgagtgagtacatgattcgtcag

SEQ ID NO: 691562 - DNA, 25 bp, Artificial sequence
  Synthetic oligonucleotide
tgtggatcaatttcagttaggccgc

SEQ ID NO: 691563 - DNA, 25 bp, Artificial sequence
  Synthetic oligonucleotide
ccgctgacacattagtaacgtcggc

SEQ ID NO: 691564 - DNA, 25 bp, Artificial sequence
  Synthetic oligonucleotide
ccgctgacacataagtaacgtcggc

SEQ ID NO: 691565 - DNA, 25 bp, Artificial sequence
  Synthetic oligonucleotide
tgtgattctcgagcgatttatacat

SEQ ID NO: 691566 - DNA, 25 bp, Artificial sequence
  Synthetic oligonucleotide
tgtgattctcgaccgatttatacat

SEQ ID NO: 691567 - DNA, 25 bp, Artificial sequence
  Synthetic oligonucleotide
ctgacagactggttggttatccaat

SEQ ID NO: 691568 - DNA, 25 bp, Artificial sequence
  Synthetic oligonucleotide
ctgacagactggatggttatccaat

SEQ ID NO: 691569 - DNA, 25 bp, Artificial sequence
  Synthetic oligonucleotide
cacgactgaatccagcttaagagcc

SEQ ID NO: 691570 - DNA, 25 bp, Artificial sequence
  Synthetic oligonucleotide
ctcatacagcgtaacggtcgctgcg

SEQ ID NO: 691571 - DNA, 25 bp, Artificial sequence
  Synthetic oligonucleotide
atgtgacgcagcacttagcgcaatg

SEQ ID NO: 691572 - DNA, 25 bp, Artificial sequence
  Synthetic oligonucleotide
ctgatgacctcgtatcatgttatag

SEQ ID NO: 691573 - DNA, 25 bp, Artificial sequence
  Synthetic oligonucleotide
cagtacatggtacttcagccaatag

SEQ ID NO: 691574 - DNA, 25 bp, Artificial sequence
  Synthetic oligonucleotide
tcagccaatagaagcctagtacgct

SEQ ID NO: 691575 - DNA, 25 bp, Artificial sequence
  Synthetic oligonucleotide
tcagccaatagatgcctagtacgct

SEQ ID NO: 691576 - DNA, 25 bp, Artificial sequence
  Synthetic oligonucleotide
ctgatcggcttatgacgtatgtgac

SEQ ID NO: 691577 - DNA, 25 bp, Artificial sequence
  Synthetic oligonucleotide
atgtgacgcagctcttagcgcaatg

SEQ ID NO: 691578 - DNA, 25 bp, Artificial sequence
  Synthetic oligonucleotide
aatgtatgtgctgttatcgaagcct

SEQ ID NO: 691579 - DNA, 25 bp, Artificial sequence
  Synthetic oligonucleotide
aatgtatgtgctcttatcgaagcct

SEQ ID NO: 691580 - DNA, 25 bp, Artificial sequence
  Synthetic oligonucleotide
cagtacatggtagttcagccaatag

SEQ ID NO: 691581 - DNA, 25 bp, Artificial sequence
  Synthetic oligonucleotide
gtatgtaacgctatggcgtgctagt

SEQ ID NO: 691582 - DNA, 25 bp, Artificial sequence
  Synthetic oligonucleotide
tggctgagtatgaaacgctatggcg

SEQ ID NO: 691583 - DNA, 25 bp, Artificial sequence
  Synthetic oligonucleotide
ctgatgacctcgaatcatgttatag

SEQ ID NO: 691584 - DNA, 25 bp, Artificial sequence
  Synthetic oligonucleotide
tatcatgttatagggctgcgaactg

SEQ ID NO: 691585 - DNA, 25 bp, Artificial sequence
  Synthetic oligonucleotide
tatcatgttatacggctgcgaactg

SEQ ID NO: 691586 - DNA, 25 bp, Artificial sequence
  Synthetic oligonucleotide
gaactgtcgatgatggtcacgactc

SEQ ID NO: 691587 - DNA, 25 bp, Artificial sequence
  Synthetic oligonucleotide
gaactgtcgatgttggtcacgactc

SEQ ID NO: 691588 - DNA, 25 bp, Artificial sequence
  Synthetic oligonucleotide
agaaggtgtgcagcctatatgatac

SEQ ID NO: 691589 - DNA, 25 bp, Artificial sequence
  Synthetic oligonucleotide
agaaggtgtgcaccctatatgatac

SEQ ID NO: 691590 - DNA, 25 bp, Artificial sequence
  Synthetic oligonucleotide
ctgatcggcttaagacgtatgtgac

SEQ ID NO: 691591 - DNA, 25 bp, Artificial sequence
  Synthetic oligonucleotide
tggctgagtatgtaacgctatggcg

SEQ ID NO: 691592 - DNA, 25 bp, Artificial sequence
  Synthetic oligonucleotide
gtatgtaacgctttggcgtgctagt

SEQ ID NO: 691593 - DNA, 25 bp, Artificial sequence
  Synthetic oligonucleotide
tcagccaatagaagcctagtacgct

SEQ ID NO: 691594 - DNA, 25 bp, Artificial sequence
  Synthetic oligonucleotide
cagtacatggtagttcagccaatag

SEQ ID NO: 691595 - DNA, 25 bp, Artificial sequence
  Synthetic oligonucleotide
agaaggtgtgcagcctatatgatac

SEQ ID NO: 691596 - DNA, 25 bp, Artificial sequence
  Synthetic oligonucleotide
tcagccaatagatgcctagtacgct

SEQ ID NO: 691597 - DNA, 25 bp, Artificial sequence
  Synthetic oligonucleotide
ctgatcggcttatgacgtatgtgac

SEQ ID NO: 691598 - DNA, 25 bp, Artificial sequence
  Synthetic oligonucleotide
ctgatcggcttaagacgtatgtgac

SEQ ID NO: 691599 - DNA, 25 bp, Artificial sequence
  Synthetic oligonucleotide
atgtgacgcagcacttagcgcaatg

SEQ ID NO: 691600 - DNA, 25 bp, Artificial sequence
  Synthetic oligonucleotide
atgtgacgcagctcttagcgcaatg

SEQ ID NO: 691601 - DNA, 25 bp, Artificial sequence
  Synthetic oligonucleotide
aatgtatgtgctgttatcgaagcct

SEQ ID NO: 691602 - DNA, 25 bp, Artificial sequence
  Synthetic oligonucleotide
aatgtatgtgctcttatcgaagcct

SEQ ID NO: 691603 - DNA, 25 bp, Artificial sequence
  Synthetic oligonucleotide
tggctgagtatgtaacgctatggcg

SEQ ID NO: 691604 - DNA, 25 bp, Artificial sequence
  Synthetic oligonucleotide
gaactgtcgatgatggtcacgactc

SEQ ID NO: 691605 - DNA, 25 bp, Artificial sequence
  Synthetic oligonucleotide
gaactgtcgatgttggtcacgactc

SEQ ID NO: 691606 - DNA, 25 bp, Artificial sequence
  Synthetic oligonucleotide
tatcatgttatacggctgcgaactg

SEQ ID NO: 691607 - DNA, 25 bp, Artificial sequence
  Synthetic oligonucleotide
tatcatgttatagggctgcgaactg

SEQ ID NO: 691608 - DNA, 25 bp, Artificial sequence
  Synthetic oligonucleotide
ctgatgacctcgaatcatgttatag

SEQ ID NO: 691609 - DNA, 25 bp, Artificial sequence
  Synthetic oligonucleotide
ctgatgacctcgtatcatgttatag

SEQ ID NO: 691610 - DNA, 25 bp, Artificial sequence
  Synthetic oligonucleotide
gtatgtaacgctttggcgtgctagt

SEQ ID NO: 691611 - DNA, 25 bp, Artificial sequence
  Synthetic oligonucleotide
gtatgtaacgctatggcgtgctagt

SEQ ID NO: 691612 - DNA, 25 bp, Artificial sequence
  Synthetic oligonucleotide
tggctgagtatgaaacgctatggcg

SEQ ID NO: 691613 - DNA, 25 bp, Artificial sequence
  Synthetic oligonucleotide
cagtacatggtacttcagccaatag

SEQ ID NO: 691614 - DNA, 25 bp, Artificial sequence
  Synthetic oligonucleotide
agaaggtgtgcaccctatatgatac

SEQ ID NO: 691615 - DNA, 25 bp, Artificial sequence
  Synthetic oligonucleotide
tcggctataacagcgagtgctacgc

SEQ ID NO: 691616 - DNA, 25 bp, Artificial sequence
  Synthetic oligonucleotide
ctgtctagcactctagctggtgcat

SEQ ID NO: 691617 - DNA, 25 bp, Artificial sequence
  Synthetic oligonucleotide
ctgtctagcactgtagctggtgcat

SEQ ID NO: 691618 - DNA, 25 bp, Artificial sequence
  Synthetic oligonucleotide
cgcctaaactgggtgtctagcactg

SEQ ID NO: 691619 - DNA, 25 bp, Artificial sequence
  Synthetic oligonucleotide
cgcctaaactggctgtctagcactg

SEQ ID NO: 691620 - DNA, 25 bp, Artificial sequence
  Synthetic oligonucleotide
cgagtgctacgcgtaaactggctgt

SEQ ID NO: 691621 - DNA, 25 bp, Artificial sequence
  Synthetic oligonucleotide
tcggctataacaccgagtgctacgc

SEQ ID NO: 691622 - DNA, 25 bp, Artificial sequence
  Synthetic oligonucleotide
gcgtataggctgatacattagctcg

SEQ ID NO: 691623 - DNA, 25 bp, Artificial sequence
  Synthetic oligonucleotide
tgcgcctattatttgcctgacgcgg

SEQ ID NO: 691624 - DNA, 25 bp, Artificial sequence
  Synthetic oligonucleotide
cagtgatacacggtgatgcacgtag

SEQ ID NO: 691625 - DNA, 25 bp, Artificial sequence
  Synthetic oligonucleotide
cgagtgctacgcctaaactggctgt

SEQ ID NO: 691626 - DNA, 25 bp, Artificial sequence
  Synthetic oligonucleotide
gcgtataggctgttacattagctcg

SEQ ID NO: 691627 - DNA, 25 bp, Artificial sequence
  Synthetic oligonucleotide
tgatacattagctcggatgctatca

SEQ ID NO: 691628 - DNA, 25 bp, Artificial sequence
  Synthetic oligonucleotide
tgatacattagcacggatgctatca

SEQ ID NO: 691629 - DNA, 25 bp, Artificial sequence
  Synthetic oligonucleotide
gctatcagcttgcgcctattatatg

SEQ ID NO: 691630 - DNA, 25 bp, Artificial sequence
  Synthetic oligonucleotide
atatgacgagactgtgcgctcatag

SEQ ID NO: 691631 - DNA, 25 bp, Artificial sequence
  Synthetic oligonucleotide
tgcgcctattatatgcctgacgcgg

SEQ ID NO: 691632 - DNA, 25 bp, Artificial sequence
  Synthetic oligonucleotide
gccgtgatcgttatatgacgagact

SEQ ID NO: 691633 - DNA, 25 bp, Artificial sequence
  Synthetic oligonucleotide
gccgtgatcgttttatgacgagact

SEQ ID NO: 691634 - DNA, 25 bp, Artificial sequence
  Synthetic oligonucleotide
atatgacgagacagtgcgctcatag

SEQ ID NO: 691635 - DNA, 25 bp, Artificial sequence
  Synthetic oligonucleotide
cagtgatacacgctgatgcacgtag

SEQ ID NO: 691636 - DNA, 25 bp, Artificial sequence
  Synthetic oligonucleotide
gctatcagcttgggcctattatatg

SEQ ID NO: 691637 - DNA, 25 bp, Artificial sequence
  Synthetic oligonucleotide
gcgtataggctgttacattagctcg

SEQ ID NO: 691638 - DNA, 25 bp, Artificial sequence
  Synthetic oligonucleotide
cgcctaaactggctgtctagcactg

SEQ ID NO: 691639 - DNA, 25 bp, Artificial sequence
  Synthetic oligonucleotide
tgatacattagcacggatgctatca

SEQ ID NO: 691640 - DNA, 25 bp, Artificial sequence
  Synthetic oligonucleotide
atatgacgagactgtgcgctcatag

SEQ ID NO: 691641 - DNA, 25 bp, Artificial sequence
  Synthetic oligonucleotide
cagtgatacacggtgatgcacgtag

SEQ ID NO: 691642 - DNA, 25 bp, Artificial sequence
  Synthetic oligonucleotide
tcggctataacagcgagtgctacgc

SEQ ID NO: 691643 - DNA, 25 bp, Artificial sequence
  Synthetic oligonucleotide
tcggctataacaccgagtgctacgc

SEQ ID NO: 691644 - DNA, 25 bp, Artificial sequence
  Synthetic oligonucleotide
cgagtgctacgcgtaaactggctgt

SEQ ID NO: 691645 - DNA, 25 bp, Artificial sequence
  Synthetic oligonucleotide
cagtgatacacgctgatgcacgtag

SEQ ID NO: 691646 - DNA, 25 bp, Artificial sequence
  Synthetic oligonucleotide
cgcctaaactgggtgtctagcactg

SEQ ID NO: 691647 - DNA, 25 bp, Artificial sequence
  Synthetic oligonucleotide
ctgtctagcactgtagctggtgcat

SEQ ID NO: 691648 - DNA, 25 bp, Artificial sequence
  Synthetic oligonucleotide
ctgtctagcactctagctggtgcat

SEQ ID NO: 691649 - DNA, 25 bp, Artificial sequence
  Synthetic oligonucleotide
gccgtgatcgttatatgacgagact

SEQ ID NO: 691650 - DNA, 25 bp, Artificial sequence
  Synthetic oligonucleotide
atatgacgagacagtgcgctcatag

SEQ ID NO: 691651 - DNA, 25 bp, Artificial sequence
  Synthetic oligonucleotide
cgagtgctacgcctaaactggctgt

SEQ ID NO: 691652 - DNA, 25 bp, Artificial sequence
  Synthetic oligonucleotide
gccgtgatcgttttatgacgagact

SEQ ID NO: 691653 - DNA, 25 bp, Artificial sequence
  Synthetic oligonucleotide
gcgtataggctgatacattagctcg

SEQ ID NO: 691654 - DNA, 25 bp, Artificial sequence
  Synthetic oligonucleotide
tgcgcctattatttgcctgacgcgg

SEQ ID NO: 691655 - DNA, 25 bp, Artificial sequence
  Synthetic oligonucleotide
tgcgcctattatatgcctgacgcgg

SEQ ID NO: 691656 - DNA, 25 bp, Artificial sequence
  Synthetic oligonucleotide
gctatcagcttgggcctattatatg

SEQ ID NO: 691657 - DNA, 25 bp, Artificial sequence
  Synthetic oligonucleotide
gctatcagcttgcgcctattatatg

SEQ ID NO: 691658 - DNA, 25 bp, Artificial sequence
  Synthetic oligonucleotide
tgatacattagctcggatgctatca

SEQ ID NO: 691659 - DNA, 25 bp, Artificial sequence
  Synthetic oligonucleotide
tatgagccgcaaagcacgactgata

SEQ ID NO: 691660 - DNA, 25 bp, Artificial sequence
  Synthetic oligonucleotide
tggtggagctatttaagccgctgtt

SEQ ID NO: 691661 - DNA, 25 bp, Artificial sequence
  Synthetic oligonucleotide
ctatgaccgcgtcatgctaactgat

SEQ ID NO: 691662 - DNA, 25 bp, Artificial sequence
  Synthetic oligonucleotide
acactgataactttgcgcagacgct

SEQ ID NO: 691663 - DNA, 25 bp, Artificial sequence
  Synthetic oligonucleotide
acactgataactatgcgcagacgct

SEQ ID NO: 691664 - DNA, 25 bp, Artificial sequence
  Synthetic oligonucleotide
tgcgcagacgcttgaaacgatgtga

SEQ ID NO: 691665 - DNA, 25 bp, Artificial sequence
  Synthetic oligonucleotide
tgcgcagacgctagaaacgatgtga

SEQ ID NO: 691666 - DNA, 25 bp, Artificial sequence
  Synthetic oligonucleotide
cttctagagtatcagccgcaatgca

SEQ ID NO: 691667 - DNA, 25 bp, Artificial sequence
  Synthetic oligonucleotide
cttctagagtatgagccgcaatgca

SEQ ID NO: 691668 - DNA, 25 bp, Artificial sequence
  Synthetic oligonucleotide
tatgagccgcaatgcacgactgata

SEQ ID NO: 691669 - DNA, 25 bp, Artificial sequence
  Synthetic oligonucleotide
ctatgaccgcgtgatgctaactgat

SEQ ID NO: 691670 - DNA, 25 bp, Artificial sequence
  Synthetic oligonucleotide
tgcaatgcttgctgtatgtatcctg

SEQ ID NO: 691671 - DNA, 25 bp, Artificial sequence
  Synthetic oligonucleotide
tgcaatgcttgcagtatgtatcctg

SEQ ID NO: 691672 - DNA, 25 bp, Artificial sequence
  Synthetic oligonucleotide
tgcgatgtctgataatacgctcgca

SEQ ID NO: 691673 - DNA, 25 bp, Artificial sequence
  Synthetic oligonucleotide
tgcgatgtctgaaaatacgctcgca

SEQ ID NO: 691674 - DNA, 25 bp, Artificial sequence
  Synthetic oligonucleotide
acgctcgcatgatatgtattgcgct

SEQ ID NO: 691675 - DNA, 25 bp, Artificial sequence
  Synthetic oligonucleotide
acgctcgcatgaaatgtattgcgct

SEQ ID NO: 691676 - DNA, 25 bp, Artificial sequence
  Synthetic oligonucleotide
ctcgcatgatatgtattgcgctcag

SEQ ID NO: 691677 - DNA, 25 bp, Artificial sequence
  Synthetic oligonucleotide
ctcgcatgatatctattgcgctcag

SEQ ID NO: 691678 - DNA, 25 bp, Artificial sequence
  Synthetic oligonucleotide
catgatatgtattgcgctcagatgc

SEQ ID NO: 691679 - DNA, 25 bp, Artificial sequence
  Synthetic oligonucleotide
tggtggagctatataagccgctgtt

SEQ ID NO: 691680 - DNA, 25 bp, Artificial sequence
  Synthetic oligonucleotide
catgatatgtatagcgctcagatgc

SEQ ID NO: 691681 - DNA, 25 bp, Artificial sequence
  Synthetic oligonucleotide
tatgagccgcaaagcacgactgata

SEQ ID NO: 691682 - DNA, 25 bp, Artificial sequence
  Synthetic oligonucleotide
tgcgcagacgctagaaacgatgtga

SEQ ID NO: 691683 - DNA, 25 bp, Artificial sequence
  Synthetic oligonucleotide
catgatatgtattgcgctcagatgc

SEQ ID NO: 691684 - DNA, 25 bp, Artificial sequence
  Synthetic oligonucleotide
tgcaatgcttgcagtatgtatcctg

SEQ ID NO: 691685 - DNA, 25 bp, Artificial sequence
  Synthetic oligonucleotide
ctatgaccgcgtgatgctaactgat

SEQ ID NO: 691686 - DNA, 25 bp, Artificial sequence
  Synthetic oligonucleotide
ctatgaccgcgtcatgctaactgat

SEQ ID NO: 691687 - DNA, 25 bp, Artificial sequence
  Synthetic oligonucleotide
acactgataactatgcgcagacgct

SEQ ID NO: 691688 - DNA, 25 bp, Artificial sequence
  Synthetic oligonucleotide
tgcgcagacgcttgaaacgatgtga

SEQ ID NO: 691689 - DNA, 25 bp, Artificial sequence
  Synthetic oligonucleotide
tggtggagctatttaagccgctgtt

SEQ ID NO: 691690 - DNA, 25 bp, Artificial sequence
  Synthetic oligonucleotide
cttctagagtatgagccgcaatgca

SEQ ID NO: 691691 - DNA, 25 bp, Artificial sequence
  Synthetic oligonucleotide
cttctagagtatcagccgcaatgca

SEQ ID NO: 691692 - DNA, 25 bp, Artificial sequence
  Synthetic oligonucleotide
ctcgcatgatatctattgcgctcag

SEQ ID NO: 691693 - DNA, 25 bp, Artificial sequence
  Synthetic oligonucleotide
catgatatgtatagcgctcagatgc

SEQ ID NO: 691694 - DNA, 25 bp, Artificial sequence
  Synthetic oligonucleotide
acactgataactttgcgcagacgct

SEQ ID NO: 691695 - DNA, 25 bp, Artificial sequence
  Synthetic oligonucleotide
ctcgcatgatatgtattgcgctcag

SEQ ID NO: 691696 - DNA, 25 bp, Artificial sequence
  Synthetic oligonucleotide
tatgagccgcaatgcacgactgata

SEQ ID NO: 691697 - DNA, 25 bp, Artificial sequence
  Synthetic oligonucleotide
acgctcgcatgaaatgtattgcgct

SEQ ID NO: 691698 - DNA, 25 bp, Artificial sequence
  Synthetic oligonucleotide
acgctcgcatgatatgtattgcgct

SEQ ID NO: 691699 - DNA, 25 bp, Artificial sequence
  Synthetic oligonucleotide
tgcgatgtctgataatacgctcgca

SEQ ID NO: 691700 - DNA, 25 bp, Artificial sequence
  Synthetic oligonucleotide
tgcgatgtctgaaaatacgctcgca

SEQ ID NO: 691701 - DNA, 25 bp, Artificial sequence
  Synthetic oligonucleotide
tgcaatgcttgctgtatgtatcctg

SEQ ID NO: 691702 - DNA, 25 bp, Artificial sequence
  Synthetic oligonucleotide
tggtggagctatataagccgctgtt

SEQ ID NO: 691703 - DNA, 25 bp, Artificial sequence
  Synthetic oligonucleotide
cgagtcgtatgtttcatgtcgggct

SEQ ID NO: 691704 - DNA, 25 bp, Artificial sequence
  Synthetic oligonucleotide
agaggatggcactcgtcattagagt

SEQ ID NO: 691705 - DNA, 25 bp, Artificial sequence
  Synthetic oligonucleotide
cattagagtgatgttctcggatcga

SEQ ID NO: 691706 - DNA, 25 bp, Artificial sequence
  Synthetic oligonucleotide
attcactaacatcgagcatcgttat

SEQ ID NO: 691707 - DNA, 25 bp, Artificial sequence
  Synthetic oligonucleotide
attcactaacatggagcatcgttat

SEQ ID NO: 691708 - DNA, 25 bp, Artificial sequence
  Synthetic oligonucleotide
taacatggagcaacgttatctaaag

SEQ ID NO: 691709 - DNA, 25 bp, Artificial sequence
  Synthetic oligonucleotide
taacatggagcatcgttatctaaag

SEQ ID NO: 691710 - DNA, 25 bp, Artificial sequence
  Synthetic oligonucleotide
attagcgagtcgtatgtatcatgtc

SEQ ID NO: 691711 - DNA, 25 bp, Artificial sequence
  Synthetic oligonucleotide
attagcgagtcgaatgtatcatgtc

SEQ ID NO: 691712 - DNA, 25 bp, Artificial sequence
  Synthetic oligonucleotide
cattagagtgatcttctcggatcga

SEQ ID NO: 691713 - DNA, 25 bp, Artificial sequence
  Synthetic oligonucleotide
cgagtcgtatgtatcatgtcgggct

SEQ ID NO: 691714 - DNA, 25 bp, Artificial sequence
  Synthetic oligonucleotide
cgtagccacaaaagtcgttaggtag

SEQ ID NO: 691715 - DNA, 25 bp, Artificial sequence
  Synthetic oligonucleotide
cgtagccacaaatgtcgttaggtag

SEQ ID NO: 691716 - DNA, 25 bp, Artificial sequence
  Synthetic oligonucleotide
gatgtcaacgcgtgttagaccgtat

SEQ ID NO: 691717 - DNA, 25 bp, Artificial sequence
  Synthetic oligonucleotide
gatgtcaacgcgagttagaccgtat

SEQ ID NO: 691718 - DNA, 25 bp, Artificial sequence
  Synthetic oligonucleotide
tggcgtacttctgaaacgtgatggg

SEQ ID NO: 691719 - DNA, 25 bp, Artificial sequence
  Synthetic oligonucleotide
tggcgtacttctcaaacgtgatggg

SEQ ID NO: 691720 - DNA, 25 bp, Artificial sequence
  Synthetic oligonucleotide
ttgggcgttgttcacccgaattcgg

SEQ ID NO: 691721 - DNA, 25 bp, Artificial sequence
  Synthetic oligonucleotide
acgtcgtctgctttaggcaaacgtc

SEQ ID NO: 691722 - DNA, 25 bp, Artificial sequence
  Synthetic oligonucleotide
agaggatggcacacgtcattagagt

SEQ ID NO: 691723 - DNA, 25 bp, Artificial sequence
  Synthetic oligonucleotide
acgtcgtctgctataggcaaacgtc

SEQ ID NO: 691724 - DNA, 25 bp, Artificial sequence
  Synthetic oligonucleotide
ttgggcgttgttgacccgaattcgg

SEQ ID NO: 691725 - DNA, 25 bp, Artificial sequence
  Synthetic oligonucleotide
attcactaacatggagcatcgttat

SEQ ID NO: 691726 - DNA, 25 bp, Artificial sequence
  Synthetic oligonucleotide
acgtcgtctgctttaggcaaacgtc

SEQ ID NO: 691727 - DNA, 25 bp, Artificial sequence
  Synthetic oligonucleotide
acgtcgtctgctataggcaaacgtc

SEQ ID NO: 691728 - DNA, 25 bp, Artificial sequence
  Synthetic oligonucleotide
agaggatggcacacgtcattagagt

SEQ ID NO: 691729 - DNA, 25 bp, Artificial sequence
  Synthetic oligonucleotide
cattagagtgatcttctcggatcga

SEQ ID NO: 691730 - DNA, 25 bp, Artificial sequence
  Synthetic oligonucleotide
attcactaacatcgagcatcgttat

SEQ ID NO: 691731 - DNA, 25 bp, Artificial sequence
  Synthetic oligonucleotide
agaggatggcactcgtcattagagt

SEQ ID NO: 691732 - DNA, 25 bp, Artificial sequence
  Synthetic oligonucleotide
taacatggagcatcgttatctaaag

SEQ ID NO: 691733 - DNA, 25 bp, Artificial sequence
  Synthetic oligonucleotide
taacatggagcaacgttatctaaag

SEQ ID NO: 691734 - DNA, 25 bp, Artificial sequence
  Synthetic oligonucleotide
attagcgagtcgaatgtatcatgtc

SEQ ID NO: 691735 - DNA, 25 bp, Artificial sequence
  Synthetic oligonucleotide
attagcgagtcgtatgtatcatgtc

SEQ ID NO: 691736 - DNA, 25 bp, Artificial sequence
  Synthetic oligonucleotide
ttgggcgttgttgacccgaattcgg

SEQ ID NO: 691737 - DNA, 25 bp, Artificial sequence
  Synthetic oligonucleotide
cattagagtgatgttctcggatcga

SEQ ID NO: 691738 - DNA, 25 bp, Artificial sequence
  Synthetic oligonucleotide
ttgggcgttgttcacccgaattcgg

SEQ ID NO: 691739 - DNA, 25 bp, Artificial sequence
  Synthetic oligonucleotide
cgagtcgtatgtttcatgtcgggct

SEQ ID NO: 691740 - DNA, 25 bp, Artificial sequence
  Synthetic oligonucleotide
tggcgtacttctgaaacgtgatggg

SEQ ID NO: 691741 - DNA, 25 bp, Artificial sequence
  Synthetic oligonucleotide
tggcgtacttctcaaacgtgatggg

SEQ ID NO: 691742 - DNA, 25 bp, Artificial sequence
  Synthetic oligonucleotide
gatgtcaacgcgagttagaccgtat

SEQ ID NO: 691743 - DNA, 25 bp, Artificial sequence
  Synthetic oligonucleotide
gatgtcaacgcgtgttagaccgtat

SEQ ID NO: 691744 - DNA, 25 bp, Artificial sequence
  Synthetic oligonucleotide
cgtagccacaaatgtcgttaggtag

SEQ ID NO: 691745 - DNA, 25 bp, Artificial sequence
  Synthetic oligonucleotide
cgtagccacaaaagtcgttaggtag

SEQ ID NO: 691746 - DNA, 25 bp, Artificial sequence
  Synthetic oligonucleotide
cgagtcgtatgtatcatgtcgggct

SEQ ID NO: 691747 - DNA, 25 bp, Artificial sequence
  Synthetic oligonucleotide
tacagcgatatagcctggattgtga

SEQ ID NO: 691748 - DNA, 25 bp, Artificial sequence
  Synthetic oligonucleotide
attgtgagcgtatttgctgtcagaa

SEQ ID NO: 691749 - DNA, 25 bp, Artificial sequence
  Synthetic oligonucleotide
attgtgagcgtaattgctgtcagaa

SEQ ID NO: 691750 - DNA, 25 bp, Artificial sequence
  Synthetic oligonucleotide
aacctcagctcaacatgtatgatgc

SEQ ID NO: 691751 - DNA, 25 bp, Artificial sequence
  Synthetic oligonucleotide
aacctcagctcatcatgtatgatgc

SEQ ID NO: 691752 - DNA, 25 bp, Artificial sequence
  Synthetic oligonucleotide
accatcctgcgaaactgaagatgca

SEQ ID NO: 691753 - DNA, 25 bp, Artificial sequence
  Synthetic oligonucleotide
accatcctgcgatactgaagatgca

SEQ ID NO: 691754 - DNA, 25 bp, Artificial sequence
  Synthetic oligonucleotide
ctgcgatactgaagatgcaccgcta

SEQ ID NO: 691755 - DNA, 25 bp, Artificial sequence
  Synthetic oligonucleotide
gcgatactgaagttgcaccgctata

SEQ ID NO: 691756 - DNA, 25 bp, Artificial sequence
  Synthetic oligonucleotide
tacagcgatataccctggattgtga

SEQ ID NO: 691757 - DNA, 25 bp, Artificial sequence
  Synthetic oligonucleotide
gctgctcgttctcaatgcgagcgag

SEQ ID NO: 691758 - DNA, 25 bp, Artificial sequence
  Synthetic oligonucleotide
gctgctcgttctgaatgcgagcgag

SEQ ID NO: 691759 - DNA, 25 bp, Artificial sequence
  Synthetic oligonucleotide
cctctacattgaaagcagatagtct

SEQ ID NO: 691760 - DNA, 25 bp, Artificial sequence
  Synthetic oligonucleotide
cctctacattgatagcagatagtct

SEQ ID NO: 691761 - DNA, 25 bp, Artificial sequence
  Synthetic oligonucleotide
atagcagatagtgtaacgggatagc

SEQ ID NO: 691762 - DNA, 25 bp, Artificial sequence
  Synthetic oligonucleotide
atagcagatagtctaacgggatagc

SEQ ID NO: 691763 - DNA, 25 bp, Artificial sequence
  Synthetic oligonucleotide
gatagtctaacgggatagcataggt

SEQ ID NO: 691764 - DNA, 25 bp, Artificial sequence
  Synthetic oligonucleotide
gatagtctaacgcgatagcataggt

SEQ ID NO: 691765 - DNA, 25 bp, Artificial sequence
  Synthetic oligonucleotide
gcataggtgcaacgctcctagcatg

SEQ ID NO: 691766 - DNA, 25 bp, Artificial sequence
  Synthetic oligonucleotide
ctgcgatactgatgatgcaccgcta

SEQ ID NO: 691767 - DNA, 25 bp, Artificial sequence
  Synthetic oligonucleotide
gcataggtgcaaggctcctagcatg

SEQ ID NO: 691768 - DNA, 25 bp, Artificial sequence
  Synthetic oligonucleotide
gcgatactgaagatgcaccgctata

SEQ ID NO: 691769 - DNA, 25 bp, Artificial sequence
  Synthetic oligonucleotide
gcgatactgaagttgcaccgctata

SEQ ID NO: 691770 - DNA, 25 bp, Artificial sequence
  Synthetic oligonucleotide
gcataggtgcaaggctcctagcatg

SEQ ID NO: 691771 - DNA, 25 bp, Artificial sequence
  Synthetic oligonucleotide
tacagcgatataccctggattgtga

SEQ ID NO: 691772 - DNA, 25 bp, Artificial sequence
  Synthetic oligonucleotide
tacagcgatatagcctggattgtga

SEQ ID NO: 691773 - DNA, 25 bp, Artificial sequence
  Synthetic oligonucleotide
attgtgagcgtaattgctgtcagaa

SEQ ID NO: 691774 - DNA, 25 bp, Artificial sequence
  Synthetic oligonucleotide
attgtgagcgtatttgctgtcagaa

SEQ ID NO: 691775 - DNA, 25 bp, Artificial sequence
  Synthetic oligonucleotide
aacctcagctcaacatgtatgatgc

SEQ ID NO: 691776 - DNA, 25 bp, Artificial sequence
  Synthetic oligonucleotide
aacctcagctcatcatgtatgatgc

SEQ ID NO: 691777 - DNA, 25 bp, Artificial sequence
  Synthetic oligonucleotide
accatcctgcgatactgaagatgca

SEQ ID NO: 691778 - DNA, 25 bp, Artificial sequence
  Synthetic oligonucleotide
accatcctgcgaaactgaagatgca

SEQ ID NO: 691779 - DNA, 25 bp, Artificial sequence
  Synthetic oligonucleotide
ctgcgatactgatgatgcaccgcta

SEQ ID NO: 691780 - DNA, 25 bp, Artificial sequence
  Synthetic oligonucleotide
gcgatactgaagatgcaccgctata

SEQ ID NO: 691781 - DNA, 25 bp, Artificial sequence
  Synthetic oligonucleotide
gctgctcgttctgaatgcgagcgag

SEQ ID NO: 691782 - DNA, 25 bp, Artificial sequence
  Synthetic oligonucleotide
gctgctcgttctcaatgcgagcgag

SEQ ID NO: 691783 - DNA, 25 bp, Artificial sequence
  Synthetic oligonucleotide
cctctacattgatagcagatagtct

SEQ ID NO: 691784 - DNA, 25 bp, Artificial sequence
  Synthetic oligonucleotide
cctctacattgaaagcagatagtct

SEQ ID NO: 691785 - DNA, 25 bp, Artificial sequence
  Synthetic oligonucleotide
atagcagatagtgtaacgggatagc

SEQ ID NO: 691786 - DNA, 25 bp, Artificial sequence
  Synthetic oligonucleotide
atagcagatagtctaacgggatagc

SEQ ID NO: 691787 - DNA, 25 bp, Artificial sequence
  Synthetic oligonucleotide
gatagtctaacgggatagcataggt

SEQ ID NO: 691788 - DNA, 25 bp, Artificial sequence
  Synthetic oligonucleotide
gatagtctaacgcgatagcataggt

SEQ ID NO: 691789 - DNA, 25 bp, Artificial sequence
  Synthetic oligonucleotide
gcataggtgcaacgctcctagcatg

SEQ ID NO: 691790 - DNA, 25 bp, Artificial sequence
  Synthetic oligonucleotide
ctgcgatactgaagatgcaccgcta

SEQ ID NO: 691791 - DNA, 25 bp, Artificial sequence
  Synthetic oligonucleotide
ttgtctaaaatttacataaaaccca

SEQ ID NO: 691792 - DNA, 25 bp, Artificial sequence
  Synthetic oligonucleotide
gaatttaatgtctttttcttgtaac

SEQ ID NO: 691793 - DNA, 25 bp, Artificial sequence
  Synthetic oligonucleotide
gaatttaatgtcattttcttgtaac

SEQ ID NO: 691794 - DNA, 25 bp, Artificial sequence
  Synthetic oligonucleotide
tatgagtaaaattcttaacaattta

SEQ ID NO: 691795 - DNA, 25 bp, Artificial sequence
  Synthetic oligonucleotide
tgagcttaaccgcaaagtagaagcg

SEQ ID NO: 691796 - DNA, 25 bp, Artificial sequence
  Synthetic oligonucleotide
tgagcttaaccggaaagtagaagcg

SEQ ID NO: 691797 - DNA, 25 bp, Artificial sequence
  Synthetic oligonucleotide
aaaatgcaacgacgagaggttcgcg

SEQ ID NO: 691798 - DNA, 25 bp, Artificial sequence
  Synthetic oligonucleotide
aaaatgcaacgaggagaggttcgcg

SEQ ID NO: 691799 - DNA, 25 bp, Artificial sequence
  Synthetic oligonucleotide
tggacaacgaagtggctcgtcatgg

SEQ ID NO: 691800 - DNA, 25 bp, Artificial sequence
  Synthetic oligonucleotide
atcattttcttcttaatttttttgg

SEQ ID NO: 691801 - DNA, 25 bp, Artificial sequence
  Synthetic oligonucleotide
caagccgttttttaaattatgtgag

SEQ ID NO: 691802 - DNA, 25 bp, Artificial sequence
  Synthetic oligonucleotide
atcattttcttcataatttttttgg

SEQ ID NO: 691803 - DNA, 25 bp, Artificial sequence
  Synthetic oligonucleotide
ttgtctaaaattaacataaaaccca

SEQ ID NO: 691804 - DNA, 25 bp, Artificial sequence
  Synthetic oligonucleotide
taaaagtaaacaaacatgcaaggct

SEQ ID NO: 691805 - DNA, 25 bp, Artificial sequence
  Synthetic oligonucleotide
taaaagtaaacatacatgcaaggct

SEQ ID NO: 691806 - DNA, 25 bp, Artificial sequence
  Synthetic oligonucleotide
gcataacgtgtgtttgggaaaccat

SEQ ID NO: 691807 - DNA, 25 bp, Artificial sequence
  Synthetic oligonucleotide
tggacaacgaagaggctcgtcatgg

SEQ ID NO: 691808 - DNA, 25 bp, Artificial sequence
  Synthetic oligonucleotide
tccatcttagattttttacaactct

SEQ ID NO: 691809 - DNA, 25 bp, Artificial sequence
  Synthetic oligonucleotide
ggaattataacgaatggccatacta

SEQ ID NO: 691810 - DNA, 25 bp, Artificial sequence
  Synthetic oligonucleotide
caatacacgacattaacaagttaac

SEQ ID NO: 691811 - DNA, 25 bp, Artificial sequence
  Synthetic oligonucleotide
gtaattagttatcaattcgctcaaa

SEQ ID NO: 691812 - DNA, 25 bp, Artificial sequence
  Synthetic oligonucleotide
gtaattagttatgaattcgctcaaa

SEQ ID NO: 691813 - DNA, 25 bp, Artificial sequence
  Synthetic oligonucleotide
taatctataaaacaacatataaact

SEQ ID NO: 691814 - DNA, 25 bp, Artificial sequence
  Synthetic oligonucleotide
taatctataaaagaacatataaact

SEQ ID NO: 691815 - DNA, 25 bp, Artificial sequence
  Synthetic oligonucleotide
ggtttttaacaaggctttacatcca

SEQ ID NO: 691816 - DNA, 25 bp, Artificial sequence
  Synthetic oligonucleotide
caactagagattatacactataaac

SEQ ID NO: 691817 - DNA, 25 bp, Artificial sequence
  Synthetic oligonucleotide
tccatcttagatattttacaactct

SEQ ID NO: 691818 - DNA, 25 bp, Artificial sequence
  Synthetic oligonucleotide
caactagagattttacactataaac

SEQ ID NO: 691819 - DNA, 25 bp, Artificial sequence
  Synthetic oligonucleotide
tactatactttattacttgttaagt

SEQ ID NO: 691820 - DNA, 25 bp, Artificial sequence
  Synthetic oligonucleotide
tactatactttaatacttgttaagt

SEQ ID NO: 691821 - DNA, 25 bp, Artificial sequence
  Synthetic oligonucleotide
tacttgattgtcgttatataaacca

SEQ ID NO: 691822 - DNA, 25 bp, Artificial sequence
  Synthetic oligonucleotide
tacttgattgtccttatataaacca

SEQ ID NO: 691823 - DNA, 25 bp, Artificial sequence
  Synthetic oligonucleotide
tttctaaaaacaattcaatgatatg

SEQ ID NO: 691824 - DNA, 25 bp, Artificial sequence
  Synthetic oligonucleotide
tttctaaaaacatttcaatgatatg

SEQ ID NO: 691825 - DNA, 25 bp, Artificial sequence
  Synthetic oligonucleotide
caagccgtttttaaaattatgtgag

SEQ ID NO: 691826 - DNA, 25 bp, Artificial sequence
  Synthetic oligonucleotide
ggtttttaacaacgctttacatcca

SEQ ID NO: 691827 - DNA, 25 bp, Artificial sequence
  Synthetic oligonucleotide
gatgcggattttcgtttcatcggca

SEQ ID NO: 691828 - DNA, 25 bp, Artificial sequence
  Synthetic oligonucleotide
tgtcggagtttcgtaccggattact

SEQ ID NO: 691829 - DNA, 25 bp, Artificial sequence
  Synthetic oligonucleotide
cacgtcgacggcaaagactatgagg

SEQ ID NO: 691830 - DNA, 25 bp, Artificial sequence
  Synthetic oligonucleotide
cacgtcgacggctaagactatgagg

SEQ ID NO: 691831 - DNA, 25 bp, Artificial sequence
  Synthetic oligonucleotide
ggcgacaataagtttcagactgatc

SEQ ID NO: 691832 - DNA, 25 bp, Artificial sequence
  Synthetic oligonucleotide
ggcgacaataagattcagactgatc

SEQ ID NO: 691833 - DNA, 25 bp, Artificial sequence
  Synthetic oligonucleotide
tccaagaagctcctctaaggcgacg

SEQ ID NO: 691834 - DNA, 25 bp, Artificial sequence
  Synthetic oligonucleotide
gcataacgtgtgattgggaaaccat

SEQ ID NO: 691835 - DNA, 25 bp, Artificial sequence
  Synthetic oligonucleotide
gatgcggattttggtttcatcggca

SEQ ID NO: 691836 - DNA, 25 bp, Artificial sequence
  Synthetic oligonucleotide
ccgtatctttacgtcatcactaacg

SEQ ID NO: 691837 - DNA, 25 bp, Artificial sequence
  Synthetic oligonucleotide
tgcagatcgttaaggagccggaggt

SEQ ID NO: 691838 - DNA, 25 bp, Artificial sequence
  Synthetic oligonucleotide
tgcagatcgttatggagccggaggt

SEQ ID NO: 691839 - DNA, 25 bp, Artificial sequence
  Synthetic oligonucleotide
aagagaaggagaggccggcgacggt

SEQ ID NO: 691840 - DNA, 25 bp, Artificial sequence
  Synthetic oligonucleotide
aagagaaggagacgccggcgacggt

SEQ ID NO: 691841 - DNA, 25 bp, Artificial sequence
  Synthetic oligonucleotide
gaagaagtgtataattgtggtgagc

SEQ ID NO: 691842 - DNA, 25 bp, Artificial sequence
  Synthetic oligonucleotide
gaagaagtgtattattgtggtgagc

SEQ ID NO: 691843 - DNA, 25 bp, Artificial sequence
  Synthetic oligonucleotide
tcaacctccggtcgagaagcctctt

SEQ ID NO: 691844 - DNA, 25 bp, Artificial sequence
  Synthetic oligonucleotide
tccaagaagctcgtctaaggcgacg

SEQ ID NO: 691845 - DNA, 25 bp, Artificial sequence
  Synthetic oligonucleotide
caagagatagagagagtaacagtga

SEQ ID NO: 691846 - DNA, 25 bp, Artificial sequence
  Synthetic oligonucleotide
tattttgagctcattcctcacgtgg

SEQ ID NO: 691847 - DNA, 25 bp, Artificial sequence
  Synthetic oligonucleotide
tattttgagctctttcctcacgtgg

SEQ ID NO: 691848 - DNA, 25 bp, Artificial sequence
  Synthetic oligonucleotide
tattgttcctgtggctatggatttc

SEQ ID NO: 691849 - DNA, 25 bp, Artificial sequence
  Synthetic oligonucleotide
tattgttcctgtcgctatggatttc

SEQ ID NO: 691850 - DNA, 25 bp, Artificial sequence
  Synthetic oligonucleotide
tctactggcgtcctagccacggcta

SEQ ID NO: 691851 - DNA, 25 bp, Artificial sequence
  Synthetic oligonucleotide
tctactggcgtcgtagccacggcta

SEQ ID NO: 691852 - DNA, 25 bp, Artificial sequence
  Synthetic oligonucleotide
cgagaaaatggcgtcgtggatgaaa

SEQ ID NO: 691853 - DNA, 25 bp, Artificial sequence
  Synthetic oligonucleotide
tgtcggagtttcctaccggattact

SEQ ID NO: 691854 - DNA, 25 bp, Artificial sequence
  Synthetic oligonucleotide
caagagatagagtgagtaacagtga

SEQ ID NO: 691855 - DNA, 25 bp, Artificial sequence
  Synthetic oligonucleotide
ccgtatctttacctcatcactaacg

SEQ ID NO: 691856 - DNA, 25 bp, Artificial sequence
  Synthetic oligonucleotide
gcgtcacaacaatatcacactcaga

SEQ ID NO: 691857 - DNA, 25 bp, Artificial sequence
  Synthetic oligonucleotide
gcgtcacaacaaaatcacactcaga

SEQ ID NO: 691858 - DNA, 25 bp, Artificial sequence
  Synthetic oligonucleotide
gaaagaataatagagtcagagctaa

SEQ ID NO: 691859 - DNA, 25 bp, Artificial sequence
  Synthetic oligonucleotide
gaaagaataatacagtcagagctaa

SEQ ID NO: 691860 - DNA, 25 bp, Artificial sequence
  Synthetic oligonucleotide
cattgtcccctcacatagctttcta

SEQ ID NO: 691861 - DNA, 25 bp, Artificial sequence
  Synthetic oligonucleotide
cattgtcccctctcatagctttcta

SEQ ID NO: 691862 - DNA, 25 bp, Artificial sequence
  Synthetic oligonucleotide
taggatcggccataagaaaccggtg

SEQ ID NO: 691863 - DNA, 25 bp, Artificial sequence
  Synthetic oligonucleotide
cgagaaaatggcctcgtggatgaaa

SEQ ID NO: 691864 - DNA, 25 bp, Artificial sequence
  Synthetic oligonucleotide
aataagacataaacaacaacaaaaa

SEQ ID NO: 691865 - DNA, 25 bp, Artificial sequence
  Synthetic oligonucleotide
tcaacctccggtggagaagcctctt

SEQ ID NO: 691866 - DNA, 25 bp, Artificial sequence
  Synthetic oligonucleotide
aaggtgaagaagctgaaagtgtcac

SEQ ID NO: 691867 - DNA, 25 bp, Artificial sequence
  Synthetic oligonucleotide
tctattcttagaaccaacggtatgt

SEQ ID NO: 691868 - DNA, 25 bp, Artificial sequence
  Synthetic oligonucleotide
tctattcttagatccaacggtatgt

SEQ ID NO: 691869 - DNA, 25 bp, Artificial sequence
  Synthetic oligonucleotide
atctactgcccctaaacaatcctga

SEQ ID NO: 691870 - DNA, 25 bp, Artificial sequence
  Synthetic oligonucleotide
atctactgccccaaaacaatcctga

SEQ ID NO: 691871 - DNA, 25 bp, Artificial sequence
  Synthetic oligonucleotide
tctactcttgttatgtttatacaag

SEQ ID NO: 691872 - DNA, 25 bp, Artificial sequence
  Synthetic oligonucleotide
ttaccagtctctcccgccgccacct

SEQ ID NO: 691873 - DNA, 25 bp, Artificial sequence
  Synthetic oligonucleotide
aataagacataatcaacaacaaaaa

SEQ ID NO: 691874 - DNA, 25 bp, Artificial sequence
  Synthetic oligonucleotide
ttaccagtctctgccgccgccacct

SEQ ID NO: 691875 - DNA, 25 bp, Artificial sequence
  Synthetic oligonucleotide
cacgtgaagcttagagtacgtgtca

SEQ ID NO: 691876 - DNA, 25 bp, Artificial sequence
  Synthetic oligonucleotide
cacgtgaagctttgagtacgtgtca

SEQ ID NO: 691877 - DNA, 25 bp, Artificial sequence
  Synthetic oligonucleotide
caattatgggataaaattaagagac

SEQ ID NO: 691878 - DNA, 25 bp, Artificial sequence
  Synthetic oligonucleotide
caattatgggattaaattaagagac

SEQ ID NO: 691879 - DNA, 25 bp, Artificial sequence
  Synthetic oligonucleotide
gaattattatttcacgtatataaga

SEQ ID NO: 691880 - DNA, 25 bp, Artificial sequence
  Synthetic oligonucleotide
gaattattatttgacgtatataaga

SEQ ID NO: 691881 - DNA, 25 bp, Artificial sequence
  Synthetic oligonucleotide
gcgaagagacaaaacaatcaggtgt

SEQ ID NO: 691882 - DNA, 25 bp, Artificial sequence
  Synthetic oligonucleotide
tctactcttgttttgtttatacaag

SEQ ID NO: 691883 - DNA, 25 bp, Artificial sequence
  Synthetic oligonucleotide
cgttagagaataggtggaagatgat

SEQ ID NO: 691884 - DNA, 25 bp, Artificial sequence
  Synthetic oligonucleotide
ggaattataacgtatggccatacta

SEQ ID NO: 691885 - DNA, 25 bp, Artificial sequence
  Synthetic oligonucleotide
caccagcaggtattttaatttagat

SEQ ID NO: 691886 - DNA, 25 bp, Artificial sequence
  Synthetic oligonucleotide
caccagcaggtaatttaatttagat

SEQ ID NO: 691887 - DNA, 25 bp, Artificial sequence
  Synthetic oligonucleotide
taaggtgacgtcttccgaatttaga

SEQ ID NO: 691888 - DNA, 25 bp, Artificial sequence
  Synthetic oligonucleotide
taaggtgacgtcatccgaatttaga

SEQ ID NO: 691889 - DNA, 25 bp, Artificial sequence
  Synthetic oligonucleotide
taatttcgtaatttttcagaaagga

SEQ ID NO: 691890 - DNA, 25 bp, Artificial sequence
  Synthetic oligonucleotide
taatttcgtaatatttcagaaagga

SEQ ID NO: 691891 - DNA, 25 bp, Artificial sequence
  Synthetic oligonucleotide
aaggtgaagaaggtgaaagtgtcac

SEQ ID NO: 691892 - DNA, 25 bp, Artificial sequence
  Synthetic oligonucleotide
gcgttgagagttgcgaaaccgaaac

SEQ ID NO: 691893 - DNA, 25 bp, Artificial sequence
  Synthetic oligonucleotide
taggatcggccaaaagaaaccggtg

SEQ ID NO: 691894 - DNA, 25 bp, Artificial sequence
  Synthetic oligonucleotide
cgttagagaatacgtggaagatgat

SEQ ID NO: 691895 - DNA, 25 bp, Artificial sequence
  Synthetic oligonucleotide
aggcaacaagtcaacgcttccgttg

SEQ ID NO: 691896 - DNA, 25 bp, Artificial sequence
  Synthetic oligonucleotide
aggcaacaagtctacgcttccgttg

SEQ ID NO: 691897 - DNA, 25 bp, Artificial sequence
  Synthetic oligonucleotide
tattacaagagagccgacacgttcg

SEQ ID NO: 691898 - DNA, 25 bp, Artificial sequence
  Synthetic oligonucleotide
gcgaagagacaatacaatcaggtgt

SEQ ID NO: 691899 - DNA, 25 bp, Artificial sequence
  Synthetic oligonucleotide
aatcggagacgtatagtgacagaac

SEQ ID NO: 691900 - DNA, 25 bp, Artificial sequence
  Synthetic oligonucleotide
aatcggagacgtttagtgacagaac

SEQ ID NO: 691901 - DNA, 25 bp, Artificial sequence
  Synthetic oligonucleotide
gcgttgagagttccgaaaccgaaac

SEQ ID NO: 691902 - DNA, 25 bp, Artificial sequence
  Synthetic oligonucleotide
caagctctaaacggttttcgttcgc

SEQ ID NO: 691903 - DNA, 25 bp, Artificial sequence
  Synthetic oligonucleotide
gattaatttgttatgtggtaggata

SEQ ID NO: 691904 - DNA, 25 bp, Artificial sequence
  Synthetic oligonucleotide
aagctgatccacctccaaccagaaa

SEQ ID NO: 691905 - DNA, 25 bp, Artificial sequence
  Synthetic oligonucleotide
aagctgatccacgtccaaccagaaa

SEQ ID NO: 691906 - DNA, 25 bp, Artificial sequence
  Synthetic oligonucleotide
gacttaattaatcccaatcccacca

SEQ ID NO: 691907 - DNA, 25 bp, Artificial sequence
  Synthetic oligonucleotide
gacttaattaatgccaatcccacca

SEQ ID NO: 691908 - DNA, 25 bp, Artificial sequence
  Synthetic oligonucleotide
ggactattccctctgcaacacataa

SEQ ID NO: 691909 - DNA, 25 bp, Artificial sequence
  Synthetic oligonucleotide
ggactattccctgtgcaacacataa

SEQ ID NO: 691910 - DNA, 25 bp, Artificial sequence
  Synthetic oligonucleotide
taagaatggaactaggcgaaaaatt

SEQ ID NO: 691911 - DNA, 25 bp, Artificial sequence
  Synthetic oligonucleotide
taagaatggaacaaggcgaaaaatt

SEQ ID NO: 691912 - DNA, 25 bp, Artificial sequence
  Synthetic oligonucleotide
ttaaacttgacccaatgtagcagtg

SEQ ID NO: 691913 - DNA, 25 bp, Artificial sequence
  Synthetic oligonucleotide
ttaaacttgaccgaatgtagcagtg

SEQ ID NO: 691914 - DNA, 25 bp, Artificial sequence
  Synthetic oligonucleotide
gattaatttgttttgtggtaggata

SEQ ID NO: 691915 - DNA, 25 bp, Artificial sequence
  Synthetic oligonucleotide
tattgagatgagacttttttgtgtc

SEQ ID NO: 691916 - DNA, 25 bp, Artificial sequence
  Synthetic oligonucleotide
aaagtagtcctggaaaccttaatgg

SEQ ID NO: 691917 - DNA, 25 bp, Artificial sequence
  Synthetic oligonucleotide
caagctctaaaccgttttcgttcgc

SEQ ID NO: 691918 - DNA, 25 bp, Artificial sequence
  Synthetic oligonucleotide
gacttagattaaggagaaaaatctc

SEQ ID NO: 691919 - DNA, 25 bp, Artificial sequence
  Synthetic oligonucleotide
gacttagattaacgagaaaaatctc

SEQ ID NO: 691920 - DNA, 25 bp, Artificial sequence
  Synthetic oligonucleotide
tatgcacattacaaaaatcctagac

SEQ ID NO: 691921 - DNA, 25 bp, Artificial sequence
  Synthetic oligonucleotide
tatgcacattactaaaatcctagac

SEQ ID NO: 691922 - DNA, 25 bp, Artificial sequence
  Synthetic oligonucleotide
aaaccttcagctctcaactaaatag

SEQ ID NO: 691923 - DNA, 25 bp, Artificial sequence
  Synthetic oligonucleotide
aaaccttcagctgtcaactaaatag

SEQ ID NO: 691924 - DNA, 25 bp, Artificial sequence
  Synthetic oligonucleotide
tctgttgttgagctggcaaagctac

SEQ ID NO: 691925 - DNA, 25 bp, Artificial sequence
  Synthetic oligonucleotide
tctgttgttgaggtggcaaagctac

SEQ ID NO: 691926 - DNA, 25 bp, Artificial sequence
  Synthetic oligonucleotide
aaagtagtcctgcaaaccttaatgg

SEQ ID NO: 691927 - DNA, 25 bp, Artificial sequence
  Synthetic oligonucleotide
tattacaagagacccgacacgttcg

SEQ ID NO: 691928 - DNA, 25 bp, Artificial sequence
  Synthetic oligonucleotide
caatacacgacaataacaagttaac

SEQ ID NO: 691929 - DNA, 25 bp, Artificial sequence
  Synthetic oligonucleotide
tattgagatgagtcttttttgtgtc

SEQ ID NO: 691930 - DNA, 25 bp, Artificial sequence
  Synthetic oligonucleotide
caaagatattagataatgggaacac

SEQ ID NO: 691931 - DNA, 25 bp, Artificial sequence
  Synthetic oligonucleotide
gtcacggataaacaaaatctctgct

SEQ ID NO: 691932 - DNA, 25 bp, Artificial sequence
  Synthetic oligonucleotide
gtcacggataaagaaaatctctgct

SEQ ID NO: 691933 - DNA, 25 bp, Artificial sequence
  Synthetic oligonucleotide
tattgattggataagggtggaattg

SEQ ID NO: 691934 - DNA, 25 bp, Artificial sequence
  Synthetic oligonucleotide
tagtgatatttcatcttcgttaaca

SEQ ID NO: 691935 - DNA, 25 bp, Artificial sequence
  Synthetic oligonucleotide
tagtgatatttcttcttcgttaaca

SEQ ID NO: 691936 - DNA, 25 bp, Artificial sequence
  Synthetic oligonucleotide
tatgagtaaaatacttaacaattta

SEQ ID NO: 691937 - DNA, 25 bp, Artificial sequence
  Synthetic oligonucleotide
ttgaatagatattttctcctctgcg

SEQ ID NO: 691938 - DNA, 25 bp, Artificial sequence
  Synthetic oligonucleotide
tattgattggattagggtggaattg

SEQ ID NO: 691939 - DNA, 25 bp, Artificial sequence
  Synthetic oligonucleotide
caaagatattagttaatgggaacac

SEQ ID NO: 691940 - DNA, 25 bp, Artificial sequence
  Synthetic oligonucleotide
caatctactttataatgctctttct

SEQ ID NO: 691941 - DNA, 25 bp, Artificial sequence
  Synthetic oligonucleotide
caatctactttaaaatgctctttct

SEQ ID NO: 691942 - DNA, 25 bp, Artificial sequence
  Synthetic oligonucleotide
aacaaataaacaaaggtacattatc

SEQ ID NO: 691943 - DNA, 25 bp, Artificial sequence
  Synthetic oligonucleotide
tcatctcaagacttacaagcacatt

SEQ ID NO: 691944 - DNA, 25 bp, Artificial sequence
  Synthetic oligonucleotide
ttgaatagatatattctcctctgcg

SEQ ID NO: 691945 - DNA, 25 bp, Artificial sequence
  Synthetic oligonucleotide
tcatctcaagacatacaagcacatt

SEQ ID NO: 691946 - DNA, 25 bp, Artificial sequence
  Synthetic oligonucleotide
aacaaataaacataggtacattatc

SEQ ID NO: 691947 - DNA, 25 bp, Artificial sequence
  Synthetic oligonucleotide
cgtgaaaagcgtactgttgaatgat

SEQ ID NO: 691948 - DNA, 25 bp, Artificial sequence
  Synthetic oligonucleotide
cgtgaaaagcgttctgttgaatgat

SEQ ID NO: 691949 - DNA, 25 bp, Artificial sequence
  Synthetic oligonucleotide
tctcatcttagcatcagtttctcca

SEQ ID NO: 691950 - DNA, 25 bp, Artificial sequence
  Synthetic oligonucleotide
gaaagagtctgctctctcagaatca

SEQ ID NO: 691951 - DNA, 25 bp, Artificial sequence
  Synthetic oligonucleotide
gaaagagtctgcactctcagaatca

SEQ ID NO: 691952 - DNA, 25 bp, Artificial sequence
  Synthetic oligonucleotide
aaagaagaagattagatcttctctg

SEQ ID NO: 691953 - DNA, 25 bp, Artificial sequence
  Synthetic oligonucleotide
aaagaagaagataagatcttctctg

SEQ ID NO: 691954 - DNA, 25 bp, Artificial sequence
  Synthetic oligonucleotide
tagtggtaacattacaacattaaca

SEQ ID NO: 691955 - DNA, 25 bp, Artificial sequence
  Synthetic oligonucleotide
tagtggtaacataacaacattaaca

SEQ ID NO: 691956 - DNA, 25 bp, Artificial sequence
  Synthetic oligonucleotide
tctcatcttagcttcagtttctcca

SEQ ID NO: 691957 - DNA, 25 bp, Artificial sequence
  Synthetic oligonucleotide
tgagagttacataacagatggttga

SEQ ID NO: 691958 - DNA, 25 bp, Artificial sequence
  Synthetic oligonucleotide
ggtatttgttcttcctcacattact

SEQ ID NO: 691959 - DNA, 25 bp, Artificial sequence
  Synthetic oligonucleotide
ggtatttgttctacctcacattact

SEQ ID NO: 691960 - DNA, 25 bp, Artificial sequence
  Synthetic oligonucleotide
caacagtggctgagagatatgtact

SEQ ID NO: 691961 - DNA, 25 bp, Artificial sequence
  Synthetic oligonucleotide
caacagtggctgtgagatatgtact

SEQ ID NO: 691962 - DNA, 25 bp, Artificial sequence
  Synthetic oligonucleotide
tgaagaccatatccacaaaacatgg

SEQ ID NO: 691963 - DNA, 25 bp, Artificial sequence
  Synthetic oligonucleotide
tgaagaccatatgcacaaaacatgg

SEQ ID NO: 691964 - DNA, 25 bp, Artificial sequence
  Synthetic oligonucleotide
gggtggaatctaattcaaggtttac

SEQ ID NO: 691965 - DNA, 25 bp, Artificial sequence
  Synthetic oligonucleotide
tgcatgatcatcgtactttgtactg

SEQ ID NO: 691966 - DNA, 25 bp, Artificial sequence
  Synthetic oligonucleotide
tgagagttacattacagatggttga

SEQ ID NO: 691967 - DNA, 25 bp, Artificial sequence
  Synthetic oligonucleotide
tgcatgatcatcctactttgtactg

SEQ ID NO: 691968 - DNA, 25 bp, Artificial sequence
  Synthetic oligonucleotide
gggtggaatctatttcaaggtttac

SEQ ID NO: 691969 - DNA, 25 bp, Artificial sequence
  Synthetic oligonucleotide
ccaatctggtttttgatttgtcgga

SEQ ID NO: 691970 - DNA, 25 bp, Artificial sequence
  Synthetic oligonucleotide
ccaatctggtttatgatttgtcgga

SEQ ID NO: 691971 - DNA, 25 bp, Artificial sequence
  Synthetic oligonucleotide
tatcatctcagcaaggagttggtgg

SEQ ID NO: 691972 - DNA, 25 bp, Artificial sequence
  Synthetic oligonucleotide
tatcatctcagctaggagttggtgg

SEQ ID NO: 691973 - DNA, 25 bp, Artificial sequence
  Synthetic oligonucleotide
tgagactcgggtaagcggaacacat

SEQ ID NO: 691974 - DNA, 25 bp, Artificial sequence
  Synthetic oligonucleotide
tgagactcgggttagcggaacacat

SEQ ID NO: 691975 - DNA, 25 bp, Artificial sequence
  Synthetic oligonucleotide
gctatattctcaatggtattggatg

SEQ ID NO: 691976 - DNA, 25 bp, Artificial sequence
  Synthetic oligonucleotide
gctatattctcattggtattggatg

SEQ ID NO: 691977 - DNA, 25 bp, Artificial sequence
  Synthetic oligonucleotide
taatagcatacaagaggttaccaag

SEQ ID NO: 691978 - DNA, 25 bp, Artificial sequence
  Synthetic oligonucleotide
taatagcatacatgaggttaccaag

SEQ ID NO: 691979 - DNA, 25 bp, Artificial sequence
  Synthetic oligonucleotide
tctccaagtgattggtgactgcgga

SEQ ID NO: 691980 - DNA, 25 bp, Artificial sequence
  Synthetic oligonucleotide
gggtcaaacttaaaacgtaattata

SEQ ID NO: 691981 - DNA, 25 bp, Artificial sequence
  Synthetic oligonucleotide
ccgacgtatatgttgtgtagctatg

SEQ ID NO: 691982 - DNA, 25 bp, Artificial sequence
  Synthetic oligonucleotide
tctccaagtgataggtgactgcgga

SEQ ID NO: 691983 - DNA, 25 bp, Artificial sequence
  Synthetic oligonucleotide
gggtcaaacttataacgtaattata

SEQ ID NO: 691984 - DNA, 25 bp, Artificial sequence
  Synthetic oligonucleotide
tgaattgttcggaggagattacgga

SEQ ID NO: 691985 - DNA, 25 bp, Artificial sequence
  Synthetic oligonucleotide
ccgacgtatatgatgtgtagctatg

SEQ ID NO: 691986 - DNA, 25 bp, Artificial sequence
  Synthetic oligonucleotide
agaatggaatccgtgtcgttagcaa

SEQ ID NO: 691987 - DNA, 25 bp, Artificial sequence
  Synthetic oligonucleotide
agaatggaatccctgtcgttagcaa

SEQ ID NO: 691988 - DNA, 25 bp, Artificial sequence
  Synthetic oligonucleotide
tgtcagcccgatgtccgaacattat

SEQ ID NO: 691989 - DNA, 25 bp, Artificial sequence
  Synthetic oligonucleotide
tgtcagcccgatctccgaacattat

SEQ ID NO: 691990 - DNA, 25 bp, Artificial sequence
  Synthetic oligonucleotide
ttttttttgtaaatctctaactctc

SEQ ID NO: 691991 - DNA, 25 bp, Artificial sequence
  Synthetic oligonucleotide
ttttttttgtaattctctaactctc

SEQ ID NO: 691992 - DNA, 25 bp, Artificial sequence
  Synthetic oligonucleotide
ttccaggtgcaagactccatcgtag

SEQ ID NO: 691993 - DNA, 25 bp, Artificial sequence
  Synthetic oligonucleotide
ttccaggtgcaacactccatcgtag

SEQ ID NO: 691994 - DNA, 25 bp, Artificial sequence
  Synthetic oligonucleotide
ttttgatttctctctttaaaactga

SEQ ID NO: 691995 - DNA, 25 bp, Artificial sequence
  Synthetic oligonucleotide
tcaacagagaatggctcagctttgc

SEQ ID NO: 691996 - DNA, 25 bp, Artificial sequence
  Synthetic oligonucleotide
caatggccgttcttgttttatgagt

SEQ ID NO: 691997 - DNA, 25 bp, Artificial sequence
  Synthetic oligonucleotide
ttttgatttctcactttaaaactga

SEQ ID NO: 691998 - DNA, 25 bp, Artificial sequence
  Synthetic oligonucleotide
tgactaattttgatacagagagact

SEQ ID NO: 691999 - DNA, 25 bp, Artificial sequence
  Synthetic oligonucleotide
catcgttggtctatgtgtgtagata

SEQ ID NO: 692000 - DNA, 25 bp, Artificial sequence
  Synthetic oligonucleotide
catcgttggtctttgtgtgtagata

SEQ ID NO: 692001 - DNA, 25 bp, Artificial sequence
  Synthetic oligonucleotide
agttatgggtggtctcttgtcagag

SEQ ID NO: 692002 - DNA, 25 bp, Artificial sequence
  Synthetic oligonucleotide
agttatgggtggactcttgtcagag

SEQ ID NO: 692003 - DNA, 25 bp, Artificial sequence
  Synthetic oligonucleotide
caatctaacaatcccttttgctggc

SEQ ID NO: 692004 - DNA, 25 bp, Artificial sequence
  Synthetic oligonucleotide
caatctaacaatgccttttgctggc

SEQ ID NO: 692005 - DNA, 25 bp, Artificial sequence
  Synthetic oligonucleotide
catctctccaaatatacaaaagggt

SEQ ID NO: 692006 - DNA, 25 bp, Artificial sequence
  Synthetic oligonucleotide
catctctccaaaaatacaaaagggt

SEQ ID NO: 692007 - DNA, 25 bp, Artificial sequence
  Synthetic oligonucleotide
caatggccgttcatgttttatgagt

SEQ ID NO: 692008 - DNA, 25 bp, Artificial sequence
  Synthetic oligonucleotide
tcaacagagaatcgctcagctttgc

SEQ ID NO: 692009 - DNA, 25 bp, Artificial sequence
  Synthetic oligonucleotide
tataattcaacacaaaactcatgat

SEQ ID NO: 692010 - DNA, 25 bp, Artificial sequence
  Synthetic oligonucleotide
gaccaacaggttacctcgatgtcga

SEQ ID NO: 692011 - DNA, 25 bp, Artificial sequence
  Synthetic oligonucleotide
gaccaacaggtttcctcgatgtcga

SEQ ID NO: 692012 - DNA, 25 bp, Artificial sequence
  Synthetic oligonucleotide
catggcctatgttaagcaggagcgg

SEQ ID NO: 692013 - DNA, 25 bp, Artificial sequence
  Synthetic oligonucleotide
catggcctatgtaaagcaggagcgg

SEQ ID NO: 692014 - DNA, 25 bp, Artificial sequence
  Synthetic oligonucleotide
gatgattatgtgcacaagagcacta

SEQ ID NO: 692015 - DNA, 25 bp, Artificial sequence
  Synthetic oligonucleotide
gatgattatgtggacaagagcacta

SEQ ID NO: 692016 - DNA, 25 bp, Artificial sequence
  Synthetic oligonucleotide
catatttgattttatacagaagaaa

SEQ ID NO: 692017 - DNA, 25 bp, Artificial sequence
  Synthetic oligonucleotide
catatttgatttaatacagaagaaa

SEQ ID NO: 692018 - DNA, 25 bp, Artificial sequence
  Synthetic oligonucleotide
ggaacattggttaaaaatacacgca

SEQ ID NO: 692019 - DNA, 25 bp, Artificial sequence
  Synthetic oligonucleotide
ggaacattggtttaaaatacacgca

SEQ ID NO: 692020 - DNA, 25 bp, Artificial sequence
  Synthetic oligonucleotide
agtgtgattctaggcttttttcatc

SEQ ID NO: 692021 - DNA, 25 bp, Artificial sequence
  Synthetic oligonucleotide
ggaacatactcatacaaatttggca

SEQ ID NO: 692022 - DNA, 25 bp, Artificial sequence
  Synthetic oligonucleotide
tataattcaacagaaaactcatgat

SEQ ID NO: 692023 - DNA, 25 bp, Artificial sequence
  Synthetic oligonucleotide
gaatccagaatagacctgttcaact

SEQ ID NO: 692024 - DNA, 25 bp, Artificial sequence
  Synthetic oligonucleotide
caatttatgcttttaatcacgagta

SEQ ID NO: 692025 - DNA, 25 bp, Artificial sequence
  Synthetic oligonucleotide
caatttatgcttataatcacgagta

SEQ ID NO: 692026 - DNA, 25 bp, Artificial sequence
  Synthetic oligonucleotide
ggcaccaaatttctatattttctct

SEQ ID NO: 692027 - DNA, 25 bp, Artificial sequence
  Synthetic oligonucleotide
ggcaccaaatttgtatattttctct

SEQ ID NO: 692028 - DNA, 25 bp, Artificial sequence
  Synthetic oligonucleotide
tctcgcatgtacgtacgccaagaaa

SEQ ID NO: 692029 - DNA, 25 bp, Artificial sequence
  Synthetic oligonucleotide
tctcgcatgtacctacgccaagaaa

SEQ ID NO: 692030 - DNA, 25 bp, Artificial sequence
  Synthetic oligonucleotide
cgagaatggagcagcctacttcatt

SEQ ID NO: 692031 - DNA, 25 bp, Artificial sequence
  Synthetic oligonucleotide
cgagaatggagctgcctacttcatt

SEQ ID NO: 692032 - DNA, 25 bp, Artificial sequence
  Synthetic oligonucleotide
cgtaaaacttaacgtgcaccattct

SEQ ID NO: 692033 - DNA, 25 bp, Artificial sequence
  Synthetic oligonucleotide
cgtaaaacttaaggtgcaccattct

SEQ ID NO: 692034 - DNA, 25 bp, Artificial sequence
  Synthetic oligonucleotide
cattgtatttaaaatcactcccaca

SEQ ID NO: 692035 - DNA, 25 bp, Artificial sequence
  Synthetic oligonucleotide
agtgtgattctacgcttttttcatc

SEQ ID NO: 692036 - DNA, 25 bp, Artificial sequence
  Synthetic oligonucleotide
ggcaaataccacttcttattgaaaa

SEQ ID NO: 692037 - DNA, 25 bp, Artificial sequence
  Synthetic oligonucleotide
tgtatacaatatgatcaactcatgt

SEQ ID NO: 692038 - DNA, 25 bp, Artificial sequence
  Synthetic oligonucleotide
ttatgtgtagaggaatcatttttac

SEQ ID NO: 692039 - DNA, 25 bp, Artificial sequence
  Synthetic oligonucleotide
ttatgtgtagagcaatcatttttac

SEQ ID NO: 692040 - DNA, 25 bp, Artificial sequence
  Synthetic oligonucleotide
gacttctctggcattatttcttttg

SEQ ID NO: 692041 - DNA, 25 bp, Artificial sequence
  Synthetic oligonucleotide
gacttctctggctttatttcttttg

SEQ ID NO: 692042 - DNA, 25 bp, Artificial sequence
  Synthetic oligonucleotide
gcatgtttggagagacaatactaat

SEQ ID NO: 692043 - DNA, 25 bp, Artificial sequence
  Synthetic oligonucleotide
gcatgtttggagtgacaatactaat

SEQ ID NO: 692044 - DNA, 25 bp, Artificial sequence
  Synthetic oligonucleotide
gctacatgtaaggtatagagtaaac

SEQ ID NO: 692045 - DNA, 25 bp, Artificial sequence
  Synthetic oligonucleotide
gctacatgtaagctatagagtaaac

SEQ ID NO: 692046 - DNA, 25 bp, Artificial sequence
  Synthetic oligonucleotide
aaggtaagtaaacatagttttatca

SEQ ID NO: 692047 - DNA, 25 bp, Artificial sequence
  Synthetic oligonucleotide
aaggtaagtaaagatagttttatca

SEQ ID NO: 692048 - DNA, 25 bp, Artificial sequence
  Synthetic oligonucleotide
acaatgtataccacttgtttgaggg

SEQ ID NO: 692049 - DNA, 25 bp, Artificial sequence
  Synthetic oligonucleotide
acttagcaattctttgattcaaagg

SEQ ID NO: 692050 - DNA, 25 bp, Artificial sequence
  Synthetic oligonucleotide
gatggtcctgctgaagatctttacg

SEQ ID NO: 692051 - DNA, 25 bp, Artificial sequence
  Synthetic oligonucleotide
ggcaaataccacatcttattgaaaa

SEQ ID NO: 692052 - DNA, 25 bp, Artificial sequence
  Synthetic oligonucleotide
taattattcagaggacatgaccaag

SEQ ID NO: 692053 - DNA, 25 bp, Artificial sequence
  Synthetic oligonucleotide
taattattcagacgacatgaccaag

SEQ ID NO: 692054 - DNA, 25 bp, Artificial sequence
  Synthetic oligonucleotide
tgaaaacaaaatatatgaaaagaaa

SEQ ID NO: 692055 - DNA, 25 bp, Artificial sequence
  Synthetic oligonucleotide
tgaaaacaaaatttatgaaaagaaa

SEQ ID NO: 692056 - DNA, 25 bp, Artificial sequence
  Synthetic oligonucleotide
tagctcccagcacatcttcttttgg

SEQ ID NO: 692057 - DNA, 25 bp, Artificial sequence
  Synthetic oligonucleotide
tagctcccagcagatcttcttttgg

SEQ ID NO: 692058 - DNA, 25 bp, Artificial sequence
  Synthetic oligonucleotide
cagactacttcagagctggctttga

SEQ ID NO: 692059 - DNA, 25 bp, Artificial sequence
  Synthetic oligonucleotide
cagactacttcacagctggctttga

SEQ ID NO: 692060 - DNA, 25 bp, Artificial sequence
  Synthetic oligonucleotide
ggaacatactcaaacaaatttggca

SEQ ID NO: 692061 - DNA, 25 bp, Artificial sequence
  Synthetic oligonucleotide
tgactaattttgttacagagagact

SEQ ID NO: 692062 - DNA, 25 bp, Artificial sequence
  Synthetic oligonucleotide
tgtatacaatatcatcaactcatgt

SEQ ID NO: 692063 - DNA, 25 bp, Artificial sequence
  Synthetic oligonucleotide
acttagcaattcattgattcaaagg

SEQ ID NO: 692064 - DNA, 25 bp, Artificial sequence
  Synthetic oligonucleotide
cctaaagttacacatatagaaagcg

SEQ ID NO: 692065 - DNA, 25 bp, Artificial sequence
  Synthetic oligonucleotide
gaggccatgcctgtgtccgtacatt

SEQ ID NO: 692066 - DNA, 25 bp, Artificial sequence
  Synthetic oligonucleotide
tacaaatctgttagagatttagacc

SEQ ID NO: 692067 - DNA, 25 bp, Artificial sequence
  Synthetic oligonucleotide
tacaaatctgtttgagatttagacc

SEQ ID NO: 692068 - DNA, 25 bp, Artificial sequence
  Synthetic oligonucleotide
tcgttcaaaaactgtaatatctatt

SEQ ID NO: 692069 - DNA, 25 bp, Artificial sequence
  Synthetic oligonucleotide
tcgttcaaaaacagtaatatctatt

SEQ ID NO: 692070 - DNA, 25 bp, Artificial sequence
  Synthetic oligonucleotide
aaaaatagaacaatatgcggcgaac

SEQ ID NO: 692071 - DNA, 25 bp, Artificial sequence
  Synthetic oligonucleotide
aaaaatagaacattatgcggcgaac

SEQ ID NO: 692072 - DNA, 25 bp, Artificial sequence
  Synthetic oligonucleotide
caacgtaaagataaatttggtatgc

SEQ ID NO: 692073 - DNA, 25 bp, Artificial sequence
  Synthetic oligonucleotide
caacgtaaagattaatttggtatgc

SEQ ID NO: 692074 - DNA, 25 bp, Artificial sequence
  Synthetic oligonucleotide
tgcatactccaaaaataaaatggtt

SEQ ID NO: 692075 - DNA, 25 bp, Artificial sequence
  Synthetic oligonucleotide
tgcatactccaataataaaatggtt

SEQ ID NO: 692076 - DNA, 25 bp, Artificial sequence
  Synthetic oligonucleotide
tacttaaacttcgaatgattgtggc

SEQ ID NO: 692077 - DNA, 25 bp, Artificial sequence
  Synthetic oligonucleotide
gatgtttagtcctttttgcacacag

SEQ ID NO: 692078 - DNA, 25 bp, Artificial sequence
  Synthetic oligonucleotide
gtggttctaaaacaacaatctcaag

SEQ ID NO: 692079 - DNA, 25 bp, Artificial sequence
  Synthetic oligonucleotide
cctaaagttacagatatagaaagcg

SEQ ID NO: 692080 - DNA, 25 bp, Artificial sequence
  Synthetic oligonucleotide
caagatactctagatatttgctttt

SEQ ID NO: 692081 - DNA, 25 bp, Artificial sequence
  Synthetic oligonucleotide
caagatactctacatatttgctttt

SEQ ID NO: 692082 - DNA, 25 bp, Artificial sequence
  Synthetic oligonucleotide
caatcggcagtttgagttttgaggt

SEQ ID NO: 692083 - DNA, 25 bp, Artificial sequence
  Synthetic oligonucleotide
caatcggcagttagagttttgaggt

SEQ ID NO: 692084 - DNA, 25 bp, Artificial sequence
  Synthetic oligonucleotide
tcgaagcgtggagggtctaaattaa

SEQ ID NO: 692085 - DNA, 25 bp, Artificial sequence
  Synthetic oligonucleotide
tcgaagcgtggacggtctaaattaa

SEQ ID NO: 692086 - DNA, 25 bp, Artificial sequence
  Synthetic oligonucleotide
gaattagaggcccataagccacaga

SEQ ID NO: 692087 - DNA, 25 bp, Artificial sequence
  Synthetic oligonucleotide
gaattagaggccgataagccacaga

SEQ ID NO: 692088 - DNA, 25 bp, Artificial sequence
  Synthetic oligonucleotide
ttttcctcttccaccgagagagaag

SEQ ID NO: 692089 - DNA, 25 bp, Artificial sequence
  Synthetic oligonucleotide
caatagagttcgtcgagagcgtcca

SEQ ID NO: 692090 - DNA, 25 bp, Artificial sequence
  Synthetic oligonucleotide
gatgtttagtccattttgcacacag

SEQ ID NO: 692091 - DNA, 25 bp, Artificial sequence
  Synthetic oligonucleotide
taaaaatgttactgccttacagtct

SEQ ID NO: 692092 - DNA, 25 bp, Artificial sequence
  Synthetic oligonucleotide
caattcgtatcttttttaaagttaa

SEQ ID NO: 692093 - DNA, 25 bp, Artificial sequence
  Synthetic oligonucleotide
caattcgtatctattttaaagttaa

SEQ ID NO: 692094 - DNA, 25 bp, Artificial sequence
  Synthetic oligonucleotide
tagtaaaaattatggaataaagcta

SEQ ID NO: 692095 - DNA, 25 bp, Artificial sequence
  Synthetic oligonucleotide
tagtaaaaattaaggaataaagcta

SEQ ID NO: 692096 - DNA, 25 bp, Artificial sequence
  Synthetic oligonucleotide
acaatgtatacctcttgtttgaggg

SEQ ID NO: 692097 - DNA, 25 bp, Artificial sequence
  Synthetic oligonucleotide
ccatagtagtataatacttttaaaa

SEQ ID NO: 692098 - DNA, 25 bp, Artificial sequence
  Synthetic oligonucleotide
cattgtatttaatatcactcccaca

SEQ ID NO: 692099 - DNA, 25 bp, Artificial sequence
  Synthetic oligonucleotide
ccatagtagtattatacttttaaaa

SEQ ID NO: 692100 - DNA, 25 bp, Artificial sequence
  Synthetic oligonucleotide
tttccaaataaatacatatgttttc

SEQ ID NO: 692101 - DNA, 25 bp, Artificial sequence
  Synthetic oligonucleotide
tttccaaataaaaacatatgttttc

SEQ ID NO: 692102 - DNA, 25 bp, Artificial sequence
  Synthetic oligonucleotide
gataatttagaaatcagaaaaatca

SEQ ID NO: 692103 - DNA, 25 bp, Artificial sequence
  Synthetic oligonucleotide
tacttaaacttccaatgattgtggc

SEQ ID NO: 692104 - DNA, 25 bp, Artificial sequence
  Synthetic oligonucleotide
taaaaatgttacagccttacagtct

SEQ ID NO: 692105 - DNA, 25 bp, Artificial sequence
  Synthetic oligonucleotide
gaggccatgcctctgtccgtacatt

SEQ ID NO: 692106 - DNA, 25 bp, Artificial sequence
  Synthetic oligonucleotide
tacatgaccaacattttgaaagaac

SEQ ID NO: 692107 - DNA, 25 bp, Artificial sequence
  Synthetic oligonucleotide
tacatgaccaactttttgaaagaac

SEQ ID NO: 692108 - DNA, 25 bp, Artificial sequence
  Synthetic oligonucleotide
aatattgcaatgatttacatcagcg

SEQ ID NO: 692109 - DNA, 25 bp, Artificial sequence
  Synthetic oligonucleotide
aatattgcaatgttttacatcagcg

SEQ ID NO: 692110 - DNA, 25 bp, Artificial sequence
  Synthetic oligonucleotide
gaaagaaaaacacattgaagattag

SEQ ID NO: 692111 - DNA, 25 bp, Artificial sequence
  Synthetic oligonucleotide
gaaagaaaaacagattgaagattag

SEQ ID NO: 692112 - DNA, 25 bp, Artificial sequence
  Synthetic oligonucleotide
tgacaaatttagattaacaaatagg

SEQ ID NO: 692113 - DNA, 25 bp, Artificial sequence
  Synthetic oligonucleotide
tgacaaatttagtttaacaaatagg

SEQ ID NO: 692114 - DNA, 25 bp, Artificial sequence
  Synthetic oligonucleotide
caaacataccttttttctaaatgta

SEQ ID NO: 692115 - DNA, 25 bp, Artificial sequence
  Synthetic oligonucleotide
caaacataccttatttctaaatgta

SEQ ID NO: 692116 - DNA, 25 bp, Artificial sequence
  Synthetic oligonucleotide
gtggttctaaaagaacaatctcaag

SEQ ID NO: 692117 - DNA, 25 bp, Artificial sequence
  Synthetic oligonucleotide
gataatttagaattcagaaaaatca

SEQ ID NO: 692118 - DNA, 25 bp, Artificial sequence
  Synthetic oligonucleotide
ggtgtgtgttactctcgtcgcttaa

SEQ ID NO: 692119 - DNA, 25 bp, Artificial sequence
  Synthetic oligonucleotide
ttttcctcttcctccgagagagaag

SEQ ID NO: 692120 - DNA, 25 bp, Artificial sequence
  Synthetic oligonucleotide
cttggagaagattaaagggtaagca

SEQ ID NO: 692121 - DNA, 25 bp, Artificial sequence
  Synthetic oligonucleotide
gattagaatttgtataagatatggt

SEQ ID NO: 692122 - DNA, 25 bp, Artificial sequence
  Synthetic oligonucleotide
gattagaatttgaataagatatggt

SEQ ID NO: 692123 - DNA, 25 bp, Artificial sequence
  Synthetic oligonucleotide
aatggttaggctatatttaatgatg

SEQ ID NO: 692124 - DNA, 25 bp, Artificial sequence
  Synthetic oligonucleotide
aatggttaggctttatttaatgatg

SEQ ID NO: 692125 - DNA, 25 bp, Artificial sequence
  Synthetic oligonucleotide
tgggtgcctcctccaataaagatga

SEQ ID NO: 692126 - DNA, 25 bp, Artificial sequence
  Synthetic oligonucleotide
tgggtgcctcctgcaataaagatga

SEQ ID NO: 692127 - DNA, 25 bp, Artificial sequence
  Synthetic oligonucleotide
gttcgtcagaacatcgatatatcga

SEQ ID NO: 692128 - DNA, 25 bp, Artificial sequence
  Synthetic oligonucleotide
gttcgtcagaacttcgatatatcga

SEQ ID NO: 692129 - DNA, 25 bp, Artificial sequence
  Synthetic oligonucleotide
gatgtggctgctcttgatatgcttc

SEQ ID NO: 692130 - DNA, 25 bp, Artificial sequence
  Synthetic oligonucleotide
caatagagttcgacgagagcgtcca

SEQ ID NO: 692131 - DNA, 25 bp, Artificial sequence
  Synthetic oligonucleotide
ggtgtgtgttacactcgtcgcttaa

SEQ ID NO: 692132 - DNA, 25 bp, Artificial sequence
  Synthetic oligonucleotide
gatggtcctgctcaagatctttacg

SEQ ID NO: 692133 - DNA, 25 bp, Artificial sequence
  Synthetic oligonucleotide
gacgtttcctatcttcttgctaaag

SEQ ID NO: 692134 - DNA, 25 bp, Artificial sequence
  Synthetic oligonucleotide
gacgtttcctatgttcttgctaaag

SEQ ID NO: 692135 - DNA, 25 bp, Artificial sequence
  Synthetic oligonucleotide
gaataggtgggaatatgcgaatgac

SEQ ID NO: 692136 - DNA, 25 bp, Artificial sequence
  Synthetic oligonucleotide
gaataggtgggattatgcgaatgac

SEQ ID NO: 692137 - DNA, 25 bp, Artificial sequence
  Synthetic oligonucleotide
tgcactgaaacatctcacagacttg

SEQ ID NO: 692138 - DNA, 25 bp, Artificial sequence
  Synthetic oligonucleotide
tgcactgaaacaactcacagacttg

SEQ ID NO: 692139 - DNA, 25 bp, Artificial sequence
  Synthetic oligonucleotide
gcgagaggggctatatctttctcct

SEQ ID NO: 692140 - DNA, 25 bp, Artificial sequence
  Synthetic oligonucleotide
gcgagaggggctttatctttctcct

SEQ ID NO: 692141 - DNA, 25 bp, Artificial sequence
  Synthetic oligonucleotide
tctatttgtttaactattgggctgc

SEQ ID NO: 692142 - DNA, 25 bp, Artificial sequence
  Synthetic oligonucleotide
tctatttgtttatctattgggctgc

SEQ ID NO: 692143 - DNA, 25 bp, Artificial sequence
  Synthetic oligonucleotide
tattgaaatgctttcagggaaaatc

SEQ ID NO: 692144 - DNA, 25 bp, Artificial sequence
  Synthetic oligonucleotide
gatgtggctgctgttgatatgcttc

SEQ ID NO: 692145 - DNA, 25 bp, Artificial sequence
  Synthetic oligonucleotide
tcgatatggctgatcactgtaagta

SEQ ID NO: 692146 - DNA, 25 bp, Artificial sequence
  Synthetic oligonucleotide
gaacctagccacaacactatcatcg

SEQ ID NO: 692147 - DNA, 25 bp, Artificial sequence
  Synthetic oligonucleotide
gaacctagccactacactatcatcg

SEQ ID NO: 692148 - DNA, 25 bp, Artificial sequence
  Synthetic oligonucleotide
gtttctcgccgtagaactatctcca

SEQ ID NO: 692149 - DNA, 25 bp, Artificial sequence
  Synthetic oligonucleotide
gtttctcgccgttgaactatctcca

SEQ ID NO: 692150 - DNA, 25 bp, Artificial sequence
  Synthetic oligonucleotide
tgaattgttcggtggagattacgga

SEQ ID NO: 692151 - DNA, 25 bp, Artificial sequence
  Synthetic oligonucleotide
tcggtgaaactgtagaacgggaacg

SEQ ID NO: 692152 - DNA, 25 bp, Artificial sequence
  Synthetic oligonucleotide
tcggtgaaactgaagaacgggaacg

SEQ ID NO: 692153 - DNA, 25 bp, Artificial sequence
  Synthetic oligonucleotide
tatgcagagttctcaacgggatgtg

SEQ ID NO: 692154 - DNA, 25 bp, Artificial sequence
  Synthetic oligonucleotide
tatgcagagttcacaacgggatgtg

SEQ ID NO: 692155 - DNA, 25 bp, Artificial sequence
  Synthetic oligonucleotide
atgggggaagattgatcgaaacgac

SEQ ID NO: 692156 - DNA, 25 bp, Artificial sequence
  Synthetic oligonucleotide
atgggggaagatagatcgaaacgac

SEQ ID NO: 692157 - DNA, 25 bp, Artificial sequence
  Synthetic oligonucleotide
cttggagaagataaaagggtaagca

SEQ ID NO: 692158 - DNA, 25 bp, Artificial sequence
  Synthetic oligonucleotide
caatgcttcgtttcgccgatgctgg

SEQ ID NO: 692159 - DNA, 25 bp, Artificial sequence
  Synthetic oligonucleotide
tattgaaatgctatcagggaaaatc

SEQ ID NO: 692160 - DNA, 25 bp, Artificial sequence
  Synthetic oligonucleotide
tcgatatggctgttcactgtaagta

SEQ ID NO: 692161 - DNA, 25 bp, Artificial sequence
  Synthetic oligonucleotide
aattgaatattctgaattgacttga

SEQ ID NO: 692162 - DNA, 25 bp, Artificial sequence
  Synthetic oligonucleotide
aattgaatattcagaattgacttga

SEQ ID NO: 692163 - DNA, 25 bp, Artificial sequence
  Synthetic oligonucleotide
gtggagattagttatagaactgtgc

SEQ ID NO: 692164 - DNA, 25 bp, Artificial sequence
  Synthetic oligonucleotide
gtggagattagtaatagaactgtgc

SEQ ID NO: 692165 - DNA, 25 bp, Artificial sequence
  Synthetic oligonucleotide
cttgatgaccttgaatgtgtggagc

SEQ ID NO: 692166 - DNA, 25 bp, Artificial sequence
  Synthetic oligonucleotide
cttgatgaccttcaatgtgtggagc

SEQ ID NO: 692167 - DNA, 25 bp, Artificial sequence
  Synthetic oligonucleotide
cacagaagaattcaattgtgtggag

SEQ ID NO: 692168 - DNA, 25 bp, Artificial sequence
  Synthetic oligonucleotide
cacagaagaattgaattgtgtggag

SEQ ID NO: 692169 - DNA, 25 bp, Artificial sequence
  Synthetic oligonucleotide
agagttgtgcttagtttgttttcta

SEQ ID NO: 692170 - DNA, 25 bp, Artificial sequence
  Synthetic oligonucleotide
agagttgtgctttgtttgttttcta

SEQ ID NO: 692171 - DNA, 25 bp, Artificial sequence
  Synthetic oligonucleotide
caatgcttcgttacgccgatgctgg

SEQ ID NO: 692172 - DNA, 25 bp, Artificial sequence
  Synthetic oligonucleotide
gaatccagaatacacctgttcaact

SEQ ID NO: 692173 - DNA, 25 bp, Artificial sequence
  Synthetic oligonucleotide
tcctctacctgaacaattcattttg

SEQ ID NO: 692174 - DNA, 25 bp, Artificial sequence
  Synthetic oligonucleotide
taagagagtctattgcggatactca

SEQ ID NO: 692175 - DNA, 25 bp, Artificial sequence
  Synthetic oligonucleotide
taagagagtctaatgcggatactca

SEQ ID NO: 692176 - DNA, 25 bp, Artificial sequence
  Synthetic oligonucleotide
gcagaagcctacatcttcccagtca

SEQ ID NO: 692177 - DNA, 25 bp, Artificial sequence
  Synthetic oligonucleotide
gcagaagcctacttcttcccagtca

SEQ ID NO: 692178 - DNA, 25 bp, Artificial sequence
  Synthetic oligonucleotide
ggtgcattctctaccggtaactgaa

SEQ ID NO: 692179 - DNA, 25 bp, Artificial sequence
  Synthetic oligonucleotide
ggtgcattctcttccggtaactgaa

SEQ ID NO: 692180 - DNA, 25 bp, Artificial sequence
  Synthetic oligonucleotide
tgcgaatacgcataaaactactcct

SEQ ID NO: 692181 - DNA, 25 bp, Artificial sequence
  Synthetic oligonucleotide
tgcgaatacgcaaaaaactactcct

SEQ ID NO: 692182 - DNA, 25 bp, Artificial sequence
  Synthetic oligonucleotide
cacaagctgaggtaagaacgttgac

SEQ ID NO: 692183 - DNA, 25 bp, Artificial sequence
  Synthetic oligonucleotide
tctcattcgcaagttcagttcagag

SEQ ID NO: 692184 - DNA, 25 bp, Artificial sequence
  Synthetic oligonucleotide
caacacttcgttttgcagaagcccg

SEQ ID NO: 692185 - DNA, 25 bp, Artificial sequence
  Synthetic oligonucleotide
tcctctacctgatcaattcattttg

SEQ ID NO: 692186 - DNA, 25 bp, Artificial sequence
  Synthetic oligonucleotide
taccactcctgtacccactgtggtg

SEQ ID NO: 692187 - DNA, 25 bp, Artificial sequence
  Synthetic oligonucleotide
cacaaaaagttttaataatgttgtc

SEQ ID NO: 692188 - DNA, 25 bp, Artificial sequence
  Synthetic oligonucleotide
taccactcctgttcccactgtggtg

SEQ ID NO: 692189 - DNA, 25 bp, Artificial sequence
  Synthetic oligonucleotide
cacaagctgagtaaagagacgctct

SEQ ID NO: 692190 - DNA, 25 bp, Artificial sequence
  Synthetic oligonucleotide
cacaagctgagttaagagacgctct

SEQ ID NO: 692191 - DNA, 25 bp, Artificial sequence
  Synthetic oligonucleotide
ggtgccttctcttcctctgcctgaa

SEQ ID NO: 692192 - DNA, 25 bp, Artificial sequence
  Synthetic oligonucleotide
ggtgccttctctacctctgcctgaa

SEQ ID NO: 692193 - DNA, 25 bp, Artificial sequence
  Synthetic oligonucleotide
tctcattcgcaacttcagttcagag

SEQ ID NO: 692194 - DNA, 25 bp, Artificial sequence
  Synthetic oligonucleotide
taagagcgaataggcgcaaagctac

SEQ ID NO: 692195 - DNA, 25 bp, Artificial sequence
  Synthetic oligonucleotide
cacaaaaagtttaaataatgttgtc

SEQ ID NO: 692196 - DNA, 25 bp, Artificial sequence
  Synthetic oligonucleotide
tgaacattacagactactcaagcct

SEQ ID NO: 692197 - DNA, 25 bp, Artificial sequence
  Synthetic oligonucleotide
tgaacattacagtctactcaagcct

SEQ ID NO: 692198 - DNA, 25 bp, Artificial sequence
  Synthetic oligonucleotide
tgttcacgcagctgcgataccttct

SEQ ID NO: 692199 - DNA, 25 bp, Artificial sequence
  Synthetic oligonucleotide
tgttcacgcagcagcgataccttct

SEQ ID NO: 692200 - DNA, 25 bp, Artificial sequence
  Synthetic oligonucleotide
gctgagttaagaccgaagacgcgca

SEQ ID NO: 692201 - DNA, 25 bp, Artificial sequence
  Synthetic oligonucleotide
gctgagttaagagcgaagacgcgca

SEQ ID NO: 692202 - DNA, 25 bp, Artificial sequence
  Synthetic oligonucleotide
ttacagtctacagaagccttcaact

SEQ ID NO: 692203 - DNA, 25 bp, Artificial sequence
  Synthetic oligonucleotide
cctcttcaaacagagatttcttctc

SEQ ID NO: 692204 - DNA, 25 bp, Artificial sequence
  Synthetic oligonucleotide
taagagcgaatacgcgcaaagctac

SEQ ID NO: 692205 - DNA, 25 bp, Artificial sequence
  Synthetic oligonucleotide
cctcttcaaacacagatttcttctc

SEQ ID NO: 692206 - DNA, 25 bp, Artificial sequence
  Synthetic oligonucleotide
gcagaagcctgcaacttctcaatca

SEQ ID NO: 692207 - DNA, 25 bp, Artificial sequence
  Synthetic oligonucleotide
gcagaagcctgctacttctcaatca

SEQ ID NO: 692208 - DNA, 25 bp, Artificial sequence
  Synthetic oligonucleotide
tactgccttctcatcctgtacctga

SEQ ID NO: 692209 - DNA, 25 bp, Artificial sequence
  Synthetic oligonucleotide
tactgccttctcttcctgtacctga

SEQ ID NO: 692210 - DNA, 25 bp, Artificial sequence
  Synthetic oligonucleotide
tcacaagcggatacacacgaaacta

SEQ ID NO: 692211 - DNA, 25 bp, Artificial sequence
  Synthetic oligonucleotide
tcacaagcggattcacacgaaacta

SEQ ID NO: 692212 - DNA, 25 bp, Artificial sequence
  Synthetic oligonucleotide
caacacttcgttatgcagaagcccg

SEQ ID NO: 692213 - DNA, 25 bp, Artificial sequence
  Synthetic oligonucleotide
tctcctcaattacaagctgggttta

SEQ ID NO: 692214 - DNA, 25 bp, Artificial sequence
  Synthetic oligonucleotide
agcagcgatgccttctcttcctgta

SEQ ID NO: 692215 - DNA, 25 bp, Artificial sequence
  Synthetic oligonucleotide
tctggatacgaaatgtttctccact

SEQ ID NO: 692216 - DNA, 25 bp, Artificial sequence
  Synthetic oligonucleotide
gaggttacgcaagatagtacctttg

SEQ ID NO: 692217 - DNA, 25 bp, Artificial sequence
  Synthetic oligonucleotide
gattcattcactgcaaatttccttc

SEQ ID NO: 692218 - DNA, 25 bp, Artificial sequence
  Synthetic oligonucleotide
ccgcggattatactaagattacaag

SEQ ID NO: 692219 - DNA, 25 bp, Artificial sequence
  Synthetic oligonucleotide
ccgcggattatagtaagattacaag

SEQ ID NO: 692220 - DNA, 25 bp, Artificial sequence
  Synthetic oligonucleotide
tactggtagtttggattgtaatatc

SEQ ID NO: 692221 - DNA, 25 bp, Artificial sequence
  Synthetic oligonucleotide
tactggtagtttcgattgtaatatc

SEQ ID NO: 692222 - DNA, 25 bp, Artificial sequence
  Synthetic oligonucleotide
tagggtttgatcgtctctctttcaa

SEQ ID NO: 692223 - DNA, 25 bp, Artificial sequence
  Synthetic oligonucleotide
tagggtttgatcctctctctttcaa

SEQ ID NO: 692224 - DNA, 25 bp, Artificial sequence
  Synthetic oligonucleotide
cttggaaacttcagataacaaatcg

SEQ ID NO: 692225 - DNA, 25 bp, Artificial sequence
  Synthetic oligonucleotide
tctccgtctgcttagaaaataaaac

SEQ ID NO: 692226 - DNA, 25 bp, Artificial sequence
  Synthetic oligonucleotide
cttggaaacttctgataacaaatcg

SEQ ID NO: 692227 - DNA, 25 bp, Artificial sequence
  Synthetic oligonucleotide
tctggatacgaattgtttctccact

SEQ ID NO: 692228 - DNA, 25 bp, Artificial sequence
  Synthetic oligonucleotide
caaaggtatgagaagactatccgac

SEQ ID NO: 692229 - DNA, 25 bp, Artificial sequence
  Synthetic oligonucleotide
caaaggtatgagtagactatccgac

SEQ ID NO: 692230 - DNA, 25 bp, Artificial sequence
  Synthetic oligonucleotide
gaaagtcatcgtcactcccagaaag

SEQ ID NO: 692231 - DNA, 25 bp, Artificial sequence
  Synthetic oligonucleotide
gaaagtcatcgtgactcccagaaag

SEQ ID NO: 692232 - DNA, 25 bp, Artificial sequence
  Synthetic oligonucleotide
aaaagatttggtgcggtcggagaga

SEQ ID NO: 692233 - DNA, 25 bp, Artificial sequence
  Synthetic oligonucleotide
aaaagatttggtccggtcggagaga

SEQ ID NO: 692234 - DNA, 25 bp, Artificial sequence
  Synthetic oligonucleotide
ttaacaatcgaatcaaaacaaaatg

SEQ ID NO: 692235 - DNA, 25 bp, Artificial sequence
  Synthetic oligonucleotide
ttaacaatcgaaacaaaacaaaatg

SEQ ID NO: 692236 - DNA, 25 bp, Artificial sequence
  Synthetic oligonucleotide
tctccgtctgctaagaaaataaaac

SEQ ID NO: 692237 - DNA, 25 bp, Artificial sequence
  Synthetic oligonucleotide
tcaggttacaatcgcgaagctaagg

SEQ ID NO: 692238 - DNA, 25 bp, Artificial sequence
  Synthetic oligonucleotide
tacccatgttcagacagcgatgcct

SEQ ID NO: 692239 - DNA, 25 bp, Artificial sequence
  Synthetic oligonucleotide
tctcctcaattagaagctgggttta

SEQ ID NO: 692240 - DNA, 25 bp, Artificial sequence
  Synthetic oligonucleotide
caacaacagcatttcactttggaga

SEQ ID NO: 692241 - DNA, 25 bp, Artificial sequence
  Synthetic oligonucleotide
caacaacagcatatcactttggaga

SEQ ID NO: 692242 - DNA, 25 bp, Artificial sequence
  Synthetic oligonucleotide
agcagaaaatctacattgtcttgcc

SEQ ID NO: 692243 - DNA, 25 bp, Artificial sequence
  Synthetic oligonucleotide
agcagaaaatcttcattgtcttgcc

SEQ ID NO: 692244 - DNA, 25 bp, Artificial sequence
  Synthetic oligonucleotide
ttttgatggagatgaagacgcttgg

SEQ ID NO: 692245 - DNA, 25 bp, Artificial sequence
  Synthetic oligonucleotide
ttttgatggagaagaagacgcttgg

SEQ ID NO: 692246 - DNA, 25 bp, Artificial sequence
  Synthetic oligonucleotide
gattcattcactccaaatttccttc

SEQ ID NO: 692247 - DNA, 25 bp, Artificial sequence
  Synthetic oligonucleotide
gaactgagcaagtctgttccttcca

SEQ ID NO: 692248 - DNA, 25 bp, Artificial sequence
  Synthetic oligonucleotide
gaggttacgcaacatagtacctttg

SEQ ID NO: 692249 - DNA, 25 bp, Artificial sequence
  Synthetic oligonucleotide
tcaggttacaatggcgaagctaagg

SEQ ID NO: 692250 - DNA, 25 bp, Artificial sequence
  Synthetic oligonucleotide
tggtttccttttagcttgatgttgt

SEQ ID NO: 692251 - DNA, 25 bp, Artificial sequence
  Synthetic oligonucleotide
tggtttcctttttgcttgatgttgt

SEQ ID NO: 692252 - DNA, 25 bp, Artificial sequence
  Synthetic oligonucleotide
ccttgtgatttttgaataaattgtg

SEQ ID NO: 692253 - DNA, 25 bp, Artificial sequence
  Synthetic oligonucleotide
ccttgtgattttagaataaattgtg

SEQ ID NO: 692254 - DNA, 25 bp, Artificial sequence
  Synthetic oligonucleotide
agcatacttctcgaattctctttgg

SEQ ID NO: 692255 - DNA, 25 bp, Artificial sequence
  Synthetic oligonucleotide
agcatacttctccaattctctttgg

SEQ ID NO: 692256 - DNA, 25 bp, Artificial sequence
  Synthetic oligonucleotide
gaacatgtttttcttcttcttgtga

SEQ ID NO: 692257 - DNA, 25 bp, Artificial sequence
  Synthetic oligonucleotide
gaacatgtttttgttcttcttgtga

SEQ ID NO: 692258 - DNA, 25 bp, Artificial sequence
  Synthetic oligonucleotide
gaactgagcaagactgttccttcca

SEQ ID NO: 692259 - DNA, 25 bp, Artificial sequence
  Synthetic oligonucleotide
cataaatctttctatttgagtggaa

SEQ ID NO: 692260 - DNA, 25 bp, Artificial sequence
  Synthetic oligonucleotide
aaaaacattttatttgagttgtcgc

SEQ ID NO: 692261 - DNA, 25 bp, Artificial sequence
  Synthetic oligonucleotide
aaaaacattttaattgagttgtcgc

SEQ ID NO: 692262 - DNA, 25 bp, Artificial sequence
  Synthetic oligonucleotide
ccttcataaaaaatgaaacatatta

SEQ ID NO: 692263 - DNA, 25 bp, Artificial sequence
  Synthetic oligonucleotide
ccttcataaaaattgaaacatatta

SEQ ID NO: 692264 - DNA, 25 bp, Artificial sequence
  Synthetic oligonucleotide
tatcacgactaatacatgctagttg

SEQ ID NO: 692265 - DNA, 25 bp, Artificial sequence
  Synthetic oligonucleotide
tatcacgactaaaacatgctagttg

SEQ ID NO: 692266 - DNA, 25 bp, Artificial sequence
  Synthetic oligonucleotide
gaatgtaagaattaaaaaaagcgta

SEQ ID NO: 692267 - DNA, 25 bp, Artificial sequence
  Synthetic oligonucleotide
gaatgtaagaataaaaaaaagcgta

SEQ ID NO: 692268 - DNA, 25 bp, Artificial sequence
  Synthetic oligonucleotide
cacaagctgaggaaagaacgttgac

SEQ ID NO: 692269 - DNA, 25 bp, Artificial sequence
  Synthetic oligonucleotide
cttgattcccctaacttgaaagtaa

SEQ ID NO: 692270 - DNA, 25 bp, Artificial sequence
  Synthetic oligonucleotide
tatcccatcaactacaactattatg

SEQ ID NO: 692271 - DNA, 25 bp, Artificial sequence
  Synthetic oligonucleotide
cataaatctttcaatttgagtggaa

SEQ ID NO: 692272 - DNA, 25 bp, Artificial sequence
  Synthetic oligonucleotide
agtagaaacactagaaccctaattc

SEQ ID NO: 692273 - DNA, 25 bp, Artificial sequence
  Synthetic oligonucleotide
agtagaaacacttgaaccctaattc

SEQ ID NO: 692274 - DNA, 25 bp, Artificial sequence
  Synthetic oligonucleotide
tggaaacgtatggaatgactaaaca

SEQ ID NO: 692275 - DNA, 25 bp, Artificial sequence
  Synthetic oligonucleotide
tggaaacgtatgcaatgactaaaca

SEQ ID NO: 692276 - DNA, 25 bp, Artificial sequence
  Synthetic oligonucleotide
ccaaaattcaggttaatcattatag

SEQ ID NO: 692277 - DNA, 25 bp, Artificial sequence
  Synthetic oligonucleotide
ccaaaattcaggataatcattatag

SEQ ID NO: 692278 - DNA, 25 bp, Artificial sequence
  Synthetic oligonucleotide
cactaaaggatcaagaaccagaaac

SEQ ID NO: 692279 - DNA, 25 bp, Artificial sequence
  Synthetic oligonucleotide
cttgattccccttacttgaaagtaa

SEQ ID NO: 692280 - DNA, 25 bp, Artificial sequence
  Synthetic oligonucleotide
gtcacattgaggaatctttggcggg

SEQ ID NO: 692281 - DNA, 25 bp, Artificial sequence
  Synthetic oligonucleotide
tttaataaaatctccgccgtctgaa

SEQ ID NO: 692282 - DNA, 25 bp, Artificial sequence
  Synthetic oligonucleotide
tttaataaaatcaccgccgtctgaa

SEQ ID NO: 692283 - DNA, 25 bp, Artificial sequence
  Synthetic oligonucleotide
acctgacggcgaggaccggtgattc

SEQ ID NO: 692284 - DNA, 25 bp, Artificial sequence
  Synthetic oligonucleotide
acctgacggcgacgaccggtgattc

SEQ ID NO: 692285 - DNA, 25 bp, Artificial sequence
  Synthetic oligonucleotide
taaaaaaagaaataagaggaggcga

SEQ ID NO: 692286 - DNA, 25 bp, Artificial sequence
  Synthetic oligonucleotide
taaaaaaagaaaaaagaggaggcga

SEQ ID NO: 692287 - DNA, 25 bp, Artificial sequence
  Synthetic oligonucleotide
ctccgatgtttcaatcgtgaaatcg

SEQ ID NO: 692288 - DNA, 25 bp, Artificial sequence
  Synthetic oligonucleotide
ctccgatgtttctatcgtgaaatcg

SEQ ID NO: 692289 - DNA, 25 bp, Artificial sequence
  Synthetic oligonucleotide
cgatgtaccctaaatatagttccaa

SEQ ID NO: 692290 - DNA, 25 bp, Artificial sequence
  Synthetic oligonucleotide
tacctataaaaaaggcggccgcaaa

SEQ ID NO: 692291 - DNA, 25 bp, Artificial sequence
  Synthetic oligonucleotide
cgatgtaccctatatatagttccaa

SEQ ID NO: 692292 - DNA, 25 bp, Artificial sequence
  Synthetic oligonucleotide
gtcacattgaggtatctttggcggg

SEQ ID NO: 692293 - DNA, 25 bp, Artificial sequence
  Synthetic oligonucleotide
cgagccagatgtcaggtaccttgag

SEQ ID NO: 692294 - DNA, 25 bp, Artificial sequence
  Synthetic oligonucleotide
cgagccagatgtgaggtaccttgag

SEQ ID NO: 692295 - DNA, 25 bp, Artificial sequence
  Synthetic oligonucleotide
tgcacacagacctatggacgtagag

SEQ ID NO: 692296 - DNA, 25 bp, Artificial sequence
  Synthetic oligonucleotide
tgcacacagaccaatggacgtagag

SEQ ID NO: 692297 - DNA, 25 bp, Artificial sequence
  Synthetic oligonucleotide
agtaaaagaaactaatcttatctgg

SEQ ID NO: 692298 - DNA, 25 bp, Artificial sequence
  Synthetic oligonucleotide
agtaaaagaaacaaatcttatctgg

SEQ ID NO: 692299 - DNA, 25 bp, Artificial sequence
  Synthetic oligonucleotide
tatcccatcaacaacaactattatg

SEQ ID NO: 692300 - DNA, 25 bp, Artificial sequence
  Synthetic oligonucleotide
aatatcattatattgcttcttcttc

SEQ ID NO: 692301 - DNA, 25 bp, Artificial sequence
  Synthetic oligonucleotide
tacctataaaaatggcggccgcaaa

SEQ ID NO: 692302 - DNA, 25 bp, Artificial sequence
  Synthetic oligonucleotide
ggaaagctccagcaccaaagagatc

SEQ ID NO: 692303 - DNA, 25 bp, Artificial sequence
  Synthetic oligonucleotide
cactaaaggatctagaaccagaaac

SEQ ID NO: 692304 - DNA, 25 bp, Artificial sequence
  Synthetic oligonucleotide
tgttgaatctggtgaagaaggttga

SEQ ID NO: 692305 - DNA, 25 bp, Artificial sequence
  Synthetic oligonucleotide
tgttgaatctggagaagaaggttga

SEQ ID NO: 692306 - DNA, 25 bp, Artificial sequence
  Synthetic oligonucleotide
tgtgtagctctgatgttatggataa

SEQ ID NO: 692307 - DNA, 25 bp, Artificial sequence
  Synthetic oligonucleotide
tgtgtagctctgttgttatggataa

SEQ ID NO: 692308 - DNA, 25 bp, Artificial sequence
  Synthetic oligonucleotide
cgtgcgggtcacaagcccataaggt

SEQ ID NO: 692309 - DNA, 25 bp, Artificial sequence
  Synthetic oligonucleotide
cgtgcgggtcactagcccataaggt

SEQ ID NO: 692310 - DNA, 25 bp, Artificial sequence
  Synthetic oligonucleotide
taggaagaatcacgatagaagagtg

SEQ ID NO: 692311 - DNA, 25 bp, Artificial sequence
  Synthetic oligonucleotide
gaacgaatgggttggatctatagga

SEQ ID NO: 692312 - DNA, 25 bp, Artificial sequence
  Synthetic oligonucleotide
ggaaagctccaggaccaaagagatc

SEQ ID NO: 692313 - DNA, 25 bp, Artificial sequence
  Synthetic oligonucleotide
tttgagaggatgatgagaggacaga

SEQ ID NO: 692314 - DNA, 25 bp, Artificial sequence
  Synthetic oligonucleotide
aaaccggagatacttatgagtcgca

SEQ ID NO: 692315 - DNA, 25 bp, Artificial sequence
  Synthetic oligonucleotide
aaaccggagatagttatgagtcgca

SEQ ID NO: 692316 - DNA, 25 bp, Artificial sequence
  Synthetic oligonucleotide
gaacctgaggccagtcctgatttca

SEQ ID NO: 692317 - DNA, 25 bp, Artificial sequence
  Synthetic oligonucleotide
gaacctgaggcctgtcctgatttca

SEQ ID NO: 692318 - DNA, 25 bp, Artificial sequence
  Synthetic oligonucleotide
tcgcaagctgaaactagtcgtgttc

SEQ ID NO: 692319 - DNA, 25 bp, Artificial sequence
  Synthetic oligonucleotide
tcgcaagctgaatctagtcgtgttc

SEQ ID NO: 692320 - DNA, 25 bp, Artificial sequence
  Synthetic oligonucleotide
gaacattgcactttgcagaagcctg

SEQ ID NO: 692321 - DNA, 25 bp, Artificial sequence
  Synthetic oligonucleotide
gaacattgcactatgcagaagcctg

SEQ ID NO: 692322 - DNA, 25 bp, Artificial sequence
  Synthetic oligonucleotide
tacccatgttcacacagcgatgcct

SEQ ID NO: 692323 - DNA, 25 bp, Artificial sequence
  Synthetic oligonucleotide
taggaagaatcaggatagaagagtg

SEQ ID NO: 692324 - DNA, 25 bp, Artificial sequence
  Synthetic oligonucleotide
tagttgaggccattaaaacttagct

SEQ ID NO: 692325 - DNA, 25 bp, Artificial sequence
  Synthetic oligonucleotide
agcagcgatgccatctcttcctgta

SEQ ID NO: 692326 - DNA, 25 bp, Artificial sequence
  Synthetic oligonucleotide
atttggggatcagtcgtctattagc

SEQ ID NO: 692327 - DNA, 25 bp, Artificial sequence
  Synthetic oligonucleotide
atttggggatcactcgtctattagc

SEQ ID NO: 692328 - DNA, 25 bp, Artificial sequence
  Synthetic oligonucleotide
gtttgatgtgatcattgcatcgtgc

SEQ ID NO: 692329 - DNA, 25 bp, Artificial sequence
  Synthetic oligonucleotide
gtttgatgtgatgattgcatcgtgc

SEQ ID NO: 692330 - DNA, 25 bp, Artificial sequence
  Synthetic oligonucleotide
ttggaccatatatgtaaaacagagc

SEQ ID NO: 692331 - DNA, 25 bp, Artificial sequence
  Synthetic oligonucleotide
ttggaccatataagtaaaacagagc

SEQ ID NO: 692332 - DNA, 25 bp, Artificial sequence
  Synthetic oligonucleotide
tgatgttcaacttgtattgttttgg

SEQ ID NO: 692333 - DNA, 25 bp, Artificial sequence
  Synthetic oligonucleotide
gaacgaatgggtaggatctatagga

SEQ ID NO: 692334 - DNA, 25 bp, Artificial sequence
  Synthetic oligonucleotide
tagttgaggccaataaaacttagct

SEQ ID NO: 692335 - DNA, 25 bp, Artificial sequence
  Synthetic oligonucleotide
aatatcattataatgcttcttcttc

SEQ ID NO: 692336 - DNA, 25 bp, Artificial sequence
  Synthetic oligonucleotide
tacgtgcttcctataactgagaact

SEQ ID NO: 692337 - DNA, 25 bp, Artificial sequence
  Synthetic oligonucleotide
tacgtgcttcctttaactgagaact

SEQ ID NO: 692338 - DNA, 25 bp, Artificial sequence
  Synthetic oligonucleotide
catgcaataggttgtgtctatcacc

SEQ ID NO: 692339 - DNA, 25 bp, Artificial sequence
  Synthetic oligonucleotide
catgcaataggtagtgtctatcacc

SEQ ID NO: 692340 - DNA, 25 bp, Artificial sequence
  Synthetic oligonucleotide
atgggtgctttacccgttgggccaa

SEQ ID NO: 692341 - DNA, 25 bp, Artificial sequence
  Synthetic oligonucleotide
atgggtgctttagccgttgggccaa

SEQ ID NO: 692342 - DNA, 25 bp, Artificial sequence
  Synthetic oligonucleotide
tcagatggcgaatttgacaatggag

SEQ ID NO: 692343 - DNA, 25 bp, Artificial sequence
  Synthetic oligonucleotide
tcagatggcgaaattgacaatggag

SEQ ID NO: 692344 - DNA, 25 bp, Artificial sequence
  Synthetic oligonucleotide
tttgagaggatgttgagaggacaga

SEQ ID NO: 692345 - DNA, 25 bp, Artificial sequence
  Synthetic oligonucleotide
tgatgttcaactagtattgttttgg

SEQ ID NO: 692346 - DNA, 25 bp, Artificial sequence
  Synthetic oligonucleotide
ctgtgtatttaaaattttgtttaga

SEQ ID NO: 692347 - DNA, 25 bp, Artificial sequence
  Synthetic oligonucleotide
ttaggtaaacgatatttaagatgct

SEQ ID NO: 692348 - DNA, 25 bp, Artificial sequence
  Synthetic oligonucleotide
tatgttttctgctatctcggagaga

SEQ ID NO: 692349 - DNA, 25 bp, Artificial sequence
  Synthetic oligonucleotide
tatgttttctgcaatctcggagaga

SEQ ID NO: 692350 - DNA, 25 bp, Artificial sequence
  Synthetic oligonucleotide
tactagtatattataattgaaaaga

SEQ ID NO: 692351 - DNA, 25 bp, Artificial sequence
  Synthetic oligonucleotide
tactagtatattttaattgaaaaga

SEQ ID NO: 692352 - DNA, 25 bp, Artificial sequence
  Synthetic oligonucleotide
aacttattggtatataagttatatc

SEQ ID NO: 692353 - DNA, 25 bp, Artificial sequence
  Synthetic oligonucleotide
ttaggtaaacgaaatttaagatgct

SEQ ID NO: 692354 - DNA, 25 bp, Artificial sequence
  Synthetic oligonucleotide
ctgtgtatttaatattttgtttaga

SEQ ID NO: 692355 - DNA, 25 bp, Artificial sequence
  Synthetic oligonucleotide
tttataatttgtagtatggattaca

SEQ ID NO: 692356 - DNA, 25 bp, Artificial sequence
  Synthetic oligonucleotide
tttataatttgttgtatggattaca

SEQ ID NO: 692357 - DNA, 25 bp, Artificial sequence
  Synthetic oligonucleotide
tttttgttaagaatacggattgtat

SEQ ID NO: 692358 - DNA, 25 bp, Artificial sequence
  Synthetic oligonucleotide
tgtttagagatctatatttggagaa

SEQ ID NO: 692359 - DNA, 25 bp, Artificial sequence
  Synthetic oligonucleotide
tgtttagagatcaatatttggagaa

SEQ ID NO: 692360 - DNA, 25 bp, Artificial sequence
  Synthetic oligonucleotide
ctcaaatttgtgttactgtaatggc

SEQ ID NO: 692361 - DNA, 25 bp, Artificial sequence
  Synthetic oligonucleotide
ctcaaatttgtgatactgtaatggc

SEQ ID NO: 692362 - DNA, 25 bp, Artificial sequence
  Synthetic oligonucleotide
aacttattggtaaataagttatatc

SEQ ID NO: 692363 - DNA, 25 bp, Artificial sequence
  Synthetic oligonucleotide
ttacagtctacacaagccttcaact

SEQ ID NO: 692364 - DNA, 25 bp, Artificial sequence
  Synthetic oligonucleotide
aaaactgcaaaaagtattattcgta

SEQ ID NO: 692365 - DNA, 25 bp, Artificial sequence
  Synthetic oligonucleotide
taggtaaatgaaactctaataaatt

SEQ ID NO: 692366 - DNA, 25 bp, Artificial sequence
  Synthetic oligonucleotide
taggtaaatgaatctctaataaatt

SEQ ID NO: 692367 - DNA, 25 bp, Artificial sequence
  Synthetic oligonucleotide
tttttgttaagattacggattgtat

SEQ ID NO: 692368 - DNA, 25 bp, Artificial sequence
  Synthetic oligonucleotide
aaaactgcaaaatgtattattcgta

SEQ ID NO: 692369 - DNA, 25 bp, Artificial sequence
  Synthetic oligonucleotide
taatagtttcgatgatttaaagttc

SEQ ID NO: 692370 - DNA, 25 bp, Artificial sequence
  Synthetic oligonucleotide
tattttcacatacctgtcttcacca

SEQ ID NO: 692371 - DNA, 25 bp, Artificial sequence
  Synthetic oligonucleotide
tattttcacatagctgtcttcacca

SEQ ID NO: 692372 - DNA, 25 bp, Artificial sequence
  Synthetic oligonucleotide
tatggaaaatgacagctcttgagcc

SEQ ID NO: 692373 - DNA, 25 bp, Artificial sequence
  Synthetic oligonucleotide
tatggaaaatgagagctcttgagcc

SEQ ID NO: 692374 - DNA, 25 bp, Artificial sequence
  Synthetic oligonucleotide
gcgatttataatagtgggttgagaa

SEQ ID NO: 692375 - DNA, 25 bp, Artificial sequence
  Synthetic oligonucleotide
gcgatttataattgtgggttgagaa

SEQ ID NO: 692376 - DNA, 25 bp, Artificial sequence
  Synthetic oligonucleotide
taatagtttcgaagatttaaagttc

SEQ ID NO: 692377 - DNA, 25 bp, Artificial sequence
  Synthetic oligonucleotide
tcttgtgaaagatattatttgtttg

SEQ ID NO: 692378 - DNA, 25 bp, Artificial sequence
  Synthetic oligonucleotide
taaaggagaggacataactggtgaa

SEQ ID NO: 692379 - DNA, 25 bp, Artificial sequence
  Synthetic oligonucleotide
catatttctattaagcggtattaac

SEQ ID NO: 692380 - DNA, 25 bp, Artificial sequence
  Synthetic oligonucleotide
catatttctatttagcggtattaac

SEQ ID NO: 692381 - DNA, 25 bp, Artificial sequence
  Synthetic oligonucleotide
catatataactttgctatccttaag

SEQ ID NO: 692382 - DNA, 25 bp, Artificial sequence
  Synthetic oligonucleotide
catatataacttagctatccttaag

SEQ ID NO: 692383 - DNA, 25 bp, Artificial sequence
  Synthetic oligonucleotide
gaatcagaatggtatgggcattgtg

SEQ ID NO: 692384 - DNA, 25 bp, Artificial sequence
  Synthetic oligonucleotide
gaatcagaatggaatgggcattgtg

SEQ ID NO: 692385 - DNA, 25 bp, Artificial sequence
  Synthetic oligonucleotide
agtcatggccatttctagatcttga

SEQ ID NO: 692386 - DNA, 25 bp, Artificial sequence
  Synthetic oligonucleotide
tcttgtgaaagaaattatttgtttg

SEQ ID NO: 692387 - DNA, 25 bp, Artificial sequence
  Synthetic oligonucleotide
agtcatggccatatctagatcttga

SEQ ID NO: 692388 - DNA, 25 bp, Artificial sequence
  Synthetic oligonucleotide
tggtggaaggattctgtaaatggca

SEQ ID NO: 692389 - DNA, 25 bp, Artificial sequence
  Synthetic oligonucleotide
tggtggaaggatactgtaaatggca

SEQ ID NO: 692390 - DNA, 25 bp, Artificial sequence
  Synthetic oligonucleotide
tagagagttgcacgcacccttggat

SEQ ID NO: 692391 - DNA, 25 bp, Artificial sequence
  Synthetic oligonucleotide
tagagagttgcaggcacccttggat

SEQ ID NO: 692392 - DNA, 25 bp, Artificial sequence
  Synthetic oligonucleotide
cgagaacacgtaaatggctgacaat

SEQ ID NO: 692393 - DNA, 25 bp, Artificial sequence
  Synthetic oligonucleotide
tgaaagaagagcaagcgacgtggcc

SEQ ID NO: 692394 - DNA, 25 bp, Artificial sequence
  Synthetic oligonucleotide
ggtttatgtaaagcggcaatgtacg

SEQ ID NO: 692395 - DNA, 25 bp, Artificial sequence
  Synthetic oligonucleotide
caaatgtgcataaacctctgagcgt

SEQ ID NO: 692396 - DNA, 25 bp, Artificial sequence
  Synthetic oligonucleotide
ggtttatgtaaaccggcaatgtacg

SEQ ID NO: 692397 - DNA, 25 bp, Artificial sequence
  Synthetic oligonucleotide
aagtcttatgcaaggataatctctt

SEQ ID NO: 692398 - DNA, 25 bp, Artificial sequence
  Synthetic oligonucleotide
caagagcaaatctcaccaagatgag

SEQ ID NO: 692399 - DNA, 25 bp, Artificial sequence
  Synthetic oligonucleotide
caagagcaaatcacaccaagatgag

SEQ ID NO: 692400 - DNA, 25 bp, Artificial sequence
  Synthetic oligonucleotide
ggaactttgcagcattttttgggga

SEQ ID NO: 692401 - DNA, 25 bp, Artificial sequence
  Synthetic oligonucleotide
ggaactttgcaggattttttgggga

SEQ ID NO: 692402 - DNA, 25 bp, Artificial sequence
  Synthetic oligonucleotide
taaaggagaggagataactggtgaa

SEQ ID NO: 692403 - DNA, 25 bp, Artificial sequence
  Synthetic oligonucleotide
caaatgtgcatatacctctgagcgt

SEQ ID NO: 692404 - DNA, 25 bp, Artificial sequence
  Synthetic oligonucleotide
aagtcttatgcatggataatctctt

SEQ ID NO: 692405 - DNA, 25 bp, Artificial sequence
  Synthetic oligonucleotide
acatgacgtcgtcaaagggccaccg

SEQ ID NO: 692406 - DNA, 25 bp, Artificial sequence
  Synthetic oligonucleotide
tcaaattggcaacatctaaaccgga

SEQ ID NO: 692407 - DNA, 25 bp, Artificial sequence
  Synthetic oligonucleotide
tgacgacaacgaatccgggatccga

SEQ ID NO: 692408 - DNA, 25 bp, Artificial sequence
  Synthetic oligonucleotide
tgacgacaacgattccgggatccga

SEQ ID NO: 692409 - DNA, 25 bp, Artificial sequence
  Synthetic oligonucleotide
tattgtgtgacacatcaagcgaaac

SEQ ID NO: 692410 - DNA, 25 bp, Artificial sequence
  Synthetic oligonucleotide
tattgtgtgacagatcaagcgaaac

SEQ ID NO: 692411 - DNA, 25 bp, Artificial sequence
  Synthetic oligonucleotide
gggattgtcctatgttacaattgga

SEQ ID NO: 692412 - DNA, 25 bp, Artificial sequence
  Synthetic oligonucleotide
cgtcgggtatagttccttccaacgc

SEQ ID NO: 692413 - DNA, 25 bp, Artificial sequence
  Synthetic oligonucleotide
cggttcagtaaaaccagaaaccata

SEQ ID NO: 692414 - DNA, 25 bp, Artificial sequence
  Synthetic oligonucleotide
tcaaattggcaagatctaaaccgga

SEQ ID NO: 692415 - DNA, 25 bp, Artificial sequence
  Synthetic oligonucleotide
gaaaacccgttgcaatacgcccaca

SEQ ID NO: 692416 - DNA, 25 bp, Artificial sequence
  Synthetic oligonucleotide
gggattggaccgcttaacgaattgc

SEQ ID NO: 692417 - DNA, 25 bp, Artificial sequence
  Synthetic oligonucleotide
gggattggaccggttaacgaattgc

SEQ ID NO: 692418 - DNA, 25 bp, Artificial sequence
  Synthetic oligonucleotide
gaatctaaatcagggagacatgttt

SEQ ID NO: 692419 - DNA, 25 bp, Artificial sequence
  Synthetic oligonucleotide
gaatctaaatcacggagacatgttt

SEQ ID NO: 692420 - DNA, 25 bp, Artificial sequence
  Synthetic oligonucleotide
ccccttgttctattatttcctagat

SEQ ID NO: 692421 - DNA, 25 bp, Artificial sequence
  Synthetic oligonucleotide
ccccttgttctaatatttcctagat

SEQ ID NO: 692422 - DNA, 25 bp, Artificial sequence
  Synthetic oligonucleotide
tcttcatttagttctatataggtcc

SEQ ID NO: 692423 - DNA, 25 bp, Artificial sequence
  Synthetic oligonucleotide
cgtcgggtatagatccttccaacgc

SEQ ID NO: 692424 - DNA, 25 bp, Artificial sequence
  Synthetic oligonucleotide
taagcctggtgctgagaatgtcgaa

SEQ ID NO: 692425 - DNA, 25 bp, Artificial sequence
  Synthetic oligonucleotide
cattgcttttgaatttacatccgga

SEQ ID NO: 692426 - DNA, 25 bp, Artificial sequence
  Synthetic oligonucleotide
tagaccgcaaacgatattggatcgg

SEQ ID NO: 692427 - DNA, 25 bp, Artificial sequence
  Synthetic oligonucleotide
tagaccgcaaaccatattggatcgg

SEQ ID NO: 692428 - DNA, 25 bp, Artificial sequence
  Synthetic oligonucleotide
tccgttgccagttacatatcttagc

SEQ ID NO: 692429 - DNA, 25 bp, Artificial sequence
  Synthetic oligonucleotide
tccgttgccagtaacatatcttagc

SEQ ID NO: 692430 - DNA, 25 bp, Artificial sequence
  Synthetic oligonucleotide
tctgaaagacgatgaaatgaaaagc

SEQ ID NO: 692431 - DNA, 25 bp, Artificial sequence
  Synthetic oligonucleotide
tctgaaagacgaagaaatgaaaagc

SEQ ID NO: 692432 - DNA, 25 bp, Artificial sequence
  Synthetic oligonucleotide
ggctaatatccaaatgtcccacaaa

SEQ ID NO: 692433 - DNA, 25 bp, Artificial sequence
  Synthetic oligonucleotide
gatacaacgaactagagcaacagca

SEQ ID NO: 692434 - DNA, 25 bp, Artificial sequence
  Synthetic oligonucleotide
ggctaatatccatatgtcccacaaa

SEQ ID NO: 692435 - DNA, 25 bp, Artificial sequence
  Synthetic oligonucleotide
cggttcagtaaatccagaaaccata

SEQ ID NO: 692436 - DNA, 25 bp, Artificial sequence
  Synthetic oligonucleotide
tgaaagaagagctagcgacgtggcc

SEQ ID NO: 692437 - DNA, 25 bp, Artificial sequence
  Synthetic oligonucleotide
acatgacgtcgtgaaagggccaccg

SEQ ID NO: 692438 - DNA, 25 bp, Artificial sequence
  Synthetic oligonucleotide
ggttgtcactaaacgacgtagcttc

SEQ ID NO: 692439 - DNA, 25 bp, Artificial sequence
  Synthetic oligonucleotide
ggttgtcactaatcgacgtagcttc

SEQ ID NO: 692440 - DNA, 25 bp, Artificial sequence
  Synthetic oligonucleotide
gaaaacccgttggaatacgcccaca

SEQ ID NO: 692441 - DNA, 25 bp, Artificial sequence
  Synthetic oligonucleotide
cattgcttttgattttacatccgga

SEQ ID NO: 692442 - DNA, 25 bp, Artificial sequence
  Synthetic oligonucleotide
gatacaacgaacaagagcaacagca

SEQ ID NO: 692443 - DNA, 25 bp, Artificial sequence
  Synthetic oligonucleotide
gccgtcagatcacattgatcgggca

SEQ ID NO: 692444 - DNA, 25 bp, Artificial sequence
  Synthetic oligonucleotide
tctgtcatgtgtgatttggtcgcgc

SEQ ID NO: 692445 - DNA, 25 bp, Artificial sequence
  Synthetic oligonucleotide
tcatcacgctcagggtttgctcctt

SEQ ID NO: 692446 - DNA, 25 bp, Artificial sequence
  Synthetic oligonucleotide
tcatcacgctcacggtttgctcctt

SEQ ID NO: 692447 - DNA, 25 bp, Artificial sequence
  Synthetic oligonucleotide
ttattattacatattgtttttcgtc

SEQ ID NO: 692448 - DNA, 25 bp, Artificial sequence
  Synthetic oligonucleotide
ttattattacattttgtttttcgtc

SEQ ID NO: 692449 - DNA, 25 bp, Artificial sequence
  Synthetic oligonucleotide
tgttgacccaccgaacaaccaaaaa

SEQ ID NO: 692450 - DNA, 25 bp, Artificial sequence
  Synthetic oligonucleotide
tgttgacccacccaacaaccaaaaa

SEQ ID NO: 692451 - DNA, 25 bp, Artificial sequence
  Synthetic oligonucleotide
aaatctgtatctgcgtctttgatcc

SEQ ID NO: 692452 - DNA, 25 bp, Artificial sequence
  Synthetic oligonucleotide
aaatctgtatctccgtctttgatcc

SEQ ID NO: 692453 - DNA, 25 bp, Artificial sequence
  Synthetic oligonucleotide
atagacagacactcccaaaccctag

SEQ ID NO: 692454 - DNA, 25 bp, Artificial sequence
  Synthetic oligonucleotide
taacccacgtgagatgctgactgtg

SEQ ID NO: 692455 - DNA, 25 bp, Artificial sequence
  Synthetic oligonucleotide
gccgtcagatcagattgatcgggca

SEQ ID NO: 692456 - DNA, 25 bp, Artificial sequence
  Synthetic oligonucleotide
gaaaaacaaaagtatgggcccaata

SEQ ID NO: 692457 - DNA, 25 bp, Artificial sequence
  Synthetic oligonucleotide
tcttcatttagtactatataggtcc

SEQ ID NO: 692458 - DNA, 25 bp, Artificial sequence
  Synthetic oligonucleotide
cgagaacacgtatatggctgacaat

SEQ ID NO: 692459 - DNA, 25 bp, Artificial sequence
  Synthetic oligonucleotide
ccgttggaatcatgcaatggtagag

SEQ ID NO: 692460 - DNA, 25 bp, Artificial sequence
  Synthetic oligonucleotide
taagcctggtgcagagaatgtcgaa

SEQ ID NO: 692461 - DNA, 25 bp, Artificial sequence
  Synthetic oligonucleotide
tatttgtgggtaactagaagaggcg

SEQ ID NO: 692462 - DNA, 25 bp, Artificial sequence
  Synthetic oligonucleotide
tctccaagctgggtgttttttcatc

SEQ ID NO: 692463 - DNA, 25 bp, Artificial sequence
  Synthetic oligonucleotide
tctccaagctggctgttttttcatc

SEQ ID NO: 692464 - DNA, 25 bp, Artificial sequence
  Synthetic oligonucleotide
actaatcgaatcacctactctaaag

SEQ ID NO: 692465 - DNA, 25 bp, Artificial sequence
  Synthetic oligonucleotide
actaatcgaatctcctactctaaag

SEQ ID NO: 692466 - DNA, 25 bp, Artificial sequence
  Synthetic oligonucleotide
tctgtcatgtgtcatttggtcgcgc

SEQ ID NO: 692467 - DNA, 25 bp, Artificial sequence
  Synthetic oligonucleotide
atagacagacacacccaaaccctag

SEQ ID NO: 692468 - DNA, 25 bp, Artificial sequence
  Synthetic oligonucleotide
gcccatagactaaagagtaagagta

SEQ ID NO: 692469 - DNA, 25 bp, Artificial sequence
  Synthetic oligonucleotide
aacggttcattcatacaatattatg

SEQ ID NO: 692470 - DNA, 25 bp, Artificial sequence
  Synthetic oligonucleotide
aacggttcattcttacaatattatg

SEQ ID NO: 692471 - DNA, 25 bp, Artificial sequence
  Synthetic oligonucleotide
tcagacatgaataatactaccgtac

SEQ ID NO: 692472 - DNA, 25 bp, Artificial sequence
  Synthetic oligonucleotide
tcagacatgaattatactaccgtac

SEQ ID NO: 692473 - DNA, 25 bp, Artificial sequence
  Synthetic oligonucleotide
tgtatgtgctactataattggtcaa

SEQ ID NO: 692474 - DNA, 25 bp, Artificial sequence
  Synthetic oligonucleotide
tgtatgtgctacaataattggtcaa

SEQ ID NO: 692475 - DNA, 25 bp, Artificial sequence
  Synthetic oligonucleotide
cagtatctaatgaattttatgctag

SEQ ID NO: 692476 - DNA, 25 bp, Artificial sequence
  Synthetic oligonucleotide
cagtatctaatgtattttatgctag

SEQ ID NO: 692477 - DNA, 25 bp, Artificial sequence
  Synthetic oligonucleotide
tactgttcgactctaacggtgttaa

SEQ ID NO: 692478 - DNA, 25 bp, Artificial sequence
  Synthetic oligonucleotide
tactgttcgactgtaacggtgttaa

SEQ ID NO: 692479 - DNA, 25 bp, Artificial sequence
  Synthetic oligonucleotide
taacccacgtgacatgctgactgtg

SEQ ID NO: 692480 - DNA, 25 bp, Artificial sequence
  Synthetic oligonucleotide
gcggttgattgaaagttaatggctc

SEQ ID NO: 692481 - DNA, 25 bp, Artificial sequence
  Synthetic oligonucleotide
tatttgtgggtatctagaagaggcg

SEQ ID NO: 692482 - DNA, 25 bp, Artificial sequence
  Synthetic oligonucleotide
gcccatagactatagagtaagagta

SEQ ID NO: 692483 - DNA, 25 bp, Artificial sequence
  Synthetic oligonucleotide
gctaacgtaaattcaaaatctttgg

SEQ ID NO: 692484 - DNA, 25 bp, Artificial sequence
  Synthetic oligonucleotide
gctaacgtaaatacaaaatctttgg

SEQ ID NO: 692485 - DNA, 25 bp, Artificial sequence
  Synthetic oligonucleotide
gttcatctcaaatatccgaaactcg

SEQ ID NO: 692486 - DNA, 25 bp, Artificial sequence
  Synthetic oligonucleotide
gttcatctcaaaaatccgaaactcg

SEQ ID NO: 692487 - DNA, 25 bp, Artificial sequence
  Synthetic oligonucleotide
tgttagatgtatgacttgaaatgcc

SEQ ID NO: 692488 - DNA, 25 bp, Artificial sequence
  Synthetic oligonucleotide
tgttagatgtatcacttgaaatgcc

SEQ ID NO: 692489 - DNA, 25 bp, Artificial sequence
  Synthetic oligonucleotide
gagtcttgataacctcacgaaccaa

SEQ ID NO: 692490 - DNA, 25 bp, Artificial sequence
  Synthetic oligonucleotide
gagtcttgataagctcacgaaccaa

SEQ ID NO: 692491 - DNA, 25 bp, Artificial sequence
  Synthetic oligonucleotide
gaaaaacaaaagaatgggcccaata

SEQ ID NO: 692492 - DNA, 25 bp, Artificial sequence
  Synthetic oligonucleotide
gcggttgattgatagttaatggctc

SEQ ID NO: 692493 - DNA, 25 bp, Artificial sequence
  Synthetic oligonucleotide
tttcccaaggtagaaagcaaacgct

SEQ ID NO: 692494 - DNA, 25 bp, Artificial sequence
  Synthetic oligonucleotide
gatgaccatgtctctttaattttgt

SEQ ID NO: 692495 - DNA, 25 bp, Artificial sequence
  Synthetic oligonucleotide
gatgaccatgtcactttaattttgt

SEQ ID NO: 692496 - DNA, 25 bp, Artificial sequence
  Synthetic oligonucleotide
gatggaccttgcataacaagttcaa

SEQ ID NO: 692497 - DNA, 25 bp, Artificial sequence
  Synthetic oligonucleotide
gatggaccttgcttaacaagttcaa

SEQ ID NO: 692498 - DNA, 25 bp, Artificial sequence
  Synthetic oligonucleotide
tataggtgtattgcgtttaggtatg

SEQ ID NO: 692499 - DNA, 25 bp, Artificial sequence
  Synthetic oligonucleotide
tataggtgtattccgtttaggtatg

SEQ ID NO: 692500 - DNA, 25 bp, Artificial sequence
  Synthetic oligonucleotide
caaagatggtaaatctgaatctggg

SEQ ID NO: 692501 - DNA, 25 bp, Artificial sequence
  Synthetic oligonucleotide
tccagcagcggtacgaggatggctc

SEQ ID NO: 692502 - DNA, 25 bp, Artificial sequence
  Synthetic oligonucleotide
tgttgatgatcagctcgtctagtgg

SEQ ID NO: 692503 - DNA, 25 bp, Artificial sequence
  Synthetic oligonucleotide
agacttgttttgtttgtatctgatc

SEQ ID NO: 692504 - DNA, 25 bp, Artificial sequence
  Synthetic oligonucleotide
tttcccaaggtacaaagcaaacgct

SEQ ID NO: 692505 - DNA, 25 bp, Artificial sequence
  Synthetic oligonucleotide
caaagatggtaattctgaatctggg

SEQ ID NO: 692506 - DNA, 25 bp, Artificial sequence
  Synthetic oligonucleotide
tgcttttgcctttgtttggaaacaa

SEQ ID NO: 692507 - DNA, 25 bp, Artificial sequence
  Synthetic oligonucleotide
tgcttttgccttagtttggaaacaa

SEQ ID NO: 692508 - DNA, 25 bp, Artificial sequence
  Synthetic oligonucleotide
ccgatgattcatatagggaggatgg

SEQ ID NO: 692509 - DNA, 25 bp, Artificial sequence
  Synthetic oligonucleotide
ccgatgattcatttagggaggatgg

SEQ ID NO: 692510 - DNA, 25 bp, Artificial sequence
  Synthetic oligonucleotide
agacagtcagggaggctgcagcgag

SEQ ID NO: 692511 - DNA, 25 bp, Artificial sequence
  Synthetic oligonucleotide
agacagtcagggtggctgcagcgag

SEQ ID NO: 692512 - DNA, 25 bp, Artificial sequence
  Synthetic oligonucleotide
aagaagcaggagtccgtgggattct

SEQ ID NO: 692513 - DNA, 25 bp, Artificial sequence
  Synthetic oligonucleotide
aagaagcaggagaccgtgggattct

SEQ ID NO: 692514 - DNA, 25 bp, Artificial sequence
  Synthetic oligonucleotide
ttcacgcataccgtgtaagtgcagc

SEQ ID NO: 692515 - DNA, 25 bp, Artificial sequence
  Synthetic oligonucleotide
ttcacgcataccctgtaagtgcagc

SEQ ID NO: 692516 - DNA, 25 bp, Artificial sequence
  Synthetic oligonucleotide
ccgttggaatcaagcaatggtagag

SEQ ID NO: 692517 - DNA, 25 bp, Artificial sequence
  Synthetic oligonucleotide
gggattgtcctaagttacaattgga

SEQ ID NO: 692518 - DNA, 25 bp, Artificial sequence
  Synthetic oligonucleotide
ggtttatgtaatgtgaatctttctc

SEQ ID NO: 692519 - DNA, 25 bp, Artificial sequence
  Synthetic oligonucleotide
tctgcgtttgtatcgcctctttgaa

SEQ ID NO: 692520 - DNA, 25 bp, Artificial sequence
  Synthetic oligonucleotide
tgttgatgatcacctcgtctagtgg

SEQ ID NO: 692521 - DNA, 25 bp, Artificial sequence
  Synthetic oligonucleotide
tctgcgtttgtaacgcctctttgaa

SEQ ID NO: 692522 - DNA, 25 bp, Artificial sequence
  Synthetic oligonucleotide
agacttgttttgattgtatctgatc

SEQ ID NO: 692523 - DNA, 25 bp, Artificial sequence
  Synthetic oligonucleotide
ttttatccatccttgttcctttttc

SEQ ID NO: 692524 - DNA, 25 bp, Artificial sequence
  Synthetic oligonucleotide
ggtttatgtaatctgaatctttctc

SEQ ID NO: 692525 - DNA, 25 bp, Artificial sequence
  Synthetic oligonucleotide
ttttatccatccatgttcctttttc

SEQ ID NO: 692526 - DNA, 25 bp, Artificial sequence
  Synthetic oligonucleotide
tccagcagcggttcgaggatggctc

SEQ ID NO: 692527 - DNA, 25 bp, Artificial sequence
  Synthetic oligonucleotide
cgaaaattgtggatgcgattgatta

SEQ ID NO: 692528 - DNA, 25 bp, Artificial sequence
  Synthetic oligonucleotide
actgttgggaatttgttttcatgga

SEQ ID NO: 692529 - DNA, 25 bp, Artificial sequence
  Synthetic oligonucleotide
tgaggtgttatgtctgtaattgcaa

SEQ ID NO: 692530 - DNA, 25 bp, Artificial sequence
  Synthetic oligonucleotide
tttagagtcatgatttgaaaagagg

SEQ ID NO: 692531 - DNA, 25 bp, Artificial sequence
  Synthetic oligonucleotide
tttagagtcatgttttgaaaagagg

SEQ ID NO: 692532 - DNA, 25 bp, Artificial sequence
  Synthetic oligonucleotide
cgaaaattgtggttgcgattgatta

SEQ ID NO: 692533 - DNA, 25 bp, Artificial sequence
  Synthetic oligonucleotide
acgtcaccttatcgaatcatgtttg

SEQ ID NO: 692534 - DNA, 25 bp, Artificial sequence
  Synthetic oligonucleotide
actgttgggaatatgttttcatgga

SEQ ID NO: 692535 - DNA, 25 bp, Artificial sequence
  Synthetic oligonucleotide
tgaggtgttatgactgtaattgcaa

SEQ ID NO: 692536 - DNA, 25 bp, Artificial sequence
  Synthetic oligonucleotide
tatctgcttcgtgattaattgggca

SEQ ID NO: 692537 - DNA, 25 bp, Artificial sequence
  Synthetic oligonucleotide
tatctgcttcgtcattaattgggca

SEQ ID NO: 692538 - DNA, 25 bp, Artificial sequence
  Synthetic oligonucleotide
ccctgtattgaactgattgctttga

SEQ ID NO: 692539 - DNA, 25 bp, Artificial sequence
  Synthetic oligonucleotide
ccctgtattgaagtgattgctttga

SEQ ID NO: 692540 - DNA, 25 bp, Artificial sequence
  Synthetic oligonucleotide
acgtcaccttatggaatcatgtttg

SEQ ID NO: 692541 - DNA, 25 bp, Artificial sequence
  Synthetic oligonucleotide
caacaacgagactaggaggcttgaa

SEQ ID NO: 692542 - DNA, 25 bp, Artificial sequence
  Synthetic oligonucleotide
gacaaaacgacagcaacagctccaa

SEQ ID NO: 692543 - DNA, 25 bp, Artificial sequence
  Synthetic oligonucleotide
caatgacggtgtagctgtgttcaaa

SEQ ID NO: 692544 - DNA, 25 bp, Artificial sequence
  Synthetic oligonucleotide
caatgacggtgttgctgtgttcaaa

SEQ ID NO: 692545 - DNA, 25 bp, Artificial sequence
  Synthetic oligonucleotide
aagcttttggtgttgggtgaatgaa

SEQ ID NO: 692546 - DNA, 25 bp, Artificial sequence
  Synthetic oligonucleotide
aagcttttggtgatgggtgaatgaa

SEQ ID NO: 692547 - DNA, 25 bp, Artificial sequence
  Synthetic oligonucleotide
caacaacgagacaaggaggcttgaa

SEQ ID NO: 692548 - DNA, 25 bp, Artificial sequence
  Synthetic oligonucleotide
ggtgacatctctcttcaaacccttt

SEQ ID NO: 692549 - DNA, 25 bp, Artificial sequence
  Synthetic oligonucleotide
ggtgacatctctgttcaaacccttt

SEQ ID NO: 692550 - DNA, 25 bp, Artificial sequence
  Synthetic oligonucleotide
ctgtaatctccctccgtcgctgcag

SEQ ID NO: 692551 - DNA, 25 bp, Artificial sequence
  Synthetic oligonucleotide
ctgtaatctcccaccgtcgctgcag

SEQ ID NO: 692552 - DNA, 25 bp, Artificial sequence
  Synthetic oligonucleotide
tcttcttcaccaacacatcagataa

SEQ ID NO: 692553 - DNA, 25 bp, Artificial sequence
  Synthetic oligonucleotide
tcttcttcaccatcacatcagataa

SEQ ID NO: 692554 - DNA, 25 bp, Artificial sequence
  Synthetic oligonucleotide
ttccattctctctcccaccaaacta

SEQ ID NO: 692555 - DNA, 25 bp, Artificial sequence
  Synthetic oligonucleotide
gacaaaacgacaccaacagctccaa

SEQ ID NO: 692556 - DNA, 25 bp, Artificial sequence
  Synthetic oligonucleotide
gaagaacgacacctttccgaccgga

SEQ ID NO: 692557 - DNA, 25 bp, Artificial sequence
  Synthetic oligonucleotide
taacgatggtgatcagaggaaaacg

SEQ ID NO: 692558 - DNA, 25 bp, Artificial sequence
  Synthetic oligonucleotide
ttccattctctcacccaccaaacta

SEQ ID NO: 692559 - DNA, 25 bp, Artificial sequence
  Synthetic oligonucleotide
taataataaacaaagttcatgattg

SEQ ID NO: 692560 - DNA, 25 bp, Artificial sequence
  Synthetic oligonucleotide
tttttggattagggtgaaaagttga

SEQ ID NO: 692561 - DNA, 25 bp, Artificial sequence
  Synthetic oligonucleotide
tttttggattagcgtgaaaagttga

SEQ ID NO: 692562 - DNA, 25 bp, Artificial sequence
  Synthetic oligonucleotide
ttcaagtgttgacgctctttaactc

SEQ ID NO: 692563 - DNA, 25 bp, Artificial sequence
  Synthetic oligonucleotide
ttcaagtgttgaggctctttaactc

SEQ ID NO: 692564 - DNA, 25 bp, Artificial sequence
  Synthetic oligonucleotide
tggtcttccaccaacctcagtaagt

SEQ ID NO: 692565 - DNA, 25 bp, Artificial sequence
  Synthetic oligonucleotide
tggtcttccacctacctcagtaagt

SEQ ID NO: 692566 - DNA, 25 bp, Artificial sequence
  Synthetic oligonucleotide
gggtactgctccagtgtactggaaa

SEQ ID NO: 692567 - DNA, 25 bp, Artificial sequence
  Synthetic oligonucleotide
gggtactgctcctgtgtactggaaa

SEQ ID NO: 692568 - DNA, 25 bp, Artificial sequence
  Synthetic oligonucleotide
gatgcgatcatccatccggcgacgt

SEQ ID NO: 692569 - DNA, 25 bp, Artificial sequence
  Synthetic oligonucleotide
tagatacaagcttccttcatgggcc

SEQ ID NO: 692570 - DNA, 25 bp, Artificial sequence
  Synthetic oligonucleotide
gggttgctttcaacggtgagtttct

SEQ ID NO: 692571 - DNA, 25 bp, Artificial sequence
  Synthetic oligonucleotide
taataataaacatagttcatgattg

SEQ ID NO: 692572 - DNA, 25 bp, Artificial sequence
  Synthetic oligonucleotide
catcgtgttgctatggtcgatataa

SEQ ID NO: 692573 - DNA, 25 bp, Artificial sequence
  Synthetic oligonucleotide
catcgtgttgctttggtcgatataa

SEQ ID NO: 692574 - DNA, 25 bp, Artificial sequence
  Synthetic oligonucleotide
tctcgaagagatgaaagagtctgtc

SEQ ID NO: 692575 - DNA, 25 bp, Artificial sequence
  Synthetic oligonucleotide
tctcgaagagatcaaagagtctgtc

SEQ ID NO: 692576 - DNA, 25 bp, Artificial sequence
  Synthetic oligonucleotide
tctccaagttaatgctgttgccacg

SEQ ID NO: 692577 - DNA, 25 bp, Artificial sequence
  Synthetic oligonucleotide
tctccaagttaaagctgttgccacg

SEQ ID NO: 692578 - DNA, 25 bp, Artificial sequence
  Synthetic oligonucleotide
tccaatactaaggagatttccgagg

SEQ ID NO: 692579 - DNA, 25 bp, Artificial sequence
  Synthetic oligonucleotide
tccaatactaagcagatttccgagg

SEQ ID NO: 692580 - DNA, 25 bp, Artificial sequence
  Synthetic oligonucleotide
tagatacaagctaccttcatgggcc

SEQ ID NO: 692581 - DNA, 25 bp, Artificial sequence
  Synthetic oligonucleotide
ttatagttagcagtctaatcgtggg

SEQ ID NO: 692582 - DNA, 25 bp, Artificial sequence
  Synthetic oligonucleotide
cttaagaaagatggaggcaaagccg

SEQ ID NO: 692583 - DNA, 25 bp, Artificial sequence
  Synthetic oligonucleotide
taaccaaccaatcatgtgtggtggg

SEQ ID NO: 692584 - DNA, 25 bp, Artificial sequence
  Synthetic oligonucleotide
taaccaaccaatgatgtgtggtggg

SEQ ID NO: 692585 - DNA, 25 bp, Artificial sequence
  Synthetic oligonucleotide
tattcaattggttactaaatggtgc

SEQ ID NO: 692586 - DNA, 25 bp, Artificial sequence
  Synthetic oligonucleotide
tattcaattggtaactaaatggtgc

SEQ ID NO: 692587 - DNA, 25 bp, Artificial sequence
  Synthetic oligonucleotide
ccagtcttatggagtacttataaca

SEQ ID NO: 692588 - DNA, 25 bp, Artificial sequence
  Synthetic oligonucleotide
ccagtcttatggtgtacttataaca

SEQ ID NO: 692589 - DNA, 25 bp, Artificial sequence
  Synthetic oligonucleotide
ttccaaattaaattagtagaaagct

SEQ ID NO: 692590 - DNA, 25 bp, Artificial sequence
  Synthetic oligonucleotide
ttccaaattaaaatagtagaaagct

SEQ ID NO: 692591 - DNA, 25 bp, Artificial sequence
  Synthetic oligonucleotide
taatccagctgctagcaaactcact

SEQ ID NO: 692592 - DNA, 25 bp, Artificial sequence
  Synthetic oligonucleotide
taattatttctatgtgtggcttgca

SEQ ID NO: 692593 - DNA, 25 bp, Artificial sequence
  Synthetic oligonucleotide
taatccagctgcaagcaaactcact

SEQ ID NO: 692594 - DNA, 25 bp, Artificial sequence
  Synthetic oligonucleotide
ttatagttagcactctaatcgtggg

SEQ ID NO: 692595 - DNA, 25 bp, Artificial sequence
  Synthetic oligonucleotide
ggctaccacatactgtataattgtt

SEQ ID NO: 692596 - DNA, 25 bp, Artificial sequence
  Synthetic oligonucleotide
ggctaccacatagtgtataattgtt

SEQ ID NO: 692597 - DNA, 25 bp, Artificial sequence
  Synthetic oligonucleotide
agttggcgcggttagggcggctgtt

SEQ ID NO: 692598 - DNA, 25 bp, Artificial sequence
  Synthetic oligonucleotide
agttggcgcggtaagggcggctgtt

SEQ ID NO: 692599 - DNA, 25 bp, Artificial sequence
  Synthetic oligonucleotide
taattaaattaagttgtattccgag

SEQ ID NO: 692600 - DNA, 25 bp, Artificial sequence
  Synthetic oligonucleotide
taattaaattaacttgtattccgag

SEQ ID NO: 692601 - DNA, 25 bp, Artificial sequence
  Synthetic oligonucleotide
gggttgctttcatcggtgagtttct

SEQ ID NO: 692602 - DNA, 25 bp, Artificial sequence
  Synthetic oligonucleotide
tctataatactacctatataacgag

SEQ ID NO: 692603 - DNA, 25 bp, Artificial sequence
  Synthetic oligonucleotide
taattatttctaagtgtggcttgca

SEQ ID NO: 692604 - DNA, 25 bp, Artificial sequence
  Synthetic oligonucleotide
gcttattttggttttgagcccattc

SEQ ID NO: 692605 - DNA, 25 bp, Artificial sequence
  Synthetic oligonucleotide
gctaatgaatgaaacagtgtacagt

SEQ ID NO: 692606 - DNA, 25 bp, Artificial sequence
  Synthetic oligonucleotide
tttggaaagagaggataagatggtt

SEQ ID NO: 692607 - DNA, 25 bp, Artificial sequence
  Synthetic oligonucleotide
tttggaaagagacgataagatggtt

SEQ ID NO: 692608 - DNA, 25 bp, Artificial sequence
  Synthetic oligonucleotide
gccaatttggggcagttatctaaaa

SEQ ID NO: 692609 - DNA, 25 bp, Artificial sequence
  Synthetic oligonucleotide
gccaatttgggggagttatctaaaa

SEQ ID NO: 692610 - DNA, 25 bp, Artificial sequence
  Synthetic oligonucleotide
caatttttcgagttgttttgctgaa

SEQ ID NO: 692611 - DNA, 25 bp, Artificial sequence
  Synthetic oligonucleotide
caatttttcgagatgttttgctgaa

SEQ ID NO: 692612 - DNA, 25 bp, Artificial sequence
  Synthetic oligonucleotide
tcttggaaagttaacaaatcacccc

SEQ ID NO: 692613 - DNA, 25 bp, Artificial sequence
  Synthetic oligonucleotide
tcttggaaagtttacaaatcacccc

SEQ ID NO: 692614 - DNA, 25 bp, Artificial sequence
  Synthetic oligonucleotide
tcttttttgtggttcacgggactac

SEQ ID NO: 692615 - DNA, 25 bp, Artificial sequence
  Synthetic oligonucleotide
gctttcaaacaaatgggctcattga

SEQ ID NO: 692616 - DNA, 25 bp, Artificial sequence
  Synthetic oligonucleotide
tagtactagttgagatgacagagac

SEQ ID NO: 692617 - DNA, 25 bp, Artificial sequence
  Synthetic oligonucleotide
gcttattttggtattgagcccattc

SEQ ID NO: 692618 - DNA, 25 bp, Artificial sequence
  Synthetic oligonucleotide
cattaaaggaaatatcccaagagtg

SEQ ID NO: 692619 - DNA, 25 bp, Artificial sequence
  Synthetic oligonucleotide
cattaaaggaaaaatcccaagagtg

SEQ ID NO: 692620 - DNA, 25 bp, Artificial sequence
  Synthetic oligonucleotide
gttccatagaccttacatttcaaat

SEQ ID NO: 692621 - DNA, 25 bp, Artificial sequence
  Synthetic oligonucleotide
gttccatagaccatacatttcaaat

SEQ ID NO: 692622 - DNA, 25 bp, Artificial sequence
  Synthetic oligonucleotide
tgtctctatgattcttaagtctttg

SEQ ID NO: 692623 - DNA, 25 bp, Artificial sequence
  Synthetic oligonucleotide
tgtctctatgatacttaagtctttg

SEQ ID NO: 692624 - DNA, 25 bp, Artificial sequence
  Synthetic oligonucleotide
gtgtaagaaaaatattctatagtag

SEQ ID NO: 692625 - DNA, 25 bp, Artificial sequence
  Synthetic oligonucleotide
gtgtaagaaaaaaattctatagtag

SEQ ID NO: 692626 - DNA, 25 bp, Artificial sequence
  Synthetic oligonucleotide
gctttcaaacaattgggctcattga

SEQ ID NO: 692627 - DNA, 25 bp, Artificial sequence
  Synthetic oligonucleotide
tcaattacttacatatttttctcct

SEQ ID NO: 692628 - DNA, 25 bp, Artificial sequence
  Synthetic oligonucleotide
tgttagaagagaagccattatcgat

SEQ ID NO: 692629 - DNA, 25 bp, Artificial sequence
  Synthetic oligonucleotide
tctataatactagctatataacgag

SEQ ID NO: 692630 - DNA, 25 bp, Artificial sequence
  Synthetic oligonucleotide
taagtattttcactcaaattcttga

SEQ ID NO: 692631 - DNA, 25 bp, Artificial sequence
  Synthetic oligonucleotide
taagtattttcagtcaaattcttga

SEQ ID NO: 692632 - DNA, 25 bp, Artificial sequence
  Synthetic oligonucleotide
cgcagcctttatcctcgaaacgtag

SEQ ID NO: 692633 - DNA, 25 bp, Artificial sequence
  Synthetic oligonucleotide
cgcagcctttatgctcgaaacgtag

SEQ ID NO: 692634 - DNA, 25 bp, Artificial sequence
  Synthetic oligonucleotide
gctgccgctaatacctccgccgttt

SEQ ID NO: 692635 - DNA, 25 bp, Artificial sequence
  Synthetic oligonucleotide
gctgccgctaattcctccgccgttt

SEQ ID NO: 692636 - DNA, 25 bp, Artificial sequence
  Synthetic oligonucleotide
caaaaaaggtttgtcattagatcgg

SEQ ID NO: 692637 - DNA, 25 bp, Artificial sequence
  Synthetic oligonucleotide
tcttttttgtggatcacgggactac

SEQ ID NO: 692638 - DNA, 25 bp, Artificial sequence
  Synthetic oligonucleotide
tcaattacttacttatttttctcct

SEQ ID NO: 692639 - DNA, 25 bp, Artificial sequence
  Synthetic oligonucleotide
gctaatgaatgatacagtgtacagt

SEQ ID NO: 692640 - DNA, 25 bp, Artificial sequence
  Synthetic oligonucleotide
tgtggtgtgaaaaatccttatcttg

SEQ ID NO: 692641 - DNA, 25 bp, Artificial sequence
  Synthetic oligonucleotide
tgttagaagagatgccattatcgat

SEQ ID NO: 692642 - DNA, 25 bp, Artificial sequence
  Synthetic oligonucleotide
gaaagaaggaagtgaagaggcttaa

SEQ ID NO: 692643 - DNA, 25 bp, Artificial sequence
  Synthetic oligonucleotide
gaaagaaggaagagaagaggcttaa

SEQ ID NO: 692644 - DNA, 25 bp, Artificial sequence
  Synthetic oligonucleotide
tactagtagtataaatatgttaata

SEQ ID NO: 692645 - DNA, 25 bp, Artificial sequence
  Synthetic oligonucleotide
tactagtagtattaatatgttaata

SEQ ID NO: 692646 - DNA, 25 bp, Artificial sequence
  Synthetic oligonucleotide
taagggtcggtcttttttgtatgct

SEQ ID NO: 692647 - DNA, 25 bp, Artificial sequence
  Synthetic oligonucleotide
taagggtcggtcatttttgtatgct

SEQ ID NO: 692648 - DNA, 25 bp, Artificial sequence
  Synthetic oligonucleotide
tagtactagttgtgatgacagagac

SEQ ID NO: 692649 - DNA, 25 bp, Artificial sequence
  Synthetic oligonucleotide
caaaaaaggtttctcattagatcgg

SEQ ID NO: 692650 - DNA, 25 bp, Artificial sequence
  Synthetic oligonucleotide
cacgtacacattaagtaattaggtt

SEQ ID NO: 692651 - DNA, 25 bp, Artificial sequence
  Synthetic oligonucleotide
ggtttttagccagccaatattataa

SEQ ID NO: 692652 - DNA, 25 bp, Artificial sequence
  Synthetic oligonucleotide
aaatcaaactacaacgagtattccg

SEQ ID NO: 692653 - DNA, 25 bp, Artificial sequence
  Synthetic oligonucleotide
aaatcaaactactacgagtattccg

SEQ ID NO: 692654 - DNA, 25 bp, Artificial sequence
  Synthetic oligonucleotide
aaaaaaatagatttaagtgactaga

SEQ ID NO: 692655 - DNA, 25 bp, Artificial sequence
  Synthetic oligonucleotide
aaaaaaatagatataagtgactaga

SEQ ID NO: 692656 - DNA, 25 bp, Artificial sequence
  Synthetic oligonucleotide
gttttaagaagaaatagatttagtg

SEQ ID NO: 692657 - DNA, 25 bp, Artificial sequence
  Synthetic oligonucleotide
gttttaagaagatatagatttagtg

SEQ ID NO: 692658 - DNA, 25 bp, Artificial sequence
  Synthetic oligonucleotide
tcattaaacttctactaaatgtgtt

SEQ ID NO: 692659 - DNA, 25 bp, Artificial sequence
  Synthetic oligonucleotide
tcattaaacttcaactaaatgtgtt

SEQ ID NO: 692660 - DNA, 25 bp, Artificial sequence
  Synthetic oligonucleotide
ttgctcatctctacgtacttcccgg

SEQ ID NO: 692661 - DNA, 25 bp, Artificial sequence
  Synthetic oligonucleotide
caattagaaccaattaatagaaact

SEQ ID NO: 692662 - DNA, 25 bp, Artificial sequence
  Synthetic oligonucleotide
ctttttgcatattagaaagagtcca

SEQ ID NO: 692663 - DNA, 25 bp, Artificial sequence
  Synthetic oligonucleotide
cacgtacacatttagtaattaggtt

SEQ ID NO: 692664 - DNA, 25 bp, Artificial sequence
  Synthetic oligonucleotide
taccatttaaaaaactcaatgaggc

SEQ ID NO: 692665 - DNA, 25 bp, Artificial sequence
  Synthetic oligonucleotide
taccatttaaaatactcaatgaggc

SEQ ID NO: 692666 - DNA, 25 bp, Artificial sequence
  Synthetic oligonucleotide
tgcataaattagttatacgaagacc

SEQ ID NO: 692667 - DNA, 25 bp, Artificial sequence
  Synthetic oligonucleotide
tgcataaattagatatacgaagacc

SEQ ID NO: 692668 - DNA, 25 bp, Artificial sequence
  Synthetic oligonucleotide
gactactatattggagaacttttca

SEQ ID NO: 692669 - DNA, 25 bp, Artificial sequence
  Synthetic oligonucleotide
gactactatattcgagaacttttca

SEQ ID NO: 692670 - DNA, 25 bp, Artificial sequence
  Synthetic oligonucleotide
gatctatttatttgttgaactaaca

SEQ ID NO: 692671 - DNA, 25 bp, Artificial sequence
  Synthetic oligonucleotide
cttaagaaagatcgaggcaaagccg

SEQ ID NO: 692672 - DNA, 25 bp, Artificial sequence
  Synthetic oligonucleotide
caattagaaccatttaatagaaact

SEQ ID NO: 692673 - DNA, 25 bp, Artificial sequence
  Synthetic oligonucleotide
tgatcctaaaaaatcctgtaaaaag

SEQ ID NO: 692674 - DNA, 25 bp, Artificial sequence
  Synthetic oligonucleotide
gtcaaagagaatcccagcgccaact

SEQ ID NO: 692675 - DNA, 25 bp, Artificial sequence
  Synthetic oligonucleotide
tatcaatcgtgttgtgtcctctcgt

SEQ ID NO: 692676 - DNA, 25 bp, Artificial sequence
  Synthetic oligonucleotide
tatcaatcgtgtagtgtcctctcgt

SEQ ID NO: 692677 - DNA, 25 bp, Artificial sequence
  Synthetic oligonucleotide
cctgatggattgcaatacattgaga

SEQ ID NO: 692678 - DNA, 25 bp, Artificial sequence
  Synthetic oligonucleotide
cctgatggattggaatacattgaga

SEQ ID NO: 692679 - DNA, 25 bp, Artificial sequence
  Synthetic oligonucleotide
catcgccagccttaacctctgcatt

SEQ ID NO: 692680 - DNA, 25 bp, Artificial sequence
  Synthetic oligonucleotide
catcgccagcctaaacctctgcatt

SEQ ID NO: 692681 - DNA, 25 bp, Artificial sequence
  Synthetic oligonucleotide
gatgcgatcatcgatccggcgacgt

SEQ ID NO: 692682 - DNA, 25 bp, Artificial sequence
  Synthetic oligonucleotide
tgtggtgtgaaatatccttatcttg

SEQ ID NO: 692683 - DNA, 25 bp, Artificial sequence
  Synthetic oligonucleotide
ttgctcatctcttcgtacttcccgg

SEQ ID NO: 692684 - DNA, 25 bp, Artificial sequence
  Synthetic oligonucleotide
tgatcctaaaaattcctgtaaaaag

SEQ ID NO: 692685 - DNA, 25 bp, Artificial sequence
  Synthetic oligonucleotide
ggtttttagccacccaatattataa

SEQ ID NO: 692686 - DNA, 25 bp, Artificial sequence
  Synthetic oligonucleotide
ttcttttaaaaaaatattgaacata

SEQ ID NO: 692687 - DNA, 25 bp, Artificial sequence
  Synthetic oligonucleotide
ttcttttaaaaatatattgaacata

SEQ ID NO: 692688 - DNA, 25 bp, Artificial sequence
  Synthetic oligonucleotide
tagacaagacgaacataaacccatg

SEQ ID NO: 692689 - DNA, 25 bp, Artificial sequence
  Synthetic oligonucleotide
tagacaagacgatcataaacccatg

SEQ ID NO: 692690 - DNA, 25 bp, Artificial sequence
  Synthetic oligonucleotide
cacaaaagtaaatgtaaatgaaaca

SEQ ID NO: 692691 - DNA, 25 bp, Artificial sequence
  Synthetic oligonucleotide
cacaaaagtaaaagtaaatgaaaca

SEQ ID NO: 692692 - DNA, 25 bp, Artificial sequence
  Synthetic oligonucleotide
tcaagggagtacaaattagcagccc

SEQ ID NO: 692693 - DNA, 25 bp, Artificial sequence
  Synthetic oligonucleotide
tcaagggagtactaattagcagccc

SEQ ID NO: 692694 - DNA, 25 bp, Artificial sequence
  Synthetic oligonucleotide
ctttttgcatataagaaagagtcca

SEQ ID NO: 692695 - DNA, 25 bp, Artificial sequence
  Synthetic oligonucleotide
gaagaacgacacgtttccgaccgga

SEQ ID NO: 692696 - DNA, 25 bp, Artificial sequence
  Synthetic oligonucleotide
ttgatattctcattcactaatggtg

SEQ ID NO: 692697 - DNA, 25 bp, Artificial sequence
  Synthetic oligonucleotide
gatctatttattagttgaactaaca

SEQ ID NO: 692698 - DNA, 25 bp, Artificial sequence
  Synthetic oligonucleotide
catttatcaattcgtgcaaaaaggg

SEQ ID NO: 692699 - DNA, 25 bp, Artificial sequence
  Synthetic oligonucleotide
caactacttatcttctatatatgca

SEQ ID NO: 692700 - DNA, 25 bp, Artificial sequence
  Synthetic oligonucleotide
gtcaaagagaatgccagcgccaact

SEQ ID NO: 692701 - DNA, 25 bp, Artificial sequence
  Synthetic oligonucleotide
caactacttatcatctatatatgca

SEQ ID NO: 692702 - DNA, 25 bp, Artificial sequence
  Synthetic oligonucleotide
tgaggtatgtaatgaatttcttttc

SEQ ID NO: 692703 - DNA, 25 bp, Artificial sequence
  Synthetic oligonucleotide
tgaggtatgtaaagaatttcttttc

SEQ ID NO: 692704 - DNA, 25 bp, Artificial sequence
  Synthetic oligonucleotide
gcgatggcaaaagaaacctattgag

SEQ ID NO: 692705 - DNA, 25 bp, Artificial sequence
  Synthetic oligonucleotide
gcgatggcaaaacaaacctattgag

SEQ ID NO: 692706 - DNA, 25 bp, Artificial sequence
  Synthetic oligonucleotide
agttgagccaagttggagcctgcga

SEQ ID NO: 692707 - DNA, 25 bp, Artificial sequence
  Synthetic oligonucleotide
ggtccatacagagttcagtttcaag

SEQ ID NO: 692708 - DNA, 25 bp, Artificial sequence
  Synthetic oligonucleotide
agttgagccaagatggagcctgcga

SEQ ID NO: 692709 - DNA, 25 bp, Artificial sequence
  Synthetic oligonucleotide
ttgatattctcaatcactaatggtg

SEQ ID NO: 692710 - DNA, 25 bp, Artificial sequence
  Synthetic oligonucleotide
gacacttttatctttcctatgaatc

SEQ ID NO: 692711 - DNA, 25 bp, Artificial sequence
  Synthetic oligonucleotide
gacacttttatcattcctatgaatc

SEQ ID NO: 692712 - DNA, 25 bp, Artificial sequence
  Synthetic oligonucleotide
catggtttgtgaccaaatagttatt

SEQ ID NO: 692713 - DNA, 25 bp, Artificial sequence
  Synthetic oligonucleotide
catggtttgtgagcaaatagttatt

SEQ ID NO: 692714 - DNA, 25 bp, Artificial sequence
  Synthetic oligonucleotide
tggttcgttttcatttataatcaaa

SEQ ID NO: 692715 - DNA, 25 bp, Artificial sequence
  Synthetic oligonucleotide
tggttcgttttcttttataatcaaa

SEQ ID NO: 692716 - DNA, 25 bp, Artificial sequence
  Synthetic oligonucleotide
tatacactatgctgatttgcattcc

SEQ ID NO: 692717 - DNA, 25 bp, Artificial sequence
  Synthetic oligonucleotide
taacgatggtgaacagaggaaaacg

SEQ ID NO: 692718 - DNA, 25 bp, Artificial sequence
  Synthetic oligonucleotide
ggtccatacagacttcagtttcaag

SEQ ID NO: 692719 - DNA, 25 bp, Artificial sequence
  Synthetic oligonucleotide
gatgcaacttggttctagttcctgg

SEQ ID NO: 692720 - DNA, 25 bp, Artificial sequence
  Synthetic oligonucleotide
taaatgtgttagataagagcttcac

SEQ ID NO: 692721 - DNA, 25 bp, Artificial sequence
  Synthetic oligonucleotide
taaatgtgttagttaagagcttcac

SEQ ID NO: 692722 - DNA, 25 bp, Artificial sequence
  Synthetic oligonucleotide
tatatacacatatgttaatatcagt

SEQ ID NO: 692723 - DNA, 25 bp, Artificial sequence
  Synthetic oligonucleotide
tatatacacataagttaatatcagt

SEQ ID NO: 692724 - DNA, 25 bp, Artificial sequence
  Synthetic oligonucleotide
tctgatgaatagtactaatttttat

SEQ ID NO: 692725 - DNA, 25 bp, Artificial sequence
  Synthetic oligonucleotide
tctgatgaatagaactaatttttat

SEQ ID NO: 692726 - DNA, 25 bp, Artificial sequence
  Synthetic oligonucleotide
gatgatggctctagtcccctcgagt

SEQ ID NO: 692727 - DNA, 25 bp, Artificial sequence
  Synthetic oligonucleotide
gatgatggctcttgtcccctcgagt

SEQ ID NO: 692728 - DNA, 25 bp, Artificial sequence
  Synthetic oligonucleotide
catttatcaattggtgcaaaaaggg

SEQ ID NO: 692729 - DNA, 25 bp, Artificial sequence
  Synthetic oligonucleotide
caaattcagaacatttcaacccata

SEQ ID NO: 692730 - DNA, 25 bp, Artificial sequence
  Synthetic oligonucleotide
tatacactatgcagatttgcattcc

SEQ ID NO: 692731 - DNA, 25 bp, Artificial sequence
  Synthetic oligonucleotide
gatgcaacttggatctagttcctgg

SEQ ID NO: 692732 - DNA, 25 bp, Artificial sequence
  Synthetic oligonucleotide
cactaaattttataatgtatgaaca

SEQ ID NO: 692733 - DNA, 25 bp, Artificial sequence
  Synthetic oligonucleotide
cactaaattttaaaatgtatgaaca

SEQ ID NO: 692734 - DNA, 25 bp, Artificial sequence
  Synthetic oligonucleotide
tctcgccaaactatgtcctataaaa

SEQ ID NO: 692735 - DNA, 25 bp, Artificial sequence
  Synthetic oligonucleotide
tctcgccaaactttgtcctataaaa

SEQ ID NO: 692736 - DNA, 25 bp, Artificial sequence
  Synthetic oligonucleotide
gatgatcgccaagttgacggtcgaa

SEQ ID NO: 692737 - DNA, 25 bp, Artificial sequence
  Synthetic oligonucleotide
gatgatcgccaacttgacggtcgaa

SEQ ID NO: 692738 - DNA, 25 bp, Artificial sequence
  Synthetic oligonucleotide
tatttcctgactcgaacgttgttcc

SEQ ID NO: 692739 - DNA, 25 bp, Artificial sequence
  Synthetic oligonucleotide
tatttcctgactggaacgttgttcc

SEQ ID NO: 692740 - DNA, 25 bp, Artificial sequence
  Synthetic oligonucleotide
caaattcagaacttttcaacccata

SEQ ID NO: 692741 - DNA, 25 bp, Artificial sequence
  Synthetic oligonucleotide
tgtgttttgctgcaatcactccatg

SEQ ID NO: 692742 - DNA, 25 bp, Artificial sequence
  Synthetic oligonucleotide
taaagacaggaatatcggaatcgcc

SEQ ID NO: 692743 - DNA, 25 bp, Artificial sequence
  Synthetic oligonucleotide
tcttcttatggtatggattctgaaa

SEQ ID NO: 692744 - DNA, 25 bp, Artificial sequence
  Synthetic oligonucleotide
tcttcttatggtttggattctgaaa

SEQ ID NO: 692745 - DNA, 25 bp, Artificial sequence
  Synthetic oligonucleotide
ccctctggttcatatccggttctcg

SEQ ID NO: 692746 - DNA, 25 bp, Artificial sequence
  Synthetic oligonucleotide
ccctctggttcaaatccggttctcg

SEQ ID NO: 692747 - DNA, 25 bp, Artificial sequence
  Synthetic oligonucleotide
acactctaccactctctggcgatga

SEQ ID NO: 692748 - DNA, 25 bp, Artificial sequence
  Synthetic oligonucleotide
acactctaccacactctggcgatga

SEQ ID NO: 692749 - DNA, 25 bp, Artificial sequence
  Synthetic oligonucleotide
cgagaacttagcagacaaaggagac

SEQ ID NO: 692750 - DNA, 25 bp, Artificial sequence
  Synthetic oligonucleotide
cgagaacttagctgacaaaggagac

SEQ ID NO: 692751 - DNA, 25 bp, Artificial sequence
  Synthetic oligonucleotide
tattcttgccaaaatgccattattg

SEQ ID NO: 692752 - DNA, 25 bp, Artificial sequence
  Synthetic oligonucleotide
ttctcagagagctgcaagaacgctc

SEQ ID NO: 692753 - DNA, 25 bp, Artificial sequence
  Synthetic oligonucleotide
tgcagctctcataccgttggcagag

SEQ ID NO: 692754 - DNA, 25 bp, Artificial sequence
  Synthetic oligonucleotide
taaagacaggaaaatcggaatcgcc

SEQ ID NO: 692755 - DNA, 25 bp, Artificial sequence
  Synthetic oligonucleotide
ttcttgagaagaaaaaaagggtcaa

SEQ ID NO: 692756 - DNA, 25 bp, Artificial sequence
  Synthetic oligonucleotide
ttcttgagaagataaaaagggtcaa

SEQ ID NO: 692757 - DNA, 25 bp, Artificial sequence
  Synthetic oligonucleotide
gaaaatatcagaaaaacaaaaccat

SEQ ID NO: 692758 - DNA, 25 bp, Artificial sequence
  Synthetic oligonucleotide
gaaaatatcagataaacaaaaccat

SEQ ID NO: 692759 - DNA, 25 bp, Artificial sequence
  Synthetic oligonucleotide
tatataacttctcacaagtcaccac

SEQ ID NO: 692760 - DNA, 25 bp, Artificial sequence
  Synthetic oligonucleotide
tatataacttctgacaagtcaccac

SEQ ID NO: 692761 - DNA, 25 bp, Artificial sequence
  Synthetic oligonucleotide
tcctgcatcagatgaagcatcaacg

SEQ ID NO: 692762 - DNA, 25 bp, Artificial sequence
  Synthetic oligonucleotide
tcctgcatcagaagaagcatcaacg

SEQ ID NO: 692763 - DNA, 25 bp, Artificial sequence
  Synthetic oligonucleotide
ttctcagagagcagcaagaacgctc

SEQ ID NO: 692764 - DNA, 25 bp, Artificial sequence
  Synthetic oligonucleotide
tgttcaaagactctttggcaaagac

SEQ ID NO: 692765 - DNA, 25 bp, Artificial sequence
  Synthetic oligonucleotide
tgaacatgtggtgggctcgattaaa

SEQ ID NO: 692766 - DNA, 25 bp, Artificial sequence
  Synthetic oligonucleotide
tgctctctttttcttttttatgtaa

SEQ ID NO: 692767 - DNA, 25 bp, Artificial sequence
  Synthetic oligonucleotide
tgctctctttttgttttttatgtaa

SEQ ID NO: 692768 - DNA, 25 bp, Artificial sequence
  Synthetic oligonucleotide
gaagcagaggactcagtgctcttca

SEQ ID NO: 692769 - DNA, 25 bp, Artificial sequence
  Synthetic oligonucleotide
gaagcagaggacacagtgctcttca

SEQ ID NO: 692770 - DNA, 25 bp, Artificial sequence
  Synthetic oligonucleotide
gctgttaaagatgttaaactcgatt

SEQ ID NO: 692771 - DNA, 25 bp, Artificial sequence
  Synthetic oligonucleotide
gctgttaaagatcttaaactcgatt

SEQ ID NO: 692772 - DNA, 25 bp, Artificial sequence
  Synthetic oligonucleotide
tatactggggagttgcaagagagaa

SEQ ID NO: 692773 - DNA, 25 bp, Artificial sequence
  Synthetic oligonucleotide
tatactggggagatgcaagagagaa

SEQ ID NO: 692774 - DNA, 25 bp, Artificial sequence
  Synthetic oligonucleotide
gatctgtcggtttaatccggtttaa

SEQ ID NO: 692775 - DNA, 25 bp, Artificial sequence
  Synthetic oligonucleotide
ggttttgttgaattaaaaaggtgca

SEQ ID NO: 692776 - DNA, 25 bp, Artificial sequence
  Synthetic oligonucleotide
gatctgtcggttaaatccggtttaa

SEQ ID NO: 692777 - DNA, 25 bp, Artificial sequence
  Synthetic oligonucleotide
tgttcaaagactgtttggcaaagac

SEQ ID NO: 692778 - DNA, 25 bp, Artificial sequence
  Synthetic oligonucleotide
gaaagaggttttaatccgaatcaac

SEQ ID NO: 692779 - DNA, 25 bp, Artificial sequence
  Synthetic oligonucleotide
gaaagaggtttttatccgaatcaac

SEQ ID NO: 692780 - DNA, 25 bp, Artificial sequence
  Synthetic oligonucleotide
catgtcttgatatgctcgacactgg

SEQ ID NO: 692781 - DNA, 25 bp, Artificial sequence
  Synthetic oligonucleotide
catgtcttgataagctcgacactgg

SEQ ID NO: 692782 - DNA, 25 bp, Artificial sequence
  Synthetic oligonucleotide
gagattatggagtaatacggtgtca

SEQ ID NO: 692783 - DNA, 25 bp, Artificial sequence
  Synthetic oligonucleotide
gagattatggagaaatacggtgtca

SEQ ID NO: 692784 - DNA, 25 bp, Artificial sequence
  Synthetic oligonucleotide
tgcagctctcattccgttggcagag

SEQ ID NO: 692785 - DNA, 25 bp, Artificial sequence
  Synthetic oligonucleotide
tactttagcttggtaccgtacgatt

SEQ ID NO: 692786 - DNA, 25 bp, Artificial sequence
  Synthetic oligonucleotide
ggttttgttgaaataaaaaggtgca

SEQ ID NO: 692787 - DNA, 25 bp, Artificial sequence
  Synthetic oligonucleotide
aaggcagcccaaaattcgataaaag

SEQ ID NO: 692788 - DNA, 25 bp, Artificial sequence
  Synthetic oligonucleotide
cggttgagatgaaaacaaatgggtc

SEQ ID NO: 692789 - DNA, 25 bp, Artificial sequence
  Synthetic oligonucleotide
tcacatgtcgatgctaatccaacgg

SEQ ID NO: 692790 - DNA, 25 bp, Artificial sequence
  Synthetic oligonucleotide
tcacatgtcgatcctaatccaacgg

SEQ ID NO: 692791 - DNA, 25 bp, Artificial sequence
  Synthetic oligonucleotide
tttaatcctatcatcaaacgtgcaa

SEQ ID NO: 692792 - DNA, 25 bp, Artificial sequence
  Synthetic oligonucleotide
tttaatcctatcttcaaacgtgcaa

SEQ ID NO: 692793 - DNA, 25 bp, Artificial sequence
  Synthetic oligonucleotide
gtttctttttctatttacatataca

SEQ ID NO: 692794 - DNA, 25 bp, Artificial sequence
  Synthetic oligonucleotide
gtttctttttctttttacatataca

SEQ ID NO: 692795 - DNA, 25 bp, Artificial sequence
  Synthetic oligonucleotide
catttttcttctacttgatagtaga

SEQ ID NO: 692796 - DNA, 25 bp, Artificial sequence
  Synthetic oligonucleotide
catttttcttcttcttgatagtaga

SEQ ID NO: 692797 - DNA, 25 bp, Artificial sequence
  Synthetic oligonucleotide
catttacaattatattcactgccag

SEQ ID NO: 692798 - DNA, 25 bp, Artificial sequence
  Synthetic oligonucleotide
cacgacaatgatggcaaaaattaag

SEQ ID NO: 692799 - DNA, 25 bp, Artificial sequence
  Synthetic oligonucleotide
ggtaatactaaccaaagacatctga

SEQ ID NO: 692800 - DNA, 25 bp, Artificial sequence
  Synthetic oligonucleotide
aaggcagcccaatattcgataaaag

SEQ ID NO: 692801 - DNA, 25 bp, Artificial sequence
  Synthetic oligonucleotide
gagtacctcgatcttttctagtttg

SEQ ID NO: 692802 - DNA, 25 bp, Artificial sequence
  Synthetic oligonucleotide
gagtacctcgatgttttctagtttg

SEQ ID NO: 692803 - DNA, 25 bp, Artificial sequence
  Synthetic oligonucleotide
gaggacatcgctaccaataaagaaa

SEQ ID NO: 692804 - DNA, 25 bp, Artificial sequence
  Synthetic oligonucleotide
gaggacatcgcttccaataaagaaa

SEQ ID NO: 692805 - DNA, 25 bp, Artificial sequence
  Synthetic oligonucleotide
gaaaaatgtctaaatcttgcttggg

SEQ ID NO: 692806 - DNA, 25 bp, Artificial sequence
  Synthetic oligonucleotide
gaaaaatgtctatatcttgcttggg

SEQ ID NO: 692807 - DNA, 25 bp, Artificial sequence
  Synthetic oligonucleotide
aaaacaggaattgattaatatgaag

SEQ ID NO: 692808 - DNA, 25 bp, Artificial sequence
  Synthetic oligonucleotide
aaaacaggaattcattaatatgaag

SEQ ID NO: 692809 - DNA, 25 bp, Artificial sequence
  Synthetic oligonucleotide
cacgacaatgatcgcaaaaattaag

SEQ ID NO: 692810 - DNA, 25 bp, Artificial sequence
  Synthetic oligonucleotide
gacaaaaatgattcgttaaatgaat

SEQ ID NO: 692811 - DNA, 25 bp, Artificial sequence
  Synthetic oligonucleotide
actgtttagtatagctgtatatgaa

SEQ ID NO: 692812 - DNA, 25 bp, Artificial sequence
  Synthetic oligonucleotide
tactttagcttgctaccgtacgatt

SEQ ID NO: 692813 - DNA, 25 bp, Artificial sequence
  Synthetic oligonucleotide
gaaataattattataaagaaacaaa

SEQ ID NO: 692814 - DNA, 25 bp, Artificial sequence
  Synthetic oligonucleotide
gaaataattattttaaagaaacaaa

SEQ ID NO: 692815 - DNA, 25 bp, Artificial sequence
  Synthetic oligonucleotide
gaagatctcattatcgttatgtcgg

SEQ ID NO: 692816 - DNA, 25 bp, Artificial sequence
  Synthetic oligonucleotide
gaagatctcattttcgttatgtcgg

SEQ ID NO: 692817 - DNA, 25 bp, Artificial sequence
  Synthetic oligonucleotide
tacgggttctaatgaaacaattatg

SEQ ID NO: 692818 - DNA, 25 bp, Artificial sequence
  Synthetic oligonucleotide
tacgggttctaaagaaacaattatg

SEQ ID NO: 692819 - DNA, 25 bp, Artificial sequence
  Synthetic oligonucleotide
tacaagtttgtacgtaattggattc

SEQ ID NO: 692820 - DNA, 25 bp, Artificial sequence
  Synthetic oligonucleotide
catttacaattaaattcactgccag

SEQ ID NO: 692821 - DNA, 25 bp, Artificial sequence
  Synthetic oligonucleotide
gacaaaaatgatacgttaaatgaat

SEQ ID NO: 692822 - DNA, 25 bp, Artificial sequence
  Synthetic oligonucleotide
cggttgagatgataacaaatgggtc

SEQ ID NO: 692823 - DNA, 25 bp, Artificial sequence
  Synthetic oligonucleotide
gagataaaagtttaagcaattacta

SEQ ID NO: 692824 - DNA, 25 bp, Artificial sequence
  Synthetic oligonucleotide
gagataaaagttaaagcaattacta

SEQ ID NO: 692825 - DNA, 25 bp, Artificial sequence
  Synthetic oligonucleotide
gccatcaatttgatggatccaaaca

SEQ ID NO: 692826 - DNA, 25 bp, Artificial sequence
  Synthetic oligonucleotide
gccatcaatttgttggatccaaaca

SEQ ID NO: 692827 - DNA, 25 bp, Artificial sequence
  Synthetic oligonucleotide
caacttacaaaagatatcaatatat

SEQ ID NO: 692828 - DNA, 25 bp, Artificial sequence
  Synthetic oligonucleotide
caacttacaaaacatatcaatatat

SEQ ID NO: 692829 - DNA, 25 bp, Artificial sequence
  Synthetic oligonucleotide
cttgtgctacttctttattagcgga

SEQ ID NO: 692830 - DNA, 25 bp, Artificial sequence
  Synthetic oligonucleotide
cttgtgctacttgtttattagcgga

SEQ ID NO: 692831 - DNA, 25 bp, Artificial sequence
  Synthetic oligonucleotide
ggtaatactaacgaaagacatctga

SEQ ID NO: 692832 - DNA, 25 bp, Artificial sequence
  Synthetic oligonucleotide
tacaagtttgtaggtaattggattc

SEQ ID NO: 692833 - DNA, 25 bp, Artificial sequence
  Synthetic oligonucleotide
cagatttcacatcggcaggttggat

SEQ ID NO: 692834 - DNA, 25 bp, Artificial sequence
  Synthetic oligonucleotide
aacttactagaatcagagacccaag

SEQ ID NO: 692835 - DNA, 25 bp, Artificial sequence
  Synthetic oligonucleotide
aacttactagaaacagagacccaag

SEQ ID NO: 692836 - DNA, 25 bp, Artificial sequence
  Synthetic oligonucleotide
tatttattttgcacgatccatttcg

SEQ ID NO: 692837 - DNA, 25 bp, Artificial sequence
  Synthetic oligonucleotide
tatttattttgctcgatccatttcg

SEQ ID NO: 692838 - DNA, 25 bp, Artificial sequence
  Synthetic oligonucleotide
tttttttaataaatagatagatcac

SEQ ID NO: 692839 - DNA, 25 bp, Artificial sequence
  Synthetic oligonucleotide
tttttttaataattagatagatcac

SEQ ID NO: 692840 - DNA, 25 bp, Artificial sequence
  Synthetic oligonucleotide
cttaaggaaaaaatctacagaaaga

SEQ ID NO: 692841 - DNA, 25 bp, Artificial sequence
  Synthetic oligonucleotide
cttaaggaaaaattctacagaaaga

SEQ ID NO: 692842 - DNA, 25 bp, Artificial sequence
  Synthetic oligonucleotide
gaatctttatgtaggttttatttgt

SEQ ID NO: 692843 - DNA, 25 bp, Artificial sequence
  Synthetic oligonucleotide
cattgatcattgtctaaatattaga

SEQ ID NO: 692844 - DNA, 25 bp, Artificial sequence
  Synthetic oligonucleotide
caaagtaaagtgtaatatcagaacc

SEQ ID NO: 692845 - DNA, 25 bp, Artificial sequence
  Synthetic oligonucleotide
cagatttcacatgggcaggttggat

SEQ ID NO: 692846 - DNA, 25 bp, Artificial sequence
  Synthetic oligonucleotide
tccaatatattgcttaaaaataagt

SEQ ID NO: 692847 - DNA, 25 bp, Artificial sequence
  Synthetic oligonucleotide
tccaatatattggttaaaaataagt

SEQ ID NO: 692848 - DNA, 25 bp, Artificial sequence
  Synthetic oligonucleotide
tgaacatgtggtcggctcgattaaa

SEQ ID NO: 692849 - DNA, 25 bp, Artificial sequence
  Synthetic oligonucleotide
tgtgttttgctggaatcactccatg

SEQ ID NO: 692850 - DNA, 25 bp, Artificial sequence
  Synthetic oligonucleotide
gagagtttcttgcttatttgtttca

SEQ ID NO: 692851 - DNA, 25 bp, Artificial sequence
  Synthetic oligonucleotide
gagagtttcttggttatttgtttca

SEQ ID NO: 692852 - DNA, 25 bp, Artificial sequence
  Synthetic oligonucleotide
aaaaagaacccacagtgttttcatc

SEQ ID NO: 692853 - DNA, 25 bp, Artificial sequence
  Synthetic oligonucleotide
tattcttgccaatatgccattattg

SEQ ID NO: 692854 - DNA, 25 bp, Artificial sequence
  Synthetic oligonucleotide
cattgatcattgactaaatattaga

SEQ ID NO: 692855 - DNA, 25 bp, Artificial sequence
  Synthetic oligonucleotide
taaccgattttgattagtccttgaa

SEQ ID NO: 692856 - DNA, 25 bp, Artificial sequence
  Synthetic oligonucleotide
catattcaattctcctataaggcta

SEQ ID NO: 692857 - DNA, 25 bp, Artificial sequence
  Synthetic oligonucleotide
gaataaattcgagcttcttctcaga

SEQ ID NO: 692858 - DNA, 25 bp, Artificial sequence
  Synthetic oligonucleotide
gaataaattcgaccttcttctcaga

SEQ ID NO: 692859 - DNA, 25 bp, Artificial sequence
  Synthetic oligonucleotide
tacttatgtaataaacttgtggtac

SEQ ID NO: 692860 - DNA, 25 bp, Artificial sequence
  Synthetic oligonucleotide
tacttatgtaattaacttgtggtac

SEQ ID NO: 692861 - DNA, 25 bp, Artificial sequence
  Synthetic oligonucleotide
gtctgtctctctatggttttcatcc

SEQ ID NO: 692862 - DNA, 25 bp, Artificial sequence
  Synthetic oligonucleotide
gtctgtctctctttggttttcatcc

SEQ ID NO: 692863 - DNA, 25 bp, Artificial sequence
  Synthetic oligonucleotide
ttcaacacaatagatagacagagcc

SEQ ID NO: 692864 - DNA, 25 bp, Artificial sequence
  Synthetic oligonucleotide
ttcaacacaatacatagacagagcc

SEQ ID NO: 692865 - DNA, 25 bp, Artificial sequence
  Synthetic oligonucleotide
gaaagtttagaagatcatcaagaca

SEQ ID NO: 692866 - DNA, 25 bp, Artificial sequence
  Synthetic oligonucleotide
tagtttatgccaaaccctctgccca

SEQ ID NO: 692867 - DNA, 25 bp, Artificial sequence
  Synthetic oligonucleotide
gaaagtttagaacatcatcaagaca

SEQ ID NO: 692868 - DNA, 25 bp, Artificial sequence
  Synthetic oligonucleotide
taaccgattttgtttagtccttgaa

SEQ ID NO: 692869 - DNA, 25 bp, Artificial sequence
  Synthetic oligonucleotide
gaacgcaatccgcttctgtaacgaa

SEQ ID NO: 692870 - DNA, 25 bp, Artificial sequence
  Synthetic oligonucleotide
gaacgcaatccggttctgtaacgaa

SEQ ID NO: 692871 - DNA, 25 bp, Artificial sequence
  Synthetic oligonucleotide
ttcaacggaaacagagcaaaaactt

SEQ ID NO: 692872 - DNA, 25 bp, Artificial sequence
  Synthetic oligonucleotide
ttcaacggaaactgagcaaaaactt

SEQ ID NO: 692873 - DNA, 25 bp, Artificial sequence
  Synthetic oligonucleotide
tatacgggccggtgggattgaaacc

SEQ ID NO: 692874 - DNA, 25 bp, Artificial sequence
  Synthetic oligonucleotide
tatacgggccggagggattgaaacc

SEQ ID NO: 692875 - DNA, 25 bp, Artificial sequence
  Synthetic oligonucleotide
caaagtaaagtgaaatatcagaacc

SEQ ID NO: 692876 - DNA, 25 bp, Artificial sequence
  Synthetic oligonucleotide
gaatctttatgttggttttatttgt

SEQ ID NO: 692877 - DNA, 25 bp, Artificial sequence
  Synthetic oligonucleotide
tagtttatgccataccctctgccca

SEQ ID NO: 692878 - DNA, 25 bp, Artificial sequence
  Synthetic oligonucleotide
aaaccatctcgctttactttgaaca

SEQ ID NO: 692879 - DNA, 25 bp, Artificial sequence
  Synthetic oligonucleotide
aaaaagaacccagagtgttttcatc

SEQ ID NO: 692880 - DNA, 25 bp, Artificial sequence
  Synthetic oligonucleotide
gctttagctatgcattaggttttag

SEQ ID NO: 692881 - DNA, 25 bp, Artificial sequence
  Synthetic oligonucleotide
ctagttgaaaatgacaatggtaggt

SEQ ID NO: 692882 - DNA, 25 bp, Artificial sequence
  Synthetic oligonucleotide
ctagttgaaaatcacaatggtaggt

SEQ ID NO: 692883 - DNA, 25 bp, Artificial sequence
  Synthetic oligonucleotide
gacaattacttctcaacgaaatgga

SEQ ID NO: 692884 - DNA, 25 bp, Artificial sequence
  Synthetic oligonucleotide
gacaattacttcacaacgaaatgga

SEQ ID NO: 692885 - DNA, 25 bp, Artificial sequence
  Synthetic oligonucleotide
tacttttgaggattatggtaaattc

SEQ ID NO: 692886 - DNA, 25 bp, Artificial sequence
  Synthetic oligonucleotide
tacttttgaggaatatggtaaattc

SEQ ID NO: 692887 - DNA, 25 bp, Artificial sequence
  Synthetic oligonucleotide
tatttttgtctttttggtctatcta

SEQ ID NO: 692888 - DNA, 25 bp, Artificial sequence
  Synthetic oligonucleotide
aactttgaatttagtctttatttca

SEQ ID NO: 692889 - DNA, 25 bp, Artificial sequence
  Synthetic oligonucleotide
aaaccatctcgcattactttgaaca

SEQ ID NO: 692890 - DNA, 25 bp, Artificial sequence
  Synthetic oligonucleotide
aactttgaattttgtctttatttca

SEQ ID NO: 692891 - DNA, 25 bp, Artificial sequence
  Synthetic oligonucleotide
caatggctttgaatttgaatccgtg

SEQ ID NO: 692892 - DNA, 25 bp, Artificial sequence
  Synthetic oligonucleotide
caatggctttgattttgaatccgtg

SEQ ID NO: 692893 - DNA, 25 bp, Artificial sequence
  Synthetic oligonucleotide
ctcgttacctaatttaaggcaatgt

SEQ ID NO: 692894 - DNA, 25 bp, Artificial sequence
  Synthetic oligonucleotide
ctcgttacctaaattaaggcaatgt

SEQ ID NO: 692895 - DNA, 25 bp, Artificial sequence
  Synthetic oligonucleotide
ggtgttggaacatatccatgattaa

SEQ ID NO: 692896 - DNA, 25 bp, Artificial sequence
  Synthetic oligonucleotide
ggtgttggaacaaatccatgattaa

SEQ ID NO: 692897 - DNA, 25 bp, Artificial sequence
  Synthetic oligonucleotide
tgtgagatacaatagggccattgat

SEQ ID NO: 692898 - DNA, 25 bp, Artificial sequence
  Synthetic oligonucleotide
tgtgagatacaaaagggccattgat

SEQ ID NO: 692899 - DNA, 25 bp, Artificial sequence
  Synthetic oligonucleotide
actgtttagtattgctgtatatgaa

SEQ ID NO: 692900 - DNA, 25 bp, Artificial sequence
  Synthetic oligonucleotide
tatttttgtcttattggtctatcta

SEQ ID NO: 692901 - DNA, 25 bp, Artificial sequence
  Synthetic oligonucleotide
tctaagtgaaatttctagtgactaa

SEQ ID NO: 692902 - DNA, 25 bp, Artificial sequence
  Synthetic oligonucleotide
tcatcgcaatttatgctttttagtt

SEQ ID NO: 692903 - DNA, 25 bp, Artificial sequence
  Synthetic oligonucleotide
tcatcgcaatttttgctttttagtt

SEQ ID NO: 692904 - DNA, 25 bp, Artificial sequence
  Synthetic oligonucleotide
ctgtctttatctaataagtcctacc

SEQ ID NO: 692905 - DNA, 25 bp, Artificial sequence
  Synthetic oligonucleotide
ctgtctttatcttataagtcctacc

SEQ ID NO: 692906 - DNA, 25 bp, Artificial sequence
  Synthetic oligonucleotide
tgtcaaggataaggaataaacgatt

SEQ ID NO: 692907 - DNA, 25 bp, Artificial sequence
  Synthetic oligonucleotide
tgtcaaggataacgaataaacgatt

SEQ ID NO: 692908 - DNA, 25 bp, Artificial sequence
  Synthetic oligonucleotide
tttgtgatccaagacgcgccttgcc

SEQ ID NO: 692909 - DNA, 25 bp, Artificial sequence
  Synthetic oligonucleotide
tttgtgatccaacacgcgccttgcc

SEQ ID NO: 692910 - DNA, 25 bp, Artificial sequence
  Synthetic oligonucleotide
gctttagctatggattaggttttag

SEQ ID NO: 692911 - DNA, 25 bp, Artificial sequence
  Synthetic oligonucleotide
tgaaacaggatattaatgggaagcg

SEQ ID NO: 692912 - DNA, 25 bp, Artificial sequence
  Synthetic oligonucleotide
catattcaattcacctataaggcta

SEQ ID NO: 692913 - DNA, 25 bp, Artificial sequence
  Synthetic oligonucleotide
tctaagtgaaatatctagtgactaa

SEQ ID NO: 692914 - DNA, 25 bp, Artificial sequence
  Synthetic oligonucleotide
tgatgaattcttgtaaactttaatc

SEQ ID NO: 692915 - DNA, 25 bp, Artificial sequence
  Synthetic oligonucleotide
tgatgaattcttctaaactttaatc

SEQ ID NO: 692916 - DNA, 25 bp, Artificial sequence
  Synthetic oligonucleotide
tttttaacgtaacaattatcattgg

SEQ ID NO: 692917 - DNA, 25 bp, Artificial sequence
  Synthetic oligonucleotide
tttttaacgtaagaattatcattgg

SEQ ID NO: 692918 - DNA, 25 bp, Artificial sequence
  Synthetic oligonucleotide
ttttttgaataatcacttgtctttg

SEQ ID NO: 692919 - DNA, 25 bp, Artificial sequence
  Synthetic oligonucleotide
ttttttgaataaacacttgtctttg

SEQ ID NO: 692920 - DNA, 25 bp, Artificial sequence
  Synthetic oligonucleotide
caaacatttaagtttgtggttacac

SEQ ID NO: 692921 - DNA, 25 bp, Artificial sequence
  Synthetic oligonucleotide
caaacatttaagattgtggttacac

SEQ ID NO: 692922 - DNA, 25 bp, Artificial sequence
  Synthetic oligonucleotide
tgaaacaggataataatgggaagcg

SEQ ID NO: 692923 - DNA, 25 bp, Artificial sequence
  Synthetic oligonucleotide
ccgtgacctggtaaccggagcgtaa

SEQ ID NO: 692924 - DNA, 25 bp, Artificial sequence
  Synthetic oligonucleotide
ggattatctcattccttctaacaaa

SEQ ID NO: 692925 - DNA, 25 bp, Artificial sequence
  Synthetic oligonucleotide
tgttcaacgtcttttgtgtctacag

SEQ ID NO: 692926 - DNA, 25 bp, Artificial sequence
  Synthetic oligonucleotide
tcatcaagactgtgattctgaatcg

SEQ ID NO: 692927 - DNA, 25 bp, Artificial sequence
  Synthetic oligonucleotide
tcatcaagactgagattctgaatcg

SEQ ID NO: 692928 - DNA, 25 bp, Artificial sequence
  Synthetic oligonucleotide
caaaatggtaagtaaattgtatcaa

SEQ ID NO: 692929 - DNA, 25 bp, Artificial sequence
  Synthetic oligonucleotide
caaaatggtaagaaaattgtatcaa

SEQ ID NO: 692930 - DNA, 25 bp, Artificial sequence
  Synthetic oligonucleotide
gcatttctacctggccgtggatcgt

SEQ ID NO: 692931 - DNA, 25 bp, Artificial sequence
  Synthetic oligonucleotide
gcatttctacctcgccgtggatcgt

SEQ ID NO: 692932 - DNA, 25 bp, Artificial sequence
  Synthetic oligonucleotide
caatttgtttttttggtttgcagtc

SEQ ID NO: 692933 - DNA, 25 bp, Artificial sequence
  Synthetic oligonucleotide
aactttggatgtcggcacaggagac

SEQ ID NO: 692934 - DNA, 25 bp, Artificial sequence
  Synthetic oligonucleotide
ggattatctcataccttctaacaaa

SEQ ID NO: 692935 - DNA, 25 bp, Artificial sequence
  Synthetic oligonucleotide
tattaggcgttcaaggtcgtcgtcc

SEQ ID NO: 692936 - DNA, 25 bp, Artificial sequence
  Synthetic oligonucleotide
tctcgttccaggttttaattttgag

SEQ ID NO: 692937 - DNA, 25 bp, Artificial sequence
  Synthetic oligonucleotide
tctcgttccaggatttaattttgag

SEQ ID NO: 692938 - DNA, 25 bp, Artificial sequence
  Synthetic oligonucleotide
ggaagctccatcactaccatttcaa

SEQ ID NO: 692939 - DNA, 25 bp, Artificial sequence
  Synthetic oligonucleotide
ggaagctccatctctaccatttcaa

SEQ ID NO: 692940 - DNA, 25 bp, Artificial sequence
  Synthetic oligonucleotide
aattggacaattatgagaaagacgg

SEQ ID NO: 692941 - DNA, 25 bp, Artificial sequence
  Synthetic oligonucleotide
ccgtgacctggttaccggagcgtaa

SEQ ID NO: 692942 - DNA, 25 bp, Artificial sequence
  Synthetic oligonucleotide
taaatctcaaaacactggaaacgac

SEQ ID NO: 692943 - DNA, 25 bp, Artificial sequence
  Synthetic oligonucleotide
taaatctcaaaagactggaaacgac

SEQ ID NO: 692944 - DNA, 25 bp, Artificial sequence
  Synthetic oligonucleotide
gatacttacataaaaccaaacgacg

SEQ ID NO: 692945 - DNA, 25 bp, Artificial sequence
  Synthetic oligonucleotide
caatttgtttttatggtttgcagtc

SEQ ID NO: 692946 - DNA, 25 bp, Artificial sequence
  Synthetic oligonucleotide
ctttggtatttgttttgaaaagacc

SEQ ID NO: 692947 - DNA, 25 bp, Artificial sequence
  Synthetic oligonucleotide
aattggacaattttgagaaagacgg

SEQ ID NO: 692948 - DNA, 25 bp, Artificial sequence
  Synthetic oligonucleotide
tggtattaacttacatgttcttccc

SEQ ID NO: 692949 - DNA, 25 bp, Artificial sequence
  Synthetic oligonucleotide
tggtattaactttcatgttcttccc

SEQ ID NO: 692950 - DNA, 25 bp, Artificial sequence
  Synthetic oligonucleotide
cgtttgttattgatcttgttgtacc

SEQ ID NO: 692951 - DNA, 25 bp, Artificial sequence
  Synthetic oligonucleotide
cgtttgttattgttcttgttgtacc

SEQ ID NO: 692952 - DNA, 25 bp, Artificial sequence
  Synthetic oligonucleotide
ttcattgtttgattgatatcatcgg

SEQ ID NO: 692953 - DNA, 25 bp, Artificial sequence
  Synthetic oligonucleotide
ttcattgtttgaatgatatcatcgg

SEQ ID NO: 692954 - DNA, 25 bp, Artificial sequence
  Synthetic oligonucleotide
gattcacttgctaggttcatcatga

SEQ ID NO: 692955 - DNA, 25 bp, Artificial sequence
  Synthetic oligonucleotide
aactttggatgtgggcacaggagac

SEQ ID NO: 692956 - DNA, 25 bp, Artificial sequence
  Synthetic oligonucleotide
ctttggtatttgatttgaaaagacc

SEQ ID NO: 692957 - DNA, 25 bp, Artificial sequence
  Synthetic oligonucleotide
tgtaaaatatgatccagaaacgatg

SEQ ID NO: 692958 - DNA, 25 bp, Artificial sequence
  Synthetic oligonucleotide
tttaactttcatagctgaggcatgt

SEQ ID NO: 692959 - DNA, 25 bp, Artificial sequence
  Synthetic oligonucleotide
tttaactttcattgctgaggcatgt

SEQ ID NO: 692960 - DNA, 25 bp, Artificial sequence
  Synthetic oligonucleotide
ccttagccgcttaggtatctctctc

SEQ ID NO: 692961 - DNA, 25 bp, Artificial sequence
  Synthetic oligonucleotide
ccttagccgctttggtatctctctc

SEQ ID NO: 692962 - DNA, 25 bp, Artificial sequence
  Synthetic oligonucleotide
gtctgttcttccttatccactcttc

SEQ ID NO: 692963 - DNA, 25 bp, Artificial sequence
  Synthetic oligonucleotide
gtctgttcttccatatccactcttc

SEQ ID NO: 692964 - DNA, 25 bp, Artificial sequence
  Synthetic oligonucleotide
tagtctgttgcagctctcgtgacga

SEQ ID NO: 692965 - DNA, 25 bp, Artificial sequence
  Synthetic oligonucleotide
tagtctgttgcacctctcgtgacga

SEQ ID NO: 692966 - DNA, 25 bp, Artificial sequence
  Synthetic oligonucleotide
tattaggcgttctaggtcgtcgtcc

SEQ ID NO: 692967 - DNA, 25 bp, Artificial sequence
  Synthetic oligonucleotide
gattcacttgcttggttcatcatga

SEQ ID NO: 692968 - DNA, 25 bp, Artificial sequence
  Synthetic oligonucleotide
caaattcggagaacgagactccata

SEQ ID NO: 692969 - DNA, 25 bp, Artificial sequence
  Synthetic oligonucleotide
cacctcgtgataaaaagatgattgc

SEQ ID NO: 692970 - DNA, 25 bp, Artificial sequence
  Synthetic oligonucleotide
cacctcgtgatataaagatgattgc

SEQ ID NO: 692971 - DNA, 25 bp, Artificial sequence
  Synthetic oligonucleotide
gtttgactggactacttttggaatg

SEQ ID NO: 692972 - DNA, 25 bp, Artificial sequence
  Synthetic oligonucleotide
gtttgactggacaacttttggaatg

SEQ ID NO: 692973 - DNA, 25 bp, Artificial sequence
  Synthetic oligonucleotide
tattatctttttttgtttggattga

SEQ ID NO: 692974 - DNA, 25 bp, Artificial sequence
  Synthetic oligonucleotide
tattatctttttatgtttggattga

SEQ ID NO: 692975 - DNA, 25 bp, Artificial sequence
  Synthetic oligonucleotide
tgtgaataaatctaaacctgtcatt

SEQ ID NO: 692976 - DNA, 25 bp, Artificial sequence
  Synthetic oligonucleotide
tgtgaataaatcaaaacctgtcatt

SEQ ID NO: 692977 - DNA, 25 bp, Artificial sequence
  Synthetic oligonucleotide
gatacttacatataaccaaacgacg

SEQ ID NO: 692978 - DNA, 25 bp, Artificial sequence
  Synthetic oligonucleotide
taaggcgtttaagatcattgaccac

SEQ ID NO: 692979 - DNA, 25 bp, Artificial sequence
  Synthetic oligonucleotide
gatcgaagaagcagaccgtgacagt

SEQ ID NO: 692980 - DNA, 25 bp, Artificial sequence
  Synthetic oligonucleotide
caaattcggagatcgagactccata

SEQ ID NO: 692981 - DNA, 25 bp, Artificial sequence
  Synthetic oligonucleotide
catagatttcgaggaatttgtgcat

SEQ ID NO: 692982 - DNA, 25 bp, Artificial sequence
  Synthetic oligonucleotide
catagatttcgacgaatttgtgcat

SEQ ID NO: 692983 - DNA, 25 bp, Artificial sequence
  Synthetic oligonucleotide
ttgatggcagaagtagataaaaacc

SEQ ID NO: 692984 - DNA, 25 bp, Artificial sequence
  Synthetic oligonucleotide
ttgatggcagaactagataaaaacc

SEQ ID NO: 692985 - DNA, 25 bp, Artificial sequence
  Synthetic oligonucleotide
tagtttggtcatgttcattgttgca

SEQ ID NO: 692986 - DNA, 25 bp, Artificial sequence
  Synthetic oligonucleotide
tagtttggtcatcttcattgttgca

SEQ ID NO: 692987 - DNA, 25 bp, Artificial sequence
  Synthetic oligonucleotide
catggtttagatgattgtacgtaga

SEQ ID NO: 692988 - DNA, 25 bp, Artificial sequence
  Synthetic oligonucleotide
catggtttagatcattgtacgtaga

SEQ ID NO: 692989 - DNA, 25 bp, Artificial sequence
  Synthetic oligonucleotide
taaggcgtttaacatcattgaccac

SEQ ID NO: 692990 - DNA, 25 bp, Artificial sequence
  Synthetic oligonucleotide
cctcttacggctaagtataaatcaa

SEQ ID NO: 692991 - DNA, 25 bp, Artificial sequence
  Synthetic oligonucleotide
gcagatagagaacgagctatggtta

SEQ ID NO: 692992 - DNA, 25 bp, Artificial sequence
  Synthetic oligonucleotide
tttttatgtatatatgtctttgacc

SEQ ID NO: 692993 - DNA, 25 bp, Artificial sequence
  Synthetic oligonucleotide
tttttatgtataaatgtctttgacc

SEQ ID NO: 692994 - DNA, 25 bp, Artificial sequence
  Synthetic oligonucleotide
tgaatatgtaaatgtccttgaacga

SEQ ID NO: 692995 - DNA, 25 bp, Artificial sequence
  Synthetic oligonucleotide
tgaatatgtaaaagtccttgaacga

SEQ ID NO: 692996 - DNA, 25 bp, Artificial sequence
  Synthetic oligonucleotide
gtataaaaataaaaatgtaattcac

SEQ ID NO: 692997 - DNA, 25 bp, Artificial sequence
  Synthetic oligonucleotide
gtataaaaataataatgtaattcac

SEQ ID NO: 692998 - DNA, 25 bp, Artificial sequence
  Synthetic oligonucleotide
gaagtttgatttctggcttggtcga

SEQ ID NO: 692999 - DNA, 25 bp, Artificial sequence
  Synthetic oligonucleotide
gaagtttgatttgtggcttggtcga

SEQ ID NO: 693000 - DNA, 25 bp, Artificial sequence
  Synthetic oligonucleotide
gggagaaaatttcacagataatgat

SEQ ID NO: 693001 - DNA, 25 bp, Artificial sequence
  Synthetic oligonucleotide
gaataatatttgttaatcaccttga

SEQ ID NO: 693002 - DNA, 25 bp, Artificial sequence
  Synthetic oligonucleotide
gggagaaaatttgacagataatgat

SEQ ID NO: 693003 - DNA, 25 bp, Artificial sequence
  Synthetic oligonucleotide
cctcttacggcttagtataaatcaa

SEQ ID NO: 693004 - DNA, 25 bp, Artificial sequence
  Synthetic oligonucleotide
taacttggaggacttcatgaagatg

SEQ ID NO: 693005 - DNA, 25 bp, Artificial sequence
  Synthetic oligonucleotide
taacttggaggagttcatgaagatg

SEQ ID NO: 693006 - DNA, 25 bp, Artificial sequence
  Synthetic oligonucleotide
catgtttttgccttaacctacgcag

SEQ ID NO: 693007 - DNA, 25 bp, Artificial sequence
  Synthetic oligonucleotide
catgtttttgccataacctacgcag

SEQ ID NO: 693008 - DNA, 25 bp, Artificial sequence
  Synthetic oligonucleotide
taattttgcgttatatctataatcg

SEQ ID NO: 693009 - DNA, 25 bp, Artificial sequence
  Synthetic oligonucleotide
taattttgcgttttatctataatcg

SEQ ID NO: 693010 - DNA, 25 bp, Artificial sequence
  Synthetic oligonucleotide
gatcgaagaagctgaccgtgacagt

SEQ ID NO: 693011 - DNA, 25 bp, Artificial sequence
  Synthetic oligonucleotide
tgtaaaatatgaaccagaaacgatg

SEQ ID NO: 693012 - DNA, 25 bp, Artificial sequence
  Synthetic oligonucleotide
gaataatatttgataatcaccttga

SEQ ID NO: 693013 - DNA, 25 bp, Artificial sequence
  Synthetic oligonucleotide
gaaaaaggaaacaacgcataagagt

SEQ ID NO: 693014 - DNA, 25 bp, Artificial sequence
  Synthetic oligonucleotide
tacagagagagacagggctatagat

SEQ ID NO: 693015 - DNA, 25 bp, Artificial sequence
  Synthetic oligonucleotide
tacagagagagagagggctatagat

SEQ ID NO: 693016 - DNA, 25 bp, Artificial sequence
  Synthetic oligonucleotide
gatcatcacaaacaaaaacctagag

SEQ ID NO: 693017 - DNA, 25 bp, Artificial sequence
  Synthetic oligonucleotide
gatcatcacaaagaaaaacctagag

SEQ ID NO: 693018 - DNA, 25 bp, Artificial sequence
  Synthetic oligonucleotide
tatagaatagcctcatcgtttaagt

SEQ ID NO: 693019 - DNA, 25 bp, Artificial sequence
  Synthetic oligonucleotide
tatagaatagccacatcgtttaagt

SEQ ID NO: 693020 - DNA, 25 bp, Artificial sequence
  Synthetic oligonucleotide
gagaaaaaaggatatccctaacaca

SEQ ID NO: 693021 - DNA, 25 bp, Artificial sequence
  Synthetic oligonucleotide
gagaaaaaaggaaatccctaacaca

SEQ ID NO: 693022 - DNA, 25 bp, Artificial sequence
  Synthetic oligonucleotide
tgttcaacgtctattgtgtctacag

SEQ ID NO: 693023 - DNA, 25 bp, Artificial sequence
  Synthetic oligonucleotide
gtaccgttacgcagaaccctaatca

SEQ ID NO: 693024 - DNA, 25 bp, Artificial sequence
  Synthetic oligonucleotide
ttcgtttagaatcattacgctagcc

SEQ ID NO: 693025 - DNA, 25 bp, Artificial sequence
  Synthetic oligonucleotide
gaaaaaggaaactacgcataagagt

SEQ ID NO: 693026 - DNA, 25 bp, Artificial sequence
  Synthetic oligonucleotide
ggtttagtacgttattaccaaatca

SEQ ID NO: 693027 - DNA, 25 bp, Artificial sequence
  Synthetic oligonucleotide
ggtttagtacgtaattaccaaatca

SEQ ID NO: 693028 - DNA, 25 bp, Artificial sequence
  Synthetic oligonucleotide
tgcaattttcttttgtagctcccta

SEQ ID NO: 693029 - DNA, 25 bp, Artificial sequence
  Synthetic oligonucleotide
tgcaattttcttatgtagctcccta

SEQ ID NO: 693030 - DNA, 25 bp, Artificial sequence
  Synthetic oligonucleotide
ctttctcttgtgaatattatcaaca

SEQ ID NO: 693031 - DNA, 25 bp, Artificial sequence
  Synthetic oligonucleotide
ctttctcttgtgtatattatcaaca

SEQ ID NO: 693032 - DNA, 25 bp, Artificial sequence
  Synthetic oligonucleotide
tatattattaaagaatgttgaaacg

SEQ ID NO: 693033 - DNA, 25 bp, Artificial sequence
  Synthetic oligonucleotide
tatattattaaacaatgttgaaacg

SEQ ID NO: 693034 - DNA, 25 bp, Artificial sequence
  Synthetic oligonucleotide
gtaccgttacgctgaaccctaatca

SEQ ID NO: 693035 - DNA, 25 bp, Artificial sequence
  Synthetic oligonucleotide
tgagtaaccgttggttatcgttgac

SEQ ID NO: 693036 - DNA, 25 bp, Artificial sequence
  Synthetic oligonucleotide
gagtgacgatcctgaagttaaagaa

SEQ ID NO: 693037 - DNA, 25 bp, Artificial sequence
  Synthetic oligonucleotide
gagaatcgttccaaaaattacagcg

SEQ ID NO: 693038 - DNA, 25 bp, Artificial sequence
  Synthetic oligonucleotide
gagaatcgttcctaaaattacagcg

SEQ ID NO: 693039 - DNA, 25 bp, Artificial sequence
  Synthetic oligonucleotide
gatgactcttcttcgaccaagatga

SEQ ID NO: 693040 - DNA, 25 bp, Artificial sequence
  Synthetic oligonucleotide
gatgactcttctacgaccaagatga

SEQ ID NO: 693041 - DNA, 25 bp, Artificial sequence
  Synthetic oligonucleotide
cgaacgagaaacgaacgtgatggaa

SEQ ID NO: 693042 - DNA, 25 bp, Artificial sequence
  Synthetic oligonucleotide
cgaacgagaaaccaacgtgatggaa

SEQ ID NO: 693043 - DNA, 25 bp, Artificial sequence
  Synthetic oligonucleotide
tgatttgttgatttgcagtcgctct

SEQ ID NO: 693044 - DNA, 25 bp, Artificial sequence
  Synthetic oligonucleotide
tgatttgttgatatgcagtcgctct

SEQ ID NO: 693045 - DNA, 25 bp, Artificial sequence
  Synthetic oligonucleotide
aatttcatgctctctgatttctccg

SEQ ID NO: 693046 - DNA, 25 bp, Artificial sequence
  Synthetic oligonucleotide
tcttcgttagccgttacgctccaaa

SEQ ID NO: 693047 - DNA, 25 bp, Artificial sequence
  Synthetic oligonucleotide
aatttcatgctcactgatttctccg

SEQ ID NO: 693048 - DNA, 25 bp, Artificial sequence
  Synthetic oligonucleotide
tgagtaaccgttcgttatcgttgac

SEQ ID NO: 693049 - DNA, 25 bp, Artificial sequence
  Synthetic oligonucleotide
agagggaagattcatgaggattcat

SEQ ID NO: 693050 - DNA, 25 bp, Artificial sequence
  Synthetic oligonucleotide
agagggaagattgatgaggattcat

SEQ ID NO: 693051 - DNA, 25 bp, Artificial sequence
  Synthetic oligonucleotide
tgggtgataaaatcggcaattgacg

SEQ ID NO: 693052 - DNA, 25 bp, Artificial sequence
  Synthetic oligonucleotide
tgggtgataaaaacggcaattgacg

SEQ ID NO: 693053 - DNA, 25 bp, Artificial sequence
  Synthetic oligonucleotide
tctgttcgcttacccgttacgaaga

SEQ ID NO: 693054 - DNA, 25 bp, Artificial sequence
  Synthetic oligonucleotide
tctgttcgcttagccgttacgaaga

SEQ ID NO: 693055 - DNA, 25 bp, Artificial sequence
  Synthetic oligonucleotide
ttcgtttagaatgattacgctagcc

SEQ ID NO: 693056 - DNA, 25 bp, Artificial sequence
  Synthetic oligonucleotide
gattgtatccagatgtctcttgacc

SEQ ID NO: 693057 - DNA, 25 bp, Artificial sequence
  Synthetic oligonucleotide
tcttcgttagcccttacgctccaaa

SEQ ID NO: 693058 - DNA, 25 bp, Artificial sequence
  Synthetic oligonucleotide
ggagaatcttctctatccgcacgcg

SEQ ID NO: 693059 - DNA, 25 bp, Artificial sequence
  Synthetic oligonucleotide
tcaaagccaaacttattgtaaaacc

SEQ ID NO: 693060 - DNA, 25 bp, Artificial sequence
  Synthetic oligonucleotide
acttgcttagctacaggttcttttt

SEQ ID NO: 693061 - DNA, 25 bp, Artificial sequence
  Synthetic oligonucleotide
gtttcaggaaacttatacaaggcgt

SEQ ID NO: 693062 - DNA, 25 bp, Artificial sequence
  Synthetic oligonucleotide
gtttcaggaaacatatacaaggcgt

SEQ ID NO: 693063 - DNA, 25 bp, Artificial sequence
  Synthetic oligonucleotide
gaaccttcctctaattcactacttg

SEQ ID NO: 693064 - DNA, 25 bp, Artificial sequence
  Synthetic oligonucleotide
gaaccttcctcttattcactacttg

SEQ ID NO: 693065 - DNA, 25 bp, Artificial sequence
  Synthetic oligonucleotide
taatcaatctgcaattgtcaagtca

SEQ ID NO: 693066 - DNA, 25 bp, Artificial sequence
  Synthetic oligonucleotide
taatcaatctgctattgtcaagtca

SEQ ID NO: 693067 - DNA, 25 bp, Artificial sequence
  Synthetic oligonucleotide
tacgagcttccttcaaagaaggttg

SEQ ID NO: 693068 - DNA, 25 bp, Artificial sequence
  Synthetic oligonucleotide
caaactctttttcttcatcaaacaa

SEQ ID NO: 693069 - DNA, 25 bp, Artificial sequence
  Synthetic oligonucleotide
ggagaatcttctgtatccgcacgcg

SEQ ID NO: 693070 - DNA, 25 bp, Artificial sequence
  Synthetic oligonucleotide
caaactctttttgttcatcaaacaa

SEQ ID NO: 693071 - DNA, 25 bp, Artificial sequence
  Synthetic oligonucleotide
tgaccgatgtttcccttccgttact

SEQ ID NO: 693072 - DNA, 25 bp, Artificial sequence
  Synthetic oligonucleotide
tgaccgatgtttgccttccgttact

SEQ ID NO: 693073 - DNA, 25 bp, Artificial sequence
  Synthetic oligonucleotide
cggaaaagaagaaaagacatctcat

SEQ ID NO: 693074 - DNA, 25 bp, Artificial sequence
  Synthetic oligonucleotide
cggaaaagaagataagacatctcat

SEQ ID NO: 693075 - DNA, 25 bp, Artificial sequence
  Synthetic oligonucleotide
ctctgtggtagatgaaggtttggaa

SEQ ID NO: 693076 - DNA, 25 bp, Artificial sequence
  Synthetic oligonucleotide
ctctgtggtagaagaaggtttggaa

SEQ ID NO: 693077 - DNA, 25 bp, Artificial sequence
  Synthetic oligonucleotide
ggcaagcaacaaacaactggaacca

SEQ ID NO: 693078 - DNA, 25 bp, Artificial sequence
  Synthetic oligonucleotide
ggcaagcaacaatcaactggaacca

SEQ ID NO: 693079 - DNA, 25 bp, Artificial sequence
  Synthetic oligonucleotide
gcagatagagaaggagctatggtta

SEQ ID NO: 693080 - DNA, 25 bp, Artificial sequence
  Synthetic oligonucleotide
tacgagcttcctacaaagaaggttg

SEQ ID NO: 693081 - DNA, 25 bp, Artificial sequence
  Synthetic oligonucleotide
aacattctgctgtttttatcttagg

SEQ ID NO: 693082 - DNA, 25 bp, Artificial sequence
  Synthetic oligonucleotide
gagtgacgatccagaagttaaagaa

SEQ ID NO: 693083 - DNA, 25 bp, Artificial sequence
  Synthetic oligonucleotide
gattgtatccagttgtctcttgacc

SEQ ID NO: 693084 - DNA, 25 bp, Artificial sequence
  Synthetic oligonucleotide
gagatgaatggtggattgataacgc

SEQ ID NO: 693085 - DNA, 25 bp, Artificial sequence
  Synthetic oligonucleotide
gagatgaatggtcgattgataacgc

SEQ ID NO: 693086 - DNA, 25 bp, Artificial sequence
  Synthetic oligonucleotide
gggttaatggctcttaagccttttg

SEQ ID NO: 693087 - DNA, 25 bp, Artificial sequence
  Synthetic oligonucleotide
gggttaatggctgttaagccttttg

SEQ ID NO: 693088 - DNA, 25 bp, Artificial sequence
  Synthetic oligonucleotide
tataacaacacatggatctccgatc

SEQ ID NO: 693089 - DNA, 25 bp, Artificial sequence
  Synthetic oligonucleotide
tataacaacacaaggatctccgatc

SEQ ID NO: 693090 - DNA, 25 bp, Artificial sequence
  Synthetic oligonucleotide
acttgcttagcttcaggttcttttt

SEQ ID NO: 693091 - DNA, 25 bp, Artificial sequence
  Synthetic oligonucleotide
tcaaatgtgctttcttattgcagat

SEQ ID NO: 693092 - DNA, 25 bp, Artificial sequence
  Synthetic oligonucleotide
tcaaagccaaacatattgtaaaacc

SEQ ID NO: 693093 - DNA, 25 bp, Artificial sequence
  Synthetic oligonucleotide
aacattctgctgattttatcttagg

SEQ ID NO: 693094 - DNA, 25 bp, Artificial sequence
  Synthetic oligonucleotide
tgtatacagtagtaccaatcaatca

SEQ ID NO: 693095 - DNA, 25 bp, Artificial sequence
  Synthetic oligonucleotide
tgtatacagtagaaccaatcaatca

SEQ ID NO: 693096 - DNA, 25 bp, Artificial sequence
  Synthetic oligonucleotide
gaaagcagtggcttactcatcgctg

SEQ ID NO: 693097 - DNA, 25 bp, Artificial sequence
  Synthetic oligonucleotide
gaaagcagtggcatactcatcgctg

SEQ ID NO: 693098 - DNA, 25 bp, Artificial sequence
  Synthetic oligonucleotide
tgttggaggtgaagtaacgactctc

SEQ ID NO: 693099 - DNA, 25 bp, Artificial sequence
  Synthetic oligonucleotide
tgttggaggtgatgtaacgactctc

SEQ ID NO: 693100 - DNA, 25 bp, Artificial sequence
  Synthetic oligonucleotide
gagacttttctcataaggtggaata

SEQ ID NO: 693101 - DNA, 25 bp, Artificial sequence
  Synthetic oligonucleotide
gagacttttctcttaaggtggaata

SEQ ID NO: 693102 - DNA, 25 bp, Artificial sequence
  Synthetic oligonucleotide
tcaaatgtgcttacttattgcagat

SEQ ID NO: 693103 - DNA, 25 bp, Artificial sequence
  Synthetic oligonucleotide
ggtgatttaaatcatcctcctttaa

SEQ ID NO: 693104 - DNA, 25 bp, Artificial sequence
  Synthetic oligonucleotide
aaatttggactcaactcgcctgcag

SEQ ID NO: 693105 - DNA, 25 bp, Artificial sequence
  Synthetic oligonucleotide
tcccggttcaccaccgagtagagcg

SEQ ID NO: 693106 - DNA, 25 bp, Artificial sequence
  Synthetic oligonucleotide
tcccggttcacctccgagtagagcg

SEQ ID NO: 693107 - DNA, 25 bp, Artificial sequence
  Synthetic oligonucleotide
tagcccaagatggtcgttttcgaga

SEQ ID NO: 693108 - DNA, 25 bp, Artificial sequence
  Synthetic oligonucleotide
tagcccaagatgctcgttttcgaga

SEQ ID NO: 693109 - DNA, 25 bp, Artificial sequence
  Synthetic oligonucleotide
caatccaatctctccaaactctcct

SEQ ID NO: 693110 - DNA, 25 bp, Artificial sequence
  Synthetic oligonucleotide
caatccaatctcaccaaactctcct

SEQ ID NO: 693111 - DNA, 25 bp, Artificial sequence
  Synthetic oligonucleotide
gccatattcggctaccgggtttcca

SEQ ID NO: 693112 - DNA, 25 bp, Artificial sequence
  Synthetic oligonucleotide
gccatattcggcaaccgggtttcca

SEQ ID NO: 693113 - DNA, 25 bp, Artificial sequence
  Synthetic oligonucleotide
gctgcaactatttctactaccattt

SEQ ID NO: 693114 - DNA, 25 bp, Artificial sequence
  Synthetic oligonucleotide
tcatcatcgtcgtcttcccgtggtt

SEQ ID NO: 693115 - DNA, 25 bp, Artificial sequence
  Synthetic oligonucleotide
actttgctgtgatctctttaggagg

SEQ ID NO: 693116 - DNA, 25 bp, Artificial sequence
  Synthetic oligonucleotide
aaatttggactctactcgcctgcag

SEQ ID NO: 693117 - DNA, 25 bp, Artificial sequence
  Synthetic oligonucleotide
gatttgattgcttgaaccgtgaccg

SEQ ID NO: 693118 - DNA, 25 bp, Artificial sequence
  Synthetic oligonucleotide
gatttgattgctagaaccgtgaccg

SEQ ID NO: 693119 - DNA, 25 bp, Artificial sequence
  Synthetic oligonucleotide
gagcatccctgcgatggcttagtag

SEQ ID NO: 693120 - DNA, 25 bp, Artificial sequence
  Synthetic oligonucleotide
gagcatccctgccatggcttagtag

SEQ ID NO: 693121 - DNA, 25 bp, Artificial sequence
  Synthetic oligonucleotide
aaacaagtgtacttagagattccgg

SEQ ID NO: 693122 - DNA, 25 bp, Artificial sequence
  Synthetic oligonucleotide
ccagtgattagaaacaaaagtgttt

SEQ ID NO: 693123 - DNA, 25 bp, Artificial sequence
  Synthetic oligonucleotide
cgccaatgcctaacagaggaggatt

SEQ ID NO: 693124 - DNA, 25 bp, Artificial sequence
  Synthetic oligonucleotide
aaatcagttatgacaatggtccatg

SEQ ID NO: 693125 - DNA, 25 bp, Artificial sequence
  Synthetic oligonucleotide
tcatcatcgtcgacttcccgtggtt

SEQ ID NO: 693126 - DNA, 25 bp, Artificial sequence
  Synthetic oligonucleotide
cattcgtagaaaggtatgcttttga

SEQ ID NO: 693127 - DNA, 25 bp, Artificial sequence
  Synthetic oligonucleotide
aggagatgatggcatttgaccgtaa

SEQ ID NO: 693128 - DNA, 25 bp, Artificial sequence
  Synthetic oligonucleotide
tttgtcctaagcctcgacgtgttgg

SEQ ID NO: 693129 - DNA, 25 bp, Artificial sequence
  Synthetic oligonucleotide
tttgtcctaagcgtcgacgtgttgg

SEQ ID NO: 693130 - DNA, 25 bp, Artificial sequence
  Synthetic oligonucleotide
aacgttattcgtcctcttagattac

SEQ ID NO: 693131 - DNA, 25 bp, Artificial sequence
  Synthetic oligonucleotide
aacgttattcgtgctcttagattac

SEQ ID NO: 693132 - DNA, 25 bp, Artificial sequence
  Synthetic oligonucleotide
ggtgatttaaatgatcctcctttaa

SEQ ID NO: 693133 - DNA, 25 bp, Artificial sequence
  Synthetic oligonucleotide
ccagtgattagatacaaaagtgttt

SEQ ID NO: 693134 - DNA, 25 bp, Artificial sequence
  Synthetic oligonucleotide
tgctatctgtagacaagctgcagcc

SEQ ID NO: 693135 - DNA, 25 bp, Artificial sequence
  Synthetic oligonucleotide
tgctatctgtagtcaagctgcagcc

SEQ ID NO: 693136 - DNA, 25 bp, Artificial sequence
  Synthetic oligonucleotide
aatagggcagttactatcatcatcc

SEQ ID NO: 693137 - DNA, 25 bp, Artificial sequence
  Synthetic oligonucleotide
tgtgattctaaagctggtgctgagc

SEQ ID NO: 693138 - DNA, 25 bp, Artificial sequence
  Synthetic oligonucleotide
aatagggcagtttctatcatcatcc

SEQ ID NO: 693139 - DNA, 25 bp, Artificial sequence
  Synthetic oligonucleotide
cattcgtagaaacgtatgcttttga

SEQ ID NO: 693140 - DNA, 25 bp, Artificial sequence
  Synthetic oligonucleotide
cacttcaggctagatgttgtgatag

SEQ ID NO: 693141 - DNA, 25 bp, Artificial sequence
  Synthetic oligonucleotide
cacttcaggctacatgttgtgatag

SEQ ID NO: 693142 - DNA, 25 bp, Artificial sequence
  Synthetic oligonucleotide
tgattaacttttgtacacctcaagt

SEQ ID NO: 693143 - DNA, 25 bp, Artificial sequence
  Synthetic oligonucleotide
tgattaacttttctacacctcaagt

SEQ ID NO: 693144 - DNA, 25 bp, Artificial sequence
  Synthetic oligonucleotide
tctgcctctgcttcagaagattctg

SEQ ID NO: 693145 - DNA, 25 bp, Artificial sequence
  Synthetic oligonucleotide
tctgcctctgctacagaagattctg

SEQ ID NO: 693146 - DNA, 25 bp, Artificial sequence
  Synthetic oligonucleotide
actttgctgtgaactctttaggagg

SEQ ID NO: 693147 - DNA, 25 bp, Artificial sequence
  Synthetic oligonucleotide
tatgtttttgtttttcatcttctcc

SEQ ID NO: 693148 - DNA, 25 bp, Artificial sequence
  Synthetic oligonucleotide
tgtgattctaaacctggtgctgagc

SEQ ID NO: 693149 - DNA, 25 bp, Artificial sequence
  Synthetic oligonucleotide
tgttggtcagcaattccaaacacca

SEQ ID NO: 693150 - DNA, 25 bp, Artificial sequence
  Synthetic oligonucleotide
ttaaactttgttaaccactcgaaca

SEQ ID NO: 693151 - DNA, 25 bp, Artificial sequence
  Synthetic oligonucleotide
ttaaactttgtttaccactcgaaca

SEQ ID NO: 693152 - DNA, 25 bp, Artificial sequence
  Synthetic oligonucleotide
ggtgaatatatgttgttgggtacaa

SEQ ID NO: 693153 - DNA, 25 bp, Artificial sequence
  Synthetic oligonucleotide
ggtgaatatatgatgttgggtacaa

SEQ ID NO: 693154 - DNA, 25 bp, Artificial sequence
  Synthetic oligonucleotide
tcgtgaaccccctccgtattgcaat

SEQ ID NO: 693155 - DNA, 25 bp, Artificial sequence
  Synthetic oligonucleotide
tcgtgaacccccaccgtattgcaat

SEQ ID NO: 693156 - DNA, 25 bp, Artificial sequence
  Synthetic oligonucleotide
catgtaggtggcgatcatatttgca

SEQ ID NO: 693157 - DNA, 25 bp, Artificial sequence
  Synthetic oligonucleotide
catgtaggtggccatcatatttgca

SEQ ID NO: 693158 - DNA, 25 bp, Artificial sequence
  Synthetic oligonucleotide
gctgcaactattactactaccattt

SEQ ID NO: 693159 - DNA, 25 bp, Artificial sequence
  Synthetic oligonucleotide
gtatcacgtccaacaacttattgtt

SEQ ID NO: 693160 - DNA, 25 bp, Artificial sequence
  Synthetic oligonucleotide
tctctcacctttctatatcaatgct

SEQ ID NO: 693161 - DNA, 25 bp, Artificial sequence
  Synthetic oligonucleotide
tgttggtcagcatttccaaacacca

SEQ ID NO: 693162 - DNA, 25 bp, Artificial sequence
  Synthetic oligonucleotide
gtttatccacaccatacacatttcg

SEQ ID NO: 693163 - DNA, 25 bp, Artificial sequence
  Synthetic oligonucleotide
gtttatccacacgatacacatttcg

SEQ ID NO: 693164 - DNA, 25 bp, Artificial sequence
  Synthetic oligonucleotide
tatgaaacagttgcatttgatccac

SEQ ID NO: 693165 - DNA, 25 bp, Artificial sequence
  Synthetic oligonucleotide
tatgaaacagttccatttgatccac

SEQ ID NO: 693166 - DNA, 25 bp, Artificial sequence
  Synthetic oligonucleotide
tcttccaattaagagagatgtttcg

SEQ ID NO: 693167 - DNA, 25 bp, Artificial sequence
  Synthetic oligonucleotide
tcttccaattaacagagatgtttcg

SEQ ID NO: 693168 - DNA, 25 bp, Artificial sequence
  Synthetic oligonucleotide
gttccagtcatcttccattttttcg

SEQ ID NO: 693169 - DNA, 25 bp, Artificial sequence
  Synthetic oligonucleotide
gttccagtcatcatccattttttcg

SEQ ID NO: 693170 - DNA, 25 bp, Artificial sequence
  Synthetic oligonucleotide
gtatcacgtccatcaacttattgtt

SEQ ID NO: 693171 - DNA, 25 bp, Artificial sequence
  Synthetic oligonucleotide
gaagctgtaaaattttcttgggaag

SEQ ID NO: 693172 - DNA, 25 bp, Artificial sequence
  Synthetic oligonucleotide
tatgtttttgttattcatcttctcc

SEQ ID NO: 693173 - DNA, 25 bp, Artificial sequence
  Synthetic oligonucleotide
gagagggaagaggaaggaggaagat

SEQ ID NO: 693174 - DNA, 25 bp, Artificial sequence
  Synthetic oligonucleotide
gagagggaagagcaaggaggaagat

SEQ ID NO: 693175 - DNA, 25 bp, Artificial sequence
  Synthetic oligonucleotide
ggtcaccgtttatctgttttattca

SEQ ID NO: 693176 - DNA, 25 bp, Artificial sequence
  Synthetic oligonucleotide
ggtcaccgtttaactgttttattca

SEQ ID NO: 693177 - DNA, 25 bp, Artificial sequence
  Synthetic oligonucleotide
taaagatgcagtatttaaaagaaga

SEQ ID NO: 693178 - DNA, 25 bp, Artificial sequence
  Synthetic oligonucleotide
taaagatgcagtttttaaaagaaga

SEQ ID NO: 693179 - DNA, 25 bp, Artificial sequence
  Synthetic oligonucleotide
tattcgtttggtctttttctgggtc

SEQ ID NO: 693180 - DNA, 25 bp, Artificial sequence
  Synthetic oligonucleotide
tattcgtttggtgtttttctgggtc

SEQ ID NO: 693181 - DNA, 25 bp, Artificial sequence
  Synthetic oligonucleotide
caatcatatatgttgtcttacaaga

SEQ ID NO: 693182 - DNA, 25 bp, Artificial sequence
  Synthetic oligonucleotide
actgtttcatatataactaagaggg

SEQ ID NO: 693183 - DNA, 25 bp, Artificial sequence
  Synthetic oligonucleotide
caatcatatatgatgtcttacaaga

SEQ ID NO: 693184 - DNA, 25 bp, Artificial sequence
  Synthetic oligonucleotide
gaagctgtaaaaatttcttgggaag

SEQ ID NO: 693185 - DNA, 25 bp, Artificial sequence
  Synthetic oligonucleotide
ctggtttctatcttctcgttgtaat

SEQ ID NO: 693186 - DNA, 25 bp, Artificial sequence
  Synthetic oligonucleotide
ctggtttctatcatctcgttgtaat

SEQ ID NO: 693187 - DNA, 25 bp, Artificial sequence
  Synthetic oligonucleotide
caacttggatttttcttctttcaga

SEQ ID NO: 693188 - DNA, 25 bp, Artificial sequence
  Synthetic oligonucleotide
caacttggatttatcttctttcaga

SEQ ID NO: 693189 - DNA, 25 bp, Artificial sequence
  Synthetic oligonucleotide
tagtaatgtttaattttcttggtga

SEQ ID NO: 693190 - DNA, 25 bp, Artificial sequence
  Synthetic oligonucleotide
tagtaatgtttatttttcttggtga

SEQ ID NO: 693191 - DNA, 25 bp, Artificial sequence
  Synthetic oligonucleotide
tctctcacctttgtatatcaatgct

SEQ ID NO: 693192 - DNA, 25 bp, Artificial sequence
  Synthetic oligonucleotide
gaatcattgcaaccttcagcagaac

SEQ ID NO: 693193 - DNA, 25 bp, Artificial sequence
  Synthetic oligonucleotide
actgtttcatatttaactaagaggg

SEQ ID NO: 693194 - DNA, 25 bp, Artificial sequence
  Synthetic oligonucleotide
ttgtcaaacttaatctttttaattc

SEQ ID NO: 693195 - DNA, 25 bp, Artificial sequence
  Synthetic oligonucleotide
aggatctactagtaaaaaataatag

SEQ ID NO: 693196 - DNA, 25 bp, Artificial sequence
  Synthetic oligonucleotide
taaaccctagatacccatgtgaatg

SEQ ID NO: 693197 - DNA, 25 bp, Artificial sequence
  Synthetic oligonucleotide
taaaccctagattcccatgtgaatg

SEQ ID NO: 693198 - DNA, 25 bp, Artificial sequence
  Synthetic oligonucleotide
cctatagtaagtaatataaggaatg

SEQ ID NO: 693199 - DNA, 25 bp, Artificial sequence
  Synthetic oligonucleotide
cctatagtaagttatataaggaatg

SEQ ID NO: 693200 - DNA, 25 bp, Artificial sequence
  Synthetic oligonucleotide
tatatatgtatatttgtttggtacg

SEQ ID NO: 693201 - DNA, 25 bp, Artificial sequence
  Synthetic oligonucleotide
tatatatgtataattgtttggtacg

SEQ ID NO: 693202 - DNA, 25 bp, Artificial sequence
  Synthetic oligonucleotide
tcatggctccaatcaatattatagg

SEQ ID NO: 693203 - DNA, 25 bp, Artificial sequence
  Synthetic oligonucleotide
aggagatgatgggatttgaccgtaa

SEQ ID NO: 693204 - DNA, 25 bp, Artificial sequence
  Synthetic oligonucleotide
ttgtcaaacttattctttttaattc

SEQ ID NO: 693205 - DNA, 25 bp, Artificial sequence
  Synthetic oligonucleotide
aagacaaataaataaaaatagaatc

SEQ ID NO: 693206 - DNA, 25 bp, Artificial sequence
  Synthetic oligonucleotide
tagtatacaattatataggtgcaat

SEQ ID NO: 693207 - DNA, 25 bp, Artificial sequence
  Synthetic oligonucleotide
tagtatacaattttataggtgcaat

SEQ ID NO: 693208 - DNA, 25 bp, Artificial sequence
  Synthetic oligonucleotide
ttaccaaacaaaaacaataattatg

SEQ ID NO: 693209 - DNA, 25 bp, Artificial sequence
  Synthetic oligonucleotide
ttaccaaacaaatacaataattatg

SEQ ID NO: 693210 - DNA, 25 bp, Artificial sequence
  Synthetic oligonucleotide
ggaatgatatctaatgttagaggaa

SEQ ID NO: 693211 - DNA, 25 bp, Artificial sequence
  Synthetic oligonucleotide
ggaatgatatcttatgttagaggaa

SEQ ID NO: 693212 - DNA, 25 bp, Artificial sequence
  Synthetic oligonucleotide
caccaaaaaaagtgaaaacaagaga

SEQ ID NO: 693213 - DNA, 25 bp, Artificial sequence
  Synthetic oligonucleotide
caccaaaaaaagagaaaacaagaga

SEQ ID NO: 693214 - DNA, 25 bp, Artificial sequence
  Synthetic oligonucleotide
tctgatgttaaaaactaaaaagaga

SEQ ID NO: 693215 - DNA, 25 bp, Artificial sequence
  Synthetic oligonucleotide
tcatggctccaaacaatattatagg

SEQ ID NO: 693216 - DNA, 25 bp, Artificial sequence
  Synthetic oligonucleotide
caactatgatagaataactatttgc

SEQ ID NO: 693217 - DNA, 25 bp, Artificial sequence
  Synthetic oligonucleotide
caagttcacaatatttattgataaa

SEQ ID NO: 693218 - DNA, 25 bp, Artificial sequence
  Synthetic oligonucleotide
caagttcacaatttttattgataaa

SEQ ID NO: 693219 - DNA, 25 bp, Artificial sequence
  Synthetic oligonucleotide
tacacagttagaacaaatcttgttt

SEQ ID NO: 693220 - DNA, 25 bp, Artificial sequence
  Synthetic oligonucleotide
tacacagttagatcaaatcttgttt

SEQ ID NO: 693221 - DNA, 25 bp, Artificial sequence
  Synthetic oligonucleotide
gcgaaaatctcttatctttaaaatt

SEQ ID NO: 693222 - DNA, 25 bp, Artificial sequence
  Synthetic oligonucleotide
gcgaaaatctctaatctttaaaatt

SEQ ID NO: 693223 - DNA, 25 bp, Artificial sequence
  Synthetic oligonucleotide
taagcgagttagcattcactggaaa

SEQ ID NO: 693224 - DNA, 25 bp, Artificial sequence
  Synthetic oligonucleotide
taagcgagttaggattcactggaaa

SEQ ID NO: 693225 - DNA, 25 bp, Artificial sequence
  Synthetic oligonucleotide
aattaaaaacaatgatgccattccg

SEQ ID NO: 693226 - DNA, 25 bp, Artificial sequence
  Synthetic oligonucleotide
aggatctactagaaaaaaataatag

SEQ ID NO: 693227 - DNA, 25 bp, Artificial sequence
  Synthetic oligonucleotide
caactatgatagtataactatttgc

SEQ ID NO: 693228 - DNA, 25 bp, Artificial sequence
  Synthetic oligonucleotide
aagacaaataaaaaaaaatagaatc

SEQ ID NO: 693229 - DNA, 25 bp, Artificial sequence
  Synthetic oligonucleotide
gacacgtttctatggaagccagcaa

SEQ ID NO: 693230 - DNA, 25 bp, Artificial sequence
  Synthetic oligonucleotide
gacacgtttctaaggaagccagcaa

SEQ ID NO: 693231 - DNA, 25 bp, Artificial sequence
  Synthetic oligonucleotide
tgaataaagaaatcatcggagccgg

SEQ ID NO: 693232 - DNA, 25 bp, Artificial sequence
  Synthetic oligonucleotide
tgaataaagaaaacatcggagccgg

SEQ ID NO: 693233 - DNA, 25 bp, Artificial sequence
  Synthetic oligonucleotide
tctggtcaaaatgtcaaacttcact

SEQ ID NO: 693234 - DNA, 25 bp, Artificial sequence
  Synthetic oligonucleotide
tctggtcaaaatctcaaacttcact

SEQ ID NO: 693235 - DNA, 25 bp, Artificial sequence
  Synthetic oligonucleotide
gccacacaagcatgcgtttttaata

SEQ ID NO: 693236 - DNA, 25 bp, Artificial sequence
  Synthetic oligonucleotide
gccacacaagcaagcgtttttaata

SEQ ID NO: 693237 - DNA, 25 bp, Artificial sequence
  Synthetic oligonucleotide
cattagtaatgttgaccaatagaat

SEQ ID NO: 693238 - DNA, 25 bp, Artificial sequence
  Synthetic oligonucleotide
aattaaaaacaaagatgccattccg

SEQ ID NO: 693239 - DNA, 25 bp, Artificial sequence
  Synthetic oligonucleotide
gaatttggctaataaatcaaagagg

SEQ ID NO: 693240 - DNA, 25 bp, Artificial sequence
  Synthetic oligonucleotide
tctgatgttaaatactaaaaagaga

SEQ ID NO: 693241 - DNA, 25 bp, Artificial sequence
  Synthetic oligonucleotide
tcaaaacttctcagtgttgttctat

SEQ ID NO: 693242 - DNA, 25 bp, Artificial sequence
  Synthetic oligonucleotide
cgtatgaattttgaattttctcgga

SEQ ID NO: 693243 - DNA, 25 bp, Artificial sequence
  Synthetic oligonucleotide
cgtatgaattttcaattttctcgga

SEQ ID NO: 693244 - DNA, 25 bp, Artificial sequence
  Synthetic oligonucleotide
ggcttagccatacggtcaaacttca

SEQ ID NO: 693245 - DNA, 25 bp, Artificial sequence
  Synthetic oligonucleotide
ggcttagccatagggtcaaacttca

SEQ ID NO: 693246 - DNA, 25 bp, Artificial sequence
  Synthetic oligonucleotide
tttcaaaaatcctttttatagccga

SEQ ID NO: 693247 - DNA, 25 bp, Artificial sequence
  Synthetic oligonucleotide
tttcaaaaatccattttatagccga

SEQ ID NO: 693248 - DNA, 25 bp, Artificial sequence
  Synthetic oligonucleotide
gaatgatctactatttcttcctcac

SEQ ID NO: 693249 - DNA, 25 bp, Artificial sequence
  Synthetic oligonucleotide
catcgttttttgtgtcttggttgaa

SEQ ID NO: 693250 - DNA, 25 bp, Artificial sequence
  Synthetic oligonucleotide
gaatttggctaaaaaatcaaagagg

SEQ ID NO: 693251 - DNA, 25 bp, Artificial sequence
  Synthetic oligonucleotide
catcgttttttgagtcttggttgaa

SEQ ID NO: 693252 - DNA, 25 bp, Artificial sequence
  Synthetic oligonucleotide
gaattcagatcccttgttttcttcg

SEQ ID NO: 693253 - DNA, 25 bp, Artificial sequence
  Synthetic oligonucleotide
gaattcagatccgttgttttcttcg

SEQ ID NO: 693254 - DNA, 25 bp, Artificial sequence
  Synthetic oligonucleotide
gagaatttctcagatcttataaagt

SEQ ID NO: 693255 - DNA, 25 bp, Artificial sequence
  Synthetic oligonucleotide
gagaatttctcacatcttataaagt

SEQ ID NO: 693256 - DNA, 25 bp, Artificial sequence
  Synthetic oligonucleotide
tgctctgtgatgcatctgatctgat

SEQ ID NO: 693257 - DNA, 25 bp, Artificial sequence
  Synthetic oligonucleotide
tgctctgtgatggatctgatctgat

SEQ ID NO: 693258 - DNA, 25 bp, Artificial sequence
  Synthetic oligonucleotide
tcaggcgttcttgtgtggatcagag

SEQ ID NO: 693259 - DNA, 25 bp, Artificial sequence
  Synthetic oligonucleotide
tcaggcgttcttctgtggatcagag

SEQ ID NO: 693260 - DNA, 25 bp, Artificial sequence
  Synthetic oligonucleotide
cgccaatgcctatcagaggaggatt

SEQ ID NO: 693261 - DNA, 25 bp, Artificial sequence
  Synthetic oligonucleotide
gaatgatctactttttcttcctcac

SEQ ID NO: 693262 - DNA, 25 bp, Artificial sequence
  Synthetic oligonucleotide
ggtctcatccttttataaaatcccc

SEQ ID NO: 693263 - DNA, 25 bp, Artificial sequence
  Synthetic oligonucleotide
gaatcattgcaagcttcagcagaac

SEQ ID NO: 693264 - DNA, 25 bp, Artificial sequence
  Synthetic oligonucleotide
tacttataaaaaatagaaatgcatg

SEQ ID NO: 693265 - DNA, 25 bp, Artificial sequence
  Synthetic oligonucleotide
tacttataaaaattagaaatgcatg

SEQ ID NO: 693266 - DNA, 25 bp, Artificial sequence
  Synthetic oligonucleotide
caaatatcactaatacgacgccgag

SEQ ID NO: 693267 - DNA, 25 bp, Artificial sequence
  Synthetic oligonucleotide
caaatatcactattacgacgccgag

SEQ ID NO: 693268 - DNA, 25 bp, Artificial sequence
  Synthetic oligonucleotide
caactttccagtatgatatactatt

SEQ ID NO: 693269 - DNA, 25 bp, Artificial sequence
  Synthetic oligonucleotide
caactttccagtttgatatactatt

SEQ ID NO: 693270 - DNA, 25 bp, Artificial sequence
  Synthetic oligonucleotide
gcaaaaattccctattccacgaaac

SEQ ID NO: 693271 - DNA, 25 bp, Artificial sequence
  Synthetic oligonucleotide
gcaaaaattcccaattccacgaaac

SEQ ID NO: 693272 - DNA, 25 bp, Artificial sequence
  Synthetic oligonucleotide
tcaaaacttctctgtgttgttctat

SEQ ID NO: 693273 - DNA, 25 bp, Artificial sequence
  Synthetic oligonucleotide
ttcatgttgtctacaacctcaccca

SEQ ID NO: 693274 - DNA, 25 bp, Artificial sequence
  Synthetic oligonucleotide
cattagtaatgtagaccaatagaat

SEQ ID NO: 693275 - DNA, 25 bp, Artificial sequence
  Synthetic oligonucleotide
ggtctcatccttatataaaatcccc

SEQ ID NO: 693276 - DNA, 25 bp, Artificial sequence
  Synthetic oligonucleotide
ccggagattttttctcaggtacatc

SEQ ID NO: 693277 - DNA, 25 bp, Artificial sequence
  Synthetic oligonucleotide
ccggagatttttactcaggtacatc

SEQ ID NO: 693278 - DNA, 25 bp, Artificial sequence
  Synthetic oligonucleotide
gtttcttaagttcctttcatggcgg

SEQ ID NO: 693279 - DNA, 25 bp, Artificial sequence
  Synthetic oligonucleotide
gtttcttaagttgctttcatggcgg

SEQ ID NO: 693280 - DNA, 25 bp, Artificial sequence
  Synthetic oligonucleotide
gaagttactttagcttttgttcatc

SEQ ID NO: 693281 - DNA, 25 bp, Artificial sequence
  Synthetic oligonucleotide
gaagttactttaccttttgttcatc

SEQ ID NO: 693282 - DNA, 25 bp, Artificial sequence
  Synthetic oligonucleotide
tctcatagatgttagatctgtgctt

SEQ ID NO: 693283 - DNA, 25 bp, Artificial sequence
  Synthetic oligonucleotide
tctcatagatgtaagatctgtgctt

SEQ ID NO: 693284 - DNA, 25 bp, Artificial sequence
  Synthetic oligonucleotide
ttcatgttgtcttcaacctcaccca

SEQ ID NO: 693285 - DNA, 25 bp, Artificial sequence
  Synthetic oligonucleotide
aaacaagtgtacatagagattccgg

SEQ ID NO: 693286 - DNA, 25 bp, Artificial sequence
  Synthetic oligonucleotide
aaatcagttatgtcaatggtccatg

SEQ ID NO: 693287 - DNA, 25 bp, Artificial sequence
  Synthetic oligonucleotide
aacatgggagaatgaaatggaggat

SEQ ID NO: 693288 - DNA, 25 bp, Artificial sequence
  Synthetic oligonucleotide
aaagggcctgatgggcgctacacaa

SEQ ID NO: 693289 - DNA, 25 bp, Artificial sequence
  Synthetic oligonucleotide
gtaatgagtgatcttgacattctga

SEQ ID NO: 693290 - DNA, 25 bp, Artificial sequence
  Synthetic oligonucleotide
gtaatgagtgatgttgacattctga

SEQ ID NO: 693291 - DNA, 25 bp, Artificial sequence
  Synthetic oligonucleotide
tgaaaacattatgtcgggacctgag

SEQ ID NO: 693292 - DNA, 25 bp, Artificial sequence
  Synthetic oligonucleotide
tgaaaacattatctcgggacctgag

SEQ ID NO: 693293 - DNA, 25 bp, Artificial sequence
  Synthetic oligonucleotide
taagaaaaggtggacccaagagact

SEQ ID NO: 693294 - DNA, 25 bp, Artificial sequence
  Synthetic oligonucleotide
taagaaaaggtgcacccaagagact

SEQ ID NO: 693295 - DNA, 25 bp, Artificial sequence
  Synthetic oligonucleotide
tcttcaaggataaacaaactcgaat

SEQ ID NO: 693296 - DNA, 25 bp, Artificial sequence
  Synthetic oligonucleotide
caagttcacaccagaaataaagttg

SEQ ID NO: 693297 - DNA, 25 bp, Artificial sequence
  Synthetic oligonucleotide
gaatgatctttgaaggtttaaagca

SEQ ID NO: 693298 - DNA, 25 bp, Artificial sequence
  Synthetic oligonucleotide
tcaaatccatttctttaaactaatc

SEQ ID NO: 693299 - DNA, 25 bp, Artificial sequence
  Synthetic oligonucleotide
agcttgctgttgagaacgcgttgaa

SEQ ID NO: 693300 - DNA, 25 bp, Artificial sequence
  Synthetic oligonucleotide
taaactagtgccaaggaagaaatgg

SEQ ID NO: 693301 - DNA, 25 bp, Artificial sequence
  Synthetic oligonucleotide
ccagaataaggaaagcgaagaagcg

SEQ ID NO: 693302 - DNA, 25 bp, Artificial sequence
  Synthetic oligonucleotide
ccagaataaggatagcgaagaagcg

SEQ ID NO: 693303 - DNA, 25 bp, Artificial sequence
  Synthetic oligonucleotide
cacgctagttcaacgatttcgatag

SEQ ID NO: 693304 - DNA, 25 bp, Artificial sequence
  Synthetic oligonucleotide
cacgctagttcatcgatttcgatag

SEQ ID NO: 693305 - DNA, 25 bp, Artificial sequence
  Synthetic oligonucleotide
gagtccattcattctttcaaacgat

SEQ ID NO: 693306 - DNA, 25 bp, Artificial sequence
  Synthetic oligonucleotide
gagtccattcatactttcaaacgat

SEQ ID NO: 693307 - DNA, 25 bp, Artificial sequence
  Synthetic oligonucleotide
tcttcaaggatatacaaactcgaat

SEQ ID NO: 693308 - DNA, 25 bp, Artificial sequence
  Synthetic oligonucleotide
cgatgaaggtgaagatgacgacgat

SEQ ID NO: 693309 - DNA, 25 bp, Artificial sequence
  Synthetic oligonucleotide
aacatgggagaaagaaatggaggat

SEQ ID NO: 693310 - DNA, 25 bp, Artificial sequence
  Synthetic oligonucleotide
tggtcaggaagtcaagacgaaagca

SEQ ID NO: 693311 - DNA, 25 bp, Artificial sequence
  Synthetic oligonucleotide
tggtcaggaagtgaagacgaaagca

SEQ ID NO: 693312 - DNA, 25 bp, Artificial sequence
  Synthetic oligonucleotide
caagaaagcggaagaaaccgtcttg

SEQ ID NO: 693313 - DNA, 25 bp, Artificial sequence
  Synthetic oligonucleotide
caagaaagcggatgaaaccgtcttg

SEQ ID NO: 693314 - DNA, 25 bp, Artificial sequence
  Synthetic oligonucleotide
gaaagctagacaacaagctaaggat

SEQ ID NO: 693315 - DNA, 25 bp, Artificial sequence
  Synthetic oligonucleotide
gaaagctagacatcaagctaaggat

SEQ ID NO: 693316 - DNA, 25 bp, Artificial sequence
  Synthetic oligonucleotide
caaattgatggagatgatagtgatg

SEQ ID NO: 693317 - DNA, 25 bp, Artificial sequence
  Synthetic oligonucleotide
caaattgatggacatgatagtgatg

SEQ ID NO: 693318 - DNA, 25 bp, Artificial sequence
  Synthetic oligonucleotide
aaagggcctgatcggcgctacacaa

SEQ ID NO: 693319 - DNA, 25 bp, Artificial sequence
  Synthetic oligonucleotide
ggtcaggaagtgatgaggaaaaaac

SEQ ID NO: 693320 - DNA, 25 bp, Artificial sequence
  Synthetic oligonucleotide
agcttgctgttgtgaacgcgttgaa

SEQ ID NO: 693321 - DNA, 25 bp, Artificial sequence
  Synthetic oligonucleotide
cgatgaaggtgatgatgacgacgat

SEQ ID NO: 693322 - DNA, 25 bp, Artificial sequence
  Synthetic oligonucleotide
cacgcccgaacgtggcatctgataa

SEQ ID NO: 693323 - DNA, 25 bp, Artificial sequence
  Synthetic oligonucleotide
cacgcccgaacgaggcatctgataa

SEQ ID NO: 693324 - DNA, 25 bp, Artificial sequence
  Synthetic oligonucleotide
gttgtttgagtttgaggagaaacca

SEQ ID NO: 693325 - DNA, 25 bp, Artificial sequence
  Synthetic oligonucleotide
gttgtttgagttagaggagaaacca

SEQ ID NO: 693326 - DNA, 25 bp, Artificial sequence
  Synthetic oligonucleotide
caatctcagagtagttgaaatctga

SEQ ID NO: 693327 - DNA, 25 bp, Artificial sequence
  Synthetic oligonucleotide
caatctcagagttgttgaaatctga

SEQ ID NO: 693328 - DNA, 25 bp, Artificial sequence
  Synthetic oligonucleotide
cctgaggagcttacacccggtaaaa

SEQ ID NO: 693329 - DNA, 25 bp, Artificial sequence
  Synthetic oligonucleotide
cctgaggagctttcacccggtaaaa

SEQ ID NO: 693330 - DNA, 25 bp, Artificial sequence
  Synthetic oligonucleotide
gaatgatctttgtaggtttaaagca

SEQ ID NO: 693331 - DNA, 25 bp, Artificial sequence
  Synthetic oligonucleotide
ggtcaggaagtgttgaggaaaaaac

SEQ ID NO: 693332 - DNA, 25 bp, Artificial sequence
  Synthetic oligonucleotide
aaagtatacaaattacaaaatggag

SEQ ID NO: 693333 - DNA, 25 bp, Artificial sequence
  Synthetic oligonucleotide
gcttaattggtccattatacctatt

SEQ ID NO: 693334 - DNA, 25 bp, Artificial sequence
  Synthetic oligonucleotide
gcttaattggtcgattatacctatt

SEQ ID NO: 693335 - DNA, 25 bp, Artificial sequence
  Synthetic oligonucleotide
gattctacataggttatggttattg

SEQ ID NO: 693336 - DNA, 25 bp, Artificial sequence
  Synthetic oligonucleotide
gattctacatagcttatggttattg

SEQ ID NO: 693337 - DNA, 25 bp, Artificial sequence
  Synthetic oligonucleotide
tcttggacaaaatgtattgttcgaa

SEQ ID NO: 693338 - DNA, 25 bp, Artificial sequence
  Synthetic oligonucleotide
tcttggacaaaaagtattgttcgaa

SEQ ID NO: 693339 - DNA, 25 bp, Artificial sequence
  Synthetic oligonucleotide
catcaaatagattccggtgttgtct

SEQ ID NO: 693340 - DNA, 25 bp, Artificial sequence
  Synthetic oligonucleotide
catcaaatagataccggtgttgtct

SEQ ID NO: 693341 - DNA, 25 bp, Artificial sequence
  Synthetic oligonucleotide
tacaaagttcctacattaccttttg

SEQ ID NO: 693342 - DNA, 25 bp, Artificial sequence
  Synthetic oligonucleotide
tcaaatccatttgtttaaactaatc

SEQ ID NO: 693343 - DNA, 25 bp, Artificial sequence
  Synthetic oligonucleotide
aaagtatacaaaatacaaaatggag

SEQ ID NO: 693344 - DNA, 25 bp, Artificial sequence
  Synthetic oligonucleotide
ttttattaatgtatgattattgtca

SEQ ID NO: 693345 - DNA, 25 bp, Artificial sequence
  Synthetic oligonucleotide
taatcttttggttggttggctcaca

SEQ ID NO: 693346 - DNA, 25 bp, Artificial sequence
  Synthetic oligonucleotide
taatcttttggtaggttggctcaca

SEQ ID NO: 693347 - DNA, 25 bp, Artificial sequence
  Synthetic oligonucleotide
aacaagcggcgtggacgttgtcgtc

SEQ ID NO: 693348 - DNA, 25 bp, Artificial sequence
  Synthetic oligonucleotide
aacaagcggcgtcgacgttgtcgtc

SEQ ID NO: 693349 - DNA, 25 bp, Artificial sequence
  Synthetic oligonucleotide
cgtaattttcctggggagcgtttgc

SEQ ID NO: 693350 - DNA, 25 bp, Artificial sequence
  Synthetic oligonucleotide
cgtaattttcctcgggagcgtttgc

SEQ ID NO: 693351 - DNA, 25 bp, Artificial sequence
  Synthetic oligonucleotide
aaacgattgagtcggattacggatg

SEQ ID NO: 693352 - DNA, 25 bp, Artificial sequence
  Synthetic oligonucleotide
aaacgattgagtgggattacggatg

SEQ ID NO: 693353 - DNA, 25 bp, Artificial sequence
  Synthetic oligonucleotide
cacgtttatcgtacatgccaggagc

SEQ ID NO: 693354 - DNA, 25 bp, Artificial sequence
  Synthetic oligonucleotide
tacaaagttccttcattaccttttg

SEQ ID NO: 693355 - DNA, 25 bp, Artificial sequence
  Synthetic oligonucleotide
gggaagaagaatacagctttttgca

SEQ ID NO: 693356 - DNA, 25 bp, Artificial sequence
  Synthetic oligonucleotide
gaacaccaaacagcctccaaaaata

SEQ ID NO: 693357 - DNA, 25 bp, Artificial sequence
  Synthetic oligonucleotide
gaacaccaaacaccctccaaaaata

SEQ ID NO: 693358 - DNA, 25 bp, Artificial sequence
  Synthetic oligonucleotide
tatttcatcgtaaatttgtaatgcg

SEQ ID NO: 693359 - DNA, 25 bp, Artificial sequence
  Synthetic oligonucleotide
tatttcatcgtatatttgtaatgcg

SEQ ID NO: 693360 - DNA, 25 bp, Artificial sequence
  Synthetic oligonucleotide
aaacagctttccattaccgtgattc

SEQ ID NO: 693361 - DNA, 25 bp, Artificial sequence
  Synthetic oligonucleotide
aaacagctttcctttaccgtgattc

SEQ ID NO: 693362 - DNA, 25 bp, Artificial sequence
  Synthetic oligonucleotide
gattccttcttcaaaagaaagaagc

SEQ ID NO: 693363 - DNA, 25 bp, Artificial sequence
  Synthetic oligonucleotide
gattccttcttctaaagaaagaagc

SEQ ID NO: 693364 - DNA, 25 bp, Artificial sequence
  Synthetic oligonucleotide
gctaaagatgctttggtccctcttg

SEQ ID NO: 693365 - DNA, 25 bp, Artificial sequence
  Synthetic oligonucleotide
catgtcctatagaaattagacaaac

SEQ ID NO: 693366 - DNA, 25 bp, Artificial sequence
  Synthetic oligonucleotide
gggaagaagaattcagctttttgca

SEQ ID NO: 693367 - DNA, 25 bp, Artificial sequence
  Synthetic oligonucleotide
catgtcctatagtaattagacaaac

SEQ ID NO: 693368 - DNA, 25 bp, Artificial sequence
  Synthetic oligonucleotide
ttcctttggtgtaaaaaagattgga

SEQ ID NO: 693369 - DNA, 25 bp, Artificial sequence
  Synthetic oligonucleotide
ttcctttggtgttaaaaagattgga

SEQ ID NO: 693370 - DNA, 25 bp, Artificial sequence
  Synthetic oligonucleotide
tgtgacactctcttgccctttgaag

SEQ ID NO: 693371 - DNA, 25 bp, Artificial sequence
  Synthetic oligonucleotide
tgtgacactctcatgccctttgaag

SEQ ID NO: 693372 - DNA, 25 bp, Artificial sequence
  Synthetic oligonucleotide
aatagtaaaaatgaagcaatttgcc

SEQ ID NO: 693373 - DNA, 25 bp, Artificial sequence
  Synthetic oligonucleotide
aatagtaaaaatcaagcaatttgcc

SEQ ID NO: 693374 - DNA, 25 bp, Artificial sequence
  Synthetic oligonucleotide
cacatgattctgttttttgggtctc

SEQ ID NO: 693375 - DNA, 25 bp, Artificial sequence
  Synthetic oligonucleotide
cacatgattctgatttttgggtctc

SEQ ID NO: 693376 - DNA, 25 bp, Artificial sequence
  Synthetic oligonucleotide
ttttattaatgtttgattattgtca

SEQ ID NO: 693377 - DNA, 25 bp, Artificial sequence
  Synthetic oligonucleotide
caagttcacacctgaaataaagttg

SEQ ID NO: 693378 - DNA, 25 bp, Artificial sequence
  Synthetic oligonucleotide
gctaaagatgctatggtccctcttg

SEQ ID NO: 693379 - DNA, 25 bp, Artificial sequence
  Synthetic oligonucleotide
catgaaagatatacttatgattgag

SEQ ID NO: 693380 - DNA, 25 bp, Artificial sequence
  Synthetic oligonucleotide
aatcatgctttgaatttgcttgaca

SEQ ID NO: 693381 - DNA, 25 bp, Artificial sequence
  Synthetic oligonucleotide
aatcatgctttgtatttgcttgaca

SEQ ID NO: 693382 - DNA, 25 bp, Artificial sequence
  Synthetic oligonucleotide
cactttttagatatatgtgatcaca

SEQ ID NO: 693383 - DNA, 25 bp, Artificial sequence
  Synthetic oligonucleotide
cactttttagatttatgtgatcaca

SEQ ID NO: 693384 - DNA, 25 bp, Artificial sequence
  Synthetic oligonucleotide
aagtccagaatttgtatccgttata

SEQ ID NO: 693385 - DNA, 25 bp, Artificial sequence
  Synthetic oligonucleotide
aagtccagaattagtatccgttata

SEQ ID NO: 693386 - DNA, 25 bp, Artificial sequence
  Synthetic oligonucleotide
tatgttaaaattcatactttgtttc

SEQ ID NO: 693387 - DNA, 25 bp, Artificial sequence
  Synthetic oligonucleotide
tatgttaaaattgatactttgtttc

SEQ ID NO: 693388 - DNA, 25 bp, Artificial sequence
  Synthetic oligonucleotide
caatttgatttacttgatgtgtacc

SEQ ID NO: 693389 - DNA, 25 bp, Artificial sequence
  Synthetic oligonucleotide
caatttgatttagttgatgtgtacc

SEQ ID NO: 693390 - DNA, 25 bp, Artificial sequence
  Synthetic oligonucleotide
gggagaaaccaaacaaattccatgt

SEQ ID NO: 693391 - DNA, 25 bp, Artificial sequence
  Synthetic oligonucleotide
tgttttgtaatatacttgtgcaagc

SEQ ID NO: 693392 - DNA, 25 bp, Artificial sequence
  Synthetic oligonucleotide
gggtcatccggccagaaaagtttat

SEQ ID NO: 693393 - DNA, 25 bp, Artificial sequence
  Synthetic oligonucleotide
catgaaagatattcttatgattgag

SEQ ID NO: 693394 - DNA, 25 bp, Artificial sequence
  Synthetic oligonucleotide
gctgcatcgtaataccctaaatctt

SEQ ID NO: 693395 - DNA, 25 bp, Artificial sequence
  Synthetic oligonucleotide
gctgcatcgtaaaaccctaaatctt

SEQ ID NO: 693396 - DNA, 25 bp, Artificial sequence
  Synthetic oligonucleotide
tccaatccattgtataacgagtaag

SEQ ID NO: 693397 - DNA, 25 bp, Artificial sequence
  Synthetic oligonucleotide
tccaatccattgaataacgagtaag

SEQ ID NO: 693398 - DNA, 25 bp, Artificial sequence
  Synthetic oligonucleotide
gatgaattatttatagaacacgaga

SEQ ID NO: 693399 - DNA, 25 bp, Artificial sequence
  Synthetic oligonucleotide
gatgaattatttttagaacacgaga

SEQ ID NO: 693400 - DNA, 25 bp, Artificial sequence
  Synthetic oligonucleotide
cacgtttatcgttcatgccaggagc

SEQ ID NO: 693401 - DNA, 25 bp, Artificial sequence
  Synthetic oligonucleotide
tttgttctaacgtaacagaactgag

SEQ ID NO: 693402 - DNA, 25 bp, Artificial sequence
  Synthetic oligonucleotide
tttgttctaacgaaacagaactgag

SEQ ID NO: 693403 - DNA, 25 bp, Artificial sequence
  Synthetic oligonucleotide
tgttttgtaataaacttgtgcaagc

SEQ ID NO: 693404 - DNA, 25 bp, Artificial sequence
  Synthetic oligonucleotide
tactatattctcaaaacgatggtgt

SEQ ID NO: 693405 - DNA, 25 bp, Artificial sequence
  Synthetic oligonucleotide
tagtaacaggccgacataataaccc

SEQ ID NO: 693406 - DNA, 25 bp, Artificial sequence
  Synthetic oligonucleotide
tagtaacaggcccacataataaccc

SEQ ID NO: 693407 - DNA, 25 bp, Artificial sequence
  Synthetic oligonucleotide
gattaaaaatagtaacacactgacc

SEQ ID NO: 693408 - DNA, 25 bp, Artificial sequence
  Synthetic oligonucleotide
gattaaaaatagaaacacactgacc

SEQ ID NO: 693409 - DNA, 25 bp, Artificial sequence
  Synthetic oligonucleotide
caagaaagatataaaaaaaactcat

SEQ ID NO: 693410 - DNA, 25 bp, Artificial sequence
  Synthetic oligonucleotide
caagaaagatattaaaaaaactcat

SEQ ID NO: 693411 - DNA, 25 bp, Artificial sequence
  Synthetic oligonucleotide
gtctctataaaacatccaactctca

SEQ ID NO: 693412 - DNA, 25 bp, Artificial sequence
  Synthetic oligonucleotide
gtctctataaaagatccaactctca

SEQ ID NO: 693413 - DNA, 25 bp, Artificial sequence
  Synthetic oligonucleotide
aaatcacatttccactctccttgaa

SEQ ID NO: 693414 - DNA, 25 bp, Artificial sequence
  Synthetic oligonucleotide
taaactagtgcctaggaagaaatgg

SEQ ID NO: 693415 - DNA, 25 bp, Artificial sequence
  Synthetic oligonucleotide
gatctattcccatttgactttcttg

SEQ ID NO: 693416 - DNA, 25 bp, Artificial sequence
  Synthetic oligonucleotide
taatgtgaaaccaggtgatgatgac

SEQ ID NO: 693417 - DNA, 25 bp, Artificial sequence
  Synthetic oligonucleotide
gatctattcccaattgactttcttg

SEQ ID NO: 693418 - DNA, 25 bp, Artificial sequence
  Synthetic oligonucleotide
tactatattctctaaacgatggtgt

SEQ ID NO: 693419 - DNA, 25 bp, Artificial sequence
  Synthetic oligonucleotide
tacagtgcggaagaagacaaaaccc

SEQ ID NO: 693420 - DNA, 25 bp, Artificial sequence
  Synthetic oligonucleotide
tacagtgcggaacaagacaaaaccc

SEQ ID NO: 693421 - DNA, 25 bp, Artificial sequence
  Synthetic oligonucleotide
gcaaagtggttgcaccaactttagg

SEQ ID NO: 693422 - DNA, 25 bp, Artificial sequence
  Synthetic oligonucleotide
gcaaagtggttggaccaactttagg

SEQ ID NO: 693423 - DNA, 25 bp, Artificial sequence
  Synthetic oligonucleotide
tgataaccggaatcatcgagtggcc

SEQ ID NO: 693424 - DNA, 25 bp, Artificial sequence
  Synthetic oligonucleotide
tgataaccggaaacatcgagtggcc

SEQ ID NO: 693425 - DNA, 25 bp, Artificial sequence
  Synthetic oligonucleotide
tgtatatctttaaacacgccaaggg

SEQ ID NO: 693426 - DNA, 25 bp, Artificial sequence
  Synthetic oligonucleotide
tgtatatctttatacacgccaaggg

SEQ ID NO: 693427 - DNA, 25 bp, Artificial sequence
  Synthetic oligonucleotide
gggtcatccggcgagaaaagtttat

SEQ ID NO: 693428 - DNA, 25 bp, Artificial sequence
  Synthetic oligonucleotide
aaaaaactacatggatcatcgataa

SEQ ID NO: 693429 - DNA, 25 bp, Artificial sequence
  Synthetic oligonucleotide
aaaaaactacatcgatcatcgataa

SEQ ID NO: 693430 - DNA, 25 bp, Artificial sequence
  Synthetic oligonucleotide
ccgcagagagtttatttgttcatga

SEQ ID NO: 693431 - DNA, 25 bp, Artificial sequence
  Synthetic oligonucleotide
caaagtcgcttggtttcgtgtccga

SEQ ID NO: 693432 - DNA, 25 bp, Artificial sequence
  Synthetic oligonucleotide
caaagtcgcttgctttcgtgtccga

SEQ ID NO: 693433 - DNA, 25 bp, Artificial sequence
  Synthetic oligonucleotide
aattgggtatttgctgagtttcgtc

SEQ ID NO: 693434 - DNA, 25 bp, Artificial sequence
  Synthetic oligonucleotide
aattgggtatttcctgagtttcgtc

SEQ ID NO: 693435 - DNA, 25 bp, Artificial sequence
  Synthetic oligonucleotide
caaggtttcattattctccaacatg

SEQ ID NO: 693436 - DNA, 25 bp, Artificial sequence
  Synthetic oligonucleotide
caaggtttcatttttctccaacatg

SEQ ID NO: 693437 - DNA, 25 bp, Artificial sequence
  Synthetic oligonucleotide
taagcctctatgatatctccgagcc

SEQ ID NO: 693438 - DNA, 25 bp, Artificial sequence
  Synthetic oligonucleotide
taagcctctatgttatctccgagcc

SEQ ID NO: 693439 - DNA, 25 bp, Artificial sequence
  Synthetic oligonucleotide
tatattggtgtcattagtttttttg

SEQ ID NO: 693440 - DNA, 25 bp, Artificial sequence
  Synthetic oligonucleotide
tatattggtgtctttagtttttttg

SEQ ID NO: 693441 - DNA, 25 bp, Artificial sequence
  Synthetic oligonucleotide
tacgaagctgatgtagtttctctgt

SEQ ID NO: 693442 - DNA, 25 bp, Artificial sequence
  Synthetic oligonucleotide
tccaagtagtagaccaggtgttcgt

SEQ ID NO: 693443 - DNA, 25 bp, Artificial sequence
  Synthetic oligonucleotide
tttttttggaattgagtacacactg

SEQ ID NO: 693444 - DNA, 25 bp, Artificial sequence
  Synthetic oligonucleotide
ccgcagagagttaatttgttcatga

SEQ ID NO: 693445 - DNA, 25 bp, Artificial sequence
  Synthetic oligonucleotide
tttttttggaatagagtacacactg

SEQ ID NO: 693446 - DNA, 25 bp, Artificial sequence
  Synthetic oligonucleotide
gatattgtttaaaagtagagtctca

SEQ ID NO: 693447 - DNA, 25 bp, Artificial sequence
  Synthetic oligonucleotide
acttcggttgttacaatgtgttgca

SEQ ID NO: 693448 - DNA, 25 bp, Artificial sequence
  Synthetic oligonucleotide
acttcggttgtttcaatgtgttgca

SEQ ID NO: 693449 - DNA, 25 bp, Artificial sequence
  Synthetic oligonucleotide
tatgcaagtggaagaggaaaagact

SEQ ID NO: 693450 - DNA, 25 bp, Artificial sequence
  Synthetic oligonucleotide
tatgcaagtggatgaggaaaagact

SEQ ID NO: 693451 - DNA, 25 bp, Artificial sequence
  Synthetic oligonucleotide
taatgtgaaacctggtgatgatgac

SEQ ID NO: 693452 - DNA, 25 bp, Artificial sequence
  Synthetic oligonucleotide
gggagaaaccaatcaaattccatgt

SEQ ID NO: 693453 - DNA, 25 bp, Artificial sequence
  Synthetic oligonucleotide
aaatcacatttcgactctccttgaa

SEQ ID NO: 693454 - DNA, 25 bp, Artificial sequence
  Synthetic oligonucleotide
tccaagtagtagtccaggtgttcgt

SEQ ID NO: 693455 - DNA, 25 bp, Artificial sequence
  Synthetic oligonucleotide
gatattgtttaatagtagagtctca

SEQ ID NO: 693456 - DNA, 25 bp, Artificial sequence
  Synthetic oligonucleotide
tgaaaattccataaaacagcaccaa

SEQ ID NO: 693457 - DNA, 25 bp, Artificial sequence
  Synthetic oligonucleotide
tgaaaattccattaaacagcaccaa

SEQ ID NO: 693458 - DNA, 25 bp, Artificial sequence
  Synthetic oligonucleotide
tctattctctatcgtaaccaaaagg

SEQ ID NO: 693459 - DNA, 25 bp, Artificial sequence
  Synthetic oligonucleotide
tctattctctatggtaaccaaaagg

SEQ ID NO: 693460 - DNA, 25 bp, Artificial sequence
  Synthetic oligonucleotide
tttttaccgcggaaagtattgaata

SEQ ID NO: 693461 - DNA, 25 bp, Artificial sequence
  Synthetic oligonucleotide
tttttaccgcggtaagtattgaata

SEQ ID NO: 693462 - DNA, 25 bp, Artificial sequence
  Synthetic oligonucleotide
ttgcttcataaaataggattcgatc

SEQ ID NO: 693463 - DNA, 25 bp, Artificial sequence
  Synthetic oligonucleotide
taaaagagaaaaggatgttcgcgcg

SEQ ID NO: 693464 - DNA, 25 bp, Artificial sequence
  Synthetic oligonucleotide
taaaagagaaaacgatgttcgcgcg

SEQ ID NO: 693465 - DNA, 25 bp, Artificial sequence
  Synthetic oligonucleotide
tacgaagctgatctagtttctctgt

SEQ ID NO: 693466 - DNA, 25 bp, Artificial sequence
  Synthetic oligonucleotide
ttgcttcataaattaggattcgatc

SEQ ID NO: 693467 - DNA, 25 bp, Artificial sequence
  Synthetic oligonucleotide
atctatatcctcatttgtgtaggaa

SEQ ID NO: 693468 - DNA, 25 bp, Artificial sequence
  Synthetic oligonucleotide
atctatatcctcttttgtgtaggaa

SEQ ID NO: 693469 - DNA, 25 bp, Artificial sequence
  Synthetic oligonucleotide
caccaattcatttttcggcaccaca

SEQ ID NO: 693470 - DNA, 25 bp, Artificial sequence
  Synthetic oligonucleotide
caaaatggtgaccccccgttccatt

SEQ ID NO: 693471 - DNA, 25 bp, Artificial sequence
  Synthetic oligonucleotide
caccaattcattattcggcaccaca

SEQ ID NO: 693472 - DNA, 25 bp, Artificial sequence
  Synthetic oligonucleotide
caaaatggtgacgccccgttccatt

SEQ ID NO: 693473 - DNA, 25 bp, Artificial sequence
  Synthetic oligonucleotide
ctttttctgaatcaggtcgtttttc

SEQ ID NO: 693474 - DNA, 25 bp, Artificial sequence
  Synthetic oligonucleotide
ctttttctgaatgaggtcgtttttc

SEQ ID NO: 693475 - DNA, 25 bp, Artificial sequence
  Synthetic oligonucleotide
cgtagcgcctttagcagcgtatccg

SEQ ID NO: 693476 - DNA, 25 bp, Artificial sequence
  Synthetic oligonucleotide
atggggatcaatggagttaatcacg

SEQ ID NO: 693477 - DNA, 25 bp, Artificial sequence
  Synthetic oligonucleotide
ttacagaaagtagaaggcggaaaaa

SEQ ID NO: 693478 - DNA, 25 bp, Artificial sequence
  Synthetic oligonucleotide
aaaatcgattaatcttgccgctaca

SEQ ID NO: 693479 - DNA, 25 bp, Artificial sequence
  Synthetic oligonucleotide
cagcgtatacatcgcttctttatag

SEQ ID NO: 693480 - DNA, 25 bp, Artificial sequence
  Synthetic oligonucleotide
aaaatcgattaaacttgccgctaca

SEQ ID NO: 693481 - DNA, 25 bp, Artificial sequence
  Synthetic oligonucleotide
cagcgtatacatggcttctttatag

SEQ ID NO: 693482 - DNA, 25 bp, Artificial sequence
  Synthetic oligonucleotide
cgtagcgccttttgcagcgtatccg

SEQ ID NO: 693483 - DNA, 25 bp, Artificial sequence
  Synthetic oligonucleotide
aagggactacccaaaataaggatga

SEQ ID NO: 693484 - DNA, 25 bp, Artificial sequence
  Synthetic oligonucleotide
tgccgatccgtctttactctgggtg

SEQ ID NO: 693485 - DNA, 25 bp, Artificial sequence
  Synthetic oligonucleotide
tgccgatccgtcattactctgggtg

SEQ ID NO: 693486 - DNA, 25 bp, Artificial sequence
  Synthetic oligonucleotide
ttgccgctccgattaaaataaaaaa

SEQ ID NO: 693487 - DNA, 25 bp, Artificial sequence
  Synthetic oligonucleotide
aagcaaagacaatatgatgacgcag

SEQ ID NO: 693488 - DNA, 25 bp, Artificial sequence
  Synthetic oligonucleotide
cggcagtatcatcattactgctctt

SEQ ID NO: 693489 - DNA, 25 bp, Artificial sequence
  Synthetic oligonucleotide
aagggactaccctaaataaggatga

SEQ ID NO: 693490 - DNA, 25 bp, Artificial sequence
  Synthetic oligonucleotide
ttacagaaagtacaaggcggaaaaa

SEQ ID NO: 693491 - DNA, 25 bp, Artificial sequence
  Synthetic oligonucleotide
atggggatcaatcgagttaatcacg

SEQ ID NO: 693492 - DNA, 25 bp, Artificial sequence
  Synthetic oligonucleotide
cagccgccttttatctattacatgt

SEQ ID NO: 693493 - DNA, 25 bp, Artificial sequence
  Synthetic oligonucleotide
cagccgccttttttctattacatgt

SEQ ID NO: 693494 - DNA, 25 bp, Artificial sequence
  Synthetic oligonucleotide
cggatttttattttcatcaagcgta

SEQ ID NO: 693495 - DNA, 25 bp, Artificial sequence
  Synthetic oligonucleotide
cggatttttattatcatcaagcgta

SEQ ID NO: 693496 - DNA, 25 bp, Artificial sequence
  Synthetic oligonucleotide
gagcacatcgtgaacatcgcttacc

SEQ ID NO: 693497 - DNA, 25 bp, Artificial sequence
  Synthetic oligonucleotide
gagcacatcgtgtacatcgcttacc

SEQ ID NO: 693498 - DNA, 25 bp, Artificial sequence
  Synthetic oligonucleotide
cggcagtatcatgattactgctctt

SEQ ID NO: 693499 - DNA, 25 bp, Artificial sequence
  Synthetic oligonucleotide
ccttccattagatagcgtttatatt

SEQ ID NO: 693500 - DNA, 25 bp, Artificial sequence
  Synthetic oligonucleotide
tctgcatattgaaatgaaccaagcc

SEQ ID NO: 693501 - DNA, 25 bp, Artificial sequence
  Synthetic oligonucleotide
gtgtaatacctgaaaaaccgccctc

SEQ ID NO: 693502 - DNA, 25 bp, Artificial sequence
  Synthetic oligonucleotide
gtgtaatacctgtaaaaccgccctc

SEQ ID NO: 693503 - DNA, 25 bp, Artificial sequence
  Synthetic oligonucleotide
tctgcatattgatatgaaccaagcc

SEQ ID NO: 693504 - DNA, 25 bp, Artificial sequence
  Synthetic oligonucleotide
ttgccgctccgaataaaataaaaaa

SEQ ID NO: 693505 - DNA, 25 bp, Artificial sequence
  Synthetic oligonucleotide
atctaatttctcgaagcatcacaca

SEQ ID NO: 693506 - DNA, 25 bp, Artificial sequence
  Synthetic oligonucleotide
atagaggggctgttgtggaaaaggg

SEQ ID NO: 693507 - DNA, 25 bp, Artificial sequence
  Synthetic oligonucleotide
ccttccattagaaagcgtttatatt

SEQ ID NO: 693508 - DNA, 25 bp, Artificial sequence
  Synthetic oligonucleotide
ataaaaaaaatccgaatgttcaaca

SEQ ID NO: 693509 - DNA, 25 bp, Artificial sequence
  Synthetic oligonucleotide
aaaagaaaacagcaaacgtgcttaa

SEQ ID NO: 693510 - DNA, 25 bp, Artificial sequence
  Synthetic oligonucleotide
aaaagaaaacaggaaacgtgcttaa

SEQ ID NO: 693511 - DNA, 25 bp, Artificial sequence
  Synthetic oligonucleotide
acgtatctgaataagctaacatgta

SEQ ID NO: 693512 - DNA, 25 bp, Artificial sequence
  Synthetic oligonucleotide
ttaagtatcctccgtatgatttgac

SEQ ID NO: 693513 - DNA, 25 bp, Artificial sequence
  Synthetic oligonucleotide
acaaaggcggcaatagagatgcttg

SEQ ID NO: 693514 - DNA, 25 bp, Artificial sequence
  Synthetic oligonucleotide
acgtatctgaattagctaacatgta

SEQ ID NO: 693515 - DNA, 25 bp, Artificial sequence
  Synthetic oligonucleotide
atctaatttctccaagcatcacaca

SEQ ID NO: 693516 - DNA, 25 bp, Artificial sequence
  Synthetic oligonucleotide
aggggcatatggttttcatatcgct

SEQ ID NO: 693517 - DNA, 25 bp, Artificial sequence
  Synthetic oligonucleotide
aaacatcgttctccccatcggaatc

SEQ ID NO: 693518 - DNA, 25 bp, Artificial sequence
  Synthetic oligonucleotide
aaacatcgttctgcccatcggaatc

SEQ ID NO: 693519 - DNA, 25 bp, Artificial sequence
  Synthetic oligonucleotide
attcactaaacgagcgatgatatca

SEQ ID NO: 693520 - DNA, 25 bp, Artificial sequence
  Synthetic oligonucleotide
attcactaaacgtgcgatgatatca

SEQ ID NO: 693521 - DNA, 25 bp, Artificial sequence
  Synthetic oligonucleotide
ttaaaaataatagccagtccggctc

SEQ ID NO: 693522 - DNA, 25 bp, Artificial sequence
  Synthetic oligonucleotide
ttaaaaataatacccagtccggctc

SEQ ID NO: 693523 - DNA, 25 bp, Artificial sequence
  Synthetic oligonucleotide
atagaggggctgatgtggaaaaggg

SEQ ID NO: 693524 - DNA, 25 bp, Artificial sequence
  Synthetic oligonucleotide
ccggcaaataaagcggcgagcgcta

SEQ ID NO: 693525 - DNA, 25 bp, Artificial sequence
  Synthetic oligonucleotide
aagcaaagacaaaatgatgacgcag

SEQ ID NO: 693526 - DNA, 25 bp, Artificial sequence
  Synthetic oligonucleotide
aggggcatatggatttcatatcgct

SEQ ID NO: 693527 - DNA, 25 bp, Artificial sequence
  Synthetic oligonucleotide
aggaacaaagactaggctacagtgc

SEQ ID NO: 693528 - DNA, 25 bp, Artificial sequence
  Synthetic oligonucleotide
aggaacaaagacaaggctacagtgc

SEQ ID NO: 693529 - DNA, 25 bp, Artificial sequence
  Synthetic oligonucleotide
taaacaaacattctcctgccgagca

SEQ ID NO: 693530 - DNA, 25 bp, Artificial sequence
  Synthetic oligonucleotide
taaacaaacattgtcctgccgagca

SEQ ID NO: 693531 - DNA, 25 bp, Artificial sequence
  Synthetic oligonucleotide
ataaaaaaaatcggaatgttcaaca

SEQ ID NO: 693532 - DNA, 25 bp, Artificial sequence
  Synthetic oligonucleotide
ccggcaaataaaccggcgagcgcta

SEQ ID NO: 693533 - DNA, 25 bp, Artificial sequence
  Synthetic oligonucleotide
agcattttagaacatgaacagctaa

SEQ ID NO: 693534 - DNA, 25 bp, Artificial sequence
  Synthetic oligonucleotide
agtttttatcaaagcacttcccgtg

SEQ ID NO: 693535 - DNA, 25 bp, Artificial sequence
  Synthetic oligonucleotide
tatgccgatttaccagaaccggagt

SEQ ID NO: 693536 - DNA, 25 bp, Artificial sequence
  Synthetic oligonucleotide
tatgccgatttagcagaaccggagt

SEQ ID NO: 693537 - DNA, 25 bp, Artificial sequence
  Synthetic oligonucleotide
tcttctaaaaaatttgtcagccagt

SEQ ID NO: 693538 - DNA, 25 bp, Artificial sequence
  Synthetic oligonucleotide
tcttctaaaaaaattgtcagccagt

SEQ ID NO: 693539 - DNA, 25 bp, Artificial sequence
  Synthetic oligonucleotide
ttaaagaaggatattttagcccgct

SEQ ID NO: 693540 - DNA, 25 bp, Artificial sequence
  Synthetic oligonucleotide
ggccttgtcctgcttgaagcgatgg

SEQ ID NO: 693541 - DNA, 25 bp, Artificial sequence
  Synthetic oligonucleotide
ggaggtttcgttcagtgagtgataa

SEQ ID NO: 693542 - DNA, 25 bp, Artificial sequence
  Synthetic oligonucleotide
aatcgaagcggggcatcaggcttat

SEQ ID NO: 693543 - DNA, 25 bp, Artificial sequence
  Synthetic oligonucleotide
gtcggtgatgttacggccgcaacag

SEQ ID NO: 693544 - DNA, 25 bp, Artificial sequence
  Synthetic oligonucleotide
gtcggtgatgtttcggccgcaacag

SEQ ID NO: 693545 - DNA, 25 bp, Artificial sequence
  Synthetic oligonucleotide
gttataaaaaacaatgtgagcggat

SEQ ID NO: 693546 - DNA, 25 bp, Artificial sequence
  Synthetic oligonucleotide
gttataaaaaactatgtgagcggat

SEQ ID NO: 693547 - DNA, 25 bp, Artificial sequence
  Synthetic oligonucleotide
ccttgtattggatcaaacattggcg

SEQ ID NO: 693548 - DNA, 25 bp, Artificial sequence
  Synthetic oligonucleotide
agcattttagaagatgaacagctaa

SEQ ID NO: 693549 - DNA, 25 bp, Artificial sequence
  Synthetic oligonucleotide
acaaaggcggcattagagatgcttg

SEQ ID NO: 693550 - DNA, 25 bp, Artificial sequence
  Synthetic oligonucleotide
caaagagcacgggaccattattgtg

SEQ ID NO: 693551 - DNA, 25 bp, Artificial sequence
  Synthetic oligonucleotide
atttatctcatcattagaagaggat

SEQ ID NO: 693552 - DNA, 25 bp, Artificial sequence
  Synthetic oligonucleotide
atttatctcatctttagaagaggat

SEQ ID NO: 693553 - DNA, 25 bp, Artificial sequence
  Synthetic oligonucleotide
tgattatgttgaattcagaagaccg

SEQ ID NO: 693554 - DNA, 25 bp, Artificial sequence
  Synthetic oligonucleotide
tgattatgttgatttcagaagaccg

SEQ ID NO: 693555 - DNA, 25 bp, Artificial sequence
  Synthetic oligonucleotide
tgaaacctatgaagtcacgacattc

SEQ ID NO: 693556 - DNA, 25 bp, Artificial sequence
  Synthetic oligonucleotide
tgaaacctatgatgtcacgacattc

SEQ ID NO: 693557 - DNA, 25 bp, Artificial sequence
  Synthetic oligonucleotide
agtttttatcaatgcacttcccgtg

SEQ ID NO: 693558 - DNA, 25 bp, Artificial sequence
  Synthetic oligonucleotide
caaagagcacggcaccattattgtg

SEQ ID NO: 693559 - DNA, 25 bp, Artificial sequence
  Synthetic oligonucleotide
aatcgaagcgggccatcaggcttat

SEQ ID NO: 693560 - DNA, 25 bp, Artificial sequence
  Synthetic oligonucleotide
agtagaacggctgtttcagcggact

SEQ ID NO: 693561 - DNA, 25 bp, Artificial sequence
  Synthetic oligonucleotide
agtagaacggctctttcagcggact

SEQ ID NO: 693562 - DNA, 25 bp, Artificial sequence
  Synthetic oligonucleotide
agatgtcgatatcgcgacagatgcg

SEQ ID NO: 693563 - DNA, 25 bp, Artificial sequence
  Synthetic oligonucleotide
agatgtcgatatggcgacagatgcg

SEQ ID NO: 693564 - DNA, 25 bp, Artificial sequence
  Synthetic oligonucleotide
cgcagttcgtgacagctatatgaaa

SEQ ID NO: 693565 - DNA, 25 bp, Artificial sequence
  Synthetic oligonucleotide
cgcagttcgtgagagctatatgaaa

SEQ ID NO: 693566 - DNA, 25 bp, Artificial sequence
  Synthetic oligonucleotide
ggccttgtcctggttgaagcgatgg

SEQ ID NO: 693567 - DNA, 25 bp, Artificial sequence
  Synthetic oligonucleotide
ttaagtatcctcggtatgatttgac

SEQ ID NO: 693568 - DNA, 25 bp, Artificial sequence
  Synthetic oligonucleotide
tcggcattgttaccactttgcatgg

SEQ ID NO: 693569 - DNA, 25 bp, Artificial sequence
  Synthetic oligonucleotide
gagaaaaaaattcaaacgatttata

SEQ ID NO: 693570 - DNA, 25 bp, Artificial sequence
  Synthetic oligonucleotide
gagaaaaaaattgaaacgatttata

SEQ ID NO: 693571 - DNA, 25 bp, Artificial sequence
  Synthetic oligonucleotide
ccgtctcctcagggcttgcggctga

SEQ ID NO: 693572 - DNA, 25 bp, Artificial sequence
  Synthetic oligonucleotide
ccgtctcctcagcgcttgcggctga

SEQ ID NO: 693573 - DNA, 25 bp, Artificial sequence
  Synthetic oligonucleotide
tccgttttgctattgagtcatcaga

SEQ ID NO: 693574 - DNA, 25 bp, Artificial sequence
  Synthetic oligonucleotide
tccgttttgctaatgagtcatcaga

SEQ ID NO: 693575 - DNA, 25 bp, Artificial sequence
  Synthetic oligonucleotide
ccttgtattggaacaaacattggcg

SEQ ID NO: 693576 - DNA, 25 bp, Artificial sequence
  Synthetic oligonucleotide
cggtgttaggttatgatccgtctct

SEQ ID NO: 693577 - DNA, 25 bp, Artificial sequence
  Synthetic oligonucleotide
aaagagaaacatggaattttaccag

SEQ ID NO: 693578 - DNA, 25 bp, Artificial sequence
  Synthetic oligonucleotide
tcggcattgttagcactttgcatgg

SEQ ID NO: 693579 - DNA, 25 bp, Artificial sequence
  Synthetic oligonucleotide
gcgcctatcttggaaaacaaatgct

SEQ ID NO: 693580 - DNA, 25 bp, Artificial sequence
  Synthetic oligonucleotide
gcgcctatcttgcaaaacaaatgct

SEQ ID NO: 693581 - DNA, 25 bp, Artificial sequence
  Synthetic oligonucleotide
ttatccatgctcactatgctctccc

SEQ ID NO: 693582 - DNA, 25 bp, Artificial sequence
  Synthetic oligonucleotide
ttatccatgctctctatgctctccc

SEQ ID NO: 693583 - DNA, 25 bp, Artificial sequence
  Synthetic oligonucleotide
aaatcgctgaggtggcggaacggga

SEQ ID NO: 693584 - DNA, 25 bp, Artificial sequence
  Synthetic oligonucleotide
cggtgttaggttttgatccgtctct

SEQ ID NO: 693585 - DNA, 25 bp, Artificial sequence
  Synthetic oligonucleotide
ggcaaaacgaaagcgaagctgcttt

SEQ ID NO: 693586 - DNA, 25 bp, Artificial sequence
  Synthetic oligonucleotide
gatttgaagctgctgctatctgaaa

SEQ ID NO: 693587 - DNA, 25 bp, Artificial sequence
  Synthetic oligonucleotide
gatttgaagctggtgctatctgaaa

SEQ ID NO: 693588 - DNA, 25 bp, Artificial sequence
  Synthetic oligonucleotide
aatcaagaccgtcttgaagatcttt

SEQ ID NO: 693589 - DNA, 25 bp, Artificial sequence
  Synthetic oligonucleotide
aatcaagaccgtgttgaagatcttt

SEQ ID NO: 693590 - DNA, 25 bp, Artificial sequence
  Synthetic oligonucleotide
aaatatggcttgcaagaccaagtct

SEQ ID NO: 693591 - DNA, 25 bp, Artificial sequence
  Synthetic oligonucleotide
aaatatggcttggaagaccaagtct

SEQ ID NO: 693592 - DNA, 25 bp, Artificial sequence
  Synthetic oligonucleotide
gagcgcgtgtatgtgaagaaaaaca

SEQ ID NO: 693593 - DNA, 25 bp, Artificial sequence
  Synthetic oligonucleotide
ggtccggagaaatcgacagcctgcg

SEQ ID NO: 693594 - DNA, 25 bp, Artificial sequence
  Synthetic oligonucleotide
gagcgcgtgtatctgaagaaaaaca

SEQ ID NO: 693595 - DNA, 25 bp, Artificial sequence
  Synthetic oligonucleotide
ggcaaaacgaaaccgaagctgcttt

SEQ ID NO: 693596 - DNA, 25 bp, Artificial sequence
  Synthetic oligonucleotide
gtgcaggatgtcatccgtgtgttcc

SEQ ID NO: 693597 - DNA, 25 bp, Artificial sequence
  Synthetic oligonucleotide
gtgcaggatgtcttccgtgtgttcc

SEQ ID NO: 693598 - DNA, 25 bp, Artificial sequence
  Synthetic oligonucleotide
gtcatccatgtgaccaacttcagaa

SEQ ID NO: 693599 - DNA, 25 bp, Artificial sequence
  Synthetic oligonucleotide
gtcatccatgtgtccaacttcagaa

SEQ ID NO: 693600 - DNA, 25 bp, Artificial sequence
  Synthetic oligonucleotide
aaagagaaacatcgaattttaccag

SEQ ID NO: 693601 - DNA, 25 bp, Artificial sequence
  Synthetic oligonucleotide
aaatcgctgaggaggcggaacggga

SEQ ID NO: 693602 - DNA, 25 bp, Artificial sequence
  Synthetic oligonucleotide
ggtccggagaaaacgacagcctgcg

SEQ ID NO: 693603 - DNA, 25 bp, Artificial sequence
  Synthetic oligonucleotide
acggtcagtttgggtaaagaagaag

SEQ ID NO: 693604 - DNA, 25 bp, Artificial sequence
  Synthetic oligonucleotide
atgtataatgctgacgttcttgctt

SEQ ID NO: 693605 - DNA, 25 bp, Artificial sequence
  Synthetic oligonucleotide
atgtataatgctcacgttcttgctt

SEQ ID NO: 693606 - DNA, 25 bp, Artificial sequence
  Synthetic oligonucleotide
agtgatgatgtccagatcggaatgg

SEQ ID NO: 693607 - DNA, 25 bp, Artificial sequence
  Synthetic oligonucleotide
agtgatgatgtcgagatcggaatgg

SEQ ID NO: 693608 - DNA, 25 bp, Artificial sequence
  Synthetic oligonucleotide
gcgaagtttgtcaaacaggaaaaaa

SEQ ID NO: 693609 - DNA, 25 bp, Artificial sequence
  Synthetic oligonucleotide
gcgaagtttgtctaacaggaaaaaa

SEQ ID NO: 693610 - DNA, 25 bp, Artificial sequence
  Synthetic oligonucleotide
gcaattcggtcatttgtcactgtca

SEQ ID NO: 693611 - DNA, 25 bp, Artificial sequence
  Synthetic oligonucleotide
tgcgatttgacagaagcggaactct

SEQ ID NO: 693612 - DNA, 25 bp, Artificial sequence
  Synthetic oligonucleotide
cggaaattcttgtgcgcacacttga

SEQ ID NO: 693613 - DNA, 25 bp, Artificial sequence
  Synthetic oligonucleotide
acggtcagtttgcgtaaagaagaag

SEQ ID NO: 693614 - DNA, 25 bp, Artificial sequence
  Synthetic oligonucleotide
gcccgcatattaggcgcagataaaa

SEQ ID NO: 693615 - DNA, 25 bp, Artificial sequence
  Synthetic oligonucleotide
gcccgcatattacgcgcagataaaa

SEQ ID NO: 693616 - DNA, 25 bp, Artificial sequence
  Synthetic oligonucleotide
acgcttccagacggcggcctaataa

SEQ ID NO: 693617 - DNA, 25 bp, Artificial sequence
  Synthetic oligonucleotide
acgcttccagaccgcggcctaataa

SEQ ID NO: 693618 - DNA, 25 bp, Artificial sequence
  Synthetic oligonucleotide
ggttcaatttaccactgcctatcgg

SEQ ID NO: 693619 - DNA, 25 bp, Artificial sequence
  Synthetic oligonucleotide
tgcgatttgacacaagcggaactct

SEQ ID NO: 693620 - DNA, 25 bp, Artificial sequence
  Synthetic oligonucleotide
ggaggtttcgttgagtgagtgataa

SEQ ID NO: 693621 - DNA, 25 bp, Artificial sequence
  Synthetic oligonucleotide
gaatcatgatctatacgcaaccgga

SEQ ID NO: 693622 - DNA, 25 bp, Artificial sequence
  Synthetic oligonucleotide
gaatcatgatctttacgcaaccgga

SEQ ID NO: 693623 - DNA, 25 bp, Artificial sequence
  Synthetic oligonucleotide
gaaaattcatgaggcgacaggtctt

SEQ ID NO: 693624 - DNA, 25 bp, Artificial sequence
  Synthetic oligonucleotide
gaaaattcatgacgcgacaggtctt

SEQ ID NO: 693625 - DNA, 25 bp, Artificial sequence
  Synthetic oligonucleotide
ttcaatccggccctttagggggaga

SEQ ID NO: 693626 - DNA, 25 bp, Artificial sequence
  Synthetic oligonucleotide
ttcaatccggccgtttagggggaga

SEQ ID NO: 693627 - DNA, 25 bp, Artificial sequence
  Synthetic oligonucleotide
tcgaattccgtgaccttcttcgggg

SEQ ID NO: 693628 - DNA, 25 bp, Artificial sequence
  Synthetic oligonucleotide
gtgcactgatcggtgccaatgcact

SEQ ID NO: 693629 - DNA, 25 bp, Artificial sequence
  Synthetic oligonucleotide
tcgaattccgtgtccttcttcgggg

SEQ ID NO: 693630 - DNA, 25 bp, Artificial sequence
  Synthetic oligonucleotide
tttttttgcgcgacccgctgaccgc

SEQ ID NO: 693631 - DNA, 25 bp, Artificial sequence
  Synthetic oligonucleotide
acatacaggctgtagtagaccgtta

SEQ ID NO: 693632 - DNA, 25 bp, Artificial sequence
  Synthetic oligonucleotide
aaccggatgtctgggcattaatccg

SEQ ID NO: 693633 - DNA, 25 bp, Artificial sequence
  Synthetic oligonucleotide
tgtattccattccgctcgccacaaa

SEQ ID NO: 693634 - DNA, 25 bp, Artificial sequence
  Synthetic oligonucleotide
tgtattccattcggctcgccacaaa

SEQ ID NO: 693635 - DNA, 25 bp, Artificial sequence
  Synthetic oligonucleotide
cggaaattcttgagcgcacacttga

SEQ ID NO: 693636 - DNA, 25 bp, Artificial sequence
  Synthetic oligonucleotide
ggccaaaagcggattttatgccgta

SEQ ID NO: 693637 - DNA, 25 bp, Artificial sequence
  Synthetic oligonucleotide
gtgcactgatcgctgccaatgcact

SEQ ID NO: 693638 - DNA, 25 bp, Artificial sequence
  Synthetic oligonucleotide
gtatcattgcgagagaactggggaa

SEQ ID NO: 693639 - DNA, 25 bp, Artificial sequence
  Synthetic oligonucleotide
gctttacggtaaagaagcgggcgtg

SEQ ID NO: 693640 - DNA, 25 bp, Artificial sequence
  Synthetic oligonucleotide
agtttcttttccaaacggatgctga

SEQ ID NO: 693641 - DNA, 25 bp, Artificial sequence
  Synthetic oligonucleotide
agtttcttttcctaacggatgctga

SEQ ID NO: 693642 - DNA, 25 bp, Artificial sequence
  Synthetic oligonucleotide
gatgtgcttgggcgcgaacaatgag

SEQ ID NO: 693643 - DNA, 25 bp, Artificial sequence
  Synthetic oligonucleotide
gatgtgcttgggggcgaacaatgag

SEQ ID NO: 693644 - DNA, 25 bp, Artificial sequence
  Synthetic oligonucleotide
taggaatcacatcctatccgagcgt

SEQ ID NO: 693645 - DNA, 25 bp, Artificial sequence
  Synthetic oligonucleotide
gcaattcggtcaattgtcactgtca

SEQ ID NO: 693646 - DNA, 25 bp, Artificial sequence
  Synthetic oligonucleotide
gtatcattgcgacagaactggggaa

SEQ ID NO: 693647 - DNA, 25 bp, Artificial sequence
  Synthetic oligonucleotide
cgaatgggtatattgaaatcgttga

SEQ ID NO: 693648 - DNA, 25 bp, Artificial sequence
  Synthetic oligonucleotide
aaaagggacatgtaatccatttcat

SEQ ID NO: 693649 - DNA, 25 bp, Artificial sequence
  Synthetic oligonucleotide
aaaagggacatgaaatccatttcat

SEQ ID NO: 693650 - DNA, 25 bp, Artificial sequence
  Synthetic oligonucleotide
ttccgtttagactgaatacatatca

SEQ ID NO: 693651 - DNA, 25 bp, Artificial sequence
  Synthetic oligonucleotide
ttccgtttagacagaatacatatca

SEQ ID NO: 693652 - DNA, 25 bp, Artificial sequence
  Synthetic oligonucleotide
attttcatgaagatgaggttaatca

SEQ ID NO: 693653 - DNA, 25 bp, Artificial sequence
  Synthetic oligonucleotide
attttcatgaagttgaggttaatca

SEQ ID NO: 693654 - DNA, 25 bp, Artificial sequence
  Synthetic oligonucleotide
taggaatcacatgctatccgagcgt

SEQ ID NO: 693655 - DNA, 25 bp, Artificial sequence
  Synthetic oligonucleotide
aggtttactattttatgataaatgg

SEQ ID NO: 693656 - DNA, 25 bp, Artificial sequence
  Synthetic oligonucleotide
ggccaaaagcggtttttatgccgta

SEQ ID NO: 693657 - DNA, 25 bp, Artificial sequence
  Synthetic oligonucleotide
gccatccggatcacggcaatgcggc

SEQ ID NO: 693658 - DNA, 25 bp, Artificial sequence
  Synthetic oligonucleotide
gccatccggatctcggcaatgcggc

SEQ ID NO: 693659 - DNA, 25 bp, Artificial sequence
  Synthetic oligonucleotide
aagaagcgatctattccgccggaat

SEQ ID NO: 693660 - DNA, 25 bp, Artificial sequence
  Synthetic oligonucleotide
aagaagcgatcttttccgccggaat

SEQ ID NO: 693661 - DNA, 25 bp, Artificial sequence
  Synthetic oligonucleotide
aagacgaaaaaacccttccggcgca

SEQ ID NO: 693662 - DNA, 25 bp, Artificial sequence
  Synthetic oligonucleotide
gctttacggtaatgaagcgggcgtg

SEQ ID NO: 693663 - DNA, 25 bp, Artificial sequence
  Synthetic oligonucleotide
aggtttactattatatgataaatgg

SEQ ID NO: 693664 - DNA, 25 bp, Artificial sequence
  Synthetic oligonucleotide
cgaatgggtataatgaaatcgttga

SEQ ID NO: 693665 - DNA, 25 bp, Artificial sequence
  Synthetic oligonucleotide
cggattttgttaatgatatctcgga

SEQ ID NO: 693666 - DNA, 25 bp, Artificial sequence
  Synthetic oligonucleotide
cggattttgttattgatatctcgga

SEQ ID NO: 693667 - DNA, 25 bp, Artificial sequence
  Synthetic oligonucleotide
caaagaaacaaagcctcaacgccta

SEQ ID NO: 693668 - DNA, 25 bp, Artificial sequence
  Synthetic oligonucleotide
caaagaaacaaaccctcaacgccta

SEQ ID NO: 693669 - DNA, 25 bp, Artificial sequence
  Synthetic oligonucleotide
ttatcccgtcaaaggattccgtttc

SEQ ID NO: 693670 - DNA, 25 bp, Artificial sequence
  Synthetic oligonucleotide
ttatcccgtcaatggattccgtttc

SEQ ID NO: 693671 - DNA, 25 bp, Artificial sequence
  Synthetic oligonucleotide
tttttttgcgcgtcccgctgaccgc

SEQ ID NO: 693672 - DNA, 25 bp, Artificial sequence
  Synthetic oligonucleotide
aagacgaaaaaagccttccggcgca

SEQ ID NO: 693673 - DNA, 25 bp, Artificial sequence
  Synthetic oligonucleotide
tgcgatactgatcatgaaattttca

SEQ ID NO: 693674 - DNA, 25 bp, Artificial sequence
  Synthetic oligonucleotide
tctcccaggagctagaggagcggag

SEQ ID NO: 693675 - DNA, 25 bp, Artificial sequence
  Synthetic oligonucleotide
agatatccatgcctgttttacagaa

SEQ ID NO: 693676 - DNA, 25 bp, Artificial sequence
  Synthetic oligonucleotide
tgtcttgattgatttaacaacgccc

SEQ ID NO: 693677 - DNA, 25 bp, Artificial sequence
  Synthetic oligonucleotide
tgtcttgattgaattaacaacgccc

SEQ ID NO: 693678 - DNA, 25 bp, Artificial sequence
  Synthetic oligonucleotide
agtacatacaaatattgcattagag

SEQ ID NO: 693679 - DNA, 25 bp, Artificial sequence
  Synthetic oligonucleotide
agtacatacaaaaattgcattagag

SEQ ID NO: 693680 - DNA, 25 bp, Artificial sequence
  Synthetic oligonucleotide
tccagttgtcggtacaaccggtttc

SEQ ID NO: 693681 - DNA, 25 bp, Artificial sequence
  Synthetic oligonucleotide
tccagttgtcggaacaaccggtttc

SEQ ID NO: 693682 - DNA, 25 bp, Artificial sequence
  Synthetic oligonucleotide
tttaaaagagctgacatctttaaca

SEQ ID NO: 693683 - DNA, 25 bp, Artificial sequence
  Synthetic oligonucleotide
tttaaaagagctcacatctttaaca

SEQ ID NO: 693684 - DNA, 25 bp, Artificial sequence
  Synthetic oligonucleotide
tgtgatgcctgttgagtcagatgct

SEQ ID NO: 693685 - DNA, 25 bp, Artificial sequence
  Synthetic oligonucleotide
gatcggagccatgatcgcgccaaat

SEQ ID NO: 693686 - DNA, 25 bp, Artificial sequence
  Synthetic oligonucleotide
catagaccatacttacgatcagcaa

SEQ ID NO: 693687 - DNA, 25 bp, Artificial sequence
  Synthetic oligonucleotide
tgcgatactgatgatgaaattttca

SEQ ID NO: 693688 - DNA, 25 bp, Artificial sequence
  Synthetic oligonucleotide
caactattttgacgatgttgagatt

SEQ ID NO: 693689 - DNA, 25 bp, Artificial sequence
  Synthetic oligonucleotide
caactattttgaggatgttgagatt

SEQ ID NO: 693690 - DNA, 25 bp, Artificial sequence
  Synthetic oligonucleotide
tcatgaccagaaccttgacgcacca

SEQ ID NO: 693691 - DNA, 25 bp, Artificial sequence
  Synthetic oligonucleotide
tcatgaccagaagcttgacgcacca

SEQ ID NO: 693692 - DNA, 25 bp, Artificial sequence
  Synthetic oligonucleotide
gcttaaaacagccgaaatgatttca

SEQ ID NO: 693693 - DNA, 25 bp, Artificial sequence
  Synthetic oligonucleotide
gcttaaaacagcggaaatgatttca

SEQ ID NO: 693694 - DNA, 25 bp, Artificial sequence
  Synthetic oligonucleotide
agaaaagcagcatggacatccggat

SEQ ID NO: 693695 - DNA, 25 bp, Artificial sequence
  Synthetic oligonucleotide
agaaaagcagcaaggacatccggat

SEQ ID NO: 693696 - DNA, 25 bp, Artificial sequence
  Synthetic oligonucleotide
tctcccaggagcaagaggagcggag

SEQ ID NO: 693697 - DNA, 25 bp, Artificial sequence
  Synthetic oligonucleotide
gatcggagccatcatcgcgccaaat

SEQ ID NO: 693698 - DNA, 25 bp, Artificial sequence
  Synthetic oligonucleotide
tcatgcataaatttaatacaagaga

SEQ ID NO: 693699 - DNA, 25 bp, Artificial sequence
  Synthetic oligonucleotide
acatacaggctgaagtagaccgtta

SEQ ID NO: 693700 - DNA, 25 bp, Artificial sequence
  Synthetic oligonucleotide
ttaaagaaggattttttagcccgct

SEQ ID NO: 693701 - DNA, 25 bp, Artificial sequence
  Synthetic oligonucleotide
cgaggctgactgtagaactgggcga

SEQ ID NO: 693702 - DNA, 25 bp, Artificial sequence
  Synthetic oligonucleotide
cgaggctgactgaagaactgggcga

SEQ ID NO: 693703 - DNA, 25 bp, Artificial sequence
  Synthetic oligonucleotide
aagtgaatcacccttatggagaaaa

SEQ ID NO: 693704 - DNA, 25 bp, Artificial sequence
  Synthetic oligonucleotide
aagtgaatcaccgttatggagaaaa

SEQ ID NO: 693705 - DNA, 25 bp, Artificial sequence
  Synthetic oligonucleotide
cgactgaagatgttaaaagcatgga

SEQ ID NO: 693706 - DNA, 25 bp, Artificial sequence
  Synthetic oligonucleotide
cgactgaagatgataaaagcatgga

SEQ ID NO: 693707 - DNA, 25 bp, Artificial sequence
  Synthetic oligonucleotide
gcgatgtgctatatgtattggtttg

SEQ ID NO: 693708 - DNA, 25 bp, Artificial sequence
  Synthetic oligonucleotide
gcgatgtgctatttgtattggtttg

SEQ ID NO: 693709 - DNA, 25 bp, Artificial sequence
  Synthetic oligonucleotide
agatatccatgcgtgttttacagaa

SEQ ID NO: 693710 - DNA, 25 bp, Artificial sequence
  Synthetic oligonucleotide
ctcttgatatctgtttagaggaagc

SEQ ID NO: 693711 - DNA, 25 bp, Artificial sequence
  Synthetic oligonucleotide
tgtgatgcctgtagagtcagatgct

SEQ ID NO: 693712 - DNA, 25 bp, Artificial sequence
  Synthetic oligonucleotide
tcatgcataaatataatacaagaga

SEQ ID NO: 693713 - DNA, 25 bp, Artificial sequence
  Synthetic oligonucleotide
ggaccagaaaagtagaaggaaagta

SEQ ID NO: 693714 - DNA, 25 bp, Artificial sequence
  Synthetic oligonucleotide
ggaccagaaaagaagaaggaaagta

SEQ ID NO: 693715 - DNA, 25 bp, Artificial sequence
  Synthetic oligonucleotide
gatgtcaaacgaaacaattaaatta

SEQ ID NO: 693716 - DNA, 25 bp, Artificial sequence
  Synthetic oligonucleotide
gatgtcaaacgatacaattaaatta

SEQ ID NO: 693717 - DNA, 25 bp, Artificial sequence
  Synthetic oligonucleotide
accgcgtggaagtatggggcaggaa

SEQ ID NO: 693718 - DNA, 25 bp, Artificial sequence
  Synthetic oligonucleotide
accgcgtggaagaatggggcaggaa

SEQ ID NO: 693719 - DNA, 25 bp, Artificial sequence
  Synthetic oligonucleotide
ggcagaacgaactccacattttgac

SEQ ID NO: 693720 - DNA, 25 bp, Artificial sequence
  Synthetic oligonucleotide
ggcagaacgaacaccacattttgac

SEQ ID NO: 693721 - DNA, 25 bp, Artificial sequence
  Synthetic oligonucleotide
aaccggatgtctcggcattaatccg

SEQ ID NO: 693722 - DNA, 25 bp, Artificial sequence
  Synthetic oligonucleotide
ctcttgatatctctttagaggaagc

SEQ ID NO: 693723 - DNA, 25 bp, Artificial sequence
  Synthetic oligonucleotide
tgctttgatcgcccatgacaagaaa

SEQ ID NO: 693724 - DNA, 25 bp, Artificial sequence
  Synthetic oligonucleotide
tcgcttgcacagggtccgtcttccg

SEQ ID NO: 693725 - DNA, 25 bp, Artificial sequence
  Synthetic oligonucleotide
catagaccatacatacgatcagcaa

SEQ ID NO: 693726 - DNA, 25 bp, Artificial sequence
  Synthetic oligonucleotide
tgctttgatcgcgcatgacaagaaa

SEQ ID NO: 693727 - DNA, 25 bp, Artificial sequence
  Synthetic oligonucleotide
tatcattgattagacggggggataa

SEQ ID NO: 693728 - DNA, 25 bp, Artificial sequence
  Synthetic oligonucleotide
tatcattgattacacggggggataa

SEQ ID NO: 693729 - DNA, 25 bp, Artificial sequence
  Synthetic oligonucleotide
catgaagattgaacagcttgtgtat

SEQ ID NO: 693730 - DNA, 25 bp, Artificial sequence
  Synthetic oligonucleotide
catgaagattgatcagcttgtgtat

SEQ ID NO: 693731 - DNA, 25 bp, Artificial sequence
  Synthetic oligonucleotide
tttcatgtcaggcgttaaactgtca

SEQ ID NO: 693732 - DNA, 25 bp, Artificial sequence
  Synthetic oligonucleotide
gcttcagatacggcatgattcttat

SEQ ID NO: 693733 - DNA, 25 bp, Artificial sequence
  Synthetic oligonucleotide
gcttcagatacgccatgattcttat

SEQ ID NO: 693734 - DNA, 25 bp, Artificial sequence
  Synthetic oligonucleotide
gcatcaggaggtgatgttcggcatg

SEQ ID NO: 693735 - DNA, 25 bp, Artificial sequence
  Synthetic oligonucleotide
tcgcttgcacagcgtccgtcttccg

SEQ ID NO: 693736 - DNA, 25 bp, Artificial sequence
  Synthetic oligonucleotide
tttcatgtcaggggttaaactgtca

SEQ ID NO: 693737 - DNA, 25 bp, Artificial sequence
  Synthetic oligonucleotide
ggttcaatttacgactgcctatcgg

SEQ ID NO: 693738 - DNA, 25 bp, Artificial sequence
  Synthetic oligonucleotide
gcatcaggaggtcatgttcggcatg

SEQ ID NO: 693739 - DNA, 25 bp, Artificial sequence
  Synthetic oligonucleotide
agacggatttgtagaaaatatcgtc

SEQ ID NO: 693740 - DNA, 25 bp, Artificial sequence
  Synthetic oligonucleotide
cgctgtcattgttgaaggtgcaggc

SEQ ID NO: 693741 - DNA, 25 bp, Artificial sequence
  Synthetic oligonucleotide
aattgatgtcagtagctatccgggc

SEQ ID NO: 693742 - DNA, 25 bp, Artificial sequence
  Synthetic oligonucleotide
aattgatgtcagaagctatccgggc

SEQ ID NO: 693743 - DNA, 25 bp, Artificial sequence
  Synthetic oligonucleotide
agaacctgataccgaaaaggtggtc

SEQ ID NO: 693744 - DNA, 25 bp, Artificial sequence
  Synthetic oligonucleotide
agacggatttgttgaaaatatcgtc

SEQ ID NO: 693745 - DNA, 25 bp, Artificial sequence
  Synthetic oligonucleotide
ccttctcagaagccggatcagagac

SEQ ID NO: 693746 - DNA, 25 bp, Artificial sequence
  Synthetic oligonucleotide
cgctgtcattgtagaaggtgcaggc

SEQ ID NO: 693747 - DNA, 25 bp, Artificial sequence
  Synthetic oligonucleotide
aatgagagagctagttgccattaac

SEQ ID NO: 693748 - DNA, 25 bp, Artificial sequence
  Synthetic oligonucleotide
agaacctgatacggaaaaggtggtc

SEQ ID NO: 693749 - DNA, 25 bp, Artificial sequence
  Synthetic oligonucleotide
ggatgaaaccaccgaccaagtgctg

SEQ ID NO: 693750 - DNA, 25 bp, Artificial sequence
  Synthetic oligonucleotide
ggatgaaaccacggaccaagtgctg

SEQ ID NO: 693751 - DNA, 25 bp, Artificial sequence
  Synthetic oligonucleotide
gctgcttaacgcgcaggtcgaaaaa

SEQ ID NO: 693752 - DNA, 25 bp, Artificial sequence
  Synthetic oligonucleotide
gctgcttaacgcccaggtcgaaaaa

SEQ ID NO: 693753 - DNA, 25 bp, Artificial sequence
  Synthetic oligonucleotide
ccttctcagaaggcggatcagagac

SEQ ID NO: 693754 - DNA, 25 bp, Artificial sequence
  Synthetic oligonucleotide
agaccctgatgacctggtcgacatc

SEQ ID NO: 693755 - DNA, 25 bp, Artificial sequence
  Synthetic oligonucleotide
aactgtcgaggaattcattgttaat

SEQ ID NO: 693756 - DNA, 25 bp, Artificial sequence
  Synthetic oligonucleotide
aatgagagagcttgttgccattaac

SEQ ID NO: 693757 - DNA, 25 bp, Artificial sequence
  Synthetic oligonucleotide
aaatggattatgggatacagcctat

SEQ ID NO: 693758 - DNA, 25 bp, Artificial sequence
  Synthetic oligonucleotide
agaccctgatgagctggtcgacatc

SEQ ID NO: 693759 - DNA, 25 bp, Artificial sequence
  Synthetic oligonucleotide
tccttttccgctggtgcgctataca

SEQ ID NO: 693760 - DNA, 25 bp, Artificial sequence
  Synthetic oligonucleotide
agatgggtaagaattttcggtattc

SEQ ID NO: 693761 - DNA, 25 bp, Artificial sequence
  Synthetic oligonucleotide
agatgggtaagatttttcggtattc

SEQ ID NO: 693762 - DNA, 25 bp, Artificial sequence
  Synthetic oligonucleotide
agaatataggcacgcgccttcagtc

SEQ ID NO: 693763 - DNA, 25 bp, Artificial sequence
  Synthetic oligonucleotide
agaatataggcaggcgccttcagtc

SEQ ID NO: 693764 - DNA, 25 bp, Artificial sequence
  Synthetic oligonucleotide
cccgacgactttttttcaccatgtg

SEQ ID NO: 693765 - DNA, 25 bp, Artificial sequence
  Synthetic oligonucleotide
cccgacgactttatttcaccatgtg

SEQ ID NO: 693766 - DNA, 25 bp, Artificial sequence
  Synthetic oligonucleotide
cattatagtggagacatcgccgagt

SEQ ID NO: 693767 - DNA, 25 bp, Artificial sequence
  Synthetic oligonucleotide
cattatagtggacacatcgccgagt

SEQ ID NO: 693768 - DNA, 25 bp, Artificial sequence
  Synthetic oligonucleotide
tgtggccgcaaaacatgttctagaa

SEQ ID NO: 693769 - DNA, 25 bp, Artificial sequence
  Synthetic oligonucleotide
atccattgatgtcgatggattaaca

SEQ ID NO: 693770 - DNA, 25 bp, Artificial sequence
  Synthetic oligonucleotide
tccttttccgctcgtgcgctataca

SEQ ID NO: 693771 - DNA, 25 bp, Artificial sequence
  Synthetic oligonucleotide
agtcaagatgacaaaagttggtgag

SEQ ID NO: 693772 - DNA, 25 bp, Artificial sequence
  Synthetic oligonucleotide
aactgtcgaggatttcattgttaat

SEQ ID NO: 693773 - DNA, 25 bp, Artificial sequence
  Synthetic oligonucleotide
tttcatctgtgaagccgctgatatt

SEQ ID NO: 693774 - DNA, 25 bp, Artificial sequence
  Synthetic oligonucleotide
atccattgatgtggatggattaaca

SEQ ID NO: 693775 - DNA, 25 bp, Artificial sequence
  Synthetic oligonucleotide
aaatggattatgcgatacagcctat

SEQ ID NO: 693776 - DNA, 25 bp, Artificial sequence
  Synthetic oligonucleotide
tccggatctggtagagatcgtagaa

SEQ ID NO: 693777 - DNA, 25 bp, Artificial sequence
  Synthetic oligonucleotide
tccggatctggttgagatcgtagaa

SEQ ID NO: 693778 - DNA, 25 bp, Artificial sequence
  Synthetic oligonucleotide
ggatttaagcatttgttatatagaa

SEQ ID NO: 693779 - DNA, 25 bp, Artificial sequence
  Synthetic oligonucleotide
ggatttaagcatatgttatatagaa

SEQ ID NO: 693780 - DNA, 25 bp, Artificial sequence
  Synthetic oligonucleotide
agtcaagatgactaaagttggtgag

SEQ ID NO: 693781 - DNA, 25 bp, Artificial sequence
  Synthetic oligonucleotide
tgtggccgcaaatcatgttctagaa

SEQ ID NO: 693782 - DNA, 25 bp, Artificial sequence
  Synthetic oligonucleotide
agataaagagatacaggtttcattt

SEQ ID NO: 693783 - DNA, 25 bp, Artificial sequence
  Synthetic oligonucleotide
tcagcagcaaaagggccgctgccag

SEQ ID NO: 693784 - DNA, 25 bp, Artificial sequence
  Synthetic oligonucleotide
aaattttcttcaaagcagtttgacc

SEQ ID NO: 693785 - DNA, 25 bp, Artificial sequence
  Synthetic oligonucleotide
aaattttcttcatagcagtttgacc

SEQ ID NO: 693786 - DNA, 25 bp, Artificial sequence
  Synthetic oligonucleotide
acgccttaatcattccagttaaagc

SEQ ID NO: 693787 - DNA, 25 bp, Artificial sequence
  Synthetic oligonucleotide
cacaagcagctgcatagtgctgctt

SEQ ID NO: 693788 - DNA, 25 bp, Artificial sequence
  Synthetic oligonucleotide
cacaagcagctggatagtgctgctt

SEQ ID NO: 693789 - DNA, 25 bp, Artificial sequence
  Synthetic oligonucleotide
gaatcatgaaaaatacagttccgtt

SEQ ID NO: 693790 - DNA, 25 bp, Artificial sequence
  Synthetic oligonucleotide
gaatcatgaaaattacagttccgtt

SEQ ID NO: 693791 - DNA, 25 bp, Artificial sequence
  Synthetic oligonucleotide
cgcatcggctgctttgtggtggata

SEQ ID NO: 693792 - DNA, 25 bp, Artificial sequence
  Synthetic oligonucleotide
agataaagagattcaggtttcattt

SEQ ID NO: 693793 - DNA, 25 bp, Artificial sequence
  Synthetic oligonucleotide
caactgcggcatgcgcgagactgac

SEQ ID NO: 693794 - DNA, 25 bp, Artificial sequence
  Synthetic oligonucleotide
taaagctcgggacattcgttttccc

SEQ ID NO: 693795 - DNA, 25 bp, Artificial sequence
  Synthetic oligonucleotide
taaagctcgggagattcgttttccc

SEQ ID NO: 693796 - DNA, 25 bp, Artificial sequence
  Synthetic oligonucleotide
ggtataatagccccgacaaggagag

SEQ ID NO: 693797 - DNA, 25 bp, Artificial sequence
  Synthetic oligonucleotide
ggtataatagccgcgacaaggagag

SEQ ID NO: 693798 - DNA, 25 bp, Artificial sequence
  Synthetic oligonucleotide
ctttaacaccggctgtcatcagtgc

SEQ ID NO: 693799 - DNA, 25 bp, Artificial sequence
  Synthetic oligonucleotide
atacttcaaacggtgctgtaacata

SEQ ID NO: 693800 - DNA, 25 bp, Artificial sequence
  Synthetic oligonucleotide
atacttcaaacgctgctgtaacata

SEQ ID NO: 693801 - DNA, 25 bp, Artificial sequence
  Synthetic oligonucleotide
acgccttaatcaatccagttaaagc

SEQ ID NO: 693802 - DNA, 25 bp, Artificial sequence
  Synthetic oligonucleotide
ctttaacaccgggtgtcatcagtgc

SEQ ID NO: 693803 - DNA, 25 bp, Artificial sequence
  Synthetic oligonucleotide
acgatgaagaaatcgctctcgatcc

SEQ ID NO: 693804 - DNA, 25 bp, Artificial sequence
  Synthetic oligonucleotide
cacgattttagaaaaagagatccag

SEQ ID NO: 693805 - DNA, 25 bp, Artificial sequence
  Synthetic oligonucleotide
gatggggacgagctatgatgtaggt

SEQ ID NO: 693806 - DNA, 25 bp, Artificial sequence
  Synthetic oligonucleotide
gatggggacgaggtatgatgtaggt

SEQ ID NO: 693807 - DNA, 25 bp, Artificial sequence
  Synthetic oligonucleotide
agctaaaaatgatgagtatttcaaa

SEQ ID NO: 693808 - DNA, 25 bp, Artificial sequence
  Synthetic oligonucleotide
agctaaaaatgaagagtatttcaaa

SEQ ID NO: 693809 - DNA, 25 bp, Artificial sequence
  Synthetic oligonucleotide
ttatttcttccgatctggtttctct

SEQ ID NO: 693810 - DNA, 25 bp, Artificial sequence
  Synthetic oligonucleotide
tttcatctgtgatgccgctgatatt

SEQ ID NO: 693811 - DNA, 25 bp, Artificial sequence
  Synthetic oligonucleotide
cattcaatccggtgccttttttggc

SEQ ID NO: 693812 - DNA, 25 bp, Artificial sequence
  Synthetic oligonucleotide
tcagcagcaaaacggccgctgccag

SEQ ID NO: 693813 - DNA, 25 bp, Artificial sequence
  Synthetic oligonucleotide
acgatgaagaaaacgctctcgatcc

SEQ ID NO: 693814 - DNA, 25 bp, Artificial sequence
  Synthetic oligonucleotide
caactgcggcatccgcgagactgac

SEQ ID NO: 693815 - DNA, 25 bp, Artificial sequence
  Synthetic oligonucleotide
tcgatatatattatcctaaatattc

SEQ ID NO: 693816 - DNA, 25 bp, Artificial sequence
  Synthetic oligonucleotide
tcgatatatattttcctaaatattc

SEQ ID NO: 693817 - DNA, 25 bp, Artificial sequence
  Synthetic oligonucleotide
tattggtcacggttaccgttgtggc

SEQ ID NO: 693818 - DNA, 25 bp, Artificial sequence
  Synthetic oligonucleotide
tattggtcacggataccgttgtggc

SEQ ID NO: 693819 - DNA, 25 bp, Artificial sequence
  Synthetic oligonucleotide
cattcatttcatgaagcactttttg

SEQ ID NO: 693820 - DNA, 25 bp, Artificial sequence
  Synthetic oligonucleotide
cattcatttcatcaagcactttttg

SEQ ID NO: 693821 - DNA, 25 bp, Artificial sequence
  Synthetic oligonucleotide
ctgacaaatcaggacccagtgttac

SEQ ID NO: 693822 - DNA, 25 bp, Artificial sequence
  Synthetic oligonucleotide
ctgacaaatcagcacccagtgttac

SEQ ID NO: 693823 - DNA, 25 bp, Artificial sequence
  Synthetic oligonucleotide
cacgattttagataaagagatccag

SEQ ID NO: 693824 - DNA, 25 bp, Artificial sequence
  Synthetic oligonucleotide
cattcaatccggagccttttttggc

SEQ ID NO: 693825 - DNA, 25 bp, Artificial sequence
  Synthetic oligonucleotide
gcggcagccaacaggatcggagaag

SEQ ID NO: 693826 - DNA, 25 bp, Artificial sequence
  Synthetic oligonucleotide
cgttctctcgtgcgagacgcaggca

SEQ ID NO: 693827 - DNA, 25 bp, Artificial sequence
  Synthetic oligonucleotide
acggttggctctcaaaaagaagtgc

SEQ ID NO: 693828 - DNA, 25 bp, Artificial sequence
  Synthetic oligonucleotide
acggttggctctgaaaaagaagtgc

SEQ ID NO: 693829 - DNA, 25 bp, Artificial sequence
  Synthetic oligonucleotide
caatatgtggctgtagacggaggca

SEQ ID NO: 693830 - DNA, 25 bp, Artificial sequence
  Synthetic oligonucleotide
caatatgtggctctagacggaggca

SEQ ID NO: 693831 - DNA, 25 bp, Artificial sequence
  Synthetic oligonucleotide
ggacaaactgaacgggccattgaac

SEQ ID NO: 693832 - DNA, 25 bp, Artificial sequence
  Synthetic oligonucleotide
attcgtcctgcgctttaccaagcta

SEQ ID NO: 693833 - DNA, 25 bp, Artificial sequence
  Synthetic oligonucleotide
ggttttgacattccggaaatttgga

SEQ ID NO: 693834 - DNA, 25 bp, Artificial sequence
  Synthetic oligonucleotide
gcggcagccaactggatcggagaag

SEQ ID NO: 693835 - DNA, 25 bp, Artificial sequence
  Synthetic oligonucleotide
acggtatcaattcccggaaagtgct

SEQ ID NO: 693836 - DNA, 25 bp, Artificial sequence
  Synthetic oligonucleotide
acggtatcaattgccggaaagtgct

SEQ ID NO: 693837 - DNA, 25 bp, Artificial sequence
  Synthetic oligonucleotide
gatatgctgatttgggatattgacc

SEQ ID NO: 693838 - DNA, 25 bp, Artificial sequence
  Synthetic oligonucleotide
gatatgctgattagggatattgacc

SEQ ID NO: 693839 - DNA, 25 bp, Artificial sequence
  Synthetic oligonucleotide
aaagaaggcgatgttcttgccgttt

SEQ ID NO: 693840 - DNA, 25 bp, Artificial sequence
  Synthetic oligonucleotide
attcgtcctgcggtttaccaagcta

SEQ ID NO: 693841 - DNA, 25 bp, Artificial sequence
  Synthetic oligonucleotide
aatcttggaggaggtttcggcattc

SEQ ID NO: 693842 - DNA, 25 bp, Artificial sequence
  Synthetic oligonucleotide
tcggaacacattcagctgctgggtg

SEQ ID NO: 693843 - DNA, 25 bp, Artificial sequence
  Synthetic oligonucleotide
tcggaacacattgagctgctgggtg

SEQ ID NO: 693844 - DNA, 25 bp, Artificial sequence
  Synthetic oligonucleotide
atcggctcgcaattctttgatacgg

SEQ ID NO: 693845 - DNA, 25 bp, Artificial sequence
  Synthetic oligonucleotide
atcggctcgcaaatctttgatacgg

SEQ ID NO: 693846 - DNA, 25 bp, Artificial sequence
  Synthetic oligonucleotide
ttagcagcggaaaaaatcttcaaaa

SEQ ID NO: 693847 - DNA, 25 bp, Artificial sequence
  Synthetic oligonucleotide
ttagcagcggaataaatcttcaaaa

SEQ ID NO: 693848 - DNA, 25 bp, Artificial sequence
  Synthetic oligonucleotide
cgttctctcgtgggagacgcaggca

SEQ ID NO: 693849 - DNA, 25 bp, Artificial sequence
  Synthetic oligonucleotide
tggagagattcatattcatttgtat

SEQ ID NO: 693850 - DNA, 25 bp, Artificial sequence
  Synthetic oligonucleotide
ggttttgacattgcggaaatttgga

SEQ ID NO: 693851 - DNA, 25 bp, Artificial sequence
  Synthetic oligonucleotide
aatcttggaggacgtttcggcattc

SEQ ID NO: 693852 - DNA, 25 bp, Artificial sequence
  Synthetic oligonucleotide
gatgatgaaccgcttcatgccactg

SEQ ID NO: 693853 - DNA, 25 bp, Artificial sequence
  Synthetic oligonucleotide
gatgatgaaccggttcatgccactg

SEQ ID NO: 693854 - DNA, 25 bp, Artificial sequence
  Synthetic oligonucleotide
aaaattatcgaagctgtgaaagaaa

SEQ ID NO: 693855 - DNA, 25 bp, Artificial sequence
  Synthetic oligonucleotide
aaaattatcgaacctgtgaaagaaa

SEQ ID NO: 693856 - DNA, 25 bp, Artificial sequence
  Synthetic oligonucleotide
gcttatggatactgcatggccaaca

SEQ ID NO: 693857 - DNA, 25 bp, Artificial sequence
  Synthetic oligonucleotide
tggagagattcaaattcatttgtat

SEQ ID NO: 693858 - DNA, 25 bp, Artificial sequence
  Synthetic oligonucleotide
tttcgatgtcaggtttattatcagg

SEQ ID NO: 693859 - DNA, 25 bp, Artificial sequence
  Synthetic oligonucleotide
aaagaaggcgatcttcttgccgttt

SEQ ID NO: 693860 - DNA, 25 bp, Artificial sequence
  Synthetic oligonucleotide
atgtcgtgacaagctcttggttggc

SEQ ID NO: 693861 - DNA, 25 bp, Artificial sequence
  Synthetic oligonucleotide
atgtcgtgacaacctcttggttggc

SEQ ID NO: 693862 - DNA, 25 bp, Artificial sequence
  Synthetic oligonucleotide
ccgcattttcgttaccgattttgtc

SEQ ID NO: 693863 - DNA, 25 bp, Artificial sequence
  Synthetic oligonucleotide
ccgcattttcgtaaccgattttgtc

SEQ ID NO: 693864 - DNA, 25 bp, Artificial sequence
  Synthetic oligonucleotide
tagcaaactcttgtttgatttttgc

SEQ ID NO: 693865 - DNA, 25 bp, Artificial sequence
  Synthetic oligonucleotide
cccagtcaatgtgagcgtttttcat

SEQ ID NO: 693866 - DNA, 25 bp, Artificial sequence
  Synthetic oligonucleotide
tttcgatgtcagctttattatcagg

SEQ ID NO: 693867 - DNA, 25 bp, Artificial sequence
  Synthetic oligonucleotide
cccagtcaatgtcagcgtttttcat

SEQ ID NO: 693868 - DNA, 25 bp, Artificial sequence
  Synthetic oligonucleotide
tgacgtttaaatcagaagctgcgtc

SEQ ID NO: 693869 - DNA, 25 bp, Artificial sequence
  Synthetic oligonucleotide
tgacgtttaaatgagaagctgcgtc

SEQ ID NO: 693870 - DNA, 25 bp, Artificial sequence
  Synthetic oligonucleotide
gggagacaagctgattcttttggct

SEQ ID NO: 693871 - DNA, 25 bp, Artificial sequence
  Synthetic oligonucleotide
gggagacaagctcattcttttggct

SEQ ID NO: 693872 - DNA, 25 bp, Artificial sequence
  Synthetic oligonucleotide
ttatttcttccgttctggtttctct

SEQ ID NO: 693873 - DNA, 25 bp, Artificial sequence
  Synthetic oligonucleotide
aagagcagggaagaactgcggatgg

SEQ ID NO: 693874 - DNA, 25 bp, Artificial sequence
  Synthetic oligonucleotide
tagcaaactcttctttgatttttgc

SEQ ID NO: 693875 - DNA, 25 bp, Artificial sequence
  Synthetic oligonucleotide
tttcttatttgattatagatacaat

SEQ ID NO: 693876 - DNA, 25 bp, Artificial sequence
  Synthetic oligonucleotide
gtaaagcaataaaagaaacgccgat

SEQ ID NO: 693877 - DNA, 25 bp, Artificial sequence
  Synthetic oligonucleotide
attccgagaccccccgttgtatttg

SEQ ID NO: 693878 - DNA, 25 bp, Artificial sequence
  Synthetic oligonucleotide
attccgagacccgccgttgtatttg

SEQ ID NO: 693879 - DNA, 25 bp, Artificial sequence
  Synthetic oligonucleotide
gaggctcatttagtcgtgaagcgag

SEQ ID NO: 693880 - DNA, 25 bp, Artificial sequence
  Synthetic oligonucleotide
gaggctcatttactcgtgaagcgag

SEQ ID NO: 693881 - DNA, 25 bp, Artificial sequence
  Synthetic oligonucleotide
gatattgtaaaagttgatctgccat

SEQ ID NO: 693882 - DNA, 25 bp, Artificial sequence
  Synthetic oligonucleotide
catcctccgagatcgcttcgtcaga

SEQ ID NO: 693883 - DNA, 25 bp, Artificial sequence
  Synthetic oligonucleotide
gtaaagcaataatagaaacgccgat

SEQ ID NO: 693884 - DNA, 25 bp, Artificial sequence
  Synthetic oligonucleotide
gcttatggatacagcatggccaaca

SEQ ID NO: 693885 - DNA, 25 bp, Artificial sequence
  Synthetic oligonucleotide
tagatacgaagatatcaatgacttt

SEQ ID NO: 693886 - DNA, 25 bp, Artificial sequence
  Synthetic oligonucleotide
tagatacgaagaaatcaatgacttt

SEQ ID NO: 693887 - DNA, 25 bp, Artificial sequence
  Synthetic oligonucleotide
ttttgccttcatgtgattctatgaa

SEQ ID NO: 693888 - DNA, 25 bp, Artificial sequence
  Synthetic oligonucleotide
ttttgccttcatctgattctatgaa

SEQ ID NO: 693889 - DNA, 25 bp, Artificial sequence
  Synthetic oligonucleotide
tatctttcgcttaatctagctggtc

SEQ ID NO: 693890 - DNA, 25 bp, Artificial sequence
  Synthetic oligonucleotide
tatctttcgctttatctagctggtc

SEQ ID NO: 693891 - DNA, 25 bp, Artificial sequence
  Synthetic oligonucleotide
gatattgtaaaacttgatctgccat

SEQ ID NO: 693892 - DNA, 25 bp, Artificial sequence
  Synthetic oligonucleotide
gcgctgtggcagcttcttgtccgca

SEQ ID NO: 693893 - DNA, 25 bp, Artificial sequence
  Synthetic oligonucleotide
gagccgtcttgtcctcatgatactc

SEQ ID NO: 693894 - DNA, 25 bp, Artificial sequence
  Synthetic oligonucleotide
tcatataaaagggctcgtcatcgga

SEQ ID NO: 693895 - DNA, 25 bp, Artificial sequence
  Synthetic oligonucleotide
tcatataaaaggcctcgtcatcgga

SEQ ID NO: 693896 - DNA, 25 bp, Artificial sequence
  Synthetic oligonucleotide
aattatgccatggcaagcatcaaat

SEQ ID NO: 693897 - DNA, 25 bp, Artificial sequence
  Synthetic oligonucleotide
aattatgccatgccaagcatcaaat

SEQ ID NO: 693898 - DNA, 25 bp, Artificial sequence
  Synthetic oligonucleotide
tgaaactgactgaagagtatgataa

SEQ ID NO: 693899 - DNA, 25 bp, Artificial sequence
  Synthetic oligonucleotide
ccgtacttatgggcgctgattccct

SEQ ID NO: 693900 - DNA, 25 bp, Artificial sequence
  Synthetic oligonucleotide
attctgtacgtctcacttgcggcga

SEQ ID NO: 693901 - DNA, 25 bp, Artificial sequence
  Synthetic oligonucleotide
gcgctgtggcaggttcttgtccgca

SEQ ID NO: 693902 - DNA, 25 bp, Artificial sequence
  Synthetic oligonucleotide
ggcgcaaaagtatgacccagcatcg

SEQ ID NO: 693903 - DNA, 25 bp, Artificial sequence
  Synthetic oligonucleotide
ggcgcaaaagtaagacccagcatcg

SEQ ID NO: 693904 - DNA, 25 bp, Artificial sequence
  Synthetic oligonucleotide
aatcgcttaaggcagcctaccaatt

SEQ ID NO: 693905 - DNA, 25 bp, Artificial sequence
  Synthetic oligonucleotide
aatcgcttaagggagcctaccaatt

SEQ ID NO: 693906 - DNA, 25 bp, Artificial sequence
  Synthetic oligonucleotide
tgaaactgactgtagagtatgataa

SEQ ID NO: 693907 - DNA, 25 bp, Artificial sequence
  Synthetic oligonucleotide
ccgtacttatggccgctgattccct

SEQ ID NO: 693908 - DNA, 25 bp, Artificial sequence
  Synthetic oligonucleotide
atggctgccattcacacaccgacgg

SEQ ID NO: 693909 - DNA, 25 bp, Artificial sequence
  Synthetic oligonucleotide
ttaaataaagatacgcatatcccga

SEQ ID NO: 693910 - DNA, 25 bp, Artificial sequence
  Synthetic oligonucleotide
cctgatctgctcccggacaacatga

SEQ ID NO: 693911 - DNA, 25 bp, Artificial sequence
  Synthetic oligonucleotide
cctgatctgctcgcggacaacatga

SEQ ID NO: 693912 - DNA, 25 bp, Artificial sequence
  Synthetic oligonucleotide
tttcttatttgaatatagatacaat

SEQ ID NO: 693913 - DNA, 25 bp, Artificial sequence
  Synthetic oligonucleotide
ggacaaactgaaggggccattgaac

SEQ ID NO: 693914 - DNA, 25 bp, Artificial sequence
  Synthetic oligonucleotide
ttaaataaagattcgcatatcccga

SEQ ID NO: 693915 - DNA, 25 bp, Artificial sequence
  Synthetic oligonucleotide
gagccgtcttgtgctcatgatactc

SEQ ID NO: 693916 - DNA, 25 bp, Artificial sequence
  Synthetic oligonucleotide
atatttttagctcacttaggaatcg

SEQ ID NO: 693917 - DNA, 25 bp, Artificial sequence
  Synthetic oligonucleotide
acgacgcctagttatgaattaagct

SEQ ID NO: 693918 - DNA, 25 bp, Artificial sequence
  Synthetic oligonucleotide
atggctgccattgacacaccgacgg

SEQ ID NO: 693919 - DNA, 25 bp, Artificial sequence
  Synthetic oligonucleotide
gcaatgggtttatttgccgctgttc

SEQ ID NO: 693920 - DNA, 25 bp, Artificial sequence
  Synthetic oligonucleotide
gcaatgggtttaattgccgctgttc

SEQ ID NO: 693921 - DNA, 25 bp, Artificial sequence
  Synthetic oligonucleotide
attgcgattgaggtcgggctttttt

SEQ ID NO: 693922 - DNA, 25 bp, Artificial sequence
  Synthetic oligonucleotide
attgcgattgagctcgggctttttt

SEQ ID NO: 693923 - DNA, 25 bp, Artificial sequence
  Synthetic oligonucleotide
acgacgcctagtaatgaattaagct

SEQ ID NO: 693924 - DNA, 25 bp, Artificial sequence
  Synthetic oligonucleotide
atatttttagctgacttaggaatcg

SEQ ID NO: 693925 - DNA, 25 bp, Artificial sequence
  Synthetic oligonucleotide
cactccatcgatcttcttcttcgga

SEQ ID NO: 693926 - DNA, 25 bp, Artificial sequence
  Synthetic oligonucleotide
ctcgctgaggaacagggactttctt

SEQ ID NO: 693927 - DNA, 25 bp, Artificial sequence
  Synthetic oligonucleotide
tccggaggagagctatatacggctg

SEQ ID NO: 693928 - DNA, 25 bp, Artificial sequence
  Synthetic oligonucleotide
tccggaggagaggtatatacggctg

SEQ ID NO: 693929 - DNA, 25 bp, Artificial sequence
  Synthetic oligonucleotide
tttccggcagaacgcatccactttc

SEQ ID NO: 693930 - DNA, 25 bp, Artificial sequence
  Synthetic oligonucleotide
aagagcagggaacaactgcggatgg

SEQ ID NO: 693931 - DNA, 25 bp, Artificial sequence
  Synthetic oligonucleotide
catcctccgagaacgcttcgtcaga

SEQ ID NO: 693932 - DNA, 25 bp, Artificial sequence
  Synthetic oligonucleotide
ctcgctgaggaagagggactttctt

SEQ ID NO: 693933 - DNA, 25 bp, Artificial sequence
  Synthetic oligonucleotide
atcgcgcttcttgaagacctatgta

SEQ ID NO: 693934 - DNA, 25 bp, Artificial sequence
  Synthetic oligonucleotide
tttccggcagaaggcatccactttc

SEQ ID NO: 693935 - DNA, 25 bp, Artificial sequence
  Synthetic oligonucleotide
caggaagattcatagtttggtttcg

SEQ ID NO: 693936 - DNA, 25 bp, Artificial sequence
  Synthetic oligonucleotide
caggaagattcaaagtttggtttcg

SEQ ID NO: 693937 - DNA, 25 bp, Artificial sequence
  Synthetic oligonucleotide
gtagaagcgcattcgcatgactaca

SEQ ID NO: 693938 - DNA, 25 bp, Artificial sequence
  Synthetic oligonucleotide
attatgaagggacagtccataaaac

SEQ ID NO: 693939 - DNA, 25 bp, Artificial sequence
  Synthetic oligonucleotide
attctgtacgtcacacttgcggcga

SEQ ID NO: 693940 - DNA, 25 bp, Artificial sequence
  Synthetic oligonucleotide
cactccatcgatgttcttcttcgga

SEQ ID NO: 693941 - DNA, 25 bp, Artificial sequence
  Synthetic oligonucleotide
gtagaagcgcatacgcatgactaca

SEQ ID NO: 693942 - DNA, 25 bp, Artificial sequence
  Synthetic oligonucleotide
atcgcgcttcttcaagacctatgta

SEQ ID NO: 693943 - DNA, 25 bp, Artificial sequence
  Synthetic oligonucleotide
gaaatcggaggtctggatgctctct

SEQ ID NO: 693944 - DNA, 25 bp, Artificial sequence
  Synthetic oligonucleotide
attatgaagggagagtccataaaac

SEQ ID NO: 693945 - DNA, 25 bp, Artificial sequence
  Synthetic oligonucleotide
ccataagcggagtaagagggaatga

SEQ ID NO: 693946 - DNA, 25 bp, Artificial sequence
  Synthetic oligonucleotide
ccataagcggagaaagagggaatga

SEQ ID NO: 693947 - DNA, 25 bp, Artificial sequence
  Synthetic oligonucleotide
cacggcacaagctgacaaaatcaac

SEQ ID NO: 693948 - DNA, 25 bp, Artificial sequence
  Synthetic oligonucleotide
cgcatcggctgcattgtggtggata

SEQ ID NO: 693949 - DNA, 25 bp, Artificial sequence
  Synthetic oligonucleotide
cacggcacaagcagacaaaatcaac

SEQ ID NO: 693950 - DNA, 25 bp, Artificial sequence
  Synthetic oligonucleotide
gcgagcaaagcattctcatcagtcg

SEQ ID NO: 693951 - DNA, 25 bp, Artificial sequence
  Synthetic oligonucleotide
gaaatcggaggtgtggatgctctct

SEQ ID NO: 693952 - DNA, 25 bp, Artificial sequence
  Synthetic oligonucleotide
aaatatggtacacctctttacgtat

SEQ ID NO: 693953 - DNA, 25 bp, Artificial sequence
  Synthetic oligonucleotide
aaatatggtacagctctttacgtat

SEQ ID NO: 693954 - DNA, 25 bp, Artificial sequence
  Synthetic oligonucleotide
ttaatacgtgagggtgctaaaagct

SEQ ID NO: 693955 - DNA, 25 bp, Artificial sequence
  Synthetic oligonucleotide
ttaatacgtgagcgtgctaaaagct

SEQ ID NO: 693956 - DNA, 25 bp, Artificial sequence
  Synthetic oligonucleotide
tttatttctgcacggctgaaagcac

SEQ ID NO: 693957 - DNA, 25 bp, Artificial sequence
  Synthetic oligonucleotide
tttatttctgcagggctgaaagcac

SEQ ID NO: 693958 - DNA, 25 bp, Artificial sequence
  Synthetic oligonucleotide
gcgagcaaagcaatctcatcagtcg

SEQ ID NO: 693959 - DNA, 25 bp, Artificial sequence
  Synthetic oligonucleotide
gttacaaggtgatcctcgaagcggc

SEQ ID NO: 693960 - DNA, 25 bp, Artificial sequence
  Synthetic oligonucleotide
actcgatggataatcaacgacaata

SEQ ID NO: 693961 - DNA, 25 bp, Artificial sequence
  Synthetic oligonucleotide
tgagccgcgagttggcgaagtatgt

SEQ ID NO: 693962 - DNA, 25 bp, Artificial sequence
  Synthetic oligonucleotide
cagccatgagccgcgagttggcgaa

SEQ ID NO: 693963 - DNA, 25 bp, Artificial sequence
  Synthetic oligonucleotide
tgtagcagccatgagccgcgagttg

SEQ ID NO: 693964 - DNA, 25 bp, Artificial sequence
  Synthetic oligonucleotide
agtgtctgtagcagccatgagccgc

SEQ ID NO: 693965 - DNA, 25 bp, Artificial sequence
  Synthetic oligonucleotide
cctggaagtgtctgtagcagccatg

SEQ ID NO: 693966 - DNA, 25 bp, Artificial sequence
  Synthetic oligonucleotide
caaggacctggaagtgtctgtagca

SEQ ID NO: 693967 - DNA, 25 bp, Artificial sequence
  Synthetic oligonucleotide
gtacgacaaggacctggaagtgtct

SEQ ID NO: 693968 - DNA, 25 bp, Artificial sequence
  Synthetic oligonucleotide
ggacatgtacgacaaggacctggaa

SEQ ID NO: 693969 - DNA, 25 bp, Artificial sequence
  Synthetic oligonucleotide
tccggcggacatgtacgacaaggac

SEQ ID NO: 693970 - DNA, 25 bp, Artificial sequence
  Synthetic oligonucleotide
agcggctccggcggacatgtacgac

SEQ ID NO: 693971 - DNA, 25 bp, Artificial sequence
  Synthetic oligonucleotide
ggcgaagtatgtacgagcctatccc

SEQ ID NO: 693972 - DNA, 25 bp, Artificial sequence
  Synthetic oligonucleotide
aggtgatcctcgaagcggctccggc

SEQ ID NO: 693973 - DNA, 25 bp, Artificial sequence
  Synthetic oligonucleotide
gtatgtacgagcctatcccagccag

SEQ ID NO: 693974 - DNA, 25 bp, Artificial sequence
  Synthetic oligonucleotide
gtagcggttacaaggtgatcctcga

SEQ ID NO: 693975 - DNA, 25 bp, Artificial sequence
  Synthetic oligonucleotide
ccgatggtagcggttacaaggtgat

SEQ ID NO: 693976 - DNA, 25 bp, Artificial sequence
  Synthetic oligonucleotide
gcctgcccgatggtagcggttacaa

SEQ ID NO: 693977 - DNA, 25 bp, Artificial sequence
  Synthetic oligonucleotide
cggtgcgcctgcccgatggtagcgg

SEQ ID NO: 693978 - DNA, 25 bp, Artificial sequence
  Synthetic oligonucleotide
tccatgcggtgcgcctgcccgatgg

SEQ ID NO: 693979 - DNA, 25 bp, Artificial sequence
  Synthetic oligonucleotide
gtgttcttccatgcggtgcgcctgc

SEQ ID NO: 693980 - DNA, 25 bp, Artificial sequence
  Synthetic oligonucleotide
cgtggagtgttcttccatgcggtgc

SEQ ID NO: 693981 - DNA, 25 bp, Artificial sequence
  Synthetic oligonucleotide
aggcgcgtggagtgttcttccatgc

SEQ ID NO: 693982 - DNA, 25 bp, Artificial sequence
  Synthetic oligonucleotide
cggcaaggcgcgtggagtgttcttc

SEQ ID NO: 693983 - DNA, 25 bp, Artificial sequence
  Synthetic oligonucleotide
ttcacgcggcaaggcgcgtggagtg

SEQ ID NO: 693984 - DNA, 25 bp, Artificial sequence
  Synthetic oligonucleotide
ttgctttcacgcggcaaggcgcgtg

SEQ ID NO: 693985 - DNA, 25 bp, Artificial sequence
  Synthetic oligonucleotide
tcctcgaagcggctccggcggacat

SEQ ID NO: 693986 - DNA, 25 bp, Artificial sequence
  Synthetic oligonucleotide
aaatggtattgaggaaagggcgtcg

SEQ ID NO: 693987 - DNA, 25 bp, Artificial sequence
  Synthetic oligonucleotide
ggtcgaaggcatggaggtgctggag

SEQ ID NO: 693988 - DNA, 25 bp, Artificial sequence
  Synthetic oligonucleotide
aggtcccgagggactcgatggataa

SEQ ID NO: 693989 - DNA, 25 bp, Artificial sequence
  Synthetic oligonucleotide
ctccgcaggtcccgagggactcgat

SEQ ID NO: 693990 - DNA, 25 bp, Artificial sequence
  Synthetic oligonucleotide
ccgcctcctccgcaggtcccgaggg

SEQ ID NO: 693991 - DNA, 25 bp, Artificial sequence
  Synthetic oligonucleotide
agctctgccgcctcctccgcaggtc

SEQ ID NO: 693992 - DNA, 25 bp, Artificial sequence
  Synthetic oligonucleotide
atgctcagctctgccgcctcctccg

SEQ ID NO: 693993 - DNA, 25 bp, Artificial sequence
  Synthetic oligonucleotide
ggtactatgctcagctctgccgcct

SEQ ID NO: 693994 - DNA, 25 bp, Artificial sequence
  Synthetic oligonucleotide
atccgggtactatgctcagctctgc

SEQ ID NO: 693995 - DNA, 25 bp, Artificial sequence
  Synthetic oligonucleotide
tttcatatccgggtactatgctcag

SEQ ID NO: 693996 - DNA, 25 bp, Artificial sequence
  Synthetic oligonucleotide
cgcctttttcatatccgggtactat

SEQ ID NO: 693997 - DNA, 25 bp, Artificial sequence
  Synthetic oligonucleotide
cggaagacgcctttttcatatccgg

SEQ ID NO: 693998 - DNA, 25 bp, Artificial sequence
  Synthetic oligonucleotide
cgagttggcgaagtatgtacgagcc

SEQ ID NO: 693999 - DNA, 25 bp, Artificial sequence
  Synthetic oligonucleotide
tattgaggaaagggcgtcggaagac

SEQ ID NO: 694000 - DNA, 25 bp, Artificial sequence
  Synthetic oligonucleotide
gcaagttcgtcccgcagttgctttc

SEQ ID NO: 694001 - DNA, 25 bp, Artificial sequence
  Synthetic oligonucleotide
gcgagaaaaaatggtattgaggaaa

SEQ ID NO: 694002 - DNA, 25 bp, Artificial sequence
  Synthetic oligonucleotide
cggatggcgagaaaaaatggtattg

SEQ ID NO: 694003 - DNA, 25 bp, Artificial sequence
  Synthetic oligonucleotide
accgcccggatggcgagaaaaaatg

SEQ ID NO: 694004 - DNA, 25 bp, Artificial sequence
  Synthetic oligonucleotide
caagaaccgcccggatggcgagaaa

SEQ ID NO: 694005 - DNA, 25 bp, Artificial sequence
  Synthetic oligonucleotide
gcgcttcaagaaccgcccggatggc

SEQ ID NO: 694006 - DNA, 25 bp, Artificial sequence
  Synthetic oligonucleotide
catgaagcgcttcaagaaccgcccg

SEQ ID NO: 694007 - DNA, 25 bp, Artificial sequence
  Synthetic oligonucleotide
gtggagcatgaagcgcttcaagaac

SEQ ID NO: 694008 - DNA, 25 bp, Artificial sequence
  Synthetic oligonucleotide
gtacatgtggagcatgaagcgcttc

SEQ ID NO: 694009 - DNA, 25 bp, Artificial sequence
  Synthetic oligonucleotide
cagccagtacatgtggagcatgaag

SEQ ID NO: 694010 - DNA, 25 bp, Artificial sequence
  Synthetic oligonucleotide
ctatcccagccagtacatgtggagc

SEQ ID NO: 694011 - DNA, 25 bp, Artificial sequence
  Synthetic oligonucleotide
acgagcctatcccagccagtacatg

SEQ ID NO: 694012 - DNA, 25 bp, Artificial sequence
  Synthetic oligonucleotide
ggcgtcggaagacgcctttttcata

SEQ ID NO: 694013 - DNA, 25 bp, Artificial sequence
  Synthetic oligonucleotide
tgggaaactgggaagtactcaacca

SEQ ID NO: 694014 - DNA, 25 bp, Artificial sequence
  Synthetic oligonucleotide
ggcagtggacgagttgctgaagaag

SEQ ID NO: 694015 - DNA, 25 bp, Artificial sequence
  Synthetic oligonucleotide
gctgaaggcagtggacgagttgctg

SEQ ID NO: 694016 - DNA, 25 bp, Artificial sequence
  Synthetic oligonucleotide
gcccaagctgaaggcagtggacgag

SEQ ID NO: 694017 - DNA, 25 bp, Artificial sequence
  Synthetic oligonucleotide
tcgtccgcccaagctgaaggcagtg

SEQ ID NO: 694018 - DNA, 25 bp, Artificial sequence
  Synthetic oligonucleotide
ttctatcgtccgcccaagctgaagg

SEQ ID NO: 694019 - DNA, 25 bp, Artificial sequence
  Synthetic oligonucleotide
gatcatcttctatcgtccgcccaag

SEQ ID NO: 694020 - DNA, 25 bp, Artificial sequence
  Synthetic oligonucleotide
caagccgatcatcttctatcgtccg

SEQ ID NO: 694021 - DNA, 25 bp, Artificial sequence
  Synthetic oligonucleotide
cctacgccaagccgatcatcttcta

SEQ ID NO: 694022 - DNA, 25 bp, Artificial sequence
  Synthetic oligonucleotide
attgctcctacgccaagccgatcat

SEQ ID NO: 694023 - DNA, 25 bp, Artificial sequence
  Synthetic oligonucleotide
acttctattgctcctacgccaagcc

SEQ ID NO: 694024 - DNA, 25 bp, Artificial sequence
  Synthetic oligonucleotide
tcaaccacttctattgctcctacgc

SEQ ID NO: 694025 - DNA, 25 bp, Artificial sequence
  Synthetic oligonucleotide
cgcagttgctttcacgcggcaaggc

SEQ ID NO: 694026 - DNA, 25 bp, Artificial sequence
  Synthetic oligonucleotide
actgggaagtactcaaccacttcta

SEQ ID NO: 694027 - DNA, 25 bp, Artificial sequence
  Synthetic oligonucleotide
aagaagcaacgcgtgcaattgggca

SEQ ID NO: 694028 - DNA, 25 bp, Artificial sequence
  Synthetic oligonucleotide
tcacctgggaaactgggaagtactc

SEQ ID NO: 694029 - DNA, 25 bp, Artificial sequence
  Synthetic oligonucleotide
taccagtcacctgggaaactgggaa

SEQ ID NO: 694030 - DNA, 25 bp, Artificial sequence
  Synthetic oligonucleotide
ggcattaccagtcacctgggaaact

SEQ ID NO: 694031 - DNA, 25 bp, Artificial sequence
  Synthetic oligonucleotide
ctggtcggcattaccagtcacctgg

SEQ ID NO: 694032 - DNA, 25 bp, Artificial sequence
  Synthetic oligonucleotide
gatggcctggtcggcattaccagtc

SEQ ID NO: 694033 - DNA, 25 bp, Artificial sequence
  Synthetic oligonucleotide
tccggcgatggcctggtcggcatta

SEQ ID NO: 694034 - DNA, 25 bp, Artificial sequence
  Synthetic oligonucleotide
ctggcttccggcgatggcctggtcg

SEQ ID NO: 694035 - DNA, 25 bp, Artificial sequence
  Synthetic oligonucleotide
ggaagcgctggcttccggcgatggc

SEQ ID NO: 694036 - DNA, 25 bp, Artificial sequence
  Synthetic oligonucleotide
gctggaggaagcgctggcttccggc

SEQ ID NO: 694037 - DNA, 25 bp, Artificial sequence
  Synthetic oligonucleotide
ggaggtgctggaggaagcgctggct

SEQ ID NO: 694038 - DNA, 25 bp, Artificial sequence
  Synthetic oligonucleotide
aggaccacctgaaactggtagtagt

SEQ ID NO: 694039 - DNA, 25 bp, Artificial sequence
  Synthetic oligonucleotide
aagtactcaaccacttctattgctc

SEQ ID NO: 694040 - DNA, 25 bp, Artificial sequence
  Synthetic oligonucleotide
gaagtgaagaaaggcggttgcgtag

SEQ ID NO: 694041 - DNA, 25 bp, Artificial sequence
  Synthetic oligonucleotide
tggataatcaacgacaatacccacg

SEQ ID NO: 694042 - DNA, 25 bp, Artificial sequence
  Synthetic oligonucleotide
tgatcagcaagttcgtcccgcagtt

SEQ ID NO: 694043 - DNA, 25 bp, Artificial sequence
  Synthetic oligonucleotide
ctgcattgatcagcaagttcgtccc

SEQ ID NO: 694044 - DNA, 25 bp, Artificial sequence
  Synthetic oligonucleotide
gcaccactgcattgatcagcaagtt

SEQ ID NO: 694045 - DNA, 25 bp, Artificial sequence
  Synthetic oligonucleotide
acctgggcaccactgcattgatcag

SEQ ID NO: 694046 - DNA, 25 bp, Artificial sequence
  Synthetic oligonucleotide
tgccctacctgggcaccactgcatt

SEQ ID NO: 694047 - DNA, 25 bp, Artificial sequence
  Synthetic oligonucleotide
tcttcgtgccctacctgggcaccac

SEQ ID NO: 694048 - DNA, 25 bp, Artificial sequence
  Synthetic oligonucleotide
ctgggctcttcgtgccctacctggg

SEQ ID NO: 694049 - DNA, 25 bp, Artificial sequence
  Synthetic oligonucleotide
gtaccgctgggctcttcgtgcccta

SEQ ID NO: 694050 - DNA, 25 bp, Artificial sequence
  Synthetic oligonucleotide
cgcgcgtaccgctgggctcttcgtg

SEQ ID NO: 694051 - DNA, 25 bp, Artificial sequence
  Synthetic oligonucleotide
cgagcccgcgcgtaccgctgggctc

SEQ ID NO: 694052 - DNA, 25 bp, Artificial sequence
  Synthetic oligonucleotide
ggacgagttgctgaagaagcaacgc

SEQ ID NO: 694053 - DNA, 25 bp, Artificial sequence
  Synthetic oligonucleotide
gcggttgcgtagggattcccgccga

SEQ ID NO: 694054 - DNA, 25 bp, Artificial sequence
  Synthetic oligonucleotide
gttgctgaagaagcaacgcgtgcaa

SEQ ID NO: 694055 - DNA, 25 bp, Artificial sequence
  Synthetic oligonucleotide
atcaaggaagtgaagaaaggcggtt

SEQ ID NO: 694056 - DNA, 25 bp, Artificial sequence
  Synthetic oligonucleotide
agtgtcatcaaggaagtgaagaaag

SEQ ID NO: 694057 - DNA, 25 bp, Artificial sequence
  Synthetic oligonucleotide
atcctcagtgtcatcaaggaagtga

SEQ ID NO: 694058 - DNA, 25 bp, Artificial sequence
  Synthetic oligonucleotide
gagggtatcctcagtgtcatcaagg

SEQ ID NO: 694059 - DNA, 25 bp, Artificial sequence
  Synthetic oligonucleotide
actccggagggtatcctcagtgtca

SEQ ID NO: 694060 - DNA, 25 bp, Artificial sequence
  Synthetic oligonucleotide
ccttccactccggagggtatcctca

SEQ ID NO: 694061 - DNA, 25 bp, Artificial sequence
  Synthetic oligonucleotide
gtcgcaccttccactccggagggta

SEQ ID NO: 694062 - DNA, 25 bp, Artificial sequence
  Synthetic oligonucleotide
aatcgcgtcgcaccttccactccgg

SEQ ID NO: 694063 - DNA, 25 bp, Artificial sequence
  Synthetic oligonucleotide
ttgggcaatcgcgtcgcaccttcca

SEQ ID NO: 694064 - DNA, 25 bp, Artificial sequence
  Synthetic oligonucleotide
gtgcaattgggcaatcgcgtcgcac

SEQ ID NO: 694065 - DNA, 25 bp, Artificial sequence
  Synthetic oligonucleotide
caacgcgtgcaattgggcaatcgcg

SEQ ID NO: 694066 - DNA, 25 bp, Artificial sequence
  Synthetic oligonucleotide
tcgtcccgcagttgctttcacgcgg

SEQ ID NO: 694067 - DNA, 25 bp, Artificial sequence
  Synthetic oligonucleotide
cgaccccgagcccgcgcgtaccgct

SEQ ID NO: 694068 - DNA, 25 bp, Artificial sequence
  Synthetic oligonucleotide
gcacatgtcagcctcttctccggcg

SEQ ID NO: 694069 - DNA, 25 bp, Artificial sequence
  Synthetic oligonucleotide
cgagggactcgatggataatcaacg

SEQ ID NO: 694070 - DNA, 25 bp, Artificial sequence
  Synthetic oligonucleotide
catcatcgccagcaactacctggtg

SEQ ID NO: 694071 - DNA, 25 bp, Artificial sequence
  Synthetic oligonucleotide
tcttcatcatcatcgccagcaacta

SEQ ID NO: 694072 - DNA, 25 bp, Artificial sequence
  Synthetic oligonucleotide
tccacatcttcatcatcatcgccag

SEQ ID NO: 694073 - DNA, 25 bp, Artificial sequence
  Synthetic oligonucleotide
tcgccttccacatcttcatcatcat

SEQ ID NO: 694074 - DNA, 25 bp, Artificial sequence
  Synthetic oligonucleotide
gcctgatcgccttccacatcttcat

SEQ ID NO: 694075 - DNA, 25 bp, Artificial sequence
  Synthetic oligonucleotide
tggccggcctgatcgccttccacat

SEQ ID NO: 694076 - DNA, 25 bp, Artificial sequence
  Synthetic oligonucleotide
gcaccctggccggcctgatcgcctt

SEQ ID NO: 694077 - DNA, 25 bp, Artificial sequence
  Synthetic oligonucleotide
ggcgcggcaccctggccggcctgat

SEQ ID NO: 694078 - DNA, 25 bp, Artificial sequence
  Synthetic oligonucleotide
cggcctggcgcggcaccctggccgg

SEQ ID NO: 694079 - DNA, 25 bp, Artificial sequence
  Synthetic oligonucleotide
ctccggcggcctggcgcggcaccct

SEQ ID NO: 694080 - DNA, 25 bp, Artificial sequence
  Synthetic oligonucleotide
caactacctggtgcagttgccgatc

SEQ ID NO: 694081 - DNA, 25 bp, Artificial sequence
  Synthetic oligonucleotide
gtcagcctcttctccggcggcctgg

SEQ ID NO: 694082 - DNA, 25 bp, Artificial sequence
  Synthetic oligonucleotide
cctggtgcagttgccgatcaccctg

SEQ ID NO: 694083 - DNA, 25 bp, Artificial sequence
  Synthetic oligonucleotide
aggacagcacatgtcagcctcttct

SEQ ID NO: 694084 - DNA, 25 bp, Artificial sequence
  Synthetic oligonucleotide
gcaaaaaggacagcacatgtcagcc

SEQ ID NO: 694085 - DNA, 25 bp, Artificial sequence
  Synthetic oligonucleotide
catcgcgcaaaaaggacagcacatg

SEQ ID NO: 694086 - DNA, 25 bp, Artificial sequence
  Synthetic oligonucleotide
tcaccccatcgcgcaaaaaggacag

SEQ ID NO: 694087 - DNA, 25 bp, Artificial sequence
  Synthetic oligonucleotide
gttccctcaccccatcgcgcaaaaa

SEQ ID NO: 694088 - DNA, 25 bp, Artificial sequence
  Synthetic oligonucleotide
ggcatgggttccctcaccccatcgc

SEQ ID NO: 694089 - DNA, 25 bp, Artificial sequence
  Synthetic oligonucleotide
tgccgggcatgggttccctcacccc

SEQ ID NO: 694090 - DNA, 25 bp, Artificial sequence
  Synthetic oligonucleotide
gcatggtgccgggcatgggttccct

SEQ ID NO: 694091 - DNA, 25 bp, Artificial sequence
  Synthetic oligonucleotide
cgctcggcatggtgccgggcatggg

SEQ ID NO: 694092 - DNA, 25 bp, Artificial sequence
  Synthetic oligonucleotide
gcgcgccgctcggcatggtgccggg

SEQ ID NO: 694093 - DNA, 25 bp, Artificial sequence
  Synthetic oligonucleotide
tagaatgcgcgccgctcggcatggt

SEQ ID NO: 694094 - DNA, 25 bp, Artificial sequence
  Synthetic oligonucleotide
ctcttctccggcggcctggcgcggc

SEQ ID NO: 694095 - DNA, 25 bp, Artificial sequence
  Synthetic oligonucleotide
ttcctggctaccgacctcaccgtgc

SEQ ID NO: 694096 - DNA, 25 bp, Artificial sequence
  Synthetic oligonucleotide
cgttgatcgcctcctacgtggtctc

SEQ ID NO: 694097 - DNA, 25 bp, Artificial sequence
  Synthetic oligonucleotide
tcccggcgttgatcgcctcctacgt

SEQ ID NO: 694098 - DNA, 25 bp, Artificial sequence
  Synthetic oligonucleotide
tcatgatcccggcgttgatcgcctc

SEQ ID NO: 694099 - DNA, 25 bp, Artificial sequence
  Synthetic oligonucleotide
cccgggtcatgatcccggcgttgat

SEQ ID NO: 694100 - DNA, 25 bp, Artificial sequence
  Synthetic oligonucleotide
tcatcgcccgggtcatgatcccggc

SEQ ID NO: 694101 - DNA, 25 bp, Artificial sequence
  Synthetic oligonucleotide
ggctggtcatcgcccgggtcatgat

SEQ ID NO: 694102 - DNA, 25 bp, Artificial sequence
  Synthetic oligonucleotide
ctgcccggctggtcatcgcccgggt

SEQ ID NO: 694103 - DNA, 25 bp, Artificial sequence
  Synthetic oligonucleotide
agggccctgcccggctggtcatcgc

SEQ ID NO: 694104 - DNA, 25 bp, Artificial sequence
  Synthetic oligonucleotide
tgggcaagggccctgcccggctggt

SEQ ID NO: 694105 - DNA, 25 bp, Artificial sequence
  Synthetic oligonucleotide
cgcttgctgggcaagggccctgccc

SEQ ID NO: 694106 - DNA, 25 bp, Artificial sequence
  Synthetic oligonucleotide
accgtgcgcttgctgggcaagggcc

SEQ ID NO: 694107 - DNA, 25 bp, Artificial sequence
  Synthetic oligonucleotide
cgccagcaactacctggtgcagttg

SEQ ID NO: 694108 - DNA, 25 bp, Artificial sequence
  Synthetic oligonucleotide
gctaccgacctcaccgtgcgcttgc

SEQ ID NO: 694109 - DNA, 25 bp, Artificial sequence
  Synthetic oligonucleotide
accgctgccggttatcggctagaat

SEQ ID NO: 694110 - DNA, 25 bp, Artificial sequence
  Synthetic oligonucleotide
gttcatcttcctggctaccgacctc

SEQ ID NO: 694111 - DNA, 25 bp, Artificial sequence
  Synthetic oligonucleotide
tttccgttcatcttcctggctaccg

SEQ ID NO: 694112 - DNA, 25 bp, Artificial sequence
  Synthetic oligonucleotide
ttcagctttccgttcatcttcctgg

SEQ ID NO: 694113 - DNA, 25 bp, Artificial sequence
  Synthetic oligonucleotide
ggcgccttcagctttccgttcatct

SEQ ID NO: 694114 - DNA, 25 bp, Artificial sequence
  Synthetic oligonucleotide
acctggggcgccttcagctttccgt

SEQ ID NO: 694115 - DNA, 25 bp, Artificial sequence
  Synthetic oligonucleotide
cacaccacctggggcgccttcagct

SEQ ID NO: 694116 - DNA, 25 bp, Artificial sequence
  Synthetic oligonucleotide
ggctggcacaccacctggggcgcct

SEQ ID NO: 694117 - DNA, 25 bp, Artificial sequence
  Synthetic oligonucleotide
ctgtttggctggcacaccacctggg

SEQ ID NO: 694118 - DNA, 25 bp, Artificial sequence
  Synthetic oligonucleotide
atcaccctgtttggctggcacacca

SEQ ID NO: 694119 - DNA, 25 bp, Artificial sequence
  Synthetic oligonucleotide
tgccgatcaccctgtttggctggca

SEQ ID NO: 694120 - DNA, 25 bp, Artificial sequence
  Synthetic oligonucleotide
tgcagttgccgatcaccctgtttgg

SEQ ID NO: 694121 - DNA, 25 bp, Artificial sequence
  Synthetic oligonucleotide
gacctcaccgtgcgcttgctgggca

SEQ ID NO: 694122 - DNA, 25 bp, Artificial sequence
  Synthetic oligonucleotide
atggcgcagacacgcgacctctccg

SEQ ID NO: 694123 - DNA, 25 bp, Artificial sequence
  Synthetic oligonucleotide
gtcgttactggccaggtacaggatc

SEQ ID NO: 694124 - DNA, 25 bp, Artificial sequence
  Synthetic oligonucleotide
ggcagtgtcgttactggccaggtac

SEQ ID NO: 694125 - DNA, 25 bp, Artificial sequence
  Synthetic oligonucleotide
ccaacaggcagtgtcgttactggcc

SEQ ID NO: 694126 - DNA, 25 bp, Artificial sequence
  Synthetic oligonucleotide
cagctcccaacaggcagtgtcgtta

SEQ ID NO: 694127 - DNA, 25 bp, Artificial sequence
  Synthetic oligonucleotide
tgacccagctcccaacaggcagtgt

SEQ ID NO: 694128 - DNA, 25 bp, Artificial sequence
  Synthetic oligonucleotide
cggatctgacccagctcccaacagg

SEQ ID NO: 694129 - DNA, 25 bp, Artificial sequence
  Synthetic oligonucleotide
aacacccggatctgacccagctccc

SEQ ID NO: 694130 - DNA, 25 bp, Artificial sequence
  Synthetic oligonucleotide
atgtcaaacacccggatctgaccca

SEQ ID NO: 694131 - DNA, 25 bp, Artificial sequence
  Synthetic oligonucleotide
gggtctatgtcaaacacccggatct

SEQ ID NO: 694132 - DNA, 25 bp, Artificial sequence
  Synthetic oligonucleotide
gacaccggggtctatgtcaaacacc

SEQ ID NO: 694133 - DNA, 25 bp, Artificial sequence
  Synthetic oligonucleotide
tctccgacaccggggtctatgtcaa

SEQ ID NO: 694134 - DNA, 25 bp, Artificial sequence
  Synthetic oligonucleotide
atcggctagaatgcgcgccgctcgg

SEQ ID NO: 694135 - DNA, 25 bp, Artificial sequence
  Synthetic oligonucleotide
cagacacgcgacctctccgacaccg

SEQ ID NO: 694136 - DNA, 25 bp, Artificial sequence
  Synthetic oligonucleotide
caggatctgccgatcgacgcgccga

SEQ ID NO: 694137 - DNA, 25 bp, Artificial sequence
  Synthetic oligonucleotide
agctgatggcgcagacacgcgacct

SEQ ID NO: 694138 - DNA, 25 bp, Artificial sequence
  Synthetic oligonucleotide
ttggcgagctgatggcgcagacacg

SEQ ID NO: 694139 - DNA, 25 bp, Artificial sequence
  Synthetic oligonucleotide
cgttatttggcgagctgatggcgca

SEQ ID NO: 694140 - DNA, 25 bp, Artificial sequence
  Synthetic oligonucleotide
tcacccgttatttggcgagctgatg

SEQ ID NO: 694141 - DNA, 25 bp, Artificial sequence
  Synthetic oligonucleotide
tatcagtcacccgttatttggcgag

SEQ ID NO: 694142 - DNA, 25 bp, Artificial sequence
  Synthetic oligonucleotide
aatccgtatcagtcacccgttattt

SEQ ID NO: 694143 - DNA, 25 bp, Artificial sequence
  Synthetic oligonucleotide
gtgccgaatccgtatcagtcacccg

SEQ ID NO: 694144 - DNA, 25 bp, Artificial sequence
  Synthetic oligonucleotide
cgctcaagtgccgaatccgtatcag

SEQ ID NO: 694145 - DNA, 25 bp, Artificial sequence
  Synthetic oligonucleotide
cgaaccccgctcaagtgccgaatcc

SEQ ID NO: 694146 - DNA, 25 bp, Artificial sequence
  Synthetic oligonucleotide
tacccacgaaccccgctcaagtgcc

SEQ ID NO: 694147 - DNA, 25 bp, Artificial sequence
  Synthetic oligonucleotide
cgacaatacccacgaaccccgctca

SEQ ID NO: 694148 - DNA, 25 bp, Artificial sequence
  Synthetic oligonucleotide
cgcgacctctccgacaccggggtct

SEQ ID NO: 694149 - DNA, 25 bp, Artificial sequence
  Synthetic oligonucleotide
tgcgctttctcagcgaagcctgaac

SEQ ID NO: 694150 - DNA, 25 bp, Artificial sequence
  Synthetic oligonucleotide
cgcgaggtcgaaggcatggaggtgc

SEQ ID NO: 694151 - DNA, 25 bp, Artificial sequence
  Synthetic oligonucleotide
ggcgaaaccgctgccggttatcggc

SEQ ID NO: 694152 - DNA, 25 bp, Artificial sequence
  Synthetic oligonucleotide
cagagtgggcgaaaccgctgccggt

SEQ ID NO: 694153 - DNA, 25 bp, Artificial sequence
  Synthetic oligonucleotide
tgatcacagagtgggcgaaaccgct

SEQ ID NO: 694154 - DNA, 25 bp, Artificial sequence
  Synthetic oligonucleotide
agccactgatcacagagtgggcgaa

SEQ ID NO: 694155 - DNA, 25 bp, Artificial sequence
  Synthetic oligonucleotide
ggcatgagccactgatcacagagtg

SEQ ID NO: 694156 - DNA, 25 bp, Artificial sequence
  Synthetic oligonucleotide
aaccccaggcatgagccactgatca

SEQ ID NO: 694157 - DNA, 25 bp, Artificial sequence
  Synthetic oligonucleotide
acgtggaaccccaggcatgagccac

SEQ ID NO: 694158 - DNA, 25 bp, Artificial sequence
  Synthetic oligonucleotide
tgttccacgtggaaccccaggcatg

SEQ ID NO: 694159 - DNA, 25 bp, Artificial sequence
  Synthetic oligonucleotide
cggtgatgttccacgtggaacccca

SEQ ID NO: 694160 - DNA, 25 bp, Artificial sequence
  Synthetic oligonucleotide
gcctgaacggtgatgttccacgtgg

SEQ ID NO: 694161 - DNA, 25 bp, Artificial sequence
  Synthetic oligonucleotide
actggccaggtacaggatctgccga

SEQ ID NO: 694162 - DNA, 25 bp, Artificial sequence
  Synthetic oligonucleotide
tttctcagcgaagcctgaacggtga

SEQ ID NO: 694163 - DNA, 25 bp, Artificial sequence
  Synthetic oligonucleotide
caggtacaggatctgccgatcgacg

SEQ ID NO: 694164 - DNA, 25 bp, Artificial sequence
  Synthetic oligonucleotide
tcggcctgcgctttctcagcgaagc

SEQ ID NO: 694165 - DNA, 25 bp, Artificial sequence
  Synthetic oligonucleotide
aaggcgtcggcctgcgctttctcag

SEQ ID NO: 694166 - DNA, 25 bp, Artificial sequence
  Synthetic oligonucleotide
tgcggaaggcgtcggcctgcgcttt

SEQ ID NO: 694167 - DNA, 25 bp, Artificial sequence
  Synthetic oligonucleotide
agtcgatgcggaaggcgtcggcctg

SEQ ID NO: 694168 - DNA, 25 bp, Artificial sequence
  Synthetic oligonucleotide
cgtgcgagtcgatgcggaaggcgtc

SEQ ID NO: 694169 - DNA, 25 bp, Artificial sequence
  Synthetic oligonucleotide
ggaagtcgtgcgagtcgatgcggaa

SEQ ID NO: 694170 - DNA, 25 bp, Artificial sequence
  Synthetic oligonucleotide
gcagatggaagtcgtgcgagtcgat

SEQ ID NO: 694171 - DNA, 25 bp, Artificial sequence
  Synthetic oligonucleotide
gatcctgcagatggaagtcgtgcga

SEQ ID NO: 694172 - DNA, 25 bp, Artificial sequence
  Synthetic oligonucleotide
cgcgccgatcctgcagatggaagtc

SEQ ID NO: 694173 - DNA, 25 bp, Artificial sequence
  Synthetic oligonucleotide
gatcgacgcgccgatcctgcagatg

SEQ ID NO: 694174 - DNA, 25 bp, Artificial sequence
  Synthetic oligonucleotide
tctgccgatcgacgcgccgatcctg

SEQ ID NO: 694175 - DNA, 25 bp, Artificial sequence
  Synthetic oligonucleotide
ccggttatcggctagaatgcgcgcc

SEQ ID NO: 694176 - DNA, 25 bp, Artificial sequence
  Synthetic oligonucleotide
agcgaagcctgaacggtgatgttcc

SEQ ID NO: 694177 - DNA, 25 bp, Artificial sequence
  Synthetic oligonucleotide
agcgcgatcccgacgcgctgttcga

SEQ ID NO: 694178 - DNA, 25 bp, Artificial sequence
  Synthetic oligonucleotide
ccggctgggttcctctggtccttcg

SEQ ID NO: 694179 - DNA, 25 bp, Artificial sequence
  Synthetic oligonucleotide
tgctgaagaagcgcgagcgctaccg

SEQ ID NO: 694180 - DNA, 25 bp, Artificial sequence
  Synthetic oligonucleotide
tcaccgtgctgaagaagcgcgagcg

SEQ ID NO: 694181 - DNA, 25 bp, Artificial sequence
  Synthetic oligonucleotide
cctggatcaccgtgctgaagaagcg

SEQ ID NO: 694182 - DNA, 25 bp, Artificial sequence
  Synthetic oligonucleotide
gattgtcctggatcaccgtgctgaa

SEQ ID NO: 694183 - DNA, 25 bp, Artificial sequence
  Synthetic oligonucleotide
aggccggattgtcctggatcaccgt

SEQ ID NO: 694184 - DNA, 25 bp, Artificial sequence
  Synthetic oligonucleotide
gcttccaggccggattgtcctggat

SEQ ID NO: 694185 - DNA, 25 bp, Artificial sequence
  Synthetic oligonucleotide
tggagggcttccaggccggattgtc

SEQ ID NO: 694186 - DNA, 25 bp, Artificial sequence
  Synthetic oligonucleotide
tgctgctggagggcttccaggccgg

SEQ ID NO: 694187 - DNA, 25 bp, Artificial sequence
  Synthetic oligonucleotide
aacttctgctgctggagggcttcca

SEQ ID NO: 694188 - DNA, 25 bp, Artificial sequence
  Synthetic oligonucleotide
tgttcgaacttctgctgctggaggg

SEQ ID NO: 694189 - DNA, 25 bp, Artificial sequence
  Synthetic oligonucleotide
gcgagcgctaccgcgaggtgctgtt

SEQ ID NO: 694190 - DNA, 25 bp, Artificial sequence
  Synthetic oligonucleotide
atcccgacgcgctgttcgaacttct

SEQ ID NO: 694191 - DNA, 25 bp, Artificial sequence
  Synthetic oligonucleotide
gctaccgcgaggtgctgttcggctt

SEQ ID NO: 694192 - DNA, 25 bp, Artificial sequence
  Synthetic oligonucleotide
gtgccgcagcgcgatcccgacgcgc

SEQ ID NO: 694193 - DNA, 25 bp, Artificial sequence
  Synthetic oligonucleotide
gtggggtgtgccgcagcgcgatccc

SEQ ID NO: 694194 - DNA, 25 bp, Artificial sequence
  Synthetic oligonucleotide
tgaggagtggggtgtgccgcagcgc

SEQ ID NO: 694195 - DNA, 25 bp, Artificial sequence
  Synthetic oligonucleotide
ccacgatgaggagtggggtgtgccg

SEQ ID NO: 694196 - DNA, 25 bp, Artificial sequence
  Synthetic oligonucleotide
ggcctaccacgatgaggagtggggt

SEQ ID NO: 694197 - DNA, 25 bp, Artificial sequence
  Synthetic oligonucleotide
ctacatggcctaccacgatgaggag

SEQ ID NO: 694198 - DNA, 25 bp, Artificial sequence
  Synthetic oligonucleotide
tcccctctacatggcctaccacgat

SEQ ID NO: 694199 - DNA, 25 bp, Artificial sequence
  Synthetic oligonucleotide
gacgatcccctctacatggcctacc

SEQ ID NO: 694200 - DNA, 25 bp, Artificial sequence
  Synthetic oligonucleotide
tgcaacgacgatcccctctacatgg

SEQ ID NO: 694201 - DNA, 25 bp, Artificial sequence
  Synthetic oligonucleotide
tctggtgcaacgacgatcccctcta

SEQ ID NO: 694202 - DNA, 25 bp, Artificial sequence
  Synthetic oligonucleotide
gctgcttctggtgcaacgacgatcc

SEQ ID NO: 694203 - DNA, 25 bp, Artificial sequence
  Synthetic oligonucleotide
acgcgctgttcgaacttctgctgct

SEQ ID NO: 694204 - DNA, 25 bp, Artificial sequence
  Synthetic oligonucleotide
tgatgctcgaccccggcatcattcg

SEQ ID NO: 694205 - DNA, 25 bp, Artificial sequence
  Synthetic oligonucleotide
aggcatggaggtgctggaggaagcg

SEQ ID NO: 694206 - DNA, 25 bp, Artificial sequence
  Synthetic oligonucleotide
ggctggagctggacgacccggctgg

SEQ ID NO: 694207 - DNA, 25 bp, Artificial sequence
  Synthetic oligonucleotide
aggcctggctggagctggacgaccc

SEQ ID NO: 694208 - DNA, 25 bp, Artificial sequence
  Synthetic oligonucleotide
acgcccaggcctggctggagctgga

SEQ ID NO: 694209 - DNA, 25 bp, Artificial sequence
  Synthetic oligonucleotide
gcagaacgcccaggcctggctggag

SEQ ID NO: 694210 - DNA, 25 bp, Artificial sequence
  Synthetic oligonucleotide
tgcgcggcagaacgcccaggcctgg

SEQ ID NO: 694211 - DNA, 25 bp, Artificial sequence
  Synthetic oligonucleotide
aacgctgcgcggcagaacgcccagg

SEQ ID NO: 694212 - DNA, 25 bp, Artificial sequence
  Synthetic oligonucleotide
aagctcaacgctgcgcggcagaacg

SEQ ID NO: 694213 - DNA, 25 bp, Artificial sequence
  Synthetic oligonucleotide
gggccaagctcaacgctgcgcggca

SEQ ID NO: 694214 - DNA, 25 bp, Artificial sequence
  Synthetic oligonucleotide
gcaatcgggccaagctcaacgctgc

SEQ ID NO: 694215 - DNA, 25 bp, Artificial sequence
  Synthetic oligonucleotide
tcattcgcaatcgggccaagctcaa

SEQ ID NO: 694216 - DNA, 25 bp, Artificial sequence
  Synthetic oligonucleotide
agaagcgcgagcgctaccgcgaggt

SEQ ID NO: 694217 - DNA, 25 bp, Artificial sequence
  Synthetic oligonucleotide
tcgaccccggcatcattcgcaatcg

SEQ ID NO: 694218 - DNA, 25 bp, Artificial sequence
  Synthetic oligonucleotide
cggaaagccttatgccacgctgctt

SEQ ID NO: 694219 - DNA, 25 bp, Artificial sequence
  Synthetic oligonucleotide
acgaactgatgctcgaccccggcat

SEQ ID NO: 694220 - DNA, 25 bp, Artificial sequence
  Synthetic oligonucleotide
agatcgacgaactgatgctcgaccc

SEQ ID NO: 694221 - DNA, 25 bp, Artificial sequence
  Synthetic oligonucleotide
acgcggagatcgacgaactgatgct

SEQ ID NO: 694222 - DNA, 25 bp, Artificial sequence
  Synthetic oligonucleotide
tgagcgacgcggagatcgacgaact

SEQ ID NO: 694223 - DNA, 25 bp, Artificial sequence
  Synthetic oligonucleotide
cacagatgagcgacgcggagatcga

SEQ ID NO: 694224 - DNA, 25 bp, Artificial sequence
  Synthetic oligonucleotide
gggtggcacagatgagcgacgcgga

SEQ ID NO: 694225 - DNA, 25 bp, Artificial sequence
  Synthetic oligonucleotide
tgcagcgggtggcacagatgagcga

SEQ ID NO: 694226 - DNA, 25 bp, Artificial sequence
  Synthetic oligonucleotide
tcgacgtgcagcgggtggcacagat

SEQ ID NO: 694227 - DNA, 25 bp, Artificial sequence
  Synthetic oligonucleotide
tcggcttcgacgtgcagcgggtggc

SEQ ID NO: 694228 - DNA, 25 bp, Artificial sequence
  Synthetic oligonucleotide
tgctgttcggcttcgacgtgcagcg

SEQ ID NO: 694229 - DNA, 25 bp, Artificial sequence
  Synthetic oligonucleotide
gcgaggtgctgttcggcttcgacgt

SEQ ID NO: 694230 - DNA, 25 bp, Artificial sequence
  Synthetic oligonucleotide
cggcatcattcgcaatcgggccaag

SEQ ID NO: 694231 - DNA, 25 bp, Artificial sequence
  Synthetic oligonucleotide
cggctcggctggacgtaggcggcgt

SEQ ID NO: 694232 - DNA, 25 bp, Artificial sequence
  Synthetic oligonucleotide
ccacttccatgtcgtagggctgcag

SEQ ID NO: 694233 - DNA, 25 bp, Artificial sequence
  Synthetic oligonucleotide
cggcgcccacttccatgtcgtaggg

SEQ ID NO: 694234 - DNA, 25 bp, Artificial sequence
  Synthetic oligonucleotide
aaggtgccggcgcccacttccatgt

SEQ ID NO: 694235 - DNA, 25 bp, Artificial sequence
  Synthetic oligonucleotide
ggtgtggaaggtgccggcgcccact

SEQ ID NO: 694236 - DNA, 25 bp, Artificial sequence
  Synthetic oligonucleotide
ggtggcggtgtggaaggtgccggcg

SEQ ID NO: 694237 - DNA, 25 bp, Artificial sequence
  Synthetic oligonucleotide
gaggaaggtggcggtgtggaaggtg

SEQ ID NO: 694238 - DNA, 25 bp, Artificial sequence
  Synthetic oligonucleotide
tggcgcggaggaaggtggcggtgtg

SEQ ID NO: 694239 - DNA, 25 bp, Artificial sequence
  Synthetic oligonucleotide
ggccgatggcgcggaggaaggtggc

SEQ ID NO: 694240 - DNA, 25 bp, Artificial sequence
  Synthetic oligonucleotide
gtctccgggccgatggcgcggagga

SEQ ID NO: 694241 - DNA, 25 bp, Artificial sequence
  Synthetic oligonucleotide
ttccaggtctccgggccgatggcgc

SEQ ID NO: 694242 - DNA, 25 bp, Artificial sequence
  Synthetic oligonucleotide
cggcgttccaggtctccgggccgat

SEQ ID NO: 694243 - DNA, 25 bp, Artificial sequence
  Synthetic oligonucleotide
tgccacgctgcttctggtgcaacga

SEQ ID NO: 694244 - DNA, 25 bp, Artificial sequence
  Synthetic oligonucleotide
gctggacgtaggcggcgttccaggt

SEQ ID NO: 694245 - DNA, 25 bp, Artificial sequence
  Synthetic oligonucleotide
ggctgcagcaccacgcagccctgct

SEQ ID NO: 694246 - DNA, 25 bp, Artificial sequence
  Synthetic oligonucleotide
gggcggcggctcggctggacgtagg

SEQ ID NO: 694247 - DNA, 25 bp, Artificial sequence
  Synthetic oligonucleotide
tcggtggggcggcggctcggctgga

SEQ ID NO: 694248 - DNA, 25 bp, Artificial sequence
  Synthetic oligonucleotide
cgaccgtcggtggggcggcggctcg

SEQ ID NO: 694249 - DNA, 25 bp, Artificial sequence
  Synthetic oligonucleotide
cgtagcgaccgtcggtggggcggcg

SEQ ID NO: 694250 - DNA, 25 bp, Artificial sequence
  Synthetic oligonucleotide
tctcgccgtagcgaccgtcggtggg

SEQ ID NO: 694251 - DNA, 25 bp, Artificial sequence
  Synthetic oligonucleotide
tggggttctcgccgtagcgaccgtc

SEQ ID NO: 694252 - DNA, 25 bp, Artificial sequence
  Synthetic oligonucleotide
caggcggttggggttctcgccgtag

SEQ ID NO: 694253 - DNA, 25 bp, Artificial sequence
  Synthetic oligonucleotide
gtgctgcaggcggttggggttctcg

SEQ ID NO: 694254 - DNA, 25 bp, Artificial sequence
  Synthetic oligonucleotide
gtagtagtgctgcaggcggttgggg

SEQ ID NO: 694255 - DNA, 25 bp, Artificial sequence
  Synthetic oligonucleotide
aactggtagtagtgctgcaggcggt

SEQ ID NO: 694256 - DNA, 25 bp, Artificial sequence
  Synthetic oligonucleotide
gctattggtcaccgccaccagcatg

SEQ ID NO: 694257 - DNA, 25 bp, Artificial sequence
  Synthetic oligonucleotide
acgtaggcggcgttccaggtctccg

SEQ ID NO: 694258 - DNA, 25 bp, Artificial sequence
  Synthetic oligonucleotide
cggcgggcgtagtctggctcacgaa

SEQ ID NO: 694259 - DNA, 25 bp, Artificial sequence
  Synthetic oligonucleotide
tgggttcctctggtccttcgtcggc

SEQ ID NO: 694260 - DNA, 25 bp, Artificial sequence
  Synthetic oligonucleotide
aaaccacggaaagccttatgccacg

SEQ ID NO: 694261 - DNA, 25 bp, Artificial sequence
  Synthetic oligonucleotide
ctggaaaaccacggaaagccttatg

SEQ ID NO: 694262 - DNA, 25 bp, Artificial sequence
  Synthetic oligonucleotide
cccgattcccgcgccgcctcgcccg

SEQ ID NO: 694263 - DNA, 25 bp, Artificial sequence
  Synthetic oligonucleotide
agtatacccgattcccgcgccgcct

SEQ ID NO: 694264 - DNA, 25 bp, Artificial sequence
  Synthetic oligonucleotide
cgcggaagtatacccgattcccgcg

SEQ ID NO: 694265 - DNA, 25 bp, Artificial sequence
  Synthetic oligonucleotide
ttcgatacaaaacgcggaagtatac

SEQ ID NO: 694266 - DNA, 25 bp, Artificial sequence
  Synthetic oligonucleotide
tgaggcttcgatacaaaacgcggaa

SEQ ID NO: 694267 - DNA, 25 bp, Artificial sequence
  Synthetic oligonucleotide
ctgtgctgaggcttcgatacaaaac

SEQ ID NO: 694268 - DNA, 25 bp, Artificial sequence
  Synthetic oligonucleotide
aattcacctgtgctgaggcttcgat

SEQ ID NO: 694269 - DNA, 25 bp, Artificial sequence
  Synthetic oligonucleotide
tcacgaaattcacctgtgctgaggc

SEQ ID NO: 694270 - DNA, 25 bp, Artificial sequence
  Synthetic oligonucleotide
tccatgtcgtagggctgcagcacca

SEQ ID NO: 694271 - DNA, 25 bp, Artificial sequence
  Synthetic oligonucleotide
gcgtagtctggctcacgaaattcac

SEQ ID NO: 694272 - DNA, 25 bp, Artificial sequence
  Synthetic oligonucleotide
tcgtagggctgcagcaccacgcagc

SEQ ID NO: 694273 - DNA, 25 bp, Artificial sequence
  Synthetic oligonucleotide
tgcgcacggcgggcgtagtctggct

SEQ ID NO: 694274 - DNA, 25 bp, Artificial sequence
  Synthetic oligonucleotide
tggaaggtgcgcacggcgggcgtag

SEQ ID NO: 694275 - DNA, 25 bp, Artificial sequence
  Synthetic oligonucleotide
aggtcttggaaggtgcgcacggcgg

SEQ ID NO: 694276 - DNA, 25 bp, Artificial sequence
  Synthetic oligonucleotide
gaatcaggtcttggaaggtgcgcac

SEQ ID NO: 694277 - DNA, 25 bp, Artificial sequence
  Synthetic oligonucleotide
gggcgagaatcaggtcttggaaggt

SEQ ID NO: 694278 - DNA, 25 bp, Artificial sequence
  Synthetic oligonucleotide
tctgcagggcgagaatcaggtcttg

SEQ ID NO: 694279 - DNA, 25 bp, Artificial sequence
  Synthetic oligonucleotide
agtagttctgcagggcgagaatcag

SEQ ID NO: 694280 - DNA, 25 bp, Artificial sequence
  Synthetic oligonucleotide
ctgcccagtagttctgcagggcgag

SEQ ID NO: 694281 - DNA, 25 bp, Artificial sequence
  Synthetic oligonucleotide
cctgctctgcccagtagttctgcag

SEQ ID NO: 694282 - DNA, 25 bp, Artificial sequence
  Synthetic oligonucleotide
acgcagccctgctctgcccagtagt

SEQ ID NO: 694283 - DNA, 25 bp, Artificial sequence
  Synthetic oligonucleotide
agcaccacgcagccctgctctgccc

SEQ ID NO: 694284 - DNA, 25 bp, Artificial sequence
  Synthetic oligonucleotide
gccttatgccacgctgcttctggtg

SEQ ID NO: 694285 - DNA, 25 bp, Artificial sequence
  Synthetic oligonucleotide
tctggctcacgaaattcacctgtgc

SEQ ID NO: 694286 - DNA, 25 bp, Artificial sequence
  Synthetic oligonucleotide
gttcgcgttattgccctggcgtgcc

SEQ ID NO: 694287 - DNA, 25 bp, Artificial sequence
  Synthetic oligonucleotide
agctggacgacccggctgggttcct

SEQ ID NO: 694288 - DNA, 25 bp, Artificial sequence
  Synthetic oligonucleotide
tgccgaatcgatcccgcgaggtagt

SEQ ID NO: 694289 - DNA, 25 bp, Artificial sequence
  Synthetic oligonucleotide
gaaattgccgaatcgatcccgcgag

SEQ ID NO: 694290 - DNA, 25 bp, Artificial sequence
  Synthetic oligonucleotide
gatgtggaaattgccgaatcgatcc

SEQ ID NO: 694291 - DNA, 25 bp, Artificial sequence
  Synthetic oligonucleotide
gctggctgatgtggaaattgccgaa

SEQ ID NO: 694292 - DNA, 25 bp, Artificial sequence
  Synthetic oligonucleotide
gcataggctggctgatgtggaaatt

SEQ ID NO: 694293 - DNA, 25 bp, Artificial sequence
  Synthetic oligonucleotide
ggggccggcataggctggctgatgt

SEQ ID NO: 694294 - DNA, 25 bp, Artificial sequence
  Synthetic oligonucleotide
gcgtcggggccggcataggctggct

SEQ ID NO: 694295 - DNA, 25 bp, Artificial sequence
  Synthetic oligonucleotide
tgcaaggcgtcggggccggcatagg

SEQ ID NO: 694296 - DNA, 25 bp, Artificial sequence
  Synthetic oligonucleotide
gtgccgtgcaaggcgtcggggccgg

SEQ ID NO: 694297 - DNA, 25 bp, Artificial sequence
  Synthetic oligonucleotide
ctggcgtgccgtgcaaggcgtcggg

SEQ ID NO: 694298 - DNA, 25 bp, Artificial sequence
  Synthetic oligonucleotide
cccgcgaggtagtgcggatcaacct

SEQ ID NO: 694299 - DNA, 25 bp, Artificial sequence
  Synthetic oligonucleotide
cgttattgccctggcgtgccgtgca

SEQ ID NO: 694300 - DNA, 25 bp, Artificial sequence
  Synthetic oligonucleotide
aggtagtgcggatcaacctgtccaa

SEQ ID NO: 694301 - DNA, 25 bp, Artificial sequence
  Synthetic oligonucleotide
acgcctgttcgcgttattgccctgg

SEQ ID NO: 694302 - DNA, 25 bp, Artificial sequence
  Synthetic oligonucleotide
ggccctacgcctgttcgcgttattg

SEQ ID NO: 694303 - DNA, 25 bp, Artificial sequence
  Synthetic oligonucleotide
tggtgggggccctacgcctgttcgc

SEQ ID NO: 694304 - DNA, 25 bp, Artificial sequence
  Synthetic oligonucleotide
tgccctggtggtgggggccctacgc

SEQ ID NO: 694305 - DNA, 25 bp, Artificial sequence
  Synthetic oligonucleotide
tcaaaggtgccctggtggtgggggc

SEQ ID NO: 694306 - DNA, 25 bp, Artificial sequence
  Synthetic oligonucleotide
gaaattcaaaggtgccctggtggtg

SEQ ID NO: 694307 - DNA, 25 bp, Artificial sequence
  Synthetic oligonucleotide
gtggagaaattcaaaggtgccctgg

SEQ ID NO: 694308 - DNA, 25 bp, Artificial sequence
  Synthetic oligonucleotide
tgtttcgtggagaaattcaaaggtg

SEQ ID NO: 694309 - DNA, 25 bp, Artificial sequence
  Synthetic oligonucleotide
gaggagtgtttcgtggagaaattca

SEQ ID NO: 694310 - DNA, 25 bp, Artificial sequence
  Synthetic oligonucleotide
tcgagcgaggagtgtttcgtggaga

SEQ ID NO: 694311 - DNA, 25 bp, Artificial sequence
  Synthetic oligonucleotide
ttcgagtcgagcgaggagtgtttcg

SEQ ID NO: 694312 - DNA, 25 bp, Artificial sequence
  Synthetic oligonucleotide
ttgccctggcgtgccgtgcaaggcg

SEQ ID NO: 694313 - DNA, 25 bp, Artificial sequence
  Synthetic oligonucleotide
aaagcctgatggatattggccggac

SEQ ID NO: 694314 - DNA, 25 bp, Artificial sequence
  Synthetic oligonucleotide
acatccgcgaggtcgaaggcatgga

SEQ ID NO: 694315 - DNA, 25 bp, Artificial sequence
  Synthetic oligonucleotide
tgagatacatccgcgaggtcgaagg

SEQ ID NO: 694316 - DNA, 25 bp, Artificial sequence
  Synthetic oligonucleotide
agtcgctgagatacatccgcgaggt

SEQ ID NO: 694317 - DNA, 25 bp, Artificial sequence
  Synthetic oligonucleotide
ctgaaaagtcgctgagatacatccg

SEQ ID NO: 694318 - DNA, 25 bp, Artificial sequence
  Synthetic oligonucleotide
ggccgcctgaaaagtcgctgagata

SEQ ID NO: 694319 - DNA, 25 bp, Artificial sequence
  Synthetic oligonucleotide
ggatctggccgcctgaaaagtcgct

SEQ ID NO: 694320 - DNA, 25 bp, Artificial sequence
  Synthetic oligonucleotide
tgcgcctggatctggccgcctgaaa

SEQ ID NO: 694321 - DNA, 25 bp, Artificial sequence
  Synthetic oligonucleotide
agtgcctgcgcctggatctggccgc

SEQ ID NO: 694322 - DNA, 25 bp, Artificial sequence
  Synthetic oligonucleotide
ccgaaagtgcctgcgcctggatctg

SEQ ID NO: 694323 - DNA, 25 bp, Artificial sequence
  Synthetic oligonucleotide
ccctcaccgaaagtgcctgcgcctg

SEQ ID NO: 694324 - DNA, 25 bp, Artificial sequence
  Synthetic oligonucleotide
gccggaccctcaccgaaagtgcctg

SEQ ID NO: 694325 - DNA, 25 bp, Artificial sequence
  Synthetic oligonucleotide
atcgatcccgcgaggtagtgcggat

SEQ ID NO: 694326 - DNA, 25 bp, Artificial sequence
  Synthetic oligonucleotide
ctgatggatattggccggaccctca

SEQ ID NO: 694327 - DNA, 25 bp, Artificial sequence
  Synthetic oligonucleotide
cctggcgtacaatgcgcgttcgagt

SEQ ID NO: 694328 - DNA, 25 bp, Artificial sequence
  Synthetic oligonucleotide
tcggacaaagcctgatggatattgg

SEQ ID NO: 694329 - DNA, 25 bp, Artificial sequence
  Synthetic oligonucleotide
agctggtcggacaaagcctgatgga

SEQ ID NO: 694330 - DNA, 25 bp, Artificial sequence
  Synthetic oligonucleotide
tggaaaagctggtcggacaaagcct

SEQ ID NO: 694331 - DNA, 25 bp, Artificial sequence
  Synthetic oligonucleotide
cgaactggaaaagctggtcggacaa

SEQ ID NO: 694332 - DNA, 25 bp, Artificial sequence
  Synthetic oligonucleotide
tgaaaccgaactggaaaagctggtc

SEQ ID NO: 694333 - DNA, 25 bp, Artificial sequence
  Synthetic oligonucleotide
ttgtctgaaaccgaactggaaaagc

SEQ ID NO: 694334 - DNA, 25 bp, Artificial sequence
  Synthetic oligonucleotide
ccccgagttgtctgaaaccgaactg

SEQ ID NO: 694335 - DNA, 25 bp, Artificial sequence
  Synthetic oligonucleotide
agtgcttccccgagttgtctgaaac

SEQ ID NO: 694336 - DNA, 25 bp, Artificial sequence
  Synthetic oligonucleotide
tgtccaagtgcttccccgagttgtc

SEQ ID NO: 694337 - DNA, 25 bp, Artificial sequence
  Synthetic oligonucleotide
tcaacctgtccaagtgcttccccga

SEQ ID NO: 694338 - DNA, 25 bp, Artificial sequence
  Synthetic oligonucleotide
tgcggatcaacctgtccaagtgctt

SEQ ID NO: 694339 - DNA, 25 bp, Artificial sequence
  Synthetic oligonucleotide
gatattggccggaccctcaccgaaa

SEQ ID NO: 694340 - DNA, 25 bp, Artificial sequence
  Synthetic oligonucleotide
cccggaagccgaggccatgagcaag

SEQ ID NO: 694341 - DNA, 25 bp, Artificial sequence
  Synthetic oligonucleotide
atgcaggccagcggcatggtcatgg

SEQ ID NO: 694342 - DNA, 25 bp, Artificial sequence
  Synthetic oligonucleotide
gccttcatgcaggccagcggcatgg

SEQ ID NO: 694343 - DNA, 25 bp, Artificial sequence
  Synthetic oligonucleotide
tgctacgccttcatgcaggccagcg

SEQ ID NO: 694344 - DNA, 25 bp, Artificial sequence
  Synthetic oligonucleotide
gaccatctgctacgccttcatgcag

SEQ ID NO: 694345 - DNA, 25 bp, Artificial sequence
  Synthetic oligonucleotide
gggccgaccatctgctacgccttca

SEQ ID NO: 694346 - DNA, 25 bp, Artificial sequence
  Synthetic oligonucleotide
ttcgtcgggccgaccatctgctacg

SEQ ID NO: 694347 - DNA, 25 bp, Artificial sequence
  Synthetic oligonucleotide
ttcaacttcgtcgggccgaccatct

SEQ ID NO: 694348 - DNA, 25 bp, Artificial sequence
  Synthetic oligonucleotide
gccggcttcaacttcgtcgggccga

SEQ ID NO: 694349 - DNA, 25 bp, Artificial sequence
  Synthetic oligonucleotide
gcgcaaggccggcttcaacttcgtc

SEQ ID NO: 694350 - DNA, 25 bp, Artificial sequence
  Synthetic oligonucleotide
ggcgctgcgcaaggccggcttcaac

SEQ ID NO: 694351 - DNA, 25 bp, Artificial sequence
  Synthetic oligonucleotide
tgagcaaggcgctgcgcaaggccgg

SEQ ID NO: 694352 - DNA, 25 bp, Artificial sequence
  Synthetic oligonucleotide
tgcgcgttcgagtcgagcgaggagt

SEQ ID NO: 694353 - DNA, 25 bp, Artificial sequence
  Synthetic oligonucleotide
aagccgaggccatgagcaaggcgct

SEQ ID NO: 694354 - DNA, 25 bp, Artificial sequence
  Synthetic oligonucleotide
gtcatggaccatacccaggactgcg

SEQ ID NO: 694355 - DNA, 25 bp, Artificial sequence
  Synthetic oligonucleotide
cgattaccccggaagccgaggccat

SEQ ID NO: 694356 - DNA, 25 bp, Artificial sequence
  Synthetic oligonucleotide
tgccggcgattaccccggaagccga

SEQ ID NO: 694357 - DNA, 25 bp, Artificial sequence
  Synthetic oligonucleotide
gtcgcgccgaggtgccggcgattac

SEQ ID NO: 694358 - DNA, 25 bp, Artificial sequence
  Synthetic oligonucleotide
tcgccggtcgcgccgaggtgccggc

SEQ ID NO: 694359 - DNA, 25 bp, Artificial sequence
  Synthetic oligonucleotide
accatttcgccggtcgcgccgaggt

SEQ ID NO: 694360 - DNA, 25 bp, Artificial sequence
  Synthetic oligonucleotide
aagatcaaccatttcgccggtcgcg

SEQ ID NO: 694361 - DNA, 25 bp, Artificial sequence
  Synthetic oligonucleotide
agccgaagatcaaccatttcgccgg

SEQ ID NO: 694362 - DNA, 25 bp, Artificial sequence
  Synthetic oligonucleotide
gcggccagccgaagatcaaccattt

SEQ ID NO: 694363 - DNA, 25 bp, Artificial sequence
  Synthetic oligonucleotide
tcgtcggcggccagccgaagatcaa

SEQ ID NO: 694364 - DNA, 25 bp, Artificial sequence
  Synthetic oligonucleotide
ggtccttcgtcggcggccagccgaa

SEQ ID NO: 694365 - DNA, 25 bp, Artificial sequence
  Synthetic oligonucleotide
cctctggtccttcgtcggcggccag

SEQ ID NO: 694366 - DNA, 25 bp, Artificial sequence
  Synthetic oligonucleotide
aggccatgagcaaggcgctgcgcaa

SEQ ID NO: 694367 - DNA, 25 bp, Artificial sequence
  Synthetic oligonucleotide
ttcggatgttccacgtggaacatcg

SEQ ID NO: 694368 - DNA, 25 bp, Artificial sequence
  Synthetic oligonucleotide
tggtctcggtgttgttccaggaagc

SEQ ID NO: 694369 - DNA, 25 bp, Artificial sequence
  Synthetic oligonucleotide
attcttcctggcgtacaatgcgcgt

SEQ ID NO: 694370 - DNA, 25 bp, Artificial sequence
  Synthetic oligonucleotide
cctcgcattcttcctggcgtacaat

SEQ ID NO: 694371 - DNA, 25 bp, Artificial sequence
  Synthetic oligonucleotide
tgccgccctcgcattcttcctggcg

SEQ ID NO: 694372 - DNA, 25 bp, Artificial sequence
  Synthetic oligonucleotide
ttggctgccgccctcgcattcttcc

SEQ ID NO: 694373 - DNA, 25 bp, Artificial sequence
  Synthetic oligonucleotide
cgcttccttggctgccgccctcgca

SEQ ID NO: 694374 - DNA, 25 bp, Artificial sequence
  Synthetic oligonucleotide
tcgccccgcttccttggctgccgcc

SEQ ID NO: 694375 - DNA, 25 bp, Artificial sequence
  Synthetic oligonucleotide
agctggtcgccccgcttccttggct

SEQ ID NO: 694376 - DNA, 25 bp, Artificial sequence
  Synthetic oligonucleotide
cagcatagctggtcgccccgcttcc

SEQ ID NO: 694377 - DNA, 25 bp, Artificial sequence
  Synthetic oligonucleotide
ggcgcgcagcatagctggtcgcccc

SEQ ID NO: 694378 - DNA, 25 bp, Artificial sequence
  Synthetic oligonucleotide
aacatcggcgcgcagcatagctggt

SEQ ID NO: 694379 - DNA, 25 bp, Artificial sequence
  Synthetic oligonucleotide
gccagcggcatggtcatggaccata

SEQ ID NO: 694380 - DNA, 25 bp, Artificial sequence
  Synthetic oligonucleotide
tgttccacgtggaacatcggcgcgc

SEQ ID NO: 694381 - DNA, 25 bp, Artificial sequence
  Synthetic oligonucleotide
ggcatggtcatggaccatacccagg

SEQ ID NO: 694382 - DNA, 25 bp, Artificial sequence
  Synthetic oligonucleotide
gatgcgttcggatgttccacgtgga

SEQ ID NO: 694383 - DNA, 25 bp, Artificial sequence
  Synthetic oligonucleotide
ctgacggatgcgttcggatgttcca

SEQ ID NO: 694384 - DNA, 25 bp, Artificial sequence
  Synthetic oligonucleotide
cgctccctgacggatgcgttcggat

SEQ ID NO: 694385 - DNA, 25 bp, Artificial sequence
  Synthetic oligonucleotide
gccgggcgctccctgacggatgcgt

SEQ ID NO: 694386 - DNA, 25 bp, Artificial sequence
  Synthetic oligonucleotide
tcggctagccgggcgctccctgacg

SEQ ID NO: 694387 - DNA, 25 bp, Artificial sequence
  Synthetic oligonucleotide
actcgtcggctagccgggcgctccc

SEQ ID NO: 694388 - DNA, 25 bp, Artificial sequence
  Synthetic oligonucleotide
cgcccaactcgtcggctagccgggc

SEQ ID NO: 694389 - DNA, 25 bp, Artificial sequence
  Synthetic oligonucleotide
ccgttacgcccaactcgtcggctag

SEQ ID NO: 694390 - DNA, 25 bp, Artificial sequence
  Synthetic oligonucleotide
actgcgaccgttacgcccaactcgt

SEQ ID NO: 694391 - DNA, 25 bp, Artificial sequence
  Synthetic oligonucleotide
cccaggactgcgaccgttacgccca

SEQ ID NO: 694392 - DNA, 25 bp, Artificial sequence
  Synthetic oligonucleotide
accatacccaggactgcgaccgtta

SEQ ID NO: 694393 - DNA, 25 bp, Artificial sequence
  Synthetic oligonucleotide
gtacaatgcgcgttcgagtcgagcg

SEQ ID NO: 694394 - DNA, 25 bp, Artificial sequence
  Synthetic oligonucleotide
acgtggaacatcggcgcgcagcata

SEQ ID NO: 694395 - DNA, 25 bp, Artificial sequence
  Synthetic oligonucleotide
cgcttcggctgcgccgcggcgcagc

SEQ ID NO: 694396 - DNA, 25 bp, Artificial sequence
  Synthetic oligonucleotide
tctcgccgatgttttcctccagcag

SEQ ID NO: 694397 - DNA, 25 bp, Artificial sequence
  Synthetic oligonucleotide
ccgatggtcgccagttgcgggctga

SEQ ID NO: 694398 - DNA, 25 bp, Artificial sequence
  Synthetic oligonucleotide
agggtgccgatggtcgccagttgcg

SEQ ID NO: 694399 - DNA, 25 bp, Artificial sequence
  Synthetic oligonucleotide
gccagcagggtgccgatggtcgcca

SEQ ID NO: 694400 - DNA, 25 bp, Artificial sequence
  Synthetic oligonucleotide
acgtgggccagcagggtgccgatgg

SEQ ID NO: 694401 - DNA, 25 bp, Artificial sequence
  Synthetic oligonucleotide
cggcgaacgtgggccagcagggtgc

SEQ ID NO: 694402 - DNA, 25 bp, Artificial sequence
  Synthetic oligonucleotide
tcgccgcggcgaacgtgggccagca

SEQ ID NO: 694403 - DNA, 25 bp, Artificial sequence
  Synthetic oligonucleotide
tcgatgtcgccgcggcgaacgtggg

SEQ ID NO: 694404 - DNA, 25 bp, Artificial sequence
  Synthetic oligonucleotide
acgctctcgatgtcgccgcggcgaa

SEQ ID NO: 694405 - DNA, 25 bp, Artificial sequence
  Synthetic oligonucleotide
gagtgtacgctctcgatgtcgccgc

SEQ ID NO: 694406 - DNA, 25 bp, Artificial sequence
  Synthetic oligonucleotide
cgcagcgagtgtacgctctcgatgt

SEQ ID NO: 694407 - DNA, 25 bp, Artificial sequence
  Synthetic oligonucleotide
agttgcgggctgatggcgatgtcga

SEQ ID NO: 694408 - DNA, 25 bp, Artificial sequence
  Synthetic oligonucleotide
ggctgcgccgcggcgcagcgagtgt

SEQ ID NO: 694409 - DNA, 25 bp, Artificial sequence
  Synthetic oligonucleotide
gggctgatggcgatgtcgatctcgc

SEQ ID NO: 694410 - DNA, 25 bp, Artificial sequence
  Synthetic oligonucleotide
ttcgatcgcttcggctgcgccgcgg

SEQ ID NO: 694411 - DNA, 25 bp, Artificial sequence
  Synthetic oligonucleotide
taccacttcgatcgcttcggctgcg

SEQ ID NO: 694412 - DNA, 25 bp, Artificial sequence
  Synthetic oligonucleotide
catgggctaccacttcgatcgcttc

SEQ ID NO: 694413 - DNA, 25 bp, Artificial sequence
  Synthetic oligonucleotide
cgtcgccatgggctaccacttcgat

SEQ ID NO: 694414 - DNA, 25 bp, Artificial sequence
  Synthetic oligonucleotide
gacttggcgtcgccatgggctacca

SEQ ID NO: 694415 - DNA, 25 bp, Artificial sequence
  Synthetic oligonucleotide
ttgctcgacttggcgtcgccatggg

SEQ ID NO: 694416 - DNA, 25 bp, Artificial sequence
  Synthetic oligonucleotide
tcaccttgctcgacttggcgtcgcc

SEQ ID NO: 694417 - DNA, 25 bp, Artificial sequence
  Synthetic oligonucleotide
gaccgatcaccttgctcgacttggc

SEQ ID NO: 694418 - DNA, 25 bp, Artificial sequence
  Synthetic oligonucleotide
tcgagcgaccgatcaccttgctcga

SEQ ID NO: 694419 - DNA, 25 bp, Artificial sequence
  Synthetic oligonucleotide
cgttgatcgagcgaccgatcacctt

SEQ ID NO: 694420 - DNA, 25 bp, Artificial sequence
  Synthetic oligonucleotide
tgatctcgttgatcgagcgaccgat

SEQ ID NO: 694421 - DNA, 25 bp, Artificial sequence
  Synthetic oligonucleotide
ccgcggcgcagcgagtgtacgctct

SEQ ID NO: 694422 - DNA, 25 bp, Artificial sequence
  Synthetic oligonucleotide
actttgctcgcgccgagccgcttgg

SEQ ID NO: 694423 - DNA, 25 bp, Artificial sequence
  Synthetic oligonucleotide
tcgcctcctacgtggtctcggtgtt

SEQ ID NO: 694424 - DNA, 25 bp, Artificial sequence
  Synthetic oligonucleotide
ggaacacgtcggtctcgccgatgtt

SEQ ID NO: 694425 - DNA, 25 bp, Artificial sequence
  Synthetic oligonucleotide
gggcgaggaacacgtcggtctcgcc

SEQ ID NO: 694426 - DNA, 25 bp, Artificial sequence
  Synthetic oligonucleotide
tggtcagggcgaggaacacgtcggt

SEQ ID NO: 694427 - DNA, 25 bp, Artificial sequence
  Synthetic oligonucleotide
cgtcgttggtcagggcgaggaacac

SEQ ID NO: 694428 - DNA, 25 bp, Artificial sequence
  Synthetic oligonucleotide
ctcgtcgtcgttggtcagggcgagg

SEQ ID NO: 694429 - DNA, 25 bp, Artificial sequence
  Synthetic oligonucleotide
gttggcctcgtcgtcgttggtcagg

SEQ ID NO: 694430 - DNA, 25 bp, Artificial sequence
  Synthetic oligonucleotide
catgatgttggcctcgtcgtcgttg

SEQ ID NO: 694431 - DNA, 25 bp, Artificial sequence
  Synthetic oligonucleotide
gcgaggacatgatgttggcctcgtc

SEQ ID NO: 694432 - DNA, 25 bp, Artificial sequence
  Synthetic oligonucleotide
ccagcagcgaggacatgatgttggc

SEQ ID NO: 694433 - DNA, 25 bp, Artificial sequence
  Synthetic oligonucleotide
gcttggccagcagcgaggacatgat

SEQ ID NO: 694434 - DNA, 25 bp, Artificial sequence
  Synthetic oligonucleotide
gtcgccagttgcgggctgatggcga

SEQ ID NO: 694435 - DNA, 25 bp, Artificial sequence
  Synthetic oligonucleotide
ctcgcgccgagccgcttggccagca

SEQ ID NO: 694436 - DNA, 25 bp, Artificial sequence
  Synthetic oligonucleotide
tggtgcccggcggcagcttgatctc

SEQ ID NO: 694437 - DNA, 25 bp, Artificial sequence
  Synthetic oligonucleotide
gtcatcactttgctcgcgccgagcc

SEQ ID NO: 694438 - DNA, 25 bp, Artificial sequence
  Synthetic oligonucleotide
atcagggtcatcactttgctcgcgc

SEQ ID NO: 694439 - DNA, 25 bp, Artificial sequence
  Synthetic oligonucleotide
ttgttgatcagggtcatcactttgc

SEQ ID NO: 694440 - DNA, 25 bp, Artificial sequence
  Synthetic oligonucleotide
gccgggttgttgatcagggtcatca

SEQ ID NO: 694441 - DNA, 25 bp, Artificial sequence
  Synthetic oligonucleotide
gacataggccgggttgttgatcagg

SEQ ID NO: 694442 - DNA, 25 bp, Artificial sequence
  Synthetic oligonucleotide
caggtcgacataggccgggttgttg

SEQ ID NO: 694443 - DNA, 25 bp, Artificial sequence
  Synthetic oligonucleotide
tgcaccaggtcgacataggccgggt

SEQ ID NO: 694444 - DNA, 25 bp, Artificial sequence
  Synthetic oligonucleotide
ccgccttgcaccaggtcgacatagg

SEQ ID NO: 694445 - DNA, 25 bp, Artificial sequence
  Synthetic oligonucleotide
atctcgccgccttgcaccaggtcga

SEQ ID NO: 694446 - DNA, 25 bp, Artificial sequence
  Synthetic oligonucleotide
atgtcgatctcgccgccttgcacca

SEQ ID NO: 694447 - DNA, 25 bp, Artificial sequence
  Synthetic oligonucleotide
atggcgatgtcgatctcgccgcctt

SEQ ID NO: 694448 - DNA, 25 bp, Artificial sequence
  Synthetic oligonucleotide
cgagccgcttggccagcagcgagga

SEQ ID NO: 694449 - DNA, 25 bp, Artificial sequence
  Synthetic oligonucleotide
tccggccaggctttgcacggaacag

SEQ ID NO: 694450 - DNA, 25 bp, Artificial sequence
  Synthetic oligonucleotide
ctatcgccgttcgcgatagggcgtg

SEQ ID NO: 694451 - DNA, 25 bp, Artificial sequence
  Synthetic oligonucleotide
gaagccctatcgccgttcgcgatag

SEQ ID NO: 694452 - DNA, 25 bp, Artificial sequence
  Synthetic oligonucleotide
taggccgaagccctatcgccgttcg

SEQ ID NO: 694453 - DNA, 25 bp, Artificial sequence
  Synthetic oligonucleotide
gttcgtaggccgaagccctatcgcc

SEQ ID NO: 694454 - DNA, 25 bp, Artificial sequence
  Synthetic oligonucleotide
cttggtgttcgtaggccgaagccct

SEQ ID NO: 694455 - DNA, 25 bp, Artificial sequence
  Synthetic oligonucleotide
ggcacgcggccccttggtgttcgta

SEQ ID NO: 694456 - DNA, 25 bp, Artificial sequence
  Synthetic oligonucleotide
cgaaggaggcacgcggccccttggt

SEQ ID NO: 694457 - DNA, 25 bp, Artificial sequence
  Synthetic oligonucleotide
ccgttgcgaaggaggcacgcggccc

SEQ ID NO: 694458 - DNA, 25 bp, Artificial sequence
  Synthetic oligonucleotide
ttcggccgttgcgaaggaggcacgc

SEQ ID NO: 694459 - DNA, 25 bp, Artificial sequence
  Synthetic oligonucleotide
gagggattcggccgttgcgaaggag

SEQ ID NO: 694460 - DNA, 25 bp, Artificial sequence
  Synthetic oligonucleotide
ggaacagagggattcggccgttgcg

SEQ ID NO: 694461 - DNA, 25 bp, Artificial sequence
  Synthetic oligonucleotide
gcagcttgatctcgttgatcgagcg

SEQ ID NO: 694462 - DNA, 25 bp, Artificial sequence
  Synthetic oligonucleotide
caggctttgcacggaacagagggat

SEQ ID NO: 694463 - DNA, 25 bp, Artificial sequence
  Synthetic oligonucleotide
agaagaacgtcaggccggcctggaa

SEQ ID NO: 694464 - DNA, 25 bp, Artificial sequence
  Synthetic oligonucleotide
cccggctccggccaggctttgcacg

SEQ ID NO: 694465 - DNA, 25 bp, Artificial sequence
  Synthetic oligonucleotide
cattgtgcccggctccggccaggct

SEQ ID NO: 694466 - DNA, 25 bp, Artificial sequence
  Synthetic oligonucleotide
tgtcggccattgtgcccggctccgg

SEQ ID NO: 694467 - DNA, 25 bp, Artificial sequence
  Synthetic oligonucleotide
aacgatgtcggccattgtgcccggc

SEQ ID NO: 694468 - DNA, 25 bp, Artificial sequence
  Synthetic oligonucleotide
ctcttccaacgatgtcggccattgt

SEQ ID NO: 694469 - DNA, 25 bp, Artificial sequence
  Synthetic oligonucleotide
cctgccctcttccaacgatgtcggc

SEQ ID NO: 694470 - DNA, 25 bp, Artificial sequence
  Synthetic oligonucleotide
catcatcctgccctcttccaacgat

SEQ ID NO: 694471 - DNA, 25 bp, Artificial sequence
  Synthetic oligonucleotide
cttcgatcatcatcctgccctcttc

SEQ ID NO: 694472 - DNA, 25 bp, Artificial sequence
  Synthetic oligonucleotide
ccagaccttcgatcatcatcctgcc

SEQ ID NO: 694473 - DNA, 25 bp, Artificial sequence
  Synthetic oligonucleotide
tcttttccagaccttcgatcatcat

SEQ ID NO: 694474 - DNA, 25 bp, Artificial sequence
  Synthetic oligonucleotide
gccagcatcttttccagaccttcga

SEQ ID NO: 694475 - DNA, 25 bp, Artificial sequence
  Synthetic oligonucleotide
ttgcacggaacagagggattcggcc

SEQ ID NO: 694476 - DNA, 25 bp, Artificial sequence
  Synthetic oligonucleotide
agcacgtggtcgccgctctcgatgc

SEQ ID NO: 694477 - DNA, 25 bp, Artificial sequence
  Synthetic oligonucleotide
cgatgttttcctccagcagcaggtc

SEQ ID NO: 694478 - DNA, 25 bp, Artificial sequence
  Synthetic oligonucleotide
ccgatggtggtgcccggcggcagct

SEQ ID NO: 694479 - DNA, 25 bp, Artificial sequence
  Synthetic oligonucleotide
agcgcgccgatggtggtgcccggcg

SEQ ID NO: 694480 - DNA, 25 bp, Artificial sequence
  Synthetic oligonucleotide
cgcaccagcgcgccgatggtggtgc

SEQ ID NO: 694481 - DNA, 25 bp, Artificial sequence
  Synthetic oligonucleotide
tcgtcgcgcaccagcgcgccgatgg

SEQ ID NO: 694482 - DNA, 25 bp, Artificial sequence
  Synthetic oligonucleotide
acttcctcgtcgcgcaccagcgcgc

SEQ ID NO: 694483 - DNA, 25 bp, Artificial sequence
  Synthetic oligonucleotide
atcagcacttcctcgtcgcgcacca

SEQ ID NO: 694484 - DNA, 25 bp, Artificial sequence
  Synthetic oligonucleotide
tgggcgatcagcacttcctcgtcgc

SEQ ID NO: 694485 - DNA, 25 bp, Artificial sequence
  Synthetic oligonucleotide
tcgccatgggcgatcagcacttcct

SEQ ID NO: 694486 - DNA, 25 bp, Artificial sequence
  Synthetic oligonucleotide
gggtgtcgccatgggcgatcagcac

SEQ ID NO: 694487 - DNA, 25 bp, Artificial sequence
  Synthetic oligonucleotide
cgatgcgggtgtcgccatgggcgat

SEQ ID NO: 694488 - DNA, 25 bp, Artificial sequence
  Synthetic oligonucleotide
gcgatagggcgtgcctcagaagaac

SEQ ID NO: 694489 - DNA, 25 bp, Artificial sequence
  Synthetic oligonucleotide
tggtcgccgctctcgatgcgggtgt

SEQ ID NO: 694490 - DNA, 25 bp, Artificial sequence
  Synthetic oligonucleotide
tgcctcagaagaacgtcaggccggc

SEQ ID NO: 694491 - DNA, 25 bp, Artificial sequence
  Synthetic oligonucleotide
aacagcagcacgtggtcgccgctct

SEQ ID NO: 694492 - DNA, 25 bp, Artificial sequence
  Synthetic oligonucleotide
accaggaacagcagcacgtggtcgc

SEQ ID NO: 694493 - DNA, 25 bp, Artificial sequence
  Synthetic oligonucleotide
ttgtcgaccaggaacagcagcacgt

SEQ ID NO: 694494 - DNA, 25 bp, Artificial sequence
  Synthetic oligonucleotide
tatttcttgtcgaccaggaacagca

SEQ ID NO: 694495 - DNA, 25 bp, Artificial sequence
  Synthetic oligonucleotide
cggatgtatttcttgtcgaccagga

SEQ ID NO: 694496 - DNA, 25 bp, Artificial sequence
  Synthetic oligonucleotide
acgtctcggatgtatttcttgtcga

SEQ ID NO: 694497 - DNA, 25 bp, Artificial sequence
  Synthetic oligonucleotide
cgctcgacgtctcggatgtatttct

SEQ ID NO: 694498 - DNA, 25 bp, Artificial sequence
  Synthetic oligonucleotide
aacagtcgctcgacgtctcggatgt

SEQ ID NO: 694499 - DNA, 25 bp, Artificial sequence
  Synthetic oligonucleotide
gcctggaacagtcgctcgacgtctc

SEQ ID NO: 694500 - DNA, 25 bp, Artificial sequence
  Synthetic oligonucleotide
aggccggcctggaacagtcgctcga

SEQ ID NO: 694501 - DNA, 25 bp, Artificial sequence
  Synthetic oligonucleotide
aacgtcaggccggcctggaacagtc

SEQ ID NO: 694502 - DNA, 25 bp, Artificial sequence
  Synthetic oligonucleotide
ccggcggcagcttgatctcgttgat

SEQ ID NO: 694503 - DNA, 25 bp, Artificial sequence
  Synthetic oligonucleotide
cgctctcgatgcgggtgtcgccatg

SEQ ID NO: 694504 - DNA, 25 bp, Artificial sequence
  Synthetic oligonucleotide
ggccttgatcccgaccaactgcgcc

SEQ ID NO: 694505 - DNA, 25 bp, Artificial sequence
  Synthetic oligonucleotide
cgtcggtctcgccgatgttttcctc

SEQ ID NO: 694506 - DNA, 25 bp, Artificial sequence
  Synthetic oligonucleotide
ggcgcttgatgtagttggtgaccac

SEQ ID NO: 694507 - DNA, 25 bp, Artificial sequence
  Synthetic oligonucleotide
cgatcaggcgcttgatgtagttggt

SEQ ID NO: 694508 - DNA, 25 bp, Artificial sequence
  Synthetic oligonucleotide
ggtgttcgatcaggcgcttgatgta

SEQ ID NO: 694509 - DNA, 25 bp, Artificial sequence
  Synthetic oligonucleotide
gcgccggggtgttcgatcaggcgct

SEQ ID NO: 694510 - DNA, 25 bp, Artificial sequence
  Synthetic oligonucleotide
tgcagcgcgccggggtgttcgatca

SEQ ID NO: 694511 - DNA, 25 bp, Artificial sequence
  Synthetic oligonucleotide
atgacttgcagcgcgccggggtgtt

SEQ ID NO: 694512 - DNA, 25 bp, Artificial sequence
  Synthetic oligonucleotide
aagtcgatgacttgcagcgcgccgg

SEQ ID NO: 694513 - DNA, 25 bp, Artificial sequence
  Synthetic oligonucleotide
tcggcgaagtcgatgacttgcagcg

SEQ ID NO: 694514 - DNA, 25 bp, Artificial sequence
  Synthetic oligonucleotide
ttgccctcggcgaagtcgatgactt

SEQ ID NO: 694515 - DNA, 25 bp, Artificial sequence
  Synthetic oligonucleotide
tgcgccttgccctcggcgaagtcga

SEQ ID NO: 694516 - DNA, 25 bp, Artificial sequence
  Synthetic oligonucleotide
agttggtgaccacctgctccgggct

SEQ ID NO: 694517 - DNA, 25 bp, Artificial sequence
  Synthetic oligonucleotide
gatcccgaccaactgcgccttgccc

SEQ ID NO: 694518 - DNA, 25 bp, Artificial sequence
  Synthetic oligonucleotide
tgaccacctgctccgggctgatcag

SEQ ID NO: 694519 - DNA, 25 bp, Artificial sequence
  Synthetic oligonucleotide
gtagtaggccttgatcccgaccaac

SEQ ID NO: 694520 - DNA, 25 bp, Artificial sequence
  Synthetic oligonucleotide
gccgccgtagtaggccttgatcccg

SEQ ID NO: 694521 - DNA, 25 bp, Artificial sequence
  Synthetic oligonucleotide
cagagggccgccgtagtaggccttg

SEQ ID NO: 694522 - DNA, 25 bp, Artificial sequence
  Synthetic oligonucleotide
ccctaccagagggccgccgtagtag

SEQ ID NO: 694523 - DNA, 25 bp, Artificial sequence
  Synthetic oligonucleotide
ctcctgccctaccagagggccgccg

SEQ ID NO: 694524 - DNA, 25 bp, Artificial sequence
  Synthetic oligonucleotide
gcgcagctcctgccctaccagaggg

SEQ ID NO: 694525 - DNA, 25 bp, Artificial sequence
  Synthetic oligonucleotide
cagctggcgcagctcctgccctacc

SEQ ID NO: 694526 - DNA, 25 bp, Artificial sequence
  Synthetic oligonucleotide
ctcgcgcagctggcgcagctcctgc

SEQ ID NO: 694527 - DNA, 25 bp, Artificial sequence
  Synthetic oligonucleotide
atgtgctcgcgcagctggcgcagct

SEQ ID NO: 694528 - DNA, 25 bp, Artificial sequence
  Synthetic oligonucleotide
ttcggcatgtgctcgcgcagctggc

SEQ ID NO: 694529 - DNA, 25 bp, Artificial sequence
  Synthetic oligonucleotide
ccacgttcggcatgtgctcgcgcag

SEQ ID NO: 694530 - DNA, 25 bp, Artificial sequence
  Synthetic oligonucleotide
gaccaactgcgccttgccctcggcg

SEQ ID NO: 694531 - DNA, 25 bp, Artificial sequence
  Synthetic oligonucleotide
cggctcgcggacgcgggcgatcttg

SEQ ID NO: 694532 - DNA, 25 bp, Artificial sequence
  Synthetic oligonucleotide
ctcgtcgctattggtcaccgccacc

SEQ ID NO: 694533 - DNA, 25 bp, Artificial sequence
  Synthetic oligonucleotide
ttggtctcgtcgctattggtcaccg

SEQ ID NO: 694534 - DNA, 25 bp, Artificial sequence
  Synthetic oligonucleotide
accatgttggtctcgtcgctattgg

SEQ ID NO: 694535 - DNA, 25 bp, Artificial sequence
  Synthetic oligonucleotide
caggcgaccatgttggtctcgtcgc

SEQ ID NO: 694536 - DNA, 25 bp, Artificial sequence
  Synthetic oligonucleotide
cctggcaggcgaccatgttggtctc

SEQ ID NO: 694537 - DNA, 25 bp, Artificial sequence
  Synthetic oligonucleotide
aggcgacctggcaggcgaccatgtt

SEQ ID NO: 694538 - DNA, 25 bp, Artificial sequence
  Synthetic oligonucleotide
gggtgtaggcgacctggcaggcgac

SEQ ID NO: 694539 - DNA, 25 bp, Artificial sequence
  Synthetic oligonucleotide
tgaacagggtgtaggcgacctggca

SEQ ID NO: 694540 - DNA, 25 bp, Artificial sequence
  Synthetic oligonucleotide
gggtgttgaacagggtgtaggcgac

SEQ ID NO: 694541 - DNA, 25 bp, Artificial sequence
  Synthetic oligonucleotide
tggtcggggtgttgaacagggtgta

SEQ ID NO: 694542 - DNA, 25 bp, Artificial sequence
  Synthetic oligonucleotide
gatcttggtcggggtgttgaacagg

SEQ ID NO: 694543 - DNA, 25 bp, Artificial sequence
  Synthetic oligonucleotide
tgatgtagttggtgaccacctgctc

SEQ ID NO: 694544 - DNA, 25 bp, Artificial sequence
  Synthetic oligonucleotide
gcggacgcgggcgatcttggtcggg

SEQ ID NO: 694545 - DNA, 25 bp, Artificial sequence
  Synthetic oligonucleotide
tcgcggcgacgcgggtatccacgtt

SEQ ID NO: 694546 - DNA, 25 bp, Artificial sequence
  Synthetic oligonucleotide
gtaggccggctcgcggacgcgggcg

SEQ ID NO: 694547 - DNA, 25 bp, Artificial sequence
  Synthetic oligonucleotide
gtcaggtaggccggctcgcggacgc

SEQ ID NO: 694548 - DNA, 25 bp, Artificial sequence
  Synthetic oligonucleotide
gtacgggtcaggtaggccggctcgc

SEQ ID NO: 694549 - DNA, 25 bp, Artificial sequence
  Synthetic oligonucleotide
tgtcgaacagcccggtacgggtcag

SEQ ID NO: 694550 - DNA, 25 bp, Artificial sequence
  Synthetic oligonucleotide
cctcgttgtcgaacagcccggtacg

SEQ ID NO: 694551 - DNA, 25 bp, Artificial sequence
  Synthetic oligonucleotide
ggatcgcctcgttgtcgaacagccc

SEQ ID NO: 694552 - DNA, 25 bp, Artificial sequence
  Synthetic oligonucleotide
caccgggatcgcctcgttgtcgaac

SEQ ID NO: 694553 - DNA, 25 bp, Artificial sequence
  Synthetic oligonucleotide
cacgtccaccgggatcgcctcgttg

SEQ ID NO: 694554 - DNA, 25 bp, Artificial sequence
  Synthetic oligonucleotide
tgatcagcacgtccaccgggatcgc

SEQ ID NO: 694555 - DNA, 25 bp, Artificial sequence
  Synthetic oligonucleotide
ccgggctgatcagcacgtccaccgg

SEQ ID NO: 694556 - DNA, 25 bp, Artificial sequence
  Synthetic oligonucleotide
cctgctccgggctgatcagcacgtc

SEQ ID NO: 694557 - DNA, 25 bp, Artificial sequence
  Synthetic oligonucleotide
gcgggcgatcttggtcggggtgttg

SEQ ID NO: 694558 - DNA, 25 bp, Artificial sequence
  Synthetic oligonucleotide
tccgagaggtgccggcagcgcagcg

SEQ ID NO: 694559 - DNA, 25 bp, Artificial sequence
  Synthetic oligonucleotide
tcgccgacattgccgccgccggcga

SEQ ID NO: 694560 - DNA, 25 bp, Artificial sequence
  Synthetic oligonucleotide
aggcgctcgccgacattgccgccgc

SEQ ID NO: 694561 - DNA, 25 bp, Artificial sequence
  Synthetic oligonucleotide
tcggccaggcgctcgccgacattgc

SEQ ID NO: 694562 - DNA, 25 bp, Artificial sequence
  Synthetic oligonucleotide
atggcctcggccaggcgctcgccga

SEQ ID NO: 694563 - DNA, 25 bp, Artificial sequence
  Synthetic oligonucleotide
ctctcgatggcctcggccaggcgct

SEQ ID NO: 694564 - DNA, 25 bp, Artificial sequence
  Synthetic oligonucleotide
gtagcggctctcgatggcctcggcc

SEQ ID NO: 694565 - DNA, 25 bp, Artificial sequence
  Synthetic oligonucleotide
tacctggtagcggctctcgatggcc

SEQ ID NO: 694566 - DNA, 25 bp, Artificial sequence
  Synthetic oligonucleotide
gatctttacctggtagcggctctcg

SEQ ID NO: 694567 - DNA, 25 bp, Artificial sequence
  Synthetic oligonucleotide
ctcgatgatctttacctggtagcgg

SEQ ID NO: 694568 - DNA, 25 bp, Artificial sequence
  Synthetic oligonucleotide
gctgcgctcgatgatctttacctgg

SEQ ID NO: 694569 - DNA, 25 bp, Artificial sequence
  Synthetic oligonucleotide
cagcgggctgcgctcgatgatcttt

SEQ ID NO: 694570 - DNA, 25 bp, Artificial sequence
  Synthetic oligonucleotide
gggtatccacgttcggcatgtgctc

SEQ ID NO: 694571 - DNA, 25 bp, Artificial sequence
  Synthetic oligonucleotide
aggtgccggcagcgcagcgggctgc

SEQ ID NO: 694572 - DNA, 25 bp, Artificial sequence
  Synthetic oligonucleotide
cggcgatgatgatccgcttgtagct

SEQ ID NO: 694573 - DNA, 25 bp, Artificial sequence
  Synthetic oligonucleotide
agggtatccgagaggtgccggcagc

SEQ ID NO: 694574 - DNA, 25 bp, Artificial sequence
  Synthetic oligonucleotide
ctgtccagggtatccgagaggtgcc

SEQ ID NO: 694575 - DNA, 25 bp, Artificial sequence
  Synthetic oligonucleotide
tggtgctgtccagggtatccgagag

SEQ ID NO: 694576 - DNA, 25 bp, Artificial sequence
  Synthetic oligonucleotide
gcacgatggtgctgtccagggtatc

SEQ ID NO: 694577 - DNA, 25 bp, Artificial sequence
  Synthetic oligonucleotide
cgttgagcacgatggtgctgtccag

SEQ ID NO: 694578 - DNA, 25 bp, Artificial sequence
  Synthetic oligonucleotide
cgctgccgttgagcacgatggtgct

SEQ ID NO: 694579 - DNA, 25 bp, Artificial sequence
  Synthetic oligonucleotide
tcggaagcgctgccgttgagcacga

SEQ ID NO: 694580 - DNA, 25 bp, Artificial sequence
  Synthetic oligonucleotide
tcgcggtcggaagcgctgccgttga

SEQ ID NO: 694581 - DNA, 25 bp, Artificial sequence
  Synthetic oligonucleotide
agcaggtcgcggtcggaagcgctgc

SEQ ID NO: 694582 - DNA, 25 bp, Artificial sequence
  Synthetic oligonucleotide
tccagcagcaggtcgcggtcggaag

SEQ ID NO: 694583 - DNA, 25 bp, Artificial sequence
  Synthetic oligonucleotide
ttttcctccagcagcaggtcgcggt

SEQ ID NO: 694584 - DNA, 25 bp, Artificial sequence
  Synthetic oligonucleotide
ggcagcgcagcgggctgcgctcgat

SEQ ID NO: 694585 - DNA, 25 bp, Artificial sequence
  Synthetic oligonucleotide
gcggcgatgaagaagacttcgtcgt

SEQ ID NO: 694586 - DNA, 25 bp, Artificial sequence
  Synthetic oligonucleotide
gcattgtccacgcctttggccagca

SEQ ID NO: 694587 - DNA, 25 bp, Artificial sequence
  Synthetic oligonucleotide
cggtagatcgcggcgacgcgggtat

SEQ ID NO: 694588 - DNA, 25 bp, Artificial sequence
  Synthetic oligonucleotide
ttgcggcggtagatcgcggcgacgc

SEQ ID NO: 694589 - DNA, 25 bp, Artificial sequence
  Synthetic oligonucleotide
ggccggttgcggcggtagatcgcgg

SEQ ID NO: 694590 - DNA, 25 bp, Artificial sequence
  Synthetic oligonucleotide
atgatcggccggttgcggcggtaga

SEQ ID NO: 694591 - DNA, 25 bp, Artificial sequence
  Synthetic oligonucleotide
tggggaatgatcggccggttgcggc

SEQ ID NO: 694592 - DNA, 25 bp, Artificial sequence
  Synthetic oligonucleotide
tcgccctggggaatgatcggccggt

SEQ ID NO: 694593 - DNA, 25 bp, Artificial sequence
  Synthetic oligonucleotide
accgtgtcgccctggggaatgatcg

SEQ ID NO: 694594 - DNA, 25 bp, Artificial sequence
  Synthetic oligonucleotide
tcgatcaccgtgtcgccctggggaa

SEQ ID NO: 694595 - DNA, 25 bp, Artificial sequence
  Synthetic oligonucleotide
tcggcctcgatcaccgtgtcgccct

SEQ ID NO: 694596 - DNA, 25 bp, Artificial sequence
  Synthetic oligonucleotide
tcgtcgtcggcctcgatcaccgtgt

SEQ ID NO: 694597 - DNA, 25 bp, Artificial sequence
  Synthetic oligonucleotide
acattgccgccgccggcgatgatga

SEQ ID NO: 694598 - DNA, 25 bp, Artificial sequence
  Synthetic oligonucleotide
atgaagaagacttcgtcgtcggcct

SEQ ID NO: 694599 - DNA, 25 bp, Artificial sequence
  Synthetic oligonucleotide
cgccgccggcgatgatgatccgctt

SEQ ID NO: 694600 - DNA, 25 bp, Artificial sequence
  Synthetic oligonucleotide
gccttggcggcgatgaagaagactt

SEQ ID NO: 694601 - DNA, 25 bp, Artificial sequence
  Synthetic oligonucleotide
gatatgggccttggcggcgatgaag

SEQ ID NO: 694602 - DNA, 25 bp, Artificial sequence
  Synthetic oligonucleotide
cgcgcggatatgggccttggcggcg

SEQ ID NO: 694603 - DNA, 25 bp, Artificial sequence
  Synthetic oligonucleotide
cattaccgcgcggatatgggccttg

SEQ ID NO: 694604 - DNA, 25 bp, Artificial sequence
  Synthetic oligonucleotide
tctcgcccattaccgcgcggatatg

SEQ ID NO: 694605 - DNA, 25 bp, Artificial sequence
  Synthetic oligonucleotide
tgcgcatctcgcccattaccgcgcg

SEQ ID NO: 694606 - DNA, 25 bp, Artificial sequence
  Synthetic oligonucleotide
cgagcctgcgcatctcgcccattac

SEQ ID NO: 694607 - DNA, 25 bp, Artificial sequence
  Synthetic oligonucleotide
tgtcgtcgagcctgcgcatctcgcc

SEQ ID NO: 694608 - DNA, 25 bp, Artificial sequence
  Synthetic oligonucleotide
tgtagctgtcgtcgagcctgcgcat

SEQ ID NO: 694609 - DNA, 25 bp, Artificial sequence
  Synthetic oligonucleotide
tccgcttgtagctgtcgtcgagcct

SEQ ID NO: 694610 - DNA, 25 bp, Artificial sequence
  Synthetic oligonucleotide
tgatgatccgcttgtagctgtcgtc

SEQ ID NO: 694611 - DNA, 25 bp, Artificial sequence
  Synthetic oligonucleotide
cgacgcgggtatccacgttcggcat

SEQ ID NO: 694612 - DNA, 25 bp, Artificial sequence
  Synthetic oligonucleotide
aagacttcgtcgtcggcctcgatca

SEQ ID NO: 694613 - DNA, 25 bp, Artificial sequence
  Synthetic oligonucleotide
cttgaggcttatcgaggcaatctgg

SEQ ID NO: 694614 - DNA, 25 bp, Artificial sequence
  Synthetic oligonucleotide
cctttggccagcatcttttccagac

SEQ ID NO: 694615 - DNA, 25 bp, Artificial sequence
  Synthetic oligonucleotide
aggtggtagcccggtgcgcggccgt

SEQ ID NO: 694616 - DNA, 25 bp, Artificial sequence
  Synthetic oligonucleotide
tcaggaggtggtagcccggtgcgcg

SEQ ID NO: 694617 - DNA, 25 bp, Artificial sequence
  Synthetic oligonucleotide
cttcattcaggaggtggtagcccgg

SEQ ID NO: 694618 - DNA, 25 bp, Artificial sequence
  Synthetic oligonucleotide
gcccttcttcattcaggaggtggta

SEQ ID NO: 694619 - DNA, 25 bp, Artificial sequence
  Synthetic oligonucleotide
ccgttgcgcccttcttcattcagga

SEQ ID NO: 694620 - DNA, 25 bp, Artificial sequence
  Synthetic oligonucleotide
ccgtgaccgttgcgcccttcttcat

SEQ ID NO: 694621 - DNA, 25 bp, Artificial sequence
  Synthetic oligonucleotide
caacggccgtgaccgttgcgccctt

SEQ ID NO: 694622 - DNA, 25 bp, Artificial sequence
  Synthetic oligonucleotide
gggcgcaacggccgtgaccgttgcg

SEQ ID NO: 694623 - DNA, 25 bp, Artificial sequence
  Synthetic oligonucleotide
gaggaagggcgcaacggccgtgacc

SEQ ID NO: 694624 - DNA, 25 bp, Artificial sequence
  Synthetic oligonucleotide
aatctggaggaagggcgcaacggcc

SEQ ID NO: 694625 - DNA, 25 bp, Artificial sequence
  Synthetic oligonucleotide
cggtgcgcggccgtgagcagcgtca

SEQ ID NO: 694626 - DNA, 25 bp, Artificial sequence
  Synthetic oligonucleotide
gcttatcgaggcaatctggaggaag

SEQ ID NO: 694627 - DNA, 25 bp, Artificial sequence
  Synthetic oligonucleotide
gcggccgtgagcagcgtcagggcat

SEQ ID NO: 694628 - DNA, 25 bp, Artificial sequence
  Synthetic oligonucleotide
caacgcttgaggcttatcgaggcaa

SEQ ID NO: 694629 - DNA, 25 bp, Artificial sequence
  Synthetic oligonucleotide
cgcagagcaacgcttgaggcttatc

SEQ ID NO: 694630 - DNA, 25 bp, Artificial sequence
  Synthetic oligonucleotide
ggcggccgcagagcaacgcttgagg

SEQ ID NO: 694631 - DNA, 25 bp, Artificial sequence
  Synthetic oligonucleotide
tgccggggcggccgcagagcaacgc

SEQ ID NO: 694632 - DNA, 25 bp, Artificial sequence
  Synthetic oligonucleotide
agatgctgccggggcggccgcagag

SEQ ID NO: 694633 - DNA, 25 bp, Artificial sequence
  Synthetic oligonucleotide
tcctgaagatgctgccggggcggcc

SEQ ID NO: 694634 - DNA, 25 bp, Artificial sequence
  Synthetic oligonucleotide
acggcatcctgaagatgctgccggg

SEQ ID NO: 694635 - DNA, 25 bp, Artificial sequence
  Synthetic oligonucleotide
actcaacggcatcctgaagatgctg

SEQ ID NO: 694636 - DNA, 25 bp, Artificial sequence
  Synthetic oligonucleotide
catgctactcaacggcatcctgaag

SEQ ID NO: 694637 - DNA, 25 bp, Artificial sequence
  Synthetic oligonucleotide
ctacggcatgctactcaacggcatc

SEQ ID NO: 694638 - DNA, 25 bp, Artificial sequence
  Synthetic oligonucleotide
gccgctctacggcatgctactcaac

SEQ ID NO: 694639 - DNA, 25 bp, Artificial sequence
  Synthetic oligonucleotide
cgaggcaatctggaggaagggcgca

SEQ ID NO: 694640 - DNA, 25 bp, Artificial sequence
  Synthetic oligonucleotide
cgcccagccctgtccgcacttcgat

SEQ ID NO: 694641 - DNA, 25 bp, Artificial sequence
  Synthetic oligonucleotide
acggattcgagcatctcattggcgg

SEQ ID NO: 694642 - DNA, 25 bp, Artificial sequence
  Synthetic oligonucleotide
tcctgtacggattcgagcatctcat

SEQ ID NO: 694643 - DNA, 25 bp, Artificial sequence
  Synthetic oligonucleotide
aggcgctcctgtacggattcgagca

SEQ ID NO: 694644 - DNA, 25 bp, Artificial sequence
  Synthetic oligonucleotide
gccctgaggcgctcctgtacggatt

SEQ ID NO: 694645 - DNA, 25 bp, Artificial sequence
  Synthetic oligonucleotide
aggagagccctgaggcgctcctgta

SEQ ID NO: 694646 - DNA, 25 bp, Artificial sequence
  Synthetic oligonucleotide
aggccgaggagagccctgaggcgct

SEQ ID NO: 694647 - DNA, 25 bp, Artificial sequence
  Synthetic oligonucleotide
ggaggaggccgaggagagccctgag

SEQ ID NO: 694648 - DNA, 25 bp, Artificial sequence
  Synthetic oligonucleotide
aggcatggaggaggccgaggagagc

SEQ ID NO: 694649 - DNA, 25 bp, Artificial sequence
  Synthetic oligonucleotide
ttccaaggcatggaggaggccgagg

SEQ ID NO: 694650 - DNA, 25 bp, Artificial sequence
  Synthetic oligonucleotide
gatcctttccaaggcatggaggagg

SEQ ID NO: 694651 - DNA, 25 bp, Artificial sequence
  Synthetic oligonucleotide
acttcgatcctttccaaggcatgga

SEQ ID NO: 694652 - DNA, 25 bp, Artificial sequence
  Synthetic oligonucleotide
gtagcccggtgcgcggccgtgagca

SEQ ID NO: 694653 - DNA, 25 bp, Artificial sequence
  Synthetic oligonucleotide
gccctgtccgcacttcgatcctttc

SEQ ID NO: 694654 - DNA, 25 bp, Artificial sequence
  Synthetic oligonucleotide
tcagccttctgctgttcgtgccgct

SEQ ID NO: 694655 - DNA, 25 bp, Artificial sequence
  Synthetic oligonucleotide
tgggaacgcccagccctgtccgcac

SEQ ID NO: 694656 - DNA, 25 bp, Artificial sequence
  Synthetic oligonucleotide
gctgaatgggaacgcccagccctgt

SEQ ID NO: 694657 - DNA, 25 bp, Artificial sequence
  Synthetic oligonucleotide
cacgcgctgaatgggaacgcccagc

SEQ ID NO: 694658 - DNA, 25 bp, Artificial sequence
  Synthetic oligonucleotide
tgcgccacgcgctgaatgggaacgc

SEQ ID NO: 694659 - DNA, 25 bp, Artificial sequence
  Synthetic oligonucleotide
aggatgtgcgccacgcgctgaatgg

SEQ ID NO: 694660 - DNA, 25 bp, Artificial sequence
  Synthetic oligonucleotide
gtgaccaggatgtgcgccacgcgct

SEQ ID NO: 694661 - DNA, 25 bp, Artificial sequence
  Synthetic oligonucleotide
ccgagcgtgaccaggatgtgcgcca

SEQ ID NO: 694662 - DNA, 25 bp, Artificial sequence
  Synthetic oligonucleotide
tcgccgccgagcgtgaccaggatgt

SEQ ID NO: 694663 - DNA, 25 bp, Artificial sequence
  Synthetic oligonucleotide
agggcatcgccgccgagcgtgacca

SEQ ID NO: 694664 - DNA, 25 bp, Artificial sequence
  Synthetic oligonucleotide
agcgtcagggcatcgccgccgagcg

SEQ ID NO: 694665 - DNA, 25 bp, Artificial sequence
  Synthetic oligonucleotide
gtgagcagcgtcagggcatcgccgc

SEQ ID NO: 694666 - DNA, 25 bp, Artificial sequence
  Synthetic oligonucleotide
gtccgcacttcgatcctttccaagg

SEQ ID NO: 694667 - DNA, 25 bp, Artificial sequence
  Synthetic oligonucleotide
accttcgtcgcacggatatccctgg

SEQ ID NO: 694668 - DNA, 25 bp, Artificial sequence
  Synthetic oligonucleotide
gcctccgtcgttcccggcactggtg

SEQ ID NO: 694669 - DNA, 25 bp, Artificial sequence
  Synthetic oligonucleotide
tcgaccgcctccgtcgttcccggca

SEQ ID NO: 694670 - DNA, 25 bp, Artificial sequence
  Synthetic oligonucleotide
caggtattcgaccgcctccgtcgtt

SEQ ID NO: 694671 - DNA, 25 bp, Artificial sequence
  Synthetic oligonucleotide
acatccaggtattcgaccgcctccg

SEQ ID NO: 694672 - DNA, 25 bp, Artificial sequence
  Synthetic oligonucleotide
tcctcgacatccaggtattcgaccg

SEQ ID NO: 694673 - DNA, 25 bp, Artificial sequence
  Synthetic oligonucleotide
ggcagatcctcgacatccaggtatt

SEQ ID NO: 694674 - DNA, 25 bp, Artificial sequence
  Synthetic oligonucleotide
tgctcgggcagatcctcgacatcca

SEQ ID NO: 694675 - DNA, 25 bp, Artificial sequence
  Synthetic oligonucleotide
cctatgtgctcgggcagatcctcga

SEQ ID NO: 694676 - DNA, 25 bp, Artificial sequence
  Synthetic oligonucleotide
tcctcgcctatgtgctcgggcagat

SEQ ID NO: 694677 - DNA, 25 bp, Artificial sequence
  Synthetic oligonucleotide
aagcttcctcgcctatgtgctcggg

SEQ ID NO: 694678 - DNA, 25 bp, Artificial sequence
  Synthetic oligonucleotide
cctggcaagcttcctcgcctatgtg

SEQ ID NO: 694679 - DNA, 25 bp, Artificial sequence
  Synthetic oligonucleotide
tgttcgtgccgctctacggcatgct

SEQ ID NO: 694680 - DNA, 25 bp, Artificial sequence
  Synthetic oligonucleotide
gtcgcacggatatccctggcaagct

SEQ ID NO: 694681 - DNA, 25 bp, Artificial sequence
  Synthetic oligonucleotide
ctggtggaccgcgccagtcgcctcg

SEQ ID NO: 694682 - DNA, 25 bp, Artificial sequence
  Synthetic oligonucleotide
ttcaacaccttcgtcgcacggatat

SEQ ID NO: 694683 - DNA, 25 bp, Artificial sequence
  Synthetic oligonucleotide
ctggagttcaacaccttcgtcgcac

SEQ ID NO: 694684 - DNA, 25 bp, Artificial sequence
  Synthetic oligonucleotide
gcgctgctggagttcaacaccttcg

SEQ ID NO: 694685 - DNA, 25 bp, Artificial sequence
  Synthetic oligonucleotide
ttctccgcgctgctggagttcaaca

SEQ ID NO: 694686 - DNA, 25 bp, Artificial sequence
  Synthetic oligonucleotide
cgtggtttctccgcgctgctggagt

SEQ ID NO: 694687 - DNA, 25 bp, Artificial sequence
  Synthetic oligonucleotide
cgttccgtggtttctccgcgctgct

SEQ ID NO: 694688 - DNA, 25 bp, Artificial sequence
  Synthetic oligonucleotide
agcggcgttccgtggtttctccgcg

SEQ ID NO: 694689 - DNA, 25 bp, Artificial sequence
  Synthetic oligonucleotide
caggaagcggcgttccgtggtttct

SEQ ID NO: 694690 - DNA, 25 bp, Artificial sequence
  Synthetic oligonucleotide
ttgttccaggaagcggcgttccgtg

SEQ ID NO: 694691 - DNA, 25 bp, Artificial sequence
  Synthetic oligonucleotide
cggtgttgttccaggaagcggcgtt

SEQ ID NO: 694692 - DNA, 25 bp, Artificial sequence
  Synthetic oligonucleotide
ggcttcaggaccacctgaaactggt

SEQ ID NO: 694693 - DNA, 25 bp, Artificial sequence
  Synthetic oligonucleotide
ggatatccctggcaagcttcctcgc

SEQ ID NO: 694694 - DNA, 25 bp, Artificial sequence
  Synthetic oligonucleotide
gcgttctggcgtagcgacaatccgt

SEQ ID NO: 694695 - DNA, 25 bp, Artificial sequence
  Synthetic oligonucleotide
attggcggaggcgttccggtgaacg

SEQ ID NO: 694696 - DNA, 25 bp, Artificial sequence
  Synthetic oligonucleotide
tgagtatcagccttctgctgttcgt

SEQ ID NO: 694697 - DNA, 25 bp, Artificial sequence
  Synthetic oligonucleotide
tgaagctgagtatcagccttctgct

SEQ ID NO: 694698 - DNA, 25 bp, Artificial sequence
  Synthetic oligonucleotide
acggagtgaagctgagtatcagcct

SEQ ID NO: 694699 - DNA, 25 bp, Artificial sequence
  Synthetic oligonucleotide
tggactacggagtgaagctgagtat

SEQ ID NO: 694700 - DNA, 25 bp, Artificial sequence
  Synthetic oligonucleotide
ccacggtggactacggagtgaagct

SEQ ID NO: 694701 - DNA, 25 bp, Artificial sequence
  Synthetic oligonucleotide
gaaatcgccacggtggactacggag

SEQ ID NO: 694702 - DNA, 25 bp, Artificial sequence
  Synthetic oligonucleotide
ctgggtggaaatcgccacggtggac

SEQ ID NO: 694703 - DNA, 25 bp, Artificial sequence
  Synthetic oligonucleotide
gcagcactgggtggaaatcgccacg

SEQ ID NO: 694704 - DNA, 25 bp, Artificial sequence
  Synthetic oligonucleotide
tcatggcgcagcactgggtggaaat

SEQ ID NO: 694705 - DNA, 25 bp, Artificial sequence
  Synthetic oligonucleotide
aatccgttcatggcgcagcactggg

SEQ ID NO: 694706 - DNA, 25 bp, Artificial sequence
  Synthetic oligonucleotide
tcgttcccggcactggtggaccgcg

SEQ ID NO: 694707 - DNA, 25 bp, Artificial sequence
  Synthetic oligonucleotide
tggcgtagcgacaatccgttcatgg

SEQ ID NO: 694708 - DNA, 25 bp, Artificial sequence
  Synthetic oligonucleotide
ccggcactggtggaccgcgccagtc

SEQ ID NO: 694709 - DNA, 25 bp, Artificial sequence
  Synthetic oligonucleotide
ttcgtggcgttctggcgtagcgaca

SEQ ID NO: 694710 - DNA, 25 bp, Artificial sequence
  Synthetic oligonucleotide
ttcttcttcgtggcgttctggcgta

SEQ ID NO: 694711 - DNA, 25 bp, Artificial sequence
  Synthetic oligonucleotide
ttcaccttcttcttcgtggcgttct

SEQ ID NO: 694712 - DNA, 25 bp, Artificial sequence
  Synthetic oligonucleotide
gacaccttcaccttcttcttcgtgg

SEQ ID NO: 694713 - DNA, 25 bp, Artificial sequence
  Synthetic oligonucleotide
tgctggacaccttcaccttcttctt

SEQ ID NO: 694714 - DNA, 25 bp, Artificial sequence
  Synthetic oligonucleotide
gcaacctgctggacaccttcacctt

SEQ ID NO: 694715 - DNA, 25 bp, Artificial sequence
  Synthetic oligonucleotide
tcctcggcaacctgctggacacctt

SEQ ID NO: 694716 - DNA, 25 bp, Artificial sequence
  Synthetic oligonucleotide
cgaccatcctcggcaacctgctgga

SEQ ID NO: 694717 - DNA, 25 bp, Artificial sequence
  Synthetic oligonucleotide
cgcctcgaccatcctcggcaacctg

SEQ ID NO: 694718 - DNA, 25 bp, Artificial sequence
  Synthetic oligonucleotide
gccagtcgcctcgaccatcctcggc

SEQ ID NO: 694719 - DNA, 25 bp, Artificial sequence
  Synthetic oligonucleotide
gaccgcgccagtcgcctcgaccatc

SEQ ID NO: 694720 - DNA, 25 bp, Artificial sequence
  Synthetic oligonucleotide
ttctgctgttcgtgccgctctacgg

SEQ ID NO: 694721 - DNA, 25 bp, Artificial sequence
  Synthetic oligonucleotide
agcgacaatccgttcatggcgcagc

SEQ ID NO: 694722 - DNA, 25 bp, Artificial sequence
  Synthetic oligonucleotide
gcaggaacaccgtcatttccttttc

SEQ ID NO: 694723 - DNA, 25 bp, Artificial sequence
  Synthetic oligonucleotide
ctgccgggcgcccgcgagatcgccg

SEQ ID NO: 694724 - DNA, 25 bp, Artificial sequence
  Synthetic oligonucleotide
ccaggcctgccgggcgcccgcgaga

SEQ ID NO: 694725 - DNA, 25 bp, Artificial sequence
  Synthetic oligonucleotide
ctgctcccaggcctgccgggcgccc

SEQ ID NO: 694726 - DNA, 25 bp, Artificial sequence
  Synthetic oligonucleotide
caggccctgctcccaggcctgccgg

SEQ ID NO: 694727 - DNA, 25 bp, Artificial sequence
  Synthetic oligonucleotide
agttgccaggccctgctcccaggcc

SEQ ID NO: 694728 - DNA, 25 bp, Artificial sequence
  Synthetic oligonucleotide
cgcggcagttgccaggccctgctcc

SEQ ID NO: 694729 - DNA, 25 bp, Artificial sequence
  Synthetic oligonucleotide
atgcgtcgcggcagttgccaggccc

SEQ ID NO: 694730 - DNA, 25 bp, Artificial sequence
  Synthetic oligonucleotide
gtcgccatgcgtcgcggcagttgcc

SEQ ID NO: 694731 - DNA, 25 bp, Artificial sequence
  Synthetic oligonucleotide
tgcttgtcgccatgcgtcgcggcag

SEQ ID NO: 694732 - DNA, 25 bp, Artificial sequence
  Synthetic oligonucleotide
tcggcctgcttgtcgccatgcgtcg

SEQ ID NO: 694733 - DNA, 25 bp, Artificial sequence
  Synthetic oligonucleotide
ccttttcggcctgcttgtcgccatg

SEQ ID NO: 694734 - DNA, 25 bp, Artificial sequence
  Synthetic oligonucleotide
cggccggcgggtggcgagaacgcgc

SEQ ID NO: 694735 - DNA, 25 bp, Artificial sequence
  Synthetic oligonucleotide
acaccgtcatttccttttcggcctg

SEQ ID NO: 694736 - DNA, 25 bp, Artificial sequence
  Synthetic oligonucleotide
tcgccggcagcctggcgcgccttgc

SEQ ID NO: 694737 - DNA, 25 bp, Artificial sequence
  Synthetic oligonucleotide
gcttgcgcaggaacaccgtcatttc

SEQ ID NO: 694738 - DNA, 25 bp, Artificial sequence
  Synthetic oligonucleotide
tgtcgagcttgcgcaggaacaccgt

SEQ ID NO: 694739 - DNA, 25 bp, Artificial sequence
  Synthetic oligonucleotide
tcgccctgtcgagcttgcgcaggaa

SEQ ID NO: 694740 - DNA, 25 bp, Artificial sequence
  Synthetic oligonucleotide
aggttctcgccctgtcgagcttgcg

SEQ ID NO: 694741 - DNA, 25 bp, Artificial sequence
  Synthetic oligonucleotide
acgctcaggttctcgccctgtcgag

SEQ ID NO: 694742 - DNA, 25 bp, Artificial sequence
  Synthetic oligonucleotide
ggccggacgctcaggttctcgccct

SEQ ID NO: 694743 - DNA, 25 bp, Artificial sequence
  Synthetic oligonucleotide
agccttggccggacgctcaggttct

SEQ ID NO: 694744 - DNA, 25 bp, Artificial sequence
  Synthetic oligonucleotide
tgcgcaagccttggccggacgctca

SEQ ID NO: 694745 - DNA, 25 bp, Artificial sequence
  Synthetic oligonucleotide
acgcgctgcgcaagccttggccgga

SEQ ID NO: 694746 - DNA, 25 bp, Artificial sequence
  Synthetic oligonucleotide
gcgagaacgcgctgcgcaagccttg

SEQ ID NO: 694747 - DNA, 25 bp, Artificial sequence
  Synthetic oligonucleotide
tcgagcatctcattggcggaggcgt

SEQ ID NO: 694748 - DNA, 25 bp, Artificial sequence
  Synthetic oligonucleotide
tcatttccttttcggcctgcttgtc

SEQ ID NO: 694749 - DNA, 25 bp, Artificial sequence
  Synthetic oligonucleotide
agcgctggaggtgttccgccgcgcg

SEQ ID NO: 694750 - DNA, 25 bp, Artificial sequence
  Synthetic oligonucleotide
cctacgtggtctcggtgttgttcca

SEQ ID NO: 694751 - DNA, 25 bp, Artificial sequence
  Synthetic oligonucleotide
agcagcgcattgtccacgcctttgg

SEQ ID NO: 694752 - DNA, 25 bp, Artificial sequence
  Synthetic oligonucleotide
gaagcgcagcagcgcattgtccacg

SEQ ID NO: 694753 - DNA, 25 bp, Artificial sequence
  Synthetic oligonucleotide
aggccgaagcgcagcagcgcattgt

SEQ ID NO: 694754 - DNA, 25 bp, Artificial sequence
  Synthetic oligonucleotide
ttgcccaggccgaagcgcagcagcg

SEQ ID NO: 694755 - DNA, 25 bp, Artificial sequence
  Synthetic oligonucleotide
agcccttgcccaggccgaagcgcag

SEQ ID NO: 694756 - DNA, 25 bp, Artificial sequence
  Synthetic oligonucleotide
caggtagcccttgcccaggccgaag

SEQ ID NO: 694757 - DNA, 25 bp, Artificial sequence
  Synthetic oligonucleotide
cgcgtccaggtagcccttgcccagg

SEQ ID NO: 694758 - DNA, 25 bp, Artificial sequence
  Synthetic oligonucleotide
gtcgcccgcgtccaggtagcccttg

SEQ ID NO: 694759 - DNA, 25 bp, Artificial sequence
  Synthetic oligonucleotide
ttcggcgtcgcccgcgtccaggtag

SEQ ID NO: 694760 - DNA, 25 bp, Artificial sequence
  Synthetic oligonucleotide
cgcgcgttcggcgtcgcccgcgtcc

SEQ ID NO: 694761 - DNA, 25 bp, Artificial sequence
  Synthetic oligonucleotide
gcgcccgcgagatcgccggcagcct

SEQ ID NO: 694762 - DNA, 25 bp, Artificial sequence
  Synthetic oligonucleotide
ggaggtgttccgccgcgcgttcggc

SEQ ID NO: 694763 - DNA, 25 bp, Artificial sequence
  Synthetic oligonucleotide
gcgagatcgccggcagcctggcgcg

SEQ ID NO: 694764 - DNA, 25 bp, Artificial sequence
  Synthetic oligonucleotide
ctacgcagcgctggaggtgttccgc

SEQ ID NO: 694765 - DNA, 25 bp, Artificial sequence
  Synthetic oligonucleotide
cctgctctacgcagcgctggaggtg

SEQ ID NO: 694766 - DNA, 25 bp, Artificial sequence
  Synthetic oligonucleotide
tcgggtcctgctctacgcagcgctg

SEQ ID NO: 694767 - DNA, 25 bp, Artificial sequence
  Synthetic oligonucleotide
aatacttcgggtcctgctctacgca

SEQ ID NO: 694768 - DNA, 25 bp, Artificial sequence
  Synthetic oligonucleotide
cggcggaatacttcgggtcctgctc

SEQ ID NO: 694769 - DNA, 25 bp, Artificial sequence
  Synthetic oligonucleotide
tccagccggcggaatacttcgggtc

SEQ ID NO: 694770 - DNA, 25 bp, Artificial sequence
  Synthetic oligonucleotide
gcagcttccagccggcggaatactt

SEQ ID NO: 694771 - DNA, 25 bp, Artificial sequence
  Synthetic oligonucleotide
gcccagcagcttccagccggcggaa

SEQ ID NO: 694772 - DNA, 25 bp, Artificial sequence
  Synthetic oligonucleotide
cgccttgcccagcagcttccagccg

SEQ ID NO: 694773 - DNA, 25 bp, Artificial sequence
  Synthetic oligonucleotide
ctggcgcgccttgcccagcagcttc

SEQ ID NO: 694774 - DNA, 25 bp, Artificial sequence
  Synthetic oligonucleotide
gcagcctggcgcgccttgcccagca

SEQ ID NO: 694775 - DNA, 25 bp, Artificial sequence
  Synthetic oligonucleotide
gaactccggccggcgggtggcgaga

SEQ ID NO: 694776 - DNA, 25 bp, Artificial sequence
  Synthetic oligonucleotide
ttccgccgcgcgttcggcgtcgccc

SEQ ID NO: 694777 - DNA, 25 bp, Artificial sequence
  Synthetic oligonucleotide
actgaacgctcttgcttcgacatgt

SEQ ID NO: 694778 - DNA, 25 bp, Artificial sequence
  Synthetic oligonucleotide
atgagtcgaagctagagggccggca

SEQ ID NO: 694779 - DNA, 25 bp, Artificial sequence
  Synthetic oligonucleotide
gaagcgatgagtcgaagctagaggg

SEQ ID NO: 694780 - DNA, 25 bp, Artificial sequence
  Synthetic oligonucleotide
ttgaccgaagcgatgagtcgaagct

SEQ ID NO: 694781 - DNA, 25 bp, Artificial sequence
  Synthetic oligonucleotide
cgggctttgaccgaagcgatgagtc

SEQ ID NO: 694782 - DNA, 25 bp, Artificial sequence
  Synthetic oligonucleotide
tcgcgttcgggctttgaccgaagcg

SEQ ID NO: 694783 - DNA, 25 bp, Artificial sequence
  Synthetic oligonucleotide
tcaggtgtcgcgttcgggctttgac

SEQ ID NO: 694784 - DNA, 25 bp, Artificial sequence
  Synthetic oligonucleotide
ttgaagtcaggtgtcgcgttcgggc

SEQ ID NO: 694785 - DNA, 25 bp, Artificial sequence
  Synthetic oligonucleotide
aagtagttgaagtcaggtgtcgcgt

SEQ ID NO: 694786 - DNA, 25 bp, Artificial sequence
  Synthetic oligonucleotide
cggaaaagtagttgaagtcaggtgt

SEQ ID NO: 694787 - DNA, 25 bp, Artificial sequence
  Synthetic oligonucleotide
tggctccggaaaagtagttgaagtc

SEQ ID NO: 694788 - DNA, 25 bp, Artificial sequence
  Synthetic oligonucleotide
gacatgttggctccggaaaagtagt

SEQ ID NO: 694789 - DNA, 25 bp, Artificial sequence
  Synthetic oligonucleotide
gcgggtggcgagaacgcgctgcgca

SEQ ID NO: 694790 - DNA, 25 bp, Artificial sequence
  Synthetic oligonucleotide
cgctcttgcttcgacatgttggctc

SEQ ID NO: 694791 - DNA, 25 bp, Artificial sequence
  Synthetic oligonucleotide
gccggcagtggtcgctcaatggggt

SEQ ID NO: 694792 - DNA, 25 bp, Artificial sequence
  Synthetic oligonucleotide
gacgggactgaacgctcttgcttcg

SEQ ID NO: 694793 - DNA, 25 bp, Artificial sequence
  Synthetic oligonucleotide
acataggacgggactgaacgctctt

SEQ ID NO: 694794 - DNA, 25 bp, Artificial sequence
  Synthetic oligonucleotide
tattcgacataggacgggactgaac

SEQ ID NO: 694795 - DNA, 25 bp, Artificial sequence
  Synthetic oligonucleotide
tatgggtattcgacataggacggga

SEQ ID NO: 694796 - DNA, 25 bp, Artificial sequence
  Synthetic oligonucleotide
ttgctcgtatgggtattcgacatag

SEQ ID NO: 694797 - DNA, 25 bp, Artificial sequence
  Synthetic oligonucleotide
aatcgcttgctcgtatgggtattcg

SEQ ID NO: 694798 - DNA, 25 bp, Artificial sequence
  Synthetic oligonucleotide
gtagagaatcgcttgctcgtatggg

SEQ ID NO: 694799 - DNA, 25 bp, Artificial sequence
  Synthetic oligonucleotide
gtgaacgtagagaatcgcttgctcg

SEQ ID NO: 694800 - DNA, 25 bp, Artificial sequence
  Synthetic oligonucleotide
gttccggtgaacgtagagaatcgct

SEQ ID NO: 694801 - DNA, 25 bp, Artificial sequence
  Synthetic oligonucleotide
ggaggcgttccggtgaacgtagaga

SEQ ID NO: 694802 - DNA, 25 bp, Artificial sequence
  Synthetic oligonucleotide
tccacgcctttggccagcatctttt

SEQ ID NO: 694803 - DNA, 25 bp, Artificial sequence
  Synthetic oligonucleotide
tgcttcgacatgttggctccggaaa

SEQ ID NO: 694804 - DNA, 25 bp, Artificial sequence
  Synthetic oligonucleotide
atgtgtggaacaggtctttgtaaaa

SEQ ID NO: 694805 - DNA, 25 bp, Artificial sequence
  Synthetic oligonucleotide
ccgtctgccggaactccggccggcg

SEQ ID NO: 694806 - DNA, 25 bp, Artificial sequence
  Synthetic oligonucleotide
agcacgcccgacccgtctgccggaa

SEQ ID NO: 694807 - DNA, 25 bp, Artificial sequence
  Synthetic oligonucleotide
tcgatgagcacgcccgacccgtctg

SEQ ID NO: 694808 - DNA, 25 bp, Artificial sequence
  Synthetic oligonucleotide
cagcgctcgatgagcacgcccgacc

SEQ ID NO: 694809 - DNA, 25 bp, Artificial sequence
  Synthetic oligonucleotide
ttctgccagcgctcgatgagcacgc

SEQ ID NO: 694810 - DNA, 25 bp, Artificial sequence
  Synthetic oligonucleotide
aaccgttctgccagcgctcgatgag

SEQ ID NO: 694811 - DNA, 25 bp, Artificial sequence
  Synthetic oligonucleotide
gctcgaaccgttctgccagcgctcg

SEQ ID NO: 694812 - DNA, 25 bp, Artificial sequence
  Synthetic oligonucleotide
gggcgtgctcgaaccgttctgccag

SEQ ID NO: 694813 - DNA, 25 bp, Artificial sequence
  Synthetic oligonucleotide
tcgtcggggcgtgctcgaaccgttc

SEQ ID NO: 694814 - DNA, 25 bp, Artificial sequence
  Synthetic oligonucleotide
aagtgtcgtcggggcgtgctcgaac

SEQ ID NO: 694815 - DNA, 25 bp, Artificial sequence
  Synthetic oligonucleotide
ttgtaaaagtgtcgtcggggcgtgc

SEQ ID NO: 694816 - DNA, 25 bp, Artificial sequence
  Synthetic oligonucleotide
cgaagctagagggccggcagtggtc

SEQ ID NO: 694817 - DNA, 25 bp, Artificial sequence
  Synthetic oligonucleotide
tggaacaggtctttgtaaaagtgtc

SEQ ID NO: 694818 - DNA, 25 bp, Artificial sequence
  Synthetic oligonucleotide
tagagggccggcagtggtcgctcaa

SEQ ID NO: 694819 - DNA, 25 bp, Artificial sequence
  Synthetic oligonucleotide
ctacgaatgtgtggaacaggtcttt

SEQ ID NO: 694820 - DNA, 25 bp, Artificial sequence
  Synthetic oligonucleotide
agttgcctacgaatgtgtggaacag

SEQ ID NO: 694821 - DNA, 25 bp, Artificial sequence
  Synthetic oligonucleotide
gacagaagttgcctacgaatgtgtg

SEQ ID NO: 694822 - DNA, 25 bp, Artificial sequence
  Synthetic oligonucleotide
catcgttgacagaagttgcctacga

SEQ ID NO: 694823 - DNA, 25 bp, Artificial sequence
  Synthetic oligonucleotide
aggctacatcgttgacagaagttgc

SEQ ID NO: 694824 - DNA, 25 bp, Artificial sequence
  Synthetic oligonucleotide
ggatgcaggctacatcgttgacaga

SEQ ID NO: 694825 - DNA, 25 bp, Artificial sequence
  Synthetic oligonucleotide
cgttcgggatgcaggctacatcgtt

SEQ ID NO: 694826 - DNA, 25 bp, Artificial sequence
  Synthetic oligonucleotide
tgttgggcgttcgggatgcaggcta

SEQ ID NO: 694827 - DNA, 25 bp, Artificial sequence
  Synthetic oligonucleotide
atggggtgttgggcgttcgggatgc

SEQ ID NO: 694828 - DNA, 25 bp, Artificial sequence
  Synthetic oligonucleotide
cgctcaatggggtgttgggcgttcg

SEQ ID NO: 694829 - DNA, 25 bp, Artificial sequence
  Synthetic oligonucleotide
agtggtcgctcaatggggtgttggg

SEQ ID NO: 694830 - DNA, 25 bp, Artificial sequence
  Synthetic oligonucleotide
atctcattggcggaggcgttccggt

SEQ ID NO: 694831 - DNA, 25 bp, Artificial sequence
  Synthetic oligonucleotide
caggtctttgtaaaagtgtcgtcgg

SEQ ID NO: 694832 - DNA, 25 bp, Artificial sequence
  Synthetic oligonucleotide
caacttccacgggctgggcaagctg

SEQ ID NO: 694833 - DNA, 25 bp, Artificial sequence
  Synthetic oligonucleotide
agaccggcgtgatggagggcgcgcg

SEQ ID NO: 694834 - DNA, 25 bp, Artificial sequence
  Synthetic oligonucleotide
tggacaagcacctggccaggaaagg

SEQ ID NO: 694835 - DNA, 25 bp, Artificial sequence
  Synthetic oligonucleotide
gggcggtggacaagcacctggccag

SEQ ID NO: 694836 - DNA, 25 bp, Artificial sequence
  Synthetic oligonucleotide
ggccctgggcggtggacaagcacct

SEQ ID NO: 694837 - DNA, 25 bp, Artificial sequence
  Synthetic oligonucleotide
cgaagtggccctgggcggtggacaa

SEQ ID NO: 694838 - DNA, 25 bp, Artificial sequence
  Synthetic oligonucleotide
cccgccgaagtggccctgggcggtg

SEQ ID NO: 694839 - DNA, 25 bp, Artificial sequence
  Synthetic oligonucleotide
atcggcccgccgaagtggccctggg

SEQ ID NO: 694840 - DNA, 25 bp, Artificial sequence
  Synthetic oligonucleotide
aagaagatcggcccgccgaagtggc

SEQ ID NO: 694841 - DNA, 25 bp, Artificial sequence
  Synthetic oligonucleotide
ctgatcaagaagatcggcccgccga

SEQ ID NO: 694842 - DNA, 25 bp, Artificial sequence
  Synthetic oligonucleotide
gaagacctgatcaagaagatcggcc

SEQ ID NO: 694843 - DNA, 25 bp, Artificial sequence
  Synthetic oligonucleotide
aagctggaagacctgatcaagaaga

SEQ ID NO: 694844 - DNA, 25 bp, Artificial sequence
  Synthetic oligonucleotide
tggccaggaaaggcgcgctgatctt

SEQ ID NO: 694845 - DNA, 25 bp, Artificial sequence
  Synthetic oligonucleotide
cacgggctgggcaagctggaagacc

SEQ ID NO: 694846 - DNA, 25 bp, Artificial sequence
  Synthetic oligonucleotide
ggaaaggcgcgctgatcttcgcccg

SEQ ID NO: 694847 - DNA, 25 bp, Artificial sequence
  Synthetic oligonucleotide
tcggccaacttccacgggctgggca

SEQ ID NO: 694848 - DNA, 25 bp, Artificial sequence
  Synthetic oligonucleotide
atcaactcggccaacttccacgggc

SEQ ID NO: 694849 - DNA, 25 bp, Artificial sequence
  Synthetic oligonucleotide
tgaagatcaactcggccaacttcca

SEQ ID NO: 694850 - DNA, 25 bp, Artificial sequence
  Synthetic oligonucleotide
ctacctgaagatcaactcggccaac

SEQ ID NO: 694851 - DNA, 25 bp, Artificial sequence
  Synthetic oligonucleotide
catggactacctgaagatcaactcg

SEQ ID NO: 694852 - DNA, 25 bp, Artificial sequence
  Synthetic oligonucleotide
gctgggcatggactacctgaagatc

SEQ ID NO: 694853 - DNA, 25 bp, Artificial sequence
  Synthetic oligonucleotide
ccacctgctgggcatggactacctg

SEQ ID NO: 694854 - DNA, 25 bp, Artificial sequence
  Synthetic oligonucleotide
caagttccacctgctgggcatggac

SEQ ID NO: 694855 - DNA, 25 bp, Artificial sequence
  Synthetic oligonucleotide
gaagagcaagttccacctgctgggc

SEQ ID NO: 694856 - DNA, 25 bp, Artificial sequence
  Synthetic oligonucleotide
cccgcagaagagcaagttccacctg

SEQ ID NO: 694857 - DNA, 25 bp, Artificial sequence
  Synthetic oligonucleotide
ccttccacccgcagaagagcaagtt

SEQ ID NO: 694858 - DNA, 25 bp, Artificial sequence
  Synthetic oligonucleotide
ctgggcaagctggaagacctgatca

SEQ ID NO: 694859 - DNA, 25 bp, Artificial sequence
  Synthetic oligonucleotide
tcaaggacctggtgctttgggacac

SEQ ID NO: 694860 - DNA, 25 bp, Artificial sequence
  Synthetic oligonucleotide
atccgcctcccggtgcgcgcgacgc

SEQ ID NO: 694861 - DNA, 25 bp, Artificial sequence
  Synthetic oligonucleotide
atggccaggtgcagaccggcgtgat

SEQ ID NO: 694862 - DNA, 25 bp, Artificial sequence
  Synthetic oligonucleotide
tcctcgatggccaggtgcagaccgg

SEQ ID NO: 694863 - DNA, 25 bp, Artificial sequence
  Synthetic oligonucleotide
acgccatcctcgatggccaggtgca

SEQ ID NO: 694864 - DNA, 25 bp, Artificial sequence
  Synthetic oligonucleotide
gccagcacgccatcctcgatggcca

SEQ ID NO: 694865 - DNA, 25 bp, Artificial sequence
  Synthetic oligonucleotide
acagccgccagcacgccatcctcga

SEQ ID NO: 694866 - DNA, 25 bp, Artificial sequence
  Synthetic oligonucleotide
gcagcgacagccgccagcacgccat

SEQ ID NO: 694867 - DNA, 25 bp, Artificial sequence
  Synthetic oligonucleotide
acgtcggcagcgacagccgccagca

SEQ ID NO: 694868 - DNA, 25 bp, Artificial sequence
  Synthetic oligonucleotide
tgagggacgtcggcagcgacagccg

SEQ ID NO: 694869 - DNA, 25 bp, Artificial sequence
  Synthetic oligonucleotide
ctccgctgagggacgtcggcagcga

SEQ ID NO: 694870 - DNA, 25 bp, Artificial sequence
  Synthetic oligonucleotide
gggacactccgctgagggacgtcgg

SEQ ID NO: 694871 - DNA, 25 bp, Artificial sequence
  Synthetic oligonucleotide
agcacctggccaggaaaggcgcgct

SEQ ID NO: 694872 - DNA, 25 bp, Artificial sequence
  Synthetic oligonucleotide
acctggtgctttgggacactccgct

SEQ ID NO: 694873 - DNA, 25 bp, Artificial sequence
  Synthetic oligonucleotide
tctacggggtgttcgccaccttcca

SEQ ID NO: 694874 - DNA, 25 bp, Artificial sequence
  Synthetic oligonucleotide
tccggatcaaggacctggtgctttg

SEQ ID NO: 694875 - DNA, 25 bp, Artificial sequence
  Synthetic oligonucleotide
acggcatccggatcaaggacctggt

SEQ ID NO: 694876 - DNA, 25 bp, Artificial sequence
  Synthetic oligonucleotide
gtgccacggcatccggatcaaggac

SEQ ID NO: 694877 - DNA, 25 bp, Artificial sequence
  Synthetic oligonucleotide
gtggagtgccacggcatccggatca

SEQ ID NO: 694878 - DNA, 25 bp, Artificial sequence
  Synthetic oligonucleotide
ggctgcgtggagtgccacggcatcc

SEQ ID NO: 694879 - DNA, 25 bp, Artificial sequence
  Synthetic oligonucleotide
gaaggtggctgcgtggagtgccacg

SEQ ID NO: 694880 - DNA, 25 bp, Artificial sequence
  Synthetic oligonucleotide
accgacgaaggtggctgcgtggagt

SEQ ID NO: 694881 - DNA, 25 bp, Artificial sequence
  Synthetic oligonucleotide
cgcaagaccgacgaaggtggctgcg

SEQ ID NO: 694882 - DNA, 25 bp, Artificial sequence
  Synthetic oligonucleotide
ttcgcccgcaagaccgacgaaggtg

SEQ ID NO: 694883 - DNA, 25 bp, Artificial sequence
  Synthetic oligonucleotide
ctgatcttcgcccgcaagaccgacg

SEQ ID NO: 694884 - DNA, 25 bp, Artificial sequence
  Synthetic oligonucleotide
ggcgcgctgatcttcgcccgcaaga

SEQ ID NO: 694885 - DNA, 25 bp, Artificial sequence
  Synthetic oligonucleotide
tgctttgggacactccgctgaggga

SEQ ID NO: 694886 - DNA, 25 bp, Artificial sequence
  Synthetic oligonucleotide
atcgagcgcgcgctgcccaaggaca

SEQ ID NO: 694887 - DNA, 25 bp, Artificial sequence
  Synthetic oligonucleotide
ctggatatcggcaccgcgccgccct

SEQ ID NO: 694888 - DNA, 25 bp, Artificial sequence
  Synthetic oligonucleotide
accgggctggatatcggcaccgcgc

SEQ ID NO: 694889 - DNA, 25 bp, Artificial sequence
  Synthetic oligonucleotide
cgccttaccgggctggatatcggca

SEQ ID NO: 694890 - DNA, 25 bp, Artificial sequence
  Synthetic oligonucleotide
cttcaaccgccttaccgggctggat

SEQ ID NO: 694891 - DNA, 25 bp, Artificial sequence
  Synthetic oligonucleotide
gatgatcttcaaccgccttaccggg

SEQ ID NO: 694892 - DNA, 25 bp, Artificial sequence
  Synthetic oligonucleotide
ggtatcgatgatcttcaaccgcctt

SEQ ID NO: 694893 - DNA, 25 bp, Artificial sequence
  Synthetic oligonucleotide
ggacgcggtatcgatgatcttcaac

SEQ ID NO: 694894 - DNA, 25 bp, Artificial sequence
  Synthetic oligonucleotide
gcggctggacgcggtatcgatgatc

SEQ ID NO: 694895 - DNA, 25 bp, Artificial sequence
  Synthetic oligonucleotide
gaccggcgcggctggacgcggtatc

SEQ ID NO: 694896 - DNA, 25 bp, Artificial sequence
  Synthetic oligonucleotide
cctggggaccggcgcggctggacgc

SEQ ID NO: 694897 - DNA, 25 bp, Artificial sequence
  Synthetic oligonucleotide
aggacacctggggaccggcgcggct

SEQ ID NO: 694898 - DNA, 25 bp, Artificial sequence
  Synthetic oligonucleotide
tcgccaccttccacccgcagaagag

SEQ ID NO: 694899 - DNA, 25 bp, Artificial sequence
  Synthetic oligonucleotide
cgcgcgctgcccaaggacacctggg

SEQ ID NO: 694900 - DNA, 25 bp, Artificial sequence
  Synthetic oligonucleotide
ccgccctacctgattcccgacaaca

SEQ ID NO: 694901 - DNA, 25 bp, Artificial sequence
  Synthetic oligonucleotide
cgctgatcgagcgcgcgctgcccaa

SEQ ID NO: 694902 - DNA, 25 bp, Artificial sequence
  Synthetic oligonucleotide
atcacacgctgatcgagcgcgcgct

SEQ ID NO: 694903 - DNA, 25 bp, Artificial sequence
  Synthetic oligonucleotide
agccctatcacacgctgatcgagcg

SEQ ID NO: 694904 - DNA, 25 bp, Artificial sequence
  Synthetic oligonucleotide
ggtacgagccctatcacacgctgat

SEQ ID NO: 694905 - DNA, 25 bp, Artificial sequence
  Synthetic oligonucleotide
aggaatggtacgagccctatcacac

SEQ ID NO: 694906 - DNA, 25 bp, Artificial sequence
  Synthetic oligonucleotide
cggtgaaggaatggtacgagcccta

SEQ ID NO: 694907 - DNA, 25 bp, Artificial sequence
  Synthetic oligonucleotide
ctcgcggcggtgaaggaatggtacg

SEQ ID NO: 694908 - DNA, 25 bp, Artificial sequence
  Synthetic oligonucleotide
gctctgctcgcggcggtgaaggaat

SEQ ID NO: 694909 - DNA, 25 bp, Artificial sequence
  Synthetic oligonucleotide
gcgacgctctgctcgcggcggtgaa

SEQ ID NO: 694910 - DNA, 25 bp, Artificial sequence
  Synthetic oligonucleotide
gtgcgcgcgacgctctgctcgcggc

SEQ ID NO: 694911 - DNA, 25 bp, Artificial sequence
  Synthetic oligonucleotide
acctgaaactggtagtagtgctgca

SEQ ID NO: 694912 - DNA, 25 bp, Artificial sequence
  Synthetic oligonucleotide
ctgcccaaggacacctggggaccgg

SEQ ID NO: 694913 - DNA, 25 bp, Artificial sequence
  Synthetic oligonucleotide
gcgcggcagaacaagacccagtggc

SEQ ID NO: 694914 - DNA, 25 bp, Artificial sequence
  Synthetic oligonucleotide
gcgtgatggagggcgcgcggatgcc

SEQ ID NO: 694915 - DNA, 25 bp, Artificial sequence
  Synthetic oligonucleotide
tcggcgaggtctacggggtgttcgc

SEQ ID NO: 694916 - DNA, 25 bp, Artificial sequence
  Synthetic oligonucleotide
gcaatgtcggcgaggtctacggggt

SEQ ID NO: 694917 - DNA, 25 bp, Artificial sequence
  Synthetic oligonucleotide
tggcgcgcaatgtcggcgaggtcta

SEQ ID NO: 694918 - DNA, 25 bp, Artificial sequence
  Synthetic oligonucleotide
tcggcctggcgcgcaatgtcggcga

SEQ ID NO: 694919 - DNA, 25 bp, Artificial sequence
  Synthetic oligonucleotide
acctgctcggcctggcgcgcaatgt

SEQ ID NO: 694920 - DNA, 25 bp, Artificial sequence
  Synthetic oligonucleotide
gcaacgacctgctcggcctggcgcg

SEQ ID NO: 694921 - DNA, 25 bp, Artificial sequence
  Synthetic oligonucleotide
ccaacggcaacgacctgctcggcct

SEQ ID NO: 694922 - DNA, 25 bp, Artificial sequence
  Synthetic oligonucleotide
tcgccgccaacggcaacgacctgct

SEQ ID NO: 694923 - DNA, 25 bp, Artificial sequence
  Synthetic oligonucleotide
ccggcttcgccgccaacggcaacga

SEQ ID NO: 694924 - DNA, 25 bp, Artificial sequence
  Synthetic oligonucleotide
cagtggcccggcttcgccgccaacg

SEQ ID NO: 694925 - DNA, 25 bp, Artificial sequence
  Synthetic oligonucleotide
atcggcaccgcgccgccctacctga

SEQ ID NO: 694926 - DNA, 25 bp, Artificial sequence
  Synthetic oligonucleotide
cagaacaagacccagtggcccggct

SEQ ID NO: 694927 - DNA, 25 bp, Artificial sequence
  Synthetic oligonucleotide
accgcgccgccctacctgattcccg

SEQ ID NO: 694928 - DNA, 25 bp, Artificial sequence
  Synthetic oligonucleotide
aacgcggcgcggcagaacaagaccc

SEQ ID NO: 694929 - DNA, 25 bp, Artificial sequence
  Synthetic oligonucleotide
ctgtggaacgcggcgcggcagaaca

SEQ ID NO: 694930 - DNA, 25 bp, Artificial sequence
  Synthetic oligonucleotide
ccgttcctgtggaacgcggcgcggc

SEQ ID NO: 694931 - DNA, 25 bp, Artificial sequence
  Synthetic oligonucleotide
cgctatccgttcctgtggaacgcgg

SEQ ID NO: 694932 - DNA, 25 bp, Artificial sequence
  Synthetic oligonucleotide
ccggtgcgctatccgttcctgtgga

SEQ ID NO: 694933 - DNA, 25 bp, Artificial sequence
  Synthetic oligonucleotide
gatgcgccggtgcgctatccgttcc

SEQ ID NO: 694934 - DNA, 25 bp, Artificial sequence
  Synthetic oligonucleotide
gcggccgatgcgccggtgcgctatc

SEQ ID NO: 694935 - DNA, 25 bp, Artificial sequence
  Synthetic oligonucleotide
atcaaggcggccgatgcgccggtgc

SEQ ID NO: 694936 - DNA, 25 bp, Artificial sequence
  Synthetic oligonucleotide
cgacaacatcaaggcggccgatgcg

SEQ ID NO: 694937 - DNA, 25 bp, Artificial sequence
  Synthetic oligonucleotide
attcccgacaacatcaaggcggccg

SEQ ID NO: 694938 - DNA, 25 bp, Artificial sequence
  Synthetic oligonucleotide
tacctgattcccgacaacatcaagg

SEQ ID NO: 694939 - DNA, 25 bp, Artificial sequence
  Synthetic oligonucleotide
gggtgttcgccaccttccacccgca

SEQ ID NO: 694940 - DNA, 25 bp, Artificial sequence
  Synthetic oligonucleotide
aagacccagtggcccggcttcgccg

SEQ ID NO: 694941 - DNA, 25 bp, Artificial sequence
  Synthetic oligonucleotide
accggctgcgagcagcgtgattccg

SEQ ID NO: 694942 - DNA, 25 bp, Artificial sequence
  Synthetic oligonucleotide
aggtgcagaccggcgtgatggaggg

SEQ ID NO: 694943 - DNA, 25 bp, Artificial sequence
  Synthetic oligonucleotide
gagaagcgtgcgctgctggagtatc

SEQ ID NO: 694944 - DNA, 25 bp, Artificial sequence
  Synthetic oligonucleotide
ggccgaggagaagcgtgcgctgctg

SEQ ID NO: 694945 - DNA, 25 bp, Artificial sequence
  Synthetic oligonucleotide
cctgtcggccgaggagaagcgtgcg

SEQ ID NO: 694946 - DNA, 25 bp, Artificial sequence
  Synthetic oligonucleotide
caccagcctgtcggccgaggagaag

SEQ ID NO: 694947 - DNA, 25 bp, Artificial sequence
  Synthetic oligonucleotide
tacggcaccagcctgtcggccgagg

SEQ ID NO: 694948 - DNA, 25 bp, Artificial sequence
  Synthetic oligonucleotide
catgagtacggcaccagcctgtcgg

SEQ ID NO: 694949 - DNA, 25 bp, Artificial sequence
  Synthetic oligonucleotide
tgcggccatgagtacggcaccagcc

SEQ ID NO: 694950 - DNA, 25 bp, Artificial sequence
  Synthetic oligonucleotide
agccgctgcggccatgagtacggca

SEQ ID NO: 694951 - DNA, 25 bp, Artificial sequence
  Synthetic oligonucleotide
ggcaacagccgctgcggccatgagt

SEQ ID NO: 694952 - DNA, 25 bp, Artificial sequence
  Synthetic oligonucleotide
tgattccggcaacagccgctgcggc

SEQ ID NO: 694953 - DNA, 25 bp, Artificial sequence
  Synthetic oligonucleotide
ctgctggagtatctgaaggtcctgt

SEQ ID NO: 694954 - DNA, 25 bp, Artificial sequence
  Synthetic oligonucleotide
tgcgagcagcgtgattccggcaaca

SEQ ID NO: 694955 - DNA, 25 bp, Artificial sequence
  Synthetic oligonucleotide
gagtatctgaaggtcctgtagtgaa

SEQ ID NO: 694956 - DNA, 25 bp, Artificial sequence
  Synthetic oligonucleotide
aagaccaccggctgcgagcagcgtg

SEQ ID NO: 694957 - DNA, 25 bp, Artificial sequence
  Synthetic oligonucleotide
gtgctgaagaccaccggctgcgagc

SEQ ID NO: 694958 - DNA, 25 bp, Artificial sequence
  Synthetic oligonucleotide
agctatgtgctgaagaccaccggct

SEQ ID NO: 694959 - DNA, 25 bp, Artificial sequence
  Synthetic oligonucleotide
ttcggcagctatgtgctgaagacca

SEQ ID NO: 694960 - DNA, 25 bp, Artificial sequence
  Synthetic oligonucleotide
acccaattcggcagctatgtgctga

SEQ ID NO: 694961 - DNA, 25 bp, Artificial sequence
  Synthetic oligonucleotide
cagcagacccaattcggcagctatg

SEQ ID NO: 694962 - DNA, 25 bp, Artificial sequence
  Synthetic oligonucleotide
gccgcccagcagacccaattcggca

SEQ ID NO: 694963 - DNA, 25 bp, Artificial sequence
  Synthetic oligonucleotide
ggcctcgccgcccagcagacccaat

SEQ ID NO: 694964 - DNA, 25 bp, Artificial sequence
  Synthetic oligonucleotide
caaggtcggcctcgccgcccagcag

SEQ ID NO: 694965 - DNA, 25 bp, Artificial sequence
  Synthetic oligonucleotide
cgtggacaaggtcggcctcgccgcc

SEQ ID NO: 694966 - DNA, 25 bp, Artificial sequence
  Synthetic oligonucleotide
tacgacgtggacaaggtcggcctcg

SEQ ID NO: 694967 - DNA, 25 bp, Artificial sequence
  Synthetic oligonucleotide
cagcgtgattccggcaacagccgct

SEQ ID NO: 694968 - DNA, 25 bp, Artificial sequence
  Synthetic oligonucleotide
cagcgagatgtccgccaccccgagg

SEQ ID NO: 694969 - DNA, 25 bp, Artificial sequence
  Synthetic oligonucleotide
tcgtcgacattgaccatcacatcgg

SEQ ID NO: 694970 - DNA, 25 bp, Artificial sequence
  Synthetic oligonucleotide
gccgcgtcgtcgacattgaccatca

SEQ ID NO: 694971 - DNA, 25 bp, Artificial sequence
  Synthetic oligonucleotide
cgcaccgccgcgtcgtcgacattga

SEQ ID NO: 694972 - DNA, 25 bp, Artificial sequence
  Synthetic oligonucleotide
ttggcgcgcaccgccgcgtcgtcga

SEQ ID NO: 694973 - DNA, 25 bp, Artificial sequence
  Synthetic oligonucleotide
tagcggttggcgcgcaccgccgcgt

SEQ ID NO: 694974 - DNA, 25 bp, Artificial sequence
  Synthetic oligonucleotide
gcgcatagcggttggcgcgcaccgc

SEQ ID NO: 694975 - DNA, 25 bp, Artificial sequence
  Synthetic oligonucleotide
ccagcagcgcatagcggttggcgcg

SEQ ID NO: 694976 - DNA, 25 bp, Artificial sequence
  Synthetic oligonucleotide
gcttggccagcagcgcatagcggtt

SEQ ID NO: 694977 - DNA, 25 bp, Artificial sequence
  Synthetic oligonucleotide
cgcgcagcttggccagcagcgcata

SEQ ID NO: 694978 - DNA, 25 bp, Artificial sequence
  Synthetic oligonucleotide
aacgacccgcgcagcttggccagca

SEQ ID NO: 694979 - DNA, 25 bp, Artificial sequence
  Synthetic oligonucleotide
ccgaggaacgacccgcgcagcttgg

SEQ ID NO: 694980 - DNA, 25 bp, Artificial sequence
  Synthetic oligonucleotide
cgtgcgctgctggagtatctgaagg

SEQ ID NO: 694981 - DNA, 25 bp, Artificial sequence
  Synthetic oligonucleotide
agatgtccgccaccccgaggaacga

SEQ ID NO: 694982 - DNA, 25 bp, Artificial sequence
  Synthetic oligonucleotide
cccggtgggctcggcctacgacgtg

SEQ ID NO: 694983 - DNA, 25 bp, Artificial sequence
  Synthetic oligonucleotide
gccgagcagcgagatgtccgccacc

SEQ ID NO: 694984 - DNA, 25 bp, Artificial sequence
  Synthetic oligonucleotide
gctcagccgagcagcgagatgtccg

SEQ ID NO: 694985 - DNA, 25 bp, Artificial sequence
  Synthetic oligonucleotide
ggactggctcagccgagcagcgaga

SEQ ID NO: 694986 - DNA, 25 bp, Artificial sequence
  Synthetic oligonucleotide
gaggcgggactggctcagccgagca

SEQ ID NO: 694987 - DNA, 25 bp, Artificial sequence
  Synthetic oligonucleotide
tcttcgaggcgggactggctcagcc

SEQ ID NO: 694988 - DNA, 25 bp, Artificial sequence
  Synthetic oligonucleotide
gccttttcttcgaggcgggactggc

SEQ ID NO: 694989 - DNA, 25 bp, Artificial sequence
  Synthetic oligonucleotide
cggtgtcgcgaggacgccgggcctt

SEQ ID NO: 694990 - DNA, 25 bp, Artificial sequence
  Synthetic oligonucleotide
aaggcccggtgtcgcgaggacgccg

SEQ ID NO: 694991 - DNA, 25 bp, Artificial sequence
  Synthetic oligonucleotide
tgaaaaaggcccggtgtcgcgagga

SEQ ID NO: 694992 - DNA, 25 bp, Artificial sequence
  Synthetic oligonucleotide
ctgtagtgaaaaaggcccggtgtcg

SEQ ID NO: 694993 - DNA, 25 bp, Artificial sequence
  Synthetic oligonucleotide
ctgaaggtcctgtagtgaaaaaggc

SEQ ID NO: 694994 - DNA, 25 bp, Artificial sequence
  Synthetic oligonucleotide
gccaccccgaggaacgacccgcgca

SEQ ID NO: 694995 - DNA, 25 bp, Artificial sequence
  Synthetic oligonucleotide
tagcggtggccggttcgatcctgca

SEQ ID NO: 694996 - DNA, 25 bp, Artificial sequence
  Synthetic oligonucleotide
aagccggaaagcgtgatgaccgacg

SEQ ID NO: 694997 - DNA, 25 bp, Artificial sequence
  Synthetic oligonucleotide
gcggtcaagccggaaagcgtgatga

SEQ ID NO: 694998 - DNA, 25 bp, Artificial sequence
  Synthetic oligonucleotide
gcggcggcggtcaagccggaaagcg

SEQ ID NO: 694999 - DNA, 25 bp, Artificial sequence
  Synthetic oligonucleotide
gccaaggcggcggcggtcaagccgg

SEQ ID NO: 695000 - DNA, 25 bp, Artificial sequence
  Synthetic oligonucleotide
cacgatgccaaggcggcggcggtca

SEQ ID NO: 695001 - DNA, 25 bp, Artificial sequence
  Synthetic oligonucleotide
gagaagcacgatgccaaggcggcgg

SEQ ID NO: 695002 - DNA, 25 bp, Artificial sequence
  Synthetic oligonucleotide
tcggtgagaagcacgatgccaaggc

SEQ ID NO: 695003 - DNA, 25 bp, Artificial sequence
  Synthetic oligonucleotide
gatcctcggtgagaagcacgatgcc

SEQ ID NO: 695004 - DNA, 25 bp, Artificial sequence
  Synthetic oligonucleotide
cgtgccgatcctcggtgagaagcac

SEQ ID NO: 695005 - DNA, 25 bp, Artificial sequence
  Synthetic oligonucleotide
gcacttcgtgccgatcctcggtgag

SEQ ID NO: 695006 - DNA, 25 bp, Artificial sequence
  Synthetic oligonucleotide
cctgcagcacttcgtgccgatcctc

SEQ ID NO: 695007 - DNA, 25 bp, Artificial sequence
  Synthetic oligonucleotide
tcggcctacgacgtggacaaggtcg

SEQ ID NO: 695008 - DNA, 25 bp, Artificial sequence
  Synthetic oligonucleotide
tggccggttcgatcctgcagcactt

SEQ ID NO: 695009 - DNA, 25 bp, Artificial sequence
  Synthetic oligonucleotide
accgacgaaacccggcaactgctga

SEQ ID NO: 695010 - DNA, 25 bp, Artificial sequence
  Synthetic oligonucleotide
ctcgccgtagcggtggccggttcga

SEQ ID NO: 695011 - DNA, 25 bp, Artificial sequence
  Synthetic oligonucleotide
gatgtactcgccgtagcggtggccg

SEQ ID NO: 695012 - DNA, 25 bp, Artificial sequence
  Synthetic oligonucleotide
gccttcgatgtactcgccgtagcgg

SEQ ID NO: 695013 - DNA, 25 bp, Artificial sequence
  Synthetic oligonucleotide
gacggagccttcgatgtactcgccg

SEQ ID NO: 695014 - DNA, 25 bp, Artificial sequence
  Synthetic oligonucleotide
gcgaccgacggagccttcgatgtac

SEQ ID NO: 695015 - DNA, 25 bp, Artificial sequence
  Synthetic oligonucleotide
ctgaaggcgaccgacggagccttcg

SEQ ID NO: 695016 - DNA, 25 bp, Artificial sequence
  Synthetic oligonucleotide
cagccgctgaaggcgaccgacggag

SEQ ID NO: 695017 - DNA, 25 bp, Artificial sequence
  Synthetic oligonucleotide
ttcggccagccgctgaaggcgaccg

SEQ ID NO: 695018 - DNA, 25 bp, Artificial sequence
  Synthetic oligonucleotide
atgccgttcggccagccgctgaagg

SEQ ID NO: 695019 - DNA, 25 bp, Artificial sequence
  Synthetic oligonucleotide
cgcgcggatgccgttcggccagccg

SEQ ID NO: 695020 - DNA, 25 bp, Artificial sequence
  Synthetic oligonucleotide
tggagggcgcgcggatgccgttcgg

SEQ ID NO: 695021 - DNA, 25 bp, Artificial sequence
  Synthetic oligonucleotide
gttcgatcctgcagcacttcgtgcc

SEQ ID NO: 695022 - DNA, 25 bp, Artificial sequence
  Synthetic oligonucleotide
atctgggcagcggcgccgtacctgc

SEQ ID NO: 695023 - DNA, 25 bp, Artificial sequence
  Synthetic oligonucleotide
gggccaatccgcctcccggtgcgcg

SEQ ID NO: 695024 - DNA, 25 bp, Artificial sequence
  Synthetic oligonucleotide
tggaatccttcccggtgggctcggc

SEQ ID NO: 695025 - DNA, 25 bp, Artificial sequence
  Synthetic oligonucleotide
cggccgcggagcgggtggaatcctt

SEQ ID NO: 695026 - DNA, 25 bp, Artificial sequence
  Synthetic oligonucleotide
tgaagccggccgcggagcgggtgga

SEQ ID NO: 695027 - DNA, 25 bp, Artificial sequence
  Synthetic oligonucleotide
agttgctgaagccggccgcggagcg

SEQ ID NO: 695028 - DNA, 25 bp, Artificial sequence
  Synthetic oligonucleotide
tggaagagttgctgaagccggccgc

SEQ ID NO: 695029 - DNA, 25 bp, Artificial sequence
  Synthetic oligonucleotide
cgaccctggaagagttgctgaagcc

SEQ ID NO: 695030 - DNA, 25 bp, Artificial sequence
  Synthetic oligonucleotide
cggtgccgaccctggaagagttgct

SEQ ID NO: 695031 - DNA, 25 bp, Artificial sequence
  Synthetic oligonucleotide
acggctcggtgccgaccctggaaga

SEQ ID NO: 695032 - DNA, 25 bp, Artificial sequence
  Synthetic oligonucleotide
tgcacaacggctcggtgccgaccct

SEQ ID NO: 695033 - DNA, 25 bp, Artificial sequence
  Synthetic oligonucleotide
gtacctgcacaacggctcggtgccg

SEQ ID NO: 695034 - DNA, 25 bp, Artificial sequence
  Synthetic oligonucleotide
gaaagcgtgatgaccgacgaaaccc

SEQ ID NO: 695035 - DNA, 25 bp, Artificial sequence
  Synthetic oligonucleotide
gcagcggcgccgtacctgcacaacg

SEQ ID NO: 695036 - DNA, 25 bp, Artificial sequence
  Synthetic oligonucleotide
gtgatgaccgacgaaacccggcaac

SEQ ID NO: 695037 - DNA, 25 bp, Artificial sequence
  Synthetic oligonucleotide
aggggatctgggcagcggcgccgta

SEQ ID NO: 695038 - DNA, 25 bp, Artificial sequence
  Synthetic oligonucleotide
gtcctgcaggggatctgggcagcgg

SEQ ID NO: 695039 - DNA, 25 bp, Artificial sequence
  Synthetic oligonucleotide
tcgcgggtcctgcaggggatctggg

SEQ ID NO: 695040 - DNA, 25 bp, Artificial sequence
  Synthetic oligonucleotide
tacgagtcgcgggtcctgcagggga

SEQ ID NO: 695041 - DNA, 25 bp, Artificial sequence
  Synthetic oligonucleotide
ctacccctacgagtcgcgggtcctg

SEQ ID NO: 695042 - DNA, 25 bp, Artificial sequence
  Synthetic oligonucleotide
gaagccggtgcgtacccaggccgac

SEQ ID NO: 695043 - DNA, 25 bp, Artificial sequence
  Synthetic oligonucleotide
ttccagaagccggtgcgtacccagg

SEQ ID NO: 695044 - DNA, 25 bp, Artificial sequence
  Synthetic oligonucleotide
accgccttccagaagccggtgcgta

SEQ ID NO: 695045 - DNA, 25 bp, Artificial sequence
  Synthetic oligonucleotide
tgctgaccgccttccagaagccggt

SEQ ID NO: 695046 - DNA, 25 bp, Artificial sequence
  Synthetic oligonucleotide
ggcaactgctgaccgccttccagaa

SEQ ID NO: 695047 - DNA, 25 bp, Artificial sequence
  Synthetic oligonucleotide
gaaacccggcaactgctgaccgcct

SEQ ID NO: 695048 - DNA, 25 bp, Artificial sequence
  Synthetic oligonucleotide
tgggctcggcctacgacgtggacaa

SEQ ID NO: 695049 - DNA, 25 bp, Artificial sequence
  Synthetic oligonucleotide
gcgccgtacctgcacaacggctcgg

SEQ ID NO: 695050 - DNA, 25 bp, Artificial sequence
  Synthetic oligonucleotide
caggcgggcgatggcctcgatcgag

SEQ ID NO: 695051 - DNA, 25 bp, Artificial sequence
  Synthetic oligonucleotide
ggcaatcccaggccagggagtcatt

SEQ ID NO: 695052 - DNA, 25 bp, Artificial sequence
  Synthetic oligonucleotide
agtcgaggttgatgactccatcgcg

SEQ ID NO: 695053 - DNA, 25 bp, Artificial sequence
  Synthetic oligonucleotide
cgtcggagtcgaggttgatgactcc

SEQ ID NO: 695054 - DNA, 25 bp, Artificial sequence
  Synthetic oligonucleotide
tgtaatcgtcggagtcgaggttgat

SEQ ID NO: 695055 - DNA, 25 bp, Artificial sequence
  Synthetic oligonucleotide
tcttgatgtaatcgtcggagtcgag

SEQ ID NO: 695056 - DNA, 25 bp, Artificial sequence
  Synthetic oligonucleotide
cgagggtcttgatgtaatcgtcgga

SEQ ID NO: 695057 - DNA, 25 bp, Artificial sequence
  Synthetic oligonucleotide
actcgtcgagggtcttgatgtaatc

SEQ ID NO: 695058 - DNA, 25 bp, Artificial sequence
  Synthetic oligonucleotide
ggatccactcgtcgagggtcttgat

SEQ ID NO: 695059 - DNA, 25 bp, Artificial sequence
  Synthetic oligonucleotide
ggatggggatccactcgtcgagggt

SEQ ID NO: 695060 - DNA, 25 bp, Artificial sequence
  Synthetic oligonucleotide
gagctggggatggggatccactcgt

SEQ ID NO: 695061 - DNA, 25 bp, Artificial sequence
  Synthetic oligonucleotide
tcgatcgagctggggatggggatcc

SEQ ID NO: 695062 - DNA, 25 bp, Artificial sequence
  Synthetic oligonucleotide
gactccatcgcggtcgagaatcagc

SEQ ID NO: 695063 - DNA, 25 bp, Artificial sequence
  Synthetic oligonucleotide
gggcgatggcctcgatcgagctggg

SEQ ID NO: 695064 - DNA, 25 bp, Artificial sequence
  Synthetic oligonucleotide
atcgcggtcgagaatcagcagggaa

SEQ ID NO: 695065 - DNA, 25 bp, Artificial sequence
  Synthetic oligonucleotide
tggctcaggcgggcgatggcctcga

SEQ ID NO: 695066 - DNA, 25 bp, Artificial sequence
  Synthetic oligonucleotide
ccggcctggctcaggcgggcgatgg

SEQ ID NO: 695067 - DNA, 25 bp, Artificial sequence
  Synthetic oligonucleotide
gtccagccggcctggctcaggcggg

SEQ ID NO: 695068 - DNA, 25 bp, Artificial sequence
  Synthetic oligonucleotide
cgacggtccagccggcctggctcag

SEQ ID NO: 695069 - DNA, 25 bp, Artificial sequence
  Synthetic oligonucleotide
ccaccgcgacggtccagccggcctg

SEQ ID NO: 695070 - DNA, 25 bp, Artificial sequence
  Synthetic oligonucleotide
tggtagccaccgcgacggtccagcc

SEQ ID NO: 695071 - DNA, 25 bp, Artificial sequence
  Synthetic oligonucleotide
actggttggtagccaccgcgacggt

SEQ ID NO: 695072 - DNA, 25 bp, Artificial sequence
  Synthetic oligonucleotide
tgccggactggttggtagccaccgc

SEQ ID NO: 695073 - DNA, 25 bp, Artificial sequence
  Synthetic oligonucleotide
ggcgatgccggactggttggtagcc

SEQ ID NO: 695074 - DNA, 25 bp, Artificial sequence
  Synthetic oligonucleotide
gccacgggcgatgccggactggttg

SEQ ID NO: 695075 - DNA, 25 bp, Artificial sequence
  Synthetic oligonucleotide
gtaatagccacgggcgatgccggac

SEQ ID NO: 695076 - DNA, 25 bp, Artificial sequence
  Synthetic oligonucleotide
tggcctcgatcgagctggggatggg

SEQ ID NO: 695077 - DNA, 25 bp, Artificial sequence
  Synthetic oligonucleotide
ctcagccagccggagcatcgcggat

SEQ ID NO: 695078 - DNA, 25 bp, Artificial sequence
  Synthetic oligonucleotide
ctcccggtgcgcgcgacgctctgct

SEQ ID NO: 695079 - DNA, 25 bp, Artificial sequence
  Synthetic oligonucleotide
tggcaatggaatggcaatcccaggc

SEQ ID NO: 695080 - DNA, 25 bp, Artificial sequence
  Synthetic oligonucleotide
aataatggcaatggaatggcaatcc

SEQ ID NO: 695081 - DNA, 25 bp, Artificial sequence
  Synthetic oligonucleotide
agattcaataatggcaatggaatgg

SEQ ID NO: 695082 - DNA, 25 bp, Artificial sequence
  Synthetic oligonucleotide
tgtactagattcaataatggcaatg

SEQ ID NO: 695083 - DNA, 25 bp, Artificial sequence
  Synthetic oligonucleotide
acaatctgtactagattcaataatg

SEQ ID NO: 695084 - DNA, 25 bp, Artificial sequence
  Synthetic oligonucleotide
cgctggacaatctgtactagattca

SEQ ID NO: 695085 - DNA, 25 bp, Artificial sequence
  Synthetic oligonucleotide
cccctacgctggacaatctgtacta

SEQ ID NO: 695086 - DNA, 25 bp, Artificial sequence
  Synthetic oligonucleotide
acgagccccctacgctggacaatct

SEQ ID NO: 695087 - DNA, 25 bp, Artificial sequence
  Synthetic oligonucleotide
ggatcgacgagccccctacgctgga

SEQ ID NO: 695088 - DNA, 25 bp, Artificial sequence
  Synthetic oligonucleotide
gcggatggatcgacgagccccctac

SEQ ID NO: 695089 - DNA, 25 bp, Artificial sequence
  Synthetic oligonucleotide
ggttgatgactccatcgcggtcgag

SEQ ID NO: 695090 - DNA, 25 bp, Artificial sequence
  Synthetic oligonucleotide
cagccggagcatcgcggatggatcg

SEQ ID NO: 695091 - DNA, 25 bp, Artificial sequence
  Synthetic oligonucleotide
tcgagcactgccaggtcgtaatagc

SEQ ID NO: 695092 - DNA, 25 bp, Artificial sequence
  Synthetic oligonucleotide
attctacctcagccagccggagcat

SEQ ID NO: 695093 - DNA, 25 bp, Artificial sequence
  Synthetic oligonucleotide
ggatcgattctacctcagccagccg

SEQ ID NO: 695094 - DNA, 25 bp, Artificial sequence
  Synthetic oligonucleotide
cggaaaggatcgattctacctcagc

SEQ ID NO: 695095 - DNA, 25 bp, Artificial sequence
  Synthetic oligonucleotide
catgaacggaaaggatcgattctac

SEQ ID NO: 695096 - DNA, 25 bp, Artificial sequence
  Synthetic oligonucleotide
gttggccatgaacggaaaggatcga

SEQ ID NO: 695097 - DNA, 25 bp, Artificial sequence
  Synthetic oligonucleotide
tgcgcagttggccatgaacggaaag

SEQ ID NO: 695098 - DNA, 25 bp, Artificial sequence
  Synthetic oligonucleotide
catcgatgcgcagttggccatgaac

SEQ ID NO: 695099 - DNA, 25 bp, Artificial sequence
  Synthetic oligonucleotide
acgggacatcgatgcgcagttggcc

SEQ ID NO: 695100 - DNA, 25 bp, Artificial sequence
  Synthetic oligonucleotide
cagggaacgggacatcgatgcgcag

SEQ ID NO: 695101 - DNA, 25 bp, Artificial sequence
  Synthetic oligonucleotide
aatcagcagggaacgggacatcgat

SEQ ID NO: 695102 - DNA, 25 bp, Artificial sequence
  Synthetic oligonucleotide
gtcgagaatcagcagggaacgggac

SEQ ID NO: 695103 - DNA, 25 bp, Artificial sequence
  Synthetic oligonucleotide
agcatcgcggatggatcgacgagcc

SEQ ID NO: 695104 - DNA, 25 bp, Artificial sequence
  Synthetic oligonucleotide
ttgcccagcgtacgtacaccttttc

SEQ ID NO: 695105 - DNA, 25 bp, Artificial sequence
  Synthetic oligonucleotide
accagatacccgacagatcgacccc

SEQ ID NO: 695106 - DNA, 25 bp, Artificial sequence
  Synthetic oligonucleotide
cgacgaaccagatacccgacagatc

SEQ ID NO: 695107 - DNA, 25 bp, Artificial sequence
  Synthetic oligonucleotide
tgtcgccgacgaaccagatacccga

SEQ ID NO: 695108 - DNA, 25 bp, Artificial sequence
  Synthetic oligonucleotide
ccgatgctgtcgccgacgaaccaga

SEQ ID NO: 695109 - DNA, 25 bp, Artificial sequence
  Synthetic oligonucleotide
aggtcaccgatgctgtcgccgacga

SEQ ID NO: 695110 - DNA, 25 bp, Artificial sequence
  Synthetic oligonucleotide
cgcctccaggtcaccgatgctgtcg

SEQ ID NO: 695111 - DNA, 25 bp, Artificial sequence
  Synthetic oligonucleotide
ccgcgccgcctccaggtcaccgatg

SEQ ID NO: 695112 - DNA, 25 bp, Artificial sequence
  Synthetic oligonucleotide
gacggcccgcgccgcctccaggtca

SEQ ID NO: 695113 - DNA, 25 bp, Artificial sequence
  Synthetic oligonucleotide
acaatcgacggcccgcgccgcctcc

SEQ ID NO: 695114 - DNA, 25 bp, Artificial sequence
  Synthetic oligonucleotide
cggctgacaatcgacggcccgcgcc

SEQ ID NO: 695115 - DNA, 25 bp, Artificial sequence
  Synthetic oligonucleotide
caataccggctgacaatcgacggcc

SEQ ID NO: 695116 - DNA, 25 bp, Artificial sequence
  Synthetic oligonucleotide
caggtcgtaatagccacgggcgatg

SEQ ID NO: 695117 - DNA, 25 bp, Artificial sequence
  Synthetic oligonucleotide
tccggtctttaccaataccggctga

SEQ ID NO: 695118 - DNA, 25 bp, Artificial sequence
  Synthetic oligonucleotide
tcgaccccgtagtgctcgccgatct

SEQ ID NO: 695119 - DNA, 25 bp, Artificial sequence
  Synthetic oligonucleotide
aagggcttgcccagcgtacgtacac

SEQ ID NO: 695120 - DNA, 25 bp, Artificial sequence
  Synthetic oligonucleotide
tctggcaagggcttgcccagcgtac

SEQ ID NO: 695121 - DNA, 25 bp, Artificial sequence
  Synthetic oligonucleotide
gtgccctctggcaagggcttgccca

SEQ ID NO: 695122 - DNA, 25 bp, Artificial sequence
  Synthetic oligonucleotide
atcagggtgccctctggcaagggct

SEQ ID NO: 695123 - DNA, 25 bp, Artificial sequence
  Synthetic oligonucleotide
tcgaatatcagggtgccctctggca

SEQ ID NO: 695124 - DNA, 25 bp, Artificial sequence
  Synthetic oligonucleotide
cagatcgtcgaatatcagggtgccc

SEQ ID NO: 695125 - DNA, 25 bp, Artificial sequence
  Synthetic oligonucleotide
tgccgccagatcgtcgaatatcagg

SEQ ID NO: 695126 - DNA, 25 bp, Artificial sequence
  Synthetic oligonucleotide
ggcgactgccgccagatcgtcgaat

SEQ ID NO: 695127 - DNA, 25 bp, Artificial sequence
  Synthetic oligonucleotide
tgcgctggcgactgccgccagatcg

SEQ ID NO: 695128 - DNA, 25 bp, Artificial sequence
  Synthetic oligonucleotide
agtaatgcgctggcgactgccgcca

SEQ ID NO: 695129 - DNA, 25 bp, Artificial sequence
  Synthetic oligonucleotide
tactgaagtaatgcgctggcgactg

SEQ ID NO: 695130 - DNA, 25 bp, Artificial sequence
  Synthetic oligonucleotide
ctttaccaataccggctgacaatcg

SEQ ID NO: 695131 - DNA, 25 bp, Artificial sequence
  Synthetic oligonucleotide
gtccatgcggacaatagacgatgag

SEQ ID NO: 695132 - DNA, 25 bp, Artificial sequence
  Synthetic oligonucleotide
cccaggccagggagtcatttggcac

SEQ ID NO: 695133 - DNA, 25 bp, Artificial sequence
  Synthetic oligonucleotide
atggcctcgagcactgccaggtcgt

SEQ ID NO: 695134 - DNA, 25 bp, Artificial sequence
  Synthetic oligonucleotide
gcatgcatggcctcgagcactgcca

SEQ ID NO: 695135 - DNA, 25 bp, Artificial sequence
  Synthetic oligonucleotide
caagcgcgcatgcatggcctcgagc

SEQ ID NO: 695136 - DNA, 25 bp, Artificial sequence
  Synthetic oligonucleotide
ttcgcgcaagcgcgcatgcatggcc

SEQ ID NO: 695137 - DNA, 25 bp, Artificial sequence
  Synthetic oligonucleotide
gaccagttcgcgcaagcgcgcatgc

SEQ ID NO: 695138 - DNA, 25 bp, Artificial sequence
  Synthetic oligonucleotide
ctccgcgaccagttcgcgcaagcgc

SEQ ID NO: 695139 - DNA, 25 bp, Artificial sequence
  Synthetic oligonucleotide
gccctgctccgcgaccagttcgcgc

SEQ ID NO: 695140 - DNA, 25 bp, Artificial sequence
  Synthetic oligonucleotide
cctcgccgccctgctccgcgaccag

SEQ ID NO: 695141 - DNA, 25 bp, Artificial sequence
  Synthetic oligonucleotide
ggccgacctcgccgccctgctccgc

SEQ ID NO: 695142 - DNA, 25 bp, Artificial sequence
  Synthetic oligonucleotide
cgatgaggccgacctcgccgccctg

SEQ ID NO: 695143 - DNA, 25 bp, Artificial sequence
  Synthetic oligonucleotide
tacccgacagatcgaccccgtagtg

SEQ ID NO: 695144 - DNA, 25 bp, Artificial sequence
  Synthetic oligonucleotide
cggacaatagacgatgaggccgacc

SEQ ID NO: 695145 - DNA, 25 bp, Artificial sequence
  Synthetic oligonucleotide
gacagatcgaccccgtagtgctcgc

SEQ ID NO: 695146 - DNA, 25 bp, Artificial sequence
  Synthetic oligonucleotide
cgtccggtccatgcggacaatagac

SEQ ID NO: 695147 - DNA, 25 bp, Artificial sequence
  Synthetic oligonucleotide
aaccgtcgtccggtccatgcggaca

SEQ ID NO: 695148 - DNA, 25 bp, Artificial sequence
  Synthetic oligonucleotide
agtcgcaaccgtcgtccggtccatg

SEQ ID NO: 695149 - DNA, 25 bp, Artificial sequence
  Synthetic oligonucleotide
tgcggcagtcgcaaccgtcgtccgg

SEQ ID NO: 695150 - DNA, 25 bp, Artificial sequence
  Synthetic oligonucleotide
tcggcttgcggcagtcgcaaccgtc

SEQ ID NO: 695151 - DNA, 25 bp, Artificial sequence
  Synthetic oligonucleotide
ccggcttcggcttgcggcagtcgca

SEQ ID NO: 695152 - DNA, 25 bp, Artificial sequence
  Synthetic oligonucleotide
agcatacccggcttcggcttgcggc

SEQ ID NO: 695153 - DNA, 25 bp, Artificial sequence
  Synthetic oligonucleotide
tgccgcagcatacccggcttcggct

SEQ ID NO: 695154 - DNA, 25 bp, Artificial sequence
  Synthetic oligonucleotide
cgatctgccgcagcatacccggctt

SEQ ID NO: 695155 - DNA, 25 bp, Artificial sequence
  Synthetic oligonucleotide
gctcgccgatctgccgcagcatacc

SEQ ID NO: 695156 - DNA, 25 bp, Artificial sequence
  Synthetic oligonucleotide
cgtagtgctcgccgatctgccgcag

SEQ ID NO: 695157 - DNA, 25 bp, Artificial sequence
  Synthetic oligonucleotide
actgccaggtcgtaatagccacggg

SEQ ID NO: 695158 - DNA, 25 bp, Artificial sequence
  Synthetic oligonucleotide
aatagacgatgaggccgacctcgcc

SEQ ID NO: 695159 - DNA, 25 bp, Artificial sequence
  Synthetic oligonucleotide
ggcgcccgcggaaggcctgccggtg

SEQ ID NO: 695160 - DNA, 25 bp, Artificial sequence
  Synthetic oligonucleotide
tggaatggcaatcccaggccaggga

SEQ ID NO: 695161 - DNA, 25 bp, Artificial sequence
  Synthetic oligonucleotide
tgttcggcctgccatacccggcaga

SEQ ID NO: 695162 - DNA, 25 bp, Artificial sequence
  Synthetic oligonucleotide
atgacctgttcggcctgccataccc

SEQ ID NO: 695163 - DNA, 25 bp, Artificial sequence
  Synthetic oligonucleotide
gtcggcatgacctgttcggcctgcc

SEQ ID NO: 695164 - DNA, 25 bp, Artificial sequence
  Synthetic oligonucleotide
cagatggtcggcatgacctgttcgg

SEQ ID NO: 695165 - DNA, 25 bp, Artificial sequence
  Synthetic oligonucleotide
gcccggcagatggtcggcatgacct

SEQ ID NO: 695166 - DNA, 25 bp, Artificial sequence
  Synthetic oligonucleotide
acgggcgcccggcagatggtcggca

SEQ ID NO: 695167 - DNA, 25 bp, Artificial sequence
  Synthetic oligonucleotide
agccggcacgggcgcccggcagatg

SEQ ID NO: 695168 - DNA, 25 bp, Artificial sequence
  Synthetic oligonucleotide
caccgtagccggcacgggcgcccgg

SEQ ID NO: 695169 - DNA, 25 bp, Artificial sequence
  Synthetic oligonucleotide
gggcttcaccgtagccggcacgggc

SEQ ID NO: 695170 - DNA, 25 bp, Artificial sequence
  Synthetic oligonucleotide
ccggtgggcttcaccgtagccggca

SEQ ID NO: 695171 - DNA, 25 bp, Artificial sequence
  Synthetic oligonucleotide
ccatacccggcagatcgaggtgaag

SEQ ID NO: 695172 - DNA, 25 bp, Artificial sequence
  Synthetic oligonucleotide
cgcggaaggcctgccggtgggcttc

SEQ ID NO: 695173 - DNA, 25 bp, Artificial sequence
  Synthetic oligonucleotide
cggcagatcgaggtgaagggcactg

SEQ ID NO: 695174 - DNA, 25 bp, Artificial sequence
  Synthetic oligonucleotide
ccccaaggcgcccgcggaaggcctg

SEQ ID NO: 695175 - DNA, 25 bp, Artificial sequence
  Synthetic oligonucleotide
tgcccaaccccaaggcgcccgcgga

SEQ ID NO: 695176 - DNA, 25 bp, Artificial sequence
  Synthetic oligonucleotide
ggctatttgcccaaccccaaggcgc

SEQ ID NO: 695177 - DNA, 25 bp, Artificial sequence
  Synthetic oligonucleotide
cgctacggctatttgcccaacccca

SEQ ID NO: 695178 - DNA, 25 bp, Artificial sequence
  Synthetic oligonucleotide
cctggcccgctacggctatttgccc

SEQ ID NO: 695179 - DNA, 25 bp, Artificial sequence
  Synthetic oligonucleotide
ccgacagcctggcccgctacggcta

SEQ ID NO: 695180 - DNA, 25 bp, Artificial sequence
  Synthetic oligonucleotide
tcctcgccgacagcctggcccgcta

SEQ ID NO: 695181 - DNA, 25 bp, Artificial sequence
  Synthetic oligonucleotide
cgcctttcctcgccgacagcctggc

SEQ ID NO: 695182 - DNA, 25 bp, Artificial sequence
  Synthetic oligonucleotide
atggaacgcctttcctcgccgacag

SEQ ID NO: 695183 - DNA, 25 bp, Artificial sequence
  Synthetic oligonucleotide
agccggatggaacgcctttcctcgc

SEQ ID NO: 695184 - DNA, 25 bp, Artificial sequence
  Synthetic oligonucleotide
gcgacagccggatggaacgcctttc

SEQ ID NO: 695185 - DNA, 25 bp, Artificial sequence
  Synthetic oligonucleotide
aggcctgccggtgggcttcaccgta

SEQ ID NO: 695186 - DNA, 25 bp, Artificial sequence
  Synthetic oligonucleotide
tcctcgccgacctcgatcgggccgt

SEQ ID NO: 695187 - DNA, 25 bp, Artificial sequence
  Synthetic oligonucleotide
atcctcggggccaatccgcctcccg

SEQ ID NO: 695188 - DNA, 25 bp, Artificial sequence
  Synthetic oligonucleotide
agccgatcctcggggccaatccgcc

SEQ ID NO: 695189 - DNA, 25 bp, Artificial sequence
  Synthetic oligonucleotide
tcgccaagccgatcctcggggccaa

SEQ ID NO: 695190 - DNA, 25 bp, Artificial sequence
  Synthetic oligonucleotide
acgccttcgccaagccgatcctcgg

SEQ ID NO: 695191 - DNA, 25 bp, Artificial sequence
  Synthetic oligonucleotide
ccttcgacgccttcgccaagccgat

SEQ ID NO: 695192 - DNA, 25 bp, Artificial sequence
  Synthetic oligonucleotide
acgccgccttcgacgccttcgccaa

SEQ ID NO: 695193 - DNA, 25 bp, Artificial sequence
  Synthetic oligonucleotide
gcgatgacgccgccttcgacgcctt

SEQ ID NO: 695194 - DNA, 25 bp, Artificial sequence
  Synthetic oligonucleotide
tgaccagcgatgacgccgccttcga

SEQ ID NO: 695195 - DNA, 25 bp, Artificial sequence
  Synthetic oligonucleotide
gaccgctgaccagcgatgacgccgc

SEQ ID NO: 695196 - DNA, 25 bp, Artificial sequence
  Synthetic oligonucleotide
cgtgggaccgctgaccagcgatgac

SEQ ID NO: 695197 - DNA, 25 bp, Artificial sequence
  Synthetic oligonucleotide
cgggccgtgggaccgctgaccagcg

SEQ ID NO: 695198 - DNA, 25 bp, Artificial sequence
  Synthetic oligonucleotide
gcctgccatacccggcagatcgagg

SEQ ID NO: 695199 - DNA, 25 bp, Artificial sequence
  Synthetic oligonucleotide
gccgacctcgatcgggccgtgggac

SEQ ID NO: 695200 - DNA, 25 bp, Artificial sequence
  Synthetic oligonucleotide
tgccctggctcaaggcgttgcgaca

SEQ ID NO: 695201 - DNA, 25 bp, Artificial sequence
  Synthetic oligonucleotide
aggcattcctcgccgacctcgatcg

SEQ ID NO: 695202 - DNA, 25 bp, Artificial sequence
  Synthetic oligonucleotide
acttccaggcattcctcgccgacct

SEQ ID NO: 695203 - DNA, 25 bp, Artificial sequence
  Synthetic oligonucleotide
tcgtcgacttccaggcattcctcgc

SEQ ID NO: 695204 - DNA, 25 bp, Artificial sequence
  Synthetic oligonucleotide
cggcgatcgtcgacttccaggcatt

SEQ ID NO: 695205 - DNA, 25 bp, Artificial sequence
  Synthetic oligonucleotide
gcggtccggcgatcgtcgacttcca

SEQ ID NO: 695206 - DNA, 25 bp, Artificial sequence
  Synthetic oligonucleotide
tcgacggcggtccggcgatcgtcga

SEQ ID NO: 695207 - DNA, 25 bp, Artificial sequence
  Synthetic oligonucleotide
atcggatcgacggcggtccggcgat

SEQ ID NO: 695208 - DNA, 25 bp, Artificial sequence
  Synthetic oligonucleotide
tgcctatcggatcgacggcggtccg

SEQ ID NO: 695209 - DNA, 25 bp, Artificial sequence
  Synthetic oligonucleotide
gggcactgcctatcggatcgacggc

SEQ ID NO: 695210 - DNA, 25 bp, Artificial sequence
  Synthetic oligonucleotide
ggtgaagggcactgcctatcggatc

SEQ ID NO: 695211 - DNA, 25 bp, Artificial sequence
  Synthetic oligonucleotide
gatcgaggtgaagggcactgcctat

SEQ ID NO: 695212 - DNA, 25 bp, Artificial sequence
  Synthetic oligonucleotide
ctcgatcgggccgtgggaccgctga

SEQ ID NO: 695213 - DNA, 25 bp, Artificial sequence
  Synthetic oligonucleotide
accggagtaacgcagtaagcgccta

SEQ ID NO: 695214 - DNA, 25 bp, Artificial sequence
  Synthetic oligonucleotide
aacgcctgaaaaagacactgcacct

SEQ ID NO: 695215 - DNA, 25 bp, Artificial sequence
  Synthetic oligonucleotide
ccgtgaaacgcctgaaaaagacact

SEQ ID NO: 695216 - DNA, 25 bp, Artificial sequence
  Synthetic oligonucleotide
gagcgggcgtgacgacggggagttc

SEQ ID NO: 695217 - DNA, 25 bp, Artificial sequence
  Synthetic oligonucleotide
caggtggagcgggcgtgacgacggg

SEQ ID NO: 695218 - DNA, 25 bp, Artificial sequence
  Synthetic oligonucleotide
caccacaggtggagcgggcgtgacg

SEQ ID NO: 695219 - DNA, 25 bp, Artificial sequence
  Synthetic oligonucleotide
tgtttccaccacaggtggagcgggc

SEQ ID NO: 695220 - DNA, 25 bp, Artificial sequence
  Synthetic oligonucleotide
cggccgtgtttccaccacaggtgga

SEQ ID NO: 695221 - DNA, 25 bp, Artificial sequence
  Synthetic oligonucleotide
gccgaccggccgtgtttccaccaca

SEQ ID NO: 695222 - DNA, 25 bp, Artificial sequence
  Synthetic oligonucleotide
gccagcacggccgaccggccgtgtt

SEQ ID NO: 695223 - DNA, 25 bp, Artificial sequence
  Synthetic oligonucleotide
atcgcatgccagcacggccgaccgg

SEQ ID NO: 695224 - DNA, 25 bp, Artificial sequence
  Synthetic oligonucleotide
gcgcctatcgcatgccagcacggcc

SEQ ID NO: 695225 - DNA, 25 bp, Artificial sequence
  Synthetic oligonucleotide
ggcgttgcgacagccggatggaacg

SEQ ID NO: 695226 - DNA, 25 bp, Artificial sequence
  Synthetic oligonucleotide
gtaacgcagtaagcgcctatcgcat

SEQ ID NO: 695227 - DNA, 25 bp, Artificial sequence
  Synthetic oligonucleotide
tgcacctttcaagcttgtccctcgc

SEQ ID NO: 695228 - DNA, 25 bp, Artificial sequence
  Synthetic oligonucleotide
tggatcaccggagtaacgcagtaag

SEQ ID NO: 695229 - DNA, 25 bp, Artificial sequence
  Synthetic oligonucleotide
ggcgggtggatcaccggagtaacgc

SEQ ID NO: 695230 - DNA, 25 bp, Artificial sequence
  Synthetic oligonucleotide
ccccttggcgggtggatcaccggag

SEQ ID NO: 695231 - DNA, 25 bp, Artificial sequence
  Synthetic oligonucleotide
cgtgcgaaccccttggcgggtggat

SEQ ID NO: 695232 - DNA, 25 bp, Artificial sequence
  Synthetic oligonucleotide
cggagtacgtgcgaaccccttggcg

SEQ ID NO: 695233 - DNA, 25 bp, Artificial sequence
  Synthetic oligonucleotide
gtgtctcggagtacgtgcgaacccc

SEQ ID NO: 695234 - DNA, 25 bp, Artificial sequence
  Synthetic oligonucleotide
cagtgggtgtctcggagtacgtgcg

SEQ ID NO: 695235 - DNA, 25 bp, Artificial sequence
  Synthetic oligonucleotide
cgcagcagtgggtgtctcggagtac

SEQ ID NO: 695236 - DNA, 25 bp, Artificial sequence
  Synthetic oligonucleotide
ttggcacgcagcagtgggtgtctcg

SEQ ID NO: 695237 - DNA, 25 bp, Artificial sequence
  Synthetic oligonucleotide
agtcatttggcacgcagcagtgggt

SEQ ID NO: 695238 - DNA, 25 bp, Artificial sequence
  Synthetic oligonucleotide
ccagggagtcatttggcacgcagca

SEQ ID NO: 695239 - DNA, 25 bp, Artificial sequence
  Synthetic oligonucleotide
cagtaagcgcctatcgcatgccagc

SEQ ID NO: 695240 - DNA, 25 bp, Artificial sequence
  Synthetic oligonucleotide
tcgaccagggcaaggaatggaccga

SEQ ID NO: 695241 - DNA, 25 bp, Artificial sequence
  Synthetic oligonucleotide
acatcggcgaagaacgtatccaccg

SEQ ID NO: 695242 - DNA, 25 bp, Artificial sequence
  Synthetic oligonucleotide
tgcccctgccctggctcaaggcgtt

SEQ ID NO: 695243 - DNA, 25 bp, Artificial sequence
  Synthetic oligonucleotide
aggtgatgcccctgccctggctcaa

SEQ ID NO: 695244 - DNA, 25 bp, Artificial sequence
  Synthetic oligonucleotide
gctcgcaggtgatgcccctgccctg

SEQ ID NO: 695245 - DNA, 25 bp, Artificial sequence
  Synthetic oligonucleotide
accagggctcgcaggtgatgcccct

SEQ ID NO: 695246 - DNA, 25 bp, Artificial sequence
  Synthetic oligonucleotide
agccgcgaccagggctcgcaggtga

SEQ ID NO: 695247 - DNA, 25 bp, Artificial sequence
  Synthetic oligonucleotide
ttctacagccgcgaccagggctcgc

SEQ ID NO: 695248 - DNA, 25 bp, Artificial sequence
  Synthetic oligonucleotide
caggacttctacagccgcgaccagg

SEQ ID NO: 695249 - DNA, 25 bp, Artificial sequence
  Synthetic oligonucleotide
caccgccaggacttctacagccgcg

SEQ ID NO: 695250 - DNA, 25 bp, Artificial sequence
  Synthetic oligonucleotide
gaaagccaccgccaggacttctaca

SEQ ID NO: 695251 - DNA, 25 bp, Artificial sequence
  Synthetic oligonucleotide
tggaccgaaagccaccgccaggact

SEQ ID NO: 695252 - DNA, 25 bp, Artificial sequence
  Synthetic oligonucleotide
tgaaaaagacactgcacctttcaag

SEQ ID NO: 695253 - DNA, 25 bp, Artificial sequence
  Synthetic oligonucleotide
agggcaaggaatggaccgaaagcca

SEQ ID NO: 695254 - DNA, 25 bp, Artificial sequence
  Synthetic oligonucleotide
agacactgcacctttcaagcttgtc

SEQ ID NO: 695255 - DNA, 25 bp, Artificial sequence
  Synthetic oligonucleotide
tcatgctcgaccagggcaaggaatg

SEQ ID NO: 695256 - DNA, 25 bp, Artificial sequence
  Synthetic oligonucleotide
ctccggtcatgctcgaccagggcaa

SEQ ID NO: 695257 - DNA, 25 bp, Artificial sequence
  Synthetic oligonucleotide
cggccgctccggtcatgctcgacca

SEQ ID NO: 695258 - DNA, 25 bp, Artificial sequence
  Synthetic oligonucleotide
ccctggcggccgctccggtcatgct

SEQ ID NO: 695259 - DNA, 25 bp, Artificial sequence
  Synthetic oligonucleotide
tccgccgccctggcggccgctccgg

SEQ ID NO: 695260 - DNA, 25 bp, Artificial sequence
  Synthetic oligonucleotide
tttcttccgccgccctggcggccgc

SEQ ID NO: 695261 - DNA, 25 bp, Artificial sequence
  Synthetic oligonucleotide
tggctctttcttccgccgccctggc

SEQ ID NO: 695262 - DNA, 25 bp, Artificial sequence
  Synthetic oligonucleotide
cttccctggctctttcttccgccgc

SEQ ID NO: 695263 - DNA, 25 bp, Artificial sequence
  Synthetic oligonucleotide
ccctcgcttccctggctctttcttc

SEQ ID NO: 695264 - DNA, 25 bp, Artificial sequence
  Synthetic oligonucleotide
gcttgtccctcgcttccctggctct

SEQ ID NO: 695265 - DNA, 25 bp, Artificial sequence
  Synthetic oligonucleotide
tttcaagcttgtccctcgcttccct

SEQ ID NO: 695266 - DNA, 25 bp, Artificial sequence
  Synthetic oligonucleotide
gctcaaggcgttgcgacagccggat

SEQ ID NO: 695267 - DNA, 25 bp, Artificial sequence
  Synthetic oligonucleotide
aggaatggaccgaaagccaccgcca

SEQ ID NO: 695268 - DNA, 25 bp, Artificial sequence
  Synthetic oligonucleotide
agcggcggaccgtctaggttgacgg

SEQ ID NO: 695269 - DNA, 25 bp, Artificial sequence
  Synthetic oligonucleotide
tacttcgtcacgcaattcgggggtg

SEQ ID NO: 695270 - DNA, 25 bp, Artificial sequence
  Synthetic oligonucleotide
gcgccgcatagaaacgcgcagcggc

SEQ ID NO: 695271 - DNA, 25 bp, Artificial sequence
  Synthetic oligonucleotide
ggcgcggcgccgcatagaaacgcgc

SEQ ID NO: 695272 - DNA, 25 bp, Artificial sequence
  Synthetic oligonucleotide
gcgagacggcgcggcgccgcataga

SEQ ID NO: 695273 - DNA, 25 bp, Artificial sequence
  Synthetic oligonucleotide
agcacggcgagacggcgcggcgccg

SEQ ID NO: 695274 - DNA, 25 bp, Artificial sequence
  Synthetic oligonucleotide
tcgaccagcacggcgagacggcgcg

SEQ ID NO: 695275 - DNA, 25 bp, Artificial sequence
  Synthetic oligonucleotide
agttgctcgaccagcacggcgagac

SEQ ID NO: 695276 - DNA, 25 bp, Artificial sequence
  Synthetic oligonucleotide
acggcgagttgctcgaccagcacgg

SEQ ID NO: 695277 - DNA, 25 bp, Artificial sequence
  Synthetic oligonucleotide
tgctgcacggcgagttgctcgacca

SEQ ID NO: 695278 - DNA, 25 bp, Artificial sequence
  Synthetic oligonucleotide
tcgggctgctgcacggcgagttgct

SEQ ID NO: 695279 - DNA, 25 bp, Artificial sequence
  Synthetic oligonucleotide
gtacggtcgggctgctgcacggcga

SEQ ID NO: 695280 - DNA, 25 bp, Artificial sequence
  Synthetic oligonucleotide
aacgcgcagcggcatagctcagacc

SEQ ID NO: 695281 - DNA, 25 bp, Artificial sequence
  Synthetic oligonucleotide
ctaggttgacggtacggtcgggctg

SEQ ID NO: 695282 - DNA, 25 bp, Artificial sequence
  Synthetic oligonucleotide
cagcggcatagctcagaccggcagc

SEQ ID NO: 695283 - DNA, 25 bp, Artificial sequence
  Synthetic oligonucleotide
cctgtagcggcggaccgtctaggtt

SEQ ID NO: 695284 - DNA, 25 bp, Artificial sequence
  Synthetic oligonucleotide
aaggcggcctgtagcggcggaccgt

SEQ ID NO: 695285 - DNA, 25 bp, Artificial sequence
  Synthetic oligonucleotide
ggcgtcgaaggcggcctgtagcggc

SEQ ID NO: 695286 - DNA, 25 bp, Artificial sequence
  Synthetic oligonucleotide
accgctggcgtcgaaggcggcctgt

SEQ ID NO: 695287 - DNA, 25 bp, Artificial sequence
  Synthetic oligonucleotide
cgggttaccgctggcgtcgaaggcg

SEQ ID NO: 695288 - DNA, 25 bp, Artificial sequence
  Synthetic oligonucleotide
ctgggtcgggttaccgctggcgtcg

SEQ ID NO: 695289 - DNA, 25 bp, Artificial sequence
  Synthetic oligonucleotide
tggcgaagcccagggcggcctgggt

SEQ ID NO: 695290 - DNA, 25 bp, Artificial sequence
  Synthetic oligonucleotide
acttcttggcgaagcccagggcggc

SEQ ID NO: 695291 - DNA, 25 bp, Artificial sequence
  Synthetic oligonucleotide
gccgcacttcttggcgaagcccagg

SEQ ID NO: 695292 - DNA, 25 bp, Artificial sequence
  Synthetic oligonucleotide
tccacgccgcacttcttggcgaagc

SEQ ID NO: 695293 - DNA, 25 bp, Artificial sequence
  Synthetic oligonucleotide
tgcagatccacgccgcacttcttgg

SEQ ID NO: 695294 - DNA, 25 bp, Artificial sequence
  Synthetic oligonucleotide
ttgacggtacggtcgggctgctgca

SEQ ID NO: 695295 - DNA, 25 bp, Artificial sequence
  Synthetic oligonucleotide
tgagggcttttggcggcagctcttc

SEQ ID NO: 695296 - DNA, 25 bp, Artificial sequence
  Synthetic oligonucleotide
acattgaccatcacatcggcgaaga

SEQ ID NO: 695297 - DNA, 25 bp, Artificial sequence
  Synthetic oligonucleotide
cagcttggccagtacttcgtcacgc

SEQ ID NO: 695298 - DNA, 25 bp, Artificial sequence
  Synthetic oligonucleotide
ctccttcagcttggccagtacttcg

SEQ ID NO: 695299 - DNA, 25 bp, Artificial sequence
  Synthetic oligonucleotide
ttcggcctccttcagcttggccagt

SEQ ID NO: 695300 - DNA, 25 bp, Artificial sequence
  Synthetic oligonucleotide
tcatcattcggcctccttcagcttg

SEQ ID NO: 695301 - DNA, 25 bp, Artificial sequence
  Synthetic oligonucleotide
ttggcgctcatcattcggcctcctt

SEQ ID NO: 695302 - DNA, 25 bp, Artificial sequence
  Synthetic oligonucleotide
gaaatccttggcgctcatcattcgg

SEQ ID NO: 695303 - DNA, 25 bp, Artificial sequence
  Synthetic oligonucleotide
cgaccaggaaatccttggcgctcat

SEQ ID NO: 695304 - DNA, 25 bp, Artificial sequence
  Synthetic oligonucleotide
ccagttcgaccaggaaatccttggc

SEQ ID NO: 695305 - DNA, 25 bp, Artificial sequence
  Synthetic oligonucleotide
cggtgcccagttcgaccaggaaatc

SEQ ID NO: 695306 - DNA, 25 bp, Artificial sequence
  Synthetic oligonucleotide
gctcttcggtgcccagttcgaccag

SEQ ID NO: 695307 - DNA, 25 bp, Artificial sequence
  Synthetic oligonucleotide
catagaaacgcgcagcggcatagct

SEQ ID NO: 695308 - DNA, 25 bp, Artificial sequence
  Synthetic oligonucleotide
cttttggcggcagctcttcggtgcc

SEQ ID NO: 695309 - DNA, 25 bp, Artificial sequence
  Synthetic oligonucleotide
cgctcttgtcgatctgctgcagatc

SEQ ID NO: 695310 - DNA, 25 bp, Artificial sequence
  Synthetic oligonucleotide
gctgttgagggcttttggcggcagc

SEQ ID NO: 695311 - DNA, 25 bp, Artificial sequence
  Synthetic oligonucleotide
cgccgaggctgttgagggcttttgg

SEQ ID NO: 695312 - DNA, 25 bp, Artificial sequence
  Synthetic oligonucleotide
aggcttcgccgaggctgttgagggc

SEQ ID NO: 695313 - DNA, 25 bp, Artificial sequence
  Synthetic oligonucleotide
tgaggaaggcttcgccgaggctgtt

SEQ ID NO: 695314 - DNA, 25 bp, Artificial sequence
  Synthetic oligonucleotide
taccgctgaggaaggcttcgccgag

SEQ ID NO: 695315 - DNA, 25 bp, Artificial sequence
  Synthetic oligonucleotide
ctcgataccgctgaggaaggcttcg

SEQ ID NO: 695316 - DNA, 25 bp, Artificial sequence
  Synthetic oligonucleotide
gcccttctcgataccgctgaggaag

SEQ ID NO: 695317 - DNA, 25 bp, Artificial sequence
  Synthetic oligonucleotide
cttgaggcccttctcgataccgctg

SEQ ID NO: 695318 - DNA, 25 bp, Artificial sequence
  Synthetic oligonucleotide
cggcagccttgaggcccttctcgat

SEQ ID NO: 695319 - DNA, 25 bp, Artificial sequence
  Synthetic oligonucleotide
tcagaccggcagccttgaggccctt

SEQ ID NO: 695320 - DNA, 25 bp, Artificial sequence
  Synthetic oligonucleotide
catagctcagaccggcagccttgag

SEQ ID NO: 695321 - DNA, 25 bp, Artificial sequence
  Synthetic oligonucleotide
gcggcagctcttcggtgcccagttc

SEQ ID NO: 695322 - DNA, 25 bp, Artificial sequence
  Synthetic oligonucleotide
cggattgtggaagcggtggccacgg

SEQ ID NO: 695323 - DNA, 25 bp, Artificial sequence
  Synthetic oligonucleotide
ccgaacagcatcaccagccattggg

SEQ ID NO: 695324 - DNA, 25 bp, Artificial sequence
  Synthetic oligonucleotide
tcgtcgccgaacagcatcaccagcc

SEQ ID NO: 695325 - DNA, 25 bp, Artificial sequence
  Synthetic oligonucleotide
accacatcgtcgccgaacagcatca

SEQ ID NO: 695326 - DNA, 25 bp, Artificial sequence
  Synthetic oligonucleotide
cactcgaccacatcgtcgccgaaca

SEQ ID NO: 695327 - DNA, 25 bp, Artificial sequence
  Synthetic oligonucleotide
atctcgcactcgaccacatcgtcgc

SEQ ID NO: 695328 - DNA, 25 bp, Artificial sequence
  Synthetic oligonucleotide
gcgaggatctcgcactcgaccacat

SEQ ID NO: 695329 - DNA, 25 bp, Artificial sequence
  Synthetic oligonucleotide
ttctgggcgaggatctcgcactcga

SEQ ID NO: 695330 - DNA, 25 bp, Artificial sequence
  Synthetic oligonucleotide
ccggctttctgggcgaggatctcgc

SEQ ID NO: 695331 - DNA, 25 bp, Artificial sequence
  Synthetic oligonucleotide
tcgcgcccggctttctgggcgagga

SEQ ID NO: 695332 - DNA, 25 bp, Artificial sequence
  Synthetic oligonucleotide
cgggattcgcgcccggctttctggg

SEQ ID NO: 695333 - DNA, 25 bp, Artificial sequence
  Synthetic oligonucleotide
tggccacgggattcgcgcccggctt

SEQ ID NO: 695334 - DNA, 25 bp, Artificial sequence
  Synthetic oligonucleotide
tctgctgcagatccacgccgcactt

SEQ ID NO: 695335 - DNA, 25 bp, Artificial sequence
  Synthetic oligonucleotide
tgtggaagcggtggccacgggattc

SEQ ID NO: 695336 - DNA, 25 bp, Artificial sequence
  Synthetic oligonucleotide
cattgggtcggacgcacgaactcct

SEQ ID NO: 695337 - DNA, 25 bp, Artificial sequence
  Synthetic oligonucleotide
ttgtccggattgtggaagcggtggc

SEQ ID NO: 695338 - DNA, 25 bp, Artificial sequence
  Synthetic oligonucleotide
cgcacattgtccggattgtggaagc

SEQ ID NO: 695339 - DNA, 25 bp, Artificial sequence
  Synthetic oligonucleotide
gaaatacgcacattgtccggattgt

SEQ ID NO: 695340 - DNA, 25 bp, Artificial sequence
  Synthetic oligonucleotide
gggctggaaatacgcacattgtccg

SEQ ID NO: 695341 - DNA, 25 bp, Artificial sequence
  Synthetic oligonucleotide
gctgccgggctggaaatacgcacat

SEQ ID NO: 695342 - DNA, 25 bp, Artificial sequence
  Synthetic oligonucleotide
agatacgctgccgggctggaaatac

SEQ ID NO: 695343 - DNA, 25 bp, Artificial sequence
  Synthetic oligonucleotide
tcttccagatacgctgccgggctgg

SEQ ID NO: 695344 - DNA, 25 bp, Artificial sequence
  Synthetic oligonucleotide
cgcaggtcttccagatacgctgccg

SEQ ID NO: 695345 - DNA, 25 bp, Artificial sequence
  Synthetic oligonucleotide
gcgccgcgcaggtcttccagatacg

SEQ ID NO: 695346 - DNA, 25 bp, Artificial sequence
  Synthetic oligonucleotide
acatgagcgccgcgcaggtcttcca

SEQ ID NO: 695347 - DNA, 25 bp, Artificial sequence
  Synthetic oligonucleotide
gccagcacatgagcgccgcgcaggt

SEQ ID NO: 695348 - DNA, 25 bp, Artificial sequence
  Synthetic oligonucleotide
aagcggtggccacgggattcgcgcc

SEQ ID NO: 695349 - DNA, 25 bp, Artificial sequence
  Synthetic oligonucleotide
tcaacgaggcctcgacgatgcccgg

SEQ ID NO: 695350 - DNA, 25 bp, Artificial sequence
  Synthetic oligonucleotide
cgtcacgcaattcgggggtggccat

SEQ ID NO: 695351 - DNA, 25 bp, Artificial sequence
  Synthetic oligonucleotide
tcggaccgctcttgtcgatctgctg

SEQ ID NO: 695352 - DNA, 25 bp, Artificial sequence
  Synthetic oligonucleotide
gcagcttcggaccgctcttgtcgat

SEQ ID NO: 695353 - DNA, 25 bp, Artificial sequence
  Synthetic oligonucleotide
tgaagcgcagcttcggaccgctctt

SEQ ID NO: 695354 - DNA, 25 bp, Artificial sequence
  Synthetic oligonucleotide
tctggatgaagcgcagcttcggacc

SEQ ID NO: 695355 - DNA, 25 bp, Artificial sequence
  Synthetic oligonucleotide
cgatggtctggatgaagcgcagctt

SEQ ID NO: 695356 - DNA, 25 bp, Artificial sequence
  Synthetic oligonucleotide
tggccggcgatggtctggatgaagc

SEQ ID NO: 695357 - DNA, 25 bp, Artificial sequence
  Synthetic oligonucleotide
gccggttggccggcgatggtctgga

SEQ ID NO: 695358 - DNA, 25 bp, Artificial sequence
  Synthetic oligonucleotide
ccggcggccggttggccggcgatgg

SEQ ID NO: 695359 - DNA, 25 bp, Artificial sequence
  Synthetic oligonucleotide
agcaggccggcggccggttggccgg

SEQ ID NO: 695360 - DNA, 25 bp, Artificial sequence
  Synthetic oligonucleotide
gcccggcagcaggccggcggccggt

SEQ ID NO: 695361 - DNA, 25 bp, Artificial sequence
  Synthetic oligonucleotide
agcatcaccagccattgggtcggac

SEQ ID NO: 695362 - DNA, 25 bp, Artificial sequence
  Synthetic oligonucleotide
aggcctcgacgatgcccggcagcag

SEQ ID NO: 695363 - DNA, 25 bp, Artificial sequence
  Synthetic oligonucleotide
accagccattgggtcggacgcacga

SEQ ID NO: 695364 - DNA, 25 bp, Artificial sequence
  Synthetic oligonucleotide
ttcgttcaacgaggcctcgacgatg

SEQ ID NO: 695365 - DNA, 25 bp, Artificial sequence
  Synthetic oligonucleotide
cggcagttcgttcaacgaggcctcg

SEQ ID NO: 695366 - DNA, 25 bp, Artificial sequence
  Synthetic oligonucleotide
gggaatcggcagttcgttcaacgag

SEQ ID NO: 695367 - DNA, 25 bp, Artificial sequence
  Synthetic oligonucleotide
ccgcttgggaatcggcagttcgttc

SEQ ID NO: 695368 - DNA, 25 bp, Artificial sequence
  Synthetic oligonucleotide
gcgcatccgcttgggaatcggcagt

SEQ ID NO: 695369 - DNA, 25 bp, Artificial sequence
  Synthetic oligonucleotide
tgcccagcgcatccgcttgggaatc

SEQ ID NO: 695370 - DNA, 25 bp, Artificial sequence
  Synthetic oligonucleotide
cgagctgcccagcgcatccgcttgg

SEQ ID NO: 695371 - DNA, 25 bp, Artificial sequence
  Synthetic oligonucleotide
tcgcggcgagctgcccagcgcatcc

SEQ ID NO: 695372 - DNA, 25 bp, Artificial sequence
  Synthetic oligonucleotide
actcctcgcggcgagctgcccagcg

SEQ ID NO: 695373 - DNA, 25 bp, Artificial sequence
  Synthetic oligonucleotide
cgcacgaactcctcgcggcgagctg

SEQ ID NO: 695374 - DNA, 25 bp, Artificial sequence
  Synthetic oligonucleotide
gtcggacgcacgaactcctcgcggc

SEQ ID NO: 695375 - DNA, 25 bp, Artificial sequence
  Synthetic oligonucleotide
tgtcgatctgctgcagatccacgcc

SEQ ID NO: 695376 - DNA, 25 bp, Artificial sequence
  Synthetic oligonucleotide
gacgatgcccggcagcaggccggcg

SEQ ID NO: 695377 - DNA, 25 bp, Artificial sequence
  Synthetic oligonucleotide
ccaggcgctccaggccgtaggtgat

SEQ ID NO: 695378 - DNA, 25 bp, Artificial sequence
  Synthetic oligonucleotide
ggccagtacttcgtcacgcaattcg

SEQ ID NO: 695379 - DNA, 25 bp, Artificial sequence
  Synthetic oligonucleotide
aggtgaactgggtgacttccatgcc

SEQ ID NO: 695380 - DNA, 25 bp, Artificial sequence
  Synthetic oligonucleotide
ggaagtaggtgaactgggtgacttc

SEQ ID NO: 695381 - DNA, 25 bp, Artificial sequence
  Synthetic oligonucleotide
acctgctggaagtaggtgaactggg

SEQ ID NO: 695382 - DNA, 25 bp, Artificial sequence
  Synthetic oligonucleotide
ccgccgacctgctggaagtaggtga

SEQ ID NO: 695383 - DNA, 25 bp, Artificial sequence
  Synthetic oligonucleotide
tcgatgccgccgacctgctggaagt

SEQ ID NO: 695384 - DNA, 25 bp, Artificial sequence
  Synthetic oligonucleotide
atagcactcgatgccgccgacctgc

SEQ ID NO: 695385 - DNA, 25 bp, Artificial sequence
  Synthetic oligonucleotide
accggatagcactcgatgccgccga

SEQ ID NO: 695386 - DNA, 25 bp, Artificial sequence
  Synthetic oligonucleotide
cggtgaccggatagcactcgatgcc

SEQ ID NO: 695387 - DNA, 25 bp, Artificial sequence
  Synthetic oligonucleotide
tctcgccggtgaccggatagcactc

SEQ ID NO: 695388 - DNA, 25 bp, Artificial sequence
  Synthetic oligonucleotide
aggtgatctcgccggtgaccggata

SEQ ID NO: 695389 - DNA, 25 bp, Artificial sequence
  Synthetic oligonucleotide
tgacttccatgccgttcagccagat

SEQ ID NO: 695390 - DNA, 25 bp, Artificial sequence
  Synthetic oligonucleotide
gctccaggccgtaggtgatctcgcc

SEQ ID NO: 695391 - DNA, 25 bp, Artificial sequence
  Synthetic oligonucleotide
ccatgccgttcagccagatttccca

SEQ ID NO: 695392 - DNA, 25 bp, Artificial sequence
  Synthetic oligonucleotide
tacatggccaggcgctccaggccgt

SEQ ID NO: 695393 - DNA, 25 bp, Artificial sequence
  Synthetic oligonucleotide
tgcaggtacatggccaggcgctcca

SEQ ID NO: 695394 - DNA, 25 bp, Artificial sequence
  Synthetic oligonucleotide
cgccctgcaggtacatggccaggcg

SEQ ID NO: 695395 - DNA, 25 bp, Artificial sequence
  Synthetic oligonucleotide
agtccacgccctgcaggtacatggc

SEQ ID NO: 695396 - DNA, 25 bp, Artificial sequence
  Synthetic oligonucleotide
agaccgagtccacgccctgcaggta

SEQ ID NO: 695397 - DNA, 25 bp, Artificial sequence
  Synthetic oligonucleotide
ggtcgtagaccgagtccacgccctg

SEQ ID NO: 695398 - DNA, 25 bp, Artificial sequence
  Synthetic oligonucleotide
agaccaggtcgtagaccgagtccac

SEQ ID NO: 695399 - DNA, 25 bp, Artificial sequence
  Synthetic oligonucleotide
cggtccagaccaggtcgtagaccga

SEQ ID NO: 695400 - DNA, 25 bp, Artificial sequence
  Synthetic oligonucleotide
ggccgtcggtccagaccaggtcgta

SEQ ID NO: 695401 - DNA, 25 bp, Artificial sequence
  Synthetic oligonucleotide
cgaacgggccgtcggtccagaccag

SEQ ID NO: 695402 - DNA, 25 bp, Artificial sequence
  Synthetic oligonucleotide
cttgccgaacgggccgtcggtccag

SEQ ID NO: 695403 - DNA, 25 bp, Artificial sequence
  Synthetic oligonucleotide
ggccgtaggtgatctcgccggtgac

SEQ ID NO: 695404 - DNA, 25 bp, Artificial sequence
  Synthetic oligonucleotide
aagcggatgtcgtggaccagcgggt

SEQ ID NO: 695405 - DNA, 25 bp, Artificial sequence
  Synthetic oligonucleotide
gggttcggcttcaggaccacctgaa

SEQ ID NO: 695406 - DNA, 25 bp, Artificial sequence
  Synthetic oligonucleotide
ttctccgggttcggcttcaggacca

SEQ ID NO: 695407 - DNA, 25 bp, Artificial sequence
  Synthetic oligonucleotide
tggaagttctccgggttcggcttca

SEQ ID NO: 695408 - DNA, 25 bp, Artificial sequence
  Synthetic oligonucleotide
agctcctggaagttctccgggttcg

SEQ ID NO: 695409 - DNA, 25 bp, Artificial sequence
  Synthetic oligonucleotide
ggtacagctcctggaagttctccgg

SEQ ID NO: 695410 - DNA, 25 bp, Artificial sequence
  Synthetic oligonucleotide
agccgaggtacagctcctggaagtt

SEQ ID NO: 695411 - DNA, 25 bp, Artificial sequence
  Synthetic oligonucleotide
tcagcgagccgaggtacagctcctg

SEQ ID NO: 695412 - DNA, 25 bp, Artificial sequence
  Synthetic oligonucleotide
tggctttcagcgagccgaggtacag

SEQ ID NO: 695413 - DNA, 25 bp, Artificial sequence
  Synthetic oligonucleotide
tgccgatggctttcagcgagccgag

SEQ ID NO: 695414 - DNA, 25 bp, Artificial sequence
  Synthetic oligonucleotide
gtcgatgccgatggctttcagcgag

SEQ ID NO: 695415 - DNA, 25 bp, Artificial sequence
  Synthetic oligonucleotide
cagcgggtcgatgccgatggctttc

SEQ ID NO: 695416 - DNA, 25 bp, Artificial sequence
  Synthetic oligonucleotide
actgggtgacttccatgccgttcag

SEQ ID NO: 695417 - DNA, 25 bp, Artificial sequence
  Synthetic oligonucleotide
atgtcgtggaccagcgggtcgatgc

SEQ ID NO: 695418 - DNA, 25 bp, Artificial sequence
  Synthetic oligonucleotide
aacacgtcgccataggtgaccttgc

SEQ ID NO: 695419 - DNA, 25 bp, Artificial sequence
  Synthetic oligonucleotide
tcgacgaagcggatgtcgtggacca

SEQ ID NO: 695420 - DNA, 25 bp, Artificial sequence
  Synthetic oligonucleotide
ttgtcctcgacgaagcggatgtcgt

SEQ ID NO: 695421 - DNA, 25 bp, Artificial sequence
  Synthetic oligonucleotide
cccagttgtcctcgacgaagcggat

SEQ ID NO: 695422 - DNA, 25 bp, Artificial sequence
  Synthetic oligonucleotide
gcgactcccagttgtcctcgacgaa

SEQ ID NO: 695423 - DNA, 25 bp, Artificial sequence
  Synthetic oligonucleotide
gggtcggcgactcccagttgtcctc

SEQ ID NO: 695424 - DNA, 25 bp, Artificial sequence
  Synthetic oligonucleotide
cgccgagggtcggcgactcccagtt

SEQ ID NO: 695425 - DNA, 25 bp, Artificial sequence
  Synthetic oligonucleotide
ccccaggcgccgagggtcggcgact

SEQ ID NO: 695426 - DNA, 25 bp, Artificial sequence
  Synthetic oligonucleotide
cccaggccccaggcgccgagggtcg

SEQ ID NO: 695427 - DNA, 25 bp, Artificial sequence
  Synthetic oligonucleotide
tcccaacccaggccccaggcgccga

SEQ ID NO: 695428 - DNA, 25 bp, Artificial sequence
  Synthetic oligonucleotide
ccagatttcccaacccaggccccag

SEQ ID NO: 695429 - DNA, 25 bp, Artificial sequence
  Synthetic oligonucleotide
gttcagccagatttcccaacccagg

SEQ ID NO: 695430 - DNA, 25 bp, Artificial sequence
  Synthetic oligonucleotide
tggaccagcgggtcgatgccgatgg

SEQ ID NO: 695431 - DNA, 25 bp, Artificial sequence
  Synthetic oligonucleotide
cgggccagggtacgcacgcgaagga

SEQ ID NO: 695432 - DNA, 25 bp, Artificial sequence
  Synthetic oligonucleotide
tgaaggtatgcgaagccttgaggac

SEQ ID NO: 695433 - DNA, 25 bp, Artificial sequence
  Synthetic oligonucleotide
gcaggttgaaggtatgcgaagcctt

SEQ ID NO: 695434 - DNA, 25 bp, Artificial sequence
  Synthetic oligonucleotide
catccagcaggttgaaggtatgcga

SEQ ID NO: 695435 - DNA, 25 bp, Artificial sequence
  Synthetic oligonucleotide
gccgcgcatccagcaggttgaaggt

SEQ ID NO: 695436 - DNA, 25 bp, Artificial sequence
  Synthetic oligonucleotide
tggcgcgccgcgcatccagcaggtt

SEQ ID NO: 695437 - DNA, 25 bp, Artificial sequence
  Synthetic oligonucleotide
ccgagatggcgcgccgcgcatccag

SEQ ID NO: 695438 - DNA, 25 bp, Artificial sequence
  Synthetic oligonucleotide
cggtgaccgagatggcgcgccgcgc

SEQ ID NO: 695439 - DNA, 25 bp, Artificial sequence
  Synthetic oligonucleotide
ggcgctcggtgaccgagatggcgcg

SEQ ID NO: 695440 - DNA, 25 bp, Artificial sequence
  Synthetic oligonucleotide
agcgctggcgctcggtgaccgagat

SEQ ID NO: 695441 - DNA, 25 bp, Artificial sequence
  Synthetic oligonucleotide
gatgtagcgctggcgctcggtgacc

SEQ ID NO: 695442 - DNA, 25 bp, Artificial sequence
  Synthetic oligonucleotide
gcgaaggatgtagcgctggcgctcg

SEQ ID NO: 695443 - DNA, 25 bp, Artificial sequence
  Synthetic oligonucleotide
ataggtgaccttgccgaacgggccg

SEQ ID NO: 695444 - DNA, 25 bp, Artificial sequence
  Synthetic oligonucleotide
agggtacgcacgcgaaggatgtagc

SEQ ID NO: 695445 - DNA, 25 bp, Artificial sequence
  Synthetic oligonucleotide
tgaggaccatctcgtaggtcggcaa

SEQ ID NO: 695446 - DNA, 25 bp, Artificial sequence
  Synthetic oligonucleotide
acggcgcgggccagggtacgcacgc

SEQ ID NO: 695447 - DNA, 25 bp, Artificial sequence
  Synthetic oligonucleotide
tgcgccacggcgcgggccagggtac

SEQ ID NO: 695448 - DNA, 25 bp, Artificial sequence
  Synthetic oligonucleotide
tagctctgcgccacggcgcgggcca

SEQ ID NO: 695449 - DNA, 25 bp, Artificial sequence
  Synthetic oligonucleotide
tgcaggtagctctgcgccacggcgc

SEQ ID NO: 695450 - DNA, 25 bp, Artificial sequence
  Synthetic oligonucleotide
cgggcctgcaggtagctctgcgcca

SEQ ID NO: 695451 - DNA, 25 bp, Artificial sequence
  Synthetic oligonucleotide
gcgcgcgcgggcctgcaggtagctc

SEQ ID NO: 695452 - DNA, 25 bp, Artificial sequence
  Synthetic oligonucleotide
agccgaggcgcgcgcgggcctgcag

SEQ ID NO: 695453 - DNA, 25 bp, Artificial sequence
  Synthetic oligonucleotide
tggggaagccgaggcgcgcgcgggc

SEQ ID NO: 695454 - DNA, 25 bp, Artificial sequence
  Synthetic oligonucleotide
tggccatggggaagccgaggcgcgc

SEQ ID NO: 695455 - DNA, 25 bp, Artificial sequence
  Synthetic oligonucleotide
cgggggtggccatggggaagccgag

SEQ ID NO: 695456 - DNA, 25 bp, Artificial sequence
  Synthetic oligonucleotide
gcaattcgggggtggccatggggaa

SEQ ID NO: 695457 - DNA, 25 bp, Artificial sequence
  Synthetic oligonucleotide
cgcacgcgaaggatgtagcgctggc

SEQ ID NO: 695458 - DNA, 25 bp, Artificial sequence
  Synthetic oligonucleotide
gtcgaacagttcgaacagcttcggc

SEQ ID NO: 695459 - DNA, 25 bp, Artificial sequence
  Synthetic oligonucleotide
ggcgctcggcgaaatcggccagcac

SEQ ID NO: 695460 - DNA, 25 bp, Artificial sequence
  Synthetic oligonucleotide
tggtggaacacgtcgccataggtga

SEQ ID NO: 695461 - DNA, 25 bp, Artificial sequence
  Synthetic oligonucleotide
cgttctggtggaacacgtcgccata

SEQ ID NO: 695462 - DNA, 25 bp, Artificial sequence
  Synthetic oligonucleotide
ccacctcgttctggtggaacacgtc

SEQ ID NO: 695463 - DNA, 25 bp, Artificial sequence
  Synthetic oligonucleotide
ttgctccacctcgttctggtggaac

SEQ ID NO: 695464 - DNA, 25 bp, Artificial sequence
  Synthetic oligonucleotide
agtggattgctccacctcgttctgg

SEQ ID NO: 695465 - DNA, 25 bp, Artificial sequence
  Synthetic oligonucleotide
gttgaaagtggattgctccacctcg

SEQ ID NO: 695466 - DNA, 25 bp, Artificial sequence
  Synthetic oligonucleotide
ctcgaagttgaaagtggattgctcc

SEQ ID NO: 695467 - DNA, 25 bp, Artificial sequence
  Synthetic oligonucleotide
ggcgtgctcgaagttgaaagtggat

SEQ ID NO: 695468 - DNA, 25 bp, Artificial sequence
  Synthetic oligonucleotide
cacgttggcgtgctcgaagttgaaa

SEQ ID NO: 695469 - DNA, 25 bp, Artificial sequence
  Synthetic oligonucleotide
cttcggcacgttggcgtgctcgaag

SEQ ID NO: 695470 - DNA, 25 bp, Artificial sequence
  Synthetic oligonucleotide
tatgcgaagccttgaggaccatctc

SEQ ID NO: 695471 - DNA, 25 bp, Artificial sequence
  Synthetic oligonucleotide
cagttcgaacagcttcggcacgttg

SEQ ID NO: 695472 - DNA, 25 bp, Artificial sequence
  Synthetic oligonucleotide
aagccttgaggaccatctcgtaggt

SEQ ID NO: 695473 - DNA, 25 bp, Artificial sequence
  Synthetic oligonucleotide
gtagaagtcgaacagttcgaacagc

SEQ ID NO: 695474 - DNA, 25 bp, Artificial sequence
  Synthetic oligonucleotide
gctttcgtagaagtcgaacagttcg

SEQ ID NO: 695475 - DNA, 25 bp, Artificial sequence
  Synthetic oligonucleotide
ggcttcgctttcgtagaagtcgaac

SEQ ID NO: 695476 - DNA, 25 bp, Artificial sequence
  Synthetic oligonucleotide
gcggttggcttcgctttcgtagaag

SEQ ID NO: 695477 - DNA, 25 bp, Artificial sequence
  Synthetic oligonucleotide
gatcaggcggttggcttcgctttcg

SEQ ID NO: 695478 - DNA, 25 bp, Artificial sequence
  Synthetic oligonucleotide
cagcgcgatcaggcggttggcttcg

SEQ ID NO: 695479 - DNA, 25 bp, Artificial sequence
  Synthetic oligonucleotide
agctccagcgcgatcaggcggttgg

SEQ ID NO: 695480 - DNA, 25 bp, Artificial sequence
  Synthetic oligonucleotide
aacggcagctccagcgcgatcaggc

SEQ ID NO: 695481 - DNA, 25 bp, Artificial sequence
  Synthetic oligonucleotide
tcggcaacggcagctccagcgcgat

SEQ ID NO: 695482 - DNA, 25 bp, Artificial sequence
  Synthetic oligonucleotide
cgtaggtcggcaacggcagctccag

SEQ ID NO: 695483 - DNA, 25 bp, Artificial sequence
  Synthetic oligonucleotide
ccatctcgtaggtcggcaacggcag

SEQ ID NO: 695484 - DNA, 25 bp, Artificial sequence
  Synthetic oligonucleotide
tcgccataggtgaccttgccgaacg

SEQ ID NO: 695485 - DNA, 25 bp, Artificial sequence
  Synthetic oligonucleotide
gaacagcttcggcacgttggcgtgc

SEQ ID NO: 695486 - DNA, 25 bp, Artificial sequence
  Synthetic oligonucleotide
cctgctcggccaggccggcggcctt

SEQ ID NO: 695487 - DNA, 25 bp, Artificial sequence
  Synthetic oligonucleotide
aatcggccagcacatgagcgccgcg

SEQ ID NO: 695488 - DNA, 25 bp, Artificial sequence
  Synthetic oligonucleotide
aggtccaggtcgagctgcttctcga

SEQ ID NO: 695489 - DNA, 25 bp, Artificial sequence
  Synthetic oligonucleotide
gctaccaggtccaggtcgagctgct

SEQ ID NO: 695490 - DNA, 25 bp, Artificial sequence
  Synthetic oligonucleotide
accgcggctaccaggtccaggtcga

SEQ ID NO: 695491 - DNA, 25 bp, Artificial sequence
  Synthetic oligonucleotide
cgttgaccgcggctaccaggtccag

SEQ ID NO: 695492 - DNA, 25 bp, Artificial sequence
  Synthetic oligonucleotide
acggcggcgttgaccgcggctacca

SEQ ID NO: 695493 - DNA, 25 bp, Artificial sequence
  Synthetic oligonucleotide
tgctcgacggcggcgttgaccgcgg

SEQ ID NO: 695494 - DNA, 25 bp, Artificial sequence
  Synthetic oligonucleotide
ccgtattgctcgacggcggcgttga

SEQ ID NO: 695495 - DNA, 25 bp, Artificial sequence
  Synthetic oligonucleotide
ttgtcgccgtattgctcgacggcgg

SEQ ID NO: 695496 - DNA, 25 bp, Artificial sequence
  Synthetic oligonucleotide
ttgaccttgtcgccgtattgctcga

SEQ ID NO: 695497 - DNA, 25 bp, Artificial sequence
  Synthetic oligonucleotide
gcggccttgaccttgtcgccgtatt

SEQ ID NO: 695498 - DNA, 25 bp, Artificial sequence
  Synthetic oligonucleotide
agctgcttctcgatgaggatgcgca

SEQ ID NO: 695499 - DNA, 25 bp, Artificial sequence
  Synthetic oligonucleotide
tcggccaggccggcggccttgacct

SEQ ID NO: 695500 - DNA, 25 bp, Artificial sequence
  Synthetic oligonucleotide
ttctcgatgaggatgcgcagcacgc

SEQ ID NO: 695501 - DNA, 25 bp, Artificial sequence
  Synthetic oligonucleotide
cagcacctgctcggccaggccggcg

SEQ ID NO: 695502 - DNA, 25 bp, Artificial sequence
  Synthetic oligonucleotide
gaagtccagcacctgctcggccagg

SEQ ID NO: 695503 - DNA, 25 bp, Artificial sequence
  Synthetic oligonucleotide
aacacgaagtccagcacctgctcgg

SEQ ID NO: 695504 - DNA, 25 bp, Artificial sequence
  Synthetic oligonucleotide
ggtcgaacacgaagtccagcacctg

SEQ ID NO: 695505 - DNA, 25 bp, Artificial sequence
  Synthetic oligonucleotide
gcaggcggtcgaacacgaagtccag

SEQ ID NO: 695506 - DNA, 25 bp, Artificial sequence
  Synthetic oligonucleotide
cgcgcgcgcaggcggtcgaacacga

SEQ ID NO: 695507 - DNA, 25 bp, Artificial sequence
  Synthetic oligonucleotide
tcgtagcgcgcgcgcaggcggtcga

SEQ ID NO: 695508 - DNA, 25 bp, Artificial sequence
  Synthetic oligonucleotide
ttcgtcctcgtagcgcgcgcgcagg

SEQ ID NO: 695509 - DNA, 25 bp, Artificial sequence
  Synthetic oligonucleotide
acgccttcgtcctcgtagcgcgcgc

SEQ ID NO: 695510 - DNA, 25 bp, Artificial sequence
  Synthetic oligonucleotide
acgtccacgccttcgtcctcgtagc

SEQ ID NO: 695511 - DNA, 25 bp, Artificial sequence
  Synthetic oligonucleotide
acggccacgtccacgccttcgtcct

SEQ ID NO: 695512 - DNA, 25 bp, Artificial sequence
  Synthetic oligonucleotide
aggccggcggccttgaccttgtcgc

SEQ ID NO: 695513 - DNA, 25 bp, Artificial sequence
  Synthetic oligonucleotide
atgccgatgccgaagataccgacca

SEQ ID NO: 695514 - DNA, 25 bp, Artificial sequence
  Synthetic oligonucleotide
agctcggcgccggcgccgcgcggca

SEQ ID NO: 695515 - DNA, 25 bp, Artificial sequence
  Synthetic oligonucleotide
gagggtagctcggcgccggcgccgc

SEQ ID NO: 695516 - DNA, 25 bp, Artificial sequence
  Synthetic oligonucleotide
agggtcgagggtagctcggcgccgg

SEQ ID NO: 695517 - DNA, 25 bp, Artificial sequence
  Synthetic oligonucleotide
ccggtcagggtcgagggtagctcgg

SEQ ID NO: 695518 - DNA, 25 bp, Artificial sequence
  Synthetic oligonucleotide
gcggcgccggtcagggtcgagggta

SEQ ID NO: 695519 - DNA, 25 bp, Artificial sequence
  Synthetic oligonucleotide
gccacggcggcgccggtcagggtcg

SEQ ID NO: 695520 - DNA, 25 bp, Artificial sequence
  Synthetic oligonucleotide
gccaccgccacggcggcgccggtca

SEQ ID NO: 695521 - DNA, 25 bp, Artificial sequence
  Synthetic oligonucleotide
ttgtcggccaccgccacggcggcgc

SEQ ID NO: 695522 - DNA, 25 bp, Artificial sequence
  Synthetic oligonucleotide
tcgagcttgtcggccaccgccacgg

SEQ ID NO: 695523 - DNA, 25 bp, Artificial sequence
  Synthetic oligonucleotide
agggtatcgagcttgtcggccaccg

SEQ ID NO: 695524 - DNA, 25 bp, Artificial sequence
  Synthetic oligonucleotide
ccgaccagggtatcgagcttgtcgg

SEQ ID NO: 695525 - DNA, 25 bp, Artificial sequence
  Synthetic oligonucleotide
aggtcgagctgcttctcgatgagga

SEQ ID NO: 695526 - DNA, 25 bp, Artificial sequence
  Synthetic oligonucleotide
atgccgaagataccgaccagggtat

SEQ ID NO: 695527 - DNA, 25 bp, Artificial sequence
  Synthetic oligonucleotide
gcgcgcaccgactggtacacggcca

SEQ ID NO: 695528 - DNA, 25 bp, Artificial sequence
  Synthetic oligonucleotide
gggaagcatgccgatgccgaagata

SEQ ID NO: 695529 - DNA, 25 bp, Artificial sequence
  Synthetic oligonucleotide
tgccggtgggaagcatgccgatgcc

SEQ ID NO: 695530 - DNA, 25 bp, Artificial sequence
  Synthetic oligonucleotide
ccttgctgccggtgggaagcatgcc

SEQ ID NO: 695531 - DNA, 25 bp, Artificial sequence
  Synthetic oligonucleotide
aggggtccttgctgccggtgggaag

SEQ ID NO: 695532 - DNA, 25 bp, Artificial sequence
  Synthetic oligonucleotide
gcgcgtaggggtccttgctgccggt

SEQ ID NO: 695533 - DNA, 25 bp, Artificial sequence
  Synthetic oligonucleotide
ggcgcagcgcgtaggggtccttgct

SEQ ID NO: 695534 - DNA, 25 bp, Artificial sequence
  Synthetic oligonucleotide
cagcgcggcgcagcgcgtaggggtc

SEQ ID NO: 695535 - DNA, 25 bp, Artificial sequence
  Synthetic oligonucleotide
ccagcgcagcgcggcgcagcgcgta

SEQ ID NO: 695536 - DNA, 25 bp, Artificial sequence
  Synthetic oligonucleotide
agcacgcccagcgcagcgcggcgca

SEQ ID NO: 695537 - DNA, 25 bp, Artificial sequence
  Synthetic oligonucleotide
atgcgcagcacgcccagcgcagcgc

SEQ ID NO: 695538 - DNA, 25 bp, Artificial sequence
  Synthetic oligonucleotide
atgaggatgcgcagcacgcccagcg

SEQ ID NO: 695539 - DNA, 25 bp, Artificial sequence
  Synthetic oligonucleotide
aagataccgaccagggtatcgagct

SEQ ID NO: 695540 - DNA, 25 bp, Artificial sequence
  Synthetic oligonucleotide
gtcgcgtgccgctgccagcggcgcg

SEQ ID NO: 695541 - DNA, 25 bp, Artificial sequence
  Synthetic oligonucleotide
ccagcaggctggcatccacgttcgg

SEQ ID NO: 695542 - DNA, 25 bp, Artificial sequence
  Synthetic oligonucleotide
gcttccaccagcaggctggcatcca

SEQ ID NO: 695543 - DNA, 25 bp, Artificial sequence
  Synthetic oligonucleotide
tcggcggcttccaccagcaggctgg

SEQ ID NO: 695544 - DNA, 25 bp, Artificial sequence
  Synthetic oligonucleotide
gccttctcggcggcttccaccagca

SEQ ID NO: 695545 - DNA, 25 bp, Artificial sequence
  Synthetic oligonucleotide
cccagggccttctcggcggcttcca

SEQ ID NO: 695546 - DNA, 25 bp, Artificial sequence
  Synthetic oligonucleotide
gcgctgcccagggccttctcggcgg

SEQ ID NO: 695547 - DNA, 25 bp, Artificial sequence
  Synthetic oligonucleotide
cgccacggcgctgcccagggccttc

SEQ ID NO: 695548 - DNA, 25 bp, Artificial sequence
  Synthetic oligonucleotide
ggcgttcgccacggcgctgcccagg

SEQ ID NO: 695549 - DNA, 25 bp, Artificial sequence
  Synthetic oligonucleotide
gctttcggcgttcgccacggcgctg

SEQ ID NO: 695550 - DNA, 25 bp, Artificial sequence
  Synthetic oligonucleotide
acttcgctttcggcgttcgccacgg

SEQ ID NO: 695551 - DNA, 25 bp, Artificial sequence
  Synthetic oligonucleotide
ggcgcgacttcgctttcggcgttcg

SEQ ID NO: 695552 - DNA, 25 bp, Artificial sequence
  Synthetic oligonucleotide
tggtacacggccacgtccacgcctt

SEQ ID NO: 695553 - DNA, 25 bp, Artificial sequence
  Synthetic oligonucleotide
gtgccgctgccagcggcgcgacttc

SEQ ID NO: 695554 - DNA, 25 bp, Artificial sequence
  Synthetic oligonucleotide
cacgttcggcggaacctcgtcctcg

SEQ ID NO: 695555 - DNA, 25 bp, Artificial sequence
  Synthetic oligonucleotide
gcgatagtcgcgtgccgctgccagc

SEQ ID NO: 695556 - DNA, 25 bp, Artificial sequence
  Synthetic oligonucleotide
gcggcgcgatagtcgcgtgccgctg

SEQ ID NO: 695557 - DNA, 25 bp, Artificial sequence
  Synthetic oligonucleotide
gccagcgcggcgcgatagtcgcgtg

SEQ ID NO: 695558 - DNA, 25 bp, Artificial sequence
  Synthetic oligonucleotide
aggcgggccagcgcggcgcgatagt

SEQ ID NO: 695559 - DNA, 25 bp, Artificial sequence
  Synthetic oligonucleotide
gccgccaggcgggccagcgcggcgc

SEQ ID NO: 695560 - DNA, 25 bp, Artificial sequence
  Synthetic oligonucleotide
cgcaaggccgccaggcgggccagcg

SEQ ID NO: 695561 - DNA, 25 bp, Artificial sequence
  Synthetic oligonucleotide
ggctcgcgcaaggccgccaggcggg

SEQ ID NO: 695562 - DNA, 25 bp, Artificial sequence
  Synthetic oligonucleotide
tccaccggctcgcgcaaggccgcca

SEQ ID NO: 695563 - DNA, 25 bp, Artificial sequence
  Synthetic oligonucleotide
aacgtatccaccggctcgcgcaagg

SEQ ID NO: 695564 - DNA, 25 bp, Artificial sequence
  Synthetic oligonucleotide
gcgaagaacgtatccaccggctcgc

SEQ ID NO: 695565 - DNA, 25 bp, Artificial sequence
  Synthetic oligonucleotide
agggcgtgcctcagaagaacgtcag

SEQ ID NO: 695566 - DNA, 25 bp, Artificial sequence
  Synthetic oligonucleotide
tgccagcggcgcgacttcgctttcg

SEQ ID NO: 695567 - DNA, 25 bp, Artificial sequence
  Synthetic oligonucleotide
tcggcttcaggcaactggcggaagg

SEQ ID NO: 695568 - DNA, 25 bp, Artificial sequence
  Synthetic oligonucleotide
cgcggcatgtactgctcgttgaggg

SEQ ID NO: 695569 - DNA, 25 bp, Artificial sequence
  Synthetic oligonucleotide
ttgagcgcgcgcaccgactggtaca

SEQ ID NO: 695570 - DNA, 25 bp, Artificial sequence
  Synthetic oligonucleotide
cttggcttgagcgcgcgcaccgact

SEQ ID NO: 695571 - DNA, 25 bp, Artificial sequence
  Synthetic oligonucleotide
ggcgagcttggcttgagcgcgcgca

SEQ ID NO: 695572 - DNA, 25 bp, Artificial sequence
  Synthetic oligonucleotide
tccagcggcgagcttggcttgagcg

SEQ ID NO: 695573 - DNA, 25 bp, Artificial sequence
  Synthetic oligonucleotide
tcgaagtccagcggcgagcttggct

SEQ ID NO: 695574 - DNA, 25 bp, Artificial sequence
  Synthetic oligonucleotide
cgctggtcgaagtccagcggcgagc

SEQ ID NO: 695575 - DNA, 25 bp, Artificial sequence
  Synthetic oligonucleotide
ctgtacgcgctggtcgaagtccagc

SEQ ID NO: 695576 - DNA, 25 bp, Artificial sequence
  Synthetic oligonucleotide
gacggcctgtacgcgctggtcgaag

SEQ ID NO: 695577 - DNA, 25 bp, Artificial sequence
  Synthetic oligonucleotide
ggcctggacggcctgtacgcgctgg

SEQ ID NO: 695578 - DNA, 25 bp, Artificial sequence
  Synthetic oligonucleotide
gcggaaggcctggacggcctgtacg

SEQ ID NO: 695579 - DNA, 25 bp, Artificial sequence
  Synthetic oligonucleotide
aggctggcatccacgttcggcggaa

SEQ ID NO: 695580 - DNA, 25 bp, Artificial sequence
  Synthetic oligonucleotide
ttcaggcaactggcggaaggcctgg

SEQ ID NO: 695581 - DNA, 25 bp, Artificial sequence
  Synthetic oligonucleotide
ggcatccacgttcggcggaacctcg

SEQ ID NO: 695582 - DNA, 25 bp, Artificial sequence
  Synthetic oligonucleotide
agggcctcggcttcaggcaactggc

SEQ ID NO: 695583 - DNA, 25 bp, Artificial sequence
  Synthetic oligonucleotide
gcggccagggcctcggcttcaggca

SEQ ID NO: 695584 - DNA, 25 bp, Artificial sequence
  Synthetic oligonucleotide
ttcgccgcggccagggcctcggctt

SEQ ID NO: 695585 - DNA, 25 bp, Artificial sequence
  Synthetic oligonucleotide
cgtttgttcgccgcggccagggcct

SEQ ID NO: 695586 - DNA, 25 bp, Artificial sequence
  Synthetic oligonucleotide
tcgacacccgtttgttcgccgcggc

SEQ ID NO: 695587 - DNA, 25 bp, Artificial sequence
  Synthetic oligonucleotide
gaatattcgacacccgtttgttcgc

SEQ ID NO: 695588 - DNA, 25 bp, Artificial sequence
  Synthetic oligonucleotide
tggcgagaatattcgacacccgttt

SEQ ID NO: 695589 - DNA, 25 bp, Artificial sequence
  Synthetic oligonucleotide
cggacttggcgagaatattcgacac

SEQ ID NO: 695590 - DNA, 25 bp, Artificial sequence
  Synthetic oligonucleotide
cgtcctcggacttggcgagaatatt

SEQ ID NO: 695591 - DNA, 25 bp, Artificial sequence
  Synthetic oligonucleotide
gaacctcgtcctcggacttggcgag

SEQ ID NO: 695592 - DNA, 25 bp, Artificial sequence
  Synthetic oligonucleotide
cggcggaacctcgtcctcggacttg

SEQ ID NO: 695593 - DNA, 25 bp, Artificial sequence
  Synthetic oligonucleotide
accgactggtacacggccacgtcca

SEQ ID NO: 695594 - DNA, 25 bp, Artificial sequence
  Synthetic oligonucleotide
caactggcggaaggcctggacggcc

SEQ ID NO: 695595 - DNA, 25 bp, Artificial sequence
  Synthetic oligonucleotide
cggtgatgaagcgaggcagcagctt

SEQ ID NO: 695596 - DNA, 25 bp, Artificial sequence
  Synthetic oligonucleotide
tgatcagggcttcctgcgggacctc

SEQ ID NO: 695597 - DNA, 25 bp, Artificial sequence
  Synthetic oligonucleotide
ggtggtgatcagggcttcctgcggg

SEQ ID NO: 695598 - DNA, 25 bp, Artificial sequence
  Synthetic oligonucleotide
tgcatggtggtgatcagggcttcct

SEQ ID NO: 695599 - DNA, 25 bp, Artificial sequence
  Synthetic oligonucleotide
ttgtcctgcatggtggtgatcaggg

SEQ ID NO: 695600 - DNA, 25 bp, Artificial sequence
  Synthetic oligonucleotide
ttctggttgtcctgcatggtggtga

SEQ ID NO: 695601 - DNA, 25 bp, Artificial sequence
  Synthetic oligonucleotide
aagtatttctggttgtcctgcatgg

SEQ ID NO: 695602 - DNA, 25 bp, Artificial sequence
  Synthetic oligonucleotide
aggcagaagtatttctggttgtcct

SEQ ID NO: 695603 - DNA, 25 bp, Artificial sequence
  Synthetic oligonucleotide
tccagcaggcagaagtatttctggt

SEQ ID NO: 695604 - DNA, 25 bp, Artificial sequence
  Synthetic oligonucleotide
ttggcgtccagcaggcagaagtatt

SEQ ID NO: 695605 - DNA, 25 bp, Artificial sequence
  Synthetic oligonucleotide
ttgccgttggcgtccagcaggcaga

SEQ ID NO: 695606 - DNA, 25 bp, Artificial sequence
  Synthetic oligonucleotide
gcagcttgccgttggcgtccagcag

SEQ ID NO: 695607 - DNA, 25 bp, Artificial sequence
  Synthetic oligonucleotide
gcgtcggtgaggcgcgggcgaacca

SEQ ID NO: 695608 - DNA, 25 bp, Artificial sequence
  Synthetic oligonucleotide
tgaagcgaggcagcagcttgccgtt

SEQ ID NO: 695609 - DNA, 25 bp, Artificial sequence
  Synthetic oligonucleotide
gggacctcgaggaagcgctcctcga

SEQ ID NO: 695610 - DNA, 25 bp, Artificial sequence
  Synthetic oligonucleotide
tggcgacggtgatgaagcgaggcag

SEQ ID NO: 695611 - DNA, 25 bp, Artificial sequence
  Synthetic oligonucleotide
cgacgttggcgacggtgatgaagcg

SEQ ID NO: 695612 - DNA, 25 bp, Artificial sequence
  Synthetic oligonucleotide
tgctctcgacgttggcgacggtgat

SEQ ID NO: 695613 - DNA, 25 bp, Artificial sequence
  Synthetic oligonucleotide
gcgccttgctctcgacgttggcgac

SEQ ID NO: 695614 - DNA, 25 bp, Artificial sequence
  Synthetic oligonucleotide
tctccggcgccttgctctcgacgtt

SEQ ID NO: 695615 - DNA, 25 bp, Artificial sequence
  Synthetic oligonucleotide
cgatgttctccggcgccttgctctc

SEQ ID NO: 695616 - DNA, 25 bp, Artificial sequence
  Synthetic oligonucleotide
cgctgacgatgttctccggcgcctt

SEQ ID NO: 695617 - DNA, 25 bp, Artificial sequence
  Synthetic oligonucleotide
tcgttaccgctgacgatgttctccg

SEQ ID NO: 695618 - DNA, 25 bp, Artificial sequence
  Synthetic oligonucleotide
caccttctcgttaccgctgacgatg

SEQ ID NO: 695619 - DNA, 25 bp, Artificial sequence
  Synthetic oligonucleotide
gcgaaccaccttctcgttaccgctg

SEQ ID NO: 695620 - DNA, 25 bp, Artificial sequence
  Synthetic oligonucleotide
gcgccggcgccgcgcggcatgtact

SEQ ID NO: 695621 - DNA, 25 bp, Artificial sequence
  Synthetic oligonucleotide
gaggcagcagcttgccgttggcgtc

SEQ ID NO: 695622 - DNA, 25 bp, Artificial sequence
  Synthetic oligonucleotide
gtcgagcaggctcggcggcacgatg

SEQ ID NO: 695623 - DNA, 25 bp, Artificial sequence
  Synthetic oligonucleotide
accatcacatcggcgaagaacgtat

SEQ ID NO: 695624 - DNA, 25 bp, Artificial sequence
  Synthetic oligonucleotide
gctcgcggcgctcggcgaaatcggc

SEQ ID NO: 695625 - DNA, 25 bp, Artificial sequence
  Synthetic oligonucleotide
gatcagctcgcggcgctcggcgaaa

SEQ ID NO: 695626 - DNA, 25 bp, Artificial sequence
  Synthetic oligonucleotide
cttggcgatcagctcgcggcgctcg

SEQ ID NO: 695627 - DNA, 25 bp, Artificial sequence
  Synthetic oligonucleotide
acgcgcttggcgatcagctcgcggc

SEQ ID NO: 695628 - DNA, 25 bp, Artificial sequence
  Synthetic oligonucleotide
tcggccacgcgcttggcgatcagct

SEQ ID NO: 695629 - DNA, 25 bp, Artificial sequence
  Synthetic oligonucleotide
gccagttcggccacgcgcttggcga

SEQ ID NO: 695630 - DNA, 25 bp, Artificial sequence
  Synthetic oligonucleotide
ctcggcggccagttcggccacgcgc

SEQ ID NO: 695631 - DNA, 25 bp, Artificial sequence
  Synthetic oligonucleotide
ctgttgctcggcggccagttcggcc

SEQ ID NO: 695632 - DNA, 25 bp, Artificial sequence
  Synthetic oligonucleotide
cgctgccctgttgctcggcggccag

SEQ ID NO: 695633 - DNA, 25 bp, Artificial sequence
  Synthetic oligonucleotide
acgatggcgctgccctgttgctcgg

SEQ ID NO: 695634 - DNA, 25 bp, Artificial sequence
  Synthetic oligonucleotide
gggcttcctgcgggacctcgaggaa

SEQ ID NO: 695635 - DNA, 25 bp, Artificial sequence
  Synthetic oligonucleotide
caggctcggcggcacgatggcgctg

SEQ ID NO: 695636 - DNA, 25 bp, Artificial sequence
  Synthetic oligonucleotide
tcctgcgggacctcgaggaagcgct

SEQ ID NO: 695637 - DNA, 25 bp, Artificial sequence
  Synthetic oligonucleotide
acttcgtcgagcaggctcggcggca

SEQ ID NO: 695638 - DNA, 25 bp, Artificial sequence
  Synthetic oligonucleotide
gcagtcacttcgtcgagcaggctcg

SEQ ID NO: 695639 - DNA, 25 bp, Artificial sequence
  Synthetic oligonucleotide
accagtgcagtcacttcgtcgagca

SEQ ID NO: 695640 - DNA, 25 bp, Artificial sequence
  Synthetic oligonucleotide
cactcgaccagtgcagtcacttcgt

SEQ ID NO: 695641 - DNA, 25 bp, Artificial sequence
  Synthetic oligonucleotide
accggccactcgaccagtgcagtca

SEQ ID NO: 695642 - DNA, 25 bp, Artificial sequence
  Synthetic oligonucleotide
agcggcaccggccactcgaccagtg

SEQ ID NO: 695643 - DNA, 25 bp, Artificial sequence
  Synthetic oligonucleotide
cagaccagcggcaccggccactcga

SEQ ID NO: 695644 - DNA, 25 bp, Artificial sequence
  Synthetic oligonucleotide
aaggagcagaccagcggcaccggcc

SEQ ID NO: 695645 - DNA, 25 bp, Artificial sequence
  Synthetic oligonucleotide
tcctcgaaggagcagaccagcggca

SEQ ID NO: 695646 - DNA, 25 bp, Artificial sequence
  Synthetic oligonucleotide
aagcgctcctcgaaggagcagacca

SEQ ID NO: 695647 - DNA, 25 bp, Artificial sequence
  Synthetic oligonucleotide
tcgaggaagcgctcctcgaaggagc

SEQ ID NO: 695648 - DNA, 25 bp, Artificial sequence
  Synthetic oligonucleotide
aactcggcgtcggtgaggcgcgggc

SEQ ID NO: 695649 - DNA, 25 bp, Artificial sequence
  Synthetic oligonucleotide
ggcggcacgatggcgctgccctgtt

SEQ ID NO: 695650 - DNA, 25 bp, Artificial sequence
  Synthetic oligonucleotide
gtagtagtagccggcgatgccctgc

SEQ ID NO: 695651 - DNA, 25 bp, Artificial sequence
  Synthetic oligonucleotide
tgccggcgcgcgaggcgttctgcgc

SEQ ID NO: 695652 - DNA, 25 bp, Artificial sequence
  Synthetic oligonucleotide
acaggatgccggcgcgcgaggcgtt

SEQ ID NO: 695653 - DNA, 25 bp, Artificial sequence
  Synthetic oligonucleotide
acttggacaggatgccggcgcgcga

SEQ ID NO: 695654 - DNA, 25 bp, Artificial sequence
  Synthetic oligonucleotide
ggtcacacttggacaggatgccggc

SEQ ID NO: 695655 - DNA, 25 bp, Artificial sequence
  Synthetic oligonucleotide
tcgccaggtcacacttggacaggat

SEQ ID NO: 695656 - DNA, 25 bp, Artificial sequence
  Synthetic oligonucleotide
tctcggtcgccaggtcacacttgga

SEQ ID NO: 695657 - DNA, 25 bp, Artificial sequence
  Synthetic oligonucleotide
cgaccatctcggtcgccaggtcaca

SEQ ID NO: 695658 - DNA, 25 bp, Artificial sequence
  Synthetic oligonucleotide
actcgccgaccatctcggtcgccag

SEQ ID NO: 695659 - DNA, 25 bp, Artificial sequence
  Synthetic oligonucleotide
cggggaactcgccgaccatctcggt

SEQ ID NO: 695660 - DNA, 25 bp, Artificial sequence
  Synthetic oligonucleotide
gcatttcggggaactcgccgaccat

SEQ ID NO: 695661 - DNA, 25 bp, Artificial sequence
  Synthetic oligonucleotide
tgccctgcatttcggggaactcgcc

SEQ ID NO: 695662 - DNA, 25 bp, Artificial sequence
  Synthetic oligonucleotide
tgaggcgcgggcgaaccaccttctc

SEQ ID NO: 695663 - DNA, 25 bp, Artificial sequence
  Synthetic oligonucleotide
gtagccggcgatgccctgcatttcg

SEQ ID NO: 695664 - DNA, 25 bp, Artificial sequence
  Synthetic oligonucleotide
tctgcgcattgccgcctatacgttc

SEQ ID NO: 695665 - DNA, 25 bp, Artificial sequence
  Synthetic oligonucleotide
gtggcgtagtagtagccggcgatgc

SEQ ID NO: 695666 - DNA, 25 bp, Artificial sequence
  Synthetic oligonucleotide
ccgtgggtggcgtagtagtagccgg

SEQ ID NO: 695667 - DNA, 25 bp, Artificial sequence
  Synthetic oligonucleotide
tcgccgccgtgggtggcgtagtagt

SEQ ID NO: 695668 - DNA, 25 bp, Artificial sequence
  Synthetic oligonucleotide
tccgcttcgccgccgtgggtggcgt

SEQ ID NO: 695669 - DNA, 25 bp, Artificial sequence
  Synthetic oligonucleotide
acgtcttccgcttcgccgccgtggg

SEQ ID NO: 695670 - DNA, 25 bp, Artificial sequence
  Synthetic oligonucleotide
agggcgacgtcttccgcttcgccgc

SEQ ID NO: 695671 - DNA, 25 bp, Artificial sequence
  Synthetic oligonucleotide
agggccagggcgacgtcttccgctt

SEQ ID NO: 695672 - DNA, 25 bp, Artificial sequence
  Synthetic oligonucleotide
cgttgagggccagggcgacgtcttc

SEQ ID NO: 695673 - DNA, 25 bp, Artificial sequence
  Synthetic oligonucleotide
actgctcgttgagggccagggcgac

SEQ ID NO: 695674 - DNA, 25 bp, Artificial sequence
  Synthetic oligonucleotide
catgtactgctcgttgagggccagg

SEQ ID NO: 695675 - DNA, 25 bp, Artificial sequence
  Synthetic oligonucleotide
cggcgaaatcggccagcacatgagc

SEQ ID NO: 695676 - DNA, 25 bp, Artificial sequence
  Synthetic oligonucleotide
ggcgatgccctgcatttcggggaac

SEQ ID NO: 695677 - DNA, 25 bp, Artificial sequence
  Synthetic oligonucleotide
acggtgccgagctgggcctggaaca

SEQ ID NO: 695678 - DNA, 25 bp, Artificial sequence
  Synthetic oligonucleotide
aagaagaactcggcgtcggtgaggc

SEQ ID NO: 695679 - DNA, 25 bp, Artificial sequence
  Synthetic oligonucleotide
tgcttgaagaagaactcggcgtcgg

SEQ ID NO: 695680 - DNA, 25 bp, Artificial sequence
  Synthetic oligonucleotide
ttgtcctgcttgaagaagaactcgg

SEQ ID NO: 695681 - DNA, 25 bp, Artificial sequence
  Synthetic oligonucleotide
ctgcttcttgtcctgcttgaagaag

SEQ ID NO: 695682 - DNA, 25 bp, Artificial sequence
  Synthetic oligonucleotide
gagcggctgcttcttgtcctgcttg

SEQ ID NO: 695683 - DNA, 25 bp, Artificial sequence
  Synthetic oligonucleotide
gctttcgagcggctgcttcttgtcc

SEQ ID NO: 695684 - DNA, 25 bp, Artificial sequence
  Synthetic oligonucleotide
cattgaagctttcgagcggctgctt

SEQ ID NO: 695685 - DNA, 25 bp, Artificial sequence
  Synthetic oligonucleotide
ggcgctcattgaagctttcgagcgg

SEQ ID NO: 695686 - DNA, 25 bp, Artificial sequence
  Synthetic oligonucleotide
tgcgcaggcgctcattgaagctttc

SEQ ID NO: 695687 - DNA, 25 bp, Artificial sequence
  Synthetic oligonucleotide
actacgttgcgcaggcgctcattga

SEQ ID NO: 695688 - DNA, 25 bp, Artificial sequence
  Synthetic oligonucleotide
tggaacactacgttgcgcaggcgct

SEQ ID NO: 695689 - DNA, 25 bp, Artificial sequence
  Synthetic oligonucleotide
cgcgcgaggcgttctgcgcattgcc

SEQ ID NO: 695690 - DNA, 25 bp, Artificial sequence
  Synthetic oligonucleotide
ccgagctgggcctggaacactacgt

SEQ ID NO: 695691 - DNA, 25 bp, Artificial sequence
  Synthetic oligonucleotide
aggcgttctgcgcattgccgcctat

SEQ ID NO: 695692 - DNA, 25 bp, Artificial sequence
  Synthetic oligonucleotide
tcgaacacggtgccgagctgggcct

SEQ ID NO: 695693 - DNA, 25 bp, Artificial sequence
  Synthetic oligonucleotide
gccttctcgaacacggtgccgagct

SEQ ID NO: 695694 - DNA, 25 bp, Artificial sequence
  Synthetic oligonucleotide
cgctgggccttctcgaacacggtgc

SEQ ID NO: 695695 - DNA, 25 bp, Artificial sequence
  Synthetic oligonucleotide
gagacgcgctgggccttctcgaaca

SEQ ID NO: 695696 - DNA, 25 bp, Artificial sequence
  Synthetic oligonucleotide
aggccggagacgcgctgggccttct

SEQ ID NO: 695697 - DNA, 25 bp, Artificial sequence
  Synthetic oligonucleotide
gcggccaggccggagacgcgctggg

SEQ ID NO: 695698 - DNA, 25 bp, Artificial sequence
  Synthetic oligonucleotide
atgtaggcggccaggccggagacgc

SEQ ID NO: 695699 - DNA, 25 bp, Artificial sequence
  Synthetic oligonucleotide
tcggcgatgtaggcggccaggccgg

SEQ ID NO: 695700 - DNA, 25 bp, Artificial sequence
  Synthetic oligonucleotide
tacgttcggcgatgtaggcggccag

SEQ ID NO: 695701 - DNA, 25 bp, Artificial sequence
  Synthetic oligonucleotide
cgcctatacgttcggcgatgtaggc

SEQ ID NO: 695702 - DNA, 25 bp, Artificial sequence
  Synthetic oligonucleotide
cattgccgcctatacgttcggcgat

SEQ ID NO: 695703 - DNA, 25 bp, Artificial sequence
  Synthetic oligonucleotide
gcgccgcgcggcatgtactgctcgt

SEQ ID NO: 695704 - DNA, 25 bp, Artificial sequence
  Synthetic oligonucleotide
tgggcctggaacactacgttgcgca

SEQ ID NO: 695705 - DNA, 25 bp, Artificial sequence
  Synthetic oligonucleotide
ctggccaggtgctcggccagtgtgc

SEQ ID NO: 695706 - DNA, 25 bp, Artificial sequence
  Synthetic oligonucleotide
caggcggtcgccgtcggtgtcgacc

SEQ ID NO: 695707 - DNA, 25 bp, Artificial sequence
  Synthetic oligonucleotide
gtcgccgtcggtgtcgaccacggtg

SEQ ID NO: 695708 - DNA, 25 bp, Artificial sequence
  Synthetic oligonucleotide
tcggtgtcgaccacggtgatgtcgt

SEQ ID NO: 695709 - DNA, 25 bp, Artificial sequence
  Synthetic oligonucleotide
tcgaccacggtgatgtcgttggctt

SEQ ID NO: 695710 - DNA, 25 bp, Artificial sequence
  Synthetic oligonucleotide
cacggtgatgtcgttggcttcgctg

SEQ ID NO: 695711 - DNA, 25 bp, Artificial sequence
  Synthetic oligonucleotide
gatgtcgttggcttcgctggccagg

SEQ ID NO: 695712 - DNA, 25 bp, Artificial sequence
  Synthetic oligonucleotide
gtcgcgcaggcggtcgccgtcggtg

SEQ ID NO: 695713 - DNA, 25 bp, Artificial sequence
  Synthetic oligonucleotide
gcttcgctggccaggtgctcggcca

SEQ ID NO: 695714 - DNA, 25 bp, Artificial sequence
  Synthetic oligonucleotide
cagtgtgccgccgacctggccggca

SEQ ID NO: 695715 - DNA, 25 bp, Artificial sequence
  Synthetic oligonucleotide
aggtgctcggccagtgtgccgccga

SEQ ID NO: 695716 - DNA, 25 bp, Artificial sequence
  Synthetic oligonucleotide
ctcggccagtgtgccgccgacctgg

SEQ ID NO: 695717 - DNA, 25 bp, Artificial sequence
  Synthetic oligonucleotide
tgccgccgacctggccggcaccgag

SEQ ID NO: 695718 - DNA, 25 bp, Artificial sequence
  Synthetic oligonucleotide
ggccggcaccgaggatgatgatttt

SEQ ID NO: 695719 - DNA, 25 bp, Artificial sequence
  Synthetic oligonucleotide
ccgttcgcgatagggcgtgcctcag

SEQ ID NO: 695720 - DNA, 25 bp, Artificial sequence
  Synthetic oligonucleotide
ggtcaccgccaccagcatgtcggcg

SEQ ID NO: 695721 - DNA, 25 bp, Artificial sequence
  Synthetic oligonucleotide
cgttggcttcgctggccaggtgctc

SEQ ID NO: 695722 - DNA, 25 bp, Artificial sequence
  Synthetic oligonucleotide
tcggcgtcgtcggcgccggcctggc

SEQ ID NO: 695723 - DNA, 25 bp, Artificial sequence
  Synthetic oligonucleotide
cgacctggccggcaccgaggatgat

SEQ ID NO: 695724 - DNA, 25 bp, Artificial sequence
  Synthetic oligonucleotide
gccgaggtcgcgcaggcggtcgccg

SEQ ID NO: 695725 - DNA, 25 bp, Artificial sequence
  Synthetic oligonucleotide
gccaccagcatgtcggcgtcgtcgg

SEQ ID NO: 695726 - DNA, 25 bp, Artificial sequence
  Synthetic oligonucleotide
agcatgtcggcgtcgtcggcgccgg

SEQ ID NO: 695727 - DNA, 25 bp, Artificial sequence
  Synthetic oligonucleotide
tcgtcggcgccggcctggcgcagca

SEQ ID NO: 695728 - DNA, 25 bp, Artificial sequence
  Synthetic oligonucleotide
gcgccggcctggcgcagcaccgtgg

SEQ ID NO: 695729 - DNA, 25 bp, Artificial sequence
  Synthetic oligonucleotide
gcctggcgcagcaccgtggggaacg

SEQ ID NO: 695730 - DNA, 25 bp, Artificial sequence
  Synthetic oligonucleotide
cgcagcaccgtggggaacgaggcct

SEQ ID NO: 695731 - DNA, 25 bp, Artificial sequence
  Synthetic oligonucleotide
tgtcgaggcggtcgccgaggtcgcg

SEQ ID NO: 695732 - DNA, 25 bp, Artificial sequence
  Synthetic oligonucleotide
ggaacgaggccttgccttgcacggt

SEQ ID NO: 695733 - DNA, 25 bp, Artificial sequence
  Synthetic oligonucleotide
aggccttgccttgcacggtgcggat

SEQ ID NO: 695734 - DNA, 25 bp, Artificial sequence
  Synthetic oligonucleotide
tgccttgcacggtgcggatgtcgag

SEQ ID NO: 695735 - DNA, 25 bp, Artificial sequence
  Synthetic oligonucleotide
gcacggtgcggatgtcgaggcggtc

SEQ ID NO: 695736 - DNA, 25 bp, Artificial sequence
  Synthetic oligonucleotide
tgcggatgtcgaggcggtcgccgag

SEQ ID NO: 695737 - DNA, 25 bp, Artificial sequence
  Synthetic oligonucleotide
ccgtggggaacgaggccttgccttg

SEQ ID NO: 695738 - DNA, 25 bp, Artificial sequence
  Synthetic oligonucleotide
ggcggtcgccgaggtcgcgcaggcg

SEQ ID NO: 695739 - DNA, 25 bp, Artificial sequence
  Synthetic oligonucleotide
ccgactacaacctgcagttcgccga

SEQ ID NO: 695740 - DNA, 25 bp, Artificial sequence
  Synthetic oligonucleotide
ggatccccgactacaacctgcagtt

SEQ ID NO: 695741 - DNA, 25 bp, Artificial sequence
  Synthetic oligonucleotide
cgcgacggatccccgactacaacct

SEQ ID NO: 695742 - DNA, 25 bp, Artificial sequence
  Synthetic oligonucleotide
gcatgccgcgacggatccccgacta

SEQ ID NO: 695743 - DNA, 25 bp, Artificial sequence
  Synthetic oligonucleotide
tcgccggcatgccgcgacggatccc

SEQ ID NO: 695744 - DNA, 25 bp, Artificial sequence
  Synthetic oligonucleotide
tcggcctcgccggcatgccgcgacg

SEQ ID NO: 695745 - DNA, 25 bp, Artificial sequence
  Synthetic oligonucleotide
acttcgtcggcctcgccggcatgcc

SEQ ID NO: 695746 - DNA, 25 bp, Artificial sequence
  Synthetic oligonucleotide
tggcgttcttcccgatgcacttcgt

SEQ ID NO: 695747 - DNA, 25 bp, Artificial sequence
  Synthetic oligonucleotide
tcttcccgatgcacttcgtcggcct

SEQ ID NO: 695748 - DNA, 25 bp, Artificial sequence
  Synthetic oligonucleotide
acaacctgcagttcgccgacttcaa

SEQ ID NO: 695749 - DNA, 25 bp, Artificial sequence
  Synthetic oligonucleotide
ccacccagctgctgttcctgttcat

SEQ ID NO: 695750 - DNA, 25 bp, Artificial sequence
  Synthetic oligonucleotide
tgaacctggcgttcttcccgatgca

SEQ ID NO: 695751 - DNA, 25 bp, Artificial sequence
  Synthetic oligonucleotide
cgatgcacttcgtcggcctcgccgg

SEQ ID NO: 695752 - DNA, 25 bp, Artificial sequence
  Synthetic oligonucleotide
tgcagttcgccgacttcaacatggt

SEQ ID NO: 695753 - DNA, 25 bp, Artificial sequence
  Synthetic oligonucleotide
tcgccgacttcaacatggtctcgtc

SEQ ID NO: 695754 - DNA, 25 bp, Artificial sequence
  Synthetic oligonucleotide
acttcaacatggtctcgtcgatcgg

SEQ ID NO: 695755 - DNA, 25 bp, Artificial sequence
  Synthetic oligonucleotide
acatggtctcgtcgatcggcgcctt

SEQ ID NO: 695756 - DNA, 25 bp, Artificial sequence
  Synthetic oligonucleotide
tctcgtcgatcggcgccttcatgtt

SEQ ID NO: 695757 - DNA, 25 bp, Artificial sequence
  Synthetic oligonucleotide
cgatcggcgccttcatgttcggcac

SEQ ID NO: 695758 - DNA, 25 bp, Artificial sequence
  Synthetic oligonucleotide
gcgccttcatgttcggcaccaccca

SEQ ID NO: 695759 - DNA, 25 bp, Artificial sequence
  Synthetic oligonucleotide
tcggcaccacccagctgctgttcct

SEQ ID NO: 695760 - DNA, 25 bp, Artificial sequence
  Synthetic oligonucleotide
agctgctgttcctgttcatcgtcat

SEQ ID NO: 695761 - DNA, 25 bp, Artificial sequence
  Synthetic oligonucleotide
tgttcctgttcatcgtcatcaagtg

SEQ ID NO: 695762 - DNA, 25 bp, Artificial sequence
  Synthetic oligonucleotide
tcggcatgaacctggcgttcttccc

SEQ ID NO: 695763 - DNA, 25 bp, Artificial sequence
  Synthetic oligonucleotide
cgcgatcttcggcatcttcgcctcg

SEQ ID NO: 695764 - DNA, 25 bp, Artificial sequence
  Synthetic oligonucleotide
tcatgttcggcaccacccagctgct

SEQ ID NO: 695765 - DNA, 25 bp, Artificial sequence
  Synthetic oligonucleotide
tactactggctgccgaagtggaccg

SEQ ID NO: 695766 - DNA, 25 bp, Artificial sequence
  Synthetic oligonucleotide
cctacttcgtggtcgcccacttcca

SEQ ID NO: 695767 - DNA, 25 bp, Artificial sequence
  Synthetic oligonucleotide
tcgtggtcgcccacttccactacgt

SEQ ID NO: 695768 - DNA, 25 bp, Artificial sequence
  Synthetic oligonucleotide
tcgcccacttccactacgtgctggt

SEQ ID NO: 695769 - DNA, 25 bp, Artificial sequence
  Synthetic oligonucleotide
acttccactacgtgctggtgcccgg

SEQ ID NO: 695770 - DNA, 25 bp, Artificial sequence
  Synthetic oligonucleotide
actacgtgctggtgcccggcgcgat

SEQ ID NO: 695771 - DNA, 25 bp, Artificial sequence
  Synthetic oligonucleotide
tgctggtgcccggcgcgatcttcgg

SEQ ID NO: 695772 - DNA, 25 bp, Artificial sequence
  Synthetic oligonucleotide
tgcccggcgcgatcttcggcatctt

SEQ ID NO: 695773 - DNA, 25 bp, Artificial sequence
  Synthetic oligonucleotide
accttcagcaccccgcccgaggtca

SEQ ID NO: 695774 - DNA, 25 bp, Artificial sequence
  Synthetic oligonucleotide
tcttcggcatcttcgcctcggctta

SEQ ID NO: 695775 - DNA, 25 bp, Artificial sequence
  Synthetic oligonucleotide
tgttcatcgtcatcaagtgcatccg

SEQ ID NO: 695776 - DNA, 25 bp, Artificial sequence
  Synthetic oligonucleotide
gcatcttcgcctcggcttactactg

SEQ ID NO: 695777 - DNA, 25 bp, Artificial sequence
  Synthetic oligonucleotide
tcggcttactactggctgccgaagt

SEQ ID NO: 695778 - DNA, 25 bp, Artificial sequence
  Synthetic oligonucleotide
cttcatcggcatgaacctggcgttc

SEQ ID NO: 695779 - DNA, 25 bp, Artificial sequence
  Synthetic oligonucleotide
tggctgccgaagtggaccggccaca

SEQ ID NO: 695780 - DNA, 25 bp, Artificial sequence
  Synthetic oligonucleotide
ccgaagtggaccggccacatgtacg

SEQ ID NO: 695781 - DNA, 25 bp, Artificial sequence
  Synthetic oligonucleotide
tggaccggccacatgtacgacgaga

SEQ ID NO: 695782 - DNA, 25 bp, Artificial sequence
  Synthetic oligonucleotide
ggccacatgtacgacgagaccctcg

SEQ ID NO: 695783 - DNA, 25 bp, Artificial sequence
  Synthetic oligonucleotide
atgtacgacgagaccctcggcaagc

SEQ ID NO: 695784 - DNA, 25 bp, Artificial sequence
  Synthetic oligonucleotide
gacgagaccctcggcaagctgcact

SEQ ID NO: 695785 - DNA, 25 bp, Artificial sequence
  Synthetic oligonucleotide
accctcggcaagctgcacttctgga

SEQ ID NO: 695786 - DNA, 25 bp, Artificial sequence
  Synthetic oligonucleotide
ggcaagctgcacttctggatgagct

SEQ ID NO: 695787 - DNA, 25 bp, Artificial sequence
  Synthetic oligonucleotide
ctgcacttctggatgagcttcatcg

SEQ ID NO: 695788 - DNA, 25 bp, Artificial sequence
  Synthetic oligonucleotide
ttctggatgagcttcatcggcatga

SEQ ID NO: 695789 - DNA, 25 bp, Artificial sequence
  Synthetic oligonucleotide
gatgagcttcatcggcatgaacctg

SEQ ID NO: 695790 - DNA, 25 bp, Artificial sequence
  Synthetic oligonucleotide
ttcgcctcggcttactactggctgc

SEQ ID NO: 695791 - DNA, 25 bp, Artificial sequence
  Synthetic oligonucleotide
cgctctatgacgtgatgtgccgcgc

SEQ ID NO: 695792 - DNA, 25 bp, Artificial sequence
  Synthetic oligonucleotide
gcgccctaccacaccttcagcaccc

SEQ ID NO: 695793 - DNA, 25 bp, Artificial sequence
  Synthetic oligonucleotide
gccgcctggtcggccgcctgctgct

SEQ ID NO: 695794 - DNA, 25 bp, Artificial sequence
  Synthetic oligonucleotide
tggtcggccgcctgctgctggtgac

SEQ ID NO: 695795 - DNA, 25 bp, Artificial sequence
  Synthetic oligonucleotide
gccgcctgctgctggtgaccgtgct

SEQ ID NO: 695796 - DNA, 25 bp, Artificial sequence
  Synthetic oligonucleotide
tgctgctggtgaccgtgctgatgtt

SEQ ID NO: 695797 - DNA, 25 bp, Artificial sequence
  Synthetic oligonucleotide
tggtgaccgtgctgatgttcgcctt

SEQ ID NO: 695798 - DNA, 25 bp, Artificial sequence
  Synthetic oligonucleotide
ccgtgctgatgttcgccttcggctt

SEQ ID NO: 695799 - DNA, 25 bp, Artificial sequence
  Synthetic oligonucleotide
tgatgttcgccttcggcttcgccct

SEQ ID NO: 695800 - DNA, 25 bp, Artificial sequence
  Synthetic oligonucleotide
tcgccttcggcttcgccctggtgcc

SEQ ID NO: 695801 - DNA, 25 bp, Artificial sequence
  Synthetic oligonucleotide
tcggcttcgccctggtgccgctcta

SEQ ID NO: 695802 - DNA, 25 bp, Artificial sequence
  Synthetic oligonucleotide
ggtcgatacccgccgcctggtcggc

SEQ ID NO: 695803 - DNA, 25 bp, Artificial sequence
  Synthetic oligonucleotide
tggtgccgctctatgacgtgatgtg

SEQ ID NO: 695804 - DNA, 25 bp, Artificial sequence
  Synthetic oligonucleotide
tgccaaggtcgatacccgccgcctg

SEQ ID NO: 695805 - DNA, 25 bp, Artificial sequence
  Synthetic oligonucleotide
tatgacgtgatgtgccgcgccctgg

SEQ ID NO: 695806 - DNA, 25 bp, Artificial sequence
  Synthetic oligonucleotide
tgatgtgccgcgccctggggatcaa

SEQ ID NO: 695807 - DNA, 25 bp, Artificial sequence
  Synthetic oligonucleotide
ccgcgccctggggatcaacggcaag

SEQ ID NO: 695808 - DNA, 25 bp, Artificial sequence
  Synthetic oligonucleotide
cctggggatcaacggcaagaccgcc

SEQ ID NO: 695809 - DNA, 25 bp, Artificial sequence
  Synthetic oligonucleotide
cggcaagaccgccggcagcgcctac

SEQ ID NO: 695810 - DNA, 25 bp, Artificial sequence
  Synthetic oligonucleotide
ccggcagcgcctacagcggcgaaca

SEQ ID NO: 695811 - DNA, 25 bp, Artificial sequence
  Synthetic oligonucleotide
gcgcctacagcggcgaacagcaggt

SEQ ID NO: 695812 - DNA, 25 bp, Artificial sequence
  Synthetic oligonucleotide
acagcggcgaacagcaggtggatgt

SEQ ID NO: 695813 - DNA, 25 bp, Artificial sequence
  Synthetic oligonucleotide
gcgaacagcaggtggatgtcgggcg

SEQ ID NO: 695814 - DNA, 25 bp, Artificial sequence
  Synthetic oligonucleotide
cagcaggtggatgtcgggcgcgagg

SEQ ID NO: 695815 - DNA, 25 bp, Artificial sequence
  Synthetic oligonucleotide
gtggatgtcgggcgcgaggtgaagg

SEQ ID NO: 695816 - DNA, 25 bp, Artificial sequence
  Synthetic oligonucleotide
tcgccctggtgccgctctatgacgt

SEQ ID NO: 695817 - DNA, 25 bp, Artificial sequence
  Synthetic oligonucleotide
atcccctcgccggcgccctaccaca

SEQ ID NO: 695818 - DNA, 25 bp, Artificial sequence
  Synthetic oligonucleotide
atcaagtgcatccgcggcggcaagc

SEQ ID NO: 695819 - DNA, 25 bp, Artificial sequence
  Synthetic oligonucleotide
tgcatccgcggcggcaagccggccc

SEQ ID NO: 695820 - DNA, 25 bp, Artificial sequence
  Synthetic oligonucleotide
cgcggcggcaagccggcccctgcca

SEQ ID NO: 695821 - DNA, 25 bp, Artificial sequence
  Synthetic oligonucleotide
ggcaagccggcccctgccaagccct

SEQ ID NO: 695822 - DNA, 25 bp, Artificial sequence
  Synthetic oligonucleotide
ccggcccctgccaagccctgggacg

SEQ ID NO: 695823 - DNA, 25 bp, Artificial sequence
  Synthetic oligonucleotide
cctgccaagccctgggacggcgccg

SEQ ID NO: 695824 - DNA, 25 bp, Artificial sequence
  Synthetic oligonucleotide
caagccctgggacggcgccgagggc

SEQ ID NO: 695825 - DNA, 25 bp, Artificial sequence
  Synthetic oligonucleotide
tgggacggcgccgagggcctggagt

SEQ ID NO: 695826 - DNA, 25 bp, Artificial sequence
  Synthetic oligonucleotide
ggcgccgagggcctggagtggagca

SEQ ID NO: 695827 - DNA, 25 bp, Artificial sequence
  Synthetic oligonucleotide
gagggcctggagtggagcatcccct

SEQ ID NO: 695828 - DNA, 25 bp, Artificial sequence
  Synthetic oligonucleotide
tacccgccgcctggtcggccgcctg

SEQ ID NO: 695829 - DNA, 25 bp, Artificial sequence
  Synthetic oligonucleotide
tggagcatcccctcgccggcgccct

SEQ ID NO: 695830 - DNA, 25 bp, Artificial sequence
  Synthetic oligonucleotide
tcgtcatcaagtgcatccgcggcgg

SEQ ID NO: 695831 - DNA, 25 bp, Artificial sequence
  Synthetic oligonucleotide
tcgccggcgccctaccacaccttca

SEQ ID NO: 695832 - DNA, 25 bp, Artificial sequence
  Synthetic oligonucleotide
cacgacacctacttcgtggtcgccc

SEQ ID NO: 695833 - DNA, 25 bp, Artificial sequence
  Synthetic oligonucleotide
taccacaccttcagcaccccgcccg

SEQ ID NO: 695834 - DNA, 25 bp, Artificial sequence
  Synthetic oligonucleotide
ttcgctgaccttcgagacgccgatg

SEQ ID NO: 695835 - DNA, 25 bp, Artificial sequence
  Synthetic oligonucleotide
agcaccccgcccgaggtcaagtgag

SEQ ID NO: 695836 - DNA, 25 bp, Artificial sequence
  Synthetic oligonucleotide
ccgcccgaggtcaagtgaggagcgc

SEQ ID NO: 695837 - DNA, 25 bp, Artificial sequence
  Synthetic oligonucleotide
gaggtcaagtgaggagcgcgtcatg

SEQ ID NO: 695838 - DNA, 25 bp, Artificial sequence
  Synthetic oligonucleotide
aagtgaggagcgcgtcatgagcgat

SEQ ID NO: 695839 - DNA, 25 bp, Artificial sequence
  Synthetic oligonucleotide
ggagcgcgtcatgagcgatgccaag

SEQ ID NO: 695840 - DNA, 25 bp, Artificial sequence
  Synthetic oligonucleotide
cgtcatgagcgatgccaaggtcgat

SEQ ID NO: 695841 - DNA, 25 bp, Artificial sequence
  Synthetic oligonucleotide
gagcgatgccaaggtcgatacccgc

SEQ ID NO: 695842 - DNA, 25 bp, Artificial sequence
  Synthetic oligonucleotide
ctggagtggagcatcccctcgccgg

SEQ ID NO: 695843 - DNA, 25 bp, Artificial sequence
  Synthetic oligonucleotide
ctggttcttcggccaccccgaggtg

SEQ ID NO: 695844 - DNA, 25 bp, Artificial sequence
  Synthetic oligonucleotide
tcgagacgccgatgctgttcgccgt

SEQ ID NO: 695845 - DNA, 25 bp, Artificial sequence
  Synthetic oligonucleotide
tccacttcggcaccagcttcttcag

SEQ ID NO: 695846 - DNA, 25 bp, Artificial sequence
  Synthetic oligonucleotide
tcggcaccagcttcttcagcgccgc

SEQ ID NO: 695847 - DNA, 25 bp, Artificial sequence
  Synthetic oligonucleotide
ccagcttcttcagcgccgccggcgg

SEQ ID NO: 695848 - DNA, 25 bp, Artificial sequence
  Synthetic oligonucleotide
tcttcagcgccgccggcggcggcga

SEQ ID NO: 695849 - DNA, 25 bp, Artificial sequence
  Synthetic oligonucleotide
agcgccgccggcggcggcgacccgg

SEQ ID NO: 695850 - DNA, 25 bp, Artificial sequence
  Synthetic oligonucleotide
ccggcggcggcgacccggtgctgtt

SEQ ID NO: 695851 - DNA, 25 bp, Artificial sequence
  Synthetic oligonucleotide
gcggcgacccggtgctgttccagca

SEQ ID NO: 695852 - DNA, 25 bp, Artificial sequence
  Synthetic oligonucleotide
acccggtgctgttccagcacgtgtt

SEQ ID NO: 695853 - DNA, 25 bp, Artificial sequence
  Synthetic oligonucleotide
tgctgttccagcacgtgttctggtt

SEQ ID NO: 695854 - DNA, 25 bp, Artificial sequence
  Synthetic oligonucleotide
tgctgatggacatccacttcggcac

SEQ ID NO: 695855 - DNA, 25 bp, Artificial sequence
  Synthetic oligonucleotide
cacgtgttctggttcttcggccacc

SEQ ID NO: 695856 - DNA, 25 bp, Artificial sequence
  Synthetic oligonucleotide
ccatgatgctgatggacatccactt

SEQ ID NO: 695857 - DNA, 25 bp, Artificial sequence
  Synthetic oligonucleotide
tcttcggccaccccgaggtgtacat

SEQ ID NO: 695858 - DNA, 25 bp, Artificial sequence
  Synthetic oligonucleotide
gccaccccgaggtgtacatcatgat

SEQ ID NO: 695859 - DNA, 25 bp, Artificial sequence
  Synthetic oligonucleotide
ccgaggtgtacatcatgatcctgcc

SEQ ID NO: 695860 - DNA, 25 bp, Artificial sequence
  Synthetic oligonucleotide
tgtacatcatgatcctgcccgcctt

SEQ ID NO: 695861 - DNA, 25 bp, Artificial sequence
  Synthetic oligonucleotide
atcatgatcctgcccgccttcggtg

SEQ ID NO: 695862 - DNA, 25 bp, Artificial sequence
  Synthetic oligonucleotide
atcctgcccgccttcggtgcggtca

SEQ ID NO: 695863 - DNA, 25 bp, Artificial sequence
  Synthetic oligonucleotide
cccgccttcggtgcggtcagtgcga

SEQ ID NO: 695864 - DNA, 25 bp, Artificial sequence
  Synthetic oligonucleotide
ttcggtgcggtcagtgcgatcatcc

SEQ ID NO: 695865 - DNA, 25 bp, Artificial sequence
  Synthetic oligonucleotide
gcggtcagtgcgatcatcccgacct

SEQ ID NO: 695866 - DNA, 25 bp, Artificial sequence
  Synthetic oligonucleotide
agtgcgatcatcccgaccttcgcgc

SEQ ID NO: 695867 - DNA, 25 bp, Artificial sequence
  Synthetic oligonucleotide
atcatcccgaccttcgcgcgcaagc

SEQ ID NO: 695868 - DNA, 25 bp, Artificial sequence
  Synthetic oligonucleotide
tccagcacgtgttctggttcttcgg

SEQ ID NO: 695869 - DNA, 25 bp, Artificial sequence
  Synthetic oligonucleotide
tgttcgtctggacctggctgatcac

SEQ ID NO: 695870 - DNA, 25 bp, Artificial sequence
  Synthetic oligonucleotide
gggcgcgatcaacgtgatcgccacc

SEQ ID NO: 695871 - DNA, 25 bp, Artificial sequence
  Synthetic oligonucleotide
gatcaacgtgatcgccaccatcctc

SEQ ID NO: 695872 - DNA, 25 bp, Artificial sequence
  Synthetic oligonucleotide
cgtgatcgccaccatcctcaacctg

SEQ ID NO: 695873 - DNA, 25 bp, Artificial sequence
  Synthetic oligonucleotide
cgccaccatcctcaacctgcgcgcc

SEQ ID NO: 695874 - DNA, 25 bp, Artificial sequence
  Synthetic oligonucleotide
ccatcctcaacctgcgcgccccggg

SEQ ID NO: 695875 - DNA, 25 bp, Artificial sequence
  Synthetic oligonucleotide
tcaacctgcgcgccccgggcatgac

SEQ ID NO: 695876 - DNA, 25 bp, Artificial sequence
  Synthetic oligonucleotide
tgcgcgccccgggcatgaccctgat

SEQ ID NO: 695877 - DNA, 25 bp, Artificial sequence
  Synthetic oligonucleotide
ccccgggcatgaccctgatgaagat

SEQ ID NO: 695878 - DNA, 25 bp, Artificial sequence
  Synthetic oligonucleotide
gcatgaccctgatgaagatgccgct

SEQ ID NO: 695879 - DNA, 25 bp, Artificial sequence
  Synthetic oligonucleotide
ccctgatgaagatgccgctgttcgt

SEQ ID NO: 695880 - DNA, 25 bp, Artificial sequence
  Synthetic oligonucleotide
tggacatccacttcggcaccagctt

SEQ ID NO: 695881 - DNA, 25 bp, Artificial sequence
  Synthetic oligonucleotide
tgccgctgttcgtctggacctggct

SEQ ID NO: 695882 - DNA, 25 bp, Artificial sequence
  Synthetic oligonucleotide
cgcaagccgctgttcggctacacct

SEQ ID NO: 695883 - DNA, 25 bp, Artificial sequence
  Synthetic oligonucleotide
tctggacctggctgatcaccgcgtt

SEQ ID NO: 695884 - DNA, 25 bp, Artificial sequence
  Synthetic oligonucleotide
cctggctgatcaccgcgttcctttt

SEQ ID NO: 695885 - DNA, 25 bp, Artificial sequence
  Synthetic oligonucleotide
tgatcaccgcgttccttttgatcgc

SEQ ID NO: 695886 - DNA, 25 bp, Artificial sequence
  Synthetic oligonucleotide
ccgcgttccttttgatcgcggtgat

SEQ ID NO: 695887 - DNA, 25 bp, Artificial sequence
  Synthetic oligonucleotide
tccttttgatcgcggtgatgcctgt

SEQ ID NO: 695888 - DNA, 25 bp, Artificial sequence
  Synthetic oligonucleotide
tgatcgcggtgatgcctgtgctggc

SEQ ID NO: 695889 - DNA, 25 bp, Artificial sequence
  Synthetic oligonucleotide
cggtgatgcctgtgctggccggcgt

SEQ ID NO: 695890 - DNA, 25 bp, Artificial sequence
  Synthetic oligonucleotide
tgcctgtgctggccggcgtggtgac

SEQ ID NO: 695891 - DNA, 25 bp, Artificial sequence
  Synthetic oligonucleotide
tgctggccggcgtggtgaccatgat

SEQ ID NO: 695892 - DNA, 25 bp, Artificial sequence
  Synthetic oligonucleotide
ccggcgtggtgaccatgatgctgat

SEQ ID NO: 695893 - DNA, 25 bp, Artificial sequence
  Synthetic oligonucleotide
tggtgaccatgatgctgatggacat

SEQ ID NO: 695894 - DNA, 25 bp, Artificial sequence
  Synthetic oligonucleotide
tgaagatgccgctgttcgtctggac

SEQ ID NO: 695895 - DNA, 25 bp, Artificial sequence
  Synthetic oligonucleotide
tggccttcgtcatcctgttcaccat

SEQ ID NO: 695896 - DNA, 25 bp, Artificial sequence
  Synthetic oligonucleotide
gaaggtgttcaactgggtgaccacc

SEQ ID NO: 695897 - DNA, 25 bp, Artificial sequence
  Synthetic oligonucleotide
gttcaactgggtgaccaccatgtgg

SEQ ID NO: 695898 - DNA, 25 bp, Artificial sequence
  Synthetic oligonucleotide
ctgggtgaccaccatgtgggagggt

SEQ ID NO: 695899 - DNA, 25 bp, Artificial sequence
  Synthetic oligonucleotide
accaccatgtgggagggttcgctga

SEQ ID NO: 695900 - DNA, 25 bp, Artificial sequence
  Synthetic oligonucleotide
atgtgggagggttcgctgaccttcg

SEQ ID NO: 695901 - DNA, 25 bp, Artificial sequence
  Synthetic oligonucleotide
gagggttcgctgaccttcgagacgc

SEQ ID NO: 695902 - DNA, 25 bp, Artificial sequence
  Synthetic oligonucleotide
cagatggtgttctacgcgcgcaacc

SEQ ID NO: 695903 - DNA, 25 bp, Artificial sequence
  Synthetic oligonucleotide
tgaccttcgagacgccgatgctgtt

SEQ ID NO: 695904 - DNA, 25 bp, Artificial sequence
  Synthetic oligonucleotide
gtcgggcgcgaggtgaaggtgcagt

SEQ ID NO: 695905 - DNA, 25 bp, Artificial sequence
  Synthetic oligonucleotide
cgccgatgctgttcgccgtggcctt

SEQ ID NO: 695906 - DNA, 25 bp, Artificial sequence
  Synthetic oligonucleotide
ccgaccttcgcgcgcaagccgctgt

SEQ ID NO: 695907 - DNA, 25 bp, Artificial sequence
  Synthetic oligonucleotide
tcgccgtggccttcgtcatcctgtt

SEQ ID NO: 695908 - DNA, 25 bp, Artificial sequence
  Synthetic oligonucleotide
cgcggtgcccaccggggtgaaggtg

SEQ ID NO: 695909 - DNA, 25 bp, Artificial sequence
  Synthetic oligonucleotide
tcgtcatcctgttcaccatcggcgg

SEQ ID NO: 695910 - DNA, 25 bp, Artificial sequence
  Synthetic oligonucleotide
atcctgttcaccatcggcggcttct

SEQ ID NO: 695911 - DNA, 25 bp, Artificial sequence
  Synthetic oligonucleotide
ttcaccatcggcggcttctccggac

SEQ ID NO: 695912 - DNA, 25 bp, Artificial sequence
  Synthetic oligonucleotide
atcggcggcttctccggactgatgc

SEQ ID NO: 695913 - DNA, 25 bp, Artificial sequence
  Synthetic oligonucleotide
gcttctccggactgatgctggcgat

SEQ ID NO: 695914 - DNA, 25 bp, Artificial sequence
  Synthetic oligonucleotide
tccggactgatgctggcgatcgccc

SEQ ID NO: 695915 - DNA, 25 bp, Artificial sequence
  Synthetic oligonucleotide
ctgatgctggcgatcgccccggcag

SEQ ID NO: 695916 - DNA, 25 bp, Artificial sequence
  Synthetic oligonucleotide
ctggcgatcgccccggcagacttcc

SEQ ID NO: 695917 - DNA, 25 bp, Artificial sequence
  Synthetic oligonucleotide
atcgccccggcagacttccagtacc

SEQ ID NO: 695918 - DNA, 25 bp, Artificial sequence
  Synthetic oligonucleotide
ccggcagacttccagtaccacgaca

SEQ ID NO: 695919 - DNA, 25 bp, Artificial sequence
  Synthetic oligonucleotide
gacttccagtaccacgacacctact

SEQ ID NO: 695920 - DNA, 25 bp, Artificial sequence
  Synthetic oligonucleotide
tgctgttcgccgtggccttcgtcat

SEQ ID NO: 695921 - DNA, 25 bp, Artificial sequence
  Synthetic oligonucleotide
cacatgttcgtggtcggcatcccgg

SEQ ID NO: 695922 - DNA, 25 bp, Artificial sequence
  Synthetic oligonucleotide
cagtaccacgacacctacttcgtgg

SEQ ID NO: 695923 - DNA, 25 bp, Artificial sequence
  Synthetic oligonucleotide
ccgctgttcggctacacctcgatgg

SEQ ID NO: 695924 - DNA, 25 bp, Artificial sequence
  Synthetic oligonucleotide
ttcggctacacctcgatggtctacg

SEQ ID NO: 695925 - DNA, 25 bp, Artificial sequence
  Synthetic oligonucleotide
acacctcgatggtctacgccaccgc

SEQ ID NO: 695926 - DNA, 25 bp, Artificial sequence
  Synthetic oligonucleotide
gatggtctacgccaccgccagcatc

SEQ ID NO: 695927 - DNA, 25 bp, Artificial sequence
  Synthetic oligonucleotide
ctacgccaccgccagcatcgccttc

SEQ ID NO: 695928 - DNA, 25 bp, Artificial sequence
  Synthetic oligonucleotide
accgccagcatcgccttcctctcct

SEQ ID NO: 695929 - DNA, 25 bp, Artificial sequence
  Synthetic oligonucleotide
agcatcgccttcctctccttcgtgg

SEQ ID NO: 695930 - DNA, 25 bp, Artificial sequence
  Synthetic oligonucleotide
gccttcctctccttcgtggtctggg

SEQ ID NO: 695931 - DNA, 25 bp, Artificial sequence
  Synthetic oligonucleotide
tctccttcgtggtctgggcgcacca

SEQ ID NO: 695932 - DNA, 25 bp, Artificial sequence
  Synthetic oligonucleotide
ttcgtggtctgggcgcaccacatgt

SEQ ID NO: 695933 - DNA, 25 bp, Artificial sequence
  Synthetic oligonucleotide
cggggtgaaggtgttcaactgggtg

SEQ ID NO: 695934 - DNA, 25 bp, Artificial sequence
  Synthetic oligonucleotide
gcgcaccacatgttcgtggtcggca

SEQ ID NO: 695935 - DNA, 25 bp, Artificial sequence
  Synthetic oligonucleotide
tgcccaccggggtgaaggtgttcaa

SEQ ID NO: 695936 - DNA, 25 bp, Artificial sequence
  Synthetic oligonucleotide
ttcgtggtcggcatcccggtcaccg

SEQ ID NO: 695937 - DNA, 25 bp, Artificial sequence
  Synthetic oligonucleotide
gtcggcatcccggtcaccggcgagc

SEQ ID NO: 695938 - DNA, 25 bp, Artificial sequence
  Synthetic oligonucleotide
atcccggtcaccggcgagctgttct

SEQ ID NO: 695939 - DNA, 25 bp, Artificial sequence
  Synthetic oligonucleotide
gtcaccggcgagctgttcttcatgt

SEQ ID NO: 695940 - DNA, 25 bp, Artificial sequence
  Synthetic oligonucleotide
ggcgagctgttcttcatgtacgcca

SEQ ID NO: 695941 - DNA, 25 bp, Artificial sequence
  Synthetic oligonucleotide
ctgttcttcatgtacgccaccatgc

SEQ ID NO: 695942 - DNA, 25 bp, Artificial sequence
  Synthetic oligonucleotide
ttcatgtacgccaccatgctgatcg

SEQ ID NO: 695943 - DNA, 25 bp, Artificial sequence
  Synthetic oligonucleotide
tacgccaccatgctgatcgcggtgc

SEQ ID NO: 695944 - DNA, 25 bp, Artificial sequence
  Synthetic oligonucleotide
accatgctgatcgcggtgcccaccg

SEQ ID NO: 695945 - DNA, 25 bp, Artificial sequence
  Synthetic oligonucleotide
ctgatcgcggtgcccaccggggtga

SEQ ID NO: 695946 - DNA, 25 bp, Artificial sequence
  Synthetic oligonucleotide
ttcgcgcgcaagccgctgttcggct

SEQ ID NO: 695947 - DNA, 25 bp, Artificial sequence
  Synthetic oligonucleotide
gtctgggcgcaccacatgttcgtgg

SEQ ID NO: 695948 - DNA, 25 bp, Artificial sequence
  Synthetic oligonucleotide
tcctgctggtcacctccagcttcac

SEQ ID NO: 695949 - DNA, 25 bp, Artificial sequence
  Synthetic oligonucleotide
tcaaggcctggctggcgctgaccgt

SEQ ID NO: 695950 - DNA, 25 bp, Artificial sequence
  Synthetic oligonucleotide
gacccgaagctgttcccgccgccga

SEQ ID NO: 695951 - DNA, 25 bp, Artificial sequence
  Synthetic oligonucleotide
aagctgttcccgccgccgagcgcgg

SEQ ID NO: 695952 - DNA, 25 bp, Artificial sequence
  Synthetic oligonucleotide
ttcccgccgccgagcgcggtgatcg

SEQ ID NO: 695953 - DNA, 25 bp, Artificial sequence
  Synthetic oligonucleotide
cgccgagcgcggtgatcgagccgtg

SEQ ID NO: 695954 - DNA, 25 bp, Artificial sequence
  Synthetic oligonucleotide
gcgcggtgatcgagccgtggaagct

SEQ ID NO: 695955 - DNA, 25 bp, Artificial sequence
  Synthetic oligonucleotide
tgatcgagccgtggaagctgccgct

SEQ ID NO: 695956 - DNA, 25 bp, Artificial sequence
  Synthetic oligonucleotide
agccgtggaagctgccgctgatcaa

SEQ ID NO: 695957 - DNA, 25 bp, Artificial sequence
  Synthetic oligonucleotide
ggaagctgccgctgatcaacaccat

SEQ ID NO: 695958 - DNA, 25 bp, Artificial sequence
  Synthetic oligonucleotide
tgccgctgatcaacaccatcctgct

SEQ ID NO: 695959 - DNA, 25 bp, Artificial sequence
  Synthetic oligonucleotide
ctgctgcagaccccggacccgaagc

SEQ ID NO: 695960 - DNA, 25 bp, Artificial sequence
  Synthetic oligonucleotide
acaccatcctgctggtcacctccag

SEQ ID NO: 695961 - DNA, 25 bp, Artificial sequence
  Synthetic oligonucleotide
tggccgctgctgcagaccccggacc

SEQ ID NO: 695962 - DNA, 25 bp, Artificial sequence
  Synthetic oligonucleotide
tggtcacctccagcttcaccgtgac

SEQ ID NO: 695963 - DNA, 25 bp, Artificial sequence
  Synthetic oligonucleotide
cctccagcttcaccgtgaccttcgc

SEQ ID NO: 695964 - DNA, 25 bp, Artificial sequence
  Synthetic oligonucleotide
gcttcaccgtgaccttcgcccacca

SEQ ID NO: 695965 - DNA, 25 bp, Artificial sequence
  Synthetic oligonucleotide
ccgtgaccttcgcccaccacgccct

SEQ ID NO: 695966 - DNA, 25 bp, Artificial sequence
  Synthetic oligonucleotide
ccttcgcccaccacgccctgaagaa

SEQ ID NO: 695967 - DNA, 25 bp, Artificial sequence
  Synthetic oligonucleotide
cccaccacgccctgaagaagaacaa

SEQ ID NO: 695968 - DNA, 25 bp, Artificial sequence
  Synthetic oligonucleotide
acgccctgaagaagaacaagcgcgg

SEQ ID NO: 695969 - DNA, 25 bp, Artificial sequence
  Synthetic oligonucleotide
tgaagaagaacaagcgcggcccgct

SEQ ID NO: 695970 - DNA, 25 bp, Artificial sequence
  Synthetic oligonucleotide
aagaacaagcgcggcccgctcaagg

SEQ ID NO: 695971 - DNA, 25 bp, Artificial sequence
  Synthetic oligonucleotide
agcgcggcccgctcaaggcctggct

SEQ ID NO: 695972 - DNA, 25 bp, Artificial sequence
  Synthetic oligonucleotide
ggcgcggtgaaccagatggtgttct

SEQ ID NO: 695973 - DNA, 25 bp, Artificial sequence
  Synthetic oligonucleotide
tgatcaacaccatcctgctggtcac

SEQ ID NO: 695974 - DNA, 25 bp, Artificial sequence
  Synthetic oligonucleotide
tcgccggtccctggctcggcggcga

SEQ ID NO: 695975 - DNA, 25 bp, Artificial sequence
  Synthetic oligonucleotide
gagctggttcatcttctccgaggtg

SEQ ID NO: 695976 - DNA, 25 bp, Artificial sequence
  Synthetic oligonucleotide
ggttcatcttctccgaggtgatgtt

SEQ ID NO: 695977 - DNA, 25 bp, Artificial sequence
  Synthetic oligonucleotide
tcttctccgaggtgatgttcttcgc

SEQ ID NO: 695978 - DNA, 25 bp, Artificial sequence
  Synthetic oligonucleotide
ccgaggtgatgttcttcgccgcctt

SEQ ID NO: 695979 - DNA, 25 bp, Artificial sequence
  Synthetic oligonucleotide
tgatgttcttcgccgccttcttcgg

SEQ ID NO: 695980 - DNA, 25 bp, Artificial sequence
  Synthetic oligonucleotide
tcttcgccgccttcttcggcgcgct

SEQ ID NO: 695981 - DNA, 25 bp, Artificial sequence
  Synthetic oligonucleotide
ccgccttcttcggcgcgctgttcta

SEQ ID NO: 695982 - DNA, 25 bp, Artificial sequence
  Synthetic oligonucleotide
tcttcggcgcgctgttctacgtccg

SEQ ID NO: 695983 - DNA, 25 bp, Artificial sequence
  Synthetic oligonucleotide
gcgcgctgttctacgtccgccactt

SEQ ID NO: 695984 - DNA, 25 bp, Artificial sequence
  Synthetic oligonucleotide
tgttctacgtccgccacttcgccgg

SEQ ID NO: 695985 - DNA, 25 bp, Artificial sequence
  Synthetic oligonucleotide
gcagaccccggacccgaagctgttc

SEQ ID NO: 695986 - DNA, 25 bp, Artificial sequence
  Synthetic oligonucleotide
gccacttcgccggtccctggctcgg

SEQ ID NO: 695987 - DNA, 25 bp, Artificial sequence
  Synthetic oligonucleotide
cctggctggcgctgaccgtgctgct

SEQ ID NO: 695988 - DNA, 25 bp, Artificial sequence
  Synthetic oligonucleotide
gtccctggctcggcggcgagggtgc

SEQ ID NO: 695989 - DNA, 25 bp, Artificial sequence
  Synthetic oligonucleotide
ggctcggcggcgagggtgccaaggg

SEQ ID NO: 695990 - DNA, 25 bp, Artificial sequence
  Synthetic oligonucleotide
cggcgagggtgccaagggcgtggcg

SEQ ID NO: 695991 - DNA, 25 bp, Artificial sequence
  Synthetic oligonucleotide
ggtgccaagggcgtggcgcacatgc

SEQ ID NO: 695992 - DNA, 25 bp, Artificial sequence
  Synthetic oligonucleotide
aagggcgtggcgcacatgctctggc

SEQ ID NO: 695993 - DNA, 25 bp, Artificial sequence
  Synthetic oligonucleotide
gtggcgcacatgctctggccgaact

SEQ ID NO: 695994 - DNA, 25 bp, Artificial sequence
  Synthetic oligonucleotide
cacatgctctggccgaacttccagt

SEQ ID NO: 695995 - DNA, 25 bp, Artificial sequence
  Synthetic oligonucleotide
ctctggccgaacttccagtacagct

SEQ ID NO: 695996 - DNA, 25 bp, Artificial sequence
  Synthetic oligonucleotide
cgaacttccagtacagctggccgct

SEQ ID NO: 695997 - DNA, 25 bp, Artificial sequence
  Synthetic oligonucleotide
ttccagtacagctggccgctgctgc

SEQ ID NO: 695998 - DNA, 25 bp, Artificial sequence
  Synthetic oligonucleotide
tacagctggccgctgctgcagaccc

SEQ ID NO: 695999 - DNA, 25 bp, Artificial sequence
  Synthetic oligonucleotide
acgtccgccacttcgccggtccctg

SEQ ID NO: 696000 - DNA, 25 bp, Artificial sequence
  Synthetic oligonucleotide
ttcgaggccgccagttggtactggc

SEQ ID NO: 696001 - DNA, 25 bp, Artificial sequence
  Synthetic oligonucleotide
cccgctcaaggcctggctggcgctg

SEQ ID NO: 696002 - DNA, 25 bp, Artificial sequence
  Synthetic oligonucleotide
ctgatcctcggcatcatgctgatcc

SEQ ID NO: 696003 - DNA, 25 bp, Artificial sequence
  Synthetic oligonucleotide
tcggcatcatgctgatccgcatcct

SEQ ID NO: 696004 - DNA, 25 bp, Artificial sequence
  Synthetic oligonucleotide
catgctgatccgcatcctgcgcggt

SEQ ID NO: 696005 - DNA, 25 bp, Artificial sequence
  Synthetic oligonucleotide
tgatccgcatcctgcgcggtcactt

SEQ ID NO: 696006 - DNA, 25 bp, Artificial sequence
  Synthetic oligonucleotide
gcatcctgcgcggtcacttcgatgc

SEQ ID NO: 696007 - DNA, 25 bp, Artificial sequence
  Synthetic oligonucleotide
tgcgcggtcacttcgatgccgagca

SEQ ID NO: 696008 - DNA, 25 bp, Artificial sequence
  Synthetic oligonucleotide
gtcacttcgatgccgagcaccactt

SEQ ID NO: 696009 - DNA, 25 bp, Artificial sequence
  Synthetic oligonucleotide
tcgatgccgagcaccacttcggctt

SEQ ID NO: 696010 - DNA, 25 bp, Artificial sequence
  Synthetic oligonucleotide
gccgagcaccacttcggcttcgagg

SEQ ID NO: 696011 - DNA, 25 bp, Artificial sequence
  Synthetic oligonucleotide
accctcggcgcgctgatcctcggca

SEQ ID NO: 696012 - DNA, 25 bp, Artificial sequence
  Synthetic oligonucleotide
ttcggcttcgaggccgccagttggt

SEQ ID NO: 696013 - DNA, 25 bp, Artificial sequence
  Synthetic oligonucleotide
cacgtgaccctcggcgcgctgatcc

SEQ ID NO: 696014 - DNA, 25 bp, Artificial sequence
  Synthetic oligonucleotide
gccgccagttggtactggcacttcg

SEQ ID NO: 696015 - DNA, 25 bp, Artificial sequence
  Synthetic oligonucleotide
agttggtactggcacttcgtcgacg

SEQ ID NO: 696016 - DNA, 25 bp, Artificial sequence
  Synthetic oligonucleotide
tactggcacttcgtcgacgtggtct

SEQ ID NO: 696017 - DNA, 25 bp, Artificial sequence
  Synthetic oligonucleotide
cacttcgtcgacgtggtctggatcg

SEQ ID NO: 696018 - DNA, 25 bp, Artificial sequence
  Synthetic oligonucleotide
tcgacgtggtctggatcggcctgtt

SEQ ID NO: 696019 - DNA, 25 bp, Artificial sequence
  Synthetic oligonucleotide
tggtctggatcggcctgttcatctt

SEQ ID NO: 696020 - DNA, 25 bp, Artificial sequence
  Synthetic oligonucleotide
ggatcggcctgttcatcttcgtcta

SEQ ID NO: 696021 - DNA, 25 bp, Artificial sequence
  Synthetic oligonucleotide
gcctgttcatcttcgtctacgtgat

SEQ ID NO: 696022 - DNA, 25 bp, Artificial sequence
  Synthetic oligonucleotide
catcttcgtctacgtgatctgaccg

SEQ ID NO: 696023 - DNA, 25 bp, Artificial sequence
  Synthetic oligonucleotide
gtctacgtgatctgaccgccaccgg

SEQ ID NO: 696024 - DNA, 25 bp, Artificial sequence
  Synthetic oligonucleotide
gtgatctgaccgccaccgggggaat

SEQ ID NO: 696025 - DNA, 25 bp, Artificial sequence
  Synthetic oligonucleotide
caccacttcggcttcgaggccgcca

SEQ ID NO: 696026 - DNA, 25 bp, Artificial sequence
  Synthetic oligonucleotide
agctgggcctgaccctcggcgccgg

SEQ ID NO: 696027 - DNA, 25 bp, Artificial sequence
  Synthetic oligonucleotide
tggcgctgaccgtgctgctggggat

SEQ ID NO: 696028 - DNA, 25 bp, Artificial sequence
  Synthetic oligonucleotide
tgaccgtgctgctggggatcgcctt

SEQ ID NO: 696029 - DNA, 25 bp, Artificial sequence
  Synthetic oligonucleotide
tgctgctggggatcgccttcctgat

SEQ ID NO: 696030 - DNA, 25 bp, Artificial sequence
  Synthetic oligonucleotide
tggggatcgccttcctgatcctgca

SEQ ID NO: 696031 - DNA, 25 bp, Artificial sequence
  Synthetic oligonucleotide
tcgccttcctgatcctgcaggccga

SEQ ID NO: 696032 - DNA, 25 bp, Artificial sequence
  Synthetic oligonucleotide
tcctgatcctgcaggccgaggagta

SEQ ID NO: 696033 - DNA, 25 bp, Artificial sequence
  Synthetic oligonucleotide
tcctgcaggccgaggagtacgtgca

SEQ ID NO: 696034 - DNA, 25 bp, Artificial sequence
  Synthetic oligonucleotide
aggccgaggagtacgtgcacgccta

SEQ ID NO: 696035 - DNA, 25 bp, Artificial sequence
  Synthetic oligonucleotide
aggagtacgtgcacgcctacaacga

SEQ ID NO: 696036 - DNA, 25 bp, Artificial sequence
  Synthetic oligonucleotide
acgtgcacgcctacaacgagctggg

SEQ ID NO: 696037 - DNA, 25 bp, Artificial sequence
  Synthetic oligonucleotide
ggcgcgctgatcctcggcatcatgc

SEQ ID NO: 696038 - DNA, 25 bp, Artificial sequence
  Synthetic oligonucleotide
acaacgagctgggcctgaccctcgg

SEQ ID NO: 696039 - DNA, 25 bp, Artificial sequence
  Synthetic oligonucleotide
ctcgttccgctggggcatgagctgg

SEQ ID NO: 696040 - DNA, 25 bp, Artificial sequence
  Synthetic oligonucleotide
gcctgaccctcggcgccggcatcta

SEQ ID NO: 696041 - DNA, 25 bp, Artificial sequence
  Synthetic oligonucleotide
cctcggcgccggcatctacggctcg

SEQ ID NO: 696042 - DNA, 25 bp, Artificial sequence
  Synthetic oligonucleotide
cgccggcatctacggctcgaccttc

SEQ ID NO: 696043 - DNA, 25 bp, Artificial sequence
  Synthetic oligonucleotide
gcatctacggctcgaccttcttcat

SEQ ID NO: 696044 - DNA, 25 bp, Artificial sequence
  Synthetic oligonucleotide
tacggctcgaccttcttcatgctca

SEQ ID NO: 696045 - DNA, 25 bp, Artificial sequence
  Synthetic oligonucleotide
tcgaccttcttcatgctcaccggct

SEQ ID NO: 696046 - DNA, 25 bp, Artificial sequence
  Synthetic oligonucleotide
ttcttcatgctcaccggcttccacg

SEQ ID NO: 696047 - DNA, 25 bp, Artificial sequence
  Synthetic oligonucleotide
atgctcaccggcttccacggcgccc

SEQ ID NO: 696048 - DNA, 25 bp, Artificial sequence
  Synthetic oligonucleotide
accggcttccacggcgcccacgtga

SEQ ID NO: 696049 - DNA, 25 bp, Artificial sequence
  Synthetic oligonucleotide
ttccacggcgcccacgtgaccctcg

SEQ ID NO: 696050 - DNA, 25 bp, Artificial sequence
  Synthetic oligonucleotide
ggcgcccacgtgaccctcggcgcgc

SEQ ID NO: 696051 - DNA, 25 bp, Artificial sequence
  Synthetic oligonucleotide
acgcctacaacgagctgggcctgac

SEQ ID NO: 696052 - DNA, 25 bp, Artificial sequence
  Synthetic oligonucleotide
caacccggcgagagcatcgagatgc

SEQ ID NO: 696053 - DNA, 25 bp, Artificial sequence
  Synthetic oligonucleotide
gggcatgagctggttcatcttctcc

SEQ ID NO: 696054 - DNA, 25 bp, Artificial sequence
  Synthetic oligonucleotide
gccccggccgaggccgcagcctact

SEQ ID NO: 696055 - DNA, 25 bp, Artificial sequence
  Synthetic oligonucleotide
gccgaggccgcagcctacttccaca

SEQ ID NO: 696056 - DNA, 25 bp, Artificial sequence
  Synthetic oligonucleotide
gccgcagcctacttccacaagaccg

SEQ ID NO: 696057 - DNA, 25 bp, Artificial sequence
  Synthetic oligonucleotide
gcctacttccacaagaccgaatgct

SEQ ID NO: 696058 - DNA, 25 bp, Artificial sequence
  Synthetic oligonucleotide
ttccacaagaccgaatgcttctgtt

SEQ ID NO: 696059 - DNA, 25 bp, Artificial sequence
  Synthetic oligonucleotide
aagaccgaatgcttctgtttcaccc

SEQ ID NO: 696060 - DNA, 25 bp, Artificial sequence
  Synthetic oligonucleotide
gaatgcttctgtttcacccagcagg

SEQ ID NO: 696061 - DNA, 25 bp, Artificial sequence
  Synthetic oligonucleotide
ttctgtttcacccagcaggtgctgc

SEQ ID NO: 696062 - DNA, 25 bp, Artificial sequence
  Synthetic oligonucleotide
ttcacccagcaggtgctgcaacccg

SEQ ID NO: 696063 - DNA, 25 bp, Artificial sequence
  Synthetic oligonucleotide
catcccgagcatcgccccggccgag

SEQ ID NO: 696064 - DNA, 25 bp, Artificial sequence
  Synthetic oligonucleotide
gtgctgcaacccggcgagagcatcg

SEQ ID NO: 696065 - DNA, 25 bp, Artificial sequence
  Synthetic oligonucleotide
gcaggccatcccgagcatcgccccg

SEQ ID NO: 696066 - DNA, 25 bp, Artificial sequence
  Synthetic oligonucleotide
ggcgagagcatcgagatgccggtgc

SEQ ID NO: 696067 - DNA, 25 bp, Artificial sequence
  Synthetic oligonucleotide
gagcatcgagatgccggtgcgcttc

SEQ ID NO: 696068 - DNA, 25 bp, Artificial sequence
  Synthetic oligonucleotide
cgagatgccggtgcgcttcatcgtc

SEQ ID NO: 696069 - DNA, 25 bp, Artificial sequence
  Synthetic oligonucleotide
gccggtgcgcttcatcgtcgaccgt

SEQ ID NO: 696070 - DNA, 25 bp, Artificial sequence
  Synthetic oligonucleotide
gcgcttcatcgtcgaccgtgatctg

SEQ ID NO: 696071 - DNA, 25 bp, Artificial sequence
  Synthetic oligonucleotide
catcgtcgaccgtgatctgcccaag

SEQ ID NO: 696072 - DNA, 25 bp, Artificial sequence
  Synthetic oligonucleotide
cgaccgtgatctgcccaaggatgtg

SEQ ID NO: 696073 - DNA, 25 bp, Artificial sequence
  Synthetic oligonucleotide
tgatctgcccaaggatgtgcggcac

SEQ ID NO: 696074 - DNA, 25 bp, Artificial sequence
  Synthetic oligonucleotide
tgcccaaggatgtgcggcacgtgac

SEQ ID NO: 696075 - DNA, 25 bp, Artificial sequence
  Synthetic oligonucleotide
aggatgtgcggcacgtgacgctggc

SEQ ID NO: 696076 - DNA, 25 bp, Artificial sequence
  Synthetic oligonucleotide
tgcggcacgtgacgctggcctacac

SEQ ID NO: 696077 - DNA, 25 bp, Artificial sequence
  Synthetic oligonucleotide
cagcaggtgctgcaacccggcgaga

SEQ ID NO: 696078 - DNA, 25 bp, Artificial sequence
  Synthetic oligonucleotide
gtggtgcatcccggcgcggtgaacc

SEQ ID NO: 696079 - DNA, 25 bp, Artificial sequence
  Synthetic oligonucleotide
gtgaaggtgcagttcatgacctcga

SEQ ID NO: 696080 - DNA, 25 bp, Artificial sequence
  Synthetic oligonucleotide
gtgcagttcatgacctcgaacaata

SEQ ID NO: 696081 - DNA, 25 bp, Artificial sequence
  Synthetic oligonucleotide
ttcatgacctcgaacaatatcgaca

SEQ ID NO: 696082 - DNA, 25 bp, Artificial sequence
  Synthetic oligonucleotide
acctcgaacaatatcgacatggtct

SEQ ID NO: 696083 - DNA, 25 bp, Artificial sequence
  Synthetic oligonucleotide
aacaatatcgacatggtctgggagt

SEQ ID NO: 696084 - DNA, 25 bp, Artificial sequence
  Synthetic oligonucleotide
atcgacatggtctgggagttccgct

SEQ ID NO: 696085 - DNA, 25 bp, Artificial sequence
  Synthetic oligonucleotide
atggtctgggagttccgctccgccg

SEQ ID NO: 696086 - DNA, 25 bp, Artificial sequence
  Synthetic oligonucleotide
tgggagttccgctccgccggcgacc

SEQ ID NO: 696087 - DNA, 25 bp, Artificial sequence
  Synthetic oligonucleotide
ttccgctccgccggcgaccagttgg

SEQ ID NO: 696088 - DNA, 25 bp, Artificial sequence
  Synthetic oligonucleotide
tccgccggcgaccagttggtggtgc

SEQ ID NO: 696089 - DNA, 25 bp, Artificial sequence
  Synthetic oligonucleotide
agcatcgccccggccgaggccgcag

SEQ ID NO: 696090 - DNA, 25 bp, Artificial sequence
  Synthetic oligonucleotide
cagttggtggtgcatcccggcgcgg

SEQ ID NO: 696091 - DNA, 25 bp, Artificial sequence
  Synthetic oligonucleotide
cctacaccctcttcgatatcactgc

SEQ ID NO: 696092 - DNA, 25 bp, Artificial sequence
  Synthetic oligonucleotide
catcccggcgcggtgaaccagatgg

SEQ ID NO: 696093 - DNA, 25 bp, Artificial sequence
  Synthetic oligonucleotide
gatcatgggcgcgatcaacgtgatc

SEQ ID NO: 696094 - DNA, 25 bp, Artificial sequence
  Synthetic oligonucleotide
gtgaaccagatggtgttctacgcgc

SEQ ID NO: 696095 - DNA, 25 bp, Artificial sequence
  Synthetic oligonucleotide
ggatcaacggcaagaccgccggcag

SEQ ID NO: 696096 - DNA, 25 bp, Artificial sequence
  Synthetic oligonucleotide
gtgttctacgcgcgcaacccgagcg

SEQ ID NO: 696097 - DNA, 25 bp, Artificial sequence
  Synthetic oligonucleotide
ctacgcgcgcaacccgagcgacaag

SEQ ID NO: 696098 - DNA, 25 bp, Artificial sequence
  Synthetic oligonucleotide
gcgcaacccgagcgacaagccgatg

SEQ ID NO: 696099 - DNA, 25 bp, Artificial sequence
  Synthetic oligonucleotide
cccgagcgacaagccgatgaccgcg

SEQ ID NO: 696100 - DNA, 25 bp, Artificial sequence
  Synthetic oligonucleotide
gcgacaagccgatgaccgcgcaggc

SEQ ID NO: 696101 - DNA, 25 bp, Artificial sequence
  Synthetic oligonucleotide
agccgatgaccgcgcaggccatccc

SEQ ID NO: 696102 - DNA, 25 bp, Artificial sequence
  Synthetic oligonucleotide
tgaccgcgcaggccatcccgagcat

SEQ ID NO: 696103 - DNA, 25 bp, Artificial sequence
  Synthetic oligonucleotide
ggcgaccagttggtggtgcatcccg

SEQ ID NO: 696104 - DNA, 25 bp, Artificial sequence
  Synthetic oligonucleotide
ttcggctggttcggcaacgtcatcc

SEQ ID NO: 696105 - DNA, 25 bp, Artificial sequence
  Synthetic oligonucleotide
accgccggccacaaggaatcccatg

SEQ ID NO: 696106 - DNA, 25 bp, Artificial sequence
  Synthetic oligonucleotide
ggccacaaggaatcccatggcccgt

SEQ ID NO: 696107 - DNA, 25 bp, Artificial sequence
  Synthetic oligonucleotide
aaggaatcccatggcccgtggatct

SEQ ID NO: 696108 - DNA, 25 bp, Artificial sequence
  Synthetic oligonucleotide
tcccatggcccgtggatcttcttcg

SEQ ID NO: 696109 - DNA, 25 bp, Artificial sequence
  Synthetic oligonucleotide
ggcccgtggatcttcttcgtcggcg

SEQ ID NO: 696110 - DNA, 25 bp, Artificial sequence
  Synthetic oligonucleotide
tggatcttcttcgtcggcgggctga

SEQ ID NO: 696111 - DNA, 25 bp, Artificial sequence
  Synthetic oligonucleotide
ttcttcgtcggcgggctgatcatcg

SEQ ID NO: 696112 - DNA, 25 bp, Artificial sequence
  Synthetic oligonucleotide
gtcggcgggctgatcatcgcctaca

SEQ ID NO: 696113 - DNA, 25 bp, Artificial sequence
  Synthetic oligonucleotide
gggctgatcatcgcctacatgctgt

SEQ ID NO: 696114 - DNA, 25 bp, Artificial sequence
  Synthetic oligonucleotide
atcatcgcctacatgctgttcggct

SEQ ID NO: 696115 - DNA, 25 bp, Artificial sequence
  Synthetic oligonucleotide
acgtgacgctggcctacaccctctt

SEQ ID NO: 696116 - DNA, 25 bp, Artificial sequence
  Synthetic oligonucleotide
atgctgttcggctggttcggcaacg

SEQ ID NO: 696117 - DNA, 25 bp, Artificial sequence
  Synthetic oligonucleotide
acctggttcaacgacctcaccgccg

SEQ ID NO: 696118 - DNA, 25 bp, Artificial sequence
  Synthetic oligonucleotide
tggttcggcaacgtcatccgcgaga

SEQ ID NO: 696119 - DNA, 25 bp, Artificial sequence
  Synthetic oligonucleotide
cggcaacgtcatccgcgagagtcgc

SEQ ID NO: 696120 - DNA, 25 bp, Artificial sequence
  Synthetic oligonucleotide
acgtcatccgcgagagtcgcgccgg

SEQ ID NO: 696121 - DNA, 25 bp, Artificial sequence
  Synthetic oligonucleotide
atccgcgagagtcgcgccggactct

SEQ ID NO: 696122 - DNA, 25 bp, Artificial sequence
  Synthetic oligonucleotide
gagagtcgcgccggactctacagcg

SEQ ID NO: 696123 - DNA, 25 bp, Artificial sequence
  Synthetic oligonucleotide
gcgccggactctacagcgcgcagat

SEQ ID NO: 696124 - DNA, 25 bp, Artificial sequence
  Synthetic oligonucleotide
gactctacagcgcgcagatggaccg

SEQ ID NO: 696125 - DNA, 25 bp, Artificial sequence
  Synthetic oligonucleotide
acagcgcgcagatggaccgctcgtt

SEQ ID NO: 696126 - DNA, 25 bp, Artificial sequence
  Synthetic oligonucleotide
gcagatggaccgctcgttccgctgg

SEQ ID NO: 696127 - DNA, 25 bp, Artificial sequence
  Synthetic oligonucleotide
ggaccgctcgttccgctggggcatg

SEQ ID NO: 696128 - DNA, 25 bp, Artificial sequence
  Synthetic oligonucleotide
cgcgaggtgaaggtgcagttcatga

SEQ ID NO: 696129 - DNA, 25 bp, Artificial sequence
  Synthetic oligonucleotide
gcctacatgctgttcggctggttcg

SEQ ID NO: 696130 - DNA, 25 bp, Artificial sequence
  Synthetic oligonucleotide
tccccgcccagagcaagtggccgat

SEQ ID NO: 696131 - DNA, 25 bp, Artificial sequence
  Synthetic oligonucleotide
ccgctggggcatgagctggttcatc

SEQ ID NO: 696132 - DNA, 25 bp, Artificial sequence
  Synthetic oligonucleotide
ccctcttcgatatcactgcgcggaa

SEQ ID NO: 696133 - DNA, 25 bp, Artificial sequence
  Synthetic oligonucleotide
ttcgatatcactgcgcggaagccgc

SEQ ID NO: 696134 - DNA, 25 bp, Artificial sequence
  Synthetic oligonucleotide
atcactgcgcggaagccgcccgtac

SEQ ID NO: 696135 - DNA, 25 bp, Artificial sequence
  Synthetic oligonucleotide
taccggttgcgggacgataaggaga

SEQ ID NO: 696136 - DNA, 25 bp, Artificial sequence
  Synthetic oligonucleotide
ttgcgggacgataaggagaacaaca

SEQ ID NO: 696137 - DNA, 25 bp, Artificial sequence
  Synthetic oligonucleotide
gacgataaggagaacaacatggcaa

SEQ ID NO: 696138 - DNA, 25 bp, Artificial sequence
  Synthetic oligonucleotide
aaggagaacaacatggcaagccacg

SEQ ID NO: 696139 - DNA, 25 bp, Artificial sequence
  Synthetic oligonucleotide
aacaacatggcaagccacgaacact

SEQ ID NO: 696140 - DNA, 25 bp, Artificial sequence
  Synthetic oligonucleotide
atggcaagccacgaacactattacg

SEQ ID NO: 696141 - DNA, 25 bp, Artificial sequence
  Synthetic oligonucleotide
agccacgaacactattacgtccccg

SEQ ID NO: 696142 - DNA, 25 bp, Artificial sequence
  Synthetic oligonucleotide
gacctcaccgccggccacaaggaat

SEQ ID NO: 696143 - DNA, 25 bp, Artificial sequence
  Synthetic oligonucleotide
attacgtccccgcccagagcaagtg

SEQ ID NO: 696144 - DNA, 25 bp, Artificial sequence
  Synthetic oligonucleotide
ttcaacgacctcaccgccggccaca

SEQ ID NO: 696145 - DNA, 25 bp, Artificial sequence
  Synthetic oligonucleotide
gcccagagcaagtggccgatcatcg

SEQ ID NO: 696146 - DNA, 25 bp, Artificial sequence
  Synthetic oligonucleotide
agcaagtggccgatcatcgccagca

SEQ ID NO: 696147 - DNA, 25 bp, Artificial sequence
  Synthetic oligonucleotide
gtggccgatcatcgccagcatcggc

SEQ ID NO: 696148 - DNA, 25 bp, Artificial sequence
  Synthetic oligonucleotide
gatcatcgccagcatcggcctgctg

SEQ ID NO: 696149 - DNA, 25 bp, Artificial sequence
  Synthetic oligonucleotide
gccagcatcggcctgctggtgacgg

SEQ ID NO: 696150 - DNA, 25 bp, Artificial sequence
  Synthetic oligonucleotide
catcggcctgctggtgacggtgttc

SEQ ID NO: 696151 - DNA, 25 bp, Artificial sequence
  Synthetic oligonucleotide
cctgctggtgacggtgttcggcctg

SEQ ID NO: 696152 - DNA, 25 bp, Artificial sequence
  Synthetic oligonucleotide
tggtgacggtgttcggcctgggtac

SEQ ID NO: 696153 - DNA, 25 bp, Artificial sequence
  Synthetic oligonucleotide
gtgttcggcctgggtacctggttca

SEQ ID NO: 696154 - DNA, 25 bp, Artificial sequence
  Synthetic oligonucleotide
ctgggtacctggttcaacgacctca

SEQ ID NO: 696155 - DNA, 25 bp, Artificial sequence
  Synthetic oligonucleotide
cgctggcctacaccctcttcgatat

SEQ ID NO: 696156 - DNA, 25 bp, Artificial sequence
  Synthetic oligonucleotide
gaacactattacgtccccgcccaga

SEQ ID NO: 696157 - DNA, 25 bp, Artificial sequence
  Synthetic oligonucleotide
atccacgagtctggatgggcttcct

SEQ ID NO: 696158 - DNA, 25 bp, Artificial sequence
  Synthetic oligonucleotide
tgcaaagccacgccgctcgcggctt

SEQ ID NO: 696159 - DNA, 25 bp, Artificial sequence
  Synthetic oligonucleotide
cgttgtcttggcggtccaccccttg

SEQ ID NO: 696160 - DNA, 25 bp, Artificial sequence
  Synthetic oligonucleotide
tccaccccttggccgttggcgtctg

SEQ ID NO: 696161 - DNA, 25 bp, Artificial sequence
  Synthetic oligonucleotide
cccttggccgttggcgtctgccggc

SEQ ID NO: 696162 - DNA, 25 bp, Artificial sequence
  Synthetic oligonucleotide
gccgttggcgtctgccggcgggata

SEQ ID NO: 696163 - DNA, 25 bp, Artificial sequence
  Synthetic oligonucleotide
tggcgtctgccggcgggataaaaac

SEQ ID NO: 696164 - DNA, 25 bp, Artificial sequence
  Synthetic oligonucleotide
tctgccggcgggataaaaacaacga

SEQ ID NO: 696165 - DNA, 25 bp, Artificial sequence
  Synthetic oligonucleotide
caacgataaggggaacccgaatgct

SEQ ID NO: 696166 - DNA, 25 bp, Artificial sequence
  Synthetic oligonucleotide
taaggggaacccgaatgctgcgaca

SEQ ID NO: 696167 - DNA, 25 bp, Artificial sequence
  Synthetic oligonucleotide
gaacccgaatgctgcgacatccacg

SEQ ID NO: 696168 - DNA, 25 bp, Artificial sequence
  Synthetic oligonucleotide
acggtcaaagttcgttgtcttggcg

SEQ ID NO: 696169 - DNA, 25 bp, Artificial sequence
  Synthetic oligonucleotide
tgcgacatccacgagtctggatggg

SEQ ID NO: 696170 - DNA, 25 bp, Artificial sequence
  Synthetic oligonucleotide
ggtgcgacggtcaaagttcgttgtc

SEQ ID NO: 696171 - DNA, 25 bp, Artificial sequence
  Synthetic oligonucleotide
gagtctggatgggcttccttttgct

SEQ ID NO: 696172 - DNA, 25 bp, Artificial sequence
  Synthetic oligonucleotide
ggatgggcttccttttgctctcggc

SEQ ID NO: 696173 - DNA, 25 bp, Artificial sequence
  Synthetic oligonucleotide
gcttccttttgctctcggcgatcag

SEQ ID NO: 696174 - DNA, 25 bp, Artificial sequence
  Synthetic oligonucleotide
tttgctctcggcgatcagccaggcg

SEQ ID NO: 696175 - DNA, 25 bp, Artificial sequence
  Synthetic oligonucleotide
tctcggcgatcagccaggcgaatgc

SEQ ID NO: 696176 - DNA, 25 bp, Artificial sequence
  Synthetic oligonucleotide
gatcagccaggcgaatgccgcctgg

SEQ ID NO: 696177 - DNA, 25 bp, Artificial sequence
  Synthetic oligonucleotide
ccaggcgaatgccgcctggacggtc

SEQ ID NO: 696178 - DNA, 25 bp, Artificial sequence
  Synthetic oligonucleotide
gaatgccgcctggacggtcaacatg

SEQ ID NO: 696179 - DNA, 25 bp, Artificial sequence
  Synthetic oligonucleotide
gcctggacggtcaacatggccccgg

SEQ ID NO: 696180 - DNA, 25 bp, Artificial sequence
  Synthetic oligonucleotide
gacggtcaacatggccccgggcgct

SEQ ID NO: 696181 - DNA, 25 bp, Artificial sequence
  Synthetic oligonucleotide
aacatggccccgggcgctaccgagg

SEQ ID NO: 696182 - DNA, 25 bp, Artificial sequence
  Synthetic oligonucleotide
gaatgctgcgacatccacgagtctg

SEQ ID NO: 696183 - DNA, 25 bp, Artificial sequence
  Synthetic oligonucleotide
cgcagccgctgtctatactcccact

SEQ ID NO: 696184 - DNA, 25 bp, Artificial sequence
  Synthetic oligonucleotide
tacctgggccaggacgtcgagtact

SEQ ID NO: 696185 - DNA, 25 bp, Artificial sequence
  Synthetic oligonucleotide
gccgctcgcggcttttagagaagaa

SEQ ID NO: 696186 - DNA, 25 bp, Artificial sequence
  Synthetic oligonucleotide
cgcggcttttagagaagaatcggca

SEQ ID NO: 696187 - DNA, 25 bp, Artificial sequence
  Synthetic oligonucleotide
ttttagagaagaatcggcactttcc

SEQ ID NO: 696188 - DNA, 25 bp, Artificial sequence
  Synthetic oligonucleotide
agaagaatcggcactttccagcgac

SEQ ID NO: 696189 - DNA, 25 bp, Artificial sequence
  Synthetic oligonucleotide
atcggcactttccagcgacgttttt

SEQ ID NO: 696190 - DNA, 25 bp, Artificial sequence
  Synthetic oligonucleotide
actttccagcgacgtttttacgctg

SEQ ID NO: 696191 - DNA, 25 bp, Artificial sequence
  Synthetic oligonucleotide
cagcgacgtttttacgctgcgttgt

SEQ ID NO: 696192 - DNA, 25 bp, Artificial sequence
  Synthetic oligonucleotide
cgtttttacgctgcgttgttatgtc

SEQ ID NO: 696193 - DNA, 25 bp, Artificial sequence
  Synthetic oligonucleotide
tacgctgcgttgttatgtcgcagcc

SEQ ID NO: 696194 - DNA, 25 bp, Artificial sequence
  Synthetic oligonucleotide
caaagttcgttgtcttggcggtcca

SEQ ID NO: 696195 - DNA, 25 bp, Artificial sequence
  Synthetic oligonucleotide
ttatgtcgcagccgctgtctatact

SEQ ID NO: 696196 - DNA, 25 bp, Artificial sequence
  Synthetic oligonucleotide
ctaccgaggtgagccggtccgtctt

SEQ ID NO: 696197 - DNA, 25 bp, Artificial sequence
  Synthetic oligonucleotide
cgctgtctatactcccactcgaatg

SEQ ID NO: 696198 - DNA, 25 bp, Artificial sequence
  Synthetic oligonucleotide
ctatactcccactcgaatgctgaac

SEQ ID NO: 696199 - DNA, 25 bp, Artificial sequence
  Synthetic oligonucleotide
tcccactcgaatgctgaacctgatg

SEQ ID NO: 696200 - DNA, 25 bp, Artificial sequence
  Synthetic oligonucleotide
tcgaatgctgaacctgatgaacccg

SEQ ID NO: 696201 - DNA, 25 bp, Artificial sequence
  Synthetic oligonucleotide
tgctgaacctgatgaacccggcctg

SEQ ID NO: 696202 - DNA, 25 bp, Artificial sequence
  Synthetic oligonucleotide
aacctgatgaacccggcctgccttg

SEQ ID NO: 696203 - DNA, 25 bp, Artificial sequence
  Synthetic oligonucleotide
atgaacccggcctgccttgctgtgt

SEQ ID NO: 696204 - DNA, 25 bp, Artificial sequence
  Synthetic oligonucleotide
ccggcctgccttgctgtgtgccgag

SEQ ID NO: 696205 - DNA, 25 bp, Artificial sequence
  Synthetic oligonucleotide
tgccttgctgtgtgccgaggtgcga

SEQ ID NO: 696206 - DNA, 25 bp, Artificial sequence
  Synthetic oligonucleotide
gctgtgtgccgaggtgcgacggtca

SEQ ID NO: 696207 - DNA, 25 bp, Artificial sequence
  Synthetic oligonucleotide
tgccgaggtgcgacggtcaaagttc

SEQ ID NO: 696208 - DNA, 25 bp, Artificial sequence
  Synthetic oligonucleotide
gcgttgttatgtcgcagccgctgtc

SEQ ID NO: 696209 - DNA, 25 bp, Artificial sequence
  Synthetic oligonucleotide
catctacgacacttccgagccggag

SEQ ID NO: 696210 - DNA, 25 bp, Artificial sequence
  Synthetic oligonucleotide
aaatcctctggacggtggtgccgtt

SEQ ID NO: 696211 - DNA, 25 bp, Artificial sequence
  Synthetic oligonucleotide
tctggacggtggtgccgttcgtgat

SEQ ID NO: 696212 - DNA, 25 bp, Artificial sequence
  Synthetic oligonucleotide
cggtggtgccgttcgtgatcctggt

SEQ ID NO: 696213 - DNA, 25 bp, Artificial sequence
  Synthetic oligonucleotide
tgccgttcgtgatcctggtggtgat

SEQ ID NO: 696214 - DNA, 25 bp, Artificial sequence
  Synthetic oligonucleotide
tcgtgatcctggtggtgatggcggt

SEQ ID NO: 696215 - DNA, 25 bp, Artificial sequence
  Synthetic oligonucleotide
tcctggtggtgatggcggtgcccgc

SEQ ID NO: 696216 - DNA, 25 bp, Artificial sequence
  Synthetic oligonucleotide
tggtgatggcggtgcccgccacccg

SEQ ID NO: 696217 - DNA, 25 bp, Artificial sequence
  Synthetic oligonucleotide
tggcggtgcccgccacccgcaccct

SEQ ID NO: 696218 - DNA, 25 bp, Artificial sequence
  Synthetic oligonucleotide
gcccgccacccgcaccctgatccac

SEQ ID NO: 696219 - DNA, 25 bp, Artificial sequence
  Synthetic oligonucleotide
cacccgcaccctgatccacatctac

SEQ ID NO: 696220 - DNA, 25 bp, Artificial sequence
  Synthetic oligonucleotide
ggccccgggcgctaccgaggtgagc

SEQ ID NO: 696221 - DNA, 25 bp, Artificial sequence
  Synthetic oligonucleotide
gatccacatctacgacacttccgag

SEQ ID NO: 696222 - DNA, 25 bp, Artificial sequence
  Synthetic oligonucleotide
acgagagcaccacggtggaaatcct

SEQ ID NO: 696223 - DNA, 25 bp, Artificial sequence
  Synthetic oligonucleotide
acgacacttccgagccggagctgga

SEQ ID NO: 696224 - DNA, 25 bp, Artificial sequence
  Synthetic oligonucleotide
cttccgagccggagctggacgtgca

SEQ ID NO: 696225 - DNA, 25 bp, Artificial sequence
  Synthetic oligonucleotide
agccggagctggacgtgcaggtcac

SEQ ID NO: 696226 - DNA, 25 bp, Artificial sequence
  Synthetic oligonucleotide
agctggacgtgcaggtcaccggcta

SEQ ID NO: 696227 - DNA, 25 bp, Artificial sequence
  Synthetic oligonucleotide
acgtgcaggtcaccggctaccagtg

SEQ ID NO: 696228 - DNA, 25 bp, Artificial sequence
  Synthetic oligonucleotide
aggtcaccggctaccagtggaagtg

SEQ ID NO: 696229 - DNA, 25 bp, Artificial sequence
  Synthetic oligonucleotide
ccggctaccagtggaagtggcagta

SEQ ID NO: 696230 - DNA, 25 bp, Artificial sequence
  Synthetic oligonucleotide
accagtggaagtggcagtacaagta

SEQ ID NO: 696231 - DNA, 25 bp, Artificial sequence
  Synthetic oligonucleotide
tggaagtggcagtacaagtacctgg

SEQ ID NO: 696232 - DNA, 25 bp, Artificial sequence
  Synthetic oligonucleotide
tggcagtacaagtacctgggccagg

SEQ ID NO: 696233 - DNA, 25 bp, Artificial sequence
  Synthetic oligonucleotide
tacaagtacctgggccaggacgtcg

SEQ ID NO: 696234 - DNA, 25 bp, Artificial sequence
  Synthetic oligonucleotide
caccctgatccacatctacgacact

SEQ ID NO: 696235 - DNA, 25 bp, Artificial sequence
  Synthetic oligonucleotide
ttcggcgcgatgttctggtcgatga

SEQ ID NO: 696236 - DNA, 25 bp, Artificial sequence
  Synthetic oligonucleotide
ccaccattcgcctgcaaagccacgc

SEQ ID NO: 696237 - DNA, 25 bp, Artificial sequence
  Synthetic oligonucleotide
aggtgagccggtccgtcttcgacct

SEQ ID NO: 696238 - DNA, 25 bp, Artificial sequence
  Synthetic oligonucleotide
gccggtccgtcttcgacctgcacat

SEQ ID NO: 696239 - DNA, 25 bp, Artificial sequence
  Synthetic oligonucleotide
ccgtcttcgacctgcacatgaccat

SEQ ID NO: 696240 - DNA, 25 bp, Artificial sequence
  Synthetic oligonucleotide
tcgacctgcacatgaccatcttctg

SEQ ID NO: 696241 - DNA, 25 bp, Artificial sequence
  Synthetic oligonucleotide
tgcacatgaccatcttctggatctg

SEQ ID NO: 696242 - DNA, 25 bp, Artificial sequence
  Synthetic oligonucleotide
tgaccatcttctggatctgcgtggt

SEQ ID NO: 696243 - DNA, 25 bp, Artificial sequence
  Synthetic oligonucleotide
tcttctggatctgcgtggtgatcgg

SEQ ID NO: 696244 - DNA, 25 bp, Artificial sequence
  Synthetic oligonucleotide
ggatctgcgtggtgatcggcgtgct

SEQ ID NO: 696245 - DNA, 25 bp, Artificial sequence
  Synthetic oligonucleotide
gcgtggtgatcggcgtgctggtctt

SEQ ID NO: 696246 - DNA, 25 bp, Artificial sequence
  Synthetic oligonucleotide
gtgatcggcgtgctggtcttcggcg

SEQ ID NO: 696247 - DNA, 25 bp, Artificial sequence
  Synthetic oligonucleotide
cggtggaaatcctctggacggtggt

SEQ ID NO: 696248 - DNA, 25 bp, Artificial sequence
  Synthetic oligonucleotide
ctggtcttcggcgcgatgttctggt

SEQ ID NO: 696249 - DNA, 25 bp, Artificial sequence
  Synthetic oligonucleotide
gcaccacggtggaaatcctctggac

SEQ ID NO: 696250 - DNA, 25 bp, Artificial sequence
  Synthetic oligonucleotide
gcgatgttctggtcgatgatcgtcc

SEQ ID NO: 696251 - DNA, 25 bp, Artificial sequence
  Synthetic oligonucleotide
ttctggtcgatgatcgtccaccgcc

SEQ ID NO: 696252 - DNA, 25 bp, Artificial sequence
  Synthetic oligonucleotide
tcgatgatcgtccaccgccgctcca

SEQ ID NO: 696253 - DNA, 25 bp, Artificial sequence
  Synthetic oligonucleotide
atcgtccaccgccgctccaccggcc

SEQ ID NO: 696254 - DNA, 25 bp, Artificial sequence
  Synthetic oligonucleotide
caccgccgctccaccggccagcagc

SEQ ID NO: 696255 - DNA, 25 bp, Artificial sequence
  Synthetic oligonucleotide
cgctccaccggccagcagccggcgc

SEQ ID NO: 696256 - DNA, 25 bp, Artificial sequence
  Synthetic oligonucleotide
accggccagcagccggcgcacttcc

SEQ ID NO: 696257 - DNA, 25 bp, Artificial sequence
  Synthetic oligonucleotide
agcagccggcgcacttccacgagag

SEQ ID NO: 696258 - DNA, 25 bp, Artificial sequence
  Synthetic oligonucleotide
cggcgcacttccacgagagcaccac

SEQ ID NO: 696259 - DNA, 25 bp, Artificial sequence
  Synthetic oligonucleotide
acttccacgagagcaccacggtgga

SEQ ID NO: 696260 - DNA, 25 bp, Artificial sequence
  Synthetic oligonucleotide
gggcgctaccgaggtgagccggtcc

SEQ ID NO: 696261 - DNA, 25 bp, Artificial sequence
  Synthetic oligonucleotide
ggcgtgctggtcttcggcgcgatgt

SEQ ID NO: 696262 - DNA, 25 bp, Artificial sequence
  Synthetic oligonucleotide
ggaagaactgctcggcgaccttcag

SEQ ID NO: 696263 - DNA, 25 bp, Artificial sequence
  Synthetic oligonucleotide
agccacgccgctcgcggcttttaga

SEQ ID NO: 696264 - DNA, 25 bp, Artificial sequence
  Synthetic oligonucleotide
aggtaggcttcgtcgagcagggcgt

SEQ ID NO: 696265 - DNA, 25 bp, Artificial sequence
  Synthetic oligonucleotide
gcttcgtcgagcagggcgtcgaggc

SEQ ID NO: 696266 - DNA, 25 bp, Artificial sequence
  Synthetic oligonucleotide
tcgagcagggcgtcgaggccgtcgt

SEQ ID NO: 696267 - DNA, 25 bp, Artificial sequence
  Synthetic oligonucleotide
agggcgtcgaggccgtcgtggccgg

SEQ ID NO: 696268 - DNA, 25 bp, Artificial sequence
  Synthetic oligonucleotide
tcgaggccgtcgtggccggcgagca

SEQ ID NO: 696269 - DNA, 25 bp, Artificial sequence
  Synthetic oligonucleotide
ccgtcgtggccggcgagcaacgccg

SEQ ID NO: 696270 - DNA, 25 bp, Artificial sequence
  Synthetic oligonucleotide
gtggccggcgagcaacgccggcggg

SEQ ID NO: 696271 - DNA, 25 bp, Artificial sequence
  Synthetic oligonucleotide
ggcgagcaacgccggcggggtgagg

SEQ ID NO: 696272 - DNA, 25 bp, Artificial sequence
  Synthetic oligonucleotide
gcaacgccggcggggtgaggaagaa

SEQ ID NO: 696273 - DNA, 25 bp, Artificial sequence
  Synthetic oligonucleotide
aggcggtgcgccaggtaggcttcgt

SEQ ID NO: 696274 - DNA, 25 bp, Artificial sequence
  Synthetic oligonucleotide
ggtgaggaagaactgctcggcgacc

SEQ ID NO: 696275 - DNA, 25 bp, Artificial sequence
  Synthetic oligonucleotide
tccaccaggcggtgcgccaggtagg

SEQ ID NO: 696276 - DNA, 25 bp, Artificial sequence
  Synthetic oligonucleotide
actgctcggcgaccttcagcaccgg

SEQ ID NO: 696277 - DNA, 25 bp, Artificial sequence
  Synthetic oligonucleotide
cggcgaccttcagcaccggcttgat

SEQ ID NO: 696278 - DNA, 25 bp, Artificial sequence
  Synthetic oligonucleotide
ccttcagcaccggcttgatccgttc

SEQ ID NO: 696279 - DNA, 25 bp, Artificial sequence
  Synthetic oligonucleotide
gcaccggcttgatccgttcctcgat

SEQ ID NO: 696280 - DNA, 25 bp, Artificial sequence
  Synthetic oligonucleotide
gcttgatccgttcctcgatgccggc

SEQ ID NO: 696281 - DNA, 25 bp, Artificial sequence
  Synthetic oligonucleotide
tccgttcctcgatgccggcttcgcg

SEQ ID NO: 696282 - DNA, 25 bp, Artificial sequence
  Synthetic oligonucleotide
cctcgatgccggcttcgcgggccac

SEQ ID NO: 696283 - DNA, 25 bp, Artificial sequence
  Synthetic oligonucleotide
tgccggcttcgcgggccacgctgtt

SEQ ID NO: 696284 - DNA, 25 bp, Artificial sequence
  Synthetic oligonucleotide
cttcgcgggccacgctgttggcggc

SEQ ID NO: 696285 - DNA, 25 bp, Artificial sequence
  Synthetic oligonucleotide
gggccacgctgttggcggcgtcgag

SEQ ID NO: 696286 - DNA, 25 bp, Artificial sequence
  Synthetic oligonucleotide
gctgttggcggcgtcgagcaggtcc

SEQ ID NO: 696287 - DNA, 25 bp, Artificial sequence
  Synthetic oligonucleotide
ccggcggggtgaggaagaactgctc

SEQ ID NO: 696288 - DNA, 25 bp, Artificial sequence
  Synthetic oligonucleotide
gttggctacggtggtgtccagtggg

SEQ ID NO: 696289 - DNA, 25 bp, Artificial sequence
  Synthetic oligonucleotide
tggtggacggcttcgtccagccggt

SEQ ID NO: 696290 - DNA, 25 bp, Artificial sequence
  Synthetic oligonucleotide
acggcttcgtccagccggttggcga

SEQ ID NO: 696291 - DNA, 25 bp, Artificial sequence
  Synthetic oligonucleotide
agaccgccggcagcgcctacagcgg

SEQ ID NO: 696292 - DNA, 25 bp, Artificial sequence
  Synthetic oligonucleotide
cagctcgatcatgggcgcgatcaac

SEQ ID NO: 696293 - DNA, 25 bp, Artificial sequence
  Synthetic oligonucleotide
tcgtccagccggttggcgaagggct

SEQ ID NO: 696294 - DNA, 25 bp, Artificial sequence
  Synthetic oligonucleotide
cagccggttggcgaagggctcgccg

SEQ ID NO: 696295 - DNA, 25 bp, Artificial sequence
  Synthetic oligonucleotide
ttggcgaagggctcgccgatcaact

SEQ ID NO: 696296 - DNA, 25 bp, Artificial sequence
  Synthetic oligonucleotide
aagggctcgccgatcaactggtggg

SEQ ID NO: 696297 - DNA, 25 bp, Artificial sequence
  Synthetic oligonucleotide
tcgccgatcaactggtgggccacca

SEQ ID NO: 696298 - DNA, 25 bp, Artificial sequence
  Synthetic oligonucleotide
atcaactggtgggccaccaggttgg

SEQ ID NO: 696299 - DNA, 25 bp, Artificial sequence
  Synthetic oligonucleotide
tgcgccaggtaggcttcgtcgagca

SEQ ID NO: 696300 - DNA, 25 bp, Artificial sequence
  Synthetic oligonucleotide
ccaccaggttggctacggtggtgtc

SEQ ID NO: 696301 - DNA, 25 bp, Artificial sequence
  Synthetic oligonucleotide
ccggtacctgttcgacgtaggcgtg

SEQ ID NO: 696302 - DNA, 25 bp, Artificial sequence
  Synthetic oligonucleotide
tacggtggtgtccagtgggatcagt

SEQ ID NO: 696303 - DNA, 25 bp, Artificial sequence
  Synthetic oligonucleotide
tggtgtccagtgggatcagtgcctg

SEQ ID NO: 696304 - DNA, 25 bp, Artificial sequence
  Synthetic oligonucleotide
ccagtgggatcagtgcctggccgaa

SEQ ID NO: 696305 - DNA, 25 bp, Artificial sequence
  Synthetic oligonucleotide
ggatcagtgcctggccgaagtgggc

SEQ ID NO: 696306 - DNA, 25 bp, Artificial sequence
  Synthetic oligonucleotide
gtgcctggccgaagtgggcgatgta

SEQ ID NO: 696307 - DNA, 25 bp, Artificial sequence
  Synthetic oligonucleotide
tggccgaagtgggcgatgtagcggt

SEQ ID NO: 696308 - DNA, 25 bp, Artificial sequence
  Synthetic oligonucleotide
aagtgggcgatgtagcggtcgttca

SEQ ID NO: 696309 - DNA, 25 bp, Artificial sequence
  Synthetic oligonucleotide
gcgatgtagcggtcgttcacttctt

SEQ ID NO: 696310 - DNA, 25 bp, Artificial sequence
  Synthetic oligonucleotide
tagcggtcgttcacttcttccacca

SEQ ID NO: 696311 - DNA, 25 bp, Artificial sequence
  Synthetic oligonucleotide
tcgttcacttcttccaccaggcggt

SEQ ID NO: 696312 - DNA, 25 bp, Artificial sequence
  Synthetic oligonucleotide
cacttcttccaccaggcggtgcgcc

SEQ ID NO: 696313 - DNA, 25 bp, Artificial sequence
  Synthetic oligonucleotide
tggtgggccaccaggttggctacgg

SEQ ID NO: 696314 - DNA, 25 bp, Artificial sequence
  Synthetic oligonucleotide
gccggcggcgcgcgccggctaagac

SEQ ID NO: 696315 - DNA, 25 bp, Artificial sequence
  Synthetic oligonucleotide
agttcacggagggcagcggtgttca

SEQ ID NO: 696316 - DNA, 25 bp, Artificial sequence
  Synthetic oligonucleotide
ggagggcagcggtgttcatggggtc

SEQ ID NO: 696317 - DNA, 25 bp, Artificial sequence
  Synthetic oligonucleotide
cagcggtgttcatggggtctcccat

SEQ ID NO: 696318 - DNA, 25 bp, Artificial sequence
  Synthetic oligonucleotide
tgttcatggggtctcccatacaacg

SEQ ID NO: 696319 - DNA, 25 bp, Artificial sequence
  Synthetic oligonucleotide
tggggtctcccatacaacggggatg

SEQ ID NO: 696320 - DNA, 25 bp, Artificial sequence
  Synthetic oligonucleotide
tctcccatacaacggggatggtgaa

SEQ ID NO: 696321 - DNA, 25 bp, Artificial sequence
  Synthetic oligonucleotide
catacaacggggatggtgaagaaga

SEQ ID NO: 696322 - DNA, 25 bp, Artificial sequence
  Synthetic oligonucleotide
acggggatggtgaagaagaggagaa

SEQ ID NO: 696323 - DNA, 25 bp, Artificial sequence
  Synthetic oligonucleotide
atggtgaagaagaggagaaacatag

SEQ ID NO: 696324 - DNA, 25 bp, Artificial sequence
  Synthetic oligonucleotide
agaagaggagaaacatagccggcgg

SEQ ID NO: 696325 - DNA, 25 bp, Artificial sequence
  Synthetic oligonucleotide
gcggcgtcgagcaggtccggtacct

SEQ ID NO: 696326 - DNA, 25 bp, Artificial sequence
  Synthetic oligonucleotide
aacatagccggcggcgcgcgccggc

SEQ ID NO: 696327 - DNA, 25 bp, Artificial sequence
  Synthetic oligonucleotide
aggtgcgcctgctggatgagttcac

SEQ ID NO: 696328 - DNA, 25 bp, Artificial sequence
  Synthetic oligonucleotide
ggcgcgcgccggctaagacgcgatt

SEQ ID NO: 696329 - DNA, 25 bp, Artificial sequence
  Synthetic oligonucleotide
cgccggctaagacgcgattgtcata

SEQ ID NO: 696330 - DNA, 25 bp, Artificial sequence
  Synthetic oligonucleotide
ctaagacgcgattgtcataatcgct

SEQ ID NO: 696331 - DNA, 25 bp, Artificial sequence
  Synthetic oligonucleotide
cgcgattgtcataatcgcttcgtgg

SEQ ID NO: 696332 - DNA, 25 bp, Artificial sequence
  Synthetic oligonucleotide
tgtcataatcgcttcgtggttatgc

SEQ ID NO: 696333 - DNA, 25 bp, Artificial sequence
  Synthetic oligonucleotide
aatcgcttcgtggttatgcgaggat

SEQ ID NO: 696334 - DNA, 25 bp, Artificial sequence
  Synthetic oligonucleotide
cttcgtggttatgcgaggatgatat

SEQ ID NO: 696335 - DNA, 25 bp, Artificial sequence
  Synthetic oligonucleotide
ggttatgcgaggatgatatatcagg

SEQ ID NO: 696336 - DNA, 25 bp, Artificial sequence
  Synthetic oligonucleotide
gcgaggatgatatatcaggcggcca

SEQ ID NO: 696337 - DNA, 25 bp, Artificial sequence
  Synthetic oligonucleotide
gatgatatatcaggcggccaccatt

SEQ ID NO: 696338 - DNA, 25 bp, Artificial sequence
  Synthetic oligonucleotide
atatcaggcggccaccattcgcctg

SEQ ID NO: 696339 - DNA, 25 bp, Artificial sequence
  Synthetic oligonucleotide
aggagaaacatagccggcggcgcgc

SEQ ID NO: 696340 - DNA, 25 bp, Artificial sequence
  Synthetic oligonucleotide
tgcgatgcaggtggggcaggcggct

SEQ ID NO: 696341 - DNA, 25 bp, Artificial sequence
  Synthetic oligonucleotide
ttcgcctgcaaagccacgccgctcg

SEQ ID NO: 696342 - DNA, 25 bp, Artificial sequence
  Synthetic oligonucleotide
cctgttcgacgtaggcgtggacgaa

SEQ ID NO: 696343 - DNA, 25 bp, Artificial sequence
  Synthetic oligonucleotide
tcgacgtaggcgtggacgaagcggg

SEQ ID NO: 696344 - DNA, 25 bp, Artificial sequence
  Synthetic oligonucleotide
taggcgtggacgaagcgggtgagta

SEQ ID NO: 696345 - DNA, 25 bp, Artificial sequence
  Synthetic oligonucleotide
tggacgaagcgggtgagtatgtctt

SEQ ID NO: 696346 - DNA, 25 bp, Artificial sequence
  Synthetic oligonucleotide
aagcgggtgagtatgtcttccgtgt

SEQ ID NO: 696347 - DNA, 25 bp, Artificial sequence
  Synthetic oligonucleotide
gtgagtatgtcttccgtgttctcgc

SEQ ID NO: 696348 - DNA, 25 bp, Artificial sequence
  Synthetic oligonucleotide
atgtcttccgtgttctcgccttgcg

SEQ ID NO: 696349 - DNA, 25 bp, Artificial sequence
  Synthetic oligonucleotide
tccgtgttctcgccttgcggctgga

SEQ ID NO: 696350 - DNA, 25 bp, Artificial sequence
  Synthetic oligonucleotide
ttctcgccttgcggctggatggtgc

SEQ ID NO: 696351 - DNA, 25 bp, Artificial sequence
  Synthetic oligonucleotide
ccttgcggctggatggtgcgatgca

SEQ ID NO: 696352 - DNA, 25 bp, Artificial sequence
  Synthetic oligonucleotide
tggatgagttcacggagggcagcgg

SEQ ID NO: 696353 - DNA, 25 bp, Artificial sequence
  Synthetic oligonucleotide
gatggtgcgatgcaggtggggcagg

SEQ ID NO: 696354 - DNA, 25 bp, Artificial sequence
  Synthetic oligonucleotide
gcctgctggatgagttcacggaggg

SEQ ID NO: 696355 - DNA, 25 bp, Artificial sequence
  Synthetic oligonucleotide
gcaggtggggcaggcggctggctat

SEQ ID NO: 696356 - DNA, 25 bp, Artificial sequence
  Synthetic oligonucleotide
gggcaggcggctggctatcagatca

SEQ ID NO: 696357 - DNA, 25 bp, Artificial sequence
  Synthetic oligonucleotide
ggcggctggctatcagatcagccag

SEQ ID NO: 696358 - DNA, 25 bp, Artificial sequence
  Synthetic oligonucleotide
tggctatcagatcagccaggtgacc

SEQ ID NO: 696359 - DNA, 25 bp, Artificial sequence
  Synthetic oligonucleotide
tcagatcagccaggtgaccgtggcg

SEQ ID NO: 696360 - DNA, 25 bp, Artificial sequence
  Synthetic oligonucleotide
tcagccaggtgaccgtggcgggctt

SEQ ID NO: 696361 - DNA, 25 bp, Artificial sequence
  Synthetic oligonucleotide
aggtgaccgtggcgggcttcgctga

SEQ ID NO: 696362 - DNA, 25 bp, Artificial sequence
  Synthetic oligonucleotide
ccgtggcgggcttcgctgaggtgcg

SEQ ID NO: 696363 - DNA, 25 bp, Artificial sequence
  Synthetic oligonucleotide
cgggcttcgctgaggtgcgcctgct

SEQ ID NO: 696364 - DNA, 25 bp, Artificial sequence
  Synthetic oligonucleotide
tcgctgaggtgcgcctgctggatga

SEQ ID NO: 696365 - DNA, 25 bp, Artificial sequence
  Synthetic oligonucleotide
cgagcaggtccggtacctgttcgac

SEQ ID NO: 696366 - DNA, 25 bp, Artificial sequence
  Synthetic oligonucleotide
cggctggatggtgcgatgcaggtgg

SEQ ID NO: 696367 - DNA, 25 bp, Artificial sequence
  Synthetic oligonucleotide
cagcttcatgatgttcctgctcggc

SEQ ID NO: 696368 - DNA, 25 bp, Artificial sequence
  Synthetic oligonucleotide
cggccaagggcctgatgcgctgggt

SEQ ID NO: 696369 - DNA, 25 bp, Artificial sequence
  Synthetic oligonucleotide
agggcctgatgcgctgggtgctgac

SEQ ID NO: 696370 - DNA, 25 bp, Artificial sequence
  Synthetic oligonucleotide
tgatgcgctgggtgctgacgaccaa

SEQ ID NO: 696371 - DNA, 25 bp, Artificial sequence
  Synthetic oligonucleotide
gctgggtgctgacgaccaaccacaa

SEQ ID NO: 696372 - DNA, 25 bp, Artificial sequence
  Synthetic oligonucleotide
tgctgacgaccaaccacaaggacat

SEQ ID NO: 696373 - DNA, 25 bp, Artificial sequence
  Synthetic oligonucleotide
acgaccaaccacaaggacatcggca

SEQ ID NO: 696374 - DNA, 25 bp, Artificial sequence
  Synthetic oligonucleotide
aaccacaaggacatcggcaccctct

SEQ ID NO: 696375 - DNA, 25 bp, Artificial sequence
  Synthetic oligonucleotide
aaggacatcggcaccctctacctgt

SEQ ID NO: 696376 - DNA, 25 bp, Artificial sequence
  Synthetic oligonucleotide
atcggcaccctctacctgtggttca

SEQ ID NO: 696377 - DNA, 25 bp, Artificial sequence
  Synthetic oligonucleotide
accctctacctgtggttcagcttca

SEQ ID NO: 696378 - DNA, 25 bp, Artificial sequence
  Synthetic oligonucleotide
agccggcgttcttcaaccagatgac

SEQ ID NO: 696379 - DNA, 25 bp, Artificial sequence
  Synthetic oligonucleotide
gtggttcagcttcatgatgttcctg

SEQ ID NO: 696380 - DNA, 25 bp, Artificial sequence
  Synthetic oligonucleotide
ggcgaccaccaccacggaccggcca

SEQ ID NO: 696381 - DNA, 25 bp, Artificial sequence
  Synthetic oligonucleotide
tcatgatgttcctgctcggcggctc

SEQ ID NO: 696382 - DNA, 25 bp, Artificial sequence
  Synthetic oligonucleotide
tgttcctgctcggcggctcgatggc

SEQ ID NO: 696383 - DNA, 25 bp, Artificial sequence
  Synthetic oligonucleotide
tgctcggcggctcgatggccatggt

SEQ ID NO: 696384 - DNA, 25 bp, Artificial sequence
  Synthetic oligonucleotide
cggctcgatggccatggtgatccgc

SEQ ID NO: 696385 - DNA, 25 bp, Artificial sequence
  Synthetic oligonucleotide
gatggccatggtgatccgcgccgag

SEQ ID NO: 696386 - DNA, 25 bp, Artificial sequence
  Synthetic oligonucleotide
catggtgatccgcgccgagctgttc

SEQ ID NO: 696387 - DNA, 25 bp, Artificial sequence
  Synthetic oligonucleotide
gatccgcgccgagctgttccagccc

SEQ ID NO: 696388 - DNA, 25 bp, Artificial sequence
  Synthetic oligonucleotide
cgccgagctgttccagcccggcctg

SEQ ID NO: 696389 - DNA, 25 bp, Artificial sequence
  Synthetic oligonucleotide
tccagcccggcctgcagatcgtcga

SEQ ID NO: 696390 - DNA, 25 bp, Artificial sequence
  Synthetic oligonucleotide
tgcagatcgtcgagccggcgttctt

SEQ ID NO: 696391 - DNA, 25 bp, Artificial sequence
  Synthetic oligonucleotide
gtcgacctggccgcggtgatcacct

SEQ ID NO: 696392 - DNA, 25 bp, Artificial sequence
  Synthetic oligonucleotide
tacctgtggttcagcttcatgatgt

SEQ ID NO: 696393 - DNA, 25 bp, Artificial sequence
  Synthetic oligonucleotide
ctacaagcagaaacaacaataggag

SEQ ID NO: 696394 - DNA, 25 bp, Artificial sequence
  Synthetic oligonucleotide
tggccgcggtgatcacctacgagcg

SEQ ID NO: 696395 - DNA, 25 bp, Artificial sequence
  Synthetic oligonucleotide
cggtgatcacctacgagcgcaacgc

SEQ ID NO: 696396 - DNA, 25 bp, Artificial sequence
  Synthetic oligonucleotide
atcacctacgagcgcaacgcctggg

SEQ ID NO: 696397 - DNA, 25 bp, Artificial sequence
  Synthetic oligonucleotide
tacgagcgcaacgcctggggcaacg

SEQ ID NO: 696398 - DNA, 25 bp, Artificial sequence
  Synthetic oligonucleotide
cgcaacgcctggggcaacgacgatg

SEQ ID NO: 696399 - DNA, 25 bp, Artificial sequence
  Synthetic oligonucleotide
cctggggcaacgacgatggcgacat

SEQ ID NO: 696400 - DNA, 25 bp, Artificial sequence
  Synthetic oligonucleotide
gcaacgacgatggcgacatggtcac

SEQ ID NO: 696401 - DNA, 25 bp, Artificial sequence
  Synthetic oligonucleotide
acgatggcgacatggtcaccccgaa

SEQ ID NO: 696402 - DNA, 25 bp, Artificial sequence
  Synthetic oligonucleotide
gcgacatggtcaccccgaaagacgt

SEQ ID NO: 696403 - DNA, 25 bp, Artificial sequence
  Synthetic oligonucleotide
tggtcaccccgaaagacgtcgtcgc

SEQ ID NO: 696404 - DNA, 25 bp, Artificial sequence
  Synthetic oligonucleotide
cccgaaagacgtcgtcgcctacaag

SEQ ID NO: 696405 - DNA, 25 bp, Artificial sequence
  Synthetic oligonucleotide
cggaccggccaagggcctgatgcgc

SEQ ID NO: 696406 - DNA, 25 bp, Artificial sequence
  Synthetic oligonucleotide
cgtcgcctacaagcagaaacaacaa

SEQ ID NO: 696407 - DNA, 25 bp, Artificial sequence
  Synthetic oligonucleotide
ccaccacggaccggccaagggcctg

SEQ ID NO: 696408 - DNA, 25 bp, Artificial sequence
  Synthetic oligonucleotide
gcagaaacaacaataggagaccgcc

SEQ ID NO: 696409 - DNA, 25 bp, Artificial sequence
  Synthetic oligonucleotide
acaacaataggagaccgccatgagt

SEQ ID NO: 696410 - DNA, 25 bp, Artificial sequence
  Synthetic oligonucleotide
taggagaccgccatgagtgctgtga

SEQ ID NO: 696411 - DNA, 25 bp, Artificial sequence
  Synthetic oligonucleotide
accgccatgagtgctgtgatcgata

SEQ ID NO: 696412 - DNA, 25 bp, Artificial sequence
  Synthetic oligonucleotide
atgagtgctgtgatcgatacgcccg

SEQ ID NO: 696413 - DNA, 25 bp, Artificial sequence
  Synthetic oligonucleotide
tgctgtgatcgatacgcccgaccac

SEQ ID NO: 696414 - DNA, 25 bp, Artificial sequence
  Synthetic oligonucleotide
atcgatacgcccgaccaccatgccg

SEQ ID NO: 696415 - DNA, 25 bp, Artificial sequence
  Synthetic oligonucleotide
acgcccgaccaccatgccggcgacc

SEQ ID NO: 696416 - DNA, 25 bp, Artificial sequence
  Synthetic oligonucleotide
gaccaccatgccggcgaccaccacc

SEQ ID NO: 696417 - DNA, 25 bp, Artificial sequence
  Synthetic oligonucleotide
catgccggcgaccaccaccacggac

SEQ ID NO: 696418 - DNA, 25 bp, Artificial sequence
  Synthetic oligonucleotide
cgttcttcaaccagatgaccaccat

SEQ ID NO: 696419 - DNA, 25 bp, Artificial sequence
  Synthetic oligonucleotide
agacgtcgtcgcctacaagcagaaa

SEQ ID NO: 696420 - DNA, 25 bp, Artificial sequence
  Synthetic oligonucleotide
cgaccaccttcgccccgcacagcgt

SEQ ID NO: 696421 - DNA, 25 bp, Artificial sequence
  Synthetic oligonucleotide
tcggcctgctggtcagcaccttgtt

SEQ ID NO: 696422 - DNA, 25 bp, Artificial sequence
  Synthetic oligonucleotide
tgctggtcagcaccttgttcatgcc

SEQ ID NO: 696423 - DNA, 25 bp, Artificial sequence
  Synthetic oligonucleotide
tcagcaccttgttcatgcccggcgg

SEQ ID NO: 696424 - DNA, 25 bp, Artificial sequence
  Synthetic oligonucleotide
ccttgttcatgcccggcggcggccc

SEQ ID NO: 696425 - DNA, 25 bp, Artificial sequence
  Synthetic oligonucleotide
tcatgcccggcggcggccccaactt

SEQ ID NO: 696426 - DNA, 25 bp, Artificial sequence
  Synthetic oligonucleotide
cggcggcggccccaacttcggctgg

SEQ ID NO: 696427 - DNA, 25 bp, Artificial sequence
  Synthetic oligonucleotide
gccccaacttcggctggaccttcta

SEQ ID NO: 696428 - DNA, 25 bp, Artificial sequence
  Synthetic oligonucleotide
acttcggctggaccttctatgcgcc

SEQ ID NO: 696429 - DNA, 25 bp, Artificial sequence
  Synthetic oligonucleotide
gctggaccttctatgcgccgctgtc

SEQ ID NO: 696430 - DNA, 25 bp, Artificial sequence
  Synthetic oligonucleotide
ccttctatgcgccgctgtcgaccac

SEQ ID NO: 696431 - DNA, 25 bp, Artificial sequence
  Synthetic oligonucleotide
tcgtcgagccggcgttcttcaacca

SEQ ID NO: 696432 - DNA, 25 bp, Artificial sequence
  Synthetic oligonucleotide
cgctgtcgaccaccttcgccccgca

SEQ ID NO: 696433 - DNA, 25 bp, Artificial sequence
  Synthetic oligonucleotide
tggctgctgccggcggccttcggcc

SEQ ID NO: 696434 - DNA, 25 bp, Artificial sequence
  Synthetic oligonucleotide
ccttcgccccgcacagcgtgacctt

SEQ ID NO: 696435 - DNA, 25 bp, Artificial sequence
  Synthetic oligonucleotide
ccccgcacagcgtgaccttcttcat

SEQ ID NO: 696436 - DNA, 25 bp, Artificial sequence
  Synthetic oligonucleotide
acagcgtgaccttcttcatcttcgc

SEQ ID NO: 696437 - DNA, 25 bp, Artificial sequence
  Synthetic oligonucleotide
tgaccttcttcatcttcgccatcca

SEQ ID NO: 696438 - DNA, 25 bp, Artificial sequence
  Synthetic oligonucleotide
tcttcatcttcgccatccacctggc

SEQ ID NO: 696439 - DNA, 25 bp, Artificial sequence
  Synthetic oligonucleotide
ggccaggacgtcgagtacttcagca

SEQ ID NO: 696440 - DNA, 25 bp, Artificial sequence
  Synthetic oligonucleotide
aggcggccaccattcgcctgcaaag

SEQ ID NO: 696441 - DNA, 25 bp, Artificial sequence
  Synthetic oligonucleotide
tcttcgccatccacctggccgggat

SEQ ID NO: 696442 - DNA, 25 bp, Artificial sequence
  Synthetic oligonucleotide
catccacctggccgggatcagctcg

SEQ ID NO: 696443 - DNA, 25 bp, Artificial sequence
  Synthetic oligonucleotide
cgggatcagctcgatcatgggcgcg

SEQ ID NO: 696444 - DNA, 25 bp, Artificial sequence
  Synthetic oligonucleotide
cctggccgggatcagctcgatcatg

SEQ ID NO: 696445 - DNA, 25 bp, Artificial sequence
  Synthetic oligonucleotide
atgcgccgctgtcgaccaccttcgc

SEQ ID NO: 696446 - DNA, 25 bp, Artificial sequence
  Synthetic oligonucleotide
gatgatcccgctgatgatcggcgcg

SEQ ID NO: 696447 - DNA, 25 bp, Artificial sequence
  Synthetic oligonucleotide
tcaaccagatgaccaccatgcacgg

SEQ ID NO: 696448 - DNA, 25 bp, Artificial sequence
  Synthetic oligonucleotide
agatgaccaccatgcacggcctgat

SEQ ID NO: 696449 - DNA, 25 bp, Artificial sequence
  Synthetic oligonucleotide
caccatgcacggcctgatcatggtc

SEQ ID NO: 696450 - DNA, 25 bp, Artificial sequence
  Synthetic oligonucleotide
gcacggcctgatcatggtcttcggc

SEQ ID NO: 696451 - DNA, 25 bp, Artificial sequence
  Synthetic oligonucleotide
ctgatcatggtcttcggcgcggtga

SEQ ID NO: 696452 - DNA, 25 bp, Artificial sequence
  Synthetic oligonucleotide
catggtcttcggcgcggtgatgccg

SEQ ID NO: 696453 - DNA, 25 bp, Artificial sequence
  Synthetic oligonucleotide
tcttcggcgcggtgatgccggcctt

SEQ ID NO: 696454 - DNA, 25 bp, Artificial sequence
  Synthetic oligonucleotide
gcgcggtgatgccggccttcgtcgg

SEQ ID NO: 696455 - DNA, 25 bp, Artificial sequence
  Synthetic oligonucleotide
tgatgccggccttcgtcggcctggc

SEQ ID NO: 696456 - DNA, 25 bp, Artificial sequence
  Synthetic oligonucleotide
cggccttcgtcggcctggccaactg

SEQ ID NO: 696457 - DNA, 25 bp, Artificial sequence
  Synthetic oligonucleotide
cgtcggcctggccaactggatgatc

SEQ ID NO: 696458 - DNA, 25 bp, Artificial sequence
  Synthetic oligonucleotide
cggccttcggcctgctggtcagcac

SEQ ID NO: 696459 - DNA, 25 bp, Artificial sequence
  Synthetic oligonucleotide
caactggatgatcccgctgatgatc

SEQ ID NO: 696460 - DNA, 25 bp, Artificial sequence
  Synthetic oligonucleotide
tgccggcggccttcggcctgctggt

SEQ ID NO: 696461 - DNA, 25 bp, Artificial sequence
  Synthetic oligonucleotide
tcccgctgatgatcggcgcgccgga

SEQ ID NO: 696462 - DNA, 25 bp, Artificial sequence
  Synthetic oligonucleotide
tgatgatcggcgcgccggacatggc

SEQ ID NO: 696463 - DNA, 25 bp, Artificial sequence
  Synthetic oligonucleotide
tcggcgcgccggacatggccctgcc

SEQ ID NO: 696464 - DNA, 25 bp, Artificial sequence
  Synthetic oligonucleotide
gccggacatggccctgccgcggatg

SEQ ID NO: 696465 - DNA, 25 bp, Artificial sequence
  Synthetic oligonucleotide
acatggccctgccgcggatgaacaa

SEQ ID NO: 696466 - DNA, 25 bp, Artificial sequence
  Synthetic oligonucleotide
ccctgccgcggatgaacaacttcag

SEQ ID NO: 696467 - DNA, 25 bp, Artificial sequence
  Synthetic oligonucleotide
cgcggatgaacaacttcagcttctg

SEQ ID NO: 696468 - DNA, 25 bp, Artificial sequence
  Synthetic oligonucleotide
tgaacaacttcagcttctggctgct

SEQ ID NO: 696469 - DNA, 25 bp, Artificial sequence
  Synthetic oligonucleotide
aacttcagcttctggctgctgccgg

SEQ ID NO: 696470 - DNA, 25 bp, Artificial sequence
  Synthetic oligonucleotide
gcttctggctgctgccggcggcctt

SEQ ID NO: 696471 - DNA, 25 bp, Artificial sequence
  Synthetic oligonucleotide
agctgttccagcccggcctgcagat

SEQ ID NO: 696472 - DNA, 25 bp, Artificial sequence
  Synthetic oligonucleotide
cctggccaactggatgatcccgctg

SEQ ID NO: 696473 - DNA, 25 bp, Artificial sequence
  Synthetic oligonucleotide
aggtcgacgagcccggcatctatcg

SEQ ID NO: 696474 - DNA, 25 bp, Artificial sequence
  Synthetic oligonucleotide
tcgtggtcgacgtcaagcccaaggc

SEQ ID NO: 696475 - DNA, 25 bp, Artificial sequence
  Synthetic oligonucleotide
atccattcctggtgggtgccggcct

SEQ ID NO: 696476 - DNA, 25 bp, Artificial sequence
  Synthetic oligonucleotide
ttcctggtgggtgccggccttcgcg

SEQ ID NO: 696477 - DNA, 25 bp, Artificial sequence
  Synthetic oligonucleotide
gccggccttcgcggtcaagcgcgac

SEQ ID NO: 696478 - DNA, 25 bp, Artificial sequence
  Synthetic oligonucleotide
ggtcaagcgcgacgccatccccggc

SEQ ID NO: 696479 - DNA, 25 bp, Artificial sequence
  Synthetic oligonucleotide
gcgcgacgccatccccggcttcgtc

SEQ ID NO: 696480 - DNA, 25 bp, Artificial sequence
  Synthetic oligonucleotide
cgccatccccggcttcgtcaacgag

SEQ ID NO: 696481 - DNA, 25 bp, Artificial sequence
  Synthetic oligonucleotide
cccggcttcgtcaacgaggcctgga

SEQ ID NO: 696482 - DNA, 25 bp, Artificial sequence
  Synthetic oligonucleotide
cttcgtcaacgaggcctggaccaag

SEQ ID NO: 696483 - DNA, 25 bp, Artificial sequence
  Synthetic oligonucleotide
caacgaggcctggaccaaggtcgac

SEQ ID NO: 696484 - DNA, 25 bp, Artificial sequence
  Synthetic oligonucleotide
tccagcgacgtgatccattcctggt

SEQ ID NO: 696485 - DNA, 25 bp, Artificial sequence
  Synthetic oligonucleotide
ggaccaaggtcgacgagcccggcat

SEQ ID NO: 696486 - DNA, 25 bp, Artificial sequence
  Synthetic oligonucleotide
atcacctccagcgacgtgatccatt

SEQ ID NO: 696487 - DNA, 25 bp, Artificial sequence
  Synthetic oligonucleotide
acgagcccggcatctatcgcggcca

SEQ ID NO: 696488 - DNA, 25 bp, Artificial sequence
  Synthetic oligonucleotide
ccggcatctatcgcggccagtgcgc

SEQ ID NO: 696489 - DNA, 25 bp, Artificial sequence
  Synthetic oligonucleotide
tctatcgcggccagtgcgccgagct

SEQ ID NO: 696490 - DNA, 25 bp, Artificial sequence
  Synthetic oligonucleotide
cggccagtgcgccgagctgtgcggc

SEQ ID NO: 696491 - DNA, 25 bp, Artificial sequence
  Synthetic oligonucleotide
gtgcgccgagctgtgcggcaaggac

SEQ ID NO: 696492 - DNA, 25 bp, Artificial sequence
  Synthetic oligonucleotide
cgagctgtgcggcaaggaccacggc

SEQ ID NO: 696493 - DNA, 25 bp, Artificial sequence
  Synthetic oligonucleotide
tgtgcggcaaggaccacggcttcat

SEQ ID NO: 696494 - DNA, 25 bp, Artificial sequence
  Synthetic oligonucleotide
gcaaggaccacggcttcatgccgat

SEQ ID NO: 696495 - DNA, 25 bp, Artificial sequence
  Synthetic oligonucleotide
accacggcttcatgccgatcgtggt

SEQ ID NO: 696496 - DNA, 25 bp, Artificial sequence
  Synthetic oligonucleotide
gcttcatgccgatcgtggtcgacgt

SEQ ID NO: 696497 - DNA, 25 bp, Artificial sequence
  Synthetic oligonucleotide
tgccgatcgtggtcgacgtcaagcc

SEQ ID NO: 696498 - DNA, 25 bp, Artificial sequence
  Synthetic oligonucleotide
aggcctggaccaaggtcgacgagcc

SEQ ID NO: 696499 - DNA, 25 bp, Artificial sequence
  Synthetic oligonucleotide
aggacgagcattacctgctggaggt

SEQ ID NO: 696500 - DNA, 25 bp, Artificial sequence
  Synthetic oligonucleotide
gacgtcgagtacttcagcaacctgg

SEQ ID NO: 696501 - DNA, 25 bp, Artificial sequence
  Synthetic oligonucleotide
gagtacttcagcaacctggccaccc

SEQ ID NO: 696502 - DNA, 25 bp, Artificial sequence
  Synthetic oligonucleotide
ttcagcaacctggccaccccgcagg

SEQ ID NO: 696503 - DNA, 25 bp, Artificial sequence
  Synthetic oligonucleotide
aacctggccaccccgcaggatcaga

SEQ ID NO: 696504 - DNA, 25 bp, Artificial sequence
  Synthetic oligonucleotide
gccaccccgcaggatcagatccaca

SEQ ID NO: 696505 - DNA, 25 bp, Artificial sequence
  Synthetic oligonucleotide
ccggcctgcagatcgtcgagccggc

SEQ ID NO: 696506 - DNA, 25 bp, Artificial sequence
  Synthetic oligonucleotide
aacgaggtcgacctggccgcggtga

SEQ ID NO: 696507 - DNA, 25 bp, Artificial sequence
  Synthetic oligonucleotide
cgcaggatcagatccacaaccggca

SEQ ID NO: 696508 - DNA, 25 bp, Artificial sequence
  Synthetic oligonucleotide
atcagatccacaaccggcaggcgaa

SEQ ID NO: 696509 - DNA, 25 bp, Artificial sequence
  Synthetic oligonucleotide
tccacaaccggcaggcgaaggacga

SEQ ID NO: 696510 - DNA, 25 bp, Artificial sequence
  Synthetic oligonucleotide
gacgtgatccattcctggtgggtgc

SEQ ID NO: 696511 - DNA, 25 bp, Artificial sequence
  Synthetic oligonucleotide
aggcgaaggacgagcattacctgct

SEQ ID NO: 696512 - DNA, 25 bp, Artificial sequence
  Synthetic oligonucleotide
cttcgcggtcaagcgcgacgccatc

SEQ ID NO: 696513 - DNA, 25 bp, Artificial sequence
  Synthetic oligonucleotide
agcattacctgctggaggtggacga

SEQ ID NO: 696514 - DNA, 25 bp, Artificial sequence
  Synthetic oligonucleotide
acctgctggaggtggacgagccgct

SEQ ID NO: 696515 - DNA, 25 bp, Artificial sequence
  Synthetic oligonucleotide
tggaggtggacgagccgctggtgct

SEQ ID NO: 696516 - DNA, 25 bp, Artificial sequence
  Synthetic oligonucleotide
tggacgagccgctggtgctgccggt

SEQ ID NO: 696517 - DNA, 25 bp, Artificial sequence
  Synthetic oligonucleotide
agccgctggtgctgccggtgggcac

SEQ ID NO: 696518 - DNA, 25 bp, Artificial sequence
  Synthetic oligonucleotide
tggtgctgccggtgggcaccaaggt

SEQ ID NO: 696519 - DNA, 25 bp, Artificial sequence
  Synthetic oligonucleotide
tgccggtgggcaccaaggtgcgctt

SEQ ID NO: 696520 - DNA, 25 bp, Artificial sequence
  Synthetic oligonucleotide
tgggcaccaaggtgcgcttcctgat

SEQ ID NO: 696521 - DNA, 25 bp, Artificial sequence
  Synthetic oligonucleotide
accaaggtgcgcttcctgatcacct

SEQ ID NO: 696522 - DNA, 25 bp, Artificial sequence
  Synthetic oligonucleotide
gtgcgcttcctgatcacctccagcg

SEQ ID NO: 696523 - DNA, 25 bp, Artificial sequence
  Synthetic oligonucleotide
ttcctgatcacctccagcgacgtga

SEQ ID NO: 696524 - DNA, 25 bp, Artificial sequence
  Synthetic oligonucleotide
accggcaggcgaaggacgagcatta

SEQ ID NO: 696525 - DNA, 25 bp, Artificial sequence
  Synthetic oligonucleotide
aggagcaccacctggaagtggtctt

SEQ ID NO: 696526 - DNA, 25 bp, Artificial sequence
  Synthetic oligonucleotide
tgcgccgcctgccaccaggccgaag

SEQ ID NO: 696527 - DNA, 25 bp, Artificial sequence
  Synthetic oligonucleotide
gcctgccaccaggccgaaggccagg

SEQ ID NO: 696528 - DNA, 25 bp, Artificial sequence
  Synthetic oligonucleotide
caccaggccgaaggccagggcatgc

SEQ ID NO: 696529 - DNA, 25 bp, Artificial sequence
  Synthetic oligonucleotide
ccgaaggccagggcatgccgccgat

SEQ ID NO: 696530 - DNA, 25 bp, Artificial sequence
  Synthetic oligonucleotide
gccagggcatgccgccgatgttccc

SEQ ID NO: 696531 - DNA, 25 bp, Artificial sequence
  Synthetic oligonucleotide
gcatgccgccgatgttcccggcgct

SEQ ID NO: 696532 - DNA, 25 bp, Artificial sequence
  Synthetic oligonucleotide
cgccgatgttcccggcgctgaaggg

SEQ ID NO: 696533 - DNA, 25 bp, Artificial sequence
  Synthetic oligonucleotide
tgttcccggcgctgaagggttcgaa

SEQ ID NO: 696534 - DNA, 25 bp, Artificial sequence
  Synthetic oligonucleotide
accgccatggcggccttcggcaagc

SEQ ID NO: 696535 - DNA, 25 bp, Artificial sequence
  Synthetic oligonucleotide
tgaagggttcgaagatcgtcaccgg

SEQ ID NO: 696536 - DNA, 25 bp, Artificial sequence
  Synthetic oligonucleotide
aagatcgtcaccgggcccaaggagc

SEQ ID NO: 696537 - DNA, 25 bp, Artificial sequence
  Synthetic oligonucleotide
caccatctgcgccgcctgccaccag

SEQ ID NO: 696538 - DNA, 25 bp, Artificial sequence
  Synthetic oligonucleotide
ggcccaaggagcaccacctggaagt

SEQ ID NO: 696539 - DNA, 25 bp, Artificial sequence
  Synthetic oligonucleotide
cggcgctgaagggttcgaagatcgt

SEQ ID NO: 696540 - DNA, 25 bp, Artificial sequence
  Synthetic oligonucleotide
accacctggaagtggtcttcaacgg

SEQ ID NO: 696541 - DNA, 25 bp, Artificial sequence
  Synthetic oligonucleotide
tggaagtggtcttcaacggcgtgcc

SEQ ID NO: 696542 - DNA, 25 bp, Artificial sequence
  Synthetic oligonucleotide
gtggtcttcaacggcgtgcccggca

SEQ ID NO: 696543 - DNA, 25 bp, Artificial sequence
  Synthetic oligonucleotide
ttcaacggcgtgcccggcaccgcca

SEQ ID NO: 696544 - DNA, 25 bp, Artificial sequence
  Synthetic oligonucleotide
ggcgtgcccggcaccgccatggcgg

SEQ ID NO: 696545 - DNA, 25 bp, Artificial sequence
  Synthetic oligonucleotide
cccggcaccgccatggcggccttcg

SEQ ID NO: 696546 - DNA, 25 bp, Artificial sequence
  Synthetic oligonucleotide
gtcgacgtcaagcccaaggccgagt

SEQ ID NO: 696547 - DNA, 25 bp, Artificial sequence
  Synthetic oligonucleotide
gtgggtgccggccttcgcggtcaag

SEQ ID NO: 696548 - DNA, 25 bp, Artificial sequence
  Synthetic oligonucleotide
atggcggccttcggcaagcagctca

SEQ ID NO: 696549 - DNA, 25 bp, Artificial sequence
  Synthetic oligonucleotide
gccttcggcaagcagctcaacgagg

SEQ ID NO: 696550 - DNA, 25 bp, Artificial sequence
  Synthetic oligonucleotide
ggcaagcagctcaacgaggtcgacc

SEQ ID NO: 696551 - DNA, 25 bp, Artificial sequence
  Synthetic oligonucleotide
cagctcaacgaggtcgacctggccg

SEQ ID NO: 696552 - DNA, 25 bp, Artificial sequence
  Synthetic oligonucleotide
gtcaccgggcccaaggagcaccacc

SEQ ID NO: 696553 - DNA, 25 bp, Artificial sequence
  Synthetic oligonucleotide
ggaagaggcggcgaaggtcaaggaa

SEQ ID NO: 696554 - DNA, 25 bp, Artificial sequence
  Synthetic oligonucleotide
gtcaagcccaaggccgagttcgacc

SEQ ID NO: 696555 - DNA, 25 bp, Artificial sequence
  Synthetic oligonucleotide
cccaaggccgagttcgaccagtggc

SEQ ID NO: 696556 - DNA, 25 bp, Artificial sequence
  Synthetic oligonucleotide
gttcgaagatcgtcaccgggcccaa

SEQ ID NO: 696557 - DNA, 25 bp, Artificial sequence
  Synthetic oligonucleotide
tcgaccagtggctggccaagcgcaa

SEQ ID NO: 696558 - DNA, 25 bp, Artificial sequence
  Synthetic oligonucleotide
agtggctggccaagcgcaaggaaga

SEQ ID NO: 696559 - DNA, 25 bp, Artificial sequence
  Synthetic oligonucleotide
agcgcaaggaagaggcggcgaaggt

SEQ ID NO: 696560 - DNA, 25 bp, Artificial sequence
  Synthetic oligonucleotide
ccgagttcgaccagtggctggccaa

SEQ ID NO: 696561 - DNA, 25 bp, Artificial sequence
  Synthetic oligonucleotide
gcggcgaaggtcaaggaactgacca

SEQ ID NO: 696562 - DNA, 25 bp, Artificial sequence
  Synthetic oligonucleotide
aaggtcaaggaactgaccagcaagg

SEQ ID NO: 696563 - DNA, 25 bp, Artificial sequence
  Synthetic oligonucleotide
aaggaactgaccagcaaggagtgga

SEQ ID NO: 696564 - DNA, 25 bp, Artificial sequence
  Synthetic oligonucleotide
ctgaccagcaaggagtggaccaagg

SEQ ID NO: 696565 - DNA, 25 bp, Artificial sequence
  Synthetic oligonucleotide
ggcgacaaggtctaccacaccatct

SEQ ID NO: 696566 - DNA, 25 bp, Artificial sequence
  Synthetic oligonucleotide
agcaaggagtggaccaaggaagagt

SEQ ID NO: 696567 - DNA, 25 bp, Artificial sequence
  Synthetic oligonucleotide
gagtggaccaaggaagagttggttg

SEQ ID NO: 696568 - DNA, 25 bp, Artificial sequence
  Synthetic oligonucleotide
accaaggaagagttggttgcgcgcg

SEQ ID NO: 696569 - DNA, 25 bp, Artificial sequence
  Synthetic oligonucleotide
gaagagttggttgcgcgcggcgaca

SEQ ID NO: 696570 - DNA, 25 bp, Artificial sequence
  Synthetic oligonucleotide
ttggttgcgcgcggcgacaaggtct

SEQ ID NO: 696571 - DNA, 25 bp, Artificial sequence
  Synthetic oligonucleotide
gcgcgcggcgacaaggtctaccaca

SEQ ID NO: 696572 - DNA, 25 bp, Artificial sequence
  Synthetic oligonucleotide
ctaccacaccatctgcgccgcctgc

SEQ ID NO: 696573 - DNA, 25 bp, Artificial sequence
  Synthetic oligonucleotide
tggccaagcgcaaggaagaggcggc

SEQ ID NO: 696574 - DNA, 25 bp, Artificial sequence
  Synthetic oligonucleotide
aaggtctaccacaccatctgcgccg

SEQ ID NO: 696575 - DNA, 25 bp, Artificial sequence
  Synthetic oligonucleotide
agagccggtagttcatcccggtctc

SEQ ID NO: 696576 - DNA, 25 bp, Artificial sequence
  Synthetic oligonucleotide
agaaggcgacctccggcagcagccg

SEQ ID NO: 696577 - DNA, 25 bp, Artificial sequence
  Synthetic oligonucleotide
gacagggtcttttccgaggtgccca

SEQ ID NO: 696578 - DNA, 25 bp, Artificial sequence
  Synthetic oligonucleotide
aggcgcgacagggtcttttccgagg

SEQ ID NO: 696579 - DNA, 25 bp, Artificial sequence
  Synthetic oligonucleotide
ggaacaggcgcgacagggtcttttc

SEQ ID NO: 696580 - DNA, 25 bp, Artificial sequence
  Synthetic oligonucleotide
cgcgctggaacaggcgcgacagggt

SEQ ID NO: 696581 - DNA, 25 bp, Artificial sequence
  Synthetic oligonucleotide
cggtctcgcgctggaacaggcgcga

SEQ ID NO: 696582 - DNA, 25 bp, Artificial sequence
  Synthetic oligonucleotide
ttccgaggtgcccaggcgctgcgcc

SEQ ID NO: 696583 - DNA, 25 bp, Artificial sequence
  Synthetic oligonucleotide
ggtagttcatcccggtctcgcgctg

SEQ ID NO: 696584 - DNA, 25 bp, Artificial sequence
  Synthetic oligonucleotide
ggtgcccaggcgctgcgcccagtcg

SEQ ID NO: 696585 - DNA, 25 bp, Artificial sequence
  Synthetic oligonucleotide
ggcgccagagccggtagttcatccc

SEQ ID NO: 696586 - DNA, 25 bp, Artificial sequence
  Synthetic oligonucleotide
tggcgttggcgccagagccggtagt

SEQ ID NO: 696587 - DNA, 25 bp, Artificial sequence
  Synthetic oligonucleotide
aggcgctggcgttggcgccagagcc

SEQ ID NO: 696588 - DNA, 25 bp, Artificial sequence
  Synthetic oligonucleotide
gcgagcaggcgctggcgttggcgcc

SEQ ID NO: 696589 - DNA, 25 bp, Artificial sequence
  Synthetic oligonucleotide
agcgaggcgagcaggcgctggcgtt

SEQ ID NO: 696590 - DNA, 25 bp, Artificial sequence
  Synthetic oligonucleotide
gcgttgagcgaggcgagcaggcgct

SEQ ID NO: 696591 - DNA, 25 bp, Artificial sequence
  Synthetic oligonucleotide
tccagcgcgttgagcgaggcgagca

SEQ ID NO: 696592 - DNA, 25 bp, Artificial sequence
  Synthetic oligonucleotide
tcatcccggtctcgcgctggaacag

SEQ ID NO: 696593 - DNA, 25 bp, Artificial sequence
  Synthetic oligonucleotide
cgtcgatcagtgcctggcacagccg

SEQ ID NO: 696594 - DNA, 25 bp, Artificial sequence
  Synthetic oligonucleotide
accggcggctacagcgcggtggaca

SEQ ID NO: 696595 - DNA, 25 bp, Artificial sequence
  Synthetic oligonucleotide
catcggcagggagaaggcgacctcc

SEQ ID NO: 696596 - DNA, 25 bp, Artificial sequence
  Synthetic oligonucleotide
gcgcggcatcggcagggagaaggcg

SEQ ID NO: 696597 - DNA, 25 bp, Artificial sequence
  Synthetic oligonucleotide
gcggctcgcgcggcatcggcaggga

SEQ ID NO: 696598 - DNA, 25 bp, Artificial sequence
  Synthetic oligonucleotide
agcaggcgcggctcgcgcggcatcg

SEQ ID NO: 696599 - DNA, 25 bp, Artificial sequence
  Synthetic oligonucleotide
agccgcagcaggcgcggctcgcgcg

SEQ ID NO: 696600 - DNA, 25 bp, Artificial sequence
  Synthetic oligonucleotide
gtcttttccgaggtgcccaggcgct

SEQ ID NO: 696601 - DNA, 25 bp, Artificial sequence
  Synthetic oligonucleotide
cagtgcctggcacagccgcagcagg

SEQ ID NO: 696602 - DNA, 25 bp, Artificial sequence
  Synthetic oligonucleotide
gtgacgctgtcgccggcctccagcg

SEQ ID NO: 696603 - DNA, 25 bp, Artificial sequence
  Synthetic oligonucleotide
tcggttcgtcgatcagtgcctggca

SEQ ID NO: 696604 - DNA, 25 bp, Artificial sequence
  Synthetic oligonucleotide
tctgggtcggttcgtcgatcagtgc

SEQ ID NO: 696605 - DNA, 25 bp, Artificial sequence
  Synthetic oligonucleotide
tcaggctctgggtcggttcgtcgat

SEQ ID NO: 696606 - DNA, 25 bp, Artificial sequence
  Synthetic oligonucleotide
ccatggtcaggctctgggtcggttc

SEQ ID NO: 696607 - DNA, 25 bp, Artificial sequence
  Synthetic oligonucleotide
cagtcgcccatggtcaggctctggg

SEQ ID NO: 696608 - DNA, 25 bp, Artificial sequence
  Synthetic oligonucleotide
tgcgcccagtcgcccatggtcaggc

SEQ ID NO: 696609 - DNA, 25 bp, Artificial sequence
  Synthetic oligonucleotide
aggcgctgcgcccagtcgcccatgg

SEQ ID NO: 696610 - DNA, 25 bp, Artificial sequence
  Synthetic oligonucleotide
tggcacagccgcagcaggcgcggct

SEQ ID NO: 696611 - DNA, 25 bp, Artificial sequence
  Synthetic oligonucleotide
gatcgtcgactatcccatcgacgtg

SEQ ID NO: 696612 - DNA, 25 bp, Artificial sequence
  Synthetic oligonucleotide
ttcgccgggctcagcgctggcggaa

SEQ ID NO: 696613 - DNA, 25 bp, Artificial sequence
  Synthetic oligonucleotide
gggcccttcgccgggctcagcgctg

SEQ ID NO: 696614 - DNA, 25 bp, Artificial sequence
  Synthetic oligonucleotide
cgcgctgggcccttcgccgggctca

SEQ ID NO: 696615 - DNA, 25 bp, Artificial sequence
  Synthetic oligonucleotide
gccccgcgcgctgggcccttcgccg

SEQ ID NO: 696616 - DNA, 25 bp, Artificial sequence
  Synthetic oligonucleotide
ttctgagccccgcgcgctgggccct

SEQ ID NO: 696617 - DNA, 25 bp, Artificial sequence
  Synthetic oligonucleotide
cgacgtgttctgagccccgcgcgct

SEQ ID NO: 696618 - DNA, 25 bp, Artificial sequence
  Synthetic oligonucleotide
ccggcctccagcgcgttgagcgagg

SEQ ID NO: 696619 - DNA, 25 bp, Artificial sequence
  Synthetic oligonucleotide
cgactatcccatcgacgtgttctga

SEQ ID NO: 696620 - DNA, 25 bp, Artificial sequence
  Synthetic oligonucleotide
ggcggaacagttcgccgggagtgaa

SEQ ID NO: 696621 - DNA, 25 bp, Artificial sequence
  Synthetic oligonucleotide
ccgggtgatcgtcgactatcccatc

SEQ ID NO: 696622 - DNA, 25 bp, Artificial sequence
  Synthetic oligonucleotide
cgaataccgggtgatcgtcgactat

SEQ ID NO: 696623 - DNA, 25 bp, Artificial sequence
  Synthetic oligonucleotide
catcgacgaataccgggtgatcgtc

SEQ ID NO: 696624 - DNA, 25 bp, Artificial sequence
  Synthetic oligonucleotide
aatgacatcgacgaataccgggtga

SEQ ID NO: 696625 - DNA, 25 bp, Artificial sequence
  Synthetic oligonucleotide
gtggacaatgacatcgacgaatacc

SEQ ID NO: 696626 - DNA, 25 bp, Artificial sequence
  Synthetic oligonucleotide
agcgcggtggacaatgacatcgacg

SEQ ID NO: 696627 - DNA, 25 bp, Artificial sequence
  Synthetic oligonucleotide
ggctacagcgcggtggacaatgaca

SEQ ID NO: 696628 - DNA, 25 bp, Artificial sequence
  Synthetic oligonucleotide
tcccatcgacgtgttctgagccccg

SEQ ID NO: 696629 - DNA, 25 bp, Artificial sequence
  Synthetic oligonucleotide
aaggcggcgatataggccgaggtcg

SEQ ID NO: 696630 - DNA, 25 bp, Artificial sequence
  Synthetic oligonucleotide
cgacctccggcagcagccgcaactg

SEQ ID NO: 696631 - DNA, 25 bp, Artificial sequence
  Synthetic oligonucleotide
gcgccggtgacgctgtcgccggcct

SEQ ID NO: 696632 - DNA, 25 bp, Artificial sequence
  Synthetic oligonucleotide
agggcggcgccggtgacgctgtcgc

SEQ ID NO: 696633 - DNA, 25 bp, Artificial sequence
  Synthetic oligonucleotide
gctgtccagggcggcgccggtgacg

SEQ ID NO: 696634 - DNA, 25 bp, Artificial sequence
  Synthetic oligonucleotide
tagccgctgtccagggcggcgccgg

SEQ ID NO: 696635 - DNA, 25 bp, Artificial sequence
  Synthetic oligonucleotide
agtcgtagccgctgtccagggcggc

SEQ ID NO: 696636 - DNA, 25 bp, Artificial sequence
  Synthetic oligonucleotide
aggtcgagtcgtagccgctgtccag

SEQ ID NO: 696637 - DNA, 25 bp, Artificial sequence
  Synthetic oligonucleotide
gggctcagcgctggcggaacagttc

SEQ ID NO: 696638 - DNA, 25 bp, Artificial sequence
  Synthetic oligonucleotide
cgatataggccgaggtcgagtcgta

SEQ ID NO: 696639 - DNA, 25 bp, Artificial sequence
  Synthetic oligonucleotide
agcgctggcggaacagttcgccggg

SEQ ID NO: 696640 - DNA, 25 bp, Artificial sequence
  Synthetic oligonucleotide
cccttgaaggcggcgatataggccg

SEQ ID NO: 696641 - DNA, 25 bp, Artificial sequence
  Synthetic oligonucleotide
aagagtcccttgaaggcggcgatat

SEQ ID NO: 696642 - DNA, 25 bp, Artificial sequence
  Synthetic oligonucleotide
aagccgaagagtcccttgaaggcgg

SEQ ID NO: 696643 - DNA, 25 bp, Artificial sequence
  Synthetic oligonucleotide
ggagtgaagccgaagagtcccttga

SEQ ID NO: 696644 - DNA, 25 bp, Artificial sequence
  Synthetic oligonucleotide
tcgccgggagtgaagccgaagagtc

SEQ ID NO: 696645 - DNA, 25 bp, Artificial sequence
  Synthetic oligonucleotide
aacagttcgccgggagtgaagccga

SEQ ID NO: 696646 - DNA, 25 bp, Artificial sequence
  Synthetic oligonucleotide
ctgtcgccggcctccagcgcgttga

SEQ ID NO: 696647 - DNA, 25 bp, Artificial sequence
  Synthetic oligonucleotide
aggccgaggtcgagtcgtagccgct

SEQ ID NO: 696648 - DNA, 25 bp, Artificial sequence
  Synthetic oligonucleotide
tcggcggtatgtacgccgagcacgc

SEQ ID NO: 696649 - DNA, 25 bp, Artificial sequence
  Synthetic oligonucleotide
cagggagaaggcgacctccggcagc

SEQ ID NO: 696650 - DNA, 25 bp, Artificial sequence
  Synthetic oligonucleotide
aagctgtacccaggcgtgccggtgg

SEQ ID NO: 696651 - DNA, 25 bp, Artificial sequence
  Synthetic oligonucleotide
taggaaagctgtacccaggcgtgcc

SEQ ID NO: 696652 - DNA, 25 bp, Artificial sequence
  Synthetic oligonucleotide
atggcgtaggaaagctgtacccagg

SEQ ID NO: 696653 - DNA, 25 bp, Artificial sequence
  Synthetic oligonucleotide
ccgctgatggcgtaggaaagctgta

SEQ ID NO: 696654 - DNA, 25 bp, Artificial sequence
  Synthetic oligonucleotide
agcacgccgctgatggcgtaggaaa

SEQ ID NO: 696655 - DNA, 25 bp, Artificial sequence
  Synthetic oligonucleotide
cgtgccggtggcgcgaggtccaaga

SEQ ID NO: 696656 - DNA, 25 bp, Artificial sequence
  Synthetic oligonucleotide
gtatgtacgccgagcacgccgctga

SEQ ID NO: 696657 - DNA, 25 bp, Artificial sequence
  Synthetic oligonucleotide
ggtggcgcgaggtccaagagccggc

SEQ ID NO: 696658 - DNA, 25 bp, Artificial sequence
  Synthetic oligonucleotide
tgccctcggcggtatgtacgccgag

SEQ ID NO: 696659 - DNA, 25 bp, Artificial sequence
  Synthetic oligonucleotide
agaagctgccctcggcggtatgtac

SEQ ID NO: 696660 - DNA, 25 bp, Artificial sequence
  Synthetic oligonucleotide
gggcgaagaagctgccctcggcggt

SEQ ID NO: 696661 - DNA, 25 bp, Artificial sequence
  Synthetic oligonucleotide
tgcggcggggcgaagaagctgccct

SEQ ID NO: 696662 - DNA, 25 bp, Artificial sequence
  Synthetic oligonucleotide
gcccgctgcggcggggcgaagaagc

SEQ ID NO: 696663 - DNA, 25 bp, Artificial sequence
  Synthetic oligonucleotide
cagatcgcccgctgcggcggggcga

SEQ ID NO: 696664 - DNA, 25 bp, Artificial sequence
  Synthetic oligonucleotide
ggaatccagatcgcccgctgcggcg

SEQ ID NO: 696665 - DNA, 25 bp, Artificial sequence
  Synthetic oligonucleotide
acgccgagcacgccgctgatggcgt

SEQ ID NO: 696666 - DNA, 25 bp, Artificial sequence
  Synthetic oligonucleotide
tagaccggccgtggcaggcgggcga

SEQ ID NO: 696667 - DNA, 25 bp, Artificial sequence
  Synthetic oligonucleotide
ggcggggcggcgctgaagatccgcg

SEQ ID NO: 696668 - DNA, 25 bp, Artificial sequence
  Synthetic oligonucleotide
agttccgcaggctgtccgttcatcg

SEQ ID NO: 696669 - DNA, 25 bp, Artificial sequence
  Synthetic oligonucleotide
cggtgcagttccgcaggctgtccgt

SEQ ID NO: 696670 - DNA, 25 bp, Artificial sequence
  Synthetic oligonucleotide
aatcgggcggtgcagttccgcaggc

SEQ ID NO: 696671 - DNA, 25 bp, Artificial sequence
  Synthetic oligonucleotide
ggtgggaatcgggcggtgcagttcc

SEQ ID NO: 696672 - DNA, 25 bp, Artificial sequence
  Synthetic oligonucleotide
ggcgagggtgggaatcgggcggtgc

SEQ ID NO: 696673 - DNA, 25 bp, Artificial sequence
  Synthetic oligonucleotide
acccaggcgtgccggtggcgcgagg

SEQ ID NO: 696674 - DNA, 25 bp, Artificial sequence
  Synthetic oligonucleotide
cggccgtggcaggcgggcgagggtg

SEQ ID NO: 696675 - DNA, 25 bp, Artificial sequence
  Synthetic oligonucleotide
cgtgttccagttgcgccggaatcca

SEQ ID NO: 696676 - DNA, 25 bp, Artificial sequence
  Synthetic oligonucleotide
gcgcgtagaccggccgtggcaggcg

SEQ ID NO: 696677 - DNA, 25 bp, Artificial sequence
  Synthetic oligonucleotide
tcggcgcgcgcgtagaccggccgtg

SEQ ID NO: 696678 - DNA, 25 bp, Artificial sequence
  Synthetic oligonucleotide
aggctttcggcgcgcgcgtagaccg

SEQ ID NO: 696679 - DNA, 25 bp, Artificial sequence
  Synthetic oligonucleotide
gcgcgcaggctttcggcgcgcgcgt

SEQ ID NO: 696680 - DNA, 25 bp, Artificial sequence
  Synthetic oligonucleotide
gagccggcgcgcaggctttcggcgc

SEQ ID NO: 696681 - DNA, 25 bp, Artificial sequence
  Synthetic oligonucleotide
gtccaagagccggcgcgcaggcttt

SEQ ID NO: 696682 - DNA, 25 bp, Artificial sequence
  Synthetic oligonucleotide
gcgaggtccaagagccggcgcgcag

SEQ ID NO: 696683 - DNA, 25 bp, Artificial sequence
  Synthetic oligonucleotide
tggcaggcgggcgagggtgggaatc

SEQ ID NO: 696684 - DNA, 25 bp, Artificial sequence
  Synthetic oligonucleotide
cgcgattcggcgctgtcgccctccg

SEQ ID NO: 696685 - DNA, 25 bp, Artificial sequence
  Synthetic oligonucleotide
gctcgcgcgccagcggcgtcacctc

SEQ ID NO: 696686 - DNA, 25 bp, Artificial sequence
  Synthetic oligonucleotide
tgatcagctcgcgcgccagcggcgt

SEQ ID NO: 696687 - DNA, 25 bp, Artificial sequence
  Synthetic oligonucleotide
actcttgatcagctcgcgcgccagc

SEQ ID NO: 696688 - DNA, 25 bp, Artificial sequence
  Synthetic oligonucleotide
cagaaactcttgatcagctcgcgcg

SEQ ID NO: 696689 - DNA, 25 bp, Artificial sequence
  Synthetic oligonucleotide
accggcaactcgcagaaactcttga

SEQ ID NO: 696690 - DNA, 25 bp, Artificial sequence
  Synthetic oligonucleotide
ctccgggtagtccaccggcaactcg

SEQ ID NO: 696691 - DNA, 25 bp, Artificial sequence
  Synthetic oligonucleotide
gcgccggaatccagatcgcccgctg

SEQ ID NO: 696692 - DNA, 25 bp, Artificial sequence
  Synthetic oligonucleotide
tcggcgctgtcgccctccgggtagt

SEQ ID NO: 696693 - DNA, 25 bp, Artificial sequence
  Synthetic oligonucleotide
tcacctccagcacccggcaacgcgt

SEQ ID NO: 696694 - DNA, 25 bp, Artificial sequence
  Synthetic oligonucleotide
accagccgcgattcggcgctgtcgc

SEQ ID NO: 696695 - DNA, 25 bp, Artificial sequence
  Synthetic oligonucleotide
acctgcaccagccgcgattcggcgc

SEQ ID NO: 696696 - DNA, 25 bp, Artificial sequence
  Synthetic oligonucleotide
agcagcacctgcaccagccgcgatt

SEQ ID NO: 696697 - DNA, 25 bp, Artificial sequence
  Synthetic oligonucleotide
tggtccagcagcacctgcaccagcc

SEQ ID NO: 696698 - DNA, 25 bp, Artificial sequence
  Synthetic oligonucleotide
cgcaactggtccagcagcacctgca

SEQ ID NO: 696699 - DNA, 25 bp, Artificial sequence
  Synthetic oligonucleotide
agcagccgcaactggtccagcagca

SEQ ID NO: 696700 - DNA, 25 bp, Artificial sequence
  Synthetic oligonucleotide
tccggcagcagccgcaactggtcca

SEQ ID NO: 696701 - DNA, 25 bp, Artificial sequence
  Synthetic oligonucleotide
ctgtcgccctccgggtagtccaccg

SEQ ID NO: 696702 - DNA, 25 bp, Artificial sequence
  Synthetic oligonucleotide
gcgtcgccacggatgtacaggctgc

SEQ ID NO: 696703 - DNA, 25 bp, Artificial sequence
  Synthetic oligonucleotide
gtagtccaccggcaactcgcagaaa

SEQ ID NO: 696704 - DNA, 25 bp, Artificial sequence
  Synthetic oligonucleotide
cacctcgtgttccagttgcgccgga

SEQ ID NO: 696705 - DNA, 25 bp, Artificial sequence
  Synthetic oligonucleotide
ggtgaccacctcgtgttccagttgc

SEQ ID NO: 696706 - DNA, 25 bp, Artificial sequence
  Synthetic oligonucleotide
ggtggaggtgaccacctcgtgttcc

SEQ ID NO: 696707 - DNA, 25 bp, Artificial sequence
  Synthetic oligonucleotide
cggcgcgggtggaggtgaccacctc

SEQ ID NO: 696708 - DNA, 25 bp, Artificial sequence
  Synthetic oligonucleotide
gcatctcggcgcgggtggaggtgac

SEQ ID NO: 696709 - DNA, 25 bp, Artificial sequence
  Synthetic oligonucleotide
aggctgcgcatctcggcgcgggtgg

SEQ ID NO: 696710 - DNA, 25 bp, Artificial sequence
  Synthetic oligonucleotide
gcgccagcggcgtcacctccagcac

SEQ ID NO: 696711 - DNA, 25 bp, Artificial sequence
  Synthetic oligonucleotide
ccacggatgtacaggctgcgcatct

SEQ ID NO: 696712 - DNA, 25 bp, Artificial sequence
  Synthetic oligonucleotide
gcggcgtcacctccagcacccggca

SEQ ID NO: 696713 - DNA, 25 bp, Artificial sequence
  Synthetic oligonucleotide
gcgcaggcgtcgccacggatgtaca

SEQ ID NO: 696714 - DNA, 25 bp, Artificial sequence
  Synthetic oligonucleotide
gcccaggcgcaggcgtcgccacgga

SEQ ID NO: 696715 - DNA, 25 bp, Artificial sequence
  Synthetic oligonucleotide
gtcggcgcccaggcgcaggcgtcgc

SEQ ID NO: 696716 - DNA, 25 bp, Artificial sequence
  Synthetic oligonucleotide
aacgcgtcggcgcccaggcgcaggc

SEQ ID NO: 696717 - DNA, 25 bp, Artificial sequence
  Synthetic oligonucleotide
cccggcaacgcgtcggcgcccaggc

SEQ ID NO: 696718 - DNA, 25 bp, Artificial sequence
  Synthetic oligonucleotide
ccagcacccggcaacgcgtcggcgc

SEQ ID NO: 696719 - DNA, 25 bp, Artificial sequence
  Synthetic oligonucleotide
ccagttgcgccggaatccagatcgc

SEQ ID NO: 696720 - DNA, 25 bp, Artificial sequence
  Synthetic oligonucleotide
atgtacaggctgcgcatctcggcgc

SEQ ID NO: 696721 - DNA, 25 bp, Artificial sequence
  Synthetic oligonucleotide
tgggcggcacctggggcggcatcga

SEQ ID NO: 696722 - DNA, 25 bp, Artificial sequence
  Synthetic oligonucleotide
agcggcgactcgttgctcggccgga

SEQ ID NO: 696723 - DNA, 25 bp, Artificial sequence
  Synthetic oligonucleotide
tgtacgccgccgaactgcagaacgt

SEQ ID NO: 696724 - DNA, 25 bp, Artificial sequence
  Synthetic oligonucleotide
gcagcctgtacgccgccgaactgca

SEQ ID NO: 696725 - DNA, 25 bp, Artificial sequence
  Synthetic oligonucleotide
tcaccagcagcctgtacgccgccga

SEQ ID NO: 696726 - DNA, 25 bp, Artificial sequence
  Synthetic oligonucleotide
gggcttcaccagcagcctgtacgcc

SEQ ID NO: 696727 - DNA, 25 bp, Artificial sequence
  Synthetic oligonucleotide
catcgagggcttcaccagcagcctg

SEQ ID NO: 696728 - DNA, 25 bp, Artificial sequence
  Synthetic oligonucleotide
aactgcagaacgtctggaagcagta

SEQ ID NO: 696729 - DNA, 25 bp, Artificial sequence
  Synthetic oligonucleotide
gcacctggggcggcatcgagggctt

SEQ ID NO: 696730 - DNA, 25 bp, Artificial sequence
  Synthetic oligonucleotide
agaacgtctggaagcagtactacgc

SEQ ID NO: 696731 - DNA, 25 bp, Artificial sequence
  Synthetic oligonucleotide
ctggctgggcggcacctggggcggc

SEQ ID NO: 696732 - DNA, 25 bp, Artificial sequence
  Synthetic oligonucleotide
tctcagctggctgggcggcacctgg

SEQ ID NO: 696733 - DNA, 25 bp, Artificial sequence
  Synthetic oligonucleotide
catcatctcagctggctgggcggca

SEQ ID NO: 696734 - DNA, 25 bp, Artificial sequence
  Synthetic oligonucleotide
gacagccatcatctcagctggctgg

SEQ ID NO: 696735 - DNA, 25 bp, Artificial sequence
  Synthetic oligonucleotide
gaccgcgacagccatcatctcagct

SEQ ID NO: 696736 - DNA, 25 bp, Artificial sequence
  Synthetic oligonucleotide
gccgggcgaccgcgacagccatcat

SEQ ID NO: 696737 - DNA, 25 bp, Artificial sequence
  Synthetic oligonucleotide
cgaactgccgggcgaccgcgacagc

SEQ ID NO: 696738 - DNA, 25 bp, Artificial sequence
  Synthetic oligonucleotide
gggcggcatcgagggcttcaccagc

SEQ ID NO: 696739 - DNA, 25 bp, Artificial sequence
  Synthetic oligonucleotide
tcgacgacaactggtcgctgaaccc

SEQ ID NO: 696740 - DNA, 25 bp, Artificial sequence
  Synthetic oligonucleotide
gtcgacagcggcgactcgttgctcg

SEQ ID NO: 696741 - DNA, 25 bp, Artificial sequence
  Synthetic oligonucleotide
aagaccgtcgacagcggcgactcgt

SEQ ID NO: 696742 - DNA, 25 bp, Artificial sequence
  Synthetic oligonucleotide
tactacaagaccgtcgacagcggcg

SEQ ID NO: 696743 - DNA, 25 bp, Artificial sequence
  Synthetic oligonucleotide
gcgcactactacaagaccgtcgaca

SEQ ID NO: 696744 - DNA, 25 bp, Artificial sequence
  Synthetic oligonucleotide
cccggcgcgcactactacaagaccg

SEQ ID NO: 696745 - DNA, 25 bp, Artificial sequence
  Synthetic oligonucleotide
ctgaaccccggcgcgcactactaca

SEQ ID NO: 696746 - DNA, 25 bp, Artificial sequence
  Synthetic oligonucleotide
ccgccgaactgcagaacgtctggaa

SEQ ID NO: 696747 - DNA, 25 bp, Artificial sequence
  Synthetic oligonucleotide
gacaactggtcgctgaaccccggcg

SEQ ID NO: 696748 - DNA, 25 bp, Artificial sequence
  Synthetic oligonucleotide
gcctcggctcgtactacggcgaact

SEQ ID NO: 696749 - DNA, 25 bp, Artificial sequence
  Synthetic oligonucleotide
acgagatcgacgacaactggtcgct

SEQ ID NO: 696750 - DNA, 25 bp, Artificial sequence
  Synthetic oligonucleotide
acacctacgagatcgacgacaactg

SEQ ID NO: 696751 - DNA, 25 bp, Artificial sequence
  Synthetic oligonucleotide
tcgactacacctacgagatcgacga

SEQ ID NO: 696752 - DNA, 25 bp, Artificial sequence
  Synthetic oligonucleotide
ccgacgtcgactacacctacgagat

SEQ ID NO: 696753 - DNA, 25 bp, Artificial sequence
  Synthetic oligonucleotide
actacgccgacgtcgactacaccta

SEQ ID NO: 696754 - DNA, 25 bp, Artificial sequence
  Synthetic oligonucleotide
agcagtactacgccgacgtcgacta

SEQ ID NO: 696755 - DNA, 25 bp, Artificial sequence
  Synthetic oligonucleotide
tctggaagcagtactacgccgacgt

SEQ ID NO: 696756 - DNA, 25 bp, Artificial sequence
  Synthetic oligonucleotide
tggtcgctgaaccccggcgcgcact

SEQ ID NO: 696757 - DNA, 25 bp, Artificial sequence
  Synthetic oligonucleotide
agctgaagctgggcgaccagttcct

SEQ ID NO: 696758 - DNA, 25 bp, Artificial sequence
  Synthetic oligonucleotide
gcgagtcgcgcatgctgccgcagac

SEQ ID NO: 696759 - DNA, 25 bp, Artificial sequence
  Synthetic oligonucleotide
ccggcggcgagtcgcgcatgctgcc

SEQ ID NO: 696760 - DNA, 25 bp, Artificial sequence
  Synthetic oligonucleotide
tggtcgccggcggcgagtcgcgcat

SEQ ID NO: 696761 - DNA, 25 bp, Artificial sequence
  Synthetic oligonucleotide
cccggtggtcgccggcggcgagtcg

SEQ ID NO: 696762 - DNA, 25 bp, Artificial sequence
  Synthetic oligonucleotide
tcagcaacccggtggtcgccggcgg

SEQ ID NO: 696763 - DNA, 25 bp, Artificial sequence
  Synthetic oligonucleotide
agttcctcagcaacccggtggtcgc

SEQ ID NO: 696764 - DNA, 25 bp, Artificial sequence
  Synthetic oligonucleotide
actacggcgaactgccgggcgaccg

SEQ ID NO: 696765 - DNA, 25 bp, Artificial sequence
  Synthetic oligonucleotide
agctgggcgaccagttcctcagcaa

SEQ ID NO: 696766 - DNA, 25 bp, Artificial sequence
  Synthetic oligonucleotide
cgcagaccttccgcggtgtgagcct

SEQ ID NO: 696767 - DNA, 25 bp, Artificial sequence
  Synthetic oligonucleotide
acaccgagctgaagctgggcgacca

SEQ ID NO: 696768 - DNA, 25 bp, Artificial sequence
  Synthetic oligonucleotide
ccttcgacaccgagctgaagctggg

SEQ ID NO: 696769 - DNA, 25 bp, Artificial sequence
  Synthetic oligonucleotide
tccgcgccttcgacaccgagctgaa

SEQ ID NO: 696770 - DNA, 25 bp, Artificial sequence
  Synthetic oligonucleotide
tgaagatccgcgccttcgacaccga

SEQ ID NO: 696771 - DNA, 25 bp, Artificial sequence
  Synthetic oligonucleotide
gcggcgctgaagatccgcgccttcg

SEQ ID NO: 696772 - DNA, 25 bp, Artificial sequence
  Synthetic oligonucleotide
cgcggcaccggcggctacagcgcgg

SEQ ID NO: 696773 - DNA, 25 bp, Artificial sequence
  Synthetic oligonucleotide
aactcgcagaaactcttgatcagct

SEQ ID NO: 696774 - DNA, 25 bp, Artificial sequence
  Synthetic oligonucleotide
gcgaccagttcctcagcaacccggt

SEQ ID NO: 696775 - DNA, 25 bp, Artificial sequence
  Synthetic oligonucleotide
gaggacctgaccctcacggctggcc

SEQ ID NO: 696776 - DNA, 25 bp, Artificial sequence
  Synthetic oligonucleotide
accagagtggccaccgtcgcctcgg

SEQ ID NO: 696777 - DNA, 25 bp, Artificial sequence
  Synthetic oligonucleotide
accgtcgcctcggctcgtactacgg

SEQ ID NO: 696778 - DNA, 25 bp, Artificial sequence
  Synthetic oligonucleotide
gtggccaccgtcgcctcggctcgta

SEQ ID NO: 696779 - DNA, 25 bp, Artificial sequence
  Synthetic oligonucleotide
actacaaccagagtggccaccgtcg

SEQ ID NO: 696780 - DNA, 25 bp, Artificial sequence
  Synthetic oligonucleotide
gtttcaccaagtactacaaccagag

SEQ ID NO: 696781 - DNA, 25 bp, Artificial sequence
  Synthetic oligonucleotide
aggtcagtttcaccaagtactacaa

SEQ ID NO: 696782 - DNA, 25 bp, Artificial sequence
  Synthetic oligonucleotide
ctggccaggtcagtttcaccaagta

SEQ ID NO: 696783 - DNA, 25 bp, Artificial sequence
  Synthetic oligonucleotide
cgcgcatgctgccgcagaccttccg

SEQ ID NO: 696784 - DNA, 25 bp, Artificial sequence
  Synthetic oligonucleotide
tgaccctcacggctggccaggtcag

SEQ ID NO: 696785 - DNA, 25 bp, Artificial sequence
  Synthetic oligonucleotide
tgctgccgcagaccttccgcggtgt

SEQ ID NO: 696786 - DNA, 25 bp, Artificial sequence
  Synthetic oligonucleotide
agtttcgaggacctgaccctcacgg

SEQ ID NO: 696787 - DNA, 25 bp, Artificial sequence
  Synthetic oligonucleotide
acaacagtttcgaggacctgaccct

SEQ ID NO: 696788 - DNA, 25 bp, Artificial sequence
  Synthetic oligonucleotide
tgaccaacaacagtttcgaggacct

SEQ ID NO: 696789 - DNA, 25 bp, Artificial sequence
  Synthetic oligonucleotide
tgagcctgaccaacaacagtttcga

SEQ ID NO: 696790 - DNA, 25 bp, Artificial sequence
  Synthetic oligonucleotide
gcggtgtgagcctgaccaacaacag

SEQ ID NO: 696791 - DNA, 25 bp, Artificial sequence
  Synthetic oligonucleotide
ccttccgcggtgtgagcctgaccaa

SEQ ID NO: 696792 - DNA, 25 bp, Artificial sequence
  Synthetic oligonucleotide
gctcgtactacggcgaactgccggg

SEQ ID NO: 696793 - DNA, 25 bp, Artificial sequence
  Synthetic oligonucleotide
tcacggctggccaggtcagtttcac

SEQ ID NO: 696794 - DNA, 25 bp, Artificial sequence
  Synthetic oligonucleotide
gcggcaagctggacctgacccgggt

SEQ ID NO: 696795 - DNA, 25 bp, Artificial sequence
  Synthetic oligonucleotide
ctggtacagcgccgacggcaagaac

SEQ ID NO: 696796 - DNA, 25 bp, Artificial sequence
  Synthetic oligonucleotide
cggcggctggtacagcgccgacggc

SEQ ID NO: 696797 - DNA, 25 bp, Artificial sequence
  Synthetic oligonucleotide
cggctacggcggctggtacagcgcc

SEQ ID NO: 696798 - DNA, 25 bp, Artificial sequence
  Synthetic oligonucleotide
acagccccggctacggcggctggta

SEQ ID NO: 696799 - DNA, 25 bp, Artificial sequence
  Synthetic oligonucleotide
gatccggacagccccggctacggcg

SEQ ID NO: 696800 - DNA, 25 bp, Artificial sequence
  Synthetic oligonucleotide
cgggtcgatccggacagccccggct

SEQ ID NO: 696801 - DNA, 25 bp, Artificial sequence
  Synthetic oligonucleotide
cgtcgccctcggcctacccggcctg

SEQ ID NO: 696802 - DNA, 25 bp, Artificial sequence
  Synthetic oligonucleotide
agctggacctgacccgggtcgatcc

SEQ ID NO: 696803 - DNA, 25 bp, Artificial sequence
  Synthetic oligonucleotide
aagcactgggaacgcgacctcgacc

SEQ ID NO: 696804 - DNA, 25 bp, Artificial sequence
  Synthetic oligonucleotide
actcgcgcggcaagctggacctgac

SEQ ID NO: 696805 - DNA, 25 bp, Artificial sequence
  Synthetic oligonucleotide
ctcgtactcgcgcggcaagctggac

SEQ ID NO: 696806 - DNA, 25 bp, Artificial sequence
  Synthetic oligonucleotide
ctcggcctcgtactcgcgcggcaag

SEQ ID NO: 696807 - DNA, 25 bp, Artificial sequence
  Synthetic oligonucleotide
gagcgcctcggcctcgtactcgcgc

SEQ ID NO: 696808 - DNA, 25 bp, Artificial sequence
  Synthetic oligonucleotide
cggcctgagcgcctcggcctcgtac

SEQ ID NO: 696809 - DNA, 25 bp, Artificial sequence
  Synthetic oligonucleotide
gcctacccggcctgagcgcctcggc

SEQ ID NO: 696810 - DNA, 25 bp, Artificial sequence
  Synthetic oligonucleotide
ccctcggcctacccggcctgagcgc

SEQ ID NO: 696811 - DNA, 25 bp, Artificial sequence
  Synthetic oligonucleotide
acctgacccgggtcgatccggacag

SEQ ID NO: 696812 - DNA, 25 bp, Artificial sequence
  Synthetic oligonucleotide
ggtccggccaaggacctctcgctgc

SEQ ID NO: 696813 - DNA, 25 bp, Artificial sequence
  Synthetic oligonucleotide
acccaccgcggcaccggcggctaca

SEQ ID NO: 696814 - DNA, 25 bp, Artificial sequence
  Synthetic oligonucleotide
tgggccacccaccgcggcaccggcg

SEQ ID NO: 696815 - DNA, 25 bp, Artificial sequence
  Synthetic oligonucleotide
ccaagtactacaaccagagtggcca

SEQ ID NO: 696816 - DNA, 25 bp, Artificial sequence
  Synthetic oligonucleotide
gactcgttgctcggccggatcgaca

SEQ ID NO: 696817 - DNA, 25 bp, Artificial sequence
  Synthetic oligonucleotide
tgcgctgggccacccaccgcggcac

SEQ ID NO: 696818 - DNA, 25 bp, Artificial sequence
  Synthetic oligonucleotide
tgcgcctgcgctgggccacccaccg

SEQ ID NO: 696819 - DNA, 25 bp, Artificial sequence
  Synthetic oligonucleotide
ctcgctgcgcctgcgctgggccacc

SEQ ID NO: 696820 - DNA, 25 bp, Artificial sequence
  Synthetic oligonucleotide
cgacggcaagaacgccaagcactgg

SEQ ID NO: 696821 - DNA, 25 bp, Artificial sequence
  Synthetic oligonucleotide
gccaaggacctctcgctgcgcctgc

SEQ ID NO: 696822 - DNA, 25 bp, Artificial sequence
  Synthetic oligonucleotide
acgccaagcactgggaacgcgacct

SEQ ID NO: 696823 - DNA, 25 bp, Artificial sequence
  Synthetic oligonucleotide
cagggcggtccggccaaggacctct

SEQ ID NO: 696824 - DNA, 25 bp, Artificial sequence
  Synthetic oligonucleotide
tacgtggtccagggcggtccggcca

SEQ ID NO: 696825 - DNA, 25 bp, Artificial sequence
  Synthetic oligonucleotide
ctgcagtacgtggtccagggcggtc

SEQ ID NO: 696826 - DNA, 25 bp, Artificial sequence
  Synthetic oligonucleotide
ctcgacctgcagtacgtggtccagg

SEQ ID NO: 696827 - DNA, 25 bp, Artificial sequence
  Synthetic oligonucleotide
cgcgacctcgacctgcagtacgtgg

SEQ ID NO: 696828 - DNA, 25 bp, Artificial sequence
  Synthetic oligonucleotide
tgggaacgcgacctcgacctgcagt

SEQ ID NO: 696829 - DNA, 25 bp, Artificial sequence
  Synthetic oligonucleotide
cagcgccgacggcaagaacgccaag

SEQ ID NO: 696830 - DNA, 25 bp, Artificial sequence
  Synthetic oligonucleotide
ggacctctcgctgcgcctgcgctgg

SEQ ID NO: 696831 - DNA, 25 bp, Artificial sequence
  Synthetic oligonucleotide
catttcgcggtcggctacaggcagc

SEQ ID NO: 696832 - DNA, 25 bp, Artificial sequence
  Synthetic oligonucleotide
acggcaacacgccgttcgactacat

SEQ ID NO: 696833 - DNA, 25 bp, Artificial sequence
  Synthetic oligonucleotide
aggtcaacggcaacacgccgttcga

SEQ ID NO: 696834 - DNA, 25 bp, Artificial sequence
  Synthetic oligonucleotide
tgcagaaggtcaacggcaacacgcc

SEQ ID NO: 696835 - DNA, 25 bp, Artificial sequence
  Synthetic oligonucleotide
cggtgctgcagaaggtcaacggcaa

SEQ ID NO: 696836 - DNA, 25 bp, Artificial sequence
  Synthetic oligonucleotide
ttgctcggccggatcgacaacaaca

SEQ ID NO: 696837 - DNA, 25 bp, Artificial sequence
  Synthetic oligonucleotide
cacaccgtcaccgcggtgctgcaga

SEQ ID NO: 696838 - DNA, 25 bp, Artificial sequence
  Synthetic oligonucleotide
aggcagcacaccgtcaccgcggtgc

SEQ ID NO: 696839 - DNA, 25 bp, Artificial sequence
  Synthetic oligonucleotide
tcaccgcggtgctgcagaaggtcaa

SEQ ID NO: 696840 - DNA, 25 bp, Artificial sequence
  Synthetic oligonucleotide
gcggtcggctacaggcagcacaccg

SEQ ID NO: 696841 - DNA, 25 bp, Artificial sequence
  Synthetic oligonucleotide
acacgccgttcgactacatcaacca

SEQ ID NO: 696842 - DNA, 25 bp, Artificial sequence
  Synthetic oligonucleotide
agcctgcatttcgcggtcggctaca

SEQ ID NO: 696843 - DNA, 25 bp, Artificial sequence
  Synthetic oligonucleotide
acctacagcctgcatttcgcggtcg

SEQ ID NO: 696844 - DNA, 25 bp, Artificial sequence
  Synthetic oligonucleotide
ggccggatcgacaacaacacctaca

SEQ ID NO: 696845 - DNA, 25 bp, Artificial sequence
  Synthetic oligonucleotide
tacgacttcgtcgccctcggcctac

SEQ ID NO: 696846 - DNA, 25 bp, Artificial sequence
  Synthetic oligonucleotide
caagaacgccaagcactgggaacgc

SEQ ID NO: 696847 - DNA, 25 bp, Artificial sequence
  Synthetic oligonucleotide
aacaacacctacagcctgcatttcg

SEQ ID NO: 696848 - DNA, 25 bp, Artificial sequence
  Synthetic oligonucleotide
gatcgacaacaacacctacagcctg

SEQ ID NO: 696849 - DNA, 25 bp, Artificial sequence
  Synthetic oligonucleotide
ggctacaggcagcacaccgtcaccg

SEQ ID NO: 696850 - DNA, 25 bp, Artificial sequence
  Synthetic oligonucleotide
agcagtattccgacttcaacggtcc

SEQ ID NO: 696851 - DNA, 25 bp, Artificial sequence
  Synthetic oligonucleotide
acgactacgacttcgtcgccctcgg

SEQ ID NO: 696852 - DNA, 25 bp, Artificial sequence
  Synthetic oligonucleotide
tgcaatacgactacgacttcgtcgc

SEQ ID NO: 696853 - DNA, 25 bp, Artificial sequence
  Synthetic oligonucleotide
ggaagctgcaatacgactacgactt

SEQ ID NO: 696854 - DNA, 25 bp, Artificial sequence
  Synthetic oligonucleotide
agtcctggaagctgcaatacgacta

SEQ ID NO: 696855 - DNA, 25 bp, Artificial sequence
  Synthetic oligonucleotide
acgagaagtcctggaagctgcaata

SEQ ID NO: 696856 - DNA, 25 bp, Artificial sequence
  Synthetic oligonucleotide
gtcccaacgagaagtcctggaagct

SEQ ID NO: 696857 - DNA, 25 bp, Artificial sequence
  Synthetic oligonucleotide
tccgacttcaacggtcccaacgaga

SEQ ID NO: 696858 - DNA, 25 bp, Artificial sequence
  Synthetic oligonucleotide
cgttcgactacatcaaccagggcga

SEQ ID NO: 696859 - DNA, 25 bp, Artificial sequence
  Synthetic oligonucleotide
actcgcagcagtattccgacttcaa

SEQ ID NO: 696860 - DNA, 25 bp, Artificial sequence
  Synthetic oligonucleotide
agggcgacagcatcttcctcgacaa

SEQ ID NO: 696861 - DNA, 25 bp, Artificial sequence
  Synthetic oligonucleotide
tcgacaactcgcagcagtattccga

SEQ ID NO: 696862 - DNA, 25 bp, Artificial sequence
  Synthetic oligonucleotide
tcttcctcgacaactcgcagcagta

SEQ ID NO: 696863 - DNA, 25 bp, Artificial sequence
  Synthetic oligonucleotide
acagcatcttcctcgacaactcgca

SEQ ID NO: 696864 - DNA, 25 bp, Artificial sequence
  Synthetic oligonucleotide
actacatcaaccagggcgacagcat

SEQ ID NO: 696865 - DNA, 25 bp, Artificial sequence
  Synthetic oligonucleotide
tcaaccagggcgacagcatcttcct

SEQ ID NO: 696866 - DNA, 25 bp, Artificial sequence
  Synthetic oligonucleotide
tcaacggtcccaacgagaagtcctg

SEQ ID NO: 696867 - DNA, 25 bp, Artificial sequence
  Synthetic oligonucleotide
cagcgcaacccggacatgctcgagg

SEQ ID NO: 696868 - DNA, 25 bp, Artificial sequence
  Synthetic oligonucleotide
cctgtcccagcgcaacccggacatg

SEQ ID NO: 696869 - DNA, 25 bp, Artificial sequence
  Synthetic oligonucleotide
agctgaccctgtcccagcgcaaccc

SEQ ID NO: 696870 - DNA, 25 bp, Artificial sequence
  Synthetic oligonucleotide
tgatcgagctgaccctgtcccagcg

SEQ ID NO: 696871 - DNA, 25 bp, Artificial sequence
  Synthetic oligonucleotide
acgtggtgatcgagctgaccctgtc

SEQ ID NO: 696872 - DNA, 25 bp, Artificial sequence
  Synthetic oligonucleotide
tgatcgcccgctacggcgcactgtt

SEQ ID NO: 696873 - DNA, 25 bp, Artificial sequence
  Synthetic oligonucleotide
tccccgacgtggtgatcgagctgac

SEQ ID NO: 696874 - DNA, 25 bp, Artificial sequence
  Synthetic oligonucleotide
cccgctacggcgcactgttccccga

SEQ ID NO: 696875 - DNA, 25 bp, Artificial sequence
  Synthetic oligonucleotide
cactgttccccgacgtggtgatcga

SEQ ID NO: 696876 - DNA, 25 bp, Artificial sequence
  Synthetic oligonucleotide
acggcgcactgttccccgacgtggt

SEQ ID NO: 696877 - DNA, 25 bp, Artificial sequence
  Synthetic oligonucleotide
aacccggacatgctcgaggaaggcc

SEQ ID NO: 696878 - DNA, 25 bp, Artificial sequence
  Synthetic oligonucleotide
ctgggcagcatccacagcgtgctct

SEQ ID NO: 696879 - DNA, 25 bp, Artificial sequence
  Synthetic oligonucleotide
gacatgctcgaggaaggccaggatg

SEQ ID NO: 696880 - DNA, 25 bp, Artificial sequence
  Synthetic oligonucleotide
ctcgaggaaggccaggatgtgctga

SEQ ID NO: 696881 - DNA, 25 bp, Artificial sequence
  Synthetic oligonucleotide
gaaggccaggatgtgctgatcaccg

SEQ ID NO: 696882 - DNA, 25 bp, Artificial sequence
  Synthetic oligonucleotide
cagcgcctgggcagcatccacagcg

SEQ ID NO: 696883 - DNA, 25 bp, Artificial sequence
  Synthetic oligonucleotide
caggatgtgctgatcaccggcgagc

SEQ ID NO: 696884 - DNA, 25 bp, Artificial sequence
  Synthetic oligonucleotide
gtgctgatcaccggcgagcgccagt

SEQ ID NO: 696885 - DNA, 25 bp, Artificial sequence
  Synthetic oligonucleotide
atcaccggcgagcgccagttgcccg

SEQ ID NO: 696886 - DNA, 25 bp, Artificial sequence
  Synthetic oligonucleotide
gtcgcccagcgcctgggcagcatcc

SEQ ID NO: 696887 - DNA, 25 bp, Artificial sequence
  Synthetic oligonucleotide
tgcccgactcggagttcgtcgccca

SEQ ID NO: 696888 - DNA, 25 bp, Artificial sequence
  Synthetic oligonucleotide
gccagttgcccgactcggagttcgt

SEQ ID NO: 696889 - DNA, 25 bp, Artificial sequence
  Synthetic oligonucleotide
gagttcgtcgcccagcgcctgggca

SEQ ID NO: 696890 - DNA, 25 bp, Artificial sequence
  Synthetic oligonucleotide
tgccgatgatcgcccgctacggcgc

SEQ ID NO: 696891 - DNA, 25 bp, Artificial sequence
  Synthetic oligonucleotide
gactcggagttcgtcgcccagcgcc

SEQ ID NO: 696892 - DNA, 25 bp, Artificial sequence
  Synthetic oligonucleotide
gcgagcgccagttgcccgactcgga

SEQ ID NO: 696893 - DNA, 25 bp, Artificial sequence
  Synthetic oligonucleotide
ccgaagccgccggcgcgcacatccg

SEQ ID NO: 696894 - DNA, 25 bp, Artificial sequence
  Synthetic oligonucleotide
ccggcgagcgttacctggaacggtg

SEQ ID NO: 696895 - DNA, 25 bp, Artificial sequence
  Synthetic oligonucleotide
ccgaagccggcgagcgttacctgga

SEQ ID NO: 696896 - DNA, 25 bp, Artificial sequence
  Synthetic oligonucleotide
agcgttacctggaacggtgccgcgg

SEQ ID NO: 696897 - DNA, 25 bp, Artificial sequence
  Synthetic oligonucleotide
acctggaacggtgccgcgggatcct

SEQ ID NO: 696898 - DNA, 25 bp, Artificial sequence
  Synthetic oligonucleotide
tacgggtgttgcccggccatgccat

SEQ ID NO: 696899 - DNA, 25 bp, Artificial sequence
  Synthetic oligonucleotide
agcatccacagcgtgctctgcgcca

SEQ ID NO: 696900 - DNA, 25 bp, Artificial sequence
  Synthetic oligonucleotide
aacggtgccgcgggatcctcgagga

SEQ ID NO: 696901 - DNA, 25 bp, Artificial sequence
  Synthetic oligonucleotide
gccgcgggatcctcgaggacatcga

SEQ ID NO: 696902 - DNA, 25 bp, Artificial sequence
  Synthetic oligonucleotide
tcgaggacatcgaggtcgccgaggc

SEQ ID NO: 696903 - DNA, 25 bp, Artificial sequence
  Synthetic oligonucleotide
acatcgaggtcgccgaggccgaagc

SEQ ID NO: 696904 - DNA, 25 bp, Artificial sequence
  Synthetic oligonucleotide
aggtcgccgaggccgaagccgccgg

SEQ ID NO: 696905 - DNA, 25 bp, Artificial sequence
  Synthetic oligonucleotide
ggatcctcgaggacatcgaggtcgc

SEQ ID NO: 696906 - DNA, 25 bp, Artificial sequence
  Synthetic oligonucleotide
cctgaccgaagccggcgagcgttac

SEQ ID NO: 696907 - DNA, 25 bp, Artificial sequence
  Synthetic oligonucleotide
acctggtgccgatgatcgcccgcta

SEQ ID NO: 696908 - DNA, 25 bp, Artificial sequence
  Synthetic oligonucleotide
ccgccggcgcgcacatccgcccctg

SEQ ID NO: 696909 - DNA, 25 bp, Artificial sequence
  Synthetic oligonucleotide
ggcgcgcacatccgcccctgcggcc

SEQ ID NO: 696910 - DNA, 25 bp, Artificial sequence
  Synthetic oligonucleotide
cacatccgcccctgcggccgcttgc

SEQ ID NO: 696911 - DNA, 25 bp, Artificial sequence
  Synthetic oligonucleotide
gcccctgcggccgcttgcgcgtgca

SEQ ID NO: 696912 - DNA, 25 bp, Artificial sequence
  Synthetic oligonucleotide
cggccgcttgcgcgtgcagtcgctg

SEQ ID NO: 696913 - DNA, 25 bp, Artificial sequence
  Synthetic oligonucleotide
cttgcgcgtgcagtcgctgatgggc

SEQ ID NO: 696914 - DNA, 25 bp, Artificial sequence
  Synthetic oligonucleotide
cgtgcagtcgctgatgggcatgggc

SEQ ID NO: 696915 - DNA, 25 bp, Artificial sequence
  Synthetic oligonucleotide
gcctggccctgaccgaagccggcga

SEQ ID NO: 696916 - DNA, 25 bp, Artificial sequence
  Synthetic oligonucleotide
tcgctgatgggcatgggccagcatc

SEQ ID NO: 696917 - DNA, 25 bp, Artificial sequence
  Synthetic oligonucleotide
tgggcatgggccagcatcacctggt

SEQ ID NO: 696918 - DNA, 25 bp, Artificial sequence
  Synthetic oligonucleotide
tgggccagcatcacctggtgccgat

SEQ ID NO: 696919 - DNA, 25 bp, Artificial sequence
  Synthetic oligonucleotide
agcatcacctggtgccgatgatcgc

SEQ ID NO: 696920 - DNA, 25 bp, Artificial sequence
  Synthetic oligonucleotide
ccgaggccgaagccgccggcgcgca

SEQ ID NO: 696921 - DNA, 25 bp, Artificial sequence
  Synthetic oligonucleotide
cgcggcgctgcgcaacggcgagctg

SEQ ID NO: 696922 - DNA, 25 bp, Artificial sequence
  Synthetic oligonucleotide
tatgcgctgtatccctcgcggcgtt

SEQ ID NO: 696923 - DNA, 25 bp, Artificial sequence
  Synthetic oligonucleotide
atgtcgccgaggtcatggcccaggc

SEQ ID NO: 696924 - DNA, 25 bp, Artificial sequence
  Synthetic oligonucleotide
ccgaggtcatggcccaggcggccaa

SEQ ID NO: 696925 - DNA, 25 bp, Artificial sequence
  Synthetic oligonucleotide
tcatggcccaggcggccaaggccga

SEQ ID NO: 696926 - DNA, 25 bp, Artificial sequence
  Synthetic oligonucleotide
cccaggcggccaaggccgacctcgg

SEQ ID NO: 696927 - DNA, 25 bp, Artificial sequence
  Synthetic oligonucleotide
cggccaaggccgacctcggcatcgc

SEQ ID NO: 696928 - DNA, 25 bp, Artificial sequence
  Synthetic oligonucleotide
ggccgacctcggcatcgccctgctg

SEQ ID NO: 696929 - DNA, 25 bp, Artificial sequence
  Synthetic oligonucleotide
ctcggcatcgccctgctgcccagct

SEQ ID NO: 696930 - DNA, 25 bp, Artificial sequence
  Synthetic oligonucleotide
atcgccctgctgcccagctacgtgg

SEQ ID NO: 696931 - DNA, 25 bp, Artificial sequence
  Synthetic oligonucleotide
ctgctgcccagctacgtggcggccg

SEQ ID NO: 696932 - DNA, 25 bp, Artificial sequence
  Synthetic oligonucleotide
gcccagctacgtggcggccgcggcg

SEQ ID NO: 696933 - DNA, 25 bp, Artificial sequence
  Synthetic oligonucleotide
ccttcatggtcaatgtcgccgaggt

SEQ ID NO: 696934 - DNA, 25 bp, Artificial sequence
  Synthetic oligonucleotide
tggcggccgcggcgctgcgcaacgg

SEQ ID NO: 696935 - DNA, 25 bp, Artificial sequence
  Synthetic oligonucleotide
agaacaccttcatggtcaatgtcgc

SEQ ID NO: 696936 - DNA, 25 bp, Artificial sequence
  Synthetic oligonucleotide
ctgcgcaacggcgagctgctacggg

SEQ ID NO: 696937 - DNA, 25 bp, Artificial sequence
  Synthetic oligonucleotide
aacggcgagctgctacgggtgttgc

SEQ ID NO: 696938 - DNA, 25 bp, Artificial sequence
  Synthetic oligonucleotide
agctgctacgggtgttgcccggcca

SEQ ID NO: 696939 - DNA, 25 bp, Artificial sequence
  Synthetic oligonucleotide
tgttgcccggccatgccatgcacca

SEQ ID NO: 696940 - DNA, 25 bp, Artificial sequence
  Synthetic oligonucleotide
ccatctatgcgctgtatccctcgcg

SEQ ID NO: 696941 - DNA, 25 bp, Artificial sequence
  Synthetic oligonucleotide
agcggaccatctatgcgctgtatcc

SEQ ID NO: 696942 - DNA, 25 bp, Artificial sequence
  Synthetic oligonucleotide
tgcaccagcggaccatctatgcgct

SEQ ID NO: 696943 - DNA, 25 bp, Artificial sequence
  Synthetic oligonucleotide
cccggcgcctggccctgaccgaagc

SEQ ID NO: 696944 - DNA, 25 bp, Artificial sequence
  Synthetic oligonucleotide
cgctgatcggcatcatcatccgcaa

SEQ ID NO: 696945 - DNA, 25 bp, Artificial sequence
  Synthetic oligonucleotide
ccggccatgccatgcaccagcggac

SEQ ID NO: 696946 - DNA, 25 bp, Artificial sequence
  Synthetic oligonucleotide
atgccatgcaccagcggaccatcta

SEQ ID NO: 696947 - DNA, 25 bp, Artificial sequence
  Synthetic oligonucleotide
gctacgtggcggccgcggcgctgcg

SEQ ID NO: 696948 - DNA, 25 bp, Artificial sequence
  Synthetic oligonucleotide
gcctgcgcctgcaggacccggccta

SEQ ID NO: 696949 - DNA, 25 bp, Artificial sequence
  Synthetic oligonucleotide
gtgctctgcgccagtcccggctacc

SEQ ID NO: 696950 - DNA, 25 bp, Artificial sequence
  Synthetic oligonucleotide
ctgcgccagtcccggctacctgcag

SEQ ID NO: 696951 - DNA, 25 bp, Artificial sequence
  Synthetic oligonucleotide
cagtcccggctacctgcagcagcac

SEQ ID NO: 696952 - DNA, 25 bp, Artificial sequence
  Synthetic oligonucleotide
cggctacctgcagcagcacggcgtg

SEQ ID NO: 696953 - DNA, 25 bp, Artificial sequence
  Synthetic oligonucleotide
cctgcagcagcacggcgtgccacgc

SEQ ID NO: 696954 - DNA, 25 bp, Artificial sequence
  Synthetic oligonucleotide
agcagcacggcgtgccacgctcggt

SEQ ID NO: 696955 - DNA, 25 bp, Artificial sequence
  Synthetic oligonucleotide
acggcgtgccacgctcggtggacga

SEQ ID NO: 696956 - DNA, 25 bp, Artificial sequence
  Synthetic oligonucleotide
tgccacgctcggtggacgacctgga

SEQ ID NO: 696957 - DNA, 25 bp, Artificial sequence
  Synthetic oligonucleotide
gctcggtggacgacctggagcgcca

SEQ ID NO: 696958 - DNA, 25 bp, Artificial sequence
  Synthetic oligonucleotide
tggacgacctggagcgccacgtctg

SEQ ID NO: 696959 - DNA, 25 bp, Artificial sequence
  Synthetic oligonucleotide
acctggagcgccacgtctgcctgcg

SEQ ID NO: 696960 - DNA, 25 bp, Artificial sequence
  Synthetic oligonucleotide
tggtcaatgtcgccgaggtcatggc

SEQ ID NO: 696961 - DNA, 25 bp, Artificial sequence
  Synthetic oligonucleotide
acgtctgcctgcgcctgcaggaccc

SEQ ID NO: 696962 - DNA, 25 bp, Artificial sequence
  Synthetic oligonucleotide
cacagcgtgctctgcgccagtcccg

SEQ ID NO: 696963 - DNA, 25 bp, Artificial sequence
  Synthetic oligonucleotide
gcctgcaggacccggcctacccgga

SEQ ID NO: 696964 - DNA, 25 bp, Artificial sequence
  Synthetic oligonucleotide
ccggcctacccggagggctggatct

SEQ ID NO: 696965 - DNA, 25 bp, Artificial sequence
  Synthetic oligonucleotide
tacccggagggctggatcttcgccg

SEQ ID NO: 696966 - DNA, 25 bp, Artificial sequence
  Synthetic oligonucleotide
agggctggatcttcgccgacgagca

SEQ ID NO: 696967 - DNA, 25 bp, Artificial sequence
  Synthetic oligonucleotide
ggatcttcgccgacgagcagggcga

SEQ ID NO: 696968 - DNA, 25 bp, Artificial sequence
  Synthetic oligonucleotide
tcgccgacgagcagggcgagcgcac

SEQ ID NO: 696969 - DNA, 25 bp, Artificial sequence
  Synthetic oligonucleotide
acgagcagggcgagcgcaccgtcag

SEQ ID NO: 696970 - DNA, 25 bp, Artificial sequence
  Synthetic oligonucleotide
agggcgagcgcaccgtcagcccgca

SEQ ID NO: 696971 - DNA, 25 bp, Artificial sequence
  Synthetic oligonucleotide
agcgcaccgtcagcccgcagaacac

SEQ ID NO: 696972 - DNA, 25 bp, Artificial sequence
  Synthetic oligonucleotide
ccgtcagcccgcagaacaccttcat

SEQ ID NO: 696973 - DNA, 25 bp, Artificial sequence
  Synthetic oligonucleotide
gcccgcagaacaccttcatggtcaa

SEQ ID NO: 696974 - DNA, 25 bp, Artificial sequence
  Synthetic oligonucleotide
agcgccacgtctgcctgcgcctgca

SEQ ID NO: 696975 - DNA, 25 bp, Artificial sequence
  Synthetic oligonucleotide
atcggcggcatcgtcgccgccacgc

SEQ ID NO: 696976 - DNA, 25 bp, Artificial sequence
  Synthetic oligonucleotide
tgctgacggcggcggcggccagcct

SEQ ID NO: 696977 - DNA, 25 bp, Artificial sequence
  Synthetic oligonucleotide
ggcggcggcggccagcctggggatg

SEQ ID NO: 696978 - DNA, 25 bp, Artificial sequence
  Synthetic oligonucleotide
ggcggccagcctggggatgatcccc

SEQ ID NO: 696979 - DNA, 25 bp, Artificial sequence
  Synthetic oligonucleotide
cagcctggggatgatccccatcgcc

SEQ ID NO: 696980 - DNA, 25 bp, Artificial sequence
  Synthetic oligonucleotide
gggatgatccccatcgcccgcgaag

SEQ ID NO: 696981 - DNA, 25 bp, Artificial sequence
  Synthetic oligonucleotide
atccccatcgcccgcgaagtgttct

SEQ ID NO: 696982 - DNA, 25 bp, Artificial sequence
  Synthetic oligonucleotide
atcgcccgcgaagtgttctgggggc

SEQ ID NO: 696983 - DNA, 25 bp, Artificial sequence
  Synthetic oligonucleotide
cgcgaagtgttctgggggccgatgg

SEQ ID NO: 696984 - DNA, 25 bp, Artificial sequence
  Synthetic oligonucleotide
gtgttctgggggccgatggcctatg

SEQ ID NO: 696985 - DNA, 25 bp, Artificial sequence
  Synthetic oligonucleotide
tgggggccgatggcctatgcgatga

SEQ ID NO: 696986 - DNA, 25 bp, Artificial sequence
  Synthetic oligonucleotide
ccgatggcctatgcgatgatcggcg

SEQ ID NO: 696987 - DNA, 25 bp, Artificial sequence
  Synthetic oligonucleotide
tcatcatccgcaactcggtgatcct

SEQ ID NO: 696988 - DNA, 25 bp, Artificial sequence
  Synthetic oligonucleotide
gcgatgatcggcggcatcgtcgccg

SEQ ID NO: 696989 - DNA, 25 bp, Artificial sequence
  Synthetic oligonucleotide
accgcacccggccgatcctgctgac

SEQ ID NO: 696990 - DNA, 25 bp, Artificial sequence
  Synthetic oligonucleotide
ggcatcgtcgccgccacgctgctca

SEQ ID NO: 696991 - DNA, 25 bp, Artificial sequence
  Synthetic oligonucleotide
gtcgccgccacgctgctcacgctga

SEQ ID NO: 696992 - DNA, 25 bp, Artificial sequence
  Synthetic oligonucleotide
gccacgctgctcacgctgatcttcc

SEQ ID NO: 696993 - DNA, 25 bp, Artificial sequence
  Synthetic oligonucleotide
ctgctcacgctgatcttcctgccgg

SEQ ID NO: 696994 - DNA, 25 bp, Artificial sequence
  Synthetic oligonucleotide
acgctgatcttcctgccggcgctgt

SEQ ID NO: 696995 - DNA, 25 bp, Artificial sequence
  Synthetic oligonucleotide
atcttcctgccggcgctgtacgtcg

SEQ ID NO: 696996 - DNA, 25 bp, Artificial sequence
  Synthetic oligonucleotide
ctgccggcgctgtacgtcgcctggt

SEQ ID NO: 696997 - DNA, 25 bp, Artificial sequence
  Synthetic oligonucleotide
gcgctgtacgtcgcctggtaccgga

SEQ ID NO: 696998 - DNA, 25 bp, Artificial sequence
  Synthetic oligonucleotide
cggattccggaaccgggacgctgag

SEQ ID NO: 696999 - DNA, 25 bp, Artificial sequence
  Synthetic oligonucleotide
ccggaaccgggacgctgagcgcggc

SEQ ID NO: 697000 - DNA, 25 bp, Artificial sequence
  Synthetic oligonucleotide
ccgggacgctgagcgcggcgtaagg

SEQ ID NO: 697001 - DNA, 25 bp, Artificial sequence
  Synthetic oligonucleotide
gcctatgcgatgatcggcggcatcg

SEQ ID NO: 697002 - DNA, 25 bp, Artificial sequence
  Synthetic oligonucleotide
tggtgacccagatcgatgccttcga

SEQ ID NO: 697003 - DNA, 25 bp, Artificial sequence
  Synthetic oligonucleotide
cgccgatgggcttcgtggcgatcct

SEQ ID NO: 697004 - DNA, 25 bp, Artificial sequence
  Synthetic oligonucleotide
ccggcacgccgatgggcttcgtggc

SEQ ID NO: 697005 - DNA, 25 bp, Artificial sequence
  Synthetic oligonucleotide
gggcttcgtggcgatcctcgggatt

SEQ ID NO: 697006 - DNA, 25 bp, Artificial sequence
  Synthetic oligonucleotide
tcgtggcgatcctcgggattctcgc

SEQ ID NO: 697007 - DNA, 25 bp, Artificial sequence
  Synthetic oligonucleotide
cagcatcctgccgatcacctcgccg

SEQ ID NO: 697008 - DNA, 25 bp, Artificial sequence
  Synthetic oligonucleotide
tgtatccctcgcggcgttacctgga

SEQ ID NO: 697009 - DNA, 25 bp, Artificial sequence
  Synthetic oligonucleotide
cgatcctcgggattctcgcgctgat

SEQ ID NO: 697010 - DNA, 25 bp, Artificial sequence
  Synthetic oligonucleotide
tcgggattctcgcgctgatcggcat

SEQ ID NO: 697011 - DNA, 25 bp, Artificial sequence
  Synthetic oligonucleotide
ttctcgcgctgatcggcatcatcat

SEQ ID NO: 697012 - DNA, 25 bp, Artificial sequence
  Synthetic oligonucleotide
tcggcatcatcatccgcaactcggt

SEQ ID NO: 697013 - DNA, 25 bp, Artificial sequence
  Synthetic oligonucleotide
tccgcaactcggtgatcctggtgac

SEQ ID NO: 697014 - DNA, 25 bp, Artificial sequence
  Synthetic oligonucleotide
cgatcctgctgacggcggcggcggc

SEQ ID NO: 697015 - DNA, 25 bp, Artificial sequence
  Synthetic oligonucleotide
tgatcctggtgacccagatcgatgc

SEQ ID NO: 697016 - DNA, 25 bp, Artificial sequence
  Synthetic oligonucleotide
ccggccgatcctgctgacggcggcg

SEQ ID NO: 697017 - DNA, 25 bp, Artificial sequence
  Synthetic oligonucleotide
ccagatcgatgccttcgagaaagac

SEQ ID NO: 697018 - DNA, 25 bp, Artificial sequence
  Synthetic oligonucleotide
cgatgccttcgagaaagacggcaag

SEQ ID NO: 697019 - DNA, 25 bp, Artificial sequence
  Synthetic oligonucleotide
cttcgagaaagacggcaagacgccc

SEQ ID NO: 697020 - DNA, 25 bp, Artificial sequence
  Synthetic oligonucleotide
gaaagacggcaagacgccctgggaa

SEQ ID NO: 697021 - DNA, 25 bp, Artificial sequence
  Synthetic oligonucleotide
cggcaagacgccctgggaagccgtg

SEQ ID NO: 697022 - DNA, 25 bp, Artificial sequence
  Synthetic oligonucleotide
gacgccctgggaagccgtgctggaa

SEQ ID NO: 697023 - DNA, 25 bp, Artificial sequence
  Synthetic oligonucleotide
ctgggaagccgtgctggaagccacc

SEQ ID NO: 697024 - DNA, 25 bp, Artificial sequence
  Synthetic oligonucleotide
gccgtgctggaagccacccaccacc

SEQ ID NO: 697025 - DNA, 25 bp, Artificial sequence
  Synthetic oligonucleotide
ctggaagccacccaccaccgcaccc

SEQ ID NO: 697026 - DNA, 25 bp, Artificial sequence
  Synthetic oligonucleotide
agccacccaccaccgcacccggccg

SEQ ID NO: 697027 - DNA, 25 bp, Artificial sequence
  Synthetic oligonucleotide
ccaccaccgcacccggccgatcctg

SEQ ID NO: 697028 - DNA, 25 bp, Artificial sequence
  Synthetic oligonucleotide
gggcgccgccgtagcagagtctgtg

SEQ ID NO: 697029 - DNA, 25 bp, Artificial sequence
  Synthetic oligonucleotide
actcggtgatcctggtgacccagat

SEQ ID NO: 697030 - DNA, 25 bp, Artificial sequence
  Synthetic oligonucleotide
ccctggacctgtccaccgcgcaggt

SEQ ID NO: 697031 - DNA, 25 bp, Artificial sequence
  Synthetic oligonucleotide
gctgagcgcggcgtaaggggaaggg

SEQ ID NO: 697032 - DNA, 25 bp, Artificial sequence
  Synthetic oligonucleotide
gacacattgcaaggcatgcgcgtgt

SEQ ID NO: 697033 - DNA, 25 bp, Artificial sequence
  Synthetic oligonucleotide
attgcaaggcatgcgcgtgttcgcc

SEQ ID NO: 697034 - DNA, 25 bp, Artificial sequence
  Synthetic oligonucleotide
aggcatgcgcgtgttcgccagggtg

SEQ ID NO: 697035 - DNA, 25 bp, Artificial sequence
  Synthetic oligonucleotide
gcgcgtgttcgccagggtggtggac

SEQ ID NO: 697036 - DNA, 25 bp, Artificial sequence
  Synthetic oligonucleotide
tgttcgccagggtggtggacagcgg

SEQ ID NO: 697037 - DNA, 25 bp, Artificial sequence
  Synthetic oligonucleotide
ccagggtggtggacagcggcagctt

SEQ ID NO: 697038 - DNA, 25 bp, Artificial sequence
  Synthetic oligonucleotide
tggtggacagcggcagcttcacttc

SEQ ID NO: 697039 - DNA, 25 bp, Artificial sequence
  Synthetic oligonucleotide
acagcggcagcttcacttccgccgc

SEQ ID NO: 697040 - DNA, 25 bp, Artificial sequence
  Synthetic oligonucleotide
gcagcttcacttccgccgcccaggc

SEQ ID NO: 697041 - DNA, 25 bp, Artificial sequence
  Synthetic oligonucleotide
tcacttccgccgcccaggccctgga

SEQ ID NO: 697042 - DNA, 25 bp, Artificial sequence
  Synthetic oligonucleotide
gaggtaatagtggacacattgcaag

SEQ ID NO: 697043 - DNA, 25 bp, Artificial sequence
  Synthetic oligonucleotide
cccaggccctggacctgtccaccgc

SEQ ID NO: 697044 - DNA, 25 bp, Artificial sequence
  Synthetic oligonucleotide
gcaaccgaggtaatagtggacacat

SEQ ID NO: 697045 - DNA, 25 bp, Artificial sequence
  Synthetic oligonucleotide
acctgtccaccgcgcaggtatcgcg

SEQ ID NO: 697046 - DNA, 25 bp, Artificial sequence
  Synthetic oligonucleotide
ccaccgcgcaggtatcgcggctgat

SEQ ID NO: 697047 - DNA, 25 bp, Artificial sequence
  Synthetic oligonucleotide
cgcaggtatcgcggctgatctccga

SEQ ID NO: 697048 - DNA, 25 bp, Artificial sequence
  Synthetic oligonucleotide
tatcgcggctgatctccgacctgga

SEQ ID NO: 697049 - DNA, 25 bp, Artificial sequence
  Synthetic oligonucleotide
ggctgatctccgacctggaggcgca

SEQ ID NO: 697050 - DNA, 25 bp, Artificial sequence
  Synthetic oligonucleotide
tctccgacctggaggcgcacctgca

SEQ ID NO: 697051 - DNA, 25 bp, Artificial sequence
  Synthetic oligonucleotide
acctggaggcgcacctgcagacgcg

SEQ ID NO: 697052 - DNA, 25 bp, Artificial sequence
  Synthetic oligonucleotide
aggcgcacctgcagacgcgcctgct

SEQ ID NO: 697053 - DNA, 25 bp, Artificial sequence
  Synthetic oligonucleotide
acctgcagacgcgcctgctgcaccg

SEQ ID NO: 697054 - DNA, 25 bp, Artificial sequence
  Synthetic oligonucleotide
agacgcgcctgctgcaccgcaccac

SEQ ID NO: 697055 - DNA, 25 bp, Artificial sequence
  Synthetic oligonucleotide
gcctgctgcaccgcaccacccggcg

SEQ ID NO: 697056 - DNA, 25 bp, Artificial sequence
  Synthetic oligonucleotide
tgcaccgcaccacccggcgcctggc

SEQ ID NO: 697057 - DNA, 25 bp, Artificial sequence
  Synthetic oligonucleotide
ccgccgcccaggccctggacctgtc

SEQ ID NO: 697058 - DNA, 25 bp, Artificial sequence
  Synthetic oligonucleotide
tgcccggcgttgctacggcgacggc

SEQ ID NO: 697059 - DNA, 25 bp, Artificial sequence
  Synthetic oligonucleotide
gcaccacccggcgcctggccctgac

SEQ ID NO: 697060 - DNA, 25 bp, Artificial sequence
  Synthetic oligonucleotide
cgccgtagcagagtctgtgcggggg

SEQ ID NO: 697061 - DNA, 25 bp, Artificial sequence
  Synthetic oligonucleotide
tagcagagtctgtgcggggggaagg

SEQ ID NO: 697062 - DNA, 25 bp, Artificial sequence
  Synthetic oligonucleotide
gagtctgtgcggggggaaggagagc

SEQ ID NO: 697063 - DNA, 25 bp, Artificial sequence
  Synthetic oligonucleotide
tgcggggggaaggagagcggacggc

SEQ ID NO: 697064 - DNA, 25 bp, Artificial sequence
  Synthetic oligonucleotide
gaaggagagcggacggcgggtgggc

SEQ ID NO: 697065 - DNA, 25 bp, Artificial sequence
  Synthetic oligonucleotide
agcggacggcgggtgggccatccgc

SEQ ID NO: 697066 - DNA, 25 bp, Artificial sequence
  Synthetic oligonucleotide
gcgggtgggccatccgccccgacgc

SEQ ID NO: 697067 - DNA, 25 bp, Artificial sequence
  Synthetic oligonucleotide
gggccatccgccccgacgccgggca

SEQ ID NO: 697068 - DNA, 25 bp, Artificial sequence
  Synthetic oligonucleotide
ccgccccgacgccgggcagggtatg

SEQ ID NO: 697069 - DNA, 25 bp, Artificial sequence
  Synthetic oligonucleotide
ccgacgccgggcagggtatgcccgg

SEQ ID NO: 697070 - DNA, 25 bp, Artificial sequence
  Synthetic oligonucleotide
atagtggacacattgcaaggcatgc

SEQ ID NO: 697071 - DNA, 25 bp, Artificial sequence
  Synthetic oligonucleotide
agggtatgcccggcgttgctacggc

SEQ ID NO: 697072 - DNA, 25 bp, Artificial sequence
  Synthetic oligonucleotide
gggaagggggcgccgccgtagcaga

SEQ ID NO: 697073 - DNA, 25 bp, Artificial sequence
  Synthetic oligonucleotide
cgttgctacggcgacggcggccagt

SEQ ID NO: 697074 - DNA, 25 bp, Artificial sequence
  Synthetic oligonucleotide
tacggcgacggcggccagtataggc

SEQ ID NO: 697075 - DNA, 25 bp, Artificial sequence
  Synthetic oligonucleotide
gacggcggccagtataggcagcccg

SEQ ID NO: 697076 - DNA, 25 bp, Artificial sequence
  Synthetic oligonucleotide
gccagtataggcagcccggcgtcag

SEQ ID NO: 697077 - DNA, 25 bp, Artificial sequence
  Synthetic oligonucleotide
ataggcagcccggcgtcagggaaaa

SEQ ID NO: 697078 - DNA, 25 bp, Artificial sequence
  Synthetic oligonucleotide
cagcccggcgtcagggaaaatccga

SEQ ID NO: 697079 - DNA, 25 bp, Artificial sequence
  Synthetic oligonucleotide
cggcgtcagggaaaatccgaccaat

SEQ ID NO: 697080 - DNA, 25 bp, Artificial sequence
  Synthetic oligonucleotide
aaaatccgaccaatttacgaatctg

SEQ ID NO: 697081 - DNA, 25 bp, Artificial sequence
  Synthetic oligonucleotide
cgaccaatttacgaatctgttttgc

SEQ ID NO: 697082 - DNA, 25 bp, Artificial sequence
  Synthetic oligonucleotide
atttacgaatctgttttgcaaccga

SEQ ID NO: 697083 - DNA, 25 bp, Artificial sequence
  Synthetic oligonucleotide
gaatctgttttgcaaccgaggtaat

SEQ ID NO: 697084 - DNA, 25 bp, Artificial sequence
  Synthetic oligonucleotide
gttttgcaaccgaggtaatagtgga

SEQ ID NO: 697085 - DNA, 25 bp, Artificial sequence
  Synthetic oligonucleotide
ccgggcagggtatgcccggcgttgc

SEQ ID NO: 697086 - DNA, 25 bp, Artificial sequence
  Synthetic oligonucleotide
ccggatttcaccacgctgtaagaag

SEQ ID NO: 697087 - DNA, 25 bp, Artificial sequence
  Synthetic oligonucleotide
ccccatgggagcgatcgcccgcgcg

SEQ ID NO: 697088 - DNA, 25 bp, Artificial sequence
  Synthetic oligonucleotide
ggagcgatcgcccgcgcgacgccag

SEQ ID NO: 697089 - DNA, 25 bp, Artificial sequence
  Synthetic oligonucleotide
atcgcccgcgcgacgccagcagaag

SEQ ID NO: 697090 - DNA, 25 bp, Artificial sequence
  Synthetic oligonucleotide
gcgcgacgccagcagaagcgtcgcc

SEQ ID NO: 697091 - DNA, 25 bp, Artificial sequence
  Synthetic oligonucleotide
acgccagcagaagcgtcgccgggaa

SEQ ID NO: 697092 - DNA, 25 bp, Artificial sequence
  Synthetic oligonucleotide
agcagaagcgtcgccgggaacgaca

SEQ ID NO: 697093 - DNA, 25 bp, Artificial sequence
  Synthetic oligonucleotide
agcgtcgccgggaacgacaccacaa

SEQ ID NO: 697094 - DNA, 25 bp, Artificial sequence
  Synthetic oligonucleotide
ccgggaacgacaccacaacacgctt

SEQ ID NO: 697095 - DNA, 25 bp, Artificial sequence
  Synthetic oligonucleotide
acgacaccacaacacgctttccggc

SEQ ID NO: 697096 - DNA, 25 bp, Artificial sequence
  Synthetic oligonucleotide
ccacaacacgctttccggccttgcc

SEQ ID NO: 697097 - DNA, 25 bp, Artificial sequence
  Synthetic oligonucleotide
cacgctttccggccttgccggattt

SEQ ID NO: 697098 - DNA, 25 bp, Artificial sequence
  Synthetic oligonucleotide
ctggcgctgtgcaccgcgtccgccg

SEQ ID NO: 697099 - DNA, 25 bp, Artificial sequence
  Synthetic oligonucleotide
gccttgccggatttcaccacgctgt

SEQ ID NO: 697100 - DNA, 25 bp, Artificial sequence
  Synthetic oligonucleotide
gttgcgcccggctgggcgccccatg

SEQ ID NO: 697101 - DNA, 25 bp, Artificial sequence
  Synthetic oligonucleotide
ttcaccacgctgtaagaaggagcaa

SEQ ID NO: 697102 - DNA, 25 bp, Artificial sequence
  Synthetic oligonucleotide
acgctgtaagaaggagcaaccgcaa

SEQ ID NO: 697103 - DNA, 25 bp, Artificial sequence
  Synthetic oligonucleotide
taagaaggagcaaccgcaatgagga

SEQ ID NO: 697104 - DNA, 25 bp, Artificial sequence
  Synthetic oligonucleotide
ggagcaaccgcaatgaggaatctgt

SEQ ID NO: 697105 - DNA, 25 bp, Artificial sequence
  Synthetic oligonucleotide
accgcaatgaggaatctgttcgcct

SEQ ID NO: 697106 - DNA, 25 bp, Artificial sequence
  Synthetic oligonucleotide
atgaggaatctgttcgccttgacgc

SEQ ID NO: 697107 - DNA, 25 bp, Artificial sequence
  Synthetic oligonucleotide
aatctgttcgccttgacgccgatgg

SEQ ID NO: 697108 - DNA, 25 bp, Artificial sequence
  Synthetic oligonucleotide
ttcgccttgacgccgatggcgctgg

SEQ ID NO: 697109 - DNA, 25 bp, Artificial sequence
  Synthetic oligonucleotide
ttgacgccgatggcgctggcgctgt

SEQ ID NO: 697110 - DNA, 25 bp, Artificial sequence
  Synthetic oligonucleotide
gccgatggcgctggcgctgtgcacc

SEQ ID NO: 697111 - DNA, 25 bp, Artificial sequence
  Synthetic oligonucleotide
gacgtggaaagcctaaagcccgatg

SEQ ID NO: 697112 - DNA, 25 bp, Artificial sequence
  Synthetic oligonucleotide
tttccggccttgccggatttcacca

SEQ ID NO: 697113 - DNA, 25 bp, Artificial sequence
  Synthetic oligonucleotide
tacactggcaagacttcccgacgcc

SEQ ID NO: 697114 - DNA, 25 bp, Artificial sequence
  Synthetic oligonucleotide
gtaccggcggcaccagcatcctgcc

SEQ ID NO: 697115 - DNA, 25 bp, Artificial sequence
  Synthetic oligonucleotide
ctaaagcccgatgagtcgaagagac

SEQ ID NO: 697116 - DNA, 25 bp, Artificial sequence
  Synthetic oligonucleotide
cccgatgagtcgaagagactttcaa

SEQ ID NO: 697117 - DNA, 25 bp, Artificial sequence
  Synthetic oligonucleotide
gagtcgaagagactttcaatagaag

SEQ ID NO: 697118 - DNA, 25 bp, Artificial sequence
  Synthetic oligonucleotide
aagagactttcaatagaagagtccg

SEQ ID NO: 697119 - DNA, 25 bp, Artificial sequence
  Synthetic oligonucleotide
ctttcaatagaagagtccgactgcg

SEQ ID NO: 697120 - DNA, 25 bp, Artificial sequence
  Synthetic oligonucleotide
atagaagagtccgactgcgtttcag

SEQ ID NO: 697121 - DNA, 25 bp, Artificial sequence
  Synthetic oligonucleotide
gagtccgactgcgtttcagccggtt

SEQ ID NO: 697122 - DNA, 25 bp, Artificial sequence
  Synthetic oligonucleotide
gactgcgtttcagccggtttccagt

SEQ ID NO: 697123 - DNA, 25 bp, Artificial sequence
  Synthetic oligonucleotide
tttcagccggtttccagtgtccgga

SEQ ID NO: 697124 - DNA, 25 bp, Artificial sequence
  Synthetic oligonucleotide
gtttccagtgtccggaaatacactg

SEQ ID NO: 697125 - DNA, 25 bp, Artificial sequence
  Synthetic oligonucleotide
tgggcgccccatgggagcgatcgcc

SEQ ID NO: 697126 - DNA, 25 bp, Artificial sequence
  Synthetic oligonucleotide
cggaaatacactggcaagacttccc

SEQ ID NO: 697127 - DNA, 25 bp, Artificial sequence
  Synthetic oligonucleotide
ccggctgggcgccccatgggagcga

SEQ ID NO: 697128 - DNA, 25 bp, Artificial sequence
  Synthetic oligonucleotide
tggcaagacttcccgacgccgaact

SEQ ID NO: 697129 - DNA, 25 bp, Artificial sequence
  Synthetic oligonucleotide
acttcccgacgccgaactttgattg

SEQ ID NO: 697130 - DNA, 25 bp, Artificial sequence
  Synthetic oligonucleotide
cgacgccgaactttgattgctccta

SEQ ID NO: 697131 - DNA, 25 bp, Artificial sequence
  Synthetic oligonucleotide
cgaactttgattgctcctattcgac

SEQ ID NO: 697132 - DNA, 25 bp, Artificial sequence
  Synthetic oligonucleotide
ttgattgctcctattcgacgtcttc

SEQ ID NO: 697133 - DNA, 25 bp, Artificial sequence
  Synthetic oligonucleotide
gctcctattcgacgtcttctcaagg

SEQ ID NO: 697134 - DNA, 25 bp, Artificial sequence
  Synthetic oligonucleotide
attcgacgtcttctcaaggccgctg

SEQ ID NO: 697135 - DNA, 25 bp, Artificial sequence
  Synthetic oligonucleotide
gtcttctcaaggccgctgataccag

SEQ ID NO: 697136 - DNA, 25 bp, Artificial sequence
  Synthetic oligonucleotide
tcaaggccgctgataccagcggcct

SEQ ID NO: 697137 - DNA, 25 bp, Artificial sequence
  Synthetic oligonucleotide
ccgctgataccagcggccttttttt

SEQ ID NO: 697138 - DNA, 25 bp, Artificial sequence
  Synthetic oligonucleotide
tttcgggttgcgcccggctgggcgc

SEQ ID NO: 697139 - DNA, 25 bp, Artificial sequence
  Synthetic oligonucleotide
ctgtgcaccgcgtccgccgcctggg

SEQ ID NO: 697140 - DNA, 25 bp, Artificial sequence
  Synthetic oligonucleotide
agtgtccggaaatacactggcaaga

SEQ ID NO: 697141 - DNA, 25 bp, Artificial sequence
  Synthetic oligonucleotide
cctgccgatcacctcgccgagcaag

SEQ ID NO: 697142 - DNA, 25 bp, Artificial sequence
  Synthetic oligonucleotide
acacgcccggcgtggtcggcttcgg

SEQ ID NO: 697143 - DNA, 25 bp, Artificial sequence
  Synthetic oligonucleotide
cggcgtggtcggcttcggcgtcgac

SEQ ID NO: 697144 - DNA, 25 bp, Artificial sequence
  Synthetic oligonucleotide
tggtcggcttcggcgtcgacgccta

SEQ ID NO: 697145 - DNA, 25 bp, Artificial sequence
  Synthetic oligonucleotide
gcttcggcgtcgacgcctacggcat

SEQ ID NO: 697146 - DNA, 25 bp, Artificial sequence
  Synthetic oligonucleotide
gcgtcgacgcctacggcatgctcgg

SEQ ID NO: 697147 - DNA, 25 bp, Artificial sequence
  Synthetic oligonucleotide
acgcctacggcatgctcgggctgaa

SEQ ID NO: 697148 - DNA, 25 bp, Artificial sequence
  Synthetic oligonucleotide
acggcatgctcgggctgaagctcga

SEQ ID NO: 697149 - DNA, 25 bp, Artificial sequence
  Synthetic oligonucleotide
tgctcgggctgaagctcgacggcgg

SEQ ID NO: 697150 - DNA, 25 bp, Artificial sequence
  Synthetic oligonucleotide
ggctgaagctcgacggcggcggcgg

SEQ ID NO: 697151 - DNA, 25 bp, Artificial sequence
  Synthetic oligonucleotide
agctcgacggcggcggcggtaccgg

SEQ ID NO: 697152 - DNA, 25 bp, Artificial sequence
  Synthetic oligonucleotide
gacggcggcggcggtaccggcggca

SEQ ID NO: 697153 - DNA, 25 bp, Artificial sequence
  Synthetic oligonucleotide
tggcgctggcgctgtgcaccgcgtc

SEQ ID NO: 697154 - DNA, 25 bp, Artificial sequence
  Synthetic oligonucleotide
gcggcaccagcatcctgccgatcac

SEQ ID NO: 697155 - DNA, 25 bp, Artificial sequence
  Synthetic oligonucleotide
ccacctttcagtccggctacacgcc

SEQ ID NO: 697156 - DNA, 25 bp, Artificial sequence
  Synthetic oligonucleotide
gatcacctcgccgagcaaggaaggc

SEQ ID NO: 697157 - DNA, 25 bp, Artificial sequence
  Synthetic oligonucleotide
ctcgccgagcaaggaaggctacgaa

SEQ ID NO: 697158 - DNA, 25 bp, Artificial sequence
  Synthetic oligonucleotide
gagcaaggaaggctacgaatccggc

SEQ ID NO: 697159 - DNA, 25 bp, Artificial sequence
  Synthetic oligonucleotide
aggaaggctacgaatccggcaaggc

SEQ ID NO: 697160 - DNA, 25 bp, Artificial sequence
  Synthetic oligonucleotide
ctacgaatccggcaaggcgcccgat

SEQ ID NO: 697161 - DNA, 25 bp, Artificial sequence
  Synthetic oligonucleotide
tccggcaaggcgcccgatgagttct

SEQ ID NO: 697162 - DNA, 25 bp, Artificial sequence
  Synthetic oligonucleotide
aaggcgcccgatgagttctccagtg

SEQ ID NO: 697163 - DNA, 25 bp, Artificial sequence
  Synthetic oligonucleotide
gagttctccagtggcggggcggcgc

SEQ ID NO: 697164 - DNA, 25 bp, Artificial sequence
  Synthetic oligonucleotide
gcccgatgagttctccagtggcggg

SEQ ID NO: 697165 - DNA, 25 bp, Artificial sequence
  Synthetic oligonucleotide
tgccgaccggcacgccgatgggctt

SEQ ID NO: 697166 - DNA, 25 bp, Artificial sequence
  Synthetic oligonucleotide
gtggacgatgccatgatcaccgtgg

SEQ ID NO: 697167 - DNA, 25 bp, Artificial sequence
  Synthetic oligonucleotide
gcggcggtaccggcggcaccagcat

SEQ ID NO: 697168 - DNA, 25 bp, Artificial sequence
  Synthetic oligonucleotide
actactacttcaaccatgaccgccg

SEQ ID NO: 697169 - DNA, 25 bp, Artificial sequence
  Synthetic oligonucleotide
accgcgtccgccgcctgggccgatg

SEQ ID NO: 697170 - DNA, 25 bp, Artificial sequence
  Synthetic oligonucleotide
tccgccgcctgggccgatgaggggg

SEQ ID NO: 697171 - DNA, 25 bp, Artificial sequence
  Synthetic oligonucleotide
cctgggccgatgagggggaagccaa

SEQ ID NO: 697172 - DNA, 25 bp, Artificial sequence
  Synthetic oligonucleotide
ccgatgagggggaagccaaagaagg

SEQ ID NO: 697173 - DNA, 25 bp, Artificial sequence
  Synthetic oligonucleotide
agggggaagccaaagaaggcttcat

SEQ ID NO: 697174 - DNA, 25 bp, Artificial sequence
  Synthetic oligonucleotide
agccaaagaaggcttcatcgaaggc

SEQ ID NO: 697175 - DNA, 25 bp, Artificial sequence
  Synthetic oligonucleotide
agaaggcttcatcgaaggctccagc

SEQ ID NO: 697176 - DNA, 25 bp, Artificial sequence
  Synthetic oligonucleotide
ttcatcgaaggctccagcctccaat

SEQ ID NO: 697177 - DNA, 25 bp, Artificial sequence
  Synthetic oligonucleotide
gaaggctccagcctccaattgctga

SEQ ID NO: 697178 - DNA, 25 bp, Artificial sequence
  Synthetic oligonucleotide
tccagcctccaattgctgacccgca

SEQ ID NO: 697179 - DNA, 25 bp, Artificial sequence
  Synthetic oligonucleotide
tccaattgctgacccgcaactacta

SEQ ID NO: 697180 - DNA, 25 bp, Artificial sequence
  Synthetic oligonucleotide
ccggctacacgcccggcgtggtcgg

SEQ ID NO: 697181 - DNA, 25 bp, Artificial sequence
  Synthetic oligonucleotide
cccgcaactactacttcaaccatga

SEQ ID NO: 697182 - DNA, 25 bp, Artificial sequence
  Synthetic oligonucleotide
ttcagtccggctacacgcccggcgt

SEQ ID NO: 697183 - DNA, 25 bp, Artificial sequence
  Synthetic oligonucleotide
acttcaaccatgaccgccggcacgc

SEQ ID NO: 697184 - DNA, 25 bp, Artificial sequence
  Synthetic oligonucleotide
accatgaccgccggcacgcttccgg

SEQ ID NO: 697185 - DNA, 25 bp, Artificial sequence
  Synthetic oligonucleotide
accgccggcacgcttccgggcacga

SEQ ID NO: 697186 - DNA, 25 bp, Artificial sequence
  Synthetic oligonucleotide
ggcacgcttccgggcacgacagcaa

SEQ ID NO: 697187 - DNA, 25 bp, Artificial sequence
  Synthetic oligonucleotide
cttccgggcacgacagcaaggaatg

SEQ ID NO: 697188 - DNA, 25 bp, Artificial sequence
  Synthetic oligonucleotide
gcacgacagcaaggaatgggcgcaa

SEQ ID NO: 697189 - DNA, 25 bp, Artificial sequence
  Synthetic oligonucleotide
cagcaaggaatgggcgcaaggcttc

SEQ ID NO: 697190 - DNA, 25 bp, Artificial sequence
  Synthetic oligonucleotide
ggaatgggcgcaaggcttcatcgcc

SEQ ID NO: 697191 - DNA, 25 bp, Artificial sequence
  Synthetic oligonucleotide
ggcgcaaggcttcatcgccaccttt

SEQ ID NO: 697192 - DNA, 25 bp, Artificial sequence
  Synthetic oligonucleotide
aggcttcatcgccacctttcagtcc

SEQ ID NO: 697193 - DNA, 25 bp, Artificial sequence
  Synthetic oligonucleotide
catcgccacctttcagtccggctac

SEQ ID NO: 697194 - DNA, 25 bp, Artificial sequence
  Synthetic oligonucleotide
gagcgggacgtggaaagcctaaagc

SEQ ID NO: 697195 - DNA, 25 bp, Artificial sequence
  Synthetic oligonucleotide
tgctgacccgcaactactacttcaa

SEQ ID NO: 697196 - DNA, 25 bp, Artificial sequence
  Synthetic oligonucleotide
tgctgccgccatactcagtttgttt

SEQ ID NO: 697197 - DNA, 25 bp, Artificial sequence
  Synthetic oligonucleotide
catggcggttaactaatatggcgcc

SEQ ID NO: 697198 - DNA, 25 bp, Artificial sequence
  Synthetic oligonucleotide
ggttaactaatatggcgcctgtccc

SEQ ID NO: 697199 - DNA, 25 bp, Artificial sequence
  Synthetic oligonucleotide
ctaatatggcgcctgtcccaagtga

SEQ ID NO: 697200 - DNA, 25 bp, Artificial sequence
  Synthetic oligonucleotide
tggcgcctgtcccaagtgaacaggg

SEQ ID NO: 697201 - DNA, 25 bp, Artificial sequence
  Synthetic oligonucleotide
ctgtcccaagtgaacagggtgtcat

SEQ ID NO: 697202 - DNA, 25 bp, Artificial sequence
  Synthetic oligonucleotide
aagtgaacagggtgtcatcggagac

SEQ ID NO: 697203 - DNA, 25 bp, Artificial sequence
  Synthetic oligonucleotide
acagggtgtcatcggagacccgcca

SEQ ID NO: 697204 - DNA, 25 bp, Artificial sequence
  Synthetic oligonucleotide
tgtcatcggagacccgccatgaatc

SEQ ID NO: 697205 - DNA, 25 bp, Artificial sequence
  Synthetic oligonucleotide
cggagacccgccatgaatcgccaga

SEQ ID NO: 697206 - DNA, 25 bp, Artificial sequence
  Synthetic oligonucleotide
cccgccatgaatcgccagatccttg

SEQ ID NO: 697207 - DNA, 25 bp, Artificial sequence
  Synthetic oligonucleotide
atgaatcgccagatccttgctgccg

SEQ ID NO: 697208 - DNA, 25 bp, Artificial sequence
  Synthetic oligonucleotide
tggtcgacgccaaccagcaggccat

SEQ ID NO: 697209 - DNA, 25 bp, Artificial sequence
  Synthetic oligonucleotide
gatccttgctgccgccatactcagt

SEQ ID NO: 697210 - DNA, 25 bp, Artificial sequence
  Synthetic oligonucleotide
gtttggctatttttccgagcatggc

SEQ ID NO: 697211 - DNA, 25 bp, Artificial sequence
  Synthetic oligonucleotide
cgccatactcagtttgttttccctc

SEQ ID NO: 697212 - DNA, 25 bp, Artificial sequence
  Synthetic oligonucleotide
actcagtttgttttccctcgcattt

SEQ ID NO: 697213 - DNA, 25 bp, Artificial sequence
  Synthetic oligonucleotide
tgttttccctcgcattttcccaggc

SEQ ID NO: 697214 - DNA, 25 bp, Artificial sequence
  Synthetic oligonucleotide
ctcgcattttcccaggccggtttcg

SEQ ID NO: 697215 - DNA, 25 bp, Artificial sequence
  Synthetic oligonucleotide
caggccggtttcgccgaagagtcct

SEQ ID NO: 697216 - DNA, 25 bp, Artificial sequence
  Synthetic oligonucleotide
gtttcgccgaagagtcctcgctgat

SEQ ID NO: 697217 - DNA, 25 bp, Artificial sequence
  Synthetic oligonucleotide
ccgaagagtcctcgctgatgaccaa

SEQ ID NO: 697218 - DNA, 25 bp, Artificial sequence
  Synthetic oligonucleotide
agtcctcgctgatgaccaaccgcat

SEQ ID NO: 697219 - DNA, 25 bp, Artificial sequence
  Synthetic oligonucleotide
cgctgatgaccaaccgcatggtcga

SEQ ID NO: 697220 - DNA, 25 bp, Artificial sequence
  Synthetic oligonucleotide
tgaccaaccgcatggtcgacgccaa

SEQ ID NO: 697221 - DNA, 25 bp, Artificial sequence
  Synthetic oligonucleotide
gaaagcctaaagcccgatgagtcga

SEQ ID NO: 697222 - DNA, 25 bp, Artificial sequence
  Synthetic oligonucleotide
cgccagatccttgctgccgccatac

SEQ ID NO: 697223 - DNA, 25 bp, Artificial sequence
  Synthetic oligonucleotide
actaccatgcaaagttcaagttact

SEQ ID NO: 697224 - DNA, 25 bp, Artificial sequence
  Synthetic oligonucleotide
ggcgttacctggacgcgaagatccg

SEQ ID NO: 697225 - DNA, 25 bp, Artificial sequence
  Synthetic oligonucleotide
acctggacgcgaagatccgcacctg

SEQ ID NO: 697226 - DNA, 25 bp, Artificial sequence
  Synthetic oligonucleotide
cgcgaagatccgcacctgggtcgat

SEQ ID NO: 697227 - DNA, 25 bp, Artificial sequence
  Synthetic oligonucleotide
gatccgcacctgggtcgatctgttg

SEQ ID NO: 697228 - DNA, 25 bp, Artificial sequence
  Synthetic oligonucleotide
cacctgggtcgatctgttgcaacag

SEQ ID NO: 697229 - DNA, 25 bp, Artificial sequence
  Synthetic oligonucleotide
ggtcgatctgttgcaacaggaactt

SEQ ID NO: 697230 - DNA, 25 bp, Artificial sequence
  Synthetic oligonucleotide
tctgttgcaacaggaacttccccag

SEQ ID NO: 697231 - DNA, 25 bp, Artificial sequence
  Synthetic oligonucleotide
gcaacaggaacttccccaggcattc

SEQ ID NO: 697232 - DNA, 25 bp, Artificial sequence
  Synthetic oligonucleotide
ggaacttccccaggcattcgcccgc

SEQ ID NO: 697233 - DNA, 25 bp, Artificial sequence
  Synthetic oligonucleotide
tccccaggcattcgcccgcgacgaa

SEQ ID NO: 697234 - DNA, 25 bp, Artificial sequence
  Synthetic oligonucleotide
gcattcgcccgcgacgaaactacca

SEQ ID NO: 697235 - DNA, 25 bp, Artificial sequence
  Synthetic oligonucleotide
tccgagcatggcggttaactaatat

SEQ ID NO: 697236 - DNA, 25 bp, Artificial sequence
  Synthetic oligonucleotide
gacgaaactaccatgcaaagttcaa

SEQ ID NO: 697237 - DNA, 25 bp, Artificial sequence
  Synthetic oligonucleotide
ctatttttccgagcatggcggttaa

SEQ ID NO: 697238 - DNA, 25 bp, Artificial sequence
  Synthetic oligonucleotide
atgcaaagttcaagttactgtgcac

SEQ ID NO: 697239 - DNA, 25 bp, Artificial sequence
  Synthetic oligonucleotide
agttcaagttactgtgcacagtgaa

SEQ ID NO: 697240 - DNA, 25 bp, Artificial sequence
  Synthetic oligonucleotide
agttactgtgcacagtgaaggattg

SEQ ID NO: 697241 - DNA, 25 bp, Artificial sequence
  Synthetic oligonucleotide
tgtgcacagtgaaggattgttgtta

SEQ ID NO: 697242 - DNA, 25 bp, Artificial sequence
  Synthetic oligonucleotide
cagtgaaggattgttgttattgagg

SEQ ID NO: 697243 - DNA, 25 bp, Artificial sequence
  Synthetic oligonucleotide
aggattgttgttattgaggtaatac

SEQ ID NO: 697244 - DNA, 25 bp, Artificial sequence
  Synthetic oligonucleotide
gttgttattgaggtaatactctctc

SEQ ID NO: 697245 - DNA, 25 bp, Artificial sequence
  Synthetic oligonucleotide
attgaggtaatactctctcgtctgt

SEQ ID NO: 697246 - DNA, 25 bp, Artificial sequence
  Synthetic oligonucleotide
gtaatactctctcgtctgtttggct

SEQ ID NO: 697247 - DNA, 25 bp, Artificial sequence
  Synthetic oligonucleotide
actctctcgtctgtttggctatttt

SEQ ID NO: 697248 - DNA, 25 bp, Artificial sequence
  Synthetic oligonucleotide
tcgtctgtttggctatttttccgag

SEQ ID NO: 697249 - DNA, 25 bp, Artificial sequence
  Synthetic oligonucleotide
acgccaaccagcaggccatcgagca

SEQ ID NO: 697250 - DNA, 25 bp, Artificial sequence
  Synthetic oligonucleotide
gcccgcgacgaaactaccatgcaaa

SEQ ID NO: 697251 - DNA, 25 bp, Artificial sequence
  Synthetic oligonucleotide
gccagctcaatggataattgtcgct

SEQ ID NO: 697252 - DNA, 25 bp, Artificial sequence
  Synthetic oligonucleotide
tgccttcctgaccgctcggacaatt

SEQ ID NO: 697253 - DNA, 25 bp, Artificial sequence
  Synthetic oligonucleotide
ctgaccgctcggacaattcttgcag

SEQ ID NO: 697254 - DNA, 25 bp, Artificial sequence
  Synthetic oligonucleotide
gctcggacaattcttgcagaatatg

SEQ ID NO: 697255 - DNA, 25 bp, Artificial sequence
  Synthetic oligonucleotide
acaattcttgcagaatatgtaaaag

SEQ ID NO: 697256 - DNA, 25 bp, Artificial sequence
  Synthetic oligonucleotide
cttgcagaatatgtaaaagactttc

SEQ ID NO: 697257 - DNA, 25 bp, Artificial sequence
  Synthetic oligonucleotide
gaatatgtaaaagactttcgttgga

SEQ ID NO: 697258 - DNA, 25 bp, Artificial sequence
  Synthetic oligonucleotide
tgtaaaagactttcgttggatatcg

SEQ ID NO: 697259 - DNA, 25 bp, Artificial sequence
  Synthetic oligonucleotide
tggatatcgggtttttccgatagtg

SEQ ID NO: 697260 - DNA, 25 bp, Artificial sequence
  Synthetic oligonucleotide
tttccgatagtggcaaaaaaatata

SEQ ID NO: 697261 - DNA, 25 bp, Artificial sequence
  Synthetic oligonucleotide
atagtggcaaaaaaatataatcgcg

SEQ ID NO: 697262 - DNA, 25 bp, Artificial sequence
  Synthetic oligonucleotide
gcaaaaaaatataatcgcgccagct

SEQ ID NO: 697263 - DNA, 25 bp, Artificial sequence
  Synthetic oligonucleotide
accgcatggtcgacgccaaccagca

SEQ ID NO: 697264 - DNA, 25 bp, Artificial sequence
  Synthetic oligonucleotide
aatcgcgccagctcaatggataatt

SEQ ID NO: 697265 - DNA, 25 bp, Artificial sequence
  Synthetic oligonucleotide
atgatatgcggcgttttttttgcct

SEQ ID NO: 697266 - DNA, 25 bp, Artificial sequence
  Synthetic oligonucleotide
tcaatggataattgtcgctggctgt

SEQ ID NO: 697267 - DNA, 25 bp, Artificial sequence
  Synthetic oligonucleotide
gataattgtcgctggctgtcgacga

SEQ ID NO: 697268 - DNA, 25 bp, Artificial sequence
  Synthetic oligonucleotide
tgtcgctggctgtcgacgatattcg

SEQ ID NO: 697269 - DNA, 25 bp, Artificial sequence
  Synthetic oligonucleotide
tggctgtcgacgatattcgttctgt

SEQ ID NO: 697270 - DNA, 25 bp, Artificial sequence
  Synthetic oligonucleotide
tcgacgatattcgttctgtcttcat

SEQ ID NO: 697271 - DNA, 25 bp, Artificial sequence
  Synthetic oligonucleotide
atattcgttctgtcttcatcgatct

SEQ ID NO: 697272 - DNA, 25 bp, Artificial sequence
  Synthetic oligonucleotide
gttctgtcttcatcgatctcgccat

SEQ ID NO: 697273 - DNA, 25 bp, Artificial sequence
  Synthetic oligonucleotide
tcttcatcgatctcgccatgcaaga

SEQ ID NO: 697274 - DNA, 25 bp, Artificial sequence
  Synthetic oligonucleotide
tcgatctcgccatgcaagagcggga

SEQ ID NO: 697275 - DNA, 25 bp, Artificial sequence
  Synthetic oligonucleotide
tcgccatgcaagagcgggacgtgga

SEQ ID NO: 697276 - DNA, 25 bp, Artificial sequence
  Synthetic oligonucleotide
tgcaagagcgggacgtggaaagcct

SEQ ID NO: 697277 - DNA, 25 bp, Artificial sequence
  Synthetic oligonucleotide
aaatataatcgcgccagctcaatgg

SEQ ID NO: 697278 - DNA, 25 bp, Artificial sequence
  Synthetic oligonucleotide
agcgcatggcgccagccgcgccatg

SEQ ID NO: 697279 - DNA, 25 bp, Artificial sequence
  Synthetic oligonucleotide
accagcaggccatcgagcaccagca

SEQ ID NO: 697280 - DNA, 25 bp, Artificial sequence
  Synthetic oligonucleotide
aggccatcgagcaccagcaggaact

SEQ ID NO: 697281 - DNA, 25 bp, Artificial sequence
  Synthetic oligonucleotide
tcgagcaccagcaggaactttccgc

SEQ ID NO: 697282 - DNA, 25 bp, Artificial sequence
  Synthetic oligonucleotide
accagcaggaactttccgcctccgc

SEQ ID NO: 697283 - DNA, 25 bp, Artificial sequence
  Synthetic oligonucleotide
aggaactttccgcctccgccgcgca

SEQ ID NO: 697284 - DNA, 25 bp, Artificial sequence
  Synthetic oligonucleotide
tttccgcctccgccgcgcaggccgg

SEQ ID NO: 697285 - DNA, 25 bp, Artificial sequence
  Synthetic oligonucleotide
cctccgccgcgcaggccggggcccg

SEQ ID NO: 697286 - DNA, 25 bp, Artificial sequence
  Synthetic oligonucleotide
ccgcgcaggccggggcccgcagcga

SEQ ID NO: 697287 - DNA, 25 bp, Artificial sequence
  Synthetic oligonucleotide
ggccggggcccgcagcgactcctga

SEQ ID NO: 697288 - DNA, 25 bp, Artificial sequence
  Synthetic oligonucleotide
gggcccgcagcgactcctgatctag

SEQ ID NO: 697289 - DNA, 25 bp, Artificial sequence
  Synthetic oligonucleotide
gcagcgactcctgatctagcgcatg

SEQ ID NO: 697290 - DNA, 25 bp, Artificial sequence
  Synthetic oligonucleotide
ttttttgccttcctgaccgctcgga

SEQ ID NO: 697291 - DNA, 25 bp, Artificial sequence
  Synthetic oligonucleotide
tgatctagcgcatggcgccagccgc

SEQ ID NO: 697292 - DNA, 25 bp, Artificial sequence
  Synthetic oligonucleotide
atgcggcgttttttttgccttcctg

SEQ ID NO: 697293 - DNA, 25 bp, Artificial sequence
  Synthetic oligonucleotide
tggcgccagccgcgccatggcttcc

SEQ ID NO: 697294 - DNA, 25 bp, Artificial sequence
  Synthetic oligonucleotide
cagccgcgccatggcttcccccggg

SEQ ID NO: 697295 - DNA, 25 bp, Artificial sequence
  Synthetic oligonucleotide
gcgccatggcttcccccgggtactc

SEQ ID NO: 697296 - DNA, 25 bp, Artificial sequence
  Synthetic oligonucleotide
ccgggtactcgggaagcgtgagcct

SEQ ID NO: 697297 - DNA, 25 bp, Artificial sequence
  Synthetic oligonucleotide
actcgggaagcgtgagcctgggtac

SEQ ID NO: 697298 - DNA, 25 bp, Artificial sequence
  Synthetic oligonucleotide
gaagcgtgagcctgggtaccctgtc

SEQ ID NO: 697299 - DNA, 25 bp, Artificial sequence
  Synthetic oligonucleotide
tgagcctgggtaccctgtccttgcg

SEQ ID NO: 697300 - DNA, 25 bp, Artificial sequence
  Synthetic oligonucleotide
tgggtaccctgtccttgcgccgcat

SEQ ID NO: 697301 - DNA, 25 bp, Artificial sequence
  Synthetic oligonucleotide
cctgtccttgcgccgcatatgatat

SEQ ID NO: 697302 - DNA, 25 bp, Artificial sequence
  Synthetic oligonucleotide
cttgcgccgcatatgatatgcggcg

SEQ ID NO: 697303 - DNA, 25 bp, Artificial sequence
  Synthetic oligonucleotide
ccgcatatgatatgcggcgtttttt

SEQ ID NO: 697304 - DNA, 25 bp, Artificial sequence
  Synthetic oligonucleotide
cctcgcggcgttacctggacgcgaa

SEQ ID NO: 697305 - DNA, 25 bp, Artificial sequence
  Synthetic oligonucleotide
actcctgatctagcgcatggcgcca

SEQ ID NO: 697306 - DNA, 25 bp, Artificial sequence
  Synthetic oligonucleotide
caccggcgaactgccggttggcgtc

SEQ ID NO: 697307 - DNA, 25 bp, Artificial sequence
  Synthetic oligonucleotide
atcgggctcaacgccagctccgccg

SEQ ID NO: 697308 - DNA, 25 bp, Artificial sequence
  Synthetic oligonucleotide
ggcggtggcgatgaaggagggcggc

SEQ ID NO: 697309 - DNA, 25 bp, Artificial sequence
  Synthetic oligonucleotide
ggcgatgaaggagggcggcaatatc

SEQ ID NO: 697310 - DNA, 25 bp, Artificial sequence
  Synthetic oligonucleotide
gaaggagggcggcaatatcctcgag

SEQ ID NO: 697311 - DNA, 25 bp, Artificial sequence
  Synthetic oligonucleotide
gggcggcaatatcctcgagttcggc

SEQ ID NO: 697312 - DNA, 25 bp, Artificial sequence
  Synthetic oligonucleotide
caatatcctcgagttcggcgaggcg

SEQ ID NO: 697313 - DNA, 25 bp, Artificial sequence
  Synthetic oligonucleotide
ctcgagttcggcgaggcgctcaatg

SEQ ID NO: 697314 - DNA, 25 bp, Artificial sequence
  Synthetic oligonucleotide
ttcggcgaggcgctcaatgcgcgca

SEQ ID NO: 697315 - DNA, 25 bp, Artificial sequence
  Synthetic oligonucleotide
gaggcgctcaatgcgcgcatgcagg

SEQ ID NO: 697316 - DNA, 25 bp, Artificial sequence
  Synthetic oligonucleotide
ctcaatgcgcgcatgcaggagatca

SEQ ID NO: 697317 - DNA, 25 bp, Artificial sequence
  Synthetic oligonucleotide
tgcgcgcatgcaggagatcaccggc

SEQ ID NO: 697318 - DNA, 25 bp, Artificial sequence
  Synthetic oligonucleotide
ggccatcggcctggcggtggcgatg

SEQ ID NO: 697319 - DNA, 25 bp, Artificial sequence
  Synthetic oligonucleotide
gagatcaccggcgaactgccggttg

SEQ ID NO: 697320 - DNA, 25 bp, Artificial sequence
  Synthetic oligonucleotide
gagccggccatcggcctggcggtgg

SEQ ID NO: 697321 - DNA, 25 bp, Artificial sequence
  Synthetic oligonucleotide
cgaactgccggttggcgtcggcgtg

SEQ ID NO: 697322 - DNA, 25 bp, Artificial sequence
  Synthetic oligonucleotide
gccggttggcgtcggcgtgcaccag

SEQ ID NO: 697323 - DNA, 25 bp, Artificial sequence
  Synthetic oligonucleotide
tggcgtcggcgtgcaccaggtgtcg

SEQ ID NO: 697324 - DNA, 25 bp, Artificial sequence
  Synthetic oligonucleotide
cggcgtgcaccaggtgtcgaaccag

SEQ ID NO: 697325 - DNA, 25 bp, Artificial sequence
  Synthetic oligonucleotide
tgcaccaggtgtcgaaccaggccca

SEQ ID NO: 697326 - DNA, 25 bp, Artificial sequence
  Synthetic oligonucleotide
aggtgtcgaaccaggcccaggtggt

SEQ ID NO: 697327 - DNA, 25 bp, Artificial sequence
  Synthetic oligonucleotide
cgaaccaggcccaggtggtgaagaa

SEQ ID NO: 697328 - DNA, 25 bp, Artificial sequence
  Synthetic oligonucleotide
aggcccaggtggtgaagaaggcggt

SEQ ID NO: 697329 - DNA, 25 bp, Artificial sequence
  Synthetic oligonucleotide
aggtggtgaagaaggcggtcggcgg

SEQ ID NO: 697330 - DNA, 25 bp, Artificial sequence
  Synthetic oligonucleotide
tgaagaaggcggtcggcggtttcac

SEQ ID NO: 697331 - DNA, 25 bp, Artificial sequence
  Synthetic oligonucleotide
gcggtttcacccgggcgctgttcga

SEQ ID NO: 697332 - DNA, 25 bp, Artificial sequence
  Synthetic oligonucleotide
catgcaggagatcaccggcgaactg

SEQ ID NO: 697333 - DNA, 25 bp, Artificial sequence
  Synthetic oligonucleotide
ggctgtccgacctggccagcatcag

SEQ ID NO: 697334 - DNA, 25 bp, Artificial sequence
  Synthetic oligonucleotide
gcgcatctcggtgcgcacctccggc

SEQ ID NO: 697335 - DNA, 25 bp, Artificial sequence
  Synthetic oligonucleotide
ctcggtgcgcacctccggcaacttc

SEQ ID NO: 697336 - DNA, 25 bp, Artificial sequence
  Synthetic oligonucleotide
gcgcacctccggcaacttccgttcg

SEQ ID NO: 697337 - DNA, 25 bp, Artificial sequence
  Synthetic oligonucleotide
cttccgttcggaaaaggacctgcag

SEQ ID NO: 697338 - DNA, 25 bp, Artificial sequence
  Synthetic oligonucleotide
ttcggaaaaggacctgcaggcggtc

SEQ ID NO: 697339 - DNA, 25 bp, Artificial sequence
  Synthetic oligonucleotide
aaaggacctgcaggcggtcaacctg

SEQ ID NO: 697340 - DNA, 25 bp, Artificial sequence
  Synthetic oligonucleotide
ctgcaggcggtcaacctgcgggtca

SEQ ID NO: 697341 - DNA, 25 bp, Artificial sequence
  Synthetic oligonucleotide
ggcggtcaacctgcgggtcaacgat

SEQ ID NO: 697342 - DNA, 25 bp, Artificial sequence
  Synthetic oligonucleotide
caacctgcgggtcaacgatcgtttc

SEQ ID NO: 697343 - DNA, 25 bp, Artificial sequence
  Synthetic oligonucleotide
tgcgggtcaacgatcgtttctaccg

SEQ ID NO: 697344 - DNA, 25 bp, Artificial sequence
  Synthetic oligonucleotide
tcaacgatcgtttctaccggctgtc

SEQ ID NO: 697345 - DNA, 25 bp, Artificial sequence
  Synthetic oligonucleotide
cggcctggcggtggcgatgaaggag

SEQ ID NO: 697346 - DNA, 25 bp, Artificial sequence
  Synthetic oligonucleotide
ttctaccggctgtccgacctggcca

SEQ ID NO: 697347 - DNA, 25 bp, Artificial sequence
  Synthetic oligonucleotide
tgttcgaggcggtggtgatcgtcct

SEQ ID NO: 697348 - DNA, 25 bp, Artificial sequence
  Synthetic oligonucleotide
ccgacctggccagcatcagccgcga

SEQ ID NO: 697349 - DNA, 25 bp, Artificial sequence
  Synthetic oligonucleotide
tggccagcatcagccgcgatttcgt

SEQ ID NO: 697350 - DNA, 25 bp, Artificial sequence
  Synthetic oligonucleotide
gcatcagccgcgatttcgtcgaccc

SEQ ID NO: 697351 - DNA, 25 bp, Artificial sequence
  Synthetic oligonucleotide
gccgcgatttcgtcgacccgccgac

SEQ ID NO: 697352 - DNA, 25 bp, Artificial sequence
  Synthetic oligonucleotide
atttcgtcgacccgccgacctcgct

SEQ ID NO: 697353 - DNA, 25 bp, Artificial sequence
  Synthetic oligonucleotide
tcgacccgccgacctcgctgttccg

SEQ ID NO: 697354 - DNA, 25 bp, Artificial sequence
  Synthetic oligonucleotide
cgccgacctcgctgttccgctacaa

SEQ ID NO: 697355 - DNA, 25 bp, Artificial sequence
  Synthetic oligonucleotide
ctcgctgttccgctacaagggcgag

SEQ ID NO: 697356 - DNA, 25 bp, Artificial sequence
  Synthetic oligonucleotide
tgttccgctacaagggcgagccggc

SEQ ID NO: 697357 - DNA, 25 bp, Artificial sequence
  Synthetic oligonucleotide
gctacaagggcgagccggccatcgg

SEQ ID NO: 697358 - DNA, 25 bp, Artificial sequence
  Synthetic oligonucleotide
agggcgagccggccatcggcctggc

SEQ ID NO: 697359 - DNA, 25 bp, Artificial sequence
  Synthetic oligonucleotide
gatcgtttctaccggctgtccgacc

SEQ ID NO: 697360 - DNA, 25 bp, Artificial sequence
  Synthetic oligonucleotide
gacctacgcctacacctcgacggcc

SEQ ID NO: 697361 - DNA, 25 bp, Artificial sequence
  Synthetic oligonucleotide
tcgccctcggcctgctggtggacga

SEQ ID NO: 697362 - DNA, 25 bp, Artificial sequence
  Synthetic oligonucleotide
ctcggcctgctggtggacgatgcca

SEQ ID NO: 697363 - DNA, 25 bp, Artificial sequence
  Synthetic oligonucleotide
ctgctggtggacgatgccatgatca

SEQ ID NO: 697364 - DNA, 25 bp, Artificial sequence
  Synthetic oligonucleotide
cgatgccatgatcaccgtggagatg

SEQ ID NO: 697365 - DNA, 25 bp, Artificial sequence
  Synthetic oligonucleotide
caccgtggagatgatgatcacgcgc

SEQ ID NO: 697366 - DNA, 25 bp, Artificial sequence
  Synthetic oligonucleotide
ggagatgatgatcacgcgcctcgaa

SEQ ID NO: 697367 - DNA, 25 bp, Artificial sequence
  Synthetic oligonucleotide
atgatcacgcgcctcgaactgggcg

SEQ ID NO: 697368 - DNA, 25 bp, Artificial sequence
  Synthetic oligonucleotide
acgcgcctcgaactgggcgactcgc

SEQ ID NO: 697369 - DNA, 25 bp, Artificial sequence
  Synthetic oligonucleotide
tcgaactgggcgactcgctacacga

SEQ ID NO: 697370 - DNA, 25 bp, Artificial sequence
  Synthetic oligonucleotide
tgggcgactcgctacacgactcggc

SEQ ID NO: 697371 - DNA, 25 bp, Artificial sequence
  Synthetic oligonucleotide
actcgctacacgactcggcgaccta

SEQ ID NO: 697372 - DNA, 25 bp, Artificial sequence
  Synthetic oligonucleotide
tcacccgggcgctgttcgaggcggt

SEQ ID NO: 697373 - DNA, 25 bp, Artificial sequence
  Synthetic oligonucleotide
ctcggcgacctacgcctacacctcg

SEQ ID NO: 697374 - DNA, 25 bp, Artificial sequence
  Synthetic oligonucleotide
ccctcggcgcgctgatcatcgccct

SEQ ID NO: 697375 - DNA, 25 bp, Artificial sequence
  Synthetic oligonucleotide
cgcctacacctcgacggccttcccg

SEQ ID NO: 697376 - DNA, 25 bp, Artificial sequence
  Synthetic oligonucleotide
cacctcgacggccttcccgatgctc

SEQ ID NO: 697377 - DNA, 25 bp, Artificial sequence
  Synthetic oligonucleotide
gacggccttcccgatgctcaccggg

SEQ ID NO: 697378 - DNA, 25 bp, Artificial sequence
  Synthetic oligonucleotide
cttcccgatgctcaccgggaccctg

SEQ ID NO: 697379 - DNA, 25 bp, Artificial sequence
  Synthetic oligonucleotide
gatgctcaccgggaccctggtgacg

SEQ ID NO: 697380 - DNA, 25 bp, Artificial sequence
  Synthetic oligonucleotide
tcaccgggaccctggtgacggtggc

SEQ ID NO: 697381 - DNA, 25 bp, Artificial sequence
  Synthetic oligonucleotide
gaccctggtgacggtggccggcttc

SEQ ID NO: 697382 - DNA, 25 bp, Artificial sequence
  Synthetic oligonucleotide
gtgacggtggccggcttcgtaccca

SEQ ID NO: 697383 - DNA, 25 bp, Artificial sequence
  Synthetic oligonucleotide
tggccggcttcgtacccatcgggct

SEQ ID NO: 697384 - DNA, 25 bp, Artificial sequence
  Synthetic oligonucleotide
ggcttcgtacccatcgggctcaacg

SEQ ID NO: 697385 - DNA, 25 bp, Artificial sequence
  Synthetic oligonucleotide
gtacccatcgggctcaacgccagct

SEQ ID NO: 697386 - DNA, 25 bp, Artificial sequence
  Synthetic oligonucleotide
acacgactcggcgacctacgcctac

SEQ ID NO: 697387 - DNA, 25 bp, Artificial sequence
  Synthetic oligonucleotide
ctcgatcccgctggtgctggcgatg

SEQ ID NO: 697388 - DNA, 25 bp, Artificial sequence
  Synthetic oligonucleotide
ggtcgaggccggccccgagcgcatc

SEQ ID NO: 697389 - DNA, 25 bp, Artificial sequence
  Synthetic oligonucleotide
aggcggtggtgatcgtcctcatcgt

SEQ ID NO: 697390 - DNA, 25 bp, Artificial sequence
  Synthetic oligonucleotide
tggtgatcgtcctcatcgtcagctt

SEQ ID NO: 697391 - DNA, 25 bp, Artificial sequence
  Synthetic oligonucleotide
tcgtcctcatcgtcagcttcgtcag

SEQ ID NO: 697392 - DNA, 25 bp, Artificial sequence
  Synthetic oligonucleotide
tcatcgtcagcttcgtcagcctcgg

SEQ ID NO: 697393 - DNA, 25 bp, Artificial sequence
  Synthetic oligonucleotide
gtcagcttcgtcagcctcggcctgc

SEQ ID NO: 697394 - DNA, 25 bp, Artificial sequence
  Synthetic oligonucleotide
ttcgtcagcctcggcctgcgcgccg

SEQ ID NO: 697395 - DNA, 25 bp, Artificial sequence
  Synthetic oligonucleotide
agcctcggcctgcgcgccgggctgg

SEQ ID NO: 697396 - DNA, 25 bp, Artificial sequence
  Synthetic oligonucleotide
ggcctgcgcgccgggctggtggtgg

SEQ ID NO: 697397 - DNA, 25 bp, Artificial sequence
  Synthetic oligonucleotide
cgcgccgggctggtggtggcctgct

SEQ ID NO: 697398 - DNA, 25 bp, Artificial sequence
  Synthetic oligonucleotide
cgggctggtggtggcctgctcgatc

SEQ ID NO: 697399 - DNA, 25 bp, Artificial sequence
  Synthetic oligonucleotide
tgatcatcgccctcggcctgctggt

SEQ ID NO: 697400 - DNA, 25 bp, Artificial sequence
  Synthetic oligonucleotide
tggcctgctcgatcccgctggtgct

SEQ ID NO: 697401 - DNA, 25 bp, Artificial sequence
  Synthetic oligonucleotide
gcgcgctgatcatcgccctcggcct

SEQ ID NO: 697402 - DNA, 25 bp, Artificial sequence
  Synthetic oligonucleotide
cccgctggtgctggcgatggtcttc

SEQ ID NO: 697403 - DNA, 25 bp, Artificial sequence
  Synthetic oligonucleotide
ggtgctggcgatggtcttcgtgttc

SEQ ID NO: 697404 - DNA, 25 bp, Artificial sequence
  Synthetic oligonucleotide
ggcgatggtcttcgtgttcatggaa

SEQ ID NO: 697405 - DNA, 25 bp, Artificial sequence
  Synthetic oligonucleotide
ggtcttcgtgttcatggaatacacc

SEQ ID NO: 697406 - DNA, 25 bp, Artificial sequence
  Synthetic oligonucleotide
cgtgttcatggaatacaccgacatc

SEQ ID NO: 697407 - DNA, 25 bp, Artificial sequence
  Synthetic oligonucleotide
tcatggaatacaccgacatcaccat

SEQ ID NO: 697408 - DNA, 25 bp, Artificial sequence
  Synthetic oligonucleotide
aatacaccgacatcaccatgcagcg

SEQ ID NO: 697409 - DNA, 25 bp, Artificial sequence
  Synthetic oligonucleotide
ccgacatcaccatgcagcgggtttc

SEQ ID NO: 697410 - DNA, 25 bp, Artificial sequence
  Synthetic oligonucleotide
tcaccatgcagcgggtttccctcgg

SEQ ID NO: 697411 - DNA, 25 bp, Artificial sequence
  Synthetic oligonucleotide
atgcagcgggtttccctcggcgcgc

SEQ ID NO: 697412 - DNA, 25 bp, Artificial sequence
  Synthetic oligonucleotide
gggtttccctcggcgcgctgatcat

SEQ ID NO: 697413 - DNA, 25 bp, Artificial sequence
  Synthetic oligonucleotide
gggcgctgttcgaggcggtggtgat

SEQ ID NO: 697414 - DNA, 25 bp, Artificial sequence
  Synthetic oligonucleotide
tggtggtggcctgctcgatcccgct

SEQ ID NO: 697415 - DNA, 25 bp, Artificial sequence
  Synthetic oligonucleotide
ctggattacgtgaagagctacacgc

SEQ ID NO: 697416 - DNA, 25 bp, Artificial sequence
  Synthetic oligonucleotide
ctggccgggcgccacggtggacgac

SEQ ID NO: 697417 - DNA, 25 bp, Artificial sequence
  Synthetic oligonucleotide
gggcgccacggtggacgacaccctg

SEQ ID NO: 697418 - DNA, 25 bp, Artificial sequence
  Synthetic oligonucleotide
cacggtggacgacaccctggagcag

SEQ ID NO: 697419 - DNA, 25 bp, Artificial sequence
  Synthetic oligonucleotide
tggacgacaccctggagcaggtcac

SEQ ID NO: 697420 - DNA, 25 bp, Artificial sequence
  Synthetic oligonucleotide
acaccctggagcaggtcaccgaccg

SEQ ID NO: 697421 - DNA, 25 bp, Artificial sequence
  Synthetic oligonucleotide
tggagcaggtcaccgaccgcatcga

SEQ ID NO: 697422 - DNA, 25 bp, Artificial sequence
  Synthetic oligonucleotide
ggtcaccgaccgcatcgagaagaag

SEQ ID NO: 697423 - DNA, 25 bp, Artificial sequence
  Synthetic oligonucleotide
gaccgcatcgagaagaagctcgagg

SEQ ID NO: 697424 - DNA, 25 bp, Artificial sequence
  Synthetic oligonucleotide
catcgagaagaagctcgaggagctg

SEQ ID NO: 697425 - DNA, 25 bp, Artificial sequence
  Synthetic oligonucleotide
aagaagctcgaggagctggactcgc

SEQ ID NO: 697426 - DNA, 25 bp, Artificial sequence
  Synthetic oligonucleotide
gctcgaggagctggactcgctggat

SEQ ID NO: 697427 - DNA, 25 bp, Artificial sequence
  Synthetic oligonucleotide
ccggcgacatcccggatatctggta

SEQ ID NO: 697428 - DNA, 25 bp, Artificial sequence
  Synthetic oligonucleotide
gactcgctggattacgtgaagagct

SEQ ID NO: 697429 - DNA, 25 bp, Artificial sequence
  Synthetic oligonucleotide
catgatcaccgtggagatgatgatc

SEQ ID NO: 697430 - DNA, 25 bp, Artificial sequence
  Synthetic oligonucleotide
tacgtgaagagctacacgcgacccg

SEQ ID NO: 697431 - DNA, 25 bp, Artificial sequence
  Synthetic oligonucleotide
aagagctacacgcgacccggcgaat

SEQ ID NO: 697432 - DNA, 25 bp, Artificial sequence
  Synthetic oligonucleotide
tacacgcgacccggcgaatcgacgg

SEQ ID NO: 697433 - DNA, 25 bp, Artificial sequence
  Synthetic oligonucleotide
cgacccggcgaatcgacggtcttcg

SEQ ID NO: 697434 - DNA, 25 bp, Artificial sequence
  Synthetic oligonucleotide
ggcgaatcgacggtcttcgtctacc

SEQ ID NO: 697435 - DNA, 25 bp, Artificial sequence
  Synthetic oligonucleotide
tcgacggtcttcgtctacctcaagg

SEQ ID NO: 697436 - DNA, 25 bp, Artificial sequence
  Synthetic oligonucleotide
gtcttcgtctacctcaaggacacca

SEQ ID NO: 697437 - DNA, 25 bp, Artificial sequence
  Synthetic oligonucleotide
gtctacctcaaggacaccaccaagg

SEQ ID NO: 697438 - DNA, 25 bp, Artificial sequence
  Synthetic oligonucleotide
tcaaggacaccaccaaggccggcga

SEQ ID NO: 697439 - DNA, 25 bp, Artificial sequence
  Synthetic oligonucleotide
acaccaccaaggccggcgacatccc

SEQ ID NO: 697440 - DNA, 25 bp, Artificial sequence
  Synthetic oligonucleotide
ccccgagcgcatctcggtgcgcacc

SEQ ID NO: 697441 - DNA, 25 bp, Artificial sequence
  Synthetic oligonucleotide
gagctggactcgctggattacgtga

SEQ ID NO: 697442 - DNA, 25 bp, Artificial sequence
  Synthetic oligonucleotide
tatcgctggtgatgggcgtgttctc

SEQ ID NO: 697443 - DNA, 25 bp, Artificial sequence
  Synthetic oligonucleotide
tccagtggcggggcggcgctgaaga

SEQ ID NO: 697444 - DNA, 25 bp, Artificial sequence
  Synthetic oligonucleotide
gatgaagggcggtttcaacctgtcg

SEQ ID NO: 697445 - DNA, 25 bp, Artificial sequence
  Synthetic oligonucleotide
agggcggtttcaacctgtcggactg

SEQ ID NO: 697446 - DNA, 25 bp, Artificial sequence
  Synthetic oligonucleotide
tttcaacctgtcggactgggccctg

SEQ ID NO: 697447 - DNA, 25 bp, Artificial sequence
  Synthetic oligonucleotide
acctgtcggactgggccctgcgcca

SEQ ID NO: 697448 - DNA, 25 bp, Artificial sequence
  Synthetic oligonucleotide
cggactgggccctgcgccaccagtc

SEQ ID NO: 697449 - DNA, 25 bp, Artificial sequence
  Synthetic oligonucleotide
gggccctgcgccaccagtccctggt

SEQ ID NO: 697450 - DNA, 25 bp, Artificial sequence
  Synthetic oligonucleotide
tgcgccaccagtccctggtctggta

SEQ ID NO: 697451 - DNA, 25 bp, Artificial sequence
  Synthetic oligonucleotide
accagtccctggtctggtacctgat

SEQ ID NO: 697452 - DNA, 25 bp, Artificial sequence
  Synthetic oligonucleotide
ccctggtctggtacctgatggcggt

SEQ ID NO: 697453 - DNA, 25 bp, Artificial sequence
  Synthetic oligonucleotide
tctggtacctgatggcggtatcgct

SEQ ID NO: 697454 - DNA, 25 bp, Artificial sequence
  Synthetic oligonucleotide
cgttgctgccgaccggcacgccgat

SEQ ID NO: 697455 - DNA, 25 bp, Artificial sequence
  Synthetic oligonucleotide
tggcggtatcgctggtgatgggcgt

SEQ ID NO: 697456 - DNA, 25 bp, Artificial sequence
  Synthetic oligonucleotide
catccagacccgctggccgggcgcc

SEQ ID NO: 697457 - DNA, 25 bp, Artificial sequence
  Synthetic oligonucleotide
tggtgatgggcgtgttctcctacct

SEQ ID NO: 697458 - DNA, 25 bp, Artificial sequence
  Synthetic oligonucleotide
tgggcgtgttctcctacctcaacct

SEQ ID NO: 697459 - DNA, 25 bp, Artificial sequence
  Synthetic oligonucleotide
tgttctcctacctcaacctggggcg

SEQ ID NO: 697460 - DNA, 25 bp, Artificial sequence
  Synthetic oligonucleotide
cctacctcaacctggggcgcgagga

SEQ ID NO: 697461 - DNA, 25 bp, Artificial sequence
  Synthetic oligonucleotide
tcaacctggggcgcgaggaggatcc

SEQ ID NO: 697462 - DNA, 25 bp, Artificial sequence
  Synthetic oligonucleotide
tggggcgcgaggaggatccctcgtt

SEQ ID NO: 697463 - DNA, 25 bp, Artificial sequence
  Synthetic oligonucleotide
gcgaggaggatccctcgttcgccat

SEQ ID NO: 697464 - DNA, 25 bp, Artificial sequence
  Synthetic oligonucleotide
aggatccctcgttcgccatcaagac

SEQ ID NO: 697465 - DNA, 25 bp, Artificial sequence
  Synthetic oligonucleotide
cctcgttcgccatcaagaccatggt

SEQ ID NO: 697466 - DNA, 25 bp, Artificial sequence
  Synthetic oligonucleotide
tcgccatcaagaccatggtcatcca

SEQ ID NO: 697467 - DNA, 25 bp, Artificial sequence
  Synthetic oligonucleotide
tcaagaccatggtcatccagacccg

SEQ ID NO: 697468 - DNA, 25 bp, Artificial sequence
  Synthetic oligonucleotide
acatcccggatatctggtaccaggt

SEQ ID NO: 697469 - DNA, 25 bp, Artificial sequence
  Synthetic oligonucleotide
acctgatggcggtatcgctggtgat

SEQ ID NO: 697470 - DNA, 25 bp, Artificial sequence
  Synthetic oligonucleotide
ccgccctcggtctcgaccagcgcca

SEQ ID NO: 697471 - DNA, 25 bp, Artificial sequence
  Synthetic oligonucleotide
gaaagacctgggcaaggtgcagatg

SEQ ID NO: 697472 - DNA, 25 bp, Artificial sequence
  Synthetic oligonucleotide
cctgggcaaggtgcagatgatcggt

SEQ ID NO: 697473 - DNA, 25 bp, Artificial sequence
  Synthetic oligonucleotide
caaggtgcagatgatcggtgcgcag

SEQ ID NO: 697474 - DNA, 25 bp, Artificial sequence
  Synthetic oligonucleotide
tgcagatgatcggtgcgcagaacga

SEQ ID NO: 697475 - DNA, 25 bp, Artificial sequence
  Synthetic oligonucleotide
tgatcggtgcgcagaacgaggtcat

SEQ ID NO: 697476 - DNA, 25 bp, Artificial sequence
  Synthetic oligonucleotide
gtgcgcagaacgaggtcatctacct

SEQ ID NO: 697477 - DNA, 25 bp, Artificial sequence
  Synthetic oligonucleotide
agaacgaggtcatctacctcaactt

SEQ ID NO: 697478 - DNA, 25 bp, Artificial sequence
  Synthetic oligonucleotide
aggtcatctacctcaacttctctac

SEQ ID NO: 697479 - DNA, 25 bp, Artificial sequence
  Synthetic oligonucleotide
tctacctcaacttctctacccgcaa

SEQ ID NO: 697480 - DNA, 25 bp, Artificial sequence
  Synthetic oligonucleotide
tcaacttctctacccgcaagctggc

SEQ ID NO: 697481 - DNA, 25 bp, Artificial sequence
  Synthetic oligonucleotide
tctctacccgcaagctggccgccct

SEQ ID NO: 697482 - DNA, 25 bp, Artificial sequence
  Synthetic oligonucleotide
ccaaggccggcgacatcccggatat

SEQ ID NO: 697483 - DNA, 25 bp, Artificial sequence
  Synthetic oligonucleotide
agctggccgccctcggtctcgacca

SEQ ID NO: 697484 - DNA, 25 bp, Artificial sequence
  Synthetic oligonucleotide
aaggtgcgcctggacatccgctcgg

SEQ ID NO: 697485 - DNA, 25 bp, Artificial sequence
  Synthetic oligonucleotide
tcggtctcgaccagcgccaggtcgt

SEQ ID NO: 697486 - DNA, 25 bp, Artificial sequence
  Synthetic oligonucleotide
tcgaccagcgccaggtcgtgcagag

SEQ ID NO: 697487 - DNA, 25 bp, Artificial sequence
  Synthetic oligonucleotide
gcgccaggtcgtgcagagcctgcag

SEQ ID NO: 697488 - DNA, 25 bp, Artificial sequence
  Synthetic oligonucleotide
aggtcgtgcagagcctgcaggcgca

SEQ ID NO: 697489 - DNA, 25 bp, Artificial sequence
  Synthetic oligonucleotide
tgcagagcctgcaggcgcagaacgc

SEQ ID NO: 697490 - DNA, 25 bp, Artificial sequence
  Synthetic oligonucleotide
gcctgcaggcgcagaacgcggtgac

SEQ ID NO: 697491 - DNA, 25 bp, Artificial sequence
  Synthetic oligonucleotide
aggcgcagaacgcggtgaccccgtc

SEQ ID NO: 697492 - DNA, 25 bp, Artificial sequence
  Synthetic oligonucleotide
cagaacgcggtgaccccgtccggcg

SEQ ID NO: 697493 - DNA, 25 bp, Artificial sequence
  Synthetic oligonucleotide
tgaccccgtccggcgtggtcgaggc

SEQ ID NO: 697494 - DNA, 25 bp, Artificial sequence
  Synthetic oligonucleotide
cggcgtggtcgaggccggccccgag

SEQ ID NO: 697495 - DNA, 25 bp, Artificial sequence
  Synthetic oligonucleotide
gacccgctggccgggcgccacggtg

SEQ ID NO: 697496 - DNA, 25 bp, Artificial sequence
  Synthetic oligonucleotide
cccgcaagctggccgccctcggtct

SEQ ID NO: 697497 - DNA, 25 bp, Artificial sequence
  Synthetic oligonucleotide
gacgtgttcggcagcgtctacgcct

SEQ ID NO: 697498 - DNA, 25 bp, Artificial sequence
  Synthetic oligonucleotide
cggatatctggtaccaggtgcgcaa

SEQ ID NO: 697499 - DNA, 25 bp, Artificial sequence
  Synthetic oligonucleotide
tctggtaccaggtgcgcaagaagat

SEQ ID NO: 697500 - DNA, 25 bp, Artificial sequence
  Synthetic oligonucleotide
accaggtgcgcaagaagatatccga

SEQ ID NO: 697501 - DNA, 25 bp, Artificial sequence
  Synthetic oligonucleotide
tgcgcaagaagatatccgacatcca

SEQ ID NO: 697502 - DNA, 25 bp, Artificial sequence
  Synthetic oligonucleotide
agaagatatccgacatccagggcga

SEQ ID NO: 697503 - DNA, 25 bp, Artificial sequence
  Synthetic oligonucleotide
tatccgacatccagggcgaattccc

SEQ ID NO: 697504 - DNA, 25 bp, Artificial sequence
  Synthetic oligonucleotide
acatccagggcgaattcccccaggg

SEQ ID NO: 697505 - DNA, 25 bp, Artificial sequence
  Synthetic oligonucleotide
agggcgaattcccccagggcatcca

SEQ ID NO: 697506 - DNA, 25 bp, Artificial sequence
  Synthetic oligonucleotide
gaattcccccagggcatccagggac

SEQ ID NO: 697507 - DNA, 25 bp, Artificial sequence
  Synthetic oligonucleotide
cagggcatccagggaccgggtttca

SEQ ID NO: 697508 - DNA, 25 bp, Artificial sequence
  Synthetic oligonucleotide
tttcaacgacgagttcggcgacgtg

SEQ ID NO: 697509 - DNA, 25 bp, Artificial sequence
  Synthetic oligonucleotide
gacatccgctcggtgaaagacctgg

SEQ ID NO: 697510 - DNA, 25 bp, Artificial sequence
  Synthetic oligonucleotide
ttcggcgacgtgttcggcagcgtct

SEQ ID NO: 697511 - DNA, 25 bp, Artificial sequence
  Synthetic oligonucleotide
cgcctggacatccgctcggtgaaag

SEQ ID NO: 697512 - DNA, 25 bp, Artificial sequence
  Synthetic oligonucleotide
tcggcagcgtctacgccttcaccgc

SEQ ID NO: 697513 - DNA, 25 bp, Artificial sequence
  Synthetic oligonucleotide
gcgtctacgccttcaccgccgatgg

SEQ ID NO: 697514 - DNA, 25 bp, Artificial sequence
  Synthetic oligonucleotide
acgccttcaccgccgatggcctgga

SEQ ID NO: 697515 - DNA, 25 bp, Artificial sequence
  Synthetic oligonucleotide
ttcaccgccgatggcctggacttcc

SEQ ID NO: 697516 - DNA, 25 bp, Artificial sequence
  Synthetic oligonucleotide
gccgatggcctggacttccgccagc

SEQ ID NO: 697517 - DNA, 25 bp, Artificial sequence
  Synthetic oligonucleotide
ggcctggacttccgccagctgcgcg

SEQ ID NO: 697518 - DNA, 25 bp, Artificial sequence
  Synthetic oligonucleotide
gacttccgccagctgcgcgactacg

SEQ ID NO: 697519 - DNA, 25 bp, Artificial sequence
  Synthetic oligonucleotide
cgccagctgcgcgactacgtggaga

SEQ ID NO: 697520 - DNA, 25 bp, Artificial sequence
  Synthetic oligonucleotide
ctgcgcgactacgtggagaaggtgc

SEQ ID NO: 697521 - DNA, 25 bp, Artificial sequence
  Synthetic oligonucleotide
gactacgtggagaaggtgcgcctgg

SEQ ID NO: 697522 - DNA, 25 bp, Artificial sequence
  Synthetic oligonucleotide
gtggagaaggtgcgcctggacatcc

SEQ ID NO: 697523 - DNA, 25 bp, Artificial sequence
  Synthetic oligonucleotide
ggccggccccgagcgcatctcggtg

SEQ ID NO: 697524 - DNA, 25 bp, Artificial sequence
  Synthetic oligonucleotide
gacgagttcggcgacgtgttcggca

SEQ ID NO: 697525 - DNA, 25 bp, Artificial sequence
  Synthetic oligonucleotide
tggagaccctggagagcctgcagat

SEQ ID NO: 697526 - DNA, 25 bp, Artificial sequence
  Synthetic oligonucleotide
gcgcggtgacccaggtgcgcgacga

SEQ ID NO: 697527 - DNA, 25 bp, Artificial sequence
  Synthetic oligonucleotide
tgacccaggtgcgcgacgacatcta

SEQ ID NO: 697528 - DNA, 25 bp, Artificial sequence
  Synthetic oligonucleotide
aggtgcgcgacgacatctacctggt

SEQ ID NO: 697529 - DNA, 25 bp, Artificial sequence
  Synthetic oligonucleotide
gcgacgacatctacctggtgaacgt

SEQ ID NO: 697530 - DNA, 25 bp, Artificial sequence
  Synthetic oligonucleotide
acatctacctggtgaacgtcatcgg

SEQ ID NO: 697531 - DNA, 25 bp, Artificial sequence
  Synthetic oligonucleotide
acctggtgaacgtcatcggccgcgc

SEQ ID NO: 697532 - DNA, 25 bp, Artificial sequence
  Synthetic oligonucleotide
tgaacgtcatcggccgcgccgagga

SEQ ID NO: 697533 - DNA, 25 bp, Artificial sequence
  Synthetic oligonucleotide
tcatcggccgcgccgaggatagcga

SEQ ID NO: 697534 - DNA, 25 bp, Artificial sequence
  Synthetic oligonucleotide
gccgcgccgaggatagcgagcgcgg

SEQ ID NO: 697535 - DNA, 25 bp, Artificial sequence
  Synthetic oligonucleotide
ccgaggatagcgagcgcggctcgct

SEQ ID NO: 697536 - DNA, 25 bp, Artificial sequence
  Synthetic oligonucleotide
tagcgagcgcggctcgctggagacc

SEQ ID NO: 697537 - DNA, 25 bp, Artificial sequence
  Synthetic oligonucleotide
agctacgagctggagcagccgctgg

SEQ ID NO: 697538 - DNA, 25 bp, Artificial sequence
  Synthetic oligonucleotide
gctcgctggagaccctggagagcct

SEQ ID NO: 697539 - DNA, 25 bp, Artificial sequence
  Synthetic oligonucleotide
acagcgtggtgaccggcagcgcggt

SEQ ID NO: 697540 - DNA, 25 bp, Artificial sequence
  Synthetic oligonucleotide
ccctggagagcctgcagatcgtcac

SEQ ID NO: 697541 - DNA, 25 bp, Artificial sequence
  Synthetic oligonucleotide
agagcctgcagatcgtcacgcccag

SEQ ID NO: 697542 - DNA, 25 bp, Artificial sequence
  Synthetic oligonucleotide
tgcagatcgtcacgcccagcggcac

SEQ ID NO: 697543 - DNA, 25 bp, Artificial sequence
  Synthetic oligonucleotide
tcgtcacgcccagcggcacctcgat

SEQ ID NO: 697544 - DNA, 25 bp, Artificial sequence
  Synthetic oligonucleotide
gcccagcggcacctcgatcccgctc

SEQ ID NO: 697545 - DNA, 25 bp, Artificial sequence
  Synthetic oligonucleotide
cggcacctcgatcccgctcaaggcg

SEQ ID NO: 697546 - DNA, 25 bp, Artificial sequence
  Synthetic oligonucleotide
ctcgatcccgctcaaggcgttcgcc

SEQ ID NO: 697547 - DNA, 25 bp, Artificial sequence
  Synthetic oligonucleotide
ccgctcaaggcgttcgccaaggtca

SEQ ID NO: 697548 - DNA, 25 bp, Artificial sequence
  Synthetic oligonucleotide
aaggcgttcgccaaggtcagctacg

SEQ ID NO: 697549 - DNA, 25 bp, Artificial sequence
  Synthetic oligonucleotide
ttcgccaaggtcagctacgagctgg

SEQ ID NO: 697550 - DNA, 25 bp, Artificial sequence
  Synthetic oligonucleotide
gagtacgccatgggcctggccggcg

SEQ ID NO: 697551 - DNA, 25 bp, Artificial sequence
  Synthetic oligonucleotide
gcgcggctcgctggagaccctggag

SEQ ID NO: 697552 - DNA, 25 bp, Artificial sequence
  Synthetic oligonucleotide
gctcaagatcgacatcgcccaggac

SEQ ID NO: 697553 - DNA, 25 bp, Artificial sequence
  Synthetic oligonucleotide
ccatgggcctggccggcgtgctcga

SEQ ID NO: 697554 - DNA, 25 bp, Artificial sequence
  Synthetic oligonucleotide
gcctggccggcgtgctcgacggcaa

SEQ ID NO: 697555 - DNA, 25 bp, Artificial sequence
  Synthetic oligonucleotide
ccggcgtgctcgacggcaacccgaa

SEQ ID NO: 697556 - DNA, 25 bp, Artificial sequence
  Synthetic oligonucleotide
tgctcgacggcaacccgaacatcgg

SEQ ID NO: 697557 - DNA, 25 bp, Artificial sequence
  Synthetic oligonucleotide
acggcaacccgaacatcggcgatat

SEQ ID NO: 697558 - DNA, 25 bp, Artificial sequence
  Synthetic oligonucleotide
acccgaacatcggcgatatcgtcta

SEQ ID NO: 697559 - DNA, 25 bp, Artificial sequence
  Synthetic oligonucleotide
acatcggcgatatcgtctacgactg

SEQ ID NO: 697560 - DNA, 25 bp, Artificial sequence
  Synthetic oligonucleotide
gcgatatcgtctacgactggaacga

SEQ ID NO: 697561 - DNA, 25 bp, Artificial sequence
  Synthetic oligonucleotide
tcgtctacgactggaacgagcccgg

SEQ ID NO: 697562 - DNA, 25 bp, Artificial sequence
  Synthetic oligonucleotide
acgactggaacgagcccgggaagat

SEQ ID NO: 697563 - DNA, 25 bp, Artificial sequence
  Synthetic oligonucleotide
gaacgagcccgggaagatgctcaag

SEQ ID NO: 697564 - DNA, 25 bp, Artificial sequence
  Synthetic oligonucleotide
ccggcagcgcggtgacccaggtgcg

SEQ ID NO: 697565 - DNA, 25 bp, Artificial sequence
  Synthetic oligonucleotide
gaagatgctcaagatcgacatcgcc

SEQ ID NO: 697566 - DNA, 25 bp, Artificial sequence
  Synthetic oligonucleotide
tggtgaccggcagcgcggtgaccca

SEQ ID NO: 697567 - DNA, 25 bp, Artificial sequence
  Synthetic oligonucleotide
gatcgacatcgcccaggacaaggcg

SEQ ID NO: 697568 - DNA, 25 bp, Artificial sequence
  Synthetic oligonucleotide
catcgcccaggacaaggcgcgccag

SEQ ID NO: 697569 - DNA, 25 bp, Artificial sequence
  Synthetic oligonucleotide
caggacaaggcgcgccagctcgggc

SEQ ID NO: 697570 - DNA, 25 bp, Artificial sequence
  Synthetic oligonucleotide
aaggcgcgccagctcgggctttcct

SEQ ID NO: 697571 - DNA, 25 bp, Artificial sequence
  Synthetic oligonucleotide
gccagctcgggctttcctccgagga

SEQ ID NO: 697572 - DNA, 25 bp, Artificial sequence
  Synthetic oligonucleotide
tcgggctttcctccgaggacgtggc

SEQ ID NO: 697573 - DNA, 25 bp, Artificial sequence
  Synthetic oligonucleotide
tttcctccgaggacgtggcgcagat

SEQ ID NO: 697574 - DNA, 25 bp, Artificial sequence
  Synthetic oligonucleotide
cgaggacgtggcgcagatcatgaac

SEQ ID NO: 697575 - DNA, 25 bp, Artificial sequence
  Synthetic oligonucleotide
cgtggcgcagatcatgaacagcgtg

SEQ ID NO: 697576 - DNA, 25 bp, Artificial sequence
  Synthetic oligonucleotide
gcagatcatgaacagcgtggtgacc

SEQ ID NO: 697577 - DNA, 25 bp, Artificial sequence
  Synthetic oligonucleotide
catgaacagcgtggtgaccggcagc

SEQ ID NO: 697578 - DNA, 25 bp, Artificial sequence
  Synthetic oligonucleotide
gagctggagcagccgctggtgtggc

SEQ ID NO: 697579 - DNA, 25 bp, Artificial sequence
  Synthetic oligonucleotide
gcccgggaagatgctcaagatcgac

SEQ ID NO: 697580 - DNA, 25 bp, Artificial sequence
  Synthetic oligonucleotide
gcagaagctattcctggtggccagc

SEQ ID NO: 697581 - DNA, 25 bp, Artificial sequence
  Synthetic oligonucleotide
gagagcggcaaggccgagggcccga

SEQ ID NO: 697582 - DNA, 25 bp, Artificial sequence
  Synthetic oligonucleotide
gcaaggccgagggcccgatcgccaa

SEQ ID NO: 697583 - DNA, 25 bp, Artificial sequence
  Synthetic oligonucleotide
ccgagggcccgatcgccaaggtggt

SEQ ID NO: 697584 - DNA, 25 bp, Artificial sequence
  Synthetic oligonucleotide
gcccgatcgccaaggtggtgccgct

SEQ ID NO: 697585 - DNA, 25 bp, Artificial sequence
  Synthetic oligonucleotide
tcgccaaggtggtgccgctgatgct

SEQ ID NO: 697586 - DNA, 25 bp, Artificial sequence
  Synthetic oligonucleotide
aggtggtgccgctgatgctgttcct

SEQ ID NO: 697587 - DNA, 25 bp, Artificial sequence
  Synthetic oligonucleotide
tgccgctgatgctgttcctcatggc

SEQ ID NO: 697588 - DNA, 25 bp, Artificial sequence
  Synthetic oligonucleotide
tgatgctgttcctcatggcgacctt

SEQ ID NO: 697589 - DNA, 25 bp, Artificial sequence
  Synthetic oligonucleotide
gttcctcatggcgaccttcctgatg

SEQ ID NO: 697590 - DNA, 25 bp, Artificial sequence
  Synthetic oligonucleotide
catggcgaccttcctgatgatccag

SEQ ID NO: 697591 - DNA, 25 bp, Artificial sequence
  Synthetic oligonucleotide
gaccttcctgatgatccagttgcag

SEQ ID NO: 697592 - DNA, 25 bp, Artificial sequence
  Synthetic oligonucleotide
aaggtcagctacgagctggagcagc

SEQ ID NO: 697593 - DNA, 25 bp, Artificial sequence
  Synthetic oligonucleotide
gagcgtgcagaagctattcctggtg

SEQ ID NO: 697594 - DNA, 25 bp, Artificial sequence
  Synthetic oligonucleotide
gtgggcggcacggtggaggagagcg

SEQ ID NO: 697595 - DNA, 25 bp, Artificial sequence
  Synthetic oligonucleotide
gctattcctggtggccagcgtcgcg

SEQ ID NO: 697596 - DNA, 25 bp, Artificial sequence
  Synthetic oligonucleotide
tcctggtggccagcgtcgcgccgct

SEQ ID NO: 697597 - DNA, 25 bp, Artificial sequence
  Synthetic oligonucleotide
tggccagcgtcgcgccgctggggct

SEQ ID NO: 697598 - DNA, 25 bp, Artificial sequence
  Synthetic oligonucleotide
gcgtcgcgccgctggggctgatcgg

SEQ ID NO: 697599 - DNA, 25 bp, Artificial sequence
  Synthetic oligonucleotide
cgccgctggggctgatcggggtggt

SEQ ID NO: 697600 - DNA, 25 bp, Artificial sequence
  Synthetic oligonucleotide
tggggctgatcggggtggtcgcggc

SEQ ID NO: 697601 - DNA, 25 bp, Artificial sequence
  Synthetic oligonucleotide
tgatcggggtggtcgcggcgttgct

SEQ ID NO: 697602 - DNA, 25 bp, Artificial sequence
  Synthetic oligonucleotide
ggtggtcgcggcgttgctgccgacc

SEQ ID NO: 697603 - DNA, 25 bp, Artificial sequence
  Synthetic oligonucleotide
tcgcggcgttgctgccgaccggcac

SEQ ID NO: 697604 - DNA, 25 bp, Artificial sequence
  Synthetic oligonucleotide
ctcaacgccagctccgccggcgagt

SEQ ID NO: 697605 - DNA, 25 bp, Artificial sequence
  Synthetic oligonucleotide
ccatggtcatccagacccgctggcc

SEQ ID NO: 697606 - DNA, 25 bp, Artificial sequence
  Synthetic oligonucleotide
gatccagttgcagagcgtgcagaag

SEQ ID NO: 697607 - DNA, 25 bp, Artificial sequence
  Synthetic oligonucleotide
ccgacctggtcgcccggctggcgcc

SEQ ID NO: 697608 - DNA, 25 bp, Artificial sequence
  Synthetic oligonucleotide
gagcagccgctggtgtggcgccgcg

SEQ ID NO: 697609 - DNA, 25 bp, Artificial sequence
  Synthetic oligonucleotide
cgctggtgtggcgccgcgaccgcaa

SEQ ID NO: 697610 - DNA, 25 bp, Artificial sequence
  Synthetic oligonucleotide
tgtggcgccgcgaccgcaagccgac

SEQ ID NO: 697611 - DNA, 25 bp, Artificial sequence
  Synthetic oligonucleotide
gccgcgaccgcaagccgacgatcac

SEQ ID NO: 697612 - DNA, 25 bp, Artificial sequence
  Synthetic oligonucleotide
accgcaagccgacgatcacggtgaa

SEQ ID NO: 697613 - DNA, 25 bp, Artificial sequence
  Synthetic oligonucleotide
aagccgacgatcacggtgaaggcgt

SEQ ID NO: 697614 - DNA, 25 bp, Artificial sequence
  Synthetic oligonucleotide
acgatcacggtgaaggcgtcgctgc

SEQ ID NO: 697615 - DNA, 25 bp, Artificial sequence
  Synthetic oligonucleotide
acggtgaaggcgtcgctgcgcggcg

SEQ ID NO: 697616 - DNA, 25 bp, Artificial sequence
  Synthetic oligonucleotide
gaaggcgtcgctgcgcggcgagatc

SEQ ID NO: 697617 - DNA, 25 bp, Artificial sequence
  Synthetic oligonucleotide
tcgctgcgcggcgagatccagccca

SEQ ID NO: 697618 - DNA, 25 bp, Artificial sequence
  Synthetic oligonucleotide
gcggcgagatccagcccaccgacct

SEQ ID NO: 697619 - DNA, 25 bp, Artificial sequence
  Synthetic oligonucleotide
gtggaggagagcggcaaggccgagg

SEQ ID NO: 697620 - DNA, 25 bp, Artificial sequence
  Synthetic oligonucleotide
agcccaccgacctggtcgcccggct

SEQ ID NO: 697621 - DNA, 25 bp, Artificial sequence
  Synthetic oligonucleotide
ggcacggtggaggagagcggcaagg

SEQ ID NO: 697622 - DNA, 25 bp, Artificial sequence
  Synthetic oligonucleotide
ggtcgcccggctggcgccggaggtc

SEQ ID NO: 697623 - DNA, 25 bp, Artificial sequence
  Synthetic oligonucleotide
cggctggcgccggaggtcaagcgct

SEQ ID NO: 697624 - DNA, 25 bp, Artificial sequence
  Synthetic oligonucleotide
gcgccggaggtcaagcgcttcgccg

SEQ ID NO: 697625 - DNA, 25 bp, Artificial sequence
  Synthetic oligonucleotide
gaggtcaagcgcttcgccgacggcc

SEQ ID NO: 697626 - DNA, 25 bp, Artificial sequence
  Synthetic oligonucleotide
aagcgcttcgccgacggcctgccgg

SEQ ID NO: 697627 - DNA, 25 bp, Artificial sequence
  Synthetic oligonucleotide
ttcgccgacggcctgccggcgaact

SEQ ID NO: 697628 - DNA, 25 bp, Artificial sequence
  Synthetic oligonucleotide
gacggcctgccggcgaactaccgga

SEQ ID NO: 697629 - DNA, 25 bp, Artificial sequence
  Synthetic oligonucleotide
ctgccggcgaactaccggatcgaag

SEQ ID NO: 697630 - DNA, 25 bp, Artificial sequence
  Synthetic oligonucleotide
gcgaactaccggatcgaagtgggcg

SEQ ID NO: 697631 - DNA, 25 bp, Artificial sequence
  Synthetic oligonucleotide
taccggatcgaagtgggcggcacgg

SEQ ID NO: 697632 - DNA, 25 bp, Artificial sequence
  Synthetic oligonucleotide
atcgaagtgggcggcacggtggagg

SEQ ID NO: 697633 - DNA, 25 bp, Artificial sequence
  Synthetic oligonucleotide
cctgatgatccagttgcagagcgtg

SEQ ID NO: 697634 - DNA, 25 bp, Artificial sequence
  Synthetic oligonucleotide
agatccagcccaccgacctggtcgc

SEQ ID NO: 697635 - DNA, 25 bp, Artificial sequence
  Synthetic oligonucleotide
tgttcctgatgaagttcgtccagca

SEQ ID NO: 697636 - DNA, 25 bp, Artificial sequence
  Synthetic oligonucleotide
ttcgacagcctgctgcacctggcga

SEQ ID NO: 697637 - DNA, 25 bp, Artificial sequence
  Synthetic oligonucleotide
agcctgctgcacctggcgatgcgcc

SEQ ID NO: 697638 - DNA, 25 bp, Artificial sequence
  Synthetic oligonucleotide
ctgcacctggcgatgcgccggcgct

SEQ ID NO: 697639 - DNA, 25 bp, Artificial sequence
  Synthetic oligonucleotide
ctggcgatgcgccggcgctggacga

SEQ ID NO: 697640 - DNA, 25 bp, Artificial sequence
  Synthetic oligonucleotide
atgcgccggcgctggacgaccatct

SEQ ID NO: 697641 - DNA, 25 bp, Artificial sequence
  Synthetic oligonucleotide
cggcgctggacgaccatcttcctca

SEQ ID NO: 697642 - DNA, 25 bp, Artificial sequence
  Synthetic oligonucleotide
tggacgaccatcttcctcaccgcgc

SEQ ID NO: 697643 - DNA, 25 bp, Artificial sequence
  Synthetic oligonucleotide
accatcttcctcaccgcgctgctgt

SEQ ID NO: 697644 - DNA, 25 bp, Artificial sequence
  Synthetic oligonucleotide
ttcctcaccgcgctgctgttcggcg

SEQ ID NO: 697645 - DNA, 25 bp, Artificial sequence
  Synthetic oligonucleotide
accgcgctgctgttcggcgtgtcgc

SEQ ID NO: 697646 - DNA, 25 bp, Artificial sequence
  Synthetic oligonucleotide
tgctgttcggcgtgtcgctgttcct

SEQ ID NO: 697647 - DNA, 25 bp, Artificial sequence
  Synthetic oligonucleotide
gcagaacagcagcatccacgagacc

SEQ ID NO: 697648 - DNA, 25 bp, Artificial sequence
  Synthetic oligonucleotide
tgtcgctgttcctgatgaagttcgt

SEQ ID NO: 697649 - DNA, 25 bp, Artificial sequence
  Synthetic oligonucleotide
ggccgcattgccgagcgtttcgaca

SEQ ID NO: 697650 - DNA, 25 bp, Artificial sequence
  Synthetic oligonucleotide
tgatgaagttcgtccagcaccagtt

SEQ ID NO: 697651 - DNA, 25 bp, Artificial sequence
  Synthetic oligonucleotide
aagttcgtccagcaccagttcttcc

SEQ ID NO: 697652 - DNA, 25 bp, Artificial sequence
  Synthetic oligonucleotide
gtccagcaccagttcttcccgtctt

SEQ ID NO: 697653 - DNA, 25 bp, Artificial sequence
  Synthetic oligonucleotide
gcaccagttcttcccgtcttccgac

SEQ ID NO: 697654 - DNA, 25 bp, Artificial sequence
  Synthetic oligonucleotide
cgtcttccgaccgtccggaactgct

SEQ ID NO: 697655 - DNA, 25 bp, Artificial sequence
  Synthetic oligonucleotide
ccgaccgtccggaactgctggtcga

SEQ ID NO: 697656 - DNA, 25 bp, Artificial sequence
  Synthetic oligonucleotide
gtccggaactgctggtcgacctcaa

SEQ ID NO: 697657 - DNA, 25 bp, Artificial sequence
  Synthetic oligonucleotide
aactgctggtcgacctcaacctgcc

SEQ ID NO: 697658 - DNA, 25 bp, Artificial sequence
  Synthetic oligonucleotide
tggtcgacctcaacctgccgcagaa

SEQ ID NO: 697659 - DNA, 25 bp, Artificial sequence
  Synthetic oligonucleotide
acctcaacctgccgcagaacagcag

SEQ ID NO: 697660 - DNA, 25 bp, Artificial sequence
  Synthetic oligonucleotide
acctgccgcagaacagcagcatcca

SEQ ID NO: 697661 - DNA, 25 bp, Artificial sequence
  Synthetic oligonucleotide
tcggcgtgtcgctgttcctgatgaa

SEQ ID NO: 697662 - DNA, 25 bp, Artificial sequence
  Synthetic oligonucleotide
ggatcgtcgcggtgctgttcgcccc

SEQ ID NO: 697663 - DNA, 25 bp, Artificial sequence
  Synthetic oligonucleotide
tccgccggcgagtacaccttcaccc

SEQ ID NO: 697664 - DNA, 25 bp, Artificial sequence
  Synthetic oligonucleotide
gccagctccgccggcgagtacacct

SEQ ID NO: 697665 - DNA, 25 bp, Artificial sequence
  Synthetic oligonucleotide
gttgcagagcgtgcagaagctattc

SEQ ID NO: 697666 - DNA, 25 bp, Artificial sequence
  Synthetic oligonucleotide
gtccgcgagtacgccatgggcctgg

SEQ ID NO: 697667 - DNA, 25 bp, Artificial sequence
  Synthetic oligonucleotide
ggcgagtacaccttcaccctgttcg

SEQ ID NO: 697668 - DNA, 25 bp, Artificial sequence
  Synthetic oligonucleotide
tacaccttcaccctgttcgcagtga

SEQ ID NO: 697669 - DNA, 25 bp, Artificial sequence
  Synthetic oligonucleotide
tcaccctgttcgcagtgatcgccgt

SEQ ID NO: 697670 - DNA, 25 bp, Artificial sequence
  Synthetic oligonucleotide
tgttcgcagtgatcgccgtggcgct

SEQ ID NO: 697671 - DNA, 25 bp, Artificial sequence
  Synthetic oligonucleotide
cagtgatcgccgtggcgctgctgct

SEQ ID NO: 697672 - DNA, 25 bp, Artificial sequence
  Synthetic oligonucleotide
tcgccgtggcgctgctgctgtcgtg

SEQ ID NO: 697673 - DNA, 25 bp, Artificial sequence
  Synthetic oligonucleotide
tggcgctgctgctgtcgtggatcgt

SEQ ID NO: 697674 - DNA, 25 bp, Artificial sequence
  Synthetic oligonucleotide
gagcgtttcgacagcctgctgcacc

SEQ ID NO: 697675 - DNA, 25 bp, Artificial sequence
  Synthetic oligonucleotide
tgtcgtggatcgtcgcggtgctgtt

SEQ ID NO: 697676 - DNA, 25 bp, Artificial sequence
  Synthetic oligonucleotide
attgccgagcgtttcgacagcctgc

SEQ ID NO: 697677 - DNA, 25 bp, Artificial sequence
  Synthetic oligonucleotide
tcgcggtgctgttcgccccggtgat

SEQ ID NO: 697678 - DNA, 25 bp, Artificial sequence
  Synthetic oligonucleotide
tgctgttcgccccggtgatcgccgt

SEQ ID NO: 697679 - DNA, 25 bp, Artificial sequence
  Synthetic oligonucleotide
tcgccccggtgatcgccgtgcacat

SEQ ID NO: 697680 - DNA, 25 bp, Artificial sequence
  Synthetic oligonucleotide
atcgccgtgcacatcctgccgaaga

SEQ ID NO: 697681 - DNA, 25 bp, Artificial sequence
  Synthetic oligonucleotide
atcctgccgaagactctcaagcaca

SEQ ID NO: 697682 - DNA, 25 bp, Artificial sequence
  Synthetic oligonucleotide
gccgaagactctcaagcacaagtcg

SEQ ID NO: 697683 - DNA, 25 bp, Artificial sequence
  Synthetic oligonucleotide
gactctcaagcacaagtcggagcag

SEQ ID NO: 697684 - DNA, 25 bp, Artificial sequence
  Synthetic oligonucleotide
tcaagcacaagtcggagcagaagaa

SEQ ID NO: 697685 - DNA, 25 bp, Artificial sequence
  Synthetic oligonucleotide
acaagtcggagcagaagaagggccg

SEQ ID NO: 697686 - DNA, 25 bp, Artificial sequence
  Synthetic oligonucleotide
cggagcagaagaagggccgcattgc

SEQ ID NO: 697687 - DNA, 25 bp, Artificial sequence
  Synthetic oligonucleotide
gaagaagggccgcattgccgagcgt

SEQ ID NO: 697688 - DNA, 25 bp, Artificial sequence
  Synthetic oligonucleotide
gtgcacatcctgccgaagactctca

SEQ ID NO: 697689 - DNA, 25 bp, Artificial sequence
  Synthetic oligonucleotide
tgctgctgtcgtggatcgtcgcggt

SEQ ID NO: 697690 - DNA, 25 bp, Artificial sequence
  Synthetic oligonucleotide
tggagatggggccgccggtgggacg

SEQ ID NO: 697691 - DNA, 25 bp, Artificial sequence
  Synthetic oligonucleotide
aggacctggaggcccgcgagcgcgt

SEQ ID NO: 697692 - DNA, 25 bp, Artificial sequence
  Synthetic oligonucleotide
tggaggcccgcgagcgcgtcgccgc

SEQ ID NO: 697693 - DNA, 25 bp, Artificial sequence
  Synthetic oligonucleotide
cccgcgagcgcgtcgccgcacgcct

SEQ ID NO: 697694 - DNA, 25 bp, Artificial sequence
  Synthetic oligonucleotide
gcgcgtcgccgcacgcctgcgcgat

SEQ ID NO: 697695 - DNA, 25 bp, Artificial sequence
  Synthetic oligonucleotide
gccgcacgcctgcgcgatcgcttgc

SEQ ID NO: 697696 - DNA, 25 bp, Artificial sequence
  Synthetic oligonucleotide
acgcctgcgcgatcgcttgcgcaag

SEQ ID NO: 697697 - DNA, 25 bp, Artificial sequence
  Synthetic oligonucleotide
gcgcgatcgcttgcgcaaggactac

SEQ ID NO: 697698 - DNA, 25 bp, Artificial sequence
  Synthetic oligonucleotide
tcgcttgcgcaaggactacgtcggc

SEQ ID NO: 697699 - DNA, 25 bp, Artificial sequence
  Synthetic oligonucleotide
gcgcaaggactacgtcggcatcagc

SEQ ID NO: 697700 - DNA, 25 bp, Artificial sequence
  Synthetic oligonucleotide
ggactacgtcggcatcagcacctac

SEQ ID NO: 697701 - DNA, 25 bp, Artificial sequence
  Synthetic oligonucleotide
cgtcggcatcagcacctacgtgcag

SEQ ID NO: 697702 - DNA, 25 bp, Artificial sequence
  Synthetic oligonucleotide
tcaccaaggacctggaggcccgcga

SEQ ID NO: 697703 - DNA, 25 bp, Artificial sequence
  Synthetic oligonucleotide
agccgctggagatggggccgccggt

SEQ ID NO: 697704 - DNA, 25 bp, Artificial sequence
  Synthetic oligonucleotide
gcatcagcacctacgtgcagccgct

SEQ ID NO: 697705 - DNA, 25 bp, Artificial sequence
  Synthetic oligonucleotide
ggccgccggtgggacggccgatcca

SEQ ID NO: 697706 - DNA, 25 bp, Artificial sequence
  Synthetic oligonucleotide
cggtgggacggccgatccagtaccg

SEQ ID NO: 697707 - DNA, 25 bp, Artificial sequence
  Synthetic oligonucleotide
gacggccgatccagtaccgggtcag

SEQ ID NO: 697708 - DNA, 25 bp, Artificial sequence
  Synthetic oligonucleotide
gatccagtaccgggtcagcggaccg

SEQ ID NO: 697709 - DNA, 25 bp, Artificial sequence
  Synthetic oligonucleotide
agtaccgggtcagcggaccgcagat

SEQ ID NO: 697710 - DNA, 25 bp, Artificial sequence
  Synthetic oligonucleotide
gacaaggtccgcgagtacgccatgg

SEQ ID NO: 697711 - DNA, 25 bp, Artificial sequence
  Synthetic oligonucleotide
gcagatcgacaaggtccgcgagtac

SEQ ID NO: 697712 - DNA, 25 bp, Artificial sequence
  Synthetic oligonucleotide
cagcagcatccacgagaccagggcg

SEQ ID NO: 697713 - DNA, 25 bp, Artificial sequence
  Synthetic oligonucleotide
cggtgatcgccgtgcacatcctgcc

SEQ ID NO: 697714 - DNA, 25 bp, Artificial sequence
  Synthetic oligonucleotide
cggaccgcagatcgacaaggtccgc

SEQ ID NO: 697715 - DNA, 25 bp, Artificial sequence
  Synthetic oligonucleotide
ggtcagcggaccgcagatcgacaag

SEQ ID NO: 697716 - DNA, 25 bp, Artificial sequence
  Synthetic oligonucleotide
gcacctacgtgcagccgctggagat

SEQ ID NO: 697717 - DNA, 25 bp, Artificial sequence
  Synthetic oligonucleotide
cactggagcgcctacgtcggcgaag

SEQ ID NO: 697718 - DNA, 25 bp, Artificial sequence
  Synthetic oligonucleotide
cagggcggtgatggaccgcctggaa

SEQ ID NO: 697719 - DNA, 25 bp, Artificial sequence
  Synthetic oligonucleotide
gtgatggaccgcctggaagcgacgc

SEQ ID NO: 697720 - DNA, 25 bp, Artificial sequence
  Synthetic oligonucleotide
acgtgcagccgctggagatggggcc

SEQ ID NO: 697721 - DNA, 25 bp, Artificial sequence
  Synthetic oligonucleotide
gatcgtcaccaaggacctggaggcc

SEQ ID NO: 697722 - DNA, 25 bp, Artificial sequence
  Synthetic oligonucleotide
cctggaagcgacgctgaaggacgac

SEQ ID NO: 697723 - DNA, 25 bp, Artificial sequence
  Synthetic oligonucleotide
agcgacgctgaaggacgacgaggac

SEQ ID NO: 697724 - DNA, 25 bp, Artificial sequence
  Synthetic oligonucleotide
cgctgaaggacgacgaggacatcga

SEQ ID NO: 697725 - DNA, 25 bp, Artificial sequence
  Synthetic oligonucleotide
ggacgacgaggacatcgaccactgg

SEQ ID NO: 697726 - DNA, 25 bp, Artificial sequence
  Synthetic oligonucleotide
atcgaccactggagcgcctacgtcg

SEQ ID NO: 697727 - DNA, 25 bp, Artificial sequence
  Synthetic oligonucleotide
ggaccgcctggaagcgacgctgaag

SEQ ID NO: 697728 - DNA, 25 bp, Artificial sequence
  Synthetic oligonucleotide
agcgcctacgtcggcgaaggcgcga

SEQ ID NO: 697729 - DNA, 25 bp, Artificial sequence
  Synthetic oligonucleotide
cgagaccagggcggtgatggaccgc

SEQ ID NO: 697730 - DNA, 25 bp, Artificial sequence
  Synthetic oligonucleotide
tacgtcggcgaaggcgcgatccgct

SEQ ID NO: 697731 - DNA, 25 bp, Artificial sequence
  Synthetic oligonucleotide
ggcgaaggcgcgatccgcttctacc

SEQ ID NO: 697732 - DNA, 25 bp, Artificial sequence
  Synthetic oligonucleotide
ttgcagaacaacttctatggccagc

SEQ ID NO: 697733 - DNA, 25 bp, Artificial sequence
  Synthetic oligonucleotide
ctggtgatcgtcaccaaggacctgg

SEQ ID NO: 697734 - DNA, 25 bp, Artificial sequence
  Synthetic oligonucleotide
ggccagctggtgatcgtcaccaagg

SEQ ID NO: 697735 - DNA, 25 bp, Artificial sequence
  Synthetic oligonucleotide
ttctatggccagctggtgatcgtca

SEQ ID NO: 697736 - DNA, 25 bp, Artificial sequence
  Synthetic oligonucleotide
cgaggacatcgaccactggagcgcc

SEQ ID NO: 697737 - DNA, 25 bp, Artificial sequence
  Synthetic oligonucleotide
aacaacttctatggccagctggtga

SEQ ID NO: 697738 - DNA, 25 bp, Artificial sequence
  Synthetic oligonucleotide
catccacgagaccagggcggtgatg

SEQ ID NO: 697739 - DNA, 25 bp, Artificial sequence
  Synthetic oligonucleotide
cagcagttgcagaacaacttctatg

SEQ ID NO: 697740 - DNA, 25 bp, Artificial sequence
  Synthetic oligonucleotide
ctggaccagcagttgcagaacaact

SEQ ID NO: 697741 - DNA, 25 bp, Artificial sequence
  Synthetic oligonucleotide
ttctacctgccgctggaccagcagt

SEQ ID NO: 697742 - DNA, 25 bp, Artificial sequence
  Synthetic oligonucleotide
ggcgcgatccgcttctacctgccgc

SEQ ID NO: 697743 - DNA, 25 bp, Artificial sequence
  Synthetic oligonucleotide
atccgcttctacctgccgctggacc

SEQ ID NO: 697744 - DNA, 25 bp, Artificial sequence
  Synthetic oligonucleotide
ctgccgctggaccagcagttgcaga

SEQ ID NO: 697745 - DNA, 25 bp, Artificial sequence
  Synthetic oligonucleotide
ggcaacgagcatgcgattccctaca

SEQ ID NO: 697746 - DNA, 25 bp, Artificial sequence
  Synthetic oligonucleotide
tgatgcacaccctggaagtcagcga

SEQ ID NO: 697747 - DNA, 25 bp, Artificial sequence
  Synthetic oligonucleotide
acaccctggaagtcagcgacccggg

SEQ ID NO: 697748 - DNA, 25 bp, Artificial sequence
  Synthetic oligonucleotide
tgcgattccctacatgtggggcacc

SEQ ID NO: 697749 - DNA, 25 bp, Artificial sequence
  Synthetic oligonucleotide
tggaagtcagcgacccgggcaacga

SEQ ID NO: 697750 - DNA, 25 bp, Artificial sequence
  Synthetic oligonucleotide
gagcatgcgattccctacatgtggg

SEQ ID NO: 697751 - DNA, 25 bp, Artificial sequence
  Synthetic oligonucleotide
gacccgggcaacgagcatgcgattc

SEQ ID NO: 697752 - DNA, 25 bp, Artificial sequence
  Synthetic oligonucleotide
gtcagcgacccgggcaacgagcatg

SEQ ID NO: 697753 - DNA, 25 bp, Artificial sequence
  Synthetic oligonucleotide
aggacctgatgcacaccctggaagt

SEQ ID NO: 697754 - DNA, 25 bp, Artificial sequence
  Synthetic oligonucleotide
tgaacaaggacctgatgcacaccct

SEQ ID NO: 697755 - DNA, 25 bp, Artificial sequence
  Synthetic oligonucleotide
agaacctgaacaaggacctgatgca

SEQ ID NO: 697756 - DNA, 25 bp, Artificial sequence
  Synthetic oligonucleotide
actggaagaacctgaacaaggacct

SEQ ID NO: 697757 - DNA, 25 bp, Artificial sequence
  Synthetic oligonucleotide
tgccgaactggaagaacctgaacaa

SEQ ID NO: 697758 - DNA, 25 bp, Artificial sequence
  Synthetic oligonucleotide
ttccctacatgtggggcaccatcgg

SEQ ID NO: 697759 - DNA, 25 bp, Artificial sequence
  Synthetic oligonucleotide
acaagtccaagctgccgaactggaa

SEQ ID NO: 697760 - DNA, 25 bp, Artificial sequence
  Synthetic oligonucleotide
caagccggagaacatccagaagctg

SEQ ID NO: 697761 - DNA, 25 bp, Artificial sequence
  Synthetic oligonucleotide
agctcgacaagtccaagctgccgaa

SEQ ID NO: 697762 - DNA, 25 bp, Artificial sequence
  Synthetic oligonucleotide
accagaagctcgacaagtccaagct

SEQ ID NO: 697763 - DNA, 25 bp, Artificial sequence
  Synthetic oligonucleotide
gggtctaccagaagctcgacaagtc

SEQ ID NO: 697764 - DNA, 25 bp, Artificial sequence
  Synthetic oligonucleotide
aaggccggggtctaccagaagctcg

SEQ ID NO: 697765 - DNA, 25 bp, Artificial sequence
  Synthetic oligonucleotide
ccaagctgccgaactggaagaacct

SEQ ID NO: 697766 - DNA, 25 bp, Artificial sequence
  Synthetic oligonucleotide
gcgccggtggattcctgggacctgg

SEQ ID NO: 697767 - DNA, 25 bp, Artificial sequence
  Synthetic oligonucleotide
gaagctgaagcagtgcggcgtcagc

SEQ ID NO: 697768 - DNA, 25 bp, Artificial sequence
  Synthetic oligonucleotide
catccagaagctgaagcagtgcggc

SEQ ID NO: 697769 - DNA, 25 bp, Artificial sequence
  Synthetic oligonucleotide
gccctgaccttggcgggctctgtgg

SEQ ID NO: 697770 - DNA, 25 bp, Artificial sequence
  Synthetic oligonucleotide
cagatcaaggccggggtctaccaga

SEQ ID NO: 697771 - DNA, 25 bp, Artificial sequence
  Synthetic oligonucleotide
aagcagtgcggcgtcagcttcctcg

SEQ ID NO: 697772 - DNA, 25 bp, Artificial sequence
  Synthetic oligonucleotide
gtgcggcgtcagcttcctcgactcg

SEQ ID NO: 697773 - DNA, 25 bp, Artificial sequence
  Synthetic oligonucleotide
ggagaacatccagaagctgaagcag

SEQ ID NO: 697774 - DNA, 25 bp, Artificial sequence
  Synthetic oligonucleotide
gtattcaagccggagaacatccaga

SEQ ID NO: 697775 - DNA, 25 bp, Artificial sequence
  Synthetic oligonucleotide
gacctggtattcaagccggagaaca

SEQ ID NO: 697776 - DNA, 25 bp, Artificial sequence
  Synthetic oligonucleotide
gtggattcctgggacctggtattca

SEQ ID NO: 697777 - DNA, 25 bp, Artificial sequence
  Synthetic oligonucleotide
catgtggggcaccatcggcatcggc

SEQ ID NO: 697778 - DNA, 25 bp, Artificial sequence
  Synthetic oligonucleotide
cgacaacgcgccggtggattcctgg

SEQ ID NO: 697779 - DNA, 25 bp, Artificial sequence
  Synthetic oligonucleotide
ccttcggcgacaacgcgccggtgga

SEQ ID NO: 697780 - DNA, 25 bp, Artificial sequence
  Synthetic oligonucleotide
aaggcggccttcggcgacaacgcgc

SEQ ID NO: 697781 - DNA, 25 bp, Artificial sequence
  Synthetic oligonucleotide
aaggtcaaggcggccttcggcgaca

SEQ ID NO: 697782 - DNA, 25 bp, Artificial sequence
  Synthetic oligonucleotide
ccggacaaggtcaaggcggccttcg

SEQ ID NO: 697783 - DNA, 25 bp, Artificial sequence
  Synthetic oligonucleotide
ctacaacccggacaaggtcaaggcg

SEQ ID NO: 697784 - DNA, 25 bp, Artificial sequence
  Synthetic oligonucleotide
atcggctacaacccggacaaggtca

SEQ ID NO: 697785 - DNA, 25 bp, Artificial sequence
  Synthetic oligonucleotide
atcggcatcggctacaacccggaca

SEQ ID NO: 697786 - DNA, 25 bp, Artificial sequence
  Synthetic oligonucleotide
gggcaccatcggcatcggctacaac

SEQ ID NO: 697787 - DNA, 25 bp, Artificial sequence
  Synthetic oligonucleotide
tcctgggacctggtattcaagccgg

SEQ ID NO: 697788 - DNA, 25 bp, Artificial sequence
  Synthetic oligonucleotide
accttggcgggctctgtggccggta

SEQ ID NO: 697789 - DNA, 25 bp, Artificial sequence
  Synthetic oligonucleotide
tggtccgactacatcgcgccggaca

SEQ ID NO: 697790 - DNA, 25 bp, Artificial sequence
  Synthetic oligonucleotide
tacaactggtccgactacatcgcgc

SEQ ID NO: 697791 - DNA, 25 bp, Artificial sequence
  Synthetic oligonucleotide
cacgtgtacaactggtccgactaca

SEQ ID NO: 697792 - DNA, 25 bp, Artificial sequence
  Synthetic oligonucleotide
gtgctgcacgtgtacaactggtccg

SEQ ID NO: 697793 - DNA, 25 bp, Artificial sequence
  Synthetic oligonucleotide
aacaaggtgctgcacgtgtacaact

SEQ ID NO: 697794 - DNA, 25 bp, Artificial sequence
  Synthetic oligonucleotide
gcggacaacaaggtgctgcacgtgt

SEQ ID NO: 697795 - DNA, 25 bp, Artificial sequence
  Synthetic oligonucleotide
caggctgcggacaacaaggtgctgc

SEQ ID NO: 697796 - DNA, 25 bp, Artificial sequence
  Synthetic oligonucleotide
tatggcgcaggctgcggacaacaag

SEQ ID NO: 697797 - DNA, 25 bp, Artificial sequence
  Synthetic oligonucleotide
ggcgggctctgtggccggtatggcg

SEQ ID NO: 697798 - DNA, 25 bp, Artificial sequence
  Synthetic oligonucleotide
ctctgtggccggtatggcgcaggct

SEQ ID NO: 697799 - DNA, 25 bp, Artificial sequence
  Synthetic oligonucleotide
cggacaccctggagaagttcaccaa

SEQ ID NO: 697800 - DNA, 25 bp, Artificial sequence
  Synthetic oligonucleotide
cctgctcgccctgaccttggcgggc

SEQ ID NO: 697801 - DNA, 25 bp, Artificial sequence
  Synthetic oligonucleotide
taagaccctgctcgccctgaccttg

SEQ ID NO: 697802 - DNA, 25 bp, Artificial sequence
  Synthetic oligonucleotide
tttcggtaagaccctgctcgccctg

SEQ ID NO: 697803 - DNA, 25 bp, Artificial sequence
  Synthetic oligonucleotide
catgatgaaacgtttcggtaagacc

SEQ ID NO: 697804 - DNA, 25 bp, Artificial sequence
  Synthetic oligonucleotide
cgtcagcttcctcgactcgccgacc

SEQ ID NO: 697805 - DNA, 25 bp, Artificial sequence
  Synthetic oligonucleotide
aggcgatccgcaacgacccgggcat

SEQ ID NO: 697806 - DNA, 25 bp, Artificial sequence
  Synthetic oligonucleotide
ccccgcatgatgaaacgtttcggta

SEQ ID NO: 697807 - DNA, 25 bp, Artificial sequence
  Synthetic oligonucleotide
gagctaccccgcatgatgaaacgtt

SEQ ID NO: 697808 - DNA, 25 bp, Artificial sequence
  Synthetic oligonucleotide
ggccggtatggcgcaggctgcggac

SEQ ID NO: 697809 - DNA, 25 bp, Artificial sequence
  Synthetic oligonucleotide
gtgctggaagccaagttgctggcgg

SEQ ID NO: 697810 - DNA, 25 bp, Artificial sequence
  Synthetic oligonucleotide
ttcctcgccaagcagatcaaggccg

SEQ ID NO: 697811 - DNA, 25 bp, Artificial sequence
  Synthetic oligonucleotide
aactccttcctcgccaagcagatca

SEQ ID NO: 697812 - DNA, 25 bp, Artificial sequence
  Synthetic oligonucleotide
ccgtccaactccttcctcgccaagc

SEQ ID NO: 697813 - DNA, 25 bp, Artificial sequence
  Synthetic oligonucleotide
gtggtgccgtccaactccttcctcg

SEQ ID NO: 697814 - DNA, 25 bp, Artificial sequence
  Synthetic oligonucleotide
gacgtggtggtgccgtccaactcct

SEQ ID NO: 697815 - DNA, 25 bp, Artificial sequence
  Synthetic oligonucleotide
gggtacgacgtggtggtgccgtcca

SEQ ID NO: 697816 - DNA, 25 bp, Artificial sequence
  Synthetic oligonucleotide
caagtccgggtacgacgtggtggtg

SEQ ID NO: 697817 - DNA, 25 bp, Artificial sequence
  Synthetic oligonucleotide
ctggcgggcaagtccgggtacgacg

SEQ ID NO: 697818 - DNA, 25 bp, Artificial sequence
  Synthetic oligonucleotide
gactacatcgcgccggacaccctgg

SEQ ID NO: 697819 - DNA, 25 bp, Artificial sequence
  Synthetic oligonucleotide
aagccaagttgctggcgggcaagtc

SEQ ID NO: 697820 - DNA, 25 bp, Artificial sequence
  Synthetic oligonucleotide
atcgcgccggacaccctggagaagt

SEQ ID NO: 697821 - DNA, 25 bp, Artificial sequence
  Synthetic oligonucleotide
aacgaagtgctggaagccaagttgc

SEQ ID NO: 697822 - DNA, 25 bp, Artificial sequence
  Synthetic oligonucleotide
gacagcaacgaagtgctggaagcca

SEQ ID NO: 697823 - DNA, 25 bp, Artificial sequence
  Synthetic oligonucleotide
gtctacgacagcaacgaagtgctgg

SEQ ID NO: 697824 - DNA, 25 bp, Artificial sequence
  Synthetic oligonucleotide
tacgacgtctacgacagcaacgaag

SEQ ID NO: 697825 - DNA, 25 bp, Artificial sequence
  Synthetic oligonucleotide
gtcgtctacgacgtctacgacagca

SEQ ID NO: 697826 - DNA, 25 bp, Artificial sequence
  Synthetic oligonucleotide
atcaaggtcgtctacgacgtctacg

SEQ ID NO: 697827 - DNA, 25 bp, Artificial sequence
  Synthetic oligonucleotide
accgggatcaaggtcgtctacgacg

SEQ ID NO: 697828 - DNA, 25 bp, Artificial sequence
  Synthetic oligonucleotide
ctggagaagttcaccaaggaaaccg

SEQ ID NO: 697829 - DNA, 25 bp, Artificial sequence
  Synthetic oligonucleotide
gccaagcagatcaaggccggggtct

SEQ ID NO: 697830 - DNA, 25 bp, Artificial sequence
  Synthetic oligonucleotide
agttgctggcgggcaagtccgggta

SEQ ID NO: 697831 - DNA, 25 bp, Artificial sequence
  Synthetic oligonucleotide
gacgccgagaacaccgagggcgccc

SEQ ID NO: 697832 - DNA, 25 bp, Artificial sequence
  Synthetic oligonucleotide
atggccgagatcaccgacgtggttc

SEQ ID NO: 697833 - DNA, 25 bp, Artificial sequence
  Synthetic oligonucleotide
gaaatcatggccgagatcaccgacg

SEQ ID NO: 697834 - DNA, 25 bp, Artificial sequence
  Synthetic oligonucleotide
aagccggaaatcatggccgagatca

SEQ ID NO: 697835 - DNA, 25 bp, Artificial sequence
  Synthetic oligonucleotide
ctgatgaagccggaaatcatggccg

SEQ ID NO: 697836 - DNA, 25 bp, Artificial sequence
  Synthetic oligonucleotide
aacttcctgatgaagccggaaatca

SEQ ID NO: 697837 - DNA, 25 bp, Artificial sequence
  Synthetic oligonucleotide
ttcgtcaacttcctgatgaagccgg

SEQ ID NO: 697838 - DNA, 25 bp, Artificial sequence
  Synthetic oligonucleotide
ctggccttcgtcaacttcctgatga

SEQ ID NO: 697839 - DNA, 25 bp, Artificial sequence
  Synthetic oligonucleotide
ggcgccctggccttcgtcaacttcc

SEQ ID NO: 697840 - DNA, 25 bp, Artificial sequence
  Synthetic oligonucleotide
ctggtgtccgaggcgatccgcaacg

SEQ ID NO: 697841 - DNA, 25 bp, Artificial sequence
  Synthetic oligonucleotide
gagaacaccgagggcgccctggcct

SEQ ID NO: 697842 - DNA, 25 bp, Artificial sequence
  Synthetic oligonucleotide
ttcagttccccaacggcaacgcggc

SEQ ID NO: 697843 - DNA, 25 bp, Artificial sequence
  Synthetic oligonucleotide
ccgaaggacgccgagaacaccgagg

SEQ ID NO: 697844 - DNA, 25 bp, Artificial sequence
  Synthetic oligonucleotide
gccattccgaaggacgccgagaaca

SEQ ID NO: 697845 - DNA, 25 bp, Artificial sequence
  Synthetic oligonucleotide
atggtcgccattccgaaggacgccg

SEQ ID NO: 697846 - DNA, 25 bp, Artificial sequence
  Synthetic oligonucleotide
tcgacatggtcgccattccgaagga

SEQ ID NO: 697847 - DNA, 25 bp, Artificial sequence
  Synthetic oligonucleotide
gcttcttcgacatggtcgccattcc

SEQ ID NO: 697848 - DNA, 25 bp, Artificial sequence
  Synthetic oligonucleotide
ccggcagcttcttcgacatggtcgc

SEQ ID NO: 697849 - DNA, 25 bp, Artificial sequence
  Synthetic oligonucleotide
aaggcgccggcagcttcttcgacat

SEQ ID NO: 697850 - DNA, 25 bp, Artificial sequence
  Synthetic oligonucleotide
ccaaggaaggcgccggcagcttctt

SEQ ID NO: 697851 - DNA, 25 bp, Artificial sequence
  Synthetic oligonucleotide
accgagggcgccctggccttcgtca

SEQ ID NO: 697852 - DNA, 25 bp, Artificial sequence
  Synthetic oligonucleotide
cccgggcatctacccgagcgaagag

SEQ ID NO: 697853 - DNA, 25 bp, Artificial sequence
  Synthetic oligonucleotide
cagccctactggtacggcgagggcg

SEQ ID NO: 697854 - DNA, 25 bp, Artificial sequence
  Synthetic oligonucleotide
aaaatggagctaccccgcatgatga

SEQ ID NO: 697855 - DNA, 25 bp, Artificial sequence
  Synthetic oligonucleotide
tccccgacctgccggccaagaccca

SEQ ID NO: 697856 - DNA, 25 bp, Artificial sequence
  Synthetic oligonucleotide
tgtataccttccccgacctgccggc

SEQ ID NO: 697857 - DNA, 25 bp, Artificial sequence
  Synthetic oligonucleotide
gaagctgtataccttccccgacctg

SEQ ID NO: 697858 - DNA, 25 bp, Artificial sequence
  Synthetic oligonucleotide
atgaagaagctgtataccttccccg

SEQ ID NO: 697859 - DNA, 25 bp, Artificial sequence
  Synthetic oligonucleotide
gaggtcatgaagaagctgtatacct

SEQ ID NO: 697860 - DNA, 25 bp, Artificial sequence
  Synthetic oligonucleotide
agcgaagaggtcatgaagaagctgt

SEQ ID NO: 697861 - DNA, 25 bp, Artificial sequence
  Synthetic oligonucleotide
gagatcaccgacgtggttcagttcc

SEQ ID NO: 697862 - DNA, 25 bp, Artificial sequence
  Synthetic oligonucleotide
gcatctacccgagcgaagaggtcat

SEQ ID NO: 697863 - DNA, 25 bp, Artificial sequence
  Synthetic oligonucleotide
gacgtggttcagttccccaacggca

SEQ ID NO: 697864 - DNA, 25 bp, Artificial sequence
  Synthetic oligonucleotide
aacgacccgggcatctacccgagcg

SEQ ID NO: 697865 - DNA, 25 bp, Artificial sequence
  Synthetic oligonucleotide
atccgcaacgacccgggcatctacc

SEQ ID NO: 697866 - DNA, 25 bp, Artificial sequence
  Synthetic oligonucleotide
gtccgaggcgatccgcaacgacccg

SEQ ID NO: 697867 - DNA, 25 bp, Artificial sequence
  Synthetic oligonucleotide
accccgctggtgtccgaggcgatcc

SEQ ID NO: 697868 - DNA, 25 bp, Artificial sequence
  Synthetic oligonucleotide
gcggccaccccgctggtgtccgagg

SEQ ID NO: 697869 - DNA, 25 bp, Artificial sequence
  Synthetic oligonucleotide
aacgcggcggccaccccgctggtgt

SEQ ID NO: 697870 - DNA, 25 bp, Artificial sequence
  Synthetic oligonucleotide
acggcaacgcggcggccaccccgct

SEQ ID NO: 697871 - DNA, 25 bp, Artificial sequence
  Synthetic oligonucleotide
tccccaacggcaacgcggcggccac

SEQ ID NO: 697872 - DNA, 25 bp, Artificial sequence
  Synthetic oligonucleotide
accgtcaagtacaacattcccaagg

SEQ ID NO: 697873 - DNA, 25 bp, Artificial sequence
  Synthetic oligonucleotide
tacccgagcgaagaggtcatgaaga

SEQ ID NO: 697874 - DNA, 25 bp, Artificial sequence
  Synthetic oligonucleotide
cggacaccgacaatcccaaggaact

SEQ ID NO: 697875 - DNA, 25 bp, Artificial sequence
  Synthetic oligonucleotide
aacattcccaaggaaggcgccggca

SEQ ID NO: 697876 - DNA, 25 bp, Artificial sequence
  Synthetic oligonucleotide
gatccgtccctacgtcacctacttc

SEQ ID NO: 697877 - DNA, 25 bp, Artificial sequence
  Synthetic oligonucleotide
ctgaagatccgtccctacgtcacct

SEQ ID NO: 697878 - DNA, 25 bp, Artificial sequence
  Synthetic oligonucleotide
ctgttcctgaagatccgtccctacg

SEQ ID NO: 697879 - DNA, 25 bp, Artificial sequence
  Synthetic oligonucleotide
gaagagctgttcctgaagatccgtc

SEQ ID NO: 697880 - DNA, 25 bp, Artificial sequence
  Synthetic oligonucleotide
gcggccgaagagctgttcctgaaga

SEQ ID NO: 697881 - DNA, 25 bp, Artificial sequence
  Synthetic oligonucleotide
ctcaaggcggccgaagagctgttcc

SEQ ID NO: 697882 - DNA, 25 bp, Artificial sequence
  Synthetic oligonucleotide
aaggaactcaaggcggccgaagagc

SEQ ID NO: 697883 - DNA, 25 bp, Artificial sequence
  Synthetic oligonucleotide
cgtcacctacttccactcgtcgaag

SEQ ID NO: 697884 - DNA, 25 bp, Artificial sequence
  Synthetic oligonucleotide
ccgacaatcccaaggaactcaaggc

SEQ ID NO: 697885 - DNA, 25 bp, Artificial sequence
  Synthetic oligonucleotide
tacttccactcgtcgaagtacattt

SEQ ID NO: 697886 - DNA, 25 bp, Artificial sequence
  Synthetic oligonucleotide
acaagccggacaccgacaatcccaa

SEQ ID NO: 697887 - DNA, 25 bp, Artificial sequence
  Synthetic oligonucleotide
tcggctacaagccggacaccgacaa

SEQ ID NO: 697888 - DNA, 25 bp, Artificial sequence
  Synthetic oligonucleotide
ttatctcggctacaagccggacacc

SEQ ID NO: 697889 - DNA, 25 bp, Artificial sequence
  Synthetic oligonucleotide
cctgcattatctcggctacaagccg

SEQ ID NO: 697890 - DNA, 25 bp, Artificial sequence
  Synthetic oligonucleotide
ggcggccctgcattatctcggctac

SEQ ID NO: 697891 - DNA, 25 bp, Artificial sequence
  Synthetic oligonucleotide
tcctcccggcggccctgcattatct

SEQ ID NO: 697892 - DNA, 25 bp, Artificial sequence
  Synthetic oligonucleotide
ccgagatcctcccggcggccctgca

SEQ ID NO: 697893 - DNA, 25 bp, Artificial sequence
  Synthetic oligonucleotide
cgccgaccgagatcctcccggcggc

SEQ ID NO: 697894 - DNA, 25 bp, Artificial sequence
  Synthetic oligonucleotide
tcgactcgccgaccgagatcctccc

SEQ ID NO: 697895 - DNA, 25 bp, Artificial sequence
  Synthetic oligonucleotide
atcccaaggaactcaaggcggccga

SEQ ID NO: 697896 - DNA, 25 bp, Artificial sequence
  Synthetic oligonucleotide
ggctactccggcgacatctaccagg

SEQ ID NO: 697897 - DNA, 25 bp, Artificial sequence
  Synthetic oligonucleotide
gcttcctcgactcgccgaccgagat

SEQ ID NO: 697898 - DNA, 25 bp, Artificial sequence
  Synthetic oligonucleotide
aaggtcaccgtcaagtacaacattc

SEQ ID NO: 697899 - DNA, 25 bp, Artificial sequence
  Synthetic oligonucleotide
aagaacaaggtcaccgtcaagtaca

SEQ ID NO: 697900 - DNA, 25 bp, Artificial sequence
  Synthetic oligonucleotide
gaggcgaagaacaaggtcaccgtca

SEQ ID NO: 697901 - DNA, 25 bp, Artificial sequence
  Synthetic oligonucleotide
gccgaagaggcgaagaacaaggtca

SEQ ID NO: 697902 - DNA, 25 bp, Artificial sequence
  Synthetic oligonucleotide
tcccgcgccgaagaggcgaagaaca

SEQ ID NO: 697903 - DNA, 25 bp, Artificial sequence
  Synthetic oligonucleotide
ccaagtcccgcgccgaagaggcgaa

SEQ ID NO: 697904 - DNA, 25 bp, Artificial sequence
  Synthetic oligonucleotide
taccaggccaagtcccgcgccgaag

SEQ ID NO: 697905 - DNA, 25 bp, Artificial sequence
  Synthetic oligonucleotide
tccctacgtcacctacttccactcg

SEQ ID NO: 697906 - DNA, 25 bp, Artificial sequence
  Synthetic oligonucleotide
tccggcgacatctaccaggccaagt

SEQ ID NO: 697907 - DNA, 25 bp, Artificial sequence
  Synthetic oligonucleotide
aagtacaacattcccaaggaaggcg

SEQ ID NO: 697908 - DNA, 25 bp, Artificial sequence
  Synthetic oligonucleotide
gccatcggctactccggcgacatct

SEQ ID NO: 697909 - DNA, 25 bp, Artificial sequence
  Synthetic oligonucleotide
tgcgtcgccatcggctactccggcg

SEQ ID NO: 697910 - DNA, 25 bp, Artificial sequence
  Synthetic oligonucleotide
aacatctgcgtcgccatcggctact

SEQ ID NO: 697911 - DNA, 25 bp, Artificial sequence
  Synthetic oligonucleotide
aacggcaacatctgcgtcgccatcg

SEQ ID NO: 697912 - DNA, 25 bp, Artificial sequence
  Synthetic oligonucleotide
ctggccaacggcaacatctgcgtcg

SEQ ID NO: 697913 - DNA, 25 bp, Artificial sequence
  Synthetic oligonucleotide
tccgacctggccaacggcaacatct

SEQ ID NO: 697914 - DNA, 25 bp, Artificial sequence
  Synthetic oligonucleotide
acatttccgacctggccaacggcaa

SEQ ID NO: 697915 - DNA, 25 bp, Artificial sequence
  Synthetic oligonucleotide
tcgaagtacatttccgacctggcca

SEQ ID NO: 697916 - DNA, 25 bp, Artificial sequence
  Synthetic oligonucleotide
cactcgtcgaagtacatttccgacc

SEQ ID NO: 697917 - DNA, 25 bp, Artificial sequence
  Synthetic oligonucleotide
gacatctaccaggccaagtcccgcg

SEQ ID NO: 697918 - DNA, 25 bp, Artificial sequence
  Synthetic oligonucleotide
acctactggccgaagatccgcgaga

SEQ ID NO: 697919 - DNA, 25 bp, Artificial sequence
  Synthetic oligonucleotide
aagtgatctgcggcttcggccgtac

SEQ ID NO: 697920 - DNA, 25 bp, Artificial sequence
  Synthetic oligonucleotide
ccgacgaagtgatctgcggcttcgg

SEQ ID NO: 697921 - DNA, 25 bp, Artificial sequence
  Synthetic oligonucleotide
tcatcgccgacgaagtgatctgcgg

SEQ ID NO: 697922 - DNA, 25 bp, Artificial sequence
  Synthetic oligonucleotide
tcctgttcatcgccgacgaagtgat

SEQ ID NO: 697923 - DNA, 25 bp, Artificial sequence
  Synthetic oligonucleotide
acgacatcctgttcatcgccgacga

SEQ ID NO: 697924 - DNA, 25 bp, Artificial sequence
  Synthetic oligonucleotide
ccaagtacgacatcctgttcatcgc

SEQ ID NO: 697925 - DNA, 25 bp, Artificial sequence
  Synthetic oligonucleotide
tcctcgccaagtacgacatcctgtt

SEQ ID NO: 697926 - DNA, 25 bp, Artificial sequence
  Synthetic oligonucleotide
gcgagatcctcgccaagtacgacat

SEQ ID NO: 697927 - DNA, 25 bp, Artificial sequence
  Synthetic oligonucleotide
gaagtgctcaaccagggcggcgagt

SEQ ID NO: 697928 - DNA, 25 bp, Artificial sequence
  Synthetic oligonucleotide
tggccgaagatccgcgagatcctcg

SEQ ID NO: 697929 - DNA, 25 bp, Artificial sequence
  Synthetic oligonucleotide
accggcgagtggttcggcagccagt

SEQ ID NO: 697930 - DNA, 25 bp, Artificial sequence
  Synthetic oligonucleotide
gccggacacctactggccgaagatc

SEQ ID NO: 697931 - DNA, 25 bp, Artificial sequence
  Synthetic oligonucleotide
gtcccgccggacacctactggccga

SEQ ID NO: 697932 - DNA, 25 bp, Artificial sequence
  Synthetic oligonucleotide
gtgatcgtcccgccggacacctact

SEQ ID NO: 697933 - DNA, 25 bp, Artificial sequence
  Synthetic oligonucleotide
ggcggcgtgatcgtcccgccggaca

SEQ ID NO: 697934 - DNA, 25 bp, Artificial sequence
  Synthetic oligonucleotide
ggcgccggcggcgtgatcgtcccgc

SEQ ID NO: 697935 - DNA, 25 bp, Artificial sequence
  Synthetic oligonucleotide
atccagggcgccggcggcgtgatcg

SEQ ID NO: 697936 - DNA, 25 bp, Artificial sequence
  Synthetic oligonucleotide
gagccgatccagggcgccggcggcg

SEQ ID NO: 697937 - DNA, 25 bp, Artificial sequence
  Synthetic oligonucleotide
atcgccgagccgatccagggcgccg

SEQ ID NO: 697938 - DNA, 25 bp, Artificial sequence
  Synthetic oligonucleotide
aagatccgcgagatcctcgccaagt

SEQ ID NO: 697939 - DNA, 25 bp, Artificial sequence
  Synthetic oligonucleotide
tcgccaagggcctcacctccggcta

SEQ ID NO: 697940 - DNA, 25 bp, Artificial sequence
  Synthetic oligonucleotide
tacggcgagggcggcgacatgtcgc

SEQ ID NO: 697941 - DNA, 25 bp, Artificial sequence
  Synthetic oligonucleotide
acgagatcgtcgaagtgctcaacca

SEQ ID NO: 697942 - DNA, 25 bp, Artificial sequence
  Synthetic oligonucleotide
tgcgcgacgagatcgtcgaagtgct

SEQ ID NO: 697943 - DNA, 25 bp, Artificial sequence
  Synthetic oligonucleotide
tggtggtgcgcgacgagatcgtcga

SEQ ID NO: 697944 - DNA, 25 bp, Artificial sequence
  Synthetic oligonucleotide
gcggggtggtggtgcgcgacgagat

SEQ ID NO: 697945 - DNA, 25 bp, Artificial sequence
  Synthetic oligonucleotide
ccatgggcggggtggtggtgcgcga

SEQ ID NO: 697946 - DNA, 25 bp, Artificial sequence
  Synthetic oligonucleotide
acatccccatgggcggggtggtggt

SEQ ID NO: 697947 - DNA, 25 bp, Artificial sequence
  Synthetic oligonucleotide
ccggctacatccccatgggcggggt

SEQ ID NO: 697948 - DNA, 25 bp, Artificial sequence
  Synthetic oligonucleotide
tctgcggcttcggccgtaccggcga

SEQ ID NO: 697949 - DNA, 25 bp, Artificial sequence
  Synthetic oligonucleotide
agggcctcacctccggctacatccc

SEQ ID NO: 697950 - DNA, 25 bp, Artificial sequence
  Synthetic oligonucleotide
ggccgtaccggcgagtggttcggca

SEQ ID NO: 697951 - DNA, 25 bp, Artificial sequence
  Synthetic oligonucleotide
tgccgatcgccaagggcctcacctc

SEQ ID NO: 697952 - DNA, 25 bp, Artificial sequence
  Synthetic oligonucleotide
acctgatgccgatcgccaagggcct

SEQ ID NO: 697953 - DNA, 25 bp, Artificial sequence
  Synthetic oligonucleotide
ccccggacctgatgccgatcgccaa

SEQ ID NO: 697954 - DNA, 25 bp, Artificial sequence
  Synthetic oligonucleotide
gcaacgccccggacctgatgccgat

SEQ ID NO: 697955 - DNA, 25 bp, Artificial sequence
  Synthetic oligonucleotide
actacggcaacgccccggacctgat

SEQ ID NO: 697956 - DNA, 25 bp, Artificial sequence
  Synthetic oligonucleotide
agccagtactacggcaacgccccgg

SEQ ID NO: 697957 - DNA, 25 bp, Artificial sequence
  Synthetic oligonucleotide
ttcggcagccagtactacggcaacg

SEQ ID NO: 697958 - DNA, 25 bp, Artificial sequence
  Synthetic oligonucleotide
gagtggttcggcagccagtactacg

SEQ ID NO: 697959 - DNA, 25 bp, Artificial sequence
  Synthetic oligonucleotide
ggaaaacgtcgccgccttcatcgcc

SEQ ID NO: 697960 - DNA, 25 bp, Artificial sequence
  Synthetic oligonucleotide
tcacctccggctacatccccatggg

SEQ ID NO: 697961 - DNA, 25 bp, Artificial sequence
  Synthetic oligonucleotide
gctaccacggctccaccgtcgccgg

SEQ ID NO: 697962 - DNA, 25 bp, Artificial sequence
  Synthetic oligonucleotide
gccttcatcgccgagccgatccagg

SEQ ID NO: 697963 - DNA, 25 bp, Artificial sequence
  Synthetic oligonucleotide
tgagcagggtgatttccccatcccg

SEQ ID NO: 697964 - DNA, 25 bp, Artificial sequence
  Synthetic oligonucleotide
gttgcatgagcagggtgatttcccc

SEQ ID NO: 697965 - DNA, 25 bp, Artificial sequence
  Synthetic oligonucleotide
gaaggcgttgcatgagcagggtgat

SEQ ID NO: 697966 - DNA, 25 bp, Artificial sequence
  Synthetic oligonucleotide
cggcatgaaggcgttgcatgagcag

SEQ ID NO: 697967 - DNA, 25 bp, Artificial sequence
  Synthetic oligonucleotide
gcctgggcggcatgaaggcgttgca

SEQ ID NO: 697968 - DNA, 25 bp, Artificial sequence
  Synthetic oligonucleotide
gcgtcagcctgggcggcatgaaggc

SEQ ID NO: 697969 - DNA, 25 bp, Artificial sequence
  Synthetic oligonucleotide
tcgccggcgtcagcctgggcggcat

SEQ ID NO: 697970 - DNA, 25 bp, Artificial sequence
  Synthetic oligonucleotide
tttccccatcccgggcatcgtccac

SEQ ID NO: 697971 - DNA, 25 bp, Artificial sequence
  Synthetic oligonucleotide
acggctccaccgtcgccggcgtcag

SEQ ID NO: 697972 - DNA, 25 bp, Artificial sequence
  Synthetic oligonucleotide
catcccgggcatcgtccacatcgcc

SEQ ID NO: 697973 - DNA, 25 bp, Artificial sequence
  Synthetic oligonucleotide
gaacggctaccacggctccaccgtc

SEQ ID NO: 697974 - DNA, 25 bp, Artificial sequence
  Synthetic oligonucleotide
ccgctggaacggctaccacggctcc

SEQ ID NO: 697975 - DNA, 25 bp, Artificial sequence
  Synthetic oligonucleotide
atcggccgctggaacggctaccacg

SEQ ID NO: 697976 - DNA, 25 bp, Artificial sequence
  Synthetic oligonucleotide
gtggtgatcggccgctggaacggct

SEQ ID NO: 697977 - DNA, 25 bp, Artificial sequence
  Synthetic oligonucleotide
aagaaagtggtgatcggccgctgga

SEQ ID NO: 697978 - DNA, 25 bp, Artificial sequence
  Synthetic oligonucleotide
ccgcagaagaaagtggtgatcggcc

SEQ ID NO: 697979 - DNA, 25 bp, Artificial sequence
  Synthetic oligonucleotide
gccagccgcagaagaaagtggtgat

SEQ ID NO: 697980 - DNA, 25 bp, Artificial sequence
  Synthetic oligonucleotide
ccaagggccagccgcagaagaaagt

SEQ ID NO: 697981 - DNA, 25 bp, Artificial sequence
  Synthetic oligonucleotide
gggcgaccaagggccagccgcagaa

SEQ ID NO: 697982 - DNA, 25 bp, Artificial sequence
  Synthetic oligonucleotide
ccaccgtcgccggcgtcagcctggg

SEQ ID NO: 697983 - DNA, 25 bp, Artificial sequence
  Synthetic oligonucleotide
gccggacgagttcggcgtctgggcc

SEQ ID NO: 697984 - DNA, 25 bp, Artificial sequence
  Synthetic oligonucleotide
tcaaccagggcggcgagttctacca

SEQ ID NO: 697985 - DNA, 25 bp, Artificial sequence
  Synthetic oligonucleotide
ggcgaggaaaacgtcgccgccttca

SEQ ID NO: 697986 - DNA, 25 bp, Artificial sequence
  Synthetic oligonucleotide
ctcgaagtgggcgaggaaaacgtcg

SEQ ID NO: 697987 - DNA, 25 bp, Artificial sequence
  Synthetic oligonucleotide
gaagattctcgaagtgggcgaggaa

SEQ ID NO: 697988 - DNA, 25 bp, Artificial sequence
  Synthetic oligonucleotide
ggagaagaagattctcgaagtgggc

SEQ ID NO: 697989 - DNA, 25 bp, Artificial sequence
  Synthetic oligonucleotide
gcagttggagaagaagattctcgaa

SEQ ID NO: 697990 - DNA, 25 bp, Artificial sequence
  Synthetic oligonucleotide
cgccgagcagttggagaagaagatt

SEQ ID NO: 697991 - DNA, 25 bp, Artificial sequence
  Synthetic oligonucleotide
ctgggccgccgagcagttggagaag

SEQ ID NO: 697992 - DNA, 25 bp, Artificial sequence
  Synthetic oligonucleotide
gggtgatttccccatcccgggcatc

SEQ ID NO: 697993 - DNA, 25 bp, Artificial sequence
  Synthetic oligonucleotide
cgagttcggcgtctgggccgccgag

SEQ ID NO: 697994 - DNA, 25 bp, Artificial sequence
  Synthetic oligonucleotide
cgtcgccgccttcatcgccgagccg

SEQ ID NO: 697995 - DNA, 25 bp, Artificial sequence
  Synthetic oligonucleotide
atgtcgccggacgagttcggcgtct

SEQ ID NO: 697996 - DNA, 25 bp, Artificial sequence
  Synthetic oligonucleotide
ggcgacatgtcgccggacgagttcg

SEQ ID NO: 697997 - DNA, 25 bp, Artificial sequence
  Synthetic oligonucleotide
gagggcggcgacatgtcgccggacg

SEQ ID NO: 697998 - DNA, 25 bp, Artificial sequence
  Synthetic oligonucleotide
acctgccggccaagacccagcgggc

SEQ ID NO: 697999 - DNA, 25 bp, Artificial sequence
  Synthetic oligonucleotide
tactggtacggcgagggcggcgaca

SEQ ID NO: 698000 - DNA, 25 bp, Artificial sequence
  Synthetic oligonucleotide
cggagaacatgaagaagctcgccaa

SEQ ID NO: 698001 - DNA, 25 bp, Artificial sequence
  Synthetic oligonucleotide
atcgcccagccctactggtacggcg

SEQ ID NO: 698002 - DNA, 25 bp, Artificial sequence
  Synthetic oligonucleotide
gtccacatcgcccagccctactggt

SEQ ID NO: 698003 - DNA, 25 bp, Artificial sequence
  Synthetic oligonucleotide
gggcatcgtccacatcgcccagccc

SEQ ID NO: 698004 - DNA, 25 bp, Artificial sequence
  Synthetic oligonucleotide
cggcgtctgggccgccgagcagttg

SEQ ID NO: 698005 - DNA, 25 bp, Artificial sequence
  Synthetic oligonucleotide
atgattatctcgccgccgctggtga

SEQ ID NO: 698006 - DNA, 25 bp, Artificial sequence
  Synthetic oligonucleotide
gcgcgcaagtgcctcgatcagaccg

SEQ ID NO: 698007 - DNA, 25 bp, Artificial sequence
  Synthetic oligonucleotide
ccctggcgcgcaagtgcctcgatca

SEQ ID NO: 698008 - DNA, 25 bp, Artificial sequence
  Synthetic oligonucleotide
tgatcaccctggcgcgcaagtgcct

SEQ ID NO: 698009 - DNA, 25 bp, Artificial sequence
  Synthetic oligonucleotide
atgagttgatcaccctggcgcgcaa

SEQ ID NO: 698010 - DNA, 25 bp, Artificial sequence
  Synthetic oligonucleotide
agatcgatgagttgatcaccctggc

SEQ ID NO: 698011 - DNA, 25 bp, Artificial sequence
  Synthetic oligonucleotide
cgtcgcagatcgatgagttgatcac

SEQ ID NO: 698012 - DNA, 25 bp, Artificial sequence
  Synthetic oligonucleotide
tcgatccgtcgcagatcgatgagtt

SEQ ID NO: 698013 - DNA, 25 bp, Artificial sequence
  Synthetic oligonucleotide
tggtgatcgatccgtcgcagatcga

SEQ ID NO: 698014 - DNA, 25 bp, Artificial sequence
  Synthetic oligonucleotide
tcgtcgaagtgctcaaccagggcgg

SEQ ID NO: 698015 - DNA, 25 bp, Artificial sequence
  Synthetic oligonucleotide
atctcgccgccgctggtgatcgatc

SEQ ID NO: 698016 - DNA, 25 bp, Artificial sequence
  Synthetic oligonucleotide
agaccgccgccgccgtcctggcttg

SEQ ID NO: 698017 - DNA, 25 bp, Artificial sequence
  Synthetic oligonucleotide
gacactatgattatctcgccgccgc

SEQ ID NO: 698018 - DNA, 25 bp, Artificial sequence
  Synthetic oligonucleotide
gtgggcgacactatgattatctcgc

SEQ ID NO: 698019 - DNA, 25 bp, Artificial sequence
  Synthetic oligonucleotide
cgcgcggtgggcgacactatgatta

SEQ ID NO: 698020 - DNA, 25 bp, Artificial sequence
  Synthetic oligonucleotide
atcatgcgcgcggtgggcgacacta

SEQ ID NO: 698021 - DNA, 25 bp, Artificial sequence
  Synthetic oligonucleotide
cggtttgatcatgcgcgcggtgggc

SEQ ID NO: 698022 - DNA, 25 bp, Artificial sequence
  Synthetic oligonucleotide
cgcaacggtttgatcatgcgcgcgg

SEQ ID NO: 698023 - DNA, 25 bp, Artificial sequence
  Synthetic oligonucleotide
tgtttccgcaacggtttgatcatgc

SEQ ID NO: 698024 - DNA, 25 bp, Artificial sequence
  Synthetic oligonucleotide
gaacattgtttccgcaacggtttga

SEQ ID NO: 698025 - DNA, 25 bp, Artificial sequence
  Synthetic oligonucleotide
cgccgctggtgatcgatccgtcgca

SEQ ID NO: 698026 - DNA, 25 bp, Artificial sequence
  Synthetic oligonucleotide
gcgccagtgcgttggccaggctcac

SEQ ID NO: 698027 - DNA, 25 bp, Artificial sequence
  Synthetic oligonucleotide
gatacttcaacaaaaatggagctac

SEQ ID NO: 698028 - DNA, 25 bp, Artificial sequence
  Synthetic oligonucleotide
cgcccggatacttcaacaaaaatgg

SEQ ID NO: 698029 - DNA, 25 bp, Artificial sequence
  Synthetic oligonucleotide
cgccaccgcccggatacttcaacaa

SEQ ID NO: 698030 - DNA, 25 bp, Artificial sequence
  Synthetic oligonucleotide
tcggttgcgccaccgcccggatact

SEQ ID NO: 698031 - DNA, 25 bp, Artificial sequence
  Synthetic oligonucleotide
acgcgatcggttgcgccaccgcccg

SEQ ID NO: 698032 - DNA, 25 bp, Artificial sequence
  Synthetic oligonucleotide
tggtgacgcgatcggttgcgccacc

SEQ ID NO: 698033 - DNA, 25 bp, Artificial sequence
  Synthetic oligonucleotide
ccgggtggtgacgcgatcggttgcg

SEQ ID NO: 698034 - DNA, 25 bp, Artificial sequence
  Synthetic oligonucleotide
ggctcaccgggtggtgacgcgatcg

SEQ ID NO: 698035 - DNA, 25 bp, Artificial sequence
  Synthetic oligonucleotide
aagtgcctcgatcagaccgccgccg

SEQ ID NO: 698036 - DNA, 25 bp, Artificial sequence
  Synthetic oligonucleotide
gtgcgttggccaggctcaccgggtg

SEQ ID NO: 698037 - DNA, 25 bp, Artificial sequence
  Synthetic oligonucleotide
tcgatcagaccgccgccgccgtcct

SEQ ID NO: 698038 - DNA, 25 bp, Artificial sequence
  Synthetic oligonucleotide
cagactgcgccagtgcgttggccag

SEQ ID NO: 698039 - DNA, 25 bp, Artificial sequence
  Synthetic oligonucleotide
ttttgccagactgcgccagtgcgtt

SEQ ID NO: 698040 - DNA, 25 bp, Artificial sequence
  Synthetic oligonucleotide
gcggacttttgccagactgcgccag

SEQ ID NO: 698041 - DNA, 25 bp, Artificial sequence
  Synthetic oligonucleotide
ccctgagcggacttttgccagactg

SEQ ID NO: 698042 - DNA, 25 bp, Artificial sequence
  Synthetic oligonucleotide
ttgagtccctgagcggacttttgcc

SEQ ID NO: 698043 - DNA, 25 bp, Artificial sequence
  Synthetic oligonucleotide
cctggcttgagtccctgagcggact

SEQ ID NO: 698044 - DNA, 25 bp, Artificial sequence
  Synthetic oligonucleotide
gccgtcctggcttgagtccctgagc

SEQ ID NO: 698045 - DNA, 25 bp, Artificial sequence
  Synthetic oligonucleotide
gccgccgccgtcctggcttgagtcc

SEQ ID NO: 698046 - DNA, 25 bp, Artificial sequence
  Synthetic oligonucleotide
ggcgtcgggatgctgtgccgggaac

SEQ ID NO: 698047 - DNA, 25 bp, Artificial sequence
  Synthetic oligonucleotide
tggccaggctcaccgggtggtgacg

SEQ ID NO: 698048 - DNA, 25 bp, Artificial sequence
  Synthetic oligonucleotide
tggccctggagaacatccgcatcct

SEQ ID NO: 698049 - DNA, 25 bp, Artificial sequence
  Synthetic oligonucleotide
tgtgccgggaacattgtttccgcaa

SEQ ID NO: 698050 - DNA, 25 bp, Artificial sequence
  Synthetic oligonucleotide
aaacggcaccgtatttgcagaaacg

SEQ ID NO: 698051 - DNA, 25 bp, Artificial sequence
  Synthetic oligonucleotide
aggcggaaacggcaccgtatttgca

SEQ ID NO: 698052 - DNA, 25 bp, Artificial sequence
  Synthetic oligonucleotide
tcgagaaggtgaaggcggaaacggc

SEQ ID NO: 698053 - DNA, 25 bp, Artificial sequence
  Synthetic oligonucleotide
agatcatcgagaaggtgaaggcgga

SEQ ID NO: 698054 - DNA, 25 bp, Artificial sequence
  Synthetic oligonucleotide
aagagaagatcatcgagaaggtgaa

SEQ ID NO: 698055 - DNA, 25 bp, Artificial sequence
  Synthetic oligonucleotide
gcgcgaagagaagatcatcgagaag

SEQ ID NO: 698056 - DNA, 25 bp, Artificial sequence
  Synthetic oligonucleotide
catcctgcgcgaagagaagatcatc

SEQ ID NO: 698057 - DNA, 25 bp, Artificial sequence
  Synthetic oligonucleotide
tttgcagaaacgctggcaggagctg

SEQ ID NO: 698058 - DNA, 25 bp, Artificial sequence
  Synthetic oligonucleotide
ggagaacatccgcatcctgcgcgaa

SEQ ID NO: 698059 - DNA, 25 bp, Artificial sequence
  Synthetic oligonucleotide
gaaacgctggcaggagctggccgac

SEQ ID NO: 698060 - DNA, 25 bp, Artificial sequence
  Synthetic oligonucleotide
ccgccgtggccctggagaacatccg

SEQ ID NO: 698061 - DNA, 25 bp, Artificial sequence
  Synthetic oligonucleotide
tggcggccgccgtggccctggagaa

SEQ ID NO: 698062 - DNA, 25 bp, Artificial sequence
  Synthetic oligonucleotide
cccggtggcggccgccgtggccctg

SEQ ID NO: 698063 - DNA, 25 bp, Artificial sequence
  Synthetic oligonucleotide
cggtcacccggtggcggccgccgtg

SEQ ID NO: 698064 - DNA, 25 bp, Artificial sequence
  Synthetic oligonucleotide
tcacctattccggtcacccggtggc

SEQ ID NO: 698065 - DNA, 25 bp, Artificial sequence
  Synthetic oligonucleotide
cacggcttcacctattccggtcacc

SEQ ID NO: 698066 - DNA, 25 bp, Artificial sequence
  Synthetic oligonucleotide
tctaccacggcttcacctattccgg

SEQ ID NO: 698067 - DNA, 25 bp, Artificial sequence
  Synthetic oligonucleotide
gcgagttctaccacggcttcaccta

SEQ ID NO: 698068 - DNA, 25 bp, Artificial sequence
  Synthetic oligonucleotide
agggcggcgagttctaccacggctt

SEQ ID NO: 698069 - DNA, 25 bp, Artificial sequence
  Synthetic oligonucleotide
catccgcatcctgcgcgaagagaag

SEQ ID NO: 698070 - DNA, 25 bp, Artificial sequence
  Synthetic oligonucleotide
tggtcgccgccctggagctggtcaa

SEQ ID NO: 698071 - DNA, 25 bp, Artificial sequence
  Synthetic oligonucleotide
tcaacaaaaatggagctaccccgca

SEQ ID NO: 698072 - DNA, 25 bp, Artificial sequence
  Synthetic oligonucleotide
gacaagggcgtcgggatgctgtgcc

SEQ ID NO: 698073 - DNA, 25 bp, Artificial sequence
  Synthetic oligonucleotide
ttcaccgacaagggcgtcgggatgc

SEQ ID NO: 698074 - DNA, 25 bp, Artificial sequence
  Synthetic oligonucleotide
agcgtttcaccgacaagggcgtcgg

SEQ ID NO: 698075 - DNA, 25 bp, Artificial sequence
  Synthetic oligonucleotide
cccgcgagcgtttcaccgacaaggg

SEQ ID NO: 698076 - DNA, 25 bp, Artificial sequence
  Synthetic oligonucleotide
agaagacccgcgagcgtttcaccga

SEQ ID NO: 698077 - DNA, 25 bp, Artificial sequence
  Synthetic oligonucleotide
agaacaagaagacccgcgagcgttt

SEQ ID NO: 698078 - DNA, 25 bp, Artificial sequence
  Synthetic oligonucleotide
tggtcaagaacaagaagacccgcga

SEQ ID NO: 698079 - DNA, 25 bp, Artificial sequence
  Synthetic oligonucleotide
caccgtatttgcagaaacgctggca

SEQ ID NO: 698080 - DNA, 25 bp, Artificial sequence
  Synthetic oligonucleotide
ccgccctggagctggtcaagaacaa

SEQ ID NO: 698081 - DNA, 25 bp, Artificial sequence
  Synthetic oligonucleotide
ggatgctgtgccgggaacattgttt

SEQ ID NO: 698082 - DNA, 25 bp, Artificial sequence
  Synthetic oligonucleotide
tcggcatggtcgccgccctggagct

SEQ ID NO: 698083 - DNA, 25 bp, Artificial sequence
  Synthetic oligonucleotide
gcggggtcggcatggtcgccgccct

SEQ ID NO: 698084 - DNA, 25 bp, Artificial sequence
  Synthetic oligonucleotide
aagcgcgcggggtcggcatggtcgc

SEQ ID NO: 698085 - DNA, 25 bp, Artificial sequence
  Synthetic oligonucleotide
tgggcgaagcgcgcggggtcggcat

SEQ ID NO: 698086 - DNA, 25 bp, Artificial sequence
  Synthetic oligonucleotide
cgttggtgggcgaagcgcgcggggt

SEQ ID NO: 698087 - DNA, 25 bp, Artificial sequence
  Synthetic oligonucleotide
accacccgttggtgggcgaagcgcg

SEQ ID NO: 698088 - DNA, 25 bp, Artificial sequence
  Synthetic oligonucleotide
tggccgaccacccgttggtgggcga

SEQ ID NO: 698089 - DNA, 25 bp, Artificial sequence
  Synthetic oligonucleotide
ggagctggccgaccacccgttggtg

SEQ ID NO: 698090 - DNA, 25 bp, Artificial sequence
  Synthetic oligonucleotide
ctggcaggagctggccgaccacccg

SEQ ID NO: 698091 - DNA, 25 bp, Artificial sequence
  Synthetic oligonucleotide
tggagctggtcaagaacaagaagac

SEQ ID NO: 698092 - DNA, 25 bp, Artificial sequence
  Synthetic oligonucleotide
aggccgtgctcgacaagctctacgt

SEQ ID NO: 698093 - DNA, 25 bp, Artificial sequence
  Synthetic oligonucleotide
cgtacctggacccggatcaagaccg

SEQ ID NO: 698094 - DNA, 25 bp, Artificial sequence
  Synthetic oligonucleotide
cctgcagacccgtacctggacccgg

SEQ ID NO: 698095 - DNA, 25 bp, Artificial sequence
  Synthetic oligonucleotide
gctgcgcctgcagacccgtacctgg

SEQ ID NO: 698096 - DNA, 25 bp, Artificial sequence
  Synthetic oligonucleotide
caaggtgctgcgcctgcagacccgt

SEQ ID NO: 698097 - DNA, 25 bp, Artificial sequence
  Synthetic oligonucleotide
tgccggccaaggtgctgcgcctgca

SEQ ID NO: 698098 - DNA, 25 bp, Artificial sequence
  Synthetic oligonucleotide
cgtgttgccggccaaggtgctgcgc

SEQ ID NO: 698099 - DNA, 25 bp, Artificial sequence
  Synthetic oligonucleotide
ttccgccgtgttgccggccaaggtg

SEQ ID NO: 698100 - DNA, 25 bp, Artificial sequence
  Synthetic oligonucleotide
tctacgtttccgccgtgttgccggc

SEQ ID NO: 698101 - DNA, 25 bp, Artificial sequence
  Synthetic oligonucleotide
tgctggtaaagatcgaccgggtaac

SEQ ID NO: 698102 - DNA, 25 bp, Artificial sequence
  Synthetic oligonucleotide
tgctcgacaagctctacgtttccgc

SEQ ID NO: 698103 - DNA, 25 bp, Artificial sequence
  Synthetic oligonucleotide
caagaccggcaaataagttcaaatt

SEQ ID NO: 698104 - DNA, 25 bp, Artificial sequence
  Synthetic oligonucleotide
cgccgcaggccgtgctcgacaagct

SEQ ID NO: 698105 - DNA, 25 bp, Artificial sequence
  Synthetic oligonucleotide
tgtatccgccgcaggccgtgctcga

SEQ ID NO: 698106 - DNA, 25 bp, Artificial sequence
  Synthetic oligonucleotide
aggaggtgtatccgccgcaggccgt

SEQ ID NO: 698107 - DNA, 25 bp, Artificial sequence
  Synthetic oligonucleotide
acagcgaggaggtgtatccgccgca

SEQ ID NO: 698108 - DNA, 25 bp, Artificial sequence
  Synthetic oligonucleotide
tcagcgacagcgaggaggtgtatcc

SEQ ID NO: 698109 - DNA, 25 bp, Artificial sequence
  Synthetic oligonucleotide
aagagcgtcagcgacagcgaggagg

SEQ ID NO: 698110 - DNA, 25 bp, Artificial sequence
  Synthetic oligonucleotide
atggacaagagcgtcagcgacagcg

SEQ ID NO: 698111 - DNA, 25 bp, Artificial sequence
  Synthetic oligonucleotide
ccgctgatggacaagagcgtcagcg

SEQ ID NO: 698112 - DNA, 25 bp, Artificial sequence
  Synthetic oligonucleotide
acaagctctacgtttccgccgtgtt

SEQ ID NO: 698113 - DNA, 25 bp, Artificial sequence
  Synthetic oligonucleotide
ggtaatggcgatagcctccggtgcc

SEQ ID NO: 698114 - DNA, 25 bp, Artificial sequence
  Synthetic oligonucleotide
aagtacatctccgacctggccaacg

SEQ ID NO: 698115 - DNA, 25 bp, Artificial sequence
  Synthetic oligonucleotide
agccgaaagaggtgctggtaaagat

SEQ ID NO: 698116 - DNA, 25 bp, Artificial sequence
  Synthetic oligonucleotide
accagcagccgaaagaggtgctggt

SEQ ID NO: 698117 - DNA, 25 bp, Artificial sequence
  Synthetic oligonucleotide
agggcaaccagcagccgaaagaggt

SEQ ID NO: 698118 - DNA, 25 bp, Artificial sequence
  Synthetic oligonucleotide
ccctagagggcaaccagcagccgaa

SEQ ID NO: 698119 - DNA, 25 bp, Artificial sequence
  Synthetic oligonucleotide
agaaagccctagagggcaaccagca

SEQ ID NO: 698120 - DNA, 25 bp, Artificial sequence
  Synthetic oligonucleotide
gcctacaagaaagccctagagggca

SEQ ID NO: 698121 - DNA, 25 bp, Artificial sequence
  Synthetic oligonucleotide
ccggtgcctacaagaaagccctaga

SEQ ID NO: 698122 - DNA, 25 bp, Artificial sequence
  Synthetic oligonucleotide
tggacccggatcaagaccggcaaat

SEQ ID NO: 698123 - DNA, 25 bp, Artificial sequence
  Synthetic oligonucleotide
tggcgatagcctccggtgcctacaa

SEQ ID NO: 698124 - DNA, 25 bp, Artificial sequence
  Synthetic oligonucleotide
cggatcaagaccggcaaataagttc

SEQ ID NO: 698125 - DNA, 25 bp, Artificial sequence
  Synthetic oligonucleotide
agttgtggtaatggcgatagcctcc

SEQ ID NO: 698126 - DNA, 25 bp, Artificial sequence
  Synthetic oligonucleotide
cttgggagttgtggtaatggcgata

SEQ ID NO: 698127 - DNA, 25 bp, Artificial sequence
  Synthetic oligonucleotide
caacgacttgggagttgtggtaatg

SEQ ID NO: 698128 - DNA, 25 bp, Artificial sequence
  Synthetic oligonucleotide
cgggctcaacgacttgggagttgtg

SEQ ID NO: 698129 - DNA, 25 bp, Artificial sequence
  Synthetic oligonucleotide
gtgaccgggctcaacgacttgggag

SEQ ID NO: 698130 - DNA, 25 bp, Artificial sequence
  Synthetic oligonucleotide
ggtagcgtgaccgggctcaacgact

SEQ ID NO: 698131 - DNA, 25 bp, Artificial sequence
  Synthetic oligonucleotide
tccgcccggtagcgtgaccgggctc

SEQ ID NO: 698132 - DNA, 25 bp, Artificial sequence
  Synthetic oligonucleotide
agttcaaattccgcccggtagcgtg

SEQ ID NO: 698133 - DNA, 25 bp, Artificial sequence
  Synthetic oligonucleotide
cgcgataccgggggcccgcccgctg

SEQ ID NO: 698134 - DNA, 25 bp, Artificial sequence
  Synthetic oligonucleotide
tagcctccggtgcctacaagaaagc

SEQ ID NO: 698135 - DNA, 25 bp, Artificial sequence
  Synthetic oligonucleotide
tgcccgcgccgaagaggccggcaag

SEQ ID NO: 698136 - DNA, 25 bp, Artificial sequence
  Synthetic oligonucleotide
gcccgcccgctgatggacaagagcg

SEQ ID NO: 698137 - DNA, 25 bp, Artificial sequence
  Synthetic oligonucleotide
gaaggcgccaacctgtggttcgacc

SEQ ID NO: 698138 - DNA, 25 bp, Artificial sequence
  Synthetic oligonucleotide
cccaaggaaggcgccaacctgtggt

SEQ ID NO: 698139 - DNA, 25 bp, Artificial sequence
  Synthetic oligonucleotide
cgtgattcccaaggaaggcgccaac

SEQ ID NO: 698140 - DNA, 25 bp, Artificial sequence
  Synthetic oligonucleotide
ccagtacgtgattcccaaggaaggc

SEQ ID NO: 698141 - DNA, 25 bp, Artificial sequence
  Synthetic oligonucleotide
cgacatccagtacgtgattcccaag

SEQ ID NO: 698142 - DNA, 25 bp, Artificial sequence
  Synthetic oligonucleotide
gggcatcgacatccagtacgtgatt

SEQ ID NO: 698143 - DNA, 25 bp, Artificial sequence
  Synthetic oligonucleotide
cggcaagggcatcgacatccagtac

SEQ ID NO: 698144 - DNA, 25 bp, Artificial sequence
  Synthetic oligonucleotide
ctgtggttcgacctgatggcgattc

SEQ ID NO: 698145 - DNA, 25 bp, Artificial sequence
  Synthetic oligonucleotide
cgccgaagaggccggcaagggcatc

SEQ ID NO: 698146 - DNA, 25 bp, Artificial sequence
  Synthetic oligonucleotide
gttcgacctgatggcgattcccgcc

SEQ ID NO: 698147 - DNA, 25 bp, Artificial sequence
  Synthetic oligonucleotide
ggccgctgcccgcgccgaagaggcc

SEQ ID NO: 698148 - DNA, 25 bp, Artificial sequence
  Synthetic oligonucleotide
cttccaggccgctgcccgcgccgaa

SEQ ID NO: 698149 - DNA, 25 bp, Artificial sequence
  Synthetic oligonucleotide
ggacgtcttccaggccgctgcccgc

SEQ ID NO: 698150 - DNA, 25 bp, Artificial sequence
  Synthetic oligonucleotide
tccggggacgtcttccaggccgctg

SEQ ID NO: 698151 - DNA, 25 bp, Artificial sequence
  Synthetic oligonucleotide
tcggctattccggggacgtcttcca

SEQ ID NO: 698152 - DNA, 25 bp, Artificial sequence
  Synthetic oligonucleotide
ctgcgtcgccttcggctattccggg

SEQ ID NO: 698153 - DNA, 25 bp, Artificial sequence
  Synthetic oligonucleotide
gcaacatctgcgtcgccttcggcta

SEQ ID NO: 698154 - DNA, 25 bp, Artificial sequence
  Synthetic oligonucleotide
gccaacggcaacatctgcgtcgcct

SEQ ID NO: 698155 - DNA, 25 bp, Artificial sequence
  Synthetic oligonucleotide
tcctcttcgagccggagaacatgaa

SEQ ID NO: 698156 - DNA, 25 bp, Artificial sequence
  Synthetic oligonucleotide
agaggccggcaagggcatcgacatc

SEQ ID NO: 698157 - DNA, 25 bp, Artificial sequence
  Synthetic oligonucleotide
atcgactacctgctgcgtccggagg

SEQ ID NO: 698158 - DNA, 25 bp, Artificial sequence
  Synthetic oligonucleotide
taaagatcgaccgggtaaccaagca

SEQ ID NO: 698159 - DNA, 25 bp, Artificial sequence
  Synthetic oligonucleotide
gctacgccaacgcgataccgggggc

SEQ ID NO: 698160 - DNA, 25 bp, Artificial sequence
  Synthetic oligonucleotide
acgtcggctacgccaacgcgatacc

SEQ ID NO: 698161 - DNA, 25 bp, Artificial sequence
  Synthetic oligonucleotide
gcgactacgtcggctacgccaacgc

SEQ ID NO: 698162 - DNA, 25 bp, Artificial sequence
  Synthetic oligonucleotide
aggtcagcgactacgtcggctacgc

SEQ ID NO: 698163 - DNA, 25 bp, Artificial sequence
  Synthetic oligonucleotide
tcgccaaggtcagcgactacgtcgg

SEQ ID NO: 698164 - DNA, 25 bp, Artificial sequence
  Synthetic oligonucleotide
ggtgatcgccaaggtcagcgactac

SEQ ID NO: 698165 - DNA, 25 bp, Artificial sequence
  Synthetic oligonucleotide
tccggaggtgatcgccaaggtcagc

SEQ ID NO: 698166 - DNA, 25 bp, Artificial sequence
  Synthetic oligonucleotide
gccaacctgtggttcgacctgatgg

SEQ ID NO: 698167 - DNA, 25 bp, Artificial sequence
  Synthetic oligonucleotide
tacctgctgcgtccggaggtgatcg

SEQ ID NO: 698168 - DNA, 25 bp, Artificial sequence
  Synthetic oligonucleotide
ccgggggcccgcccgctgatggaca

SEQ ID NO: 698169 - DNA, 25 bp, Artificial sequence
  Synthetic oligonucleotide
gcgttcatcgactacctgctgcgtc

SEQ ID NO: 698170 - DNA, 25 bp, Artificial sequence
  Synthetic oligonucleotide
gcctacgcgttcatcgactacctgc

SEQ ID NO: 698171 - DNA, 25 bp, Artificial sequence
  Synthetic oligonucleotide
gataacgcctacgcgttcatcgact

SEQ ID NO: 698172 - DNA, 25 bp, Artificial sequence
  Synthetic oligonucleotide
gccgccgataacgcctacgcgttca

SEQ ID NO: 698173 - DNA, 25 bp, Artificial sequence
  Synthetic oligonucleotide
gccaaggccgccgataacgcctacg

SEQ ID NO: 698174 - DNA, 25 bp, Artificial sequence
  Synthetic oligonucleotide
gccgatgccaaggccgccgataacg

SEQ ID NO: 698175 - DNA, 25 bp, Artificial sequence
  Synthetic oligonucleotide
attcccgccgatgccaaggccgccg

SEQ ID NO: 698176 - DNA, 25 bp, Artificial sequence
  Synthetic oligonucleotide
tggcgattcccgccgatgccaaggc

SEQ ID NO: 698177 - DNA, 25 bp, Artificial sequence
  Synthetic oligonucleotide
acctgatggcgattcccgccgatgc

SEQ ID NO: 698178 - DNA, 25 bp, Artificial sequence
  Synthetic oligonucleotide
ctgcgtccggaggtgatcgccaagg

SEQ ID NO: 698179 - DNA, 25 bp, Artificial sequence
  Synthetic oligonucleotide
ccgagatcgacgagcgcgtggccga

SEQ ID NO: 698180 - DNA, 25 bp, Artificial sequence
  Synthetic oligonucleotide
aagcgcaagccgcaccagctctccg

SEQ ID NO: 698181 - DNA, 25 bp, Artificial sequence
  Synthetic oligonucleotide
tacgccaagcgcaagccgcaccagc

SEQ ID NO: 698182 - DNA, 25 bp, Artificial sequence
  Synthetic oligonucleotide
cccagtacgccaagcgcaagccgca

SEQ ID NO: 698183 - DNA, 25 bp, Artificial sequence
  Synthetic oligonucleotide
acatgacccagtacgccaagcgcaa

SEQ ID NO: 698184 - DNA, 25 bp, Artificial sequence
  Synthetic oligonucleotide
tggtgcacatgacccagtacgccaa

SEQ ID NO: 698185 - DNA, 25 bp, Artificial sequence
  Synthetic oligonucleotide
tcaagctggtgcacatgacccagta

SEQ ID NO: 698186 - DNA, 25 bp, Artificial sequence
  Synthetic oligonucleotide
agatgctcaagctggtgcacatgac

SEQ ID NO: 698187 - DNA, 25 bp, Artificial sequence
  Synthetic oligonucleotide
tggccgagatgctcaagctggtgca

SEQ ID NO: 698188 - DNA, 25 bp, Artificial sequence
  Synthetic oligonucleotide
aagaggtgctggtaaagatcgaccg

SEQ ID NO: 698189 - DNA, 25 bp, Artificial sequence
  Synthetic oligonucleotide
tcgacgagcgcgtggccgagatgct

SEQ ID NO: 698190 - DNA, 25 bp, Artificial sequence
  Synthetic oligonucleotide
ctctccggcggccagcgccagcggg

SEQ ID NO: 698191 - DNA, 25 bp, Artificial sequence
  Synthetic oligonucleotide
ccaaggccgagatcgacgagcgcgt

SEQ ID NO: 698192 - DNA, 25 bp, Artificial sequence
  Synthetic oligonucleotide
gcctgcccaaggccgagatcgacga

SEQ ID NO: 698193 - DNA, 25 bp, Artificial sequence
  Synthetic oligonucleotide
caggacggcctgcccaaggccgaga

SEQ ID NO: 698194 - DNA, 25 bp, Artificial sequence
  Synthetic oligonucleotide
ctcaagcaggacggcctgcccaagg

SEQ ID NO: 698195 - DNA, 25 bp, Artificial sequence
  Synthetic oligonucleotide
ttcggcctcaagcaggacggcctgc

SEQ ID NO: 698196 - DNA, 25 bp, Artificial sequence
  Synthetic oligonucleotide
tcgccttcggcctcaagcaggacgg

SEQ ID NO: 698197 - DNA, 25 bp, Artificial sequence
  Synthetic oligonucleotide
gaacatcgccttcggcctcaagcag

SEQ ID NO: 698198 - DNA, 25 bp, Artificial sequence
  Synthetic oligonucleotide
ggcgcagaacatcgccttcggcctc

SEQ ID NO: 698199 - DNA, 25 bp, Artificial sequence
  Synthetic oligonucleotide
agcgcgtggccgagatgctcaagct

SEQ ID NO: 698200 - DNA, 25 bp, Artificial sequence
  Synthetic oligonucleotide
ccgaagctgctgctgctcgacgagc

SEQ ID NO: 698201 - DNA, 25 bp, Artificial sequence
  Synthetic oligonucleotide
tgcaactggaactggtggagatcat

SEQ ID NO: 698202 - DNA, 25 bp, Artificial sequence
  Synthetic oligonucleotide
cgcagatgcaactggaactggtgga

SEQ ID NO: 698203 - DNA, 25 bp, Artificial sequence
  Synthetic oligonucleotide
tgcgctcgcagatgcaactggaact

SEQ ID NO: 698204 - DNA, 25 bp, Artificial sequence
  Synthetic oligonucleotide
agaagctgcgctcgcagatgcaact

SEQ ID NO: 698205 - DNA, 25 bp, Artificial sequence
  Synthetic oligonucleotide
tggacaagaagctgcgctcgcagat

SEQ ID NO: 698206 - DNA, 25 bp, Artificial sequence
  Synthetic oligonucleotide
gcgcgctggacaagaagctgcgctc

SEQ ID NO: 698207 - DNA, 25 bp, Artificial sequence
  Synthetic oligonucleotide
cgatgggcgcgctggacaagaagct

SEQ ID NO: 698208 - DNA, 25 bp, Artificial sequence
  Synthetic oligonucleotide
acgagccgatgggcgcgctggacaa

SEQ ID NO: 698209 - DNA, 25 bp, Artificial sequence
  Synthetic oligonucleotide
aagccgcaccagctctccggcggcc

SEQ ID NO: 698210 - DNA, 25 bp, Artificial sequence
  Synthetic oligonucleotide
tgctgctgctcgacgagccgatggg

SEQ ID NO: 698211 - DNA, 25 bp, Artificial sequence
  Synthetic oligonucleotide
caccagctctccggcggccagcgcc

SEQ ID NO: 698212 - DNA, 25 bp, Artificial sequence
  Synthetic oligonucleotide
aagcggccgaagctgctgctgctcg

SEQ ID NO: 698213 - DNA, 25 bp, Artificial sequence
  Synthetic oligonucleotide
ctggccaagcggccgaagctgctgc

SEQ ID NO: 698214 - DNA, 25 bp, Artificial sequence
  Synthetic oligonucleotide
gttcgctggccaagcggccgaagct

SEQ ID NO: 698215 - DNA, 25 bp, Artificial sequence
  Synthetic oligonucleotide
tggctcgttcgctggccaagcggcc

SEQ ID NO: 698216 - DNA, 25 bp, Artificial sequence
  Synthetic oligonucleotide
ggccctggctcgttcgctggccaag

SEQ ID NO: 698217 - DNA, 25 bp, Artificial sequence
  Synthetic oligonucleotide
agcgggtggccctggctcgttcgct

SEQ ID NO: 698218 - DNA, 25 bp, Artificial sequence
  Synthetic oligonucleotide
agcgccagcgggtggccctggctcg

SEQ ID NO: 698219 - DNA, 25 bp, Artificial sequence
  Synthetic oligonucleotide
ggcggccagcgccagcgggtggccc

SEQ ID NO: 698220 - DNA, 25 bp, Artificial sequence
  Synthetic oligonucleotide
ttcccgcacatgagcgtggcgcaga

SEQ ID NO: 698221 - DNA, 25 bp, Artificial sequence
  Synthetic oligonucleotide
tgctcgacgagccgatgggcgcgct

SEQ ID NO: 698222 - DNA, 25 bp, Artificial sequence
  Synthetic oligonucleotide
tgaccatcaacaagggcgagatctt

SEQ ID NO: 698223 - DNA, 25 bp, Artificial sequence
  Synthetic oligonucleotide
agcgtggcgcagaacatcgccttcg

SEQ ID NO: 698224 - DNA, 25 bp, Artificial sequence
  Synthetic oligonucleotide
aaatccaccctgttacgcatgctcg

SEQ ID NO: 698225 - DNA, 25 bp, Artificial sequence
  Synthetic oligonucleotide
tcgggtaaatccaccctgttacgca

SEQ ID NO: 698226 - DNA, 25 bp, Artificial sequence
  Synthetic oligonucleotide
ctccggctcgggtaaatccaccctg

SEQ ID NO: 698227 - DNA, 25 bp, Artificial sequence
  Synthetic oligonucleotide
ggcggctccggctcgggtaaatcca

SEQ ID NO: 698228 - DNA, 25 bp, Artificial sequence
  Synthetic oligonucleotide
ctgctcggcggctccggctcgggta

SEQ ID NO: 698229 - DNA, 25 bp, Artificial sequence
  Synthetic oligonucleotide
ttcgccctgctcggcggctccggct

SEQ ID NO: 698230 - DNA, 25 bp, Artificial sequence
  Synthetic oligonucleotide
gagatcttcgccctgctcggcggct

SEQ ID NO: 698231 - DNA, 25 bp, Artificial sequence
  Synthetic oligonucleotide
gttacgcatgctcgccggtttcgag

SEQ ID NO: 698232 - DNA, 25 bp, Artificial sequence
  Synthetic oligonucleotide
tcaacaagggcgagatcttcgccct

SEQ ID NO: 698233 - DNA, 25 bp, Artificial sequence
  Synthetic oligonucleotide
catgctcgccggtttcgagcggccc

SEQ ID NO: 698234 - DNA, 25 bp, Artificial sequence
  Synthetic oligonucleotide
tgtccctgaccatcaacaagggcga

SEQ ID NO: 698235 - DNA, 25 bp, Artificial sequence
  Synthetic oligonucleotide
acaccgtgtccctgaccatcaacaa

SEQ ID NO: 698236 - DNA, 25 bp, Artificial sequence
  Synthetic oligonucleotide
cggtggacaccgtgtccctgaccat

SEQ ID NO: 698237 - DNA, 25 bp, Artificial sequence
  Synthetic oligonucleotide
cgctggcggtggacaccgtgtccct

SEQ ID NO: 698238 - DNA, 25 bp, Artificial sequence
  Synthetic oligonucleotide
acgagacgctggcggtggacaccgt

SEQ ID NO: 698239 - DNA, 25 bp, Artificial sequence
  Synthetic oligonucleotide
agttcgacgagacgctggcggtgga

SEQ ID NO: 698240 - DNA, 25 bp, Artificial sequence
  Synthetic oligonucleotide
ccaagcagttcgacgagacgctggc

SEQ ID NO: 698241 - DNA, 25 bp, Artificial sequence
  Synthetic oligonucleotide
gggtaaccaagcagttcgacgagac

SEQ ID NO: 698242 - DNA, 25 bp, Artificial sequence
  Synthetic oligonucleotide
tcgaccgggtaaccaagcagttcga

SEQ ID NO: 698243 - DNA, 25 bp, Artificial sequence
  Synthetic oligonucleotide
agggcgagatcttcgccctgctcgg

SEQ ID NO: 698244 - DNA, 25 bp, Artificial sequence
  Synthetic oligonucleotide
atcaccgacctgccgccctacgagc

SEQ ID NO: 698245 - DNA, 25 bp, Artificial sequence
  Synthetic oligonucleotide
ctcctccaagtacatctccgacctg

SEQ ID NO: 698246 - DNA, 25 bp, Artificial sequence
  Synthetic oligonucleotide
gcgctgttcccgcacatgagcgtgg

SEQ ID NO: 698247 - DNA, 25 bp, Artificial sequence
  Synthetic oligonucleotide
tcctatgcgctgttcccgcacatga

SEQ ID NO: 698248 - DNA, 25 bp, Artificial sequence
  Synthetic oligonucleotide
gttccagtcctatgcgctgttcccg

SEQ ID NO: 698249 - DNA, 25 bp, Artificial sequence
  Synthetic oligonucleotide
catgatgttccagtcctatgcgctg

SEQ ID NO: 698250 - DNA, 25 bp, Artificial sequence
  Synthetic oligonucleotide
gatcaacatgatgttccagtcctat

SEQ ID NO: 698251 - DNA, 25 bp, Artificial sequence
  Synthetic oligonucleotide
gcggccgatcaacatgatgttccag

SEQ ID NO: 698252 - DNA, 25 bp, Artificial sequence
  Synthetic oligonucleotide
ctacgagcggccgatcaacatgatg

SEQ ID NO: 698253 - DNA, 25 bp, Artificial sequence
  Synthetic oligonucleotide
accctgttacgcatgctcgccggtt

SEQ ID NO: 698254 - DNA, 25 bp, Artificial sequence
  Synthetic oligonucleotide
gacctgccgccctacgagcggccga

SEQ ID NO: 698255 - DNA, 25 bp, Artificial sequence
  Synthetic oligonucleotide
cacatgagcgtggcgcagaacatcg

SEQ ID NO: 698256 - DNA, 25 bp, Artificial sequence
  Synthetic oligonucleotide
caggacatcaccgacctgccgccct

SEQ ID NO: 698257 - DNA, 25 bp, Artificial sequence
  Synthetic oligonucleotide
gatggccaggacatcaccgacctgc

SEQ ID NO: 698258 - DNA, 25 bp, Artificial sequence
  Synthetic oligonucleotide
tcctcgatggccaggacatcaccga

SEQ ID NO: 698259 - DNA, 25 bp, Artificial sequence
  Synthetic oligonucleotide
ggatcttcctcgatggccaggacat

SEQ ID NO: 698260 - DNA, 25 bp, Artificial sequence
  Synthetic oligonucleotide
aggggcggatcttcctcgatggcca

SEQ ID NO: 698261 - DNA, 25 bp, Artificial sequence
  Synthetic oligonucleotide
caccgaggggcggatcttcctcgat

SEQ ID NO: 698262 - DNA, 25 bp, Artificial sequence
  Synthetic oligonucleotide
gcggcccaccgaggggcggatcttc

SEQ ID NO: 698263 - DNA, 25 bp, Artificial sequence
  Synthetic oligonucleotide
ttcgagcggcccaccgaggggcgga

SEQ ID NO: 698264 - DNA, 25 bp, Artificial sequence
  Synthetic oligonucleotide
cgccggtttcgagcggcccaccgag

SEQ ID NO: 698265 - DNA, 25 bp, Artificial sequence
  Synthetic oligonucleotide
gccgccctacgagcggccgatcaac

SEQ ID NO: 698266 - DNA, 25 bp, Artificial sequence
  Synthetic oligonucleotide
atgaaacccgagtgatctgggctta

SEQ ID NO: 698267 - DNA, 25 bp, Artificial sequence
  Synthetic oligonucleotide
gtgctgccgtgaaaaggcccggaac

SEQ ID NO: 698268 - DNA, 25 bp, Artificial sequence
  Synthetic oligonucleotide
ggcagggtgctgccgtgaaaaggcc

SEQ ID NO: 698269 - DNA, 25 bp, Artificial sequence
  Synthetic oligonucleotide
cgaacaggcagggtgctgccgtgaa

SEQ ID NO: 698270 - DNA, 25 bp, Artificial sequence
  Synthetic oligonucleotide
cacgggtcgaacaggcagggtgctg

SEQ ID NO: 698271 - DNA, 25 bp, Artificial sequence
  Synthetic oligonucleotide
aagaacacgggtcgaacaggcaggg

SEQ ID NO: 698272 - DNA, 25 bp, Artificial sequence
  Synthetic oligonucleotide
cacttgaagaacacgggtcgaacag

SEQ ID NO: 698273 - DNA, 25 bp, Artificial sequence
  Synthetic oligonucleotide
catcggcacttgaagaacacgggtc

SEQ ID NO: 698274 - DNA, 25 bp, Artificial sequence
  Synthetic oligonucleotide
ggcttacatcggcacttgaagaaca

SEQ ID NO: 698275 - DNA, 25 bp, Artificial sequence
  Synthetic oligonucleotide
ttacatcgctcccaccaccctcaag

SEQ ID NO: 698276 - DNA, 25 bp, Artificial sequence
  Synthetic oligonucleotide
cccgagtgatctgggcttacatcgg

SEQ ID NO: 698277 - DNA, 25 bp, Artificial sequence
  Synthetic oligonucleotide
aggagtcggacatgcaacattccat

SEQ ID NO: 698278 - DNA, 25 bp, Artificial sequence
  Synthetic oligonucleotide
gttgtcatgaaacccgagtgatctg

SEQ ID NO: 698279 - DNA, 25 bp, Artificial sequence
  Synthetic oligonucleotide
cgtcgggttgtcatgaaacccgagt

SEQ ID NO: 698280 - DNA, 25 bp, Artificial sequence
  Synthetic oligonucleotide
cggaatcgtcgggttgtcatgaaac

SEQ ID NO: 698281 - DNA, 25 bp, Artificial sequence
  Synthetic oligonucleotide
tcccggcggaatcgtcgggttgtca

SEQ ID NO: 698282 - DNA, 25 bp, Artificial sequence
  Synthetic oligonucleotide
catgtttcccggcggaatcgtcggg

SEQ ID NO: 698283 - DNA, 25 bp, Artificial sequence
  Synthetic oligonucleotide
tcactcatgtttcccggcggaatcg

SEQ ID NO: 698284 - DNA, 25 bp, Artificial sequence
  Synthetic oligonucleotide
cccagctcactcatgtttcccggcg

SEQ ID NO: 698285 - DNA, 25 bp, Artificial sequence
  Synthetic oligonucleotide
agggaacccagctcactcatgtttc

SEQ ID NO: 698286 - DNA, 25 bp, Artificial sequence
  Synthetic oligonucleotide
tgatctgggcttacatcggcacttg

SEQ ID NO: 698287 - DNA, 25 bp, Artificial sequence
  Synthetic oligonucleotide
tacggcgatcgcgggccccgtgcag

SEQ ID NO: 698288 - DNA, 25 bp, Artificial sequence
  Synthetic oligonucleotide
atctccgacctggccaacggcaaca

SEQ ID NO: 698289 - DNA, 25 bp, Artificial sequence
  Synthetic oligonucleotide
aactggaccgattacatcgctccca

SEQ ID NO: 698290 - DNA, 25 bp, Artificial sequence
  Synthetic oligonucleotide
tctataactggaccgattacatcgc

SEQ ID NO: 698291 - DNA, 25 bp, Artificial sequence
  Synthetic oligonucleotide
gcacatctataactggaccgattac

SEQ ID NO: 698292 - DNA, 25 bp, Artificial sequence
  Synthetic oligonucleotide
gagcctgcacatctataactggacc

SEQ ID NO: 698293 - DNA, 25 bp, Artificial sequence
  Synthetic oligonucleotide
gaagaagagcctgcacatctataac

SEQ ID NO: 698294 - DNA, 25 bp, Artificial sequence
  Synthetic oligonucleotide
ggcggagaagaagagcctgcacatc

SEQ ID NO: 698295 - DNA, 25 bp, Artificial sequence
  Synthetic oligonucleotide
cgtgcaggcggagaagaagagcctg

SEQ ID NO: 698296 - DNA, 25 bp, Artificial sequence
  Synthetic oligonucleotide
aaggcccggaacaggagtcggacat

SEQ ID NO: 698297 - DNA, 25 bp, Artificial sequence
  Synthetic oligonucleotide
gatcgcgggccccgtgcaggcggag

SEQ ID NO: 698298 - DNA, 25 bp, Artificial sequence
  Synthetic oligonucleotide
cggaacaggagtcggacatgcaaca

SEQ ID NO: 698299 - DNA, 25 bp, Artificial sequence
  Synthetic oligonucleotide
tctggctacggcgatcgcgggcccc

SEQ ID NO: 698300 - DNA, 25 bp, Artificial sequence
  Synthetic oligonucleotide
tagccgctctggctacggcgatcgc

SEQ ID NO: 698301 - DNA, 25 bp, Artificial sequence
  Synthetic oligonucleotide
tgctggtagccgctctggctacggc

SEQ ID NO: 698302 - DNA, 25 bp, Artificial sequence
  Synthetic oligonucleotide
agacactgctggtagccgctctggc

SEQ ID NO: 698303 - DNA, 25 bp, Artificial sequence
  Synthetic oligonucleotide
ttggcaagacactgctggtagccgc

SEQ ID NO: 698304 - DNA, 25 bp, Artificial sequence
  Synthetic oligonucleotide
attccattggcaagacactgctggt

SEQ ID NO: 698305 - DNA, 25 bp, Artificial sequence
  Synthetic oligonucleotide
tgcaacattccattggcaagacact

SEQ ID NO: 698306 - DNA, 25 bp, Artificial sequence
  Synthetic oligonucleotide
cggacatgcaacattccattggcaa

SEQ ID NO: 698307 - DNA, 25 bp, Artificial sequence
  Synthetic oligonucleotide
tgtcgctcgcaccggggccgagggc

SEQ ID NO: 698308 - DNA, 25 bp, Artificial sequence
  Synthetic oligonucleotide
gggccccgtgcaggcggagaagaag

SEQ ID NO: 698309 - DNA, 25 bp, Artificial sequence
  Synthetic oligonucleotide
tccgcgaggagcccggcggcgcctg

SEQ ID NO: 698310 - DNA, 25 bp, Artificial sequence
  Synthetic oligonucleotide
gccggtagggaacccagctcactca

SEQ ID NO: 698311 - DNA, 25 bp, Artificial sequence
  Synthetic oligonucleotide
tccggccgcgctcccctgcgaagag

SEQ ID NO: 698312 - DNA, 25 bp, Artificial sequence
  Synthetic oligonucleotide
gtttcctccggccgcgctcccctgc

SEQ ID NO: 698313 - DNA, 25 bp, Artificial sequence
  Synthetic oligonucleotide
cacgagagaaccggaacgcggccgg

SEQ ID NO: 698314 - DNA, 25 bp, Artificial sequence
  Synthetic oligonucleotide
tccggcacgagagaaccggaacgcg

SEQ ID NO: 698315 - DNA, 25 bp, Artificial sequence
  Synthetic oligonucleotide
cggcgctccggcacgagagaaccgg

SEQ ID NO: 698316 - DNA, 25 bp, Artificial sequence
  Synthetic oligonucleotide
aagccgccggcgctccggcacgaga

SEQ ID NO: 698317 - DNA, 25 bp, Artificial sequence
  Synthetic oligonucleotide
gcgcctgaagccgccggcgctccgg

SEQ ID NO: 698318 - DNA, 25 bp, Artificial sequence
  Synthetic oligonucleotide
cccctgcgaagaggttcgactcttt

SEQ ID NO: 698319 - DNA, 25 bp, Artificial sequence
  Synthetic oligonucleotide
aggagcccggcggcgcctgaagccg

SEQ ID NO: 698320 - DNA, 25 bp, Artificial sequence
  Synthetic oligonucleotide
cgaagaggttcgactcttttgcccg

SEQ ID NO: 698321 - DNA, 25 bp, Artificial sequence
  Synthetic oligonucleotide
aagtgatccgcgaggagcccggcgg

SEQ ID NO: 698322 - DNA, 25 bp, Artificial sequence
  Synthetic oligonucleotide
tccggcaagtgatccgcgaggagcc

SEQ ID NO: 698323 - DNA, 25 bp, Artificial sequence
  Synthetic oligonucleotide
tcaagtccggcaagtgatccgcgag

SEQ ID NO: 698324 - DNA, 25 bp, Artificial sequence
  Synthetic oligonucleotide
ccaagatcaagtccggcaagtgatc

SEQ ID NO: 698325 - DNA, 25 bp, Artificial sequence
  Synthetic oligonucleotide
gctggaccaagatcaagtccggcaa

SEQ ID NO: 698326 - DNA, 25 bp, Artificial sequence
  Synthetic oligonucleotide
cccgcagctggaccaagatcaagtc

SEQ ID NO: 698327 - DNA, 25 bp, Artificial sequence
  Synthetic oligonucleotide
cgatgacccgcagctggaccaagat

SEQ ID NO: 698328 - DNA, 25 bp, Artificial sequence
  Synthetic oligonucleotide
agcgggcgatgacccgcagctggac

SEQ ID NO: 698329 - DNA, 25 bp, Artificial sequence
  Synthetic oligonucleotide
gacccagcgggcgatgacccgcagc

SEQ ID NO: 698330 - DNA, 25 bp, Artificial sequence
  Synthetic oligonucleotide
ccggcggcgcctgaagccgccggcg

SEQ ID NO: 698331 - DNA, 25 bp, Artificial sequence
  Synthetic oligonucleotide
gtatcgacgacgaagacgctgccat

SEQ ID NO: 698332 - DNA, 25 bp, Artificial sequence
  Synthetic oligonucleotide
gctcccaccaccctcaaggacttca

SEQ ID NO: 698333 - DNA, 25 bp, Artificial sequence
  Synthetic oligonucleotide
ggtcgtgtcgctcgcaccggggccg

SEQ ID NO: 698334 - DNA, 25 bp, Artificial sequence
  Synthetic oligonucleotide
ggggccggtcgtgtcgctcgcaccg

SEQ ID NO: 698335 - DNA, 25 bp, Artificial sequence
  Synthetic oligonucleotide
ccgcgccggggccggtcgtgtcgct

SEQ ID NO: 698336 - DNA, 25 bp, Artificial sequence
  Synthetic oligonucleotide
aatctgccgcgccggggccggtcgt

SEQ ID NO: 698337 - DNA, 25 bp, Artificial sequence
  Synthetic oligonucleotide
ctgcgccaatctgccgcgccggggc

SEQ ID NO: 698338 - DNA, 25 bp, Artificial sequence
  Synthetic oligonucleotide
tgggcgctgcgccaatctgccgcgc

SEQ ID NO: 698339 - DNA, 25 bp, Artificial sequence
  Synthetic oligonucleotide
ctgccatgggcgctgcgccaatctg

SEQ ID NO: 698340 - DNA, 25 bp, Artificial sequence
  Synthetic oligonucleotide
cgcgctcccctgcgaagaggttcga

SEQ ID NO: 698341 - DNA, 25 bp, Artificial sequence
  Synthetic oligonucleotide
cgacgaagacgctgccatgggcgct

SEQ ID NO: 698342 - DNA, 25 bp, Artificial sequence
  Synthetic oligonucleotide
caacacgccggtagggaacccagct

SEQ ID NO: 698343 - DNA, 25 bp, Artificial sequence
  Synthetic oligonucleotide
gacgcagtatcgacgacgaagacgc

SEQ ID NO: 698344 - DNA, 25 bp, Artificial sequence
  Synthetic oligonucleotide
cgaccggacgcagtatcgacgacga

SEQ ID NO: 698345 - DNA, 25 bp, Artificial sequence
  Synthetic oligonucleotide
gcccgacgaccggacgcagtatcga

SEQ ID NO: 698346 - DNA, 25 bp, Artificial sequence
  Synthetic oligonucleotide
ctgggggcccgacgaccggacgcag

SEQ ID NO: 698347 - DNA, 25 bp, Artificial sequence
  Synthetic oligonucleotide
cagacgcttcctcctgggggcccga

SEQ ID NO: 698348 - DNA, 25 bp, Artificial sequence
  Synthetic oligonucleotide
tcgtccagacgcttcctcctggggg

SEQ ID NO: 698349 - DNA, 25 bp, Artificial sequence
  Synthetic oligonucleotide
gcccgttcgtccagacgcttcctcc

SEQ ID NO: 698350 - DNA, 25 bp, Artificial sequence
  Synthetic oligonucleotide
tcttttgcccgttcgtccagacgct

SEQ ID NO: 698351 - DNA, 25 bp, Artificial sequence
  Synthetic oligonucleotide
ttcgactcttttgcccgttcgtcca

SEQ ID NO: 698352 - DNA, 25 bp, Artificial sequence
  Synthetic oligonucleotide
aagacgctgccatgggcgctgcgcc

SEQ ID NO: 698353 - DNA, 25 bp, Artificial sequence
  Synthetic oligonucleotide
tcggcgaccagccgatcgactcctg

SEQ ID NO: 698354 - DNA, 25 bp, Artificial sequence
  Synthetic oligonucleotide
tcgccaagtgcggcgtggccttcat

SEQ ID NO: 698355 - DNA, 25 bp, Artificial sequence
  Synthetic oligonucleotide
agaagctcgccaagtgcggcgtggc

SEQ ID NO: 698356 - DNA, 25 bp, Artificial sequence
  Synthetic oligonucleotide
acatgaagaagctcgccaagtgcgg

SEQ ID NO: 698357 - DNA, 25 bp, Artificial sequence
  Synthetic oligonucleotide
gcccaacgtgaactcgttccgccgc

SEQ ID NO: 698358 - DNA, 25 bp, Artificial sequence
  Synthetic oligonucleotide
tcgagccggagaacatgaagaagct

SEQ ID NO: 698359 - DNA, 25 bp, Artificial sequence
  Synthetic oligonucleotide
actattgggcgaccaagggccagcc

SEQ ID NO: 698360 - DNA, 25 bp, Artificial sequence
  Synthetic oligonucleotide
gggccatcctcttcgagccggagaa

SEQ ID NO: 698361 - DNA, 25 bp, Artificial sequence
  Synthetic oligonucleotide
actcctgggccatcctcttcgagcc

SEQ ID NO: 698362 - DNA, 25 bp, Artificial sequence
  Synthetic oligonucleotide
gaccgattacatcgctcccaccacc

SEQ ID NO: 698363 - DNA, 25 bp, Artificial sequence
  Synthetic oligonucleotide
accagccgatcgactcctgggccat

SEQ ID NO: 698364 - DNA, 25 bp, Artificial sequence
  Synthetic oligonucleotide
gccttcatggacagcggcgacgaga

SEQ ID NO: 698365 - DNA, 25 bp, Artificial sequence
  Synthetic oligonucleotide
aagtcctcggcgaccagccgatcga

SEQ ID NO: 698366 - DNA, 25 bp, Artificial sequence
  Synthetic oligonucleotide
caaggaagtcctcggcgaccagccg

SEQ ID NO: 698367 - DNA, 25 bp, Artificial sequence
  Synthetic oligonucleotide
caaggtcaaggaagtcctcggcgac

SEQ ID NO: 698368 - DNA, 25 bp, Artificial sequence
  Synthetic oligonucleotide
gtggccaaggtcaaggaagtcctcg

SEQ ID NO: 698369 - DNA, 25 bp, Artificial sequence
  Synthetic oligonucleotide
tacaacgtggccaaggtcaaggaag

SEQ ID NO: 698370 - DNA, 25 bp, Artificial sequence
  Synthetic oligonucleotide
atcggttacaacgtggccaaggtca

SEQ ID NO: 698371 - DNA, 25 bp, Artificial sequence
  Synthetic oligonucleotide
aacggcatcggttacaacgtggcca

SEQ ID NO: 698372 - DNA, 25 bp, Artificial sequence
  Synthetic oligonucleotide
ggcaccaacggcatcggttacaacg

SEQ ID NO: 698373 - DNA, 25 bp, Artificial sequence
  Synthetic oligonucleotide
cgatcgactcctgggccatcctctt

SEQ ID NO: 698374 - DNA, 25 bp, Artificial sequence
  Synthetic oligonucleotide
cacccacgacccgaaggactacaag

SEQ ID NO: 698375 - DNA, 25 bp, Artificial sequence
  Synthetic oligonucleotide
cttccactcctccaagtacatctcc

SEQ ID NO: 698376 - DNA, 25 bp, Artificial sequence
  Synthetic oligonucleotide
cagctacttccactcctccaagtac

SEQ ID NO: 698377 - DNA, 25 bp, Artificial sequence
  Synthetic oligonucleotide
tacgtcagctacttccactcctcca

SEQ ID NO: 698378 - DNA, 25 bp, Artificial sequence
  Synthetic oligonucleotide
tcgcccctacgtcagctacttccac

SEQ ID NO: 698379 - DNA, 25 bp, Artificial sequence
  Synthetic oligonucleotide
aaggttcgcccctacgtcagctact

SEQ ID NO: 698380 - DNA, 25 bp, Artificial sequence
  Synthetic oligonucleotide
ctgaccaaggttcgcccctacgtca

SEQ ID NO: 698381 - DNA, 25 bp, Artificial sequence
  Synthetic oligonucleotide
gccgaggaagtcctgaccaaggttc

SEQ ID NO: 698382 - DNA, 25 bp, Artificial sequence
  Synthetic oligonucleotide
caagaaggccgaggaagtcctgacc

SEQ ID NO: 698383 - DNA, 25 bp, Artificial sequence
  Synthetic oligonucleotide
aagtgcggcgtggccttcatggaca

SEQ ID NO: 698384 - DNA, 25 bp, Artificial sequence
  Synthetic oligonucleotide
cccgaaggactacaagaaggccgag

SEQ ID NO: 698385 - DNA, 25 bp, Artificial sequence
  Synthetic oligonucleotide
ggcgtggccttcatggacagcggcg

SEQ ID NO: 698386 - DNA, 25 bp, Artificial sequence
  Synthetic oligonucleotide
atctggggctggaccccaacaccca

SEQ ID NO: 698387 - DNA, 25 bp, Artificial sequence
  Synthetic oligonucleotide
tcaactatctggggctggaccccaa

SEQ ID NO: 698388 - DNA, 25 bp, Artificial sequence
  Synthetic oligonucleotide
ccgccctcaactatctggggctgga

SEQ ID NO: 698389 - DNA, 25 bp, Artificial sequence
  Synthetic oligonucleotide
tgcccgccgccctcaactatctggg

SEQ ID NO: 698390 - DNA, 25 bp, Artificial sequence
  Synthetic oligonucleotide
gatgctgcccgccgccctcaactat

SEQ ID NO: 698391 - DNA, 25 bp, Artificial sequence
  Synthetic oligonucleotide
gacgagatgctgcccgccgccctca

SEQ ID NO: 698392 - DNA, 25 bp, Artificial sequence
  Synthetic oligonucleotide
agcggcgacgagatgctgcccgccg

SEQ ID NO: 698393 - DNA, 25 bp, Artificial sequence
  Synthetic oligonucleotide
atggacagcggcgacgagatgctgc

SEQ ID NO: 698394 - DNA, 25 bp, Artificial sequence
  Synthetic oligonucleotide
tacgcggttccctacctgtggggca

SEQ ID NO: 698395 - DNA, 25 bp, Artificial sequence
  Synthetic oligonucleotide
ggactacaagaaggccgaggaagtc

SEQ ID NO: 698396 - DNA, 25 bp, Artificial sequence
  Synthetic oligonucleotide
tcgactccaacgagaccctcgaggg

SEQ ID NO: 698397 - DNA, 25 bp, Artificial sequence
  Synthetic oligonucleotide
ctgtggggcaccaacggcatcggtt

SEQ ID NO: 698398 - DNA, 25 bp, Artificial sequence
  Synthetic oligonucleotide
catcgtggtgccgtcgaacaacttc

SEQ ID NO: 698399 - DNA, 25 bp, Artificial sequence
  Synthetic oligonucleotide
ctatgacatcgtggtgccgtcgaac

SEQ ID NO: 698400 - DNA, 25 bp, Artificial sequence
  Synthetic oligonucleotide
ctccggctatgacatcgtggtgccg

SEQ ID NO: 698401 - DNA, 25 bp, Artificial sequence
  Synthetic oligonucleotide
cggccactccggctatgacatcgtg

SEQ ID NO: 698402 - DNA, 25 bp, Artificial sequence
  Synthetic oligonucleotide
tggtctccggccactccggctatga

SEQ ID NO: 698403 - DNA, 25 bp, Artificial sequence
  Synthetic oligonucleotide
gcaagctggtctccggccactccgg

SEQ ID NO: 698404 - DNA, 25 bp, Artificial sequence
  Synthetic oligonucleotide
tcgagggcaagctggtctccggcca

SEQ ID NO: 698405 - DNA, 25 bp, Artificial sequence
  Synthetic oligonucleotide
gtcgaacaacttcctcggcaagcag

SEQ ID NO: 698406 - DNA, 25 bp, Artificial sequence
  Synthetic oligonucleotide
tccaacgagaccctcgagggcaagc

SEQ ID NO: 698407 - DNA, 25 bp, Artificial sequence
  Synthetic oligonucleotide
caacttcctcggcaagcagatccag

SEQ ID NO: 698408 - DNA, 25 bp, Artificial sequence
  Synthetic oligonucleotide
acgtcttcgactccaacgagaccct

SEQ ID NO: 698409 - DNA, 25 bp, Artificial sequence
  Synthetic oligonucleotide
gctacgacgtcttcgactccaacga

SEQ ID NO: 698410 - DNA, 25 bp, Artificial sequence
  Synthetic oligonucleotide
acgtcagctacgacgtcttcgactc

SEQ ID NO: 698411 - DNA, 25 bp, Artificial sequence
  Synthetic oligonucleotide
ggatcgacgtcagctacgacgtctt

SEQ ID NO: 698412 - DNA, 25 bp, Artificial sequence
  Synthetic oligonucleotide
agagcgggatcgacgtcagctacga

SEQ ID NO: 698413 - DNA, 25 bp, Artificial sequence
  Synthetic oligonucleotide
accaaggagagcgggatcgacgtca

SEQ ID NO: 698414 - DNA, 25 bp, Artificial sequence
  Synthetic oligonucleotide
gacttcaccaaggagagcgggatcg

SEQ ID NO: 698415 - DNA, 25 bp, Artificial sequence
  Synthetic oligonucleotide
ctcaaggacttcaccaaggagagcg

SEQ ID NO: 698416 - DNA, 25 bp, Artificial sequence
  Synthetic oligonucleotide
accaccctcaaggacttcaccaagg

SEQ ID NO: 698417 - DNA, 25 bp, Artificial sequence
  Synthetic oligonucleotide
gagaccctcgagggcaagctggtct

SEQ ID NO: 698418 - DNA, 25 bp, Artificial sequence
  Synthetic oligonucleotide
tgccgaactggaagaacctcgatcc

SEQ ID NO: 698419 - DNA, 25 bp, Artificial sequence
  Synthetic oligonucleotide
cggccaagacccagcgggcgatgac

SEQ ID NO: 698420 - DNA, 25 bp, Artificial sequence
  Synthetic oligonucleotide
caaccagtacgcggttccctacctg

SEQ ID NO: 698421 - DNA, 25 bp, Artificial sequence
  Synthetic oligonucleotide
tcagcgacccgggcaaccagtacgc

SEQ ID NO: 698422 - DNA, 25 bp, Artificial sequence
  Synthetic oligonucleotide
tggaggtcagcgacccgggcaacca

SEQ ID NO: 698423 - DNA, 25 bp, Artificial sequence
  Synthetic oligonucleotide
aagcaactggaggtcagcgacccgg

SEQ ID NO: 698424 - DNA, 25 bp, Artificial sequence
  Synthetic oligonucleotide
tgctcaagcaactggaggtcagcga

SEQ ID NO: 698425 - DNA, 25 bp, Artificial sequence
  Synthetic oligonucleotide
cggcgctgctcaagcaactggaggt

SEQ ID NO: 698426 - DNA, 25 bp, Artificial sequence
  Synthetic oligonucleotide
tcgatccggcgctgctcaagcaact

SEQ ID NO: 698427 - DNA, 25 bp, Artificial sequence
  Synthetic oligonucleotide
ggtgccgtcgaacaacttcctcggc

SEQ ID NO: 698428 - DNA, 25 bp, Artificial sequence
  Synthetic oligonucleotide
actggaagaacctcgatccggcgct

SEQ ID NO: 698429 - DNA, 25 bp, Artificial sequence
  Synthetic oligonucleotide
tccctacctgtggggcaccaacggc

SEQ ID NO: 698430 - DNA, 25 bp, Artificial sequence
  Synthetic oligonucleotide
gcaagctgccgaactggaagaacct

SEQ ID NO: 698431 - DNA, 25 bp, Artificial sequence
  Synthetic oligonucleotide
acaagagcaagctgccgaactggaa

SEQ ID NO: 698432 - DNA, 25 bp, Artificial sequence
  Synthetic oligonucleotide
agctggacaagagcaagctgccgaa

SEQ ID NO: 698433 - DNA, 25 bp, Artificial sequence
  Synthetic oligonucleotide
tccagaagctggacaagagcaagct

SEQ ID NO: 698434 - DNA, 25 bp, Artificial sequence
  Synthetic oligonucleotide
gtgccttccagaagctggacaagag

SEQ ID NO: 698435 - DNA, 25 bp, Artificial sequence
  Synthetic oligonucleotide
aggccggtgccttccagaagctgga

SEQ ID NO: 698436 - DNA, 25 bp, Artificial sequence
  Synthetic oligonucleotide
gatccaggccggtgccttccagaag

SEQ ID NO: 698437 - DNA, 25 bp, Artificial sequence
  Synthetic oligonucleotide
caagcagatccaggccggtgccttc

SEQ ID NO: 698438 - DNA, 25 bp, Artificial sequence
  Synthetic oligonucleotide
ctcggcaagcagatccaggccggtg

SEQ ID NO: 698439 - DNA, 25 bp, Artificial sequence
  Synthetic oligonucleotide
aagaacctcgatccggcgctgctca

SEQ ID NO: 698440 - DNA, 25 bp, Artificial sequence
  Synthetic oligonucleotide
catgcggggggtaggctatgagtca

SEQ ID NO: 698441 - DNA, 25 bp, Artificial sequence
  Synthetic oligonucleotide
cctcttgtggggcgttgaggccgtt

SEQ ID NO: 698442 - DNA, 25 bp, Artificial sequence
  Synthetic oligonucleotide
aaacgccctcttgtggggcgttgag

SEQ ID NO: 698443 - DNA, 25 bp, Artificial sequence
  Synthetic oligonucleotide
tagccgccaaaaacgccctcttgtg

SEQ ID NO: 698444 - DNA, 25 bp, Artificial sequence
  Synthetic oligonucleotide
tgtcaatagccgccaaaaacgccct

SEQ ID NO: 698445 - DNA, 25 bp, Artificial sequence
  Synthetic oligonucleotide
gtgggatgtcaatagccgccaaaaa

SEQ ID NO: 698446 - DNA, 25 bp, Artificial sequence
  Synthetic oligonucleotide
aagcctgtgggatgtcaatagccgc

SEQ ID NO: 698447 - DNA, 25 bp, Artificial sequence
  Synthetic oligonucleotide
atccgaaagcctgtgggatgtcaat

SEQ ID NO: 698448 - DNA, 25 bp, Artificial sequence
  Synthetic oligonucleotide
gagtcaatccgaaagcctgtgggat

SEQ ID NO: 698449 - DNA, 25 bp, Artificial sequence
  Synthetic oligonucleotide
tacaaacaacgggtgtctcatgtct

SEQ ID NO: 698450 - DNA, 25 bp, Artificial sequence
  Synthetic oligonucleotide
ggggtaggctatgagtcaatccgaa

SEQ ID NO: 698451 - DNA, 25 bp, Artificial sequence
  Synthetic oligonucleotide
gaggccgttttcagggcattttcgc

SEQ ID NO: 698452 - DNA, 25 bp, Artificial sequence
  Synthetic oligonucleotide
ttcaatcatgcggggggtaggctat

SEQ ID NO: 698453 - DNA, 25 bp, Artificial sequence
  Synthetic oligonucleotide
aaaatttcaatcatgcggggggtag

SEQ ID NO: 698454 - DNA, 25 bp, Artificial sequence
  Synthetic oligonucleotide
tttttgttaaaaatttcaatcatgc

SEQ ID NO: 698455 - DNA, 25 bp, Artificial sequence
  Synthetic oligonucleotide
tgatgcaacaccttttttgttaaaa

SEQ ID NO: 698456 - DNA, 25 bp, Artificial sequence
  Synthetic oligonucleotide
cgacatgatgcaacaccttttttgt

SEQ ID NO: 698457 - DNA, 25 bp, Artificial sequence
  Synthetic oligonucleotide
gggtaccgacatgatgcaacacctt

SEQ ID NO: 698458 - DNA, 25 bp, Artificial sequence
  Synthetic oligonucleotide
cacgctggggtaccgacatgatgca

SEQ ID NO: 698459 - DNA, 25 bp, Artificial sequence
  Synthetic oligonucleotide
gaacggcacgctggggtaccgacat

SEQ ID NO: 698460 - DNA, 25 bp, Artificial sequence
  Synthetic oligonucleotide
ggctatgagtcaatccgaaagcctg

SEQ ID NO: 698461 - DNA, 25 bp, Artificial sequence
  Synthetic oligonucleotide
caattttttacaggcctattgtgta

SEQ ID NO: 698462 - DNA, 25 bp, Artificial sequence
  Synthetic oligonucleotide
cggtcgggcgcttctgccagggttc

SEQ ID NO: 698463 - DNA, 25 bp, Artificial sequence
  Synthetic oligonucleotide
accccataacatctacaaacaacgg

SEQ ID NO: 698464 - DNA, 25 bp, Artificial sequence
  Synthetic oligonucleotide
ggccaaaccccataacatctacaaa

SEQ ID NO: 698465 - DNA, 25 bp, Artificial sequence
  Synthetic oligonucleotide
agctcggccaaaccccataacatct

SEQ ID NO: 698466 - DNA, 25 bp, Artificial sequence
  Synthetic oligonucleotide
acgctaagctcggccaaaccccata

SEQ ID NO: 698467 - DNA, 25 bp, Artificial sequence
  Synthetic oligonucleotide
tgaacaacgctaagctcggccaaac

SEQ ID NO: 698468 - DNA, 25 bp, Artificial sequence
  Synthetic oligonucleotide
aaaaaatgaacaacgctaagctcgg

SEQ ID NO: 698469 - DNA, 25 bp, Artificial sequence
  Synthetic oligonucleotide
tgtgtaaaaaaatgaacaacgctaa

SEQ ID NO: 698470 - DNA, 25 bp, Artificial sequence
  Synthetic oligonucleotide
tgtggggcgttgaggccgttttcag

SEQ ID NO: 698471 - DNA, 25 bp, Artificial sequence
  Synthetic oligonucleotide
tacaggcctattgtgtaaaaaaatg

SEQ ID NO: 698472 - DNA, 25 bp, Artificial sequence
  Synthetic oligonucleotide
gcgttgaggccgttttcagggcatt

SEQ ID NO: 698473 - DNA, 25 bp, Artificial sequence
  Synthetic oligonucleotide
cgtgttcaattttttacaggcctat

SEQ ID NO: 698474 - DNA, 25 bp, Artificial sequence
  Synthetic oligonucleotide
ggagtgcgtgttcaattttttacag

SEQ ID NO: 698475 - DNA, 25 bp, Artificial sequence
  Synthetic oligonucleotide
tgttcaggagtgcgtgttcaatttt

SEQ ID NO: 698476 - DNA, 25 bp, Artificial sequence
  Synthetic oligonucleotide
gaagggtgttcaggagtgcgtgttc

SEQ ID NO: 698477 - DNA, 25 bp, Artificial sequence
  Synthetic oligonucleotide
cgcgtcgaagggtgttcaggagtgc

SEQ ID NO: 698478 - DNA, 25 bp, Artificial sequence
  Synthetic oligonucleotide
aaacctcgcgtcgaagggtgttcag

SEQ ID NO: 698479 - DNA, 25 bp, Artificial sequence
  Synthetic oligonucleotide
gcattttcgccggacgaaaagccga

SEQ ID NO: 698480 - DNA, 25 bp, Artificial sequence
  Synthetic oligonucleotide
ttttcagggcattttcgccggacga

SEQ ID NO: 698481 - DNA, 25 bp, Artificial sequence
  Synthetic oligonucleotide
ctcgctcggttcagtgagctgaacg

SEQ ID NO: 698482 - DNA, 25 bp, Artificial sequence
  Synthetic oligonucleotide
gcctattgtgtaaaaaaatgaacaa

SEQ ID NO: 698483 - DNA, 25 bp, Artificial sequence
  Synthetic oligonucleotide
gtcggcgtcgccgatgtcgagaccc

SEQ ID NO: 698484 - DNA, 25 bp, Artificial sequence
  Synthetic oligonucleotide
tgagctgaacggcacgctggggtac

SEQ ID NO: 698485 - DNA, 25 bp, Artificial sequence
  Synthetic oligonucleotide
gatatcgagggcgaacagggaagcg

SEQ ID NO: 698486 - DNA, 25 bp, Artificial sequence
  Synthetic oligonucleotide
gccggtgatatcgagggcgaacagg

SEQ ID NO: 698487 - DNA, 25 bp, Artificial sequence
  Synthetic oligonucleotide
ggtggagccggtgatatcgagggcg

SEQ ID NO: 698488 - DNA, 25 bp, Artificial sequence
  Synthetic oligonucleotide
ctctacggtggagccggtgatatcg

SEQ ID NO: 698489 - DNA, 25 bp, Artificial sequence
  Synthetic oligonucleotide
gtactctctacggtggagccggtga

SEQ ID NO: 698490 - DNA, 25 bp, Artificial sequence
  Synthetic oligonucleotide
aggccggtactctctacggtggagc

SEQ ID NO: 698491 - DNA, 25 bp, Artificial sequence
  Synthetic oligonucleotide
agacccaggccggtactctctacgg

SEQ ID NO: 698492 - DNA, 25 bp, Artificial sequence
  Synthetic oligonucleotide
gcgaacagggaagcgggaaggttga

SEQ ID NO: 698493 - DNA, 25 bp, Artificial sequence
  Synthetic oligonucleotide
gtcgccgatgtcgagacccaggccg

SEQ ID NO: 698494 - DNA, 25 bp, Artificial sequence
  Synthetic oligonucleotide
cagggaagcgggaaggttgatacct

SEQ ID NO: 698495 - DNA, 25 bp, Artificial sequence
  Synthetic oligonucleotide
gatccggtcggcgtcgccgatgtcg

SEQ ID NO: 698496 - DNA, 25 bp, Artificial sequence
  Synthetic oligonucleotide
gtagcagatccggtcggcgtcgccg

SEQ ID NO: 698497 - DNA, 25 bp, Artificial sequence
  Synthetic oligonucleotide
gatcgggtagcagatccggtcggcg

SEQ ID NO: 698498 - DNA, 25 bp, Artificial sequence
  Synthetic oligonucleotide
gccggggatcgggtagcagatccgg

SEQ ID NO: 698499 - DNA, 25 bp, Artificial sequence
  Synthetic oligonucleotide
gagggtgccggggatcgggtagcag

SEQ ID NO: 698500 - DNA, 25 bp, Artificial sequence
  Synthetic oligonucleotide
ccatggagagggtgccggggatcgg

SEQ ID NO: 698501 - DNA, 25 bp, Artificial sequence
  Synthetic oligonucleotide
agggttccatggagagggtgccggg

SEQ ID NO: 698502 - DNA, 25 bp, Artificial sequence
  Synthetic oligonucleotide
tctgccagggttccatggagagggt

SEQ ID NO: 698503 - DNA, 25 bp, Artificial sequence
  Synthetic oligonucleotide
tcggcttgccgagcgagttccaggt

SEQ ID NO: 698504 - DNA, 25 bp, Artificial sequence
  Synthetic oligonucleotide
gatgtcgagacccaggccggtactc

SEQ ID NO: 698505 - DNA, 25 bp, Artificial sequence
  Synthetic oligonucleotide
ccattcatgtctgcaataaggaggt

SEQ ID NO: 698506 - DNA, 25 bp, Artificial sequence
  Synthetic oligonucleotide
caacgggtgtctcatgtctcgcctg

SEQ ID NO: 698507 - DNA, 25 bp, Artificial sequence
  Synthetic oligonucleotide
gaggaactcgctcggttcagtgagc

SEQ ID NO: 698508 - DNA, 25 bp, Artificial sequence
  Synthetic oligonucleotide
ttccttgaggaactcgctcggttca

SEQ ID NO: 698509 - DNA, 25 bp, Artificial sequence
  Synthetic oligonucleotide
gggatgttccttgaggaactcgctc

SEQ ID NO: 698510 - DNA, 25 bp, Artificial sequence
  Synthetic oligonucleotide
gacctcgggatgttccttgaggaac

SEQ ID NO: 698511 - DNA, 25 bp, Artificial sequence
  Synthetic oligonucleotide
gaactggacctcgggatgttccttg

SEQ ID NO: 698512 - DNA, 25 bp, Artificial sequence
  Synthetic oligonucleotide
gtcgacgaactggacctcgggatgt

SEQ ID NO: 698513 - DNA, 25 bp, Artificial sequence
  Synthetic oligonucleotide
aaggaggtcgacgaactggacctcg

SEQ ID NO: 698514 - DNA, 25 bp, Artificial sequence
  Synthetic oligonucleotide
cgagggcgaacagggaagcgggaag

SEQ ID NO: 698515 - DNA, 25 bp, Artificial sequence
  Synthetic oligonucleotide
atgtctgcaataaggaggtcgacga

SEQ ID NO: 698516 - DNA, 25 bp, Artificial sequence
  Synthetic oligonucleotide
ggttcagtgagctgaacggcacgct

SEQ ID NO: 698517 - DNA, 25 bp, Artificial sequence
  Synthetic oligonucleotide
aaccacgccattcatgtctgcaata

SEQ ID NO: 698518 - DNA, 25 bp, Artificial sequence
  Synthetic oligonucleotide
gccgcgaaccacgccattcatgtct

SEQ ID NO: 698519 - DNA, 25 bp, Artificial sequence
  Synthetic oligonucleotide
ccgcttgccgcgaaccacgccattc

SEQ ID NO: 698520 - DNA, 25 bp, Artificial sequence
  Synthetic oligonucleotide
ttcgatccgcttgccgcgaaccacg

SEQ ID NO: 698521 - DNA, 25 bp, Artificial sequence
  Synthetic oligonucleotide
gttgcgttcgatccgcttgccgcga

SEQ ID NO: 698522 - DNA, 25 bp, Artificial sequence
  Synthetic oligonucleotide
cagactgttgcgttcgatccgcttg

SEQ ID NO: 698523 - DNA, 25 bp, Artificial sequence
  Synthetic oligonucleotide
tttgttcagactgttgcgttcgatc

SEQ ID NO: 698524 - DNA, 25 bp, Artificial sequence
  Synthetic oligonucleotide
cgaagactttgttcagactgttgcg

SEQ ID NO: 698525 - DNA, 25 bp, Artificial sequence
  Synthetic oligonucleotide
ctttttcgaagactttgttcagact

SEQ ID NO: 698526 - DNA, 25 bp, Artificial sequence
  Synthetic oligonucleotide
gcaataaggaggtcgacgaactgga

SEQ ID NO: 698527 - DNA, 25 bp, Artificial sequence
  Synthetic oligonucleotide
atcgacgccggcattccggtcctcg

SEQ ID NO: 698528 - DNA, 25 bp, Artificial sequence
  Synthetic oligonucleotide
ctttcggcggcagcctgcaccagaa

SEQ ID NO: 698529 - DNA, 25 bp, Artificial sequence
  Synthetic oligonucleotide
acgtggctttcggcggcagcctgca

SEQ ID NO: 698530 - DNA, 25 bp, Artificial sequence
  Synthetic oligonucleotide
aatgaacgtggctttcggcggcagc

SEQ ID NO: 698531 - DNA, 25 bp, Artificial sequence
  Synthetic oligonucleotide
ccaggaaatgaacgtggctttcggc

SEQ ID NO: 698532 - DNA, 25 bp, Artificial sequence
  Synthetic oligonucleotide
cggtttccaggaaatgaacgtggct

SEQ ID NO: 698533 - DNA, 25 bp, Artificial sequence
  Synthetic oligonucleotide
tgccgcggtttccaggaaatgaacg

SEQ ID NO: 698534 - DNA, 25 bp, Artificial sequence
  Synthetic oligonucleotide
ggcatctgccgcggtttccaggaaa

SEQ ID NO: 698535 - DNA, 25 bp, Artificial sequence
  Synthetic oligonucleotide
ggtcctcggcatctgccgcggtttc

SEQ ID NO: 698536 - DNA, 25 bp, Artificial sequence
  Synthetic oligonucleotide
taacatctacaaacaacgggtgtct

SEQ ID NO: 698537 - DNA, 25 bp, Artificial sequence
  Synthetic oligonucleotide
gccggcattccggtcctcggcatct

SEQ ID NO: 698538 - DNA, 25 bp, Artificial sequence
  Synthetic oligonucleotide
accagaaggtgcacgaggtcggaac

SEQ ID NO: 698539 - DNA, 25 bp, Artificial sequence
  Synthetic oligonucleotide
gccgccatcgacgccggcattccgg

SEQ ID NO: 698540 - DNA, 25 bp, Artificial sequence
  Synthetic oligonucleotide
gtccgcgccgccatcgacgccggca

SEQ ID NO: 698541 - DNA, 25 bp, Artificial sequence
  Synthetic oligonucleotide
gccgctggtccgcgccgccatcgac

SEQ ID NO: 698542 - DNA, 25 bp, Artificial sequence
  Synthetic oligonucleotide
tacgttgccgctggtccgcgccgcc

SEQ ID NO: 698543 - DNA, 25 bp, Artificial sequence
  Synthetic oligonucleotide
cgccactacgttgccgctggtccgc

SEQ ID NO: 698544 - DNA, 25 bp, Artificial sequence
  Synthetic oligonucleotide
ccgcgacgccactacgttgccgctg

SEQ ID NO: 698545 - DNA, 25 bp, Artificial sequence
  Synthetic oligonucleotide
ctccgaccgcgacgccactacgttg

SEQ ID NO: 698546 - DNA, 25 bp, Artificial sequence
  Synthetic oligonucleotide
ccacgactccgaccgcgacgccact

SEQ ID NO: 698547 - DNA, 25 bp, Artificial sequence
  Synthetic oligonucleotide
attccggtcctcggcatctgccgcg

SEQ ID NO: 698548 - DNA, 25 bp, Artificial sequence
  Synthetic oligonucleotide
gccgctcgaggttcagtacgcgccg

SEQ ID NO: 698549 - DNA, 25 bp, Artificial sequence
  Synthetic oligonucleotide
ctcgttccgccgcttcctgcccgat

SEQ ID NO: 698550 - DNA, 25 bp, Artificial sequence
  Synthetic oligonucleotide
gtgctcgccggtatcggcttgccga

SEQ ID NO: 698551 - DNA, 25 bp, Artificial sequence
  Synthetic oligonucleotide
ggcggagtgctcgccggtatcggct

SEQ ID NO: 698552 - DNA, 25 bp, Artificial sequence
  Synthetic oligonucleotide
cagccgggcggagtgctcgccggta

SEQ ID NO: 698553 - DNA, 25 bp, Artificial sequence
  Synthetic oligonucleotide
gcatgtgcagccgggcggagtgctc

SEQ ID NO: 698554 - DNA, 25 bp, Artificial sequence
  Synthetic oligonucleotide
tgccatgcatgtgcagccgggcgga

SEQ ID NO: 698555 - DNA, 25 bp, Artificial sequence
  Synthetic oligonucleotide
gcgccatgccatgcatgtgcagccg

SEQ ID NO: 698556 - DNA, 25 bp, Artificial sequence
  Synthetic oligonucleotide
cgcgccgcgccatgccatgcatgtg

SEQ ID NO: 698557 - DNA, 25 bp, Artificial sequence
  Synthetic oligonucleotide
ggcggcagcctgcaccagaaggtgc

SEQ ID NO: 698558 - DNA, 25 bp, Artificial sequence
  Synthetic oligonucleotide
cgaggttcagtacgcgccgcgccat

SEQ ID NO: 698559 - DNA, 25 bp, Artificial sequence
  Synthetic oligonucleotide
agcctgcaccagaaggtgcacgagg

SEQ ID NO: 698560 - DNA, 25 bp, Artificial sequence
  Synthetic oligonucleotide
cgaccagccgctcgaggttcagtac

SEQ ID NO: 698561 - DNA, 25 bp, Artificial sequence
  Synthetic oligonucleotide
gccggccgaccagccgctcgaggtt

SEQ ID NO: 698562 - DNA, 25 bp, Artificial sequence
  Synthetic oligonucleotide
ccgcgagccggccgaccagccgctc

SEQ ID NO: 698563 - DNA, 25 bp, Artificial sequence
  Synthetic oligonucleotide
tggaccaccgcgagccggccgacca

SEQ ID NO: 698564 - DNA, 25 bp, Artificial sequence
  Synthetic oligonucleotide
ccttcatggaccaccgcgagccggc

SEQ ID NO: 698565 - DNA, 25 bp, Artificial sequence
  Synthetic oligonucleotide
tcggaaccttcatggaccaccgcga

SEQ ID NO: 698566 - DNA, 25 bp, Artificial sequence
  Synthetic oligonucleotide
acgaggtcggaaccttcatggacca

SEQ ID NO: 698567 - DNA, 25 bp, Artificial sequence
  Synthetic oligonucleotide
aggtgcacgaggtcggaaccttcat

SEQ ID NO: 698568 - DNA, 25 bp, Artificial sequence
  Synthetic oligonucleotide
gagcgagcccggcaccctccacgac

SEQ ID NO: 698569 - DNA, 25 bp, Artificial sequence
  Synthetic oligonucleotide
tcagtacgcgccgcgccatgccatg

SEQ ID NO: 698570 - DNA, 25 bp, Artificial sequence
  Synthetic oligonucleotide
atcggtcttcatccctaccatattg

SEQ ID NO: 698571 - DNA, 25 bp, Artificial sequence
  Synthetic oligonucleotide
caccctccacgactccgaccgcgac

SEQ ID NO: 698572 - DNA, 25 bp, Artificial sequence
  Synthetic oligonucleotide
acggcgctggcggtctcccgctgat

SEQ ID NO: 698573 - DNA, 25 bp, Artificial sequence
  Synthetic oligonucleotide
tcgtcaacggcgctggcggtctccc

SEQ ID NO: 698574 - DNA, 25 bp, Artificial sequence
  Synthetic oligonucleotide
gtgccgtcgtcaacggcgctggcgg

SEQ ID NO: 698575 - DNA, 25 bp, Artificial sequence
  Synthetic oligonucleotide
atctgcgtgccgtcgtcaacggcgc

SEQ ID NO: 698576 - DNA, 25 bp, Artificial sequence
  Synthetic oligonucleotide
acaaatatctgcgtgccgtcgtcaa

SEQ ID NO: 698577 - DNA, 25 bp, Artificial sequence
  Synthetic oligonucleotide
ccggcgacaaatatctgcgtgccgt

SEQ ID NO: 698578 - DNA, 25 bp, Artificial sequence
  Synthetic oligonucleotide
atattgccggcgacaaatatctgcg

SEQ ID NO: 698579 - DNA, 25 bp, Artificial sequence
  Synthetic oligonucleotide
ggtctcccgctgatcattcctgcgc

SEQ ID NO: 698580 - DNA, 25 bp, Artificial sequence
  Synthetic oligonucleotide
ttcatccctaccatattgccggcga

SEQ ID NO: 698581 - DNA, 25 bp, Artificial sequence
  Synthetic oligonucleotide
ccgctgatcattcctgcgctgggcg

SEQ ID NO: 698582 - DNA, 25 bp, Artificial sequence
  Synthetic oligonucleotide
aagcagatcggtcttcatccctacc

SEQ ID NO: 698583 - DNA, 25 bp, Artificial sequence
  Synthetic oligonucleotide
tgcaccaagcagatcggtcttcatc

SEQ ID NO: 698584 - DNA, 25 bp, Artificial sequence
  Synthetic oligonucleotide
accgcctgcaccaagcagatcggtc

SEQ ID NO: 698585 - DNA, 25 bp, Artificial sequence
  Synthetic oligonucleotide
ggcgtcaccgcctgcaccaagcaga

SEQ ID NO: 698586 - DNA, 25 bp, Artificial sequence
  Synthetic oligonucleotide
ttaatcggcgtcaccgcctgcacca

SEQ ID NO: 698587 - DNA, 25 bp, Artificial sequence
  Synthetic oligonucleotide
ctgccgttaatcggcgtcaccgcct

SEQ ID NO: 698588 - DNA, 25 bp, Artificial sequence
  Synthetic oligonucleotide
tctcgcctgccgttaatcggcgtca

SEQ ID NO: 698589 - DNA, 25 bp, Artificial sequence
  Synthetic oligonucleotide
tcatgtctcgcctgccgttaatcgg

SEQ ID NO: 698590 - DNA, 25 bp, Artificial sequence
  Synthetic oligonucleotide
gtgtctcatgtctcgcctgccgtta

SEQ ID NO: 698591 - DNA, 25 bp, Artificial sequence
  Synthetic oligonucleotide
cctaccatattgccggcgacaaata

SEQ ID NO: 698592 - DNA, 25 bp, Artificial sequence
  Synthetic oligonucleotide
gacggcttgctcttcactggctcgc

SEQ ID NO: 698593 - DNA, 25 bp, Artificial sequence
  Synthetic oligonucleotide
gttgcgcggtcgggcgcttctgcca

SEQ ID NO: 698594 - DNA, 25 bp, Artificial sequence
  Synthetic oligonucleotide
accggcgagcgagcccggcaccctc

SEQ ID NO: 698595 - DNA, 25 bp, Artificial sequence
  Synthetic oligonucleotide
tagtggaccggcgagcgagcccggc

SEQ ID NO: 698596 - DNA, 25 bp, Artificial sequence
  Synthetic oligonucleotide
tcattatagtggaccggcgagcgag

SEQ ID NO: 698597 - DNA, 25 bp, Artificial sequence
  Synthetic oligonucleotide
gccccgtcattatagtggaccggcg

SEQ ID NO: 698598 - DNA, 25 bp, Artificial sequence
  Synthetic oligonucleotide
cgtcgagccccgtcattatagtgga

SEQ ID NO: 698599 - DNA, 25 bp, Artificial sequence
  Synthetic oligonucleotide
cgtcgaacgtcgagccccgtcatta

SEQ ID NO: 698600 - DNA, 25 bp, Artificial sequence
  Synthetic oligonucleotide
ggctcgccgtcgaacgtcgagcccc

SEQ ID NO: 698601 - DNA, 25 bp, Artificial sequence
  Synthetic oligonucleotide
gctggcggtctcccgctgatcattc

SEQ ID NO: 698602 - DNA, 25 bp, Artificial sequence
  Synthetic oligonucleotide
ttgctcttcactggctcgccgtcga

SEQ ID NO: 698603 - DNA, 25 bp, Artificial sequence
  Synthetic oligonucleotide
gcccggcaccctccacgactccgac

SEQ ID NO: 698604 - DNA, 25 bp, Artificial sequence
  Synthetic oligonucleotide
gcgtcgacggcttgctcttcactgg

SEQ ID NO: 698605 - DNA, 25 bp, Artificial sequence
  Synthetic oligonucleotide
tggacagcgtcgacggcttgctctt

SEQ ID NO: 698606 - DNA, 25 bp, Artificial sequence
  Synthetic oligonucleotide
ccctgctggacagcgtcgacggctt

SEQ ID NO: 698607 - DNA, 25 bp, Artificial sequence
  Synthetic oligonucleotide
aggcagccctgctggacagcgtcga

SEQ ID NO: 698608 - DNA, 25 bp, Artificial sequence
  Synthetic oligonucleotide
tcgaccaggcagccctgctggacag

SEQ ID NO: 698609 - DNA, 25 bp, Artificial sequence
  Synthetic oligonucleotide
agtcgatcgaccaggcagccctgct

SEQ ID NO: 698610 - DNA, 25 bp, Artificial sequence
  Synthetic oligonucleotide
tgggcgagtcgatcgaccaggcagc

SEQ ID NO: 698611 - DNA, 25 bp, Artificial sequence
  Synthetic oligonucleotide
ctgcgctgggcgagtcgatcgacca

SEQ ID NO: 698612 - DNA, 25 bp, Artificial sequence
  Synthetic oligonucleotide
atcattcctgcgctgggcgagtcga

SEQ ID NO: 698613 - DNA, 25 bp, Artificial sequence
  Synthetic oligonucleotide
ttcactggctcgccgtcgaacgtcg

SEQ ID NO: 698614 - DNA, 25 bp, Artificial sequence
  Synthetic oligonucleotide
tccgggctgccggtgggcacgcgca

SEQ ID NO: 698615 - DNA, 25 bp, Artificial sequence
  Synthetic oligonucleotide
gcgttcggcacgtagaactgcgaac

SEQ ID NO: 698616 - DNA, 25 bp, Artificial sequence
  Synthetic oligonucleotide
ctcggcgcgttcggcacgtagaact

SEQ ID NO: 698617 - DNA, 25 bp, Artificial sequence
  Synthetic oligonucleotide
ccccagctcggcgcgttcggcacgt

SEQ ID NO: 698618 - DNA, 25 bp, Artificial sequence
  Synthetic oligonucleotide
tccaggccccagctcggcgcgttcg

SEQ ID NO: 698619 - DNA, 25 bp, Artificial sequence
  Synthetic oligonucleotide
cggttgtccaggccccagctcggcg

SEQ ID NO: 698620 - DNA, 25 bp, Artificial sequence
  Synthetic oligonucleotide
acggtgcggttgtccaggccccagc

SEQ ID NO: 698621 - DNA, 25 bp, Artificial sequence
  Synthetic oligonucleotide
agggccacggtgcggttgtccaggc

SEQ ID NO: 698622 - DNA, 25 bp, Artificial sequence
  Synthetic oligonucleotide
acgcgcagggccacggtgcggttgt

SEQ ID NO: 698623 - DNA, 25 bp, Artificial sequence
  Synthetic oligonucleotide
tcgctggtgaagatgttgttgccat

SEQ ID NO: 698624 - DNA, 25 bp, Artificial sequence
  Synthetic oligonucleotide
ctgccggtgggcacgcgcagggcca

SEQ ID NO: 698625 - DNA, 25 bp, Artificial sequence
  Synthetic oligonucleotide
ctgcgaaccgaagcggcggtaggag

SEQ ID NO: 698626 - DNA, 25 bp, Artificial sequence
  Synthetic oligonucleotide
accgcgtccgggctgccggtgggca

SEQ ID NO: 698627 - DNA, 25 bp, Artificial sequence
  Synthetic oligonucleotide
aggcgtaccgcgtccgggctgccgg

SEQ ID NO: 698628 - DNA, 25 bp, Artificial sequence
  Synthetic oligonucleotide
tgttccaggcgtaccgcgtccgggc

SEQ ID NO: 698629 - DNA, 25 bp, Artificial sequence
  Synthetic oligonucleotide
acgcggtgttccaggcgtaccgcgt

SEQ ID NO: 698630 - DNA, 25 bp, Artificial sequence
  Synthetic oligonucleotide
ccggccacgcggtgttccaggcgta

SEQ ID NO: 698631 - DNA, 25 bp, Artificial sequence
  Synthetic oligonucleotide
tcggcgccggccacgcggtgttcca

SEQ ID NO: 698632 - DNA, 25 bp, Artificial sequence
  Synthetic oligonucleotide
ttggcgtcggcgccggccacgcggt

SEQ ID NO: 698633 - DNA, 25 bp, Artificial sequence
  Synthetic oligonucleotide
taggggttggcgtcggcgccggcca

SEQ ID NO: 698634 - DNA, 25 bp, Artificial sequence
  Synthetic oligonucleotide
gtgggcacgcgcagggccacggtgc

SEQ ID NO: 698635 - DNA, 25 bp, Artificial sequence
  Synthetic oligonucleotide
aggccggcagggtctcgagcacacc

SEQ ID NO: 698636 - DNA, 25 bp, Artificial sequence
  Synthetic oligonucleotide
ggcgcttctgccagggttccatgga

SEQ ID NO: 698637 - DNA, 25 bp, Artificial sequence
  Synthetic oligonucleotide
tgctcgggatcctcgctggtgaaga

SEQ ID NO: 698638 - DNA, 25 bp, Artificial sequence
  Synthetic oligonucleotide
gcgttctgctcgggatcctcgctgg

SEQ ID NO: 698639 - DNA, 25 bp, Artificial sequence
  Synthetic oligonucleotide
aatgcggcgttctgctcgggatcct

SEQ ID NO: 698640 - DNA, 25 bp, Artificial sequence
  Synthetic oligonucleotide
tggcgcaatgcggcgttctgctcgg

SEQ ID NO: 698641 - DNA, 25 bp, Artificial sequence
  Synthetic oligonucleotide
atcgcatggcgcaatgcggcgttct

SEQ ID NO: 698642 - DNA, 25 bp, Artificial sequence
  Synthetic oligonucleotide
ccgccgatcgcatggcgcaatgcgg

SEQ ID NO: 698643 - DNA, 25 bp, Artificial sequence
  Synthetic oligonucleotide
agcacaccgccgatcgcatggcgca

SEQ ID NO: 698644 - DNA, 25 bp, Artificial sequence
  Synthetic oligonucleotide
ggcacgtagaactgcgaaccgaagc

SEQ ID NO: 698645 - DNA, 25 bp, Artificial sequence
  Synthetic oligonucleotide
gcagggtctcgagcacaccgccgat

SEQ ID NO: 698646 - DNA, 25 bp, Artificial sequence
  Synthetic oligonucleotide
tagaactgcgaaccgaagcggcggt

SEQ ID NO: 698647 - DNA, 25 bp, Artificial sequence
  Synthetic oligonucleotide
catggaggccggcagggtctcgagc

SEQ ID NO: 698648 - DNA, 25 bp, Artificial sequence
  Synthetic oligonucleotide
gaaggccatggaggccggcagggtc

SEQ ID NO: 698649 - DNA, 25 bp, Artificial sequence
  Synthetic oligonucleotide
gcagaggaaggccatggaggccggc

SEQ ID NO: 698650 - DNA, 25 bp, Artificial sequence
  Synthetic oligonucleotide
cgttcgggcagaggaaggccatgga

SEQ ID NO: 698651 - DNA, 25 bp, Artificial sequence
  Synthetic oligonucleotide
agttgacgttcgggcagaggaaggc

SEQ ID NO: 698652 - DNA, 25 bp, Artificial sequence
  Synthetic oligonucleotide
ggtaggagttgacgttcgggcagag

SEQ ID NO: 698653 - DNA, 25 bp, Artificial sequence
  Synthetic oligonucleotide
agcggcggtaggagttgacgttcgg

SEQ ID NO: 698654 - DNA, 25 bp, Artificial sequence
  Synthetic oligonucleotide
accgaagcggcggtaggagttgacg

SEQ ID NO: 698655 - DNA, 25 bp, Artificial sequence
  Synthetic oligonucleotide
gcaccgctgccagtagcaggtaggg

SEQ ID NO: 698656 - DNA, 25 bp, Artificial sequence
  Synthetic oligonucleotide
gtctcgagcacaccgccgatcgcat

SEQ ID NO: 698657 - DNA, 25 bp, Artificial sequence
  Synthetic oligonucleotide
ccagctcgctttccttgcaggcgac

SEQ ID NO: 698658 - DNA, 25 bp, Artificial sequence
  Synthetic oligonucleotide
tagcaggtaggggttggcgtcggcg

SEQ ID NO: 698659 - DNA, 25 bp, Artificial sequence
  Synthetic oligonucleotide
ttcgccatgatctcgctttcgtcca

SEQ ID NO: 698660 - DNA, 25 bp, Artificial sequence
  Synthetic oligonucleotide
gatgtacttcgccatgatctcgctt

SEQ ID NO: 698661 - DNA, 25 bp, Artificial sequence
  Synthetic oligonucleotide
tcgggtcgatgtacttcgccatgat

SEQ ID NO: 698662 - DNA, 25 bp, Artificial sequence
  Synthetic oligonucleotide
tgtacttcgggtcgatgtacttcgc

SEQ ID NO: 698663 - DNA, 25 bp, Artificial sequence
  Synthetic oligonucleotide
tgtcgatgtacttcgggtcgatgta

SEQ ID NO: 698664 - DNA, 25 bp, Artificial sequence
  Synthetic oligonucleotide
cgaagatgtcgatgtacttcgggtc

SEQ ID NO: 698665 - DNA, 25 bp, Artificial sequence
  Synthetic oligonucleotide
aggcgacgaagatgtcgatgtactt

SEQ ID NO: 698666 - DNA, 25 bp, Artificial sequence
  Synthetic oligonucleotide
tcgctttcgtccagctcgcgcaggg

SEQ ID NO: 698667 - DNA, 25 bp, Artificial sequence
  Synthetic oligonucleotide
cgctttccttgcaggcgacgaagat

SEQ ID NO: 698668 - DNA, 25 bp, Artificial sequence
  Synthetic oligonucleotide
tcgtccagctcgcgcagggcgtcgc

SEQ ID NO: 698669 - DNA, 25 bp, Artificial sequence
  Synthetic oligonucleotide
aactcctccagctcgctttccttgc

SEQ ID NO: 698670 - DNA, 25 bp, Artificial sequence
  Synthetic oligonucleotide
tgctcgaactcctccagctcgcttt

SEQ ID NO: 698671 - DNA, 25 bp, Artificial sequence
  Synthetic oligonucleotide
atcgagtgctcgaactcctccagct

SEQ ID NO: 698672 - DNA, 25 bp, Artificial sequence
  Synthetic oligonucleotide
tcggagatcgagtgctcgaactcct

SEQ ID NO: 698673 - DNA, 25 bp, Artificial sequence
  Synthetic oligonucleotide
tcgaggtcggagatcgagtgctcga

SEQ ID NO: 698674 - DNA, 25 bp, Artificial sequence
  Synthetic oligonucleotide
ttgtactcgaggtcggagatcgagt

SEQ ID NO: 698675 - DNA, 25 bp, Artificial sequence
  Synthetic oligonucleotide
taccagttgtactcgaggtcggaga

SEQ ID NO: 698676 - DNA, 25 bp, Artificial sequence
  Synthetic oligonucleotide
atgcaggtaccagttgtactcgagg

SEQ ID NO: 698677 - DNA, 25 bp, Artificial sequence
  Synthetic oligonucleotide
gacggtatgcaggtaccagttgtac

SEQ ID NO: 698678 - DNA, 25 bp, Artificial sequence
  Synthetic oligonucleotide
ccttgcaggcgacgaagatgtcgat

SEQ ID NO: 698679 - DNA, 25 bp, Artificial sequence
  Synthetic oligonucleotide
tgccttcgatcggcgcgcccggctc

SEQ ID NO: 698680 - DNA, 25 bp, Artificial sequence
  Synthetic oligonucleotide
gtgaagatgttgttgccatgcttgt

SEQ ID NO: 698681 - DNA, 25 bp, Artificial sequence
  Synthetic oligonucleotide
ctgccagcaccgctgccagtagcag

SEQ ID NO: 698682 - DNA, 25 bp, Artificial sequence
  Synthetic oligonucleotide
tgaacgcctgccagcaccgctgcca

SEQ ID NO: 698683 - DNA, 25 bp, Artificial sequence
  Synthetic oligonucleotide
ccgtgatgaacgcctgccagcaccg

SEQ ID NO: 698684 - DNA, 25 bp, Artificial sequence
  Synthetic oligonucleotide
gtcagcccgtgatgaacgcctgcca

SEQ ID NO: 698685 - DNA, 25 bp, Artificial sequence
  Synthetic oligonucleotide
tgttggtcagcccgtgatgaacgcc

SEQ ID NO: 698686 - DNA, 25 bp, Artificial sequence
  Synthetic oligonucleotide
cgaccttgttggtcagcccgtgatg

SEQ ID NO: 698687 - DNA, 25 bp, Artificial sequence
  Synthetic oligonucleotide
ccggctcgaccttgttggtcagccc

SEQ ID NO: 698688 - DNA, 25 bp, Artificial sequence
  Synthetic oligonucleotide
atgatctcgctttcgtccagctcgc

SEQ ID NO: 698689 - DNA, 25 bp, Artificial sequence
  Synthetic oligonucleotide
cgatcggcgcgcccggctcgacctt

SEQ ID NO: 698690 - DNA, 25 bp, Artificial sequence
  Synthetic oligonucleotide
ctgccagtagcaggtaggggttggc

SEQ ID NO: 698691 - DNA, 25 bp, Artificial sequence
  Synthetic oligonucleotide
ggagttgccttcgatcggcgcgccc

SEQ ID NO: 698692 - DNA, 25 bp, Artificial sequence
  Synthetic oligonucleotide
ctcgtaggagttgccttcgatcggc

SEQ ID NO: 698693 - DNA, 25 bp, Artificial sequence
  Synthetic oligonucleotide
catctgctcgtaggagttgccttcg

SEQ ID NO: 698694 - DNA, 25 bp, Artificial sequence
  Synthetic oligonucleotide
gcaggctcggctccatctgctcgta

SEQ ID NO: 698695 - DNA, 25 bp, Artificial sequence
  Synthetic oligonucleotide
gttcggcaggctcggctccatctgc

SEQ ID NO: 698696 - DNA, 25 bp, Artificial sequence
  Synthetic oligonucleotide
aggttgttcggcaggctcggctcca

SEQ ID NO: 698697 - DNA, 25 bp, Artificial sequence
  Synthetic oligonucleotide
gtcgcgcaggttgttcggcaggctc

SEQ ID NO: 698698 - DNA, 25 bp, Artificial sequence
  Synthetic oligonucleotide
cagggcgtcgcgcaggttgttcggc

SEQ ID NO: 698699 - DNA, 25 bp, Artificial sequence
  Synthetic oligonucleotide
gctcgcgcagggcgtcgcgcaggtt

SEQ ID NO: 698700 - DNA, 25 bp, Artificial sequence
  Synthetic oligonucleotide
gcgcgcccggctcgaccttgttggt

SEQ ID NO: 698701 - DNA, 25 bp, Artificial sequence
  Synthetic oligonucleotide
actgcggacgtttgccggagatcgg

SEQ ID NO: 698702 - DNA, 25 bp, Artificial sequence
  Synthetic oligonucleotide
cctggtcgatcaggtagaactccag

SEQ ID NO: 698703 - DNA, 25 bp, Artificial sequence
  Synthetic oligonucleotide
cgttctcctggtcgatcaggtagaa

SEQ ID NO: 698704 - DNA, 25 bp, Artificial sequence
  Synthetic oligonucleotide
cgttcacgttctcctggtcgatcag

SEQ ID NO: 698705 - DNA, 25 bp, Artificial sequence
  Synthetic oligonucleotide
gccggccgttcacgttctcctggtc

SEQ ID NO: 698706 - DNA, 25 bp, Artificial sequence
  Synthetic oligonucleotide
gttgcggccggccgttcacgttctc

SEQ ID NO: 698707 - DNA, 25 bp, Artificial sequence
  Synthetic oligonucleotide
cgcggcggttgcggccggccgttca

SEQ ID NO: 698708 - DNA, 25 bp, Artificial sequence
  Synthetic oligonucleotide
ggcgagcgcggcggttgcggccggc

SEQ ID NO: 698709 - DNA, 25 bp, Artificial sequence
  Synthetic oligonucleotide
gagatcggcgagcgcggcggttgcg

SEQ ID NO: 698710 - DNA, 25 bp, Artificial sequence
  Synthetic oligonucleotide
ggatcctcgctggtgaagatgttgt

SEQ ID NO: 698711 - DNA, 25 bp, Artificial sequence
  Synthetic oligonucleotide
gacgtttgccggagatcggcgagcg

SEQ ID NO: 698712 - DNA, 25 bp, Artificial sequence
  Synthetic oligonucleotide
actccagctcgaaggcggcgacgat

SEQ ID NO: 698713 - DNA, 25 bp, Artificial sequence
  Synthetic oligonucleotide
gcaccgactgcggacgtttgccgga

SEQ ID NO: 698714 - DNA, 25 bp, Artificial sequence
  Synthetic oligonucleotide
acacctgcaccgactgcggacgttt

SEQ ID NO: 698715 - DNA, 25 bp, Artificial sequence
  Synthetic oligonucleotide
atggagtacacctgcaccgactgcg

SEQ ID NO: 698716 - DNA, 25 bp, Artificial sequence
  Synthetic oligonucleotide
tcgtcgatggagtacacctgcaccg

SEQ ID NO: 698717 - DNA, 25 bp, Artificial sequence
  Synthetic oligonucleotide
tcgaggtcgtcgatggagtacacct

SEQ ID NO: 698718 - DNA, 25 bp, Artificial sequence
  Synthetic oligonucleotide
tattcgtcgaggtcgtcgatggagt

SEQ ID NO: 698719 - DNA, 25 bp, Artificial sequence
  Synthetic oligonucleotide
tcgacgtattcgtcgaggtcgtcga

SEQ ID NO: 698720 - DNA, 25 bp, Artificial sequence
  Synthetic oligonucleotide
aggcactcgacgtattcgtcgaggt

SEQ ID NO: 698721 - DNA, 25 bp, Artificial sequence
  Synthetic oligonucleotide
ttgccggagatcggcgagcgcggcg

SEQ ID NO: 698722 - DNA, 25 bp, Artificial sequence
  Synthetic oligonucleotide
accacctggcgcaggacttcgcggg

SEQ ID NO: 698723 - DNA, 25 bp, Artificial sequence
  Synthetic oligonucleotide
tcagcagttgcgcggtcgggcgctt

SEQ ID NO: 698724 - DNA, 25 bp, Artificial sequence
  Synthetic oligonucleotide
tggtcatcagcagttgcgcggtcgg

SEQ ID NO: 698725 - DNA, 25 bp, Artificial sequence
  Synthetic oligonucleotide
cgtgcatggtcatcagcagttgcgc

SEQ ID NO: 698726 - DNA, 25 bp, Artificial sequence
  Synthetic oligonucleotide
ccagttcgtgcatggtcatcagcag

SEQ ID NO: 698727 - DNA, 25 bp, Artificial sequence
  Synthetic oligonucleotide
cgccttccagttcgtgcatggtcat

SEQ ID NO: 698728 - DNA, 25 bp, Artificial sequence
  Synthetic oligonucleotide
acggctcgccttccagttcgtgcat

SEQ ID NO: 698729 - DNA, 25 bp, Artificial sequence
  Synthetic oligonucleotide
cgaagaacggctcgccttccagttc

SEQ ID NO: 698730 - DNA, 25 bp, Artificial sequence
  Synthetic oligonucleotide
ggtcggcgaagaacggctcgccttc

SEQ ID NO: 698731 - DNA, 25 bp, Artificial sequence
  Synthetic oligonucleotide
cgatcaggtagaactccagctcgaa

SEQ ID NO: 698732 - DNA, 25 bp, Artificial sequence
  Synthetic oligonucleotide
tggcgcaggacttcgcgggggtcgg

SEQ ID NO: 698733 - DNA, 25 bp, Artificial sequence
  Synthetic oligonucleotide
ggtagaactccagctcgaaggcggc

SEQ ID NO: 698734 - DNA, 25 bp, Artificial sequence
  Synthetic oligonucleotide
tggccaccacctggcgcaggacttc

SEQ ID NO: 698735 - DNA, 25 bp, Artificial sequence
  Synthetic oligonucleotide
tgaacctggccaccacctggcgcag

SEQ ID NO: 698736 - DNA, 25 bp, Artificial sequence
  Synthetic oligonucleotide
tctcggtgaacctggccaccacctg

SEQ ID NO: 698737 - DNA, 25 bp, Artificial sequence
  Synthetic oligonucleotide
gttccatctcggtgaacctggccac

SEQ ID NO: 698738 - DNA, 25 bp, Artificial sequence
  Synthetic oligonucleotide
ggtcagttccatctcggtgaacctg

SEQ ID NO: 698739 - DNA, 25 bp, Artificial sequence
  Synthetic oligonucleotide
gacgatggtcagttccatctcggtg

SEQ ID NO: 698740 - DNA, 25 bp, Artificial sequence
  Synthetic oligonucleotide
ggcggcgacgatggtcagttccatc

SEQ ID NO: 698741 - DNA, 25 bp, Artificial sequence
  Synthetic oligonucleotide
ctcgaaggcggcgacgatggtcagt

SEQ ID NO: 698742 - DNA, 25 bp, Artificial sequence
  Synthetic oligonucleotide
gccgtcgatgatgtcctggaggcac

SEQ ID NO: 698743 - DNA, 25 bp, Artificial sequence
  Synthetic oligonucleotide
caggacttcgcgggggtcggcgaag

SEQ ID NO: 698744 - DNA, 25 bp, Artificial sequence
  Synthetic oligonucleotide
ccggatagggcttggccatgaaggt

SEQ ID NO: 698745 - DNA, 25 bp, Artificial sequence
  Synthetic oligonucleotide
tcctggaggcactcgacgtattcgt

SEQ ID NO: 698746 - DNA, 25 bp, Artificial sequence
  Synthetic oligonucleotide
tcttgaccaggcgcttgagcagcac

SEQ ID NO: 698747 - DNA, 25 bp, Artificial sequence
  Synthetic oligonucleotide
cgatgttcttgaccaggcgcttgag

SEQ ID NO: 698748 - DNA, 25 bp, Artificial sequence
  Synthetic oligonucleotide
cgtaggcgatgttcttgaccaggcg

SEQ ID NO: 698749 - DNA, 25 bp, Artificial sequence
  Synthetic oligonucleotide
gtggtcgtaggcgatgttcttgacc

SEQ ID NO: 698750 - DNA, 25 bp, Artificial sequence
  Synthetic oligonucleotide
ccatctcgtggtcgtaggcgatgtt

SEQ ID NO: 698751 - DNA, 25 bp, Artificial sequence
  Synthetic oligonucleotide
tggtgtccatctcgtggtcgtaggc

SEQ ID NO: 698752 - DNA, 25 bp, Artificial sequence
  Synthetic oligonucleotide
tgaaggtggtgtccatctcgtggtc

SEQ ID NO: 698753 - DNA, 25 bp, Artificial sequence
  Synthetic oligonucleotide
cgcttgagcagcaccgcgtggtcgc

SEQ ID NO: 698754 - DNA, 25 bp, Artificial sequence
  Synthetic oligonucleotide
agggcttggccatgaaggtggtgtc

SEQ ID NO: 698755 - DNA, 25 bp, Artificial sequence
  Synthetic oligonucleotide
agcagcaccgcgtggtcgcaggcct

SEQ ID NO: 698756 - DNA, 25 bp, Artificial sequence
  Synthetic oligonucleotide
cctggcccggatagggcttggccat

SEQ ID NO: 698757 - DNA, 25 bp, Artificial sequence
  Synthetic oligonucleotide
cccggcctggcccggatagggcttg

SEQ ID NO: 698758 - DNA, 25 bp, Artificial sequence
  Synthetic oligonucleotide
cacgtgcagtccgttcccggcctgg

SEQ ID NO: 698759 - DNA, 25 bp, Artificial sequence
  Synthetic oligonucleotide
atatgcacgtgcagtccgttcccgg

SEQ ID NO: 698760 - DNA, 25 bp, Artificial sequence
  Synthetic oligonucleotide
agcgagatatgcacgtgcagtccgt

SEQ ID NO: 698761 - DNA, 25 bp, Artificial sequence
  Synthetic oligonucleotide
tcgagcagcgagatatgcacgtgca

SEQ ID NO: 698762 - DNA, 25 bp, Artificial sequence
  Synthetic oligonucleotide
tgcttgtcgagcagcgagatatgca

SEQ ID NO: 698763 - DNA, 25 bp, Artificial sequence
  Synthetic oligonucleotide
ttgccatgcttgtcgagcagcgaga

SEQ ID NO: 698764 - DNA, 25 bp, Artificial sequence
  Synthetic oligonucleotide
atgttgttgccatgcttgtcgagca

SEQ ID NO: 698765 - DNA, 25 bp, Artificial sequence
  Synthetic oligonucleotide
tggccatgaaggtggtgtccatctc

SEQ ID NO: 698766 - DNA, 25 bp, Artificial sequence
  Synthetic oligonucleotide
aactgcgccggtgcggattcggcga

SEQ ID NO: 698767 - DNA, 25 bp, Artificial sequence
  Synthetic oligonucleotide
tgccgagcgagttccaggtcaattc

SEQ ID NO: 698768 - DNA, 25 bp, Artificial sequence
  Synthetic oligonucleotide
gcgggcgccgtcgatgatgtcctgg

SEQ ID NO: 698769 - DNA, 25 bp, Artificial sequence
  Synthetic oligonucleotide
ctgggcgcgggcgccgtcgatgatg

SEQ ID NO: 698770 - DNA, 25 bp, Artificial sequence
  Synthetic oligonucleotide
gatgccctgggcgcgggcgccgtcg

SEQ ID NO: 698771 - DNA, 25 bp, Artificial sequence
  Synthetic oligonucleotide
ggccgggatgccctgggcgcgggcg

SEQ ID NO: 698772 - DNA, 25 bp, Artificial sequence
  Synthetic oligonucleotide
tggcgtcggccgggatgccctgggc

SEQ ID NO: 698773 - DNA, 25 bp, Artificial sequence
  Synthetic oligonucleotide
cgacgatggcgtcggccgggatgcc

SEQ ID NO: 698774 - DNA, 25 bp, Artificial sequence
  Synthetic oligonucleotide
ttcggcgacgatggcgtcggccggg

SEQ ID NO: 698775 - DNA, 25 bp, Artificial sequence
  Synthetic oligonucleotide
accaggcgcttgagcagcaccgcgt

SEQ ID NO: 698776 - DNA, 25 bp, Artificial sequence
  Synthetic oligonucleotide
gccggtgcggattcggcgacgatgg

SEQ ID NO: 698777 - DNA, 25 bp, Artificial sequence
  Synthetic oligonucleotide
gatgatgtcctggaggcactcgacg

SEQ ID NO: 698778 - DNA, 25 bp, Artificial sequence
  Synthetic oligonucleotide
acctcgaactgcgccggtgcggatt

SEQ ID NO: 698779 - DNA, 25 bp, Artificial sequence
  Synthetic oligonucleotide
aggttgacctcgaactgcgccggtg

SEQ ID NO: 698780 - DNA, 25 bp, Artificial sequence
  Synthetic oligonucleotide
tggttgaggttgacctcgaactgcg

SEQ ID NO: 698781 - DNA, 25 bp, Artificial sequence
  Synthetic oligonucleotide
ttgacgtggttgaggttgacctcga

SEQ ID NO: 698782 - DNA, 25 bp, Artificial sequence
  Synthetic oligonucleotide
gcgtcgttgacgtggttgaggttga

SEQ ID NO: 698783 - DNA, 25 bp, Artificial sequence
  Synthetic oligonucleotide
ttgagggcgtcgttgacgtggttga

SEQ ID NO: 698784 - DNA, 25 bp, Artificial sequence
  Synthetic oligonucleotide
caggccttgagggcgtcgttgacgt

SEQ ID NO: 698785 - DNA, 25 bp, Artificial sequence
  Synthetic oligonucleotide
tggtcgcaggccttgagggcgtcgt

SEQ ID NO: 698786 - DNA, 25 bp, Artificial sequence
  Synthetic oligonucleotide
accgcgtggtcgcaggccttgaggg

SEQ ID NO: 698787 - DNA, 25 bp, Artificial sequence
  Synthetic oligonucleotide
gcggattcggcgacgatggcgtcgg

SEQ ID NO: 698788 - DNA, 25 bp, Artificial sequence
  Synthetic oligonucleotide
tggctgccagcctgctgtgcggcta

SEQ ID NO: 698789 - DNA, 25 bp, Artificial sequence
  Synthetic oligonucleotide
caggtcaaaggtcgcggctatgaac

SEQ ID NO: 698790 - DNA, 25 bp, Artificial sequence
  Synthetic oligonucleotide
agcgcccaggtcaaaggtcgcggct

SEQ ID NO: 698791 - DNA, 25 bp, Artificial sequence
  Synthetic oligonucleotide
aagccgagcgcccaggtcaaaggtc

SEQ ID NO: 698792 - DNA, 25 bp, Artificial sequence
  Synthetic oligonucleotide
aggcatcaagccgagcgcccaggtc

SEQ ID NO: 698793 - DNA, 25 bp, Artificial sequence
  Synthetic oligonucleotide
gtcgaaggcatcaagccgagcgccc

SEQ ID NO: 698794 - DNA, 25 bp, Artificial sequence
  Synthetic oligonucleotide
ggcatggtcgaaggcatcaagccga

SEQ ID NO: 698795 - DNA, 25 bp, Artificial sequence
  Synthetic oligonucleotide
tacatcggcatggtcgaaggcatca

SEQ ID NO: 698796 - DNA, 25 bp, Artificial sequence
  Synthetic oligonucleotide
tgcggctacatcggcatggtcgaag

SEQ ID NO: 698797 - DNA, 25 bp, Artificial sequence
  Synthetic oligonucleotide
aagcgtgcggagcacgagaatttca

SEQ ID NO: 698798 - DNA, 25 bp, Artificial sequence
  Synthetic oligonucleotide
gccagcctgctgtgcggctacatcg

SEQ ID NO: 698799 - DNA, 25 bp, Artificial sequence
  Synthetic oligonucleotide
atgaacgccgcaacctgcgcctgcc

SEQ ID NO: 698800 - DNA, 25 bp, Artificial sequence
  Synthetic oligonucleotide
ggcgctggctgccagcctgctgtgc

SEQ ID NO: 698801 - DNA, 25 bp, Artificial sequence
  Synthetic oligonucleotide
ttacctggcgctggctgccagcctg

SEQ ID NO: 698802 - DNA, 25 bp, Artificial sequence
  Synthetic oligonucleotide
aacccttacctggcgctggctgcca

SEQ ID NO: 698803 - DNA, 25 bp, Artificial sequence
  Synthetic oligonucleotide
acgccaacccttacctggcgctggc

SEQ ID NO: 698804 - DNA, 25 bp, Artificial sequence
  Synthetic oligonucleotide
gcgccgacgccaacccttacctggc

SEQ ID NO: 698805 - DNA, 25 bp, Artificial sequence
  Synthetic oligonucleotide
ctcgccggcgccgacgccaaccctt

SEQ ID NO: 698806 - DNA, 25 bp, Artificial sequence
  Synthetic oligonucleotide
aaccgtctcgccggcgccgacgcca

SEQ ID NO: 698807 - DNA, 25 bp, Artificial sequence
  Synthetic oligonucleotide
gtcgagaaccgtctcgccggcgccg

SEQ ID NO: 698808 - DNA, 25 bp, Artificial sequence
  Synthetic oligonucleotide
ctgctgtgcggctacatcggcatgg

SEQ ID NO: 698809 - DNA, 25 bp, Artificial sequence
  Synthetic oligonucleotide
tggagaactgcaagcccctcgagca

SEQ ID NO: 698810 - DNA, 25 bp, Artificial sequence
  Synthetic oligonucleotide
gaccggcgagccgggcagcgcgatg

SEQ ID NO: 698811 - DNA, 25 bp, Artificial sequence
  Synthetic oligonucleotide
acgtcgcggtgaagcgtgcggagca

SEQ ID NO: 698812 - DNA, 25 bp, Artificial sequence
  Synthetic oligonucleotide
gcggctacgtcgcggtgaagcgtgc

SEQ ID NO: 698813 - DNA, 25 bp, Artificial sequence
  Synthetic oligonucleotide
tcatcagcggctacgtcgcggtgaa

SEQ ID NO: 698814 - DNA, 25 bp, Artificial sequence
  Synthetic oligonucleotide
gcaagttcatcagcggctacgtcgc

SEQ ID NO: 698815 - DNA, 25 bp, Artificial sequence
  Synthetic oligonucleotide
tcggcagcaagttcatcagcggcta

SEQ ID NO: 698816 - DNA, 25 bp, Artificial sequence
  Synthetic oligonucleotide
agtatctcggcagcaagttcatcag

SEQ ID NO: 698817 - DNA, 25 bp, Artificial sequence
  Synthetic oligonucleotide
tcgagcagtatctcggcagcaagtt

SEQ ID NO: 698818 - DNA, 25 bp, Artificial sequence
  Synthetic oligonucleotide
aaggtcgcggctatgaacgccgcaa

SEQ ID NO: 698819 - DNA, 25 bp, Artificial sequence
  Synthetic oligonucleotide
actgcaagcccctcgagcagtatct

SEQ ID NO: 698820 - DNA, 25 bp, Artificial sequence
  Synthetic oligonucleotide
gcggctatgaacgccgcaacctgcg

SEQ ID NO: 698821 - DNA, 25 bp, Artificial sequence
  Synthetic oligonucleotide
agcgcatggagaactgcaagcccct

SEQ ID NO: 698822 - DNA, 25 bp, Artificial sequence
  Synthetic oligonucleotide
cgctggagcgcatggagaactgcaa

SEQ ID NO: 698823 - DNA, 25 bp, Artificial sequence
  Synthetic oligonucleotide
gaagcggcgctggagcgcatggaga

SEQ ID NO: 698824 - DNA, 25 bp, Artificial sequence
  Synthetic oligonucleotide
acgatcgaagcggcgctggagcgca

SEQ ID NO: 698825 - DNA, 25 bp, Artificial sequence
  Synthetic oligonucleotide
ccgctgacgatcgaagcggcgctgg

SEQ ID NO: 698826 - DNA, 25 bp, Artificial sequence
  Synthetic oligonucleotide
cgcctgccgctgacgatcgaagcgg

SEQ ID NO: 698827 - DNA, 25 bp, Artificial sequence
  Synthetic oligonucleotide
acctgcgcctgccgctgacgatcga

SEQ ID NO: 698828 - DNA, 25 bp, Artificial sequence
  Synthetic oligonucleotide
gccgcaacctgcgcctgccgctgac

SEQ ID NO: 698829 - DNA, 25 bp, Artificial sequence
  Synthetic oligonucleotide
tgccggactccagcccggagaaccg

SEQ ID NO: 698830 - DNA, 25 bp, Artificial sequence
  Synthetic oligonucleotide
agcccctcgagcagtatctcggcag

SEQ ID NO: 698831 - DNA, 25 bp, Artificial sequence
  Synthetic oligonucleotide
aagaacatcttctccaatgccgacg

SEQ ID NO: 698832 - DNA, 25 bp, Artificial sequence
  Synthetic oligonucleotide
cgccgggtcgagaaccgtctcgccg

SEQ ID NO: 698833 - DNA, 25 bp, Artificial sequence
  Synthetic oligonucleotide
atcggcggcctgcagaagttcatcc

SEQ ID NO: 698834 - DNA, 25 bp, Artificial sequence
  Synthetic oligonucleotide
accatatcggcggcctgcagaagtt

SEQ ID NO: 698835 - DNA, 25 bp, Artificial sequence
  Synthetic oligonucleotide
tcctgcaccatatcggcggcctgca

SEQ ID NO: 698836 - DNA, 25 bp, Artificial sequence
  Synthetic oligonucleotide
agctgttcctgcaccatatcggcgg

SEQ ID NO: 698837 - DNA, 25 bp, Artificial sequence
  Synthetic oligonucleotide
atgagcgagctgttcctgcaccata

SEQ ID NO: 698838 - DNA, 25 bp, Artificial sequence
  Synthetic oligonucleotide
ggcaccatgagcgagctgttcctgc

SEQ ID NO: 698839 - DNA, 25 bp, Artificial sequence
  Synthetic oligonucleotide
gccgacggcaccatgagcgagctgt

SEQ ID NO: 698840 - DNA, 25 bp, Artificial sequence
  Synthetic oligonucleotide
cagaagttcatcccggaagtgctgc

SEQ ID NO: 698841 - DNA, 25 bp, Artificial sequence
  Synthetic oligonucleotide
atcttctccaatgccgacggcacca

SEQ ID NO: 698842 - DNA, 25 bp, Artificial sequence
  Synthetic oligonucleotide
ttcatcccggaagtgctgccgctgt

SEQ ID NO: 698843 - DNA, 25 bp, Artificial sequence
  Synthetic oligonucleotide
accggcaagaacatcttctccaatg

SEQ ID NO: 698844 - DNA, 25 bp, Artificial sequence
  Synthetic oligonucleotide
gtgaagaccggcaagaacatcttct

SEQ ID NO: 698845 - DNA, 25 bp, Artificial sequence
  Synthetic oligonucleotide
gtcgacgtgaagaccggcaagaaca

SEQ ID NO: 698846 - DNA, 25 bp, Artificial sequence
  Synthetic oligonucleotide
agcatcgtcgacgtgaagaccggca

SEQ ID NO: 698847 - DNA, 25 bp, Artificial sequence
  Synthetic oligonucleotide
caccagagcatcgtcgacgtgaaga

SEQ ID NO: 698848 - DNA, 25 bp, Artificial sequence
  Synthetic oligonucleotide
cacctgcaccagagcatcgtcgacg

SEQ ID NO: 698849 - DNA, 25 bp, Artificial sequence
  Synthetic oligonucleotide
gcgatgcacctgcaccagagcatcg

SEQ ID NO: 698850 - DNA, 25 bp, Artificial sequence
  Synthetic oligonucleotide
ggcagcgcgatgcacctgcaccaga

SEQ ID NO: 698851 - DNA, 25 bp, Artificial sequence
  Synthetic oligonucleotide
ccggtatcggcttgccgagcgagtt

SEQ ID NO: 698852 - DNA, 25 bp, Artificial sequence
  Synthetic oligonucleotide
tccaatgccgacggcaccatgagcg

SEQ ID NO: 698853 - DNA, 25 bp, Artificial sequence
  Synthetic oligonucleotide
tgcccgatacctcggcgccggtgaa

SEQ ID NO: 698854 - DNA, 25 bp, Artificial sequence
  Synthetic oligonucleotide
tgcggagcacgagaatttcaagcgg

SEQ ID NO: 698855 - DNA, 25 bp, Artificial sequence
  Synthetic oligonucleotide
tgcgcgtgccggactccagcccgga

SEQ ID NO: 698856 - DNA, 25 bp, Artificial sequence
  Synthetic oligonucleotide
tcggcctgcgcgtgccggactccag

SEQ ID NO: 698857 - DNA, 25 bp, Artificial sequence
  Synthetic oligonucleotide
gtaccgtcggcctgcgcgtgccgga

SEQ ID NO: 698858 - DNA, 25 bp, Artificial sequence
  Synthetic oligonucleotide
agaaccgtaccgtcggcctgcgcgt

SEQ ID NO: 698859 - DNA, 25 bp, Artificial sequence
  Synthetic oligonucleotide
cgaagagaaccgtaccgtcggcctg

SEQ ID NO: 698860 - DNA, 25 bp, Artificial sequence
  Synthetic oligonucleotide
acgtcgagtggggcgaagagaaccg

SEQ ID NO: 698861 - DNA, 25 bp, Artificial sequence
  Synthetic oligonucleotide
ccggtgaacgtcgagtggggcgaag

SEQ ID NO: 698862 - DNA, 25 bp, Artificial sequence
  Synthetic oligonucleotide
ggcctgcagaagttcatcccggaag

SEQ ID NO: 698863 - DNA, 25 bp, Artificial sequence
  Synthetic oligonucleotide
atacctcggcgccggtgaacgtcga

SEQ ID NO: 698864 - DNA, 25 bp, Artificial sequence
  Synthetic oligonucleotide
cagcccggagaaccgccgggtcgag

SEQ ID NO: 698865 - DNA, 25 bp, Artificial sequence
  Synthetic oligonucleotide
cttcctgcccgatacctcggcgccg

SEQ ID NO: 698866 - DNA, 25 bp, Artificial sequence
  Synthetic oligonucleotide
ccgccgcttcctgcccgatacctcg

SEQ ID NO: 698867 - DNA, 25 bp, Artificial sequence
  Synthetic oligonucleotide
ctggtggagatcatcgagcgcgtcg

SEQ ID NO: 698868 - DNA, 25 bp, Artificial sequence
  Synthetic oligonucleotide
acgtgaactcgttccgccgcttcct

SEQ ID NO: 698869 - DNA, 25 bp, Artificial sequence
  Synthetic oligonucleotide
gagatcatcgagcgcgtcggcgtga

SEQ ID NO: 698870 - DNA, 25 bp, Artificial sequence
  Synthetic oligonucleotide
gttcgcgcccaacgtgaactcgttc

SEQ ID NO: 698871 - DNA, 25 bp, Artificial sequence
  Synthetic oligonucleotide
ccgctgttcgcgcccaacgtgaact

SEQ ID NO: 698872 - DNA, 25 bp, Artificial sequence
  Synthetic oligonucleotide
gtgctgccgctgttcgcgcccaacg

SEQ ID NO: 698873 - DNA, 25 bp, Artificial sequence
  Synthetic oligonucleotide
ccggaagtgctgccgctgttcgcgc

SEQ ID NO: 698874 - DNA, 25 bp, Artificial sequence
  Synthetic oligonucleotide
tcggcgccggtgaacgtcgagtggg

SEQ ID NO: 698875 - DNA, 25 bp, Artificial sequence
  Synthetic oligonucleotide
tcggctacggccgcgaggagctggt

SEQ ID NO: 698876 - DNA, 25 bp, Artificial sequence
  Synthetic oligonucleotide
tctacaacctgttcttccagaccgc

SEQ ID NO: 698877 - DNA, 25 bp, Artificial sequence
  Synthetic oligonucleotide
tgccgttctacaacctgttcttcca

SEQ ID NO: 698878 - DNA, 25 bp, Artificial sequence
  Synthetic oligonucleotide
gcgagttgccgttctacaacctgtt

SEQ ID NO: 698879 - DNA, 25 bp, Artificial sequence
  Synthetic oligonucleotide
agatgcgcgagttgccgttctacaa

SEQ ID NO: 698880 - DNA, 25 bp, Artificial sequence
  Synthetic oligonucleotide
cccggcagatgcgcgagttgccgtt

SEQ ID NO: 698881 - DNA, 25 bp, Artificial sequence
  Synthetic oligonucleotide
ccgccacccggcagatgcgcgagtt

SEQ ID NO: 698882 - DNA, 25 bp, Artificial sequence
  Synthetic oligonucleotide
tccaggccgccacccggcagatgcg

SEQ ID NO: 698883 - DNA, 25 bp, Artificial sequence
  Synthetic oligonucleotide
agctggtccaggccgccacccggca

SEQ ID NO: 698884 - DNA, 25 bp, Artificial sequence
  Synthetic oligonucleotide
gcggtgaagcgtgcggagcacgaga

SEQ ID NO: 698885 - DNA, 25 bp, Artificial sequence
  Synthetic oligonucleotide
acggccgcgaggagctggtccaggc

SEQ ID NO: 698886 - DNA, 25 bp, Artificial sequence
  Synthetic oligonucleotide
ccgcccacccgccggtggtcgagct

SEQ ID NO: 698887 - DNA, 25 bp, Artificial sequence
  Synthetic oligonucleotide
tcaacgtcggctacggccgcgagga

SEQ ID NO: 698888 - DNA, 25 bp, Artificial sequence
  Synthetic oligonucleotide
gtgcgtcaacgtcggctacggccgc

SEQ ID NO: 698889 - DNA, 25 bp, Artificial sequence
  Synthetic oligonucleotide
ctctggtgcgtcaacgtcggctacg

SEQ ID NO: 698890 - DNA, 25 bp, Artificial sequence
  Synthetic oligonucleotide
gccggcctctggtgcgtcaacgtcg

SEQ ID NO: 698891 - DNA, 25 bp, Artificial sequence
  Synthetic oligonucleotide
gcgatggccggcctctggtgcgtca

SEQ ID NO: 698892 - DNA, 25 bp, Artificial sequence
  Synthetic oligonucleotide
ctcgatgcgatggccggcctctggt

SEQ ID NO: 698893 - DNA, 25 bp, Artificial sequence
  Synthetic oligonucleotide
aagatcctcgatgcgatggccggcc

SEQ ID NO: 698894 - DNA, 25 bp, Artificial sequence
  Synthetic oligonucleotide
ggcaacaagatcctcgatgcgatgg

SEQ ID NO: 698895 - DNA, 25 bp, Artificial sequence
  Synthetic oligonucleotide
gcgaggagctggtccaggccgccac

SEQ ID NO: 698896 - DNA, 25 bp, Artificial sequence
  Synthetic oligonucleotide
aaggcatgaaccacgtgttcttcac

SEQ ID NO: 698897 - DNA, 25 bp, Artificial sequence
  Synthetic oligonucleotide
tatggtccgccactattgggcgacc

SEQ ID NO: 698898 - DNA, 25 bp, Artificial sequence
  Synthetic oligonucleotide
gctgcgtatggtccgccactattgg

SEQ ID NO: 698899 - DNA, 25 bp, Artificial sequence
  Synthetic oligonucleotide
accgtgctgcgtatggtccgccact

SEQ ID NO: 698900 - DNA, 25 bp, Artificial sequence
  Synthetic oligonucleotide
caacgacaccgtgctgcgtatggtc

SEQ ID NO: 698901 - DNA, 25 bp, Artificial sequence
  Synthetic oligonucleotide
cgaggccaacgacaccgtgctgcgt

SEQ ID NO: 698902 - DNA, 25 bp, Artificial sequence
  Synthetic oligonucleotide
cggctccgaggccaacgacaccgtg

SEQ ID NO: 698903 - DNA, 25 bp, Artificial sequence
  Synthetic oligonucleotide
ccggctccggctccgaggccaacga

SEQ ID NO: 698904 - DNA, 25 bp, Artificial sequence
  Synthetic oligonucleotide
tcttcaccggctccggctccgaggc

SEQ ID NO: 698905 - DNA, 25 bp, Artificial sequence
  Synthetic oligonucleotide
cctgttcttccagaccgcccacccg

SEQ ID NO: 698906 - DNA, 25 bp, Artificial sequence
  Synthetic oligonucleotide
tgaaccacgtgttcttcaccggctc

SEQ ID NO: 698907 - DNA, 25 bp, Artificial sequence
  Synthetic oligonucleotide
cttccagaccgcccacccgccggtg

SEQ ID NO: 698908 - DNA, 25 bp, Artificial sequence
  Synthetic oligonucleotide
ctccggaaggcatgaaccacgtgtt

SEQ ID NO: 698909 - DNA, 25 bp, Artificial sequence
  Synthetic oligonucleotide
acgtcgctccggaaggcatgaacca

SEQ ID NO: 698910 - DNA, 25 bp, Artificial sequence
  Synthetic oligonucleotide
tcgccgacgtcgctccggaaggcat

SEQ ID NO: 698911 - DNA, 25 bp, Artificial sequence
  Synthetic oligonucleotide
aggcgatcgccgacgtcgctccgga

SEQ ID NO: 698912 - DNA, 25 bp, Artificial sequence
  Synthetic oligonucleotide
tggccaaggcgatcgccgacgtcgc

SEQ ID NO: 698913 - DNA, 25 bp, Artificial sequence
  Synthetic oligonucleotide
tcgagctggccaaggcgatcgccga

SEQ ID NO: 698914 - DNA, 25 bp, Artificial sequence
  Synthetic oligonucleotide
cggtggtcgagctggccaaggcgat

SEQ ID NO: 698915 - DNA, 25 bp, Artificial sequence
  Synthetic oligonucleotide
acccgccggtggtcgagctggccaa

SEQ ID NO: 698916 - DNA, 25 bp, Artificial sequence
  Synthetic oligonucleotide
tatatctgggacagcgagggcaaca

SEQ ID NO: 698917 - DNA, 25 bp, Artificial sequence
  Synthetic oligonucleotide
acgtgttcttcaccggctccggctc

SEQ ID NO: 698918 - DNA, 25 bp, Artificial sequence
  Synthetic oligonucleotide
ttgatcctgaccgggggcggccggc

SEQ ID NO: 698919 - DNA, 25 bp, Artificial sequence
  Synthetic oligonucleotide
agcgagggcaacaagatcctcgatg

SEQ ID NO: 698920 - DNA, 25 bp, Artificial sequence
  Synthetic oligonucleotide
tgtgacatgaacagccaaatcacca

SEQ ID NO: 698921 - DNA, 25 bp, Artificial sequence
  Synthetic oligonucleotide
aagaggtgtgacatgaacagccaaa

SEQ ID NO: 698922 - DNA, 25 bp, Artificial sequence
  Synthetic oligonucleotide
gaatagaagaggtgtgacatgaaca

SEQ ID NO: 698923 - DNA, 25 bp, Artificial sequence
  Synthetic oligonucleotide
agtcttgaatagaagaggtgtgaca

SEQ ID NO: 698924 - DNA, 25 bp, Artificial sequence
  Synthetic oligonucleotide
cccggacagtcttgaatagaagagg

SEQ ID NO: 698925 - DNA, 25 bp, Artificial sequence
  Synthetic oligonucleotide
ccgctcccggacagtcttgaataga

SEQ ID NO: 698926 - DNA, 25 bp, Artificial sequence
  Synthetic oligonucleotide
ggtccgccgctcccggacagtcttg

SEQ ID NO: 698927 - DNA, 25 bp, Artificial sequence
  Synthetic oligonucleotide
agccaaatcaccaacgccaagaccc

SEQ ID NO: 698928 - DNA, 25 bp, Artificial sequence
  Synthetic oligonucleotide
gggcggccggcgtggtccgccgctc

SEQ ID NO: 698929 - DNA, 25 bp, Artificial sequence
  Synthetic oligonucleotide
atcaccaacgccaagacccgtgagt

SEQ ID NO: 698930 - DNA, 25 bp, Artificial sequence
  Synthetic oligonucleotide
tcctgctttccgtttgatcctgacc

SEQ ID NO: 698931 - DNA, 25 bp, Artificial sequence
  Synthetic oligonucleotide
aattcctcctgctttccgtttgatc

SEQ ID NO: 698932 - DNA, 25 bp, Artificial sequence
  Synthetic oligonucleotide
agcgggaattcctcctgctttccgt

SEQ ID NO: 698933 - DNA, 25 bp, Artificial sequence
  Synthetic oligonucleotide
cctgggagcgggaattcctcctgct

SEQ ID NO: 698934 - DNA, 25 bp, Artificial sequence
  Synthetic oligonucleotide
tcagctcctgggagcgggaattcct

SEQ ID NO: 698935 - DNA, 25 bp, Artificial sequence
  Synthetic oligonucleotide
gggtaatcagctcctgggagcggga

SEQ ID NO: 698936 - DNA, 25 bp, Artificial sequence
  Synthetic oligonucleotide
tcaagcgggtaatcagctcctggga

SEQ ID NO: 698937 - DNA, 25 bp, Artificial sequence
  Synthetic oligonucleotide
agaatttcaagcgggtaatcagctc

SEQ ID NO: 698938 - DNA, 25 bp, Artificial sequence
  Synthetic oligonucleotide
gcacgagaatttcaagcgggtaatc

SEQ ID NO: 698939 - DNA, 25 bp, Artificial sequence
  Synthetic oligonucleotide
cggcgtggtccgccgctcccggaca

SEQ ID NO: 698940 - DNA, 25 bp, Artificial sequence
  Synthetic oligonucleotide
accgactacaagcagttgaacgaga

SEQ ID NO: 698941 - DNA, 25 bp, Artificial sequence
  Synthetic oligonucleotide
ccgatgaccggcgagccgggcagcg

SEQ ID NO: 698942 - DNA, 25 bp, Artificial sequence
  Synthetic oligonucleotide
ggcgtctatatctgggacagcgagg

SEQ ID NO: 698943 - DNA, 25 bp, Artificial sequence
  Synthetic oligonucleotide
gccgaaggcgtctatatctgggaca

SEQ ID NO: 698944 - DNA, 25 bp, Artificial sequence
  Synthetic oligonucleotide
accaaggccgaaggcgtctatatct

SEQ ID NO: 698945 - DNA, 25 bp, Artificial sequence
  Synthetic oligonucleotide
atcatcaccaaggccgaaggcgtct

SEQ ID NO: 698946 - DNA, 25 bp, Artificial sequence
  Synthetic oligonucleotide
gcgcggatcatcaccaaggccgaag

SEQ ID NO: 698947 - DNA, 25 bp, Artificial sequence
  Synthetic oligonucleotide
aagggcgcgcggatcatcaccaagg

SEQ ID NO: 698948 - DNA, 25 bp, Artificial sequence
  Synthetic oligonucleotide
aacgagaagggcgcgcggatcatca

SEQ ID NO: 698949 - DNA, 25 bp, Artificial sequence
  Synthetic oligonucleotide
atgaacagccaaatcaccaacgcca

SEQ ID NO: 698950 - DNA, 25 bp, Artificial sequence
  Synthetic oligonucleotide
tacaagcagttgaacgagaagggcg

SEQ ID NO: 698951 - DNA, 25 bp, Artificial sequence
  Synthetic oligonucleotide
tgggacagcgagggcaacaagatcc

SEQ ID NO: 698952 - DNA, 25 bp, Artificial sequence
  Synthetic oligonucleotide
ccgttcaccgactacaagcagttga

SEQ ID NO: 698953 - DNA, 25 bp, Artificial sequence
  Synthetic oligonucleotide
ctgccgccgttcaccgactacaagc

SEQ ID NO: 698954 - DNA, 25 bp, Artificial sequence
  Synthetic oligonucleotide
caccatctgccgccgttcaccgact

SEQ ID NO: 698955 - DNA, 25 bp, Artificial sequence
  Synthetic oligonucleotide
ccgcgaccaccatctgccgccgttc

SEQ ID NO: 698956 - DNA, 25 bp, Artificial sequence
  Synthetic oligonucleotide
gttgagccgcgaccaccatctgccg

SEQ ID NO: 698957 - DNA, 25 bp, Artificial sequence
  Synthetic oligonucleotide
gcaggcgttgagccgcgaccaccat

SEQ ID NO: 698958 - DNA, 25 bp, Artificial sequence
  Synthetic oligonucleotide
tgagtggcaggcgttgagccgcgac

SEQ ID NO: 698959 - DNA, 25 bp, Artificial sequence
  Synthetic oligonucleotide
agacccgtgagtggcaggcgttgag

SEQ ID NO: 698960 - DNA, 25 bp, Artificial sequence
  Synthetic oligonucleotide
acgccaagacccgtgagtggcaggc

SEQ ID NO: 698961 - DNA, 25 bp, Artificial sequence
  Synthetic oligonucleotide
cagttgaacgagaagggcgcgcgga

SEQ ID NO: 698962 - DNA, 25 bp, Artificial sequence
  Synthetic oligonucleotide
aaggaacgcaagatcaccgaagtgg

SEQ ID NO: 698963 - DNA, 25 bp, Artificial sequence
  Synthetic oligonucleotide
gcggcaagatctcgccgaccaacaa

SEQ ID NO: 698964 - DNA, 25 bp, Artificial sequence
  Synthetic oligonucleotide
cgcccgcggcaagatctcgccgacc

SEQ ID NO: 698965 - DNA, 25 bp, Artificial sequence
  Synthetic oligonucleotide
aggcatcgcccgcggcaagatctcg

SEQ ID NO: 698966 - DNA, 25 bp, Artificial sequence
  Synthetic oligonucleotide
tctgacaggcatcgcccgcggcaag

SEQ ID NO: 698967 - DNA, 25 bp, Artificial sequence
  Synthetic oligonucleotide
tccgatctgacaggcatcgcccgcg

SEQ ID NO: 698968 - DNA, 25 bp, Artificial sequence
  Synthetic oligonucleotide
ctgatttccgatctgacaggcatcg

SEQ ID NO: 698969 - DNA, 25 bp, Artificial sequence
  Synthetic oligonucleotide
gaatgcctgatttccgatctgacag

SEQ ID NO: 698970 - DNA, 25 bp, Artificial sequence
  Synthetic oligonucleotide
gaagtggaatgcctgatttccgatc

SEQ ID NO: 698971 - DNA, 25 bp, Artificial sequence
  Synthetic oligonucleotide
atggtctgccgcccggacgagaatg

SEQ ID NO: 698972 - DNA, 25 bp, Artificial sequence
  Synthetic oligonucleotide
cgcaagatcaccgaagtggaatgcc

SEQ ID NO: 698973 - DNA, 25 bp, Artificial sequence
  Synthetic oligonucleotide
ccaacaaattcatcgcggaaaaggg

SEQ ID NO: 698974 - DNA, 25 bp, Artificial sequence
  Synthetic oligonucleotide
tggctgaaggaacgcaagatcaccg

SEQ ID NO: 698975 - DNA, 25 bp, Artificial sequence
  Synthetic oligonucleotide
accagctggctgaaggaacgcaaga

SEQ ID NO: 698976 - DNA, 25 bp, Artificial sequence
  Synthetic oligonucleotide
cagctgaccagctggctgaaggaac

SEQ ID NO: 698977 - DNA, 25 bp, Artificial sequence
  Synthetic oligonucleotide
gttagaccagctgaccagctggctg

SEQ ID NO: 698978 - DNA, 25 bp, Artificial sequence
  Synthetic oligonucleotide
taccaagttagaccagctgaccagc

SEQ ID NO: 698979 - DNA, 25 bp, Artificial sequence
  Synthetic oligonucleotide
tatgactaccaagttagaccagctg

SEQ ID NO: 698980 - DNA, 25 bp, Artificial sequence
  Synthetic oligonucleotide
ggtctttatgactaccaagttagac

SEQ ID NO: 698981 - DNA, 25 bp, Artificial sequence
  Synthetic oligonucleotide
ccctgaggtctttatgactaccaag

SEQ ID NO: 698982 - DNA, 25 bp, Artificial sequence
  Synthetic oligonucleotide
atcaccgaagtggaatgcctgattt

SEQ ID NO: 698983 - DNA, 25 bp, Artificial sequence
  Synthetic oligonucleotide
ccgtcaccggcgactacgtggaaga

SEQ ID NO: 698984 - DNA, 25 bp, Artificial sequence
  Synthetic oligonucleotide
cgagccgggcagcgcgatgcacctg

SEQ ID NO: 698985 - DNA, 25 bp, Artificial sequence
  Synthetic oligonucleotide
gccgacatcgatatggtctgccgcc

SEQ ID NO: 698986 - DNA, 25 bp, Artificial sequence
  Synthetic oligonucleotide
acccggccgacatcgatatggtctg

SEQ ID NO: 698987 - DNA, 25 bp, Artificial sequence
  Synthetic oligonucleotide
tgctcgacccggccgacatcgatat

SEQ ID NO: 698988 - DNA, 25 bp, Artificial sequence
  Synthetic oligonucleotide
tacgacctgctcgacccggccgaca

SEQ ID NO: 698989 - DNA, 25 bp, Artificial sequence
  Synthetic oligonucleotide
atttactacgacctgctcgacccgg

SEQ ID NO: 698990 - DNA, 25 bp, Artificial sequence
  Synthetic oligonucleotide
acgacatttactacgacctgctcga

SEQ ID NO: 698991 - DNA, 25 bp, Artificial sequence
  Synthetic oligonucleotide
tggaagacgacatttactacgacct

SEQ ID NO: 698992 - DNA, 25 bp, Artificial sequence
  Synthetic oligonucleotide
agatctcgccgaccaacaaattcat

SEQ ID NO: 698993 - DNA, 25 bp, Artificial sequence
  Synthetic oligonucleotide
ccggcgactacgtggaagacgacat

SEQ ID NO: 698994 - DNA, 25 bp, Artificial sequence
  Synthetic oligonucleotide
cgccgaccaacaaattcatcgcgga

SEQ ID NO: 698995 - DNA, 25 bp, Artificial sequence
  Synthetic oligonucleotide
tgcagaccgtcaccggcgactacgt

SEQ ID NO: 698996 - DNA, 25 bp, Artificial sequence
  Synthetic oligonucleotide
gttctgctgcagaccgtcaccggcg

SEQ ID NO: 698997 - DNA, 25 bp, Artificial sequence
  Synthetic oligonucleotide
gagagcgttctgctgcagaccgtca

SEQ ID NO: 698998 - DNA, 25 bp, Artificial sequence
  Synthetic oligonucleotide
ctgccggagagcgttctgctgcaga

SEQ ID NO: 698999 - DNA, 25 bp, Artificial sequence
  Synthetic oligonucleotide
catgcgcctgccggagagcgttctg

SEQ ID NO: 699000 - DNA, 25 bp, Artificial sequence
  Synthetic oligonucleotide
aaaagggcatgcgcctgccggagag

SEQ ID NO: 699001 - DNA, 25 bp, Artificial sequence
  Synthetic oligonucleotide
tcgcggaaaagggcatgcgcctgcc

SEQ ID NO: 699002 - DNA, 25 bp, Artificial sequence
  Synthetic oligonucleotide
aattcatcgcggaaaagggcatgcg

SEQ ID NO: 699003 - DNA, 25 bp, Artificial sequence
  Synthetic oligonucleotide
ttggggccggactctcaaccctgag

SEQ ID NO: 699004 - DNA, 25 bp, Artificial sequence
  Synthetic oligonucleotide
actacgtggaagacgacatttacta

SEQ ID NO: 699005 - DNA, 25 bp, Artificial sequence
  Synthetic oligonucleotide
ggccttcgagtagaagcactggcgc

SEQ ID NO: 699006 - DNA, 25 bp, Artificial sequence
  Synthetic oligonucleotide
tctcaaccctgaggtctttatgact

SEQ ID NO: 699007 - DNA, 25 bp, Artificial sequence
  Synthetic oligonucleotide
gaaggtgcaaaagccttcgctcttg

SEQ ID NO: 699008 - DNA, 25 bp, Artificial sequence
  Synthetic oligonucleotide
tccgtagaaggtgcaaaagccttcg

SEQ ID NO: 699009 - DNA, 25 bp, Artificial sequence
  Synthetic oligonucleotide
gccatctccgtagaaggtgcaaaag

SEQ ID NO: 699010 - DNA, 25 bp, Artificial sequence
  Synthetic oligonucleotide
ggtcgaagccatctccgtagaaggt

SEQ ID NO: 699011 - DNA, 25 bp, Artificial sequence
  Synthetic oligonucleotide
cgggttggtcgaagccatctccgta

SEQ ID NO: 699012 - DNA, 25 bp, Artificial sequence
  Synthetic oligonucleotide
gcctgacgggttggtcgaagccatc

SEQ ID NO: 699013 - DNA, 25 bp, Artificial sequence
  Synthetic oligonucleotide
actggcgcctgacgggttggtcgaa

SEQ ID NO: 699014 - DNA, 25 bp, Artificial sequence
  Synthetic oligonucleotide
ccttcgctcttggtgtgcaatggca

SEQ ID NO: 699015 - DNA, 25 bp, Artificial sequence
  Synthetic oligonucleotide
tcgagtagaagcactggcgcctgac

SEQ ID NO: 699016 - DNA, 25 bp, Artificial sequence
  Synthetic oligonucleotide
gctcttggtgtgcaatggcacccgg

SEQ ID NO: 699017 - DNA, 25 bp, Artificial sequence
  Synthetic oligonucleotide
ggcgccgggccttcgagtagaagca

SEQ ID NO: 699018 - DNA, 25 bp, Artificial sequence
  Synthetic oligonucleotide
tcgtctggcgccgggccttcgagta

SEQ ID NO: 699019 - DNA, 25 bp, Artificial sequence
  Synthetic oligonucleotide
gttgatcgtctggcgccgggccttc

SEQ ID NO: 699020 - DNA, 25 bp, Artificial sequence
  Synthetic oligonucleotide
agggcgttgatcgtctggcgccggg

SEQ ID NO: 699021 - DNA, 25 bp, Artificial sequence
  Synthetic oligonucleotide
atggccagggcgttgatcgtctggc

SEQ ID NO: 699022 - DNA, 25 bp, Artificial sequence
  Synthetic oligonucleotide
ccatccatggccagggcgttgatcg

SEQ ID NO: 699023 - DNA, 25 bp, Artificial sequence
  Synthetic oligonucleotide
tcaattccatccatggccagggcgt

SEQ ID NO: 699024 - DNA, 25 bp, Artificial sequence
  Synthetic oligonucleotide
tccaggtcaattccatccatggcca

SEQ ID NO: 699025 - DNA, 25 bp, Artificial sequence
  Synthetic oligonucleotide
gcgagttccaggtcaattccatcca

SEQ ID NO: 699026 - DNA, 25 bp, Artificial sequence
  Synthetic oligonucleotide
agaagcactggcgcctgacgggttg

SEQ ID NO: 699027 - DNA, 25 bp, Artificial sequence
  Synthetic oligonucleotide
tcttccaggctttcggtaaggcctg

SEQ ID NO: 699028 - DNA, 25 bp, Artificial sequence
  Synthetic oligonucleotide
tgccgcccggacgagaatgccgtgt

SEQ ID NO: 699029 - DNA, 25 bp, Artificial sequence
  Synthetic oligonucleotide
cggctgttggggccggactctcaac

SEQ ID NO: 699030 - DNA, 25 bp, Artificial sequence
  Synthetic oligonucleotide
tgagtccggctgttggggccggact

SEQ ID NO: 699031 - DNA, 25 bp, Artificial sequence
  Synthetic oligonucleotide
caacgttgagtccggctgttggggc

SEQ ID NO: 699032 - DNA, 25 bp, Artificial sequence
  Synthetic oligonucleotide
cggggcaacgttgagtccggctgtt

SEQ ID NO: 699033 - DNA, 25 bp, Artificial sequence
  Synthetic oligonucleotide
agagggcggggcaacgttgagtccg

SEQ ID NO: 699034 - DNA, 25 bp, Artificial sequence
  Synthetic oligonucleotide
gcagcaagagggcggggcaacgttg

SEQ ID NO: 699035 - DNA, 25 bp, Artificial sequence
  Synthetic oligonucleotide
aggcctgcagcaagagggcggggca

SEQ ID NO: 699036 - DNA, 25 bp, Artificial sequence
  Synthetic oligonucleotide
caaaagccttcgctcttggtgtgca

SEQ ID NO: 699037 - DNA, 25 bp, Artificial sequence
  Synthetic oligonucleotide
aggctttcggtaaggcctgcagcaa

SEQ ID NO: 699038 - DNA, 25 bp, Artificial sequence
  Synthetic oligonucleotide
ccggactctcaaccctgaggtcttt

SEQ ID NO: 699039 - DNA, 25 bp, Artificial sequence
  Synthetic oligonucleotide
tcgctatcttccaggctttcggtaa

SEQ ID NO: 699040 - DNA, 25 bp, Artificial sequence
  Synthetic oligonucleotide
actatctcgctatcttccaggcttt

SEQ ID NO: 699041 - DNA, 25 bp, Artificial sequence
  Synthetic oligonucleotide
accccaactatctcgctatcttcca

SEQ ID NO: 699042 - DNA, 25 bp, Artificial sequence
  Synthetic oligonucleotide
tgacgaaccccaactatctcgctat

SEQ ID NO: 699043 - DNA, 25 bp, Artificial sequence
  Synthetic oligonucleotide
caggttctgacgaaccccaactatc

SEQ ID NO: 699044 - DNA, 25 bp, Artificial sequence
  Synthetic oligonucleotide
gagtggcaggttctgacgaacccca

SEQ ID NO: 699045 - DNA, 25 bp, Artificial sequence
  Synthetic oligonucleotide
cacccggagtggcaggttctgacga

SEQ ID NO: 699046 - DNA, 25 bp, Artificial sequence
  Synthetic oligonucleotide
caatggcacccggagtggcaggttc

SEQ ID NO: 699047 - DNA, 25 bp, Artificial sequence
  Synthetic oligonucleotide
ggtgtgcaatggcacccggagtggc

SEQ ID NO: 699048 - DNA, 25 bp, Artificial sequence
  Synthetic oligonucleotide
tcggtaaggcctgcagcaagagggc

SEQ ID NO: 699049 - DNA, 25 bp, Artificial sequence
  Synthetic oligonucleotide
aggacatgtacgactggtgcgaggc

SEQ ID NO: 699050 - DNA, 25 bp, Artificial sequence
  Synthetic oligonucleotide
aaggcaccgcgcagatggagatcaa

SEQ ID NO: 699051 - DNA, 25 bp, Artificial sequence
  Synthetic oligonucleotide
cacgaggaaggcaccgcgcagatgg

SEQ ID NO: 699052 - DNA, 25 bp, Artificial sequence
  Synthetic oligonucleotide
tgatccacgaggaaggcaccgcgca

SEQ ID NO: 699053 - DNA, 25 bp, Artificial sequence
  Synthetic oligonucleotide
atacgctgatccacgaggaaggcac

SEQ ID NO: 699054 - DNA, 25 bp, Artificial sequence
  Synthetic oligonucleotide
acctggatacgctgatccacgagga

SEQ ID NO: 699055 - DNA, 25 bp, Artificial sequence
  Synthetic oligonucleotide
gccttgacctggatacgctgatcca

SEQ ID NO: 699056 - DNA, 25 bp, Artificial sequence
  Synthetic oligonucleotide
cccagggccttgacctggatacgct

SEQ ID NO: 699057 - DNA, 25 bp, Artificial sequence
  Synthetic oligonucleotide
gcgaggcccagggccttgacctgga

SEQ ID NO: 699058 - DNA, 25 bp, Artificial sequence
  Synthetic oligonucleotide
atcgatatggtctgccgcccggacg

SEQ ID NO: 699059 - DNA, 25 bp, Artificial sequence
  Synthetic oligonucleotide
tgtacgactggtgcgaggcccaggg

SEQ ID NO: 699060 - DNA, 25 bp, Artificial sequence
  Synthetic oligonucleotide
agatcaacttccgtcatggcgacgc

SEQ ID NO: 699061 - DNA, 25 bp, Artificial sequence
  Synthetic oligonucleotide
tgttcgaggacatgtacgactggtg

SEQ ID NO: 699062 - DNA, 25 bp, Artificial sequence
  Synthetic oligonucleotide
acccgctgttcgaggacatgtacga

SEQ ID NO: 699063 - DNA, 25 bp, Artificial sequence
  Synthetic oligonucleotide
agttcgacccgctgttcgaggacat

SEQ ID NO: 699064 - DNA, 25 bp, Artificial sequence
  Synthetic oligonucleotide
ccaacgagttcgacccgctgttcga

SEQ ID NO: 699065 - DNA, 25 bp, Artificial sequence
  Synthetic oligonucleotide
acgccgccaacgagttcgacccgct

SEQ ID NO: 699066 - DNA, 25 bp, Artificial sequence
  Synthetic oligonucleotide
ccatcgacgccgccaacgagttcga

SEQ ID NO: 699067 - DNA, 25 bp, Artificial sequence
  Synthetic oligonucleotide
tcgttctccatcgacgccgccaacg

SEQ ID NO: 699068 - DNA, 25 bp, Artificial sequence
  Synthetic oligonucleotide
cgtcagtcgttctccatcgacgccg

SEQ ID NO: 699069 - DNA, 25 bp, Artificial sequence
  Synthetic oligonucleotide
actggtgcgaggcccagggccttga

SEQ ID NO: 699070 - DNA, 25 bp, Artificial sequence
  Synthetic oligonucleotide
gtgttcaagcgcaccatgcgcgagg

SEQ ID NO: 699071 - DNA, 25 bp, Artificial sequence
  Synthetic oligonucleotide
gccaagccgatgaccggcgagccgg

SEQ ID NO: 699072 - DNA, 25 bp, Artificial sequence
  Synthetic oligonucleotide
ttcatggccaagccgatgaccggcg

SEQ ID NO: 699073 - DNA, 25 bp, Artificial sequence
  Synthetic oligonucleotide
gcgaccttcatggccaagccgatga

SEQ ID NO: 699074 - DNA, 25 bp, Artificial sequence
  Synthetic oligonucleotide
gtcgccgcgaccttcatggccaagc

SEQ ID NO: 699075 - DNA, 25 bp, Artificial sequence
  Synthetic oligonucleotide
cacaacgtcgccgcgaccttcatgg

SEQ ID NO: 699076 - DNA, 25 bp, Artificial sequence
  Synthetic oligonucleotide
ctcaagcacaacgtcgccgcgacct

SEQ ID NO: 699077 - DNA, 25 bp, Artificial sequence
  Synthetic oligonucleotide
gccgcgctcaagcacaacgtcgccg

SEQ ID NO: 699078 - DNA, 25 bp, Artificial sequence
  Synthetic oligonucleotide
cgcgaggccgcgctcaagcacaacg

SEQ ID NO: 699079 - DNA, 25 bp, Artificial sequence
  Synthetic oligonucleotide
ccgcgcagatggagatcaacttccg

SEQ ID NO: 699080 - DNA, 25 bp, Artificial sequence
  Synthetic oligonucleotide
caagcgcaccatgcgcgaggccgcg

SEQ ID NO: 699081 - DNA, 25 bp, Artificial sequence
  Synthetic oligonucleotide
agatggagatcaacttccgtcatgg

SEQ ID NO: 699082 - DNA, 25 bp, Artificial sequence
  Synthetic oligonucleotide
tcctggtgttcaagcgcaccatgcg

SEQ ID NO: 699083 - DNA, 25 bp, Artificial sequence
  Synthetic oligonucleotide
accagatcctggtgttcaagcgcac

SEQ ID NO: 699084 - DNA, 25 bp, Artificial sequence
  Synthetic oligonucleotide
ggccgaccagatcctggtgttcaag

SEQ ID NO: 699085 - DNA, 25 bp, Artificial sequence
  Synthetic oligonucleotide
cgacctggccgaccagatcctggtg

SEQ ID NO: 699086 - DNA, 25 bp, Artificial sequence
  Synthetic oligonucleotide
cgccctcgacctggccgaccagatc

SEQ ID NO: 699087 - DNA, 25 bp, Artificial sequence
  Synthetic oligonucleotide
tggcgacgccctcgacctggccgac

SEQ ID NO: 699088 - DNA, 25 bp, Artificial sequence
  Synthetic oligonucleotide
ccgtcatggcgacgccctcgacctg

SEQ ID NO: 699089 - DNA, 25 bp, Artificial sequence
  Synthetic oligonucleotide
aacttccgtcatggcgacgccctcg

SEQ ID NO: 699090 - DNA, 25 bp, Artificial sequence
  Synthetic oligonucleotide
cggacgccaggaaaccgggcgtcag

SEQ ID NO: 699091 - DNA, 25 bp, Artificial sequence
  Synthetic oligonucleotide
caccatgcgcgaggccgcgctcaag

SEQ ID NO: 699092 - DNA, 25 bp, Artificial sequence
  Synthetic oligonucleotide
tggtgatccacgacaccttcgacaa

SEQ ID NO: 699093 - DNA, 25 bp, Artificial sequence
  Synthetic oligonucleotide
accgggcgtcagtcgttctccatcg

SEQ ID NO: 699094 - DNA, 25 bp, Artificial sequence
  Synthetic oligonucleotide
cgcgcaacatcctcaagcgcgtgtt

SEQ ID NO: 699095 - DNA, 25 bp, Artificial sequence
  Synthetic oligonucleotide
tgtcgccgcgcaacatcctcaagcg

SEQ ID NO: 699096 - DNA, 25 bp, Artificial sequence
  Synthetic oligonucleotide
tcgagctgtcgccgcgcaacatcct

SEQ ID NO: 699097 - DNA, 25 bp, Artificial sequence
  Synthetic oligonucleotide
atcccatcgagctgtcgccgcgcaa

SEQ ID NO: 699098 - DNA, 25 bp, Artificial sequence
  Synthetic oligonucleotide
tcggcaatcccatcgagctgtcgcc

SEQ ID NO: 699099 - DNA, 25 bp, Artificial sequence
  Synthetic oligonucleotide
acaagctcggcaatcccatcgagct

SEQ ID NO: 699100 - DNA, 25 bp, Artificial sequence
  Synthetic oligonucleotide
cttcgacaagctcggcaatcccatc

SEQ ID NO: 699101 - DNA, 25 bp, Artificial sequence
  Synthetic oligonucleotide
tcaagcgcgtgttgaagatgtatgc

SEQ ID NO: 699102 - DNA, 25 bp, Artificial sequence
  Synthetic oligonucleotide
tccacgacaccttcgacaagctcgg

SEQ ID NO: 699103 - DNA, 25 bp, Artificial sequence
  Synthetic oligonucleotide
gcgtgttgaagatgtatgccgacaa

SEQ ID NO: 699104 - DNA, 25 bp, Artificial sequence
  Synthetic oligonucleotide
ccgcgatggtgatccacgacacctt

SEQ ID NO: 699105 - DNA, 25 bp, Artificial sequence
  Synthetic oligonucleotide
agcccaccgcgatggtgatccacga

SEQ ID NO: 699106 - DNA, 25 bp, Artificial sequence
  Synthetic oligonucleotide
catcgagcccaccgcgatggtgatc

SEQ ID NO: 699107 - DNA, 25 bp, Artificial sequence
  Synthetic oligonucleotide
ctgggccatcgagcccaccgcgatg

SEQ ID NO: 699108 - DNA, 25 bp, Artificial sequence
  Synthetic oligonucleotide
cgtcccctgggccatcgagcccacc

SEQ ID NO: 699109 - DNA, 25 bp, Artificial sequence
  Synthetic oligonucleotide
ttcctcgtcccctgggccatcgagc

SEQ ID NO: 699110 - DNA, 25 bp, Artificial sequence
  Synthetic oligonucleotide
gccgtgttcctcgtcccctgggcca

SEQ ID NO: 699111 - DNA, 25 bp, Artificial sequence
  Synthetic oligonucleotide
gagaatgccgtgttcctcgtcccct

SEQ ID NO: 699112 - DNA, 25 bp, Artificial sequence
  Synthetic oligonucleotide
ccggacgagaatgccgtgttcctcg

SEQ ID NO: 699113 - DNA, 25 bp, Artificial sequence
  Synthetic oligonucleotide
gacaccttcgacaagctcggcaatc

SEQ ID NO: 699114 - DNA, 25 bp, Artificial sequence
  Synthetic oligonucleotide
tctacctgaccaagcgcagcgacga

SEQ ID NO: 699115 - DNA, 25 bp, Artificial sequence
  Synthetic oligonucleotide
tccgccactattgggcgaccaaggg

SEQ ID NO: 699116 - DNA, 25 bp, Artificial sequence
  Synthetic oligonucleotide
tgggccgctccggacgccaggaaac

SEQ ID NO: 699117 - DNA, 25 bp, Artificial sequence
  Synthetic oligonucleotide
cccggtgggccgctccggacgccag

SEQ ID NO: 699118 - DNA, 25 bp, Artificial sequence
  Synthetic oligonucleotide
gcaggccccggtgggccgctccgga

SEQ ID NO: 699119 - DNA, 25 bp, Artificial sequence
  Synthetic oligonucleotide
ccgttgcaggccccggtgggccgct

SEQ ID NO: 699120 - DNA, 25 bp, Artificial sequence
  Synthetic oligonucleotide
actatccgttgcaggccccggtggg

SEQ ID NO: 699121 - DNA, 25 bp, Artificial sequence
  Synthetic oligonucleotide
gaccccgactatccgttgcaggccc

SEQ ID NO: 699122 - DNA, 25 bp, Artificial sequence
  Synthetic oligonucleotide
gcgacgaccccgactatccgttgca

SEQ ID NO: 699123 - DNA, 25 bp, Artificial sequence
  Synthetic oligonucleotide
acatcctcaagcgcgtgttgaagat

SEQ ID NO: 699124 - DNA, 25 bp, Artificial sequence
  Synthetic oligonucleotide
tgaccaagcgcagcgacgaccccga

SEQ ID NO: 699125 - DNA, 25 bp, Artificial sequence
  Synthetic oligonucleotide
caggaaaccgggcgtcagtcgttct

SEQ ID NO: 699126 - DNA, 25 bp, Artificial sequence
  Synthetic oligonucleotide
tggagttctacctgaccaagcgcag

SEQ ID NO: 699127 - DNA, 25 bp, Artificial sequence
  Synthetic oligonucleotide
cagagatggagttctacctgaccaa

SEQ ID NO: 699128 - DNA, 25 bp, Artificial sequence
  Synthetic oligonucleotide
tggcgccagagatggagttctacct

SEQ ID NO: 699129 - DNA, 25 bp, Artificial sequence
  Synthetic oligonucleotide
cgatcgtggcgccagagatggagtt

SEQ ID NO: 699130 - DNA, 25 bp, Artificial sequence
  Synthetic oligonucleotide
tggcggccgatcgtggcgccagaga

SEQ ID NO: 699131 - DNA, 25 bp, Artificial sequence
  Synthetic oligonucleotide
aagggctggcggccgatcgtggcgc

SEQ ID NO: 699132 - DNA, 25 bp, Artificial sequence
  Synthetic oligonucleotide
gccgacaagggctggcggccgatcg

SEQ ID NO: 699133 - DNA, 25 bp, Artificial sequence
  Synthetic oligonucleotide
atgtatgccgacaagggctggcggc

SEQ ID NO: 699134 - DNA, 25 bp, Artificial sequence
  Synthetic oligonucleotide
ttgaagatgtatgccgacaagggct

SEQ ID NO: 699135 - DNA, 25 bp, Artificial sequence
  Synthetic oligonucleotide
agcgcagcgacgaccccgactatcc

SEQ ID NO: 699136 - DNA, 25 bp, Artificial sequence
  Synthetic oligonucleotide
aacggcctgctaaacagcgtactga

SEQ ID NO: 699137 - DNA, 25 bp, Artificial sequence
  Synthetic oligonucleotide
tcgcctacgcggaccagcagttgca

SEQ ID NO: 699138 - DNA, 25 bp, Artificial sequence
  Synthetic oligonucleotide
tcctgctgctgctgatcatgatgcc

SEQ ID NO: 699139 - DNA, 25 bp, Artificial sequence
  Synthetic oligonucleotide
gctgctgatcatgatgccgacctgg

SEQ ID NO: 699140 - DNA, 25 bp, Artificial sequence
  Synthetic oligonucleotide
gatcatgatgccgacctggacggcg

SEQ ID NO: 699141 - DNA, 25 bp, Artificial sequence
  Synthetic oligonucleotide
gatgccgacctggacggcgatcctg

SEQ ID NO: 699142 - DNA, 25 bp, Artificial sequence
  Synthetic oligonucleotide
gacctggacggcgatcctgatccgg

SEQ ID NO: 699143 - DNA, 25 bp, Artificial sequence
  Synthetic oligonucleotide
gacggcgatcctgatccgggtctat

SEQ ID NO: 699144 - DNA, 25 bp, Artificial sequence
  Synthetic oligonucleotide
gatcctgatccgggtctatgcctgg

SEQ ID NO: 699145 - DNA, 25 bp, Artificial sequence
  Synthetic oligonucleotide
gatccgggtctatgcctggatgggc

SEQ ID NO: 699146 - DNA, 25 bp, Artificial sequence
  Synthetic oligonucleotide
ggtctatgcctggatgggcatcctt

SEQ ID NO: 699147 - DNA, 25 bp, Artificial sequence
  Synthetic oligonucleotide
gcctggatgggcatcctttccaaca

SEQ ID NO: 699148 - DNA, 25 bp, Artificial sequence
  Synthetic oligonucleotide
atgggcatcctttccaacaacggcc

SEQ ID NO: 699149 - DNA, 25 bp, Artificial sequence
  Synthetic oligonucleotide
tcctcgcagaccgtcctgctgctgc

SEQ ID NO: 699150 - DNA, 25 bp, Artificial sequence
  Synthetic oligonucleotide
tccaacaacggcctgctaaacagcg

SEQ ID NO: 699151 - DNA, 25 bp, Artificial sequence
  Synthetic oligonucleotide
agccagtcctcgcagaccgtcctgc

SEQ ID NO: 699152 - DNA, 25 bp, Artificial sequence
  Synthetic oligonucleotide
ctgctaaacagcgtactgatggggc

SEQ ID NO: 699153 - DNA, 25 bp, Artificial sequence
  Synthetic oligonucleotide
aaacagcgtactgatggggctgggg

SEQ ID NO: 699154 - DNA, 25 bp, Artificial sequence
  Synthetic oligonucleotide
gtactgatggggctggggctcatca

SEQ ID NO: 699155 - DNA, 25 bp, Artificial sequence
  Synthetic oligonucleotide
atggggctggggctcatcagcgagc

SEQ ID NO: 699156 - DNA, 25 bp, Artificial sequence
  Synthetic oligonucleotide
ctggggctcatcagcgagccgctga

SEQ ID NO: 699157 - DNA, 25 bp, Artificial sequence
  Synthetic oligonucleotide
gctcatcagcgagccgctgaccatc

SEQ ID NO: 699158 - DNA, 25 bp, Artificial sequence
  Synthetic oligonucleotide
agcgagccgctgaccatcctcaata

SEQ ID NO: 699159 - DNA, 25 bp, Artificial sequence
  Synthetic oligonucleotide
ccgctgaccatcctcaataccaaca

SEQ ID NO: 699160 - DNA, 25 bp, Artificial sequence
  Synthetic oligonucleotide
accatcctcaataccaacatcgcgg

SEQ ID NO: 699161 - DNA, 25 bp, Artificial sequence
  Synthetic oligonucleotide
ctcaataccaacatcgcggtgtaca

SEQ ID NO: 699162 - DNA, 25 bp, Artificial sequence
  Synthetic oligonucleotide
accaacatcgcggtgtacatcggca

SEQ ID NO: 699163 - DNA, 25 bp, Artificial sequence
  Synthetic oligonucleotide
atcgcggtgtacatcggcatcgtct

SEQ ID NO: 699164 - DNA, 25 bp, Artificial sequence
  Synthetic oligonucleotide
gtgtacatcggcatcgtctattcct

SEQ ID NO: 699165 - DNA, 25 bp, Artificial sequence
  Synthetic oligonucleotide
atcctttccaacaacggcctgctaa

SEQ ID NO: 699166 - DNA, 25 bp, Artificial sequence
  Synthetic oligonucleotide
ctcggctcgctgaagatggccttca

SEQ ID NO: 699167 - DNA, 25 bp, Artificial sequence
  Synthetic oligonucleotide
acgcggaccagcagttgcaggtgct

SEQ ID NO: 699168 - DNA, 25 bp, Artificial sequence
  Synthetic oligonucleotide
accagcagttgcaggtgctcctcaa

SEQ ID NO: 699169 - DNA, 25 bp, Artificial sequence
  Synthetic oligonucleotide
cagttgcaggtgctcctcaacctcg

SEQ ID NO: 699170 - DNA, 25 bp, Artificial sequence
  Synthetic oligonucleotide
aggtgctcctcaacctcggcaacta

SEQ ID NO: 699171 - DNA, 25 bp, Artificial sequence
  Synthetic oligonucleotide
cctcaacctcggcaactacctgatg

SEQ ID NO: 699172 - DNA, 25 bp, Artificial sequence
  Synthetic oligonucleotide
acctcggcaactacctgatgctgac

SEQ ID NO: 699173 - DNA, 25 bp, Artificial sequence
  Synthetic oligonucleotide
gcaactacctgatgctgaccgatga

SEQ ID NO: 699174 - DNA, 25 bp, Artificial sequence
  Synthetic oligonucleotide
acctgatgctgaccgatgacccgct

SEQ ID NO: 699175 - DNA, 25 bp, Artificial sequence
  Synthetic oligonucleotide
tgctgaccgatgacccgctctacat

SEQ ID NO: 699176 - DNA, 25 bp, Artificial sequence
  Synthetic oligonucleotide
accgatgacccgctctacatcgatg

SEQ ID NO: 699177 - DNA, 25 bp, Artificial sequence
  Synthetic oligonucleotide
gacccgctctacatcgatgcctacc

SEQ ID NO: 699178 - DNA, 25 bp, Artificial sequence
  Synthetic oligonucleotide
ctctacatcgatgcctacctcggct

SEQ ID NO: 699179 - DNA, 25 bp, Artificial sequence
  Synthetic oligonucleotide
cagaccgtcctgctgctgctgatca

SEQ ID NO: 699180 - DNA, 25 bp, Artificial sequence
  Synthetic oligonucleotide
gcctacctcggctcgctgaagatgg

SEQ ID NO: 699181 - DNA, 25 bp, Artificial sequence
  Synthetic oligonucleotide
tattcctacctgccgttcatgatcc

SEQ ID NO: 699182 - DNA, 25 bp, Artificial sequence
  Synthetic oligonucleotide
tcgctgaagatggccttcatcagta

SEQ ID NO: 699183 - DNA, 25 bp, Artificial sequence
  Synthetic oligonucleotide
aagatggccttcatcagtaccctga

SEQ ID NO: 699184 - DNA, 25 bp, Artificial sequence
  Synthetic oligonucleotide
ggccttcatcagtaccctgatctgc

SEQ ID NO: 699185 - DNA, 25 bp, Artificial sequence
  Synthetic oligonucleotide
atcagtaccctgatctgcctgctgg

SEQ ID NO: 699186 - DNA, 25 bp, Artificial sequence
  Synthetic oligonucleotide
accctgatctgcctgctggtgggct

SEQ ID NO: 699187 - DNA, 25 bp, Artificial sequence
  Synthetic oligonucleotide
tctgcctgctggtgggctacccgat

SEQ ID NO: 699188 - DNA, 25 bp, Artificial sequence
  Synthetic oligonucleotide
tgctggtgggctacccgatggccta

SEQ ID NO: 699189 - DNA, 25 bp, Artificial sequence
  Synthetic oligonucleotide
tgggctacccgatggcctacgccat

SEQ ID NO: 699190 - DNA, 25 bp, Artificial sequence
  Synthetic oligonucleotide
acccgatggcctacgccatcgcccg

SEQ ID NO: 699191 - DNA, 25 bp, Artificial sequence
  Synthetic oligonucleotide
tggcctacgccatcgcccgctccag

SEQ ID NO: 699192 - DNA, 25 bp, Artificial sequence
  Synthetic oligonucleotide
tacgccatcgcccgctccagccagt

SEQ ID NO: 699193 - DNA, 25 bp, Artificial sequence
  Synthetic oligonucleotide
atcgcccgctccagccagtcctcgc

SEQ ID NO: 699194 - DNA, 25 bp, Artificial sequence
  Synthetic oligonucleotide
cgctccagccagtcctcgcagaccg

SEQ ID NO: 699195 - DNA, 25 bp, Artificial sequence
  Synthetic oligonucleotide
atcgatgcctacctcggctcgctga

SEQ ID NO: 699196 - DNA, 25 bp, Artificial sequence
  Synthetic oligonucleotide
cgtccgccctggcggtggtgatgct

SEQ ID NO: 699197 - DNA, 25 bp, Artificial sequence
  Synthetic oligonucleotide
ccggaactgctcggcggccccgaga

SEQ ID NO: 699198 - DNA, 25 bp, Artificial sequence
  Synthetic oligonucleotide
ctgctcggcggccccgagaccctga

SEQ ID NO: 699199 - DNA, 25 bp, Artificial sequence
  Synthetic oligonucleotide
ggcggccccgagaccctgatgatcg

SEQ ID NO: 699200 - DNA, 25 bp, Artificial sequence
  Synthetic oligonucleotide
cccgagaccctgatgatcggcaagg

SEQ ID NO: 699201 - DNA, 25 bp, Artificial sequence
  Synthetic oligonucleotide
gaccctgatgatcggcaaggtgctc

SEQ ID NO: 699202 - DNA, 25 bp, Artificial sequence
  Synthetic oligonucleotide
gatgatcggcaaggtgctctggcag

SEQ ID NO: 699203 - DNA, 25 bp, Artificial sequence
  Synthetic oligonucleotide
cggcaaggtgctctggcaggagttc

SEQ ID NO: 699204 - DNA, 25 bp, Artificial sequence
  Synthetic oligonucleotide
ggtgctctggcaggagttcttcaac

SEQ ID NO: 699205 - DNA, 25 bp, Artificial sequence
  Synthetic oligonucleotide
ctggcaggagttcttcaacaaccgc

SEQ ID NO: 699206 - DNA, 25 bp, Artificial sequence
  Synthetic oligonucleotide
ggagttcttcaacaaccgcgactgg

SEQ ID NO: 699207 - DNA, 25 bp, Artificial sequence
  Synthetic oligonucleotide
ttcaacaaccgcgactggccggtgg

SEQ ID NO: 699208 - DNA, 25 bp, Artificial sequence
  Synthetic oligonucleotide
aaccgcgactggccggtggcgtccg

SEQ ID NO: 699209 - DNA, 25 bp, Artificial sequence
  Synthetic oligonucleotide
atcggcatcgtctattcctacctgc

SEQ ID NO: 699210 - DNA, 25 bp, Artificial sequence
  Synthetic oligonucleotide
cggtggcgtccgccctggcggtggt

SEQ ID NO: 699211 - DNA, 25 bp, Artificial sequence
  Synthetic oligonucleotide
gtgggcgagttcgtcatcccggaac

SEQ ID NO: 699212 - DNA, 25 bp, Artificial sequence
  Synthetic oligonucleotide
ccctggcggtggtgatgctggcgat

SEQ ID NO: 699213 - DNA, 25 bp, Artificial sequence
  Synthetic oligonucleotide
cggtggtgatgctggcgatcctgat

SEQ ID NO: 699214 - DNA, 25 bp, Artificial sequence
  Synthetic oligonucleotide
tgatgctggcgatcctgatcatccc

SEQ ID NO: 699215 - DNA, 25 bp, Artificial sequence
  Synthetic oligonucleotide
tggcgatcctgatcatcccgatcat

SEQ ID NO: 699216 - DNA, 25 bp, Artificial sequence
  Synthetic oligonucleotide
tcctgatcatcccgatcatcctgtt

SEQ ID NO: 699217 - DNA, 25 bp, Artificial sequence
  Synthetic oligonucleotide
tcatcccgatcatcctgttcaacaa

SEQ ID NO: 699218 - DNA, 25 bp, Artificial sequence
  Synthetic oligonucleotide
ccgatcatcctgttcaacaagaacc

SEQ ID NO: 699219 - DNA, 25 bp, Artificial sequence
  Synthetic oligonucleotide
atcctgttcaacaagaaccaggcca

SEQ ID NO: 699220 - DNA, 25 bp, Artificial sequence
  Synthetic oligonucleotide
ttcaacaagaaccaggccaaagaac

SEQ ID NO: 699221 - DNA, 25 bp, Artificial sequence
  Synthetic oligonucleotide
aagaaccaggccaaagaactggagg

SEQ ID NO: 699222 - DNA, 25 bp, Artificial sequence
  Synthetic oligonucleotide
ccaggccaaagaactggagggcaag

SEQ ID NO: 699223 - DNA, 25 bp, Artificial sequence
  Synthetic oligonucleotide
caaagaactggagggcaaggtatga

SEQ ID NO: 699224 - DNA, 25 bp, Artificial sequence
  Synthetic oligonucleotide
ctggaactggtggagatcatcgagc

SEQ ID NO: 699225 - DNA, 25 bp, Artificial sequence
  Synthetic oligonucleotide
gactggccggtggcgtccgccctgg

SEQ ID NO: 699226 - DNA, 25 bp, Artificial sequence
  Synthetic oligonucleotide
accagcttctggaagatcaccgtgc

SEQ ID NO: 699227 - DNA, 25 bp, Artificial sequence
  Synthetic oligonucleotide
ccaacctggtgaagcacgacccgag

SEQ ID NO: 699228 - DNA, 25 bp, Artificial sequence
  Synthetic oligonucleotide
tacctgccgttcatgatcctgccgc

SEQ ID NO: 699229 - DNA, 25 bp, Artificial sequence
  Synthetic oligonucleotide
ccgttcatgatcctgccgctctacg

SEQ ID NO: 699230 - DNA, 25 bp, Artificial sequence
  Synthetic oligonucleotide
atgatcctgccgctctacgccaacc

SEQ ID NO: 699231 - DNA, 25 bp, Artificial sequence
  Synthetic oligonucleotide
tgccgctctacgccaacctggtgaa

SEQ ID NO: 699232 - DNA, 25 bp, Artificial sequence
  Synthetic oligonucleotide
tctacgccaacctggtgaagcacga

SEQ ID NO: 699233 - DNA, 25 bp, Artificial sequence
  Synthetic oligonucleotide
tggtgaagcacgacccgagcctgct

SEQ ID NO: 699234 - DNA, 25 bp, Artificial sequence
  Synthetic oligonucleotide
gacccgagcctgctggaggccgctt

SEQ ID NO: 699235 - DNA, 25 bp, Artificial sequence
  Synthetic oligonucleotide
gagcctgctggaggccgcttccgac

SEQ ID NO: 699236 - DNA, 25 bp, Artificial sequence
  Synthetic oligonucleotide
gctggaggccgcttccgacctgggc

SEQ ID NO: 699237 - DNA, 25 bp, Artificial sequence
  Synthetic oligonucleotide
ggccgcttccgacctgggcgcgcgt

SEQ ID NO: 699238 - DNA, 25 bp, Artificial sequence
  Synthetic oligonucleotide
ttccgacctgggcgcgcgtaacttc

SEQ ID NO: 699239 - DNA, 25 bp, Artificial sequence
  Synthetic oligonucleotide
ctgggcgcgcgtaacttcaccagct

SEQ ID NO: 699240 - DNA, 25 bp, Artificial sequence
  Synthetic oligonucleotide
gtcatcccggaactgctcggcggcc

SEQ ID NO: 699241 - DNA, 25 bp, Artificial sequence
  Synthetic oligonucleotide
gaacggcatcatcgccggctgcatg

SEQ ID NO: 699242 - DNA, 25 bp, Artificial sequence
  Synthetic oligonucleotide
atcgtctattcctacctgccgttca

SEQ ID NO: 699243 - DNA, 25 bp, Artificial sequence
  Synthetic oligonucleotide
ccggcggtgggcgagttcgtcatcc

SEQ ID NO: 699244 - DNA, 25 bp, Artificial sequence
  Synthetic oligonucleotide
ttcatcccggcggtgggcgagttcg

SEQ ID NO: 699245 - DNA, 25 bp, Artificial sequence
  Synthetic oligonucleotide
gctggtgttcatcccggcggtgggc

SEQ ID NO: 699246 - DNA, 25 bp, Artificial sequence
  Synthetic oligonucleotide
ctgcatgctggtgttcatcccggcg

SEQ ID NO: 699247 - DNA, 25 bp, Artificial sequence
  Synthetic oligonucleotide
gcgcgtaacttcaccagcttctgga

SEQ ID NO: 699248 - DNA, 25 bp, Artificial sequence
  Synthetic oligonucleotide
catcatcgccggctgcatgctggtg

SEQ ID NO: 699249 - DNA, 25 bp, Artificial sequence
  Synthetic oligonucleotide
aacttcaccagcttctggaagatca

SEQ ID NO: 699250 - DNA, 25 bp, Artificial sequence
  Synthetic oligonucleotide
tcgaagaacggcatcatcgccggct

SEQ ID NO: 699251 - DNA, 25 bp, Artificial sequence
  Synthetic oligonucleotide
ccgctgtcgaagaacggcatcatcg

SEQ ID NO: 699252 - DNA, 25 bp, Artificial sequence
  Synthetic oligonucleotide
accgtgccgctgtcgaagaacggca

SEQ ID NO: 699253 - DNA, 25 bp, Artificial sequence
  Synthetic oligonucleotide
aagatcaccgtgccgctgtcgaaga

SEQ ID NO: 699254 - DNA, 25 bp, Artificial sequence
  Synthetic oligonucleotide
ttctggaagatcaccgtgccgctgt

SEQ ID NO: 699255 - DNA, 25 bp, Artificial sequence
  Synthetic oligonucleotide
gagttcgtcatcccggaactgctcg

SEQ ID NO: 699256 - DNA, 25 bp, Artificial sequence
  Synthetic oligonucleotide
cgccggctgcatgctggtgttcatc

SEQ ID NO: 699257 - DNA, 25 bp, Artificial sequence
  Synthetic oligonucleotide
acccgcgccgaggacaagcgcatca

SEQ ID NO: 699258 - DNA, 25 bp, Artificial sequence
  Synthetic oligonucleotide
gtgctggtggaggacgtgcaggacc

SEQ ID NO: 699259 - DNA, 25 bp, Artificial sequence
  Synthetic oligonucleotide
gtggaggacgtgcaggaccatgcgg

SEQ ID NO: 699260 - DNA, 25 bp, Artificial sequence
  Synthetic oligonucleotide
gacgtgcaggaccatgcggtgatcg

SEQ ID NO: 699261 - DNA, 25 bp, Artificial sequence
  Synthetic oligonucleotide
caggaccatgcggtgatcgcctgcc

SEQ ID NO: 699262 - DNA, 25 bp, Artificial sequence
  Synthetic oligonucleotide
atgcggtgatcgcctgcccgcagct

SEQ ID NO: 699263 - DNA, 25 bp, Artificial sequence
  Synthetic oligonucleotide
tgatcgcctgcccgcagctggagaa

SEQ ID NO: 699264 - DNA, 25 bp, Artificial sequence
  Synthetic oligonucleotide
cctgcccgcagctggagaacccgat

SEQ ID NO: 699265 - DNA, 25 bp, Artificial sequence
  Synthetic oligonucleotide
cgcagctggagaacccgatctacat

SEQ ID NO: 699266 - DNA, 25 bp, Artificial sequence
  Synthetic oligonucleotide
tggagaacccgatctacatcggcca

SEQ ID NO: 699267 - DNA, 25 bp, Artificial sequence
  Synthetic oligonucleotide
acccgatctacatcggccacggcat

SEQ ID NO: 699268 - DNA, 25 bp, Artificial sequence
  Synthetic oligonucleotide
atctacatcggccacggcatcagca

SEQ ID NO: 699269 - DNA, 25 bp, Artificial sequence
  Synthetic oligonucleotide
atcggccacggcatcagcacccgcg

SEQ ID NO: 699270 - DNA, 25 bp, Artificial sequence
  Synthetic oligonucleotide
acgccgggcacaactgggcccaggg

SEQ ID NO: 699271 - DNA, 25 bp, Artificial sequence
  Synthetic oligonucleotide
atcagcacccgcgccgaggacaagc

SEQ ID NO: 699272 - DNA, 25 bp, Artificial sequence
  Synthetic oligonucleotide
ggcaacgtcaacctgttcgacggcg

SEQ ID NO: 699273 - DNA, 25 bp, Artificial sequence
  Synthetic oligonucleotide
ccgaggacaagcgcatcacctacgc

SEQ ID NO: 699274 - DNA, 25 bp, Artificial sequence
  Synthetic oligonucleotide
acaagcgcatcacctacgcgctgcg

SEQ ID NO: 699275 - DNA, 25 bp, Artificial sequence
  Synthetic oligonucleotide
gcatcacctacgcgctgcggccgga

SEQ ID NO: 699276 - DNA, 25 bp, Artificial sequence
  Synthetic oligonucleotide
cctacgcgctgcggccggagaaagt

SEQ ID NO: 699277 - DNA, 25 bp, Artificial sequence
  Synthetic oligonucleotide
cgctgcggccggagaaagtgatgat

SEQ ID NO: 699278 - DNA, 25 bp, Artificial sequence
  Synthetic oligonucleotide
ggccggagaaagtgatgatcagcgc

SEQ ID NO: 699279 - DNA, 25 bp, Artificial sequence
  Synthetic oligonucleotide
agaaagtgatgatcagcgcgcagaa

SEQ ID NO: 699280 - DNA, 25 bp, Artificial sequence
  Synthetic oligonucleotide
tgatgatcagcgcgcagaagccgga

SEQ ID NO: 699281 - DNA, 25 bp, Artificial sequence
  Synthetic oligonucleotide
tcagcgcgcagaagccggacaacct

SEQ ID NO: 699282 - DNA, 25 bp, Artificial sequence
  Synthetic oligonucleotide
cgcagaagccggacaacctggaaca

SEQ ID NO: 699283 - DNA, 25 bp, Artificial sequence
  Synthetic oligonucleotide
agccggacaacctggaacacgccgg

SEQ ID NO: 699284 - DNA, 25 bp, Artificial sequence
  Synthetic oligonucleotide
acaacctggaacacgccgggcacaa

SEQ ID NO: 699285 - DNA, 25 bp, Artificial sequence
  Synthetic oligonucleotide
tggaacacgccgggcacaactgggc

SEQ ID NO: 699286 - DNA, 25 bp, Artificial sequence
  Synthetic oligonucleotide
cacggcatcagcacccgcgccgagg

SEQ ID NO: 699287 - DNA, 25 bp, Artificial sequence
  Synthetic oligonucleotide
tcatgcacctgggctgcatcgagca

SEQ ID NO: 699288 - DNA, 25 bp, Artificial sequence
  Synthetic oligonucleotide
atcgagcgcgtcggcgtgacctgcg

SEQ ID NO: 699289 - DNA, 25 bp, Artificial sequence
  Synthetic oligonucleotide
aagcacgacccgagcctgctggagg

SEQ ID NO: 699290 - DNA, 25 bp, Artificial sequence
  Synthetic oligonucleotide
gatcttcgcctacgcggaccagcag

SEQ ID NO: 699291 - DNA, 25 bp, Artificial sequence
  Synthetic oligonucleotide
cgcgtcggcgtgacctgcgtgatgg

SEQ ID NO: 699292 - DNA, 25 bp, Artificial sequence
  Synthetic oligonucleotide
gcgtgacctgcgtgatggtgaccca

SEQ ID NO: 699293 - DNA, 25 bp, Artificial sequence
  Synthetic oligonucleotide
cctgcgtgatggtgacccacgacca

SEQ ID NO: 699294 - DNA, 25 bp, Artificial sequence
  Synthetic oligonucleotide
tgatggtgacccacgaccaggaaga

SEQ ID NO: 699295 - DNA, 25 bp, Artificial sequence
  Synthetic oligonucleotide
tgacccacgaccaggaagaggccat

SEQ ID NO: 699296 - DNA, 25 bp, Artificial sequence
  Synthetic oligonucleotide
acgaccaggaagaggccatgaccat

SEQ ID NO: 699297 - DNA, 25 bp, Artificial sequence
  Synthetic oligonucleotide
aggaagaggccatgaccatggccca

SEQ ID NO: 699298 - DNA, 25 bp, Artificial sequence
  Synthetic oligonucleotide
aggccatgaccatggcccagcgcat

SEQ ID NO: 699299 - DNA, 25 bp, Artificial sequence
  Synthetic oligonucleotide
tgaccatggcccagcgcatcgccat

SEQ ID NO: 699300 - DNA, 25 bp, Artificial sequence
  Synthetic oligonucleotide
tggcccagcgcatcgccatcatgca

SEQ ID NO: 699301 - DNA, 25 bp, Artificial sequence
  Synthetic oligonucleotide
gacggcgtgctggtggaggacgtgc

SEQ ID NO: 699302 - DNA, 25 bp, Artificial sequence
  Synthetic oligonucleotide
gatggacatctacgagaccccggcg

SEQ ID NO: 699303 - DNA, 25 bp, Artificial sequence
  Synthetic oligonucleotide
gtcaacctgttcgacggcgtgctgg

SEQ ID NO: 699304 - DNA, 25 bp, Artificial sequence
  Synthetic oligonucleotide
tgcgagttcatcggcaacgtcaacc

SEQ ID NO: 699305 - DNA, 25 bp, Artificial sequence
  Synthetic oligonucleotide
ctggtctgcgagttcatcggcaacg

SEQ ID NO: 699306 - DNA, 25 bp, Artificial sequence
  Synthetic oligonucleotide
agccgcctggtctgcgagttcatcg

SEQ ID NO: 699307 - DNA, 25 bp, Artificial sequence
  Synthetic oligonucleotide
ccggcgagccgcctggtctgcgagt

SEQ ID NO: 699308 - DNA, 25 bp, Artificial sequence
  Synthetic oligonucleotide
agcgcatcgccatcatgcacctggg

SEQ ID NO: 699309 - DNA, 25 bp, Artificial sequence
  Synthetic oligonucleotide
acatctacgagaccccggcgagccg

SEQ ID NO: 699310 - DNA, 25 bp, Artificial sequence
  Synthetic oligonucleotide
tcgccatcatgcacctgggctgcat

SEQ ID NO: 699311 - DNA, 25 bp, Artificial sequence
  Synthetic oligonucleotide
cagcccgatggacatctacgagacc

SEQ ID NO: 699312 - DNA, 25 bp, Artificial sequence
  Synthetic oligonucleotide
gatcggcagcccgatggacatctac

SEQ ID NO: 699313 - DNA, 25 bp, Artificial sequence
  Synthetic oligonucleotide
tcgagcagatcggcagcccgatgga

SEQ ID NO: 699314 - DNA, 25 bp, Artificial sequence
  Synthetic oligonucleotide
gctgcatcgagcagatcggcagccc

SEQ ID NO: 699315 - DNA, 25 bp, Artificial sequence
  Synthetic oligonucleotide
acctgggctgcatcgagcagatcgg

SEQ ID NO: 699316 - DNA, 25 bp, Artificial sequence
  Synthetic oligonucleotide
ctgttcgacggcgtgctggtggagg

SEQ ID NO: 699317 - DNA, 25 bp, Artificial sequence
  Synthetic oligonucleotide
cgagaccccggcgagccgcctggtc

SEQ ID NO: 699318 - DNA, 25 bp, Artificial sequence
  Synthetic oligonucleotide
cctgctgcccttcgccatcgtgctg

SEQ ID NO: 699319 - DNA, 25 bp, Artificial sequence
  Synthetic oligonucleotide
tactgcagtcatgaaattcgccaac

SEQ ID NO: 699320 - DNA, 25 bp, Artificial sequence
  Synthetic oligonucleotide
agtcatgaaattcgccaacagcctg

SEQ ID NO: 699321 - DNA, 25 bp, Artificial sequence
  Synthetic oligonucleotide
gaaattcgccaacagcctgaaaaag

SEQ ID NO: 699322 - DNA, 25 bp, Artificial sequence
  Synthetic oligonucleotide
gccaacagcctgaaaaagcgcatgc

SEQ ID NO: 699323 - DNA, 25 bp, Artificial sequence
  Synthetic oligonucleotide
agcctgaaaaagcgcatgcccaccg

SEQ ID NO: 699324 - DNA, 25 bp, Artificial sequence
  Synthetic oligonucleotide
gaaaaagcgcatgcccaccgggcgg

SEQ ID NO: 699325 - DNA, 25 bp, Artificial sequence
  Synthetic oligonucleotide
agcgcatgcccaccgggcggcatgc

SEQ ID NO: 699326 - DNA, 25 bp, Artificial sequence
  Synthetic oligonucleotide
tgcccaccgggcggcatgcggtcat

SEQ ID NO: 699327 - DNA, 25 bp, Artificial sequence
  Synthetic oligonucleotide
ccgggcggcatgcggtcatcggggt

SEQ ID NO: 699328 - DNA, 25 bp, Artificial sequence
  Synthetic oligonucleotide
ggcatgcggtcatcggggtgccgtt

SEQ ID NO: 699329 - DNA, 25 bp, Artificial sequence
  Synthetic oligonucleotide
cggtcatcggggtgccgttcctgtg

SEQ ID NO: 699330 - DNA, 25 bp, Artificial sequence
  Synthetic oligonucleotide
tgccgttcctgtggctcttcctgtt

SEQ ID NO: 699331 - DNA, 25 bp, Artificial sequence
  Synthetic oligonucleotide
tggctcttcctgttcttcctgctgc

SEQ ID NO: 699332 - DNA, 25 bp, Artificial sequence
  Synthetic oligonucleotide
gcgtggtactgcagtcatgaaattc

SEQ ID NO: 699333 - DNA, 25 bp, Artificial sequence
  Synthetic oligonucleotide
tggcggaagcggacgtggccatccc

SEQ ID NO: 699334 - DNA, 25 bp, Artificial sequence
  Synthetic oligonucleotide
taccgagatcttcgcctacgcggac

SEQ ID NO: 699335 - DNA, 25 bp, Artificial sequence
  Synthetic oligonucleotide
ccctataccgagatcttcgcctacg

SEQ ID NO: 699336 - DNA, 25 bp, Artificial sequence
  Synthetic oligonucleotide
atcccgccctataccgagatcttcg

SEQ ID NO: 699337 - DNA, 25 bp, Artificial sequence
  Synthetic oligonucleotide
ttcatcggcaacgtcaacctgttcg

SEQ ID NO: 699338 - DNA, 25 bp, Artificial sequence
  Synthetic oligonucleotide
ggcacaactgggcccagggcaccgt

SEQ ID NO: 699339 - DNA, 25 bp, Artificial sequence
  Synthetic oligonucleotide
ttcctgttcttcctgctgcccttcg

SEQ ID NO: 699340 - DNA, 25 bp, Artificial sequence
  Synthetic oligonucleotide
agcggacgtggccatcccgccctat

SEQ ID NO: 699341 - DNA, 25 bp, Artificial sequence
  Synthetic oligonucleotide
gttcttcctgctgcccttcgccatc

SEQ ID NO: 699342 - DNA, 25 bp, Artificial sequence
  Synthetic oligonucleotide
tcagcctggcggaagcggacgtggc

SEQ ID NO: 699343 - DNA, 25 bp, Artificial sequence
  Synthetic oligonucleotide
tgaagatcagcctggcggaagcgga

SEQ ID NO: 699344 - DNA, 25 bp, Artificial sequence
  Synthetic oligonucleotide
tcgtgctgaagatcagcctggcgga

SEQ ID NO: 699345 - DNA, 25 bp, Artificial sequence
  Synthetic oligonucleotide
tcgccatcgtgctgaagatcagcct

SEQ ID NO: 699346 - DNA, 25 bp, Artificial sequence
  Synthetic oligonucleotide
gcccttcgccatcgtgctgaagatc

SEQ ID NO: 699347 - DNA, 25 bp, Artificial sequence
  Synthetic oligonucleotide
tcggggtgccgttcctgtggctctt

SEQ ID NO: 699348 - DNA, 25 bp, Artificial sequence
  Synthetic oligonucleotide
gtggccatcccgccctataccgaga

SEQ ID NO: 699349 - DNA, 25 bp, Artificial sequence
  Synthetic oligonucleotide
cctaccttggcggccactcggtgta

SEQ ID NO: 699350 - DNA, 25 bp, Artificial sequence
  Synthetic oligonucleotide
tgatcgtccaggccttcatggccaa

SEQ ID NO: 699351 - DNA, 25 bp, Artificial sequence
  Synthetic oligonucleotide
ccgggatgatcgtccaggccttcat

SEQ ID NO: 699352 - DNA, 25 bp, Artificial sequence
  Synthetic oligonucleotide
tggcgtccgggatgatcgtccaggc

SEQ ID NO: 699353 - DNA, 25 bp, Artificial sequence
  Synthetic oligonucleotide
acatcgcctaccttggcggccactc

SEQ ID NO: 699354 - DNA, 25 bp, Artificial sequence
  Synthetic oligonucleotide
actacatcaagctggcgtccgggat

SEQ ID NO: 699355 - DNA, 25 bp, Artificial sequence
  Synthetic oligonucleotide
tccaggccttcatggccaacgccga

SEQ ID NO: 699356 - DNA, 25 bp, Artificial sequence
  Synthetic oligonucleotide
ttggcggccactcggtgtactacat

SEQ ID NO: 699357 - DNA, 25 bp, Artificial sequence
  Synthetic oligonucleotide
tcaagctggcgtccgggatgatcgt

SEQ ID NO: 699358 - DNA, 25 bp, Artificial sequence
  Synthetic oligonucleotide
actgggcccagggcaccgtctacga

SEQ ID NO: 699359 - DNA, 25 bp, Artificial sequence
  Synthetic oligonucleotide
acagcggcgtggtactgcagtcatg

SEQ ID NO: 699360 - DNA, 25 bp, Artificial sequence
  Synthetic oligonucleotide
tcctgtggctcttcctgttcttcct

SEQ ID NO: 699361 - DNA, 25 bp, Artificial sequence
  Synthetic oligonucleotide
tctacgacatcgcctaccttggcgg

SEQ ID NO: 699362 - DNA, 25 bp, Artificial sequence
  Synthetic oligonucleotide
gcaccgtctacgacatcgcctacct

SEQ ID NO: 699363 - DNA, 25 bp, Artificial sequence
  Synthetic oligonucleotide
cccagggcaccgtctacgacatcgc

SEQ ID NO: 699364 - DNA, 25 bp, Artificial sequence
  Synthetic oligonucleotide
gccactcggtgtactacatcaagct

SEQ ID NO: 699365 - DNA, 25 bp, Artificial sequence
  Synthetic oligonucleotide
cggtgtacatcagctggtacgacga

SEQ ID NO: 699366 - DNA, 25 bp, Artificial sequence
  Synthetic oligonucleotide
acgacgacagcggcgtggtactgca

SEQ ID NO: 699367 - DNA, 25 bp, Artificial sequence
  Synthetic oligonucleotide
gctggtacgacgacagcggcgtggt

SEQ ID NO: 699368 - DNA, 25 bp, Artificial sequence
  Synthetic oligonucleotide
cggtgtactacatcaagctggcgtc

SEQ ID NO: 699369 - DNA, 25 bp, Artificial sequence
  Synthetic oligonucleotide
acatcagctggtacgacgacagcgg

SEQ ID NO: 699370 - DNA, 25 bp, Artificial sequence
  Synthetic oligonucleotide
gccttcatggccaacgccgagcgcc

SEQ ID NO: 699371 - DNA, 25 bp, Artificial sequence
  Synthetic oligonucleotide
accagtcggtgtacatcagctggta

SEQ ID NO: 699372 - DNA, 25 bp, Artificial sequence
  Synthetic oligonucleotide
cctgggaccagtcggtgtacatcag

SEQ ID NO: 699373 - DNA, 25 bp, Artificial sequence
  Synthetic oligonucleotide
ggccgacctgggaccagtcggtgta

SEQ ID NO: 699374 - DNA, 25 bp, Artificial sequence
  Synthetic oligonucleotide
tcgcccggccgacctgggaccagtc

SEQ ID NO: 699375 - DNA, 25 bp, Artificial sequence
  Synthetic oligonucleotide
gccacgtcgcccggccgacctggga

SEQ ID NO: 699376 - DNA, 25 bp, Artificial sequence
  Synthetic oligonucleotide
cgagcgccacgtcgcccggccgacc

SEQ ID NO: 699377 - DNA, 25 bp, Artificial sequence
  Synthetic oligonucleotide
aacgccgagcgccacgtcgcccggc

SEQ ID NO: 699378 - DNA, 25 bp, Artificial sequence
  Synthetic oligonucleotide
atggccaacgccgagcgccacgtcg

SEQ ID NO: 699379 - DNA, 25 bp, Artificial sequence
  Synthetic oligonucleotide
tggccaccttcgagcactgcgtcga

SEQ ID NO: 699380 - DNA, 25 bp, Artificial sequence
  Synthetic oligonucleotide
acggggtgatgagccagagcgagca

SEQ ID NO: 699381 - DNA, 25 bp, Artificial sequence
  Synthetic oligonucleotide
tgctggacggggtgatgagccagag

SEQ ID NO: 699382 - DNA, 25 bp, Artificial sequence
  Synthetic oligonucleotide
gctgggtgctggacggggtgatgag

SEQ ID NO: 699383 - DNA, 25 bp, Artificial sequence
  Synthetic oligonucleotide
agcagggctgggtgctggacggggt

SEQ ID NO: 699384 - DNA, 25 bp, Artificial sequence
  Synthetic oligonucleotide
gcgtcgagcagggctgggtgctgga

SEQ ID NO: 699385 - DNA, 25 bp, Artificial sequence
  Synthetic oligonucleotide
cgaggaagtcgccaacgaggcgctg

SEQ ID NO: 699386 - DNA, 25 bp, Artificial sequence
  Synthetic oligonucleotide
agcactgcgtcgagcagggctgggt

SEQ ID NO: 699387 - DNA, 25 bp, Artificial sequence
  Synthetic oligonucleotide
ggagttcgaggcgaccaccgaggaa

SEQ ID NO: 699388 - DNA, 25 bp, Artificial sequence
  Synthetic oligonucleotide
aggcgctggccaccttcgagcactg

SEQ ID NO: 699389 - DNA, 25 bp, Artificial sequence
  Synthetic oligonucleotide
cgaccaccgaggaagtcgccaacga

SEQ ID NO: 699390 - DNA, 25 bp, Artificial sequence
  Synthetic oligonucleotide
tgatgagccagagcgagcagcagtt

SEQ ID NO: 699391 - DNA, 25 bp, Artificial sequence
  Synthetic oligonucleotide
tcgaggcgaccaccgaggaagtcgc

SEQ ID NO: 699392 - DNA, 25 bp, Artificial sequence
  Synthetic oligonucleotide
ccaacgaggcgctggccaccttcga

SEQ ID NO: 699393 - DNA, 25 bp, Artificial sequence
  Synthetic oligonucleotide
aagtcgccaacgaggcgctggccac

SEQ ID NO: 699394 - DNA, 25 bp, Artificial sequence
  Synthetic oligonucleotide
ccttcgagcactgcgtcgagcaggg

SEQ ID NO: 699395 - DNA, 25 bp, Artificial sequence
  Synthetic oligonucleotide
tctccgagaccatctcccactggac

SEQ ID NO: 699396 - DNA, 25 bp, Artificial sequence
  Synthetic oligonucleotide
acaagaacgacatctcggtcacggt

SEQ ID NO: 699397 - DNA, 25 bp, Artificial sequence
  Synthetic oligonucleotide
cgccgtacaagaacgacatctcggt

SEQ ID NO: 699398 - DNA, 25 bp, Artificial sequence
  Synthetic oligonucleotide
tcaccgctatggtcctcggcacgcc

SEQ ID NO: 699399 - DNA, 25 bp, Artificial sequence
  Synthetic oligonucleotide
ccctgctggagttcgaggcgaccac

SEQ ID NO: 699400 - DNA, 25 bp, Artificial sequence
  Synthetic oligonucleotide
acgacatctcggtcacggtttcccg

SEQ ID NO: 699401 - DNA, 25 bp, Artificial sequence
  Synthetic oligonucleotide
cgggtgcccgccttcctcaaggaca

SEQ ID NO: 699402 - DNA, 25 bp, Artificial sequence
  Synthetic oligonucleotide
agaccatctcccactggacgccgta

SEQ ID NO: 699403 - DNA, 25 bp, Artificial sequence
  Synthetic oligonucleotide
tctcccactggacgccgtacaagaa

SEQ ID NO: 699404 - DNA, 25 bp, Artificial sequence
  Synthetic oligonucleotide
gccagagcgagcagcagttgcagaa

SEQ ID NO: 699405 - DNA, 25 bp, Artificial sequence
  Synthetic oligonucleotide
agtacatctccgagaccatctccca

SEQ ID NO: 699406 - DNA, 25 bp, Artificial sequence
  Synthetic oligonucleotide
tgcgcgagtacatctccgagaccat

SEQ ID NO: 699407 - DNA, 25 bp, Artificial sequence
  Synthetic oligonucleotide
ggaagctgcgcgagtacatctccga

SEQ ID NO: 699408 - DNA, 25 bp, Artificial sequence
  Synthetic oligonucleotide
acctgtggaagctgcgcgagtacat

SEQ ID NO: 699409 - DNA, 25 bp, Artificial sequence
  Synthetic oligonucleotide
tgcagaacctgtggaagctgcgcga

SEQ ID NO: 699410 - DNA, 25 bp, Artificial sequence
  Synthetic oligonucleotide
agcagttgcagaacctgtggaagct

SEQ ID NO: 699411 - DNA, 25 bp, Artificial sequence
  Synthetic oligonucleotide
gcgagcagcagttgcagaacctgtg

SEQ ID NO: 699412 - DNA, 25 bp, Artificial sequence
  Synthetic oligonucleotide
actggacgccgtacaagaacgacat

SEQ ID NO: 699413 - DNA, 25 bp, Artificial sequence
  Synthetic oligonucleotide
agaacctcaccgctatggtcctcgg

SEQ ID NO: 699414 - DNA, 25 bp, Artificial sequence
  Synthetic oligonucleotide
tgccttccagagcaagctcgacctg

SEQ ID NO: 699415 - DNA, 25 bp, Artificial sequence
  Synthetic oligonucleotide
tgctgcatgccttccagagcaagct

SEQ ID NO: 699416 - DNA, 25 bp, Artificial sequence
  Synthetic oligonucleotide
tgccggtgctgcatgccttccagag

SEQ ID NO: 699417 - DNA, 25 bp, Artificial sequence
  Synthetic oligonucleotide
cgatcatgccggtgctgcatgcctt

SEQ ID NO: 699418 - DNA, 25 bp, Artificial sequence
  Synthetic oligonucleotide
tcgactcgatcatgccggtgctgca

SEQ ID NO: 699419 - DNA, 25 bp, Artificial sequence
  Synthetic oligonucleotide
ccgacttcgactcgatcatgccggt

SEQ ID NO: 699420 - DNA, 25 bp, Artificial sequence
  Synthetic oligonucleotide
tcctcggcacgcccgacttcgactc

SEQ ID NO: 699421 - DNA, 25 bp, Artificial sequence
  Synthetic oligonucleotide
ctatggtcctcggcacgcccgactt

SEQ ID NO: 699422 - DNA, 25 bp, Artificial sequence
  Synthetic oligonucleotide
gacctgaccgccttcgagttcttct

SEQ ID NO: 699423 - DNA, 25 bp, Artificial sequence
  Synthetic oligonucleotide
cgccgaagaacctcaccgctatggt

SEQ ID NO: 699424 - DNA, 25 bp, Artificial sequence
  Synthetic oligonucleotide
agcgcacgccgaagaacctcaccgc

SEQ ID NO: 699425 - DNA, 25 bp, Artificial sequence
  Synthetic oligonucleotide
cccgccttcctcaaggacatcgacg

SEQ ID NO: 699426 - DNA, 25 bp, Artificial sequence
  Synthetic oligonucleotide
cttctcgtctgtggcgggcgccacg

SEQ ID NO: 699427 - DNA, 25 bp, Artificial sequence
  Synthetic oligonucleotide
gtctggagcgcacgccgaagaacct

SEQ ID NO: 699428 - DNA, 25 bp, Artificial sequence
  Synthetic oligonucleotide
catgcgtctggagcgcacgccgaag

SEQ ID NO: 699429 - DNA, 25 bp, Artificial sequence
  Synthetic oligonucleotide
gcacgcccgacttcgactcgatcat

SEQ ID NO: 699430 - DNA, 25 bp, Artificial sequence
  Synthetic oligonucleotide
caaggtcctggcccgtggcgatgta

SEQ ID NO: 699431 - DNA, 25 bp, Artificial sequence
  Synthetic oligonucleotide
gcccgttctacgccctgctggagtt

SEQ ID NO: 699432 - DNA, 25 bp, Artificial sequence
  Synthetic oligonucleotide
ccgactgcccgttctacgccctgct

SEQ ID NO: 699433 - DNA, 25 bp, Artificial sequence
  Synthetic oligonucleotide
tcgagaccgactgcccgttctacgc

SEQ ID NO: 699434 - DNA, 25 bp, Artificial sequence
  Synthetic oligonucleotide
ggcgttcgagaccgactgcccgttc

SEQ ID NO: 699435 - DNA, 25 bp, Artificial sequence
  Synthetic oligonucleotide
accacgggcgttcgagaccgactgc

SEQ ID NO: 699436 - DNA, 25 bp, Artificial sequence
  Synthetic oligonucleotide
gatgtaccacgggcgttcgagaccg

SEQ ID NO: 699437 - DNA, 25 bp, Artificial sequence
  Synthetic oligonucleotide
ccagagcaagctcgacctgaccgcc

SEQ ID NO: 699438 - DNA, 25 bp, Artificial sequence
  Synthetic oligonucleotide
ctggcccgtggcgatgtaccacggg

SEQ ID NO: 699439 - DNA, 25 bp, Artificial sequence
  Synthetic oligonucleotide
aagctcgacctgaccgccttcgagt

SEQ ID NO: 699440 - DNA, 25 bp, Artificial sequence
  Synthetic oligonucleotide
cctggccaaggtcctggcccgtggc

SEQ ID NO: 699441 - DNA, 25 bp, Artificial sequence
  Synthetic oligonucleotide
caaggccctggccaaggtcctggcc

SEQ ID NO: 699442 - DNA, 25 bp, Artificial sequence
  Synthetic oligonucleotide
tccgacaaggccctggccaaggtcc

SEQ ID NO: 699443 - DNA, 25 bp, Artificial sequence
  Synthetic oligonucleotide
ttcttctccgacaaggccctggcca

SEQ ID NO: 699444 - DNA, 25 bp, Artificial sequence
  Synthetic oligonucleotide
ttcgagttcttctccgacaaggccc

SEQ ID NO: 699445 - DNA, 25 bp, Artificial sequence
  Synthetic oligonucleotide
accgccttcgagttcttctccgaca

SEQ ID NO: 699446 - DNA, 25 bp, Artificial sequence
  Synthetic oligonucleotide
tctacgccctgctggagttcgaggc

SEQ ID NO: 699447 - DNA, 25 bp, Artificial sequence
  Synthetic oligonucleotide
cgtggcgatgtaccacgggcgttcg

SEQ ID NO: 699448 - DNA, 25 bp, Artificial sequence
  Synthetic oligonucleotide
tgcctatatgaaggcactgaaggcg

SEQ ID NO: 699449 - DNA, 25 bp, Artificial sequence
  Synthetic oligonucleotide
ggtcatccggcccttctcgtctgtg

SEQ ID NO: 699450 - DNA, 25 bp, Artificial sequence
  Synthetic oligonucleotide
atgaatcccggcaagatcttcgccg

SEQ ID NO: 699451 - DNA, 25 bp, Artificial sequence
  Synthetic oligonucleotide
gggatcatgaatcccggcaagatct

SEQ ID NO: 699452 - DNA, 25 bp, Artificial sequence
  Synthetic oligonucleotide
cccaacgggatcatgaatcccggca

SEQ ID NO: 699453 - DNA, 25 bp, Artificial sequence
  Synthetic oligonucleotide
ttcgaccccaacgggatcatgaatc

SEQ ID NO: 699454 - DNA, 25 bp, Artificial sequence
  Synthetic oligonucleotide
gcggtgttcgaccccaacgggatca

SEQ ID NO: 699455 - DNA, 25 bp, Artificial sequence
  Synthetic oligonucleotide
aagatcttcgccgagtagcaggtgt

SEQ ID NO: 699456 - DNA, 25 bp, Artificial sequence
  Synthetic oligonucleotide
tatgaaggcactgaaggcggtgttc

SEQ ID NO: 699457 - DNA, 25 bp, Artificial sequence
  Synthetic oligonucleotide
ttcgccgagtagcaggtgtcgcaac

SEQ ID NO: 699458 - DNA, 25 bp, Artificial sequence
  Synthetic oligonucleotide
cgaaattgcctatatgaaggcactg

SEQ ID NO: 699459 - DNA, 25 bp, Artificial sequence
  Synthetic oligonucleotide
ggaaaccgaaattgcctatatgaag

SEQ ID NO: 699460 - DNA, 25 bp, Artificial sequence
  Synthetic oligonucleotide
ccgctcggaaaccgaaattgcctat

SEQ ID NO: 699461 - DNA, 25 bp, Artificial sequence
  Synthetic oligonucleotide
tgacctacacccgctcggaaaccga

SEQ ID NO: 699462 - DNA, 25 bp, Artificial sequence
  Synthetic oligonucleotide
actacttgacctacacccgctcgga

SEQ ID NO: 699463 - DNA, 25 bp, Artificial sequence
  Synthetic oligonucleotide
agcgcgactacttgacctacacccg

SEQ ID NO: 699464 - DNA, 25 bp, Artificial sequence
  Synthetic oligonucleotide
ggcactgaaggcggtgttcgacccc

SEQ ID NO: 699465 - DNA, 25 bp, Artificial sequence
  Synthetic oligonucleotide
tctgtggcgggcgccacggatgcct

SEQ ID NO: 699466 - DNA, 25 bp, Artificial sequence
  Synthetic oligonucleotide
tggaaagcgaactgcgcgaagcggg

SEQ ID NO: 699467 - DNA, 25 bp, Artificial sequence
  Synthetic oligonucleotide
gcgaccatgcgtctggagcgcacgc

SEQ ID NO: 699468 - DNA, 25 bp, Artificial sequence
  Synthetic oligonucleotide
gagtcggtaaatgagttaccagcat

SEQ ID NO: 699469 - DNA, 25 bp, Artificial sequence
  Synthetic oligonucleotide
gttcaggagtcggtaaatgagttac

SEQ ID NO: 699470 - DNA, 25 bp, Artificial sequence
  Synthetic oligonucleotide
ccacccgttcaggagtcggtaaatg

SEQ ID NO: 699471 - DNA, 25 bp, Artificial sequence
  Synthetic oligonucleotide
atgcctttccacccgttcaggagtc

SEQ ID NO: 699472 - DNA, 25 bp, Artificial sequence
  Synthetic oligonucleotide
cccggcaagatcttcgccgagtagc

SEQ ID NO: 699473 - DNA, 25 bp, Artificial sequence
  Synthetic oligonucleotide
gcgggcgccacggatgcctttccac

SEQ ID NO: 699474 - DNA, 25 bp, Artificial sequence
  Synthetic oligonucleotide
atggcgtgggcatgaccaagcgcga

SEQ ID NO: 699475 - DNA, 25 bp, Artificial sequence
  Synthetic oligonucleotide
ccggcccttctcgtctgtggcgggc

SEQ ID NO: 699476 - DNA, 25 bp, Artificial sequence
  Synthetic oligonucleotide
agggccggtcatccggcccttctcg

SEQ ID NO: 699477 - DNA, 25 bp, Artificial sequence
  Synthetic oligonucleotide
acgcagagggccggtcatccggccc

SEQ ID NO: 699478 - DNA, 25 bp, Artificial sequence
  Synthetic oligonucleotide
gtcgcaacgcagagggccggtcatc

SEQ ID NO: 699479 - DNA, 25 bp, Artificial sequence
  Synthetic oligonucleotide
gcaggtgtcgcaacgcagagggccg

SEQ ID NO: 699480 - DNA, 25 bp, Artificial sequence
  Synthetic oligonucleotide
cgagtagcaggtgtcgcaacgcaga

SEQ ID NO: 699481 - DNA, 25 bp, Artificial sequence
  Synthetic oligonucleotide
gccacggatgcctttccacccgttc

SEQ ID NO: 699482 - DNA, 25 bp, Artificial sequence
  Synthetic oligonucleotide
ttcgaggtggtgtggttcggccaca

SEQ ID NO: 699483 - DNA, 25 bp, Artificial sequence
  Synthetic oligonucleotide
tgaacatcctcaagccggaaaacct

SEQ ID NO: 699484 - DNA, 25 bp, Artificial sequence
  Synthetic oligonucleotide
gcacctgaacatcctcaagccggaa

SEQ ID NO: 699485 - DNA, 25 bp, Artificial sequence
  Synthetic oligonucleotide
aacctgcacctgaacatcctcaagc

SEQ ID NO: 699486 - DNA, 25 bp, Artificial sequence
  Synthetic oligonucleotide
gacggcaacctgcacctgaacatcc

SEQ ID NO: 699487 - DNA, 25 bp, Artificial sequence
  Synthetic oligonucleotide
atcggcgacggcaacctgcacctga

SEQ ID NO: 699488 - DNA, 25 bp, Artificial sequence
  Synthetic oligonucleotide
ggccacatcggcgacggcaacctgc

SEQ ID NO: 699489 - DNA, 25 bp, Artificial sequence
  Synthetic oligonucleotide
tgaccaagcgcgactacttgaccta

SEQ ID NO: 699490 - DNA, 25 bp, Artificial sequence
  Synthetic oligonucleotide
ggtggtgtggttcggccacatcggc

SEQ ID NO: 699491 - DNA, 25 bp, Artificial sequence
  Synthetic oligonucleotide
ggcaaggacgagttcttcgccaagt

SEQ ID NO: 699492 - DNA, 25 bp, Artificial sequence
  Synthetic oligonucleotide
ccggacttcgaggtggtgtggttcg

SEQ ID NO: 699493 - DNA, 25 bp, Artificial sequence
  Synthetic oligonucleotide
caactacccggacttcgaggtggtg

SEQ ID NO: 699494 - DNA, 25 bp, Artificial sequence
  Synthetic oligonucleotide
cgaggccaactacccggacttcgag

SEQ ID NO: 699495 - DNA, 25 bp, Artificial sequence
  Synthetic oligonucleotide
catcgtcgaggccaactacccggac

SEQ ID NO: 699496 - DNA, 25 bp, Artificial sequence
  Synthetic oligonucleotide
tcgacgccatcgtcgaggccaacta

SEQ ID NO: 699497 - DNA, 25 bp, Artificial sequence
  Synthetic oligonucleotide
aaggacatcgacgccatcgtcgagg

SEQ ID NO: 699498 - DNA, 25 bp, Artificial sequence
  Synthetic oligonucleotide
gtggttcggccacatcggcgacggc

SEQ ID NO: 699499 - DNA, 25 bp, Artificial sequence
  Synthetic oligonucleotide
tgggtgttcgagaccgtcgagaagt

SEQ ID NO: 699500 - DNA, 25 bp, Artificial sequence
  Synthetic oligonucleotide
ttcctcaaggacatcgacgccatcg

SEQ ID NO: 699501 - DNA, 25 bp, Artificial sequence
  Synthetic oligonucleotide
ccgagcatggcgtgggcatgaccaa

SEQ ID NO: 699502 - DNA, 25 bp, Artificial sequence
  Synthetic oligonucleotide
tttccgccgagcatggcgtgggcat

SEQ ID NO: 699503 - DNA, 25 bp, Artificial sequence
  Synthetic oligonucleotide
gctcgatttccgccgagcatggcgt

SEQ ID NO: 699504 - DNA, 25 bp, Artificial sequence
  Synthetic oligonucleotide
tacaacggctcgatttccgccgagc

SEQ ID NO: 699505 - DNA, 25 bp, Artificial sequence
  Synthetic oligonucleotide
gagaagtacaacggctcgatttccg

SEQ ID NO: 699506 - DNA, 25 bp, Artificial sequence
  Synthetic oligonucleotide
tcctcaagccggaaaacctcggcaa

SEQ ID NO: 699507 - DNA, 25 bp, Artificial sequence
  Synthetic oligonucleotide
ttcgagaccgtcgagaagtacaacg

SEQ ID NO: 699508 - DNA, 25 bp, Artificial sequence
  Synthetic oligonucleotide
aacctcggcaaggacgagttcttcg

SEQ ID NO: 699509 - DNA, 25 bp, Artificial sequence
  Synthetic oligonucleotide
aacaagtgggtgttcgagaccgtcg

SEQ ID NO: 699510 - DNA, 25 bp, Artificial sequence
  Synthetic oligonucleotide
accgtcaacaagtgggtgttcgaga

SEQ ID NO: 699511 - DNA, 25 bp, Artificial sequence
  Synthetic oligonucleotide
tgcgcgaccgtcaacaagtgggtgt

SEQ ID NO: 699512 - DNA, 25 bp, Artificial sequence
  Synthetic oligonucleotide
gccaagtgcgcgaccgtcaacaagt

SEQ ID NO: 699513 - DNA, 25 bp, Artificial sequence
  Synthetic oligonucleotide
ttcttcgccaagtgcgcgaccgtca

SEQ ID NO: 699514 - DNA, 25 bp, Artificial sequence
  Synthetic oligonucleotide
gacgagttcttcgccaagtgcgcga

SEQ ID NO: 699515 - DNA, 25 bp, Artificial sequence
  Synthetic oligonucleotide
tgggcatgaccaagcgcgactactt

SEQ ID NO: 699516 - DNA, 25 bp, Artificial sequence
  Synthetic oligonucleotide
accgtcgagaagtacaacggctcga

SEQ ID NO: 699517 - DNA, 25 bp, Artificial sequence
  Synthetic oligonucleotide
aatgacccgcgaagccctgatcgaa

SEQ ID NO: 699518 - DNA, 25 bp, Artificial sequence
  Synthetic oligonucleotide
gcgcgaagcgggtccggccggcgct

SEQ ID NO: 699519 - DNA, 25 bp, Artificial sequence
  Synthetic oligonucleotide
agcctggcaagctgctcgacgacgc

SEQ ID NO: 699520 - DNA, 25 bp, Artificial sequence
  Synthetic oligonucleotide
tggtcgagcctggcaagctgctcga

SEQ ID NO: 699521 - DNA, 25 bp, Artificial sequence
  Synthetic oligonucleotide
agcccctggtcgagcctggcaagct

SEQ ID NO: 699522 - DNA, 25 bp, Artificial sequence
  Synthetic oligonucleotide
tcgctcaagcccctggtcgagcctg

SEQ ID NO: 699523 - DNA, 25 bp, Artificial sequence
  Synthetic oligonucleotide
atcgaatcgctcaagcccctggtcg

SEQ ID NO: 699524 - DNA, 25 bp, Artificial sequence
  Synthetic oligonucleotide
tgctcgacgacgccgcctccctgga

SEQ ID NO: 699525 - DNA, 25 bp, Artificial sequence
  Synthetic oligonucleotide
cgcgaagccctgatcgaatcgctca

SEQ ID NO: 699526 - DNA, 25 bp, Artificial sequence
  Synthetic oligonucleotide
acgacgccgcctccctggacgccta

SEQ ID NO: 699527 - DNA, 25 bp, Artificial sequence
  Synthetic oligonucleotide
tgagagttcccgaatgacccgcgaa

SEQ ID NO: 699528 - DNA, 25 bp, Artificial sequence
  Synthetic oligonucleotide
ccatgaatcatttgagagttcccga

SEQ ID NO: 699529 - DNA, 25 bp, Artificial sequence
  Synthetic oligonucleotide
ggacgaccatgaatcatttgagagt

SEQ ID NO: 699530 - DNA, 25 bp, Artificial sequence
  Synthetic oligonucleotide
ttctcaggacgaccatgaatcattt

SEQ ID NO: 699531 - DNA, 25 bp, Artificial sequence
  Synthetic oligonucleotide
gagttgttctcaggacgaccatgaa

SEQ ID NO: 699532 - DNA, 25 bp, Artificial sequence
  Synthetic oligonucleotide
cgacctgagttgttctcaggacgac

SEQ ID NO: 699533 - DNA, 25 bp, Artificial sequence
  Synthetic oligonucleotide
gccctgatcgaatcgctcaagcccc

SEQ ID NO: 699534 - DNA, 25 bp, Artificial sequence
  Synthetic oligonucleotide
agcatttcgcccctgcgccgctggc

SEQ ID NO: 699535 - DNA, 25 bp, Artificial sequence
  Synthetic oligonucleotide
gagcaggtccaggcgatcgtccgct

SEQ ID NO: 699536 - DNA, 25 bp, Artificial sequence
  Synthetic oligonucleotide
agcgtcgagcaggtccaggcgatcg

SEQ ID NO: 699537 - DNA, 25 bp, Artificial sequence
  Synthetic oligonucleotide
cccaagagcgtcgagcaggtccagg

SEQ ID NO: 699538 - DNA, 25 bp, Artificial sequence
  Synthetic oligonucleotide
tgttccccaagagcgtcgagcaggt

SEQ ID NO: 699539 - DNA, 25 bp, Artificial sequence
  Synthetic oligonucleotide
catcgtgttccccaagagcgtcgag

SEQ ID NO: 699540 - DNA, 25 bp, Artificial sequence
  Synthetic oligonucleotide
cgctggccatcgtgttccccaagag

SEQ ID NO: 699541 - DNA, 25 bp, Artificial sequence
  Synthetic oligonucleotide
gcaagctgctcgacgacgccgcctc

SEQ ID NO: 699542 - DNA, 25 bp, Artificial sequence
  Synthetic oligonucleotide
tcgcccctgcgccgctggccatcgt

SEQ ID NO: 699543 - DNA, 25 bp, Artificial sequence
  Synthetic oligonucleotide
cttttccttgcccggttgcgacctg

SEQ ID NO: 699544 - DNA, 25 bp, Artificial sequence
  Synthetic oligonucleotide
ggaccaagcatttcgcccctgcgcc

SEQ ID NO: 699545 - DNA, 25 bp, Artificial sequence
  Synthetic oligonucleotide
aggactggaccaagcatttcgcccc

SEQ ID NO: 699546 - DNA, 25 bp, Artificial sequence
  Synthetic oligonucleotide
acggcaaggactggaccaagcattt

SEQ ID NO: 699547 - DNA, 25 bp, Artificial sequence
  Synthetic oligonucleotide
acgcctacggcaaggactggaccaa

SEQ ID NO: 699548 - DNA, 25 bp, Artificial sequence
  Synthetic oligonucleotide
ccctggacgcctacggcaaggactg

SEQ ID NO: 699549 - DNA, 25 bp, Artificial sequence
  Synthetic oligonucleotide
ccgcctccctggacgcctacggcaa

SEQ ID NO: 699550 - DNA, 25 bp, Artificial sequence
  Synthetic oligonucleotide
ctgcgccgctggccatcgtgttccc

SEQ ID NO: 699551 - DNA, 25 bp, Artificial sequence
  Synthetic oligonucleotide
ttgctcttgtcgagagaggtcttgc

SEQ ID NO: 699552 - DNA, 25 bp, Artificial sequence
  Synthetic oligonucleotide
ggaggaagtggctggaaagcgaact

SEQ ID NO: 699553 - DNA, 25 bp, Artificial sequence
  Synthetic oligonucleotide
tgtcccggaggaagtggctggaaag

SEQ ID NO: 699554 - DNA, 25 bp, Artificial sequence
  Synthetic oligonucleotide
acctgttgtcccggaggaagtggct

SEQ ID NO: 699555 - DNA, 25 bp, Artificial sequence
  Synthetic oligonucleotide
tgcgtaaacctgttgtcccggagga

SEQ ID NO: 699556 - DNA, 25 bp, Artificial sequence
  Synthetic oligonucleotide
ctcatctgcgtaaacctgttgtccc

SEQ ID NO: 699557 - DNA, 25 bp, Artificial sequence
  Synthetic oligonucleotide
gtcttgctcatctgcgtaaacctgt

SEQ ID NO: 699558 - DNA, 25 bp, Artificial sequence
  Synthetic oligonucleotide
cggttgcgacctgagttgttctcag

SEQ ID NO: 699559 - DNA, 25 bp, Artificial sequence
  Synthetic oligonucleotide
ttgtcgagagaggtcttgctcatct

SEQ ID NO: 699560 - DNA, 25 bp, Artificial sequence
  Synthetic oligonucleotide
gcgaactgcgcgaagcgggtccggc

SEQ ID NO: 699561 - DNA, 25 bp, Artificial sequence
  Synthetic oligonucleotide
ttgatcttgctcttgtcgagagagg

SEQ ID NO: 699562 - DNA, 25 bp, Artificial sequence
  Synthetic oligonucleotide
aggaacttgatcttgctcttgtcga

SEQ ID NO: 699563 - DNA, 25 bp, Artificial sequence
  Synthetic oligonucleotide
agaagaaggaacttgatcttgctct

SEQ ID NO: 699564 - DNA, 25 bp, Artificial sequence
  Synthetic oligonucleotide
ccttcgagaagaaggaacttgatct

SEQ ID NO: 699565 - DNA, 25 bp, Artificial sequence
  Synthetic oligonucleotide
tggacaccttcgagaagaaggaact

SEQ ID NO: 699566 - DNA, 25 bp, Artificial sequence
  Synthetic oligonucleotide
tctggtggacaccttcgagaagaag

SEQ ID NO: 699567 - DNA, 25 bp, Artificial sequence
  Synthetic oligonucleotide
agagaggtcttgctcatctgcgtaa

SEQ ID NO: 699568 - DNA, 25 bp, Artificial sequence
  Synthetic oligonucleotide
caactcggcgcccagaggcactaag

SEQ ID NO: 699569 - DNA, 25 bp, Artificial sequence
  Synthetic oligonucleotide
gtccgctgggccaaccagcacaagg

SEQ ID NO: 699570 - DNA, 25 bp, Artificial sequence
  Synthetic oligonucleotide
gcatgttctcccttttccttgcccg

SEQ ID NO: 699571 - DNA, 25 bp, Artificial sequence
  Synthetic oligonucleotide
atgctagcatgttctcccttttcct

SEQ ID NO: 699572 - DNA, 25 bp, Artificial sequence
  Synthetic oligonucleotide
gggcgtatgctagcatgttctccct

SEQ ID NO: 699573 - DNA, 25 bp, Artificial sequence
  Synthetic oligonucleotide
gcgcggggggcgtatgctagcatgt

SEQ ID NO: 699574 - DNA, 25 bp, Artificial sequence
  Synthetic oligonucleotide
cactaagcgcggggggcgtatgcta

SEQ ID NO: 699575 - DNA, 25 bp, Artificial sequence
  Synthetic oligonucleotide
agtggctggaaagcgaactgcgcga

SEQ ID NO: 699576 - DNA, 25 bp, Artificial sequence
  Synthetic oligonucleotide
ggcgcccagaggcactaagcgcggg

SEQ ID NO: 699577 - DNA, 25 bp, Artificial sequence
  Synthetic oligonucleotide
ctttcatggcgacgcccaagaaaac

SEQ ID NO: 699578 - DNA, 25 bp, Artificial sequence
  Synthetic oligonucleotide
gcacccgcaactcggcgcccagagg

SEQ ID NO: 699579 - DNA, 25 bp, Artificial sequence
  Synthetic oligonucleotide
ggccggcacccgcaactcggcgccc

SEQ ID NO: 699580 - DNA, 25 bp, Artificial sequence
  Synthetic oligonucleotide
cggcgctggccggcacccgcaactc

SEQ ID NO: 699581 - DNA, 25 bp, Artificial sequence
  Synthetic oligonucleotide
tccggccggcgctggccggcacccg

SEQ ID NO: 699582 - DNA, 25 bp, Artificial sequence
  Synthetic oligonucleotide
agcgggtccggccggcgctggccgg

SEQ ID NO: 699583 - DNA, 25 bp, Artificial sequence
  Synthetic oligonucleotide
gtaaatgagttaccagcatcaatat

SEQ ID NO: 699584 - DNA, 25 bp, Artificial sequence
  Synthetic oligonucleotide
cttgcccggttgcgacctgagttgt

SEQ ID NO: 699585 - DNA, 25 bp, Artificial sequence
  Synthetic oligonucleotide
cagaggcactaagcgcggggggcgt

SEQ ID NO: 699586 - DNA, 25 bp, Artificial sequence
  Synthetic oligonucleotide
caaggtcattcgctacggcatgacc

SEQ ID NO: 699587 - DNA, 25 bp, Artificial sequence
  Synthetic oligonucleotide
ggtcgtcaccggcaagggcgacctg

SEQ ID NO: 699588 - DNA, 25 bp, Artificial sequence
  Synthetic oligonucleotide
gatgaaggtcgtcaccggcaagggc

SEQ ID NO: 699589 - DNA, 25 bp, Artificial sequence
  Synthetic oligonucleotide
ggccgggatgaaggtcgtcaccggc

SEQ ID NO: 699590 - DNA, 25 bp, Artificial sequence
  Synthetic oligonucleotide
ctgggtggccgggatgaaggtcgtc

SEQ ID NO: 699591 - DNA, 25 bp, Artificial sequence
  Synthetic oligonucleotide
ccgtaactgggtggccgggatgaag

SEQ ID NO: 699592 - DNA, 25 bp, Artificial sequence
  Synthetic oligonucleotide
gcatgacccgtaactgggtggccgg

SEQ ID NO: 699593 - DNA, 25 bp, Artificial sequence
  Synthetic oligonucleotide
agccagatcggcggcaatatcggca

SEQ ID NO: 699594 - DNA, 25 bp, Artificial sequence
  Synthetic oligonucleotide
cattcgctacggcatgacccgtaac

SEQ ID NO: 699595 - DNA, 25 bp, Artificial sequence
  Synthetic oligonucleotide
gacctgctcgagctgaacaaggacc

SEQ ID NO: 699596 - DNA, 25 bp, Artificial sequence
  Synthetic oligonucleotide
gggatcaaggtcattcgctacggca

SEQ ID NO: 699597 - DNA, 25 bp, Artificial sequence
  Synthetic oligonucleotide
gccggcgggatcaaggtcattcgct

SEQ ID NO: 699598 - DNA, 25 bp, Artificial sequence
  Synthetic oligonucleotide
accaatgccggcgggatcaaggtca

SEQ ID NO: 699599 - DNA, 25 bp, Artificial sequence
  Synthetic oligonucleotide
atcggcaccaatgccggcgggatca

SEQ ID NO: 699600 - DNA, 25 bp, Artificial sequence
  Synthetic oligonucleotide
ggcaatatcggcaccaatgccggcg

SEQ ID NO: 699601 - DNA, 25 bp, Artificial sequence
  Synthetic oligonucleotide
gtccaggcgatcgtccgctgggcca

SEQ ID NO: 699602 - DNA, 25 bp, Artificial sequence
  Synthetic oligonucleotide
gctacggcatgacccgtaactgggt

SEQ ID NO: 699603 - DNA, 25 bp, Artificial sequence
  Synthetic oligonucleotide
gctacgacatgcgccagctgttcat

SEQ ID NO: 699604 - DNA, 25 bp, Artificial sequence
  Synthetic oligonucleotide
ttcgtggtcgaggcgaccatgcgtc

SEQ ID NO: 699605 - DNA, 25 bp, Artificial sequence
  Synthetic oligonucleotide
tgggcttcgtggtcgaggcgaccat

SEQ ID NO: 699606 - DNA, 25 bp, Artificial sequence
  Synthetic oligonucleotide
gcaccctgggcttcgtggtcgaggc

SEQ ID NO: 699607 - DNA, 25 bp, Artificial sequence
  Synthetic oligonucleotide
ccgaaggcaccctgggcttcgtggt

SEQ ID NO: 699608 - DNA, 25 bp, Artificial sequence
  Synthetic oligonucleotide
tcggcgccgaaggcaccctgggctt

SEQ ID NO: 699609 - DNA, 25 bp, Artificial sequence
  Synthetic oligonucleotide
tgttcatcggcgccgaaggcaccct

SEQ ID NO: 699610 - DNA, 25 bp, Artificial sequence
  Synthetic oligonucleotide
accggcaagggcgacctgctcgagc

SEQ ID NO: 699611 - DNA, 25 bp, Artificial sequence
  Synthetic oligonucleotide
acatgcgccagctgttcatcggcgc

SEQ ID NO: 699612 - DNA, 25 bp, Artificial sequence
  Synthetic oligonucleotide
aagggcgacctgctcgagctgaaca

SEQ ID NO: 699613 - DNA, 25 bp, Artificial sequence
  Synthetic oligonucleotide
ccaccggctacgacatgcgccagct

SEQ ID NO: 699614 - DNA, 25 bp, Artificial sequence
  Synthetic oligonucleotide
agaacgccaccggctacgacatgcg

SEQ ID NO: 699615 - DNA, 25 bp, Artificial sequence
  Synthetic oligonucleotide
tgatcaagaacgccaccggctacga

SEQ ID NO: 699616 - DNA, 25 bp, Artificial sequence
  Synthetic oligonucleotide
aaggacctgatcaagaacgccaccg

SEQ ID NO: 699617 - DNA, 25 bp, Artificial sequence
  Synthetic oligonucleotide
ctgaacaaggacctgatcaagaacg

SEQ ID NO: 699618 - DNA, 25 bp, Artificial sequence
  Synthetic oligonucleotide
ctcgagctgaacaaggacctgatca

SEQ ID NO: 699619 - DNA, 25 bp, Artificial sequence
  Synthetic oligonucleotide
ggttccagccagatcggcggcaata

SEQ ID NO: 699620 - DNA, 25 bp, Artificial sequence
  Synthetic oligonucleotide
gccagctgttcatcggcgccgaagg

SEQ ID NO: 699621 - DNA, 25 bp, Artificial sequence
  Synthetic oligonucleotide
gggctctccgccgcggccgtggcgg

SEQ ID NO: 699622 - DNA, 25 bp, Artificial sequence
  Synthetic oligonucleotide
tcgactacatgaaccggatactcga

SEQ ID NO: 699623 - DNA, 25 bp, Artificial sequence
  Synthetic oligonucleotide
tggccttcgactacatgaaccggat

SEQ ID NO: 699624 - DNA, 25 bp, Artificial sequence
  Synthetic oligonucleotide
tcgtggtggccttcgactacatgaa

SEQ ID NO: 699625 - DNA, 25 bp, Artificial sequence
  Synthetic oligonucleotide
gcgaagtcgtggtggccttcgacta

SEQ ID NO: 699626 - DNA, 25 bp, Artificial sequence
  Synthetic oligonucleotide
ccaacggcgaagtcgtggtggcctt

SEQ ID NO: 699627 - DNA, 25 bp, Artificial sequence
  Synthetic oligonucleotide
gtggcggccaacggcgaagtcgtgg

SEQ ID NO: 699628 - DNA, 25 bp, Artificial sequence
  Synthetic oligonucleotide
atcggcggcaatatcggcaccaatg

SEQ ID NO: 699629 - DNA, 25 bp, Artificial sequence
  Synthetic oligonucleotide
tccgccgcggccgtggcggccaacg

SEQ ID NO: 699630 - DNA, 25 bp, Artificial sequence
  Synthetic oligonucleotide
tactcgacttcaatgccttcgaccg

SEQ ID NO: 699631 - DNA, 25 bp, Artificial sequence
  Synthetic oligonucleotide
cgtaccgggctctccgccgcggccg

SEQ ID NO: 699632 - DNA, 25 bp, Artificial sequence
  Synthetic oligonucleotide
gcggtcgtaccgggctctccgccgc

SEQ ID NO: 699633 - DNA, 25 bp, Artificial sequence
  Synthetic oligonucleotide
gcacaaggtcggtctggtcccgtcg

SEQ ID NO: 699634 - DNA, 25 bp, Artificial sequence
  Synthetic oligonucleotide
aaccagcacaaggtcggtctggtcc

SEQ ID NO: 699635 - DNA, 25 bp, Artificial sequence
  Synthetic oligonucleotide
tgggccaaccagcacaaggtcggtc

SEQ ID NO: 699636 - DNA, 25 bp, Artificial sequence
  Synthetic oligonucleotide
gtcgaggcgaccatgcgtctggagc

SEQ ID NO: 699637 - DNA, 25 bp, Artificial sequence
  Synthetic oligonucleotide
gcggccgtggcggccaacggcgaag

SEQ ID NO: 699638 - DNA, 25 bp, Artificial sequence
  Synthetic oligonucleotide
ggcgtggttaccaagcaactgcaga

SEQ ID NO: 699639 - DNA, 25 bp, Artificial sequence
  Synthetic oligonucleotide
tcttccggttccagccagatcggcg

SEQ ID NO: 699640 - DNA, 25 bp, Artificial sequence
  Synthetic oligonucleotide
tcgcttcttccggttccagccagat

SEQ ID NO: 699641 - DNA, 25 bp, Artificial sequence
  Synthetic oligonucleotide
gttgacttcgcttcttccggttcca

SEQ ID NO: 699642 - DNA, 25 bp, Artificial sequence
  Synthetic oligonucleotide
gcctgtactacccggttgacttcgc

SEQ ID NO: 699643 - DNA, 25 bp, Artificial sequence
  Synthetic oligonucleotide
tcgccgaggaaaacggcctgtacta

SEQ ID NO: 699644 - DNA, 25 bp, Artificial sequence
  Synthetic oligonucleotide
actgcagaccttcgccgaggaaaac

SEQ ID NO: 699645 - DNA, 25 bp, Artificial sequence
  Synthetic oligonucleotide
acatgaaccggatactcgacttcaa

SEQ ID NO: 699646 - DNA, 25 bp, Artificial sequence
  Synthetic oligonucleotide
gttaccaagcaactgcagaccttcg

SEQ ID NO: 699647 - DNA, 25 bp, Artificial sequence
  Synthetic oligonucleotide
accggatactcgacttcaatgcctt

SEQ ID NO: 699648 - DNA, 25 bp, Artificial sequence
  Synthetic oligonucleotide
ccagccgggcgtggttaccaagcaa

SEQ ID NO: 699649 - DNA, 25 bp, Artificial sequence
  Synthetic oligonucleotide
agtctgccagccgggcgtggttacc

SEQ ID NO: 699650 - DNA, 25 bp, Artificial sequence
  Synthetic oligonucleotide
gcaccgtagtctgccagccgggcgt

SEQ ID NO: 699651 - DNA, 25 bp, Artificial sequence
  Synthetic oligonucleotide
tcgaccgcaccgtagtctgccagcc

SEQ ID NO: 699652 - DNA, 25 bp, Artificial sequence
  Synthetic oligonucleotide
atgccttcgaccgcaccgtagtctg

SEQ ID NO: 699653 - DNA, 25 bp, Artificial sequence
  Synthetic oligonucleotide
acttcaatgccttcgaccgcaccgt

SEQ ID NO: 699654 - DNA, 25 bp, Artificial sequence
  Synthetic oligonucleotide
gcgatcgtccgctgggccaaccagc

SEQ ID NO: 699655 - DNA, 25 bp, Artificial sequence
  Synthetic oligonucleotide
aagcaactgcagaccttcgccgagg

SEQ ID NO: 699656 - DNA, 25 bp, Artificial sequence
  Synthetic oligonucleotide
ccgctgctcggcctgagcaatcccg

SEQ ID NO: 699657 - DNA, 25 bp, Artificial sequence
  Synthetic oligonucleotide
gggggcaatgccctttcatggcgac

SEQ ID NO: 699658 - DNA, 25 bp, Artificial sequence
  Synthetic oligonucleotide
agaacggcaacgtcgcggtgaccga

SEQ ID NO: 699659 - DNA, 25 bp, Artificial sequence
  Synthetic oligonucleotide
gtgctggagaacggcaacgtcgcgg

SEQ ID NO: 699660 - DNA, 25 bp, Artificial sequence
  Synthetic oligonucleotide
gtggcggtgctggagaacggcaacg

SEQ ID NO: 699661 - DNA, 25 bp, Artificial sequence
  Synthetic oligonucleotide
gaaggcgtggcggtgctggagaacg

SEQ ID NO: 699662 - DNA, 25 bp, Artificial sequence
  Synthetic oligonucleotide
aatcccgaaggcgtggcggtgctgg

SEQ ID NO: 699663 - DNA, 25 bp, Artificial sequence
  Synthetic oligonucleotide
tcgcggtgaccgacgagcgccgcaa

SEQ ID NO: 699664 - DNA, 25 bp, Artificial sequence
  Synthetic oligonucleotide
ctcggcctgagcaatcccgaaggcg

SEQ ID NO: 699665 - DNA, 25 bp, Artificial sequence
  Synthetic oligonucleotide
tgaccgacgagcgccgcaataccct

SEQ ID NO: 699666 - DNA, 25 bp, Artificial sequence
  Synthetic oligonucleotide
caccatcccgctgctcggcctgagc

SEQ ID NO: 699667 - DNA, 25 bp, Artificial sequence
  Synthetic oligonucleotide
gctgcgcaccatcccgctgctcggc

SEQ ID NO: 699668 - DNA, 25 bp, Artificial sequence
  Synthetic oligonucleotide
cgacgtgctgcgcaccatcccgctg

SEQ ID NO: 699669 - DNA, 25 bp, Artificial sequence
  Synthetic oligonucleotide
tcaccggcgacgtgctgcgcaccat

SEQ ID NO: 699670 - DNA, 25 bp, Artificial sequence
  Synthetic oligonucleotide
tgtcgctcaccggcgacgtgctgcg

SEQ ID NO: 699671 - DNA, 25 bp, Artificial sequence
  Synthetic oligonucleotide
tggagctgtcgctcaccggcgacgt

SEQ ID NO: 699672 - DNA, 25 bp, Artificial sequence
  Synthetic oligonucleotide
ctgagcaatcccgaaggcgtggcgg

SEQ ID NO: 699673 - DNA, 25 bp, Artificial sequence
  Synthetic oligonucleotide
acccgcagaccgccgagctgagcac

SEQ ID NO: 699674 - DNA, 25 bp, Artificial sequence
  Synthetic oligonucleotide
gggcaatattggcaagaagaacaag

SEQ ID NO: 699675 - DNA, 25 bp, Artificial sequence
  Synthetic oligonucleotide
cccgctgggcaatattggcaagaag

SEQ ID NO: 699676 - DNA, 25 bp, Artificial sequence
  Synthetic oligonucleotide
cgaattcccgctgggcaatattggc

SEQ ID NO: 699677 - DNA, 25 bp, Artificial sequence
  Synthetic oligonucleotide
cctggccgaattcccgctgggcaat

SEQ ID NO: 699678 - DNA, 25 bp, Artificial sequence
  Synthetic oligonucleotide
caagagcctggccgaattcccgctg

SEQ ID NO: 699679 - DNA, 25 bp, Artificial sequence
  Synthetic oligonucleotide
tgagcaccaagagcctggccgaatt

SEQ ID NO: 699680 - DNA, 25 bp, Artificial sequence
  Synthetic oligonucleotide
gcaacgtcgcggtgaccgacgagcg

SEQ ID NO: 699681 - DNA, 25 bp, Artificial sequence
  Synthetic oligonucleotide
agaccgccgagctgagcaccaagag

SEQ ID NO: 699682 - DNA, 25 bp, Artificial sequence
  Synthetic oligonucleotide
gcaagcggccgctgctggtggagct

SEQ ID NO: 699683 - DNA, 25 bp, Artificial sequence
  Synthetic oligonucleotide
atgtcgacccgcagaccgccgagct

SEQ ID NO: 699684 - DNA, 25 bp, Artificial sequence
  Synthetic oligonucleotide
tcttccatgtcgacccgcagaccgc

SEQ ID NO: 699685 - DNA, 25 bp, Artificial sequence
  Synthetic oligonucleotide
tgaccatcttccatgtcgacccgca

SEQ ID NO: 699686 - DNA, 25 bp, Artificial sequence
  Synthetic oligonucleotide
ataccctgaccatcttccatgtcga

SEQ ID NO: 699687 - DNA, 25 bp, Artificial sequence
  Synthetic oligonucleotide
gccgcaataccctgaccatcttcca

SEQ ID NO: 699688 - DNA, 25 bp, Artificial sequence
  Synthetic oligonucleotide
acgagcgccgcaataccctgaccat

SEQ ID NO: 699689 - DNA, 25 bp, Artificial sequence
  Synthetic oligonucleotide
ccgagctgagcaccaagagcctggc

SEQ ID NO: 699690 - DNA, 25 bp, Artificial sequence
  Synthetic oligonucleotide
cggcctttggtggaaggaaagccag

SEQ ID NO: 699691 - DNA, 25 bp, Artificial sequence
  Synthetic oligonucleotide
gaaagcatctggctgccgggctatc

SEQ ID NO: 699692 - DNA, 25 bp, Artificial sequence
  Synthetic oligonucleotide
cgcgacgaaagcatctggctgccgg

SEQ ID NO: 699693 - DNA, 25 bp, Artificial sequence
  Synthetic oligonucleotide
agcagcgcgacgaaagcatctggct

SEQ ID NO: 699694 - DNA, 25 bp, Artificial sequence
  Synthetic oligonucleotide
gccagcagcagcgcgacgaaagcat

SEQ ID NO: 699695 - DNA, 25 bp, Artificial sequence
  Synthetic oligonucleotide
aggccagccagcagcagcgcgacga

SEQ ID NO: 699696 - DNA, 25 bp, Artificial sequence
  Synthetic oligonucleotide
aaagccaggccagccagcagcagcg

SEQ ID NO: 699697 - DNA, 25 bp, Artificial sequence
  Synthetic oligonucleotide
gctggtggagctgtcgctcaccggc

SEQ ID NO: 699698 - DNA, 25 bp, Artificial sequence
  Synthetic oligonucleotide
ttggtggaaggaaagccaggccagc

SEQ ID NO: 699699 - DNA, 25 bp, Artificial sequence
  Synthetic oligonucleotide
gggctatcgggtggtgatcgacgcc

SEQ ID NO: 699700 - DNA, 25 bp, Artificial sequence
  Synthetic oligonucleotide
atcgcgccggcctttggtggaagga

SEQ ID NO: 699701 - DNA, 25 bp, Artificial sequence
  Synthetic oligonucleotide
gggacgatcgcgccggcctttggtg

SEQ ID NO: 699702 - DNA, 25 bp, Artificial sequence
  Synthetic oligonucleotide
tgcattgggacgatcgcgccggcct

SEQ ID NO: 699703 - DNA, 25 bp, Artificial sequence
  Synthetic oligonucleotide
tcgtcatgcattgggacgatcgcgc

SEQ ID NO: 699704 - DNA, 25 bp, Artificial sequence
  Synthetic oligonucleotide
tgaccatcgtcatgcattgggacga

SEQ ID NO: 699705 - DNA, 25 bp, Artificial sequence
  Synthetic oligonucleotide
tggtgctgaccatcgtcatgcattg

SEQ ID NO: 699706 - DNA, 25 bp, Artificial sequence
  Synthetic oligonucleotide
gaaggaaagccaggccagccagcag

SEQ ID NO: 699707 - DNA, 25 bp, Artificial sequence
  Synthetic oligonucleotide
gaagaaacctcggacctggcctaca

SEQ ID NO: 699708 - DNA, 25 bp, Artificial sequence
  Synthetic oligonucleotide
aacaagggcttcgagggcatcgcct

SEQ ID NO: 699709 - DNA, 25 bp, Artificial sequence
  Synthetic oligonucleotide
ttaccggcaagcggccgctgctggt

SEQ ID NO: 699710 - DNA, 25 bp, Artificial sequence
  Synthetic oligonucleotide
tcaccgttaccggcaagcggccgct

SEQ ID NO: 699711 - DNA, 25 bp, Artificial sequence
  Synthetic oligonucleotide
ccctgttcaccgttaccggcaagcg

SEQ ID NO: 699712 - DNA, 25 bp, Artificial sequence
  Synthetic oligonucleotide
ccggcaaccaggaccctgttcaccg

SEQ ID NO: 699713 - DNA, 25 bp, Artificial sequence
  Synthetic oligonucleotide
ctacaacccggcaaccaggaccctg

SEQ ID NO: 699714 - DNA, 25 bp, Artificial sequence
  Synthetic oligonucleotide
atctggctgccgggctatcgggtgg

SEQ ID NO: 699715 - DNA, 25 bp, Artificial sequence
  Synthetic oligonucleotide
ctcggacctggcctacaacccggca

SEQ ID NO: 699716 - DNA, 25 bp, Artificial sequence
  Synthetic oligonucleotide
gctgccgggctatcgggtggtgatc

SEQ ID NO: 699717 - DNA, 25 bp, Artificial sequence
  Synthetic oligonucleotide
cagggcctggaggaggaagaaacct

SEQ ID NO: 699718 - DNA, 25 bp, Artificial sequence
  Synthetic oligonucleotide
cgttgcagggcctggaggaggaaga

SEQ ID NO: 699719 - DNA, 25 bp, Artificial sequence
  Synthetic oligonucleotide
ccaagccgttgcagggcctggagga

SEQ ID NO: 699720 - DNA, 25 bp, Artificial sequence
  Synthetic oligonucleotide
tcgacgccaagccgttgcagggcct

SEQ ID NO: 699721 - DNA, 25 bp, Artificial sequence
  Synthetic oligonucleotide
tggtgatcgacgccaagccgttgca

SEQ ID NO: 699722 - DNA, 25 bp, Artificial sequence
  Synthetic oligonucleotide
atcgggtggtgatcgacgccaagcc

SEQ ID NO: 699723 - DNA, 25 bp, Artificial sequence
  Synthetic oligonucleotide
ggccgctgctggtggagctgtcgct

SEQ ID NO: 699724 - DNA, 25 bp, Artificial sequence
  Synthetic oligonucleotide
cctggcctacaacccggcaaccagg

SEQ ID NO: 699725 - DNA, 25 bp, Artificial sequence
  Synthetic oligonucleotide
aagggcgagccggtcagcttcatca

SEQ ID NO: 699726 - DNA, 25 bp, Artificial sequence
  Synthetic oligonucleotide
tggacagcaagatcccgcgcgccga

SEQ ID NO: 699727 - DNA, 25 bp, Artificial sequence
  Synthetic oligonucleotide
aacggcctggacagcaagatcccgc

SEQ ID NO: 699728 - DNA, 25 bp, Artificial sequence
  Synthetic oligonucleotide
ggcttcaacggcctggacagcaaga

SEQ ID NO: 699729 - DNA, 25 bp, Artificial sequence
  Synthetic oligonucleotide
ctcggcggcttcaacggcctggaca

SEQ ID NO: 699730 - DNA, 25 bp, Artificial sequence
  Synthetic oligonucleotide
agcctgctcggcggcttcaacggcc

SEQ ID NO: 699731 - DNA, 25 bp, Artificial sequence
  Synthetic oligonucleotide
ttcatcagcctgctcggcggcttca

SEQ ID NO: 699732 - DNA, 25 bp, Artificial sequence
  Synthetic oligonucleotide
gtgctgtcggccgaatcgcatctgc

SEQ ID NO: 699733 - DNA, 25 bp, Artificial sequence
  Synthetic oligonucleotide
gagccggtcagcttcatcagcctgc

SEQ ID NO: 699734 - DNA, 25 bp, Artificial sequence
  Synthetic oligonucleotide
gcgccgaaggggtggccatcgacga

SEQ ID NO: 699735 - DNA, 25 bp, Artificial sequence
  Synthetic oligonucleotide
gacgagaagggcgagccggtcagct

SEQ ID NO: 699736 - DNA, 25 bp, Artificial sequence
  Synthetic oligonucleotide
gagctggacgagaagggcgagccgg

SEQ ID NO: 699737 - DNA, 25 bp, Artificial sequence
  Synthetic oligonucleotide
ctgctggagctggacgagaagggcg

SEQ ID NO: 699738 - DNA, 25 bp, Artificial sequence
  Synthetic oligonucleotide
catctgctgctggagctggacgaga

SEQ ID NO: 699739 - DNA, 25 bp, Artificial sequence
  Synthetic oligonucleotide
cgaatcgcatctgctgctggagctg

SEQ ID NO: 699740 - DNA, 25 bp, Artificial sequence
  Synthetic oligonucleotide
tattggcaagaagaacaagggcttc

SEQ ID NO: 699741 - DNA, 25 bp, Artificial sequence
  Synthetic oligonucleotide
gtcagcttcatcagcctgctcggcg

SEQ ID NO: 699742 - DNA, 25 bp, Artificial sequence
  Synthetic oligonucleotide
gtcagcgagccgaacctgttctacg

SEQ ID NO: 699743 - DNA, 25 bp, Artificial sequence
  Synthetic oligonucleotide
cgcctggccaccagcgacgccgatt

SEQ ID NO: 699744 - DNA, 25 bp, Artificial sequence
  Synthetic oligonucleotide
cggcgagcgcctggccaccagcgac

SEQ ID NO: 699745 - DNA, 25 bp, Artificial sequence
  Synthetic oligonucleotide
aagagcggcgagcgcctggccacca

SEQ ID NO: 699746 - DNA, 25 bp, Artificial sequence
  Synthetic oligonucleotide
cgcaagaagagcggcgagcgcctgg

SEQ ID NO: 699747 - DNA, 25 bp, Artificial sequence
  Synthetic oligonucleotide
gtgttccgcaagaagagcggcgagc

SEQ ID NO: 699748 - DNA, 25 bp, Artificial sequence
  Synthetic oligonucleotide
ttctacgtgttccgcaagaagagcg

SEQ ID NO: 699749 - DNA, 25 bp, Artificial sequence
  Synthetic oligonucleotide
gcaagatcccgcgcgccgaaggggt

SEQ ID NO: 699750 - DNA, 25 bp, Artificial sequence
  Synthetic oligonucleotide
gagccgaacctgttctacgtgttcc

SEQ ID NO: 699751 - DNA, 25 bp, Artificial sequence
  Synthetic oligonucleotide
tcccgcgcgccgaaggggtggccat

SEQ ID NO: 699752 - DNA, 25 bp, Artificial sequence
  Synthetic oligonucleotide
tacatggtcagcgagccgaacctgt

SEQ ID NO: 699753 - DNA, 25 bp, Artificial sequence
  Synthetic oligonucleotide
accatctacatggtcagcgagccga

SEQ ID NO: 699754 - DNA, 25 bp, Artificial sequence
  Synthetic oligonucleotide
gagggcaccatctacatggtcagcg

SEQ ID NO: 699755 - DNA, 25 bp, Artificial sequence
  Synthetic oligonucleotide
gacgacgagggcaccatctacatgg

SEQ ID NO: 699756 - DNA, 25 bp, Artificial sequence
  Synthetic oligonucleotide
ggccatcgacgacgagggcaccatc

SEQ ID NO: 699757 - DNA, 25 bp, Artificial sequence
  Synthetic oligonucleotide
aggggtggccatcgacgacgagggc

SEQ ID NO: 699758 - DNA, 25 bp, Artificial sequence
  Synthetic oligonucleotide
taccctggtgctgtcggccgaatcg

SEQ ID NO: 699759 - DNA, 25 bp, Artificial sequence
  Synthetic oligonucleotide
aacctgttctacgtgttccgcaaga

SEQ ID NO: 699760 - DNA, 25 bp, Artificial sequence
  Synthetic oligonucleotide
agcagcgtctgttgctgagcaagga

SEQ ID NO: 699761 - DNA, 25 bp, Artificial sequence
  Synthetic oligonucleotide
gctggaagagcgacggcgggccgag

SEQ ID NO: 699762 - DNA, 25 bp, Artificial sequence
  Synthetic oligonucleotide
tgttcagctggaagagcgacggcgg

SEQ ID NO: 699763 - DNA, 25 bp, Artificial sequence
  Synthetic oligonucleotide
tgaccctgttcagctggaagagcga

SEQ ID NO: 699764 - DNA, 25 bp, Artificial sequence
  Synthetic oligonucleotide
atccgatgaccctgttcagctggaa

SEQ ID NO: 699765 - DNA, 25 bp, Artificial sequence
  Synthetic oligonucleotide
agcgcgatccgatgaccctgttcag

SEQ ID NO: 699766 - DNA, 25 bp, Artificial sequence
  Synthetic oligonucleotide
gcaaggagcgcgatccgatgaccct

SEQ ID NO: 699767 - DNA, 25 bp, Artificial sequence
  Synthetic oligonucleotide
tcggccgaatcgcatctgctgctgg

SEQ ID NO: 699768 - DNA, 25 bp, Artificial sequence
  Synthetic oligonucleotide
gtctgttgctgagcaaggagcgcga

SEQ ID NO: 699769 - DNA, 25 bp, Artificial sequence
  Synthetic oligonucleotide
ggccgagcctgagcggggcgatgac

SEQ ID NO: 699770 - DNA, 25 bp, Artificial sequence
  Synthetic oligonucleotide
gcgccagcagcgtctgttgctgagc

SEQ ID NO: 699771 - DNA, 25 bp, Artificial sequence
  Synthetic oligonucleotide
gggatccgcgccagcagcgtctgtt

SEQ ID NO: 699772 - DNA, 25 bp, Artificial sequence
  Synthetic oligonucleotide
atcgcctgggatccgcgccagcagc

SEQ ID NO: 699773 - DNA, 25 bp, Artificial sequence
  Synthetic oligonucleotide
gagggcatcgcctgggatccgcgcc

SEQ ID NO: 699774 - DNA, 25 bp, Artificial sequence
  Synthetic oligonucleotide
ggcttcgagggcatcgcctgggatc

SEQ ID NO: 699775 - DNA, 25 bp, Artificial sequence
  Synthetic oligonucleotide
tcgtcgtgctcgtcggcgtggtgct

SEQ ID NO: 699776 - DNA, 25 bp, Artificial sequence
  Synthetic oligonucleotide
tgctgagcaaggagcgcgatccgat

SEQ ID NO: 699777 - DNA, 25 bp, Artificial sequence
  Synthetic oligonucleotide
gacctgtacatgcgcaacgtctcgg

SEQ ID NO: 699778 - DNA, 25 bp, Artificial sequence
  Synthetic oligonucleotide
cggccataccctggtgctgtcggcc

SEQ ID NO: 699779 - DNA, 25 bp, Artificial sequence
  Synthetic oligonucleotide
gcgtaccggccataccctggtgctg

SEQ ID NO: 699780 - DNA, 25 bp, Artificial sequence
  Synthetic oligonucleotide
cgacccgcgtaccggccataccctg

SEQ ID NO: 699781 - DNA, 25 bp, Artificial sequence
  Synthetic oligonucleotide
agcgtcgacccgcgtaccggccata

SEQ ID NO: 699782 - DNA, 25 bp, Artificial sequence
  Synthetic oligonucleotide
ggccctcagcgtcgacccgcgtacc

SEQ ID NO: 699783 - DNA, 25 bp, Artificial sequence
  Synthetic oligonucleotide
cgtctcggccctcagcgtcgacccg

SEQ ID NO: 699784 - DNA, 25 bp, Artificial sequence
  Synthetic oligonucleotide
agagcgacggcgggccgagcctgag

SEQ ID NO: 699785 - DNA, 25 bp, Artificial sequence
  Synthetic oligonucleotide
tacatgcgcaacgtctcggccctca

SEQ ID NO: 699786 - DNA, 25 bp, Artificial sequence
  Synthetic oligonucleotide
acggcgggccgagcctgagcggggc

SEQ ID NO: 699787 - DNA, 25 bp, Artificial sequence
  Synthetic oligonucleotide
gcgacgacctgtacatgcgcaacgt

SEQ ID NO: 699788 - DNA, 25 bp, Artificial sequence
  Synthetic oligonucleotide
taccgagcgacgacctgtacatgcg

SEQ ID NO: 699789 - DNA, 25 bp, Artificial sequence
  Synthetic oligonucleotide
ccgcgctaccgagcgacgacctgta

SEQ ID NO: 699790 - DNA, 25 bp, Artificial sequence
  Synthetic oligonucleotide
cgatgaccgcgctaccgagcgacga

SEQ ID NO: 699791 - DNA, 25 bp, Artificial sequence
  Synthetic oligonucleotide
gcggggcgatgaccgcgctaccgag

SEQ ID NO: 699792 - DNA, 25 bp, Artificial sequence
  Synthetic oligonucleotide
cctgagcggggcgatgaccgcgcta

SEQ ID NO: 699793 - DNA, 25 bp, Artificial sequence
  Synthetic oligonucleotide
caagaagaacaagggcttcgagggc

SEQ ID NO: 699794 - DNA, 25 bp, Artificial sequence
  Synthetic oligonucleotide
cgcaacgtctcggccctcagcgtcg

SEQ ID NO: 699795 - DNA, 25 bp, Artificial sequence
  Synthetic oligonucleotide
aggaggtcctcgacgcgatctccgg

SEQ ID NO: 699796 - DNA, 25 bp, Artificial sequence
  Synthetic oligonucleotide
accttgcgcgaggtccaggcgaaac

SEQ ID NO: 699797 - DNA, 25 bp, Artificial sequence
  Synthetic oligonucleotide
gacctgaccttgcgcgaggtccagg

SEQ ID NO: 699798 - DNA, 25 bp, Artificial sequence
  Synthetic oligonucleotide
gcgctggacctgaccttgcgcgagg

SEQ ID NO: 699799 - DNA, 25 bp, Artificial sequence
  Synthetic oligonucleotide
gcgccggcgctggacctgaccttgc

SEQ ID NO: 699800 - DNA, 25 bp, Artificial sequence
  Synthetic oligonucleotide
ggctatgcgccggcgctggacctga

SEQ ID NO: 699801 - DNA, 25 bp, Artificial sequence
  Synthetic oligonucleotide
gatctccggctatgcgccggcgctg

SEQ ID NO: 699802 - DNA, 25 bp, Artificial sequence
  Synthetic oligonucleotide
cgtgctgatcggcaagccgctgtcg

SEQ ID NO: 699803 - DNA, 25 bp, Artificial sequence
  Synthetic oligonucleotide
gtcctcgacgcgatctccggctatg

SEQ ID NO: 699804 - DNA, 25 bp, Artificial sequence
  Synthetic oligonucleotide
actgaaggaaaagggcctgccctgg

SEQ ID NO: 699805 - DNA, 25 bp, Artificial sequence
  Synthetic oligonucleotide
accgcgaggaggtcctcgacgcgat

SEQ ID NO: 699806 - DNA, 25 bp, Artificial sequence
  Synthetic oligonucleotide
agccgaaccgcgaggaggtcctcga

SEQ ID NO: 699807 - DNA, 25 bp, Artificial sequence
  Synthetic oligonucleotide
cgcgcaagccgaaccgcgaggaggt

SEQ ID NO: 699808 - DNA, 25 bp, Artificial sequence
  Synthetic oligonucleotide
cgctgtcgcgcaagccgaaccgcga

SEQ ID NO: 699809 - DNA, 25 bp, Artificial sequence
  Synthetic oligonucleotide
gcaagccgctgtcgcgcaagccgaa

SEQ ID NO: 699810 - DNA, 25 bp, Artificial sequence
  Synthetic oligonucleotide
gcatccgcctgaccatcaacggcga

SEQ ID NO: 699811 - DNA, 25 bp, Artificial sequence
  Synthetic oligonucleotide
gacgcgatctccggctatgcgccgg

SEQ ID NO: 699812 - DNA, 25 bp, Artificial sequence
  Synthetic oligonucleotide
ttcgatggcgccggcgtgctgtcgc

SEQ ID NO: 699813 - DNA, 25 bp, Artificial sequence
  Synthetic oligonucleotide
tcggcgtggtgctgaccatcgtcat

SEQ ID NO: 699814 - DNA, 25 bp, Artificial sequence
  Synthetic oligonucleotide
cgaccgacatcggcatccgcctgac

SEQ ID NO: 699815 - DNA, 25 bp, Artificial sequence
  Synthetic oligonucleotide
ccgacccgaccgacatcggcatccg

SEQ ID NO: 699816 - DNA, 25 bp, Artificial sequence
  Synthetic oligonucleotide
cagtttcccgacccgaccgacatcg

SEQ ID NO: 699817 - DNA, 25 bp, Artificial sequence
  Synthetic oligonucleotide
tcgtgaacgccgaccagtttcccga

SEQ ID NO: 699818 - DNA, 25 bp, Artificial sequence
  Synthetic oligonucleotide
tgtcgccgttcgtgaacgccgacca

SEQ ID NO: 699819 - DNA, 25 bp, Artificial sequence
  Synthetic oligonucleotide
cgcgaggtccaggcgaaactgaagg

SEQ ID NO: 699820 - DNA, 25 bp, Artificial sequence
  Synthetic oligonucleotide
ggcgccggcgtgctgtcgccgttcg

SEQ ID NO: 699821 - DNA, 25 bp, Artificial sequence
  Synthetic oligonucleotide
gcgaaactgaaggaaaagggcctgc

SEQ ID NO: 699822 - DNA, 25 bp, Artificial sequence
  Synthetic oligonucleotide
agagcttcgatggcgccggcgtgct

SEQ ID NO: 699823 - DNA, 25 bp, Artificial sequence
  Synthetic oligonucleotide
tggcaaagagcttcgatggcgccgg

SEQ ID NO: 699824 - DNA, 25 bp, Artificial sequence
  Synthetic oligonucleotide
gggagctggcaaagagcttcgatgg

SEQ ID NO: 699825 - DNA, 25 bp, Artificial sequence
  Synthetic oligonucleotide
tgccctgggagctggcaaagagctt

SEQ ID NO: 699826 - DNA, 25 bp, Artificial sequence
  Synthetic oligonucleotide
agggcctgccctgggagctggcaaa

SEQ ID NO: 699827 - DNA, 25 bp, Artificial sequence
  Synthetic oligonucleotide
ggaaaagggcctgccctgggagctg

SEQ ID NO: 699828 - DNA, 25 bp, Artificial sequence
  Synthetic oligonucleotide
aaatcgccgtgctgatcggcaagcc

SEQ ID NO: 699829 - DNA, 25 bp, Artificial sequence
  Synthetic oligonucleotide
ggcgtgctgtcgccgttcgtgaacg

SEQ ID NO: 699830 - DNA, 25 bp, Artificial sequence
  Synthetic oligonucleotide
tccccctgggcaagctggtctgcgt

SEQ ID NO: 699831 - DNA, 25 bp, Artificial sequence
  Synthetic oligonucleotide
caacccggttcccaccgagccgctg

SEQ ID NO: 699832 - DNA, 25 bp, Artificial sequence
  Synthetic oligonucleotide
acacgccaaggaactgaacaacccg

SEQ ID NO: 699833 - DNA, 25 bp, Artificial sequence
  Synthetic oligonucleotide
cgccgaacacgccaaggaactgaac

SEQ ID NO: 699834 - DNA, 25 bp, Artificial sequence
  Synthetic oligonucleotide
caactacgccgaacacgccaaggaa

SEQ ID NO: 699835 - DNA, 25 bp, Artificial sequence
  Synthetic oligonucleotide
cgggcgcaactacgccgaacacgcc

SEQ ID NO: 699836 - DNA, 25 bp, Artificial sequence
  Synthetic oligonucleotide
ctgcgtcgggcgcaactacgccgaa

SEQ ID NO: 699837 - DNA, 25 bp, Artificial sequence
  Synthetic oligonucleotide
gatcggcaagccgctgtcgcgcaag

SEQ ID NO: 699838 - DNA, 25 bp, Artificial sequence
  Synthetic oligonucleotide
tgggcaagctggtctgcgtcgggcg

SEQ ID NO: 699839 - DNA, 25 bp, Artificial sequence
  Synthetic oligonucleotide
agccgctgctgttcatcaagcccgg

SEQ ID NO: 699840 - DNA, 25 bp, Artificial sequence
  Synthetic oligonucleotide
ccacttccccctgggcaagctggtc

SEQ ID NO: 699841 - DNA, 25 bp, Artificial sequence
  Synthetic oligonucleotide
cccgatccacttccccctgggcaag

SEQ ID NO: 699842 - DNA, 25 bp, Artificial sequence
  Synthetic oligonucleotide
cggcaccccgatccacttccccctg

SEQ ID NO: 699843 - DNA, 25 bp, Artificial sequence
  Synthetic oligonucleotide
atatcgacggcaccccgatccactt

SEQ ID NO: 699844 - DNA, 25 bp, Artificial sequence
  Synthetic oligonucleotide
tcaatatatcgacggcaccccgatc

SEQ ID NO: 699845 - DNA, 25 bp, Artificial sequence
  Synthetic oligonucleotide
ccagcatcaatatatcgacggcacc

SEQ ID NO: 699846 - DNA, 25 bp, Artificial sequence
  Synthetic oligonucleotide
agctggtctgcgtcgggcgcaacta

SEQ ID NO: 699847 - DNA, 25 bp, Artificial sequence
  Synthetic oligonucleotide
tgagcggcgggctgagcctgccgca

SEQ ID NO: 699848 - DNA, 25 bp, Artificial sequence
  Synthetic oligonucleotide
aggcggaaatcgccgtgctgatcgg

SEQ ID NO: 699849 - DNA, 25 bp, Artificial sequence
  Synthetic oligonucleotide
actacgaggcggaaatcgccgtgct

SEQ ID NO: 699850 - DNA, 25 bp, Artificial sequence
  Synthetic oligonucleotide
cggtacactacgaggcggaaatcgc

SEQ ID NO: 699851 - DNA, 25 bp, Artificial sequence
  Synthetic oligonucleotide
gcggctcggtacactacgaggcgga

SEQ ID NO: 699852 - DNA, 25 bp, Artificial sequence
  Synthetic oligonucleotide
aggagcgcggctcggtacactacga

SEQ ID NO: 699853 - DNA, 25 bp, Artificial sequence
  Synthetic oligonucleotide
tgccgcaggagcgcggctcggtaca

SEQ ID NO: 699854 - DNA, 25 bp, Artificial sequence
  Synthetic oligonucleotide
ggttcccaccgagccgctgctgttc

SEQ ID NO: 699855 - DNA, 25 bp, Artificial sequence
  Synthetic oligonucleotide
gcgggctgagcctgccgcaggagcg

SEQ ID NO: 699856 - DNA, 25 bp, Artificial sequence
  Synthetic oligonucleotide
caccgagccgctgctgttcatcaag

SEQ ID NO: 699857 - DNA, 25 bp, Artificial sequence
  Synthetic oligonucleotide
tgccggtgagcggcgggctgagcct

SEQ ID NO: 699858 - DNA, 25 bp, Artificial sequence
  Synthetic oligonucleotide
cgtggtgccggtgagcggcgggctg

SEQ ID NO: 699859 - DNA, 25 bp, Artificial sequence
  Synthetic oligonucleotide
ctcctgcgtggtgccggtgagcggc

SEQ ID NO: 699860 - DNA, 25 bp, Artificial sequence
  Synthetic oligonucleotide
gcccggctcctgcgtggtgccggtg

SEQ ID NO: 699861 - DNA, 25 bp, Artificial sequence
  Synthetic oligonucleotide
catcaagcccggctcctgcgtggtg

SEQ ID NO: 699862 - DNA, 25 bp, Artificial sequence
  Synthetic oligonucleotide
tgctgttcatcaagcccggctcctg

SEQ ID NO: 699863 - DNA, 25 bp, Artificial sequence
  Synthetic oligonucleotide
gcctgaccatcaacggcgaggtgcg

SEQ ID NO: 699864 - DNA, 25 bp, Artificial sequence
  Synthetic oligonucleotide
tgagcctgccgcaggagcgcggctc

SEQ ID NO: 699865 - DNA, 25 bp, Artificial sequence
  Synthetic oligonucleotide
gcagcggaaacgactgtcggtcggc

SEQ ID NO: 699866 - DNA, 25 bp, Artificial sequence
  Synthetic oligonucleotide
cggcgttctggtggacaccttcgag

SEQ ID NO: 699867 - DNA, 25 bp, Artificial sequence
  Synthetic oligonucleotide
acaggccgggggcaatgccctttca

SEQ ID NO: 699868 - DNA, 25 bp, Artificial sequence
  Synthetic oligonucleotide
cgattgacaggccgggggcaatgcc

SEQ ID NO: 699869 - DNA, 25 bp, Artificial sequence
  Synthetic oligonucleotide
acgcttcgattgacaggccgggggc

SEQ ID NO: 699870 - DNA, 25 bp, Artificial sequence
  Synthetic oligonucleotide
tggccgacgcttcgattgacaggcc

SEQ ID NO: 699871 - DNA, 25 bp, Artificial sequence
  Synthetic oligonucleotide
gtcggctggccgacgcttcgattga

SEQ ID NO: 699872 - DNA, 25 bp, Artificial sequence
  Synthetic oligonucleotide
aaccgctgcggccgccgggtgcggc

SEQ ID NO: 699873 - DNA, 25 bp, Artificial sequence
  Synthetic oligonucleotide
aaacgactgtcggtcggctggccga

SEQ ID NO: 699874 - DNA, 25 bp, Artificial sequence
  Synthetic oligonucleotide
tggcgacgcccaagaaaacacctgg

SEQ ID NO: 699875 - DNA, 25 bp, Artificial sequence
  Synthetic oligonucleotide
gcgccggcagcggaaacgactgtcg

SEQ ID NO: 699876 - DNA, 25 bp, Artificial sequence
  Synthetic oligonucleotide
tccctagcgccggcagcggaaacga

SEQ ID NO: 699877 - DNA, 25 bp, Artificial sequence
  Synthetic oligonucleotide
ccggcctccctagcgccggcagcgg

SEQ ID NO: 699878 - DNA, 25 bp, Artificial sequence
  Synthetic oligonucleotide
gtgcggccggcctccctagcgccgg

SEQ ID NO: 699879 - DNA, 25 bp, Artificial sequence
  Synthetic oligonucleotide
cgccgggtgcggccggcctccctag

SEQ ID NO: 699880 - DNA, 25 bp, Artificial sequence
  Synthetic oligonucleotide
acatcggcatccgcctgaccatcaa

SEQ ID NO: 699881 - DNA, 25 bp, Artificial sequence
  Synthetic oligonucleotide
ctgtcggtcggctggccgacgcttc

SEQ ID NO: 699882 - DNA, 25 bp, Artificial sequence
  Synthetic oligonucleotide
cccatgtcccttgcctccaagcttc

SEQ ID NO: 699883 - DNA, 25 bp, Artificial sequence
  Synthetic oligonucleotide
gagttaccagcatcaatatatcgac

SEQ ID NO: 699884 - DNA, 25 bp, Artificial sequence
  Synthetic oligonucleotide
cggcgttcgtcgtgctcgtcggcgt

SEQ ID NO: 699885 - DNA, 25 bp, Artificial sequence
  Synthetic oligonucleotide
tgctgccggcgttcgtcgtgctcgt

SEQ ID NO: 699886 - DNA, 25 bp, Artificial sequence
  Synthetic oligonucleotide
gctggctgctgccggcgttcgtcgt

SEQ ID NO: 699887 - DNA, 25 bp, Artificial sequence
  Synthetic oligonucleotide
gtttccgctggctgctgccggcgtt

SEQ ID NO: 699888 - DNA, 25 bp, Artificial sequence
  Synthetic oligonucleotide
tccccgtttccgctggctgctgccg

SEQ ID NO: 699889 - DNA, 25 bp, Artificial sequence
  Synthetic oligonucleotide
aatgccctttcatggcgacgcccaa

SEQ ID NO: 699890 - DNA, 25 bp, Artificial sequence
  Synthetic oligonucleotide
tgcctccaagcttccccgtttccgc

SEQ ID NO: 699891 - DNA, 25 bp, Artificial sequence
  Synthetic oligonucleotide
atcatttgagagttcccgaatgacc

SEQ ID NO: 699892 - DNA, 25 bp, Artificial sequence
  Synthetic oligonucleotide
gcctcgcccatgtcccttgcctcca

SEQ ID NO: 699893 - DNA, 25 bp, Artificial sequence
  Synthetic oligonucleotide
agtcgagcctcgcccatgtcccttg

SEQ ID NO: 699894 - DNA, 25 bp, Artificial sequence
  Synthetic oligonucleotide
ccaaacagtcgagcctcgcccatgt

SEQ ID NO: 699895 - DNA, 25 bp, Artificial sequence
  Synthetic oligonucleotide
acctggccaaacagtcgagcctcgc

SEQ ID NO: 699896 - DNA, 25 bp, Artificial sequence
  Synthetic oligonucleotide
gaaaacacctggccaaacagtcgag

SEQ ID NO: 699897 - DNA, 25 bp, Artificial sequence
  Synthetic oligonucleotide
gcccaagaaaacacctggccaaaca

SEQ ID NO: 699898 - DNA, 25 bp, Artificial sequence
  Synthetic oligonucleotide
ctctgaaccgctgcggccgccgggt

SEQ ID NO: 699899 - DNA, 25 bp, Artificial sequence
  Synthetic oligonucleotide
caagcttccccgtttccgctggctg

SEQ ID NO: 699900 - DNA, 25 bp, Artificial sequence
  Synthetic oligonucleotide
gacatgctcaatccgatcgtgccgc

SEQ ID NO: 699901 - DNA, 25 bp, Artificial sequence
  Synthetic oligonucleotide
ttctcgctacaggccggcgatgtgg

SEQ ID NO: 699902 - DNA, 25 bp, Artificial sequence
  Synthetic oligonucleotide
ggcatttctcgctacaggccggcga

SEQ ID NO: 699903 - DNA, 25 bp, Artificial sequence
  Synthetic oligonucleotide
tcgccgggcatttctcgctacaggc

SEQ ID NO: 699904 - DNA, 25 bp, Artificial sequence
  Synthetic oligonucleotide
agcacatcgccgggcatttctcgct

SEQ ID NO: 699905 - DNA, 25 bp, Artificial sequence
  Synthetic oligonucleotide
tgatccagcacatcgccgggcattt

SEQ ID NO: 699906 - DNA, 25 bp, Artificial sequence
  Synthetic oligonucleotide
tgccgctgatccagcacatcgccgg

SEQ ID NO: 699907 - DNA, 25 bp, Artificial sequence
  Synthetic oligonucleotide
tgcggccgccgggtgcggccggcct

SEQ ID NO: 699908 - DNA, 25 bp, Artificial sequence
  Synthetic oligonucleotide
tcaatccgatcgtgccgctgatcca

SEQ ID NO: 699909 - DNA, 25 bp, Artificial sequence
  Synthetic oligonucleotide
gatgtggtgctgaccggcacgccgt

SEQ ID NO: 699910 - DNA, 25 bp, Artificial sequence
  Synthetic oligonucleotide
agccgcgacatgctcaatccgatcg

SEQ ID NO: 699911 - DNA, 25 bp, Artificial sequence
  Synthetic oligonucleotide
cggcaacagccgcgacatgctcaat

SEQ ID NO: 699912 - DNA, 25 bp, Artificial sequence
  Synthetic oligonucleotide
gccaggacggcaacagccgcgacat

SEQ ID NO: 699913 - DNA, 25 bp, Artificial sequence
  Synthetic oligonucleotide
aggtgcgccaggacggcaacagccg

SEQ ID NO: 699914 - DNA, 25 bp, Artificial sequence
  Synthetic oligonucleotide
acggcgaggtgcgccaggacggcaa

SEQ ID NO: 699915 - DNA, 25 bp, Artificial sequence
  Synthetic oligonucleotide
ccatcaacggcgaggtgcgccagga

SEQ ID NO: 699916 - DNA, 25 bp, Artificial sequence
  Synthetic oligonucleotide
cgatcgtgccgctgatccagcacat

SEQ ID NO: 699917 - DNA, 25 bp, Artificial sequence
  Synthetic oligonucleotide
gcgacgagttgctgctcgaattgcc

SEQ ID NO: 699918 - DNA, 25 bp, Artificial sequence
  Synthetic oligonucleotide
cgcgtgctctgaaccgctgcggccg

SEQ ID NO: 699919 - DNA, 25 bp, Artificial sequence
  Synthetic oligonucleotide
gagacccgcgtgctctgaaccgctg

SEQ ID NO: 699920 - DNA, 25 bp, Artificial sequence
  Synthetic oligonucleotide
cgtttcgagacccgcgtgctctgaa

SEQ ID NO: 699921 - DNA, 25 bp, Artificial sequence
  Synthetic oligonucleotide
ccagccgtttcgagacccgcgtgct

SEQ ID NO: 699922 - DNA, 25 bp, Artificial sequence
  Synthetic oligonucleotide
cgggcgccagccgtttcgagacccg

SEQ ID NO: 699923 - DNA, 25 bp, Artificial sequence
  Synthetic oligonucleotide
aattgccgggcgccagccgtttcga

SEQ ID NO: 699924 - DNA, 25 bp, Artificial sequence
  Synthetic oligonucleotide
ctacaggccggcgatgtggtgctga

SEQ ID NO: 699925 - DNA, 25 bp, Artificial sequence
  Synthetic oligonucleotide
agttgctgctcgaattgccgggcgc

SEQ ID NO: 699926 - DNA, 25 bp, Artificial sequence
  Synthetic oligonucleotide
gccggcgatgtggtgctgaccggca

SEQ ID NO: 699927 - DNA, 25 bp, Artificial sequence
  Synthetic oligonucleotide
aacagcggcgacgagttgctgctcg

SEQ ID NO: 699928 - DNA, 25 bp, Artificial sequence
  Synthetic oligonucleotide
ccgctgaacagcggcgacgagttgc

SEQ ID NO: 699929 - DNA, 25 bp, Artificial sequence
  Synthetic oligonucleotide
ggtcgggccgctgaacagcggcgac

SEQ ID NO: 699930 - DNA, 25 bp, Artificial sequence
  Synthetic oligonucleotide
gtccggggtcgggccgctgaacagc

SEQ ID NO: 699931 - DNA, 25 bp, Artificial sequence
  Synthetic oligonucleotide
cacgccgtccggggtcgggccgctg

SEQ ID NO: 699932 - DNA, 25 bp, Artificial sequence
  Synthetic oligonucleotide
ggtgctgaccggcacgccgtccggg

SEQ ID NO: 699933 - DNA, 25 bp, Artificial sequence
  Synthetic oligonucleotide
tgctcgtcggcgtggtgctgaccat

SEQ ID NO: 699934 - DNA, 25 bp, Artificial sequence
  Synthetic oligonucleotide
tgctcgaattgccgggcgccagccg

SEQ ID NO: 699935 - DNA, 25 bp, Artificial sequence
  Synthetic oligonucleotide
cccttgaggtcttccagcgacttga

SEQ ID NO: 699936 - DNA, 25 bp, Artificial sequence
  Synthetic oligonucleotide
ggcttcgcagtggaaatcgctgtgc

SEQ ID NO: 699937 - DNA, 25 bp, Artificial sequence
  Synthetic oligonucleotide
cggcgcgcacgatcaactgggcgct

SEQ ID NO: 699938 - DNA, 25 bp, Artificial sequence
  Synthetic oligonucleotide
tttcgtcggcgcgcacgatcaactg

SEQ ID NO: 699939 - DNA, 25 bp, Artificial sequence
  Synthetic oligonucleotide
ggcgggtttcgtcggcgcgcacgat

SEQ ID NO: 699940 - DNA, 25 bp, Artificial sequence
  Synthetic oligonucleotide
gaactggcgggtttcgtcggcgcgc

SEQ ID NO: 699941 - DNA, 25 bp, Artificial sequence
  Synthetic oligonucleotide
cgacttgaactggcgggtttcgtcg

SEQ ID NO: 699942 - DNA, 25 bp, Artificial sequence
  Synthetic oligonucleotide
caactgggcgctggagatggtgtat

SEQ ID NO: 699943 - DNA, 25 bp, Artificial sequence
  Synthetic oligonucleotide
aggtcttccagcgacttgaactggc

SEQ ID NO: 699944 - DNA, 25 bp, Artificial sequence
  Synthetic oligonucleotide
ggcgctggagatggtgtatggctcg

SEQ ID NO: 699945 - DNA, 25 bp, Artificial sequence
  Synthetic oligonucleotide
ttgaggcccttgaggtcttccagcg

SEQ ID NO: 699946 - DNA, 25 bp, Artificial sequence
  Synthetic oligonucleotide
ccgagcttgaggcccttgaggtctt

SEQ ID NO: 699947 - DNA, 25 bp, Artificial sequence
  Synthetic oligonucleotide
ccgacgccgagcttgaggcccttga

SEQ ID NO: 699948 - DNA, 25 bp, Artificial sequence
  Synthetic oligonucleotide
ccctggccgacgccgagcttgaggc

SEQ ID NO: 699949 - DNA, 25 bp, Artificial sequence
  Synthetic oligonucleotide
ttggtgccctggccgacgccgagct

SEQ ID NO: 699950 - DNA, 25 bp, Artificial sequence
  Synthetic oligonucleotide
gcgtagttggtgccctggccgacgc

SEQ ID NO: 699951 - DNA, 25 bp, Artificial sequence
  Synthetic oligonucleotide
tccagcgacttgaactggcgggttt

SEQ ID NO: 699952 - DNA, 25 bp, Artificial sequence
  Synthetic oligonucleotide
ttgcgccgctgctcgttcaccgaga

SEQ ID NO: 699953 - DNA, 25 bp, Artificial sequence
  Synthetic oligonucleotide
ttgccgctctgcaggccggcgagga

SEQ ID NO: 699954 - DNA, 25 bp, Artificial sequence
  Synthetic oligonucleotide
tcgtacttgccgctctgcaggccgg

SEQ ID NO: 699955 - DNA, 25 bp, Artificial sequence
  Synthetic oligonucleotide
cgcgatgtcgtacttgccgctctgc

SEQ ID NO: 699956 - DNA, 25 bp, Artificial sequence
  Synthetic oligonucleotide
ttcagcgcgatgtcgtacttgccgc

SEQ ID NO: 699957 - DNA, 25 bp, Artificial sequence
  Synthetic oligonucleotide
acctggttcagcgcgatgtcgtact

SEQ ID NO: 699958 - DNA, 25 bp, Artificial sequence
  Synthetic oligonucleotide
accgagacctggttcagcgcgatgt

SEQ ID NO: 699959 - DNA, 25 bp, Artificial sequence
  Synthetic oligonucleotide
cacgatcaactgggcgctggagatg

SEQ ID NO: 699960 - DNA, 25 bp, Artificial sequence
  Synthetic oligonucleotide
cgctgctcgttcaccgagacctggt

SEQ ID NO: 699961 - DNA, 25 bp, Artificial sequence
  Synthetic oligonucleotide
accgacttcgccaggtcggcgtagt

SEQ ID NO: 699962 - DNA, 25 bp, Artificial sequence
  Synthetic oligonucleotide
aagaccttgcgccgctgctcgttca

SEQ ID NO: 699963 - DNA, 25 bp, Artificial sequence
  Synthetic oligonucleotide
agtcgaagaccttgcgccgctgctc

SEQ ID NO: 699964 - DNA, 25 bp, Artificial sequence
  Synthetic oligonucleotide
gctgaagtcgaagaccttgcgccgc

SEQ ID NO: 699965 - DNA, 25 bp, Artificial sequence
  Synthetic oligonucleotide
tggctcgctgaagtcgaagaccttg

SEQ ID NO: 699966 - DNA, 25 bp, Artificial sequence
  Synthetic oligonucleotide
ggtgtatggctcgctgaagtcgaag

SEQ ID NO: 699967 - DNA, 25 bp, Artificial sequence
  Synthetic oligonucleotide
ggagatggtgtatggctcgctgaag

SEQ ID NO: 699968 - DNA, 25 bp, Artificial sequence
  Synthetic oligonucleotide
tcgttcaccgagacctggttcagcg

SEQ ID NO: 699969 - DNA, 25 bp, Artificial sequence
  Synthetic oligonucleotide
cggtcccaccgccgcgccgggcttg

SEQ ID NO: 699970 - DNA, 25 bp, Artificial sequence
  Synthetic oligonucleotide
ggcgaaggggatcagcaggcggtcg

SEQ ID NO: 699971 - DNA, 25 bp, Artificial sequence
  Synthetic oligonucleotide
gcggatggcgaaggggatcagcagg

SEQ ID NO: 699972 - DNA, 25 bp, Artificial sequence
  Synthetic oligonucleotide
tggcctcgcggatggcgaaggggat

SEQ ID NO: 699973 - DNA, 25 bp, Artificial sequence
  Synthetic oligonucleotide
gcagcttggcctcgcggatggcgaa

SEQ ID NO: 699974 - DNA, 25 bp, Artificial sequence
  Synthetic oligonucleotide
tgaccggcagcttggcctcgcggat

SEQ ID NO: 699975 - DNA, 25 bp, Artificial sequence
  Synthetic oligonucleotide
gggcttgaccggcagcttggcctcg

SEQ ID NO: 699976 - DNA, 25 bp, Artificial sequence
  Synthetic oligonucleotide
caggtcggcgtagttggtgccctgg

SEQ ID NO: 699977 - DNA, 25 bp, Artificial sequence
  Synthetic oligonucleotide
accgccgcgccgggcttgaccggca

SEQ ID NO: 699978 - DNA, 25 bp, Artificial sequence
  Synthetic oligonucleotide
ggcggtcgttgagcgccgcgtcgat

SEQ ID NO: 699979 - DNA, 25 bp, Artificial sequence
  Synthetic oligonucleotide
ttcgccaccggtcccaccgccgcgc

SEQ ID NO: 699980 - DNA, 25 bp, Artificial sequence
  Synthetic oligonucleotide
gccatgttcgccaccggtcccaccg

SEQ ID NO: 699981 - DNA, 25 bp, Artificial sequence
  Synthetic oligonucleotide
ggaatcgccatgttcgccaccggtc

SEQ ID NO: 699982 - DNA, 25 bp, Artificial sequence
  Synthetic oligonucleotide
ggtagggaatcgccatgttcgccac

SEQ ID NO: 699983 - DNA, 25 bp, Artificial sequence
  Synthetic oligonucleotide
tcttccggtagggaatcgccatgtt

SEQ ID NO: 699984 - DNA, 25 bp, Artificial sequence
  Synthetic oligonucleotide
gattgttcttccggtagggaatcgc

SEQ ID NO: 699985 - DNA, 25 bp, Artificial sequence
  Synthetic oligonucleotide
gcgccgggcttgaccggcagcttgg

SEQ ID NO: 699986 - DNA, 25 bp, Artificial sequence
  Synthetic oligonucleotide
gcaggtattccggggcgcccggata

SEQ ID NO: 699987 - DNA, 25 bp, Artificial sequence
  Synthetic oligonucleotide
cgaggatgccgctccattcggtggt

SEQ ID NO: 699988 - DNA, 25 bp, Artificial sequence
  Synthetic oligonucleotide
ccggccaccgacttcgccaggtcgg

SEQ ID NO: 699989 - DNA, 25 bp, Artificial sequence
  Synthetic oligonucleotide
ttgacgccggccaccgacttcgcca

SEQ ID NO: 699990 - DNA, 25 bp, Artificial sequence
  Synthetic oligonucleotide
cgcacgttgacgccggccaccgact

SEQ ID NO: 699991 - DNA, 25 bp, Artificial sequence
  Synthetic oligonucleotide
aggtgcgcacgttgacgccggccac

SEQ ID NO: 699992 - DNA, 25 bp, Artificial sequence
  Synthetic oligonucleotide
ccggataggtgcgcacgttgacgcc

SEQ ID NO: 699993 - DNA, 25 bp, Artificial sequence
  Synthetic oligonucleotide
ggggatcagcaggcggtcgttgagc

SEQ ID NO: 699994 - DNA, 25 bp, Artificial sequence
  Synthetic oligonucleotide
attccggggcgcccggataggtgcg

SEQ ID NO: 699995 - DNA, 25 bp, Artificial sequence
  Synthetic oligonucleotide
cagcaggcggtcgttgagcgccgcg

SEQ ID NO: 699996 - DNA, 25 bp, Artificial sequence
  Synthetic oligonucleotide
aggtcctgcaggtattccggggcgc

SEQ ID NO: 699997 - DNA, 25 bp, Artificial sequence
  Synthetic oligonucleotide
gctggccaggtcctgcaggtattcc

SEQ ID NO: 699998 - DNA, 25 bp, Artificial sequence
  Synthetic oligonucleotide
gcgtttgctggccaggtcctgcagg

SEQ ID NO: 699999 - DNA, 25 bp, Artificial sequence
  Synthetic oligonucleotide
gtcgatgcgtttgctggccaggtcc

SEQ ID NO: 700000 - DNA, 25 bp, Artificial sequence
  Synthetic oligonucleotide
cgccgcgtcgatgcgtttgctggcc

SEQ ID NO: 700001 - DNA, 25 bp, Artificial sequence
  Synthetic oligonucleotide
gttgagcgccgcgtcgatgcgtttg

SEQ ID NO: 700002 - DNA, 25 bp, Artificial sequence
  Synthetic oligonucleotide
ttcgccaggtcggcgtagttggtgc

SEQ ID NO: 700003 - DNA, 25 bp, Artificial sequence
  Synthetic oligonucleotide
gggcgcccggataggtgcgcacgtt

SEQ ID NO: 700004 - DNA, 25 bp, Artificial sequence
  Synthetic oligonucleotide
tactcctcgggtgggaatgaacgtc

SEQ ID NO: 700005 - DNA, 25 bp, Artificial sequence
  Synthetic oligonucleotide
cagcttagccgggcccgcgtcctgg

SEQ ID NO: 700006 - DNA, 25 bp, Artificial sequence
  Synthetic oligonucleotide
ttcgttcagcttagccgggcccgcg

SEQ ID NO: 700007 - DNA, 25 bp, Artificial sequence
  Synthetic oligonucleotide
atgctgttcgttcagcttagccggg

SEQ ID NO: 700008 - DNA, 25 bp, Artificial sequence
  Synthetic oligonucleotide
gggcctatgctgttcgttcagctta

SEQ ID NO: 700009 - DNA, 25 bp, Artificial sequence
  Synthetic oligonucleotide
tcggtcgggcctatgctgttcgttc

SEQ ID NO: 700010 - DNA, 25 bp, Artificial sequence
  Synthetic oligonucleotide
tgaacgtcggtcgggcctatgctgt

SEQ ID NO: 700011 - DNA, 25 bp, Artificial sequence
  Synthetic oligonucleotide
agggataccagcatcagcaggcggg

SEQ ID NO: 700012 - DNA, 25 bp, Artificial sequence
  Synthetic oligonucleotide
ctcgggtgggaatgaacgtcggtcg

SEQ ID NO: 700013 - DNA, 25 bp, Artificial sequence
  Synthetic oligonucleotide
gtcctggacaatcgcgaacctactg

SEQ ID NO: 700014 - DNA, 25 bp, Artificial sequence
  Synthetic oligonucleotide
atgtagtactcctcgggtgggaatg

SEQ ID NO: 700015 - DNA, 25 bp, Artificial sequence
  Synthetic oligonucleotide
aatcgcatgtagtactcctcgggtg

SEQ ID NO: 700016 - DNA, 25 bp, Artificial sequence
  Synthetic oligonucleotide
ggcagaaatcgcatgtagtactcct

SEQ ID NO: 700017 - DNA, 25 bp, Artificial sequence
  Synthetic oligonucleotide
aggcggggcagaaatcgcatgtagt

SEQ ID NO: 700018 - DNA, 25 bp, Artificial sequence
  Synthetic oligonucleotide
atcagcaggcggggcagaaatcgca

SEQ ID NO: 700019 - DNA, 25 bp, Artificial sequence
  Synthetic oligonucleotide
gctctgcaggccggcgaggatgccg

SEQ ID NO: 700020 - DNA, 25 bp, Artificial sequence
  Synthetic oligonucleotide
tgggaatgaacgtcggtcgggccta

SEQ ID NO: 700021 - DNA, 25 bp, Artificial sequence
  Synthetic oligonucleotide
tttccaggggttgcgggcattgacc

SEQ ID NO: 700022 - DNA, 25 bp, Artificial sequence
  Synthetic oligonucleotide
taacacgggcttcgcagtggaaatc

SEQ ID NO: 700023 - DNA, 25 bp, Artificial sequence
  Synthetic oligonucleotide
cgctctaacacgggcttcgcagtgg

SEQ ID NO: 700024 - DNA, 25 bp, Artificial sequence
  Synthetic oligonucleotide
gagcgccgctctaacacgggcttcg

SEQ ID NO: 700025 - DNA, 25 bp, Artificial sequence
  Synthetic oligonucleotide
tgcgcgagcgccgctctaacacggg

SEQ ID NO: 700026 - DNA, 25 bp, Artificial sequence
  Synthetic oligonucleotide
gattatgtgcgcgagcgccgctcta

SEQ ID NO: 700027 - DNA, 25 bp, Artificial sequence
  Synthetic oligonucleotide
tgacccggattatgtgcgcgagcgc

SEQ ID NO: 700028 - DNA, 25 bp, Artificial sequence
  Synthetic oligonucleotide
agccgggcccgcgtcctggacaatc

SEQ ID NO: 700029 - DNA, 25 bp, Artificial sequence
  Synthetic oligonucleotide
gggttgcgggcattgacccggatta

SEQ ID NO: 700030 - DNA, 25 bp, Artificial sequence
  Synthetic oligonucleotide
gcccgcgtcctggacaatcgcgaac

SEQ ID NO: 700031 - DNA, 25 bp, Artificial sequence
  Synthetic oligonucleotide
cggtctttccaggggttgcgggcat

SEQ ID NO: 700032 - DNA, 25 bp, Artificial sequence
  Synthetic oligonucleotide
tgcatgcggtctttccaggggttgc

SEQ ID NO: 700033 - DNA, 25 bp, Artificial sequence
  Synthetic oligonucleotide
tgggttgcatgcggtctttccaggg

SEQ ID NO: 700034 - DNA, 25 bp, Artificial sequence
  Synthetic oligonucleotide
cctactgggttgcatgcggtctttc

SEQ ID NO: 700035 - DNA, 25 bp, Artificial sequence
  Synthetic oligonucleotide
cgcgaacctactgggttgcatgcgg

SEQ ID NO: 700036 - DNA, 25 bp, Artificial sequence
  Synthetic oligonucleotide
gacaatcgcgaacctactgggttgc

SEQ ID NO: 700037 - DNA, 25 bp, Artificial sequence
  Synthetic oligonucleotide
gcggccagggataccagcatcagca

SEQ ID NO: 700038 - DNA, 25 bp, Artificial sequence
  Synthetic oligonucleotide
gggcattgacccggattatgtgcgc

SEQ ID NO: 700039 - DNA, 25 bp, Artificial sequence
  Synthetic oligonucleotide
ttgaccgccagttcggcggccagca

SEQ ID NO: 700040 - DNA, 25 bp, Artificial sequence
  Synthetic oligonucleotide
agccggtgagcttgccaccctgctt

SEQ ID NO: 700041 - DNA, 25 bp, Artificial sequence
  Synthetic oligonucleotide
tctcgaagccggtgagcttgccacc

SEQ ID NO: 700042 - DNA, 25 bp, Artificial sequence
  Synthetic oligonucleotide
ttcggtctcgaagccggtgagcttg

SEQ ID NO: 700043 - DNA, 25 bp, Artificial sequence
  Synthetic oligonucleotide
cccagttcggtctcgaagccggtga

SEQ ID NO: 700044 - DNA, 25 bp, Artificial sequence
  Synthetic oligonucleotide
agttcgcccagttcggtctcgaagc

SEQ ID NO: 700045 - DNA, 25 bp, Artificial sequence
  Synthetic oligonucleotide
gccagcagttcgcccagttcggtct

SEQ ID NO: 700046 - DNA, 25 bp, Artificial sequence
  Synthetic oligonucleotide
accagcatcagcaggcggggcagaa

SEQ ID NO: 700047 - DNA, 25 bp, Artificial sequence
  Synthetic oligonucleotide
gccagttcggcggccagcagttcgc

SEQ ID NO: 700048 - DNA, 25 bp, Artificial sequence
  Synthetic oligonucleotide
ctgcttgaagttgaacggcggatag

SEQ ID NO: 700049 - DNA, 25 bp, Artificial sequence
  Synthetic oligonucleotide
ttcaggcttgaccgccagttcggcg

SEQ ID NO: 700050 - DNA, 25 bp, Artificial sequence
  Synthetic oligonucleotide
gacgaattcaggcttgaccgccagt

SEQ ID NO: 700051 - DNA, 25 bp, Artificial sequence
  Synthetic oligonucleotide
cggtggtgacgaattcaggcttgac

SEQ ID NO: 700052 - DNA, 25 bp, Artificial sequence
  Synthetic oligonucleotide
tccattcggtggtgacgaattcagg

SEQ ID NO: 700053 - DNA, 25 bp, Artificial sequence
  Synthetic oligonucleotide
tgccgctccattcggtggtgacgaa

SEQ ID NO: 700054 - DNA, 25 bp, Artificial sequence
  Synthetic oligonucleotide
gcgttcagcgcctcgccgaacttcg

SEQ ID NO: 700055 - DNA, 25 bp, Artificial sequence
  Synthetic oligonucleotide
tcggcggccagcagttcgcccagtt

SEQ ID NO: 700056 - DNA, 25 bp, Artificial sequence
  Synthetic oligonucleotide
cgcagggcgccgcgctggtggacgt

SEQ ID NO: 700057 - DNA, 25 bp, Artificial sequence
  Synthetic oligonucleotide
agcggagcggccagggataccagca

SEQ ID NO: 700058 - DNA, 25 bp, Artificial sequence
  Synthetic oligonucleotide
tgggccagcggagcggccagggata

SEQ ID NO: 700059 - DNA, 25 bp, Artificial sequence
  Synthetic oligonucleotide
tcggcatgggccagcggagcggcca

SEQ ID NO: 700060 - DNA, 25 bp, Artificial sequence
  Synthetic oligonucleotide
agcagctcggcatgggccagcggag

SEQ ID NO: 700061 - DNA, 25 bp, Artificial sequence
  Synthetic oligonucleotide
tcgtcgagcagctcggcatgggcca

SEQ ID NO: 700062 - DNA, 25 bp, Artificial sequence
  Synthetic oligonucleotide
tggacgtcgtcgagcagctcggcat

SEQ ID NO: 700063 - DNA, 25 bp, Artificial sequence
  Synthetic oligonucleotide
gagcttgccaccctgcttgaagttg

SEQ ID NO: 700064 - DNA, 25 bp, Artificial sequence
  Synthetic oligonucleotide
gcgccgcgctggtggacgtcgtcga

SEQ ID NO: 700065 - DNA, 25 bp, Artificial sequence
  Synthetic oligonucleotide
gccaccctgcttgaagttgaacggc

SEQ ID NO: 700066 - DNA, 25 bp, Artificial sequence
  Synthetic oligonucleotide
gcgatgcgcagggcgccgcgctggt

SEQ ID NO: 700067 - DNA, 25 bp, Artificial sequence
  Synthetic oligonucleotide
tccagggcgatgcgcagggcgccgc

SEQ ID NO: 700068 - DNA, 25 bp, Artificial sequence
  Synthetic oligonucleotide
gtgccctccagggcgatgcgcaggg

SEQ ID NO: 700069 - DNA, 25 bp, Artificial sequence
  Synthetic oligonucleotide
ggataggtgccctccagggcgatgc

SEQ ID NO: 700070 - DNA, 25 bp, Artificial sequence
  Synthetic oligonucleotide
aacggcggataggtgccctccaggg

SEQ ID NO: 700071 - DNA, 25 bp, Artificial sequence
  Synthetic oligonucleotide
aagttgaacggcggataggtgccct

SEQ ID NO: 700072 - DNA, 25 bp, Artificial sequence
  Synthetic oligonucleotide
aggccggcgaggatgccgctccatt

SEQ ID NO: 700073 - DNA, 25 bp, Artificial sequence
  Synthetic oligonucleotide
cgctggtggacgtcgtcgagcagct

SEQ ID NO: 700074 - DNA, 25 bp, Artificial sequence
  Synthetic oligonucleotide
tgatgatgttccacagggtctggcc

SEQ ID NO: 700075 - DNA, 25 bp, Artificial sequence
  Synthetic oligonucleotide
gcttcccattgtcccttgtcgatgc

SEQ ID NO: 700076 - DNA, 25 bp, Artificial sequence
  Synthetic oligonucleotide
agcccggcttcccattgtcccttgt

SEQ ID NO: 700077 - DNA, 25 bp, Artificial sequence
  Synthetic oligonucleotide
gaccgagagcccggcttcccattgt

SEQ ID NO: 700078 - DNA, 25 bp, Artificial sequence
  Synthetic oligonucleotide
caggccgaccgagagcccggcttcc

SEQ ID NO: 700079 - DNA, 25 bp, Artificial sequence
  Synthetic oligonucleotide
ccaggtcaggccgaccgagagcccg

SEQ ID NO: 700080 - DNA, 25 bp, Artificial sequence
  Synthetic oligonucleotide
tctggccccaggtcaggccgaccga

SEQ ID NO: 700081 - DNA, 25 bp, Artificial sequence
  Synthetic oligonucleotide
tgttcgacaggctcggcaccgccag

SEQ ID NO: 700082 - DNA, 25 bp, Artificial sequence
  Synthetic oligonucleotide
tgttccacagggtctggccccaggt

SEQ ID NO: 700083 - DNA, 25 bp, Artificial sequence
  Synthetic oligonucleotide
gtcgatgccgaggatcgccccgcgc

SEQ ID NO: 700084 - DNA, 25 bp, Artificial sequence
  Synthetic oligonucleotide
gcggggtgatgatgttccacagggt

SEQ ID NO: 700085 - DNA, 25 bp, Artificial sequence
  Synthetic oligonucleotide
gggcctgcggggtgatgatgttcca

SEQ ID NO: 700086 - DNA, 25 bp, Artificial sequence
  Synthetic oligonucleotide
ggcgcagggcctgcggggtgatgat

SEQ ID NO: 700087 - DNA, 25 bp, Artificial sequence
  Synthetic oligonucleotide
ccgccaggcgcagggcctgcggggt

SEQ ID NO: 700088 - DNA, 25 bp, Artificial sequence
  Synthetic oligonucleotide
tcggcaccgccaggcgcagggcctg

SEQ ID NO: 700089 - DNA, 25 bp, Artificial sequence
  Synthetic oligonucleotide
gatgcctacgctcggcagcccgtag

SEQ ID NO: 700090 - DNA, 25 bp, Artificial sequence
  Synthetic oligonucleotide
acagggtctggccccaggtcaggcc

SEQ ID NO: 700091 - DNA, 25 bp, Artificial sequence
  Synthetic oligonucleotide
aggccgcgacattcagggtcagcgc

SEQ ID NO: 700092 - DNA, 25 bp, Artificial sequence
  Synthetic oligonucleotide
tcgccgaacttcggattgttcttcc

SEQ ID NO: 700093 - DNA, 25 bp, Artificial sequence
  Synthetic oligonucleotide
ccggggtgaactcgatgcctacgct

SEQ ID NO: 700094 - DNA, 25 bp, Artificial sequence
  Synthetic oligonucleotide
cggtgaccggggtgaactcgatgcc

SEQ ID NO: 700095 - DNA, 25 bp, Artificial sequence
  Synthetic oligonucleotide
tgcccgcggtgaccggggtgaactc

SEQ ID NO: 700096 - DNA, 25 bp, Artificial sequence
  Synthetic oligonucleotide
ccaggatgcccgcggtgaccggggt

SEQ ID NO: 700097 - DNA, 25 bp, Artificial sequence
  Synthetic oligonucleotide
tcagcgccaggatgcccgcggtgac

SEQ ID NO: 700098 - DNA, 25 bp, Artificial sequence
  Synthetic oligonucleotide
cattgtcccttgtcgatgccgagga

SEQ ID NO: 700099 - DNA, 25 bp, Artificial sequence
  Synthetic oligonucleotide
cgacattcagggtcagcgccaggat

SEQ ID NO: 700100 - DNA, 25 bp, Artificial sequence
  Synthetic oligonucleotide
tcccttgtcgatgccgaggatcgcc

SEQ ID NO: 700101 - DNA, 25 bp, Artificial sequence
  Synthetic oligonucleotide
gagataggccgcgacattcagggtc

SEQ ID NO: 700102 - DNA, 25 bp, Artificial sequence
  Synthetic oligonucleotide
actccgagagataggccgcgacatt

SEQ ID NO: 700103 - DNA, 25 bp, Artificial sequence
  Synthetic oligonucleotide
gcatggactccgagagataggccgc

SEQ ID NO: 700104 - DNA, 25 bp, Artificial sequence
  Synthetic oligonucleotide
ccccgcgcatggactccgagagata

SEQ ID NO: 700105 - DNA, 25 bp, Artificial sequence
  Synthetic oligonucleotide
ggatcgccccgcgcatggactccga

SEQ ID NO: 700106 - DNA, 25 bp, Artificial sequence
  Synthetic oligonucleotide
tgccgaggatcgccccgcgcatgga

SEQ ID NO: 700107 - DNA, 25 bp, Artificial sequence
  Synthetic oligonucleotide
tcaggctgttcgacaggctcggcac

SEQ ID NO: 700108 - DNA, 25 bp, Artificial sequence
  Synthetic oligonucleotide
ttcagggtcagcgccaggatgcccg

SEQ ID NO: 700109 - DNA, 25 bp, Artificial sequence
  Synthetic oligonucleotide
tttctgcacacgctcgaagagtgcc

SEQ ID NO: 700110 - DNA, 25 bp, Artificial sequence
  Synthetic oligonucleotide
cggcgagatagagcggcagcggctg

SEQ ID NO: 700111 - DNA, 25 bp, Artificial sequence
  Synthetic oligonucleotide
ccggcggcggcgagatagagcggca

SEQ ID NO: 700112 - DNA, 25 bp, Artificial sequence
  Synthetic oligonucleotide
tagatcccggcggcggcgagataga

SEQ ID NO: 700113 - DNA, 25 bp, Artificial sequence
  Synthetic oligonucleotide
agccagtagatcccggcggcggcga

SEQ ID NO: 700114 - DNA, 25 bp, Artificial sequence
  Synthetic oligonucleotide
gaaagcagccagtagatcccggcgg

SEQ ID NO: 700115 - DNA, 25 bp, Artificial sequence
  Synthetic oligonucleotide
agtgccgaaagcagccagtagatcc

SEQ ID NO: 700116 - DNA, 25 bp, Artificial sequence
  Synthetic oligonucleotide
acaggctcggcaccgccaggcgcag

SEQ ID NO: 700117 - DNA, 25 bp, Artificial sequence
  Synthetic oligonucleotide
cacacgctcgaagagtgccgaaagc

SEQ ID NO: 700118 - DNA, 25 bp, Artificial sequence
  Synthetic oligonucleotide
gcggctggaaggtctcggcgatgac

SEQ ID NO: 700119 - DNA, 25 bp, Artificial sequence
  Synthetic oligonucleotide
cagggctttctgcacacgctcgaag

SEQ ID NO: 700120 - DNA, 25 bp, Artificial sequence
  Synthetic oligonucleotide
ggttctccagggctttctgcacacg

SEQ ID NO: 700121 - DNA, 25 bp, Artificial sequence
  Synthetic oligonucleotide
gtcaggcggttctccagggctttct

SEQ ID NO: 700122 - DNA, 25 bp, Artificial sequence
  Synthetic oligonucleotide
ggcgcggtcaggcggttctccaggg

SEQ ID NO: 700123 - DNA, 25 bp, Artificial sequence
  Synthetic oligonucleotide
cgcagcggcgcggtcaggcggttct

SEQ ID NO: 700124 - DNA, 25 bp, Artificial sequence
  Synthetic oligonucleotide
tcagcgccgcagcggcgcggtcagg

SEQ ID NO: 700125 - DNA, 25 bp, Artificial sequence
  Synthetic oligonucleotide
tcgaagagtgccgaaagcagccagt

SEQ ID NO: 700126 - DNA, 25 bp, Artificial sequence
  Synthetic oligonucleotide
tcagttcggtcacggtgatcacgga

SEQ ID NO: 700127 - DNA, 25 bp, Artificial sequence
  Synthetic oligonucleotide
ggctgatcaggctgttcgacaggct

SEQ ID NO: 700128 - DNA, 25 bp, Artificial sequence
  Synthetic oligonucleotide
tgatcaggctgatcaggctgttcga

SEQ ID NO: 700129 - DNA, 25 bp, Artificial sequence
  Synthetic oligonucleotide
tgtccttgatcaggctgatcaggct

SEQ ID NO: 700130 - DNA, 25 bp, Artificial sequence
  Synthetic oligonucleotide
gcgaggtgtccttgatcaggctgat

SEQ ID NO: 700131 - DNA, 25 bp, Artificial sequence
  Synthetic oligonucleotide
agatcagcgaggtgtccttgatcag

SEQ ID NO: 700132 - DNA, 25 bp, Artificial sequence
  Synthetic oligonucleotide
tcacggagatcagcgaggtgtcctt

SEQ ID NO: 700133 - DNA, 25 bp, Artificial sequence
  Synthetic oligonucleotide
gatagagcggcagcggctggaaggt

SEQ ID NO: 700134 - DNA, 25 bp, Artificial sequence
  Synthetic oligonucleotide
cggtcacggtgatcacggagatcag

SEQ ID NO: 700135 - DNA, 25 bp, Artificial sequence
  Synthetic oligonucleotide
gcggcagcggctggaaggtctcggc

SEQ ID NO: 700136 - DNA, 25 bp, Artificial sequence
  Synthetic oligonucleotide
ccagcatcagttcggtcacggtgat

SEQ ID NO: 700137 - DNA, 25 bp, Artificial sequence
  Synthetic oligonucleotide
ggtcgccagcatcagttcggtcacg

SEQ ID NO: 700138 - DNA, 25 bp, Artificial sequence
  Synthetic oligonucleotide
ctccttggtcgccagcatcagttcg

SEQ ID NO: 700139 - DNA, 25 bp, Artificial sequence
  Synthetic oligonucleotide
cgatgacctccttggtcgccagcat

SEQ ID NO: 700140 - DNA, 25 bp, Artificial sequence
  Synthetic oligonucleotide
gtctcggcgatgacctccttggtcg

SEQ ID NO: 700141 - DNA, 25 bp, Artificial sequence
  Synthetic oligonucleotide
tggaaggtctcggcgatgacctcct

SEQ ID NO: 700142 - DNA, 25 bp, Artificial sequence
  Synthetic oligonucleotide
tacgctcggcagcccgtagtacagg

SEQ ID NO: 700143 - DNA, 25 bp, Artificial sequence
  Synthetic oligonucleotide
cggtgatcacggagatcagcgaggt

SEQ ID NO: 700144 - DNA, 25 bp, Artificial sequence
  Synthetic oligonucleotide
tgcagcgaattcattcaacactcca

SEQ ID NO: 700145 - DNA, 25 bp, Artificial sequence
  Synthetic oligonucleotide
ctctcgggcgcggccgcttcccccg

SEQ ID NO: 700146 - DNA, 25 bp, Artificial sequence
  Synthetic oligonucleotide
cgcgtctctcgggcgcggccgcttc

SEQ ID NO: 700147 - DNA, 25 bp, Artificial sequence
  Synthetic oligonucleotide
gacggccgcgtctctcgggcgcggc

SEQ ID NO: 700148 - DNA, 25 bp, Artificial sequence
  Synthetic oligonucleotide
aaacacgacggccgcgtctctcggg

SEQ ID NO: 700149 - DNA, 25 bp, Artificial sequence
  Synthetic oligonucleotide
tgtccacggcgttctggtggacacc

SEQ ID NO: 700150 - DNA, 25 bp, Artificial sequence
  Synthetic oligonucleotide
cactccatcgacaaacacgacggcc

SEQ ID NO: 700151 - DNA, 25 bp, Artificial sequence
  Synthetic oligonucleotide
tcccgagcagctcgaccaggttggc

SEQ ID NO: 700152 - DNA, 25 bp, Artificial sequence
  Synthetic oligonucleotide
gaattcattcaacactccatcgaca

SEQ ID NO: 700153 - DNA, 25 bp, Artificial sequence
  Synthetic oligonucleotide
tcacttcggcggctggctgacgtcc

SEQ ID NO: 700154 - DNA, 25 bp, Artificial sequence
  Synthetic oligonucleotide
aatttctgcagcgaattcattcaac

SEQ ID NO: 700155 - DNA, 25 bp, Artificial sequence
  Synthetic oligonucleotide
tcgagcaatttctgcagcgaattca

SEQ ID NO: 700156 - DNA, 25 bp, Artificial sequence
  Synthetic oligonucleotide
gagccattcgagcaatttctgcagc

SEQ ID NO: 700157 - DNA, 25 bp, Artificial sequence
  Synthetic oligonucleotide
gttggcgagccattcgagcaatttc

SEQ ID NO: 700158 - DNA, 25 bp, Artificial sequence
  Synthetic oligonucleotide
gaccaggttggcgagccattcgagc

SEQ ID NO: 700159 - DNA, 25 bp, Artificial sequence
  Synthetic oligonucleotide
tgaactcgatgcctacgctcggcag

SEQ ID NO: 700160 - DNA, 25 bp, Artificial sequence
  Synthetic oligonucleotide
ttcccgaatgacccgcgaagccctg

SEQ ID NO: 700161 - DNA, 25 bp, Artificial sequence
  Synthetic oligonucleotide
cgagagcttggcgaagcggccgtcg

SEQ ID NO: 700162 - DNA, 25 bp, Artificial sequence
  Synthetic oligonucleotide
atcgacaaacacgacggccgcgtct

SEQ ID NO: 700163 - DNA, 25 bp, Artificial sequence
  Synthetic oligonucleotide
agcgccgcgttcagcgcctcgccga

SEQ ID NO: 700164 - DNA, 25 bp, Artificial sequence
  Synthetic oligonucleotide
ttctccagcgccgcgttcagcgcct

SEQ ID NO: 700165 - DNA, 25 bp, Artificial sequence
  Synthetic oligonucleotide
ttgatcttctccagcgccgcgttca

SEQ ID NO: 700166 - DNA, 25 bp, Artificial sequence
  Synthetic oligonucleotide
cggccttgatcttctccagcgccgc

SEQ ID NO: 700167 - DNA, 25 bp, Artificial sequence
  Synthetic oligonucleotide
ggccgtcggccttgatcttctccag

SEQ ID NO: 700168 - DNA, 25 bp, Artificial sequence
  Synthetic oligonucleotide
tcgggcgggaactcacttcggcggc

SEQ ID NO: 700169 - DNA, 25 bp, Artificial sequence
  Synthetic oligonucleotide
cttggcgaagcggccgtcggccttg

SEQ ID NO: 700170 - DNA, 25 bp, Artificial sequence
  Synthetic oligonucleotide
gggaactcacttcggcggctggctg

SEQ ID NO: 700171 - DNA, 25 bp, Artificial sequence
  Synthetic oligonucleotide
acttttccgagagcttggcgaagcg

SEQ ID NO: 700172 - DNA, 25 bp, Artificial sequence
  Synthetic oligonucleotide
cgaaccacttttccgagagcttggc

SEQ ID NO: 700173 - DNA, 25 bp, Artificial sequence
  Synthetic oligonucleotide
ccaggccgaaccacttttccgagag

SEQ ID NO: 700174 - DNA, 25 bp, Artificial sequence
  Synthetic oligonucleotide
tgacgtccaggccgaaccacttttc

SEQ ID NO: 700175 - DNA, 25 bp, Artificial sequence
  Synthetic oligonucleotide
gctggctgacgtccaggccgaacca

SEQ ID NO: 700176 - DNA, 25 bp, Artificial sequence
  Synthetic oligonucleotide
tcggcggctggctgacgtccaggcc

SEQ ID NO: 700177 - DNA, 25 bp, Artificial sequence
  Synthetic oligonucleotide
aggccatcccgagcagctcgaccag

SEQ ID NO: 700178 - DNA, 25 bp, Artificial sequence
  Synthetic oligonucleotide
gaagcggccgtcggccttgatcttc

SEQ ID NO: 700179 - DNA, 25 bp, Artificial sequence
  Synthetic oligonucleotide
cagtggcgtcccgcggaaggcgctg

SEQ ID NO: 700180 - DNA, 25 bp, Artificial sequence
  Synthetic oligonucleotide
gcaccttggtcacccggaccaccgc

SEQ ID NO: 700181 - DNA, 25 bp, Artificial sequence
  Synthetic oligonucleotide
tgcgagaccaccggcaccttggtca

SEQ ID NO: 700182 - DNA, 25 bp, Artificial sequence
  Synthetic oligonucleotide
gcgatctgcgagaccaccggcacct

SEQ ID NO: 700183 - DNA, 25 bp, Artificial sequence
  Synthetic oligonucleotide
accgcggcgatctgcgagaccaccg

SEQ ID NO: 700184 - DNA, 25 bp, Artificial sequence
  Synthetic oligonucleotide
acgtagaccgcggcgatctgcgaga

SEQ ID NO: 700185 - DNA, 25 bp, Artificial sequence
  Synthetic oligonucleotide
gcgctgacgtagaccgcggcgatct

SEQ ID NO: 700186 - DNA, 25 bp, Artificial sequence
  Synthetic oligonucleotide
gcagctcgaccaggttggcgagcca

SEQ ID NO: 700187 - DNA, 25 bp, Artificial sequence
  Synthetic oligonucleotide
cgtcccgcggaaggcgctgacgtag

SEQ ID NO: 700188 - DNA, 25 bp, Artificial sequence
  Synthetic oligonucleotide
accaccgcgacgctgaagccgagga

SEQ ID NO: 700189 - DNA, 25 bp, Artificial sequence
  Synthetic oligonucleotide
accagcagtggcgtcccgcggaagg

SEQ ID NO: 700190 - DNA, 25 bp, Artificial sequence
  Synthetic oligonucleotide
gatctgcaccagcagtggcgtcccg

SEQ ID NO: 700191 - DNA, 25 bp, Artificial sequence
  Synthetic oligonucleotide
gacgaagatctgcaccagcagtggc

SEQ ID NO: 700192 - DNA, 25 bp, Artificial sequence
  Synthetic oligonucleotide
gtacaggacgaagatctgcaccagc

SEQ ID NO: 700193 - DNA, 25 bp, Artificial sequence
  Synthetic oligonucleotide
cccgtagtacaggacgaagatctgc

SEQ ID NO: 700194 - DNA, 25 bp, Artificial sequence
  Synthetic oligonucleotide
cggcagcccgtagtacaggacgaag

SEQ ID NO: 700195 - DNA, 25 bp, Artificial sequence
  Synthetic oligonucleotide
gcggaaggcgctgacgtagaccgcg

SEQ ID NO: 700196 - DNA, 25 bp, Artificial sequence
  Synthetic oligonucleotide
gataccgcggcgaacagcacggtat

SEQ ID NO: 700197 - DNA, 25 bp, Artificial sequence
  Synthetic oligonucleotide
aagggccaggccatcccgagcagct

SEQ ID NO: 700198 - DNA, 25 bp, Artificial sequence
  Synthetic oligonucleotide
gcaggaagggccaggccatcccgag

SEQ ID NO: 700199 - DNA, 25 bp, Artificial sequence
  Synthetic oligonucleotide
ctggagcaggaagggccaggccatc

SEQ ID NO: 700200 - DNA, 25 bp, Artificial sequence
  Synthetic oligonucleotide
gcgccctggagcaggaagggccagg

SEQ ID NO: 700201 - DNA, 25 bp, Artificial sequence
  Synthetic oligonucleotide
tacatcgcgccctggagcaggaagg

SEQ ID NO: 700202 - DNA, 25 bp, Artificial sequence
  Synthetic oligonucleotide
acggtatacatcgcgccctggagca

SEQ ID NO: 700203 - DNA, 25 bp, Artificial sequence
  Synthetic oligonucleotide
tggtcacccggaccaccgcgacgct

SEQ ID NO: 700204 - DNA, 25 bp, Artificial sequence
  Synthetic oligonucleotide
gcggcgaacagcacggtatacatcg

SEQ ID NO: 700205 - DNA, 25 bp, Artificial sequence
  Synthetic oligonucleotide
acccggaccaccgcgacgctgaagc

SEQ ID NO: 700206 - DNA, 25 bp, Artificial sequence
  Synthetic oligonucleotide
accatcgataccgcggcgaacagca

SEQ ID NO: 700207 - DNA, 25 bp, Artificial sequence
  Synthetic oligonucleotide
ccaggaccatcgataccgcggcgaa

SEQ ID NO: 700208 - DNA, 25 bp, Artificial sequence
  Synthetic oligonucleotide
atcaggcccaggaccatcgataccg

SEQ ID NO: 700209 - DNA, 25 bp, Artificial sequence
  Synthetic oligonucleotide
ccgaggatcaggcccaggaccatcg

SEQ ID NO: 700210 - DNA, 25 bp, Artificial sequence
  Synthetic oligonucleotide
ctgaagccgaggatcaggcccagga

SEQ ID NO: 700211 - DNA, 25 bp, Artificial sequence
  Synthetic oligonucleotide
gcgacgctgaagccgaggatcaggc

SEQ ID NO: 700212 - DNA, 25 bp, Artificial sequence
  Synthetic oligonucleotide
agcgcctcgccgaacttcggattgt

SEQ ID NO: 700213 - DNA, 25 bp, Artificial sequence
  Synthetic oligonucleotide
aacagcacggtatacatcgcgccct

SEQ ID NO: 700214 - DNA, 25 bp, Artificial sequence
  Synthetic oligonucleotide
cactgggtggagggcagttcgggaa

SEQ ID NO: 700215 - DNA, 25 bp, Artificial sequence
  Synthetic oligonucleotide
ttggcctgtgcctcggcggtggagc

SEQ ID NO: 700216 - DNA, 25 bp, Artificial sequence
  Synthetic oligonucleotide
tcggacatgcccagcagctcgtgca

SEQ ID NO: 700217 - DNA, 25 bp, Artificial sequence
  Synthetic oligonucleotide
acgatgtcggacatgcccagcagct

SEQ ID NO: 700218 - DNA, 25 bp, Artificial sequence
  Synthetic oligonucleotide
agcgagacgatgtcggacatgccca

SEQ ID NO: 700219 - DNA, 25 bp, Artificial sequence
  Synthetic oligonucleotide
acgtgcagcgagacgatgtcggaca

SEQ ID NO: 700220 - DNA, 25 bp, Artificial sequence
  Synthetic oligonucleotide
tcgggaacgtgcagcgagacgatgt

SEQ ID NO: 700221 - DNA, 25 bp, Artificial sequence
  Synthetic oligonucleotide
agcagctcgtgcaggctgccgatct

SEQ ID NO: 700222 - DNA, 25 bp, Artificial sequence
  Synthetic oligonucleotide
gtggagggcagttcgggaacgtgca

SEQ ID NO: 700223 - DNA, 25 bp, Artificial sequence
  Synthetic oligonucleotide
tcgtgcaggctgccgatctgcaccg

SEQ ID NO: 700224 - DNA, 25 bp, Artificial sequence
  Synthetic oligonucleotide
atcatccactgggtggagggcagtt

SEQ ID NO: 700225 - DNA, 25 bp, Artificial sequence
  Synthetic oligonucleotide
ctcgccgatcatccactgggtggag

SEQ ID NO: 700226 - DNA, 25 bp, Artificial sequence
  Synthetic oligonucleotide
ttccttctcgccgatcatccactgg

SEQ ID NO: 700227 - DNA, 25 bp, Artificial sequence
  Synthetic oligonucleotide
gcggatttccttctcgccgatcatc

SEQ ID NO: 700228 - DNA, 25 bp, Artificial sequence
  Synthetic oligonucleotide
atcgcgcggatttccttctcgccga

SEQ ID NO: 700229 - DNA, 25 bp, Artificial sequence
  Synthetic oligonucleotide
ttcttcatcgcgcggatttccttct

SEQ ID NO: 700230 - DNA, 25 bp, Artificial sequence
  Synthetic oligonucleotide
ggcagttcgggaacgtgcagcgaga

SEQ ID NO: 700231 - DNA, 25 bp, Artificial sequence
  Synthetic oligonucleotide
tggtcacggtgtcgtagaagaacac

SEQ ID NO: 700232 - DNA, 25 bp, Artificial sequence
  Synthetic oligonucleotide
agtaccgagagctgggtgccgatcg

SEQ ID NO: 700233 - DNA, 25 bp, Artificial sequence
  Synthetic oligonucleotide
tcggcgagtaccgagagctgggtgc

SEQ ID NO: 700234 - DNA, 25 bp, Artificial sequence
  Synthetic oligonucleotide
agggcctcggcgagtaccgagagct

SEQ ID NO: 700235 - DNA, 25 bp, Artificial sequence
  Synthetic oligonucleotide
atgcccagggcctcggcgagtaccg

SEQ ID NO: 700236 - DNA, 25 bp, Artificial sequence
  Synthetic oligonucleotide
acctgcatgcccagggcctcggcga

SEQ ID NO: 700237 - DNA, 25 bp, Artificial sequence
  Synthetic oligonucleotide
aagaacacctgcatgcccagggcct

SEQ ID NO: 700238 - DNA, 25 bp, Artificial sequence
  Synthetic oligonucleotide
atgcccagcagctcgtgcaggctgc

SEQ ID NO: 700239 - DNA, 25 bp, Artificial sequence
  Synthetic oligonucleotide
cggtgtcgtagaagaacacctgcat

SEQ ID NO: 700240 - DNA, 25 bp, Artificial sequence
  Synthetic oligonucleotide
ttgatcaggatgccgcccttcttca

SEQ ID NO: 700241 - DNA, 25 bp, Artificial sequence
  Synthetic oligonucleotide
gcagcttggtcacggtgtcgtagaa

SEQ ID NO: 700242 - DNA, 25 bp, Artificial sequence
  Synthetic oligonucleotide
cccagcggcagcttggtcacggtgt

SEQ ID NO: 700243 - DNA, 25 bp, Artificial sequence
  Synthetic oligonucleotide
gcgttgcccagcggcagcttggtca

SEQ ID NO: 700244 - DNA, 25 bp, Artificial sequence
  Synthetic oligonucleotide
tgcaccgcgttgcccagcggcagct

SEQ ID NO: 700245 - DNA, 25 bp, Artificial sequence
  Synthetic oligonucleotide
ccgatctgcaccgcgttgcccagcg

SEQ ID NO: 700246 - DNA, 25 bp, Artificial sequence
  Synthetic oligonucleotide
aggctgccgatctgcaccgcgttgc

SEQ ID NO: 700247 - DNA, 25 bp, Artificial sequence
  Synthetic oligonucleotide
cgtagaagaacacctgcatgcccag

SEQ ID NO: 700248 - DNA, 25 bp, Artificial sequence
  Synthetic oligonucleotide
caggatcacccggtccaggccacgc

SEQ ID NO: 700249 - DNA, 25 bp, Artificial sequence
  Synthetic oligonucleotide
ttggatttcggctcgaccgggaaca

SEQ ID NO: 700250 - DNA, 25 bp, Artificial sequence
  Synthetic oligonucleotide
tcgtcgttggatttcggctcgaccg

SEQ ID NO: 700251 - DNA, 25 bp, Artificial sequence
  Synthetic oligonucleotide
aattcctcgtcgttggatttcggct

SEQ ID NO: 700252 - DNA, 25 bp, Artificial sequence
  Synthetic oligonucleotide
ctggcgaattcctcgtcgttggatt

SEQ ID NO: 700253 - DNA, 25 bp, Artificial sequence
  Synthetic oligonucleotide
agcgggctggcgaattcctcgtcgt

SEQ ID NO: 700254 - DNA, 25 bp, Artificial sequence
  Synthetic oligonucleotide
ccacgcagcgggctggcgaattcct

SEQ ID NO: 700255 - DNA, 25 bp, Artificial sequence
  Synthetic oligonucleotide
ccgcccttcttcatcgcgcggattt

SEQ ID NO: 700256 - DNA, 25 bp, Artificial sequence
  Synthetic oligonucleotide
cacccggtccaggccacgcagcggg

SEQ ID NO: 700257 - DNA, 25 bp, Artificial sequence
  Synthetic oligonucleotide
gggaacacgtcgatggcggcgccga

SEQ ID NO: 700258 - DNA, 25 bp, Artificial sequence
  Synthetic oligonucleotide
cggggtcaggatcacccggtccagg

SEQ ID NO: 700259 - DNA, 25 bp, Artificial sequence
  Synthetic oligonucleotide
atgtgcggggtcaggatcacccggt

SEQ ID NO: 700260 - DNA, 25 bp, Artificial sequence
  Synthetic oligonucleotide
ccgccgatgtgcggggtcaggatca

SEQ ID NO: 700261 - DNA, 25 bp, Artificial sequence
  Synthetic oligonucleotide
gtggagccgccgatgtgcggggtca

SEQ ID NO: 700262 - DNA, 25 bp, Artificial sequence
  Synthetic oligonucleotide
tcggcggtggagccgccgatgtgcg

SEQ ID NO: 700263 - DNA, 25 bp, Artificial sequence
  Synthetic oligonucleotide
tgtgcctcggcggtggagccgccga

SEQ ID NO: 700264 - DNA, 25 bp, Artificial sequence
  Synthetic oligonucleotide
gtccaggccacgcagcgggctggcg

SEQ ID NO: 700265 - DNA, 25 bp, Artificial sequence
  Synthetic oligonucleotide
atcgcggcggccaggtggtccagct

SEQ ID NO: 700266 - DNA, 25 bp, Artificial sequence
  Synthetic oligonucleotide
ccgatcgagccgtagccgacgatgc

SEQ ID NO: 700267 - DNA, 25 bp, Artificial sequence
  Synthetic oligonucleotide
gcggcgttgatcaggatgccgccct

SEQ ID NO: 700268 - DNA, 25 bp, Artificial sequence
  Synthetic oligonucleotide
ccgcgcgcggcgttgatcaggatgc

SEQ ID NO: 700269 - DNA, 25 bp, Artificial sequence
  Synthetic oligonucleotide
actgtgccgcgcgcggcgttgatca

SEQ ID NO: 700270 - DNA, 25 bp, Artificial sequence
  Synthetic oligonucleotide
ctcgaccactgtgccgcgcgcggcg

SEQ ID NO: 700271 - DNA, 25 bp, Artificial sequence
  Synthetic oligonucleotide
tccagctcgaccactgtgccgcgcg

SEQ ID NO: 700272 - DNA, 25 bp, Artificial sequence
  Synthetic oligonucleotide
ttcggctcgaccgggaacacgtcga

SEQ ID NO: 700273 - DNA, 25 bp, Artificial sequence
  Synthetic oligonucleotide
gcggccaggtggtccagctcgacca

SEQ ID NO: 700274 - DNA, 25 bp, Artificial sequence
  Synthetic oligonucleotide
tcgaccgggaacacgtcgatggcgg

SEQ ID NO: 700275 - DNA, 25 bp, Artificial sequence
  Synthetic oligonucleotide
tccttgatcgcggcggccaggtggt

SEQ ID NO: 700276 - DNA, 25 bp, Artificial sequence
  Synthetic oligonucleotide
tgctcgtccttgatcgcggcggcca

SEQ ID NO: 700277 - DNA, 25 bp, Artificial sequence
  Synthetic oligonucleotide
atcaggtgctcgtccttgatcgcgg

SEQ ID NO: 700278 - DNA, 25 bp, Artificial sequence
  Synthetic oligonucleotide
gcgccgatcaggtgctcgtccttga

SEQ ID NO: 700279 - DNA, 25 bp, Artificial sequence
  Synthetic oligonucleotide
atggcggcgccgatcaggtgctcgt

SEQ ID NO: 700280 - DNA, 25 bp, Artificial sequence
  Synthetic oligonucleotide
acgtcgatggcggcgccgatcaggt

SEQ ID NO: 700281 - DNA, 25 bp, Artificial sequence
  Synthetic oligonucleotide
aggatgccgcccttcttcatcgcgc

SEQ ID NO: 700282 - DNA, 25 bp, Artificial sequence
  Synthetic oligonucleotide
aggtggtccagctcgaccactgtgc

SEQ ID NO: 700283 - DNA, 25 bp, Artificial sequence
  Synthetic oligonucleotide
cagtttcttcgcgcagtcgaagacc

SEQ ID NO: 700284 - DNA, 25 bp, Artificial sequence
  Synthetic oligonucleotide
gcgaatgccgatgaagtgcgcatcg

SEQ ID NO: 700285 - DNA, 25 bp, Artificial sequence
  Synthetic oligonucleotide
gcgggagcgaatgccgatgaagtgc

SEQ ID NO: 700286 - DNA, 25 bp, Artificial sequence
  Synthetic oligonucleotide
ctgggtgcgggagcgaatgccgatg

SEQ ID NO: 700287 - DNA, 25 bp, Artificial sequence
  Synthetic oligonucleotide
ggtcagctgggtgcgggagcgaatg

SEQ ID NO: 700288 - DNA, 25 bp, Artificial sequence
  Synthetic oligonucleotide
tcttcggtcagctgggtgcgggagc

SEQ ID NO: 700289 - DNA, 25 bp, Artificial sequence
  Synthetic oligonucleotide
aagacctcttcggtcagctgggtgc

SEQ ID NO: 700290 - DNA, 25 bp, Artificial sequence
  Synthetic oligonucleotide
tcgacctggttggtgccgatgcaga

SEQ ID NO: 700291 - DNA, 25 bp, Artificial sequence
  Synthetic oligonucleotide
ttcgcgcagtcgaagacctcttcgg

SEQ ID NO: 700292 - DNA, 25 bp, Artificial sequence
  Synthetic oligonucleotide
gcgcatcggcgatcctttccttcag

SEQ ID NO: 700293 - DNA, 25 bp, Artificial sequence
  Synthetic oligonucleotide
cgcgatcagtttcttcgcgcagtcg

SEQ ID NO: 700294 - DNA, 25 bp, Artificial sequence
  Synthetic oligonucleotide
gccgaccgcgatcagtttcttcgcg

SEQ ID NO: 700295 - DNA, 25 bp, Artificial sequence
  Synthetic oligonucleotide
aagcagccgaccgcgatcagtttct

SEQ ID NO: 700296 - DNA, 25 bp, Artificial sequence
  Synthetic oligonucleotide
atgcagaagcagccgaccgcgatca

SEQ ID NO: 700297 - DNA, 25 bp, Artificial sequence
  Synthetic oligonucleotide
gtgccgatgcagaagcagccgaccg

SEQ ID NO: 700298 - DNA, 25 bp, Artificial sequence
  Synthetic oligonucleotide
gagagctgggtgccgatcgagccgt

SEQ ID NO: 700299 - DNA, 25 bp, Artificial sequence
  Synthetic oligonucleotide
cagtcgaagacctcttcggtcagct

SEQ ID NO: 700300 - DNA, 25 bp, Artificial sequence
  Synthetic oligonucleotide
ggtcttgaggtactcgatgttggtg

SEQ ID NO: 700301 - DNA, 25 bp, Artificial sequence
  Synthetic oligonucleotide
attcaacactccatcgacaaacacg

SEQ ID NO: 700302 - DNA, 25 bp, Artificial sequence
  Synthetic oligonucleotide
gcagtggaaatcgctgtgccagcga

SEQ ID NO: 700303 - DNA, 25 bp, Artificial sequence
  Synthetic oligonucleotide
tcagcgtgtccacggcgttctggtg

SEQ ID NO: 700304 - DNA, 25 bp, Artificial sequence
  Synthetic oligonucleotide
cggccttcagcgtgtccacggcgtt

SEQ ID NO: 700305 - DNA, 25 bp, Artificial sequence
  Synthetic oligonucleotide
tagccggcggccttcagcgtgtcca

SEQ ID NO: 700306 - DNA, 25 bp, Artificial sequence
  Synthetic oligonucleotide
ttggtgtagccggcggccttcagcg

SEQ ID NO: 700307 - DNA, 25 bp, Artificial sequence
  Synthetic oligonucleotide
tgccgatgaagtgcgcatcggcgat

SEQ ID NO: 700308 - DNA, 25 bp, Artificial sequence
  Synthetic oligonucleotide
aggtactcgatgttggtgtagccgg

SEQ ID NO: 700309 - DNA, 25 bp, Artificial sequence
  Synthetic oligonucleotide
tgaagtgcgcatcggcgatcctttc

SEQ ID NO: 700310 - DNA, 25 bp, Artificial sequence
  Synthetic oligonucleotide
agcgcggtcttgaggtactcgatgt

SEQ ID NO: 700311 - DNA, 25 bp, Artificial sequence
  Synthetic oligonucleotide
ccggaaagcgcggtcttgaggtact

SEQ ID NO: 700312 - DNA, 25 bp, Artificial sequence
  Synthetic oligonucleotide
ctcgtcgccggaaagcgcggtcttg

SEQ ID NO: 700313 - DNA, 25 bp, Artificial sequence
  Synthetic oligonucleotide
cttcagctcgtcgccggaaagcgcg

SEQ ID NO: 700314 - DNA, 25 bp, Artificial sequence
  Synthetic oligonucleotide
cctttccttcagctcgtcgccggaa

SEQ ID NO: 700315 - DNA, 25 bp, Artificial sequence
  Synthetic oligonucleotide
ggcgatcctttccttcagctcgtcg

SEQ ID NO: 700316 - DNA, 25 bp, Artificial sequence
  Synthetic oligonucleotide
gttgaggtcgacctggttggtgccg

SEQ ID NO: 700317 - DNA, 25 bp, Artificial sequence
  Synthetic oligonucleotide
tcgatgttggtgtagccggcggcct

SEQ ID NO: 700318 - DNA, 25 bp, Artificial sequence
  Synthetic oligonucleotide
cacggatctcgaaggaattcgccgc

SEQ ID NO: 700319 - DNA, 25 bp, Artificial sequence
  Synthetic oligonucleotide
ttttccgggatgccgcgcagcagca

SEQ ID NO: 700320 - DNA, 25 bp, Artificial sequence
  Synthetic oligonucleotide
gcgttcttttccgggatgccgcgca

SEQ ID NO: 700321 - DNA, 25 bp, Artificial sequence
  Synthetic oligonucleotide
gcaggaggcgttcttttccgggatg

SEQ ID NO: 700322 - DNA, 25 bp, Artificial sequence
  Synthetic oligonucleotide
cgcgatggcaggaggcgttcttttc

SEQ ID NO: 700323 - DNA, 25 bp, Artificial sequence
  Synthetic oligonucleotide
tgatccagccgccgcgatggcagga

SEQ ID NO: 700324 - DNA, 25 bp, Artificial sequence
  Synthetic oligonucleotide
tcgccgcgctcttgatccagccgcc

SEQ ID NO: 700325 - DNA, 25 bp, Artificial sequence
  Synthetic oligonucleotide
tggttggtgccgatgcagaagcagc

SEQ ID NO: 700326 - DNA, 25 bp, Artificial sequence
  Synthetic oligonucleotide
tctcgaaggaattcgccgcgctctt

SEQ ID NO: 700327 - DNA, 25 bp, Artificial sequence
  Synthetic oligonucleotide
agcagcaggatcgcctcggccagta

SEQ ID NO: 700328 - DNA, 25 bp, Artificial sequence
  Synthetic oligonucleotide
tcttgccacggatctcgaaggaatt

SEQ ID NO: 700329 - DNA, 25 bp, Artificial sequence
  Synthetic oligonucleotide
cgagcttcttgccacggatctcgaa

SEQ ID NO: 700330 - DNA, 25 bp, Artificial sequence
  Synthetic oligonucleotide
acgatgccgagcttcttgccacgga

SEQ ID NO: 700331 - DNA, 25 bp, Artificial sequence
  Synthetic oligonucleotide
tagccgacgatgccgagcttcttgc

SEQ ID NO: 700332 - DNA, 25 bp, Artificial sequence
  Synthetic oligonucleotide
gagccgtagccgacgatgccgagct

SEQ ID NO: 700333 - DNA, 25 bp, Artificial sequence
  Synthetic oligonucleotide
cgctcttgatccagccgccgcgatg

SEQ ID NO: 700334 - DNA, 25 bp, Artificial sequence
  Synthetic oligonucleotide
aggaattcgccgcgctcttgatcca

SEQ ID NO: 700335 - DNA, 25 bp, Artificial sequence
  Synthetic oligonucleotide
gcgggtgttcgagtagggcgcgttg

SEQ ID NO: 700336 - DNA, 25 bp, Artificial sequence
  Synthetic oligonucleotide
ggcggcgttgaggtcgacctggttg

SEQ ID NO: 700337 - DNA, 25 bp, Artificial sequence
  Synthetic oligonucleotide
ttcgcgggcggcgttgaggtcgacc

SEQ ID NO: 700338 - DNA, 25 bp, Artificial sequence
  Synthetic oligonucleotide
taccgcgttcgcgggcggcgttgag

SEQ ID NO: 700339 - DNA, 25 bp, Artificial sequence
  Synthetic oligonucleotide
cggcgataccgcgttcgcgggcggc

SEQ ID NO: 700340 - DNA, 25 bp, Artificial sequence
  Synthetic oligonucleotide
tgaacacggcgataccgcgttcgcg

SEQ ID NO: 700341 - DNA, 25 bp, Artificial sequence
  Synthetic oligonucleotide
gcgcgttgaacacggcgataccgcg

SEQ ID NO: 700342 - DNA, 25 bp, Artificial sequence
  Synthetic oligonucleotide
gggatgccgcgcagcagcaggatcg

SEQ ID NO: 700343 - DNA, 25 bp, Artificial sequence
  Synthetic oligonucleotide
tgttcgagtagggcgcgttgaacac

SEQ ID NO: 700344 - DNA, 25 bp, Artificial sequence
  Synthetic oligonucleotide
ccgcgcagcagcaggatcgcctcgg

SEQ ID NO: 700345 - DNA, 25 bp, Artificial sequence
  Synthetic oligonucleotide
cacagagcgggtgttcgagtagggc

SEQ ID NO: 700346 - DNA, 25 bp, Artificial sequence
  Synthetic oligonucleotide
ctcagccacagagcgggtgttcgag

SEQ ID NO: 700347 - DNA, 25 bp, Artificial sequence
  Synthetic oligonucleotide
taccagctcagccacagagcgggtg

SEQ ID NO: 700348 - DNA, 25 bp, Artificial sequence
  Synthetic oligonucleotide
ggccagtaccagctcagccacagag

SEQ ID NO: 700349 - DNA, 25 bp, Artificial sequence
  Synthetic oligonucleotide
gcctcggccagtaccagctcagcca

SEQ ID NO: 700350 - DNA, 25 bp, Artificial sequence
  Synthetic oligonucleotide
aggatcgcctcggccagtaccagct

SEQ ID NO: 700351 - DNA, 25 bp, Artificial sequence
  Synthetic oligonucleotide
tgggtgccgatcgagccgtagccga

SEQ ID NO: 700352 - DNA, 25 bp, Artificial sequence
  Synthetic oligonucleotide
agtagggcgcgttgaacacggcgat

SEQ ID NO: 700353 - DNA, 25 bp, Artificial sequence
  Synthetic oligonucleotide
tcggcctgaaaggcatgggcgtggc

SEQ ID NO: 700354 - DNA, 25 bp, Artificial sequence
  Synthetic oligonucleotide
agatcaccctgccgccgggcaagca

SEQ ID NO: 700355 - DNA, 25 bp, Artificial sequence
  Synthetic oligonucleotide
ccggataccggccaccatcacctgt

SEQ ID NO: 700356 - DNA, 25 bp, Artificial sequence
  Synthetic oligonucleotide
cgacatgccggataccggccaccat

SEQ ID NO: 700357 - DNA, 25 bp, Artificial sequence
  Synthetic oligonucleotide
cggcgtcgacatgccggataccggc

SEQ ID NO: 700358 - DNA, 25 bp, Artificial sequence
  Synthetic oligonucleotide
gccggccggcgtcgacatgccggat

SEQ ID NO: 700359 - DNA, 25 bp, Artificial sequence
  Synthetic oligonucleotide
gcgtggcgccggccggcgtcgacat

SEQ ID NO: 700360 - DNA, 25 bp, Artificial sequence
  Synthetic oligonucleotide
caccatcacctgttggtggacctga

SEQ ID NO: 700361 - DNA, 25 bp, Artificial sequence
  Synthetic oligonucleotide
tgaaaggcatgggcgtggcgccggc

SEQ ID NO: 700362 - DNA, 25 bp, Artificial sequence
  Synthetic oligonucleotide
cacctgttggtggacctgaaggagc

SEQ ID NO: 700363 - DNA, 25 bp, Artificial sequence
  Synthetic oligonucleotide
tgaaattcggcctgaaaggcatggg

SEQ ID NO: 700364 - DNA, 25 bp, Artificial sequence
  Synthetic oligonucleotide
tcaccgtgaaattcggcctgaaagg

SEQ ID NO: 700365 - DNA, 25 bp, Artificial sequence
  Synthetic oligonucleotide
agaccttcaccgtgaaattcggcct

SEQ ID NO: 700366 - DNA, 25 bp, Artificial sequence
  Synthetic oligonucleotide
tcgacaagaccttcaccgtgaaatt

SEQ ID NO: 700367 - DNA, 25 bp, Artificial sequence
  Synthetic oligonucleotide
caaccgtcgacaagaccttcaccgt

SEQ ID NO: 700368 - DNA, 25 bp, Artificial sequence
  Synthetic oligonucleotide
atggtgcaaccgtcgacaagacctt

SEQ ID NO: 700369 - DNA, 25 bp, Artificial sequence
  Synthetic oligonucleotide
gcatgggcgtggcgccggccggcgt

SEQ ID NO: 700370 - DNA, 25 bp, Artificial sequence
  Synthetic oligonucleotide
cgctgccgatgaccgacaacatccg

SEQ ID NO: 700371 - DNA, 25 bp, Artificial sequence
  Synthetic oligonucleotide
aaaccgagatcaccctgccgccggg

SEQ ID NO: 700372 - DNA, 25 bp, Artificial sequence
  Synthetic oligonucleotide
gaccgaaaccgagatcaccctgccg

SEQ ID NO: 700373 - DNA, 25 bp, Artificial sequence
  Synthetic oligonucleotide
gggccagaccgaaaccgagatcacc

SEQ ID NO: 700374 - DNA, 25 bp, Artificial sequence
  Synthetic oligonucleotide
cggcaagggccagaccgaaaccgag

SEQ ID NO: 700375 - DNA, 25 bp, Artificial sequence
  Synthetic oligonucleotide
ccacttcggcaagggccagaccgaa

SEQ ID NO: 700376 - DNA, 25 bp, Artificial sequence
  Synthetic oligonucleotide
catccgccacttcggcaagggccag

SEQ ID NO: 700377 - DNA, 25 bp, Artificial sequence
  Synthetic oligonucleotide
accggccaccatcacctgttggtgg

SEQ ID NO: 700378 - DNA, 25 bp, Artificial sequence
  Synthetic oligonucleotide
cgatgaccgacaacatccgccactt

SEQ ID NO: 700379 - DNA, 25 bp, Artificial sequence
  Synthetic oligonucleotide
atttcatcacgccggccgatggtgc

SEQ ID NO: 700380 - DNA, 25 bp, Artificial sequence
  Synthetic oligonucleotide
acctgccgctgccgatgaccgacaa

SEQ ID NO: 700381 - DNA, 25 bp, Artificial sequence
  Synthetic oligonucleotide
cgatgaacctgccgctgccgatgac

SEQ ID NO: 700382 - DNA, 25 bp, Artificial sequence
  Synthetic oligonucleotide
agccggcgatgaacctgccgctgcc

SEQ ID NO: 700383 - DNA, 25 bp, Artificial sequence
  Synthetic oligonucleotide
ggagcagccggcgatgaacctgccg

SEQ ID NO: 700384 - DNA, 25 bp, Artificial sequence
  Synthetic oligonucleotide
acctgaaggagcagccggcgatgaa

SEQ ID NO: 700385 - DNA, 25 bp, Artificial sequence
  Synthetic oligonucleotide
ttggtggacctgaaggagcagccgg

SEQ ID NO: 700386 - DNA, 25 bp, Artificial sequence
  Synthetic oligonucleotide
cgacaacatccgccacttcggcaag

SEQ ID NO: 700387 - DNA, 25 bp, Artificial sequence
  Synthetic oligonucleotide
tttccctgattcggaaggcacgaag

SEQ ID NO: 700388 - DNA, 25 bp, Artificial sequence
  Synthetic oligonucleotide
gaagtgaaaacaggagactcccatg

SEQ ID NO: 700389 - DNA, 25 bp, Artificial sequence
  Synthetic oligonucleotide
ctaacggaagtgaaaacaggagact

SEQ ID NO: 700390 - DNA, 25 bp, Artificial sequence
  Synthetic oligonucleotide
cgggtgctaacggaagtgaaaacag

SEQ ID NO: 700391 - DNA, 25 bp, Artificial sequence
  Synthetic oligonucleotide
cgtccagtggtgtttcccgggtgct

SEQ ID NO: 700392 - DNA, 25 bp, Artificial sequence
  Synthetic oligonucleotide
agtgccggggaaattccgtccagtg

SEQ ID NO: 700393 - DNA, 25 bp, Artificial sequence
  Synthetic oligonucleotide
cacgaagagtgccggggaaattccg

SEQ ID NO: 700394 - DNA, 25 bp, Artificial sequence
  Synthetic oligonucleotide
cggccgatggtgcaaccgtcgacaa

SEQ ID NO: 700395 - DNA, 25 bp, Artificial sequence
  Synthetic oligonucleotide
tgattcggaaggcacgaagagtgcc

SEQ ID NO: 700396 - DNA, 25 bp, Artificial sequence
  Synthetic oligonucleotide
tcccatgagagtgacattgccttgc

SEQ ID NO: 700397 - DNA, 25 bp, Artificial sequence
  Synthetic oligonucleotide
gatgcctttccctgattcggaaggc

SEQ ID NO: 700398 - DNA, 25 bp, Artificial sequence
  Synthetic oligonucleotide
gccagcgatgcctttccctgattcg

SEQ ID NO: 700399 - DNA, 25 bp, Artificial sequence
  Synthetic oligonucleotide
ccgatgttggcctgtgcctcggcgg

SEQ ID NO: 700400 - DNA, 25 bp, Artificial sequence
  Synthetic oligonucleotide
agccgccgcgatggcaggaggcgtt

SEQ ID NO: 700401 - DNA, 25 bp, Artificial sequence
  Synthetic oligonucleotide
gctgtgccagcgatgcctttccctg

SEQ ID NO: 700402 - DNA, 25 bp, Artificial sequence
  Synthetic oligonucleotide
gaaatcgctgtgccagcgatgcctt

SEQ ID NO: 700403 - DNA, 25 bp, Artificial sequence
  Synthetic oligonucleotide
ggaaggcacgaagagtgccggggaa

SEQ ID NO: 700404 - DNA, 25 bp, Artificial sequence
  Synthetic oligonucleotide
tgatgttcggcgcatccgccagcct

SEQ ID NO: 700405 - DNA, 25 bp, Artificial sequence
  Synthetic oligonucleotide
aagtgtatttcatcacgccggccga

SEQ ID NO: 700406 - DNA, 25 bp, Artificial sequence
  Synthetic oligonucleotide
gggcgaaagtgtatttcatcacgcc

SEQ ID NO: 700407 - DNA, 25 bp, Artificial sequence
  Synthetic oligonucleotide
ctgccccggacgaaggcgcccgaag

SEQ ID NO: 700408 - DNA, 25 bp, Artificial sequence
  Synthetic oligonucleotide
ctgccgacctgccccggacgaaggc

SEQ ID NO: 700409 - DNA, 25 bp, Artificial sequence
  Synthetic oligonucleotide
tgatggctgccgacctgccccggac

SEQ ID NO: 700410 - DNA, 25 bp, Artificial sequence
  Synthetic oligonucleotide
ccagcctgatggctgccgacctgcc

SEQ ID NO: 700411 - DNA, 25 bp, Artificial sequence
  Synthetic oligonucleotide
aaaacaggagactcccatgagagtg

SEQ ID NO: 700412 - DNA, 25 bp, Artificial sequence
  Synthetic oligonucleotide
cggcgcatccgccagcctgatggct

SEQ ID NO: 700413 - DNA, 25 bp, Artificial sequence
  Synthetic oligonucleotide
ggagactcccatgagagtgacattg

SEQ ID NO: 700414 - DNA, 25 bp, Artificial sequence
  Synthetic oligonucleotide
ccgccctgatgttcggcgcatccgc

SEQ ID NO: 700415 - DNA, 25 bp, Artificial sequence
  Synthetic oligonucleotide
gtctagccgccctgatgttcggcgc

SEQ ID NO: 700416 - DNA, 25 bp, Artificial sequence
  Synthetic oligonucleotide
gcctcggtctagccgccctgatgtt

SEQ ID NO: 700417 - DNA, 25 bp, Artificial sequence
  Synthetic oligonucleotide
tgccttgcctcggtctagccgccct

SEQ ID NO: 700418 - DNA, 25 bp, Artificial sequence
  Synthetic oligonucleotide
tgacattgccttgcctcggtctagc

SEQ ID NO: 700419 - DNA, 25 bp, Artificial sequence
  Synthetic oligonucleotide
gagagtgacattgccttgcctcggt

SEQ ID NO: 700420 - DNA, 25 bp, Artificial sequence
  Synthetic oligonucleotide
tcacgccggccgatggtgcaaccgt

SEQ ID NO: 700421 - DNA, 25 bp, Artificial sequence
  Synthetic oligonucleotide
atccgccagcctgatggctgccgac

SEQ ID NO: 700422 - DNA, 25 bp, Artificial sequence
  Synthetic oligonucleotide
gttgtcggcgaagaccttgttgatc

SEQ ID NO: 700423 - DNA, 25 bp, Artificial sequence
  Synthetic oligonucleotide
tagccgaccttctcgttggtttgca

SEQ ID NO: 700424 - DNA, 25 bp, Artificial sequence
  Synthetic oligonucleotide
tggcgtggatgtgcagcaggcggtg

SEQ ID NO: 700425 - DNA, 25 bp, Artificial sequence
  Synthetic oligonucleotide
cgccggggatgttggcgtggatgtg

SEQ ID NO: 700426 - DNA, 25 bp, Artificial sequence
  Synthetic oligonucleotide
tcatcacgccggggatgttggcgtg

SEQ ID NO: 700427 - DNA, 25 bp, Artificial sequence
  Synthetic oligonucleotide
tctcgctcatcacgccggggatgtt

SEQ ID NO: 700428 - DNA, 25 bp, Artificial sequence
  Synthetic oligonucleotide
tgttgatctcgctcatcacgccggg

SEQ ID NO: 700429 - DNA, 25 bp, Artificial sequence
  Synthetic oligonucleotide
aggcggtgcttgcctgggtgcgacg

SEQ ID NO: 700430 - DNA, 25 bp, Artificial sequence
  Synthetic oligonucleotide
ggcgaagaccttgttgatctcgctc

SEQ ID NO: 700431 - DNA, 25 bp, Artificial sequence
  Synthetic oligonucleotide
tgcttgcctgggtgcgacggcaggg

SEQ ID NO: 700432 - DNA, 25 bp, Artificial sequence
  Synthetic oligonucleotide
gatgccgttgtcggcgaagaccttg

SEQ ID NO: 700433 - DNA, 25 bp, Artificial sequence
  Synthetic oligonucleotide
aacgttgatgccgttgtcggcgaag

SEQ ID NO: 700434 - DNA, 25 bp, Artificial sequence
  Synthetic oligonucleotide
gccggaaacgttgatgccgttgtcg

SEQ ID NO: 700435 - DNA, 25 bp, Artificial sequence
  Synthetic oligonucleotide
gtactggccggaaacgttgatgccg

SEQ ID NO: 700436 - DNA, 25 bp, Artificial sequence
  Synthetic oligonucleotide
ttgcaggtactggccggaaacgttg

SEQ ID NO: 700437 - DNA, 25 bp, Artificial sequence
  Synthetic oligonucleotide
tcgttggtttgcaggtactggccgg

SEQ ID NO: 700438 - DNA, 25 bp, Artificial sequence
  Synthetic oligonucleotide
accttctcgttggtttgcaggtact

SEQ ID NO: 700439 - DNA, 25 bp, Artificial sequence
  Synthetic oligonucleotide
gaccttgttgatctcgctcatcacg

SEQ ID NO: 700440 - DNA, 25 bp, Artificial sequence
  Synthetic oligonucleotide
cgttgtcgctgtacttgaccagctt

SEQ ID NO: 700441 - DNA, 25 bp, Artificial sequence
  Synthetic oligonucleotide
tccaggccgatgttggcctgtgcct

SEQ ID NO: 700442 - DNA, 25 bp, Artificial sequence
  Synthetic oligonucleotide
gccacttccaggccgatgttggcct

SEQ ID NO: 700443 - DNA, 25 bp, Artificial sequence
  Synthetic oligonucleotide
cttctccgccacttccaggccgatg

SEQ ID NO: 700444 - DNA, 25 bp, Artificial sequence
  Synthetic oligonucleotide
gaccagcttctccgccacttccagg

SEQ ID NO: 700445 - DNA, 25 bp, Artificial sequence
  Synthetic oligonucleotide
ccgaaggggcgaaagtgtatttcat

SEQ ID NO: 700446 - DNA, 25 bp, Artificial sequence
  Synthetic oligonucleotide
ccctgccgccgggcaagcacaccct

SEQ ID NO: 700447 - DNA, 25 bp, Artificial sequence
  Synthetic oligonucleotide
gcagcaggcggtgcttgcctgggtg

SEQ ID NO: 700448 - DNA, 25 bp, Artificial sequence
  Synthetic oligonucleotide
tcgctgtacttgaccagcttctccg

SEQ ID NO: 700449 - DNA, 25 bp, Artificial sequence
  Synthetic oligonucleotide
ggatgttggcgtggatgtgcagcag

SEQ ID NO: 700450 - DNA, 25 bp, Artificial sequence
  Synthetic oligonucleotide
aggtgccgttgtcgctgtacttgac

SEQ ID NO: 700451 - DNA, 25 bp, Artificial sequence
  Synthetic oligonucleotide
acaccgaggtgccgttgtcgctgta

SEQ ID NO: 700452 - DNA, 25 bp, Artificial sequence
  Synthetic oligonucleotide
accgaggacaccgaggtgccgttgt

SEQ ID NO: 700453 - DNA, 25 bp, Artificial sequence
  Synthetic oligonucleotide
gaagttgaccgaggacaccgaggtg

SEQ ID NO: 700454 - DNA, 25 bp, Artificial sequence
  Synthetic oligonucleotide
gcagggccacttcggggaagttgac

SEQ ID NO: 700455 - DNA, 25 bp, Artificial sequence
  Synthetic oligonucleotide
gcgacggcagggccacttcggggaa

SEQ ID NO: 700456 - DNA, 25 bp, Artificial sequence
  Synthetic oligonucleotide
ctgggtgcgacggcagggccacttc

SEQ ID NO: 700457 - DNA, 25 bp, Artificial sequence
  Synthetic oligonucleotide
tacttgaccagcttctccgccactt

SEQ ID NO: 700458 - DNA, 25 bp, Artificial sequence
  Synthetic oligonucleotide
acaagaaccacgtgccgctggagcc

SEQ ID NO: 700459 - DNA, 25 bp, Artificial sequence
  Synthetic oligonucleotide
tccgccggacgctgccttagaacag

SEQ ID NO: 700460 - DNA, 25 bp, Artificial sequence
  Synthetic oligonucleotide
ttcctttccgccggacgctgcctta

SEQ ID NO: 700461 - DNA, 25 bp, Artificial sequence
  Synthetic oligonucleotide
gatcaccgttaccgtcaagtgacgg

SEQ ID NO: 700462 - DNA, 25 bp, Artificial sequence
  Synthetic oligonucleotide
tgggcgacaagaaccacgtgccgct

SEQ ID NO: 700463 - DNA, 25 bp, Artificial sequence
  Synthetic oligonucleotide
ggagtcggagaagatcaccgttacc

SEQ ID NO: 700464 - DNA, 25 bp, Artificial sequence
  Synthetic oligonucleotide
gaccgtggagtcggagaagatcacc

SEQ ID NO: 700465 - DNA, 25 bp, Artificial sequence
  Synthetic oligonucleotide
ggagccgaccgtggagtcggagaag

SEQ ID NO: 700466 - DNA, 25 bp, Artificial sequence
  Synthetic oligonucleotide
ggacgctgccttagaacagcacgcg

SEQ ID NO: 700467 - DNA, 25 bp, Artificial sequence
  Synthetic oligonucleotide
accacgtgccgctggagccgaccgt

SEQ ID NO: 700468 - DNA, 25 bp, Artificial sequence
  Synthetic oligonucleotide
ggagaagatcaccgttaccgtcaag

SEQ ID NO: 700469 - DNA, 25 bp, Artificial sequence
  Synthetic oligonucleotide
actacgtagccgaccttctcgttgg

SEQ ID NO: 700470 - DNA, 25 bp, Artificial sequence
  Synthetic oligonucleotide
ggatgtgcagcaggcggtgcttgcc

SEQ ID NO: 700471 - DNA, 25 bp, Artificial sequence
  Synthetic oligonucleotide
tgctggtgggcgacaagaaccacgt

SEQ ID NO: 700472 - DNA, 25 bp, Artificial sequence
  Synthetic oligonucleotide
cgccgggcaagcacaccctgcaact

SEQ ID NO: 700473 - DNA, 25 bp, Artificial sequence
  Synthetic oligonucleotide
tgcaactgctggtgggcgacaagaa

SEQ ID NO: 700474 - DNA, 25 bp, Artificial sequence
  Synthetic oligonucleotide
gcaagcacaccctgcaactgctggt

SEQ ID NO: 700475 - DNA, 25 bp, Artificial sequence
  Synthetic oligonucleotide
acaccctgcaactgctggtgggcga

SEQ ID NO: 700476 - DNA, 25 bp, Artificial sequence
  Synthetic oligonucleotide
gccgctggagccgaccgtggagtcg

SEQ ID NO: 700477 - DNA, 25 bp, Artificial sequence
  Synthetic oligonucleotide
tcgatcactacgtagccgaccttct

SEQ ID NO: 700478 - DNA, 25 bp, Artificial sequence
  Synthetic oligonucleotide
cggcatcgacgtcgatcactacgta

SEQ ID NO: 700479 - DNA, 25 bp, Artificial sequence
  Synthetic oligonucleotide
tgccttagaacagcacgcggctacg

SEQ ID NO: 700480 - DNA, 25 bp, Artificial sequence
  Synthetic oligonucleotide
agggccaggtccgagtactcggcat

SEQ ID NO: 700481 - DNA, 25 bp, Artificial sequence
  Synthetic oligonucleotide
cgacgtcgatcactacgtagccgac

SEQ ID NO: 700482 - DNA, 25 bp, Artificial sequence
  Synthetic oligonucleotide
agtactcggcatcgacgtcgatcac

SEQ ID NO: 700483 - DNA, 25 bp, Artificial sequence
  Synthetic oligonucleotide
ctggagtttctccagggccaggtcc

SEQ ID NO: 700484 - DNA, 25 bp, Artificial sequence
  Synthetic oligonucleotide
ggtccgagtactcggcatcgacgtc

SEQ ID NO: 700485 - DNA, 25 bp, Artificial sequence
  Synthetic oligonucleotide
gacctgctggagtttctccagggcc

SEQ ID NO: 700486 - DNA, 25 bp, Artificial sequence
  Synthetic oligonucleotide
accgttgacctgctggagtttctcc

SEQ ID NO: 700487 - DNA, 25 bp, Artificial sequence
  Synthetic oligonucleotide
gatggtaccgttgacctgctggagt

SEQ ID NO: 700488 - DNA, 25 bp, Artificial sequence
  Synthetic oligonucleotide
ggctacggatggtaccgttgacctg

SEQ ID NO: 700489 - DNA, 25 bp, Artificial sequence
  Synthetic oligonucleotide
gcacgcggctacggatggtaccgtt

SEQ ID NO: 700490 - DNA, 25 bp, Artificial sequence
  Synthetic oligonucleotide
agaacagcacgcggctacggatggt

SEQ ID NO: 700491 - DNA, 25 bp, Artificial sequence
  Synthetic oligonucleotide
tttctccagggccaggtccgagtac

SEQ ID NO: 700492 - DNA, 25 bp, Artificial sequence
  Synthetic oligonucleotide
tcggtgaggaagagctggaagctgc

SEQ ID NO: 700493 - DNA, 25 bp, Artificial sequence
  Synthetic oligonucleotide
aggaagagctggaagctgcgctggt

SEQ ID NO: 700494 - DNA, 25 bp, Artificial sequence
  Synthetic oligonucleotide
gagctggaagctgcgctggtcgctg

SEQ ID NO: 700495 - DNA, 25 bp, Artificial sequence
  Synthetic oligonucleotide
ccctcgtcggtgaggaagagctgga

SEQ ID NO: 700496 - DNA, 25 bp, Artificial sequence
  Synthetic oligonucleotide
tgttccaccggggtgagcggggcaa

SEQ ID NO: 700497 - DNA, 25 bp, Artificial sequence
  Synthetic oligonucleotide
gccagcccctcgtcggtgaggaaga

SEQ ID NO: 700498 - DNA, 25 bp, Artificial sequence
  Synthetic oligonucleotide
gtggatggccagcccctcgtcggtg

SEQ ID NO: 700499 - DNA, 25 bp, Artificial sequence
  Synthetic oligonucleotide
atgctggtggatggccagcccctcg

SEQ ID NO: 700500 - DNA, 25 bp, Artificial sequence
  Synthetic oligonucleotide
cggggtgagcggggcaaacaactcg

SEQ ID NO: 700501 - DNA, 25 bp, Artificial sequence
  Synthetic oligonucleotide
ctccgcatgctggtggatggccagc

SEQ ID NO: 700502 - DNA, 25 bp, Artificial sequence
  Synthetic oligonucleotide
cgtcatgcacgcgtgacatgatggc

SEQ ID NO: 700503 - DNA, 25 bp, Artificial sequence
  Synthetic oligonucleotide
tgacatgatggcctccgcatgctgg

SEQ ID NO: 700504 - DNA, 25 bp, Artificial sequence
  Synthetic oligonucleotide
gagcggggcaaacaactcgtcatgc

SEQ ID NO: 700505 - DNA, 25 bp, Artificial sequence
  Synthetic oligonucleotide
gcacgcgtgacatgatggcctccgc

SEQ ID NO: 700506 - DNA, 25 bp, Artificial sequence
  Synthetic oligonucleotide
gaagctgcgctggtcgctggggttg

SEQ ID NO: 700507 - DNA, 25 bp, Artificial sequence
  Synthetic oligonucleotide
ggcaaacaactcgtcatgcacgcgt

SEQ ID NO: 700508 - DNA, 25 bp, Artificial sequence
  Synthetic oligonucleotide
caactcgtcatgcacgcgtgacatg

SEQ ID NO: 700509 - DNA, 25 bp, Artificial sequence
  Synthetic oligonucleotide
gatggcctccgcatgctggtggatg

SEQ ID NO: 700510 - DNA, 25 bp, Artificial sequence
  Synthetic oligonucleotide
gggtgatcagtgccttgtcgcggca

SEQ ID NO: 700511 - DNA, 25 bp, Artificial sequence
  Synthetic oligonucleotide
cccaggtcctgcaggttcagcccgc

SEQ ID NO: 700512 - DNA, 25 bp, Artificial sequence
  Synthetic oligonucleotide
tggcgtcccaggtcctgcaggttca

SEQ ID NO: 700513 - DNA, 25 bp, Artificial sequence
  Synthetic oligonucleotide
tcctgcaggttcagcccgcgttgtt

SEQ ID NO: 700514 - DNA, 25 bp, Artificial sequence
  Synthetic oligonucleotide
gaaagacttcggcatcaagatggac

SEQ ID NO: 700515 - DNA, 25 bp, Artificial sequence
  Synthetic oligonucleotide
ggtggcctgttccaccggggtgagc

SEQ ID NO: 700516 - DNA, 25 bp, Artificial sequence
  Synthetic oligonucleotide
aggttcagcccgcgttgttcgtcga

SEQ ID NO: 700517 - DNA, 25 bp, Artificial sequence
  Synthetic oligonucleotide
agcccgcgttgttcgtcgataagct

SEQ ID NO: 700518 - DNA, 25 bp, Artificial sequence
  Synthetic oligonucleotide
cacatctggcgtcccaggtcctgca

SEQ ID NO: 700519 - DNA, 25 bp, Artificial sequence
  Synthetic oligonucleotide
tcagtgccttgtcgcggcacatctg

SEQ ID NO: 700520 - DNA, 25 bp, Artificial sequence
  Synthetic oligonucleotide
gccttgtcgcggcacatctggcgtc

SEQ ID NO: 700521 - DNA, 25 bp, Artificial sequence
  Synthetic oligonucleotide
gcgctggtcgctggggttgcgctcg

SEQ ID NO: 700522 - DNA, 25 bp, Artificial sequence
  Synthetic oligonucleotide
tcttccgggtgatcagtgccttgtc

SEQ ID NO: 700523 - DNA, 25 bp, Artificial sequence
  Synthetic oligonucleotide
cgcggatcttccgggtgatcagtgc

SEQ ID NO: 700524 - DNA, 25 bp, Artificial sequence
  Synthetic oligonucleotide
ccagctcgcggatcttccgggtgat

SEQ ID NO: 700525 - DNA, 25 bp, Artificial sequence
  Synthetic oligonucleotide
ttccctccagctcgcggatcttccg

SEQ ID NO: 700526 - DNA, 25 bp, Artificial sequence
  Synthetic oligonucleotide
aggtttcttccctccagctcgcgga

SEQ ID NO: 700527 - DNA, 25 bp, Artificial sequence
  Synthetic oligonucleotide
gcggaccaggtttcttccctccagc

SEQ ID NO: 700528 - DNA, 25 bp, Artificial sequence
  Synthetic oligonucleotide
tgcgctcgcggcggaccaggtttct

SEQ ID NO: 700529 - DNA, 25 bp, Artificial sequence
  Synthetic oligonucleotide
tggggttgcgctcgcggcggaccag

SEQ ID NO: 700530 - DNA, 25 bp, Artificial sequence
  Synthetic oligonucleotide
gtcgctggggttgcgctcgcggcgg

SEQ ID NO: 700531 - DNA, 25 bp, Artificial sequence
  Synthetic oligonucleotide
tcgcggcacatctggcgtcccaggt

SEQ ID NO: 700532 - DNA, 25 bp, Artificial sequence
  Synthetic oligonucleotide
tgaagctgaaagacttcggcatcaa

SEQ ID NO: 700533 - DNA, 25 bp, Artificial sequence
  Synthetic oligonucleotide
ccgtcgaaggcattcgccagtaagc

SEQ ID NO: 700534 - DNA, 25 bp, Artificial sequence
  Synthetic oligonucleotide
tgctctccgtcgaaggcattcgcca

SEQ ID NO: 700535 - DNA, 25 bp, Artificial sequence
  Synthetic oligonucleotide
gagctgctgctctccgtcgaaggca

SEQ ID NO: 700536 - DNA, 25 bp, Artificial sequence
  Synthetic oligonucleotide
gaagtcgagctgctgctctccgtcg

SEQ ID NO: 700537 - DNA, 25 bp, Artificial sequence
  Synthetic oligonucleotide
tcccaggaagtcgagctgctgctct

SEQ ID NO: 700538 - DNA, 25 bp, Artificial sequence
  Synthetic oligonucleotide
cccggcatcccaggaagtcgagctg

SEQ ID NO: 700539 - DNA, 25 bp, Artificial sequence
  Synthetic oligonucleotide
cctcggcccggcatcccaggaagtc

SEQ ID NO: 700540 - DNA, 25 bp, Artificial sequence
  Synthetic oligonucleotide
catcaagatggacctcggcccggca

SEQ ID NO: 700541 - DNA, 25 bp, Artificial sequence
  Synthetic oligonucleotide
cttcggcatcaagatggacctcggc

SEQ ID NO: 700542 - DNA, 25 bp, Artificial sequence
  Synthetic oligonucleotide
cagtaagcggatacctgaaacgaaa

SEQ ID NO: 700543 - DNA, 25 bp, Artificial sequence
  Synthetic oligonucleotide
ccaccctgaagctgaaagacttcgg

SEQ ID NO: 700544 - DNA, 25 bp, Artificial sequence
  Synthetic oligonucleotide
gcagcgccaccctgaagctgaaaga

SEQ ID NO: 700545 - DNA, 25 bp, Artificial sequence
  Synthetic oligonucleotide
tcgaaggcagcgccaccctgaagct

SEQ ID NO: 700546 - DNA, 25 bp, Artificial sequence
  Synthetic oligonucleotide
cgttgttcgtcgataagcttcaata

SEQ ID NO: 700547 - DNA, 25 bp, Artificial sequence
  Synthetic oligonucleotide
ctatgcaacgaacgccagccatgcg

SEQ ID NO: 700548 - DNA, 25 bp, Artificial sequence
  Synthetic oligonucleotide
ccggcttcgaaggcagcgccaccct

SEQ ID NO: 700549 - DNA, 25 bp, Artificial sequence
  Synthetic oligonucleotide
taccgtgccggcttcgaaggcagcg

SEQ ID NO: 700550 - DNA, 25 bp, Artificial sequence
  Synthetic oligonucleotide
ggcggctaccgtgccggcttcgaag

SEQ ID NO: 700551 - DNA, 25 bp, Artificial sequence
  Synthetic oligonucleotide
gatggacctcggcccggcatcccag

SEQ ID NO: 700552 - DNA, 25 bp, Artificial sequence
  Synthetic oligonucleotide
cttcgaaaagaatgttcttaaatat

SEQ ID NO: 700553 - DNA, 25 bp, Artificial sequence
  Synthetic oligonucleotide
agatgcaccagggtggcctgttcca

SEQ ID NO: 700554 - DNA, 25 bp, Artificial sequence
  Synthetic oligonucleotide
gtcgaggagatgcaccagggtggcc

SEQ ID NO: 700555 - DNA, 25 bp, Artificial sequence
  Synthetic oligonucleotide
gcactggtcgaggagatgcaccagg

SEQ ID NO: 700556 - DNA, 25 bp, Artificial sequence
  Synthetic oligonucleotide
ggccaggcactggtcgaggagatgc

SEQ ID NO: 700557 - DNA, 25 bp, Artificial sequence
  Synthetic oligonucleotide
gttgcgcggccaggcactggtcgag

SEQ ID NO: 700558 - DNA, 25 bp, Artificial sequence
  Synthetic oligonucleotide
aagcggttgcgcggccaggcactgg

SEQ ID NO: 700559 - DNA, 25 bp, Artificial sequence
  Synthetic oligonucleotide
tcctcaagcggttgcgcggccaggc

SEQ ID NO: 700560 - DNA, 25 bp, Artificial sequence
  Synthetic oligonucleotide
taaatatcctcaagcggttgcgcgg

SEQ ID NO: 700561 - DNA, 25 bp, Artificial sequence
  Synthetic oligonucleotide
aaggcattcgccagtaagcggatac

SEQ ID NO: 700562 - DNA, 25 bp, Artificial sequence
  Synthetic oligonucleotide
aaagaatgttcttaaatatcctcaa

SEQ ID NO: 700563 - DNA, 25 bp, Artificial sequence
  Synthetic oligonucleotide
attcgccagtaagcggatacctgaa

SEQ ID NO: 700564 - DNA, 25 bp, Artificial sequence
  Synthetic oligonucleotide
attgtgcttcgaaaagaatgttctt

SEQ ID NO: 700565 - DNA, 25 bp, Artificial sequence
  Synthetic oligonucleotide
tttttcattgtgcttcgaaaagaat

SEQ ID NO: 700566 - DNA, 25 bp, Artificial sequence
  Synthetic oligonucleotide
ccggcgtttttcattgtgcttcgaa

SEQ ID NO: 700567 - DNA, 25 bp, Artificial sequence
  Synthetic oligonucleotide
cgatcgccggcgtttttcattgtgc

SEQ ID NO: 700568 - DNA, 25 bp, Artificial sequence
  Synthetic oligonucleotide
cgccggcgatcgccggcgtttttca

SEQ ID NO: 700569 - DNA, 25 bp, Artificial sequence
  Synthetic oligonucleotide
cgaaaaacgccggcgatcgccggcg

SEQ ID NO: 700570 - DNA, 25 bp, Artificial sequence
  Synthetic oligonucleotide
ctgaaacgaaaaacgccggcgatcg

SEQ ID NO: 700571 - DNA, 25 bp, Artificial sequence
  Synthetic oligonucleotide
caccagggtggcctgttccaccggg

SEQ ID NO: 700572 - DNA, 25 bp, Artificial sequence
  Synthetic oligonucleotide
tgttcttaaatatcctcaagcggtt

SEQ ID NO: 700573 - DNA, 25 bp, Artificial sequence
  Synthetic oligonucleotide
ttcggacgtttacaaacacctatga

SEQ ID NO: 700574 - DNA, 25 bp, Artificial sequence
  Synthetic oligonucleotide
agccggtgcagcgccttcacgctgc

SEQ ID NO: 700575 - DNA, 25 bp, Artificial sequence
  Synthetic oligonucleotide
tcttcgagccggtgcagcgccttca

SEQ ID NO: 700576 - DNA, 25 bp, Artificial sequence
  Synthetic oligonucleotide
tgccttcttcgagccggtgcagcgc

SEQ ID NO: 700577 - DNA, 25 bp, Artificial sequence
  Synthetic oligonucleotide
ttgcctgccttcttcgagccggtgc

SEQ ID NO: 700578 - DNA, 25 bp, Artificial sequence
  Synthetic oligonucleotide
agtattttgcctgccttcttcgagc

SEQ ID NO: 700579 - DNA, 25 bp, Artificial sequence
  Synthetic oligonucleotide
aatgtaagtattttgcctgccttct

SEQ ID NO: 700580 - DNA, 25 bp, Artificial sequence
  Synthetic oligonucleotide
cctatgaatgtaagtattttgcctg

SEQ ID NO: 700581 - DNA, 25 bp, Artificial sequence
  Synthetic oligonucleotide
atggcgccgggtggataaccggcca

SEQ ID NO: 700582 - DNA, 25 bp, Artificial sequence
  Synthetic oligonucleotide
cgtttacaaacacctatgaatgtaa

SEQ ID NO: 700583 - DNA, 25 bp, Artificial sequence
  Synthetic oligonucleotide
cgctgcatcggccgctttcgctcat

SEQ ID NO: 700584 - DNA, 25 bp, Artificial sequence
  Synthetic oligonucleotide
cacgcgaggctttcggacgtttaca

SEQ ID NO: 700585 - DNA, 25 bp, Artificial sequence
  Synthetic oligonucleotide
tgttttcacgcgaggctttcggacg

SEQ ID NO: 700586 - DNA, 25 bp, Artificial sequence
  Synthetic oligonucleotide
tcaggtgttttcacgcgaggctttc

SEQ ID NO: 700587 - DNA, 25 bp, Artificial sequence
  Synthetic oligonucleotide
aacgtttcaggtgttttcacgcgag

SEQ ID NO: 700588 - DNA, 25 bp, Artificial sequence
  Synthetic oligonucleotide
atcgagctaaaacgtttcaggtgtt

SEQ ID NO: 700589 - DNA, 25 bp, Artificial sequence
  Synthetic oligonucleotide
ccggccatcgagctaaaacgtttca

SEQ ID NO: 700590 - DNA, 25 bp, Artificial sequence
  Synthetic oligonucleotide
ggataaccggccatcgagctaaaac

SEQ ID NO: 700591 - DNA, 25 bp, Artificial sequence
  Synthetic oligonucleotide
tgaggacaacgctatgcaacgaacg

SEQ ID NO: 700592 - DNA, 25 bp, Artificial sequence
  Synthetic oligonucleotide
caaacacctatgaatgtaagtattt

SEQ ID NO: 700593 - DNA, 25 bp, Artificial sequence
  Synthetic oligonucleotide
gtgtactggttccggccctgctggt

SEQ ID NO: 700594 - DNA, 25 bp, Artificial sequence
  Synthetic oligonucleotide
cggcgctgcataaaagcatcggcat

SEQ ID NO: 700595 - DNA, 25 bp, Artificial sequence
  Synthetic oligonucleotide
ccgtggggcggctaccgtgccggct

SEQ ID NO: 700596 - DNA, 25 bp, Artificial sequence
  Synthetic oligonucleotide
ccgccgccggcgcaaacgccggagg

SEQ ID NO: 700597 - DNA, 25 bp, Artificial sequence
  Synthetic oligonucleotide
gaggcgccgccgccggcgcaaacgc

SEQ ID NO: 700598 - DNA, 25 bp, Artificial sequence
  Synthetic oligonucleotide
aaaagcgaggcgccgccgccggcgc

SEQ ID NO: 700599 - DNA, 25 bp, Artificial sequence
  Synthetic oligonucleotide
tgcggaaaaagcgaggcgccgccgc

SEQ ID NO: 700600 - DNA, 25 bp, Artificial sequence
  Synthetic oligonucleotide
tccgggtgcggaaaaagcgaggcgc

SEQ ID NO: 700601 - DNA, 25 bp, Artificial sequence
  Synthetic oligonucleotide
tgctggtcgcgatttcggccctttc

SEQ ID NO: 700602 - DNA, 25 bp, Artificial sequence
  Synthetic oligonucleotide
gcagcgccttcacgctgcatcggcc

SEQ ID NO: 700603 - DNA, 25 bp, Artificial sequence
  Synthetic oligonucleotide
tggttccggccctgctggtcgcgat

SEQ ID NO: 700604 - DNA, 25 bp, Artificial sequence
  Synthetic oligonucleotide
ccttcacgctgcatcggccgctttc

SEQ ID NO: 700605 - DNA, 25 bp, Artificial sequence
  Synthetic oligonucleotide
ccatgcgtgtactggttccggccct

SEQ ID NO: 700606 - DNA, 25 bp, Artificial sequence
  Synthetic oligonucleotide
gccagccatgcgtgtactggttccg

SEQ ID NO: 700607 - DNA, 25 bp, Artificial sequence
  Synthetic oligonucleotide
aacgaacgccagccatgcgtgtact

SEQ ID NO: 700608 - DNA, 25 bp, Artificial sequence
  Synthetic oligonucleotide
acaacgctatgcaacgaacgccagc

SEQ ID NO: 700609 - DNA, 25 bp, Artificial sequence
  Synthetic oligonucleotide
cgctcatgaggacaacgctatgcaa

SEQ ID NO: 700610 - DNA, 25 bp, Artificial sequence
  Synthetic oligonucleotide
cgctttcgctcatgaggacaacgct

SEQ ID NO: 700611 - DNA, 25 bp, Artificial sequence
  Synthetic oligonucleotide
atcggccgctttcgctcatgaggac

SEQ ID NO: 700612 - DNA, 25 bp, Artificial sequence
  Synthetic oligonucleotide
tgggccatggcgccgggtggataac

SEQ ID NO: 700613 - DNA, 25 bp, Artificial sequence
  Synthetic oligonucleotide
cggccctgctggtcgcgatttcggc

SEQ ID NO: 700614 - DNA, 25 bp, Artificial sequence
  Synthetic oligonucleotide
aatcgagctcgctctggatgcgcgt

SEQ ID NO: 700615 - DNA, 25 bp, Artificial sequence
  Synthetic oligonucleotide
gcgggcatcaggtcgggattcacgg

SEQ ID NO: 700616 - DNA, 25 bp, Artificial sequence
  Synthetic oligonucleotide
atcagcgcgggcatcaggtcgggat

SEQ ID NO: 700617 - DNA, 25 bp, Artificial sequence
  Synthetic oligonucleotide
accgccatcagcgcgggcatcaggt

SEQ ID NO: 700618 - DNA, 25 bp, Artificial sequence
  Synthetic oligonucleotide
ggaagaccgccatcagcgcgggcat

SEQ ID NO: 700619 - DNA, 25 bp, Artificial sequence
  Synthetic oligonucleotide
catgctggaagaccgccatcagcgc

SEQ ID NO: 700620 - DNA, 25 bp, Artificial sequence
  Synthetic oligonucleotide
tccgcacatgctggaagaccgccat

SEQ ID NO: 700621 - DNA, 25 bp, Artificial sequence
  Synthetic oligonucleotide
tgcgcgtccgcacatgctggaagac

SEQ ID NO: 700622 - DNA, 25 bp, Artificial sequence
  Synthetic oligonucleotide
ccgggtggataaccggccatcgagc

SEQ ID NO: 700623 - DNA, 25 bp, Artificial sequence
  Synthetic oligonucleotide
agctcgctctggatgcgcgtccgca

SEQ ID NO: 700624 - DNA, 25 bp, Artificial sequence
  Synthetic oligonucleotide
tcacggggtagttcattggtttggc

SEQ ID NO: 700625 - DNA, 25 bp, Artificial sequence
  Synthetic oligonucleotide
gctggcaatcgagctcgctctggat

SEQ ID NO: 700626 - DNA, 25 bp, Artificial sequence
  Synthetic oligonucleotide
cgagtcgctggcaatcgagctcgct

SEQ ID NO: 700627 - DNA, 25 bp, Artificial sequence
  Synthetic oligonucleotide
tcaggtcgagtcgctggcaatcgag

SEQ ID NO: 700628 - DNA, 25 bp, Artificial sequence
  Synthetic oligonucleotide
gcggggtcaggtcgagtcgctggca

SEQ ID NO: 700629 - DNA, 25 bp, Artificial sequence
  Synthetic oligonucleotide
cgtcgggcggggtcaggtcgagtcg

SEQ ID NO: 700630 - DNA, 25 bp, Artificial sequence
  Synthetic oligonucleotide
tacatggacgtcgggcggggtcagg

SEQ ID NO: 700631 - DNA, 25 bp, Artificial sequence
  Synthetic oligonucleotide
cttcaatacatggacgtcgggcggg

SEQ ID NO: 700632 - DNA, 25 bp, Artificial sequence
  Synthetic oligonucleotide
ataagcttcaatacatggacgtcgg

SEQ ID NO: 700633 - DNA, 25 bp, Artificial sequence
  Synthetic oligonucleotide
tctggatgcgcgtccgcacatgctg

SEQ ID NO: 700634 - DNA, 25 bp, Artificial sequence
  Synthetic oligonucleotide
gatccagtcaactattttgcttatt

SEQ ID NO: 700635 - DNA, 25 bp, Artificial sequence
  Synthetic oligonucleotide
gaatatgggccatggcgccgggtgg

SEQ ID NO: 700636 - DNA, 25 bp, Artificial sequence
  Synthetic oligonucleotide
ggttctgaatatgggccatggcgcc

SEQ ID NO: 700637 - DNA, 25 bp, Artificial sequence
  Synthetic oligonucleotide
gtttcaggttctgaatatgggccat

SEQ ID NO: 700638 - DNA, 25 bp, Artificial sequence
  Synthetic oligonucleotide
aaccttgtttcaggttctgaatatg

SEQ ID NO: 700639 - DNA, 25 bp, Artificial sequence
  Synthetic oligonucleotide
cttatcaaccttgtttcaggttctg

SEQ ID NO: 700640 - DNA, 25 bp, Artificial sequence
  Synthetic oligonucleotide
gttgaccttatcaaccttgtttcag

SEQ ID NO: 700641 - DNA, 25 bp, Artificial sequence
  Synthetic oligonucleotide
attttagttgaccttatcaaccttg

SEQ ID NO: 700642 - DNA, 25 bp, Artificial sequence
  Synthetic oligonucleotide
tgcttattttagttgaccttatcaa

SEQ ID NO: 700643 - DNA, 25 bp, Artificial sequence
  Synthetic oligonucleotide
atcaggtcgggattcacggggtagt

SEQ ID NO: 700644 - DNA, 25 bp, Artificial sequence
  Synthetic oligonucleotide
agtcaactattttgcttattttagt

SEQ ID NO: 700645 - DNA, 25 bp, Artificial sequence
  Synthetic oligonucleotide
tcgggattcacggggtagttcattg

SEQ ID NO: 700646 - DNA, 25 bp, Artificial sequence
  Synthetic oligonucleotide
gtggttgatccagtcaactattttg

SEQ ID NO: 700647 - DNA, 25 bp, Artificial sequence
  Synthetic oligonucleotide
gtaaatgtggttgatccagtcaact

SEQ ID NO: 700648 - DNA, 25 bp, Artificial sequence
  Synthetic oligonucleotide
cctaatgtaaatgtggttgatccag

SEQ ID NO: 700649 - DNA, 25 bp, Artificial sequence
  Synthetic oligonucleotide
agtaaacctaatgtaaatgtggttg

SEQ ID NO: 700650 - DNA, 25 bp, Artificial sequence
  Synthetic oligonucleotide
tggccgagtaaacctaatgtaaatg

SEQ ID NO: 700651 - DNA, 25 bp, Artificial sequence
  Synthetic oligonucleotide
tcattggtttggccgagtaaaccta

SEQ ID NO: 700652 - DNA, 25 bp, Artificial sequence
  Synthetic oligonucleotide
ggtagttcattggtttggccgagta

SEQ ID NO: 700653 - DNA, 25 bp, Artificial sequence
  Synthetic oligonucleotide
tcgtcgataagcttcaatacatgga

SEQ ID NO: 700654 - DNA, 25 bp, Artificial sequence
  Synthetic oligonucleotide
ctattttgcttattttagttgacct

SEQ ID NO: 700655 - DNA, 25 bp, Artificial sequence
  Synthetic oligonucleotide
gcggtgatcgtcgcgggctacctga

SEQ ID NO: 700656 - DNA, 25 bp, Artificial sequence
  Synthetic oligonucleotide
ttcggctggttctccgtgccggcaa

SEQ ID NO: 700657 - DNA, 25 bp, Artificial sequence
  Synthetic oligonucleotide
agcgtgttcggctggttctccgtgc

SEQ ID NO: 700658 - DNA, 25 bp, Artificial sequence
  Synthetic oligonucleotide
ccgatcagcgtgttcggctggttct

SEQ ID NO: 700659 - DNA, 25 bp, Artificial sequence
  Synthetic oligonucleotide
ggcgaaccgatcagcgtgttcggct

SEQ ID NO: 700660 - DNA, 25 bp, Artificial sequence
  Synthetic oligonucleotide
cgccgacggcgaaccgatcagcgtg

SEQ ID NO: 700661 - DNA, 25 bp, Artificial sequence
  Synthetic oligonucleotide
ttccaccgccgacggcgaaccgatc

SEQ ID NO: 700662 - DNA, 25 bp, Artificial sequence
  Synthetic oligonucleotide
tacctgatttccaccgccgacggcg

SEQ ID NO: 700663 - DNA, 25 bp, Artificial sequence
  Synthetic oligonucleotide
ctcacgcgggtagcgagcaagcttg

SEQ ID NO: 700664 - DNA, 25 bp, Artificial sequence
  Synthetic oligonucleotide
atcgtcgcgggctacctgatttcca

SEQ ID NO: 700665 - DNA, 25 bp, Artificial sequence
  Synthetic oligonucleotide
cggcaaccctcagcgggctgcccga

SEQ ID NO: 700666 - DNA, 25 bp, Artificial sequence
  Synthetic oligonucleotide
ctgctggcggtgatcgtcgcgggct

SEQ ID NO: 700667 - DNA, 25 bp, Artificial sequence
  Synthetic oligonucleotide
gggctgctgctggcggtgatcgtcg

SEQ ID NO: 700668 - DNA, 25 bp, Artificial sequence
  Synthetic oligonucleotide
tgtacgggctgctgctggcggtgat

SEQ ID NO: 700669 - DNA, 25 bp, Artificial sequence
  Synthetic oligonucleotide
tcgcgctgtacgggctgctgctggc

SEQ ID NO: 700670 - DNA, 25 bp, Artificial sequence
  Synthetic oligonucleotide
gccacctcgcgctgtacgggctgct

SEQ ID NO: 700671 - DNA, 25 bp, Artificial sequence
  Synthetic oligonucleotide
aagcttggccacctcgcgctgtacg

SEQ ID NO: 700672 - DNA, 25 bp, Artificial sequence
  Synthetic oligonucleotide
agcgagcaagcttggccacctcgcg

SEQ ID NO: 700673 - DNA, 25 bp, Artificial sequence
  Synthetic oligonucleotide
gcatcacttcgtcgaccgcgacccg

SEQ ID NO: 700674 - DNA, 25 bp, Artificial sequence
  Synthetic oligonucleotide
gcgggctacctgatttccaccgccg

SEQ ID NO: 700675 - DNA, 25 bp, Artificial sequence
  Synthetic oligonucleotide
atccatctctacctggcctgggcgc

SEQ ID NO: 700676 - DNA, 25 bp, Artificial sequence
  Synthetic oligonucleotide
aaagcatcggcatcctgctggccat

SEQ ID NO: 700677 - DNA, 25 bp, Artificial sequence
  Synthetic oligonucleotide
ggccgccctcaagcatcacttcgtc

SEQ ID NO: 700678 - DNA, 25 bp, Artificial sequence
  Synthetic oligonucleotide
tgccctggccgccctcaagcatcac

SEQ ID NO: 700679 - DNA, 25 bp, Artificial sequence
  Synthetic oligonucleotide
cctccatgccctggccgccctcaag

SEQ ID NO: 700680 - DNA, 25 bp, Artificial sequence
  Synthetic oligonucleotide
cgccgtcctccatgccctggccgcc

SEQ ID NO: 700681 - DNA, 25 bp, Artificial sequence
  Synthetic oligonucleotide
ggtcttcgccgtcctccatgccctg

SEQ ID NO: 700682 - DNA, 25 bp, Artificial sequence
  Synthetic oligonucleotide
gctggtggtcttcgccgtcctccat

SEQ ID NO: 700683 - DNA, 25 bp, Artificial sequence
  Synthetic oligonucleotide
tgggcgctggtggtcttcgccgtcc

SEQ ID NO: 700684 - DNA, 25 bp, Artificial sequence
  Synthetic oligonucleotide
tggttctccgtgccggcaaccctca

SEQ ID NO: 700685 - DNA, 25 bp, Artificial sequence
  Synthetic oligonucleotide
ctctacctggcctgggcgctggtgg

SEQ ID NO: 700686 - DNA, 25 bp, Artificial sequence
  Synthetic oligonucleotide
tccgtgccggcaaccctcagcgggc

SEQ ID NO: 700687 - DNA, 25 bp, Artificial sequence
  Synthetic oligonucleotide
gtgaaatccatctctacctggcctg

SEQ ID NO: 700688 - DNA, 25 bp, Artificial sequence
  Synthetic oligonucleotide
tcgcgggtgaaatccatctctacct

SEQ ID NO: 700689 - DNA, 25 bp, Artificial sequence
  Synthetic oligonucleotide
cagacgtcgcgggtgaaatccatct

SEQ ID NO: 700690 - DNA, 25 bp, Artificial sequence
  Synthetic oligonucleotide
accaggcagacgtcgcgggtgaaat

SEQ ID NO: 700691 - DNA, 25 bp, Artificial sequence
  Synthetic oligonucleotide
tgcccgaccaggcagacgtcgcggg

SEQ ID NO: 700692 - DNA, 25 bp, Artificial sequence
  Synthetic oligonucleotide
gcgggctgcccgaccaggcagacgt

SEQ ID NO: 700693 - DNA, 25 bp, Artificial sequence
  Synthetic oligonucleotide
ccctcagcgggctgcccgaccaggc

SEQ ID NO: 700694 - DNA, 25 bp, Artificial sequence
  Synthetic oligonucleotide
ggtccgctcacgcgggtagcgagca

SEQ ID NO: 700695 - DNA, 25 bp, Artificial sequence
  Synthetic oligonucleotide
ctggcctgggcgctggtggtcttcg

SEQ ID NO: 700696 - DNA, 25 bp, Artificial sequence
  Synthetic oligonucleotide
agcctgttcctgcactggggcagcg

SEQ ID NO: 700697 - DNA, 25 bp, Artificial sequence
  Synthetic oligonucleotide
gcctgtggatgcgcgaactgagcta

SEQ ID NO: 700698 - DNA, 25 bp, Artificial sequence
  Synthetic oligonucleotide
gcctgggcctgtggatgcgcgaact

SEQ ID NO: 700699 - DNA, 25 bp, Artificial sequence
  Synthetic oligonucleotide
tgttcggcctgggcctgtggatgcg

SEQ ID NO: 700700 - DNA, 25 bp, Artificial sequence
  Synthetic oligonucleotide
ttcggcctgttcggcctgggcctgt

SEQ ID NO: 700701 - DNA, 25 bp, Artificial sequence
  Synthetic oligonucleotide
tggtcttcggcctgttcggcctggg

SEQ ID NO: 700702 - DNA, 25 bp, Artificial sequence
  Synthetic oligonucleotide
cgctggtggtcttcggcctgttcgg

SEQ ID NO: 700703 - DNA, 25 bp, Artificial sequence
  Synthetic oligonucleotide
ggcagcgcgctggtggtcttcggcc

SEQ ID NO: 700704 - DNA, 25 bp, Artificial sequence
  Synthetic oligonucleotide
cgggtagcgagcaagcttggccacc

SEQ ID NO: 700705 - DNA, 25 bp, Artificial sequence
  Synthetic oligonucleotide
ttcctgcactggggcagcgcgctgg

SEQ ID NO: 700706 - DNA, 25 bp, Artificial sequence
  Synthetic oligonucleotide
tgagctattacgacccctggtacca

SEQ ID NO: 700707 - DNA, 25 bp, Artificial sequence
  Synthetic oligonucleotide
gtattcagcctgttcctgcactggg

SEQ ID NO: 700708 - DNA, 25 bp, Artificial sequence
  Synthetic oligonucleotide
acggcgtattcagcctgttcctgca

SEQ ID NO: 700709 - DNA, 25 bp, Artificial sequence
  Synthetic oligonucleotide
ccgttacggcgtattcagcctgttc

SEQ ID NO: 700710 - DNA, 25 bp, Artificial sequence
  Synthetic oligonucleotide
ctcatcccgttacggcgtattcagc

SEQ ID NO: 700711 - DNA, 25 bp, Artificial sequence
  Synthetic oligonucleotide
aatacctcatcccgttacggcgtat

SEQ ID NO: 700712 - DNA, 25 bp, Artificial sequence
  Synthetic oligonucleotide
tggcgcaatacctcatcccgttacg

SEQ ID NO: 700713 - DNA, 25 bp, Artificial sequence
  Synthetic oligonucleotide
atgcagtggcgcaatacctcatccc

SEQ ID NO: 700714 - DNA, 25 bp, Artificial sequence
  Synthetic oligonucleotide
cggcgcaaacgccggaggtcgggat

SEQ ID NO: 700715 - DNA, 25 bp, Artificial sequence
  Synthetic oligonucleotide
cactggggcagcgcgctggtggtct

SEQ ID NO: 700716 - DNA, 25 bp, Artificial sequence
  Synthetic oligonucleotide
ttgccctgctggtgcggatcgtctg

SEQ ID NO: 700717 - DNA, 25 bp, Artificial sequence
  Synthetic oligonucleotide
aaccacggtccgctcacgcgggtag

SEQ ID NO: 700718 - DNA, 25 bp, Artificial sequence
  Synthetic oligonucleotide
cggccaaccacggtccgctcacgcg

SEQ ID NO: 700719 - DNA, 25 bp, Artificial sequence
  Synthetic oligonucleotide
cggcgccggccaaccacggtccgct

SEQ ID NO: 700720 - DNA, 25 bp, Artificial sequence
  Synthetic oligonucleotide
ccgccgccggcgccggccaaccacg

SEQ ID NO: 700721 - DNA, 25 bp, Artificial sequence
  Synthetic oligonucleotide
agcccgccgccgccggcgccggcca

SEQ ID NO: 700722 - DNA, 25 bp, Artificial sequence
  Synthetic oligonucleotide
ttcgtcagcccgccgccgccggcgc

SEQ ID NO: 700723 - DNA, 25 bp, Artificial sequence
  Synthetic oligonucleotide
tggcgtttcgtcagcccgccgccgc

SEQ ID NO: 700724 - DNA, 25 bp, Artificial sequence
  Synthetic oligonucleotide
atcgtctggcgtttcgtcagcccgc

SEQ ID NO: 700725 - DNA, 25 bp, Artificial sequence
  Synthetic oligonucleotide
ggatgcgcgaactgagctattacga

SEQ ID NO: 700726 - DNA, 25 bp, Artificial sequence
  Synthetic oligonucleotide
tgctggtgcggatcgtctggcgttt

SEQ ID NO: 700727 - DNA, 25 bp, Artificial sequence
  Synthetic oligonucleotide
gcgaactgagctattacgacccctg

SEQ ID NO: 700728 - DNA, 25 bp, Artificial sequence
  Synthetic oligonucleotide
tggccattgccctgctggtgcggat

SEQ ID NO: 700729 - DNA, 25 bp, Artificial sequence
  Synthetic oligonucleotide
tcctgctggccattgccctgctggt

SEQ ID NO: 700730 - DNA, 25 bp, Artificial sequence
  Synthetic oligonucleotide
tcggcatcctgctggccattgccct

SEQ ID NO: 700731 - DNA, 25 bp, Artificial sequence
  Synthetic oligonucleotide
tgcataaaagcatcggcatcctgct

SEQ ID NO: 700732 - DNA, 25 bp, Artificial sequence
  Synthetic oligonucleotide
ccgcgccggcgctgcataaaagcat

SEQ ID NO: 700733 - DNA, 25 bp, Artificial sequence
  Synthetic oligonucleotide
accaccccgcgccggcgctgcataa

SEQ ID NO: 700734 - DNA, 25 bp, Artificial sequence
  Synthetic oligonucleotide
cctggtaccaccccgcgccggcgct

SEQ ID NO: 700735 - DNA, 25 bp, Artificial sequence
  Synthetic oligonucleotide
gaccgcgacccgaccctaaagcgca

SEQ ID NO: 700736 - DNA, 25 bp, Artificial sequence
  Synthetic oligonucleotide
tgcggatcgtctggcgtttcgtcag

SEQ ID NO: 700737 - DNA, 25 bp, Artificial sequence
  Synthetic oligonucleotide
ccaacagcgtggacaccaaccatgc

SEQ ID NO: 700738 - DNA, 25 bp, Artificial sequence
  Synthetic oligonucleotide
atttcctcaacgtcagcaagaaccc

SEQ ID NO: 700739 - DNA, 25 bp, Artificial sequence
  Synthetic oligonucleotide
gcggtgatttcctcaacgtcagcaa

SEQ ID NO: 700740 - DNA, 25 bp, Artificial sequence
  Synthetic oligonucleotide
tgcgcagcggtgatttcctcaacgt

SEQ ID NO: 700741 - DNA, 25 bp, Artificial sequence
  Synthetic oligonucleotide
agcacctgcgcagcggtgatttcct

SEQ ID NO: 700742 - DNA, 25 bp, Artificial sequence
  Synthetic oligonucleotide
gtgacaagcacctgcgcagcggtga

SEQ ID NO: 700743 - DNA, 25 bp, Artificial sequence
  Synthetic oligonucleotide
gccgagcgtgacaagcacctgcgca

SEQ ID NO: 700744 - DNA, 25 bp, Artificial sequence
  Synthetic oligonucleotide
accatgccgagcgtgacaagcacct

SEQ ID NO: 700745 - DNA, 25 bp, Artificial sequence
  Synthetic oligonucleotide
gcagcttcaccttcgacgagaagaa

SEQ ID NO: 700746 - DNA, 25 bp, Artificial sequence
  Synthetic oligonucleotide
gcgtggacaccaaccatgccgagcg

SEQ ID NO: 700747 - DNA, 25 bp, Artificial sequence
  Synthetic oligonucleotide
ccgaccgctaccttcgaatccaccg

SEQ ID NO: 700748 - DNA, 25 bp, Artificial sequence
  Synthetic oligonucleotide
tcaacaccaacagcgtggacaccaa

SEQ ID NO: 700749 - DNA, 25 bp, Artificial sequence
  Synthetic oligonucleotide
gaccatcaacaccaacagcgtggac

SEQ ID NO: 700750 - DNA, 25 bp, Artificial sequence
  Synthetic oligonucleotide
caaggtgaccatcaacaccaacagc

SEQ ID NO: 700751 - DNA, 25 bp, Artificial sequence
  Synthetic oligonucleotide
caaggtcaaggtgaccatcaacacc

SEQ ID NO: 700752 - DNA, 25 bp, Artificial sequence
  Synthetic oligonucleotide
ggccgacaaggtcaaggtgaccatc

SEQ ID NO: 700753 - DNA, 25 bp, Artificial sequence
  Synthetic oligonucleotide
cccgtcggccgacaaggtcaaggtg

SEQ ID NO: 700754 - DNA, 25 bp, Artificial sequence
  Synthetic oligonucleotide
tcgacgagaagaacccgtcggccga

SEQ ID NO: 700755 - DNA, 25 bp, Artificial sequence
  Synthetic oligonucleotide
cctcaagcatcacttcgtcgaccgc

SEQ ID NO: 700756 - DNA, 25 bp, Artificial sequence
  Synthetic oligonucleotide
acaccaaccatgccgagcgtgacaa

SEQ ID NO: 700757 - DNA, 25 bp, Artificial sequence
  Synthetic oligonucleotide
cgacatcaccggcaacctgaccctg

SEQ ID NO: 700758 - DNA, 25 bp, Artificial sequence
  Synthetic oligonucleotide
tgatcggccagggcgacgacccgtg

SEQ ID NO: 700759 - DNA, 25 bp, Artificial sequence
  Synthetic oligonucleotide
ccaagctgatcggccagggcgacga

SEQ ID NO: 700760 - DNA, 25 bp, Artificial sequence
  Synthetic oligonucleotide
tcaaggccaagctgatcggccaggg

SEQ ID NO: 700761 - DNA, 25 bp, Artificial sequence
  Synthetic oligonucleotide
tcaccatcaaggccaagctgatcgg

SEQ ID NO: 700762 - DNA, 25 bp, Artificial sequence
  Synthetic oligonucleotide
agccggtcaccatcaaggccaagct

SEQ ID NO: 700763 - DNA, 25 bp, Artificial sequence
  Synthetic oligonucleotide
tgaccaagccggtcaccatcaaggc

SEQ ID NO: 700764 - DNA, 25 bp, Artificial sequence
  Synthetic oligonucleotide
acggcgtgaccaagccggtcaccat

SEQ ID NO: 700765 - DNA, 25 bp, Artificial sequence
  Synthetic oligonucleotide
ccctgaacggcgtgaccaagccggt

SEQ ID NO: 700766 - DNA, 25 bp, Artificial sequence
  Synthetic oligonucleotide
tcaacgtcagcaagaacccgaccgc

SEQ ID NO: 700767 - DNA, 25 bp, Artificial sequence
  Synthetic oligonucleotide
caccggcaacctgaccctgaacggc

SEQ ID NO: 700768 - DNA, 25 bp, Artificial sequence
  Synthetic oligonucleotide
tcagcaagaacccgaccgctacctt

SEQ ID NO: 700769 - DNA, 25 bp, Artificial sequence
  Synthetic oligonucleotide
acagcgccgacatcaccggcaacct

SEQ ID NO: 700770 - DNA, 25 bp, Artificial sequence
  Synthetic oligonucleotide
acggcgacagcgccgacatcaccgg

SEQ ID NO: 700771 - DNA, 25 bp, Artificial sequence
  Synthetic oligonucleotide
aggccaacggcgacagcgccgacat

SEQ ID NO: 700772 - DNA, 25 bp, Artificial sequence
  Synthetic oligonucleotide
gaagtgaaggccaacggcgacagcg

SEQ ID NO: 700773 - DNA, 25 bp, Artificial sequence
  Synthetic oligonucleotide
tccaccgaagtgaaggccaacggcg

SEQ ID NO: 700774 - DNA, 25 bp, Artificial sequence
  Synthetic oligonucleotide
ttcgaatccaccgaagtgaaggcca

SEQ ID NO: 700775 - DNA, 25 bp, Artificial sequence
  Synthetic oligonucleotide
gctaccttcgaatccaccgaagtga

SEQ ID NO: 700776 - DNA, 25 bp, Artificial sequence
  Synthetic oligonucleotide
tcgacggcagcttcaccttcgacga

SEQ ID NO: 700777 - DNA, 25 bp, Artificial sequence
  Synthetic oligonucleotide
aacctgaccctgaacggcgtgacca

SEQ ID NO: 700778 - DNA, 25 bp, Artificial sequence
  Synthetic oligonucleotide
accacgttaaggagaatgtccatgc

SEQ ID NO: 700779 - DNA, 25 bp, Artificial sequence
  Synthetic oligonucleotide
gctccgcactgttcaccgccggcca

SEQ ID NO: 700780 - DNA, 25 bp, Artificial sequence
  Synthetic oligonucleotide
cgctcggctccgcactgttcaccgc

SEQ ID NO: 700781 - DNA, 25 bp, Artificial sequence
  Synthetic oligonucleotide
gcgctggcgctcggctccgcactgt

SEQ ID NO: 700782 - DNA, 25 bp, Artificial sequence
  Synthetic oligonucleotide
cttgccgcgctggcgctcggctccg

SEQ ID NO: 700783 - DNA, 25 bp, Artificial sequence
  Synthetic oligonucleotide
aagacccttgccgcgctggcgctcg

SEQ ID NO: 700784 - DNA, 25 bp, Artificial sequence
  Synthetic oligonucleotide
ctgaagaagacccttgccgcgctgg

SEQ ID NO: 700785 - DNA, 25 bp, Artificial sequence
  Synthetic oligonucleotide
tccatgctgaagaagacccttgccg

SEQ ID NO: 700786 - DNA, 25 bp, Artificial sequence
  Synthetic oligonucleotide
tcaccttcgacgagaagaacccgtc

SEQ ID NO: 700787 - DNA, 25 bp, Artificial sequence
  Synthetic oligonucleotide
ttaaggagaatgtccatgctgaaga

SEQ ID NO: 700788 - DNA, 25 bp, Artificial sequence
  Synthetic oligonucleotide
ccggccaggcaatggccgcggacta

SEQ ID NO: 700789 - DNA, 25 bp, Artificial sequence
  Synthetic oligonucleotide
tcaacaaccacgttaaggagaatgt

SEQ ID NO: 700790 - DNA, 25 bp, Artificial sequence
  Synthetic oligonucleotide
gaatgatcaacaaccacgttaagga

SEQ ID NO: 700791 - DNA, 25 bp, Artificial sequence
  Synthetic oligonucleotide
ctcgtcgaatgatcaacaaccacgt

SEQ ID NO: 700792 - DNA, 25 bp, Artificial sequence
  Synthetic oligonucleotide
cggtcgctcgtcgaatgatcaacaa

SEQ ID NO: 700793 - DNA, 25 bp, Artificial sequence
  Synthetic oligonucleotide
catgctcggtcgctcgtcgaatgat

SEQ ID NO: 700794 - DNA, 25 bp, Artificial sequence
  Synthetic oligonucleotide
aaagcgcatgctcggtcgctcgtcg

SEQ ID NO: 700795 - DNA, 25 bp, Artificial sequence
  Synthetic oligonucleotide
accctaaagcgcatgctcggtcgct

SEQ ID NO: 700796 - DNA, 25 bp, Artificial sequence
  Synthetic oligonucleotide
gacccgaccctaaagcgcatgctcg

SEQ ID NO: 700797 - DNA, 25 bp, Artificial sequence
  Synthetic oligonucleotide
agaatgtccatgctgaagaagaccc

SEQ ID NO: 700798 - DNA, 25 bp, Artificial sequence
  Synthetic oligonucleotide
acgccttcatcgagttccgcatcaa

SEQ ID NO: 700799 - DNA, 25 bp, Artificial sequence
  Synthetic oligonucleotide
acgacttcgacggcagcttcacctt

SEQ ID NO: 700800 - DNA, 25 bp, Artificial sequence
  Synthetic oligonucleotide
gcttcaacgacttcgacggcagctt

SEQ ID NO: 700801 - DNA, 25 bp, Artificial sequence
  Synthetic oligonucleotide
acggccgcttcaacgacttcgacgg

SEQ ID NO: 700802 - DNA, 25 bp, Artificial sequence
  Synthetic oligonucleotide
gctgtacggccgcttcaacgacttc

SEQ ID NO: 700803 - DNA, 25 bp, Artificial sequence
  Synthetic oligonucleotide
tagctggctgtacggccgcttcaac

SEQ ID NO: 700804 - DNA, 25 bp, Artificial sequence
  Synthetic oligonucleotide
ggctatagctggctgtacggccgct

SEQ ID NO: 700805 - DNA, 25 bp, Artificial sequence
  Synthetic oligonucleotide
gcacctgggctatagctggctgtac

SEQ ID NO: 700806 - DNA, 25 bp, Artificial sequence
  Synthetic oligonucleotide
catcaagcacctgggctatagctgg

SEQ ID NO: 700807 - DNA, 25 bp, Artificial sequence
  Synthetic oligonucleotide
actgttcaccgccggccaggcaatg

SEQ ID NO: 700808 - DNA, 25 bp, Artificial sequence
  Synthetic oligonucleotide
catcgagttccgcatcaagcacctg

SEQ ID NO: 700809 - DNA, 25 bp, Artificial sequence
  Synthetic oligonucleotide
caccgccggccaggcaatggccgcg

SEQ ID NO: 700810 - DNA, 25 bp, Artificial sequence
  Synthetic oligonucleotide
gccagcacgccttcatcgagttccg

SEQ ID NO: 700811 - DNA, 25 bp, Artificial sequence
  Synthetic oligonucleotide
aggaaggccagcacgccttcatcga

SEQ ID NO: 700812 - DNA, 25 bp, Artificial sequence
  Synthetic oligonucleotide
tcgacaaggaaggccagcacgcctt

SEQ ID NO: 700813 - DNA, 25 bp, Artificial sequence
  Synthetic oligonucleotide
acaagatcgacaaggaaggccagca

SEQ ID NO: 700814 - DNA, 25 bp, Artificial sequence
  Synthetic oligonucleotide
cggactacaagatcgacaaggaagg

SEQ ID NO: 700815 - DNA, 25 bp, Artificial sequence
  Synthetic oligonucleotide
tggccgcggactacaagatcgacaa

SEQ ID NO: 700816 - DNA, 25 bp, Artificial sequence
  Synthetic oligonucleotide
aggcaatggccgcggactacaagat

SEQ ID NO: 700817 - DNA, 25 bp, Artificial sequence
  Synthetic oligonucleotide
cagggcgacgacccgtggggcggct

SEQ ID NO: 700818 - DNA, 25 bp, Artificial sequence
  Synthetic oligonucleotide
gttccgcatcaagcacctgggctat

SEQ ID NO: 700819 - DNA, 25 bp, Artificial sequence
  Synthetic oligonucleotide
tgggtgaaatgaggttgccgattca

SEQ ID NO: 700820 - DNA, 25 bp, Artificial sequence
  Synthetic oligonucleotide
cagtcagttcttgttttcaaaacgg

SEQ ID NO: 700821 - DNA, 25 bp, Artificial sequence
  Synthetic oligonucleotide
ttgcttaccgcagcattccggagtg

SEQ ID NO: 700822 - DNA, 25 bp, Artificial sequence
  Synthetic oligonucleotide
ttgcttaccgcaccattccggagtg

SEQ ID NO: 700823 - DNA, 25 bp, Artificial sequence
  Synthetic oligonucleotide
ccgttgcaggcgaagttgattttgc

SEQ ID NO: 700824 - DNA, 25 bp, Artificial sequence
  Synthetic oligonucleotide
ccgttgcaggcgtagttgattttgc

SEQ ID NO: 700825 - DNA, 25 bp, Artificial sequence
  Synthetic oligonucleotide
tggaaaatgctttagaaggatctgt

SEQ ID NO: 700826 - DNA, 25 bp, Artificial sequence
  Synthetic oligonucleotide
tggaaaatgcttaagaaggatctgt

SEQ ID NO: 700827 - DNA, 25 bp, Artificial sequence
  Synthetic oligonucleotide
aatgccataaatatcttcatcgaca

SEQ ID NO: 700828 - DNA, 25 bp, Artificial sequence
  Synthetic oligonucleotide
tcgtccatccctcaagagagaatgc

SEQ ID NO: 700829 - DNA, 25 bp, Artificial sequence
  Synthetic oligonucleotide
tagactatttaatacatgaacagcc

SEQ ID NO: 700830 - DNA, 25 bp, Artificial sequence
  Synthetic oligonucleotide
ttccatatgaatacgccaattctac

SEQ ID NO: 700831 - DNA, 25 bp, Artificial sequence
  Synthetic oligonucleotide
tgggtgaaatgacgttgccgattca

SEQ ID NO: 700832 - DNA, 25 bp, Artificial sequence
  Synthetic oligonucleotide
aatgccataaatttcttcatcgaca

SEQ ID NO: 700833 - DNA, 25 bp, Artificial sequence
  Synthetic oligonucleotide
tcatttggaggaaaggtcaggtgcg

SEQ ID NO: 700834 - DNA, 25 bp, Artificial sequence
  Synthetic oligonucleotide
tcgacaaaatttactcacattcaca

SEQ ID NO: 700835 - DNA, 25 bp, Artificial sequence
  Synthetic oligonucleotide
cagtcagttcttcttttcaaaacgg

SEQ ID NO: 700836 - DNA, 25 bp, Artificial sequence
  Synthetic oligonucleotide
ttccatatgaattcgccaattctac

SEQ ID NO: 700837 - DNA, 25 bp, Artificial sequence
  Synthetic oligonucleotide
tagactatttaaaacatgaacagcc

SEQ ID NO: 700838 - DNA, 25 bp, Artificial sequence
  Synthetic oligonucleotide
ttccattcaccagaccattccgctt

SEQ ID NO: 700839 - DNA, 25 bp, Artificial sequence
  Synthetic oligonucleotide
agatgccgttcataaggtcgattta

SEQ ID NO: 700840 - DNA, 25 bp, Artificial sequence
  Synthetic oligonucleotide
agatgccgttcaaaaggtcgattta

SEQ ID NO: 700841 - DNA, 25 bp, Artificial sequence
  Synthetic oligonucleotide
gtgataagtaggcagcattcgtaga

SEQ ID NO: 700842 - DNA, 25 bp, Artificial sequence
  Synthetic oligonucleotide
caaagtttgtcagtgaccatcccga

SEQ ID NO: 700843 - DNA, 25 bp, Artificial sequence
  Synthetic oligonucleotide
gttttataaatagagggatgctgtt

SEQ ID NO: 700844 - DNA, 25 bp, Artificial sequence
  Synthetic oligonucleotide
gttttataaatacagggatgctgtt

SEQ ID NO: 700845 - DNA, 25 bp, Artificial sequence
  Synthetic oligonucleotide
caccatggtaaatgaacaaattatc

SEQ ID NO: 700846 - DNA, 25 bp, Artificial sequence
  Synthetic oligonucleotide
caccatggtaaaagaacaaattatc

SEQ ID NO: 700847 - DNA, 25 bp, Artificial sequence
  Synthetic oligonucleotide
tcatttggaggataggtcaggtgcg

SEQ ID NO: 700848 - DNA, 25 bp, Artificial sequence
  Synthetic oligonucleotide
tcttcaggcggttgctgattctgga

SEQ ID NO: 700849 - DNA, 25 bp, Artificial sequence
  Synthetic oligonucleotide
ttccattcaccacaccattccgctt

SEQ ID NO: 700850 - DNA, 25 bp, Artificial sequence
  Synthetic oligonucleotide
gttatttaggtccagcagctacatt

SEQ ID NO: 700851 - DNA, 25 bp, Artificial sequence
  Synthetic oligonucleotide
aaatgtgacactctctatcagtacg

SEQ ID NO: 700852 - DNA, 25 bp, Artificial sequence
  Synthetic oligonucleotide
aaatgtgacactgtctatcagtacg

SEQ ID NO: 700853 - DNA, 25 bp, Artificial sequence
  Synthetic oligonucleotide
agaagacattcaaacattaatgaat

SEQ ID NO: 700854 - DNA, 25 bp, Artificial sequence
  Synthetic oligonucleotide
agaagacattcatacattaatgaat

SEQ ID NO: 700855 - DNA, 25 bp, Artificial sequence
  Synthetic oligonucleotide
gtttgattttgttgaaaaggttgaa

SEQ ID NO: 700856 - DNA, 25 bp, Artificial sequence
  Synthetic oligonucleotide
gtttgattttgtagaaaaggttgaa

SEQ ID NO: 700857 - DNA, 25 bp, Artificial sequence
  Synthetic oligonucleotide
aggtgcataaggcagagaaaatcgt

SEQ ID NO: 700858 - DNA, 25 bp, Artificial sequence
  Synthetic oligonucleotide
aggtgcataagggagagaaaatcgt

SEQ ID NO: 700859 - DNA, 25 bp, Artificial sequence
  Synthetic oligonucleotide
gttatttaggtcgagcagctacatt

SEQ ID NO: 700860 - DNA, 25 bp, Artificial sequence
  Synthetic oligonucleotide
tcttcaggcggtagctgattctgga

SEQ ID NO: 700861 - DNA, 25 bp, Artificial sequence
  Synthetic oligonucleotide
ggatggctgcagttaaatctccgta

SEQ ID NO: 700862 - DNA, 25 bp, Artificial sequence
  Synthetic oligonucleotide
cagtcttaccaaatataaaaaaagc

SEQ ID NO: 700863 - DNA, 25 bp, Artificial sequence
  Synthetic oligonucleotide
ttagtctttaattaaaaatgccggc

SEQ ID NO: 700864 - DNA, 25 bp, Artificial sequence
  Synthetic oligonucleotide
ttagtctttaataaaaaatgccggc

SEQ ID NO: 700865 - DNA, 25 bp, Artificial sequence
  Synthetic oligonucleotide
cttggcaggcttgatcgatgcgatg

SEQ ID NO: 700866 - DNA, 25 bp, Artificial sequence
  Synthetic oligonucleotide
cttggcaggcttcatcgatgcgatg

SEQ ID NO: 700867 - DNA, 25 bp, Artificial sequence
  Synthetic oligonucleotide
ctgtcagtgtatgcaggtgcacgcc

SEQ ID NO: 700868 - DNA, 25 bp, Artificial sequence
  Synthetic oligonucleotide
gtgataagtagggagcattcgtaga

SEQ ID NO: 700869 - DNA, 25 bp, Artificial sequence
  Synthetic oligonucleotide
tgatgaaatggctaacttctttccg

SEQ ID NO: 700870 - DNA, 25 bp, Artificial sequence
  Synthetic oligonucleotide
ctgtcagtgtatccaggtgcacgcc

SEQ ID NO: 700871 - DNA, 25 bp, Artificial sequence
  Synthetic oligonucleotide
ggatggctgcagataaatctccgta

SEQ ID NO: 700872 - DNA, 25 bp, Artificial sequence
  Synthetic oligonucleotide
gcactcggctgctaagtgaggcttc

SEQ ID NO: 700873 - DNA, 25 bp, Artificial sequence
  Synthetic oligonucleotide
ttacgtcttttagtgtaacgccttc

SEQ ID NO: 700874 - DNA, 25 bp, Artificial sequence
  Synthetic oligonucleotide
ttacgtcttttactgtaacgccttc

SEQ ID NO: 700875 - DNA, 25 bp, Artificial sequence
  Synthetic oligonucleotide
gctgcagttcctcttctgtccgttc

SEQ ID NO: 700876 - DNA, 25 bp, Artificial sequence
  Synthetic oligonucleotide
gctgcagttcctgttctgtccgttc

SEQ ID NO: 700877 - DNA, 25 bp, Artificial sequence
  Synthetic oligonucleotide
gacatgctatgattctttctgcctg

SEQ ID NO: 700878 - DNA, 25 bp, Artificial sequence
  Synthetic oligonucleotide
gacatgctatgaatctttctgcctg

SEQ ID NO: 700879 - DNA, 25 bp, Artificial sequence
  Synthetic oligonucleotide
gagcggctgcatgcatgtatacata

SEQ ID NO: 700880 - DNA, 25 bp, Artificial sequence
  Synthetic oligonucleotide
aaagctgcttgatcgaaaaaaagca

SEQ ID NO: 700881 - DNA, 25 bp, Artificial sequence
  Synthetic oligonucleotide
cgggcgaaatgcagatgatatggtc

SEQ ID NO: 700882 - DNA, 25 bp, Artificial sequence
  Synthetic oligonucleotide
tgatgaaatggcaaacttctttccg

SEQ ID NO: 700883 - DNA, 25 bp, Artificial sequence
  Synthetic oligonucleotide
gcaggatgatcactccggggcgctg

SEQ ID NO: 700884 - DNA, 25 bp, Artificial sequence
  Synthetic oligonucleotide
gggtcattgccattgatatggcagc

SEQ ID NO: 700885 - DNA, 25 bp, Artificial sequence
  Synthetic oligonucleotide
gggtcattgccaatgatatggcagc

SEQ ID NO: 700886 - DNA, 25 bp, Artificial sequence
  Synthetic oligonucleotide
attaaaaatcgtcaaacgggatata

SEQ ID NO: 700887 - DNA, 25 bp, Artificial sequence
  Synthetic oligonucleotide
attaaaaatcgtgaaacgggatata

SEQ ID NO: 700888 - DNA, 25 bp, Artificial sequence
  Synthetic oligonucleotide
ggacaatcatactagatttgttatc

SEQ ID NO: 700889 - DNA, 25 bp, Artificial sequence
  Synthetic oligonucleotide
ggacaatcatacaagatttgttatc

SEQ ID NO: 700890 - DNA, 25 bp, Artificial sequence
  Synthetic oligonucleotide
tgaaaacatatcttttgaagtgaat

SEQ ID NO: 700891 - DNA, 25 bp, Artificial sequence
  Synthetic oligonucleotide
tgaaaacatatcatttgaagtgaat

SEQ ID NO: 700892 - DNA, 25 bp, Artificial sequence
  Synthetic oligonucleotide
ctctaggcccaaaacgaccttaatg

SEQ ID NO: 700893 - DNA, 25 bp, Artificial sequence
  Synthetic oligonucleotide
cagtcttaccaattataaaaaaagc

SEQ ID NO: 700894 - DNA, 25 bp, Artificial sequence
  Synthetic oligonucleotide
gcaggatgatcagtccggggcgctg

SEQ ID NO: 700895 - DNA, 25 bp, Artificial sequence
  Synthetic oligonucleotide
gcactcggctgcaaagtgaggcttc

SEQ ID NO: 700896 - DNA, 25 bp, Artificial sequence
  Synthetic oligonucleotide
gtctgcattttcttggagaaattta

SEQ ID NO: 700897 - DNA, 25 bp, Artificial sequence
  Synthetic oligonucleotide
gtctgcattttcatggagaaattta

SEQ ID NO: 700898 - DNA, 25 bp, Artificial sequence
  Synthetic oligonucleotide
aattgagtcacgtccgactaaaacc

SEQ ID NO: 700899 - DNA, 25 bp, Artificial sequence
  Synthetic oligonucleotide
aattgagtcacgaccgactaaaacc

SEQ ID NO: 700900 - DNA, 25 bp, Artificial sequence
  Synthetic oligonucleotide
tatttctttatttttgatattgaga

SEQ ID NO: 700901 - DNA, 25 bp, Artificial sequence
  Synthetic oligonucleotide
tatttctttattattgatattgaga

SEQ ID NO: 700902 - DNA, 25 bp, Artificial sequence
  Synthetic oligonucleotide
gatgtattgattccaggggccatgc

SEQ ID NO: 700903 - DNA, 25 bp, Artificial sequence
  Synthetic oligonucleotide
gatgtattgattgcaggggccatgc

SEQ ID NO: 700904 - DNA, 25 bp, Artificial sequence
  Synthetic oligonucleotide
caaagtttgtcactgaccatcccga

SEQ ID NO: 700905 - DNA, 25 bp, Artificial sequence
  Synthetic oligonucleotide
ctctaggcccaatacgaccttaatg

SEQ ID NO: 700906 - DNA, 25 bp, Artificial sequence
  Synthetic oligonucleotide
gctttcagaaaagggcgagccggga

SEQ ID NO: 700907 - DNA, 25 bp, Artificial sequence
  Synthetic oligonucleotide
cgggcgaaatgctgatgatatggtc

SEQ ID NO: 700908 - DNA, 25 bp, Artificial sequence
  Synthetic oligonucleotide
gagcggctgcatccatgtatacata

SEQ ID NO: 700909 - DNA, 25 bp, Artificial sequence
  Synthetic oligonucleotide
gccgggcaccgttgtgacagacgat

SEQ ID NO: 700910 - DNA, 25 bp, Artificial sequence
  Synthetic oligonucleotide
ggtcatcgctgatttaacagagcac

SEQ ID NO: 700911 - DNA, 25 bp, Artificial sequence
  Synthetic oligonucleotide
ggtcatcgctgaattaacagagcac

SEQ ID NO: 700912 - DNA, 25 bp, Artificial sequence
  Synthetic oligonucleotide
tgtcattgcaagtggcggaagaggc

SEQ ID NO: 700913 - DNA, 25 bp, Artificial sequence
  Synthetic oligonucleotide
tgtcattgcaagaggcggaagaggc

SEQ ID NO: 700914 - DNA, 25 bp, Artificial sequence
  Synthetic oligonucleotide
tagccgctttgcaacaccggctaat

SEQ ID NO: 700915 - DNA, 25 bp, Artificial sequence
  Synthetic oligonucleotide
catggttgaaacggatgacggacgc

SEQ ID NO: 700916 - DNA, 25 bp, Artificial sequence
  Synthetic oligonucleotide
gctttcagaaaacggcgagccggga

SEQ ID NO: 700917 - DNA, 25 bp, Artificial sequence
  Synthetic oligonucleotide
gattcgcggcgaccatggcatgtcc

SEQ ID NO: 700918 - DNA, 25 bp, Artificial sequence
  Synthetic oligonucleotide
cattgttcttgaattaaaagtgctt

SEQ ID NO: 700919 - DNA, 25 bp, Artificial sequence
  Synthetic oligonucleotide
cattgttcttgatttaaaagtgctt

SEQ ID NO: 700920 - DNA, 25 bp, Artificial sequence
  Synthetic oligonucleotide
acttgtcgggttgccgagtgtggga

SEQ ID NO: 700921 - DNA, 25 bp, Artificial sequence
  Synthetic oligonucleotide
acttgtcgggttcccgagtgtggga

SEQ ID NO: 700922 - DNA, 25 bp, Artificial sequence
  Synthetic oligonucleotide
gctgtctgttgtctcatctgcaaaa

SEQ ID NO: 700923 - DNA, 25 bp, Artificial sequence
  Synthetic oligonucleotide
gctgtctgttgtgtcatctgcaaaa

SEQ ID NO: 700924 - DNA, 25 bp, Artificial sequence
  Synthetic oligonucleotide
ggactatcactttacaacgcttgtc

SEQ ID NO: 700925 - DNA, 25 bp, Artificial sequence
  Synthetic oligonucleotide
ggactatcacttaacaacgcttgtc

SEQ ID NO: 700926 - DNA, 25 bp, Artificial sequence
  Synthetic oligonucleotide
gccgggcaccgtagtgacagacgat

SEQ ID NO: 700927 - DNA, 25 bp, Artificial sequence
  Synthetic oligonucleotide
tagccgctttgctacaccggctaat

SEQ ID NO: 700928 - DNA, 25 bp, Artificial sequence
  Synthetic oligonucleotide
caaagtatatgttaaaggcggcgac

SEQ ID NO: 700929 - DNA, 25 bp, Artificial sequence
  Synthetic oligonucleotide
tgattttcacggcgcctttgccgat

SEQ ID NO: 700930 - DNA, 25 bp, Artificial sequence
  Synthetic oligonucleotide
tgattttcacggggcctttgccgat

SEQ ID NO: 700931 - DNA, 25 bp, Artificial sequence
  Synthetic oligonucleotide
tgatgatattcgccagaatggatat

SEQ ID NO: 700932 - DNA, 25 bp, Artificial sequence
  Synthetic oligonucleotide
tgatgatattcggcagaatggatat

SEQ ID NO: 700933 - DNA, 25 bp, Artificial sequence
  Synthetic oligonucleotide
tatcatgcgttttgaaatcacgagt

SEQ ID NO: 700934 - DNA, 25 bp, Artificial sequence
  Synthetic oligonucleotide
tatcatgcgtttagaaatcacgagt

SEQ ID NO: 700935 - DNA, 25 bp, Artificial sequence
  Synthetic oligonucleotide
gattgaaattgggttggactagcgg

SEQ ID NO: 700936 - DNA, 25 bp, Artificial sequence
  Synthetic oligonucleotide
gattgaaattggcttggactagcgg

SEQ ID NO: 700937 - DNA, 25 bp, Artificial sequence
  Synthetic oligonucleotide
gtttagaacggaggacattatgttt

SEQ ID NO: 700938 - DNA, 25 bp, Artificial sequence
  Synthetic oligonucleotide
tcgacaaaattttctcacattcaca

SEQ ID NO: 700939 - DNA, 25 bp, Artificial sequence
  Synthetic oligonucleotide
caaagtatatgtaaaaggcggcgac

SEQ ID NO: 700940 - DNA, 25 bp, Artificial sequence
  Synthetic oligonucleotide
gattcgcggcgagcatggcatgtcc

SEQ ID NO: 700941 - DNA, 25 bp, Artificial sequence
  Synthetic oligonucleotide
tatggttgcgttacgccgtgaaaaa

SEQ ID NO: 700942 - DNA, 25 bp, Artificial sequence
  Synthetic oligonucleotide
tatggttgcgtttcgccgtgaaaaa

SEQ ID NO: 700943 - DNA, 25 bp, Artificial sequence
  Synthetic oligonucleotide
aggcggccctgcgggcggtgacgga

SEQ ID NO: 700944 - DNA, 25 bp, Artificial sequence
  Synthetic oligonucleotide
aggcggccctgccggcggtgacgga

SEQ ID NO: 700945 - DNA, 25 bp, Artificial sequence
  Synthetic oligonucleotide
agacgtcgttttagaagtagatgaa

SEQ ID NO: 700946 - DNA, 25 bp, Artificial sequence
  Synthetic oligonucleotide
agacgtcgtttttgaagtagatgaa

SEQ ID NO: 700947 - DNA, 25 bp, Artificial sequence
  Synthetic oligonucleotide
cctgatggattttagatacaaaaaa

SEQ ID NO: 700948 - DNA, 25 bp, Artificial sequence
  Synthetic oligonucleotide
cctgatggatttaagatacaaaaaa

SEQ ID NO: 700949 - DNA, 25 bp, Artificial sequence
  Synthetic oligonucleotide
ggctgatttgcctgggctgattgaa

SEQ ID NO: 700950 - DNA, 25 bp, Artificial sequence
  Synthetic oligonucleotide
gtttagaacggacgacattatgttt

SEQ ID NO: 700951 - DNA, 25 bp, Artificial sequence
  Synthetic oligonucleotide
agatataatcaggcttctggaattt

SEQ ID NO: 700952 - DNA, 25 bp, Artificial sequence
  Synthetic oligonucleotide
agaagtgccatttaacattacacgc

SEQ ID NO: 700953 - DNA, 25 bp, Artificial sequence
  Synthetic oligonucleotide
agaagtgccattaaacattacacgc

SEQ ID NO: 700954 - DNA, 25 bp, Artificial sequence
  Synthetic oligonucleotide
tgtatttgtgctttcaggagacagc

SEQ ID NO: 700955 - DNA, 25 bp, Artificial sequence
  Synthetic oligonucleotide
tgtatttgtgctatcaggagacagc

SEQ ID NO: 700956 - DNA, 25 bp, Artificial sequence
  Synthetic oligonucleotide
attcaagatgacagatttctcacgt

SEQ ID NO: 700957 - DNA, 25 bp, Artificial sequence
  Synthetic oligonucleotide
attcaagatgactgatttctcacgt

SEQ ID NO: 700958 - DNA, 25 bp, Artificial sequence
  Synthetic oligonucleotide
taaacggtttgcaagacagatgcgc

SEQ ID NO: 700959 - DNA, 25 bp, Artificial sequence
  Synthetic oligonucleotide
taaacggtttgctagacagatgcgc

SEQ ID NO: 700960 - DNA, 25 bp, Artificial sequence
  Synthetic oligonucleotide
catggttgaaaccgatgacggacgc

SEQ ID NO: 700961 - DNA, 25 bp, Artificial sequence
  Synthetic oligonucleotide
tgatgaagcactcagagaacgcgga

SEQ ID NO: 700962 - DNA, 25 bp, Artificial sequence
  Synthetic oligonucleotide
cacaccggaattcccgctgtatgac

SEQ ID NO: 700963 - DNA, 25 bp, Artificial sequence
  Synthetic oligonucleotide
agatataatcagccttctggaattt

SEQ ID NO: 700964 - DNA, 25 bp, Artificial sequence
  Synthetic oligonucleotide
tattgattaatctatgttggctgaa

SEQ ID NO: 700965 - DNA, 25 bp, Artificial sequence
  Synthetic oligonucleotide
tattgattaatcaatgttggctgaa

SEQ ID NO: 700966 - DNA, 25 bp, Artificial sequence
  Synthetic oligonucleotide
gtgccaggctctgtattttaaaggg

SEQ ID NO: 700967 - DNA, 25 bp, Artificial sequence
  Synthetic oligonucleotide
gtgccaggctctctattttaaaggg

SEQ ID NO: 700968 - DNA, 25 bp, Artificial sequence
  Synthetic oligonucleotide
gaaagaggagactttttatcttgtc

SEQ ID NO: 700969 - DNA, 25 bp, Artificial sequence
  Synthetic oligonucleotide
gaaagaggagacattttatcttgtc

SEQ ID NO: 700970 - DNA, 25 bp, Artificial sequence
  Synthetic oligonucleotide
attgcccgatgctatgagaaaaaca

SEQ ID NO: 700971 - DNA, 25 bp, Artificial sequence
  Synthetic oligonucleotide
attgcccgatgcaatgagaaaaaca

SEQ ID NO: 700972 - DNA, 25 bp, Artificial sequence
  Synthetic oligonucleotide
tgatgaagcactgagagaacgcgga

SEQ ID NO: 700973 - DNA, 25 bp, Artificial sequence
  Synthetic oligonucleotide
taaaatggacatcccggaggctgcg

SEQ ID NO: 700974 - DNA, 25 bp, Artificial sequence
  Synthetic oligonucleotide
ggctgatttgccagggctgattgaa

SEQ ID NO: 700975 - DNA, 25 bp, Artificial sequence
  Synthetic oligonucleotide
aggcgtcggactgggccaccagttt

SEQ ID NO: 700976 - DNA, 25 bp, Artificial sequence
  Synthetic oligonucleotide
aggcgtcggactcggccaccagttt

SEQ ID NO: 700977 - DNA, 25 bp, Artificial sequence
  Synthetic oligonucleotide
tgaacggacgagcgttattgttcat

SEQ ID NO: 700978 - DNA, 25 bp, Artificial sequence
  Synthetic oligonucleotide
tgaacggacgagggttattgttcat

SEQ ID NO: 700979 - DNA, 25 bp, Artificial sequence
  Synthetic oligonucleotide
gtcaggcttagaaggccgtgatcca

SEQ ID NO: 700980 - DNA, 25 bp, Artificial sequence
  Synthetic oligonucleotide
gtcaggcttagatggccgtgatcca

SEQ ID NO: 700981 - DNA, 25 bp, Artificial sequence
  Synthetic oligonucleotide
tcttacgattaagcaggagctgagc

SEQ ID NO: 700982 - DNA, 25 bp, Artificial sequence
  Synthetic oligonucleotide
tcttacgattaaccaggagctgagc

SEQ ID NO: 700983 - DNA, 25 bp, Artificial sequence
  Synthetic oligonucleotide
tacacaaaaccgtgtcatgtacacg

SEQ ID NO: 700984 - DNA, 25 bp, Artificial sequence
  Synthetic oligonucleotide
gcgtctcactgaccgtccgcaaatt

SEQ ID NO: 700985 - DNA, 25 bp, Artificial sequence
  Synthetic oligonucleotide
tacacaaaaccgagtcatgtacacg

SEQ ID NO: 700986 - DNA, 25 bp, Artificial sequence
  Synthetic oligonucleotide
taaaatggacatgccggaggctgcg

SEQ ID NO: 700987 - DNA, 25 bp, Artificial sequence
  Synthetic oligonucleotide
agcctttaaagaaaagctgacggat

SEQ ID NO: 700988 - DNA, 25 bp, Artificial sequence
  Synthetic oligonucleotide
agcctttaaagataagctgacggat

SEQ ID NO: 700989 - DNA, 25 bp, Artificial sequence
  Synthetic oligonucleotide
attcccgatcagagcggtgacaaga

SEQ ID NO: 700990 - DNA, 25 bp, Artificial sequence
  Synthetic oligonucleotide
attcccgatcagtgcggtgacaaga

SEQ ID NO: 700991 - DNA, 25 bp, Artificial sequence
  Synthetic oligonucleotide
tgagcttctgtttgaggttgccaat

SEQ ID NO: 700992 - DNA, 25 bp, Artificial sequence
  Synthetic oligonucleotide
tgagcttctgttagaggttgccaat

SEQ ID NO: 700993 - DNA, 25 bp, Artificial sequence
  Synthetic oligonucleotide
cacaccggaattgccgctgtatgac

SEQ ID NO: 700994 - DNA, 25 bp, Artificial sequence
  Synthetic oligonucleotide
aaagctgcttgaacgaaaaaaagca

SEQ ID NO: 700995 - DNA, 25 bp, Artificial sequence
  Synthetic oligonucleotide
gcgtctcactgagcgtccgcaaatt

SEQ ID NO: 700996 - DNA, 25 bp, Artificial sequence
  Synthetic oligonucleotide
tcgtccatccctgaagagagaatgc

SEQ ID NO: 700997 - DNA, 25 bp, Artificial sequence
  Synthetic oligonucleotide
aattctgcagcgccagtgaaggcac

SEQ ID NO: 700998 - DNA, 25 bp, Artificial sequence
  Synthetic oligonucleotide
gtttgaacagcgtcgcaatgaagaa

SEQ ID NO: 700999 - DNA, 25 bp, Artificial sequence
  Synthetic oligonucleotide
cccagattttttgtattgatcggga

SEQ ID NO: 701000 - DNA, 25 bp, Artificial sequence
  Synthetic oligonucleotide
cccagattttttctattgatcggga

SEQ ID NO: 701001 - DNA, 25 bp, Artificial sequence
  Synthetic oligonucleotide
tggattttatgggtggacattgaga

SEQ ID NO: 701002 - DNA, 25 bp, Artificial sequence
  Synthetic oligonucleotide
ttgtgcaggtatcaagacaggtgtt

SEQ ID NO: 701003 - DNA, 25 bp, Artificial sequence
  Synthetic oligonucleotide
ggccggatatagtccgcccctactc

SEQ ID NO: 701004 - DNA, 25 bp, Artificial sequence
  Synthetic oligonucleotide
ttgtgcaggtatgaagacaggtgtt

SEQ ID NO: 701005 - DNA, 25 bp, Artificial sequence
  Synthetic oligonucleotide
ggccggatatagaccgcccctactc

SEQ ID NO: 701006 - DNA, 25 bp, Artificial sequence
  Synthetic oligonucleotide
gtagtcagaggaaaaacgggtttcc

SEQ ID NO: 701007 - DNA, 25 bp, Artificial sequence
  Synthetic oligonucleotide
gtagtcagaggataaacgggtttcc

SEQ ID NO: 701008 - DNA, 25 bp, Artificial sequence
  Synthetic oligonucleotide
acatttacggtgccggctctgaatc

SEQ ID NO: 701009 - DNA, 25 bp, Artificial sequence
  Synthetic oligonucleotide
acatttacggtggcggctctgaatc

SEQ ID NO: 701010 - DNA, 25 bp, Artificial sequence
  Synthetic oligonucleotide
aattctgcagcggcagtgaaggcac

SEQ ID NO: 701011 - DNA, 25 bp, Artificial sequence
  Synthetic oligonucleotide
tggattttatggctggacattgaga

SEQ ID NO: 701012 - DNA, 25 bp, Artificial sequence
  Synthetic oligonucleotide
tgactgttacatcatatccctgctg

SEQ ID NO: 701013 - DNA, 25 bp, Artificial sequence
  Synthetic oligonucleotide
tggcgataatcggtacatttttcgc

SEQ ID NO: 701014 - DNA, 25 bp, Artificial sequence
  Synthetic oligonucleotide
aatgattgaatggccagaaaattgg

SEQ ID NO: 701015 - DNA, 25 bp, Artificial sequence
  Synthetic oligonucleotide
ataaaatgtcttttcgtttttggca

SEQ ID NO: 701016 - DNA, 25 bp, Artificial sequence
  Synthetic oligonucleotide
ataaaatgtcttatcgtttttggca

SEQ ID NO: 701017 - DNA, 25 bp, Artificial sequence
  Synthetic oligonucleotide
cagcgcaattatcaatggactgatg

SEQ ID NO: 701018 - DNA, 25 bp, Artificial sequence
  Synthetic oligonucleotide
gtttgaacagcgacgcaatgaagaa

SEQ ID NO: 701019 - DNA, 25 bp, Artificial sequence
  Synthetic oligonucleotide
tgactgttacatgatatccctgctg

SEQ ID NO: 701020 - DNA, 25 bp, Artificial sequence
  Synthetic oligonucleotide
aatgattgaatgcccagaaaattgg

SEQ ID NO: 701021 - DNA, 25 bp, Artificial sequence
  Synthetic oligonucleotide
tttcctcggtaaaaagcccgtattc

SEQ ID NO: 701022 - DNA, 25 bp, Artificial sequence
  Synthetic oligonucleotide
tttcctcggtaataagcccgtattc

SEQ ID NO: 701023 - DNA, 25 bp, Artificial sequence
  Synthetic oligonucleotide
acaaggcctgtttccggccggatat

SEQ ID NO: 701024 - DNA, 25 bp, Artificial sequence
  Synthetic oligonucleotide
acaaggcctgttaccggccggatat

SEQ ID NO: 701025 - DNA, 25 bp, Artificial sequence
  Synthetic oligonucleotide
atgatcccggttacagaatttgcat

SEQ ID NO: 701026 - DNA, 25 bp, Artificial sequence
  Synthetic oligonucleotide
atgatcccggtttcagaatttgcat

SEQ ID NO: 701027 - DNA, 25 bp, Artificial sequence
  Synthetic oligonucleotide
cagcgcaattatgaatggactgatg

SEQ ID NO: 701028 - DNA, 25 bp, Artificial sequence
  Synthetic oligonucleotide
tcaaattctcctatcttttgttccc

SEQ ID NO: 701029 - DNA, 25 bp, Artificial sequence
  Synthetic oligonucleotide
atatatcctgtacaataacctgtct

SEQ ID NO: 701030 - DNA, 25 bp, Artificial sequence
  Synthetic oligonucleotide
atatatcctgtagaataacctgtct

SEQ ID NO: 701031 - DNA, 25 bp, Artificial sequence
  Synthetic oligonucleotide
ctttttttgcgagttctcctcctgt

SEQ ID NO: 701032 - DNA, 25 bp, Artificial sequence
  Synthetic oligonucleotide
ctttttttgcgacttctcctcctgt

SEQ ID NO: 701033 - DNA, 25 bp, Artificial sequence
  Synthetic oligonucleotide
tagattccttcagccacagaagaag

SEQ ID NO: 701034 - DNA, 25 bp, Artificial sequence
  Synthetic oligonucleotide
tagattccttcacccacagaagaag

SEQ ID NO: 701035 - DNA, 25 bp, Artificial sequence
  Synthetic oligonucleotide
ttgcgggatatctgtttttccattt

SEQ ID NO: 701036 - DNA, 25 bp, Artificial sequence
  Synthetic oligonucleotide
tgttggcgcccattagctttaattc

SEQ ID NO: 701037 - DNA, 25 bp, Artificial sequence
  Synthetic oligonucleotide
tggcgataatcgctacatttttcgc

SEQ ID NO: 701038 - DNA, 25 bp, Artificial sequence
  Synthetic oligonucleotide
tcaaattctcctttcttttgttccc

SEQ ID NO: 701039 - DNA, 25 bp, Artificial sequence
  Synthetic oligonucleotide
aacgtatgtaattactgttccagct

SEQ ID NO: 701040 - DNA, 25 bp, Artificial sequence
  Synthetic oligonucleotide
aacgtatgtaataactgttccagct

SEQ ID NO: 701041 - DNA, 25 bp, Artificial sequence
  Synthetic oligonucleotide
gtatgcctgccataagagatgcgga

SEQ ID NO: 701042 - DNA, 25 bp, Artificial sequence
  Synthetic oligonucleotide
gtatgcctgccaaaagagatgcgga

SEQ ID NO: 701043 - DNA, 25 bp, Artificial sequence
  Synthetic oligonucleotide
gtgtctgctgcatgggttacaggga

SEQ ID NO: 701044 - DNA, 25 bp, Artificial sequence
  Synthetic oligonucleotide
tgttggcgcccaatagctttaattc

SEQ ID NO: 701045 - DNA, 25 bp, Artificial sequence
  Synthetic oligonucleotide
gcttcttgttcgctttttcttaatg

SEQ ID NO: 701046 - DNA, 25 bp, Artificial sequence
  Synthetic oligonucleotide
cggatttggtcttgaaagtatgttc

SEQ ID NO: 701047 - DNA, 25 bp, Artificial sequence
  Synthetic oligonucleotide
gtgtctgctgcaagggttacaggga

SEQ ID NO: 701048 - DNA, 25 bp, Artificial sequence
  Synthetic oligonucleotide
ttgcgggatatcagtttttccattt

SEQ ID NO: 701049 - DNA, 25 bp, Artificial sequence
  Synthetic oligonucleotide
caccctataatatgcggaagacatt

SEQ ID NO: 701050 - DNA, 25 bp, Artificial sequence
  Synthetic oligonucleotide
caccctataataagcggaagacatt

SEQ ID NO: 701051 - DNA, 25 bp, Artificial sequence
  Synthetic oligonucleotide
aacataacatattgtccttcaaatg

SEQ ID NO: 701052 - DNA, 25 bp, Artificial sequence
  Synthetic oligonucleotide
aacataacatatagtccttcaaatg

SEQ ID NO: 701053 - DNA, 25 bp, Artificial sequence
  Synthetic oligonucleotide
ccggttgaaatggaaatattactcc

SEQ ID NO: 701054 - DNA, 25 bp, Artificial sequence
  Synthetic oligonucleotide
ccggttgaaatgcaaatattactcc

SEQ ID NO: 701055 - DNA, 25 bp, Artificial sequence
  Synthetic oligonucleotide
tcagacggaccgaggtaacctgcag

SEQ ID NO: 701056 - DNA, 25 bp, Artificial sequence
  Synthetic oligonucleotide
tcagacggaccgtggtaacctgcag

SEQ ID NO: 701057 - DNA, 25 bp, Artificial sequence
  Synthetic oligonucleotide
gcttcttgttcggtttttcttaatg

SEQ ID NO: 701058 - DNA, 25 bp, Artificial sequence
  Synthetic oligonucleotide
cggatttggtctagaaagtatgttc

SEQ ID NO: 701059 - DNA, 25 bp, Artificial sequence
  Synthetic oligonucleotide
gatttaatatgtcgatccggactag

SEQ ID NO: 701060 - DNA, 25 bp, Artificial sequence
  Synthetic oligonucleotide
taatgatcctacccgactaatacga

SEQ ID NO: 701061 - DNA, 25 bp, Artificial sequence
  Synthetic oligonucleotide
taatgatcctacgcgactaatacga

SEQ ID NO: 701062 - DNA, 25 bp, Artificial sequence
  Synthetic oligonucleotide
tagaattcgcctttacgagttcctt

SEQ ID NO: 701063 - DNA, 25 bp, Artificial sequence
  Synthetic oligonucleotide
tagaattcgcctatacgagttcctt

SEQ ID NO: 701064 - DNA, 25 bp, Artificial sequence
  Synthetic oligonucleotide
aagtcatagcgttatcgcaccatta

SEQ ID NO: 701065 - DNA, 25 bp, Artificial sequence
  Synthetic oligonucleotide
tacaaacgatagtacgaccctatca

SEQ ID NO: 701066 - DNA, 25 bp, Artificial sequence
  Synthetic oligonucleotide
tttactcggcgtccgatattactta

SEQ ID NO: 701067 - DNA, 25 bp, Artificial sequence
  Synthetic oligonucleotide
tttgcctacgcaggattgtttttca

SEQ ID NO: 701068 - DNA, 25 bp, Artificial sequence
  Synthetic oligonucleotide
tttactcggcgtgcgatattactta

SEQ ID NO: 701069 - DNA, 25 bp, Artificial sequence
  Synthetic oligonucleotide
gatttaatatgtggatccggactag

SEQ ID NO: 701070 - DNA, 25 bp, Artificial sequence
  Synthetic oligonucleotide
aatccacgtaggtattacgtcagtt

SEQ ID NO: 701071 - DNA, 25 bp, Artificial sequence
  Synthetic oligonucleotide
aatccacgtaggaattacgtcagtt

SEQ ID NO: 701072 - DNA, 25 bp, Artificial sequence
  Synthetic oligonucleotide
agccgatcggacggtaataaattta

SEQ ID NO: 701073 - DNA, 25 bp, Artificial sequence
  Synthetic oligonucleotide
agccgatcggaccgtaataaattta

SEQ ID NO: 701074 - DNA, 25 bp, Artificial sequence
  Synthetic oligonucleotide
aagtcatagcgtaatcgcaccatta

SEQ ID NO: 701075 - DNA, 25 bp, Artificial sequence
  Synthetic oligonucleotide
tatcttttaccagttcgcgttgagt

SEQ ID NO: 701076 - DNA, 25 bp, Artificial sequence
  Synthetic oligonucleotide
ttttaggataacggtacgacgcaaa

SEQ ID NO: 701077 - DNA, 25 bp, Artificial sequence
  Synthetic oligonucleotide
ttttaggataaccgtacgacgcaaa

SEQ ID NO: 701078 - DNA, 25 bp, Artificial sequence
  Synthetic oligonucleotide
agttaatagcgaacgttcgtcaagt

SEQ ID NO: 701079 - DNA, 25 bp, Artificial sequence
  Synthetic oligonucleotide
agttaatagcgatcgttcgtcaagt

SEQ ID NO: 701080 - DNA, 25 bp, Artificial sequence
  Synthetic oligonucleotide
tattaaaatctatacggcgcccgat

SEQ ID NO: 701081 - DNA, 25 bp, Artificial sequence
  Synthetic oligonucleotide
tattaaaatctaaacggcgcccgat

SEQ ID NO: 701082 - DNA, 25 bp, Artificial sequence
  Synthetic oligonucleotide
tacaaacgatagaacgaccctatca

SEQ ID NO: 701083 - DNA, 25 bp, Artificial sequence
  Synthetic oligonucleotide
cccaaagcgtaagtacgtaatatag

SEQ ID NO: 701084 - DNA, 25 bp, Artificial sequence
  Synthetic oligonucleotide
caattaacatcgcgctaaacatgga

SEQ ID NO: 701085 - DNA, 25 bp, Artificial sequence
  Synthetic oligonucleotide
tatcttttaccacttcgcgttgagt

SEQ ID NO: 701086 - DNA, 25 bp, Artificial sequence
  Synthetic oligonucleotide
aaaactacgatcacgcgtatactag

SEQ ID NO: 701087 - DNA, 25 bp, Artificial sequence
  Synthetic oligonucleotide
aaaactacgatctcgcgtatactag

SEQ ID NO: 701088 - DNA, 25 bp, Artificial sequence
  Synthetic oligonucleotide
ctagtaagtacgatacgctttgtct

SEQ ID NO: 701089 - DNA, 25 bp, Artificial sequence
  Synthetic oligonucleotide
ctagtaagtacgttacgctttgtct

SEQ ID NO: 701090 - DNA, 25 bp, Artificial sequence
  Synthetic oligonucleotide
tttgcctacgcacgattgtttttca

SEQ ID NO: 701091 - DNA, 25 bp, Artificial sequence
  Synthetic oligonucleotide
cccaaagcgtaactacgtaatatag

SEQ ID NO: 701092 - DNA, 25 bp, Artificial sequence
  Synthetic oligonucleotide
tactgacgcgaagtagttaacagaa

SEQ ID NO: 701093 - DNA, 25 bp, Artificial sequence
  Synthetic oligonucleotide
tcttaataacgttcgatcgaaggga

SEQ ID NO: 701094 - DNA, 25 bp, Artificial sequence
  Synthetic oligonucleotide
tcttaataacgtacgatcgaaggga

SEQ ID NO: 701095 - DNA, 25 bp, Artificial sequence
  Synthetic oligonucleotide
accgaaagttatggctcgtttgtta

SEQ ID NO: 701096 - DNA, 25 bp, Artificial sequence
  Synthetic oligonucleotide
accgaaagttatcgctcgtttgtta

SEQ ID NO: 701097 - DNA, 25 bp, Artificial sequence
  Synthetic oligonucleotide
caagaagcgcgttttgtaactgatt

SEQ ID NO: 701098 - DNA, 25 bp, Artificial sequence
  Synthetic oligonucleotide
caagaagcgcgtattgtaactgatt

SEQ ID NO: 701099 - DNA, 25 bp, Artificial sequence
  Synthetic oligonucleotide
ttgtactcgaagtaacgcgtatgtt

SEQ ID NO: 701100 - DNA, 25 bp, Artificial sequence
  Synthetic oligonucleotide
tccttatatcggccgtatatggtaa

SEQ ID NO: 701101 - DNA, 25 bp, Artificial sequence
  Synthetic oligonucleotide
taagttgtatcgggccgatttagat

SEQ ID NO: 701102 - DNA, 25 bp, Artificial sequence
  Synthetic oligonucleotide
acttaccagctattacgcgaactaa

SEQ ID NO: 701103 - DNA, 25 bp, Artificial sequence
  Synthetic oligonucleotide
aaaagagttagtggtcgcagatcta

SEQ ID NO: 701104 - DNA, 25 bp, Artificial sequence
  Synthetic oligonucleotide
aaaagagttagtcgtcgcagatcta

SEQ ID NO: 701105 - DNA, 25 bp, Artificial sequence
  Synthetic oligonucleotide
tgttaaaataccctcgcgtttcgaa

SEQ ID NO: 701106 - DNA, 25 bp, Artificial sequence
  Synthetic oligonucleotide
tgttaaaataccgtcgcgtttcgaa

SEQ ID NO: 701107 - DNA, 25 bp, Artificial sequence
  Synthetic oligonucleotide
acatctcggatatcgccttgtttaa

SEQ ID NO: 701108 - DNA, 25 bp, Artificial sequence
  Synthetic oligonucleotide
tactgacgcgaactagttaacagaa

SEQ ID NO: 701109 - DNA, 25 bp, Artificial sequence
  Synthetic oligonucleotide
aacacagggtaatcgtcgtacaaat

SEQ ID NO: 701110 - DNA, 25 bp, Artificial sequence
  Synthetic oligonucleotide
acatctcggataacgccttgtttaa

SEQ ID NO: 701111 - DNA, 25 bp, Artificial sequence
  Synthetic oligonucleotide
caattaacatcgggctaaacatgga

SEQ ID NO: 701112 - DNA, 25 bp, Artificial sequence
  Synthetic oligonucleotide
tatcagagtccgacgtaaattccat

SEQ ID NO: 701113 - DNA, 25 bp, Artificial sequence
  Synthetic oligonucleotide
tatcagagtccgtcgtaaattccat

SEQ ID NO: 701114 - DNA, 25 bp, Artificial sequence
  Synthetic oligonucleotide
aaccaataacgtatgccgcattgaa

SEQ ID NO: 701115 - DNA, 25 bp, Artificial sequence
  Synthetic oligonucleotide
aaccaataacgtttgccgcattgaa

SEQ ID NO: 701116 - DNA, 25 bp, Artificial sequence
  Synthetic oligonucleotide
ataaagtatcgccaatcctgctatc

SEQ ID NO: 701117 - DNA, 25 bp, Artificial sequence
  Synthetic oligonucleotide
attgaacattgtttcgcgtctttgg

SEQ ID NO: 701118 - DNA, 25 bp, Artificial sequence
  Synthetic oligonucleotide
ataaagtatcgcgaatcctgctatc

SEQ ID NO: 701119 - DNA, 25 bp, Artificial sequence
  Synthetic oligonucleotide
aacacagggtaaacgtcgtacaaat

SEQ ID NO: 701120 - DNA, 25 bp, Artificial sequence
  Synthetic oligonucleotide
caataagatatacgcgtcgctttca

SEQ ID NO: 701121 - DNA, 25 bp, Artificial sequence
  Synthetic oligonucleotide
caataagatataggcgtcgctttca

SEQ ID NO: 701122 - DNA, 25 bp, Artificial sequence
  Synthetic oligonucleotide
tatcaaatatagaccgcgacactct

SEQ ID NO: 701123 - DNA, 25 bp, Artificial sequence
  Synthetic oligonucleotide
tatcaaatatagtccgcgacactct

SEQ ID NO: 701124 - DNA, 25 bp, Artificial sequence
  Synthetic oligonucleotide
taagttgtatcgcgccgatttagat

SEQ ID NO: 701125 - DNA, 25 bp, Artificial sequence
  Synthetic oligonucleotide
ttgtactcgaagaaacgcgtatgtt

SEQ ID NO: 701126 - DNA, 25 bp, Artificial sequence
  Synthetic oligonucleotide
attgaacattgtatcgcgtctttgg

SEQ ID NO: 701127 - DNA, 25 bp, Artificial sequence
  Synthetic oligonucleotide
agtttgtacgcgttactacattcga

SEQ ID NO: 701128 - DNA, 25 bp, Artificial sequence
  Synthetic oligonucleotide
taactgcgcgtctagtagttaatca

SEQ ID NO: 701129 - DNA, 25 bp, Artificial sequence
  Synthetic oligonucleotide
tactaatagttcctacgacattcgc

SEQ ID NO: 701130 - DNA, 25 bp, Artificial sequence
  Synthetic oligonucleotide
tactaatagttcgtacgacattcgc

SEQ ID NO: 701131 - DNA, 25 bp, Artificial sequence
  Synthetic oligonucleotide
atctgaatcgtattggacgtgtcta

SEQ ID NO: 701132 - DNA, 25 bp, Artificial sequence
  Synthetic oligonucleotide
atctgaatcgtaatggacgtgtcta

SEQ ID NO: 701133 - DNA, 25 bp, Artificial sequence
  Synthetic oligonucleotide
aattgaccgcgagtagtactattca

SEQ ID NO: 701134 - DNA, 25 bp, Artificial sequence
  Synthetic oligonucleotide
atctagtaagttggcgtacttcgaa

SEQ ID NO: 701135 - DNA, 25 bp, Artificial sequence
  Synthetic oligonucleotide
agtttgtacgcgatactacattcga

SEQ ID NO: 701136 - DNA, 25 bp, Artificial sequence
  Synthetic oligonucleotide
ctgataaagttagggctcgtaatgt

SEQ ID NO: 701137 - DNA, 25 bp, Artificial sequence
  Synthetic oligonucleotide
ttcacacgtaacccgttaactctaa

SEQ ID NO: 701138 - DNA, 25 bp, Artificial sequence
  Synthetic oligonucleotide
ttcacacgtaacgcgttaactctaa

SEQ ID NO: 701139 - DNA, 25 bp, Artificial sequence
  Synthetic oligonucleotide
ggtcactagtatggtgcgttaatat

SEQ ID NO: 701140 - DNA, 25 bp, Artificial sequence
  Synthetic oligonucleotide
ggtcactagtatcgtgcgttaatat

SEQ ID NO: 701141 - DNA, 25 bp, Artificial sequence
  Synthetic oligonucleotide
aatgtctagcgatcgcgtatttttc

SEQ ID NO: 701142 - DNA, 25 bp, Artificial sequence
  Synthetic oligonucleotide
tgaaaatgcgatccggttaatgcat

SEQ ID NO: 701143 - DNA, 25 bp, Artificial sequence
  Synthetic oligonucleotide
aattgaccgcgactagtactattca

SEQ ID NO: 701144 - DNA, 25 bp, Artificial sequence
  Synthetic oligonucleotide
ttgttgattccttcgcgtaaacagt

SEQ ID NO: 701145 - DNA, 25 bp, Artificial sequence
  Synthetic oligonucleotide
ttctgacgttacaacggattagtac

SEQ ID NO: 701146 - DNA, 25 bp, Artificial sequence
  Synthetic oligonucleotide
atcaattgtcgccatctaatgcctt

SEQ ID NO: 701147 - DNA, 25 bp, Artificial sequence
  Synthetic oligonucleotide
taatggcgatcccttatagtctaag

SEQ ID NO: 701148 - DNA, 25 bp, Artificial sequence
  Synthetic oligonucleotide
taatggcgatccgttatagtctaag

SEQ ID NO: 701149 - DNA, 25 bp, Artificial sequence
  Synthetic oligonucleotide
aactcatatggtgcgacgattacat

SEQ ID NO: 701150 - DNA, 25 bp, Artificial sequence
  Synthetic oligonucleotide
aactcatatggtccgacgattacat

SEQ ID NO: 701151 - DNA, 25 bp, Artificial sequence
  Synthetic oligonucleotide
atctagtaagttcgcgtacttcgaa

SEQ ID NO: 701152 - DNA, 25 bp, Artificial sequence
  Synthetic oligonucleotide
tcatataatccgccgtattggaact

SEQ ID NO: 701153 - DNA, 25 bp, Artificial sequence
  Synthetic oligonucleotide
taactgcgcgtcaagtagttaatca

SEQ ID NO: 701154 - DNA, 25 bp, Artificial sequence
  Synthetic oligonucleotide
ttgttgattcctacgcgtaaacagt

SEQ ID NO: 701155 - DNA, 25 bp, Artificial sequence
  Synthetic oligonucleotide
aatagtcttaccgcacgattagctt

SEQ ID NO: 701156 - DNA, 25 bp, Artificial sequence
  Synthetic oligonucleotide
aatagtcttaccccacgattagctt

SEQ ID NO: 701157 - DNA, 25 bp, Artificial sequence
  Synthetic oligonucleotide
aagaacgcgataggacgtattatac

SEQ ID NO: 701158 - DNA, 25 bp, Artificial sequence
  Synthetic oligonucleotide
aagaacgcgatacgacgtattatac

SEQ ID NO: 701159 - DNA, 25 bp, Artificial sequence
  Synthetic oligonucleotide
ctgataaagttacggctcgtaatgt

SEQ ID NO: 701160 - DNA, 25 bp, Artificial sequence
  Synthetic oligonucleotide
tcatataatccggcgtattggaact

SEQ ID NO: 701161 - DNA, 25 bp, Artificial sequence
  Synthetic oligonucleotide
gaggatttagcgtcgactaattttc

SEQ ID NO: 701162 - DNA, 25 bp, Artificial sequence
  Synthetic oligonucleotide
aatgtctagcgaacgcgtatttttc

SEQ ID NO: 701163 - DNA, 25 bp, Artificial sequence
  Synthetic oligonucleotide
actcaatatttaccgcggatatcac

SEQ ID NO: 701164 - DNA, 25 bp, Artificial sequence
  Synthetic oligonucleotide
actcaatatttagcgcggatatcac

SEQ ID NO: 701165 - DNA, 25 bp, Artificial sequence
  Synthetic oligonucleotide
tataacccgcgttgtaatatcttcg

SEQ ID NO: 701166 - DNA, 25 bp, Artificial sequence
  Synthetic oligonucleotide
tataacccgcgtagtaatatcttcg

SEQ ID NO: 701167 - DNA, 25 bp, Artificial sequence
  Synthetic oligonucleotide
attataccgtcgaactaagtagtgg

SEQ ID NO: 701168 - DNA, 25 bp, Artificial sequence
  Synthetic oligonucleotide
cacaaaacgcggtatcgagaaatat

SEQ ID NO: 701169 - DNA, 25 bp, Artificial sequence
  Synthetic oligonucleotide
gaggatttagcgacgactaattttc

SEQ ID NO: 701170 - DNA, 25 bp, Artificial sequence
  Synthetic oligonucleotide
aaaatttatcggtctcacgtacagc

SEQ ID NO: 701171 - DNA, 25 bp, Artificial sequence
  Synthetic oligonucleotide
cttaaactaacgtcgcttaccgata

SEQ ID NO: 701172 - DNA, 25 bp, Artificial sequence
  Synthetic oligonucleotide
cttaaactaacgacgcttaccgata

SEQ ID NO: 701173 - DNA, 25 bp, Artificial sequence
  Synthetic oligonucleotide
gaatttgtcgactcgatactgaaca

SEQ ID NO: 701174 - DNA, 25 bp, Artificial sequence
  Synthetic oligonucleotide
gaatttgtcgacacgatactgaaca

SEQ ID NO: 701175 - DNA, 25 bp, Artificial sequence
  Synthetic oligonucleotide
tgtaccatacgagcgttacattcta

SEQ ID NO: 701176 - DNA, 25 bp, Artificial sequence
  Synthetic oligonucleotide
tgtaccatacgaccgttacattcta

SEQ ID NO: 701177 - DNA, 25 bp, Artificial sequence
  Synthetic oligonucleotide
attataccgtcgtactaagtagtgg

SEQ ID NO: 701178 - DNA, 25 bp, Artificial sequence
  Synthetic oligonucleotide
atcacttcggtcgacaagaatagta

SEQ ID NO: 701179 - DNA, 25 bp, Artificial sequence
  Synthetic oligonucleotide
ttttctcgcgcattacgtatttggt

SEQ ID NO: 701180 - DNA, 25 bp, Artificial sequence
  Synthetic oligonucleotide
ttttctcgcgcaatacgtatttggt

SEQ ID NO: 701181 - DNA, 25 bp, Artificial sequence
  Synthetic oligonucleotide
aaactagtaacgccgatacctgtat

SEQ ID NO: 701182 - DNA, 25 bp, Artificial sequence
  Synthetic oligonucleotide
aaactagtaacggcgatacctgtat

SEQ ID NO: 701183 - DNA, 25 bp, Artificial sequence
  Synthetic oligonucleotide
cgatttcatcgtaatacgactagga

SEQ ID NO: 701184 - DNA, 25 bp, Artificial sequence
  Synthetic oligonucleotide
cgatttcatcgttatacgactagga

SEQ ID NO: 701185 - DNA, 25 bp, Artificial sequence
  Synthetic oligonucleotide
cacaaaacgcggaatcgagaaatat

SEQ ID NO: 701186 - DNA, 25 bp, Artificial sequence
  Synthetic oligonucleotide
tgaaaatgcgatgcggttaatgcat

SEQ ID NO: 701187 - DNA, 25 bp, Artificial sequence
  Synthetic oligonucleotide
tccttatatcgggcgtatatggtaa

SEQ ID NO: 701188 - DNA, 25 bp, Artificial sequence
  Synthetic oligonucleotide
atcacttcggtccacaagaatagta

SEQ ID NO: 701189 - DNA, 25 bp, Artificial sequence
  Synthetic oligonucleotide
taattgtatcgacaacgcgtagtag

SEQ ID NO: 701190 - DNA, 25 bp, Artificial sequence
  Synthetic oligonucleotide
taattgtatcgagaacgcgtagtag

SEQ ID NO: 701191 - DNA, 25 bp, Artificial sequence
  Synthetic oligonucleotide
tttatgatcccggaacgatgataag

SEQ ID NO: 701192 - DNA, 25 bp, Artificial sequence
  Synthetic oligonucleotide
tttatgatcccgcaacgatgataag

SEQ ID NO: 701193 - DNA, 25 bp, Artificial sequence
  Synthetic oligonucleotide
aaaatttatcggactcacgtacagc

SEQ ID NO: 701194 - DNA, 25 bp, Artificial sequence
  Synthetic oligonucleotide
acttaccagctaatacgcgaactaa

SEQ ID NO: 701195 - DNA, 25 bp, Artificial sequence
  Synthetic oligonucleotide
aatgttcttataccgcggtcacata

SEQ ID NO: 701196 - DNA, 25 bp, Artificial sequence
  Synthetic oligonucleotide
aaatcaataggcgacgtaacatagc

SEQ ID NO: 701197 - DNA, 25 bp, Artificial sequence
  Synthetic oligonucleotide
aaatcaataggccacgtaacatagc

SEQ ID NO: 701198 - DNA, 25 bp, Artificial sequence
  Synthetic oligonucleotide
aaggtccgcgaattagtgacatttt

SEQ ID NO: 701199 - DNA, 25 bp, Artificial sequence
  Synthetic oligonucleotide
aaggtccgcgaaatagtgacatttt

SEQ ID NO: 701200 - DNA, 25 bp, Artificial sequence
  Synthetic oligonucleotide
actaatgcgtatatcgatcccctat

SEQ ID NO: 701201 - DNA, 25 bp, Artificial sequence
  Synthetic oligonucleotide
ttataaaccgagtagatcggatacg

SEQ ID NO: 701202 - DNA, 25 bp, Artificial sequence
  Synthetic oligonucleotide
aatgttcttatagcgcggtcacata

SEQ ID NO: 701203 - DNA, 25 bp, Artificial sequence
  Synthetic oligonucleotide
tttcgttatcgctcgatagcttatc

SEQ ID NO: 701204 - DNA, 25 bp, Artificial sequence
  Synthetic oligonucleotide
aaggtgaatatgggcgtcgtaaata

SEQ ID NO: 701205 - DNA, 25 bp, Artificial sequence
  Synthetic oligonucleotide
aaggtgaatatgcgcgtcgtaaata

SEQ ID NO: 701206 - DNA, 25 bp, Artificial sequence
  Synthetic oligonucleotide
cttttgcttattagcgcgacttagt

SEQ ID NO: 701207 - DNA, 25 bp, Artificial sequence
  Synthetic oligonucleotide
cttttgcttatttgcgcgacttagt

SEQ ID NO: 701208 - DNA, 25 bp, Artificial sequence
  Synthetic oligonucleotide
attgccccgaacgtacttattatag

SEQ ID NO: 701209 - DNA, 25 bp, Artificial sequence
  Synthetic oligonucleotide
tgagtaggacgcgttatatgaatca

SEQ ID NO: 701210 - DNA, 25 bp, Artificial sequence
  Synthetic oligonucleotide
actaatgcgtatttcgatcccctat

SEQ ID NO: 701211 - DNA, 25 bp, Artificial sequence
  Synthetic oligonucleotide
aacaagacggttatacgtcaacaca

SEQ ID NO: 701212 - DNA, 25 bp, Artificial sequence
  Synthetic oligonucleotide
tttgtccgtatgacgaaccaataag

SEQ ID NO: 701213 - DNA, 25 bp, Artificial sequence
  Synthetic oligonucleotide
cgtttttcacgagccgtatattgta

SEQ ID NO: 701214 - DNA, 25 bp, Artificial sequence
  Synthetic oligonucleotide
cgtttttcacgacccgtatattgta

SEQ ID NO: 701215 - DNA, 25 bp, Artificial sequence
  Synthetic oligonucleotide
atcattgtacgtcgcgtaagtattc

SEQ ID NO: 701216 - DNA, 25 bp, Artificial sequence
  Synthetic oligonucleotide
atcattgtacgtggcgtaagtattc

SEQ ID NO: 701217 - DNA, 25 bp, Artificial sequence
  Synthetic oligonucleotide
tgctctacgtaccttacgagtaaaa

SEQ ID NO: 701218 - DNA, 25 bp, Artificial sequence
  Synthetic oligonucleotide
gattaaatatgaggcgcgaaagatg

SEQ ID NO: 701219 - DNA, 25 bp, Artificial sequence
  Synthetic oligonucleotide
aacaagacggttttacgtcaacaca

SEQ ID NO: 701220 - DNA, 25 bp, Artificial sequence
  Synthetic oligonucleotide
gattaaatatgacgcgcgaaagatg

SEQ ID NO: 701221 - DNA, 25 bp, Artificial sequence
  Synthetic oligonucleotide
tagttgacgtaaggtcgtaagtttg

SEQ ID NO: 701222 - DNA, 25 bp, Artificial sequence
  Synthetic oligonucleotide
tagttgacgtaacgtcgtaagtttg

SEQ ID NO: 701223 - DNA, 25 bp, Artificial sequence
  Synthetic oligonucleotide
tactagcgcgattatagtcacactt

SEQ ID NO: 701224 - DNA, 25 bp, Artificial sequence
  Synthetic oligonucleotide
tactagcgcgataatagtcacactt

SEQ ID NO: 701225 - DNA, 25 bp, Artificial sequence
  Synthetic oligonucleotide
tttcgttatcgcacgatagcttatc

SEQ ID NO: 701226 - DNA, 25 bp, Artificial sequence
  Synthetic oligonucleotide
ttataaaccgagaagatcggatacg

SEQ ID NO: 701227 - DNA, 25 bp, Artificial sequence
  Synthetic oligonucleotide
tgctctacgtacgttacgagtaaaa

SEQ ID NO: 701228 - DNA, 25 bp, Artificial sequence
  Synthetic oligonucleotide
gaaaccacgattgatacgctgtaat

SEQ ID NO: 701229 - DNA, 25 bp, Artificial sequence
  Synthetic oligonucleotide
ataaaaggcgttagtcgaagcatca

SEQ ID NO: 701230 - DNA, 25 bp, Artificial sequence
  Synthetic oligonucleotide
tagatttagagcgttacgccatcta

SEQ ID NO: 701231 - DNA, 25 bp, Artificial sequence
  Synthetic oligonucleotide
tagatttagagccttacgccatcta

SEQ ID NO: 701232 - DNA, 25 bp, Artificial sequence
  Synthetic oligonucleotide
gaaacacgtattacgacctcacaat

SEQ ID NO: 701233 - DNA, 25 bp, Artificial sequence
  Synthetic oligonucleotide
gaaacacgtatttcgacctcacaat

SEQ ID NO: 701234 - DNA, 25 bp, Artificial sequence
  Synthetic oligonucleotide
attgccccgaacctacttattatag

SEQ ID NO: 701235 - DNA, 25 bp, Artificial sequence
  Synthetic oligonucleotide
cgaataagattactcgcgaacattc

SEQ ID NO: 701236 - DNA, 25 bp, Artificial sequence
  Synthetic oligonucleotide
caacagcgcgtatctcgaaaaaaat

SEQ ID NO: 701237 - DNA, 25 bp, Artificial sequence
  Synthetic oligonucleotide
gaaaccacgattcatacgctgtaat

SEQ ID NO: 701238 - DNA, 25 bp, Artificial sequence
  Synthetic oligonucleotide
agcaaacgtactataacggctctaa

SEQ ID NO: 701239 - DNA, 25 bp, Artificial sequence
  Synthetic oligonucleotide
agcaaacgtactttaacggctctaa

SEQ ID NO: 701240 - DNA, 25 bp, Artificial sequence
  Synthetic oligonucleotide
atttacaacgtacgatcgaccatga

SEQ ID NO: 701241 - DNA, 25 bp, Artificial sequence
  Synthetic oligonucleotide
atttacaacgtaggatcgaccatga

SEQ ID NO: 701242 - DNA, 25 bp, Artificial sequence
  Synthetic oligonucleotide
tgagtaggacgccttatatgaatca

SEQ ID NO: 701243 - DNA, 25 bp, Artificial sequence
  Synthetic oligonucleotide
cgaataagattagtcgcgaacattc

SEQ ID NO: 701244 - DNA, 25 bp, Artificial sequence
  Synthetic oligonucleotide
agaatgcgtaaccttacggaatctt

SEQ ID NO: 701245 - DNA, 25 bp, Artificial sequence
  Synthetic oligonucleotide
agatctgcgaccattcgtactaata

SEQ ID NO: 701246 - DNA, 25 bp, Artificial sequence
  Synthetic oligonucleotide
agatctgcgacctttcgtactaata

SEQ ID NO: 701247 - DNA, 25 bp, Artificial sequence
  Synthetic oligonucleotide
gagaatacgcacgatactaaactca

SEQ ID NO: 701248 - DNA, 25 bp, Artificial sequence
  Synthetic oligonucleotide
gagaatacgcaccatactaaactca

SEQ ID NO: 701249 - DNA, 25 bp, Artificial sequence
  Synthetic oligonucleotide
accatcatacgctatcgtcttaagt

SEQ ID NO: 701250 - DNA, 25 bp, Artificial sequence
  Synthetic oligonucleotide
accatcatacgcaatcgtcttaagt

SEQ ID NO: 701251 - DNA, 25 bp, Artificial sequence
  Synthetic oligonucleotide
ataaaaggcgtttgtcgaagcatca

SEQ ID NO: 701252 - DNA, 25 bp, Artificial sequence
  Synthetic oligonucleotide
gagagacgcgctagtatataagttt

SEQ ID NO: 701253 - DNA, 25 bp, Artificial sequence
  Synthetic oligonucleotide
caacagcgcgtaactcgaaaaaaat

SEQ ID NO: 701254 - DNA, 25 bp, Artificial sequence
  Synthetic oligonucleotide
agaatgcgtaacgttacggaatctt

SEQ ID NO: 701255 - DNA, 25 bp, Artificial sequence
  Synthetic oligonucleotide
agttagtgtcggttagacgttatac

SEQ ID NO: 701256 - DNA, 25 bp, Artificial sequence
  Synthetic oligonucleotide
agttagtgtcggatagacgttatac

SEQ ID NO: 701257 - DNA, 25 bp, Artificial sequence
  Synthetic oligonucleotide
gttagaatattccatcgcgttcgat

SEQ ID NO: 701258 - DNA, 25 bp, Artificial sequence
  Synthetic oligonucleotide
gttagaatattcgatcgcgttcgat

SEQ ID NO: 701259 - DNA, 25 bp, Artificial sequence
  Synthetic oligonucleotide
caagatagtctattacgcgcataag

SEQ ID NO: 701260 - DNA, 25 bp, Artificial sequence
  Synthetic oligonucleotide
gagagacgcgcttgtatataagttt

SEQ ID NO: 701261 - DNA, 25 bp, Artificial sequence
  Synthetic oligonucleotide
ttagtgttatacccgtaggtttgac

SEQ ID NO: 701262 - DNA, 25 bp, Artificial sequence
  Synthetic oligonucleotide
gttttgcgtatcctaacgtattcga

SEQ ID NO: 701263 - DNA, 25 bp, Artificial sequence
  Synthetic oligonucleotide
caaaccttacctggacgtatactta

SEQ ID NO: 701264 - DNA, 25 bp, Artificial sequence
  Synthetic oligonucleotide
caaaccttacctcgacgtatactta

SEQ ID NO: 701265 - DNA, 25 bp, Artificial sequence
  Synthetic oligonucleotide
atacactcgcgagagactagataaa

SEQ ID NO: 701266 - DNA, 25 bp, Artificial sequence
  Synthetic oligonucleotide
atacactcgcgacagactagataaa

SEQ ID NO: 701267 - DNA, 25 bp, Artificial sequence
  Synthetic oligonucleotide
tttgtccgtatgtcgaaccaataag

SEQ ID NO: 701268 - DNA, 25 bp, Artificial sequence
  Synthetic oligonucleotide
atattgtaacgcaagacgctatacc

SEQ ID NO: 701269 - DNA, 25 bp, Artificial sequence
  Synthetic oligonucleotide
gacataatattcgacggacagatag

SEQ ID NO: 701270 - DNA, 25 bp, Artificial sequence
  Synthetic oligonucleotide
ttagtgttatacgcgtaggtttgac

SEQ ID NO: 701271 - DNA, 25 bp, Artificial sequence
  Synthetic oligonucleotide
tattatctatactcgaacgagccga

SEQ ID NO: 701272 - DNA, 25 bp, Artificial sequence
  Synthetic oligonucleotide
tattatctatacacgaacgagccga

SEQ ID NO: 701273 - DNA, 25 bp, Artificial sequence
  Synthetic oligonucleotide
aatagcttcgcgtaactacagatga

SEQ ID NO: 701274 - DNA, 25 bp, Artificial sequence
  Synthetic oligonucleotide
aatagcttcgcgaaactacagatga

SEQ ID NO: 701275 - DNA, 25 bp, Artificial sequence
  Synthetic oligonucleotide
tgactacgacgttcgtacagtattt

SEQ ID NO: 701276 - DNA, 25 bp, Artificial sequence
  Synthetic oligonucleotide
atattgtaacgctagacgctatacc

SEQ ID NO: 701277 - DNA, 25 bp, Artificial sequence
  Synthetic oligonucleotide
cattattacggtgggtacagattac

SEQ ID NO: 701278 - DNA, 25 bp, Artificial sequence
  Synthetic oligonucleotide
aggactcgtcctatctacgaatatt

SEQ ID NO: 701279 - DNA, 25 bp, Artificial sequence
  Synthetic oligonucleotide
aggactcgtcctttctacgaatatt

SEQ ID NO: 701280 - DNA, 25 bp, Artificial sequence
  Synthetic oligonucleotide
tataacaggtacgttacgcagtttg

SEQ ID NO: 701281 - DNA, 25 bp, Artificial sequence
  Synthetic oligonucleotide
tataacaggtaccttacgcagtttg

SEQ ID NO: 701282 - DNA, 25 bp, Artificial sequence
  Synthetic oligonucleotide
ccatatcttagtacgcgaaccaata

SEQ ID NO: 701283 - DNA, 25 bp, Artificial sequence
  Synthetic oligonucleotide
ccatatcttagttcgcgaaccaata

SEQ ID NO: 701284 - DNA, 25 bp, Artificial sequence
  Synthetic oligonucleotide
gttttgcgtatcgtaacgtattcga

SEQ ID NO: 701285 - DNA, 25 bp, Artificial sequence
  Synthetic oligonucleotide
taactgtacgcgttctaagtagtag

SEQ ID NO: 701286 - DNA, 25 bp, Artificial sequence
  Synthetic oligonucleotide
gacataatattccacggacagatag

SEQ ID NO: 701287 - DNA, 25 bp, Artificial sequence
  Synthetic oligonucleotide
cattattacggtcggtacagattac

SEQ ID NO: 701288 - DNA, 25 bp, Artificial sequence
  Synthetic oligonucleotide
ctgtgttagtacgagcgattgattt

SEQ ID NO: 701289 - DNA, 25 bp, Artificial sequence
  Synthetic oligonucleotide
ctgtgttagtaccagcgattgattt

SEQ ID NO: 701290 - DNA, 25 bp, Artificial sequence
  Synthetic oligonucleotide
tatgcttatctcccgattagtgatg

SEQ ID NO: 701291 - DNA, 25 bp, Artificial sequence
  Synthetic oligonucleotide
tatgcttatctcgcgattagtgatg

SEQ ID NO: 701292 - DNA, 25 bp, Artificial sequence
  Synthetic oligonucleotide
ctagttgatctacgcgctattgtta

SEQ ID NO: 701293 - DNA, 25 bp, Artificial sequence
  Synthetic oligonucleotide
taactgtacgcgatctaagtagtag

SEQ ID NO: 701294 - DNA, 25 bp, Artificial sequence
  Synthetic oligonucleotide
atcaattgtcgcgatctaatgcctt

SEQ ID NO: 701295 - DNA, 25 bp, Artificial sequence
  Synthetic oligonucleotide
tgactacgacgtacgtacagtattt

SEQ ID NO: 701296 - DNA, 25 bp, Artificial sequence
  Synthetic oligonucleotide
atcctgtgtcgaaccgttaaaatga

SEQ ID NO: 701297 - DNA, 25 bp, Artificial sequence
  Synthetic oligonucleotide
cgtaaaacgcgttactatcactatg

SEQ ID NO: 701298 - DNA, 25 bp, Artificial sequence
  Synthetic oligonucleotide
cgtaaaacgcgtaactatcactatg

SEQ ID NO: 701299 - DNA, 25 bp, Artificial sequence
  Synthetic oligonucleotide
gatctgcgttacccgttattaaatg

SEQ ID NO: 701300 - DNA, 25 bp, Artificial sequence
  Synthetic oligonucleotide
gatctgcgttacgcgttattaaatg

SEQ ID NO: 701301 - DNA, 25 bp, Artificial sequence
  Synthetic oligonucleotide
caacagtaacgtaaaggcgttgata

SEQ ID NO: 701302 - DNA, 25 bp, Artificial sequence
  Synthetic oligonucleotide
aaaaagaccgcgtaaagtgtcaatc

SEQ ID NO: 701303 - DNA, 25 bp, Artificial sequence
  Synthetic oligonucleotide
caacagtaacgttaaggcgttgata

SEQ ID NO: 701304 - DNA, 25 bp, Artificial sequence
  Synthetic oligonucleotide
tagttctgcggttacgatagcaatt

SEQ ID NO: 701305 - DNA, 25 bp, Artificial sequence
  Synthetic oligonucleotide
ctctaccggctttatacgaatactt

SEQ ID NO: 701306 - DNA, 25 bp, Artificial sequence
  Synthetic oligonucleotide
ctctaccggcttaatacgaatactt

SEQ ID NO: 701307 - DNA, 25 bp, Artificial sequence
  Synthetic oligonucleotide
atcatgggtcgtaatacgtaagtag

SEQ ID NO: 701308 - DNA, 25 bp, Artificial sequence
  Synthetic oligonucleotide
atcatgggtcgttatacgtaagtag

SEQ ID NO: 701309 - DNA, 25 bp, Artificial sequence
  Synthetic oligonucleotide
tagttctgcggtaacgatagcaatt

SEQ ID NO: 701310 - DNA, 25 bp, Artificial sequence
  Synthetic oligonucleotide
ttctgacgttactacggattagtac

SEQ ID NO: 701311 - DNA, 25 bp, Artificial sequence
  Synthetic oligonucleotide
cgctagcgcgaataggtatttatat

SEQ ID NO: 701312 - DNA, 25 bp, Artificial sequence
  Synthetic oligonucleotide
caagatagtctaatacgcgcataag

SEQ ID NO: 701313 - DNA, 25 bp, Artificial sequence
  Synthetic oligonucleotide
aattaagtctacggcgtcacaagat

SEQ ID NO: 701314 - DNA, 25 bp, Artificial sequence
  Synthetic oligonucleotide
aattaagtctaccgcgtcacaagat

SEQ ID NO: 701315 - DNA, 25 bp, Artificial sequence
  Synthetic oligonucleotide
acattgacccgaacgtttaactcta

SEQ ID NO: 701316 - DNA, 25 bp, Artificial sequence
  Synthetic oligonucleotide
acattgacccgatcgtttaactcta

SEQ ID NO: 701317 - DNA, 25 bp, Artificial sequence
  Synthetic oligonucleotide
actaaccgcacgataagtaagagtt

SEQ ID NO: 701318 - DNA, 25 bp, Artificial sequence
  Synthetic oligonucleotide
atcctgtgtcgatccgttaaaatga

SEQ ID NO: 701319 - DNA, 25 bp, Artificial sequence
  Synthetic oligonucleotide
cgctagcgcgaaaaggtatttatat

SEQ ID NO: 701320 - DNA, 25 bp, Artificial sequence
  Synthetic oligonucleotide
ctagttgatctaggcgctattgtta

SEQ ID NO: 701321 - DNA, 25 bp, Artificial sequence
  Synthetic oligonucleotide
tacccacgctatattagcgaaaaag

SEQ ID NO: 701322 - DNA, 25 bp, Artificial sequence
  Synthetic oligonucleotide
tacccacgctattttagcgaaaaag

SEQ ID NO: 701323 - DNA, 25 bp, Artificial sequence
  Synthetic oligonucleotide
taaatccgttgccatacggttgata

SEQ ID NO: 701324 - DNA, 25 bp, Artificial sequence
  Synthetic oligonucleotide
taaatccgttgcgatacggttgata

SEQ ID NO: 701325 - DNA, 25 bp, Artificial sequence
  Synthetic oligonucleotide
cacaatatgtcgcgagatagtatgt

SEQ ID NO: 701326 - DNA, 25 bp, Artificial sequence
  Synthetic oligonucleotide
cacaatatgtcgggagatagtatgt

SEQ ID NO: 701327 - DNA, 25 bp, Artificial sequence
  Synthetic oligonucleotide
actaaccgcacgttaagtaagagtt

SEQ ID NO: 701328 - DNA, 25 bp, Artificial sequence
  Synthetic oligonucleotide
atacaagtatcgtcgttgtgtgaga

SEQ ID NO: 701329 - DNA, 25 bp, Artificial sequence
  Synthetic oligonucleotide
attatctagtataccgcgagtatgc

SEQ ID NO: 701330 - DNA, 25 bp, Artificial sequence
  Synthetic oligonucleotide
tgtatggttcgaatagtcgaatcga

SEQ ID NO: 701331 - DNA, 25 bp, Artificial sequence
  Synthetic oligonucleotide
tgtatggttcgattagtcgaatcga

SEQ ID NO: 701332 - DNA, 25 bp, Artificial sequence
  Synthetic oligonucleotide
gttatgtagtatacgcgcactactt

SEQ ID NO: 701333 - DNA, 25 bp, Artificial sequence
  Synthetic oligonucleotide
gttatgtagtattcgcgcactactt

SEQ ID NO: 701334 - DNA, 25 bp, Artificial sequence
  Synthetic oligonucleotide
gtctgccgtgcgataatctatattt

SEQ ID NO: 701335 - DNA, 25 bp, Artificial sequence
  Synthetic oligonucleotide
ttccctctaatatgcgtcgtttcta

SEQ ID NO: 701336 - DNA, 25 bp, Artificial sequence
  Synthetic oligonucleotide
atactaatcacgcgcgtaaaatcct

SEQ ID NO: 701337 - DNA, 25 bp, Artificial sequence
  Synthetic oligonucleotide
atacaagtatcgacgttgtgtgaga

SEQ ID NO: 701338 - DNA, 25 bp, Artificial sequence
  Synthetic oligonucleotide
aaacagtactagtgtcgcgattatc

SEQ ID NO: 701339 - DNA, 25 bp, Artificial sequence
  Synthetic oligonucleotide
aaacagtactagagtcgcgattatc

SEQ ID NO: 701340 - DNA, 25 bp, Artificial sequence
  Synthetic oligonucleotide
aagtaatagaacgcgatacaggctt

SEQ ID NO: 701341 - DNA, 25 bp, Artificial sequence
  Synthetic oligonucleotide
aagtaatagaacccgatacaggctt

SEQ ID NO: 701342 - DNA, 25 bp, Artificial sequence
  Synthetic oligonucleotide
cacattacgcgtagaacgatattgt

SEQ ID NO: 701343 - DNA, 25 bp, Artificial sequence
  Synthetic oligonucleotide
ttccctctaataagcgtcgtttcta

SEQ ID NO: 701344 - DNA, 25 bp, Artificial sequence
  Synthetic oligonucleotide
ttagtagatagtggctacgtgatgt

SEQ ID NO: 701345 - DNA, 25 bp, Artificial sequence
  Synthetic oligonucleotide
attatctagtattccgcgagtatgc

SEQ ID NO: 701346 - DNA, 25 bp, Artificial sequence
  Synthetic oligonucleotide
agtaattacggcgctactactactt

SEQ ID NO: 701347 - DNA, 25 bp, Artificial sequence
  Synthetic oligonucleotide
agtaattacggccctactactactt

SEQ ID NO: 701348 - DNA, 25 bp, Artificial sequence
  Synthetic oligonucleotide
ttctgttcgcgatcaatcatacgat

SEQ ID NO: 701349 - DNA, 25 bp, Artificial sequence
  Synthetic oligonucleotide
ttctgttcgcgaacaatcatacgat

SEQ ID NO: 701350 - DNA, 25 bp, Artificial sequence
  Synthetic oligonucleotide
gtctgccgtgcgttaatctatattt

SEQ ID NO: 701351 - DNA, 25 bp, Artificial sequence
  Synthetic oligonucleotide
actttagtatcgactagcgtagtac

SEQ ID NO: 701352 - DNA, 25 bp, Artificial sequence
  Synthetic oligonucleotide
tagttttatagctgacgcgcattca

SEQ ID NO: 701353 - DNA, 25 bp, Artificial sequence
  Synthetic oligonucleotide
ttagtagatagtcgctacgtgatgt

SEQ ID NO: 701354 - DNA, 25 bp, Artificial sequence
  Synthetic oligonucleotide
gtcttatagtcaggattcgactaga

SEQ ID NO: 701355 - DNA, 25 bp, Artificial sequence
  Synthetic oligonucleotide
gtcttatagtcacgattcgactaga

SEQ ID NO: 701356 - DNA, 25 bp, Artificial sequence
  Synthetic oligonucleotide
aactaaacgataagtcgcgaagaca

SEQ ID NO: 701357 - DNA, 25 bp, Artificial sequence
  Synthetic oligonucleotide
aactaaacgatatgtcgcgaagaca

SEQ ID NO: 701358 - DNA, 25 bp, Artificial sequence
  Synthetic oligonucleotide
atactaatcacgggcgtaaaatcct

SEQ ID NO: 701359 - DNA, 25 bp, Artificial sequence
  Synthetic oligonucleotide
actttagtatcgtctagcgtagtac

SEQ ID NO: 701360 - DNA, 25 bp, Artificial sequence
  Synthetic oligonucleotide
ttcatttaatcgtccgtcgcaatag

SEQ ID NO: 701361 - DNA, 25 bp, Artificial sequence
  Synthetic oligonucleotide
tattggcgcgtccttattagaagaa

SEQ ID NO: 701362 - DNA, 25 bp, Artificial sequence
  Synthetic oligonucleotide
aaaaagaccgcgaaaagtgtcaatc

SEQ ID NO: 701363 - DNA, 25 bp, Artificial sequence
  Synthetic oligonucleotide
gaaatatacgacgctagtagatcac

SEQ ID NO: 701364 - DNA, 25 bp, Artificial sequence
  Synthetic oligonucleotide
gaaatatacgaccctagtagatcac

SEQ ID NO: 701365 - DNA, 25 bp, Artificial sequence
  Synthetic oligonucleotide
aaaagaggagtaggcgtaacatgta

SEQ ID NO: 701366 - DNA, 25 bp, Artificial sequence
  Synthetic oligonucleotide
cacattacgcgttgaacgatattgt

SEQ ID NO: 701367 - DNA, 25 bp, Artificial sequence
  Synthetic oligonucleotide
ttcatttaatcgaccgtcgcaatag

SEQ ID NO: 701368 - DNA, 25 bp, Artificial sequence
  Synthetic oligonucleotide
aaatgacgatacaagacgttctcca

SEQ ID NO: 701369 - DNA, 25 bp, Artificial sequence
  Synthetic oligonucleotide
aaaagtcgtccaaagtcgatcatag

SEQ ID NO: 701370 - DNA, 25 bp, Artificial sequence
  Synthetic oligonucleotide
aaaagtcgtccatagtcgatcatag

SEQ ID NO: 701371 - DNA, 25 bp, Artificial sequence
  Synthetic oligonucleotide
gttagttcgtatacgcgcaaaaaac

SEQ ID NO: 701372 - DNA, 25 bp, Artificial sequence
  Synthetic oligonucleotide
gttagttcgtattcgcgcaaaaaac

SEQ ID NO: 701373 - DNA, 25 bp, Artificial sequence
  Synthetic oligonucleotide
gatacccgttcgaactaatagtgtt

SEQ ID NO: 701374 - DNA, 25 bp, Artificial sequence
  Synthetic oligonucleotide
gatacccgttcgtactaatagtgtt

SEQ ID NO: 701375 - DNA, 25 bp, Artificial sequence
  Synthetic oligonucleotide
aaaagaggagtacgcgtaacatgta

SEQ ID NO: 701376 - DNA, 25 bp, Artificial sequence
  Synthetic oligonucleotide
caaatagttcgaggtacgacgattt

SEQ ID NO: 701377 - DNA, 25 bp, Artificial sequence
  Synthetic oligonucleotide
ttgtctgttctccgttacgactata

SEQ ID NO: 701378 - DNA, 25 bp, Artificial sequence
  Synthetic oligonucleotide
ggtatacgcgattatacgcgtttaa

SEQ ID NO: 701379 - DNA, 25 bp, Artificial sequence
  Synthetic oligonucleotide
ggtatacgcgataatacgcgtttaa

SEQ ID NO: 701380 - DNA, 25 bp, Artificial sequence
  Synthetic oligonucleotide
ttgtctgttctcggttacgactata

SEQ ID NO: 701381 - DNA, 25 bp, Artificial sequence
  Synthetic oligonucleotide
atagatgtatacgcttcgactgtag

SEQ ID NO: 701382 - DNA, 25 bp, Artificial sequence
  Synthetic oligonucleotide
ataatagaatctcgtacgctacctc

SEQ ID NO: 701383 - DNA, 25 bp, Artificial sequence
  Synthetic oligonucleotide
cttattgtagttggtacgctcacat

SEQ ID NO: 701384 - DNA, 25 bp, Artificial sequence
  Synthetic oligonucleotide
caaatagttcgacgtacgacgattt

SEQ ID NO: 701385 - DNA, 25 bp, Artificial sequence
  Synthetic oligonucleotide
cttattgtagttcgtacgctcacat

SEQ ID NO: 701386 - DNA, 25 bp, Artificial sequence
  Synthetic oligonucleotide
gtttcagtactaaagcgcgtgttta

SEQ ID NO: 701387 - DNA, 25 bp, Artificial sequence
  Synthetic oligonucleotide
gtttcagtactatagcgcgtgttta

SEQ ID NO: 701388 - DNA, 25 bp, Artificial sequence
  Synthetic oligonucleotide
aagcttcgagtatcgatattctcga

SEQ ID NO: 701389 - DNA, 25 bp, Artificial sequence
  Synthetic oligonucleotide
aagcttcgagtaacgatattctcga

SEQ ID NO: 701390 - DNA, 25 bp, Artificial sequence
  Synthetic oligonucleotide
aaatgacgatactagacgttctcca

SEQ ID NO: 701391 - DNA, 25 bp, Artificial sequence
  Synthetic oligonucleotide
tagttttatagcagacgcgcattca

SEQ ID NO: 701392 - DNA, 25 bp, Artificial sequence
  Synthetic oligonucleotide
ataatagaatctggtacgctacctc

SEQ ID NO: 701393 - DNA, 25 bp, Artificial sequence
  Synthetic oligonucleotide
aataagaacgcgtactcgtcaaaac

SEQ ID NO: 701394 - DNA, 25 bp, Artificial sequence
  Synthetic oligonucleotide
gattctgattgcgcccataatgtaa

SEQ ID NO: 701395 - DNA, 25 bp, Artificial sequence
  Synthetic oligonucleotide
gattctgattgcccccataatgtaa

SEQ ID NO: 701396 - DNA, 25 bp, Artificial sequence
  Synthetic oligonucleotide
taattatccgttgcgacgtgactat

SEQ ID NO: 701397 - DNA, 25 bp, Artificial sequence
  Synthetic oligonucleotide
taattatccgttccgacgtgactat

SEQ ID NO: 701398 - DNA, 25 bp, Artificial sequence
  Synthetic oligonucleotide
gataaagtatcgaaacggctctcta

SEQ ID NO: 701399 - DNA, 25 bp, Artificial sequence
  Synthetic oligonucleotide
gtatcttatatggtcgcggaaaagt

SEQ ID NO: 701400 - DNA, 25 bp, Artificial sequence
  Synthetic oligonucleotide
aataagaacgcgaactcgtcaaaac

SEQ ID NO: 701401 - DNA, 25 bp, Artificial sequence
  Synthetic oligonucleotide
atagatgtatacccttcgactgtag

SEQ ID NO: 701402 - DNA, 25 bp, Artificial sequence
  Synthetic oligonucleotide
atcatttcgcgatcgtaaacagaag

SEQ ID NO: 701403 - DNA, 25 bp, Artificial sequence
  Synthetic oligonucleotide
atcatttcgcgaacgtaaacagaag

SEQ ID NO: 701404 - DNA, 25 bp, Artificial sequence
  Synthetic oligonucleotide
tacataacgcgagtagttagtctgt

SEQ ID NO: 701405 - DNA, 25 bp, Artificial sequence
  Synthetic oligonucleotide
tacataacgcgactagttagtctgt

SEQ ID NO: 701406 - DNA, 25 bp, Artificial sequence
  Synthetic oligonucleotide
atgtgagtaacgatcgacaaacagt

SEQ ID NO: 701407 - DNA, 25 bp, Artificial sequence
  Synthetic oligonucleotide
atgtgagtaacgttcgacaaacagt

SEQ ID NO: 701408 - DNA, 25 bp, Artificial sequence
  Synthetic oligonucleotide
gataaagtatcgtaacggctctcta

SEQ ID NO: 701409 - DNA, 25 bp, Artificial sequence
  Synthetic oligonucleotide
tttagcacgtaatacgcggtttatc

SEQ ID NO: 701410 - DNA, 25 bp, Artificial sequence
  Synthetic oligonucleotide
tattggcgcgtcgttattagaagaa

SEQ ID NO: 701411 - DNA, 25 bp, Artificial sequence
  Synthetic oligonucleotide
gcattattcatacgacgcagtactt

SEQ ID NO: 701412 - DNA, 25 bp, Artificial sequence
  Synthetic oligonucleotide
gcattattcataggacgcagtactt

SEQ ID NO: 701413 - DNA, 25 bp, Artificial sequence
  Synthetic oligonucleotide
acataatcgcacgcgtttatgtcta

SEQ ID NO: 701414 - DNA, 25 bp, Artificial sequence
  Synthetic oligonucleotide
acataatcgcacccgtttatgtcta

SEQ ID NO: 701415 - DNA, 25 bp, Artificial sequence
  Synthetic oligonucleotide
attgaacacgtatggcgtaccttta

SEQ ID NO: 701416 - DNA, 25 bp, Artificial sequence
  Synthetic oligonucleotide
taagtacggcgctagtatatgtatc

SEQ ID NO: 701417 - DNA, 25 bp, Artificial sequence
  Synthetic oligonucleotide
tttagcacgtaaaacgcggtttatc

SEQ ID NO: 701418 - DNA, 25 bp, Artificial sequence
  Synthetic oligonucleotide
catgtattgtcgggaacgatcatat

SEQ ID NO: 701419 - DNA, 25 bp, Artificial sequence
  Synthetic oligonucleotide
acgtatcgttaagggtacggatata

SEQ ID NO: 701420 - DNA, 25 bp, Artificial sequence
  Synthetic oligonucleotide
acgtatcgttaacggtacggatata

SEQ ID NO: 701421 - DNA, 25 bp, Artificial sequence
  Synthetic oligonucleotide
tgtttggtatcgggcgttagttatt

SEQ ID NO: 701422 - DNA, 25 bp, Artificial sequence
  Synthetic oligonucleotide
tgtttggtatcgcgcgttagttatt

SEQ ID NO: 701423 - DNA, 25 bp, Artificial sequence
  Synthetic oligonucleotide
tcaagatcgattaacgacgccttaa

SEQ ID NO: 701424 - DNA, 25 bp, Artificial sequence
  Synthetic oligonucleotide
taagtacggcgcaagtatatgtatc

SEQ ID NO: 701425 - DNA, 25 bp, Artificial sequence
  Synthetic oligonucleotide
attgaacacgtaaggcgtaccttta

SEQ ID NO: 701426 - DNA, 25 bp, Artificial sequence
  Synthetic oligonucleotide
ttagttactcgcgacgtattaactc

SEQ ID NO: 701427 - DNA, 25 bp, Artificial sequence
  Synthetic oligonucleotide
tgttacgatgcgcgattaacatcta

SEQ ID NO: 701428 - DNA, 25 bp, Artificial sequence
  Synthetic oligonucleotide
tcaagatcgatttacgacgccttaa

SEQ ID NO: 701429 - DNA, 25 bp, Artificial sequence
  Synthetic oligonucleotide
aaatcttctatccgctacgtcaatc

SEQ ID NO: 701430 - DNA, 25 bp, Artificial sequence
  Synthetic oligonucleotide
ctgaaatcgcgcacgattaaaaatg

SEQ ID NO: 701431 - DNA, 25 bp, Artificial sequence
  Synthetic oligonucleotide
accaccatagatcgtcgcaatttaa

SEQ ID NO: 701432 - DNA, 25 bp, Artificial sequence
  Synthetic oligonucleotide
tgttacgatgcgggattaacatcta

SEQ ID NO: 701433 - DNA, 25 bp, Artificial sequence
  Synthetic oligonucleotide
catgtattgtcgcgaacgatcatat

SEQ ID NO: 701434 - DNA, 25 bp, Artificial sequence
  Synthetic oligonucleotide
gatattcagtataacgcgcgtgttt

SEQ ID NO: 701435 - DNA, 25 bp, Artificial sequence
  Synthetic oligonucleotide
gagattcgtatacgtcgcgaaaata

SEQ ID NO: 701436 - DNA, 25 bp, Artificial sequence
  Synthetic oligonucleotide
gagattcgtataggtcgcgaaaata

SEQ ID NO: 701437 - DNA, 25 bp, Artificial sequence
  Synthetic oligonucleotide
tattacacggttccgcgttatgata

SEQ ID NO: 701438 - DNA, 25 bp, Artificial sequence
  Synthetic oligonucleotide
tattacacggttgcgcgttatgata

SEQ ID NO: 701439 - DNA, 25 bp, Artificial sequence
  Synthetic oligonucleotide
cattatatagttggaccgttcgagt

SEQ ID NO: 701440 - DNA, 25 bp, Artificial sequence
  Synthetic oligonucleotide
cattatatagttcgaccgttcgagt

SEQ ID NO: 701441 - DNA, 25 bp, Artificial sequence
  Synthetic oligonucleotide
aaatcttctatcggctacgtcaatc

SEQ ID NO: 701442 - DNA, 25 bp, Artificial sequence
  Synthetic oligonucleotide
catacttacgataagcgcgagaata

SEQ ID NO: 701443 - DNA, 25 bp, Artificial sequence
  Synthetic oligonucleotide
actcatctacgggacgtaattcata

SEQ ID NO: 701444 - DNA, 25 bp, Artificial sequence
  Synthetic oligonucleotide
actcatctacggcacgtaattcata

SEQ ID NO: 701445 - DNA, 25 bp, Artificial sequence
  Synthetic oligonucleotide
gtatctcgttatggacgctgtataa

SEQ ID NO: 701446 - DNA, 25 bp, Artificial sequence
  Synthetic oligonucleotide
ttagttactcgccacgtattaactc

SEQ ID NO: 701447 - DNA, 25 bp, Artificial sequence
  Synthetic oligonucleotide
gtatctcgttatcgacgctgtataa

SEQ ID NO: 701448 - DNA, 25 bp, Artificial sequence
  Synthetic oligonucleotide
accaccatagatggtcgcaatttaa

SEQ ID NO: 701449 - DNA, 25 bp, Artificial sequence
  Synthetic oligonucleotide
gtatcttatatgctcgcggaaaagt

SEQ ID NO: 701450 - DNA, 25 bp, Artificial sequence
  Synthetic oligonucleotide
attagtcgccgttataaccaccaaa

SEQ ID NO: 701451 - DNA, 25 bp, Artificial sequence
  Synthetic oligonucleotide
gatattcagtattacgcgcgtgttt

SEQ ID NO: 701452 - DNA, 25 bp, Artificial sequence
  Synthetic oligonucleotide
catacttacgattagcgcgagaata

SEQ ID NO: 701453 - DNA, 25 bp, Artificial sequence
  Synthetic oligonucleotide
agtaaagcgttaatgcgaacttcct

SEQ ID NO: 701454 - DNA, 25 bp, Artificial sequence
  Synthetic oligonucleotide
agtaaagcgttattgcgaacttcct

SEQ ID NO: 701455 - DNA, 25 bp, Artificial sequence
  Synthetic oligonucleotide
atctacatgcgaggcagtacaatta

SEQ ID NO: 701456 - DNA, 25 bp, Artificial sequence
  Synthetic oligonucleotide
atctacatgcgacgcagtacaatta

SEQ ID NO: 701457 - DNA, 25 bp, Artificial sequence
  Synthetic oligonucleotide
ctgaaatcgcgctcgattaaaaatg

SEQ ID NO: 701458 - DNA, 25 bp, Artificial sequence
  Synthetic oligonucleotide
attagtcgccgtaataaccaccaaa

SEQ ID NO: 701459 - DNA, 25 bp, Artificial sequence
  Synthetic oligonucleotide
atctcatcgcgctacactaatcagt

SEQ ID NO: 701460 - DNA, 25 bp, Artificial sequence
  Synthetic oligonucleotide
ctaaatcgataagggtcggtaatcg

SEQ ID NO: 701461 - DNA, 25 bp, Artificial sequence
  Synthetic oligonucleotide
aagtttcgcattcgtcgtaaacgga

SEQ ID NO: 701462 - DNA, 25 bp, Artificial sequence
  Synthetic oligonucleotide
atctcatcgcgcaacactaatcagt

SEQ ID NO: 701463 - DNA, 25 bp, Artificial sequence
  Synthetic oligonucleotide
agacaacgagcgtacaacggaattt

SEQ ID NO: 701464 - DNA, 25 bp, Artificial sequence
  Synthetic oligonucleotide
ctaaatcgataacggtcggtaatcg

SEQ ID NO: 701465 - DNA, 25 bp, Artificial sequence
  Synthetic oligonucleotide
tgaagttacgcgttaaaccatcagc

SEQ ID NO: 701466 - DNA, 25 bp, Artificial sequence
  Synthetic oligonucleotide
tgaagttacgcgataaaccatcagc

SEQ ID NO: 701467 - DNA, 25 bp, Artificial sequence
  Synthetic oligonucleotide
caatcacgtacgggtagaaccattt

SEQ ID NO: 701468 - DNA, 25 bp, Artificial sequence
  Synthetic oligonucleotide
caatcacgtacgcgtagaaccattt

SEQ ID NO: 701469 - DNA, 25 bp, Artificial sequence
  Synthetic oligonucleotide
tactatgacgtcccgtatatctacg

SEQ ID NO: 701470 - DNA, 25 bp, Artificial sequence
  Synthetic oligonucleotide
agacaacgagcgaacaacggaattt

SEQ ID NO: 701471 - DNA, 25 bp, Artificial sequence
  Synthetic oligonucleotide
ttatatgtcgcgaccttatccgact

SEQ ID NO: 701472 - DNA, 25 bp, Artificial sequence
  Synthetic oligonucleotide
ataaaggcgttaaacgtgcgaatgg

SEQ ID NO: 701473 - DNA, 25 bp, Artificial sequence
  Synthetic oligonucleotide
ataaaggcgttatacgtgcgaatgg

SEQ ID NO: 701474 - DNA, 25 bp, Artificial sequence
  Synthetic oligonucleotide
tcacttctaatacgatcgctccagt

SEQ ID NO: 701475 - DNA, 25 bp, Artificial sequence
  Synthetic oligonucleotide
tactatgacgtcgcgtatatctacg

SEQ ID NO: 701476 - DNA, 25 bp, Artificial sequence
  Synthetic oligonucleotide
tcactacctacgcgacttatctaac

SEQ ID NO: 701477 - DNA, 25 bp, Artificial sequence
  Synthetic oligonucleotide
tcactacctacgggacttatctaac

SEQ ID NO: 701478 - DNA, 25 bp, Artificial sequence
  Synthetic oligonucleotide
cttacatcgtatcgtaccggttttc

SEQ ID NO: 701479 - DNA, 25 bp, Artificial sequence
  Synthetic oligonucleotide
cttacatcgtatggtaccggttttc

SEQ ID NO: 701480 - DNA, 25 bp, Artificial sequence
  Synthetic oligonucleotide
ttagatattctgtcgcgtagtgagc

SEQ ID NO: 701481 - DNA, 25 bp, Artificial sequence
  Synthetic oligonucleotide
ttagatattctgacgcgtagtgagc

SEQ ID NO: 701482 - DNA, 25 bp, Artificial sequence
  Synthetic oligonucleotide
accagactcgcaattcgtagttagt

SEQ ID NO: 701483 - DNA, 25 bp, Artificial sequence
  Synthetic oligonucleotide
catcacatcgaacgtacggttagaa

SEQ ID NO: 701484 - DNA, 25 bp, Artificial sequence
  Synthetic oligonucleotide
aagtttcgcattggtcgtaaacgga

SEQ ID NO: 701485 - DNA, 25 bp, Artificial sequence
  Synthetic oligonucleotide
ttatatgtcgcgtccttatccgact

SEQ ID NO: 701486 - DNA, 25 bp, Artificial sequence
  Synthetic oligonucleotide
ttcaatgtacgtatcgacgatgggt

SEQ ID NO: 701487 - DNA, 25 bp, Artificial sequence
  Synthetic oligonucleotide
ttcaatgtacgtttcgacgatgggt

SEQ ID NO: 701488 - DNA, 25 bp, Artificial sequence
  Synthetic oligonucleotide
acactttcgttttcgccgatactct

SEQ ID NO: 701489 - DNA, 25 bp, Artificial sequence
  Synthetic oligonucleotide
acactttcgtttacgccgatactct

SEQ ID NO: 701490 - DNA, 25 bp, Artificial sequence
  Synthetic oligonucleotide
accagactcgcatttcgtagttagt

SEQ ID NO: 701491 - DNA, 25 bp, Artificial sequence
  Synthetic oligonucleotide
atttgcttatcgccgtcgtactcat

SEQ ID NO: 701492 - DNA, 25 bp, Artificial sequence
  Synthetic oligonucleotide
atttgcttatcggcgtcgtactcat

SEQ ID NO: 701493 - DNA, 25 bp, Artificial sequence
  Synthetic oligonucleotide
cctgaactatcccctacgatatgaa

SEQ ID NO: 701494 - DNA, 25 bp, Artificial sequence
  Synthetic oligonucleotide
cctgaactatccgctacgatatgaa

SEQ ID NO: 701495 - DNA, 25 bp, Artificial sequence
  Synthetic oligonucleotide
catcacatcgaaggtacggttagaa

SEQ ID NO: 701496 - DNA, 25 bp, Artificial sequence
  Synthetic oligonucleotide
ggtatccgtataaccggtatagtga

SEQ ID NO: 701497 - DNA, 25 bp, Artificial sequence
  Synthetic oligonucleotide
tgttctttgcgcgaatagacaccta

SEQ ID NO: 701498 - DNA, 25 bp, Artificial sequence
  Synthetic oligonucleotide
gaactactagtatcgcgaagtagct

SEQ ID NO: 701499 - DNA, 25 bp, Artificial sequence
  Synthetic oligonucleotide
aaagtcacatatggtcgcttccgat

SEQ ID NO: 701500 - DNA, 25 bp, Artificial sequence
  Synthetic oligonucleotide
aaagtcacatatcgtcgcttccgat

SEQ ID NO: 701501 - DNA, 25 bp, Artificial sequence
  Synthetic oligonucleotide
atcagtaccgcggataatggttttg

SEQ ID NO: 701502 - DNA, 25 bp, Artificial sequence
  Synthetic oligonucleotide
atcagtaccgcgcataatggttttg

SEQ ID NO: 701503 - DNA, 25 bp, Artificial sequence
  Synthetic oligonucleotide
ctacgtcgtgacgattcgttattct

SEQ ID NO: 701504 - DNA, 25 bp, Artificial sequence
  Synthetic oligonucleotide
tcacttctaataggatcgctccagt

SEQ ID NO: 701505 - DNA, 25 bp, Artificial sequence
  Synthetic oligonucleotide
ggtatccgtatatccggtatagtga

SEQ ID NO: 701506 - DNA, 25 bp, Artificial sequence
  Synthetic oligonucleotide
tgttctttgcgccaatagacaccta

SEQ ID NO: 701507 - DNA, 25 bp, Artificial sequence
  Synthetic oligonucleotide
agctggctagtactacgcgtataaa

SEQ ID NO: 701508 - DNA, 25 bp, Artificial sequence
  Synthetic oligonucleotide
agctggctagtagtacgcgtataaa

SEQ ID NO: 701509 - DNA, 25 bp, Artificial sequence
  Synthetic oligonucleotide
tatttctaccgcacgttagatgagg

SEQ ID NO: 701510 - DNA, 25 bp, Artificial sequence
  Synthetic oligonucleotide
tatttctaccgctcgttagatgagg

SEQ ID NO: 701511 - DNA, 25 bp, Artificial sequence
  Synthetic oligonucleotide
ctttaccgtatattcgcgatgaagg

SEQ ID NO: 701512 - DNA, 25 bp, Artificial sequence
  Synthetic oligonucleotide
atcaagtaatagcggatcggtacct

SEQ ID NO: 701513 - DNA, 25 bp, Artificial sequence
  Synthetic oligonucleotide
gatcacacgctacaccgatttctat

SEQ ID NO: 701514 - DNA, 25 bp, Artificial sequence
  Synthetic oligonucleotide
ctacgtcgtgaccattcgttattct

SEQ ID NO: 701515 - DNA, 25 bp, Artificial sequence
  Synthetic oligonucleotide
aactatcgatacccggaattcacac

SEQ ID NO: 701516 - DNA, 25 bp, Artificial sequence
  Synthetic oligonucleotide
ggattattcgtaggatacggtttcg

SEQ ID NO: 701517 - DNA, 25 bp, Artificial sequence
  Synthetic oligonucleotide
acctatagtcgttaccgcgcatata

SEQ ID NO: 701518 - DNA, 25 bp, Artificial sequence
  Synthetic oligonucleotide
acctatagtcgtaaccgcgcatata

SEQ ID NO: 701519 - DNA, 25 bp, Artificial sequence
  Synthetic oligonucleotide
gaacttcgaatagcgtcgtagtgtt

SEQ ID NO: 701520 - DNA, 25 bp, Artificial sequence
  Synthetic oligonucleotide
gaacttcgaataccgtcgtagtgtt

SEQ ID NO: 701521 - DNA, 25 bp, Artificial sequence
  Synthetic oligonucleotide
ctgattactagtcgcgcttgagtta

SEQ ID NO: 701522 - DNA, 25 bp, Artificial sequence
  Synthetic oligonucleotide
ctgattactagtggcgcttgagtta

SEQ ID NO: 701523 - DNA, 25 bp, Artificial sequence
  Synthetic oligonucleotide
gaactactagtaacgcgaagtagct

SEQ ID NO: 701524 - DNA, 25 bp, Artificial sequence
  Synthetic oligonucleotide
ctcgtgcgacgtaacgtctaattta

SEQ ID NO: 701525 - DNA, 25 bp, Artificial sequence
  Synthetic oligonucleotide
ggattattcgtacgatacggtttcg

SEQ ID NO: 701526 - DNA, 25 bp, Artificial sequence
  Synthetic oligonucleotide
aactatcgatacgcggaattcacac

SEQ ID NO: 701527 - DNA, 25 bp, Artificial sequence
  Synthetic oligonucleotide
accgttcgtatgtttcggaaaatgg

SEQ ID NO: 701528 - DNA, 25 bp, Artificial sequence
  Synthetic oligonucleotide
accgttcgtatgattcggaaaatgg

SEQ ID NO: 701529 - DNA, 25 bp, Artificial sequence
  Synthetic oligonucleotide
accaattcgactatggacggatttc

SEQ ID NO: 701530 - DNA, 25 bp, Artificial sequence
  Synthetic oligonucleotide
accaattcgactttggacggatttc

SEQ ID NO: 701531 - DNA, 25 bp, Artificial sequence
  Synthetic oligonucleotide
ccaattgttcgccatagtaatggtc

SEQ ID NO: 701532 - DNA, 25 bp, Artificial sequence
  Synthetic oligonucleotide
ccaattgttcgcgatagtaatggtc

SEQ ID NO: 701533 - DNA, 25 bp, Artificial sequence
  Synthetic oligonucleotide
ctcgtgcgacgttacgtctaattta

SEQ ID NO: 701534 - DNA, 25 bp, Artificial sequence
  Synthetic oligonucleotide
tctaacctcatatctcgcgatatgc

SEQ ID NO: 701535 - DNA, 25 bp, Artificial sequence
  Synthetic oligonucleotide
acaaaaggccgatagatcgttcagt

SEQ ID NO: 701536 - DNA, 25 bp, Artificial sequence
  Synthetic oligonucleotide
cctattcgcgaatgtaccaacctta

SEQ ID NO: 701537 - DNA, 25 bp, Artificial sequence
  Synthetic oligonucleotide
cctattcgcgaaagtaccaacctta

SEQ ID NO: 701538 - DNA, 25 bp, Artificial sequence
  Synthetic oligonucleotide
gatcacacgctagaccgatttctat

SEQ ID NO: 701539 - DNA, 25 bp, Artificial sequence
  Synthetic oligonucleotide
gtgtaatcggcaaacgaagtaactc

SEQ ID NO: 701540 - DNA, 25 bp, Artificial sequence
  Synthetic oligonucleotide
tttaccattagtgcgacgccgtaat

SEQ ID NO: 701541 - DNA, 25 bp, Artificial sequence
  Synthetic oligonucleotide
tttaccattagtccgacgccgtaat

SEQ ID NO: 701542 - DNA, 25 bp, Artificial sequence
  Synthetic oligonucleotide
caaagtgtaggaggccgtatcttaa

SEQ ID NO: 701543 - DNA, 25 bp, Artificial sequence
  Synthetic oligonucleotide
ctggttgacgcgatatacacttctt

SEQ ID NO: 701544 - DNA, 25 bp, Artificial sequence
  Synthetic oligonucleotide
tatggccgccgtactagtaatttga

SEQ ID NO: 701545 - DNA, 25 bp, Artificial sequence
  Synthetic oligonucleotide
tctaacctcataactcgcgatatgc

SEQ ID NO: 701546 - DNA, 25 bp, Artificial sequence
  Synthetic oligonucleotide
atcaacacgcgaaacaatgatctgc

SEQ ID NO: 701547 - DNA, 25 bp, Artificial sequence
  Synthetic oligonucleotide
atcaacacgcgatacaatgatctgc

SEQ ID NO: 701548 - DNA, 25 bp, Artificial sequence
  Synthetic oligonucleotide
caagatccgcgtaatacgacgtaat

SEQ ID NO: 701549 - DNA, 25 bp, Artificial sequence
  Synthetic oligonucleotide
caagatccgcgttatacgacgtaat

SEQ ID NO: 701550 - DNA, 25 bp, Artificial sequence
  Synthetic oligonucleotide
ttcctccgtacggtatctataactc

SEQ ID NO: 701551 - DNA, 25 bp, Artificial sequence
  Synthetic oligonucleotide
gtgtaatcggcatacgaagtaactc

SEQ ID NO: 701552 - DNA, 25 bp, Artificial sequence
  Synthetic oligonucleotide
ctttaccgtataatcgcgatgaagg

SEQ ID NO: 701553 - DNA, 25 bp, Artificial sequence
  Synthetic oligonucleotide
aatactaacgctatcggacccatac

SEQ ID NO: 701554 - DNA, 25 bp, Artificial sequence
  Synthetic oligonucleotide
gatcttaacgcgacgttagttaagc

SEQ ID NO: 701555 - DNA, 25 bp, Artificial sequence
  Synthetic oligonucleotide
gatcttaacgcgtcgttagttaagc

SEQ ID NO: 701556 - DNA, 25 bp, Artificial sequence
  Synthetic oligonucleotide
gaataagcgtcagacgtatgagatg

SEQ ID NO: 701557 - DNA, 25 bp, Artificial sequence
  Synthetic oligonucleotide
gaataagcgtcacacgtatgagatg

SEQ ID NO: 701558 - DNA, 25 bp, Artificial sequence
  Synthetic oligonucleotide
tgtattgtcgcgaacgaatgcatac

SEQ ID NO: 701559 - DNA, 25 bp, Artificial sequence
  Synthetic oligonucleotide
tgtattgtcgcgtacgaatgcatac

SEQ ID NO: 701560 - DNA, 25 bp, Artificial sequence
  Synthetic oligonucleotide
gtttctcgcccgatagtatctgttt

SEQ ID NO: 701561 - DNA, 25 bp, Artificial sequence
  Synthetic oligonucleotide
caaagtgtaggacgccgtatcttaa

SEQ ID NO: 701562 - DNA, 25 bp, Artificial sequence
  Synthetic oligonucleotide
aatactaacgctttcggacccatac

SEQ ID NO: 701563 - DNA, 25 bp, Artificial sequence
  Synthetic oligonucleotide
acaaaaggccgaaagatcgttcagt

SEQ ID NO: 701564 - DNA, 25 bp, Artificial sequence
  Synthetic oligonucleotide
tacttaccgattaggcgaactcaca

SEQ ID NO: 701565 - DNA, 25 bp, Artificial sequence
  Synthetic oligonucleotide
tacttaccgatttggcgaactcaca

SEQ ID NO: 701566 - DNA, 25 bp, Artificial sequence
  Synthetic oligonucleotide
ttctctactaatacgcggatgcact

SEQ ID NO: 701567 - DNA, 25 bp, Artificial sequence
  Synthetic oligonucleotide
ttctctactaattcgcggatgcact

SEQ ID NO: 701568 - DNA, 25 bp, Artificial sequence
  Synthetic oligonucleotide
ctttcaggtttatcgcgacgaattc

SEQ ID NO: 701569 - DNA, 25 bp, Artificial sequence
  Synthetic oligonucleotide
ctttcaggtttaacgcgacgaattc

SEQ ID NO: 701570 - DNA, 25 bp, Artificial sequence
  Synthetic oligonucleotide
tatggccgccgttctagtaatttga

SEQ ID NO: 701571 - DNA, 25 bp, Artificial sequence
  Synthetic oligonucleotide
gtttctcgcccgttagtatctgttt

SEQ ID NO: 701572 - DNA, 25 bp, Artificial sequence
  Synthetic oligonucleotide
cttgtttacgccgaccttaaacaga

SEQ ID NO: 701573 - DNA, 25 bp, Artificial sequence
  Synthetic oligonucleotide
ttcctccgtacgctatctataactc

SEQ ID NO: 701574 - DNA, 25 bp, Artificial sequence
  Synthetic oligonucleotide
aactagcgttagaactcgacattcg

SEQ ID NO: 701575 - DNA, 25 bp, Artificial sequence
  Synthetic oligonucleotide
aactagcgttagtactcgacattcg

SEQ ID NO: 701576 - DNA, 25 bp, Artificial sequence
  Synthetic oligonucleotide
tactcatacgttatgacgcgacctt

SEQ ID NO: 701577 - DNA, 25 bp, Artificial sequence
  Synthetic oligonucleotide
tactcatacgttttgacgcgacctt

SEQ ID NO: 701578 - DNA, 25 bp, Artificial sequence
  Synthetic oligonucleotide
cgtgaagacagtacgcgtaaatgta

SEQ ID NO: 701579 - DNA, 25 bp, Artificial sequence
  Synthetic oligonucleotide
cgtgaagacagttcgcgtaaatgta

SEQ ID NO: 701580 - DNA, 25 bp, Artificial sequence
  Synthetic oligonucleotide
cgtaaatagtatggcggtatccatg

SEQ ID NO: 701581 - DNA, 25 bp, Artificial sequence
  Synthetic oligonucleotide
actttacgcgatgtacgatcgtttc

SEQ ID NO: 701582 - DNA, 25 bp, Artificial sequence
  Synthetic oligonucleotide
tggactctacgctgatcgtaaattg

SEQ ID NO: 701583 - DNA, 25 bp, Artificial sequence
  Synthetic oligonucleotide
cttgtttacgcccaccttaaacaga

SEQ ID NO: 701584 - DNA, 25 bp, Artificial sequence
  Synthetic oligonucleotide
tgcgcatcactaattcgcggttttt

SEQ ID NO: 701585 - DNA, 25 bp, Artificial sequence
  Synthetic oligonucleotide
tgcgcatcactatttcgcggttttt

SEQ ID NO: 701586 - DNA, 25 bp, Artificial sequence
  Synthetic oligonucleotide
cgcatagttcgccaacgttctaaaa

SEQ ID NO: 701587 - DNA, 25 bp, Artificial sequence
  Synthetic oligonucleotide
cgcatagttcgcgaacgttctaaaa

SEQ ID NO: 701588 - DNA, 25 bp, Artificial sequence
  Synthetic oligonucleotide
gcattcatgacttacgcgacatagt

SEQ ID NO: 701589 - DNA, 25 bp, Artificial sequence
  Synthetic oligonucleotide
gcattcatgactaacgcgacatagt

SEQ ID NO: 701590 - DNA, 25 bp, Artificial sequence
  Synthetic oligonucleotide
actttacgcgatctacgatcgtttc

SEQ ID NO: 701591 - DNA, 25 bp, Artificial sequence
  Synthetic oligonucleotide
tataaacgaactagtgtcgcgagca

SEQ ID NO: 701592 - DNA, 25 bp, Artificial sequence
  Synthetic oligonucleotide
gtcaaacgcgaccatataaacgatg

SEQ ID NO: 701593 - DNA, 25 bp, Artificial sequence
  Synthetic oligonucleotide
gtcaaacgcgacgatataaacgatg

SEQ ID NO: 701594 - DNA, 25 bp, Artificial sequence
  Synthetic oligonucleotide
tagtcagtagcgacgtatgtgtaac

SEQ ID NO: 701595 - DNA, 25 bp, Artificial sequence
  Synthetic oligonucleotide
tagtcagtagcgtcgtatgtgtaac

SEQ ID NO: 701596 - DNA, 25 bp, Artificial sequence
  Synthetic oligonucleotide
atcatcgattcttgcgcgaactcta

SEQ ID NO: 701597 - DNA, 25 bp, Artificial sequence
  Synthetic oligonucleotide
atcatcgattctagcgcgaactcta

SEQ ID NO: 701598 - DNA, 25 bp, Artificial sequence
  Synthetic oligonucleotide
agtagcgtctaacgacgtattgcat

SEQ ID NO: 701599 - DNA, 25 bp, Artificial sequence
  Synthetic oligonucleotide
cgtaaatagtatcgcggtatccatg

SEQ ID NO: 701600 - DNA, 25 bp, Artificial sequence
  Synthetic oligonucleotide
tataaacgaacttgtgtcgcgagca

SEQ ID NO: 701601 - DNA, 25 bp, Artificial sequence
  Synthetic oligonucleotide
atcaagtaataggggatcggtacct

SEQ ID NO: 701602 - DNA, 25 bp, Artificial sequence
  Synthetic oligonucleotide
tgaccttaccgttgcgaataaacgt

SEQ ID NO: 701603 - DNA, 25 bp, Artificial sequence
  Synthetic oligonucleotide
tgaccttaccgtagcgaataaacgt

SEQ ID NO: 701604 - DNA, 25 bp, Artificial sequence
  Synthetic oligonucleotide
tactactacctcgacgtaaggtaga

SEQ ID NO: 701605 - DNA, 25 bp, Artificial sequence
  Synthetic oligonucleotide
tactactacctccacgtaaggtaga

SEQ ID NO: 701606 - DNA, 25 bp, Artificial sequence
  Synthetic oligonucleotide
gcctgtactattcgacgcattatac

SEQ ID NO: 701607 - DNA, 25 bp, Artificial sequence
  Synthetic oligonucleotide
gcctgtactattggacgcattatac

SEQ ID NO: 701608 - DNA, 25 bp, Artificial sequence
  Synthetic oligonucleotide
tggactctacgcagatcgtaaattg

SEQ ID NO: 701609 - DNA, 25 bp, Artificial sequence
  Synthetic oligonucleotide
agtagcgtctaaggacgtattgcat

SEQ ID NO: 701610 - DNA, 25 bp, Artificial sequence
  Synthetic oligonucleotide
ttcaaccggtcgaaagctttaatcc

SEQ ID NO: 701611 - DNA, 25 bp, Artificial sequence
  Synthetic oligonucleotide
gccatccgcgataagtcctttatat

SEQ ID NO: 701612 - DNA, 25 bp, Artificial sequence
  Synthetic oligonucleotide
tagattattggcctcgtactagcac

SEQ ID NO: 701613 - DNA, 25 bp, Artificial sequence
  Synthetic oligonucleotide
tagattattggcgtcgtactagcac

SEQ ID NO: 701614 - DNA, 25 bp, Artificial sequence
  Synthetic oligonucleotide
gatacttacgccgatagactcaaca

SEQ ID NO: 701615 - DNA, 25 bp, Artificial sequence
  Synthetic oligonucleotide
gatacttacgcccatagactcaaca

SEQ ID NO: 701616 - DNA, 25 bp, Artificial sequence
  Synthetic oligonucleotide
agtcatatacgcggccctatgtaaa

SEQ ID NO: 701617 - DNA, 25 bp, Artificial sequence
  Synthetic oligonucleotide
agtcatatacgccgccctatgtaaa

SEQ ID NO: 701618 - DNA, 25 bp, Artificial sequence
  Synthetic oligonucleotide
ccggttgcgtaaaatgtcgattatc

SEQ ID NO: 701619 - DNA, 25 bp, Artificial sequence
  Synthetic oligonucleotide
ccggttgcgtaatatgtcgattatc

SEQ ID NO: 701620 - DNA, 25 bp, Artificial sequence
  Synthetic oligonucleotide
aatctgcgctaccattaactgacgt

SEQ ID NO: 701621 - DNA, 25 bp, Artificial sequence
  Synthetic oligonucleotide
aatctgcgctacgattaactgacgt

SEQ ID NO: 701622 - DNA, 25 bp, Artificial sequence
  Synthetic oligonucleotide
aaaggccgtcgactagtaatgtaac

SEQ ID NO: 701623 - DNA, 25 bp, Artificial sequence
  Synthetic oligonucleotide
aaaggccgtcgagtagtaatgtaac

SEQ ID NO: 701624 - DNA, 25 bp, Artificial sequence
  Synthetic oligonucleotide
tgattccctaacgcgagtagaaatg

SEQ ID NO: 701625 - DNA, 25 bp, Artificial sequence
  Synthetic oligonucleotide
aatctcatatggcgtcccgagattt

SEQ ID NO: 701626 - DNA, 25 bp, Artificial sequence
  Synthetic oligonucleotide
aatttagtattggcgtacccgatgg

SEQ ID NO: 701627 - DNA, 25 bp, Artificial sequence
  Synthetic oligonucleotide
actctggacgattataccgcattga

SEQ ID NO: 701628 - DNA, 25 bp, Artificial sequence
  Synthetic oligonucleotide
tgcacttaaggtcgatcggaatatg

SEQ ID NO: 701629 - DNA, 25 bp, Artificial sequence
  Synthetic oligonucleotide
tgcacttaaggtggatcggaatatg

SEQ ID NO: 701630 - DNA, 25 bp, Artificial sequence
  Synthetic oligonucleotide
aaagattagacgggtaatcggcatg

SEQ ID NO: 701631 - DNA, 25 bp, Artificial sequence
  Synthetic oligonucleotide
atctacgatcgcccactaagaatca

SEQ ID NO: 701632 - DNA, 25 bp, Artificial sequence
  Synthetic oligonucleotide
aatctcatatggggtcccgagattt

SEQ ID NO: 701633 - DNA, 25 bp, Artificial sequence
  Synthetic oligonucleotide
atctacgatcgcgcactaagaatca

SEQ ID NO: 701634 - DNA, 25 bp, Artificial sequence
  Synthetic oligonucleotide
tgaatacgacgcctattatggcatc

SEQ ID NO: 701635 - DNA, 25 bp, Artificial sequence
  Synthetic oligonucleotide
tgaatacgacgcgtattatggcatc

SEQ ID NO: 701636 - DNA, 25 bp, Artificial sequence
  Synthetic oligonucleotide
ggctagcgaattagtagcgatagta

SEQ ID NO: 701637 - DNA, 25 bp, Artificial sequence
  Synthetic oligonucleotide
ggctagcgaatttgtagcgatagta

SEQ ID NO: 701638 - DNA, 25 bp, Artificial sequence
  Synthetic oligonucleotide
ttcaaccggtcgtaagctttaatcc

SEQ ID NO: 701639 - DNA, 25 bp, Artificial sequence
  Synthetic oligonucleotide
catagtagtacgtcgctagggttta

SEQ ID NO: 701640 - DNA, 25 bp, Artificial sequence
  Synthetic oligonucleotide
aaagattagacgcgtaatcggcatg

SEQ ID NO: 701641 - DNA, 25 bp, Artificial sequence
  Synthetic oligonucleotide
gctaattccgttatacgtgccagta

SEQ ID NO: 701642 - DNA, 25 bp, Artificial sequence
  Synthetic oligonucleotide
caaaaagcgtacgaactaggtcttg

SEQ ID NO: 701643 - DNA, 25 bp, Artificial sequence
  Synthetic oligonucleotide
caaaaagcgtaccaactaggtcttg

SEQ ID NO: 701644 - DNA, 25 bp, Artificial sequence
  Synthetic oligonucleotide
agttacttccgaaacgctacgtctt

SEQ ID NO: 701645 - DNA, 25 bp, Artificial sequence
  Synthetic oligonucleotide
agttacttccgatacgctacgtctt

SEQ ID NO: 701646 - DNA, 25 bp, Artificial sequence
  Synthetic oligonucleotide
tcagttctagcgcgatataaagcgt

SEQ ID NO: 701647 - DNA, 25 bp, Artificial sequence
  Synthetic oligonucleotide
tcagttctagcgggatataaagcgt

SEQ ID NO: 701648 - DNA, 25 bp, Artificial sequence
  Synthetic oligonucleotide
aacaactagaccctacgcgtacatt

SEQ ID NO: 701649 - DNA, 25 bp, Artificial sequence
  Synthetic oligonucleotide
aacaactagaccgtacgcgtacatt

SEQ ID NO: 701650 - DNA, 25 bp, Artificial sequence
  Synthetic oligonucleotide
gaataaccgtgcctaatagtgagag

SEQ ID NO: 701651 - DNA, 25 bp, Artificial sequence
  Synthetic oligonucleotide
gaataaccgtgcgtaatagtgagag

SEQ ID NO: 701652 - DNA, 25 bp, Artificial sequence
  Synthetic oligonucleotide
tatatatagggccgtatcgcgatga

SEQ ID NO: 701653 - DNA, 25 bp, Artificial sequence
  Synthetic oligonucleotide
tatatatagggcggtatcgcgatga

SEQ ID NO: 701654 - DNA, 25 bp, Artificial sequence
  Synthetic oligonucleotide
gcggaaacgtattgtcgcctattaa

SEQ ID NO: 701655 - DNA, 25 bp, Artificial sequence
  Synthetic oligonucleotide
tgattccctaacccgagtagaaatg

SEQ ID NO: 701656 - DNA, 25 bp, Artificial sequence
  Synthetic oligonucleotide
tggtgacgataaggcgaatactttg

SEQ ID NO: 701657 - DNA, 25 bp, Artificial sequence
  Synthetic oligonucleotide
catagtagtacgacgctagggttta

SEQ ID NO: 701658 - DNA, 25 bp, Artificial sequence
  Synthetic oligonucleotide
ctttgatcggacctagacgttatac

SEQ ID NO: 701659 - DNA, 25 bp, Artificial sequence
  Synthetic oligonucleotide
ctttgatcggacgtagacgttatac

SEQ ID NO: 701660 - DNA, 25 bp, Artificial sequence
  Synthetic oligonucleotide
ctttatggttacgttatcggtgagc

SEQ ID NO: 701661 - DNA, 25 bp, Artificial sequence
  Synthetic oligonucleotide
ctttatggttaccttatcggtgagc

SEQ ID NO: 701662 - DNA, 25 bp, Artificial sequence
  Synthetic oligonucleotide
gcggaaacgtatagtcgcctattaa

SEQ ID NO: 701663 - DNA, 25 bp, Artificial sequence
  Synthetic oligonucleotide
gcatataccggccttatatatgctg

SEQ ID NO: 701664 - DNA, 25 bp, Artificial sequence
  Synthetic oligonucleotide
gctaattccgttttacgtgccagta

SEQ ID NO: 701665 - DNA, 25 bp, Artificial sequence
  Synthetic oligonucleotide
tggtgacgataacgcgaatactttg

SEQ ID NO: 701666 - DNA, 25 bp, Artificial sequence
  Synthetic oligonucleotide
agaatttccgcgatgatcggatttg

SEQ ID NO: 701667 - DNA, 25 bp, Artificial sequence
  Synthetic oligonucleotide
agaatttccgcgttgatcggatttg

SEQ ID NO: 701668 - DNA, 25 bp, Artificial sequence
  Synthetic oligonucleotide
caatttccccgatcgcgtttattca

SEQ ID NO: 701669 - DNA, 25 bp, Artificial sequence
  Synthetic oligonucleotide
caatttccccgaacgcgtttattca

SEQ ID NO: 701670 - DNA, 25 bp, Artificial sequence
  Synthetic oligonucleotide
gccatccgcgattagtcctttatat

SEQ ID NO: 701671 - DNA, 25 bp, Artificial sequence
  Synthetic oligonucleotide
gcatataccggcgttatatatgctg

SEQ ID NO: 701672 - DNA, 25 bp, Artificial sequence
  Synthetic oligonucleotide
gctgttgtaacgttcggtctaaaac

SEQ ID NO: 701673 - DNA, 25 bp, Artificial sequence
  Synthetic oligonucleotide
actctggacgataataccgcattga

SEQ ID NO: 701674 - DNA, 25 bp, Artificial sequence
  Synthetic oligonucleotide
aacacttacgcgtctagtcgatatc

SEQ ID NO: 701675 - DNA, 25 bp, Artificial sequence
  Synthetic oligonucleotide
aacacttacgcgactagtcgatatc

SEQ ID NO: 701676 - DNA, 25 bp, Artificial sequence
  Synthetic oligonucleotide
caaggtaccgatagttccgtctaat

SEQ ID NO: 701677 - DNA, 25 bp, Artificial sequence
  Synthetic oligonucleotide
caaggtaccgattgttccgtctaat

SEQ ID NO: 701678 - DNA, 25 bp, Artificial sequence
  Synthetic oligonucleotide
tgtaagatacggcgcttacgactta

SEQ ID NO: 701679 - DNA, 25 bp, Artificial sequence
  Synthetic oligonucleotide
tgtaagatacggggcttacgactta

SEQ ID NO: 701680 - DNA, 25 bp, Artificial sequence
  Synthetic oligonucleotide
tcgttattgacgctcgatctacgat

SEQ ID NO: 701681 - DNA, 25 bp, Artificial sequence
  Synthetic oligonucleotide
tcgttattgacggtcgatctacgat

SEQ ID NO: 701682 - DNA, 25 bp, Artificial sequence
  Synthetic oligonucleotide
atacgctattcgtaccgacctagaa

SEQ ID NO: 701683 - DNA, 25 bp, Artificial sequence
  Synthetic oligonucleotide
atacgctattcgaaccgacctagaa

SEQ ID NO: 701684 - DNA, 25 bp, Artificial sequence
  Synthetic oligonucleotide
ctaaactagcgtaccgatctgtgtt

SEQ ID NO: 701685 - DNA, 25 bp, Artificial sequence
  Synthetic oligonucleotide
ctaaactagcgttccgatctgtgtt

SEQ ID NO: 701686 - DNA, 25 bp, Artificial sequence
  Synthetic oligonucleotide
ttctactactatggcgctatctagg

SEQ ID NO: 701687 - DNA, 25 bp, Artificial sequence
  Synthetic oligonucleotide
actagtcgcatcggtaatattgctc

SEQ ID NO: 701688 - DNA, 25 bp, Artificial sequence
  Synthetic oligonucleotide
aagagggcgctaggattgattcaaa

SEQ ID NO: 701689 - DNA, 25 bp, Artificial sequence
  Synthetic oligonucleotide
aagagggcgctacgattgattcaaa

SEQ ID NO: 701690 - DNA, 25 bp, Artificial sequence
  Synthetic oligonucleotide
tatcattcggacacgcgaataacct

SEQ ID NO: 701691 - DNA, 25 bp, Artificial sequence
  Synthetic oligonucleotide
tatcattcggactcgcgaataacct

SEQ ID NO: 701692 - DNA, 25 bp, Artificial sequence
  Synthetic oligonucleotide
cctagtgcgttccacgtataataac

SEQ ID NO: 701693 - DNA, 25 bp, Artificial sequence
  Synthetic oligonucleotide
gacgtgcgcgtaatatcgtatcatt

SEQ ID NO: 701694 - DNA, 25 bp, Artificial sequence
  Synthetic oligonucleotide
actagtcgcatccgtaatattgctc

SEQ ID NO: 701695 - DNA, 25 bp, Artificial sequence
  Synthetic oligonucleotide
gacgtgcgcgtattatcgtatcatt

SEQ ID NO: 701696 - DNA, 25 bp, Artificial sequence
  Synthetic oligonucleotide
ctattcgatctaccgtcgttacctt

SEQ ID NO: 701697 - DNA, 25 bp, Artificial sequence
  Synthetic oligonucleotide
ctattcgatctagcgtcgttacctt

SEQ ID NO: 701698 - DNA, 25 bp, Artificial sequence
  Synthetic oligonucleotide
aaaggttcgatccgctattttggca

SEQ ID NO: 701699 - DNA, 25 bp, Artificial sequence
  Synthetic oligonucleotide
aaaggttcgatcggctattttggca

SEQ ID NO: 701700 - DNA, 25 bp, Artificial sequence
  Synthetic oligonucleotide
gctgttgtaacgatcggtctaaaac

SEQ ID NO: 701701 - DNA, 25 bp, Artificial sequence
  Synthetic oligonucleotide
gtcttcatacgttcgacggtatgat

SEQ ID NO: 701702 - DNA, 25 bp, Artificial sequence
  Synthetic oligonucleotide
cctagtgcgttcgacgtataataac

SEQ ID NO: 701703 - DNA, 25 bp, Artificial sequence
  Synthetic oligonucleotide
gacaaacgggttagtacgtatgcat

SEQ ID NO: 701704 - DNA, 25 bp, Artificial sequence
  Synthetic oligonucleotide
ctgtaatactctcgcgtagtctttc

SEQ ID NO: 701705 - DNA, 25 bp, Artificial sequence
  Synthetic oligonucleotide
ctgtaatactctggcgtagtctttc

SEQ ID NO: 701706 - DNA, 25 bp, Artificial sequence
  Synthetic oligonucleotide
ataccatattgccggtgcgtaacaa

SEQ ID NO: 701707 - DNA, 25 bp, Artificial sequence
  Synthetic oligonucleotide
ctggttgacgcgttatacacttctt

SEQ ID NO: 701708 - DNA, 25 bp, Artificial sequence
  Synthetic oligonucleotide
tcactatcgacgcttaaaccttcgt

SEQ ID NO: 701709 - DNA, 25 bp, Artificial sequence
  Synthetic oligonucleotide
tcactatcgacggttaaaccttcgt

SEQ ID NO: 701710 - DNA, 25 bp, Artificial sequence
  Synthetic oligonucleotide
caactccgttagggtacgattagaa

SEQ ID NO: 701711 - DNA, 25 bp, Artificial sequence
  Synthetic oligonucleotide
caactccgttagcgtacgattagaa

SEQ ID NO: 701712 - DNA, 25 bp, Artificial sequence
  Synthetic oligonucleotide
gctcatacggtcccgtatatctaat

SEQ ID NO: 701713 - DNA, 25 bp, Artificial sequence
  Synthetic oligonucleotide
gctcatacggtcgcgtatatctaat

SEQ ID NO: 701714 - DNA, 25 bp, Artificial sequence
  Synthetic oligonucleotide
gcttttccgaatcataccgtcttct

SEQ ID NO: 701715 - DNA, 25 bp, Artificial sequence
  Synthetic oligonucleotide
gcttttccgaatgataccgtcttct

SEQ ID NO: 701716 - DNA, 25 bp, Artificial sequence
  Synthetic oligonucleotide
catagaacgagccgtaatggctata

SEQ ID NO: 701717 - DNA, 25 bp, Artificial sequence
  Synthetic oligonucleotide
ttctactactatcgcgctatctagg

SEQ ID NO: 701718 - DNA, 25 bp, Artificial sequence
  Synthetic oligonucleotide
gatactatcgcgcacgtatctttca

SEQ ID NO: 701719 - DNA, 25 bp, Artificial sequence
  Synthetic oligonucleotide
gtcttcatacgtacgacggtatgat

SEQ ID NO: 701720 - DNA, 25 bp, Artificial sequence
  Synthetic oligonucleotide
gatactaccgcgctattacatttgc

SEQ ID NO: 701721 - DNA, 25 bp, Artificial sequence
  Synthetic oligonucleotide
gatactaccgcggtattacatttgc

SEQ ID NO: 701722 - DNA, 25 bp, Artificial sequence
  Synthetic oligonucleotide
aaaacccgctatatgtcgctctaga

SEQ ID NO: 701723 - DNA, 25 bp, Artificial sequence
  Synthetic oligonucleotide
aaaacccgctatttgtcgctctaga

SEQ ID NO: 701724 - DNA, 25 bp, Artificial sequence
  Synthetic oligonucleotide
catagaacgagcggtaatggctata

SEQ ID NO: 701725 - DNA, 25 bp, Artificial sequence
  Synthetic oligonucleotide
cgatcatctaccgcgtaatactttc

SEQ ID NO: 701726 - DNA, 25 bp, Artificial sequence
  Synthetic oligonucleotide
gacaaacgggtttgtacgtatgcat

SEQ ID NO: 701727 - DNA, 25 bp, Artificial sequence
  Synthetic oligonucleotide
gatactatcgcggacgtatctttca

SEQ ID NO: 701728 - DNA, 25 bp, Artificial sequence
  Synthetic oligonucleotide
agaagggagcgttgtacgaatcata

SEQ ID NO: 701729 - DNA, 25 bp, Artificial sequence
  Synthetic oligonucleotide
ataccatattgcgggtgcgtaacaa

SEQ ID NO: 701730 - DNA, 25 bp, Artificial sequence
  Synthetic oligonucleotide
tttactgtcacgacgtatgacctca

SEQ ID NO: 701731 - DNA, 25 bp, Artificial sequence
  Synthetic oligonucleotide
taattgttacgtcgtgcgaaccctt

SEQ ID NO: 701732 - DNA, 25 bp, Artificial sequence
  Synthetic oligonucleotide
tttactgtcacgtcgtatgacctca

SEQ ID NO: 701733 - DNA, 25 bp, Artificial sequence
  Synthetic oligonucleotide
cgatcatctaccccgtaatactttc

SEQ ID NO: 701734 - DNA, 25 bp, Artificial sequence
  Synthetic oligonucleotide
ctgatcaatcgccctaacgatgata

SEQ ID NO: 701735 - DNA, 25 bp, Artificial sequence
  Synthetic oligonucleotide
catcgtcgacgaccgctaattaaat

SEQ ID NO: 701736 - DNA, 25 bp, Artificial sequence
  Synthetic oligonucleotide
agtaaccgggacgtaatacactcaa

SEQ ID NO: 701737 - DNA, 25 bp, Artificial sequence
  Synthetic oligonucleotide
actagagctagatcgtcgtactctt

SEQ ID NO: 701738 - DNA, 25 bp, Artificial sequence
  Synthetic oligonucleotide
actagagctagaacgtcgtactctt

SEQ ID NO: 701739 - DNA, 25 bp, Artificial sequence
  Synthetic oligonucleotide
ggttaacgcgattactacgcacata

SEQ ID NO: 701740 - DNA, 25 bp, Artificial sequence
  Synthetic oligonucleotide
ggttaacgcgataactacgcacata

SEQ ID NO: 701741 - DNA, 25 bp, Artificial sequence
  Synthetic oligonucleotide
gtttgtgcgtctagtatcgcgttaa

SEQ ID NO: 701742 - DNA, 25 bp, Artificial sequence
  Synthetic oligonucleotide
gtttgtgcgtcttgtatcgcgttaa

SEQ ID NO: 701743 - DNA, 25 bp, Artificial sequence
  Synthetic oligonucleotide
actaggtacgttcggtactagatac

SEQ ID NO: 701744 - DNA, 25 bp, Artificial sequence
  Synthetic oligonucleotide
actaggtacgttgggtactagatac

SEQ ID NO: 701745 - DNA, 25 bp, Artificial sequence
  Synthetic oligonucleotide
gtccaacgctacgtactacacataa

SEQ ID NO: 701746 - DNA, 25 bp, Artificial sequence
  Synthetic oligonucleotide
gtccaacgctacctactacacataa

SEQ ID NO: 701747 - DNA, 25 bp, Artificial sequence
  Synthetic oligonucleotide
ggcattcgcgactaatctttacttg

SEQ ID NO: 701748 - DNA, 25 bp, Artificial sequence
  Synthetic oligonucleotide
taacggtgcgcgttataagacattg

SEQ ID NO: 701749 - DNA, 25 bp, Artificial sequence
  Synthetic oligonucleotide
tagtacgtatcaccgtacgctgtaa

SEQ ID NO: 701750 - DNA, 25 bp, Artificial sequence
  Synthetic oligonucleotide
catcgtcgacgagcgctaattaaat

SEQ ID NO: 701751 - DNA, 25 bp, Artificial sequence
  Synthetic oligonucleotide
ctttcggattacctacgcgaaacaa

SEQ ID NO: 701752 - DNA, 25 bp, Artificial sequence
  Synthetic oligonucleotide
ctttcggattacgtacgcgaaacaa

SEQ ID NO: 701753 - DNA, 25 bp, Artificial sequence
  Synthetic oligonucleotide
atactgaacgcggtatcggatttga

SEQ ID NO: 701754 - DNA, 25 bp, Artificial sequence
  Synthetic oligonucleotide
atactgaacgcgctatcggatttga

SEQ ID NO: 701755 - DNA, 25 bp, Artificial sequence
  Synthetic oligonucleotide
ggcattcgcgacaaatctttacttg

SEQ ID NO: 701756 - DNA, 25 bp, Artificial sequence
  Synthetic oligonucleotide
taaagtcgacccgactagtataagc

SEQ ID NO: 701757 - DNA, 25 bp, Artificial sequence
  Synthetic oligonucleotide
ctgatcaatcgcgctaacgatgata

SEQ ID NO: 701758 - DNA, 25 bp, Artificial sequence
  Synthetic oligonucleotide
tagtacgtatcagcgtacgctgtaa

SEQ ID NO: 701759 - DNA, 25 bp, Artificial sequence
  Synthetic oligonucleotide
gtcctttaattcgggcgtatgactt

SEQ ID NO: 701760 - DNA, 25 bp, Artificial sequence
  Synthetic oligonucleotide
gtcctttaattccggcgtatgactt

SEQ ID NO: 701761 - DNA, 25 bp, Artificial sequence
  Synthetic oligonucleotide
atgatcgtcgacccaagtagtaagt

SEQ ID NO: 701762 - DNA, 25 bp, Artificial sequence
  Synthetic oligonucleotide
atgatcgtcgacgcaagtagtaagt

SEQ ID NO: 701763 - DNA, 25 bp, Artificial sequence
  Synthetic oligonucleotide
taacggtgcgcgatataagacattg

SEQ ID NO: 701764 - DNA, 25 bp, Artificial sequence
  Synthetic oligonucleotide
taaagtcgaccccactagtataagc

SEQ ID NO: 701765 - DNA, 25 bp, Artificial sequence
  Synthetic oligonucleotide
aatttagtattgccgtacccgatgg

SEQ ID NO: 701766 - DNA, 25 bp, Artificial sequence
  Synthetic oligonucleotide
taattgttacgtggtgcgaaccctt

SEQ ID NO: 701767 - DNA, 25 bp, Artificial sequence
  Synthetic oligonucleotide
tcaagagcgtaaatcgacgagacta

SEQ ID NO: 701768 - DNA, 25 bp, Artificial sequence
  Synthetic oligonucleotide
tcaagagcgtaattcgacgagacta

SEQ ID NO: 701769 - DNA, 25 bp, Artificial sequence
  Synthetic oligonucleotide
agccaagtcgcgaaacaacgttata

SEQ ID NO: 701770 - DNA, 25 bp, Artificial sequence
  Synthetic oligonucleotide
agccaagtcgcgtaacaacgttata

SEQ ID NO: 701771 - DNA, 25 bp, Artificial sequence
  Synthetic oligonucleotide
agtactcgtcgaatcgtgatctagt

SEQ ID NO: 701772 - DNA, 25 bp, Artificial sequence
  Synthetic oligonucleotide
agtactcgtcgattcgtgatctagt

SEQ ID NO: 701773 - DNA, 25 bp, Artificial sequence
  Synthetic oligonucleotide
tccagatctaagggcgcgatttaat

SEQ ID NO: 701774 - DNA, 25 bp, Artificial sequence
  Synthetic oligonucleotide
tccagatctaagcgcgcgatttaat

SEQ ID NO: 701775 - DNA, 25 bp, Artificial sequence
  Synthetic oligonucleotide
tttacccgaccgatcgtacattatg

SEQ ID NO: 701776 - DNA, 25 bp, Artificial sequence
  Synthetic oligonucleotide
tttacccgaccgttcgtacattatg

SEQ ID NO: 701777 - DNA, 25 bp, Artificial sequence
  Synthetic oligonucleotide
ccctatcgcaattcgtcgattatac

SEQ ID NO: 701778 - DNA, 25 bp, Artificial sequence
  Synthetic oligonucleotide
ccctatcgcaatacgtcgattatac

SEQ ID NO: 701779 - DNA, 25 bp, Artificial sequence
  Synthetic oligonucleotide
agtaaccgggacctaatacactcaa

SEQ ID NO: 701780 - DNA, 25 bp, Artificial sequence
  Synthetic oligonucleotide
tcaagtcgcgcttaagaatggcata

SEQ ID NO: 701781 - DNA, 25 bp, Artificial sequence
  Synthetic oligonucleotide
acttaatagctcgtacgcggtatac

SEQ ID NO: 701782 - DNA, 25 bp, Artificial sequence
  Synthetic oligonucleotide
acttaatagctcctacgcggtatac

SEQ ID NO: 701783 - DNA, 25 bp, Artificial sequence
  Synthetic oligonucleotide
tcacttcgcgacgaatagtacattg

SEQ ID NO: 701784 - DNA, 25 bp, Artificial sequence
  Synthetic oligonucleotide
tcacttcgcgaccaatagtacattg

SEQ ID NO: 701785 - DNA, 25 bp, Artificial sequence
  Synthetic oligonucleotide
tgctttccgcgactaactaagtaca

SEQ ID NO: 701786 - DNA, 25 bp, Artificial sequence
  Synthetic oligonucleotide
ctaatccgatccaagatcgttccaa

SEQ ID NO: 701787 - DNA, 25 bp, Artificial sequence
  Synthetic oligonucleotide
tcaagtcgcgctaaagaatggcata

SEQ ID NO: 701788 - DNA, 25 bp, Artificial sequence
  Synthetic oligonucleotide
agaagggagcgtagtacgaatcata

SEQ ID NO: 701789 - DNA, 25 bp, Artificial sequence
  Synthetic oligonucleotide
taaatgtcgtaccggcatagaagca

SEQ ID NO: 701790 - DNA, 25 bp, Artificial sequence
  Synthetic oligonucleotide
taaatgtcgtacgggcatagaagca

SEQ ID NO: 701791 - DNA, 25 bp, Artificial sequence
  Synthetic oligonucleotide
taggtttcgtaccgtcctatcgtta

SEQ ID NO: 701792 - DNA, 25 bp, Artificial sequence
  Synthetic oligonucleotide
taggtttcgtacggtcctatcgtta

SEQ ID NO: 701793 - DNA, 25 bp, Artificial sequence
  Synthetic oligonucleotide
ctaatccgatcctagatcgttccaa

SEQ ID NO: 701794 - DNA, 25 bp, Artificial sequence
  Synthetic oligonucleotide
tgctttccgcgagtaactaagtaca

SEQ ID NO: 701795 - DNA, 25 bp, Artificial sequence
  Synthetic oligonucleotide
atcattgaccggatacgtttcagca

SEQ ID NO: 701796 - DNA, 25 bp, Artificial sequence
  Synthetic oligonucleotide
aataccatcaccgtacgggctttat

SEQ ID NO: 701797 - DNA, 25 bp, Artificial sequence
  Synthetic oligonucleotide
cgatcttcggcgtttaacggttata

SEQ ID NO: 701798 - DNA, 25 bp, Artificial sequence
  Synthetic oligonucleotide
gttgttccgcgtacataagtgagtt

SEQ ID NO: 701799 - DNA, 25 bp, Artificial sequence
  Synthetic oligonucleotide
gttgttccgcgttcataagtgagtt

SEQ ID NO: 701800 - DNA, 25 bp, Artificial sequence
  Synthetic oligonucleotide
ccaagtcgattacgcgtacgaaata

SEQ ID NO: 701801 - DNA, 25 bp, Artificial sequence
  Synthetic oligonucleotide
gattgtcgcgcaatagatactgctt

SEQ ID NO: 701802 - DNA, 25 bp, Artificial sequence
  Synthetic oligonucleotide
tttccgcgcgtgttatagttggatt

SEQ ID NO: 701803 - DNA, 25 bp, Artificial sequence
  Synthetic oligonucleotide
agatctggcgtattacgacacgaat

SEQ ID NO: 701804 - DNA, 25 bp, Artificial sequence
  Synthetic oligonucleotide
aataccatcaccctacgggctttat

SEQ ID NO: 701805 - DNA, 25 bp, Artificial sequence
  Synthetic oligonucleotide
agatctggcgtaatacgacacgaat

SEQ ID NO: 701806 - DNA, 25 bp, Artificial sequence
  Synthetic oligonucleotide
aacgggcgcgattcgtataattgtt

SEQ ID NO: 701807 - DNA, 25 bp, Artificial sequence
  Synthetic oligonucleotide
aacgggcgcgatacgtataattgtt

SEQ ID NO: 701808 - DNA, 25 bp, Artificial sequence
  Synthetic oligonucleotide
gcattatcgtaccataggcgttttg

SEQ ID NO: 701809 - DNA, 25 bp, Artificial sequence
  Synthetic oligonucleotide
gcattatcgtacgataggcgttttg

SEQ ID NO: 701810 - DNA, 25 bp, Artificial sequence
  Synthetic oligonucleotide
cgatcttcggcgattaacggttata

SEQ ID NO: 701811 - DNA, 25 bp, Artificial sequence
  Synthetic oligonucleotide
gaacccatataatcgcgtccaatca

SEQ ID NO: 701812 - DNA, 25 bp, Artificial sequence
  Synthetic oligonucleotide
atcattgaccggttacgtttcagca

SEQ ID NO: 701813 - DNA, 25 bp, Artificial sequence
  Synthetic oligonucleotide
tattgttagtccgtcgcaaggttag

SEQ ID NO: 701814 - DNA, 25 bp, Artificial sequence
  Synthetic oligonucleotide
tttttcagtatccacgcgtgtgtga

SEQ ID NO: 701815 - DNA, 25 bp, Artificial sequence
  Synthetic oligonucleotide
tttttcagtatcgacgcgtgtgtga

SEQ ID NO: 701816 - DNA, 25 bp, Artificial sequence
  Synthetic oligonucleotide
tttggtctcgcgtacgatatgaaac

SEQ ID NO: 701817 - DNA, 25 bp, Artificial sequence
  Synthetic oligonucleotide
ggttaagcgttccgatacggataat

SEQ ID NO: 701818 - DNA, 25 bp, Artificial sequence
  Synthetic oligonucleotide
gaacccatataaacgcgtccaatca

SEQ ID NO: 701819 - DNA, 25 bp, Artificial sequence
  Synthetic oligonucleotide
ggttaagcgttcggatacggataat

SEQ ID NO: 701820 - DNA, 25 bp, Artificial sequence
  Synthetic oligonucleotide
agtgtacgttcgggacatacaatgt

SEQ ID NO: 701821 - DNA, 25 bp, Artificial sequence
  Synthetic oligonucleotide
agtgtacgttcgcgacatacaatgt

SEQ ID NO: 701822 - DNA, 25 bp, Artificial sequence
  Synthetic oligonucleotide
cactcacgtacgaagttagattcca

SEQ ID NO: 701823 - DNA, 25 bp, Artificial sequence
  Synthetic oligonucleotide
cccttttacgcgtagtaattcgtca

SEQ ID NO: 701824 - DNA, 25 bp, Artificial sequence
  Synthetic oligonucleotide
cactcacgtacgtagttagattcca

SEQ ID NO: 701825 - DNA, 25 bp, Artificial sequence
  Synthetic oligonucleotide
ccaagtcgattaggcgtacgaaata

SEQ ID NO: 701826 - DNA, 25 bp, Artificial sequence
  Synthetic oligonucleotide
tttggtctcgcgaacgatatgaaac

SEQ ID NO: 701827 - DNA, 25 bp, Artificial sequence
  Synthetic oligonucleotide
tttccgcgcgtgatatagttggatt

SEQ ID NO: 701828 - DNA, 25 bp, Artificial sequence
  Synthetic oligonucleotide
ctgatgtcgtactacggctacatat

SEQ ID NO: 701829 - DNA, 25 bp, Artificial sequence
  Synthetic oligonucleotide
ctgatgtcgtacaacggctacatat

SEQ ID NO: 701830 - DNA, 25 bp, Artificial sequence
  Synthetic oligonucleotide
aagtagatccgctattgcgacgtaa

SEQ ID NO: 701831 - DNA, 25 bp, Artificial sequence
  Synthetic oligonucleotide
gtgacagtaacgcaatgcggatata

SEQ ID NO: 701832 - DNA, 25 bp, Artificial sequence
  Synthetic oligonucleotide
atctcagctcgaaagaacgggaaat

SEQ ID NO: 701833 - DNA, 25 bp, Artificial sequence
  Synthetic oligonucleotide
gattgtcgcgcattagatactgctt

SEQ ID NO: 701834 - DNA, 25 bp, Artificial sequence
  Synthetic oligonucleotide
atgcaccgcgatactaaagactcaa

SEQ ID NO: 701835 - DNA, 25 bp, Artificial sequence
  Synthetic oligonucleotide
tacaacgatcgagtatacgacacca

SEQ ID NO: 701836 - DNA, 25 bp, Artificial sequence
  Synthetic oligonucleotide
aagtagatccgcaattgcgacgtaa

SEQ ID NO: 701837 - DNA, 25 bp, Artificial sequence
  Synthetic oligonucleotide
atcagactatattcgtccgggtttg

SEQ ID NO: 701838 - DNA, 25 bp, Artificial sequence
  Synthetic oligonucleotide
cccttttacgcgaagtaattcgtca

SEQ ID NO: 701839 - DNA, 25 bp, Artificial sequence
  Synthetic oligonucleotide
atcagactatatacgtccgggtttg

SEQ ID NO: 701840 - DNA, 25 bp, Artificial sequence
  Synthetic oligonucleotide
tcggctatagggggcgtaattaatt

SEQ ID NO: 701841 - DNA, 25 bp, Artificial sequence
  Synthetic oligonucleotide
tcggctatagggcgcgtaattaatt

SEQ ID NO: 701842 - DNA, 25 bp, Artificial sequence
  Synthetic oligonucleotide
tattgttagtccctcgcaaggttag

SEQ ID NO: 701843 - DNA, 25 bp, Artificial sequence
  Synthetic oligonucleotide
tacaacgatcgactatacgacacca

SEQ ID NO: 701844 - DNA, 25 bp, Artificial sequence
  Synthetic oligonucleotide
gtgacagtaacggaatgcggatata

SEQ ID NO: 701845 - DNA, 25 bp, Artificial sequence
  Synthetic oligonucleotide
ggactattacgaccgaagctcttaa

SEQ ID NO: 701846 - DNA, 25 bp, Artificial sequence
  Synthetic oligonucleotide
tagcatatcgcgaataacgacgcat

SEQ ID NO: 701847 - DNA, 25 bp, Artificial sequence
  Synthetic oligonucleotide
atctcagctcgatagaacgggaaat

SEQ ID NO: 701848 - DNA, 25 bp, Artificial sequence
  Synthetic oligonucleotide
ggactattacgagcgaagctcttaa

SEQ ID NO: 701849 - DNA, 25 bp, Artificial sequence
  Synthetic oligonucleotide
atgcaccgcgattctaaagactcaa

SEQ ID NO: 701850 - DNA, 25 bp, Artificial sequence
  Synthetic oligonucleotide
tagcatatcgcgtataacgacgcat

SEQ ID NO: 701851 - DNA, 25 bp, Artificial sequence
  Synthetic oligonucleotide
acaggtggttctactacgctctata

SEQ ID NO: 701852 - DNA, 25 bp, Artificial sequence
  Synthetic oligonucleotide
acaggtggttcttctacgctctata

SEQ ID NO: 701853 - DNA, 25 bp, Artificial sequence
  Synthetic oligonucleotide
acgttacgcgtatactagtgtcaga

SEQ ID NO: 701854 - DNA, 25 bp, Artificial sequence
  Synthetic oligonucleotide
acgttacgcgtaaactagtgtcaga

SEQ ID NO: 701855 - DNA, 25 bp, Artificial sequence
  Synthetic oligonucleotide
atttgacgcgatatacagggaccat

SEQ ID NO: 701856 - DNA, 25 bp, Artificial sequence
  Synthetic oligonucleotide
atttgacgcgatttacagggaccat

SEQ ID NO: 701857 - DNA, 25 bp, Artificial sequence
  Synthetic oligonucleotide
attccgagaacgagcggtaatttgt

SEQ ID NO: 701858 - DNA, 25 bp, Artificial sequence
  Synthetic oligonucleotide
attccgagaacgtgcggtaatttgt

SEQ ID NO: 701859 - DNA, 25 bp, Artificial sequence
  Synthetic oligonucleotide
tatccgtcgcgtaagcctattacac

SEQ ID NO: 701860 - DNA, 25 bp, Artificial sequence
  Synthetic oligonucleotide
tcgattgtcgcgaagtatccctttg

SEQ ID NO: 701861 - DNA, 25 bp, Artificial sequence
  Synthetic oligonucleotide
atcaatgccgaccgtataagctctc

SEQ ID NO: 701862 - DNA, 25 bp, Artificial sequence
  Synthetic oligonucleotide
atcaatgccgacggtataagctctc

SEQ ID NO: 701863 - DNA, 25 bp, Artificial sequence
  Synthetic oligonucleotide
atcccagtcgtttcgcgatcaaaca

SEQ ID NO: 701864 - DNA, 25 bp, Artificial sequence
  Synthetic oligonucleotide
tcgattgtcgcgtagtatccctttg

SEQ ID NO: 701865 - DNA, 25 bp, Artificial sequence
  Synthetic oligonucleotide
gtgtaaactaatatcgcgcggatcg

SEQ ID NO: 701866 - DNA, 25 bp, Artificial sequence
  Synthetic oligonucleotide
gtgtaaactaatttcgcgcggatcg

SEQ ID NO: 701867 - DNA, 25 bp, Artificial sequence
  Synthetic oligonucleotide
tgtgtcaatacgacgtccggatcta

SEQ ID NO: 701868 - DNA, 25 bp, Artificial sequence
  Synthetic oligonucleotide
ccacttgtgtgcgacgtaacagata

SEQ ID NO: 701869 - DNA, 25 bp, Artificial sequence
  Synthetic oligonucleotide
atcccagtcgttacgcgatcaaaca

SEQ ID NO: 701870 - DNA, 25 bp, Artificial sequence
  Synthetic oligonucleotide
tgtgtcaatacgtcgtccggatcta

SEQ ID NO: 701871 - DNA, 25 bp, Artificial sequence
  Synthetic oligonucleotide
agtaggcgctatctaaccgtaacag

SEQ ID NO: 701872 - DNA, 25 bp, Artificial sequence
  Synthetic oligonucleotide
agaaaacgtcgtatacggactgcct

SEQ ID NO: 701873 - DNA, 25 bp, Artificial sequence
  Synthetic oligonucleotide
caacgaggtacgggatagttgttga

SEQ ID NO: 701874 - DNA, 25 bp, Artificial sequence
  Synthetic oligonucleotide
caacgaggtacgcgatagttgttga

SEQ ID NO: 701875 - DNA, 25 bp, Artificial sequence
  Synthetic oligonucleotide
ccacttgtgtgccacgtaacagata

SEQ ID NO: 701876 - DNA, 25 bp, Artificial sequence
  Synthetic oligonucleotide
gaggtgctaacgttcgcgttaatac

SEQ ID NO: 701877 - DNA, 25 bp, Artificial sequence
  Synthetic oligonucleotide
agtttacgcccgtatactacaacgc

SEQ ID NO: 701878 - DNA, 25 bp, Artificial sequence
  Synthetic oligonucleotide
attgtaatcgtacatcgcggcagac

SEQ ID NO: 701879 - DNA, 25 bp, Artificial sequence
  Synthetic oligonucleotide
attgtaatcgtagatcgcggcagac

SEQ ID NO: 701880 - DNA, 25 bp, Artificial sequence
  Synthetic oligonucleotide
gggacgtatagtaacgcgaataacg

SEQ ID NO: 701881 - DNA, 25 bp, Artificial sequence
  Synthetic oligonucleotide
gggacgtatagttacgcgaataacg

SEQ ID NO: 701882 - DNA, 25 bp, Artificial sequence
  Synthetic oligonucleotide
acgttcgcgtatacgatactggatc

SEQ ID NO: 701883 - DNA, 25 bp, Artificial sequence
  Synthetic oligonucleotide
agtttacgcccgaatactacaacgc

SEQ ID NO: 701884 - DNA, 25 bp, Artificial sequence
  Synthetic oligonucleotide
agtaggcgctatgtaaccgtaacag

SEQ ID NO: 701885 - DNA, 25 bp, Artificial sequence
  Synthetic oligonucleotide
ggctagcaccgacgtaataatacgt

SEQ ID NO: 701886 - DNA, 25 bp, Artificial sequence
  Synthetic oligonucleotide
agtctagatacggtcggtaaactcg

SEQ ID NO: 701887 - DNA, 25 bp, Artificial sequence
  Synthetic oligonucleotide
agtctagatacgctcggtaaactcg

SEQ ID NO: 701888 - DNA, 25 bp, Artificial sequence
  Synthetic oligonucleotide
gcaaagcgtatccctaggagtttac

SEQ ID NO: 701889 - DNA, 25 bp, Artificial sequence
  Synthetic oligonucleotide
gcaaagcgtatcgctaggagtttac

SEQ ID NO: 701890 - DNA, 25 bp, Artificial sequence
  Synthetic oligonucleotide
acttcttaaacgcctgtcgcatcct

SEQ ID NO: 701891 - DNA, 25 bp, Artificial sequence
  Synthetic oligonucleotide
acttcttaaacggctgtcgcatcct

SEQ ID NO: 701892 - DNA, 25 bp, Artificial sequence
  Synthetic oligonucleotide
actgacggtaacggcgttagttgta

SEQ ID NO: 701893 - DNA, 25 bp, Artificial sequence
  Synthetic oligonucleotide
actgacggtaaccgcgttagttgta

SEQ ID NO: 701894 - DNA, 25 bp, Artificial sequence
  Synthetic oligonucleotide
tctaagtcgacgcgggataattcga

SEQ ID NO: 701895 - DNA, 25 bp, Artificial sequence
  Synthetic oligonucleotide
tctaagtcgacgggggataattcga

SEQ ID NO: 701896 - DNA, 25 bp, Artificial sequence
  Synthetic oligonucleotide
ggctagcaccgaggtaataatacgt

SEQ ID NO: 701897 - DNA, 25 bp, Artificial sequence
  Synthetic oligonucleotide
acgttcgcgtattcgatactggatc

SEQ ID NO: 701898 - DNA, 25 bp, Artificial sequence
  Synthetic oligonucleotide
ataactcgtacgtgcgataagtccg

SEQ ID NO: 701899 - DNA, 25 bp, Artificial sequence
  Synthetic oligonucleotide
gcgtaacgcctatcgtacagtctaa

SEQ ID NO: 701900 - DNA, 25 bp, Artificial sequence
  Synthetic oligonucleotide
gcgtaacgcctaacgtacagtctaa

SEQ ID NO: 701901 - DNA, 25 bp, Artificial sequence
  Synthetic oligonucleotide
tcggaaccgtagaccgatagactta

SEQ ID NO: 701902 - DNA, 25 bp, Artificial sequence
  Synthetic oligonucleotide
tcggaaccgtagtccgatagactta

SEQ ID NO: 701903 - DNA, 25 bp, Artificial sequence
  Synthetic oligonucleotide
gaaatcctagtcccgacgtggttta

SEQ ID NO: 701904 - DNA, 25 bp, Artificial sequence
  Synthetic oligonucleotide
gaaatcctagtcgcgacgtggttta

SEQ ID NO: 701905 - DNA, 25 bp, Artificial sequence
  Synthetic oligonucleotide
tcctcgcgcgattctaagttacaac

SEQ ID NO: 701906 - DNA, 25 bp, Artificial sequence
  Synthetic oligonucleotide
tcctcgcgcgatactaagttacaac

SEQ ID NO: 701907 - DNA, 25 bp, Artificial sequence
  Synthetic oligonucleotide
tcttctacccgcgtatacgacagta

SEQ ID NO: 701908 - DNA, 25 bp, Artificial sequence
  Synthetic oligonucleotide
attagtgtaatacgtcgcgaccacc

SEQ ID NO: 701909 - DNA, 25 bp, Artificial sequence
  Synthetic oligonucleotide
aagctgacacccgtcgatactaagt

SEQ ID NO: 701910 - DNA, 25 bp, Artificial sequence
  Synthetic oligonucleotide
ataactcgtacgagcgataagtccg

SEQ ID NO: 701911 - DNA, 25 bp, Artificial sequence
  Synthetic oligonucleotide
ttgcttcgctacaggcgtactagta

SEQ ID NO: 701912 - DNA, 25 bp, Artificial sequence
  Synthetic oligonucleotide
ttgcttcgctactggcgtactagta

SEQ ID NO: 701913 - DNA, 25 bp, Artificial sequence
  Synthetic oligonucleotide
taggaatacgtccttagactggtcg

SEQ ID NO: 701914 - DNA, 25 bp, Artificial sequence
  Synthetic oligonucleotide
agaaaacgtcgtttacggactgcct

SEQ ID NO: 701915 - DNA, 25 bp, Artificial sequence
  Synthetic oligonucleotide
cagaccccgacgtgtaatgtgtaat

SEQ ID NO: 701916 - DNA, 25 bp, Artificial sequence
  Synthetic oligonucleotide
taggaatacgtcgttagactggtcg

SEQ ID NO: 701917 - DNA, 25 bp, Artificial sequence
  Synthetic oligonucleotide
atactgtactcgacggtcgaacact

SEQ ID NO: 701918 - DNA, 25 bp, Artificial sequence
  Synthetic oligonucleotide
attagtgtaataggtcgcgaccacc

SEQ ID NO: 701919 - DNA, 25 bp, Artificial sequence
  Synthetic oligonucleotide
ttctctcttcgccaactaggcgaaa

SEQ ID NO: 701920 - DNA, 25 bp, Artificial sequence
  Synthetic oligonucleotide
attggcctatgccccgcattcataa

SEQ ID NO: 701921 - DNA, 25 bp, Artificial sequence
  Synthetic oligonucleotide
attggcctatgcgccgcattcataa

SEQ ID NO: 701922 - DNA, 25 bp, Artificial sequence
  Synthetic oligonucleotide
tggtgatacggttcgtaagccgtaa

SEQ ID NO: 701923 - DNA, 25 bp, Artificial sequence
  Synthetic oligonucleotide
tggtgatacggtacgtaagccgtaa

SEQ ID NO: 701924 - DNA, 25 bp, Artificial sequence
  Synthetic oligonucleotide
ttacttcgtgactagcgactgttcg

SEQ ID NO: 701925 - DNA, 25 bp, Artificial sequence
  Synthetic oligonucleotide
ttacttcgtgacaagcgactgttcg

SEQ ID NO: 701926 - DNA, 25 bp, Artificial sequence
  Synthetic oligonucleotide
atcgtaaacgtcgggacgatcagat

SEQ ID NO: 701927 - DNA, 25 bp, Artificial sequence
  Synthetic oligonucleotide
atcgtaaacgtccggacgatcagat

SEQ ID NO: 701928 - DNA, 25 bp, Artificial sequence
  Synthetic oligonucleotide
gtgaaacgactacgctttagactgg

SEQ ID NO: 701929 - DNA, 25 bp, Artificial sequence
  Synthetic oligonucleotide
ggtcaaatcgcgtcgtataaggagt

SEQ ID NO: 701930 - DNA, 25 bp, Artificial sequence
  Synthetic oligonucleotide
gtgaaacgactaggctttagactgg

SEQ ID NO: 701931 - DNA, 25 bp, Artificial sequence
  Synthetic oligonucleotide
ttctctcttcgcgaactaggcgaaa

SEQ ID NO: 701932 - DNA, 25 bp, Artificial sequence
  Synthetic oligonucleotide
caaaactctacgggatactccgttg

SEQ ID NO: 701933 - DNA, 25 bp, Artificial sequence
  Synthetic oligonucleotide
caaaactctacgcgatactccgttg

SEQ ID NO: 701934 - DNA, 25 bp, Artificial sequence
  Synthetic oligonucleotide
tcttctacccgcctatacgacagta

SEQ ID NO: 701935 - DNA, 25 bp, Artificial sequence
  Synthetic oligonucleotide
gaggtgctaacgatcgcgttaatac

SEQ ID NO: 701936 - DNA, 25 bp, Artificial sequence
  Synthetic oligonucleotide
aaagagaccgtacgctacgccataa

SEQ ID NO: 701937 - DNA, 25 bp, Artificial sequence
  Synthetic oligonucleotide
aaagagaccgtaggctacgccataa

SEQ ID NO: 701938 - DNA, 25 bp, Artificial sequence
  Synthetic oligonucleotide
aagctgacacccctcgatactaagt

SEQ ID NO: 701939 - DNA, 25 bp, Artificial sequence
  Synthetic oligonucleotide
tatccgtcgcgttagcctattacac

SEQ ID NO: 701940 - DNA, 25 bp, Artificial sequence
  Synthetic oligonucleotide
ggtcaaatcgcgacgtataaggagt

SEQ ID NO: 701941 - DNA, 25 bp, Artificial sequence
  Synthetic oligonucleotide
tgtcccctcgattcgtcgagaattt

SEQ ID NO: 701942 - DNA, 25 bp, Artificial sequence
  Synthetic oligonucleotide
gacgattacgtctcgacgttgagaa

SEQ ID NO: 701943 - DNA, 25 bp, Artificial sequence
  Synthetic oligonucleotide
caaaacgtctcgggttatgcagttc

SEQ ID NO: 701944 - DNA, 25 bp, Artificial sequence
  Synthetic oligonucleotide
caaaacgtctcgcgttatgcagttc

SEQ ID NO: 701945 - DNA, 25 bp, Artificial sequence
  Synthetic oligonucleotide
ctaagagcgcgaatatactagggtc

SEQ ID NO: 701946 - DNA, 25 bp, Artificial sequence
  Synthetic oligonucleotide
ctaagagcgcgattatactagggtc

SEQ ID NO: 701947 - DNA, 25 bp, Artificial sequence
  Synthetic oligonucleotide
cctcatgcgtaacgggattctgata

SEQ ID NO: 701948 - DNA, 25 bp, Artificial sequence
  Synthetic oligonucleotide
cctcatgcgtaaggggattctgata

SEQ ID NO: 701949 - DNA, 25 bp, Artificial sequence
  Synthetic oligonucleotide
tccttccgtaaggacgtattcacca

SEQ ID NO: 701950 - DNA, 25 bp, Artificial sequence
  Synthetic oligonucleotide
gtaagggcggtccacgtaatttcaa

SEQ ID NO: 701951 - DNA, 25 bp, Artificial sequence
  Synthetic oligonucleotide
acatctttcgcgcgcatagttgctt

SEQ ID NO: 701952 - DNA, 25 bp, Artificial sequence
  Synthetic oligonucleotide
tgtcccctcgatacgtcgagaattt

SEQ ID NO: 701953 - DNA, 25 bp, Artificial sequence
  Synthetic oligonucleotide
ggtgattatacgaccgcaacagaac

SEQ ID NO: 701954 - DNA, 25 bp, Artificial sequence
  Synthetic oligonucleotide
ggtgattatacgtccgcaacagaac

SEQ ID NO: 701955 - DNA, 25 bp, Artificial sequence
  Synthetic oligonucleotide
cagaccccgacgagtaatgtgtaat

SEQ ID NO: 701956 - DNA, 25 bp, Artificial sequence
  Synthetic oligonucleotide
tccttccgtaagcacgtattcacca

SEQ ID NO: 701957 - DNA, 25 bp, Artificial sequence
  Synthetic oligonucleotide
aatatgacatgcaacgtcggcatgc

SEQ ID NO: 701958 - DNA, 25 bp, Artificial sequence
  Synthetic oligonucleotide
aatatgacatgctacgtcggcatgc

SEQ ID NO: 701959 - DNA, 25 bp, Artificial sequence
  Synthetic oligonucleotide
gtatctgacgatacgccgagaacat

SEQ ID NO: 701960 - DNA, 25 bp, Artificial sequence
  Synthetic oligonucleotide
gtaagggcggtcgacgtaatttcaa

SEQ ID NO: 701961 - DNA, 25 bp, Artificial sequence
  Synthetic oligonucleotide
ctctaaatggttagacgcgctacgt

SEQ ID NO: 701962 - DNA, 25 bp, Artificial sequence
  Synthetic oligonucleotide
atactgtactcgtcggtcgaacact

SEQ ID NO: 701963 - DNA, 25 bp, Artificial sequence
  Synthetic oligonucleotide
catcacgttctaaccgcgatcatga

SEQ ID NO: 701964 - DNA, 25 bp, Artificial sequence
  Synthetic oligonucleotide
tccattcgtacccttgtatggtagc

SEQ ID NO: 701965 - DNA, 25 bp, Artificial sequence
  Synthetic oligonucleotide
tccattcgtaccgttgtatggtagc

SEQ ID NO: 701966 - DNA, 25 bp, Artificial sequence
  Synthetic oligonucleotide
gattaaggttcgcgcgtaacggaaa

SEQ ID NO: 701967 - DNA, 25 bp, Artificial sequence
  Synthetic oligonucleotide
gattaaggttcgggcgtaacggaaa

SEQ ID NO: 701968 - DNA, 25 bp, Artificial sequence
  Synthetic oligonucleotide
aagtgggttagtccgcgatgtgtaa

SEQ ID NO: 701969 - DNA, 25 bp, Artificial sequence
  Synthetic oligonucleotide
aagtgggttagtgcgcgatgtgtaa

SEQ ID NO: 701970 - DNA, 25 bp, Artificial sequence
  Synthetic oligonucleotide
gacgattacgtcacgacgttgagaa

SEQ ID NO: 701971 - DNA, 25 bp, Artificial sequence
  Synthetic oligonucleotide
cggttttatcgactagcgtagagga

SEQ ID NO: 701972 - DNA, 25 bp, Artificial sequence
  Synthetic oligonucleotide
acatctttcgcgggcatagttgctt

SEQ ID NO: 701973 - DNA, 25 bp, Artificial sequence
  Synthetic oligonucleotide
ctctaaatggtttgacgcgctacgt

SEQ ID NO: 701974 - DNA, 25 bp, Artificial sequence
  Synthetic oligonucleotide
ttatattctcaaggcgcctagtggc

SEQ ID NO: 701975 - DNA, 25 bp, Artificial sequence
  Synthetic oligonucleotide
ttatattctcaacgcgcctagtggc

SEQ ID NO: 701976 - DNA, 25 bp, Artificial sequence
  Synthetic oligonucleotide
tttgattatcgccctagttctcccg

SEQ ID NO: 701977 - DNA, 25 bp, Artificial sequence
  Synthetic oligonucleotide
tttgattatcgcgctagttctcccg

SEQ ID NO: 701978 - DNA, 25 bp, Artificial sequence
  Synthetic oligonucleotide
agcgtccgatcgtacgttgattgat

SEQ ID NO: 701979 - DNA, 25 bp, Artificial sequence
  Synthetic oligonucleotide
agcgtccgatcgaacgttgattgat

SEQ ID NO: 701980 - DNA, 25 bp, Artificial sequence
  Synthetic oligonucleotide
ttacccatgtcgtatagcggaaagg

SEQ ID NO: 701981 - DNA, 25 bp, Artificial sequence
  Synthetic oligonucleotide
cggttttatcgagtagcgtagagga

SEQ ID NO: 701982 - DNA, 25 bp, Artificial sequence
  Synthetic oligonucleotide
tactgtgtatcgcgtaccaacgttg

SEQ ID NO: 701983 - DNA, 25 bp, Artificial sequence
  Synthetic oligonucleotide
gtatctgacgattcgccgagaacat

SEQ ID NO: 701984 - DNA, 25 bp, Artificial sequence
  Synthetic oligonucleotide
tatcccgtagtagttcgcgagtact

SEQ ID NO: 701985 - DNA, 25 bp, Artificial sequence
  Synthetic oligonucleotide
agataccgcggtacgtaaatactgc

SEQ ID NO: 701986 - DNA, 25 bp, Artificial sequence
  Synthetic oligonucleotide
agataccgcggttcgtaaatactgc

SEQ ID NO: 701987 - DNA, 25 bp, Artificial sequence
  Synthetic oligonucleotide
tgtgcaacggttcgctaaccgttaa

SEQ ID NO: 701988 - DNA, 25 bp, Artificial sequence
  Synthetic oligonucleotide
tgtgcaacggttggctaaccgttaa

SEQ ID NO: 701989 - DNA, 25 bp, Artificial sequence
  Synthetic oligonucleotide
cacgcacttcgacttacggatgttt

SEQ ID NO: 701990 - DNA, 25 bp, Artificial sequence
  Synthetic oligonucleotide
cacgcacttcgagttacggatgttt

SEQ ID NO: 701991 - DNA, 25 bp, Artificial sequence
  Synthetic oligonucleotide
gacacttaatcgccgtatggggaat

SEQ ID NO: 701992 - DNA, 25 bp, Artificial sequence
  Synthetic oligonucleotide
agcaacttgacgccgctatactcat

SEQ ID NO: 701993 - DNA, 25 bp, Artificial sequence
  Synthetic oligonucleotide
gacacttaatcggcgtatggggaat

SEQ ID NO: 701994 - DNA, 25 bp, Artificial sequence
  Synthetic oligonucleotide
tactgtgtatcgggtaccaacgttg

SEQ ID NO: 701995 - DNA, 25 bp, Artificial sequence
  Synthetic oligonucleotide
agatgaatcgtaggaacgcggtgaa

SEQ ID NO: 701996 - DNA, 25 bp, Artificial sequence
  Synthetic oligonucleotide
agatgaatcgtacgaacgcggtgaa

SEQ ID NO: 701997 - DNA, 25 bp, Artificial sequence
  Synthetic oligonucleotide
gcaagttgtcgaggctattaatgcc

SEQ ID NO: 701998 - DNA, 25 bp, Artificial sequence
  Synthetic oligonucleotide
gcaagttgtcgacgctattaatgcc

SEQ ID NO: 701999 - DNA, 25 bp, Artificial sequence
  Synthetic oligonucleotide
gagtttttacgccatggacgatcct

SEQ ID NO: 702000 - DNA, 25 bp, Artificial sequence
  Synthetic oligonucleotide
gagtttttacgcgatggacgatcct

SEQ ID NO: 702001 - DNA, 25 bp, Artificial sequence
  Synthetic oligonucleotide
ttcgaatatgtcgttcgcgttgcca

SEQ ID NO: 702002 - DNA, 25 bp, Artificial sequence
  Synthetic oligonucleotide
agcaacttgacggcgctatactcat

SEQ ID NO: 702003 - DNA, 25 bp, Artificial sequence
  Synthetic oligonucleotide
caccccccattataacgcgaagtat

SEQ ID NO: 702004 - DNA, 25 bp, Artificial sequence
  Synthetic oligonucleotide
ttcgaatatgtccttcgcgttgcca

SEQ ID NO: 702005 - DNA, 25 bp, Artificial sequence
  Synthetic oligonucleotide
cgcataaacgagacgtatctgcatc

SEQ ID NO: 702006 - DNA, 25 bp, Artificial sequence
  Synthetic oligonucleotide
cgcataaacgagtcgtatctgcatc

SEQ ID NO: 702007 - DNA, 25 bp, Artificial sequence
  Synthetic oligonucleotide
caaacatcgacgtctaacgggtaac

SEQ ID NO: 702008 - DNA, 25 bp, Artificial sequence
  Synthetic oligonucleotide
caaacatcgacgactaacgggtaac

SEQ ID NO: 702009 - DNA, 25 bp, Artificial sequence
  Synthetic oligonucleotide
gaatactaacgggtccgaaccgata

SEQ ID NO: 702010 - DNA, 25 bp, Artificial sequence
  Synthetic oligonucleotide
gaatactaacggctccgaaccgata

SEQ ID NO: 702011 - DNA, 25 bp, Artificial sequence
  Synthetic oligonucleotide
gtcgctgacttcccgacgttattta

SEQ ID NO: 702012 - DNA, 25 bp, Artificial sequence
  Synthetic oligonucleotide
tatcccgtagtacttcgcgagtact

SEQ ID NO: 702013 - DNA, 25 bp, Artificial sequence
  Synthetic oligonucleotide
caccccccattaaaacgcgaagtat

SEQ ID NO: 702014 - DNA, 25 bp, Artificial sequence
  Synthetic oligonucleotide
ttacccatgtcgaatagcggaaagg

SEQ ID NO: 702015 - DNA, 25 bp, Artificial sequence
  Synthetic oligonucleotide
gactatagcgcgactattggcatga

SEQ ID NO: 702016 - DNA, 25 bp, Artificial sequence
  Synthetic oligonucleotide
gactatagcgcgtctattggcatga

SEQ ID NO: 702017 - DNA, 25 bp, Artificial sequence
  Synthetic oligonucleotide
atctcaagccgagcgtaatagccat

SEQ ID NO: 702018 - DNA, 25 bp, Artificial sequence
  Synthetic oligonucleotide
atctcaagccgaccgtaatagccat

SEQ ID NO: 702019 - DNA, 25 bp, Artificial sequence
  Synthetic oligonucleotide
aaaggtcgcgtaatgaggtgacctt

SEQ ID NO: 702020 - DNA, 25 bp, Artificial sequence
  Synthetic oligonucleotide
aaaggtcgcgtattgaggtgacctt

SEQ ID NO: 702021 - DNA, 25 bp, Artificial sequence
  Synthetic oligonucleotide
tatccacggacgaactaggtaacct

SEQ ID NO: 702022 - DNA, 25 bp, Artificial sequence
  Synthetic oligonucleotide
tatccacggacgtactaggtaacct

SEQ ID NO: 702023 - DNA, 25 bp, Artificial sequence
  Synthetic oligonucleotide
gtcgctgacttcgcgacgttattta

SEQ ID NO: 702024 - DNA, 25 bp, Artificial sequence
  Synthetic oligonucleotide
actggaaccctaggaatcggttatc

SEQ ID NO: 702025 - DNA, 25 bp, Artificial sequence
  Synthetic oligonucleotide
ctacacaccgcgtaataggtgatgt

SEQ ID NO: 702026 - DNA, 25 bp, Artificial sequence
  Synthetic oligonucleotide
tgctcttactaacgcgtagccagat

SEQ ID NO: 702027 - DNA, 25 bp, Artificial sequence
  Synthetic oligonucleotide
tttctcttcgcgctcggtacatgta

SEQ ID NO: 702028 - DNA, 25 bp, Artificial sequence
  Synthetic oligonucleotide
tttctcttcgcggtcggtacatgta

SEQ ID NO: 702029 - DNA, 25 bp, Artificial sequence
  Synthetic oligonucleotide
ccatgtggtaccgcgatatctcttt

SEQ ID NO: 702030 - DNA, 25 bp, Artificial sequence
  Synthetic oligonucleotide
ccatgtggtaccccgatatctcttt

SEQ ID NO: 702031 - DNA, 25 bp, Artificial sequence
  Synthetic oligonucleotide
ggagctcgtattcgagcgttttaag

SEQ ID NO: 702032 - DNA, 25 bp, Artificial sequence
  Synthetic oligonucleotide
ggagctcgtattggagcgttttaag

SEQ ID NO: 702033 - DNA, 25 bp, Artificial sequence
  Synthetic oligonucleotide
ccaaatttgcgcggactattggaac

SEQ ID NO: 702034 - DNA, 25 bp, Artificial sequence
  Synthetic oligonucleotide
ccaaatttgcgccgactattggaac

SEQ ID NO: 702035 - DNA, 25 bp, Artificial sequence
  Synthetic oligonucleotide
atagtgatacgtcgttcggtggtgt

SEQ ID NO: 702036 - DNA, 25 bp, Artificial sequence
  Synthetic oligonucleotide
atagtgatacgtggttcggtggtgt

SEQ ID NO: 702037 - DNA, 25 bp, Artificial sequence
  Synthetic oligonucleotide
acaacacgttattcgcgatcccatg

SEQ ID NO: 702038 - DNA, 25 bp, Artificial sequence
  Synthetic oligonucleotide
taattttcgcgggaggtaaaggctc

SEQ ID NO: 702039 - DNA, 25 bp, Artificial sequence
  Synthetic oligonucleotide
acaacacgttatacgcgatcccatg

SEQ ID NO: 702040 - DNA, 25 bp, Artificial sequence
  Synthetic oligonucleotide
actggaaccctacgaatcggttatc

SEQ ID NO: 702041 - DNA, 25 bp, Artificial sequence
  Synthetic oligonucleotide
gtgtatgtgcgttatgtcgccagat

SEQ ID NO: 702042 - DNA, 25 bp, Artificial sequence
  Synthetic oligonucleotide
gtgtatgtgcgtaatgtcgccagat

SEQ ID NO: 702043 - DNA, 25 bp, Artificial sequence
  Synthetic oligonucleotide
gctagactaagtcgcgcatagagaa

SEQ ID NO: 702044 - DNA, 25 bp, Artificial sequence
  Synthetic oligonucleotide
gctagactaagtggcgcatagagaa

SEQ ID NO: 702045 - DNA, 25 bp, Artificial sequence
  Synthetic oligonucleotide
cctactatatacctcgccttcgaca

SEQ ID NO: 702046 - DNA, 25 bp, Artificial sequence
  Synthetic oligonucleotide
cctactatatacgtcgccttcgaca

SEQ ID NO: 702047 - DNA, 25 bp, Artificial sequence
  Synthetic oligonucleotide
gtaactttaacgggcgtactgtcac

SEQ ID NO: 702048 - DNA, 25 bp, Artificial sequence
  Synthetic oligonucleotide
gtaactttaacgcgcgtactgtcac

SEQ ID NO: 702049 - DNA, 25 bp, Artificial sequence
  Synthetic oligonucleotide
acactctcgtacctcggctgaatat

SEQ ID NO: 702050 - DNA, 25 bp, Artificial sequence
  Synthetic oligonucleotide
acactctcgtacgtcggctgaatat

SEQ ID NO: 702051 - DNA, 25 bp, Artificial sequence
  Synthetic oligonucleotide
agcttagtacaagcggtcgctttct

SEQ ID NO: 702052 - DNA, 25 bp, Artificial sequence
  Synthetic oligonucleotide
taattttcgcggcaggtaaaggctc

SEQ ID NO: 702053 - DNA, 25 bp, Artificial sequence
  Synthetic oligonucleotide
gactgctataatcgacccgtctgaa

SEQ ID NO: 702054 - DNA, 25 bp, Artificial sequence
  Synthetic oligonucleotide
ctacacaccgcgaaataggtgatgt

SEQ ID NO: 702055 - DNA, 25 bp, Artificial sequence
  Synthetic oligonucleotide
gcaactggtatttacgccgtatggt

SEQ ID NO: 702056 - DNA, 25 bp, Artificial sequence
  Synthetic oligonucleotide
gcaactggtattaacgccgtatggt

SEQ ID NO: 702057 - DNA, 25 bp, Artificial sequence
  Synthetic oligonucleotide
tgttctaacgtagcgctcgcatcta

SEQ ID NO: 702058 - DNA, 25 bp, Artificial sequence
  Synthetic oligonucleotide
tgttctaacgtaccgctcgcatcta

SEQ ID NO: 702059 - DNA, 25 bp, Artificial sequence
  Synthetic oligonucleotide
ttgagatcacgaggcgatattctcc

SEQ ID NO: 702060 - DNA, 25 bp, Artificial sequence
  Synthetic oligonucleotide
ttgagatcacgacgcgatattctcc

SEQ ID NO: 702061 - DNA, 25 bp, Artificial sequence
  Synthetic oligonucleotide
cagttacgctcgacgtatgttgtca

SEQ ID NO: 702062 - DNA, 25 bp, Artificial sequence
  Synthetic oligonucleotide
cagttacgctcgtcgtatgttgtca

SEQ ID NO: 702063 - DNA, 25 bp, Artificial sequence
  Synthetic oligonucleotide
agatcacgcgccgtaatgatgtcta

SEQ ID NO: 702064 - DNA, 25 bp, Artificial sequence
  Synthetic oligonucleotide
agatcacgcgccctaatgatgtcta

SEQ ID NO: 702065 - DNA, 25 bp, Artificial sequence
  Synthetic oligonucleotide
aggattggttcgaaccgtaacgatg

SEQ ID NO: 702066 - DNA, 25 bp, Artificial sequence
  Synthetic oligonucleotide
tgctcttactaaggcgtagccagat

SEQ ID NO: 702067 - DNA, 25 bp, Artificial sequence
  Synthetic oligonucleotide
gactgctataatggacccgtctgaa

SEQ ID NO: 702068 - DNA, 25 bp, Artificial sequence
  Synthetic oligonucleotide
aaaatatagcgcccaacgaccttcc

SEQ ID NO: 702069 - DNA, 25 bp, Artificial sequence
  Synthetic oligonucleotide
agattaatcccgctcgatcctgcta

SEQ ID NO: 702070 - DNA, 25 bp, Artificial sequence
  Synthetic oligonucleotide
agattaatcccggtcgatcctgcta

SEQ ID NO: 702071 - DNA, 25 bp, Artificial sequence
  Synthetic oligonucleotide
gaatgccggtaacgtcgtacatcta

SEQ ID NO: 702072 - DNA, 25 bp, Artificial sequence
  Synthetic oligonucleotide
gaatgccggtaaggtcgtacatcta

SEQ ID NO: 702073 - DNA, 25 bp, Artificial sequence
  Synthetic oligonucleotide
ggctttcgtctactaacggttcagt

SEQ ID NO: 702074 - DNA, 25 bp, Artificial sequence
  Synthetic oligonucleotide
ggctttcgtctagtaacggttcagt

SEQ ID NO: 702075 - DNA, 25 bp, Artificial sequence
  Synthetic oligonucleotide
ttcagcacgtacgatacgccgtata

SEQ ID NO: 702076 - DNA, 25 bp, Artificial sequence
  Synthetic oligonucleotide
ttcagcacgtaccatacgccgtata

SEQ ID NO: 702077 - DNA, 25 bp, Artificial sequence
  Synthetic oligonucleotide
tgaagcatgtaatacgccggatagg

SEQ ID NO: 702078 - DNA, 25 bp, Artificial sequence
  Synthetic oligonucleotide
tgaagcatgtaaaacgccggatagg

SEQ ID NO: 702079 - DNA, 25 bp, Artificial sequence
  Synthetic oligonucleotide
gactaacgatacccaaggtttccac

SEQ ID NO: 702080 - DNA, 25 bp, Artificial sequence
  Synthetic oligonucleotide
gactaacgatacgcaaggtttccac

SEQ ID NO: 702081 - DNA, 25 bp, Artificial sequence
  Synthetic oligonucleotide
aggattggttcgtaccgtaacgatg

SEQ ID NO: 702082 - DNA, 25 bp, Artificial sequence
  Synthetic oligonucleotide
ggtgttcgaataaacggcgaacgaa

SEQ ID NO: 702083 - DNA, 25 bp, Artificial sequence
  Synthetic oligonucleotide
tggagctgcgtaagtcgacaaatga

SEQ ID NO: 702084 - DNA, 25 bp, Artificial sequence
  Synthetic oligonucleotide
tggagctgcgtatgtcgacaaatga

SEQ ID NO: 702085 - DNA, 25 bp, Artificial sequence
  Synthetic oligonucleotide
gtacgtcgttcgacgaactctgttt

SEQ ID NO: 702086 - DNA, 25 bp, Artificial sequence
  Synthetic oligonucleotide
gtacgtcgttcgtcgaactctgttt

SEQ ID NO: 702087 - DNA, 25 bp, Artificial sequence
  Synthetic oligonucleotide
tactcggtacgatagacgcgttatg

SEQ ID NO: 702088 - DNA, 25 bp, Artificial sequence
  Synthetic oligonucleotide
tactcggtacgaaagacgcgttatg

SEQ ID NO: 702089 - DNA, 25 bp, Artificial sequence
  Synthetic oligonucleotide
acttgttcgcgtaacggatcgaact

SEQ ID NO: 702090 - DNA, 25 bp, Artificial sequence
  Synthetic oligonucleotide
acttgttcgcgttacggatcgaact

SEQ ID NO: 702091 - DNA, 25 bp, Artificial sequence
  Synthetic oligonucleotide
agagtctaagacgtcgcgaattgtg

SEQ ID NO: 702092 - DNA, 25 bp, Artificial sequence
  Synthetic oligonucleotide
agagtctaagacctcgcgaattgtg

SEQ ID NO: 702093 - DNA, 25 bp, Artificial sequence
  Synthetic oligonucleotide
tgacctacgcatcgcgtaatgaaga

SEQ ID NO: 702094 - DNA, 25 bp, Artificial sequence
  Synthetic oligonucleotide
ccatatcgcgcgtatcaacacaaca

SEQ ID NO: 702095 - DNA, 25 bp, Artificial sequence
  Synthetic oligonucleotide
agcttagtacaaccggtcgctttct

SEQ ID NO: 702096 - DNA, 25 bp, Artificial sequence
  Synthetic oligonucleotide
ggtgttcgaatatacggcgaacgaa

SEQ ID NO: 702097 - DNA, 25 bp, Artificial sequence
  Synthetic oligonucleotide
caagtggttacgttcggtcagttag

SEQ ID NO: 702098 - DNA, 25 bp, Artificial sequence
  Synthetic oligonucleotide
agaatgttagggagacgcgtctatc

SEQ ID NO: 702099 - DNA, 25 bp, Artificial sequence
  Synthetic oligonucleotide
agaatgttagggtgacgcgtctatc

SEQ ID NO: 702100 - DNA, 25 bp, Artificial sequence
  Synthetic oligonucleotide
cctatagaccgtgtagcgttgatgt

SEQ ID NO: 702101 - DNA, 25 bp, Artificial sequence
  Synthetic oligonucleotide
cctatagaccgtctagcgttgatgt

SEQ ID NO: 702102 - DNA, 25 bp, Artificial sequence
  Synthetic oligonucleotide
acccctgatcgacgttacactaaac

SEQ ID NO: 702103 - DNA, 25 bp, Artificial sequence
  Synthetic oligonucleotide
acccctgatcgaggttacactaaac

SEQ ID NO: 702104 - DNA, 25 bp, Artificial sequence
  Synthetic oligonucleotide
gagagagggtataccgtcgataaca

SEQ ID NO: 702105 - DNA, 25 bp, Artificial sequence
  Synthetic oligonucleotide
gagagagggtattccgtcgataaca

SEQ ID NO: 702106 - DNA, 25 bp, Artificial sequence
  Synthetic oligonucleotide
tagttttcgcaagcgacccagaaac

SEQ ID NO: 702107 - DNA, 25 bp, Artificial sequence
  Synthetic oligonucleotide
tagttttcgcaaccgacccagaaac

SEQ ID NO: 702108 - DNA, 25 bp, Artificial sequence
  Synthetic oligonucleotide
tgacctacgcatggcgtaatgaaga

SEQ ID NO: 702109 - DNA, 25 bp, Artificial sequence
  Synthetic oligonucleotide
cgagccgtacgatcgtatgattgaa

SEQ ID NO: 702110 - DNA, 25 bp, Artificial sequence
  Synthetic oligonucleotide
attcacagtcgtaccgtagcagcaa

SEQ ID NO: 702111 - DNA, 25 bp, Artificial sequence
  Synthetic oligonucleotide
ccgaaacgcatacgttcgaatatgg

SEQ ID NO: 702112 - DNA, 25 bp, Artificial sequence
  Synthetic oligonucleotide
cgaattcgctcgaatagtgtatcgg

SEQ ID NO: 702113 - DNA, 25 bp, Artificial sequence
  Synthetic oligonucleotide
attcacagtcgttccgtagcagcaa

SEQ ID NO: 702114 - DNA, 25 bp, Artificial sequence
  Synthetic oligonucleotide
cgctaatatcgcgtacgttttccga

SEQ ID NO: 702115 - DNA, 25 bp, Artificial sequence
  Synthetic oligonucleotide
cgctaatatcgcctacgttttccga

SEQ ID NO: 702116 - DNA, 25 bp, Artificial sequence
  Synthetic oligonucleotide
agactgtacgaccgtgtcgataatg

SEQ ID NO: 702117 - DNA, 25 bp, Artificial sequence
  Synthetic oligonucleotide
agactgtacgacggtgtcgataatg

SEQ ID NO: 702118 - DNA, 25 bp, Artificial sequence
  Synthetic oligonucleotide
gagggattcggcggtacgataattt

SEQ ID NO: 702119 - DNA, 25 bp, Artificial sequence
  Synthetic oligonucleotide
gagggattcggccgtacgataattt

SEQ ID NO: 702120 - DNA, 25 bp, Artificial sequence
  Synthetic oligonucleotide
gtggtatatacgaccgacaaagcca

SEQ ID NO: 702121 - DNA, 25 bp, Artificial sequence
  Synthetic oligonucleotide
gtggtatatacgtccgacaaagcca

SEQ ID NO: 702122 - DNA, 25 bp, Artificial sequence
  Synthetic oligonucleotide
ttgcaggactatacgacgcttagga

SEQ ID NO: 702123 - DNA, 25 bp, Artificial sequence
  Synthetic oligonucleotide
ttgcaggactattcgacgcttagga

SEQ ID NO: 702124 - DNA, 25 bp, Artificial sequence
  Synthetic oligonucleotide
cagacagtaacgcacgtactttgtg

SEQ ID NO: 702125 - DNA, 25 bp, Artificial sequence
  Synthetic oligonucleotide
cgaatacaatcgcgtagcgtatgct

SEQ ID NO: 702126 - DNA, 25 bp, Artificial sequence
  Synthetic oligonucleotide
cgaattcgctcgtatagtgtatcgg

SEQ ID NO: 702127 - DNA, 25 bp, Artificial sequence
  Synthetic oligonucleotide
ccgaaacgcataggttcgaatatgg

SEQ ID NO: 702128 - DNA, 25 bp, Artificial sequence
  Synthetic oligonucleotide
tacttaagtcgcgaacattcgccgt

SEQ ID NO: 702129 - DNA, 25 bp, Artificial sequence
  Synthetic oligonucleotide
tacttaagtcgccaacattcgccgt

SEQ ID NO: 702130 - DNA, 25 bp, Artificial sequence
  Synthetic oligonucleotide
taccagcgcgatttgtacgtacgat

SEQ ID NO: 702131 - DNA, 25 bp, Artificial sequence
  Synthetic oligonucleotide
taccagcgcgatatgtacgtacgat

SEQ ID NO: 702132 - DNA, 25 bp, Artificial sequence
  Synthetic oligonucleotide
tggacttcgcgtggtaatgccaaat

SEQ ID NO: 702133 - DNA, 25 bp, Artificial sequence
  Synthetic oligonucleotide
tggacttcgcgtcgtaatgccaaat

SEQ ID NO: 702134 - DNA, 25 bp, Artificial sequence
  Synthetic oligonucleotide
ctatagacgtcgtatcggtccacat

SEQ ID NO: 702135 - DNA, 25 bp, Artificial sequence
  Synthetic oligonucleotide
ctatagacgtcgaatcggtccacat

SEQ ID NO: 702136 - DNA, 25 bp, Artificial sequence
  Synthetic oligonucleotide
gacgttgtcctacgcgaatttctct

SEQ ID NO: 702137 - DNA, 25 bp, Artificial sequence
  Synthetic oligonucleotide
gacgttgtcctaggcgaatttctct

SEQ ID NO: 702138 - DNA, 25 bp, Artificial sequence
  Synthetic oligonucleotide
caagtggttacgatcggtcagttag

SEQ ID NO: 702139 - DNA, 25 bp, Artificial sequence
  Synthetic oligonucleotide
aaaatatagcgcgcaacgaccttcc

SEQ ID NO: 702140 - DNA, 25 bp, Artificial sequence
  Synthetic oligonucleotide
cgaatacaatcgggtagcgtatgct

SEQ ID NO: 702141 - DNA, 25 bp, Artificial sequence
  Synthetic oligonucleotide
atcctgtcggacatacgtctagatg

SEQ ID NO: 702142 - DNA, 25 bp, Artificial sequence
  Synthetic oligonucleotide
ctcggtgcgtaaacgactaacatct

SEQ ID NO: 702143 - DNA, 25 bp, Artificial sequence
  Synthetic oligonucleotide
ctcggtgcgtaatcgactaacatct

SEQ ID NO: 702144 - DNA, 25 bp, Artificial sequence
  Synthetic oligonucleotide
tgtgtcgtcgtatcgtacgtttcct

SEQ ID NO: 702145 - DNA, 25 bp, Artificial sequence
  Synthetic oligonucleotide
tgtgtcgtcgtaacgtacgtttcct

SEQ ID NO: 702146 - DNA, 25 bp, Artificial sequence
  Synthetic oligonucleotide
caaaatcgtcgtttaaggccgagac

SEQ ID NO: 702147 - DNA, 25 bp, Artificial sequence
  Synthetic oligonucleotide
caaaatcgtcgtataaggccgagac

SEQ ID NO: 702148 - DNA, 25 bp, Artificial sequence
  Synthetic oligonucleotide
gttactcgtaactcgacgtggcaaa

SEQ ID NO: 702149 - DNA, 25 bp, Artificial sequence
  Synthetic oligonucleotide
gttactcgtaacacgacgtggcaaa

SEQ ID NO: 702150 - DNA, 25 bp, Artificial sequence
  Synthetic oligonucleotide
cttttggaaatttcgcgcgagatcg

SEQ ID NO: 702151 - DNA, 25 bp, Artificial sequence
  Synthetic oligonucleotide
tgtgtagcgagagtatcgtctttgg

SEQ ID NO: 702152 - DNA, 25 bp, Artificial sequence
  Synthetic oligonucleotide
cgagtttgtatcggaccgcttgtat

SEQ ID NO: 702153 - DNA, 25 bp, Artificial sequence
  Synthetic oligonucleotide
ttgccctacggcctagtacctatat

SEQ ID NO: 702154 - DNA, 25 bp, Artificial sequence
  Synthetic oligonucleotide
tcgaaacgacggacgtcaaacaagt

SEQ ID NO: 702155 - DNA, 25 bp, Artificial sequence
  Synthetic oligonucleotide
atcctgtcggacttacgtctagatg

SEQ ID NO: 702156 - DNA, 25 bp, Artificial sequence
  Synthetic oligonucleotide
tgtacttaacggatcgcgtcaagtg

SEQ ID NO: 702157 - DNA, 25 bp, Artificial sequence
  Synthetic oligonucleotide
taagtctacgccgaaacgctcatga

SEQ ID NO: 702158 - DNA, 25 bp, Artificial sequence
  Synthetic oligonucleotide
taagtctacgcccaaacgctcatga

SEQ ID NO: 702159 - DNA, 25 bp, Artificial sequence
  Synthetic oligonucleotide
tgtgtagactatgttcgcgcgacat

SEQ ID NO: 702160 - DNA, 25 bp, Artificial sequence
  Synthetic oligonucleotide
tgtgtagactatcttcgcgcgacat

SEQ ID NO: 702161 - DNA, 25 bp, Artificial sequence
  Synthetic oligonucleotide
cctaaacgataccgtcgtatcatcg

SEQ ID NO: 702162 - DNA, 25 bp, Artificial sequence
  Synthetic oligonucleotide
cctaaacgatacggtcgtatcatcg

SEQ ID NO: 702163 - DNA, 25 bp, Artificial sequence
  Synthetic oligonucleotide
taggttcgcgtcctaccttttgtct

SEQ ID NO: 702164 - DNA, 25 bp, Artificial sequence
  Synthetic oligonucleotide
taggttcgcgtcgtaccttttgtct

SEQ ID NO: 702165 - DNA, 25 bp, Artificial sequence
  Synthetic oligonucleotide
cctactcgtatcgacacgataggta

SEQ ID NO: 702166 - DNA, 25 bp, Artificial sequence
  Synthetic oligonucleotide
cctactcgtatccacacgataggta

SEQ ID NO: 702167 - DNA, 25 bp, Artificial sequence
  Synthetic oligonucleotide
accagagagcgtcgacaatatcagt

SEQ ID NO: 702168 - DNA, 25 bp, Artificial sequence
  Synthetic oligonucleotide
accagagagcgtggacaatatcagt

SEQ ID NO: 702169 - DNA, 25 bp, Artificial sequence
  Synthetic oligonucleotide
ttgccctacggcgtagtacctatat

SEQ ID NO: 702170 - DNA, 25 bp, Artificial sequence
  Synthetic oligonucleotide
tcagtggtccggggtataagttaca

SEQ ID NO: 702171 - DNA, 25 bp, Artificial sequence
  Synthetic oligonucleotide
cagacagtaacggacgtactttgtg

SEQ ID NO: 702172 - DNA, 25 bp, Artificial sequence
  Synthetic oligonucleotide
gtttacacgcgcgaactatgcgaaa

SEQ ID NO: 702173 - DNA, 25 bp, Artificial sequence
  Synthetic oligonucleotide
cgagtttgtatccgaccgcttgtat

SEQ ID NO: 702174 - DNA, 25 bp, Artificial sequence
  Synthetic oligonucleotide
cacgaagacgccctacttatgaact

SEQ ID NO: 702175 - DNA, 25 bp, Artificial sequence
  Synthetic oligonucleotide
cacgaagacgccgtacttatgaact

SEQ ID NO: 702176 - DNA, 25 bp, Artificial sequence
  Synthetic oligonucleotide
ttacaatatcgcgcatcgttcgacg

SEQ ID NO: 702177 - DNA, 25 bp, Artificial sequence
  Synthetic oligonucleotide
ttacaatatcgcccatcgttcgacg

SEQ ID NO: 702178 - DNA, 25 bp, Artificial sequence
  Synthetic oligonucleotide
atacgattcgcgcatggataacgtg

SEQ ID NO: 702179 - DNA, 25 bp, Artificial sequence
  Synthetic oligonucleotide
atacgattcgcggatggataacgtg

SEQ ID NO: 702180 - DNA, 25 bp, Artificial sequence
  Synthetic oligonucleotide
gtccaacgttcgacggtatactcat

SEQ ID NO: 702181 - DNA, 25 bp, Artificial sequence
  Synthetic oligonucleotide
gtccaacgttcgtcggtatactcat

SEQ ID NO: 702182 - DNA, 25 bp, Artificial sequence
  Synthetic oligonucleotide
atgtttgtctcgggttaaggaccgt

SEQ ID NO: 702183 - DNA, 25 bp, Artificial sequence
  Synthetic oligonucleotide
gaaagaactacgttacgccaacctg

SEQ ID NO: 702184 - DNA, 25 bp, Artificial sequence
  Synthetic oligonucleotide
tcagtggtccggcgtataagttaca

SEQ ID NO: 702185 - DNA, 25 bp, Artificial sequence
  Synthetic oligonucleotide
gaaagaactacgatacgccaacctg

SEQ ID NO: 702186 - DNA, 25 bp, Artificial sequence
  Synthetic oligonucleotide
cgacaactcgtaacgggtataactc

SEQ ID NO: 702187 - DNA, 25 bp, Artificial sequence
  Synthetic oligonucleotide
cgacaactcgtatcgggtataactc

SEQ ID NO: 702188 - DNA, 25 bp, Artificial sequence
  Synthetic oligonucleotide
cgagccgtacgaacgtatgattgaa

SEQ ID NO: 702189 - DNA, 25 bp, Artificial sequence
  Synthetic oligonucleotide
tgcttctcggcgcgatttaatacac

SEQ ID NO: 702190 - DNA, 25 bp, Artificial sequence
  Synthetic oligonucleotide
tgcttctcggcgggatttaatacac

SEQ ID NO: 702191 - DNA, 25 bp, Artificial sequence
  Synthetic oligonucleotide
atagagcgctagttcgcccttgaaa

SEQ ID NO: 702192 - DNA, 25 bp, Artificial sequence
  Synthetic oligonucleotide
atagagcgctagatcgcccttgaaa

SEQ ID NO: 702193 - DNA, 25 bp, Artificial sequence
  Synthetic oligonucleotide
gcgtaactattagtcgcgggaagtt

SEQ ID NO: 702194 - DNA, 25 bp, Artificial sequence
  Synthetic oligonucleotide
gcgtaactattactcgcgggaagtt

SEQ ID NO: 702195 - DNA, 25 bp, Artificial sequence
  Synthetic oligonucleotide
gaggtattacgcctagggaagaagt

SEQ ID NO: 702196 - DNA, 25 bp, Artificial sequence
  Synthetic oligonucleotide
gaggtattacgcgtagggaagaagt

SEQ ID NO: 702197 - DNA, 25 bp, Artificial sequence
  Synthetic oligonucleotide
tgtacttaacggttcgcgtcaagtg

SEQ ID NO: 702198 - DNA, 25 bp, Artificial sequence
  Synthetic oligonucleotide
tgtgtagcgagactatcgtctttgg

SEQ ID NO: 702199 - DNA, 25 bp, Artificial sequence
  Synthetic oligonucleotide
atgtttgtctcgcgttaaggaccgt

SEQ ID NO: 702200 - DNA, 25 bp, Artificial sequence
  Synthetic oligonucleotide
tagaacgcgcgttcaatcaggcatt

SEQ ID NO: 702201 - DNA, 25 bp, Artificial sequence
  Synthetic oligonucleotide
tccgatgtcgcgttaatacccacat

SEQ ID NO: 702202 - DNA, 25 bp, Artificial sequence
  Synthetic oligonucleotide
gaacagagaacgggacgtacaattc

SEQ ID NO: 702203 - DNA, 25 bp, Artificial sequence
  Synthetic oligonucleotide
gaacagagaacgcgacgtacaattc

SEQ ID NO: 702204 - DNA, 25 bp, Artificial sequence
  Synthetic oligonucleotide
tgaacaggttacccgtaacctgcat

SEQ ID NO: 702205 - DNA, 25 bp, Artificial sequence
  Synthetic oligonucleotide
tgaacaggttacgcgtaacctgcat

SEQ ID NO: 702206 - DNA, 25 bp, Artificial sequence
  Synthetic oligonucleotide
ttgcatccgcacaacgtacagttct

SEQ ID NO: 702207 - DNA, 25 bp, Artificial sequence
  Synthetic oligonucleotide
ttgcatccgcactacgtacagttct

SEQ ID NO: 702208 - DNA, 25 bp, Artificial sequence
  Synthetic oligonucleotide
gttcttgcgtcgtatacgaaaggca

SEQ ID NO: 702209 - DNA, 25 bp, Artificial sequence
  Synthetic oligonucleotide
gtttacacgcgccaactatgcgaaa

SEQ ID NO: 702210 - DNA, 25 bp, Artificial sequence
  Synthetic oligonucleotide
cacgtatcgcaacgtatacgaatcc

SEQ ID NO: 702211 - DNA, 25 bp, Artificial sequence
  Synthetic oligonucleotide
tcgaaacgacggtcgtcaaacaagt

SEQ ID NO: 702212 - DNA, 25 bp, Artificial sequence
  Synthetic oligonucleotide
cacgtatcgcaaggtatacgaatcc

SEQ ID NO: 702213 - DNA, 25 bp, Artificial sequence
  Synthetic oligonucleotide
tcgcagtcgtaacggactaccttaa

SEQ ID NO: 702214 - DNA, 25 bp, Artificial sequence
  Synthetic oligonucleotide
tagaacgcgcgtacaatcaggcatt

SEQ ID NO: 702215 - DNA, 25 bp, Artificial sequence
  Synthetic oligonucleotide
tcgcagtcgtaagggactaccttaa

SEQ ID NO: 702216 - DNA, 25 bp, Artificial sequence
  Synthetic oligonucleotide
gttatccgcgatggaacgaatctgt

SEQ ID NO: 702217 - DNA, 25 bp, Artificial sequence
  Synthetic oligonucleotide
gttatccgcgatcgaacgaatctgt

SEQ ID NO: 702218 - DNA, 25 bp, Artificial sequence
  Synthetic oligonucleotide
taatatattcgccgcgactgaccag

SEQ ID NO: 702219 - DNA, 25 bp, Artificial sequence
  Synthetic oligonucleotide
taatatattcgcggcgactgaccag

SEQ ID NO: 702220 - DNA, 25 bp, Artificial sequence
  Synthetic oligonucleotide
atagcatagcgctacgagacatggt

SEQ ID NO: 702221 - DNA, 25 bp, Artificial sequence
  Synthetic oligonucleotide
atagcatagcgcaacgagacatggt

SEQ ID NO: 702222 - DNA, 25 bp, Artificial sequence
  Synthetic oligonucleotide
caatgctagccgacgctaaattctg

SEQ ID NO: 702223 - DNA, 25 bp, Artificial sequence
  Synthetic oligonucleotide
caatgctagccgtcgctaaattctg

SEQ ID NO: 702224 - DNA, 25 bp, Artificial sequence
  Synthetic oligonucleotide
ccttaggtacgttacgcgtgacata

SEQ ID NO: 702225 - DNA, 25 bp, Artificial sequence
  Synthetic oligonucleotide
ccttaggtacgtaacgcgtgacata

SEQ ID NO: 702226 - DNA, 25 bp, Artificial sequence
  Synthetic oligonucleotide
aggcagcggtcgggttatatatgaa

SEQ ID NO: 702227 - DNA, 25 bp, Artificial sequence
  Synthetic oligonucleotide
aggcagcggtcgcgttatatatgaa

SEQ ID NO: 702228 - DNA, 25 bp, Artificial sequence
  Synthetic oligonucleotide
gttcttgcgtcgaatacgaaaggca

SEQ ID NO: 702229 - DNA, 25 bp, Artificial sequence
  Synthetic oligonucleotide
cttttggaaattacgcgcgagatcg

SEQ ID NO: 702230 - DNA, 25 bp, Artificial sequence
  Synthetic oligonucleotide
tattttcgtaccgaagcgtggcaga

SEQ ID NO: 702231 - DNA, 25 bp, Artificial sequence
  Synthetic oligonucleotide
taacttcgcatcccgtagtcttagg

SEQ ID NO: 702232 - DNA, 25 bp, Artificial sequence
  Synthetic oligonucleotide
tccgatgtcgcgataatacccacat

SEQ ID NO: 702233 - DNA, 25 bp, Artificial sequence
  Synthetic oligonucleotide
aagtccctagtacacgcgagagtat

SEQ ID NO: 702234 - DNA, 25 bp, Artificial sequence
  Synthetic oligonucleotide
aagtccctagtagacgcgagagtat

SEQ ID NO: 702235 - DNA, 25 bp, Artificial sequence
  Synthetic oligonucleotide
gatagaatacgtcacgcggctactt

SEQ ID NO: 702236 - DNA, 25 bp, Artificial sequence
  Synthetic oligonucleotide
gatagaatacgtgacgcggctactt

SEQ ID NO: 702237 - DNA, 25 bp, Artificial sequence
  Synthetic oligonucleotide
aattcgccgtagggcattactacct

SEQ ID NO: 702238 - DNA, 25 bp, Artificial sequence
  Synthetic oligonucleotide
catcatcttatcccgttgatacgcc

SEQ ID NO: 702239 - DNA, 25 bp, Artificial sequence
  Synthetic oligonucleotide
taacttcgcatcgcgtagtcttagg

SEQ ID NO: 702240 - DNA, 25 bp, Artificial sequence
  Synthetic oligonucleotide
tattttcgtacccaagcgtggcaga

SEQ ID NO: 702241 - DNA, 25 bp, Artificial sequence
  Synthetic oligonucleotide
atcgcccgataccgtacgtttatag

SEQ ID NO: 702242 - DNA, 25 bp, Artificial sequence
  Synthetic oligonucleotide
atcgcccgatacggtacgtttatag

SEQ ID NO: 702243 - DNA, 25 bp, Artificial sequence
  Synthetic oligonucleotide
gtattctaccggtcgactgtgcaaa

SEQ ID NO: 702244 - DNA, 25 bp, Artificial sequence
  Synthetic oligonucleotide
gtattctaccggacgactgtgcaaa

SEQ ID NO: 702245 - DNA, 25 bp, Artificial sequence
  Synthetic oligonucleotide
acacgtgtagcgtttcgcgaataac

SEQ ID NO: 702246 - DNA, 25 bp, Artificial sequence
  Synthetic oligonucleotide
acacgtgtagcgattcgcgaataac

SEQ ID NO: 702247 - DNA, 25 bp, Artificial sequence
  Synthetic oligonucleotide
catcatcttatcgcgttgatacgcc

SEQ ID NO: 702248 - DNA, 25 bp, Artificial sequence
  Synthetic oligonucleotide
gtctatcgtacgccactatatgtgc

SEQ ID NO: 702249 - DNA, 25 bp, Artificial sequence
  Synthetic oligonucleotide
aattcgccgtagcgcattactacct

SEQ ID NO: 702250 - DNA, 25 bp, Artificial sequence
  Synthetic oligonucleotide
catcacgttctatccgcgatcatga

SEQ ID NO: 702251 - DNA, 25 bp, Artificial sequence
  Synthetic oligonucleotide
ttttcacgaaccccgagtaatctgg

SEQ ID NO: 702252 - DNA, 25 bp, Artificial sequence
  Synthetic oligonucleotide
ccatatcgcgcgaatcaacacaaca

SEQ ID NO: 702253 - DNA, 25 bp, Artificial sequence
  Synthetic oligonucleotide
cattctacgtcgtaccatctatggc

SEQ ID NO: 702254 - DNA, 25 bp, Artificial sequence
  Synthetic oligonucleotide
cattctacgtcgaaccatctatggc

SEQ ID NO: 702255 - DNA, 25 bp, Artificial sequence
  Synthetic oligonucleotide
gctgttaagcgaacgacgtcataac

SEQ ID NO: 702256 - DNA, 25 bp, Artificial sequence
  Synthetic oligonucleotide
gctgttaagcgatcgacgtcataac

SEQ ID NO: 702257 - DNA, 25 bp, Artificial sequence
  Synthetic oligonucleotide
ttttcacgaaccgcgagtaatctgg

SEQ ID NO: 702258 - DNA, 25 bp, Artificial sequence
  Synthetic oligonucleotide
gtctatcgtacggcactatatgtgc

SEQ ID NO: 702259 - DNA, 25 bp, Artificial sequence
  Synthetic oligonucleotide
cgtaagcgtataggaggtcaccgat

SEQ ID NO: 702260 - DNA, 25 bp, Artificial sequence
  Synthetic oligonucleotide
gtcagaaggcctagcgcgattatac

SEQ ID NO: 702261 - DNA, 25 bp, Artificial sequence
  Synthetic oligonucleotide
agaacgaatagcgcgcgtagacgaa

SEQ ID NO: 702262 - DNA, 25 bp, Artificial sequence
  Synthetic oligonucleotide
cgttatatacgcccgatacacgcca

SEQ ID NO: 702263 - DNA, 25 bp, Artificial sequence
  Synthetic oligonucleotide
ctggttcgagcgtagtacgtgattc

SEQ ID NO: 702264 - DNA, 25 bp, Artificial sequence
  Synthetic oligonucleotide
gtcagaaggccttgcgcgattatac

SEQ ID NO: 702265 - DNA, 25 bp, Artificial sequence
  Synthetic oligonucleotide
cgtaagcgtatacgaggtcaccgat

SEQ ID NO: 702266 - DNA, 25 bp, Artificial sequence
  Synthetic oligonucleotide
agaacgaatagcccgcgtagacgaa

SEQ ID NO: 702267 - DNA, 25 bp, Artificial sequence
  Synthetic oligonucleotide
cgttatatacgcgcgatacacgcca

SEQ ID NO: 702268 - DNA, 25 bp, Artificial sequence
  Synthetic oligonucleotide
tgggagtaagtcacgtccgagatct

SEQ ID NO: 702269 - DNA, 25 bp, Artificial sequence
  Synthetic oligonucleotide
cccattaggatcgcgtaccaggtaa

SEQ ID NO: 702270 - DNA, 25 bp, Artificial sequence
  Synthetic oligonucleotide
gtgaagccgttaaagtacgggtcag

SEQ ID NO: 702271 - DNA, 25 bp, Artificial sequence
  Synthetic oligonucleotide
gtatttacgtcggacgactgctacg

SEQ ID NO: 702272 - DNA, 25 bp, Artificial sequence
  Synthetic oligonucleotide
gtatttacgtcgcacgactgctacg

SEQ ID NO: 702273 - DNA, 25 bp, Artificial sequence
  Synthetic oligonucleotide
ttagtttcgcgaaaaccgccgctac

SEQ ID NO: 702274 - DNA, 25 bp, Artificial sequence
  Synthetic oligonucleotide
ttagtttcgcgataaccgccgctac

SEQ ID NO: 702275 - DNA, 25 bp, Artificial sequence
  Synthetic oligonucleotide
ctggttcgagcgaagtacgtgattc

SEQ ID NO: 702276 - DNA, 25 bp, Artificial sequence
  Synthetic oligonucleotide
ggccaggcgtattacggccataaaa

SEQ ID NO: 702277 - DNA, 25 bp, Artificial sequence
  Synthetic oligonucleotide
gtgatgagtacttcggtcgtccatg

SEQ ID NO: 702278 - DNA, 25 bp, Artificial sequence
  Synthetic oligonucleotide
gtgatgagtactacggtcgtccatg

SEQ ID NO: 702279 - DNA, 25 bp, Artificial sequence
  Synthetic oligonucleotide
cttttatcacgacggtacgcgttgc

SEQ ID NO: 702280 - DNA, 25 bp, Artificial sequence
  Synthetic oligonucleotide
ggccaggcgtataacggccataaaa

SEQ ID NO: 702281 - DNA, 25 bp, Artificial sequence
  Synthetic oligonucleotide
tgggagtaagtctcgtccgagatct

SEQ ID NO: 702282 - DNA, 25 bp, Artificial sequence
  Synthetic oligonucleotide
gtgtctataccgctacgcgagctaa

SEQ ID NO: 702283 - DNA, 25 bp, Artificial sequence
  Synthetic oligonucleotide
taaaggatacccggacgcttccaga

SEQ ID NO: 702284 - DNA, 25 bp, Artificial sequence
  Synthetic oligonucleotide
taaaggataccccgacgcttccaga

SEQ ID NO: 702285 - DNA, 25 bp, Artificial sequence
  Synthetic oligonucleotide
tcattcgccttaacgcgatcatcgc

SEQ ID NO: 702286 - DNA, 25 bp, Artificial sequence
  Synthetic oligonucleotide
tcattcgccttatcgcgatcatcgc

SEQ ID NO: 702287 - DNA, 25 bp, Artificial sequence
  Synthetic oligonucleotide
aagtatacgcgccgcatactcccat

SEQ ID NO: 702288 - DNA, 25 bp, Artificial sequence
  Synthetic oligonucleotide
aagtatacgcgcggcatactcccat

SEQ ID NO: 702289 - DNA, 25 bp, Artificial sequence
  Synthetic oligonucleotide
accgcacctcgacacgtattttcca

SEQ ID NO: 702290 - DNA, 25 bp, Artificial sequence
  Synthetic oligonucleotide
accgcacctcgagacgtattttcca

SEQ ID NO: 702291 - DNA, 25 bp, Artificial sequence
  Synthetic oligonucleotide
tcgtcaagcgagtatcgcgtaagtc

SEQ ID NO: 702292 - DNA, 25 bp, Artificial sequence
  Synthetic oligonucleotide
tcgtcaagcgagaatcgcgtaagtc

SEQ ID NO: 702293 - DNA, 25 bp, Artificial sequence
  Synthetic oligonucleotide
gtgtctataccggtacgcgagctaa

SEQ ID NO: 702294 - DNA, 25 bp, Artificial sequence
  Synthetic oligonucleotide
cttttatcacgagggtacgcgttgc

SEQ ID NO: 702295 - DNA, 25 bp, Artificial sequence
  Synthetic oligonucleotide
gattcgatcgcggcgtaagaatcca

SEQ ID NO: 702296 - DNA, 25 bp, Artificial sequence
  Synthetic oligonucleotide
tcactttacgcgtcccgatgtcaga

SEQ ID NO: 702297 - DNA, 25 bp, Artificial sequence
  Synthetic oligonucleotide
ctctagccgttcacgcggattctaa

SEQ ID NO: 702298 - DNA, 25 bp, Artificial sequence
  Synthetic oligonucleotide
ctctagccgttctcgcggattctaa

SEQ ID NO: 702299 - DNA, 25 bp, Artificial sequence
  Synthetic oligonucleotide
gtacttaccgccgcgaataaagagc

SEQ ID NO: 702300 - DNA, 25 bp, Artificial sequence
  Synthetic oligonucleotide
gtacttaccgccccgaataaagagc

SEQ ID NO: 702301 - DNA, 25 bp, Artificial sequence
  Synthetic oligonucleotide
agtatacgctagtcggtcggggatt

SEQ ID NO: 702302 - DNA, 25 bp, Artificial sequence
  Synthetic oligonucleotide
agtatacgctagacggtcggggatt

SEQ ID NO: 702303 - DNA, 25 bp, Artificial sequence
  Synthetic oligonucleotide
aactgattcgcgttaacggtctgcc

SEQ ID NO: 702304 - DNA, 25 bp, Artificial sequence
  Synthetic oligonucleotide
aactgattcgcgataacggtctgcc

SEQ ID NO: 702305 - DNA, 25 bp, Artificial sequence
  Synthetic oligonucleotide
aagcagtctcgcctatcgttctggt

SEQ ID NO: 702306 - DNA, 25 bp, Artificial sequence
  Synthetic oligonucleotide
aagcattgcgaacgatacgcccatc

SEQ ID NO: 702307 - DNA, 25 bp, Artificial sequence
  Synthetic oligonucleotide
gattcgatcgcgccgtaagaatcca

SEQ ID NO: 702308 - DNA, 25 bp, Artificial sequence
  Synthetic oligonucleotide
gtcctccgtatcgcgagattcagat

SEQ ID NO: 702309 - DNA, 25 bp, Artificial sequence
  Synthetic oligonucleotide
acggtacgtacatacgcgttgtctc

SEQ ID NO: 702310 - DNA, 25 bp, Artificial sequence
  Synthetic oligonucleotide
acggtacgtacaaacgcgttgtctc

SEQ ID NO: 702311 - DNA, 25 bp, Artificial sequence
  Synthetic oligonucleotide
ctatgcgtcttaacgcgcggatagt

SEQ ID NO: 702312 - DNA, 25 bp, Artificial sequence
  Synthetic oligonucleotide
ctatgcgtcttatcgcgcggatagt

SEQ ID NO: 702313 - DNA, 25 bp, Artificial sequence
  Synthetic oligonucleotide
atgtaaccgggttcgatcagaggca

SEQ ID NO: 702314 - DNA, 25 bp, Artificial sequence
  Synthetic oligonucleotide
atgtaaccgggtacgatcagaggca

SEQ ID NO: 702315 - DNA, 25 bp, Artificial sequence
  Synthetic oligonucleotide
gtgaagccgttatagtacgggtcag

SEQ ID NO: 702316 - DNA, 25 bp, Artificial sequence
  Synthetic oligonucleotide
aagcattgcgaaggatacgcccatc

SEQ ID NO: 702317 - DNA, 25 bp, Artificial sequence
  Synthetic oligonucleotide
gctaggacgcgttgacgtagattca

SEQ ID NO: 702318 - DNA, 25 bp, Artificial sequence
  Synthetic oligonucleotide
tctctagcgttaatcgcccggtaac

SEQ ID NO: 702319 - DNA, 25 bp, Artificial sequence
  Synthetic oligonucleotide
tctctagcgttattcgcccggtaac

SEQ ID NO: 702320 - DNA, 25 bp, Artificial sequence
  Synthetic oligonucleotide
aagcagtctcgcgtatcgttctggt

SEQ ID NO: 702321 - DNA, 25 bp, Artificial sequence
  Synthetic oligonucleotide
tcctcaagcgcgtttgtcgtactca

SEQ ID NO: 702322 - DNA, 25 bp, Artificial sequence
  Synthetic oligonucleotide
gcataaaacacgtctcgcgtctcgt

SEQ ID NO: 702323 - DNA, 25 bp, Artificial sequence
  Synthetic oligonucleotide
gcataaaacacgactcgcgtctcgt

SEQ ID NO: 702324 - DNA, 25 bp, Artificial sequence
  Synthetic oligonucleotide
agagcataggtcggtagcgcaaaag

SEQ ID NO: 702325 - DNA, 25 bp, Artificial sequence
  Synthetic oligonucleotide
agagcataggtccgtagcgcaaaag

SEQ ID NO: 702326 - DNA, 25 bp, Artificial sequence
  Synthetic oligonucleotide
caatggcgatacgcgttaaacgagc

SEQ ID NO: 702327 - DNA, 25 bp, Artificial sequence
  Synthetic oligonucleotide
caatggcgatacccgttaaacgagc

SEQ ID NO: 702328 - DNA, 25 bp, Artificial sequence
  Synthetic oligonucleotide
agcaatcgacgtttcccgtatacgc

SEQ ID NO: 702329 - DNA, 25 bp, Artificial sequence
  Synthetic oligonucleotide
agcaatcgacgtatcccgtatacgc

SEQ ID NO: 702330 - DNA, 25 bp, Artificial sequence
  Synthetic oligonucleotide
cacttccgatattgcgccttacgga

SEQ ID NO: 702331 - DNA, 25 bp, Artificial sequence
  Synthetic oligonucleotide
cacttccgatatagcgccttacgga

SEQ ID NO: 702332 - DNA, 25 bp, Artificial sequence
  Synthetic oligonucleotide
aggagctcaggtcgcgtaatacatg

SEQ ID NO: 702333 - DNA, 25 bp, Artificial sequence
  Synthetic oligonucleotide
tcactttacgcgacccgatgtcaga

SEQ ID NO: 702334 - DNA, 25 bp, Artificial sequence
  Synthetic oligonucleotide
tcctcaagcgcgattgtcgtactca

SEQ ID NO: 702335 - DNA, 25 bp, Artificial sequence
  Synthetic oligonucleotide
gtcctccgtatcccgagattcagat

SEQ ID NO: 702336 - DNA, 25 bp, Artificial sequence
  Synthetic oligonucleotide
agtaagcgatcccgtatatagcgcg

SEQ ID NO: 702337 - DNA, 25 bp, Artificial sequence
  Synthetic oligonucleotide
agtaagcgatccggtatatagcgcg

SEQ ID NO: 702338 - DNA, 25 bp, Artificial sequence
  Synthetic oligonucleotide
aatcgttcggtgcgacggtttcaga

SEQ ID NO: 702339 - DNA, 25 bp, Artificial sequence
  Synthetic oligonucleotide
aatcgttcggtgggacggtttcaga

SEQ ID NO: 702340 - DNA, 25 bp, Artificial sequence
  Synthetic oligonucleotide
tttcggcgtatacgacgcgcgtatt

SEQ ID NO: 702341 - DNA, 25 bp, Artificial sequence
  Synthetic oligonucleotide
tttcggcgtataggacgcgcgtatt

SEQ ID NO: 702342 - DNA, 25 bp, Artificial sequence
  Synthetic oligonucleotide
ttcacggtttgatcgcgcgttgtac

SEQ ID NO: 702343 - DNA, 25 bp, Artificial sequence
  Synthetic oligonucleotide
ttcacggtttgaacgcgcgttgtac

SEQ ID NO: 702344 - DNA, 25 bp, Artificial sequence
  Synthetic oligonucleotide
tttgaagtagattgcgacggccgga

SEQ ID NO: 702345 - DNA, 25 bp, Artificial sequence
  Synthetic oligonucleotide
tttgaagtagatagcgacggccgga

SEQ ID NO: 702346 - DNA, 25 bp, Artificial sequence
  Synthetic oligonucleotide
cccattaggatcccgtaccaggtaa

SEQ ID NO: 702347 - DNA, 25 bp, Artificial sequence
  Synthetic oligonucleotide
aggagctcaggtggcgtaatacatg

SEQ ID NO: 702348 - DNA, 25 bp, Artificial sequence
  Synthetic oligonucleotide
cttagctcatgacgcgctacgcata

SEQ ID NO: 702349 - DNA, 25 bp, Artificial sequence
  Synthetic oligonucleotide
cgtaattaccgctacggacaagtcc

SEQ ID NO: 702350 - DNA, 25 bp, Artificial sequence
  Synthetic oligonucleotide
ccataccgtaagccgacttaatggg

SEQ ID NO: 702351 - DNA, 25 bp, Artificial sequence
  Synthetic oligonucleotide
accacgccccgtacgattatgaact

SEQ ID NO: 702352 - DNA, 25 bp, Artificial sequence
  Synthetic oligonucleotide
accacgccccgttcgattatgaact

SEQ ID NO: 702353 - DNA, 25 bp, Artificial sequence
  Synthetic oligonucleotide
gagggctatacccttcgcgttacat

SEQ ID NO: 702354 - DNA, 25 bp, Artificial sequence
  Synthetic oligonucleotide
gagggctataccgttcgcgttacat

SEQ ID NO: 702355 - DNA, 25 bp, Artificial sequence
  Synthetic oligonucleotide
acaacgtaggacaccgtcgtttgac

SEQ ID NO: 702356 - DNA, 25 bp, Artificial sequence
  Synthetic oligonucleotide
acaacgtaggactccgtcgtttgac

SEQ ID NO: 702357 - DNA, 25 bp, Artificial sequence
  Synthetic oligonucleotide
tgaatggtagcgggatacagtggga

SEQ ID NO: 702358 - DNA, 25 bp, Artificial sequence
  Synthetic oligonucleotide
ggtgctcgtacccacgtataatgca

SEQ ID NO: 702359 - DNA, 25 bp, Artificial sequence
  Synthetic oligonucleotide
tgaatggtagcgcgatacagtggga

SEQ ID NO: 702360 - DNA, 25 bp, Artificial sequence
  Synthetic oligonucleotide
cttagctcatgaggcgctacgcata

SEQ ID NO: 702361 - DNA, 25 bp, Artificial sequence
  Synthetic oligonucleotide
gtgtttatgtaacgcgcgatgctgc

SEQ ID NO: 702362 - DNA, 25 bp, Artificial sequence
  Synthetic oligonucleotide
gtgtttatgtaaggcgcgatgctgc

SEQ ID NO: 702363 - DNA, 25 bp, Artificial sequence
  Synthetic oligonucleotide
tatggtacgtaagtcgcgaggcagt

SEQ ID NO: 702364 - DNA, 25 bp, Artificial sequence
  Synthetic oligonucleotide
tatggtacgtaactcgcgaggcagt

SEQ ID NO: 702365 - DNA, 25 bp, Artificial sequence
  Synthetic oligonucleotide
ccaaatacggtcggtaacagagagc

SEQ ID NO: 702366 - DNA, 25 bp, Artificial sequence
  Synthetic oligonucleotide
ccaaatacggtccgtaacagagagc

SEQ ID NO: 702367 - DNA, 25 bp, Artificial sequence
  Synthetic oligonucleotide
gtcaaatacgtacccgctacaagcc

SEQ ID NO: 702368 - DNA, 25 bp, Artificial sequence
  Synthetic oligonucleotide
gtcaaatacgtagccgctacaagcc

SEQ ID NO: 702369 - DNA, 25 bp, Artificial sequence
  Synthetic oligonucleotide
ggtgctcgtaccgacgtataatgca

SEQ ID NO: 702370 - DNA, 25 bp, Artificial sequence
  Synthetic oligonucleotide
tcaccatccgtcaagcgttcaactc

SEQ ID NO: 702371 - DNA, 25 bp, Artificial sequence
  Synthetic oligonucleotide
tacagacgagcgcgtaactagtcct

SEQ ID NO: 702372 - DNA, 25 bp, Artificial sequence
  Synthetic oligonucleotide
actacacgcgatatagctccgagga

SEQ ID NO: 702373 - DNA, 25 bp, Artificial sequence
  Synthetic oligonucleotide
tggagctatcggacgcctatattgg

SEQ ID NO: 702374 - DNA, 25 bp, Artificial sequence
  Synthetic oligonucleotide
tggagctatcggtcgcctatattgg

SEQ ID NO: 702375 - DNA, 25 bp, Artificial sequence
  Synthetic oligonucleotide
ggtcgagagtaatcgcgtagaactc

SEQ ID NO: 702376 - DNA, 25 bp, Artificial sequence
  Synthetic oligonucleotide
ggtcgagagtaaacgcgtagaactc

SEQ ID NO: 702377 - DNA, 25 bp, Artificial sequence
  Synthetic oligonucleotide
accttttcccgataacgcgtgcgaa

SEQ ID NO: 702378 - DNA, 25 bp, Artificial sequence
  Synthetic oligonucleotide
accttttcccgaaaacgcgtgcgaa

SEQ ID NO: 702379 - DNA, 25 bp, Artificial sequence
  Synthetic oligonucleotide
ccataccgtaaggcgacttaatggg

SEQ ID NO: 702380 - DNA, 25 bp, Artificial sequence
  Synthetic oligonucleotide
tccccggcgtacgttaagcatctat

SEQ ID NO: 702381 - DNA, 25 bp, Artificial sequence
  Synthetic oligonucleotide
gtggcgtcgcgtttataggtagcaa

SEQ ID NO: 702382 - DNA, 25 bp, Artificial sequence
  Synthetic oligonucleotide
tcaccatccgtctagcgttcaactc

SEQ ID NO: 702383 - DNA, 25 bp, Artificial sequence
  Synthetic oligonucleotide
catcggatgcgttgcggacaaagaa

SEQ ID NO: 702384 - DNA, 25 bp, Artificial sequence
  Synthetic oligonucleotide
catcggatgcgtagcggacaaagaa

SEQ ID NO: 702385 - DNA, 25 bp, Artificial sequence
  Synthetic oligonucleotide
caccgacaacgtgcgatacaatggt

SEQ ID NO: 702386 - DNA, 25 bp, Artificial sequence
  Synthetic oligonucleotide
caccgacaacgtccgatacaatggt

SEQ ID NO: 702387 - DNA, 25 bp, Artificial sequence
  Synthetic oligonucleotide
acctctcgtagttgtccgcatcttc

SEQ ID NO: 702388 - DNA, 25 bp, Artificial sequence
  Synthetic oligonucleotide
acctctcgtagtagtccgcatcttc

SEQ ID NO: 702389 - DNA, 25 bp, Artificial sequence
  Synthetic oligonucleotide
ctttggccgtacgcatagtaggact

SEQ ID NO: 702390 - DNA, 25 bp, Artificial sequence
  Synthetic oligonucleotide
ctttggccgtacccatagtaggact

SEQ ID NO: 702391 - DNA, 25 bp, Artificial sequence
  Synthetic oligonucleotide
tccccggcgtaccttaagcatctat

SEQ ID NO: 702392 - DNA, 25 bp, Artificial sequence
  Synthetic oligonucleotide
tcgacttcgacttgtccgactagag

SEQ ID NO: 702393 - DNA, 25 bp, Artificial sequence
  Synthetic oligonucleotide
cgggtacgacgcgaagttaattgct

SEQ ID NO: 702394 - DNA, 25 bp, Artificial sequence
  Synthetic oligonucleotide
cagccatactatgtcgcgagaaagc

SEQ ID NO: 702395 - DNA, 25 bp, Artificial sequence
  Synthetic oligonucleotide
cagccatactatctcgcgagaaagc

SEQ ID NO: 702396 - DNA, 25 bp, Artificial sequence
  Synthetic oligonucleotide
attaggtagtacgcggtcttgggag

SEQ ID NO: 702397 - DNA, 25 bp, Artificial sequence
  Synthetic oligonucleotide
attaggtagtacccggtcttgggag

SEQ ID NO: 702398 - DNA, 25 bp, Artificial sequence
  Synthetic oligonucleotide
cactggataacgtaggcgggaaaga

SEQ ID NO: 702399 - DNA, 25 bp, Artificial sequence
  Synthetic oligonucleotide
cactggataacgaaggcgggaaaga

SEQ ID NO: 702400 - DNA, 25 bp, Artificial sequence
  Synthetic oligonucleotide
gcttatgtcgatacggtacccacct

SEQ ID NO: 702401 - DNA, 25 bp, Artificial sequence
  Synthetic oligonucleotide
gctccgttatctaaccgcgtctatc

SEQ ID NO: 702402 - DNA, 25 bp, Artificial sequence
  Synthetic oligonucleotide
tcgacttcgactagtccgactagag

SEQ ID NO: 702403 - DNA, 25 bp, Artificial sequence
  Synthetic oligonucleotide
gacgatttcgtgacggtcctagagt

SEQ ID NO: 702404 - DNA, 25 bp, Artificial sequence
  Synthetic oligonucleotide
tgcctacgcccgaatacaaacgcaa

SEQ ID NO: 702405 - DNA, 25 bp, Artificial sequence
  Synthetic oligonucleotide
tgcctacgcccgtatacaaacgcaa

SEQ ID NO: 702406 - DNA, 25 bp, Artificial sequence
  Synthetic oligonucleotide
acaacgttgcgttcgcgatgacaac

SEQ ID NO: 702407 - DNA, 25 bp, Artificial sequence
  Synthetic oligonucleotide
acaacgttgcgtacgcgatgacaac

SEQ ID NO: 702408 - DNA, 25 bp, Artificial sequence
  Synthetic oligonucleotide
tacgtcgtaatgtctcgcgcatcga

SEQ ID NO: 702409 - DNA, 25 bp, Artificial sequence
  Synthetic oligonucleotide
tacgtcgtaatgactcgcgcatcga

SEQ ID NO: 702410 - DNA, 25 bp, Artificial sequence
  Synthetic oligonucleotide
ctcgaggtcgcgaccttaacttgtt

SEQ ID NO: 702411 - DNA, 25 bp, Artificial sequence
  Synthetic oligonucleotide
ctcgaggtcgcgtccttaacttgtt

SEQ ID NO: 702412 - DNA, 25 bp, Artificial sequence
  Synthetic oligonucleotide
acaacaccatatccggacgaggatg

SEQ ID NO: 702413 - DNA, 25 bp, Artificial sequence
  Synthetic oligonucleotide
gcttatgtcgattcggtacccacct

SEQ ID NO: 702414 - DNA, 25 bp, Artificial sequence
  Synthetic oligonucleotide
ctacgttgttgccaccgtcgatttc

SEQ ID NO: 702415 - DNA, 25 bp, Artificial sequence
  Synthetic oligonucleotide
acaacaccatatgcggacgaggatg

SEQ ID NO: 702416 - DNA, 25 bp, Artificial sequence
  Synthetic oligonucleotide
gtggcgtcgcgtatataggtagcaa

SEQ ID NO: 702417 - DNA, 25 bp, Artificial sequence
  Synthetic oligonucleotide
gctaggacgcgtagacgtagattca

SEQ ID NO: 702418 - DNA, 25 bp, Artificial sequence
  Synthetic oligonucleotide
cgtaattaccgcaacggacaagtcc

SEQ ID NO: 702419 - DNA, 25 bp, Artificial sequence
  Synthetic oligonucleotide
actccgtattcgcgcggattaatcg

SEQ ID NO: 702420 - DNA, 25 bp, Artificial sequence
  Synthetic oligonucleotide
actccgtattcgggcggattaatcg

SEQ ID NO: 702421 - DNA, 25 bp, Artificial sequence
  Synthetic oligonucleotide
ccaattatccgtggcgatagttcgg

SEQ ID NO: 702422 - DNA, 25 bp, Artificial sequence
  Synthetic oligonucleotide
ccaattatccgtcgcgatagttcgg

SEQ ID NO: 702423 - DNA, 25 bp, Artificial sequence
  Synthetic oligonucleotide
atgaaatacgcgggacataccctcc

SEQ ID NO: 702424 - DNA, 25 bp, Artificial sequence
  Synthetic oligonucleotide
cgggtacgacgccaagttaattgct

SEQ ID NO: 702425 - DNA, 25 bp, Artificial sequence
  Synthetic oligonucleotide
ctacgttgttgcgaccgtcgatttc

SEQ ID NO: 702426 - DNA, 25 bp, Artificial sequence
  Synthetic oligonucleotide
gacgatttcgtgtcggtcctagagt

SEQ ID NO: 702427 - DNA, 25 bp, Artificial sequence
  Synthetic oligonucleotide
tgccactggaatggcgcatagactt

SEQ ID NO: 702428 - DNA, 25 bp, Artificial sequence
  Synthetic oligonucleotide
tacagacgagcgggtaactagtcct

SEQ ID NO: 702429 - DNA, 25 bp, Artificial sequence
  Synthetic oligonucleotide
gtgttgaacggtttgcgcgataacg

SEQ ID NO: 702430 - DNA, 25 bp, Artificial sequence
  Synthetic oligonucleotide
gtgttgaacggtatgcgcgataacg

SEQ ID NO: 702431 - DNA, 25 bp, Artificial sequence
  Synthetic oligonucleotide
tcaagcctccgtagtcgactagctt

SEQ ID NO: 702432 - DNA, 25 bp, Artificial sequence
  Synthetic oligonucleotide
tcaagcctccgttgtcgactagctt

SEQ ID NO: 702433 - DNA, 25 bp, Artificial sequence
  Synthetic oligonucleotide
ggtaatgtacgatgcgagagatccg

SEQ ID NO: 702434 - DNA, 25 bp, Artificial sequence
  Synthetic oligonucleotide
ggtaatgtacgaagcgagagatccg

SEQ ID NO: 702435 - DNA, 25 bp, Artificial sequence
  Synthetic oligonucleotide
gctccgttatcttaccgcgtctatc

SEQ ID NO: 702436 - DNA, 25 bp, Artificial sequence
  Synthetic oligonucleotide
atgaaatacgcgcgacataccctcc

SEQ ID NO: 702437 - DNA, 25 bp, Artificial sequence
  Synthetic oligonucleotide
gtcggtaccgacccgtttagatgtt

SEQ ID NO: 702438 - DNA, 25 bp, Artificial sequence
  Synthetic oligonucleotide
gcacctctatgattgcgcgagctta

SEQ ID NO: 702439 - DNA, 25 bp, Artificial sequence
  Synthetic oligonucleotide
gcagcttatgttccggacgtttgtc

SEQ ID NO: 702440 - DNA, 25 bp, Artificial sequence
  Synthetic oligonucleotide
gcagcttatgttgcggacgtttgtc

SEQ ID NO: 702441 - DNA, 25 bp, Artificial sequence
  Synthetic oligonucleotide
cggtaccggaacccgactaagaata

SEQ ID NO: 702442 - DNA, 25 bp, Artificial sequence
  Synthetic oligonucleotide
cggtaccggaacgcgactaagaata

SEQ ID NO: 702443 - DNA, 25 bp, Artificial sequence
  Synthetic oligonucleotide
ttctgataccggagtacgcaagacc

SEQ ID NO: 702444 - DNA, 25 bp, Artificial sequence
  Synthetic oligonucleotide
ttctgataccggtgtacgcaagacc

SEQ ID NO: 702445 - DNA, 25 bp, Artificial sequence
  Synthetic oligonucleotide
caatgaagcgtagcgttcgcttcct

SEQ ID NO: 702446 - DNA, 25 bp, Artificial sequence
  Synthetic oligonucleotide
caatgaagcgtaccgttcgcttcct

SEQ ID NO: 702447 - DNA, 25 bp, Artificial sequence
  Synthetic oligonucleotide
gtcgcttaggcgaaccgtaaatcac

SEQ ID NO: 702448 - DNA, 25 bp, Artificial sequence
  Synthetic oligonucleotide
gtcgcttaggcgtaccgtaaatcac

SEQ ID NO: 702449 - DNA, 25 bp, Artificial sequence
  Synthetic oligonucleotide
gggatggatagcctaccgtgttaag

SEQ ID NO: 702450 - DNA, 25 bp, Artificial sequence
  Synthetic oligonucleotide
tactgagtcaattcgcgcggggtaa

SEQ ID NO: 702451 - DNA, 25 bp, Artificial sequence
  Synthetic oligonucleotide
gtctggtaagtagcggtcgcgtaat

SEQ ID NO: 702452 - DNA, 25 bp, Artificial sequence
  Synthetic oligonucleotide
gtcggtaccgacgcgtttagatgtt

SEQ ID NO: 702453 - DNA, 25 bp, Artificial sequence
  Synthetic oligonucleotide
ggtatagctagccgcgtaagctttc

SEQ ID NO: 702454 - DNA, 25 bp, Artificial sequence
  Synthetic oligonucleotide
ggtatagctagcggcgtaagctttc

SEQ ID NO: 702455 - DNA, 25 bp, Artificial sequence
  Synthetic oligonucleotide
gttggggcgatatgtaccgcataga

SEQ ID NO: 702456 - DNA, 25 bp, Artificial sequence
  Synthetic oligonucleotide
ttggctccgcgttatgactaccgat

SEQ ID NO: 702457 - DNA, 25 bp, Artificial sequence
  Synthetic oligonucleotide
aaaatgtctacccgacgtcccagag

SEQ ID NO: 702458 - DNA, 25 bp, Artificial sequence
  Synthetic oligonucleotide
gtcttcaatgcgaacgctcgtcgtt

SEQ ID NO: 702459 - DNA, 25 bp, Artificial sequence
  Synthetic oligonucleotide
gtcttcaatgcgtacgctcgtcgtt

SEQ ID NO: 702460 - DNA, 25 bp, Artificial sequence
  Synthetic oligonucleotide
cttactcgacgtactctagcgtgac

SEQ ID NO: 702461 - DNA, 25 bp, Artificial sequence
  Synthetic oligonucleotide
cttactcgacgttctctagcgtgac

SEQ ID NO: 702462 - DNA, 25 bp, Artificial sequence
  Synthetic oligonucleotide
tattggtacgcggacgttacggact

SEQ ID NO: 702463 - DNA, 25 bp, Artificial sequence
  Synthetic oligonucleotide
tactgagtcaatacgcgcggggtaa

SEQ ID NO: 702464 - DNA, 25 bp, Artificial sequence
  Synthetic oligonucleotide
gcctatacccgtggcttaaaacgac

SEQ ID NO: 702465 - DNA, 25 bp, Artificial sequence
  Synthetic oligonucleotide
gggatggatagcgtaccgtgttaag

SEQ ID NO: 702466 - DNA, 25 bp, Artificial sequence
  Synthetic oligonucleotide
tgaagtcgtgttggcgaatagggtc

SEQ ID NO: 702467 - DNA, 25 bp, Artificial sequence
  Synthetic oligonucleotide
tgaagtcgtgttcgcgaatagggtc

SEQ ID NO: 702468 - DNA, 25 bp, Artificial sequence
  Synthetic oligonucleotide
ttgcgactcggtagcgcatttgttg

SEQ ID NO: 702469 - DNA, 25 bp, Artificial sequence
  Synthetic oligonucleotide
ttgcgactcggttgcgcatttgttg

SEQ ID NO: 702470 - DNA, 25 bp, Artificial sequence
  Synthetic oligonucleotide
ccttgacgtccgaatggtacgtagt

SEQ ID NO: 702471 - DNA, 25 bp, Artificial sequence
  Synthetic oligonucleotide
ccttgacgtccgtatggtacgtagt

SEQ ID NO: 702472 - DNA, 25 bp, Artificial sequence
  Synthetic oligonucleotide
aaagcgctcggtacgacgttgttgt

SEQ ID NO: 702473 - DNA, 25 bp, Artificial sequence
  Synthetic oligonucleotide
aaagcgctcggttcgacgttgttgt

SEQ ID NO: 702474 - DNA, 25 bp, Artificial sequence
  Synthetic oligonucleotide
tgccagcgtcgctagtaatatagcg

SEQ ID NO: 702475 - DNA, 25 bp, Artificial sequence
  Synthetic oligonucleotide
tgccagcgtcgcaagtaatatagcg

SEQ ID NO: 702476 - DNA, 25 bp, Artificial sequence
  Synthetic oligonucleotide
gcacctctatgaatgcgcgagctta

SEQ ID NO: 702477 - DNA, 25 bp, Artificial sequence
  Synthetic oligonucleotide
cacagccgatagaatgcggtatgtc

SEQ ID NO: 702478 - DNA, 25 bp, Artificial sequence
  Synthetic oligonucleotide
gtctggtaagtaccggtcgcgtaat

SEQ ID NO: 702479 - DNA, 25 bp, Artificial sequence
  Synthetic oligonucleotide
gcctatacccgtcgcttaaaacgac

SEQ ID NO: 702480 - DNA, 25 bp, Artificial sequence
  Synthetic oligonucleotide
ggtacgctatatctcgcgctcattc

SEQ ID NO: 702481 - DNA, 25 bp, Artificial sequence
  Synthetic oligonucleotide
ggtacgctatatgtcgcgctcattc

SEQ ID NO: 702482 - DNA, 25 bp, Artificial sequence
  Synthetic oligonucleotide
aattcctcgatccacggtcggaatg

SEQ ID NO: 702483 - DNA, 25 bp, Artificial sequence
  Synthetic oligonucleotide
aattcctcgatcgacggtcggaatg

SEQ ID NO: 702484 - DNA, 25 bp, Artificial sequence
  Synthetic oligonucleotide
gagaggacgacggaagtcgaaacaa

SEQ ID NO: 702485 - DNA, 25 bp, Artificial sequence
  Synthetic oligonucleotide
gagaggacgacgcaagtcgaaacaa

SEQ ID NO: 702486 - DNA, 25 bp, Artificial sequence
  Synthetic oligonucleotide
ctatggcgcgtagtgaaacgggaat

SEQ ID NO: 702487 - DNA, 25 bp, Artificial sequence
  Synthetic oligonucleotide
ctatggcgcgtactgaaacgggaat

SEQ ID NO: 702488 - DNA, 25 bp, Artificial sequence
  Synthetic oligonucleotide
cactatgcgtacggacgatgtgagt

SEQ ID NO: 702489 - DNA, 25 bp, Artificial sequence
  Synthetic oligonucleotide
cactatgcgtaccgacgatgtgagt

SEQ ID NO: 702490 - DNA, 25 bp, Artificial sequence
  Synthetic oligonucleotide
gcttcttacttgggcgcgaccttta

SEQ ID NO: 702491 - DNA, 25 bp, Artificial sequence
  Synthetic oligonucleotide
cacagccgatagtatgcggtatgtc

SEQ ID NO: 702492 - DNA, 25 bp, Artificial sequence
  Synthetic oligonucleotide
ggatactacgatcggtggcatatgc

SEQ ID NO: 702493 - DNA, 25 bp, Artificial sequence
  Synthetic oligonucleotide
tattggtacgcgcacgttacggact

SEQ ID NO: 702494 - DNA, 25 bp, Artificial sequence
  Synthetic oligonucleotide
cctatagtcccgcgattaacggcaa

SEQ ID NO: 702495 - DNA, 25 bp, Artificial sequence
  Synthetic oligonucleotide
gattgttagcgccttaaccagggtc

SEQ ID NO: 702496 - DNA, 25 bp, Artificial sequence
  Synthetic oligonucleotide
gattgttagcgcgttaaccagggtc

SEQ ID NO: 702497 - DNA, 25 bp, Artificial sequence
  Synthetic oligonucleotide
tcttcacgttaaggaacgccctcag

SEQ ID NO: 702498 - DNA, 25 bp, Artificial sequence
  Synthetic oligonucleotide
tcttcacgttaacgaacgccctcag

SEQ ID NO: 702499 - DNA, 25 bp, Artificial sequence
  Synthetic oligonucleotide
tatgcgtcgtatagcggacatgtcg

SEQ ID NO: 702500 - DNA, 25 bp, Artificial sequence
  Synthetic oligonucleotide
tatgcgtcgtattgcggacatgtcg

SEQ ID NO: 702501 - DNA, 25 bp, Artificial sequence
  Synthetic oligonucleotide
gtgagcgtacgcgttatacgtatgg

SEQ ID NO: 702502 - DNA, 25 bp, Artificial sequence
  Synthetic oligonucleotide
gtgagcgtacgccttatacgtatgg

SEQ ID NO: 702503 - DNA, 25 bp, Artificial sequence
  Synthetic oligonucleotide
aagtgacgcggtatagtagcggctt

SEQ ID NO: 702504 - DNA, 25 bp, Artificial sequence
  Synthetic oligonucleotide
tagaaccgtccgttcggtaacttcc

SEQ ID NO: 702505 - DNA, 25 bp, Artificial sequence
  Synthetic oligonucleotide
tccgaaccgcgacgatataactcgt

SEQ ID NO: 702506 - DNA, 25 bp, Artificial sequence
  Synthetic oligonucleotide
tagaaccgtccgatcggtaacttcc

SEQ ID NO: 702507 - DNA, 25 bp, Artificial sequence
  Synthetic oligonucleotide
ggatactacgatgggtggcatatgc

SEQ ID NO: 702508 - DNA, 25 bp, Artificial sequence
  Synthetic oligonucleotide
aaacctactgcgaacgagtgctagc

SEQ ID NO: 702509 - DNA, 25 bp, Artificial sequence
  Synthetic oligonucleotide
aaacctactgcgtacgagtgctagc

SEQ ID NO: 702510 - DNA, 25 bp, Artificial sequence
  Synthetic oligonucleotide
ggctgcacgccgtataggaagaata

SEQ ID NO: 702511 - DNA, 25 bp, Artificial sequence
  Synthetic oligonucleotide
ggctgcacgccgaataggaagaata

SEQ ID NO: 702512 - DNA, 25 bp, Artificial sequence
  Synthetic oligonucleotide
caatattcggacctgtacgtcgggt

SEQ ID NO: 702513 - DNA, 25 bp, Artificial sequence
  Synthetic oligonucleotide
caatattcggacgtgtacgtcgggt

SEQ ID NO: 702514 - DNA, 25 bp, Artificial sequence
  Synthetic oligonucleotide
gaaccttcgagtacgtacgtactgc

SEQ ID NO: 702515 - DNA, 25 bp, Artificial sequence
  Synthetic oligonucleotide
gaaccttcgagttcgtacgtactgc

SEQ ID NO: 702516 - DNA, 25 bp, Artificial sequence
  Synthetic oligonucleotide
gttggggcgataagtaccgcataga

SEQ ID NO: 702517 - DNA, 25 bp, Artificial sequence
  Synthetic oligonucleotide
tgccactggaatcgcgcatagactt

SEQ ID NO: 702518 - DNA, 25 bp, Artificial sequence
  Synthetic oligonucleotide
actacacgcgatttagctccgagga

SEQ ID NO: 702519 - DNA, 25 bp, Artificial sequence
  Synthetic oligonucleotide
tccgaaccgcgaggatataactcgt

SEQ ID NO: 702520 - DNA, 25 bp, Artificial sequence
  Synthetic oligonucleotide
ctaataactaacggccgatggcacc

SEQ ID NO: 702521 - DNA, 25 bp, Artificial sequence
  Synthetic oligonucleotide
ttggctccgcgtaatgactaccgat

SEQ ID NO: 702522 - DNA, 25 bp, Artificial sequence
  Synthetic oligonucleotide
cctcctcgttcggtcgatctgtaaa

SEQ ID NO: 702523 - DNA, 25 bp, Artificial sequence
  Synthetic oligonucleotide
cctcctcgttcgctcgatctgtaaa

SEQ ID NO: 702524 - DNA, 25 bp, Artificial sequence
  Synthetic oligonucleotide
catgacattccggcccgatattcac

SEQ ID NO: 702525 - DNA, 25 bp, Artificial sequence
  Synthetic oligonucleotide
catgacattccgccccgatattcac

SEQ ID NO: 702526 - DNA, 25 bp, Artificial sequence
  Synthetic oligonucleotide
tggtggcgatacggcgctagaaatt

SEQ ID NO: 702527 - DNA, 25 bp, Artificial sequence
  Synthetic oligonucleotide
tggtggcgataccgcgctagaaatt

SEQ ID NO: 702528 - DNA, 25 bp, Artificial sequence
  Synthetic oligonucleotide
taacgccgcgattctttcgaatggc

SEQ ID NO: 702529 - DNA, 25 bp, Artificial sequence
  Synthetic oligonucleotide
taacgccgcgatactttcgaatggc

SEQ ID NO: 702530 - DNA, 25 bp, Artificial sequence
  Synthetic oligonucleotide
acgacagtactaaaggcggtccaca

SEQ ID NO: 702531 - DNA, 25 bp, Artificial sequence
  Synthetic oligonucleotide
acgacagtactataggcggtccaca

SEQ ID NO: 702532 - DNA, 25 bp, Artificial sequence
  Synthetic oligonucleotide
cctatagtcccgggattaacggcaa

SEQ ID NO: 702533 - DNA, 25 bp, Artificial sequence
  Synthetic oligonucleotide
ccgttgagtgatcgcgacgtataga

SEQ ID NO: 702534 - DNA, 25 bp, Artificial sequence
  Synthetic oligonucleotide
gcttcttacttgcgcgcgaccttta

SEQ ID NO: 702535 - DNA, 25 bp, Artificial sequence
  Synthetic oligonucleotide
ctaataactaaccgccgatggcacc

SEQ ID NO: 702536 - DNA, 25 bp, Artificial sequence
  Synthetic oligonucleotide
gagtattagtacgagcgcggaaagg

SEQ ID NO: 702537 - DNA, 25 bp, Artificial sequence
  Synthetic oligonucleotide
gagtattagtaccagcgcggaaagg

SEQ ID NO: 702538 - DNA, 25 bp, Artificial sequence
  Synthetic oligonucleotide
ataaaggatataacgcgcgggtggg

SEQ ID NO: 702539 - DNA, 25 bp, Artificial sequence
  Synthetic oligonucleotide
ataaaggatatatcgcgcgggtggg

SEQ ID NO: 702540 - DNA, 25 bp, Artificial sequence
  Synthetic oligonucleotide
gtaggctacggaccggttattatgg

SEQ ID NO: 702541 - DNA, 25 bp, Artificial sequence
  Synthetic oligonucleotide
gtaggctacggagcggttattatgg

SEQ ID NO: 702542 - DNA, 25 bp, Artificial sequence
  Synthetic oligonucleotide
tacgactagtacccgcgatgtcaga

SEQ ID NO: 702543 - DNA, 25 bp, Artificial sequence
  Synthetic oligonucleotide
tacgactagtacgcgcgatgtcaga

SEQ ID NO: 702544 - DNA, 25 bp, Artificial sequence
  Synthetic oligonucleotide
atcagtttatcgcgtacggtacgcg

SEQ ID NO: 702545 - DNA, 25 bp, Artificial sequence
  Synthetic oligonucleotide
atcagtttatcgggtacggtacgcg

SEQ ID NO: 702546 - DNA, 25 bp, Artificial sequence
  Synthetic oligonucleotide
aagtgacgcggtttagtagcggctt

SEQ ID NO: 702547 - DNA, 25 bp, Artificial sequence
  Synthetic oligonucleotide
ccgttgagtgatggcgacgtataga

SEQ ID NO: 702548 - DNA, 25 bp, Artificial sequence
  Synthetic oligonucleotide
aatatggcgagactagtcgggcttc

SEQ ID NO: 702549 - DNA, 25 bp, Artificial sequence
  Synthetic oligonucleotide
tatggtcgctagttcggtcccacta

SEQ ID NO: 702550 - DNA, 25 bp, Artificial sequence
  Synthetic oligonucleotide
cattgacgcgataccgtcaaaggtc

SEQ ID NO: 702551 - DNA, 25 bp, Artificial sequence
  Synthetic oligonucleotide
tgatagtacgcttcgcggaccacat

SEQ ID NO: 702552 - DNA, 25 bp, Artificial sequence
  Synthetic oligonucleotide
tgatagtacgctacgcggaccacat

SEQ ID NO: 702553 - DNA, 25 bp, Artificial sequence
  Synthetic oligonucleotide
ttggcttaaaccgcgtagctgtgtg

SEQ ID NO: 702554 - DNA, 25 bp, Artificial sequence
  Synthetic oligonucleotide
ttggcttaaaccccgtagctgtgtg

SEQ ID NO: 702555 - DNA, 25 bp, Artificial sequence
  Synthetic oligonucleotide
agttccccgtcttatcgcggatatc

SEQ ID NO: 702556 - DNA, 25 bp, Artificial sequence
  Synthetic oligonucleotide
agttccccgtctaatcgcggatatc

SEQ ID NO: 702557 - DNA, 25 bp, Artificial sequence
  Synthetic oligonucleotide
tgtgatccgactaacgcggaggttt

SEQ ID NO: 702558 - DNA, 25 bp, Artificial sequence
  Synthetic oligonucleotide
ccttccagtcgcgtaacgtaaatgc

SEQ ID NO: 702559 - DNA, 25 bp, Artificial sequence
  Synthetic oligonucleotide
gtctaggtacgcacgtcatagtgac

SEQ ID NO: 702560 - DNA, 25 bp, Artificial sequence
  Synthetic oligonucleotide
gtttcttcttatccgcgaccgagca

SEQ ID NO: 702561 - DNA, 25 bp, Artificial sequence
  Synthetic oligonucleotide
aatatggcgagagtagtcgggcttc

SEQ ID NO: 702562 - DNA, 25 bp, Artificial sequence
  Synthetic oligonucleotide
gtttcttcttatgcgcgaccgagca

SEQ ID NO: 702563 - DNA, 25 bp, Artificial sequence
  Synthetic oligonucleotide
tcgttcactaccggtcgagccatta

SEQ ID NO: 702564 - DNA, 25 bp, Artificial sequence
  Synthetic oligonucleotide
tcgttcactacccgtcgagccatta

SEQ ID NO: 702565 - DNA, 25 bp, Artificial sequence
  Synthetic oligonucleotide
ctatgagcgatggtacgtttgctcc

SEQ ID NO: 702566 - DNA, 25 bp, Artificial sequence
  Synthetic oligonucleotide
ctatgagcgatgctacgtttgctcc

SEQ ID NO: 702567 - DNA, 25 bp, Artificial sequence
  Synthetic oligonucleotide
gaagagcccggtacgtaaagtaagc

SEQ ID NO: 702568 - DNA, 25 bp, Artificial sequence
  Synthetic oligonucleotide
gaagagcccggttcgtaaagtaagc

SEQ ID NO: 702569 - DNA, 25 bp, Artificial sequence
  Synthetic oligonucleotide
gcaacattacgcgtctacgtaggag

SEQ ID NO: 702570 - DNA, 25 bp, Artificial sequence
  Synthetic oligonucleotide
gcaacattacgcctctacgtaggag

SEQ ID NO: 702571 - DNA, 25 bp, Artificial sequence
  Synthetic oligonucleotide
gatttaagcctcctaacgcgtggag

SEQ ID NO: 702572 - DNA, 25 bp, Artificial sequence
  Synthetic oligonucleotide
gatttaagcctcgtaacgcgtggag

SEQ ID NO: 702573 - DNA, 25 bp, Artificial sequence
  Synthetic oligonucleotide
gacatccgcgtagatacgagggttt

SEQ ID NO: 702574 - DNA, 25 bp, Artificial sequence
  Synthetic oligonucleotide
gacatccgcgtacatacgagggttt

SEQ ID NO: 702575 - DNA, 25 bp, Artificial sequence
  Synthetic oligonucleotide
gtctaggtacgctcgtcatagtgac

SEQ ID NO: 702576 - DNA, 25 bp, Artificial sequence
  Synthetic oligonucleotide
tagtcaacggagggacgtaccgaaa

SEQ ID NO: 702577 - DNA, 25 bp, Artificial sequence
  Synthetic oligonucleotide
gtgaaaatcggccgtaagcactacg

SEQ ID NO: 702578 - DNA, 25 bp, Artificial sequence
  Synthetic oligonucleotide
gtgaaaatcggcggtaagcactacg

SEQ ID NO: 702579 - DNA, 25 bp, Artificial sequence
  Synthetic oligonucleotide
accgtgtatgtcgcgatacgttagg

SEQ ID NO: 702580 - DNA, 25 bp, Artificial sequence
  Synthetic oligonucleotide
accgtgtatgtcccgatacgttagg

SEQ ID NO: 702581 - DNA, 25 bp, Artificial sequence
  Synthetic oligonucleotide
taggtgttcgcgaattcggcgcttt

SEQ ID NO: 702582 - DNA, 25 bp, Artificial sequence
  Synthetic oligonucleotide
taggtgttcgcgtattcggcgcttt

SEQ ID NO: 702583 - DNA, 25 bp, Artificial sequence
  Synthetic oligonucleotide
gcacctcggccgtagattaactttg

SEQ ID NO: 702584 - DNA, 25 bp, Artificial sequence
  Synthetic oligonucleotide
gcacctcggccgaagattaactttg

SEQ ID NO: 702585 - DNA, 25 bp, Artificial sequence
  Synthetic oligonucleotide
ctttcaggtagccctcgaatgccat

SEQ ID NO: 702586 - DNA, 25 bp, Artificial sequence
  Synthetic oligonucleotide
ctttcaggtagcgctcgaatgccat

SEQ ID NO: 702587 - DNA, 25 bp, Artificial sequence
  Synthetic oligonucleotide
tgagtagttaacgcccgatgcactg

SEQ ID NO: 702588 - DNA, 25 bp, Artificial sequence
  Synthetic oligonucleotide
cattgacgcgattccgtcaaaggtc

SEQ ID NO: 702589 - DNA, 25 bp, Artificial sequence
  Synthetic oligonucleotide
tagtcaacggagcgacgtaccgaaa

SEQ ID NO: 702590 - DNA, 25 bp, Artificial sequence
  Synthetic oligonucleotide
ccttccagtcgcctaacgtaaatgc

SEQ ID NO: 702591 - DNA, 25 bp, Artificial sequence
  Synthetic oligonucleotide
catatatatacgtcgcgtcggcctc

SEQ ID NO: 702592 - DNA, 25 bp, Artificial sequence
  Synthetic oligonucleotide
catatatatacgacgcgtcggcctc

SEQ ID NO: 702593 - DNA, 25 bp, Artificial sequence
  Synthetic oligonucleotide
aaaatgtctaccggacgtcccagag

SEQ ID NO: 702594 - DNA, 25 bp, Artificial sequence
  Synthetic oligonucleotide
taaggggccgctagacgaagtaatc

SEQ ID NO: 702595 - DNA, 25 bp, Artificial sequence
  Synthetic oligonucleotide
caagctcgacgcacgatagactcta

SEQ ID NO: 702596 - DNA, 25 bp, Artificial sequence
  Synthetic oligonucleotide
caagctcgacgctcgatagactcta

SEQ ID NO: 702597 - DNA, 25 bp, Artificial sequence
  Synthetic oligonucleotide
ttcctgatcgcgttacacgactgtc

SEQ ID NO: 702598 - DNA, 25 bp, Artificial sequence
  Synthetic oligonucleotide
ttcctgatcgcgatacacgactgtc

SEQ ID NO: 702599 - DNA, 25 bp, Artificial sequence
  Synthetic oligonucleotide
gcctctccgtttggcggtaaactta

SEQ ID NO: 702600 - DNA, 25 bp, Artificial sequence
  Synthetic oligonucleotide
gcctctccgtttcgcggtaaactta

SEQ ID NO: 702601 - DNA, 25 bp, Artificial sequence
  Synthetic oligonucleotide
catctcaacgcggaaccgtggataa

SEQ ID NO: 702602 - DNA, 25 bp, Artificial sequence
  Synthetic oligonucleotide
catctcaacgcgcaaccgtggataa

SEQ ID NO: 702603 - DNA, 25 bp, Artificial sequence
  Synthetic oligonucleotide
tgagtagttaacccccgatgcactg

SEQ ID NO: 702604 - DNA, 25 bp, Artificial sequence
  Synthetic oligonucleotide
caagtaagtgcgacgtacgcgcaat

SEQ ID NO: 702605 - DNA, 25 bp, Artificial sequence
  Synthetic oligonucleotide
ccgttccgttcgggagtaataacac

SEQ ID NO: 702606 - DNA, 25 bp, Artificial sequence
  Synthetic oligonucleotide
acaggacgcgtaagcatagatgtcc

SEQ ID NO: 702607 - DNA, 25 bp, Artificial sequence
  Synthetic oligonucleotide
acaggacgcgtatgcatagatgtcc

SEQ ID NO: 702608 - DNA, 25 bp, Artificial sequence
  Synthetic oligonucleotide
gctcagctatacgagcggaacattc

SEQ ID NO: 702609 - DNA, 25 bp, Artificial sequence
  Synthetic oligonucleotide
gctcagctataccagcggaacattc

SEQ ID NO: 702610 - DNA, 25 bp, Artificial sequence
  Synthetic oligonucleotide
gacctattaacgaccggacagggta

SEQ ID NO: 702611 - DNA, 25 bp, Artificial sequence
  Synthetic oligonucleotide
gacctattaacgtccggacagggta

SEQ ID NO: 702612 - DNA, 25 bp, Artificial sequence
  Synthetic oligonucleotide
caccaatcgccgtttacgtgacatc

SEQ ID NO: 702613 - DNA, 25 bp, Artificial sequence
  Synthetic oligonucleotide
tatggtcgctagatcggtcccacta

SEQ ID NO: 702614 - DNA, 25 bp, Artificial sequence
  Synthetic oligonucleotide
atgtgatgcgacggtaataccggca

SEQ ID NO: 702615 - DNA, 25 bp, Artificial sequence
  Synthetic oligonucleotide
tgtgatccgacttacgcggaggttt

SEQ ID NO: 702616 - DNA, 25 bp, Artificial sequence
  Synthetic oligonucleotide
atgtgatgcgaccgtaataccggca

SEQ ID NO: 702617 - DNA, 25 bp, Artificial sequence
  Synthetic oligonucleotide
ccgttccgttcgcgagtaataacac

SEQ ID NO: 702618 - DNA, 25 bp, Artificial sequence
  Synthetic oligonucleotide
gaatcctagataggtcgcgtgagca

SEQ ID NO: 702619 - DNA, 25 bp, Artificial sequence
  Synthetic oligonucleotide
caccaatcgccgattacgtgacatc

SEQ ID NO: 702620 - DNA, 25 bp, Artificial sequence
  Synthetic oligonucleotide
caagtaagtgcgtcgtacgcgcaat

SEQ ID NO: 702621 - DNA, 25 bp, Artificial sequence
  Synthetic oligonucleotide
ccgcacatgcgccattaggtatctt

SEQ ID NO: 702622 - DNA, 25 bp, Artificial sequence
  Synthetic oligonucleotide
ccgcacatgcgcgattaggtatctt

SEQ ID NO: 702623 - DNA, 25 bp, Artificial sequence
  Synthetic oligonucleotide
gacacgcgattccacgtcctaattg

SEQ ID NO: 702624 - DNA, 25 bp, Artificial sequence
  Synthetic oligonucleotide
gacacgcgattcgacgtcctaattg

SEQ ID NO: 702625 - DNA, 25 bp, Artificial sequence
  Synthetic oligonucleotide
gcaagaacgtatgacgcgcaaaagc

SEQ ID NO: 702626 - DNA, 25 bp, Artificial sequence
  Synthetic oligonucleotide
gcaagaacgtatcacgcgcaaaagc

SEQ ID NO: 702627 - DNA, 25 bp, Artificial sequence
  Synthetic oligonucleotide
cgcgctcgaaagtcgtatcatcaag

SEQ ID NO: 702628 - DNA, 25 bp, Artificial sequence
  Synthetic oligonucleotide
cgcgctcgaaagacgtatcatcaag

SEQ ID NO: 702629 - DNA, 25 bp, Artificial sequence
  Synthetic oligonucleotide
catgcttacgcgaattcgcgcagaa

SEQ ID NO: 702630 - DNA, 25 bp, Artificial sequence
  Synthetic oligonucleotide
catgcttacgcgtattcgcgcagaa

SEQ ID NO: 702631 - DNA, 25 bp, Artificial sequence
  Synthetic oligonucleotide
taaggggccgcttgacgaagtaatc

SEQ ID NO: 702632 - DNA, 25 bp, Artificial sequence
  Synthetic oligonucleotide
gaatcctagatacgtcgcgtgagca

SEQ ID NO: 702633 - DNA, 25 bp, Artificial sequence
  Synthetic oligonucleotide
atctggaactccggtacgctaaagg

SEQ ID NO: 702634 - DNA, 25 bp, Artificial sequence
  Synthetic oligonucleotide
tccgaacctatacggcgcatatagc

SEQ ID NO: 702635 - DNA, 25 bp, Artificial sequence
  Synthetic oligonucleotide
tccgaacctatagggcgcatatagc

SEQ ID NO: 702636 - DNA, 25 bp, Artificial sequence
  Synthetic oligonucleotide
actttatccgcgggatagtagcagg

SEQ ID NO: 702637 - DNA, 25 bp, Artificial sequence
  Synthetic oligonucleotide
attgtgttcatcccgctagctcggt

SEQ ID NO: 702638 - DNA, 25 bp, Artificial sequence
  Synthetic oligonucleotide
gttcgcagtcgtattgcgcgataga

SEQ ID NO: 702639 - DNA, 25 bp, Artificial sequence
  Synthetic oligonucleotide
agacataatagtcgcgcccttgtcg

SEQ ID NO: 702640 - DNA, 25 bp, Artificial sequence
  Synthetic oligonucleotide
gaaccgcgcgtttggctactataag

SEQ ID NO: 702641 - DNA, 25 bp, Artificial sequence
  Synthetic oligonucleotide
agacataatagtggcgcccttgtcg

SEQ ID NO: 702642 - DNA, 25 bp, Artificial sequence
  Synthetic oligonucleotide
ttgggttccgtcctactagtgttgc

SEQ ID NO: 702643 - DNA, 25 bp, Artificial sequence
  Synthetic oligonucleotide
actttatccgcgcgatagtagcagg

SEQ ID NO: 702644 - DNA, 25 bp, Artificial sequence
  Synthetic oligonucleotide
ccaatttttacgtaccgcgctgcga

SEQ ID NO: 702645 - DNA, 25 bp, Artificial sequence
  Synthetic oligonucleotide
atctggaactcccgtacgctaaagg

SEQ ID NO: 702646 - DNA, 25 bp, Artificial sequence
  Synthetic oligonucleotide
gaaccgcgcgttaggctactataag

SEQ ID NO: 702647 - DNA, 25 bp, Artificial sequence
  Synthetic oligonucleotide
ctttcctaccgtatcgcgacatctg

SEQ ID NO: 702648 - DNA, 25 bp, Artificial sequence
  Synthetic oligonucleotide
ctttcctaccgtttcgcgacatctg

SEQ ID NO: 702649 - DNA, 25 bp, Artificial sequence
  Synthetic oligonucleotide
attgtgttcatcgcgctagctcggt

SEQ ID NO: 702650 - DNA, 25 bp, Artificial sequence
  Synthetic oligonucleotide
ttgggttccgtcgtactagtgttgc

SEQ ID NO: 702651 - DNA, 25 bp, Artificial sequence
  Synthetic oligonucleotide
ggtcgagtacgtatccgtttcgtga

SEQ ID NO: 702652 - DNA, 25 bp, Artificial sequence
  Synthetic oligonucleotide
ggtcgagtacgtttccgtttcgtga

SEQ ID NO: 702653 - DNA, 25 bp, Artificial sequence
  Synthetic oligonucleotide
gttgatgcgtacgtctgacctgtac

SEQ ID NO: 702654 - DNA, 25 bp, Artificial sequence
  Synthetic oligonucleotide
gttgatgcgtacctctgacctgtac

SEQ ID NO: 702655 - DNA, 25 bp, Artificial sequence
  Synthetic oligonucleotide
tcttatatacgcccgtctgcaacgc

SEQ ID NO: 702656 - DNA, 25 bp, Artificial sequence
  Synthetic oligonucleotide
tcttatatacgcgcgtctgcaacgc

SEQ ID NO: 702657 - DNA, 25 bp, Artificial sequence
  Synthetic oligonucleotide
gttcgcagtcgttttgcgcgataga

SEQ ID NO: 702658 - DNA, 25 bp, Artificial sequence
  Synthetic oligonucleotide
ccaatttttacgaaccgcgctgcga

SEQ ID NO: 702659 - DNA, 25 bp, Artificial sequence
  Synthetic oligonucleotide
tcttcattatatcgcgggcgcccag

SEQ ID NO: 702660 - DNA, 25 bp, Artificial sequence
  Synthetic oligonucleotide
gcatataggtatgcgtcgaccggac

SEQ ID NO: 702661 - DNA, 25 bp, Artificial sequence
  Synthetic oligonucleotide
gtaatccgtataccggcaagtgccc

SEQ ID NO: 702662 - DNA, 25 bp, Artificial sequence
  Synthetic oligonucleotide
gtaatccgtatagcggcaagtgccc

SEQ ID NO: 702663 - DNA, 25 bp, Artificial sequence
  Synthetic oligonucleotide
tggcttacgacccttgccttgacct

SEQ ID NO: 702664 - DNA, 25 bp, Artificial sequence
  Synthetic oligonucleotide
tggcttacgaccgttgccttgacct

SEQ ID NO: 702665 - DNA, 25 bp, Artificial sequence
  Synthetic oligonucleotide
aatacccgccgtacgactagctgca

SEQ ID NO: 702666 - DNA, 25 bp, Artificial sequence
  Synthetic oligonucleotide
tcgtgggatactccgtacgatggag

SEQ ID NO: 702667 - DNA, 25 bp, Artificial sequence
  Synthetic oligonucleotide
gcatataggtatccgtcgaccggac

SEQ ID NO: 702668 - DNA, 25 bp, Artificial sequence
  Synthetic oligonucleotide
tcttcattatatggcgggcgcccag

SEQ ID NO: 702669 - DNA, 25 bp, Artificial sequence
  Synthetic oligonucleotide
ttgtctcgcgtactccaaagcaccg

SEQ ID NO: 702670 - DNA, 25 bp, Artificial sequence
  Synthetic oligonucleotide
ctcgggcgtgttgggtacctttaca

SEQ ID NO: 702671 - DNA, 25 bp, Artificial sequence
  Synthetic oligonucleotide
ttgtctcgcgtagtccaaagcaccg

SEQ ID NO: 702672 - DNA, 25 bp, Artificial sequence
  Synthetic oligonucleotide
tcgtgggatactgcgtacgatggag

SEQ ID NO: 702673 - DNA, 25 bp, Artificial sequence
  Synthetic oligonucleotide
gacctgcggtacgagttagcatacg

SEQ ID NO: 702674 - DNA, 25 bp, Artificial sequence
  Synthetic oligonucleotide
gacctgcggtaccagttagcatacg

SEQ ID NO: 702675 - DNA, 25 bp, Artificial sequence
  Synthetic oligonucleotide
aatacccgccgttcgactagctgca

SEQ ID NO: 702676 - DNA, 25 bp, Artificial sequence
  Synthetic oligonucleotide
gttacaggcgtaatagacgccgtgc

SEQ ID NO: 702677 - DNA, 25 bp, Artificial sequence
  Synthetic oligonucleotide
aacggtctcttagcgcggaaacgac

SEQ ID NO: 702678 - DNA, 25 bp, Artificial sequence
  Synthetic oligonucleotide
cgaggccgacgtgcgatcttttcaa

SEQ ID NO: 702679 - DNA, 25 bp, Artificial sequence
  Synthetic oligonucleotide
cgaggccgacgtccgatcttttcaa

SEQ ID NO: 702680 - DNA, 25 bp, Artificial sequence
  Synthetic oligonucleotide
gtagtcaagcgcgggtacgagaaga

SEQ ID NO: 702681 - DNA, 25 bp, Artificial sequence
  Synthetic oligonucleotide
gtagtcaagcgccggtacgagaaga

SEQ ID NO: 702682 - DNA, 25 bp, Artificial sequence
  Synthetic oligonucleotide
ttgaagttcgcgcggctagtcagtc

SEQ ID NO: 702683 - DNA, 25 bp, Artificial sequence
  Synthetic oligonucleotide
ttgaagttcgcggggctagtcagtc

SEQ ID NO: 702684 - DNA, 25 bp, Artificial sequence
  Synthetic oligonucleotide
ctcatttacgacccggtatacgggg

SEQ ID NO: 702685 - DNA, 25 bp, Artificial sequence
  Synthetic oligonucleotide
aatcgatacgctggtacggagccac

SEQ ID NO: 702686 - DNA, 25 bp, Artificial sequence
  Synthetic oligonucleotide
gttacaggcgtattagacgccgtgc

SEQ ID NO: 702687 - DNA, 25 bp, Artificial sequence
  Synthetic oligonucleotide
cgaatggcgaatacggacgttgcct

SEQ ID NO: 702688 - DNA, 25 bp, Artificial sequence
  Synthetic oligonucleotide
accgattcgactacgtgcgttcagg

SEQ ID NO: 702689 - DNA, 25 bp, Artificial sequence
  Synthetic oligonucleotide
accgattcgacttcgtgcgttcagg

SEQ ID NO: 702690 - DNA, 25 bp, Artificial sequence
  Synthetic oligonucleotide
tcgtaatcgtccctcggtaggcatc

SEQ ID NO: 702691 - DNA, 25 bp, Artificial sequence
  Synthetic oligonucleotide
tcgtaatcgtccgtcggtaggcatc

SEQ ID NO: 702692 - DNA, 25 bp, Artificial sequence
  Synthetic oligonucleotide
acgtgagttcgactagtcgctcgtg

SEQ ID NO: 702693 - DNA, 25 bp, Artificial sequence
  Synthetic oligonucleotide
acgtgagttcgagtagtcgctcgtg

SEQ ID NO: 702694 - DNA, 25 bp, Artificial sequence
  Synthetic oligonucleotide
ctcgggcgtgttcggtacctttaca

SEQ ID NO: 702695 - DNA, 25 bp, Artificial sequence
  Synthetic oligonucleotide
aatcgatacgctcgtacggagccac

SEQ ID NO: 702696 - DNA, 25 bp, Artificial sequence
  Synthetic oligonucleotide
ctcatttacgacgcggtatacgggg

SEQ ID NO: 702697 - DNA, 25 bp, Artificial sequence
  Synthetic oligonucleotide
tacatgcacgaacgtctcgacaccg

SEQ ID NO: 702698 - DNA, 25 bp, Artificial sequence
  Synthetic oligonucleotide
gctcatctatgtgtcgcgaacggga

SEQ ID NO: 702699 - DNA, 25 bp, Artificial sequence
  Synthetic oligonucleotide
gcctagaacgtatcgacgcaagacc

SEQ ID NO: 702700 - DNA, 25 bp, Artificial sequence
  Synthetic oligonucleotide
gggtcacgctaggccgattaagtca

SEQ ID NO: 702701 - DNA, 25 bp, Artificial sequence
  Synthetic oligonucleotide
ctggtgacgcggactaatgacgtgt

SEQ ID NO: 702702 - DNA, 25 bp, Artificial sequence
  Synthetic oligonucleotide
ctggtgacgcggtctaatgacgtgt

SEQ ID NO: 702703 - DNA, 25 bp, Artificial sequence
  Synthetic oligonucleotide
caactaatgtctaggcgcgacccca

SEQ ID NO: 702704 - DNA, 25 bp, Artificial sequence
  Synthetic oligonucleotide
caactaatgtcttggcgcgacccca

SEQ ID NO: 702705 - DNA, 25 bp, Artificial sequence
  Synthetic oligonucleotide
gcacccttctatcgcgagcctgtta

SEQ ID NO: 702706 - DNA, 25 bp, Artificial sequence
  Synthetic oligonucleotide
gcacccttctatggcgagcctgtta

SEQ ID NO: 702707 - DNA, 25 bp, Artificial sequence
  Synthetic oligonucleotide
gttaggagcgcctatcgagtcgtct

SEQ ID NO: 702708 - DNA, 25 bp, Artificial sequence
  Synthetic oligonucleotide
gttaggagcgccaatcgagtcgtct

SEQ ID NO: 702709 - DNA, 25 bp, Artificial sequence
  Synthetic oligonucleotide
tttacgctaacgtccgcgtacggac

SEQ ID NO: 702710 - DNA, 25 bp, Artificial sequence
  Synthetic oligonucleotide
tgtggatcgatacgcggactcccat

SEQ ID NO: 702711 - DNA, 25 bp, Artificial sequence
  Synthetic oligonucleotide
gctcatctatgtctcgcgaacggga

SEQ ID NO: 702712 - DNA, 25 bp, Artificial sequence
  Synthetic oligonucleotide
tgtggatcgataggcggactcccat

SEQ ID NO: 702713 - DNA, 25 bp, Artificial sequence
  Synthetic oligonucleotide
caaaggctacgtggcgcatgattcg

SEQ ID NO: 702714 - DNA, 25 bp, Artificial sequence
  Synthetic oligonucleotide
caaaggctacgtcgcgcatgattcg

SEQ ID NO: 702715 - DNA, 25 bp, Artificial sequence
  Synthetic oligonucleotide
gcctagaacgtaacgacgcaagacc

SEQ ID NO: 702716 - DNA, 25 bp, Artificial sequence
  Synthetic oligonucleotide
tacatgcacgaaggtctcgacaccg

SEQ ID NO: 702717 - DNA, 25 bp, Artificial sequence
  Synthetic oligonucleotide
aagcgtgccgggcgaattatcgcat

SEQ ID NO: 702718 - DNA, 25 bp, Artificial sequence
  Synthetic oligonucleotide
aagcgtgccgggggaattatcgcat

SEQ ID NO: 702719 - DNA, 25 bp, Artificial sequence
  Synthetic oligonucleotide
cggaatcgtcgtaaacgcctagctg

SEQ ID NO: 702720 - DNA, 25 bp, Artificial sequence
  Synthetic oligonucleotide
cggaatcgtcgttaacgcctagctg

SEQ ID NO: 702721 - DNA, 25 bp, Artificial sequence
  Synthetic oligonucleotide
cacgcaaacctaacgccgatggtca

SEQ ID NO: 702722 - DNA, 25 bp, Artificial sequence
  Synthetic oligonucleotide
cacgcaaacctatcgccgatggtca

SEQ ID NO: 702723 - DNA, 25 bp, Artificial sequence
  Synthetic oligonucleotide
gtgcctaccgtcccataagcatggt

SEQ ID NO: 702724 - DNA, 25 bp, Artificial sequence
  Synthetic oligonucleotide
cgaatggcgaattcggacgttgcct

SEQ ID NO: 702725 - DNA, 25 bp, Artificial sequence
  Synthetic oligonucleotide
tttacgctaacgaccgcgtacggac

SEQ ID NO: 702726 - DNA, 25 bp, Artificial sequence
  Synthetic oligonucleotide
gtgggacgcaaggggatagttacag

SEQ ID NO: 702727 - DNA, 25 bp, Artificial sequence
  Synthetic oligonucleotide
ctcaacctacgtgcgacgtcatcct

SEQ ID NO: 702728 - DNA, 25 bp, Artificial sequence
  Synthetic oligonucleotide
ctcaacctacgtccgacgtcatcct

SEQ ID NO: 702729 - DNA, 25 bp, Artificial sequence
  Synthetic oligonucleotide
gcatgtctgcgccaatagggtcaac

SEQ ID NO: 702730 - DNA, 25 bp, Artificial sequence
  Synthetic oligonucleotide
gcatgtctgcgcgaatagggtcaac

SEQ ID NO: 702731 - DNA, 25 bp, Artificial sequence
  Synthetic oligonucleotide
gactctctacgcccgtctaggtttc

SEQ ID NO: 702732 - DNA, 25 bp, Artificial sequence
  Synthetic oligonucleotide
gactctctacgcgcgtctaggtttc

SEQ ID NO: 702733 - DNA, 25 bp, Artificial sequence
  Synthetic oligonucleotide
accgtggtgtatacggtcggattcc

SEQ ID NO: 702734 - DNA, 25 bp, Artificial sequence
  Synthetic oligonucleotide
accgtggtgtattcggtcggattcc

SEQ ID NO: 702735 - DNA, 25 bp, Artificial sequence
  Synthetic oligonucleotide
tctttgcgcgtaagacgcaggctac

SEQ ID NO: 702736 - DNA, 25 bp, Artificial sequence
  Synthetic oligonucleotide
tctttgcgcgtatgacgcaggctac

SEQ ID NO: 702737 - DNA, 25 bp, Artificial sequence
  Synthetic oligonucleotide
tagactcgcgtttgacggttagcgg

SEQ ID NO: 702738 - DNA, 25 bp, Artificial sequence
  Synthetic oligonucleotide
gggtcacgctagcccgattaagtca

SEQ ID NO: 702739 - DNA, 25 bp, Artificial sequence
  Synthetic oligonucleotide
gtgggacgcaagcggatagttacag

SEQ ID NO: 702740 - DNA, 25 bp, Artificial sequence
  Synthetic oligonucleotide
aacggtctcttaccgcggaaacgac

SEQ ID NO: 702741 - DNA, 25 bp, Artificial sequence
  Synthetic oligonucleotide
gcagcatcgcaccatatacgggtca

SEQ ID NO: 702742 - DNA, 25 bp, Artificial sequence
  Synthetic oligonucleotide
gcagcatcgcacgatatacgggtca

SEQ ID NO: 702743 - DNA, 25 bp, Artificial sequence
  Synthetic oligonucleotide
gtgcgcgtacgaggctatacatacg

SEQ ID NO: 702744 - DNA, 25 bp, Artificial sequence
  Synthetic oligonucleotide
gtgcgcgtacgacgctatacatacg

SEQ ID NO: 702745 - DNA, 25 bp, Artificial sequence
  Synthetic oligonucleotide
catttcccgtaaggcgcaatggtcc

SEQ ID NO: 702746 - DNA, 25 bp, Artificial sequence
  Synthetic oligonucleotide
catttcccgtaacgcgcaatggtcc

SEQ ID NO: 702747 - DNA, 25 bp, Artificial sequence
  Synthetic oligonucleotide
gcgctgattagtggcgcgatgaagt

SEQ ID NO: 702748 - DNA, 25 bp, Artificial sequence
  Synthetic oligonucleotide
gcgctgattagtcgcgcgatgaagt

SEQ ID NO: 702749 - DNA, 25 bp, Artificial sequence
  Synthetic oligonucleotide
agaggtcggtaccatgcgtagtgtg

SEQ ID NO: 702750 - DNA, 25 bp, Artificial sequence
  Synthetic oligonucleotide
agaggtcggtacgatgcgtagtgtg

SEQ ID NO: 702751 - DNA, 25 bp, Artificial sequence
  Synthetic oligonucleotide
cgtgtcgatcggcgctttaacttgc

SEQ ID NO: 702752 - DNA, 25 bp, Artificial sequence
  Synthetic oligonucleotide
cgtgtcgatcggggctttaacttgc

SEQ ID NO: 702753 - DNA, 25 bp, Artificial sequence
  Synthetic oligonucleotide
tagactcgcgttagacggttagcgg

SEQ ID NO: 702754 - DNA, 25 bp, Artificial sequence
  Synthetic oligonucleotide
gctgtacgattcccgcataacgggt

SEQ ID NO: 702755 - DNA, 25 bp, Artificial sequence
  Synthetic oligonucleotide
ctaatctcgtaaggtgctcacggcc

SEQ ID NO: 702756 - DNA, 25 bp, Artificial sequence
  Synthetic oligonucleotide
ctaatctcgtaacgtgctcacggcc

SEQ ID NO: 702757 - DNA, 25 bp, Artificial sequence
  Synthetic oligonucleotide
ctgcactcggcgggacataaccatt

SEQ ID NO: 702758 - DNA, 25 bp, Artificial sequence
  Synthetic oligonucleotide
ctgcactcggcgcgacataaccatt

SEQ ID NO: 702759 - DNA, 25 bp, Artificial sequence
  Synthetic oligonucleotide
cttttagcgacgggttgatggtccc

SEQ ID NO: 702760 - DNA, 25 bp, Artificial sequence
  Synthetic oligonucleotide
cttttagcgacgcgttgatggtccc

SEQ ID NO: 702761 - DNA, 25 bp, Artificial sequence
  Synthetic oligonucleotide
tccggaacacgcggtatcgaactca

SEQ ID NO: 702762 - DNA, 25 bp, Artificial sequence
  Synthetic oligonucleotide
tccggaacacgccgtatcgaactca

SEQ ID NO: 702763 - DNA, 25 bp, Artificial sequence
  Synthetic oligonucleotide
ttgagttacgctcgagcgatggacg

SEQ ID NO: 702764 - DNA, 25 bp, Artificial sequence
  Synthetic oligonucleotide
ctgctcccgtacaatcgtgtgaacg

SEQ ID NO: 702765 - DNA, 25 bp, Artificial sequence
  Synthetic oligonucleotide
gctgtacgattcgcgcataacgggt

SEQ ID NO: 702766 - DNA, 25 bp, Artificial sequence
  Synthetic oligonucleotide
ccaatcacggataaccgggtgtctc

SEQ ID NO: 702767 - DNA, 25 bp, Artificial sequence
  Synthetic oligonucleotide
ccacgatactaaggacgcgacccta

SEQ ID NO: 702768 - DNA, 25 bp, Artificial sequence
  Synthetic oligonucleotide
ccacgatactaacgacgcgacccta

SEQ ID NO: 702769 - DNA, 25 bp, Artificial sequence
  Synthetic oligonucleotide
ccccttgttcgtacgcgattgaggt

SEQ ID NO: 702770 - DNA, 25 bp, Artificial sequence
  Synthetic oligonucleotide
ccccttgttcgttcgcgattgaggt

SEQ ID NO: 702771 - DNA, 25 bp, Artificial sequence
  Synthetic oligonucleotide
gtcgtgatagcgacgcgcacatatg

SEQ ID NO: 702772 - DNA, 25 bp, Artificial sequence
  Synthetic oligonucleotide
gtcgtgatagcgtcgcgcacatatg

SEQ ID NO: 702773 - DNA, 25 bp, Artificial sequence
  Synthetic oligonucleotide
aggccaaccgcgcgttagatgaaag

SEQ ID NO: 702774 - DNA, 25 bp, Artificial sequence
  Synthetic oligonucleotide
aggccaaccgcgggttagatgaaag

SEQ ID NO: 702775 - DNA, 25 bp, Artificial sequence
  Synthetic oligonucleotide
agggcaatatcgcgacgggaaagga

SEQ ID NO: 702776 - DNA, 25 bp, Artificial sequence
  Synthetic oligonucleotide
ccgcatctcgcgggaatagcactat

SEQ ID NO: 702777 - DNA, 25 bp, Artificial sequence
  Synthetic oligonucleotide
ttgagttacgctggagcgatggacg

SEQ ID NO: 702778 - DNA, 25 bp, Artificial sequence
  Synthetic oligonucleotide
atatgtcacgatatacgcgcgcggc

SEQ ID NO: 702779 - DNA, 25 bp, Artificial sequence
  Synthetic oligonucleotide
ggcagcgattccccgatcactttct

SEQ ID NO: 702780 - DNA, 25 bp, Artificial sequence
  Synthetic oligonucleotide
ccgcatctcgcgcgaatagcactat

SEQ ID NO: 702781 - DNA, 25 bp, Artificial sequence
  Synthetic oligonucleotide
gtgcctaccgtcgcataagcatggt

SEQ ID NO: 702782 - DNA, 25 bp, Artificial sequence
  Synthetic oligonucleotide
gtttcgggcataacacgcgctactg

SEQ ID NO: 702783 - DNA, 25 bp, Artificial sequence
  Synthetic oligonucleotide
gtttcgggcatatcacgcgctactg

SEQ ID NO: 702784 - DNA, 25 bp, Artificial sequence
  Synthetic oligonucleotide
taggcccgtcacgcgtagaaacaac

SEQ ID NO: 702785 - DNA, 25 bp, Artificial sequence
  Synthetic oligonucleotide
taggcccgtcacccgtagaaacaac

SEQ ID NO: 702786 - DNA, 25 bp, Artificial sequence
  Synthetic oligonucleotide
acagagatgcgggttcggtagccaa

SEQ ID NO: 702787 - DNA, 25 bp, Artificial sequence
  Synthetic oligonucleotide
acagagatgcggcttcggtagccaa

SEQ ID NO: 702788 - DNA, 25 bp, Artificial sequence
  Synthetic oligonucleotide
ggaaggtcgtatagacgctgcagtc

SEQ ID NO: 702789 - DNA, 25 bp, Artificial sequence
  Synthetic oligonucleotide
aggcaccgcgacgcgtatgattact

SEQ ID NO: 702790 - DNA, 25 bp, Artificial sequence
  Synthetic oligonucleotide
atatgtcacgatttacgcgcgcggc

SEQ ID NO: 702791 - DNA, 25 bp, Artificial sequence
  Synthetic oligonucleotide
aggcaccgcgacccgtatgattact

SEQ ID NO: 702792 - DNA, 25 bp, Artificial sequence
  Synthetic oligonucleotide
ccctatggtacctaacgcgttggct

SEQ ID NO: 702793 - DNA, 25 bp, Artificial sequence
  Synthetic oligonucleotide
ccctatggtaccaaacgcgttggct

SEQ ID NO: 702794 - DNA, 25 bp, Artificial sequence
  Synthetic oligonucleotide
cagacgttagacccgacgtcgtcaa

SEQ ID NO: 702795 - DNA, 25 bp, Artificial sequence
  Synthetic oligonucleotide
cagacgttagacgcgacgtcgtcaa

SEQ ID NO: 702796 - DNA, 25 bp, Artificial sequence
  Synthetic oligonucleotide
ctgtggacccgccattcgtgatttc

SEQ ID NO: 702797 - DNA, 25 bp, Artificial sequence
  Synthetic oligonucleotide
ctgtggacccgcgattcgtgatttc

SEQ ID NO: 702798 - DNA, 25 bp, Artificial sequence
  Synthetic oligonucleotide
agaagcacacgttacgcggtgcttg

SEQ ID NO: 702799 - DNA, 25 bp, Artificial sequence
  Synthetic oligonucleotide
agaagcacacgtaacgcggtgcttg

SEQ ID NO: 702800 - DNA, 25 bp, Artificial sequence
  Synthetic oligonucleotide
ccaatcacggattaccgggtgtctc

SEQ ID NO: 702801 - DNA, 25 bp, Artificial sequence
  Synthetic oligonucleotide
ctgctcccgtactatcgtgtgaacg

SEQ ID NO: 702802 - DNA, 25 bp, Artificial sequence
  Synthetic oligonucleotide
ggaaggtcgtattgacgctgcagtc

SEQ ID NO: 702803 - DNA, 25 bp, Artificial sequence
  Synthetic oligonucleotide
agcagccgtcggatctcgtgataga

SEQ ID NO: 702804 - DNA, 25 bp, Artificial sequence
  Synthetic oligonucleotide
cttagcgcgtaagggtcgtacaagc

SEQ ID NO: 702805 - DNA, 25 bp, Artificial sequence
  Synthetic oligonucleotide
cattactgttatcggaccgcgaggg

SEQ ID NO: 702806 - DNA, 25 bp, Artificial sequence
  Synthetic oligonucleotide
cattactgttatgggaccgcgaggg

SEQ ID NO: 702807 - DNA, 25 bp, Artificial sequence
  Synthetic oligonucleotide
tctgatgtaacgaagcgcggcctca

SEQ ID NO: 702808 - DNA, 25 bp, Artificial sequence
  Synthetic oligonucleotide
tctgatgtaacgtagcgcggcctca

SEQ ID NO: 702809 - DNA, 25 bp, Artificial sequence
  Synthetic oligonucleotide
gtatggcgctattcgaacctgtgcg

SEQ ID NO: 702810 - DNA, 25 bp, Artificial sequence
  Synthetic oligonucleotide
gtatggcgctatacgaacctgtgcg

SEQ ID NO: 702811 - DNA, 25 bp, Artificial sequence
  Synthetic oligonucleotide
cggtgtatatcgcgtccggcatagt

SEQ ID NO: 702812 - DNA, 25 bp, Artificial sequence
  Synthetic oligonucleotide
cggtgtatatcgggtccggcatagt

SEQ ID NO: 702813 - DNA, 25 bp, Artificial sequence
  Synthetic oligonucleotide
agggcaatatcgggacgggaaagga

SEQ ID NO: 702814 - DNA, 25 bp, Artificial sequence
  Synthetic oligonucleotide
ctaccggactagttccgcggaatag

SEQ ID NO: 702815 - DNA, 25 bp, Artificial sequence
  Synthetic oligonucleotide
agccctgacccgttacgaggtagta

SEQ ID NO: 702816 - DNA, 25 bp, Artificial sequence
  Synthetic oligonucleotide
agcagccgtcggttctcgtgataga

SEQ ID NO: 702817 - DNA, 25 bp, Artificial sequence
  Synthetic oligonucleotide
aatcgccccgtccgattcgttgtac

SEQ ID NO: 702818 - DNA, 25 bp, Artificial sequence
  Synthetic oligonucleotide
aatcgccccgtcggattcgttgtac

SEQ ID NO: 702819 - DNA, 25 bp, Artificial sequence
  Synthetic oligonucleotide
aggccaaggtcgtcgtacgcttatg

SEQ ID NO: 702820 - DNA, 25 bp, Artificial sequence
  Synthetic oligonucleotide
aggccaaggtcgacgtacgcttatg

SEQ ID NO: 702821 - DNA, 25 bp, Artificial sequence
  Synthetic oligonucleotide
ttagagacgggaggtatcggtaccc

SEQ ID NO: 702822 - DNA, 25 bp, Artificial sequence
  Synthetic oligonucleotide
ttagagacgggacgtatcggtaccc

SEQ ID NO: 702823 - DNA, 25 bp, Artificial sequence
  Synthetic oligonucleotide
cattggacgcgaaccgtagttacgg

SEQ ID NO: 702824 - DNA, 25 bp, Artificial sequence
  Synthetic oligonucleotide
cattggacgcgatccgtagttacgg

SEQ ID NO: 702825 - DNA, 25 bp, Artificial sequence
  Synthetic oligonucleotide
cccatacgtaggatggccgtgacat

SEQ ID NO: 702826 - DNA, 25 bp, Artificial sequence
  Synthetic oligonucleotide
ctaccggactagatccgcggaatag

SEQ ID NO: 702827 - DNA, 25 bp, Artificial sequence
  Synthetic oligonucleotide
ctccaaagactaacgcgctccaacg

SEQ ID NO: 702828 - DNA, 25 bp, Artificial sequence
  Synthetic oligonucleotide
tctccgttgtctcgcgacatgacct

SEQ ID NO: 702829 - DNA, 25 bp, Artificial sequence
  Synthetic oligonucleotide
tctccgttgtctggcgacatgacct

SEQ ID NO: 702830 - DNA, 25 bp, Artificial sequence
  Synthetic oligonucleotide
tcccaagttaccccccgtagctctt

SEQ ID NO: 702831 - DNA, 25 bp, Artificial sequence
  Synthetic oligonucleotide
tcccaagttaccgcccgtagctctt

SEQ ID NO: 702832 - DNA, 25 bp, Artificial sequence
  Synthetic oligonucleotide
atcaagcgcgattcggcaaggcgat

SEQ ID NO: 702833 - DNA, 25 bp, Artificial sequence
  Synthetic oligonucleotide
atcaagcgcgatacggcaaggcgat

SEQ ID NO: 702834 - DNA, 25 bp, Artificial sequence
  Synthetic oligonucleotide
acatcatcttacgagcggcagaggc

SEQ ID NO: 702835 - DNA, 25 bp, Artificial sequence
  Synthetic oligonucleotide
acatcatcttaccagcggcagaggc

SEQ ID NO: 702836 - DNA, 25 bp, Artificial sequence
  Synthetic oligonucleotide
gcccatgtactgctacgcgtatcag

SEQ ID NO: 702837 - DNA, 25 bp, Artificial sequence
  Synthetic oligonucleotide
gcccatgtactggtacgcgtatcag

SEQ ID NO: 702838 - DNA, 25 bp, Artificial sequence
  Synthetic oligonucleotide
cttagcgcgtaacggtcgtacaagc

SEQ ID NO: 702839 - DNA, 25 bp, Artificial sequence
  Synthetic oligonucleotide
cgaacgatagcggtaaccgagccat

SEQ ID NO: 702840 - DNA, 25 bp, Artificial sequence
  Synthetic oligonucleotide
agccctgacccgatacgaggtagta

SEQ ID NO: 702841 - DNA, 25 bp, Artificial sequence
  Synthetic oligonucleotide
ctccaaagactatcgcgctccaacg

SEQ ID NO: 702842 - DNA, 25 bp, Artificial sequence
  Synthetic oligonucleotide
tcgtattcgtcaatccgcgtgccga

SEQ ID NO: 702843 - DNA, 25 bp, Artificial sequence
  Synthetic oligonucleotide
tcgtattcgtcattccgcgtgccga

SEQ ID NO: 702844 - DNA, 25 bp, Artificial sequence
  Synthetic oligonucleotide
tgcctaccgtgccttcgaagacgta

SEQ ID NO: 702845 - DNA, 25 bp, Artificial sequence
  Synthetic oligonucleotide
tgcctaccgtgcgttcgaagacgta

SEQ ID NO: 702846 - DNA, 25 bp, Artificial sequence
  Synthetic oligonucleotide
aagggaataacgacggacgcccatg

SEQ ID NO: 702847 - DNA, 25 bp, Artificial sequence
  Synthetic oligonucleotide
aagggaataacgtcggacgcccatg

SEQ ID NO: 702848 - DNA, 25 bp, Artificial sequence
  Synthetic oligonucleotide
tgggaacgaagtaacgcggtcacga

SEQ ID NO: 702849 - DNA, 25 bp, Artificial sequence
  Synthetic oligonucleotide
tgggaacgaagttacgcggtcacga

SEQ ID NO: 702850 - DNA, 25 bp, Artificial sequence
  Synthetic oligonucleotide
cccatacgtaggttggccgtgacat

SEQ ID NO: 702851 - DNA, 25 bp, Artificial sequence
  Synthetic oligonucleotide
cgaacgatagcgctaaccgagccat

SEQ ID NO: 702852 - DNA, 25 bp, Artificial sequence
  Synthetic oligonucleotide
gttagacgcgcgtattaggctccct

SEQ ID NO: 702853 - DNA, 25 bp, Artificial sequence
  Synthetic oligonucleotide
acaaaagtacgccctcgtcagagcg

SEQ ID NO: 702854 - DNA, 25 bp, Artificial sequence
  Synthetic oligonucleotide
ggatagactctaacgcggcactagc

SEQ ID NO: 702855 - DNA, 25 bp, Artificial sequence
  Synthetic oligonucleotide
ggatagactctatcgcggcactagc

SEQ ID NO: 702856 - DNA, 25 bp, Artificial sequence
  Synthetic oligonucleotide
cgaattcggatagggtctagcgcct

SEQ ID NO: 702857 - DNA, 25 bp, Artificial sequence
  Synthetic oligonucleotide
cgaattcggatacggtctagcgcct

SEQ ID NO: 702858 - DNA, 25 bp, Artificial sequence
  Synthetic oligonucleotide
ctgtgtccgcataagtccgatgcct

SEQ ID NO: 702859 - DNA, 25 bp, Artificial sequence
  Synthetic oligonucleotide
ctgtgtccgcattagtccgatgcct

SEQ ID NO: 702860 - DNA, 25 bp, Artificial sequence
  Synthetic oligonucleotide
agttgatatcgcaagtgcggggctg

SEQ ID NO: 702861 - DNA, 25 bp, Artificial sequence
  Synthetic oligonucleotide
agttgatatcgctagtgcggggctg

SEQ ID NO: 702862 - DNA, 25 bp, Artificial sequence
  Synthetic oligonucleotide
ggctaaggaccgttatgcgtggcaa

SEQ ID NO: 702863 - DNA, 25 bp, Artificial sequence
  Synthetic oligonucleotide
gtcaggcgcacgttcgaaacgcaat

SEQ ID NO: 702864 - DNA, 25 bp, Artificial sequence
  Synthetic oligonucleotide
gttagacgcgcgaattaggctccct

SEQ ID NO: 702865 - DNA, 25 bp, Artificial sequence
  Synthetic oligonucleotide
cggtagtcgcgtcgtaacgagacaa

SEQ ID NO: 702866 - DNA, 25 bp, Artificial sequence
  Synthetic oligonucleotide
ccggccattggtacgcgaaagagtt

SEQ ID NO: 702867 - DNA, 25 bp, Artificial sequence
  Synthetic oligonucleotide
ccggccattggttcgcgaaagagtt

SEQ ID NO: 702868 - DNA, 25 bp, Artificial sequence
  Synthetic oligonucleotide
gagtggtagtcggcgtacgattgca

SEQ ID NO: 702869 - DNA, 25 bp, Artificial sequence
  Synthetic oligonucleotide
gagtggtagtcgccgtacgattgca

SEQ ID NO: 702870 - DNA, 25 bp, Artificial sequence
  Synthetic oligonucleotide
cgcacacttcgagccgtattcgtag

SEQ ID NO: 702871 - DNA, 25 bp, Artificial sequence
  Synthetic oligonucleotide
cgcacacttcgacccgtattcgtag

SEQ ID NO: 702872 - DNA, 25 bp, Artificial sequence
  Synthetic oligonucleotide
cgttttgcggattggtcggcggtaa

SEQ ID NO: 702873 - DNA, 25 bp, Artificial sequence
  Synthetic oligonucleotide
cgttttgcggataggtcggcggtaa

SEQ ID NO: 702874 - DNA, 25 bp, Artificial sequence
  Synthetic oligonucleotide
tgccactatcgcacgccgacgattt

SEQ ID NO: 702875 - DNA, 25 bp, Artificial sequence
  Synthetic oligonucleotide
tgccactatcgctcgccgacgattt

SEQ ID NO: 702876 - DNA, 25 bp, Artificial sequence
  Synthetic oligonucleotide
ggctaaggaccgatatgcgtggcaa

SEQ ID NO: 702877 - DNA, 25 bp, Artificial sequence
  Synthetic oligonucleotide
tacatgccggtcgtttaggtgctgg

SEQ ID NO: 702878 - DNA, 25 bp, Artificial sequence
  Synthetic oligonucleotide
gtcaggcgcacgatcgaaacgcaat

SEQ ID NO: 702879 - DNA, 25 bp, Artificial sequence
  Synthetic oligonucleotide
cgaaggtaactcgcgaagtacgcca

SEQ ID NO: 702880 - DNA, 25 bp, Artificial sequence
  Synthetic oligonucleotide
cgaaggtaactcccgaagtacgcca

SEQ ID NO: 702881 - DNA, 25 bp, Artificial sequence
  Synthetic oligonucleotide
ttgtaatacggagccgctaggtcgg

SEQ ID NO: 702882 - DNA, 25 bp, Artificial sequence
  Synthetic oligonucleotide
ttgtaatacggacccgctaggtcgg

SEQ ID NO: 702883 - DNA, 25 bp, Artificial sequence
  Synthetic oligonucleotide
atcagatacgtcggttaccgcccac

SEQ ID NO: 702884 - DNA, 25 bp, Artificial sequence
  Synthetic oligonucleotide
atcagatacgtccgttaccgcccac

SEQ ID NO: 702885 - DNA, 25 bp, Artificial sequence
  Synthetic oligonucleotide
ggacaccgtgcgttagacgatgttg

SEQ ID NO: 702886 - DNA, 25 bp, Artificial sequence
  Synthetic oligonucleotide
ggacaccgtgcgatagacgatgttg

SEQ ID NO: 702887 - DNA, 25 bp, Artificial sequence
  Synthetic oligonucleotide
aacacccgccgtacgaactctagtc

SEQ ID NO: 702888 - DNA, 25 bp, Artificial sequence
  Synthetic oligonucleotide
acaaaagtacgcgctcgtcagagcg

SEQ ID NO: 702889 - DNA, 25 bp, Artificial sequence
  Synthetic oligonucleotide
tacatgccggtcctttaggtgctgg

SEQ ID NO: 702890 - DNA, 25 bp, Artificial sequence
  Synthetic oligonucleotide
cggtagtcgcgtggtaacgagacaa

SEQ ID NO: 702891 - DNA, 25 bp, Artificial sequence
  Synthetic oligonucleotide
ttggggcgtaacggacgctcattgt

SEQ ID NO: 702892 - DNA, 25 bp, Artificial sequence
  Synthetic oligonucleotide
ttggggcgtaaccgacgctcattgt

SEQ ID NO: 702893 - DNA, 25 bp, Artificial sequence
  Synthetic oligonucleotide
ttcgggtcctagcgatacggttgac

SEQ ID NO: 702894 - DNA, 25 bp, Artificial sequence
  Synthetic oligonucleotide
acaccgccggtcctcacaaaatgag

SEQ ID NO: 702895 - DNA, 25 bp, Artificial sequence
  Synthetic oligonucleotide
tctaacggtccgccgtaatctaccg

SEQ ID NO: 702896 - DNA, 25 bp, Artificial sequence
  Synthetic oligonucleotide
tgctgaagtacgcttcgtctcagcg

SEQ ID NO: 702897 - DNA, 25 bp, Artificial sequence
  Synthetic oligonucleotide
atgctgcgattactacccgcggagt

SEQ ID NO: 702898 - DNA, 25 bp, Artificial sequence
  Synthetic oligonucleotide
atgctgcgattagtacccgcggagt

SEQ ID NO: 702899 - DNA, 25 bp, Artificial sequence
  Synthetic oligonucleotide
ttgggcatatgccgttccgacggaa

SEQ ID NO: 702900 - DNA, 25 bp, Artificial sequence
  Synthetic oligonucleotide
ttgggcatatgcggttccgacggaa

SEQ ID NO: 702901 - DNA, 25 bp, Artificial sequence
  Synthetic oligonucleotide
tttgccccgcgtcgtctataacctg

SEQ ID NO: 702902 - DNA, 25 bp, Artificial sequence
  Synthetic oligonucleotide
aacacccgccgttcgaactctagtc

SEQ ID NO: 702903 - DNA, 25 bp, Artificial sequence
  Synthetic oligonucleotide
gtaggacatgtttcgagcgacgtgc

SEQ ID NO: 702904 - DNA, 25 bp, Artificial sequence
  Synthetic oligonucleotide
agcgtgtattatggcgcccccaagt

SEQ ID NO: 702905 - DNA, 25 bp, Artificial sequence
  Synthetic oligonucleotide
aagcggccggtacgctaatacccat

SEQ ID NO: 702906 - DNA, 25 bp, Artificial sequence
  Synthetic oligonucleotide
atatctcgtacgagcgttctgcccg

SEQ ID NO: 702907 - DNA, 25 bp, Artificial sequence
  Synthetic oligonucleotide
atatctcgtacgtgcgttctgcccg

SEQ ID NO: 702908 - DNA, 25 bp, Artificial sequence
  Synthetic oligonucleotide
ctcatgcggcgttctcttaccgatc

SEQ ID NO: 702909 - DNA, 25 bp, Artificial sequence
  Synthetic oligonucleotide
ctcatgcggcgtactcttaccgatc

SEQ ID NO: 702910 - DNA, 25 bp, Artificial sequence
  Synthetic oligonucleotide
cataccacgtgaggcggtattgacc

SEQ ID NO: 702911 - DNA, 25 bp, Artificial sequence
  Synthetic oligonucleotide
cataccacgtgacgcggtattgacc

SEQ ID NO: 702912 - DNA, 25 bp, Artificial sequence
  Synthetic oligonucleotide
gagacgcgcgaggatagacagattc

SEQ ID NO: 702913 - DNA, 25 bp, Artificial sequence
  Synthetic oligonucleotide
gagacgcgcgagcatagacagattc

SEQ ID NO: 702914 - DNA, 25 bp, Artificial sequence
  Synthetic oligonucleotide
ccctacgtctcgaacgcgaatttgc

SEQ ID NO: 702915 - DNA, 25 bp, Artificial sequence
  Synthetic oligonucleotide
gagtgaattacgccggaccagctga

SEQ ID NO: 702916 - DNA, 25 bp, Artificial sequence
  Synthetic oligonucleotide
ccctacgtctcgtacgcgaatttgc

SEQ ID NO: 702917 - DNA, 25 bp, Artificial sequence
  Synthetic oligonucleotide
gtaggacatgttacgagcgacgtgc

SEQ ID NO: 702918 - DNA, 25 bp, Artificial sequence
  Synthetic oligonucleotide
agtttccgcacgtacggtctctacg

SEQ ID NO: 702919 - DNA, 25 bp, Artificial sequence
  Synthetic oligonucleotide
agtttccgcacgaacggtctctacg

SEQ ID NO: 702920 - DNA, 25 bp, Artificial sequence
  Synthetic oligonucleotide
gcatcaactcggaacgtcgcagaag

SEQ ID NO: 702921 - DNA, 25 bp, Artificial sequence
  Synthetic oligonucleotide
gcatcaactcggtacgtcgcagaag

SEQ ID NO: 702922 - DNA, 25 bp, Artificial sequence
  Synthetic oligonucleotide
tgtgttgcgcgatacgacttccgct

SEQ ID NO: 702923 - DNA, 25 bp, Artificial sequence
  Synthetic oligonucleotide
tgtgttgcgcgaaacgacttccgct

SEQ ID NO: 702924 - DNA, 25 bp, Artificial sequence
  Synthetic oligonucleotide
ctcaccatagtcgtaccggcttgtg

SEQ ID NO: 702925 - DNA, 25 bp, Artificial sequence
  Synthetic oligonucleotide
ctcaccatagtcctaccggcttgtg

SEQ ID NO: 702926 - DNA, 25 bp, Artificial sequence
  Synthetic oligonucleotide
acgcagatcggcgtatcgctatgga

SEQ ID NO: 702927 - DNA, 25 bp, Artificial sequence
  Synthetic oligonucleotide
acgcagatcggcctatcgctatgga

SEQ ID NO: 702928 - DNA, 25 bp, Artificial sequence
  Synthetic oligonucleotide
gagtgaattacggcggaccagctga

SEQ ID NO: 702929 - DNA, 25 bp, Artificial sequence
  Synthetic oligonucleotide
ctgatcacgataccccccgtgttag

SEQ ID NO: 702930 - DNA, 25 bp, Artificial sequence
  Synthetic oligonucleotide
acaccgccggtcgtcacaaaatgag

SEQ ID NO: 702931 - DNA, 25 bp, Artificial sequence
  Synthetic oligonucleotide
tttgccccgcgtggtctataacctg

SEQ ID NO: 702932 - DNA, 25 bp, Artificial sequence
  Synthetic oligonucleotide
aacagtcgtcgttacacgcctaccc

SEQ ID NO: 702933 - DNA, 25 bp, Artificial sequence
  Synthetic oligonucleotide
aacagtcgtcgtaacacgcctaccc

SEQ ID NO: 702934 - DNA, 25 bp, Artificial sequence
  Synthetic oligonucleotide
gaagatcgagtatcgcgctcaggtg

SEQ ID NO: 702935 - DNA, 25 bp, Artificial sequence
  Synthetic oligonucleotide
gaagatcgagtaacgcgctcaggtg

SEQ ID NO: 702936 - DNA, 25 bp, Artificial sequence
  Synthetic oligonucleotide
acaggcgttaccgcgcgtaatgttc

SEQ ID NO: 702937 - DNA, 25 bp, Artificial sequence
  Synthetic oligonucleotide
acaggcgttaccccgcgtaatgttc

SEQ ID NO: 702938 - DNA, 25 bp, Artificial sequence
  Synthetic oligonucleotide
ctcgtccctacccatagcgtatcac

SEQ ID NO: 702939 - DNA, 25 bp, Artificial sequence
  Synthetic oligonucleotide
ctcgtccctaccgatagcgtatcac

SEQ ID NO: 702940 - DNA, 25 bp, Artificial sequence
  Synthetic oligonucleotide
aagcggccggtaggctaatacccat

SEQ ID NO: 702941 - DNA, 25 bp, Artificial sequence
  Synthetic oligonucleotide
agcctgaccgttatgccgccaattg

SEQ ID NO: 702942 - DNA, 25 bp, Artificial sequence
  Synthetic oligonucleotide
agcgtgtattatcgcgcccccaagt

SEQ ID NO: 702943 - DNA, 25 bp, Artificial sequence
  Synthetic oligonucleotide
ctgatcacgatagcccccgtgttag

SEQ ID NO: 702944 - DNA, 25 bp, Artificial sequence
  Synthetic oligonucleotide
tcaaccaacggctcgtacgtagtcc

SEQ ID NO: 702945 - DNA, 25 bp, Artificial sequence
  Synthetic oligonucleotide
tcaaccaacggcacgtacgtagtcc

SEQ ID NO: 702946 - DNA, 25 bp, Artificial sequence
  Synthetic oligonucleotide
gcgggtcgtactataccgggcaatt

SEQ ID NO: 702947 - DNA, 25 bp, Artificial sequence
  Synthetic oligonucleotide
gcgggtcgtactttaccgggcaatt

SEQ ID NO: 702948 - DNA, 25 bp, Artificial sequence
  Synthetic oligonucleotide
agacattcggtcttcgcgttagccc

SEQ ID NO: 702949 - DNA, 25 bp, Artificial sequence
  Synthetic oligonucleotide
agacattcggtcatcgcgttagccc

SEQ ID NO: 702950 - DNA, 25 bp, Artificial sequence
  Synthetic oligonucleotide
atagtctgcgtaggagacgccgtac

SEQ ID NO: 702951 - DNA, 25 bp, Artificial sequence
  Synthetic oligonucleotide
atagtctgcgtacgagacgccgtac

SEQ ID NO: 702952 - DNA, 25 bp, Artificial sequence
  Synthetic oligonucleotide
ccttgtcgacgctttactacccctc

SEQ ID NO: 702953 - DNA, 25 bp, Artificial sequence
  Synthetic oligonucleotide
ccttgtcgacgcattactacccctc

SEQ ID NO: 702954 - DNA, 25 bp, Artificial sequence
  Synthetic oligonucleotide
agcctgaccgttttgccgccaattg

SEQ ID NO: 702955 - DNA, 25 bp, Artificial sequence
  Synthetic oligonucleotide
gcaggctcggcgtaacactgattca

SEQ ID NO: 702956 - DNA, 25 bp, Artificial sequence
  Synthetic oligonucleotide
ccctaataggtacgcgggaagctca

SEQ ID NO: 702957 - DNA, 25 bp, Artificial sequence
  Synthetic oligonucleotide
cgtagtgtccgcccaaaacacccaa

SEQ ID NO: 702958 - DNA, 25 bp, Artificial sequence
  Synthetic oligonucleotide
cgtagtgtccgcgcaaaacacccaa

SEQ ID NO: 702959 - DNA, 25 bp, Artificial sequence
  Synthetic oligonucleotide
tgcttatgcgcgttaccgttgtcgc

SEQ ID NO: 702960 - DNA, 25 bp, Artificial sequence
  Synthetic oligonucleotide
tgcttatgcgcgataccgttgtcgc

SEQ ID NO: 702961 - DNA, 25 bp, Artificial sequence
  Synthetic oligonucleotide
tgctgaagtacggttcgtctcagcg

SEQ ID NO: 702962 - DNA, 25 bp, Artificial sequence
  Synthetic oligonucleotide
gcgaatcgcgtaggtaacgatcacc

SEQ ID NO: 702963 - DNA, 25 bp, Artificial sequence
  Synthetic oligonucleotide
tcttcagatacgcgcccgtctatgg

SEQ ID NO: 702964 - DNA, 25 bp, Artificial sequence
  Synthetic oligonucleotide
acaccgcgcgaaatagcgtccatct

SEQ ID NO: 702965 - DNA, 25 bp, Artificial sequence
  Synthetic oligonucleotide
acagccttagcgatacgggcaagtg

SEQ ID NO: 702966 - DNA, 25 bp, Artificial sequence
  Synthetic oligonucleotide
tctagctccgacctacctaagtcgc

SEQ ID NO: 702967 - DNA, 25 bp, Artificial sequence
  Synthetic oligonucleotide
gcaggctcggcgaaacactgattca

SEQ ID NO: 702968 - DNA, 25 bp, Artificial sequence
  Synthetic oligonucleotide
gtaagggaattaggcgtcgtcggag

SEQ ID NO: 702969 - DNA, 25 bp, Artificial sequence
  Synthetic oligonucleotide
acaagctacgcggacggttacgagt

SEQ ID NO: 702970 - DNA, 25 bp, Artificial sequence
  Synthetic oligonucleotide
acaagctacgcgcacggttacgagt

SEQ ID NO: 702971 - DNA, 25 bp, Artificial sequence
  Synthetic oligonucleotide
actcaagcgctaaatgacggccctg

SEQ ID NO: 702972 - DNA, 25 bp, Artificial sequence
  Synthetic oligonucleotide
actcaagcgctatatgacggccctg

SEQ ID NO: 702973 - DNA, 25 bp, Artificial sequence
  Synthetic oligonucleotide
gaggggtacgtatgtcgcgaatgtg

SEQ ID NO: 702974 - DNA, 25 bp, Artificial sequence
  Synthetic oligonucleotide
gaggggtacgtaagtcgcgaatgtg

SEQ ID NO: 702975 - DNA, 25 bp, Artificial sequence
  Synthetic oligonucleotide
ataatccgggtctcgcgtagggtag

SEQ ID NO: 702976 - DNA, 25 bp, Artificial sequence
  Synthetic oligonucleotide
ataatccgggtcacgcgtagggtag

SEQ ID NO: 702977 - DNA, 25 bp, Artificial sequence
  Synthetic oligonucleotide
gaacctccgaaccacctagcgatct

SEQ ID NO: 702978 - DNA, 25 bp, Artificial sequence
  Synthetic oligonucleotide
gaacctccgaacgacctagcgatct

SEQ ID NO: 702979 - DNA, 25 bp, Artificial sequence
  Synthetic oligonucleotide
ccctaataggtaggcgggaagctca

SEQ ID NO: 702980 - DNA, 25 bp, Artificial sequence
  Synthetic oligonucleotide
acagccttagcgttacgggcaagtg

SEQ ID NO: 702981 - DNA, 25 bp, Artificial sequence
  Synthetic oligonucleotide
gagtacattacccccgcgtacgcta

SEQ ID NO: 702982 - DNA, 25 bp, Artificial sequence
  Synthetic oligonucleotide
ttcgggtcctagggatacggttgac

SEQ ID NO: 702983 - DNA, 25 bp, Artificial sequence
  Synthetic oligonucleotide
tgttctcgcgctagtcgtaaccagg

SEQ ID NO: 702984 - DNA, 25 bp, Artificial sequence
  Synthetic oligonucleotide
tgttctcgcgcttgtcgtaaccagg

SEQ ID NO: 702985 - DNA, 25 bp, Artificial sequence
  Synthetic oligonucleotide
ctggcgcgtacgccgactataatct

SEQ ID NO: 702986 - DNA, 25 bp, Artificial sequence
  Synthetic oligonucleotide
ctggcgcgtacggcgactataatct

SEQ ID NO: 702987 - DNA, 25 bp, Artificial sequence
  Synthetic oligonucleotide
cctatgcctagtacgtcgaccccaa

SEQ ID NO: 702988 - DNA, 25 bp, Artificial sequence
  Synthetic oligonucleotide
cctatgcctagttcgtcgaccccaa

SEQ ID NO: 702989 - DNA, 25 bp, Artificial sequence
  Synthetic oligonucleotide
cgtcacaaacgcccgataggagaga

SEQ ID NO: 702990 - DNA, 25 bp, Artificial sequence
  Synthetic oligonucleotide
cgtcacaaacgcgcgataggagaga

SEQ ID NO: 702991 - DNA, 25 bp, Artificial sequence
  Synthetic oligonucleotide
caaacagtcatcacgcgaacgccac

SEQ ID NO: 702992 - DNA, 25 bp, Artificial sequence
  Synthetic oligonucleotide
tctagctccgacgtacctaagtcgc

SEQ ID NO: 702993 - DNA, 25 bp, Artificial sequence
  Synthetic oligonucleotide
gagtacattaccgccgcgtacgcta

SEQ ID NO: 702994 - DNA, 25 bp, Artificial sequence
  Synthetic oligonucleotide
acaccgcgcgaattagcgtccatct

SEQ ID NO: 702995 - DNA, 25 bp, Artificial sequence
  Synthetic oligonucleotide
cgttcgtgcgtttagaccgtgctga

SEQ ID NO: 702996 - DNA, 25 bp, Artificial sequence
  Synthetic oligonucleotide
cgttcgtgcgttaagaccgtgctga

SEQ ID NO: 702997 - DNA, 25 bp, Artificial sequence
  Synthetic oligonucleotide
gtgcgtatagcggcattcgtgtgga

SEQ ID NO: 702998 - DNA, 25 bp, Artificial sequence
  Synthetic oligonucleotide
gtgcgtatagcgccattcgtgtgga

SEQ ID NO: 702999 - DNA, 25 bp, Artificial sequence
  Synthetic oligonucleotide
tgtactgggttaaccgcgtgatccc

SEQ ID NO: 703000 - DNA, 25 bp, Artificial sequence
  Synthetic oligonucleotide
tgtactgggttatccgcgtgatccc

SEQ ID NO: 703001 - DNA, 25 bp, Artificial sequence
  Synthetic oligonucleotide
tcaggggcgcgtgacgtatagtatc

SEQ ID NO: 703002 - DNA, 25 bp, Artificial sequence
  Synthetic oligonucleotide
tcaggggcgcgtcacgtatagtatc

SEQ ID NO: 703003 - DNA, 25 bp, Artificial sequence
  Synthetic oligonucleotide
cgtatggttgcgtctacgtcgggaa

SEQ ID NO: 703004 - DNA, 25 bp, Artificial sequence
  Synthetic oligonucleotide
cgtatggttgcgactacgtcgggaa

SEQ ID NO: 703005 - DNA, 25 bp, Artificial sequence
  Synthetic oligonucleotide
gtaagggaattacgcgtcgtcggag

SEQ ID NO: 703006 - DNA, 25 bp, Artificial sequence
  Synthetic oligonucleotide
caaacagtcatctcgcgaacgccac

SEQ ID NO: 703007 - DNA, 25 bp, Artificial sequence
  Synthetic oligonucleotide
tacaggctacgcgcgaaactcaagc

SEQ ID NO: 703008 - DNA, 25 bp, Artificial sequence
  Synthetic oligonucleotide
aacgtgtccgcgctcggtatctcta

SEQ ID NO: 703009 - DNA, 25 bp, Artificial sequence
  Synthetic oligonucleotide
tccagttcgtagcgtcgcgttgaca

SEQ ID NO: 703010 - DNA, 25 bp, Artificial sequence
  Synthetic oligonucleotide
tccagttcgtagggtcgcgttgaca

SEQ ID NO: 703011 - DNA, 25 bp, Artificial sequence
  Synthetic oligonucleotide
tgtgctaaaccgaccgcgcatagtc

SEQ ID NO: 703012 - DNA, 25 bp, Artificial sequence
  Synthetic oligonucleotide
tgtgctaaaccgtccgcgcatagtc

SEQ ID NO: 703013 - DNA, 25 bp, Artificial sequence
  Synthetic oligonucleotide
tctaacggtccggcgtaatctaccg

SEQ ID NO: 703014 - DNA, 25 bp, Artificial sequence
  Synthetic oligonucleotide
ggcagcgattccgcgatcactttct

SEQ ID NO: 703015 - DNA, 25 bp, Artificial sequence
  Synthetic oligonucleotide
ccctaggttagctcgcgtacaacgt

SEQ ID NO: 703016 - DNA, 25 bp, Artificial sequence
  Synthetic oligonucleotide
ccctaggttagcacgcgtacaacgt

SEQ ID NO: 703017 - DNA, 25 bp, Artificial sequence
  Synthetic oligonucleotide
catagtcgcgcgtccaaaaaggcga

SEQ ID NO: 703018 - DNA, 25 bp, Artificial sequence
  Synthetic oligonucleotide
aacgtgtccgcggtcggtatctcta

SEQ ID NO: 703019 - DNA, 25 bp, Artificial sequence
  Synthetic oligonucleotide
tacaggctacgcccgaaactcaagc

SEQ ID NO: 703020 - DNA, 25 bp, Artificial sequence
  Synthetic oligonucleotide
tggtatcggcgtcaatcgtgtggtg

SEQ ID NO: 703021 - DNA, 25 bp, Artificial sequence
  Synthetic oligonucleotide
gcacggacccgcgagtaatagcttt

SEQ ID NO: 703022 - DNA, 25 bp, Artificial sequence
  Synthetic oligonucleotide
gcacggacccgccagtaatagcttt

SEQ ID NO: 703023 - DNA, 25 bp, Artificial sequence
  Synthetic oligonucleotide
tggtatcggcgtgaatcgtgtggtg

SEQ ID NO: 703024 - DNA, 25 bp, Artificial sequence
  Synthetic oligonucleotide
atgccaagctatcgccggtagtctc

SEQ ID NO: 703025 - DNA, 25 bp, Artificial sequence
  Synthetic oligonucleotide
tcgaggggtaacctaccgctcttac

SEQ ID NO: 703026 - DNA, 25 bp, Artificial sequence
  Synthetic oligonucleotide
gcgaatcgcgtacgtaacgatcacc

SEQ ID NO: 703027 - DNA, 25 bp, Artificial sequence
  Synthetic oligonucleotide
gatatgcatgtcgggttcgaggtgc

SEQ ID NO: 703028 - DNA, 25 bp, Artificial sequence
  Synthetic oligonucleotide
gatatgcatgtccggttcgaggtgc

SEQ ID NO: 703029 - DNA, 25 bp, Artificial sequence
  Synthetic oligonucleotide
tcctcctcgtaacccgcaaagtgga

SEQ ID NO: 703030 - DNA, 25 bp, Artificial sequence
  Synthetic oligonucleotide
tcctcctcgtaagccgcaaagtgga

SEQ ID NO: 703031 - DNA, 25 bp, Artificial sequence
  Synthetic oligonucleotide
tcttcagatacgggcccgtctatgg

SEQ ID NO: 703032 - DNA, 25 bp, Artificial sequence
  Synthetic oligonucleotide
catagtcgcgcgaccaaaaaggcga

SEQ ID NO: 703033 - DNA, 25 bp, Artificial sequence
  Synthetic oligonucleotide
acagatttacgaacgtcccctgggg

SEQ ID NO: 703034 - DNA, 25 bp, Artificial sequence
  Synthetic oligonucleotide
tcgaggggtaacgtaccgctcttac

SEQ ID NO: 703035 - DNA, 25 bp, Artificial sequence
  Synthetic oligonucleotide
gcttacgttcgcgataacgcgttgc

SEQ ID NO: 703036 - DNA, 25 bp, Artificial sequence
  Synthetic oligonucleotide
atgccaagctatggccggtagtctc

SEQ ID NO: 703037 - DNA, 25 bp, Artificial sequence
  Synthetic oligonucleotide
gtgtgatagcgcgagctatctggtg

SEQ ID NO: 703038 - DNA, 25 bp, Artificial sequence
  Synthetic oligonucleotide
acagatttacgatcgtcccctgggg

SEQ ID NO: 703039 - DNA, 25 bp, Artificial sequence
  Synthetic oligonucleotide
agcggtaattggcctcgcgtcaaag

SEQ ID NO: 703040 - DNA, 25 bp, Artificial sequence
  Synthetic oligonucleotide
agcggtaattgggctcgcgtcaaag

SEQ ID NO: 703041 - DNA, 25 bp, Artificial sequence
  Synthetic oligonucleotide
gaattacgcaacgctagtggctcgc

SEQ ID NO: 703042 - DNA, 25 bp, Artificial sequence
  Synthetic oligonucleotide
gaattacgcaaccctagtggctcgc

SEQ ID NO: 703043 - DNA, 25 bp, Artificial sequence
  Synthetic oligonucleotide
ccattagttcgaaagcgcagcaggc

SEQ ID NO: 703044 - DNA, 25 bp, Artificial sequence
  Synthetic oligonucleotide
ccattagttcgatagcgcagcaggc

SEQ ID NO: 703045 - DNA, 25 bp, Artificial sequence
  Synthetic oligonucleotide
gcatttatagtgggtcggtcgcctg

SEQ ID NO: 703046 - DNA, 25 bp, Artificial sequence
  Synthetic oligonucleotide
ggttttcagataggcgtcggtaggg

SEQ ID NO: 703047 - DNA, 25 bp, Artificial sequence
  Synthetic oligonucleotide
ggggtcatcgtgcggtaagatgatg

SEQ ID NO: 703048 - DNA, 25 bp, Artificial sequence
  Synthetic oligonucleotide
ggggtcatcgtggggtaagatgatg

SEQ ID NO: 703049 - DNA, 25 bp, Artificial sequence
  Synthetic oligonucleotide
acgccttttggactacgcgcacctt

SEQ ID NO: 703050 - DNA, 25 bp, Artificial sequence
  Synthetic oligonucleotide
acgccttttggagtacgcgcacctt

SEQ ID NO: 703051 - DNA, 25 bp, Artificial sequence
  Synthetic oligonucleotide
cccccgtagcgtcgtacgaacatta

SEQ ID NO: 703052 - DNA, 25 bp, Artificial sequence
  Synthetic oligonucleotide
cccccgtagcgtggtacgaacatta

SEQ ID NO: 703053 - DNA, 25 bp, Artificial sequence
  Synthetic oligonucleotide
gtcacttaccgtggaacgatggctg

SEQ ID NO: 703054 - DNA, 25 bp, Artificial sequence
  Synthetic oligonucleotide
gtcacttaccgtcgaacgatggctg

SEQ ID NO: 703055 - DNA, 25 bp, Artificial sequence
  Synthetic oligonucleotide
gcttacgttcgccataacgcgttgc

SEQ ID NO: 703056 - DNA, 25 bp, Artificial sequence
  Synthetic oligonucleotide
ggttttcagatacgcgtcggtaggg

SEQ ID NO: 703057 - DNA, 25 bp, Artificial sequence
  Synthetic oligonucleotide
gtgtgatagcgccagctatctggtg

SEQ ID NO: 703058 - DNA, 25 bp, Artificial sequence
  Synthetic oligonucleotide
gcatttatagtgcgtcggtcgcctg

SEQ ID NO: 703059 - DNA, 25 bp, Artificial sequence
  Synthetic oligonucleotide
cctgtgcgatcgggttaggtatcgg

SEQ ID NO: 703060 - DNA, 25 bp, Artificial sequence
  Synthetic oligonucleotide
tggagttaacgttccgcgggacgga

SEQ ID NO: 703061 - DNA, 25 bp, Artificial sequence
  Synthetic oligonucleotide
tggagttaacgtaccgcgggacgga

SEQ ID NO: 703062 - DNA, 25 bp, Artificial sequence
  Synthetic oligonucleotide
cgccgtggcgcatcctagtaaaagc

SEQ ID NO: 703063 - DNA, 25 bp, Artificial sequence
  Synthetic oligonucleotide
cctgtgcgatcgcgttaggtatcgg

SEQ ID NO: 703064 - DNA, 25 bp, Artificial sequence
  Synthetic oligonucleotide
tgacggctacgagccgcgtccaaaa

SEQ ID NO: 703065 - DNA, 25 bp, Artificial sequence
  Synthetic oligonucleotide
tttctgttcgcgacgactcgcctcg

SEQ ID NO: 703066 - DNA, 25 bp, Artificial sequence
  Synthetic oligonucleotide
tgacggctacgacccgcgtccaaaa

SEQ ID NO: 703067 - DNA, 25 bp, Artificial sequence
  Synthetic oligonucleotide
cgccgtggcgcaacctagtaaaagc

SEQ ID NO: 703068 - DNA, 25 bp, Artificial sequence
  Synthetic oligonucleotide
acagtgccgagacgttacgacggct

SEQ ID NO: 703069 - DNA, 25 bp, Artificial sequence
  Synthetic oligonucleotide
acagtgccgagaggttacgacggct

SEQ ID NO: 703070 - DNA, 25 bp, Artificial sequence
  Synthetic oligonucleotide
ttgacgtacgtcggagcgcatcgct

SEQ ID NO: 703071 - DNA, 25 bp, Artificial sequence
  Synthetic oligonucleotide
tttctgttcgcgtcgactcgcctcg

SEQ ID NO: 703072 - DNA, 25 bp, Artificial sequence
  Synthetic oligonucleotide
gtcagagcgagaatacgcggtaggc

SEQ ID NO: 703073 - DNA, 25 bp, Artificial sequence
  Synthetic oligonucleotide
gtcagagcgagattacgcggtaggc

SEQ ID NO: 703074 - DNA, 25 bp, Artificial sequence
  Synthetic oligonucleotide
cgaacctgcggcctgtcgttttggt

SEQ ID NO: 703075 - DNA, 25 bp, Artificial sequence
  Synthetic oligonucleotide
gccatgatctagctgcgcggtatgc

SEQ ID NO: 703076 - DNA, 25 bp, Artificial sequence
  Synthetic oligonucleotide
ttgacgtacgtccgagcgcatcgct

SEQ ID NO: 703077 - DNA, 25 bp, Artificial sequence
  Synthetic oligonucleotide
ggtactgcgaatggttcccgcttcc

SEQ ID NO: 703078 - DNA, 25 bp, Artificial sequence
  Synthetic oligonucleotide
gtgcctacccgtacggatatcgtcg

SEQ ID NO: 703079 - DNA, 25 bp, Artificial sequence
  Synthetic oligonucleotide
tgtgctgcgctatgtcggaagaggc

SEQ ID NO: 703080 - DNA, 25 bp, Artificial sequence
  Synthetic oligonucleotide
cgaagatagtcgccccgaaccttgc

SEQ ID NO: 703081 - DNA, 25 bp, Artificial sequence
  Synthetic oligonucleotide
tgtgctgcgctaagtcggaagaggc

SEQ ID NO: 703082 - DNA, 25 bp, Artificial sequence
  Synthetic oligonucleotide
gccatgatctaggtgcgcggtatgc

SEQ ID NO: 703083 - DNA, 25 bp, Artificial sequence
  Synthetic oligonucleotide
cggaataacgcgcgcattacggtcc

SEQ ID NO: 703084 - DNA, 25 bp, Artificial sequence
  Synthetic oligonucleotide
cggaataacgcgggcattacggtcc

SEQ ID NO: 703085 - DNA, 25 bp, Artificial sequence
  Synthetic oligonucleotide
ctgtgcaacgcgtgatcgctagtcc

SEQ ID NO: 703086 - DNA, 25 bp, Artificial sequence
  Synthetic oligonucleotide
cgaacctgcggcgtgtcgttttggt

SEQ ID NO: 703087 - DNA, 25 bp, Artificial sequence
  Synthetic oligonucleotide
ggtactgcgaatcgttcccgcttcc

SEQ ID NO: 703088 - DNA, 25 bp, Artificial sequence
  Synthetic oligonucleotide
gtagtcgacgttacgtcgccagagc

SEQ ID NO: 703089 - DNA, 25 bp, Artificial sequence
  Synthetic oligonucleotide
gtagtcgacgtttcgtcgccagagc

SEQ ID NO: 703090 - DNA, 25 bp, Artificial sequence
  Synthetic oligonucleotide
actgaacgggcgtcgtgtactgcgt

SEQ ID NO: 703091 - DNA, 25 bp, Artificial sequence
  Synthetic oligonucleotide
actgaacgggcgacgtgtactgcgt

SEQ ID NO: 703092 - DNA, 25 bp, Artificial sequence
  Synthetic oligonucleotide
tgaggccggactaatgcggagttcg

SEQ ID NO: 703093 - DNA, 25 bp, Artificial sequence
  Synthetic oligonucleotide
tgaggccggacttatgcggagttcg

SEQ ID NO: 703094 - DNA, 25 bp, Artificial sequence
  Synthetic oligonucleotide
ctgtgcaacgcgagatcgctagtcc

SEQ ID NO: 703095 - DNA, 25 bp, Artificial sequence
  Synthetic oligonucleotide
actcactagcgacgttcggagctgc

SEQ ID NO: 703096 - DNA, 25 bp, Artificial sequence
  Synthetic oligonucleotide
gccatccgcacgctatacggggttt

SEQ ID NO: 703097 - DNA, 25 bp, Artificial sequence
  Synthetic oligonucleotide
ttctagcgttaatcgggccgccacg

SEQ ID NO: 703098 - DNA, 25 bp, Artificial sequence
  Synthetic oligonucleotide
ttctagcgttaaacgggccgccacg

SEQ ID NO: 703099 - DNA, 25 bp, Artificial sequence
  Synthetic oligonucleotide
tgctcataacggttcgccgcgcttg

SEQ ID NO: 703100 - DNA, 25 bp, Artificial sequence
  Synthetic oligonucleotide
tgctcataacggatcgccgcgcttg

SEQ ID NO: 703101 - DNA, 25 bp, Artificial sequence
  Synthetic oligonucleotide
tcctaccatgccacgcgtacggaga

SEQ ID NO: 703102 - DNA, 25 bp, Artificial sequence
  Synthetic oligonucleotide
tcctaccatgcctcgcgtacggaga

SEQ ID NO: 703103 - DNA, 25 bp, Artificial sequence
  Synthetic oligonucleotide
gcttcgtcgtacaccgacgctgaac

SEQ ID NO: 703104 - DNA, 25 bp, Artificial sequence
  Synthetic oligonucleotide
tggatacgcgcttcgatgtacgggc

SEQ ID NO: 703105 - DNA, 25 bp, Artificial sequence
  Synthetic oligonucleotide
actcactagcgaggttcggagctgc

SEQ ID NO: 703106 - DNA, 25 bp, Artificial sequence
  Synthetic oligonucleotide
atcctcacggtacgcgttaggcctc

SEQ ID NO: 703107 - DNA, 25 bp, Artificial sequence
  Synthetic oligonucleotide
cctcttaaactctagcgcgaggggg

SEQ ID NO: 703108 - DNA, 25 bp, Artificial sequence
  Synthetic oligonucleotide
cctcttaaactcaagcgcgaggggg

SEQ ID NO: 703109 - DNA, 25 bp, Artificial sequence
  Synthetic oligonucleotide
tgcgcgcgacgaaacgtcactctga

SEQ ID NO: 703110 - DNA, 25 bp, Artificial sequence
  Synthetic oligonucleotide
tgcgcgcgacgatacgtcactctga

SEQ ID NO: 703111 - DNA, 25 bp, Artificial sequence
  Synthetic oligonucleotide
ggcgtgtacgtaccgctcctaaggt

SEQ ID NO: 703112 - DNA, 25 bp, Artificial sequence
  Synthetic oligonucleotide
ggcgtgtacgtagcgctcctaaggt

SEQ ID NO: 703113 - DNA, 25 bp, Artificial sequence
  Synthetic oligonucleotide
agcacggacgcggtcgtatgtacgt

SEQ ID NO: 703114 - DNA, 25 bp, Artificial sequence
  Synthetic oligonucleotide
agcacggacgcgctcgtatgtacgt

SEQ ID NO: 703115 - DNA, 25 bp, Artificial sequence
  Synthetic oligonucleotide
atcgggtaatgttccgcgaccgtgc

SEQ ID NO: 703116 - DNA, 25 bp, Artificial sequence
  Synthetic oligonucleotide
gcttcgtcgtactccgacgctgaac

SEQ ID NO: 703117 - DNA, 25 bp, Artificial sequence
  Synthetic oligonucleotide
atgccccgccgatcgtactctagtc

SEQ ID NO: 703118 - DNA, 25 bp, Artificial sequence
  Synthetic oligonucleotide
tcccgacgaggccacgatagtgaca

SEQ ID NO: 703119 - DNA, 25 bp, Artificial sequence
  Synthetic oligonucleotide
ttcccaacgatgggcgtcgacagct

SEQ ID NO: 703120 - DNA, 25 bp, Artificial sequence
  Synthetic oligonucleotide
ccggtcagctcgggcgatataatgc

SEQ ID NO: 703121 - DNA, 25 bp, Artificial sequence
  Synthetic oligonucleotide
ccggtcagctcgcgcgatataatgc

SEQ ID NO: 703122 - DNA, 25 bp, Artificial sequence
  Synthetic oligonucleotide
tcgatccgggccgtacgtaacttgg

SEQ ID NO: 703123 - DNA, 25 bp, Artificial sequence
  Synthetic oligonucleotide
tcgatccgggccctacgtaacttgg

SEQ ID NO: 703124 - DNA, 25 bp, Artificial sequence
  Synthetic oligonucleotide
ggagcctatccgcgacatatgtcgc

SEQ ID NO: 703125 - DNA, 25 bp, Artificial sequence
  Synthetic oligonucleotide
ggagcctatccgggacatatgtcgc

SEQ ID NO: 703126 - DNA, 25 bp, Artificial sequence
  Synthetic oligonucleotide
tgggggataggcccgatcgaagaag

SEQ ID NO: 703127 - DNA, 25 bp, Artificial sequence
  Synthetic oligonucleotide
gccatccgcacggtatacggggttt

SEQ ID NO: 703128 - DNA, 25 bp, Artificial sequence
  Synthetic oligonucleotide
atgccccgccgaacgtactctagtc

SEQ ID NO: 703129 - DNA, 25 bp, Artificial sequence
  Synthetic oligonucleotide
atcctcacggtaggcgttaggcctc

SEQ ID NO: 703130 - DNA, 25 bp, Artificial sequence
  Synthetic oligonucleotide
caaccagcccgtagtacgctatccg

SEQ ID NO: 703131 - DNA, 25 bp, Artificial sequence
  Synthetic oligonucleotide
caaccagcccgttgtacgctatccg

SEQ ID NO: 703132 - DNA, 25 bp, Artificial sequence
  Synthetic oligonucleotide
aggagctcgcgttcctatcggttcg

SEQ ID NO: 703133 - DNA, 25 bp, Artificial sequence
  Synthetic oligonucleotide
aggagctcgcgtacctatcggttcg

SEQ ID NO: 703134 - DNA, 25 bp, Artificial sequence
  Synthetic oligonucleotide
gtgccccgcgataggtagccgtaat

SEQ ID NO: 703135 - DNA, 25 bp, Artificial sequence
  Synthetic oligonucleotide
gtgccccgcgattggtagccgtaat

SEQ ID NO: 703136 - DNA, 25 bp, Artificial sequence
  Synthetic oligonucleotide
ctctcctacgtcggctagcggatgt

SEQ ID NO: 703137 - DNA, 25 bp, Artificial sequence
  Synthetic oligonucleotide
ctctcctacgtccgctagcggatgt

SEQ ID NO: 703138 - DNA, 25 bp, Artificial sequence
  Synthetic oligonucleotide
gttcgcacgcgaaatctcgaggacg

SEQ ID NO: 703139 - DNA, 25 bp, Artificial sequence
  Synthetic oligonucleotide
tgggggataggcgcgatcgaagaag

SEQ ID NO: 703140 - DNA, 25 bp, Artificial sequence
  Synthetic oligonucleotide
cggcgtcgtatactgccgcatgttc

SEQ ID NO: 703141 - DNA, 25 bp, Artificial sequence
  Synthetic oligonucleotide
atcgggtaatgtaccgcgaccgtgc

SEQ ID NO: 703142 - DNA, 25 bp, Artificial sequence
  Synthetic oligonucleotide
ccatggcgatacccgaccgatccaa

SEQ ID NO: 703143 - DNA, 25 bp, Artificial sequence
  Synthetic oligonucleotide
agccaccggtgttacgtcgacacga

SEQ ID NO: 703144 - DNA, 25 bp, Artificial sequence
  Synthetic oligonucleotide
agccaccggtgtaacgtcgacacga

SEQ ID NO: 703145 - DNA, 25 bp, Artificial sequence
  Synthetic oligonucleotide
tgcacccgaccaacccgatctccat

SEQ ID NO: 703146 - DNA, 25 bp, Artificial sequence
  Synthetic oligonucleotide
tgcacccgaccatcccgatctccat

SEQ ID NO: 703147 - DNA, 25 bp, Artificial sequence
  Synthetic oligonucleotide
cccacgatagctcgcgtaccgtagt

SEQ ID NO: 703148 - DNA, 25 bp, Artificial sequence
  Synthetic oligonucleotide
cccacgatagctggcgtaccgtagt

SEQ ID NO: 703149 - DNA, 25 bp, Artificial sequence
  Synthetic oligonucleotide
cttcgctccgaaggcggtactagtg

SEQ ID NO: 703150 - DNA, 25 bp, Artificial sequence
  Synthetic oligonucleotide
gtgctccgcacccattagtaagcgc

SEQ ID NO: 703151 - DNA, 25 bp, Artificial sequence
  Synthetic oligonucleotide
cggcgtcgtatagtgccgcatgttc

SEQ ID NO: 703152 - DNA, 25 bp, Artificial sequence
  Synthetic oligonucleotide
gtgctccgcaccgattagtaagcgc

SEQ ID NO: 703153 - DNA, 25 bp, Artificial sequence
  Synthetic oligonucleotide
tcgcgcatagcgcgtcctacagatc

SEQ ID NO: 703154 - DNA, 25 bp, Artificial sequence
  Synthetic oligonucleotide
tcgcgcatagcgggtcctacagatc

SEQ ID NO: 703155 - DNA, 25 bp, Artificial sequence
  Synthetic oligonucleotide
ccgtaccgcgcgaagtatatcgagc

SEQ ID NO: 703156 - DNA, 25 bp, Artificial sequence
  Synthetic oligonucleotide
ccgtaccgcgcgtagtatatcgagc

SEQ ID NO: 703157 - DNA, 25 bp, Artificial sequence
  Synthetic oligonucleotide
ccgtccacgcgtaagtcgaactgtc

SEQ ID NO: 703158 - DNA, 25 bp, Artificial sequence
  Synthetic oligonucleotide
ccgtccacgcgttagtcgaactgtc

SEQ ID NO: 703159 - DNA, 25 bp, Artificial sequence
  Synthetic oligonucleotide
gagctgtgagcgggcgtacttttgg

SEQ ID NO: 703160 - DNA, 25 bp, Artificial sequence
  Synthetic oligonucleotide
gagctgtgagcgcgcgtacttttgg

SEQ ID NO: 703161 - DNA, 25 bp, Artificial sequence
  Synthetic oligonucleotide
tcccgacgaggcgacgatagtgaca

SEQ ID NO: 703162 - DNA, 25 bp, Artificial sequence
  Synthetic oligonucleotide
cttcgctccgaacgcggtactagtg

SEQ ID NO: 703163 - DNA, 25 bp, Artificial sequence
  Synthetic oligonucleotide
tacctctaggttggcgagcttcggg

SEQ ID NO: 703164 - DNA, 25 bp, Artificial sequence
  Synthetic oligonucleotide
tggatacgcgctacgatgtacgggc

SEQ ID NO: 703165 - DNA, 25 bp, Artificial sequence
  Synthetic oligonucleotide
tgctcttggatcccggttaagcgcc

SEQ ID NO: 703166 - DNA, 25 bp, Artificial sequence
  Synthetic oligonucleotide
tgctcttggatcgcggttaagcgcc

SEQ ID NO: 703167 - DNA, 25 bp, Artificial sequence
  Synthetic oligonucleotide
ggagagacgcgccctaagttgctct

SEQ ID NO: 703168 - DNA, 25 bp, Artificial sequence
  Synthetic oligonucleotide
ggagagacgcgcgctaagttgctct

SEQ ID NO: 703169 - DNA, 25 bp, Artificial sequence
  Synthetic oligonucleotide
gcggaggcgaaccgtataccatgca

SEQ ID NO: 703170 - DNA, 25 bp, Artificial sequence
  Synthetic oligonucleotide
gcggaggcgaacggtataccatgca

SEQ ID NO: 703171 - DNA, 25 bp, Artificial sequence
  Synthetic oligonucleotide
acaagccggtactcgtcgtgcatcg

SEQ ID NO: 703172 - DNA, 25 bp, Artificial sequence
  Synthetic oligonucleotide
acaagccggtacacgtcgtgcatcg

SEQ ID NO: 703173 - DNA, 25 bp, Artificial sequence
  Synthetic oligonucleotide
ccatggcgatacgcgaccgatccaa

SEQ ID NO: 703174 - DNA, 25 bp, Artificial sequence
  Synthetic oligonucleotide
gaatgccatgtcccgcctacgccat

SEQ ID NO: 703175 - DNA, 25 bp, Artificial sequence
  Synthetic oligonucleotide
gttcgcacgcgatatctcgaggacg

SEQ ID NO: 703176 - DNA, 25 bp, Artificial sequence
  Synthetic oligonucleotide
tacctctaggttcgcgagcttcggg

SEQ ID NO: 703177 - DNA, 25 bp, Artificial sequence
  Synthetic oligonucleotide
tcgcgacgctgcccgattaaggcta

SEQ ID NO: 703178 - DNA, 25 bp, Artificial sequence
  Synthetic oligonucleotide
tcgcgacgctgcgcgattaaggcta

SEQ ID NO: 703179 - DNA, 25 bp, Artificial sequence
  Synthetic oligonucleotide
gcgactaacgcgcctaggcttagag

SEQ ID NO: 703180 - DNA, 25 bp, Artificial sequence
  Synthetic oligonucleotide
gcgactaacgcggctaggcttagag

SEQ ID NO: 703181 - DNA, 25 bp, Artificial sequence
  Synthetic oligonucleotide
gttcaccgcgagacttagctcgacc

SEQ ID NO: 703182 - DNA, 25 bp, Artificial sequence
  Synthetic oligonucleotide
gttcaccgcgagtcttagctcgacc

SEQ ID NO: 703183 - DNA, 25 bp, Artificial sequence
  Synthetic oligonucleotide
gcgtcctggggtacgtcgacattca

SEQ ID NO: 703184 - DNA, 25 bp, Artificial sequence
  Synthetic oligonucleotide
gcgtcctggggttcgtcgacattca

SEQ ID NO: 703185 - DNA, 25 bp, Artificial sequence
  Synthetic oligonucleotide
gaatgccatgtcgcgcctacgccat

SEQ ID NO: 703186 - DNA, 25 bp, Artificial sequence
  Synthetic oligonucleotide
gcgttaccatacccgccgaagctga

SEQ ID NO: 703187 - DNA, 25 bp, Artificial sequence
  Synthetic oligonucleotide
acgctgtaccgttcgcgcacaaagg

SEQ ID NO: 703188 - DNA, 25 bp, Artificial sequence
  Synthetic oligonucleotide
acgctgtaccgtacgcgcacaaagg

SEQ ID NO: 703189 - DNA, 25 bp, Artificial sequence
  Synthetic oligonucleotide
ctcacgcgtacgggcgattatgggt

SEQ ID NO: 703190 - DNA, 25 bp, Artificial sequence
  Synthetic oligonucleotide
ctcacgcgtacgcgcgattatgggt

SEQ ID NO: 703191 - DNA, 25 bp, Artificial sequence
  Synthetic oligonucleotide
ctgccgcgtatcgtacgggctcatt

SEQ ID NO: 703192 - DNA, 25 bp, Artificial sequence
  Synthetic oligonucleotide
ctgccgcgtatcctacgggctcatt

SEQ ID NO: 703193 - DNA, 25 bp, Artificial sequence
  Synthetic oligonucleotide
cccttacggaccacgatactggctc

SEQ ID NO: 703194 - DNA, 25 bp, Artificial sequence
  Synthetic oligonucleotide
cccttacggacctcgatactggctc

SEQ ID NO: 703195 - DNA, 25 bp, Artificial sequence
  Synthetic oligonucleotide
ttcccaacgatgcgcgtcgacagct

SEQ ID NO: 703196 - DNA, 25 bp, Artificial sequence
  Synthetic oligonucleotide
cgccgcgtatcgaacggagatctga

SEQ ID NO: 703197 - DNA, 25 bp, Artificial sequence
  Synthetic oligonucleotide
gtgggtggtatatagcgcgcctcca

SEQ ID NO: 703198 - DNA, 25 bp, Artificial sequence
  Synthetic oligonucleotide
gcgttaccatacgcgccgaagctga

SEQ ID NO: 703199 - DNA, 25 bp, Artificial sequence
  Synthetic oligonucleotide
ctgatgccgaccgcgtaaaaaggcc

SEQ ID NO: 703200 - DNA, 25 bp, Artificial sequence
  Synthetic oligonucleotide
ctgatgccgaccccgtaaaaaggcc

SEQ ID NO: 703201 - DNA, 25 bp, Artificial sequence
  Synthetic oligonucleotide
cccaccgatcgacgttcgctaaagc

SEQ ID NO: 703202 - DNA, 25 bp, Artificial sequence
  Synthetic oligonucleotide
cccaccgatcgaggttcgctaaagc

SEQ ID NO: 703203 - DNA, 25 bp, Artificial sequence
  Synthetic oligonucleotide
caacaaacggtattacggcgcgcgg

SEQ ID NO: 703204 - DNA, 25 bp, Artificial sequence
  Synthetic oligonucleotide
caacaaacggtaatacggcgcgcgg

SEQ ID NO: 703205 - DNA, 25 bp, Artificial sequence
  Synthetic oligonucleotide
gagatgccgtacgcgatacatggcc

SEQ ID NO: 703206 - DNA, 25 bp, Artificial sequence
  Synthetic oligonucleotide
gagatgccgtacccgatacatggcc

SEQ ID NO: 703207 - DNA, 25 bp, Artificial sequence
  Synthetic oligonucleotide
cgccgcgtatcgtacggagatctga

SEQ ID NO: 703208 - DNA, 25 bp, Artificial sequence
  Synthetic oligonucleotide
cgggcaacttattcccgcgtgtcac

SEQ ID NO: 703209 - DNA, 25 bp, Artificial sequence
  Synthetic oligonucleotide
agcaccattgacaaccgcgcgccaa

SEQ ID NO: 703210 - DNA, 25 bp, Artificial sequence
  Synthetic oligonucleotide
tacccttaacggttcgccgcgatgc

SEQ ID NO: 703211 - DNA, 25 bp, Artificial sequence
  Synthetic oligonucleotide
tacccttaacggatcgccgcgatgc

SEQ ID NO: 703212 - DNA, 25 bp, Artificial sequence
  Synthetic oligonucleotide
cgcctttagactgtccgcggtaacc

SEQ ID NO: 703213 - DNA, 25 bp, Artificial sequence
  Synthetic oligonucleotide
cgcctttagactctccgcggtaacc

SEQ ID NO: 703214 - DNA, 25 bp, Artificial sequence
  Synthetic oligonucleotide
cgacagtataccgcgggcgcttttc

SEQ ID NO: 703215 - DNA, 25 bp, Artificial sequence
  Synthetic oligonucleotide
cgacagtataccccgggcgcttttc

SEQ ID NO: 703216 - DNA, 25 bp, Artificial sequence
  Synthetic oligonucleotide
gtaatcatagcgcttcgcgctggcc

SEQ ID NO: 703217 - DNA, 25 bp, Artificial sequence
  Synthetic oligonucleotide
gtaatcatagcggttcgcgctggcc

SEQ ID NO: 703218 - DNA, 25 bp, Artificial sequence
  Synthetic oligonucleotide
ccacgttaacgtagggcgagacagg

SEQ ID NO: 703219 - DNA, 25 bp, Artificial sequence
  Synthetic oligonucleotide
gggtgcgcgtcttgacgactatcag

SEQ ID NO: 703220 - DNA, 25 bp, Artificial sequence
  Synthetic oligonucleotide
ccacgttaacgttgggcgagacagg

SEQ ID NO: 703221 - DNA, 25 bp, Artificial sequence
  Synthetic oligonucleotide
cgggcaacttatacccgcgtgtcac

SEQ ID NO: 703222 - DNA, 25 bp, Artificial sequence
  Synthetic oligonucleotide
ccacgtgtacgaacgcgcgctaaca

SEQ ID NO: 703223 - DNA, 25 bp, Artificial sequence
  Synthetic oligonucleotide
ccacgtgtacgatcgcgcgctaaca

SEQ ID NO: 703224 - DNA, 25 bp, Artificial sequence
  Synthetic oligonucleotide
cacacttacgcggggtatcacgcct

SEQ ID NO: 703225 - DNA, 25 bp, Artificial sequence
  Synthetic oligonucleotide
cacacttacgcgcggtatcacgcct

SEQ ID NO: 703226 - DNA, 25 bp, Artificial sequence
  Synthetic oligonucleotide
ctcctaccgtctttacgctggggtc

SEQ ID NO: 703227 - DNA, 25 bp, Artificial sequence
  Synthetic oligonucleotide
ctcctaccgtctatacgctggggtc

SEQ ID NO: 703228 - DNA, 25 bp, Artificial sequence
  Synthetic oligonucleotide
gtgggtggtataaagcgcgcctcca

SEQ ID NO: 703229 - DNA, 25 bp, Artificial sequence
  Synthetic oligonucleotide
tgcggggcgcgaggtgtatatgtct

SEQ ID NO: 703230 - DNA, 25 bp, Artificial sequence
  Synthetic oligonucleotide
gggtgcgcgtctagacgactatcag

SEQ ID NO: 703231 - DNA, 25 bp, Artificial sequence
  Synthetic oligonucleotide
cgacacgacgcgtctaggttgacgt

SEQ ID NO: 703232 - DNA, 25 bp, Artificial sequence
  Synthetic oligonucleotide
gcaatgctagtcgcgcgtaggggta

SEQ ID NO: 703233 - DNA, 25 bp, Artificial sequence
  Synthetic oligonucleotide
acacacatatagggggtcgagcgcc

SEQ ID NO: 703234 - DNA, 25 bp, Artificial sequence
  Synthetic oligonucleotide
acacacatatagcgggtcgagcgcc

SEQ ID NO: 703235 - DNA, 25 bp, Artificial sequence
  Synthetic oligonucleotide
ccacagctagcgaaccggactcaca

SEQ ID NO: 703236 - DNA, 25 bp, Artificial sequence
  Synthetic oligonucleotide
ccacagctagcgtaccggactcaca

SEQ ID NO: 703237 - DNA, 25 bp, Artificial sequence
  Synthetic oligonucleotide
cgctagtacgcgtccgatcttcacg

SEQ ID NO: 703238 - DNA, 25 bp, Artificial sequence
  Synthetic oligonucleotide
cgctagtacgcgaccgatcttcacg

SEQ ID NO: 703239 - DNA, 25 bp, Artificial sequence
  Synthetic oligonucleotide
aagctacggggtctatcgcggacga

SEQ ID NO: 703240 - DNA, 25 bp, Artificial sequence
  Synthetic oligonucleotide
aagctacggggtgtatcgcggacga

SEQ ID NO: 703241 - DNA, 25 bp, Artificial sequence
  Synthetic oligonucleotide
cggaattcgtacgccgtaccgtgac

SEQ ID NO: 703242 - DNA, 25 bp, Artificial sequence
  Synthetic oligonucleotide
gccatctaactcccgcgtagtgacc

SEQ ID NO: 703243 - DNA, 25 bp, Artificial sequence
  Synthetic oligonucleotide
caggacgggctaatacgcgccaaac

SEQ ID NO: 703244 - DNA, 25 bp, Artificial sequence
  Synthetic oligonucleotide
cgacacgacgcgactaggttgacgt

SEQ ID NO: 703245 - DNA, 25 bp, Artificial sequence
  Synthetic oligonucleotide
gagccggatcgccgaacgtatccta

SEQ ID NO: 703246 - DNA, 25 bp, Artificial sequence
  Synthetic oligonucleotide
acgcttcgacttacgcgagacctgg

SEQ ID NO: 703247 - DNA, 25 bp, Artificial sequence
  Synthetic oligonucleotide
cgactttcgcgcctactgaagcgag

SEQ ID NO: 703248 - DNA, 25 bp, Artificial sequence
  Synthetic oligonucleotide
cgactttcgcgcgtactgaagcgag

SEQ ID NO: 703249 - DNA, 25 bp, Artificial sequence
  Synthetic oligonucleotide
ttgttctacgacgtcggacacgggg

SEQ ID NO: 703250 - DNA, 25 bp, Artificial sequence
  Synthetic oligonucleotide
ttgttctacgacctcggacacgggg

SEQ ID NO: 703251 - DNA, 25 bp, Artificial sequence
  Synthetic oligonucleotide
cggcttccgacggtattcggtagca

SEQ ID NO: 703252 - DNA, 25 bp, Artificial sequence
  Synthetic oligonucleotide
cggcttccgacgctattcggtagca

SEQ ID NO: 703253 - DNA, 25 bp, Artificial sequence
  Synthetic oligonucleotide
gccatctaactcgcgcgtagtgacc

SEQ ID NO: 703254 - DNA, 25 bp, Artificial sequence
  Synthetic oligonucleotide
atgggatcgcgctagagtggctagc

SEQ ID NO: 703255 - DNA, 25 bp, Artificial sequence
  Synthetic oligonucleotide
acgcttcgactttcgcgagacctgg

SEQ ID NO: 703256 - DNA, 25 bp, Artificial sequence
  Synthetic oligonucleotide
tgcggggcgcgacgtgtatatgtct

SEQ ID NO: 703257 - DNA, 25 bp, Artificial sequence
  Synthetic oligonucleotide
cccctgagtaacgccggacttctca

SEQ ID NO: 703258 - DNA, 25 bp, Artificial sequence
  Synthetic oligonucleotide
cccctgagtaaccccggacttctca

SEQ ID NO: 703259 - DNA, 25 bp, Artificial sequence
  Synthetic oligonucleotide
cggctagatagcggctcgtcacaga

SEQ ID NO: 703260 - DNA, 25 bp, Artificial sequence
  Synthetic oligonucleotide
cggctagatagccgctcgtcacaga

SEQ ID NO: 703261 - DNA, 25 bp, Artificial sequence
  Synthetic oligonucleotide
gaaggagtcgcgggcgtattcgtca

SEQ ID NO: 703262 - DNA, 25 bp, Artificial sequence
  Synthetic oligonucleotide
gaaggagtcgcgcgcgtattcgtca

SEQ ID NO: 703263 - DNA, 25 bp, Artificial sequence
  Synthetic oligonucleotide
ctgataacgcgtaagcgggaccctc

SEQ ID NO: 703264 - DNA, 25 bp, Artificial sequence
  Synthetic oligonucleotide
cggaattcgtaccccgtaccgtgac

SEQ ID NO: 703265 - DNA, 25 bp, Artificial sequence
  Synthetic oligonucleotide
atgggatcgcgcaagagtggctagc

SEQ ID NO: 703266 - DNA, 25 bp, Artificial sequence
  Synthetic oligonucleotide
gcaatgctagtcccgcgtaggggta

SEQ ID NO: 703267 - DNA, 25 bp, Artificial sequence
  Synthetic oligonucleotide
gcagcaggtacgccaatacgcctca

SEQ ID NO: 703268 - DNA, 25 bp, Artificial sequence
  Synthetic oligonucleotide
gcagcaggtacggcaatacgcctca

SEQ ID NO: 703269 - DNA, 25 bp, Artificial sequence
  Synthetic oligonucleotide
atcggtccgtcgctagtactggagg

SEQ ID NO: 703270 - DNA, 25 bp, Artificial sequence
  Synthetic oligonucleotide
atcggtccgtcggtagtactggagg

SEQ ID NO: 703271 - DNA, 25 bp, Artificial sequence
  Synthetic oligonucleotide
cctcaacgacgcaagcgtacccaag

SEQ ID NO: 703272 - DNA, 25 bp, Artificial sequence
  Synthetic oligonucleotide
cctcaacgacgctagcgtacccaag

SEQ ID NO: 703273 - DNA, 25 bp, Artificial sequence
  Synthetic oligonucleotide
agtagccgtcgatcgtaggagcggt

SEQ ID NO: 703274 - DNA, 25 bp, Artificial sequence
  Synthetic oligonucleotide
agtagccgtcgaacgtaggagcggt

SEQ ID NO: 703275 - DNA, 25 bp, Artificial sequence
  Synthetic oligonucleotide
caggacgggctattacgcgccaaac

SEQ ID NO: 703276 - DNA, 25 bp, Artificial sequence
  Synthetic oligonucleotide
ctgataacgcgttagcgggaccctc

SEQ ID NO: 703277 - DNA, 25 bp, Artificial sequence
  Synthetic oligonucleotide
acccgaccgacgggtgatcgatatg

SEQ ID NO: 703278 - DNA, 25 bp, Artificial sequence
  Synthetic oligonucleotide
atcccttgtcccccgatagcccaag

SEQ ID NO: 703279 - DNA, 25 bp, Artificial sequence
  Synthetic oligonucleotide
acgtgctcacgtgcgctagacacac

SEQ ID NO: 703280 - DNA, 25 bp, Artificial sequence
  Synthetic oligonucleotide
acgtgctcacgtccgctagacacac

SEQ ID NO: 703281 - DNA, 25 bp, Artificial sequence
  Synthetic oligonucleotide
cgcggtaagtcgccttacgcagatg

SEQ ID NO: 703282 - DNA, 25 bp, Artificial sequence
  Synthetic oligonucleotide
cgcggtaagtcggcttacgcagatg

SEQ ID NO: 703283 - DNA, 25 bp, Artificial sequence
  Synthetic oligonucleotide
tgggagcgtgagggacgatgtacct

SEQ ID NO: 703284 - DNA, 25 bp, Artificial sequence
  Synthetic oligonucleotide
tgggagcgtgagcgacgatgtacct

SEQ ID NO: 703285 - DNA, 25 bp, Artificial sequence
  Synthetic oligonucleotide
ctgctcataccgagtcgcgtacgca

SEQ ID NO: 703286 - DNA, 25 bp, Artificial sequence
  Synthetic oligonucleotide
gctaaccgtctcgacccgtgtgatg

SEQ ID NO: 703287 - DNA, 25 bp, Artificial sequence
  Synthetic oligonucleotide
acccgaccgacgcgtgatcgatatg

SEQ ID NO: 703288 - DNA, 25 bp, Artificial sequence
  Synthetic oligonucleotide
ctcgcatgcgagcttaccgtacctg

SEQ ID NO: 703289 - DNA, 25 bp, Artificial sequence
  Synthetic oligonucleotide
acgagagtccggttatgcggctcgt

SEQ ID NO: 703290 - DNA, 25 bp, Artificial sequence
  Synthetic oligonucleotide
acgagagtccggatatgcggctcgt

SEQ ID NO: 703291 - DNA, 25 bp, Artificial sequence
  Synthetic oligonucleotide
atacgattgcgccttgtagggcggc

SEQ ID NO: 703292 - DNA, 25 bp, Artificial sequence
  Synthetic oligonucleotide
atacgattgcgcgttgtagggcggc

SEQ ID NO: 703293 - DNA, 25 bp, Artificial sequence
  Synthetic oligonucleotide
aggatgtcgtgcgttagcgagctgc

SEQ ID NO: 703294 - DNA, 25 bp, Artificial sequence
  Synthetic oligonucleotide
aggatgtcgtgccttagcgagctgc

SEQ ID NO: 703295 - DNA, 25 bp, Artificial sequence
  Synthetic oligonucleotide
ggttgggcggtaaatcgagagcacc

SEQ ID NO: 703296 - DNA, 25 bp, Artificial sequence
  Synthetic oligonucleotide
ggttgggcggtatatcgagagcacc

SEQ ID NO: 703297 - DNA, 25 bp, Artificial sequence
  Synthetic oligonucleotide
atcgcgctcgcaacgtgcgacaatg

SEQ ID NO: 703298 - DNA, 25 bp, Artificial sequence
  Synthetic oligonucleotide
ctgctcataccgtgtcgcgtacgca

SEQ ID NO: 703299 - DNA, 25 bp, Artificial sequence
  Synthetic oligonucleotide
tagaccgcgctccgcgtattcatgc

SEQ ID NO: 703300 - DNA, 25 bp, Artificial sequence
  Synthetic oligonucleotide
tgatcggccgtaggcaactagggca

SEQ ID NO: 703301 - DNA, 25 bp, Artificial sequence
  Synthetic oligonucleotide
tgatcggccgtacgcaactagggca

SEQ ID NO: 703302 - DNA, 25 bp, Artificial sequence
  Synthetic oligonucleotide
accgaaatcgttaccgcggacgtgc

SEQ ID NO: 703303 - DNA, 25 bp, Artificial sequence
  Synthetic oligonucleotide
accgaaatcgtttccgcggacgtgc

SEQ ID NO: 703304 - DNA, 25 bp, Artificial sequence
  Synthetic oligonucleotide
gacgtacgccgcgataagtcgaagg

SEQ ID NO: 703305 - DNA, 25 bp, Artificial sequence
  Synthetic oligonucleotide
gacgtacgccgccataagtcgaagg

SEQ ID NO: 703306 - DNA, 25 bp, Artificial sequence
  Synthetic oligonucleotide
cacaccgatctagggcccgattgca

SEQ ID NO: 703307 - DNA, 25 bp, Artificial sequence
  Synthetic oligonucleotide
cacaccgatctacggcccgattgca

SEQ ID NO: 703308 - DNA, 25 bp, Artificial sequence
  Synthetic oligonucleotide
ggaaggcgatacgggaacgtggttc

SEQ ID NO: 703309 - DNA, 25 bp, Artificial sequence
  Synthetic oligonucleotide
atcccttgtcccgcgatagcccaag

SEQ ID NO: 703310 - DNA, 25 bp, Artificial sequence
  Synthetic oligonucleotide
tagaccgcgctcggcgtattcatgc

SEQ ID NO: 703311 - DNA, 25 bp, Artificial sequence
  Synthetic oligonucleotide
ctcgcatgcgaggttaccgtacctg

SEQ ID NO: 703312 - DNA, 25 bp, Artificial sequence
  Synthetic oligonucleotide
ccctacgtacccatcgcgtgcaagt

SEQ ID NO: 703313 - DNA, 25 bp, Artificial sequence
  Synthetic oligonucleotide
ccctacgtacccttcgcgtgcaagt

SEQ ID NO: 703314 - DNA, 25 bp, Artificial sequence
  Synthetic oligonucleotide
actccggtcgcgtcctacttgcctt

SEQ ID NO: 703315 - DNA, 25 bp, Artificial sequence
  Synthetic oligonucleotide
actccggtcgcgacctacttgcctt

SEQ ID NO: 703316 - DNA, 25 bp, Artificial sequence
  Synthetic oligonucleotide
cacggagacgctacgcatcgcagat

SEQ ID NO: 703317 - DNA, 25 bp, Artificial sequence
  Synthetic oligonucleotide
cacggagacgcttcgcatcgcagat

SEQ ID NO: 703318 - DNA, 25 bp, Artificial sequence
  Synthetic oligonucleotide
cccctattacgcgcgacgtggtctt

SEQ ID NO: 703319 - DNA, 25 bp, Artificial sequence
  Synthetic oligonucleotide
cccctattacgcccgacgtggtctt

SEQ ID NO: 703320 - DNA, 25 bp, Artificial sequence
  Synthetic oligonucleotide
gttaccgtatacccccggatgagcc

SEQ ID NO: 703321 - DNA, 25 bp, Artificial sequence
  Synthetic oligonucleotide
ggaaggcgataccggaacgtggttc

SEQ ID NO: 703322 - DNA, 25 bp, Artificial sequence
  Synthetic oligonucleotide
tctacccccgttaagcgaggctctg

SEQ ID NO: 703323 - DNA, 25 bp, Artificial sequence
  Synthetic oligonucleotide
atcgcgctcgcatcgtgcgacaatg

SEQ ID NO: 703324 - DNA, 25 bp, Artificial sequence
  Synthetic oligonucleotide
ctggtgtactaccggtcggatgtgc

SEQ ID NO: 703325 - DNA, 25 bp, Artificial sequence
  Synthetic oligonucleotide
ctggtgtactacgggtcggatgtgc

SEQ ID NO: 703326 - DNA, 25 bp, Artificial sequence
  Synthetic oligonucleotide
gcggagtaacgtctcgcggaaatcg

SEQ ID NO: 703327 - DNA, 25 bp, Artificial sequence
  Synthetic oligonucleotide
gcggagtaacgtgtcgcggaaatcg

SEQ ID NO: 703328 - DNA, 25 bp, Artificial sequence
  Synthetic oligonucleotide
gcagcagcggttacgctagggctaa

SEQ ID NO: 703329 - DNA, 25 bp, Artificial sequence
  Synthetic oligonucleotide
gcagcagcggtttcgctagggctaa

SEQ ID NO: 703330 - DNA, 25 bp, Artificial sequence
  Synthetic oligonucleotide
aacgcgttacgcaacgacggtcagc

SEQ ID NO: 703331 - DNA, 25 bp, Artificial sequence
  Synthetic oligonucleotide
aacgcgttacgctacgacggtcagc

SEQ ID NO: 703332 - DNA, 25 bp, Artificial sequence
  Synthetic oligonucleotide
aagggcggtgcttcgtcgtcggata

SEQ ID NO: 703333 - DNA, 25 bp, Artificial sequence
  Synthetic oligonucleotide
acactggcgcgtggactacgcatct

SEQ ID NO: 703334 - DNA, 25 bp, Artificial sequence
  Synthetic oligonucleotide
ggtctacgccgttacgctggactgt

SEQ ID NO: 703335 - DNA, 25 bp, Artificial sequence
  Synthetic oligonucleotide
tctacccccgtttagcgaggctctg

SEQ ID NO: 703336 - DNA, 25 bp, Artificial sequence
  Synthetic oligonucleotide
gcatcaggtgcgacggttaagaccg

SEQ ID NO: 703337 - DNA, 25 bp, Artificial sequence
  Synthetic oligonucleotide
gcatcaggtgcgtcggttaagaccg

SEQ ID NO: 703338 - DNA, 25 bp, Artificial sequence
  Synthetic oligonucleotide
ttggttgggtagacgtgcgtacccg

SEQ ID NO: 703339 - DNA, 25 bp, Artificial sequence
  Synthetic oligonucleotide
ttggttgggtagtcgtgcgtacccg

SEQ ID NO: 703340 - DNA, 25 bp, Artificial sequence
  Synthetic oligonucleotide
ccgcccttaggcgaaacgcttcgaa

SEQ ID NO: 703341 - DNA, 25 bp, Artificial sequence
  Synthetic oligonucleotide
ccgcccttaggccaaacgcttcgaa

SEQ ID NO: 703342 - DNA, 25 bp, Artificial sequence
  Synthetic oligonucleotide
aggaacatacgacgcgcacggtagc

SEQ ID NO: 703343 - DNA, 25 bp, Artificial sequence
  Synthetic oligonucleotide
gagccggatcgcggaacgtatccta

SEQ ID NO: 703344 - DNA, 25 bp, Artificial sequence
  Synthetic oligonucleotide
acactggcgcgtcgactacgcatct

SEQ ID NO: 703345 - DNA, 25 bp, Artificial sequence
  Synthetic oligonucleotide
cggtgccgttagtcggtaactgcac

SEQ ID NO: 703346 - DNA, 25 bp, Artificial sequence
  Synthetic oligonucleotide
agtcggcggcccgttacgtgataga

SEQ ID NO: 703347 - DNA, 25 bp, Artificial sequence
  Synthetic oligonucleotide
agtcggcggccccttacgtgataga

SEQ ID NO: 703348 - DNA, 25 bp, Artificial sequence
  Synthetic oligonucleotide
ttacggacgcgtggtacctcacggt

SEQ ID NO: 703349 - DNA, 25 bp, Artificial sequence
  Synthetic oligonucleotide
cttgccgacgcgttatacggagagc

SEQ ID NO: 703350 - DNA, 25 bp, Artificial sequence
  Synthetic oligonucleotide
cttgccgacgcgatatacggagagc

SEQ ID NO: 703351 - DNA, 25 bp, Artificial sequence
  Synthetic oligonucleotide
agctgccgtacgatcggaggacgta

SEQ ID NO: 703352 - DNA, 25 bp, Artificial sequence
  Synthetic oligonucleotide
agctgccgtacgttcggaggacgta

SEQ ID NO: 703353 - DNA, 25 bp, Artificial sequence
  Synthetic oligonucleotide
cgaagatagtcggcccgaaccttgc

SEQ ID NO: 703354 - DNA, 25 bp, Artificial sequence
  Synthetic oligonucleotide
gtgcctacccgttcggatatcgtcg

SEQ ID NO: 703355 - DNA, 25 bp, Artificial sequence
  Synthetic oligonucleotide
aagggcggtgctacgtcgtcggata

SEQ ID NO: 703356 - DNA, 25 bp, Artificial sequence
  Synthetic oligonucleotide
cggtgccgttagacggtaactgcac

SEQ ID NO: 703357 - DNA, 25 bp, Artificial sequence
  Synthetic oligonucleotide
gttaccgtatacgcccggatgagcc

SEQ ID NO: 703358 - DNA, 25 bp, Artificial sequence
  Synthetic oligonucleotide
gggtatcgtaagccgtagtcgagcc

SEQ ID NO: 703359 - DNA, 25 bp, Artificial sequence
  Synthetic oligonucleotide
gggtatcgtaaggcgtagtcgagcc

SEQ ID NO: 703360 - DNA, 25 bp, Artificial sequence
  Synthetic oligonucleotide
tctccgcgtccgtcgagtaaaacgc

SEQ ID NO: 703361 - DNA, 25 bp, Artificial sequence
  Synthetic oligonucleotide
tctccgcgtccgacgagtaaaacgc

SEQ ID NO: 703362 - DNA, 25 bp, Artificial sequence
  Synthetic oligonucleotide
cacaatcgcgctttcagtcggctgg

SEQ ID NO: 703363 - DNA, 25 bp, Artificial sequence
  Synthetic oligonucleotide
cacaatcgcgctatcagtcggctgg

SEQ ID NO: 703364 - DNA, 25 bp, Artificial sequence
  Synthetic oligonucleotide
tgcgcccgactaaccgcgatgttga

SEQ ID NO: 703365 - DNA, 25 bp, Artificial sequence
  Synthetic oligonucleotide
tgcgcccgactatccgcgatgttga

SEQ ID NO: 703366 - DNA, 25 bp, Artificial sequence
  Synthetic oligonucleotide
ggtctacgccgtaacgctggactgt

SEQ ID NO: 703367 - DNA, 25 bp, Artificial sequence
  Synthetic oligonucleotide
agcaccattgactaccgcgcgccaa

SEQ ID NO: 703368 - DNA, 25 bp, Artificial sequence
  Synthetic oligonucleotide
gcccattccgaaggcgtactgagct

SEQ ID NO: 703369 - DNA, 25 bp, Artificial sequence
  Synthetic oligonucleotide
tccccttaagcccttgcggggcata

SEQ ID NO: 703370 - DNA, 25 bp, Artificial sequence
  Synthetic oligonucleotide
cagctgggtctacgcgtagaagacc

SEQ ID NO: 703371 - DNA, 25 bp, Artificial sequence
  Synthetic oligonucleotide
taagccgccggttcgctagcttgct

SEQ ID NO: 703372 - DNA, 25 bp, Artificial sequence
  Synthetic oligonucleotide
taagccgccggtacgctagcttgct

SEQ ID NO: 703373 - DNA, 25 bp, Artificial sequence
  Synthetic oligonucleotide
cagtcttacgcgacgtgattggccg

SEQ ID NO: 703374 - DNA, 25 bp, Artificial sequence
  Synthetic oligonucleotide
cagtcttacgcgtcgtgattggccg

SEQ ID NO: 703375 - DNA, 25 bp, Artificial sequence
  Synthetic oligonucleotide
agccgggcctagggcgtatttcgat

SEQ ID NO: 703376 - DNA, 25 bp, Artificial sequence
  Synthetic oligonucleotide
agccgggcctagcgcgtatttcgat

SEQ ID NO: 703377 - DNA, 25 bp, Artificial sequence
  Synthetic oligonucleotide
cataaccgaccggaagcgtagcgac

SEQ ID NO: 703378 - DNA, 25 bp, Artificial sequence
  Synthetic oligonucleotide
ggttatgcgctatcggtatgcggcc

SEQ ID NO: 703379 - DNA, 25 bp, Artificial sequence
  Synthetic oligonucleotide
gcccattccgaacgcgtactgagct

SEQ ID NO: 703380 - DNA, 25 bp, Artificial sequence
  Synthetic oligonucleotide
ggttatgcgctaacggtatgcggcc

SEQ ID NO: 703381 - DNA, 25 bp, Artificial sequence
  Synthetic oligonucleotide
gcctttctaacgtctcgcgtcaggg

SEQ ID NO: 703382 - DNA, 25 bp, Artificial sequence
  Synthetic oligonucleotide
gcctttctaacgactcgcgtcaggg

SEQ ID NO: 703383 - DNA, 25 bp, Artificial sequence
  Synthetic oligonucleotide
ggtcttcggtaaggtcgcacgcgta

SEQ ID NO: 703384 - DNA, 25 bp, Artificial sequence
  Synthetic oligonucleotide
ggtcttcggtaacgtcgcacgcgta

SEQ ID NO: 703385 - DNA, 25 bp, Artificial sequence
  Synthetic oligonucleotide
tccccatgcgtaccggctattgcac

SEQ ID NO: 703386 - DNA, 25 bp, Artificial sequence
  Synthetic oligonucleotide
tccccatgcgtagcggctattgcac

SEQ ID NO: 703387 - DNA, 25 bp, Artificial sequence
  Synthetic oligonucleotide
tccgtttcgccgctctacgcaggtt

SEQ ID NO: 703388 - DNA, 25 bp, Artificial sequence
  Synthetic oligonucleotide
tccgtttcgccggtctacgcaggtt

SEQ ID NO: 703389 - DNA, 25 bp, Artificial sequence
  Synthetic oligonucleotide
tccccttaagccgttgcggggcata

SEQ ID NO: 703390 - DNA, 25 bp, Artificial sequence
  Synthetic oligonucleotide
cataaccgaccgcaagcgtagcgac

SEQ ID NO: 703391 - DNA, 25 bp, Artificial sequence
  Synthetic oligonucleotide
ccgttaaatcgtgcgaccgggctct

SEQ ID NO: 703392 - DNA, 25 bp, Artificial sequence
  Synthetic oligonucleotide
aggaacatacgaggcgcacggtagc

SEQ ID NO: 703393 - DNA, 25 bp, Artificial sequence
  Synthetic oligonucleotide
agagttgccgtaccgtgatcggagc

SEQ ID NO: 703394 - DNA, 25 bp, Artificial sequence
  Synthetic oligonucleotide
ttacggacgcgtcgtacctcacggt

SEQ ID NO: 703395 - DNA, 25 bp, Artificial sequence
  Synthetic oligonucleotide
gctaaccgtctccacccgtgtgatg

SEQ ID NO: 703396 - DNA, 25 bp, Artificial sequence
  Synthetic oligonucleotide
agagttgccgtagcgtgatcggagc

SEQ ID NO: 703397 - DNA, 25 bp, Artificial sequence
  Synthetic oligonucleotide
ctttggacgcgcccgataggcaatg

SEQ ID NO: 703398 - DNA, 25 bp, Artificial sequence
  Synthetic oligonucleotide
ctttggacgcgcgcgataggcaatg

SEQ ID NO: 703399 - DNA, 25 bp, Artificial sequence
  Synthetic oligonucleotide
ttcccgcctattcgcgactccctag

SEQ ID NO: 703400 - DNA, 25 bp, Artificial sequence
  Synthetic oligonucleotide
ttcccgcctattggcgactccctag

SEQ ID NO: 703401 - DNA, 25 bp, Artificial sequence
  Synthetic oligonucleotide
ccagctatcgcgcgaagagcttcgt

SEQ ID NO: 703402 - DNA, 25 bp, Artificial sequence
  Synthetic oligonucleotide
gaccgataacgtggcgttcccacgt

SEQ ID NO: 703403 - DNA, 25 bp, Artificial sequence
  Synthetic oligonucleotide
cagctgggtctaggcgtagaagacc

SEQ ID NO: 703404 - DNA, 25 bp, Artificial sequence
  Synthetic oligonucleotide
ccgttaaatcgtccgaccgggctct

SEQ ID NO: 703405 - DNA, 25 bp, Artificial sequence
  Synthetic oligonucleotide
taaccgcgcgcaattacctccaccg

SEQ ID NO: 703406 - DNA, 25 bp, Artificial sequence
  Synthetic oligonucleotide
taaccgcgcgcatttacctccaccg

SEQ ID NO: 703407 - DNA, 25 bp, Artificial sequence
  Synthetic oligonucleotide
agcagtcgaacgcctaccggtttgg

SEQ ID NO: 703408 - DNA, 25 bp, Artificial sequence
  Synthetic oligonucleotide
agcagtcgaacggctaccggtttgg

SEQ ID NO: 703409 - DNA, 25 bp, Artificial sequence
  Synthetic oligonucleotide
atgctctggcgagctcgtaagcgct

SEQ ID NO: 703410 - DNA, 25 bp, Artificial sequence
  Synthetic oligonucleotide
atgctctggcgacctcgtaagcgct

SEQ ID NO: 703411 - DNA, 25 bp, Artificial sequence
  Synthetic oligonucleotide
tggacgaccgtaggggagtgcattg

SEQ ID NO: 703412 - DNA, 25 bp, Artificial sequence
  Synthetic oligonucleotide
tggacgaccgtacgggagtgcattg

SEQ ID NO: 703413 - DNA, 25 bp, Artificial sequence
  Synthetic oligonucleotide
gaccgataacgtcgcgttcccacgt

SEQ ID NO: 703414 - DNA, 25 bp, Artificial sequence
  Synthetic oligonucleotide
caccctcgacgggtacctacatagc

SEQ ID NO: 703415 - DNA, 25 bp, Artificial sequence
  Synthetic oligonucleotide
tcagggcgacctacgcgtttgatgc

SEQ ID NO: 703416 - DNA, 25 bp, Artificial sequence
  Synthetic oligonucleotide
tcagggcgaccttcgcgtttgatgc

SEQ ID NO: 703417 - DNA, 25 bp, Artificial sequence
  Synthetic oligonucleotide
cgcccgcgcacgtactacgtattag

SEQ ID NO: 703418 - DNA, 25 bp, Artificial sequence
  Synthetic oligonucleotide
cgcccgcgcacgaactacgtattag

SEQ ID NO: 703419 - DNA, 25 bp, Artificial sequence
  Synthetic oligonucleotide
cgaggtcgttcgcgcgtagcatact

SEQ ID NO: 703420 - DNA, 25 bp, Artificial sequence
  Synthetic oligonucleotide
cgaggtcgttcgggcgtagcatact

SEQ ID NO: 703421 - DNA, 25 bp, Artificial sequence
  Synthetic oligonucleotide
gagcggtatcggtacccgatcacct

SEQ ID NO: 703422 - DNA, 25 bp, Artificial sequence
  Synthetic oligonucleotide
cgcagcccgatagtcgatcacacac

SEQ ID NO: 703423 - DNA, 25 bp, Artificial sequence
  Synthetic oligonucleotide
aagtgccgcggttttgtcgccgcat

SEQ ID NO: 703424 - DNA, 25 bp, Artificial sequence
  Synthetic oligonucleotide
ccggtcgatacaaaccgcgtcgtgt

SEQ ID NO: 703425 - DNA, 25 bp, Artificial sequence
  Synthetic oligonucleotide
cgagcgtcgacgaatgaggcagtga

SEQ ID NO: 703426 - DNA, 25 bp, Artificial sequence
  Synthetic oligonucleotide
gagcggtatcggaacccgatcacct

SEQ ID NO: 703427 - DNA, 25 bp, Artificial sequence
  Synthetic oligonucleotide
caccctcgacggctacctacatagc

SEQ ID NO: 703428 - DNA, 25 bp, Artificial sequence
  Synthetic oligonucleotide
tccagccggggtcgtctataaagcg

SEQ ID NO: 703429 - DNA, 25 bp, Artificial sequence
  Synthetic oligonucleotide
tccagccggggtggtctataaagcg

SEQ ID NO: 703430 - DNA, 25 bp, Artificial sequence
  Synthetic oligonucleotide
gggagtcgcgtccttgataagcgag

SEQ ID NO: 703431 - DNA, 25 bp, Artificial sequence
  Synthetic oligonucleotide
gggagtcgcgtcgttgataagcgag

SEQ ID NO: 703432 - DNA, 25 bp, Artificial sequence
  Synthetic oligonucleotide
ggttttgcgtgtaacgcgaccgcag

SEQ ID NO: 703433 - DNA, 25 bp, Artificial sequence
  Synthetic oligonucleotide
ccagctatcgcgggaagagcttcgt

SEQ ID NO: 703434 - DNA, 25 bp, Artificial sequence
  Synthetic oligonucleotide
cgcagcccgatactcgatcacacac

SEQ ID NO: 703435 - DNA, 25 bp, Artificial sequence
  Synthetic oligonucleotide
ggaagtcgtgcacgacgtactcgct

SEQ ID NO: 703436 - DNA, 25 bp, Artificial sequence
  Synthetic oligonucleotide
ggaagtcgtgcaggacgtactcgct

SEQ ID NO: 703437 - DNA, 25 bp, Artificial sequence
  Synthetic oligonucleotide
cgagcgtcgacgtatgaggcagtga

SEQ ID NO: 703438 - DNA, 25 bp, Artificial sequence
  Synthetic oligonucleotide
acaggagccgtagtacgtcgcttgg

SEQ ID NO: 703439 - DNA, 25 bp, Artificial sequence
  Synthetic oligonucleotide
gcgtccacccgccctcttaaaagtg

SEQ ID NO: 703440 - DNA, 25 bp, Artificial sequence
  Synthetic oligonucleotide
gcgtccacccgcgctcttaaaagtg

SEQ ID NO: 703441 - DNA, 25 bp, Artificial sequence
  Synthetic oligonucleotide
aagtgccgcggtattgtcgccgcat

SEQ ID NO: 703442 - DNA, 25 bp, Artificial sequence
  Synthetic oligonucleotide
cgctctacgcgcgggtataaaaggg

SEQ ID NO: 703443 - DNA, 25 bp, Artificial sequence
  Synthetic oligonucleotide
cgcttacggccgatatacgggccaa

SEQ ID NO: 703444 - DNA, 25 bp, Artificial sequence
  Synthetic oligonucleotide
ggttttgcgtgttacgcgaccgcag

SEQ ID NO: 703445 - DNA, 25 bp, Artificial sequence
  Synthetic oligonucleotide
cgcttacggccgttatacgggccaa

SEQ ID NO: 703446 - DNA, 25 bp, Artificial sequence
  Synthetic oligonucleotide
cgctctacgcgccggtataaaaggg

SEQ ID NO: 703447 - DNA, 25 bp, Artificial sequence
  Synthetic oligonucleotide
acaggagccgtactacgtcgcttgg

SEQ ID NO: 703448 - DNA, 25 bp, Artificial sequence
  Synthetic oligonucleotide
acggcttgcgcgaacgagcttaagc

SEQ ID NO: 703449 - DNA, 25 bp, Artificial sequence
  Synthetic oligonucleotide
acggcttgcgcgtacgagcttaagc

SEQ ID NO: 703450 - DNA, 25 bp, Artificial sequence
  Synthetic oligonucleotide
atcgaacgggcggtatacgccatcg

SEQ ID NO: 703451 - DNA, 25 bp, Artificial sequence
  Synthetic oligonucleotide
cccggtcgtccgagcctaattagac

SEQ ID NO: 703452 - DNA, 25 bp, Artificial sequence
  Synthetic oligonucleotide
cccggtcgtccgtgcctaattagac

SEQ ID NO: 703453 - DNA, 25 bp, Artificial sequence
  Synthetic oligonucleotide
tttcccattctaggccgcggacagg

SEQ ID NO: 703454 - DNA, 25 bp, Artificial sequence
  Synthetic oligonucleotide
tttcccattctacgccgcggacagg

SEQ ID NO: 703455 - DNA, 25 bp, Artificial sequence
  Synthetic oligonucleotide
ggtagccgagatgcgtatggtgtcc

SEQ ID NO: 703456 - DNA, 25 bp, Artificial sequence
  Synthetic oligonucleotide
ggtagccgagatccgtatggtgtcc

SEQ ID NO: 703457 - DNA, 25 bp, Artificial sequence
  Synthetic oligonucleotide
atcgaacgggcgctatacgccatcg

SEQ ID NO: 703458 - DNA, 25 bp, Artificial sequence
  Synthetic oligonucleotide
ccggtcgatacataccgcgtcgtgt

SEQ ID NO: 703459 - DNA, 25 bp, Artificial sequence
  Synthetic oligonucleotide
agcggtgccgtactccgatcgctgt

SEQ ID NO: 703460 - DNA, 25 bp, Artificial sequence
  Synthetic oligonucleotide
cgtcctcgccgattacgcagaaggc

SEQ ID NO: 703461 - DNA, 25 bp, Artificial sequence
  Synthetic oligonucleotide
agcggtgccgtagtccgatcgctgt

SEQ ID NO: 703462 - DNA, 25 bp, Artificial sequence
  Synthetic oligonucleotide
gtctgcgtcgtatggcgcgctctag

SEQ ID NO: 703463 - DNA, 25 bp, Artificial sequence
  Synthetic oligonucleotide
gtctgcgtcgtaaggcgcgctctag

SEQ ID NO: 703464 - DNA, 25 bp, Artificial sequence
  Synthetic oligonucleotide
ccaagctatcgcccgacgtggttgg

SEQ ID NO: 703465 - DNA, 25 bp, Artificial sequence
  Synthetic oligonucleotide
gcactccggtcgtcaacggtacgca

SEQ ID NO: 703466 - DNA, 25 bp, Artificial sequence
  Synthetic oligonucleotide
atctaacgacggactcgcagccccg

SEQ ID NO: 703467 - DNA, 25 bp, Artificial sequence
  Synthetic oligonucleotide
gcactccggtcgacaacggtacgca

SEQ ID NO: 703468 - DNA, 25 bp, Artificial sequence
  Synthetic oligonucleotide
atctaacgacggtctcgcagccccg

SEQ ID NO: 703469 - DNA, 25 bp, Artificial sequence
  Synthetic oligonucleotide
ccaagctatcgcgcgacgtggttgg

SEQ ID NO: 703470 - DNA, 25 bp, Artificial sequence
  Synthetic oligonucleotide
cgctcgcgtccgttaaacgaaccgg

SEQ ID NO: 703471 - DNA, 25 bp, Artificial sequence
  Synthetic oligonucleotide
cgctcgcgtccgataaacgaaccgg

SEQ ID NO: 703472 - DNA, 25 bp, Artificial sequence
  Synthetic oligonucleotide
agctctggcgtccgaacgagcgatc

SEQ ID NO: 703473 - DNA, 25 bp, Artificial sequence
  Synthetic oligonucleotide
agctctggcgtcggaacgagcgatc

SEQ ID NO: 703474 - DNA, 25 bp, Artificial sequence
  Synthetic oligonucleotide
gagaacacgcgcgacgtagcgagtc

SEQ ID NO: 703475 - DNA, 25 bp, Artificial sequence
  Synthetic oligonucleotide
gccgtgacgcgccttggatcgtaca

SEQ ID NO: 703476 - DNA, 25 bp, Artificial sequence
  Synthetic oligonucleotide
gagaacacgcgccacgtagcgagtc

SEQ ID NO: 703477 - DNA, 25 bp, Artificial sequence
  Synthetic oligonucleotide
ttgtcccgcgaggcataccccgatc

SEQ ID NO: 703478 - DNA, 25 bp, Artificial sequence
  Synthetic oligonucleotide
gagggctcagtaccggtcggacgaa

SEQ ID NO: 703479 - DNA, 25 bp, Artificial sequence
  Synthetic oligonucleotide
gagggctcagtagcggtcggacgaa

SEQ ID NO: 703480 - DNA, 25 bp, Artificial sequence
  Synthetic oligonucleotide
cgtcctcgccgaatacgcagaaggc

SEQ ID NO: 703481 - DNA, 25 bp, Artificial sequence
  Synthetic oligonucleotide
ttgtcccgcgagccataccccgatc

SEQ ID NO: 703482 - DNA, 25 bp, Artificial sequence
  Synthetic oligonucleotide
gccgtgacgcgcgttggatcgtaca

SEQ ID NO: 703483 - DNA, 25 bp, Artificial sequence
  Synthetic oligonucleotide
tggtccctagtacggtgcgggagct

SEQ ID NO: 703484 - DNA, 25 bp, Artificial sequence
  Synthetic oligonucleotide
cacgccgcgctaggctgatataccc

SEQ ID NO: 703485 - DNA, 25 bp, Artificial sequence
  Synthetic oligonucleotide
cacgccgcgctacgctgatataccc

SEQ ID NO: 703486 - DNA, 25 bp, Artificial sequence
  Synthetic oligonucleotide
atccccttagcgtacgcgggcgtct

SEQ ID NO: 703487 - DNA, 25 bp, Artificial sequence
  Synthetic oligonucleotide
taccgggtcgcgaatacacccgtcg

SEQ ID NO: 703488 - DNA, 25 bp, Artificial sequence
  Synthetic oligonucleotide
acgacgacgggacgtacgctgtcgt

SEQ ID NO: 703489 - DNA, 25 bp, Artificial sequence
  Synthetic oligonucleotide
acgacgacgggaggtacgctgtcgt

SEQ ID NO: 703490 - DNA, 25 bp, Artificial sequence
  Synthetic oligonucleotide
ctagcatcacgactacgcgcgggtc

SEQ ID NO: 703491 - DNA, 25 bp, Artificial sequence
  Synthetic oligonucleotide
cgacaatcgagccctacgcgtacgc

SEQ ID NO: 703492 - DNA, 25 bp, Artificial sequence
  Synthetic oligonucleotide
cgacaatcgagcgctacgcgtacgc

SEQ ID NO: 703493 - DNA, 25 bp, Artificial sequence
  Synthetic oligonucleotide
cgtaccatcgtccggtcgttcggac

SEQ ID NO: 703494 - DNA, 25 bp, Artificial sequence
  Synthetic oligonucleotide
ctagcatcacgagtacgcgcgggtc

SEQ ID NO: 703495 - DNA, 25 bp, Artificial sequence
  Synthetic oligonucleotide
tggtccctagtagggtgcgggagct

SEQ ID NO: 703496 - DNA, 25 bp, Artificial sequence
  Synthetic oligonucleotide
cgcttccgcgtaccggataccacag

SEQ ID NO: 703497 - DNA, 25 bp, Artificial sequence
  Synthetic oligonucleotide
gaggcttcgaccggtagcgcaactg

SEQ ID NO: 703498 - DNA, 25 bp, Artificial sequence
  Synthetic oligonucleotide
gaggcttcgacccgtagcgcaactg

SEQ ID NO: 703499 - DNA, 25 bp, Artificial sequence
  Synthetic oligonucleotide
acccgagcgctcggtattgggaacg

SEQ ID NO: 703500 - DNA, 25 bp, Artificial sequence
  Synthetic oligonucleotide
acccgagcgctccgtattgggaacg

SEQ ID NO: 703501 - DNA, 25 bp, Artificial sequence
  Synthetic oligonucleotide
ccctaagtacgaccgtcgcccggat

SEQ ID NO: 703502 - DNA, 25 bp, Artificial sequence
  Synthetic oligonucleotide
ccctaagtacgagcgtcgcccggat

SEQ ID NO: 703503 - DNA, 25 bp, Artificial sequence
  Synthetic oligonucleotide
gccaactagcgccgttccggatcag

SEQ ID NO: 703504 - DNA, 25 bp, Artificial sequence
  Synthetic oligonucleotide
gccaactagcgcggttccggatcag

SEQ ID NO: 703505 - DNA, 25 bp, Artificial sequence
  Synthetic oligonucleotide
ccccccgttatagcgccggctgtat

SEQ ID NO: 703506 - DNA, 25 bp, Artificial sequence
  Synthetic oligonucleotide
ccccccgttataccgccggctgtat

SEQ ID NO: 703507 - DNA, 25 bp, Artificial sequence
  Synthetic oligonucleotide
cgcttccgcgtagcggataccacag

SEQ ID NO: 703508 - DNA, 25 bp, Artificial sequence
  Synthetic oligonucleotide
cgtaccatcgtcgggtcgttcggac

SEQ ID NO: 703509 - DNA, 25 bp, Artificial sequence
  Synthetic oligonucleotide
ggtgccagtctaggcgacgagttcc

SEQ ID NO: 703510 - DNA, 25 bp, Artificial sequence
  Synthetic oligonucleotide
tcgggggtgcgatcgaccggctatt

SEQ ID NO: 703511 - DNA, 25 bp, Artificial sequence
  Synthetic oligonucleotide
tcatgcgaaccgaacgacggcgcga

SEQ ID NO: 703512 - DNA, 25 bp, Artificial sequence
  Synthetic oligonucleotide
tcatgcgaaccgtacgacggcgcga

SEQ ID NO: 703513 - DNA, 25 bp, Artificial sequence
  Synthetic oligonucleotide
ggcagctacgtccaacccgaatccc

SEQ ID NO: 703514 - DNA, 25 bp, Artificial sequence
  Synthetic oligonucleotide
ggcagctacgtcgaacccgaatccc

SEQ ID NO: 703515 - DNA, 25 bp, Artificial sequence
  Synthetic oligonucleotide
ctaggcgcgacgaggtaccttaccg

SEQ ID NO: 703516 - DNA, 25 bp, Artificial sequence
  Synthetic oligonucleotide
ctaggcgcgacgtggtaccttaccg

SEQ ID NO: 703517 - DNA, 25 bp, Artificial sequence
  Synthetic oligonucleotide
cggatgacgcggtccagttgtggac

SEQ ID NO: 703518 - DNA, 25 bp, Artificial sequence
  Synthetic oligonucleotide
cggatgacgcggaccagttgtggac

SEQ ID NO: 703519 - DNA, 25 bp, Artificial sequence
  Synthetic oligonucleotide
tcggcccgaagtacgctcgtgactg

SEQ ID NO: 703520 - DNA, 25 bp, Artificial sequence
  Synthetic oligonucleotide
ggctagacgtagtaccgggatccgc

SEQ ID NO: 703521 - DNA, 25 bp, Artificial sequence
  Synthetic oligonucleotide
ggtgccagtctacgcgacgagttcc

SEQ ID NO: 703522 - DNA, 25 bp, Artificial sequence
  Synthetic oligonucleotide
cgtcgagtacacccgtccggagttg

SEQ ID NO: 703523 - DNA, 25 bp, Artificial sequence
  Synthetic oligonucleotide
tcaccataaccacgtcgcgtggcgg

SEQ ID NO: 703524 - DNA, 25 bp, Artificial sequence
  Synthetic oligonucleotide
tcaccataaccaggtcgcgtggcgg

SEQ ID NO: 703525 - DNA, 25 bp, Artificial sequence
  Synthetic oligonucleotide
tcgggggtgcgaacgaccggctatt

SEQ ID NO: 703526 - DNA, 25 bp, Artificial sequence
  Synthetic oligonucleotide
atccccttagcgaacgcgggcgtct

SEQ ID NO: 703527 - DNA, 25 bp, Artificial sequence
  Synthetic oligonucleotide
ggcatgccgcgaggtacgtacggat

SEQ ID NO: 703528 - DNA, 25 bp, Artificial sequence
  Synthetic oligonucleotide
ggcatgccgcgacgtacgtacggat

SEQ ID NO: 703529 - DNA, 25 bp, Artificial sequence
  Synthetic oligonucleotide
tcgagggttatgggcgatcggcagc

SEQ ID NO: 703530 - DNA, 25 bp, Artificial sequence
  Synthetic oligonucleotide
gtgcccactacgacgcgctacctca

SEQ ID NO: 703531 - DNA, 25 bp, Artificial sequence
  Synthetic oligonucleotide
cccctaccgtaagtagccggctgtg

SEQ ID NO: 703532 - DNA, 25 bp, Artificial sequence
  Synthetic oligonucleotide
cccctaccgtaactagccggctgtg

SEQ ID NO: 703533 - DNA, 25 bp, Artificial sequence
  Synthetic oligonucleotide
tcggcccgaagttcgctcgtgactg

SEQ ID NO: 703534 - DNA, 25 bp, Artificial sequence
  Synthetic oligonucleotide
ctgaggattatcgcgcggcgatcgc

SEQ ID NO: 703535 - DNA, 25 bp, Artificial sequence
  Synthetic oligonucleotide
ggtatctcggacccgtagtcggcgt

SEQ ID NO: 703536 - DNA, 25 bp, Artificial sequence
  Synthetic oligonucleotide
ggtatctcggacgcgtagtcggcgt

SEQ ID NO: 703537 - DNA, 25 bp, Artificial sequence
  Synthetic oligonucleotide
cagcagcgttcgcactacatcgggc

SEQ ID NO: 703538 - DNA, 25 bp, Artificial sequence
  Synthetic oligonucleotide
cagcagcgttcggactacatcgggc

SEQ ID NO: 703539 - DNA, 25 bp, Artificial sequence
  Synthetic oligonucleotide
gcaagcctatgctcgcgcgctagtg

SEQ ID NO: 703540 - DNA, 25 bp, Artificial sequence
  Synthetic oligonucleotide
gcaagcctatgcacgcgcgctagtg

SEQ ID NO: 703541 - DNA, 25 bp, Artificial sequence
  Synthetic oligonucleotide
gtcatctatggcccgcgctcgagga

SEQ ID NO: 703542 - DNA, 25 bp, Artificial sequence
  Synthetic oligonucleotide
gtcatctatggcgcgcgctcgagga

SEQ ID NO: 703543 - DNA, 25 bp, Artificial sequence
  Synthetic oligonucleotide
acctcgcgtcgtactagcgcgcaag

SEQ ID NO: 703544 - DNA, 25 bp, Artificial sequence
  Synthetic oligonucleotide
acctcgcgtcgttctagcgcgcaag

SEQ ID NO: 703545 - DNA, 25 bp, Artificial sequence
  Synthetic oligonucleotide
ggctagacgtagaaccgggatccgc

SEQ ID NO: 703546 - DNA, 25 bp, Artificial sequence
  Synthetic oligonucleotide
agccgctctcgcgtaccgtcatcct

SEQ ID NO: 703547 - DNA, 25 bp, Artificial sequence
  Synthetic oligonucleotide
taccgggtcgcgtatacacccgtcg

SEQ ID NO: 703548 - DNA, 25 bp, Artificial sequence
  Synthetic oligonucleotide
ctgaggattatcccgcggcgatcgc

SEQ ID NO: 703549 - DNA, 25 bp, Artificial sequence
  Synthetic oligonucleotide
tacgggcgtgacgtccgatccagca

SEQ ID NO: 703550 - DNA, 25 bp, Artificial sequence
  Synthetic oligonucleotide
tacgggcgtgacctccgatccagca

SEQ ID NO: 703551 - DNA, 25 bp, Artificial sequence
  Synthetic oligonucleotide
atgaggcgtacgggcgttctcccga

SEQ ID NO: 703552 - DNA, 25 bp, Artificial sequence
  Synthetic oligonucleotide
atgaggcgtacgcgcgttctcccga

SEQ ID NO: 703553 - DNA, 25 bp, Artificial sequence
  Synthetic oligonucleotide
ctccctcccgtaccgcatagcctgt

SEQ ID NO: 703554 - DNA, 25 bp, Artificial sequence
  Synthetic oligonucleotide
ctccctcccgtagcgcatagcctgt

SEQ ID NO: 703555 - DNA, 25 bp, Artificial sequence
  Synthetic oligonucleotide
tgtcactcggtaggagcgtgccgtc

SEQ ID NO: 703556 - DNA, 25 bp, Artificial sequence
  Synthetic oligonucleotide
tgtcactcggtacgagcgtgccgtc

SEQ ID NO: 703557 - DNA, 25 bp, Artificial sequence
  Synthetic oligonucleotide
cgtcgagtacacgcgtccggagttg

SEQ ID NO: 703558 - DNA, 25 bp, Artificial sequence
  Synthetic oligonucleotide
agccgctctcgcctaccgtcatcct

SEQ ID NO: 703559 - DNA, 25 bp, Artificial sequence
  Synthetic oligonucleotide
ccatgtgcgtgcggcggtagcatga

SEQ ID NO: 703560 - DNA, 25 bp, Artificial sequence
  Synthetic oligonucleotide
agcggatacgatggacgcatggccg

SEQ ID NO: 703561 - DNA, 25 bp, Artificial sequence
  Synthetic oligonucleotide
cggggaacgtcgtgaccggttcaga

SEQ ID NO: 703562 - DNA, 25 bp, Artificial sequence
  Synthetic oligonucleotide
cggggaacgtcgagaccggttcaga

SEQ ID NO: 703563 - DNA, 25 bp, Artificial sequence
  Synthetic oligonucleotide
ctacccttggcgagacgcgtcttcc

SEQ ID NO: 703564 - DNA, 25 bp, Artificial sequence
  Synthetic oligonucleotide
ctacccttggcgtgacgcgtcttcc

SEQ ID NO: 703565 - DNA, 25 bp, Artificial sequence
  Synthetic oligonucleotide
cgtccaacaccggtcgcatcgacgt

SEQ ID NO: 703566 - DNA, 25 bp, Artificial sequence
  Synthetic oligonucleotide
cgtccaacaccgctcgcatcgacgt

SEQ ID NO: 703567 - DNA, 25 bp, Artificial sequence
  Synthetic oligonucleotide
cgctggacccgtatcgcaccttcca

SEQ ID NO: 703568 - DNA, 25 bp, Artificial sequence
  Synthetic oligonucleotide
cgctggacccgtttcgcaccttcca

SEQ ID NO: 703569 - DNA, 25 bp, Artificial sequence
  Synthetic oligonucleotide
ctcggacacgaccgtaacgcgtacc

SEQ ID NO: 703570 - DNA, 25 bp, Artificial sequence
  Synthetic oligonucleotide
gcgggtctcaataggcgcgatggag

SEQ ID NO: 703571 - DNA, 25 bp, Artificial sequence
  Synthetic oligonucleotide
ccatgtgcgtgccgcggtagcatga

SEQ ID NO: 703572 - DNA, 25 bp, Artificial sequence
  Synthetic oligonucleotide
cggcctactgtcccgacacacggtt

SEQ ID NO: 703573 - DNA, 25 bp, Artificial sequence
  Synthetic oligonucleotide
accaagccgcttcggtacgtctggc

SEQ ID NO: 703574 - DNA, 25 bp, Artificial sequence
  Synthetic oligonucleotide
accaagccgcttgggtacgtctggc

SEQ ID NO: 703575 - DNA, 25 bp, Artificial sequence
  Synthetic oligonucleotide
ccccacgtccgcgatacacaagcga

SEQ ID NO: 703576 - DNA, 25 bp, Artificial sequence
  Synthetic oligonucleotide
ccccacgtccgccatacacaagcga

SEQ ID NO: 703577 - DNA, 25 bp, Artificial sequence
  Synthetic oligonucleotide
gcagtattggacggtcgcggctcag

SEQ ID NO: 703578 - DNA, 25 bp, Artificial sequence
  Synthetic oligonucleotide
gcagtattggaccgtcgcggctcag

SEQ ID NO: 703579 - DNA, 25 bp, Artificial sequence
  Synthetic oligonucleotide
gggtcgctcgtcgcgtacggagtaa

SEQ ID NO: 703580 - DNA, 25 bp, Artificial sequence
  Synthetic oligonucleotide
gggtcgctcgtcccgtacggagtaa

SEQ ID NO: 703581 - DNA, 25 bp, Artificial sequence
  Synthetic oligonucleotide
ttcgcgtagtcccgtcgtacggcct

SEQ ID NO: 703582 - DNA, 25 bp, Artificial sequence
  Synthetic oligonucleotide
ttcgctggcgtcgcgactacgtcac

SEQ ID NO: 703583 - DNA, 25 bp, Artificial sequence
  Synthetic oligonucleotide
ctcggacacgacggtaacgcgtacc

SEQ ID NO: 703584 - DNA, 25 bp, Artificial sequence
  Synthetic oligonucleotide
tcgcgtccgcggacgtcaaaaggac

SEQ ID NO: 703585 - DNA, 25 bp, Artificial sequence
  Synthetic oligonucleotide
tcccgtcacgcgctatcgtaggtgc

SEQ ID NO: 703586 - DNA, 25 bp, Artificial sequence
  Synthetic oligonucleotide
gccgtacgcgtttcgacgtggcgta

SEQ ID NO: 703587 - DNA, 25 bp, Artificial sequence
  Synthetic oligonucleotide
cggtgccataccccgccgacatcaa

SEQ ID NO: 703588 - DNA, 25 bp, Artificial sequence
  Synthetic oligonucleotide
cggtgccataccgcgccgacatcaa

SEQ ID NO: 703589 - DNA, 25 bp, Artificial sequence
  Synthetic oligonucleotide
gtacagttacgaccgcggaccgtgc

SEQ ID NO: 703590 - DNA, 25 bp, Artificial sequence
  Synthetic oligonucleotide
gtacagttacgagcgcggaccgtgc

SEQ ID NO: 703591 - DNA, 25 bp, Artificial sequence
  Synthetic oligonucleotide
gccctgtacttcccggtcgcttcct

SEQ ID NO: 703592 - DNA, 25 bp, Artificial sequence
  Synthetic oligonucleotide
gccctgtacttcgcggtcgcttcct

SEQ ID NO: 703593 - DNA, 25 bp, Artificial sequence
  Synthetic oligonucleotide
gtgcccactacgtcgcgctacctca

SEQ ID NO: 703594 - DNA, 25 bp, Artificial sequence
  Synthetic oligonucleotide
ttcgctggcgtcccgactacgtcac

SEQ ID NO: 703595 - DNA, 25 bp, Artificial sequence
  Synthetic oligonucleotide
gcgggtctcaattggcgcgatggag

SEQ ID NO: 703596 - DNA, 25 bp, Artificial sequence
  Synthetic oligonucleotide
gcggacacgaccgctacgtttcagc

SEQ ID NO: 703597 - DNA, 25 bp, Artificial sequence
  Synthetic oligonucleotide
agcggatacgatcgacgcatggccg

SEQ ID NO: 703598 - DNA, 25 bp, Artificial sequence
  Synthetic oligonucleotide
tcgcgtccgcggtcgtcaaaaggac

SEQ ID NO: 703599 - DNA, 25 bp, Artificial sequence
  Synthetic oligonucleotide
gtcgtgcagtcgaccggtacttgcg

SEQ ID NO: 703600 - DNA, 25 bp, Artificial sequence
  Synthetic oligonucleotide
gtcgtgcagtcgtccggtacttgcg

SEQ ID NO: 703601 - DNA, 25 bp, Artificial sequence
  Synthetic oligonucleotide
aggaatcgtcacccgtaccgtgccg

SEQ ID NO: 703602 - DNA, 25 bp, Artificial sequence
  Synthetic oligonucleotide
aggaatcgtcacgcgtaccgtgccg

SEQ ID NO: 703603 - DNA, 25 bp, Artificial sequence
  Synthetic oligonucleotide
ctggagtataccgggcggtcgcatc

SEQ ID NO: 703604 - DNA, 25 bp, Artificial sequence
  Synthetic oligonucleotide
ctggagtatacccggcggtcgcatc

SEQ ID NO: 703605 - DNA, 25 bp, Artificial sequence
  Synthetic oligonucleotide
tccagtatacgccgaacccccgcct

SEQ ID NO: 703606 - DNA, 25 bp, Artificial sequence
  Synthetic oligonucleotide
tccagtatacgcggaacccccgcct

SEQ ID NO: 703607 - DNA, 25 bp, Artificial sequence
  Synthetic oligonucleotide
cggcctactgtcgcgacacacggtt

SEQ ID NO: 703608 - DNA, 25 bp, Artificial sequence
  Synthetic oligonucleotide
gcggacacgacccctacgtttcagc

SEQ ID NO: 703609 - DNA, 25 bp, Artificial sequence
  Synthetic oligonucleotide
acgggtgtacgttgacgcgagtcgc

SEQ ID NO: 703610 - DNA, 25 bp, Artificial sequence
  Synthetic oligonucleotide
ttcgcgtagtccggtcgtacggcct

SEQ ID NO: 703611 - DNA, 25 bp, Artificial sequence
  Synthetic oligonucleotide
cgcatctcgccaagacgcggaaacg

SEQ ID NO: 703612 - DNA, 25 bp, Artificial sequence
  Synthetic oligonucleotide
cgcatctcgccatgacgcggaaacg

SEQ ID NO: 703613 - DNA, 25 bp, Artificial sequence
  Synthetic oligonucleotide
tcgccttaggacccgcgtactggag

SEQ ID NO: 703614 - DNA, 25 bp, Artificial sequence
  Synthetic oligonucleotide
tcgccttaggacgcgcgtactggag

SEQ ID NO: 703615 - DNA, 25 bp, Artificial sequence
  Synthetic oligonucleotide
accgggggcggtatgtcgatcgatg

SEQ ID NO: 703616 - DNA, 25 bp, Artificial sequence
  Synthetic oligonucleotide
accgggggcggtttgtcgatcgatg

SEQ ID NO: 703617 - DNA, 25 bp, Artificial sequence
  Synthetic oligonucleotide
agtcgcagcgtcggactaggctacg

SEQ ID NO: 703618 - DNA, 25 bp, Artificial sequence
  Synthetic oligonucleotide
agtcgcagcgtccgactaggctacg

SEQ ID NO: 703619 - DNA, 25 bp, Artificial sequence
  Synthetic oligonucleotide
agagaccgtgccctagcgagctctg

SEQ ID NO: 703620 - DNA, 25 bp, Artificial sequence
  Synthetic oligonucleotide
tgggaaactaacccgcggcaagggc

SEQ ID NO: 703621 - DNA, 25 bp, Artificial sequence
  Synthetic oligonucleotide
acgggtgtacgtagacgcgagtcgc

SEQ ID NO: 703622 - DNA, 25 bp, Artificial sequence
  Synthetic oligonucleotide
cgttggtatccgtgcgtcgacgcag

SEQ ID NO: 703623 - DNA, 25 bp, Artificial sequence
  Synthetic oligonucleotide
ggcgcgtatcgcagttacgggtctg

SEQ ID NO: 703624 - DNA, 25 bp, Artificial sequence
  Synthetic oligonucleotide
ggcgcgtatcgctgttacgggtctg

SEQ ID NO: 703625 - DNA, 25 bp, Artificial sequence
  Synthetic oligonucleotide
ttcttggcgttatgcggaccgcccc

SEQ ID NO: 703626 - DNA, 25 bp, Artificial sequence
  Synthetic oligonucleotide
ttcttggcgttaagcggaccgcccc

SEQ ID NO: 703627 - DNA, 25 bp, Artificial sequence
  Synthetic oligonucleotide
acggtccgcgcgtatgatcagtcgg

SEQ ID NO: 703628 - DNA, 25 bp, Artificial sequence
  Synthetic oligonucleotide
acggtccgcgcgaatgatcagtcgg

SEQ ID NO: 703629 - DNA, 25 bp, Artificial sequence
  Synthetic oligonucleotide
ggcctgcgcgccgtgttatgaggaa

SEQ ID NO: 703630 - DNA, 25 bp, Artificial sequence
  Synthetic oligonucleotide
ggcctgcgcgccctgttatgaggaa

SEQ ID NO: 703631 - DNA, 25 bp, Artificial sequence
  Synthetic oligonucleotide
gtccgcttcgaccccgcatgacaga

SEQ ID NO: 703632 - DNA, 25 bp, Artificial sequence
  Synthetic oligonucleotide
gtccgcttcgacgccgcatgacaga

SEQ ID NO: 703633 - DNA, 25 bp, Artificial sequence
  Synthetic oligonucleotide
agagaccgtgccgtagcgagctctg

SEQ ID NO: 703634 - DNA, 25 bp, Artificial sequence
  Synthetic oligonucleotide
ggacataacgcgggccgatcaacgg

SEQ ID NO: 703635 - DNA, 25 bp, Artificial sequence
  Synthetic oligonucleotide
gcgttcgtccgtggtagcgtgcaga

SEQ ID NO: 703636 - DNA, 25 bp, Artificial sequence
  Synthetic oligonucleotide
gcgttcgtccgtcgtagcgtgcaga

SEQ ID NO: 703637 - DNA, 25 bp, Artificial sequence
  Synthetic oligonucleotide
tcgatcgtacaccgcaacgacgggc

SEQ ID NO: 703638 - DNA, 25 bp, Artificial sequence
  Synthetic oligonucleotide
tcgatcgtacacggcaacgacgggc

SEQ ID NO: 703639 - DNA, 25 bp, Artificial sequence
  Synthetic oligonucleotide
cggccccatcgatcgtacgcctagt

SEQ ID NO: 703640 - DNA, 25 bp, Artificial sequence
  Synthetic oligonucleotide
cggccccatcgaacgtacgcctagt

SEQ ID NO: 703641 - DNA, 25 bp, Artificial sequence
  Synthetic oligonucleotide
gacgaagacctaactcgcggtccgc

SEQ ID NO: 703642 - DNA, 25 bp, Artificial sequence
  Synthetic oligonucleotide
gacgaagacctatctcgcggtccgc

SEQ ID NO: 703643 - DNA, 25 bp, Artificial sequence
  Synthetic oligonucleotide
ggggcgttcggactatcggttcagg

SEQ ID NO: 703644 - DNA, 25 bp, Artificial sequence
  Synthetic oligonucleotide
ggggcgttcggagtatcggttcagg

SEQ ID NO: 703645 - DNA, 25 bp, Artificial sequence
  Synthetic oligonucleotide
tgggaaactaacgcgcggcaagggc

SEQ ID NO: 703646 - DNA, 25 bp, Artificial sequence
  Synthetic oligonucleotide
tcgccaggacgctatacgctgagcg

SEQ ID NO: 703647 - DNA, 25 bp, Artificial sequence
  Synthetic oligonucleotide
tcgagggttatgcgcgatcggcagc

SEQ ID NO: 703648 - DNA, 25 bp, Artificial sequence
  Synthetic oligonucleotide
ggacataacgcgcgccgatcaacgg

SEQ ID NO: 703649 - DNA, 25 bp, Artificial sequence
  Synthetic oligonucleotide
gcttgcggtcgagcgtatgttcccg

SEQ ID NO: 703650 - DNA, 25 bp, Artificial sequence
  Synthetic oligonucleotide
gcttgcggtcgaccgtatgttcccg

SEQ ID NO: 703651 - DNA, 25 bp, Artificial sequence
  Synthetic oligonucleotide
tggcgttcgcggcgtacctttccgt

SEQ ID NO: 703652 - DNA, 25 bp, Artificial sequence
  Synthetic oligonucleotide
tggcgttcgcggggtacctttccgt

SEQ ID NO: 703653 - DNA, 25 bp, Artificial sequence
  Synthetic oligonucleotide
gcacgttacggcgcggttgcgatac

SEQ ID NO: 703654 - DNA, 25 bp, Artificial sequence
  Synthetic oligonucleotide
gcacgttacggcccggttgcgatac

SEQ ID NO: 703655 - DNA, 25 bp, Artificial sequence
  Synthetic oligonucleotide
gggcgacgcgtactgacggaaacca

SEQ ID NO: 703656 - DNA, 25 bp, Artificial sequence
  Synthetic oligonucleotide
gggcgacgcgtagtgacggaaacca

SEQ ID NO: 703657 - DNA, 25 bp, Artificial sequence
  Synthetic oligonucleotide
cgttggtatccgagcgtcgacgcag

SEQ ID NO: 703658 - DNA, 25 bp, Artificial sequence
  Synthetic oligonucleotide
tcgccaggacgcaatacgctgagcg

SEQ ID NO: 703659 - DNA, 25 bp, Artificial sequence
  Synthetic oligonucleotide
aggaccttaggcccgacggctactc

SEQ ID NO: 703660 - DNA, 25 bp, Artificial sequence
  Synthetic oligonucleotide
atttggccgcgaggtaacccacggc

SEQ ID NO: 703661 - DNA, 25 bp, Artificial sequence
  Synthetic oligonucleotide
ggattcgttccgtctcgcgagtccc

SEQ ID NO: 703662 - DNA, 25 bp, Artificial sequence
  Synthetic oligonucleotide
ggattcgttccgactcgcgagtccc

SEQ ID NO: 703663 - DNA, 25 bp, Artificial sequence
  Synthetic oligonucleotide
tggtgggtccgcctatcgaagcgtg

SEQ ID NO: 703664 - DNA, 25 bp, Artificial sequence
  Synthetic oligonucleotide
tggtgggtccgcgtatcgaagcgtg

SEQ ID NO: 703665 - DNA, 25 bp, Artificial sequence
  Synthetic oligonucleotide
gcgactgatatcgcaggcgcccaac

SEQ ID NO: 703666 - DNA, 25 bp, Artificial sequence
  Synthetic oligonucleotide
gcgactgatatcccaggcgcccaac

SEQ ID NO: 703667 - DNA, 25 bp, Artificial sequence
  Synthetic oligonucleotide
gagggcatcggacgcgaatggttgg

SEQ ID NO: 703668 - DNA, 25 bp, Artificial sequence
  Synthetic oligonucleotide
gagggcatcggaggcgaatggttgg

SEQ ID NO: 703669 - DNA, 25 bp, Artificial sequence
  Synthetic oligonucleotide
agcggtacggcgcgcgttaatgtcg

SEQ ID NO: 703670 - DNA, 25 bp, Artificial sequence
  Synthetic oligonucleotide
aggtcctagcgttcggcgacccaca

SEQ ID NO: 703671 - DNA, 25 bp, Artificial sequence
  Synthetic oligonucleotide
aggaccttaggcgcgacggctactc

SEQ ID NO: 703672 - DNA, 25 bp, Artificial sequence
  Synthetic oligonucleotide
ggcttggtatgcggcgtcaggagca

SEQ ID NO: 703673 - DNA, 25 bp, Artificial sequence
  Synthetic oligonucleotide
tacgcgggtcaccggtacggtcttg

SEQ ID NO: 703674 - DNA, 25 bp, Artificial sequence
  Synthetic oligonucleotide
tacgcgggtcacgggtacggtcttg

SEQ ID NO: 703675 - DNA, 25 bp, Artificial sequence
  Synthetic oligonucleotide
aggcgcagcccgggtaagtatgacg

SEQ ID NO: 703676 - DNA, 25 bp, Artificial sequence
  Synthetic oligonucleotide
aggcgcagcccgcgtaagtatgacg

SEQ ID NO: 703677 - DNA, 25 bp, Artificial sequence
  Synthetic oligonucleotide
ttcgcccggtcgctgcgtattctcc

SEQ ID NO: 703678 - DNA, 25 bp, Artificial sequence
  Synthetic oligonucleotide
ttcgcccggtcggtgcgtattctcc

SEQ ID NO: 703679 - DNA, 25 bp, Artificial sequence
  Synthetic oligonucleotide
cgcactccgacgacttacgggtgtc

SEQ ID NO: 703680 - DNA, 25 bp, Artificial sequence
  Synthetic oligonucleotide
cgcactccgacgtcttacgggtgtc

SEQ ID NO: 703681 - DNA, 25 bp, Artificial sequence
  Synthetic oligonucleotide
caagggaaatcgccgcacggcctct

SEQ ID NO: 703682 - DNA, 25 bp, Artificial sequence
  Synthetic oligonucleotide
caagggaaatcggcgcacggcctct

SEQ ID NO: 703683 - DNA, 25 bp, Artificial sequence
  Synthetic oligonucleotide
agcggtacggcgggcgttaatgtcg

SEQ ID NO: 703684 - DNA, 25 bp, Artificial sequence
  Synthetic oligonucleotide
accgaccggtatctcgcgtgtcgga

SEQ ID NO: 703685 - DNA, 25 bp, Artificial sequence
  Synthetic oligonucleotide
gcgtctgcgcaaatcatcgggctcg

SEQ ID NO: 703686 - DNA, 25 bp, Artificial sequence
  Synthetic oligonucleotide
gcgtctgcgcaattcatcgggctcg

SEQ ID NO: 703687 - DNA, 25 bp, Artificial sequence
  Synthetic oligonucleotide
tgaccggtactcgacgtagcccacc

SEQ ID NO: 703688 - DNA, 25 bp, Artificial sequence
  Synthetic oligonucleotide
tgaccggtactccacgtagcccacc

SEQ ID NO: 703689 - DNA, 25 bp, Artificial sequence
  Synthetic oligonucleotide
cctccagctcgttgcgctaacggct

SEQ ID NO: 703690 - DNA, 25 bp, Artificial sequence
  Synthetic oligonucleotide
cctccagctcgtagcgctaacggct

SEQ ID NO: 703691 - DNA, 25 bp, Artificial sequence
  Synthetic oligonucleotide
tcccagggtacgttcgtacgccgag

SEQ ID NO: 703692 - DNA, 25 bp, Artificial sequence
  Synthetic oligonucleotide
tcccagggtacgatcgtacgccgag

SEQ ID NO: 703693 - DNA, 25 bp, Artificial sequence
  Synthetic oligonucleotide
cgtaactaccgaggaacgcgggctc

SEQ ID NO: 703694 - DNA, 25 bp, Artificial sequence
  Synthetic oligonucleotide
cgtaactaccgacgaacgcgggctc

SEQ ID NO: 703695 - DNA, 25 bp, Artificial sequence
  Synthetic oligonucleotide
aggtcctagcgtacggcgacccaca

SEQ ID NO: 703696 - DNA, 25 bp, Artificial sequence
  Synthetic oligonucleotide
gcgcggtctgatacgtcgcgaactc

SEQ ID NO: 703697 - DNA, 25 bp, Artificial sequence
  Synthetic oligonucleotide
ggcccttcgcgctaggtaggcagat

SEQ ID NO: 703698 - DNA, 25 bp, Artificial sequence
  Synthetic oligonucleotide
accgaccggtatgtcgcgtgtcgga

SEQ ID NO: 703699 - DNA, 25 bp, Artificial sequence
  Synthetic oligonucleotide
atgtctgacctatccgcgccggcca

SEQ ID NO: 703700 - DNA, 25 bp, Artificial sequence
  Synthetic oligonucleotide
atgtctgacctaaccgcgccggcca

SEQ ID NO: 703701 - DNA, 25 bp, Artificial sequence
  Synthetic oligonucleotide
gtagggcggcggataccgtggtatg

SEQ ID NO: 703702 - DNA, 25 bp, Artificial sequence
  Synthetic oligonucleotide
gtagggcggcggttaccgtggtatg

SEQ ID NO: 703703 - DNA, 25 bp, Artificial sequence
  Synthetic oligonucleotide
aatcggcgtgcgatcgaccgcacag

SEQ ID NO: 703704 - DNA, 25 bp, Artificial sequence
  Synthetic oligonucleotide
aatcggcgtgcgttcgaccgcacag

SEQ ID NO: 703705 - DNA, 25 bp, Artificial sequence
  Synthetic oligonucleotide
caacctgtacgatccgggaaggggc

SEQ ID NO: 703706 - DNA, 25 bp, Artificial sequence
  Synthetic oligonucleotide
caacctgtacgaaccgggaaggggc

SEQ ID NO: 703707 - DNA, 25 bp, Artificial sequence
  Synthetic oligonucleotide
ggcttggtatgccgcgtcaggagca

SEQ ID NO: 703708 - DNA, 25 bp, Artificial sequence
  Synthetic oligonucleotide
gcgcggtctgattcgtcgcgaactc

SEQ ID NO: 703709 - DNA, 25 bp, Artificial sequence
  Synthetic oligonucleotide
agggttcggcccaatcgtagagcgg

SEQ ID NO: 703710 - DNA, 25 bp, Artificial sequence
  Synthetic oligonucleotide
gtcgtaccgcgccactataggtccc

SEQ ID NO: 703711 - DNA, 25 bp, Artificial sequence
  Synthetic oligonucleotide
gtcgtaccgcgcgactataggtccc

SEQ ID NO: 703712 - DNA, 25 bp, Artificial sequence
  Synthetic oligonucleotide
gggctgtacgtcgcgccaactcatg

SEQ ID NO: 703713 - DNA, 25 bp, Artificial sequence
  Synthetic oligonucleotide
gggctgtacgtcccgccaactcatg

SEQ ID NO: 703714 - DNA, 25 bp, Artificial sequence
  Synthetic oligonucleotide
gctggtatcgcccgctagtagccca

SEQ ID NO: 703715 - DNA, 25 bp, Artificial sequence
  Synthetic oligonucleotide
gctggtatcgccggctagtagccca

SEQ ID NO: 703716 - DNA, 25 bp, Artificial sequence
  Synthetic oligonucleotide
tacgcgcgtaagagcggttcggtcc

SEQ ID NO: 703717 - DNA, 25 bp, Artificial sequence
  Synthetic oligonucleotide
tacgcgcgtaagtgcggttcggtcc

SEQ ID NO: 703718 - DNA, 25 bp, Artificial sequence
  Synthetic oligonucleotide
tcaggcacgtccggacgtattgccg

SEQ ID NO: 703719 - DNA, 25 bp, Artificial sequence
  Synthetic oligonucleotide
tcaggcacgtcccgacgtattgccg

SEQ ID NO: 703720 - DNA, 25 bp, Artificial sequence
  Synthetic oligonucleotide
ctgaggtcgcgcacttacggtgacc

SEQ ID NO: 703721 - DNA, 25 bp, Artificial sequence
  Synthetic oligonucleotide
gactgaagttcgcgtaggctcgggc

SEQ ID NO: 703722 - DNA, 25 bp, Artificial sequence
  Synthetic oligonucleotide
cccggtaggtatggcgaacctgacc

SEQ ID NO: 703723 - DNA, 25 bp, Artificial sequence
  Synthetic oligonucleotide
agggttcggccctatcgtagagcgg

SEQ ID NO: 703724 - DNA, 25 bp, Artificial sequence
  Synthetic oligonucleotide
ccatccacagcgaagcgcgttccga

SEQ ID NO: 703725 - DNA, 25 bp, Artificial sequence
  Synthetic oligonucleotide
ccatccacagcgtagcgcgttccga

SEQ ID NO: 703726 - DNA, 25 bp, Artificial sequence
  Synthetic oligonucleotide
ggcgggtgactcccgtcgttcgttt

SEQ ID NO: 703727 - DNA, 25 bp, Artificial sequence
  Synthetic oligonucleotide
ggcgggtgactcgcgtcgttcgttt

SEQ ID NO: 703728 - DNA, 25 bp, Artificial sequence
  Synthetic oligonucleotide
tccggcatagcccacggtcaacacc

SEQ ID NO: 703729 - DNA, 25 bp, Artificial sequence
  Synthetic oligonucleotide
gccgtacgcgttacgacgtggcgta

SEQ ID NO: 703730 - DNA, 25 bp, Artificial sequence
  Synthetic oligonucleotide
ttgcggcgcttaccggtaggacgct

SEQ ID NO: 703731 - DNA, 25 bp, Artificial sequence
  Synthetic oligonucleotide
tggaagtcgagcctgatcggggcct

SEQ ID NO: 703732 - DNA, 25 bp, Artificial sequence
  Synthetic oligonucleotide
ttgcggcgcttagcggtaggacgct

SEQ ID NO: 703733 - DNA, 25 bp, Artificial sequence
  Synthetic oligonucleotide
gactgaagttcgggtaggctcgggc

SEQ ID NO: 703734 - DNA, 25 bp, Artificial sequence
  Synthetic oligonucleotide
agacgccgatagcggtccgttggac

SEQ ID NO: 703735 - DNA, 25 bp, Artificial sequence
  Synthetic oligonucleotide
tccggcatagccgacggtcaacacc

SEQ ID NO: 703736 - DNA, 25 bp, Artificial sequence
  Synthetic oligonucleotide
ggcccttcgcgcaaggtaggcagat

SEQ ID NO: 703737 - DNA, 25 bp, Artificial sequence
  Synthetic oligonucleotide
acgaagtatcgcccgggcgtacgtc

SEQ ID NO: 703738 - DNA, 25 bp, Artificial sequence
  Synthetic oligonucleotide
acgaagtatcgcgcgggcgtacgtc

SEQ ID NO: 703739 - DNA, 25 bp, Artificial sequence
  Synthetic oligonucleotide
ccggcacgataccgactggctaacg

SEQ ID NO: 703740 - DNA, 25 bp, Artificial sequence
  Synthetic oligonucleotide
ccggcacgatacggactggctaacg

SEQ ID NO: 703741 - DNA, 25 bp, Artificial sequence
  Synthetic oligonucleotide
aagcgaagccgtagtcgcgctgcct

SEQ ID NO: 703742 - DNA, 25 bp, Artificial sequence
  Synthetic oligonucleotide
aagcgaagccgttgtcgcgctgcct

SEQ ID NO: 703743 - DNA, 25 bp, Artificial sequence
  Synthetic oligonucleotide
acatcctccgcgacgggtaggagct

SEQ ID NO: 703744 - DNA, 25 bp, Artificial sequence
  Synthetic oligonucleotide
acatcctccgcgtcgggtaggagct

SEQ ID NO: 703745 - DNA, 25 bp, Artificial sequence
  Synthetic oligonucleotide
gggtgactagcgcgcgtaatggcac

SEQ ID NO: 703746 - DNA, 25 bp, Artificial sequence
  Synthetic oligonucleotide
tttgccttcgtcgaccgcgaggcgt

SEQ ID NO: 703747 - DNA, 25 bp, Artificial sequence
  Synthetic oligonucleotide
gggtgactagcgggcgtaatggcac

SEQ ID NO: 703748 - DNA, 25 bp, Artificial sequence
  Synthetic oligonucleotide
agacgccgataggggtccgttggac

SEQ ID NO: 703749 - DNA, 25 bp, Artificial sequence
  Synthetic oligonucleotide
acctgctcgcgctccgtagaaggga

SEQ ID NO: 703750 - DNA, 25 bp, Artificial sequence
  Synthetic oligonucleotide
acctgctcgcgcaccgtagaaggga

SEQ ID NO: 703751 - DNA, 25 bp, Artificial sequence
  Synthetic oligonucleotide
gattgcgccgacctctatccgtcgc

SEQ ID NO: 703752 - DNA, 25 bp, Artificial sequence
  Synthetic oligonucleotide
gattgcgccgacgtctatccgtcgc

SEQ ID NO: 703753 - DNA, 25 bp, Artificial sequence
  Synthetic oligonucleotide
caggagcgcgcaatggtccgatcgt

SEQ ID NO: 703754 - DNA, 25 bp, Artificial sequence
  Synthetic oligonucleotide
caggagcgcgcattggtccgatcgt

SEQ ID NO: 703755 - DNA, 25 bp, Artificial sequence
  Synthetic oligonucleotide
gtggcactcttacgacgcggcttcc

SEQ ID NO: 703756 - DNA, 25 bp, Artificial sequence
  Synthetic oligonucleotide
gtggcactcttaggacgcggcttcc

SEQ ID NO: 703757 - DNA, 25 bp, Artificial sequence
  Synthetic oligonucleotide
cccggtaggtatcgcgaacctgacc

SEQ ID NO: 703758 - DNA, 25 bp, Artificial sequence
  Synthetic oligonucleotide
ctgaggtcgcgctcttacggtgacc

SEQ ID NO: 703759 - DNA, 25 bp, Artificial sequence
  Synthetic oligonucleotide
tttgccttcgtccaccgcgaggcgt

SEQ ID NO: 703760 - DNA, 25 bp, Artificial sequence
  Synthetic oligonucleotide
agccaatgcctaacgcgcccatggg

SEQ ID NO: 703761 - DNA, 25 bp, Artificial sequence
  Synthetic oligonucleotide
aaacaccgttacgaccgcgcctggc

SEQ ID NO: 703762 - DNA, 25 bp, Artificial sequence
  Synthetic oligonucleotide
aaacaccgttaccaccgcgcctggc

SEQ ID NO: 703763 - DNA, 25 bp, Artificial sequence
  Synthetic oligonucleotide
ccgctgactagaacggcgcagccta

SEQ ID NO: 703764 - DNA, 25 bp, Artificial sequence
  Synthetic oligonucleotide
ccgctgactagatcggcgcagccta

SEQ ID NO: 703765 - DNA, 25 bp, Artificial sequence
  Synthetic oligonucleotide
gaaccattacgctcggcgacaccgc

SEQ ID NO: 703766 - DNA, 25 bp, Artificial sequence
  Synthetic oligonucleotide
gaaccattacgcacggcgacaccgc

SEQ ID NO: 703767 - DNA, 25 bp, Artificial sequence
  Synthetic oligonucleotide
cacaccgctacgtcggacagctcga

SEQ ID NO: 703768 - DNA, 25 bp, Artificial sequence
  Synthetic oligonucleotide
cacaccgctacgacggacagctcga

SEQ ID NO: 703769 - DNA, 25 bp, Artificial sequence
  Synthetic oligonucleotide
gtaagccccgtcgcgtacggatcca

SEQ ID NO: 703770 - DNA, 25 bp, Artificial sequence
  Synthetic oligonucleotide
gtaagccccgtcccgtacggatcca

SEQ ID NO: 703771 - DNA, 25 bp, Artificial sequence
  Synthetic oligonucleotide
agtgccacgcgtggatagcgtggag

SEQ ID NO: 703772 - DNA, 25 bp, Artificial sequence
  Synthetic oligonucleotide
tcgtcagggcgtactcgcacagctc

SEQ ID NO: 703773 - DNA, 25 bp, Artificial sequence
  Synthetic oligonucleotide
cccagcacgcgtagtaccggggtta

SEQ ID NO: 703774 - DNA, 25 bp, Artificial sequence
  Synthetic oligonucleotide
agccaatgcctatcgcgcccatggg

SEQ ID NO: 703775 - DNA, 25 bp, Artificial sequence
  Synthetic oligonucleotide
ccgagtttaactccgcgcggccatc

SEQ ID NO: 703776 - DNA, 25 bp, Artificial sequence
  Synthetic oligonucleotide
ccgagtttaactgcgcgcggccatc

SEQ ID NO: 703777 - DNA, 25 bp, Artificial sequence
  Synthetic oligonucleotide
cctcgtccgcgtagcgttggcagta

SEQ ID NO: 703778 - DNA, 25 bp, Artificial sequence
  Synthetic oligonucleotide
cctcgtccgcgttgcgttggcagta

SEQ ID NO: 703779 - DNA, 25 bp, Artificial sequence
  Synthetic oligonucleotide
ctgtgaaccgacggcgaatgcacgg

SEQ ID NO: 703780 - DNA, 25 bp, Artificial sequence
  Synthetic oligonucleotide
ctgtgaaccgaccgcgaatgcacgg

SEQ ID NO: 703781 - DNA, 25 bp, Artificial sequence
  Synthetic oligonucleotide
acggagttacgccacctacgcgtcc

SEQ ID NO: 703782 - DNA, 25 bp, Artificial sequence
  Synthetic oligonucleotide
acggagttacgcgacctacgcgtcc

SEQ ID NO: 703783 - DNA, 25 bp, Artificial sequence
  Synthetic oligonucleotide
agtgccacgcgtcgatagcgtggag

SEQ ID NO: 703784 - DNA, 25 bp, Artificial sequence
  Synthetic oligonucleotide
tcgtcagggcgttctcgcacagctc

SEQ ID NO: 703785 - DNA, 25 bp, Artificial sequence
  Synthetic oligonucleotide
aagcagtgtaccaccggcggggact

SEQ ID NO: 703786 - DNA, 25 bp, Artificial sequence
  Synthetic oligonucleotide
atttggccgcgacgtaacccacggc

SEQ ID NO: 703787 - DNA, 25 bp, Artificial sequence
  Synthetic oligonucleotide
cacctcataccggacgcgttcggtc

SEQ ID NO: 703788 - DNA, 25 bp, Artificial sequence
  Synthetic oligonucleotide
cacctcataccgcacgcgttcggtc

SEQ ID NO: 703789 - DNA, 25 bp, Artificial sequence
  Synthetic oligonucleotide
gcccagaatccgcgcgacaggaagt

SEQ ID NO: 703790 - DNA, 25 bp, Artificial sequence
  Synthetic oligonucleotide
gcttgtccgtggaacgcgaacgtgc

SEQ ID NO: 703791 - DNA, 25 bp, Artificial sequence
  Synthetic oligonucleotide
gcttgtccgtggtacgcgaacgtgc

SEQ ID NO: 703792 - DNA, 25 bp, Artificial sequence
  Synthetic oligonucleotide
gctggagacctaggtaccgcaccac

SEQ ID NO: 703793 - DNA, 25 bp, Artificial sequence
  Synthetic oligonucleotide
gctggagacctacgtaccgcaccac

SEQ ID NO: 703794 - DNA, 25 bp, Artificial sequence
  Synthetic oligonucleotide
ggccatgcgcgtttaaccgggtagg

SEQ ID NO: 703795 - DNA, 25 bp, Artificial sequence
  Synthetic oligonucleotide
ggccatgcgcgtataaccgggtagg

SEQ ID NO: 703796 - DNA, 25 bp, Artificial sequence
  Synthetic oligonucleotide
ccacacatcggtggcgcacgggaat

SEQ ID NO: 703797 - DNA, 25 bp, Artificial sequence
  Synthetic oligonucleotide
cagatgcgccgtagggtaagtcccg

SEQ ID NO: 703798 - DNA, 25 bp, Artificial sequence
  Synthetic oligonucleotide
ccacacatcggtcgcgcacgggaat

SEQ ID NO: 703799 - DNA, 25 bp, Artificial sequence
  Synthetic oligonucleotide
aagcagtgtacctccggcggggact

SEQ ID NO: 703800 - DNA, 25 bp, Artificial sequence
  Synthetic oligonucleotide
ggctcgcgttagcggatgcaaaccg

SEQ ID NO: 703801 - DNA, 25 bp, Artificial sequence
  Synthetic oligonucleotide
ggctcgcgttaggggatgcaaaccg

SEQ ID NO: 703802 - DNA, 25 bp, Artificial sequence
  Synthetic oligonucleotide
gcactcacgtcgcacgtcccatcac

SEQ ID NO: 703803 - DNA, 25 bp, Artificial sequence
  Synthetic oligonucleotide
gcactcacgtcggacgtcccatcac

SEQ ID NO: 703804 - DNA, 25 bp, Artificial sequence
  Synthetic oligonucleotide
cgcttatagcgttcgtcgcccgtgc

SEQ ID NO: 703805 - DNA, 25 bp, Artificial sequence
  Synthetic oligonucleotide
cgcttatagcgtacgtcgcccgtgc

SEQ ID NO: 703806 - DNA, 25 bp, Artificial sequence
  Synthetic oligonucleotide
gggcattaacgacgtccgccgctca

SEQ ID NO: 703807 - DNA, 25 bp, Artificial sequence
  Synthetic oligonucleotide
gggcattaacgaggtccgccgctca

SEQ ID NO: 703808 - DNA, 25 bp, Artificial sequence
  Synthetic oligonucleotide
cccagcacgcgttgtaccggggtta

SEQ ID NO: 703809 - DNA, 25 bp, Artificial sequence
  Synthetic oligonucleotide
gcccagaatccgggcgacaggaagt

SEQ ID NO: 703810 - DNA, 25 bp, Artificial sequence
  Synthetic oligonucleotide
cagatgcgccgttgggtaagtcccg

SEQ ID NO: 703811 - DNA, 25 bp, Artificial sequence
  Synthetic oligonucleotide
tgcaaccgtaacggccgaagccggt

SEQ ID NO: 703812 - DNA, 25 bp, Artificial sequence
  Synthetic oligonucleotide
ctctgctatgcccaccgttcacggg

SEQ ID NO: 703813 - DNA, 25 bp, Artificial sequence
  Synthetic oligonucleotide
agcatggacgtaacgcgcgtctccc

SEQ ID NO: 703814 - DNA, 25 bp, Artificial sequence
  Synthetic oligonucleotide
agcatggacgtatcgcgcgtctccc

SEQ ID NO: 703815 - DNA, 25 bp, Artificial sequence
  Synthetic oligonucleotide
gggagacgacgttgcgcgatgctct

SEQ ID NO: 703816 - DNA, 25 bp, Artificial sequence
  Synthetic oligonucleotide
gggagacgacgtagcgcgatgctct

SEQ ID NO: 703817 - DNA, 25 bp, Artificial sequence
  Synthetic oligonucleotide
tggaagtcgagcgtgatcggggcct

SEQ ID NO: 703818 - DNA, 25 bp, Artificial sequence
  Synthetic oligonucleotide
tcccgtcacgcggtatcgtaggtgc

SEQ ID NO: 703819 - DNA, 25 bp, Artificial sequence
  Synthetic oligonucleotide
aatcagcgagtatccgcgggggcac

SEQ ID NO: 703820 - DNA, 25 bp, Artificial sequence
  Synthetic oligonucleotide
ccggaagtccggacgtacgaagcga

SEQ ID NO: 703821 - DNA, 25 bp, Artificial sequence
  Synthetic oligonucleotide
ctctgctatgccgaccgttcacggg

SEQ ID NO: 703822 - DNA, 25 bp, Artificial sequence
  Synthetic oligonucleotide
tgcaaccgtaaccgccgaagccggt

SEQ ID NO: 703823 - DNA, 25 bp, Artificial sequence
  Synthetic oligonucleotide
ccggaagtccggtcgtacgaagcga

SEQ ID NO: 703824 - DNA, 25 bp, Artificial sequence
  Synthetic oligonucleotide
ccgagcgggtctggtacgacggtaa

SEQ ID NO: 703825 - DNA, 25 bp, Artificial sequence
  Synthetic oligonucleotide
ccgagcgggtctcgtacgacggtaa

SEQ ID NO: 703826 - DNA, 25 bp, Artificial sequence
  Synthetic oligonucleotide
cggacccgcgacccctatatcctga

SEQ ID NO: 703827 - DNA, 25 bp, Artificial sequence
  Synthetic oligonucleotide
cggacccgcgacgcctatatcctga

SEQ ID NO: 703828 - DNA, 25 bp, Artificial sequence
  Synthetic oligonucleotide
gaacgccgcaaagggctagtccacg

SEQ ID NO: 703829 - DNA, 25 bp, Artificial sequence
  Synthetic oligonucleotide
gaacgccgcaaacggctagtccacg

SEQ ID NO: 703830 - DNA, 25 bp, Artificial sequence
  Synthetic oligonucleotide
aatcagcgagtaaccgcgggggcac

SEQ ID NO: 703831 - DNA, 25 bp, Artificial sequence
  Synthetic oligonucleotide
gtcacagggtcgcgtcgaatgctcg

SEQ ID NO: 703832 - DNA, 25 bp, Artificial sequence
  Synthetic oligonucleotide
gtcacagggtcgggtcgaatgctcg

SEQ ID NO: 703833 - DNA, 25 bp, Artificial sequence
  Synthetic oligonucleotide
cgcacttctacgggcgtcgaccagt

SEQ ID NO: 703834 - DNA, 25 bp, Artificial sequence
  Synthetic oligonucleotide
gaatcgaggtccgtagcgcagcgca

SEQ ID NO: 703835 - DNA, 25 bp, Artificial sequence
  Synthetic oligonucleotide
tgctagggtccgcaacgttgccgca

SEQ ID NO: 703836 - DNA, 25 bp, Artificial sequence
  Synthetic oligonucleotide
ggtacgccgacgcgtacttcggcta

SEQ ID NO: 703837 - DNA, 25 bp, Artificial sequence
  Synthetic oligonucleotide
ggtacgccgacgggtacttcggcta

SEQ ID NO: 703838 - DNA, 25 bp, Artificial sequence
  Synthetic oligonucleotide
gaatcgaggtccctagcgcagcgca

SEQ ID NO: 703839 - DNA, 25 bp, Artificial sequence
  Synthetic oligonucleotide
gtccgcacattaggcgcccgctaac

SEQ ID NO: 703840 - DNA, 25 bp, Artificial sequence
  Synthetic oligonucleotide
ggctcgtaacgcgacgttgctggtg

SEQ ID NO: 703841 - DNA, 25 bp, Artificial sequence
  Synthetic oligonucleotide
tcggcataagccggccgtaggcaga

SEQ ID NO: 703842 - DNA, 25 bp, Artificial sequence
  Synthetic oligonucleotide
tcggcataagcccgccgtaggcaga

SEQ ID NO: 703843 - DNA, 25 bp, Artificial sequence
  Synthetic oligonucleotide
caccacgtaccggtacgaccctagc

SEQ ID NO: 703844 - DNA, 25 bp, Artificial sequence
  Synthetic oligonucleotide
ggctcgtaacgccacgttgctggtg

SEQ ID NO: 703845 - DNA, 25 bp, Artificial sequence
  Synthetic oligonucleotide
tgctagggtccggaacgttgccgca

SEQ ID NO: 703846 - DNA, 25 bp, Artificial sequence
  Synthetic oligonucleotide
ggaccccgtatactcgggcctatcg

SEQ ID NO: 703847 - DNA, 25 bp, Artificial sequence
  Synthetic oligonucleotide
ggaccccgtatagtcgggcctatcg

SEQ ID NO: 703848 - DNA, 25 bp, Artificial sequence
  Synthetic oligonucleotide
ggtgggcctagcccggtttcccaaa

SEQ ID NO: 703849 - DNA, 25 bp, Artificial sequence
  Synthetic oligonucleotide
gtccgcacattacgcgcccgctaac

SEQ ID NO: 703850 - DNA, 25 bp, Artificial sequence
  Synthetic oligonucleotide
ctgagccgagcccactatcttccgg

SEQ ID NO: 703851 - DNA, 25 bp, Artificial sequence
  Synthetic oligonucleotide
caccacgtaccgctacgaccctagc

SEQ ID NO: 703852 - DNA, 25 bp, Artificial sequence
  Synthetic oligonucleotide
ctgagccgagccgactatcttccgg

SEQ ID NO: 703853 - DNA, 25 bp, Artificial sequence
  Synthetic oligonucleotide
ggtgggcctagcgcggtttcccaaa

SEQ ID NO: 703854 - DNA, 25 bp, Artificial sequence
  Synthetic oligonucleotide
gtgggcagttatttcgcgcgacccg

SEQ ID NO: 703855 - DNA, 25 bp, Artificial sequence
  Synthetic oligonucleotide
cgcacttctacgcgcgtcgaccagt

SEQ ID NO: 703856 - DNA, 25 bp, Artificial sequence
  Synthetic oligonucleotide
gtgggcagttatatcgcgcgacccg

SEQ ID NO: 703857 - DNA, 25 bp, Artificial sequence
  Synthetic oligonucleotide
gtagaacgttgttcccgcgcgtggg

SEQ ID NO: 703858 - DNA, 25 bp, Artificial sequence
  Synthetic oligonucleotide
gtagaacgttgtacccgcgcgtggg

SEQ ID NO: 703859 - DNA, 25 bp, Artificial sequence
  Synthetic oligonucleotide
ttggggcgcgtacgatgtcgccgct

SEQ ID NO: 703860 - DNA, 25 bp, Artificial sequence
  Synthetic oligonucleotide
tcagtgagcgggacgtacgggtgcc

SEQ ID NO: 703861 - DNA, 25 bp, Artificial sequence
  Synthetic oligonucleotide
tcagtgagcgggtcgtacgggtgcc

SEQ ID NO: 703862 - DNA, 25 bp, Artificial sequence
  Synthetic oligonucleotide
cggtccgcggttggcggaatgatcg

SEQ ID NO: 703863 - DNA, 25 bp, Artificial sequence
  Synthetic oligonucleotide
agaggtgtccggggtcataccccgc

SEQ ID NO: 703864 - DNA, 25 bp, Artificial sequence
  Synthetic oligonucleotide
agaggtgtccggcgtcataccccgc

SEQ ID NO: 703865 - DNA, 25 bp, Artificial sequence
  Synthetic oligonucleotide
gtgctgtcggacgtgcgagcgttgc

SEQ ID NO: 703866 - DNA, 25 bp, Artificial sequence
  Synthetic oligonucleotide
gtgctgtcggacctgcgagcgttgc

SEQ ID NO: 703867 - DNA, 25 bp, Artificial sequence
  Synthetic oligonucleotide
ttggggcgcgtaggatgtcgccgct

SEQ ID NO: 703868 - DNA, 25 bp, Artificial sequence
  Synthetic oligonucleotide
cggtccgcggttcgcggaatgatcg

SEQ ID NO: 703869 - DNA, 25 bp, Artificial sequence
  Synthetic oligonucleotide
gctcctgcgtcgggctataggggtg

SEQ ID NO: 703870 - DNA, 25 bp, Artificial sequence
  Synthetic oligonucleotide
gctcctgcgtcgcgctataggggtg

SEQ ID NO: 703871 - DNA, 25 bp, Artificial sequence
  Synthetic oligonucleotide
tctggacgtacgtccgcgtcgggtg

SEQ ID NO: 703872 - DNA, 25 bp, Artificial sequence
  Synthetic oligonucleotide
tctggacgtacgaccgcgtcgggtg

SEQ ID NO: 703873 - DNA, 25 bp, Artificial sequence
  Synthetic oligonucleotide
aggtcgcgaccacggtacgagtggc

SEQ ID NO: 703874 - DNA, 25 bp, Artificial sequence
  Synthetic oligonucleotide
aggtcgcgaccagggtacgagtggc

SEQ ID NO: 703875 - DNA, 25 bp, Artificial sequence
  Synthetic oligonucleotide
gcctgccggagcgttacgcgtacct

SEQ ID NO: 703876 - DNA, 25 bp, Artificial sequence
  Synthetic oligonucleotide
gcctgccggagccttacgcgtacct

SEQ ID NO: 703877 - DNA, 25 bp, Artificial sequence
  Synthetic oligonucleotide
cttaggcgccataggatcgcccggc

SEQ ID NO: 703878 - DNA, 25 bp, Artificial sequence
  Synthetic oligonucleotide
ccggcctcgcgcgttgacatcgcta

SEQ ID NO: 703879 - DNA, 25 bp, Artificial sequence
  Synthetic oligonucleotide
gactcgatagccgcgcgcgagctac

SEQ ID NO: 703880 - DNA, 25 bp, Artificial sequence
  Synthetic oligonucleotide
gactcgatagccccgcgcgagctac

SEQ ID NO: 703881 - DNA, 25 bp, Artificial sequence
  Synthetic oligonucleotide
cttaggcgccattggatcgcccggc

SEQ ID NO: 703882 - DNA, 25 bp, Artificial sequence
  Synthetic oligonucleotide
ggatgccgcgagtctaagcgcccct

SEQ ID NO: 703883 - DNA, 25 bp, Artificial sequence
  Synthetic oligonucleotide
tgacccctagcgcaagccgtctgcc

SEQ ID NO: 703884 - DNA, 25 bp, Artificial sequence
  Synthetic oligonucleotide
tgacccctagcggaagccgtctgcc

SEQ ID NO: 703885 - DNA, 25 bp, Artificial sequence
  Synthetic oligonucleotide
tgaaccagcgcgacgtaccgcaggc

SEQ ID NO: 703886 - DNA, 25 bp, Artificial sequence
  Synthetic oligonucleotide
tcgcccctctacccgccgatgccta

SEQ ID NO: 703887 - DNA, 25 bp, Artificial sequence
  Synthetic oligonucleotide
cggcaaaggcgcggtatcgcgcgat

SEQ ID NO: 703888 - DNA, 25 bp, Artificial sequence
  Synthetic oligonucleotide
cggcaaaggcgccgtatcgcgcgat

SEQ ID NO: 703889 - DNA, 25 bp, Artificial sequence
  Synthetic oligonucleotide
cacgtcgtacggttcgcggcagtgc

SEQ ID NO: 703890 - DNA, 25 bp, Artificial sequence
  Synthetic oligonucleotide
cacgtcgtacggatcgcggcagtgc

SEQ ID NO: 703891 - DNA, 25 bp, Artificial sequence
  Synthetic oligonucleotide
agcccccccgcgaatcgggatgatg

SEQ ID NO: 703892 - DNA, 25 bp, Artificial sequence
  Synthetic oligonucleotide
agcccccccgcgtatcgggatgatg

SEQ ID NO: 703893 - DNA, 25 bp, Artificial sequence
  Synthetic oligonucleotide
tcgcccctctacgcgccgatgccta

SEQ ID NO: 703894 - DNA, 25 bp, Artificial sequence
  Synthetic oligonucleotide
gggtaggcggtcggcactaggtcga

SEQ ID NO: 703895 - DNA, 25 bp, Artificial sequence
  Synthetic oligonucleotide
ccggcctcgcgccttgacatcgcta

SEQ ID NO: 703896 - DNA, 25 bp, Artificial sequence
  Synthetic oligonucleotide
ggatgccgcgagactaagcgcccct

SEQ ID NO: 703897 - DNA, 25 bp, Artificial sequence
  Synthetic oligonucleotide
tgctccgggtacctcgagcgcagag

SEQ ID NO: 703898 - DNA, 25 bp, Artificial sequence
  Synthetic oligonucleotide
tgctccgggtacgtcgagcgcagag

SEQ ID NO: 703899 - DNA, 25 bp, Artificial sequence
  Synthetic oligonucleotide
cgctgtccgacgtacgactgccagc

SEQ ID NO: 703900 - DNA, 25 bp, Artificial sequence
  Synthetic oligonucleotide
cgctgtccgacgaacgactgccagc

SEQ ID NO: 703901 - DNA, 25 bp, Artificial sequence
  Synthetic oligonucleotide
tgcggttcgcgcctacgactccgag

SEQ ID NO: 703902 - DNA, 25 bp, Artificial sequence
  Synthetic oligonucleotide
tgcggttcgcgcgtacgactccgag

SEQ ID NO: 703903 - DNA, 25 bp, Artificial sequence
  Synthetic oligonucleotide
gtgcgagtcgtaccgcgaccttgcc

SEQ ID NO: 703904 - DNA, 25 bp, Artificial sequence
  Synthetic oligonucleotide
gtgcgagtcgtagcgcgaccttgcc

SEQ ID NO: 703905 - DNA, 25 bp, Artificial sequence
  Synthetic oligonucleotide
tcgcggcgtcgttcgtcggtctgga

SEQ ID NO: 703906 - DNA, 25 bp, Artificial sequence
  Synthetic oligonucleotide
tcgcggcgtcgtacgtcggtctgga

SEQ ID NO: 703907 - DNA, 25 bp, Artificial sequence
  Synthetic oligonucleotide
gggtaggcggtccgcactaggtcga

SEQ ID NO: 703908 - DNA, 25 bp, Artificial sequence
  Synthetic oligonucleotide
acttcgcgaacggcctacggcacgg

SEQ ID NO: 703909 - DNA, 25 bp, Artificial sequence
  Synthetic oligonucleotide
acttcccgcgcgatagacgcgccca

SEQ ID NO: 703910 - DNA, 25 bp, Artificial sequence
  Synthetic oligonucleotide
gagcccgcgcgttataacgcccgga

SEQ ID NO: 703911 - DNA, 25 bp, Artificial sequence
  Synthetic oligonucleotide
gagcccgcgcgtaataacgcccgga

SEQ ID NO: 703912 - DNA, 25 bp, Artificial sequence
  Synthetic oligonucleotide
gatgcccgcaattccccgcgagctg

SEQ ID NO: 703913 - DNA, 25 bp, Artificial sequence
  Synthetic oligonucleotide
gatgcccgcaataccccgcgagctg

SEQ ID NO: 703914 - DNA, 25 bp, Artificial sequence
  Synthetic oligonucleotide
cgcagatacggcgggtccgttcgac

SEQ ID NO: 703915 - DNA, 25 bp, Artificial sequence
  Synthetic oligonucleotide
cgcagatacggccggtccgttcgac

SEQ ID NO: 703916 - DNA, 25 bp, Artificial sequence
  Synthetic oligonucleotide
ggtgcgattcgaccgtcggggacac

SEQ ID NO: 703917 - DNA, 25 bp, Artificial sequence
  Synthetic oligonucleotide
ggtgcgattcgagcgtcggggacac

SEQ ID NO: 703918 - DNA, 25 bp, Artificial sequence
  Synthetic oligonucleotide
agccgctacggtgccgacgtaggca

SEQ ID NO: 703919 - DNA, 25 bp, Artificial sequence
  Synthetic oligonucleotide
tgcgccttaccgggtcggtgttgcc

SEQ ID NO: 703920 - DNA, 25 bp, Artificial sequence
  Synthetic oligonucleotide
acttcgcgaacgccctacggcacgg

SEQ ID NO: 703921 - DNA, 25 bp, Artificial sequence
  Synthetic oligonucleotide
cggtcctagcgtagaccgcatgcgc

SEQ ID NO: 703922 - DNA, 25 bp, Artificial sequence
  Synthetic oligonucleotide
acagcgtggtctagcgcgaggtgcc

SEQ ID NO: 703923 - DNA, 25 bp, Artificial sequence
  Synthetic oligonucleotide
acagcgtggtcttgcgcgaggtgcc

SEQ ID NO: 703924 - DNA, 25 bp, Artificial sequence
  Synthetic oligonucleotide
gcggcaacgggtcgaccgaagcgta

SEQ ID NO: 703925 - DNA, 25 bp, Artificial sequence
  Synthetic oligonucleotide
gcggcaacgggtggaccgaagcgta

SEQ ID NO: 703926 - DNA, 25 bp, Artificial sequence
  Synthetic oligonucleotide
gcgagaacgcggtaacgcccgtgac

SEQ ID NO: 703927 - DNA, 25 bp, Artificial sequence
  Synthetic oligonucleotide
gcgagaacgcggaaacgcccgtgac

SEQ ID NO: 703928 - DNA, 25 bp, Artificial sequence
  Synthetic oligonucleotide
gaatgccgtacgacgcgccccctgt

SEQ ID NO: 703929 - DNA, 25 bp, Artificial sequence
  Synthetic oligonucleotide
tccctagacgtaacgcccgcccgtc

SEQ ID NO: 703930 - DNA, 25 bp, Artificial sequence
  Synthetic oligonucleotide
tccagccgctacccgcagtccgaga

SEQ ID NO: 703931 - DNA, 25 bp, Artificial sequence
  Synthetic oligonucleotide
tcaggggcgtccgacgtcttcgcgt

SEQ ID NO: 703932 - DNA, 25 bp, Artificial sequence
  Synthetic oligonucleotide
agccgctacggtcccgacgtaggca

SEQ ID NO: 703933 - DNA, 25 bp, Artificial sequence
  Synthetic oligonucleotide
aatgcccctaaccgccgactgcgcc

SEQ ID NO: 703934 - DNA, 25 bp, Artificial sequence
  Synthetic oligonucleotide
cccctagccgtgctacgcgctcaag

SEQ ID NO: 703935 - DNA, 25 bp, Artificial sequence
  Synthetic oligonucleotide
ccgtccctgttacgtcgcgacaggc

SEQ ID NO: 703936 - DNA, 25 bp, Artificial sequence
  Synthetic oligonucleotide
ccgtccctgttaggtcgcgacaggc

SEQ ID NO: 703937 - DNA, 25 bp, Artificial sequence
  Synthetic oligonucleotide
cgcatcgtcgcgcagcgaagccaac

SEQ ID NO: 703938 - DNA, 25 bp, Artificial sequence
  Synthetic oligonucleotide
cgcatcgtcgcggagcgaagccaac

SEQ ID NO: 703939 - DNA, 25 bp, Artificial sequence
  Synthetic oligonucleotide
aaccggagccgagcgcgtaagccca

SEQ ID NO: 703940 - DNA, 25 bp, Artificial sequence
  Synthetic oligonucleotide
aaccggagccgaccgcgtaagccca

SEQ ID NO: 703941 - DNA, 25 bp, Artificial sequence
  Synthetic oligonucleotide
tgccggcccaacgtacgcgtggcat

SEQ ID NO: 703942 - DNA, 25 bp, Artificial sequence
  Synthetic oligonucleotide
tgccggcccaacctacgcgtggcat

SEQ ID NO: 703943 - DNA, 25 bp, Artificial sequence
  Synthetic oligonucleotide
gcaacatgcgtcctgcgacctgcgg

SEQ ID NO: 703944 - DNA, 25 bp, Artificial sequence
  Synthetic oligonucleotide
tgcgccttaccgcgtcggtgttgcc

SEQ ID NO: 703945 - DNA, 25 bp, Artificial sequence
  Synthetic oligonucleotide
aatgcccctaacggccgactgcgcc

SEQ ID NO: 703946 - DNA, 25 bp, Artificial sequence
  Synthetic oligonucleotide
cccctagccgtggtacgcgctcaag

SEQ ID NO: 703947 - DNA, 25 bp, Artificial sequence
  Synthetic oligonucleotide
tacacggtccgatcgcggaacgggc

SEQ ID NO: 703948 - DNA, 25 bp, Artificial sequence
  Synthetic oligonucleotide
tacacggtccgaacgcggaacgggc

SEQ ID NO: 703949 - DNA, 25 bp, Artificial sequence
  Synthetic oligonucleotide
tgcgtcggtcgccgggtatgtggtc

SEQ ID NO: 703950 - DNA, 25 bp, Artificial sequence
  Synthetic oligonucleotide
tgcgtcggtcgcggggtatgtggtc

SEQ ID NO: 703951 - DNA, 25 bp, Artificial sequence
  Synthetic oligonucleotide
tgcccaacggtccatagcgccacgg

SEQ ID NO: 703952 - DNA, 25 bp, Artificial sequence
  Synthetic oligonucleotide
tgcccaacggtcgatagcgccacgg

SEQ ID NO: 703953 - DNA, 25 bp, Artificial sequence
  Synthetic oligonucleotide
acttcccgcgcgttagacgcgccca

SEQ ID NO: 703954 - DNA, 25 bp, Artificial sequence
  Synthetic oligonucleotide
tcaggggcgtcccacgtcttcgcgt

SEQ ID NO: 703955 - DNA, 25 bp, Artificial sequence
  Synthetic oligonucleotide
tgaaccagcgcgtcgtaccgcaggc

SEQ ID NO: 703956 - DNA, 25 bp, Artificial sequence
  Synthetic oligonucleotide
cggtcctagcgttgaccgcatgcgc

SEQ ID NO: 703957 - DNA, 25 bp, Artificial sequence
  Synthetic oligonucleotide
gcaacatgcgtcgtgcgacctgcgg

SEQ ID NO: 703958 - DNA, 25 bp, Artificial sequence
  Synthetic oligonucleotide
ttccgcgtagggtacgcgacctgcc

SEQ ID NO: 703959 - DNA, 25 bp, Artificial sequence
  Synthetic oligonucleotide
tggtagcgtgtaggaccggagggcg

SEQ ID NO: 703960 - DNA, 25 bp, Artificial sequence
  Synthetic oligonucleotide
gcgtgtctaacgacgaccagggggg

SEQ ID NO: 703961 - DNA, 25 bp, Artificial sequence
  Synthetic oligonucleotide
gcgtgtctaacgtcgaccagggggg

SEQ ID NO: 703962 - DNA, 25 bp, Artificial sequence
  Synthetic oligonucleotide
cgccatagcgcgaagcacgctgcag

SEQ ID NO: 703963 - DNA, 25 bp, Artificial sequence
  Synthetic oligonucleotide
cgccatagcgcgtagcacgctgcag

SEQ ID NO: 703964 - DNA, 25 bp, Artificial sequence
  Synthetic oligonucleotide
gcgtaccggtccgtacgaaggtggc

SEQ ID NO: 703965 - DNA, 25 bp, Artificial sequence
  Synthetic oligonucleotide
gcgtaccggtccctacgaaggtggc

SEQ ID NO: 703966 - DNA, 25 bp, Artificial sequence
  Synthetic oligonucleotide
ctcgcacgcgattacggcggcatgg

SEQ ID NO: 703967 - DNA, 25 bp, Artificial sequence
  Synthetic oligonucleotide
ctcgcacgcgataacggcggcatgg

SEQ ID NO: 703968 - DNA, 25 bp, Artificial sequence
  Synthetic oligonucleotide
accggccctcgtccgcgtacacttg

SEQ ID NO: 703969 - DNA, 25 bp, Artificial sequence
  Synthetic oligonucleotide
tacgcgacgaccgcgtcgtgacctg

SEQ ID NO: 703970 - DNA, 25 bp, Artificial sequence
  Synthetic oligonucleotide
ttccgcgtagggaacgcgacctgcc

SEQ ID NO: 703971 - DNA, 25 bp, Artificial sequence
  Synthetic oligonucleotide
ccccttcgcctagacgcgatctcgc

SEQ ID NO: 703972 - DNA, 25 bp, Artificial sequence
  Synthetic oligonucleotide
ccaggccgcgcgatctagtcgtctg

SEQ ID NO: 703973 - DNA, 25 bp, Artificial sequence
  Synthetic oligonucleotide
ccaggccgcgcgttctagtcgtctg

SEQ ID NO: 703974 - DNA, 25 bp, Artificial sequence
  Synthetic oligonucleotide
agctcgactagtcgctccgcctgcg

SEQ ID NO: 703975 - DNA, 25 bp, Artificial sequence
  Synthetic oligonucleotide
agctcgactagtggctccgcctgcg

SEQ ID NO: 703976 - DNA, 25 bp, Artificial sequence
  Synthetic oligonucleotide
ccccccgaccgacacgctaaagtgc

SEQ ID NO: 703977 - DNA, 25 bp, Artificial sequence
  Synthetic oligonucleotide
gcgcgcgcggtctaaatcgtacggg

SEQ ID NO: 703978 - DNA, 25 bp, Artificial sequence
  Synthetic oligonucleotide
cacccttacgcgtgcgacctgtggg

SEQ ID NO: 703979 - DNA, 25 bp, Artificial sequence
  Synthetic oligonucleotide
gaccacaacgcgtctagcgcgggga

SEQ ID NO: 703980 - DNA, 25 bp, Artificial sequence
  Synthetic oligonucleotide
gaccacaacgcgactagcgcgggga

SEQ ID NO: 703981 - DNA, 25 bp, Artificial sequence
  Synthetic oligonucleotide
atcgccgttacgtcggtccgcacgc

SEQ ID NO: 703982 - DNA, 25 bp, Artificial sequence
  Synthetic oligonucleotide
accggccctcgtgcgcgtacacttg

SEQ ID NO: 703983 - DNA, 25 bp, Artificial sequence
  Synthetic oligonucleotide
ggcgttctcgaccggtcgatacgcg

SEQ ID NO: 703984 - DNA, 25 bp, Artificial sequence
  Synthetic oligonucleotide
gcgcgcgcggtcaaaatcgtacggg

SEQ ID NO: 703985 - DNA, 25 bp, Artificial sequence
  Synthetic oligonucleotide
tccagccgctacgcgcagtccgaga

SEQ ID NO: 703986 - DNA, 25 bp, Artificial sequence
  Synthetic oligonucleotide
tcacggcgcctacgtaccgggacct

SEQ ID NO: 703987 - DNA, 25 bp, Artificial sequence
  Synthetic oligonucleotide
tcacggcgcctaggtaccgggacct

SEQ ID NO: 703988 - DNA, 25 bp, Artificial sequence
  Synthetic oligonucleotide
ttggcgcccgcgaaagtcgggttcg

SEQ ID NO: 703989 - DNA, 25 bp, Artificial sequence
  Synthetic oligonucleotide
ttggcgcccgcgtaagtcgggttcg

SEQ ID NO: 703990 - DNA, 25 bp, Artificial sequence
  Synthetic oligonucleotide
gcgcagaacgtcggcgcaagacgct

SEQ ID NO: 703991 - DNA, 25 bp, Artificial sequence
  Synthetic oligonucleotide
gcgcagaacgtccgcgcaagacgct

SEQ ID NO: 703992 - DNA, 25 bp, Artificial sequence
  Synthetic oligonucleotide
gtcgcctcgcgcgctaaacaaggcc

SEQ ID NO: 703993 - DNA, 25 bp, Artificial sequence
  Synthetic oligonucleotide
gtcgcctcgcgccctaaacaaggcc

SEQ ID NO: 703994 - DNA, 25 bp, Artificial sequence
  Synthetic oligonucleotide
tacgcgacgaccccgtcgtgacctg

SEQ ID NO: 703995 - DNA, 25 bp, Artificial sequence
  Synthetic oligonucleotide
catgtactacgccggacgtccggcg

SEQ ID NO: 703996 - DNA, 25 bp, Artificial sequence
  Synthetic oligonucleotide
tccctagacgtatcgcccgcccgtc

SEQ ID NO: 703997 - DNA, 25 bp, Artificial sequence
  Synthetic oligonucleotide
ggcgttctcgacgggtcgatacgcg

SEQ ID NO: 703998 - DNA, 25 bp, Artificial sequence
  Synthetic oligonucleotide
gcggctccgcgttctaggtccgaca

SEQ ID NO: 703999 - DNA, 25 bp, Artificial sequence
  Synthetic oligonucleotide
gcggctccgcgtactaggtccgaca

SEQ ID NO: 704000 - DNA, 25 bp, Artificial sequence
  Synthetic oligonucleotide
gtctagaccggtctaccgctggggg

SEQ ID NO: 704001 - DNA, 25 bp, Artificial sequence
  Synthetic oligonucleotide
gtctagaccggtgtaccgctggggg

SEQ ID NO: 704002 - DNA, 25 bp, Artificial sequence
  Synthetic oligonucleotide
ccgcagcgcgcatcggtcagctcta

SEQ ID NO: 704003 - DNA, 25 bp, Artificial sequence
  Synthetic oligonucleotide
ccgcagcgcgcaacggtcagctcta

SEQ ID NO: 704004 - DNA, 25 bp, Artificial sequence
  Synthetic oligonucleotide
ccgtgcccttacccgaacgccagtg

SEQ ID NO: 704005 - DNA, 25 bp, Artificial sequence
  Synthetic oligonucleotide
ccgtgcccttacgcgaacgccagtg

SEQ ID NO: 704006 - DNA, 25 bp, Artificial sequence
  Synthetic oligonucleotide
ccccttcgcctacacgcgatctcgc

SEQ ID NO: 704007 - DNA, 25 bp, Artificial sequence
  Synthetic oligonucleotide
catgtactacgcgggacgtccggcg

SEQ ID NO: 704008 - DNA, 25 bp, Artificial sequence
  Synthetic oligonucleotide
gtactgcacgatcgaccgggaggcc

SEQ ID NO: 704009 - DNA, 25 bp, Artificial sequence
  Synthetic oligonucleotide
tggtagcgtgtacgaccggagggcg

SEQ ID NO: 704010 - DNA, 25 bp, Artificial sequence
  Synthetic oligonucleotide
tggtagttgcgtaacgcggcccgcg

SEQ ID NO: 704011 - DNA, 25 bp, Artificial sequence
  Synthetic oligonucleotide
tggtagttgcgttacgcggcccgcg

SEQ ID NO: 704012 - DNA, 25 bp, Artificial sequence
  Synthetic oligonucleotide
ggcgattgtcgcgcgtacatcgcgc

SEQ ID NO: 704013 - DNA, 25 bp, Artificial sequence
  Synthetic oligonucleotide
ggcgattgtcgcccgtacatcgcgc

SEQ ID NO: 704014 - DNA, 25 bp, Artificial sequence
  Synthetic oligonucleotide
acgcggcgacggaattcgcggtcac

SEQ ID NO: 704015 - DNA, 25 bp, Artificial sequence
  Synthetic oligonucleotide
acgcggcgacggtattcgcggtcac

SEQ ID NO: 704016 - DNA, 25 bp, Artificial sequence
  Synthetic oligonucleotide
ccgcgcgtaggccgtcgctagtaac

SEQ ID NO: 704017 - DNA, 25 bp, Artificial sequence
  Synthetic oligonucleotide
ccgcgcgtaggcggtcgctagtaac

SEQ ID NO: 704018 - DNA, 25 bp, Artificial sequence
  Synthetic oligonucleotide
gggccaccgctaggatgcgttggtc

SEQ ID NO: 704019 - DNA, 25 bp, Artificial sequence
  Synthetic oligonucleotide
ccggagcgccctgtcgaaccagtag

SEQ ID NO: 704020 - DNA, 25 bp, Artificial sequence
  Synthetic oligonucleotide
gtactgcacgatggaccgggaggcc

SEQ ID NO: 704021 - DNA, 25 bp, Artificial sequence
  Synthetic oligonucleotide
gagtgtgcctacacgcgtcgcacgc

SEQ ID NO: 704022 - DNA, 25 bp, Artificial sequence
  Synthetic oligonucleotide
ggcagttaggactcgcgcgttcggc

SEQ ID NO: 704023 - DNA, 25 bp, Artificial sequence
  Synthetic oligonucleotide
ggcagttaggacacgcgcgttcggc

SEQ ID NO: 704024 - DNA, 25 bp, Artificial sequence
  Synthetic oligonucleotide
tgcgccctacgaccgttcgccgact

SEQ ID NO: 704025 - DNA, 25 bp, Artificial sequence
  Synthetic oligonucleotide
tgcgccctacgagcgttcgccgact

SEQ ID NO: 704026 - DNA, 25 bp, Artificial sequence
  Synthetic oligonucleotide
tctgcgcgcgcgtattcggttgcgg

SEQ ID NO: 704027 - DNA, 25 bp, Artificial sequence
  Synthetic oligonucleotide
tctgcgcgcgcgaattcggttgcgg

SEQ ID NO: 704028 - DNA, 25 bp, Artificial sequence
  Synthetic oligonucleotide
agcccgggcgtttcgggctagagac

SEQ ID NO: 704029 - DNA, 25 bp, Artificial sequence
  Synthetic oligonucleotide
agcccgggcgttacgggctagagac

SEQ ID NO: 704030 - DNA, 25 bp, Artificial sequence
  Synthetic oligonucleotide
cggtaaggtaatggcgcggcccgca

SEQ ID NO: 704031 - DNA, 25 bp, Artificial sequence
  Synthetic oligonucleotide
cggtaaggtaatcgcgcggcccgca

SEQ ID NO: 704032 - DNA, 25 bp, Artificial sequence
  Synthetic oligonucleotide
gggccaccgctacgatgcgttggtc

SEQ ID NO: 704033 - DNA, 25 bp, Artificial sequence
  Synthetic oligonucleotide
aggtgccgcgattaggacgtccgcg

SEQ ID NO: 704034 - DNA, 25 bp, Artificial sequence
  Synthetic oligonucleotide
cacccttacgcgagcgacctgtggg

SEQ ID NO: 704035 - DNA, 25 bp, Artificial sequence
  Synthetic oligonucleotide
atcgccgttacgacggtccgcacgc

SEQ ID NO: 704036 - DNA, 25 bp, Artificial sequence
  Synthetic oligonucleotide
ggttagacgtacgacgcgggaccgc

SEQ ID NO: 704037 - DNA, 25 bp, Artificial sequence
  Synthetic oligonucleotide
ggttagacgtaccacgcgggaccgc

SEQ ID NO: 704038 - DNA, 25 bp, Artificial sequence
  Synthetic oligonucleotide
ctctcgacgcaacgacggggaggac

SEQ ID NO: 704039 - DNA, 25 bp, Artificial sequence
  Synthetic oligonucleotide
ctctcgacgcaaggacggggaggac

SEQ ID NO: 704040 - DNA, 25 bp, Artificial sequence
  Synthetic oligonucleotide
tcggtgacggatcgcgaacgacccg

SEQ ID NO: 704041 - DNA, 25 bp, Artificial sequence
  Synthetic oligonucleotide
tcggtgacggatggcgaacgacccg

SEQ ID NO: 704042 - DNA, 25 bp, Artificial sequence
  Synthetic oligonucleotide
gtctgcacgtaaccgctgctccggg

SEQ ID NO: 704043 - DNA, 25 bp, Artificial sequence
  Synthetic oligonucleotide
gtctgcacgtaagcgctgctccggg

SEQ ID NO: 704044 - DNA, 25 bp, Artificial sequence
  Synthetic oligonucleotide
ccggagcgccctctcgaaccagtag

SEQ ID NO: 704045 - DNA, 25 bp, Artificial sequence
  Synthetic oligonucleotide
ttggccttagcgcacgcgtgtcgcc

SEQ ID NO: 704046 - DNA, 25 bp, Artificial sequence
  Synthetic oligonucleotide
gaatgccgtacgtcgcgccccctgt

SEQ ID NO: 704047 - DNA, 25 bp, Artificial sequence
  Synthetic oligonucleotide
aggtgccgcgataaggacgtccgcg

SEQ ID NO: 704048 - DNA, 25 bp, Artificial sequence
  Synthetic oligonucleotide
cgcgatacccgcggtatgaccccga

SEQ ID NO: 704049 - DNA, 25 bp, Artificial sequence
  Synthetic oligonucleotide
cgcgatacccgccgtatgaccccga

SEQ ID NO: 704050 - DNA, 25 bp, Artificial sequence
  Synthetic oligonucleotide
tctagctagtagcgccgcggtgccg

SEQ ID NO: 704051 - DNA, 25 bp, Artificial sequence
  Synthetic oligonucleotide
tctagctagtagggccgcggtgccg

SEQ ID NO: 704052 - DNA, 25 bp, Artificial sequence
  Synthetic oligonucleotide
tggctcccgccgcataacgcgtcca

SEQ ID NO: 704053 - DNA, 25 bp, Artificial sequence
  Synthetic oligonucleotide
tggctcccgccggataacgcgtcca

SEQ ID NO: 704054 - DNA, 25 bp, Artificial sequence
  Synthetic oligonucleotide
ccctagcggtgcgatacgggtcacc

SEQ ID NO: 704055 - DNA, 25 bp, Artificial sequence
  Synthetic oligonucleotide
ccctagcggtgccatacgggtcacc

SEQ ID NO: 704056 - DNA, 25 bp, Artificial sequence
  Synthetic oligonucleotide
gagtgtgcctactcgcgtcgcacgc

SEQ ID NO: 704057 - DNA, 25 bp, Artificial sequence
  Synthetic oligonucleotide
ttggccttagcggacgcgtgtcgcc

SEQ ID NO: 704058 - DNA, 25 bp, Artificial sequence
  Synthetic oligonucleotide
ccacgtcggacgaaatcgccccctc

SEQ ID NO: 704059 - DNA, 25 bp, Artificial sequence
  Synthetic oligonucleotide
ggcgccatagcggtcgcgtacctag

SEQ ID NO: 704060 - DNA, 25 bp, Artificial sequence
  Synthetic oligonucleotide
tagggggtagtcgcggaccgtggct

SEQ ID NO: 704061 - DNA, 25 bp, Artificial sequence
  Synthetic oligonucleotide
tagggggtagtcccggaccgtggct

SEQ ID NO: 704062 - DNA, 25 bp, Artificial sequence
  Synthetic oligonucleotide
cggactgcgcggaatagtcacccgg

SEQ ID NO: 704063 - DNA, 25 bp, Artificial sequence
  Synthetic oligonucleotide
cggactgcgcggtatagtcacccgg

SEQ ID NO: 704064 - DNA, 25 bp, Artificial sequence
  Synthetic oligonucleotide
caccctcgtccgcgaatggcctgac

SEQ ID NO: 704065 - DNA, 25 bp, Artificial sequence
  Synthetic oligonucleotide
caccctcgtccgggaatggcctgac

SEQ ID NO: 704066 - DNA, 25 bp, Artificial sequence
  Synthetic oligonucleotide
cggccactacggacgttcgcccaca

SEQ ID NO: 704067 - DNA, 25 bp, Artificial sequence
  Synthetic oligonucleotide
cggccactacggtcgttcgcccaca

SEQ ID NO: 704068 - DNA, 25 bp, Artificial sequence
  Synthetic oligonucleotide
tgggggtagtacccgcgacgtctcc

SEQ ID NO: 704069 - DNA, 25 bp, Artificial sequence
  Synthetic oligonucleotide
gcaccccttgcgatagcgcggactc

SEQ ID NO: 704070 - DNA, 25 bp, Artificial sequence
  Synthetic oligonucleotide
ccacgtcggacgtaatcgccccctc

SEQ ID NO: 704071 - DNA, 25 bp, Artificial sequence
  Synthetic oligonucleotide
gtcacgtcccgttagcgcgccatcg

SEQ ID NO: 704072 - DNA, 25 bp, Artificial sequence
  Synthetic oligonucleotide
gccaagcatgaccagcgcgaggcag

SEQ ID NO: 704073 - DNA, 25 bp, Artificial sequence
  Synthetic oligonucleotide
gccaagcatgacgagcgcgaggcag

SEQ ID NO: 704074 - DNA, 25 bp, Artificial sequence
  Synthetic oligonucleotide
cgggtacgtcgctcgagtaggcctg

SEQ ID NO: 704075 - DNA, 25 bp, Artificial sequence
  Synthetic oligonucleotide
cgggtacgtcgcacgagtaggcctg

SEQ ID NO: 704076 - DNA, 25 bp, Artificial sequence
  Synthetic oligonucleotide
cggccccctaccccgcgaatgcatt

SEQ ID NO: 704077 - DNA, 25 bp, Artificial sequence
  Synthetic oligonucleotide
cggccccctaccgcgcgaatgcatt

SEQ ID NO: 704078 - DNA, 25 bp, Artificial sequence
  Synthetic oligonucleotide
ccatgcggcgtacgatcgagtcgcc

SEQ ID NO: 704079 - DNA, 25 bp, Artificial sequence
  Synthetic oligonucleotide
ccatgcggcgtaggatcgagtcgcc

SEQ ID NO: 704080 - DNA, 25 bp, Artificial sequence
  Synthetic oligonucleotide
ggcgtcgcgctaccgtatgagtcgg

SEQ ID NO: 704081 - DNA, 25 bp, Artificial sequence
  Synthetic oligonucleotide
cagggctccctaggcgtcggcactt

SEQ ID NO: 704082 - DNA, 25 bp, Artificial sequence
  Synthetic oligonucleotide
tgggggtagtacgcgcgacgtctcc

SEQ ID NO: 704083 - DNA, 25 bp, Artificial sequence
  Synthetic oligonucleotide
ctagcctacgcgcgcttaccacggc

SEQ ID NO: 704084 - DNA, 25 bp, Artificial sequence
  Synthetic oligonucleotide
ctcccgacgctataccggccatggg

SEQ ID NO: 704085 - DNA, 25 bp, Artificial sequence
  Synthetic oligonucleotide
ctcccgacgctaaaccggccatggg

SEQ ID NO: 704086 - DNA, 25 bp, Artificial sequence
  Synthetic oligonucleotide
caaacggtcgtctacgcggctgcgg

SEQ ID NO: 704087 - DNA, 25 bp, Artificial sequence
  Synthetic oligonucleotide
caaacggtcgtcaacgcggctgcgg

SEQ ID NO: 704088 - DNA, 25 bp, Artificial sequence
  Synthetic oligonucleotide
gctccgcagccgatatacgggaggg

SEQ ID NO: 704089 - DNA, 25 bp, Artificial sequence
  Synthetic oligonucleotide
gctccgcagccgttatacgggaggg

SEQ ID NO: 704090 - DNA, 25 bp, Artificial sequence
  Synthetic oligonucleotide
cggctggccgcgaacgctaaaggga

SEQ ID NO: 704091 - DNA, 25 bp, Artificial sequence
  Synthetic oligonucleotide
cggctggccgcgtacgctaaaggga

SEQ ID NO: 704092 - DNA, 25 bp, Artificial sequence
  Synthetic oligonucleotide
gcatgataacgacgcaccgccgccc

SEQ ID NO: 704093 - DNA, 25 bp, Artificial sequence
  Synthetic oligonucleotide
gcatgataacgaggcaccgccgccc

SEQ ID NO: 704094 - DNA, 25 bp, Artificial sequence
  Synthetic oligonucleotide
gcaccccttgcgttagcgcggactc

SEQ ID NO: 704095 - DNA, 25 bp, Artificial sequence
  Synthetic oligonucleotide
gagcagggaacccacgcgtaccagc

SEQ ID NO: 704096 - DNA, 25 bp, Artificial sequence
  Synthetic oligonucleotide
ggcgccatagcgctcgcgtacctag

SEQ ID NO: 704097 - DNA, 25 bp, Artificial sequence
  Synthetic oligonucleotide
ctagcctacgcgggcttaccacggc

SEQ ID NO: 704098 - DNA, 25 bp, Artificial sequence
  Synthetic oligonucleotide
tgagtaccgagttcgcgctcgcccc

SEQ ID NO: 704099 - DNA, 25 bp, Artificial sequence
  Synthetic oligonucleotide
tgagtaccgagtacgcgctcgcccc

SEQ ID NO: 704100 - DNA, 25 bp, Artificial sequence
  Synthetic oligonucleotide
ccgttggcgcgtcgacgttctcagg

SEQ ID NO: 704101 - DNA, 25 bp, Artificial sequence
  Synthetic oligonucleotide
ccgttggcgcgtggacgttctcagg

SEQ ID NO: 704102 - DNA, 25 bp, Artificial sequence
  Synthetic oligonucleotide
tcctgcatgttccgcgcgttgcggg

SEQ ID NO: 704103 - DNA, 25 bp, Artificial sequence
  Synthetic oligonucleotide
tcctgcatgttcggcgcgttgcggg

SEQ ID NO: 704104 - DNA, 25 bp, Artificial sequence
  Synthetic oligonucleotide
gccgagctggacgatcggcttggtc

SEQ ID NO: 704105 - DNA, 25 bp, Artificial sequence
  Synthetic oligonucleotide
gccgagctggaccatcggcttggtc

SEQ ID NO: 704106 - DNA, 25 bp, Artificial sequence
  Synthetic oligonucleotide
gtcacgtcccgtaagcgcgccatcg

SEQ ID NO: 704107 - DNA, 25 bp, Artificial sequence
  Synthetic oligonucleotide
gagcagggaaccgacgcgtaccagc

SEQ ID NO: 704108 - DNA, 25 bp, Artificial sequence
  Synthetic oligonucleotide
cagtgacgcgaccgcactacgcagg

SEQ ID NO: 704109 - DNA, 25 bp, Artificial sequence
  Synthetic oligonucleotide
ggcgtcgcgctagcgtatgagtcgg

SEQ ID NO: 704110 - DNA, 25 bp, Artificial sequence
  Synthetic oligonucleotide
tgctgggcgcgtcaagggactacgc

SEQ ID NO: 704111 - DNA, 25 bp, Artificial sequence
  Synthetic oligonucleotide
tgctgggcgcgtgaagggactacgc

SEQ ID NO: 704112 - DNA, 25 bp, Artificial sequence
  Synthetic oligonucleotide
gctcaatcgacgggactagcgcggg

SEQ ID NO: 704113 - DNA, 25 bp, Artificial sequence
  Synthetic oligonucleotide
gctcaatcgacgcgactagcgcggg

SEQ ID NO: 704114 - DNA, 25 bp, Artificial sequence
  Synthetic oligonucleotide
cgcccgtccgatacgtccgaatgcc

SEQ ID NO: 704115 - DNA, 25 bp, Artificial sequence
  Synthetic oligonucleotide
cgcccgtccgattcgtccgaatgcc

SEQ ID NO: 704116 - DNA, 25 bp, Artificial sequence
  Synthetic oligonucleotide
cctggccgtatcctgtcgcgcggaa

SEQ ID NO: 704117 - DNA, 25 bp, Artificial sequence
  Synthetic oligonucleotide
cctggccgtatcgtgtcgcgcggaa

SEQ ID NO: 704118 - DNA, 25 bp, Artificial sequence
  Synthetic oligonucleotide
agcttgcggacgtagtcgcaccgcg

SEQ ID NO: 704119 - DNA, 25 bp, Artificial sequence
  Synthetic oligonucleotide
gtatggtacctcgaccgcgggagcg

SEQ ID NO: 704120 - DNA, 25 bp, Artificial sequence
  Synthetic oligonucleotide
cagtgacgcgacggcactacgcagg

SEQ ID NO: 704121 - DNA, 25 bp, Artificial sequence
  Synthetic oligonucleotide
ctaccacgcgccgatctaacgcggg

SEQ ID NO: 704122 - DNA, 25 bp, Artificial sequence
  Synthetic oligonucleotide
atgctcgcctataccgcggacccgg

SEQ ID NO: 704123 - DNA, 25 bp, Artificial sequence
  Synthetic oligonucleotide
atgctcgcctattccgcggacccgg

SEQ ID NO: 704124 - DNA, 25 bp, Artificial sequence
  Synthetic oligonucleotide
cggcctactgcgcggattagcaggg

SEQ ID NO: 704125 - DNA, 25 bp, Artificial sequence
  Synthetic oligonucleotide
cggcctactgcggggattagcaggg

SEQ ID NO: 704126 - DNA, 25 bp, Artificial sequence
  Synthetic oligonucleotide
ggtgtgcgataccgcgcgttggagg

SEQ ID NO: 704127 - DNA, 25 bp, Artificial sequence
  Synthetic oligonucleotide
ggtgtgcgatacggcgcgttggagg

SEQ ID NO: 704128 - DNA, 25 bp, Artificial sequence
  Synthetic oligonucleotide
cccggcgcctcgtacgcgagtctaa

SEQ ID NO: 704129 - DNA, 25 bp, Artificial sequence
  Synthetic oligonucleotide
cccggcgcctcgaacgcgagtctaa

SEQ ID NO: 704130 - DNA, 25 bp, Artificial sequence
  Synthetic oligonucleotide
tcggcctagtcccgcggatgatggc

SEQ ID NO: 704131 - DNA, 25 bp, Artificial sequence
  Synthetic oligonucleotide
ccccccgaccgagacgctaaagtgc

SEQ ID NO: 704132 - DNA, 25 bp, Artificial sequence
  Synthetic oligonucleotide
agcttgcggacgaagtcgcaccgcg

SEQ ID NO: 704133 - DNA, 25 bp, Artificial sequence
  Synthetic oligonucleotide
ctaagccttacggggccgagcaccc

SEQ ID NO: 704134 - DNA, 25 bp, Artificial sequence
  Synthetic oligonucleotide
ccgccctaacgattgcgcgacgcca

SEQ ID NO: 704135 - DNA, 25 bp, Artificial sequence
  Synthetic oligonucleotide
ccgccctaacgaatgcgcgacgcca

SEQ ID NO: 704136 - DNA, 25 bp, Artificial sequence
  Synthetic oligonucleotide
gttatgcgtcccaatcgcgcggccg

SEQ ID NO: 704137 - DNA, 25 bp, Artificial sequence
  Synthetic oligonucleotide
gttatgcgtccctatcgcgcggccg

SEQ ID NO: 704138 - DNA, 25 bp, Artificial sequence
  Synthetic oligonucleotide
ccgatccgtggacgctacccatcgc

SEQ ID NO: 704139 - DNA, 25 bp, Artificial sequence
  Synthetic oligonucleotide
ccgatccgtggaggctacccatcgc

SEQ ID NO: 704140 - DNA, 25 bp, Artificial sequence
  Synthetic oligonucleotide
acggtgacgtccgaaggcgcatgcc

SEQ ID NO: 704141 - DNA, 25 bp, Artificial sequence
  Synthetic oligonucleotide
acggtgacgtcccaaggcgcatgcc

SEQ ID NO: 704142 - DNA, 25 bp, Artificial sequence
  Synthetic oligonucleotide
agatcccgcgacgcgtacacagcgg

SEQ ID NO: 704143 - DNA, 25 bp, Artificial sequence
  Synthetic oligonucleotide
agatcccgcgacccgtacacagcgg

SEQ ID NO: 704144 - DNA, 25 bp, Artificial sequence
  Synthetic oligonucleotide
gtatggtacctccaccgcgggagcg

SEQ ID NO: 704145 - DNA, 25 bp, Artificial sequence
  Synthetic oligonucleotide
ctcctcgttatactcgcggcgcggg

SEQ ID NO: 704146 - DNA, 25 bp, Artificial sequence
  Synthetic oligonucleotide
tcggcctagtccggcggatgatggc

SEQ ID NO: 704147 - DNA, 25 bp, Artificial sequence
  Synthetic oligonucleotide
ctaagccttacgcggccgagcaccc

SEQ ID NO: 704148 - DNA, 25 bp, Artificial sequence
  Synthetic oligonucleotide
ggccccagcgcgcgattagctttgg

SEQ ID NO: 704149 - DNA, 25 bp, Artificial sequence
  Synthetic oligonucleotide
ggccccagcgcgggattagctttgg

SEQ ID NO: 704150 - DNA, 25 bp, Artificial sequence
  Synthetic oligonucleotide
gctagaaccgcgcagcgtacaccgc

SEQ ID NO: 704151 - DNA, 25 bp, Artificial sequence
  Synthetic oligonucleotide
gctagaaccgcggagcgtacaccgc

SEQ ID NO: 704152 - DNA, 25 bp, Artificial sequence
  Synthetic oligonucleotide
actggttatccgtccggcggccacg

SEQ ID NO: 704153 - DNA, 25 bp, Artificial sequence
  Synthetic oligonucleotide
actggttatccgaccggcggccacg

SEQ ID NO: 704154 - DNA, 25 bp, Artificial sequence
  Synthetic oligonucleotide
gcttatctagcgccatcgcggcccc

SEQ ID NO: 704155 - DNA, 25 bp, Artificial sequence
  Synthetic oligonucleotide
gcttatctagcggcatcgcggcccc

SEQ ID NO: 704156 - DNA, 25 bp, Artificial sequence
  Synthetic oligonucleotide
ctaccacgcgcccatctaacgcggg

SEQ ID NO: 704157 - DNA, 25 bp, Artificial sequence
  Synthetic oligonucleotide
ctcctcgttatagtcgcggcgcggg

SEQ ID NO: 704158 - DNA, 25 bp, Artificial sequence
  Synthetic oligonucleotide
tccctgcgctagggcgaacccccat

SEQ ID NO: 704159 - DNA, 25 bp, Artificial sequence
  Synthetic oligonucleotide
aagtcgtacgccgtccgcaggtccc

SEQ ID NO: 704160 - DNA, 25 bp, Artificial sequence
  Synthetic oligonucleotide
gacggtcgtatgcgggccacgtctg

SEQ ID NO: 704161 - DNA, 25 bp, Artificial sequence
  Synthetic oligonucleotide
agcgcgtatcgagggccgctcgcta

SEQ ID NO: 704162 - DNA, 25 bp, Artificial sequence
  Synthetic oligonucleotide
agcgcgtatcgacggccgctcgcta

SEQ ID NO: 704163 - DNA, 25 bp, Artificial sequence
  Synthetic oligonucleotide
cgccgagtagaccgtcgacttgcgc

SEQ ID NO: 704164 - DNA, 25 bp, Artificial sequence
  Synthetic oligonucleotide
cgccgagtagacggtcgacttgcgc

SEQ ID NO: 704165 - DNA, 25 bp, Artificial sequence
  Synthetic oligonucleotide
cccgccgcgatacgccggtcaatga

SEQ ID NO: 704166 - DNA, 25 bp, Artificial sequence
  Synthetic oligonucleotide
cccgccgcgataggccggtcaatga

SEQ ID NO: 704167 - DNA, 25 bp, Artificial sequence
  Synthetic oligonucleotide
ctgccgggtagcctcgacaaccagc

SEQ ID NO: 704168 - DNA, 25 bp, Artificial sequence
  Synthetic oligonucleotide
ctgccgggtagcgtcgacaaccagc

SEQ ID NO: 704169 - DNA, 25 bp, Artificial sequence
  Synthetic oligonucleotide
acagacccgtcccaaacgccagccg

SEQ ID NO: 704170 - DNA, 25 bp, Artificial sequence
  Synthetic oligonucleotide
cacacccgccttacgaccgggatcg

SEQ ID NO: 704171 - DNA, 25 bp, Artificial sequence
  Synthetic oligonucleotide
cagggctccctacgcgtcggcactt

SEQ ID NO: 704172 - DNA, 25 bp, Artificial sequence
  Synthetic oligonucleotide
tccctgcgctagcgcgaacccccat

SEQ ID NO: 704173 - DNA, 25 bp, Artificial sequence
  Synthetic oligonucleotide
ggcctaccgtgactagtcggctccc

SEQ ID NO: 704174 - DNA, 25 bp, Artificial sequence
  Synthetic oligonucleotide
ggcctaccgtgagtagtcggctccc

SEQ ID NO: 704175 - DNA, 25 bp, Artificial sequence
  Synthetic oligonucleotide
tccagccgtacgccgtcgagtgcac

SEQ ID NO: 704176 - DNA, 25 bp, Artificial sequence
  Synthetic oligonucleotide
tccagccgtacggcgtcgagtgcac

SEQ ID NO: 704177 - DNA, 25 bp, Artificial sequence
  Synthetic oligonucleotide
tcccgcagtaagtcgcgcgacgacg

SEQ ID NO: 704178 - DNA, 25 bp, Artificial sequence
  Synthetic oligonucleotide
tcccgcagtaagacgcgcgacgacg

SEQ ID NO: 704179 - DNA, 25 bp, Artificial sequence
  Synthetic oligonucleotide
ccgatgcgttgcgcgtgcatcgtcc

SEQ ID NO: 704180 - DNA, 25 bp, Artificial sequence
  Synthetic oligonucleotide
ccgatgcgttgcccgtgcatcgtcc

SEQ ID NO: 704181 - DNA, 25 bp, Artificial sequence
  Synthetic oligonucleotide
aagtcgtacgccctccgcaggtccc

SEQ ID NO: 704182 - DNA, 25 bp, Artificial sequence
  Synthetic oligonucleotide
cacacccgcctttcgaccgggatcg

SEQ ID NO: 704183 - DNA, 25 bp, Artificial sequence
  Synthetic oligonucleotide
gtcaggaatgcgctccgcgcgcatg

SEQ ID NO: 704184 - DNA, 25 bp, Artificial sequence
  Synthetic oligonucleotide
ggtccgaccgtttctcgcgggatcg

SEQ ID NO: 704185 - DNA, 25 bp, Artificial sequence
  Synthetic oligonucleotide
catgtgcctacgccgtaacccggcg

SEQ ID NO: 704186 - DNA, 25 bp, Artificial sequence
  Synthetic oligonucleotide
catgtgcctacggcgtaacccggcg

SEQ ID NO: 704187 - DNA, 25 bp, Artificial sequence
  Synthetic oligonucleotide
accggacccgtaggcatcggtgtgc

SEQ ID NO: 704188 - DNA, 25 bp, Artificial sequence
  Synthetic oligonucleotide
accggacccgtacgcatcggtgtgc

SEQ ID NO: 704189 - DNA, 25 bp, Artificial sequence
  Synthetic oligonucleotide
ctggctaccgcgaagatcggccgca

SEQ ID NO: 704190 - DNA, 25 bp, Artificial sequence
  Synthetic oligonucleotide
ctggctaccgcgtagatcggccgca

SEQ ID NO: 704191 - DNA, 25 bp, Artificial sequence
  Synthetic oligonucleotide
ccaaaggtctacacgcgcgtcgggc

SEQ ID NO: 704192 - DNA, 25 bp, Artificial sequence
  Synthetic oligonucleotide
ccaaaggtctactcgcgcgtcgggc

SEQ ID NO: 704193 - DNA, 25 bp, Artificial sequence
  Synthetic oligonucleotide
gagactcgtcgcggactagggcgtg

SEQ ID NO: 704194 - DNA, 25 bp, Artificial sequence
  Synthetic oligonucleotide
ggtccgaccgttactcgcgggatcg

SEQ ID NO: 704195 - DNA, 25 bp, Artificial sequence
  Synthetic oligonucleotide
gtcaggaatgcggtccgcgcgcatg

SEQ ID NO: 704196 - DNA, 25 bp, Artificial sequence
  Synthetic oligonucleotide
gacggtcgtatgggggccacgtctg

SEQ ID NO: 704197 - DNA, 25 bp, Artificial sequence
  Synthetic oligonucleotide
accatgccggtaccgcatacggccg

SEQ ID NO: 704198 - DNA, 25 bp, Artificial sequence
  Synthetic oligonucleotide
accatgccggtagcgcatacggccg

SEQ ID NO: 704199 - DNA, 25 bp, Artificial sequence
  Synthetic oligonucleotide
ggcgacccggacgctagttgcctac

SEQ ID NO: 704200 - DNA, 25 bp, Artificial sequence
  Synthetic oligonucleotide
ggcgacccggaccctagttgcctac

SEQ ID NO: 704201 - DNA, 25 bp, Artificial sequence
  Synthetic oligonucleotide
tggtcgctatcgtaagcggggcggc

SEQ ID NO: 704202 - DNA, 25 bp, Artificial sequence
  Synthetic oligonucleotide
tggtcgctatcgaaagcggggcggc

SEQ ID NO: 704203 - DNA, 25 bp, Artificial sequence
  Synthetic oligonucleotide
tcgtgctcgcgcgagactagccagc

SEQ ID NO: 704204 - DNA, 25 bp, Artificial sequence
  Synthetic oligonucleotide
tcgtgctcgcgccagactagccagc

SEQ ID NO: 704205 - DNA, 25 bp, Artificial sequence
  Synthetic oligonucleotide
gcgaagcggtccggattaacgcgcg

SEQ ID NO: 704206 - DNA, 25 bp, Artificial sequence
  Synthetic oligonucleotide
gcgaagcggtcccgattaacgcgcg

SEQ ID NO: 704207 - DNA, 25 bp, Artificial sequence
  Synthetic oligonucleotide
gagactcgtcgccgactagggcgtg

SEQ ID NO: 704208 - DNA, 25 bp, Artificial sequence
  Synthetic oligonucleotide
ccgggcttcgcggacaggtcagaga

SEQ ID NO: 704209 - DNA, 25 bp, Artificial sequence
  Synthetic oligonucleotide
cgcgcttaccgcgtgtcgtccggtt

SEQ ID NO: 704210 - DNA, 25 bp, Artificial sequence
  Synthetic oligonucleotide
ggggaacgccacaagcggtccacgt

SEQ ID NO: 704211 - DNA, 25 bp, Artificial sequence
  Synthetic oligonucleotide
ggggaacgccactagcggtccacgt

SEQ ID NO: 704212 - DNA, 25 bp, Artificial sequence
  Synthetic oligonucleotide
cgggctacgcgctcgtatgctcgag

SEQ ID NO: 704213 - DNA, 25 bp, Artificial sequence
  Synthetic oligonucleotide
cgggctacgcgcacgtatgctcgag

SEQ ID NO: 704214 - DNA, 25 bp, Artificial sequence
  Synthetic oligonucleotide
gcccagccccgtctcgcgagcttaa

SEQ ID NO: 704215 - DNA, 25 bp, Artificial sequence
  Synthetic oligonucleotide
gcccagccccgtgtcgcgagcttaa

SEQ ID NO: 704216 - DNA, 25 bp, Artificial sequence
  Synthetic oligonucleotide
gtccctgcgaccatcgacggttccc

SEQ ID NO: 704217 - DNA, 25 bp, Artificial sequence
  Synthetic oligonucleotide
gtccctgcgaccttcgacggttccc

SEQ ID NO: 704218 - DNA, 25 bp, Artificial sequence
  Synthetic oligonucleotide
cgttgtcggaccgcgatcaggagcg

SEQ ID NO: 704219 - DNA, 25 bp, Artificial sequence
  Synthetic oligonucleotide
cgcgcttaccgcctgtcgtccggtt

SEQ ID NO: 704220 - DNA, 25 bp, Artificial sequence
  Synthetic oligonucleotide
ccgggcttcgcgcacaggtcagaga

SEQ ID NO: 704221 - DNA, 25 bp, Artificial sequence
  Synthetic oligonucleotide
cgttgtcggaccccgatcaggagcg

SEQ ID NO: 704222 - DNA, 25 bp, Artificial sequence
  Synthetic oligonucleotide
cgcgctcgtagccctagagcgatgg

SEQ ID NO: 704223 - DNA, 25 bp, Artificial sequence
  Synthetic oligonucleotide
cgcgctcgtagcgctagagcgatgg

SEQ ID NO: 704224 - DNA, 25 bp, Artificial sequence
  Synthetic oligonucleotide
gacgcgacacggaacgtcggggtac

SEQ ID NO: 704225 - DNA, 25 bp, Artificial sequence
  Synthetic oligonucleotide
gacgcgacacggtacgtcggggtac

SEQ ID NO: 704226 - DNA, 25 bp, Artificial sequence
  Synthetic oligonucleotide
ccacggctagcgcaacggggctgtt

SEQ ID NO: 704227 - DNA, 25 bp, Artificial sequence
  Synthetic oligonucleotide
ccacggctagcggaacggggctgtt

SEQ ID NO: 704228 - DNA, 25 bp, Artificial sequence
  Synthetic oligonucleotide
tcggggatagatcgcgcgcgcgtga

SEQ ID NO: 704229 - DNA, 25 bp, Artificial sequence
  Synthetic oligonucleotide
ggcccaaagctacgcgtcgtgggac

SEQ ID NO: 704230 - DNA, 25 bp, Artificial sequence
  Synthetic oligonucleotide
acagacccgtccgaaacgccagccg

SEQ ID NO: 704231 - DNA, 25 bp, Artificial sequence
  Synthetic oligonucleotide
tcggggatagatggcgcgcgcgtga

SEQ ID NO: 704232 - DNA, 25 bp, Artificial sequence
  Synthetic oligonucleotide
cgcatgcgatacgcgccgtgcggaa

SEQ ID NO: 704233 - DNA, 25 bp, Artificial sequence
  Synthetic oligonucleotide
atgaggccgtgagcgcgtagccggt

SEQ ID NO: 704234 - DNA, 25 bp, Artificial sequence
  Synthetic oligonucleotide
ggcccaaagctaggcgtcgtgggac

SEQ ID NO: 704235 - DNA, 25 bp, Artificial sequence
  Synthetic oligonucleotide
cgcatgcgatacccgccgtgcggaa

SEQ ID NO: 704236 - DNA, 25 bp, Artificial sequence
  Synthetic oligonucleotide
atgaggccgtgaccgcgtagccggt

SEQ ID NO: 704237 - DNA, 25 bp, Artificial sequence
  Synthetic oligonucleotide
gtagctgcgccgtacgacacgctgc

SEQ ID NO: 704238 - DNA, 25 bp, Artificial sequence
  Synthetic oligonucleotide
ccatccacgcgttccgctacgtgcg

SEQ ID NO: 704239 - DNA, 25 bp, Artificial sequence
  Synthetic oligonucleotide
ccatccacgcgtaccgctacgtgcg

SEQ ID NO: 704240 - DNA, 25 bp, Artificial sequence
  Synthetic oligonucleotide
tgggcgggcgcgaactcgatagggt

SEQ ID NO: 704241 - DNA, 25 bp, Artificial sequence
  Synthetic oligonucleotide
tgggcgggcgcgtactcgatagggt

SEQ ID NO: 704242 - DNA, 25 bp, Artificial sequence
  Synthetic oligonucleotide
ctcgtgcggtccgcggtttgccatg

SEQ ID NO: 704243 - DNA, 25 bp, Artificial sequence
  Synthetic oligonucleotide
ctcgtgcggtccccggtttgccatg

SEQ ID NO: 704244 - DNA, 25 bp, Artificial sequence
  Synthetic oligonucleotide
tcacccacgcctaaacccgcgtcgg

SEQ ID NO: 704245 - DNA, 25 bp, Artificial sequence
  Synthetic oligonucleotide
tcacccacgccttaacccgcgtcgg

SEQ ID NO: 704246 - DNA, 25 bp, Artificial sequence
  Synthetic oligonucleotide
gacggcgacgttcgaccgcggtact

SEQ ID NO: 704247 - DNA, 25 bp, Artificial sequence
  Synthetic oligonucleotide
cgagcgcggcgtcggtactgtagac

SEQ ID NO: 704248 - DNA, 25 bp, Artificial sequence
  Synthetic oligonucleotide
gacggcgacgttggaccgcggtact

SEQ ID NO: 704249 - DNA, 25 bp, Artificial sequence
  Synthetic oligonucleotide
cgagcgcggcgtgggtactgtagac

SEQ ID NO: 704250 - DNA, 25 bp, Artificial sequence
  Synthetic oligonucleotide
cattgccgataccccgacggaggcc

SEQ ID NO: 704251 - DNA, 25 bp, Artificial sequence
  Synthetic oligonucleotide
cattgccgatacgccgacggaggcc

SEQ ID NO: 704252 - DNA, 25 bp, Artificial sequence
  Synthetic oligonucleotide
tccatggcgccgctctagtgggtcc

SEQ ID NO: 704253 - DNA, 25 bp, Artificial sequence
  Synthetic oligonucleotide
tccatggcgccggtctagtgggtcc

SEQ ID NO: 704254 - DNA, 25 bp, Artificial sequence
  Synthetic oligonucleotide
gccgttagcgtcctgcgacgcaagc

SEQ ID NO: 704255 - DNA, 25 bp, Artificial sequence
  Synthetic oligonucleotide
cgagggaatgcggaacccgtcgcga

SEQ ID NO: 704256 - DNA, 25 bp, Artificial sequence
  Synthetic oligonucleotide
cgagggaatgcgcaacccgtcgcga

SEQ ID NO: 704257 - DNA, 25 bp, Artificial sequence
  Synthetic oligonucleotide
gccgttagcgtcgtgcgacgcaagc

SEQ ID NO: 704258 - DNA, 25 bp, Artificial sequence
  Synthetic oligonucleotide
gtagctgcgccgaacgacacgctgc

SEQ ID NO: 704259 - DNA, 25 bp, Artificial sequence
  Synthetic oligonucleotide
ggcgaccccgtcttcgcgaatccgg

SEQ ID NO: 704260 - DNA, 25 bp, Artificial sequence
  Synthetic oligonucleotide
ccggctcccgcggtattcggttggg

SEQ ID NO: 704261 - DNA, 25 bp, Artificial sequence
  Synthetic oligonucleotide
gctagcctaacgaccgcccgccagg

SEQ ID NO: 704262 - DNA, 25 bp, Artificial sequence
  Synthetic oligonucleotide
gctagcctaacgtccgcccgccagg

SEQ ID NO: 704263 - DNA, 25 bp, Artificial sequence
  Synthetic oligonucleotide
cccggaacgtatggccgcgtcccag

SEQ ID NO: 704264 - DNA, 25 bp, Artificial sequence
  Synthetic oligonucleotide
cccggaacgtatcgccgcgtcccag

SEQ ID NO: 704265 - DNA, 25 bp, Artificial sequence
  Synthetic oligonucleotide
gccggttaccgccgctcgacccact

SEQ ID NO: 704266 - DNA, 25 bp, Artificial sequence
  Synthetic oligonucleotide
cgctgccgtcctaccggtcggtcct

SEQ ID NO: 704267 - DNA, 25 bp, Artificial sequence
  Synthetic oligonucleotide
ccggctcccgcgctattcggttggg

SEQ ID NO: 704268 - DNA, 25 bp, Artificial sequence
  Synthetic oligonucleotide
gccccgacggtccatcccctcgcat

SEQ ID NO: 704269 - DNA, 25 bp, Artificial sequence
  Synthetic oligonucleotide
ggcgaccccgtcatcgcgaatccgg

SEQ ID NO: 704270 - DNA, 25 bp, Artificial sequence
  Synthetic oligonucleotide
cgctgccgtccttccggtcggtcct

SEQ ID NO: 704271 - DNA, 25 bp, Artificial sequence
  Synthetic oligonucleotide
gctcgcccgacgggtcgaaggtgct

SEQ ID NO: 704272 - DNA, 25 bp, Artificial sequence
  Synthetic oligonucleotide
gctcgcccgacgcgtcgaaggtgct

SEQ ID NO: 704273 - DNA, 25 bp, Artificial sequence
  Synthetic oligonucleotide
tggagcgtaacgcacgccgccgcac

SEQ ID NO: 704274 - DNA, 25 bp, Artificial sequence
  Synthetic oligonucleotide
tggagcgtaacggacgccgccgcac

SEQ ID NO: 704275 - DNA, 25 bp, Artificial sequence
  Synthetic oligonucleotide
gcgggtgcgatcgtgcgtaaggcgg

SEQ ID NO: 704276 - DNA, 25 bp, Artificial sequence
  Synthetic oligonucleotide
cccccgcgtactgtcgggtcacacc

SEQ ID NO: 704277 - DNA, 25 bp, Artificial sequence
  Synthetic oligonucleotide
gccccgacggtcgatcccctcgcat

SEQ ID NO: 704278 - DNA, 25 bp, Artificial sequence
  Synthetic oligonucleotide
ccaggacgcgcccgttaagacggcg

SEQ ID NO: 704279 - DNA, 25 bp, Artificial sequence
  Synthetic oligonucleotide
ccaggacgcgccggttaagacggcg

SEQ ID NO: 704280 - DNA, 25 bp, Artificial sequence
  Synthetic oligonucleotide
ggggcgacgaattcccgcgcacagg

SEQ ID NO: 704281 - DNA, 25 bp, Artificial sequence
  Synthetic oligonucleotide
gccggttaccgcggctcgacccact

SEQ ID NO: 704282 - DNA, 25 bp, Artificial sequence
  Synthetic oligonucleotide
cccccgcgtactctcgggtcacacc

SEQ ID NO: 704283 - DNA, 25 bp, Artificial sequence
  Synthetic oligonucleotide
tccgcttatacgcggcccggagccc

SEQ ID NO: 704284 - DNA, 25 bp, Artificial sequence
  Synthetic oligonucleotide
ggggcgacgaatacccgcgcacagg

SEQ ID NO: 704285 - DNA, 25 bp, Artificial sequence
  Synthetic oligonucleotide
cccgacgaatatccggcgccctgcg

SEQ ID NO: 704286 - DNA, 25 bp, Artificial sequence
  Synthetic oligonucleotide
gggtagacgcgtcgctaggcgagcc

SEQ ID NO: 704287 - DNA, 25 bp, Artificial sequence
  Synthetic oligonucleotide
gggtagacgcgtggctaggcgagcc

SEQ ID NO: 704288 - DNA, 25 bp, Artificial sequence
  Synthetic oligonucleotide
gcgggcgcgttaggatacccggctc

SEQ ID NO: 704289 - DNA, 25 bp, Artificial sequence
  Synthetic oligonucleotide
gcgggcgcgttacgatacccggctc

SEQ ID NO: 704290 - DNA, 25 bp, Artificial sequence
  Synthetic oligonucleotide
tggcgcttcgcccaccgtcctctgg

SEQ ID NO: 704291 - DNA, 25 bp, Artificial sequence
  Synthetic oligonucleotide
tggcgcttcgccgaccgtcctctgg

SEQ ID NO: 704292 - DNA, 25 bp, Artificial sequence
  Synthetic oligonucleotide
acccctcggcgcctactgtctcggg

SEQ ID NO: 704293 - DNA, 25 bp, Artificial sequence
  Synthetic oligonucleotide
acccctcggcgcgtactgtctcggg

SEQ ID NO: 704294 - DNA, 25 bp, Artificial sequence
  Synthetic oligonucleotide
cccgacgaatatgcggcgccctgcg

SEQ ID NO: 704295 - DNA, 25 bp, Artificial sequence
  Synthetic oligonucleotide
tggtcggcgctatccgcgtgaccgc

SEQ ID NO: 704296 - DNA, 25 bp, Artificial sequence
  Synthetic oligonucleotide
cgctcgctcgggcgtaacgccgcta

SEQ ID NO: 704297 - DNA, 25 bp, Artificial sequence
  Synthetic oligonucleotide
tccgcttatacggggcccggagccc

SEQ ID NO: 704298 - DNA, 25 bp, Artificial sequence
  Synthetic oligonucleotide
cgcggccgatacgccacgtgttccc

SEQ ID NO: 704299 - DNA, 25 bp, Artificial sequence
  Synthetic oligonucleotide
cgcggccgataccccacgtgttccc

SEQ ID NO: 704300 - DNA, 25 bp, Artificial sequence
  Synthetic oligonucleotide
ggcgttggcgctacgtcgaccggag

SEQ ID NO: 704301 - DNA, 25 bp, Artificial sequence
  Synthetic oligonucleotide
ggcgttggcgcttcgtcgaccggag

SEQ ID NO: 704302 - DNA, 25 bp, Artificial sequence
  Synthetic oligonucleotide
ccgcccgacttcgcgcgattccggt

SEQ ID NO: 704303 - DNA, 25 bp, Artificial sequence
  Synthetic oligonucleotide
ccgcccgacttcccgcgattccggt

SEQ ID NO: 704304 - DNA, 25 bp, Artificial sequence
  Synthetic oligonucleotide
cctccatacgcaccgaccgtcgccg

SEQ ID NO: 704305 - DNA, 25 bp, Artificial sequence
  Synthetic oligonucleotide
cctccatacgcagcgaccgtcgccg

SEQ ID NO: 704306 - DNA, 25 bp, Artificial sequence
  Synthetic oligonucleotide
cgctcgctcgggggtaacgccgcta

SEQ ID NO: 704307 - DNA, 25 bp, Artificial sequence
  Synthetic oligonucleotide
tggtcggcgctaaccgcgtgaccgc

SEQ ID NO: 704308 - DNA, 25 bp, Artificial sequence
  Synthetic oligonucleotide
accgcaatacgcccggacgcccctg

SEQ ID NO: 704309 - DNA, 25 bp, Artificial sequence
  Synthetic oligonucleotide
tgtcgggctagtacccgcgagcccg

SEQ ID NO: 704310 - DNA, 25 bp, Artificial sequence
  Synthetic oligonucleotide
tgtcgggctagttcccgcgagcccg

SEQ ID NO: 704311 - DNA, 25 bp, Artificial sequence
  Synthetic oligonucleotide
tccggcacgacccgtgcgtcggtgt

SEQ ID NO: 704312 - DNA, 25 bp, Artificial sequence
  Synthetic oligonucleotide
tccggcacgaccggtgcgtcggtgt

SEQ ID NO: 704313 - DNA, 25 bp, Artificial sequence
  Synthetic oligonucleotide
cccgaagccgtaggcggatgcgcct

SEQ ID NO: 704314 - DNA, 25 bp, Artificial sequence
  Synthetic oligonucleotide
cccgaagccgtacgcggatgcgcct

SEQ ID NO: 704315 - DNA, 25 bp, Artificial sequence
  Synthetic oligonucleotide
tagaggcgcacgtgcggtaggggcc

SEQ ID NO: 704316 - DNA, 25 bp, Artificial sequence
  Synthetic oligonucleotide
tagaggcgcacgagcggtaggggcc

SEQ ID NO: 704317 - DNA, 25 bp, Artificial sequence
  Synthetic oligonucleotide
tcacggctgccgcgcgctacgcaag

SEQ ID NO: 704318 - DNA, 25 bp, Artificial sequence
  Synthetic oligonucleotide
tcacggctgccgggcgctacgcaag

SEQ ID NO: 704319 - DNA, 25 bp, Artificial sequence
  Synthetic oligonucleotide
tggacggacctagggcgcgagtccg

SEQ ID NO: 704320 - DNA, 25 bp, Artificial sequence
  Synthetic oligonucleotide
ggctccctgcggtcgcgaactacgg

SEQ ID NO: 704321 - DNA, 25 bp, Artificial sequence
  Synthetic oligonucleotide
ggcaggcgcatgtcggttgggcgga

SEQ ID NO: 704322 - DNA, 25 bp, Artificial sequence
  Synthetic oligonucleotide
accgcaatacgcgcggacgcccctg

SEQ ID NO: 704323 - DNA, 25 bp, Artificial sequence
  Synthetic oligonucleotide
ggcgctgtcgtgggctgtagtgcgc

SEQ ID NO: 704324 - DNA, 25 bp, Artificial sequence
  Synthetic oligonucleotide
ggcgctgtcgtgcgctgtagtgcgc

SEQ ID NO: 704325 - DNA, 25 bp, Artificial sequence
  Synthetic oligonucleotide
gcggccggtcgcgcgtgtaaaccct

SEQ ID NO: 704326 - DNA, 25 bp, Artificial sequence
  Synthetic oligonucleotide
gcggccggtcgcccgtgtaaaccct

SEQ ID NO: 704327 - DNA, 25 bp, Artificial sequence
  Synthetic oligonucleotide
ggctgtctagttcgcgggccccggt

SEQ ID NO: 704328 - DNA, 25 bp, Artificial sequence
  Synthetic oligonucleotide
ggctgtctagttggcgggccccggt

SEQ ID NO: 704329 - DNA, 25 bp, Artificial sequence
  Synthetic oligonucleotide
ggcgctgtcatagcgccgtctggcg

SEQ ID NO: 704330 - DNA, 25 bp, Artificial sequence
  Synthetic oligonucleotide
tggacggacctacggcgcgagtccg

SEQ ID NO: 704331 - DNA, 25 bp, Artificial sequence
  Synthetic oligonucleotide
cacgcgcgggtcccgtatagcccac

SEQ ID NO: 704332 - DNA, 25 bp, Artificial sequence
  Synthetic oligonucleotide
ggctccctgcggacgcgaactacgg

SEQ ID NO: 704333 - DNA, 25 bp, Artificial sequence
  Synthetic oligonucleotide
gaggcccgtcgggctaagacgcgca

SEQ ID NO: 704334 - DNA, 25 bp, Artificial sequence
  Synthetic oligonucleotide
cctacgcgtcgatcgtctgggggcc

SEQ ID NO: 704335 - DNA, 25 bp, Artificial sequence
  Synthetic oligonucleotide
cctacgcgtcgaacgtctgggggcc

SEQ ID NO: 704336 - DNA, 25 bp, Artificial sequence
  Synthetic oligonucleotide
gaagggtgttgtcgcgcggcggagc

SEQ ID NO: 704337 - DNA, 25 bp, Artificial sequence
  Synthetic oligonucleotide
gaagggtgttgtggcgcggcggagc

SEQ ID NO: 704338 - DNA, 25 bp, Artificial sequence
  Synthetic oligonucleotide
tcgcgcgtaccgtcgacggccccat

SEQ ID NO: 704339 - DNA, 25 bp, Artificial sequence
  Synthetic oligonucleotide
tcgcgcgtaccgacgacggccccat

SEQ ID NO: 704340 - DNA, 25 bp, Artificial sequence
  Synthetic oligonucleotide
cgccggacgcgccatggatgtcgca

SEQ ID NO: 704341 - DNA, 25 bp, Artificial sequence
  Synthetic oligonucleotide
cgccggacgcgcgatggatgtcgca

SEQ ID NO: 704342 - DNA, 25 bp, Artificial sequence
  Synthetic oligonucleotide
cagagggcgcgacgtacgtggggag

SEQ ID NO: 704343 - DNA, 25 bp, Artificial sequence
  Synthetic oligonucleotide
cagagggcgcgaggtacgtggggag

SEQ ID NO: 704344 - DNA, 25 bp, Artificial sequence
  Synthetic oligonucleotide
gtcgctattcgcgcgcccatccgcg

SEQ ID NO: 704345 - DNA, 25 bp, Artificial sequence
  Synthetic oligonucleotide
ggagtcgcggtatcgcgaaccggcg

SEQ ID NO: 704346 - DNA, 25 bp, Artificial sequence
  Synthetic oligonucleotide
gtcgctattcgcccgcccatccgcg

SEQ ID NO: 704347 - DNA, 25 bp, Artificial sequence
  Synthetic oligonucleotide
gaggcccgtcggcctaagacgcgca

SEQ ID NO: 704348 - DNA, 25 bp, Artificial sequence
  Synthetic oligonucleotide
gaaccccgtcgaacgcgcagggcag

SEQ ID NO: 704349 - DNA, 25 bp, Artificial sequence
  Synthetic oligonucleotide
gaaccccgtcgatcgcgcagggcag

SEQ ID NO: 704350 - DNA, 25 bp, Artificial sequence
  Synthetic oligonucleotide
gtctggtcgtaccggcccggcatgc

SEQ ID NO: 704351 - DNA, 25 bp, Artificial sequence
  Synthetic oligonucleotide
gtctggtcgtacgggcccggcatgc

SEQ ID NO: 704352 - DNA, 25 bp, Artificial sequence
  Synthetic oligonucleotide
cgcagtgacgcggggttggcagcga

SEQ ID NO: 704353 - DNA, 25 bp, Artificial sequence
  Synthetic oligonucleotide
cgcagtgacgcgcggttggcagcga

SEQ ID NO: 704354 - DNA, 25 bp, Artificial sequence
  Synthetic oligonucleotide
actgcgcgcgttccgacgtcgaggg

SEQ ID NO: 704355 - DNA, 25 bp, Artificial sequence
  Synthetic oligonucleotide
actgcgcgcgttgcgacgtcgaggg

SEQ ID NO: 704356 - DNA, 25 bp, Artificial sequence
  Synthetic oligonucleotide
ggcaggcgcatgacggttgggcgga

SEQ ID NO: 704357 - DNA, 25 bp, Artificial sequence
  Synthetic oligonucleotide
gcgggtgcgatcctgcgtaaggcgg

SEQ ID NO: 704358 - DNA, 25 bp, Artificial sequence
  Synthetic oligonucleotide
ggagtcgcggtaacgcgaaccggcg

SEQ ID NO: 704359 - DNA, 25 bp, Artificial sequence
  Synthetic oligonucleotide
gactatccggcgggactgtcgggcg

SEQ ID NO: 704360 - DNA, 25 bp, Artificial sequence
  Synthetic oligonucleotide
cacgcgcgggtcgcgtatagcccac

SEQ ID NO: 704361 - DNA, 25 bp, Artificial sequence
  Synthetic oligonucleotide
aggggccgagctaaccgcgccacga

SEQ ID NO: 704362 - DNA, 25 bp, Artificial sequence
  Synthetic oligonucleotide
aggggccgagcttaccgcgccacga

SEQ ID NO: 704363 - DNA, 25 bp, Artificial sequence
  Synthetic oligonucleotide
gcccgcgtacgagcgacgcggacaa

SEQ ID NO: 704364 - DNA, 25 bp, Artificial sequence
  Synthetic oligonucleotide
gcccgcgtacgaccgacgcggacaa

SEQ ID NO: 704365 - DNA, 25 bp, Artificial sequence
  Synthetic oligonucleotide
gagtgcgcgggctagtacgcgccga

SEQ ID NO: 704366 - DNA, 25 bp, Artificial sequence
  Synthetic oligonucleotide
gagtgcgcgggcaagtacgcgccga

SEQ ID NO: 704367 - DNA, 25 bp, Artificial sequence
  Synthetic oligonucleotide
gcgcccggcatagtagcgggagtgg

SEQ ID NO: 704368 - DNA, 25 bp, Artificial sequence
  Synthetic oligonucleotide
gcgcccggcatactagcgggagtgg

SEQ ID NO: 704369 - DNA, 25 bp, Artificial sequence
  Synthetic oligonucleotide
cggggcaggcgcggtaacgatcgac

SEQ ID NO: 704370 - DNA, 25 bp, Artificial sequence
  Synthetic oligonucleotide
gtccgctcgcgcgtatggtcgagcc

SEQ ID NO: 704371 - DNA, 25 bp, Artificial sequence
  Synthetic oligonucleotide
gactatccggcgcgactgtcgggcg

SEQ ID NO: 704372 - DNA, 25 bp, Artificial sequence
  Synthetic oligonucleotide
tcagctcgactcgcctacggcgccc

SEQ ID NO: 704373 - DNA, 25 bp, Artificial sequence
  Synthetic oligonucleotide
acaccgtcgcacgacgtgccgcagg

SEQ ID NO: 704374 - DNA, 25 bp, Artificial sequence
  Synthetic oligonucleotide
acaccgtcgcaccacgtgccgcagg

SEQ ID NO: 704375 - DNA, 25 bp, Artificial sequence
  Synthetic oligonucleotide
gcgtacgcgctatcgggcgccacag

SEQ ID NO: 704376 - DNA, 25 bp, Artificial sequence
  Synthetic oligonucleotide
gcgtacgcgctaacgggcgccacag

SEQ ID NO: 704377 - DNA, 25 bp, Artificial sequence
  Synthetic oligonucleotide
cacggacgcggcaacgtacggcgca

SEQ ID NO: 704378 - DNA, 25 bp, Artificial sequence
  Synthetic oligonucleotide
cacggacgcggctacgtacggcgca

SEQ ID NO: 704379 - DNA, 25 bp, Artificial sequence
  Synthetic oligonucleotide
gcccccacttcgggcgtgtgtccgt

SEQ ID NO: 704380 - DNA, 25 bp, Artificial sequence
  Synthetic oligonucleotide
gcccccacttcgcgcgtgtgtccgt

SEQ ID NO: 704381 - DNA, 25 bp, Artificial sequence
  Synthetic oligonucleotide
gggtcggtcgtctacgcgcgactgg

SEQ ID NO: 704382 - DNA, 25 bp, Artificial sequence
  Synthetic oligonucleotide
ccgcagtcgcgcgtatgcggatgcc

SEQ ID NO: 704383 - DNA, 25 bp, Artificial sequence
  Synthetic oligonucleotide
cggggcaggcgccgtaacgatcgac

SEQ ID NO: 704384 - DNA, 25 bp, Artificial sequence
  Synthetic oligonucleotide
cgggccttcgaccgcgttcaggcac

SEQ ID NO: 704385 - DNA, 25 bp, Artificial sequence
  Synthetic oligonucleotide
ggccgagcggtccactcgtcagctc

SEQ ID NO: 704386 - DNA, 25 bp, Artificial sequence
  Synthetic oligonucleotide
taggcggcgctaggtcggtgcacgc

SEQ ID NO: 704387 - DNA, 25 bp, Artificial sequence
  Synthetic oligonucleotide
cacgcgcgatcccgcgaacgctgga

SEQ ID NO: 704388 - DNA, 25 bp, Artificial sequence
  Synthetic oligonucleotide
cacgcgcgatccggcgaacgctgga

SEQ ID NO: 704389 - DNA, 25 bp, Artificial sequence
  Synthetic oligonucleotide
ggtctgcgcgtatgcgagcccggtg

SEQ ID NO: 704390 - DNA, 25 bp, Artificial sequence
  Synthetic oligonucleotide
ggtctgcgcgtaagcgagcccggtg

SEQ ID NO: 704391 - DNA, 25 bp, Artificial sequence
  Synthetic oligonucleotide
tggccgcgcttacgtccgaggccga

SEQ ID NO: 704392 - DNA, 25 bp, Artificial sequence
  Synthetic oligonucleotide
tggccgcgcttaggtccgaggccga

SEQ ID NO: 704393 - DNA, 25 bp, Artificial sequence
  Synthetic oligonucleotide
agacgccgctagctacggggtcgcg

SEQ ID NO: 704394 - DNA, 25 bp, Artificial sequence
  Synthetic oligonucleotide
agacgccgctaggtacggggtcgcg

SEQ ID NO: 704395 - DNA, 25 bp, Artificial sequence
  Synthetic oligonucleotide
gtccgctcgcgcctatggtcgagcc

SEQ ID NO: 704396 - DNA, 25 bp, Artificial sequence
  Synthetic oligonucleotide
gcgcgcggaacgacgcggttttgcg

SEQ ID NO: 704397 - DNA, 25 bp, Artificial sequence
  Synthetic oligonucleotide
ccgcagtcgcgcctatgcggatgcc

SEQ ID NO: 704398 - DNA, 25 bp, Artificial sequence
  Synthetic oligonucleotide
cgggccttcgacggcgttcaggcac

SEQ ID NO: 704399 - DNA, 25 bp, Artificial sequence
  Synthetic oligonucleotide
acacggcgaacgggggtcggagacg

SEQ ID NO: 704400 - DNA, 25 bp, Artificial sequence
  Synthetic oligonucleotide
acacggcgaacgcgggtcggagacg

SEQ ID NO: 704401 - DNA, 25 bp, Artificial sequence
  Synthetic oligonucleotide
ggcggagttccgggcttcggcgtac

SEQ ID NO: 704402 - DNA, 25 bp, Artificial sequence
  Synthetic oligonucleotide
ggcggagttccgcgcttcggcgtac

SEQ ID NO: 704403 - DNA, 25 bp, Artificial sequence
  Synthetic oligonucleotide
gtgtcggctacgatccgccggtccg

SEQ ID NO: 704404 - DNA, 25 bp, Artificial sequence
  Synthetic oligonucleotide
gtgtcggctacgttccgccggtccg

SEQ ID NO: 704405 - DNA, 25 bp, Artificial sequence
  Synthetic oligonucleotide
ctcccgggggcgaattacgcacgcg

SEQ ID NO: 704406 - DNA, 25 bp, Artificial sequence
  Synthetic oligonucleotide
ctcccgggggcgtattacgcacgcg

SEQ ID NO: 704407 - DNA, 25 bp, Artificial sequence
  Synthetic oligonucleotide
tcagctcgactcccctacggcgccc

SEQ ID NO: 704408 - DNA, 25 bp, Artificial sequence
  Synthetic oligonucleotide
gcgcgcggaacgtcgcggttttgcg

SEQ ID NO: 704409 - DNA, 25 bp, Artificial sequence
  Synthetic oligonucleotide
gggcactatgcgcgatcgggcgcgt

SEQ ID NO: 704410 - DNA, 25 bp, Artificial sequence
  Synthetic oligonucleotide
gggtcggtcgtcaacgcgcgactgg

SEQ ID NO: 704411 - DNA, 25 bp, Artificial sequence
  Synthetic oligonucleotide
taggggtcgtaagccgcgcctcgcc

SEQ ID NO: 704412 - DNA, 25 bp, Artificial sequence
  Synthetic oligonucleotide
taggggtcgtaacccgcgcctcgcc

SEQ ID NO: 704413 - DNA, 25 bp, Artificial sequence
  Synthetic oligonucleotide
tccctgtgacgcctagcggtccgcc

SEQ ID NO: 704414 - DNA, 25 bp, Artificial sequence
  Synthetic oligonucleotide
tccctgtgacgcgtagcggtccgcc

SEQ ID NO: 704415 - DNA, 25 bp, Artificial sequence
  Synthetic oligonucleotide
catcccgtcgaccgtacgcgccgag

SEQ ID NO: 704416 - DNA, 25 bp, Artificial sequence
  Synthetic oligonucleotide
catcccgtcgacggtacgcgccgag

SEQ ID NO: 704417 - DNA, 25 bp, Artificial sequence
  Synthetic oligonucleotide
ccgggactaccgacgctcgagcgtc

SEQ ID NO: 704418 - DNA, 25 bp, Artificial sequence
  Synthetic oligonucleotide
ccgggactaccgtcgctcgagcgtc

SEQ ID NO: 704419 - DNA, 25 bp, Artificial sequence
  Synthetic oligonucleotide
gcggtcgacggtggttccgtgccca

SEQ ID NO: 704420 - DNA, 25 bp, Artificial sequence
  Synthetic oligonucleotide
ggagaggacgggacgactcgcgctc

SEQ ID NO: 704421 - DNA, 25 bp, Artificial sequence
  Synthetic oligonucleotide
gggcactatgcgggatcgggcgcgt

SEQ ID NO: 704422 - DNA, 25 bp, Artificial sequence
  Synthetic oligonucleotide
ctcacccgtcgcccgaacacggtgc

SEQ ID NO: 704423 - DNA, 25 bp, Artificial sequence
  Synthetic oligonucleotide
tcgccgcgcggtatgtccaccgacc

SEQ ID NO: 704424 - DNA, 25 bp, Artificial sequence
  Synthetic oligonucleotide
tcgccgcgcggtttgtccaccgacc

SEQ ID NO: 704425 - DNA, 25 bp, Artificial sequence
  Synthetic oligonucleotide
ggccgtgtaacggcgcgacccaacg

SEQ ID NO: 704426 - DNA, 25 bp, Artificial sequence
  Synthetic oligonucleotide
ggccgtgtaacgccgcgacccaacg

SEQ ID NO: 704427 - DNA, 25 bp, Artificial sequence
  Synthetic oligonucleotide
ccgtgccgcatagtacggccccgtc

SEQ ID NO: 704428 - DNA, 25 bp, Artificial sequence
  Synthetic oligonucleotide
ccgtgccgcatactacggccccgtc

SEQ ID NO: 704429 - DNA, 25 bp, Artificial sequence
  Synthetic oligonucleotide
acgcctgtaggttcgcgcgggacgc

SEQ ID NO: 704430 - DNA, 25 bp, Artificial sequence
  Synthetic oligonucleotide
acgcctgtaggtacgcgcgggacgc

SEQ ID NO: 704431 - DNA, 25 bp, Artificial sequence
  Synthetic oligonucleotide
cccgtctagcgcgtcggatccgcac

SEQ ID NO: 704432 - DNA, 25 bp, Artificial sequence
  Synthetic oligonucleotide
cccgtctagcgcctcggatccgcac

SEQ ID NO: 704433 - DNA, 25 bp, Artificial sequence
  Synthetic oligonucleotide
gcggtcgacggtcgttccgtgccca

SEQ ID NO: 704434 - DNA, 25 bp, Artificial sequence
  Synthetic oligonucleotide
cctggcgtacgtagccgcgccaggt

SEQ ID NO: 704435 - DNA, 25 bp, Artificial sequence
  Synthetic oligonucleotide
tcgtccccgatgtcggacggtcccg

SEQ ID NO: 704436 - DNA, 25 bp, Artificial sequence
  Synthetic oligonucleotide
tcgtccccgatgacggacggtcccg

SEQ ID NO: 704437 - DNA, 25 bp, Artificial sequence
  Synthetic oligonucleotide
ccgggctgtgcgtcccgtactaccc

SEQ ID NO: 704438 - DNA, 25 bp, Artificial sequence
  Synthetic oligonucleotide
ccgggctgtgcgacccgtactaccc

SEQ ID NO: 704439 - DNA, 25 bp, Artificial sequence
  Synthetic oligonucleotide
ggcacggaaggcccgttaccgtccc

SEQ ID NO: 704440 - DNA, 25 bp, Artificial sequence
  Synthetic oligonucleotide
ggcacggaaggcgcgttaccgtccc

SEQ ID NO: 704441 - DNA, 25 bp, Artificial sequence
  Synthetic oligonucleotide
gccccttaggacacccgcgacaggg

SEQ ID NO: 704442 - DNA, 25 bp, Artificial sequence
  Synthetic oligonucleotide
gccccttaggactcccgcgacaggg

SEQ ID NO: 704443 - DNA, 25 bp, Artificial sequence
  Synthetic oligonucleotide
tcttggtcgaaccgccccgcggcgt

SEQ ID NO: 704444 - DNA, 25 bp, Artificial sequence
  Synthetic oligonucleotide
tcttggtcgaacggccccgcggcgt

SEQ ID NO: 704445 - DNA, 25 bp, Artificial sequence
  Synthetic oligonucleotide
ggagaggacgggtcgactcgcgctc

SEQ ID NO: 704446 - DNA, 25 bp, Artificial sequence
  Synthetic oligonucleotide
ctagcccgagtcgcgctagaggggc

SEQ ID NO: 704447 - DNA, 25 bp, Artificial sequence
  Synthetic oligonucleotide
ggcgctgtcataccgccgtctggcg

SEQ ID NO: 704448 - DNA, 25 bp, Artificial sequence
  Synthetic oligonucleotide
cctggcgtacgttgccgcgccaggt

SEQ ID NO: 704449 - DNA, 25 bp, Artificial sequence
  Synthetic oligonucleotide
ggggccttacgccgacccgtgtcca

SEQ ID NO: 704450 - DNA, 25 bp, Artificial sequence
  Synthetic oligonucleotide
ggggccttacgcggacccgtgtcca

SEQ ID NO: 704451 - DNA, 25 bp, Artificial sequence
  Synthetic oligonucleotide
agcggccgcgggtctagcggtgtag

SEQ ID NO: 704452 - DNA, 25 bp, Artificial sequence
  Synthetic oligonucleotide
agcggccgcgggactagcggtgtag

SEQ ID NO: 704453 - DNA, 25 bp, Artificial sequence
  Synthetic oligonucleotide
cggagctacgccggtcgcttgcgag

SEQ ID NO: 704454 - DNA, 25 bp, Artificial sequence
  Synthetic oligonucleotide
cggagctacgcccgtcgcttgcgag

SEQ ID NO: 704455 - DNA, 25 bp, Artificial sequence
  Synthetic oligonucleotide
ccgcgacgcggaaaactcgtggcgc

SEQ ID NO: 704456 - DNA, 25 bp, Artificial sequence
  Synthetic oligonucleotide
ccgcgacgcggataactcgtggcgc

SEQ ID NO: 704457 - DNA, 25 bp, Artificial sequence
  Synthetic oligonucleotide
ctcacccgtcgcgcgaacacggtgc

SEQ ID NO: 704458 - DNA, 25 bp, Artificial sequence
  Synthetic oligonucleotide
ctagcccgagtcccgctagaggggc

SEQ ID NO: 704459 - DNA, 25 bp, Artificial sequence
  Synthetic oligonucleotide
aacgagcccctactcgacgccgggc

SEQ ID NO: 704460 - DNA, 25 bp, Artificial sequence
  Synthetic oligonucleotide
cgctcctacgcgtggtcggaaccgg

SEQ ID NO: 704461 - DNA, 25 bp, Artificial sequence
  Synthetic oligonucleotide
acacggacggcggtccgacgcatcc

SEQ ID NO: 704462 - DNA, 25 bp, Artificial sequence
  Synthetic oligonucleotide
accgcagccgtccggcgtacccatc

SEQ ID NO: 704463 - DNA, 25 bp, Artificial sequence
  Synthetic oligonucleotide
accgcagccgtcgggcgtacccatc

SEQ ID NO: 704464 - DNA, 25 bp, Artificial sequence
  Synthetic oligonucleotide
cgcgccgcgtactatgccgagggca

SEQ ID NO: 704465 - DNA, 25 bp, Artificial sequence
  Synthetic oligonucleotide
cgcgccgcgtacaatgccgagggca

SEQ ID NO: 704466 - DNA, 25 bp, Artificial sequence
  Synthetic oligonucleotide
ggcaggtaccgcggaaccctcgtcc

SEQ ID NO: 704467 - DNA, 25 bp, Artificial sequence
  Synthetic oligonucleotide
ggcaggtaccgccgaaccctcgtcc

SEQ ID NO: 704468 - DNA, 25 bp, Artificial sequence
  Synthetic oligonucleotide
acgggagtccgttaccgcggctgcc

SEQ ID NO: 704469 - DNA, 25 bp, Artificial sequence
  Synthetic oligonucleotide
acgggagtccgtaaccgcggctgcc

SEQ ID NO: 704470 - DNA, 25 bp, Artificial sequence
  Synthetic oligonucleotide
gggcggtattcgggcccgcccagtt

SEQ ID NO: 704471 - DNA, 25 bp, Artificial sequence
  Synthetic oligonucleotide
ggagactacgcgacgcacggtccgc

SEQ ID NO: 704472 - DNA, 25 bp, Artificial sequence
  Synthetic oligonucleotide
gggcggtattcgcgcccgcccagtt

SEQ ID NO: 704473 - DNA, 25 bp, Artificial sequence
  Synthetic oligonucleotide
aacgagcccctagtcgacgccgggc

SEQ ID NO: 704474 - DNA, 25 bp, Artificial sequence
  Synthetic oligonucleotide
ccgggagcgatacgccgattccggg

SEQ ID NO: 704475 - DNA, 25 bp, Artificial sequence
  Synthetic oligonucleotide
ccgggagcgataggccgattccggg

SEQ ID NO: 704476 - DNA, 25 bp, Artificial sequence
  Synthetic oligonucleotide
ccccggcttgcgtgtcgacgggaac

SEQ ID NO: 704477 - DNA, 25 bp, Artificial sequence
  Synthetic oligonucleotide
ccccggcttgcgagtcgacgggaac

SEQ ID NO: 704478 - DNA, 25 bp, Artificial sequence
  Synthetic oligonucleotide
tcggagtttcgcgcgaggccggggt

SEQ ID NO: 704479 - DNA, 25 bp, Artificial sequence
  Synthetic oligonucleotide
tcggagtttcgcccgaggccggggt

SEQ ID NO: 704480 - DNA, 25 bp, Artificial sequence
  Synthetic oligonucleotide
cgcttccgcgttaggtcgtccggcg

SEQ ID NO: 704481 - DNA, 25 bp, Artificial sequence
  Synthetic oligonucleotide
cgcgaccgtacggcgggttggcagt

SEQ ID NO: 704482 - DNA, 25 bp, Artificial sequence
  Synthetic oligonucleotide
cctggggcgtcgggttaggccacgt

SEQ ID NO: 704483 - DNA, 25 bp, Artificial sequence
  Synthetic oligonucleotide
ggagactacgcgtcgcacggtccgc

SEQ ID NO: 704484 - DNA, 25 bp, Artificial sequence
  Synthetic oligonucleotide
ctccgtccgaacccacgagcgctgg

SEQ ID NO: 704485 - DNA, 25 bp, Artificial sequence
  Synthetic oligonucleotide
cctggggcgtcgcgttaggccacgt

SEQ ID NO: 704486 - DNA, 25 bp, Artificial sequence
  Synthetic oligonucleotide
gcctagggactaacgcgcgagccgg

SEQ ID NO: 704487 - DNA, 25 bp, Artificial sequence
  Synthetic oligonucleotide
gcctagggactatcgcgcgagccgg

SEQ ID NO: 704488 - DNA, 25 bp, Artificial sequence
  Synthetic oligonucleotide
cagcgcgatcgtgcgtagcgtccgc

SEQ ID NO: 704489 - DNA, 25 bp, Artificial sequence
  Synthetic oligonucleotide
cagcgcgatcgtccgtagcgtccgc

SEQ ID NO: 704490 - DNA, 25 bp, Artificial sequence
  Synthetic oligonucleotide
ccttcgggtcgtgcgcgtaggagcc

SEQ ID NO: 704491 - DNA, 25 bp, Artificial sequence
  Synthetic oligonucleotide
ccttcgggtcgtccgcgtaggagcc

SEQ ID NO: 704492 - DNA, 25 bp, Artificial sequence
  Synthetic oligonucleotide
ccaggcgcgctcaagaccggtctcc

SEQ ID NO: 704493 - DNA, 25 bp, Artificial sequence
  Synthetic oligonucleotide
ccaggcgcgctctagaccggtctcc

SEQ ID NO: 704494 - DNA, 25 bp, Artificial sequence
  Synthetic oligonucleotide
gcgcataccgcgaaacggacgccgc

SEQ ID NO: 704495 - DNA, 25 bp, Artificial sequence
  Synthetic oligonucleotide
acacggacggcgctccgacgcatcc

SEQ ID NO: 704496 - DNA, 25 bp, Artificial sequence
  Synthetic oligonucleotide
ctccgtccgaacgcacgagcgctgg

SEQ ID NO: 704497 - DNA, 25 bp, Artificial sequence
  Synthetic oligonucleotide
cgctcctacgcgaggtcggaaccgg

SEQ ID NO: 704498 - DNA, 25 bp, Artificial sequence
  Synthetic oligonucleotide
ctggcggtcgcgaactcgacctggg

SEQ ID NO: 704499 - DNA, 25 bp, Artificial sequence
  Synthetic oligonucleotide
ctggcggtcgcgtactcgacctggg

SEQ ID NO: 704500 - DNA, 25 bp, Artificial sequence
  Synthetic oligonucleotide
acgggggcgcgtaacgacgcgcaag

SEQ ID NO: 704501 - DNA, 25 bp, Artificial sequence
  Synthetic oligonucleotide
acgggggcgcgttacgacgcgcaag

SEQ ID NO: 704502 - DNA, 25 bp, Artificial sequence
  Synthetic oligonucleotide
gagggcacgcttgtacgcgctcccc

SEQ ID NO: 704503 - DNA, 25 bp, Artificial sequence
  Synthetic oligonucleotide
gagggcacgcttctacgcgctcccc

SEQ ID NO: 704504 - DNA, 25 bp, Artificial sequence
  Synthetic oligonucleotide
cggtcctcgcattcggtcgccccca

SEQ ID NO: 704505 - DNA, 25 bp, Artificial sequence
  Synthetic oligonucleotide
cggtcctcgcatacggtcgccccca

SEQ ID NO: 704506 - DNA, 25 bp, Artificial sequence
  Synthetic oligonucleotide
gtgggcacgtaacgagtcgcgcgcc

SEQ ID NO: 704507 - DNA, 25 bp, Artificial sequence
  Synthetic oligonucleotide
gtgggcacgtaaggagtcgcgcgcc

SEQ ID NO: 704508 - DNA, 25 bp, Artificial sequence
  Synthetic oligonucleotide
gcgcataccgcgtaacggacgccgc

SEQ ID NO: 704509 - DNA, 25 bp, Artificial sequence
  Synthetic oligonucleotide
gggggtgaactagcgcgacccccac

SEQ ID NO: 704510 - DNA, 25 bp, Artificial sequence
  Synthetic oligonucleotide
cagacgggacggcctacgcgggagt

SEQ ID NO: 704511 - DNA, 25 bp, Artificial sequence
  Synthetic oligonucleotide
tcagctctccgcctacgtccggccg

SEQ ID NO: 704512 - DNA, 25 bp, Artificial sequence
  Synthetic oligonucleotide
tcagctctccgcgtacgtccggccg

SEQ ID NO: 704513 - DNA, 25 bp, Artificial sequence
  Synthetic oligonucleotide
gcgctggccgtcggggtatgcgtct

SEQ ID NO: 704514 - DNA, 25 bp, Artificial sequence
  Synthetic oligonucleotide
gcgctggccgtccgggtatgcgtct

SEQ ID NO: 704515 - DNA, 25 bp, Artificial sequence
  Synthetic oligonucleotide
gccaccgacgcgtgacgtaggccag

SEQ ID NO: 704516 - DNA, 25 bp, Artificial sequence
  Synthetic oligonucleotide
gccaccgacgcgagacgtaggccag

SEQ ID NO: 704517 - DNA, 25 bp, Artificial sequence
  Synthetic oligonucleotide
gtctgggcgacttccgtccctcccg

SEQ ID NO: 704518 - DNA, 25 bp, Artificial sequence
  Synthetic oligonucleotide
gtctgggcgactaccgtccctcccg

SEQ ID NO: 704519 - DNA, 25 bp, Artificial sequence
  Synthetic oligonucleotide
cgttgccgtcggccgtatgcgcgct

SEQ ID NO: 704520 - DNA, 25 bp, Artificial sequence
  Synthetic oligonucleotide
gacgtcgtccgacgcgatgctgcgg

SEQ ID NO: 704521 - DNA, 25 bp, Artificial sequence
  Synthetic oligonucleotide
gggggtgaactaccgcgacccccac

SEQ ID NO: 704522 - DNA, 25 bp, Artificial sequence
  Synthetic oligonucleotide
cgcgttggtctatcgcgcgcccgac

SEQ ID NO: 704523 - DNA, 25 bp, Artificial sequence
  Synthetic oligonucleotide
gcgcgttaccgccccggtatcggct

SEQ ID NO: 704524 - DNA, 25 bp, Artificial sequence
  Synthetic oligonucleotide
gcgcgttaccgcgccggtatcggct

SEQ ID NO: 704525 - DNA, 25 bp, Artificial sequence
  Synthetic oligonucleotide
gaggtgcggtacctacccgccagcc

SEQ ID NO: 704526 - DNA, 25 bp, Artificial sequence
  Synthetic oligonucleotide
gaggtgcggtacgtacccgccagcc

SEQ ID NO: 704527 - DNA, 25 bp, Artificial sequence
  Synthetic oligonucleotide
tgggtctatccgcctacgcgcggcc

SEQ ID NO: 704528 - DNA, 25 bp, Artificial sequence
  Synthetic oligonucleotide
tgggtctatccggctacgcgcggcc

SEQ ID NO: 704529 - DNA, 25 bp, Artificial sequence
  Synthetic oligonucleotide
ggcgctcgctaagggcggaatgcgc

SEQ ID NO: 704530 - DNA, 25 bp, Artificial sequence
  Synthetic oligonucleotide
ggcgctcgctaacggcggaatgcgc

SEQ ID NO: 704531 - DNA, 25 bp, Artificial sequence
  Synthetic oligonucleotide
taggcggcgctacgtcggtgcacgc

SEQ ID NO: 704532 - DNA, 25 bp, Artificial sequence
  Synthetic oligonucleotide
cgcgaccgtacgccgggttggcagt

SEQ ID NO: 704533 - DNA, 25 bp, Artificial sequence
  Synthetic oligonucleotide
cgttgccgtcgggcgtatgcgcgct

SEQ ID NO: 704534 - DNA, 25 bp, Artificial sequence
  Synthetic oligonucleotide
ctaggcgtccggacctagcgcagcg

SEQ ID NO: 704535 - DNA, 25 bp, Artificial sequence
  Synthetic oligonucleotide
cgcttgacgggcgagacgtccaggc

SEQ ID NO: 704536 - DNA, 25 bp, Artificial sequence
  Synthetic oligonucleotide
cgcttgacgggccagacgtccaggc

SEQ ID NO: 704537 - DNA, 25 bp, Artificial sequence
  Synthetic oligonucleotide
cgccccttcgcgacggaactggcac

SEQ ID NO: 704538 - DNA, 25 bp, Artificial sequence
  Synthetic oligonucleotide
cgccccttcgcgtcggaactggcac

SEQ ID NO: 704539 - DNA, 25 bp, Artificial sequence
  Synthetic oligonucleotide
aggaggcggtcgtccgctaccacgc

SEQ ID NO: 704540 - DNA, 25 bp, Artificial sequence
  Synthetic oligonucleotide
aggaggcggtcgaccgctaccacgc

SEQ ID NO: 704541 - DNA, 25 bp, Artificial sequence
  Synthetic oligonucleotide
gccaggcgtacgtctactcggcggg

SEQ ID NO: 704542 - DNA, 25 bp, Artificial sequence
  Synthetic oligonucleotide
gccaggcgtacgactactcggcggg

SEQ ID NO: 704543 - DNA, 25 bp, Artificial sequence
  Synthetic oligonucleotide
cctcatgtacggtcgggccgccctg

SEQ ID NO: 704544 - DNA, 25 bp, Artificial sequence
  Synthetic oligonucleotide
cctcatgtacggacgggccgccctg

SEQ ID NO: 704545 - DNA, 25 bp, Artificial sequence
  Synthetic oligonucleotide
gacgtcgtccgaggcgatgctgcgg

SEQ ID NO: 704546 - DNA, 25 bp, Artificial sequence
  Synthetic oligonucleotide
tcgcgcgacgcatgcggacgggact

SEQ ID NO: 704547 - DNA, 25 bp, Artificial sequence
  Synthetic oligonucleotide
cgcttccgcgtttggtcgtccggcg

SEQ ID NO: 704548 - DNA, 25 bp, Artificial sequence
  Synthetic oligonucleotide
ctaggcgtccggtcctagcgcagcg

SEQ ID NO: 704549 - DNA, 25 bp, Artificial sequence
  Synthetic oligonucleotide
aggcaacgacgttcgtgcgggcccc

SEQ ID NO: 704550 - DNA, 25 bp, Artificial sequence
  Synthetic oligonucleotide
aggcaacgacgtacgtgcgggcccc

SEQ ID NO: 704551 - DNA, 25 bp, Artificial sequence
  Synthetic oligonucleotide
tggaccaccggcgcgctagtcacgg

SEQ ID NO: 704552 - DNA, 25 bp, Artificial sequence
  Synthetic oligonucleotide
tggaccaccggcccgctagtcacgg

SEQ ID NO: 704553 - DNA, 25 bp, Artificial sequence
  Synthetic oligonucleotide
cgccggcgttcgcgacgtaagcgca

SEQ ID NO: 704554 - DNA, 25 bp, Artificial sequence
  Synthetic oligonucleotide
cgccggcgttcgggacgtaagcgca

SEQ ID NO: 704555 - DNA, 25 bp, Artificial sequence
  Synthetic oligonucleotide
cacgtccggactggtacgccgaggc

SEQ ID NO: 704556 - DNA, 25 bp, Artificial sequence
  Synthetic oligonucleotide
cacgtccggactcgtacgccgaggc

SEQ ID NO: 704557 - DNA, 25 bp, Artificial sequence
  Synthetic oligonucleotide
cgcgttggtctaacgcgcgcccgac

SEQ ID NO: 704558 - DNA, 25 bp, Artificial sequence
  Synthetic oligonucleotide
tcgcgcgacgcaagcggacgggact

SEQ ID NO: 704559 - DNA, 25 bp, Artificial sequence
  Synthetic oligonucleotide
cgcctcggctacggacgaacggagc

SEQ ID NO: 704560 - DNA, 25 bp, Artificial sequence
  Synthetic oligonucleotide
ccagggcgcaagttacccggcgcga

SEQ ID NO: 704561 - DNA, 25 bp, Artificial sequence
  Synthetic oligonucleotide
cccctggcgttacggctcgtcggac

SEQ ID NO: 704562 - DNA, 25 bp, Artificial sequence
  Synthetic oligonucleotide
ctcgggtctagggcgcggaccttgc

SEQ ID NO: 704563 - DNA, 25 bp, Artificial sequence
  Synthetic oligonucleotide
ctcgggtctaggccgcggaccttgc

SEQ ID NO: 704564 - DNA, 25 bp, Artificial sequence
  Synthetic oligonucleotide
ccagggcgatacgaccgcgctgcga

SEQ ID NO: 704565 - DNA, 25 bp, Artificial sequence
  Synthetic oligonucleotide
ccagggcgataccaccgcgctgcga

SEQ ID NO: 704566 - DNA, 25 bp, Artificial sequence
  Synthetic oligonucleotide
ggactggcgcggtatccaaccccgc

SEQ ID NO: 704567 - DNA, 25 bp, Artificial sequence
  Synthetic oligonucleotide
ggactggcgcggaatccaaccccgc

SEQ ID NO: 704568 - DNA, 25 bp, Artificial sequence
  Synthetic oligonucleotide
tgcgcggtcgcccataacgcgggag

SEQ ID NO: 704569 - DNA, 25 bp, Artificial sequence
  Synthetic oligonucleotide
tgcgcggtcgccgataacgcgggag

SEQ ID NO: 704570 - DNA, 25 bp, Artificial sequence
  Synthetic oligonucleotide
acgcgccgatacacgtcggccgggt

SEQ ID NO: 704571 - DNA, 25 bp, Artificial sequence
  Synthetic oligonucleotide
ggaggcgtaggacggcgcagcaacc

SEQ ID NO: 704572 - DNA, 25 bp, Artificial sequence
  Synthetic oligonucleotide
cccagcgtacgccacgacctggtcc

SEQ ID NO: 704573 - DNA, 25 bp, Artificial sequence
  Synthetic oligonucleotide
cgcctcggctaccgacgaacggagc

SEQ ID NO: 704574 - DNA, 25 bp, Artificial sequence
  Synthetic oligonucleotide
ccgcctatgcgacggtccgtgggct

SEQ ID NO: 704575 - DNA, 25 bp, Artificial sequence
  Synthetic oligonucleotide
ccgcctatgcgagggtccgtgggct

SEQ ID NO: 704576 - DNA, 25 bp, Artificial sequence
  Synthetic oligonucleotide
acggcggtcgtgtgtcggcggtacc

SEQ ID NO: 704577 - DNA, 25 bp, Artificial sequence
  Synthetic oligonucleotide
acggcggtcgtgagtcggcggtacc

SEQ ID NO: 704578 - DNA, 25 bp, Artificial sequence
  Synthetic oligonucleotide
gtggcgcgcgcctagacatggccac

SEQ ID NO: 704579 - DNA, 25 bp, Artificial sequence
  Synthetic oligonucleotide
gtggcgcgcgccaagacatggccac

SEQ ID NO: 704580 - DNA, 25 bp, Artificial sequence
  Synthetic oligonucleotide
ccggggcgacccctgtacgcgatct

SEQ ID NO: 704581 - DNA, 25 bp, Artificial sequence
  Synthetic oligonucleotide
ccggggcgacccgtgtacgcgatct

SEQ ID NO: 704582 - DNA, 25 bp, Artificial sequence
  Synthetic oligonucleotide
ccagggcgcaagatacccggcgcga

SEQ ID NO: 704583 - DNA, 25 bp, Artificial sequence
  Synthetic oligonucleotide
ggaggcgtaggagggcgcagcaacc

SEQ ID NO: 704584 - DNA, 25 bp, Artificial sequence
  Synthetic oligonucleotide
gtgacccgcggtgggatacggccgt

SEQ ID NO: 704585 - DNA, 25 bp, Artificial sequence
  Synthetic oligonucleotide
ggccgagcggtcgactcgtcagctc

SEQ ID NO: 704586 - DNA, 25 bp, Artificial sequence
  Synthetic oligonucleotide
cagacgggacgggctacgcgggagt

SEQ ID NO: 704587 - DNA, 25 bp, Artificial sequence
  Synthetic oligonucleotide
gtcggcgtaacggccgaccctcgac

SEQ ID NO: 704588 - DNA, 25 bp, Artificial sequence
  Synthetic oligonucleotide
cccctggcgttagggctcgtcggac

SEQ ID NO: 704589 - DNA, 25 bp, Artificial sequence
  Synthetic oligonucleotide
agccgaggtacgcccggatgaccgc

SEQ ID NO: 704590 - DNA, 25 bp, Artificial sequence
  Synthetic oligonucleotide
agccgaggtacggccggatgaccgc

SEQ ID NO: 704591 - DNA, 25 bp, Artificial sequence
  Synthetic oligonucleotide
cggccgccgaacatgcgcgctcaag

SEQ ID NO: 704592 - DNA, 25 bp, Artificial sequence
  Synthetic oligonucleotide
cggccgccgaacttgcgcgctcaag

SEQ ID NO: 704593 - DNA, 25 bp, Artificial sequence
  Synthetic oligonucleotide
tgcgggacgacgcagcgtactcccc

SEQ ID NO: 704594 - DNA, 25 bp, Artificial sequence
  Synthetic oligonucleotide
tgcgggacgacggagcgtactcccc

SEQ ID NO: 704595 - DNA, 25 bp, Artificial sequence
  Synthetic oligonucleotide
cggccacccgtagggcatagtcccc

SEQ ID NO: 704596 - DNA, 25 bp, Artificial sequence
  Synthetic oligonucleotide
ggggacaggcgcgttacggctgcag

SEQ ID NO: 704597 - DNA, 25 bp, Artificial sequence
  Synthetic oligonucleotide
cggccacccgtacggcatagtcccc

SEQ ID NO: 704598 - DNA, 25 bp, Artificial sequence
  Synthetic oligonucleotide
gtgacccgcggtcggatacggccgt

SEQ ID NO: 704599 - DNA, 25 bp, Artificial sequence
  Synthetic oligonucleotide
caggtctagtaccgtcgccgccccg

SEQ ID NO: 704600 - DNA, 25 bp, Artificial sequence
  Synthetic oligonucleotide
caggtctagtacggtcgccgccccg

SEQ ID NO: 704601 - DNA, 25 bp, Artificial sequence
  Synthetic oligonucleotide
gggagcgcgaccgcgattgcacagg

SEQ ID NO: 704602 - DNA, 25 bp, Artificial sequence
  Synthetic oligonucleotide
gggagcgcgaccccgattgcacagg

SEQ ID NO: 704603 - DNA, 25 bp, Artificial sequence
  Synthetic oligonucleotide
tccccgagacgcgcggtcgtcagag

SEQ ID NO: 704604 - DNA, 25 bp, Artificial sequence
  Synthetic oligonucleotide
tccccgagacgcccggtcgtcagag

SEQ ID NO: 704605 - DNA, 25 bp, Artificial sequence
  Synthetic oligonucleotide
gttccctagcgcctacgctccgccc

SEQ ID NO: 704606 - DNA, 25 bp, Artificial sequence
  Synthetic oligonucleotide
gttccctagcgcgtacgctccgccc

SEQ ID NO: 704607 - DNA, 25 bp, Artificial sequence
  Synthetic oligonucleotide
cccagcgtacgcgacgacctggtcc

SEQ ID NO: 704608 - DNA, 25 bp, Artificial sequence
  Synthetic oligonucleotide
ggggacaggcgccttacggctgcag

SEQ ID NO: 704609 - DNA, 25 bp, Artificial sequence
  Synthetic oligonucleotide
ggggctgtcgacacgacccagtccg

SEQ ID NO: 704610 - DNA, 25 bp, Artificial sequence
  Synthetic oligonucleotide
cgcgcggcgcggtcttacgtatccc

SEQ ID NO: 704611 - DNA, 25 bp, Artificial sequence
  Synthetic oligonucleotide
gagcccccgcggacgtagaccgctt

SEQ ID NO: 704612 - DNA, 25 bp, Artificial sequence
  Synthetic oligonucleotide
gagcccccgcggtcgtagaccgctt

SEQ ID NO: 704613 - DNA, 25 bp, Artificial sequence
  Synthetic oligonucleotide
caacggcgtgcgtcgtaggctcggg

SEQ ID NO: 704614 - DNA, 25 bp, Artificial sequence
  Synthetic oligonucleotide
caacggcgtgcgacgtaggctcggg

SEQ ID NO: 704615 - DNA, 25 bp, Artificial sequence
  Synthetic oligonucleotide
cggtcctaatcgaggcgcggcccgt

SEQ ID NO: 704616 - DNA, 25 bp, Artificial sequence
  Synthetic oligonucleotide
cggtcctaatcgtggcgcggcccgt

SEQ ID NO: 704617 - DNA, 25 bp, Artificial sequence
  Synthetic oligonucleotide
accgctgatacgcgcgggacccagg

SEQ ID NO: 704618 - DNA, 25 bp, Artificial sequence
  Synthetic oligonucleotide
accgctgatacgggcgggacccagg

SEQ ID NO: 704619 - DNA, 25 bp, Artificial sequence
  Synthetic oligonucleotide
ccgcacccgcgtagacgtacagccg

SEQ ID NO: 704620 - DNA, 25 bp, Artificial sequence
  Synthetic oligonucleotide
cgcgcggcgcggacttacgtatccc

SEQ ID NO: 704621 - DNA, 25 bp, Artificial sequence
  Synthetic oligonucleotide
ggggctgtcgactcgacccagtccg

SEQ ID NO: 704622 - DNA, 25 bp, Artificial sequence
  Synthetic oligonucleotide
tccagccgcggtaagctcgcacgcc

SEQ ID NO: 704623 - DNA, 25 bp, Artificial sequence
  Synthetic oligonucleotide
gcgagatagggccgcaacggccggt

SEQ ID NO: 704624 - DNA, 25 bp, Artificial sequence
  Synthetic oligonucleotide
gcgagatagggcggcaacggccggt

SEQ ID NO: 704625 - DNA, 25 bp, Artificial sequence
  Synthetic oligonucleotide
cggctagttgacccgaggtggcccg

SEQ ID NO: 704626 - DNA, 25 bp, Artificial sequence
  Synthetic oligonucleotide
cggctagttgacgcgaggtggcccg

SEQ ID NO: 704627 - DNA, 25 bp, Artificial sequence
  Synthetic oligonucleotide
gccagccgtcgccgagctagtcgct

SEQ ID NO: 704628 - DNA, 25 bp, Artificial sequence
  Synthetic oligonucleotide
gccagccgtcgcggagctagtcgct

SEQ ID NO: 704629 - DNA, 25 bp, Artificial sequence
  Synthetic oligonucleotide
caccgcacgtgcggctatctggccc

SEQ ID NO: 704630 - DNA, 25 bp, Artificial sequence
  Synthetic oligonucleotide
caccgcacgtgccgctatctggccc

SEQ ID NO: 704631 - DNA, 25 bp, Artificial sequence
  Synthetic oligonucleotide
tccagccgcggttagctcgcacgcc

SEQ ID NO: 704632 - DNA, 25 bp, Artificial sequence
  Synthetic oligonucleotide
acgcgccgatactcgtcggccgggt

SEQ ID NO: 704633 - DNA, 25 bp, Artificial sequence
  Synthetic oligonucleotide
gtcggcgtaacgcccgaccctcgac

SEQ ID NO: 704634 - DNA, 25 bp, Artificial sequence
  Synthetic oligonucleotide
ccgcacccgcgttgacgtacagccg

SEQ ID NO: 704635 - DNA, 25 bp, Artificial sequence
  Synthetic oligonucleotide
cgctgggagcgtacgcgactctcgc

SEQ ID NO: 704636 - DNA, 25 bp, Artificial sequence
  Synthetic oligonucleotide
tggcccattggccggcgtccggatc

SEQ ID NO: 704637 - DNA, 25 bp, Artificial sequence
  Synthetic oligonucleotide
tggcccattggcgggcgtccggatc

SEQ ID NO: 704638 - DNA, 25 bp, Artificial sequence
  Synthetic oligonucleotide
cgctgggagcgttcgcgactctcgc

SEQ ID NO: 704639 - DNA, 25 bp, Artificial sequence
  Synthetic oligonucleotide
gagcaccccgatggtacgggacgcg

SEQ ID NO: 704640 - DNA, 25 bp, Artificial sequence
  Synthetic oligonucleotide
gagcaccccgatcgtacgggacgcg

SEQ ID NO: 704641 - DNA, 25 bp, Artificial sequence
  Synthetic oligonucleotide
acgcggatcgcgtaggcggggcagt

SEQ ID NO: 704642 - DNA, 25 bp, Artificial sequence
  Synthetic oligonucleotide
acgcggatcgcgaaggcggggcagt

SEQ ID NO: 704643 - DNA, 25 bp, Artificial sequence
  Synthetic oligonucleotide
cggaggcccgtatcgcgcatgctgg

SEQ ID NO: 704644 - DNA, 25 bp, Artificial sequence
  Synthetic oligonucleotide
cggaggcccgtaacgcgcatgctgg

SEQ ID NO: 704645 - DNA, 25 bp, Artificial sequence
  Synthetic oligonucleotide
gggcgctgtaggggcgctagtctgc

SEQ ID NO: 704646 - DNA, 25 bp, Artificial sequence
  Synthetic oligonucleotide
gggcgctgtaggcgcgctagtctgc

SEQ ID NO: 704647 - DNA, 25 bp, Artificial sequence
  Synthetic oligonucleotide
ccccgttatcgcgctccgagcccgt

SEQ ID NO: 704648 - DNA, 25 bp, Artificial sequence
  Synthetic oligonucleotide
accgcgcgggccgtagtaagcctgg

SEQ ID NO: 704649 - DNA, 25 bp, Artificial sequence
  Synthetic oligonucleotide
cgtacggcgcgtaaccgaccgagcc

SEQ ID NO: 704650 - DNA, 25 bp, Artificial sequence
  Synthetic oligonucleotide
ggccggtatgcgcattcgcgtcccg

SEQ ID NO: 704651 - DNA, 25 bp, Artificial sequence
  Synthetic oligonucleotide
accgcgcgggccctagtaagcctgg

SEQ ID NO: 704652 - DNA, 25 bp, Artificial sequence
  Synthetic oligonucleotide
ccccgttatcgccctccgagcccgt

SEQ ID NO: 704653 - DNA, 25 bp, Artificial sequence
  Synthetic oligonucleotide
agggcggactactcgcgatgccggc

SEQ ID NO: 704654 - DNA, 25 bp, Artificial sequence
  Synthetic oligonucleotide
agggcggactacacgcgatgccggc

SEQ ID NO: 704655 - DNA, 25 bp, Artificial sequence
  Synthetic oligonucleotide
cggcgcgctacgcgggtattcccac

SEQ ID NO: 704656 - DNA, 25 bp, Artificial sequence
  Synthetic oligonucleotide
cggcgcgctacgggggtattcccac

SEQ ID NO: 704657 - DNA, 25 bp, Artificial sequence
  Synthetic oligonucleotide
cgtacggcgcgttaccgaccgagcc

SEQ ID NO: 704658 - DNA, 25 bp, Artificial sequence
  Synthetic oligonucleotide
ggccggtatgcggattcgcgtcccg

SEQ ID NO: 704659 - DNA, 25 bp, Artificial sequence
  Synthetic oligonucleotide
ttcggcgcgtacgtctcggcggccc

SEQ ID NO: 704660 - DNA, 25 bp, Artificial sequence
  Synthetic oligonucleotide
cctggccacggcatcgcgacggcga

SEQ ID NO: 704661 - DNA, 25 bp, Artificial sequence
  Synthetic oligonucleotide
cctggccacggcttcgcgacggcga

SEQ ID NO: 704662 - DNA, 25 bp, Artificial sequence
  Synthetic oligonucleotide
agggcctcggtccactcgcgccagc

SEQ ID NO: 704663 - DNA, 25 bp, Artificial sequence
  Synthetic oligonucleotide
agggcctcggtcgactcgcgccagc

SEQ ID NO: 704664 - DNA, 25 bp, Artificial sequence
  Synthetic oligonucleotide
cctgccccccgttcgtcgcagagcc

SEQ ID NO: 704665 - DNA, 25 bp, Artificial sequence
  Synthetic oligonucleotide
cctgccccccgtacgtcgcagagcc

SEQ ID NO: 704666 - DNA, 25 bp, Artificial sequence
  Synthetic oligonucleotide
tgctggcgctcgcgttacggccgcg

SEQ ID NO: 704667 - DNA, 25 bp, Artificial sequence
  Synthetic oligonucleotide
cgtgcgtccgcgtcgttcggcggct

SEQ ID NO: 704668 - DNA, 25 bp, Artificial sequence
  Synthetic oligonucleotide
gggccgcggcgcacgctaactcgct

SEQ ID NO: 704669 - DNA, 25 bp, Artificial sequence
  Synthetic oligonucleotide
cgtgcgtccgcgacgttcggcggct

SEQ ID NO: 704670 - DNA, 25 bp, Artificial sequence
  Synthetic oligonucleotide
tgctggcgctcgggttacggccgcg

SEQ ID NO: 704671 - DNA, 25 bp, Artificial sequence
  Synthetic oligonucleotide
ttcggcgcgtacctctcggcggccc

SEQ ID NO: 704672 - DNA, 25 bp, Artificial sequence
  Synthetic oligonucleotide
acctgcccccgtatcgccggcgcag

SEQ ID NO: 704673 - DNA, 25 bp, Artificial sequence
  Synthetic oligonucleotide
acctgcccccgtttcgccggcgcag

SEQ ID NO: 704674 - DNA, 25 bp, Artificial sequence
  Synthetic oligonucleotide
gcacggagcgcgcactacgcgggac

SEQ ID NO: 704675 - DNA, 25 bp, Artificial sequence
  Synthetic oligonucleotide
gaggacccggcggtagtcgccaccc

SEQ ID NO: 704676 - DNA, 25 bp, Artificial sequence
  Synthetic oligonucleotide
gggccgcggcgctcgctaactcgct

SEQ ID NO: 704677 - DNA, 25 bp, Artificial sequence
  Synthetic oligonucleotide
acggtgctaacccgcgcgtcgccgc

SEQ ID NO: 704678 - DNA, 25 bp, Artificial sequence
  Synthetic oligonucleotide
acggtgctaaccggcgcgtcgccgc

SEQ ID NO: 704679 - DNA, 25 bp, Artificial sequence
  Synthetic oligonucleotide
gccaggggtaccctcgagcccgacc

SEQ ID NO: 704680 - DNA, 25 bp, Artificial sequence
  Synthetic oligonucleotide
cgccggccgtacgcgtctggtgcca

SEQ ID NO: 704681 - DNA, 25 bp, Artificial sequence
  Synthetic oligonucleotide
gcacggagcgcggactacgcgggac

SEQ ID NO: 704682 - DNA, 25 bp, Artificial sequence
  Synthetic oligonucleotide
gaggacccggcgctagtcgccaccc

SEQ ID NO: 704683 - DNA, 25 bp, Artificial sequence
  Synthetic oligonucleotide
cgccggccgtacccgtctggtgcca

SEQ ID NO: 704684 - DNA, 25 bp, Artificial sequence
  Synthetic oligonucleotide
ggcgtgtacccgccgcgatgccgtg

SEQ ID NO: 704685 - DNA, 25 bp, Artificial sequence
  Synthetic oligonucleotide
tcggtgccaggcgtacgacccccgg

SEQ ID NO: 704686 - DNA, 25 bp, Artificial sequence
  Synthetic oligonucleotide
tcggtgccaggcctacgacccccgg

SEQ ID NO: 704687 - DNA, 25 bp, Artificial sequence
  Synthetic oligonucleotide
tcgggagttcgaccgcgcgggtcgc

SEQ ID NO: 704688 - DNA, 25 bp, Artificial sequence
  Synthetic oligonucleotide
tcgggagttcgagcgcgcgggtcgc

SEQ ID NO: 704689 - DNA, 25 bp, Artificial sequence
  Synthetic oligonucleotide
cgggagcgcgatagaacgcgcggcc

SEQ ID NO: 704690 - DNA, 25 bp, Artificial sequence
  Synthetic oligonucleotide
cgggagcgcgattgaacgcgcggcc

SEQ ID NO: 704691 - DNA, 25 bp, Artificial sequence
  Synthetic oligonucleotide
cccgagcgagtagccgcgaccctcg

SEQ ID NO: 704692 - DNA, 25 bp, Artificial sequence
  Synthetic oligonucleotide
cccgagcgagtacccgcgaccctcg

SEQ ID NO: 704693 - DNA, 25 bp, Artificial sequence
  Synthetic oligonucleotide
caccgtcgtgcgcgatagggggggg

SEQ ID NO: 704694 - DNA, 25 bp, Artificial sequence
  Synthetic oligonucleotide
gcatgcggcgtcgaacgctcgggcc

SEQ ID NO: 704695 - DNA, 25 bp, Artificial sequence
  Synthetic oligonucleotide
gcggcgggtaccgatacgccagcgg

SEQ ID NO: 704696 - DNA, 25 bp, Artificial sequence
  Synthetic oligonucleotide
gccaggggtaccgtcgagcccgacc

SEQ ID NO: 704697 - DNA, 25 bp, Artificial sequence
  Synthetic oligonucleotide
ggcgtgtacccggcgcgatgccgtg

SEQ ID NO: 704698 - DNA, 25 bp, Artificial sequence
  Synthetic oligonucleotide
gcatgcggcgtccaacgctcgggcc

SEQ ID NO: 704699 - DNA, 25 bp, Artificial sequence
  Synthetic oligonucleotide
ccccgcctgcgacgcacgaccgaag

SEQ ID NO: 704700 - DNA, 25 bp, Artificial sequence
  Synthetic oligonucleotide
ccccgcctgcgaggcacgaccgaag

SEQ ID NO: 704701 - DNA, 25 bp, Artificial sequence
  Synthetic oligonucleotide
cggacgcggtcggtacggaccctgc

SEQ ID NO: 704702 - DNA, 25 bp, Artificial sequence
  Synthetic oligonucleotide
cggacgcggtcgctacggaccctgc

SEQ ID NO: 704703 - DNA, 25 bp, Artificial sequence
  Synthetic oligonucleotide
ccgggtcccggtacgtcgcagctgg

SEQ ID NO: 704704 - DNA, 25 bp, Artificial sequence
  Synthetic oligonucleotide
ccgggtcccggttcgtcgcagctgg

SEQ ID NO: 704705 - DNA, 25 bp, Artificial sequence
  Synthetic oligonucleotide
cccgggtctcgacgtgcgacgtgcg

SEQ ID NO: 704706 - DNA, 25 bp, Artificial sequence
  Synthetic oligonucleotide
cccgggtctcgaggtgcgacgtgcg

SEQ ID NO: 704707 - DNA, 25 bp, Artificial sequence
  Synthetic oligonucleotide
caccgtcgtgcgggatagggggggg

SEQ ID NO: 704708 - DNA, 25 bp, Artificial sequence
  Synthetic oligonucleotide
cagctcgccgggaacgcgtgtgcgg

SEQ ID NO: 704709 - DNA, 25 bp, Artificial sequence
  Synthetic oligonucleotide
ggcgacggtccgacgtacgtggcgc

SEQ ID NO: 704710 - DNA, 25 bp, Artificial sequence
  Synthetic oligonucleotide
cccaatgcgaccccctacgccgggc

SEQ ID NO: 704711 - DNA, 25 bp, Artificial sequence
  Synthetic oligonucleotide
cccaatgcgaccgcctacgccgggc

SEQ ID NO: 704712 - DNA, 25 bp, Artificial sequence
  Synthetic oligonucleotide
cgctcgctacgagcggtgccagggc

SEQ ID NO: 704713 - DNA, 25 bp, Artificial sequence
  Synthetic oligonucleotide
cgctcgctacgaccggtgccagggc

SEQ ID NO: 704714 - DNA, 25 bp, Artificial sequence
  Synthetic oligonucleotide
cccagcgcgtgccgctcgttagggc

SEQ ID NO: 704715 - DNA, 25 bp, Artificial sequence
  Synthetic oligonucleotide
cccagcgcgtgcggctcgttagggc

SEQ ID NO: 704716 - DNA, 25 bp, Artificial sequence
  Synthetic oligonucleotide
cccccggcgtatcccctcgcgctac

SEQ ID NO: 704717 - DNA, 25 bp, Artificial sequence
  Synthetic oligonucleotide
cccccggcgtatgccctcgcgctac

SEQ ID NO: 704718 - DNA, 25 bp, Artificial sequence
  Synthetic oligonucleotide
gggcgctcgtccgcgaacctcggag

SEQ ID NO: 704719 - DNA, 25 bp, Artificial sequence
  Synthetic oligonucleotide
ctcgggccggacccgctatcgggac

SEQ ID NO: 704720 - DNA, 25 bp, Artificial sequence
  Synthetic oligonucleotide
cagctcgccgggtacgcgtgtgcgg

SEQ ID NO: 704721 - DNA, 25 bp, Artificial sequence
  Synthetic oligonucleotide
tcgaggcgacgccaagcgctccccc

SEQ ID NO: 704722 - DNA, 25 bp, Artificial sequence
  Synthetic oligonucleotide
tgcccggctagcgcgacgcgacggt

SEQ ID NO: 704723 - DNA, 25 bp, Artificial sequence
  Synthetic oligonucleotide
tgcccggctagcccgacgcgacggt

SEQ ID NO: 704724 - DNA, 25 bp, Artificial sequence
  Synthetic oligonucleotide
gcagctgtcggactagcggcccccc

SEQ ID NO: 704725 - DNA, 25 bp, Artificial sequence
  Synthetic oligonucleotide
gcagctgtcggagtagcggcccccc

SEQ ID NO: 704726 - DNA, 25 bp, Artificial sequence
  Synthetic oligonucleotide
ccgggcggcgtaaaggcgccatgcg

SEQ ID NO: 704727 - DNA, 25 bp, Artificial sequence
  Synthetic oligonucleotide
ccgggcggcgtataggcgccatgcg

SEQ ID NO: 704728 - DNA, 25 bp, Artificial sequence
  Synthetic oligonucleotide
ggcgacggtccgtcgtacgtggcgc

SEQ ID NO: 704729 - DNA, 25 bp, Artificial sequence
  Synthetic oligonucleotide
caggcgccgttatcgcccggtgccc

SEQ ID NO: 704730 - DNA, 25 bp, Artificial sequence
  Synthetic oligonucleotide
caggcgccgttaacgcccggtgccc

SEQ ID NO: 704731 - DNA, 25 bp, Artificial sequence
  Synthetic oligonucleotide
agggccatcggttgcgcgcggtcgg

SEQ ID NO: 704732 - DNA, 25 bp, Artificial sequence
  Synthetic oligonucleotide
gggcgctcgtccccgaacctcggag

SEQ ID NO: 704733 - DNA, 25 bp, Artificial sequence
  Synthetic oligonucleotide
agctcgtcgtgaggcggccggaggc

SEQ ID NO: 704734 - DNA, 25 bp, Artificial sequence
  Synthetic oligonucleotide
gcgcgcacccccctcggacggcatt

SEQ ID NO: 704735 - DNA, 25 bp, Artificial sequence
  Synthetic oligonucleotide
gcgcgcacccccgtcggacggcatt

SEQ ID NO: 704736 - DNA, 25 bp, Artificial sequence
  Synthetic oligonucleotide
ccccgctgtatcgcgcgaggccgag

SEQ ID NO: 704737 - DNA, 25 bp, Artificial sequence
  Synthetic oligonucleotide
ccccgctgtatcccgcgaggccgag

SEQ ID NO: 704738 - DNA, 25 bp, Artificial sequence
  Synthetic oligonucleotide
cgacgccgacgccctaccggtccac

SEQ ID NO: 704739 - DNA, 25 bp, Artificial sequence
  Synthetic oligonucleotide
cgacgccgacgcgctaccggtccac

SEQ ID NO: 704740 - DNA, 25 bp, Artificial sequence
  Synthetic oligonucleotide
gcggggcgcgaaggcatggtacgcg

SEQ ID NO: 704741 - DNA, 25 bp, Artificial sequence
  Synthetic oligonucleotide
gcggggcgcgaacgcatggtacgcg

SEQ ID NO: 704742 - DNA, 25 bp, Artificial sequence
  Synthetic oligonucleotide
gaaggccgtacggacccgcgctggc

SEQ ID NO: 704743 - DNA, 25 bp, Artificial sequence
  Synthetic oligonucleotide
gaaggccgtacgcacccgcgctggc

SEQ ID NO: 704744 - DNA, 25 bp, Artificial sequence
  Synthetic oligonucleotide
ctcgggccggacgcgctatcgggac

SEQ ID NO: 704745 - DNA, 25 bp, Artificial sequence
  Synthetic oligonucleotide
cgcggccccatatcggccgatccgg

SEQ ID NO: 704746 - DNA, 25 bp, Artificial sequence
  Synthetic oligonucleotide
gcggcgggtacccatacgccagcgg

SEQ ID NO: 704747 - DNA, 25 bp, Artificial sequence
  Synthetic oligonucleotide
agctcgtcgtgacgcggccggaggc

SEQ ID NO: 704748 - DNA, 25 bp, Artificial sequence
  Synthetic oligonucleotide
cggcgtactatcgcgggggccaccc

SEQ ID NO: 704749 - DNA, 25 bp, Artificial sequence
  Synthetic oligonucleotide
cggcgtactatcccgggggccaccc

SEQ ID NO: 704750 - DNA, 25 bp, Artificial sequence
  Synthetic oligonucleotide
ctcgcctcgccccgctacacgggtc

SEQ ID NO: 704751 - DNA, 25 bp, Artificial sequence
  Synthetic oligonucleotide
ctcgcctcgcccggctacacgggtc

SEQ ID NO: 704752 - DNA, 25 bp, Artificial sequence
  Synthetic oligonucleotide
ccgctcgacgggtcgcgcatgcctg

SEQ ID NO: 704753 - DNA, 25 bp, Artificial sequence
  Synthetic oligonucleotide
ccgctcgacgggacgcgcatgcctg

SEQ ID NO: 704754 - DNA, 25 bp, Artificial sequence
  Synthetic oligonucleotide
ggtcggcgtaagacgcgacgcggcc

SEQ ID NO: 704755 - DNA, 25 bp, Artificial sequence
  Synthetic oligonucleotide
ggtcggcgtaagtcgcgacgcggcc

SEQ ID NO: 704756 - DNA, 25 bp, Artificial sequence
  Synthetic oligonucleotide
tcgaggcgacgcgaagcgctccccc

SEQ ID NO: 704757 - DNA, 25 bp, Artificial sequence
  Synthetic oligonucleotide
cgcggccccataacggccgatccgg

SEQ ID NO: 704758 - DNA, 25 bp, Artificial sequence
  Synthetic oligonucleotide
gcgggggatcgttcacgcggcggtc

SEQ ID NO: 704759 - DNA, 25 bp, Artificial sequence
  Synthetic oligonucleotide
gggctaacctcgcgtcgggcgtccg

SEQ ID NO: 704760 - DNA, 25 bp, Artificial sequence
  Synthetic oligonucleotide
gcggtagaccggccgtacgcgggtc

SEQ ID NO: 704761 - DNA, 25 bp, Artificial sequence
  Synthetic oligonucleotide
gcggtagaccgggcgtacgcgggtc

SEQ ID NO: 704762 - DNA, 25 bp, Artificial sequence
  Synthetic oligonucleotide
cgcccggtcgtacgccccgcgagta

SEQ ID NO: 704763 - DNA, 25 bp, Artificial sequence
  Synthetic oligonucleotide
cgcccggtcgtaggccccgcgagta

SEQ ID NO: 704764 - DNA, 25 bp, Artificial sequence
  Synthetic oligonucleotide
gggggaggaccgttgcgtcacgcgg

SEQ ID NO: 704765 - DNA, 25 bp, Artificial sequence
  Synthetic oligonucleotide
gggggaggaccgatgcgtcacgcgg

SEQ ID NO: 704766 - DNA, 25 bp, Artificial sequence
  Synthetic oligonucleotide
ccgctctgcggtatccggcgcacgg

SEQ ID NO: 704767 - DNA, 25 bp, Artificial sequence
  Synthetic oligonucleotide
ccgctctgcggtttccggcgcacgg

SEQ ID NO: 704768 - DNA, 25 bp, Artificial sequence
  Synthetic oligonucleotide
cgcggcacgccgatacgcaggcctc

SEQ ID NO: 704769 - DNA, 25 bp, Artificial sequence
  Synthetic oligonucleotide
gctggagatagcgccgcgcgacccc

SEQ ID NO: 704770 - DNA, 25 bp, Artificial sequence
  Synthetic oligonucleotide
gcgggggatcgtacacgcggcggtc

SEQ ID NO: 704771 - DNA, 25 bp, Artificial sequence
  Synthetic oligonucleotide
cgcgcgctaaccggtccgatggccg

SEQ ID NO: 704772 - DNA, 25 bp, Artificial sequence
  Synthetic oligonucleotide
ggcacgcggccgctaaccgcgttcg

SEQ ID NO: 704773 - DNA, 25 bp, Artificial sequence
  Synthetic oligonucleotide
cgagccacggagggtcgaccagggg

SEQ ID NO: 704774 - DNA, 25 bp, Artificial sequence
  Synthetic oligonucleotide
cgagccacggagcgtcgaccagggg

SEQ ID NO: 704775 - DNA, 25 bp, Artificial sequence
  Synthetic oligonucleotide
accccagcgcgagacggtacgcggg

SEQ ID NO: 704776 - DNA, 25 bp, Artificial sequence
  Synthetic oligonucleotide
accccagcgcgacacggtacgcggg

SEQ ID NO: 704777 - DNA, 25 bp, Artificial sequence
  Synthetic oligonucleotide
gcggcgacgcgcggttaggcccact

SEQ ID NO: 704778 - DNA, 25 bp, Artificial sequence
  Synthetic oligonucleotide
gcggcgacgcgccgttaggcccact

SEQ ID NO: 704779 - DNA, 25 bp, Artificial sequence
  Synthetic oligonucleotide
cgggagccgagtacgtcgcctgcgc

SEQ ID NO: 704780 - DNA, 25 bp, Artificial sequence
  Synthetic oligonucleotide
cgggagccgagttcgtcgcctgcgc

SEQ ID NO: 704781 - DNA, 25 bp, Artificial sequence
  Synthetic oligonucleotide
gcgggcatccgcctagctcgacggg

SEQ ID NO: 704782 - DNA, 25 bp, Artificial sequence
  Synthetic oligonucleotide
cgcggcacgccgttacgcaggcctc

SEQ ID NO: 704783 - DNA, 25 bp, Artificial sequence
  Synthetic oligonucleotide
cacgcccgggtatacggccgcccga

SEQ ID NO: 704784 - DNA, 25 bp, Artificial sequence
  Synthetic oligonucleotide
cgcgacacccctgcgcgaagtcgcg

SEQ ID NO: 704785 - DNA, 25 bp, Artificial sequence
  Synthetic oligonucleotide
cggttgcccgaacttcgcggccgcc

SEQ ID NO: 704786 - DNA, 25 bp, Artificial sequence
  Synthetic oligonucleotide
ggcacgcggccggtaaccgcgttcg

SEQ ID NO: 704787 - DNA, 25 bp, Artificial sequence
  Synthetic oligonucleotide
gggctaacctcgggtcgggcgtccg

SEQ ID NO: 704788 - DNA, 25 bp, Artificial sequence
  Synthetic oligonucleotide
ccgccgccgcgcaagtacgccggat

SEQ ID NO: 704789 - DNA, 25 bp, Artificial sequence
  Synthetic oligonucleotide
ccgccgccgcgctagtacgccggat

SEQ ID NO: 704790 - DNA, 25 bp, Artificial sequence
  Synthetic oligonucleotide
cgcgcggcacgaccgcgaatggtgc

SEQ ID NO: 704791 - DNA, 25 bp, Artificial sequence
  Synthetic oligonucleotide
cgcgcggcacgagcgcgaatggtgc

SEQ ID NO: 704792 - DNA, 25 bp, Artificial sequence
  Synthetic oligonucleotide
gcgcttgtagcgggcaacgggccgg

SEQ ID NO: 704793 - DNA, 25 bp, Artificial sequence
  Synthetic oligonucleotide
gcgcttgtagcgcgcaacgggccgg

SEQ ID NO: 704794 - DNA, 25 bp, Artificial sequence
  Synthetic oligonucleotide
gctggagatagccccgcgcgacccc

SEQ ID NO: 704795 - DNA, 25 bp, Artificial sequence
  Synthetic oligonucleotide
gcgcggctaactccgtcggcggacc

SEQ ID NO: 704796 - DNA, 25 bp, Artificial sequence
  Synthetic oligonucleotide
cagcagctaccggggtcggccgtgc

SEQ ID NO: 704797 - DNA, 25 bp, Artificial sequence
  Synthetic oligonucleotide
cacgcccgggtaaacggccgcccga

SEQ ID NO: 704798 - DNA, 25 bp, Artificial sequence
  Synthetic oligonucleotide
cggcactagttcccgaccggcgcgc

SEQ ID NO: 704799 - DNA, 25 bp, Artificial sequence
  Synthetic oligonucleotide
cggcactagttcgcgaccggcgcgc

SEQ ID NO: 704800 - DNA, 25 bp, Artificial sequence
  Synthetic oligonucleotide
gcctacgcgtgcggaccgagccagc

SEQ ID NO: 704801 - DNA, 25 bp, Artificial sequence
  Synthetic oligonucleotide
gcctacgcgtgccgaccgagccagc

SEQ ID NO: 704802 - DNA, 25 bp, Artificial sequence
  Synthetic oligonucleotide
gcactgggtcggtcccgacggcgac

SEQ ID NO: 704803 - DNA, 25 bp, Artificial sequence
  Synthetic oligonucleotide
gcactgggtcggacccgacggcgac

SEQ ID NO: 704804 - DNA, 25 bp, Artificial sequence
  Synthetic oligonucleotide
ccccgccaactacgtcgcgccaggg

SEQ ID NO: 704805 - DNA, 25 bp, Artificial sequence
  Synthetic oligonucleotide
ccccgccaactaggtcgcgccaggg

SEQ ID NO: 704806 - DNA, 25 bp, Artificial sequence
  Synthetic oligonucleotide
cgcgcgctaacccgtccgatggccg

SEQ ID NO: 704807 - DNA, 25 bp, Artificial sequence
  Synthetic oligonucleotide
gcgcggctaactgcgtcggcggacc

SEQ ID NO: 704808 - DNA, 25 bp, Artificial sequence
  Synthetic oligonucleotide
acgggcgtcggccgatacggcgcgt

SEQ ID NO: 704809 - DNA, 25 bp, Artificial sequence
  Synthetic oligonucleotide
gcacgctacggagcggcgtctccgg

SEQ ID NO: 704810 - DNA, 25 bp, Artificial sequence
  Synthetic oligonucleotide
gcgccgcgcggtccgatagtccgca

SEQ ID NO: 704811 - DNA, 25 bp, Artificial sequence
  Synthetic oligonucleotide
gcgccgcgcggtgcgatagtccgca

SEQ ID NO: 704812 - DNA, 25 bp, Artificial sequence
  Synthetic oligonucleotide
ccgcctccgtcgcgagcttagggcc

SEQ ID NO: 704813 - DNA, 25 bp, Artificial sequence
  Synthetic oligonucleotide
ccgcctccgtcgggagcttagggcc

SEQ ID NO: 704814 - DNA, 25 bp, Artificial sequence
  Synthetic oligonucleotide
tgccgccgggtgggatacggacgcg

SEQ ID NO: 704815 - DNA, 25 bp, Artificial sequence
  Synthetic oligonucleotide
tgccgccgggtgcgatacggacgcg

SEQ ID NO: 704816 - DNA, 25 bp, Artificial sequence
  Synthetic oligonucleotide
tgccacggtcgcaaccggagcgcgg

SEQ ID NO: 704817 - DNA, 25 bp, Artificial sequence
  Synthetic oligonucleotide
tgccacggtcgctaccggagcgcgg

SEQ ID NO: 704818 - DNA, 25 bp, Artificial sequence
  Synthetic oligonucleotide
tcacgctgatcgcggtccgcccccc

SEQ ID NO: 704819 - DNA, 25 bp, Artificial sequence
  Synthetic oligonucleotide
gcgggcatccgcgtagctcgacggg

SEQ ID NO: 704820 - DNA, 25 bp, Artificial sequence
  Synthetic oligonucleotide
acgggcgtcggcggatacggcgcgt

SEQ ID NO: 704821 - DNA, 25 bp, Artificial sequence
  Synthetic oligonucleotide
ggggacgcgtcgcgtacagcggcca

SEQ ID NO: 704822 - DNA, 25 bp, Artificial sequence
  Synthetic oligonucleotide
gggccgccgtcgtacgacctgaccc

SEQ ID NO: 704823 - DNA, 25 bp, Artificial sequence
  Synthetic oligonucleotide
gggccgccgtcgaacgacctgaccc

SEQ ID NO: 704824 - DNA, 25 bp, Artificial sequence
  Synthetic oligonucleotide
ggggcgggcggcgtatcgtggtctg

SEQ ID NO: 704825 - DNA, 25 bp, Artificial sequence
  Synthetic oligonucleotide
ggggcgggcggcctatcgtggtctg

SEQ ID NO: 704826 - DNA, 25 bp, Artificial sequence
  Synthetic oligonucleotide
gcccgcacgcgtagcgggactgagg

SEQ ID NO: 704827 - DNA, 25 bp, Artificial sequence
  Synthetic oligonucleotide
gcccgcacgcgttgcgggactgagg

SEQ ID NO: 704828 - DNA, 25 bp, Artificial sequence
  Synthetic oligonucleotide
cccaccgggcattcgcgacccgagc

SEQ ID NO: 704829 - DNA, 25 bp, Artificial sequence
  Synthetic oligonucleotide
cccaccgggcatacgcgacccgagc

SEQ ID NO: 704830 - DNA, 25 bp, Artificial sequence
  Synthetic oligonucleotide
agcgggcgcgcgcactatgcggcga

SEQ ID NO: 704831 - DNA, 25 bp, Artificial sequence
  Synthetic oligonucleotide
agcgggcgcgcggactatgcggcga

SEQ ID NO: 704832 - DNA, 25 bp, Artificial sequence
  Synthetic oligonucleotide
tcacgctgatcggggtccgcccccc

SEQ ID NO: 704833 - DNA, 25 bp, Artificial sequence
  Synthetic oligonucleotide
cccgggcgcgacgcgcgataccttg

SEQ ID NO: 704834 - DNA, 25 bp, Artificial sequence
  Synthetic oligonucleotide
agggccatcggtagcgcgcggtcgg

SEQ ID NO: 704835 - DNA, 25 bp, Artificial sequence
  Synthetic oligonucleotide
ccgcgttcgcgtacgcccaccccac

SEQ ID NO: 704836 - DNA, 25 bp, Artificial sequence
  Synthetic oligonucleotide
ccgcgttcgcgttcgcccaccccac

SEQ ID NO: 704837 - DNA, 25 bp, Artificial sequence
  Synthetic oligonucleotide
ggcggataccggaacgcgctgggcc

SEQ ID NO: 704838 - DNA, 25 bp, Artificial sequence
  Synthetic oligonucleotide
ggcggataccggtacgcgctgggcc

SEQ ID NO: 704839 - DNA, 25 bp, Artificial sequence
  Synthetic oligonucleotide
ggccgacggtagttcgcgcggtccg

SEQ ID NO: 704840 - DNA, 25 bp, Artificial sequence
  Synthetic oligonucleotide
ggccgacggtagatcgcgcggtccg

SEQ ID NO: 704841 - DNA, 25 bp, Artificial sequence
  Synthetic oligonucleotide
cgggaccccggcgcgcatactgtcc

SEQ ID NO: 704842 - DNA, 25 bp, Artificial sequence
  Synthetic oligonucleotide
cgggaccccggcccgcatactgtcc

SEQ ID NO: 704843 - DNA, 25 bp, Artificial sequence
  Synthetic oligonucleotide
cagaggcggggttccaacgccgcgc

SEQ ID NO: 704844 - DNA, 25 bp, Artificial sequence
  Synthetic oligonucleotide
gcacgctacggaccggcgtctccgg

SEQ ID NO: 704845 - DNA, 25 bp, Artificial sequence
  Synthetic oligonucleotide
cccgggcgcgacccgcgataccttg

SEQ ID NO: 704846 - DNA, 25 bp, Artificial sequence
  Synthetic oligonucleotide
ggggacgcgtcgggtacagcggcca

SEQ ID NO: 704847 - DNA, 25 bp, Artificial sequence
  Synthetic oligonucleotide
cccgagccggtgcgactcgccgact

SEQ ID NO: 704848 - DNA, 25 bp, Artificial sequence
  Synthetic oligonucleotide
cccgagccggtgggactcgccgact

SEQ ID NO: 704849 - DNA, 25 bp, Artificial sequence
  Synthetic oligonucleotide
ggccgggccgcgacacgttcctgac

SEQ ID NO: 704850 - DNA, 25 bp, Artificial sequence
  Synthetic oligonucleotide
ggccgggccgcgtcacgttcctgac

SEQ ID NO: 704851 - DNA, 25 bp, Artificial sequence
  Synthetic oligonucleotide
cccccccgcctagcggtcgatagcc

SEQ ID NO: 704852 - DNA, 25 bp, Artificial sequence
  Synthetic oligonucleotide
cccccccgcctaccggtcgatagcc

SEQ ID NO: 704853 - DNA, 25 bp, Artificial sequence
  Synthetic oligonucleotide
agggcgacgagtccgcgtgcccctg

SEQ ID NO: 704854 - DNA, 25 bp, Artificial sequence
  Synthetic oligonucleotide
agggcgacgagtgcgcgtgcccctg

SEQ ID NO: 704855 - DNA, 25 bp, Artificial sequence
  Synthetic oligonucleotide
cgatcggtgcgttcccccgcccagg

SEQ ID NO: 704856 - DNA, 25 bp, Artificial sequence
  Synthetic oligonucleotide
cgatcggtgcgtacccccgcccagg

SEQ ID NO: 704857 - DNA, 25 bp, Artificial sequence
  Synthetic oligonucleotide
cagcagctaccgcggtcggccgtgc

SEQ ID NO: 704858 - DNA, 25 bp, Artificial sequence
  Synthetic oligonucleotide
cagaggcggggtaccaacgccgcgc

SEQ ID NO: 704859 - DNA, 25 bp, Artificial sequence
  Synthetic oligonucleotide
gggccgtcgcgggataagggcaccg

SEQ ID NO: 704860 - DNA, 25 bp, Artificial sequence
  Synthetic oligonucleotide
cctgcgccgctacggcggtcttccc

SEQ ID NO: 704861 - DNA, 25 bp, Artificial sequence
  Synthetic oligonucleotide
gacggcgcggggtacgtcgacacgg

SEQ ID NO: 704862 - DNA, 25 bp, Artificial sequence
  Synthetic oligonucleotide
gacggcgcggggaacgtcgacacgg

SEQ ID NO: 704863 - DNA, 25 bp, Artificial sequence
  Synthetic oligonucleotide
cttcgcggctcgtacggcgggctgc

SEQ ID NO: 704864 - DNA, 25 bp, Artificial sequence
  Synthetic oligonucleotide
cttcgcggctcgaacggcgggctgc

SEQ ID NO: 704865 - DNA, 25 bp, Artificial sequence
  Synthetic oligonucleotide
gcggcgactacgggccggtgcgatc

SEQ ID NO: 704866 - DNA, 25 bp, Artificial sequence
  Synthetic oligonucleotide
gcggcgactacgcgccggtgcgatc

SEQ ID NO: 704867 - DNA, 25 bp, Artificial sequence
  Synthetic oligonucleotide
gcgtgcatcgatccgcggtggcggc

SEQ ID NO: 704868 - DNA, 25 bp, Artificial sequence
  Synthetic oligonucleotide
gcgtgcatcgatgcgcggtggcggc

SEQ ID NO: 704869 - DNA, 25 bp, Artificial sequence
  Synthetic oligonucleotide
gaggaggcgcaaacggacgggcccc

SEQ ID NO: 704870 - DNA, 25 bp, Artificial sequence
  Synthetic oligonucleotide
cctctccgtgcgaccggttgggggc

SEQ ID NO: 704871 - DNA, 25 bp, Artificial sequence
  Synthetic oligonucleotide
gggccgtcgcggcataagggcaccg

SEQ ID NO: 704872 - DNA, 25 bp, Artificial sequence
  Synthetic oligonucleotide
ggcgtgtcggcgttacgccgtggcc

SEQ ID NO: 704873 - DNA, 25 bp, Artificial sequence
  Synthetic oligonucleotide
ccccgcctacgcctcgcgggaacga

SEQ ID NO: 704874 - DNA, 25 bp, Artificial sequence
  Synthetic oligonucleotide
ccccgcctacgcgtcgcgggaacga

SEQ ID NO: 704875 - DNA, 25 bp, Artificial sequence
  Synthetic oligonucleotide
cgacggtccgcgacgggcaggtcgt

SEQ ID NO: 704876 - DNA, 25 bp, Artificial sequence
  Synthetic oligonucleotide
cgacggtccgcgtcgggcaggtcgt

SEQ ID NO: 704877 - DNA, 25 bp, Artificial sequence
  Synthetic oligonucleotide
ctgcgccgctagacgcggagtcccc

SEQ ID NO: 704878 - DNA, 25 bp, Artificial sequence
  Synthetic oligonucleotide
ctgcgccgctagtcgcggagtcccc

SEQ ID NO: 704879 - DNA, 25 bp, Artificial sequence
  Synthetic oligonucleotide
gatgcgacggatcgcgcgccgccct

SEQ ID NO: 704880 - DNA, 25 bp, Artificial sequence
  Synthetic oligonucleotide
gatgcgacggatggcgcgccgccct

SEQ ID NO: 704881 - DNA, 25 bp, Artificial sequence
  Synthetic oligonucleotide
agcgcccgacgccagaccgctggac

SEQ ID NO: 704882 - DNA, 25 bp, Artificial sequence
  Synthetic oligonucleotide
ggcgacccgctaggcgagccttgcc

SEQ ID NO: 704883 - DNA, 25 bp, Artificial sequence
  Synthetic oligonucleotide
gaggaggcgcaatcggacgggcccc

SEQ ID NO: 704884 - DNA, 25 bp, Artificial sequence
  Synthetic oligonucleotide
ggccttcccgtaacgcgctcggggc

SEQ ID NO: 704885 - DNA, 25 bp, Artificial sequence
  Synthetic oligonucleotide
cgccggcgcggcctattcgtcggct

SEQ ID NO: 704886 - DNA, 25 bp, Artificial sequence
  Synthetic oligonucleotide
cgccggcgcggcgtattcgtcggct

SEQ ID NO: 704887 - DNA, 25 bp, Artificial sequence
  Synthetic oligonucleotide
actgggcgcgggcacgatcgtcggg

SEQ ID NO: 704888 - DNA, 25 bp, Artificial sequence
  Synthetic oligonucleotide
actgggcgcggggacgatcgtcggg

SEQ ID NO: 704889 - DNA, 25 bp, Artificial sequence
  Synthetic oligonucleotide
gtgcgcccgtcgaactgcggcgcag

SEQ ID NO: 704890 - DNA, 25 bp, Artificial sequence
  Synthetic oligonucleotide
gtgcgcccgtcgtactgcggcgcag

SEQ ID NO: 704891 - DNA, 25 bp, Artificial sequence
  Synthetic oligonucleotide
ggcacgcgcgcgtttacccggcctc

SEQ ID NO: 704892 - DNA, 25 bp, Artificial sequence
  Synthetic oligonucleotide
ggcacgcgcgcgattacccggcctc

SEQ ID NO: 704893 - DNA, 25 bp, Artificial sequence
  Synthetic oligonucleotide
ccccagctagcgcgccgaccgactg

SEQ ID NO: 704894 - DNA, 25 bp, Artificial sequence
  Synthetic oligonucleotide
ccccagctagcgggccgaccgactg

SEQ ID NO: 704895 - DNA, 25 bp, Artificial sequence
  Synthetic oligonucleotide
cctctccgtgcgtccggttgggggc

SEQ ID NO: 704896 - DNA, 25 bp, Artificial sequence
  Synthetic oligonucleotide
aggacggcgctaccgcaacggggcg

SEQ ID NO: 704897 - DNA, 25 bp, Artificial sequence
  Synthetic oligonucleotide
cctgcgccgctagggcggtcttccc

SEQ ID NO: 704898 - DNA, 25 bp, Artificial sequence
  Synthetic oligonucleotide
ggccttcccgtatcgcgctcggggc

SEQ ID NO: 704899 - DNA, 25 bp, Artificial sequence
  Synthetic oligonucleotide
gcccgcacgacccgctacgcctctg

SEQ ID NO: 704900 - DNA, 25 bp, Artificial sequence
  Synthetic oligonucleotide
gcccgcacgaccggctacgcctctg

SEQ ID NO: 704901 - DNA, 25 bp, Artificial sequence
  Synthetic oligonucleotide
gctgcctgcgacgtacgggcgggga

SEQ ID NO: 704902 - DNA, 25 bp, Artificial sequence
  Synthetic oligonucleotide
gctgcctgcgacctacgggcgggga

SEQ ID NO: 704903 - DNA, 25 bp, Artificial sequence
  Synthetic oligonucleotide
ccactcgtcgaagcgtgcggccggg

SEQ ID NO: 704904 - DNA, 25 bp, Artificial sequence
  Synthetic oligonucleotide
ccactcgtcgaaccgtgcggccggg

SEQ ID NO: 704905 - DNA, 25 bp, Artificial sequence
  Synthetic oligonucleotide
gtgggcacggtcgcatcgctgccgg

SEQ ID NO: 704906 - DNA, 25 bp, Artificial sequence
  Synthetic oligonucleotide
gtgggcacggtcccatcgctgccgg

SEQ ID NO: 704907 - DNA, 25 bp, Artificial sequence
  Synthetic oligonucleotide
ggcgtgtcggcgatacgccgtggcc

SEQ ID NO: 704908 - DNA, 25 bp, Artificial sequence
  Synthetic oligonucleotide
aggacggcgctagcgcaacggggcg

SEQ ID NO: 704909 - DNA, 25 bp, Artificial sequence
  Synthetic oligonucleotide
cgcaggcgcgaagcggtccttgccg

SEQ ID NO: 704910 - DNA, 25 bp, Artificial sequence
  Synthetic oligonucleotide
agcgcccgacgcgagaccgctggac

SEQ ID NO: 704911 - DNA, 25 bp, Artificial sequence
  Synthetic oligonucleotide
ccgccaccgcgcctagtacggctcg

SEQ ID NO: 704912 - DNA, 25 bp, Artificial sequence
  Synthetic oligonucleotide
ccgccaccgcgcgtagtacggctcg

SEQ ID NO: 704913 - DNA, 25 bp, Artificial sequence
  Synthetic oligonucleotide
cgactgcgccacacgtacggccgcc

SEQ ID NO: 704914 - DNA, 25 bp, Artificial sequence
  Synthetic oligonucleotide
cgactgcgccactcgtacggccgcc

SEQ ID NO: 704915 - DNA, 25 bp, Artificial sequence
  Synthetic oligonucleotide
cgggccacgggcctacgaagcctgg

SEQ ID NO: 704916 - DNA, 25 bp, Artificial sequence
  Synthetic oligonucleotide
cgggccacgggcgtacgaagcctgg

SEQ ID NO: 704917 - DNA, 25 bp, Artificial sequence
  Synthetic oligonucleotide
gggccccggcatacgacggcgctag

SEQ ID NO: 704918 - DNA, 25 bp, Artificial sequence
  Synthetic oligonucleotide
gggccccggcattcgacggcgctag

SEQ ID NO: 704919 - DNA, 25 bp, Artificial sequence
  Synthetic oligonucleotide
atggcggagcgttctcgcgccgggc

SEQ ID NO: 704920 - DNA, 25 bp, Artificial sequence
  Synthetic oligonucleotide
gtgctcaccgaaggtccgcgcgccg

SEQ ID NO: 704921 - DNA, 25 bp, Artificial sequence
  Synthetic oligonucleotide
cgcaggcgcgaaccggtccttgccg

SEQ ID NO: 704922 - DNA, 25 bp, Artificial sequence
  Synthetic oligonucleotide
gagcccgtcgtctcgacgaggccgc

SEQ ID NO: 704923 - DNA, 25 bp, Artificial sequence
  Synthetic oligonucleotide
gcggcactagccgggtacgtcggcc

SEQ ID NO: 704924 - DNA, 25 bp, Artificial sequence
  Synthetic oligonucleotide
gcggcactagcccggtacgtcggcc

SEQ ID NO: 704925 - DNA, 25 bp, Artificial sequence
  Synthetic oligonucleotide
tcgagggtcccggggcgtatgggcg

SEQ ID NO: 704926 - DNA, 25 bp, Artificial sequence
  Synthetic oligonucleotide
tcgagggtcccgcggcgtatgggcg

SEQ ID NO: 704927 - DNA, 25 bp, Artificial sequence
  Synthetic oligonucleotide
cgtccccgcgtcgactaccgcgagc

SEQ ID NO: 704928 - DNA, 25 bp, Artificial sequence
  Synthetic oligonucleotide
cgtccccgcgtccactaccgcgagc

SEQ ID NO: 704929 - DNA, 25 bp, Artificial sequence
  Synthetic oligonucleotide
gcgacggggtatggggacgacgcgc

SEQ ID NO: 704930 - DNA, 25 bp, Artificial sequence
  Synthetic oligonucleotide
gcgacggggtatcgggacgacgcgc

SEQ ID NO: 704931 - DNA, 25 bp, Artificial sequence
  Synthetic oligonucleotide
cggttgcccgaagttcgcggccgcc

SEQ ID NO: 704932 - DNA, 25 bp, Artificial sequence
  Synthetic oligonucleotide
cgcccggggtgcccccgttctgatc

SEQ ID NO: 704933 - DNA, 25 bp, Artificial sequence
  Synthetic oligonucleotide
atggcggagcgtactcgcgccgggc

SEQ ID NO: 704934 - DNA, 25 bp, Artificial sequence
  Synthetic oligonucleotide
agagtggtcccgtacggcgcgccgg

SEQ ID NO: 704935 - DNA, 25 bp, Artificial sequence
  Synthetic oligonucleotide
gccgccatcggcggcgactgagtgg

SEQ ID NO: 704936 - DNA, 25 bp, Artificial sequence
  Synthetic oligonucleotide
gccgccatcggccgcgactgagtgg

SEQ ID NO: 704937 - DNA, 25 bp, Artificial sequence
  Synthetic oligonucleotide
ctggcgcgcgcggttacctaccccc

SEQ ID NO: 704938 - DNA, 25 bp, Artificial sequence
  Synthetic oligonucleotide
ctggcgcgcgcgcttacctaccccc

SEQ ID NO: 704939 - DNA, 25 bp, Artificial sequence
  Synthetic oligonucleotide
gcagagcctacggcgcgtaccgggg

SEQ ID NO: 704940 - DNA, 25 bp, Artificial sequence
  Synthetic oligonucleotide
gcagagcctacgccgcgtaccgggg

SEQ ID NO: 704941 - DNA, 25 bp, Artificial sequence
  Synthetic oligonucleotide
cggggttcgtgggcgcgacgagctg

SEQ ID NO: 704942 - DNA, 25 bp, Artificial sequence
  Synthetic oligonucleotide
cggggttcgtggccgcgacgagctg

SEQ ID NO: 704943 - DNA, 25 bp, Artificial sequence
  Synthetic oligonucleotide
cgctcggcccgttgcgacgcacagg

SEQ ID NO: 704944 - DNA, 25 bp, Artificial sequence
  Synthetic oligonucleotide
cgctcggcccgtagcgacgcacagg

SEQ ID NO: 704945 - DNA, 25 bp, Artificial sequence
  Synthetic oligonucleotide
gtgctcaccgaacgtccgcgcgccg

SEQ ID NO: 704946 - DNA, 25 bp, Artificial sequence
  Synthetic oligonucleotide
cgcgacacccctccgcgaagtcgcg

SEQ ID NO: 704947 - DNA, 25 bp, Artificial sequence
  Synthetic oligonucleotide
gggaccgtagcgcgcccgagcacag

SEQ ID NO: 704948 - DNA, 25 bp, Artificial sequence
  Synthetic oligonucleotide
agagtggtcccgaacggcgcgccgg

SEQ ID NO: 704949 - DNA, 25 bp, Artificial sequence
  Synthetic oligonucleotide
ccgcgtacgtcgggaccgatgggcg

SEQ ID NO: 704950 - DNA, 25 bp, Artificial sequence
  Synthetic oligonucleotide
ccgcgtacgtcgcgaccgatgggcg

SEQ ID NO: 704951 - DNA, 25 bp, Artificial sequence
  Synthetic oligonucleotide
gggaccgtagcgggcccgagcacag

SEQ ID NO: 704952 - DNA, 25 bp, Artificial sequence
  Synthetic oligonucleotide
tcgccgcggtacgcgactctcggcc

SEQ ID NO: 704953 - DNA, 25 bp, Artificial sequence
  Synthetic oligonucleotide
ggcccacgtggtacgtcgcggccgt

SEQ ID NO: 704954 - DNA, 25 bp, Artificial sequence
  Synthetic oligonucleotide
ggcccacgtggttcgtcgcggccgt

SEQ ID NO: 704955 - DNA, 25 bp, Artificial sequence
  Synthetic oligonucleotide
gggccgttacggcgcgcgcgcacaa

SEQ ID NO: 704956 - DNA, 25 bp, Artificial sequence
  Synthetic oligonucleotide
gggccgttacggggcgcgcgcacaa

SEQ ID NO: 704957 - DNA, 25 bp, Artificial sequence
  Synthetic oligonucleotide
gagcccgtcgtcacgacgaggccgc

SEQ ID NO: 704958 - DNA, 25 bp, Artificial sequence
  Synthetic oligonucleotide
cgcccggggtgcgcccgttctgatc

SEQ ID NO: 704959 - DNA, 25 bp, Artificial sequence
  Synthetic oligonucleotide
agctcccgatcgtgcgggtgccgcg

SEQ ID NO: 704960 - DNA, 25 bp, Artificial sequence
  Synthetic oligonucleotide
ggaccgcgttgcctcggtcccctgc

SEQ ID NO: 704961 - DNA, 25 bp, Artificial sequence
  Synthetic oligonucleotide
cggccccgccgcgcgtatggcattc

SEQ ID NO: 704962 - DNA, 25 bp, Artificial sequence
  Synthetic oligonucleotide
cggccccgccgcccgtatggcattc

SEQ ID NO: 704963 - DNA, 25 bp, Artificial sequence
  Synthetic oligonucleotide
cgggcgccgaaccgtcgagacgcct

SEQ ID NO: 704964 - DNA, 25 bp, Artificial sequence
  Synthetic oligonucleotide
cgggcgccgaacggtcgagacgcct

SEQ ID NO: 704965 - DNA, 25 bp, Artificial sequence
  Synthetic oligonucleotide
tcgctcccgcgacgcgtagcgtgcc

SEQ ID NO: 704966 - DNA, 25 bp, Artificial sequence
  Synthetic oligonucleotide
tcgctcccgcgaggcgtagcgtgcc

SEQ ID NO: 704967 - DNA, 25 bp, Artificial sequence
  Synthetic oligonucleotide
cccgcccgttgcccgtcgagtcacg

SEQ ID NO: 704968 - DNA, 25 bp, Artificial sequence
  Synthetic oligonucleotide
cccgcccgttgcgcgtcgagtcacg

SEQ ID NO: 704969 - DNA, 25 bp, Artificial sequence
  Synthetic oligonucleotide
cccagcccgtcgtaccggatgcccc

SEQ ID NO: 704970 - DNA, 25 bp, Artificial sequence
  Synthetic oligonucleotide
gcgcgcgtcgcgcgtataggtgcgg

SEQ ID NO: 704971 - DNA, 25 bp, Artificial sequence
  Synthetic oligonucleotide
agctcccgatcgagcgggtgccgcg

SEQ ID NO: 704972 - DNA, 25 bp, Artificial sequence
  Synthetic oligonucleotide
gcggggctacggacgtccgcacagc

SEQ ID NO: 704973 - DNA, 25 bp, Artificial sequence
  Synthetic oligonucleotide
cgtcgggccgtacgtagcggcaggg

SEQ ID NO: 704974 - DNA, 25 bp, Artificial sequence
  Synthetic oligonucleotide
cgtcgggccgtaggtagcggcaggg

SEQ ID NO: 704975 - DNA, 25 bp, Artificial sequence
  Synthetic oligonucleotide
cctgctacgtgtccggacggccgcc

SEQ ID NO: 704976 - DNA, 25 bp, Artificial sequence
  Synthetic oligonucleotide
cctgctacgtgtgcggacggccgcc

SEQ ID NO: 704977 - DNA, 25 bp, Artificial sequence
  Synthetic oligonucleotide
gtgcggccgatagaacgcggggcgg

SEQ ID NO: 704978 - DNA, 25 bp, Artificial sequence
  Synthetic oligonucleotide
gtgcggccgatacaacgcggggcgg

SEQ ID NO: 704979 - DNA, 25 bp, Artificial sequence
  Synthetic oligonucleotide
cgacagtacgtcgcggccggacccg

SEQ ID NO: 704980 - DNA, 25 bp, Artificial sequence
  Synthetic oligonucleotide
cgacagtacgtcccggccggacccg

SEQ ID NO: 704981 - DNA, 25 bp, Artificial sequence
  Synthetic oligonucleotide
taccgggtcgcgaatgcccggggcc

SEQ ID NO: 704982 - DNA, 25 bp, Artificial sequence
  Synthetic oligonucleotide
taccgggtcgcgtatgcccggggcc

SEQ ID NO: 704983 - DNA, 25 bp, Artificial sequence
  Synthetic oligonucleotide
cccagcccgtcgaaccggatgcccc

SEQ ID NO: 704984 - DNA, 25 bp, Artificial sequence
  Synthetic oligonucleotide
ccctggggccgattacgcgcccgac

SEQ ID NO: 704985 - DNA, 25 bp, Artificial sequence
  Synthetic oligonucleotide
tgcgcctacgtagggcgcgcgtccg

SEQ ID NO: 704986 - DNA, 25 bp, Artificial sequence
  Synthetic oligonucleotide
tgcgcctacgtacggcgcgcgtccg

SEQ ID NO: 704987 - DNA, 25 bp, Artificial sequence
  Synthetic oligonucleotide
tcgccgcggtacccgactctcggcc

SEQ ID NO: 704988 - DNA, 25 bp, Artificial sequence
  Synthetic oligonucleotide
ggcgacccgctacgcgagccttgcc

SEQ ID NO: 704989 - DNA, 25 bp, Artificial sequence
  Synthetic oligonucleotide
ggttcctcgccgcaccgatcgggcc

SEQ ID NO: 704990 - DNA, 25 bp, Artificial sequence
  Synthetic oligonucleotide
ggttcctcgccggaccgatcgggcc

SEQ ID NO: 704991 - DNA, 25 bp, Artificial sequence
  Synthetic oligonucleotide
ccggccagcgtactcgcgcagaccc

SEQ ID NO: 704992 - DNA, 25 bp, Artificial sequence
  Synthetic oligonucleotide
ccggccagcgtagtcgcgcagaccc

SEQ ID NO: 704993 - DNA, 25 bp, Artificial sequence
  Synthetic oligonucleotide
ggcccgccgacccatacgggagcga

SEQ ID NO: 704994 - DNA, 25 bp, Artificial sequence
  Synthetic oligonucleotide
ggcccgccgaccgatacgggagcga

SEQ ID NO: 704995 - DNA, 25 bp, Artificial sequence
  Synthetic oligonucleotide
gcgcgcgtcgcgggtataggtgcgg

SEQ ID NO: 704996 - DNA, 25 bp, Artificial sequence
  Synthetic oligonucleotide
cgactgcgtacgcccgagccccggt

SEQ ID NO: 704997 - DNA, 25 bp, Artificial sequence
  Synthetic oligonucleotide
ctgggcatagccggcgtcgcgcgtc

SEQ ID NO: 704998 - DNA, 25 bp, Artificial sequence
  Synthetic oligonucleotide
ccctggggccgaatacgcgcccgac

SEQ ID NO: 704999 - DNA, 25 bp, Artificial sequence
  Synthetic oligonucleotide
gagcgccgcgttggctagcacgcgg

SEQ ID NO: 705000 - DNA, 25 bp, Artificial sequence
  Synthetic oligonucleotide
gagcgccgcgttcgctagcacgcgg

SEQ ID NO: 705001 - DNA, 25 bp, Artificial sequence
  Synthetic oligonucleotide
cccacgatgcccgaacgcgccctgc

SEQ ID NO: 705002 - DNA, 25 bp, Artificial sequence
  Synthetic oligonucleotide
ctgggcatagcccgcgtcgcgcgtc

SEQ ID NO: 705003 - DNA, 25 bp, Artificial sequence
  Synthetic oligonucleotide
gagcccccggtacgcttcggggcga

SEQ ID NO: 705004 - DNA, 25 bp, Artificial sequence
  Synthetic oligonucleotide
gagcccccggtaggcttcggggcga

SEQ ID NO: 705005 - DNA, 25 bp, Artificial sequence
  Synthetic oligonucleotide
gtggcccacgggtcgtacgggaggc

SEQ ID NO: 705006 - DNA, 25 bp, Artificial sequence
  Synthetic oligonucleotide
gtggcccacgggacgtacgggaggc

SEQ ID NO: 705007 - DNA, 25 bp, Artificial sequence
  Synthetic oligonucleotide
gcggggctacggtcgtccgcacagc

SEQ ID NO: 705008 - DNA, 25 bp, Artificial sequence
  Synthetic oligonucleotide
cgactgcgtacggccgagccccggt

SEQ ID NO: 705009 - DNA, 25 bp, Artificial sequence
  Synthetic oligonucleotide
cggccggacgcagcgacgagccatc

SEQ ID NO: 705010 - DNA, 25 bp, Artificial sequence
  Synthetic oligonucleotide
gcgcgtctacgacggccgtacgcgc

SEQ ID NO: 705011 - DNA, 25 bp, Artificial sequence
  Synthetic oligonucleotide
gcgcgtctacgagggccgtacgcgc

SEQ ID NO: 705012 - DNA, 25 bp, Artificial sequence
  Synthetic oligonucleotide
cgcggtctcggtggatcgcgcacgg

SEQ ID NO: 705013 - DNA, 25 bp, Artificial sequence
  Synthetic oligonucleotide
cgcggtctcggtcgatcgcgcacgg

SEQ ID NO: 705014 - DNA, 25 bp, Artificial sequence
  Synthetic oligonucleotide
ccacacgtccgaacgcgcgggcgca

SEQ ID NO: 705015 - DNA, 25 bp, Artificial sequence
  Synthetic oligonucleotide
ccacacgtccgatcgcgcgggcgca

SEQ ID NO: 705016 - DNA, 25 bp, Artificial sequence
  Synthetic oligonucleotide
cggagcccggcgtacaacgccccac

SEQ ID NO: 705017 - DNA, 25 bp, Artificial sequence
  Synthetic oligonucleotide
cggagcccggcgaacaacgccccac

SEQ ID NO: 705018 - DNA, 25 bp, Artificial sequence
  Synthetic oligonucleotide
gacgggtatcgccacgccgtcgggg

SEQ ID NO: 705019 - DNA, 25 bp, Artificial sequence
  Synthetic oligonucleotide
gacgggtatcgcgacgccgtcgggg

SEQ ID NO: 705020 - DNA, 25 bp, Artificial sequence
  Synthetic oligonucleotide
cacggcgcgcctcgtacgagaggcg

SEQ ID NO: 705021 - DNA, 25 bp, Artificial sequence
  Synthetic oligonucleotide
gggacgtagcgccctgacgtggccc

SEQ ID NO: 705022 - DNA, 25 bp, Artificial sequence
  Synthetic oligonucleotide
gaagggcgtaaccgcgaggcccgcc

SEQ ID NO: 705023 - DNA, 25 bp, Artificial sequence
  Synthetic oligonucleotide
cggccggacgcaccgacgagccatc

SEQ ID NO: 705024 - DNA, 25 bp, Artificial sequence
  Synthetic oligonucleotide
gacgccttgacggtccgcgtggggc

SEQ ID NO: 705025 - DNA, 25 bp, Artificial sequence
  Synthetic oligonucleotide
gacgccttgacgctccgcgtggggc

SEQ ID NO: 705026 - DNA, 25 bp, Artificial sequence
  Synthetic oligonucleotide
gcgggttccgatggagcgcgctggc

SEQ ID NO: 705027 - DNA, 25 bp, Artificial sequence
  Synthetic oligonucleotide
gcgggttccgatcgagcgcgctggc

SEQ ID NO: 705028 - DNA, 25 bp, Artificial sequence
  Synthetic oligonucleotide
ggaccgcgttgcgtcggtcccctgc

SEQ ID NO: 705029 - DNA, 25 bp, Artificial sequence
  Synthetic oligonucleotide
cccacgatgccccaacgcgccctgc

SEQ ID NO: 705030 - DNA, 25 bp, Artificial sequence
  Synthetic oligonucleotide
ccaaggggtatgccgcgcggcacgc

SEQ ID NO: 705031 - DNA, 25 bp, Artificial sequence
  Synthetic oligonucleotide
ccaaggggtatggcgcgcggcacgc

SEQ ID NO: 705032 - DNA, 25 bp, Artificial sequence
  Synthetic oligonucleotide
tgctgacggtcatcgcgcccgcccg

SEQ ID NO: 705033 - DNA, 25 bp, Artificial sequence
  Synthetic oligonucleotide
tgctgacggtcaacgcgcccgcccg

SEQ ID NO: 705034 - DNA, 25 bp, Artificial sequence
  Synthetic oligonucleotide
gaagggcgtaacggcgaggcccgcc

SEQ ID NO: 705035 - DNA, 25 bp, Artificial sequence
  Synthetic oligonucleotide
gcgcggctagcgtatcgcgctcccg

SEQ ID NO: 705036 - DNA, 25 bp, Artificial sequence
  Synthetic oligonucleotide
cggcggccgtcggcgcaagttacgg

SEQ ID NO: 705037 - DNA, 25 bp, Artificial sequence
  Synthetic oligonucleotide
gctggcgctacccgcggtagcgtcg

SEQ ID NO: 705038 - DNA, 25 bp, Artificial sequence
  Synthetic oligonucleotide
gctggcgctaccggcggtagcgtcg

SEQ ID NO: 705039 - DNA, 25 bp, Artificial sequence
  Synthetic oligonucleotide
cggcggccgtcgccgcaagttacgg

SEQ ID NO: 705040 - DNA, 25 bp, Artificial sequence
  Synthetic oligonucleotide
gggacgtagcgcgctgacgtggccc

SEQ ID NO: 705041 - DNA, 25 bp, Artificial sequence
  Synthetic oligonucleotide
cacggcgcgcctggtacgagaggcg

SEQ ID NO: 705042 - DNA, 25 bp, Artificial sequence
  Synthetic oligonucleotide
ggccgcatagactcgcgcgccccca

SEQ ID NO: 705043 - DNA, 25 bp, Artificial sequence
  Synthetic oligonucleotide
ggccgcatagacacgcgcgccccca

SEQ ID NO: 705044 - DNA, 25 bp, Artificial sequence
  Synthetic oligonucleotide
gtcccgacggcgtcgcgtggtgtcc

SEQ ID NO: 705045 - DNA, 25 bp, Artificial sequence
  Synthetic oligonucleotide
gcgcggctagcgaatcgcgctcccg

SEQ ID NO: 705046 - DNA, 25 bp, Artificial sequence
  Synthetic oligonucleotide
ggacgctcgcgcggttggggcaagg

SEQ ID NO: 705047 - DNA, 25 bp, Artificial sequence
  Synthetic oligonucleotide
cgctcccgcgaagcggttggcagcg

SEQ ID NO: 705048 - DNA, 25 bp, Artificial sequence
  Synthetic oligonucleotide
ctcgggcgatcgcctacgggcaggc

SEQ ID NO: 705049 - DNA, 25 bp, Artificial sequence
  Synthetic oligonucleotide
ctcgggcgatcggctacgggcaggc

SEQ ID NO: 705050 - DNA, 25 bp, Artificial sequence
  Synthetic oligonucleotide
ggagcgctacgccacggcgcgctac

SEQ ID NO: 705051 - DNA, 25 bp, Artificial sequence
  Synthetic oligonucleotide
ggagcgctacgcgacggcgcgctac

SEQ ID NO: 705052 - DNA, 25 bp, Artificial sequence
  Synthetic oligonucleotide
cgctcccgcgaaccggttggcagcg

SEQ ID NO: 705053 - DNA, 25 bp, Artificial sequence
  Synthetic oligonucleotide
ccccggggtatgcccgcgctagcct

SEQ ID NO: 705054 - DNA, 25 bp, Artificial sequence
  Synthetic oligonucleotide
cgtcggcgcatacgcggctggcctg

SEQ ID NO: 705055 - DNA, 25 bp, Artificial sequence
  Synthetic oligonucleotide
cgtcggcgcataggcggctggcctg

SEQ ID NO: 705056 - DNA, 25 bp, Artificial sequence
  Synthetic oligonucleotide
ggacgctcgcgccgttggggcaagg

SEQ ID NO: 705057 - DNA, 25 bp, Artificial sequence
  Synthetic oligonucleotide
gtcccgacggcgacgcgtggtgtcc

SEQ ID NO: 705058 - DNA, 25 bp, Artificial sequence
  Synthetic oligonucleotide
ccccggggtatggccgcgctagcct

SEQ ID NO: 705059 - DNA, 25 bp, Artificial sequence
  Synthetic oligonucleotide
gcgtgccgcgtcgaccggtcgccgt

SEQ ID NO: 705060 - DNA, 25 bp, Artificial sequence
  Synthetic oligonucleotide
gctgcggtactgcaccgcggccgcc

SEQ ID NO: 705061 - DNA, 25 bp, Artificial sequence
  Synthetic oligonucleotide
gtcggcgtaacgccgcgccgctggc

SEQ ID NO: 705062 - DNA, 25 bp, Artificial sequence
  Synthetic oligonucleotide
gggcgctacgcggggtcgactgcgc

SEQ ID NO: 705063 - DNA, 25 bp, Artificial sequence
  Synthetic oligonucleotide
cgccgaacggacgcgcgacgtcccc

SEQ ID NO: 705064 - DNA, 25 bp, Artificial sequence
  Synthetic oligonucleotide
cgccgaacggacccgcgacgtcccc

SEQ ID NO: 705065 - DNA, 25 bp, Artificial sequence
  Synthetic oligonucleotide
ctcccgccacgtttccgcgccgcgg

SEQ ID NO: 705066 - DNA, 25 bp, Artificial sequence
  Synthetic oligonucleotide
ctcccgccacgtatccgcgccgcgg

SEQ ID NO: 705067 - DNA, 25 bp, Artificial sequence
  Synthetic oligonucleotide
gcaccccgccgttggctcgggcctg

SEQ ID NO: 705068 - DNA, 25 bp, Artificial sequence
  Synthetic oligonucleotide
gcaccccgccgtaggctcgggcctg

SEQ ID NO: 705069 - DNA, 25 bp, Artificial sequence
  Synthetic oligonucleotide
agcgcctagacggcacgcggcccgg

SEQ ID NO: 705070 - DNA, 25 bp, Artificial sequence
  Synthetic oligonucleotide
agcgcctagacgccacgcggcccgg

SEQ ID NO: 705071 - DNA, 25 bp, Artificial sequence
  Synthetic oligonucleotide
gccgccgtacgagccggacgctcgc

SEQ ID NO: 705072 - DNA, 25 bp, Artificial sequence
  Synthetic oligonucleotide
gccgccgtacgacccggacgctcgc

SEQ ID NO: 705073 - DNA, 25 bp, Artificial sequence
  Synthetic oligonucleotide
cgccacgcccgtacgccgtgacggc

SEQ ID NO: 705074 - DNA, 25 bp, Artificial sequence
  Synthetic oligonucleotide
cgcgagtgccgtacgacgggccgcg

SEQ ID NO: 705075 - DNA, 25 bp, Artificial sequence
  Synthetic oligonucleotide
gtcggcgtaacggcgcgccgctggc

SEQ ID NO: 705076 - DNA, 25 bp, Artificial sequence
  Synthetic oligonucleotide
cagccggctacggtccgcgacggcg

SEQ ID NO: 705077 - DNA, 25 bp, Artificial sequence
  Synthetic oligonucleotide
gcccgtcgctaccgcccgtcgtccc

SEQ ID NO: 705078 - DNA, 25 bp, Artificial sequence
  Synthetic oligonucleotide
gcccgtcgctacggcccgtcgtccc

SEQ ID NO: 705079 - DNA, 25 bp, Artificial sequence
  Synthetic oligonucleotide
ggcgactacgttcggcgccggcgcg

SEQ ID NO: 705080 - DNA, 25 bp, Artificial sequence
  Synthetic oligonucleotide
ggcgactacgttgggcgccggcgcg

SEQ ID NO: 705081 - DNA, 25 bp, Artificial sequence
  Synthetic oligonucleotide
cctccgcctatgcgcgacgggccgg

SEQ ID NO: 705082 - DNA, 25 bp, Artificial sequence
  Synthetic oligonucleotide
cctccgcctatgggcgacgggccgg

SEQ ID NO: 705083 - DNA, 25 bp, Artificial sequence
  Synthetic oligonucleotide
ccaccgggtcgcacgcgaacgcgcg

SEQ ID NO: 705084 - DNA, 25 bp, Artificial sequence
  Synthetic oligonucleotide
ccaccgggtcgctcgcgaacgcgcg

SEQ ID NO: 705085 - DNA, 25 bp, Artificial sequence
  Synthetic oligonucleotide
ccgccgcgacccgccgtactggcga

SEQ ID NO: 705086 - DNA, 25 bp, Artificial sequence
  Synthetic oligonucleotide
ccgccgcgaccccccgtactggcga

SEQ ID NO: 705087 - DNA, 25 bp, Artificial sequence
  Synthetic oligonucleotide
cgcgcccgctagcgcgaggacggga

SEQ ID NO: 705088 - DNA, 25 bp, Artificial sequence
  Synthetic oligonucleotide
cgcgcccgctagggcgaggacggga

SEQ ID NO: 705089 - DNA, 25 bp, Artificial sequence
  Synthetic oligonucleotide
cgcgagtgccgttcgacgggccgcg

SEQ ID NO: 705090 - DNA, 25 bp, Artificial sequence
  Synthetic oligonucleotide
cgccacgcccgttcgccgtgacggc

SEQ ID NO: 705091 - DNA, 25 bp, Artificial sequence
  Synthetic oligonucleotide
agtgcgccgctcccgcgtacccccg

SEQ ID NO: 705092 - DNA, 25 bp, Artificial sequence
  Synthetic oligonucleotide
ccgccgatcgaccgtcgcggggcga

SEQ ID NO: 705093 - DNA, 25 bp, Artificial sequence
  Synthetic oligonucleotide
ccgccgatcgacggtcgcggggcga

SEQ ID NO: 705094 - DNA, 25 bp, Artificial sequence
  Synthetic oligonucleotide
ggcccttaccgggacgtcgcgccgg

SEQ ID NO: 705095 - DNA, 25 bp, Artificial sequence
  Synthetic oligonucleotide
ggcccttaccggcacgtcgcgccgg

SEQ ID NO: 705096 - DNA, 25 bp, Artificial sequence
  Synthetic oligonucleotide
ggagcgcgggtagtgcggcccgctg

SEQ ID NO: 705097 - DNA, 25 bp, Artificial sequence
  Synthetic oligonucleotide
ggagcgcgggtactgcggcccgctg

SEQ ID NO: 705098 - DNA, 25 bp, Artificial sequence
  Synthetic oligonucleotide
tgggcggctagcggtacgcgccccg

SEQ ID NO: 705099 - DNA, 25 bp, Artificial sequence
  Synthetic oligonucleotide
gcccccgtacgtagcccgccgctcc

SEQ ID NO: 705100 - DNA, 25 bp, Artificial sequence
  Synthetic oligonucleotide
cgtgggcgacgcgcgacgactccgc

SEQ ID NO: 705101 - DNA, 25 bp, Artificial sequence
  Synthetic oligonucleotide
gcccccgtacgttgcccgccgctcc

SEQ ID NO: 705102 - DNA, 25 bp, Artificial sequence
  Synthetic oligonucleotide
ctgggcgtcgatggcgggtccggcg

SEQ ID NO: 705103 - DNA, 25 bp, Artificial sequence
  Synthetic oligonucleotide
ctgggcgtcgatcgcgggtccggcg

SEQ ID NO: 705104 - DNA, 25 bp, Artificial sequence
  Synthetic oligonucleotide
caggcccgaccggcatcgccctgcc

SEQ ID NO: 705105 - DNA, 25 bp, Artificial sequence
  Synthetic oligonucleotide
gggccgcgtcccgtcacgacgctgc

SEQ ID NO: 705106 - DNA, 25 bp, Artificial sequence
  Synthetic oligonucleotide
gcggtgtgcgaccgcccgtgcgcac

SEQ ID NO: 705107 - DNA, 25 bp, Artificial sequence
  Synthetic oligonucleotide
gggcgctacgcgcggtcgactgcgc

SEQ ID NO: 705108 - DNA, 25 bp, Artificial sequence
  Synthetic oligonucleotide
gtcgccggcgtaggcgtgagcgccg

SEQ ID NO: 705109 - DNA, 25 bp, Artificial sequence
  Synthetic oligonucleotide
gtcgccggcgtacgcgtgagcgccg

SEQ ID NO: 705110 - DNA, 25 bp, Artificial sequence
  Synthetic oligonucleotide
ccccgacgtacgggatccgcccgcc

SEQ ID NO: 705111 - DNA, 25 bp, Artificial sequence
  Synthetic oligonucleotide
ccccgacgtacgcgatccgcccgcc

SEQ ID NO: 705112 - DNA, 25 bp, Artificial sequence
  Synthetic oligonucleotide
caggcccgaccgccatcgccctgcc

SEQ ID NO: 705113 - DNA, 25 bp, Artificial sequence
  Synthetic oligonucleotide
cggccccgcgctaggcgacagtcgg

SEQ ID NO: 705114 - DNA, 25 bp, Artificial sequence
  Synthetic oligonucleotide
agtgcgccgctcgcgcgtacccccg

SEQ ID NO: 705115 - DNA, 25 bp, Artificial sequence
  Synthetic oligonucleotide
gcggtgtgcgacggcccgtgcgcac

SEQ ID NO: 705116 - DNA, 25 bp, Artificial sequence
  Synthetic oligonucleotide
agccgccctatcctcgggcgcccgc

SEQ ID NO: 705117 - DNA, 25 bp, Artificial sequence
  Synthetic oligonucleotide
agccgccctatcgtcgggcgcccgc

SEQ ID NO: 705118 - DNA, 25 bp, Artificial sequence
  Synthetic oligonucleotide
tggcacgggtcgggtacgccggccg

SEQ ID NO: 705119 - DNA, 25 bp, Artificial sequence
  Synthetic oligonucleotide
tggcacgggtcgcgtacgccggccg

SEQ ID NO: 705120 - DNA, 25 bp, Artificial sequence
  Synthetic oligonucleotide
cagccggctacgctccgcgacggcg

SEQ ID NO: 705121 - DNA, 25 bp, Artificial sequence
  Synthetic oligonucleotide
cggccccgcgcttggcgacagtcgg

SEQ ID NO: 705122 - DNA, 25 bp, Artificial sequence
  Synthetic oligonucleotide
cggcgccatactggcgcgggcaccg

SEQ ID NO: 705123 - DNA, 25 bp, Artificial sequence
  Synthetic oligonucleotide
cgccagtcgtaccgccgggcgcgtg

SEQ ID NO: 705124 - DNA, 25 bp, Artificial sequence
  Synthetic oligonucleotide
ctggggccgtcaacgggcggccgac

SEQ ID NO: 705125 - DNA, 25 bp, Artificial sequence
  Synthetic oligonucleotide
ctggggccgtcatcgggcggccgac

SEQ ID NO: 705126 - DNA, 25 bp, Artificial sequence
  Synthetic oligonucleotide
tgggcggctagccgtacgcgccccg

SEQ ID NO: 705127 - DNA, 25 bp, Artificial sequence
  Synthetic oligonucleotide
gctgcggtactggaccgcggccgcc

SEQ ID NO: 705128 - DNA, 25 bp, Artificial sequence
  Synthetic oligonucleotide
acccggcgcgcgtcatagccggccc

SEQ ID NO: 705129 - DNA, 25 bp, Artificial sequence
  Synthetic oligonucleotide
ggcgccgcgtagcggcgaatccccg

SEQ ID NO: 705130 - DNA, 25 bp, Artificial sequence
  Synthetic oligonucleotide
cctgcggtacgcccggtaccccggc

SEQ ID NO: 705131 - DNA, 25 bp, Artificial sequence
  Synthetic oligonucleotide
cggcgccatactcgcgcgggcaccg

SEQ ID NO: 705132 - DNA, 25 bp, Artificial sequence
  Synthetic oligonucleotide
cgacgggtacgcgggactccgcgcc

SEQ ID NO: 705133 - DNA, 25 bp, Artificial sequence
  Synthetic oligonucleotide
cgacgggtacgccggactccgcgcc

SEQ ID NO: 705134 - DNA, 25 bp, Artificial sequence
  Synthetic oligonucleotide
ggttggccgcgcgtatggggccggc

SEQ ID NO: 705135 - DNA, 25 bp, Artificial sequence
  Synthetic oligonucleotide
ggttggccgcgcctatggggccggc

SEQ ID NO: 705136 - DNA, 25 bp, Artificial sequence
  Synthetic oligonucleotide
cgccagtcgtacggccgggcgcgtg

SEQ ID NO: 705137 - DNA, 25 bp, Artificial sequence
  Synthetic oligonucleotide
ggcgccgcgtaggggcgaatccccg

SEQ ID NO: 705138 - DNA, 25 bp, Artificial sequence
  Synthetic oligonucleotide
gcgcccatcgacgctcgcggcaggc

SEQ ID NO: 705139 - DNA, 25 bp, Artificial sequence
  Synthetic oligonucleotide
cgtgggcgacgcccgacgactccgc

SEQ ID NO: 705140 - DNA, 25 bp, Artificial sequence
  Synthetic oligonucleotide
gcgccgcggccgggacatagcgtgc

SEQ ID NO: 705141 - DNA, 25 bp, Artificial sequence
  Synthetic oligonucleotide
gcgccgcggccgcgacatagcgtgc

SEQ ID NO: 705142 - DNA, 25 bp, Artificial sequence
  Synthetic oligonucleotide
ggcgcaccgacgcgagacccctgcc

SEQ ID NO: 705143 - DNA, 25 bp, Artificial sequence
  Synthetic oligonucleotide
ggcgcaccgacgggagacccctgcc

SEQ ID NO: 705144 - DNA, 25 bp, Artificial sequence
  Synthetic oligonucleotide
acccggcgcgcgacatagccggccc

SEQ ID NO: 705145 - DNA, 25 bp, Artificial sequence
  Synthetic oligonucleotide
gtcggcgggcgctaccgatcgcgcc

SEQ ID NO: 705146 - DNA, 25 bp, Artificial sequence
  Synthetic oligonucleotide
cctgcggtacgcgcggtaccccggc

SEQ ID NO: 705147 - DNA, 25 bp, Artificial sequence
  Synthetic oligonucleotide
gcgcccatcgaccctcgcggcaggc

SEQ ID NO: 705148 - DNA, 25 bp, Artificial sequence
  Synthetic oligonucleotide
gggggcagcgacggcctacgcccct

SEQ ID NO: 705149 - DNA, 25 bp, Artificial sequence
  Synthetic oligonucleotide
gggggcagcgaccgcctacgcccct

SEQ ID NO: 705150 - DNA, 25 bp, Artificial sequence
  Synthetic oligonucleotide
gggccgcgtcccctcacgacgctgc

SEQ ID NO: 705151 - DNA, 25 bp, Artificial sequence
  Synthetic oligonucleotide
ggcgcccagcgctcgtacggcccca

SEQ ID NO: 705152 - DNA, 25 bp, Artificial sequence
  Synthetic oligonucleotide
gcgcgggaccggttacgcgccaggg

SEQ ID NO: 705153 - DNA, 25 bp, Artificial sequence
  Synthetic oligonucleotide
gtcggcgggcgcaaccgatcgcgcc

SEQ ID NO: 705154 - DNA, 25 bp, Artificial sequence
  Synthetic oligonucleotide
agcggcggcgtatcacgcccgcccg

SEQ ID NO: 705155 - DNA, 25 bp, Artificial sequence
  Synthetic oligonucleotide
ggcgcccagcgcacgtacggcccca

SEQ ID NO: 705156 - DNA, 25 bp, Artificial sequence
  Synthetic oligonucleotide
gcgcgggaccggatacgcgccaggg

SEQ ID NO: 705157 - DNA, 25 bp, Artificial sequence
  Synthetic oligonucleotide
cggggctcgcgtctacggtccgccc

SEQ ID NO: 705158 - DNA, 25 bp, Artificial sequence
  Synthetic oligonucleotide
cggggctcgcgtgtacggtccgccc

SEQ ID NO: 705159 - DNA, 25 bp, Artificial sequence
  Synthetic oligonucleotide
ggcccgcgccgacggtctatcgccc

SEQ ID NO: 705160 - DNA, 25 bp, Artificial sequence
  Synthetic oligonucleotide
ggcccgcgccgagggtctatcgccc

SEQ ID NO: 705161 - DNA, 25 bp, Artificial sequence
  Synthetic oligonucleotide
gctgggcgcgtacgcccgaggccgt

SEQ ID NO: 705162 - DNA, 25 bp, Artificial sequence
  Synthetic oligonucleotide
gctgggcgcgtaggcccgaggccgt

SEQ ID NO: 705163 - DNA, 25 bp, Artificial sequence
  Synthetic oligonucleotide
ccgccctatcgcgccgcacacccgg

SEQ ID NO: 705164 - DNA, 25 bp, Artificial sequence
  Synthetic oligonucleotide
ccgccctatcgccccgcacacccgg

SEQ ID NO: 705165 - DNA, 25 bp, Artificial sequence
  Synthetic oligonucleotide
ccccggcggtcgaacgcgtgcgcca

SEQ ID NO: 705166 - DNA, 25 bp, Artificial sequence
  Synthetic oligonucleotide
agcggcggcgtaacacgcccgcccg

SEQ ID NO: 705167 - DNA, 25 bp, Artificial sequence
  Synthetic oligonucleotide
cccgcctggtcgtccgcggacgtcc

SEQ ID NO: 705168 - DNA, 25 bp, Artificial sequence
  Synthetic oligonucleotide
cccgcctggtcgaccgcggacgtcc

SEQ ID NO: 705169 - DNA, 25 bp, Artificial sequence
  Synthetic oligonucleotide
caagggcggtcgacggtgcggggcg

SEQ ID NO: 705170 - DNA, 25 bp, Artificial sequence
  Synthetic oligonucleotide
cctagggtgctcccgcgaccccccg

SEQ ID NO: 705171 - DNA, 25 bp, Artificial sequence
  Synthetic oligonucleotide
cctagggtgctcgcgcgaccccccg

SEQ ID NO: 705172 - DNA, 25 bp, Artificial sequence
  Synthetic oligonucleotide
ccccggcggtcgtacgcgtgcgcca

SEQ ID NO: 705173 - DNA, 25 bp, Artificial sequence
  Synthetic oligonucleotide
cggtgccgtcgcctaccgagcccgc

SEQ ID NO: 705174 - DNA, 25 bp, Artificial sequence
  Synthetic oligonucleotide
gttgccacgggcggtcgcacccggc

SEQ ID NO: 705175 - DNA, 25 bp, Artificial sequence
  Synthetic oligonucleotide
caagggcggtcgtcggtgcggggcg

SEQ ID NO: 705176 - DNA, 25 bp, Artificial sequence
  Synthetic oligonucleotide
tgcgcgcacgcgcagcgtacggccg

SEQ ID NO: 705177 - DNA, 25 bp, Artificial sequence
  Synthetic oligonucleotide
tgcgcgcacgcggagcgtacggccg

SEQ ID NO: 705178 - DNA, 25 bp, Artificial sequence
  Synthetic oligonucleotide
ccggcgagacgtcggacgccggagc

SEQ ID NO: 705179 - DNA, 25 bp, Artificial sequence
  Synthetic oligonucleotide
ccggcgagacgtgggacgccggagc

SEQ ID NO: 705180 - DNA, 25 bp, Artificial sequence
  Synthetic oligonucleotide
cctccccgccaccagcgacccctgg

SEQ ID NO: 705181 - DNA, 25 bp, Artificial sequence
  Synthetic oligonucleotide
cggtgccgtcgcgtaccgagcccgc

SEQ ID NO: 705182 - DNA, 25 bp, Artificial sequence
  Synthetic oligonucleotide
gttgccacgggccgtcgcacccggc

SEQ ID NO: 705183 - DNA, 25 bp, Artificial sequence
  Synthetic oligonucleotide
cctccccgccacgagcgacccctgg

SEQ ID NO: 705184 - DNA, 25 bp, Artificial sequence
  Synthetic oligonucleotide
gcggcgtaccggacgacgcgctgcg

SEQ ID NO: 705185 - DNA, 25 bp, Artificial sequence
  Synthetic oligonucleotide
gcccggggtctaggcgcgtcgggtg

SEQ ID NO: 705186 - DNA, 25 bp, Artificial sequence
  Synthetic oligonucleotide
gcccggggtctacgcgcgtcgggtg

SEQ ID NO: 705187 - DNA, 25 bp, Artificial sequence
  Synthetic oligonucleotide
ccccggcgcgatagacgccgctgcc

SEQ ID NO: 705188 - DNA, 25 bp, Artificial sequence
  Synthetic oligonucleotide
ccccggcgcgattgacgccgctgcc

SEQ ID NO: 705189 - DNA, 25 bp, Artificial sequence
  Synthetic oligonucleotide
acggcgcggtcgagctacgcgccgg

SEQ ID NO: 705190 - DNA, 25 bp, Artificial sequence
  Synthetic oligonucleotide
cggtccgggcgcgtaagccccagcg

SEQ ID NO: 705191 - DNA, 25 bp, Artificial sequence
  Synthetic oligonucleotide
gcggcgtaccggtcgacgcgctgcg

SEQ ID NO: 705192 - DNA, 25 bp, Artificial sequence
  Synthetic oligonucleotide
acggcgcggtcgtgctacgcgccgg

SEQ ID NO: 705193 - DNA, 25 bp, Artificial sequence
  Synthetic oligonucleotide
ggccgggcgcgtagcggtactggcc

SEQ ID NO: 705194 - DNA, 25 bp, Artificial sequence
  Synthetic oligonucleotide
gcggccacggacggtcggccgtcga

SEQ ID NO: 705195 - DNA, 25 bp, Artificial sequence
  Synthetic oligonucleotide
ccaggccgcgctacccgatcggggg

SEQ ID NO: 705196 - DNA, 25 bp, Artificial sequence
  Synthetic oligonucleotide
ccaggccgcgcttcccgatcggggg

SEQ ID NO: 705197 - DNA, 25 bp, Artificial sequence
  Synthetic oligonucleotide
cggtccgggcgcctaagccccagcg

SEQ ID NO: 705198 - DNA, 25 bp, Artificial sequence
  Synthetic oligonucleotide
gcggccacggaccgtcggccgtcga

SEQ ID NO: 705199 - DNA, 25 bp, Artificial sequence
  Synthetic oligonucleotide
gacgcctctacgccgcgccgctccc

SEQ ID NO: 705200 - DNA, 25 bp, Artificial sequence
  Synthetic oligonucleotide
gacgcctctacggcgcgccgctccc

SEQ ID NO: 705201 - DNA, 25 bp, Artificial sequence
  Synthetic oligonucleotide
ccgggccacgtcgcgcgacagtgcc

SEQ ID NO: 705202 - DNA, 25 bp, Artificial sequence
  Synthetic oligonucleotide
gacggctacgcggccccgtgtcggc

SEQ ID NO: 705203 - DNA, 25 bp, Artificial sequence
  Synthetic oligonucleotide
gggcgccgtcgcgcatctaccggcg

SEQ ID NO: 705204 - DNA, 25 bp, Artificial sequence
  Synthetic oligonucleotide
cgcgtgccgcgagacgcgtcctgcc

SEQ ID NO: 705205 - DNA, 25 bp, Artificial sequence
  Synthetic oligonucleotide
ccgggccacgtcccgcgacagtgcc

SEQ ID NO: 705206 - DNA, 25 bp, Artificial sequence
  Synthetic oligonucleotide
gcacgccgacggaagccgggctggc

SEQ ID NO: 705207 - DNA, 25 bp, Artificial sequence
  Synthetic oligonucleotide
gcgcgcacgcgtaagaccgccgcgg

SEQ ID NO: 705208 - DNA, 25 bp, Artificial sequence
  Synthetic oligonucleotide
ggccgggcgcgttgcggtactggcc

SEQ ID NO: 705209 - DNA, 25 bp, Artificial sequence
  Synthetic oligonucleotide
gcacgccgacggtagccgggctggc

SEQ ID NO: 705210 - DNA, 25 bp, Artificial sequence
  Synthetic oligonucleotide
ccgcgactgtcgggcgacgggccgt

SEQ ID NO: 705211 - DNA, 25 bp, Artificial sequence
  Synthetic oligonucleotide
ccgcgactgtcgcgcgacgggccgt

SEQ ID NO: 705212 - DNA, 25 bp, Artificial sequence
  Synthetic oligonucleotide
cgcccgcccggttgcgacgctgtgg

SEQ ID NO: 705213 - DNA, 25 bp, Artificial sequence
  Synthetic oligonucleotide
cgcccgcccggtagcgacgctgtgg

SEQ ID NO: 705214 - DNA, 25 bp, Artificial sequence
  Synthetic oligonucleotide
gggcggacggtatccggcgcaggcc

SEQ ID NO: 705215 - DNA, 25 bp, Artificial sequence
  Synthetic oligonucleotide
gggcggacggtaaccggcgcaggcc

SEQ ID NO: 705216 - DNA, 25 bp, Artificial sequence
  Synthetic oligonucleotide
gcgcgcacgcgttagaccgccgcgg

SEQ ID NO: 705217 - DNA, 25 bp, Artificial sequence
  Synthetic oligonucleotide
ggcgcgctcggcccgtacgtctggc

SEQ ID NO: 705218 - DNA, 25 bp, Artificial sequence
  Synthetic oligonucleotide
cctgccggccggtatagcgcgcccc

SEQ ID NO: 705219 - DNA, 25 bp, Artificial sequence
  Synthetic oligonucleotide
gggcgccgtcgcccatctaccggcg

SEQ ID NO: 705220 - DNA, 25 bp, Artificial sequence
  Synthetic oligonucleotide
gggtcgccgaacccggtcgagcgcc

SEQ ID NO: 705221 - DNA, 25 bp, Artificial sequence
  Synthetic oligonucleotide
gggtcgccgaacgcggtcgagcgcc

SEQ ID NO: 705222 - DNA, 25 bp, Artificial sequence
  Synthetic oligonucleotide
cgggccgacgtcccgcgtaccggca

SEQ ID NO: 705223 - DNA, 25 bp, Artificial sequence
  Synthetic oligonucleotide
cgggccgacgtcgcgcgtaccggca

SEQ ID NO: 705224 - DNA, 25 bp, Artificial sequence
  Synthetic oligonucleotide
cctgccggccggaatagcgcgcccc

SEQ ID NO: 705225 - DNA, 25 bp, Artificial sequence
  Synthetic oligonucleotide
agcggggcgcgagcgtctacggcgc

SEQ ID NO: 705226 - DNA, 25 bp, Artificial sequence
  Synthetic oligonucleotide
ggcctgccgacggaccggtccgtgc

SEQ ID NO: 705227 - DNA, 25 bp, Artificial sequence
  Synthetic oligonucleotide
ggcgcgctcggcgcgtacgtctggc

SEQ ID NO: 705228 - DNA, 25 bp, Artificial sequence
  Synthetic oligonucleotide
tcccgccgcgtacggggcacgcgca

SEQ ID NO: 705229 - DNA, 25 bp, Artificial sequence
  Synthetic oligonucleotide
gacggctacgcgcccccgtgtcggc

SEQ ID NO: 705230 - DNA, 25 bp, Artificial sequence
  Synthetic oligonucleotide
ttcgccgtacgagggccccgcgcgc

SEQ ID NO: 705231 - DNA, 25 bp, Artificial sequence
  Synthetic oligonucleotide
tcccgccgcgtagggggcacgcgca

SEQ ID NO: 705232 - DNA, 25 bp, Artificial sequence
  Synthetic oligonucleotide
gccgcccgtatgcgcgccgcttgcc

SEQ ID NO: 705233 - DNA, 25 bp, Artificial sequence
  Synthetic oligonucleotide
agcggggcgcgaccgtctacggcgc

SEQ ID NO: 705234 - DNA, 25 bp, Artificial sequence
  Synthetic oligonucleotide
gcaggcggtcgcctgacggcccctg

SEQ ID NO: 705235 - DNA, 25 bp, Artificial sequence
  Synthetic oligonucleotide
gccccggggtacgacgcggccatcg

SEQ ID NO: 705236 - DNA, 25 bp, Artificial sequence
  Synthetic oligonucleotide
gccccggggtaccacgcggccatcg

SEQ ID NO: 705237 - DNA, 25 bp, Artificial sequence
  Synthetic oligonucleotide
gcgcttcgcacgtcgaccgcggccg

SEQ ID NO: 705238 - DNA, 25 bp, Artificial sequence
  Synthetic oligonucleotide
gcgcttcgcacgacgaccgcggccg

SEQ ID NO: 705239 - DNA, 25 bp, Artificial sequence
  Synthetic oligonucleotide
gcgcgggccggcctaagcgcggaga

SEQ ID NO: 705240 - DNA, 25 bp, Artificial sequence
  Synthetic oligonucleotide
gcgcgggccggcgtaagcgcggaga

SEQ ID NO: 705241 - DNA, 25 bp, Artificial sequence
  Synthetic oligonucleotide
tgagcccgacccgtcggtcgcgcgg

SEQ ID NO: 705242 - DNA, 25 bp, Artificial sequence
  Synthetic oligonucleotide
cgcgctgcgtacgccgtcgcgcagg

SEQ ID NO: 705243 - DNA, 25 bp, Artificial sequence
  Synthetic oligonucleotide
tgagcccgacccctcggtcgcgcgg

SEQ ID NO: 705244 - DNA, 25 bp, Artificial sequence
  Synthetic oligonucleotide
gcaggcggtcgcgtgacggcccctg

SEQ ID NO: 705245 - DNA, 25 bp, Artificial sequence
  Synthetic oligonucleotide
ctcgcgggggtaggcgatccggcgg

SEQ ID NO: 705246 - DNA, 25 bp, Artificial sequence
  Synthetic oligonucleotide
ctcgcgggggtacgcgatccggcgg

SEQ ID NO: 705247 - DNA, 25 bp, Artificial sequence
  Synthetic oligonucleotide
gcccggcgaggcggtccgtacccag

SEQ ID NO: 705248 - DNA, 25 bp, Artificial sequence
  Synthetic oligonucleotide
gcccggcgaggccgtccgtacccag

SEQ ID NO: 705249 - DNA, 25 bp, Artificial sequence
  Synthetic oligonucleotide
ggcctgccgacgcaccggtccgtgc

SEQ ID NO: 705250 - DNA, 25 bp, Artificial sequence
  Synthetic oligonucleotide
cgcgtgccgcgacacgcgtcctgcc

SEQ ID NO: 705251 - DNA, 25 bp, Artificial sequence
  Synthetic oligonucleotide
cgcgctgcgtaccccgtcgcgcagg

SEQ ID NO: 705252 - DNA, 25 bp, Artificial sequence
  Synthetic oligonucleotide
cgtcccatcgcggggactggcgcgg

SEQ ID NO: 705253 - DNA, 25 bp, Artificial sequence
  Synthetic oligonucleotide
gccccacgccagtacgcgaggcgcg

SEQ ID NO: 705254 - DNA, 25 bp, Artificial sequence
  Synthetic oligonucleotide
agggcgggatacgaccggccggcgc

SEQ ID NO: 705255 - DNA, 25 bp, Artificial sequence
  Synthetic oligonucleotide
agggcgggataccaccggccggcgc

SEQ ID NO: 705256 - DNA, 25 bp, Artificial sequence
  Synthetic oligonucleotide
ttcgccgtacgacggccccgcgcgc

SEQ ID NO: 705257 - DNA, 25 bp, Artificial sequence
  Synthetic oligonucleotide
gccccacgccagaacgcgaggcgcg

SEQ ID NO: 705258 - DNA, 25 bp, Artificial sequence
  Synthetic oligonucleotide
gccggccgaccgtcggggtgagacc

SEQ ID NO: 705259 - DNA, 25 bp, Artificial sequence
  Synthetic oligonucleotide
tgcggcctacgggcgcgatgggggc

SEQ ID NO: 705260 - DNA, 25 bp, Artificial sequence
  Synthetic oligonucleotide
cgtcccatcgcgcggactggcgcgg

SEQ ID NO: 705261 - DNA, 25 bp, Artificial sequence
  Synthetic oligonucleotide
cgcaggggccgcgcgataggcgctc

SEQ ID NO: 705262 - DNA, 25 bp, Artificial sequence
  Synthetic oligonucleotide
gggccggcctcgggatacggacccc

SEQ ID NO: 705263 - DNA, 25 bp, Artificial sequence
  Synthetic oligonucleotide
gggccggcctcgcgatacggacccc

SEQ ID NO: 705264 - DNA, 25 bp, Artificial sequence
  Synthetic oligonucleotide
tcgcggcccggtgcgtcgtgctggc

SEQ ID NO: 705265 - DNA, 25 bp, Artificial sequence
  Synthetic oligonucleotide
tcgcggcccggtccgtcgtgctggc

SEQ ID NO: 705266 - DNA, 25 bp, Artificial sequence
  Synthetic oligonucleotide
ccgcatgaacgtgcccgcgccgggg

SEQ ID NO: 705267 - DNA, 25 bp, Artificial sequence
  Synthetic oligonucleotide
ccgcatgaacgtccccgcgccgggg

SEQ ID NO: 705268 - DNA, 25 bp, Artificial sequence
  Synthetic oligonucleotide
gccggccgaccgacggggtgagacc

SEQ ID NO: 705269 - DNA, 25 bp, Artificial sequence
  Synthetic oligonucleotide
ggcgccgcatccgtacgcggtgggc

SEQ ID NO: 705270 - DNA, 25 bp, Artificial sequence
  Synthetic oligonucleotide
ccttggccgtaacgcgcgcgcgccc

SEQ ID NO: 705271 - DNA, 25 bp, Artificial sequence
  Synthetic oligonucleotide
gccgcccgtatgggcgccgcttgcc

SEQ ID NO: 705272 - DNA, 25 bp, Artificial sequence
  Synthetic oligonucleotide
cctcgccgacgcggaccgtgtgccg

SEQ ID NO: 705273 - DNA, 25 bp, Artificial sequence
  Synthetic oligonucleotide
cctcgccgacgccgaccgtgtgccg

SEQ ID NO: 705274 - DNA, 25 bp, Artificial sequence
  Synthetic oligonucleotide
ggccgccgccgaggtacgctgcggt

SEQ ID NO: 705275 - DNA, 25 bp, Artificial sequence
  Synthetic oligonucleotide
ggccgccgccgacgtacgctgcggt

SEQ ID NO: 705276 - DNA, 25 bp, Artificial sequence
  Synthetic oligonucleotide
tgcggcctacggccgcgatgggggc

SEQ ID NO: 705277 - DNA, 25 bp, Artificial sequence
  Synthetic oligonucleotide
ccgccgtatcgccgaccgccgaccg

SEQ ID NO: 705278 - DNA, 25 bp, Artificial sequence
  Synthetic oligonucleotide
cgcagggcgaacggcgcagcaggcg

SEQ ID NO: 705279 - DNA, 25 bp, Artificial sequence
  Synthetic oligonucleotide
ggcgccgcatccctacgcggtgggc

SEQ ID NO: 705280 - DNA, 25 bp, Artificial sequence
  Synthetic oligonucleotide
agcgggaccgccgtcggaccggtgc

SEQ ID NO: 705281 - DNA, 25 bp, Artificial sequence
  Synthetic oligonucleotide
agcgggaccgccctcggaccggtgc

SEQ ID NO: 705282 - DNA, 25 bp, Artificial sequence
  Synthetic oligonucleotide
ggcggcgcgcgcggattaggcccac

SEQ ID NO: 705283 - DNA, 25 bp, Artificial sequence
  Synthetic oligonucleotide
ggcggcgcgcgccgattaggcccac

SEQ ID NO: 705284 - DNA, 25 bp, Artificial sequence
  Synthetic oligonucleotide
cgcaggggccgcccgataggcgctc

SEQ ID NO: 705285 - DNA, 25 bp, Artificial sequence
  Synthetic oligonucleotide
ccgccgtatcgcggaccgccgaccg

SEQ ID NO: 705286 - DNA, 25 bp, Artificial sequence
  Synthetic oligonucleotide
gaggggttatcgggcgcggccggcc

SEQ ID NO: 705287 - DNA, 25 bp, Artificial sequence
  Synthetic oligonucleotide
cgcggcgcccgttcgacggcggtac

SEQ ID NO: 705288 - DNA, 25 bp, Artificial sequence
  Synthetic oligonucleotide
cgcggcgcccgtacgacggcggtac

SEQ ID NO: 705289 - DNA, 25 bp, Artificial sequence
  Synthetic oligonucleotide
gcggagcgaccgagcgggtctgggc

SEQ ID NO: 705290 - DNA, 25 bp, Artificial sequence
  Synthetic oligonucleotide
gcggagcgaccgtgcgggtctgggc

SEQ ID NO: 705291 - DNA, 25 bp, Artificial sequence
  Synthetic oligonucleotide
gcaggccgtcagttcgcggggcgcg

SEQ ID NO: 705292 - DNA, 25 bp, Artificial sequence
  Synthetic oligonucleotide
gcaggccgtcagatcgcggggcgcg

SEQ ID NO: 705293 - DNA, 25 bp, Artificial sequence
  Synthetic oligonucleotide
ccggcccgcaccggtaggacacgcg

SEQ ID NO: 705294 - DNA, 25 bp, Artificial sequence
  Synthetic oligonucleotide
gagccccccgacccgagacgggtcc

SEQ ID NO: 705295 - DNA, 25 bp, Artificial sequence
  Synthetic oligonucleotide
tggcctcccgcgaacggtgcggccc

SEQ ID NO: 705296 - DNA, 25 bp, Artificial sequence
  Synthetic oligonucleotide
gaggggttatcgcgcgcggccggcc

SEQ ID NO: 705297 - DNA, 25 bp, Artificial sequence
  Synthetic oligonucleotide
gggcgcctcatgggcgcgacgcacc

SEQ ID NO: 705298 - DNA, 25 bp, Artificial sequence
  Synthetic oligonucleotide
gggcgcctcatgcgcgcgacgcacc

SEQ ID NO: 705299 - DNA, 25 bp, Artificial sequence
  Synthetic oligonucleotide
gcggcgtcgcgaccgcactcgcctg

SEQ ID NO: 705300 - DNA, 25 bp, Artificial sequence
  Synthetic oligonucleotide
gcggcgtcgcgagcgcactcgcctg

SEQ ID NO: 705301 - DNA, 25 bp, Artificial sequence
  Synthetic oligonucleotide
ttggcgccgcggctcgacgggcctc

SEQ ID NO: 705302 - DNA, 25 bp, Artificial sequence
  Synthetic oligonucleotide
gagccccccgacgcgagacgggtcc

SEQ ID NO: 705303 - DNA, 25 bp, Artificial sequence
  Synthetic oligonucleotide
ggctgacgtcacgggaccgcgcccg

SEQ ID NO: 705304 - DNA, 25 bp, Artificial sequence
  Synthetic oligonucleotide
ttggcgccgcgggtcgacgggcctc

SEQ ID NO: 705305 - DNA, 25 bp, Artificial sequence
  Synthetic oligonucleotide
cgcagggcgaaccgcgcagcaggcg

SEQ ID NO: 705306 - DNA, 25 bp, Artificial sequence
  Synthetic oligonucleotide
gagggctagcggacgaccgccgggg

SEQ ID NO: 705307 - DNA, 25 bp, Artificial sequence
  Synthetic oligonucleotide
gagggctagcggtcgaccgccgggg

SEQ ID NO: 705308 - DNA, 25 bp, Artificial sequence
  Synthetic oligonucleotide
gggtcggtatcgggccccgcaggcg

SEQ ID NO: 705309 - DNA, 25 bp, Artificial sequence
  Synthetic oligonucleotide
gggtcggtatcgcgccccgcaggcg

SEQ ID NO: 705310 - DNA, 25 bp, Artificial sequence
  Synthetic oligonucleotide
cgtgcgggtagcgcggacggcgcac

SEQ ID NO: 705311 - DNA, 25 bp, Artificial sequence
  Synthetic oligonucleotide
ggtgcgcgcttacggcgtccccccc

SEQ ID NO: 705312 - DNA, 25 bp, Artificial sequence
  Synthetic oligonucleotide
cgtgcgggtagcccggacggcgcac

SEQ ID NO: 705313 - DNA, 25 bp, Artificial sequence
  Synthetic oligonucleotide
ggctgacgtcaccggaccgcgcccg

SEQ ID NO: 705314 - DNA, 25 bp, Artificial sequence
  Synthetic oligonucleotide
gggccgcgatgccctaccggagccg

SEQ ID NO: 705315 - DNA, 25 bp, Artificial sequence
  Synthetic oligonucleotide
gggccgcgatgcgctaccggagccg

SEQ ID NO: 705316 - DNA, 25 bp, Artificial sequence
  Synthetic oligonucleotide
gggctcacgcgccgtactggcggcg

SEQ ID NO: 705317 - DNA, 25 bp, Artificial sequence
  Synthetic oligonucleotide
gggctcacgcgcggtactggcggcg

SEQ ID NO: 705318 - DNA, 25 bp, Artificial sequence
  Synthetic oligonucleotide
tggcctcccgcgtacggtgcggccc

SEQ ID NO: 705319 - DNA, 25 bp, Artificial sequence
  Synthetic oligonucleotide
ccggcccgcacccgtaggacacgcg

SEQ ID NO: 705320 - DNA, 25 bp, Artificial sequence
  Synthetic oligonucleotide
ggtgcgcgcttagggcgtccccccc

SEQ ID NO: 705321 - DNA, 25 bp, Artificial sequence
  Synthetic oligonucleotide
ccctccggccggacgcgtacagcgg

SEQ ID NO: 705322 - DNA, 25 bp, Artificial sequence
  Synthetic oligonucleotide
ccacagcgacgcgtagccgggggcc

SEQ ID NO: 705323 - DNA, 25 bp, Artificial sequence
  Synthetic oligonucleotide
gcgtccgtgcgagcgcgcaaggccg

SEQ ID NO: 705324 - DNA, 25 bp, Artificial sequence
  Synthetic oligonucleotide
gcgtccgtgcgaccgcgcaaggccg

SEQ ID NO: 705325 - DNA, 25 bp, Artificial sequence
  Synthetic oligonucleotide
cgcgctcgggccggtacgacccacc

SEQ ID NO: 705326 - DNA, 25 bp, Artificial sequence
  Synthetic oligonucleotide
cgcgctcgggcccgtacgacccacc

SEQ ID NO: 705327 - DNA, 25 bp, Artificial sequence
  Synthetic oligonucleotide
cgggtctgcgccgtgacgcgcgcga

SEQ ID NO: 705328 - DNA, 25 bp, Artificial sequence
  Synthetic oligonucleotide
cgctcctcgccccacggggaggcga

SEQ ID NO: 705329 - DNA, 25 bp, Artificial sequence
  Synthetic oligonucleotide
ccctccggccggtcgcgtacagcgg

SEQ ID NO: 705330 - DNA, 25 bp, Artificial sequence
  Synthetic oligonucleotide
ggcggcacgacgaagcgcgggcacg

SEQ ID NO: 705331 - DNA, 25 bp, Artificial sequence
  Synthetic oligonucleotide
gtggcccccgatagcggtcggcggc

SEQ ID NO: 705332 - DNA, 25 bp, Artificial sequence
  Synthetic oligonucleotide
gtggcccccgattgcggtcggcggc

SEQ ID NO: 705333 - DNA, 25 bp, Artificial sequence
  Synthetic oligonucleotide
caggaccggacgcgcgttccgcccc

SEQ ID NO: 705334 - DNA, 25 bp, Artificial sequence
  Synthetic oligonucleotide
ccttggccgtaaggcgcgcgcgccc

SEQ ID NO: 705335 - DNA, 25 bp, Artificial sequence
  Synthetic oligonucleotide
ccaccccgacgcgtatccgcgggcg

SEQ ID NO: 705336 - DNA, 25 bp, Artificial sequence
  Synthetic oligonucleotide
ccaccccgacgcctatccgcgggcg

SEQ ID NO: 705337 - DNA, 25 bp, Artificial sequence
  Synthetic oligonucleotide
cgggtctgcgccctgacgcgcgcga

SEQ ID NO: 705338 - DNA, 25 bp, Artificial sequence
  Synthetic oligonucleotide
tcgggcgcggttcgcgcctccccga

SEQ ID NO: 705339 - DNA, 25 bp, Artificial sequence
  Synthetic oligonucleotide
caggaccggacgggcgttccgcccc

SEQ ID NO: 705340 - DNA, 25 bp, Artificial sequence
  Synthetic oligonucleotide
ggggccgcgtccccgtcgacgtgag

SEQ ID NO: 705341 - DNA, 25 bp, Artificial sequence
  Synthetic oligonucleotide
tacgccgcccgatgtcgcgggggcg

SEQ ID NO: 705342 - DNA, 25 bp, Artificial sequence
  Synthetic oligonucleotide
tacgccgcccgaagtcgcgggggcg

SEQ ID NO: 705343 - DNA, 25 bp, Artificial sequence
  Synthetic oligonucleotide
cgtggccgtacgcccgtgcagcggg

SEQ ID NO: 705344 - DNA, 25 bp, Artificial sequence
  Synthetic oligonucleotide
cgtggccgtacggccgtgcagcggg

SEQ ID NO: 705345 - DNA, 25 bp, Artificial sequence
  Synthetic oligonucleotide
cgctcctcgcccgacggggaggcga

SEQ ID NO: 705346 - DNA, 25 bp, Artificial sequence
  Synthetic oligonucleotide
gggtagcgcggcgtcgagagcccgc

SEQ ID NO: 705347 - DNA, 25 bp, Artificial sequence
  Synthetic oligonucleotide
ggccccacgcggagtatgccccggg

SEQ ID NO: 705348 - DNA, 25 bp, Artificial sequence
  Synthetic oligonucleotide
tcgggcgcggttggcgcctccccga

SEQ ID NO: 705349 - DNA, 25 bp, Artificial sequence
  Synthetic oligonucleotide
aggagcgtcgcggaaccggcgcggg

SEQ ID NO: 705350 - DNA, 25 bp, Artificial sequence
  Synthetic oligonucleotide
aggagcgtcgcgcaaccggcgcggg

SEQ ID NO: 705351 - DNA, 25 bp, Artificial sequence
  Synthetic oligonucleotide
cccagagcggccggtcgatcccggg

SEQ ID NO: 705352 - DNA, 25 bp, Artificial sequence
  Synthetic oligonucleotide
cccagagcggcccgtcgatcccggg

SEQ ID NO: 705353 - DNA, 25 bp, Artificial sequence
  Synthetic oligonucleotide
ggcggcacgacgtagcgcgggcacg

SEQ ID NO: 705354 - DNA, 25 bp, Artificial sequence
  Synthetic oligonucleotide
gggtagcgcggcctcgagagcccgc

SEQ ID NO: 705355 - DNA, 25 bp, Artificial sequence
  Synthetic oligonucleotide
gcaccccgcgcgtctcgtccggctc

SEQ ID NO: 705356 - DNA, 25 bp, Artificial sequence
  Synthetic oligonucleotide
tgcgcgcgcgactactcgggcgccg

SEQ ID NO: 705357 - DNA, 25 bp, Artificial sequence
  Synthetic oligonucleotide
tgcgcgcgcgacaactcgggcgccg

SEQ ID NO: 705358 - DNA, 25 bp, Artificial sequence
  Synthetic oligonucleotide
cctcgcaccggcctccgaacgcgcc

SEQ ID NO: 705359 - DNA, 25 bp, Artificial sequence
  Synthetic oligonucleotide
cctcgcaccggcgtccgaacgcgcc

SEQ ID NO: 705360 - DNA, 25 bp, Artificial sequence
  Synthetic oligonucleotide
cgggtctcaaaccggcgcgcccgcg

SEQ ID NO: 705361 - DNA, 25 bp, Artificial sequence
  Synthetic oligonucleotide
cgggtctcaaacgggcgcgcccgcg

SEQ ID NO: 705362 - DNA, 25 bp, Artificial sequence
  Synthetic oligonucleotide
cgccgcggacgttcgtccgccagcg

SEQ ID NO: 705363 - DNA, 25 bp, Artificial sequence
  Synthetic oligonucleotide
ggccacacgctaggcgtcggcccgc

SEQ ID NO: 705364 - DNA, 25 bp, Artificial sequence
  Synthetic oligonucleotide
cggccggtcgcaacgggccggagct

SEQ ID NO: 705365 - DNA, 25 bp, Artificial sequence
  Synthetic oligonucleotide
gcaccccgcgcgactcgtccggctc

SEQ ID NO: 705366 - DNA, 25 bp, Artificial sequence
  Synthetic oligonucleotide
gcagcccgacccgtgtcggcggcgt

SEQ ID NO: 705367 - DNA, 25 bp, Artificial sequence
  Synthetic oligonucleotide
gcagcccgacccctgtcggcggcgt

SEQ ID NO: 705368 - DNA, 25 bp, Artificial sequence
  Synthetic oligonucleotide
ggctccgtcgagcgcacggtggccg

SEQ ID NO: 705369 - DNA, 25 bp, Artificial sequence
  Synthetic oligonucleotide
ggctccgtcgagggcacggtggccg

SEQ ID NO: 705370 - DNA, 25 bp, Artificial sequence
  Synthetic oligonucleotide
gcgtgccgcgtccaccggtcgccgt

SEQ ID NO: 705371 - DNA, 25 bp, Artificial sequence
  Synthetic oligonucleotide
ggccacacgctacgcgtcggcccgc

SEQ ID NO: 705372 - DNA, 25 bp, Artificial sequence
  Synthetic oligonucleotide
ggcggccgaagcggaccgtgcccgt

SEQ ID NO: 705373 - DNA, 25 bp, Artificial sequence
  Synthetic oligonucleotide
ccacagcgacgcctagccgggggcc

SEQ ID NO: 705374 - DNA, 25 bp, Artificial sequence
  Synthetic oligonucleotide
ggccccacgcggtgtatgccccggg

SEQ ID NO: 705375 - DNA, 25 bp, Artificial sequence
  Synthetic oligonucleotide
gctcaccgcgcgtcgatggggcccg

SEQ ID NO: 705376 - DNA, 25 bp, Artificial sequence
  Synthetic oligonucleotide
gctcaccgcgcgacgatggggcccg

SEQ ID NO: 705377 - DNA, 25 bp, Artificial sequence
  Synthetic oligonucleotide
ccccgacgggcgggagtagcgcacg

SEQ ID NO: 705378 - DNA, 25 bp, Artificial sequence
  Synthetic oligonucleotide
ccccgacgggcgcgagtagcgcacg

SEQ ID NO: 705379 - DNA, 25 bp, Artificial sequence
  Synthetic oligonucleotide
cacggacgtgtccaccggcggccgg

SEQ ID NO: 705380 - DNA, 25 bp, Artificial sequence
  Synthetic oligonucleotide
gcccgcacacacggcgtcggacggc

SEQ ID NO: 705381 - DNA, 25 bp, Artificial sequence
  Synthetic oligonucleotide
cacggacgtgtcgaccggcggccgg

SEQ ID NO: 705382 - DNA, 25 bp, Artificial sequence
  Synthetic oligonucleotide
ggcggccgaagccgaccgtgcccgt

SEQ ID NO: 705383 - DNA, 25 bp, Artificial sequence
  Synthetic oligonucleotide
gctcgggtcgcgccgaactcggggg

SEQ ID NO: 705384 - DNA, 25 bp, Artificial sequence
  Synthetic oligonucleotide
gctcgggtcgcggcgaactcggggg

SEQ ID NO: 705385 - DNA, 25 bp, Artificial sequence
  Synthetic oligonucleotide
gtggcggcacgcccgatagccggcg

SEQ ID NO: 705386 - DNA, 25 bp, Artificial sequence
  Synthetic oligonucleotide
gtggcggcacgcgcgatagccggcg

SEQ ID NO: 705387 - DNA, 25 bp, Artificial sequence
  Synthetic oligonucleotide
cggccggtcgcatcgggccggagct

SEQ ID NO: 705388 - DNA, 25 bp, Artificial sequence
  Synthetic oligonucleotide
cgccgcggacgtacgtccgccagcg

SEQ ID NO: 705389 - DNA, 25 bp, Artificial sequence
  Synthetic oligonucleotide
gcccgcacacaccgcgtcggacggc

SEQ ID NO: 705390 - DNA, 25 bp, Artificial sequence
  Synthetic oligonucleotide
gacgcgcgcgcaacgaccggcctcc

SEQ ID NO: 705391 - DNA, 25 bp, Artificial sequence
  Synthetic oligonucleotide
ggggccgcgtccgcgtcgacgtgag

SEQ ID NO: 705392 - DNA, 25 bp, Artificial sequence
  Synthetic oligonucleotide
cctgccggttcgtcgcgacgcgccc

SEQ ID NO: 705393 - DNA, 25 bp, Artificial sequence
  Synthetic oligonucleotide
tacgccgctagcccggacgcggcgg

SEQ ID NO: 705394 - DNA, 25 bp, Artificial sequence
  Synthetic oligonucleotide
tacgccgctagcgcggacgcggcgg

SEQ ID NO: 705395 - DNA, 25 bp, Artificial sequence
  Synthetic oligonucleotide
gcggcgccgccgtatcgcgcagcct

SEQ ID NO: 705396 - DNA, 25 bp, Artificial sequence
  Synthetic oligonucleotide
gcggcgccgccgaatcgcgcagcct

SEQ ID NO: 705397 - DNA, 25 bp, Artificial sequence
  Synthetic oligonucleotide
ggctggcggacgatcgtgcccgcgg

SEQ ID NO: 705398 - DNA, 25 bp, Artificial sequence
  Synthetic oligonucleotide
ccgcggagtacgtaccgcgcgggcc

SEQ ID NO: 705399 - DNA, 25 bp, Artificial sequence
  Synthetic oligonucleotide
ggctggcggacgttcgtgcccgcgg

SEQ ID NO: 705400 - DNA, 25 bp, Artificial sequence
  Synthetic oligonucleotide
gacgcgcgcgcatcgaccggcctcc

SEQ ID NO: 705401 - DNA, 25 bp, Artificial sequence
  Synthetic oligonucleotide
gagcggcgtagcctaggcgggcccc

SEQ ID NO: 705402 - DNA, 25 bp, Artificial sequence
  Synthetic oligonucleotide
gagcggcgtagcgtaggcgggcccc

SEQ ID NO: 705403 - DNA, 25 bp, Artificial sequence
  Synthetic oligonucleotide
cgcagccgggcgggaaacaggcgcg

SEQ ID NO: 705404 - DNA, 25 bp, Artificial sequence
  Synthetic oligonucleotide
cgcagccgggcgcgaaacaggcgcg

SEQ ID NO: 705405 - DNA, 25 bp, Artificial sequence
  Synthetic oligonucleotide
cggtcgcgtcgcgtatggggggccc

SEQ ID NO: 705406 - DNA, 25 bp, Artificial sequence
  Synthetic oligonucleotide
ccgcggagtacgaaccgcgcgggcc

SEQ ID NO: 705407 - DNA, 25 bp, Artificial sequence
  Synthetic oligonucleotide
ccggcgcgctaccggcgactcgagg

SEQ ID NO: 705408 - DNA, 25 bp, Artificial sequence
  Synthetic oligonucleotide
aggccggtcgacgtccgcgcagcgc

SEQ ID NO: 705409 - DNA, 25 bp, Artificial sequence
  Synthetic oligonucleotide
cggagcgcggcggaacgtccggacc

SEQ ID NO: 705410 - DNA, 25 bp, Artificial sequence
  Synthetic oligonucleotide
cggagcgcggcgcaacgtccggacc

SEQ ID NO: 705411 - DNA, 25 bp, Artificial sequence
  Synthetic oligonucleotide
cggtccgcgctaccgcaccgcggtg

SEQ ID NO: 705412 - DNA, 25 bp, Artificial sequence
  Synthetic oligonucleotide
cggtccgcgctagcgcaccgcggtg

SEQ ID NO: 705413 - DNA, 25 bp, Artificial sequence
  Synthetic oligonucleotide
aggggctcggacgggccgtgctccc

SEQ ID NO: 705414 - DNA, 25 bp, Artificial sequence
  Synthetic oligonucleotide
cctgccggttcgacgcgacgcgccc

SEQ ID NO: 705415 - DNA, 25 bp, Artificial sequence
  Synthetic oligonucleotide
ccggcgcgctacgggcgactcgagg

SEQ ID NO: 705416 - DNA, 25 bp, Artificial sequence
  Synthetic oligonucleotide
ggccagtcgcgaggtaccggcgcgc

SEQ ID NO: 705417 - DNA, 25 bp, Artificial sequence
  Synthetic oligonucleotide
aggcgctaccgccgagcggcgaggg

SEQ ID NO: 705418 - DNA, 25 bp, Artificial sequence
  Synthetic oligonucleotide
aggcgctaccgcggagcggcgaggg

SEQ ID NO: 705419 - DNA, 25 bp, Artificial sequence
  Synthetic oligonucleotide
agcgcctcgtaccggcgtgccgcgg

SEQ ID NO: 705420 - DNA, 25 bp, Artificial sequence
  Synthetic oligonucleotide
agcgcctcgtacgggcgtgccgcgg

SEQ ID NO: 705421 - DNA, 25 bp, Artificial sequence
  Synthetic oligonucleotide
tcgtcgccggcaaaccgcgcccgcg

SEQ ID NO: 705422 - DNA, 25 bp, Artificial sequence
  Synthetic oligonucleotide
tcgtcgccggcataccgcgcccgcg

SEQ ID NO: 705423 - DNA, 25 bp, Artificial sequence
  Synthetic oligonucleotide
aggggctcggaccggccgtgctccc

SEQ ID NO: 705424 - DNA, 25 bp, Artificial sequence
  Synthetic oligonucleotide
gcgtgggacccgcgtaccgggcacg

SEQ ID NO: 705425 - DNA, 25 bp, Artificial sequence
  Synthetic oligonucleotide
ccgcagcgatcgacacggggcgccc

SEQ ID NO: 705426 - DNA, 25 bp, Artificial sequence
  Synthetic oligonucleotide
cccggctcgtgcccgcgaaagggcg

SEQ ID NO: 705427 - DNA, 25 bp, Artificial sequence
  Synthetic oligonucleotide
cccggctcgtgcgcgcgaaagggcg

SEQ ID NO: 705428 - DNA, 25 bp, Artificial sequence
  Synthetic oligonucleotide
cggtgccggtcgcgccgtagggcca

SEQ ID NO: 705429 - DNA, 25 bp, Artificial sequence
  Synthetic oligonucleotide
cggtgccggtcgggccgtagggcca

SEQ ID NO: 705430 - DNA, 25 bp, Artificial sequence
  Synthetic oligonucleotide
tgcctctccgcggtccgacggcggg

SEQ ID NO: 705431 - DNA, 25 bp, Artificial sequence
  Synthetic oligonucleotide
cggtcgcgtcgcctatggggggccc

SEQ ID NO: 705432 - DNA, 25 bp, Artificial sequence
  Synthetic oligonucleotide
gcgtgggacccgggtaccgggcacg

SEQ ID NO: 705433 - DNA, 25 bp, Artificial sequence
  Synthetic oligonucleotide
gcggcctacgcacgacgggcgccct

SEQ ID NO: 705434 - DNA, 25 bp, Artificial sequence
  Synthetic oligonucleotide
ggtgggcggtcgatcccgcaccggg

SEQ ID NO: 705435 - DNA, 25 bp, Artificial sequence
  Synthetic oligonucleotide
ggtgggcggtcgttcccgcaccggg

SEQ ID NO: 705436 - DNA, 25 bp, Artificial sequence
  Synthetic oligonucleotide
ccaccctcgtaccggcgtcgccgcg

SEQ ID NO: 705437 - DNA, 25 bp, Artificial sequence
  Synthetic oligonucleotide
ccaccctcgtacgggcgtcgccgcg

SEQ ID NO: 705438 - DNA, 25 bp, Artificial sequence
  Synthetic oligonucleotide
cccgggctatggcgcgtcgcctccc

SEQ ID NO: 705439 - DNA, 25 bp, Artificial sequence
  Synthetic oligonucleotide
cccgggctatggggcgtcgcctccc

SEQ ID NO: 705440 - DNA, 25 bp, Artificial sequence
  Synthetic oligonucleotide
tgcctctccgcgctccgacggcggg

SEQ ID NO: 705441 - DNA, 25 bp, Artificial sequence
  Synthetic oligonucleotide
agacggcggacccgcgtacggccgc

SEQ ID NO: 705442 - DNA, 25 bp, Artificial sequence
  Synthetic oligonucleotide
aggccggtcgacctccgcgcagcgc

SEQ ID NO: 705443 - DNA, 25 bp, Artificial sequence
  Synthetic oligonucleotide
tcgggcggcttacgcgcggcctccg

SEQ ID NO: 705444 - DNA, 25 bp, Artificial sequence
  Synthetic oligonucleotide
tcgggcggcttaggcgcggcctccg

SEQ ID NO: 705445 - DNA, 25 bp, Artificial sequence
  Synthetic oligonucleotide
cgtcggatacggcgcgcgtccgcgc

SEQ ID NO: 705446 - DNA, 25 bp, Artificial sequence
  Synthetic oligonucleotide
cgtcggatacggggcgcgtccgcgc

SEQ ID NO: 705447 - DNA, 25 bp, Artificial sequence
  Synthetic oligonucleotide
gtcggcggcgtagcgtacggccgcg

SEQ ID NO: 705448 - DNA, 25 bp, Artificial sequence
  Synthetic oligonucleotide
ccgcagcgatcgtcacggggcgccc

SEQ ID NO: 705449 - DNA, 25 bp, Artificial sequence
  Synthetic oligonucleotide
agacggcggaccggcgtacggccgc

SEQ ID NO: 705450 - DNA, 25 bp, Artificial sequence
  Synthetic oligonucleotide
gcggcctacgcaggacgggcgccct

SEQ ID NO: 705451 - DNA, 25 bp, Artificial sequence
  Synthetic oligonucleotide
gcccgacgcgcgagtaccgtggggc

SEQ ID NO: 705452 - DNA, 25 bp, Artificial sequence
  Synthetic oligonucleotide
gcccgacgcgcgtgtaccgtggggc

SEQ ID NO: 705453 - DNA, 25 bp, Artificial sequence
  Synthetic oligonucleotide
gccactccgcgttgcggcaggccgg

SEQ ID NO: 705454 - DNA, 25 bp, Artificial sequence
  Synthetic oligonucleotide
gccactccgcgtagcggcaggccgg

SEQ ID NO: 705455 - DNA, 25 bp, Artificial sequence
  Synthetic oligonucleotide
gggccgcgcgacgtacgcgacctcg

SEQ ID NO: 705456 - DNA, 25 bp, Artificial sequence
  Synthetic oligonucleotide
gggccgcgcgacctacgcgacctcg

SEQ ID NO: 705457 - DNA, 25 bp, Artificial sequence
  Synthetic oligonucleotide
ggccagtcgcgacgtaccggcgcgc

SEQ ID NO: 705458 - DNA, 25 bp, Artificial sequence
  Synthetic oligonucleotide
gtcggcggcgtaccgtacggccgcg

SEQ ID NO: 705459 - DNA, 25 bp, Artificial sequence
  Synthetic oligonucleotide
gcacccacgcgccgttgcgcccgcc

SEQ ID NO: 705460 - DNA, 25 bp, Artificial sequence
  Synthetic oligonucleotide
gcggggtaccgcgtcacgggcggcg

SEQ ID NO: 705461 - DNA, 25 bp, Artificial sequence
  Synthetic oligonucleotide
gcggggtaccgcctcacgggcggcg

SEQ ID NO: 705462 - DNA, 25 bp, Artificial sequence
  Synthetic oligonucleotide
gcccgggcggtcctacgcacgcggg

SEQ ID NO: 705463 - DNA, 25 bp, Artificial sequence
  Synthetic oligonucleotide
gcacccacgcgcggttgcgcccgcc

SEQ ID NO: 705464 - DNA, 25 bp, Artificial sequence
  Synthetic oligonucleotide
aggcggccgaccgttgcgcccggcc

SEQ ID NO: 705465 - DNA, 25 bp, Artificial sequence
  Synthetic oligonucleotide
gcgcgcccgacggccgtcgagcgca

SEQ ID NO: 705466 - DNA, 25 bp, Artificial sequence
  Synthetic oligonucleotide
gcgcgcccgacgcccgtcgagcgca

SEQ ID NO: 705467 - DNA, 25 bp, Artificial sequence
  Synthetic oligonucleotide
ccgcccgcgtaaccgcgcagcgcgg

SEQ ID NO: 705468 - DNA, 25 bp, Artificial sequence
  Synthetic oligonucleotide
ccgcccgcgtaagcgcgcagcgcgg

SEQ ID NO: 705469 - DNA, 25 bp, Artificial sequence
  Synthetic oligonucleotide
gccccgtaccgccgcgtgtcgggcc

SEQ ID NO: 705470 - DNA, 25 bp, Artificial sequence
  Synthetic oligonucleotide
gccccgtaccgcggcgtgtcgggcc

SEQ ID NO: 705471 - DNA, 25 bp, Artificial sequence
  Synthetic oligonucleotide
gcccgggcggtcgtacgcacgcggg

SEQ ID NO: 705472 - DNA, 25 bp, Artificial sequence
  Synthetic oligonucleotide
gcggcgcccgcgacgggttgcgcca

SEQ ID NO: 705473 - DNA, 25 bp, Artificial sequence
  Synthetic oligonucleotide
cgggcccggtccgacgcggcactcg

SEQ ID NO: 705474 - DNA, 25 bp, Artificial sequence
  Synthetic oligonucleotide
ggcgcgctagcgcgcgtcggaggcc

SEQ ID NO: 705475 - DNA, 25 bp, Artificial sequence
  Synthetic oligonucleotide
gccaccgtcgaccggcgctgggggc

SEQ ID NO: 705476 - DNA, 25 bp, Artificial sequence
  Synthetic oligonucleotide
ggcgcgctagcgggcgtcggaggcc

SEQ ID NO: 705477 - DNA, 25 bp, Artificial sequence
  Synthetic oligonucleotide
gccgcgcgtcgcggcctaccacggg

SEQ ID NO: 705478 - DNA, 25 bp, Artificial sequence
  Synthetic oligonucleotide
ccgcgggtccgcgcatccggccacc

SEQ ID NO: 705479 - DNA, 25 bp, Artificial sequence
  Synthetic oligonucleotide
gcggcgcccgcgtcgggttgcgcca

SEQ ID NO: 705480 - DNA, 25 bp, Artificial sequence
  Synthetic oligonucleotide
ccgcgggtccgcccatccggccacc

SEQ ID NO: 705481 - DNA, 25 bp, Artificial sequence
  Synthetic oligonucleotide
ggccgctcggtcgccggtagccggc

SEQ ID NO: 705482 - DNA, 25 bp, Artificial sequence
  Synthetic oligonucleotide
ggccgctcggtccccggtagccggc

SEQ ID NO: 705483 - DNA, 25 bp, Artificial sequence
  Synthetic oligonucleotide
gggccgcggacgggtaccgctcccg

SEQ ID NO: 705484 - DNA, 25 bp, Artificial sequence
  Synthetic oligonucleotide
gggccgcggacgcgtaccgctcccg

SEQ ID NO: 705485 - DNA, 25 bp, Artificial sequence
  Synthetic oligonucleotide
gcggccttcggcgcgctacggccgg

SEQ ID NO: 705486 - DNA, 25 bp, Artificial sequence
  Synthetic oligonucleotide
aggcggccgacccttgcgcccggcc

SEQ ID NO: 705487 - DNA, 25 bp, Artificial sequence
  Synthetic oligonucleotide
gccgcgcgtcgccgcctaccacggg

SEQ ID NO: 705488 - DNA, 25 bp, Artificial sequence
  Synthetic oligonucleotide
cgggcccggtcccacgcggcactcg

SEQ ID NO: 705489 - DNA, 25 bp, Artificial sequence
  Synthetic oligonucleotide
ggcgcgcgtcgatacccgcgggccc

SEQ ID NO: 705490 - DNA, 25 bp, Artificial sequence
  Synthetic oligonucleotide
gcaggccgcggcgtaacccgcccgc

SEQ ID NO: 705491 - DNA, 25 bp, Artificial sequence
  Synthetic oligonucleotide
gcaggccgcggcctaacccgcccgc

SEQ ID NO: 705492 - DNA, 25 bp, Artificial sequence
  Synthetic oligonucleotide
ccgcgcgcccgacgcgctaccggca

SEQ ID NO: 705493 - DNA, 25 bp, Artificial sequence
  Synthetic oligonucleotide
ccgcgcgcccgaggcgctaccggca

SEQ ID NO: 705494 - DNA, 25 bp, Artificial sequence
  Synthetic oligonucleotide
gccgcctctcgagccgacgccgcgc

SEQ ID NO: 705495 - DNA, 25 bp, Artificial sequence
  Synthetic oligonucleotide
gccgcctctcgacccgacgccgcgc

SEQ ID NO: 705496 - DNA, 25 bp, Artificial sequence
  Synthetic oligonucleotide
gtggccgggtacccggcgtgggccg

SEQ ID NO: 705497 - DNA, 25 bp, Artificial sequence
  Synthetic oligonucleotide
gtggccgggtacgcggcgtgggccg

SEQ ID NO: 705498 - DNA, 25 bp, Artificial sequence
  Synthetic oligonucleotide
gcccgccgcgacggtacggcgacgc

SEQ ID NO: 705499 - DNA, 25 bp, Artificial sequence
  Synthetic oligonucleotide
ggcggcctacgtgggtccgcgcccg

SEQ ID NO: 705500 - DNA, 25 bp, Artificial sequence
  Synthetic oligonucleotide
gaccgcaccggaggacggcgggcgg

SEQ ID NO: 705501 - DNA, 25 bp, Artificial sequence
  Synthetic oligonucleotide
ccgcgcacgcgaccgttgccgcccc

SEQ ID NO: 705502 - DNA, 25 bp, Artificial sequence
  Synthetic oligonucleotide
gcggccttcggcccgctacggccgg

SEQ ID NO: 705503 - DNA, 25 bp, Artificial sequence
  Synthetic oligonucleotide
gccaccgtcgacgggcgctgggggc

SEQ ID NO: 705504 - DNA, 25 bp, Artificial sequence
  Synthetic oligonucleotide
ccgcgcacgcgagcgttgccgcccc

SEQ ID NO: 705505 - DNA, 25 bp, Artificial sequence
  Synthetic oligonucleotide
ggcagctacgggggcctcgcccccg

SEQ ID NO: 705506 - DNA, 25 bp, Artificial sequence
  Synthetic oligonucleotide
ggcagctacgggcgcctcgcccccg

SEQ ID NO: 705507 - DNA, 25 bp, Artificial sequence
  Synthetic oligonucleotide
ccgcgtcgacgcggtagcccgcgcc

SEQ ID NO: 705508 - DNA, 25 bp, Artificial sequence
  Synthetic oligonucleotide
ccgcgtcgacgccgtagcccgcgcc

SEQ ID NO: 705509 - DNA, 25 bp, Artificial sequence
  Synthetic oligonucleotide
gcgccgcgcgcgatcggaccccagg

SEQ ID NO: 705510 - DNA, 25 bp, Artificial sequence
  Synthetic oligonucleotide
gcgccgcgcgcgttcggaccccagg

SEQ ID NO: 705511 - DNA, 25 bp, Artificial sequence
  Synthetic oligonucleotide
cgcgggcgtgcgccctacgcagggg

SEQ ID NO: 705512 - DNA, 25 bp, Artificial sequence
  Synthetic oligonucleotide
cgcgggcgtgcggcctacgcagggg

SEQ ID NO: 705513 - DNA, 25 bp, Artificial sequence
  Synthetic oligonucleotide
ggggcccgcgcggctatgcccccca

SEQ ID NO: 705514 - DNA, 25 bp, Artificial sequence
  Synthetic oligonucleotide
ggggcccgcgcgcctatgcccccca

SEQ ID NO: 705515 - DNA, 25 bp, Artificial sequence
  Synthetic oligonucleotide
gcccgccgcgcgatcggtcgcggtg

SEQ ID NO: 705516 - DNA, 25 bp, Artificial sequence
  Synthetic oligonucleotide
gcccgccgcgcgttcggtcgcggtg

SEQ ID NO: 705517 - DNA, 25 bp, Artificial sequence
  Synthetic oligonucleotide
gaccgcaccggacgacggcgggcgg

SEQ ID NO: 705518 - DNA, 25 bp, Artificial sequence
  Synthetic oligonucleotide
gccagcccgtacgacggcccgggcg

SEQ ID NO: 705519 - DNA, 25 bp, Artificial sequence
  Synthetic oligonucleotide
cgcgcgcgtgcgtcgcaccccggac

SEQ ID NO: 705520 - DNA, 25 bp, Artificial sequence
  Synthetic oligonucleotide
cgcgcgcgtgcgacgcaccccggac

SEQ ID NO: 705521 - DNA, 25 bp, Artificial sequence
  Synthetic oligonucleotide
agggcgcgatacgcggccgccgcgc

SEQ ID NO: 705522 - DNA, 25 bp, Artificial sequence
  Synthetic oligonucleotide
agggcgcgatacccggccgccgcgc

SEQ ID NO: 705523 - DNA, 25 bp, Artificial sequence
  Synthetic oligonucleotide
ggccgagccaacccgcggtggggcg

SEQ ID NO: 705524 - DNA, 25 bp, Artificial sequence
  Synthetic oligonucleotide
ggccgagccaacgcgcggtggggcg

SEQ ID NO: 705525 - DNA, 25 bp, Artificial sequence
  Synthetic oligonucleotide
gcggcgtacggcccgcgcacggacg

SEQ ID NO: 705526 - DNA, 25 bp, Artificial sequence
  Synthetic oligonucleotide
ggggggagctcgggtagcgccggcc

SEQ ID NO: 705527 - DNA, 25 bp, Artificial sequence
  Synthetic oligonucleotide
gcggcgtacggcgcgcgcacggacg

SEQ ID NO: 705528 - DNA, 25 bp, Artificial sequence
  Synthetic oligonucleotide
gccagcccgtaccacggcccgggcg

SEQ ID NO: 705529 - DNA, 25 bp, Artificial sequence
  Synthetic oligonucleotide
gcgaggcgcgcgaagcgacggcgcg

SEQ ID NO: 705530 - DNA, 25 bp, Artificial sequence
  Synthetic oligonucleotide
gcgaggcgcgcgtagcgacggcgcg

SEQ ID NO: 705531 - DNA, 25 bp, Artificial sequence
  Synthetic oligonucleotide
cgcgggcgtagcgcggtacgccgcc

SEQ ID NO: 705532 - DNA, 25 bp, Artificial sequence
  Synthetic oligonucleotide
cgcgggcgtagcccggtacgccgcc

SEQ ID NO: 705533 - DNA, 25 bp, Artificial sequence
  Synthetic oligonucleotide
gccgcccgtcgcgtgagcgcgcctc

SEQ ID NO: 705534 - DNA, 25 bp, Artificial sequence
  Synthetic oligonucleotide
ggggggagctcgcgtagcgccggcc

SEQ ID NO: 705535 - DNA, 25 bp, Artificial sequence
  Synthetic oligonucleotide
cctgccacgcgccgtagcggggccc

SEQ ID NO: 705536 - DNA, 25 bp, Artificial sequence
  Synthetic oligonucleotide
tgcccccggtccgagcgacgcccgg

SEQ ID NO: 705537 - DNA, 25 bp, Artificial sequence
  Synthetic oligonucleotide
tgcccccggtcccagcgacgcccgg

SEQ ID NO: 705538 - DNA, 25 bp, Artificial sequence
  Synthetic oligonucleotide
cccgcgcgtccggtacgaggcggcc

SEQ ID NO: 705539 - DNA, 25 bp, Artificial sequence
  Synthetic oligonucleotide
cccgcgcgtccgctacgaggcggcc

SEQ ID NO: 705540 - DNA, 25 bp, Artificial sequence
  Synthetic oligonucleotide
gacccgccgcgcgtacgtgcccggg

SEQ ID NO: 705541 - DNA, 25 bp, Artificial sequence
  Synthetic oligonucleotide
gacccgccgcgcctacgtgcccggg

SEQ ID NO: 705542 - DNA, 25 bp, Artificial sequence
  Synthetic oligonucleotide
ggccgccggcgcgcgtagtaggcgc

SEQ ID NO: 705543 - DNA, 25 bp, Artificial sequence
  Synthetic oligonucleotide
acgggcgcacgcgacgaccccgccg

SEQ ID NO: 705544 - DNA, 25 bp, Artificial sequence
  Synthetic oligonucleotide
ggccgccggcgcccgtagtaggcgc

SEQ ID NO: 705545 - DNA, 25 bp, Artificial sequence
  Synthetic oligonucleotide
cctgccacgcgcggtagcggggccc

SEQ ID NO: 705546 - DNA, 25 bp, Artificial sequence
  Synthetic oligonucleotide
ccccggcccgcggtacgacgcagcg

SEQ ID NO: 705547 - DNA, 25 bp, Artificial sequence
  Synthetic oligonucleotide
ccccggcccgcgctacgacgcagcg

SEQ ID NO: 705548 - DNA, 25 bp, Artificial sequence
  Synthetic oligonucleotide
gccgcctacgtcgaccgcgggcccg

SEQ ID NO: 705549 - DNA, 25 bp, Artificial sequence
  Synthetic oligonucleotide
gccgcctacgtccaccgcgggcccg

SEQ ID NO: 705550 - DNA, 25 bp, Artificial sequence
  Synthetic oligonucleotide
ggcgcgcgtcgaaacccgcgggccc

SEQ ID NO: 705551 - DNA, 25 bp, Artificial sequence
  Synthetic oligonucleotide
cggcgcgcgcaaggcccgtgcgggt

SEQ ID NO: 705552 - DNA, 25 bp, Artificial sequence
  Synthetic oligonucleotide
acgggcgcacgccacgaccccgccg

SEQ ID NO: 705553 - DNA, 25 bp, Artificial sequence
  Synthetic oligonucleotide
gcggccggatacgcgcgggcagggc

SEQ ID NO: 705554 - DNA, 25 bp, Artificial sequence
  Synthetic oligonucleotide
gccgcccgtcgcctgagcgcgcctc

SEQ ID NO: 705555 - DNA, 25 bp, Artificial sequence
  Synthetic oligonucleotide
ccagcggtcgacggcggacggcggc

SEQ ID NO: 705556 - DNA, 25 bp, Artificial sequence
  Synthetic oligonucleotide
ccagcggtcgaccgcggacggcggc

SEQ ID NO: 705557 - DNA, 25 bp, Artificial sequence
  Synthetic oligonucleotide
gccccgctacggtgacgcggccggc

SEQ ID NO: 705558 - DNA, 25 bp, Artificial sequence
  Synthetic oligonucleotide
gccccgctacggagacgcggccggc

SEQ ID NO: 705559 - DNA, 25 bp, Artificial sequence
  Synthetic oligonucleotide
gcacgcgttcggccgcgtcccggcg

SEQ ID NO: 705560 - DNA, 25 bp, Artificial sequence
  Synthetic oligonucleotide
ggggcgtcgaccggcacgccgctgg

SEQ ID NO: 705561 - DNA, 25 bp, Artificial sequence
  Synthetic oligonucleotide
gcggccggatacccgcgggcagggc

SEQ ID NO: 705562 - DNA, 25 bp, Artificial sequence
  Synthetic oligonucleotide
ccggccgcgttcggcgatcgcgggg

SEQ ID NO: 705563 - DNA, 25 bp, Artificial sequence
  Synthetic oligonucleotide
gctgccggtcgcgccgacggcgagg

SEQ ID NO: 705564 - DNA, 25 bp, Artificial sequence
  Synthetic oligonucleotide
gctgccggtcgccccgacggcgagg

SEQ ID NO: 705565 - DNA, 25 bp, Artificial sequence
  Synthetic oligonucleotide
cccgggcgtacgggcccctgctggc

SEQ ID NO: 705566 - DNA, 25 bp, Artificial sequence
  Synthetic oligonucleotide
cccgggcgtacgcgcccctgctggc

SEQ ID NO: 705567 - DNA, 25 bp, Artificial sequence
  Synthetic oligonucleotide
gggctgtagaccgcccgcgggggcg

SEQ ID NO: 705568 - DNA, 25 bp, Artificial sequence
  Synthetic oligonucleotide
gggctgtagaccccccgcgggggcg

SEQ ID NO: 705569 - DNA, 25 bp, Artificial sequence
  Synthetic oligonucleotide
cccgccacgcgcgtacggcaccgcg

SEQ ID NO: 705570 - DNA, 25 bp, Artificial sequence
  Synthetic oligonucleotide
gcacgcgttcgggcgcgtcccggcg

SEQ ID NO: 705571 - DNA, 25 bp, Artificial sequence
  Synthetic oligonucleotide
ggcgggggccgttcgagcgccacgg

SEQ ID NO: 705572 - DNA, 25 bp, Artificial sequence
  Synthetic oligonucleotide
cccgccacgcgcctacggcaccgcg

SEQ ID NO: 705573 - DNA, 25 bp, Artificial sequence
  Synthetic oligonucleotide
ggcccgtagacgcccggcgcctccg

SEQ ID NO: 705574 - DNA, 25 bp, Artificial sequence
  Synthetic oligonucleotide
ggcccgtagacggccggcgcctccg

SEQ ID NO: 705575 - DNA, 25 bp, Artificial sequence
  Synthetic oligonucleotide
gccgggcgaccgcgcgtctacgcgg

SEQ ID NO: 705576 - DNA, 25 bp, Artificial sequence
  Synthetic oligonucleotide
gccgggcgaccgggcgtctacgcgg

SEQ ID NO: 705577 - DNA, 25 bp, Artificial sequence
  Synthetic oligonucleotide
gcggcggttccgcggcgtacggccc

SEQ ID NO: 705578 - DNA, 25 bp, Artificial sequence
  Synthetic oligonucleotide
ggggcgtcgacccgcacgccgctgg

SEQ ID NO: 705579 - DNA, 25 bp, Artificial sequence
  Synthetic oligonucleotide
ggcgggggccgtacgagcgccacgg

SEQ ID NO: 705580 - DNA, 25 bp, Artificial sequence
  Synthetic oligonucleotide
cggcgcgcgcaacgcccgtgcgggt

SEQ ID NO: 705581 - DNA, 25 bp, Artificial sequence
  Synthetic oligonucleotide
cggggggtacgcctccgcgtggcgc

SEQ ID NO: 705582 - DNA, 25 bp, Artificial sequence
  Synthetic oligonucleotide
cggggggtacgcgtccgcgtggcgc

SEQ ID NO: 705583 - DNA, 25 bp, Artificial sequence
  Synthetic oligonucleotide
cggctcccgcgccgacgtacgcgcg

SEQ ID NO: 705584 - DNA, 25 bp, Artificial sequence
  Synthetic oligonucleotide
cggctcccgcgcggacgtacgcgcg

SEQ ID NO: 705585 - DNA, 25 bp, Artificial sequence
  Synthetic oligonucleotide
cgcccctaacgtggccggcgcgcgc

SEQ ID NO: 705586 - DNA, 25 bp, Artificial sequence
  Synthetic oligonucleotide
cgcccctaacgtcgccggcgcgcgc

SEQ ID NO: 705587 - DNA, 25 bp, Artificial sequence
  Synthetic oligonucleotide
ccggccgcgttccgcgatcgcgggg

SEQ ID NO: 705588 - DNA, 25 bp, Artificial sequence
  Synthetic oligonucleotide
gcggcggttccggggcgtacggccc

SEQ ID NO: 705589 - DNA, 25 bp, Artificial sequence
  Synthetic oligonucleotide
gtggccccgttcggccgagcccggc

SEQ ID NO: 705590 - DNA, 25 bp, Artificial sequence
  Synthetic oligonucleotide
caggggcacgggggctacgccgccc

SEQ ID NO: 705591 - DNA, 25 bp, Artificial sequence
  Synthetic oligonucleotide
caggggcacgggcgctacgccgccc

SEQ ID NO: 705592 - DNA, 25 bp, Artificial sequence
  Synthetic oligonucleotide
gccggctgccgcaacgcggccggga

SEQ ID NO: 705593 - DNA, 25 bp, Artificial sequence
  Synthetic oligonucleotide
gccggctgccgctacgcggccggga

SEQ ID NO: 705594 - DNA, 25 bp, Artificial sequence
  Synthetic oligonucleotide
gggcagcgcgtacgtccgcggcgcc

SEQ ID NO: 705595 - DNA, 25 bp, Artificial sequence
  Synthetic oligonucleotide
ccgggcggcgcgtagtcgcccctcc

SEQ ID NO: 705596 - DNA, 25 bp, Artificial sequence
  Synthetic oligonucleotide
gtggccccgttccgccgagcccggc

SEQ ID NO: 705597 - DNA, 25 bp, Artificial sequence
  Synthetic oligonucleotide
ggccccaggccgtacgccgcccgct

SEQ ID NO: 705598 - DNA, 25 bp, Artificial sequence
  Synthetic oligonucleotide
tggcggtagccgcgcccgagcccgc

SEQ ID NO: 705599 - DNA, 25 bp, Artificial sequence
  Synthetic oligonucleotide
tggcggtagccgggcccgagcccgc

SEQ ID NO: 705600 - DNA, 25 bp, Artificial sequence
  Synthetic oligonucleotide
cgggcgatcgtcgggcgggcctccg

SEQ ID NO: 705601 - DNA, 25 bp, Artificial sequence
  Synthetic oligonucleotide
cgggcgatcgtccggcgggcctccg

SEQ ID NO: 705602 - DNA, 25 bp, Artificial sequence
  Synthetic oligonucleotide
gcccgccgcgaccgtacggcgacgc

SEQ ID NO: 705603 - DNA, 25 bp, Artificial sequence
  Synthetic oligonucleotide
ggcggcgacggcgtacgctggggcg

SEQ ID NO: 705604 - DNA, 25 bp, Artificial sequence
  Synthetic oligonucleotide
gggcagcgcgtaggtccgcggcgcc

SEQ ID NO: 705605 - DNA, 25 bp, Artificial sequence
  Synthetic oligonucleotide
gtggcgcggtccgggcgtacgcccc

SEQ ID NO: 705606 - DNA, 25 bp, Artificial sequence
  Synthetic oligonucleotide
ccgcgggttcgtcgcgcggcgtccg

SEQ ID NO: 705607 - DNA, 25 bp, Artificial sequence
  Synthetic oligonucleotide
cgcacggtcatcggcgcggcccccg

SEQ ID NO: 705608 - DNA, 25 bp, Artificial sequence
  Synthetic oligonucleotide
cgcacggtcatccgcgcggcccccg

SEQ ID NO: 705609 - DNA, 25 bp, Artificial sequence
  Synthetic oligonucleotide
cgggcgggtcgtcgcgaacggcggc

SEQ ID NO: 705610 - DNA, 25 bp, Artificial sequence
  Synthetic oligonucleotide
cgggcgggtcgtggcgaacggcggc

SEQ ID NO: 705611 - DNA, 25 bp, Artificial sequence
  Synthetic oligonucleotide
ccgagctcgcgctaggccccccgcg

SEQ ID NO: 705612 - DNA, 25 bp, Artificial sequence
  Synthetic oligonucleotide
cgcgtgcggcgtcggatcggcggcg

SEQ ID NO: 705613 - DNA, 25 bp, Artificial sequence
  Synthetic oligonucleotide
gtggcgcggtcccggcgtacgcccc

SEQ ID NO: 705614 - DNA, 25 bp, Artificial sequence
  Synthetic oligonucleotide
cgcgtgcggcgtgggatcggcggcg

SEQ ID NO: 705615 - DNA, 25 bp, Artificial sequence
  Synthetic oligonucleotide
cggggcgccgcggctcgtaggccac

SEQ ID NO: 705616 - DNA, 25 bp, Artificial sequence
  Synthetic oligonucleotide
cggggcgccgcgcctcgtaggccac

SEQ ID NO: 705617 - DNA, 25 bp, Artificial sequence
  Synthetic oligonucleotide
gccggcgccctcgcgtcgactgccc

SEQ ID NO: 705618 - DNA, 25 bp, Artificial sequence
  Synthetic oligonucleotide
gccggcgccctcccgtcgactgccc

SEQ ID NO: 705619 - DNA, 25 bp, Artificial sequence
  Synthetic oligonucleotide
ggccccaggccgaacgccgcccgct

SEQ ID NO: 705620 - DNA, 25 bp, Artificial sequence
  Synthetic oligonucleotide
cgcggcggttacgcggccgccgcca

SEQ ID NO: 705621 - DNA, 25 bp, Artificial sequence
  Synthetic oligonucleotide
ccgagctcgcgcaaggccccccgcg

SEQ ID NO: 705622 - DNA, 25 bp, Artificial sequence
  Synthetic oligonucleotide
gcgcccccgtgtagcgcaccccccc

SEQ ID NO: 705623 - DNA, 25 bp, Artificial sequence
  Synthetic oligonucleotide
ggccaccgcggtccgacgcccccca

SEQ ID NO: 705624 - DNA, 25 bp, Artificial sequence
  Synthetic oligonucleotide
ggtgcgtacgcccccccggcgccac

SEQ ID NO: 705625 - DNA, 25 bp, Artificial sequence
  Synthetic oligonucleotide
ggtgcgtacgccgccccggcgccac

SEQ ID NO: 705626 - DNA, 25 bp, Artificial sequence
  Synthetic oligonucleotide
ggcccgtcgtcgggcacccggcgag

SEQ ID NO: 705627 - DNA, 25 bp, Artificial sequence
  Synthetic oligonucleotide
ggcccgtcgtcgcgcacccggcgag

SEQ ID NO: 705628 - DNA, 25 bp, Artificial sequence
  Synthetic oligonucleotide
cgcccgtgcgcgcatcgagggccgc

SEQ ID NO: 705629 - DNA, 25 bp, Artificial sequence
  Synthetic oligonucleotide
ctccccggtcccgcgtacggcgcgc

SEQ ID NO: 705630 - DNA, 25 bp, Artificial sequence
  Synthetic oligonucleotide
ccgccctcgcggcgctgtacgcggg

SEQ ID NO: 705631 - DNA, 25 bp, Artificial sequence
  Synthetic oligonucleotide
ctggggcggtccgctagcggcccgg

SEQ ID NO: 705632 - DNA, 25 bp, Artificial sequence
  Synthetic oligonucleotide
gcgcccccgtgttgcgcaccccccc

SEQ ID NO: 705633 - DNA, 25 bp, Artificial sequence
  Synthetic oligonucleotide
cgggcccgtcctggcaacgccgccc

SEQ ID NO: 705634 - DNA, 25 bp, Artificial sequence
  Synthetic oligonucleotide
cgggcccgtcctcgcaacgccgccc

SEQ ID NO: 705635 - DNA, 25 bp, Artificial sequence
  Synthetic oligonucleotide
gccgtgtcgaacgggccgcggggcc

SEQ ID NO: 705636 - DNA, 25 bp, Artificial sequence
  Synthetic oligonucleotide
gccgtgtcgaaccggccgcggggcc

SEQ ID NO: 705637 - DNA, 25 bp, Artificial sequence
  Synthetic oligonucleotide
ccgggcggcgcgaagtcgcccctcc

SEQ ID NO: 705638 - DNA, 25 bp, Artificial sequence
  Synthetic oligonucleotide
cgcccgtgcgcggatcgagggccgc

SEQ ID NO: 705639 - DNA, 25 bp, Artificial sequence
  Synthetic oligonucleotide
cccgcctcgttgggcgtcgccgggg

SEQ ID NO: 705640 - DNA, 25 bp, Artificial sequence
  Synthetic oligonucleotide
cgccccttgcgccaccgtccgcggg

SEQ ID NO: 705641 - DNA, 25 bp, Artificial sequence
  Synthetic oligonucleotide
cgcggcggttacccggccgccgcca

SEQ ID NO: 705642 - DNA, 25 bp, Artificial sequence
  Synthetic oligonucleotide
ggcgggcccgtaggctcggcggcga

SEQ ID NO: 705643 - DNA, 25 bp, Artificial sequence
  Synthetic oligonucleotide
ggcgggcccgtacgctcggcggcga

SEQ ID NO: 705644 - DNA, 25 bp, Artificial sequence
  Synthetic oligonucleotide
ccggcgccgtagctcgcgacccgcc

SEQ ID NO: 705645 - DNA, 25 bp, Artificial sequence
  Synthetic oligonucleotide
ccggcgccgtaggtcgcgacccgcc

SEQ ID NO: 705646 - DNA, 25 bp, Artificial sequence
  Synthetic oligonucleotide
ctccccggtcccccgtacggcgcgc

SEQ ID NO: 705647 - DNA, 25 bp, Artificial sequence
  Synthetic oligonucleotide
gagggcaccgtcgcgcctcgggcgg

SEQ ID NO: 705648 - DNA, 25 bp, Artificial sequence
  Synthetic oligonucleotide
ggccaccgcggtgcgacgcccccca

SEQ ID NO: 705649 - DNA, 25 bp, Artificial sequence
  Synthetic oligonucleotide
cccgcctcgttgcgcgtcgccgggg

SEQ ID NO: 705650 - DNA, 25 bp, Artificial sequence
  Synthetic oligonucleotide
ggcgctcgtacgaccgcccggccgg

SEQ ID NO: 705651 - DNA, 25 bp, Artificial sequence
  Synthetic oligonucleotide
ggcgctcgtacgtccgcccggccgg

SEQ ID NO: 705652 - DNA, 25 bp, Artificial sequence
  Synthetic oligonucleotide
ggggcgcgtgcggcgtacgtgggcc

SEQ ID NO: 705653 - DNA, 25 bp, Artificial sequence
  Synthetic oligonucleotide
ggggcgcgtgcgccgtacgtgggcc

SEQ ID NO: 705654 - DNA, 25 bp, Artificial sequence
  Synthetic oligonucleotide
ctggggcggtcccctagcggcccgg

SEQ ID NO: 705655 - DNA, 25 bp, Artificial sequence
  Synthetic oligonucleotide
gagggcaccgtcccgcctcgggcgg

SEQ ID NO: 705656 - DNA, 25 bp, Artificial sequence
  Synthetic oligonucleotide
tccgccgggcggtcgtacggcggcc

SEQ ID NO: 705657 - DNA, 25 bp, Artificial sequence
  Synthetic oligonucleotide
ggcgggtacgcgagggcggcccgct

SEQ ID NO: 705658 - DNA, 25 bp, Artificial sequence
  Synthetic oligonucleotide
cgccggtggtaccgcgacggcgcgc

SEQ ID NO: 705659 - DNA, 25 bp, Artificial sequence
  Synthetic oligonucleotide
ggctgcgccgcgtcgtacgcccgcc

SEQ ID NO: 705660 - DNA, 25 bp, Artificial sequence
  Synthetic oligonucleotide
ggctgcgccgcgacgtacgcccgcc

SEQ ID NO: 705661 - DNA, 25 bp, Artificial sequence
  Synthetic oligonucleotide
ccggtcacgacgcgtgcggggcccc

SEQ ID NO: 705662 - DNA, 25 bp, Artificial sequence
  Synthetic oligonucleotide
ccggtcacgacgggtgcggggcccc

SEQ ID NO: 705663 - DNA, 25 bp, Artificial sequence
  Synthetic oligonucleotide
ccgccctcgcggggctgtacgcggg

SEQ ID NO: 705664 - DNA, 25 bp, Artificial sequence
  Synthetic oligonucleotide
ggcgggcggtaccaccgcgcggagc

SEQ ID NO: 705665 - DNA, 25 bp, Artificial sequence
  Synthetic oligonucleotide
cgcgcgggtgcggcccgtaccgacc

SEQ ID NO: 705666 - DNA, 25 bp, Artificial sequence
  Synthetic oligonucleotide
tccgccgggcggacgtacggcggcc

SEQ ID NO: 705667 - DNA, 25 bp, Artificial sequence
  Synthetic oligonucleotide
cacgcctcgctagcgcgccgggcgc

SEQ ID NO: 705668 - DNA, 25 bp, Artificial sequence
  Synthetic oligonucleotide
cacgcctcgctaccgcgccgggcgc

SEQ ID NO: 705669 - DNA, 25 bp, Artificial sequence
  Synthetic oligonucleotide
gcggcgcgaccgcctcgaacggccg

SEQ ID NO: 705670 - DNA, 25 bp, Artificial sequence
  Synthetic oligonucleotide
gcggcgcgaccggctcgaacggccg

SEQ ID NO: 705671 - DNA, 25 bp, Artificial sequence
  Synthetic oligonucleotide
ccgcgggttcgtggcgcggcgtccg

SEQ ID NO: 705672 - DNA, 25 bp, Artificial sequence
  Synthetic oligonucleotide
ggcgggcggtacgaccgcgcggagc

SEQ ID NO: 705673 - DNA, 25 bp, Artificial sequence
  Synthetic oligonucleotide
gggccggcgccgggtacatggccgg

SEQ ID NO: 705674 - DNA, 25 bp, Artificial sequence
  Synthetic oligonucleotide
tggccggggccgatcgacgcccggc

SEQ ID NO: 705675 - DNA, 25 bp, Artificial sequence
  Synthetic oligonucleotide
tggccggggccgttcgacgcccggc

SEQ ID NO: 705676 - DNA, 25 bp, Artificial sequence
  Synthetic oligonucleotide
ccgcgcgccgtagcgcggtgcagcc

SEQ ID NO: 705677 - DNA, 25 bp, Artificial sequence
  Synthetic oligonucleotide
ccgcgcgccgtaccgcggtgcagcc

SEQ ID NO: 705678 - DNA, 25 bp, Artificial sequence
  Synthetic oligonucleotide
cggcctctcgacccgggggtgcccc

SEQ ID NO: 705679 - DNA, 25 bp, Artificial sequence
  Synthetic oligonucleotide
cggcctctcgacgcgggggtgcccc

SEQ ID NO: 705680 - DNA, 25 bp, Artificial sequence
  Synthetic oligonucleotide
cgccggtggtacggcgacggcgcgc

SEQ ID NO: 705681 - DNA, 25 bp, Artificial sequence
  Synthetic oligonucleotide
ccccgccggacggccgtatcggcgc

SEQ ID NO: 705682 - DNA, 25 bp, Artificial sequence
  Synthetic oligonucleotide
ggcggcgacggcctacgctggggcg

SEQ ID NO: 705683 - DNA, 25 bp, Artificial sequence
  Synthetic oligonucleotide
gggccggcgccgcgtacatggccgg

SEQ ID NO: 705684 - DNA, 25 bp, Artificial sequence
  Synthetic oligonucleotide
gcgcgggcgcgtgtcgagggctcgg

SEQ ID NO: 705685 - DNA, 25 bp, Artificial sequence
  Synthetic oligonucleotide
gcgcgggcgcgtctcgagggctcgg

SEQ ID NO: 705686 - DNA, 25 bp, Artificial sequence
  Synthetic oligonucleotide
gccgcggtaccgtcgagcgccggcc

SEQ ID NO: 705687 - DNA, 25 bp, Artificial sequence
  Synthetic oligonucleotide
gccgcggtaccgacgagcgccggcc

SEQ ID NO: 705688 - DNA, 25 bp, Artificial sequence
  Synthetic oligonucleotide
cgcgcgggtgcgccccgtaccgacc

SEQ ID NO: 705689 - DNA, 25 bp, Artificial sequence
  Synthetic oligonucleotide
ccccgccggacgcccgtatcggcgc

SEQ ID NO: 705690 - DNA, 25 bp, Artificial sequence
  Synthetic oligonucleotide
ccggcgaccccgcgcgtacgtcgcg

SEQ ID NO: 705691 - DNA, 25 bp, Artificial sequence
  Synthetic oligonucleotide
ggcgggtacgcgtgggcggcccgct

SEQ ID NO: 705692 - DNA, 25 bp, Artificial sequence
  Synthetic oligonucleotide
ggcgtggtcgaccgtccgccgcgcg

SEQ ID NO: 705693 - DNA, 25 bp, Artificial sequence
  Synthetic oligonucleotide
cgtccgcggccccacgtacggccgc

SEQ ID NO: 705694 - DNA, 25 bp, Artificial sequence
  Synthetic oligonucleotide
cgtccgcggcccgacgtacggccgc

SEQ ID NO: 705695 - DNA, 25 bp, Artificial sequence
  Synthetic oligonucleotide
gacgggcgcgaccgtcgacccggcg

SEQ ID NO: 705696 - DNA, 25 bp, Artificial sequence
  Synthetic oligonucleotide
gacgggcgcgacggtcgacccggcg

SEQ ID NO: 705697 - DNA, 25 bp, Artificial sequence
  Synthetic oligonucleotide
gcctgggtgtcgtccgcgccccggc

SEQ ID NO: 705698 - DNA, 25 bp, Artificial sequence
  Synthetic oligonucleotide
cgcgggtgcgtacgcagcgggcggg

SEQ ID NO: 705699 - DNA, 25 bp, Artificial sequence
  Synthetic oligonucleotide
gcctgggtgtcgaccgcgccccggc

SEQ ID NO: 705700 - DNA, 25 bp, Artificial sequence
  Synthetic oligonucleotide
ccggcgaccccgggcgtacgtcgcg

SEQ ID NO: 705701 - DNA, 25 bp, Artificial sequence
  Synthetic oligonucleotide
ggcagggtcggagcgcggagggccc

SEQ ID NO: 705702 - DNA, 25 bp, Artificial sequence
  Synthetic oligonucleotide
ggagccagcgcgaccggtgcgcggg

SEQ ID NO: 705703 - DNA, 25 bp, Artificial sequence
  Synthetic oligonucleotide
ggccggcgtcggccgtacggcaggg

SEQ ID NO: 705704 - DNA, 25 bp, Artificial sequence
  Synthetic oligonucleotide
ggccggcgtcgggcgtacggcaggg

SEQ ID NO: 705705 - DNA, 25 bp, Artificial sequence
  Synthetic oligonucleotide
ggagccagcgcgtccggtgcgcggg

SEQ ID NO: 705706 - DNA, 25 bp, Artificial sequence
  Synthetic oligonucleotide
cgcgggtgcgtaggcagcgggcggg

SEQ ID NO: 705707 - DNA, 25 bp, Artificial sequence
  Synthetic oligonucleotide
cggcgcgtacggcgcgatccggcgg

SEQ ID NO: 705708 - DNA, 25 bp, Artificial sequence
  Synthetic oligonucleotide
ggcggcctacgtcggtccgcgcccg

SEQ ID NO: 705709 - DNA, 25 bp, Artificial sequence
  Synthetic oligonucleotide
ccccgcggtagcgtccacgggccgc

SEQ ID NO: 705710 - DNA, 25 bp, Artificial sequence
  Synthetic oligonucleotide
ccccgcggtagcctccacgggccgc

SEQ ID NO: 705711 - DNA, 25 bp, Artificial sequence
  Synthetic oligonucleotide
cgcggtgccgggacgacgtggcgcc

SEQ ID NO: 705712 - DNA, 25 bp, Artificial sequence
  Synthetic oligonucleotide
cgcggtgccgggtcgacgtggcgcc

SEQ ID NO: 705713 - DNA, 25 bp, Artificial sequence
  Synthetic oligonucleotide
ggcggccgcgccggatcgtcctggc

SEQ ID NO: 705714 - DNA, 25 bp, Artificial sequence
  Synthetic oligonucleotide
ggcgtggtcgacggtccgccgcgcg

SEQ ID NO: 705715 - DNA, 25 bp, Artificial sequence
  Synthetic oligonucleotide
cggcgcgtacggggcgatccggcgg

SEQ ID NO: 705716 - DNA, 25 bp, Artificial sequence
  Synthetic oligonucleotide
cgccccttgcgcgaccgtccgcggg

SEQ ID NO: 705717 - DNA, 25 bp, Artificial sequence
  Synthetic oligonucleotide
ggggcgacgcgcgggcctacctggc

SEQ ID NO: 705718 - DNA, 25 bp, Artificial sequence
  Synthetic oligonucleotide
ggggcgacgcgccggcctacctggc

SEQ ID NO: 705719 - DNA, 25 bp, Artificial sequence
  Synthetic oligonucleotide
cgcccccgcgtagcgagggcaggcg

SEQ ID NO: 705720 - DNA, 25 bp, Artificial sequence
  Synthetic oligonucleotide
cgcccccgcgtaccgagggcaggcg

SEQ ID NO: 705721 - DNA, 25 bp, Artificial sequence
  Synthetic oligonucleotide
ccgggcacaacccgtccgccgcgcg

SEQ ID NO: 705722 - DNA, 25 bp, Artificial sequence
  Synthetic oligonucleotide
ccgggcacaaccggtccgccgcgcg

SEQ ID NO: 705723 - DNA, 25 bp, Artificial sequence
  Synthetic oligonucleotide
ggcggccgcgcccgatcgtcctggc

SEQ ID NO: 705724 - DNA, 25 bp, Artificial sequence
  Synthetic oligonucleotide
gacgcgctcccgctacgcgcgcccg

SEQ ID NO: 705725 - DNA, 25 bp, Artificial sequence
  Synthetic oligonucleotide
cgcggggcgaccactcgcgggcgct

SEQ ID NO: 705726 - DNA, 25 bp, Artificial sequence
  Synthetic oligonucleotide
cgcggggcgacctctcgcgggcgct

SEQ ID NO: 705727 - DNA, 25 bp, Artificial sequence
  Synthetic oligonucleotide
ggccgaaccggtggacgcgggccgc

SEQ ID NO: 705728 - DNA, 25 bp, Artificial sequence
  Synthetic oligonucleotide
ggccgaaccggtcgacgcgggccgc

SEQ ID NO: 705729 - DNA, 25 bp, Artificial sequence
  Synthetic oligonucleotide
cgcggctcgccggtaggcgccgtgc

SEQ ID NO: 705730 - DNA, 25 bp, Artificial sequence
  Synthetic oligonucleotide
gcggcggcggccgttgcgtggccca

SEQ ID NO: 705731 - DNA, 25 bp, Artificial sequence
  Synthetic oligonucleotide
gacgcgctcccggtacgcgcgcccg

SEQ ID NO: 705732 - DNA, 25 bp, Artificial sequence
  Synthetic oligonucleotide
gcgcgataccccccgcgaccccccg

SEQ ID NO: 705733 - DNA, 25 bp, Artificial sequence
  Synthetic oligonucleotide
cggccctatgcgcgccgcggccacg

SEQ ID NO: 705734 - DNA, 25 bp, Artificial sequence
  Synthetic oligonucleotide
cggccctatgcgggccgcggccacg

SEQ ID NO: 705735 - DNA, 25 bp, Artificial sequence
  Synthetic oligonucleotide
ccggcgcgcccgcgcgataggtggg

SEQ ID NO: 705736 - DNA, 25 bp, Artificial sequence
  Synthetic oligonucleotide
cccctggcgcgagcctacggggcgc

SEQ ID NO: 705737 - DNA, 25 bp, Artificial sequence
  Synthetic oligonucleotide
cgcggcaccggggcgtacggctccg

SEQ ID NO: 705738 - DNA, 25 bp, Artificial sequence
  Synthetic oligonucleotide
cgcggcaccgggccgtacggctccg

SEQ ID NO: 705739 - DNA, 25 bp, Artificial sequence
  Synthetic oligonucleotide
cgcggctcgccgctaggcgccgtgc

SEQ ID NO: 705740 - DNA, 25 bp, Artificial sequence
  Synthetic oligonucleotide
gccgcaccgcgcctcgcaagccggc

SEQ ID NO: 705741 - DNA, 25 bp, Artificial sequence
  Synthetic oligonucleotide
gcggcggcggcccttgcgtggccca

SEQ ID NO: 705742 - DNA, 25 bp, Artificial sequence
  Synthetic oligonucleotide
ccgcgcggttcgcccgcgtcggagc

SEQ ID NO: 705743 - DNA, 25 bp, Artificial sequence
  Synthetic oligonucleotide
ccgcgcggttcggccgcgtcggagc

SEQ ID NO: 705744 - DNA, 25 bp, Artificial sequence
  Synthetic oligonucleotide
gcgggctcgcgagcgcgcacgctgc

SEQ ID NO: 705745 - DNA, 25 bp, Artificial sequence
  Synthetic oligonucleotide
gcgggctcgcgaccgcgcacgctgc

SEQ ID NO: 705746 - DNA, 25 bp, Artificial sequence
  Synthetic oligonucleotide
gcggggcgtatccggaccgcccgcg

SEQ ID NO: 705747 - DNA, 25 bp, Artificial sequence
  Synthetic oligonucleotide
gcgcagcgcacgttcgcggcgcggg

SEQ ID NO: 705748 - DNA, 25 bp, Artificial sequence
  Synthetic oligonucleotide
gccgcaccgcgcgtcgcaagccggc

SEQ ID NO: 705749 - DNA, 25 bp, Artificial sequence
  Synthetic oligonucleotide
gcgcagcgcacgatcgcggcgcggg

SEQ ID NO: 705750 - DNA, 25 bp, Artificial sequence
  Synthetic oligonucleotide
cgggtcggtcgttcgcgcggcccgc

SEQ ID NO: 705751 - DNA, 25 bp, Artificial sequence
  Synthetic oligonucleotide
cgggtcggtcgtacgcgcggcccgc

SEQ ID NO: 705752 - DNA, 25 bp, Artificial sequence
  Synthetic oligonucleotide
gggctctgtcggtccgcgggccgcg

SEQ ID NO: 705753 - DNA, 25 bp, Artificial sequence
  Synthetic oligonucleotide
gggctctgtcggaccgcgggccgcg

SEQ ID NO: 705754 - DNA, 25 bp, Artificial sequence
  Synthetic oligonucleotide
gcgcgataccccgcgcgaccccccg

SEQ ID NO: 705755 - DNA, 25 bp, Artificial sequence
  Synthetic oligonucleotide
gcggcagcccggtgcgacgcgaccc

SEQ ID NO: 705756 - DNA, 25 bp, Artificial sequence
  Synthetic oligonucleotide
gcggggcgtatcgggaccgcccgcg

SEQ ID NO: 705757 - DNA, 25 bp, Artificial sequence
  Synthetic oligonucleotide
ccgcccccctggttcggcgcgaggc

SEQ ID NO: 705758 - DNA, 25 bp, Artificial sequence
  Synthetic oligonucleotide
ggcgcgacggtcccgggtagccccc

SEQ ID NO: 705759 - DNA, 25 bp, Artificial sequence
  Synthetic oligonucleotide
tccgggccgctccgcggtagggcgc

SEQ ID NO: 705760 - DNA, 25 bp, Artificial sequence
  Synthetic oligonucleotide
ccgccacgcgctgggtcgaggcccg

SEQ ID NO: 705761 - DNA, 25 bp, Artificial sequence
  Synthetic oligonucleotide
ccgccacgcgctcggtcgaggcccg

SEQ ID NO: 705762 - DNA, 25 bp, Artificial sequence
  Synthetic oligonucleotide
gccggtgcgcggtcgtgtccgcgcc

SEQ ID NO: 705763 - DNA, 25 bp, Artificial sequence
  Synthetic oligonucleotide
gccggtgcgcggacgtgtccgcgcc

SEQ ID NO: 705764 - DNA, 25 bp, Artificial sequence
  Synthetic oligonucleotide
gaccccgggacgtgcgtcggcccgc

SEQ ID NO: 705765 - DNA, 25 bp, Artificial sequence
  Synthetic oligonucleotide
ggcgcgcgcgtggcgactaccggcg

SEQ ID NO: 705766 - DNA, 25 bp, Artificial sequence
  Synthetic oligonucleotide
gaccccgggacgagcgtcggcccgc

SEQ ID NO: 705767 - DNA, 25 bp, Artificial sequence
  Synthetic oligonucleotide
ccgcccccctggatcggcgcgaggc

SEQ ID NO: 705768 - DNA, 25 bp, Artificial sequence
  Synthetic oligonucleotide
cggcgcgggcggaacggtcgcacgg

SEQ ID NO: 705769 - DNA, 25 bp, Artificial sequence
  Synthetic oligonucleotide
ccggccgtcggtcggcacgccggtc

SEQ ID NO: 705770 - DNA, 25 bp, Artificial sequence
  Synthetic oligonucleotide
cggcgcgggcggtacggtcgcacgg

SEQ ID NO: 705771 - DNA, 25 bp, Artificial sequence
  Synthetic oligonucleotide
ggcagggtcggaccgcggagggccc

SEQ ID NO: 705772 - DNA, 25 bp, Artificial sequence
  Synthetic oligonucleotide
ggcgtgcgtctacgcgcgggggccg

SEQ ID NO: 705773 - DNA, 25 bp, Artificial sequence
  Synthetic oligonucleotide
ggcgcgcgcgtgccgactaccggcg

SEQ ID NO: 705774 - DNA, 25 bp, Artificial sequence
  Synthetic oligonucleotide
cgaccctcgacgcgagggccgcggc

SEQ ID NO: 705775 - DNA, 25 bp, Artificial sequence
  Synthetic oligonucleotide
ccggcgcgcccgggcgataggtggg

SEQ ID NO: 705776 - DNA, 25 bp, Artificial sequence
  Synthetic oligonucleotide
gcggcagcccggagcgacgcgaccc

SEQ ID NO: 705777 - DNA, 25 bp, Artificial sequence
  Synthetic oligonucleotide
aggccccgcgtgcgacacggcgggc

SEQ ID NO: 705778 - DNA, 25 bp, Artificial sequence
  Synthetic oligonucleotide
aggccccgcgtgggacacggcgggc

SEQ ID NO: 705779 - DNA, 25 bp, Artificial sequence
  Synthetic oligonucleotide
cggcggcgtcgcctagggagggcgc

SEQ ID NO: 705780 - DNA, 25 bp, Artificial sequence
  Synthetic oligonucleotide
cggcggcgtcgcgtagggagggcgc

SEQ ID NO: 705781 - DNA, 25 bp, Artificial sequence
  Synthetic oligonucleotide
tccgggccgctcggcggtagggcgc

SEQ ID NO: 705782 - DNA, 25 bp, Artificial sequence
  Synthetic oligonucleotide
gggccctcggacccccgtccggtgc

SEQ ID NO: 705783 - DNA, 25 bp, Artificial sequence
  Synthetic oligonucleotide
ggcgcgacggtcgcgggtagccccc

SEQ ID NO: 705784 - DNA, 25 bp, Artificial sequence
  Synthetic oligonucleotide
cgaccctcgacgggagggccgcggc

SEQ ID NO: 705785 - DNA, 25 bp, Artificial sequence
  Synthetic oligonucleotide
cccgcgcgtcccgacgtcggcggct

SEQ ID NO: 705786 - DNA, 25 bp, Artificial sequence
  Synthetic oligonucleotide
cccgcgcgtccccacgtcggcggct

SEQ ID NO: 705787 - DNA, 25 bp, Artificial sequence
  Synthetic oligonucleotide
ggcgtgcgtctaggcgcgggggccg

SEQ ID NO: 705788 - DNA, 25 bp, Artificial sequence
  Synthetic oligonucleotide
ggccgggcgtcccagcggtcggtcc

SEQ ID NO: 705789 - DNA, 25 bp, Artificial sequence
  Synthetic oligonucleotide
ggccgggcgtccgagcggtcggtcc

SEQ ID NO: 705790 - DNA, 25 bp, Artificial sequence
  Synthetic oligonucleotide
gggccctcggacgcccgtccggtgc

SEQ ID NO: 705791 - DNA, 25 bp, Artificial sequence
  Synthetic oligonucleotide
ccgcggcgggcgcgacgtaccccac

SEQ ID NO: 705792 - DNA, 25 bp, Artificial sequence
  Synthetic oligonucleotide
ggcggcgccccgaagtcgaccggcc

SEQ ID NO: 705793 - DNA, 25 bp, Artificial sequence
  Synthetic oligonucleotide
ggccgctcggtaggggcgcaggccc

SEQ ID NO: 705794 - DNA, 25 bp, Artificial sequence
  Synthetic oligonucleotide
ggccgctcggtacgggcgcaggccc

SEQ ID NO: 705795 - DNA, 25 bp, Artificial sequence
  Synthetic oligonucleotide
ggcgccggtgcaacgcgcacggccg

SEQ ID NO: 705796 - DNA, 25 bp, Artificial sequence
  Synthetic oligonucleotide
ggcgccggtgcatcgcgcacggccg

SEQ ID NO: 705797 - DNA, 25 bp, Artificial sequence
  Synthetic oligonucleotide
ggccggcagactcgcgcgtgccggg

SEQ ID NO: 705798 - DNA, 25 bp, Artificial sequence
  Synthetic oligonucleotide
cccccggcgccgctacggaggctgc

SEQ ID NO: 705799 - DNA, 25 bp, Artificial sequence
  Synthetic oligonucleotide
ccgcggcgggcgggacgtaccccac

SEQ ID NO: 705800 - DNA, 25 bp, Artificial sequence
  Synthetic oligonucleotide
ggccgccgtcgcgcgtatgggcccc

SEQ ID NO: 705801 - DNA, 25 bp, Artificial sequence
  Synthetic oligonucleotide
ccccgctagcgccccgacggtccgc

SEQ ID NO: 705802 - DNA, 25 bp, Artificial sequence
  Synthetic oligonucleotide
ccccgctagcgcgccgacggtccgc

SEQ ID NO: 705803 - DNA, 25 bp, Artificial sequence
  Synthetic oligonucleotide
cgcggccgcgtcggcacgagcgcac

SEQ ID NO: 705804 - DNA, 25 bp, Artificial sequence
  Synthetic oligonucleotide
cgcggccgcgtccgcacgagcgcac

SEQ ID NO: 705805 - DNA, 25 bp, Artificial sequence
  Synthetic oligonucleotide
gcggcgccgtcgtacgcggggggct

SEQ ID NO: 705806 - DNA, 25 bp, Artificial sequence
  Synthetic oligonucleotide
gcggcgccgtcgaacgcggggggct

SEQ ID NO: 705807 - DNA, 25 bp, Artificial sequence
  Synthetic oligonucleotide
ggcggcgccccgtagtcgaccggcc

SEQ ID NO: 705808 - DNA, 25 bp, Artificial sequence
  Synthetic oligonucleotide
ggccggcagactggcgcgtgccggg

SEQ ID NO: 705809 - DNA, 25 bp, Artificial sequence
  Synthetic oligonucleotide
cccctggcgcgaccctacggggcgc

SEQ ID NO: 705810 - DNA, 25 bp, Artificial sequence
  Synthetic oligonucleotide
ccggccgtcggtgggcacgccggtc

SEQ ID NO: 705811 - DNA, 25 bp, Artificial sequence
  Synthetic oligonucleotide
ccgcgcatcggcggcgagccgcgtc

SEQ ID NO: 705812 - DNA, 25 bp, Artificial sequence
  Synthetic oligonucleotide
ccgcgcatcggccgcgagccgcgtc

SEQ ID NO: 705813 - DNA, 25 bp, Artificial sequence
  Synthetic oligonucleotide
ggcagcgtcgacgcgcggtcggggg

SEQ ID NO: 705814 - DNA, 25 bp, Artificial sequence
  Synthetic oligonucleotide
ggcagcgtcgacccgcggtcggggg

SEQ ID NO: 705815 - DNA, 25 bp, Artificial sequence
  Synthetic oligonucleotide
gcgtgcgtacgtccgcggccccgcc

SEQ ID NO: 705816 - DNA, 25 bp, Artificial sequence
  Synthetic oligonucleotide
cccccggcgccggtacggaggctgc

SEQ ID NO: 705817 - DNA, 25 bp, Artificial sequence
  Synthetic oligonucleotide
gggccgcatcggctcgccgaggccc

SEQ ID NO: 705818 - DNA, 25 bp, Artificial sequence
  Synthetic oligonucleotide
ggggaccgttcaggcggggccgcgc

SEQ ID NO: 705819 - DNA, 25 bp, Artificial sequence
  Synthetic oligonucleotide
ggggaccgttcacgcggggccgcgc

SEQ ID NO: 705820 - DNA, 25 bp, Artificial sequence
  Synthetic oligonucleotide
gcccgccgaccgcactacgcgcccc

SEQ ID NO: 705821 - DNA, 25 bp, Artificial sequence
  Synthetic oligonucleotide
ggtcgccgtacgggcgtcggcgcgc

SEQ ID NO: 705822 - DNA, 25 bp, Artificial sequence
  Synthetic oligonucleotide
ggtcgccgtacgcgcgtcggcgcgc

SEQ ID NO: 705823 - DNA, 25 bp, Artificial sequence
  Synthetic oligonucleotide
gccgcccggacgcgtagtggcccgg

SEQ ID NO: 705824 - DNA, 25 bp, Artificial sequence
  Synthetic oligonucleotide
gccgcccggacgggtagtggcccgg

SEQ ID NO: 705825 - DNA, 25 bp, Artificial sequence
  Synthetic oligonucleotide
ggccgccgtcgcccgtatgggcccc

SEQ ID NO: 705826 - DNA, 25 bp, Artificial sequence
  Synthetic oligonucleotide
gcgtgcgtacgtgcgcggccccgcc

SEQ ID NO: 705827 - DNA, 25 bp, Artificial sequence
  Synthetic oligonucleotide
ggcgggtaggcccgcgcgtgcgcga

SEQ ID NO: 705828 - DNA, 25 bp, Artificial sequence
  Synthetic oligonucleotide
cgccccgccgcggcgtatctccggc

SEQ ID NO: 705829 - DNA, 25 bp, Artificial sequence
  Synthetic oligonucleotide
cgccccgccgcgccgtatctccggc

SEQ ID NO: 705830 - DNA, 25 bp, Artificial sequence
  Synthetic oligonucleotide
ccccccatgcgtacgggcgcgggcc

SEQ ID NO: 705831 - DNA, 25 bp, Artificial sequence
  Synthetic oligonucleotide
ccccccatgcgttcgggcgcgggcc

SEQ ID NO: 705832 - DNA, 25 bp, Artificial sequence
  Synthetic oligonucleotide
acccgcgcgcgccatacggggggcc

SEQ ID NO: 705833 - DNA, 25 bp, Artificial sequence
  Synthetic oligonucleotide
acccgcgcgcgcgatacggggggcc

SEQ ID NO: 705834 - DNA, 25 bp, Artificial sequence
  Synthetic oligonucleotide
ggcgcgcccgaccgcgcaaccgcac

SEQ ID NO: 705835 - DNA, 25 bp, Artificial sequence
  Synthetic oligonucleotide
cgagcggaccgtcggctcgcccggc

SEQ ID NO: 705836 - DNA, 25 bp, Artificial sequence
  Synthetic oligonucleotide
ggcgggtaggccggcgcgtgcgcga

SEQ ID NO: 705837 - DNA, 25 bp, Artificial sequence
  Synthetic oligonucleotide
agcccctccgcacgacgcgggggcg

SEQ ID NO: 705838 - DNA, 25 bp, Artificial sequence
  Synthetic oligonucleotide
gggcgcggtagtcgcgcggaccggc

SEQ ID NO: 705839 - DNA, 25 bp, Artificial sequence
  Synthetic oligonucleotide
gggcgcggtagtggcgcggaccggc

SEQ ID NO: 705840 - DNA, 25 bp, Artificial sequence
  Synthetic oligonucleotide
ggcccggtcgcgcgatcgggcgagg

SEQ ID NO: 705841 - DNA, 25 bp, Artificial sequence
  Synthetic oligonucleotide
gggccgcatcgggtcgccgaggccc

SEQ ID NO: 705842 - DNA, 25 bp, Artificial sequence
  Synthetic oligonucleotide
gcccgccgaccggactacgcgcccc

SEQ ID NO: 705843 - DNA, 25 bp, Artificial sequence
  Synthetic oligonucleotide
cgagcggaccgtgggctcgcccggc

SEQ ID NO: 705844 - DNA, 25 bp, Artificial sequence
  Synthetic oligonucleotide
ggggcggttcggaccgcggcgagcg

SEQ ID NO: 705845 - DNA, 25 bp, Artificial sequence
  Synthetic oligonucleotide
ccccgcggcgtagcccgatgcggcg

SEQ ID NO: 705846 - DNA, 25 bp, Artificial sequence
  Synthetic oligonucleotide
ggcccggtcgcgggatcgggcgagg

SEQ ID NO: 705847 - DNA, 25 bp, Artificial sequence
  Synthetic oligonucleotide
tgcgcgtacgcggcgaccgcgcccg

SEQ ID NO: 705848 - DNA, 25 bp, Artificial sequence
  Synthetic oligonucleotide
ccccgcggcgtaccccgatgcggcg

SEQ ID NO: 705849 - DNA, 25 bp, Artificial sequence
  Synthetic oligonucleotide
ggcgcgcccgacggcgcaaccgcac

SEQ ID NO: 705850 - DNA, 25 bp, Artificial sequence
  Synthetic oligonucleotide
agcccctccgcaggacgcgggggcg

SEQ ID NO: 705851 - DNA, 25 bp, Artificial sequence
  Synthetic oligonucleotide
gaggcccggctaggcgcgtggcggc

SEQ ID NO: 705852 - DNA, 25 bp, Artificial sequence
  Synthetic oligonucleotide
ggggcggttcggtccgcggcgagcg

SEQ ID NO: 705853 - DNA, 25 bp, Artificial sequence
  Synthetic oligonucleotide
tgcgcgtacgcgccgaccgcgcccg

SEQ ID NO: 705854 - DNA, 25 bp, Artificial sequence
  Synthetic oligonucleotide
ggccgccgacgctccggggcgatgg

SEQ ID NO: 705855 - DNA, 25 bp, Artificial sequence
  Synthetic oligonucleotide
ggccgccgacgcaccggggcgatgg

SEQ ID NO: 705856 - DNA, 25 bp, Artificial sequence
  Synthetic oligonucleotide
gggcgcctgccgaaacgcgcgcccc

SEQ ID NO: 705857 - DNA, 25 bp, Artificial sequence
  Synthetic oligonucleotide
gggcgcctgccgtaacgcgcgcccc

SEQ ID NO: 705858 - DNA, 25 bp, Artificial sequence
  Synthetic oligonucleotide
gaggcccggctacgcgcgtggcggc

SEQ ID NO: 705859 - DNA, 25 bp, Artificial sequence
  Synthetic oligonucleotide
cggacccgcgcggcagggcgtgcgg

SEQ ID NO: 705860 - DNA, 25 bp, Artificial sequence
  Synthetic oligonucleotide
cggacccgcgcgccagggcgtgcgg

SEQ ID NO: 705861 - DNA, 25 bp, Artificial sequence
  Synthetic oligonucleotide
cgtgcggcggccgtcggcccgctcg

SEQ ID NO: 705862 - DNA, 25 bp, Artificial sequence
  Synthetic oligonucleotide
cgtgcggcggccctcggcccgctcg

SEQ ID NO: 705863 - DNA, 25 bp, Artificial sequence
  Synthetic oligonucleotide
cctccgcgccgggccgacgcgcgca

SEQ ID NO: 705864 - DNA, 25 bp, Artificial sequence
  Synthetic oligonucleotide
ggtgcgctaccggcccgcgccgccc

SEQ ID NO: 705865 - DNA, 25 bp, Artificial sequence
  Synthetic oligonucleotide
cccaccccccgcctgcggctgcccc

SEQ ID NO: 705866 - DNA, 25 bp, Artificial sequence
  Synthetic oligonucleotide
cgcgcccggcgccgcgtgccgcatg

SEQ ID NO: 705867 - DNA, 25 bp, Artificial sequence
  Synthetic oligonucleotide
ccggaggcggtggcgtggcggccgg

SEQ ID NO: 705868 - DNA, 25 bp, Artificial sequence
  Synthetic oligonucleotide
cgcgcccggcgcggcgtgccgcatg

SEQ ID NO: 705869 - DNA, 25 bp, Artificial sequence
  Synthetic oligonucleotide
cggtcgtcggagggcccccgcgcgg

SEQ ID NO: 705870 - DNA, 25 bp, Artificial sequence
  Synthetic oligonucleotide
cggtcgtcggagcgcccccgcgcgg

SEQ ID NO: 705871 - DNA, 25 bp, Artificial sequence
  Synthetic oligonucleotide
ccgtgcgcgtcggggccgccgtgcg

SEQ ID NO: 705872 - DNA, 25 bp, Artificial sequence
  Synthetic oligonucleotide
ccgtgcgcgtcgcggccgccgtgcg

SEQ ID NO: 705873 - DNA, 25 bp, Artificial sequence
  Synthetic oligonucleotide
gcgcggcgggccgtctggcgcggtc

SEQ ID NO: 705874 - DNA, 25 bp, Artificial sequence
  Synthetic oligonucleotide
cggccccggacgggcgacgcgaccc

SEQ ID NO: 705875 - DNA, 25 bp, Artificial sequence
  Synthetic oligonucleotide
cgcagcgcgcgcgccggtagccggc

SEQ ID NO: 705876 - DNA, 25 bp, Artificial sequence
  Synthetic oligonucleotide
gccctggcgccggctcgacccgccg

SEQ ID NO: 705877 - DNA, 25 bp, Artificial sequence
  Synthetic oligonucleotide
cgcagcgcgcgccccggtagccggc

SEQ ID NO: 705878 - DNA, 25 bp, Artificial sequence
  Synthetic oligonucleotide
ccgctctcggcacggcgccgccggg

SEQ ID NO: 705879 - DNA, 25 bp, Artificial sequence
  Synthetic oligonucleotide
cggccacgtctgcccggcgggcgcc

SEQ ID NO: 705880 - DNA, 25 bp, Artificial sequence
  Synthetic oligonucleotide
cgcggccgtcgctgtgcgcgggggc

SEQ ID NO: 705881 - DNA, 25 bp, Artificial sequence
  Synthetic oligonucleotide
ccgctctcggcagggcgccgccggg

SEQ ID NO: 705882 - DNA, 25 bp, Artificial sequence
  Synthetic oligonucleotide
ggtgcgctaccgccccgcgccgccc

SEQ ID NO: 705883 - DNA, 25 bp, Artificial sequence
  Synthetic oligonucleotide
gccctggcgccgcctcgacccgccg

SEQ ID NO: 705884 - DNA, 25 bp, Artificial sequence
  Synthetic oligonucleotide
cggccccggacgcgcgacgcgaccc

SEQ ID NO: 705885 - DNA, 25 bp, Artificial sequence
  Synthetic oligonucleotide
ccggaggcggtgccgtggcggccgg

SEQ ID NO: 705886 - DNA, 25 bp, Artificial sequence
  Synthetic oligonucleotide
cgcggccgtcgcagtgcgcgggggc

SEQ ID NO: 705887 - DNA, 25 bp, Artificial sequence
  Synthetic oligonucleotide
ggcgcggaccggtccccccacgcgc

SEQ ID NO: 705888 - DNA, 25 bp, Artificial sequence
  Synthetic oligonucleotide
ggcgcggaccggaccccccacgcgc

SEQ ID NO: 705889 - DNA, 25 bp, Artificial sequence
  Synthetic oligonucleotide
gggcgccgcgcacgggcccgtcgga

SEQ ID NO: 705890 - DNA, 25 bp, Artificial sequence
  Synthetic oligonucleotide
tgcggaggggccgcgcaccggcgcg

SEQ ID NO: 705891 - DNA, 25 bp, Artificial sequence
  Synthetic oligonucleotide
ggggcccggcgtgcccgcggagcga

SEQ ID NO: 705892 - DNA, 25 bp, Artificial sequence
  Synthetic oligonucleotide
gcccccggtcgctgccagcgggcgg

SEQ ID NO: 705893 - DNA, 25 bp, Artificial sequence
  Synthetic oligonucleotide
cgccgtcggccgcccgcacgctcgg

SEQ ID NO: 705894 - DNA, 25 bp, Artificial sequence
  Synthetic oligonucleotide
cgccgtcggccggccgcacgctcgg

SEQ ID NO: 705895 - DNA, 25 bp, Artificial sequence
  Synthetic oligonucleotide
ccggccggactgcgccgccgcggga

SEQ ID NO: 705896 - DNA, 25 bp, Artificial sequence
  Synthetic oligonucleotide
ggccagccggtgggggacccgccgg

SEQ ID NO: 705897 - DNA, 25 bp, Artificial sequence
  Synthetic oligonucleotide
tgcggaggggccccgcaccggcgcg

SEQ ID NO: 705898 - DNA, 25 bp, Artificial sequence
  Synthetic oligonucleotide
ggccagccggtgcgggacccgccgg

SEQ ID NO: 705899 - DNA, 25 bp, Artificial sequence
  Synthetic oligonucleotide
ccgcgatggcgcggcccctcgggcg

SEQ ID NO: 705900 - DNA, 25 bp, Artificial sequence
  Synthetic oligonucleotide
ccgcgatggcgccgcccctcgggcg

SEQ ID NO: 705901 - DNA, 25 bp, Artificial sequence
  Synthetic oligonucleotide
cgcctgcgtcccgcccctgggcgcg

SEQ ID NO: 705902 - DNA, 25 bp, Artificial sequence
  Synthetic oligonucleotide
cgcctgcgtcccccccctgggcgcg

SEQ ID NO: 705903 - DNA, 25 bp, Artificial sequence
  Synthetic oligonucleotide
cgcccccccgtcggcacgggctgcg

SEQ ID NO: 705904 - DNA, 25 bp, Artificial sequence
  Synthetic oligonucleotide
cctccgcgccggcccgacgcgcgca

SEQ ID NO: 705905 - DNA, 25 bp, Artificial sequence
  Synthetic oligonucleotide
ccggccggactgggccgccgcggga

SEQ ID NO: 705906 - DNA, 25 bp, Artificial sequence
  Synthetic oligonucleotide
gcggcccggacgcgccttcccgcgc

SEQ ID NO: 705907 - DNA, 25 bp, Artificial sequence
  Synthetic oligonucleotide
gggccccgggggccgatcccgcagc

SEQ ID NO: 705908 - DNA, 25 bp, Artificial sequence
  Synthetic oligonucleotide
gggccccggggggcgatcccgcagc

SEQ ID NO: 705909 - DNA, 25 bp, Artificial sequence
  Synthetic oligonucleotide
gcctacgcggccgtcggccggcgcc

SEQ ID NO: 705910 - DNA, 25 bp, Artificial sequence
  Synthetic oligonucleotide
gcctacgcggccctcggccggcgcc

SEQ ID NO: 705911 - DNA, 25 bp, Artificial sequence
  Synthetic oligonucleotide
gcccggcaggtctcgcgcggcgcgc

SEQ ID NO: 705912 - DNA, 25 bp, Artificial sequence
  Synthetic oligonucleotide
gcccccggtcgcagccagcgggcgg

SEQ ID NO: 705913 - DNA, 25 bp, Artificial sequence
  Synthetic oligonucleotide
gcggcccggacgggccttcccgcgc

SEQ ID NO: 705914 - DNA, 25 bp, Artificial sequence
  Synthetic oligonucleotide
gggcgccgcgcaggggcccgtcgga

SEQ ID NO: 705915 - DNA, 25 bp, Artificial sequence
  Synthetic oligonucleotide
accgcggcgggccacgccgtggccc

SEQ ID NO: 705916 - DNA, 25 bp, Artificial sequence
  Synthetic oligonucleotide
accgcggcgggcgacgccgtggccc

SEQ ID NO: 705917 - DNA, 25 bp, Artificial sequence
  Synthetic oligonucleotide
ggaccgccggacccgccggcgacgg

SEQ ID NO: 705918 - DNA, 25 bp, Artificial sequence
  Synthetic oligonucleotide
ggaccgccggacgcgccggcgacgg

SEQ ID NO: 705919 - DNA, 25 bp, Artificial sequence
  Synthetic oligonucleotide
ggggcccggcgtccccgcggagcga

SEQ ID NO: 705920 - DNA, 25 bp, Artificial sequence
  Synthetic oligonucleotide
cggccacgtctggccggcgggcgcc

SEQ ID NO: 705921 - DNA, 25 bp, Artificial sequence
  Synthetic oligonucleotide
gcccggcaggtcacgcgcggcgcgc

SEQ ID NO: 705922 - DNA, 25 bp, Artificial sequence
  Synthetic oligonucleotide
tccacgacgcgcgcgcccggccggg

SEQ ID NO: 705923 - DNA, 25 bp, Artificial sequence
  Synthetic oligonucleotide
ggcgcgccgtcgggcgccgctggct

SEQ ID NO: 705924 - DNA, 25 bp, Artificial sequence
  Synthetic oligonucleotide
ggcgcgccgtcgcgcgccgctggct

SEQ ID NO: 705925 - DNA, 25 bp, Artificial sequence
  Synthetic oligonucleotide
gcggggccgcgccacggctcaggcc

SEQ ID NO: 705926 - DNA, 25 bp, Artificial sequence
  Synthetic oligonucleotide
gcggggccgcgcgacggctcaggcc

SEQ ID NO: 705927 - DNA, 25 bp, Artificial sequence
  Synthetic oligonucleotide
ctgggggcggccgccgtccgcgagc

SEQ ID NO: 705928 - DNA, 25 bp, Artificial sequence
  Synthetic oligonucleotide
ctgggggcggcccccgtccgcgagc

SEQ ID NO: 705929 - DNA, 25 bp, Artificial sequence
  Synthetic oligonucleotide
cccgtgccggcggcccccgtccgca

SEQ ID NO: 705930 - DNA, 25 bp, Artificial sequence
  Synthetic oligonucleotide
ggcctggcgccggtccgcgacgcgc

SEQ ID NO: 705931 - DNA, 25 bp, Artificial sequence
  Synthetic oligonucleotide
tccacgacgcgcccgcccggccggg

SEQ ID NO: 705932 - DNA, 25 bp, Artificial sequence
  Synthetic oligonucleotide
ggcctggcgccgctccgcgacgcgc

SEQ ID NO: 705933 - DNA, 25 bp, Artificial sequence
  Synthetic oligonucleotide
cgcccgcgcgtcccgcctccggctg

SEQ ID NO: 705934 - DNA, 25 bp, Artificial sequence
  Synthetic oligonucleotide
cgcccgcgcgtcgcgcctccggctg

SEQ ID NO: 705935 - DNA, 25 bp, Artificial sequence
  Synthetic oligonucleotide
ggacccgtcgcggcggcccgtgcgg

SEQ ID NO: 705936 - DNA, 25 bp, Artificial sequence
  Synthetic oligonucleotide
ggacccgtcgcgccggcccgtgcgg

SEQ ID NO: 705937 - DNA, 25 bp, Artificial sequence
  Synthetic oligonucleotide
cggcggcgacgctgccgcggcccca

SEQ ID NO: 705938 - DNA, 25 bp, Artificial sequence
  Synthetic oligonucleotide
cggcggcgacgcagccgcggcccca

SEQ ID NO: 705939 - DNA, 25 bp, Artificial sequence
  Synthetic oligonucleotide
aaggggtgccgcgccgcggcgccgg

SEQ ID NO: 705940 - DNA, 25 bp, Artificial sequence
  Synthetic oligonucleotide
aaggggtgccgccccgcggcgccgg

SEQ ID NO: 705941 - DNA, 25 bp, Artificial sequence
  Synthetic oligonucleotide
cccgtgccggcgccccccgtccgca

SEQ ID NO: 705942 - DNA, 25 bp, Artificial sequence
  Synthetic oligonucleotide
ccggaggcggacggccgggcggctc

SEQ ID NO: 705943 - DNA, 25 bp, Artificial sequence
  Synthetic oligonucleotide
gcgcggcgggccctctggcgcggtc

SEQ ID NO: 705944 - DNA, 25 bp, Artificial sequence
  Synthetic oligonucleotide
ccccggctcgagcgggccggtcgcc

SEQ ID NO: 705945 - DNA, 25 bp, Artificial sequence
  Synthetic oligonucleotide
tggcctgccggcccgccgcgcccag

SEQ ID NO: 705946 - DNA, 25 bp, Artificial sequence
  Synthetic oligonucleotide
tggcctgccggcgcgccgcgcccag

SEQ ID NO: 705947 - DNA, 25 bp, Artificial sequence
  Synthetic oligonucleotide
gcggccgcgatcggcccccagcgcg

SEQ ID NO: 705948 - DNA, 25 bp, Artificial sequence
  Synthetic oligonucleotide
gcggccgcgatccgcccccagcgcg

SEQ ID NO: 705949 - DNA, 25 bp, Artificial sequence
  Synthetic oligonucleotide
cggaccgccccgctgccgggcaggc

SEQ ID NO: 705950 - DNA, 25 bp, Artificial sequence
  Synthetic oligonucleotide
cgcccccccgtccgcacgggctgcg

SEQ ID NO: 705951 - DNA, 25 bp, Artificial sequence
  Synthetic oligonucleotide
ccggaggcggaccgccgggcggctc

SEQ ID NO: 705952 - DNA, 25 bp, Artificial sequence
  Synthetic oligonucleotide
ggcgccgagagggcccccgtggccg

SEQ ID NO: 705953 - DNA, 25 bp, Artificial sequence
  Synthetic oligonucleotide
gcctggcgctacggcccccgcgggc

SEQ ID NO: 705954 - DNA, 25 bp, Artificial sequence
  Synthetic oligonucleotide
gcctggcgctaccgcccccgcgggc

SEQ ID NO: 705955 - DNA, 25 bp, Artificial sequence
  Synthetic oligonucleotide
gccacgccccgtggccgagcggggg

SEQ ID NO: 705956 - DNA, 25 bp, Artificial sequence
  Synthetic oligonucleotide
gccacgccccgtcgccgagcggggg

SEQ ID NO: 705957 - DNA, 25 bp, Artificial sequence
  Synthetic oligonucleotide
cggaggccgcgccgcgcgtggccct

SEQ ID NO: 705958 - DNA, 25 bp, Artificial sequence
  Synthetic oligonucleotide
cggaggccgcgcggcgcgtggccct

SEQ ID NO: 705959 - DNA, 25 bp, Artificial sequence
  Synthetic oligonucleotide
gtccaccgccgtgcggcgggccccc

SEQ ID NO: 705960 - DNA, 25 bp, Artificial sequence
  Synthetic oligonucleotide
gtccaccgccgtccggcgggccccc

SEQ ID NO: 705961 - DNA, 25 bp, Artificial sequence
  Synthetic oligonucleotide
cggaccgccccggtgccgggcaggc

SEQ ID NO: 705962 - DNA, 25 bp, Artificial sequence
  Synthetic oligonucleotide
cggcccgcgccgagtcgtccccggc

SEQ ID NO: 705963 - DNA, 25 bp, Artificial sequence
  Synthetic oligonucleotide
cgccccgcctcgcagccgcgctgcg

SEQ ID NO: 705964 - DNA, 25 bp, Artificial sequence
  Synthetic oligonucleotide
cgcgcggccgcgcacgccgtgggtg

SEQ ID NO: 705965 - DNA, 25 bp, Artificial sequence
  Synthetic oligonucleotide
cgcgcggccgcggacgccgtgggtg

SEQ ID NO: 705966 - DNA, 25 bp, Artificial sequence
  Synthetic oligonucleotide
tgcgccccgggcgggacggcctgcc

SEQ ID NO: 705967 - DNA, 25 bp, Artificial sequence
  Synthetic oligonucleotide
tgcgccccgggccggacggcctgcc

SEQ ID NO: 705968 - DNA, 25 bp, Artificial sequence
  Synthetic oligonucleotide
cctgggccgcccccgctaccggcgg

SEQ ID NO: 705969 - DNA, 25 bp, Artificial sequence
  Synthetic oligonucleotide
cctgggccgcccgcgctaccggcgg

SEQ ID NO: 705970 - DNA, 25 bp, Artificial sequence
  Synthetic oligonucleotide
ccgccggtcgcccgcggcgagtggc

SEQ ID NO: 705971 - DNA, 25 bp, Artificial sequence
  Synthetic oligonucleotide
ccctggtgccggctcgccgccccgg

SEQ ID NO: 705972 - DNA, 25 bp, Artificial sequence
  Synthetic oligonucleotide
cccggcggctggccgccaccgcgag

SEQ ID NO: 705973 - DNA, 25 bp, Artificial sequence
  Synthetic oligonucleotide
cggcccgcgccgtgtcgtccccggc

SEQ ID NO: 705974 - DNA, 25 bp, Artificial sequence
  Synthetic oligonucleotide
gtgccgcgcccgggggggcagctcc

SEQ ID NO: 705975 - DNA, 25 bp, Artificial sequence
  Synthetic oligonucleotide
gtgccgcgcccgcgggggcagctcc

SEQ ID NO: 705976 - DNA, 25 bp, Artificial sequence
  Synthetic oligonucleotide
gccggccgacgaggcgcggcctgcc

SEQ ID NO: 705977 - DNA, 25 bp, Artificial sequence
  Synthetic oligonucleotide
gccggccgacgacgcgcggcctgcc

SEQ ID NO: 705978 - DNA, 25 bp, Artificial sequence
  Synthetic oligonucleotide
cgctcgggcccggcggtcgccagcg

SEQ ID NO: 705979 - DNA, 25 bp, Artificial sequence
  Synthetic oligonucleotide
cgctcgggcccgccggtcgccagcg

SEQ ID NO: 705980 - DNA, 25 bp, Artificial sequence
  Synthetic oligonucleotide
ggcgccccgggcgcgacgacctgcc

SEQ ID NO: 705981 - DNA, 25 bp, Artificial sequence
  Synthetic oligonucleotide
ccctggtgccgggtcgccgccccgg

SEQ ID NO: 705982 - DNA, 25 bp, Artificial sequence
  Synthetic oligonucleotide
gcggcgccggcgggtaccgaggggg

SEQ ID NO: 705983 - DNA, 25 bp, Artificial sequence
  Synthetic oligonucleotide
ggcgccccgggcccgacgacctgcc

SEQ ID NO: 705984 - DNA, 25 bp, Artificial sequence
  Synthetic oligonucleotide
ggcgccgagaggccccccgtggccg

SEQ ID NO: 705985 - DNA, 25 bp, Artificial sequence
  Synthetic oligonucleotide
ccggcgccggcaccgtgcgccgctc

SEQ ID NO: 705986 - DNA, 25 bp, Artificial sequence
  Synthetic oligonucleotide
ccggcgccggcagcgtgcgccgctc

SEQ ID NO: 705987 - DNA, 25 bp, Artificial sequence
  Synthetic oligonucleotide
cccgtgcggccgagcccggggcgca

SEQ ID NO: 705988 - DNA, 25 bp, Artificial sequence
  Synthetic oligonucleotide
cccgtgcggccgtgcccggggcgca

SEQ ID NO: 705989 - DNA, 25 bp, Artificial sequence
  Synthetic oligonucleotide
ggcggcgcgccgaccgaccgcctcc

SEQ ID NO: 705990 - DNA, 25 bp, Artificial sequence
  Synthetic oligonucleotide
ggcggcgcgccgtccgaccgcctcc

SEQ ID NO: 705991 - DNA, 25 bp, Artificial sequence
  Synthetic oligonucleotide
cgccccgcctcggagccgcgctgcg

SEQ ID NO: 705992 - DNA, 25 bp, Artificial sequence
  Synthetic oligonucleotide
cggcaggcgccgcccaacccgccgg

SEQ ID NO: 705993 - DNA, 25 bp, Artificial sequence
  Synthetic oligonucleotide
cccggcggctgggcgccaccgcgag

SEQ ID NO: 705994 - DNA, 25 bp, Artificial sequence
  Synthetic oligonucleotide
gcggcgccggcgcgtaccgaggggg

SEQ ID NO: 705995 - DNA, 25 bp, Artificial sequence
  Synthetic oligonucleotide
cccccggtgcgccagcggcgggtcc

SEQ ID NO: 705996 - DNA, 25 bp, Artificial sequence
  Synthetic oligonucleotide
cccccggtgcgcgagcggcgggtcc

SEQ ID NO: 705997 - DNA, 25 bp, Artificial sequence
  Synthetic oligonucleotide
cggtgcccggcggccgaccgggtgc

SEQ ID NO: 705998 - DNA, 25 bp, Artificial sequence
  Synthetic oligonucleotide
cggtgcccggcgcccgaccgggtgc

SEQ ID NO: 705999 - DNA, 25 bp, Artificial sequence
  Synthetic oligonucleotide
gggcgcggcaactggcgcgcgcggg

SEQ ID NO: 706000 - DNA, 25 bp, Artificial sequence
  Synthetic oligonucleotide
gggcgcggcaacaggcgcgcgcggg

SEQ ID NO: 706001 - DNA, 25 bp, Artificial sequence
  Synthetic oligonucleotide
ccgccggtcgccggcggcgagtggc

SEQ ID NO: 706002 - DNA, 25 bp, Artificial sequence
  Synthetic oligonucleotide
cggcaggcgccggccaacccgccgg

SEQ ID NO: 706003 - DNA, 25 bp, Artificial sequence
  Synthetic oligonucleotide
gccgcgcggtccaacgcgggccgcg

SEQ ID NO: 706004 - DNA, 25 bp, Artificial sequence
  Synthetic oligonucleotide
gcgggccgtacggcggtcggccggc

SEQ ID NO: 706005 - DNA, 25 bp, Artificial sequence
  Synthetic oligonucleotide
gcggcccgcgtccagggaccgcggc

SEQ ID NO: 706006 - DNA, 25 bp, Artificial sequence
  Synthetic oligonucleotide
gcggcccgcgtcgagggaccgcggc

SEQ ID NO: 706007 - DNA, 25 bp, Artificial sequence
  Synthetic oligonucleotide
gcggcgcgcgtggcgtacccgcggc

SEQ ID NO: 706008 - DNA, 25 bp, Artificial sequence
  Synthetic oligonucleotide
gcggcgcgcgtgccgtacccgcggc

SEQ ID NO: 706009 - DNA, 25 bp, Artificial sequence
  Synthetic oligonucleotide
gcggcccgcgtccacgcgtccgggc

SEQ ID NO: 706010 - DNA, 25 bp, Artificial sequence
  Synthetic oligonucleotide
ggccggcgggagggctcgagcccgc

SEQ ID NO: 706011 - DNA, 25 bp, Artificial sequence
  Synthetic oligonucleotide
gcgcgccgcgtatcggcccgccgcc

SEQ ID NO: 706012 - DNA, 25 bp, Artificial sequence
  Synthetic oligonucleotide
gccgcgcggtcctacgcgggccgcg

SEQ ID NO: 706013 - DNA, 25 bp, Artificial sequence
  Synthetic oligonucleotide
cgggcgcggtgcgccgctacgccgc

SEQ ID NO: 706014 - DNA, 25 bp, Artificial sequence
  Synthetic oligonucleotide
cgggcgcggtgccccgctacgccgc

SEQ ID NO: 706015 - DNA, 25 bp, Artificial sequence
  Synthetic oligonucleotide
ccccgcacccggcgtagcggcgcgc

SEQ ID NO: 706016 - DNA, 25 bp, Artificial sequence
  Synthetic oligonucleotide
gcgggccgtacgccggtcggccggc

SEQ ID NO: 706017 - DNA, 25 bp, Artificial sequence
  Synthetic oligonucleotide
gccgggcgatcccacgccgggcgcg

SEQ ID NO: 706018 - DNA, 25 bp, Artificial sequence
  Synthetic oligonucleotide
ggccggcgggagcgctcgagcccgc

SEQ ID NO: 706019 - DNA, 25 bp, Artificial sequence
  Synthetic oligonucleotide
cgggcgcgcgacggtgcgacgcccc

SEQ ID NO: 706020 - DNA, 25 bp, Artificial sequence
  Synthetic oligonucleotide
cggggggcgttcccggcacgccggc

SEQ ID NO: 706021 - DNA, 25 bp, Artificial sequence
  Synthetic oligonucleotide
ggcccgcgcccgtacggagccgccc

SEQ ID NO: 706022 - DNA, 25 bp, Artificial sequence
  Synthetic oligonucleotide
ggcccgcgcccgaacggagccgccc

SEQ ID NO: 706023 - DNA, 25 bp, Artificial sequence
  Synthetic oligonucleotide
gcggggcgcccgatagcgcgcgcgg

SEQ ID NO: 706024 - DNA, 25 bp, Artificial sequence
  Synthetic oligonucleotide
gcggggcgcccgttagcgcgcgcgg

SEQ ID NO: 706025 - DNA, 25 bp, Artificial sequence
  Synthetic oligonucleotide
gcggcccgcgtcgacgcgtccgggc

SEQ ID NO: 706026 - DNA, 25 bp, Artificial sequence
  Synthetic oligonucleotide
cgggcccgccggaacacggcgcggc

SEQ ID NO: 706027 - DNA, 25 bp, Artificial sequence
  Synthetic oligonucleotide
ccgcggcgtcgcgtacccgcgggcg

SEQ ID NO: 706028 - DNA, 25 bp, Artificial sequence
  Synthetic oligonucleotide
cgggcgcgcgaccgtgcgacgcccc

SEQ ID NO: 706029 - DNA, 25 bp, Artificial sequence
  Synthetic oligonucleotide
ggccggcgcggttcgacggcgcccc

SEQ ID NO: 706030 - DNA, 25 bp, Artificial sequence
  Synthetic oligonucleotide
ggccggcgcggtacgacggcgcccc

SEQ ID NO: 706031 - DNA, 25 bp, Artificial sequence
  Synthetic oligonucleotide
ccgcgccgcggtagcggtcggcggg

SEQ ID NO: 706032 - DNA, 25 bp, Artificial sequence
  Synthetic oligonucleotide
gcggcccgcgtaggaccgcgcgccc

SEQ ID NO: 706033 - DNA, 25 bp, Artificial sequence
  Synthetic oligonucleotide
gcgcgccgcgtaacggcccgccgcc

SEQ ID NO: 706034 - DNA, 25 bp, Artificial sequence
  Synthetic oligonucleotide
cgggcccgccggtacacggcgcggc

SEQ ID NO: 706035 - DNA, 25 bp, Artificial sequence
  Synthetic oligonucleotide
gccccggcgcgataccccccgcgcg

SEQ ID NO: 706036 - DNA, 25 bp, Artificial sequence
  Synthetic oligonucleotide
ggcgcgaacccggtcgcccgcgccg

SEQ ID NO: 706037 - DNA, 25 bp, Artificial sequence
  Synthetic oligonucleotide
cggcgggcccgtcgcacgaggcgcc

SEQ ID NO: 706038 - DNA, 25 bp, Artificial sequence
  Synthetic oligonucleotide
cggcgggcccgtggcacgaggcgcc

SEQ ID NO: 706039 - DNA, 25 bp, Artificial sequence
  Synthetic oligonucleotide
gggggggcctagctccgcgcgcgcg

SEQ ID NO: 706040 - DNA, 25 bp, Artificial sequence
  Synthetic oligonucleotide
gggggggcctaggtccgcgcgcgcg

SEQ ID NO: 706041 - DNA, 25 bp, Artificial sequence
  Synthetic oligonucleotide
gggcgcgcacgccgacgtcgcgccc

SEQ ID NO: 706042 - DNA, 25 bp, Artificial sequence
  Synthetic oligonucleotide
ggcggggcgcgagtcccgacccgcg

SEQ ID NO: 706043 - DNA, 25 bp, Artificial sequence
  Synthetic oligonucleotide
cggcgggaccggggtagcgcgcccc

SEQ ID NO: 706044 - DNA, 25 bp, Artificial sequence
  Synthetic oligonucleotide
gccccggcgcgaaaccccccgcgcg

SEQ ID NO: 706045 - DNA, 25 bp, Artificial sequence
  Synthetic oligonucleotide
cgggccgcgcggacgcgtagccggg

SEQ ID NO: 706046 - DNA, 25 bp, Artificial sequence
  Synthetic oligonucleotide
cgggccgcgcggtcgcgtagccggg

SEQ ID NO: 706047 - DNA, 25 bp, Artificial sequence
  Synthetic oligonucleotide
cgccccgcgtcgaacgggcgcggcc

SEQ ID NO: 706048 - DNA, 25 bp, Artificial sequence
  Synthetic oligonucleotide
cgccccgcgtcgtacgggcgcggcc

SEQ ID NO: 706049 - DNA, 25 bp, Artificial sequence
  Synthetic oligonucleotide
cggggggcgttcgcggcacgccggc

SEQ ID NO: 706050 - DNA, 25 bp, Artificial sequence
  Synthetic oligonucleotide
ggcggggcgcgactcccgacccgcg

SEQ ID NO: 706051 - DNA, 25 bp, Artificial sequence
  Synthetic oligonucleotide
gcggggctccgccggtacgcgccgg

SEQ ID NO: 706052 - DNA, 25 bp, Artificial sequence
  Synthetic oligonucleotide
ccgcggcgtcgcctacccgcgggcg

SEQ ID NO: 706053 - DNA, 25 bp, Artificial sequence
  Synthetic oligonucleotide
gcgggccgtcgcgtacgggccgccc

SEQ ID NO: 706054 - DNA, 25 bp, Artificial sequence
  Synthetic oligonucleotide
gcgggccgtcgcctacgggccgccc

SEQ ID NO: 706055 - DNA, 25 bp, Artificial sequence
  Synthetic oligonucleotide
ggcgcgcgtcgtacgcggggcccgc

SEQ ID NO: 706056 - DNA, 25 bp, Artificial sequence
  Synthetic oligonucleotide
ggcgcgcgtcgttcgcggggcccgc

SEQ ID NO: 706057 - DNA, 25 bp, Artificial sequence
  Synthetic oligonucleotide
gggcgcgcacgcggacgtcgcgccc

SEQ ID NO: 706058 - DNA, 25 bp, Artificial sequence
  Synthetic oligonucleotide
gccgcgctacgcggcgtcggccggg

SEQ ID NO: 706059 - DNA, 25 bp, Artificial sequence
  Synthetic oligonucleotide
gcggcgcgacgttcgccccgccccg

SEQ ID NO: 706060 - DNA, 25 bp, Artificial sequence
  Synthetic oligonucleotide
gcggggctccgcgggtacgcgccgg

SEQ ID NO: 706061 - DNA, 25 bp, Artificial sequence
  Synthetic oligonucleotide
cgccccctcgacggcgcgagccccc

SEQ ID NO: 706062 - DNA, 25 bp, Artificial sequence
  Synthetic oligonucleotide
cgccccctcgaccgcgcgagccccc

SEQ ID NO: 706063 - DNA, 25 bp, Artificial sequence
  Synthetic oligonucleotide
ggcgcggaccgaacgcgcgcgggcg

SEQ ID NO: 706064 - DNA, 25 bp, Artificial sequence
  Synthetic oligonucleotide
ggcgcggaccgatcgcgcgcgggcg

SEQ ID NO: 706065 - DNA, 25 bp, Artificial sequence
  Synthetic oligonucleotide
cggcgggaccggcgtagcgcgcccc

SEQ ID NO: 706066 - DNA, 25 bp, Artificial sequence
  Synthetic oligonucleotide
gccgcgctacgccgcgtcggccggg

SEQ ID NO: 706067 - DNA, 25 bp, Artificial sequence
  Synthetic oligonucleotide
cggccgacgcccctcgcgaccgccg

SEQ ID NO: 706068 - DNA, 25 bp, Artificial sequence
  Synthetic oligonucleotide
ccggccccgccgccacgtaccgcgc

SEQ ID NO: 706069 - DNA, 25 bp, Artificial sequence
  Synthetic oligonucleotide
ccccggctcgagggggccggtcgcc

SEQ ID NO: 706070 - DNA, 25 bp, Artificial sequence
  Synthetic oligonucleotide
ggcgggacgcggacgtccggcccgc

SEQ ID NO: 706071 - DNA, 25 bp, Artificial sequence
  Synthetic oligonucleotide
cgggccacgcggccgtacgcgccgc

SEQ ID NO: 706072 - DNA, 25 bp, Artificial sequence
  Synthetic oligonucleotide
cgggccacgcgggcgtacgcgccgc

SEQ ID NO: 706073 - DNA, 25 bp, Artificial sequence
  Synthetic oligonucleotide
ggcgggacgcggtcgtccggcccgc

SEQ ID NO: 706074 - DNA, 25 bp, Artificial sequence
  Synthetic oligonucleotide
cggcccacgcgcgcggttgcgggcc

SEQ ID NO: 706075 - DNA, 25 bp, Artificial sequence
  Synthetic oligonucleotide
ccccggacggccggtccgagcgcgc

SEQ ID NO: 706076 - DNA, 25 bp, Artificial sequence
  Synthetic oligonucleotide
cggccgacgcccgtcgcgaccgccg

SEQ ID NO: 706077 - DNA, 25 bp, Artificial sequence
  Synthetic oligonucleotide
ggggcgaccgtccctccgcgcgcgg

SEQ ID NO: 706078 - DNA, 25 bp, Artificial sequence
  Synthetic oligonucleotide
ggggcgaccgtcgctccgcgcgcgg

SEQ ID NO: 706079 - DNA, 25 bp, Artificial sequence
  Synthetic oligonucleotide
ccccgcacccggggtagcggcgcgc

SEQ ID NO: 706080 - DNA, 25 bp, Artificial sequence
  Synthetic oligonucleotide
gcgggcccgccccacgatcccgcgg

SEQ ID NO: 706081 - DNA, 25 bp, Artificial sequence
  Synthetic oligonucleotide
gccgggcgatccgacgccgggcgcg

SEQ ID NO: 706082 - DNA, 25 bp, Artificial sequence
  Synthetic oligonucleotide
cggcccacgcgcccggttgcgggcc

SEQ ID NO: 706083 - DNA, 25 bp, Artificial sequence
  Synthetic oligonucleotide
ggcggcacgtcccacgcggcgcccc

SEQ ID NO: 706084 - DNA, 25 bp, Artificial sequence
  Synthetic oligonucleotide
cccgccccgagccctacgcgcgcgg

SEQ ID NO: 706085 - DNA, 25 bp, Artificial sequence
  Synthetic oligonucleotide
cccgccccgacgcgagcgtgcgggc

SEQ ID NO: 706086 - DNA, 25 bp, Artificial sequence
  Synthetic oligonucleotide
cccgccccgacgggagcgtgcgggc

SEQ ID NO: 706087 - DNA, 25 bp, Artificial sequence
  Synthetic oligonucleotide
gccccgccgacccgtacgcgggcgc

SEQ ID NO: 706088 - DNA, 25 bp, Artificial sequence
  Synthetic oligonucleotide
gccccgccgaccggtacgcgggcgc

SEQ ID NO: 706089 - DNA, 25 bp, Artificial sequence
  Synthetic oligonucleotide
cccaccccccgcgtgcggctgcccc

SEQ ID NO: 706090 - DNA, 25 bp, Artificial sequence
  Synthetic oligonucleotide
ggcgccatcgcgggagcgggcgggc

SEQ ID NO: 706091 - DNA, 25 bp, Artificial sequence
  Synthetic oligonucleotide
cggccgccgcgaggcgtgaggcgcc

SEQ ID NO: 706092 - DNA, 25 bp, Artificial sequence
  Synthetic oligonucleotide
ggcggcacgtccgacgcggcgcccc

SEQ ID NO: 706093 - DNA, 25 bp, Artificial sequence
  Synthetic oligonucleotide
cccgccccgagcgctacgcgcgcgg

SEQ ID NO: 706094 - DNA, 25 bp, Artificial sequence
  Synthetic oligonucleotide
cggcccacggtcgaccgcgggccgc

SEQ ID NO: 706095 - DNA, 25 bp, Artificial sequence
  Synthetic oligonucleotide
gcgggcccgcccgacgatcccgcgg

SEQ ID NO: 706096 - DNA, 25 bp, Artificial sequence
  Synthetic oligonucleotide
cggcccacggtccaccgcgggccgc

SEQ ID NO: 706097 - DNA, 25 bp, Artificial sequence
  Synthetic oligonucleotide
ccccggacggcccgtccgagcgcgc

SEQ ID NO: 706098 - DNA, 25 bp, Artificial sequence
  Synthetic oligonucleotide
ggcgccatcgcgcgagcgggcgggc

SEQ ID NO: 706099 - DNA, 25 bp, Artificial sequence
  Synthetic oligonucleotide
ccggcgcctcgtacgggcggcgcgg

SEQ ID NO: 706100 - DNA, 25 bp, Artificial sequence
  Synthetic oligonucleotide
ccggccccgccggcacgtaccgcgc

SEQ ID NO: 706101 - DNA, 25 bp, Artificial sequence
  Synthetic oligonucleotide
cccggcccgtcgatgcgcgcgggcg

SEQ ID NO: 706102 - DNA, 25 bp, Artificial sequence
  Synthetic oligonucleotide
cccggcccgtcgttgcgcgcgggcg

SEQ ID NO: 706103 - DNA, 25 bp, Artificial sequence
  Synthetic oligonucleotide
cgccggccgttccggcgagcgccgc

SEQ ID NO: 706104 - DNA, 25 bp, Artificial sequence
  Synthetic oligonucleotide
cgccggccgttcgggcgagcgccgc

SEQ ID NO: 706105 - DNA, 25 bp, Artificial sequence
  Synthetic oligonucleotide
ccgcggccggtccgcgctaccgcgc

SEQ ID NO: 706106 - DNA, 25 bp, Artificial sequence
  Synthetic oligonucleotide
cgccgccctagcggcggacggcgcg

SEQ ID NO: 706107 - DNA, 25 bp, Artificial sequence
  Synthetic oligonucleotide
cccggcccggcaggctacgcgcccg

SEQ ID NO: 706108 - DNA, 25 bp, Artificial sequence
  Synthetic oligonucleotide
ccggcgcctcgttcgggcggcgcgg

SEQ ID NO: 706109 - DNA, 25 bp, Artificial sequence
  Synthetic oligonucleotide
gggccgcgaccccctagcggccgcc

SEQ ID NO: 706110 - DNA, 25 bp, Artificial sequence
  Synthetic oligonucleotide
gggccgcgacccgctagcggccgcc

SEQ ID NO: 706111 - DNA, 25 bp, Artificial sequence
  Synthetic oligonucleotide
cgggcgcgacggctccgcacggcgc

SEQ ID NO: 706112 - DNA, 25 bp, Artificial sequence
  Synthetic oligonucleotide
cgggcgcgacgggtccgcacggcgc

SEQ ID NO: 706113 - DNA, 25 bp, Artificial sequence
  Synthetic oligonucleotide
gcggcgcgacgtacgccccgccccg

SEQ ID NO: 706114 - DNA, 25 bp, Artificial sequence
  Synthetic oligonucleotide
cgccgccctagccgcggacggcgcg

SEQ ID NO: 706115 - DNA, 25 bp, Artificial sequence
  Synthetic oligonucleotide
cccgccccgcgtttcgccgcgcccc

SEQ ID NO: 706116 - DNA, 25 bp, Artificial sequence
  Synthetic oligonucleotide
cggccgccgcgacgcgtgaggcgcc

SEQ ID NO: 706117 - DNA, 25 bp, Artificial sequence
  Synthetic oligonucleotide
gccgcgccgcgcgacgaacggcggc

SEQ ID NO: 706118 - DNA, 25 bp, Artificial sequence
  Synthetic oligonucleotide
gccgcgccgcgccacgaacggcggc

SEQ ID NO: 706119 - DNA, 25 bp, Artificial sequence
  Synthetic oligonucleotide
gggcccccgcggggcatacgggcgc

SEQ ID NO: 706120 - DNA, 25 bp, Artificial sequence
  Synthetic oligonucleotide
gggcccccgcggcgcatacgggcgc

SEQ ID NO: 706121 - DNA, 25 bp, Artificial sequence
  Synthetic oligonucleotide
ccgcggccggtcggcgctaccgcgc

SEQ ID NO: 706122 - DNA, 25 bp, Artificial sequence
  Synthetic oligonucleotide
ggcgcgccgcggctatgcccccccg

SEQ ID NO: 706123 - DNA, 25 bp, Artificial sequence
  Synthetic oligonucleotide
gcggcccgcgtacgaccgcgcgccc

SEQ ID NO: 706124 - DNA, 25 bp, Artificial sequence
  Synthetic oligonucleotide
cccgccccgcgtatcgccgcgcccc

SEQ ID NO: 706125 - DNA, 25 bp, Artificial sequence
  Synthetic oligonucleotide
cccgcgccgcgtctcgacccccgcg

SEQ ID NO: 706126 - DNA, 25 bp, Artificial sequence
  Synthetic oligonucleotide
cccgcgccgcgtgtcgacccccgcg

SEQ ID NO: 706127 - DNA, 25 bp, Artificial sequence
  Synthetic oligonucleotide
gcggggccggatgaccgcgccgcgg

SEQ ID NO: 706128 - DNA, 25 bp, Artificial sequence
  Synthetic oligonucleotide
gcggggccggatcaccgcgccgcgg

SEQ ID NO: 706129 - DNA, 25 bp, Artificial sequence
  Synthetic oligonucleotide
cccggcccggcacgctacgcgcccg

SEQ ID NO: 706130 - DNA, 25 bp, Artificial sequence
  Synthetic oligonucleotide
ggcgcgccgcgggtatgcccccccg

SEQ ID NO: 706131 - DNA, 25 bp, Artificial sequence
  Synthetic oligonucleotide
cagggggggcgtacccgcgcgcgcg

SEQ ID NO: 706132 - DNA, 25 bp, Artificial sequence
  Synthetic oligonucleotide
gcgcaccccccgcgtcgagcgcccg

SEQ ID NO: 706133 - DNA, 25 bp, Artificial sequence
  Synthetic oligonucleotide
accccgcgcgtcgggcgcagggcgg

SEQ ID NO: 706134 - DNA, 25 bp, Artificial sequence
  Synthetic oligonucleotide
cgccgcgcccgtacgggcgagccgg

SEQ ID NO: 706135 - DNA, 25 bp, Artificial sequence
  Synthetic oligonucleotide
ccggcggcgacgcgcccgtgcgagc

SEQ ID NO: 706136 - DNA, 25 bp, Artificial sequence
  Synthetic oligonucleotide
tccggcgcgtcggaccgcggcgccg

SEQ ID NO: 706137 - DNA, 25 bp, Artificial sequence
  Synthetic oligonucleotide
cgcgcccgcgtaggcgcggcccctc

SEQ ID NO: 706138 - DNA, 25 bp, Artificial sequence
  Synthetic oligonucleotide
ggcgcgaacccgctcgcccgcgccg

SEQ ID NO: 706139 - DNA, 25 bp, Artificial sequence
  Synthetic oligonucleotide
cgcgcccgcgtacgcgcggcccctc

SEQ ID NO: 706140 - DNA, 25 bp, Artificial sequence
  Synthetic oligonucleotide
cagggggggcgttcccgcgcgcgcg

SEQ ID NO: 706141 - DNA, 25 bp, Artificial sequence
  Synthetic oligonucleotide
cgggccgtcgcgcgacgcgccaggg

SEQ ID NO: 706142 - DNA, 25 bp, Artificial sequence
  Synthetic oligonucleotide
cgggccgtcgcgggacgcgccaggg

SEQ ID NO: 706143 - DNA, 25 bp, Artificial sequence
  Synthetic oligonucleotide
gccggctacgggcgggccgcgcacc

SEQ ID NO: 706144 - DNA, 25 bp, Artificial sequence
  Synthetic oligonucleotide
gccggctacgggggggccgcgcacc

SEQ ID NO: 706145 - DNA, 25 bp, Artificial sequence
  Synthetic oligonucleotide
ccggggcccactggcggcgcgcgac

SEQ ID NO: 706146 - DNA, 25 bp, Artificial sequence
  Synthetic oligonucleotide
tccggcgcgtcgcaccgcggcgccg

SEQ ID NO: 706147 - DNA, 25 bp, Artificial sequence
  Synthetic oligonucleotide
cgcgccccggacgggtcgccgccga

SEQ ID NO: 706148 - DNA, 25 bp, Artificial sequence
  Synthetic oligonucleotide
cggcggccccgtagcgcggaggccg

SEQ ID NO: 706149 - DNA, 25 bp, Artificial sequence
  Synthetic oligonucleotide
cggcggccccgttgcgcggaggccg

SEQ ID NO: 706150 - DNA, 25 bp, Artificial sequence
  Synthetic oligonucleotide
gagccgcccgcgagtcgcgcgcgcg

SEQ ID NO: 706151 - DNA, 25 bp, Artificial sequence
  Synthetic oligonucleotide
gagccgcccgcgtgtcgcgcgcgcg

SEQ ID NO: 706152 - DNA, 25 bp, Artificial sequence
  Synthetic oligonucleotide
gcccgcccgacgggcggtgcgcctc

SEQ ID NO: 706153 - DNA, 25 bp, Artificial sequence
  Synthetic oligonucleotide
accccgcgcgtccggcgcagggcgg

SEQ ID NO: 706154 - DNA, 25 bp, Artificial sequence
  Synthetic oligonucleotide
cgcgccccggaccggtcgccgccga

SEQ ID NO: 706155 - DNA, 25 bp, Artificial sequence
  Synthetic oligonucleotide
ccccccgtgcgaggacgcccggcgc

SEQ ID NO: 706156 - DNA, 25 bp, Artificial sequence
  Synthetic oligonucleotide
gcgaggccggccctacggcgcgcgg

SEQ ID NO: 706157 - DNA, 25 bp, Artificial sequence
  Synthetic oligonucleotide
gcgaggccggccgtacggcgcgcgg

SEQ ID NO: 706158 - DNA, 25 bp, Artificial sequence
  Synthetic oligonucleotide
cgggcgcgacgggcgtcggcctccc

SEQ ID NO: 706159 - DNA, 25 bp, Artificial sequence
  Synthetic oligonucleotide
cgggcgcgacggccgtcggcctccc

SEQ ID NO: 706160 - DNA, 25 bp, Artificial sequence
  Synthetic oligonucleotide
cccgcgcgcgcgccgtacggcctcc

SEQ ID NO: 706161 - DNA, 25 bp, Artificial sequence
  Synthetic oligonucleotide
cccgcgcgcgcggcgtacggcctcc

SEQ ID NO: 706162 - DNA, 25 bp, Artificial sequence
  Synthetic oligonucleotide
gcccgcccgacgcgcggtgcgcctc

SEQ ID NO: 706163 - DNA, 25 bp, Artificial sequence
  Synthetic oligonucleotide
ccacagcccccccacgcgcggcgcc

SEQ ID NO: 706164 - DNA, 25 bp, Artificial sequence
  Synthetic oligonucleotide
ccgccgcccgccggcggtgtctgcc

SEQ ID NO: 706165 - DNA, 25 bp, Artificial sequence
  Synthetic oligonucleotide
ccgccgcccgcccgcggtgtctgcc

SEQ ID NO: 706166 - DNA, 25 bp, Artificial sequence
  Synthetic oligonucleotide
cgcgctacgcggcgcccccccacgc

SEQ ID NO: 706167 - DNA, 25 bp, Artificial sequence
  Synthetic oligonucleotide
cgcgctacgcggggcccccccacgc

SEQ ID NO: 706168 - DNA, 25 bp, Artificial sequence
  Synthetic oligonucleotide
cgtcggcgcgccgaggcgacccccg

SEQ ID NO: 706169 - DNA, 25 bp, Artificial sequence
  Synthetic oligonucleotide
ccggggcccactcgcggcgcgcgac

SEQ ID NO: 706170 - DNA, 25 bp, Artificial sequence
  Synthetic oligonucleotide
ccacagccccccgacgcgcggcgcc

SEQ ID NO: 706171 - DNA, 25 bp, Artificial sequence
  Synthetic oligonucleotide
acggcgggggctcgcagccgcgccg

SEQ ID NO: 706172 - DNA, 25 bp, Artificial sequence
  Synthetic oligonucleotide
gcctcggacgccaccggcgcggcgg

SEQ ID NO: 706173 - DNA, 25 bp, Artificial sequence
  Synthetic oligonucleotide
gcctcggacgcctccggcgcggcgg

SEQ ID NO: 706174 - DNA, 25 bp, Artificial sequence
  Synthetic oligonucleotide
ccccacactcccccggcggccgggc

SEQ ID NO: 706175 - DNA, 25 bp, Artificial sequence
  Synthetic oligonucleotide
ccccacactcccgcggcggccgggc

SEQ ID NO: 706176 - DNA, 25 bp, Artificial sequence
  Synthetic oligonucleotide
ggggccgccggcccgcggcagtgtg

SEQ ID NO: 706177 - DNA, 25 bp, Artificial sequence
  Synthetic oligonucleotide
ggggccgccggcgcgcggcagtgtg

SEQ ID NO: 706178 - DNA, 25 bp, Artificial sequence
  Synthetic oligonucleotide
cgtcggcgcgcccaggcgacccccg

SEQ ID NO: 706179 - DNA, 25 bp, Artificial sequence
  Synthetic oligonucleotide
cgcccgctggaccagcggcgcgccg

SEQ ID NO: 706180 - DNA, 25 bp, Artificial sequence
  Synthetic oligonucleotide
cgccgcgcccgttcgggcgagccgg

SEQ ID NO: 706181 - DNA, 25 bp, Artificial sequence
  Synthetic oligonucleotide
gcgggctgtccgccggtgggccccc

SEQ ID NO: 706182 - DNA, 25 bp, Artificial sequence
  Synthetic oligonucleotide
gcgggctgtccggcggtgggccccc

SEQ ID NO: 706183 - DNA, 25 bp, Artificial sequence
  Synthetic oligonucleotide
cccgcacccggccgtcgcaccccgc

SEQ ID NO: 706184 - DNA, 25 bp, Artificial sequence
  Synthetic oligonucleotide
cccgcacccggcggtcgcaccccgc

SEQ ID NO: 706185 - DNA, 25 bp, Artificial sequence
  Synthetic oligonucleotide
gcgggagcccccgcgcgcgtcccgt

SEQ ID NO: 706186 - DNA, 25 bp, Artificial sequence
  Synthetic oligonucleotide
gccggtgggcgggccacgcgcctcg

SEQ ID NO: 706187 - DNA, 25 bp, Artificial sequence
  Synthetic oligonucleotide
cgcccgctggacgagcggcgcgccg

SEQ ID NO: 706188 - DNA, 25 bp, Artificial sequence
  Synthetic oligonucleotide
gccggtgggcggcccacgcgcctcg

SEQ ID NO: 706189 - DNA, 25 bp, Artificial sequence
  Synthetic oligonucleotide
gcgcgaccgccgcgccggcagccac

SEQ ID NO: 706190 - DNA, 25 bp, Artificial sequence
  Synthetic oligonucleotide
gcgcgaccgccgggccggcagccac

SEQ ID NO: 706191 - DNA, 25 bp, Artificial sequence
  Synthetic oligonucleotide
ggccgggctaggggccgcacccggg

SEQ ID NO: 706192 - DNA, 25 bp, Artificial sequence
  Synthetic oligonucleotide
ccgcgccgcggttgcggtcggcggg

SEQ ID NO: 706193 - DNA, 25 bp, Artificial sequence
  Synthetic oligonucleotide
acggcgggggctggcagccgcgccg

SEQ ID NO: 706194 - DNA, 25 bp, Artificial sequence
  Synthetic oligonucleotide
ccccccgtgcgacgacgcccggcgc

SEQ ID NO: 706195 - DNA, 25 bp, Artificial sequence
  Synthetic oligonucleotide
gcgggagcccccccgcgcgtcccgt

SEQ ID NO: 706196 - DNA, 25 bp, Artificial sequence
  Synthetic oligonucleotide
gcgccggtcgcatgcgcggcccgcg

SEQ ID NO: 706197 - DNA, 25 bp, Artificial sequence
  Synthetic oligonucleotide
ggccccgtcggcgcatcgcccgccg

SEQ ID NO: 706198 - DNA, 25 bp, Artificial sequence
  Synthetic oligonucleotide
ggcgggggtcgcgcggtagcgggcc

SEQ ID NO: 706199 - DNA, 25 bp, Artificial sequence
  Synthetic oligonucleotide
gcgcaccccccgggtcgagcgcccg

SEQ ID NO: 706200 - DNA, 25 bp, Artificial sequence
  Synthetic oligonucleotide
gccgcgggtctcgaccgcggccgcg

SEQ ID NO: 706201 - DNA, 25 bp, Artificial sequence
  Synthetic oligonucleotide
gccgcgggtctccaccgcggccgcg

SEQ ID NO: 706202 - DNA, 25 bp, Artificial sequence
  Synthetic oligonucleotide
ccggcggtcgaccgcgcgaggcccg

SEQ ID NO: 706203 - DNA, 25 bp, Artificial sequence
  Synthetic oligonucleotide
gcgggcggtaggcgcaccgccggcg

SEQ ID NO: 706204 - DNA, 25 bp, Artificial sequence
  Synthetic oligonucleotide
gcgccggtcgcaagcgcggcccgcg

SEQ ID NO: 706205 - DNA, 25 bp, Artificial sequence
  Synthetic oligonucleotide
gcgggcggtaggggcaccgccggcg

SEQ ID NO: 706206 - DNA, 25 bp, Artificial sequence
  Synthetic oligonucleotide
gggcgggtcgcgaccgcctggccgg

SEQ ID NO: 706207 - DNA, 25 bp, Artificial sequence
  Synthetic oligonucleotide
gggcgggtcgcgtccgcctggccgg

SEQ ID NO: 706208 - DNA, 25 bp, Artificial sequence
  Synthetic oligonucleotide
ccgcgcgtcgcgcccgtaccggccc

SEQ ID NO: 706209 - DNA, 25 bp, Artificial sequence
  Synthetic oligonucleotide
ccgcgcgtcgcggccgtaccggccc

SEQ ID NO: 706210 - DNA, 25 bp, Artificial sequence
  Synthetic oligonucleotide
ggcggggtcgcgcgtacgggccggc

SEQ ID NO: 706211 - DNA, 25 bp, Artificial sequence
  Synthetic oligonucleotide
ggcggggtcgcgggtacgggccggc

SEQ ID NO: 706212 - DNA, 25 bp, Artificial sequence
  Synthetic oligonucleotide
ccggcggtcgacggcgcgaggcccg

SEQ ID NO: 706213 - DNA, 25 bp, Artificial sequence
  Synthetic oligonucleotide
cgccccggcggtgcgctaggcggcg

SEQ ID NO: 706214 - DNA, 25 bp, Artificial sequence
  Synthetic oligonucleotide
ggccgggctaggcgccgcacccggg

SEQ ID NO: 706215 - DNA, 25 bp, Artificial sequence
  Synthetic oligonucleotide
cgccgcggcccgaacgacggcgccg

SEQ ID NO: 706216 - DNA, 25 bp, Artificial sequence
  Synthetic oligonucleotide
cgccgcggcccgtacgacggcgccg

SEQ ID NO: 706217 - DNA, 25 bp, Artificial sequence
  Synthetic oligonucleotide
gcccgcggcgatccgacgggccgcc

SEQ ID NO: 706218 - DNA, 25 bp, Artificial sequence
  Synthetic oligonucleotide
gcccgcggcgatgcgacgggccgcc

SEQ ID NO: 706219 - DNA, 25 bp, Artificial sequence
  Synthetic oligonucleotide
ccgccgggcgcgcgctagtccccgc

SEQ ID NO: 706220 - DNA, 25 bp, Artificial sequence
  Synthetic oligonucleotide
ccggcggcgacgggcccgtgcgagc

SEQ ID NO: 706221 - DNA, 25 bp, Artificial sequence
  Synthetic oligonucleotide
cgccccggcggtccgctaggcggcg

SEQ ID NO: 706222 - DNA, 25 bp, Artificial sequence
  Synthetic oligonucleotide
ggcgggggtcgcccggtagcgggcc

SEQ ID NO: 706223 - DNA, 25 bp, Artificial sequence
  Synthetic oligonucleotide
cgcgcgggcgtcctcccgaccgggc

SEQ ID NO: 706224 - DNA, 25 bp, Artificial sequence
  Synthetic oligonucleotide
cgcgcgggcgtcgtcccgaccgggc

SEQ ID NO: 706225 - DNA, 25 bp, Artificial sequence
  Synthetic oligonucleotide
gccgccggggcgacgaacgcgcggg

SEQ ID NO: 706226 - DNA, 25 bp, Artificial sequence
  Synthetic oligonucleotide
gccgccggggcgtcgaacgcgcggg

SEQ ID NO: 706227 - DNA, 25 bp, Artificial sequence
  Synthetic oligonucleotide
gggggcggtacgggctccgccccgc

SEQ ID NO: 706228 - DNA, 25 bp, Artificial sequence
  Synthetic oligonucleotide
gggggcggtacgcgctccgccccgc

SEQ ID NO: 706229 - DNA, 25 bp, Artificial sequence
  Synthetic oligonucleotide
ccgccgggcgcgggctagtccccgc

SEQ ID NO: 706230 - DNA, 25 bp, Artificial sequence
  Synthetic oligonucleotide
ggggcctggcggtcgcacgcgcgcc

SEQ ID NO: 706231 - DNA, 25 bp, Artificial sequence
  Synthetic oligonucleotide
gcgcgaccacgccggacgggccccc

SEQ ID NO: 706232 - DNA, 25 bp, Artificial sequence
  Synthetic oligonucleotide
tgggggacggcccgtccgcggcgcc

SEQ ID NO: 706233 - DNA, 25 bp, Artificial sequence
  Synthetic oligonucleotide
tgggggacggccggtccgcggcgcc

SEQ ID NO: 706234 - DNA, 25 bp, Artificial sequence
  Synthetic oligonucleotide
ccggcgttgcgcgggacggcgcgcc

SEQ ID NO: 706235 - DNA, 25 bp, Artificial sequence
  Synthetic oligonucleotide
ccggcgttgcgccggacggcgcgcc

SEQ ID NO: 706236 - DNA, 25 bp, Artificial sequence
  Synthetic oligonucleotide
cgcgggtgcgcgctcgcgagcgcgc

SEQ ID NO: 706237 - DNA, 25 bp, Artificial sequence
  Synthetic oligonucleotide
ggccccgtcggcccatcgcccgccg

SEQ ID NO: 706238 - DNA, 25 bp, Artificial sequence
  Synthetic oligonucleotide
ggccggttcgcccgcgggtggcggc

SEQ ID NO: 706239 - DNA, 25 bp, Artificial sequence
  Synthetic oligonucleotide
cggccctcgtacgccgggcggcgcc

SEQ ID NO: 706240 - DNA, 25 bp, Artificial sequence
  Synthetic oligonucleotide
cgggcctcggcggtcacggcgccgg

SEQ ID NO: 706241 - DNA, 25 bp, Artificial sequence
  Synthetic oligonucleotide
ggccggttcgccggcgggtggcggc

SEQ ID NO: 706242 - DNA, 25 bp, Artificial sequence
  Synthetic oligonucleotide
ggggcctggcggacgcacgcgcgcc

SEQ ID NO: 706243 - DNA, 25 bp, Artificial sequence
  Synthetic oligonucleotide
gcgcgaccacgcgggacgggccccc

SEQ ID NO: 706244 - DNA, 25 bp, Artificial sequence
  Synthetic oligonucleotide
cgggcctcggcgctcacggcgccgg

SEQ ID NO: 706245 - DNA, 25 bp, Artificial sequence
  Synthetic oligonucleotide
cggccctcgtaccccgggcggcgcc

SEQ ID NO: 706246 - DNA, 25 bp, Artificial sequence
  Synthetic oligonucleotide
cgcgggtgcgcggtcgcgagcgcgc

SEQ ID NO: 706247 - DNA, 25 bp, Artificial sequence
  Synthetic oligonucleotide
cccgcctgcgcgcgccgtacggccc

SEQ ID NO: 706248 - DNA, 25 bp, Artificial sequence
  Synthetic oligonucleotide
cccgcctgcgcgggccgtacggccc

SEQ ID NO: 706249 - DNA, 25 bp, Artificial sequence
  Synthetic oligonucleotide
ggcgggtcgcgggcgatcccggcgg

SEQ ID NO: 706250 - DNA, 25 bp, Artificial sequence
  Synthetic oligonucleotide
ggcgggtcgcggccgatcccggcgg

SEQ ID NO: 706251 - DNA, 25 bp, Artificial sequence
  Synthetic oligonucleotide
gccccctccacgcgtcgcggccccg

SEQ ID NO: 706252 - DNA, 25 bp, Artificial sequence
  Synthetic oligonucleotide
gccccctccacgggtcgcggccccg

SEQ ID NO: 706253 - DNA, 25 bp, Artificial sequence
  Synthetic oligonucleotide
cggcgctaggcgacgcggcccgccc

SEQ ID NO: 706254 - DNA, 25 bp, Artificial sequence
  Synthetic oligonucleotide
cggcgctaggcgtcgcggcccgccc

SEQ ID NO: 706255 - DNA, 25 bp, Artificial sequence
  Synthetic oligonucleotide
ccgccgtagcgagcccgcggcccgc

SEQ ID NO: 706256 - DNA, 25 bp, Artificial sequence
  Synthetic oligonucleotide
ccgccgtagcgaccccgcggcccgc

SEQ ID NO: 706257 - DNA, 25 bp, Artificial sequence
  Synthetic oligonucleotide
gcgcccgtgcgcgcgatcggcggcg

SEQ ID NO: 706258 - DNA, 25 bp, Artificial sequence
  Synthetic oligonucleotide
gcgcccgtgcgcccgatcggcggcg

SEQ ID NO: 706259 - DNA, 25 bp, Artificial sequence
  Synthetic oligonucleotide
aatagttataacattaacgattcaa

SEQ ID NO: 706260 - DNA, 25 bp, Artificial sequence
  Synthetic oligonucleotide
taaaagatacgaatattgtaactaa

SEQ ID NO: 706261 - DNA, 25 bp, Artificial sequence
  Synthetic oligonucleotide
ttataatatcgtatttaaccgatat

SEQ ID NO: 706262 - DNA, 25 bp, Artificial sequence
  Synthetic oligonucleotide
ttataatatcgtttttaaccgatat

SEQ ID NO: 706263 - DNA, 25 bp, Artificial sequence
  Synthetic oligonucleotide
gaattatttcgtataattactcata

SEQ ID NO: 706264 - DNA, 25 bp, Artificial sequence
  Synthetic oligonucleotide
gaattatttcgtttaattactcata

SEQ ID NO: 706265 - DNA, 25 bp, Artificial sequence
  Synthetic oligonucleotide
aagtgtaacaattaatcgatattat

SEQ ID NO: 706266 - DNA, 25 bp, Artificial sequence
  Synthetic oligonucleotide
cttttatcaaattcgtctattaatt

SEQ ID NO: 706267 - DNA, 25 bp, Artificial sequence
  Synthetic oligonucleotide
tgatttatatccgttaattaatatg

SEQ ID NO: 706268 - DNA, 25 bp, Artificial sequence
  Synthetic oligonucleotide
tgatttatatcccttaattaatatg

SEQ ID NO: 706269 - DNA, 25 bp, Artificial sequence
  Synthetic oligonucleotide
tgtaatttacgaaaatatcttaaac

SEQ ID NO: 706270 - DNA, 25 bp, Artificial sequence
  Synthetic oligonucleotide
tgtaatttacgataatatcttaaac

SEQ ID NO: 706271 - DNA, 25 bp, Artificial sequence
  Synthetic oligonucleotide
aataatttatatgaatcgcttagaa

SEQ ID NO: 706272 - DNA, 25 bp, Artificial sequence
  Synthetic oligonucleotide
aataatttatatcaatcgcttagaa

SEQ ID NO: 706273 - DNA, 25 bp, Artificial sequence
  Synthetic oligonucleotide
attatacggttaatttaatagaaca

SEQ ID NO: 706274 - DNA, 25 bp, Artificial sequence
  Synthetic oligonucleotide
aagtgtaacaataaatcgatattat

SEQ ID NO: 706275 - DNA, 25 bp, Artificial sequence
  Synthetic oligonucleotide
gtaactatatcgaattacaaatatt

SEQ ID NO: 706276 - DNA, 25 bp, Artificial sequence
  Synthetic oligonucleotide
attatacggttattttaatagaaca

SEQ ID NO: 706277 - DNA, 25 bp, Artificial sequence
  Synthetic oligonucleotide
aatagttataactttaacgattcaa

SEQ ID NO: 706278 - DNA, 25 bp, Artificial sequence
  Synthetic oligonucleotide
tataatattattggataagaagcaa

SEQ ID NO: 706279 - DNA, 25 bp, Artificial sequence
  Synthetic oligonucleotide
tataatattattcgataagaagcaa

SEQ ID NO: 706280 - DNA, 25 bp, Artificial sequence
  Synthetic oligonucleotide
taatgatcggataatttaattacaa

SEQ ID NO: 706281 - DNA, 25 bp, Artificial sequence
  Synthetic oligonucleotide
taatgatcggattatttaattacaa

SEQ ID NO: 706282 - DNA, 25 bp, Artificial sequence
  Synthetic oligonucleotide
catttttgtaattttcgataatcta

SEQ ID NO: 706283 - DNA, 25 bp, Artificial sequence
  Synthetic oligonucleotide
atctattcgataaaatgtaattctt

SEQ ID NO: 706284 - DNA, 25 bp, Artificial sequence
  Synthetic oligonucleotide
ataggacgatatgaataaatataat

SEQ ID NO: 706285 - DNA, 25 bp, Artificial sequence
  Synthetic oligonucleotide
ataggacgatatcaataaatataat

SEQ ID NO: 706286 - DNA, 25 bp, Artificial sequence
  Synthetic oligonucleotide
taatgactattacgttaatttcata

SEQ ID NO: 706287 - DNA, 25 bp, Artificial sequence
  Synthetic oligonucleotide
aacattacgattgtaaattatttca

SEQ ID NO: 706288 - DNA, 25 bp, Artificial sequence
  Synthetic oligonucleotide
gtaactatatcgtattacaaatatt

SEQ ID NO: 706289 - DNA, 25 bp, Artificial sequence
  Synthetic oligonucleotide
taattgacgttattataatacagtt

SEQ ID NO: 706290 - DNA, 25 bp, Artificial sequence
  Synthetic oligonucleotide
atagatatatctttcgataaaaaca

SEQ ID NO: 706291 - DNA, 25 bp, Artificial sequence
  Synthetic oligonucleotide
atagatatatctatcgataaaaaca

SEQ ID NO: 706292 - DNA, 25 bp, Artificial sequence
  Synthetic oligonucleotide
ttagtattaattacgaacaatctaa

SEQ ID NO: 706293 - DNA, 25 bp, Artificial sequence
  Synthetic oligonucleotide
ttagtattaatttcgaacaatctaa

SEQ ID NO: 706294 - DNA, 25 bp, Artificial sequence
  Synthetic oligonucleotide
ttgatgtattaccgttaaataaatt

SEQ ID NO: 706295 - DNA, 25 bp, Artificial sequence
  Synthetic oligonucleotide
ttgatgtattacggttaaataaatt

SEQ ID NO: 706296 - DNA, 25 bp, Artificial sequence
  Synthetic oligonucleotide
cttttatcaaatacgtctattaatt

SEQ ID NO: 706297 - DNA, 25 bp, Artificial sequence
  Synthetic oligonucleotide
atctattcgatataatgtaattctt

SEQ ID NO: 706298 - DNA, 25 bp, Artificial sequence
  Synthetic oligonucleotide
aacattacgattctaaattatttca

SEQ ID NO: 706299 - DNA, 25 bp, Artificial sequence
  Synthetic oligonucleotide
gataattattacgaatcatttaaga

SEQ ID NO: 706300 - DNA, 25 bp, Artificial sequence
  Synthetic oligonucleotide
gataattattaccaatcatttaaga

SEQ ID NO: 706301 - DNA, 25 bp, Artificial sequence
  Synthetic oligonucleotide
taaaagatacgattattgtaactaa

SEQ ID NO: 706302 - DNA, 25 bp, Artificial sequence
  Synthetic oligonucleotide
taatgactattaggttaatttcata

SEQ ID NO: 706303 - DNA, 25 bp, Artificial sequence
  Synthetic oligonucleotide
ttaatcgtattgtattaactaaaag

SEQ ID NO: 706304 - DNA, 25 bp, Artificial sequence
  Synthetic oligonucleotide
taaataactatcgataattatgctt

SEQ ID NO: 706305 - DNA, 25 bp, Artificial sequence
  Synthetic oligonucleotide
taaataactatccataattatgctt

SEQ ID NO: 706306 - DNA, 25 bp, Artificial sequence
  Synthetic oligonucleotide
gtaaatatactatctattcgttaat

SEQ ID NO: 706307 - DNA, 25 bp, Artificial sequence
  Synthetic oligonucleotide
gtaaatatactaactattcgttaat

SEQ ID NO: 706308 - DNA, 25 bp, Artificial sequence
  Synthetic oligonucleotide
aatacaactcgtaataatatttgaa

SEQ ID NO: 706309 - DNA, 25 bp, Artificial sequence
  Synthetic oligonucleotide
aatacaactcgttataatatttgaa

SEQ ID NO: 706310 - DNA, 25 bp, Artificial sequence
  Synthetic oligonucleotide
aagtatattattatccgatatctat

SEQ ID NO: 706311 - DNA, 25 bp, Artificial sequence
  Synthetic oligonucleotide
aagtatattattttccgatatctat

SEQ ID NO: 706312 - DNA, 25 bp, Artificial sequence
  Synthetic oligonucleotide
aaatcaattcgagtatattatagaa

SEQ ID NO: 706313 - DNA, 25 bp, Artificial sequence
  Synthetic oligonucleotide
aaatcaattcgactatattatagaa

SEQ ID NO: 706314 - DNA, 25 bp, Artificial sequence
  Synthetic oligonucleotide
gaattataaatttactatcgtctat

SEQ ID NO: 706315 - DNA, 25 bp, Artificial sequence
  Synthetic oligonucleotide
gaattataaattaactatcgtctat

SEQ ID NO: 706316 - DNA, 25 bp, Artificial sequence
  Synthetic oligonucleotide
ataaatatcgtagatgttatatgta

SEQ ID NO: 706317 - DNA, 25 bp, Artificial sequence
  Synthetic oligonucleotide
aaatattagtcgaaatttatgatct

SEQ ID NO: 706318 - DNA, 25 bp, Artificial sequence
  Synthetic oligonucleotide
attgaataaatcgatatagttctat

SEQ ID NO: 706319 - DNA, 25 bp, Artificial sequence
  Synthetic oligonucleotide
ttaatcgtattgaattaactaaaag

SEQ ID NO: 706320 - DNA, 25 bp, Artificial sequence
  Synthetic oligonucleotide
aattttgataagtcgttaaacatat

SEQ ID NO: 706321 - DNA, 25 bp, Artificial sequence
  Synthetic oligonucleotide
aattttgataagacgttaaacatat

SEQ ID NO: 706322 - DNA, 25 bp, Artificial sequence
  Synthetic oligonucleotide
agtttatatcgttaatctaaaaaga

SEQ ID NO: 706323 - DNA, 25 bp, Artificial sequence
  Synthetic oligonucleotide
agtttatatcgtaaatctaaaaaga

SEQ ID NO: 706324 - DNA, 25 bp, Artificial sequence
  Synthetic oligonucleotide
ataaatatcgtacatgttatatgta

SEQ ID NO: 706325 - DNA, 25 bp, Artificial sequence
  Synthetic oligonucleotide
catttttgtaatattcgataatcta

SEQ ID NO: 706326 - DNA, 25 bp, Artificial sequence
  Synthetic oligonucleotide
tatacattatctaatcgttagtaat

SEQ ID NO: 706327 - DNA, 25 bp, Artificial sequence
  Synthetic oligonucleotide
tatacattatcttatcgttagtaat

SEQ ID NO: 706328 - DNA, 25 bp, Artificial sequence
  Synthetic oligonucleotide
ttattaatatgtgttatcgttatgt

SEQ ID NO: 706329 - DNA, 25 bp, Artificial sequence
  Synthetic oligonucleotide
ttattaatatgtcttatcgttatgt

SEQ ID NO: 706330 - DNA, 25 bp, Artificial sequence
  Synthetic oligonucleotide
taattgacgttaatataatacagtt

SEQ ID NO: 706331 - DNA, 25 bp, Artificial sequence
  Synthetic oligonucleotide
aattgtattatccgttagaatttta

SEQ ID NO: 706332 - DNA, 25 bp, Artificial sequence
  Synthetic oligonucleotide
aaatattagtcgtaatttatgatct

SEQ ID NO: 706333 - DNA, 25 bp, Artificial sequence
  Synthetic oligonucleotide
atgtagtcgattaataatagtttta

SEQ ID NO: 706334 - DNA, 25 bp, Artificial sequence
  Synthetic oligonucleotide
tatattattataggcgaaaatctaa

SEQ ID NO: 706335 - DNA, 25 bp, Artificial sequence
  Synthetic oligonucleotide
catttttaatataatcgttctaaac

SEQ ID NO: 706336 - DNA, 25 bp, Artificial sequence
  Synthetic oligonucleotide
catttttaatattatcgttctaaac

SEQ ID NO: 706337 - DNA, 25 bp, Artificial sequence
  Synthetic oligonucleotide
tatagattagatatcgatatattct

SEQ ID NO: 706338 - DNA, 25 bp, Artificial sequence
  Synthetic oligonucleotide
tatagattagatttcgatatattct

SEQ ID NO: 706339 - DNA, 25 bp, Artificial sequence
  Synthetic oligonucleotide
aatgtattaagtacgattaacaatt

SEQ ID NO: 706340 - DNA, 25 bp, Artificial sequence
  Synthetic oligonucleotide
aatgtattaagttcgattaacaatt

SEQ ID NO: 706341 - DNA, 25 bp, Artificial sequence
  Synthetic oligonucleotide
tatctatacttattcgtaatactaa

SEQ ID NO: 706342 - DNA, 25 bp, Artificial sequence
  Synthetic oligonucleotide
tatctatacttaatcgtaatactaa

SEQ ID NO: 706343 - DNA, 25 bp, Artificial sequence
  Synthetic oligonucleotide
tatctgatacataattcgtatatta

SEQ ID NO: 706344 - DNA, 25 bp, Artificial sequence
  Synthetic oligonucleotide
tatctgatacattattcgtatatta

SEQ ID NO: 706345 - DNA, 25 bp, Artificial sequence
  Synthetic oligonucleotide
aatatattagtatttcgtaaagcaa

SEQ ID NO: 706346 - DNA, 25 bp, Artificial sequence
  Synthetic oligonucleotide
aatatattagtaattcgtaaagcaa

SEQ ID NO: 706347 - DNA, 25 bp, Artificial sequence
  Synthetic oligonucleotide
atgtattcggattgattatatatta

SEQ ID NO: 706348 - DNA, 25 bp, Artificial sequence
  Synthetic oligonucleotide
acacaattagattattacgttattt

SEQ ID NO: 706349 - DNA, 25 bp, Artificial sequence
  Synthetic oligonucleotide
tatattattatacgcgaaaatctaa

SEQ ID NO: 706350 - DNA, 25 bp, Artificial sequence
  Synthetic oligonucleotide
attgaataaatccatatagttctat

SEQ ID NO: 706351 - DNA, 25 bp, Artificial sequence
  Synthetic oligonucleotide
aaacttttagcgttattatgttata

SEQ ID NO: 706352 - DNA, 25 bp, Artificial sequence
  Synthetic oligonucleotide
aaacttttagcgatattatgttata

SEQ ID NO: 706353 - DNA, 25 bp, Artificial sequence
  Synthetic oligonucleotide
tacatcgaatatataatctatgaaa

SEQ ID NO: 706354 - DNA, 25 bp, Artificial sequence
  Synthetic oligonucleotide
tatattcgagtttagttaatttgaa

SEQ ID NO: 706355 - DNA, 25 bp, Artificial sequence
  Synthetic oligonucleotide
acacaattagataattacgttattt

SEQ ID NO: 706356 - DNA, 25 bp, Artificial sequence
  Synthetic oligonucleotide
tatattcgagttaagttaatttgaa

SEQ ID NO: 706357 - DNA, 25 bp, Artificial sequence
  Synthetic oligonucleotide
agtaaaacgctatattaataatcaa

SEQ ID NO: 706358 - DNA, 25 bp, Artificial sequence
  Synthetic oligonucleotide
agtaaaacgctaaattaataatcaa

SEQ ID NO: 706359 - DNA, 25 bp, Artificial sequence
  Synthetic oligonucleotide
caatctcgatttttatatcttttat

SEQ ID NO: 706360 - DNA, 25 bp, Artificial sequence
  Synthetic oligonucleotide
caatctcgatttatatatcttttat

SEQ ID NO: 706361 - DNA, 25 bp, Artificial sequence
  Synthetic oligonucleotide
atgtagtcgatttataatagtttta

SEQ ID NO: 706362 - DNA, 25 bp, Artificial sequence
  Synthetic oligonucleotide
atgtattcggatagattatatatta

SEQ ID NO: 706363 - DNA, 25 bp, Artificial sequence
  Synthetic oligonucleotide
tacatcgaatatttaatctatgaaa

SEQ ID NO: 706364 - DNA, 25 bp, Artificial sequence
  Synthetic oligonucleotide
tgtattataataggtctaaactata

SEQ ID NO: 706365 - DNA, 25 bp, Artificial sequence
  Synthetic oligonucleotide
ttttttatcgtaaatctatatgaag

SEQ ID NO: 706366 - DNA, 25 bp, Artificial sequence
  Synthetic oligonucleotide
tctatttagtatattattcgttaag

SEQ ID NO: 706367 - DNA, 25 bp, Artificial sequence
  Synthetic oligonucleotide
tctatttagtattttattcgttaag

SEQ ID NO: 706368 - DNA, 25 bp, Artificial sequence
  Synthetic oligonucleotide
aacataatacttattgcgattaaat

SEQ ID NO: 706369 - DNA, 25 bp, Artificial sequence
  Synthetic oligonucleotide
aacataatactttttgcgattaaat

SEQ ID NO: 706370 - DNA, 25 bp, Artificial sequence
  Synthetic oligonucleotide
tttctattatttatctacgatatag

SEQ ID NO: 706371 - DNA, 25 bp, Artificial sequence
  Synthetic oligonucleotide
acttctataacaattcgaatttaaa

SEQ ID NO: 706372 - DNA, 25 bp, Artificial sequence
  Synthetic oligonucleotide
tatattataagttcgtattatactg

SEQ ID NO: 706373 - DNA, 25 bp, Artificial sequence
  Synthetic oligonucleotide
tgtattataatacgtctaaactata

SEQ ID NO: 706374 - DNA, 25 bp, Artificial sequence
  Synthetic oligonucleotide
tttctttatatcctataagatgatt

SEQ ID NO: 706375 - DNA, 25 bp, Artificial sequence
  Synthetic oligonucleotide
tttctttatatcgtataagatgatt

SEQ ID NO: 706376 - DNA, 25 bp, Artificial sequence
  Synthetic oligonucleotide
tcaaatttaagtaaattcgtacaat

SEQ ID NO: 706377 - DNA, 25 bp, Artificial sequence
  Synthetic oligonucleotide
tcaaatttaagttaattcgtacaat

SEQ ID NO: 706378 - DNA, 25 bp, Artificial sequence
  Synthetic oligonucleotide
taacaaatttttcgataactaagat

SEQ ID NO: 706379 - DNA, 25 bp, Artificial sequence
  Synthetic oligonucleotide
acttctataacatttcgaatttaaa

SEQ ID NO: 706380 - DNA, 25 bp, Artificial sequence
  Synthetic oligonucleotide
atattttcgaattgttattatcgat

SEQ ID NO: 706381 - DNA, 25 bp, Artificial sequence
  Synthetic oligonucleotide
gatattagtttatcgatattacata

SEQ ID NO: 706382 - DNA, 25 bp, Artificial sequence
  Synthetic oligonucleotide
gatattagtttaacgatattacata

SEQ ID NO: 706383 - DNA, 25 bp, Artificial sequence
  Synthetic oligonucleotide
tttttttacgataacgatttataga

SEQ ID NO: 706384 - DNA, 25 bp, Artificial sequence
  Synthetic oligonucleotide
tttttttacgattacgatttataga

SEQ ID NO: 706385 - DNA, 25 bp, Artificial sequence
  Synthetic oligonucleotide
gtaattgataataatacgataacaa

SEQ ID NO: 706386 - DNA, 25 bp, Artificial sequence
  Synthetic oligonucleotide
gtaattgataattatacgataacaa

SEQ ID NO: 706387 - DNA, 25 bp, Artificial sequence
  Synthetic oligonucleotide
ttttttatcgtatatctatatgaag

SEQ ID NO: 706388 - DNA, 25 bp, Artificial sequence
  Synthetic oligonucleotide
ttaggtcgacaaaattataatttat

SEQ ID NO: 706389 - DNA, 25 bp, Artificial sequence
  Synthetic oligonucleotide
tatattataagtacgtattatactg

SEQ ID NO: 706390 - DNA, 25 bp, Artificial sequence
  Synthetic oligonucleotide
atattttcgaatagttattatcgat

SEQ ID NO: 706391 - DNA, 25 bp, Artificial sequence
  Synthetic oligonucleotide
aaatattagattcgatctattagta

SEQ ID NO: 706392 - DNA, 25 bp, Artificial sequence
  Synthetic oligonucleotide
aaatattagattggatctattagta

SEQ ID NO: 706393 - DNA, 25 bp, Artificial sequence
  Synthetic oligonucleotide
aatagatcaaattttgaacgttaaa

SEQ ID NO: 706394 - DNA, 25 bp, Artificial sequence
  Synthetic oligonucleotide
aatagatcaaatattgaacgttaaa

SEQ ID NO: 706395 - DNA, 25 bp, Artificial sequence
  Synthetic oligonucleotide
atcattaacgatagttatatttgaa

SEQ ID NO: 706396 - DNA, 25 bp, Artificial sequence
  Synthetic oligonucleotide
ttaggtcgacaatattataatttat

SEQ ID NO: 706397 - DNA, 25 bp, Artificial sequence
  Synthetic oligonucleotide
taaaccgatgttatattatatgata

SEQ ID NO: 706398 - DNA, 25 bp, Artificial sequence
  Synthetic oligonucleotide
tagtaatttaaaacgttagaaacaa

SEQ ID NO: 706399 - DNA, 25 bp, Artificial sequence
  Synthetic oligonucleotide
tagtaatttaaatcgttagaaacaa

SEQ ID NO: 706400 - DNA, 25 bp, Artificial sequence
  Synthetic oligonucleotide
attgttactacgtaaattatgatat

SEQ ID NO: 706401 - DNA, 25 bp, Artificial sequence
  Synthetic oligonucleotide
attgttactacgaaaattatgatat

SEQ ID NO: 706402 - DNA, 25 bp, Artificial sequence
  Synthetic oligonucleotide
cattagcgattaattaatattgtaa

SEQ ID NO: 706403 - DNA, 25 bp, Artificial sequence
  Synthetic oligonucleotide
tttctattatttttctacgatatag

SEQ ID NO: 706404 - DNA, 25 bp, Artificial sequence
  Synthetic oligonucleotide
taaaccgatgttttattatatgata

SEQ ID NO: 706405 - DNA, 25 bp, Artificial sequence
  Synthetic oligonucleotide
aatttatatattcggattaatgaga

SEQ ID NO: 706406 - DNA, 25 bp, Artificial sequence
  Synthetic oligonucleotide
atgaatctaaaccatattaatattg

SEQ ID NO: 706407 - DNA, 25 bp, Artificial sequence
  Synthetic oligonucleotide
atgaatctaaacgatattaatattg

SEQ ID NO: 706408 - DNA, 25 bp, Artificial sequence
  Synthetic oligonucleotide
ctaaaataatatggctgtaattaaa

SEQ ID NO: 706409 - DNA, 25 bp, Artificial sequence
  Synthetic oligonucleotide
ctaaaataatatcgctgtaattaaa

SEQ ID NO: 706410 - DNA, 25 bp, Artificial sequence
  Synthetic oligonucleotide
tatattataattacgtaatgttcga

SEQ ID NO: 706411 - DNA, 25 bp, Artificial sequence
  Synthetic oligonucleotide
aatagttagtataattcgattaatg

SEQ ID NO: 706412 - DNA, 25 bp, Artificial sequence
  Synthetic oligonucleotide
cattagcgattatttaatattgtaa

SEQ ID NO: 706413 - DNA, 25 bp, Artificial sequence
  Synthetic oligonucleotide
cactacatcgtaaatttataaattt

SEQ ID NO: 706414 - DNA, 25 bp, Artificial sequence
  Synthetic oligonucleotide
atcattaacgattgttatatttgaa

SEQ ID NO: 706415 - DNA, 25 bp, Artificial sequence
  Synthetic oligonucleotide
gttctctataacgatattattaatt

SEQ ID NO: 706416 - DNA, 25 bp, Artificial sequence
  Synthetic oligonucleotide
gttctctataaccatattattaatt

SEQ ID NO: 706417 - DNA, 25 bp, Artificial sequence
  Synthetic oligonucleotide
atgattttaatgtttaatcgctatt

SEQ ID NO: 706418 - DNA, 25 bp, Artificial sequence
  Synthetic oligonucleotide
atgattttaatgattaatcgctatt

SEQ ID NO: 706419 - DNA, 25 bp, Artificial sequence
  Synthetic oligonucleotide
ctaaattttcgattctaatataaga

SEQ ID NO: 706420 - DNA, 25 bp, Artificial sequence
  Synthetic oligonucleotide
aattttcttatcaacgattatatag

SEQ ID NO: 706421 - DNA, 25 bp, Artificial sequence
  Synthetic oligonucleotide
cactacatcgtatatttataaattt

SEQ ID NO: 706422 - DNA, 25 bp, Artificial sequence
  Synthetic oligonucleotide
aattttcttatctacgattatatag

SEQ ID NO: 706423 - DNA, 25 bp, Artificial sequence
  Synthetic oligonucleotide
taacaaatttttggataactaagat

SEQ ID NO: 706424 - DNA, 25 bp, Artificial sequence
  Synthetic oligonucleotide
aattgtattatcggttagaatttta

SEQ ID NO: 706425 - DNA, 25 bp, Artificial sequence
  Synthetic oligonucleotide
tattttaacgattaatatctgtaag

SEQ ID NO: 706426 - DNA, 25 bp, Artificial sequence
  Synthetic oligonucleotide
tattttaacgataaatatctgtaag

SEQ ID NO: 706427 - DNA, 25 bp, Artificial sequence
  Synthetic oligonucleotide
aatttatatattgggattaatgaga

SEQ ID NO: 706428 - DNA, 25 bp, Artificial sequence
  Synthetic oligonucleotide
atttatttgattacgacaattgttt

SEQ ID NO: 706429 - DNA, 25 bp, Artificial sequence
  Synthetic oligonucleotide
ctaaattttcgaatctaatataaga

SEQ ID NO: 706430 - DNA, 25 bp, Artificial sequence
  Synthetic oligonucleotide
aattcaaatatggggataattataa

SEQ ID NO: 706431 - DNA, 25 bp, Artificial sequence
  Synthetic oligonucleotide
aaaaactaacgaatcgatattaata

SEQ ID NO: 706432 - DNA, 25 bp, Artificial sequence
  Synthetic oligonucleotide
aaaaactaacgattcgatattaata

SEQ ID NO: 706433 - DNA, 25 bp, Artificial sequence
  Synthetic oligonucleotide
gaaatcgattgatatattatattgt

SEQ ID NO: 706434 - DNA, 25 bp, Artificial sequence
  Synthetic oligonucleotide
gaaatcgattgaaatattatattgt

SEQ ID NO: 706435 - DNA, 25 bp, Artificial sequence
  Synthetic oligonucleotide
aatctcgattataaatgtacaatat

SEQ ID NO: 706436 - DNA, 25 bp, Artificial sequence
  Synthetic oligonucleotide
atgataatttaacttatcgataaca

SEQ ID NO: 706437 - DNA, 25 bp, Artificial sequence
  Synthetic oligonucleotide
aattcaaatatgcggataattataa

SEQ ID NO: 706438 - DNA, 25 bp, Artificial sequence
  Synthetic oligonucleotide
tttatctatttaatgcgaataagta

SEQ ID NO: 706439 - DNA, 25 bp, Artificial sequence
  Synthetic oligonucleotide
actgatcgattaaataatgataaat

SEQ ID NO: 706440 - DNA, 25 bp, Artificial sequence
  Synthetic oligonucleotide
actgatcgattatataatgataaat

SEQ ID NO: 706441 - DNA, 25 bp, Artificial sequence
  Synthetic oligonucleotide
ttaatcgttaatttacaatttctag

SEQ ID NO: 706442 - DNA, 25 bp, Artificial sequence
  Synthetic oligonucleotide
ttaatcgttaatatacaatttctag

SEQ ID NO: 706443 - DNA, 25 bp, Artificial sequence
  Synthetic oligonucleotide
tacattaacgtatatattcgataat

SEQ ID NO: 706444 - DNA, 25 bp, Artificial sequence
  Synthetic oligonucleotide
tacattaacgtaaatattcgataat

SEQ ID NO: 706445 - DNA, 25 bp, Artificial sequence
  Synthetic oligonucleotide
aatctcgattattaatgtacaatat

SEQ ID NO: 706446 - DNA, 25 bp, Artificial sequence
  Synthetic oligonucleotide
tattcttcgaatataagttagataa

SEQ ID NO: 706447 - DNA, 25 bp, Artificial sequence
  Synthetic oligonucleotide
attaattatctacattgcgaatttt

SEQ ID NO: 706448 - DNA, 25 bp, Artificial sequence
  Synthetic oligonucleotide
cttattcgtaactagataaatatat

SEQ ID NO: 706449 - DNA, 25 bp, Artificial sequence
  Synthetic oligonucleotide
cttattcgtaacaagataaatatat

SEQ ID NO: 706450 - DNA, 25 bp, Artificial sequence
  Synthetic oligonucleotide
atatatgatattttaatcggatgaa

SEQ ID NO: 706451 - DNA, 25 bp, Artificial sequence
  Synthetic oligonucleotide
atatatgatattataatcggatgaa

SEQ ID NO: 706452 - DNA, 25 bp, Artificial sequence
  Synthetic oligonucleotide
attgttatttacgagattaatgatt

SEQ ID NO: 706453 - DNA, 25 bp, Artificial sequence
  Synthetic oligonucleotide
tatattaattaaatcgtatcaggta

SEQ ID NO: 706454 - DNA, 25 bp, Artificial sequence
  Synthetic oligonucleotide
tattcttcgaatttaagttagataa

SEQ ID NO: 706455 - DNA, 25 bp, Artificial sequence
  Synthetic oligonucleotide
tatattaattaattcgtatcaggta

SEQ ID NO: 706456 - DNA, 25 bp, Artificial sequence
  Synthetic oligonucleotide
atttttcgtctaagttatatagaaa

SEQ ID NO: 706457 - DNA, 25 bp, Artificial sequence
  Synthetic oligonucleotide
atttttcgtctatgttatatagaaa

SEQ ID NO: 706458 - DNA, 25 bp, Artificial sequence
  Synthetic oligonucleotide
ttgttttccgaatatttataaaatc

SEQ ID NO: 706459 - DNA, 25 bp, Artificial sequence
  Synthetic oligonucleotide
ttgttttccgaaaatttataaaatc

SEQ ID NO: 706460 - DNA, 25 bp, Artificial sequence
  Synthetic oligonucleotide
tttatctatttattgcgaataagta

SEQ ID NO: 706461 - DNA, 25 bp, Artificial sequence
  Synthetic oligonucleotide
atgagaagatataatcgtatttatt

SEQ ID NO: 706462 - DNA, 25 bp, Artificial sequence
  Synthetic oligonucleotide
attgttatttaccagattaatgatt

SEQ ID NO: 706463 - DNA, 25 bp, Artificial sequence
  Synthetic oligonucleotide
ataatcgaattaaattaagtaccta

SEQ ID NO: 706464 - DNA, 25 bp, Artificial sequence
  Synthetic oligonucleotide
attagatttaactcgtaatacattt

SEQ ID NO: 706465 - DNA, 25 bp, Artificial sequence
  Synthetic oligonucleotide
attactatttgaggattaattatct

SEQ ID NO: 706466 - DNA, 25 bp, Artificial sequence
  Synthetic oligonucleotide
attactatttgacgattaattatct

SEQ ID NO: 706467 - DNA, 25 bp, Artificial sequence
  Synthetic oligonucleotide
tcaattagttgttcgtataattata

SEQ ID NO: 706468 - DNA, 25 bp, Artificial sequence
  Synthetic oligonucleotide
tcaattagttgtacgtataattata

SEQ ID NO: 706469 - DNA, 25 bp, Artificial sequence
  Synthetic oligonucleotide
atagagattaacgatattatatgta

SEQ ID NO: 706470 - DNA, 25 bp, Artificial sequence
  Synthetic oligonucleotide
gttaaataccgatataatattgaat

SEQ ID NO: 706471 - DNA, 25 bp, Artificial sequence
  Synthetic oligonucleotide
ataatcgaattatattaagtaccta

SEQ ID NO: 706472 - DNA, 25 bp, Artificial sequence
  Synthetic oligonucleotide
taaaagattcgcaaatataattgat

SEQ ID NO: 706473 - DNA, 25 bp, Artificial sequence
  Synthetic oligonucleotide
acaaatttgatcctaaatatctaat

SEQ ID NO: 706474 - DNA, 25 bp, Artificial sequence
  Synthetic oligonucleotide
acaaatttgatcgtaaatatctaat

SEQ ID NO: 706475 - DNA, 25 bp, Artificial sequence
  Synthetic oligonucleotide
caaactagtttattcgttattatat

SEQ ID NO: 706476 - DNA, 25 bp, Artificial sequence
  Synthetic oligonucleotide
caaactagtttaatcgttattatat

SEQ ID NO: 706477 - DNA, 25 bp, Artificial sequence
  Synthetic oligonucleotide
atttatttgatttcgacaattgttt

SEQ ID NO: 706478 - DNA, 25 bp, Artificial sequence
  Synthetic oligonucleotide
attaattatctagattgcgaatttt

SEQ ID NO: 706479 - DNA, 25 bp, Artificial sequence
  Synthetic oligonucleotide
atagagattaaccatattatatgta

SEQ ID NO: 706480 - DNA, 25 bp, Artificial sequence
  Synthetic oligonucleotide
aaaactaacgataagcataataaat

SEQ ID NO: 706481 - DNA, 25 bp, Artificial sequence
  Synthetic oligonucleotide
atgataatttaagttatcgataaca

SEQ ID NO: 706482 - DNA, 25 bp, Artificial sequence
  Synthetic oligonucleotide
atgagaagatattatcgtatttatt

SEQ ID NO: 706483 - DNA, 25 bp, Artificial sequence
  Synthetic oligonucleotide
atatatattaagaaattcgtcaatg

SEQ ID NO: 706484 - DNA, 25 bp, Artificial sequence
  Synthetic oligonucleotide
atatatattaagtaattcgtcaatg

SEQ ID NO: 706485 - DNA, 25 bp, Artificial sequence
  Synthetic oligonucleotide
tatttacgaactatataattggaat

SEQ ID NO: 706486 - DNA, 25 bp, Artificial sequence
  Synthetic oligonucleotide
tatttacgaactttataattggaat

SEQ ID NO: 706487 - DNA, 25 bp, Artificial sequence
  Synthetic oligonucleotide
gttaaataccgaaataatattgaat

SEQ ID NO: 706488 - DNA, 25 bp, Artificial sequence
  Synthetic oligonucleotide
caatctactcgtattaattaaattt

SEQ ID NO: 706489 - DNA, 25 bp, Artificial sequence
  Synthetic oligonucleotide
attagatttaacacgtaatacattt

SEQ ID NO: 706490 - DNA, 25 bp, Artificial sequence
  Synthetic oligonucleotide
aaaactaacgattagcataataaat

SEQ ID NO: 706491 - DNA, 25 bp, Artificial sequence
  Synthetic oligonucleotide
atactattatataacgaaacgtaaa

SEQ ID NO: 706492 - DNA, 25 bp, Artificial sequence
  Synthetic oligonucleotide
atactattatattacgaaacgtaaa

SEQ ID NO: 706493 - DNA, 25 bp, Artificial sequence
  Synthetic oligonucleotide
ctaatattataccaattactatcat

SEQ ID NO: 706494 - DNA, 25 bp, Artificial sequence
  Synthetic oligonucleotide
ctaatattatacgaattactatcat

SEQ ID NO: 706495 - DNA, 25 bp, Artificial sequence
  Synthetic oligonucleotide
taaaagattcgctaatataattgat

SEQ ID NO: 706496 - DNA, 25 bp, Artificial sequence
  Synthetic oligonucleotide
caatctactcgttttaattaaattt

SEQ ID NO: 706497 - DNA, 25 bp, Artificial sequence
  Synthetic oligonucleotide
atatattatcgataatcaatacgta

SEQ ID NO: 706498 - DNA, 25 bp, Artificial sequence
  Synthetic oligonucleotide
tttttgataatgcgcaataatattt

SEQ ID NO: 706499 - DNA, 25 bp, Artificial sequence
  Synthetic oligonucleotide
aaaatatcgagtataaatacaaatc

SEQ ID NO: 706500 - DNA, 25 bp, Artificial sequence
  Synthetic oligonucleotide
aatttctatagaggttataatcata

SEQ ID NO: 706501 - DNA, 25 bp, Artificial sequence
  Synthetic oligonucleotide
aatttctatagacgttataatcata

SEQ ID NO: 706502 - DNA, 25 bp, Artificial sequence
  Synthetic oligonucleotide
ttcatgtttattagtcgaattttat

SEQ ID NO: 706503 - DNA, 25 bp, Artificial sequence
  Synthetic oligonucleotide
ttcatgtttatttgtcgaattttat

SEQ ID NO: 706504 - DNA, 25 bp, Artificial sequence
  Synthetic oligonucleotide
gtgttatacgattactatattaatt

SEQ ID NO: 706505 - DNA, 25 bp, Artificial sequence
  Synthetic oligonucleotide
tattacgaaactaatagatacaata

SEQ ID NO: 706506 - DNA, 25 bp, Artificial sequence
  Synthetic oligonucleotide
atatattatcgaaaatcaatacgta

SEQ ID NO: 706507 - DNA, 25 bp, Artificial sequence
  Synthetic oligonucleotide
tattacgaaacttatagatacaata

SEQ ID NO: 706508 - DNA, 25 bp, Artificial sequence
  Synthetic oligonucleotide
ttgaacgtttaattagaataatctt

SEQ ID NO: 706509 - DNA, 25 bp, Artificial sequence
  Synthetic oligonucleotide
ttgaacgtttaaatagaataatctt

SEQ ID NO: 706510 - DNA, 25 bp, Artificial sequence
  Synthetic oligonucleotide
atccttttataaagttcgatttata

SEQ ID NO: 706511 - DNA, 25 bp, Artificial sequence
  Synthetic oligonucleotide
atccttttataatgttcgatttata

SEQ ID NO: 706512 - DNA, 25 bp, Artificial sequence
  Synthetic oligonucleotide
ttttttcgaaattgataattgcaaa

SEQ ID NO: 706513 - DNA, 25 bp, Artificial sequence
  Synthetic oligonucleotide
ttttttcgaaatagataattgcaaa

SEQ ID NO: 706514 - DNA, 25 bp, Artificial sequence
  Synthetic oligonucleotide
atctaaatacgatatctatttacta

SEQ ID NO: 706515 - DNA, 25 bp, Artificial sequence
  Synthetic oligonucleotide
atctaaatacgaaatctatttacta

SEQ ID NO: 706516 - DNA, 25 bp, Artificial sequence
  Synthetic oligonucleotide
gtgttatacgataactatattaatt

SEQ ID NO: 706517 - DNA, 25 bp, Artificial sequence
  Synthetic oligonucleotide
gaattatcgaaatttgatctttatt

SEQ ID NO: 706518 - DNA, 25 bp, Artificial sequence
  Synthetic oligonucleotide
ttatatcaaattggtaattatcaac

SEQ ID NO: 706519 - DNA, 25 bp, Artificial sequence
  Synthetic oligonucleotide
ttatatcaaattcgtaattatcaac

SEQ ID NO: 706520 - DNA, 25 bp, Artificial sequence
  Synthetic oligonucleotide
gtattattagttaattacgattgat

SEQ ID NO: 706521 - DNA, 25 bp, Artificial sequence
  Synthetic oligonucleotide
gtattattagtttattacgattgat

SEQ ID NO: 706522 - DNA, 25 bp, Artificial sequence
  Synthetic oligonucleotide
ttaatgttaataaacaacgtttagt

SEQ ID NO: 706523 - DNA, 25 bp, Artificial sequence
  Synthetic oligonucleotide
ttaatgttaatatacaacgtttagt

SEQ ID NO: 706524 - DNA, 25 bp, Artificial sequence
  Synthetic oligonucleotide
tcctataataagatcgaataatttt

SEQ ID NO: 706525 - DNA, 25 bp, Artificial sequence
  Synthetic oligonucleotide
aaaatatcgagtttaaatacaaatc

SEQ ID NO: 706526 - DNA, 25 bp, Artificial sequence
  Synthetic oligonucleotide
gaattatcgaaaattgatctttatt

SEQ ID NO: 706527 - DNA, 25 bp, Artificial sequence
  Synthetic oligonucleotide
tatagacgtagaactaataaatatt

SEQ ID NO: 706528 - DNA, 25 bp, Artificial sequence
  Synthetic oligonucleotide
aatagttagtattattcgattaatg

SEQ ID NO: 706529 - DNA, 25 bp, Artificial sequence
  Synthetic oligonucleotide
tgtatatcgaattaacattactaaa

SEQ ID NO: 706530 - DNA, 25 bp, Artificial sequence
  Synthetic oligonucleotide
ttaattataaagaaattcgcattct

SEQ ID NO: 706531 - DNA, 25 bp, Artificial sequence
  Synthetic oligonucleotide
ttaattataaagtaattcgcattct

SEQ ID NO: 706532 - DNA, 25 bp, Artificial sequence
  Synthetic oligonucleotide
aaatttcgtactagttatatcaaaa

SEQ ID NO: 706533 - DNA, 25 bp, Artificial sequence
  Synthetic oligonucleotide
aaatttcgtacttgttatatcaaaa

SEQ ID NO: 706534 - DNA, 25 bp, Artificial sequence
  Synthetic oligonucleotide
acacttacttatatcgattatttta

SEQ ID NO: 706535 - DNA, 25 bp, Artificial sequence
  Synthetic oligonucleotide
acacttacttatttcgattatttta

SEQ ID NO: 706536 - DNA, 25 bp, Artificial sequence
  Synthetic oligonucleotide
tcctataataagttcgaataatttt

SEQ ID NO: 706537 - DNA, 25 bp, Artificial sequence
  Synthetic oligonucleotide
tttttatagttaacgataaattcga

SEQ ID NO: 706538 - DNA, 25 bp, Artificial sequence
  Synthetic oligonucleotide
taacatcggtatgattaataaaata

SEQ ID NO: 706539 - DNA, 25 bp, Artificial sequence
  Synthetic oligonucleotide
tttaacgtattgctctttaaaaata

SEQ ID NO: 706540 - DNA, 25 bp, Artificial sequence
  Synthetic oligonucleotide
tttaacgtattggtctttaaaaata

SEQ ID NO: 706541 - DNA, 25 bp, Artificial sequence
  Synthetic oligonucleotide
tatttttcgaaacttattatgacta

SEQ ID NO: 706542 - DNA, 25 bp, Artificial sequence
  Synthetic oligonucleotide
tatttttcgaaagttattatgacta

SEQ ID NO: 706543 - DNA, 25 bp, Artificial sequence
  Synthetic oligonucleotide
aattattattcgtaatctaaatcga

SEQ ID NO: 706544 - DNA, 25 bp, Artificial sequence
  Synthetic oligonucleotide
aattattattcgaaatctaaatcga

SEQ ID NO: 706545 - DNA, 25 bp, Artificial sequence
  Synthetic oligonucleotide
gtattatcataaatcgtatagtaat

SEQ ID NO: 706546 - DNA, 25 bp, Artificial sequence
  Synthetic oligonucleotide
cttaaatcggtattataatattact

SEQ ID NO: 706547 - DNA, 25 bp, Artificial sequence
  Synthetic oligonucleotide
ataatttatgttagtttcgtcttat

SEQ ID NO: 706548 - DNA, 25 bp, Artificial sequence
  Synthetic oligonucleotide
tttttatagttatcgataaattcga

SEQ ID NO: 706549 - DNA, 25 bp, Artificial sequence
  Synthetic oligonucleotide
tttgatcgaaattattagtttaaac

SEQ ID NO: 706550 - DNA, 25 bp, Artificial sequence
  Synthetic oligonucleotide
tttgatcgaaataattagtttaaac

SEQ ID NO: 706551 - DNA, 25 bp, Artificial sequence
  Synthetic oligonucleotide
ttatttacgtataaatcgtttgtta

SEQ ID NO: 706552 - DNA, 25 bp, Artificial sequence
  Synthetic oligonucleotide
ttatttacgtattaatcgtttgtta

SEQ ID NO: 706553 - DNA, 25 bp, Artificial sequence
  Synthetic oligonucleotide
atgaatacgaatgattattagataa

SEQ ID NO: 706554 - DNA, 25 bp, Artificial sequence
  Synthetic oligonucleotide
atgaatacgaatcattattagataa

SEQ ID NO: 706555 - DNA, 25 bp, Artificial sequence
  Synthetic oligonucleotide
tgtatatcgaataaacattactaaa

SEQ ID NO: 706556 - DNA, 25 bp, Artificial sequence
  Synthetic oligonucleotide
cttaaatcggtaatataatattact

SEQ ID NO: 706557 - DNA, 25 bp, Artificial sequence
  Synthetic oligonucleotide
taaaatactataataatgcgaagat

SEQ ID NO: 706558 - DNA, 25 bp, Artificial sequence
  Synthetic oligonucleotide
tctctttattatggaactaaaaata

SEQ ID NO: 706559 - DNA, 25 bp, Artificial sequence
  Synthetic oligonucleotide
tatagacgtagatctaataaatatt

SEQ ID NO: 706560 - DNA, 25 bp, Artificial sequence
  Synthetic oligonucleotide
ataattaatcaatttattcgcagtt

SEQ ID NO: 706561 - DNA, 25 bp, Artificial sequence
  Synthetic oligonucleotide
ataattaatcaaattattcgcagtt

SEQ ID NO: 706562 - DNA, 25 bp, Artificial sequence
  Synthetic oligonucleotide
tgatcatttatgattaaacgtttta

SEQ ID NO: 706563 - DNA, 25 bp, Artificial sequence
  Synthetic oligonucleotide
tgatcatttatgtttaaacgtttta

SEQ ID NO: 706564 - DNA, 25 bp, Artificial sequence
  Synthetic oligonucleotide
gaaacagtattaatatcgaaattat

SEQ ID NO: 706565 - DNA, 25 bp, Artificial sequence
  Synthetic oligonucleotide
gaaacagtattattatcgaaattat

SEQ ID NO: 706566 - DNA, 25 bp, Artificial sequence
  Synthetic oligonucleotide
taacatcggtatcattaataaaata

SEQ ID NO: 706567 - DNA, 25 bp, Artificial sequence
  Synthetic oligonucleotide
tcttttatgttcgatataatgaaat

SEQ ID NO: 706568 - DNA, 25 bp, Artificial sequence
  Synthetic oligonucleotide
ataatttatgtttgtttcgtcttat

SEQ ID NO: 706569 - DNA, 25 bp, Artificial sequence
  Synthetic oligonucleotide
taaaatactatattaatgcgaagat

SEQ ID NO: 706570 - DNA, 25 bp, Artificial sequence
  Synthetic oligonucleotide
ttaattaatcttaacatacgttact

SEQ ID NO: 706571 - DNA, 25 bp, Artificial sequence
  Synthetic oligonucleotide
ttaattaatctttacatacgttact

SEQ ID NO: 706572 - DNA, 25 bp, Artificial sequence
  Synthetic oligonucleotide
aaacaacgtttaaatataagcttaa

SEQ ID NO: 706573 - DNA, 25 bp, Artificial sequence
  Synthetic oligonucleotide
aaacaacgtttatatataagcttaa

SEQ ID NO: 706574 - DNA, 25 bp, Artificial sequence
  Synthetic oligonucleotide
tctctttattatcgaactaaaaata

SEQ ID NO: 706575 - DNA, 25 bp, Artificial sequence
  Synthetic oligonucleotide
aataaacttattatattcgactatc

SEQ ID NO: 706576 - DNA, 25 bp, Artificial sequence
  Synthetic oligonucleotide
gtattatcataattcgtatagtaat

SEQ ID NO: 706577 - DNA, 25 bp, Artificial sequence
  Synthetic oligonucleotide
tcttttatgttccatataatgaaat

SEQ ID NO: 706578 - DNA, 25 bp, Artificial sequence
  Synthetic oligonucleotide
taataaagttattcgattaacaatg

SEQ ID NO: 706579 - DNA, 25 bp, Artificial sequence
  Synthetic oligonucleotide
cttaattctcgaatcaattattaaa

SEQ ID NO: 706580 - DNA, 25 bp, Artificial sequence
  Synthetic oligonucleotide
tatattataatttcgtaatgttcga

SEQ ID NO: 706581 - DNA, 25 bp, Artificial sequence
  Synthetic oligonucleotide
ataattaacgaaacattgtagaaaa

SEQ ID NO: 706582 - DNA, 25 bp, Artificial sequence
  Synthetic oligonucleotide
ttattcgatttagcatattaataag

SEQ ID NO: 706583 - DNA, 25 bp, Artificial sequence
  Synthetic oligonucleotide
ttattcgatttaccatattaataag

SEQ ID NO: 706584 - DNA, 25 bp, Artificial sequence
  Synthetic oligonucleotide
tagtatttcgtattgattatgtaat

SEQ ID NO: 706585 - DNA, 25 bp, Artificial sequence
  Synthetic oligonucleotide
tagtatttcgtaatgattatgtaat

SEQ ID NO: 706586 - DNA, 25 bp, Artificial sequence
  Synthetic oligonucleotide
agtatgatatacctttaataactaa

SEQ ID NO: 706587 - DNA, 25 bp, Artificial sequence
  Synthetic oligonucleotide
ttttaattagtaggaataatgcttt

SEQ ID NO: 706588 - DNA, 25 bp, Artificial sequence
  Synthetic oligonucleotide
agtatgatatacgtttaataactaa

SEQ ID NO: 706589 - DNA, 25 bp, Artificial sequence
  Synthetic oligonucleotide
taataaagttatacgattaacaatg

SEQ ID NO: 706590 - DNA, 25 bp, Artificial sequence
  Synthetic oligonucleotide
tatttttatgtcgtcgtataatata

SEQ ID NO: 706591 - DNA, 25 bp, Artificial sequence
  Synthetic oligonucleotide
tatttttatgtcctcgtataatata

SEQ ID NO: 706592 - DNA, 25 bp, Artificial sequence
  Synthetic oligonucleotide
aattaaattcgataagattttagac

SEQ ID NO: 706593 - DNA, 25 bp, Artificial sequence
  Synthetic oligonucleotide
aattaaattcgaaaagattttagac

SEQ ID NO: 706594 - DNA, 25 bp, Artificial sequence
  Synthetic oligonucleotide
aatgtctataacgaaaattctataa

SEQ ID NO: 706595 - DNA, 25 bp, Artificial sequence
  Synthetic oligonucleotide
aatgtctataaccaaaattctataa

SEQ ID NO: 706596 - DNA, 25 bp, Artificial sequence
  Synthetic oligonucleotide
cttaattctcgattcaattattaaa

SEQ ID NO: 706597 - DNA, 25 bp, Artificial sequence
  Synthetic oligonucleotide
ttttaattagtacgaataatgcttt

SEQ ID NO: 706598 - DNA, 25 bp, Artificial sequence
  Synthetic oligonucleotide
tctaaaaactttatacgttcaatta

SEQ ID NO: 706599 - DNA, 25 bp, Artificial sequence
  Synthetic oligonucleotide
aataaacttattttattcgactatc

SEQ ID NO: 706600 - DNA, 25 bp, Artificial sequence
  Synthetic oligonucleotide
tttttgataatgggcaataatattt

SEQ ID NO: 706601 - DNA, 25 bp, Artificial sequence
  Synthetic oligonucleotide
ataagatatacgtttagtttttgaa

SEQ ID NO: 706602 - DNA, 25 bp, Artificial sequence
  Synthetic oligonucleotide
ataagatatacgattagtttttgaa

SEQ ID NO: 706603 - DNA, 25 bp, Artificial sequence
  Synthetic oligonucleotide
aaatcattaatgtatttcgttaaag

SEQ ID NO: 706604 - DNA, 25 bp, Artificial sequence
  Synthetic oligonucleotide
aaatcattaatgaatttcgttaaag

SEQ ID NO: 706605 - DNA, 25 bp, Artificial sequence
  Synthetic oligonucleotide
ttggtgttatataacgataaaaaat

SEQ ID NO: 706606 - DNA, 25 bp, Artificial sequence
  Synthetic oligonucleotide
ataattaacgaatcattgtagaaaa

SEQ ID NO: 706607 - DNA, 25 bp, Artificial sequence
  Synthetic oligonucleotide
tctaaaaactttttacgttcaatta

SEQ ID NO: 706608 - DNA, 25 bp, Artificial sequence
  Synthetic oligonucleotide
attaaaagtcgaaaatctatacaat

SEQ ID NO: 706609 - DNA, 25 bp, Artificial sequence
  Synthetic oligonucleotide
gtacatcgtctattaattaaatatt

SEQ ID NO: 706610 - DNA, 25 bp, Artificial sequence
  Synthetic oligonucleotide
attaaaagtcgataatctatacaat

SEQ ID NO: 706611 - DNA, 25 bp, Artificial sequence
  Synthetic oligonucleotide
aatacaaggataaatcgttataaat

SEQ ID NO: 706612 - DNA, 25 bp, Artificial sequence
  Synthetic oligonucleotide
aatacaaggatatatcgttataaat

SEQ ID NO: 706613 - DNA, 25 bp, Artificial sequence
  Synthetic oligonucleotide
tctcagtttatataaatcgaattaa

SEQ ID NO: 706614 - DNA, 25 bp, Artificial sequence
  Synthetic oligonucleotide
tctcagtttataaaaatcgaattaa

SEQ ID NO: 706615 - DNA, 25 bp, Artificial sequence
  Synthetic oligonucleotide
tatatttatttaccgaattatcatg

SEQ ID NO: 706616 - DNA, 25 bp, Artificial sequence
  Synthetic oligonucleotide
tatatttatttagcgaattatcatg

SEQ ID NO: 706617 - DNA, 25 bp, Artificial sequence
  Synthetic oligonucleotide
ttggtgttatattacgataaaaaat

SEQ ID NO: 706618 - DNA, 25 bp, Artificial sequence
  Synthetic oligonucleotide
acagttacttaccaattatattatt

SEQ ID NO: 706619 - DNA, 25 bp, Artificial sequence
  Synthetic oligonucleotide
gttcatattaattagtacgataaat

SEQ ID NO: 706620 - DNA, 25 bp, Artificial sequence
  Synthetic oligonucleotide
tttcttatacgaatcataatttact

SEQ ID NO: 706621 - DNA, 25 bp, Artificial sequence
  Synthetic oligonucleotide
tttcttatacgattcataatttact

SEQ ID NO: 706622 - DNA, 25 bp, Artificial sequence
  Synthetic oligonucleotide
actagaactatccaaattatttatt

SEQ ID NO: 706623 - DNA, 25 bp, Artificial sequence
  Synthetic oligonucleotide
actagaactatcgaaattatttatt

SEQ ID NO: 706624 - DNA, 25 bp, Artificial sequence
  Synthetic oligonucleotide
tgaattcttatcgtatattatactt

SEQ ID NO: 706625 - DNA, 25 bp, Artificial sequence
  Synthetic oligonucleotide
tgaattcttatcctatattatactt

SEQ ID NO: 706626 - DNA, 25 bp, Artificial sequence
  Synthetic oligonucleotide
gagatatcgttttgtattaattaat

SEQ ID NO: 706627 - DNA, 25 bp, Artificial sequence
  Synthetic oligonucleotide
gttcatattaataagtacgataaat

SEQ ID NO: 706628 - DNA, 25 bp, Artificial sequence
  Synthetic oligonucleotide
aatctttttattagttcgaaataca

SEQ ID NO: 706629 - DNA, 25 bp, Artificial sequence
  Synthetic oligonucleotide
aatctttttatttgttcgaaataca

SEQ ID NO: 706630 - DNA, 25 bp, Artificial sequence
  Synthetic oligonucleotide
atagttctaatgggataatatttta

SEQ ID NO: 706631 - DNA, 25 bp, Artificial sequence
  Synthetic oligonucleotide
atagttctaatgcgataatatttta

SEQ ID NO: 706632 - DNA, 25 bp, Artificial sequence
  Synthetic oligonucleotide
aaatcatgatataaatcgaagtaaa

SEQ ID NO: 706633 - DNA, 25 bp, Artificial sequence
  Synthetic oligonucleotide
aaatcatgatattaatcgaagtaaa

SEQ ID NO: 706634 - DNA, 25 bp, Artificial sequence
  Synthetic oligonucleotide
aaaaagtgcgtaaaatattattaac

SEQ ID NO: 706635 - DNA, 25 bp, Artificial sequence
  Synthetic oligonucleotide
gtacatcgtctaataattaaatatt

SEQ ID NO: 706636 - DNA, 25 bp, Artificial sequence
  Synthetic oligonucleotide
taaagtaatatttcgaagattaatc

SEQ ID NO: 706637 - DNA, 25 bp, Artificial sequence
  Synthetic oligonucleotide
taaagtaatattacgaagattaatc

SEQ ID NO: 706638 - DNA, 25 bp, Artificial sequence
  Synthetic oligonucleotide
gagatatcgtttagtattaattaat

SEQ ID NO: 706639 - DNA, 25 bp, Artificial sequence
  Synthetic oligonucleotide
gaaaataatattcgttgatacataa

SEQ ID NO: 706640 - DNA, 25 bp, Artificial sequence
  Synthetic oligonucleotide
atattcttaatccaaaaattccatt

SEQ ID NO: 706641 - DNA, 25 bp, Artificial sequence
  Synthetic oligonucleotide
tgtgtattctaaacgatatatataa

SEQ ID NO: 706642 - DNA, 25 bp, Artificial sequence
  Synthetic oligonucleotide
atattcttaatcgaaaaattccatt

SEQ ID NO: 706643 - DNA, 25 bp, Artificial sequence
  Synthetic oligonucleotide
acagttacttacgaattatattatt

SEQ ID NO: 706644 - DNA, 25 bp, Artificial sequence
  Synthetic oligonucleotide
aaaaagtgcgtataatattattaac

SEQ ID NO: 706645 - DNA, 25 bp, Artificial sequence
  Synthetic oligonucleotide
tgtgtattctaatcgatatatataa

SEQ ID NO: 706646 - DNA, 25 bp, Artificial sequence
  Synthetic oligonucleotide
caatgattatatggtactataaatt

SEQ ID NO: 706647 - DNA, 25 bp, Artificial sequence
  Synthetic oligonucleotide
caatgattatatcgtactataaatt

SEQ ID NO: 706648 - DNA, 25 bp, Artificial sequence
  Synthetic oligonucleotide
gaaaataatattggttgatacataa

SEQ ID NO: 706649 - DNA, 25 bp, Artificial sequence
  Synthetic oligonucleotide
tatcttaatcgaactaaatacattt

SEQ ID NO: 706650 - DNA, 25 bp, Artificial sequence
  Synthetic oligonucleotide
atttaaatgattattcgctatatct

SEQ ID NO: 706651 - DNA, 25 bp, Artificial sequence
  Synthetic oligonucleotide
taatagataaccctatcatttttat

SEQ ID NO: 706652 - DNA, 25 bp, Artificial sequence
  Synthetic oligonucleotide
tttataattatctatttcgaaaagg

SEQ ID NO: 706653 - DNA, 25 bp, Artificial sequence
  Synthetic oligonucleotide
taatagataaccgtatcatttttat

SEQ ID NO: 706654 - DNA, 25 bp, Artificial sequence
  Synthetic oligonucleotide
tttataattatcaatttcgaaaagg

SEQ ID NO: 706655 - DNA, 25 bp, Artificial sequence
  Synthetic oligonucleotide
atttaaatgatttttcgctatatct

SEQ ID NO: 706656 - DNA, 25 bp, Artificial sequence
  Synthetic oligonucleotide
tttatttgtatttaatcgatttgca

SEQ ID NO: 706657 - DNA, 25 bp, Artificial sequence
  Synthetic oligonucleotide
tatcttaatcgatctaaatacattt

SEQ ID NO: 706658 - DNA, 25 bp, Artificial sequence
  Synthetic oligonucleotide
tttatttgtattaaatcgatttgca

SEQ ID NO: 706659 - DNA, 25 bp, Artificial sequence
  Synthetic oligonucleotide
aaatatcgttaatataatcctgaga

SEQ ID NO: 706660 - DNA, 25 bp, Artificial sequence
  Synthetic oligonucleotide
aaatatcgttaaaataatcctgaga

SEQ ID NO: 706661 - DNA, 25 bp, Artificial sequence
  Synthetic oligonucleotide
attaaaatattatcgaaacgacaag

SEQ ID NO: 706662 - DNA, 25 bp, Artificial sequence
  Synthetic oligonucleotide
attaaaatattaacgaaacgacaag

SEQ ID NO: 706663 - DNA, 25 bp, Artificial sequence
  Synthetic oligonucleotide
taaaaacgatatttagctatttcgt

SEQ ID NO: 706664 - DNA, 25 bp, Artificial sequence
  Synthetic oligonucleotide
tttatttgtaattcgatccacaata

SEQ ID NO: 706665 - DNA, 25 bp, Artificial sequence
  Synthetic oligonucleotide
taaaaacgatatatagctatttcgt

SEQ ID NO: 706666 - DNA, 25 bp, Artificial sequence
  Synthetic oligonucleotide
gatttttaactttttcgaattcgat

SEQ ID NO: 706667 - DNA, 25 bp, Artificial sequence
  Synthetic oligonucleotide
atcaagcgatcaagttattatttat

SEQ ID NO: 706668 - DNA, 25 bp, Artificial sequence
  Synthetic oligonucleotide
agcaacgcataaaaattcattaaaa

SEQ ID NO: 706669 - DNA, 25 bp, Artificial sequence
  Synthetic oligonucleotide
ttaacaatcaatagtatcgttatgt

SEQ ID NO: 706670 - DNA, 25 bp, Artificial sequence
  Synthetic oligonucleotide
ttaacaatcaattgtatcgttatgt

SEQ ID NO: 706671 - DNA, 25 bp, Artificial sequence
  Synthetic oligonucleotide
tttatttgtaatacgatccacaata

SEQ ID NO: 706672 - DNA, 25 bp, Artificial sequence
  Synthetic oligonucleotide
tacttcatattagtacgtcttaaat

SEQ ID NO: 706673 - DNA, 25 bp, Artificial sequence
  Synthetic oligonucleotide
tacttcatattactacgtcttaaat

SEQ ID NO: 706674 - DNA, 25 bp, Artificial sequence
  Synthetic oligonucleotide
agaatttatgcgtaatttatcctaa

SEQ ID NO: 706675 - DNA, 25 bp, Artificial sequence
  Synthetic oligonucleotide
gacttagttcgaaaaatatgataaa

SEQ ID NO: 706676 - DNA, 25 bp, Artificial sequence
  Synthetic oligonucleotide
atcaagcgatcatgttattatttat

SEQ ID NO: 706677 - DNA, 25 bp, Artificial sequence
  Synthetic oligonucleotide
agaatttatgcgaaatttatcctaa

SEQ ID NO: 706678 - DNA, 25 bp, Artificial sequence
  Synthetic oligonucleotide
aaacatgattagaacgaaatgaata

SEQ ID NO: 706679 - DNA, 25 bp, Artificial sequence
  Synthetic oligonucleotide
aacagtattcaccatataattagtt

SEQ ID NO: 706680 - DNA, 25 bp, Artificial sequence
  Synthetic oligonucleotide
gatttttaacttattcgaattcgat

SEQ ID NO: 706681 - DNA, 25 bp, Artificial sequence
  Synthetic oligonucleotide
agcaacgcataataattcattaaaa

SEQ ID NO: 706682 - DNA, 25 bp, Artificial sequence
  Synthetic oligonucleotide
aaacatgattagtacgaaatgaata

SEQ ID NO: 706683 - DNA, 25 bp, Artificial sequence
  Synthetic oligonucleotide
atgctattttttttacgcgaattat

SEQ ID NO: 706684 - DNA, 25 bp, Artificial sequence
  Synthetic oligonucleotide
atgctattttttatacgcgaattat

SEQ ID NO: 706685 - DNA, 25 bp, Artificial sequence
  Synthetic oligonucleotide
tctattatgatatcgtattactagt

SEQ ID NO: 706686 - DNA, 25 bp, Artificial sequence
  Synthetic oligonucleotide
tctattatgataacgtattactagt

SEQ ID NO: 706687 - DNA, 25 bp, Artificial sequence
  Synthetic oligonucleotide
aacagtattcacgatataattagtt

SEQ ID NO: 706688 - DNA, 25 bp, Artificial sequence
  Synthetic oligonucleotide
tgaaattcgactatagataactatt

SEQ ID NO: 706689 - DNA, 25 bp, Artificial sequence
  Synthetic oligonucleotide
tatgattacgcgtaaatattatttg

SEQ ID NO: 706690 - DNA, 25 bp, Artificial sequence
  Synthetic oligonucleotide
aaaacttcgtaatattatacctgaa

SEQ ID NO: 706691 - DNA, 25 bp, Artificial sequence
  Synthetic oligonucleotide
ataatacaataatttagcgataggt

SEQ ID NO: 706692 - DNA, 25 bp, Artificial sequence
  Synthetic oligonucleotide
tatgattacgcgaaaatattatttg

SEQ ID NO: 706693 - DNA, 25 bp, Artificial sequence
  Synthetic oligonucleotide
caaatattagtcacatcgtatatat

SEQ ID NO: 706694 - DNA, 25 bp, Artificial sequence
  Synthetic oligonucleotide
caaatattagtctcatcgtatatat

SEQ ID NO: 706695 - DNA, 25 bp, Artificial sequence
  Synthetic oligonucleotide
aaattgtcgatatcttatatgaaca

SEQ ID NO: 706696 - DNA, 25 bp, Artificial sequence
  Synthetic oligonucleotide
aaattgtcgataacttatatgaaca

SEQ ID NO: 706697 - DNA, 25 bp, Artificial sequence
  Synthetic oligonucleotide
aataaaattacggaacaatttcaga

SEQ ID NO: 706698 - DNA, 25 bp, Artificial sequence
  Synthetic oligonucleotide
aataaaattacgcaacaatttcaga

SEQ ID NO: 706699 - DNA, 25 bp, Artificial sequence
  Synthetic oligonucleotide
gacttagttcgataaatatgataaa

SEQ ID NO: 706700 - DNA, 25 bp, Artificial sequence
  Synthetic oligonucleotide
atttaattattgacgaatcacgatt

SEQ ID NO: 706701 - DNA, 25 bp, Artificial sequence
  Synthetic oligonucleotide
atttaattattgtcgaatcacgatt

SEQ ID NO: 706702 - DNA, 25 bp, Artificial sequence
  Synthetic oligonucleotide
gtggttatcgtaaatataagaaaat

SEQ ID NO: 706703 - DNA, 25 bp, Artificial sequence
  Synthetic oligonucleotide
ttttattcgtacaatcaaaaatgtc

SEQ ID NO: 706704 - DNA, 25 bp, Artificial sequence
  Synthetic oligonucleotide
tgaaattcgactttagataactatt

SEQ ID NO: 706705 - DNA, 25 bp, Artificial sequence
  Synthetic oligonucleotide
gattgatcaaatatcgttgaattat

SEQ ID NO: 706706 - DNA, 25 bp, Artificial sequence
  Synthetic oligonucleotide
gattgatcaaatttcgttgaattat

SEQ ID NO: 706707 - DNA, 25 bp, Artificial sequence
  Synthetic oligonucleotide
aataattaacgcacgaatctaaaaa

SEQ ID NO: 706708 - DNA, 25 bp, Artificial sequence
  Synthetic oligonucleotide
aataattaacgctcgaatctaaaaa

SEQ ID NO: 706709 - DNA, 25 bp, Artificial sequence
  Synthetic oligonucleotide
tataatgtacgaacgtaaatcaatt

SEQ ID NO: 706710 - DNA, 25 bp, Artificial sequence
  Synthetic oligonucleotide
tataatgtacgatcgtaaatcaatt

SEQ ID NO: 706711 - DNA, 25 bp, Artificial sequence
  Synthetic oligonucleotide
taaatggacgcgtttatatttataa

SEQ ID NO: 706712 - DNA, 25 bp, Artificial sequence
  Synthetic oligonucleotide
taaatggacgcgattatatttataa

SEQ ID NO: 706713 - DNA, 25 bp, Artificial sequence
  Synthetic oligonucleotide
acaattcgtcgatttactataaata

SEQ ID NO: 706714 - DNA, 25 bp, Artificial sequence
  Synthetic oligonucleotide
acaattcgtcgaattactataaata

SEQ ID NO: 706715 - DNA, 25 bp, Artificial sequence
  Synthetic oligonucleotide
acatatatatctaaacgcgattatt

SEQ ID NO: 706716 - DNA, 25 bp, Artificial sequence
  Synthetic oligonucleotide
acatatatatcttaacgcgattatt

SEQ ID NO: 706717 - DNA, 25 bp, Artificial sequence
  Synthetic oligonucleotide
gtggttatcgtatatataagaaaat

SEQ ID NO: 706718 - DNA, 25 bp, Artificial sequence
  Synthetic oligonucleotide
ggatattatattaacgttagtctta

SEQ ID NO: 706719 - DNA, 25 bp, Artificial sequence
  Synthetic oligonucleotide
aatagtatcgcataaactataacat

SEQ ID NO: 706720 - DNA, 25 bp, Artificial sequence
  Synthetic oligonucleotide
ctaaatcgctaatttatgtaaatca

SEQ ID NO: 706721 - DNA, 25 bp, Artificial sequence
  Synthetic oligonucleotide
tatttttcaattatatatcgcagtc

SEQ ID NO: 706722 - DNA, 25 bp, Artificial sequence
  Synthetic oligonucleotide
tatttttcaattttatatcgcagtc

SEQ ID NO: 706723 - DNA, 25 bp, Artificial sequence
  Synthetic oligonucleotide
aagaaatcgacttatgttgaaataa

SEQ ID NO: 706724 - DNA, 25 bp, Artificial sequence
  Synthetic oligonucleotide
aagaaatcgactaatgttgaaataa

SEQ ID NO: 706725 - DNA, 25 bp, Artificial sequence
  Synthetic oligonucleotide
aatagtatcgcaaaaactataacat

SEQ ID NO: 706726 - DNA, 25 bp, Artificial sequence
  Synthetic oligonucleotide
aaaacttcgtaaaattatacctgaa

SEQ ID NO: 706727 - DNA, 25 bp, Artificial sequence
  Synthetic oligonucleotide
gatagttatatgggatttattactt

SEQ ID NO: 706728 - DNA, 25 bp, Artificial sequence
  Synthetic oligonucleotide
gatagttatatgcgatttattactt

SEQ ID NO: 706729 - DNA, 25 bp, Artificial sequence
  Synthetic oligonucleotide
atgaatgttattttactacgtcaat

SEQ ID NO: 706730 - DNA, 25 bp, Artificial sequence
  Synthetic oligonucleotide
atgaatgttattatactacgtcaat

SEQ ID NO: 706731 - DNA, 25 bp, Artificial sequence
  Synthetic oligonucleotide
attgaatcttaatcgaatatgttgt

SEQ ID NO: 706732 - DNA, 25 bp, Artificial sequence
  Synthetic oligonucleotide
tgagttatagtcgaatttttcttat

SEQ ID NO: 706733 - DNA, 25 bp, Artificial sequence
  Synthetic oligonucleotide
attgaatcttaaacgaatatgttgt

SEQ ID NO: 706734 - DNA, 25 bp, Artificial sequence
  Synthetic oligonucleotide
ggatattatatttacgttagtctta

SEQ ID NO: 706735 - DNA, 25 bp, Artificial sequence
  Synthetic oligonucleotide
tctacttactaatgaacgtaaaata

SEQ ID NO: 706736 - DNA, 25 bp, Artificial sequence
  Synthetic oligonucleotide
tctacttactaaagaacgtaaaata

SEQ ID NO: 706737 - DNA, 25 bp, Artificial sequence
  Synthetic oligonucleotide
tttgacgttgatttcgatttttaaa

SEQ ID NO: 706738 - DNA, 25 bp, Artificial sequence
  Synthetic oligonucleotide
tttgacgttgatatcgatttttaaa

SEQ ID NO: 706739 - DNA, 25 bp, Artificial sequence
  Synthetic oligonucleotide
ttacgatatcgattaaaggttttta

SEQ ID NO: 706740 - DNA, 25 bp, Artificial sequence
  Synthetic oligonucleotide
ttacgatatcgaataaaggttttta

SEQ ID NO: 706741 - DNA, 25 bp, Artificial sequence
  Synthetic oligonucleotide
cagattataaatccgttaattacat

SEQ ID NO: 706742 - DNA, 25 bp, Artificial sequence
  Synthetic oligonucleotide
cagattataaatgcgttaattacat

SEQ ID NO: 706743 - DNA, 25 bp, Artificial sequence
  Synthetic oligonucleotide
tattctatttatatcgatcgaaact

SEQ ID NO: 706744 - DNA, 25 bp, Artificial sequence
  Synthetic oligonucleotide
tattctatttatttcgatcgaaact

SEQ ID NO: 706745 - DNA, 25 bp, Artificial sequence
  Synthetic oligonucleotide
gattatattacgattagttagagat

SEQ ID NO: 706746 - DNA, 25 bp, Artificial sequence
  Synthetic oligonucleotide
tacagtacgaattttaactattatg

SEQ ID NO: 706747 - DNA, 25 bp, Artificial sequence
  Synthetic oligonucleotide
tgagttatagtccaatttttcttat

SEQ ID NO: 706748 - DNA, 25 bp, Artificial sequence
  Synthetic oligonucleotide
gttatgtaatattatgcgatgataa

SEQ ID NO: 706749 - DNA, 25 bp, Artificial sequence
  Synthetic oligonucleotide
ttagtataatagaatcgttaacttg

SEQ ID NO: 706750 - DNA, 25 bp, Artificial sequence
  Synthetic oligonucleotide
ttagtataatagtatcgttaacttg

SEQ ID NO: 706751 - DNA, 25 bp, Artificial sequence
  Synthetic oligonucleotide
acttattaacttattacgatttgtc

SEQ ID NO: 706752 - DNA, 25 bp, Artificial sequence
  Synthetic oligonucleotide
acttattaactttttacgatttgtc

SEQ ID NO: 706753 - DNA, 25 bp, Artificial sequence
  Synthetic oligonucleotide
ctttcaattatatttagcgtatatg

SEQ ID NO: 706754 - DNA, 25 bp, Artificial sequence
  Synthetic oligonucleotide
ctttcaattataattagcgtatatg

SEQ ID NO: 706755 - DNA, 25 bp, Artificial sequence
  Synthetic oligonucleotide
aaaagtatttcaagcgattatttgt

SEQ ID NO: 706756 - DNA, 25 bp, Artificial sequence
  Synthetic oligonucleotide
aaaagtatttcatgcgattatttgt

SEQ ID NO: 706757 - DNA, 25 bp, Artificial sequence
  Synthetic oligonucleotide
gagaaaatcgtattaagttattctt

SEQ ID NO: 706758 - DNA, 25 bp, Artificial sequence
  Synthetic oligonucleotide
gagaaaatcgtaataagttattctt

SEQ ID NO: 706759 - DNA, 25 bp, Artificial sequence
  Synthetic oligonucleotide
atatataattacgaaattggctatc

SEQ ID NO: 706760 - DNA, 25 bp, Artificial sequence
  Synthetic oligonucleotide
atatataattaccaaattggctatc

SEQ ID NO: 706761 - DNA, 25 bp, Artificial sequence
  Synthetic oligonucleotide
ctaaatcgctaaattatgtaaatca

SEQ ID NO: 706762 - DNA, 25 bp, Artificial sequence
  Synthetic oligonucleotide
aattagttacgatatgattaatggt

SEQ ID NO: 706763 - DNA, 25 bp, Artificial sequence
  Synthetic oligonucleotide
ataatacaataaattagcgataggt

SEQ ID NO: 706764 - DNA, 25 bp, Artificial sequence
  Synthetic oligonucleotide
gttatgtaatataatgcgatgataa

SEQ ID NO: 706765 - DNA, 25 bp, Artificial sequence
  Synthetic oligonucleotide
tgaataaacatttacgaactacaaa

SEQ ID NO: 706766 - DNA, 25 bp, Artificial sequence
  Synthetic oligonucleotide
tgaataaacattaacgaactacaaa

SEQ ID NO: 706767 - DNA, 25 bp, Artificial sequence
  Synthetic oligonucleotide
acaactaaattattttacgctatga

SEQ ID NO: 706768 - DNA, 25 bp, Artificial sequence
  Synthetic oligonucleotide
acaactaaattaatttacgctatga

SEQ ID NO: 706769 - DNA, 25 bp, Artificial sequence
  Synthetic oligonucleotide
tgatatctaattattaatcgtgcat

SEQ ID NO: 706770 - DNA, 25 bp, Artificial sequence
  Synthetic oligonucleotide
tgatatctaatttttaatcgtgcat

SEQ ID NO: 706771 - DNA, 25 bp, Artificial sequence
  Synthetic oligonucleotide
atgtatatatcgtcactattgatta

SEQ ID NO: 706772 - DNA, 25 bp, Artificial sequence
  Synthetic oligonucleotide
atgtatatatcgacactattgatta

SEQ ID NO: 706773 - DNA, 25 bp, Artificial sequence
  Synthetic oligonucleotide
tatataacattaggcttatgatatc

SEQ ID NO: 706774 - DNA, 25 bp, Artificial sequence
  Synthetic oligonucleotide
tatataacattacgcttatgatatc

SEQ ID NO: 706775 - DNA, 25 bp, Artificial sequence
  Synthetic oligonucleotide
tatatctaaattacgtacaagcaaa

SEQ ID NO: 706776 - DNA, 25 bp, Artificial sequence
  Synthetic oligonucleotide
tatatctaaatttcgtacaagcaaa

SEQ ID NO: 706777 - DNA, 25 bp, Artificial sequence
  Synthetic oligonucleotide
aattagttacgaaatgattaatggt

SEQ ID NO: 706778 - DNA, 25 bp, Artificial sequence
  Synthetic oligonucleotide
ttatgtataatttcgcataatacga

SEQ ID NO: 706779 - DNA, 25 bp, Artificial sequence
  Synthetic oligonucleotide
tatatatcttatttcgcataaacct

SEQ ID NO: 706780 - DNA, 25 bp, Artificial sequence
  Synthetic oligonucleotide
tatatatcttatatcgcataaacct

SEQ ID NO: 706781 - DNA, 25 bp, Artificial sequence
  Synthetic oligonucleotide
cactattacgttttaactataaatg

SEQ ID NO: 706782 - DNA, 25 bp, Artificial sequence
  Synthetic oligonucleotide
cactattacgttataactataaatg

SEQ ID NO: 706783 - DNA, 25 bp, Artificial sequence
  Synthetic oligonucleotide
aataatcaactttgttcgaactaaa

SEQ ID NO: 706784 - DNA, 25 bp, Artificial sequence
  Synthetic oligonucleotide
aataatcaacttagttcgaactaaa

SEQ ID NO: 706785 - DNA, 25 bp, Artificial sequence
  Synthetic oligonucleotide
ctaagcttattattacgaaatcttt

SEQ ID NO: 706786 - DNA, 25 bp, Artificial sequence
  Synthetic oligonucleotide
ttattaatagtccttagataccaat

SEQ ID NO: 706787 - DNA, 25 bp, Artificial sequence
  Synthetic oligonucleotide
ttacagtaaatcgaacaataattga

SEQ ID NO: 706788 - DNA, 25 bp, Artificial sequence
  Synthetic oligonucleotide
ttatgtataattacgcataatacga

SEQ ID NO: 706789 - DNA, 25 bp, Artificial sequence
  Synthetic oligonucleotide
tactattacttattaacgcttagta

SEQ ID NO: 706790 - DNA, 25 bp, Artificial sequence
  Synthetic oligonucleotide
tactattacttaataacgcttagta

SEQ ID NO: 706791 - DNA, 25 bp, Artificial sequence
  Synthetic oligonucleotide
tagaatactaagggagtttatatta

SEQ ID NO: 706792 - DNA, 25 bp, Artificial sequence
  Synthetic oligonucleotide
tagaatactaagcgagtttatatta

SEQ ID NO: 706793 - DNA, 25 bp, Artificial sequence
  Synthetic oligonucleotide
tcataatttacgatatacgataact

SEQ ID NO: 706794 - DNA, 25 bp, Artificial sequence
  Synthetic oligonucleotide
ttattaatagtcgttagataccaat

SEQ ID NO: 706795 - DNA, 25 bp, Artificial sequence
  Synthetic oligonucleotide
atataaacgttatcgtattagtgat

SEQ ID NO: 706796 - DNA, 25 bp, Artificial sequence
  Synthetic oligonucleotide
attagatcgtaaaatgtaaattgca

SEQ ID NO: 706797 - DNA, 25 bp, Artificial sequence
  Synthetic oligonucleotide
caacttaacaataaatcgtaacaaa

SEQ ID NO: 706798 - DNA, 25 bp, Artificial sequence
  Synthetic oligonucleotide
gtattatatcgataaagattcatct

SEQ ID NO: 706799 - DNA, 25 bp, Artificial sequence
  Synthetic oligonucleotide
gtattatatcgaaaaagattcatct

SEQ ID NO: 706800 - DNA, 25 bp, Artificial sequence
  Synthetic oligonucleotide
tacacttatacggttaaattcatat

SEQ ID NO: 706801 - DNA, 25 bp, Artificial sequence
  Synthetic oligonucleotide
tacacttatacgcttaaattcatat

SEQ ID NO: 706802 - DNA, 25 bp, Artificial sequence
  Synthetic oligonucleotide
tctgtatcgatgaaaattaaatgtt

SEQ ID NO: 706803 - DNA, 25 bp, Artificial sequence
  Synthetic oligonucleotide
taagggtacgattaattaattatct

SEQ ID NO: 706804 - DNA, 25 bp, Artificial sequence
  Synthetic oligonucleotide
tctgtatcgatgtaaattaaatgtt

SEQ ID NO: 706805 - DNA, 25 bp, Artificial sequence
  Synthetic oligonucleotide
atataaacgttaacgtattagtgat

SEQ ID NO: 706806 - DNA, 25 bp, Artificial sequence
  Synthetic oligonucleotide
taataatattagtttacgaaagcac

SEQ ID NO: 706807 - DNA, 25 bp, Artificial sequence
  Synthetic oligonucleotide
taataatattagattacgaaagcac

SEQ ID NO: 706808 - DNA, 25 bp, Artificial sequence
  Synthetic oligonucleotide
taattaattacgatcgtttaagaag

SEQ ID NO: 706809 - DNA, 25 bp, Artificial sequence
  Synthetic oligonucleotide
taattaattacgttcgtttaagaag

SEQ ID NO: 706810 - DNA, 25 bp, Artificial sequence
  Synthetic oligonucleotide
ttacagtaaatccaacaataattga

SEQ ID NO: 706811 - DNA, 25 bp, Artificial sequence
  Synthetic oligonucleotide
tatcagtcgatatagtttatgaaat

SEQ ID NO: 706812 - DNA, 25 bp, Artificial sequence
  Synthetic oligonucleotide
taagggtacgataaattaattatct

SEQ ID NO: 706813 - DNA, 25 bp, Artificial sequence
  Synthetic oligonucleotide
aattctgtcgaagtaatatatagat

SEQ ID NO: 706814 - DNA, 25 bp, Artificial sequence
  Synthetic oligonucleotide
tttggagtaatccaattatatgtat

SEQ ID NO: 706815 - DNA, 25 bp, Artificial sequence
  Synthetic oligonucleotide
acatcgattcaataatacgatttta

SEQ ID NO: 706816 - DNA, 25 bp, Artificial sequence
  Synthetic oligonucleotide
acatcgattcaaaaatacgatttta

SEQ ID NO: 706817 - DNA, 25 bp, Artificial sequence
  Synthetic oligonucleotide
aggtaattaacttattacgagaata

SEQ ID NO: 706818 - DNA, 25 bp, Artificial sequence
  Synthetic oligonucleotide
aggtaattaactaattacgagaata

SEQ ID NO: 706819 - DNA, 25 bp, Artificial sequence
  Synthetic oligonucleotide
aaatacgtattaggattttatgaac

SEQ ID NO: 706820 - DNA, 25 bp, Artificial sequence
  Synthetic oligonucleotide
ctaagcttattaatacgaaatcttt

SEQ ID NO: 706821 - DNA, 25 bp, Artificial sequence
  Synthetic oligonucleotide
aattctgtcgaactaatatatagat

SEQ ID NO: 706822 - DNA, 25 bp, Artificial sequence
  Synthetic oligonucleotide
tcaattatatcccattagatatact

SEQ ID NO: 706823 - DNA, 25 bp, Artificial sequence
  Synthetic oligonucleotide
tacgtctaatctatatatcgaaatt

SEQ ID NO: 706824 - DNA, 25 bp, Artificial sequence
  Synthetic oligonucleotide
tacgtctaatctttatatcgaaatt

SEQ ID NO: 706825 - DNA, 25 bp, Artificial sequence
  Synthetic oligonucleotide
aactttgttgtgatatatcgatata

SEQ ID NO: 706826 - DNA, 25 bp, Artificial sequence
  Synthetic oligonucleotide
aactttgttgtgttatatcgatata

SEQ ID NO: 706827 - DNA, 25 bp, Artificial sequence
  Synthetic oligonucleotide
catacaaataatagttcgattcaaa

SEQ ID NO: 706828 - DNA, 25 bp, Artificial sequence
  Synthetic oligonucleotide
gattatattacgtttagttagagat

SEQ ID NO: 706829 - DNA, 25 bp, Artificial sequence
  Synthetic oligonucleotide
aaatacgtattacgattttatgaac

SEQ ID NO: 706830 - DNA, 25 bp, Artificial sequence
  Synthetic oligonucleotide
atgaaagcgttattattaacaaaga

SEQ ID NO: 706831 - DNA, 25 bp, Artificial sequence
  Synthetic oligonucleotide
tatcagtcgataaagtttatgaaat

SEQ ID NO: 706832 - DNA, 25 bp, Artificial sequence
  Synthetic oligonucleotide
taaatgcgttatatttcactgataa

SEQ ID NO: 706833 - DNA, 25 bp, Artificial sequence
  Synthetic oligonucleotide
taaatgcgttatttttcactgataa

SEQ ID NO: 706834 - DNA, 25 bp, Artificial sequence
  Synthetic oligonucleotide
actcaaaaaatacgtcgattaaata

SEQ ID NO: 706835 - DNA, 25 bp, Artificial sequence
  Synthetic oligonucleotide
actcaaaaaataggtcgattaaata

SEQ ID NO: 706836 - DNA, 25 bp, Artificial sequence
  Synthetic oligonucleotide
ttttttaatcgaatgtattgatctc

SEQ ID NO: 706837 - DNA, 25 bp, Artificial sequence
  Synthetic oligonucleotide
tttggagtaatcgaattatatgtat

SEQ ID NO: 706838 - DNA, 25 bp, Artificial sequence
  Synthetic oligonucleotide
atgaaagcgttaatattaacaaaga

SEQ ID NO: 706839 - DNA, 25 bp, Artificial sequence
  Synthetic oligonucleotide
tcaattatatccgattagatatact

SEQ ID NO: 706840 - DNA, 25 bp, Artificial sequence
  Synthetic oligonucleotide
cataaacaaatcgctaataaatctt

SEQ ID NO: 706841 - DNA, 25 bp, Artificial sequence
  Synthetic oligonucleotide
cataaacaaatccctaataaatctt

SEQ ID NO: 706842 - DNA, 25 bp, Artificial sequence
  Synthetic oligonucleotide
tgcatcgataattatagttaaagaa

SEQ ID NO: 706843 - DNA, 25 bp, Artificial sequence
  Synthetic oligonucleotide
tgcatcgataataatagttaaagaa

SEQ ID NO: 706844 - DNA, 25 bp, Artificial sequence
  Synthetic oligonucleotide
aaagtaatccgaacttatagttata

SEQ ID NO: 706845 - DNA, 25 bp, Artificial sequence
  Synthetic oligonucleotide
aaagtaatccgatcttatagttata

SEQ ID NO: 706846 - DNA, 25 bp, Artificial sequence
  Synthetic oligonucleotide
tcataatttacgttatacgataact

SEQ ID NO: 706847 - DNA, 25 bp, Artificial sequence
  Synthetic oligonucleotide
ttttttaatcgattgtattgatctc

SEQ ID NO: 706848 - DNA, 25 bp, Artificial sequence
  Synthetic oligonucleotide
attagcgattatctacgtttattta

SEQ ID NO: 706849 - DNA, 25 bp, Artificial sequence
  Synthetic oligonucleotide
tattaatattgaatttcggtatagg

SEQ ID NO: 706850 - DNA, 25 bp, Artificial sequence
  Synthetic oligonucleotide
tattaatattgattttcggtatagg

SEQ ID NO: 706851 - DNA, 25 bp, Artificial sequence
  Synthetic oligonucleotide
actattatttagcgactaaattgat

SEQ ID NO: 706852 - DNA, 25 bp, Artificial sequence
  Synthetic oligonucleotide
actattatttagggactaaattgat

SEQ ID NO: 706853 - DNA, 25 bp, Artificial sequence
  Synthetic oligonucleotide
aaaggatatatcggttaatacattt

SEQ ID NO: 706854 - DNA, 25 bp, Artificial sequence
  Synthetic oligonucleotide
aaaggatatatccgttaatacattt

SEQ ID NO: 706855 - DNA, 25 bp, Artificial sequence
  Synthetic oligonucleotide
aattacgaattatttatctagcact

SEQ ID NO: 706856 - DNA, 25 bp, Artificial sequence
  Synthetic oligonucleotide
tattcctgattattcgataattcat

SEQ ID NO: 706857 - DNA, 25 bp, Artificial sequence
  Synthetic oligonucleotide
ctagagacgaaaattgtaaaatatt

SEQ ID NO: 706858 - DNA, 25 bp, Artificial sequence
  Synthetic oligonucleotide
attagcgattatgtacgtttattta

SEQ ID NO: 706859 - DNA, 25 bp, Artificial sequence
  Synthetic oligonucleotide
ttgtttatttcgtaatattcagctt

SEQ ID NO: 706860 - DNA, 25 bp, Artificial sequence
  Synthetic oligonucleotide
ttgtttatttcgaaatattcagctt

SEQ ID NO: 706861 - DNA, 25 bp, Artificial sequence
  Synthetic oligonucleotide
atacaattatatcggattaattcag

SEQ ID NO: 706862 - DNA, 25 bp, Artificial sequence
  Synthetic oligonucleotide
atacaattatatgggattaattcag

SEQ ID NO: 706863 - DNA, 25 bp, Artificial sequence
  Synthetic oligonucleotide
caacttaacaattaatcgtaacaaa

SEQ ID NO: 706864 - DNA, 25 bp, Artificial sequence
  Synthetic oligonucleotide
tattcctgattaatcgataattcat

SEQ ID NO: 706865 - DNA, 25 bp, Artificial sequence
  Synthetic oligonucleotide
tatcgatatcgatttaatacactaa

SEQ ID NO: 706866 - DNA, 25 bp, Artificial sequence
  Synthetic oligonucleotide
cacttctaatataatcgatattttg

SEQ ID NO: 706867 - DNA, 25 bp, Artificial sequence
  Synthetic oligonucleotide
cacttctaatattatcgatattttg

SEQ ID NO: 706868 - DNA, 25 bp, Artificial sequence
  Synthetic oligonucleotide
aaacaatcgtaattttcgcaaatta

SEQ ID NO: 706869 - DNA, 25 bp, Artificial sequence
  Synthetic oligonucleotide
aaacaatcgtaaatttcgcaaatta

SEQ ID NO: 706870 - DNA, 25 bp, Artificial sequence
  Synthetic oligonucleotide
tattggatatttttcatacgttctt

SEQ ID NO: 706871 - DNA, 25 bp, Artificial sequence
  Synthetic oligonucleotide
tattggatatttatcatacgttctt

SEQ ID NO: 706872 - DNA, 25 bp, Artificial sequence
  Synthetic oligonucleotide
tacaacgtcataaagtattacttta

SEQ ID NO: 706873 - DNA, 25 bp, Artificial sequence
  Synthetic oligonucleotide
attaggatttttacgcttatttatc

SEQ ID NO: 706874 - DNA, 25 bp, Artificial sequence
  Synthetic oligonucleotide
tacaacgtcatatagtattacttta

SEQ ID NO: 706875 - DNA, 25 bp, Artificial sequence
  Synthetic oligonucleotide
tatcgatatcgaattaatacactaa

SEQ ID NO: 706876 - DNA, 25 bp, Artificial sequence
  Synthetic oligonucleotide
tacatatatcgtggttataatttga

SEQ ID NO: 706877 - DNA, 25 bp, Artificial sequence
  Synthetic oligonucleotide
tacatatatcgtcgttataatttga

SEQ ID NO: 706878 - DNA, 25 bp, Artificial sequence
  Synthetic oligonucleotide
aacaccgtaatatatcttgtatatt

SEQ ID NO: 706879 - DNA, 25 bp, Artificial sequence
  Synthetic oligonucleotide
aacaccgtaataaatcttgtatatt

SEQ ID NO: 706880 - DNA, 25 bp, Artificial sequence
  Synthetic oligonucleotide
ctagagacgaaatttgtaaaatatt

SEQ ID NO: 706881 - DNA, 25 bp, Artificial sequence
  Synthetic oligonucleotide
gtcctgtatattttaatcgattaaa

SEQ ID NO: 706882 - DNA, 25 bp, Artificial sequence
  Synthetic oligonucleotide
attaggattttttcgcttatttatc

SEQ ID NO: 706883 - DNA, 25 bp, Artificial sequence
  Synthetic oligonucleotide
catttgcgtatctataataatactt

SEQ ID NO: 706884 - DNA, 25 bp, Artificial sequence
  Synthetic oligonucleotide
gtaaaaagttcgattgaatatgata

SEQ ID NO: 706885 - DNA, 25 bp, Artificial sequence
  Synthetic oligonucleotide
aatatgtacggtataattaaggaat

SEQ ID NO: 706886 - DNA, 25 bp, Artificial sequence
  Synthetic oligonucleotide
aatatgtacggtttaattaaggaat

SEQ ID NO: 706887 - DNA, 25 bp, Artificial sequence
  Synthetic oligonucleotide
atgaataaacttacgctttaaaatg

SEQ ID NO: 706888 - DNA, 25 bp, Artificial sequence
  Synthetic oligonucleotide
atgaataaactttcgctttaaaatg

SEQ ID NO: 706889 - DNA, 25 bp, Artificial sequence
  Synthetic oligonucleotide
aagtagattatttaacgcttcattt

SEQ ID NO: 706890 - DNA, 25 bp, Artificial sequence
  Synthetic oligonucleotide
aattacgaattaattatctagcact

SEQ ID NO: 706891 - DNA, 25 bp, Artificial sequence
  Synthetic oligonucleotide
catttgcgtatcaataataatactt

SEQ ID NO: 706892 - DNA, 25 bp, Artificial sequence
  Synthetic oligonucleotide
ttttttaatttcgtcaattagtcca

SEQ ID NO: 706893 - DNA, 25 bp, Artificial sequence
  Synthetic oligonucleotide
gttaacgctaacacttatatatata

SEQ ID NO: 706894 - DNA, 25 bp, Artificial sequence
  Synthetic oligonucleotide
gttaacgctaactcttatatatata

SEQ ID NO: 706895 - DNA, 25 bp, Artificial sequence
  Synthetic oligonucleotide
atttcgtaataattcgtatatgtag

SEQ ID NO: 706896 - DNA, 25 bp, Artificial sequence
  Synthetic oligonucleotide
atttcgtaataaatcgtatatgtag

SEQ ID NO: 706897 - DNA, 25 bp, Artificial sequence
  Synthetic oligonucleotide
tcgtacgcaagtatattattaaaaa

SEQ ID NO: 706898 - DNA, 25 bp, Artificial sequence
  Synthetic oligonucleotide
tcgtacgcaagtttattattaaaaa

SEQ ID NO: 706899 - DNA, 25 bp, Artificial sequence
  Synthetic oligonucleotide
aagtagattattaaacgcttcattt

SEQ ID NO: 706900 - DNA, 25 bp, Artificial sequence
  Synthetic oligonucleotide
caatacaatctatttacgaagatta

SEQ ID NO: 706901 - DNA, 25 bp, Artificial sequence
  Synthetic oligonucleotide
gtcctgtatattataatcgattaaa

SEQ ID NO: 706902 - DNA, 25 bp, Artificial sequence
  Synthetic oligonucleotide
ggtatttatacgattacttatacaa

SEQ ID NO: 706903 - DNA, 25 bp, Artificial sequence
  Synthetic oligonucleotide
ggtatttatacgtttacttatacaa

SEQ ID NO: 706904 - DNA, 25 bp, Artificial sequence
  Synthetic oligonucleotide
atgattcgattattaatctaaaacg

SEQ ID NO: 706905 - DNA, 25 bp, Artificial sequence
  Synthetic oligonucleotide
atgattcgattaataatctaaaacg

SEQ ID NO: 706906 - DNA, 25 bp, Artificial sequence
  Synthetic oligonucleotide
gtgattaattttggactaaatactt

SEQ ID NO: 706907 - DNA, 25 bp, Artificial sequence
  Synthetic oligonucleotide
gtaaaaagttcgtttgaatatgata

SEQ ID NO: 706908 - DNA, 25 bp, Artificial sequence
  Synthetic oligonucleotide
caatacaatctaattacgaagatta

SEQ ID NO: 706909 - DNA, 25 bp, Artificial sequence
  Synthetic oligonucleotide
ttttttaatttcctcaattagtcca

SEQ ID NO: 706910 - DNA, 25 bp, Artificial sequence
  Synthetic oligonucleotide
aaagttctattccatataaaatcgt

SEQ ID NO: 706911 - DNA, 25 bp, Artificial sequence
  Synthetic oligonucleotide
aaagttctattcgatataaaatcgt

SEQ ID NO: 706912 - DNA, 25 bp, Artificial sequence
  Synthetic oligonucleotide
aagatgtatatttagcgaatattag

SEQ ID NO: 706913 - DNA, 25 bp, Artificial sequence
  Synthetic oligonucleotide
aagatgtatattaagcgaatattag

SEQ ID NO: 706914 - DNA, 25 bp, Artificial sequence
  Synthetic oligonucleotide
aaagttttcgatcatcatatactaa

SEQ ID NO: 706915 - DNA, 25 bp, Artificial sequence
  Synthetic oligonucleotide
aaagttttcgatgatcatatactaa

SEQ ID NO: 706916 - DNA, 25 bp, Artificial sequence
  Synthetic oligonucleotide
attagatcgtaatatgtaaattgca

SEQ ID NO: 706917 - DNA, 25 bp, Artificial sequence
  Synthetic oligonucleotide
gtgattaattttcgactaaatactt

SEQ ID NO: 706918 - DNA, 25 bp, Artificial sequence
  Synthetic oligonucleotide
atttactattaatcgatagtgatga

SEQ ID NO: 706919 - DNA, 25 bp, Artificial sequence
  Synthetic oligonucleotide
ttatcatttcgagatattatcagat

SEQ ID NO: 706920 - DNA, 25 bp, Artificial sequence
  Synthetic oligonucleotide
agttacgtataaatattaagtagct

SEQ ID NO: 706921 - DNA, 25 bp, Artificial sequence
  Synthetic oligonucleotide
agttacgtataattattaagtagct

SEQ ID NO: 706922 - DNA, 25 bp, Artificial sequence
  Synthetic oligonucleotide
aaaatatatgcaaaacgatttgaag

SEQ ID NO: 706923 - DNA, 25 bp, Artificial sequence
  Synthetic oligonucleotide
aaaatatatgcataacgatttgaag

SEQ ID NO: 706924 - DNA, 25 bp, Artificial sequence
  Synthetic oligonucleotide
ttatgtaatacaaatagcgttatac

SEQ ID NO: 706925 - DNA, 25 bp, Artificial sequence
  Synthetic oligonucleotide
gatattcgactaacataatatagat

SEQ ID NO: 706926 - DNA, 25 bp, Artificial sequence
  Synthetic oligonucleotide
atttactattaaacgatagtgatga

SEQ ID NO: 706927 - DNA, 25 bp, Artificial sequence
  Synthetic oligonucleotide
tattaactacgatattaactacatg

SEQ ID NO: 706928 - DNA, 25 bp, Artificial sequence
  Synthetic oligonucleotide
taagatatctattacgaaatatctg

SEQ ID NO: 706929 - DNA, 25 bp, Artificial sequence
  Synthetic oligonucleotide
taagatatctataacgaaatatctg

SEQ ID NO: 706930 - DNA, 25 bp, Artificial sequence
  Synthetic oligonucleotide
tgaaaattatcgtttatcaacttgt

SEQ ID NO: 706931 - DNA, 25 bp, Artificial sequence
  Synthetic oligonucleotide
tgaaaattatcgattatcaacttgt

SEQ ID NO: 706932 - DNA, 25 bp, Artificial sequence
  Synthetic oligonucleotide
agtatttgaagtctcgtattaataa

SEQ ID NO: 706933 - DNA, 25 bp, Artificial sequence
  Synthetic oligonucleotide
ttttaatgcgatttcttatagtaca

SEQ ID NO: 706934 - DNA, 25 bp, Artificial sequence
  Synthetic oligonucleotide
ttatgtaatacatatagcgttatac

SEQ ID NO: 706935 - DNA, 25 bp, Artificial sequence
  Synthetic oligonucleotide
gatatattaatccgatattacagat

SEQ ID NO: 706936 - DNA, 25 bp, Artificial sequence
  Synthetic oligonucleotide
catacaaataattgttcgattcaaa

SEQ ID NO: 706937 - DNA, 25 bp, Artificial sequence
  Synthetic oligonucleotide
caaatagtattcgataaatctaagt

SEQ ID NO: 706938 - DNA, 25 bp, Artificial sequence
  Synthetic oligonucleotide
caaatagtattccataaatctaagt

SEQ ID NO: 706939 - DNA, 25 bp, Artificial sequence
  Synthetic oligonucleotide
tgtttttaatcgtatgataagacta

SEQ ID NO: 706940 - DNA, 25 bp, Artificial sequence
  Synthetic oligonucleotide
tgtttttaatcgaatgataagacta

SEQ ID NO: 706941 - DNA, 25 bp, Artificial sequence
  Synthetic oligonucleotide
caatggcgtaattttgttataaata

SEQ ID NO: 706942 - DNA, 25 bp, Artificial sequence
  Synthetic oligonucleotide
ttatcatttcgacatattatcagat

SEQ ID NO: 706943 - DNA, 25 bp, Artificial sequence
  Synthetic oligonucleotide
gatatattaatcggatattacagat

SEQ ID NO: 706944 - DNA, 25 bp, Artificial sequence
  Synthetic oligonucleotide
tattaactacgaaattaactacatg

SEQ ID NO: 706945 - DNA, 25 bp, Artificial sequence
  Synthetic oligonucleotide
tatgaaatattagtttatcgtaggt

SEQ ID NO: 706946 - DNA, 25 bp, Artificial sequence
  Synthetic oligonucleotide
tatgaaatattactttatcgtaggt

SEQ ID NO: 706947 - DNA, 25 bp, Artificial sequence
  Synthetic oligonucleotide
tattagtatatcggattaacttctt

SEQ ID NO: 706948 - DNA, 25 bp, Artificial sequence
  Synthetic oligonucleotide
tattagtatatccgattaacttctt

SEQ ID NO: 706949 - DNA, 25 bp, Artificial sequence
  Synthetic oligonucleotide
atgtaaacgaattcttataaatcgt

SEQ ID NO: 706950 - DNA, 25 bp, Artificial sequence
  Synthetic oligonucleotide
atgtaaacgaatacttataaatcgt

SEQ ID NO: 706951 - DNA, 25 bp, Artificial sequence
  Synthetic oligonucleotide
gatattcgactatcataatatagat

SEQ ID NO: 706952 - DNA, 25 bp, Artificial sequence
  Synthetic oligonucleotide
caatggcgtaatattgttataaata

SEQ ID NO: 706953 - DNA, 25 bp, Artificial sequence
  Synthetic oligonucleotide
atgttcaatcgctattaattgaaat

SEQ ID NO: 706954 - DNA, 25 bp, Artificial sequence
  Synthetic oligonucleotide
aatacgtcgatattaagaacaataa

SEQ ID NO: 706955 - DNA, 25 bp, Artificial sequence
  Synthetic oligonucleotide
aatacgtcgataataagaacaataa

SEQ ID NO: 706956 - DNA, 25 bp, Artificial sequence
  Synthetic oligonucleotide
atatataataatgcgaactacaaca

SEQ ID NO: 706957 - DNA, 25 bp, Artificial sequence
  Synthetic oligonucleotide
atatataataatccgaactacaaca

SEQ ID NO: 706958 - DNA, 25 bp, Artificial sequence
  Synthetic oligonucleotide
ttcctacgaatctatatttatattg

SEQ ID NO: 706959 - DNA, 25 bp, Artificial sequence
  Synthetic oligonucleotide
ttcctacgaatcaatatttatattg

SEQ ID NO: 706960 - DNA, 25 bp, Artificial sequence
  Synthetic oligonucleotide
agtatttgaagtgtcgtattaataa

SEQ ID NO: 706961 - DNA, 25 bp, Artificial sequence
  Synthetic oligonucleotide
ttttcgtcaatcgttatagaatata

SEQ ID NO: 706962 - DNA, 25 bp, Artificial sequence
  Synthetic oligonucleotide
cttacaattactcattatcgaaatt

SEQ ID NO: 706963 - DNA, 25 bp, Artificial sequence
  Synthetic oligonucleotide
atgttcaatcgcaattaattgaaat

SEQ ID NO: 706964 - DNA, 25 bp, Artificial sequence
  Synthetic oligonucleotide
cttattaatcgaaacttatattggt

SEQ ID NO: 706965 - DNA, 25 bp, Artificial sequence
  Synthetic oligonucleotide
cttattaatcgatacttatattggt

SEQ ID NO: 706966 - DNA, 25 bp, Artificial sequence
  Synthetic oligonucleotide
ataattatcaatatcgattgtaagg

SEQ ID NO: 706967 - DNA, 25 bp, Artificial sequence
  Synthetic oligonucleotide
ataattatcaatttcgattgtaagg

SEQ ID NO: 706968 - DNA, 25 bp, Artificial sequence
  Synthetic oligonucleotide
tacagtacgaatattaactattatg

SEQ ID NO: 706969 - DNA, 25 bp, Artificial sequence
  Synthetic oligonucleotide
ttttcgtcaatccttatagaatata

SEQ ID NO: 706970 - DNA, 25 bp, Artificial sequence
  Synthetic oligonucleotide
gtaactattctaacgttaaagaatt

SEQ ID NO: 706971 - DNA, 25 bp, Artificial sequence
  Synthetic oligonucleotide
aagtttagcgataaataagtatgta

SEQ ID NO: 706972 - DNA, 25 bp, Artificial sequence
  Synthetic oligonucleotide
aagtttagcgattaataagtatgta

SEQ ID NO: 706973 - DNA, 25 bp, Artificial sequence
  Synthetic oligonucleotide
caagataatcatatttcgtaacttt

SEQ ID NO: 706974 - DNA, 25 bp, Artificial sequence
  Synthetic oligonucleotide
caagataatcatttttcgtaacttt

SEQ ID NO: 706975 - DNA, 25 bp, Artificial sequence
  Synthetic oligonucleotide
agtattaattaattgacgattgcat

SEQ ID NO: 706976 - DNA, 25 bp, Artificial sequence
  Synthetic oligonucleotide
agtattaattaaatgacgattgcat

SEQ ID NO: 706977 - DNA, 25 bp, Artificial sequence
  Synthetic oligonucleotide
actgtcatattaggtaaagattaat

SEQ ID NO: 706978 - DNA, 25 bp, Artificial sequence
  Synthetic oligonucleotide
aaattaattctacaacaacgagatt

SEQ ID NO: 706979 - DNA, 25 bp, Artificial sequence
  Synthetic oligonucleotide
actgtcatattacgtaaagattaat

SEQ ID NO: 706980 - DNA, 25 bp, Artificial sequence
  Synthetic oligonucleotide
gtaactattctatcgttaaagaatt

SEQ ID NO: 706981 - DNA, 25 bp, Artificial sequence
  Synthetic oligonucleotide
gaaatctattcgaagtattattcat

SEQ ID NO: 706982 - DNA, 25 bp, Artificial sequence
  Synthetic oligonucleotide
gaaatctattcgtagtattattcat

SEQ ID NO: 706983 - DNA, 25 bp, Artificial sequence
  Synthetic oligonucleotide
aggtatatacgaaattcgaaataat

SEQ ID NO: 706984 - DNA, 25 bp, Artificial sequence
  Synthetic oligonucleotide
aggtatatacgatattcgaaataat

SEQ ID NO: 706985 - DNA, 25 bp, Artificial sequence
  Synthetic oligonucleotide
cttacaattactgattatcgaaatt

SEQ ID NO: 706986 - DNA, 25 bp, Artificial sequence
  Synthetic oligonucleotide
actgataatatactatacgaatctt

SEQ ID NO: 706987 - DNA, 25 bp, Artificial sequence
  Synthetic oligonucleotide
aaattaattctagaacaacgagatt

SEQ ID NO: 706988 - DNA, 25 bp, Artificial sequence
  Synthetic oligonucleotide
aataaatattcgtaaaattgtcgca

SEQ ID NO: 706989 - DNA, 25 bp, Artificial sequence
  Synthetic oligonucleotide
gattatgttcaattcgtaagttata

SEQ ID NO: 706990 - DNA, 25 bp, Artificial sequence
  Synthetic oligonucleotide
gattatgttcaaatcgtaagttata

SEQ ID NO: 706991 - DNA, 25 bp, Artificial sequence
  Synthetic oligonucleotide
attcgctatatccaattataactta

SEQ ID NO: 706992 - DNA, 25 bp, Artificial sequence
  Synthetic oligonucleotide
attcgctatatcgaattataactta

SEQ ID NO: 706993 - DNA, 25 bp, Artificial sequence
  Synthetic oligonucleotide
aaaaacgatagtatactaatgcaaa

SEQ ID NO: 706994 - DNA, 25 bp, Artificial sequence
  Synthetic oligonucleotide
aaaaacgatagtttactaatgcaaa

SEQ ID NO: 706995 - DNA, 25 bp, Artificial sequence
  Synthetic oligonucleotide
tcttgcgtcgaaataatataaataa

SEQ ID NO: 706996 - DNA, 25 bp, Artificial sequence
  Synthetic oligonucleotide
gtaatattttttcgagaaatagaac

SEQ ID NO: 706997 - DNA, 25 bp, Artificial sequence
  Synthetic oligonucleotide
ataatgacctcgtattttatcttaa

SEQ ID NO: 706998 - DNA, 25 bp, Artificial sequence
  Synthetic oligonucleotide
aataaatattcgaaaaattgtcgca

SEQ ID NO: 706999 - DNA, 25 bp, Artificial sequence
  Synthetic oligonucleotide
ctcgtcgatttaaatctatttaata

SEQ ID NO: 707000 - DNA, 25 bp, Artificial sequence
  Synthetic oligonucleotide
ctcgtcgatttatatctatttaata

SEQ ID NO: 707001 - DNA, 25 bp, Artificial sequence
  Synthetic oligonucleotide
ttttataattattatcggatgtagg

SEQ ID NO: 707002 - DNA, 25 bp, Artificial sequence
  Synthetic oligonucleotide
ttttataattataatcggatgtagg

SEQ ID NO: 707003 - DNA, 25 bp, Artificial sequence
  Synthetic oligonucleotide
ttttaatgcgatatcttatagtaca

SEQ ID NO: 707004 - DNA, 25 bp, Artificial sequence
  Synthetic oligonucleotide
gtaatattttttggagaaatagaac

SEQ ID NO: 707005 - DNA, 25 bp, Artificial sequence
  Synthetic oligonucleotide
ttatctcgttatttcataaccaata

SEQ ID NO: 707006 - DNA, 25 bp, Artificial sequence
  Synthetic oligonucleotide
aaacttaagtataagtatcgaaaga

SEQ ID NO: 707007 - DNA, 25 bp, Artificial sequence
  Synthetic oligonucleotide
aaacttaagtattagtatcgaaaga

SEQ ID NO: 707008 - DNA, 25 bp, Artificial sequence
  Synthetic oligonucleotide
tttctttctatcgttcaatatagta

SEQ ID NO: 707009 - DNA, 25 bp, Artificial sequence
  Synthetic oligonucleotide
tttctttctatccttcaatatagta

SEQ ID NO: 707010 - DNA, 25 bp, Artificial sequence
  Synthetic oligonucleotide
aagcttaatataatataccgagatt

SEQ ID NO: 707011 - DNA, 25 bp, Artificial sequence
  Synthetic oligonucleotide
aagcttaatatattataccgagatt

SEQ ID NO: 707012 - DNA, 25 bp, Artificial sequence
  Synthetic oligonucleotide
gattatagcggtaaatttaatttct

SEQ ID NO: 707013 - DNA, 25 bp, Artificial sequence
  Synthetic oligonucleotide
gatcttaatcgatcgtaataatttt

SEQ ID NO: 707014 - DNA, 25 bp, Artificial sequence
  Synthetic oligonucleotide
gattatagcggttaatttaatttct

SEQ ID NO: 707015 - DNA, 25 bp, Artificial sequence
  Synthetic oligonucleotide
ttatctcgttatatcataaccaata

SEQ ID NO: 707016 - DNA, 25 bp, Artificial sequence
  Synthetic oligonucleotide
ttcctttatggatattcgtattatt

SEQ ID NO: 707017 - DNA, 25 bp, Artificial sequence
  Synthetic oligonucleotide
ttcctttatggaaattcgtattatt

SEQ ID NO: 707018 - DNA, 25 bp, Artificial sequence
  Synthetic oligonucleotide
agtcagatttcgtaataataatttc

SEQ ID NO: 707019 - DNA, 25 bp, Artificial sequence
  Synthetic oligonucleotide
agtcagatttcgaaataataatttc

SEQ ID NO: 707020 - DNA, 25 bp, Artificial sequence
  Synthetic oligonucleotide
ataatgacctcgaattttatcttaa

SEQ ID NO: 707021 - DNA, 25 bp, Artificial sequence
  Synthetic oligonucleotide
aaataattacttgataacgatttgg

SEQ ID NO: 707022 - DNA, 25 bp, Artificial sequence
  Synthetic oligonucleotide
gatcttaatcgaacgtaataatttt

SEQ ID NO: 707023 - DNA, 25 bp, Artificial sequence
  Synthetic oligonucleotide
ctatcataagtcgattattaatgtt

SEQ ID NO: 707024 - DNA, 25 bp, Artificial sequence
  Synthetic oligonucleotide
tcttgcgtcgaattaatataaataa

SEQ ID NO: 707025 - DNA, 25 bp, Artificial sequence
  Synthetic oligonucleotide
gttttagattaatcgtataattctg

SEQ ID NO: 707026 - DNA, 25 bp, Artificial sequence
  Synthetic oligonucleotide
gttttagattaaacgtataattctg

SEQ ID NO: 707027 - DNA, 25 bp, Artificial sequence
  Synthetic oligonucleotide
atttctattatacttatcggttaag

SEQ ID NO: 707028 - DNA, 25 bp, Artificial sequence
  Synthetic oligonucleotide
atttctattatagttatcggttaag

SEQ ID NO: 707029 - DNA, 25 bp, Artificial sequence
  Synthetic oligonucleotide
tttaatacgttaatggttatgagtt

SEQ ID NO: 707030 - DNA, 25 bp, Artificial sequence
  Synthetic oligonucleotide
ttcatttaatttaattcgcgtacaa

SEQ ID NO: 707031 - DNA, 25 bp, Artificial sequence
  Synthetic oligonucleotide
ctatcataagtccattattaatgtt

SEQ ID NO: 707032 - DNA, 25 bp, Artificial sequence
  Synthetic oligonucleotide
actgttagcgtaaattaatacaaaa

SEQ ID NO: 707033 - DNA, 25 bp, Artificial sequence
  Synthetic oligonucleotide
tttctatcgactttttatcaagatt

SEQ ID NO: 707034 - DNA, 25 bp, Artificial sequence
  Synthetic oligonucleotide
tttctatcgactatttatcaagatt

SEQ ID NO: 707035 - DNA, 25 bp, Artificial sequence
  Synthetic oligonucleotide
ctaacagttgatggaatttaataat

SEQ ID NO: 707036 - DNA, 25 bp, Artificial sequence
  Synthetic oligonucleotide
ctaacagttgatcgaatttaataat

SEQ ID NO: 707037 - DNA, 25 bp, Artificial sequence
  Synthetic oligonucleotide
agtttcattatatacgattaagact

SEQ ID NO: 707038 - DNA, 25 bp, Artificial sequence
  Synthetic oligonucleotide
agtttcattataaacgattaagact

SEQ ID NO: 707039 - DNA, 25 bp, Artificial sequence
  Synthetic oligonucleotide
actgataatatagtatacgaatctt

SEQ ID NO: 707040 - DNA, 25 bp, Artificial sequence
  Synthetic oligonucleotide
tttaatacgttattggttatgagtt

SEQ ID NO: 707041 - DNA, 25 bp, Artificial sequence
  Synthetic oligonucleotide
atttaaacagtaaaattcgagaatc

SEQ ID NO: 707042 - DNA, 25 bp, Artificial sequence
  Synthetic oligonucleotide
aaataattacttcataacgatttgg

SEQ ID NO: 707043 - DNA, 25 bp, Artificial sequence
  Synthetic oligonucleotide
agtttcgataactattactaatgtt

SEQ ID NO: 707044 - DNA, 25 bp, Artificial sequence
  Synthetic oligonucleotide
agtttcgataacaattactaatgtt

SEQ ID NO: 707045 - DNA, 25 bp, Artificial sequence
  Synthetic oligonucleotide
aatatttctattcgtactatatcac

SEQ ID NO: 707046 - DNA, 25 bp, Artificial sequence
  Synthetic oligonucleotide
aatatttctattggtactatatcac

SEQ ID NO: 707047 - DNA, 25 bp, Artificial sequence
  Synthetic oligonucleotide
tgattaacgaaactcctaattaaat

SEQ ID NO: 707048 - DNA, 25 bp, Artificial sequence
  Synthetic oligonucleotide
ttcatttaattttattcgcgtacaa

SEQ ID NO: 707049 - DNA, 25 bp, Artificial sequence
  Synthetic oligonucleotide
atttaaacagtataattcgagaatc

SEQ ID NO: 707050 - DNA, 25 bp, Artificial sequence
  Synthetic oligonucleotide
ttttattcgtactatcaaaaatgtc

SEQ ID NO: 707051 - DNA, 25 bp, Artificial sequence
  Synthetic oligonucleotide
agtatcgattaaataacgaacaatt

SEQ ID NO: 707052 - DNA, 25 bp, Artificial sequence
  Synthetic oligonucleotide
agtatcgattaattaacgaacaatt

SEQ ID NO: 707053 - DNA, 25 bp, Artificial sequence
  Synthetic oligonucleotide
ggatcactaatcctatataaaaata

SEQ ID NO: 707054 - DNA, 25 bp, Artificial sequence
  Synthetic oligonucleotide
ggatcactaatcgtatataaaaata

SEQ ID NO: 707055 - DNA, 25 bp, Artificial sequence
  Synthetic oligonucleotide
ataaaaaatagtacgattgccataa

SEQ ID NO: 707056 - DNA, 25 bp, Artificial sequence
  Synthetic oligonucleotide
ataaaaaatagttcgattgccataa

SEQ ID NO: 707057 - DNA, 25 bp, Artificial sequence
  Synthetic oligonucleotide
actgttagcgtatattaatacaaaa

SEQ ID NO: 707058 - DNA, 25 bp, Artificial sequence
  Synthetic oligonucleotide
tgattaacgaaagtcctaattaaat

SEQ ID NO: 707059 - DNA, 25 bp, Artificial sequence
  Synthetic oligonucleotide
acatacgactaaacagttattaagt

SEQ ID NO: 707060 - DNA, 25 bp, Artificial sequence
  Synthetic oligonucleotide
ttggacaatatttcgtagtaattag

SEQ ID NO: 707061 - DNA, 25 bp, Artificial sequence
  Synthetic oligonucleotide
acatagatatcgaaataagtcgtat

SEQ ID NO: 707062 - DNA, 25 bp, Artificial sequence
  Synthetic oligonucleotide
caaaacgttaacttatactatactc

SEQ ID NO: 707063 - DNA, 25 bp, Artificial sequence
  Synthetic oligonucleotide
caaaacgttaacatatactatactc

SEQ ID NO: 707064 - DNA, 25 bp, Artificial sequence
  Synthetic oligonucleotide
ttgtagaaaattcacgatcttctat

SEQ ID NO: 707065 - DNA, 25 bp, Artificial sequence
  Synthetic oligonucleotide
ttgtagaaaattgacgatcttctat

SEQ ID NO: 707066 - DNA, 25 bp, Artificial sequence
  Synthetic oligonucleotide
acggaatcgactattatattttttc

SEQ ID NO: 707067 - DNA, 25 bp, Artificial sequence
  Synthetic oligonucleotide
acggaatcgacttttatattttttc

SEQ ID NO: 707068 - DNA, 25 bp, Artificial sequence
  Synthetic oligonucleotide
aagagttagaacggaaagatatata

SEQ ID NO: 707069 - DNA, 25 bp, Artificial sequence
  Synthetic oligonucleotide
aagagttagaaccgaaagatatata

SEQ ID NO: 707070 - DNA, 25 bp, Artificial sequence
  Synthetic oligonucleotide
ttagatcgtatatacgaaatccata

SEQ ID NO: 707071 - DNA, 25 bp, Artificial sequence
  Synthetic oligonucleotide
atcgtaattaagggaattgtcaaaa

SEQ ID NO: 707072 - DNA, 25 bp, Artificial sequence
  Synthetic oligonucleotide
gcaattttataccactattgtagtt

SEQ ID NO: 707073 - DNA, 25 bp, Artificial sequence
  Synthetic oligonucleotide
ttggacaatattacgtagtaattag

SEQ ID NO: 707074 - DNA, 25 bp, Artificial sequence
  Synthetic oligonucleotide
gtctagtgattacgtattaaactat

SEQ ID NO: 707075 - DNA, 25 bp, Artificial sequence
  Synthetic oligonucleotide
gtctagtgattaggtattaaactat

SEQ ID NO: 707076 - DNA, 25 bp, Artificial sequence
  Synthetic oligonucleotide
agatacgtataagtttaatacagag

SEQ ID NO: 707077 - DNA, 25 bp, Artificial sequence
  Synthetic oligonucleotide
agatacgtataactttaatacagag

SEQ ID NO: 707078 - DNA, 25 bp, Artificial sequence
  Synthetic oligonucleotide
ataattacgcaccttttaatgtcta

SEQ ID NO: 707079 - DNA, 25 bp, Artificial sequence
  Synthetic oligonucleotide
ataattacgcacgttttaatgtcta

SEQ ID NO: 707080 - DNA, 25 bp, Artificial sequence
  Synthetic oligonucleotide
gcaaaaattattacgacatatacct

SEQ ID NO: 707081 - DNA, 25 bp, Artificial sequence
  Synthetic oligonucleotide
gcaaaaattatttcgacatatacct

SEQ ID NO: 707082 - DNA, 25 bp, Artificial sequence
  Synthetic oligonucleotide
gaatacgcctataatattaaaggtt

SEQ ID NO: 707083 - DNA, 25 bp, Artificial sequence
  Synthetic oligonucleotide
atcgtaattaagcgaattgtcaaaa

SEQ ID NO: 707084 - DNA, 25 bp, Artificial sequence
  Synthetic oligonucleotide
cacaataatatgtaccgacattaaa

SEQ ID NO: 707085 - DNA, 25 bp, Artificial sequence
  Synthetic oligonucleotide
gaacttatcgcgttttatttttatc

SEQ ID NO: 707086 - DNA, 25 bp, Artificial sequence
  Synthetic oligonucleotide
gaacttatcgcgatttatttttatc

SEQ ID NO: 707087 - DNA, 25 bp, Artificial sequence
  Synthetic oligonucleotide
tgtcatacgaataaaagattttcac

SEQ ID NO: 707088 - DNA, 25 bp, Artificial sequence
  Synthetic oligonucleotide
tgtcatacgaattaaagattttcac

SEQ ID NO: 707089 - DNA, 25 bp, Artificial sequence
  Synthetic oligonucleotide
atattatcttttacgatcgactgta

SEQ ID NO: 707090 - DNA, 25 bp, Artificial sequence
  Synthetic oligonucleotide
atattatctttttcgatcgactgta

SEQ ID NO: 707091 - DNA, 25 bp, Artificial sequence
  Synthetic oligonucleotide
gtaaatagtcaagattcgaagtatt

SEQ ID NO: 707092 - DNA, 25 bp, Artificial sequence
  Synthetic oligonucleotide
gtaaatagtcaacattcgaagtatt

SEQ ID NO: 707093 - DNA, 25 bp, Artificial sequence
  Synthetic oligonucleotide
ttctatagataacacacgtttagat

SEQ ID NO: 707094 - DNA, 25 bp, Artificial sequence
  Synthetic oligonucleotide
ttctatagataagacacgtttagat

SEQ ID NO: 707095 - DNA, 25 bp, Artificial sequence
  Synthetic oligonucleotide
acatagatatcgtaataagtcgtat

SEQ ID NO: 707096 - DNA, 25 bp, Artificial sequence
  Synthetic oligonucleotide
tactaacgatttgagtatattcaag

SEQ ID NO: 707097 - DNA, 25 bp, Artificial sequence
  Synthetic oligonucleotide
gcaattttatacgactattgtagtt

SEQ ID NO: 707098 - DNA, 25 bp, Artificial sequence
  Synthetic oligonucleotide
cacaataatatgaaccgacattaaa

SEQ ID NO: 707099 - DNA, 25 bp, Artificial sequence
  Synthetic oligonucleotide
gataacaattttggactgtttaaga

SEQ ID NO: 707100 - DNA, 25 bp, Artificial sequence
  Synthetic oligonucleotide
gataacaattttcgactgtttaaga

SEQ ID NO: 707101 - DNA, 25 bp, Artificial sequence
  Synthetic oligonucleotide
ataatttaattactcgtcttcaagc

SEQ ID NO: 707102 - DNA, 25 bp, Artificial sequence
  Synthetic oligonucleotide
ataatttaattagtcgtcttcaagc

SEQ ID NO: 707103 - DNA, 25 bp, Artificial sequence
  Synthetic oligonucleotide
gtatcacttcttttcggtataaata

SEQ ID NO: 707104 - DNA, 25 bp, Artificial sequence
  Synthetic oligonucleotide
gtatcacttcttatcggtataaata

SEQ ID NO: 707105 - DNA, 25 bp, Artificial sequence
  Synthetic oligonucleotide
tagtaagttaaccctaaataatagg

SEQ ID NO: 707106 - DNA, 25 bp, Artificial sequence
  Synthetic oligonucleotide
tagtaagttaacgctaaataatagg

SEQ ID NO: 707107 - DNA, 25 bp, Artificial sequence
  Synthetic oligonucleotide
tgcgaataagtcctattatatttct

SEQ ID NO: 707108 - DNA, 25 bp, Artificial sequence
  Synthetic oligonucleotide
tactaacgatttcagtatattcaag

SEQ ID NO: 707109 - DNA, 25 bp, Artificial sequence
  Synthetic oligonucleotide
actgtagttattgggatgaaattta

SEQ ID NO: 707110 - DNA, 25 bp, Artificial sequence
  Synthetic oligonucleotide
gaatacgcctattatattaaaggtt

SEQ ID NO: 707111 - DNA, 25 bp, Artificial sequence
  Synthetic oligonucleotide
aatcatattatatcgagtaagtgac

SEQ ID NO: 707112 - DNA, 25 bp, Artificial sequence
  Synthetic oligonucleotide
cagaatatcgtaatggaatttaatc

SEQ ID NO: 707113 - DNA, 25 bp, Artificial sequence
  Synthetic oligonucleotide
cagaatatcgtattggaatttaatc

SEQ ID NO: 707114 - DNA, 25 bp, Artificial sequence
  Synthetic oligonucleotide
tgctacgataattactaatcaaaca

SEQ ID NO: 707115 - DNA, 25 bp, Artificial sequence
  Synthetic oligonucleotide
tgctacgataataactaatcaaaca

SEQ ID NO: 707116 - DNA, 25 bp, Artificial sequence
  Synthetic oligonucleotide
attatacgcgaaatacaatacctat

SEQ ID NO: 707117 - DNA, 25 bp, Artificial sequence
  Synthetic oligonucleotide
attatacgcgaattacaatacctat

SEQ ID NO: 707118 - DNA, 25 bp, Artificial sequence
  Synthetic oligonucleotide
caaatttatgcgtattaatagtggt

SEQ ID NO: 707119 - DNA, 25 bp, Artificial sequence
  Synthetic oligonucleotide
caaatttatgcgaattaatagtggt

SEQ ID NO: 707120 - DNA, 25 bp, Artificial sequence
  Synthetic oligonucleotide
agataaatcgattaactatattcgg

SEQ ID NO: 707121 - DNA, 25 bp, Artificial sequence
  Synthetic oligonucleotide
ctatttacggttattataacgatct

SEQ ID NO: 707122 - DNA, 25 bp, Artificial sequence
  Synthetic oligonucleotide
agataaatcgataaactatattcgg

SEQ ID NO: 707123 - DNA, 25 bp, Artificial sequence
  Synthetic oligonucleotide
actgtagttattcggatgaaattta

SEQ ID NO: 707124 - DNA, 25 bp, Artificial sequence
  Synthetic oligonucleotide
ctgtaaatcgtttttcaatattctg

SEQ ID NO: 707125 - DNA, 25 bp, Artificial sequence
  Synthetic oligonucleotide
ctgtaaatcgttattcaatattctg

SEQ ID NO: 707126 - DNA, 25 bp, Artificial sequence
  Synthetic oligonucleotide
gtatgtaatttaactacgatcagat

SEQ ID NO: 707127 - DNA, 25 bp, Artificial sequence
  Synthetic oligonucleotide
gtatgtaatttatctacgatcagat

SEQ ID NO: 707128 - DNA, 25 bp, Artificial sequence
  Synthetic oligonucleotide
tgatatattattacgtcgaagatga

SEQ ID NO: 707129 - DNA, 25 bp, Artificial sequence
  Synthetic oligonucleotide
tgatatattatttcgtcgaagatga

SEQ ID NO: 707130 - DNA, 25 bp, Artificial sequence
  Synthetic oligonucleotide
tcgaggaatacgatacaataattta

SEQ ID NO: 707131 - DNA, 25 bp, Artificial sequence
  Synthetic oligonucleotide
tcgaggaatacgttacaataattta

SEQ ID NO: 707132 - DNA, 25 bp, Artificial sequence
  Synthetic oligonucleotide
ttagatcgtataaacgaaatccata

SEQ ID NO: 707133 - DNA, 25 bp, Artificial sequence
  Synthetic oligonucleotide
ctatttacggtttttataacgatct

SEQ ID NO: 707134 - DNA, 25 bp, Artificial sequence
  Synthetic oligonucleotide
atttgtttcgtccatttttaagaga

SEQ ID NO: 707135 - DNA, 25 bp, Artificial sequence
  Synthetic oligonucleotide
agatttctcgaattttaccatattg

SEQ ID NO: 707136 - DNA, 25 bp, Artificial sequence
  Synthetic oligonucleotide
tgttctaacgctttgataatatgat

SEQ ID NO: 707137 - DNA, 25 bp, Artificial sequence
  Synthetic oligonucleotide
tgttctaacgctatgataatatgat

SEQ ID NO: 707138 - DNA, 25 bp, Artificial sequence
  Synthetic oligonucleotide
ttatacgttatatatataagctggg

SEQ ID NO: 707139 - DNA, 25 bp, Artificial sequence
  Synthetic oligonucleotide
ttatacgttataaatataagctggg

SEQ ID NO: 707140 - DNA, 25 bp, Artificial sequence
  Synthetic oligonucleotide
tagaataatttagtttacgaccaac

SEQ ID NO: 707141 - DNA, 25 bp, Artificial sequence
  Synthetic oligonucleotide
tagaataatttactttacgaccaac

SEQ ID NO: 707142 - DNA, 25 bp, Artificial sequence
  Synthetic oligonucleotide
tctttaatttaatcgaacgcgttta

SEQ ID NO: 707143 - DNA, 25 bp, Artificial sequence
  Synthetic oligonucleotide
tctttaatttaaacgaacgcgttta

SEQ ID NO: 707144 - DNA, 25 bp, Artificial sequence
  Synthetic oligonucleotide
caatgatagaatatatccgatcata

SEQ ID NO: 707145 - DNA, 25 bp, Artificial sequence
  Synthetic oligonucleotide
aatcatattataacgagtaagtgac

SEQ ID NO: 707146 - DNA, 25 bp, Artificial sequence
  Synthetic oligonucleotide
atttgtttcgtcgatttttaagaga

SEQ ID NO: 707147 - DNA, 25 bp, Artificial sequence
  Synthetic oligonucleotide
tgcgaataagtcgtattatatttct

SEQ ID NO: 707148 - DNA, 25 bp, Artificial sequence
  Synthetic oligonucleotide
tctaatcatattacgataatccatg

SEQ ID NO: 707149 - DNA, 25 bp, Artificial sequence
  Synthetic oligonucleotide
tctaatcatatttcgataatccatg

SEQ ID NO: 707150 - DNA, 25 bp, Artificial sequence
  Synthetic oligonucleotide
aataagtatataatcgaacggagtt

SEQ ID NO: 707151 - DNA, 25 bp, Artificial sequence
  Synthetic oligonucleotide
aataagtatatattcgaacggagtt

SEQ ID NO: 707152 - DNA, 25 bp, Artificial sequence
  Synthetic oligonucleotide
acagaaaagttcctaatatgagaat

SEQ ID NO: 707153 - DNA, 25 bp, Artificial sequence
  Synthetic oligonucleotide
acagaaaagttcgtaatatgagaat

SEQ ID NO: 707154 - DNA, 25 bp, Artificial sequence
  Synthetic oligonucleotide
gcttgtacgaaataatactatagaa

SEQ ID NO: 707155 - DNA, 25 bp, Artificial sequence
  Synthetic oligonucleotide
gcttgtacgaaaaaatactatagaa

SEQ ID NO: 707156 - DNA, 25 bp, Artificial sequence
  Synthetic oligonucleotide
tacaaagtgttaacgctaattaaac

SEQ ID NO: 707157 - DNA, 25 bp, Artificial sequence
  Synthetic oligonucleotide
tacaaagtgttatcgctaattaaac

SEQ ID NO: 707158 - DNA, 25 bp, Artificial sequence
  Synthetic oligonucleotide
caatgatagaatttatccgatcata

SEQ ID NO: 707159 - DNA, 25 bp, Artificial sequence
  Synthetic oligonucleotide
tactgcttgcatggatataaaaaat

SEQ ID NO: 707160 - DNA, 25 bp, Artificial sequence
  Synthetic oligonucleotide
atttacaatgatttcgtatactctc

SEQ ID NO: 707161 - DNA, 25 bp, Artificial sequence
  Synthetic oligonucleotide
aatcaattcgttagttgaacaactt

SEQ ID NO: 707162 - DNA, 25 bp, Artificial sequence
  Synthetic oligonucleotide
cacagatattcgatatgatataact

SEQ ID NO: 707163 - DNA, 25 bp, Artificial sequence
  Synthetic oligonucleotide
cacagatattcgttatgatataact

SEQ ID NO: 707164 - DNA, 25 bp, Artificial sequence
  Synthetic oligonucleotide
ttgaataacgacaatgaattatgac

SEQ ID NO: 707165 - DNA, 25 bp, Artificial sequence
  Synthetic oligonucleotide
ttgaataacgactatgaattatgac

SEQ ID NO: 707166 - DNA, 25 bp, Artificial sequence
  Synthetic oligonucleotide
ctatctcgaactttagtaaaattac

SEQ ID NO: 707167 - DNA, 25 bp, Artificial sequence
  Synthetic oligonucleotide
ctatctcgaactatagtaaaattac

SEQ ID NO: 707168 - DNA, 25 bp, Artificial sequence
  Synthetic oligonucleotide
taatttcgttagtctcaattagaag

SEQ ID NO: 707169 - DNA, 25 bp, Artificial sequence
  Synthetic oligonucleotide
taatttcgttagactcaattagaag

SEQ ID NO: 707170 - DNA, 25 bp, Artificial sequence
  Synthetic oligonucleotide
atagtacgactaaatatcttaatcc

SEQ ID NO: 707171 - DNA, 25 bp, Artificial sequence
  Synthetic oligonucleotide
caacatcggtaagtttatatagaat

SEQ ID NO: 707172 - DNA, 25 bp, Artificial sequence
  Synthetic oligonucleotide
atagtacgactatatatcttaatcc

SEQ ID NO: 707173 - DNA, 25 bp, Artificial sequence
  Synthetic oligonucleotide
tactgcttgcatcgatataaaaaat

SEQ ID NO: 707174 - DNA, 25 bp, Artificial sequence
  Synthetic oligonucleotide
ctcaataaggttgttatcgataaaa

SEQ ID NO: 707175 - DNA, 25 bp, Artificial sequence
  Synthetic oligonucleotide
ctcaataaggttcttatcgataaaa

SEQ ID NO: 707176 - DNA, 25 bp, Artificial sequence
  Synthetic oligonucleotide
aattactagaaataccgtatgctaa

SEQ ID NO: 707177 - DNA, 25 bp, Artificial sequence
  Synthetic oligonucleotide
aattactagaaaaaccgtatgctaa

SEQ ID NO: 707178 - DNA, 25 bp, Artificial sequence
  Synthetic oligonucleotide
aatatagtatagatagtcgaaaacg

SEQ ID NO: 707179 - DNA, 25 bp, Artificial sequence
  Synthetic oligonucleotide
aatatagtatagttagtcgaaaacg

SEQ ID NO: 707180 - DNA, 25 bp, Artificial sequence
  Synthetic oligonucleotide
tgtagtattatagttaacgcaatca

SEQ ID NO: 707181 - DNA, 25 bp, Artificial sequence
  Synthetic oligonucleotide
tgtagtattatacttaacgcaatca

SEQ ID NO: 707182 - DNA, 25 bp, Artificial sequence
  Synthetic oligonucleotide
aatccttaaacatttgtcgctaata

SEQ ID NO: 707183 - DNA, 25 bp, Artificial sequence
  Synthetic oligonucleotide
caacatcggtaactttatatagaat

SEQ ID NO: 707184 - DNA, 25 bp, Artificial sequence
  Synthetic oligonucleotide
taagaagtcttattagatcgattac

SEQ ID NO: 707185 - DNA, 25 bp, Artificial sequence
  Synthetic oligonucleotide
tcattcggaattatttgacttattg

SEQ ID NO: 707186 - DNA, 25 bp, Artificial sequence
  Synthetic oligonucleotide
actttctattgtacgtcaaagaata

SEQ ID NO: 707187 - DNA, 25 bp, Artificial sequence
  Synthetic oligonucleotide
actttctattgttcgtcaaagaata

SEQ ID NO: 707188 - DNA, 25 bp, Artificial sequence
  Synthetic oligonucleotide
acatacgactaatcagttattaagt

SEQ ID NO: 707189 - DNA, 25 bp, Artificial sequence
  Synthetic oligonucleotide
tcattcggaattttttgacttattg

SEQ ID NO: 707190 - DNA, 25 bp, Artificial sequence
  Synthetic oligonucleotide
aagtatattatagtatatcgccctt

SEQ ID NO: 707191 - DNA, 25 bp, Artificial sequence
  Synthetic oligonucleotide
aagtatattatactatatcgccctt

SEQ ID NO: 707192 - DNA, 25 bp, Artificial sequence
  Synthetic oligonucleotide
gtctcctaaatttatcgaaaacaat

SEQ ID NO: 707193 - DNA, 25 bp, Artificial sequence
  Synthetic oligonucleotide
gtctcctaaattaatcgaaaacaat

SEQ ID NO: 707194 - DNA, 25 bp, Artificial sequence
  Synthetic oligonucleotide
tcgtggataactatatcgattttta

SEQ ID NO: 707195 - DNA, 25 bp, Artificial sequence
  Synthetic oligonucleotide
aatcaattcgtttgttgaacaactt

SEQ ID NO: 707196 - DNA, 25 bp, Artificial sequence
  Synthetic oligonucleotide
taagaagtcttaatagatcgattac

SEQ ID NO: 707197 - DNA, 25 bp, Artificial sequence
  Synthetic oligonucleotide
tcatatagatgattatcgaaacatg

SEQ ID NO: 707198 - DNA, 25 bp, Artificial sequence
  Synthetic oligonucleotide
gattgacgttaaagtgatattttac

SEQ ID NO: 707199 - DNA, 25 bp, Artificial sequence
  Synthetic oligonucleotide
gattgacgttaatgtgatattttac

SEQ ID NO: 707200 - DNA, 25 bp, Artificial sequence
  Synthetic oligonucleotide
ctaatttttacgtaacgcatatgat

SEQ ID NO: 707201 - DNA, 25 bp, Artificial sequence
  Synthetic oligonucleotide
ctaatttttacgaaacgcatatgat

SEQ ID NO: 707202 - DNA, 25 bp, Artificial sequence
  Synthetic oligonucleotide
aagaggatggcgaaatattattata

SEQ ID NO: 707203 - DNA, 25 bp, Artificial sequence
  Synthetic oligonucleotide
aagaggatggcgtaatattattata

SEQ ID NO: 707204 - DNA, 25 bp, Artificial sequence
  Synthetic oligonucleotide
aagggcatacgttatataagaaatt

SEQ ID NO: 707205 - DNA, 25 bp, Artificial sequence
  Synthetic oligonucleotide
aagggcatacgtaatataagaaatt

SEQ ID NO: 707206 - DNA, 25 bp, Artificial sequence
  Synthetic oligonucleotide
aactatatcgtaagctacaacattt

SEQ ID NO: 707207 - DNA, 25 bp, Artificial sequence
  Synthetic oligonucleotide
aactatatcgtatgctacaacattt

SEQ ID NO: 707208 - DNA, 25 bp, Artificial sequence
  Synthetic oligonucleotide
tcgtggataactttatcgattttta

SEQ ID NO: 707209 - DNA, 25 bp, Artificial sequence
  Synthetic oligonucleotide
taaacatatattgcgtagacttaca

SEQ ID NO: 707210 - DNA, 25 bp, Artificial sequence
  Synthetic oligonucleotide
atttacaatgatatcgtatactctc

SEQ ID NO: 707211 - DNA, 25 bp, Artificial sequence
  Synthetic oligonucleotide
tcagcatcgaaatttttcgataatt

SEQ ID NO: 707212 - DNA, 25 bp, Artificial sequence
  Synthetic oligonucleotide
atcaagcgtattttgatagaacaat

SEQ ID NO: 707213 - DNA, 25 bp, Artificial sequence
  Synthetic oligonucleotide
atcaagcgtattatgatagaacaat

SEQ ID NO: 707214 - DNA, 25 bp, Artificial sequence
  Synthetic oligonucleotide
atagatactattaatcgatcgaaca

SEQ ID NO: 707215 - DNA, 25 bp, Artificial sequence
  Synthetic oligonucleotide
atagatactatttatcgatcgaaca

SEQ ID NO: 707216 - DNA, 25 bp, Artificial sequence
  Synthetic oligonucleotide
tccgttcgtactttataatgtaata

SEQ ID NO: 707217 - DNA, 25 bp, Artificial sequence
  Synthetic oligonucleotide
tccgttcgtactatataatgtaata

SEQ ID NO: 707218 - DNA, 25 bp, Artificial sequence
  Synthetic oligonucleotide
tagttatttaacgatcgaatattgc

SEQ ID NO: 707219 - DNA, 25 bp, Artificial sequence
  Synthetic oligonucleotide
tagttatttaaccatcgaatattgc

SEQ ID NO: 707220 - DNA, 25 bp, Artificial sequence
  Synthetic oligonucleotide
gattgaattgtgggatatgaaaaaa

SEQ ID NO: 707221 - DNA, 25 bp, Artificial sequence
  Synthetic oligonucleotide
tctaagtaagcgtattattagtgaa

SEQ ID NO: 707222 - DNA, 25 bp, Artificial sequence
  Synthetic oligonucleotide
gattgaattgtgcgatatgaaaaaa

SEQ ID NO: 707223 - DNA, 25 bp, Artificial sequence
  Synthetic oligonucleotide
taaacatatattccgtagacttaca

SEQ ID NO: 707224 - DNA, 25 bp, Artificial sequence
  Synthetic oligonucleotide
ttgataagcggttaatagtaatagt

SEQ ID NO: 707225 - DNA, 25 bp, Artificial sequence
  Synthetic oligonucleotide
ttgataagcggtaaatagtaatagt

SEQ ID NO: 707226 - DNA, 25 bp, Artificial sequence
  Synthetic oligonucleotide
tcgttacgcaattctcttattaata

SEQ ID NO: 707227 - DNA, 25 bp, Artificial sequence
  Synthetic oligonucleotide
tcgttacgcaatactcttattaata

SEQ ID NO: 707228 - DNA, 25 bp, Artificial sequence
  Synthetic oligonucleotide
aagagaaataccgtaattgcttata

SEQ ID NO: 707229 - DNA, 25 bp, Artificial sequence
  Synthetic oligonucleotide
aagagaaataccctaattgcttata

SEQ ID NO: 707230 - DNA, 25 bp, Artificial sequence
  Synthetic oligonucleotide
tcaattatcgaattttagcgtttgt

SEQ ID NO: 707231 - DNA, 25 bp, Artificial sequence
  Synthetic oligonucleotide
tcaattatcgaaatttagcgtttgt

SEQ ID NO: 707232 - DNA, 25 bp, Artificial sequence
  Synthetic oligonucleotide
aatccttaaacaattgtcgctaata

SEQ ID NO: 707233 - DNA, 25 bp, Artificial sequence
  Synthetic oligonucleotide
tctaagtaagcgaattattagtgaa

SEQ ID NO: 707234 - DNA, 25 bp, Artificial sequence
  Synthetic oligonucleotide
taaagtttttaaaacgtcgattctc

SEQ ID NO: 707235 - DNA, 25 bp, Artificial sequence
  Synthetic oligonucleotide
tcatatagatgaatatcgaaacatg

SEQ ID NO: 707236 - DNA, 25 bp, Artificial sequence
  Synthetic oligonucleotide
ttctaacggttaatttattgactgt

SEQ ID NO: 707237 - DNA, 25 bp, Artificial sequence
  Synthetic oligonucleotide
ttctaacggttattttattgactgt

SEQ ID NO: 707238 - DNA, 25 bp, Artificial sequence
  Synthetic oligonucleotide
aataaaaacgatttagttgctctac

SEQ ID NO: 707239 - DNA, 25 bp, Artificial sequence
  Synthetic oligonucleotide
aataaaaacgatatagttgctctac

SEQ ID NO: 707240 - DNA, 25 bp, Artificial sequence
  Synthetic oligonucleotide
tctaatagatagtacgcataacatt

SEQ ID NO: 707241 - DNA, 25 bp, Artificial sequence
  Synthetic oligonucleotide
tctaatagatagaacgcataacatt

SEQ ID NO: 707242 - DNA, 25 bp, Artificial sequence
  Synthetic oligonucleotide
atcgattagatacttcgtaaactaa

SEQ ID NO: 707243 - DNA, 25 bp, Artificial sequence
  Synthetic oligonucleotide
atcgattagatagttcgtaaactaa

SEQ ID NO: 707244 - DNA, 25 bp, Artificial sequence
  Synthetic oligonucleotide
tcaatcttaatcctaacgtattaga

SEQ ID NO: 707245 - DNA, 25 bp, Artificial sequence
  Synthetic oligonucleotide
tcagcatcgaaaattttcgataatt

SEQ ID NO: 707246 - DNA, 25 bp, Artificial sequence
  Synthetic oligonucleotide
taaagtttttaatacgtcgattctc

SEQ ID NO: 707247 - DNA, 25 bp, Artificial sequence
  Synthetic oligonucleotide
ataggtattagcgcgatataattta

SEQ ID NO: 707248 - DNA, 25 bp, Artificial sequence
  Synthetic oligonucleotide
agagtatactaaacgtttaactttg

SEQ ID NO: 707249 - DNA, 25 bp, Artificial sequence
  Synthetic oligonucleotide
agagtatactaatcgtttaactttg

SEQ ID NO: 707250 - DNA, 25 bp, Artificial sequence
  Synthetic oligonucleotide
tttatataaccattatatcggaggt

SEQ ID NO: 707251 - DNA, 25 bp, Artificial sequence
  Synthetic oligonucleotide
tttatataaccaatatatcggaggt

SEQ ID NO: 707252 - DNA, 25 bp, Artificial sequence
  Synthetic oligonucleotide
ctaagttataatagttagcgtttga

SEQ ID NO: 707253 - DNA, 25 bp, Artificial sequence
  Synthetic oligonucleotide
ctaagttataattgttagcgtttga

SEQ ID NO: 707254 - DNA, 25 bp, Artificial sequence
  Synthetic oligonucleotide
atataaactaattgcgtactttcga

SEQ ID NO: 707255 - DNA, 25 bp, Artificial sequence
  Synthetic oligonucleotide
atataaactaatagcgtactttcga

SEQ ID NO: 707256 - DNA, 25 bp, Artificial sequence
  Synthetic oligonucleotide
atttttactatttgtacgatcatgc

SEQ ID NO: 707257 - DNA, 25 bp, Artificial sequence
  Synthetic oligonucleotide
atttttactattagtacgatcatgc

SEQ ID NO: 707258 - DNA, 25 bp, Artificial sequence
  Synthetic oligonucleotide
tcaatcttaatcgtaacgtattaga

SEQ ID NO: 707259 - DNA, 25 bp, Artificial sequence
  Synthetic oligonucleotide
tcaatatagatatttaaccgcagtt

SEQ ID NO: 707260 - DNA, 25 bp, Artificial sequence
  Synthetic oligonucleotide
aatttttatcccgcgtatagatata

SEQ ID NO: 707261 - DNA, 25 bp, Artificial sequence
  Synthetic oligonucleotide
tacttacgtttacgttatagatttg

SEQ ID NO: 707262 - DNA, 25 bp, Artificial sequence
  Synthetic oligonucleotide
ttcattgcgtaatctatattttggt

SEQ ID NO: 707263 - DNA, 25 bp, Artificial sequence
  Synthetic oligonucleotide
ttcattgcgtaaactatattttggt

SEQ ID NO: 707264 - DNA, 25 bp, Artificial sequence
  Synthetic oligonucleotide
cgactatttagttcgtcatattaaa

SEQ ID NO: 707265 - DNA, 25 bp, Artificial sequence
  Synthetic oligonucleotide
cgactatttagtacgtcatattaaa

SEQ ID NO: 707266 - DNA, 25 bp, Artificial sequence
  Synthetic oligonucleotide
ttctacgatgaacatttctaaaact

SEQ ID NO: 707267 - DNA, 25 bp, Artificial sequence
  Synthetic oligonucleotide
ttctacgatgaagatttctaaaact

SEQ ID NO: 707268 - DNA, 25 bp, Artificial sequence
  Synthetic oligonucleotide
atcaatcgcgaaatttttactatac

SEQ ID NO: 707269 - DNA, 25 bp, Artificial sequence
  Synthetic oligonucleotide
atcaatcgcgaattttttactatac

SEQ ID NO: 707270 - DNA, 25 bp, Artificial sequence
  Synthetic oligonucleotide
gactatttttcgaattgatccaaaa

SEQ ID NO: 707271 - DNA, 25 bp, Artificial sequence
  Synthetic oligonucleotide
tttgaattcgattaccgaaacaaat

SEQ ID NO: 707272 - DNA, 25 bp, Artificial sequence
  Synthetic oligonucleotide
gactatttttcgtattgatccaaaa

SEQ ID NO: 707273 - DNA, 25 bp, Artificial sequence
  Synthetic oligonucleotide
tcaatatagataattaaccgcagtt

SEQ ID NO: 707274 - DNA, 25 bp, Artificial sequence
  Synthetic oligonucleotide
gtaagcgataattattcgtaaaaga

SEQ ID NO: 707275 - DNA, 25 bp, Artificial sequence
  Synthetic oligonucleotide
gtaagcgataataattcgtaaaaga

SEQ ID NO: 707276 - DNA, 25 bp, Artificial sequence
  Synthetic oligonucleotide
aataattaacgtagcgcgataatat

SEQ ID NO: 707277 - DNA, 25 bp, Artificial sequence
  Synthetic oligonucleotide
aataattaacgttgcgcgataatat

SEQ ID NO: 707278 - DNA, 25 bp, Artificial sequence
  Synthetic oligonucleotide
aatatattaataggcggacagattt

SEQ ID NO: 707279 - DNA, 25 bp, Artificial sequence
  Synthetic oligonucleotide
aatatattaatacgcggacagattt

SEQ ID NO: 707280 - DNA, 25 bp, Artificial sequence
  Synthetic oligonucleotide
ttgtattccgtcgaactataaataa

SEQ ID NO: 707281 - DNA, 25 bp, Artificial sequence
  Synthetic oligonucleotide
caatttattatccgcgtaaaacaat

SEQ ID NO: 707282 - DNA, 25 bp, Artificial sequence
  Synthetic oligonucleotide
tattttatcataacgatacgcacat

SEQ ID NO: 707283 - DNA, 25 bp, Artificial sequence
  Synthetic oligonucleotide
tttgaattcgataaccgaaacaaat

SEQ ID NO: 707284 - DNA, 25 bp, Artificial sequence
  Synthetic oligonucleotide
gactctttaatatcgatatgacata

SEQ ID NO: 707285 - DNA, 25 bp, Artificial sequence
  Synthetic oligonucleotide
tattttatcatatcgatacgcacat

SEQ ID NO: 707286 - DNA, 25 bp, Artificial sequence
  Synthetic oligonucleotide
tttagacaatattaatcgcttcaga

SEQ ID NO: 707287 - DNA, 25 bp, Artificial sequence
  Synthetic oligonucleotide
tttagacaatataaatcgcttcaga

SEQ ID NO: 707288 - DNA, 25 bp, Artificial sequence
  Synthetic oligonucleotide
taagtatacggtgtaaattatctct

SEQ ID NO: 707289 - DNA, 25 bp, Artificial sequence
  Synthetic oligonucleotide
taagtatacggtctaaattatctct

SEQ ID NO: 707290 - DNA, 25 bp, Artificial sequence
  Synthetic oligonucleotide
agtggatattacgattagtttatag

SEQ ID NO: 707291 - DNA, 25 bp, Artificial sequence
  Synthetic oligonucleotide
agtggatattaccattagtttatag

SEQ ID NO: 707292 - DNA, 25 bp, Artificial sequence
  Synthetic oligonucleotide
tctaagtataaatctcgaactgttt

SEQ ID NO: 707293 - DNA, 25 bp, Artificial sequence
  Synthetic oligonucleotide
tctaagtataaaactcgaactgttt

SEQ ID NO: 707294 - DNA, 25 bp, Artificial sequence
  Synthetic oligonucleotide
aaacatgtcggtaaataacaatcta

SEQ ID NO: 707295 - DNA, 25 bp, Artificial sequence
  Synthetic oligonucleotide
tacttacgtttaggttatagatttg

SEQ ID NO: 707296 - DNA, 25 bp, Artificial sequence
  Synthetic oligonucleotide
gactctttaataacgatatgacata

SEQ ID NO: 707297 - DNA, 25 bp, Artificial sequence
  Synthetic oligonucleotide
aatttttatcccccgtatagatata

SEQ ID NO: 707298 - DNA, 25 bp, Artificial sequence
  Synthetic oligonucleotide
cttcaagtacgtactaaatcattaa

SEQ ID NO: 707299 - DNA, 25 bp, Artificial sequence
  Synthetic oligonucleotide
cttcaagtacgttctaaatcattaa

SEQ ID NO: 707300 - DNA, 25 bp, Artificial sequence
  Synthetic oligonucleotide
tcatatatatgactaccgttgattt

SEQ ID NO: 707301 - DNA, 25 bp, Artificial sequence
  Synthetic oligonucleotide
tcatatatatgagtaccgttgattt

SEQ ID NO: 707302 - DNA, 25 bp, Artificial sequence
  Synthetic oligonucleotide
gaataatacgtgatcgattaattgt

SEQ ID NO: 707303 - DNA, 25 bp, Artificial sequence
  Synthetic oligonucleotide
gaataatacgtgttcgattaattgt

SEQ ID NO: 707304 - DNA, 25 bp, Artificial sequence
  Synthetic oligonucleotide
ctttacaaaattcaatcgtcttaca

SEQ ID NO: 707305 - DNA, 25 bp, Artificial sequence
  Synthetic oligonucleotide
ctttacaaaattgaatcgtcttaca

SEQ ID NO: 707306 - DNA, 25 bp, Artificial sequence
  Synthetic oligonucleotide
gtactacttattaggaacgattaat

SEQ ID NO: 707307 - DNA, 25 bp, Artificial sequence
  Synthetic oligonucleotide
gtactacttatttggaacgattaat

SEQ ID NO: 707308 - DNA, 25 bp, Artificial sequence
  Synthetic oligonucleotide
aaacatgtcggttaataacaatcta

SEQ ID NO: 707309 - DNA, 25 bp, Artificial sequence
  Synthetic oligonucleotide
ttaatttagtacctcgatacaactt

SEQ ID NO: 707310 - DNA, 25 bp, Artificial sequence
  Synthetic oligonucleotide
aatagatatcgcgatagacataaat

SEQ ID NO: 707311 - DNA, 25 bp, Artificial sequence
  Synthetic oligonucleotide
tttttcaatgttggcgactatattt

SEQ ID NO: 707312 - DNA, 25 bp, Artificial sequence
  Synthetic oligonucleotide
tttttcaatgttcgcgactatattt

SEQ ID NO: 707313 - DNA, 25 bp, Artificial sequence
  Synthetic oligonucleotide
gaactattatcgcgtagtaataatt

SEQ ID NO: 707314 - DNA, 25 bp, Artificial sequence
  Synthetic oligonucleotide
gaactattatcgggtagtaataatt

SEQ ID NO: 707315 - DNA, 25 bp, Artificial sequence
  Synthetic oligonucleotide
agtaaatcgttatcgcatatttact

SEQ ID NO: 707316 - DNA, 25 bp, Artificial sequence
  Synthetic oligonucleotide
agtaaatcgttaacgcatatttact

SEQ ID NO: 707317 - DNA, 25 bp, Artificial sequence
  Synthetic oligonucleotide
aggtaatccgatggtaataaattta

SEQ ID NO: 707318 - DNA, 25 bp, Artificial sequence
  Synthetic oligonucleotide
aggtaatccgatcgtaataaattta

SEQ ID NO: 707319 - DNA, 25 bp, Artificial sequence
  Synthetic oligonucleotide
ataacttatgtaacgacgttataag

SEQ ID NO: 707320 - DNA, 25 bp, Artificial sequence
  Synthetic oligonucleotide
taatataattaccctagcgactata

SEQ ID NO: 707321 - DNA, 25 bp, Artificial sequence
  Synthetic oligonucleotide
ttaatttagtacgtcgatacaactt

SEQ ID NO: 707322 - DNA, 25 bp, Artificial sequence
  Synthetic oligonucleotide
aaatttatctagggcgataatttgt

SEQ ID NO: 707323 - DNA, 25 bp, Artificial sequence
  Synthetic oligonucleotide
aaaatatacgcgataacttaaactc

SEQ ID NO: 707324 - DNA, 25 bp, Artificial sequence
  Synthetic oligonucleotide
aaaatatacgcgttaacttaaactc

SEQ ID NO: 707325 - DNA, 25 bp, Artificial sequence
  Synthetic oligonucleotide
aactattacatcccgtattgaattt

SEQ ID NO: 707326 - DNA, 25 bp, Artificial sequence
  Synthetic oligonucleotide
aactattacatcgcgtattgaattt

SEQ ID NO: 707327 - DNA, 25 bp, Artificial sequence
  Synthetic oligonucleotide
taacttctattaacgtacgtaaaag

SEQ ID NO: 707328 - DNA, 25 bp, Artificial sequence
  Synthetic oligonucleotide
taacttctattatcgtacgtaaaag

SEQ ID NO: 707329 - DNA, 25 bp, Artificial sequence
  Synthetic oligonucleotide
caatttattatcggcgtaaaacaat

SEQ ID NO: 707330 - DNA, 25 bp, Artificial sequence
  Synthetic oligonucleotide
atatctgttcgaaatttatggatag

SEQ ID NO: 707331 - DNA, 25 bp, Artificial sequence
  Synthetic oligonucleotide
ataggtattagcccgatataattta

SEQ ID NO: 707332 - DNA, 25 bp, Artificial sequence
  Synthetic oligonucleotide
agatttctcgaaatttaccatattg

SEQ ID NO: 707333 - DNA, 25 bp, Artificial sequence
  Synthetic oligonucleotide
ataacttatgtatcgacgttataag

SEQ ID NO: 707334 - DNA, 25 bp, Artificial sequence
  Synthetic oligonucleotide
ttagttcgtatcgtacgaatattat

SEQ ID NO: 707335 - DNA, 25 bp, Artificial sequence
  Synthetic oligonucleotide
agtatatagctatacgcgttatata

SEQ ID NO: 707336 - DNA, 25 bp, Artificial sequence
  Synthetic oligonucleotide
agtatatagctaaacgcgttatata

SEQ ID NO: 707337 - DNA, 25 bp, Artificial sequence
  Synthetic oligonucleotide
atatattagatcgcgatagtttagt

SEQ ID NO: 707338 - DNA, 25 bp, Artificial sequence
  Synthetic oligonucleotide
atatattagatcccgatagtttagt

SEQ ID NO: 707339 - DNA, 25 bp, Artificial sequence
  Synthetic oligonucleotide
aataactactcgaaacgcaattaaa

SEQ ID NO: 707340 - DNA, 25 bp, Artificial sequence
  Synthetic oligonucleotide
aataactactcgtaacgcaattaaa

SEQ ID NO: 707341 - DNA, 25 bp, Artificial sequence
  Synthetic oligonucleotide
tttgaatacgaacgcgttatatata

SEQ ID NO: 707342 - DNA, 25 bp, Artificial sequence
  Synthetic oligonucleotide
tttgaatacgaaggcgttatatata

SEQ ID NO: 707343 - DNA, 25 bp, Artificial sequence
  Synthetic oligonucleotide
attattcttattagtcgcgtatatg

SEQ ID NO: 707344 - DNA, 25 bp, Artificial sequence
  Synthetic oligonucleotide
attattcttatttgtcgcgtatatg

SEQ ID NO: 707345 - DNA, 25 bp, Artificial sequence
  Synthetic oligonucleotide
taatataattacgctagcgactata

SEQ ID NO: 707346 - DNA, 25 bp, Artificial sequence
  Synthetic oligonucleotide
taaattcgtcttatagcgtattaca

SEQ ID NO: 707347 - DNA, 25 bp, Artificial sequence
  Synthetic oligonucleotide
ttgtattccgtccaactataaataa

SEQ ID NO: 707348 - DNA, 25 bp, Artificial sequence
  Synthetic oligonucleotide
ttagttcgtatcctacgaatattat

SEQ ID NO: 707349 - DNA, 25 bp, Artificial sequence
  Synthetic oligonucleotide
tattatcgtacgtacgtaaattctt

SEQ ID NO: 707350 - DNA, 25 bp, Artificial sequence
  Synthetic oligonucleotide
tattatcgtacgaacgtaaattctt

SEQ ID NO: 707351 - DNA, 25 bp, Artificial sequence
  Synthetic oligonucleotide
aaataacggtctaacgatatactaa

SEQ ID NO: 707352 - DNA, 25 bp, Artificial sequence
  Synthetic oligonucleotide
aaataacggtcttacgatatactaa

SEQ ID NO: 707353 - DNA, 25 bp, Artificial sequence
  Synthetic oligonucleotide
taaattcgaatttcgacgtttattc

SEQ ID NO: 707354 - DNA, 25 bp, Artificial sequence
  Synthetic oligonucleotide
taaattcgaattacgacgtttattc

SEQ ID NO: 707355 - DNA, 25 bp, Artificial sequence
  Synthetic oligonucleotide
aatatacgaataacgtacgaatatg

SEQ ID NO: 707356 - DNA, 25 bp, Artificial sequence
  Synthetic oligonucleotide
aatatacgaatatcgtacgaatatg

SEQ ID NO: 707357 - DNA, 25 bp, Artificial sequence
  Synthetic oligonucleotide
aaatttatctagcgcgataatttgt

SEQ ID NO: 707358 - DNA, 25 bp, Artificial sequence
  Synthetic oligonucleotide
taaattcgtcttttagcgtattaca

SEQ ID NO: 707359 - DNA, 25 bp, Artificial sequence
  Synthetic oligonucleotide
atccgcgatattataatagatctat

SEQ ID NO: 707360 - DNA, 25 bp, Artificial sequence
  Synthetic oligonucleotide
atttgcgtttaaatacgtcaaaatg

SEQ ID NO: 707361 - DNA, 25 bp, Artificial sequence
  Synthetic oligonucleotide
atacgtataatgccgtaactaatta

SEQ ID NO: 707362 - DNA, 25 bp, Artificial sequence
  Synthetic oligonucleotide
atacgtataatggcgtaactaatta

SEQ ID NO: 707363 - DNA, 25 bp, Artificial sequence
  Synthetic oligonucleotide
atttaatgcgaagtttagtacacta

SEQ ID NO: 707364 - DNA, 25 bp, Artificial sequence
  Synthetic oligonucleotide
atttaatgcgaactttagtacacta

SEQ ID NO: 707365 - DNA, 25 bp, Artificial sequence
  Synthetic oligonucleotide
atcaattcgaaactctaacaaacat

SEQ ID NO: 707366 - DNA, 25 bp, Artificial sequence
  Synthetic oligonucleotide
atcaattcgaaagtctaacaaacat

SEQ ID NO: 707367 - DNA, 25 bp, Artificial sequence
  Synthetic oligonucleotide
tcgatacgtgaatcttgtatatttt

SEQ ID NO: 707368 - DNA, 25 bp, Artificial sequence
  Synthetic oligonucleotide
tcgatacgtgaaacttgtatatttt

SEQ ID NO: 707369 - DNA, 25 bp, Artificial sequence
  Synthetic oligonucleotide
caatttttaacgcttaattgacaag

SEQ ID NO: 707370 - DNA, 25 bp, Artificial sequence
  Synthetic oligonucleotide
gtactacgttaagtataagtcttat

SEQ ID NO: 707371 - DNA, 25 bp, Artificial sequence
  Synthetic oligonucleotide
atccgcgatattttaatagatctat

SEQ ID NO: 707372 - DNA, 25 bp, Artificial sequence
  Synthetic oligonucleotide
aaacggtaacgttatattgacataa

SEQ ID NO: 707373 - DNA, 25 bp, Artificial sequence
  Synthetic oligonucleotide
ctctaagatatattcgataacaatg

SEQ ID NO: 707374 - DNA, 25 bp, Artificial sequence
  Synthetic oligonucleotide
ctctaagatataatcgataacaatg

SEQ ID NO: 707375 - DNA, 25 bp, Artificial sequence
  Synthetic oligonucleotide
gttttaacctattttactcgtacaa

SEQ ID NO: 707376 - DNA, 25 bp, Artificial sequence
  Synthetic oligonucleotide
gttttaacctatattactcgtacaa

SEQ ID NO: 707377 - DNA, 25 bp, Artificial sequence
  Synthetic oligonucleotide
tgatagtctaaattttgacgttctt

SEQ ID NO: 707378 - DNA, 25 bp, Artificial sequence
  Synthetic oligonucleotide
tgatagtctaaaatttgacgttctt

SEQ ID NO: 707379 - DNA, 25 bp, Artificial sequence
  Synthetic oligonucleotide
ctaaacgaatatggtttgatttgat

SEQ ID NO: 707380 - DNA, 25 bp, Artificial sequence
  Synthetic oligonucleotide
ctaaacgaatatcgtttgatttgat

SEQ ID NO: 707381 - DNA, 25 bp, Artificial sequence
  Synthetic oligonucleotide
caattaatataaaaccgaactgcat

SEQ ID NO: 707382 - DNA, 25 bp, Artificial sequence
  Synthetic oligonucleotide
caattaatataataccgaactgcat

SEQ ID NO: 707383 - DNA, 25 bp, Artificial sequence
  Synthetic oligonucleotide
caatttttaacggttaattgacaag

SEQ ID NO: 707384 - DNA, 25 bp, Artificial sequence
  Synthetic oligonucleotide
taattggtttacgatttgatcatct

SEQ ID NO: 707385 - DNA, 25 bp, Artificial sequence
  Synthetic oligonucleotide
aatagatatcgccatagacataaat

SEQ ID NO: 707386 - DNA, 25 bp, Artificial sequence
  Synthetic oligonucleotide
cttggagtatatatcgtaaagtata

SEQ ID NO: 707387 - DNA, 25 bp, Artificial sequence
  Synthetic oligonucleotide
agacccgtattcttatattaaatga

SEQ ID NO: 707388 - DNA, 25 bp, Artificial sequence
  Synthetic oligonucleotide
tcattctattacggttaattcactt

SEQ ID NO: 707389 - DNA, 25 bp, Artificial sequence
  Synthetic oligonucleotide
tcattctattaccgttaattcactt

SEQ ID NO: 707390 - DNA, 25 bp, Artificial sequence
  Synthetic oligonucleotide
tctagattgataaatttcgatcaga

SEQ ID NO: 707391 - DNA, 25 bp, Artificial sequence
  Synthetic oligonucleotide
tctagattgatatatttcgatcaga

SEQ ID NO: 707392 - DNA, 25 bp, Artificial sequence
  Synthetic oligonucleotide
aatacataaatatgtggcgaatcaa

SEQ ID NO: 707393 - DNA, 25 bp, Artificial sequence
  Synthetic oligonucleotide
aatacataaataagtggcgaatcaa

SEQ ID NO: 707394 - DNA, 25 bp, Artificial sequence
  Synthetic oligonucleotide
tgttaaaaacgttattcgatactga

SEQ ID NO: 707395 - DNA, 25 bp, Artificial sequence
  Synthetic oligonucleotide
atttgcgtttaattacgtcaaaatg

SEQ ID NO: 707396 - DNA, 25 bp, Artificial sequence
  Synthetic oligonucleotide
taattggtttaccatttgatcatct

SEQ ID NO: 707397 - DNA, 25 bp, Artificial sequence
  Synthetic oligonucleotide
aaacggtaacgtaatattgacataa

SEQ ID NO: 707398 - DNA, 25 bp, Artificial sequence
  Synthetic oligonucleotide
caactatatcgaattatactgagat

SEQ ID NO: 707399 - DNA, 25 bp, Artificial sequence
  Synthetic oligonucleotide
caactatatcgatttatactgagat

SEQ ID NO: 707400 - DNA, 25 bp, Artificial sequence
  Synthetic oligonucleotide
aacactaaccgaaattaagtaagaa

SEQ ID NO: 707401 - DNA, 25 bp, Artificial sequence
  Synthetic oligonucleotide
aacactaaccgatattaagtaagaa

SEQ ID NO: 707402 - DNA, 25 bp, Artificial sequence
  Synthetic oligonucleotide
tgaacattcgaaaattagttcttac

SEQ ID NO: 707403 - DNA, 25 bp, Artificial sequence
  Synthetic oligonucleotide
tgaacattcgaatattagttcttac

SEQ ID NO: 707404 - DNA, 25 bp, Artificial sequence
  Synthetic oligonucleotide
tcattgatctatatactcgaatttc

SEQ ID NO: 707405 - DNA, 25 bp, Artificial sequence
  Synthetic oligonucleotide
tcattgatctatttactcgaatttc

SEQ ID NO: 707406 - DNA, 25 bp, Artificial sequence
  Synthetic oligonucleotide
ataaagcgaattgaaatatcagtag

SEQ ID NO: 707407 - DNA, 25 bp, Artificial sequence
  Synthetic oligonucleotide
ataaagcgaattcaaatatcagtag

SEQ ID NO: 707408 - DNA, 25 bp, Artificial sequence
  Synthetic oligonucleotide
cttggagtatatttcgtaaagtata

SEQ ID NO: 707409 - DNA, 25 bp, Artificial sequence
  Synthetic oligonucleotide
tgttaaaaacgtaattcgatactga

SEQ ID NO: 707410 - DNA, 25 bp, Artificial sequence
  Synthetic oligonucleotide
ttcattagggaaaatatcgtcaaat

SEQ ID NO: 707411 - DNA, 25 bp, Artificial sequence
  Synthetic oligonucleotide
tttctcaacgtatcgttaaactaaa

SEQ ID NO: 707412 - DNA, 25 bp, Artificial sequence
  Synthetic oligonucleotide
tttctcaacgtaacgttaaactaaa

SEQ ID NO: 707413 - DNA, 25 bp, Artificial sequence
  Synthetic oligonucleotide
gtaaaatcgtaggtgtaaaatatgt

SEQ ID NO: 707414 - DNA, 25 bp, Artificial sequence
  Synthetic oligonucleotide
gtaaaatcgtagctgtaaaatatgt

SEQ ID NO: 707415 - DNA, 25 bp, Artificial sequence
  Synthetic oligonucleotide
actgtcttataccatttaatcaatg

SEQ ID NO: 707416 - DNA, 25 bp, Artificial sequence
  Synthetic oligonucleotide
actgtcttatacgatttaatcaatg

SEQ ID NO: 707417 - DNA, 25 bp, Artificial sequence
  Synthetic oligonucleotide
agctcttatatcctattagatatct

SEQ ID NO: 707418 - DNA, 25 bp, Artificial sequence
  Synthetic oligonucleotide
agctcttatatcgtattagatatct

SEQ ID NO: 707419 - DNA, 25 bp, Artificial sequence
  Synthetic oligonucleotide
ggatgactaatattatacgaattga

SEQ ID NO: 707420 - DNA, 25 bp, Artificial sequence
  Synthetic oligonucleotide
ggatttcgctttttaatatatgtgt

SEQ ID NO: 707421 - DNA, 25 bp, Artificial sequence
  Synthetic oligonucleotide
tgagaaacgagaaacattacaatta

SEQ ID NO: 707422 - DNA, 25 bp, Artificial sequence
  Synthetic oligonucleotide
ggatgactaataatatacgaattga

SEQ ID NO: 707423 - DNA, 25 bp, Artificial sequence
  Synthetic oligonucleotide
ttcattagggaatatatcgtcaaat

SEQ ID NO: 707424 - DNA, 25 bp, Artificial sequence
  Synthetic oligonucleotide
aatctcgtataactaagattcacat

SEQ ID NO: 707425 - DNA, 25 bp, Artificial sequence
  Synthetic oligonucleotide
aatctcgtataagtaagattcacat

SEQ ID NO: 707426 - DNA, 25 bp, Artificial sequence
  Synthetic oligonucleotide
tttaatcgaattacttaactcctga

SEQ ID NO: 707427 - DNA, 25 bp, Artificial sequence
  Synthetic oligonucleotide
tttaatcgaatttcttaactcctga

SEQ ID NO: 707428 - DNA, 25 bp, Artificial sequence
  Synthetic oligonucleotide
cagttcaataataaacgttagtaga

SEQ ID NO: 707429 - DNA, 25 bp, Artificial sequence
  Synthetic oligonucleotide
cagttcaataattaacgttagtaga

SEQ ID NO: 707430 - DNA, 25 bp, Artificial sequence
  Synthetic oligonucleotide
gcatatgaattatacgtacgtttat

SEQ ID NO: 707431 - DNA, 25 bp, Artificial sequence
  Synthetic oligonucleotide
gcatatgaattaaacgtacgtttat

SEQ ID NO: 707432 - DNA, 25 bp, Artificial sequence
  Synthetic oligonucleotide
atatctgttcgatatttatggatag

SEQ ID NO: 707433 - DNA, 25 bp, Artificial sequence
  Synthetic oligonucleotide
agacccgtattcatatattaaatga

SEQ ID NO: 707434 - DNA, 25 bp, Artificial sequence
  Synthetic oligonucleotide
gtcaaatcggacgaattatattaaa

SEQ ID NO: 707435 - DNA, 25 bp, Artificial sequence
  Synthetic oligonucleotide
tgagaaacgagatacattacaatta

SEQ ID NO: 707436 - DNA, 25 bp, Artificial sequence
  Synthetic oligonucleotide
ggatttcgctttataatatatgtgt

SEQ ID NO: 707437 - DNA, 25 bp, Artificial sequence
  Synthetic oligonucleotide
aagaatagaccgaattaataacttg

SEQ ID NO: 707438 - DNA, 25 bp, Artificial sequence
  Synthetic oligonucleotide
ttcatttcgttctattaagtacgat

SEQ ID NO: 707439 - DNA, 25 bp, Artificial sequence
  Synthetic oligonucleotide
ttcatttcgttcaattaagtacgat

SEQ ID NO: 707440 - DNA, 25 bp, Artificial sequence
  Synthetic oligonucleotide
cagtatatattattccgatagacta

SEQ ID NO: 707441 - DNA, 25 bp, Artificial sequence
  Synthetic oligonucleotide
gtcaaatcggaccaattatattaaa

SEQ ID NO: 707442 - DNA, 25 bp, Artificial sequence
  Synthetic oligonucleotide
aagaatagaccgtattaataacttg

SEQ ID NO: 707443 - DNA, 25 bp, Artificial sequence
  Synthetic oligonucleotide
ctttatacccaattacgataatgta

SEQ ID NO: 707444 - DNA, 25 bp, Artificial sequence
  Synthetic oligonucleotide
ctttatacccaaatacgataatgta

SEQ ID NO: 707445 - DNA, 25 bp, Artificial sequence
  Synthetic oligonucleotide
gtactacgttaactataagtcttat

SEQ ID NO: 707446 - DNA, 25 bp, Artificial sequence
  Synthetic oligonucleotide
cgatagtacgctataataattctat

SEQ ID NO: 707447 - DNA, 25 bp, Artificial sequence
  Synthetic oligonucleotide
cgtatatccgtataataagtaatac

SEQ ID NO: 707448 - DNA, 25 bp, Artificial sequence
  Synthetic oligonucleotide
cagtatatattaatccgatagacta

SEQ ID NO: 707449 - DNA, 25 bp, Artificial sequence
  Synthetic oligonucleotide
cgtatatccgtaaaataagtaatac

SEQ ID NO: 707450 - DNA, 25 bp, Artificial sequence
  Synthetic oligonucleotide
acattatttaatggaaaagtcgtac

SEQ ID NO: 707451 - DNA, 25 bp, Artificial sequence
  Synthetic oligonucleotide
cgatagtacgctttaataattctat

SEQ ID NO: 707452 - DNA, 25 bp, Artificial sequence
  Synthetic oligonucleotide
ataatactaaacgatcatttactcg

SEQ ID NO: 707453 - DNA, 25 bp, Artificial sequence
  Synthetic oligonucleotide
cgttctttaacaggatataaacatt

SEQ ID NO: 707454 - DNA, 25 bp, Artificial sequence
  Synthetic oligonucleotide
cgttctttaacacgatataaacatt

SEQ ID NO: 707455 - DNA, 25 bp, Artificial sequence
  Synthetic oligonucleotide
aggctaaattagcgatattaaattg

SEQ ID NO: 707456 - DNA, 25 bp, Artificial sequence
  Synthetic oligonucleotide
aggctaaattagggatattaaattg

SEQ ID NO: 707457 - DNA, 25 bp, Artificial sequence
  Synthetic oligonucleotide
acattatttaatcgaaaagtcgtac

SEQ ID NO: 707458 - DNA, 25 bp, Artificial sequence
  Synthetic oligonucleotide
ataatactaaaccatcatttactcg

SEQ ID NO: 707459 - DNA, 25 bp, Artificial sequence
  Synthetic oligonucleotide
gttgattgcgaaatatcaaggtttt

SEQ ID NO: 707460 - DNA, 25 bp, Artificial sequence
  Synthetic oligonucleotide
atacgaattctaattaacggtagtg

SEQ ID NO: 707461 - DNA, 25 bp, Artificial sequence
  Synthetic oligonucleotide
gaataatcttagctttatcgtcttg

SEQ ID NO: 707462 - DNA, 25 bp, Artificial sequence
  Synthetic oligonucleotide
gaataatcttaggtttatcgtcttg

SEQ ID NO: 707463 - DNA, 25 bp, Artificial sequence
  Synthetic oligonucleotide
gtttgaattcaaggctagtaagaat

SEQ ID NO: 707464 - DNA, 25 bp, Artificial sequence
  Synthetic oligonucleotide
gtttgaattcaacgctagtaagaat

SEQ ID NO: 707465 - DNA, 25 bp, Artificial sequence
  Synthetic oligonucleotide
gttgattgcgaattatcaaggtttt

SEQ ID NO: 707466 - DNA, 25 bp, Artificial sequence
  Synthetic oligonucleotide
gttaatattttcgctagtacagttg

SEQ ID NO: 707467 - DNA, 25 bp, Artificial sequence
  Synthetic oligonucleotide
atacgaattctatttaacggtagtg

SEQ ID NO: 707468 - DNA, 25 bp, Artificial sequence
  Synthetic oligonucleotide
gttaatattttccctagtacagttg

SEQ ID NO: 707469 - DNA, 25 bp, Artificial sequence
  Synthetic oligonucleotide
tgtacgcaaatttgacgaatagtat

SEQ ID NO: 707470 - DNA, 25 bp, Artificial sequence
  Synthetic oligonucleotide
tgtacgcaaattagacgaatagtat

SEQ ID NO: 707471 - DNA, 25 bp, Artificial sequence
  Synthetic oligonucleotide
atactattgagtcgtaccgttataa

SEQ ID NO: 707472 - DNA, 25 bp, Artificial sequence
  Synthetic oligonucleotide
atactattgagtggtaccgttataa

SEQ ID NO: 707473 - DNA, 25 bp, Artificial sequence
  Synthetic oligonucleotide
tatattttagtacgctccggtaaat

SEQ ID NO: 707474 - DNA, 25 bp, Artificial sequence
  Synthetic oligonucleotide
tatattttagtaggctccggtaaat

SEQ ID NO: 707475 - DNA, 25 bp, Artificial sequence
  Synthetic oligonucleotide
actttatcgcgaactaggttaaata

SEQ ID NO: 707476 - DNA, 25 bp, Artificial sequence
  Synthetic oligonucleotide
actttatcgcgatctaggttaaata

SEQ ID NO: 707477 - DNA, 25 bp, Artificial sequence
  Synthetic oligonucleotide
ttatattattcgccccgtaaatagt

SEQ ID NO: 707478 - DNA, 25 bp, Artificial sequence
  Synthetic oligonucleotide
ttatattattcggcccgtaaatagt

SEQ ID NO: 707479 - DNA, 25 bp, Artificial sequence
  Synthetic oligonucleotide
aactattacctacgttcgcaattaa

SEQ ID NO: 707480 - DNA, 25 bp, Artificial sequence
  Synthetic oligonucleotide
ttggcaatttaagcgatcttataag

SEQ ID NO: 707481 - DNA, 25 bp, Artificial sequence
  Synthetic oligonucleotide
aactattacctaggttcgcaattaa

SEQ ID NO: 707482 - DNA, 25 bp, Artificial sequence
  Synthetic oligonucleotide
gtttaatttccgatacaatagtagc

SEQ ID NO: 707483 - DNA, 25 bp, Artificial sequence
  Synthetic oligonucleotide
atacattttaatgcgcgaggtttat

SEQ ID NO: 707484 - DNA, 25 bp, Artificial sequence
  Synthetic oligonucleotide
tttatatctagagtaaacgagccat

SEQ ID NO: 707485 - DNA, 25 bp, Artificial sequence
  Synthetic oligonucleotide
gaattttaagtcgaccgctattaaa

SEQ ID NO: 707486 - DNA, 25 bp, Artificial sequence
  Synthetic oligonucleotide
tagattgatatcgtcgaaattcatg

SEQ ID NO: 707487 - DNA, 25 bp, Artificial sequence
  Synthetic oligonucleotide
atgacaaagttcctcactttgtaaa

SEQ ID NO: 707488 - DNA, 25 bp, Artificial sequence
  Synthetic oligonucleotide
atgacaaagttcgtcactttgtaaa

SEQ ID NO: 707489 - DNA, 25 bp, Artificial sequence
  Synthetic oligonucleotide
attggtcattcgctattaatttcgt

SEQ ID NO: 707490 - DNA, 25 bp, Artificial sequence
  Synthetic oligonucleotide
attggtcattcggtattaatttcgt

SEQ ID NO: 707491 - DNA, 25 bp, Artificial sequence
  Synthetic oligonucleotide
ccttattacgcttaatacattcaga

SEQ ID NO: 707492 - DNA, 25 bp, Artificial sequence
  Synthetic oligonucleotide
ccttattacgctaaatacattcaga

SEQ ID NO: 707493 - DNA, 25 bp, Artificial sequence
  Synthetic oligonucleotide
tagattgatatcctcgaaattcatg

SEQ ID NO: 707494 - DNA, 25 bp, Artificial sequence
  Synthetic oligonucleotide
tagctcgtaaaccacttatttctat

SEQ ID NO: 707495 - DNA, 25 bp, Artificial sequence
  Synthetic oligonucleotide
ttggcaatttaaccgatcttataag

SEQ ID NO: 707496 - DNA, 25 bp, Artificial sequence
  Synthetic oligonucleotide
gtttaatttccgttacaatagtagc

SEQ ID NO: 707497 - DNA, 25 bp, Artificial sequence
  Synthetic oligonucleotide
atagtgttttgaactaatcgctatg

SEQ ID NO: 707498 - DNA, 25 bp, Artificial sequence
  Synthetic oligonucleotide
atagtgttttgatctaatcgctatg

SEQ ID NO: 707499 - DNA, 25 bp, Artificial sequence
  Synthetic oligonucleotide
tcatttatttcggtatcgatcagta

SEQ ID NO: 707500 - DNA, 25 bp, Artificial sequence
  Synthetic oligonucleotide
tcatttatttcgctatcgatcagta

SEQ ID NO: 707501 - DNA, 25 bp, Artificial sequence
  Synthetic oligonucleotide
agatttgatttgacaattcgctagt

SEQ ID NO: 707502 - DNA, 25 bp, Artificial sequence
  Synthetic oligonucleotide
agatttgatttgtcaattcgctagt

SEQ ID NO: 707503 - DNA, 25 bp, Artificial sequence
  Synthetic oligonucleotide
ctaagtcttactagtacgaatatgt

SEQ ID NO: 707504 - DNA, 25 bp, Artificial sequence
  Synthetic oligonucleotide
ctaagtcttacttgtacgaatatgt

SEQ ID NO: 707505 - DNA, 25 bp, Artificial sequence
  Synthetic oligonucleotide
gatcaagacatattacttcgttgaa

SEQ ID NO: 707506 - DNA, 25 bp, Artificial sequence
  Synthetic oligonucleotide
gatcaagacataatacttcgttgaa

SEQ ID NO: 707507 - DNA, 25 bp, Artificial sequence
  Synthetic oligonucleotide
tagctcgtaaacgacttatttctat

SEQ ID NO: 707508 - DNA, 25 bp, Artificial sequence
  Synthetic oligonucleotide
catttatgcgcgttaatacatatag

SEQ ID NO: 707509 - DNA, 25 bp, Artificial sequence
  Synthetic oligonucleotide
taatgtttgcgtacgaactgatata

SEQ ID NO: 707510 - DNA, 25 bp, Artificial sequence
  Synthetic oligonucleotide
taatgtttgcgttcgaactgatata

SEQ ID NO: 707511 - DNA, 25 bp, Artificial sequence
  Synthetic oligonucleotide
cttactttacgtttcggacatatat

SEQ ID NO: 707512 - DNA, 25 bp, Artificial sequence
  Synthetic oligonucleotide
cttactttacgtatcggacatatat

SEQ ID NO: 707513 - DNA, 25 bp, Artificial sequence
  Synthetic oligonucleotide
tctatattacgagtcgtagtgtaaa

SEQ ID NO: 707514 - DNA, 25 bp, Artificial sequence
  Synthetic oligonucleotide
tctatattacgactcgtagtgtaaa

SEQ ID NO: 707515 - DNA, 25 bp, Artificial sequence
  Synthetic oligonucleotide
ttaacattacgatcgctacagataa

SEQ ID NO: 707516 - DNA, 25 bp, Artificial sequence
  Synthetic oligonucleotide
ttaacattacgaacgctacagataa

SEQ ID NO: 707517 - DNA, 25 bp, Artificial sequence
  Synthetic oligonucleotide
aacttattaatcggctacgctttaa

SEQ ID NO: 707518 - DNA, 25 bp, Artificial sequence
  Synthetic oligonucleotide
atagtacatacgtcgcgatataaaa

SEQ ID NO: 707519 - DNA, 25 bp, Artificial sequence
  Synthetic oligonucleotide
catttatgcgcgataatacatatag

SEQ ID NO: 707520 - DNA, 25 bp, Artificial sequence
  Synthetic oligonucleotide
atagtacatacgacgcgatataaaa

SEQ ID NO: 707521 - DNA, 25 bp, Artificial sequence
  Synthetic oligonucleotide
ttttattgcgcgtctaataggtata

SEQ ID NO: 707522 - DNA, 25 bp, Artificial sequence
  Synthetic oligonucleotide
ttttattgcgcgactaataggtata

SEQ ID NO: 707523 - DNA, 25 bp, Artificial sequence
  Synthetic oligonucleotide
atgttttctaattgcgtcgatacat

SEQ ID NO: 707524 - DNA, 25 bp, Artificial sequence
  Synthetic oligonucleotide
atgttttctaatagcgtcgatacat

SEQ ID NO: 707525 - DNA, 25 bp, Artificial sequence
  Synthetic oligonucleotide
cataaatcgtcgcatatacttgaaa

SEQ ID NO: 707526 - DNA, 25 bp, Artificial sequence
  Synthetic oligonucleotide
cataaatcgtcggatatacttgaaa

SEQ ID NO: 707527 - DNA, 25 bp, Artificial sequence
  Synthetic oligonucleotide
ctaaaatcgcgttctaagtttttga

SEQ ID NO: 707528 - DNA, 25 bp, Artificial sequence
  Synthetic oligonucleotide
ctaaaatcgcgtactaagtttttga

SEQ ID NO: 707529 - DNA, 25 bp, Artificial sequence
  Synthetic oligonucleotide
tgttaatcgcgaatagttcctaata

SEQ ID NO: 707530 - DNA, 25 bp, Artificial sequence
  Synthetic oligonucleotide
tgaatctcgcgaaatagtctatttt

SEQ ID NO: 707531 - DNA, 25 bp, Artificial sequence
  Synthetic oligonucleotide
aacttattaatccgctacgctttaa

SEQ ID NO: 707532 - DNA, 25 bp, Artificial sequence
  Synthetic oligonucleotide
ttttaacgtatgtatcgcgtgaata

SEQ ID NO: 707533 - DNA, 25 bp, Artificial sequence
  Synthetic oligonucleotide
ataattgtcggcctagtatattact

SEQ ID NO: 707534 - DNA, 25 bp, Artificial sequence
  Synthetic oligonucleotide
ataattgtcggcgtagtatattact

SEQ ID NO: 707535 - DNA, 25 bp, Artificial sequence
  Synthetic oligonucleotide
ttaaaaggtaccccgaataattgta

SEQ ID NO: 707536 - DNA, 25 bp, Artificial sequence
  Synthetic oligonucleotide
ttaaaaggtaccgcgaataattgta

SEQ ID NO: 707537 - DNA, 25 bp, Artificial sequence
  Synthetic oligonucleotide
aacaaaggatcgtacgctatattat

SEQ ID NO: 707538 - DNA, 25 bp, Artificial sequence
  Synthetic oligonucleotide
aacaaaggatcgaacgctatattat

SEQ ID NO: 707539 - DNA, 25 bp, Artificial sequence
  Synthetic oligonucleotide
aattaaggatataaccgcgaaacaa

SEQ ID NO: 707540 - DNA, 25 bp, Artificial sequence
  Synthetic oligonucleotide
aattaaggatattaccgcgaaacaa

SEQ ID NO: 707541 - DNA, 25 bp, Artificial sequence
  Synthetic oligonucleotide
tatgatctaacccgcgtatatatat

SEQ ID NO: 707542 - DNA, 25 bp, Artificial sequence
  Synthetic oligonucleotide
tatgatctaaccggcgtatatatat

SEQ ID NO: 707543 - DNA, 25 bp, Artificial sequence
  Synthetic oligonucleotide
atacattttaatccgcgaggtttat

SEQ ID NO: 707544 - DNA, 25 bp, Artificial sequence
  Synthetic oligonucleotide
tattttcgtcggacgtataatagat

SEQ ID NO: 707545 - DNA, 25 bp, Artificial sequence
  Synthetic oligonucleotide
tttatatctagactaaacgagccat

SEQ ID NO: 707546 - DNA, 25 bp, Artificial sequence
  Synthetic oligonucleotide
ttttaacgtatgaatcgcgtgaata

SEQ ID NO: 707547 - DNA, 25 bp, Artificial sequence
  Synthetic oligonucleotide
taattgcggttgggtactaaattta

SEQ ID NO: 707548 - DNA, 25 bp, Artificial sequence
  Synthetic oligonucleotide
taattgcggttgcgtactaaattta

SEQ ID NO: 707549 - DNA, 25 bp, Artificial sequence
  Synthetic oligonucleotide
tttattcgcggtatagtactgaatt

SEQ ID NO: 707550 - DNA, 25 bp, Artificial sequence
  Synthetic oligonucleotide
tttattcgcggtttagtactgaatt

SEQ ID NO: 707551 - DNA, 25 bp, Artificial sequence
  Synthetic oligonucleotide
tataatcgaatactcgcgaaatgat

SEQ ID NO: 707552 - DNA, 25 bp, Artificial sequence
  Synthetic oligonucleotide
tataatcgaatagtcgcgaaatgat

SEQ ID NO: 707553 - DNA, 25 bp, Artificial sequence
  Synthetic oligonucleotide
aaatttcctatacgtcacgtaacat

SEQ ID NO: 707554 - DNA, 25 bp, Artificial sequence
  Synthetic oligonucleotide
aaatttcctataggtcacgtaacat

SEQ ID NO: 707555 - DNA, 25 bp, Artificial sequence
  Synthetic oligonucleotide
gaattttaagtccaccgctattaaa

SEQ ID NO: 707556 - DNA, 25 bp, Artificial sequence
  Synthetic oligonucleotide
tattttcgtcggtcgtataatagat

SEQ ID NO: 707557 - DNA, 25 bp, Artificial sequence
  Synthetic oligonucleotide
ttctctattacattcgatcgtattc

SEQ ID NO: 707558 - DNA, 25 bp, Artificial sequence
  Synthetic oligonucleotide
aaacttttatcgaattcgaaaggca

SEQ ID NO: 707559 - DNA, 25 bp, Artificial sequence
  Synthetic oligonucleotide
ctctatattaacggtctatagtgtt

SEQ ID NO: 707560 - DNA, 25 bp, Artificial sequence
  Synthetic oligonucleotide
ctctatattaaccgtctatagtgtt

SEQ ID NO: 707561 - DNA, 25 bp, Artificial sequence
  Synthetic oligonucleotide
tcgagttaatcgtaacataggtatt

SEQ ID NO: 707562 - DNA, 25 bp, Artificial sequence
  Synthetic oligonucleotide
tcgagttaatcgaaacataggtatt

SEQ ID NO: 707563 - DNA, 25 bp, Artificial sequence
  Synthetic oligonucleotide
aagcataatcgtatactcatttgag

SEQ ID NO: 707564 - DNA, 25 bp, Artificial sequence
  Synthetic oligonucleotide
aagcataatcgtttactcatttgag

SEQ ID NO: 707565 - DNA, 25 bp, Artificial sequence
  Synthetic oligonucleotide
ttgcttacgctaaaaaagagaaaga

SEQ ID NO: 707566 - DNA, 25 bp, Artificial sequence
  Synthetic oligonucleotide
ttgcttacgctataaaagagaaaga

SEQ ID NO: 707567 - DNA, 25 bp, Artificial sequence
  Synthetic oligonucleotide
ccgatcgatattttaaactttggat

SEQ ID NO: 707568 - DNA, 25 bp, Artificial sequence
  Synthetic oligonucleotide
gaagttcaacttattaatcgaatgc

SEQ ID NO: 707569 - DNA, 25 bp, Artificial sequence
  Synthetic oligonucleotide
ttctctattacaatcgatcgtattc

SEQ ID NO: 707570 - DNA, 25 bp, Artificial sequence
  Synthetic oligonucleotide
ttagccgtatagtattgatattcga

SEQ ID NO: 707571 - DNA, 25 bp, Artificial sequence
  Synthetic oligonucleotide
ttcgaaaaatcgtccgaaatagatt

SEQ ID NO: 707572 - DNA, 25 bp, Artificial sequence
  Synthetic oligonucleotide
ttcgaaaaatcgaccgaaatagatt

SEQ ID NO: 707573 - DNA, 25 bp, Artificial sequence
  Synthetic oligonucleotide
tcattctaatagttcgtacatccat

SEQ ID NO: 707574 - DNA, 25 bp, Artificial sequence
  Synthetic oligonucleotide
tcattctaatagatcgtacatccat

SEQ ID NO: 707575 - DNA, 25 bp, Artificial sequence
  Synthetic oligonucleotide
ttatccgaattagtttacgatgatc

SEQ ID NO: 707576 - DNA, 25 bp, Artificial sequence
  Synthetic oligonucleotide
ttatccgaattactttacgatgatc

SEQ ID NO: 707577 - DNA, 25 bp, Artificial sequence
  Synthetic oligonucleotide
taccaaatagattaacgtactcgta

SEQ ID NO: 707578 - DNA, 25 bp, Artificial sequence
  Synthetic oligonucleotide
taccaaatagataaacgtactcgta

SEQ ID NO: 707579 - DNA, 25 bp, Artificial sequence
  Synthetic oligonucleotide
attaatccgttatggttaaatccca

SEQ ID NO: 707580 - DNA, 25 bp, Artificial sequence
  Synthetic oligonucleotide
attaatccgttaaggttaaatccca

SEQ ID NO: 707581 - DNA, 25 bp, Artificial sequence
  Synthetic oligonucleotide
ccgatcgatattataaactttggat

SEQ ID NO: 707582 - DNA, 25 bp, Artificial sequence
  Synthetic oligonucleotide
atttgtatgatcgcacataaaggtt

SEQ ID NO: 707583 - DNA, 25 bp, Artificial sequence
  Synthetic oligonucleotide
tgaatctcgcgatatagtctatttt

SEQ ID NO: 707584 - DNA, 25 bp, Artificial sequence
  Synthetic oligonucleotide
aaacttttatcgtattcgaaaggca

SEQ ID NO: 707585 - DNA, 25 bp, Artificial sequence
  Synthetic oligonucleotide
aacaaagatgcgtgaataattatgc

SEQ ID NO: 707586 - DNA, 25 bp, Artificial sequence
  Synthetic oligonucleotide
aacaaagatgcgagaataattatgc

SEQ ID NO: 707587 - DNA, 25 bp, Artificial sequence
  Synthetic oligonucleotide
aaagtatatatcggacttacttacc

SEQ ID NO: 707588 - DNA, 25 bp, Artificial sequence
  Synthetic oligonucleotide
aaagtatatatccgacttacttacc

SEQ ID NO: 707589 - DNA, 25 bp, Artificial sequence
  Synthetic oligonucleotide
gtaagtacaatatccgtacatactt

SEQ ID NO: 707590 - DNA, 25 bp, Artificial sequence
  Synthetic oligonucleotide
gtaagtacaataaccgtacatactt

SEQ ID NO: 707591 - DNA, 25 bp, Artificial sequence
  Synthetic oligonucleotide
agactcgtaatagtaattgaagcta

SEQ ID NO: 707592 - DNA, 25 bp, Artificial sequence
  Synthetic oligonucleotide
agactcgtaatactaattgaagcta

SEQ ID NO: 707593 - DNA, 25 bp, Artificial sequence
  Synthetic oligonucleotide
gaagttcaactttttaatcgaatgc

SEQ ID NO: 707594 - DNA, 25 bp, Artificial sequence
  Synthetic oligonucleotide
aaacataagtaacaaacgtacctca

SEQ ID NO: 707595 - DNA, 25 bp, Artificial sequence
  Synthetic oligonucleotide
aatgttttcgctatctaagatatcc

SEQ ID NO: 707596 - DNA, 25 bp, Artificial sequence
  Synthetic oligonucleotide
atttgtatgatcccacataaaggtt

SEQ ID NO: 707597 - DNA, 25 bp, Artificial sequence
  Synthetic oligonucleotide
aatactcgctaatcctatatatctc

SEQ ID NO: 707598 - DNA, 25 bp, Artificial sequence
  Synthetic oligonucleotide
aatactcgctaaacctatatatctc

SEQ ID NO: 707599 - DNA, 25 bp, Artificial sequence
  Synthetic oligonucleotide
gattccgatcatttatgaaatccta

SEQ ID NO: 707600 - DNA, 25 bp, Artificial sequence
  Synthetic oligonucleotide
gattccgatcatatatgaaatccta

SEQ ID NO: 707601 - DNA, 25 bp, Artificial sequence
  Synthetic oligonucleotide
gtcatcttacgttaatcgtaaattg

SEQ ID NO: 707602 - DNA, 25 bp, Artificial sequence
  Synthetic oligonucleotide
gtcatcttacgtaaatcgtaaattg

SEQ ID NO: 707603 - DNA, 25 bp, Artificial sequence
  Synthetic oligonucleotide
gattaataatgatcgcactattcga

SEQ ID NO: 707604 - DNA, 25 bp, Artificial sequence
  Synthetic oligonucleotide
gattaataatgaacgcactattcga

SEQ ID NO: 707605 - DNA, 25 bp, Artificial sequence
  Synthetic oligonucleotide
ttagccgtatagaattgatattcga

SEQ ID NO: 707606 - DNA, 25 bp, Artificial sequence
  Synthetic oligonucleotide
aaacataagtaagaaacgtacctca

SEQ ID NO: 707607 - DNA, 25 bp, Artificial sequence
  Synthetic oligonucleotide
cgcacataatattacaatcgagtat

SEQ ID NO: 707608 - DNA, 25 bp, Artificial sequence
  Synthetic oligonucleotide
attcattaatcgttactagcgagtt

SEQ ID NO: 707609 - DNA, 25 bp, Artificial sequence
  Synthetic oligonucleotide
attcattaatcgatactagcgagtt

SEQ ID NO: 707610 - DNA, 25 bp, Artificial sequence
  Synthetic oligonucleotide
taatgcgataggttaaactttagga

SEQ ID NO: 707611 - DNA, 25 bp, Artificial sequence
  Synthetic oligonucleotide
taatgcgataggataaactttagga

SEQ ID NO: 707612 - DNA, 25 bp, Artificial sequence
  Synthetic oligonucleotide
agttgttgtacgtataacatatctc

SEQ ID NO: 707613 - DNA, 25 bp, Artificial sequence
  Synthetic oligonucleotide
agttgttgtacgaataacatatctc

SEQ ID NO: 707614 - DNA, 25 bp, Artificial sequence
  Synthetic oligonucleotide
acttaatgcgtcaagtattatcgta

SEQ ID NO: 707615 - DNA, 25 bp, Artificial sequence
  Synthetic oligonucleotide
acttaatgcgtctagtattatcgta

SEQ ID NO: 707616 - DNA, 25 bp, Artificial sequence
  Synthetic oligonucleotide
tcaaacgcatataagtataacgaag

SEQ ID NO: 707617 - DNA, 25 bp, Artificial sequence
  Synthetic oligonucleotide
tcaaacgcatattagtataacgaag

SEQ ID NO: 707618 - DNA, 25 bp, Artificial sequence
  Synthetic oligonucleotide
tcgtatcgtaattaattggagttga

SEQ ID NO: 707619 - DNA, 25 bp, Artificial sequence
  Synthetic oligonucleotide
ccaaccaatcgtattaattgatgat

SEQ ID NO: 707620 - DNA, 25 bp, Artificial sequence
  Synthetic oligonucleotide
acaatttcgacgatacatatctttg

SEQ ID NO: 707621 - DNA, 25 bp, Artificial sequence
  Synthetic oligonucleotide
cgcacataatataacaatcgagtat

SEQ ID NO: 707622 - DNA, 25 bp, Artificial sequence
  Synthetic oligonucleotide
tttagatccgagatgtttaagagtt

SEQ ID NO: 707623 - DNA, 25 bp, Artificial sequence
  Synthetic oligonucleotide
tttagatccgagttgtttaagagtt

SEQ ID NO: 707624 - DNA, 25 bp, Artificial sequence
  Synthetic oligonucleotide
ttgaagtttatttccgcaataaggt

SEQ ID NO: 707625 - DNA, 25 bp, Artificial sequence
  Synthetic oligonucleotide
ttgaagtttattaccgcaataaggt

SEQ ID NO: 707626 - DNA, 25 bp, Artificial sequence
  Synthetic oligonucleotide
ttgatcgattatatataacgccatg

SEQ ID NO: 707627 - DNA, 25 bp, Artificial sequence
  Synthetic oligonucleotide
ttgatcgattatttataacgccatg

SEQ ID NO: 707628 - DNA, 25 bp, Artificial sequence
  Synthetic oligonucleotide
ttatgataattcgctatcgataagg

SEQ ID NO: 707629 - DNA, 25 bp, Artificial sequence
  Synthetic oligonucleotide
ttatgataattccctatcgataagg

SEQ ID NO: 707630 - DNA, 25 bp, Artificial sequence
  Synthetic oligonucleotide
gtaagtaatccgtagtattaaatgc

SEQ ID NO: 707631 - DNA, 25 bp, Artificial sequence
  Synthetic oligonucleotide
ccaaccaatcgttttaattgatgat

SEQ ID NO: 707632 - DNA, 25 bp, Artificial sequence
  Synthetic oligonucleotide
atcagtcacgtaaaggataaatttc

SEQ ID NO: 707633 - DNA, 25 bp, Artificial sequence
  Synthetic oligonucleotide
gtaagtaatccgaagtattaaatgc

SEQ ID NO: 707634 - DNA, 25 bp, Artificial sequence
  Synthetic oligonucleotide
aatgttttcgctttctaagatatcc

SEQ ID NO: 707635 - DNA, 25 bp, Artificial sequence
  Synthetic oligonucleotide
ggaagataacgaattaatcctatgt

SEQ ID NO: 707636 - DNA, 25 bp, Artificial sequence
  Synthetic oligonucleotide
ggaagataacgatttaatcctatgt

SEQ ID NO: 707637 - DNA, 25 bp, Artificial sequence
  Synthetic oligonucleotide
tggtttacatcgatcattgagtaaa

SEQ ID NO: 707638 - DNA, 25 bp, Artificial sequence
  Synthetic oligonucleotide
tggtttacatcgttcattgagtaaa

SEQ ID NO: 707639 - DNA, 25 bp, Artificial sequence
  Synthetic oligonucleotide
aaaatcgaattattatttcgaccgc

SEQ ID NO: 707640 - DNA, 25 bp, Artificial sequence
  Synthetic oligonucleotide
aaaatcgaattaatatttcgaccgc

SEQ ID NO: 707641 - DNA, 25 bp, Artificial sequence
  Synthetic oligonucleotide
atatgttcttcgaagtttagcctta

SEQ ID NO: 707642 - DNA, 25 bp, Artificial sequence
  Synthetic oligonucleotide
atatgttcttcgtagtttagcctta

SEQ ID NO: 707643 - DNA, 25 bp, Artificial sequence
  Synthetic oligonucleotide
cttttatacatatgtattcgcagca

SEQ ID NO: 707644 - DNA, 25 bp, Artificial sequence
  Synthetic oligonucleotide
ttgcttacgattaattctatgtgga

SEQ ID NO: 707645 - DNA, 25 bp, Artificial sequence
  Synthetic oligonucleotide
cttttatacataagtattcgcagca

SEQ ID NO: 707646 - DNA, 25 bp, Artificial sequence
  Synthetic oligonucleotide
atcagtcacgtataggataaatttc

SEQ ID NO: 707647 - DNA, 25 bp, Artificial sequence
  Synthetic oligonucleotide
gtaattaaactctctatcgaacttg

SEQ ID NO: 707648 - DNA, 25 bp, Artificial sequence
  Synthetic oligonucleotide
gtaattaaactcactatcgaacttg

SEQ ID NO: 707649 - DNA, 25 bp, Artificial sequence
  Synthetic oligonucleotide
agtgttgtgcgaataattagtaagt

SEQ ID NO: 707650 - DNA, 25 bp, Artificial sequence
  Synthetic oligonucleotide
agtgttgtgcgattaattagtaagt

SEQ ID NO: 707651 - DNA, 25 bp, Artificial sequence
  Synthetic oligonucleotide
tcttccatattactccgatttgata

SEQ ID NO: 707652 - DNA, 25 bp, Artificial sequence
  Synthetic oligonucleotide
tcttccatattagtccgatttgata

SEQ ID NO: 707653 - DNA, 25 bp, Artificial sequence
  Synthetic oligonucleotide
aagaattgttataaacgtcgcactt

SEQ ID NO: 707654 - DNA, 25 bp, Artificial sequence
  Synthetic oligonucleotide
aagaattgttattaacgtcgcactt

SEQ ID NO: 707655 - DNA, 25 bp, Artificial sequence
  Synthetic oligonucleotide
acaatttcgacgttacatatctttg

SEQ ID NO: 707656 - DNA, 25 bp, Artificial sequence
  Synthetic oligonucleotide
tcgtatcgtaataaattggagttga

SEQ ID NO: 707657 - DNA, 25 bp, Artificial sequence
  Synthetic oligonucleotide
ttgcttacgatttattctatgtgga

SEQ ID NO: 707658 - DNA, 25 bp, Artificial sequence
  Synthetic oligonucleotide
caaaatactcgaggtattgctataa

SEQ ID NO: 707659 - DNA, 25 bp, Artificial sequence
  Synthetic oligonucleotide
cacaatacgcgctagtataatttta

SEQ ID NO: 707660 - DNA, 25 bp, Artificial sequence
  Synthetic oligonucleotide
tctaaaataattgggacgcattcat

SEQ ID NO: 707661 - DNA, 25 bp, Artificial sequence
  Synthetic oligonucleotide
tctaaaataattcggacgcattcat

SEQ ID NO: 707662 - DNA, 25 bp, Artificial sequence
  Synthetic oligonucleotide
ttacctataatacgggcgtttataa

SEQ ID NO: 707663 - DNA, 25 bp, Artificial sequence
  Synthetic oligonucleotide
ttacctataataggggcgtttataa

SEQ ID NO: 707664 - DNA, 25 bp, Artificial sequence
  Synthetic oligonucleotide
ttacacataacgacgtgacttaaat

SEQ ID NO: 707665 - DNA, 25 bp, Artificial sequence
  Synthetic oligonucleotide
ttacacataacgtcgtgacttaaat

SEQ ID NO: 707666 - DNA, 25 bp, Artificial sequence
  Synthetic oligonucleotide
ctaaatagttattcgcgactcatta

SEQ ID NO: 707667 - DNA, 25 bp, Artificial sequence
  Synthetic oligonucleotide
ctaaatagttatacgcgactcatta

SEQ ID NO: 707668 - DNA, 25 bp, Artificial sequence
  Synthetic oligonucleotide
atgtttaggttcccgtaatattttc

SEQ ID NO: 707669 - DNA, 25 bp, Artificial sequence
  Synthetic oligonucleotide
ttttttatactaacggacgcaatac

SEQ ID NO: 707670 - DNA, 25 bp, Artificial sequence
  Synthetic oligonucleotide
caaaatactcgacgtattgctataa

SEQ ID NO: 707671 - DNA, 25 bp, Artificial sequence
  Synthetic oligonucleotide
caacatatatagcacgcgaaaattt

SEQ ID NO: 707672 - DNA, 25 bp, Artificial sequence
  Synthetic oligonucleotide
tgaattacgtccctactatcattaa

SEQ ID NO: 707673 - DNA, 25 bp, Artificial sequence
  Synthetic oligonucleotide
tgaattacgtccgtactatcattaa

SEQ ID NO: 707674 - DNA, 25 bp, Artificial sequence
  Synthetic oligonucleotide
caaatgacgtatcgcgtaatattat

SEQ ID NO: 707675 - DNA, 25 bp, Artificial sequence
  Synthetic oligonucleotide
caaatgacgtatggcgtaatattat

SEQ ID NO: 707676 - DNA, 25 bp, Artificial sequence
  Synthetic oligonucleotide
taagtaacgtacgcgttattagaaa

SEQ ID NO: 707677 - DNA, 25 bp, Artificial sequence
  Synthetic oligonucleotide
taagtaacgtacccgttattagaaa

SEQ ID NO: 707678 - DNA, 25 bp, Artificial sequence
  Synthetic oligonucleotide
ctattaacgcgtcgttaatttaatc

SEQ ID NO: 707679 - DNA, 25 bp, Artificial sequence
  Synthetic oligonucleotide
ctattaacgcgtggttaatttaatc

SEQ ID NO: 707680 - DNA, 25 bp, Artificial sequence
  Synthetic oligonucleotide
tatatgacgcgttagtagtaatact

SEQ ID NO: 707681 - DNA, 25 bp, Artificial sequence
  Synthetic oligonucleotide
taacgacgcattattccgaataaat

SEQ ID NO: 707682 - DNA, 25 bp, Artificial sequence
  Synthetic oligonucleotide
atgtttaggttcgcgtaatattttc

SEQ ID NO: 707683 - DNA, 25 bp, Artificial sequence
  Synthetic oligonucleotide
gttattcgacgaatatgtccaataa

SEQ ID NO: 707684 - DNA, 25 bp, Artificial sequence
  Synthetic oligonucleotide
attacacgcatactatacgagtaat

SEQ ID NO: 707685 - DNA, 25 bp, Artificial sequence
  Synthetic oligonucleotide
attacacgcatagtatacgagtaat

SEQ ID NO: 707686 - DNA, 25 bp, Artificial sequence
  Synthetic oligonucleotide
attaaacgcaatacgtctaacatga

SEQ ID NO: 707687 - DNA, 25 bp, Artificial sequence
  Synthetic oligonucleotide
attaaacgcaattcgtctaacatga

SEQ ID NO: 707688 - DNA, 25 bp, Artificial sequence
  Synthetic oligonucleotide
acatgacgcaaatcgtactaaaaaa

SEQ ID NO: 707689 - DNA, 25 bp, Artificial sequence
  Synthetic oligonucleotide
acatgacgcaaaacgtactaaaaaa

SEQ ID NO: 707690 - DNA, 25 bp, Artificial sequence
  Synthetic oligonucleotide
atttaacgattgtacgtacaggata

SEQ ID NO: 707691 - DNA, 25 bp, Artificial sequence
  Synthetic oligonucleotide
atttaacgattgaacgtacaggata

SEQ ID NO: 707692 - DNA, 25 bp, Artificial sequence
  Synthetic oligonucleotide
ttctaacgatcaaacgtactaagaa

SEQ ID NO: 707693 - DNA, 25 bp, Artificial sequence
  Synthetic oligonucleotide
ttctaacgatcatacgtactaagaa

SEQ ID NO: 707694 - DNA, 25 bp, Artificial sequence
  Synthetic oligonucleotide
ttttttatactatcggacgcaatac

SEQ ID NO: 707695 - DNA, 25 bp, Artificial sequence
  Synthetic oligonucleotide
ctatttcgacggaatatcaatcaat

SEQ ID NO: 707696 - DNA, 25 bp, Artificial sequence
  Synthetic oligonucleotide
tttatttcgacttagttcgtcctat

SEQ ID NO: 707697 - DNA, 25 bp, Artificial sequence
  Synthetic oligonucleotide
gttattcgacgattatgtccaataa

SEQ ID NO: 707698 - DNA, 25 bp, Artificial sequence
  Synthetic oligonucleotide
aataagcacgacggattataacata

SEQ ID NO: 707699 - DNA, 25 bp, Artificial sequence
  Synthetic oligonucleotide
aataagcacgaccgattataacata

SEQ ID NO: 707700 - DNA, 25 bp, Artificial sequence
  Synthetic oligonucleotide
gtaattattacttgcgacgctttaa

SEQ ID NO: 707701 - DNA, 25 bp, Artificial sequence
  Synthetic oligonucleotide
gtaattattactagcgacgctttaa

SEQ ID NO: 707702 - DNA, 25 bp, Artificial sequence
  Synthetic oligonucleotide
atacaaatgattcgcgctaaaacaa

SEQ ID NO: 707703 - DNA, 25 bp, Artificial sequence
  Synthetic oligonucleotide
atacaaatgattggcgctaaaacaa

SEQ ID NO: 707704 - DNA, 25 bp, Artificial sequence
  Synthetic oligonucleotide
aaaaatatatagtgacgcgggaaaa

SEQ ID NO: 707705 - DNA, 25 bp, Artificial sequence
  Synthetic oligonucleotide
aaaaatatatagagacgcgggaaaa

SEQ ID NO: 707706 - DNA, 25 bp, Artificial sequence
  Synthetic oligonucleotide
caacatatataggacgcgaaaattt

SEQ ID NO: 707707 - DNA, 25 bp, Artificial sequence
  Synthetic oligonucleotide
ctatttcgacggtatatcaatcaat

SEQ ID NO: 707708 - DNA, 25 bp, Artificial sequence
  Synthetic oligonucleotide
cgaacacgactccttatataatttt

SEQ ID NO: 707709 - DNA, 25 bp, Artificial sequence
  Synthetic oligonucleotide
ctttacaacgcgatatagatatctt

SEQ ID NO: 707710 - DNA, 25 bp, Artificial sequence
  Synthetic oligonucleotide
agtatctaagttcgcgatattatca

SEQ ID NO: 707711 - DNA, 25 bp, Artificial sequence
  Synthetic oligonucleotide
agtatctaagttggcgatattatca

SEQ ID NO: 707712 - DNA, 25 bp, Artificial sequence
  Synthetic oligonucleotide
tagaatgtacgaaatcgtatttcct

SEQ ID NO: 707713 - DNA, 25 bp, Artificial sequence
  Synthetic oligonucleotide
tagaatgtacgatatcgtatttcct

SEQ ID NO: 707714 - DNA, 25 bp, Artificial sequence
  Synthetic oligonucleotide
tttttactataattcgcgatagctc

SEQ ID NO: 707715 - DNA, 25 bp, Artificial sequence
  Synthetic oligonucleotide
tttttactataaatcgcgatagctc

SEQ ID NO: 707716 - DNA, 25 bp, Artificial sequence
  Synthetic oligonucleotide
aagaatcgcgattttagtactaaac

SEQ ID NO: 707717 - DNA, 25 bp, Artificial sequence
  Synthetic oligonucleotide
aagaatcgcgatattagtactaaac

SEQ ID NO: 707718 - DNA, 25 bp, Artificial sequence
  Synthetic oligonucleotide
tcctaacgcgattactatttaatca

SEQ ID NO: 707719 - DNA, 25 bp, Artificial sequence
  Synthetic oligonucleotide
aattgatagacgaaatacgctgaaa

SEQ ID NO: 707720 - DNA, 25 bp, Artificial sequence
  Synthetic oligonucleotide
cgaacacgactcgttatataatttt

SEQ ID NO: 707721 - DNA, 25 bp, Artificial sequence
  Synthetic oligonucleotide
tgactatagtacgcgtaattttaca

SEQ ID NO: 707722 - DNA, 25 bp, Artificial sequence
  Synthetic oligonucleotide
acttgaccgaatcgttaattaaatg

SEQ ID NO: 707723 - DNA, 25 bp, Artificial sequence
  Synthetic oligonucleotide
acttgaccgaatggttaattaaatg

SEQ ID NO: 707724 - DNA, 25 bp, Artificial sequence
  Synthetic oligonucleotide
cattaaatgtatggacgtaccttaa

SEQ ID NO: 707725 - DNA, 25 bp, Artificial sequence
  Synthetic oligonucleotide
cattaaatgtatcgacgtaccttaa

SEQ ID NO: 707726 - DNA, 25 bp, Artificial sequence
  Synthetic oligonucleotide
ttgaatatacgagggattagtagtt

SEQ ID NO: 707727 - DNA, 25 bp, Artificial sequence
  Synthetic oligonucleotide
ttgaatatacgacggattagtagtt

SEQ ID NO: 707728 - DNA, 25 bp, Artificial sequence
  Synthetic oligonucleotide
tgttgtaagttatcgcgtatatcaa

SEQ ID NO: 707729 - DNA, 25 bp, Artificial sequence
  Synthetic oligonucleotide
tgttgtaagttaacgcgtatatcaa

SEQ ID NO: 707730 - DNA, 25 bp, Artificial sequence
  Synthetic oligonucleotide
ctttacaacgcgttatagatatctt

SEQ ID NO: 707731 - DNA, 25 bp, Artificial sequence
  Synthetic oligonucleotide
tgttaatcgcgattagttcctaata

SEQ ID NO: 707732 - DNA, 25 bp, Artificial sequence
  Synthetic oligonucleotide
tcctaacgcgataactatttaatca

SEQ ID NO: 707733 - DNA, 25 bp, Artificial sequence
  Synthetic oligonucleotide
attatattaacgcgtactaggcata

SEQ ID NO: 707734 - DNA, 25 bp, Artificial sequence
  Synthetic oligonucleotide
agtaaaacgcgactagtatcattta

SEQ ID NO: 707735 - DNA, 25 bp, Artificial sequence
  Synthetic oligonucleotide
agtaaaacgcgagtagtatcattta

SEQ ID NO: 707736 - DNA, 25 bp, Artificial sequence
  Synthetic oligonucleotide
gatatcacaacgtcgatacatttaa

SEQ ID NO: 707737 - DNA, 25 bp, Artificial sequence
  Synthetic oligonucleotide
gatatcacaacgacgatacatttaa

SEQ ID NO: 707738 - DNA, 25 bp, Artificial sequence
  Synthetic oligonucleotide
aacacaaatccgtatacgcaattat

SEQ ID NO: 707739 - DNA, 25 bp, Artificial sequence
  Synthetic oligonucleotide
aacacaaatccgaatacgcaattat

SEQ ID NO: 707740 - DNA, 25 bp, Artificial sequence
  Synthetic oligonucleotide
attacaaactccccgtataattaag

SEQ ID NO: 707741 - DNA, 25 bp, Artificial sequence
  Synthetic oligonucleotide
attacaaactccgcgtataattaag

SEQ ID NO: 707742 - DNA, 25 bp, Artificial sequence
  Synthetic oligonucleotide
ttttaaaacgtctcgatacaagagt

SEQ ID NO: 707743 - DNA, 25 bp, Artificial sequence
  Synthetic oligonucleotide
ttttaaaacgtcacgatacaagagt

SEQ ID NO: 707744 - DNA, 25 bp, Artificial sequence
  Synthetic oligonucleotide
aattgatagacgtaatacgctgaaa

SEQ ID NO: 707745 - DNA, 25 bp, Artificial sequence
  Synthetic oligonucleotide
ttaagaaacctaacgttcgataaca

SEQ ID NO: 707746 - DNA, 25 bp, Artificial sequence
  Synthetic oligonucleotide
tatatgacgcgtaagtagtaatact

SEQ ID NO: 707747 - DNA, 25 bp, Artificial sequence
  Synthetic oligonucleotide
attatattaacgggtactaggcata

SEQ ID NO: 707748 - DNA, 25 bp, Artificial sequence
  Synthetic oligonucleotide
aattaatcgcgttaatacaccctaa

SEQ ID NO: 707749 - DNA, 25 bp, Artificial sequence
  Synthetic oligonucleotide
aattaatcgcgtaaatacaccctaa

SEQ ID NO: 707750 - DNA, 25 bp, Artificial sequence
  Synthetic oligonucleotide
aggaattcgcgtttgattattgata

SEQ ID NO: 707751 - DNA, 25 bp, Artificial sequence
  Synthetic oligonucleotide
aggaattcgcgtatgattattgata

SEQ ID NO: 707752 - DNA, 25 bp, Artificial sequence
  Synthetic oligonucleotide
attagctattaccatcggaatttca

SEQ ID NO: 707753 - DNA, 25 bp, Artificial sequence
  Synthetic oligonucleotide
attagctattacgatcggaatttca

SEQ ID NO: 707754 - DNA, 25 bp, Artificial sequence
  Synthetic oligonucleotide
atagtatatacgattaccgtatgtc

SEQ ID NO: 707755 - DNA, 25 bp, Artificial sequence
  Synthetic oligonucleotide
atagtatatacgtttaccgtatgtc

SEQ ID NO: 707756 - DNA, 25 bp, Artificial sequence
  Synthetic oligonucleotide
tgactatagtacccgtaattttaca

SEQ ID NO: 707757 - DNA, 25 bp, Artificial sequence
  Synthetic oligonucleotide
ttaagaaacctatcgttcgataaca

SEQ ID NO: 707758 - DNA, 25 bp, Artificial sequence
  Synthetic oligonucleotide
ataatatacgaccgtatactcttgt

SEQ ID NO: 707759 - DNA, 25 bp, Artificial sequence
  Synthetic oligonucleotide
gaaaaataacgcctataggatacta

SEQ ID NO: 707760 - DNA, 25 bp, Artificial sequence
  Synthetic oligonucleotide
tgattatacgtaaagtcggtcaaat

SEQ ID NO: 707761 - DNA, 25 bp, Artificial sequence
  Synthetic oligonucleotide
tataactacgtaactccgatattca

SEQ ID NO: 707762 - DNA, 25 bp, Artificial sequence
  Synthetic oligonucleotide
tataactacgtatctccgatattca

SEQ ID NO: 707763 - DNA, 25 bp, Artificial sequence
  Synthetic oligonucleotide
tatagttacggtaagtcgtaagaat

SEQ ID NO: 707764 - DNA, 25 bp, Artificial sequence
  Synthetic oligonucleotide
tatagttacggttagtcgtaagaat

SEQ ID NO: 707765 - DNA, 25 bp, Artificial sequence
  Synthetic oligonucleotide
catacatacgcggtagtataatata

SEQ ID NO: 707766 - DNA, 25 bp, Artificial sequence
  Synthetic oligonucleotide
catacatacgcgctagtataatata

SEQ ID NO: 707767 - DNA, 25 bp, Artificial sequence
  Synthetic oligonucleotide
atatcatacgatttgacgcaagtta

SEQ ID NO: 707768 - DNA, 25 bp, Artificial sequence
  Synthetic oligonucleotide
atatcatacgatatgacgcaagtta

SEQ ID NO: 707769 - DNA, 25 bp, Artificial sequence
  Synthetic oligonucleotide
tggttatacgttcgtcctatattat

SEQ ID NO: 707770 - DNA, 25 bp, Artificial sequence
  Synthetic oligonucleotide
tagagttacgagtcgactataaaaa

SEQ ID NO: 707771 - DNA, 25 bp, Artificial sequence
  Synthetic oligonucleotide
tggttatacgttggtcctatattat

SEQ ID NO: 707772 - DNA, 25 bp, Artificial sequence
  Synthetic oligonucleotide
ataatatacgacggtatactcttgt

SEQ ID NO: 707773 - DNA, 25 bp, Artificial sequence
  Synthetic oligonucleotide
ttacgataccttatacgcgattaaa

SEQ ID NO: 707774 - DNA, 25 bp, Artificial sequence
  Synthetic oligonucleotide
ttacgataccttttacgcgattaaa

SEQ ID NO: 707775 - DNA, 25 bp, Artificial sequence
  Synthetic oligonucleotide
tattaataccggatcgtaattctgt

SEQ ID NO: 707776 - DNA, 25 bp, Artificial sequence
  Synthetic oligonucleotide
tattaataccggttcgtaattctgt

SEQ ID NO: 707777 - DNA, 25 bp, Artificial sequence
  Synthetic oligonucleotide
tattattaatacgacgcgaaggttt

SEQ ID NO: 707778 - DNA, 25 bp, Artificial sequence
  Synthetic oligonucleotide
tattattaataccacgcgaaggttt

SEQ ID NO: 707779 - DNA, 25 bp, Artificial sequence
  Synthetic oligonucleotide
cctatataagttacgtcgcaaattt

SEQ ID NO: 707780 - DNA, 25 bp, Artificial sequence
  Synthetic oligonucleotide
cctatataagtttcgtcgcaaattt

SEQ ID NO: 707781 - DNA, 25 bp, Artificial sequence
  Synthetic oligonucleotide
gaaaaataacgcgtataggatacta

SEQ ID NO: 707782 - DNA, 25 bp, Artificial sequence
  Synthetic oligonucleotide
tagagttacgagacgactataaaaa

SEQ ID NO: 707783 - DNA, 25 bp, Artificial sequence
  Synthetic oligonucleotide
attacatataatccgcgctctaaaa

SEQ ID NO: 707784 - DNA, 25 bp, Artificial sequence
  Synthetic oligonucleotide
tttatttcgactaagttcgtcctat

SEQ ID NO: 707785 - DNA, 25 bp, Artificial sequence
  Synthetic oligonucleotide
cacaatacgcgcaagtataatttta

SEQ ID NO: 707786 - DNA, 25 bp, Artificial sequence
  Synthetic oligonucleotide
taacgacgcatttttccgaataaat

SEQ ID NO: 707787 - DNA, 25 bp, Artificial sequence
  Synthetic oligonucleotide
tatatgtattgccaacgtcgaataa

SEQ ID NO: 707788 - DNA, 25 bp, Artificial sequence
  Synthetic oligonucleotide
tatatgtattgcgaacgtcgaataa

SEQ ID NO: 707789 - DNA, 25 bp, Artificial sequence
  Synthetic oligonucleotide
tatgtatatgtcccgtagaaatgta

SEQ ID NO: 707790 - DNA, 25 bp, Artificial sequence
  Synthetic oligonucleotide
tatgtatatgtcgcgtagaaatgta

SEQ ID NO: 707791 - DNA, 25 bp, Artificial sequence
  Synthetic oligonucleotide
actttgtatcgcatcgtcataatta

SEQ ID NO: 707792 - DNA, 25 bp, Artificial sequence
  Synthetic oligonucleotide
actttgtatcgcttcgtcataatta

SEQ ID NO: 707793 - DNA, 25 bp, Artificial sequence
  Synthetic oligonucleotide
gatatatataccttacgcgataaag

SEQ ID NO: 707794 - DNA, 25 bp, Artificial sequence
  Synthetic oligonucleotide
tttcaatacgtccctagattttgat

SEQ ID NO: 707795 - DNA, 25 bp, Artificial sequence
  Synthetic oligonucleotide
attacatataatgcgcgctctaaaa

SEQ ID NO: 707796 - DNA, 25 bp, Artificial sequence
  Synthetic oligonucleotide
tgattatacgtatagtcggtcaaat

SEQ ID NO: 707797 - DNA, 25 bp, Artificial sequence
  Synthetic oligonucleotide
gataagtataaccttccgctataaa

SEQ ID NO: 707798 - DNA, 25 bp, Artificial sequence
  Synthetic oligonucleotide
gataagtataacgttccgctataaa

SEQ ID NO: 707799 - DNA, 25 bp, Artificial sequence
  Synthetic oligonucleotide
gaatagtagtcgtcaatcgaaattt

SEQ ID NO: 707800 - DNA, 25 bp, Artificial sequence
  Synthetic oligonucleotide
gaatagtagtcgacaatcgaaattt

SEQ ID NO: 707801 - DNA, 25 bp, Artificial sequence
  Synthetic oligonucleotide
gtatgttagcttaacgtcgtaattt

SEQ ID NO: 707802 - DNA, 25 bp, Artificial sequence
  Synthetic oligonucleotide
gtatgttagctttacgtcgtaattt

SEQ ID NO: 707803 - DNA, 25 bp, Artificial sequence
  Synthetic oligonucleotide
ttcatatactattcgccgaagttat

SEQ ID NO: 707804 - DNA, 25 bp, Artificial sequence
  Synthetic oligonucleotide
ttcatatactatacgccgaagttat

SEQ ID NO: 707805 - DNA, 25 bp, Artificial sequence
  Synthetic oligonucleotide
tttaaatactagtcgacgtacatac

SEQ ID NO: 707806 - DNA, 25 bp, Artificial sequence
  Synthetic oligonucleotide
tttaaatactagacgacgtacatac

SEQ ID NO: 707807 - DNA, 25 bp, Artificial sequence
  Synthetic oligonucleotide
gatatatataccatacgcgataaag

SEQ ID NO: 707808 - DNA, 25 bp, Artificial sequence
  Synthetic oligonucleotide
tttcaacgtaacgcgattaaatttc

SEQ ID NO: 707809 - DNA, 25 bp, Artificial sequence
  Synthetic oligonucleotide
ttttagctaccgcgatatatttttg

SEQ ID NO: 707810 - DNA, 25 bp, Artificial sequence
  Synthetic oligonucleotide
ttttagctaccgggatatatttttg

SEQ ID NO: 707811 - DNA, 25 bp, Artificial sequence
  Synthetic oligonucleotide
aaaagactaatcgtacgactatgtt

SEQ ID NO: 707812 - DNA, 25 bp, Artificial sequence
  Synthetic oligonucleotide
aaaagactaatcctacgactatgtt

SEQ ID NO: 707813 - DNA, 25 bp, Artificial sequence
  Synthetic oligonucleotide
tgtgatctaacgcgtgataaattat

SEQ ID NO: 707814 - DNA, 25 bp, Artificial sequence
  Synthetic oligonucleotide
tgtgatctaacgggtgataaattat

SEQ ID NO: 707815 - DNA, 25 bp, Artificial sequence
  Synthetic oligonucleotide
cataaacgtctattcgtacttgttt

SEQ ID NO: 707816 - DNA, 25 bp, Artificial sequence
  Synthetic oligonucleotide
cataaacgtctaatcgtacttgttt

SEQ ID NO: 707817 - DNA, 25 bp, Artificial sequence
  Synthetic oligonucleotide
ttaaatcgtacgcgataaatattgc

SEQ ID NO: 707818 - DNA, 25 bp, Artificial sequence
  Synthetic oligonucleotide
ttaaatcgtacgggataaatattgc

SEQ ID NO: 707819 - DNA, 25 bp, Artificial sequence
  Synthetic oligonucleotide
aagatacgtaatttacgcgatgata

SEQ ID NO: 707820 - DNA, 25 bp, Artificial sequence
  Synthetic oligonucleotide
atactactagtacgtatcggtaaaa

SEQ ID NO: 707821 - DNA, 25 bp, Artificial sequence
  Synthetic oligonucleotide
tttcaacgtaacccgattaaatttc

SEQ ID NO: 707822 - DNA, 25 bp, Artificial sequence
  Synthetic oligonucleotide
aatgagcggtcttatcgtataatat

SEQ ID NO: 707823 - DNA, 25 bp, Artificial sequence
  Synthetic oligonucleotide
tatatacggttgtaatacgtgctaa

SEQ ID NO: 707824 - DNA, 25 bp, Artificial sequence
  Synthetic oligonucleotide
tatatacggttgaaatacgtgctaa

SEQ ID NO: 707825 - DNA, 25 bp, Artificial sequence
  Synthetic oligonucleotide
tcttcacggtgaaattcgatataat

SEQ ID NO: 707826 - DNA, 25 bp, Artificial sequence
  Synthetic oligonucleotide
tcttcacggtgatattcgatataat

SEQ ID NO: 707827 - DNA, 25 bp, Artificial sequence
  Synthetic oligonucleotide
attatgcggtctttacgtaataaca

SEQ ID NO: 707828 - DNA, 25 bp, Artificial sequence
  Synthetic oligonucleotide
attatgcggtctatacgtaataaca

SEQ ID NO: 707829 - DNA, 25 bp, Artificial sequence
  Synthetic oligonucleotide
aatgagcggtctaatcgtataatat

SEQ ID NO: 707830 - DNA, 25 bp, Artificial sequence
  Synthetic oligonucleotide
tatgtttaacgccgtattgcaaaaa

SEQ ID NO: 707831 - DNA, 25 bp, Artificial sequence
  Synthetic oligonucleotide
acttcacgcgaaaagtagataaata

SEQ ID NO: 707832 - DNA, 25 bp, Artificial sequence
  Synthetic oligonucleotide
tttcaatacgtcgctagattttgat

SEQ ID NO: 707833 - DNA, 25 bp, Artificial sequence
  Synthetic oligonucleotide
acttcacgcgaatagtagataaata

SEQ ID NO: 707834 - DNA, 25 bp, Artificial sequence
  Synthetic oligonucleotide
aagatacgtaatatacgcgatgata

SEQ ID NO: 707835 - DNA, 25 bp, Artificial sequence
  Synthetic oligonucleotide
agaaatgtttaaccgtcgatttaga

SEQ ID NO: 707836 - DNA, 25 bp, Artificial sequence
  Synthetic oligonucleotide
agaaatgtttaagcgtcgatttaga

SEQ ID NO: 707837 - DNA, 25 bp, Artificial sequence
  Synthetic oligonucleotide
aagatagtacgtaatacggttcatt

SEQ ID NO: 707838 - DNA, 25 bp, Artificial sequence
  Synthetic oligonucleotide
aagatagtacgttatacggttcatt

SEQ ID NO: 707839 - DNA, 25 bp, Artificial sequence
  Synthetic oligonucleotide
tagatagtacggtttacgaaaaaca

SEQ ID NO: 707840 - DNA, 25 bp, Artificial sequence
  Synthetic oligonucleotide
tagatagtacggattacgaaaaaca

SEQ ID NO: 707841 - DNA, 25 bp, Artificial sequence
  Synthetic oligonucleotide
taaaatggtcgaggaattagtgtat

SEQ ID NO: 707842 - DNA, 25 bp, Artificial sequence
  Synthetic oligonucleotide
taaaatggtcgacgaattagtgtat

SEQ ID NO: 707843 - DNA, 25 bp, Artificial sequence
  Synthetic oligonucleotide
tttccagcgcgaatctatattatat

SEQ ID NO: 707844 - DNA, 25 bp, Artificial sequence
  Synthetic oligonucleotide
tttccagcgcgattctatattatat

SEQ ID NO: 707845 - DNA, 25 bp, Artificial sequence
  Synthetic oligonucleotide
taaagagcgataaacgtctatatga

SEQ ID NO: 707846 - DNA, 25 bp, Artificial sequence
  Synthetic oligonucleotide
taaagagcgatatacgtctatatga

SEQ ID NO: 707847 - DNA, 25 bp, Artificial sequence
  Synthetic oligonucleotide
tatttagaacgaccgtataagctaa

SEQ ID NO: 707848 - DNA, 25 bp, Artificial sequence
  Synthetic oligonucleotide
tatgtttaacgcggtattgcaaaaa

SEQ ID NO: 707849 - DNA, 25 bp, Artificial sequence
  Synthetic oligonucleotide
taaatagacgtagcgattataatgc

SEQ ID NO: 707850 - DNA, 25 bp, Artificial sequence
  Synthetic oligonucleotide
tatacactatcatatcgcggataaa

SEQ ID NO: 707851 - DNA, 25 bp, Artificial sequence
  Synthetic oligonucleotide
atactactagtaggtatcggtaaaa

SEQ ID NO: 707852 - DNA, 25 bp, Artificial sequence
  Synthetic oligonucleotide
tatttagaacgagcgtataagctaa

SEQ ID NO: 707853 - DNA, 25 bp, Artificial sequence
  Synthetic oligonucleotide
taaaaagacgataattcgctagtac

SEQ ID NO: 707854 - DNA, 25 bp, Artificial sequence
  Synthetic oligonucleotide
taaaaagacgattattcgctagtac

SEQ ID NO: 707855 - DNA, 25 bp, Artificial sequence
  Synthetic oligonucleotide
cataatgacgcgatctataattaac

SEQ ID NO: 707856 - DNA, 25 bp, Artificial sequence
  Synthetic oligonucleotide
cataatgacgcgttctataattaac

SEQ ID NO: 707857 - DNA, 25 bp, Artificial sequence
  Synthetic oligonucleotide
taaatagacgtaccgattataatgc

SEQ ID NO: 707858 - DNA, 25 bp, Artificial sequence
  Synthetic oligonucleotide
tatacactatcaaatcgcggataaa

SEQ ID NO: 707859 - DNA, 25 bp, Artificial sequence
  Synthetic oligonucleotide
gaatatcgcgagaaactaagtacat

SEQ ID NO: 707860 - DNA, 25 bp, Artificial sequence
  Synthetic oligonucleotide
gaatatcgcgagtaactaagtacat

SEQ ID NO: 707861 - DNA, 25 bp, Artificial sequence
  Synthetic oligonucleotide
acttttcgcgattacctattttctg

SEQ ID NO: 707862 - DNA, 25 bp, Artificial sequence
  Synthetic oligonucleotide
acttttcgcgataacctattttctg

SEQ ID NO: 707863 - DNA, 25 bp, Artificial sequence
  Synthetic oligonucleotide
tccttacgcgattctgtatttttgt

SEQ ID NO: 707864 - DNA, 25 bp, Artificial sequence
  Synthetic oligonucleotide
tccttacgcgatactgtatttttgt

SEQ ID NO: 707865 - DNA, 25 bp, Artificial sequence
  Synthetic oligonucleotide
aagctacgcgatagatctagattat

SEQ ID NO: 707866 - DNA, 25 bp, Artificial sequence
  Synthetic oligonucleotide
gtctatcgcgagatagtatgttata

SEQ ID NO: 707867 - DNA, 25 bp, Artificial sequence
  Synthetic oligonucleotide
ataaatcgcgcaatagtattaggga

SEQ ID NO: 707868 - DNA, 25 bp, Artificial sequence
  Synthetic oligonucleotide
aagtaacgcgaactcttatcaagaa

SEQ ID NO: 707869 - DNA, 25 bp, Artificial sequence
  Synthetic oligonucleotide
ataaatcgcgcattagtattaggga

SEQ ID NO: 707870 - DNA, 25 bp, Artificial sequence
  Synthetic oligonucleotide
aagctacgcgattgatctagattat

SEQ ID NO: 707871 - DNA, 25 bp, Artificial sequence
  Synthetic oligonucleotide
gtctatcgcgagttagtatgttata

SEQ ID NO: 707872 - DNA, 25 bp, Artificial sequence
  Synthetic oligonucleotide
tactatcgcgacttattacataggt

SEQ ID NO: 707873 - DNA, 25 bp, Artificial sequence
  Synthetic oligonucleotide
tactatcgcgacatattacataggt

SEQ ID NO: 707874 - DNA, 25 bp, Artificial sequence
  Synthetic oligonucleotide
aaaatacgcgacaaataagataggg

SEQ ID NO: 707875 - DNA, 25 bp, Artificial sequence
  Synthetic oligonucleotide
aagtaacgcgaagtcttatcaagaa

SEQ ID NO: 707876 - DNA, 25 bp, Artificial sequence
  Synthetic oligonucleotide
aacactcgccgtatagattatgttt

SEQ ID NO: 707877 - DNA, 25 bp, Artificial sequence
  Synthetic oligonucleotide
aacactcgccgtttagattatgttt

SEQ ID NO: 707878 - DNA, 25 bp, Artificial sequence
  Synthetic oligonucleotide
ttttcacgccgacaatataaatacc

SEQ ID NO: 707879 - DNA, 25 bp, Artificial sequence
  Synthetic oligonucleotide
taaggtcgcgcattcaatatactta

SEQ ID NO: 707880 - DNA, 25 bp, Artificial sequence
  Synthetic oligonucleotide
taaaaacgctacgatctaatggatg

SEQ ID NO: 707881 - DNA, 25 bp, Artificial sequence
  Synthetic oligonucleotide
ttttcacgccgagaatataaatacc

SEQ ID NO: 707882 - DNA, 25 bp, Artificial sequence
  Synthetic oligonucleotide
aaaatacgcgactaataagataggg

SEQ ID NO: 707883 - DNA, 25 bp, Artificial sequence
  Synthetic oligonucleotide
ttcaaccgtaacctcgatagttatt

SEQ ID NO: 707884 - DNA, 25 bp, Artificial sequence
  Synthetic oligonucleotide
ttttttattaatggtcgcgaccgat

SEQ ID NO: 707885 - DNA, 25 bp, Artificial sequence
  Synthetic oligonucleotide
atatatcggtattaatccgcttgac

SEQ ID NO: 707886 - DNA, 25 bp, Artificial sequence
  Synthetic oligonucleotide
atatatcggtataaatccgcttgac

SEQ ID NO: 707887 - DNA, 25 bp, Artificial sequence
  Synthetic oligonucleotide
caaagccggtagtatacgatttatt

SEQ ID NO: 707888 - DNA, 25 bp, Artificial sequence
  Synthetic oligonucleotide
caaagccggtagaatacgatttatt

SEQ ID NO: 707889 - DNA, 25 bp, Artificial sequence
  Synthetic oligonucleotide
attatccggcgttttacatttggtt

SEQ ID NO: 707890 - DNA, 25 bp, Artificial sequence
  Synthetic oligonucleotide
attatccggcgtattacatttggtt

SEQ ID NO: 707891 - DNA, 25 bp, Artificial sequence
  Synthetic oligonucleotide
ttgaatcgcttaaacgtacgtacat

SEQ ID NO: 707892 - DNA, 25 bp, Artificial sequence
  Synthetic oligonucleotide
ttgaatcgcttatacgtacgtacat

SEQ ID NO: 707893 - DNA, 25 bp, Artificial sequence
  Synthetic oligonucleotide
taaaaacgctaccatctaatggatg

SEQ ID NO: 707894 - DNA, 25 bp, Artificial sequence
  Synthetic oligonucleotide
agagatcgcgtttacgattctattt

SEQ ID NO: 707895 - DNA, 25 bp, Artificial sequence
  Synthetic oligonucleotide
agagatcgcgttaacgattctattt

SEQ ID NO: 707896 - DNA, 25 bp, Artificial sequence
  Synthetic oligonucleotide
taaggtcgcgcaatcaatatactta

SEQ ID NO: 707897 - DNA, 25 bp, Artificial sequence
  Synthetic oligonucleotide
agtgaacgcgttttaccatttattg

SEQ ID NO: 707898 - DNA, 25 bp, Artificial sequence
  Synthetic oligonucleotide
agtgaacgcgttataccatttattg

SEQ ID NO: 707899 - DNA, 25 bp, Artificial sequence
  Synthetic oligonucleotide
aactttcgcgtctattagtaggata

SEQ ID NO: 707900 - DNA, 25 bp, Artificial sequence
  Synthetic oligonucleotide
aactttcgcgtcaattagtaggata

SEQ ID NO: 707901 - DNA, 25 bp, Artificial sequence
  Synthetic oligonucleotide
gatatccgcgtactaagttagaata

SEQ ID NO: 707902 - DNA, 25 bp, Artificial sequence
  Synthetic oligonucleotide
gatatccgcgtagtaagttagaata

SEQ ID NO: 707903 - DNA, 25 bp, Artificial sequence
  Synthetic oligonucleotide
taattccgcgtaacatacttagtct

SEQ ID NO: 707904 - DNA, 25 bp, Artificial sequence
  Synthetic oligonucleotide
taattccgcgtatcatacttagtct

SEQ ID NO: 707905 - DNA, 25 bp, Artificial sequence
  Synthetic oligonucleotide
aaacagcgcgcttgtataaaacaaa

SEQ ID NO: 707906 - DNA, 25 bp, Artificial sequence
  Synthetic oligonucleotide
aaacagcgcgctagtataaaacaaa

SEQ ID NO: 707907 - DNA, 25 bp, Artificial sequence
  Synthetic oligonucleotide
tgtattcgccgatacattaaaccat

SEQ ID NO: 707908 - DNA, 25 bp, Artificial sequence
  Synthetic oligonucleotide
tggaagcagtcgttatcgtatttaa

SEQ ID NO: 707909 - DNA, 25 bp, Artificial sequence
  Synthetic oligonucleotide
atatctattcgatcgcgtaatggaa

SEQ ID NO: 707910 - DNA, 25 bp, Artificial sequence
  Synthetic oligonucleotide
tgatttccgcgattatctaatcaag

SEQ ID NO: 707911 - DNA, 25 bp, Artificial sequence
  Synthetic oligonucleotide
tgatttccgcgaatatctaatcaag

SEQ ID NO: 707912 - DNA, 25 bp, Artificial sequence
  Synthetic oligonucleotide
atacgaccgaaccattagtttctta

SEQ ID NO: 707913 - DNA, 25 bp, Artificial sequence
  Synthetic oligonucleotide
atacgaccgaacgattagtttctta

SEQ ID NO: 707914 - DNA, 25 bp, Artificial sequence
  Synthetic oligonucleotide
attatgcatcgtatacggtatatcc

SEQ ID NO: 707915 - DNA, 25 bp, Artificial sequence
  Synthetic oligonucleotide
attatgcatcgtttacggtatatcc

SEQ ID NO: 707916 - DNA, 25 bp, Artificial sequence
  Synthetic oligonucleotide
tcagttcatacttatcgcgatgata

SEQ ID NO: 707917 - DNA, 25 bp, Artificial sequence
  Synthetic oligonucleotide
tcagttcatactaatcgcgatgata

SEQ ID NO: 707918 - DNA, 25 bp, Artificial sequence
  Synthetic oligonucleotide
tagtaacataagcgacgatacattc

SEQ ID NO: 707919 - DNA, 25 bp, Artificial sequence
  Synthetic oligonucleotide
aagtagccgctaaaacgataattac

SEQ ID NO: 707920 - DNA, 25 bp, Artificial sequence
  Synthetic oligonucleotide
tggaagcagtcgatatcgtatttaa

SEQ ID NO: 707921 - DNA, 25 bp, Artificial sequence
  Synthetic oligonucleotide
tgaagaccgttaggtatagactaaa

SEQ ID NO: 707922 - DNA, 25 bp, Artificial sequence
  Synthetic oligonucleotide
agaatacagcgttatacgatctgat

SEQ ID NO: 707923 - DNA, 25 bp, Artificial sequence
  Synthetic oligonucleotide
agaatacagcgtaatacgatctgat

SEQ ID NO: 707924 - DNA, 25 bp, Artificial sequence
  Synthetic oligonucleotide
ttttaccaattactacgcggatgaa

SEQ ID NO: 707925 - DNA, 25 bp, Artificial sequence
  Synthetic oligonucleotide
ttttaccaattagtacgcggatgaa

SEQ ID NO: 707926 - DNA, 25 bp, Artificial sequence
  Synthetic oligonucleotide
aatcttcaatgaggcgtatatgcat

SEQ ID NO: 707927 - DNA, 25 bp, Artificial sequence
  Synthetic oligonucleotide
aatcttcaatgacgcgtatatgcat

SEQ ID NO: 707928 - DNA, 25 bp, Artificial sequence
  Synthetic oligonucleotide
tagaaaattgtccgatcgttctatg

SEQ ID NO: 707929 - DNA, 25 bp, Artificial sequence
  Synthetic oligonucleotide
tagaaaattgtcggatcgttctatg

SEQ ID NO: 707930 - DNA, 25 bp, Artificial sequence
  Synthetic oligonucleotide
atatctattcgaacgcgtaatggaa

SEQ ID NO: 707931 - DNA, 25 bp, Artificial sequence
  Synthetic oligonucleotide
ttttttattaatcgtcgcgaccgat

SEQ ID NO: 707932 - DNA, 25 bp, Artificial sequence
  Synthetic oligonucleotide
tagtaacataagggacgatacattc

SEQ ID NO: 707933 - DNA, 25 bp, Artificial sequence
  Synthetic oligonucleotide
atcaagcgacgctatatcttcatta

SEQ ID NO: 707934 - DNA, 25 bp, Artificial sequence
  Synthetic oligonucleotide
ttaatgcgcataggactaatctttg

SEQ ID NO: 707935 - DNA, 25 bp, Artificial sequence
  Synthetic oligonucleotide
ttaatgcgcatacgactaatctttg

SEQ ID NO: 707936 - DNA, 25 bp, Artificial sequence
  Synthetic oligonucleotide
acaagtcgatcggacataatgatat

SEQ ID NO: 707937 - DNA, 25 bp, Artificial sequence
  Synthetic oligonucleotide
acaagtcgatcgcacataatgatat

SEQ ID NO: 707938 - DNA, 25 bp, Artificial sequence
  Synthetic oligonucleotide
gttaaacgatatactagccctgtat

SEQ ID NO: 707939 - DNA, 25 bp, Artificial sequence
  Synthetic oligonucleotide
gttaaacgatattctagccctgtat

SEQ ID NO: 707940 - DNA, 25 bp, Artificial sequence
  Synthetic oligonucleotide
tattagcgacttatgcgtatcgtat

SEQ ID NO: 707941 - DNA, 25 bp, Artificial sequence
  Synthetic oligonucleotide
tattagcgacttttgcgtatcgtat

SEQ ID NO: 707942 - DNA, 25 bp, Artificial sequence
  Synthetic oligonucleotide
tatatgcgactaaacgagatgtgaa

SEQ ID NO: 707943 - DNA, 25 bp, Artificial sequence
  Synthetic oligonucleotide
tatatgcgactatacgagatgtgaa

SEQ ID NO: 707944 - DNA, 25 bp, Artificial sequence
  Synthetic oligonucleotide
aagtagccgctataacgataattac

SEQ ID NO: 707945 - DNA, 25 bp, Artificial sequence
  Synthetic oligonucleotide
taattacgacgctattagagtgttc

SEQ ID NO: 707946 - DNA, 25 bp, Artificial sequence
  Synthetic oligonucleotide
tgtattcgccgaaacattaaaccat

SEQ ID NO: 707947 - DNA, 25 bp, Artificial sequence
  Synthetic oligonucleotide
atcaagcgacgcaatatcttcatta

SEQ ID NO: 707948 - DNA, 25 bp, Artificial sequence
  Synthetic oligonucleotide
atctaccgaagtttatcggtcttat

SEQ ID NO: 707949 - DNA, 25 bp, Artificial sequence
  Synthetic oligonucleotide
atctaccgaagtatatcggtcttat

SEQ ID NO: 707950 - DNA, 25 bp, Artificial sequence
  Synthetic oligonucleotide
tagagccgaaggaacgataaaattt

SEQ ID NO: 707951 - DNA, 25 bp, Artificial sequence
  Synthetic oligonucleotide
tagagccgaaggtacgataaaattt

SEQ ID NO: 707952 - DNA, 25 bp, Artificial sequence
  Synthetic oligonucleotide
ccaaaacctataatcgtcgaagtaa

SEQ ID NO: 707953 - DNA, 25 bp, Artificial sequence
  Synthetic oligonucleotide
ccaaaacctatattcgtcgaagtaa

SEQ ID NO: 707954 - DNA, 25 bp, Artificial sequence
  Synthetic oligonucleotide
tatcagcctaacgacgattatcttt

SEQ ID NO: 707955 - DNA, 25 bp, Artificial sequence
  Synthetic oligonucleotide
tatcagcctaaccacgattatcttt

SEQ ID NO: 707956 - DNA, 25 bp, Artificial sequence
  Synthetic oligonucleotide
tgaagaccgttacgtatagactaaa

SEQ ID NO: 707957 - DNA, 25 bp, Artificial sequence
  Synthetic oligonucleotide
taattacgacgcaattagagtgttc

SEQ ID NO: 707958 - DNA, 25 bp, Artificial sequence
  Synthetic oligonucleotide
gttgaactgacgttcgtataattac

SEQ ID NO: 707959 - DNA, 25 bp, Artificial sequence
  Synthetic oligonucleotide
ggatatgcgttgaacgtataatttg

SEQ ID NO: 707960 - DNA, 25 bp, Artificial sequence
  Synthetic oligonucleotide
ctttctgacgctttatacgatgatt

SEQ ID NO: 707961 - DNA, 25 bp, Artificial sequence
  Synthetic oligonucleotide
tagatagacgcgaatattctatctg

SEQ ID NO: 707962 - DNA, 25 bp, Artificial sequence
  Synthetic oligonucleotide
tagatagacgcgtatattctatctg

SEQ ID NO: 707963 - DNA, 25 bp, Artificial sequence
  Synthetic oligonucleotide
taagatgacgcgtactatagtttag

SEQ ID NO: 707964 - DNA, 25 bp, Artificial sequence
  Synthetic oligonucleotide
taagatgacgcgaactatagtttag

SEQ ID NO: 707965 - DNA, 25 bp, Artificial sequence
  Synthetic oligonucleotide
gcgattgacgcgtctatattattat

SEQ ID NO: 707966 - DNA, 25 bp, Artificial sequence
  Synthetic oligonucleotide
gcgattgacgcgactatattattat

SEQ ID NO: 707967 - DNA, 25 bp, Artificial sequence
  Synthetic oligonucleotide
tatttccttgacgcgatatcaacat

SEQ ID NO: 707968 - DNA, 25 bp, Artificial sequence
  Synthetic oligonucleotide
tatttccttgacccgatatcaacat

SEQ ID NO: 707969 - DNA, 25 bp, Artificial sequence
  Synthetic oligonucleotide
aggtatgacgttcgcaataaataag

SEQ ID NO: 707970 - DNA, 25 bp, Artificial sequence
  Synthetic oligonucleotide
atataccttaaccaatcgcttgtac

SEQ ID NO: 707971 - DNA, 25 bp, Artificial sequence
  Synthetic oligonucleotide
aggtatgacgttggcaataaataag

SEQ ID NO: 707972 - DNA, 25 bp, Artificial sequence
  Synthetic oligonucleotide
gttgaactgacgatcgtataattac

SEQ ID NO: 707973 - DNA, 25 bp, Artificial sequence
  Synthetic oligonucleotide
atatcactcgcggattaaaactttg

SEQ ID NO: 707974 - DNA, 25 bp, Artificial sequence
  Synthetic oligonucleotide
atatcactcgcgcattaaaactttg

SEQ ID NO: 707975 - DNA, 25 bp, Artificial sequence
  Synthetic oligonucleotide
ggattactatatggcgtactaatga

SEQ ID NO: 707976 - DNA, 25 bp, Artificial sequence
  Synthetic oligonucleotide
ggattactatatcgcgtactaatga

SEQ ID NO: 707977 - DNA, 25 bp, Artificial sequence
  Synthetic oligonucleotide
ttttgtctatatcgcggaatgaagt

SEQ ID NO: 707978 - DNA, 25 bp, Artificial sequence
  Synthetic oligonucleotide
ttttgtctatatggcggaatgaagt

SEQ ID NO: 707979 - DNA, 25 bp, Artificial sequence
  Synthetic oligonucleotide
tttttgctataccgttcgaagtaag

SEQ ID NO: 707980 - DNA, 25 bp, Artificial sequence
  Synthetic oligonucleotide
tttttgctatacggttcgaagtaag

SEQ ID NO: 707981 - DNA, 25 bp, Artificial sequence
  Synthetic oligonucleotide
ttttaactatacgcgagtaccaaca

SEQ ID NO: 707982 - DNA, 25 bp, Artificial sequence
  Synthetic oligonucleotide
atataccttaacgaatcgcttgtac

SEQ ID NO: 707983 - DNA, 25 bp, Artificial sequence
  Synthetic oligonucleotide
acgtttgcgtaaccgtatagtataa

SEQ ID NO: 707984 - DNA, 25 bp, Artificial sequence
  Synthetic oligonucleotide
atttagacgagtcgactatagaaca

SEQ ID NO: 707985 - DNA, 25 bp, Artificial sequence
  Synthetic oligonucleotide
ggatatgcgttgtacgtataatttg

SEQ ID NO: 707986 - DNA, 25 bp, Artificial sequence
  Synthetic oligonucleotide
gtatttattaacgcgctacccataa

SEQ ID NO: 707987 - DNA, 25 bp, Artificial sequence
  Synthetic oligonucleotide
catagagcgttccgttatatttatg

SEQ ID NO: 707988 - DNA, 25 bp, Artificial sequence
  Synthetic oligonucleotide
catagagcgttcggttatatttatg

SEQ ID NO: 707989 - DNA, 25 bp, Artificial sequence
  Synthetic oligonucleotide
gtgttagcgttccatactatgataa

SEQ ID NO: 707990 - DNA, 25 bp, Artificial sequence
  Synthetic oligonucleotide
gtgttagcgttcgatactatgataa

SEQ ID NO: 707991 - DNA, 25 bp, Artificial sequence
  Synthetic oligonucleotide
ttgtacgcgttacttcgtataaaga

SEQ ID NO: 707992 - DNA, 25 bp, Artificial sequence
  Synthetic oligonucleotide
ttgtacgcgttagttcgtataaaga

SEQ ID NO: 707993 - DNA, 25 bp, Artificial sequence
  Synthetic oligonucleotide
atatctgcgtaatatcgagcaatca

SEQ ID NO: 707994 - DNA, 25 bp, Artificial sequence
  Synthetic oligonucleotide
ctttctgacgctatatacgatgatt

SEQ ID NO: 707995 - DNA, 25 bp, Artificial sequence
  Synthetic oligonucleotide
acgtttgcgtaagcgtatagtataa

SEQ ID NO: 707996 - DNA, 25 bp, Artificial sequence
  Synthetic oligonucleotide
tccattctagtaaacgtcgtagaaa

SEQ ID NO: 707997 - DNA, 25 bp, Artificial sequence
  Synthetic oligonucleotide
agagttgcggataatcgtttgataa

SEQ ID NO: 707998 - DNA, 25 bp, Artificial sequence
  Synthetic oligonucleotide
agagttgcggattatcgtttgataa

SEQ ID NO: 707999 - DNA, 25 bp, Artificial sequence
  Synthetic oligonucleotide
gttattgcgcgtaatgtaaggtaaa

SEQ ID NO: 708000 - DNA, 25 bp, Artificial sequence
  Synthetic oligonucleotide
gttattgcgcgttatgtaaggtaaa

SEQ ID NO: 708001 - DNA, 25 bp, Artificial sequence
  Synthetic oligonucleotide
aaaaatgattcgtgcgttacttcac

SEQ ID NO: 708002 - DNA, 25 bp, Artificial sequence
  Synthetic oligonucleotide
aaaaatgattcgagcgttacttcac

SEQ ID NO: 708003 - DNA, 25 bp, Artificial sequence
  Synthetic oligonucleotide
atttacgatagcctacgtttcaaag

SEQ ID NO: 708004 - DNA, 25 bp, Artificial sequence
  Synthetic oligonucleotide
atttacgatagcgtacgtttcaaag

SEQ ID NO: 708005 - DNA, 25 bp, Artificial sequence
  Synthetic oligonucleotide
agtactgataatacgtcggatctat

SEQ ID NO: 708006 - DNA, 25 bp, Artificial sequence
  Synthetic oligonucleotide
agtactgataattcgtcggatctat

SEQ ID NO: 708007 - DNA, 25 bp, Artificial sequence
  Synthetic oligonucleotide
atatctgcgtaaaatcgagcaatca

SEQ ID NO: 708008 - DNA, 25 bp, Artificial sequence
  Synthetic oligonucleotide
cttattcgtagaactatcgtgttag

SEQ ID NO: 708009 - DNA, 25 bp, Artificial sequence
  Synthetic oligonucleotide
tccatacgtcgaatatacgaacatt

SEQ ID NO: 708010 - DNA, 25 bp, Artificial sequence
  Synthetic oligonucleotide
ttcgaacgtccaatacgatttatgt

SEQ ID NO: 708011 - DNA, 25 bp, Artificial sequence
  Synthetic oligonucleotide
ttcgaacgtccattacgatttatgt

SEQ ID NO: 708012 - DNA, 25 bp, Artificial sequence
  Synthetic oligonucleotide
atatagcgtattccgatactagcta

SEQ ID NO: 708013 - DNA, 25 bp, Artificial sequence
  Synthetic oligonucleotide
atatagcgtattgcgatactagcta

SEQ ID NO: 708014 - DNA, 25 bp, Artificial sequence
  Synthetic oligonucleotide
aacgttcgtatctagacgtgttaaa

SEQ ID NO: 708015 - DNA, 25 bp, Artificial sequence
  Synthetic oligonucleotide
aacgttcgtatcaagacgtgttaaa

SEQ ID NO: 708016 - DNA, 25 bp, Artificial sequence
  Synthetic oligonucleotide
acttttcgtatattacgcgttgact

SEQ ID NO: 708017 - DNA, 25 bp, Artificial sequence
  Synthetic oligonucleotide
acttttcgtataatacgcgttgact

SEQ ID NO: 708018 - DNA, 25 bp, Artificial sequence
  Synthetic oligonucleotide
attctacgtatatcgcgaatgaatg

SEQ ID NO: 708019 - DNA, 25 bp, Artificial sequence
  Synthetic oligonucleotide
ttttaactatacccgagtaccaaca

SEQ ID NO: 708020 - DNA, 25 bp, Artificial sequence
  Synthetic oligonucleotide
cttattcgtagatctatcgtgttag

SEQ ID NO: 708021 - DNA, 25 bp, Artificial sequence
  Synthetic oligonucleotide
atatagcgtcgatataacgcagatt

SEQ ID NO: 708022 - DNA, 25 bp, Artificial sequence
  Synthetic oligonucleotide
acattacgtactcatacgaccattt

SEQ ID NO: 708023 - DNA, 25 bp, Artificial sequence
  Synthetic oligonucleotide
acattacgtactgatacgaccattt

SEQ ID NO: 708024 - DNA, 25 bp, Artificial sequence
  Synthetic oligonucleotide
acgaatcgtacttcggatttataga

SEQ ID NO: 708025 - DNA, 25 bp, Artificial sequence
  Synthetic oligonucleotide
acgaatcgtactacggatttataga

SEQ ID NO: 708026 - DNA, 25 bp, Artificial sequence
  Synthetic oligonucleotide
gttccacgtacggtactaaatatta

SEQ ID NO: 708027 - DNA, 25 bp, Artificial sequence
  Synthetic oligonucleotide
gttccacgtacgctactaaatatta

SEQ ID NO: 708028 - DNA, 25 bp, Artificial sequence
  Synthetic oligonucleotide
taattccgtacattaacgctccaat

SEQ ID NO: 708029 - DNA, 25 bp, Artificial sequence
  Synthetic oligonucleotide
taattccgtacaataacgctccaat

SEQ ID NO: 708030 - DNA, 25 bp, Artificial sequence
  Synthetic oligonucleotide
aggcatcgtaatgactacgtaatta

SEQ ID NO: 708031 - DNA, 25 bp, Artificial sequence
  Synthetic oligonucleotide
aggcatcgtaatcactacgtaatta

SEQ ID NO: 708032 - DNA, 25 bp, Artificial sequence
  Synthetic oligonucleotide
attctacgtataacgcgaatgaatg

SEQ ID NO: 708033 - DNA, 25 bp, Artificial sequence
  Synthetic oligonucleotide
ttagatcgttatactcgagaggtaa

SEQ ID NO: 708034 - DNA, 25 bp, Artificial sequence
  Synthetic oligonucleotide
ttcaaccgtaacgtcgatagttatt

SEQ ID NO: 708035 - DNA, 25 bp, Artificial sequence
  Synthetic oligonucleotide
tctgaactaatcggcgtatacaaat

SEQ ID NO: 708036 - DNA, 25 bp, Artificial sequence
  Synthetic oligonucleotide
tctgaactaatccgcgtatacaaat

SEQ ID NO: 708037 - DNA, 25 bp, Artificial sequence
  Synthetic oligonucleotide
acttagcgtttacgctagtaagtat

SEQ ID NO: 708038 - DNA, 25 bp, Artificial sequence
  Synthetic oligonucleotide
acttagcgtttaggctagtaagtat

SEQ ID NO: 708039 - DNA, 25 bp, Artificial sequence
  Synthetic oligonucleotide
gacaaacgtttatcgcgtatacatt

SEQ ID NO: 708040 - DNA, 25 bp, Artificial sequence
  Synthetic oligonucleotide
gacaaacgtttaacgcgtatacatt

SEQ ID NO: 708041 - DNA, 25 bp, Artificial sequence
  Synthetic oligonucleotide
gatacacgttcgtgtatagttcaaa

SEQ ID NO: 708042 - DNA, 25 bp, Artificial sequence
  Synthetic oligonucleotide
gatacacgttcgagtatagttcaaa

SEQ ID NO: 708043 - DNA, 25 bp, Artificial sequence
  Synthetic oligonucleotide
tggttacgttatagtacgctatgtt

SEQ ID NO: 708044 - DNA, 25 bp, Artificial sequence
  Synthetic oligonucleotide
tccatacgtcgattatacgaacatt

SEQ ID NO: 708045 - DNA, 25 bp, Artificial sequence
  Synthetic oligonucleotide
ttagatcgttattctcgagaggtaa

SEQ ID NO: 708046 - DNA, 25 bp, Artificial sequence
  Synthetic oligonucleotide
atatagcgtcgaaataacgcagatt

SEQ ID NO: 708047 - DNA, 25 bp, Artificial sequence
  Synthetic oligonucleotide
atgactcgttagtagcgtaacatat

SEQ ID NO: 708048 - DNA, 25 bp, Artificial sequence
  Synthetic oligonucleotide
atgactcgttagaagcgtaacatat

SEQ ID NO: 708049 - DNA, 25 bp, Artificial sequence
  Synthetic oligonucleotide
ctggatcgttacgcgattatttaat

SEQ ID NO: 708050 - DNA, 25 bp, Artificial sequence
  Synthetic oligonucleotide
ctggatcgttacccgattatttaat

SEQ ID NO: 708051 - DNA, 25 bp, Artificial sequence
  Synthetic oligonucleotide
gacaatcgttaagtagtcgttaatc

SEQ ID NO: 708052 - DNA, 25 bp, Artificial sequence
  Synthetic oligonucleotide
gacaatcgttaactagtcgttaatc

SEQ ID NO: 708053 - DNA, 25 bp, Artificial sequence
  Synthetic oligonucleotide
gtattacgtgtatagtcgaagatct

SEQ ID NO: 708054 - DNA, 25 bp, Artificial sequence
  Synthetic oligonucleotide
gtattacgtgtaaagtcgaagatct

SEQ ID NO: 708055 - DNA, 25 bp, Artificial sequence
  Synthetic oligonucleotide
caacaccgtcggagtattataaaat

SEQ ID NO: 708056 - DNA, 25 bp, Artificial sequence
  Synthetic oligonucleotide
caacaccgtcggtgtattataaaat

SEQ ID NO: 708057 - DNA, 25 bp, Artificial sequence
  Synthetic oligonucleotide
tccattctagtatacgtcgtagaaa

SEQ ID NO: 708058 - DNA, 25 bp, Artificial sequence
  Synthetic oligonucleotide
tggttacgttattgtacgctatgtt

SEQ ID NO: 708059 - DNA, 25 bp, Artificial sequence
  Synthetic oligonucleotide
ttacagtcgatatccgttagtttct

SEQ ID NO: 708060 - DNA, 25 bp, Artificial sequence
  Synthetic oligonucleotide
taacaatatcgacgtactagatagc

SEQ ID NO: 708061 - DNA, 25 bp, Artificial sequence
  Synthetic oligonucleotide
gctaacttacgcgttactaaaagat

SEQ ID NO: 708062 - DNA, 25 bp, Artificial sequence
  Synthetic oligonucleotide
gctaacttacgccttactaaaagat

SEQ ID NO: 708063 - DNA, 25 bp, Artificial sequence
  Synthetic oligonucleotide
ttgaagttacgcggataatcatatg

SEQ ID NO: 708064 - DNA, 25 bp, Artificial sequence
  Synthetic oligonucleotide
ttgaagttacgccgataatcatatg

SEQ ID NO: 708065 - DNA, 25 bp, Artificial sequence
  Synthetic oligonucleotide
atctcttgtatttacgcgatgaaga

SEQ ID NO: 708066 - DNA, 25 bp, Artificial sequence
  Synthetic oligonucleotide
atctcttgtattaacgcgatgaaga

SEQ ID NO: 708067 - DNA, 25 bp, Artificial sequence
  Synthetic oligonucleotide
ttaaattcttacgcgtattgaccgt

SEQ ID NO: 708068 - DNA, 25 bp, Artificial sequence
  Synthetic oligonucleotide
ttaaattcttacccgtattgaccgt

SEQ ID NO: 708069 - DNA, 25 bp, Artificial sequence
  Synthetic oligonucleotide
ctgatatcgtattacgatgacactt

SEQ ID NO: 708070 - DNA, 25 bp, Artificial sequence
  Synthetic oligonucleotide
aggctattatcgttctacgaacatt

SEQ ID NO: 708071 - DNA, 25 bp, Artificial sequence
  Synthetic oligonucleotide
ttacagtcgataaccgttagtttct

SEQ ID NO: 708072 - DNA, 25 bp, Artificial sequence
  Synthetic oligonucleotide
ttctgattcgcgactatatcatagt

SEQ ID NO: 708073 - DNA, 25 bp, Artificial sequence
  Synthetic oligonucleotide
acagcttatgtcgaacgtaacaatt

SEQ ID NO: 708074 - DNA, 25 bp, Artificial sequence
  Synthetic oligonucleotide
acagcttatgtccaacgtaacaatt

SEQ ID NO: 708075 - DNA, 25 bp, Artificial sequence
  Synthetic oligonucleotide
tcgtaatatgcgataacgacatact

SEQ ID NO: 708076 - DNA, 25 bp, Artificial sequence
  Synthetic oligonucleotide
tcgtaatatgcgttaacgacatact

SEQ ID NO: 708077 - DNA, 25 bp, Artificial sequence
  Synthetic oligonucleotide
tgtgattatcgtcgtaagtatcaac

SEQ ID NO: 708078 - DNA, 25 bp, Artificial sequence
  Synthetic oligonucleotide
tgtgattatcgtggtaagtatcaac

SEQ ID NO: 708079 - DNA, 25 bp, Artificial sequence
  Synthetic oligonucleotide
aggttatatcggacgtaatctacaa

SEQ ID NO: 708080 - DNA, 25 bp, Artificial sequence
  Synthetic oligonucleotide
aggttatatcggtcgtaatctacaa

SEQ ID NO: 708081 - DNA, 25 bp, Artificial sequence
  Synthetic oligonucleotide
aaccagtatcggatcgttaatgtta

SEQ ID NO: 708082 - DNA, 25 bp, Artificial sequence
  Synthetic oligonucleotide
atttagacgagtggactatagaaca

SEQ ID NO: 708083 - DNA, 25 bp, Artificial sequence
  Synthetic oligonucleotide
ctgatatcgtataacgatgacactt

SEQ ID NO: 708084 - DNA, 25 bp, Artificial sequence
  Synthetic oligonucleotide
aaagataagcgtatatcggcgaatt

SEQ ID NO: 708085 - DNA, 25 bp, Artificial sequence
  Synthetic oligonucleotide
tatttaacgatacgtcgtatcacga

SEQ ID NO: 708086 - DNA, 25 bp, Artificial sequence
  Synthetic oligonucleotide
aatgtaacgaggcgtaataaatcag

SEQ ID NO: 708087 - DNA, 25 bp, Artificial sequence
  Synthetic oligonucleotide
cttactacgaacgtcgttaattcat

SEQ ID NO: 708088 - DNA, 25 bp, Artificial sequence
  Synthetic oligonucleotide
cttactacgaacctcgttaattcat

SEQ ID NO: 708089 - DNA, 25 bp, Artificial sequence
  Synthetic oligonucleotide
caaagtacctcgacgtatttaaaca

SEQ ID NO: 708090 - DNA, 25 bp, Artificial sequence
  Synthetic oligonucleotide
caaagtacctcgtcgtatttaaaca

SEQ ID NO: 708091 - DNA, 25 bp, Artificial sequence
  Synthetic oligonucleotide
atttttaatcgcggagtatgctatc

SEQ ID NO: 708092 - DNA, 25 bp, Artificial sequence
  Synthetic oligonucleotide
atttttaatcgccgagtatgctatc

SEQ ID NO: 708093 - DNA, 25 bp, Artificial sequence
  Synthetic oligonucleotide
aaagccaatcgcgttacgaatattt

SEQ ID NO: 708094 - DNA, 25 bp, Artificial sequence
  Synthetic oligonucleotide
aaagccaatcgccttacgaatattt

SEQ ID NO: 708095 - DNA, 25 bp, Artificial sequence
  Synthetic oligonucleotide
aggctattatcgatctacgaacatt

SEQ ID NO: 708096 - DNA, 25 bp, Artificial sequence
  Synthetic oligonucleotide
acgtataatatccttcgcgttttgt

SEQ ID NO: 708097 - DNA, 25 bp, Artificial sequence
  Synthetic oligonucleotide
taacaatatcgaggtactagatagc

SEQ ID NO: 708098 - DNA, 25 bp, Artificial sequence
  Synthetic oligonucleotide
aaagataagcgtttatcggcgaatt

SEQ ID NO: 708099 - DNA, 25 bp, Artificial sequence
  Synthetic oligonucleotide
cttatgaacttagtcgcgagtaaat

SEQ ID NO: 708100 - DNA, 25 bp, Artificial sequence
  Synthetic oligonucleotide
cttatgaacttactcgcgagtaaat

SEQ ID NO: 708101 - DNA, 25 bp, Artificial sequence
  Synthetic oligonucleotide
tactaaaacgttcgaacgatcgata

SEQ ID NO: 708102 - DNA, 25 bp, Artificial sequence
  Synthetic oligonucleotide
tactaaaacgttggaacgatcgata

SEQ ID NO: 708103 - DNA, 25 bp, Artificial sequence
  Synthetic oligonucleotide
gttttaaacgatacgacctcattag

SEQ ID NO: 708104 - DNA, 25 bp, Artificial sequence
  Synthetic oligonucleotide
gttttaaacgattcgacctcattag

SEQ ID NO: 708105 - DNA, 25 bp, Artificial sequence
  Synthetic oligonucleotide
ttgactttcgcgttaatacatacac

SEQ ID NO: 708106 - DNA, 25 bp, Artificial sequence
  Synthetic oligonucleotide
ttgactttcgcgataatacatacac

SEQ ID NO: 708107 - DNA, 25 bp, Artificial sequence
  Synthetic oligonucleotide
ttctgattcgcgtctatatcatagt

SEQ ID NO: 708108 - DNA, 25 bp, Artificial sequence
  Synthetic oligonucleotide
acgtataatatcgttcgcgttttgt

SEQ ID NO: 708109 - DNA, 25 bp, Artificial sequence
  Synthetic oligonucleotide
aacaatcgaatttgtcgtaggttca

SEQ ID NO: 708110 - DNA, 25 bp, Artificial sequence
  Synthetic oligonucleotide
aaccagtatcggttcgttaatgtta

SEQ ID NO: 708111 - DNA, 25 bp, Artificial sequence
  Synthetic oligonucleotide
agcgatcgtccgatataatcattta

SEQ ID NO: 708112 - DNA, 25 bp, Artificial sequence
  Synthetic oligonucleotide
agcgatcgtccgttataatcattta

SEQ ID NO: 708113 - DNA, 25 bp, Artificial sequence
  Synthetic oligonucleotide
gtacaccggtaaacgtataagtata

SEQ ID NO: 708114 - DNA, 25 bp, Artificial sequence
  Synthetic oligonucleotide
gtacaccggtaatcgtataagtata

SEQ ID NO: 708115 - DNA, 25 bp, Artificial sequence
  Synthetic oligonucleotide
aagtgacgcgtattacttatcttct

SEQ ID NO: 708116 - DNA, 25 bp, Artificial sequence
  Synthetic oligonucleotide
aagtgacgcgtaatacttatcttct

SEQ ID NO: 708117 - DNA, 25 bp, Artificial sequence
  Synthetic oligonucleotide
attatacgcgtattaagtacgcgtt

SEQ ID NO: 708118 - DNA, 25 bp, Artificial sequence
  Synthetic oligonucleotide
attatacgcgtaataagtacgcgtt

SEQ ID NO: 708119 - DNA, 25 bp, Artificial sequence
  Synthetic oligonucleotide
cagtttcgcgaactataatgcataa

SEQ ID NO: 708120 - DNA, 25 bp, Artificial sequence
  Synthetic oligonucleotide
gaaggactattcgtaacgtcatatt

SEQ ID NO: 708121 - DNA, 25 bp, Artificial sequence
  Synthetic oligonucleotide
aacaatcgaattagtcgtaggttca

SEQ ID NO: 708122 - DNA, 25 bp, Artificial sequence
  Synthetic oligonucleotide
atagatgtcgaaacgtatacgttct

SEQ ID NO: 708123 - DNA, 25 bp, Artificial sequence
  Synthetic oligonucleotide
tgatggcgaataacggttaaagaaa

SEQ ID NO: 708124 - DNA, 25 bp, Artificial sequence
  Synthetic oligonucleotide
tgatggcgaatatcggttaaagaaa

SEQ ID NO: 708125 - DNA, 25 bp, Artificial sequence
  Synthetic oligonucleotide
ttacaaattacgggtactagaaagg

SEQ ID NO: 708126 - DNA, 25 bp, Artificial sequence
  Synthetic oligonucleotide
ttacaaattacgcgtactagaaagg

SEQ ID NO: 708127 - DNA, 25 bp, Artificial sequence
  Synthetic oligonucleotide
tagagtattacgaccgataagctta

SEQ ID NO: 708128 - DNA, 25 bp, Artificial sequence
  Synthetic oligonucleotide
tagagtattacgtccgataagctta

SEQ ID NO: 708129 - DNA, 25 bp, Artificial sequence
  Synthetic oligonucleotide
aatcgtatacgccactaaaagtgtt

SEQ ID NO: 708130 - DNA, 25 bp, Artificial sequence
  Synthetic oligonucleotide
aatcgtatacgcgactaaaagtgtt

SEQ ID NO: 708131 - DNA, 25 bp, Artificial sequence
  Synthetic oligonucleotide
tgagtgaatacgggatgtaagttat

SEQ ID NO: 708132 - DNA, 25 bp, Artificial sequence
  Synthetic oligonucleotide
tgagtgaatacgcgatgtaagttat

SEQ ID NO: 708133 - DNA, 25 bp, Artificial sequence
  Synthetic oligonucleotide
cagtttcgcgaagtataatgcataa

SEQ ID NO: 708134 - DNA, 25 bp, Artificial sequence
  Synthetic oligonucleotide
agaaaatacgatttcgtaccgtgaa

SEQ ID NO: 708135 - DNA, 25 bp, Artificial sequence
  Synthetic oligonucleotide
atgggatagtatttcgacgaactta

SEQ ID NO: 708136 - DNA, 25 bp, Artificial sequence
  Synthetic oligonucleotide
atgggatagtatatcgacgaactta

SEQ ID NO: 708137 - DNA, 25 bp, Artificial sequence
  Synthetic oligonucleotide
attagctagtacccgttaagctatt

SEQ ID NO: 708138 - DNA, 25 bp, Artificial sequence
  Synthetic oligonucleotide
attagctagtacgcgttaagctatt

SEQ ID NO: 708139 - DNA, 25 bp, Artificial sequence
  Synthetic oligonucleotide
tatgtctagtaattcgacgtcctta

SEQ ID NO: 708140 - DNA, 25 bp, Artificial sequence
  Synthetic oligonucleotide
tatgtctagtaaatcgacgtcctta

SEQ ID NO: 708141 - DNA, 25 bp, Artificial sequence
  Synthetic oligonucleotide
ggatcctacttaatacgcgataata

SEQ ID NO: 708142 - DNA, 25 bp, Artificial sequence
  Synthetic oligonucleotide
ggatcctacttattacgcgataata

SEQ ID NO: 708143 - DNA, 25 bp, Artificial sequence
  Synthetic oligonucleotide
ttagaatacgtcgatacatcgtaac

SEQ ID NO: 708144 - DNA, 25 bp, Artificial sequence
  Synthetic oligonucleotide
ttagaatacgtccatacatcgtaac

SEQ ID NO: 708145 - DNA, 25 bp, Artificial sequence
  Synthetic oligonucleotide
gaaggactattcctaacgtcatatt

SEQ ID NO: 708146 - DNA, 25 bp, Artificial sequence
  Synthetic oligonucleotide
gtgtcttacgcgtattaagttctat

SEQ ID NO: 708147 - DNA, 25 bp, Artificial sequence
  Synthetic oligonucleotide
tatttaacgataggtcgtatcacga

SEQ ID NO: 708148 - DNA, 25 bp, Artificial sequence
  Synthetic oligonucleotide
agaaaatacgatatcgtaccgtgaa

SEQ ID NO: 708149 - DNA, 25 bp, Artificial sequence
  Synthetic oligonucleotide
gtacactaccgatcgtataattaac

SEQ ID NO: 708150 - DNA, 25 bp, Artificial sequence
  Synthetic oligonucleotide
gtacactaccgaacgtataattaac

SEQ ID NO: 708151 - DNA, 25 bp, Artificial sequence
  Synthetic oligonucleotide
ttaacttaattactcgcgagcaaac

SEQ ID NO: 708152 - DNA, 25 bp, Artificial sequence
  Synthetic oligonucleotide
ttaacttaattagtcgcgagcaaac

SEQ ID NO: 708153 - DNA, 25 bp, Artificial sequence
  Synthetic oligonucleotide
tgaaaataatccgtcgtataccgtt

SEQ ID NO: 708154 - DNA, 25 bp, Artificial sequence
  Synthetic oligonucleotide
tgaaaataatccctcgtataccgtt

SEQ ID NO: 708155 - DNA, 25 bp, Artificial sequence
  Synthetic oligonucleotide
ttcaaggtcgacgtaattaccatta

SEQ ID NO: 708156 - DNA, 25 bp, Artificial sequence
  Synthetic oligonucleotide
ttcaaggtcgacctaattaccatta

SEQ ID NO: 708157 - DNA, 25 bp, Artificial sequence
  Synthetic oligonucleotide
atagatgtcgaatcgtatacgttct

SEQ ID NO: 708158 - DNA, 25 bp, Artificial sequence
  Synthetic oligonucleotide
gtgtcttacgcgaattaagttctat

SEQ ID NO: 708159 - DNA, 25 bp, Artificial sequence
  Synthetic oligonucleotide
aatttgataccgttcgtacctttga

SEQ ID NO: 708160 - DNA, 25 bp, Artificial sequence
  Synthetic oligonucleotide
aaaaacataataggcgtcgcaatag

SEQ ID NO: 708161 - DNA, 25 bp, Artificial sequence
  Synthetic oligonucleotide
ataagaatacgtctcggatcgttta

SEQ ID NO: 708162 - DNA, 25 bp, Artificial sequence
  Synthetic oligonucleotide
ataagaatacgtgtcggatcgttta

SEQ ID NO: 708163 - DNA, 25 bp, Artificial sequence
  Synthetic oligonucleotide
aggaatatacgtggaggtacattta

SEQ ID NO: 708164 - DNA, 25 bp, Artificial sequence
  Synthetic oligonucleotide
aggaatatacgtcgaggtacattta

SEQ ID NO: 708165 - DNA, 25 bp, Artificial sequence
  Synthetic oligonucleotide
aaaaatatacgtatgaccgacccta

SEQ ID NO: 708166 - DNA, 25 bp, Artificial sequence
  Synthetic oligonucleotide
aaaaatatacgtttgaccgacccta

SEQ ID NO: 708167 - DNA, 25 bp, Artificial sequence
  Synthetic oligonucleotide
tgtataatacgcgtcgtaaacagat

SEQ ID NO: 708168 - DNA, 25 bp, Artificial sequence
  Synthetic oligonucleotide
tgtataatacgcctcgtaaacagat

SEQ ID NO: 708169 - DNA, 25 bp, Artificial sequence
  Synthetic oligonucleotide
aatacaatacgcctcattggcaaaa

SEQ ID NO: 708170 - DNA, 25 bp, Artificial sequence
  Synthetic oligonucleotide
aattatatactaggcgttggccaat

SEQ ID NO: 708171 - DNA, 25 bp, Artificial sequence
  Synthetic oligonucleotide
aatttgataccgatcgtacctttga

SEQ ID NO: 708172 - DNA, 25 bp, Artificial sequence
  Synthetic oligonucleotide
aatacaataggttacgcgttgttac

SEQ ID NO: 708173 - DNA, 25 bp, Artificial sequence
  Synthetic oligonucleotide
agatctatacccgatcgttttcata

SEQ ID NO: 708174 - DNA, 25 bp, Artificial sequence
  Synthetic oligonucleotide
agatctataccccatcgttttcata

SEQ ID NO: 708175 - DNA, 25 bp, Artificial sequence
  Synthetic oligonucleotide
accataatacagggcgataaataag

SEQ ID NO: 708176 - DNA, 25 bp, Artificial sequence
  Synthetic oligonucleotide
accataatacagcgcgataaataag

SEQ ID NO: 708177 - DNA, 25 bp, Artificial sequence
  Synthetic oligonucleotide
tttcacataatgggcgctataaaca

SEQ ID NO: 708178 - DNA, 25 bp, Artificial sequence
  Synthetic oligonucleotide
tttcacataatgcgcgctataaaca

SEQ ID NO: 708179 - DNA, 25 bp, Artificial sequence
  Synthetic oligonucleotide
gcaattataatcgtacgcgaataga

SEQ ID NO: 708180 - DNA, 25 bp, Artificial sequence
  Synthetic oligonucleotide
gcaattataatcctacgcgaataga

SEQ ID NO: 708181 - DNA, 25 bp, Artificial sequence
  Synthetic oligonucleotide
agtataataatcggtcgtgttatgg

SEQ ID NO: 708182 - DNA, 25 bp, Artificial sequence
  Synthetic oligonucleotide
aatgtaacgaggggtaataaatcag

SEQ ID NO: 708183 - DNA, 25 bp, Artificial sequence
  Synthetic oligonucleotide
aatacaatacgcgtcattggcaaaa

SEQ ID NO: 708184 - DNA, 25 bp, Artificial sequence
  Synthetic oligonucleotide
tactttatattgggacgtctgattc

SEQ ID NO: 708185 - DNA, 25 bp, Artificial sequence
  Synthetic oligonucleotide
tggtttatcgttcgcgatatttttc

SEQ ID NO: 708186 - DNA, 25 bp, Artificial sequence
  Synthetic oligonucleotide
tggtttatcgttggcgatatttttc

SEQ ID NO: 708187 - DNA, 25 bp, Artificial sequence
  Synthetic oligonucleotide
ctaattatcgtaaagtccggtttga

SEQ ID NO: 708188 - DNA, 25 bp, Artificial sequence
  Synthetic oligonucleotide
ctaattatcgtatagtccggtttga

SEQ ID NO: 708189 - DNA, 25 bp, Artificial sequence
  Synthetic oligonucleotide
atctacatcgtacgtcgttagttat

SEQ ID NO: 708190 - DNA, 25 bp, Artificial sequence
  Synthetic oligonucleotide
atctacatcgtaggtcgttagttat

SEQ ID NO: 708191 - DNA, 25 bp, Artificial sequence
  Synthetic oligonucleotide
tcctatatcgtaccgtagaagaatt

SEQ ID NO: 708192 - DNA, 25 bp, Artificial sequence
  Synthetic oligonucleotide
tcctatatcgtagcgtagaagaatt

SEQ ID NO: 708193 - DNA, 25 bp, Artificial sequence
  Synthetic oligonucleotide
gatctaatcgtatttcgggtatgta

SEQ ID NO: 708194 - DNA, 25 bp, Artificial sequence
  Synthetic oligonucleotide
gatctaatcgtaattcgggtatgta

SEQ ID NO: 708195 - DNA, 25 bp, Artificial sequence
  Synthetic oligonucleotide
aattatatactacgcgttggccaat

SEQ ID NO: 708196 - DNA, 25 bp, Artificial sequence
  Synthetic oligonucleotide
cttaatatcgcgtaaacgtaatacg

SEQ ID NO: 708197 - DNA, 25 bp, Artificial sequence
  Synthetic oligonucleotide
aaaaacataatacgcgtcgcaatag

SEQ ID NO: 708198 - DNA, 25 bp, Artificial sequence
  Synthetic oligonucleotide
tactttatattgcgacgtctgattc

SEQ ID NO: 708199 - DNA, 25 bp, Artificial sequence
  Synthetic oligonucleotide
atatacatatgtacgagcgagaaag

SEQ ID NO: 708200 - DNA, 25 bp, Artificial sequence
  Synthetic oligonucleotide
atatacatatgttcgagcgagaaag

SEQ ID NO: 708201 - DNA, 25 bp, Artificial sequence
  Synthetic oligonucleotide
atagatatataccgctacgctgaat

SEQ ID NO: 708202 - DNA, 25 bp, Artificial sequence
  Synthetic oligonucleotide
atagatatatacggctacgctgaat

SEQ ID NO: 708203 - DNA, 25 bp, Artificial sequence
  Synthetic oligonucleotide
ataaggatagtaaacgcgcaaatag

SEQ ID NO: 708204 - DNA, 25 bp, Artificial sequence
  Synthetic oligonucleotide
ataaggatagtatacgcgcaaatag

SEQ ID NO: 708205 - DNA, 25 bp, Artificial sequence
  Synthetic oligonucleotide
cgatatatagtaaaccgcgttatgt

SEQ ID NO: 708206 - DNA, 25 bp, Artificial sequence
  Synthetic oligonucleotide
cgatatatagtataccgcgttatgt

SEQ ID NO: 708207 - DNA, 25 bp, Artificial sequence
  Synthetic oligonucleotide
aatacaataggtaacgcgttgttac

SEQ ID NO: 708208 - DNA, 25 bp, Artificial sequence
  Synthetic oligonucleotide
cttaatatcgcgaaaacgtaatacg

SEQ ID NO: 708209 - DNA, 25 bp, Artificial sequence
  Synthetic oligonucleotide
gttactacggcgtattatcgtttta

SEQ ID NO: 708210 - DNA, 25 bp, Artificial sequence
  Synthetic oligonucleotide
agtataataatccgtcgtgttatgg

SEQ ID NO: 708211 - DNA, 25 bp, Artificial sequence
  Synthetic oligonucleotide
aaagctactaatccgacgtatatct

SEQ ID NO: 708212 - DNA, 25 bp, Artificial sequence
  Synthetic oligonucleotide
aaagctactaatgcgacgtatatct

SEQ ID NO: 708213 - DNA, 25 bp, Artificial sequence
  Synthetic oligonucleotide
aaagtaacgttattcgtcgattcca

SEQ ID NO: 708214 - DNA, 25 bp, Artificial sequence
  Synthetic oligonucleotide
aaagtaacgttaatcgtcgattcca

SEQ ID NO: 708215 - DNA, 25 bp, Artificial sequence
  Synthetic oligonucleotide
tatcgaacgttaacgcgtaagatat

SEQ ID NO: 708216 - DNA, 25 bp, Artificial sequence
  Synthetic oligonucleotide
tatcgaacgttatcgcgtaagatat

SEQ ID NO: 708217 - DNA, 25 bp, Artificial sequence
  Synthetic oligonucleotide
cagttaacgttaacgcgttatatag

SEQ ID NO: 708218 - DNA, 25 bp, Artificial sequence
  Synthetic oligonucleotide
cagttaacgttatcgcgttatatag

SEQ ID NO: 708219 - DNA, 25 bp, Artificial sequence
  Synthetic oligonucleotide
atttatacgtcttgatacggtacga

SEQ ID NO: 708220 - DNA, 25 bp, Artificial sequence
  Synthetic oligonucleotide
tagaatactatcgtaacggactctt

SEQ ID NO: 708221 - DNA, 25 bp, Artificial sequence
  Synthetic oligonucleotide
gttactacggcgaattatcgtttta

SEQ ID NO: 708222 - DNA, 25 bp, Artificial sequence
  Synthetic oligonucleotide
caaattactatttcgcgctaaatcc

SEQ ID NO: 708223 - DNA, 25 bp, Artificial sequence
  Synthetic oligonucleotide
tagaagacggacgtaattctttgta

SEQ ID NO: 708224 - DNA, 25 bp, Artificial sequence
  Synthetic oligonucleotide
tagaagacggacctaattctttgta

SEQ ID NO: 708225 - DNA, 25 bp, Artificial sequence
  Synthetic oligonucleotide
tttgacacgctatattcggacttaa

SEQ ID NO: 708226 - DNA, 25 bp, Artificial sequence
  Synthetic oligonucleotide
tttgacacgctaaattcggacttaa

SEQ ID NO: 708227 - DNA, 25 bp, Artificial sequence
  Synthetic oligonucleotide
taaatcacgcgttatctagtatgca

SEQ ID NO: 708228 - DNA, 25 bp, Artificial sequence
  Synthetic oligonucleotide
taaatcacgcgtaatctagtatgca

SEQ ID NO: 708229 - DNA, 25 bp, Artificial sequence
  Synthetic oligonucleotide
tgaattacgcgattacgtttttgtc

SEQ ID NO: 708230 - DNA, 25 bp, Artificial sequence
  Synthetic oligonucleotide
tgaattacgcgaatacgtttttgtc

SEQ ID NO: 708231 - DNA, 25 bp, Artificial sequence
  Synthetic oligonucleotide
aacagaacgcgataacgttatagta

SEQ ID NO: 708232 - DNA, 25 bp, Artificial sequence
  Synthetic oligonucleotide
aacagaacgcgaaaacgttatagta

SEQ ID NO: 708233 - DNA, 25 bp, Artificial sequence
  Synthetic oligonucleotide
atttatacgtctagatacggtacga

SEQ ID NO: 708234 - DNA, 25 bp, Artificial sequence
  Synthetic oligonucleotide
ttactaaggtcgtttcgtagttctt

SEQ ID NO: 708235 - DNA, 25 bp, Artificial sequence
  Synthetic oligonucleotide
taatggataagtttcgcgcactaaa

SEQ ID NO: 708236 - DNA, 25 bp, Artificial sequence
  Synthetic oligonucleotide
taatggataagtatcgcgcactaaa

SEQ ID NO: 708237 - DNA, 25 bp, Artificial sequence
  Synthetic oligonucleotide
ttatcaagtatactcgcgaaagaag

SEQ ID NO: 708238 - DNA, 25 bp, Artificial sequence
  Synthetic oligonucleotide
ttatcaagtatagtcgcgaaagaag

SEQ ID NO: 708239 - DNA, 25 bp, Artificial sequence
  Synthetic oligonucleotide
tacataagtacggtcgtaagttgtt

SEQ ID NO: 708240 - DNA, 25 bp, Artificial sequence
  Synthetic oligonucleotide
tacataagtacgctcgtaagttgtt

SEQ ID NO: 708241 - DNA, 25 bp, Artificial sequence
  Synthetic oligonucleotide
agtacaagtacgttttgcgttactt

SEQ ID NO: 708242 - DNA, 25 bp, Artificial sequence
  Synthetic oligonucleotide
agtacaagtacgatttgcgttactt

SEQ ID NO: 708243 - DNA, 25 bp, Artificial sequence
  Synthetic oligonucleotide
taaaggaggtcgaatcgttaattct

SEQ ID NO: 708244 - DNA, 25 bp, Artificial sequence
  Synthetic oligonucleotide
taaaggaggtcgtatcgttaattct

SEQ ID NO: 708245 - DNA, 25 bp, Artificial sequence
  Synthetic oligonucleotide
tagaatactatcctaacggactctt

SEQ ID NO: 708246 - DNA, 25 bp, Artificial sequence
  Synthetic oligonucleotide
caaaataggtcgtaatacgcatcat

SEQ ID NO: 708247 - DNA, 25 bp, Artificial sequence
  Synthetic oligonucleotide
gtatttattaacccgctacccataa

SEQ ID NO: 708248 - DNA, 25 bp, Artificial sequence
  Synthetic oligonucleotide
ttactaaggtcgattcgtagttctt

SEQ ID NO: 708249 - DNA, 25 bp, Artificial sequence
  Synthetic oligonucleotide
tataggaggcgacgtatatagttta

SEQ ID NO: 708250 - DNA, 25 bp, Artificial sequence
  Synthetic oligonucleotide
tataggaggcgaggtatatagttta

SEQ ID NO: 708251 - DNA, 25 bp, Artificial sequence
  Synthetic oligonucleotide
aagagtagctcgcgtattagaaatt

SEQ ID NO: 708252 - DNA, 25 bp, Artificial sequence
  Synthetic oligonucleotide
aagagtagctcgggtattagaaatt

SEQ ID NO: 708253 - DNA, 25 bp, Artificial sequence
  Synthetic oligonucleotide
gttaagagcgtctatacgagaaatt

SEQ ID NO: 708254 - DNA, 25 bp, Artificial sequence
  Synthetic oligonucleotide
gttaagagcgtcaatacgagaaatt

SEQ ID NO: 708255 - DNA, 25 bp, Artificial sequence
  Synthetic oligonucleotide
cgtgaaagattaacgcacgaataat

SEQ ID NO: 708256 - DNA, 25 bp, Artificial sequence
  Synthetic oligonucleotide
cgtgaaagattatcgcacgaataat

SEQ ID NO: 708257 - DNA, 25 bp, Artificial sequence
  Synthetic oligonucleotide
caaattactattacgcgctaaatcc

SEQ ID NO: 708258 - DNA, 25 bp, Artificial sequence
  Synthetic oligonucleotide
caaaataggtcgaaatacgcatcat

SEQ ID NO: 708259 - DNA, 25 bp, Artificial sequence
  Synthetic oligonucleotide
gaaaggacttatccatcaatataaa

SEQ ID NO: 708260 - DNA, 25 bp, Artificial sequence
  Synthetic oligonucleotide
catcagaagctgatttcagtgatat

SEQ ID NO: 708261 - DNA, 25 bp, Artificial sequence
  Synthetic oligonucleotide
taaatgatttggaagtcgttcaaga

SEQ ID NO: 708262 - DNA, 25 bp, Artificial sequence
  Synthetic oligonucleotide
taaatgatttggtagtcgttcaaga

SEQ ID NO: 708263 - DNA, 25 bp, Artificial sequence
  Synthetic oligonucleotide
catatcgtgtagtagggaacggttg

SEQ ID NO: 708264 - DNA, 25 bp, Artificial sequence
  Synthetic oligonucleotide
catatcgtgtagaagggaacggttg

SEQ ID NO: 708265 - DNA, 25 bp, Artificial sequence
  Synthetic oligonucleotide
gaaaggacttatgcatcaatataaa

SEQ ID NO: 708266 - DNA, 25 bp, Artificial sequence
  Synthetic oligonucleotide
tgtaacagatcaaacaccggcgcta

SEQ ID NO: 708267 - DNA, 25 bp, Artificial sequence
  Synthetic oligonucleotide
aggaaacacaccacttattcacctg

SEQ ID NO: 708268 - DNA, 25 bp, Artificial sequence
  Synthetic oligonucleotide
tgagcagctcggaattgagcttcat

SEQ ID NO: 708269 - DNA, 25 bp, Artificial sequence
  Synthetic oligonucleotide
tgagcagctcggtattgagcttcat

SEQ ID NO: 708270 - DNA, 25 bp, Artificial sequence
  Synthetic oligonucleotide
aggcgtcaatccaacgggatcattt

SEQ ID NO: 708271 - DNA, 25 bp, Artificial sequence
  Synthetic oligonucleotide
aatggttatggcagtggcaaaggca

SEQ ID NO: 708272 - DNA, 25 bp, Artificial sequence
  Synthetic oligonucleotide
aggcgtcaatcctacgggatcattt

SEQ ID NO: 708273 - DNA, 25 bp, Artificial sequence
  Synthetic oligonucleotide
gaattcatgtaatagatgaggttgg

SEQ ID NO: 708274 - DNA, 25 bp, Artificial sequence
  Synthetic oligonucleotide
cgaacagctgggggaagcgcctgat

SEQ ID NO: 708275 - DNA, 25 bp, Artificial sequence
  Synthetic oligonucleotide
ctgtcatgaaaattatgcgcctagg

SEQ ID NO: 708276 - DNA, 25 bp, Artificial sequence
  Synthetic oligonucleotide
aatggttatggctgtggcaaaggca

SEQ ID NO: 708277 - DNA, 25 bp, Artificial sequence
  Synthetic oligonucleotide
acagctttgtcgcaccgcaatatga

SEQ ID NO: 708278 - DNA, 25 bp, Artificial sequence
  Synthetic oligonucleotide
acagctttgtcggaccgcaatatga

SEQ ID NO: 708279 - DNA, 25 bp, Artificial sequence
  Synthetic oligonucleotide
aatcgccgtctgtcatttatgcaca

SEQ ID NO: 708280 - DNA, 25 bp, Artificial sequence
  Synthetic oligonucleotide
ctgtcatgaaaaatatgcgcctagg

SEQ ID NO: 708281 - DNA, 25 bp, Artificial sequence
  Synthetic oligonucleotide
gaattcatgtaaaagatgaggttgg

SEQ ID NO: 708282 - DNA, 25 bp, Artificial sequence
  Synthetic oligonucleotide
catcagaagctgttttcagtgatat

SEQ ID NO: 708283 - DNA, 25 bp, Artificial sequence
  Synthetic oligonucleotide
aaattacatctgtgttctcagagcg

SEQ ID NO: 708284 - DNA, 25 bp, Artificial sequence
  Synthetic oligonucleotide
aaattacatctgagttctcagagcg

SEQ ID NO: 708285 - DNA, 25 bp, Artificial sequence
  Synthetic oligonucleotide
ttgaaaaaatccttcagctgccaat

SEQ ID NO: 708286 - DNA, 25 bp, Artificial sequence
  Synthetic oligonucleotide
ttgaaaaaatccatcagctgccaat

SEQ ID NO: 708287 - DNA, 25 bp, Artificial sequence
  Synthetic oligonucleotide
atgagttagctgaaatcgtaattgt

SEQ ID NO: 708288 - DNA, 25 bp, Artificial sequence
  Synthetic oligonucleotide
atgagttagctgtaatcgtaattgt

SEQ ID NO: 708289 - DNA, 25 bp, Artificial sequence
  Synthetic oligonucleotide
aatcgccgtctgacatttatgcaca

SEQ ID NO: 708290 - DNA, 25 bp, Artificial sequence
  Synthetic oligonucleotide
tgcggcggcaatggtgcgcaatgaa

SEQ ID NO: 708291 - DNA, 25 bp, Artificial sequence
  Synthetic oligonucleotide
cattgaaggccaaaaaactgctgcc

SEQ ID NO: 708292 - DNA, 25 bp, Artificial sequence
  Synthetic oligonucleotide
cccggtcggaaatgctggaaacatc

SEQ ID NO: 708293 - DNA, 25 bp, Artificial sequence
  Synthetic oligonucleotide
gaagggcttcaaggaatatcatgag

SEQ ID NO: 708294 - DNA, 25 bp, Artificial sequence
  Synthetic oligonucleotide
gaagggcttcaacgaatatcatgag

SEQ ID NO: 708295 - DNA, 25 bp, Artificial sequence
  Synthetic oligonucleotide
aggccttccgaatatgcgcggcttt

SEQ ID NO: 708296 - DNA, 25 bp, Artificial sequence
  Synthetic oligonucleotide
cgaacagctgggcgaagcgcctgat

SEQ ID NO: 708297 - DNA, 25 bp, Artificial sequence
  Synthetic oligonucleotide
tgcggcggcaatcgtgcgcaatgaa

SEQ ID NO: 708298 - DNA, 25 bp, Artificial sequence
  Synthetic oligonucleotide
cattgaaggccataaaactgctgcc

SEQ ID NO: 708299 - DNA, 25 bp, Artificial sequence
  Synthetic oligonucleotide
tccggaaacaatagcgacagccatt

SEQ ID NO: 708300 - DNA, 25 bp, Artificial sequence
  Synthetic oligonucleotide
tccggaaacaattgcgacagccatt

SEQ ID NO: 708301 - DNA, 25 bp, Artificial sequence
  Synthetic oligonucleotide
cccggcaagctgggacaaagctgta

SEQ ID NO: 708302 - DNA, 25 bp, Artificial sequence
  Synthetic oligonucleotide
cccggcaagctgcgacaaagctgta

SEQ ID NO: 708303 - DNA, 25 bp, Artificial sequence
  Synthetic oligonucleotide
tgccgacagcgacatccgttgtttc

SEQ ID NO: 708304 - DNA, 25 bp, Artificial sequence
  Synthetic oligonucleotide
tgtaacagatcatacaccggcgcta

SEQ ID NO: 708305 - DNA, 25 bp, Artificial sequence
  Synthetic oligonucleotide
aggccttccgaaaatgcgcggcttt

SEQ ID NO: 708306 - DNA, 25 bp, Artificial sequence
  Synthetic oligonucleotide
agccgagattatcgcaattgacgga

SEQ ID NO: 708307 - DNA, 25 bp, Artificial sequence
  Synthetic oligonucleotide
caatgacacgattatgtgcgcgtca

SEQ ID NO: 708308 - DNA, 25 bp, Artificial sequence
  Synthetic oligonucleotide
ttccgctgctgccgcagcatatgca

SEQ ID NO: 708309 - DNA, 25 bp, Artificial sequence
  Synthetic oligonucleotide
ttccgctgctgcggcagcatatgca

SEQ ID NO: 708310 - DNA, 25 bp, Artificial sequence
  Synthetic oligonucleotide
catgaaatgcatagtcatcatcccg

SEQ ID NO: 708311 - DNA, 25 bp, Artificial sequence
  Synthetic oligonucleotide
catgaaatgcattgtcatcatcccg

SEQ ID NO: 708312 - DNA, 25 bp, Artificial sequence
  Synthetic oligonucleotide
cccggtcggaaaagctggaaacatc

SEQ ID NO: 708313 - DNA, 25 bp, Artificial sequence
  Synthetic oligonucleotide
tgcatttggaaatctcgctcaagct

SEQ ID NO: 708314 - DNA, 25 bp, Artificial sequence
  Synthetic oligonucleotide
caatgacacgataatgtgcgcgtca

SEQ ID NO: 708315 - DNA, 25 bp, Artificial sequence
  Synthetic oligonucleotide
agccgagattatggcaattgacgga

SEQ ID NO: 708316 - DNA, 25 bp, Artificial sequence
  Synthetic oligonucleotide
tgcgcttaaaatagtccgttccatc

SEQ ID NO: 708317 - DNA, 25 bp, Artificial sequence
  Synthetic oligonucleotide
tgcgcttaaaattgtccgttccatc

SEQ ID NO: 708318 - DNA, 25 bp, Artificial sequence
  Synthetic oligonucleotide
accgattgccctagtcaactcagtc

SEQ ID NO: 708319 - DNA, 25 bp, Artificial sequence
  Synthetic oligonucleotide
accgattgcccttgtcaactcagtc

SEQ ID NO: 708320 - DNA, 25 bp, Artificial sequence
  Synthetic oligonucleotide
ggaatccaatggcaaaattgacgaa

SEQ ID NO: 708321 - DNA, 25 bp, Artificial sequence
  Synthetic oligonucleotide
tgcatttggaaaactcgctcaagct

SEQ ID NO: 708322 - DNA, 25 bp, Artificial sequence
  Synthetic oligonucleotide
tgtatgatgtcattgatgatccaga

SEQ ID NO: 708323 - DNA, 25 bp, Artificial sequence
  Synthetic oligonucleotide
gataagcttatggatcaggtcggct

SEQ ID NO: 708324 - DNA, 25 bp, Artificial sequence
  Synthetic oligonucleotide
gataagcttatgcatcaggtcggct

SEQ ID NO: 708325 - DNA, 25 bp, Artificial sequence
  Synthetic oligonucleotide
aaaaagtgcttgtaaaagatttaga

SEQ ID NO: 708326 - DNA, 25 bp, Artificial sequence
  Synthetic oligonucleotide
aaaaagtgcttgaaaaagatttaga

SEQ ID NO: 708327 - DNA, 25 bp, Artificial sequence
  Synthetic oligonucleotide
aagtagatttgcggaaggaagtgct

SEQ ID NO: 708328 - DNA, 25 bp, Artificial sequence
  Synthetic oligonucleotide
gctccgagctgcttgccgaagcgaa

SEQ ID NO: 708329 - DNA, 25 bp, Artificial sequence
  Synthetic oligonucleotide
tgtatgatgtcaatgatgatccaga

SEQ ID NO: 708330 - DNA, 25 bp, Artificial sequence
  Synthetic oligonucleotide
gcgattcgtgtacggcttttaggtt

SEQ ID NO: 708331 - DNA, 25 bp, Artificial sequence
  Synthetic oligonucleotide
tcatcgaggtgaacggcggcgttga

SEQ ID NO: 708332 - DNA, 25 bp, Artificial sequence
  Synthetic oligonucleotide
tcatcgaggtgatcggcggcgttga

SEQ ID NO: 708333 - DNA, 25 bp, Artificial sequence
  Synthetic oligonucleotide
aatatttggtcgtcgcgctgagatc

SEQ ID NO: 708334 - DNA, 25 bp, Artificial sequence
  Synthetic oligonucleotide
aatatttggtcgacgcgctgagatc

SEQ ID NO: 708335 - DNA, 25 bp, Artificial sequence
  Synthetic oligonucleotide
ttgtcacagcaatcaaggacttaat

SEQ ID NO: 708336 - DNA, 25 bp, Artificial sequence
  Synthetic oligonucleotide
ttgtcacagcaaacaaggacttaat

SEQ ID NO: 708337 - DNA, 25 bp, Artificial sequence
  Synthetic oligonucleotide
aagtagatttgccgaaggaagtgct

SEQ ID NO: 708338 - DNA, 25 bp, Artificial sequence
  Synthetic oligonucleotide
caaaacaggagccggcttatataat

SEQ ID NO: 708339 - DNA, 25 bp, Artificial sequence
  Synthetic oligonucleotide
aggaaacacacctcttattcacctg

SEQ ID NO: 708340 - DNA, 25 bp, Artificial sequence
  Synthetic oligonucleotide
tgccgacagcgagatccgttgtttc

SEQ ID NO: 708341 - DNA, 25 bp, Artificial sequence
  Synthetic oligonucleotide
ggaatccaatgggaaaattgacgaa

SEQ ID NO: 708342 - DNA, 25 bp, Artificial sequence
  Synthetic oligonucleotide
ctcaaggtgaggagaaaatctgaca

SEQ ID NO: 708343 - DNA, 25 bp, Artificial sequence
  Synthetic oligonucleotide
ctcaaggtgaggtgaaaatctgaca

SEQ ID NO: 708344 - DNA, 25 bp, Artificial sequence
  Synthetic oligonucleotide
aaaataaagaatgttgtcatatcaa

SEQ ID NO: 708345 - DNA, 25 bp, Artificial sequence
  Synthetic oligonucleotide
ggaagcggtgtccttaaaattattc

SEQ ID NO: 708346 - DNA, 25 bp, Artificial sequence
  Synthetic oligonucleotide
caaaacaggagcgggcttatataat

SEQ ID NO: 708347 - DNA, 25 bp, Artificial sequence
  Synthetic oligonucleotide
ggaagcggtgtcgttaaaattattc

SEQ ID NO: 708348 - DNA, 25 bp, Artificial sequence
  Synthetic oligonucleotide
atatgtctgtgtagagttaacaatt

SEQ ID NO: 708349 - DNA, 25 bp, Artificial sequence
  Synthetic oligonucleotide
atatgtctgtgttgagttaacaatt

SEQ ID NO: 708350 - DNA, 25 bp, Artificial sequence
  Synthetic oligonucleotide
gaggacaatcaatagaaaggtggag

SEQ ID NO: 708351 - DNA, 25 bp, Artificial sequence
  Synthetic oligonucleotide
gaggacaatcaaaagaaaggtggag

SEQ ID NO: 708352 - DNA, 25 bp, Artificial sequence
  Synthetic oligonucleotide
gcgattcgtgtagggcttttaggtt

SEQ ID NO: 708353 - DNA, 25 bp, Artificial sequence
  Synthetic oligonucleotide
tttacattcgcataattcagcctaa

SEQ ID NO: 708354 - DNA, 25 bp, Artificial sequence
  Synthetic oligonucleotide
tttacattcgcaaaattcagcctaa

SEQ ID NO: 708355 - DNA, 25 bp, Artificial sequence
  Synthetic oligonucleotide
ttcctgaccatcatccgctttctgc

SEQ ID NO: 708356 - DNA, 25 bp, Artificial sequence
  Synthetic oligonucleotide
tggaagacgtcaaagtaaaggggat

SEQ ID NO: 708357 - DNA, 25 bp, Artificial sequence
  Synthetic oligonucleotide
tggaagacgtcatagtaaaggggat

SEQ ID NO: 708358 - DNA, 25 bp, Artificial sequence
  Synthetic oligonucleotide
cagacgaggacaacagcttcagcaa

SEQ ID NO: 708359 - DNA, 25 bp, Artificial sequence
  Synthetic oligonucleotide
cagacgaggacatcagcttcagcaa

SEQ ID NO: 708360 - DNA, 25 bp, Artificial sequence
  Synthetic oligonucleotide
atacaatgaagcagatcgggattgc

SEQ ID NO: 708361 - DNA, 25 bp, Artificial sequence
  Synthetic oligonucleotide
atacaatgaagctgatcgggattgc

SEQ ID NO: 708362 - DNA, 25 bp, Artificial sequence
  Synthetic oligonucleotide
tattggcgcgcctcggcttctcgat

SEQ ID NO: 708363 - DNA, 25 bp, Artificial sequence
  Synthetic oligonucleotide
gcagcaaaatcgaggtcagcgtaca

SEQ ID NO: 708364 - DNA, 25 bp, Artificial sequence
  Synthetic oligonucleotide
ttcctgaccatcttccgctttctgc

SEQ ID NO: 708365 - DNA, 25 bp, Artificial sequence
  Synthetic oligonucleotide
gctccgagctgcatgccgaagcgaa

SEQ ID NO: 708366 - DNA, 25 bp, Artificial sequence
  Synthetic oligonucleotide
aaaataaagaatcttgtcatatcaa

SEQ ID NO: 708367 - DNA, 25 bp, Artificial sequence
  Synthetic oligonucleotide
agtttaacgctgtttatgtatacgg

SEQ ID NO: 708368 - DNA, 25 bp, Artificial sequence
  Synthetic oligonucleotide
agtttaacgctgattatgtatacgg

SEQ ID NO: 708369 - DNA, 25 bp, Artificial sequence
  Synthetic oligonucleotide
gtgagacgatgttctacgggccggg

SEQ ID NO: 708370 - DNA, 25 bp, Artificial sequence
  Synthetic oligonucleotide
gtgagacgatgtactacgggccggg

SEQ ID NO: 708371 - DNA, 25 bp, Artificial sequence
  Synthetic oligonucleotide
gcagcaaaatcgtggtcagcgtaca

SEQ ID NO: 708372 - DNA, 25 bp, Artificial sequence
  Synthetic oligonucleotide
cagatcgaattagaaaaatgatggg

SEQ ID NO: 708373 - DNA, 25 bp, Artificial sequence
  Synthetic oligonucleotide
ttccgattctgcgcacgttagagga

SEQ ID NO: 708374 - DNA, 25 bp, Artificial sequence
  Synthetic oligonucleotide
tattggcgcgccacggcttctcgat

SEQ ID NO: 708375 - DNA, 25 bp, Artificial sequence
  Synthetic oligonucleotide
cagatcgaattacaaaaatgatggg

SEQ ID NO: 708376 - DNA, 25 bp, Artificial sequence
  Synthetic oligonucleotide
gcgatatctactatgaagccagtgt

SEQ ID NO: 708377 - DNA, 25 bp, Artificial sequence
  Synthetic oligonucleotide
ttccgattctgcccacgttagagga

SEQ ID NO: 708378 - DNA, 25 bp, Artificial sequence
  Synthetic oligonucleotide
gcacaacaaactttatcttaaccaa

SEQ ID NO: 708379 - DNA, 25 bp, Artificial sequence
  Synthetic oligonucleotide
gcgatatctactttgaagccagtgt

SEQ ID NO: 708380 - DNA, 25 bp, Artificial sequence
  Synthetic oligonucleotide
gcacaacaaactatatcttaaccaa

SEQ ID NO: 708381 - DNA, 25 bp, Artificial sequence
  Synthetic oligonucleotide
agaaaagcccattcgaggaagtgct

SEQ ID NO: 708382 - DNA, 25 bp, Artificial sequence
  Synthetic oligonucleotide
agaaaagcccatacgaggaagtgct

SEQ ID NO: 708383 - DNA, 25 bp, Artificial sequence
  Synthetic oligonucleotide
aggatctcggttttgccgaagctga

SEQ ID NO: 708384 - DNA, 25 bp, Artificial sequence
  Synthetic oligonucleotide
aggatctcggttatgccgaagctga

SEQ ID NO: 708385 - DNA, 25 bp, Artificial sequence
  Synthetic oligonucleotide
acgtggaagggcatgacgccgcacg

SEQ ID NO: 708386 - DNA, 25 bp, Artificial sequence
  Synthetic oligonucleotide
acgtggaagggcttgacgccgcacg

SEQ ID NO: 708387 - DNA, 25 bp, Artificial sequence
  Synthetic oligonucleotide
agctgacaagtctcaaagctgatca

SEQ ID NO: 708388 - DNA, 25 bp, Artificial sequence
  Synthetic oligonucleotide
ttgatgaccgagtaaaaacagagca

SEQ ID NO: 708389 - DNA, 25 bp, Artificial sequence
  Synthetic oligonucleotide
aacctgttgaagtgcaaggcctctc

SEQ ID NO: 708390 - DNA, 25 bp, Artificial sequence
  Synthetic oligonucleotide
aacctgttgaagagcaaggcctctc

SEQ ID NO: 708391 - DNA, 25 bp, Artificial sequence
  Synthetic oligonucleotide
acggcaaagggcagacgagaggtgc

SEQ ID NO: 708392 - DNA, 25 bp, Artificial sequence
  Synthetic oligonucleotide
ctaatttaactgtaacagatgatgc

SEQ ID NO: 708393 - DNA, 25 bp, Artificial sequence
  Synthetic oligonucleotide
acggcaaagggctgacgagaggtgc

SEQ ID NO: 708394 - DNA, 25 bp, Artificial sequence
  Synthetic oligonucleotide
ctttttctcctgacggcaaatggct

SEQ ID NO: 708395 - DNA, 25 bp, Artificial sequence
  Synthetic oligonucleotide
ttgtgcttgtcagcgtaaagtcggg

SEQ ID NO: 708396 - DNA, 25 bp, Artificial sequence
  Synthetic oligonucleotide
ctaatttaactgaaacagatgatgc

SEQ ID NO: 708397 - DNA, 25 bp, Artificial sequence
  Synthetic oligonucleotide
agctgacaagtcacaaagctgatca

SEQ ID NO: 708398 - DNA, 25 bp, Artificial sequence
  Synthetic oligonucleotide
atgatgtttacataatgtcactgga

SEQ ID NO: 708399 - DNA, 25 bp, Artificial sequence
  Synthetic oligonucleotide
atgatgtttacaaaatgtcactgga

SEQ ID NO: 708400 - DNA, 25 bp, Artificial sequence
  Synthetic oligonucleotide
ctttttctcctgtcggcaaatggct

SEQ ID NO: 708401 - DNA, 25 bp, Artificial sequence
  Synthetic oligonucleotide
ttgatgaccgagaaaaaacagagca

SEQ ID NO: 708402 - DNA, 25 bp, Artificial sequence
  Synthetic oligonucleotide
ttgtgcttgtcaccgtaaagtcggg

SEQ ID NO: 708403 - DNA, 25 bp, Artificial sequence
  Synthetic oligonucleotide
ggcgcacgcttggctttatttctga

SEQ ID NO: 708404 - DNA, 25 bp, Artificial sequence
  Synthetic oligonucleotide
cccgtgccgcatatgtaaaatcaca

SEQ ID NO: 708405 - DNA, 25 bp, Artificial sequence
  Synthetic oligonucleotide
agaaagattcgtatacatcaaatat

SEQ ID NO: 708406 - DNA, 25 bp, Artificial sequence
  Synthetic oligonucleotide
agaaagattcgtttacatcaaatat

SEQ ID NO: 708407 - DNA, 25 bp, Artificial sequence
  Synthetic oligonucleotide
cgaaaacgggaggatctgttccttg

SEQ ID NO: 708408 - DNA, 25 bp, Artificial sequence
  Synthetic oligonucleotide
gcgcgaatgacaagtttgtcaggga

SEQ ID NO: 708409 - DNA, 25 bp, Artificial sequence
  Synthetic oligonucleotide
ttaagcaggttagacctcatcgcgg

SEQ ID NO: 708410 - DNA, 25 bp, Artificial sequence
  Synthetic oligonucleotide
cgaaaacgggagcatctgttccttg

SEQ ID NO: 708411 - DNA, 25 bp, Artificial sequence
  Synthetic oligonucleotide
ggcgcacgcttgcctttatttctga

SEQ ID NO: 708412 - DNA, 25 bp, Artificial sequence
  Synthetic oligonucleotide
aaaagcgaagcagcgacccaagatg

SEQ ID NO: 708413 - DNA, 25 bp, Artificial sequence
  Synthetic oligonucleotide
ttctggtcactatcagtttgggaga

SEQ ID NO: 708414 - DNA, 25 bp, Artificial sequence
  Synthetic oligonucleotide
atgcggcacagctttatatcatgag

SEQ ID NO: 708415 - DNA, 25 bp, Artificial sequence
  Synthetic oligonucleotide
atgcggcacagcattatatcatgag

SEQ ID NO: 708416 - DNA, 25 bp, Artificial sequence
  Synthetic oligonucleotide
gagaagcaagaaaactgactgatat

SEQ ID NO: 708417 - DNA, 25 bp, Artificial sequence
  Synthetic oligonucleotide
gagaagcaagaatactgactgatat

SEQ ID NO: 708418 - DNA, 25 bp, Artificial sequence
  Synthetic oligonucleotide
tgtcaaagccgcaatggtccccgga

SEQ ID NO: 708419 - DNA, 25 bp, Artificial sequence
  Synthetic oligonucleotide
tgtcaaagccgctatggtccccgga

SEQ ID NO: 708420 - DNA, 25 bp, Artificial sequence
  Synthetic oligonucleotide
ttctggtcactaacagtttgggaga

SEQ ID NO: 708421 - DNA, 25 bp, Artificial sequence
  Synthetic oligonucleotide
aaaagcgaagcaccgacccaagatg

SEQ ID NO: 708422 - DNA, 25 bp, Artificial sequence
  Synthetic oligonucleotide
aaatggaaggtgtgacaacatatcc

SEQ ID NO: 708423 - DNA, 25 bp, Artificial sequence
  Synthetic oligonucleotide
gtatcccgcttggacaggaagagaa

SEQ ID NO: 708424 - DNA, 25 bp, Artificial sequence
  Synthetic oligonucleotide
gtgtgacaaagccggacagaccgag

SEQ ID NO: 708425 - DNA, 25 bp, Artificial sequence
  Synthetic oligonucleotide
gtatcccgcttgcacaggaagagaa

SEQ ID NO: 708426 - DNA, 25 bp, Artificial sequence
  Synthetic oligonucleotide
gcgcgaatgacatgtttgtcaggga

SEQ ID NO: 708427 - DNA, 25 bp, Artificial sequence
  Synthetic oligonucleotide
caatacctgaagtgattcaatatgc

SEQ ID NO: 708428 - DNA, 25 bp, Artificial sequence
  Synthetic oligonucleotide
caatacctgaagagattcaatatgc

SEQ ID NO: 708429 - DNA, 25 bp, Artificial sequence
  Synthetic oligonucleotide
gcgtgatggtgaacggctggctgat

SEQ ID NO: 708430 - DNA, 25 bp, Artificial sequence
  Synthetic oligonucleotide
tttctctttcacctgatgaacagca

SEQ ID NO: 708431 - DNA, 25 bp, Artificial sequence
  Synthetic oligonucleotide
aaatggaaggtgagacaacatatcc

SEQ ID NO: 708432 - DNA, 25 bp, Artificial sequence
  Synthetic oligonucleotide
tttctctttcacgtgatgaacagca

SEQ ID NO: 708433 - DNA, 25 bp, Artificial sequence
  Synthetic oligonucleotide
acatacacggcgctccgcatatgat

SEQ ID NO: 708434 - DNA, 25 bp, Artificial sequence
  Synthetic oligonucleotide
acatacacggcggtccgcatatgat

SEQ ID NO: 708435 - DNA, 25 bp, Artificial sequence
  Synthetic oligonucleotide
catattttcatgagtttcaggtgct

SEQ ID NO: 708436 - DNA, 25 bp, Artificial sequence
  Synthetic oligonucleotide
catattttcatgtgtttcaggtgct

SEQ ID NO: 708437 - DNA, 25 bp, Artificial sequence
  Synthetic oligonucleotide
gatacgcggtcgtttatatcaatcc

SEQ ID NO: 708438 - DNA, 25 bp, Artificial sequence
  Synthetic oligonucleotide
gatacgcggtcgattatatcaatcc

SEQ ID NO: 708439 - DNA, 25 bp, Artificial sequence
  Synthetic oligonucleotide
cccgtgccgcatttgtaaaatcaca

SEQ ID NO: 708440 - DNA, 25 bp, Artificial sequence
  Synthetic oligonucleotide
acccaaatgatcggcgtcccgaatg

SEQ ID NO: 708441 - DNA, 25 bp, Artificial sequence
  Synthetic oligonucleotide
gcgtgatggtgatcggctggctgat

SEQ ID NO: 708442 - DNA, 25 bp, Artificial sequence
  Synthetic oligonucleotide
tagcggatgcgcagattggagattc

SEQ ID NO: 708443 - DNA, 25 bp, Artificial sequence
  Synthetic oligonucleotide
caagctcattttcaccagacggaag

SEQ ID NO: 708444 - DNA, 25 bp, Artificial sequence
  Synthetic oligonucleotide
caagctcattttgaccagacggaag

SEQ ID NO: 708445 - DNA, 25 bp, Artificial sequence
  Synthetic oligonucleotide
tgcttggaaatgaaaaggaatataa

SEQ ID NO: 708446 - DNA, 25 bp, Artificial sequence
  Synthetic oligonucleotide
tgcttggaaatgtaaaggaatataa

SEQ ID NO: 708447 - DNA, 25 bp, Artificial sequence
  Synthetic oligonucleotide
tctcaaaggcgtggctctatgatat

SEQ ID NO: 708448 - DNA, 25 bp, Artificial sequence
  Synthetic oligonucleotide
tctcaaaggcgtcgctctatgatat

SEQ ID NO: 708449 - DNA, 25 bp, Artificial sequence
  Synthetic oligonucleotide
gcctcacatgtcttactgagatgct

SEQ ID NO: 708450 - DNA, 25 bp, Artificial sequence
  Synthetic oligonucleotide
gtgtgacaaagcgggacagaccgag

SEQ ID NO: 708451 - DNA, 25 bp, Artificial sequence
  Synthetic oligonucleotide
tagcggatgcgctgattggagattc

SEQ ID NO: 708452 - DNA, 25 bp, Artificial sequence
  Synthetic oligonucleotide
ttaagcaggttacacctcatcgcgg

SEQ ID NO: 708453 - DNA, 25 bp, Artificial sequence
  Synthetic oligonucleotide
gtgctgaacagcgcccgatttggac

SEQ ID NO: 708454 - DNA, 25 bp, Artificial sequence
  Synthetic oligonucleotide
gtgctgaacagcccccgatttggac

SEQ ID NO: 708455 - DNA, 25 bp, Artificial sequence
  Synthetic oligonucleotide
aagggttttatgtcatcggcacaga

SEQ ID NO: 708456 - DNA, 25 bp, Artificial sequence
  Synthetic oligonucleotide
aagggttttatgacatcggcacaga

SEQ ID NO: 708457 - DNA, 25 bp, Artificial sequence
  Synthetic oligonucleotide
cgggcatctattttatttcgattga

SEQ ID NO: 708458 - DNA, 25 bp, Artificial sequence
  Synthetic oligonucleotide
cgggcatctattatatttcgattga

SEQ ID NO: 708459 - DNA, 25 bp, Artificial sequence
  Synthetic oligonucleotide
atccgattcgtctggaaaaagagta

SEQ ID NO: 708460 - DNA, 25 bp, Artificial sequence
  Synthetic oligonucleotide
atccgattcgtcaggaaaaagagta

SEQ ID NO: 708461 - DNA, 25 bp, Artificial sequence
  Synthetic oligonucleotide
gcctcacatgtcatactgagatgct

SEQ ID NO: 708462 - DNA, 25 bp, Artificial sequence
  Synthetic oligonucleotide
accgcagatttgtacggaaaagaaa

SEQ ID NO: 708463 - DNA, 25 bp, Artificial sequence
  Synthetic oligonucleotide
tttgattcagtccgaatggcgctca

SEQ ID NO: 708464 - DNA, 25 bp, Artificial sequence
  Synthetic oligonucleotide
aagctgaccgtcattgaaagcgaca

SEQ ID NO: 708465 - DNA, 25 bp, Artificial sequence
  Synthetic oligonucleotide
aagctgaccgtctttgaaagcgaca

SEQ ID NO: 708466 - DNA, 25 bp, Artificial sequence
  Synthetic oligonucleotide
gaggctgaaacagaaacagtcgccg

SEQ ID NO: 708467 - DNA, 25 bp, Artificial sequence
  Synthetic oligonucleotide
gaggctgaaacacaaacagtcgccg

SEQ ID NO: 708468 - DNA, 25 bp, Artificial sequence
  Synthetic oligonucleotide
ggtacagataacctgatctaccaag

SEQ ID NO: 708469 - DNA, 25 bp, Artificial sequence
  Synthetic oligonucleotide
tctgaagcggactagctgcatttag

SEQ ID NO: 708470 - DNA, 25 bp, Artificial sequence
  Synthetic oligonucleotide
accgcagatttgaacggaaaagaaa

SEQ ID NO: 708471 - DNA, 25 bp, Artificial sequence
  Synthetic oligonucleotide
tctctgtgaccgttcctcaatacgc

SEQ ID NO: 708472 - DNA, 25 bp, Artificial sequence
  Synthetic oligonucleotide
catgtgaaggtgaggagcgacatcc

SEQ ID NO: 708473 - DNA, 25 bp, Artificial sequence
  Synthetic oligonucleotide
catgtgaaggtgtggagcgacatcc

SEQ ID NO: 708474 - DNA, 25 bp, Artificial sequence
  Synthetic oligonucleotide
ggccttggcagctgcgccgcagcga

SEQ ID NO: 708475 - DNA, 25 bp, Artificial sequence
  Synthetic oligonucleotide
ggccttggcagcagcgccgcagcga

SEQ ID NO: 708476 - DNA, 25 bp, Artificial sequence
  Synthetic oligonucleotide
attgaactggctcatgaattatgcg

SEQ ID NO: 708477 - DNA, 25 bp, Artificial sequence
  Synthetic oligonucleotide
attgaactggctgatgaattatgcg

SEQ ID NO: 708478 - DNA, 25 bp, Artificial sequence
  Synthetic oligonucleotide
tctgaagcggacaagctgcatttag

SEQ ID NO: 708479 - DNA, 25 bp, Artificial sequence
  Synthetic oligonucleotide
ggtacagataacgtgatctaccaag

SEQ ID NO: 708480 - DNA, 25 bp, Artificial sequence
  Synthetic oligonucleotide
aggaaacggactcaaagatccgaac

SEQ ID NO: 708481 - DNA, 25 bp, Artificial sequence
  Synthetic oligonucleotide
tgaaatccttcacgcatatcagctg

SEQ ID NO: 708482 - DNA, 25 bp, Artificial sequence
  Synthetic oligonucleotide
tgaaatccttcaggcatatcagctg

SEQ ID NO: 708483 - DNA, 25 bp, Artificial sequence
  Synthetic oligonucleotide
agaaggcgtgtttgcagaaccaggt

SEQ ID NO: 708484 - DNA, 25 bp, Artificial sequence
  Synthetic oligonucleotide
agaaggcgtgttagcagaaccaggt

SEQ ID NO: 708485 - DNA, 25 bp, Artificial sequence
  Synthetic oligonucleotide
tatcgcaggagtcctgaaacaggtg

SEQ ID NO: 708486 - DNA, 25 bp, Artificial sequence
  Synthetic oligonucleotide
tatcgcaggagtgctgaaacaggtg

SEQ ID NO: 708487 - DNA, 25 bp, Artificial sequence
  Synthetic oligonucleotide
aattccgaaagggagcaaggtcgta

SEQ ID NO: 708488 - DNA, 25 bp, Artificial sequence
  Synthetic oligonucleotide
tttgattcagtcggaatggcgctca

SEQ ID NO: 708489 - DNA, 25 bp, Artificial sequence
  Synthetic oligonucleotide
aggaaacggactgaaagatccgaac

SEQ ID NO: 708490 - DNA, 25 bp, Artificial sequence
  Synthetic oligonucleotide
actgttcccggaagcacagctaacc

SEQ ID NO: 708491 - DNA, 25 bp, Artificial sequence
  Synthetic oligonucleotide
catttcagaaatgaagcctgtcaca

SEQ ID NO: 708492 - DNA, 25 bp, Artificial sequence
  Synthetic oligonucleotide
catttcagaaatcaagcctgtcaca

SEQ ID NO: 708493 - DNA, 25 bp, Artificial sequence
  Synthetic oligonucleotide
tgaagacagcatgcttgaatatgta

SEQ ID NO: 708494 - DNA, 25 bp, Artificial sequence
  Synthetic oligonucleotide
tgaagacagcatccttgaatatgta

SEQ ID NO: 708495 - DNA, 25 bp, Artificial sequence
  Synthetic oligonucleotide
gtagtcgttgtctttcctttttatg

SEQ ID NO: 708496 - DNA, 25 bp, Artificial sequence
  Synthetic oligonucleotide
ccgtgtatgaacgaagccgacatgc

SEQ ID NO: 708497 - DNA, 25 bp, Artificial sequence
  Synthetic oligonucleotide
actgttcccggatgcacagctaacc

SEQ ID NO: 708498 - DNA, 25 bp, Artificial sequence
  Synthetic oligonucleotide
aattccgaaaggcagcaaggtcgta

SEQ ID NO: 708499 - DNA, 25 bp, Artificial sequence
  Synthetic oligonucleotide
cttttttttgctggagataaaggag

SEQ ID NO: 708500 - DNA, 25 bp, Artificial sequence
  Synthetic oligonucleotide
gtcatgaccgaaaaaggaaagggag

SEQ ID NO: 708501 - DNA, 25 bp, Artificial sequence
  Synthetic oligonucleotide
gtcatgaccgaataaggaaagggag

SEQ ID NO: 708502 - DNA, 25 bp, Artificial sequence
  Synthetic oligonucleotide
gaacagctcgcggttcatttccctc

SEQ ID NO: 708503 - DNA, 25 bp, Artificial sequence
  Synthetic oligonucleotide
gaacagctcgcgcttcatttccctc

SEQ ID NO: 708504 - DNA, 25 bp, Artificial sequence
  Synthetic oligonucleotide
gacgctttgaccgttccgaaagagg

SEQ ID NO: 708505 - DNA, 25 bp, Artificial sequence
  Synthetic oligonucleotide
gacgctttgacccttccgaaagagg

SEQ ID NO: 708506 - DNA, 25 bp, Artificial sequence
  Synthetic oligonucleotide
gagcgaaatcctttatatcaagtaa

SEQ ID NO: 708507 - DNA, 25 bp, Artificial sequence
  Synthetic oligonucleotide
ggaacggctctctgcggagcaggcc

SEQ ID NO: 708508 - DNA, 25 bp, Artificial sequence
  Synthetic oligonucleotide
atcatgccaagccttcctcagcgtc

SEQ ID NO: 708509 - DNA, 25 bp, Artificial sequence
  Synthetic oligonucleotide
atcatgccaagcgttcctcagcgtc

SEQ ID NO: 708510 - DNA, 25 bp, Artificial sequence
  Synthetic oligonucleotide
aacgaaatacatctaaaaaggagga

SEQ ID NO: 708511 - DNA, 25 bp, Artificial sequence
  Synthetic oligonucleotide
aacgaaatacatgtaaaaaggagga

SEQ ID NO: 708512 - DNA, 25 bp, Artificial sequence
  Synthetic oligonucleotide
aaaagctgataagcgcagacgacat

SEQ ID NO: 708513 - DNA, 25 bp, Artificial sequence
  Synthetic oligonucleotide
aaaagctgataaccgcagacgacat

SEQ ID NO: 708514 - DNA, 25 bp, Artificial sequence
  Synthetic oligonucleotide
tctctgtgaccgatcctcaatacgc

SEQ ID NO: 708515 - DNA, 25 bp, Artificial sequence
  Synthetic oligonucleotide
gaaggacacccggacaatgctggcg

SEQ ID NO: 708516 - DNA, 25 bp, Artificial sequence
  Synthetic oligonucleotide
ccgtgtatgaaccaagccgacatgc

SEQ ID NO: 708517 - DNA, 25 bp, Artificial sequence
  Synthetic oligonucleotide
gagcgaaatcctatatatcaagtaa

SEQ ID NO: 708518 - DNA, 25 bp, Artificial sequence
  Synthetic oligonucleotide
agagacgcgagacacgtgcttccga

SEQ ID NO: 708519 - DNA, 25 bp, Artificial sequence
  Synthetic oligonucleotide
gaaggacacccgcacaatgctggcg

SEQ ID NO: 708520 - DNA, 25 bp, Artificial sequence
  Synthetic oligonucleotide
cttttttttgctcgagataaaggag

SEQ ID NO: 708521 - DNA, 25 bp, Artificial sequence
  Synthetic oligonucleotide
ggaacggctctcagcggagcaggcc

SEQ ID NO: 708522 - DNA, 25 bp, Artificial sequence
  Synthetic oligonucleotide
ggcggacttgtgttcggcctgcatg

SEQ ID NO: 708523 - DNA, 25 bp, Artificial sequence
  Synthetic oligonucleotide
acccaaatgatccgcgtcccgaatg

SEQ ID NO: 708524 - DNA, 25 bp, Artificial sequence
  Synthetic oligonucleotide
agagacgcgagagacgtgcttccga

SEQ ID NO: 708525 - DNA, 25 bp, Artificial sequence
  Synthetic oligonucleotide
ggcggacttgtgatcggcctgcatg

SEQ ID NO: 708526 - DNA, 25 bp, Artificial sequence
  Synthetic oligonucleotide
tatgccgatgccctaaaagcaagtg

SEQ ID NO: 708527 - DNA, 25 bp, Artificial sequence
  Synthetic oligonucleotide
tatgccgatgccgtaaaagcaagtg

SEQ ID NO: 708528 - DNA, 25 bp, Artificial sequence
  Synthetic oligonucleotide
cagccgtaccgggcgatgcttgtgc

SEQ ID NO: 708529 - DNA, 25 bp, Artificial sequence
  Synthetic oligonucleotide
atcctcattgctccgatcatgtcca

SEQ ID NO: 708530 - DNA, 25 bp, Artificial sequence
  Synthetic oligonucleotide
atcctcattgctgcgatcatgtcca

SEQ ID NO: 708531 - DNA, 25 bp, Artificial sequence
  Synthetic oligonucleotide
cttgtcgggaaaatcatgaagaagg

SEQ ID NO: 708532 - DNA, 25 bp, Artificial sequence
  Synthetic oligonucleotide
cttgtcgggaaattcatgaagaagg

SEQ ID NO: 708533 - DNA, 25 bp, Artificial sequence
  Synthetic oligonucleotide
cagccgtaccggccgatgcttgtgc

SEQ ID NO: 708534 - DNA, 25 bp, Artificial sequence
  Synthetic oligonucleotide
gtagtcgttgtcattcctttttatg

SEQ ID NO: 708535 - DNA, 25 bp, Artificial sequence
  Synthetic oligonucleotide
aaagtagagcacgtcgccgagatga

SEQ ID NO: 708536 - DNA, 25 bp, Artificial sequence
  Synthetic oligonucleotide
aaagtagagcacctcgccgagatga

SEQ ID NO: 708537 - DNA, 25 bp, Artificial sequence
  Synthetic oligonucleotide
ctaaaagaagtggtgaactggatga

SEQ ID NO: 708538 - DNA, 25 bp, Artificial sequence
  Synthetic oligonucleotide
ctaaaagaagtgctgaactggatga

SEQ ID NO: 708539 - DNA, 25 bp, Artificial sequence
  Synthetic oligonucleotide
gatcaggacagcaaatctctttaca

SEQ ID NO: 708540 - DNA, 25 bp, Artificial sequence
  Synthetic oligonucleotide
gatcaggacagctaatctctttaca

SEQ ID NO: 708541 - DNA, 25 bp, Artificial sequence
  Synthetic oligonucleotide
acaattaaagaagagcagggccgtt

SEQ ID NO: 708542 - DNA, 25 bp, Artificial sequence
  Synthetic oligonucleotide
tccagatattcgattatcggcctga

SEQ ID NO: 708543 - DNA, 25 bp, Artificial sequence
  Synthetic oligonucleotide
tatcttcttgaatgcaaggacgata

SEQ ID NO: 708544 - DNA, 25 bp, Artificial sequence
  Synthetic oligonucleotide
aaaatcaaaacacctgagcttggca

SEQ ID NO: 708545 - DNA, 25 bp, Artificial sequence
  Synthetic oligonucleotide
tccagatattcgtttatcggcctga

SEQ ID NO: 708546 - DNA, 25 bp, Artificial sequence
  Synthetic oligonucleotide
acaattaaagaacagcagggccgtt

SEQ ID NO: 708547 - DNA, 25 bp, Artificial sequence
  Synthetic oligonucleotide
aaaatcaaaacagctgagcttggca

SEQ ID NO: 708548 - DNA, 25 bp, Artificial sequence
  Synthetic oligonucleotide
ggcggagctgtcgggtacttaagct

SEQ ID NO: 708549 - DNA, 25 bp, Artificial sequence
  Synthetic oligonucleotide
ggcggagctgtccggtacttaagct

SEQ ID NO: 708550 - DNA, 25 bp, Artificial sequence
  Synthetic oligonucleotide
ccgctgattgagccttctgttcctt

SEQ ID NO: 708551 - DNA, 25 bp, Artificial sequence
  Synthetic oligonucleotide
ccgctgattgaggcttctgttcctt

SEQ ID NO: 708552 - DNA, 25 bp, Artificial sequence
  Synthetic oligonucleotide
gaaacagacatgcaaaagtgtatgc

SEQ ID NO: 708553 - DNA, 25 bp, Artificial sequence
  Synthetic oligonucleotide
cggacattaattccgtatgatcatg

SEQ ID NO: 708554 - DNA, 25 bp, Artificial sequence
  Synthetic oligonucleotide
cggacattaattgcgtatgatcatg

SEQ ID NO: 708555 - DNA, 25 bp, Artificial sequence
  Synthetic oligonucleotide
tatcttcttgaaagcaaggacgata

SEQ ID NO: 708556 - DNA, 25 bp, Artificial sequence
  Synthetic oligonucleotide
aaaaaatactgaattgtaatacgat

SEQ ID NO: 708557 - DNA, 25 bp, Artificial sequence
  Synthetic oligonucleotide
gaaacagacatggaaaagtgtatgc

SEQ ID NO: 708558 - DNA, 25 bp, Artificial sequence
  Synthetic oligonucleotide
tctcatgccatcttctcattctcct

SEQ ID NO: 708559 - DNA, 25 bp, Artificial sequence
  Synthetic oligonucleotide
gtccactttatcgaatatgcaaggc

SEQ ID NO: 708560 - DNA, 25 bp, Artificial sequence
  Synthetic oligonucleotide
atgcttgaaaacttcattaaacaaa

SEQ ID NO: 708561 - DNA, 25 bp, Artificial sequence
  Synthetic oligonucleotide
aaaaaatactgatttgtaatacgat

SEQ ID NO: 708562 - DNA, 25 bp, Artificial sequence
  Synthetic oligonucleotide
agaaatacacaagagtgtgtataaa

SEQ ID NO: 708563 - DNA, 25 bp, Artificial sequence
  Synthetic oligonucleotide
gagttgagttagtgaatagggtagc

SEQ ID NO: 708564 - DNA, 25 bp, Artificial sequence
  Synthetic oligonucleotide
gagttgagttagagaatagggtagc

SEQ ID NO: 708565 - DNA, 25 bp, Artificial sequence
  Synthetic oligonucleotide
ttagttgagctgtgacattatgttt

SEQ ID NO: 708566 - DNA, 25 bp, Artificial sequence
  Synthetic oligonucleotide
ttagttgagctgagacattatgttt

SEQ ID NO: 708567 - DNA, 25 bp, Artificial sequence
  Synthetic oligonucleotide
agaaatacacaacagtgtgtataaa

SEQ ID NO: 708568 - DNA, 25 bp, Artificial sequence
  Synthetic oligonucleotide
ttcttttgggttaatttgttatata

SEQ ID NO: 708569 - DNA, 25 bp, Artificial sequence
  Synthetic oligonucleotide
attcaaatgatagagaagcttgaca

SEQ ID NO: 708570 - DNA, 25 bp, Artificial sequence
  Synthetic oligonucleotide
tctcatgccatcatctcattctcct

SEQ ID NO: 708571 - DNA, 25 bp, Artificial sequence
  Synthetic oligonucleotide
gtgagagcaatgtatttccaatcaa

SEQ ID NO: 708572 - DNA, 25 bp, Artificial sequence
  Synthetic oligonucleotide
gtgagagcaatgaatttccaatcaa

SEQ ID NO: 708573 - DNA, 25 bp, Artificial sequence
  Synthetic oligonucleotide
tttttagaggactgcttgtcccacc

SEQ ID NO: 708574 - DNA, 25 bp, Artificial sequence
  Synthetic oligonucleotide
tttttagaggacagcttgtcccacc

SEQ ID NO: 708575 - DNA, 25 bp, Artificial sequence
  Synthetic oligonucleotide
attgtggagaccatcacagtcgata

SEQ ID NO: 708576 - DNA, 25 bp, Artificial sequence
  Synthetic oligonucleotide
attgtggagaccttcacagtcgata

SEQ ID NO: 708577 - DNA, 25 bp, Artificial sequence
  Synthetic oligonucleotide
attcaaatgatacagaagcttgaca

SEQ ID NO: 708578 - DNA, 25 bp, Artificial sequence
  Synthetic oligonucleotide
ttcttttgggtttatttgttatata

SEQ ID NO: 708579 - DNA, 25 bp, Artificial sequence
  Synthetic oligonucleotide
gcttgatccctttcaccttcatgaa

SEQ ID NO: 708580 - DNA, 25 bp, Artificial sequence
  Synthetic oligonucleotide
tgtcagcgaaaggggaatcggttct

SEQ ID NO: 708581 - DNA, 25 bp, Artificial sequence
  Synthetic oligonucleotide
aaacctgatgcgctttccgttttaa

SEQ ID NO: 708582 - DNA, 25 bp, Artificial sequence
  Synthetic oligonucleotide
ttttcaaggggataacagctattta

SEQ ID NO: 708583 - DNA, 25 bp, Artificial sequence
  Synthetic oligonucleotide
ttttcaaggggaaaacagctattta

SEQ ID NO: 708584 - DNA, 25 bp, Artificial sequence
  Synthetic oligonucleotide
gcgcgctgtttccatacctgtactc

SEQ ID NO: 708585 - DNA, 25 bp, Artificial sequence
  Synthetic oligonucleotide
gcgcgctgtttcgatacctgtactc

SEQ ID NO: 708586 - DNA, 25 bp, Artificial sequence
  Synthetic oligonucleotide
tattattgattctcttcaagtggag

SEQ ID NO: 708587 - DNA, 25 bp, Artificial sequence
  Synthetic oligonucleotide
tattattgattcacttcaagtggag

SEQ ID NO: 708588 - DNA, 25 bp, Artificial sequence
  Synthetic oligonucleotide
aatcggagcggaagccatattgtta

SEQ ID NO: 708589 - DNA, 25 bp, Artificial sequence
  Synthetic oligonucleotide
gtacctgtgcggattgcaaaagact

SEQ ID NO: 708590 - DNA, 25 bp, Artificial sequence
  Synthetic oligonucleotide
gcttgatcccttacaccttcatgaa

SEQ ID NO: 708591 - DNA, 25 bp, Artificial sequence
  Synthetic oligonucleotide
gtacctgtgcggtttgcaaaagact

SEQ ID NO: 708592 - DNA, 25 bp, Artificial sequence
  Synthetic oligonucleotide
agcaggtgaaaaggagatggacgtg

SEQ ID NO: 708593 - DNA, 25 bp, Artificial sequence
  Synthetic oligonucleotide
agcaggtgaaaacgagatggacgtg

SEQ ID NO: 708594 - DNA, 25 bp, Artificial sequence
  Synthetic oligonucleotide
tcatgatgcaactacgctagaacaa

SEQ ID NO: 708595 - DNA, 25 bp, Artificial sequence
  Synthetic oligonucleotide
tcatgatgcaacaacgctagaacaa

SEQ ID NO: 708596 - DNA, 25 bp, Artificial sequence
  Synthetic oligonucleotide
attcacgcctgatattctcggcata

SEQ ID NO: 708597 - DNA, 25 bp, Artificial sequence
  Synthetic oligonucleotide
attcacgcctgaaattctcggcata

SEQ ID NO: 708598 - DNA, 25 bp, Artificial sequence
  Synthetic oligonucleotide
cctaaaaacgtttgaaacatctgta

SEQ ID NO: 708599 - DNA, 25 bp, Artificial sequence
  Synthetic oligonucleotide
cctaaaaacgttagaaacatctgta

SEQ ID NO: 708600 - DNA, 25 bp, Artificial sequence
  Synthetic oligonucleotide
acaaatcgcatcacttgctccgaaa

SEQ ID NO: 708601 - DNA, 25 bp, Artificial sequence
  Synthetic oligonucleotide
gccgggagtatagcgtttcacccga

SEQ ID NO: 708602 - DNA, 25 bp, Artificial sequence
  Synthetic oligonucleotide
aatcggagcggatgccatattgtta

SEQ ID NO: 708603 - DNA, 25 bp, Artificial sequence
  Synthetic oligonucleotide
cattagagacgattacaagcggagg

SEQ ID NO: 708604 - DNA, 25 bp, Artificial sequence
  Synthetic oligonucleotide
agcttgaacgactaaagcagaaaga

SEQ ID NO: 708605 - DNA, 25 bp, Artificial sequence
  Synthetic oligonucleotide
tcacaaatggcacacttgaagattt

SEQ ID NO: 708606 - DNA, 25 bp, Artificial sequence
  Synthetic oligonucleotide
ctccgaaagagaccgcttatctcat

SEQ ID NO: 708607 - DNA, 25 bp, Artificial sequence
  Synthetic oligonucleotide
ctccgaaagagagcgcttatctcat

SEQ ID NO: 708608 - DNA, 25 bp, Artificial sequence
  Synthetic oligonucleotide
ttgaaaataaaagcagcagttccgc

SEQ ID NO: 708609 - DNA, 25 bp, Artificial sequence
  Synthetic oligonucleotide
ttgaaaataaaaccagcagttccgc

SEQ ID NO: 708610 - DNA, 25 bp, Artificial sequence
  Synthetic oligonucleotide
cagcttttaatgcaggggctgcgat

SEQ ID NO: 708611 - DNA, 25 bp, Artificial sequence
  Synthetic oligonucleotide
cagcttttaatggaggggctgcgat

SEQ ID NO: 708612 - DNA, 25 bp, Artificial sequence
  Synthetic oligonucleotide
ggatcaccgcctcactgaaggaagg

SEQ ID NO: 708613 - DNA, 25 bp, Artificial sequence
  Synthetic oligonucleotide
aaacctgatgcggtttccgttttaa

SEQ ID NO: 708614 - DNA, 25 bp, Artificial sequence
  Synthetic oligonucleotide
cattagagacgaatacaagcggagg

SEQ ID NO: 708615 - DNA, 25 bp, Artificial sequence
  Synthetic oligonucleotide
tgtcagcgaaagcggaatcggttct

SEQ ID NO: 708616 - DNA, 25 bp, Artificial sequence
  Synthetic oligonucleotide
agcttgaacgacaaaagcagaaaga

SEQ ID NO: 708617 - DNA, 25 bp, Artificial sequence
  Synthetic oligonucleotide
atgcttgaaaacatcattaaacaaa

SEQ ID NO: 708618 - DNA, 25 bp, Artificial sequence
  Synthetic oligonucleotide
gtaaaaacactggtcttgccggaag

SEQ ID NO: 708619 - DNA, 25 bp, Artificial sequence
  Synthetic oligonucleotide
gtaaaaacactgctcttgccggaag

SEQ ID NO: 708620 - DNA, 25 bp, Artificial sequence
  Synthetic oligonucleotide
gaaaaacgttcaattaaagaggcgc

SEQ ID NO: 708621 - DNA, 25 bp, Artificial sequence
  Synthetic oligonucleotide
gaaaaacgttcatttaaagaggcgc

SEQ ID NO: 708622 - DNA, 25 bp, Artificial sequence
  Synthetic oligonucleotide
aatcggtttatcgggttgattgctg

SEQ ID NO: 708623 - DNA, 25 bp, Artificial sequence
  Synthetic oligonucleotide
aatcggtttatccggttgattgctg

SEQ ID NO: 708624 - DNA, 25 bp, Artificial sequence
  Synthetic oligonucleotide
gcgtcgccgtcataagggcttatta

SEQ ID NO: 708625 - DNA, 25 bp, Artificial sequence
  Synthetic oligonucleotide
gcgtcgccgtcaaaagggcttatta

SEQ ID NO: 708626 - DNA, 25 bp, Artificial sequence
  Synthetic oligonucleotide
ggatcaccgcctgactgaaggaagg

SEQ ID NO: 708627 - DNA, 25 bp, Artificial sequence
  Synthetic oligonucleotide
cggacactatcagagacttaatgaa

SEQ ID NO: 708628 - DNA, 25 bp, Artificial sequence
  Synthetic oligonucleotide
acaaatcgcatctcttgctccgaaa

SEQ ID NO: 708629 - DNA, 25 bp, Artificial sequence
  Synthetic oligonucleotide
atcatgagaacagaactcaagagat

SEQ ID NO: 708630 - DNA, 25 bp, Artificial sequence
  Synthetic oligonucleotide
aagatgatgtggtcggctttgtgat

SEQ ID NO: 708631 - DNA, 25 bp, Artificial sequence
  Synthetic oligonucleotide
aagatgatgtggacggctttgtgat

SEQ ID NO: 708632 - DNA, 25 bp, Artificial sequence
  Synthetic oligonucleotide
tcaaaggggcaacagggggcactgg

SEQ ID NO: 708633 - DNA, 25 bp, Artificial sequence
  Synthetic oligonucleotide
tcaaaggggcaagagggggcactgg

SEQ ID NO: 708634 - DNA, 25 bp, Artificial sequence
  Synthetic oligonucleotide
cttgggactgtgagccggaatacca

SEQ ID NO: 708635 - DNA, 25 bp, Artificial sequence
  Synthetic oligonucleotide
cttgggactgtgtgccggaatacca

SEQ ID NO: 708636 - DNA, 25 bp, Artificial sequence
  Synthetic oligonucleotide
taggaaaacgttcttttatcgcagg

SEQ ID NO: 708637 - DNA, 25 bp, Artificial sequence
  Synthetic oligonucleotide
tgctgacagattgtgaaatatggaa

SEQ ID NO: 708638 - DNA, 25 bp, Artificial sequence
  Synthetic oligonucleotide
cggacactatcacagacttaatgaa

SEQ ID NO: 708639 - DNA, 25 bp, Artificial sequence
  Synthetic oligonucleotide
tgctgacagattctgaaatatggaa

SEQ ID NO: 708640 - DNA, 25 bp, Artificial sequence
  Synthetic oligonucleotide
caggaattgaccatgccagcggaat

SEQ ID NO: 708641 - DNA, 25 bp, Artificial sequence
  Synthetic oligonucleotide
caggaattgaccttgccagcggaat

SEQ ID NO: 708642 - DNA, 25 bp, Artificial sequence
  Synthetic oligonucleotide
gacaaaaagatcagaatctgatgag

SEQ ID NO: 708643 - DNA, 25 bp, Artificial sequence
  Synthetic oligonucleotide
gacaaaaagatctgaatctgatgag

SEQ ID NO: 708644 - DNA, 25 bp, Artificial sequence
  Synthetic oligonucleotide
aaaggatgaaccgatatgtatccat

SEQ ID NO: 708645 - DNA, 25 bp, Artificial sequence
  Synthetic oligonucleotide
aaaggatgaacccatatgtatccat

SEQ ID NO: 708646 - DNA, 25 bp, Artificial sequence
  Synthetic oligonucleotide
ataggcagataccgtgattttggcg

SEQ ID NO: 708647 - DNA, 25 bp, Artificial sequence
  Synthetic oligonucleotide
ataggcagatacggtgattttggcg

SEQ ID NO: 708648 - DNA, 25 bp, Artificial sequence
  Synthetic oligonucleotide
ccggaaacactcttgcagccgttag

SEQ ID NO: 708649 - DNA, 25 bp, Artificial sequence
  Synthetic oligonucleotide
ccggaaacactcatgcagccgttag

SEQ ID NO: 708650 - DNA, 25 bp, Artificial sequence
  Synthetic oligonucleotide
taggaaaacgttgttttatcgcagg

SEQ ID NO: 708651 - DNA, 25 bp, Artificial sequence
  Synthetic oligonucleotide
cggattatctggcctttatttttgc

SEQ ID NO: 708652 - DNA, 25 bp, Artificial sequence
  Synthetic oligonucleotide
aacatttgtcaaagaacatggagca

SEQ ID NO: 708653 - DNA, 25 bp, Artificial sequence
  Synthetic oligonucleotide
aacatttgtcaatgaacatggagca

SEQ ID NO: 708654 - DNA, 25 bp, Artificial sequence
  Synthetic oligonucleotide
tattggtgaatcattgatgagacaa

SEQ ID NO: 708655 - DNA, 25 bp, Artificial sequence
  Synthetic oligonucleotide
tattggtgaatctttgatgagacaa

SEQ ID NO: 708656 - DNA, 25 bp, Artificial sequence
  Synthetic oligonucleotide
aaaagcaatccatgctttgtttggg

SEQ ID NO: 708657 - DNA, 25 bp, Artificial sequence
  Synthetic oligonucleotide
aaaagcaatccaagctttgtttggg

SEQ ID NO: 708658 - DNA, 25 bp, Artificial sequence
  Synthetic oligonucleotide
tgaagaagccgggattaaaatattg

SEQ ID NO: 708659 - DNA, 25 bp, Artificial sequence
  Synthetic oligonucleotide
tgaagaagccggcattaaaatattg

SEQ ID NO: 708660 - DNA, 25 bp, Artificial sequence
  Synthetic oligonucleotide
cactgcaggatttgcagcttgcagc

SEQ ID NO: 708661 - DNA, 25 bp, Artificial sequence
  Synthetic oligonucleotide
atcatgagaacacaactcaagagat

SEQ ID NO: 708662 - DNA, 25 bp, Artificial sequence
  Synthetic oligonucleotide
cggattatctgggctttatttttgc

SEQ ID NO: 708663 - DNA, 25 bp, Artificial sequence
  Synthetic oligonucleotide
gccgggagtataccgtttcacccga

SEQ ID NO: 708664 - DNA, 25 bp, Artificial sequence
  Synthetic oligonucleotide
gaaaagtatctcggcaagatgtgaa

SEQ ID NO: 708665 - DNA, 25 bp, Artificial sequence
  Synthetic oligonucleotide
gaaaagtatctccgcaagatgtgaa

SEQ ID NO: 708666 - DNA, 25 bp, Artificial sequence
  Synthetic oligonucleotide
gtcaagtttgtgtcgaaaaacaggt

SEQ ID NO: 708667 - DNA, 25 bp, Artificial sequence
  Synthetic oligonucleotide
gtcaagtttgtgacgaaaaacaggt

SEQ ID NO: 708668 - DNA, 25 bp, Artificial sequence
  Synthetic oligonucleotide
ttgttaatgaatcgatagagacgat

SEQ ID NO: 708669 - DNA, 25 bp, Artificial sequence
  Synthetic oligonucleotide
ttgttaatgaatggatagagacgat

SEQ ID NO: 708670 - DNA, 25 bp, Artificial sequence
  Synthetic oligonucleotide
ccgaagacttaattctagacgtcat

SEQ ID NO: 708671 - DNA, 25 bp, Artificial sequence
  Synthetic oligonucleotide
ccgaagacttaaatctagacgtcat

SEQ ID NO: 708672 - DNA, 25 bp, Artificial sequence
  Synthetic oligonucleotide
gtgatgaggaacctgcggatgccga

SEQ ID NO: 708673 - DNA, 25 bp, Artificial sequence
  Synthetic oligonucleotide
gtgatgaggaacgtgcggatgccga

SEQ ID NO: 708674 - DNA, 25 bp, Artificial sequence
  Synthetic oligonucleotide
cactgcaggattagcagcttgcagc

SEQ ID NO: 708675 - DNA, 25 bp, Artificial sequence
  Synthetic oligonucleotide
caggccgattgaaaaaaggggttca

SEQ ID NO: 708676 - DNA, 25 bp, Artificial sequence
  Synthetic oligonucleotide
gtgttgcatcgaaacaggcaggtgc

SEQ ID NO: 708677 - DNA, 25 bp, Artificial sequence
  Synthetic oligonucleotide
ctgaagatgagagactgaaggttga

SEQ ID NO: 708678 - DNA, 25 bp, Artificial sequence
  Synthetic oligonucleotide
atgaaaaagaaatagcggagcatta

SEQ ID NO: 708679 - DNA, 25 bp, Artificial sequence
  Synthetic oligonucleotide
atgaaaaagaaaaagcggagcatta

SEQ ID NO: 708680 - DNA, 25 bp, Artificial sequence
  Synthetic oligonucleotide
atcttgcccgaaacgatatcggcag

SEQ ID NO: 708681 - DNA, 25 bp, Artificial sequence
  Synthetic oligonucleotide
atcttgcccgaatcgatatcggcag

SEQ ID NO: 708682 - DNA, 25 bp, Artificial sequence
  Synthetic oligonucleotide
atggttctgtttctgtgccggagtt

SEQ ID NO: 708683 - DNA, 25 bp, Artificial sequence
  Synthetic oligonucleotide
atggttctgtttgtgtgccggagtt

SEQ ID NO: 708684 - DNA, 25 bp, Artificial sequence
  Synthetic oligonucleotide
tttccttttcacttgtcatgcacat

SEQ ID NO: 708685 - DNA, 25 bp, Artificial sequence
  Synthetic oligonucleotide
cgattgccggtaggagaaaacgcgg

SEQ ID NO: 708686 - DNA, 25 bp, Artificial sequence
  Synthetic oligonucleotide
caggccgattgataaaaggggttca

SEQ ID NO: 708687 - DNA, 25 bp, Artificial sequence
  Synthetic oligonucleotide
cgattgccggtacgagaaaacgcgg

SEQ ID NO: 708688 - DNA, 25 bp, Artificial sequence
  Synthetic oligonucleotide
cactgatgtctggtttcccggcggg

SEQ ID NO: 708689 - DNA, 25 bp, Artificial sequence
  Synthetic oligonucleotide
cactgatgtctgctttcccggcggg

SEQ ID NO: 708690 - DNA, 25 bp, Artificial sequence
  Synthetic oligonucleotide
gcgcacccaaaatccgtgccatgca

SEQ ID NO: 708691 - DNA, 25 bp, Artificial sequence
  Synthetic oligonucleotide
gcgcacccaaaaaccgtgccatgca

SEQ ID NO: 708692 - DNA, 25 bp, Artificial sequence
  Synthetic oligonucleotide
aactcgagccaagaccgagagagac

SEQ ID NO: 708693 - DNA, 25 bp, Artificial sequence
  Synthetic oligonucleotide
aactcgagccaacaccgagagagac

SEQ ID NO: 708694 - DNA, 25 bp, Artificial sequence
  Synthetic oligonucleotide
gtattgcctacattgggtttgacgg

SEQ ID NO: 708695 - DNA, 25 bp, Artificial sequence
  Synthetic oligonucleotide
gtattgcctacaatgggtttgacgg

SEQ ID NO: 708696 - DNA, 25 bp, Artificial sequence
  Synthetic oligonucleotide
cttgtattacgattcgcacgatgag

SEQ ID NO: 708697 - DNA, 25 bp, Artificial sequence
  Synthetic oligonucleotide
tcacaaatggcagacttgaagattt

SEQ ID NO: 708698 - DNA, 25 bp, Artificial sequence
  Synthetic oligonucleotide
tttccttttcacatgtcatgcacat

SEQ ID NO: 708699 - DNA, 25 bp, Artificial sequence
  Synthetic oligonucleotide
tcaaaagctataaaaaagcaggcga

SEQ ID NO: 708700 - DNA, 25 bp, Artificial sequence
  Synthetic oligonucleotide
aaaacgaaaaaatggatgtattcca

SEQ ID NO: 708701 - DNA, 25 bp, Artificial sequence
  Synthetic oligonucleotide
aaaacgaaaaaaaggatgtattcca

SEQ ID NO: 708702 - DNA, 25 bp, Artificial sequence
  Synthetic oligonucleotide
tggagcttcaaattctcattgaaaa

SEQ ID NO: 708703 - DNA, 25 bp, Artificial sequence
  Synthetic oligonucleotide
tggagcttcaaaatctcattgaaaa

SEQ ID NO: 708704 - DNA, 25 bp, Artificial sequence
  Synthetic oligonucleotide
aaaacataaaagagctgtttctttc

SEQ ID NO: 708705 - DNA, 25 bp, Artificial sequence
  Synthetic oligonucleotide
aaaacataaaagtgctgtttctttc

SEQ ID NO: 708706 - DNA, 25 bp, Artificial sequence
  Synthetic oligonucleotide
acaagacacccacctttgagacagt

SEQ ID NO: 708707 - DNA, 25 bp, Artificial sequence
  Synthetic oligonucleotide
acaagacacccagctttgagacagt

SEQ ID NO: 708708 - DNA, 25 bp, Artificial sequence
  Synthetic oligonucleotide
atgaaaaatcggcttttatggctga

SEQ ID NO: 708709 - DNA, 25 bp, Artificial sequence
  Synthetic oligonucleotide
ctgaagatgagacactgaaggttga

SEQ ID NO: 708710 - DNA, 25 bp, Artificial sequence
  Synthetic oligonucleotide
tcaaaagctatataaaagcaggcga

SEQ ID NO: 708711 - DNA, 25 bp, Artificial sequence
  Synthetic oligonucleotide
gtgttgcatcgatacaggcaggtgc

SEQ ID NO: 708712 - DNA, 25 bp, Artificial sequence
  Synthetic oligonucleotide
gtgttttatcacaaaaatttgaggt

SEQ ID NO: 708713 - DNA, 25 bp, Artificial sequence
  Synthetic oligonucleotide
gtgttttatcactaaaatttgaggt

SEQ ID NO: 708714 - DNA, 25 bp, Artificial sequence
  Synthetic oligonucleotide
cagatgcttttgagttataccgagt

SEQ ID NO: 708715 - DNA, 25 bp, Artificial sequence
  Synthetic oligonucleotide
cagatgcttttgtgttataccgagt

SEQ ID NO: 708716 - DNA, 25 bp, Artificial sequence
  Synthetic oligonucleotide
tcaatccttcgcggtatatgtatta

SEQ ID NO: 708717 - DNA, 25 bp, Artificial sequence
  Synthetic oligonucleotide
tcaatccttcgccgtatatgtatta

SEQ ID NO: 708718 - DNA, 25 bp, Artificial sequence
  Synthetic oligonucleotide
tagacagagaaaaagtcggcagctc

SEQ ID NO: 708719 - DNA, 25 bp, Artificial sequence
  Synthetic oligonucleotide
tagacagagaaatagtcggcagctc

SEQ ID NO: 708720 - DNA, 25 bp, Artificial sequence
  Synthetic oligonucleotide
taatacacgttcaagacgggcactt

SEQ ID NO: 708721 - DNA, 25 bp, Artificial sequence
  Synthetic oligonucleotide
taatacacgttctagacgggcactt

SEQ ID NO: 708722 - DNA, 25 bp, Artificial sequence
  Synthetic oligonucleotide
atgaaaaatcgggttttatggctga

SEQ ID NO: 708723 - DNA, 25 bp, Artificial sequence
  Synthetic oligonucleotide
ggtttcagaacggtatttaatctgc

SEQ ID NO: 708724 - DNA, 25 bp, Artificial sequence
  Synthetic oligonucleotide
cttgtattacgaatcgcacgatgag

SEQ ID NO: 708725 - DNA, 25 bp, Artificial sequence
  Synthetic oligonucleotide
ggcaatcgctctgtctcttctaaaa

SEQ ID NO: 708726 - DNA, 25 bp, Artificial sequence
  Synthetic oligonucleotide
gatgttttagagcagctagaggttt

SEQ ID NO: 708727 - DNA, 25 bp, Artificial sequence
  Synthetic oligonucleotide
gatgttttagaggagctagaggttt

SEQ ID NO: 708728 - DNA, 25 bp, Artificial sequence
  Synthetic oligonucleotide
actcccgaaaaggtcaaaagcagca

SEQ ID NO: 708729 - DNA, 25 bp, Artificial sequence
  Synthetic oligonucleotide
actcccgaaaagctcaaaagcagca

SEQ ID NO: 708730 - DNA, 25 bp, Artificial sequence
  Synthetic oligonucleotide
aacatgggatttctttttgcgccgc

SEQ ID NO: 708731 - DNA, 25 bp, Artificial sequence
  Synthetic oligonucleotide
aacatgggatttgtttttgcgccgc

SEQ ID NO: 708732 - DNA, 25 bp, Artificial sequence
  Synthetic oligonucleotide
tctatgaaacatgtagcaggtacta

SEQ ID NO: 708733 - DNA, 25 bp, Artificial sequence
  Synthetic oligonucleotide
gttgcctcggcagctggtgcgaaaa

SEQ ID NO: 708734 - DNA, 25 bp, Artificial sequence
  Synthetic oligonucleotide
ggtttcagaacgctatttaatctgc

SEQ ID NO: 708735 - DNA, 25 bp, Artificial sequence
  Synthetic oligonucleotide
gttgcctcggcacctggtgcgaaaa

SEQ ID NO: 708736 - DNA, 25 bp, Artificial sequence
  Synthetic oligonucleotide
agcaatcctttagaggcgaagtcag

SEQ ID NO: 708737 - DNA, 25 bp, Artificial sequence
  Synthetic oligonucleotide
agcaatcctttacaggcgaagtcag

SEQ ID NO: 708738 - DNA, 25 bp, Artificial sequence
  Synthetic oligonucleotide
tattctgttgaaaaagctggactga

SEQ ID NO: 708739 - DNA, 25 bp, Artificial sequence
  Synthetic oligonucleotide
tattctgttgaataagctggactga

SEQ ID NO: 708740 - DNA, 25 bp, Artificial sequence
  Synthetic oligonucleotide
ctggagacgtttcagccgaagcacg

SEQ ID NO: 708741 - DNA, 25 bp, Artificial sequence
  Synthetic oligonucleotide
ctggagacgtttgagccgaagcacg

SEQ ID NO: 708742 - DNA, 25 bp, Artificial sequence
  Synthetic oligonucleotide
tcaagccgtgaccgtttagatgagc

SEQ ID NO: 708743 - DNA, 25 bp, Artificial sequence
  Synthetic oligonucleotide
tcaagccgtgacggtttagatgagc

SEQ ID NO: 708744 - DNA, 25 bp, Artificial sequence
  Synthetic oligonucleotide
gcaccgaccgacctgattgaattaa

SEQ ID NO: 708745 - DNA, 25 bp, Artificial sequence
  Synthetic oligonucleotide
gcaccgaccgacgtgattgaattaa

SEQ ID NO: 708746 - DNA, 25 bp, Artificial sequence
  Synthetic oligonucleotide
tctatgaaacatctagcaggtacta

SEQ ID NO: 708747 - DNA, 25 bp, Artificial sequence
  Synthetic oligonucleotide
aatatgatgatgccagcggaaatga

SEQ ID NO: 708748 - DNA, 25 bp, Artificial sequence
  Synthetic oligonucleotide
ctgattctgttcgggaagccgaata

SEQ ID NO: 708749 - DNA, 25 bp, Artificial sequence
  Synthetic oligonucleotide
ctgattctgttccggaagccgaata

SEQ ID NO: 708750 - DNA, 25 bp, Artificial sequence
  Synthetic oligonucleotide
gtaataaagccgctgcgctgctgaa

SEQ ID NO: 708751 - DNA, 25 bp, Artificial sequence
  Synthetic oligonucleotide
gtaataaagccggtgcgctgctgaa

SEQ ID NO: 708752 - DNA, 25 bp, Artificial sequence
  Synthetic oligonucleotide
ttgcagaagacatgtttcatagcaa

SEQ ID NO: 708753 - DNA, 25 bp, Artificial sequence
  Synthetic oligonucleotide
ttgcagaagacaagtttcatagcaa

SEQ ID NO: 708754 - DNA, 25 bp, Artificial sequence
  Synthetic oligonucleotide
ctgatgaacagatttctacaattgt

SEQ ID NO: 708755 - DNA, 25 bp, Artificial sequence
  Synthetic oligonucleotide
ctgatgaacagaattctacaattgt

SEQ ID NO: 708756 - DNA, 25 bp, Artificial sequence
  Synthetic oligonucleotide
aaaacccttactgccggtgaggctg

SEQ ID NO: 708757 - DNA, 25 bp, Artificial sequence
  Synthetic oligonucleotide
ggcaatcgctctctctcttctaaaa

SEQ ID NO: 708758 - DNA, 25 bp, Artificial sequence
  Synthetic oligonucleotide
aatatgatgatggcagcggaaatga

SEQ ID NO: 708759 - DNA, 25 bp, Artificial sequence
  Synthetic oligonucleotide
gtccactttatccaatatgcaaggc

SEQ ID NO: 708760 - DNA, 25 bp, Artificial sequence
  Synthetic oligonucleotide
atgggggggataatgtcaattcttg

SEQ ID NO: 708761 - DNA, 25 bp, Artificial sequence
  Synthetic oligonucleotide
atgggggggatattgtcaattcttg

SEQ ID NO: 708762 - DNA, 25 bp, Artificial sequence
  Synthetic oligonucleotide
gagacgccagaagagcttgcgggtt

SEQ ID NO: 708763 - DNA, 25 bp, Artificial sequence
  Synthetic oligonucleotide
gagacgccagaacagcttgcgggtt

SEQ ID NO: 708764 - DNA, 25 bp, Artificial sequence
  Synthetic oligonucleotide
atgcgggcacaccctcttacagtcg

SEQ ID NO: 708765 - DNA, 25 bp, Artificial sequence
  Synthetic oligonucleotide
atgcgggcacacgctcttacagtcg

SEQ ID NO: 708766 - DNA, 25 bp, Artificial sequence
  Synthetic oligonucleotide
gatattgttgattcatgcggaacag

SEQ ID NO: 708767 - DNA, 25 bp, Artificial sequence
  Synthetic oligonucleotide
gatattgttgatacatgcggaacag

SEQ ID NO: 708768 - DNA, 25 bp, Artificial sequence
  Synthetic oligonucleotide
atttccacttttaatatctcaacgc

SEQ ID NO: 708769 - DNA, 25 bp, Artificial sequence
  Synthetic oligonucleotide
atttccactttttatatctcaacgc

SEQ ID NO: 708770 - DNA, 25 bp, Artificial sequence
  Synthetic oligonucleotide
aaaacccttactcccggtgaggctg

SEQ ID NO: 708771 - DNA, 25 bp, Artificial sequence
  Synthetic oligonucleotide
gatatcttggcagcattccgagtaa

SEQ ID NO: 708772 - DNA, 25 bp, Artificial sequence
  Synthetic oligonucleotide
tggagttccaccagaagaagcaggg

SEQ ID NO: 708773 - DNA, 25 bp, Artificial sequence
  Synthetic oligonucleotide
gatatcttggcaccattccgagtaa

SEQ ID NO: 708774 - DNA, 25 bp, Artificial sequence
  Synthetic oligonucleotide
tggagttccacctgaagaagcaggg

SEQ ID NO: 708775 - DNA, 25 bp, Artificial sequence
  Synthetic oligonucleotide
gctgaatcttcttctggtacatgga

SEQ ID NO: 708776 - DNA, 25 bp, Artificial sequence
  Synthetic oligonucleotide
gctgaatcttctactggtacatgga

SEQ ID NO: 708777 - DNA, 25 bp, Artificial sequence
  Synthetic oligonucleotide
gaccgatgggcttaccagccttgat

SEQ ID NO: 708778 - DNA, 25 bp, Artificial sequence
  Synthetic oligonucleotide
ggacttatgtcaccacaaacagaga

SEQ ID NO: 708779 - DNA, 25 bp, Artificial sequence
  Synthetic oligonucleotide
gacgatgctacctcatcgagcccgt

SEQ ID NO: 708780 - DNA, 25 bp, Artificial sequence
  Synthetic oligonucleotide
gacgatgctaccacatcgagcccgt

SEQ ID NO: 708781 - DNA, 25 bp, Artificial sequence
  Synthetic oligonucleotide
gaccgatgggctaaccagccttgat

SEQ ID NO: 708782 - DNA, 25 bp, Artificial sequence
  Synthetic oligonucleotide
attcctaatttaagtcgagtagacc

SEQ ID NO: 708783 - DNA, 25 bp, Artificial sequence
  Synthetic oligonucleotide
tacaataatgatctatttggcgaat

SEQ ID NO: 708784 - DNA, 25 bp, Artificial sequence
  Synthetic oligonucleotide
catggtctaataaagaataattctg

SEQ ID NO: 708785 - DNA, 25 bp, Artificial sequence
  Synthetic oligonucleotide
catggtctaatatagaataattctg

SEQ ID NO: 708786 - DNA, 25 bp, Artificial sequence
  Synthetic oligonucleotide
gatgtactattataccaaaattggg

SEQ ID NO: 708787 - DNA, 25 bp, Artificial sequence
  Synthetic oligonucleotide
tacaataatgatgtatttggcgaat

SEQ ID NO: 708788 - DNA, 25 bp, Artificial sequence
  Synthetic oligonucleotide
gaaactcaattttttgcgtatgtag

SEQ ID NO: 708789 - DNA, 25 bp, Artificial sequence
  Synthetic oligonucleotide
tgttgggttcaaagctggtgttaaa

SEQ ID NO: 708790 - DNA, 25 bp, Artificial sequence
  Synthetic oligonucleotide
attcctaatttatgtcgagtagacc

SEQ ID NO: 708791 - DNA, 25 bp, Artificial sequence
  Synthetic oligonucleotide
gacttactatactcctgaatatgaa

SEQ ID NO: 708792 - DNA, 25 bp, Artificial sequence
  Synthetic oligonucleotide
tattgcaagaatactaaattcatga

SEQ ID NO: 708793 - DNA, 25 bp, Artificial sequence
  Synthetic oligonucleotide
tattgcaagaattctaaattcatga

SEQ ID NO: 708794 - DNA, 25 bp, Artificial sequence
  Synthetic oligonucleotide
ggacttatgtcagcacaaacagaga

SEQ ID NO: 708795 - DNA, 25 bp, Artificial sequence
  Synthetic oligonucleotide
tgtgaaagattcctgtgaaaaaggt

SEQ ID NO: 708796 - DNA, 25 bp, Artificial sequence
  Synthetic oligonucleotide
tgttgggttcaatgctggtgttaaa

SEQ ID NO: 708797 - DNA, 25 bp, Artificial sequence
  Synthetic oligonucleotide
gacttactatacacctgaatatgaa

SEQ ID NO: 708798 - DNA, 25 bp, Artificial sequence
  Synthetic oligonucleotide
tgtgaaagattcgtgtgaaaaaggt

SEQ ID NO: 708799 - DNA, 25 bp, Artificial sequence
  Synthetic oligonucleotide
tctacgtggtggtcttgattttacc

SEQ ID NO: 708800 - DNA, 25 bp, Artificial sequence
  Synthetic oligonucleotide
agctgtatttgcgagagaattggga

SEQ ID NO: 708801 - DNA, 25 bp, Artificial sequence
  Synthetic oligonucleotide
agctgtatttgccagagaattggga

SEQ ID NO: 708802 - DNA, 25 bp, Artificial sequence
  Synthetic oligonucleotide
caccagagcattctaaatattaggc

SEQ ID NO: 708803 - DNA, 25 bp, Artificial sequence
  Synthetic oligonucleotide
gaaaaagaagtaataggttgcgcta

SEQ ID NO: 708804 - DNA, 25 bp, Artificial sequence
  Synthetic oligonucleotide
tgctactgcgggaacatgcgaagaa

SEQ ID NO: 708805 - DNA, 25 bp, Artificial sequence
  Synthetic oligonucleotide
tgctactgcgggtacatgcgaagaa

SEQ ID NO: 708806 - DNA, 25 bp, Artificial sequence
  Synthetic oligonucleotide
caggctgaaacacgtgaaatcaaag

SEQ ID NO: 708807 - DNA, 25 bp, Artificial sequence
  Synthetic oligonucleotide
caggctgaaacaggtgaaatcaaag

SEQ ID NO: 708808 - DNA, 25 bp, Artificial sequence
  Synthetic oligonucleotide
cgtttcttattttgtgccgaagcta

SEQ ID NO: 708809 - DNA, 25 bp, Artificial sequence
  Synthetic oligonucleotide
cgtttcttatttagtgccgaagcta

SEQ ID NO: 708810 - DNA, 25 bp, Artificial sequence
  Synthetic oligonucleotide
tgtgaactcccaaccatttatgcgt

SEQ ID NO: 708811 - DNA, 25 bp, Artificial sequence
  Synthetic oligonucleotide
gataaattgaacaagtatggacgtc

SEQ ID NO: 708812 - DNA, 25 bp, Artificial sequence
  Synthetic oligonucleotide
tctacgtggtggacttgattttacc

SEQ ID NO: 708813 - DNA, 25 bp, Artificial sequence
  Synthetic oligonucleotide
gaaactcaatttattgcgtatgtag

SEQ ID NO: 708814 - DNA, 25 bp, Artificial sequence
  Synthetic oligonucleotide
cgcgaaaaactatggtagagcagtt

SEQ ID NO: 708815 - DNA, 25 bp, Artificial sequence
  Synthetic oligonucleotide
cgcgaaaaactaaggtagagcagtt

SEQ ID NO: 708816 - DNA, 25 bp, Artificial sequence
  Synthetic oligonucleotide
gatgtactattaaaccaaaattggg

SEQ ID NO: 708817 - DNA, 25 bp, Artificial sequence
  Synthetic oligonucleotide
gataaattgaactagtatggacgtc

SEQ ID NO: 708818 - DNA, 25 bp, Artificial sequence
  Synthetic oligonucleotide
aaactttccaagcaccacctcatgg

SEQ ID NO: 708819 - DNA, 25 bp, Artificial sequence
  Synthetic oligonucleotide
aaactttccaaggaccacctcatgg

SEQ ID NO: 708820 - DNA, 25 bp, Artificial sequence
  Synthetic oligonucleotide
tacgtctagaggttctgcgaatccc

SEQ ID NO: 708821 - DNA, 25 bp, Artificial sequence
  Synthetic oligonucleotide
tacgtctagaggatctgcgaatccc

SEQ ID NO: 708822 - DNA, 25 bp, Artificial sequence
  Synthetic oligonucleotide
gggtaatgtatttgggttcaaagcc

SEQ ID NO: 708823 - DNA, 25 bp, Artificial sequence
  Synthetic oligonucleotide
gggtaatgtattagggttcaaagcc

SEQ ID NO: 708824 - DNA, 25 bp, Artificial sequence
  Synthetic oligonucleotide
tttgaagaaggttcggttactaaca

SEQ ID NO: 708825 - DNA, 25 bp, Artificial sequence
  Synthetic oligonucleotide
tttgaagaaggtacggttactaaca

SEQ ID NO: 708826 - DNA, 25 bp, Artificial sequence
  Synthetic oligonucleotide
tgtgaactcccatccatttatgcgt

SEQ ID NO: 708827 - DNA, 25 bp, Artificial sequence
  Synthetic oligonucleotide
cctagagtcgctgcgccgactggaa

SEQ ID NO: 708828 - DNA, 25 bp, Artificial sequence
  Synthetic oligonucleotide
gggaaggctacatccagtaccggac

SEQ ID NO: 708829 - DNA, 25 bp, Artificial sequence
  Synthetic oligonucleotide
tttttttcacgtatcgaaacctctg

SEQ ID NO: 708830 - DNA, 25 bp, Artificial sequence
  Synthetic oligonucleotide
gggaaggctacaaccagtaccggac

SEQ ID NO: 708831 - DNA, 25 bp, Artificial sequence
  Synthetic oligonucleotide
caccagagcattgtaaatattaggc

SEQ ID NO: 708832 - DNA, 25 bp, Artificial sequence
  Synthetic oligonucleotide
taatttcttgacgaagagtatctcg

SEQ ID NO: 708833 - DNA, 25 bp, Artificial sequence
  Synthetic oligonucleotide
taatttcttgaccaagagtatctcg

SEQ ID NO: 708834 - DNA, 25 bp, Artificial sequence
  Synthetic oligonucleotide
gattatttcctattaattgctgtac

SEQ ID NO: 708835 - DNA, 25 bp, Artificial sequence
  Synthetic oligonucleotide
gattatttcctaataattgctgtac

SEQ ID NO: 708836 - DNA, 25 bp, Artificial sequence
  Synthetic oligonucleotide
ttaaaccctctgacgcactcatagc

SEQ ID NO: 708837 - DNA, 25 bp, Artificial sequence
  Synthetic oligonucleotide
ttaaaccctctgtcgcactcatagc

SEQ ID NO: 708838 - DNA, 25 bp, Artificial sequence
  Synthetic oligonucleotide
gaggatttcccaaatcaaccacgtc

SEQ ID NO: 708839 - DNA, 25 bp, Artificial sequence
  Synthetic oligonucleotide
tagtaggatttgttctcataataaa

SEQ ID NO: 708840 - DNA, 25 bp, Artificial sequence
  Synthetic oligonucleotide
cctagagtcgctccgccgactggaa

SEQ ID NO: 708841 - DNA, 25 bp, Artificial sequence
  Synthetic oligonucleotide
tagtaggatttgatctcataataaa

SEQ ID NO: 708842 - DNA, 25 bp, Artificial sequence
  Synthetic oligonucleotide
tatcaacgggttccccaagcacgtt

SEQ ID NO: 708843 - DNA, 25 bp, Artificial sequence
  Synthetic oligonucleotide
tatcaacgggttgcccaagcacgtt

SEQ ID NO: 708844 - DNA, 25 bp, Artificial sequence
  Synthetic oligonucleotide
taggagatgttgtgcgagtatcgac

SEQ ID NO: 708845 - DNA, 25 bp, Artificial sequence
  Synthetic oligonucleotide
taggagatgttgagcgagtatcgac

SEQ ID NO: 708846 - DNA, 25 bp, Artificial sequence
  Synthetic oligonucleotide
gtatctaattctttaaaagcaggcg

SEQ ID NO: 708847 - DNA, 25 bp, Artificial sequence
  Synthetic oligonucleotide
gtatctaattctataaaagcaggcg

SEQ ID NO: 708848 - DNA, 25 bp, Artificial sequence
  Synthetic oligonucleotide
gatctactactttaattcctgtttc

SEQ ID NO: 708849 - DNA, 25 bp, Artificial sequence
  Synthetic oligonucleotide
gatctactacttaaattcctgtttc

SEQ ID NO: 708850 - DNA, 25 bp, Artificial sequence
  Synthetic oligonucleotide
tccaatttttccgccacgacgataa

SEQ ID NO: 708851 - DNA, 25 bp, Artificial sequence
  Synthetic oligonucleotide
tccaatttttcccccacgacgataa

SEQ ID NO: 708852 - DNA, 25 bp, Artificial sequence
  Synthetic oligonucleotide
cgtaatgcatgactacttaacaggg

SEQ ID NO: 708853 - DNA, 25 bp, Artificial sequence
  Synthetic oligonucleotide
tagttgcattgattcttattttcgt

SEQ ID NO: 708854 - DNA, 25 bp, Artificial sequence
  Synthetic oligonucleotide
gaggatttcccatatcaaccacgtc

SEQ ID NO: 708855 - DNA, 25 bp, Artificial sequence
  Synthetic oligonucleotide
gcaagcctttgtattatctagcgaa

SEQ ID NO: 708856 - DNA, 25 bp, Artificial sequence
  Synthetic oligonucleotide
ggatttataaaatgtcaaagattca

SEQ ID NO: 708857 - DNA, 25 bp, Artificial sequence
  Synthetic oligonucleotide
ggatttataaaaagtcaaagattca

SEQ ID NO: 708858 - DNA, 25 bp, Artificial sequence
  Synthetic oligonucleotide
tatctaggatttacatatacaacag

SEQ ID NO: 708859 - DNA, 25 bp, Artificial sequence
  Synthetic oligonucleotide
tatctaggattttcatatacaacag

SEQ ID NO: 708860 - DNA, 25 bp, Artificial sequence
  Synthetic oligonucleotide
ttcattttcatgcatgaattccgca

SEQ ID NO: 708861 - DNA, 25 bp, Artificial sequence
  Synthetic oligonucleotide
ttcattttcatggatgaattccgca

SEQ ID NO: 708862 - DNA, 25 bp, Artificial sequence
  Synthetic oligonucleotide
gcgtcccatttaatcatccctttag

SEQ ID NO: 708863 - DNA, 25 bp, Artificial sequence
  Synthetic oligonucleotide
gcgtcccatttattcatccctttag

SEQ ID NO: 708864 - DNA, 25 bp, Artificial sequence
  Synthetic oligonucleotide
tttttttcgtatattcattttagca

SEQ ID NO: 708865 - DNA, 25 bp, Artificial sequence
  Synthetic oligonucleotide
tttttttcgtattttcattttagca

SEQ ID NO: 708866 - DNA, 25 bp, Artificial sequence
  Synthetic oligonucleotide
cggaactttagttatgattcattat

SEQ ID NO: 708867 - DNA, 25 bp, Artificial sequence
  Synthetic oligonucleotide
tttttttcacgtttcgaaacctctg

SEQ ID NO: 708868 - DNA, 25 bp, Artificial sequence
  Synthetic oligonucleotide
gcaagcctttgttttatctagcgaa

SEQ ID NO: 708869 - DNA, 25 bp, Artificial sequence
  Synthetic oligonucleotide
gaaaaagaagtattaggttgcgcta

SEQ ID NO: 708870 - DNA, 25 bp, Artificial sequence
  Synthetic oligonucleotide
gaaagtcttttatttttttatcata

SEQ ID NO: 708871 - DNA, 25 bp, Artificial sequence
  Synthetic oligonucleotide
gaaagtcttttaattttttatcata

SEQ ID NO: 708872 - DNA, 25 bp, Artificial sequence
  Synthetic oligonucleotide
gaaggaatagtctttttcaagctca

SEQ ID NO: 708873 - DNA, 25 bp, Artificial sequence
  Synthetic oligonucleotide
gaaggaatagtcattttcaagctca

SEQ ID NO: 708874 - DNA, 25 bp, Artificial sequence
  Synthetic oligonucleotide
aagcggatgtggtattcaatttttt

SEQ ID NO: 708875 - DNA, 25 bp, Artificial sequence
  Synthetic oligonucleotide
aagcggatgtggaattcaatttttt

SEQ ID NO: 708876 - DNA, 25 bp, Artificial sequence
  Synthetic oligonucleotide
gagtaagcactcgatttcgttggtc

SEQ ID NO: 708877 - DNA, 25 bp, Artificial sequence
  Synthetic oligonucleotide
gagtaagcactccatttcgttggtc

SEQ ID NO: 708878 - DNA, 25 bp, Artificial sequence
  Synthetic oligonucleotide
cgatagcaaattaatcggttaattc

SEQ ID NO: 708879 - DNA, 25 bp, Artificial sequence
  Synthetic oligonucleotide
cgatagcaaatttatcggttaattc

SEQ ID NO: 708880 - DNA, 25 bp, Artificial sequence
  Synthetic oligonucleotide
ttgttacgaattttttcgaatacag

SEQ ID NO: 708881 - DNA, 25 bp, Artificial sequence
  Synthetic oligonucleotide
ttgttacgaattatttcgaatacag

SEQ ID NO: 708882 - DNA, 25 bp, Artificial sequence
  Synthetic oligonucleotide
cggaactttagtaatgattcattat

SEQ ID NO: 708883 - DNA, 25 bp, Artificial sequence
  Synthetic oligonucleotide
tcatctattgttattgtattttcat

SEQ ID NO: 708884 - DNA, 25 bp, Artificial sequence
  Synthetic oligonucleotide
tagtatacgagaatttactaaaaaa

SEQ ID NO: 708885 - DNA, 25 bp, Artificial sequence
  Synthetic oligonucleotide
tctagttattcctataatgttgatc

SEQ ID NO: 708886 - DNA, 25 bp, Artificial sequence
  Synthetic oligonucleotide
aaaacttttatgcttgggatgagcg

SEQ ID NO: 708887 - DNA, 25 bp, Artificial sequence
  Synthetic oligonucleotide
aaaacttttatggttgggatgagcg

SEQ ID NO: 708888 - DNA, 25 bp, Artificial sequence
  Synthetic oligonucleotide
gactactataagacaagaccgtttt

SEQ ID NO: 708889 - DNA, 25 bp, Artificial sequence
  Synthetic oligonucleotide
gactactataagtcaagaccgtttt

SEQ ID NO: 708890 - DNA, 25 bp, Artificial sequence
  Synthetic oligonucleotide
gtaaagcaatggatagttttgctcc

SEQ ID NO: 708891 - DNA, 25 bp, Artificial sequence
  Synthetic oligonucleotide
gtaaagcaatggttagttttgctcc

SEQ ID NO: 708892 - DNA, 25 bp, Artificial sequence
  Synthetic oligonucleotide
tttctaagggagtattggaatacag

SEQ ID NO: 708893 - DNA, 25 bp, Artificial sequence
  Synthetic oligonucleotide
tttctaagggagaattggaatacag

SEQ ID NO: 708894 - DNA, 25 bp, Artificial sequence
  Synthetic oligonucleotide
cagaagctctatggaaaaatcgtgg

SEQ ID NO: 708895 - DNA, 25 bp, Artificial sequence
  Synthetic oligonucleotide
gctccaaggacattcgcaatttcat

SEQ ID NO: 708896 - DNA, 25 bp, Artificial sequence
  Synthetic oligonucleotide
tcatctattgtttttgtattttcat

SEQ ID NO: 708897 - DNA, 25 bp, Artificial sequence
  Synthetic oligonucleotide
gctccaaggacaatcgcaatttcat

SEQ ID NO: 708898 - DNA, 25 bp, Artificial sequence
  Synthetic oligonucleotide
tgcatttttcaaatttttcattgaa

SEQ ID NO: 708899 - DNA, 25 bp, Artificial sequence
  Synthetic oligonucleotide
tgcatttttcaattttttcattgaa

SEQ ID NO: 708900 - DNA, 25 bp, Artificial sequence
  Synthetic oligonucleotide
tgcttactctgattagaaaatgaac

SEQ ID NO: 708901 - DNA, 25 bp, Artificial sequence
  Synthetic oligonucleotide
tgcttactctgaatagaaaatgaac

SEQ ID NO: 708902 - DNA, 25 bp, Artificial sequence
  Synthetic oligonucleotide
cttaataatctttgcaattgcatcg

SEQ ID NO: 708903 - DNA, 25 bp, Artificial sequence
  Synthetic oligonucleotide
cttaataatcttagcaattgcatcg

SEQ ID NO: 708904 - DNA, 25 bp, Artificial sequence
  Synthetic oligonucleotide
tcatttagaatttaaattgattcat

SEQ ID NO: 708905 - DNA, 25 bp, Artificial sequence
  Synthetic oligonucleotide
tcatttagaattaaaattgattcat

SEQ ID NO: 708906 - DNA, 25 bp, Artificial sequence
  Synthetic oligonucleotide
tatgagaatttttcacaatataaga

SEQ ID NO: 708907 - DNA, 25 bp, Artificial sequence
  Synthetic oligonucleotide
tatgagaattttacacaatataaga

SEQ ID NO: 708908 - DNA, 25 bp, Artificial sequence
  Synthetic oligonucleotide
tcttatattcataagcgaagaacaa

SEQ ID NO: 708909 - DNA, 25 bp, Artificial sequence
  Synthetic oligonucleotide
taaggatactaaatataattgtact

SEQ ID NO: 708910 - DNA, 25 bp, Artificial sequence
  Synthetic oligonucleotide
cagaagctctatcgaaaaatcgtgg

SEQ ID NO: 708911 - DNA, 25 bp, Artificial sequence
  Synthetic oligonucleotide
taatgaaagttacatttataatttc

SEQ ID NO: 708912 - DNA, 25 bp, Artificial sequence
  Synthetic oligonucleotide
tgtgaacaatgtcgacattatttga

SEQ ID NO: 708913 - DNA, 25 bp, Artificial sequence
  Synthetic oligonucleotide
tgtgaacaatgtggacattatttga

SEQ ID NO: 708914 - DNA, 25 bp, Artificial sequence
  Synthetic oligonucleotide
tatggattaatgtataagaaagtca

SEQ ID NO: 708915 - DNA, 25 bp, Artificial sequence
  Synthetic oligonucleotide
tatggattaatgaataagaaagtca

SEQ ID NO: 708916 - DNA, 25 bp, Artificial sequence
  Synthetic oligonucleotide
caatcaattgtggattcaatgcgac

SEQ ID NO: 708917 - DNA, 25 bp, Artificial sequence
  Synthetic oligonucleotide
caatcaattgtgcattcaatgcgac

SEQ ID NO: 708918 - DNA, 25 bp, Artificial sequence
  Synthetic oligonucleotide
gttctaaggatttcgatataactca

SEQ ID NO: 708919 - DNA, 25 bp, Artificial sequence
  Synthetic oligonucleotide
gttctaaggattacgatataactca

SEQ ID NO: 708920 - DNA, 25 bp, Artificial sequence
  Synthetic oligonucleotide
caagataagaactaataggaatcgt

SEQ ID NO: 708921 - DNA, 25 bp, Artificial sequence
  Synthetic oligonucleotide
caagataagaacaaataggaatcgt

SEQ ID NO: 708922 - DNA, 25 bp, Artificial sequence
  Synthetic oligonucleotide
tgaaagcggaaagattcgtgaaagt

SEQ ID NO: 708923 - DNA, 25 bp, Artificial sequence
  Synthetic oligonucleotide
tctagttattccaataatgttgatc

SEQ ID NO: 708924 - DNA, 25 bp, Artificial sequence
  Synthetic oligonucleotide
taatgaaagttagatttataatttc

SEQ ID NO: 708925 - DNA, 25 bp, Artificial sequence
  Synthetic oligonucleotide
tagtatacgagattttactaaaaaa

SEQ ID NO: 708926 - DNA, 25 bp, Artificial sequence
  Synthetic oligonucleotide
gataataactttttaatcgatagta

SEQ ID NO: 708927 - DNA, 25 bp, Artificial sequence
  Synthetic oligonucleotide
gataataactttataatcgatagta

SEQ ID NO: 708928 - DNA, 25 bp, Artificial sequence
  Synthetic oligonucleotide
tagttgcattgaatcttattttcgt

SEQ ID NO: 708929 - DNA, 25 bp, Artificial sequence
  Synthetic oligonucleotide
taaggatactaattataattgtact

SEQ ID NO: 708930 - DNA, 25 bp, Artificial sequence
  Synthetic oligonucleotide
tctaaaggtgacaacgatctgcact

SEQ ID NO: 708931 - DNA, 25 bp, Artificial sequence
  Synthetic oligonucleotide
tctaaaggtgactacgatctgcact

SEQ ID NO: 708932 - DNA, 25 bp, Artificial sequence
  Synthetic oligonucleotide
tatagttattgtagttctagttatc

SEQ ID NO: 708933 - DNA, 25 bp, Artificial sequence
  Synthetic oligonucleotide
tatagttattgttgttctagttatc

SEQ ID NO: 708934 - DNA, 25 bp, Artificial sequence
  Synthetic oligonucleotide
gagattgacaatcattttagtgacc

SEQ ID NO: 708935 - DNA, 25 bp, Artificial sequence
  Synthetic oligonucleotide
gagattgacaatgattttagtgacc

SEQ ID NO: 708936 - DNA, 25 bp, Artificial sequence
  Synthetic oligonucleotide
gacaccttttttcttagggatagta

SEQ ID NO: 708937 - DNA, 25 bp, Artificial sequence
  Synthetic oligonucleotide
gacaccttttttgttagggatagta

SEQ ID NO: 708938 - DNA, 25 bp, Artificial sequence
  Synthetic oligonucleotide
tgaaagcggaaacattcgtgaaagt

SEQ ID NO: 708939 - DNA, 25 bp, Artificial sequence
  Synthetic oligonucleotide
tgcgcgatgattttgttgaaaaaga

SEQ ID NO: 708940 - DNA, 25 bp, Artificial sequence
  Synthetic oligonucleotide
tcttatattcattagcgaagaacaa

SEQ ID NO: 708941 - DNA, 25 bp, Artificial sequence
  Synthetic oligonucleotide
gagtagctctggtagcatgtgtaca

SEQ ID NO: 708942 - DNA, 25 bp, Artificial sequence
  Synthetic oligonucleotide
cccttggggaaatgcaccgggtgcc

SEQ ID NO: 708943 - DNA, 25 bp, Artificial sequence
  Synthetic oligonucleotide
cccttggggaaaagcaccgggtgcc

SEQ ID NO: 708944 - DNA, 25 bp, Artificial sequence
  Synthetic oligonucleotide
gattctgtactagaattcggtggag

SEQ ID NO: 708945 - DNA, 25 bp, Artificial sequence
  Synthetic oligonucleotide
gattctgtactacaattcggtggag

SEQ ID NO: 708946 - DNA, 25 bp, Artificial sequence
  Synthetic oligonucleotide
tggcatatgcctgctttgaccgaga

SEQ ID NO: 708947 - DNA, 25 bp, Artificial sequence
  Synthetic oligonucleotide
tggcatatgcctcctttgaccgaga

SEQ ID NO: 708948 - DNA, 25 bp, Artificial sequence
  Synthetic oligonucleotide
tggtgttctgcctgtggcttcaggg

SEQ ID NO: 708949 - DNA, 25 bp, Artificial sequence
  Synthetic oligonucleotide
tggtgttctgccagtggcttcaggg

SEQ ID NO: 708950 - DNA, 25 bp, Artificial sequence
  Synthetic oligonucleotide
tctttttcactctagattgggtctc

SEQ ID NO: 708951 - DNA, 25 bp, Artificial sequence
  Synthetic oligonucleotide
taatgagggacgtgatcttgcagtc

SEQ ID NO: 708952 - DNA, 25 bp, Artificial sequence
  Synthetic oligonucleotide
tgcgcgatgattatgttgaaaaaga

SEQ ID NO: 708953 - DNA, 25 bp, Artificial sequence
  Synthetic oligonucleotide
taatgagggacgagatcttgcagtc

SEQ ID NO: 708954 - DNA, 25 bp, Artificial sequence
  Synthetic oligonucleotide
gacagggagtcaactttgggctttg

SEQ ID NO: 708955 - DNA, 25 bp, Artificial sequence
  Synthetic oligonucleotide
gacagggagtcatctttgggctttg

SEQ ID NO: 708956 - DNA, 25 bp, Artificial sequence
  Synthetic oligonucleotide
cacgcgggtacagtagtaggtaaac

SEQ ID NO: 708957 - DNA, 25 bp, Artificial sequence
  Synthetic oligonucleotide
cacgcgggtacactagtaggtaaac

SEQ ID NO: 708958 - DNA, 25 bp, Artificial sequence
  Synthetic oligonucleotide
gctaaagctttaggtctatctggtg

SEQ ID NO: 708959 - DNA, 25 bp, Artificial sequence
  Synthetic oligonucleotide
gctaaagctttacgtctatctggtg

SEQ ID NO: 708960 - DNA, 25 bp, Artificial sequence
  Synthetic oligonucleotide
tagacagaagaatcatggtatgcac

SEQ ID NO: 708961 - DNA, 25 bp, Artificial sequence
  Synthetic oligonucleotide
tagacagaagaaacatggtatgcac

SEQ ID NO: 708962 - DNA, 25 bp, Artificial sequence
  Synthetic oligonucleotide
acttcttcacatccaccgtgcaatg

SEQ ID NO: 708963 - DNA, 25 bp, Artificial sequence
  Synthetic oligonucleotide
acttcttcacatgcaccgtgcaatg

SEQ ID NO: 708964 - DNA, 25 bp, Artificial sequence
  Synthetic oligonucleotide
tactagtttgtctcattattgccga

SEQ ID NO: 708965 - DNA, 25 bp, Artificial sequence
  Synthetic oligonucleotide
tactagtttgtcacattattgccga

SEQ ID NO: 708966 - DNA, 25 bp, Artificial sequence
  Synthetic oligonucleotide
tctttttcactcaagattgggtctc

SEQ ID NO: 708967 - DNA, 25 bp, Artificial sequence
  Synthetic oligonucleotide
ttttttgatagatacatacttaaat

SEQ ID NO: 708968 - DNA, 25 bp, Artificial sequence
  Synthetic oligonucleotide
tttcattccgtattggaataaaaaa

SEQ ID NO: 708969 - DNA, 25 bp, Artificial sequence
  Synthetic oligonucleotide
tttcattccgtaatggaataaaaaa

SEQ ID NO: 708970 - DNA, 25 bp, Artificial sequence
  Synthetic oligonucleotide
tcttctaccccaacctgcatgttgt

SEQ ID NO: 708971 - DNA, 25 bp, Artificial sequence
  Synthetic oligonucleotide
tcttctaccccatcctgcatgttgt

SEQ ID NO: 708972 - DNA, 25 bp, Artificial sequence
  Synthetic oligonucleotide
tctttcgtgtcacggcttgaaccaa

SEQ ID NO: 708973 - DNA, 25 bp, Artificial sequence
  Synthetic oligonucleotide
tctttcgtgtcagggcttgaaccaa

SEQ ID NO: 708974 - DNA, 25 bp, Artificial sequence
  Synthetic oligonucleotide
gaaacatggattcttaattcttagg

SEQ ID NO: 708975 - DNA, 25 bp, Artificial sequence
  Synthetic oligonucleotide
gaaacatggattgttaattcttagg

SEQ ID NO: 708976 - DNA, 25 bp, Artificial sequence
  Synthetic oligonucleotide
tgttattgtagtgttgtgtccacaa

SEQ ID NO: 708977 - DNA, 25 bp, Artificial sequence
  Synthetic oligonucleotide
tgttattgtagtcttgtgtccacaa

SEQ ID NO: 708978 - DNA, 25 bp, Artificial sequence
  Synthetic oligonucleotide
ctcttcaataaaaaaaagaagatta

SEQ ID NO: 708979 - DNA, 25 bp, Artificial sequence
  Synthetic oligonucleotide
gagtagctctggaagcatgtgtaca

SEQ ID NO: 708980 - DNA, 25 bp, Artificial sequence
  Synthetic oligonucleotide
ttttttgatagaaacatacttaaat

SEQ ID NO: 708981 - DNA, 25 bp, Artificial sequence
  Synthetic oligonucleotide
cgtaatgcatgagtacttaacaggg

SEQ ID NO: 708982 - DNA, 25 bp, Artificial sequence
  Synthetic oligonucleotide
taaaaaagattgtgccgaggttatc

SEQ ID NO: 708983 - DNA, 25 bp, Artificial sequence
  Synthetic oligonucleotide
taaaaaagattgagccgaggttatc

SEQ ID NO: 708984 - DNA, 25 bp, Artificial sequence
  Synthetic oligonucleotide
tagtttaattgcactcggctcaatc

SEQ ID NO: 708985 - DNA, 25 bp, Artificial sequence
  Synthetic oligonucleotide
tagtttaattgctctcggctcaatc

SEQ ID NO: 708986 - DNA, 25 bp, Artificial sequence
  Synthetic oligonucleotide
gatgaattagatttagtaattcacg

SEQ ID NO: 708987 - DNA, 25 bp, Artificial sequence
  Synthetic oligonucleotide
gatgaattagatatagtaattcacg

SEQ ID NO: 708988 - DNA, 25 bp, Artificial sequence
  Synthetic oligonucleotide
aacttcccaaccatcgataaattag

SEQ ID NO: 708989 - DNA, 25 bp, Artificial sequence
  Synthetic oligonucleotide
aacttcccaaccttcgataaattag

SEQ ID NO: 708990 - DNA, 25 bp, Artificial sequence
  Synthetic oligonucleotide
tagctgctgcttctgaagtatggaa

SEQ ID NO: 708991 - DNA, 25 bp, Artificial sequence
  Synthetic oligonucleotide
tagctgctgcttgtgaagtatggaa

SEQ ID NO: 708992 - DNA, 25 bp, Artificial sequence
  Synthetic oligonucleotide
aattatccgtgaagcttgcaaatgg

SEQ ID NO: 708993 - DNA, 25 bp, Artificial sequence
  Synthetic oligonucleotide
aattatccgtgatgcttgcaaatgg

SEQ ID NO: 708994 - DNA, 25 bp, Artificial sequence
  Synthetic oligonucleotide
ctcttcaataaataaaagaagatta

SEQ ID NO: 708995 - DNA, 25 bp, Artificial sequence
  Synthetic oligonucleotide
aaatctgaggccaaatagcactaag

SEQ ID NO: 708996 - DNA, 25 bp, Artificial sequence
  Synthetic oligonucleotide
ttgaactgaaactgtagagactact

SEQ ID NO: 708997 - DNA, 25 bp, Artificial sequence
  Synthetic oligonucleotide
cacagagcaacaagaagagcaacgg

SEQ ID NO: 708998 - DNA, 25 bp, Artificial sequence
  Synthetic oligonucleotide
tcttgggaaagatagttgtaactgt

SEQ ID NO: 708999 - DNA, 25 bp, Artificial sequence
  Synthetic oligonucleotide
tcttgggaaagaaagttgtaactgt

SEQ ID NO: 709000 - DNA, 25 bp, Artificial sequence
  Synthetic oligonucleotide
tcaggatcaggagctgtatcagccc

SEQ ID NO: 709001 - DNA, 25 bp, Artificial sequence
  Synthetic oligonucleotide
tcaggatcaggacctgtatcagccc

SEQ ID NO: 709002 - DNA, 25 bp, Artificial sequence
  Synthetic oligonucleotide
ttttgtgtgtgtcttgcagttgagc

SEQ ID NO: 709003 - DNA, 25 bp, Artificial sequence
  Synthetic oligonucleotide
ttttgtgtgtgtgttgcagttgagc

SEQ ID NO: 709004 - DNA, 25 bp, Artificial sequence
  Synthetic oligonucleotide
taaaccaaacttcaattcatgattg

SEQ ID NO: 709005 - DNA, 25 bp, Artificial sequence
  Synthetic oligonucleotide
taaaccaaacttgaattcatgattg

SEQ ID NO: 709006 - DNA, 25 bp, Artificial sequence
  Synthetic oligonucleotide
tccttaggaatagtctctaaaccgg

SEQ ID NO: 709007 - DNA, 25 bp, Artificial sequence
  Synthetic oligonucleotide
tccttaggaatactctctaaaccgg

SEQ ID NO: 709008 - DNA, 25 bp, Artificial sequence
  Synthetic oligonucleotide
cggtttggttcgcttcagttcctga

SEQ ID NO: 709009 - DNA, 25 bp, Artificial sequence
  Synthetic oligonucleotide
cggtttggttcggttcagttcctga

SEQ ID NO: 709010 - DNA, 25 bp, Artificial sequence
  Synthetic oligonucleotide
tcatggccaagatgggtatcaagtg

SEQ ID NO: 709011 - DNA, 25 bp, Artificial sequence
  Synthetic oligonucleotide
tcaggactttaagtaggaaatctaa

SEQ ID NO: 709012 - DNA, 25 bp, Artificial sequence
  Synthetic oligonucleotide
ttaacgctttgtccttatccaccac

SEQ ID NO: 709013 - DNA, 25 bp, Artificial sequence
  Synthetic oligonucleotide
ttaacgctttgtgcttatccaccac

SEQ ID NO: 709014 - DNA, 25 bp, Artificial sequence
  Synthetic oligonucleotide
ggtttttacaaaaatagctcaagaa

SEQ ID NO: 709015 - DNA, 25 bp, Artificial sequence
  Synthetic oligonucleotide
ggtttttacaaatatagctcaagaa

SEQ ID NO: 709016 - DNA, 25 bp, Artificial sequence
  Synthetic oligonucleotide
gaatcactttgacattctctgacag

SEQ ID NO: 709017 - DNA, 25 bp, Artificial sequence
  Synthetic oligonucleotide
gtcttcaggactagtctataccttg

SEQ ID NO: 709018 - DNA, 25 bp, Artificial sequence
  Synthetic oligonucleotide
tcaggactttaactaggaaatctaa

SEQ ID NO: 709019 - DNA, 25 bp, Artificial sequence
  Synthetic oligonucleotide
gtcttcaggacttgtctataccttg

SEQ ID NO: 709020 - DNA, 25 bp, Artificial sequence
  Synthetic oligonucleotide
tgcttcttttatactctacttgtga

SEQ ID NO: 709021 - DNA, 25 bp, Artificial sequence
  Synthetic oligonucleotide
tgcttcttttattctctacttgtga

SEQ ID NO: 709022 - DNA, 25 bp, Artificial sequence
  Synthetic oligonucleotide
tagtagatgtgtttaaatcgatgta

SEQ ID NO: 709023 - DNA, 25 bp, Artificial sequence
  Synthetic oligonucleotide
tagtagatgtgtataaatcgatgta

SEQ ID NO: 709024 - DNA, 25 bp, Artificial sequence
  Synthetic oligonucleotide
ttgaactgaaacagtagagactact

SEQ ID NO: 709025 - DNA, 25 bp, Artificial sequence
  Synthetic oligonucleotide
tgttggctgtgatagaagacaaaca

SEQ ID NO: 709026 - DNA, 25 bp, Artificial sequence
  Synthetic oligonucleotide
gaatcactttgagattctctgacag

SEQ ID NO: 709027 - DNA, 25 bp, Artificial sequence
  Synthetic oligonucleotide
cacaactttattgatctttaaatgc

SEQ ID NO: 709028 - DNA, 25 bp, Artificial sequence
  Synthetic oligonucleotide
cacagagcaacatgaagagcaacgg

SEQ ID NO: 709029 - DNA, 25 bp, Artificial sequence
  Synthetic oligonucleotide
gctcctgctttcatggacaagcttg

SEQ ID NO: 709030 - DNA, 25 bp, Artificial sequence
  Synthetic oligonucleotide
gctcctgctttcttggacaagcttg

SEQ ID NO: 709031 - DNA, 25 bp, Artificial sequence
  Synthetic oligonucleotide
caagaacttcttgactctgcctaac

SEQ ID NO: 709032 - DNA, 25 bp, Artificial sequence
  Synthetic oligonucleotide
caagaacttcttcactctgcctaac

SEQ ID NO: 709033 - DNA, 25 bp, Artificial sequence
  Synthetic oligonucleotide
caacttggacaagatgatggatggg

SEQ ID NO: 709034 - DNA, 25 bp, Artificial sequence
  Synthetic oligonucleotide
ttttcttttgagtattttttggtgc

SEQ ID NO: 709035 - DNA, 25 bp, Artificial sequence
  Synthetic oligonucleotide
tttaaaaattgtctttacttcttga

SEQ ID NO: 709036 - DNA, 25 bp, Artificial sequence
  Synthetic oligonucleotide
cacaactttattcatctttaaatgc

SEQ ID NO: 709037 - DNA, 25 bp, Artificial sequence
  Synthetic oligonucleotide
tctcataggttcgacttattttggg

SEQ ID NO: 709038 - DNA, 25 bp, Artificial sequence
  Synthetic oligonucleotide
tctcataggttccacttattttggg

SEQ ID NO: 709039 - DNA, 25 bp, Artificial sequence
  Synthetic oligonucleotide
gcaaaggtcaagctaaatccttcca

SEQ ID NO: 709040 - DNA, 25 bp, Artificial sequence
  Synthetic oligonucleotide
gcaaaggtcaaggtaaatccttcca

SEQ ID NO: 709041 - DNA, 25 bp, Artificial sequence
  Synthetic oligonucleotide
actataggacaatactgaatccgga

SEQ ID NO: 709042 - DNA, 25 bp, Artificial sequence
  Synthetic oligonucleotide
ttttcttttgagaattttttggtgc

SEQ ID NO: 709043 - DNA, 25 bp, Artificial sequence
  Synthetic oligonucleotide
ccacgctgtccttagctcatacgaa

SEQ ID NO: 709044 - DNA, 25 bp, Artificial sequence
  Synthetic oligonucleotide
gtgccatcaacacagctccggtaca

SEQ ID NO: 709045 - DNA, 25 bp, Artificial sequence
  Synthetic oligonucleotide
cagatggagaggtcttgcctacgac

SEQ ID NO: 709046 - DNA, 25 bp, Artificial sequence
  Synthetic oligonucleotide
cagatggagaggacttgcctacgac

SEQ ID NO: 709047 - DNA, 25 bp, Artificial sequence
  Synthetic oligonucleotide
tcaacaagacatgaccagaggcaag

SEQ ID NO: 709048 - DNA, 25 bp, Artificial sequence
  Synthetic oligonucleotide
tcaacaagacatcaccagaggcaag

SEQ ID NO: 709049 - DNA, 25 bp, Artificial sequence
  Synthetic oligonucleotide
caacttggacaacatgatggatggg

SEQ ID NO: 709050 - DNA, 25 bp, Artificial sequence
  Synthetic oligonucleotide
ctctgtcttccaagctcctatggga

SEQ ID NO: 709051 - DNA, 25 bp, Artificial sequence
  Synthetic oligonucleotide
tgttggctgtgaaagaagacaaaca

SEQ ID NO: 709052 - DNA, 25 bp, Artificial sequence
  Synthetic oligonucleotide
ccacgctgtcctaagctcatacgaa

SEQ ID NO: 709053 - DNA, 25 bp, Artificial sequence
  Synthetic oligonucleotide
caaggccttagggagtaagttctca

SEQ ID NO: 709054 - DNA, 25 bp, Artificial sequence
  Synthetic oligonucleotide
caaggccttaggcagtaagttctca

SEQ ID NO: 709055 - DNA, 25 bp, Artificial sequence
  Synthetic oligonucleotide
tagatctctcattagttccataaag

SEQ ID NO: 709056 - DNA, 25 bp, Artificial sequence
  Synthetic oligonucleotide
tagatctctcataagttccataaag

SEQ ID NO: 709057 - DNA, 25 bp, Artificial sequence
  Synthetic oligonucleotide
tttaaaaattgtgtttacttcttga

SEQ ID NO: 709058 - DNA, 25 bp, Artificial sequence
  Synthetic oligonucleotide
ctctgtcttccatgctcctatggga

SEQ ID NO: 709059 - DNA, 25 bp, Artificial sequence
  Synthetic oligonucleotide
aagttgcattaaatagtttttagcg

SEQ ID NO: 709060 - DNA, 25 bp, Artificial sequence
  Synthetic oligonucleotide
acatcggttattaggaacattatta

SEQ ID NO: 709061 - DNA, 25 bp, Artificial sequence
  Synthetic oligonucleotide
tgcatgatgctaacttagcctcgac

SEQ ID NO: 709062 - DNA, 25 bp, Artificial sequence
  Synthetic oligonucleotide
tacttcatcttctaaactatatatt

SEQ ID NO: 709063 - DNA, 25 bp, Artificial sequence
  Synthetic oligonucleotide
tacttcatcttcaaaactatatatt

SEQ ID NO: 709064 - DNA, 25 bp, Artificial sequence
  Synthetic oligonucleotide
tatgcattgcatgacttgtttttac

SEQ ID NO: 709065 - DNA, 25 bp, Artificial sequence
  Synthetic oligonucleotide
tataatcttattacatattttagca

SEQ ID NO: 709066 - DNA, 25 bp, Artificial sequence
  Synthetic oligonucleotide
aagttgcattaattagtttttagcg

SEQ ID NO: 709067 - DNA, 25 bp, Artificial sequence
  Synthetic oligonucleotide
tataatcttatttcatattttagca

SEQ ID NO: 709068 - DNA, 25 bp, Artificial sequence
  Synthetic oligonucleotide
ggttaatttgataaccacatacttg

SEQ ID NO: 709069 - DNA, 25 bp, Artificial sequence
  Synthetic oligonucleotide
ggttaatttgattaccacatacttg

SEQ ID NO: 709070 - DNA, 25 bp, Artificial sequence
  Synthetic oligonucleotide
gtatctagagttgtatataacaaaa

SEQ ID NO: 709071 - DNA, 25 bp, Artificial sequence
  Synthetic oligonucleotide
gtatctagagttctatataacaaaa

SEQ ID NO: 709072 - DNA, 25 bp, Artificial sequence
  Synthetic oligonucleotide
tattggctaagccaatttctctcca

SEQ ID NO: 709073 - DNA, 25 bp, Artificial sequence
  Synthetic oligonucleotide
tctccattagtgctttaatgttact

SEQ ID NO: 709074 - DNA, 25 bp, Artificial sequence
  Synthetic oligonucleotide
tatgcattgcatcacttgtttttac

SEQ ID NO: 709075 - DNA, 25 bp, Artificial sequence
  Synthetic oligonucleotide
tgtgaatatatacttttagatgagt

SEQ ID NO: 709076 - DNA, 25 bp, Artificial sequence
  Synthetic oligonucleotide
cacatgagagaatggttgagaaaac

SEQ ID NO: 709077 - DNA, 25 bp, Artificial sequence
  Synthetic oligonucleotide
cacatgagagaaaggttgagaaaac

SEQ ID NO: 709078 - DNA, 25 bp, Artificial sequence
  Synthetic oligonucleotide
ggatgagaaattataatgatcagac

SEQ ID NO: 709079 - DNA, 25 bp, Artificial sequence
  Synthetic oligonucleotide
ggatgagaaattttaatgatcagac

SEQ ID NO: 709080 - DNA, 25 bp, Artificial sequence
  Synthetic oligonucleotide
tttatagcttagagtagaaaacgat

SEQ ID NO: 709081 - DNA, 25 bp, Artificial sequence
  Synthetic oligonucleotide
tgcatgatgctatcttagcctcgac

SEQ ID NO: 709082 - DNA, 25 bp, Artificial sequence
  Synthetic oligonucleotide
tgtgaatatatagttttagatgagt

SEQ ID NO: 709083 - DNA, 25 bp, Artificial sequence
  Synthetic oligonucleotide
acatcggttatttggaacattatta

SEQ ID NO: 709084 - DNA, 25 bp, Artificial sequence
  Synthetic oligonucleotide
tagtaactttgagggaacaataaac

SEQ ID NO: 709085 - DNA, 25 bp, Artificial sequence
  Synthetic oligonucleotide
tagtaactttgacggaacaataaac

SEQ ID NO: 709086 - DNA, 25 bp, Artificial sequence
  Synthetic oligonucleotide
ttattttaaaacaagtaaattcata

SEQ ID NO: 709087 - DNA, 25 bp, Artificial sequence
  Synthetic oligonucleotide
ttattttaaaactagtaaattcata

SEQ ID NO: 709088 - DNA, 25 bp, Artificial sequence
  Synthetic oligonucleotide
gatatattcatattttcactatgaa

SEQ ID NO: 709089 - DNA, 25 bp, Artificial sequence
  Synthetic oligonucleotide
gatatattcataatttcactatgaa

SEQ ID NO: 709090 - DNA, 25 bp, Artificial sequence
  Synthetic oligonucleotide
tttatagcttagtgtagaaaacgat

SEQ ID NO: 709091 - DNA, 25 bp, Artificial sequence
  Synthetic oligonucleotide
taagcttcttctactaccaatctaa

SEQ ID NO: 709092 - DNA, 25 bp, Artificial sequence
  Synthetic oligonucleotide
tattggctaagcgaatttctctcca

SEQ ID NO: 709093 - DNA, 25 bp, Artificial sequence
  Synthetic oligonucleotide
catcgtgtggcgttcagagagttaa

SEQ ID NO: 709094 - DNA, 25 bp, Artificial sequence
  Synthetic oligonucleotide
cgaagagataaccaattggttgttg

SEQ ID NO: 709095 - DNA, 25 bp, Artificial sequence
  Synthetic oligonucleotide
cgaagagataacgaattggttgttg

SEQ ID NO: 709096 - DNA, 25 bp, Artificial sequence
  Synthetic oligonucleotide
taaatctctcagattcttgctcaca

SEQ ID NO: 709097 - DNA, 25 bp, Artificial sequence
  Synthetic oligonucleotide
tcctaatcatcttcctcgtggcaac

SEQ ID NO: 709098 - DNA, 25 bp, Artificial sequence
  Synthetic oligonucleotide
taagcttcttcttctaccaatctaa

SEQ ID NO: 709099 - DNA, 25 bp, Artificial sequence
  Synthetic oligonucleotide
tcctaatcatctacctcgtggcaac

SEQ ID NO: 709100 - DNA, 25 bp, Artificial sequence
  Synthetic oligonucleotide
cagcttcttgtgttgtgacgcatac

SEQ ID NO: 709101 - DNA, 25 bp, Artificial sequence
  Synthetic oligonucleotide
cagcttcttgtgatgtgacgcatac

SEQ ID NO: 709102 - DNA, 25 bp, Artificial sequence
  Synthetic oligonucleotide
agtcttgagataaggccgccgcagt

SEQ ID NO: 709103 - DNA, 25 bp, Artificial sequence
  Synthetic oligonucleotide
agtcttgagatatggccgccgcagt

SEQ ID NO: 709104 - DNA, 25 bp, Artificial sequence
  Synthetic oligonucleotide
gtgccatcaacagagctccggtaca

SEQ ID NO: 709105 - DNA, 25 bp, Artificial sequence
  Synthetic oligonucleotide
caaatctccgatcttgacccggttt

SEQ ID NO: 709106 - DNA, 25 bp, Artificial sequence
  Synthetic oligonucleotide
taaatctctcagtttcttgctcaca

SEQ ID NO: 709107 - DNA, 25 bp, Artificial sequence
  Synthetic oligonucleotide
caatgattttccaaagcatatgtgg

SEQ ID NO: 709108 - DNA, 25 bp, Artificial sequence
  Synthetic oligonucleotide
gcaatgtcattaaccaaaattttgg

SEQ ID NO: 709109 - DNA, 25 bp, Artificial sequence
  Synthetic oligonucleotide
gcaatgtcattatccaaaattttgg

SEQ ID NO: 709110 - DNA, 25 bp, Artificial sequence
  Synthetic oligonucleotide
cgtatgaagaagtgtgtagaagtat

SEQ ID NO: 709111 - DNA, 25 bp, Artificial sequence
  Synthetic oligonucleotide
cgtatgaagaagagtgtagaagtat

SEQ ID NO: 709112 - DNA, 25 bp, Artificial sequence
  Synthetic oligonucleotide
gaatggcttacctcaatcctcaaaa

SEQ ID NO: 709113 - DNA, 25 bp, Artificial sequence
  Synthetic oligonucleotide
catcgtgtggcgatcagagagttaa

SEQ ID NO: 709114 - DNA, 25 bp, Artificial sequence
  Synthetic oligonucleotide
caatgattttcctaagcatatgtgg

SEQ ID NO: 709115 - DNA, 25 bp, Artificial sequence
  Synthetic oligonucleotide
tctccattagtggtttaatgttact

SEQ ID NO: 709116 - DNA, 25 bp, Artificial sequence
  Synthetic oligonucleotide
taatgttataatgttcacttgaaaa

SEQ ID NO: 709117 - DNA, 25 bp, Artificial sequence
  Synthetic oligonucleotide
taatgttataatcttcacttgaaaa

SEQ ID NO: 709118 - DNA, 25 bp, Artificial sequence
  Synthetic oligonucleotide
cattggcacagaatagccatttgac

SEQ ID NO: 709119 - DNA, 25 bp, Artificial sequence
  Synthetic oligonucleotide
cattggcacagattagccatttgac

SEQ ID NO: 709120 - DNA, 25 bp, Artificial sequence
  Synthetic oligonucleotide
taaacatattccacgtggaccaatc

SEQ ID NO: 709121 - DNA, 25 bp, Artificial sequence
  Synthetic oligonucleotide
taaacatattcctcgtggaccaatc

SEQ ID NO: 709122 - DNA, 25 bp, Artificial sequence
  Synthetic oligonucleotide
gaatggcttaccacaatcctcaaaa

SEQ ID NO: 709123 - DNA, 25 bp, Artificial sequence
  Synthetic oligonucleotide
actataggacaaaactgaatccgga

SEQ ID NO: 709124 - DNA, 25 bp, Artificial sequence
  Synthetic oligonucleotide
ggaaaacgaatcaatttcctcagct

SEQ ID NO: 709125 - DNA, 25 bp, Artificial sequence
  Synthetic oligonucleotide
gaacatccatcaacatacatacata

SEQ ID NO: 709126 - DNA, 25 bp, Artificial sequence
  Synthetic oligonucleotide
gaacatccatcatcatacatacata

SEQ ID NO: 709127 - DNA, 25 bp, Artificial sequence
  Synthetic oligonucleotide
tgtgatcacaattctctttatttta

SEQ ID NO: 709128 - DNA, 25 bp, Artificial sequence
  Synthetic oligonucleotide
tgtgatcacaatactctttatttta

SEQ ID NO: 709129 - DNA, 25 bp, Artificial sequence
  Synthetic oligonucleotide
cataattgtgtgaaagtgtatatat

SEQ ID NO: 709130 - DNA, 25 bp, Artificial sequence
  Synthetic oligonucleotide
cataattgtgtgtaagtgtatatat

SEQ ID NO: 709131 - DNA, 25 bp, Artificial sequence
  Synthetic oligonucleotide
gattgcaatctctagactattagca

SEQ ID NO: 709132 - DNA, 25 bp, Artificial sequence
  Synthetic oligonucleotide
gattgcaatctcaagactattagca

SEQ ID NO: 709133 - DNA, 25 bp, Artificial sequence
  Synthetic oligonucleotide
gatgaaatctgaaacattgcttctc

SEQ ID NO: 709134 - DNA, 25 bp, Artificial sequence
  Synthetic oligonucleotide
gatgaaatctgatacattgcttctc

SEQ ID NO: 709135 - DNA, 25 bp, Artificial sequence
  Synthetic oligonucleotide
aacggagcactacaccattgactgg

SEQ ID NO: 709136 - DNA, 25 bp, Artificial sequence
  Synthetic oligonucleotide
aacggagcactagaccattgactgg

SEQ ID NO: 709137 - DNA, 25 bp, Artificial sequence
  Synthetic oligonucleotide
ggaacctgtgtctacaacttttgag

SEQ ID NO: 709138 - DNA, 25 bp, Artificial sequence
  Synthetic oligonucleotide
tatgatgtacaagacattggtaatt

SEQ ID NO: 709139 - DNA, 25 bp, Artificial sequence
  Synthetic oligonucleotide
tcatggccaagaagggtatcaagtg

SEQ ID NO: 709140 - DNA, 25 bp, Artificial sequence
  Synthetic oligonucleotide
gcttattaatttgctgttttactcc

SEQ ID NO: 709141 - DNA, 25 bp, Artificial sequence
  Synthetic oligonucleotide
tggtttatttttgtcctttgtgtaa

SEQ ID NO: 709142 - DNA, 25 bp, Artificial sequence
  Synthetic oligonucleotide
tggtttatttttctcctttgtgtaa

SEQ ID NO: 709143 - DNA, 25 bp, Artificial sequence
  Synthetic oligonucleotide
gatcttgtcctcatttgttcccttt

SEQ ID NO: 709144 - DNA, 25 bp, Artificial sequence
  Synthetic oligonucleotide
tgtcgcattcacttgtaaagcaaga

SEQ ID NO: 709145 - DNA, 25 bp, Artificial sequence
  Synthetic oligonucleotide
tatgatgtacaacacattggtaatt

SEQ ID NO: 709146 - DNA, 25 bp, Artificial sequence
  Synthetic oligonucleotide
tgtcgcattcacatgtaaagcaaga

SEQ ID NO: 709147 - DNA, 25 bp, Artificial sequence
  Synthetic oligonucleotide
gccttgtcataatctacacttctta

SEQ ID NO: 709148 - DNA, 25 bp, Artificial sequence
  Synthetic oligonucleotide
gccttgtcataaactacacttctta

SEQ ID NO: 709149 - DNA, 25 bp, Artificial sequence
  Synthetic oligonucleotide
cacactaggtaaatgcttagacata

SEQ ID NO: 709150 - DNA, 25 bp, Artificial sequence
  Synthetic oligonucleotide
cacactaggtaattgcttagacata

SEQ ID NO: 709151 - DNA, 25 bp, Artificial sequence
  Synthetic oligonucleotide
aaatctgaggcctaatagcactaag

SEQ ID NO: 709152 - DNA, 25 bp, Artificial sequence
  Synthetic oligonucleotide
tatggtcactagtgcaacaagctat

SEQ ID NO: 709153 - DNA, 25 bp, Artificial sequence
  Synthetic oligonucleotide
gatcttgtcctcttttgttcccttt

SEQ ID NO: 709154 - DNA, 25 bp, Artificial sequence
  Synthetic oligonucleotide
catgtagacaaatgaaattaggaat

SEQ ID NO: 709155 - DNA, 25 bp, Artificial sequence
  Synthetic oligonucleotide
ggaaaacgaatctatttcctcagct

SEQ ID NO: 709156 - DNA, 25 bp, Artificial sequence
  Synthetic oligonucleotide
taaacaaagaccaaacaaaacaagc

SEQ ID NO: 709157 - DNA, 25 bp, Artificial sequence
  Synthetic oligonucleotide
taaacaaagacctaacaaaacaagc

SEQ ID NO: 709158 - DNA, 25 bp, Artificial sequence
  Synthetic oligonucleotide
tgtcatgttactgcatttttcaagc

SEQ ID NO: 709159 - DNA, 25 bp, Artificial sequence
  Synthetic oligonucleotide
tgtcatgttactccatttttcaagc

SEQ ID NO: 709160 - DNA, 25 bp, Artificial sequence
  Synthetic oligonucleotide
tcccggaaagtttcgaagctcccat

SEQ ID NO: 709161 - DNA, 25 bp, Artificial sequence
  Synthetic oligonucleotide
caattaagcatactgatgaacaaca

SEQ ID NO: 709162 - DNA, 25 bp, Artificial sequence
  Synthetic oligonucleotide
gaaatcctctgttgagactcaagac

SEQ ID NO: 709163 - DNA, 25 bp, Artificial sequence
  Synthetic oligonucleotide
catgtagacaaaagaaattaggaat

SEQ ID NO: 709164 - DNA, 25 bp, Artificial sequence
  Synthetic oligonucleotide
gcagcttagaaatagaatattcagc

SEQ ID NO: 709165 - DNA, 25 bp, Artificial sequence
  Synthetic oligonucleotide
gcagcttagaaaaagaatattcagc

SEQ ID NO: 709166 - DNA, 25 bp, Artificial sequence
  Synthetic oligonucleotide
cggttaatgagtctacaagagaaca

SEQ ID NO: 709167 - DNA, 25 bp, Artificial sequence
  Synthetic oligonucleotide
cggttaatgagtgtacaagagaaca

SEQ ID NO: 709168 - DNA, 25 bp, Artificial sequence
  Synthetic oligonucleotide
gcaaaacagacaatgttggcctcag

SEQ ID NO: 709169 - DNA, 25 bp, Artificial sequence
  Synthetic oligonucleotide
caattaagcatagtgatgaacaaca

SEQ ID NO: 709170 - DNA, 25 bp, Artificial sequence
  Synthetic oligonucleotide
actgaaaattctaacggtcgacctc

SEQ ID NO: 709171 - DNA, 25 bp, Artificial sequence
  Synthetic oligonucleotide
ggaacctgtgtcaacaacttttgag

SEQ ID NO: 709172 - DNA, 25 bp, Artificial sequence
  Synthetic oligonucleotide
tcaggttttagatgtaacgaccttg

SEQ ID NO: 709173 - DNA, 25 bp, Artificial sequence
  Synthetic oligonucleotide
tcaggttttagaagtaacgaccttg

SEQ ID NO: 709174 - DNA, 25 bp, Artificial sequence
  Synthetic oligonucleotide
gaggctaactatggcagggcttttg

SEQ ID NO: 709175 - DNA, 25 bp, Artificial sequence
  Synthetic oligonucleotide
gaggctaactatcgcagggcttttg

SEQ ID NO: 709176 - DNA, 25 bp, Artificial sequence
  Synthetic oligonucleotide
tcccggaaagttacgaagctcccat

SEQ ID NO: 709177 - DNA, 25 bp, Artificial sequence
  Synthetic oligonucleotide
gctgtttagtacgtaaccgaagcaa

SEQ ID NO: 709178 - DNA, 25 bp, Artificial sequence
  Synthetic oligonucleotide
tatggtcactagagcaacaagctat

SEQ ID NO: 709179 - DNA, 25 bp, Artificial sequence
  Synthetic oligonucleotide
actgaaaattcttacggtcgacctc

SEQ ID NO: 709180 - DNA, 25 bp, Artificial sequence
  Synthetic oligonucleotide
ggcggaactctgttgacacaatcat

SEQ ID NO: 709181 - DNA, 25 bp, Artificial sequence
  Synthetic oligonucleotide
ggcggaactctgatgacacaatcat

SEQ ID NO: 709182 - DNA, 25 bp, Artificial sequence
  Synthetic oligonucleotide
cctgtcttctataggtcttgaacga

SEQ ID NO: 709183 - DNA, 25 bp, Artificial sequence
  Synthetic oligonucleotide
cctgtcttctattggtcttgaacga

SEQ ID NO: 709184 - DNA, 25 bp, Artificial sequence
  Synthetic oligonucleotide
gaaatcctctgtagagactcaagac

SEQ ID NO: 709185 - DNA, 25 bp, Artificial sequence
  Synthetic oligonucleotide
gctgtttagtacctaaccgaagcaa

SEQ ID NO: 709186 - DNA, 25 bp, Artificial sequence
  Synthetic oligonucleotide
ggagaagttctactgggccccgacc

SEQ ID NO: 709187 - DNA, 25 bp, Artificial sequence
  Synthetic oligonucleotide
gttccctggtcattctatcggtaag

SEQ ID NO: 709188 - DNA, 25 bp, Artificial sequence
  Synthetic oligonucleotide
cccaggaatgtacaacaaggaagag

SEQ ID NO: 709189 - DNA, 25 bp, Artificial sequence
  Synthetic oligonucleotide
cccaggaatgtagaacaaggaagag

SEQ ID NO: 709190 - DNA, 25 bp, Artificial sequence
  Synthetic oligonucleotide
ccccatcatttgcactggtaacgat

SEQ ID NO: 709191 - DNA, 25 bp, Artificial sequence
  Synthetic oligonucleotide
ccccatcatttggactggtaacgat

SEQ ID NO: 709192 - DNA, 25 bp, Artificial sequence
  Synthetic oligonucleotide
catgaacattgctgataacccaacc

SEQ ID NO: 709193 - DNA, 25 bp, Artificial sequence
  Synthetic oligonucleotide
tatacgctcctctcatccgtgatgg

SEQ ID NO: 709194 - DNA, 25 bp, Artificial sequence
  Synthetic oligonucleotide
cagtacactgtctacaaccagatgg

SEQ ID NO: 709195 - DNA, 25 bp, Artificial sequence
  Synthetic oligonucleotide
ggagaagttctagtgggccccgacc

SEQ ID NO: 709196 - DNA, 25 bp, Artificial sequence
  Synthetic oligonucleotide
tatcggtgtctgcaagggtatcttc

SEQ ID NO: 709197 - DNA, 25 bp, Artificial sequence
  Synthetic oligonucleotide
tatcggtgtctggaagggtatcttc

SEQ ID NO: 709198 - DNA, 25 bp, Artificial sequence
  Synthetic oligonucleotide
gatcaaggacgatgacattgtcaca

SEQ ID NO: 709199 - DNA, 25 bp, Artificial sequence
  Synthetic oligonucleotide
gatcaaggacgaagacattgtcaca

SEQ ID NO: 709200 - DNA, 25 bp, Artificial sequence
  Synthetic oligonucleotide
gcttattaatttcctgttttactcc

SEQ ID NO: 709201 - DNA, 25 bp, Artificial sequence
  Synthetic oligonucleotide
tatacgctcctcacatccgtgatgg

SEQ ID NO: 709202 - DNA, 25 bp, Artificial sequence
  Synthetic oligonucleotide
tatccgtcagaggtaccgtgaggca

SEQ ID NO: 709203 - DNA, 25 bp, Artificial sequence
  Synthetic oligonucleotide
caaatctccgatgttgacccggttt

SEQ ID NO: 709204 - DNA, 25 bp, Artificial sequence
  Synthetic oligonucleotide
gctctctttcgacaagaatctaaaa

SEQ ID NO: 709205 - DNA, 25 bp, Artificial sequence
  Synthetic oligonucleotide
gctctctttcgagaagaatctaaaa

SEQ ID NO: 709206 - DNA, 25 bp, Artificial sequence
  Synthetic oligonucleotide
ttttgcagcccaatcatgatgagtg

SEQ ID NO: 709207 - DNA, 25 bp, Artificial sequence
  Synthetic oligonucleotide
ttttgcagcccattcatgatgagtg

SEQ ID NO: 709208 - DNA, 25 bp, Artificial sequence
  Synthetic oligonucleotide
catgaacattgcagataacccaacc

SEQ ID NO: 709209 - DNA, 25 bp, Artificial sequence
  Synthetic oligonucleotide
ttgagagtggaaacgcaggagaacc

SEQ ID NO: 709210 - DNA, 25 bp, Artificial sequence
  Synthetic oligonucleotide
ccctgaaaatgtactatataggacc

SEQ ID NO: 709211 - DNA, 25 bp, Artificial sequence
  Synthetic oligonucleotide
tatccgtcagagctaccgtgaggca

SEQ ID NO: 709212 - DNA, 25 bp, Artificial sequence
  Synthetic oligonucleotide
caagaagggaaagatgtgttgtctc

SEQ ID NO: 709213 - DNA, 25 bp, Artificial sequence
  Synthetic oligonucleotide
caagaagggaaacatgtgttgtctc

SEQ ID NO: 709214 - DNA, 25 bp, Artificial sequence
  Synthetic oligonucleotide
atcttgacgctgctgcgggtcgtat

SEQ ID NO: 709215 - DNA, 25 bp, Artificial sequence
  Synthetic oligonucleotide
atcttgacgctggtgcgggtcgtat

SEQ ID NO: 709216 - DNA, 25 bp, Artificial sequence
  Synthetic oligonucleotide
cagtacactgtcaacaaccagatgg

SEQ ID NO: 709217 - DNA, 25 bp, Artificial sequence
  Synthetic oligonucleotide
ttgagagtggaatcgcaggagaacc

SEQ ID NO: 709218 - DNA, 25 bp, Artificial sequence
  Synthetic oligonucleotide
taaaagagaaagtgaagaaaatgga

SEQ ID NO: 709219 - DNA, 25 bp, Artificial sequence
  Synthetic oligonucleotide
gttccctggtcaatctatcggtaag

SEQ ID NO: 709220 - DNA, 25 bp, Artificial sequence
  Synthetic oligonucleotide
cagccaggctgctttgggagacgca

SEQ ID NO: 709221 - DNA, 25 bp, Artificial sequence
  Synthetic oligonucleotide
catcggccgcggtactttctacggt

SEQ ID NO: 709222 - DNA, 25 bp, Artificial sequence
  Synthetic oligonucleotide
catcggccgcggaactttctacggt

SEQ ID NO: 709223 - DNA, 25 bp, Artificial sequence
  Synthetic oligonucleotide
tgttttttggttaagttggccactg

SEQ ID NO: 709224 - DNA, 25 bp, Artificial sequence
  Synthetic oligonucleotide
cagccaggctgcattgggagacgca

SEQ ID NO: 709225 - DNA, 25 bp, Artificial sequence
  Synthetic oligonucleotide
taaaagagaaagagaagaaaatgga

SEQ ID NO: 709226 - DNA, 25 bp, Artificial sequence
  Synthetic oligonucleotide
gaatgtcaagagagtccaacttgcc

SEQ ID NO: 709227 - DNA, 25 bp, Artificial sequence
  Synthetic oligonucleotide
agttaaacttacttgacttgcagga

SEQ ID NO: 709228 - DNA, 25 bp, Artificial sequence
  Synthetic oligonucleotide
agttaaacttacatgacttgcagga

SEQ ID NO: 709229 - DNA, 25 bp, Artificial sequence
  Synthetic oligonucleotide
taaacctgccagatcctgaagggtg

SEQ ID NO: 709230 - DNA, 25 bp, Artificial sequence
  Synthetic oligonucleotide
taaacctgccagttcctgaagggtg

SEQ ID NO: 709231 - DNA, 25 bp, Artificial sequence
  Synthetic oligonucleotide
ggctgaaaactttgatccaacggct

SEQ ID NO: 709232 - DNA, 25 bp, Artificial sequence
  Synthetic oligonucleotide
ggctgaaaacttagatccaacggct

SEQ ID NO: 709233 - DNA, 25 bp, Artificial sequence
  Synthetic oligonucleotide
tgttttttggtttagttggccactg

SEQ ID NO: 709234 - DNA, 25 bp, Artificial sequence
  Synthetic oligonucleotide
gaaagaggctggataactcaaggga

SEQ ID NO: 709235 - DNA, 25 bp, Artificial sequence
  Synthetic oligonucleotide
ccctgaaaatgttctatataggacc

SEQ ID NO: 709236 - DNA, 25 bp, Artificial sequence
  Synthetic oligonucleotide
tctgatatgtgtttttggtgtggac

SEQ ID NO: 709237 - DNA, 25 bp, Artificial sequence
  Synthetic oligonucleotide
tctgatatgtgtatttggtgtggac

SEQ ID NO: 709238 - DNA, 25 bp, Artificial sequence
  Synthetic oligonucleotide
tgctttgagggccagagtgtacgat

SEQ ID NO: 709239 - DNA, 25 bp, Artificial sequence
  Synthetic oligonucleotide
tgctttgagggcgagagtgtacgat

SEQ ID NO: 709240 - DNA, 25 bp, Artificial sequence
  Synthetic oligonucleotide
gaagttcgttgagagccttggagtt

SEQ ID NO: 709241 - DNA, 25 bp, Artificial sequence
  Synthetic oligonucleotide
gcaaaacagacattgttggcctcag

SEQ ID NO: 709242 - DNA, 25 bp, Artificial sequence
  Synthetic oligonucleotide
gaaagaggctggttaactcaaggga

SEQ ID NO: 709243 - DNA, 25 bp, Artificial sequence
  Synthetic oligonucleotide
cgtgttcgagcatcccgagatgact

SEQ ID NO: 709244 - DNA, 25 bp, Artificial sequence
  Synthetic oligonucleotide
cgtgttcgagcaacccgagatgact

SEQ ID NO: 709245 - DNA, 25 bp, Artificial sequence
  Synthetic oligonucleotide
tatggaatacggaaacatgcttgtg

SEQ ID NO: 709246 - DNA, 25 bp, Artificial sequence
  Synthetic oligonucleotide
tatggaatacggtaacatgcttgtg

SEQ ID NO: 709247 - DNA, 25 bp, Artificial sequence
  Synthetic oligonucleotide
gaatgtcaagagtgtccaacttgcc

SEQ ID NO: 709248 - DNA, 25 bp, Artificial sequence
  Synthetic oligonucleotide
gaagttcgttgacagccttggagtt

SEQ ID NO: 709249 - DNA, 25 bp, Artificial sequence
  Synthetic oligonucleotide
catattgaacaaaaacaatcctgtt

SEQ ID NO: 709250 - DNA, 25 bp, Artificial sequence
  Synthetic oligonucleotide
tgtgtaccttatcagctttatgtgt

SEQ ID NO: 709251 - DNA, 25 bp, Artificial sequence
  Synthetic oligonucleotide
cttggtgggtgttacagggcggctt

SEQ ID NO: 709252 - DNA, 25 bp, Artificial sequence
  Synthetic oligonucleotide
cttggtgggtgtaacagggcggctt

SEQ ID NO: 709253 - DNA, 25 bp, Artificial sequence
  Synthetic oligonucleotide
cgtttgtaggattctgtgtgcaaca

SEQ ID NO: 709254 - DNA, 25 bp, Artificial sequence
  Synthetic oligonucleotide
cgtttgtaggatactgtgtgcaaca

SEQ ID NO: 709255 - DNA, 25 bp, Artificial sequence
  Synthetic oligonucleotide
gacaggaccattcgagaacttggca

SEQ ID NO: 709256 - DNA, 25 bp, Artificial sequence
  Synthetic oligonucleotide
gacaggaccattggagaacttggca

SEQ ID NO: 709257 - DNA, 25 bp, Artificial sequence
  Synthetic oligonucleotide
gatccatggcacaacaacattggcg

SEQ ID NO: 709258 - DNA, 25 bp, Artificial sequence
  Synthetic oligonucleotide
gatccatggcactacaacattggcg

SEQ ID NO: 709259 - DNA, 25 bp, Artificial sequence
  Synthetic oligonucleotide
tccactgtagatgggctatgctcgc

SEQ ID NO: 709260 - DNA, 25 bp, Artificial sequence
  Synthetic oligonucleotide
tatccctttcaactaatgaatgtaa

SEQ ID NO: 709261 - DNA, 25 bp, Artificial sequence
  Synthetic oligonucleotide
taagcacacacaacaacttaccttt

SEQ ID NO: 709262 - DNA, 25 bp, Artificial sequence
  Synthetic oligonucleotide
tgtgtaccttatgagctttatgtgt

SEQ ID NO: 709263 - DNA, 25 bp, Artificial sequence
  Synthetic oligonucleotide
tgtgtaatgaaagacagatttgtga

SEQ ID NO: 709264 - DNA, 25 bp, Artificial sequence
  Synthetic oligonucleotide
tgtgtaatgaaacacagatttgtga

SEQ ID NO: 709265 - DNA, 25 bp, Artificial sequence
  Synthetic oligonucleotide
ttgtcttggtgatcgaatgctcgtg

SEQ ID NO: 709266 - DNA, 25 bp, Artificial sequence
  Synthetic oligonucleotide
ttgtcttggtgaacgaatgctcgtg

SEQ ID NO: 709267 - DNA, 25 bp, Artificial sequence
  Synthetic oligonucleotide
taagtgatgaacgttttgaacccaa

SEQ ID NO: 709268 - DNA, 25 bp, Artificial sequence
  Synthetic oligonucleotide
taagtgatgaaccttttgaacccaa

SEQ ID NO: 709269 - DNA, 25 bp, Artificial sequence
  Synthetic oligonucleotide
tctcatgcttcctacagaagaaaca

SEQ ID NO: 709270 - DNA, 25 bp, Artificial sequence
  Synthetic oligonucleotide
tctcatgcttccaacagaagaaaca

SEQ ID NO: 709271 - DNA, 25 bp, Artificial sequence
  Synthetic oligonucleotide
tatccctttcaagtaatgaatgtaa

SEQ ID NO: 709272 - DNA, 25 bp, Artificial sequence
  Synthetic oligonucleotide
gccattgcatttgttgagcaccaga

SEQ ID NO: 709273 - DNA, 25 bp, Artificial sequence
  Synthetic oligonucleotide
tatccaatctttgtcttatcataag

SEQ ID NO: 709274 - DNA, 25 bp, Artificial sequence
  Synthetic oligonucleotide
tatccaatctttctcttatcataag

SEQ ID NO: 709275 - DNA, 25 bp, Artificial sequence
  Synthetic oligonucleotide
agtttaatctaatggacttggtggg

SEQ ID NO: 709276 - DNA, 25 bp, Artificial sequence
  Synthetic oligonucleotide
agtttaatctaaaggacttggtggg

SEQ ID NO: 709277 - DNA, 25 bp, Artificial sequence
  Synthetic oligonucleotide
cctgggattttgctaccagaagcat

SEQ ID NO: 709278 - DNA, 25 bp, Artificial sequence
  Synthetic oligonucleotide
cctgggattttggtaccagaagcat

SEQ ID NO: 709279 - DNA, 25 bp, Artificial sequence
  Synthetic oligonucleotide
gaaactgggttaaggctcaggaatg

SEQ ID NO: 709280 - DNA, 25 bp, Artificial sequence
  Synthetic oligonucleotide
tcttttctagtaaaatcatttaagg

SEQ ID NO: 709281 - DNA, 25 bp, Artificial sequence
  Synthetic oligonucleotide
gggtcaagccacatacttgggaaac

SEQ ID NO: 709282 - DNA, 25 bp, Artificial sequence
  Synthetic oligonucleotide
tgtacaaatgtatatctaatgttgg

SEQ ID NO: 709283 - DNA, 25 bp, Artificial sequence
  Synthetic oligonucleotide
ggtactttgccctcaatcttggcca

SEQ ID NO: 709284 - DNA, 25 bp, Artificial sequence
  Synthetic oligonucleotide
tgtacaaatgtaaatctaatgttgg

SEQ ID NO: 709285 - DNA, 25 bp, Artificial sequence
  Synthetic oligonucleotide
gccattgcatttcttgagcaccaga

SEQ ID NO: 709286 - DNA, 25 bp, Artificial sequence
  Synthetic oligonucleotide
gaccctgagaagaagaagtacccgg

SEQ ID NO: 709287 - DNA, 25 bp, Artificial sequence
  Synthetic oligonucleotide
gaccctgagaagtagaagtacccgg

SEQ ID NO: 709288 - DNA, 25 bp, Artificial sequence
  Synthetic oligonucleotide
gaccctcttggatactcgaaggacc

SEQ ID NO: 709289 - DNA, 25 bp, Artificial sequence
  Synthetic oligonucleotide
gaccctcttggaaactcgaaggacc

SEQ ID NO: 709290 - DNA, 25 bp, Artificial sequence
  Synthetic oligonucleotide
cgaggaattgaaagttaaagagatc

SEQ ID NO: 709291 - DNA, 25 bp, Artificial sequence
  Synthetic oligonucleotide
cgaggaattgaatgttaaagagatc

SEQ ID NO: 709292 - DNA, 25 bp, Artificial sequence
  Synthetic oligonucleotide
taagcacacacatcaacttaccttt

SEQ ID NO: 709293 - DNA, 25 bp, Artificial sequence
  Synthetic oligonucleotide
catactataaacaccataacagaag

SEQ ID NO: 709294 - DNA, 25 bp, Artificial sequence
  Synthetic oligonucleotide
ggtactttgcccacaatcttggcca

SEQ ID NO: 709295 - DNA, 25 bp, Artificial sequence
  Synthetic oligonucleotide
cttaaagaaaactttagatttgaca

SEQ ID NO: 709296 - DNA, 25 bp, Artificial sequence
  Synthetic oligonucleotide
catgactatttgatagatttctcaa

SEQ ID NO: 709297 - DNA, 25 bp, Artificial sequence
  Synthetic oligonucleotide
acatctttgacaatcaatggttccc

SEQ ID NO: 709298 - DNA, 25 bp, Artificial sequence
  Synthetic oligonucleotide
acatctttgacattcaatggttccc

SEQ ID NO: 709299 - DNA, 25 bp, Artificial sequence
  Synthetic oligonucleotide
ttgagctagaatatgaagaaaaatc

SEQ ID NO: 709300 - DNA, 25 bp, Artificial sequence
  Synthetic oligonucleotide
ttgagctagaatttgaagaaaaatc

SEQ ID NO: 709301 - DNA, 25 bp, Artificial sequence
  Synthetic oligonucleotide
ttacagattttaattcatatatggc

SEQ ID NO: 709302 - DNA, 25 bp, Artificial sequence
  Synthetic oligonucleotide
ttacagattttatttcatatatggc

SEQ ID NO: 709303 - DNA, 25 bp, Artificial sequence
  Synthetic oligonucleotide
tatatgattttctcaatttaattca

SEQ ID NO: 709304 - DNA, 25 bp, Artificial sequence
  Synthetic oligonucleotide
tatatgattttcacaatttaattca

SEQ ID NO: 709305 - DNA, 25 bp, Artificial sequence
  Synthetic oligonucleotide
tcaactataaagattaaatgagaca

SEQ ID NO: 709306 - DNA, 25 bp, Artificial sequence
  Synthetic oligonucleotide
tcaagtaatcagaatttcaaataat

SEQ ID NO: 709307 - DNA, 25 bp, Artificial sequence
  Synthetic oligonucleotide
cagagtcttggaaagttttgtcttc

SEQ ID NO: 709308 - DNA, 25 bp, Artificial sequence
  Synthetic oligonucleotide
cttaaagaaaacattagatttgaca

SEQ ID NO: 709309 - DNA, 25 bp, Artificial sequence
  Synthetic oligonucleotide
aaattttcaccattctcttccaata

SEQ ID NO: 709310 - DNA, 25 bp, Artificial sequence
  Synthetic oligonucleotide
aaattttcaccaatctcttccaata

SEQ ID NO: 709311 - DNA, 25 bp, Artificial sequence
  Synthetic oligonucleotide
ggagctatcttcgtaatcatatcca

SEQ ID NO: 709312 - DNA, 25 bp, Artificial sequence
  Synthetic oligonucleotide
ggagctatcttcctaatcatatcca

SEQ ID NO: 709313 - DNA, 25 bp, Artificial sequence
  Synthetic oligonucleotide
tgagatagaaacttgagctgcgtgg

SEQ ID NO: 709314 - DNA, 25 bp, Artificial sequence
  Synthetic oligonucleotide
tgagatagaaacatgagctgcgtgg

SEQ ID NO: 709315 - DNA, 25 bp, Artificial sequence
  Synthetic oligonucleotide
ttttttctgtctgattgacccaaag

SEQ ID NO: 709316 - DNA, 25 bp, Artificial sequence
  Synthetic oligonucleotide
ttttttctgtctcattgacccaaag

SEQ ID NO: 709317 - DNA, 25 bp, Artificial sequence
  Synthetic oligonucleotide
tcaagtaatcagtatttcaaataat

SEQ ID NO: 709318 - DNA, 25 bp, Artificial sequence
  Synthetic oligonucleotide
ttccccctcattattaccttctaca

SEQ ID NO: 709319 - DNA, 25 bp, Artificial sequence
  Synthetic oligonucleotide
gaaactgggttatggctcaggaatg

SEQ ID NO: 709320 - DNA, 25 bp, Artificial sequence
  Synthetic oligonucleotide
catactataaactccataacagaag

SEQ ID NO: 709321 - DNA, 25 bp, Artificial sequence
  Synthetic oligonucleotide
catgattatttgatagagttctcaa

SEQ ID NO: 709322 - DNA, 25 bp, Artificial sequence
  Synthetic oligonucleotide
catgattatttgttagagttctcaa

SEQ ID NO: 709323 - DNA, 25 bp, Artificial sequence
  Synthetic oligonucleotide
ccaaatatgctttttgtttatatca

SEQ ID NO: 709324 - DNA, 25 bp, Artificial sequence
  Synthetic oligonucleotide
ccaaatatgcttattgtttatatca

SEQ ID NO: 709325 - DNA, 25 bp, Artificial sequence
  Synthetic oligonucleotide
ggttattgaaccacaccaagataca

SEQ ID NO: 709326 - DNA, 25 bp, Artificial sequence
  Synthetic oligonucleotide
ggttattgaacctcaccaagataca

SEQ ID NO: 709327 - DNA, 25 bp, Artificial sequence
  Synthetic oligonucleotide
catttgagttttgatgaatattttc

SEQ ID NO: 709328 - DNA, 25 bp, Artificial sequence
  Synthetic oligonucleotide
tcaactataaagtttaaatgagaca

SEQ ID NO: 709329 - DNA, 25 bp, Artificial sequence
  Synthetic oligonucleotide
ttccccctcatttttaccttctaca

SEQ ID NO: 709330 - DNA, 25 bp, Artificial sequence
  Synthetic oligonucleotide
catgactatttgttagatttctcaa

SEQ ID NO: 709331 - DNA, 25 bp, Artificial sequence
  Synthetic oligonucleotide
catattgaacaataacaatcctgtt

SEQ ID NO: 709332 - DNA, 25 bp, Artificial sequence
  Synthetic oligonucleotide
tcttttctagtataatcatttaagg

SEQ ID NO: 709333 - DNA, 25 bp, Artificial sequence
  Synthetic oligonucleotide
aattagttgatgactttcttatcac

SEQ ID NO: 709334 - DNA, 25 bp, Artificial sequence
  Synthetic oligonucleotide
aattagttgatgtctttcttatcac

SEQ ID NO: 709335 - DNA, 25 bp, Artificial sequence
  Synthetic oligonucleotide
tatacttctactaatttttcttttg

SEQ ID NO: 709336 - DNA, 25 bp, Artificial sequence
  Synthetic oligonucleotide
tatacttctacttatttttcttttg

SEQ ID NO: 709337 - DNA, 25 bp, Artificial sequence
  Synthetic oligonucleotide
taatcttcaccttcaaaatagagta

SEQ ID NO: 709338 - DNA, 25 bp, Artificial sequence
  Synthetic oligonucleotide
taatcttcacctacaaaatagagta

SEQ ID NO: 709339 - DNA, 25 bp, Artificial sequence
  Synthetic oligonucleotide
cagagtcttggatagttttgtcttc

SEQ ID NO: 709340 - DNA, 25 bp, Artificial sequence
  Synthetic oligonucleotide
catttgagttttcatgaatattttc

SEQ ID NO: 709341 - DNA, 25 bp, Artificial sequence
  Synthetic oligonucleotide
tgttcgttgatcgaagttttaccgg

SEQ ID NO: 709342 - DNA, 25 bp, Artificial sequence
  Synthetic oligonucleotide
aatagtaatatacgtagattctgct

SEQ ID NO: 709343 - DNA, 25 bp, Artificial sequence
  Synthetic oligonucleotide
tatgctcattcaaatcctgattgag

SEQ ID NO: 709344 - DNA, 25 bp, Artificial sequence
  Synthetic oligonucleotide
tatgctcattcatatcctgattgag

SEQ ID NO: 709345 - DNA, 25 bp, Artificial sequence
  Synthetic oligonucleotide
gaaacttagttccaaagattctgaa

SEQ ID NO: 709346 - DNA, 25 bp, Artificial sequence
  Synthetic oligonucleotide
gaaacttagttcgaaagattctgaa

SEQ ID NO: 709347 - DNA, 25 bp, Artificial sequence
  Synthetic oligonucleotide
acagtgtgtctgcaaatggtattct

SEQ ID NO: 709348 - DNA, 25 bp, Artificial sequence
  Synthetic oligonucleotide
acagtgtgtctggaaatggtattct

SEQ ID NO: 709349 - DNA, 25 bp, Artificial sequence
  Synthetic oligonucleotide
tgtctaaacacgttgtctcaaaatg

SEQ ID NO: 709350 - DNA, 25 bp, Artificial sequence
  Synthetic oligonucleotide
tgtctaaacacgatgtctcaaaatg

SEQ ID NO: 709351 - DNA, 25 bp, Artificial sequence
  Synthetic oligonucleotide
ttgtttctgacttagagacatgaag

SEQ ID NO: 709352 - DNA, 25 bp, Artificial sequence
  Synthetic oligonucleotide
tagatactcctttcaagacatatga

SEQ ID NO: 709353 - DNA, 25 bp, Artificial sequence
  Synthetic oligonucleotide
ggtttatgtgtgaagtagtgctagt

SEQ ID NO: 709354 - DNA, 25 bp, Artificial sequence
  Synthetic oligonucleotide
gggtcaagccacttacttgggaaac

SEQ ID NO: 709355 - DNA, 25 bp, Artificial sequence
  Synthetic oligonucleotide
tctccagtcttagcaataaatccag

SEQ ID NO: 709356 - DNA, 25 bp, Artificial sequence
  Synthetic oligonucleotide
tccactgtagatcggctatgctcgc

SEQ ID NO: 709357 - DNA, 25 bp, Artificial sequence
  Synthetic oligonucleotide
caatcgcagattaaccggtccgggt

SEQ ID NO: 709358 - DNA, 25 bp, Artificial sequence
  Synthetic oligonucleotide
caatcgcagatttaccggtccgggt

SEQ ID NO: 709359 - DNA, 25 bp, Artificial sequence
  Synthetic oligonucleotide
cattagtagaaatgtgtttcaccga

SEQ ID NO: 709360 - DNA, 25 bp, Artificial sequence
  Synthetic oligonucleotide
cattagtagaaaagtgtttcaccga

SEQ ID NO: 709361 - DNA, 25 bp, Artificial sequence
  Synthetic oligonucleotide
tatctgatagcaactcgttgcagtg

SEQ ID NO: 709362 - DNA, 25 bp, Artificial sequence
  Synthetic oligonucleotide
tatctgatagcatctcgttgcagtg

SEQ ID NO: 709363 - DNA, 25 bp, Artificial sequence
  Synthetic oligonucleotide
tagatactccttacaagacatatga

SEQ ID NO: 709364 - DNA, 25 bp, Artificial sequence
  Synthetic oligonucleotide
tatctatctatctatcacctgggaa

SEQ ID NO: 709365 - DNA, 25 bp, Artificial sequence
  Synthetic oligonucleotide
taaagagtattcgaattggccgacg

SEQ ID NO: 709366 - DNA, 25 bp, Artificial sequence
  Synthetic oligonucleotide
taaagagtattccaattggccgacg

SEQ ID NO: 709367 - DNA, 25 bp, Artificial sequence
  Synthetic oligonucleotide
tatatcggcggtcagtttttcggtg

SEQ ID NO: 709368 - DNA, 25 bp, Artificial sequence
  Synthetic oligonucleotide
tatatcggcggtgagtttttcggtg

SEQ ID NO: 709369 - DNA, 25 bp, Artificial sequence
  Synthetic oligonucleotide
tactcttgaggcctttaagactgga

SEQ ID NO: 709370 - DNA, 25 bp, Artificial sequence
  Synthetic oligonucleotide
tactcttgaggcgtttaagactgga

SEQ ID NO: 709371 - DNA, 25 bp, Artificial sequence
  Synthetic oligonucleotide
aagaggtggagaaagctatgtgctc

SEQ ID NO: 709372 - DNA, 25 bp, Artificial sequence
  Synthetic oligonucleotide
aagaggtggagatagctatgtgctc

SEQ ID NO: 709373 - DNA, 25 bp, Artificial sequence
  Synthetic oligonucleotide
caatacttggttattgtgatgatgg

SEQ ID NO: 709374 - DNA, 25 bp, Artificial sequence
  Synthetic oligonucleotide
ttgtttctgactaagagacatgaag

SEQ ID NO: 709375 - DNA, 25 bp, Artificial sequence
  Synthetic oligonucleotide
tatctatctatcaatcacctgggaa

SEQ ID NO: 709376 - DNA, 25 bp, Artificial sequence
  Synthetic oligonucleotide
tctccagtcttaccaataaatccag

SEQ ID NO: 709377 - DNA, 25 bp, Artificial sequence
  Synthetic oligonucleotide
gatgtttcagagtttgtggttgtaa

SEQ ID NO: 709378 - DNA, 25 bp, Artificial sequence
  Synthetic oligonucleotide
gatgtttcagagattgtggttgtaa

SEQ ID NO: 709379 - DNA, 25 bp, Artificial sequence
  Synthetic oligonucleotide
catatattgtatgatggatttaggt

SEQ ID NO: 709380 - DNA, 25 bp, Artificial sequence
  Synthetic oligonucleotide
catatattgtatcatggatttaggt

SEQ ID NO: 709381 - DNA, 25 bp, Artificial sequence
  Synthetic oligonucleotide
ggagttgcttggaatttgagtttcc

SEQ ID NO: 709382 - DNA, 25 bp, Artificial sequence
  Synthetic oligonucleotide
ggagttgcttggtatttgagtttcc

SEQ ID NO: 709383 - DNA, 25 bp, Artificial sequence
  Synthetic oligonucleotide
tgtgttggcctggaaatttgtgttg

SEQ ID NO: 709384 - DNA, 25 bp, Artificial sequence
  Synthetic oligonucleotide
tgtgttggcctgcaaatttgtgttg

SEQ ID NO: 709385 - DNA, 25 bp, Artificial sequence
  Synthetic oligonucleotide
ggtttatgtgtgtagtagtgctagt

SEQ ID NO: 709386 - DNA, 25 bp, Artificial sequence
  Synthetic oligonucleotide
caatacttggtttttgtgatgatgg

SEQ ID NO: 709387 - DNA, 25 bp, Artificial sequence
  Synthetic oligonucleotide
ttctagatagattactggaacctct

SEQ ID NO: 709388 - DNA, 25 bp, Artificial sequence
  Synthetic oligonucleotide
ccttgacggttctgctcctgggtac

SEQ ID NO: 709389 - DNA, 25 bp, Artificial sequence
  Synthetic oligonucleotide
tactctgttttgttgctcagtttgg

SEQ ID NO: 709390 - DNA, 25 bp, Artificial sequence
  Synthetic oligonucleotide
tactctgttttgatgctcagtttgg

SEQ ID NO: 709391 - DNA, 25 bp, Artificial sequence
  Synthetic oligonucleotide
tagattactctgttttgatgacatg

SEQ ID NO: 709392 - DNA, 25 bp, Artificial sequence
  Synthetic oligonucleotide
tagattactctgatttgatgacatg

SEQ ID NO: 709393 - DNA, 25 bp, Artificial sequence
  Synthetic oligonucleotide
cattgtacgttttgtgaaagattca

SEQ ID NO: 709394 - DNA, 25 bp, Artificial sequence
  Synthetic oligonucleotide
cattgtacgtttagtgaaagattca

SEQ ID NO: 709395 - DNA, 25 bp, Artificial sequence
  Synthetic oligonucleotide
aatagtaatataggtagattctgct

SEQ ID NO: 709396 - DNA, 25 bp, Artificial sequence
  Synthetic oligonucleotide
tattgggtattcatatttcagaaag

SEQ ID NO: 709397 - DNA, 25 bp, Artificial sequence
  Synthetic oligonucleotide
ccttgacggttcagctcctgggtac

SEQ ID NO: 709398 - DNA, 25 bp, Artificial sequence
  Synthetic oligonucleotide
cagaatttgaattccctttagttgt

SEQ ID NO: 709399 - DNA, 25 bp, Artificial sequence
  Synthetic oligonucleotide
tattgggtattcttatttcagaaag

SEQ ID NO: 709400 - DNA, 25 bp, Artificial sequence
  Synthetic oligonucleotide
ttctagatagataactggaacctct

SEQ ID NO: 709401 - DNA, 25 bp, Artificial sequence
  Synthetic oligonucleotide
aagggttctgatttcaacattggag

SEQ ID NO: 709402 - DNA, 25 bp, Artificial sequence
  Synthetic oligonucleotide
aagggttctgatatcaacattggag

SEQ ID NO: 709403 - DNA, 25 bp, Artificial sequence
  Synthetic oligonucleotide
cagtttttctaagttattgggtaca

SEQ ID NO: 709404 - DNA, 25 bp, Artificial sequence
  Synthetic oligonucleotide
cagtttttctaacttattgggtaca

SEQ ID NO: 709405 - DNA, 25 bp, Artificial sequence
  Synthetic oligonucleotide
gactttgggtttgacccacttggac

SEQ ID NO: 709406 - DNA, 25 bp, Artificial sequence
  Synthetic oligonucleotide
gactttgggtttcacccacttggac

SEQ ID NO: 709407 - DNA, 25 bp, Artificial sequence
  Synthetic oligonucleotide
ccagcgaaccttgagagatacaaag

SEQ ID NO: 709408 - DNA, 25 bp, Artificial sequence
  Synthetic oligonucleotide
ccagcgaaccttcagagatacaaag

SEQ ID NO: 709409 - DNA, 25 bp, Artificial sequence
  Synthetic oligonucleotide
tgttcgttgatccaagttttaccgg

SEQ ID NO: 709410 - DNA, 25 bp, Artificial sequence
  Synthetic oligonucleotide
tgatatcgagaagacacgtggccca

SEQ ID NO: 709411 - DNA, 25 bp, Artificial sequence
  Synthetic oligonucleotide
cacatagtgcagttggatatcgaac

SEQ ID NO: 709412 - DNA, 25 bp, Artificial sequence
  Synthetic oligonucleotide
cagaatttgaataccctttagttgt

SEQ ID NO: 709413 - DNA, 25 bp, Artificial sequence
  Synthetic oligonucleotide
tgatatcgagaacacacgtggccca

SEQ ID NO: 709414 - DNA, 25 bp, Artificial sequence
  Synthetic oligonucleotide
tgctcactggatccctggcgagcca

SEQ ID NO: 709415 - DNA, 25 bp, Artificial sequence
  Synthetic oligonucleotide
cgcaggctctgtatagccaattgca

SEQ ID NO: 709416 - DNA, 25 bp, Artificial sequence
  Synthetic oligonucleotide
cgcaggctctgtttagccaattgca

SEQ ID NO: 709417 - DNA, 25 bp, Artificial sequence
  Synthetic oligonucleotide
gattctcatctctcaaatcttactt

SEQ ID NO: 709418 - DNA, 25 bp, Artificial sequence
  Synthetic oligonucleotide
gattctcatctcacaaatcttactt

SEQ ID NO: 709419 - DNA, 25 bp, Artificial sequence
  Synthetic oligonucleotide
ctcccacattcagacttccaccaaa

SEQ ID NO: 709420 - DNA, 25 bp, Artificial sequence
  Synthetic oligonucleotide
ctcccacattcacacttccaccaaa

SEQ ID NO: 709421 - DNA, 25 bp, Artificial sequence
  Synthetic oligonucleotide
ccaaacgccgggtatgttggtcgta

SEQ ID NO: 709422 - DNA, 25 bp, Artificial sequence
  Synthetic oligonucleotide
cacatagtgcagatggatatcgaac

SEQ ID NO: 709423 - DNA, 25 bp, Artificial sequence
  Synthetic oligonucleotide
cacatctttctcctttggtggcaaa

SEQ ID NO: 709424 - DNA, 25 bp, Artificial sequence
  Synthetic oligonucleotide
ccaaacgccgggaatgttggtcgta

SEQ ID NO: 709425 - DNA, 25 bp, Artificial sequence
  Synthetic oligonucleotide
tcttccaagtcttaattcgtatccg

SEQ ID NO: 709426 - DNA, 25 bp, Artificial sequence
  Synthetic oligonucleotide
tcttccaagtctaaattcgtatccg

SEQ ID NO: 709427 - DNA, 25 bp, Artificial sequence
  Synthetic oligonucleotide
gagctgtggcatagccgccgtgtac

SEQ ID NO: 709428 - DNA, 25 bp, Artificial sequence
  Synthetic oligonucleotide
gagctgtggcattgccgccgtgtac

SEQ ID NO: 709429 - DNA, 25 bp, Artificial sequence
  Synthetic oligonucleotide
tagagagaaacgatggcgtcgaact

SEQ ID NO: 709430 - DNA, 25 bp, Artificial sequence
  Synthetic oligonucleotide
tagagagaaacgttggcgtcgaact

SEQ ID NO: 709431 - DNA, 25 bp, Artificial sequence
  Synthetic oligonucleotide
cacatctttctcgtttggtggcaaa

SEQ ID NO: 709432 - DNA, 25 bp, Artificial sequence
  Synthetic oligonucleotide
tgctcactggatgcctggcgagcca

SEQ ID NO: 709433 - DNA, 25 bp, Artificial sequence
  Synthetic oligonucleotide
tcaaagaccatatagattcgaagcc

SEQ ID NO: 709434 - DNA, 25 bp, Artificial sequence
  Synthetic oligonucleotide
caagaataagcatctagtgccgact

SEQ ID NO: 709435 - DNA, 25 bp, Artificial sequence
  Synthetic oligonucleotide
cggtgaaattcatgagtaataaact

SEQ ID NO: 709436 - DNA, 25 bp, Artificial sequence
  Synthetic oligonucleotide
ccctatagaaaaaaataaaagcata

SEQ ID NO: 709437 - DNA, 25 bp, Artificial sequence
  Synthetic oligonucleotide
ccctatagaaaataataaaagcata

SEQ ID NO: 709438 - DNA, 25 bp, Artificial sequence
  Synthetic oligonucleotide
cattgttaaggttacgcaagaaggc

SEQ ID NO: 709439 - DNA, 25 bp, Artificial sequence
  Synthetic oligonucleotide
cattgttaaggtaacgcaagaaggc

SEQ ID NO: 709440 - DNA, 25 bp, Artificial sequence
  Synthetic oligonucleotide
ctcttggtgtctatattaattggta

SEQ ID NO: 709441 - DNA, 25 bp, Artificial sequence
  Synthetic oligonucleotide
ctcttggtgtctttattaattggta

SEQ ID NO: 709442 - DNA, 25 bp, Artificial sequence
  Synthetic oligonucleotide
cggtgaaattcaagagtaataaact

SEQ ID NO: 709443 - DNA, 25 bp, Artificial sequence
  Synthetic oligonucleotide
aatcccgatgtattctcttttacta

SEQ ID NO: 709444 - DNA, 25 bp, Artificial sequence
  Synthetic oligonucleotide
aatcccgatgtaatctcttttacta

SEQ ID NO: 709445 - DNA, 25 bp, Artificial sequence
  Synthetic oligonucleotide
ggtcgataaataaaccatggttttg

SEQ ID NO: 709446 - DNA, 25 bp, Artificial sequence
  Synthetic oligonucleotide
caagaataagcaactagtgccgact

SEQ ID NO: 709447 - DNA, 25 bp, Artificial sequence
  Synthetic oligonucleotide
tgtatggtggttcgtggagactacg

SEQ ID NO: 709448 - DNA, 25 bp, Artificial sequence
  Synthetic oligonucleotide
tgtatggtggttggtggagactacg

SEQ ID NO: 709449 - DNA, 25 bp, Artificial sequence
  Synthetic oligonucleotide
tacggtgacgtgaaaatgtgaccca

SEQ ID NO: 709450 - DNA, 25 bp, Artificial sequence
  Synthetic oligonucleotide
ggtcgataaatataccatggttttg

SEQ ID NO: 709451 - DNA, 25 bp, Artificial sequence
  Synthetic oligonucleotide
tcttatttctttctttctttatgcg

SEQ ID NO: 709452 - DNA, 25 bp, Artificial sequence
  Synthetic oligonucleotide
gatcagtttatattattttcaatgg

SEQ ID NO: 709453 - DNA, 25 bp, Artificial sequence
  Synthetic oligonucleotide
gatttcccgggtagcaacaacggta

SEQ ID NO: 709454 - DNA, 25 bp, Artificial sequence
  Synthetic oligonucleotide
gatttcccgggttgcaacaacggta

SEQ ID NO: 709455 - DNA, 25 bp, Artificial sequence
  Synthetic oligonucleotide
caaaccattgttggattgaagatca

SEQ ID NO: 709456 - DNA, 25 bp, Artificial sequence
  Synthetic oligonucleotide
caaaccattgttcgattgaagatca

SEQ ID NO: 709457 - DNA, 25 bp, Artificial sequence
  Synthetic oligonucleotide
gagcagctcattgccaacaaagcca

SEQ ID NO: 709458 - DNA, 25 bp, Artificial sequence
  Synthetic oligonucleotide
gagcagctcattcccaacaaagcca

SEQ ID NO: 709459 - DNA, 25 bp, Artificial sequence
  Synthetic oligonucleotide
gctaaagcctaaaacaaacgaagcg

SEQ ID NO: 709460 - DNA, 25 bp, Artificial sequence
  Synthetic oligonucleotide
gctaaagcctaatacaaacgaagcg

SEQ ID NO: 709461 - DNA, 25 bp, Artificial sequence
  Synthetic oligonucleotide
tagaacgcgtcgataaatacatccg

SEQ ID NO: 709462 - DNA, 25 bp, Artificial sequence
  Synthetic oligonucleotide
tacggagaagtctctcaacaaatgc

SEQ ID NO: 709463 - DNA, 25 bp, Artificial sequence
  Synthetic oligonucleotide
tcttatttctttgtttctttatgcg

SEQ ID NO: 709464 - DNA, 25 bp, Artificial sequence
  Synthetic oligonucleotide
cgtggaaagtcacttgagcaacctc

SEQ ID NO: 709465 - DNA, 25 bp, Artificial sequence
  Synthetic oligonucleotide
tttcatggcgaaaaggacggtcttg

SEQ ID NO: 709466 - DNA, 25 bp, Artificial sequence
  Synthetic oligonucleotide
tttcatggcgaataggacggtcttg

SEQ ID NO: 709467 - DNA, 25 bp, Artificial sequence
  Synthetic oligonucleotide
tgtggagataaatagaaaaagcctg

SEQ ID NO: 709468 - DNA, 25 bp, Artificial sequence
  Synthetic oligonucleotide
tgtggagataaaaagaaaaagcctg

SEQ ID NO: 709469 - DNA, 25 bp, Artificial sequence
  Synthetic oligonucleotide
gaatagcagagctataacagttcag

SEQ ID NO: 709470 - DNA, 25 bp, Artificial sequence
  Synthetic oligonucleotide
gaatagcagagcaataacagttcag

SEQ ID NO: 709471 - DNA, 25 bp, Artificial sequence
  Synthetic oligonucleotide
ccttcaaaatttcttctttacagca

SEQ ID NO: 709472 - DNA, 25 bp, Artificial sequence
  Synthetic oligonucleotide
ccttcaaaatttgttctttacagca

SEQ ID NO: 709473 - DNA, 25 bp, Artificial sequence
  Synthetic oligonucleotide
tcaaaccacaaatcaactaagcaaa

SEQ ID NO: 709474 - DNA, 25 bp, Artificial sequence
  Synthetic oligonucleotide
tcaaaccacaaaacaactaagcaaa

SEQ ID NO: 709475 - DNA, 25 bp, Artificial sequence
  Synthetic oligonucleotide
tagaacgcgtcgttaaatacatccg

SEQ ID NO: 709476 - DNA, 25 bp, Artificial sequence
  Synthetic oligonucleotide
gaacctgactcctacttcgaccatg

SEQ ID NO: 709477 - DNA, 25 bp, Artificial sequence
  Synthetic oligonucleotide
tcaaagaccataaagattcgaagcc

SEQ ID NO: 709478 - DNA, 25 bp, Artificial sequence
  Synthetic oligonucleotide
cgcaaaagcagttcgcggatgcggt

SEQ ID NO: 709479 - DNA, 25 bp, Artificial sequence
  Synthetic oligonucleotide
tgcttcctacgactctgatcccaga

SEQ ID NO: 709480 - DNA, 25 bp, Artificial sequence
  Synthetic oligonucleotide
tgcttcctacgagtctgatcccaga

SEQ ID NO: 709481 - DNA, 25 bp, Artificial sequence
  Synthetic oligonucleotide
gaaagtgttgagtgtgagattgata

SEQ ID NO: 709482 - DNA, 25 bp, Artificial sequence
  Synthetic oligonucleotide
gaaagtgttgagagtgagattgata

SEQ ID NO: 709483 - DNA, 25 bp, Artificial sequence
  Synthetic oligonucleotide
tgttaagtacttcagcccggtttac

SEQ ID NO: 709484 - DNA, 25 bp, Artificial sequence
  Synthetic oligonucleotide
tgttaagtacttgagcccggtttac

SEQ ID NO: 709485 - DNA, 25 bp, Artificial sequence
  Synthetic oligonucleotide
gaaggttcaaccatctcgtggattc

SEQ ID NO: 709486 - DNA, 25 bp, Artificial sequence
  Synthetic oligonucleotide
gaaggttcaaccttctcgtggattc

SEQ ID NO: 709487 - DNA, 25 bp, Artificial sequence
  Synthetic oligonucleotide
tacggagaagtcactcaacaaatgc

SEQ ID NO: 709488 - DNA, 25 bp, Artificial sequence
  Synthetic oligonucleotide
aaactcacttgctcgtaccctggca

SEQ ID NO: 709489 - DNA, 25 bp, Artificial sequence
  Synthetic oligonucleotide
tgtcaaatagcttttggattacaaa

SEQ ID NO: 709490 - DNA, 25 bp, Artificial sequence
  Synthetic oligonucleotide
gaacctgactccaacttcgaccatg

SEQ ID NO: 709491 - DNA, 25 bp, Artificial sequence
  Synthetic oligonucleotide
tattgcataatgacatattgtgaga

SEQ ID NO: 709492 - DNA, 25 bp, Artificial sequence
  Synthetic oligonucleotide
tattgcataatgtcatattgtgaga

SEQ ID NO: 709493 - DNA, 25 bp, Artificial sequence
  Synthetic oligonucleotide
aatgcatgtgtaagagaatttagac

SEQ ID NO: 709494 - DNA, 25 bp, Artificial sequence
  Synthetic oligonucleotide
aatgcatgtgtatgagaatttagac

SEQ ID NO: 709495 - DNA, 25 bp, Artificial sequence
  Synthetic oligonucleotide
tatctcccttttagtttctctcagg

SEQ ID NO: 709496 - DNA, 25 bp, Artificial sequence
  Synthetic oligonucleotide
tatctccctttttgtttctctcagg

SEQ ID NO: 709497 - DNA, 25 bp, Artificial sequence
  Synthetic oligonucleotide
ggatggacaatttgatagactggac

SEQ ID NO: 709498 - DNA, 25 bp, Artificial sequence
  Synthetic oligonucleotide
ggatggacaattagatagactggac

SEQ ID NO: 709499 - DNA, 25 bp, Artificial sequence
  Synthetic oligonucleotide
cgtggaaagtcagttgagcaacctc

SEQ ID NO: 709500 - DNA, 25 bp, Artificial sequence
  Synthetic oligonucleotide
aaactcacttgcacgtaccctggca

SEQ ID NO: 709501 - DNA, 25 bp, Artificial sequence
  Synthetic oligonucleotide
tacacattgcttttagtgagtcaag

SEQ ID NO: 709502 - DNA, 25 bp, Artificial sequence
  Synthetic oligonucleotide
gcaaaaaccatatcatttgttttga

SEQ ID NO: 709503 - DNA, 25 bp, Artificial sequence
  Synthetic oligonucleotide
gcaaaaaccataacatttgttttga

SEQ ID NO: 709504 - DNA, 25 bp, Artificial sequence
  Synthetic oligonucleotide
tattcaggatcatcaagaacatccc

SEQ ID NO: 709505 - DNA, 25 bp, Artificial sequence
  Synthetic oligonucleotide
tattcaggatcaacaagaacatccc

SEQ ID NO: 709506 - DNA, 25 bp, Artificial sequence
  Synthetic oligonucleotide
ttaaaggcatgatccgacgtcgcac

SEQ ID NO: 709507 - DNA, 25 bp, Artificial sequence
  Synthetic oligonucleotide
ttaaaggcatgaaccgacgtcgcac

SEQ ID NO: 709508 - DNA, 25 bp, Artificial sequence
  Synthetic oligonucleotide
aataagcttcttgtcctgctgcttc

SEQ ID NO: 709509 - DNA, 25 bp, Artificial sequence
  Synthetic oligonucleotide
aataagcttcttctcctgctgcttc

SEQ ID NO: 709510 - DNA, 25 bp, Artificial sequence
  Synthetic oligonucleotide
gccttctgtgtctaataacttctcc

SEQ ID NO: 709511 - DNA, 25 bp, Artificial sequence
  Synthetic oligonucleotide
gccttctgtgtcaaataacttctcc

SEQ ID NO: 709512 - DNA, 25 bp, Artificial sequence
  Synthetic oligonucleotide
tatcctattgatcatactcatgttg

SEQ ID NO: 709513 - DNA, 25 bp, Artificial sequence
  Synthetic oligonucleotide
gatgttcatcaaaacatcctctttg

SEQ ID NO: 709514 - DNA, 25 bp, Artificial sequence
  Synthetic oligonucleotide
tgaaaacaaacacaaacaccaatta

SEQ ID NO: 709515 - DNA, 25 bp, Artificial sequence
  Synthetic oligonucleotide
tacacattgcttatagtgagtcaag

SEQ ID NO: 709516 - DNA, 25 bp, Artificial sequence
  Synthetic oligonucleotide
cttagttataaggacctgatgaatc

SEQ ID NO: 709517 - DNA, 25 bp, Artificial sequence
  Synthetic oligonucleotide
cttagttataagcacctgatgaatc

SEQ ID NO: 709518 - DNA, 25 bp, Artificial sequence
  Synthetic oligonucleotide
gatgacttcattacagaatgcaaag

SEQ ID NO: 709519 - DNA, 25 bp, Artificial sequence
  Synthetic oligonucleotide
gatgacttcatttcagaatgcaaag

SEQ ID NO: 709520 - DNA, 25 bp, Artificial sequence
  Synthetic oligonucleotide
tataactattcttcaaagcagcagc

SEQ ID NO: 709521 - DNA, 25 bp, Artificial sequence
  Synthetic oligonucleotide
tataactattctacaaagcagcagc

SEQ ID NO: 709522 - DNA, 25 bp, Artificial sequence
  Synthetic oligonucleotide
ggtctccttggcgatcccacctata

SEQ ID NO: 709523 - DNA, 25 bp, Artificial sequence
  Synthetic oligonucleotide
ggtctccttggccatcccacctata

SEQ ID NO: 709524 - DNA, 25 bp, Artificial sequence
  Synthetic oligonucleotide
gataaccataaaagagagtttttga

SEQ ID NO: 709525 - DNA, 25 bp, Artificial sequence
  Synthetic oligonucleotide
gatgttcatcaatacatcctctttg

SEQ ID NO: 709526 - DNA, 25 bp, Artificial sequence
  Synthetic oligonucleotide
cagattcaacaagtaagtaagaaca

SEQ ID NO: 709527 - DNA, 25 bp, Artificial sequence
  Synthetic oligonucleotide
gatcagtttataatattttcaatgg

SEQ ID NO: 709528 - DNA, 25 bp, Artificial sequence
  Synthetic oligonucleotide
tgtcaaatagctattggattacaaa

SEQ ID NO: 709529 - DNA, 25 bp, Artificial sequence
  Synthetic oligonucleotide
agttcaaacttcgttatagattcca

SEQ ID NO: 709530 - DNA, 25 bp, Artificial sequence
  Synthetic oligonucleotide
agttcaaacttccttatagattcca

SEQ ID NO: 709531 - DNA, 25 bp, Artificial sequence
  Synthetic oligonucleotide
gcaaagaaattatacatacaagtaa

SEQ ID NO: 709532 - DNA, 25 bp, Artificial sequence
  Synthetic oligonucleotide
gcaaagaaattaaacatacaagtaa

SEQ ID NO: 709533 - DNA, 25 bp, Artificial sequence
  Synthetic oligonucleotide
tgcaatcaccaagtactactttggg

SEQ ID NO: 709534 - DNA, 25 bp, Artificial sequence
  Synthetic oligonucleotide
tgcaatcaccaactactactttggg

SEQ ID NO: 709535 - DNA, 25 bp, Artificial sequence
  Synthetic oligonucleotide
gcctttgatgccttctggatcagcc

SEQ ID NO: 709536 - DNA, 25 bp, Artificial sequence
  Synthetic oligonucleotide
gcctttgatgccatctggatcagcc

SEQ ID NO: 709537 - DNA, 25 bp, Artificial sequence
  Synthetic oligonucleotide
cacaaagcatttatattggcaagca

SEQ ID NO: 709538 - DNA, 25 bp, Artificial sequence
  Synthetic oligonucleotide
gttctgatagaattccacaactaca

SEQ ID NO: 709539 - DNA, 25 bp, Artificial sequence
  Synthetic oligonucleotide
cacaaagcatttttattggcaagca

SEQ ID NO: 709540 - DNA, 25 bp, Artificial sequence
  Synthetic oligonucleotide
cagattcaacaactaagtaagaaca

SEQ ID NO: 709541 - DNA, 25 bp, Artificial sequence
  Synthetic oligonucleotide
tgaccacaaaaaatgcagattaaac

SEQ ID NO: 709542 - DNA, 25 bp, Artificial sequence
  Synthetic oligonucleotide
tgaccacaaaaattgcagattaaac

SEQ ID NO: 709543 - DNA, 25 bp, Artificial sequence
  Synthetic oligonucleotide
ttaccttgactatctgcaaacagag

SEQ ID NO: 709544 - DNA, 25 bp, Artificial sequence
  Synthetic oligonucleotide
ttaccttgactaactgcaaacagag

SEQ ID NO: 709545 - DNA, 25 bp, Artificial sequence
  Synthetic oligonucleotide
caatatctctttcaagaagagccct

SEQ ID NO: 709546 - DNA, 25 bp, Artificial sequence
  Synthetic oligonucleotide
caatatctctttgaagaagagccct

SEQ ID NO: 709547 - DNA, 25 bp, Artificial sequence
  Synthetic oligonucleotide
caacaagagctttacctagcccttg

SEQ ID NO: 709548 - DNA, 25 bp, Artificial sequence
  Synthetic oligonucleotide
caacaagagcttaacctagcccttg

SEQ ID NO: 709549 - DNA, 25 bp, Artificial sequence
  Synthetic oligonucleotide
tgaaaacaaacagaaacaccaatta

SEQ ID NO: 709550 - DNA, 25 bp, Artificial sequence
  Synthetic oligonucleotide
tatcctattgatgatactcatgttg

SEQ ID NO: 709551 - DNA, 25 bp, Artificial sequence
  Synthetic oligonucleotide
gttctgatagaaatccacaactaca

SEQ ID NO: 709552 - DNA, 25 bp, Artificial sequence
  Synthetic oligonucleotide
caccaaacaaactacaatggctgtc

SEQ ID NO: 709553 - DNA, 25 bp, Artificial sequence
  Synthetic oligonucleotide
cgcaaaagcagtacgcggatgcggt

SEQ ID NO: 709554 - DNA, 25 bp, Artificial sequence
  Synthetic oligonucleotide
tgtttttcctattgacccattgtcc

SEQ ID NO: 709555 - DNA, 25 bp, Artificial sequence
  Synthetic oligonucleotide
tctctctttcccgatttaatcttat

SEQ ID NO: 709556 - DNA, 25 bp, Artificial sequence
  Synthetic oligonucleotide
tctctctttccccatttaatcttat

SEQ ID NO: 709557 - DNA, 25 bp, Artificial sequence
  Synthetic oligonucleotide
aaaaatcacatctctatatcaccac

SEQ ID NO: 709558 - DNA, 25 bp, Artificial sequence
  Synthetic oligonucleotide
aaaaatcacatcactatatcaccac

SEQ ID NO: 709559 - DNA, 25 bp, Artificial sequence
  Synthetic oligonucleotide
taaaatcaaaaatcgttacccacat

SEQ ID NO: 709560 - DNA, 25 bp, Artificial sequence
  Synthetic oligonucleotide
taaaatcaaaaaacgttacccacat

SEQ ID NO: 709561 - DNA, 25 bp, Artificial sequence
  Synthetic oligonucleotide
taaatcctcatcactcaacctgagc

SEQ ID NO: 709562 - DNA, 25 bp, Artificial sequence
  Synthetic oligonucleotide
taaatcctcatctctcaacctgagc

SEQ ID NO: 709563 - DNA, 25 bp, Artificial sequence
  Synthetic oligonucleotide
aaataaaactccatttcttctctgc

SEQ ID NO: 709564 - DNA, 25 bp, Artificial sequence
  Synthetic oligonucleotide
aaaaaaagagcttaggcggagaaga

SEQ ID NO: 709565 - DNA, 25 bp, Artificial sequence
  Synthetic oligonucleotide
aaataaaactccttttcttctctgc

SEQ ID NO: 709566 - DNA, 25 bp, Artificial sequence
  Synthetic oligonucleotide
caccaaacaaacaacaatggctgtc

SEQ ID NO: 709567 - DNA, 25 bp, Artificial sequence
  Synthetic oligonucleotide
tcaacacaagctctcaattcaactc

SEQ ID NO: 709568 - DNA, 25 bp, Artificial sequence
  Synthetic oligonucleotide
tcaacacaagctgtcaattcaactc

SEQ ID NO: 709569 - DNA, 25 bp, Artificial sequence
  Synthetic oligonucleotide
tcttcttcctcctccaaacaagtct

SEQ ID NO: 709570 - DNA, 25 bp, Artificial sequence
  Synthetic oligonucleotide
tcttcttcctccaccaaacaagtct

SEQ ID NO: 709571 - DNA, 25 bp, Artificial sequence
  Synthetic oligonucleotide
cgtcaaccacaatccaaccgtagat

SEQ ID NO: 709572 - DNA, 25 bp, Artificial sequence
  Synthetic oligonucleotide
cgtcaaccacaaaccaaccgtagat

SEQ ID NO: 709573 - DNA, 25 bp, Artificial sequence
  Synthetic oligonucleotide
tcacttgcgcacaagaaaccatcgt

SEQ ID NO: 709574 - DNA, 25 bp, Artificial sequence
  Synthetic oligonucleotide
tcacttgcgcactagaaaccatcgt

SEQ ID NO: 709575 - DNA, 25 bp, Artificial sequence
  Synthetic oligonucleotide
tgctgactctggctgcggcaaaagt

SEQ ID NO: 709576 - DNA, 25 bp, Artificial sequence
  Synthetic oligonucleotide
aaaaaaagagctaaggcggagaaga

SEQ ID NO: 709577 - DNA, 25 bp, Artificial sequence
  Synthetic oligonucleotide
tctccaaattatgttttagccaaaa

SEQ ID NO: 709578 - DNA, 25 bp, Artificial sequence
  Synthetic oligonucleotide
gataaccataaatgagagtttttga

SEQ ID NO: 709579 - DNA, 25 bp, Artificial sequence
  Synthetic oligonucleotide
tcatcttcagacgttaaacacctaa

SEQ ID NO: 709580 - DNA, 25 bp, Artificial sequence
  Synthetic oligonucleotide
tcatcttcagaccttaaacacctaa

SEQ ID NO: 709581 - DNA, 25 bp, Artificial sequence
  Synthetic oligonucleotide
tgtccaattagattctcccacgtgt

SEQ ID NO: 709582 - DNA, 25 bp, Artificial sequence
  Synthetic oligonucleotide
tgtccaattagaatctcccacgtgt

SEQ ID NO: 709583 - DNA, 25 bp, Artificial sequence
  Synthetic oligonucleotide
tatccaaatcccaaaaaaataagca

SEQ ID NO: 709584 - DNA, 25 bp, Artificial sequence
  Synthetic oligonucleotide
tatccaaatccctaaaaaataagca

SEQ ID NO: 709585 - DNA, 25 bp, Artificial sequence
  Synthetic oligonucleotide
aacgtctccctcgatgccctgttag

SEQ ID NO: 709586 - DNA, 25 bp, Artificial sequence
  Synthetic oligonucleotide
aacgtctccctccatgccctgttag

SEQ ID NO: 709587 - DNA, 25 bp, Artificial sequence
  Synthetic oligonucleotide
acttcatcggcatctccactcctct

SEQ ID NO: 709588 - DNA, 25 bp, Artificial sequence
  Synthetic oligonucleotide
tgtttttcctatagacccattgtcc

SEQ ID NO: 709589 - DNA, 25 bp, Artificial sequence
  Synthetic oligonucleotide
tctccaaattatcttttagccaaaa

SEQ ID NO: 709590 - DNA, 25 bp, Artificial sequence
  Synthetic oligonucleotide
atgcggaggctctccagcgtctttg

SEQ ID NO: 709591 - DNA, 25 bp, Artificial sequence
  Synthetic oligonucleotide
accataagtttaatacttcatgaag

SEQ ID NO: 709592 - DNA, 25 bp, Artificial sequence
  Synthetic oligonucleotide
accataagtttattacttcatgaag

SEQ ID NO: 709593 - DNA, 25 bp, Artificial sequence
  Synthetic oligonucleotide
gatctttggttttttaatggctata

SEQ ID NO: 709594 - DNA, 25 bp, Artificial sequence
  Synthetic oligonucleotide
gatctttggtttattaatggctata

SEQ ID NO: 709595 - DNA, 25 bp, Artificial sequence
  Synthetic oligonucleotide
tcctcttatcttatcaacaacatct

SEQ ID NO: 709596 - DNA, 25 bp, Artificial sequence
  Synthetic oligonucleotide
tcctcttatcttttcaacaacatct

SEQ ID NO: 709597 - DNA, 25 bp, Artificial sequence
  Synthetic oligonucleotide
gagactaatcaagattacaaacaat

SEQ ID NO: 709598 - DNA, 25 bp, Artificial sequence
  Synthetic oligonucleotide
gagactaatcaacattacaaacaat

SEQ ID NO: 709599 - DNA, 25 bp, Artificial sequence
  Synthetic oligonucleotide
caagaaaccaaatcatgagccaatc

SEQ ID NO: 709600 - DNA, 25 bp, Artificial sequence
  Synthetic oligonucleotide
caagaaaccaaaacatgagccaatc

SEQ ID NO: 709601 - DNA, 25 bp, Artificial sequence
  Synthetic oligonucleotide
acttcatcggcaactccactcctct

SEQ ID NO: 709602 - DNA, 25 bp, Artificial sequence
  Synthetic oligonucleotide
gaataattcaacaacatttacacca

SEQ ID NO: 709603 - DNA, 25 bp, Artificial sequence
  Synthetic oligonucleotide
taaagatggatcattgaatctatgc

SEQ ID NO: 709604 - DNA, 25 bp, Artificial sequence
  Synthetic oligonucleotide
tgtgacaccgataaatttttattcg

SEQ ID NO: 709605 - DNA, 25 bp, Artificial sequence
  Synthetic oligonucleotide
tgtgacaccgattaatttttattcg

SEQ ID NO: 709606 - DNA, 25 bp, Artificial sequence
  Synthetic oligonucleotide
gtctatagttttcgtacttgtaatg

SEQ ID NO: 709607 - DNA, 25 bp, Artificial sequence
  Synthetic oligonucleotide
gtctatagttttggtacttgtaatg

SEQ ID NO: 709608 - DNA, 25 bp, Artificial sequence
  Synthetic oligonucleotide
atctacttgtgaaggtttgatgagc

SEQ ID NO: 709609 - DNA, 25 bp, Artificial sequence
  Synthetic oligonucleotide
atctacttgtgatggtttgatgagc

SEQ ID NO: 709610 - DNA, 25 bp, Artificial sequence
  Synthetic oligonucleotide
tactagacttcactatctacttgga

SEQ ID NO: 709611 - DNA, 25 bp, Artificial sequence
  Synthetic oligonucleotide
tactagacttcagtatctacttgga

SEQ ID NO: 709612 - DNA, 25 bp, Artificial sequence
  Synthetic oligonucleotide
gtcaaattcgcttggaaaattcagg

SEQ ID NO: 709613 - DNA, 25 bp, Artificial sequence
  Synthetic oligonucleotide
tgctgactctgggtgcggcaaaagt

SEQ ID NO: 709614 - DNA, 25 bp, Artificial sequence
  Synthetic oligonucleotide
gaataattcaactacatttacacca

SEQ ID NO: 709615 - DNA, 25 bp, Artificial sequence
  Synthetic oligonucleotide
ggacttagatttatactagaatcag

SEQ ID NO: 709616 - DNA, 25 bp, Artificial sequence
  Synthetic oligonucleotide
cggtttatcttaaaaaactgaatct

SEQ ID NO: 709617 - DNA, 25 bp, Artificial sequence
  Synthetic oligonucleotide
cggtttatcttataaaactgaatct

SEQ ID NO: 709618 - DNA, 25 bp, Artificial sequence
  Synthetic oligonucleotide
tggtcacagagggacatggctgaaa

SEQ ID NO: 709619 - DNA, 25 bp, Artificial sequence
  Synthetic oligonucleotide
tggtcacagaggcacatggctgaaa

SEQ ID NO: 709620 - DNA, 25 bp, Artificial sequence
  Synthetic oligonucleotide
ttggagagcatcaaagcgagtatcg

SEQ ID NO: 709621 - DNA, 25 bp, Artificial sequence
  Synthetic oligonucleotide
ttggagagcatctaagcgagtatcg

SEQ ID NO: 709622 - DNA, 25 bp, Artificial sequence
  Synthetic oligonucleotide
gaaagcccgacttcgatgcattcat

SEQ ID NO: 709623 - DNA, 25 bp, Artificial sequence
  Synthetic oligonucleotide
gaaagcccgactacgatgcattcat

SEQ ID NO: 709624 - DNA, 25 bp, Artificial sequence
  Synthetic oligonucleotide
taatttcttgatctaaccccgtgtc

SEQ ID NO: 709625 - DNA, 25 bp, Artificial sequence
  Synthetic oligonucleotide
taatttcttgatgtaaccccgtgtc

SEQ ID NO: 709626 - DNA, 25 bp, Artificial sequence
  Synthetic oligonucleotide
gtcaaattcgctaggaaaattcagg

SEQ ID NO: 709627 - DNA, 25 bp, Artificial sequence
  Synthetic oligonucleotide
tatagccgtcgagaaaccgatttat

SEQ ID NO: 709628 - DNA, 25 bp, Artificial sequence
  Synthetic oligonucleotide
tacggtgacgtgtaaatgtgaccca

SEQ ID NO: 709629 - DNA, 25 bp, Artificial sequence
  Synthetic oligonucleotide
tgctaagccaccaaaaggcgggaac

SEQ ID NO: 709630 - DNA, 25 bp, Artificial sequence
  Synthetic oligonucleotide
tgctaagccacctaaaggcgggaac

SEQ ID NO: 709631 - DNA, 25 bp, Artificial sequence
  Synthetic oligonucleotide
actcatcagcgacacgaccactgtg

SEQ ID NO: 709632 - DNA, 25 bp, Artificial sequence
  Synthetic oligonucleotide
actcatcagcgagacgaccactgtg

SEQ ID NO: 709633 - DNA, 25 bp, Artificial sequence
  Synthetic oligonucleotide
gattaccattctttggataggtacg

SEQ ID NO: 709634 - DNA, 25 bp, Artificial sequence
  Synthetic oligonucleotide
gattaccattctatggataggtacg

SEQ ID NO: 709635 - DNA, 25 bp, Artificial sequence
  Synthetic oligonucleotide
agaaagtcaccggtttggacccacg

SEQ ID NO: 709636 - DNA, 25 bp, Artificial sequence
  Synthetic oligonucleotide
agaaagtcaccgctttggacccacg

SEQ ID NO: 709637 - DNA, 25 bp, Artificial sequence
  Synthetic oligonucleotide
tctcatgtatgagcaagtcaaagct

SEQ ID NO: 709638 - DNA, 25 bp, Artificial sequence
  Synthetic oligonucleotide
taaagatggatctttgaatctatgc

SEQ ID NO: 709639 - DNA, 25 bp, Artificial sequence
  Synthetic oligonucleotide
tatagccgtcgacaaaccgatttat

SEQ ID NO: 709640 - DNA, 25 bp, Artificial sequence
  Synthetic oligonucleotide
ggacttagatttttactagaatcag

SEQ ID NO: 709641 - DNA, 25 bp, Artificial sequence
  Synthetic oligonucleotide
tggacttcttgaccctccggagctt

SEQ ID NO: 709642 - DNA, 25 bp, Artificial sequence
  Synthetic oligonucleotide
tggacttcttgagcctccggagctt

SEQ ID NO: 709643 - DNA, 25 bp, Artificial sequence
  Synthetic oligonucleotide
cctaagattcttgtcatcgaaggtc

SEQ ID NO: 709644 - DNA, 25 bp, Artificial sequence
  Synthetic oligonucleotide
cctaagattcttctcatcgaaggtc

SEQ ID NO: 709645 - DNA, 25 bp, Artificial sequence
  Synthetic oligonucleotide
tgtaagctacacttactctgttatg

SEQ ID NO: 709646 - DNA, 25 bp, Artificial sequence
  Synthetic oligonucleotide
tgtaagctacacatactctgttatg

SEQ ID NO: 709647 - DNA, 25 bp, Artificial sequence
  Synthetic oligonucleotide
tcttagacatactcaaattttagag

SEQ ID NO: 709648 - DNA, 25 bp, Artificial sequence
  Synthetic oligonucleotide
tcttagacatacacaaattttagag

SEQ ID NO: 709649 - DNA, 25 bp, Artificial sequence
  Synthetic oligonucleotide
gtctcttatcttgtcggaatttcga

SEQ ID NO: 709650 - DNA, 25 bp, Artificial sequence
  Synthetic oligonucleotide
gtctcttatcttctcggaatttcga

SEQ ID NO: 709651 - DNA, 25 bp, Artificial sequence
  Synthetic oligonucleotide
atgcggaggctcaccagcgtctttg

SEQ ID NO: 709652 - DNA, 25 bp, Artificial sequence
  Synthetic oligonucleotide
tctcatgtatgaccaagtcaaagct

SEQ ID NO: 709653 - DNA, 25 bp, Artificial sequence
  Synthetic oligonucleotide
taattgtgttatcacccaaaagaga

SEQ ID NO: 709654 - DNA, 25 bp, Artificial sequence
  Synthetic oligonucleotide
ttcgttagtagatgaaactagaaag

SEQ ID NO: 709655 - DNA, 25 bp, Artificial sequence
  Synthetic oligonucleotide
ggtgccacctccgtgctgtgcagga

SEQ ID NO: 709656 - DNA, 25 bp, Artificial sequence
  Synthetic oligonucleotide
ggtgccacctccctgctgtgcagga

SEQ ID NO: 709657 - DNA, 25 bp, Artificial sequence
  Synthetic oligonucleotide
tgagtccatgtcaaggctacctatc

SEQ ID NO: 709658 - DNA, 25 bp, Artificial sequence
  Synthetic oligonucleotide
tgagtccatgtctaggctacctatc

SEQ ID NO: 709659 - DNA, 25 bp, Artificial sequence
  Synthetic oligonucleotide
gcagcaataacaagtggcacagtgg

SEQ ID NO: 709660 - DNA, 25 bp, Artificial sequence
  Synthetic oligonucleotide
gcagcaataacatgtggcacagtgg

SEQ ID NO: 709661 - DNA, 25 bp, Artificial sequence
  Synthetic oligonucleotide
tgttttgacagtgttcatcgttgca

SEQ ID NO: 709662 - DNA, 25 bp, Artificial sequence
  Synthetic oligonucleotide
tgttttgacagtcttcatcgttgca

SEQ ID NO: 709663 - DNA, 25 bp, Artificial sequence
  Synthetic oligonucleotide
tgaacggtatggctcaaaccacacc

SEQ ID NO: 709664 - DNA, 25 bp, Artificial sequence
  Synthetic oligonucleotide
cacaatggctttggctttgaggttc

SEQ ID NO: 709665 - DNA, 25 bp, Artificial sequence
  Synthetic oligonucleotide
gcatgcagatgcatacagtccgctg

SEQ ID NO: 709666 - DNA, 25 bp, Artificial sequence
  Synthetic oligonucleotide
taattgtgttatgacccaaaagaga

SEQ ID NO: 709667 - DNA, 25 bp, Artificial sequence
  Synthetic oligonucleotide
tccaacaacaaaacacaagcgtaga

SEQ ID NO: 709668 - DNA, 25 bp, Artificial sequence
  Synthetic oligonucleotide
tccaacaacaaatcacaagcgtaga

SEQ ID NO: 709669 - DNA, 25 bp, Artificial sequence
  Synthetic oligonucleotide
tatataaacccaacatcatctccca

SEQ ID NO: 709670 - DNA, 25 bp, Artificial sequence
  Synthetic oligonucleotide
tatataaacccatcatcatctccca

SEQ ID NO: 709671 - DNA, 25 bp, Artificial sequence
  Synthetic oligonucleotide
tagtcatcatttatcccccatacga

SEQ ID NO: 709672 - DNA, 25 bp, Artificial sequence
  Synthetic oligonucleotide
tagtcatcatttttcccccatacga

SEQ ID NO: 709673 - DNA, 25 bp, Artificial sequence
  Synthetic oligonucleotide
taaatgcaaaacgaactactaacaa

SEQ ID NO: 709674 - DNA, 25 bp, Artificial sequence
  Synthetic oligonucleotide
tatgttgtatacatgtgtcttaaca

SEQ ID NO: 709675 - DNA, 25 bp, Artificial sequence
  Synthetic oligonucleotide
cacaatggctttcgctttgaggttc

SEQ ID NO: 709676 - DNA, 25 bp, Artificial sequence
  Synthetic oligonucleotide
acttggctaattactcgatcttgag

SEQ ID NO: 709677 - DNA, 25 bp, Artificial sequence
  Synthetic oligonucleotide
tgtttgtcttgaaggctttgtaatc

SEQ ID NO: 709678 - DNA, 25 bp, Artificial sequence
  Synthetic oligonucleotide
tgtttgtcttgatggctttgtaatc

SEQ ID NO: 709679 - DNA, 25 bp, Artificial sequence
  Synthetic oligonucleotide
taagacggctatctaagctgatatt

SEQ ID NO: 709680 - DNA, 25 bp, Artificial sequence
  Synthetic oligonucleotide
taagacggctatgtaagctgatatt

SEQ ID NO: 709681 - DNA, 25 bp, Artificial sequence
  Synthetic oligonucleotide
catttgcctgaacagtatggtttcg

SEQ ID NO: 709682 - DNA, 25 bp, Artificial sequence
  Synthetic oligonucleotide
catttgcctgaagagtatggtttcg

SEQ ID NO: 709683 - DNA, 25 bp, Artificial sequence
  Synthetic oligonucleotide
tattgttgcagcatcaagtgaagtg

SEQ ID NO: 709684 - DNA, 25 bp, Artificial sequence
  Synthetic oligonucleotide
tattgttgcagcttcaagtgaagtg

SEQ ID NO: 709685 - DNA, 25 bp, Artificial sequence
  Synthetic oligonucleotide
ctttctagtgatgtaatttatactc

SEQ ID NO: 709686 - DNA, 25 bp, Artificial sequence
  Synthetic oligonucleotide
tgaacggtatgggtcaaaccacacc

SEQ ID NO: 709687 - DNA, 25 bp, Artificial sequence
  Synthetic oligonucleotide
acttggctaatttctcgatcttgag

SEQ ID NO: 709688 - DNA, 25 bp, Artificial sequence
  Synthetic oligonucleotide
ttcgttagtagaagaaactagaaag

SEQ ID NO: 709689 - DNA, 25 bp, Artificial sequence
  Synthetic oligonucleotide
agtactgctcattttctctctaata

SEQ ID NO: 709690 - DNA, 25 bp, Artificial sequence
  Synthetic oligonucleotide
agtactgctcatattctctctaata

SEQ ID NO: 709691 - DNA, 25 bp, Artificial sequence
  Synthetic oligonucleotide
ccaactgcgccacgtaagtttttaa

SEQ ID NO: 709692 - DNA, 25 bp, Artificial sequence
  Synthetic oligonucleotide
ccaactgcgccaggtaagtttttaa

SEQ ID NO: 709693 - DNA, 25 bp, Artificial sequence
  Synthetic oligonucleotide
gcggtgttagcatcccctatcccat

SEQ ID NO: 709694 - DNA, 25 bp, Artificial sequence
  Synthetic oligonucleotide
gcggtgttagcaacccctatcccat

SEQ ID NO: 709695 - DNA, 25 bp, Artificial sequence
  Synthetic oligonucleotide
taatccaagtctagcctctggcctt

SEQ ID NO: 709696 - DNA, 25 bp, Artificial sequence
  Synthetic oligonucleotide
taatccaagtcttgcctctggcctt

SEQ ID NO: 709697 - DNA, 25 bp, Artificial sequence
  Synthetic oligonucleotide
gcatgcagatgcttacagtccgctg

SEQ ID NO: 709698 - DNA, 25 bp, Artificial sequence
  Synthetic oligonucleotide
ctttctagtgatctaatttatactc

SEQ ID NO: 709699 - DNA, 25 bp, Artificial sequence
  Synthetic oligonucleotide
tcaagtatagtttgaaaaagactgt

SEQ ID NO: 709700 - DNA, 25 bp, Artificial sequence
  Synthetic oligonucleotide
taaatgcaaaaccaactactaacaa

SEQ ID NO: 709701 - DNA, 25 bp, Artificial sequence
  Synthetic oligonucleotide
gttaatgattattcgaaatatcgag

SEQ ID NO: 709702 - DNA, 25 bp, Artificial sequence
  Synthetic oligonucleotide
gttaatgattatacgaaatatcgag

SEQ ID NO: 709703 - DNA, 25 bp, Artificial sequence
  Synthetic oligonucleotide
ttattaaatcttatttgttgttgac

SEQ ID NO: 709704 - DNA, 25 bp, Artificial sequence
  Synthetic oligonucleotide
ttattaaatcttttttgttgttgac

SEQ ID NO: 709705 - DNA, 25 bp, Artificial sequence
  Synthetic oligonucleotide
tataaaacgtatatttggcgtacga

SEQ ID NO: 709706 - DNA, 25 bp, Artificial sequence
  Synthetic oligonucleotide
tataaaacgtatttttggcgtacga

SEQ ID NO: 709707 - DNA, 25 bp, Artificial sequence
  Synthetic oligonucleotide
tggcattcacgtaaaaatcttcctg

SEQ ID NO: 709708 - DNA, 25 bp, Artificial sequence
  Synthetic oligonucleotide
tggcattcacgttaaaatcttcctg

SEQ ID NO: 709709 - DNA, 25 bp, Artificial sequence
  Synthetic oligonucleotide
tgaactttgctatttataatggcca

SEQ ID NO: 709710 - DNA, 25 bp, Artificial sequence
  Synthetic oligonucleotide
tatggttcgtattcaaaattatgca

SEQ ID NO: 709711 - DNA, 25 bp, Artificial sequence
  Synthetic oligonucleotide
taaacgtgatggcagaattgtgatg

SEQ ID NO: 709712 - DNA, 25 bp, Artificial sequence
  Synthetic oligonucleotide
tcaagtatagttagaaaaagactgt

SEQ ID NO: 709713 - DNA, 25 bp, Artificial sequence
  Synthetic oligonucleotide
ggtttcgtgtatttattcccgcttg

SEQ ID NO: 709714 - DNA, 25 bp, Artificial sequence
  Synthetic oligonucleotide
ggtttcgtgtatatattcccgcttg

SEQ ID NO: 709715 - DNA, 25 bp, Artificial sequence
  Synthetic oligonucleotide
tattgcattcatcctatgtactgca

SEQ ID NO: 709716 - DNA, 25 bp, Artificial sequence
  Synthetic oligonucleotide
tattgcattcatgctatgtactgca

SEQ ID NO: 709717 - DNA, 25 bp, Artificial sequence
  Synthetic oligonucleotide
ttatatatggcttatagagcgatag

SEQ ID NO: 709718 - DNA, 25 bp, Artificial sequence
  Synthetic oligonucleotide
ttatatatggctaatagagcgatag

SEQ ID NO: 709719 - DNA, 25 bp, Artificial sequence
  Synthetic oligonucleotide
actatgagacatttatgagactgca

SEQ ID NO: 709720 - DNA, 25 bp, Artificial sequence
  Synthetic oligonucleotide
actatgagacatatatgagactgca

SEQ ID NO: 709721 - DNA, 25 bp, Artificial sequence
  Synthetic oligonucleotide
tatggttcgtatacaaaattatgca

SEQ ID NO: 709722 - DNA, 25 bp, Artificial sequence
  Synthetic oligonucleotide
cgctctaaacatgctaattaaaaaa

SEQ ID NO: 709723 - DNA, 25 bp, Artificial sequence
  Synthetic oligonucleotide
gaaacataactacatatgactggag

SEQ ID NO: 709724 - DNA, 25 bp, Artificial sequence
  Synthetic oligonucleotide
gaaacataactagatatgactggag

SEQ ID NO: 709725 - DNA, 25 bp, Artificial sequence
  Synthetic oligonucleotide
tacatatgactgcagaaactaatta

SEQ ID NO: 709726 - DNA, 25 bp, Artificial sequence
  Synthetic oligonucleotide
tacatatgactggagaaactaatta

SEQ ID NO: 709727 - DNA, 25 bp, Artificial sequence
  Synthetic oligonucleotide
tacattctgaaaactgatactattg

SEQ ID NO: 709728 - DNA, 25 bp, Artificial sequence
  Synthetic oligonucleotide
tacattctgaaatctgatactattg

SEQ ID NO: 709729 - DNA, 25 bp, Artificial sequence
  Synthetic oligonucleotide
cagtatagctgtatatatattgacg

SEQ ID NO: 709730 - DNA, 25 bp, Artificial sequence
  Synthetic oligonucleotide
cagtatagctgtttatatattgacg

SEQ ID NO: 709731 - DNA, 25 bp, Artificial sequence
  Synthetic oligonucleotide
taactgcagatatatgaatatatat

SEQ ID NO: 709732 - DNA, 25 bp, Artificial sequence
  Synthetic oligonucleotide
gcacctctatcattcaattatgtag

SEQ ID NO: 709733 - DNA, 25 bp, Artificial sequence
  Synthetic oligonucleotide
cgctctaaacatcctaattaaaaaa

SEQ ID NO: 709734 - DNA, 25 bp, Artificial sequence
  Synthetic oligonucleotide
tgaactttgctaattataatggcca

SEQ ID NO: 709735 - DNA, 25 bp, Artificial sequence
  Synthetic oligonucleotide
aacgattttctcttgtctactacag

SEQ ID NO: 709736 - DNA, 25 bp, Artificial sequence
  Synthetic oligonucleotide
aacgattttctcatgtctactacag

SEQ ID NO: 709737 - DNA, 25 bp, Artificial sequence
  Synthetic oligonucleotide
gctgacatttcaactacaacgaaga

SEQ ID NO: 709738 - DNA, 25 bp, Artificial sequence
  Synthetic oligonucleotide
gctgacatttcatctacaacgaaga

SEQ ID NO: 709739 - DNA, 25 bp, Artificial sequence
  Synthetic oligonucleotide
ggacggtattacttatatagtacac

SEQ ID NO: 709740 - DNA, 25 bp, Artificial sequence
  Synthetic oligonucleotide
ggacggtattacatatatagtacac

SEQ ID NO: 709741 - DNA, 25 bp, Artificial sequence
  Synthetic oligonucleotide
gatacacgtgtcaatcagctgcaca

SEQ ID NO: 709742 - DNA, 25 bp, Artificial sequence
  Synthetic oligonucleotide
gatacacgtgtctatcagctgcaca

SEQ ID NO: 709743 - DNA, 25 bp, Artificial sequence
  Synthetic oligonucleotide
taaacgtgatgggagaattgtgatg

SEQ ID NO: 709744 - DNA, 25 bp, Artificial sequence
  Synthetic oligonucleotide
taactgcagataaatgaatatatat

SEQ ID NO: 709745 - DNA, 25 bp, Artificial sequence
  Synthetic oligonucleotide
tatcgcctctgtcaatcggtcgtac

SEQ ID NO: 709746 - DNA, 25 bp, Artificial sequence
  Synthetic oligonucleotide
tactaagttttcttttacggattca

SEQ ID NO: 709747 - DNA, 25 bp, Artificial sequence
  Synthetic oligonucleotide
ttttcgtcaaatctagtgtacctaa

SEQ ID NO: 709748 - DNA, 25 bp, Artificial sequence
  Synthetic oligonucleotide
ttttcgtcaaatgtagtgtacctaa

SEQ ID NO: 709749 - DNA, 25 bp, Artificial sequence
  Synthetic oligonucleotide
gatcaagtatacagcgacttcaaag

SEQ ID NO: 709750 - DNA, 25 bp, Artificial sequence
  Synthetic oligonucleotide
gatcaagtatactgcgacttcaaag

SEQ ID NO: 709751 - DNA, 25 bp, Artificial sequence
  Synthetic oligonucleotide
caagaatttgtattgacataagtta

SEQ ID NO: 709752 - DNA, 25 bp, Artificial sequence
  Synthetic oligonucleotide
caagaatttgtaatgacataagtta

SEQ ID NO: 709753 - DNA, 25 bp, Artificial sequence
  Synthetic oligonucleotide
cataattttttttattcctttatca

SEQ ID NO: 709754 - DNA, 25 bp, Artificial sequence
  Synthetic oligonucleotide
aaacaaatcaaatcccaaatactca

SEQ ID NO: 709755 - DNA, 25 bp, Artificial sequence
  Synthetic oligonucleotide
caaaagttaattacgagttagggca

SEQ ID NO: 709756 - DNA, 25 bp, Artificial sequence
  Synthetic oligonucleotide
caaaagttaatttcgagttagggca

SEQ ID NO: 709757 - DNA, 25 bp, Artificial sequence
  Synthetic oligonucleotide
taatgacaccgatcggatatccgat

SEQ ID NO: 709758 - DNA, 25 bp, Artificial sequence
  Synthetic oligonucleotide
tactaagttttcatttacggattca

SEQ ID NO: 709759 - DNA, 25 bp, Artificial sequence
  Synthetic oligonucleotide
tatcgcctctgtgaatcggtcgtac

SEQ ID NO: 709760 - DNA, 25 bp, Artificial sequence
  Synthetic oligonucleotide
cataatttttttaattcctttatca

SEQ ID NO: 709761 - DNA, 25 bp, Artificial sequence
  Synthetic oligonucleotide
cggaggtttccgatcctagagagga

SEQ ID NO: 709762 - DNA, 25 bp, Artificial sequence
  Synthetic oligonucleotide
cggaggtttccgttcctagagagga

SEQ ID NO: 709763 - DNA, 25 bp, Artificial sequence
  Synthetic oligonucleotide
tacgctcttgtcacttcttgaatcc

SEQ ID NO: 709764 - DNA, 25 bp, Artificial sequence
  Synthetic oligonucleotide
tacgctcttgtctcttcttgaatcc

SEQ ID NO: 709765 - DNA, 25 bp, Artificial sequence
  Synthetic oligonucleotide
tgggcggcgatagatccatcggcaa

SEQ ID NO: 709766 - DNA, 25 bp, Artificial sequence
  Synthetic oligonucleotide
tgggcggcgatacatccatcggcaa

SEQ ID NO: 709767 - DNA, 25 bp, Artificial sequence
  Synthetic oligonucleotide
gcaatctctgttgcggaaaaagcgc

SEQ ID NO: 709768 - DNA, 25 bp, Artificial sequence
  Synthetic oligonucleotide
gcaatctctgttccggaaaaagcgc

SEQ ID NO: 709769 - DNA, 25 bp, Artificial sequence
  Synthetic oligonucleotide
tcgtcaaatgtttaccaaagttatt

SEQ ID NO: 709770 - DNA, 25 bp, Artificial sequence
  Synthetic oligonucleotide
tcgtcaaatgttaaccaaagttatt

SEQ ID NO: 709771 - DNA, 25 bp, Artificial sequence
  Synthetic oligonucleotide
gcacctctatcaatcaattatgtag

SEQ ID NO: 709772 - DNA, 25 bp, Artificial sequence
  Synthetic oligonucleotide
tatgttgtatacttgtgtcttaaca

SEQ ID NO: 709773 - DNA, 25 bp, Artificial sequence
  Synthetic oligonucleotide
taatgacaccgaacggatatccgat

SEQ ID NO: 709774 - DNA, 25 bp, Artificial sequence
  Synthetic oligonucleotide
taatattaagctctttttaaacaac

SEQ ID NO: 709775 - DNA, 25 bp, Artificial sequence
  Synthetic oligonucleotide
tgataatatatagtatcggtacctt

SEQ ID NO: 709776 - DNA, 25 bp, Artificial sequence
  Synthetic oligonucleotide
tgataatatatactatcggtacctt

SEQ ID NO: 709777 - DNA, 25 bp, Artificial sequence
  Synthetic oligonucleotide
ttatagtttatatatctttccgcca

SEQ ID NO: 709778 - DNA, 25 bp, Artificial sequence
  Synthetic oligonucleotide
ttatagtttataaatctttccgcca

SEQ ID NO: 709779 - DNA, 25 bp, Artificial sequence
  Synthetic oligonucleotide
cgtaaaaatcatttagtgaagagtc

SEQ ID NO: 709780 - DNA, 25 bp, Artificial sequence
  Synthetic oligonucleotide
aaacaaatcaaaacccaaatactca

SEQ ID NO: 709781 - DNA, 25 bp, Artificial sequence
  Synthetic oligonucleotide
taatattaagctgtttttaaacaac

SEQ ID NO: 709782 - DNA, 25 bp, Artificial sequence
  Synthetic oligonucleotide
actaagtaagttatcatttggtatg

SEQ ID NO: 709783 - DNA, 25 bp, Artificial sequence
  Synthetic oligonucleotide
tataagctcttacgtttggagtgaa

SEQ ID NO: 709784 - DNA, 25 bp, Artificial sequence
  Synthetic oligonucleotide
tataagctcttaggtttggagtgaa

SEQ ID NO: 709785 - DNA, 25 bp, Artificial sequence
  Synthetic oligonucleotide
ttttgagattggaaaagtgtaaacc

SEQ ID NO: 709786 - DNA, 25 bp, Artificial sequence
  Synthetic oligonucleotide
ttttgagattggtaaagtgtaaacc

SEQ ID NO: 709787 - DNA, 25 bp, Artificial sequence
  Synthetic oligonucleotide
aatacgaagaaataatgttgaatgg

SEQ ID NO: 709788 - DNA, 25 bp, Artificial sequence
  Synthetic oligonucleotide
aatacgaagaaaaaatgttgaatgg

SEQ ID NO: 709789 - DNA, 25 bp, Artificial sequence
  Synthetic oligonucleotide
taaacatgcatttttcaattattca

SEQ ID NO: 709790 - DNA, 25 bp, Artificial sequence
  Synthetic oligonucleotide
cgtaaaaatcatatagtgaagagtc

SEQ ID NO: 709791 - DNA, 25 bp, Artificial sequence
  Synthetic oligonucleotide
caattattaactaaccgacgacacg

SEQ ID NO: 709792 - DNA, 25 bp, Artificial sequence
  Synthetic oligonucleotide
actaagtaagttttcatttggtatg

SEQ ID NO: 709793 - DNA, 25 bp, Artificial sequence
  Synthetic oligonucleotide
gagatttcatcgagttgattatgaa

SEQ ID NO: 709794 - DNA, 25 bp, Artificial sequence
  Synthetic oligonucleotide
taaacatgcattattcaattattca

SEQ ID NO: 709795 - DNA, 25 bp, Artificial sequence
  Synthetic oligonucleotide
cagtgttgttaactataatagaaaa

SEQ ID NO: 709796 - DNA, 25 bp, Artificial sequence
  Synthetic oligonucleotide
cagtgttgttaagtataatagaaaa

SEQ ID NO: 709797 - DNA, 25 bp, Artificial sequence
  Synthetic oligonucleotide
caaacaatattttattgattaggac

SEQ ID NO: 709798 - DNA, 25 bp, Artificial sequence
  Synthetic oligonucleotide
caaacaatatttaattgattaggac

SEQ ID NO: 709799 - DNA, 25 bp, Artificial sequence
  Synthetic oligonucleotide
tcaccagcataattgaaaataaaat

SEQ ID NO: 709800 - DNA, 25 bp, Artificial sequence
  Synthetic oligonucleotide
tcaccagcataaatgaaaataaaat

SEQ ID NO: 709801 - DNA, 25 bp, Artificial sequence
  Synthetic oligonucleotide
caattattaacttaccgacgacacg

SEQ ID NO: 709802 - DNA, 25 bp, Artificial sequence
  Synthetic oligonucleotide
gagatttcatcgtgttgattatgaa

SEQ ID NO: 709803 - DNA, 25 bp, Artificial sequence
  Synthetic oligonucleotide
tgtaacaacaaatcgtaccaaccgc

SEQ ID NO: 709804 - DNA, 25 bp, Artificial sequence
  Synthetic oligonucleotide
tcaaaccagtaacaaattaaatact

SEQ ID NO: 709805 - DNA, 25 bp, Artificial sequence
  Synthetic oligonucleotide
tgtaacaacaaaacgtaccaaccgc

SEQ ID NO: 709806 - DNA, 25 bp, Artificial sequence
  Synthetic oligonucleotide
tccttttgtcgacgttgatattgac

SEQ ID NO: 709807 - DNA, 25 bp, Artificial sequence
  Synthetic oligonucleotide
tctttatctagagcgtcaatgcact

SEQ ID NO: 709808 - DNA, 25 bp, Artificial sequence
  Synthetic oligonucleotide
tctttatctagaccgtcaatgcact

SEQ ID NO: 709809 - DNA, 25 bp, Artificial sequence
  Synthetic oligonucleotide
tacaactcaataaccatcgcctaaa

SEQ ID NO: 709810 - DNA, 25 bp, Artificial sequence
  Synthetic oligonucleotide
tacaactcaatatccatcgcctaaa

SEQ ID NO: 709811 - DNA, 25 bp, Artificial sequence
  Synthetic oligonucleotide
tccttttgtcgaggttgatattgac

SEQ ID NO: 709812 - DNA, 25 bp, Artificial sequence
  Synthetic oligonucleotide
tacacacatgggataaacactatcc

SEQ ID NO: 709813 - DNA, 25 bp, Artificial sequence
  Synthetic oligonucleotide
tacacacatgggttaaacactatcc

SEQ ID NO: 709814 - DNA, 25 bp, Artificial sequence
  Synthetic oligonucleotide
tgtagatgagaactgaaatcctttt

SEQ ID NO: 709815 - DNA, 25 bp, Artificial sequence
  Synthetic oligonucleotide
tcaaagcagttttaaaactttgaat

SEQ ID NO: 709816 - DNA, 25 bp, Artificial sequence
  Synthetic oligonucleotide
ggcattaaatcatacactactgaat

SEQ ID NO: 709817 - DNA, 25 bp, Artificial sequence
  Synthetic oligonucleotide
tcaaaccagtaagaaattaaatact

SEQ ID NO: 709818 - DNA, 25 bp, Artificial sequence
  Synthetic oligonucleotide
tgtagatgagaagtgaaatcctttt

SEQ ID NO: 709819 - DNA, 25 bp, Artificial sequence
  Synthetic oligonucleotide
aagatgctccttgatatttgtgcta

SEQ ID NO: 709820 - DNA, 25 bp, Artificial sequence
  Synthetic oligonucleotide
ggcattaaatcaaacactactgaat

SEQ ID NO: 709821 - DNA, 25 bp, Artificial sequence
  Synthetic oligonucleotide
taataatacaagctacagaatttgg

SEQ ID NO: 709822 - DNA, 25 bp, Artificial sequence
  Synthetic oligonucleotide
aagatgctccttcatatttgtgcta

SEQ ID NO: 709823 - DNA, 25 bp, Artificial sequence
  Synthetic oligonucleotide
taaataccatgtgaatgtgtatagt

SEQ ID NO: 709824 - DNA, 25 bp, Artificial sequence
  Synthetic oligonucleotide
caattgatctcgaattttattgact

SEQ ID NO: 709825 - DNA, 25 bp, Artificial sequence
  Synthetic oligonucleotide
caattgatctcgtattttattgact

SEQ ID NO: 709826 - DNA, 25 bp, Artificial sequence
  Synthetic oligonucleotide
gagttgtaaaagttggatacagccc

SEQ ID NO: 709827 - DNA, 25 bp, Artificial sequence
  Synthetic oligonucleotide
gagttgtaaaagatggatacagccc

SEQ ID NO: 709828 - DNA, 25 bp, Artificial sequence
  Synthetic oligonucleotide
tcaaagcagtttaaaaactttgaat

SEQ ID NO: 709829 - DNA, 25 bp, Artificial sequence
  Synthetic oligonucleotide
taataatacaaggtacagaatttgg

SEQ ID NO: 709830 - DNA, 25 bp, Artificial sequence
  Synthetic oligonucleotide
gaatacatgtttcttctgaatcagg

SEQ ID NO: 709831 - DNA, 25 bp, Artificial sequence
  Synthetic oligonucleotide
tacttgatggaaaccaaccaaaacg

SEQ ID NO: 709832 - DNA, 25 bp, Artificial sequence
  Synthetic oligonucleotide
gatcaatttcactccacagctctta

SEQ ID NO: 709833 - DNA, 25 bp, Artificial sequence
  Synthetic oligonucleotide
gatcaatttcacaccacagctctta

SEQ ID NO: 709834 - DNA, 25 bp, Artificial sequence
  Synthetic oligonucleotide
taaataccatgtcaatgtgtatagt

SEQ ID NO: 709835 - DNA, 25 bp, Artificial sequence
  Synthetic oligonucleotide
gaatacatgtttgttctgaatcagg

SEQ ID NO: 709836 - DNA, 25 bp, Artificial sequence
  Synthetic oligonucleotide
tacttgatggaatccaaccaaaacg

SEQ ID NO: 709837 - DNA, 25 bp, Artificial sequence
  Synthetic oligonucleotide
tcggctaaaccgtacaaaattggga

SEQ ID NO: 709838 - DNA, 25 bp, Artificial sequence
  Synthetic oligonucleotide
tcggctaaaccgaacaaaattggga

SEQ ID NO: 709839 - DNA, 25 bp, Artificial sequence
  Synthetic oligonucleotide
cgtaaactctaatacctaatatcag

SEQ ID NO: 709840 - DNA, 25 bp, Artificial sequence
  Synthetic oligonucleotide
tattgaaaatgcgttagtaaacact

SEQ ID NO: 709841 - DNA, 25 bp, Artificial sequence
  Synthetic oligonucleotide
gatacttttatcagttcaaattgcc

SEQ ID NO: 709842 - DNA, 25 bp, Artificial sequence
  Synthetic oligonucleotide
gatacttttatctgttcaaattgcc

SEQ ID NO: 709843 - DNA, 25 bp, Artificial sequence
  Synthetic oligonucleotide
tgctctgaaaaaggcttaagaccaa

SEQ ID NO: 709844 - DNA, 25 bp, Artificial sequence
  Synthetic oligonucleotide
tgctctgaaaaacgcttaagaccaa

SEQ ID NO: 709845 - DNA, 25 bp, Artificial sequence
  Synthetic oligonucleotide
tggttaattcgatcaaataaaactt

SEQ ID NO: 709846 - DNA, 25 bp, Artificial sequence
  Synthetic oligonucleotide
tggttaattcgaacaaataaaactt

SEQ ID NO: 709847 - DNA, 25 bp, Artificial sequence
  Synthetic oligonucleotide
taaaatggtgctctaatggtaaaag

SEQ ID NO: 709848 - DNA, 25 bp, Artificial sequence
  Synthetic oligonucleotide
taaaatggtgctgtaatggtaaaag

SEQ ID NO: 709849 - DNA, 25 bp, Artificial sequence
  Synthetic oligonucleotide
gagtccggctttaggaaaagttcga

SEQ ID NO: 709850 - DNA, 25 bp, Artificial sequence
  Synthetic oligonucleotide
caagacttatatttcactgttatta

SEQ ID NO: 709851 - DNA, 25 bp, Artificial sequence
  Synthetic oligonucleotide
cgtaaactctaaaacctaatatcag

SEQ ID NO: 709852 - DNA, 25 bp, Artificial sequence
  Synthetic oligonucleotide
ccaaatgacctaaattgattgtttg

SEQ ID NO: 709853 - DNA, 25 bp, Artificial sequence
  Synthetic oligonucleotide
tgtttctgttaaatatagcaattcc

SEQ ID NO: 709854 - DNA, 25 bp, Artificial sequence
  Synthetic oligonucleotide
tgtttctgttaattatagcaattcc

SEQ ID NO: 709855 - DNA, 25 bp, Artificial sequence
  Synthetic oligonucleotide
gaaacatgaagttaatctacagcct

SEQ ID NO: 709856 - DNA, 25 bp, Artificial sequence
  Synthetic oligonucleotide
gaaacatgaagtaaatctacagcct

SEQ ID NO: 709857 - DNA, 25 bp, Artificial sequence
  Synthetic oligonucleotide
gaactagcttcctttattgcaactt

SEQ ID NO: 709858 - DNA, 25 bp, Artificial sequence
  Synthetic oligonucleotide
gaactagcttccattattgcaactt

SEQ ID NO: 709859 - DNA, 25 bp, Artificial sequence
  Synthetic oligonucleotide
taaccaagaattgataaacaaactg

SEQ ID NO: 709860 - DNA, 25 bp, Artificial sequence
  Synthetic oligonucleotide
taaccaagaattcataaacaaactg

SEQ ID NO: 709861 - DNA, 25 bp, Artificial sequence
  Synthetic oligonucleotide
tctcgatcaactctgaaaaatatat

SEQ ID NO: 709862 - DNA, 25 bp, Artificial sequence
  Synthetic oligonucleotide
tctcgatcaactgtgaaaaatatat

SEQ ID NO: 709863 - DNA, 25 bp, Artificial sequence
  Synthetic oligonucleotide
tattgaaaatgccttagtaaacact

SEQ ID NO: 709864 - DNA, 25 bp, Artificial sequence
  Synthetic oligonucleotide
gagtccggcttttggaaaagttcga

SEQ ID NO: 709865 - DNA, 25 bp, Artificial sequence
  Synthetic oligonucleotide
caaaaacatttcttttacgtcaaga

SEQ ID NO: 709866 - DNA, 25 bp, Artificial sequence
  Synthetic oligonucleotide
tcctatcttaatgtattagtctttt

SEQ ID NO: 709867 - DNA, 25 bp, Artificial sequence
  Synthetic oligonucleotide
gaagtcttctctatttatccaatcc

SEQ ID NO: 709868 - DNA, 25 bp, Artificial sequence
  Synthetic oligonucleotide
gaagtcttctctttttatccaatcc

SEQ ID NO: 709869 - DNA, 25 bp, Artificial sequence
  Synthetic oligonucleotide
gtcggagtttaggacttttatgggc

SEQ ID NO: 709870 - DNA, 25 bp, Artificial sequence
  Synthetic oligonucleotide
gtcggagtttagcacttttatgggc

SEQ ID NO: 709871 - DNA, 25 bp, Artificial sequence
  Synthetic oligonucleotide
gggattgatgaatatagagaaaccg

SEQ ID NO: 709872 - DNA, 25 bp, Artificial sequence
  Synthetic oligonucleotide
gggattgatgaaaatagagaaaccg

SEQ ID NO: 709873 - DNA, 25 bp, Artificial sequence
  Synthetic oligonucleotide
cacaaaaaaaaaacgaacatatcac

SEQ ID NO: 709874 - DNA, 25 bp, Artificial sequence
  Synthetic oligonucleotide
cacaaaaaaaaatcgaacatatcac

SEQ ID NO: 709875 - DNA, 25 bp, Artificial sequence
  Synthetic oligonucleotide
catgttcttgaaacaaaaagagtaa

SEQ ID NO: 709876 - DNA, 25 bp, Artificial sequence
  Synthetic oligonucleotide
caagacttatatatcactgttatta

SEQ ID NO: 709877 - DNA, 25 bp, Artificial sequence
  Synthetic oligonucleotide
caaaaacatttcatttacgtcaaga

SEQ ID NO: 709878 - DNA, 25 bp, Artificial sequence
  Synthetic oligonucleotide
tatctgaaaatggaatggaatattc

SEQ ID NO: 709879 - DNA, 25 bp, Artificial sequence
  Synthetic oligonucleotide
taacctaacaaagacacaatctgca

SEQ ID NO: 709880 - DNA, 25 bp, Artificial sequence
  Synthetic oligonucleotide
taacctaacaaacacacaatctgca

SEQ ID NO: 709881 - DNA, 25 bp, Artificial sequence
  Synthetic oligonucleotide
gcatttgtagctacgttcttagagt

SEQ ID NO: 709882 - DNA, 25 bp, Artificial sequence
  Synthetic oligonucleotide
gcatttgtagcttcgttcttagagt

SEQ ID NO: 709883 - DNA, 25 bp, Artificial sequence
  Synthetic oligonucleotide
cactaaaagagacatactatttgac

SEQ ID NO: 709884 - DNA, 25 bp, Artificial sequence
  Synthetic oligonucleotide
cactaaaagagagatactatttgac

SEQ ID NO: 709885 - DNA, 25 bp, Artificial sequence
  Synthetic oligonucleotide
caatatagtttaatttttatgcata

SEQ ID NO: 709886 - DNA, 25 bp, Artificial sequence
  Synthetic oligonucleotide
caatatagtttattttttatgcata

SEQ ID NO: 709887 - DNA, 25 bp, Artificial sequence
  Synthetic oligonucleotide
acaaataagattaatttggttaaca

SEQ ID NO: 709888 - DNA, 25 bp, Artificial sequence
  Synthetic oligonucleotide
tatctgaaaatgcaatggaatattc

SEQ ID NO: 709889 - DNA, 25 bp, Artificial sequence
  Synthetic oligonucleotide
ccaaatgacctatattgattgtttg

SEQ ID NO: 709890 - DNA, 25 bp, Artificial sequence
  Synthetic oligonucleotide
catgttcttgaatcaaaaagagtaa

SEQ ID NO: 709891 - DNA, 25 bp, Artificial sequence
  Synthetic oligonucleotide
gatcttaattgggtgaaggtaaaca

SEQ ID NO: 709892 - DNA, 25 bp, Artificial sequence
  Synthetic oligonucleotide
gatctttacccttgcttatcctacg

SEQ ID NO: 709893 - DNA, 25 bp, Artificial sequence
  Synthetic oligonucleotide
ggtgaagcagccgtgtcttgcaaca

SEQ ID NO: 709894 - DNA, 25 bp, Artificial sequence
  Synthetic oligonucleotide
ggtgaagcagccctgtcttgcaaca

SEQ ID NO: 709895 - DNA, 25 bp, Artificial sequence
  Synthetic oligonucleotide
tattagccgtgtccctggttcttgc

SEQ ID NO: 709896 - DNA, 25 bp, Artificial sequence
  Synthetic oligonucleotide
tattagccgtgtgcctggttcttgc

SEQ ID NO: 709897 - DNA, 25 bp, Artificial sequence
  Synthetic oligonucleotide
aaaaaaaacagaaagtaacatgaga

SEQ ID NO: 709898 - DNA, 25 bp, Artificial sequence
  Synthetic oligonucleotide
aaaaaaaacagatagtaacatgaga

SEQ ID NO: 709899 - DNA, 25 bp, Artificial sequence
  Synthetic oligonucleotide
taaataacctctgtattttctaacc

SEQ ID NO: 709900 - DNA, 25 bp, Artificial sequence
  Synthetic oligonucleotide
taaataacctctctattttctaacc

SEQ ID NO: 709901 - DNA, 25 bp, Artificial sequence
  Synthetic oligonucleotide
actcttcctcaagtaccaatctcaa

SEQ ID NO: 709902 - DNA, 25 bp, Artificial sequence
  Synthetic oligonucleotide
gatctttaccctagcttatcctacg

SEQ ID NO: 709903 - DNA, 25 bp, Artificial sequence
  Synthetic oligonucleotide
caactaactaacagtaacactcgtg

SEQ ID NO: 709904 - DNA, 25 bp, Artificial sequence
  Synthetic oligonucleotide
caactaactaactgtaacactcgtg

SEQ ID NO: 709905 - DNA, 25 bp, Artificial sequence
  Synthetic oligonucleotide
tattgttagatagaatgcagttgaa

SEQ ID NO: 709906 - DNA, 25 bp, Artificial sequence
  Synthetic oligonucleotide
tattgttagatacaatgcagttgaa

SEQ ID NO: 709907 - DNA, 25 bp, Artificial sequence
  Synthetic oligonucleotide
tggatagttaaacaagaaaaaatgt

SEQ ID NO: 709908 - DNA, 25 bp, Artificial sequence
  Synthetic oligonucleotide
tggatagttaaagaagaaaaaatgt

SEQ ID NO: 709909 - DNA, 25 bp, Artificial sequence
  Synthetic oligonucleotide
tagtaggcctttattattgattaag

SEQ ID NO: 709910 - DNA, 25 bp, Artificial sequence
  Synthetic oligonucleotide
tagtaggccttttttattgattaag

SEQ ID NO: 709911 - DNA, 25 bp, Artificial sequence
  Synthetic oligonucleotide
taacaactcttcacattgtagttgg

SEQ ID NO: 709912 - DNA, 25 bp, Artificial sequence
  Synthetic oligonucleotide
taacaactcttctcattgtagttgg

SEQ ID NO: 709913 - DNA, 25 bp, Artificial sequence
  Synthetic oligonucleotide
tcctatcttaatctattagtctttt

SEQ ID NO: 709914 - DNA, 25 bp, Artificial sequence
  Synthetic oligonucleotide
gaaacattctccttgcttccaccct

SEQ ID NO: 709915 - DNA, 25 bp, Artificial sequence
  Synthetic oligonucleotide
acaaataagatttatttggttaaca

SEQ ID NO: 709916 - DNA, 25 bp, Artificial sequence
  Synthetic oligonucleotide
actcttcctcaactaccaatctcaa

SEQ ID NO: 709917 - DNA, 25 bp, Artificial sequence
  Synthetic oligonucleotide
tttcttttttttacagtatccagtg

SEQ ID NO: 709918 - DNA, 25 bp, Artificial sequence
  Synthetic oligonucleotide
gaaacattctccatgcttccaccct

SEQ ID NO: 709919 - DNA, 25 bp, Artificial sequence
  Synthetic oligonucleotide
gatcttaattggctgaaggtaaaca

SEQ ID NO: 709920 - DNA, 25 bp, Artificial sequence
  Synthetic oligonucleotide
ggtcccaaccctctgctgcaacggt

SEQ ID NO: 709921 - DNA, 25 bp, Artificial sequence
  Synthetic oligonucleotide
gaatgttctaatttcagcaggcact

SEQ ID NO: 709922 - DNA, 25 bp, Artificial sequence
  Synthetic oligonucleotide
gctagttgctaattgatcagtgatg

SEQ ID NO: 709923 - DNA, 25 bp, Artificial sequence
  Synthetic oligonucleotide
gctagttgctaaatgatcagtgatg

SEQ ID NO: 709924 - DNA, 25 bp, Artificial sequence
  Synthetic oligonucleotide
cctaataattaaaaaatgagggcat

SEQ ID NO: 709925 - DNA, 25 bp, Artificial sequence
  Synthetic oligonucleotide
cctaataattaataaatgagggcat

SEQ ID NO: 709926 - DNA, 25 bp, Artificial sequence
  Synthetic oligonucleotide
aaatcttaaaggtagctactacaag

SEQ ID NO: 709927 - DNA, 25 bp, Artificial sequence
  Synthetic oligonucleotide
gaatgttctaatatcagcaggcact

SEQ ID NO: 709928 - DNA, 25 bp, Artificial sequence
  Synthetic oligonucleotide
tttctttttttttcagtatccagtg

SEQ ID NO: 709929 - DNA, 25 bp, Artificial sequence
  Synthetic oligonucleotide
cactctctctctttgtgattactga

SEQ ID NO: 709930 - DNA, 25 bp, Artificial sequence
  Synthetic oligonucleotide
cactctctctctatgtgattactga

SEQ ID NO: 709931 - DNA, 25 bp, Artificial sequence
  Synthetic oligonucleotide
ctctctcctagaaccatccaaaatg

SEQ ID NO: 709932 - DNA, 25 bp, Artificial sequence
  Synthetic oligonucleotide
caagagtcaggctcaaacttctgtg

SEQ ID NO: 709933 - DNA, 25 bp, Artificial sequence
  Synthetic oligonucleotide
aaatcttaaaggaagctactacaag

SEQ ID NO: 709934 - DNA, 25 bp, Artificial sequence
  Synthetic oligonucleotide
ggtcccaaccctgtgctgcaacggt

SEQ ID NO: 709935 - DNA, 25 bp, Artificial sequence
  Synthetic oligonucleotide
gggtctgtcgttccatcaaatctgc

SEQ ID NO: 709936 - DNA, 25 bp, Artificial sequence
  Synthetic oligonucleotide
caagagtcaggcacaaacttctgtg

SEQ ID NO: 709937 - DNA, 25 bp, Artificial sequence
  Synthetic oligonucleotide
ctctctcctagatccatccaaaatg

SEQ ID NO: 709938 - DNA, 25 bp, Artificial sequence
  Synthetic oligonucleotide
ccttctaaatgtggtgtcgatctcc

SEQ ID NO: 709939 - DNA, 25 bp, Artificial sequence
  Synthetic oligonucleotide
ccttctaaatgtcgtgtcgatctcc

SEQ ID NO: 709940 - DNA, 25 bp, Artificial sequence
  Synthetic oligonucleotide
gcccttccactgactgcgacaggta

SEQ ID NO: 709941 - DNA, 25 bp, Artificial sequence
  Synthetic oligonucleotide
gcccttccactgtctgcgacaggta

SEQ ID NO: 709942 - DNA, 25 bp, Artificial sequence
  Synthetic oligonucleotide
gggtctgtcgttgcatcaaatctgc

SEQ ID NO: 709943 - DNA, 25 bp, Artificial sequence
  Synthetic oligonucleotide
tgcttatacctgaaagaacccttgc

SEQ ID NO: 709944 - DNA, 25 bp, Artificial sequence
  Synthetic oligonucleotide
gctatgggcaactctcttttatgga

SEQ ID NO: 709945 - DNA, 25 bp, Artificial sequence
  Synthetic oligonucleotide
gctatgggcaacactcttttatgga

SEQ ID NO: 709946 - DNA, 25 bp, Artificial sequence
  Synthetic oligonucleotide
tgatattcattataccatgacgcag

SEQ ID NO: 709947 - DNA, 25 bp, Artificial sequence
  Synthetic oligonucleotide
tgcttatacctgtaagaacccttgc

SEQ ID NO: 709948 - DNA, 25 bp, Artificial sequence
  Synthetic oligonucleotide
tgatattcattaaaccatgacgcag

SEQ ID NO: 709949 - DNA, 25 bp, Artificial sequence
  Synthetic oligonucleotide
tttcagcttaaagtatattcacccg

SEQ ID NO: 709950 - DNA, 25 bp, Artificial sequence
  Synthetic oligonucleotide
tttcagcttaaactatattcacccg

SEQ ID NO: 709951 - DNA, 25 bp, Artificial sequence
  Synthetic oligonucleotide
ggcttatcgtcaatcacaatgttgc

SEQ ID NO: 709952 - DNA, 25 bp, Artificial sequence
  Synthetic oligonucleotide
gaaacgggcttatgatccctcgagc

SEQ ID NO: 709953 - DNA, 25 bp, Artificial sequence
  Synthetic oligonucleotide
gaaacgggcttaagatccctcgagc

SEQ ID NO: 709954 - DNA, 25 bp, Artificial sequence
  Synthetic oligonucleotide
ttgtcacaagtatatgagtttatcg

SEQ ID NO: 709955 - DNA, 25 bp, Artificial sequence
  Synthetic oligonucleotide
tttgatgtggtaaatataagctctc

SEQ ID NO: 709956 - DNA, 25 bp, Artificial sequence
  Synthetic oligonucleotide
tttgatgtggtatatataagctctc

SEQ ID NO: 709957 - DNA, 25 bp, Artificial sequence
  Synthetic oligonucleotide
catcgttccatttttgttttccacc

SEQ ID NO: 709958 - DNA, 25 bp, Artificial sequence
  Synthetic oligonucleotide
ctttgtggagagatgcagtggctta

SEQ ID NO: 709959 - DNA, 25 bp, Artificial sequence
  Synthetic oligonucleotide
cgtttcttccccgatttgtatgaaa

SEQ ID NO: 709960 - DNA, 25 bp, Artificial sequence
  Synthetic oligonucleotide
gctaagtgttggttgccgaatctct

SEQ ID NO: 709961 - DNA, 25 bp, Artificial sequence
  Synthetic oligonucleotide
ggcttatcgtcattcacaatgttgc

SEQ ID NO: 709962 - DNA, 25 bp, Artificial sequence
  Synthetic oligonucleotide
cgtttcttcccccatttgtatgaaa

SEQ ID NO: 709963 - DNA, 25 bp, Artificial sequence
  Synthetic oligonucleotide
tgtgagatgttcataaatcactctc

SEQ ID NO: 709964 - DNA, 25 bp, Artificial sequence
  Synthetic oligonucleotide
catcgttccattattgttttccacc

SEQ ID NO: 709965 - DNA, 25 bp, Artificial sequence
  Synthetic oligonucleotide
ttgtcacaagtaaatgagtttatcg

SEQ ID NO: 709966 - DNA, 25 bp, Artificial sequence
  Synthetic oligonucleotide
ggttggttacttgacagatactctc

SEQ ID NO: 709967 - DNA, 25 bp, Artificial sequence
  Synthetic oligonucleotide
ggttggttacttcacagatactctc

SEQ ID NO: 709968 - DNA, 25 bp, Artificial sequence
  Synthetic oligonucleotide
ttcgtggcagcttcaattggtttga

SEQ ID NO: 709969 - DNA, 25 bp, Artificial sequence
  Synthetic oligonucleotide
ttcgtggcagctacaattggtttga

SEQ ID NO: 709970 - DNA, 25 bp, Artificial sequence
  Synthetic oligonucleotide
ttctccacagggaaaattgcaccag

SEQ ID NO: 709971 - DNA, 25 bp, Artificial sequence
  Synthetic oligonucleotide
ttctccacagggtaaattgcaccag

SEQ ID NO: 709972 - DNA, 25 bp, Artificial sequence
  Synthetic oligonucleotide
tgtgagatgttcttaaatcactctc

SEQ ID NO: 709973 - DNA, 25 bp, Artificial sequence
  Synthetic oligonucleotide
gatgtgtagttgattatatggataa

SEQ ID NO: 709974 - DNA, 25 bp, Artificial sequence
  Synthetic oligonucleotide
taatgatatcaaacattgatctatc

SEQ ID NO: 709975 - DNA, 25 bp, Artificial sequence
  Synthetic oligonucleotide
ctttgtggagagttgcagtggctta

SEQ ID NO: 709976 - DNA, 25 bp, Artificial sequence
  Synthetic oligonucleotide
tattagcttgggtaatattgtaacc

SEQ ID NO: 709977 - DNA, 25 bp, Artificial sequence
  Synthetic oligonucleotide
tattagcttgggaaatattgtaacc

SEQ ID NO: 709978 - DNA, 25 bp, Artificial sequence
  Synthetic oligonucleotide
gctaagtgttggatgccgaatctct

SEQ ID NO: 709979 - DNA, 25 bp, Artificial sequence
  Synthetic oligonucleotide
caatttcgcttctgtcctcgtgttg

SEQ ID NO: 709980 - DNA, 25 bp, Artificial sequence
  Synthetic oligonucleotide
tatgaacaaaaaaaactatgtcagg

SEQ ID NO: 709981 - DNA, 25 bp, Artificial sequence
  Synthetic oligonucleotide
tatgaacaaaaataactatgtcagg

SEQ ID NO: 709982 - DNA, 25 bp, Artificial sequence
  Synthetic oligonucleotide
tagaaaaaaaaattggtggccttga

SEQ ID NO: 709983 - DNA, 25 bp, Artificial sequence
  Synthetic oligonucleotide
tagaaaaaaaaaatggtggccttga

SEQ ID NO: 709984 - DNA, 25 bp, Artificial sequence
  Synthetic oligonucleotide
ccaagtctgtataaggattctctga

SEQ ID NO: 709985 - DNA, 25 bp, Artificial sequence
  Synthetic oligonucleotide
ccaagtctgtattaggattctctga

SEQ ID NO: 709986 - DNA, 25 bp, Artificial sequence
  Synthetic oligonucleotide
tcctggtttcgttgatccttcaaaa

SEQ ID NO: 709987 - DNA, 25 bp, Artificial sequence
  Synthetic oligonucleotide
caatttcgcttcagtcctcgtgttg

SEQ ID NO: 709988 - DNA, 25 bp, Artificial sequence
  Synthetic oligonucleotide
tagggtctttatctggatggacagc

SEQ ID NO: 709989 - DNA, 25 bp, Artificial sequence
  Synthetic oligonucleotide
tcagtggacaaattttctaaacccg

SEQ ID NO: 709990 - DNA, 25 bp, Artificial sequence
  Synthetic oligonucleotide
tgctctttccctattggatatctga

SEQ ID NO: 709991 - DNA, 25 bp, Artificial sequence
  Synthetic oligonucleotide
tgctctttcccttttggatatctga

SEQ ID NO: 709992 - DNA, 25 bp, Artificial sequence
  Synthetic oligonucleotide
tcattttttctcacgttctttgaac

SEQ ID NO: 709993 - DNA, 25 bp, Artificial sequence
  Synthetic oligonucleotide
tcattttttctctcgttctttgaac

SEQ ID NO: 709994 - DNA, 25 bp, Artificial sequence
  Synthetic oligonucleotide
tcctggtttcgtagatccttcaaaa

SEQ ID NO: 709995 - DNA, 25 bp, Artificial sequence
  Synthetic oligonucleotide
tcatgtggatgcgagtttcccaaat

SEQ ID NO: 709996 - DNA, 25 bp, Artificial sequence
  Synthetic oligonucleotide
gatgtgtagttgtttatatggataa

SEQ ID NO: 709997 - DNA, 25 bp, Artificial sequence
  Synthetic oligonucleotide
tagggtctttatgtggatggacagc

SEQ ID NO: 709998 - DNA, 25 bp, Artificial sequence
  Synthetic oligonucleotide
gaactgggaaacattcagagaaagg

SEQ ID NO: 709999 - DNA, 25 bp, Artificial sequence
  Synthetic oligonucleotide
gaactgggaaactttcagagaaagg

SEQ ID NO: 710000 - DNA, 25 bp, Artificial sequence
  Synthetic oligonucleotide
ttctcttaactacctactggtaaga

SEQ ID NO: 710001 - DNA, 25 bp, Artificial sequence
  Synthetic oligonucleotide
ttctcttaactagctactggtaaga

SEQ ID NO: 710002 - DNA, 25 bp, Artificial sequence
  Synthetic oligonucleotide
tcagtggacaaaatttctaaacccg

SEQ ID NO: 710003 - DNA, 25 bp, Artificial sequence
  Synthetic oligonucleotide
tcatgtggatgccagtttcccaaat

SEQ ID NO: 710004 - DNA, 25 bp, Artificial sequence
  Synthetic oligonucleotide
cgagaggtttgttgtatcaaatgca

SEQ ID NO: 710005 - DNA, 25 bp, Artificial sequence
  Synthetic oligonucleotide
caagcagcaatgtctagattcccgt

SEQ ID NO: 710006 - DNA, 25 bp, Artificial sequence
  Synthetic oligonucleotide
caagcagcaatgactagattcccgt

SEQ ID NO: 710007 - DNA, 25 bp, Artificial sequence
  Synthetic oligonucleotide
tgcatctccggccaccggggttgat

SEQ ID NO: 710008 - DNA, 25 bp, Artificial sequence
  Synthetic oligonucleotide
tgcatctccggcgaccggggttgat

SEQ ID NO: 710009 - DNA, 25 bp, Artificial sequence
  Synthetic oligonucleotide
ttaatcctccgcctcagcagaatcc

SEQ ID NO: 710010 - DNA, 25 bp, Artificial sequence
  Synthetic oligonucleotide
ttaatcctccgcgtcagcagaatcc

SEQ ID NO: 710011 - DNA, 25 bp, Artificial sequence
  Synthetic oligonucleotide
cctaatttgggagagcagacaccga

SEQ ID NO: 710012 - DNA, 25 bp, Artificial sequence
  Synthetic oligonucleotide
cctaatttgggacagcagacaccga

SEQ ID NO: 710013 - DNA, 25 bp, Artificial sequence
  Synthetic oligonucleotide
cagcagcagcagaatgtatcgagtc

SEQ ID NO: 710014 - DNA, 25 bp, Artificial sequence
  Synthetic oligonucleotide
cagcagcagcagtatgtatcgagtc

SEQ ID NO: 710015 - DNA, 25 bp, Artificial sequence
  Synthetic oligonucleotide
aaattgatgagggcattgaatcaca

SEQ ID NO: 710016 - DNA, 25 bp, Artificial sequence
  Synthetic oligonucleotide
aaattgatgaggccattgaatcaca

SEQ ID NO: 710017 - DNA, 25 bp, Artificial sequence
  Synthetic oligonucleotide
ccgcagcaattagtatagttttcta

SEQ ID NO: 710018 - DNA, 25 bp, Artificial sequence
  Synthetic oligonucleotide
tttaaacaacccatctcttctctcg

SEQ ID NO: 710019 - DNA, 25 bp, Artificial sequence
  Synthetic oligonucleotide
caaaaatggaggtcacgaagccacc

SEQ ID NO: 710020 - DNA, 25 bp, Artificial sequence
  Synthetic oligonucleotide
cgagaggtttgtagtatcaaatgca

SEQ ID NO: 710021 - DNA, 25 bp, Artificial sequence
  Synthetic oligonucleotide
ctttatatacttatgatgaaattca

SEQ ID NO: 710022 - DNA, 25 bp, Artificial sequence
  Synthetic oligonucleotide
ctttatatacttttgatgaaattca

SEQ ID NO: 710023 - DNA, 25 bp, Artificial sequence
  Synthetic oligonucleotide
ggagattatctccaaacctttttaa

SEQ ID NO: 710024 - DNA, 25 bp, Artificial sequence
  Synthetic oligonucleotide
ccgcagcaattactatagttttcta

SEQ ID NO: 710025 - DNA, 25 bp, Artificial sequence
  Synthetic oligonucleotide
aatgcgcttatctggacgcttggcg

SEQ ID NO: 710026 - DNA, 25 bp, Artificial sequence
  Synthetic oligonucleotide
taatgatatcaatcattgatctatc

SEQ ID NO: 710027 - DNA, 25 bp, Artificial sequence
  Synthetic oligonucleotide
taattgaatttattgatctatcacg

SEQ ID NO: 710028 - DNA, 25 bp, Artificial sequence
  Synthetic oligonucleotide
taattgaatttaatgatctatcacg

SEQ ID NO: 710029 - DNA, 25 bp, Artificial sequence
  Synthetic oligonucleotide
tgagttgttatctccttaggagtcg

SEQ ID NO: 710030 - DNA, 25 bp, Artificial sequence
  Synthetic oligonucleotide
tgagttgttatcaccttaggagtcg

SEQ ID NO: 710031 - DNA, 25 bp, Artificial sequence
  Synthetic oligonucleotide
tctgttgtcctatttggtagtagaa

SEQ ID NO: 710032 - DNA, 25 bp, Artificial sequence
  Synthetic oligonucleotide
tctgttgtcctaattggtagtagaa

SEQ ID NO: 710033 - DNA, 25 bp, Artificial sequence
  Synthetic oligonucleotide
aatgcgcttatcaggacgcttggcg

SEQ ID NO: 710034 - DNA, 25 bp, Artificial sequence
  Synthetic oligonucleotide
tcagctttggctatcgttttcccgg

SEQ ID NO: 710035 - DNA, 25 bp, Artificial sequence
  Synthetic oligonucleotide
tcgccgtttagaactttgaaagaac

SEQ ID NO: 710036 - DNA, 25 bp, Artificial sequence
  Synthetic oligonucleotide
ccgtaatgaatgaatgtacacgcca

SEQ ID NO: 710037 - DNA, 25 bp, Artificial sequence
  Synthetic oligonucleotide
ccgtaatgaatgtatgtacacgcca

SEQ ID NO: 710038 - DNA, 25 bp, Artificial sequence
  Synthetic oligonucleotide
tgttcaagcaagtccatagagatta

SEQ ID NO: 710039 - DNA, 25 bp, Artificial sequence
  Synthetic oligonucleotide
tgttcaagcaagaccatagagatta

SEQ ID NO: 710040 - DNA, 25 bp, Artificial sequence
  Synthetic oligonucleotide
tcattcttttttgctaagggttata

SEQ ID NO: 710041 - DNA, 25 bp, Artificial sequence
  Synthetic oligonucleotide
tcattcttttttcctaagggttata

SEQ ID NO: 710042 - DNA, 25 bp, Artificial sequence
  Synthetic oligonucleotide
ctactctgtaatatcatgtattttt

SEQ ID NO: 710043 - DNA, 25 bp, Artificial sequence
  Synthetic oligonucleotide
ctactctgtaatttcatgtattttt

SEQ ID NO: 710044 - DNA, 25 bp, Artificial sequence
  Synthetic oligonucleotide
gaatcatatagttaaataatgtctg

SEQ ID NO: 710045 - DNA, 25 bp, Artificial sequence
  Synthetic oligonucleotide
gaatcatatagtaaaataatgtctg

SEQ ID NO: 710046 - DNA, 25 bp, Artificial sequence
  Synthetic oligonucleotide
taacttttgataatgaacggtcaaa

SEQ ID NO: 710047 - DNA, 25 bp, Artificial sequence
  Synthetic oligonucleotide
taacttttgatattgaacggtcaaa

SEQ ID NO: 710048 - DNA, 25 bp, Artificial sequence
  Synthetic oligonucleotide
atgcttctattgcagcaattgcaaa

SEQ ID NO: 710049 - DNA, 25 bp, Artificial sequence
  Synthetic oligonucleotide
tcttctctcactaagacaagacaac

SEQ ID NO: 710050 - DNA, 25 bp, Artificial sequence
  Synthetic oligonucleotide
tcgccgtttagatctttgaaagaac

SEQ ID NO: 710051 - DNA, 25 bp, Artificial sequence
  Synthetic oligonucleotide
caaaaatggaggacacgaagccacc

SEQ ID NO: 710052 - DNA, 25 bp, Artificial sequence
  Synthetic oligonucleotide
tcccaaaatagattccctaaaagag

SEQ ID NO: 710053 - DNA, 25 bp, Artificial sequence
  Synthetic oligonucleotide
tcccaaaatagaatccctaaaagag

SEQ ID NO: 710054 - DNA, 25 bp, Artificial sequence
  Synthetic oligonucleotide
cacggcgaagaacatttccccgaaa

SEQ ID NO: 710055 - DNA, 25 bp, Artificial sequence
  Synthetic oligonucleotide
gaaacattctcgcttcagctttggc

SEQ ID NO: 710056 - DNA, 25 bp, Artificial sequence
  Synthetic oligonucleotide
tcttctctcacttagacaagacaac

SEQ ID NO: 710057 - DNA, 25 bp, Artificial sequence
  Synthetic oligonucleotide
gaaacattctcggttcagctttggc

SEQ ID NO: 710058 - DNA, 25 bp, Artificial sequence
  Synthetic oligonucleotide
gcccaattagattggcccagataaa

SEQ ID NO: 710059 - DNA, 25 bp, Artificial sequence
  Synthetic oligonucleotide
gcccaattagataggcccagataaa

SEQ ID NO: 710060 - DNA, 25 bp, Artificial sequence
  Synthetic oligonucleotide
tagttggcttaatatttgtggtctt

SEQ ID NO: 710061 - DNA, 25 bp, Artificial sequence
  Synthetic oligonucleotide
tagttggcttaaaatttgtggtctt

SEQ ID NO: 710062 - DNA, 25 bp, Artificial sequence
  Synthetic oligonucleotide
tcagctttggctttcgttttcccgg

SEQ ID NO: 710063 - DNA, 25 bp, Artificial sequence
  Synthetic oligonucleotide
atgcttctattggagcaattgcaaa

SEQ ID NO: 710064 - DNA, 25 bp, Artificial sequence
  Synthetic oligonucleotide
cacggcgaagaagatttccccgaaa

SEQ ID NO: 710065 - DNA, 25 bp, Artificial sequence
  Synthetic oligonucleotide
taggatcaatactaaagagcacatg

SEQ ID NO: 710066 - DNA, 25 bp, Artificial sequence
  Synthetic oligonucleotide
tcgtttttacatcccggctctctag

SEQ ID NO: 710067 - DNA, 25 bp, Artificial sequence
  Synthetic oligonucleotide
tatttctgtttcactttggtatcaa

SEQ ID NO: 710068 - DNA, 25 bp, Artificial sequence
  Synthetic oligonucleotide
gagagttcgactacgattgtgtagt

SEQ ID NO: 710069 - DNA, 25 bp, Artificial sequence
  Synthetic oligonucleotide
gagagttcgacttcgattgtgtagt

SEQ ID NO: 710070 - DNA, 25 bp, Artificial sequence
  Synthetic oligonucleotide
tgtttttggcaatagacgtttgtga

SEQ ID NO: 710071 - DNA, 25 bp, Artificial sequence
  Synthetic oligonucleotide
tgtttttggcaaaagacgtttgtga

SEQ ID NO: 710072 - DNA, 25 bp, Artificial sequence
  Synthetic oligonucleotide
gggcttacacaacataatggacttt

SEQ ID NO: 710073 - DNA, 25 bp, Artificial sequence
  Synthetic oligonucleotide
gggcttacacaagataatggacttt

SEQ ID NO: 710074 - DNA, 25 bp, Artificial sequence
  Synthetic oligonucleotide
gctattgggtttcaagccatttcaa

SEQ ID NO: 710075 - DNA, 25 bp, Artificial sequence
  Synthetic oligonucleotide
gctattgggtttgaagccatttcaa

SEQ ID NO: 710076 - DNA, 25 bp, Artificial sequence
  Synthetic oligonucleotide
tgaatttttcttctagttttgactc

SEQ ID NO: 710077 - DNA, 25 bp, Artificial sequence
  Synthetic oligonucleotide
tgaatttttcttgtagttttgactc

SEQ ID NO: 710078 - DNA, 25 bp, Artificial sequence
  Synthetic oligonucleotide
cctctgttaccgtaacttgaagaaa

SEQ ID NO: 710079 - DNA, 25 bp, Artificial sequence
  Synthetic oligonucleotide
tcacaagattattggcgacagtagc

SEQ ID NO: 710080 - DNA, 25 bp, Artificial sequence
  Synthetic oligonucleotide
gtacccttcttcatcctcctctctg

SEQ ID NO: 710081 - DNA, 25 bp, Artificial sequence
  Synthetic oligonucleotide
tcgtttttacatgccggctctctag

SEQ ID NO: 710082 - DNA, 25 bp, Artificial sequence
  Synthetic oligonucleotide
cgtgtattgataatcccgtgttctc

SEQ ID NO: 710083 - DNA, 25 bp, Artificial sequence
  Synthetic oligonucleotide
cgtgtattgatattcccgtgttctc

SEQ ID NO: 710084 - DNA, 25 bp, Artificial sequence
  Synthetic oligonucleotide
gaaggtaaagccttcgcgacgtctc

SEQ ID NO: 710085 - DNA, 25 bp, Artificial sequence
  Synthetic oligonucleotide
gaaggtaaagccatcgcgacgtctc

SEQ ID NO: 710086 - DNA, 25 bp, Artificial sequence
  Synthetic oligonucleotide
cctctgttaccgaaacttgaagaaa

SEQ ID NO: 710087 - DNA, 25 bp, Artificial sequence
  Synthetic oligonucleotide
caagtactacaataattctctcaca

SEQ ID NO: 710088 - DNA, 25 bp, Artificial sequence
  Synthetic oligonucleotide
taggatcaatacaaaagagcacatg

SEQ ID NO: 710089 - DNA, 25 bp, Artificial sequence
  Synthetic oligonucleotide
gtacccttcttcttcctcctctctg

SEQ ID NO: 710090 - DNA, 25 bp, Artificial sequence
  Synthetic oligonucleotide
ggcccaagaacactctcacttacat

SEQ ID NO: 710091 - DNA, 25 bp, Artificial sequence
  Synthetic oligonucleotide
ggcccaagaacagtctcacttacat

SEQ ID NO: 710092 - DNA, 25 bp, Artificial sequence
  Synthetic oligonucleotide
ttaacgataataccaaccgtccacg

SEQ ID NO: 710093 - DNA, 25 bp, Artificial sequence
  Synthetic oligonucleotide
ttaacgataatagcaaccgtccacg

SEQ ID NO: 710094 - DNA, 25 bp, Artificial sequence
  Synthetic oligonucleotide
tcacaagattataggcgacagtagc

SEQ ID NO: 710095 - DNA, 25 bp, Artificial sequence
  Synthetic oligonucleotide
caagtactacaaaaattctctcaca

SEQ ID NO: 710096 - DNA, 25 bp, Artificial sequence
  Synthetic oligonucleotide
tggtaatccaaaaaggaaaacttca

SEQ ID NO: 710097 - DNA, 25 bp, Artificial sequence
  Synthetic oligonucleotide
tttaaacaacccttctcttctctcg

SEQ ID NO: 710098 - DNA, 25 bp, Artificial sequence
  Synthetic oligonucleotide
tagacaaagtgtgggcacgcatgga

SEQ ID NO: 710099 - DNA, 25 bp, Artificial sequence
  Synthetic oligonucleotide
aaatgccatcttctctcttggacag

SEQ ID NO: 710100 - DNA, 25 bp, Artificial sequence
  Synthetic oligonucleotide
aaatgccatcttgtctcttggacag

SEQ ID NO: 710101 - DNA, 25 bp, Artificial sequence
  Synthetic oligonucleotide
tagacatgaacacgtcaggttctct

SEQ ID NO: 710102 - DNA, 25 bp, Artificial sequence
  Synthetic oligonucleotide
tagacatgaacaggtcaggttctct

SEQ ID NO: 710103 - DNA, 25 bp, Artificial sequence
  Synthetic oligonucleotide
taaactgcttatattgtcggtagca

SEQ ID NO: 710104 - DNA, 25 bp, Artificial sequence
  Synthetic oligonucleotide
taaactgcttattttgtcggtagca

SEQ ID NO: 710105 - DNA, 25 bp, Artificial sequence
  Synthetic oligonucleotide
aaaaccccacttactctcaatttca

SEQ ID NO: 710106 - DNA, 25 bp, Artificial sequence
  Synthetic oligonucleotide
aaaaccccactttctctcaatttca

SEQ ID NO: 710107 - DNA, 25 bp, Artificial sequence
  Synthetic oligonucleotide
cccggaaattttcaagtcaacagat

SEQ ID NO: 710108 - DNA, 25 bp, Artificial sequence
  Synthetic oligonucleotide
cccggaaattttgaagtcaacagat

SEQ ID NO: 710109 - DNA, 25 bp, Artificial sequence
  Synthetic oligonucleotide
tgctaaaaaggtgaaattgagtaag

SEQ ID NO: 710110 - DNA, 25 bp, Artificial sequence
  Synthetic oligonucleotide
tatttctgtttctctttggtatcaa

SEQ ID NO: 710111 - DNA, 25 bp, Artificial sequence
  Synthetic oligonucleotide
tcgaactgaatctaacaccaacact

SEQ ID NO: 710112 - DNA, 25 bp, Artificial sequence
  Synthetic oligonucleotide
taagaaagtctaccttccattgaag

SEQ ID NO: 710113 - DNA, 25 bp, Artificial sequence
  Synthetic oligonucleotide
taagaaagtctagcttccattgaag

SEQ ID NO: 710114 - DNA, 25 bp, Artificial sequence
  Synthetic oligonucleotide
cgactaatgaaatctgaaaattatc

SEQ ID NO: 710115 - DNA, 25 bp, Artificial sequence
  Synthetic oligonucleotide
cgactaatgaaaactgaaaattatc

SEQ ID NO: 710116 - DNA, 25 bp, Artificial sequence
  Synthetic oligonucleotide
gaaggatccagctttggaagctcga

SEQ ID NO: 710117 - DNA, 25 bp, Artificial sequence
  Synthetic oligonucleotide
tgctaaaaaggtcaaattgagtaag

SEQ ID NO: 710118 - DNA, 25 bp, Artificial sequence
  Synthetic oligonucleotide
tcgaactgaatcaaacaccaacact

SEQ ID NO: 710119 - DNA, 25 bp, Artificial sequence
  Synthetic oligonucleotide
ggagattatctcgaaacctttttaa

SEQ ID NO: 710120 - DNA, 25 bp, Artificial sequence
  Synthetic oligonucleotide
cattctagaatcactcttatttgag

SEQ ID NO: 710121 - DNA, 25 bp, Artificial sequence
  Synthetic oligonucleotide
cattctagaatctctcttatttgag

SEQ ID NO: 710122 - DNA, 25 bp, Artificial sequence
  Synthetic oligonucleotide
gacagcagaacacagtctacctttc

SEQ ID NO: 710123 - DNA, 25 bp, Artificial sequence
  Synthetic oligonucleotide
tagacaaagtgtcggcacgcatgga

SEQ ID NO: 710124 - DNA, 25 bp, Artificial sequence
  Synthetic oligonucleotide
gacagcagaacagagtctacctttc

SEQ ID NO: 710125 - DNA, 25 bp, Artificial sequence
  Synthetic oligonucleotide
tggtaatccaaataggaaaacttca

SEQ ID NO: 710126 - DNA, 25 bp, Artificial sequence
  Synthetic oligonucleotide
gaaggatccagcattggaagctcga

SEQ ID NO: 710127 - DNA, 25 bp, Artificial sequence
  Synthetic oligonucleotide
ttttaagttttgcgtttgctcagtg

SEQ ID NO: 710128 - DNA, 25 bp, Artificial sequence
  Synthetic oligonucleotide
gaagagagaaaaagaagcagctgtg

SEQ ID NO: 710129 - DNA, 25 bp, Artificial sequence
  Synthetic oligonucleotide
gaagagagaaaatgaagcagctgtg

SEQ ID NO: 710130 - DNA, 25 bp, Artificial sequence
  Synthetic oligonucleotide
gggagtggtctctactcacattgtg

SEQ ID NO: 710131 - DNA, 25 bp, Artificial sequence
  Synthetic oligonucleotide
gggagtggtctcaactcacattgtg

SEQ ID NO: 710132 - DNA, 25 bp, Artificial sequence
  Synthetic oligonucleotide
gctcacaatggcagaagcaatgcct

SEQ ID NO: 710133 - DNA, 25 bp, Artificial sequence
  Synthetic oligonucleotide
gctcacaatggctgaagcaatgcct

SEQ ID NO: 710134 - DNA, 25 bp, Artificial sequence
  Synthetic oligonucleotide
gctacttcagctgttgtcaccatcg

SEQ ID NO: 710135 - DNA, 25 bp, Artificial sequence
  Synthetic oligonucleotide
gctacttcagctcttgtcaccatcg

SEQ ID NO: 710136 - DNA, 25 bp, Artificial sequence
  Synthetic oligonucleotide
aactgtttgtactatttcggtaagc

SEQ ID NO: 710137 - DNA, 25 bp, Artificial sequence
  Synthetic oligonucleotide
aactgtttgtacaatttcggtaagc

SEQ ID NO: 710138 - DNA, 25 bp, Artificial sequence
  Synthetic oligonucleotide
aactgtgtggcatctgtgggaagac

SEQ ID NO: 710139 - DNA, 25 bp, Artificial sequence
  Synthetic oligonucleotide
aactgtgtggcaactgtgggaagac

SEQ ID NO: 710140 - DNA, 25 bp, Artificial sequence
  Synthetic oligonucleotide
ggtggactctcccttcttcctcaag

SEQ ID NO: 710141 - DNA, 25 bp, Artificial sequence
  Synthetic oligonucleotide
tgttaggaaaccattcgttgctttc

SEQ ID NO: 710142 - DNA, 25 bp, Artificial sequence
  Synthetic oligonucleotide
caaacagtatctagcctgggacaac

SEQ ID NO: 710143 - DNA, 25 bp, Artificial sequence
  Synthetic oligonucleotide
aaagcgtgcgtctatcggtggtgct

SEQ ID NO: 710144 - DNA, 25 bp, Artificial sequence
  Synthetic oligonucleotide
gacattggttagtcatatcagtcac

SEQ ID NO: 710145 - DNA, 25 bp, Artificial sequence
  Synthetic oligonucleotide
gacattggttagacatatcagtcac

SEQ ID NO: 710146 - DNA, 25 bp, Artificial sequence
  Synthetic oligonucleotide
tactttccccccataattttatctg

SEQ ID NO: 710147 - DNA, 25 bp, Artificial sequence
  Synthetic oligonucleotide
tactttccccccttaattttatctg

SEQ ID NO: 710148 - DNA, 25 bp, Artificial sequence
  Synthetic oligonucleotide
ggtggactctccgttcttcctcaag

SEQ ID NO: 710149 - DNA, 25 bp, Artificial sequence
  Synthetic oligonucleotide
tgctgtggcagcaataatcatggta

SEQ ID NO: 710150 - DNA, 25 bp, Artificial sequence
  Synthetic oligonucleotide
ttttaagttttgggtttgctcagtg

SEQ ID NO: 710151 - DNA, 25 bp, Artificial sequence
  Synthetic oligonucleotide
cagatcatgtggtcaacatttgtcc

SEQ ID NO: 710152 - DNA, 25 bp, Artificial sequence
  Synthetic oligonucleotide
tgttttaattaattcgacacttcga

SEQ ID NO: 710153 - DNA, 25 bp, Artificial sequence
  Synthetic oligonucleotide
tgttttaattaaatcgacacttcga

SEQ ID NO: 710154 - DNA, 25 bp, Artificial sequence
  Synthetic oligonucleotide
catgtattccaatggcattagacta

SEQ ID NO: 710155 - DNA, 25 bp, Artificial sequence
  Synthetic oligonucleotide
catgtattccaaaggcattagacta

SEQ ID NO: 710156 - DNA, 25 bp, Artificial sequence
  Synthetic oligonucleotide
cagatcatgtggacaacatttgtcc

SEQ ID NO: 710157 - DNA, 25 bp, Artificial sequence
  Synthetic oligonucleotide
tgctgtggcagctataatcatggta

SEQ ID NO: 710158 - DNA, 25 bp, Artificial sequence
  Synthetic oligonucleotide
tcggaatcggacacggactccgact

SEQ ID NO: 710159 - DNA, 25 bp, Artificial sequence
  Synthetic oligonucleotide
tctcaaagggaattccaggtttggg

SEQ ID NO: 710160 - DNA, 25 bp, Artificial sequence
  Synthetic oligonucleotide
tggttggtggatgttttttattttg

SEQ ID NO: 710161 - DNA, 25 bp, Artificial sequence
  Synthetic oligonucleotide
tggttggtggatcttttttattttg

SEQ ID NO: 710162 - DNA, 25 bp, Artificial sequence
  Synthetic oligonucleotide
tctaaaatcaaacgctcaattttgt

SEQ ID NO: 710163 - DNA, 25 bp, Artificial sequence
  Synthetic oligonucleotide
tctaaaatcaaaggctcaattttgt

SEQ ID NO: 710164 - DNA, 25 bp, Artificial sequence
  Synthetic oligonucleotide
tctcaaagggaaatccaggtttggg

SEQ ID NO: 710165 - DNA, 25 bp, Artificial sequence
  Synthetic oligonucleotide
cagcaggtgcggattgaatttctga

SEQ ID NO: 710166 - DNA, 25 bp, Artificial sequence
  Synthetic oligonucleotide
tcggaatcggactcggactccgact

SEQ ID NO: 710167 - DNA, 25 bp, Artificial sequence
  Synthetic oligonucleotide
gactcgccgactcgttcctgttcgt

SEQ ID NO: 710168 - DNA, 25 bp, Artificial sequence
  Synthetic oligonucleotide
tcaatggcttgagtcggtggaattc

SEQ ID NO: 710169 - DNA, 25 bp, Artificial sequence
  Synthetic oligonucleotide
tcaatggcttgactcggtggaattc

SEQ ID NO: 710170 - DNA, 25 bp, Artificial sequence
  Synthetic oligonucleotide
tgttaggaaacctttcgttgctttc

SEQ ID NO: 710171 - DNA, 25 bp, Artificial sequence
  Synthetic oligonucleotide
caaacagtatcttgcctgggacaac

SEQ ID NO: 710172 - DNA, 25 bp, Artificial sequence
  Synthetic oligonucleotide
aaagcgtgcgtcaatcggtggtgct

SEQ ID NO: 710173 - DNA, 25 bp, Artificial sequence
  Synthetic oligonucleotide
cagcaggtgcggtttgaatttctga

SEQ ID NO: 710174 - DNA, 25 bp, Artificial sequence
  Synthetic oligonucleotide
aaagatattataatacatagatcag

SEQ ID NO: 710175 - DNA, 25 bp, Artificial sequence
  Synthetic oligonucleotide
tagagtttgtttattggatacaggg

SEQ ID NO: 710176 - DNA, 25 bp, Artificial sequence
  Synthetic oligonucleotide
ggatttagtggaagtgatagataga

SEQ ID NO: 710177 - DNA, 25 bp, Artificial sequence
  Synthetic oligonucleotide
gactcgccgactggttcctgttcgt

SEQ ID NO: 710178 - DNA, 25 bp, Artificial sequence
  Synthetic oligonucleotide
tagagtttgttttttggatacaggg

SEQ ID NO: 710179 - DNA, 25 bp, Artificial sequence
  Synthetic oligonucleotide
ggatttagtggatgtgatagataga

SEQ ID NO: 710180 - DNA, 25 bp, Artificial sequence
  Synthetic oligonucleotide
aaagatattatattacatagatcag

SEQ ID NO: 710181 - DNA, 25 bp, Artificial sequence
  Synthetic oligonucleotide
gaaacaataccgctctttcggctgt

SEQ ID NO: 710182 - DNA, 25 bp, Artificial sequence
  Synthetic oligonucleotide
gaaacaataccggtctttcggctgt

SEQ ID NO: 710183 - DNA, 25 bp, Artificial sequence
  Synthetic oligonucleotide
ggagcaaacattccgtttctcatgc

SEQ ID NO: 710184 - DNA, 25 bp, Artificial sequence
  Synthetic oligonucleotide
tcagatcatcctgaatacccagaat

SEQ ID NO: 710185 - DNA, 25 bp, Artificial sequence
  Synthetic oligonucleotide
caagaatgggactcatggacggcca

SEQ ID NO: 710186 - DNA, 25 bp, Artificial sequence
  Synthetic oligonucleotide
caagaatgggacacatggacggcca

SEQ ID NO: 710187 - DNA, 25 bp, Artificial sequence
  Synthetic oligonucleotide
tcagatcatcctcaatacccagaat

SEQ ID NO: 710188 - DNA, 25 bp, Artificial sequence
  Synthetic oligonucleotide
ggagcaaacattgcgtttctcatgc

SEQ ID NO: 710189 - DNA, 25 bp, Artificial sequence
  Synthetic oligonucleotide
ctctcttatctgcatttgatcagca

SEQ ID NO: 710190 - DNA, 25 bp, Artificial sequence
  Synthetic oligonucleotide
tctttccccacctaaactaagtgat

SEQ ID NO: 710191 - DNA, 25 bp, Artificial sequence
  Synthetic oligonucleotide
tctttccccaccaaaactaagtgat

SEQ ID NO: 710192 - DNA, 25 bp, Artificial sequence
  Synthetic oligonucleotide
gaaaaaggttacttcaggctgaaga

SEQ ID NO: 710193 - DNA, 25 bp, Artificial sequence
  Synthetic oligonucleotide
ccagagggtctcagtggaatcaaca

SEQ ID NO: 710194 - DNA, 25 bp, Artificial sequence
  Synthetic oligonucleotide
cattgtgaagaattcttggggacca

SEQ ID NO: 710195 - DNA, 25 bp, Artificial sequence
  Synthetic oligonucleotide
ctctcttatctggatttgatcagca

SEQ ID NO: 710196 - DNA, 25 bp, Artificial sequence
  Synthetic oligonucleotide
cattgtgaagaaatcttggggacca

SEQ ID NO: 710197 - DNA, 25 bp, Artificial sequence
  Synthetic oligonucleotide
tatataagaagcagagaattgacaa

SEQ ID NO: 710198 - DNA, 25 bp, Artificial sequence
  Synthetic oligonucleotide
gaaaaaggttacatcaggctgaaga

SEQ ID NO: 710199 - DNA, 25 bp, Artificial sequence
  Synthetic oligonucleotide
ccagagggtctctgtggaatcaaca

SEQ ID NO: 710200 - DNA, 25 bp, Artificial sequence
  Synthetic oligonucleotide
agtgtcttcgttttttctcttttga

SEQ ID NO: 710201 - DNA, 25 bp, Artificial sequence
  Synthetic oligonucleotide
agtgtcttcgttatttctcttttga

SEQ ID NO: 710202 - DNA, 25 bp, Artificial sequence
  Synthetic oligonucleotide
ggaagtcttgtatcaactatgtgca

SEQ ID NO: 710203 - DNA, 25 bp, Artificial sequence
  Synthetic oligonucleotide
tatataagaagctgagaattgacaa

SEQ ID NO: 710204 - DNA, 25 bp, Artificial sequence
  Synthetic oligonucleotide
agtttcttggggaagaaataattga

SEQ ID NO: 710205 - DNA, 25 bp, Artificial sequence
  Synthetic oligonucleotide
caaccatgaagatattaaagcagag

SEQ ID NO: 710206 - DNA, 25 bp, Artificial sequence
  Synthetic oligonucleotide
caaccatgaagaaattaaagcagag

SEQ ID NO: 710207 - DNA, 25 bp, Artificial sequence
  Synthetic oligonucleotide
tgggtatggatcaagcaagggttca

SEQ ID NO: 710208 - DNA, 25 bp, Artificial sequence
  Synthetic oligonucleotide
tgttttgaaaacaggatgaatctga

SEQ ID NO: 710209 - DNA, 25 bp, Artificial sequence
  Synthetic oligonucleotide
taatgattattgtagaaaagaacag

SEQ ID NO: 710210 - DNA, 25 bp, Artificial sequence
  Synthetic oligonucleotide
taatgattattgaagaaaagaacag

SEQ ID NO: 710211 - DNA, 25 bp, Artificial sequence
  Synthetic oligonucleotide
ggaagtcttgtaacaactatgtgca

SEQ ID NO: 710212 - DNA, 25 bp, Artificial sequence
  Synthetic oligonucleotide
tgtcgccattgatgcatctggtaga

SEQ ID NO: 710213 - DNA, 25 bp, Artificial sequence
  Synthetic oligonucleotide
tactctatggaacaaggaacttgcg

SEQ ID NO: 710214 - DNA, 25 bp, Artificial sequence
  Synthetic oligonucleotide
tgctctgcgggaataataaaagttg

SEQ ID NO: 710215 - DNA, 25 bp, Artificial sequence
  Synthetic oligonucleotide
agtttcttggggtagaaataattga

SEQ ID NO: 710216 - DNA, 25 bp, Artificial sequence
  Synthetic oligonucleotide
ggtcccattctaatatcaactcttg

SEQ ID NO: 710217 - DNA, 25 bp, Artificial sequence
  Synthetic oligonucleotide
ggtcccattctattatcaactcttg

SEQ ID NO: 710218 - DNA, 25 bp, Artificial sequence
  Synthetic oligonucleotide
gatgtgttaatgtaaggtggtccca

SEQ ID NO: 710219 - DNA, 25 bp, Artificial sequence
  Synthetic oligonucleotide
gatgtgttaatgaaaggtggtccca

SEQ ID NO: 710220 - DNA, 25 bp, Artificial sequence
  Synthetic oligonucleotide
tgttttgaaaactggatgaatctga

SEQ ID NO: 710221 - DNA, 25 bp, Artificial sequence
  Synthetic oligonucleotide
taatggacaccatgacgtacctact

SEQ ID NO: 710222 - DNA, 25 bp, Artificial sequence
  Synthetic oligonucleotide
taatggacaccaagacgtacctact

SEQ ID NO: 710223 - DNA, 25 bp, Artificial sequence
  Synthetic oligonucleotide
gagtctcttgaaggcattggctcat

SEQ ID NO: 710224 - DNA, 25 bp, Artificial sequence
  Synthetic oligonucleotide
tgggtatggatctagcaagggttca

SEQ ID NO: 710225 - DNA, 25 bp, Artificial sequence
  Synthetic oligonucleotide
tgtcgccattgaagcatctggtaga

SEQ ID NO: 710226 - DNA, 25 bp, Artificial sequence
  Synthetic oligonucleotide
tagcggcgtaagaacattataaacc

SEQ ID NO: 710227 - DNA, 25 bp, Artificial sequence
  Synthetic oligonucleotide
tagcggcgtaagtacattataaacc

SEQ ID NO: 710228 - DNA, 25 bp, Artificial sequence
  Synthetic oligonucleotide
gaaaatggttgttagttaattgctc

SEQ ID NO: 710229 - DNA, 25 bp, Artificial sequence
  Synthetic oligonucleotide
gaaaatggttgtaagttaattgctc

SEQ ID NO: 710230 - DNA, 25 bp, Artificial sequence
  Synthetic oligonucleotide
cattttgtatttcgtatatgaaggg

SEQ ID NO: 710231 - DNA, 25 bp, Artificial sequence
  Synthetic oligonucleotide
cattttgtatttggtatatgaaggg

SEQ ID NO: 710232 - DNA, 25 bp, Artificial sequence
  Synthetic oligonucleotide
cggtgcggggttcatcttgaccacg

SEQ ID NO: 710233 - DNA, 25 bp, Artificial sequence
  Synthetic oligonucleotide
cggtgcggggttgatcttgaccacg

SEQ ID NO: 710234 - DNA, 25 bp, Artificial sequence
  Synthetic oligonucleotide
gagtctcttgaacgcattggctcat

SEQ ID NO: 710235 - DNA, 25 bp, Artificial sequence
  Synthetic oligonucleotide
ataccaactgtagggaataccagcg

SEQ ID NO: 710236 - DNA, 25 bp, Artificial sequence
  Synthetic oligonucleotide
gagatcccgtgacaagtagacctaa

SEQ ID NO: 710237 - DNA, 25 bp, Artificial sequence
  Synthetic oligonucleotide
agtgcccacaattgccccaagctta

SEQ ID NO: 710238 - DNA, 25 bp, Artificial sequence
  Synthetic oligonucleotide
agtgcccacaatagccccaagctta

SEQ ID NO: 710239 - DNA, 25 bp, Artificial sequence
  Synthetic oligonucleotide
gagatcccgtgagaagtagacctaa

SEQ ID NO: 710240 - DNA, 25 bp, Artificial sequence
  Synthetic oligonucleotide
tcgtagacgtttactgcagtggaag

SEQ ID NO: 710241 - DNA, 25 bp, Artificial sequence
  Synthetic oligonucleotide
tgctctgcgggattaataaaagttg

SEQ ID NO: 710242 - DNA, 25 bp, Artificial sequence
  Synthetic oligonucleotide
ccaaaattgcaatagaagaaaacca

SEQ ID NO: 710243 - DNA, 25 bp, Artificial sequence
  Synthetic oligonucleotide
ccaaaattgcaaaagaagaaaacca

SEQ ID NO: 710244 - DNA, 25 bp, Artificial sequence
  Synthetic oligonucleotide
catgaagcctttattattatgctcg

SEQ ID NO: 710245 - DNA, 25 bp, Artificial sequence
  Synthetic oligonucleotide
tcatcgctttccatcttcttggtag

SEQ ID NO: 710246 - DNA, 25 bp, Artificial sequence
  Synthetic oligonucleotide
ataccaactgtacggaataccagcg

SEQ ID NO: 710247 - DNA, 25 bp, Artificial sequence
  Synthetic oligonucleotide
catacggtttacttcgggataaatc

SEQ ID NO: 710248 - DNA, 25 bp, Artificial sequence
  Synthetic oligonucleotide
taacggccatgaagaaaaaccccat

SEQ ID NO: 710249 - DNA, 25 bp, Artificial sequence
  Synthetic oligonucleotide
taacggccatgatgaaaaaccccat

SEQ ID NO: 710250 - DNA, 25 bp, Artificial sequence
  Synthetic oligonucleotide
gacacgacctatgttgtcgatgaag

SEQ ID NO: 710251 - DNA, 25 bp, Artificial sequence
  Synthetic oligonucleotide
gacacgacctatcttgtcgatgaag

SEQ ID NO: 710252 - DNA, 25 bp, Artificial sequence
  Synthetic oligonucleotide
ccaataaccgggaatggtggagcaa

SEQ ID NO: 710253 - DNA, 25 bp, Artificial sequence
  Synthetic oligonucleotide
ccaataaccgggtatggtggagcaa

SEQ ID NO: 710254 - DNA, 25 bp, Artificial sequence
  Synthetic oligonucleotide
gatggctcctaaatccgccacttca

SEQ ID NO: 710255 - DNA, 25 bp, Artificial sequence
  Synthetic oligonucleotide
gatggctcctaattccgccacttca

SEQ ID NO: 710256 - DNA, 25 bp, Artificial sequence
  Synthetic oligonucleotide
tcgtagacgttttctgcagtggaag

SEQ ID NO: 710257 - DNA, 25 bp, Artificial sequence
  Synthetic oligonucleotide
tgttaagaacggaggtctacgcaag

SEQ ID NO: 710258 - DNA, 25 bp, Artificial sequence
  Synthetic oligonucleotide
catgaagccttttttattatgctcg

SEQ ID NO: 710259 - DNA, 25 bp, Artificial sequence
  Synthetic oligonucleotide
gaagcaaagtgctcacggaggattg

SEQ ID NO: 710260 - DNA, 25 bp, Artificial sequence
  Synthetic oligonucleotide
aatctttagattcaacagtttacag

SEQ ID NO: 710261 - DNA, 25 bp, Artificial sequence
  Synthetic oligonucleotide
aaaaaacagaggtaatgtagattaa

SEQ ID NO: 710262 - DNA, 25 bp, Artificial sequence
  Synthetic oligonucleotide
aaaaaacagaggaaatgtagattaa

SEQ ID NO: 710263 - DNA, 25 bp, Artificial sequence
  Synthetic oligonucleotide
tcttgggtaagatgcaattggaaaa

SEQ ID NO: 710264 - DNA, 25 bp, Artificial sequence
  Synthetic oligonucleotide
tcttgggtaagaagcaattggaaaa

SEQ ID NO: 710265 - DNA, 25 bp, Artificial sequence
  Synthetic oligonucleotide
tcaaagcaaaatctaaacaaaatct

SEQ ID NO: 710266 - DNA, 25 bp, Artificial sequence
  Synthetic oligonucleotide
tcaaagcaaaatgtaaacaaaatct

SEQ ID NO: 710267 - DNA, 25 bp, Artificial sequence
  Synthetic oligonucleotide
gcagaaatatacaattgtatgaact

SEQ ID NO: 710268 - DNA, 25 bp, Artificial sequence
  Synthetic oligonucleotide
gcagaaatatactattgtatgaact

SEQ ID NO: 710269 - DNA, 25 bp, Artificial sequence
  Synthetic oligonucleotide
tcatcgctttccttcttcttggtag

SEQ ID NO: 710270 - DNA, 25 bp, Artificial sequence
  Synthetic oligonucleotide
tcatgtgttcaatatgtcgagatca

SEQ ID NO: 710271 - DNA, 25 bp, Artificial sequence
  Synthetic oligonucleotide
aatctttagattgaacagtttacag

SEQ ID NO: 710272 - DNA, 25 bp, Artificial sequence
  Synthetic oligonucleotide
gaagcaaagtgcacacggaggattg

SEQ ID NO: 710273 - DNA, 25 bp, Artificial sequence
  Synthetic oligonucleotide
tctgtggctcatgttcagactcagc

SEQ ID NO: 710274 - DNA, 25 bp, Artificial sequence
  Synthetic oligonucleotide
tctgtggctcatcttcagactcagc

SEQ ID NO: 710275 - DNA, 25 bp, Artificial sequence
  Synthetic oligonucleotide
ggtcatgctcgtactcctctaacga

SEQ ID NO: 710276 - DNA, 25 bp, Artificial sequence
  Synthetic oligonucleotide
ggtcatgctcgttctcctctaacga

SEQ ID NO: 710277 - DNA, 25 bp, Artificial sequence
  Synthetic oligonucleotide
tttccttggtgatgaaatacgtcac

SEQ ID NO: 710278 - DNA, 25 bp, Artificial sequence
  Synthetic oligonucleotide
tttccttggtgaagaaatacgtcac

SEQ ID NO: 710279 - DNA, 25 bp, Artificial sequence
  Synthetic oligonucleotide
aatgcaaacgcctccaagaatcaag

SEQ ID NO: 710280 - DNA, 25 bp, Artificial sequence
  Synthetic oligonucleotide
aatgcaaacgccaccaagaatcaag

SEQ ID NO: 710281 - DNA, 25 bp, Artificial sequence
  Synthetic oligonucleotide
catacggtttacatcgggataaatc

SEQ ID NO: 710282 - DNA, 25 bp, Artificial sequence
  Synthetic oligonucleotide
tcatgtgttcaaaatgtcgagatca

SEQ ID NO: 710283 - DNA, 25 bp, Artificial sequence
  Synthetic oligonucleotide
ccgcagggccgggtcagaataataa

SEQ ID NO: 710284 - DNA, 25 bp, Artificial sequence
  Synthetic oligonucleotide
caaaactaagctaaaagacacagac

SEQ ID NO: 710285 - DNA, 25 bp, Artificial sequence
  Synthetic oligonucleotide
caattaagattgctgatcaaaacat

SEQ ID NO: 710286 - DNA, 25 bp, Artificial sequence
  Synthetic oligonucleotide
tcagttaattacatagttggcccac

SEQ ID NO: 710287 - DNA, 25 bp, Artificial sequence
  Synthetic oligonucleotide
tcagttaattacttagttggcccac

SEQ ID NO: 710288 - DNA, 25 bp, Artificial sequence
  Synthetic oligonucleotide
gctttcttattgatgaggttggcat

SEQ ID NO: 710289 - DNA, 25 bp, Artificial sequence
  Synthetic oligonucleotide
gctttcttattgttgaggttggcat

SEQ ID NO: 710290 - DNA, 25 bp, Artificial sequence
  Synthetic oligonucleotide
ggccttccttaaatgattacctctg

SEQ ID NO: 710291 - DNA, 25 bp, Artificial sequence
  Synthetic oligonucleotide
ggccttccttaattgattacctctg

SEQ ID NO: 710292 - DNA, 25 bp, Artificial sequence
  Synthetic oligonucleotide
cagaggtttctagttctgcacataa

SEQ ID NO: 710293 - DNA, 25 bp, Artificial sequence
  Synthetic oligonucleotide
gattatgggccggaaatccatgatt

SEQ ID NO: 710294 - DNA, 25 bp, Artificial sequence
  Synthetic oligonucleotide
ccgcagggccggctcagaataataa

SEQ ID NO: 710295 - DNA, 25 bp, Artificial sequence
  Synthetic oligonucleotide
gattatgggccgcaaatccatgatt

SEQ ID NO: 710296 - DNA, 25 bp, Artificial sequence
  Synthetic oligonucleotide
gagctggaaaaaaaaattagttctc

SEQ ID NO: 710297 - DNA, 25 bp, Artificial sequence
  Synthetic oligonucleotide
gagctggaaaaataaattagttctc

SEQ ID NO: 710298 - DNA, 25 bp, Artificial sequence
  Synthetic oligonucleotide
gttatatatcaaaatttttggaccc

SEQ ID NO: 710299 - DNA, 25 bp, Artificial sequence
  Synthetic oligonucleotide
gttatatatcaatatttttggaccc

SEQ ID NO: 710300 - DNA, 25 bp, Artificial sequence
  Synthetic oligonucleotide
aagaaattttgggtagaccctgtgc

SEQ ID NO: 710301 - DNA, 25 bp, Artificial sequence
  Synthetic oligonucleotide
aagaaattttggctagaccctgtgc

SEQ ID NO: 710302 - DNA, 25 bp, Artificial sequence
  Synthetic oligonucleotide
cagcacatgtgttaagccggcctgc

SEQ ID NO: 710303 - DNA, 25 bp, Artificial sequence
  Synthetic oligonucleotide
cagcacatgtgtaaagccggcctgc

SEQ ID NO: 710304 - DNA, 25 bp, Artificial sequence
  Synthetic oligonucleotide
tacttggagtcaaagtaacctcatg

SEQ ID NO: 710305 - DNA, 25 bp, Artificial sequence
  Synthetic oligonucleotide
tacttggagtcatagtaacctcatg

SEQ ID NO: 710306 - DNA, 25 bp, Artificial sequence
  Synthetic oligonucleotide
cagaggtttctacttctgcacataa

SEQ ID NO: 710307 - DNA, 25 bp, Artificial sequence
  Synthetic oligonucleotide
taaaacgaagatccttatcctcctg

SEQ ID NO: 710308 - DNA, 25 bp, Artificial sequence
  Synthetic oligonucleotide
tactctatggaagaaggaacttgcg

SEQ ID NO: 710309 - DNA, 25 bp, Artificial sequence
  Synthetic oligonucleotide
tgttaagaacggtggtctacgcaag

SEQ ID NO: 710310 - DNA, 25 bp, Artificial sequence
  Synthetic oligonucleotide
taaatgaatccactttatgaaaaat

SEQ ID NO: 710311 - DNA, 25 bp, Artificial sequence
  Synthetic oligonucleotide
taaatgaatccagtttatgaaaaat

SEQ ID NO: 710312 - DNA, 25 bp, Artificial sequence
  Synthetic oligonucleotide
tagatcatacttggtagtggttggt

SEQ ID NO: 710313 - DNA, 25 bp, Artificial sequence
  Synthetic oligonucleotide
tagatcatacttcgtagtggttggt

SEQ ID NO: 710314 - DNA, 25 bp, Artificial sequence
  Synthetic oligonucleotide
tcattataaaaatcaagtttttacg

SEQ ID NO: 710315 - DNA, 25 bp, Artificial sequence
  Synthetic oligonucleotide
tcattataaaaaacaagtttttacg

SEQ ID NO: 710316 - DNA, 25 bp, Artificial sequence
  Synthetic oligonucleotide
tttatatatcttattcaacaattag

SEQ ID NO: 710317 - DNA, 25 bp, Artificial sequence
  Synthetic oligonucleotide
caattaagattggtgatcaaaacat

SEQ ID NO: 710318 - DNA, 25 bp, Artificial sequence
  Synthetic oligonucleotide
taaaacgaagatgcttatcctcctg

SEQ ID NO: 710319 - DNA, 25 bp, Artificial sequence
  Synthetic oligonucleotide
gaattttatattgtctcattaagaa

SEQ ID NO: 710320 - DNA, 25 bp, Artificial sequence
  Synthetic oligonucleotide
gaaatcttggtgcattgacaggtca

SEQ ID NO: 710321 - DNA, 25 bp, Artificial sequence
  Synthetic oligonucleotide
gaaatcttggtggattgacaggtca

SEQ ID NO: 710322 - DNA, 25 bp, Artificial sequence
  Synthetic oligonucleotide
gttctttacagattaaatatcttat

SEQ ID NO: 710323 - DNA, 25 bp, Artificial sequence
  Synthetic oligonucleotide
gttctttacagaataaatatcttat

SEQ ID NO: 710324 - DNA, 25 bp, Artificial sequence
  Synthetic oligonucleotide
gaaatatacttctccgtaatctcat

SEQ ID NO: 710325 - DNA, 25 bp, Artificial sequence
  Synthetic oligonucleotide
gaattttatattctctcattaagaa

SEQ ID NO: 710326 - DNA, 25 bp, Artificial sequence
  Synthetic oligonucleotide
ttagaacagtgaacaaaagaagagc

SEQ ID NO: 710327 - DNA, 25 bp, Artificial sequence
  Synthetic oligonucleotide
ttagaacagtgatcaaaagaagagc

SEQ ID NO: 710328 - DNA, 25 bp, Artificial sequence
  Synthetic oligonucleotide
taaacttcaacaatcattcatacca

SEQ ID NO: 710329 - DNA, 25 bp, Artificial sequence
  Synthetic oligonucleotide
taaacttcaacattcattcatacca

SEQ ID NO: 710330 - DNA, 25 bp, Artificial sequence
  Synthetic oligonucleotide
tttatatatctttttcaacaattag

SEQ ID NO: 710331 - DNA, 25 bp, Artificial sequence
  Synthetic oligonucleotide
aaacttgtttcgcaggaagttgttg

SEQ ID NO: 710332 - DNA, 25 bp, Artificial sequence
  Synthetic oligonucleotide
caagaaaatgtatttagggctcaag

SEQ ID NO: 710333 - DNA, 25 bp, Artificial sequence
  Synthetic oligonucleotide
caagaaaatgtaattagggctcaag

SEQ ID NO: 710334 - DNA, 25 bp, Artificial sequence
  Synthetic oligonucleotide
gagacgcgatgatgaaagatcttac

SEQ ID NO: 710335 - DNA, 25 bp, Artificial sequence
  Synthetic oligonucleotide
gagacgcgatgaagaaagatcttac

SEQ ID NO: 710336 - DNA, 25 bp, Artificial sequence
  Synthetic oligonucleotide
cttacagggacgtcgaagctgttcc

SEQ ID NO: 710337 - DNA, 25 bp, Artificial sequence
  Synthetic oligonucleotide
cttacagggacgacgaagctgttcc

SEQ ID NO: 710338 - DNA, 25 bp, Artificial sequence
  Synthetic oligonucleotide
ttgactggagaatgaaaggagctgt

SEQ ID NO: 710339 - DNA, 25 bp, Artificial sequence
  Synthetic oligonucleotide
ttgactggagaaagaaaggagctgt

SEQ ID NO: 710340 - DNA, 25 bp, Artificial sequence
  Synthetic oligonucleotide
gaaccagggctcttgtggtaatatc

SEQ ID NO: 710341 - DNA, 25 bp, Artificial sequence
  Synthetic oligonucleotide
cgggctcaacgactttgcggatttg

SEQ ID NO: 710342 - DNA, 25 bp, Artificial sequence
  Synthetic oligonucleotide
ctgatctgttaaaggaagttttgac

SEQ ID NO: 710343 - DNA, 25 bp, Artificial sequence
  Synthetic oligonucleotide
ctgatctgttaatggaagttttgac

SEQ ID NO: 710344 - DNA, 25 bp, Artificial sequence
  Synthetic oligonucleotide
cagtagcagctgacgaaggtataaa

SEQ ID NO: 710345 - DNA, 25 bp, Artificial sequence
  Synthetic oligonucleotide
cagtagcagctgtcgaaggtataaa

SEQ ID NO: 710346 - DNA, 25 bp, Artificial sequence
  Synthetic oligonucleotide
gacaggaaacttcacaacattgtca

SEQ ID NO: 710347 - DNA, 25 bp, Artificial sequence
  Synthetic oligonucleotide
gacaggaaacttgacaacattgtca

SEQ ID NO: 710348 - DNA, 25 bp, Artificial sequence
  Synthetic oligonucleotide
catagactgtgagacgacctacaac

SEQ ID NO: 710349 - DNA, 25 bp, Artificial sequence
  Synthetic oligonucleotide
catagactgtgacacgacctacaac

SEQ ID NO: 710350 - DNA, 25 bp, Artificial sequence
  Synthetic oligonucleotide
caaaactaagcttaaagacacagac

SEQ ID NO: 710351 - DNA, 25 bp, Artificial sequence
  Synthetic oligonucleotide
gaaatatacttcaccgtaatctcat

SEQ ID NO: 710352 - DNA, 25 bp, Artificial sequence
  Synthetic oligonucleotide
caacggtggtctgatggactatgcc

SEQ ID NO: 710353 - DNA, 25 bp, Artificial sequence
  Synthetic oligonucleotide
caacggtggtctcatggactatgcc

SEQ ID NO: 710354 - DNA, 25 bp, Artificial sequence
  Synthetic oligonucleotide
gaaccagggctcatgtggtaatatc

SEQ ID NO: 710355 - DNA, 25 bp, Artificial sequence
  Synthetic oligonucleotide
gaatcctctgttatgctcttgcctt

SEQ ID NO: 710356 - DNA, 25 bp, Artificial sequence
  Synthetic oligonucleotide
gttacagattcagactactttactc

SEQ ID NO: 710357 - DNA, 25 bp, Artificial sequence
  Synthetic oligonucleotide
gagcgacctctaacgagtctccagc

SEQ ID NO: 710358 - DNA, 25 bp, Artificial sequence
  Synthetic oligonucleotide
gagcgacctctatcgagtctccagc

SEQ ID NO: 710359 - DNA, 25 bp, Artificial sequence
  Synthetic oligonucleotide
aaacttgtttcggaggaagttgttg

SEQ ID NO: 710360 - DNA, 25 bp, Artificial sequence
  Synthetic oligonucleotide
cgggctcaacgagtttgcggatttg

SEQ ID NO: 710361 - DNA, 25 bp, Artificial sequence
  Synthetic oligonucleotide
ggctcttctcttccatttcctctta

SEQ ID NO: 710362 - DNA, 25 bp, Artificial sequence
  Synthetic oligonucleotide
ggctcttctcttgcatttcctctta

SEQ ID NO: 710363 - DNA, 25 bp, Artificial sequence
  Synthetic oligonucleotide
gttacagattcacactactttactc

SEQ ID NO: 710364 - DNA, 25 bp, Artificial sequence
  Synthetic oligonucleotide
gaaaaacaaacgaactcaaatggct

SEQ ID NO: 710365 - DNA, 25 bp, Artificial sequence
  Synthetic oligonucleotide
gaatcctctgttttgctcttgcctt

SEQ ID NO: 710366 - DNA, 25 bp, Artificial sequence
  Synthetic oligonucleotide
tctctccctctcattcgcttcttcc

SEQ ID NO: 710367 - DNA, 25 bp, Artificial sequence
  Synthetic oligonucleotide
tctctccctctctttcgcttcttcc

SEQ ID NO: 710368 - DNA, 25 bp, Artificial sequence
  Synthetic oligonucleotide
aattttgagaaaccttatgaaaccg

SEQ ID NO: 710369 - DNA, 25 bp, Artificial sequence
  Synthetic oligonucleotide
gaaaaacaaacgtactcaaatggct

SEQ ID NO: 710370 - DNA, 25 bp, Artificial sequence
  Synthetic oligonucleotide
catcgttggatagtcccccgaggat

SEQ ID NO: 710371 - DNA, 25 bp, Artificial sequence
  Synthetic oligonucleotide
catcgatgagacaaacaagaaaggg

SEQ ID NO: 710372 - DNA, 25 bp, Artificial sequence
  Synthetic oligonucleotide
tgacaaactcattgaactcttcgaa

SEQ ID NO: 710373 - DNA, 25 bp, Artificial sequence
  Synthetic oligonucleotide
ttcttaggttcgaagttttcaagga

SEQ ID NO: 710374 - DNA, 25 bp, Artificial sequence
  Synthetic oligonucleotide
tgacaaactcatagaactcttcgaa

SEQ ID NO: 710375 - DNA, 25 bp, Artificial sequence
  Synthetic oligonucleotide
aattttgagaaagcttatgaaaccg

SEQ ID NO: 710376 - DNA, 25 bp, Artificial sequence
  Synthetic oligonucleotide
catcgttggatactcccccgaggat

SEQ ID NO: 710377 - DNA, 25 bp, Artificial sequence
  Synthetic oligonucleotide
ttcttaggttcgtagttttcaagga

SEQ ID NO: 710378 - DNA, 25 bp, Artificial sequence
  Synthetic oligonucleotide
catcgatgagactaacaagaaaggg

SEQ ID NO: 710379 - DNA, 25 bp, Artificial sequence
  Synthetic oligonucleotide
aatgagcacgtaccctgcttctcca

SEQ ID NO: 710380 - DNA, 25 bp, Artificial sequence
  Synthetic oligonucleotide
cacagaaccaaagcttaaactcgaa

SEQ ID NO: 710381 - DNA, 25 bp, Artificial sequence
  Synthetic oligonucleotide
cacagaaccaaaccttaaactcgaa

SEQ ID NO: 710382 - DNA, 25 bp, Artificial sequence
  Synthetic oligonucleotide
cagtctctgaacacaagattccatg

SEQ ID NO: 710383 - DNA, 25 bp, Artificial sequence
  Synthetic oligonucleotide
aatgagcacgtagcctgcttctcca

SEQ ID NO: 710384 - DNA, 25 bp, Artificial sequence
  Synthetic oligonucleotide
tcttcttatctctgtgatgatcatc

SEQ ID NO: 710385 - DNA, 25 bp, Artificial sequence
  Synthetic oligonucleotide
gatggatccttagatcaactttgac

SEQ ID NO: 710386 - DNA, 25 bp, Artificial sequence
  Synthetic oligonucleotide
gatggatccttacatcaactttgac

SEQ ID NO: 710387 - DNA, 25 bp, Artificial sequence
  Synthetic oligonucleotide
tgttttgatgagtcagcctctgcat

SEQ ID NO: 710388 - DNA, 25 bp, Artificial sequence
  Synthetic oligonucleotide
agactgggtcttctgtagggtattc

SEQ ID NO: 710389 - DNA, 25 bp, Artificial sequence
  Synthetic oligonucleotide
cggaaggagttatatgtagagacaa

SEQ ID NO: 710390 - DNA, 25 bp, Artificial sequence
  Synthetic oligonucleotide
gaaggtagctcggagagcctcctga

SEQ ID NO: 710391 - DNA, 25 bp, Artificial sequence
  Synthetic oligonucleotide
tgttttgatgagacagcctctgcat

SEQ ID NO: 710392 - DNA, 25 bp, Artificial sequence
  Synthetic oligonucleotide
cggaaggagttaaatgtagagacaa

SEQ ID NO: 710393 - DNA, 25 bp, Artificial sequence
  Synthetic oligonucleotide
tcttcttatctcagtgatgatcatc

SEQ ID NO: 710394 - DNA, 25 bp, Artificial sequence
  Synthetic oligonucleotide
ttgatggaagccacgggcctaaaga

SEQ ID NO: 710395 - DNA, 25 bp, Artificial sequence
  Synthetic oligonucleotide
acgagagttacttttgctatattcc

SEQ ID NO: 710396 - DNA, 25 bp, Artificial sequence
  Synthetic oligonucleotide
acgagagttactattgctatattcc

SEQ ID NO: 710397 - DNA, 25 bp, Artificial sequence
  Synthetic oligonucleotide
caactaagcgtgtttgtgtgtatgt

SEQ ID NO: 710398 - DNA, 25 bp, Artificial sequence
  Synthetic oligonucleotide
agactgggtcttgtgtagggtattc

SEQ ID NO: 710399 - DNA, 25 bp, Artificial sequence
  Synthetic oligonucleotide
ccaagcactgtttggaattgctgat

SEQ ID NO: 710400 - DNA, 25 bp, Artificial sequence
  Synthetic oligonucleotide
ttgatggaagcctcgggcctaaaga

SEQ ID NO: 710401 - DNA, 25 bp, Artificial sequence
  Synthetic oligonucleotide
gaaggtagctcgcagagcctcctga

SEQ ID NO: 710402 - DNA, 25 bp, Artificial sequence
  Synthetic oligonucleotide
cagtctctgaactcaagattccatg

SEQ ID NO: 710403 - DNA, 25 bp, Artificial sequence
  Synthetic oligonucleotide
ggttctcagagctctactcagtcag

SEQ ID NO: 710404 - DNA, 25 bp, Artificial sequence
  Synthetic oligonucleotide
ggttctcagagcactactcagtcag

SEQ ID NO: 710405 - DNA, 25 bp, Artificial sequence
  Synthetic oligonucleotide
ggcctcgactcattctgttcttcag

SEQ ID NO: 710406 - DNA, 25 bp, Artificial sequence
  Synthetic oligonucleotide
ggcctcgactcaatctgttcttcag

SEQ ID NO: 710407 - DNA, 25 bp, Artificial sequence
  Synthetic oligonucleotide
cccttgtttactggtggttcagcct

SEQ ID NO: 710408 - DNA, 25 bp, Artificial sequence
  Synthetic oligonucleotide
cccttgtttactcgtggttcagcct

SEQ ID NO: 710409 - DNA, 25 bp, Artificial sequence
  Synthetic oligonucleotide
ccaagcactgttaggaattgctgat

SEQ ID NO: 710410 - DNA, 25 bp, Artificial sequence
  Synthetic oligonucleotide
tactattgcgagtcaaaaaagttgg

SEQ ID NO: 710411 - DNA, 25 bp, Artificial sequence
  Synthetic oligonucleotide
atgattagaaatggcatgcgtggga

SEQ ID NO: 710412 - DNA, 25 bp, Artificial sequence
  Synthetic oligonucleotide
tatttctacagcgaaagagaccgaa

SEQ ID NO: 710413 - DNA, 25 bp, Artificial sequence
  Synthetic oligonucleotide
tatttctacagccaaagagaccgaa

SEQ ID NO: 710414 - DNA, 25 bp, Artificial sequence
  Synthetic oligonucleotide
atgattagaaatcgcatgcgtggga

SEQ ID NO: 710415 - DNA, 25 bp, Artificial sequence
  Synthetic oligonucleotide
caactaagcgtgattgtgtgtatgt

SEQ ID NO: 710416 - DNA, 25 bp, Artificial sequence
  Synthetic oligonucleotide
ggctgagaactatccgagcaacggc

SEQ ID NO: 710417 - DNA, 25 bp, Artificial sequence
  Synthetic oligonucleotide
tcacatgatcagattcattatcctg

SEQ ID NO: 710418 - DNA, 25 bp, Artificial sequence
  Synthetic oligonucleotide
tattggaaagccaccggcaaagaca

SEQ ID NO: 710419 - DNA, 25 bp, Artificial sequence
  Synthetic oligonucleotide
tactattgcgagacaaaaaagttgg

SEQ ID NO: 710420 - DNA, 25 bp, Artificial sequence
  Synthetic oligonucleotide
tttaaaagctaaatgtttctaaaca

SEQ ID NO: 710421 - DNA, 25 bp, Artificial sequence
  Synthetic oligonucleotide
tttaaaagctaattgtttctaaaca

SEQ ID NO: 710422 - DNA, 25 bp, Artificial sequence
  Synthetic oligonucleotide
tcaataatatcctacaatttttttg

SEQ ID NO: 710423 - DNA, 25 bp, Artificial sequence
  Synthetic oligonucleotide
gattggaacaatacttcggggggaa

SEQ ID NO: 710424 - DNA, 25 bp, Artificial sequence
  Synthetic oligonucleotide
gctgacaagcgatgagattaacaga

SEQ ID NO: 710425 - DNA, 25 bp, Artificial sequence
  Synthetic oligonucleotide
tcacatgatcagtttcattatcctg

SEQ ID NO: 710426 - DNA, 25 bp, Artificial sequence
  Synthetic oligonucleotide
aaaccgattgggtcatgcacgaatt

SEQ ID NO: 710427 - DNA, 25 bp, Artificial sequence
  Synthetic oligonucleotide
cgagtaatatacgtgtttatgtgtt

SEQ ID NO: 710428 - DNA, 25 bp, Artificial sequence
  Synthetic oligonucleotide
gatcgtcagttattctcttcttagc

SEQ ID NO: 710429 - DNA, 25 bp, Artificial sequence
  Synthetic oligonucleotide
gatcgtcagttaatctcttcttagc

SEQ ID NO: 710430 - DNA, 25 bp, Artificial sequence
  Synthetic oligonucleotide
gctctccaaaggaatacacagttaa

SEQ ID NO: 710431 - DNA, 25 bp, Artificial sequence
  Synthetic oligonucleotide
gctctccaaaggtatacacagttaa

SEQ ID NO: 710432 - DNA, 25 bp, Artificial sequence
  Synthetic oligonucleotide
ggctgagaactaaccgagcaacggc

SEQ ID NO: 710433 - DNA, 25 bp, Artificial sequence
  Synthetic oligonucleotide
ggatctcatcatcctcccaatcatt

SEQ ID NO: 710434 - DNA, 25 bp, Artificial sequence
  Synthetic oligonucleotide
cgagtaatatacctgtttatgtgtt

SEQ ID NO: 710435 - DNA, 25 bp, Artificial sequence
  Synthetic oligonucleotide
aaaccgattgggacatgcacgaatt

SEQ ID NO: 710436 - DNA, 25 bp, Artificial sequence
  Synthetic oligonucleotide
tggttttctatctaggtcgagctcc

SEQ ID NO: 710437 - DNA, 25 bp, Artificial sequence
  Synthetic oligonucleotide
tggttttctatcaaggtcgagctcc

SEQ ID NO: 710438 - DNA, 25 bp, Artificial sequence
  Synthetic oligonucleotide
tctaagaaagggaaagctagttggg

SEQ ID NO: 710439 - DNA, 25 bp, Artificial sequence
  Synthetic oligonucleotide
tctaagaaagggtaagctagttggg

SEQ ID NO: 710440 - DNA, 25 bp, Artificial sequence
  Synthetic oligonucleotide
tattggaaagcctccggcaaagaca

SEQ ID NO: 710441 - DNA, 25 bp, Artificial sequence
  Synthetic oligonucleotide
ggatctcatcatgctcccaatcatt

SEQ ID NO: 710442 - DNA, 25 bp, Artificial sequence
  Synthetic oligonucleotide
aagtctgcaaaacctttgacgctgc

SEQ ID NO: 710443 - DNA, 25 bp, Artificial sequence
  Synthetic oligonucleotide
tcatcggccgatagagttcacgagg

SEQ ID NO: 710444 - DNA, 25 bp, Artificial sequence
  Synthetic oligonucleotide
aaggcacctctcctctacggctatg

SEQ ID NO: 710445 - DNA, 25 bp, Artificial sequence
  Synthetic oligonucleotide
tctccacagattgctagattcctgt

SEQ ID NO: 710446 - DNA, 25 bp, Artificial sequence
  Synthetic oligonucleotide
tctccacagattcctagattcctgt

SEQ ID NO: 710447 - DNA, 25 bp, Artificial sequence
  Synthetic oligonucleotide
gagaattgcaccatcaacatttggg

SEQ ID NO: 710448 - DNA, 25 bp, Artificial sequence
  Synthetic oligonucleotide
ggaaacgcacttcccctagagacaa

SEQ ID NO: 710449 - DNA, 25 bp, Artificial sequence
  Synthetic oligonucleotide
aagtctgcaaaagctttgacgctgc

SEQ ID NO: 710450 - DNA, 25 bp, Artificial sequence
  Synthetic oligonucleotide
gctgacaagcgaagagattaacaga

SEQ ID NO: 710451 - DNA, 25 bp, Artificial sequence
  Synthetic oligonucleotide
gggacacactcattagggtacctat

SEQ ID NO: 710452 - DNA, 25 bp, Artificial sequence
  Synthetic oligonucleotide
gggacacactcaatagggtacctat

SEQ ID NO: 710453 - DNA, 25 bp, Artificial sequence
  Synthetic oligonucleotide
aatgtttttgtttctctgttttgag

SEQ ID NO: 710454 - DNA, 25 bp, Artificial sequence
  Synthetic oligonucleotide
aatgtttttgttactctgttttgag

SEQ ID NO: 710455 - DNA, 25 bp, Artificial sequence
  Synthetic oligonucleotide
tagtcattttacatgattctagtag

SEQ ID NO: 710456 - DNA, 25 bp, Artificial sequence
  Synthetic oligonucleotide
ggaaacgcacttgccctagagacaa

SEQ ID NO: 710457 - DNA, 25 bp, Artificial sequence
  Synthetic oligonucleotide
gagaattgcaccttcaacatttggg

SEQ ID NO: 710458 - DNA, 25 bp, Artificial sequence
  Synthetic oligonucleotide
tcactcgatagcatttggaggccgg

SEQ ID NO: 710459 - DNA, 25 bp, Artificial sequence
  Synthetic oligonucleotide
tcaataatatccaacaatttttttg

SEQ ID NO: 710460 - DNA, 25 bp, Artificial sequence
  Synthetic oligonucleotide
tcggattatatgatgtttttaaaac

SEQ ID NO: 710461 - DNA, 25 bp, Artificial sequence
  Synthetic oligonucleotide
tccacctttcacaaaaaaaatcaag

SEQ ID NO: 710462 - DNA, 25 bp, Artificial sequence
  Synthetic oligonucleotide
tccacctttcactaaaaaaatcaag

SEQ ID NO: 710463 - DNA, 25 bp, Artificial sequence
  Synthetic oligonucleotide
cactgttggcatagtctggagtaga

SEQ ID NO: 710464 - DNA, 25 bp, Artificial sequence
  Synthetic oligonucleotide
aaggcacctctcgtctacggctatg

SEQ ID NO: 710465 - DNA, 25 bp, Artificial sequence
  Synthetic oligonucleotide
tcactcgatagcttttggaggccgg

SEQ ID NO: 710466 - DNA, 25 bp, Artificial sequence
  Synthetic oligonucleotide
tcatcggccgattgagttcacgagg

SEQ ID NO: 710467 - DNA, 25 bp, Artificial sequence
  Synthetic oligonucleotide
tttgaacatctcttcagatattttg

SEQ ID NO: 710468 - DNA, 25 bp, Artificial sequence
  Synthetic oligonucleotide
tttgaacatctcatcagatattttg

SEQ ID NO: 710469 - DNA, 25 bp, Artificial sequence
  Synthetic oligonucleotide
gggagagaactatcaaggcctgagc

SEQ ID NO: 710470 - DNA, 25 bp, Artificial sequence
  Synthetic oligonucleotide
gggagagaactaacaaggcctgagc

SEQ ID NO: 710471 - DNA, 25 bp, Artificial sequence
  Synthetic oligonucleotide
tcaggacgcttagcatctgtgggct

SEQ ID NO: 710472 - DNA, 25 bp, Artificial sequence
  Synthetic oligonucleotide
tcaggacgcttaccatctgtgggct

SEQ ID NO: 710473 - DNA, 25 bp, Artificial sequence
  Synthetic oligonucleotide
cactgttggcattgtctggagtaga

SEQ ID NO: 710474 - DNA, 25 bp, Artificial sequence
  Synthetic oligonucleotide
gtttcaaggtataaaggacctctag

SEQ ID NO: 710475 - DNA, 25 bp, Artificial sequence
  Synthetic oligonucleotide
tagtcattttacttgattctagtag

SEQ ID NO: 710476 - DNA, 25 bp, Artificial sequence
  Synthetic oligonucleotide
cctgaaacagaaattaaataaatca

SEQ ID NO: 710477 - DNA, 25 bp, Artificial sequence
  Synthetic oligonucleotide
gataggtgattgtatagccaaggca

SEQ ID NO: 710478 - DNA, 25 bp, Artificial sequence
  Synthetic oligonucleotide
gataggtgattgaatagccaaggca

SEQ ID NO: 710479 - DNA, 25 bp, Artificial sequence
  Synthetic oligonucleotide
gataatatgaaagatcactacctgt

SEQ ID NO: 710480 - DNA, 25 bp, Artificial sequence
  Synthetic oligonucleotide
tcggaacaaaaatcctcagaataac

SEQ ID NO: 710481 - DNA, 25 bp, Artificial sequence
  Synthetic oligonucleotide
gtttcaaggtattaaggacctctag

SEQ ID NO: 710482 - DNA, 25 bp, Artificial sequence
  Synthetic oligonucleotide
tcggaacaaaaaacctcagaataac

SEQ ID NO: 710483 - DNA, 25 bp, Artificial sequence
  Synthetic oligonucleotide
gctagacatacatatatttcatcgt

SEQ ID NO: 710484 - DNA, 25 bp, Artificial sequence
  Synthetic oligonucleotide
gctagacatacaaatatttcatcgt

SEQ ID NO: 710485 - DNA, 25 bp, Artificial sequence
  Synthetic oligonucleotide
cccacggtagatacatgtaaaatac

SEQ ID NO: 710486 - DNA, 25 bp, Artificial sequence
  Synthetic oligonucleotide
cccacggtagattcatgtaaaatac

SEQ ID NO: 710487 - DNA, 25 bp, Artificial sequence
  Synthetic oligonucleotide
tgtctgattgtacaaacatttcctc

SEQ ID NO: 710488 - DNA, 25 bp, Artificial sequence
  Synthetic oligonucleotide
tgtctgattgtagaaacatttcctc

SEQ ID NO: 710489 - DNA, 25 bp, Artificial sequence
  Synthetic oligonucleotide
gataatatgaaacatcactacctgt

SEQ ID NO: 710490 - DNA, 25 bp, Artificial sequence
  Synthetic oligonucleotide
tgcttactttcgaagatgttgccaa

SEQ ID NO: 710491 - DNA, 25 bp, Artificial sequence
  Synthetic oligonucleotide
tttaggaagatcacatgatattccg

SEQ ID NO: 710492 - DNA, 25 bp, Artificial sequence
  Synthetic oligonucleotide
tttaggaagatctcatgatattccg

SEQ ID NO: 710493 - DNA, 25 bp, Artificial sequence
  Synthetic oligonucleotide
actgcgctggctttcatttctcaag

SEQ ID NO: 710494 - DNA, 25 bp, Artificial sequence
  Synthetic oligonucleotide
actgcgctggctatcatttctcaag

SEQ ID NO: 710495 - DNA, 25 bp, Artificial sequence
  Synthetic oligonucleotide
tcaaaaagcactgcgactggcactt

SEQ ID NO: 710496 - DNA, 25 bp, Artificial sequence
  Synthetic oligonucleotide
cctgaaacagaatttaaataaatca

SEQ ID NO: 710497 - DNA, 25 bp, Artificial sequence
  Synthetic oligonucleotide
tgcttactttcgtagatgttgccaa

SEQ ID NO: 710498 - DNA, 25 bp, Artificial sequence
  Synthetic oligonucleotide
gattggaacaattcttcggggggaa

SEQ ID NO: 710499 - DNA, 25 bp, Artificial sequence
  Synthetic oligonucleotide
tatcatcaaataagcagaaactgtc

SEQ ID NO: 710500 - DNA, 25 bp, Artificial sequence
  Synthetic oligonucleotide
tatcatcaaatatgcagaaactgtc

SEQ ID NO: 710501 - DNA, 25 bp, Artificial sequence
  Synthetic oligonucleotide
gcacatagattcttcaacgcatagg

SEQ ID NO: 710502 - DNA, 25 bp, Artificial sequence
  Synthetic oligonucleotide
gcacatagattcatcaacgcatagg

SEQ ID NO: 710503 - DNA, 25 bp, Artificial sequence
  Synthetic oligonucleotide
cacggtaggaacatatattgaatcc

SEQ ID NO: 710504 - DNA, 25 bp, Artificial sequence
  Synthetic oligonucleotide
cacggtaggaacttatattgaatcc

SEQ ID NO: 710505 - DNA, 25 bp, Artificial sequence
  Synthetic oligonucleotide
tcaaaaagcactccgactggcactt

SEQ ID NO: 710506 - DNA, 25 bp, Artificial sequence
  Synthetic oligonucleotide
tggaaattaaattctaacatatgat

SEQ ID NO: 710507 - DNA, 25 bp, Artificial sequence
  Synthetic oligonucleotide
cagagagcataatgcgttatcaaga

SEQ ID NO: 710508 - DNA, 25 bp, Artificial sequence
  Synthetic oligonucleotide
cagagagcataaagcgttatcaaga

SEQ ID NO: 710509 - DNA, 25 bp, Artificial sequence
  Synthetic oligonucleotide
accaattgactataccattttaaca

SEQ ID NO: 710510 - DNA, 25 bp, Artificial sequence
  Synthetic oligonucleotide
accaattgactaaaccattttaaca

SEQ ID NO: 710511 - DNA, 25 bp, Artificial sequence
  Synthetic oligonucleotide
tcttcttatgttttgtaacatgcaa

SEQ ID NO: 710512 - DNA, 25 bp, Artificial sequence
  Synthetic oligonucleotide
tcttcttatgttatgtaacatgcaa

SEQ ID NO: 710513 - DNA, 25 bp, Artificial sequence
  Synthetic oligonucleotide
gatatatatcatagagaatgtagac

SEQ ID NO: 710514 - DNA, 25 bp, Artificial sequence
  Synthetic oligonucleotide
gatatatatcattgagaatgtagac

SEQ ID NO: 710515 - DNA, 25 bp, Artificial sequence
  Synthetic oligonucleotide
tattatctatgtctatcctcagcta

SEQ ID NO: 710516 - DNA, 25 bp, Artificial sequence
  Synthetic oligonucleotide
tattatctatgtgtatcctcagcta

SEQ ID NO: 710517 - DNA, 25 bp, Artificial sequence
  Synthetic oligonucleotide
ctaggcaaaaatttgtgagtctgtt

SEQ ID NO: 710518 - DNA, 25 bp, Artificial sequence
  Synthetic oligonucleotide
ctaggcaaaaatatgtgagtctgtt

SEQ ID NO: 710519 - DNA, 25 bp, Artificial sequence
  Synthetic oligonucleotide
tgttttggatagtgtacgtaattaa

SEQ ID NO: 710520 - DNA, 25 bp, Artificial sequence
  Synthetic oligonucleotide
gcaaagttgcctccgggattcagat

SEQ ID NO: 710521 - DNA, 25 bp, Artificial sequence
  Synthetic oligonucleotide
gacacacccaaaagatcccaataat

SEQ ID NO: 710522 - DNA, 25 bp, Artificial sequence
  Synthetic oligonucleotide
gcaaagttgcctgcgggattcagat

SEQ ID NO: 710523 - DNA, 25 bp, Artificial sequence
  Synthetic oligonucleotide
gagatgaaggaaagtagtataagca

SEQ ID NO: 710524 - DNA, 25 bp, Artificial sequence
  Synthetic oligonucleotide
gagatgaaggaatgtagtataagca

SEQ ID NO: 710525 - DNA, 25 bp, Artificial sequence
  Synthetic oligonucleotide
cctagaaaaaaaaaggatcaaatca

SEQ ID NO: 710526 - DNA, 25 bp, Artificial sequence
  Synthetic oligonucleotide
cctagaaaaaaataggatcaaatca

SEQ ID NO: 710527 - DNA, 25 bp, Artificial sequence
  Synthetic oligonucleotide
tgttttggatagagtacgtaattaa

SEQ ID NO: 710528 - DNA, 25 bp, Artificial sequence
  Synthetic oligonucleotide
tatctctcttttcctcttaaccatc

SEQ ID NO: 710529 - DNA, 25 bp, Artificial sequence
  Synthetic oligonucleotide
tggaaattaaatactaacatatgat

SEQ ID NO: 710530 - DNA, 25 bp, Artificial sequence
  Synthetic oligonucleotide
gacacacccaaatgatcccaataat

SEQ ID NO: 710531 - DNA, 25 bp, Artificial sequence
  Synthetic oligonucleotide
gcaattactacttaaaccaagggtc

SEQ ID NO: 710532 - DNA, 25 bp, Artificial sequence
  Synthetic oligonucleotide
gcaattactactaaaaccaagggtc

SEQ ID NO: 710533 - DNA, 25 bp, Artificial sequence
  Synthetic oligonucleotide
aaaaatgatataaatagaagttgac

SEQ ID NO: 710534 - DNA, 25 bp, Artificial sequence
  Synthetic oligonucleotide
aaaaatgatatatatagaagttgac

SEQ ID NO: 710535 - DNA, 25 bp, Artificial sequence
  Synthetic oligonucleotide
tggaagctagtaatacattctttaa

SEQ ID NO: 710536 - DNA, 25 bp, Artificial sequence
  Synthetic oligonucleotide
tatctctcttttgctcttaaccatc

SEQ ID NO: 710537 - DNA, 25 bp, Artificial sequence
  Synthetic oligonucleotide
ccaaaatccatgaataaaaatgacc

SEQ ID NO: 710538 - DNA, 25 bp, Artificial sequence
  Synthetic oligonucleotide
tgtttcatggcacccatgccactgt

SEQ ID NO: 710539 - DNA, 25 bp, Artificial sequence
  Synthetic oligonucleotide
gtctttgggccacgcgggcctttca

SEQ ID NO: 710540 - DNA, 25 bp, Artificial sequence
  Synthetic oligonucleotide
gtctttgggccaggcgggcctttca

SEQ ID NO: 710541 - DNA, 25 bp, Artificial sequence
  Synthetic oligonucleotide
aatcgtggaatttagtatagggcaa

SEQ ID NO: 710542 - DNA, 25 bp, Artificial sequence
  Synthetic oligonucleotide
aatcgtggaattaagtatagggcaa

SEQ ID NO: 710543 - DNA, 25 bp, Artificial sequence
  Synthetic oligonucleotide
gctgttcacatgtattattctcatt

SEQ ID NO: 710544 - DNA, 25 bp, Artificial sequence
  Synthetic oligonucleotide
taattagcaaaacttattcaccgat

SEQ ID NO: 710545 - DNA, 25 bp, Artificial sequence
  Synthetic oligonucleotide
tcggattatatgttgtttttaaaac

SEQ ID NO: 710546 - DNA, 25 bp, Artificial sequence
  Synthetic oligonucleotide
ccaaaatccatgtataaaaatgacc

SEQ ID NO: 710547 - DNA, 25 bp, Artificial sequence
  Synthetic oligonucleotide
tccacaattaatcggcaagtttgag

SEQ ID NO: 710548 - DNA, 25 bp, Artificial sequence
  Synthetic oligonucleotide
gttttatacacgaggcacagcaatg

SEQ ID NO: 710549 - DNA, 25 bp, Artificial sequence
  Synthetic oligonucleotide
gatctgaggtaatggcgaaaacgac

SEQ ID NO: 710550 - DNA, 25 bp, Artificial sequence
  Synthetic oligonucleotide
cgttatgagattgattaaacttttc

SEQ ID NO: 710551 - DNA, 25 bp, Artificial sequence
  Synthetic oligonucleotide
gtgtctatgactacgtcgacaaatg

SEQ ID NO: 710552 - DNA, 25 bp, Artificial sequence
  Synthetic oligonucleotide
taattagcaaaagttattcaccgat

SEQ ID NO: 710553 - DNA, 25 bp, Artificial sequence
  Synthetic oligonucleotide
gtttcatagtataaactaatcctac

SEQ ID NO: 710554 - DNA, 25 bp, Artificial sequence
  Synthetic oligonucleotide
tccacaattaatgggcaagtttgag

SEQ ID NO: 710555 - DNA, 25 bp, Artificial sequence
  Synthetic oligonucleotide
tggaagctagtattacattctttaa

SEQ ID NO: 710556 - DNA, 25 bp, Artificial sequence
  Synthetic oligonucleotide
tcaaaacattaaaatactaaaagaa

SEQ ID NO: 710557 - DNA, 25 bp, Artificial sequence
  Synthetic oligonucleotide
tcaaaacattaatatactaaaagaa

SEQ ID NO: 710558 - DNA, 25 bp, Artificial sequence
  Synthetic oligonucleotide
gaaataattaaaccattcagacacg

SEQ ID NO: 710559 - DNA, 25 bp, Artificial sequence
  Synthetic oligonucleotide
gctgttcacatgaattattctcatt

SEQ ID NO: 710560 - DNA, 25 bp, Artificial sequence
  Synthetic oligonucleotide
gtttcatagtattaactaatcctac

SEQ ID NO: 710561 - DNA, 25 bp, Artificial sequence
  Synthetic oligonucleotide
tgtttcatggcagccatgccactgt

SEQ ID NO: 710562 - DNA, 25 bp, Artificial sequence
  Synthetic oligonucleotide
cataaacaataatcagaaaaaactg

SEQ ID NO: 710563 - DNA, 25 bp, Artificial sequence
  Synthetic oligonucleotide
cataaacaataaacagaaaaaactg

SEQ ID NO: 710564 - DNA, 25 bp, Artificial sequence
  Synthetic oligonucleotide
cgtgtattttaaagacggagattac

SEQ ID NO: 710565 - DNA, 25 bp, Artificial sequence
  Synthetic oligonucleotide
cgtgtattttaatgacggagattac

SEQ ID NO: 710566 - DNA, 25 bp, Artificial sequence
  Synthetic oligonucleotide
gtgtctatgacttcgtcgacaaatg

SEQ ID NO: 710567 - DNA, 25 bp, Artificial sequence
  Synthetic oligonucleotide
gatctgaggtaaaggcgaaaacgac

SEQ ID NO: 710568 - DNA, 25 bp, Artificial sequence
  Synthetic oligonucleotide
gaaataattaaagcattcagacacg

SEQ ID NO: 710569 - DNA, 25 bp, Artificial sequence
  Synthetic oligonucleotide
aatgtaaaattcgttgggtttgatc

SEQ ID NO: 710570 - DNA, 25 bp, Artificial sequence
  Synthetic oligonucleotide
tatacgagaagttgacactcttggc

SEQ ID NO: 710571 - DNA, 25 bp, Artificial sequence
  Synthetic oligonucleotide
gacccttcaacttcataataattat

SEQ ID NO: 710572 - DNA, 25 bp, Artificial sequence
  Synthetic oligonucleotide
gggtcctgattacttttcaaatcaa

SEQ ID NO: 710573 - DNA, 25 bp, Artificial sequence
  Synthetic oligonucleotide
gggtcctgattagttttcaaatcaa

SEQ ID NO: 710574 - DNA, 25 bp, Artificial sequence
  Synthetic oligonucleotide
tcttattctctcctttgcttacgcc

SEQ ID NO: 710575 - DNA, 25 bp, Artificial sequence
  Synthetic oligonucleotide
tagtcgtcattcatttgatcaaaga

SEQ ID NO: 710576 - DNA, 25 bp, Artificial sequence
  Synthetic oligonucleotide
aatgtaaaattccttgggtttgatc

SEQ ID NO: 710577 - DNA, 25 bp, Artificial sequence
  Synthetic oligonucleotide
tagtcgtcattcttttgatcaaaga

SEQ ID NO: 710578 - DNA, 25 bp, Artificial sequence
  Synthetic oligonucleotide
ggtttatagcctttagagtgtgaca

SEQ ID NO: 710579 - DNA, 25 bp, Artificial sequence
  Synthetic oligonucleotide
ggtttatagcctatagagtgtgaca

SEQ ID NO: 710580 - DNA, 25 bp, Artificial sequence
  Synthetic oligonucleotide
taagagtaacgaggaaaaagtcaat

SEQ ID NO: 710581 - DNA, 25 bp, Artificial sequence
  Synthetic oligonucleotide
taagagtaacgacgaaaaagtcaat

SEQ ID NO: 710582 - DNA, 25 bp, Artificial sequence
  Synthetic oligonucleotide
tcaaccaaattcatgaaaaaaaagc

SEQ ID NO: 710583 - DNA, 25 bp, Artificial sequence
  Synthetic oligonucleotide
tcaaccaaattcttgaaaaaaaagc

SEQ ID NO: 710584 - DNA, 25 bp, Artificial sequence
  Synthetic oligonucleotide
tcttattctctcgtttgcttacgcc

SEQ ID NO: 710585 - DNA, 25 bp, Artificial sequence
  Synthetic oligonucleotide
gctttagttcaaaccctcacggatg

SEQ ID NO: 710586 - DNA, 25 bp, Artificial sequence
  Synthetic oligonucleotide
gttttatacacgtggcacagcaatg

SEQ ID NO: 710587 - DNA, 25 bp, Artificial sequence
  Synthetic oligonucleotide
gacgatgagcttgtctgcgattact

SEQ ID NO: 710588 - DNA, 25 bp, Artificial sequence
  Synthetic oligonucleotide
tgaacatggcatatcttataaagaa

SEQ ID NO: 710589 - DNA, 25 bp, Artificial sequence
  Synthetic oligonucleotide
cgttatgagattcattaaacttttc

SEQ ID NO: 710590 - DNA, 25 bp, Artificial sequence
  Synthetic oligonucleotide
tgaacatggcatttcttataaagaa

SEQ ID NO: 710591 - DNA, 25 bp, Artificial sequence
  Synthetic oligonucleotide
gacccttcaactacataataattat

SEQ ID NO: 710592 - DNA, 25 bp, Artificial sequence
  Synthetic oligonucleotide
gctttagttcaatccctcacggatg

SEQ ID NO: 710593 - DNA, 25 bp, Artificial sequence
  Synthetic oligonucleotide
tatactattaatcgtaaatcctaaa

SEQ ID NO: 710594 - DNA, 25 bp, Artificial sequence
  Synthetic oligonucleotide
tcgttgttttggatgaataatcaca

SEQ ID NO: 710595 - DNA, 25 bp, Artificial sequence
  Synthetic oligonucleotide
tcgttgttttggttgaataatcaca

SEQ ID NO: 710596 - DNA, 25 bp, Artificial sequence
  Synthetic oligonucleotide
tcaaaatcctacacatttacacgcg

SEQ ID NO: 710597 - DNA, 25 bp, Artificial sequence
  Synthetic oligonucleotide
tcaaaatcctactcatttacacgcg

SEQ ID NO: 710598 - DNA, 25 bp, Artificial sequence
  Synthetic oligonucleotide
tctttatttcaatcaaaattccaca

SEQ ID NO: 710599 - DNA, 25 bp, Artificial sequence
  Synthetic oligonucleotide
tctttatttcaaacaaaattccaca

SEQ ID NO: 710600 - DNA, 25 bp, Artificial sequence
  Synthetic oligonucleotide
tatactattaatggtaaatcctaaa

SEQ ID NO: 710601 - DNA, 25 bp, Artificial sequence
  Synthetic oligonucleotide
gggacatcccaagtacgttttcatt

SEQ ID NO: 710602 - DNA, 25 bp, Artificial sequence
  Synthetic oligonucleotide
tctagaaacaaaactttagaagtta

SEQ ID NO: 710603 - DNA, 25 bp, Artificial sequence
  Synthetic oligonucleotide
tctagaaacaaatctttagaagtta

SEQ ID NO: 710604 - DNA, 25 bp, Artificial sequence
  Synthetic oligonucleotide
tatgtcatgatcatctttcgtgttc

SEQ ID NO: 710605 - DNA, 25 bp, Artificial sequence
  Synthetic oligonucleotide
tatgtcatgatcttctttcgtgttc

SEQ ID NO: 710606 - DNA, 25 bp, Artificial sequence
  Synthetic oligonucleotide
gttttactttgaaatggttggtcca

SEQ ID NO: 710607 - DNA, 25 bp, Artificial sequence
  Synthetic oligonucleotide
gttttactttgatatggttggtcca

SEQ ID NO: 710608 - DNA, 25 bp, Artificial sequence
  Synthetic oligonucleotide
catatctactaatacaaaagttgga

SEQ ID NO: 710609 - DNA, 25 bp, Artificial sequence
  Synthetic oligonucleotide
gacaacagtatcattattgatccat

SEQ ID NO: 710610 - DNA, 25 bp, Artificial sequence
  Synthetic oligonucleotide
gggacatcccaactacgttttcatt

SEQ ID NO: 710611 - DNA, 25 bp, Artificial sequence
  Synthetic oligonucleotide
tgatccaagtcgatctcaacaagtg

SEQ ID NO: 710612 - DNA, 25 bp, Artificial sequence
  Synthetic oligonucleotide
gacgatgagcttctctgcgattact

SEQ ID NO: 710613 - DNA, 25 bp, Artificial sequence
  Synthetic oligonucleotide
tatacgagaagtagacactcttggc

SEQ ID NO: 710614 - DNA, 25 bp, Artificial sequence
  Synthetic oligonucleotide
tgatccaagtcgttctcaacaagtg

SEQ ID NO: 710615 - DNA, 25 bp, Artificial sequence
  Synthetic oligonucleotide
gatcgcttcacaataatcatcgacc

SEQ ID NO: 710616 - DNA, 25 bp, Artificial sequence
  Synthetic oligonucleotide
gatcgcttcacattaatcatcgacc

SEQ ID NO: 710617 - DNA, 25 bp, Artificial sequence
  Synthetic oligonucleotide
gacaacagtatctttattgatccat

SEQ ID NO: 710618 - DNA, 25 bp, Artificial sequence
  Synthetic oligonucleotide
tacacatatatacatactttataag

SEQ ID NO: 710619 - DNA, 25 bp, Artificial sequence
  Synthetic oligonucleotide
gatcagatgatttcaatttataaga

SEQ ID NO: 710620 - DNA, 25 bp, Artificial sequence
  Synthetic oligonucleotide
cgtaataatatgtaattaattcgag

SEQ ID NO: 710621 - DNA, 25 bp, Artificial sequence
  Synthetic oligonucleotide
gatcagatgattacaatttataaga

SEQ ID NO: 710622 - DNA, 25 bp, Artificial sequence
  Synthetic oligonucleotide
tacacatatatagatactttataag

SEQ ID NO: 710623 - DNA, 25 bp, Artificial sequence
  Synthetic oligonucleotide
cgtaataatatgaaattaattcgag

SEQ ID NO: 710624 - DNA, 25 bp, Artificial sequence
  Synthetic oligonucleotide
cgatttatataaagttatggattgg

SEQ ID NO: 710625 - DNA, 25 bp, Artificial sequence
  Synthetic oligonucleotide
cgatttatataatgttatggattgg

SEQ ID NO: 710626 - DNA, 25 bp, Artificial sequence
  Synthetic oligonucleotide
caaaaaccttatacaaacatataac

SEQ ID NO: 710627 - DNA, 25 bp, Artificial sequence
  Synthetic oligonucleotide
gcatccagtttaaacaatgtagtct

SEQ ID NO: 710628 - DNA, 25 bp, Artificial sequence
  Synthetic oligonucleotide
gcatccagtttatacaatgtagtct

SEQ ID NO: 710629 - DNA, 25 bp, Artificial sequence
  Synthetic oligonucleotide
aactttaagatgttgatgtcacctc

SEQ ID NO: 710630 - DNA, 25 bp, Artificial sequence
  Synthetic oligonucleotide
catatctactaaaacaaaagttgga

SEQ ID NO: 710631 - DNA, 25 bp, Artificial sequence
  Synthetic oligonucleotide
caaaaaccttattcaaacatataac

SEQ ID NO: 710632 - DNA, 25 bp, Artificial sequence
  Synthetic oligonucleotide
aactttaagatgatgatgtcacctc

SEQ ID NO: 710633 - DNA, 25 bp, Artificial sequence
  Synthetic oligonucleotide
ggaagttgcttcgaaaacgagaatc

SEQ ID NO: 710634 - DNA, 25 bp, Artificial sequence
  Synthetic oligonucleotide
tgatggatttctagttggtggtgcc

SEQ ID NO: 710635 - DNA, 25 bp, Artificial sequence
  Synthetic oligonucleotide
gaggcaacagtgcagagcttgccaa

SEQ ID NO: 710636 - DNA, 25 bp, Artificial sequence
  Synthetic oligonucleotide
gaggcaacagtggagagcttgccaa

SEQ ID NO: 710637 - DNA, 25 bp, Artificial sequence
  Synthetic oligonucleotide
gattattgccttctcaattgccagg

SEQ ID NO: 710638 - DNA, 25 bp, Artificial sequence
  Synthetic oligonucleotide
gattattgccttgtcaattgccagg

SEQ ID NO: 710639 - DNA, 25 bp, Artificial sequence
  Synthetic oligonucleotide
tagctgtccgcgcttggctaaagaa

SEQ ID NO: 710640 - DNA, 25 bp, Artificial sequence
  Synthetic oligonucleotide
gcgttagattagttatctgtcgcaa

SEQ ID NO: 710641 - DNA, 25 bp, Artificial sequence
  Synthetic oligonucleotide
ggaagttgcttccaaaacgagaatc

SEQ ID NO: 710642 - DNA, 25 bp, Artificial sequence
  Synthetic oligonucleotide
ctctagggtcctgagtttgcaacca

SEQ ID NO: 710643 - DNA, 25 bp, Artificial sequence
  Synthetic oligonucleotide
tagctgtccgcggttggctaaagaa

SEQ ID NO: 710644 - DNA, 25 bp, Artificial sequence
  Synthetic oligonucleotide
taaagttgcatcacctcagcaagca

SEQ ID NO: 710645 - DNA, 25 bp, Artificial sequence
  Synthetic oligonucleotide
gcgttagattagatatctgtcgcaa

SEQ ID NO: 710646 - DNA, 25 bp, Artificial sequence
  Synthetic oligonucleotide
gtcacgtcgaagtaagttgctgctt

SEQ ID NO: 710647 - DNA, 25 bp, Artificial sequence
  Synthetic oligonucleotide
gttgttgtgttcatacatcttcttc

SEQ ID NO: 710648 - DNA, 25 bp, Artificial sequence
  Synthetic oligonucleotide
gttgttgtgttcttacatcttcttc

SEQ ID NO: 710649 - DNA, 25 bp, Artificial sequence
  Synthetic oligonucleotide
aaagctagaagagagggaagcaggc

SEQ ID NO: 710650 - DNA, 25 bp, Artificial sequence
  Synthetic oligonucleotide
gatgagaaataaaagggaggttagc

SEQ ID NO: 710651 - DNA, 25 bp, Artificial sequence
  Synthetic oligonucleotide
tcagtaacggaattcgctagtctcc

SEQ ID NO: 710652 - DNA, 25 bp, Artificial sequence
  Synthetic oligonucleotide
tagaagtaaagctgctcacactcac

SEQ ID NO: 710653 - DNA, 25 bp, Artificial sequence
  Synthetic oligonucleotide
gtcacgtcgaagaaagttgctgctt

SEQ ID NO: 710654 - DNA, 25 bp, Artificial sequence
  Synthetic oligonucleotide
tgatggatttcttgttggtggtgcc

SEQ ID NO: 710655 - DNA, 25 bp, Artificial sequence
  Synthetic oligonucleotide
ctctagggtcctcagtttgcaacca

SEQ ID NO: 710656 - DNA, 25 bp, Artificial sequence
  Synthetic oligonucleotide
taataatggaaaacagaaagaaaaa

SEQ ID NO: 710657 - DNA, 25 bp, Artificial sequence
  Synthetic oligonucleotide
tagaagtaaagcagctcacactcac

SEQ ID NO: 710658 - DNA, 25 bp, Artificial sequence
  Synthetic oligonucleotide
gatgagaaataatagggaggttagc

SEQ ID NO: 710659 - DNA, 25 bp, Artificial sequence
  Synthetic oligonucleotide
taaagtttagacgtttatggatatg

SEQ ID NO: 710660 - DNA, 25 bp, Artificial sequence
  Synthetic oligonucleotide
taaagtttagacctttatggatatg

SEQ ID NO: 710661 - DNA, 25 bp, Artificial sequence
  Synthetic oligonucleotide
tcagtaacggaaatcgctagtctcc

SEQ ID NO: 710662 - DNA, 25 bp, Artificial sequence
  Synthetic oligonucleotide
tgagtgagggtcatggagtgatagc

SEQ ID NO: 710663 - DNA, 25 bp, Artificial sequence
  Synthetic oligonucleotide
gtgtaatatatgtaccttgtctgaa

SEQ ID NO: 710664 - DNA, 25 bp, Artificial sequence
  Synthetic oligonucleotide
gcccgttttaccatacagcgtggaa

SEQ ID NO: 710665 - DNA, 25 bp, Artificial sequence
  Synthetic oligonucleotide
aaaccctaaatttcctcaagactga

SEQ ID NO: 710666 - DNA, 25 bp, Artificial sequence
  Synthetic oligonucleotide
taataatggaaatcagaaagaaaaa

SEQ ID NO: 710667 - DNA, 25 bp, Artificial sequence
  Synthetic oligonucleotide
ccttggctgcaagtgggtcattctt

SEQ ID NO: 710668 - DNA, 25 bp, Artificial sequence
  Synthetic oligonucleotide
ccttggctgcaactgggtcattctt

SEQ ID NO: 710669 - DNA, 25 bp, Artificial sequence
  Synthetic oligonucleotide
gaacggagacatgtcatcggagaaa

SEQ ID NO: 710670 - DNA, 25 bp, Artificial sequence
  Synthetic oligonucleotide
gaacggagacatctcatcggagaaa

SEQ ID NO: 710671 - DNA, 25 bp, Artificial sequence
  Synthetic oligonucleotide
aaataaaacactatataagcactgg

SEQ ID NO: 710672 - DNA, 25 bp, Artificial sequence
  Synthetic oligonucleotide
aaataaaacactttataagcactgg

SEQ ID NO: 710673 - DNA, 25 bp, Artificial sequence
  Synthetic oligonucleotide
aagggttgtgaaaacatatttgctc

SEQ ID NO: 710674 - DNA, 25 bp, Artificial sequence
  Synthetic oligonucleotide
aagggttgtgaatacatatttgctc

SEQ ID NO: 710675 - DNA, 25 bp, Artificial sequence
  Synthetic oligonucleotide
tttgcttcgcgctactgaaggcgtt

SEQ ID NO: 710676 - DNA, 25 bp, Artificial sequence
  Synthetic oligonucleotide
aaccatagtttatcgggaagaaagc

SEQ ID NO: 710677 - DNA, 25 bp, Artificial sequence
  Synthetic oligonucleotide
taaagttgcatctcctcagcaagca

SEQ ID NO: 710678 - DNA, 25 bp, Artificial sequence
  Synthetic oligonucleotide
tgagtgagggtcttggagtgatagc

SEQ ID NO: 710679 - DNA, 25 bp, Artificial sequence
  Synthetic oligonucleotide
aaagctagaagacagggaagcaggc

SEQ ID NO: 710680 - DNA, 25 bp, Artificial sequence
  Synthetic oligonucleotide
gcccgttttaccttacagcgtggaa

SEQ ID NO: 710681 - DNA, 25 bp, Artificial sequence
  Synthetic oligonucleotide
tttgcttcgcgcaactgaaggcgtt

SEQ ID NO: 710682 - DNA, 25 bp, Artificial sequence
  Synthetic oligonucleotide
tgtattttctttgattaccctctcc

SEQ ID NO: 710683 - DNA, 25 bp, Artificial sequence
  Synthetic oligonucleotide
tgtattttctttcattaccctctcc

SEQ ID NO: 710684 - DNA, 25 bp, Artificial sequence
  Synthetic oligonucleotide
tgtctgaactcatttaacagcagta

SEQ ID NO: 710685 - DNA, 25 bp, Artificial sequence
  Synthetic oligonucleotide
tgtctgaactcaattaacagcagta

SEQ ID NO: 710686 - DNA, 25 bp, Artificial sequence
  Synthetic oligonucleotide
ttttcagatgctgtgcctagctggg

SEQ ID NO: 710687 - DNA, 25 bp, Artificial sequence
  Synthetic oligonucleotide
ttttcagatgctctgcctagctggg

SEQ ID NO: 710688 - DNA, 25 bp, Artificial sequence
  Synthetic oligonucleotide
tgttgcatacgagcctgtatgggca

SEQ ID NO: 710689 - DNA, 25 bp, Artificial sequence
  Synthetic oligonucleotide
tgttgcatacgaccctgtatgggca

SEQ ID NO: 710690 - DNA, 25 bp, Artificial sequence
  Synthetic oligonucleotide
aaccatagtttaacgggaagaaagc

SEQ ID NO: 710691 - DNA, 25 bp, Artificial sequence
  Synthetic oligonucleotide
tttggttttctggtaaaagaggaga

SEQ ID NO: 710692 - DNA, 25 bp, Artificial sequence
  Synthetic oligonucleotide
ggaaactctttcaaaacgccgaagc

SEQ ID NO: 710693 - DNA, 25 bp, Artificial sequence
  Synthetic oligonucleotide
ggaaactctttctaaacgccgaagc

SEQ ID NO: 710694 - DNA, 25 bp, Artificial sequence
  Synthetic oligonucleotide
caactggaaggaccaaaacagctct

SEQ ID NO: 710695 - DNA, 25 bp, Artificial sequence
  Synthetic oligonucleotide
caactggaaggagcaaaacagctct

SEQ ID NO: 710696 - DNA, 25 bp, Artificial sequence
  Synthetic oligonucleotide
tcttgttctttgttttcccagacga

SEQ ID NO: 710697 - DNA, 25 bp, Artificial sequence
  Synthetic oligonucleotide
tcttgttctttgatttcccagacga

SEQ ID NO: 710698 - DNA, 25 bp, Artificial sequence
  Synthetic oligonucleotide
ggccaaagtagtaccctgaagataa

SEQ ID NO: 710699 - DNA, 25 bp, Artificial sequence
  Synthetic oligonucleotide
ggccaaagtagttccctgaagataa

SEQ ID NO: 710700 - DNA, 25 bp, Artificial sequence
  Synthetic oligonucleotide
tcaatcagattaatcaatcacactg

SEQ ID NO: 710701 - DNA, 25 bp, Artificial sequence
  Synthetic oligonucleotide
tcaatcagattattcaatcacactg

SEQ ID NO: 710702 - DNA, 25 bp, Artificial sequence
  Synthetic oligonucleotide
ggaagagtacaaagagagaagcgaa

SEQ ID NO: 710703 - DNA, 25 bp, Artificial sequence
  Synthetic oligonucleotide
ggaagagtacaatgagagaagcgaa

SEQ ID NO: 710704 - DNA, 25 bp, Artificial sequence
  Synthetic oligonucleotide
tctaaagagtacaatgctggaacaa

SEQ ID NO: 710705 - DNA, 25 bp, Artificial sequence
  Synthetic oligonucleotide
tcatcgagtgatccctcggtagacc

SEQ ID NO: 710706 - DNA, 25 bp, Artificial sequence
  Synthetic oligonucleotide
catgaggagaatatttatgacaaga

SEQ ID NO: 710707 - DNA, 25 bp, Artificial sequence
  Synthetic oligonucleotide
tttggttttctgctaaaagaggaga

SEQ ID NO: 710708 - DNA, 25 bp, Artificial sequence
  Synthetic oligonucleotide
tgtttaactgcagaaatgatgaacc

SEQ ID NO: 710709 - DNA, 25 bp, Artificial sequence
  Synthetic oligonucleotide
tgtttaactgcacaaatgatgaacc

SEQ ID NO: 710710 - DNA, 25 bp, Artificial sequence
  Synthetic oligonucleotide
ccaatggtttacgttggtgagacgc

SEQ ID NO: 710711 - DNA, 25 bp, Artificial sequence
  Synthetic oligonucleotide
ccaatggtttaccttggtgagacgc

SEQ ID NO: 710712 - DNA, 25 bp, Artificial sequence
  Synthetic oligonucleotide
tgtatgcccatacaccgaggaggag

SEQ ID NO: 710713 - DNA, 25 bp, Artificial sequence
  Synthetic oligonucleotide
tgtatgcccatagaccgaggaggag

SEQ ID NO: 710714 - DNA, 25 bp, Artificial sequence
  Synthetic oligonucleotide
tccgagtgttaataggaaaacagat

SEQ ID NO: 710715 - DNA, 25 bp, Artificial sequence
  Synthetic oligonucleotide
tccgagtgttaaaaggaaaacagat

SEQ ID NO: 710716 - DNA, 25 bp, Artificial sequence
  Synthetic oligonucleotide
gagaagacctccagattcaactacc

SEQ ID NO: 710717 - DNA, 25 bp, Artificial sequence
  Synthetic oligonucleotide
gtgtaatatatgaaccttgtctgaa

SEQ ID NO: 710718 - DNA, 25 bp, Artificial sequence
  Synthetic oligonucleotide
tatgttggcatgagttttagaacgg

SEQ ID NO: 710719 - DNA, 25 bp, Artificial sequence
  Synthetic oligonucleotide
gagaagacctcctgattcaactacc

SEQ ID NO: 710720 - DNA, 25 bp, Artificial sequence
  Synthetic oligonucleotide
tcatcgagtgatgcctcggtagacc

SEQ ID NO: 710721 - DNA, 25 bp, Artificial sequence
  Synthetic oligonucleotide
tctcctgaacaacacaagcccaagg

SEQ ID NO: 710722 - DNA, 25 bp, Artificial sequence
  Synthetic oligonucleotide
tgagctctggttagacagagagaga

SEQ ID NO: 710723 - DNA, 25 bp, Artificial sequence
  Synthetic oligonucleotide
taaagatctttgaaactaagctgtg

SEQ ID NO: 710724 - DNA, 25 bp, Artificial sequence
  Synthetic oligonucleotide
taaagatctttgtaactaagctgtg

SEQ ID NO: 710725 - DNA, 25 bp, Artificial sequence
  Synthetic oligonucleotide
caatttgagtaaccttgactcacga

SEQ ID NO: 710726 - DNA, 25 bp, Artificial sequence
  Synthetic oligonucleotide
caatttgagtaagcttgactcacga

SEQ ID NO: 710727 - DNA, 25 bp, Artificial sequence
  Synthetic oligonucleotide
taatctaaatcaaatctcaagccac

SEQ ID NO: 710728 - DNA, 25 bp, Artificial sequence
  Synthetic oligonucleotide
taatctaaatcatatctcaagccac

SEQ ID NO: 710729 - DNA, 25 bp, Artificial sequence
  Synthetic oligonucleotide
gctcgatagtcctgacagagagata

SEQ ID NO: 710730 - DNA, 25 bp, Artificial sequence
  Synthetic oligonucleotide
gctcgatagtccagacagagagata

SEQ ID NO: 710731 - DNA, 25 bp, Artificial sequence
  Synthetic oligonucleotide
gattctcaaacataccacactccaa

SEQ ID NO: 710732 - DNA, 25 bp, Artificial sequence
  Synthetic oligonucleotide
gattctcaaacaaaccacactccaa

SEQ ID NO: 710733 - DNA, 25 bp, Artificial sequence
  Synthetic oligonucleotide
tagtgcattcatggcttagataagt

SEQ ID NO: 710734 - DNA, 25 bp, Artificial sequence
  Synthetic oligonucleotide
tagtgcattcatcgcttagataagt

SEQ ID NO: 710735 - DNA, 25 bp, Artificial sequence
  Synthetic oligonucleotide
aaaccctaaattacctcaagactga

SEQ ID NO: 710736 - DNA, 25 bp, Artificial sequence
  Synthetic oligonucleotide
gttttgatgaactaaaacattagta

SEQ ID NO: 710737 - DNA, 25 bp, Artificial sequence
  Synthetic oligonucleotide
tgagctctggtttgacagagagaga

SEQ ID NO: 710738 - DNA, 25 bp, Artificial sequence
  Synthetic oligonucleotide
catgaggagaatttttatgacaaga

SEQ ID NO: 710739 - DNA, 25 bp, Artificial sequence
  Synthetic oligonucleotide
cgaaaaacagatctaaaccatttat

SEQ ID NO: 710740 - DNA, 25 bp, Artificial sequence
  Synthetic oligonucleotide
cgaaaaacagatgtaaaccatttat

SEQ ID NO: 710741 - DNA, 25 bp, Artificial sequence
  Synthetic oligonucleotide
tctactgctaaaaaagttactgatg

SEQ ID NO: 710742 - DNA, 25 bp, Artificial sequence
  Synthetic oligonucleotide
gaatcacaactcagtgtaagtcgca

SEQ ID NO: 710743 - DNA, 25 bp, Artificial sequence
  Synthetic oligonucleotide
gttttgatgaacaaaaacattagta

SEQ ID NO: 710744 - DNA, 25 bp, Artificial sequence
  Synthetic oligonucleotide
gaatcacaactctgtgtaagtcgca

SEQ ID NO: 710745 - DNA, 25 bp, Artificial sequence
  Synthetic oligonucleotide
ctatttggagagaccaatactttcc

SEQ ID NO: 710746 - DNA, 25 bp, Artificial sequence
  Synthetic oligonucleotide
ctatttggagagtccaatactttcc

SEQ ID NO: 710747 - DNA, 25 bp, Artificial sequence
  Synthetic oligonucleotide
tctcttgtacttcctcctgatcata

SEQ ID NO: 710748 - DNA, 25 bp, Artificial sequence
  Synthetic oligonucleotide
tctcttgtacttgctcctgatcata

SEQ ID NO: 710749 - DNA, 25 bp, Artificial sequence
  Synthetic oligonucleotide
tctcctgaacaagacaagcccaagg

SEQ ID NO: 710750 - DNA, 25 bp, Artificial sequence
  Synthetic oligonucleotide
tctaaagagtactatgctggaacaa

SEQ ID NO: 710751 - DNA, 25 bp, Artificial sequence
  Synthetic oligonucleotide
tctactgctaaataagttactgatg

SEQ ID NO: 710752 - DNA, 25 bp, Artificial sequence
  Synthetic oligonucleotide
actacagcgcgtggcaacgagacgt

SEQ ID NO: 710753 - DNA, 25 bp, Artificial sequence
  Synthetic oligonucleotide
caggctgaacagctggatacttagt

SEQ ID NO: 710754 - DNA, 25 bp, Artificial sequence
  Synthetic oligonucleotide
caggctgaacaggtggatacttagt

SEQ ID NO: 710755 - DNA, 25 bp, Artificial sequence
  Synthetic oligonucleotide
gccttctccggcaagtatagtgact

SEQ ID NO: 710756 - DNA, 25 bp, Artificial sequence
  Synthetic oligonucleotide
gccttctccggctagtatagtgact

SEQ ID NO: 710757 - DNA, 25 bp, Artificial sequence
  Synthetic oligonucleotide
tgaccacagaaatatttatacctac

SEQ ID NO: 710758 - DNA, 25 bp, Artificial sequence
  Synthetic oligonucleotide
tgaccacagaaaaatttatacctac

SEQ ID NO: 710759 - DNA, 25 bp, Artificial sequence
  Synthetic oligonucleotide
taggaatactttaaccaaattatta

SEQ ID NO: 710760 - DNA, 25 bp, Artificial sequence
  Synthetic oligonucleotide
taggaatacttttaccaaattatta

SEQ ID NO: 710761 - DNA, 25 bp, Artificial sequence
  Synthetic oligonucleotide
caatcttagaaaatagtagtactaa

SEQ ID NO: 710762 - DNA, 25 bp, Artificial sequence
  Synthetic oligonucleotide
caatcttagaaattagtagtactaa

SEQ ID NO: 710763 - DNA, 25 bp, Artificial sequence
  Synthetic oligonucleotide
cgtctcgacggatacagtgttaatg

SEQ ID NO: 710764 - DNA, 25 bp, Artificial sequence
  Synthetic oligonucleotide
cgtctcgacggaaacagtgttaatg

SEQ ID NO: 710765 - DNA, 25 bp, Artificial sequence
  Synthetic oligonucleotide
gccaaacccgacgacatggcagcta

SEQ ID NO: 710766 - DNA, 25 bp, Artificial sequence
  Synthetic oligonucleotide
catcgaccattttgggcacctgatc

SEQ ID NO: 710767 - DNA, 25 bp, Artificial sequence
  Synthetic oligonucleotide
tggtttaaaggatggattctcaagc

SEQ ID NO: 710768 - DNA, 25 bp, Artificial sequence
  Synthetic oligonucleotide
actacagcgcgtcgcaacgagacgt

SEQ ID NO: 710769 - DNA, 25 bp, Artificial sequence
  Synthetic oligonucleotide
gagaacgaggctagatgataccatc

SEQ ID NO: 710770 - DNA, 25 bp, Artificial sequence
  Synthetic oligonucleotide
gagaacgaggcttgatgataccatc

SEQ ID NO: 710771 - DNA, 25 bp, Artificial sequence
  Synthetic oligonucleotide
gaaagacaaaataaccctcgagagt

SEQ ID NO: 710772 - DNA, 25 bp, Artificial sequence
  Synthetic oligonucleotide
gaaagacaaaattaccctcgagagt

SEQ ID NO: 710773 - DNA, 25 bp, Artificial sequence
  Synthetic oligonucleotide
agagcacaaccagcaaccctctcat

SEQ ID NO: 710774 - DNA, 25 bp, Artificial sequence
  Synthetic oligonucleotide
agagcacaaccaccaaccctctcat

SEQ ID NO: 710775 - DNA, 25 bp, Artificial sequence
  Synthetic oligonucleotide
tctgctaccttatgctgagagagtc

SEQ ID NO: 710776 - DNA, 25 bp, Artificial sequence
  Synthetic oligonucleotide
tctgctaccttaagctgagagagtc

SEQ ID NO: 710777 - DNA, 25 bp, Artificial sequence
  Synthetic oligonucleotide
gtctctatctctgctctttgccttt

SEQ ID NO: 710778 - DNA, 25 bp, Artificial sequence
  Synthetic oligonucleotide
gtctctatctctcctctttgccttt

SEQ ID NO: 710779 - DNA, 25 bp, Artificial sequence
  Synthetic oligonucleotide
gccaaacccgaccacatggcagcta

SEQ ID NO: 710780 - DNA, 25 bp, Artificial sequence
  Synthetic oligonucleotide
catcgaccatttagggcacctgatc

SEQ ID NO: 710781 - DNA, 25 bp, Artificial sequence
  Synthetic oligonucleotide
tcttgttgcttgacaattggaatga

SEQ ID NO: 710782 - DNA, 25 bp, Artificial sequence
  Synthetic oligonucleotide
gattggtagcttgttatcaaaacag

SEQ ID NO: 710783 - DNA, 25 bp, Artificial sequence
  Synthetic oligonucleotide
gattggtagcttcttatcaaaacag

SEQ ID NO: 710784 - DNA, 25 bp, Artificial sequence
  Synthetic oligonucleotide
taccgtttaaaagatccaatgaaac

SEQ ID NO: 710785 - DNA, 25 bp, Artificial sequence
  Synthetic oligonucleotide
taccgtttaaaacatccaatgaaac

SEQ ID NO: 710786 - DNA, 25 bp, Artificial sequence
  Synthetic oligonucleotide
tgaaatcaatgtttggacaaaaagg

SEQ ID NO: 710787 - DNA, 25 bp, Artificial sequence
  Synthetic oligonucleotide
tgaaatcaatgtatggacaaaaagg

SEQ ID NO: 710788 - DNA, 25 bp, Artificial sequence
  Synthetic oligonucleotide
tggatcattctctcccaaactatgg

SEQ ID NO: 710789 - DNA, 25 bp, Artificial sequence
  Synthetic oligonucleotide
tggatcattctcacccaaactatgg

SEQ ID NO: 710790 - DNA, 25 bp, Artificial sequence
  Synthetic oligonucleotide
gagccactttgcgtgagctttcaaa

SEQ ID NO: 710791 - DNA, 25 bp, Artificial sequence
  Synthetic oligonucleotide
gagccactttgcctgagctttcaaa

SEQ ID NO: 710792 - DNA, 25 bp, Artificial sequence
  Synthetic oligonucleotide
taataaatgaataacaaagatctct

SEQ ID NO: 710793 - DNA, 25 bp, Artificial sequence
  Synthetic oligonucleotide
taataaatgaattacaaagatctct

SEQ ID NO: 710794 - DNA, 25 bp, Artificial sequence
  Synthetic oligonucleotide
gcttgggttaattagagacacatgc

SEQ ID NO: 710795 - DNA, 25 bp, Artificial sequence
  Synthetic oligonucleotide
gagtagtattactattaaccattag

SEQ ID NO: 710796 - DNA, 25 bp, Artificial sequence
  Synthetic oligonucleotide
gcttgggttaataagagacacatgc

SEQ ID NO: 710797 - DNA, 25 bp, Artificial sequence
  Synthetic oligonucleotide
gccaagcttatcaccgatctcaaca

SEQ ID NO: 710798 - DNA, 25 bp, Artificial sequence
  Synthetic oligonucleotide
gaaccaaactgttagataaaatgtc

SEQ ID NO: 710799 - DNA, 25 bp, Artificial sequence
  Synthetic oligonucleotide
gcgttgcaactattccctccttatg

SEQ ID NO: 710800 - DNA, 25 bp, Artificial sequence
  Synthetic oligonucleotide
agttcacagaaaagtggccatacgg

SEQ ID NO: 710801 - DNA, 25 bp, Artificial sequence
  Synthetic oligonucleotide
agttcacagaaatgtggccatacgg

SEQ ID NO: 710802 - DNA, 25 bp, Artificial sequence
  Synthetic oligonucleotide
gaaagctgaccggaaagtgatcact

SEQ ID NO: 710803 - DNA, 25 bp, Artificial sequence
  Synthetic oligonucleotide
gaaagctgaccgcaaagtgatcact

SEQ ID NO: 710804 - DNA, 25 bp, Artificial sequence
  Synthetic oligonucleotide
aagttggaggaactgggctgcgacg

SEQ ID NO: 710805 - DNA, 25 bp, Artificial sequence
  Synthetic oligonucleotide
aagttggaggaagtgggctgcgacg

SEQ ID NO: 710806 - DNA, 25 bp, Artificial sequence
  Synthetic oligonucleotide
accctataggggtaagagtggactg

SEQ ID NO: 710807 - DNA, 25 bp, Artificial sequence
  Synthetic oligonucleotide
accctataggggaaagagtggactg

SEQ ID NO: 710808 - DNA, 25 bp, Artificial sequence
  Synthetic oligonucleotide
tggtttaaaggaaggattctcaagc

SEQ ID NO: 710809 - DNA, 25 bp, Artificial sequence
  Synthetic oligonucleotide
gaaccaaactgtaagataaaatgtc

SEQ ID NO: 710810 - DNA, 25 bp, Artificial sequence
  Synthetic oligonucleotide
gagtagtattacaattaaccattag

SEQ ID NO: 710811 - DNA, 25 bp, Artificial sequence
  Synthetic oligonucleotide
ttctgatttgaatatggacctcatg

SEQ ID NO: 710812 - DNA, 25 bp, Artificial sequence
  Synthetic oligonucleotide
gttgtctaaacagttgctatctctg

SEQ ID NO: 710813 - DNA, 25 bp, Artificial sequence
  Synthetic oligonucleotide
gctgcagtttttggttggaggaaac

SEQ ID NO: 710814 - DNA, 25 bp, Artificial sequence
  Synthetic oligonucleotide
gctgcagtttttcgttggaggaaac

SEQ ID NO: 710815 - DNA, 25 bp, Artificial sequence
  Synthetic oligonucleotide
gtaagtacatataatgctcattgtc

SEQ ID NO: 710816 - DNA, 25 bp, Artificial sequence
  Synthetic oligonucleotide
gtaagtacatattatgctcattgtc

SEQ ID NO: 710817 - DNA, 25 bp, Artificial sequence
  Synthetic oligonucleotide
tctgtatgttgtgtctcggccctga

SEQ ID NO: 710818 - DNA, 25 bp, Artificial sequence
  Synthetic oligonucleotide
tctgtatgttgtctctcggccctga

SEQ ID NO: 710819 - DNA, 25 bp, Artificial sequence
  Synthetic oligonucleotide
tatgttggcatgtgttttagaacgg

SEQ ID NO: 710820 - DNA, 25 bp, Artificial sequence
  Synthetic oligonucleotide
gccaagcttatctccgatctcaaca

SEQ ID NO: 710821 - DNA, 25 bp, Artificial sequence
  Synthetic oligonucleotide
gaagcagatgtacgtgagtttctgc

SEQ ID NO: 710822 - DNA, 25 bp, Artificial sequence
  Synthetic oligonucleotide
gaagcagatgtaggtgagtttctgc

SEQ ID NO: 710823 - DNA, 25 bp, Artificial sequence
  Synthetic oligonucleotide
tgagtcaagctcactatatttggag

SEQ ID NO: 710824 - DNA, 25 bp, Artificial sequence
  Synthetic oligonucleotide
gttgtctaaacacttgctatctctg

SEQ ID NO: 710825 - DNA, 25 bp, Artificial sequence
  Synthetic oligonucleotide
ttctgatttgaaaatggacctcatg

SEQ ID NO: 710826 - DNA, 25 bp, Artificial sequence
  Synthetic oligonucleotide
catttgtctacatcgaccaggtcaa

SEQ ID NO: 710827 - DNA, 25 bp, Artificial sequence
  Synthetic oligonucleotide
ctaaatgatcgtttttgcgtagatg

SEQ ID NO: 710828 - DNA, 25 bp, Artificial sequence
  Synthetic oligonucleotide
ctaaatgatcgtatttgcgtagatg

SEQ ID NO: 710829 - DNA, 25 bp, Artificial sequence
  Synthetic oligonucleotide
catttgtctacaacgaccaggtcaa

SEQ ID NO: 710830 - DNA, 25 bp, Artificial sequence
  Synthetic oligonucleotide
tgacagaccgtaatgacatatcagg

SEQ ID NO: 710831 - DNA, 25 bp, Artificial sequence
  Synthetic oligonucleotide
tcttgggttgggtaaggtggagcct

SEQ ID NO: 710832 - DNA, 25 bp, Artificial sequence
  Synthetic oligonucleotide
tcttgggttgggaaaggtggagcct

SEQ ID NO: 710833 - DNA, 25 bp, Artificial sequence
  Synthetic oligonucleotide
tcaggttacgacttctctttttcac

SEQ ID NO: 710834 - DNA, 25 bp, Artificial sequence
  Synthetic oligonucleotide
tcaggttacgacatctctttttcac

SEQ ID NO: 710835 - DNA, 25 bp, Artificial sequence
  Synthetic oligonucleotide
tttatttgattgaaattttttgacg

SEQ ID NO: 710836 - DNA, 25 bp, Artificial sequence
  Synthetic oligonucleotide
tttatttgattgtaattttttgacg

SEQ ID NO: 710837 - DNA, 25 bp, Artificial sequence
  Synthetic oligonucleotide
gcgttgcaactaatccctccttatg

SEQ ID NO: 710838 - DNA, 25 bp, Artificial sequence
  Synthetic oligonucleotide
tgcccctccttcattctccggtctc

SEQ ID NO: 710839 - DNA, 25 bp, Artificial sequence
  Synthetic oligonucleotide
tcttgttgcttgtcaattggaatga

SEQ ID NO: 710840 - DNA, 25 bp, Artificial sequence
  Synthetic oligonucleotide
tgagtcaagctctctatatttggag

SEQ ID NO: 710841 - DNA, 25 bp, Artificial sequence
  Synthetic oligonucleotide
tcgtttcttcctcttcttcttctca

SEQ ID NO: 710842 - DNA, 25 bp, Artificial sequence
  Synthetic oligonucleotide
tgcccctccttctttctccggtctc

SEQ ID NO: 710843 - DNA, 25 bp, Artificial sequence
  Synthetic oligonucleotide
atttctcccaagctcgacgctgccg

SEQ ID NO: 710844 - DNA, 25 bp, Artificial sequence
  Synthetic oligonucleotide
tgacagaccgtattgacatatcagg

SEQ ID NO: 710845 - DNA, 25 bp, Artificial sequence
  Synthetic oligonucleotide
aatgctagattctggatttcgagtg

SEQ ID NO: 710846 - DNA, 25 bp, Artificial sequence
  Synthetic oligonucleotide
atttctcccaaggtcgacgctgccg

SEQ ID NO: 710847 - DNA, 25 bp, Artificial sequence
  Synthetic oligonucleotide
caatccttcttccaccgcgtcaatt

SEQ ID NO: 710848 - DNA, 25 bp, Artificial sequence
  Synthetic oligonucleotide
tcgtttcttcctgttcttcttctca

SEQ ID NO: 710849 - DNA, 25 bp, Artificial sequence
  Synthetic oligonucleotide
ccccagaggtgtagttgccatggct

SEQ ID NO: 710850 - DNA, 25 bp, Artificial sequence
  Synthetic oligonucleotide
ccccagaggtgttgttgccatggct

SEQ ID NO: 710851 - DNA, 25 bp, Artificial sequence
  Synthetic oligonucleotide
caactttaacccacaaactctattg

SEQ ID NO: 710852 - DNA, 25 bp, Artificial sequence
  Synthetic oligonucleotide
caactttaaccctcaaactctattg

SEQ ID NO: 710853 - DNA, 25 bp, Artificial sequence
  Synthetic oligonucleotide
cattgtttaggaatgagtgtgtgag

SEQ ID NO: 710854 - DNA, 25 bp, Artificial sequence
  Synthetic oligonucleotide
cattgtttaggattgagtgtgtgag

SEQ ID NO: 710855 - DNA, 25 bp, Artificial sequence
  Synthetic oligonucleotide
ccttttacttgcatgattggtatca

SEQ ID NO: 710856 - DNA, 25 bp, Artificial sequence
  Synthetic oligonucleotide
tatgattgaggaagaaagttattcc

SEQ ID NO: 710857 - DNA, 25 bp, Artificial sequence
  Synthetic oligonucleotide
agctttggttttgtttcctactcca

SEQ ID NO: 710858 - DNA, 25 bp, Artificial sequence
  Synthetic oligonucleotide
agctttggttttctttcctactcca

SEQ ID NO: 710859 - DNA, 25 bp, Artificial sequence
  Synthetic oligonucleotide
taagaatctcaaatctcttcattgc

SEQ ID NO: 710860 - DNA, 25 bp, Artificial sequence
  Synthetic oligonucleotide
caatccttcttcgaccgcgtcaatt

SEQ ID NO: 710861 - DNA, 25 bp, Artificial sequence
  Synthetic oligonucleotide
aatgctagattcaggatttcgagtg

SEQ ID NO: 710862 - DNA, 25 bp, Artificial sequence
  Synthetic oligonucleotide
ccttttacttgcttgattggtatca

SEQ ID NO: 710863 - DNA, 25 bp, Artificial sequence
  Synthetic oligonucleotide
taagaatctcaattctcttcattgc

SEQ ID NO: 710864 - DNA, 25 bp, Artificial sequence
  Synthetic oligonucleotide
tatgattgaggatgaaagttattcc

SEQ ID NO: 710865 - DNA, 25 bp, Artificial sequence
  Synthetic oligonucleotide
ggtttgctttgcaacaccacaaatg

SEQ ID NO: 710866 - DNA, 25 bp, Artificial sequence
  Synthetic oligonucleotide
ggtttgctttgctacaccacaaatg

SEQ ID NO: 710867 - DNA, 25 bp, Artificial sequence
  Synthetic oligonucleotide
tctcctcagtcttcaattgattcaa

SEQ ID NO: 710868 - DNA, 25 bp, Artificial sequence
  Synthetic oligonucleotide
tctcctcagtctacaattgattcaa

SEQ ID NO: 710869 - DNA, 25 bp, Artificial sequence
  Synthetic oligonucleotide
cagattctctaatttgtttttggca

SEQ ID NO: 710870 - DNA, 25 bp, Artificial sequence
  Synthetic oligonucleotide
cagattctctaaattgtttttggca

SEQ ID NO: 710871 - DNA, 25 bp, Artificial sequence
  Synthetic oligonucleotide
gacagaaattaatgtaggcaggcaa

SEQ ID NO: 710872 - DNA, 25 bp, Artificial sequence
  Synthetic oligonucleotide
attaatgtaggcaggcaacagttat

SEQ ID NO: 710873 - DNA, 25 bp, Artificial sequence
  Synthetic oligonucleotide
aattaatgtagggaggcaacagtta

SEQ ID NO: 710874 - DNA, 25 bp, Artificial sequence
  Synthetic oligonucleotide
aattaatgtaggcaggcaacagtta

SEQ ID NO: 710875 - DNA, 25 bp, Artificial sequence
  Synthetic oligonucleotide
aaattaatgtagccaggcaacagtt

SEQ ID NO: 710876 - DNA, 25 bp, Artificial sequence
  Synthetic oligonucleotide
aaattaatgtaggcaggcaacagtt

SEQ ID NO: 710877 - DNA, 25 bp, Artificial sequence
  Synthetic oligonucleotide
gaaattaatgtacgcaggcaacagt

SEQ ID NO: 710878 - DNA, 25 bp, Artificial sequence
  Synthetic oligonucleotide
gaaattaatgtaggcaggcaacagt

SEQ ID NO: 710879 - DNA, 25 bp, Artificial sequence
  Synthetic oligonucleotide
agaaattaatgtaggcaggcaacag

SEQ ID NO: 710880 - DNA, 25 bp, Artificial sequence
  Synthetic oligonucleotide
agaaattaatgttggcaggcaacag

SEQ ID NO: 710881 - DNA, 25 bp, Artificial sequence
  Synthetic oligonucleotide
cagaaattaatgtaggcaggcaaca

SEQ ID NO: 710882 - DNA, 25 bp, Artificial sequence
  Synthetic oligonucleotide
cagaaattaatgaaggcaggcaaca

SEQ ID NO: 710883 - DNA, 25 bp, Artificial sequence
  Synthetic oligonucleotide
acagaaattaatgtaggcaggcaac

SEQ ID NO: 710884 - DNA, 25 bp, Artificial sequence
  Synthetic oligonucleotide
cagttatccagaagaccagaggaaa

SEQ ID NO: 710885 - DNA, 25 bp, Artificial sequence
  Synthetic oligonucleotide
gacagaaattaaagtaggcaggcaa

SEQ ID NO: 710886 - DNA, 25 bp, Artificial sequence
  Synthetic oligonucleotide
ttaatgtaggcaggcaacagttatc

SEQ ID NO: 710887 - DNA, 25 bp, Artificial sequence
  Synthetic oligonucleotide
ggagacagaaataaatgtaggcagg

SEQ ID NO: 710888 - DNA, 25 bp, Artificial sequence
  Synthetic oligonucleotide
ggagacagaaattaatgtaggcagg

SEQ ID NO: 710889 - DNA, 25 bp, Artificial sequence
  Synthetic oligonucleotide
aggagacagaaattaatgtaggcag

SEQ ID NO: 710890 - DNA, 25 bp, Artificial sequence
  Synthetic oligonucleotide
aggagacagaaaataatgtaggcag

SEQ ID NO: 710891 - DNA, 25 bp, Artificial sequence
  Synthetic oligonucleotide
gaggagacagaaattaatgtaggca

SEQ ID NO: 710892 - DNA, 25 bp, Artificial sequence
  Synthetic oligonucleotide
gaggagacagaatttaatgtaggca

SEQ ID NO: 710893 - DNA, 25 bp, Artificial sequence
  Synthetic oligonucleotide
tgaggagacagaaattaatgtaggc

SEQ ID NO: 710894 - DNA, 25 bp, Artificial sequence
  Synthetic oligonucleotide
tgaggagacagatattaatgtaggc

SEQ ID NO: 710895 - DNA, 25 bp, Artificial sequence
  Synthetic oligonucleotide
ttgaggagacagaaattaatgtagg

SEQ ID NO: 710896 - DNA, 25 bp, Artificial sequence
  Synthetic oligonucleotide
ttgaggagacagtaattaatgtagg

SEQ ID NO: 710897 - DNA, 25 bp, Artificial sequence
  Synthetic oligonucleotide
gttgaggagacacaaattaatgtag

SEQ ID NO: 710898 - DNA, 25 bp, Artificial sequence
  Synthetic oligonucleotide
gttgaggagacagaaattaatgtag

SEQ ID NO: 710899 - DNA, 25 bp, Artificial sequence
  Synthetic oligonucleotide
acagaaattaatctaggcaggcaac

SEQ ID NO: 710900 - DNA, 25 bp, Artificial sequence
  Synthetic oligonucleotide
caggcaacagttatccagaagacca

SEQ ID NO: 710901 - DNA, 25 bp, Artificial sequence
  Synthetic oligonucleotide
cagttatccagatgaccagaggaaa

SEQ ID NO: 710902 - DNA, 25 bp, Artificial sequence
  Synthetic oligonucleotide
acagttatccagaagaccagaggaa

SEQ ID NO: 710903 - DNA, 25 bp, Artificial sequence
  Synthetic oligonucleotide
acagttatccagtagaccagaggaa

SEQ ID NO: 710904 - DNA, 25 bp, Artificial sequence
  Synthetic oligonucleotide
aacagttatccacaagaccagagga

SEQ ID NO: 710905 - DNA, 25 bp, Artificial sequence
  Synthetic oligonucleotide
aacagttatccagaagaccagagga

SEQ ID NO: 710906 - DNA, 25 bp, Artificial sequence
  Synthetic oligonucleotide
caacagttatccagaagaccagagg

SEQ ID NO: 710907 - DNA, 25 bp, Artificial sequence
  Synthetic oligonucleotide
caacagttatcctgaagaccagagg

SEQ ID NO: 710908 - DNA, 25 bp, Artificial sequence
  Synthetic oligonucleotide
gcaacagttatccagaagaccagag

SEQ ID NO: 710909 - DNA, 25 bp, Artificial sequence
  Synthetic oligonucleotide
gcaacagttatcgagaagaccagag

SEQ ID NO: 710910 - DNA, 25 bp, Artificial sequence
  Synthetic oligonucleotide
ggcaacagttatgcagaagaccaga

SEQ ID NO: 710911 - DNA, 25 bp, Artificial sequence
  Synthetic oligonucleotide
ggcaacagttatccagaagaccaga

SEQ ID NO: 710912 - DNA, 25 bp, Artificial sequence
  Synthetic oligonucleotide
aggcaacagttaaccagaagaccag

SEQ ID NO: 710913 - DNA, 25 bp, Artificial sequence
  Synthetic oligonucleotide
attaatgtaggctggcaacagttat

SEQ ID NO: 710914 - DNA, 25 bp, Artificial sequence
  Synthetic oligonucleotide
caggcaacagttttccagaagacca

SEQ ID NO: 710915 - DNA, 25 bp, Artificial sequence
  Synthetic oligonucleotide
ttaatgtaggcacgcaacagttatc

SEQ ID NO: 710916 - DNA, 25 bp, Artificial sequence
  Synthetic oligonucleotide
gcaggcaacagtaatccagaagacc

SEQ ID NO: 710917 - DNA, 25 bp, Artificial sequence
  Synthetic oligonucleotide
gcaggcaacagttatccagaagacc

SEQ ID NO: 710918 - DNA, 25 bp, Artificial sequence
  Synthetic oligonucleotide
ggcaggcaacagttatccagaagac

SEQ ID NO: 710919 - DNA, 25 bp, Artificial sequence
  Synthetic oligonucleotide
ggcaggcaacagatatccagaagac

SEQ ID NO: 710920 - DNA, 25 bp, Artificial sequence
  Synthetic oligonucleotide
aggcaggcaacacttatccagaaga

SEQ ID NO: 710921 - DNA, 25 bp, Artificial sequence
  Synthetic oligonucleotide
aggcaggcaacagttatccagaaga

SEQ ID NO: 710922 - DNA, 25 bp, Artificial sequence
  Synthetic oligonucleotide
taggcaggcaactgttatccagaag

SEQ ID NO: 710923 - DNA, 25 bp, Artificial sequence
  Synthetic oligonucleotide
taggcaggcaacagttatccagaag

SEQ ID NO: 710924 - DNA, 25 bp, Artificial sequence
  Synthetic oligonucleotide
gtaggcaggcaagagttatccagaa

SEQ ID NO: 710925 - DNA, 25 bp, Artificial sequence
  Synthetic oligonucleotide
gtaggcaggcaacagttatccagaa

SEQ ID NO: 710926 - DNA, 25 bp, Artificial sequence
  Synthetic oligonucleotide
aatgtaggcaggcaacagttatcca

SEQ ID NO: 710927 - DNA, 25 bp, Artificial sequence
  Synthetic oligonucleotide
aatgtaggcagggaacagttatcca

SEQ ID NO: 710928 - DNA, 25 bp, Artificial sequence
  Synthetic oligonucleotide
agttgaggagacagaaattaatgta

SEQ ID NO: 710929 - DNA, 25 bp, Artificial sequence
  Synthetic oligonucleotide
aggcaacagttatccagaagaccag

SEQ ID NO: 710930 - DNA, 25 bp, Artificial sequence
  Synthetic oligonucleotide
agttgaggagactgaaattaatgta

SEQ ID NO: 710931 - DNA, 25 bp, Artificial sequence
  Synthetic oligonucleotide
aggcaacagttatccagaagaccag

SEQ ID NO: 710932 - DNA, 25 bp, Artificial sequence
  Synthetic oligonucleotide
agttgaggagactgaaattaatgta

SEQ ID NO: 710933 - DNA, 25 bp, Artificial sequence
  Synthetic oligonucleotide
aatgtaggcagggaacagttatcca

SEQ ID NO: 710934 - DNA, 25 bp, Artificial sequence
  Synthetic oligonucleotide
gtaggcaggcaagagttatccagaa

SEQ ID NO: 710935 - DNA, 25 bp, Artificial sequence
  Synthetic oligonucleotide
gtaggcaggcaacagttatccagaa

SEQ ID NO: 710936 - DNA, 25 bp, Artificial sequence
  Synthetic oligonucleotide
taggcaggcaactgttatccagaag

SEQ ID NO: 710937 - DNA, 25 bp, Artificial sequence
  Synthetic oligonucleotide
taggcaggcaacagttatccagaag

SEQ ID NO: 710938 - DNA, 25 bp, Artificial sequence
  Synthetic oligonucleotide
aggcaggcaacagttatccagaaga

SEQ ID NO: 710939 - DNA, 25 bp, Artificial sequence
  Synthetic oligonucleotide
aggcaggcaacacttatccagaaga

SEQ ID NO: 710940 - DNA, 25 bp, Artificial sequence
  Synthetic oligonucleotide
ggcaggcaacagttatccagaagac

SEQ ID NO: 710941 - DNA, 25 bp, Artificial sequence
  Synthetic oligonucleotide
ggcaggcaacagatatccagaagac

SEQ ID NO: 710942 - DNA, 25 bp, Artificial sequence
  Synthetic oligonucleotide
gcaggcaacagtaatccagaagacc

SEQ ID NO: 710943 - DNA, 25 bp, Artificial sequence
  Synthetic oligonucleotide
gcaggcaacagttatccagaagacc

SEQ ID NO: 710944 - DNA, 25 bp, Artificial sequence
  Synthetic oligonucleotide
caggcaacagttatccagaagacca

SEQ ID NO: 710945 - DNA, 25 bp, Artificial sequence
  Synthetic oligonucleotide
ttaatgtaggcacgcaacagttatc

SEQ ID NO: 710946 - DNA, 25 bp, Artificial sequence
  Synthetic oligonucleotide
aggcaacagttaaccagaagaccag

SEQ ID NO: 710947 - DNA, 25 bp, Artificial sequence
  Synthetic oligonucleotide
ggcaacagttatccagaagaccaga

SEQ ID NO: 710948 - DNA, 25 bp, Artificial sequence
  Synthetic oligonucleotide
ggcaacagttatgcagaagaccaga

SEQ ID NO: 710949 - DNA, 25 bp, Artificial sequence
  Synthetic oligonucleotide
gcaacagttatcgagaagaccagag

SEQ ID NO: 710950 - DNA, 25 bp, Artificial sequence
  Synthetic oligonucleotide
gcaacagttatccagaagaccagag

SEQ ID NO: 710951 - DNA, 25 bp, Artificial sequence
  Synthetic oligonucleotide
caacagttatcctgaagaccagagg

SEQ ID NO: 710952 - DNA, 25 bp, Artificial sequence
  Synthetic oligonucleotide
caacagttatccagaagaccagagg

SEQ ID NO: 710953 - DNA, 25 bp, Artificial sequence
  Synthetic oligonucleotide
aacagttatccagaagaccagagga

SEQ ID NO: 710954 - DNA, 25 bp, Artificial sequence
  Synthetic oligonucleotide
aacagttatccacaagaccagagga

SEQ ID NO: 710955 - DNA, 25 bp, Artificial sequence
  Synthetic oligonucleotide
acagttatccagaagaccagaggaa

SEQ ID NO: 710956 - DNA, 25 bp, Artificial sequence
  Synthetic oligonucleotide
acagttatccagtagaccagaggaa

SEQ ID NO: 710957 - DNA, 25 bp, Artificial sequence
  Synthetic oligonucleotide
cagttatccagaagaccagaggaaa

SEQ ID NO: 710958 - DNA, 25 bp, Artificial sequence
  Synthetic oligonucleotide
cagttatccagatgaccagaggaaa

SEQ ID NO: 710959 - DNA, 25 bp, Artificial sequence
  Synthetic oligonucleotide
caggcaacagttttccagaagacca

SEQ ID NO: 710960 - DNA, 25 bp, Artificial sequence
  Synthetic oligonucleotide
acagaaattaatgtaggcaggcaac

SEQ ID NO: 710961 - DNA, 25 bp, Artificial sequence
  Synthetic oligonucleotide
ggagacagaaataaatgtaggcagg

SEQ ID NO: 710962 - DNA, 25 bp, Artificial sequence
  Synthetic oligonucleotide
agttgaggagacagaaattaatgta

SEQ ID NO: 710963 - DNA, 25 bp, Artificial sequence
  Synthetic oligonucleotide
gttgaggagacacaaattaatgtag

SEQ ID NO: 710964 - DNA, 25 bp, Artificial sequence
  Synthetic oligonucleotide
gttgaggagacagaaattaatgtag

SEQ ID NO: 710965 - DNA, 25 bp, Artificial sequence
  Synthetic oligonucleotide
ttgaggagacagaaattaatgtagg

SEQ ID NO: 710966 - DNA, 25 bp, Artificial sequence
  Synthetic oligonucleotide
ttgaggagacagtaattaatgtagg

SEQ ID NO: 710967 - DNA, 25 bp, Artificial sequence
  Synthetic oligonucleotide
tgaggagacagaaattaatgtaggc

SEQ ID NO: 710968 - DNA, 25 bp, Artificial sequence
  Synthetic oligonucleotide
tgaggagacagatattaatgtaggc

SEQ ID NO: 710969 - DNA, 25 bp, Artificial sequence
  Synthetic oligonucleotide
gaggagacagaaattaatgtaggca

SEQ ID NO: 710970 - DNA, 25 bp, Artificial sequence
  Synthetic oligonucleotide
gaggagacagaatttaatgtaggca

SEQ ID NO: 710971 - DNA, 25 bp, Artificial sequence
  Synthetic oligonucleotide
aggagacagaaattaatgtaggcag

SEQ ID NO: 710972 - DNA, 25 bp, Artificial sequence
  Synthetic oligonucleotide
aggagacagaaaataatgtaggcag

SEQ ID NO: 710973 - DNA, 25 bp, Artificial sequence
  Synthetic oligonucleotide
aatgtaggcaggcaacagttatcca

SEQ ID NO: 710974 - DNA, 25 bp, Artificial sequence
  Synthetic oligonucleotide
gacagaaattaatgtaggcaggcaa

SEQ ID NO: 710975 - DNA, 25 bp, Artificial sequence
  Synthetic oligonucleotide
ttaatgtaggcaggcaacagttatc

SEQ ID NO: 710976 - DNA, 25 bp, Artificial sequence
  Synthetic oligonucleotide
acagaaattaatctaggcaggcaac

SEQ ID NO: 710977 - DNA, 25 bp, Artificial sequence
  Synthetic oligonucleotide
cagaaattaatgaaggcaggcaaca

SEQ ID NO: 710978 - DNA, 25 bp, Artificial sequence
  Synthetic oligonucleotide
cagaaattaatgtaggcaggcaaca

SEQ ID NO: 710979 - DNA, 25 bp, Artificial sequence
  Synthetic oligonucleotide
agaaattaatgttggcaggcaacag

SEQ ID NO: 710980 - DNA, 25 bp, Artificial sequence
  Synthetic oligonucleotide
agaaattaatgtaggcaggcaacag

SEQ ID NO: 710981 - DNA, 25 bp, Artificial sequence
  Synthetic oligonucleotide
gaaattaatgtacgcaggcaacagt

SEQ ID NO: 710982 - DNA, 25 bp, Artificial sequence
  Synthetic oligonucleotide
gaaattaatgtaggcaggcaacagt

SEQ ID NO: 710983 - DNA, 25 bp, Artificial sequence
  Synthetic oligonucleotide
aaattaatgtagccaggcaacagtt

SEQ ID NO: 710984 - DNA, 25 bp, Artificial sequence
  Synthetic oligonucleotide
aaattaatgtaggcaggcaacagtt

SEQ ID NO: 710985 - DNA, 25 bp, Artificial sequence
  Synthetic oligonucleotide
aattaatgtaggcaggcaacagtta

SEQ ID NO: 710986 - DNA, 25 bp, Artificial sequence
  Synthetic oligonucleotide
aattaatgtagggaggcaacagtta

SEQ ID NO: 710987 - DNA, 25 bp, Artificial sequence
  Synthetic oligonucleotide
attaatgtaggctggcaacagttat

SEQ ID NO: 710988 - DNA, 25 bp, Artificial sequence
  Synthetic oligonucleotide
attaatgtaggcaggcaacagttat

SEQ ID NO: 710989 - DNA, 25 bp, Artificial sequence
  Synthetic oligonucleotide
ggagacagaaattaatgtaggcagg

SEQ ID NO: 710990 - DNA, 25 bp, Artificial sequence
  Synthetic oligonucleotide
gacagaaattaaagtaggcaggcaa

SEQ ID NO: 710991 - DNA, 25 bp, Artificial sequence
  Synthetic oligonucleotide
atacttgctgtaaagggaagcacca

SEQ ID NO: 710992 - DNA, 25 bp, Artificial sequence
  Synthetic oligonucleotide
tgaatacttgctgtatagggaagca

SEQ ID NO: 710993 - DNA, 25 bp, Artificial sequence
  Synthetic oligonucleotide
tgaatacttgctctatagggaagca

SEQ ID NO: 710994 - DNA, 25 bp, Artificial sequence
  Synthetic oligonucleotide
gaatacttgctgaatagggaagcac

SEQ ID NO: 710995 - DNA, 25 bp, Artificial sequence
  Synthetic oligonucleotide
gaatacttgctgtatagggaagcac

SEQ ID NO: 710996 - DNA, 25 bp, Artificial sequence
  Synthetic oligonucleotide
aatacttgctgtatagggaagcacc

SEQ ID NO: 710997 - DNA, 25 bp, Artificial sequence
  Synthetic oligonucleotide
tgctgtatagggaagcaccagccac

SEQ ID NO: 710998 - DNA, 25 bp, Artificial sequence
  Synthetic oligonucleotide
atacttgctgtatagggaagcacca

SEQ ID NO: 710999 - DNA, 25 bp, Artificial sequence
  Synthetic oligonucleotide
actgaatacttgctgtatagggaag

SEQ ID NO: 711000 - DNA, 25 bp, Artificial sequence
  Synthetic oligonucleotide
acttgctgtatagggaagcaccagc

SEQ ID NO: 711001 - DNA, 25 bp, Artificial sequence
  Synthetic oligonucleotide
acttgctgtatacggaagcaccagc

SEQ ID NO: 711002 - DNA, 25 bp, Artificial sequence
  Synthetic oligonucleotide
cttgctgtatagcgaagcaccagcc

SEQ ID NO: 711003 - DNA, 25 bp, Artificial sequence
  Synthetic oligonucleotide
cttgctgtatagggaagcaccagcc

SEQ ID NO: 711004 - DNA, 25 bp, Artificial sequence
  Synthetic oligonucleotide
tgctgtatagggtagcaccagccac

SEQ ID NO: 711005 - DNA, 25 bp, Artificial sequence
  Synthetic oligonucleotide
aatacttgctgtttagggaagcacc

SEQ ID NO: 711006 - DNA, 25 bp, Artificial sequence
  Synthetic oligonucleotide
ctgaatacttgctgtatagggaagc

SEQ ID NO: 711007 - DNA, 25 bp, Artificial sequence
  Synthetic oligonucleotide
caggacactgaatacttgctgtata

SEQ ID NO: 711008 - DNA, 25 bp, Artificial sequence
  Synthetic oligonucleotide
actgaatacttggtgtatagggaag

SEQ ID NO: 711009 - DNA, 25 bp, Artificial sequence
  Synthetic oligonucleotide
cactgaatacttgctgtatagggaa

SEQ ID NO: 711010 - DNA, 25 bp, Artificial sequence
  Synthetic oligonucleotide
cactgaatacttcctgtatagggaa

SEQ ID NO: 711011 - DNA, 25 bp, Artificial sequence
  Synthetic oligonucleotide
acactgaatactagctgtataggga

SEQ ID NO: 711012 - DNA, 25 bp, Artificial sequence
  Synthetic oligonucleotide
acactgaatacttgctgtataggga

SEQ ID NO: 711013 - DNA, 25 bp, Artificial sequence
  Synthetic oligonucleotide
gacactgaatacttgctgtataggg

SEQ ID NO: 711014 - DNA, 25 bp, Artificial sequence
  Synthetic oligonucleotide
gacactgaatacatgctgtataggg

SEQ ID NO: 711015 - DNA, 25 bp, Artificial sequence
  Synthetic oligonucleotide
ggacactgaatacttgctgtatagg

SEQ ID NO: 711016 - DNA, 25 bp, Artificial sequence
  Synthetic oligonucleotide
ggacactgaatagttgctgtatagg

SEQ ID NO: 711017 - DNA, 25 bp, Artificial sequence
  Synthetic oligonucleotide
aggacactgaatacttgctgtatag

SEQ ID NO: 711018 - DNA, 25 bp, Artificial sequence
  Synthetic oligonucleotide
aggacactgaattcttgctgtatag

SEQ ID NO: 711019 - DNA, 25 bp, Artificial sequence
  Synthetic oligonucleotide
caggacactgaaaacttgctgtata

SEQ ID NO: 711020 - DNA, 25 bp, Artificial sequence
  Synthetic oligonucleotide
ctgaatacttgcagtatagggaagc

SEQ ID NO: 711021 - DNA, 25 bp, Artificial sequence
  Synthetic oligonucleotide
gaagcaccagccacagtgaggaatg

SEQ ID NO: 711022 - DNA, 25 bp, Artificial sequence
  Synthetic oligonucleotide
accagccacagtgaggaatgtccac

SEQ ID NO: 711023 - DNA, 25 bp, Artificial sequence
  Synthetic oligonucleotide
caccagccacagagaggaatgtcca

SEQ ID NO: 711024 - DNA, 25 bp, Artificial sequence
  Synthetic oligonucleotide
caccagccacagtgaggaatgtcca

SEQ ID NO: 711025 - DNA, 25 bp, Artificial sequence
  Synthetic oligonucleotide
gcaccagccacagtgaggaatgtcc

SEQ ID NO: 711026 - DNA, 25 bp, Artificial sequence
  Synthetic oligonucleotide
gcaccagccacactgaggaatgtcc

SEQ ID NO: 711027 - DNA, 25 bp, Artificial sequence
  Synthetic oligonucleotide
gctgtatagggatgcaccagccaca

SEQ ID NO: 711028 - DNA, 25 bp, Artificial sequence
  Synthetic oligonucleotide
aagcaccagccacagtgaggaatgt

SEQ ID NO: 711029 - DNA, 25 bp, Artificial sequence
  Synthetic oligonucleotide
accagccacagtcaggaatgtccac

SEQ ID NO: 711030 - DNA, 25 bp, Artificial sequence
  Synthetic oligonucleotide
gaagcaccagcctcagtgaggaatg

SEQ ID NO: 711031 - DNA, 25 bp, Artificial sequence
  Synthetic oligonucleotide
ggaagcaccagccacagtgaggaat

SEQ ID NO: 711032 - DNA, 25 bp, Artificial sequence
  Synthetic oligonucleotide
ggaagcaccagcgacagtgaggaat

SEQ ID NO: 711033 - DNA, 25 bp, Artificial sequence
  Synthetic oligonucleotide
gggaagcaccagccacagtgaggaa

SEQ ID NO: 711034 - DNA, 25 bp, Artificial sequence
  Synthetic oligonucleotide
gggaagcaccaggcacagtgaggaa

SEQ ID NO: 711035 - DNA, 25 bp, Artificial sequence
  Synthetic oligonucleotide
agggaagcaccagccacagtgagga

SEQ ID NO: 711036 - DNA, 25 bp, Artificial sequence
  Synthetic oligonucleotide
tgtatagggaaggaccagccacagt

SEQ ID NO: 711037 - DNA, 25 bp, Artificial sequence
  Synthetic oligonucleotide
aagcaccagccagagtgaggaatgt

SEQ ID NO: 711038 - DNA, 25 bp, Artificial sequence
  Synthetic oligonucleotide
gctgtatagggaagcaccagccaca

SEQ ID NO: 711039 - DNA, 25 bp, Artificial sequence
  Synthetic oligonucleotide
agggaagcaccacccacagtgagga

SEQ ID NO: 711040 - DNA, 25 bp, Artificial sequence
  Synthetic oligonucleotide
ctgtatagggaagcaccagccacag

SEQ ID NO: 711041 - DNA, 25 bp, Artificial sequence
  Synthetic oligonucleotide
tgtatagggaagcaccagccacagt

SEQ ID NO: 711042 - DNA, 25 bp, Artificial sequence
  Synthetic oligonucleotide
gtatagggaagcaccagccacagtg

SEQ ID NO: 711043 - DNA, 25 bp, Artificial sequence
  Synthetic oligonucleotide
gtatagggaagctccagccacagtg

SEQ ID NO: 711044 - DNA, 25 bp, Artificial sequence
  Synthetic oligonucleotide
tatagggaagcaccagccacagtga

SEQ ID NO: 711045 - DNA, 25 bp, Artificial sequence
  Synthetic oligonucleotide
tatagggaagcagcagccacagtga

SEQ ID NO: 711046 - DNA, 25 bp, Artificial sequence
  Synthetic oligonucleotide
atagggaagcaccagccacagtgag

SEQ ID NO: 711047 - DNA, 25 bp, Artificial sequence
  Synthetic oligonucleotide
atagggaagcacgagccacagtgag

SEQ ID NO: 711048 - DNA, 25 bp, Artificial sequence
  Synthetic oligonucleotide
tagggaagcaccagccacagtgagg

SEQ ID NO: 711049 - DNA, 25 bp, Artificial sequence
  Synthetic oligonucleotide
tagggaagcacctgccacagtgagg

SEQ ID NO: 711050 - DNA, 25 bp, Artificial sequence
  Synthetic oligonucleotide
ctgtatagggaaccaccagccacag

SEQ ID NO: 711051 - DNA, 25 bp, Artificial sequence
  Synthetic oligonucleotide
tgctgtatagggaagcaccagccac

SEQ ID NO: 711052 - DNA, 25 bp, Artificial sequence
  Synthetic oligonucleotide
aatacttgctgtttagggaagcacc

SEQ ID NO: 711053 - DNA, 25 bp, Artificial sequence
  Synthetic oligonucleotide
tgaatacttgctctatagggaagca

SEQ ID NO: 711054 - DNA, 25 bp, Artificial sequence
  Synthetic oligonucleotide
tgaatacttgctgtatagggaagca

SEQ ID NO: 711055 - DNA, 25 bp, Artificial sequence
  Synthetic oligonucleotide
gaatacttgctgaatagggaagcac

SEQ ID NO: 711056 - DNA, 25 bp, Artificial sequence
  Synthetic oligonucleotide
gaatacttgctgtatagggaagcac

SEQ ID NO: 711057 - DNA, 25 bp, Artificial sequence
  Synthetic oligonucleotide
aatacttgctgtatagggaagcacc

SEQ ID NO: 711058 - DNA, 25 bp, Artificial sequence
  Synthetic oligonucleotide
atacttgctgtaaagggaagcacca

SEQ ID NO: 711059 - DNA, 25 bp, Artificial sequence
  Synthetic oligonucleotide
atacttgctgtatagggaagcacca

SEQ ID NO: 711060 - DNA, 25 bp, Artificial sequence
  Synthetic oligonucleotide
acttgctgtatacggaagcaccagc

SEQ ID NO: 711061 - DNA, 25 bp, Artificial sequence
  Synthetic oligonucleotide
acttgctgtatagggaagcaccagc

SEQ ID NO: 711062 - DNA, 25 bp, Artificial sequence
  Synthetic oligonucleotide
cttgctgtatagcgaagcaccagcc

SEQ ID NO: 711063 - DNA, 25 bp, Artificial sequence
  Synthetic oligonucleotide
tgctgtatagggtagcaccagccac

SEQ ID NO: 711064 - DNA, 25 bp, Artificial sequence
  Synthetic oligonucleotide
cttgctgtatagggaagcaccagcc

SEQ ID NO: 711065 - DNA, 25 bp, Artificial sequence
  Synthetic oligonucleotide
ctgaatacttgcagtatagggaagc

SEQ ID NO: 711066 - DNA, 25 bp, Artificial sequence
  Synthetic oligonucleotide
actgaatacttggtgtatagggaag

SEQ ID NO: 711067 - DNA, 25 bp, Artificial sequence
  Synthetic oligonucleotide
cactgaatacttgctgtatagggaa

SEQ ID NO: 711068 - DNA, 25 bp, Artificial sequence
  Synthetic oligonucleotide
cactgaatacttcctgtatagggaa

SEQ ID NO: 711069 - DNA, 25 bp, Artificial sequence
  Synthetic oligonucleotide
acactgaatacttgctgtataggga

SEQ ID NO: 711070 - DNA, 25 bp, Artificial sequence
  Synthetic oligonucleotide
acactgaatactagctgtataggga

SEQ ID NO: 711071 - DNA, 25 bp, Artificial sequence
  Synthetic oligonucleotide
gacactgaatacttgctgtataggg

SEQ ID NO: 711072 - DNA, 25 bp, Artificial sequence
  Synthetic oligonucleotide
gacactgaatacatgctgtataggg

SEQ ID NO: 711073 - DNA, 25 bp, Artificial sequence
  Synthetic oligonucleotide
ggacactgaatacttgctgtatagg

SEQ ID NO: 711074 - DNA, 25 bp, Artificial sequence
  Synthetic oligonucleotide
ggacactgaatagttgctgtatagg

SEQ ID NO: 711075 - DNA, 25 bp, Artificial sequence
  Synthetic oligonucleotide
aggacactgaatacttgctgtatag

SEQ ID NO: 711076 - DNA, 25 bp, Artificial sequence
  Synthetic oligonucleotide
gctgtatagggaagcaccagccaca

SEQ ID NO: 711077 - DNA, 25 bp, Artificial sequence
  Synthetic oligonucleotide
caggacactgaatacttgctgtata

SEQ ID NO: 711078 - DNA, 25 bp, Artificial sequence
  Synthetic oligonucleotide
gggaagcaccaggcacagtgaggaa

SEQ ID NO: 711079 - DNA, 25 bp, Artificial sequence
  Synthetic oligonucleotide
aggacactgaattcttgctgtatag

SEQ ID NO: 711080 - DNA, 25 bp, Artificial sequence
  Synthetic oligonucleotide
agggaagcaccagccacagtgagga

SEQ ID NO: 711081 - DNA, 25 bp, Artificial sequence
  Synthetic oligonucleotide
actgaatacttgctgtatagggaag

SEQ ID NO: 711082 - DNA, 25 bp, Artificial sequence
  Synthetic oligonucleotide
caggacactgaaaacttgctgtata

SEQ ID NO: 711083 - DNA, 25 bp, Artificial sequence
  Synthetic oligonucleotide
accagccacagtcaggaatgtccac

SEQ ID NO: 711084 - DNA, 25 bp, Artificial sequence
  Synthetic oligonucleotide
caccagccacagagaggaatgtcca

SEQ ID NO: 711085 - DNA, 25 bp, Artificial sequence
  Synthetic oligonucleotide
caccagccacagtgaggaatgtcca

SEQ ID NO: 711086 - DNA, 25 bp, Artificial sequence
  Synthetic oligonucleotide
gcaccagccacagtgaggaatgtcc

SEQ ID NO: 711087 - DNA, 25 bp, Artificial sequence
  Synthetic oligonucleotide
gcaccagccacactgaggaatgtcc

SEQ ID NO: 711088 - DNA, 25 bp, Artificial sequence
  Synthetic oligonucleotide
aagcaccagccacagtgaggaatgt

SEQ ID NO: 711089 - DNA, 25 bp, Artificial sequence
  Synthetic oligonucleotide
aagcaccagccagagtgaggaatgt

SEQ ID NO: 711090 - DNA, 25 bp, Artificial sequence
  Synthetic oligonucleotide
gaagcaccagccacagtgaggaatg

SEQ ID NO: 711091 - DNA, 25 bp, Artificial sequence
  Synthetic oligonucleotide
gaagcaccagcctcagtgaggaatg

SEQ ID NO: 711092 - DNA, 25 bp, Artificial sequence
  Synthetic oligonucleotide
ggaagcaccagccacagtgaggaat

SEQ ID NO: 711093 - DNA, 25 bp, Artificial sequence
  Synthetic oligonucleotide
agggaagcaccacccacagtgagga

SEQ ID NO: 711094 - DNA, 25 bp, Artificial sequence
  Synthetic oligonucleotide
gggaagcaccagccacagtgaggaa

SEQ ID NO: 711095 - DNA, 25 bp, Artificial sequence
  Synthetic oligonucleotide
gctgtatagggatgcaccagccaca

SEQ ID NO: 711096 - DNA, 25 bp, Artificial sequence
  Synthetic oligonucleotide
accagccacagtgaggaatgtccac

SEQ ID NO: 711097 - DNA, 25 bp, Artificial sequence
  Synthetic oligonucleotide
tagggaagcaccagccacagtgagg

SEQ ID NO: 711098 - DNA, 25 bp, Artificial sequence
  Synthetic oligonucleotide
tagggaagcacctgccacagtgagg

SEQ ID NO: 711099 - DNA, 25 bp, Artificial sequence
  Synthetic oligonucleotide
atagggaagcaccagccacagtgag

SEQ ID NO: 711100 - DNA, 25 bp, Artificial sequence
  Synthetic oligonucleotide
atagggaagcacgagccacagtgag

SEQ ID NO: 711101 - DNA, 25 bp, Artificial sequence
  Synthetic oligonucleotide
tatagggaagcaccagccacagtga

SEQ ID NO: 711102 - DNA, 25 bp, Artificial sequence
  Synthetic oligonucleotide
tatagggaagcagcagccacagtga

SEQ ID NO: 711103 - DNA, 25 bp, Artificial sequence
  Synthetic oligonucleotide
gtatagggaagcaccagccacagtg

SEQ ID NO: 711104 - DNA, 25 bp, Artificial sequence
  Synthetic oligonucleotide
gtatagggaagctccagccacagtg

SEQ ID NO: 711105 - DNA, 25 bp, Artificial sequence
  Synthetic oligonucleotide
tgtatagggaagcaccagccacagt

SEQ ID NO: 711106 - DNA, 25 bp, Artificial sequence
  Synthetic oligonucleotide
tgtatagggaaggaccagccacagt

SEQ ID NO: 711107 - DNA, 25 bp, Artificial sequence
  Synthetic oligonucleotide
ctgtatagggaaccaccagccacag

SEQ ID NO: 711108 - DNA, 25 bp, Artificial sequence
  Synthetic oligonucleotide
ctgtatagggaagcaccagccacag

SEQ ID NO: 711109 - DNA, 25 bp, Artificial sequence
  Synthetic oligonucleotide
ggaagcaccagcgacagtgaggaat

SEQ ID NO: 711110 - DNA, 25 bp, Artificial sequence
  Synthetic oligonucleotide
ctgaatacttgctgtatagggaagc

SEQ ID NO: 711111 - DNA, 25 bp, Artificial sequence
  Synthetic oligonucleotide
aatgagggcagacctgaccatctgg

SEQ ID NO: 711112 - DNA, 25 bp, Artificial sequence
  Synthetic oligonucleotide
catctggacggagacagtgatttct

SEQ ID NO: 711113 - DNA, 25 bp, Artificial sequence
  Synthetic oligonucleotide
catctggacggacacagtgatttct

SEQ ID NO: 711114 - DNA, 25 bp, Artificial sequence
  Synthetic oligonucleotide
atctggacggactcagtgatttcta

SEQ ID NO: 711115 - DNA, 25 bp, Artificial sequence
  Synthetic oligonucleotide
atctggacggacacagtgatttcta

SEQ ID NO: 711116 - DNA, 25 bp, Artificial sequence
  Synthetic oligonucleotide
tctggacggacagagtgatttctat

SEQ ID NO: 711117 - DNA, 25 bp, Artificial sequence
  Synthetic oligonucleotide
tctggacggacacagtgatttctat

SEQ ID NO: 711118 - DNA, 25 bp, Artificial sequence
  Synthetic oligonucleotide
ctggacggacacagtgatttctatg

SEQ ID NO: 711119 - DNA, 25 bp, Artificial sequence
  Synthetic oligonucleotide
ctggacggacactgtgatttctatg

SEQ ID NO: 711120 - DNA, 25 bp, Artificial sequence
  Synthetic oligonucleotide
tggacggacacagtgatttctatgg

SEQ ID NO: 711121 - DNA, 25 bp, Artificial sequence
  Synthetic oligonucleotide
tggacggacacactgatttctatgg

SEQ ID NO: 711122 - DNA, 25 bp, Artificial sequence
  Synthetic oligonucleotide
ggacggacacagtgatttctatgga

SEQ ID NO: 711123 - DNA, 25 bp, Artificial sequence
  Synthetic oligonucleotide
ccatctggacggtcacagtgatttc

SEQ ID NO: 711124 - DNA, 25 bp, Artificial sequence
  Synthetic oligonucleotide
gacggacacagtgatttctatggaa

SEQ ID NO: 711125 - DNA, 25 bp, Artificial sequence
  Synthetic oligonucleotide
accatctggacggacacagtgattt

SEQ ID NO: 711126 - DNA, 25 bp, Artificial sequence
  Synthetic oligonucleotide
tgaatgagggcagagctgaccatct

SEQ ID NO: 711127 - DNA, 25 bp, Artificial sequence
  Synthetic oligonucleotide
gacggacacagtcatttctatggaa

SEQ ID NO: 711128 - DNA, 25 bp, Artificial sequence
  Synthetic oligonucleotide
acggacacagtgttttctatggaag

SEQ ID NO: 711129 - DNA, 25 bp, Artificial sequence
  Synthetic oligonucleotide
acggacacagtgatttctatggaag

SEQ ID NO: 711130 - DNA, 25 bp, Artificial sequence
  Synthetic oligonucleotide
cggacacagtgatttctatggaagg

SEQ ID NO: 711131 - DNA, 25 bp, Artificial sequence
  Synthetic oligonucleotide
cggacacagtgaattctatggaagg

SEQ ID NO: 711132 - DNA, 25 bp, Artificial sequence
  Synthetic oligonucleotide
ggacacagtgatatctatggaaggc

SEQ ID NO: 711133 - DNA, 25 bp, Artificial sequence
  Synthetic oligonucleotide
ggacacagtgatttctatggaaggc

SEQ ID NO: 711134 - DNA, 25 bp, Artificial sequence
  Synthetic oligonucleotide
gacacagtgattactatggaaggct

SEQ ID NO: 711135 - DNA, 25 bp, Artificial sequence
  Synthetic oligonucleotide
gacacagtgatttctatggaaggct

SEQ ID NO: 711136 - DNA, 25 bp, Artificial sequence
  Synthetic oligonucleotide
acacagtgatttctatggaaggctt

SEQ ID NO: 711137 - DNA, 25 bp, Artificial sequence
  Synthetic oligonucleotide
acacagtgatttgtatggaaggctt

SEQ ID NO: 711138 - DNA, 25 bp, Artificial sequence
  Synthetic oligonucleotide
cacagtgatttctatggaaggcttg

SEQ ID NO: 711139 - DNA, 25 bp, Artificial sequence
  Synthetic oligonucleotide
ggacggacacagagatttctatgga

SEQ ID NO: 711140 - DNA, 25 bp, Artificial sequence
  Synthetic oligonucleotide
cagagctgaccaactggacggacac

SEQ ID NO: 711141 - DNA, 25 bp, Artificial sequence
  Synthetic oligonucleotide
aatgagggcagagctgaccatctgg

SEQ ID NO: 711142 - DNA, 25 bp, Artificial sequence
  Synthetic oligonucleotide
atgagggcagagctgaccatctgga

SEQ ID NO: 711143 - DNA, 25 bp, Artificial sequence
  Synthetic oligonucleotide
atgagggcagaggtgaccatctgga

SEQ ID NO: 711144 - DNA, 25 bp, Artificial sequence
  Synthetic oligonucleotide
tgagggcagagctgaccatctggac

SEQ ID NO: 711145 - DNA, 25 bp, Artificial sequence
  Synthetic oligonucleotide
tgagggcagagcagaccatctggac

SEQ ID NO: 711146 - DNA, 25 bp, Artificial sequence
  Synthetic oligonucleotide
gagggcagagctcaccatctggacg

SEQ ID NO: 711147 - DNA, 25 bp, Artificial sequence
  Synthetic oligonucleotide
gagggcagagctgaccatctggacg

SEQ ID NO: 711148 - DNA, 25 bp, Artificial sequence
  Synthetic oligonucleotide
gggcagagctgagcatctggacgga

SEQ ID NO: 711149 - DNA, 25 bp, Artificial sequence
  Synthetic oligonucleotide
gggcagagctgaccatctggacgga

SEQ ID NO: 711150 - DNA, 25 bp, Artificial sequence
  Synthetic oligonucleotide
ggcagagctgacgatctggacggac

SEQ ID NO: 711151 - DNA, 25 bp, Artificial sequence
  Synthetic oligonucleotide
ggcagagctgaccatctggacggac

SEQ ID NO: 711152 - DNA, 25 bp, Artificial sequence
  Synthetic oligonucleotide
gcagagctgaccttctggacggaca

SEQ ID NO: 711153 - DNA, 25 bp, Artificial sequence
  Synthetic oligonucleotide
ccatctggacggacacagtgatttc

SEQ ID NO: 711154 - DNA, 25 bp, Artificial sequence
  Synthetic oligonucleotide
cagagctgaccatctggacggacac

SEQ ID NO: 711155 - DNA, 25 bp, Artificial sequence
  Synthetic oligonucleotide
tgaatgagggcacagctgaccatct

SEQ ID NO: 711156 - DNA, 25 bp, Artificial sequence
  Synthetic oligonucleotide
agagctgaccatctggacggacaca

SEQ ID NO: 711157 - DNA, 25 bp, Artificial sequence
  Synthetic oligonucleotide
agagctgaccatgtggacggacaca

SEQ ID NO: 711158 - DNA, 25 bp, Artificial sequence
  Synthetic oligonucleotide
gagctgaccatcaggacggacacag

SEQ ID NO: 711159 - DNA, 25 bp, Artificial sequence
  Synthetic oligonucleotide
gagctgaccatctggacggacacag

SEQ ID NO: 711160 - DNA, 25 bp, Artificial sequence
  Synthetic oligonucleotide
agctgaccatctcgacggacacagt

SEQ ID NO: 711161 - DNA, 25 bp, Artificial sequence
  Synthetic oligonucleotide
agctgaccatctggacggacacagt

SEQ ID NO: 711162 - DNA, 25 bp, Artificial sequence
  Synthetic oligonucleotide
gctgaccatctggacggacacagtg

SEQ ID NO: 711163 - DNA, 25 bp, Artificial sequence
  Synthetic oligonucleotide
gctgaccatctgcacggacacagtg

SEQ ID NO: 711164 - DNA, 25 bp, Artificial sequence
  Synthetic oligonucleotide
tgaccatctggacggacacagtgat

SEQ ID NO: 711165 - DNA, 25 bp, Artificial sequence
  Synthetic oligonucleotide
tgaccatctggagggacacagtgat

SEQ ID NO: 711166 - DNA, 25 bp, Artificial sequence
  Synthetic oligonucleotide
gaccatctggacggacacagtgatt

SEQ ID NO: 711167 - DNA, 25 bp, Artificial sequence
  Synthetic oligonucleotide
gaccatctggaccgacacagtgatt

SEQ ID NO: 711168 - DNA, 25 bp, Artificial sequence
  Synthetic oligonucleotide
accatctggacgcacacagtgattt

SEQ ID NO: 711169 - DNA, 25 bp, Artificial sequence
  Synthetic oligonucleotide
gcagagctgaccatctggacggaca

SEQ ID NO: 711170 - DNA, 25 bp, Artificial sequence
  Synthetic oligonucleotide
cacagtgatttcaatggaaggcttg

SEQ ID NO: 711171 - DNA, 25 bp, Artificial sequence
  Synthetic oligonucleotide
gacggacacagtgatttctatggaa

SEQ ID NO: 711172 - DNA, 25 bp, Artificial sequence
  Synthetic oligonucleotide
tgaatgagggcacagctgaccatct

SEQ ID NO: 711173 - DNA, 25 bp, Artificial sequence
  Synthetic oligonucleotide
ccatctggacggacacagtgatttc

SEQ ID NO: 711174 - DNA, 25 bp, Artificial sequence
  Synthetic oligonucleotide
catctggacggacacagtgatttct

SEQ ID NO: 711175 - DNA, 25 bp, Artificial sequence
  Synthetic oligonucleotide
catctggacggagacagtgatttct

SEQ ID NO: 711176 - DNA, 25 bp, Artificial sequence
  Synthetic oligonucleotide
atctggacggacacagtgatttcta

SEQ ID NO: 711177 - DNA, 25 bp, Artificial sequence
  Synthetic oligonucleotide
atctggacggactcagtgatttcta

SEQ ID NO: 711178 - DNA, 25 bp, Artificial sequence
  Synthetic oligonucleotide
tctggacggacacagtgatttctat

SEQ ID NO: 711179 - DNA, 25 bp, Artificial sequence
  Synthetic oligonucleotide
tctggacggacagagtgatttctat

SEQ ID NO: 711180 - DNA, 25 bp, Artificial sequence
  Synthetic oligonucleotide
ctggacggacactgtgatttctatg

SEQ ID NO: 711181 - DNA, 25 bp, Artificial sequence
  Synthetic oligonucleotide
ctggacggacacagtgatttctatg

SEQ ID NO: 711182 - DNA, 25 bp, Artificial sequence
  Synthetic oligonucleotide
tggacggacacagtgatttctatgg

SEQ ID NO: 711183 - DNA, 25 bp, Artificial sequence
  Synthetic oligonucleotide
tggacggacacactgatttctatgg

SEQ ID NO: 711184 - DNA, 25 bp, Artificial sequence
  Synthetic oligonucleotide
ggacggacacagagatttctatgga

SEQ ID NO: 711185 - DNA, 25 bp, Artificial sequence
  Synthetic oligonucleotide
accatctggacgcacacagtgattt

SEQ ID NO: 711186 - DNA, 25 bp, Artificial sequence
  Synthetic oligonucleotide
gacggacacagtcatttctatggaa

SEQ ID NO: 711187 - DNA, 25 bp, Artificial sequence
  Synthetic oligonucleotide
acggacacagtgatttctatggaag

SEQ ID NO: 711188 - DNA, 25 bp, Artificial sequence
  Synthetic oligonucleotide
acggacacagtgttttctatggaag

SEQ ID NO: 711189 - DNA, 25 bp, Artificial sequence
  Synthetic oligonucleotide
cggacacagtgatttctatggaagg

SEQ ID NO: 711190 - DNA, 25 bp, Artificial sequence
  Synthetic oligonucleotide
cggacacagtgaattctatggaagg

SEQ ID NO: 711191 - DNA, 25 bp, Artificial sequence
  Synthetic oligonucleotide
ggacacagtgatatctatggaaggc

SEQ ID NO: 711192 - DNA, 25 bp, Artificial sequence
  Synthetic oligonucleotide
ggacacagtgatttctatggaaggc

SEQ ID NO: 711193 - DNA, 25 bp, Artificial sequence
  Synthetic oligonucleotide
gacacagtgattactatggaaggct

SEQ ID NO: 711194 - DNA, 25 bp, Artificial sequence
  Synthetic oligonucleotide
gacacagtgatttctatggaaggct

SEQ ID NO: 711195 - DNA, 25 bp, Artificial sequence
  Synthetic oligonucleotide
acacagtgatttctatggaaggctt

SEQ ID NO: 711196 - DNA, 25 bp, Artificial sequence
  Synthetic oligonucleotide
acacagtgatttgtatggaaggctt

SEQ ID NO: 711197 - DNA, 25 bp, Artificial sequence
  Synthetic oligonucleotide
cacagtgatttctatggaaggcttg

SEQ ID NO: 711198 - DNA, 25 bp, Artificial sequence
  Synthetic oligonucleotide
cacagtgatttcaatggaaggcttg

SEQ ID NO: 711199 - DNA, 25 bp, Artificial sequence
  Synthetic oligonucleotide
ggacggacacagtgatttctatgga

SEQ ID NO: 711200 - DNA, 25 bp, Artificial sequence
  Synthetic oligonucleotide
cagagctgaccatctggacggacac

SEQ ID NO: 711201 - DNA, 25 bp, Artificial sequence
  Synthetic oligonucleotide
ggcagagctgacgatctggacggac

SEQ ID NO: 711202 - DNA, 25 bp, Artificial sequence
  Synthetic oligonucleotide
tgaatgagggcagagctgaccatct

SEQ ID NO: 711203 - DNA, 25 bp, Artificial sequence
  Synthetic oligonucleotide
aatgagggcagacctgaccatctgg

SEQ ID NO: 711204 - DNA, 25 bp, Artificial sequence
  Synthetic oligonucleotide
aatgagggcagagctgaccatctgg

SEQ ID NO: 711205 - DNA, 25 bp, Artificial sequence
  Synthetic oligonucleotide
atgagggcagagctgaccatctgga

SEQ ID NO: 711206 - DNA, 25 bp, Artificial sequence
  Synthetic oligonucleotide
atgagggcagaggtgaccatctgga

SEQ ID NO: 711207 - DNA, 25 bp, Artificial sequence
  Synthetic oligonucleotide
tgagggcagagctgaccatctggac

SEQ ID NO: 711208 - DNA, 25 bp, Artificial sequence
  Synthetic oligonucleotide
tgagggcagagcagaccatctggac

SEQ ID NO: 711209 - DNA, 25 bp, Artificial sequence
  Synthetic oligonucleotide
gagggcagagctcaccatctggacg

SEQ ID NO: 711210 - DNA, 25 bp, Artificial sequence
  Synthetic oligonucleotide
gagggcagagctgaccatctggacg

SEQ ID NO: 711211 - DNA, 25 bp, Artificial sequence
  Synthetic oligonucleotide
gggcagagctgaccatctggacgga

SEQ ID NO: 711212 - DNA, 25 bp, Artificial sequence
  Synthetic oligonucleotide
gggcagagctgagcatctggacgga

SEQ ID NO: 711213 - DNA, 25 bp, Artificial sequence
  Synthetic oligonucleotide
ccatctggacggtcacagtgatttc

SEQ ID NO: 711214 - DNA, 25 bp, Artificial sequence
  Synthetic oligonucleotide
gcagagctgaccatctggacggaca

SEQ ID NO: 711215 - DNA, 25 bp, Artificial sequence
  Synthetic oligonucleotide
accatctggacggacacagtgattt

SEQ ID NO: 711216 - DNA, 25 bp, Artificial sequence
  Synthetic oligonucleotide
cagagctgaccaactggacggacac

SEQ ID NO: 711217 - DNA, 25 bp, Artificial sequence
  Synthetic oligonucleotide
agagctgaccatgtggacggacaca

SEQ ID NO: 711218 - DNA, 25 bp, Artificial sequence
  Synthetic oligonucleotide
agagctgaccatctggacggacaca

SEQ ID NO: 711219 - DNA, 25 bp, Artificial sequence
  Synthetic oligonucleotide
gagctgaccatcaggacggacacag

SEQ ID NO: 711220 - DNA, 25 bp, Artificial sequence
  Synthetic oligonucleotide
gagctgaccatctggacggacacag

SEQ ID NO: 711221 - DNA, 25 bp, Artificial sequence
  Synthetic oligonucleotide
agctgaccatctggacggacacagt

SEQ ID NO: 711222 - DNA, 25 bp, Artificial sequence
  Synthetic oligonucleotide
agctgaccatctcgacggacacagt

SEQ ID NO: 711223 - DNA, 25 bp, Artificial sequence
  Synthetic oligonucleotide
gctgaccatctggacggacacagtg

SEQ ID NO: 711224 - DNA, 25 bp, Artificial sequence
  Synthetic oligonucleotide
gctgaccatctgcacggacacagtg

SEQ ID NO: 711225 - DNA, 25 bp, Artificial sequence
  Synthetic oligonucleotide
tgaccatctggagggacacagtgat

SEQ ID NO: 711226 - DNA, 25 bp, Artificial sequence
  Synthetic oligonucleotide
tgaccatctggacggacacagtgat

SEQ ID NO: 711227 - DNA, 25 bp, Artificial sequence
  Synthetic oligonucleotide
gaccatctggaccgacacagtgatt

SEQ ID NO: 711228 - DNA, 25 bp, Artificial sequence
  Synthetic oligonucleotide
gaccatctggacggacacagtgatt

SEQ ID NO: 711229 - DNA, 25 bp, Artificial sequence
  Synthetic oligonucleotide
ggcagagctgaccatctggacggac

SEQ ID NO: 711230 - DNA, 25 bp, Artificial sequence
  Synthetic oligonucleotide
gcagagctgaccttctggacggaca

SEQ ID NO: 711231 - DNA, 25 bp, Artificial sequence
  Synthetic oligonucleotide
agtggcagcgacctttggggctgat

SEQ ID NO: 711232 - DNA, 25 bp, Artificial sequence
  Synthetic oligonucleotide
catgttggaagtggcagcgacgttt

SEQ ID NO: 711233 - DNA, 25 bp, Artificial sequence
  Synthetic oligonucleotide
catgttggaagtcgcagcgacgttt

SEQ ID NO: 711234 - DNA, 25 bp, Artificial sequence
  Synthetic oligonucleotide
tgttggaagtggcagcgacgtttgg

SEQ ID NO: 711235 - DNA, 25 bp, Artificial sequence
  Synthetic oligonucleotide
tgttggaagtgggagcgacgtttgg

SEQ ID NO: 711236 - DNA, 25 bp, Artificial sequence
  Synthetic oligonucleotide
gttggaagtggcagcgacgtttggg

SEQ ID NO: 711237 - DNA, 25 bp, Artificial sequence
  Synthetic oligonucleotide
gttggaagtggctgcgacgtttggg

SEQ ID NO: 711238 - DNA, 25 bp, Artificial sequence
  Synthetic oligonucleotide
ttggaagtggcagcgacgtttgggg

SEQ ID NO: 711239 - DNA, 25 bp, Artificial sequence
  Synthetic oligonucleotide
ttggaagtggcaccgacgtttgggg

SEQ ID NO: 711240 - DNA, 25 bp, Artificial sequence
  Synthetic oligonucleotide
tggaagtggcagcgacgtttggggc

SEQ ID NO: 711241 - DNA, 25 bp, Artificial sequence
  Synthetic oligonucleotide
tggaagtggcagggacgtttggggc

SEQ ID NO: 711242 - DNA, 25 bp, Artificial sequence
  Synthetic oligonucleotide
ggaagtggcagcgacgtttggggct

SEQ ID NO: 711243 - DNA, 25 bp, Artificial sequence
  Synthetic oligonucleotide
ggaagtggcagccacgtttggggct

SEQ ID NO: 711244 - DNA, 25 bp, Artificial sequence
  Synthetic oligonucleotide
tcatgttggaagaggcagcgacgtt

SEQ ID NO: 711245 - DNA, 25 bp, Artificial sequence
  Synthetic oligonucleotide
agtggcagcgacgtttggggctgat

SEQ ID NO: 711246 - DNA, 25 bp, Artificial sequence
  Synthetic oligonucleotide
aagtggcagcgacgtttggggctga

SEQ ID NO: 711247 - DNA, 25 bp, Artificial sequence
  Synthetic oligonucleotide
tggcagcgacgtttggggctgatcc

SEQ ID NO: 711248 - DNA, 25 bp, Artificial sequence
  Synthetic oligonucleotide
tggcagcgacgtatggggctgatcc

SEQ ID NO: 711249 - DNA, 25 bp, Artificial sequence
  Synthetic oligonucleotide
ggcagcgacgtttggggctgatccc

SEQ ID NO: 711250 - DNA, 25 bp, Artificial sequence
  Synthetic oligonucleotide
ggcagcgacgttaggggctgatccc

SEQ ID NO: 711251 - DNA, 25 bp, Artificial sequence
  Synthetic oligonucleotide
tgctgaggaggcccctctctcatgt

SEQ ID NO: 711252 - DNA, 25 bp, Artificial sequence
  Synthetic oligonucleotide
tgctgaggaggcgcctctctcatgt

SEQ ID NO: 711253 - DNA, 25 bp, Artificial sequence
  Synthetic oligonucleotide
ttgctgaggagggccctctctcatg

SEQ ID NO: 711254 - DNA, 25 bp, Artificial sequence
  Synthetic oligonucleotide
ttgctgaggaggcccctctctcatg

SEQ ID NO: 711255 - DNA, 25 bp, Artificial sequence
  Synthetic oligonucleotide
attgctgaggagccccctctctcat

SEQ ID NO: 711256 - DNA, 25 bp, Artificial sequence
  Synthetic oligonucleotide
attgctgaggaggcccctctctcat

SEQ ID NO: 711257 - DNA, 25 bp, Artificial sequence
  Synthetic oligonucleotide
cattgctgaggacgcccctctctca

SEQ ID NO: 711258 - DNA, 25 bp, Artificial sequence
  Synthetic oligonucleotide
gaggaggcccctctctcatgttgga

SEQ ID NO: 711259 - DNA, 25 bp, Artificial sequence
  Synthetic oligonucleotide
gaggaggcccctgtctcatgttgga

SEQ ID NO: 711260 - DNA, 25 bp, Artificial sequence
  Synthetic oligonucleotide
gaggcccctctcacatgttggaagt

SEQ ID NO: 711261 - DNA, 25 bp, Artificial sequence
  Synthetic oligonucleotide
cattgctgaggaggcccctctctca

SEQ ID NO: 711262 - DNA, 25 bp, Artificial sequence
  Synthetic oligonucleotide
cccctctctcatgttggaagtggca

SEQ ID NO: 711263 - DNA, 25 bp, Artificial sequence
  Synthetic oligonucleotide
gcccctctctcaagttggaagtggc

SEQ ID NO: 711264 - DNA, 25 bp, Artificial sequence
  Synthetic oligonucleotide
gcccctctctcatgttggaagtggc

SEQ ID NO: 711265 - DNA, 25 bp, Artificial sequence
  Synthetic oligonucleotide
ggcccctctctcatgttggaagtgg

SEQ ID NO: 711266 - DNA, 25 bp, Artificial sequence
  Synthetic oligonucleotide
ggcccctctctcttgttggaagtgg

SEQ ID NO: 711267 - DNA, 25 bp, Artificial sequence
  Synthetic oligonucleotide
cccctctctcatcttggaagtggca

SEQ ID NO: 711268 - DNA, 25 bp, Artificial sequence
  Synthetic oligonucleotide
aggcccctctctcatgttggaagtg

SEQ ID NO: 711269 - DNA, 25 bp, Artificial sequence
  Synthetic oligonucleotide
ggaggcccctctctcatgttggaag

SEQ ID NO: 711270 - DNA, 25 bp, Artificial sequence
  Synthetic oligonucleotide
gaggcccctctctcatgttggaagt

SEQ ID NO: 711271 - DNA, 25 bp, Artificial sequence
  Synthetic oligonucleotide
tcatgttggaagtggcagcgacgtt

SEQ ID NO: 711272 - DNA, 25 bp, Artificial sequence
  Synthetic oligonucleotide
ggaggcccctctgtcatgttggaag

SEQ ID NO: 711273 - DNA, 25 bp, Artificial sequence
  Synthetic oligonucleotide
aagtggcagcgaggtttggggctga

SEQ ID NO: 711274 - DNA, 25 bp, Artificial sequence
  Synthetic oligonucleotide
aggaggcccctcactcatgttggaa

SEQ ID NO: 711275 - DNA, 25 bp, Artificial sequence
  Synthetic oligonucleotide
aggaggcccctctctcatgttggaa

SEQ ID NO: 711276 - DNA, 25 bp, Artificial sequence
  Synthetic oligonucleotide
aggcccctctctgatgttggaagtg

SEQ ID NO: 711277 - DNA, 25 bp, Artificial sequence
  Synthetic oligonucleotide
tctcatgttggaagtggcagcgacg

SEQ ID NO: 711278 - DNA, 25 bp, Artificial sequence
  Synthetic oligonucleotide
ctcatgttggaactggcagcgacgt

SEQ ID NO: 711279 - DNA, 25 bp, Artificial sequence
  Synthetic oligonucleotide
ctcatgttggaagtggcagcgacgt

SEQ ID NO: 711280 - DNA, 25 bp, Artificial sequence
  Synthetic oligonucleotide
tctcatgttggatgtggcagcgacg

SEQ ID NO: 711281 - DNA, 25 bp, Artificial sequence
  Synthetic oligonucleotide
ctctcatgttggtagtggcagcgac

SEQ ID NO: 711282 - DNA, 25 bp, Artificial sequence
  Synthetic oligonucleotide
ctctcatgttggaagtggcagcgac

SEQ ID NO: 711283 - DNA, 25 bp, Artificial sequence
  Synthetic oligonucleotide
tctctcatgttgcaagtggcagcga

SEQ ID NO: 711284 - DNA, 25 bp, Artificial sequence
  Synthetic oligonucleotide
tctctcatgttggaagtggcagcga

SEQ ID NO: 711285 - DNA, 25 bp, Artificial sequence
  Synthetic oligonucleotide
ctctctcatgttggaagtggcagcg

SEQ ID NO: 711286 - DNA, 25 bp, Artificial sequence
  Synthetic oligonucleotide
cctctctcatgtaggaagtggcagc

SEQ ID NO: 711287 - DNA, 25 bp, Artificial sequence
  Synthetic oligonucleotide
cctctctcatgttggaagtggcagc

SEQ ID NO: 711288 - DNA, 25 bp, Artificial sequence
  Synthetic oligonucleotide
ccctctctcatgttggaagtggcag

SEQ ID NO: 711289 - DNA, 25 bp, Artificial sequence
  Synthetic oligonucleotide
ccctctctcatgatggaagtggcag

SEQ ID NO: 711290 - DNA, 25 bp, Artificial sequence
  Synthetic oligonucleotide
ctctctcatgttcgaagtggcagcg

SEQ ID NO: 711291 - DNA, 25 bp, Artificial sequence
  Synthetic oligonucleotide
ctcatgttggaagtggcagcgacgt

SEQ ID NO: 711292 - DNA, 25 bp, Artificial sequence
  Synthetic oligonucleotide
ctctcatgttggtagtggcagcgac

SEQ ID NO: 711293 - DNA, 25 bp, Artificial sequence
  Synthetic oligonucleotide
gttggaagtggcagcgacgtttggg

SEQ ID NO: 711294 - DNA, 25 bp, Artificial sequence
  Synthetic oligonucleotide
tgttggaagtgggagcgacgtttgg

SEQ ID NO: 711295 - DNA, 25 bp, Artificial sequence
  Synthetic oligonucleotide
tgttggaagtggcagcgacgtttgg

SEQ ID NO: 711296 - DNA, 25 bp, Artificial sequence
  Synthetic oligonucleotide
catgttggaagtggcagcgacgttt

SEQ ID NO: 711297 - DNA, 25 bp, Artificial sequence
  Synthetic oligonucleotide
catgttggaagtcgcagcgacgttt

SEQ ID NO: 711298 - DNA, 25 bp, Artificial sequence
  Synthetic oligonucleotide
tcatgttggaagtggcagcgacgtt

SEQ ID NO: 711299 - DNA, 25 bp, Artificial sequence
  Synthetic oligonucleotide
tctcatgttggaagtggcagcgacg

SEQ ID NO: 711300 - DNA, 25 bp, Artificial sequence
  Synthetic oligonucleotide
ctcatgttggaactggcagcgacgt

SEQ ID NO: 711301 - DNA, 25 bp, Artificial sequence
  Synthetic oligonucleotide
tctcatgttggatgtggcagcgacg

SEQ ID NO: 711302 - DNA, 25 bp, Artificial sequence
  Synthetic oligonucleotide
ctctcatgttggaagtggcagcgac

SEQ ID NO: 711303 - DNA, 25 bp, Artificial sequence
  Synthetic oligonucleotide
ggaagtggcagccacgtttggggct

SEQ ID NO: 711304 - DNA, 25 bp, Artificial sequence
  Synthetic oligonucleotide
tcatgttggaagaggcagcgacgtt

SEQ ID NO: 711305 - DNA, 25 bp, Artificial sequence
  Synthetic oligonucleotide
aagtggcagcgaggtttggggctga

SEQ ID NO: 711306 - DNA, 25 bp, Artificial sequence
  Synthetic oligonucleotide
tctctcatgttgcaagtggcagcga

SEQ ID NO: 711307 - DNA, 25 bp, Artificial sequence
  Synthetic oligonucleotide
ggaggcccctctctcatgttggaag

SEQ ID NO: 711308 - DNA, 25 bp, Artificial sequence
  Synthetic oligonucleotide
tggcagcgacgtatggggctgatcc

SEQ ID NO: 711309 - DNA, 25 bp, Artificial sequence
  Synthetic oligonucleotide
tggcagcgacgtttggggctgatcc

SEQ ID NO: 711310 - DNA, 25 bp, Artificial sequence
  Synthetic oligonucleotide
agtggcagcgacctttggggctgat

SEQ ID NO: 711311 - DNA, 25 bp, Artificial sequence
  Synthetic oligonucleotide
tggaagtggcagggacgtttggggc

SEQ ID NO: 711312 - DNA, 25 bp, Artificial sequence
  Synthetic oligonucleotide
aagtggcagcgacgtttggggctga

SEQ ID NO: 711313 - DNA, 25 bp, Artificial sequence
  Synthetic oligonucleotide
gttggaagtggctgcgacgtttggg

SEQ ID NO: 711314 - DNA, 25 bp, Artificial sequence
  Synthetic oligonucleotide
ggcagcgacgtttggggctgatccc

SEQ ID NO: 711315 - DNA, 25 bp, Artificial sequence
  Synthetic oligonucleotide
ggaagtggcagcgacgtttggggct

SEQ ID NO: 711316 - DNA, 25 bp, Artificial sequence
  Synthetic oligonucleotide
ggcagcgacgttaggggctgatccc

SEQ ID NO: 711317 - DNA, 25 bp, Artificial sequence
  Synthetic oligonucleotide
tggaagtggcagcgacgtttggggc

SEQ ID NO: 711318 - DNA, 25 bp, Artificial sequence
  Synthetic oligonucleotide
ttggaagtggcagcgacgtttgggg

SEQ ID NO: 711319 - DNA, 25 bp, Artificial sequence
  Synthetic oligonucleotide
ttggaagtggcaccgacgtttgggg

SEQ ID NO: 711320 - DNA, 25 bp, Artificial sequence
  Synthetic oligonucleotide
agtggcagcgacgtttggggctgat

SEQ ID NO: 711321 - DNA, 25 bp, Artificial sequence
  Synthetic oligonucleotide
tgctgaggaggcgcctctctcatgt

SEQ ID NO: 711322 - DNA, 25 bp, Artificial sequence
  Synthetic oligonucleotide
gaggcccctctctcatgttggaagt

SEQ ID NO: 711323 - DNA, 25 bp, Artificial sequence
  Synthetic oligonucleotide
tctctcatgttggaagtggcagcga

SEQ ID NO: 711324 - DNA, 25 bp, Artificial sequence
  Synthetic oligonucleotide
cattgctgaggacgcccctctctca

SEQ ID NO: 711325 - DNA, 25 bp, Artificial sequence
  Synthetic oligonucleotide
attgctgaggaggcccctctctcat

SEQ ID NO: 711326 - DNA, 25 bp, Artificial sequence
  Synthetic oligonucleotide
attgctgaggagccccctctctcat

SEQ ID NO: 711327 - DNA, 25 bp, Artificial sequence
  Synthetic oligonucleotide
ttgctgaggaggcccctctctcatg

SEQ ID NO: 711328 - DNA, 25 bp, Artificial sequence
  Synthetic oligonucleotide
tgctgaggaggcccctctctcatgt

SEQ ID NO: 711329 - DNA, 25 bp, Artificial sequence
  Synthetic oligonucleotide
cattgctgaggaggcccctctctca

SEQ ID NO: 711330 - DNA, 25 bp, Artificial sequence
  Synthetic oligonucleotide
gaggaggcccctgtctcatgttgga

SEQ ID NO: 711331 - DNA, 25 bp, Artificial sequence
  Synthetic oligonucleotide
gaggaggcccctctctcatgttgga

SEQ ID NO: 711332 - DNA, 25 bp, Artificial sequence
  Synthetic oligonucleotide
aggaggcccctcactcatgttggaa

SEQ ID NO: 711333 - DNA, 25 bp, Artificial sequence
  Synthetic oligonucleotide
aggaggcccctctctcatgttggaa

SEQ ID NO: 711334 - DNA, 25 bp, Artificial sequence
  Synthetic oligonucleotide
ggaggcccctctgtcatgttggaag

SEQ ID NO: 711335 - DNA, 25 bp, Artificial sequence
  Synthetic oligonucleotide
gaggcccctctcacatgttggaagt

SEQ ID NO: 711336 - DNA, 25 bp, Artificial sequence
  Synthetic oligonucleotide
ctctctcatgttggaagtggcagcg

SEQ ID NO: 711337 - DNA, 25 bp, Artificial sequence
  Synthetic oligonucleotide
ttgctgaggagggccctctctcatg

SEQ ID NO: 711338 - DNA, 25 bp, Artificial sequence
  Synthetic oligonucleotide
ctctctcatgttcgaagtggcagcg

SEQ ID NO: 711339 - DNA, 25 bp, Artificial sequence
  Synthetic oligonucleotide
aggcccctctctgatgttggaagtg

SEQ ID NO: 711340 - DNA, 25 bp, Artificial sequence
  Synthetic oligonucleotide
cctctctcatgtaggaagtggcagc

SEQ ID NO: 711341 - DNA, 25 bp, Artificial sequence
  Synthetic oligonucleotide
cctctctcatgttggaagtggcagc

SEQ ID NO: 711342 - DNA, 25 bp, Artificial sequence
  Synthetic oligonucleotide
ccctctctcatgatggaagtggcag

SEQ ID NO: 711343 - DNA, 25 bp, Artificial sequence
  Synthetic oligonucleotide
ccctctctcatgttggaagtggcag

SEQ ID NO: 711344 - DNA, 25 bp, Artificial sequence
  Synthetic oligonucleotide
cccctctctcatcttggaagtggca

SEQ ID NO: 711345 - DNA, 25 bp, Artificial sequence
  Synthetic oligonucleotide
cccctctctcatgttggaagtggca

SEQ ID NO: 711346 - DNA, 25 bp, Artificial sequence
  Synthetic oligonucleotide
gcccctctctcatgttggaagtggc

SEQ ID NO: 711347 - DNA, 25 bp, Artificial sequence
  Synthetic oligonucleotide
gcccctctctcaagttggaagtggc

SEQ ID NO: 711348 - DNA, 25 bp, Artificial sequence
  Synthetic oligonucleotide
ggcccctctctcatgttggaagtgg

SEQ ID NO: 711349 - DNA, 25 bp, Artificial sequence
  Synthetic oligonucleotide
ggcccctctctcttgttggaagtgg

SEQ ID NO: 711350 - DNA, 25 bp, Artificial sequence
  Synthetic oligonucleotide
aggcccctctctcatgttggaagtg

SEQ ID NO: 711351 - DNA, 25 bp, Artificial sequence
  Synthetic oligonucleotide
ggtggctccatcttggcctcactgt

SEQ ID NO: 711352 - DNA, 25 bp, Artificial sequence
  Synthetic oligonucleotide
cgtgacatcaaagagaagctgtgct

SEQ ID NO: 711353 - DNA, 25 bp, Artificial sequence
  Synthetic oligonucleotide
tcctccctggagaagagctatgagc

SEQ ID NO: 711354 - DNA, 25 bp, Artificial sequence
  Synthetic oligonucleotide
caagtcatcactattggcaacgagc

SEQ ID NO: 711355 - DNA, 25 bp, Artificial sequence
  Synthetic oligonucleotide
gatgccctgaggctcttttccagcc

SEQ ID NO: 711356 - DNA, 25 bp, Artificial sequence
  Synthetic oligonucleotide
ggaatcctgtggcatccatgaaact

SEQ ID NO: 711357 - DNA, 25 bp, Artificial sequence
  Synthetic oligonucleotide
catcatgaagtgtgacgttgacatc

SEQ ID NO: 711358 - DNA, 25 bp, Artificial sequence
  Synthetic oligonucleotide
ccaacacagtgttgtctggtggtac

SEQ ID NO: 711359 - DNA, 25 bp, Artificial sequence
  Synthetic oligonucleotide
caggcattgctgacaggatgcagaa

SEQ ID NO: 711360 - DNA, 25 bp, Artificial sequence
  Synthetic oligonucleotide
cctccatcgtgcaccgcaagtgctt

SEQ ID NO: 711361 - DNA, 25 bp, Artificial sequence
  Synthetic oligonucleotide
tcctcctgagcgcaagtactctgtg

SEQ ID NO: 711362 - DNA, 25 bp, Artificial sequence
  Synthetic oligonucleotide
tgttactgagctgcgttttacaccc

SEQ ID NO: 711363 - DNA, 25 bp, Artificial sequence
  Synthetic oligonucleotide
cagatgtggatcagcaagcaggagt

SEQ ID NO: 711364 - DNA, 25 bp, Artificial sequence
  Synthetic oligonucleotide
tctggctcctagcaccatgaagatc

SEQ ID NO: 711365 - DNA, 25 bp, Artificial sequence
  Synthetic oligonucleotide
gactacctcatgaagatcctgaccg

SEQ ID NO: 711366 - DNA, 25 bp, Artificial sequence
  Synthetic oligonucleotide
catcctgcgtctggacttggctggc

SEQ ID NO: 711367 - DNA, 25 bp, Artificial sequence
  Synthetic oligonucleotide
cacactgtgcccatctacgagggct

SEQ ID NO: 711368 - DNA, 25 bp, Artificial sequence
  Synthetic oligonucleotide
taccacgggcattgtgatggactcc

SEQ ID NO: 711369 - DNA, 25 bp, Artificial sequence
  Synthetic oligonucleotide
ccatccaggctgtgctgtccctgta

SEQ ID NO: 711370 - DNA, 25 bp, Artificial sequence
  Synthetic oligonucleotide
tgtttgagaccttcaacaccccagc

SEQ ID NO: 711371 - DNA, 25 bp, Artificial sequence
  Synthetic oligonucleotide
taaggccaaccgtgaaaagatgacc

SEQ ID NO: 711372 - DNA, 25 bp, Artificial sequence
  Synthetic oligonucleotide
gcaccctgtgctgctcaccgaggcc

SEQ ID NO: 711373 - DNA, 25 bp, Artificial sequence
  Synthetic oligonucleotide
tctacaatgagctgcgtgtggcccc

SEQ ID NO: 711374 - DNA, 25 bp, Artificial sequence
  Synthetic oligonucleotide
taccaactgggacgacatggagaag

SEQ ID NO: 711375 - DNA, 25 bp, Artificial sequence
  Synthetic oligonucleotide
atcctgaccctgaagtaccccattg

SEQ ID NO: 711376 - DNA, 25 bp, Artificial sequence
  Synthetic oligonucleotide
tcctatgtgggtgacgaggcccaga

SEQ ID NO: 711377 - DNA, 25 bp, Artificial sequence
  Synthetic oligonucleotide
caaggtgtgatggtgggaatgggtc

SEQ ID NO: 711378 - DNA, 25 bp, Artificial sequence
  Synthetic oligonucleotide
gacttcgagcaggagatggccactg

SEQ ID NO: 711379 - DNA, 25 bp, Artificial sequence
  Synthetic oligonucleotide
ggctgtattcccctccatcgtgggc

SEQ ID NO: 711380 - DNA, 25 bp, Artificial sequence
  Synthetic oligonucleotide
gcttcaccaccacagctgagaggga

SEQ ID NO: 711381 - DNA, 25 bp, Artificial sequence
  Synthetic oligonucleotide
gccggacgcgaggagatgaacgaac

SEQ ID NO: 711382 - DNA, 25 bp, Artificial sequence
  Synthetic oligonucleotide
gtgctttatggctggcgcaaactcg

SEQ ID NO: 711383 - DNA, 25 bp, Artificial sequence
  Synthetic oligonucleotide
tcaggcgatgtgctttatggcaggc

SEQ ID NO: 711384 - DNA, 25 bp, Artificial sequence
  Synthetic oligonucleotide
tcaggcgatgtggtttatggcaggc

SEQ ID NO: 711385 - DNA, 25 bp, Artificial sequence
  Synthetic oligonucleotide
aacagactcaggggatgtgctttat

SEQ ID NO: 711386 - DNA, 25 bp, Artificial sequence
  Synthetic oligonucleotide
aacagactcaggcgatgtgctttat

SEQ ID NO: 711387 - DNA, 25 bp, Artificial sequence
  Synthetic oligonucleotide
gatgaacgaacagactcaggcgatg

SEQ ID NO: 711388 - DNA, 25 bp, Artificial sequence
  Synthetic oligonucleotide
gatgaacgaacacactcaggcgatg

SEQ ID NO: 711389 - DNA, 25 bp, Artificial sequence
  Synthetic oligonucleotide
cgagcagatgaaggaacagactcag

SEQ ID NO: 711390 - DNA, 25 bp, Artificial sequence
  Synthetic oligonucleotide
gtgctttatggcaggcgcaaactcg

SEQ ID NO: 711391 - DNA, 25 bp, Artificial sequence
  Synthetic oligonucleotide
gccggacgcgagcagatgaacgaac

SEQ ID NO: 711392 - DNA, 25 bp, Artificial sequence
  Synthetic oligonucleotide
ggatcatgatgccaacctcttacgt

SEQ ID NO: 711393 - DNA, 25 bp, Artificial sequence
  Synthetic oligonucleotide
gcgcctttctgccggacgcgagcag

SEQ ID NO: 711394 - DNA, 25 bp, Artificial sequence
  Synthetic oligonucleotide
gcgcctttctgcgggacgcgagcag

SEQ ID NO: 711395 - DNA, 25 bp, Artificial sequence
  Synthetic oligonucleotide
tgccaacctcttacgtgcgcctttc

SEQ ID NO: 711396 - DNA, 25 bp, Artificial sequence
  Synthetic oligonucleotide
tgccaacctctttcgtgcgcctttc

SEQ ID NO: 711397 - DNA, 25 bp, Artificial sequence
  Synthetic oligonucleotide
ggatcatgatgcgaacctcttacgt

SEQ ID NO: 711398 - DNA, 25 bp, Artificial sequence
  Synthetic oligonucleotide
ggtcgcgcggatgatgatgccaacc

SEQ ID NO: 711399 - DNA, 25 bp, Artificial sequence
  Synthetic oligonucleotide
ggtcgcgcggatcatgatgccaacc

SEQ ID NO: 711400 - DNA, 25 bp, Artificial sequence
  Synthetic oligonucleotide
cgagcagatgaacgaacagactcag

SEQ ID NO: 711401 - DNA, 25 bp, Artificial sequence
  Synthetic oligonucleotide
atattacaacgccgcagcattatga

SEQ ID NO: 711402 - DNA, 25 bp, Artificial sequence
  Synthetic oligonucleotide
atggcaggcgcaaactcgattttct

SEQ ID NO: 711403 - DNA, 25 bp, Artificial sequence
  Synthetic oligonucleotide
atattacaacgcggcagcattatga

SEQ ID NO: 711404 - DNA, 25 bp, Artificial sequence
  Synthetic oligonucleotide
acaggcgctgatgaccccggacacc

SEQ ID NO: 711405 - DNA, 25 bp, Artificial sequence
  Synthetic oligonucleotide
acaggcgctgatcaccccggacacc

SEQ ID NO: 711406 - DNA, 25 bp, Artificial sequence
  Synthetic oligonucleotide
cgtcttgaacaggcgctgatgaccc

SEQ ID NO: 711407 - DNA, 25 bp, Artificial sequence
  Synthetic oligonucleotide
cgtcttgaacagccgctgatgaccc

SEQ ID NO: 711408 - DNA, 25 bp, Artificial sequence
  Synthetic oligonucleotide
acagcaacgtcttgaacaggcgctg

SEQ ID NO: 711409 - DNA, 25 bp, Artificial sequence
  Synthetic oligonucleotide
acagcaacgtctagaacaggcgctg

SEQ ID NO: 711410 - DNA, 25 bp, Artificial sequence
  Synthetic oligonucleotide
cgcagcaaactgccgtgctggcagg

SEQ ID NO: 711411 - DNA, 25 bp, Artificial sequence
  Synthetic oligonucleotide
tacggttgcaaactgctgaccacgc

SEQ ID NO: 711412 - DNA, 25 bp, Artificial sequence
  Synthetic oligonucleotide
gggctaaatccgcagcaaactgccg

SEQ ID NO: 711413 - DNA, 25 bp, Artificial sequence
  Synthetic oligonucleotide
gggctaaatccggagcaaactgccg

SEQ ID NO: 711414 - DNA, 25 bp, Artificial sequence
  Synthetic oligonucleotide
gacctgcaactgttccgcaaactgg

SEQ ID NO: 711415 - DNA, 25 bp, Artificial sequence
  Synthetic oligonucleotide
gacctgcaactgatccgcaaactgg

SEQ ID NO: 711416 - DNA, 25 bp, Artificial sequence
  Synthetic oligonucleotide
caaactgctgacgacgccgaatccg

SEQ ID NO: 711417 - DNA, 25 bp, Artificial sequence
  Synthetic oligonucleotide
caaactgctgaccacgccgaatccg

SEQ ID NO: 711418 - DNA, 25 bp, Artificial sequence
  Synthetic oligonucleotide
tacggttgcaaagtgctgaccacgc

SEQ ID NO: 711419 - DNA, 25 bp, Artificial sequence
  Synthetic oligonucleotide
atggcaggcgcatactcgattttct

SEQ ID NO: 711420 - DNA, 25 bp, Artificial sequence
  Synthetic oligonucleotide
cgcagcaaactggcgtgctggcagg

SEQ ID NO: 711421 - DNA, 25 bp, Artificial sequence
  Synthetic oligonucleotide
cgagcagatgaaggaacagactcag

SEQ ID NO: 711422 - DNA, 25 bp, Artificial sequence
  Synthetic oligonucleotide
cgagcagatgaacgaacagactcag

SEQ ID NO: 711423 - DNA, 25 bp, Artificial sequence
  Synthetic oligonucleotide
gatgaacgaacacactcaggcgatg

SEQ ID NO: 711424 - DNA, 25 bp, Artificial sequence
  Synthetic oligonucleotide
gatgaacgaacagactcaggcgatg

SEQ ID NO: 711425 - DNA, 25 bp, Artificial sequence
  Synthetic oligonucleotide
aacagactcaggggatgtgctttat

SEQ ID NO: 711426 - DNA, 25 bp, Artificial sequence
  Synthetic oligonucleotide
aacagactcaggcgatgtgctttat

SEQ ID NO: 711427 - DNA, 25 bp, Artificial sequence
  Synthetic oligonucleotide
tcaggcgatgtggtttatggcaggc

SEQ ID NO: 711428 - DNA, 25 bp, Artificial sequence
  Synthetic oligonucleotide
tgccaacctcttacgtgcgcctttc

SEQ ID NO: 711429 - DNA, 25 bp, Artificial sequence
  Synthetic oligonucleotide
tcaggcgatgtgctttatggcaggc

SEQ ID NO: 711430 - DNA, 25 bp, Artificial sequence
  Synthetic oligonucleotide
gccggacgcgagcagatgaacgaac

SEQ ID NO: 711431 - DNA, 25 bp, Artificial sequence
  Synthetic oligonucleotide
gccggacgcgaggagatgaacgaac

SEQ ID NO: 711432 - DNA, 25 bp, Artificial sequence
  Synthetic oligonucleotide
gcgcctttctgccggacgcgagcag

SEQ ID NO: 711433 - DNA, 25 bp, Artificial sequence
  Synthetic oligonucleotide
ggtcgcgcggatgatgatgccaacc

SEQ ID NO: 711434 - DNA, 25 bp, Artificial sequence
  Synthetic oligonucleotide
tgccaacctctttcgtgcgcctttc

SEQ ID NO: 711435 - DNA, 25 bp, Artificial sequence
  Synthetic oligonucleotide
ggatcatgatgcgaacctcttacgt

SEQ ID NO: 711436 - DNA, 25 bp, Artificial sequence
  Synthetic oligonucleotide
ggatcatgatgccaacctcttacgt

SEQ ID NO: 711437 - DNA, 25 bp, Artificial sequence
  Synthetic oligonucleotide
gtgctttatggcaggcgcaaactcg

SEQ ID NO: 711438 - DNA, 25 bp, Artificial sequence
  Synthetic oligonucleotide
cgcagcaaactggcgtgctggcagg

SEQ ID NO: 711439 - DNA, 25 bp, Artificial sequence
  Synthetic oligonucleotide
gcgcctttctgcgggacgcgagcag

SEQ ID NO: 711440 - DNA, 25 bp, Artificial sequence
  Synthetic oligonucleotide
atattacaacgccgcagcattatga

SEQ ID NO: 711441 - DNA, 25 bp, Artificial sequence
  Synthetic oligonucleotide
ggtcgcgcggatcatgatgccaacc

SEQ ID NO: 711442 - DNA, 25 bp, Artificial sequence
  Synthetic oligonucleotide
acaggcgctgatgaccccggacacc

SEQ ID NO: 711443 - DNA, 25 bp, Artificial sequence
  Synthetic oligonucleotide
acaggcgctgatcaccccggacacc

SEQ ID NO: 711444 - DNA, 25 bp, Artificial sequence
  Synthetic oligonucleotide
cgtcttgaacaggcgctgatgaccc

SEQ ID NO: 711445 - DNA, 25 bp, Artificial sequence
  Synthetic oligonucleotide
cgtcttgaacagccgctgatgaccc

SEQ ID NO: 711446 - DNA, 25 bp, Artificial sequence
  Synthetic oligonucleotide
acagcaacgtcttgaacaggcgctg

SEQ ID NO: 711447 - DNA, 25 bp, Artificial sequence
  Synthetic oligonucleotide
acagcaacgtctagaacaggcgctg

SEQ ID NO: 711448 - DNA, 25 bp, Artificial sequence
  Synthetic oligonucleotide
gggctaaatccggagcaaactgccg

SEQ ID NO: 711449 - DNA, 25 bp, Artificial sequence
  Synthetic oligonucleotide
gggctaaatccgcagcaaactgccg

SEQ ID NO: 711450 - DNA, 25 bp, Artificial sequence
  Synthetic oligonucleotide
gtgctttatggctggcgcaaactcg

SEQ ID NO: 711451 - DNA, 25 bp, Artificial sequence
  Synthetic oligonucleotide
gacctgcaactgttccgcaaactgg

SEQ ID NO: 711452 - DNA, 25 bp, Artificial sequence
  Synthetic oligonucleotide
gacctgcaactgatccgcaaactgg

SEQ ID NO: 711453 - DNA, 25 bp, Artificial sequence
  Synthetic oligonucleotide
caaactgctgacgacgccgaatccg

SEQ ID NO: 711454 - DNA, 25 bp, Artificial sequence
  Synthetic oligonucleotide
caaactgctgaccacgccgaatccg

SEQ ID NO: 711455 - DNA, 25 bp, Artificial sequence
  Synthetic oligonucleotide
tacggttgcaaagtgctgaccacgc

SEQ ID NO: 711456 - DNA, 25 bp, Artificial sequence
  Synthetic oligonucleotide
tacggttgcaaactgctgaccacgc

SEQ ID NO: 711457 - DNA, 25 bp, Artificial sequence
  Synthetic oligonucleotide
atggcaggcgcatactcgattttct

SEQ ID NO: 711458 - DNA, 25 bp, Artificial sequence
  Synthetic oligonucleotide
atggcaggcgcaaactcgattttct

SEQ ID NO: 711459 - DNA, 25 bp, Artificial sequence
  Synthetic oligonucleotide
cgcagcaaactgccgtgctggcagg

SEQ ID NO: 711460 - DNA, 25 bp, Artificial sequence
  Synthetic oligonucleotide
atattacaacgcggcagcattatga

SEQ ID NO: 711461 - DNA, 25 bp, Artificial sequence
  Synthetic oligonucleotide
gcgcagcaggtggatcgccagcatt

SEQ ID NO: 711462 - DNA, 25 bp, Artificial sequence
  Synthetic oligonucleotide
cgatcctcgtcaggtgcaggtcagc

SEQ ID NO: 711463 - DNA, 25 bp, Artificial sequence
  Synthetic oligonucleotide
cgatcctcgtcacgtgcaggtcagc

SEQ ID NO: 711464 - DNA, 25 bp, Artificial sequence
  Synthetic oligonucleotide
gcatttcgatccacgtcaggtgcag

SEQ ID NO: 711465 - DNA, 25 bp, Artificial sequence
  Synthetic oligonucleotide
gcatttcgatcctcgtcaggtgcag

SEQ ID NO: 711466 - DNA, 25 bp, Artificial sequence
  Synthetic oligonucleotide
gcatcgccagcaattcgatcctcgt

SEQ ID NO: 711467 - DNA, 25 bp, Artificial sequence
  Synthetic oligonucleotide
gcatcgccagcatttcgatcctcgt

SEQ ID NO: 711468 - DNA, 25 bp, Artificial sequence
  Synthetic oligonucleotide
gcaggtgcatcgccagcatttcgat

SEQ ID NO: 711469 - DNA, 25 bp, Artificial sequence
  Synthetic oligonucleotide
gacattgtcgcaagtcacagaatta

SEQ ID NO: 711470 - DNA, 25 bp, Artificial sequence
  Synthetic oligonucleotide
gcgcagcaggtgcatcgccagcatt

SEQ ID NO: 711471 - DNA, 25 bp, Artificial sequence
  Synthetic oligonucleotide
gcaggtcagcaccttgctgtcgatt

SEQ ID NO: 711472 - DNA, 25 bp, Artificial sequence
  Synthetic oligonucleotide
ggatctgctgtttgaagcgcagcag

SEQ ID NO: 711473 - DNA, 25 bp, Artificial sequence
  Synthetic oligonucleotide
ggatctgctgttagaagcgcagcag

SEQ ID NO: 711474 - DNA, 25 bp, Artificial sequence
  Synthetic oligonucleotide
gttgctggatctgctgtttgaagcg

SEQ ID NO: 711475 - DNA, 25 bp, Artificial sequence
  Synthetic oligonucleotide
gttgctggatctcctgtttgaagcg

SEQ ID NO: 711476 - DNA, 25 bp, Artificial sequence
  Synthetic oligonucleotide
attgtcgcaagtcacagaattattt

SEQ ID NO: 711477 - DNA, 25 bp, Artificial sequence
  Synthetic oligonucleotide
attgtcgcaagtgacagaattattt

SEQ ID NO: 711478 - DNA, 25 bp, Artificial sequence
  Synthetic oligonucleotide
ggcaggatcgacccgcttctgtatg

SEQ ID NO: 711479 - DNA, 25 bp, Artificial sequence
  Synthetic oligonucleotide
gcaggtgcatcggcagcatttcgat

SEQ ID NO: 711480 - DNA, 25 bp, Artificial sequence
  Synthetic oligonucleotide
agattgcaaatagtgcccgcaaacg

SEQ ID NO: 711481 - DNA, 25 bp, Artificial sequence
  Synthetic oligonucleotide
caaagcgaaagcggcaggatcgacg

SEQ ID NO: 711482 - DNA, 25 bp, Artificial sequence
  Synthetic oligonucleotide
caaagcgaaagccgcaggatcgacg

SEQ ID NO: 711483 - DNA, 25 bp, Artificial sequence
  Synthetic oligonucleotide
ggagtcggcgcgcaaagcgaaagcg

SEQ ID NO: 711484 - DNA, 25 bp, Artificial sequence
  Synthetic oligonucleotide
ggagtcggcgcggaaagcgaaagcg

SEQ ID NO: 711485 - DNA, 25 bp, Artificial sequence
  Synthetic oligonucleotide
tgaacaggtgctggagtcggcgcgc

SEQ ID NO: 711486 - DNA, 25 bp, Artificial sequence
  Synthetic oligonucleotide
tgaacaggtgctcgagtcggcgcgc

SEQ ID NO: 711487 - DNA, 25 bp, Artificial sequence
  Synthetic oligonucleotide
caaatactgcccccaaacgtcgcgc

SEQ ID NO: 711488 - DNA, 25 bp, Artificial sequence
  Synthetic oligonucleotide
tcgtcaggtgcacgtcagcacgttg

SEQ ID NO: 711489 - DNA, 25 bp, Artificial sequence
  Synthetic oligonucleotide
agattgcaaatactgcccgcaaacg

SEQ ID NO: 711490 - DNA, 25 bp, Artificial sequence
  Synthetic oligonucleotide
tcgtcaggtgcaggtcagcacgttg

SEQ ID NO: 711491 - DNA, 25 bp, Artificial sequence
  Synthetic oligonucleotide
agcttgtccggaagattgcaaatac

SEQ ID NO: 711492 - DNA, 25 bp, Artificial sequence
  Synthetic oligonucleotide
agcttgtccggatgattgcaaatac

SEQ ID NO: 711493 - DNA, 25 bp, Artificial sequence
  Synthetic oligonucleotide
gctgtcgattaagaccggagcttgt

SEQ ID NO: 711494 - DNA, 25 bp, Artificial sequence
  Synthetic oligonucleotide
gctgtcgattaacaccggagcttgt

SEQ ID NO: 711495 - DNA, 25 bp, Artificial sequence
  Synthetic oligonucleotide
cagcacgttgctgtcgattaagacc

SEQ ID NO: 711496 - DNA, 25 bp, Artificial sequence
  Synthetic oligonucleotide
cagcacgttgctctcgattaagacc

SEQ ID NO: 711497 - DNA, 25 bp, Artificial sequence
  Synthetic oligonucleotide
gcaggtcagcacgttgctgtcgatt

SEQ ID NO: 711498 - DNA, 25 bp, Artificial sequence
  Synthetic oligonucleotide
gacattgtcgcatgtcacagaatta

SEQ ID NO: 711499 - DNA, 25 bp, Artificial sequence
  Synthetic oligonucleotide
caaatactgcccgcaaacgtcgcgc

SEQ ID NO: 711500 - DNA, 25 bp, Artificial sequence
  Synthetic oligonucleotide
ggcaggatcgacgcgcttctgtatg

SEQ ID NO: 711501 - DNA, 25 bp, Artificial sequence
  Synthetic oligonucleotide
gcgcagcaggtgcatcgccagcatt

SEQ ID NO: 711502 - DNA, 25 bp, Artificial sequence
  Synthetic oligonucleotide
ggcaggatcgacgcgcttctgtatg

SEQ ID NO: 711503 - DNA, 25 bp, Artificial sequence
  Synthetic oligonucleotide
cgatcctcgtcaggtgcaggtcagc

SEQ ID NO: 711504 - DNA, 25 bp, Artificial sequence
  Synthetic oligonucleotide
cgatcctcgtcacgtgcaggtcagc

SEQ ID NO: 711505 - DNA, 25 bp, Artificial sequence
  Synthetic oligonucleotide
gcatttcgatcctcgtcaggtgcag

SEQ ID NO: 711506 - DNA, 25 bp, Artificial sequence
  Synthetic oligonucleotide
gcatttcgatccacgtcaggtgcag

SEQ ID NO: 711507 - DNA, 25 bp, Artificial sequence
  Synthetic oligonucleotide
gcatcgccagcatttcgatcctcgt

SEQ ID NO: 711508 - DNA, 25 bp, Artificial sequence
  Synthetic oligonucleotide
gcatcgccagcaattcgatcctcgt

SEQ ID NO: 711509 - DNA, 25 bp, Artificial sequence
  Synthetic oligonucleotide
tcgtcaggtgcaggtcagcacgttg

SEQ ID NO: 711510 - DNA, 25 bp, Artificial sequence
  Synthetic oligonucleotide
gcaggtgcatcggcagcatttcgat

SEQ ID NO: 711511 - DNA, 25 bp, Artificial sequence
  Synthetic oligonucleotide
gcaggtcagcaccttgctgtcgatt

SEQ ID NO: 711512 - DNA, 25 bp, Artificial sequence
  Synthetic oligonucleotide
gcgcagcaggtggatcgccagcatt

SEQ ID NO: 711513 - DNA, 25 bp, Artificial sequence
  Synthetic oligonucleotide
gacattgtcgcatgtcacagaatta

SEQ ID NO: 711514 - DNA, 25 bp, Artificial sequence
  Synthetic oligonucleotide
ggatctgctgtttgaagcgcagcag

SEQ ID NO: 711515 - DNA, 25 bp, Artificial sequence
  Synthetic oligonucleotide
ggatctgctgttagaagcgcagcag

SEQ ID NO: 711516 - DNA, 25 bp, Artificial sequence
  Synthetic oligonucleotide
gttgctggatctgctgtttgaagcg

SEQ ID NO: 711517 - DNA, 25 bp, Artificial sequence
  Synthetic oligonucleotide
gttgctggatctcctgtttgaagcg

SEQ ID NO: 711518 - DNA, 25 bp, Artificial sequence
  Synthetic oligonucleotide
attgtcgcaagtgacagaattattt

SEQ ID NO: 711519 - DNA, 25 bp, Artificial sequence
  Synthetic oligonucleotide
gcaggtgcatcgccagcatttcgat

SEQ ID NO: 711520 - DNA, 25 bp, Artificial sequence
  Synthetic oligonucleotide
agattgcaaatagtgcccgcaaacg

SEQ ID NO: 711521 - DNA, 25 bp, Artificial sequence
  Synthetic oligonucleotide
ggcaggatcgacccgcttctgtatg

SEQ ID NO: 711522 - DNA, 25 bp, Artificial sequence
  Synthetic oligonucleotide
caaagcgaaagccgcaggatcgacg

SEQ ID NO: 711523 - DNA, 25 bp, Artificial sequence
  Synthetic oligonucleotide
caaagcgaaagcggcaggatcgacg

SEQ ID NO: 711524 - DNA, 25 bp, Artificial sequence
  Synthetic oligonucleotide
ggagtcggcgcggaaagcgaaagcg

SEQ ID NO: 711525 - DNA, 25 bp, Artificial sequence
  Synthetic oligonucleotide
ggagtcggcgcgcaaagcgaaagcg

SEQ ID NO: 711526 - DNA, 25 bp, Artificial sequence
  Synthetic oligonucleotide
tgaacaggtgctcgagtcggcgcgc

SEQ ID NO: 711527 - DNA, 25 bp, Artificial sequence
  Synthetic oligonucleotide
tgaacaggtgctggagtcggcgcgc

SEQ ID NO: 711528 - DNA, 25 bp, Artificial sequence
  Synthetic oligonucleotide
tcgtcaggtgcacgtcagcacgttg

SEQ ID NO: 711529 - DNA, 25 bp, Artificial sequence
  Synthetic oligonucleotide
caaatactgcccgcaaacgtcgcgc

SEQ ID NO: 711530 - DNA, 25 bp, Artificial sequence
  Synthetic oligonucleotide
attgtcgcaagtcacagaattattt

SEQ ID NO: 711531 - DNA, 25 bp, Artificial sequence
  Synthetic oligonucleotide
agattgcaaatactgcccgcaaacg

SEQ ID NO: 711532 - DNA, 25 bp, Artificial sequence
  Synthetic oligonucleotide
agcttgtccggaagattgcaaatac

SEQ ID NO: 711533 - DNA, 25 bp, Artificial sequence
  Synthetic oligonucleotide
agcttgtccggatgattgcaaatac

SEQ ID NO: 711534 - DNA, 25 bp, Artificial sequence
  Synthetic oligonucleotide
gctgtcgattaagaccggagcttgt

SEQ ID NO: 711535 - DNA, 25 bp, Artificial sequence
  Synthetic oligonucleotide
gctgtcgattaacaccggagcttgt

SEQ ID NO: 711536 - DNA, 25 bp, Artificial sequence
  Synthetic oligonucleotide
cagcacgttgctgtcgattaagacc

SEQ ID NO: 711537 - DNA, 25 bp, Artificial sequence
  Synthetic oligonucleotide
cagcacgttgctctcgattaagacc

SEQ ID NO: 711538 - DNA, 25 bp, Artificial sequence
  Synthetic oligonucleotide
gcaggtcagcacgttgctgtcgatt

SEQ ID NO: 711539 - DNA, 25 bp, Artificial sequence
  Synthetic oligonucleotide
caaatactgcccccaaacgtcgcgc

SEQ ID NO: 711540 - DNA, 25 bp, Artificial sequence
  Synthetic oligonucleotide
gacattgtcgcaagtcacagaatta

SEQ ID NO: 711541 - DNA, 25 bp, Artificial sequence
  Synthetic oligonucleotide
atcaccacacgctcttatcaggaac

SEQ ID NO: 711542 - DNA, 25 bp, Artificial sequence
  Synthetic oligonucleotide
gccgggatcaaagtctgttctggcg

SEQ ID NO: 711543 - DNA, 25 bp, Artificial sequence
  Synthetic oligonucleotide
gccgggatcaaactctgttctggcg

SEQ ID NO: 711544 - DNA, 25 bp, Artificial sequence
  Synthetic oligonucleotide
agtgcgcgatgccgggatcaaagtc

SEQ ID NO: 711545 - DNA, 25 bp, Artificial sequence
  Synthetic oligonucleotide
agtgcgcgatgcggggatcaaagtc

SEQ ID NO: 711546 - DNA, 25 bp, Artificial sequence
  Synthetic oligonucleotide
ggaaaaagtgcgcgatgccgggatc

SEQ ID NO: 711547 - DNA, 25 bp, Artificial sequence
  Synthetic oligonucleotide
ggaaaaagtgcgggatgccgggatc

SEQ ID NO: 711548 - DNA, 25 bp, Artificial sequence
  Synthetic oligonucleotide
atacgctggaaaaagtgcgcgatgc

SEQ ID NO: 711549 - DNA, 25 bp, Artificial sequence
  Synthetic oligonucleotide
aagtctgttctgccggcattgtggg

SEQ ID NO: 711550 - DNA, 25 bp, Artificial sequence
  Synthetic oligonucleotide
acgcacttatcacgaacgcctcgat

SEQ ID NO: 711551 - DNA, 25 bp, Artificial sequence
  Synthetic oligonucleotide
acgcacttatcaggaacgcctcgat

SEQ ID NO: 711552 - DNA, 25 bp, Artificial sequence
  Synthetic oligonucleotide
gcaatatcatcagcacacgcactta

SEQ ID NO: 711553 - DNA, 25 bp, Artificial sequence
  Synthetic oligonucleotide
gcaatatcatcaccacacgcactta

SEQ ID NO: 711554 - DNA, 25 bp, Artificial sequence
  Synthetic oligonucleotide
gttttacggcaaaatcatcaccaca

SEQ ID NO: 711555 - DNA, 25 bp, Artificial sequence
  Synthetic oligonucleotide
gttttacggcaatatcatcaccaca

SEQ ID NO: 711556 - DNA, 25 bp, Artificial sequence
  Synthetic oligonucleotide
gccggagttttacggcaatatcatc

SEQ ID NO: 711557 - DNA, 25 bp, Artificial sequence
  Synthetic oligonucleotide
gccggagttttagggcaatatcatc

SEQ ID NO: 711558 - DNA, 25 bp, Artificial sequence
  Synthetic oligonucleotide
acgatgatgtcgttgcctttgattt

SEQ ID NO: 711559 - DNA, 25 bp, Artificial sequence
  Synthetic oligonucleotide
atacgctggaaatagtgcgcgatgc

SEQ ID NO: 711560 - DNA, 25 bp, Artificial sequence
  Synthetic oligonucleotide
ttgccgataacgttgatgtcgatgc

SEQ ID NO: 711561 - DNA, 25 bp, Artificial sequence
  Synthetic oligonucleotide
atcaccacacgcacttatcaggaac

SEQ ID NO: 711562 - DNA, 25 bp, Artificial sequence
  Synthetic oligonucleotide
acgatgatgtcgatgcctttgattt

SEQ ID NO: 711563 - DNA, 25 bp, Artificial sequence
  Synthetic oligonucleotide
aagtctgttctggcggcattgtggg

SEQ ID NO: 711564 - DNA, 25 bp, Artificial sequence
  Synthetic oligonucleotide
ttgccgataacgatgatgtcgatgc

SEQ ID NO: 711565 - DNA, 25 bp, Artificial sequence
  Synthetic oligonucleotide
acgccgcttgcccataacgatgatg

SEQ ID NO: 711566 - DNA, 25 bp, Artificial sequence
  Synthetic oligonucleotide
acgccgcttgccgataacgatgatg

SEQ ID NO: 711567 - DNA, 25 bp, Artificial sequence
  Synthetic oligonucleotide
tggtgaaggtgataggcacgccgct

SEQ ID NO: 711568 - DNA, 25 bp, Artificial sequence
  Synthetic oligonucleotide
tggtgaaggtgaaaggcacgccgct

SEQ ID NO: 711569 - DNA, 25 bp, Artificial sequence
  Synthetic oligonucleotide
caatcaacatgctggtgaaggtgaa

SEQ ID NO: 711570 - DNA, 25 bp, Artificial sequence
  Synthetic oligonucleotide
caatcaacatgcaggtgaaggtgaa

SEQ ID NO: 711571 - DNA, 25 bp, Artificial sequence
  Synthetic oligonucleotide
gccggattattggtgcaactggcaa

SEQ ID NO: 711572 - DNA, 25 bp, Artificial sequence
  Synthetic oligonucleotide
aagcgtgccaatcaacatgctggtg

SEQ ID NO: 711573 - DNA, 25 bp, Artificial sequence
  Synthetic oligonucleotide
aagatcgcgccggattattgctgca

SEQ ID NO: 711574 - DNA, 25 bp, Artificial sequence
  Synthetic oligonucleotide
gccggattattgctgcaactggcaa

SEQ ID NO: 711575 - DNA, 25 bp, Artificial sequence
  Synthetic oligonucleotide
attgctgcaactcgcaaacctgccg

SEQ ID NO: 711576 - DNA, 25 bp, Artificial sequence
  Synthetic oligonucleotide
attgctgcaactggcaaacctgccg

SEQ ID NO: 711577 - DNA, 25 bp, Artificial sequence
  Synthetic oligonucleotide
cgccggaaagcgtgccaatcaacat

SEQ ID NO: 711578 - DNA, 25 bp, Artificial sequence
  Synthetic oligonucleotide
cgccggaaagcgagccaatcaacat

SEQ ID NO: 711579 - DNA, 25 bp, Artificial sequence
  Synthetic oligonucleotide
aagcgtgccaatgaacatgctggtg

SEQ ID NO: 711580 - DNA, 25 bp, Artificial sequence
  Synthetic oligonucleotide
aagatcgcgccgcattattgctgca

SEQ ID NO: 711581 - DNA, 25 bp, Artificial sequence
  Synthetic oligonucleotide
gttttacggcaatatcatcaccaca

SEQ ID NO: 711582 - DNA, 25 bp, Artificial sequence
  Synthetic oligonucleotide
gccgggatcaaactctgttctggcg

SEQ ID NO: 711583 - DNA, 25 bp, Artificial sequence
  Synthetic oligonucleotide
atacgctggaaaaagtgcgcgatgc

SEQ ID NO: 711584 - DNA, 25 bp, Artificial sequence
  Synthetic oligonucleotide
gccgggatcaaagtctgttctggcg

SEQ ID NO: 711585 - DNA, 25 bp, Artificial sequence
  Synthetic oligonucleotide
agtgcgcgatgccgggatcaaagtc

SEQ ID NO: 711586 - DNA, 25 bp, Artificial sequence
  Synthetic oligonucleotide
aagtctgttctggcggcattgtggg

SEQ ID NO: 711587 - DNA, 25 bp, Artificial sequence
  Synthetic oligonucleotide
agtgcgcgatgcggggatcaaagtc

SEQ ID NO: 711588 - DNA, 25 bp, Artificial sequence
  Synthetic oligonucleotide
ggaaaaagtgcgggatgccgggatc

SEQ ID NO: 711589 - DNA, 25 bp, Artificial sequence
  Synthetic oligonucleotide
ggaaaaagtgcgcgatgccgggatc

SEQ ID NO: 711590 - DNA, 25 bp, Artificial sequence
  Synthetic oligonucleotide
atacgctggaaatagtgcgcgatgc

SEQ ID NO: 711591 - DNA, 25 bp, Artificial sequence
  Synthetic oligonucleotide
acgcacttatcaggaacgcctcgat

SEQ ID NO: 711592 - DNA, 25 bp, Artificial sequence
  Synthetic oligonucleotide
acgcacttatcacgaacgcctcgat

SEQ ID NO: 711593 - DNA, 25 bp, Artificial sequence
  Synthetic oligonucleotide
atcaccacacgctcttatcaggaac

SEQ ID NO: 711594 - DNA, 25 bp, Artificial sequence
  Synthetic oligonucleotide
atcaccacacgcacttatcaggaac

SEQ ID NO: 711595 - DNA, 25 bp, Artificial sequence
  Synthetic oligonucleotide
gccggagttttacggcaatatcatc

SEQ ID NO: 711596 - DNA, 25 bp, Artificial sequence
  Synthetic oligonucleotide
gcaatatcatcagcacacgcactta

SEQ ID NO: 711597 - DNA, 25 bp, Artificial sequence
  Synthetic oligonucleotide
gttttacggcaaaatcatcaccaca

SEQ ID NO: 711598 - DNA, 25 bp, Artificial sequence
  Synthetic oligonucleotide
gccggagttttagggcaatatcatc

SEQ ID NO: 711599 - DNA, 25 bp, Artificial sequence
  Synthetic oligonucleotide
tggtgaaggtgaaaggcacgccgct

SEQ ID NO: 711600 - DNA, 25 bp, Artificial sequence
  Synthetic oligonucleotide
aagtctgttctgccggcattgtggg

SEQ ID NO: 711601 - DNA, 25 bp, Artificial sequence
  Synthetic oligonucleotide
gcaatatcatcaccacacgcactta

SEQ ID NO: 711602 - DNA, 25 bp, Artificial sequence
  Synthetic oligonucleotide
acgatgatgtcgatgcctttgattt

SEQ ID NO: 711603 - DNA, 25 bp, Artificial sequence
  Synthetic oligonucleotide
caatcaacatgctggtgaaggtgaa

SEQ ID NO: 711604 - DNA, 25 bp, Artificial sequence
  Synthetic oligonucleotide
acgatgatgtcgttgcctttgattt

SEQ ID NO: 711605 - DNA, 25 bp, Artificial sequence
  Synthetic oligonucleotide
aagatcgcgccgcattattgctgca

SEQ ID NO: 711606 - DNA, 25 bp, Artificial sequence
  Synthetic oligonucleotide
ttgccgataacgatgatgtcgatgc

SEQ ID NO: 711607 - DNA, 25 bp, Artificial sequence
  Synthetic oligonucleotide
ttgccgataacgttgatgtcgatgc

SEQ ID NO: 711608 - DNA, 25 bp, Artificial sequence
  Synthetic oligonucleotide
acgccgcttgcccataacgatgatg

SEQ ID NO: 711609 - DNA, 25 bp, Artificial sequence
  Synthetic oligonucleotide
acgccgcttgccgataacgatgatg

SEQ ID NO: 711610 - DNA, 25 bp, Artificial sequence
  Synthetic oligonucleotide
tggtgaaggtgataggcacgccgct

SEQ ID NO: 711611 - DNA, 25 bp, Artificial sequence
  Synthetic oligonucleotide
caatcaacatgcaggtgaaggtgaa

SEQ ID NO: 711612 - DNA, 25 bp, Artificial sequence
  Synthetic oligonucleotide
gccggattattggtgcaactggcaa

SEQ ID NO: 711613 - DNA, 25 bp, Artificial sequence
  Synthetic oligonucleotide
gccggattattgctgcaactggcaa

SEQ ID NO: 711614 - DNA, 25 bp, Artificial sequence
  Synthetic oligonucleotide
attgctgcaactggcaaacctgccg

SEQ ID NO: 711615 - DNA, 25 bp, Artificial sequence
  Synthetic oligonucleotide
attgctgcaactcgcaaacctgccg

SEQ ID NO: 711616 - DNA, 25 bp, Artificial sequence
  Synthetic oligonucleotide
cgccggaaagcgagccaatcaacat

SEQ ID NO: 711617 - DNA, 25 bp, Artificial sequence
  Synthetic oligonucleotide
cgccggaaagcgtgccaatcaacat

SEQ ID NO: 711618 - DNA, 25 bp, Artificial sequence
  Synthetic oligonucleotide
aagcgtgccaatcaacatgctggtg

SEQ ID NO: 711619 - DNA, 25 bp, Artificial sequence
  Synthetic oligonucleotide
aagcgtgccaatgaacatgctggtg

SEQ ID NO: 711620 - DNA, 25 bp, Artificial sequence
  Synthetic oligonucleotide
aagatcgcgccggattattgctgca

SEQ ID NO: 711621 - DNA, 25 bp, Artificial sequence
  Synthetic oligonucleotide
atcacgctgtggtttgatgatgcgc

SEQ ID NO: 711622 - DNA, 25 bp, Artificial sequence
  Synthetic oligonucleotide
ggtggacgagcgtccgcatgctaat

SEQ ID NO: 711623 - DNA, 25 bp, Artificial sequence
  Synthetic oligonucleotide
gatgaaatcgaacagtcgctgaacg

SEQ ID NO: 711624 - DNA, 25 bp, Artificial sequence
  Synthetic oligonucleotide
ttcagcccatcacgctgtggtttga

SEQ ID NO: 711625 - DNA, 25 bp, Artificial sequence
  Synthetic oligonucleotide
ttcagcccatcaggctgtggtttga

SEQ ID NO: 711626 - DNA, 25 bp, Artificial sequence
  Synthetic oligonucleotide
acatcatattcagcccatcacgctg

SEQ ID NO: 711627 - DNA, 25 bp, Artificial sequence
  Synthetic oligonucleotide
acatcatattcaccccatcacgctg

SEQ ID NO: 711628 - DNA, 25 bp, Artificial sequence
  Synthetic oligonucleotide
aacagtcgctgaacggcgtgcatta

SEQ ID NO: 711629 - DNA, 25 bp, Artificial sequence
  Synthetic oligonucleotide
aacagtcgctgatcggcgtgcatta

SEQ ID NO: 711630 - DNA, 25 bp, Artificial sequence
  Synthetic oligonucleotide
gatgaaatcgaagagtcgctgaacg

SEQ ID NO: 711631 - DNA, 25 bp, Artificial sequence
  Synthetic oligonucleotide
tttaccgccagatgaaatcgaacag

SEQ ID NO: 711632 - DNA, 25 bp, Artificial sequence
  Synthetic oligonucleotide
tttaccgccagaagaaatcgaacag

SEQ ID NO: 711633 - DNA, 25 bp, Artificial sequence
  Synthetic oligonucleotide
tacccgaacgtcttcaggcgtggca

SEQ ID NO: 711634 - DNA, 25 bp, Artificial sequence
  Synthetic oligonucleotide
cgtccgcatgcttatcgctttttac

SEQ ID NO: 711635 - DNA, 25 bp, Artificial sequence
  Synthetic oligonucleotide
atcacgctgtggattgatgatgcgc

SEQ ID NO: 711636 - DNA, 25 bp, Artificial sequence
  Synthetic oligonucleotide
ggtggacgagcgaccgcatgctaat

SEQ ID NO: 711637 - DNA, 25 bp, Artificial sequence
  Synthetic oligonucleotide
tacccgaacgtcatcaggcgtggca

SEQ ID NO: 711638 - DNA, 25 bp, Artificial sequence
  Synthetic oligonucleotide
atgatgcgctcactgccatgcgttc

SEQ ID NO: 711639 - DNA, 25 bp, Artificial sequence
  Synthetic oligonucleotide
cgtccgcatgctaatcgctttttac

SEQ ID NO: 711640 - DNA, 25 bp, Artificial sequence
  Synthetic oligonucleotide
gcgttcgcagttgcagcgattgcaa

SEQ ID NO: 711641 - DNA, 25 bp, Artificial sequence
  Synthetic oligonucleotide
ggtttgatgatgcgctcagtgccat

SEQ ID NO: 711642 - DNA, 25 bp, Artificial sequence
  Synthetic oligonucleotide
ggtttgatgatgggctcagtgccat

SEQ ID NO: 711643 - DNA, 25 bp, Artificial sequence
  Synthetic oligonucleotide
agttgcagcgattgcaactggcctg

SEQ ID NO: 711644 - DNA, 25 bp, Artificial sequence
  Synthetic oligonucleotide
gcgttcgcagttccagcgattgcaa

SEQ ID NO: 711645 - DNA, 25 bp, Artificial sequence
  Synthetic oligonucleotide
attaacgcgttcccagttgcagcga

SEQ ID NO: 711646 - DNA, 25 bp, Artificial sequence
  Synthetic oligonucleotide
attaacgcgttcgcagttgcagcga

SEQ ID NO: 711647 - DNA, 25 bp, Artificial sequence
  Synthetic oligonucleotide
atcttcatgaagggcgcgacccgcg

SEQ ID NO: 711648 - DNA, 25 bp, Artificial sequence
  Synthetic oligonucleotide
atcttcatgaagcgcgcgacccgcg

SEQ ID NO: 711649 - DNA, 25 bp, Artificial sequence
  Synthetic oligonucleotide
tgccacgcatcttcatgaagggcgc

SEQ ID NO: 711650 - DNA, 25 bp, Artificial sequence
  Synthetic oligonucleotide
tgccacgcatctacatgaagggcgc

SEQ ID NO: 711651 - DNA, 25 bp, Artificial sequence
  Synthetic oligonucleotide
atgatgcgctcagtgccatgcgttc

SEQ ID NO: 711652 - DNA, 25 bp, Artificial sequence
  Synthetic oligonucleotide
ggcatcggtgccacgcatcttcatg

SEQ ID NO: 711653 - DNA, 25 bp, Artificial sequence
  Synthetic oligonucleotide
ctgaaaggcatcggtgccacgcatc

SEQ ID NO: 711654 - DNA, 25 bp, Artificial sequence
  Synthetic oligonucleotide
ctgaaaggcatccgtgccacgcatc

SEQ ID NO: 711655 - DNA, 25 bp, Artificial sequence
  Synthetic oligonucleotide
catgcgttcgctgaaaggcatcggt

SEQ ID NO: 711656 - DNA, 25 bp, Artificial sequence
  Synthetic oligonucleotide
catgcgttcgctcaaaggcatcggt

SEQ ID NO: 711657 - DNA, 25 bp, Artificial sequence
  Synthetic oligonucleotide
ctcagtgccatgggttcgctgaaag

SEQ ID NO: 711658 - DNA, 25 bp, Artificial sequence
  Synthetic oligonucleotide
ctcagtgccatgcgttcgctgaaag

SEQ ID NO: 711659 - DNA, 25 bp, Artificial sequence
  Synthetic oligonucleotide
agttgcagcgatagcaactggcctg

SEQ ID NO: 711660 - DNA, 25 bp, Artificial sequence
  Synthetic oligonucleotide
ggcatcggtgcctcgcatcttcatg

SEQ ID NO: 711661 - DNA, 25 bp, Artificial sequence
  Synthetic oligonucleotide
aacagtcgctgatcggcgtgcatta

SEQ ID NO: 711662 - DNA, 25 bp, Artificial sequence
  Synthetic oligonucleotide
acatcatattcaccccatcacgctg

SEQ ID NO: 711663 - DNA, 25 bp, Artificial sequence
  Synthetic oligonucleotide
acatcatattcagcccatcacgctg

SEQ ID NO: 711664 - DNA, 25 bp, Artificial sequence
  Synthetic oligonucleotide
ttcagcccatcacgctgtggtttga

SEQ ID NO: 711665 - DNA, 25 bp, Artificial sequence
  Synthetic oligonucleotide
ttcagcccatcaggctgtggtttga

SEQ ID NO: 711666 - DNA, 25 bp, Artificial sequence
  Synthetic oligonucleotide
tacccgaacgtcatcaggcgtggca

SEQ ID NO: 711667 - DNA, 25 bp, Artificial sequence
  Synthetic oligonucleotide
atcacgctgtggattgatgatgcgc

SEQ ID NO: 711668 - DNA, 25 bp, Artificial sequence
  Synthetic oligonucleotide
cgtccgcatgctaatcgctttttac

SEQ ID NO: 711669 - DNA, 25 bp, Artificial sequence
  Synthetic oligonucleotide
atcacgctgtggtttgatgatgcgc

SEQ ID NO: 711670 - DNA, 25 bp, Artificial sequence
  Synthetic oligonucleotide
aacagtcgctgaacggcgtgcatta

SEQ ID NO: 711671 - DNA, 25 bp, Artificial sequence
  Synthetic oligonucleotide
ggtggacgagcgaccgcatgctaat

SEQ ID NO: 711672 - DNA, 25 bp, Artificial sequence
  Synthetic oligonucleotide
gatgaaatcgaacagtcgctgaacg

SEQ ID NO: 711673 - DNA, 25 bp, Artificial sequence
  Synthetic oligonucleotide
gatgaaatcgaagagtcgctgaacg

SEQ ID NO: 711674 - DNA, 25 bp, Artificial sequence
  Synthetic oligonucleotide
tttaccgccagatgaaatcgaacag

SEQ ID NO: 711675 - DNA, 25 bp, Artificial sequence
  Synthetic oligonucleotide
cgtccgcatgcttatcgctttttac

SEQ ID NO: 711676 - DNA, 25 bp, Artificial sequence
  Synthetic oligonucleotide
ggtggacgagcgtccgcatgctaat

SEQ ID NO: 711677 - DNA, 25 bp, Artificial sequence
  Synthetic oligonucleotide
ggtttgatgatgggctcagtgccat

SEQ ID NO: 711678 - DNA, 25 bp, Artificial sequence
  Synthetic oligonucleotide
ggcatcggtgccacgcatcttcatg

SEQ ID NO: 711679 - DNA, 25 bp, Artificial sequence
  Synthetic oligonucleotide
tttaccgccagaagaaatcgaacag

SEQ ID NO: 711680 - DNA, 25 bp, Artificial sequence
  Synthetic oligonucleotide
tgccacgcatcttcatgaagggcgc

SEQ ID NO: 711681 - DNA, 25 bp, Artificial sequence
  Synthetic oligonucleotide
agttgcagcgattgcaactggcctg

SEQ ID NO: 711682 - DNA, 25 bp, Artificial sequence
  Synthetic oligonucleotide
agttgcagcgatagcaactggcctg

SEQ ID NO: 711683 - DNA, 25 bp, Artificial sequence
  Synthetic oligonucleotide
gcgttcgcagttgcagcgattgcaa

SEQ ID NO: 711684 - DNA, 25 bp, Artificial sequence
  Synthetic oligonucleotide
gcgttcgcagttccagcgattgcaa

SEQ ID NO: 711685 - DNA, 25 bp, Artificial sequence
  Synthetic oligonucleotide
attaacgcgttcccagttgcagcga

SEQ ID NO: 711686 - DNA, 25 bp, Artificial sequence
  Synthetic oligonucleotide
attaacgcgttcgcagttgcagcga

SEQ ID NO: 711687 - DNA, 25 bp, Artificial sequence
  Synthetic oligonucleotide
atcttcatgaagcgcgcgacccgcg

SEQ ID NO: 711688 - DNA, 25 bp, Artificial sequence
  Synthetic oligonucleotide
atcttcatgaagggcgcgacccgcg

SEQ ID NO: 711689 - DNA, 25 bp, Artificial sequence
  Synthetic oligonucleotide
ctgaaaggcatccgtgccacgcatc

SEQ ID NO: 711690 - DNA, 25 bp, Artificial sequence
  Synthetic oligonucleotide
tgccacgcatctacatgaagggcgc

SEQ ID NO: 711691 - DNA, 25 bp, Artificial sequence
  Synthetic oligonucleotide
ggtttgatgatgcgctcagtgccat

SEQ ID NO: 711692 - DNA, 25 bp, Artificial sequence
  Synthetic oligonucleotide
ggcatcggtgcctcgcatcttcatg

SEQ ID NO: 711693 - DNA, 25 bp, Artificial sequence
  Synthetic oligonucleotide
tacccgaacgtcttcaggcgtggca

SEQ ID NO: 711694 - DNA, 25 bp, Artificial sequence
  Synthetic oligonucleotide
ctgaaaggcatcggtgccacgcatc

SEQ ID NO: 711695 - DNA, 25 bp, Artificial sequence
  Synthetic oligonucleotide
catgcgttcgctgaaaggcatcggt

SEQ ID NO: 711696 - DNA, 25 bp, Artificial sequence
  Synthetic oligonucleotide
catgcgttcgctcaaaggcatcggt

SEQ ID NO: 711697 - DNA, 25 bp, Artificial sequence
  Synthetic oligonucleotide
ctcagtgccatgggttcgctgaaag

SEQ ID NO: 711698 - DNA, 25 bp, Artificial sequence
  Synthetic oligonucleotide
ctcagtgccatgcgttcgctgaaag

SEQ ID NO: 711699 - DNA, 25 bp, Artificial sequence
  Synthetic oligonucleotide
atgatgcgctcactgccatgcgttc

SEQ ID NO: 711700 - DNA, 25 bp, Artificial sequence
  Synthetic oligonucleotide
atgatgcgctcagtgccatgcgttc

SEQ ID NO: 711701 - DNA, 25 bp, Artificial sequence
  Synthetic oligonucleotide
gccgcagaccattatctggcgggag

SEQ ID NO: 711702 - DNA, 25 bp, Artificial sequence
  Synthetic oligonucleotide
aacatgcagatctacagcgccagag

SEQ ID NO: 711703 - DNA, 25 bp, Artificial sequence
  Synthetic oligonucleotide
tgagccgccactcgcgggaacgtca

SEQ ID NO: 711704 - DNA, 25 bp, Artificial sequence
  Synthetic oligonucleotide
gggttgtggacctggctggatgagc

SEQ ID NO: 711705 - DNA, 25 bp, Artificial sequence
  Synthetic oligonucleotide
gggttgtggaccaggctggatgagc

SEQ ID NO: 711706 - DNA, 25 bp, Artificial sequence
  Synthetic oligonucleotide
tactggcaatgcttccacagcgtaa

SEQ ID NO: 711707 - DNA, 25 bp, Artificial sequence
  Synthetic oligonucleotide
tactggcaatgcatccacagcgtaa

SEQ ID NO: 711708 - DNA, 25 bp, Artificial sequence
  Synthetic oligonucleotide
gagtgctgacgccttactggcaatg

SEQ ID NO: 711709 - DNA, 25 bp, Artificial sequence
  Synthetic oligonucleotide
gagtgctgacgcgttactggcaatg

SEQ ID NO: 711710 - DNA, 25 bp, Artificial sequence
  Synthetic oligonucleotide
cgttagcgactgcgacgttcgatct

SEQ ID NO: 711711 - DNA, 25 bp, Artificial sequence
  Synthetic oligonucleotide
tacagcgccagactgctgacgcctt

SEQ ID NO: 711712 - DNA, 25 bp, Artificial sequence
  Synthetic oligonucleotide
gcgcaggtgacggccttagatctct

SEQ ID NO: 711713 - DNA, 25 bp, Artificial sequence
  Synthetic oligonucleotide
aacatgcagatcaacagcgccagag

SEQ ID NO: 711714 - DNA, 25 bp, Artificial sequence
  Synthetic oligonucleotide
cgcacactatgagcaacatgcagat

SEQ ID NO: 711715 - DNA, 25 bp, Artificial sequence
  Synthetic oligonucleotide
cgcacactatgaccaacatgcagat

SEQ ID NO: 711716 - DNA, 25 bp, Artificial sequence
  Synthetic oligonucleotide
gtcgggcagccgcacactatgagca

SEQ ID NO: 711717 - DNA, 25 bp, Artificial sequence
  Synthetic oligonucleotide
gtcgggcagccggacactatgagca

SEQ ID NO: 711718 - DNA, 25 bp, Artificial sequence
  Synthetic oligonucleotide
cagcggcatttggtcgggcagccgc

SEQ ID NO: 711719 - DNA, 25 bp, Artificial sequence
  Synthetic oligonucleotide
cagcggcatttgctcgggcagccgc

SEQ ID NO: 711720 - DNA, 25 bp, Artificial sequence
  Synthetic oligonucleotide
tacagcgccagagtgctgacgcctt

SEQ ID NO: 711721 - DNA, 25 bp, Artificial sequence
  Synthetic oligonucleotide
agaaggatgccggagaccattatct

SEQ ID NO: 711722 - DNA, 25 bp, Artificial sequence
  Synthetic oligonucleotide
atttatccacggcactccgcgagct

SEQ ID NO: 711723 - DNA, 25 bp, Artificial sequence
  Synthetic oligonucleotide
caatctcgcagtgcagtggtgcggt

SEQ ID NO: 711724 - DNA, 25 bp, Artificial sequence
  Synthetic oligonucleotide
caatctcgcagtccagtggtgcggt

SEQ ID NO: 711725 - DNA, 25 bp, Artificial sequence
  Synthetic oligonucleotide
gatcttgcatggtgcaatctcgcag

SEQ ID NO: 711726 - DNA, 25 bp, Artificial sequence
  Synthetic oligonucleotide
gatcttgcatggagcaatctcgcag

SEQ ID NO: 711727 - DNA, 25 bp, Artificial sequence
  Synthetic oligonucleotide
cgacgttcgatcttgcatggagcaa

SEQ ID NO: 711728 - DNA, 25 bp, Artificial sequence
  Synthetic oligonucleotide
cgacgttcgatcatgcatggagcaa

SEQ ID NO: 711729 - DNA, 25 bp, Artificial sequence
  Synthetic oligonucleotide
tgagccgccactggcgggaacgtca

SEQ ID NO: 711730 - DNA, 25 bp, Artificial sequence
  Synthetic oligonucleotide
gccgcagaccataatctggcgggag

SEQ ID NO: 711731 - DNA, 25 bp, Artificial sequence
  Synthetic oligonucleotide
gcgcaggtgacgcccttagatctct

SEQ ID NO: 711732 - DNA, 25 bp, Artificial sequence
  Synthetic oligonucleotide
agaaggatgccgcagaccattatct

SEQ ID NO: 711733 - DNA, 25 bp, Artificial sequence
  Synthetic oligonucleotide
tgttcaggcacggcagaaggatgcc

SEQ ID NO: 711734 - DNA, 25 bp, Artificial sequence
  Synthetic oligonucleotide
tgttcaggcacgccagaaggatgcc

SEQ ID NO: 711735 - DNA, 25 bp, Artificial sequence
  Synthetic oligonucleotide
gccgccaatgcttgttcaggcacgc

SEQ ID NO: 711736 - DNA, 25 bp, Artificial sequence
  Synthetic oligonucleotide
gccgccaatgctagttcaggcacgc

SEQ ID NO: 711737 - DNA, 25 bp, Artificial sequence
  Synthetic oligonucleotide
gccttagatctctcgccgccaatgc

SEQ ID NO: 711738 - DNA, 25 bp, Artificial sequence
  Synthetic oligonucleotide
gccttagatctcacgccgccaatgc

SEQ ID NO: 711739 - DNA, 25 bp, Artificial sequence
  Synthetic oligonucleotide
atttatccacgggactccgcgagct

SEQ ID NO: 711740 - DNA, 25 bp, Artificial sequence
  Synthetic oligonucleotide
cgttagcgactgggacgttcgatct

SEQ ID NO: 711741 - DNA, 25 bp, Artificial sequence
  Synthetic oligonucleotide
tacagcgccagactgctgacgcctt

SEQ ID NO: 711742 - DNA, 25 bp, Artificial sequence
  Synthetic oligonucleotide
atttatccacggcactccgcgagct

SEQ ID NO: 711743 - DNA, 25 bp, Artificial sequence
  Synthetic oligonucleotide
tgagccgccactcgcgggaacgtca

SEQ ID NO: 711744 - DNA, 25 bp, Artificial sequence
  Synthetic oligonucleotide
gggttgtggacctggctggatgagc

SEQ ID NO: 711745 - DNA, 25 bp, Artificial sequence
  Synthetic oligonucleotide
gggttgtggaccaggctggatgagc

SEQ ID NO: 711746 - DNA, 25 bp, Artificial sequence
  Synthetic oligonucleotide
tactggcaatgcttccacagcgtaa

SEQ ID NO: 711747 - DNA, 25 bp, Artificial sequence
  Synthetic oligonucleotide
tactggcaatgcatccacagcgtaa

SEQ ID NO: 711748 - DNA, 25 bp, Artificial sequence
  Synthetic oligonucleotide
gagtgctgacgccttactggcaatg

SEQ ID NO: 711749 - DNA, 25 bp, Artificial sequence
  Synthetic oligonucleotide
gcgcaggtgacgcccttagatctct

SEQ ID NO: 711750 - DNA, 25 bp, Artificial sequence
  Synthetic oligonucleotide
tacagcgccagagtgctgacgcctt

SEQ ID NO: 711751 - DNA, 25 bp, Artificial sequence
  Synthetic oligonucleotide
gcgcaggtgacggccttagatctct

SEQ ID NO: 711752 - DNA, 25 bp, Artificial sequence
  Synthetic oligonucleotide
aacatgcagatctacagcgccagag

SEQ ID NO: 711753 - DNA, 25 bp, Artificial sequence
  Synthetic oligonucleotide
aacatgcagatcaacagcgccagag

SEQ ID NO: 711754 - DNA, 25 bp, Artificial sequence
  Synthetic oligonucleotide
cgcacactatgagcaacatgcagat

SEQ ID NO: 711755 - DNA, 25 bp, Artificial sequence
  Synthetic oligonucleotide
cgcacactatgaccaacatgcagat

SEQ ID NO: 711756 - DNA, 25 bp, Artificial sequence
  Synthetic oligonucleotide
gtcgggcagccgcacactatgagca

SEQ ID NO: 711757 - DNA, 25 bp, Artificial sequence
  Synthetic oligonucleotide
gtcgggcagccggacactatgagca

SEQ ID NO: 711758 - DNA, 25 bp, Artificial sequence
  Synthetic oligonucleotide
cagcggcatttgctcgggcagccgc

SEQ ID NO: 711759 - DNA, 25 bp, Artificial sequence
  Synthetic oligonucleotide
cagcggcatttggtcgggcagccgc

SEQ ID NO: 711760 - DNA, 25 bp, Artificial sequence
  Synthetic oligonucleotide
gagtgctgacgcgttactggcaatg

SEQ ID NO: 711761 - DNA, 25 bp, Artificial sequence
  Synthetic oligonucleotide
gccgcagaccataatctggcgggag

SEQ ID NO: 711762 - DNA, 25 bp, Artificial sequence
  Synthetic oligonucleotide
caatctcgcagtgcagtggtgcggt

SEQ ID NO: 711763 - DNA, 25 bp, Artificial sequence
  Synthetic oligonucleotide
caatctcgcagtccagtggtgcggt

SEQ ID NO: 711764 - DNA, 25 bp, Artificial sequence
  Synthetic oligonucleotide
gatcttgcatggagcaatctcgcag

SEQ ID NO: 711765 - DNA, 25 bp, Artificial sequence
  Synthetic oligonucleotide
gatcttgcatggtgcaatctcgcag

SEQ ID NO: 711766 - DNA, 25 bp, Artificial sequence
  Synthetic oligonucleotide
cgacgttcgatcttgcatggagcaa

SEQ ID NO: 711767 - DNA, 25 bp, Artificial sequence
  Synthetic oligonucleotide
cgacgttcgatcatgcatggagcaa

SEQ ID NO: 711768 - DNA, 25 bp, Artificial sequence
  Synthetic oligonucleotide
cgttagcgactgggacgttcgatct

SEQ ID NO: 711769 - DNA, 25 bp, Artificial sequence
  Synthetic oligonucleotide
tgagccgccactggcgggaacgtca

SEQ ID NO: 711770 - DNA, 25 bp, Artificial sequence
  Synthetic oligonucleotide
gccgcagaccattatctggcgggag

SEQ ID NO: 711771 - DNA, 25 bp, Artificial sequence
  Synthetic oligonucleotide
atttatccacgggactccgcgagct

SEQ ID NO: 711772 - DNA, 25 bp, Artificial sequence
  Synthetic oligonucleotide
agaaggatgccggagaccattatct

SEQ ID NO: 711773 - DNA, 25 bp, Artificial sequence
  Synthetic oligonucleotide
agaaggatgccgcagaccattatct

SEQ ID NO: 711774 - DNA, 25 bp, Artificial sequence
  Synthetic oligonucleotide
tgttcaggcacggcagaaggatgcc

SEQ ID NO: 711775 - DNA, 25 bp, Artificial sequence
  Synthetic oligonucleotide
tgttcaggcacgccagaaggatgcc

SEQ ID NO: 711776 - DNA, 25 bp, Artificial sequence
  Synthetic oligonucleotide
gccgccaatgcttgttcaggcacgc

SEQ ID NO: 711777 - DNA, 25 bp, Artificial sequence
  Synthetic oligonucleotide
gccgccaatgctagttcaggcacgc

SEQ ID NO: 711778 - DNA, 25 bp, Artificial sequence
  Synthetic oligonucleotide
gccttagatctctcgccgccaatgc

SEQ ID NO: 711779 - DNA, 25 bp, Artificial sequence
  Synthetic oligonucleotide
gccttagatctcacgccgccaatgc

SEQ ID NO: 711780 - DNA, 25 bp, Artificial sequence
  Synthetic oligonucleotide
cgttagcgactgcgacgttcgatct

SEQ ID NO: 711781 - DNA, 25 bp, Artificial sequence
  Synthetic oligonucleotide
gaaaacgtcacggtgaatatatgac

SEQ ID NO: 711782 - DNA, 25 bp, Artificial sequence
  Synthetic oligonucleotide
gaatatatgacctcgctcacccgca

SEQ ID NO: 711783 - DNA, 25 bp, Artificial sequence
  Synthetic oligonucleotide
ctgaatatatgaccacgctcacccg

SEQ ID NO: 711784 - DNA, 25 bp, Artificial sequence
  Synthetic oligonucleotide
ctgaatatatgagcacgctcacccg

SEQ ID NO: 711785 - DNA, 25 bp, Artificial sequence
  Synthetic oligonucleotide
acgctgaatatatgaccacgctcac

SEQ ID NO: 711786 - DNA, 25 bp, Artificial sequence
  Synthetic oligonucleotide
acgctgaatataagaccacgctcac

SEQ ID NO: 711787 - DNA, 25 bp, Artificial sequence
  Synthetic oligonucleotide
cgtcacgctgaatatatgaccacgc

SEQ ID NO: 711788 - DNA, 25 bp, Artificial sequence
  Synthetic oligonucleotide
cgtcacgctgaaaatatgaccacgc

SEQ ID NO: 711789 - DNA, 25 bp, Artificial sequence
  Synthetic oligonucleotide
gaatatatgaccacgctcacccgca

SEQ ID NO: 711790 - DNA, 25 bp, Artificial sequence
  Synthetic oligonucleotide
aaacgtcacgctgaatatatgacca

SEQ ID NO: 711791 - DNA, 25 bp, Artificial sequence
  Synthetic oligonucleotide
ctttctgacactatcacttttgcag

SEQ ID NO: 711792 - DNA, 25 bp, Artificial sequence
  Synthetic oligonucleotide
gaaaacgtcacgctgaatatatgac

SEQ ID NO: 711793 - DNA, 25 bp, Artificial sequence
  Synthetic oligonucleotide
tttgcagattgggtaacacaggaac

SEQ ID NO: 711794 - DNA, 25 bp, Artificial sequence
  Synthetic oligonucleotide
tttgcagattggctaacacaggaac

SEQ ID NO: 711795 - DNA, 25 bp, Artificial sequence
  Synthetic oligonucleotide
tgacactttcacatttgcagattgg

SEQ ID NO: 711796 - DNA, 25 bp, Artificial sequence
  Synthetic oligonucleotide
tgacactttcacttttgcagattgg

SEQ ID NO: 711797 - DNA, 25 bp, Artificial sequence
  Synthetic oligonucleotide
ctttctgacactttcacttttgcag

SEQ ID NO: 711798 - DNA, 25 bp, Artificial sequence
  Synthetic oligonucleotide
ggtgctggcggctggtttacgccgc

SEQ ID NO: 711799 - DNA, 25 bp, Artificial sequence
  Synthetic oligonucleotide
ccgctgctgggagagatcccctggc

SEQ ID NO: 711800 - DNA, 25 bp, Artificial sequence
  Synthetic oligonucleotide
aaacgtcacgctcaatatatgacca

SEQ ID NO: 711801 - DNA, 25 bp, Artificial sequence
  Synthetic oligonucleotide
gagatcccctggcttgcagaaaatc

SEQ ID NO: 711802 - DNA, 25 bp, Artificial sequence
  Synthetic oligonucleotide
ggtgctggcggcaggtttacgccgc

SEQ ID NO: 711803 - DNA, 25 bp, Artificial sequence
  Synthetic oligonucleotide
ctgctgggagagttcccctggcttg

SEQ ID NO: 711804 - DNA, 25 bp, Artificial sequence
  Synthetic oligonucleotide
ccgctgctgggacagatcccctggc

SEQ ID NO: 711805 - DNA, 25 bp, Artificial sequence
  Synthetic oligonucleotide
gctgggagagatgccctggcttgca

SEQ ID NO: 711806 - DNA, 25 bp, Artificial sequence
  Synthetic oligonucleotide
gctgggagagatcccctggcttgca

SEQ ID NO: 711807 - DNA, 25 bp, Artificial sequence
  Synthetic oligonucleotide
cccgcatgattcccgcgccgctgct

SEQ ID NO: 711808 - DNA, 25 bp, Artificial sequence
  Synthetic oligonucleotide
ggagagatcccctggcttgcagaaa

SEQ ID NO: 711809 - DNA, 25 bp, Artificial sequence
  Synthetic oligonucleotide
ctgctgggagagatcccctggcttg

SEQ ID NO: 711810 - DNA, 25 bp, Artificial sequence
  Synthetic oligonucleotide
gagatcccctgggttgcagaaaatc

SEQ ID NO: 711811 - DNA, 25 bp, Artificial sequence
  Synthetic oligonucleotide
catgattcccgccccgctgctggga

SEQ ID NO: 711812 - DNA, 25 bp, Artificial sequence
  Synthetic oligonucleotide
atcccctggcttgcagaaaatccag

SEQ ID NO: 711813 - DNA, 25 bp, Artificial sequence
  Synthetic oligonucleotide
cgcgccgctgctgggagagatcccc

SEQ ID NO: 711814 - DNA, 25 bp, Artificial sequence
  Synthetic oligonucleotide
cgcgccgctgctcggagagatcccc

SEQ ID NO: 711815 - DNA, 25 bp, Artificial sequence
  Synthetic oligonucleotide
gattcccgcgccgctgctgggagag

SEQ ID NO: 711816 - DNA, 25 bp, Artificial sequence
  Synthetic oligonucleotide
gattcccgcgcccctgctgggagag

SEQ ID NO: 711817 - DNA, 25 bp, Artificial sequence
  Synthetic oligonucleotide
atcccctggcttccagaaaatccag

SEQ ID NO: 711818 - DNA, 25 bp, Artificial sequence
  Synthetic oligonucleotide
cccgcatgattcgcgcgccgctgct

SEQ ID NO: 711819 - DNA, 25 bp, Artificial sequence
  Synthetic oligonucleotide
ggagagatccccaggcttgcagaaa

SEQ ID NO: 711820 - DNA, 25 bp, Artificial sequence
  Synthetic oligonucleotide
catgattcccgcgccgctgctggga

SEQ ID NO: 711821 - DNA, 25 bp, Artificial sequence
  Synthetic oligonucleotide
aaacgtcacgctgaatatatgacca

SEQ ID NO: 711822 - DNA, 25 bp, Artificial sequence
  Synthetic oligonucleotide
cgtcacgctgaaaatatgaccacgc

SEQ ID NO: 711823 - DNA, 25 bp, Artificial sequence
  Synthetic oligonucleotide
cgtcacgctgaatatatgaccacgc

SEQ ID NO: 711824 - DNA, 25 bp, Artificial sequence
  Synthetic oligonucleotide
acgctgaatataagaccacgctcac

SEQ ID NO: 711825 - DNA, 25 bp, Artificial sequence
  Synthetic oligonucleotide
ctgctgggagagatcccctggcttg

SEQ ID NO: 711826 - DNA, 25 bp, Artificial sequence
  Synthetic oligonucleotide
ctgaatatatgagcacgctcacccg

SEQ ID NO: 711827 - DNA, 25 bp, Artificial sequence
  Synthetic oligonucleotide
acgctgaatatatgaccacgctcac

SEQ ID NO: 711828 - DNA, 25 bp, Artificial sequence
  Synthetic oligonucleotide
aaacgtcacgctcaatatatgacca

SEQ ID NO: 711829 - DNA, 25 bp, Artificial sequence
  Synthetic oligonucleotide
gaaaacgtcacgctgaatatatgac

SEQ ID NO: 711830 - DNA, 25 bp, Artificial sequence
  Synthetic oligonucleotide
gaaaacgtcacggtgaatatatgac

SEQ ID NO: 711831 - DNA, 25 bp, Artificial sequence
  Synthetic oligonucleotide
tttgcagattggctaacacaggaac

SEQ ID NO: 711832 - DNA, 25 bp, Artificial sequence
  Synthetic oligonucleotide
tttgcagattgggtaacacaggaac

SEQ ID NO: 711833 - DNA, 25 bp, Artificial sequence
  Synthetic oligonucleotide
tgacactttcacatttgcagattgg

SEQ ID NO: 711834 - DNA, 25 bp, Artificial sequence
  Synthetic oligonucleotide
ctgaatatatgaccacgctcacccg

SEQ ID NO: 711835 - DNA, 25 bp, Artificial sequence
  Synthetic oligonucleotide
ctttctgacactttcacttttgcag

SEQ ID NO: 711836 - DNA, 25 bp, Artificial sequence
  Synthetic oligonucleotide
gctgggagagatgccctggcttgca

SEQ ID NO: 711837 - DNA, 25 bp, Artificial sequence
  Synthetic oligonucleotide
ctttctgacactatcacttttgcag

SEQ ID NO: 711838 - DNA, 25 bp, Artificial sequence
  Synthetic oligonucleotide
ggtgctggcggcaggtttacgccgc

SEQ ID NO: 711839 - DNA, 25 bp, Artificial sequence
  Synthetic oligonucleotide
tgacactttcacttttgcagattgg

SEQ ID NO: 711840 - DNA, 25 bp, Artificial sequence
  Synthetic oligonucleotide
ggagagatcccctggcttgcagaaa

SEQ ID NO: 711841 - DNA, 25 bp, Artificial sequence
  Synthetic oligonucleotide
ccgctgctgggagagatcccctggc

SEQ ID NO: 711842 - DNA, 25 bp, Artificial sequence
  Synthetic oligonucleotide
ctgctgggagagttcccctggcttg

SEQ ID NO: 711843 - DNA, 25 bp, Artificial sequence
  Synthetic oligonucleotide
cccgcatgattcccgcgccgctgct

SEQ ID NO: 711844 - DNA, 25 bp, Artificial sequence
  Synthetic oligonucleotide
ggtgctggcggctggtttacgccgc

SEQ ID NO: 711845 - DNA, 25 bp, Artificial sequence
  Synthetic oligonucleotide
atcccctggcttccagaaaatccag

SEQ ID NO: 711846 - DNA, 25 bp, Artificial sequence
  Synthetic oligonucleotide
atcccctggcttgcagaaaatccag

SEQ ID NO: 711847 - DNA, 25 bp, Artificial sequence
  Synthetic oligonucleotide
gagatcccctgggttgcagaaaatc

SEQ ID NO: 711848 - DNA, 25 bp, Artificial sequence
  Synthetic oligonucleotide
ccgctgctgggacagatcccctggc

SEQ ID NO: 711849 - DNA, 25 bp, Artificial sequence
  Synthetic oligonucleotide
ggagagatccccaggcttgcagaaa

SEQ ID NO: 711850 - DNA, 25 bp, Artificial sequence
  Synthetic oligonucleotide
gaatatatgaccacgctcacccgca

SEQ ID NO: 711851 - DNA, 25 bp, Artificial sequence
  Synthetic oligonucleotide
gctgggagagatcccctggcttgca

SEQ ID NO: 711852 - DNA, 25 bp, Artificial sequence
  Synthetic oligonucleotide
cgcgccgctgctgggagagatcccc

SEQ ID NO: 711853 - DNA, 25 bp, Artificial sequence
  Synthetic oligonucleotide
cgcgccgctgctcggagagatcccc

SEQ ID NO: 711854 - DNA, 25 bp, Artificial sequence
  Synthetic oligonucleotide
gattcccgcgccgctgctgggagag

SEQ ID NO: 711855 - DNA, 25 bp, Artificial sequence
  Synthetic oligonucleotide
gattcccgcgcccctgctgggagag

SEQ ID NO: 711856 - DNA, 25 bp, Artificial sequence
  Synthetic oligonucleotide
catgattcccgcgccgctgctggga

SEQ ID NO: 711857 - DNA, 25 bp, Artificial sequence
  Synthetic oligonucleotide
cccgcatgattcgcgcgccgctgct

SEQ ID NO: 711858 - DNA, 25 bp, Artificial sequence
  Synthetic oligonucleotide
gaatatatgacctcgctcacccgca

SEQ ID NO: 711859 - DNA, 25 bp, Artificial sequence
  Synthetic oligonucleotide
gagatcccctggcttgcagaaaatc

SEQ ID NO: 711860 - DNA, 25 bp, Artificial sequence
  Synthetic oligonucleotide
catgattcccgccccgctgctggga

SEQ ID NO: 711861 - DNA, 25 bp, Artificial sequence
  Synthetic oligonucleotide
caagccgcaaaggcagcaggctacc

SEQ ID NO: 711862 - DNA, 25 bp, Artificial sequence
  Synthetic oligonucleotide
gcgctggcgttacagcgcaacagca

SEQ ID NO: 711863 - DNA, 25 bp, Artificial sequence
  Synthetic oligonucleotide
gcgctggcgttagagcgcaacagca

SEQ ID NO: 711864 - DNA, 25 bp, Artificial sequence
  Synthetic oligonucleotide
gcgacgcgctggggttacagcgcaa

SEQ ID NO: 711865 - DNA, 25 bp, Artificial sequence
  Synthetic oligonucleotide
gcgacgcgctggcgttacagcgcaa

SEQ ID NO: 711866 - DNA, 25 bp, Artificial sequence
  Synthetic oligonucleotide
cgcaatagcgacccgctggcgttac

SEQ ID NO: 711867 - DNA, 25 bp, Artificial sequence
  Synthetic oligonucleotide
cgcaatagcgacgcgctggcgttac

SEQ ID NO: 711868 - DNA, 25 bp, Artificial sequence
  Synthetic oligonucleotide
aggtttacgcaaaagcgacgcgctg

SEQ ID NO: 711869 - DNA, 25 bp, Artificial sequence
  Synthetic oligonucleotide
cgttacagcgcaacagcagcctgca

SEQ ID NO: 711870 - DNA, 25 bp, Artificial sequence
  Synthetic oligonucleotide
caagccgcaaagccagcaggctacc

SEQ ID NO: 711871 - DNA, 25 bp, Artificial sequence
  Synthetic oligonucleotide
aggtttacgcaatagcgacgcgctg

SEQ ID NO: 711872 - DNA, 25 bp, Artificial sequence
  Synthetic oligonucleotide
cacttttacaaggcgcaaaggcagc

SEQ ID NO: 711873 - DNA, 25 bp, Artificial sequence
  Synthetic oligonucleotide
cacttttacaagccgcaaaggcagc

SEQ ID NO: 711874 - DNA, 25 bp, Artificial sequence
  Synthetic oligonucleotide
cgccagttgtgcacttttacaagcc

SEQ ID NO: 711875 - DNA, 25 bp, Artificial sequence
  Synthetic oligonucleotide
cgccagttgtgctcttttacaagcc

SEQ ID NO: 711876 - DNA, 25 bp, Artificial sequence
  Synthetic oligonucleotide
gggaaaactgtcgccagttgtgcac

SEQ ID NO: 711877 - DNA, 25 bp, Artificial sequence
  Synthetic oligonucleotide
gggaaaactgtccccagttgtgcac

SEQ ID NO: 711878 - DNA, 25 bp, Artificial sequence
  Synthetic oligonucleotide
agcgcaacagcaccctgcagctgga

SEQ ID NO: 711879 - DNA, 25 bp, Artificial sequence
  Synthetic oligonucleotide
gcaaaggcagcacgctaccggacgg

SEQ ID NO: 711880 - DNA, 25 bp, Artificial sequence
  Synthetic oligonucleotide
cgcaagagggcacaccgatagaatc

SEQ ID NO: 711881 - DNA, 25 bp, Artificial sequence
  Synthetic oligonucleotide
cagcagcctgcacctggattacgca

SEQ ID NO: 711882 - DNA, 25 bp, Artificial sequence
  Synthetic oligonucleotide
cagcagcctgcagctggattacgca

SEQ ID NO: 711883 - DNA, 25 bp, Artificial sequence
  Synthetic oligonucleotide
gcaaaggcagcaggctaccggacgg

SEQ ID NO: 711884 - DNA, 25 bp, Artificial sequence
  Synthetic oligonucleotide
cgttacagcgcatcagcagcctgca

SEQ ID NO: 711885 - DNA, 25 bp, Artificial sequence
  Synthetic oligonucleotide
ctgcagctggattacgcaacagtaa

SEQ ID NO: 711886 - DNA, 25 bp, Artificial sequence
  Synthetic oligonucleotide
catcagcgcgcatgagggcagaccg

SEQ ID NO: 711887 - DNA, 25 bp, Artificial sequence
  Synthetic oligonucleotide
cgcaagagggcagaccgatagaatc

SEQ ID NO: 711888 - DNA, 25 bp, Artificial sequence
  Synthetic oligonucleotide
ctgcagctggataacgcaacagtaa

SEQ ID NO: 711889 - DNA, 25 bp, Artificial sequence
  Synthetic oligonucleotide
gggcagaccgatagaatcattggta

SEQ ID NO: 711890 - DNA, 25 bp, Artificial sequence
  Synthetic oligonucleotide
gggcagaccgattgaatcattggta

SEQ ID NO: 711891 - DNA, 25 bp, Artificial sequence
  Synthetic oligonucleotide
ttggtaatgagccccggattacgcg

SEQ ID NO: 711892 - DNA, 25 bp, Artificial sequence
  Synthetic oligonucleotide
agcgcaacagcagcctgcagctgga

SEQ ID NO: 711893 - DNA, 25 bp, Artificial sequence
  Synthetic oligonucleotide
atgagcgccggattacgcgcgcttg

SEQ ID NO: 711894 - DNA, 25 bp, Artificial sequence
  Synthetic oligonucleotide
catcagcgcgcaagagggcagaccg

SEQ ID NO: 711895 - DNA, 25 bp, Artificial sequence
  Synthetic oligonucleotide
atgagcgccggaatacgcgcgcttg

SEQ ID NO: 711896 - DNA, 25 bp, Artificial sequence
  Synthetic oligonucleotide
ttggtaatgagcgccggattacgcg

SEQ ID NO: 711897 - DNA, 25 bp, Artificial sequence
  Synthetic oligonucleotide
agaatcattggtaatgagcgccgga

SEQ ID NO: 711898 - DNA, 25 bp, Artificial sequence
  Synthetic oligonucleotide
agaatcattggttatgagcgccgga

SEQ ID NO: 711899 - DNA, 25 bp, Artificial sequence
  Synthetic oligonucleotide
gaccgatagaatcattggtaatgag

SEQ ID NO: 711900 - DNA, 25 bp, Artificial sequence
  Synthetic oligonucleotide
gaccgatagaatgattggtaatgag

SEQ ID NO: 711901 - DNA, 25 bp, Artificial sequence
  Synthetic oligonucleotide
aggtttacgcaatagcgacgcgctg

SEQ ID NO: 711902 - DNA, 25 bp, Artificial sequence
  Synthetic oligonucleotide
gcgctggcgttagagcgcaacagca

SEQ ID NO: 711903 - DNA, 25 bp, Artificial sequence
  Synthetic oligonucleotide
gcgacgcgctggggttacagcgcaa

SEQ ID NO: 711904 - DNA, 25 bp, Artificial sequence
  Synthetic oligonucleotide
gcgacgcgctggcgttacagcgcaa

SEQ ID NO: 711905 - DNA, 25 bp, Artificial sequence
  Synthetic oligonucleotide
cgcaatagcgacccgctggcgttac

SEQ ID NO: 711906 - DNA, 25 bp, Artificial sequence
  Synthetic oligonucleotide
cgcaatagcgacgcgctggcgttac

SEQ ID NO: 711907 - DNA, 25 bp, Artificial sequence
  Synthetic oligonucleotide
aggtttacgcaaaagcgacgcgctg

SEQ ID NO: 711908 - DNA, 25 bp, Artificial sequence
  Synthetic oligonucleotide
cgttacagcgcatcagcagcctgca

SEQ ID NO: 711909 - DNA, 25 bp, Artificial sequence
  Synthetic oligonucleotide
gcgctggcgttacagcgcaacagca

SEQ ID NO: 711910 - DNA, 25 bp, Artificial sequence
  Synthetic oligonucleotide
gcaaaggcagcacgctaccggacgg

SEQ ID NO: 711911 - DNA, 25 bp, Artificial sequence
  Synthetic oligonucleotide
gcaaaggcagcaggctaccggacgg

SEQ ID NO: 711912 - DNA, 25 bp, Artificial sequence
  Synthetic oligonucleotide
gggaaaactgtccccagttgtgcac

SEQ ID NO: 711913 - DNA, 25 bp, Artificial sequence
  Synthetic oligonucleotide
gggaaaactgtcgccagttgtgcac

SEQ ID NO: 711914 - DNA, 25 bp, Artificial sequence
  Synthetic oligonucleotide
cgccagttgtgctcttttacaagcc

SEQ ID NO: 711915 - DNA, 25 bp, Artificial sequence
  Synthetic oligonucleotide
cgccagttgtgcacttttacaagcc

SEQ ID NO: 711916 - DNA, 25 bp, Artificial sequence
  Synthetic oligonucleotide
cacttttacaaggcgcaaaggcagc

SEQ ID NO: 711917 - DNA, 25 bp, Artificial sequence
  Synthetic oligonucleotide
caagccgcaaaggcagcaggctacc

SEQ ID NO: 711918 - DNA, 25 bp, Artificial sequence
  Synthetic oligonucleotide
cgttacagcgcaacagcagcctgca

SEQ ID NO: 711919 - DNA, 25 bp, Artificial sequence
  Synthetic oligonucleotide
gggcagaccgattgaatcattggta

SEQ ID NO: 711920 - DNA, 25 bp, Artificial sequence
  Synthetic oligonucleotide
cacttttacaagccgcaaaggcagc

SEQ ID NO: 711921 - DNA, 25 bp, Artificial sequence
  Synthetic oligonucleotide
atgagcgccggaatacgcgcgcttg

SEQ ID NO: 711922 - DNA, 25 bp, Artificial sequence
  Synthetic oligonucleotide
gaccgatagaatgattggtaatgag

SEQ ID NO: 711923 - DNA, 25 bp, Artificial sequence
  Synthetic oligonucleotide
cgcaagagggcacaccgatagaatc

SEQ ID NO: 711924 - DNA, 25 bp, Artificial sequence
  Synthetic oligonucleotide
agaatcattggtaatgagcgccgga

SEQ ID NO: 711925 - DNA, 25 bp, Artificial sequence
  Synthetic oligonucleotide
agcgcaacagcagcctgcagctgga

SEQ ID NO: 711926 - DNA, 25 bp, Artificial sequence
  Synthetic oligonucleotide
agaatcattggttatgagcgccgga

SEQ ID NO: 711927 - DNA, 25 bp, Artificial sequence
  Synthetic oligonucleotide
ttggtaatgagcgccggattacgcg

SEQ ID NO: 711928 - DNA, 25 bp, Artificial sequence
  Synthetic oligonucleotide
ttggtaatgagccccggattacgcg

SEQ ID NO: 711929 - DNA, 25 bp, Artificial sequence
  Synthetic oligonucleotide
atgagcgccggattacgcgcgcttg

SEQ ID NO: 711930 - DNA, 25 bp, Artificial sequence
  Synthetic oligonucleotide
gaccgatagaatcattggtaatgag

SEQ ID NO: 711931 - DNA, 25 bp, Artificial sequence
  Synthetic oligonucleotide
ctgcagctggattacgcaacagtaa

SEQ ID NO: 711932 - DNA, 25 bp, Artificial sequence
  Synthetic oligonucleotide
agcgcaacagcaccctgcagctgga

SEQ ID NO: 711933 - DNA, 25 bp, Artificial sequence
  Synthetic oligonucleotide
cagcagcctgcacctggattacgca

SEQ ID NO: 711934 - DNA, 25 bp, Artificial sequence
  Synthetic oligonucleotide
ctgcagctggataacgcaacagtaa

SEQ ID NO: 711935 - DNA, 25 bp, Artificial sequence
  Synthetic oligonucleotide
gggcagaccgatagaatcattggta

SEQ ID NO: 711936 - DNA, 25 bp, Artificial sequence
  Synthetic oligonucleotide
catcagcgcgcaagagggcagaccg

SEQ ID NO: 711937 - DNA, 25 bp, Artificial sequence
  Synthetic oligonucleotide
catcagcgcgcatgagggcagaccg

SEQ ID NO: 711938 - DNA, 25 bp, Artificial sequence
  Synthetic oligonucleotide
cgcaagagggcagaccgatagaatc

SEQ ID NO: 711939 - DNA, 25 bp, Artificial sequence
  Synthetic oligonucleotide
caagccgcaaagccagcaggctacc

SEQ ID NO: 711940 - DNA, 25 bp, Artificial sequence
  Synthetic oligonucleotide
cagcagcctgcagctggattacgca

SEQ ID NO: 711941 - DNA, 25 bp, Artificial sequence
  Synthetic oligonucleotide
ttgcgtcacacactgggcgtgctta

SEQ ID NO: 711942 - DNA, 25 bp, Artificial sequence
  Synthetic oligonucleotide
cgctttacaccctcggactacaagc

SEQ ID NO: 711943 - DNA, 25 bp, Artificial sequence
  Synthetic oligonucleotide
ccgctttacaccctcggactacaag

SEQ ID NO: 711944 - DNA, 25 bp, Artificial sequence
  Synthetic oligonucleotide
acccttgcgtcacacactgggcgtg

SEQ ID NO: 711945 - DNA, 25 bp, Artificial sequence
  Synthetic oligonucleotide
ccttgcgtcacacactgggcgtgct

SEQ ID NO: 711946 - DNA, 25 bp, Artificial sequence
  Synthetic oligonucleotide
cttgcgtcacacactgggcgtgctt

SEQ ID NO: 711947 - DNA, 25 bp, Artificial sequence
  Synthetic oligonucleotide
tgcgtcacacactgggcgtgcttac

SEQ ID NO: 711948 - DNA, 25 bp, Artificial sequence
  Synthetic oligonucleotide
gcgtcacacactgggcgtgcttaca

SEQ ID NO: 711949 - DNA, 25 bp, Artificial sequence
  Synthetic oligonucleotide
cgtcacacactgggcgtgcttacac

SEQ ID NO: 711950 - DNA, 25 bp, Artificial sequence
  Synthetic oligonucleotide
gtcacacactgggcgtgcttacact

SEQ ID NO: 711951 - DNA, 25 bp, Artificial sequence
  Synthetic oligonucleotide
cacacactgggcgtgcttacactcc

SEQ ID NO: 711952 - DNA, 25 bp, Artificial sequence
  Synthetic oligonucleotide
acacactgggcgtgcttacactccc

SEQ ID NO: 711953 - DNA, 25 bp, Artificial sequence
  Synthetic oligonucleotide
cactgggcgtgcttacactccccgc

SEQ ID NO: 711954 - DNA, 25 bp, Artificial sequence
  Synthetic oligonucleotide
ccccttttccggcagctcccagagc

SEQ ID NO: 711955 - DNA, 25 bp, Artificial sequence
  Synthetic oligonucleotide
cacgccccgcgtaccaggcccgctt

SEQ ID NO: 711956 - DNA, 25 bp, Artificial sequence
  Synthetic oligonucleotide
caggcccgctttacaccctcggact

SEQ ID NO: 711957 - DNA, 25 bp, Artificial sequence
  Synthetic oligonucleotide
gcccgctttacaccctcggactaca

SEQ ID NO: 711958 - DNA, 25 bp, Artificial sequence
  Synthetic oligonucleotide
actacaagcccacagctcagtaatc

SEQ ID NO: 711959 - DNA, 25 bp, Artificial sequence
  Synthetic oligonucleotide
tcacacactgggcgtgcttacactc

SEQ ID NO: 711960 - DNA, 25 bp, Artificial sequence
  Synthetic oligonucleotide
acagctcagtaatcaactgcaccct

SEQ ID NO: 711961 - DNA, 25 bp, Artificial sequence
  Synthetic oligonucleotide
tacaagcccacagctcagtaatcaa

SEQ ID NO: 711962 - DNA, 25 bp, Artificial sequence
  Synthetic oligonucleotide
accaggccctgccccgtgctaggcc

SEQ ID NO: 711963 - DNA, 25 bp, Artificial sequence
  Synthetic oligonucleotide
tcagtaatcaactgcaccctgactc

SEQ ID NO: 711964 - DNA, 25 bp, Artificial sequence
  Synthetic oligonucleotide
ctcagtaatcaactgcaccctgact

SEQ ID NO: 711965 - DNA, 25 bp, Artificial sequence
  Synthetic oligonucleotide
gctcagtaatcaactgcaccctgac

SEQ ID NO: 711966 - DNA, 25 bp, Artificial sequence
  Synthetic oligonucleotide
cagctcagtaatcaactgcaccctg

SEQ ID NO: 711967 - DNA, 25 bp, Artificial sequence
  Synthetic oligonucleotide
gcccacagctcagtaatcaactgca

SEQ ID NO: 711968 - DNA, 25 bp, Artificial sequence
  Synthetic oligonucleotide
agcccacagctcagtaatcaactgc

SEQ ID NO: 711969 - DNA, 25 bp, Artificial sequence
  Synthetic oligonucleotide
aagcccacagctcagtaatcaactg

SEQ ID NO: 711970 - DNA, 25 bp, Artificial sequence
  Synthetic oligonucleotide
tacaccctcggactacaagcccaca

SEQ ID NO: 711971 - DNA, 25 bp, Artificial sequence
  Synthetic oligonucleotide
tttacaccctcggactacaagccca

SEQ ID NO: 711972 - DNA, 25 bp, Artificial sequence
  Synthetic oligonucleotide
agctcagtaatcaactgcaccctga

SEQ ID NO: 711973 - DNA, 25 bp, Artificial sequence
  Synthetic oligonucleotide
ttacaccctcggactacaagcccac

SEQ ID NO: 711974 - DNA, 25 bp, Artificial sequence
  Synthetic oligonucleotide
caagcccacagctcagtaatcaact

SEQ ID NO: 711975 - DNA, 25 bp, Artificial sequence
  Synthetic oligonucleotide
caccctcggactacaagcccacagc

SEQ ID NO: 711976 - DNA, 25 bp, Artificial sequence
  Synthetic oligonucleotide
ccctcggactacaagcccacagctc

SEQ ID NO: 711977 - DNA, 25 bp, Artificial sequence
  Synthetic oligonucleotide
ggactacaagcccacagctcagtaa

SEQ ID NO: 711978 - DNA, 25 bp, Artificial sequence
  Synthetic oligonucleotide
gactacaagcccacagctcagtaat

SEQ ID NO: 711979 - DNA, 25 bp, Artificial sequence
  Synthetic oligonucleotide
ctacaagcccacagctcagtaatca

SEQ ID NO: 711980 - DNA, 25 bp, Artificial sequence
  Synthetic oligonucleotide
acaagcccacagctcagtaatcaac

SEQ ID NO: 711981 - DNA, 25 bp, Artificial sequence
  Synthetic oligonucleotide
cgtagattggggtacccgagaggag

SEQ ID NO: 711982 - DNA, 25 bp, Artificial sequence
  Synthetic oligonucleotide
cacctgtcctgttagggagggaccg

SEQ ID NO: 711983 - DNA, 25 bp, Artificial sequence
  Synthetic oligonucleotide
ggagccgcggcgcactactgagttc

SEQ ID NO: 711984 - DNA, 25 bp, Artificial sequence
  Synthetic oligonucleotide
gcggcgcactactgagttcccaaga

SEQ ID NO: 711985 - DNA, 25 bp, Artificial sequence
  Synthetic oligonucleotide
ggcgcactactgagttcccaagaac

SEQ ID NO: 711986 - DNA, 25 bp, Artificial sequence
  Synthetic oligonucleotide
aagtggtgtccggaagagtcaaggc

SEQ ID NO: 711987 - DNA, 25 bp, Artificial sequence
  Synthetic oligonucleotide
cgttcgcggtcgaaggaaagtggtg

SEQ ID NO: 711988 - DNA, 25 bp, Artificial sequence
  Synthetic oligonucleotide
tgcgttgagaccgttcgcggtcgaa

SEQ ID NO: 711989 - DNA, 25 bp, Artificial sequence
  Synthetic oligonucleotide
ctctgcgctgctcactggtgtggga

SEQ ID NO: 711990 - DNA, 25 bp, Artificial sequence
  Synthetic oligonucleotide
atccgcttcgctgtgtttttctgcc

SEQ ID NO: 711991 - DNA, 25 bp, Artificial sequence
  Synthetic oligonucleotide
cccaagaacttctgctagactcctg

SEQ ID NO: 711992 - DNA, 25 bp, Artificial sequence
  Synthetic oligonucleotide
gcactactgagttcccaagaacttc

SEQ ID NO: 711993 - DNA, 25 bp, Artificial sequence
  Synthetic oligonucleotide
gaacttctgctagactcctgcccgg

SEQ ID NO: 711994 - DNA, 25 bp, Artificial sequence
  Synthetic oligonucleotide
tgctagactcctgcccggcctaacc

SEQ ID NO: 711995 - DNA, 25 bp, Artificial sequence
  Synthetic oligonucleotide
cgaccgcacccgagctcagtgtttg

SEQ ID NO: 711996 - DNA, 25 bp, Artificial sequence
  Synthetic oligonucleotide
cgcacccgagctcagtgtttgctcg

SEQ ID NO: 711997 - DNA, 25 bp, Artificial sequence
  Synthetic oligonucleotide
gagctcagtgtttgctcggcgtctg

SEQ ID NO: 711998 - DNA, 25 bp, Artificial sequence
  Synthetic oligonucleotide
ctcagtgtttgctcggcgtctgccg

SEQ ID NO: 711999 - DNA, 25 bp, Artificial sequence
  Synthetic oligonucleotide
tttgctcggcgtctgccgggtccgc

SEQ ID NO: 712000 - DNA, 25 bp, Artificial sequence
  Synthetic oligonucleotide
atgggagcccggtgccgcagctttt

SEQ ID NO: 712001 - DNA, 25 bp, Artificial sequence
  Synthetic oligonucleotide
ctcctgctgcaggtatgtggagggt

SEQ ID NO: 712002 - DNA, 25 bp, Artificial sequence
  Synthetic oligonucleotide
atgtggagggtcctgactcgtgccc

SEQ ID NO: 712003 - DNA, 25 bp, Artificial sequence
  Synthetic oligonucleotide
acccgagaggagtctgcgggtgtgc

SEQ ID NO: 712004 - DNA, 25 bp, Artificial sequence
  Synthetic oligonucleotide
catgatccgcttcgctgtgtttttc

SEQ ID NO: 712005 - DNA, 25 bp, Artificial sequence
  Synthetic oligonucleotide
ctctggcgcaggttcccaggtgggg

SEQ ID NO: 712006 - DNA, 25 bp, Artificial sequence
  Synthetic oligonucleotide
aagcacctgtcctgttagggaggga

SEQ ID NO: 712007 - DNA, 25 bp, Artificial sequence
  Synthetic oligonucleotide
tataaaagcacctgtcctgttaggg

SEQ ID NO: 712008 - DNA, 25 bp, Artificial sequence
  Synthetic oligonucleotide
tagtattataaaagcacctgtcctg

SEQ ID NO: 712009 - DNA, 25 bp, Artificial sequence
  Synthetic oligonucleotide
cgatccgagataagggaagggattt

SEQ ID NO: 712010 - DNA, 25 bp, Artificial sequence
  Synthetic oligonucleotide
gaagtagcgcggacgatccgagata

SEQ ID NO: 712011 - DNA, 25 bp, Artificial sequence
  Synthetic oligonucleotide
cccatgatccgcttcgctgtgtttt

SEQ ID NO: 712012 - DNA, 25 bp, Artificial sequence
  Synthetic oligonucleotide
gagcagggtccctgtttgagacaga

SEQ ID NO: 712013 - DNA, 25 bp, Artificial sequence
  Synthetic oligonucleotide
tgagttcccaagaacttctgctaga

SEQ ID NO: 712014 - DNA, 25 bp, Artificial sequence
  Synthetic oligonucleotide
gcgcggagtggtcgcctctggcgca

SEQ ID NO: 712015 - DNA, 25 bp, Artificial sequence
  Synthetic oligonucleotide
gatccggagggccagatcgccctgg

SEQ ID NO: 712016 - DNA, 25 bp, Artificial sequence
  Synthetic oligonucleotide
cgcttcccttcttccaagaaagttg

SEQ ID NO: 712017 - DNA, 25 bp, Artificial sequence
  Synthetic oligonucleotide
gccggctgtggtcccgcttcccttc

SEQ ID NO: 712018 - DNA, 25 bp, Artificial sequence
  Synthetic oligonucleotide
ctgtgtttttctgccggctgtggtc

SEQ ID NO: 712019 - DNA, 25 bp, Artificial sequence
  Synthetic oligonucleotide
cttcgctgtgtttttctgccggctg

SEQ ID NO: 712020 - DNA, 25 bp, Artificial sequence
  Synthetic oligonucleotide
tgcctgtagaaggtggggtgctgaa

SEQ ID NO: 712021 - DNA, 25 bp, Artificial sequence
  Synthetic oligonucleotide
ccttccttcgaaatgacctggagca

SEQ ID NO: 712022 - DNA, 25 bp, Artificial sequence
  Synthetic oligonucleotide
gcgcaagcgcgacctgacacactca

SEQ ID NO: 712023 - DNA, 25 bp, Artificial sequence
  Synthetic oligonucleotide
ggagcagcacaaccagcagtggcta

SEQ ID NO: 712024 - DNA, 25 bp, Artificial sequence
  Synthetic oligonucleotide
actcggactcggagctcgagcagta

SEQ ID NO: 712025 - DNA, 25 bp, Artificial sequence
  Synthetic oligonucleotide
gctactgcagccaggaggactcgga

SEQ ID NO: 712026 - DNA, 25 bp, Artificial sequence
  Synthetic oligonucleotide
ccagcagtggctactgcagccagga

SEQ ID NO: 712027 - DNA, 25 bp, Artificial sequence
  Synthetic oligonucleotide
cgaaatgacctggagcagcacaacc

SEQ ID NO: 712028 - DNA, 25 bp, Artificial sequence
  Synthetic oligonucleotide
tgggactctgcactagagcgggata

SEQ ID NO: 712029 - DNA, 25 bp, Artificial sequence
  Synthetic oligonucleotide
gcgaggctgaaacaccttccttcga

SEQ ID NO: 712030 - DNA, 25 bp, Artificial sequence
  Synthetic oligonucleotide
acttcacggcgcgtacctcgctggt

SEQ ID NO: 712031 - DNA, 25 bp, Artificial sequence
  Synthetic oligonucleotide
gcggtggttagaggctctccacgca

SEQ ID NO: 712032 - DNA, 25 bp, Artificial sequence
  Synthetic oligonucleotide
aaagttaggtgatgggcagcctccc

SEQ ID NO: 712033 - DNA, 25 bp, Artificial sequence
  Synthetic oligonucleotide
tttcagtcctaacggttgccgcgcg

SEQ ID NO: 712034 - DNA, 25 bp, Artificial sequence
  Synthetic oligonucleotide
cgggctgtctacgtttcagtcctaa

SEQ ID NO: 712035 - DNA, 25 bp, Artificial sequence
  Synthetic oligonucleotide
accagagctaaagtcgggctgtcta

SEQ ID NO: 712036 - DNA, 25 bp, Artificial sequence
  Synthetic oligonucleotide
ccctcgacaccagagctaaagtcgg

SEQ ID NO: 712037 - DNA, 25 bp, Artificial sequence
  Synthetic oligonucleotide
atccgtcgagctgtagcgtcgtggc

SEQ ID NO: 712038 - DNA, 25 bp, Artificial sequence
  Synthetic oligonucleotide
atgaggtcatccgtcgagctgtagc

SEQ ID NO: 712039 - DNA, 25 bp, Artificial sequence
  Synthetic oligonucleotide
tgcctctgcgatgaggtcatccgtc

SEQ ID NO: 712040 - DNA, 25 bp, Artificial sequence
  Synthetic oligonucleotide
ctctccacgcagtggactagggatc

SEQ ID NO: 712041 - DNA, 25 bp, Artificial sequence
  Synthetic oligonucleotide
agttcacctgccattaccgttgtcg

SEQ ID NO: 712042 - DNA, 25 bp, Artificial sequence
  Synthetic oligonucleotide
ggtttgtcaggcgaaggcgctccct

SEQ ID NO: 712043 - DNA, 25 bp, Artificial sequence
  Synthetic oligonucleotide
agatgctagtttcgctgggtttgtc

SEQ ID NO: 712044 - DNA, 25 bp, Artificial sequence
  Synthetic oligonucleotide
tcccggcatcagagatgctagtttc

SEQ ID NO: 712045 - DNA, 25 bp, Artificial sequence
  Synthetic oligonucleotide
cagtgatcaatttcccggcatcaga

SEQ ID NO: 712046 - DNA, 25 bp, Artificial sequence
  Synthetic oligonucleotide
tccctacgccgtgcataatgaacac

SEQ ID NO: 712047 - DNA, 25 bp, Artificial sequence
  Synthetic oligonucleotide
agggttaatccctacgccgtgcata

SEQ ID NO: 712048 - DNA, 25 bp, Artificial sequence
  Synthetic oligonucleotide
gaggtgtgcagggttaatccctacg

SEQ ID NO: 712049 - DNA, 25 bp, Artificial sequence
  Synthetic oligonucleotide
agctcgagcagtacttcacggcgcg

SEQ ID NO: 712050 - DNA, 25 bp, Artificial sequence
  Synthetic oligonucleotide
cgctcgtctgcttggactgctgcgg

SEQ ID NO: 712051 - DNA, 25 bp, Artificial sequence
  Synthetic oligonucleotide
cagcggcggtgcacatgcgcacacg

SEQ ID NO: 712052 - DNA, 25 bp, Artificial sequence
  Synthetic oligonucleotide
cagactgcaagttcacctgccatta

SEQ ID NO: 712053 - DNA, 25 bp, Artificial sequence
  Synthetic oligonucleotide
ggccagccctttctgcagactgcaa

SEQ ID NO: 712054 - DNA, 25 bp, Artificial sequence
  Synthetic oligonucleotide
agccgagtggagatgcctctgcgat

SEQ ID NO: 712055 - DNA, 25 bp, Artificial sequence
  Synthetic oligonucleotide
agggttctctgtcccgagtagaagc

SEQ ID NO: 712056 - DNA, 25 bp, Artificial sequence
  Synthetic oligonucleotide
gaagcgtacgtagggttctctgtcc

SEQ ID NO: 712057 - DNA, 25 bp, Artificial sequence
  Synthetic oligonucleotide
cctgacaaaagcgaggaagcgtacg

SEQ ID NO: 712058 - DNA, 25 bp, Artificial sequence
  Synthetic oligonucleotide
tccatagcgagccactcggagggtc

SEQ ID NO: 712059 - DNA, 25 bp, Artificial sequence
  Synthetic oligonucleotide
cactagagcgggatacgaacgtggt

SEQ ID NO: 712060 - DNA, 25 bp, Artificial sequence
  Synthetic oligonucleotide
cattaccgttgtcgcgcgctcgtct

SEQ ID NO: 712061 - DNA, 25 bp, Artificial sequence
  Synthetic oligonucleotide
ctacacttgttaccgcttgtcctga

SEQ ID NO: 712062 - DNA, 25 bp, Artificial sequence
  Synthetic oligonucleotide
cgtggagcagagagacaccagagct

SEQ ID NO: 712063 - DNA, 25 bp, Artificial sequence
  Synthetic oligonucleotide
tggagcagagagacaccagagctcc

SEQ ID NO: 712064 - DNA, 25 bp, Artificial sequence
  Synthetic oligonucleotide
agcagagagacaccagagctccgcg

SEQ ID NO: 712065 - DNA, 25 bp, Artificial sequence
  Synthetic oligonucleotide
gcagagagacaccagagctccgcgc

SEQ ID NO: 712066 - DNA, 25 bp, Artificial sequence
  Synthetic oligonucleotide
gagacaccagagctccgcgcccgcg

SEQ ID NO: 712067 - DNA, 25 bp, Artificial sequence
  Synthetic oligonucleotide
cgcgcccgcggctcactacacttgt

SEQ ID NO: 712068 - DNA, 25 bp, Artificial sequence
  Synthetic oligonucleotide
ggctcactacacttgttaccgcttg

SEQ ID NO: 712069 - DNA, 25 bp, Artificial sequence
  Synthetic oligonucleotide
ctgaggtcagggtgggagcccgcaa

SEQ ID NO: 712070 - DNA, 25 bp, Artificial sequence
  Synthetic oligonucleotide
actacacttgttaccgcttgtcctg

SEQ ID NO: 712071 - DNA, 25 bp, Artificial sequence
  Synthetic oligonucleotide
tcagcacgtggagcagagagacacc

SEQ ID NO: 712072 - DNA, 25 bp, Artificial sequence
  Synthetic oligonucleotide
cacttgttaccgcttgtcctgagcg

SEQ ID NO: 712073 - DNA, 25 bp, Artificial sequence
  Synthetic oligonucleotide
cttgttaccgcttgtcctgagcgcg

SEQ ID NO: 712074 - DNA, 25 bp, Artificial sequence
  Synthetic oligonucleotide
tgttaccgcttgtcctgagcgcgga

SEQ ID NO: 712075 - DNA, 25 bp, Artificial sequence
  Synthetic oligonucleotide
ttaccgcttgtcctgagcgcggaga

SEQ ID NO: 712076 - DNA, 25 bp, Artificial sequence
  Synthetic oligonucleotide
taccgcttgtcctgagcgcggagag

SEQ ID NO: 712077 - DNA, 25 bp, Artificial sequence
  Synthetic oligonucleotide
cgcttgtcctgagcgcggagaggac

SEQ ID NO: 712078 - DNA, 25 bp, Artificial sequence
  Synthetic oligonucleotide
agaggacgagctccggctgaggtca

SEQ ID NO: 712079 - DNA, 25 bp, Artificial sequence
  Synthetic oligonucleotide
ctcactacacttgttaccgcttgtc

SEQ ID NO: 712080 - DNA, 25 bp, Artificial sequence
  Synthetic oligonucleotide
atcagagagcgcctctcagcacgtg

SEQ ID NO: 712081 - DNA, 25 bp, Artificial sequence
  Synthetic oligonucleotide
cgaaatccagttcgcgctttgcgct

SEQ ID NO: 712082 - DNA, 25 bp, Artificial sequence
  Synthetic oligonucleotide
atccagttcgcgctttgcgctttgc

SEQ ID NO: 712083 - DNA, 25 bp, Artificial sequence
  Synthetic oligonucleotide
ccagttcgcgctttgcgctttgccg

SEQ ID NO: 712084 - DNA, 25 bp, Artificial sequence
  Synthetic oligonucleotide
agttcgcgctttgcgctttgccggc

SEQ ID NO: 712085 - DNA, 25 bp, Artificial sequence
  Synthetic oligonucleotide
cgcgctttgcgctttgccggcaggc

SEQ ID NO: 712086 - DNA, 25 bp, Artificial sequence
  Synthetic oligonucleotide
tgccggcaggcctacgcagcccggc

SEQ ID NO: 712087 - DNA, 25 bp, Artificial sequence
  Synthetic oligonucleotide
agcccggcctctgtcgagagccaat

SEQ ID NO: 712088 - DNA, 25 bp, Artificial sequence
  Synthetic oligonucleotide
ccggcctctgtcgagagccaatcag

SEQ ID NO: 712089 - DNA, 25 bp, Artificial sequence
  Synthetic oligonucleotide
gcacgtggagcagagagacaccaga

SEQ ID NO: 712090 - DNA, 25 bp, Artificial sequence
  Synthetic oligonucleotide
gcctctgtcgagagccaatcagaga

SEQ ID NO: 712091 - DNA, 25 bp, Artificial sequence
  Synthetic oligonucleotide
cagcacgtggagcagagagacacca

SEQ ID NO: 712092 - DNA, 25 bp, Artificial sequence
  Synthetic oligonucleotide
tcagagagcgcctctcagcacgtgg

SEQ ID NO: 712093 - DNA, 25 bp, Artificial sequence
  Synthetic oligonucleotide
agagagcgcctctcagcacgtggag

SEQ ID NO: 712094 - DNA, 25 bp, Artificial sequence
  Synthetic oligonucleotide
agagcgcctctcagcacgtggagca

SEQ ID NO: 712095 - DNA, 25 bp, Artificial sequence
  Synthetic oligonucleotide
agcgcctctcagcacgtggagcaga

SEQ ID NO: 712096 - DNA, 25 bp, Artificial sequence
  Synthetic oligonucleotide
cgcctctcagcacgtggagcagaga

SEQ ID NO: 712097 - DNA, 25 bp, Artificial sequence
  Synthetic oligonucleotide
cctctcagcacgtggagcagagaga

SEQ ID NO: 712098 - DNA, 25 bp, Artificial sequence
  Synthetic oligonucleotide
tctcagcacgtggagcagagagaca

SEQ ID NO: 712099 - DNA, 25 bp, Artificial sequence
  Synthetic oligonucleotide
gtcagggtgggagcccgcaaccgag

SEQ ID NO: 712100 - DNA, 25 bp, Artificial sequence
  Synthetic oligonucleotide
cggcctctgtcgagagccaatcaga

SEQ ID NO: 712101 - DNA, 25 bp, Artificial sequence
  Synthetic oligonucleotide
aggtgctggatcctctggctgcacg

SEQ ID NO: 712102 - DNA, 25 bp, Artificial sequence
  Synthetic oligonucleotide
ttacaatctatctaaaattcccgcg

SEQ ID NO: 712103 - DNA, 25 bp, Artificial sequence
  Synthetic oligonucleotide
gccgcaattacaatctatctaaaat

SEQ ID NO: 712104 - DNA, 25 bp, Artificial sequence
  Synthetic oligonucleotide
gcagccgcaattacaatctatctaa

SEQ ID NO: 712105 - DNA, 25 bp, Artificial sequence
  Synthetic oligonucleotide
cgcagccgcaattacaatctatcta

SEQ ID NO: 712106 - DNA, 25 bp, Artificial sequence
  Synthetic oligonucleotide
cgcgcagccgcaattacaatctatc

SEQ ID NO: 712107 - DNA, 25 bp, Artificial sequence
  Synthetic oligonucleotide
gccgcgcagccgcaattacaatcta

SEQ ID NO: 712108 - DNA, 25 bp, Artificial sequence
  Synthetic oligonucleotide
atcctctggctgcacgggcagcggc

SEQ ID NO: 712109 - DNA, 25 bp, Artificial sequence
  Synthetic oligonucleotide
aaagatccgtacttccaagcgccga

SEQ ID NO: 712110 - DNA, 25 bp, Artificial sequence
  Synthetic oligonucleotide
tgctggatcctctggctgcacgggc

SEQ ID NO: 712111 - DNA, 25 bp, Artificial sequence
  Synthetic oligonucleotide
gctctccgtcgccaaggaaaccggc

SEQ ID NO: 712112 - DNA, 25 bp, Artificial sequence
  Synthetic oligonucleotide
gaggtgctggatcctctggctgcac

SEQ ID NO: 712113 - DNA, 25 bp, Artificial sequence
  Synthetic oligonucleotide
ccaagcgccgaggacggagaagccc

SEQ ID NO: 712114 - DNA, 25 bp, Artificial sequence
  Synthetic oligonucleotide
ttccaagcgccgaggacggagaagc

SEQ ID NO: 712115 - DNA, 25 bp, Artificial sequence
  Synthetic oligonucleotide
ccgtacttccaagcgccgaggacgg

SEQ ID NO: 712116 - DNA, 25 bp, Artificial sequence
  Synthetic oligonucleotide
tccgtacttccaagcgccgaggacg

SEQ ID NO: 712117 - DNA, 25 bp, Artificial sequence
  Synthetic oligonucleotide
gatccgtacttccaagcgccgagga

SEQ ID NO: 712118 - DNA, 25 bp, Artificial sequence
  Synthetic oligonucleotide
agatccgtacttccaagcgccgagg

SEQ ID NO: 712119 - DNA, 25 bp, Artificial sequence
  Synthetic oligonucleotide
tggatcctctggctgcacgggcagc

SEQ ID NO: 712120 - DNA, 25 bp, Artificial sequence
  Synthetic oligonucleotide
agcgctagcctttcggaacacaaga

SEQ ID NO: 712121 - DNA, 25 bp, Artificial sequence
  Synthetic oligonucleotide
aacacaagatccagacacgtcagcg

SEQ ID NO: 712122 - DNA, 25 bp, Artificial sequence
  Synthetic oligonucleotide
ggaacacaagatccagacacgtcag

SEQ ID NO: 712123 - DNA, 25 bp, Artificial sequence
  Synthetic oligonucleotide
tcggaacacaagatccagacacgtc

SEQ ID NO: 712124 - DNA, 25 bp, Artificial sequence
  Synthetic oligonucleotide
tttcggaacacaagatccagacacg

SEQ ID NO: 712125 - DNA, 25 bp, Artificial sequence
  Synthetic oligonucleotide
cctttcggaacacaagatccagaca

SEQ ID NO: 712126 - DNA, 25 bp, Artificial sequence
  Synthetic oligonucleotide
agcctttcggaacacaagatccaga

SEQ ID NO: 712127 - DNA, 25 bp, Artificial sequence
  Synthetic oligonucleotide
ctagcctttcggaacacaagatcca

SEQ ID NO: 712128 - DNA, 25 bp, Artificial sequence
  Synthetic oligonucleotide
aaaattcccgcgctctccgtcgcca

SEQ ID NO: 712129 - DNA, 25 bp, Artificial sequence
  Synthetic oligonucleotide
gcgctagcctttcggaacacaagat

SEQ ID NO: 712130 - DNA, 25 bp, Artificial sequence
  Synthetic oligonucleotide
cccgcgctctccgtcgccaaggaaa

SEQ ID NO: 712131 - DNA, 25 bp, Artificial sequence
  Synthetic oligonucleotide
ctagcgctagcctttcggaacacaa

SEQ ID NO: 712132 - DNA, 25 bp, Artificial sequence
  Synthetic oligonucleotide
cctagcgctagcctttcggaacaca

SEQ ID NO: 712133 - DNA, 25 bp, Artificial sequence
  Synthetic oligonucleotide
cgcctagcgctagcctttcggaaca

SEQ ID NO: 712134 - DNA, 25 bp, Artificial sequence
  Synthetic oligonucleotide
ggcgcctagcgctagcctttcggaa

SEQ ID NO: 712135 - DNA, 25 bp, Artificial sequence
  Synthetic oligonucleotide
gcttggcgcctagcgctagcctttc

SEQ ID NO: 712136 - DNA, 25 bp, Artificial sequence
  Synthetic oligonucleotide
cgcttggcgcctagcgctagccttt

SEQ ID NO: 712137 - DNA, 25 bp, Artificial sequence
  Synthetic oligonucleotide
ggaaaccggccgcttggcgcctagc

SEQ ID NO: 712138 - DNA, 25 bp, Artificial sequence
  Synthetic oligonucleotide
atctatctaaaattcccgcgctctc

SEQ ID NO: 712139 - DNA, 25 bp, Artificial sequence
  Synthetic oligonucleotide
gctagcctttcggaacacaagatcc

SEQ ID NO: 712140 - DNA, 25 bp, Artificial sequence
  Synthetic oligonucleotide
aaaagatccgtacttccaagcgccg

SEQ ID NO: 712141 - DNA, 25 bp, Artificial sequence
  Synthetic oligonucleotide
tgagaggacgaaagcctccggcttc

SEQ ID NO: 712142 - DNA, 25 bp, Artificial sequence
  Synthetic oligonucleotide
cgaggaactgggcaggtaccaggaa

SEQ ID NO: 712143 - DNA, 25 bp, Artificial sequence
  Synthetic oligonucleotide
gctttgtgtcccttccccgagctgt

SEQ ID NO: 712144 - DNA, 25 bp, Artificial sequence
  Synthetic oligonucleotide
ggcagggcgctttgtgtcccttccc

SEQ ID NO: 712145 - DNA, 25 bp, Artificial sequence
  Synthetic oligonucleotide
cgcacgaagcgacagctgcgggacc

SEQ ID NO: 712146 - DNA, 25 bp, Artificial sequence
  Synthetic oligonucleotide
gctcagggcgcacgaagcgacagct

SEQ ID NO: 712147 - DNA, 25 bp, Artificial sequence
  Synthetic oligonucleotide
acgcaaggagcggaggccgctcgga

SEQ ID NO: 712148 - DNA, 25 bp, Artificial sequence
  Synthetic oligonucleotide
agctgcgcccgacgcaaggagcgga

SEQ ID NO: 712149 - DNA, 25 bp, Artificial sequence
  Synthetic oligonucleotide
ccgagtcacaggtggggcgcgcgct

SEQ ID NO: 712150 - DNA, 25 bp, Artificial sequence
  Synthetic oligonucleotide
acgactactacgacaccggcgagga

SEQ ID NO: 712151 - DNA, 25 bp, Artificial sequence
  Synthetic oligonucleotide
tacgacaccggcgaggaactgggca

SEQ ID NO: 712152 - DNA, 25 bp, Artificial sequence
  Synthetic oligonucleotide
cccagcctagacttaacaaagggcg

SEQ ID NO: 712153 - DNA, 25 bp, Artificial sequence
  Synthetic oligonucleotide
actactacgacaccggcgaggaact

SEQ ID NO: 712154 - DNA, 25 bp, Artificial sequence
  Synthetic oligonucleotide
cacactctgagaggacgaaagcctc

SEQ ID NO: 712155 - DNA, 25 bp, Artificial sequence
  Synthetic oligonucleotide
cttgggttcacactctgagaggacg

SEQ ID NO: 712156 - DNA, 25 bp, Artificial sequence
  Synthetic oligonucleotide
acggatccttgggttcacactctga

SEQ ID NO: 712157 - DNA, 25 bp, Artificial sequence
  Synthetic oligonucleotide
cacacggatccttgggttcacactc

SEQ ID NO: 712158 - DNA, 25 bp, Artificial sequence
  Synthetic oligonucleotide
tggcccacacggatccttgggttca

SEQ ID NO: 712159 - DNA, 25 bp, Artificial sequence
  Synthetic oligonucleotide
gcctggcccacacggatccttgggt

SEQ ID NO: 712160 - DNA, 25 bp, Artificial sequence
  Synthetic oligonucleotide
tccggcttcttcgaagcgggcggca

SEQ ID NO: 712161 - DNA, 25 bp, Artificial sequence
  Synthetic oligonucleotide
atgaggggctcgcagcagcgaggcg

SEQ ID NO: 712162 - DNA, 25 bp, Artificial sequence
  Synthetic oligonucleotide
caggaaaacgtggacgactactacg

SEQ ID NO: 712163 - DNA, 25 bp, Artificial sequence
  Synthetic oligonucleotide
ggcaggaaaacgtggacgactacta

SEQ ID NO: 712164 - DNA, 25 bp, Artificial sequence
  Synthetic oligonucleotide
ttcaggcaggaaaacgtggacgact

SEQ ID NO: 712165 - DNA, 25 bp, Artificial sequence
  Synthetic oligonucleotide
ctgtgttcaggcaggaaaacgtgga

SEQ ID NO: 712166 - DNA, 25 bp, Artificial sequence
  Synthetic oligonucleotide
catgactgtgttcaggcaggaaaac

SEQ ID NO: 712167 - DNA, 25 bp, Artificial sequence
  Synthetic oligonucleotide
ctatcatgactgtgttcaggcagga

SEQ ID NO: 712168 - DNA, 25 bp, Artificial sequence
  Synthetic oligonucleotide
agtctatcatgactgtgttcaggca

SEQ ID NO: 712169 - DNA, 25 bp, Artificial sequence
  Synthetic oligonucleotide
gaggcgtgacagtctatcatgactg

SEQ ID NO: 712170 - DNA, 25 bp, Artificial sequence
  Synthetic oligonucleotide
tgtccccacgttgtccggaggcgga

SEQ ID NO: 712171 - DNA, 25 bp, Artificial sequence
  Synthetic oligonucleotide
ctttggtgaggcgtgacagtctatc

SEQ ID NO: 712172 - DNA, 25 bp, Artificial sequence
  Synthetic oligonucleotide
tttcagaggtctgcggcttggtgca

SEQ ID NO: 712173 - DNA, 25 bp, Artificial sequence
  Synthetic oligonucleotide
atgtctttcagaggtctgcggcttg

SEQ ID NO: 712174 - DNA, 25 bp, Artificial sequence
  Synthetic oligonucleotide
ccatgtctttcagaggtctgcggct

SEQ ID NO: 712175 - DNA, 25 bp, Artificial sequence
  Synthetic oligonucleotide
gagtttaccgtctcattcttctccc

SEQ ID NO: 712176 - DNA, 25 bp, Artificial sequence
  Synthetic oligonucleotide
tagagtttaccgtctcattcttctc

SEQ ID NO: 712177 - DNA, 25 bp, Artificial sequence
  Synthetic oligonucleotide
gaggcctcgagatcgggacccagcc

SEQ ID NO: 712178 - DNA, 25 bp, Artificial sequence
  Synthetic oligonucleotide
tagacttaacaaagggcgcgtggcc

SEQ ID NO: 712179 - DNA, 25 bp, Artificial sequence
  Synthetic oligonucleotide
gcctagacttaacaaagggcgcgtg

SEQ ID NO: 712180 - DNA, 25 bp, Artificial sequence
  Synthetic oligonucleotide
ggtgaggcgtgacagtctatcatga

SEQ ID NO: 712181 - DNA, 25 bp, Artificial sequence
  Synthetic oligonucleotide
tcgaacttgaaaagaattggcgctc

SEQ ID NO: 712182 - DNA, 25 bp, Artificial sequence
  Synthetic oligonucleotide
cgtgtccaccgttgcgacgtgcgac

SEQ ID NO: 712183 - DNA, 25 bp, Artificial sequence
  Synthetic oligonucleotide
ttgaaaagaattggcgctcccgaag

SEQ ID NO: 712184 - DNA, 25 bp, Artificial sequence
  Synthetic oligonucleotide
cgctccggcctcctgcctgtcgcgc

SEQ ID NO: 712185 - DNA, 25 bp, Artificial sequence
  Synthetic oligonucleotide
tctttctgcctggagttcgattccc

SEQ ID NO: 712186 - DNA, 25 bp, Artificial sequence
  Synthetic oligonucleotide
cgcgggcagcatctttctgcctgga

SEQ ID NO: 712187 - DNA, 25 bp, Artificial sequence
  Synthetic oligonucleotide
tctctcgcgggcagcatctttctgc

SEQ ID NO: 712188 - DNA, 25 bp, Artificial sequence
  Synthetic oligonucleotide
tggagttgtctctcgcgggcagcat

SEQ ID NO: 712189 - DNA, 25 bp, Artificial sequence
  Synthetic oligonucleotide
gcggctcacggcgtccgcgagtgag

SEQ ID NO: 712190 - DNA, 25 bp, Artificial sequence
  Synthetic oligonucleotide
tcctgtccggatttcgtgtccgcga

SEQ ID NO: 712191 - DNA, 25 bp, Artificial sequence
  Synthetic oligonucleotide
gtccaccgttgcgacgtgcgacgac

SEQ ID NO: 712192 - DNA, 25 bp, Artificial sequence
  Synthetic oligonucleotide
tttcgtgtccgcgacttgcgggtgt

SEQ ID NO: 712193 - DNA, 25 bp, Artificial sequence
  Synthetic oligonucleotide
taaagctacagccaactgccgcgca

SEQ ID NO: 712194 - DNA, 25 bp, Artificial sequence
  Synthetic oligonucleotide
ggcctaaagctacagccaactgccg

SEQ ID NO: 712195 - DNA, 25 bp, Artificial sequence
  Synthetic oligonucleotide
ccaatcctcgttggcgattgaggcg

SEQ ID NO: 712196 - DNA, 25 bp, Artificial sequence
  Synthetic oligonucleotide
tagcccaatcctcgttggcgattga

SEQ ID NO: 712197 - DNA, 25 bp, Artificial sequence
  Synthetic oligonucleotide
tagatccaaatagcccaatcctcgt

SEQ ID NO: 712198 - DNA, 25 bp, Artificial sequence
  Synthetic oligonucleotide
gggcgcccacctagatccaaatagc

SEQ ID NO: 712199 - DNA, 25 bp, Artificial sequence
  Synthetic oligonucleotide
tccaatgtcagctcgggcgcccacc

SEQ ID NO: 712200 - DNA, 25 bp, Artificial sequence
  Synthetic oligonucleotide
tctaggaaaggggaggcggctcacg

SEQ ID NO: 712201 - DNA, 25 bp, Artificial sequence
  Synthetic oligonucleotide
ggaccgtcgcctccgtcggaagcag

SEQ ID NO: 712202 - DNA, 25 bp, Artificial sequence
  Synthetic oligonucleotide
acttgaaaagaattggcgctcccga

SEQ ID NO: 712203 - DNA, 25 bp, Artificial sequence
  Synthetic oligonucleotide
cttggaacatttggaagaagcgggt

SEQ ID NO: 712204 - DNA, 25 bp, Artificial sequence
  Synthetic oligonucleotide
cccttcttggaacatttggaagaag

SEQ ID NO: 712205 - DNA, 25 bp, Artificial sequence
  Synthetic oligonucleotide
agagttgtggaggtcgttcctgttt

SEQ ID NO: 712206 - DNA, 25 bp, Artificial sequence
  Synthetic oligonucleotide
aagtgaagaattggcgcccaggaag

SEQ ID NO: 712207 - DNA, 25 bp, Artificial sequence
  Synthetic oligonucleotide
atcaaaagtgaagaattggcgccca

SEQ ID NO: 712208 - DNA, 25 bp, Artificial sequence
  Synthetic oligonucleotide
ctgagcacctagaagaaaaggggaa

SEQ ID NO: 712209 - DNA, 25 bp, Artificial sequence
  Synthetic oligonucleotide
cggaagatttcctgtccggatttcg

SEQ ID NO: 712210 - DNA, 25 bp, Artificial sequence
  Synthetic oligonucleotide
tttttctccctgagcacctagaaga

SEQ ID NO: 712211 - DNA, 25 bp, Artificial sequence
  Synthetic oligonucleotide
gacgaggacaaagagtgggccagga

SEQ ID NO: 712212 - DNA, 25 bp, Artificial sequence
  Synthetic oligonucleotide
ggcgaacatgacctagcggcccgcg

SEQ ID NO: 712213 - DNA, 25 bp, Artificial sequence
  Synthetic oligonucleotide
caagtggcgaacatgacctagcggc

SEQ ID NO: 712214 - DNA, 25 bp, Artificial sequence
  Synthetic oligonucleotide
ggcccaagtggcgaacatgacctag

SEQ ID NO: 712215 - DNA, 25 bp, Artificial sequence
  Synthetic oligonucleotide
cggaccggcctcgacgcggccgcct

SEQ ID NO: 712216 - DNA, 25 bp, Artificial sequence
  Synthetic oligonucleotide
agtcgtagaactaaggggccgcgcg

SEQ ID NO: 712217 - DNA, 25 bp, Artificial sequence
  Synthetic oligonucleotide
cgtgtccgcgacttgcgggtgtccc

SEQ ID NO: 712218 - DNA, 25 bp, Artificial sequence
  Synthetic oligonucleotide
tccggatttcgtgtccgcgacttgc

SEQ ID NO: 712219 - DNA, 25 bp, Artificial sequence
  Synthetic oligonucleotide
ctccctgagcacctagaagaaaagg

SEQ ID NO: 712220 - DNA, 25 bp, Artificial sequence
  Synthetic oligonucleotide
tgcgccccgagaagtcgtagaacta

SEQ ID NO: 712221 - DNA, 25 bp, Artificial sequence
  Synthetic oligonucleotide
ttctgtcacacggaatgaaagattg

SEQ ID NO: 712222 - DNA, 25 bp, Artificial sequence
  Synthetic oligonucleotide
ggctgctaaccttcaaatgacccaa

SEQ ID NO: 712223 - DNA, 25 bp, Artificial sequence
  Synthetic oligonucleotide
ccgggctgctaaccttcaaatgacc

SEQ ID NO: 712224 - DNA, 25 bp, Artificial sequence
  Synthetic oligonucleotide
ttcccgggctgctaaccttcaaatg

SEQ ID NO: 712225 - DNA, 25 bp, Artificial sequence
  Synthetic oligonucleotide
tgcgagtgaactttcggtgaaccct

SEQ ID NO: 712226 - DNA, 25 bp, Artificial sequence
  Synthetic oligonucleotide
tatgcgagtgaactttcggtgaacc

SEQ ID NO: 712227 - DNA, 25 bp, Artificial sequence
  Synthetic oligonucleotide
tgcctaatatatgcgagtgaacttt

SEQ ID NO: 712228 - DNA, 25 bp, Artificial sequence
  Synthetic oligonucleotide
cgcggcgcacgggaactctggtccc

SEQ ID NO: 712229 - DNA, 25 bp, Artificial sequence
  Synthetic oligonucleotide
acacggaatgaaagattgaattgcc

SEQ ID NO: 712230 - DNA, 25 bp, Artificial sequence
  Synthetic oligonucleotide
accagtctgacatcaccaactccca

SEQ ID NO: 712231 - DNA, 25 bp, Artificial sequence
  Synthetic oligonucleotide
ccacttctgtcacacggaatgaaag

SEQ ID NO: 712232 - DNA, 25 bp, Artificial sequence
  Synthetic oligonucleotide
ggagcagctcacttcctaccacttc

SEQ ID NO: 712233 - DNA, 25 bp, Artificial sequence
  Synthetic oligonucleotide
aatagaccctcctgcctcggagcag

SEQ ID NO: 712234 - DNA, 25 bp, Artificial sequence
  Synthetic oligonucleotide
aaagaatagaccctcctgcctcgga

SEQ ID NO: 712235 - DNA, 25 bp, Artificial sequence
  Synthetic oligonucleotide
ggcaaagaatagaccctcctgcctc

SEQ ID NO: 712236 - DNA, 25 bp, Artificial sequence
  Synthetic oligonucleotide
ttgaattgcctaatatatgcgagtg

SEQ ID NO: 712237 - DNA, 25 bp, Artificial sequence
  Synthetic oligonucleotide
agagccttcagccagcgagtccgcg

SEQ ID NO: 712238 - DNA, 25 bp, Artificial sequence
  Synthetic oligonucleotide
gccctggcagggagaccctcgccct

SEQ ID NO: 712239 - DNA, 25 bp, Artificial sequence
  Synthetic oligonucleotide
tgcggtttgcgccttttcatcggcc

SEQ ID NO: 712240 - DNA, 25 bp, Artificial sequence
  Synthetic oligonucleotide
gcggctgcggtttgcgccttttcat

SEQ ID NO: 712241 - DNA, 25 bp, Artificial sequence
  Synthetic oligonucleotide
gcaaacaatgccaggagcgcaggga

SEQ ID NO: 712242 - DNA, 25 bp, Artificial sequence
  Synthetic oligonucleotide
tcagcgtgcaaacaatgccaggagc

SEQ ID NO: 712243 - DNA, 25 bp, Artificial sequence
  Synthetic oligonucleotide
accttcaaatgacccaaccagtctg

SEQ ID NO: 712244 - DNA, 25 bp, Artificial sequence
  Synthetic oligonucleotide
ccacggctcagcgtgcaaacaatgc

SEQ ID NO: 712245 - DNA, 25 bp, Artificial sequence
  Synthetic oligonucleotide
aatgacccaaccagtctgacatcac

SEQ ID NO: 712246 - DNA, 25 bp, Artificial sequence
  Synthetic oligonucleotide
tgcaagagccttcagccagcgagtc

SEQ ID NO: 712247 - DNA, 25 bp, Artificial sequence
  Synthetic oligonucleotide
cccagcagccctgcaagagccttca

SEQ ID NO: 712248 - DNA, 25 bp, Artificial sequence
  Synthetic oligonucleotide
tctcacagcgcttaaaaactcccag

SEQ ID NO: 712249 - DNA, 25 bp, Artificial sequence
  Synthetic oligonucleotide
cccaggattctcacagcgcttaaaa

SEQ ID NO: 712250 - DNA, 25 bp, Artificial sequence
  Synthetic oligonucleotide
actcccaggattctcacagcgctta

SEQ ID NO: 712251 - DNA, 25 bp, Artificial sequence
  Synthetic oligonucleotide
gtttgcgccttttcatcggccggcc

SEQ ID NO: 712252 - DNA, 25 bp, Artificial sequence
  Synthetic oligonucleotide
ggctcagcgtgcaaacaatgccagg

SEQ ID NO: 712253 - DNA, 25 bp, Artificial sequence
  Synthetic oligonucleotide
agttctcccttccaggcgacgcccg

SEQ ID NO: 712254 - DNA, 25 bp, Artificial sequence
  Synthetic oligonucleotide
atcccagtcttgtggccgcggcgca

SEQ ID NO: 712255 - DNA, 25 bp, Artificial sequence
  Synthetic oligonucleotide
tctgcatcccagtcttgtggccgcg

SEQ ID NO: 712256 - DNA, 25 bp, Artificial sequence
  Synthetic oligonucleotide
gtgcccagacgctccctgcccgggt

SEQ ID NO: 712257 - DNA, 25 bp, Artificial sequence
  Synthetic oligonucleotide
gatcccaagttctcccttccaggcg

SEQ ID NO: 712258 - DNA, 25 bp, Artificial sequence
  Synthetic oligonucleotide
gttcccgcaccgatcccaagttctc

SEQ ID NO: 712259 - DNA, 25 bp, Artificial sequence
  Synthetic oligonucleotide
ctcgctcggccgatccagccagggc

SEQ ID NO: 712260 - DNA, 25 bp, Artificial sequence
  Synthetic oligonucleotide
cgtcctctgcatcccagtcttgtgg

SEQ ID NO: 712261 - DNA, 25 bp, Artificial sequence
  Synthetic oligonucleotide
acccagcgagtgagctcggactgta

SEQ ID NO: 712262 - DNA, 25 bp, Artificial sequence
  Synthetic oligonucleotide
ctttgaagaaaagagcggcagtccc

SEQ ID NO: 712263 - DNA, 25 bp, Artificial sequence
  Synthetic oligonucleotide
gccgggctacttggaaggcacttcc

SEQ ID NO: 712264 - DNA, 25 bp, Artificial sequence
  Synthetic oligonucleotide
tggaaggcacttccccggagctcat

SEQ ID NO: 712265 - DNA, 25 bp, Artificial sequence
  Synthetic oligonucleotide
ggagctcatcgttgcccaccgtgca

SEQ ID NO: 712266 - DNA, 25 bp, Artificial sequence
  Synthetic oligonucleotide
tcatcgttgcccaccgtgcacagtg

SEQ ID NO: 712267 - DNA, 25 bp, Artificial sequence
  Synthetic oligonucleotide
ccaccgtgcacagtgcccggttaaa

SEQ ID NO: 712268 - DNA, 25 bp, Artificial sequence
  Synthetic oligonucleotide
gcacagtgcccggttaaacccagcg

SEQ ID NO: 712269 - DNA, 25 bp, Artificial sequence
  Synthetic oligonucleotide
gccacttagtcctgtcccgccgggc

SEQ ID NO: 712270 - DNA, 25 bp, Artificial sequence
  Synthetic oligonucleotide
cccggttaaacccagcgagtgagct

SEQ ID NO: 712271 - DNA, 25 bp, Artificial sequence
  Synthetic oligonucleotide
accggcccaggacgcgcccagccca

SEQ ID NO: 712272 - DNA, 25 bp, Artificial sequence
  Synthetic oligonucleotide
cgagtgagctcggactgtagcatca

SEQ ID NO: 712273 - DNA, 25 bp, Artificial sequence
  Synthetic oligonucleotide
tgagctcggactgtagcatcagcgc

SEQ ID NO: 712274 - DNA, 25 bp, Artificial sequence
  Synthetic oligonucleotide
ctcggactgtagcatcagcgctagc

SEQ ID NO: 712275 - DNA, 25 bp, Artificial sequence
  Synthetic oligonucleotide
actgtagcatcagcgctagcgctcg

SEQ ID NO: 712276 - DNA, 25 bp, Artificial sequence
  Synthetic oligonucleotide
tcagcgctagcgctcggcaactttg

SEQ ID NO: 712277 - DNA, 25 bp, Artificial sequence
  Synthetic oligonucleotide
gctagcgctcggcaactttgaagaa

SEQ ID NO: 712278 - DNA, 25 bp, Artificial sequence
  Synthetic oligonucleotide
gcgctcggcaactttgaagaaaaga

SEQ ID NO: 712279 - DNA, 25 bp, Artificial sequence
  Synthetic oligonucleotide
agtgcccggttaaacccagcgagtg

SEQ ID NO: 712280 - DNA, 25 bp, Artificial sequence
  Synthetic oligonucleotide
agccgccagcgccaagaatcttctt

SEQ ID NO: 712281 - DNA, 25 bp, Artificial sequence
  Synthetic oligonucleotide
gcccacaactgcattattccctata

SEQ ID NO: 712282 - DNA, 25 bp, Artificial sequence
  Synthetic oligonucleotide
ctgcattattccctataaggatctg

SEQ ID NO: 712283 - DNA, 25 bp, Artificial sequence
  Synthetic oligonucleotide
ttccctataaggatctgaacggtcc

SEQ ID NO: 712284 - DNA, 25 bp, Artificial sequence
  Synthetic oligonucleotide
tataaggatctgaacggtccgggcc

SEQ ID NO: 712285 - DNA, 25 bp, Artificial sequence
  Synthetic oligonucleotide
gatctgaacggtccgggccggctcc

SEQ ID NO: 712286 - DNA, 25 bp, Artificial sequence
  Synthetic oligonucleotide
ctttttggagggccgatgaggtaat

SEQ ID NO: 712287 - DNA, 25 bp, Artificial sequence
  Synthetic oligonucleotide
ccgatgaggtaatgcggcgctgcca

SEQ ID NO: 712288 - DNA, 25 bp, Artificial sequence
  Synthetic oligonucleotide
tcccgccgggctacttggaaggcac

SEQ ID NO: 712289 - DNA, 25 bp, Artificial sequence
  Synthetic oligonucleotide
agccctggactctcgctcacagtgg

SEQ ID NO: 712290 - DNA, 25 bp, Artificial sequence
  Synthetic oligonucleotide
tgggacgccgctgtagcgcacaccg

SEQ ID NO: 712291 - DNA, 25 bp, Artificial sequence
  Synthetic oligonucleotide
cgcttctccgcttcccgatccttct

SEQ ID NO: 712292 - DNA, 25 bp, Artificial sequence
  Synthetic oligonucleotide
atccttctccgggaggccactcgtt

SEQ ID NO: 712293 - DNA, 25 bp, Artificial sequence
  Synthetic oligonucleotide
aggccactcgttggctccgcggact

SEQ ID NO: 712294 - DNA, 25 bp, Artificial sequence
  Synthetic oligonucleotide
gctccgcggactcgtgttccagcga

SEQ ID NO: 712295 - DNA, 25 bp, Artificial sequence
  Synthetic oligonucleotide
gactcgtgttccagcgacccttggc

SEQ ID NO: 712296 - DNA, 25 bp, Artificial sequence
  Synthetic oligonucleotide
gttccagcgacccttggccacttag

SEQ ID NO: 712297 - DNA, 25 bp, Artificial sequence
  Synthetic oligonucleotide
cagcccacccactcgcgtgcccaca

SEQ ID NO: 712298 - DNA, 25 bp, Artificial sequence
  Synthetic oligonucleotide
gcgacccttggccacttagtcctgt

SEQ ID NO: 712299 - DNA, 25 bp, Artificial sequence
  Synthetic oligonucleotide
taatgcggcgctgccattggtcgga

SEQ ID NO: 712300 - DNA, 25 bp, Artificial sequence
  Synthetic oligonucleotide
tcgcgtgcccacaactgcattattc

SEQ ID NO: 712301 - DNA, 25 bp, Artificial sequence
  Synthetic oligonucleotide
cgccgccctccggtctgcacgctcc

SEQ ID NO: 712302 - DNA, 25 bp, Artificial sequence
  Synthetic oligonucleotide
cgaaataccgcagaggcagggcata

SEQ ID NO: 712303 - DNA, 25 bp, Artificial sequence
  Synthetic oligonucleotide
agcgcagtcggctaccgttgaggaa

SEQ ID NO: 712304 - DNA, 25 bp, Artificial sequence
  Synthetic oligonucleotide
gctaccgttgaggaaggtggagtga

SEQ ID NO: 712305 - DNA, 25 bp, Artificial sequence
  Synthetic oligonucleotide
tggagtgaggagtggcccttccagc

SEQ ID NO: 712306 - DNA, 25 bp, Artificial sequence
  Synthetic oligonucleotide
ctatgtacgccttcctgcgctcggg

SEQ ID NO: 712307 - DNA, 25 bp, Artificial sequence
  Synthetic oligonucleotide
atgtacgccttcctgcgctcggggc

SEQ ID NO: 712308 - DNA, 25 bp, Artificial sequence
  Synthetic oligonucleotide
ttgcccgcctccgtaccgcccgtga

SEQ ID NO: 712309 - DNA, 25 bp, Artificial sequence
  Synthetic oligonucleotide
gcgtgggtcgtccagcccatttctt

SEQ ID NO: 712310 - DNA, 25 bp, Artificial sequence
  Synthetic oligonucleotide
gcgcgtgccggcgactcccacccgg

SEQ ID NO: 712311 - DNA, 25 bp, Artificial sequence
  Synthetic oligonucleotide
caacaagatggcgaaggccctgtgc

SEQ ID NO: 712312 - DNA, 25 bp, Artificial sequence
  Synthetic oligonucleotide
cggtctgcacgctcctgacttgccc

SEQ ID NO: 712313 - DNA, 25 bp, Artificial sequence
  Synthetic oligonucleotide
cccgtctccggccttctgctggcca

SEQ ID NO: 712314 - DNA, 25 bp, Artificial sequence
  Synthetic oligonucleotide
ttctgctggccacgggctcgcaggt

SEQ ID NO: 712315 - DNA, 25 bp, Artificial sequence
  Synthetic oligonucleotide
tggccacgggctcgcaggtttccct

SEQ ID NO: 712316 - DNA, 25 bp, Artificial sequence
  Synthetic oligonucleotide
tccgcggacggaggtcgcgactccc

SEQ ID NO: 712317 - DNA, 25 bp, Artificial sequence
  Synthetic oligonucleotide
ttccttacctcgcaggcagcctcgc

SEQ ID NO: 712318 - DNA, 25 bp, Artificial sequence
  Synthetic oligonucleotide
ctcgcccttactagcagtcttctgt

SEQ ID NO: 712319 - DNA, 25 bp, Artificial sequence
  Synthetic oligonucleotide
gagcgagcgtctggcaggtgagtgc

SEQ ID NO: 712320 - DNA, 25 bp, Artificial sequence
  Synthetic oligonucleotide
caatccctcattccggagcagcggg

SEQ ID NO: 712321 - DNA, 25 bp, Artificial sequence
  Synthetic oligonucleotide
tccgctctaggtgcgtgggtcgtcc

SEQ ID NO: 712322 - DNA, 25 bp, Artificial sequence
  Synthetic oligonucleotide
ttctgtccgctctaggtgcgtgggt

SEQ ID NO: 712323 - DNA, 25 bp, Artificial sequence
  Synthetic oligonucleotide
gtggctgccggaaacccggccgcta

SEQ ID NO: 712324 - DNA, 25 bp, Artificial sequence
  Synthetic oligonucleotide
gtcttctgtccgctctaggtgcgtg

SEQ ID NO: 712325 - DNA, 25 bp, Artificial sequence
  Synthetic oligonucleotide
agcagtcttctgtccgctctaggtg

SEQ ID NO: 712326 - DNA, 25 bp, Artificial sequence
  Synthetic oligonucleotide
tactagcagtcttctgtccgctcta

SEQ ID NO: 712327 - DNA, 25 bp, Artificial sequence
  Synthetic oligonucleotide
ataccgcagaggcagggcataggct

SEQ ID NO: 712328 - DNA, 25 bp, Artificial sequence
  Synthetic oligonucleotide
agcagcggaccgaggctggcgcgat

SEQ ID NO: 712329 - DNA, 25 bp, Artificial sequence
  Synthetic oligonucleotide
agtccaatccctcattccggagcag

SEQ ID NO: 712330 - DNA, 25 bp, Artificial sequence
  Synthetic oligonucleotide
caagatggcgaaggccctgtgctga

SEQ ID NO: 712331 - DNA, 25 bp, Artificial sequence
  Synthetic oligonucleotide
tccctcattccggagcagcgggacg

SEQ ID NO: 712332 - DNA, 25 bp, Artificial sequence
  Synthetic oligonucleotide
ctcattccggagcagcgggacgccg

SEQ ID NO: 712333 - DNA, 25 bp, Artificial sequence
  Synthetic oligonucleotide
agccgctcccatcgcgcgtgcgcac

SEQ ID NO: 712334 - DNA, 25 bp, Artificial sequence
  Synthetic oligonucleotide
cgcgtgcgcactgcccgcttcccgc

SEQ ID NO: 712335 - DNA, 25 bp, Artificial sequence
  Synthetic oligonucleotide
ttcccgcctccaacaagatggcgaa

SEQ ID NO: 712336 - DNA, 25 bp, Artificial sequence
  Synthetic oligonucleotide
ccgcctccaacaagatggcgaaggc

SEQ ID NO: 712337 - DNA, 25 bp, Artificial sequence
  Synthetic oligonucleotide
ctccaacaagatggcgaaggccctg

SEQ ID NO: 712338 - DNA, 25 bp, Artificial sequence
  Synthetic oligonucleotide
gcccttactagcagtcttctgtccg

SEQ ID NO: 712339 - DNA, 25 bp, Artificial sequence
  Synthetic oligonucleotide
ctgcggctgcgcagtccaatccctc

SEQ ID NO: 712340 - DNA, 25 bp, Artificial sequence
  Synthetic oligonucleotide
cgcgatgctgttcccggggagcgca

SEQ ID NO: 712341 - DNA, 25 bp, Artificial sequence
  Synthetic oligonucleotide
gttgtcctgggaagctgtgcggagc

SEQ ID NO: 712342 - DNA, 25 bp, Artificial sequence
  Synthetic oligonucleotide
tgcaaagagcgccagtcgtgagcga

SEQ ID NO: 712343 - DNA, 25 bp, Artificial sequence
  Synthetic oligonucleotide
gcggattcagtgctgcgtagacaga

SEQ ID NO: 712344 - DNA, 25 bp, Artificial sequence
  Synthetic oligonucleotide
gtgcggattcagtgctgcgtagaca

SEQ ID NO: 712345 - DNA, 25 bp, Artificial sequence
  Synthetic oligonucleotide
actgcctgctgggtgcggattcagt

SEQ ID NO: 712346 - DNA, 25 bp, Artificial sequence
  Synthetic oligonucleotide
tcactgcctgctgggtgcggattca

SEQ ID NO: 712347 - DNA, 25 bp, Artificial sequence
  Synthetic oligonucleotide
actcactgcctgctgggtgcggatt

SEQ ID NO: 712348 - DNA, 25 bp, Artificial sequence
  Synthetic oligonucleotide
agcggactcactgcctgctgggtgc

SEQ ID NO: 712349 - DNA, 25 bp, Artificial sequence
  Synthetic oligonucleotide
tactcagagtgaggacgcacgcgta

SEQ ID NO: 712350 - DNA, 25 bp, Artificial sequence
  Synthetic oligonucleotide
ctgtgcggagcggactcactgcctg

SEQ ID NO: 712351 - DNA, 25 bp, Artificial sequence
  Synthetic oligonucleotide
caagctggttgtcctgggaagctgt

SEQ ID NO: 712352 - DNA, 25 bp, Artificial sequence
  Synthetic oligonucleotide
tgcaagctggttgtcctgggaagct

SEQ ID NO: 712353 - DNA, 25 bp, Artificial sequence
  Synthetic oligonucleotide
agctgcaagctggttgtcctgggaa

SEQ ID NO: 712354 - DNA, 25 bp, Artificial sequence
  Synthetic oligonucleotide
cgacagctgcaagctggttgtcctg

SEQ ID NO: 712355 - DNA, 25 bp, Artificial sequence
  Synthetic oligonucleotide
cccgacagctgcaagctggttgtcc

SEQ ID NO: 712356 - DNA, 25 bp, Artificial sequence
  Synthetic oligonucleotide
agtcgtgagcgagcccaggccccga

SEQ ID NO: 712357 - DNA, 25 bp, Artificial sequence
  Synthetic oligonucleotide
agagcgccagtcgtgagcgagccca

SEQ ID NO: 712358 - DNA, 25 bp, Artificial sequence
  Synthetic oligonucleotide
caaagagcgccagtcgtgagcgagc

SEQ ID NO: 712359 - DNA, 25 bp, Artificial sequence
  Synthetic oligonucleotide
tgcggagcggactcactgcctgctg

SEQ ID NO: 712360 - DNA, 25 bp, Artificial sequence
  Synthetic oligonucleotide
cccggatgctgactcaacacgttgg

SEQ ID NO: 712361 - DNA, 25 bp, Artificial sequence
  Synthetic oligonucleotide
ggacactcgcttgtgggacccgagt

SEQ ID NO: 712362 - DNA, 25 bp, Artificial sequence
  Synthetic oligonucleotide
gagaagccggtagcggagctctgca

SEQ ID NO: 712363 - DNA, 25 bp, Artificial sequence
  Synthetic oligonucleotide
aacacgttggagagagaagccggta

SEQ ID NO: 712364 - DNA, 25 bp, Artificial sequence
  Synthetic oligonucleotide
tcaacacgttggagagagaagccgg

SEQ ID NO: 712365 - DNA, 25 bp, Artificial sequence
  Synthetic oligonucleotide
actcaacacgttggagagagaagcc

SEQ ID NO: 712366 - DNA, 25 bp, Artificial sequence
  Synthetic oligonucleotide
gctgactcaacacgttggagagaga

SEQ ID NO: 712367 - DNA, 25 bp, Artificial sequence
  Synthetic oligonucleotide
atgctgactcaacacgttggagaga

SEQ ID NO: 712368 - DNA, 25 bp, Artificial sequence
  Synthetic oligonucleotide
tgctgcgtagacagaggggtactca

SEQ ID NO: 712369 - DNA, 25 bp, Artificial sequence
  Synthetic oligonucleotide
ccggatgctgactcaacacgttgga

SEQ ID NO: 712370 - DNA, 25 bp, Artificial sequence
  Synthetic oligonucleotide
cggattcagtgctgcgtagacagag

SEQ ID NO: 712371 - DNA, 25 bp, Artificial sequence
  Synthetic oligonucleotide
gccttataaggggcatcgcgctccg

SEQ ID NO: 712372 - DNA, 25 bp, Artificial sequence
  Synthetic oligonucleotide
ccagccttataaggggcatcgcgct

SEQ ID NO: 712373 - DNA, 25 bp, Artificial sequence
  Synthetic oligonucleotide
ccgccagccttataaggggcatcgc

SEQ ID NO: 712374 - DNA, 25 bp, Artificial sequence
  Synthetic oligonucleotide
ggccgccagccttataaggggcatc

SEQ ID NO: 712375 - DNA, 25 bp, Artificial sequence
  Synthetic oligonucleotide
cgggccgccagccttataaggggca

SEQ ID NO: 712376 - DNA, 25 bp, Artificial sequence
  Synthetic oligonucleotide
caccgggccgccagccttataaggg

SEQ ID NO: 712377 - DNA, 25 bp, Artificial sequence
  Synthetic oligonucleotide
agtgaggacgcacgcgtaggccacc

SEQ ID NO: 712378 - DNA, 25 bp, Artificial sequence
  Synthetic oligonucleotide
actcagagtgaggacgcacgcgtag

SEQ ID NO: 712379 - DNA, 25 bp, Artificial sequence
  Synthetic oligonucleotide
ggatgctgactcaacacgttggaga

SEQ ID NO: 712380 - DNA, 25 bp, Artificial sequence
  Synthetic oligonucleotide
ctgcgtagacagaggggtactcaga

SEQ ID NO: 712381 - DNA, 25 bp, Artificial sequence
  Synthetic oligonucleotide
caggcttagcgcctttcttggcgga

SEQ ID NO: 712382 - DNA, 25 bp, Artificial sequence
  Synthetic oligonucleotide
ctagcacccgggcagccgcacaccc

SEQ ID NO: 712383 - DNA, 25 bp, Artificial sequence
  Synthetic oligonucleotide
cgcacacccgaactccagcctcgga

SEQ ID NO: 712384 - DNA, 25 bp, Artificial sequence
  Synthetic oligonucleotide
ctcggagcctcgtgcgaaatacctg

SEQ ID NO: 712385 - DNA, 25 bp, Artificial sequence
  Synthetic oligonucleotide
tcgtgcgaaatacctggccctagct

SEQ ID NO: 712386 - DNA, 25 bp, Artificial sequence
  Synthetic oligonucleotide
tgcgaaatacctggccctagctcgg

SEQ ID NO: 712387 - DNA, 25 bp, Artificial sequence
  Synthetic oligonucleotide
acctggccctagctcgggtcccaga

SEQ ID NO: 712388 - DNA, 25 bp, Artificial sequence
  Synthetic oligonucleotide
ctgggctgcagcgttgcctcctcgc

SEQ ID NO: 712389 - DNA, 25 bp, Artificial sequence
  Synthetic oligonucleotide
gttcactcggctagcacccgggcag

SEQ ID NO: 712390 - DNA, 25 bp, Artificial sequence
  Synthetic oligonucleotide
tgccgcaggcttagcgcctttcttg

SEQ ID NO: 712391 - DNA, 25 bp, Artificial sequence
  Synthetic oligonucleotide
agcctcggagcctcgtgcgaaatac

SEQ ID NO: 712392 - DNA, 25 bp, Artificial sequence
  Synthetic oligonucleotide
ttagcgcctttcttggcggaccggc

SEQ ID NO: 712393 - DNA, 25 bp, Artificial sequence
  Synthetic oligonucleotide
cttggcgcgcgtcgcccagctagcc

SEQ ID NO: 712394 - DNA, 25 bp, Artificial sequence
  Synthetic oligonucleotide
cccgcaagctggtagccggagtctt

SEQ ID NO: 712395 - DNA, 25 bp, Artificial sequence
  Synthetic oligonucleotide
gagtcttggtcgaagcgggaccgga

SEQ ID NO: 712396 - DNA, 25 bp, Artificial sequence
  Synthetic oligonucleotide
gaccgcgacctttggcggggctcag

SEQ ID NO: 712397 - DNA, 25 bp, Artificial sequence
  Synthetic oligonucleotide
ccctcctgccactgacgcggagtcc

SEQ ID NO: 712398 - DNA, 25 bp, Artificial sequence
  Synthetic oligonucleotide
ctcagggcgccaggaagggtgcgca

SEQ ID NO: 712399 - DNA, 25 bp, Artificial sequence
  Synthetic oligonucleotide
accacagcccgcctggaaagagggt

SEQ ID NO: 712400 - DNA, 25 bp, Artificial sequence
  Synthetic oligonucleotide
gactgccgcaggcttagcgcctttc

SEQ ID NO: 712401 - DNA, 25 bp, Artificial sequence
  Synthetic oligonucleotide
ggaccgactgaaactgaacattgaa

SEQ ID NO: 712402 - DNA, 25 bp, Artificial sequence
  Synthetic oligonucleotide
tccgtctctgagaacggctcgaagc

SEQ ID NO: 712403 - DNA, 25 bp, Artificial sequence
  Synthetic oligonucleotide
cggggttccgtctctgagaacggct

SEQ ID NO: 712404 - DNA, 25 bp, Artificial sequence
  Synthetic oligonucleotide
agcaccagcggggttccgtctctga

SEQ ID NO: 712405 - DNA, 25 bp, Artificial sequence
  Synthetic oligonucleotide
accgttgtcgttcggccagcaccag

SEQ ID NO: 712406 - DNA, 25 bp, Artificial sequence
  Synthetic oligonucleotide
gagaaccgttgtcgttcggccagca

SEQ ID NO: 712407 - DNA, 25 bp, Artificial sequence
  Synthetic oligonucleotide
gcctcgtgcgaaatacctggcccta

SEQ ID NO: 712408 - DNA, 25 bp, Artificial sequence
  Synthetic oligonucleotide
gactgaaactgaacattgaaagccc

SEQ ID NO: 712409 - DNA, 25 bp, Artificial sequence
  Synthetic oligonucleotide
ctggggccgttcactcggctagcac

SEQ ID NO: 712410 - DNA, 25 bp, Artificial sequence
  Synthetic oligonucleotide
gaggaccgactgaaactgaacattg

SEQ ID NO: 712411 - DNA, 25 bp, Artificial sequence
  Synthetic oligonucleotide
ccgagaggaccgactgaaactgaac

SEQ ID NO: 712412 - DNA, 25 bp, Artificial sequence
  Synthetic oligonucleotide
acagggcgcccgacgccctgtactc

SEQ ID NO: 712413 - DNA, 25 bp, Artificial sequence
  Synthetic oligonucleotide
actgaacattgaaagccccggagga

SEQ ID NO: 712414 - DNA, 25 bp, Artificial sequence
  Synthetic oligonucleotide
cgcggagtccctggggccgttcact

SEQ ID NO: 712415 - DNA, 25 bp, Artificial sequence
  Synthetic oligonucleotide
ctgagaaaaccgagaggaccgactg

SEQ ID NO: 712416 - DNA, 25 bp, Artificial sequence
  Synthetic oligonucleotide
tgcccttactgtcctaagcctgcaa

SEQ ID NO: 712417 - DNA, 25 bp, Artificial sequence
  Synthetic oligonucleotide
aagcctgcaacccaggggctcagga

SEQ ID NO: 712418 - DNA, 25 bp, Artificial sequence
  Synthetic oligonucleotide
caacccaggggctcaggagtgccct

SEQ ID NO: 712419 - DNA, 25 bp, Artificial sequence
  Synthetic oligonucleotide
cagcggggtggctgcgcctcttcca

SEQ ID NO: 712420 - DNA, 25 bp, Artificial sequence
  Synthetic oligonucleotide
cggcctgagaaaaccgagaggaccg

SEQ ID NO: 712421 - DNA, 25 bp, Artificial sequence
  Synthetic oligonucleotide
gggatcgcacgaacttcaccaagaa

SEQ ID NO: 712422 - DNA, 25 bp, Artificial sequence
  Synthetic oligonucleotide
ggcccatctttgctccacgcccatc

SEQ ID NO: 712423 - DNA, 25 bp, Artificial sequence
  Synthetic oligonucleotide
tcaagatcctctctagcctcaacaa

SEQ ID NO: 712424 - DNA, 25 bp, Artificial sequence
  Synthetic oligonucleotide
tctagcctcaacaacatgttcacga

SEQ ID NO: 712425 - DNA, 25 bp, Artificial sequence
  Synthetic oligonucleotide
atgttcacgaaagccagagcgcagc

SEQ ID NO: 712426 - DNA, 25 bp, Artificial sequence
  Synthetic oligonucleotide
cagagcgcagctcgctgtcctgggt

SEQ ID NO: 712427 - DNA, 25 bp, Artificial sequence
  Synthetic oligonucleotide
agctcgctgtcctgggtctccggga

SEQ ID NO: 712428 - DNA, 25 bp, Artificial sequence
  Synthetic oligonucleotide
ggtctccgggatcgcacgaacttca

SEQ ID NO: 712429 - DNA, 25 bp, Artificial sequence
  Synthetic oligonucleotide
ggtgcggccctcttctcaagatcct

SEQ ID NO: 712430 - DNA, 25 bp, Artificial sequence
  Synthetic oligonucleotide
gccggcaacgtctcctgcgccgatc

SEQ ID NO: 712431 - DNA, 25 bp, Artificial sequence
  Synthetic oligonucleotide
tttcggttttaagcgcgagcatccc

SEQ ID NO: 712432 - DNA, 25 bp, Artificial sequence
  Synthetic oligonucleotide
cgcagcccgaggacgttgtttattt

SEQ ID NO: 712433 - DNA, 25 bp, Artificial sequence
  Synthetic oligonucleotide
gtgtacccgggaccagggcctgcac

SEQ ID NO: 712434 - DNA, 25 bp, Artificial sequence
  Synthetic oligonucleotide
agagaagagccgctgcgtgtacccg

SEQ ID NO: 712435 - DNA, 25 bp, Artificial sequence
  Synthetic oligonucleotide
tcctccggttgggaacagcgcgcag

SEQ ID NO: 712436 - DNA, 25 bp, Artificial sequence
  Synthetic oligonucleotide
tacgctgcgctcctccggttgggaa

SEQ ID NO: 712437 - DNA, 25 bp, Artificial sequence
  Synthetic oligonucleotide
gaacccttagcggtacgctgcgctc

SEQ ID NO: 712438 - DNA, 25 bp, Artificial sequence
  Synthetic oligonucleotide
ttttgaacccttagcggtacgctgc

SEQ ID NO: 712439 - DNA, 25 bp, Artificial sequence
  Synthetic oligonucleotide
aaataggaagatcggcgaggccagc

SEQ ID NO: 712440 - DNA, 25 bp, Artificial sequence
  Synthetic oligonucleotide
tgctccgagtccatctataaaaaga

SEQ ID NO: 712441 - DNA, 25 bp, Artificial sequence
  Synthetic oligonucleotide
aggtttcccttgctccgagtccatc

SEQ ID NO: 712442 - DNA, 25 bp, Artificial sequence
  Synthetic oligonucleotide
ctcggcgaggtttcccttgctccga

SEQ ID NO: 712443 - DNA, 25 bp, Artificial sequence
  Synthetic oligonucleotide
gaaactttcgtctatgcctgacgcc

SEQ ID NO: 712444 - DNA, 25 bp, Artificial sequence
  Synthetic oligonucleotide
cttcggcgttgaggcacctcgagac

SEQ ID NO: 712445 - DNA, 25 bp, Artificial sequence
  Synthetic oligonucleotide
gttgaggcacctcgagacccacgcg

SEQ ID NO: 712446 - DNA, 25 bp, Artificial sequence
  Synthetic oligonucleotide
caagaaaaccctctcttggagtggg

SEQ ID NO: 712447 - DNA, 25 bp, Artificial sequence
  Synthetic oligonucleotide
gcgcgctgaatcctcacagtgacca

SEQ ID NO: 712448 - DNA, 25 bp, Artificial sequence
  Synthetic oligonucleotide
tcctcacagtgaccaagaacctgcg

SEQ ID NO: 712449 - DNA, 25 bp, Artificial sequence
  Synthetic oligonucleotide
gaacctgcgacccatgctcccgctg

SEQ ID NO: 712450 - DNA, 25 bp, Artificial sequence
  Synthetic oligonucleotide
tgctcccgctgctgtactccctcag

SEQ ID NO: 712451 - DNA, 25 bp, Artificial sequence
  Synthetic oligonucleotide
gtcccgaaactttcgtctatgcctg

SEQ ID NO: 712452 - DNA, 25 bp, Artificial sequence
  Synthetic oligonucleotide
acaagcgaggtgagaagcgccgccc

SEQ ID NO: 712453 - DNA, 25 bp, Artificial sequence
  Synthetic oligonucleotide
gccgatcggctttcgctccggttaa

SEQ ID NO: 712454 - DNA, 25 bp, Artificial sequence
  Synthetic oligonucleotide
cagtcgcgcgggaaagcttcccaga

SEQ ID NO: 712455 - DNA, 25 bp, Artificial sequence
  Synthetic oligonucleotide
gaaagcttcccagaggcgcccaggg

SEQ ID NO: 712456 - DNA, 25 bp, Artificial sequence
  Synthetic oligonucleotide
acccatcgcggtgacagccagcgcc

SEQ ID NO: 712457 - DNA, 25 bp, Artificial sequence
  Synthetic oligonucleotide
ctagcagtagctgcgccctttcgca

SEQ ID NO: 712458 - DNA, 25 bp, Artificial sequence
  Synthetic oligonucleotide
agtagctgcgccctttcgcagccgg

SEQ ID NO: 712459 - DNA, 25 bp, Artificial sequence
  Synthetic oligonucleotide
tcgcacgaacttcaccaagaaaacc

SEQ ID NO: 712460 - DNA, 25 bp, Artificial sequence
  Synthetic oligonucleotide
ctcagcggcggcctcactgtgacaa

SEQ ID NO: 712461 - DNA, 25 bp, Artificial sequence
  Synthetic oligonucleotide
cgagatatggcccgcgctggagttt

SEQ ID NO: 712462 - DNA, 25 bp, Artificial sequence
  Synthetic oligonucleotide
gtctctggtgtagctgatgatccga

SEQ ID NO: 712463 - DNA, 25 bp, Artificial sequence
  Synthetic oligonucleotide
atggatttccgtctctggtgtagct

SEQ ID NO: 712464 - DNA, 25 bp, Artificial sequence
  Synthetic oligonucleotide
tggtcgagcgatcgatttccgtctc

SEQ ID NO: 712465 - DNA, 25 bp, Artificial sequence
  Synthetic oligonucleotide
tggtcgagcgatggatttccgtctc

SEQ ID NO: 712466 - DNA, 25 bp, Artificial sequence
  Synthetic oligonucleotide
caccgcaggtgtagagaaggcactt

SEQ ID NO: 712467 - DNA, 25 bp, Artificial sequence
  Synthetic oligonucleotide
caccgcaggtgttgagaaggcactt

SEQ ID NO: 712468 - DNA, 25 bp, Artificial sequence
  Synthetic oligonucleotide
cgctggttagcagcgcaggtgtaga

SEQ ID NO: 712469 - DNA, 25 bp, Artificial sequence
  Synthetic oligonucleotide
gtctctggtgtacctgatgatccga

SEQ ID NO: 712470 - DNA, 25 bp, Artificial sequence
  Synthetic oligonucleotide
cgagatatggccggcgctggagttt

SEQ ID NO: 712471 - DNA, 25 bp, Artificial sequence
  Synthetic oligonucleotide
atggatttccgtgtctggtgtagct

SEQ ID NO: 712472 - DNA, 25 bp, Artificial sequence
  Synthetic oligonucleotide
gtgcccgtgtcgcagccgcgcgaga

SEQ ID NO: 712473 - DNA, 25 bp, Artificial sequence
  Synthetic oligonucleotide
gtgcccgtgtcggagccgcgcgaga

SEQ ID NO: 712474 - DNA, 25 bp, Artificial sequence
  Synthetic oligonucleotide
ctggtctggacacagtgcccgtgtc

SEQ ID NO: 712475 - DNA, 25 bp, Artificial sequence
  Synthetic oligonucleotide
ctggtctggacagagtgcccgtgtc

SEQ ID NO: 712476 - DNA, 25 bp, Artificial sequence
  Synthetic oligonucleotide
tggtcagagatagctggcctggtct

SEQ ID NO: 712477 - DNA, 25 bp, Artificial sequence
  Synthetic oligonucleotide
tagtgaaacaggggcaatggtgcgc

SEQ ID NO: 712478 - DNA, 25 bp, Artificial sequence
  Synthetic oligonucleotide
cgctggttagcaccgcaggtgtaga

SEQ ID NO: 712479 - DNA, 25 bp, Artificial sequence
  Synthetic oligonucleotide
tagtgaaacaggcgcaatggtgcgc

SEQ ID NO: 712480 - DNA, 25 bp, Artificial sequence
  Synthetic oligonucleotide
ggagtttcaataccggagatcatgc

SEQ ID NO: 712481 - DNA, 25 bp, Artificial sequence
  Synthetic oligonucleotide
tggtcagagatacctggcctggtct

SEQ ID NO: 712482 - DNA, 25 bp, Artificial sequence
  Synthetic oligonucleotide
ttgtcatgaactttatccgtaacct

SEQ ID NO: 712483 - DNA, 25 bp, Artificial sequence
  Synthetic oligonucleotide
ttgtcatgaactatatccgtaacct

SEQ ID NO: 712484 - DNA, 25 bp, Artificial sequence
  Synthetic oligonucleotide
ccaatgtaaatattgtcatgaacta

SEQ ID NO: 712485 - DNA, 25 bp, Artificial sequence
  Synthetic oligonucleotide
ccaatgtaaataatgtcatgaacta

SEQ ID NO: 712486 - DNA, 25 bp, Artificial sequence
  Synthetic oligonucleotide
ctggtggctggaccaatgtaaatat

SEQ ID NO: 712487 - DNA, 25 bp, Artificial sequence
  Synthetic oligonucleotide
ctggtggctggagcaatgtaaatat

SEQ ID NO: 712488 - DNA, 25 bp, Artificial sequence
  Synthetic oligonucleotide
ggagatcatgcaagctggtggctgg

SEQ ID NO: 712489 - DNA, 25 bp, Artificial sequence
  Synthetic oligonucleotide
ggagtttcaatagcggagatcatgc

SEQ ID NO: 712490 - DNA, 25 bp, Artificial sequence
  Synthetic oligonucleotide
taaggatgactcaggtcagagatac

SEQ ID NO: 712491 - DNA, 25 bp, Artificial sequence
  Synthetic oligonucleotide
taaggatgactctggtcagagatac

SEQ ID NO: 712492 - DNA, 25 bp, Artificial sequence
  Synthetic oligonucleotide
tgtagctgatgaaccgaataactac

SEQ ID NO: 712493 - DNA, 25 bp, Artificial sequence
  Synthetic oligonucleotide
ggagatcatgcatgctggtggctgg

SEQ ID NO: 712494 - DNA, 25 bp, Artificial sequence
  Synthetic oligonucleotide
tgtagctgatgatccgaataactac

SEQ ID NO: 712495 - DNA, 25 bp, Artificial sequence
  Synthetic oligonucleotide
gattgatttacgccgctaaggatga

SEQ ID NO: 712496 - DNA, 25 bp, Artificial sequence
  Synthetic oligonucleotide
accagccagctatcaactcgcgccc

SEQ ID NO: 712497 - DNA, 25 bp, Artificial sequence
  Synthetic oligonucleotide
accagccagctaacaactcgcgccc

SEQ ID NO: 712498 - DNA, 25 bp, Artificial sequence
  Synthetic oligonucleotide
gcaactcatcgaatgatttacggcg

SEQ ID NO: 712499 - DNA, 25 bp, Artificial sequence
  Synthetic oligonucleotide
gcaactcatcgattgatttacggcg

SEQ ID NO: 712500 - DNA, 25 bp, Artificial sequence
  Synthetic oligonucleotide
gattgatttacggcgctaaggatga

SEQ ID NO: 712501 - DNA, 25 bp, Artificial sequence
  Synthetic oligonucleotide
ctggtggctggaccaatgtaaatat

SEQ ID NO: 712502 - DNA, 25 bp, Artificial sequence
  Synthetic oligonucleotide
ctggtctggacagagtgcccgtgtc

SEQ ID NO: 712503 - DNA, 25 bp, Artificial sequence
  Synthetic oligonucleotide
tagtgaaacaggggcaatggtgcgc

SEQ ID NO: 712504 - DNA, 25 bp, Artificial sequence
  Synthetic oligonucleotide
tagtgaaacaggcgcaatggtgcgc

SEQ ID NO: 712505 - DNA, 25 bp, Artificial sequence
  Synthetic oligonucleotide
ttgtcatgaactatatccgtaacct

SEQ ID NO: 712506 - DNA, 25 bp, Artificial sequence
  Synthetic oligonucleotide
ttgtcatgaactttatccgtaacct

SEQ ID NO: 712507 - DNA, 25 bp, Artificial sequence
  Synthetic oligonucleotide
ccaatgtaaatattgtcatgaacta

SEQ ID NO: 712508 - DNA, 25 bp, Artificial sequence
  Synthetic oligonucleotide
ccaatgtaaataatgtcatgaacta

SEQ ID NO: 712509 - DNA, 25 bp, Artificial sequence
  Synthetic oligonucleotide
ctggtctggacacagtgcccgtgtc

SEQ ID NO: 712510 - DNA, 25 bp, Artificial sequence
  Synthetic oligonucleotide
atggatttccgtgtctggtgtagct

SEQ ID NO: 712511 - DNA, 25 bp, Artificial sequence
  Synthetic oligonucleotide
tggtcagagatagctggcctggtct

SEQ ID NO: 712512 - DNA, 25 bp, Artificial sequence
  Synthetic oligonucleotide
tggtcagagatacctggcctggtct

SEQ ID NO: 712513 - DNA, 25 bp, Artificial sequence
  Synthetic oligonucleotide
taaggatgactctggtcagagatac

SEQ ID NO: 712514 - DNA, 25 bp, Artificial sequence
  Synthetic oligonucleotide
taaggatgactcaggtcagagatac

SEQ ID NO: 712515 - DNA, 25 bp, Artificial sequence
  Synthetic oligonucleotide
gattgatttacggcgctaaggatga

SEQ ID NO: 712516 - DNA, 25 bp, Artificial sequence
  Synthetic oligonucleotide
gattgatttacgccgctaaggatga

SEQ ID NO: 712517 - DNA, 25 bp, Artificial sequence
  Synthetic oligonucleotide
gcaactcatcgaatgatttacggcg

SEQ ID NO: 712518 - DNA, 25 bp, Artificial sequence
  Synthetic oligonucleotide
gcaactcatcgattgatttacggcg

SEQ ID NO: 712519 - DNA, 25 bp, Artificial sequence
  Synthetic oligonucleotide
accagccagctatcaactcgcgccc

SEQ ID NO: 712520 - DNA, 25 bp, Artificial sequence
  Synthetic oligonucleotide
accagccagctaacaactcgcgccc

SEQ ID NO: 712521 - DNA, 25 bp, Artificial sequence
  Synthetic oligonucleotide
tgtagctgatgatccgaataactac

SEQ ID NO: 712522 - DNA, 25 bp, Artificial sequence
  Synthetic oligonucleotide
tgtagctgatgaaccgaataactac

SEQ ID NO: 712523 - DNA, 25 bp, Artificial sequence
  Synthetic oligonucleotide
gtgcccgtgtcgcagccgcgcgaga

SEQ ID NO: 712524 - DNA, 25 bp, Artificial sequence
  Synthetic oligonucleotide
gtctctggtgtacctgatgatccga

SEQ ID NO: 712525 - DNA, 25 bp, Artificial sequence
  Synthetic oligonucleotide
cgctggttagcaccgcaggtgtaga

SEQ ID NO: 712526 - DNA, 25 bp, Artificial sequence
  Synthetic oligonucleotide
ggagatcatgcaagctggtggctgg

SEQ ID NO: 712527 - DNA, 25 bp, Artificial sequence
  Synthetic oligonucleotide
ggagatcatgcatgctggtggctgg

SEQ ID NO: 712528 - DNA, 25 bp, Artificial sequence
  Synthetic oligonucleotide
ggagtttcaataccggagatcatgc

SEQ ID NO: 712529 - DNA, 25 bp, Artificial sequence
  Synthetic oligonucleotide
ggagtttcaatagcggagatcatgc

SEQ ID NO: 712530 - DNA, 25 bp, Artificial sequence
  Synthetic oligonucleotide
cgagatatggcccgcgctggagttt

SEQ ID NO: 712531 - DNA, 25 bp, Artificial sequence
  Synthetic oligonucleotide
gtctctggtgtagctgatgatccga

SEQ ID NO: 712532 - DNA, 25 bp, Artificial sequence
  Synthetic oligonucleotide
gtgcccgtgtcggagccgcgcgaga

SEQ ID NO: 712533 - DNA, 25 bp, Artificial sequence
  Synthetic oligonucleotide
ctggtggctggagcaatgtaaatat

SEQ ID NO: 712534 - DNA, 25 bp, Artificial sequence
  Synthetic oligonucleotide
cgctggttagcagcgcaggtgtaga

SEQ ID NO: 712535 - DNA, 25 bp, Artificial sequence
  Synthetic oligonucleotide
caccgcaggtgtagagaaggcactt

SEQ ID NO: 712536 - DNA, 25 bp, Artificial sequence
  Synthetic oligonucleotide
caccgcaggtgttgagaaggcactt

SEQ ID NO: 712537 - DNA, 25 bp, Artificial sequence
  Synthetic oligonucleotide
tggtcgagcgatcgatttccgtctc

SEQ ID NO: 712538 - DNA, 25 bp, Artificial sequence
  Synthetic oligonucleotide
tggtcgagcgatggatttccgtctc

SEQ ID NO: 712539 - DNA, 25 bp, Artificial sequence
  Synthetic oligonucleotide
atggatttccgtctctggtgtagct

SEQ ID NO: 712540 - DNA, 25 bp, Artificial sequence
  Synthetic oligonucleotide
cgagatatggccggcgctggagttt

SEQ ID NO: 712541 - DNA, 25 bp, Artificial sequence
  Synthetic oligonucleotide
gacatgttcagggatcgccaggcgt

SEQ ID NO: 712542 - DNA, 25 bp, Artificial sequence
  Synthetic oligonucleotide
gcaagaacctgatggacatgttcag

SEQ ID NO: 712543 - DNA, 25 bp, Artificial sequence
  Synthetic oligonucleotide
gcaacatttggggcagctaaacatg

SEQ ID NO: 712544 - DNA, 25 bp, Artificial sequence
  Synthetic oligonucleotide
tctatatcttcacgcgcgcggtctg

SEQ ID NO: 712545 - DNA, 25 bp, Artificial sequence
  Synthetic oligonucleotide
tctatatcttcaggcgcgcggtctg

SEQ ID NO: 712546 - DNA, 25 bp, Artificial sequence
  Synthetic oligonucleotide
gaagatgttcgcgattatcttctat

SEQ ID NO: 712547 - DNA, 25 bp, Artificial sequence
  Synthetic oligonucleotide
gaagatgttcgccattatcttctat

SEQ ID NO: 712548 - DNA, 25 bp, Artificial sequence
  Synthetic oligonucleotide
gcggcatggtgctagttgaataacc

SEQ ID NO: 712549 - DNA, 25 bp, Artificial sequence
  Synthetic oligonucleotide
gcggcatggtgcaagttgaataacc

SEQ ID NO: 712550 - DNA, 25 bp, Artificial sequence
  Synthetic oligonucleotide
gcaacatttgggccagctaaacatg

SEQ ID NO: 712551 - DNA, 25 bp, Artificial sequence
  Synthetic oligonucleotide
gacatgttcaggcatcgccaggcgt

SEQ ID NO: 712552 - DNA, 25 bp, Artificial sequence
  Synthetic oligonucleotide
gccaggcgttttctgagcatacctg

SEQ ID NO: 712553 - DNA, 25 bp, Artificial sequence
  Synthetic oligonucleotide
gcaagaacctgaaggacatgttcag

SEQ ID NO: 712554 - DNA, 25 bp, Artificial sequence
  Synthetic oligonucleotide
gagtgatgaggttcgcaagaacctg

SEQ ID NO: 712555 - DNA, 25 bp, Artificial sequence
  Synthetic oligonucleotide
gagtgatgaggtacgcaagaacctg

SEQ ID NO: 712556 - DNA, 25 bp, Artificial sequence
  Synthetic oligonucleotide
taccggtcgatggaacgagtgatga

SEQ ID NO: 712557 - DNA, 25 bp, Artificial sequence
  Synthetic oligonucleotide
taccggtcgatgcaacgagtgatga

SEQ ID NO: 712558 - DNA, 25 bp, Artificial sequence
  Synthetic oligonucleotide
atttgcctgcataaccggtcgatgc

SEQ ID NO: 712559 - DNA, 25 bp, Artificial sequence
  Synthetic oligonucleotide
tcagggttaaagatatctcacgtac

SEQ ID NO: 712560 - DNA, 25 bp, Artificial sequence
  Synthetic oligonucleotide
gccaggcgttttgtgagcatacctg

SEQ ID NO: 712561 - DNA, 25 bp, Artificial sequence
  Synthetic oligonucleotide
atttgcctgcattaccggtcgatgc

SEQ ID NO: 712562 - DNA, 25 bp, Artificial sequence
  Synthetic oligonucleotide
atggaaaatagcgatcgctgccagg

SEQ ID NO: 712563 - DNA, 25 bp, Artificial sequence
  Synthetic oligonucleotide
tcagggttaaagttatctcacgtac

SEQ ID NO: 712564 - DNA, 25 bp, Artificial sequence
  Synthetic oligonucleotide
ccagctaaacatccttcatcgtcgg

SEQ ID NO: 712565 - DNA, 25 bp, Artificial sequence
  Synthetic oligonucleotide
atggaaaatagccatcgctgccagg

SEQ ID NO: 712566 - DNA, 25 bp, Artificial sequence
  Synthetic oligonucleotide
tcgttcactcatggaaaatagcgat

SEQ ID NO: 712567 - DNA, 25 bp, Artificial sequence
  Synthetic oligonucleotide
tcgttcactcatcgaaaatagcgat

SEQ ID NO: 712568 - DNA, 25 bp, Artificial sequence
  Synthetic oligonucleotide
ctctagcgttcgaacgcactgattt

SEQ ID NO: 712569 - DNA, 25 bp, Artificial sequence
  Synthetic oligonucleotide
ctctagcgttcgtacgcactgattt

SEQ ID NO: 712570 - DNA, 25 bp, Artificial sequence
  Synthetic oligonucleotide
acgtgcaaaacacgctctagcgttc

SEQ ID NO: 712571 - DNA, 25 bp, Artificial sequence
  Synthetic oligonucleotide
acgtgcaaaacaggctctagcgttc

SEQ ID NO: 712572 - DNA, 25 bp, Artificial sequence
  Synthetic oligonucleotide
ccgggctgccacgaccaagtgacag

SEQ ID NO: 712573 - DNA, 25 bp, Artificial sequence
  Synthetic oligonucleotide
ccagctaaacatgcttcatcgtcgg

SEQ ID NO: 712574 - DNA, 25 bp, Artificial sequence
  Synthetic oligonucleotide
ccgggctgccaccaccaagtgacag

SEQ ID NO: 712575 - DNA, 25 bp, Artificial sequence
  Synthetic oligonucleotide
gaccaagtgacaccaatgctgtttc

SEQ ID NO: 712576 - DNA, 25 bp, Artificial sequence
  Synthetic oligonucleotide
gaccaagtgacagcaatgctgtttc

SEQ ID NO: 712577 - DNA, 25 bp, Artificial sequence
  Synthetic oligonucleotide
aatgctgtttcactggttatgcggc

SEQ ID NO: 712578 - DNA, 25 bp, Artificial sequence
  Synthetic oligonucleotide
aatgctgtttcagtggttatgcggc

SEQ ID NO: 712579 - DNA, 25 bp, Artificial sequence
  Synthetic oligonucleotide
atgccggtgaacgtgcaaaacaggc

SEQ ID NO: 712580 - DNA, 25 bp, Artificial sequence
  Synthetic oligonucleotide
atgccggtgaacctgcaaaacaggc

SEQ ID NO: 712581 - DNA, 25 bp, Artificial sequence
  Synthetic oligonucleotide
gagtgatgaggttcgcaagaacctg

SEQ ID NO: 712582 - DNA, 25 bp, Artificial sequence
  Synthetic oligonucleotide
gccaggcgttttctgagcatacctg

SEQ ID NO: 712583 - DNA, 25 bp, Artificial sequence
  Synthetic oligonucleotide
tctatatcttcacgcgcgcggtctg

SEQ ID NO: 712584 - DNA, 25 bp, Artificial sequence
  Synthetic oligonucleotide
gaagatgttcgcgattatcttctat

SEQ ID NO: 712585 - DNA, 25 bp, Artificial sequence
  Synthetic oligonucleotide
gaagatgttcgccattatcttctat

SEQ ID NO: 712586 - DNA, 25 bp, Artificial sequence
  Synthetic oligonucleotide
gcggcatggtgctagttgaataacc

SEQ ID NO: 712587 - DNA, 25 bp, Artificial sequence
  Synthetic oligonucleotide
gcggcatggtgcaagttgaataacc

SEQ ID NO: 712588 - DNA, 25 bp, Artificial sequence
  Synthetic oligonucleotide
gccaggcgttttgtgagcatacctg

SEQ ID NO: 712589 - DNA, 25 bp, Artificial sequence
  Synthetic oligonucleotide
tctatatcttcaggcgcgcggtctg

SEQ ID NO: 712590 - DNA, 25 bp, Artificial sequence
  Synthetic oligonucleotide
gacatgttcaggcatcgccaggcgt

SEQ ID NO: 712591 - DNA, 25 bp, Artificial sequence
  Synthetic oligonucleotide
gacatgttcagggatcgccaggcgt

SEQ ID NO: 712592 - DNA, 25 bp, Artificial sequence
  Synthetic oligonucleotide
gcaagaacctgaaggacatgttcag

SEQ ID NO: 712593 - DNA, 25 bp, Artificial sequence
  Synthetic oligonucleotide
atttgcctgcataaccggtcgatgc

SEQ ID NO: 712594 - DNA, 25 bp, Artificial sequence
  Synthetic oligonucleotide
gagtgatgaggtacgcaagaacctg

SEQ ID NO: 712595 - DNA, 25 bp, Artificial sequence
  Synthetic oligonucleotide
gcaacatttggggcagctaaacatg

SEQ ID NO: 712596 - DNA, 25 bp, Artificial sequence
  Synthetic oligonucleotide
taccggtcgatgcaacgagtgatga

SEQ ID NO: 712597 - DNA, 25 bp, Artificial sequence
  Synthetic oligonucleotide
taccggtcgatggaacgagtgatga

SEQ ID NO: 712598 - DNA, 25 bp, Artificial sequence
  Synthetic oligonucleotide
atttgcctgcattaccggtcgatgc

SEQ ID NO: 712599 - DNA, 25 bp, Artificial sequence
  Synthetic oligonucleotide
gcaagaacctgatggacatgttcag

SEQ ID NO: 712600 - DNA, 25 bp, Artificial sequence
  Synthetic oligonucleotide
acgtgcaaaacacgctctagcgttc

SEQ ID NO: 712601 - DNA, 25 bp, Artificial sequence
  Synthetic oligonucleotide
ccgggctgccacgaccaagtgacag

SEQ ID NO: 712602 - DNA, 25 bp, Artificial sequence
  Synthetic oligonucleotide
tcagggttaaagttatctcacgtac

SEQ ID NO: 712603 - DNA, 25 bp, Artificial sequence
  Synthetic oligonucleotide
atggaaaatagcgatcgctgccagg

SEQ ID NO: 712604 - DNA, 25 bp, Artificial sequence
  Synthetic oligonucleotide
atggaaaatagccatcgctgccagg

SEQ ID NO: 712605 - DNA, 25 bp, Artificial sequence
  Synthetic oligonucleotide
tcgttcactcatggaaaatagcgat

SEQ ID NO: 712606 - DNA, 25 bp, Artificial sequence
  Synthetic oligonucleotide
tcgttcactcatcgaaaatagcgat

SEQ ID NO: 712607 - DNA, 25 bp, Artificial sequence
  Synthetic oligonucleotide
ctctagcgttcgtacgcactgattt

SEQ ID NO: 712608 - DNA, 25 bp, Artificial sequence
  Synthetic oligonucleotide
tcagggttaaagatatctcacgtac

SEQ ID NO: 712609 - DNA, 25 bp, Artificial sequence
  Synthetic oligonucleotide
acgtgcaaaacaggctctagcgttc

SEQ ID NO: 712610 - DNA, 25 bp, Artificial sequence
  Synthetic oligonucleotide
gcaacatttgggccagctaaacatg

SEQ ID NO: 712611 - DNA, 25 bp, Artificial sequence
  Synthetic oligonucleotide
atgccggtgaacgtgcaaaacaggc

SEQ ID NO: 712612 - DNA, 25 bp, Artificial sequence
  Synthetic oligonucleotide
atgccggtgaacctgcaaaacaggc

SEQ ID NO: 712613 - DNA, 25 bp, Artificial sequence
  Synthetic oligonucleotide
aatgctgtttcagtggttatgcggc

SEQ ID NO: 712614 - DNA, 25 bp, Artificial sequence
  Synthetic oligonucleotide
aatgctgtttcactggttatgcggc

SEQ ID NO: 712615 - DNA, 25 bp, Artificial sequence
  Synthetic oligonucleotide
gaccaagtgacaccaatgctgtttc

SEQ ID NO: 712616 - DNA, 25 bp, Artificial sequence
  Synthetic oligonucleotide
gaccaagtgacagcaatgctgtttc

SEQ ID NO: 712617 - DNA, 25 bp, Artificial sequence
  Synthetic oligonucleotide
ccgggctgccaccaccaagtgacag

SEQ ID NO: 712618 - DNA, 25 bp, Artificial sequence
  Synthetic oligonucleotide
ccagctaaacatgcttcatcgtcgg

SEQ ID NO: 712619 - DNA, 25 bp, Artificial sequence
  Synthetic oligonucleotide
ctctagcgttcgaacgcactgattt

SEQ ID NO: 712620 - DNA, 25 bp, Artificial sequence
  Synthetic oligonucleotide
ccagctaaacatccttcatcgtcgg

SEQ ID NO: 712621 - DNA, 25 bp, Artificial sequence
  Synthetic oligonucleotide
tgccgatgcccccatgtttgtgatg

SEQ ID NO: 712622 - DNA, 25 bp, Artificial sequence
  Synthetic oligonucleotide
ttccaccttcgatgccggggctggc

SEQ ID NO: 712623 - DNA, 25 bp, Artificial sequence
  Synthetic oligonucleotide
gttgtctcctgcgacttcaacagca

SEQ ID NO: 712624 - DNA, 25 bp, Artificial sequence
  Synthetic oligonucleotide
cactgaagggcatcttgggctacac

SEQ ID NO: 712625 - DNA, 25 bp, Artificial sequence
  Synthetic oligonucleotide
catcaagaaggtggtgaagcaggca

SEQ ID NO: 712626 - DNA, 25 bp, Artificial sequence
  Synthetic oligonucleotide
ctgacgtgccgcctggagaaacctg

SEQ ID NO: 712627 - DNA, 25 bp, Artificial sequence
  Synthetic oligonucleotide
cttccgtgttcctacccccaatgtg

SEQ ID NO: 712628 - DNA, 25 bp, Artificial sequence
  Synthetic oligonucleotide
tcatcccagagctgaacgggaagct

SEQ ID NO: 712629 - DNA, 25 bp, Artificial sequence
  Synthetic oligonucleotide
catccactggtgctgccaaggctgt

SEQ ID NO: 712630 - DNA, 25 bp, Artificial sequence
  Synthetic oligonucleotide
tggccgtggggctgcccagaacatc

SEQ ID NO: 712631 - DNA, 25 bp, Artificial sequence
  Synthetic oligonucleotide
cagaagactgtggatggcccctctg

SEQ ID NO: 712632 - DNA, 25 bp, Artificial sequence
  Synthetic oligonucleotide
gggctcatgaccacagtccatgcca

SEQ ID NO: 712633 - DNA, 25 bp, Artificial sequence
  Synthetic oligonucleotide
ggtcatccatgacaactttggcatt

SEQ ID NO: 712634 - DNA, 25 bp, Artificial sequence
  Synthetic oligonucleotide
gaatacggctacagcaacagggtgg

SEQ ID NO: 712635 - DNA, 25 bp, Artificial sequence
  Synthetic oligonucleotide
cgagaaatatgacaactcactcaag

SEQ ID NO: 712636 - DNA, 25 bp, Artificial sequence
  Synthetic oligonucleotide
ggcctacatggcctccaaggagtaa

SEQ ID NO: 712637 - DNA, 25 bp, Artificial sequence
  Synthetic oligonucleotide
aagggtggagccaaacgggtcatca

SEQ ID NO: 712638 - DNA, 25 bp, Artificial sequence
  Synthetic oligonucleotide
ggtgtcttcaccaccatggagaagg

SEQ ID NO: 712639 - DNA, 25 bp, Artificial sequence
  Synthetic oligonucleotide
gggtgaggccggtgctgagtatgtc

SEQ ID NO: 712640 - DNA, 25 bp, Artificial sequence
  Synthetic oligonucleotide
atcaccatcttccaggagcgagacc

SEQ ID NO: 712641 - DNA, 25 bp, Artificial sequence
  Synthetic oligonucleotide
gaatgggaagcttgtcatcaacggg

SEQ ID NO: 712642 - DNA, 25 bp, Artificial sequence
  Synthetic oligonucleotide
tccactcacggcaaattcaacggca

SEQ ID NO: 712643 - DNA, 25 bp, Artificial sequence
  Synthetic oligonucleotide
tgacctcaactacatggtctacatg

SEQ ID NO: 712644 - DNA, 25 bp, Artificial sequence
  Synthetic oligonucleotide
caaagtggagattgttgccatcaac

SEQ ID NO: 712645 - DNA, 25 bp, Artificial sequence
  Synthetic oligonucleotide
tattgggcgcctggtcaccagggct

SEQ ID NO: 712646 - DNA, 25 bp, Artificial sequence
  Synthetic oligonucleotide
caaaatggtgaaggtcggtgtgaac

SEQ ID NO: 712647 - DNA, 25 bp, Artificial sequence
  Synthetic oligonucleotide
gccgcatcttcttgtgcagtgccag

SEQ ID NO: 712648 - DNA, 25 bp, Artificial sequence
  Synthetic oligonucleotide
gcatcctgcaccaccaactgcttag

SEQ ID NO: 712649 - DNA, 25 bp, Artificial sequence
  Synthetic oligonucleotide
caccccagcaaggacactgagcaag

SEQ ID NO: 712650 - DNA, 25 bp, Artificial sequence
  Synthetic oligonucleotide
actcggcccccaacactgagcatct

SEQ ID NO: 712651 - DNA, 25 bp, Artificial sequence
  Synthetic oligonucleotide
cccagacccccataataacaggagg

SEQ ID NO: 712652 - DNA, 25 bp, Artificial sequence
  Synthetic oligonucleotide
ggagccctccctactctcttgaata

SEQ ID NO: 712653 - DNA, 25 bp, Artificial sequence
  Synthetic oligonucleotide
caactttgtcaagctcatttcctgg

SEQ ID NO: 712654 - DNA, 25 bp, Artificial sequence
  Synthetic oligonucleotide
caagcaggtaggctatgagaacgcc

SEQ ID NO: 712655 - DNA, 25 bp, Artificial sequence
  Synthetic oligonucleotide
ccgcattgaggttttccggagtggt

SEQ ID NO: 712656 - DNA, 25 bp, Artificial sequence
  Synthetic oligonucleotide
gaggaccctgcacgcagcttccagc

SEQ ID NO: 712657 - DNA, 25 bp, Artificial sequence
  Synthetic oligonucleotide
tggctgtgccattcagtgtcgggtc

SEQ ID NO: 712658 - DNA, 25 bp, Artificial sequence
  Synthetic oligonucleotide
tgacctgggcctgcggcaggagaac

SEQ ID NO: 712659 - DNA, 25 bp, Artificial sequence
  Synthetic oligonucleotide
catgctcagatccacgtgtccgaag

SEQ ID NO: 712660 - DNA, 25 bp, Artificial sequence
  Synthetic oligonucleotide
cggtcaccgaggagatcacagatgt

SEQ ID NO: 712661 - DNA, 25 bp, Artificial sequence
  Synthetic oligonucleotide
gagttcctggtggacaagcacggca

SEQ ID NO: 712662 - DNA, 25 bp, Artificial sequence
  Synthetic oligonucleotide
tgccaccaagatgagcagagccctg

SEQ ID NO: 712663 - DNA, 25 bp, Artificial sequence
  Synthetic oligonucleotide
aacttcgctcacgtctcaccagtga

SEQ ID NO: 712664 - DNA, 25 bp, Artificial sequence
  Synthetic oligonucleotide
tgcggaatcaccaggggctgctgtt

SEQ ID NO: 712665 - DNA, 25 bp, Artificial sequence
  Synthetic oligonucleotide
cgggatgcccaccagtcactgctgg

SEQ ID NO: 712666 - DNA, 25 bp, Artificial sequence
  Synthetic oligonucleotide
atcgaggtcaattcccgcctgcagg

SEQ ID NO: 712667 - DNA, 25 bp, Artificial sequence
  Synthetic oligonucleotide
atgggcatccgcctggacaacgcct

SEQ ID NO: 712668 - DNA, 25 bp, Artificial sequence
  Synthetic oligonucleotide
gtcaaggtcattgcacacggcaaag

SEQ ID NO: 712669 - DNA, 25 bp, Artificial sequence
  Synthetic oligonucleotide
gggaggcgccacgttcgacgttgcc

SEQ ID NO: 712670 - DNA, 25 bp, Artificial sequence
  Synthetic oligonucleotide
tgtccgaggtgtaaagaccaacatc

SEQ ID NO: 712671 - DNA, 25 bp, Artificial sequence
  Synthetic oligonucleotide
tgttctcaacaaccagcagttcctg

SEQ ID NO: 712672 - DNA, 25 bp, Artificial sequence
  Synthetic oligonucleotide
tggacacccagttcatcgatgagaa

SEQ ID NO: 712673 - DNA, 25 bp, Artificial sequence
  Synthetic oligonucleotide
gctgttccagcttcggcctgcacag

SEQ ID NO: 712674 - DNA, 25 bp, Artificial sequence
  Synthetic oligonucleotide
gaagttgctacattacctcggacat

SEQ ID NO: 712675 - DNA, 25 bp, Artificial sequence
  Synthetic oligonucleotide
gtgaatggccctaccactccaatcc

SEQ ID NO: 712676 - DNA, 25 bp, Artificial sequence
  Synthetic oligonucleotide
gagccccagtcctgtggatcctgct

SEQ ID NO: 712677 - DNA, 25 bp, Artificial sequence
  Synthetic oligonucleotide
ataggcccacctccagctggtttca

SEQ ID NO: 712678 - DNA, 25 bp, Artificial sequence
  Synthetic oligonucleotide
cttctgcgagaagggccagagggct

SEQ ID NO: 712679 - DNA, 25 bp, Artificial sequence
  Synthetic oligonucleotide
aaggtggtagagatcgcccctgcta

SEQ ID NO: 712680 - DNA, 25 bp, Artificial sequence
  Synthetic oligonucleotide
ggcgctgtcatatcgccccactatg

SEQ ID NO: 712681 - DNA, 25 bp, Artificial sequence
  Synthetic oligonucleotide
catgttaccaaggacatgactctgg

SEQ ID NO: 712682 - DNA, 25 bp, Artificial sequence
  Synthetic oligonucleotide
tgcgcacacatgatctcaaaaagat

SEQ ID NO: 712683 - DNA, 25 bp, Artificial sequence
  Synthetic oligonucleotide
gaggtgaccccagaggacgtcctct

SEQ ID NO: 712684 - DNA, 25 bp, Artificial sequence
  Synthetic oligonucleotide
catgtaccctgatgtctttgctcaa

SEQ ID NO: 712685 - DNA, 25 bp, Artificial sequence
  Synthetic oligonucleotide
cacggctaccttcggccccctggat

SEQ ID NO: 712686 - DNA, 25 bp, Artificial sequence
  Synthetic oligonucleotide
tcgtctctttcttcaaggacccaaa

SEQ ID NO: 712687 - DNA, 25 bp, Artificial sequence
  Synthetic oligonucleotide
gagtttgaggttgagctggaacggg

SEQ ID NO: 712688 - DNA, 25 bp, Artificial sequence
  Synthetic oligonucleotide
catcaaagccctggctgtaagcgac

SEQ ID NO: 712689 - DNA, 25 bp, Artificial sequence
  Synthetic oligonucleotide
ggccagaggcaggtgttctttgaac

SEQ ID NO: 712690 - DNA, 25 bp, Artificial sequence
  Synthetic oligonucleotide
gatccattctggttaaagacaccca

SEQ ID NO: 712691 - DNA, 25 bp, Artificial sequence
  Synthetic oligonucleotide
gatgcacttccatcccaaggctttg

SEQ ID NO: 712692 - DNA, 25 bp, Artificial sequence
  Synthetic oligonucleotide
caaattggggccccgatgcctggga

SEQ ID NO: 712693 - DNA, 25 bp, Artificial sequence
  Synthetic oligonucleotide
tcaaggtggcagcaggggacaaggt

SEQ ID NO: 712694 - DNA, 25 bp, Artificial sequence
  Synthetic oligonucleotide
ctggagcctccctccctcccctgaa

SEQ ID NO: 712695 - DNA, 25 bp, Artificial sequence
  Synthetic oligonucleotide
gtgacttcgcccatggagggcacta

SEQ ID NO: 712696 - DNA, 25 bp, Artificial sequence
  Synthetic oligonucleotide
taaggtgctaaaggacctgccaaga

SEQ ID NO: 712697 - DNA, 25 bp, Artificial sequence
  Synthetic oligonucleotide
catcctagagattgagtgatcttac

SEQ ID NO: 712698 - DNA, 25 bp, Artificial sequence
  Synthetic oligonucleotide
ctggccgaccctaccccaagcctct

SEQ ID NO: 712699 - DNA, 25 bp, Artificial sequence
  Synthetic oligonucleotide
aagctgtgcagccagggcaggccca

SEQ ID NO: 712700 - DNA, 25 bp, Artificial sequence
  Synthetic oligonucleotide
tacctgagagtaggaaggccaggcc

SEQ ID NO: 712701 - DNA, 25 bp, Artificial sequence
  Synthetic oligonucleotide
tgtcccatgggacagcacacacact

SEQ ID NO: 712702 - DNA, 25 bp, Artificial sequence
  Synthetic oligonucleotide
tgcccattcccttcagctatttgtc

SEQ ID NO: 712703 - DNA, 25 bp, Artificial sequence
  Synthetic oligonucleotide
gcaggtagttgctcacatattcatc

SEQ ID NO: 712704 - DNA, 25 bp, Artificial sequence
  Synthetic oligonucleotide
aaataagggcctgctcctcgtggga

SEQ ID NO: 712705 - DNA, 25 bp, Artificial sequence
  Synthetic oligonucleotide
tgtacagtcggtggccttgtacctg

SEQ ID NO: 712706 - DNA, 25 bp, Artificial sequence
  Synthetic oligonucleotide
gtggcttagggcttctacctctggg

SEQ ID NO: 712707 - DNA, 25 bp, Artificial sequence
  Synthetic oligonucleotide
gaagacctaattcacaggtcctggg

SEQ ID NO: 712708 - DNA, 25 bp, Artificial sequence
  Synthetic oligonucleotide
gctcaataaaagtggccttcccttg

SEQ ID NO: 712709 - DNA, 25 bp, Artificial sequence
  Synthetic oligonucleotide
cactaggtcatgtacagtctaaaaa

SEQ ID NO: 712710 - DNA, 25 bp, Artificial sequence
  Synthetic oligonucleotide
cctctgtgtgctcagcgccatgaag

SEQ ID NO: 712711 - DNA, 25 bp, Artificial sequence
  Synthetic oligonucleotide
agtagactccatgtctgggatgacc

SEQ ID NO: 712712 - DNA, 25 bp, Artificial sequence
  Synthetic oligonucleotide
gagctccgggagcttatcccgaaca

SEQ ID NO: 712713 - DNA, 25 bp, Artificial sequence
  Synthetic oligonucleotide
ttcctgtacgagtgcccctggcggc

SEQ ID NO: 712714 - DNA, 25 bp, Artificial sequence
  Synthetic oligonucleotide
tccagatgctactgaggggggccaa

SEQ ID NO: 712715 - DNA, 25 bp, Artificial sequence
  Synthetic oligonucleotide
gccaaagagaatggtatggacgtct

SEQ ID NO: 712716 - DNA, 25 bp, Artificial sequence
  Synthetic oligonucleotide
ttgactccctcaactacttgccaaa

SEQ ID NO: 712717 - DNA, 25 bp, Artificial sequence
  Synthetic oligonucleotide
tgggcatggaagcagcaggcagtgc

SEQ ID NO: 712718 - DNA, 25 bp, Artificial sequence
  Synthetic oligonucleotide
tggaggctgccatctcatacacggg

SEQ ID NO: 712719 - DNA, 25 bp, Artificial sequence
  Synthetic oligonucleotide
tagtcgcactaaatactcactggag

SEQ ID NO: 712720 - DNA, 25 bp, Artificial sequence
  Synthetic oligonucleotide
gcttagctgaagaactggtgcgagc

SEQ ID NO: 712721 - DNA, 25 bp, Artificial sequence
  Synthetic oligonucleotide
cctgtgcattaaggacatggcgggc

SEQ ID NO: 712722 - DNA, 25 bp, Artificial sequence
  Synthetic oligonucleotide
tgccgcctgcaccatgctggtcagc

SEQ ID NO: 712723 - DNA, 25 bp, Artificial sequence
  Synthetic oligonucleotide
gattccccgacctcccactgcacat

SEQ ID NO: 712724 - DNA, 25 bp, Artificial sequence
  Synthetic oligonucleotide
tggagaaggacctgattgataggca

SEQ ID NO: 712725 - DNA, 25 bp, Artificial sequence
  Synthetic oligonucleotide
ctgtgcacaagcaggggctgatgtt

SEQ ID NO: 712726 - DNA, 25 bp, Artificial sequence
  Synthetic oligonucleotide
gttgcccacaacttcaacaagctct

SEQ ID NO: 712727 - DNA, 25 bp, Artificial sequence
  Synthetic oligonucleotide
catgggggccctggtggcctgtacc

SEQ ID NO: 712728 - DNA, 25 bp, Artificial sequence
  Synthetic oligonucleotide
tttggacacagaggtacccctggag

SEQ ID NO: 712729 - DNA, 25 bp, Artificial sequence
  Synthetic oligonucleotide
ttgactacagtgagtactgggaagg

SEQ ID NO: 712730 - DNA, 25 bp, Artificial sequence
  Synthetic oligonucleotide
tgtacgcagccttcgattgcacggc

SEQ ID NO: 712731 - DNA, 25 bp, Artificial sequence
  Synthetic oligonucleotide
tggcaactccgacgtgtatgagaat

SEQ ID NO: 712732 - DNA, 25 bp, Artificial sequence
  Synthetic oligonucleotide
ggggccagtacaccaacctgcactt

SEQ ID NO: 712733 - DNA, 25 bp, Artificial sequence
  Synthetic oligonucleotide
catggggcttggctccaagttcaag

SEQ ID NO: 712734 - DNA, 25 bp, Artificial sequence
  Synthetic oligonucleotide
cctatgtggaggctaaccagatgct

SEQ ID NO: 712735 - DNA, 25 bp, Artificial sequence
  Synthetic oligonucleotide
tcaaggtgacaccatcctccaagat

SEQ ID NO: 712736 - DNA, 25 bp, Artificial sequence
  Synthetic oligonucleotide
tggcccagttcatggtgcagaatgg

SEQ ID NO: 712737 - DNA, 25 bp, Artificial sequence
  Synthetic oligonucleotide
aggcagaagctcaggcagaagagct

SEQ ID NO: 712738 - DNA, 25 bp, Artificial sequence
  Synthetic oligonucleotide
cccgctctgtggtggagttcctgca

SEQ ID NO: 712739 - DNA, 25 bp, Artificial sequence
  Synthetic oligonucleotide
gcattccccatgggggtttccctga

SEQ ID NO: 712740 - DNA, 25 bp, Artificial sequence
  Synthetic oligonucleotide
ccatgatacatcaggggcaggtgtg

SEQ ID NO: 712741 - DNA, 25 bp, Artificial sequence
  Synthetic oligonucleotide
tttcgtgcgtgcacagagctgggta

SEQ ID NO: 712742 - DNA, 25 bp, Artificial sequence
  Synthetic oligonucleotide
cgagcgagactgctccatccagcgt

SEQ ID NO: 712743 - DNA, 25 bp, Artificial sequence
  Synthetic oligonucleotide
ccaactaccctgacaacgtggtctt

SEQ ID NO: 712744 - DNA, 25 bp, Artificial sequence
  Synthetic oligonucleotide
cctgctggaggcctgggcctcgggt

SEQ ID NO: 712745 - DNA, 25 bp, Artificial sequence
  Synthetic oligonucleotide
tactgcctgtggatcctctatcacg

SEQ ID NO: 712746 - DNA, 25 bp, Artificial sequence
  Synthetic oligonucleotide
cacacctaggtgcttggctggtaca

SEQ ID NO: 712747 - DNA, 25 bp, Artificial sequence
  Synthetic oligonucleotide
ttccaaacagttcgagggggcctga

SEQ ID NO: 712748 - DNA, 25 bp, Artificial sequence
  Synthetic oligonucleotide
tgggtgtccgccgatcctcctcggc

SEQ ID NO: 712749 - DNA, 25 bp, Artificial sequence
  Synthetic oligonucleotide
taatggtggccaacagaggtgagat

SEQ ID NO: 712750 - DNA, 25 bp, Artificial sequence
  Synthetic oligonucleotide
tgtctactcggagcaggacacaggg

SEQ ID NO: 712751 - DNA, 25 bp, Artificial sequence
  Synthetic oligonucleotide
gcagaaagctgatgaagcctacctt

SEQ ID NO: 712752 - DNA, 25 bp, Artificial sequence
  Synthetic oligonucleotide
tggcacctgtgcaggcctacctgca

SEQ ID NO: 712753 - DNA, 25 bp, Artificial sequence
  Synthetic oligonucleotide
gacatcatcaaggtggccaaggaaa

SEQ ID NO: 712754 - DNA, 25 bp, Artificial sequence
  Synthetic oligonucleotide
gctccctgcacgaggcgcatgagtt

SEQ ID NO: 712755 - DNA, 25 bp, Artificial sequence
  Synthetic oligonucleotide
gaagttcattgagaagccaaggcac

SEQ ID NO: 712756 - DNA, 25 bp, Artificial sequence
  Synthetic oligonucleotide
cctaggggaccagtatgggaacatc

SEQ ID NO: 712757 - DNA, 25 bp, Artificial sequence
  Synthetic oligonucleotide
caaatgtccggcgtctggagtataa

SEQ ID NO: 712758 - DNA, 25 bp, Artificial sequence
  Synthetic oligonucleotide
gcggtgcatcctggctatgggttcc

SEQ ID NO: 712759 - DNA, 25 bp, Artificial sequence
  Synthetic oligonucleotide
tggaagagaattacacccgggccta

SEQ ID NO: 712760 - DNA, 25 bp, Artificial sequence
  Synthetic oligonucleotide
tcggcttccctattatcttcaaggc

SEQ ID NO: 712761 - DNA, 25 bp, Artificial sequence
  Synthetic oligonucleotide
ccttggcagcctttgggaatggagc

SEQ ID NO: 712762 - DNA, 25 bp, Artificial sequence
  Synthetic oligonucleotide
tgcaggcgttccagtggtccccggc

SEQ ID NO: 712763 - DNA, 25 bp, Artificial sequence
  Synthetic oligonucleotide
agacaaggtggaagcccgggccatt

SEQ ID NO: 712764 - DNA, 25 bp, Artificial sequence
  Synthetic oligonucleotide
ttcattggtccaagcccagaggtgg

SEQ ID NO: 712765 - DNA, 25 bp, Artificial sequence
  Synthetic oligonucleotide
agactttgcccaggcctgccaagat

SEQ ID NO: 712766 - DNA, 25 bp, Artificial sequence
  Synthetic oligonucleotide
gggccgcggcatgcgggtcgtgcat

SEQ ID NO: 712767 - DNA, 25 bp, Artificial sequence
  Synthetic oligonucleotide
aagaattcagctaacgcttccagac

SEQ ID NO: 712768 - DNA, 25 bp, Artificial sequence
  Synthetic oligonucleotide
gatttgacagaagcggaactctctt

SEQ ID NO: 712769 - DNA, 25 bp, Artificial sequence
  Synthetic oligonucleotide
aagaattcagcttacgcttccagac

SEQ ID NO: 712770 - DNA, 25 bp, Artificial sequence
  Synthetic oligonucleotide
tatcccgtcaaacgattccgtttct

SEQ ID NO: 712771 - DNA, 25 bp, Artificial sequence
  Synthetic oligonucleotide
gatttgacagaaccggaactctctt

SEQ ID NO: 712772 - DNA, 25 bp, Artificial sequence
  Synthetic oligonucleotide
gtacggtcagtttgcgtaaagaaga

SEQ ID NO: 712773 - DNA, 25 bp, Artificial sequence
  Synthetic oligonucleotide
gtacggtcagttagcgtaaagaaga

SEQ ID NO: 712774 - DNA, 25 bp, Artificial sequence
  Synthetic oligonucleotide
gctgaagcagcccgcatattaggcg

SEQ ID NO: 712775 - DNA, 25 bp, Artificial sequence
  Synthetic oligonucleotide
caattcggtcaaatgtcactgtcat

SEQ ID NO: 712776 - DNA, 25 bp, Artificial sequence
  Synthetic oligonucleotide
tatcccgtcaaaggattccgtttct

SEQ ID NO: 712777 - DNA, 25 bp, Artificial sequence
  Synthetic oligonucleotide
gctgaagcagccggcatattaggcg

SEQ ID NO: 712778 - DNA, 25 bp, Artificial sequence
  Synthetic oligonucleotide
ttcatcagccggtttttgttattga

SEQ ID NO: 712779 - DNA, 25 bp, Artificial sequence
  Synthetic oligonucleotide
atctcggatacattagaggcaaaga

SEQ ID NO: 712780 - DNA, 25 bp, Artificial sequence
  Synthetic oligonucleotide
caattcggtcaattgtcactgtcat

SEQ ID NO: 712781 - DNA, 25 bp, Artificial sequence
  Synthetic oligonucleotide
ttcatcagccggattttgttattga

SEQ ID NO: 712782 - DNA, 25 bp, Artificial sequence
  Synthetic oligonucleotide
tcatcagccggattttgttattgat

SEQ ID NO: 712783 - DNA, 25 bp, Artificial sequence
  Synthetic oligonucleotide
tcatcagccggaatttgttattgat

SEQ ID NO: 712784 - DNA, 25 bp, Artificial sequence
  Synthetic oligonucleotide
atctcggatacaatagaggcaaaga

SEQ ID NO: 712785 - DNA, 25 bp, Artificial sequence
  Synthetic oligonucleotide
ttccggcgcatatagtcagcaaggt

SEQ ID NO: 712786 - DNA, 25 bp, Artificial sequence
  Synthetic oligonucleotide
gaagcgatctttaccgccggaatcc

SEQ ID NO: 712787 - DNA, 25 bp, Artificial sequence
  Synthetic oligonucleotide
gaagcgatcttttccgccggaatcc

SEQ ID NO: 712788 - DNA, 25 bp, Artificial sequence
  Synthetic oligonucleotide
ttccggcgcataaagtcagcaaggt

SEQ ID NO: 712789 - DNA, 25 bp, Artificial sequence
  Synthetic oligonucleotide
gaaaaagggatcggagccatcatcg

SEQ ID NO: 712790 - DNA, 25 bp, Artificial sequence
  Synthetic oligonucleotide
gaaaaagggatccgagccatcatcg

SEQ ID NO: 712791 - DNA, 25 bp, Artificial sequence
  Synthetic oligonucleotide
tcatcatgaccagaagcttgacgca

SEQ ID NO: 712792 - DNA, 25 bp, Artificial sequence
  Synthetic oligonucleotide
tcatcatgaccacaagcttgacgca

SEQ ID NO: 712793 - DNA, 25 bp, Artificial sequence
  Synthetic oligonucleotide
ctcggtgcgatactgatgatgaaat

SEQ ID NO: 712794 - DNA, 25 bp, Artificial sequence
  Synthetic oligonucleotide
ctcggtgcgatagtgatgatgaaat

SEQ ID NO: 712795 - DNA, 25 bp, Artificial sequence
  Synthetic oligonucleotide
ccaaattttgcggtcggtgcgatac

SEQ ID NO: 712796 - DNA, 25 bp, Artificial sequence
  Synthetic oligonucleotide
acaaccggatgtgttgattgattta

SEQ ID NO: 712797 - DNA, 25 bp, Artificial sequence
  Synthetic oligonucleotide
attatctgatgtcatgcctgttgag

SEQ ID NO: 712798 - DNA, 25 bp, Artificial sequence
  Synthetic oligonucleotide
attatctgatgtgatgcctgttgag

SEQ ID NO: 712799 - DNA, 25 bp, Artificial sequence
  Synthetic oligonucleotide
ccaaattttgcgctcggtgcgatac

SEQ ID NO: 712800 - DNA, 25 bp, Artificial sequence
  Synthetic oligonucleotide
ggccatagaccatacatacgatcag

SEQ ID NO: 712801 - DNA, 25 bp, Artificial sequence
  Synthetic oligonucleotide
acaaccggtttcacagaagctgatt

SEQ ID NO: 712802 - DNA, 25 bp, Artificial sequence
  Synthetic oligonucleotide
acaccacattttgaccttgtagggg

SEQ ID NO: 712803 - DNA, 25 bp, Artificial sequence
  Synthetic oligonucleotide
acaaccggatgtcttgattgattta

SEQ ID NO: 712804 - DNA, 25 bp, Artificial sequence
  Synthetic oligonucleotide
tcttgattgattaaacaacgcccga

SEQ ID NO: 712805 - DNA, 25 bp, Artificial sequence
  Synthetic oligonucleotide
tcttgattgatttaacaacgcccga

SEQ ID NO: 712806 - DNA, 25 bp, Artificial sequence
  Synthetic oligonucleotide
ttagagcacggagtccgtccagttg

SEQ ID NO: 712807 - DNA, 25 bp, Artificial sequence
  Synthetic oligonucleotide
ttagagcacggactccgtccagttg

SEQ ID NO: 712808 - DNA, 25 bp, Artificial sequence
  Synthetic oligonucleotide
acaaccggtttctcagaagctgatt

SEQ ID NO: 712809 - DNA, 25 bp, Artificial sequence
  Synthetic oligonucleotide
acaccacattttcaccttgtagggg

SEQ ID NO: 712810 - DNA, 25 bp, Artificial sequence
  Synthetic oligonucleotide
ggccatagaccaaacatacgatcag

SEQ ID NO: 712811 - DNA, 25 bp, Artificial sequence
  Synthetic oligonucleotide
cccacagtgatgttgtcgagatcgg

SEQ ID NO: 712812 - DNA, 25 bp, Artificial sequence
  Synthetic oligonucleotide
cccacagtgatgatgtcgagatcgg

SEQ ID NO: 712813 - DNA, 25 bp, Artificial sequence
  Synthetic oligonucleotide
ccgaatgtataaagctgacgttctt

SEQ ID NO: 712814 - DNA, 25 bp, Artificial sequence
  Synthetic oligonucleotide
atgaaggtgtttacgaattccgtga

SEQ ID NO: 712815 - DNA, 25 bp, Artificial sequence
  Synthetic oligonucleotide
atgaaggtgttttcgaattccgtga

SEQ ID NO: 712816 - DNA, 25 bp, Artificial sequence
  Synthetic oligonucleotide
gcggaaattcttgtgcgcacacttg

SEQ ID NO: 712817 - DNA, 25 bp, Artificial sequence
  Synthetic oligonucleotide
gaaaattgctttcatcgcgcatgac

SEQ ID NO: 712818 - DNA, 25 bp, Artificial sequence
  Synthetic oligonucleotide
ccgaatgtataatgctgacgttctt

SEQ ID NO: 712819 - DNA, 25 bp, Artificial sequence
  Synthetic oligonucleotide
tgaaccggatgtctcggcattaatc

SEQ ID NO: 712820 - DNA, 25 bp, Artificial sequence
  Synthetic oligonucleotide
tgaagattgatctgcttgtgtatgg

SEQ ID NO: 712821 - DNA, 25 bp, Artificial sequence
  Synthetic oligonucleotide
tgaagattgatcagcttgtgtatgg

SEQ ID NO: 712822 - DNA, 25 bp, Artificial sequence
  Synthetic oligonucleotide
gaaaattgctttgatcgcgcatgac

SEQ ID NO: 712823 - DNA, 25 bp, Artificial sequence
  Synthetic oligonucleotide
aaagaatcatgaactatacgcaacc

SEQ ID NO: 712824 - DNA, 25 bp, Artificial sequence
  Synthetic oligonucleotide
gtcatttttttgcgcgacccgctga

SEQ ID NO: 712825 - DNA, 25 bp, Artificial sequence
  Synthetic oligonucleotide
aaagaatcatgatctatacgcaacc

SEQ ID NO: 712826 - DNA, 25 bp, Artificial sequence
  Synthetic oligonucleotide
tgaaccggatgtgtcggcattaatc

SEQ ID NO: 712827 - DNA, 25 bp, Artificial sequence
  Synthetic oligonucleotide
gcggaaattcttctgcgcacacttg

SEQ ID NO: 712828 - DNA, 25 bp, Artificial sequence
  Synthetic oligonucleotide
ccgtttatgtgaagtgtattccatt

SEQ ID NO: 712829 - DNA, 25 bp, Artificial sequence
  Synthetic oligonucleotide
ccgtttatgtgatgtgtattccatt

SEQ ID NO: 712830 - DNA, 25 bp, Artificial sequence
  Synthetic oligonucleotide
ctgcggaaattcatgtgcgcacact

SEQ ID NO: 712831 - DNA, 25 bp, Artificial sequence
  Synthetic oligonucleotide
ctgcggaaattcttgtgcgcacact

SEQ ID NO: 712832 - DNA, 25 bp, Artificial sequence
  Synthetic oligonucleotide
gtcatttttttgggcgacccgctga

SEQ ID NO: 712833 - DNA, 25 bp, Artificial sequence
  Synthetic oligonucleotide
ggccggttttgtgttagcagcggaa

SEQ ID NO: 712834 - DNA, 25 bp, Artificial sequence
  Synthetic oligonucleotide
gttttgtgttaggagcggaaaaaat

SEQ ID NO: 712835 - DNA, 25 bp, Artificial sequence
  Synthetic oligonucleotide
atacggccggttatgtgttagcagc

SEQ ID NO: 712836 - DNA, 25 bp, Artificial sequence
  Synthetic oligonucleotide
atacggccggttttgtgttagcagc

SEQ ID NO: 712837 - DNA, 25 bp, Artificial sequence
  Synthetic oligonucleotide
gttttgtgttagcagcggaaaaaat

SEQ ID NO: 712838 - DNA, 25 bp, Artificial sequence
  Synthetic oligonucleotide
atgccactgaattcgttgaaaaaat

SEQ ID NO: 712839 - DNA, 25 bp, Artificial sequence
  Synthetic oligonucleotide
tattcatttgtaaccaaggtgctga

SEQ ID NO: 712840 - DNA, 25 bp, Artificial sequence
  Synthetic oligonucleotide
ggccggttttgtcttagcagcggaa

SEQ ID NO: 712841 - DNA, 25 bp, Artificial sequence
  Synthetic oligonucleotide
cgggccgttctctcgtgggagacgc

SEQ ID NO: 712842 - DNA, 25 bp, Artificial sequence
  Synthetic oligonucleotide
gaaccgggccgtactctcgtgggag

SEQ ID NO: 712843 - DNA, 25 bp, Artificial sequence
  Synthetic oligonucleotide
atgccactgaatacgttgaaaaaat

SEQ ID NO: 712844 - DNA, 25 bp, Artificial sequence
  Synthetic oligonucleotide
tcatgccactgattacgttgaaaaa

SEQ ID NO: 712845 - DNA, 25 bp, Artificial sequence
  Synthetic oligonucleotide
tcatgccactgaatacgttgaaaaa

SEQ ID NO: 712846 - DNA, 25 bp, Artificial sequence
  Synthetic oligonucleotide
gtgctgaatcttggaggaggtttcg

SEQ ID NO: 712847 - DNA, 25 bp, Artificial sequence
  Synthetic oligonucleotide
ttgtatccaaggagctgaatcttgg

SEQ ID NO: 712848 - DNA, 25 bp, Artificial sequence
  Synthetic oligonucleotide
ttgtatccaaggtgctgaatcttgg

SEQ ID NO: 712849 - DNA, 25 bp, Artificial sequence
  Synthetic oligonucleotide
ttcatttgtatcgaaggtgctgaat

SEQ ID NO: 712850 - DNA, 25 bp, Artificial sequence
  Synthetic oligonucleotide
tattcatttgtatccaaggtgctga

SEQ ID NO: 712851 - DNA, 25 bp, Artificial sequence
  Synthetic oligonucleotide
gtgctgaatcttcgaggaggtttcg

SEQ ID NO: 712852 - DNA, 25 bp, Artificial sequence
  Synthetic oligonucleotide
cgggccgttctcacgtgggagacgc

SEQ ID NO: 712853 - DNA, 25 bp, Artificial sequence
  Synthetic oligonucleotide
gaaccgggccgttctctcgtgggag

SEQ ID NO: 712854 - DNA, 25 bp, Artificial sequence
  Synthetic oligonucleotide
ttcatttgtatccaaggtgctgaat

SEQ ID NO: 712855 - DNA, 25 bp, Artificial sequence
  Synthetic oligonucleotide
gagagctatatacggctgttgcagc

SEQ ID NO: 712856 - DNA, 25 bp, Artificial sequence
  Synthetic oligonucleotide
ggctttaatacgtgagcgtgctaaa

SEQ ID NO: 712857 - DNA, 25 bp, Artificial sequence
  Synthetic oligonucleotide
gcaggcgtttatatctgcagggctg

SEQ ID NO: 712858 - DNA, 25 bp, Artificial sequence
  Synthetic oligonucleotide
atcagtcgcaatgattcagctcgct

SEQ ID NO: 712859 - DNA, 25 bp, Artificial sequence
  Synthetic oligonucleotide
atcagtcgcaatcattcagctcgct

SEQ ID NO: 712860 - DNA, 25 bp, Artificial sequence
  Synthetic oligonucleotide
ggactttctttacatgtcgtatccg

SEQ ID NO: 712861 - DNA, 25 bp, Artificial sequence
  Synthetic oligonucleotide
gagagctatatagggctgttgcagc

SEQ ID NO: 712862 - DNA, 25 bp, Artificial sequence
  Synthetic oligonucleotide
cacctctttacgtatatgatgtggc

SEQ ID NO: 712863 - DNA, 25 bp, Artificial sequence
  Synthetic oligonucleotide
ggctttaatacgagagcgtgctaaa

SEQ ID NO: 712864 - DNA, 25 bp, Artificial sequence
  Synthetic oligonucleotide
ggactttctttagatgtcgtatccg

SEQ ID NO: 712865 - DNA, 25 bp, Artificial sequence
  Synthetic oligonucleotide
ggatgctctctaattagcggagaaa

SEQ ID NO: 712866 - DNA, 25 bp, Artificial sequence
  Synthetic oligonucleotide
gcaggcgtttatttctgcagggctg

SEQ ID NO: 712867 - DNA, 25 bp, Artificial sequence
  Synthetic oligonucleotide
cacctctttacgaatatgatgtggc

SEQ ID NO: 712868 - DNA, 25 bp, Artificial sequence
  Synthetic oligonucleotide
ggatgctctctatttagcggagaaa

SEQ ID NO: 712869 - DNA, 25 bp, Artificial sequence
  Synthetic oligonucleotide
tagaaatcggagctgtggatgctct

SEQ ID NO: 712870 - DNA, 25 bp, Artificial sequence
  Synthetic oligonucleotide
agcggagaaataaggtacacctctt

SEQ ID NO: 712871 - DNA, 25 bp, Artificial sequence
  Synthetic oligonucleotide
agcggagaaatatggtacacctctt

SEQ ID NO: 712872 - DNA, 25 bp, Artificial sequence
  Synthetic oligonucleotide
ggagaaatatggtacacctctttac

SEQ ID NO: 712873 - DNA, 25 bp, Artificial sequence
  Synthetic oligonucleotide
ggagaaatatggaacacctctttac

SEQ ID NO: 712874 - DNA, 25 bp, Artificial sequence
  Synthetic oligonucleotide
tacacctctttacgtatatgatgtg

SEQ ID NO: 712875 - DNA, 25 bp, Artificial sequence
  Synthetic oligonucleotide
tacacctctttaggtatatgatgtg

SEQ ID NO: 712876 - DNA, 25 bp, Artificial sequence
  Synthetic oligonucleotide
tagaaatcggaggtgtggatgctct

SEQ ID NO: 712877 - DNA, 25 bp, Artificial sequence
  Synthetic oligonucleotide
agtttggtttcgatcttcataacgg

SEQ ID NO: 712878 - DNA, 25 bp, Artificial sequence
  Synthetic oligonucleotide
agtttggtttcgttcttcataacgg

SEQ ID NO: 712879 - DNA, 25 bp, Artificial sequence
  Synthetic oligonucleotide
tttcgatcttcataacggacaaact

SEQ ID NO: 712880 - DNA, 25 bp, Artificial sequence
  Synthetic oligonucleotide
tttcgatcttcaaaacggacaaact

SEQ ID NO: 712881 - DNA, 25 bp, Artificial sequence
  Synthetic oligonucleotide
actgaacgggccattgaacaagtat

SEQ ID NO: 712882 - DNA, 25 bp, Artificial sequence
  Synthetic oligonucleotide
actgaacgggcctttgaacaagtat

SEQ ID NO: 712883 - DNA, 25 bp, Artificial sequence
  Synthetic oligonucleotide
ctgaacgggccattgaacaagtatt

SEQ ID NO: 712884 - DNA, 25 bp, Artificial sequence
  Synthetic oligonucleotide
gactacattacaacgggccaggaag

SEQ ID NO: 712885 - DNA, 25 bp, Artificial sequence
  Synthetic oligonucleotide
tccattgccataacggctcgcaaat

SEQ ID NO: 712886 - DNA, 25 bp, Artificial sequence
  Synthetic oligonucleotide
cttcggatcacgcccggagtagaag

SEQ ID NO: 712887 - DNA, 25 bp, Artificial sequence
  Synthetic oligonucleotide
ctgaacgggccaatgaacaagtatt

SEQ ID NO: 712888 - DNA, 25 bp, Artificial sequence
  Synthetic oligonucleotide
gactacattacatcgggccaggaag

SEQ ID NO: 712889 - DNA, 25 bp, Artificial sequence
  Synthetic oligonucleotide
tgactacattacaacgggccaggaa

SEQ ID NO: 712890 - DNA, 25 bp, Artificial sequence
  Synthetic oligonucleotide
tgactacattactacgggccaggaa

SEQ ID NO: 712891 - DNA, 25 bp, Artificial sequence
  Synthetic oligonucleotide
tacgcatgactagattacaacgggc

SEQ ID NO: 712892 - DNA, 25 bp, Artificial sequence
  Synthetic oligonucleotide
tacgcatgactacattacaacgggc

SEQ ID NO: 712893 - DNA, 25 bp, Artificial sequence
  Synthetic oligonucleotide
cttcggatcacggccggagtagaag

SEQ ID NO: 712894 - DNA, 25 bp, Artificial sequence
  Synthetic oligonucleotide
gcttcttgaagagctatgtaaagaa

SEQ ID NO: 712895 - DNA, 25 bp, Artificial sequence
  Synthetic oligonucleotide
gcttcttgaagacctatgtaaagaa

SEQ ID NO: 712896 - DNA, 25 bp, Artificial sequence
  Synthetic oligonucleotide
gaacgcatccacattcatggaaaca

SEQ ID NO: 712897 - DNA, 25 bp, Artificial sequence
  Synthetic oligonucleotide
gaacgcatccactttcatggaaaca

SEQ ID NO: 712898 - DNA, 25 bp, Artificial sequence
  Synthetic oligonucleotide
tccattgccatatcggctcgcaaat

SEQ ID NO: 712899 - DNA, 25 bp, Artificial sequence
  Synthetic oligonucleotide
tccggggcgctggatagagtgctgt

SEQ ID NO: 712900 - DNA, 25 bp, Artificial sequence
  Synthetic oligonucleotide
cctgtcaaaaattgagtcacgtccg

SEQ ID NO: 712901 - DNA, 25 bp, Artificial sequence
  Synthetic oligonucleotide
gagtcacgtccgactaaaaccggat

SEQ ID NO: 712902 - DNA, 25 bp, Artificial sequence
  Synthetic oligonucleotide
gagtcacgtccgtctaaaaccggat

SEQ ID NO: 712903 - DNA, 25 bp, Artificial sequence
  Synthetic oligonucleotide
tcaaaaattgagtcacgtccgacta

SEQ ID NO: 712904 - DNA, 25 bp, Artificial sequence
  Synthetic oligonucleotide
tcaaaaattgagacacgtccgacta

SEQ ID NO: 712905 - DNA, 25 bp, Artificial sequence
  Synthetic oligonucleotide
ctgtcaaaaattcagtcacgtccga

SEQ ID NO: 712906 - DNA, 25 bp, Artificial sequence
  Synthetic oligonucleotide
atggtcatgctgccgcaggatgatc

SEQ ID NO: 712907 - DNA, 25 bp, Artificial sequence
  Synthetic oligonucleotide
cctgtcaaaaatagagtcacgtccg

SEQ ID NO: 712908 - DNA, 25 bp, Artificial sequence
  Synthetic oligonucleotide
gaccatcccgaggtgaatatcgggg

SEQ ID NO: 712909 - DNA, 25 bp, Artificial sequence
  Synthetic oligonucleotide
gtctgcattttcttggagaaattta

SEQ ID NO: 712910 - DNA, 25 bp, Artificial sequence
  Synthetic oligonucleotide
atcggggtcattgccaatgatatgg

SEQ ID NO: 712911 - DNA, 25 bp, Artificial sequence
  Synthetic oligonucleotide
ctgtcaaaaattgagtcacgtccga

SEQ ID NO: 712912 - DNA, 25 bp, Artificial sequence
  Synthetic oligonucleotide
atcggggtcattcccaatgatatgg

SEQ ID NO: 712913 - DNA, 25 bp, Artificial sequence
  Synthetic oligonucleotide
gtctgcattttcatggagaaattta

SEQ ID NO: 712914 - DNA, 25 bp, Artificial sequence
  Synthetic oligonucleotide
ctgtctcccgatgaaaacatatctt

SEQ ID NO: 712915 - DNA, 25 bp, Artificial sequence
  Synthetic oligonucleotide
ctgtctcccgatcaaaacatatctt

SEQ ID NO: 712916 - DNA, 25 bp, Artificial sequence
  Synthetic oligonucleotide
gagctctaggcccaaaacgacctta

SEQ ID NO: 712917 - DNA, 25 bp, Artificial sequence
  Synthetic oligonucleotide
gagctctaggccgaaaacgacctta

SEQ ID NO: 712918 - DNA, 25 bp, Artificial sequence
  Synthetic oligonucleotide
atggtcatgctggcgcaggatgatc

SEQ ID NO: 712919 - DNA, 25 bp, Artificial sequence
  Synthetic oligonucleotide
tccggggcgctgcatagagtgctgt

SEQ ID NO: 712920 - DNA, 25 bp, Artificial sequence
  Synthetic oligonucleotide
gaccatcccgagctgaatatcgggg

SEQ ID NO: 712921 - DNA, 25 bp, Artificial sequence
  Synthetic oligonucleotide
aggtcgatttaagtagaagtgcgtt

SEQ ID NO: 712922 - DNA, 25 bp, Artificial sequence
  Synthetic oligonucleotide
tgacactgtctaacagtacgtcggc

SEQ ID NO: 712923 - DNA, 25 bp, Artificial sequence
  Synthetic oligonucleotide
gattcagtagcagatgccgttcaaa

SEQ ID NO: 712924 - DNA, 25 bp, Artificial sequence
  Synthetic oligonucleotide
gattcagtagcacatgccgttcaaa

SEQ ID NO: 712925 - DNA, 25 bp, Artificial sequence
  Synthetic oligonucleotide
gcagatgccgttgaaaaggtcgatt

SEQ ID NO: 712926 - DNA, 25 bp, Artificial sequence
  Synthetic oligonucleotide
gcagatgccgttcaaaaggtcgatt

SEQ ID NO: 712927 - DNA, 25 bp, Artificial sequence
  Synthetic oligonucleotide
ttttccattctagaccatggtaaaa

SEQ ID NO: 712928 - DNA, 25 bp, Artificial sequence
  Synthetic oligonucleotide
gtgacactgtctatcagtacgtcgg

SEQ ID NO: 712929 - DNA, 25 bp, Artificial sequence
  Synthetic oligonucleotide
tatcagtacgtcggcaatggaagaa

SEQ ID NO: 712930 - DNA, 25 bp, Artificial sequence
  Synthetic oligonucleotide
ttttccattctacaccatggtaaaa

SEQ ID NO: 712931 - DNA, 25 bp, Artificial sequence
  Synthetic oligonucleotide
tttggaggataggtcaggtgcgtta

SEQ ID NO: 712932 - DNA, 25 bp, Artificial sequence
  Synthetic oligonucleotide
tttggaggatagctcaggtgcgtta

SEQ ID NO: 712933 - DNA, 25 bp, Artificial sequence
  Synthetic oligonucleotide
ggaggataggtctggtgcgttatct

SEQ ID NO: 712934 - DNA, 25 bp, Artificial sequence
  Synthetic oligonucleotide
ggaggataggtcaggtgcgttatct

SEQ ID NO: 712935 - DNA, 25 bp, Artificial sequence
  Synthetic oligonucleotide
tgacactgtctatcagtacgtcggc

SEQ ID NO: 712936 - DNA, 25 bp, Artificial sequence
  Synthetic oligonucleotide
gtagctgattctcgaagcaacgttc

SEQ ID NO: 712937 - DNA, 25 bp, Artificial sequence
  Synthetic oligonucleotide
ctggaagcaacgttctttccattca

SEQ ID NO: 712938 - DNA, 25 bp, Artificial sequence
  Synthetic oligonucleotide
ctggaagcaacgatctttccattca

SEQ ID NO: 712939 - DNA, 25 bp, Artificial sequence
  Synthetic oligonucleotide
gtgacactgtctttcagtacgtcgg

SEQ ID NO: 712940 - DNA, 25 bp, Artificial sequence
  Synthetic oligonucleotide
tatcagtacgtccgcaatggaagaa

SEQ ID NO: 712941 - DNA, 25 bp, Artificial sequence
  Synthetic oligonucleotide
gtagctgattctggaagcaacgttc

SEQ ID NO: 712942 - DNA, 25 bp, Artificial sequence
  Synthetic oligonucleotide
aggtcgatttaactagaagtgcgtt

SEQ ID NO: 712943 - DNA, 25 bp, Artificial sequence
  Synthetic oligonucleotide
aatcgtgggtgaaatgacgttgccg

SEQ ID NO: 712944 - DNA, 25 bp, Artificial sequence
  Synthetic oligonucleotide
aatcgtgggtgatatgacgttgccg

SEQ ID NO: 712945 - DNA, 25 bp, Artificial sequence
  Synthetic oligonucleotide
gctcgacaaaatatactcacattca

SEQ ID NO: 712946 - DNA, 25 bp, Artificial sequence
  Synthetic oligonucleotide
gctcgacaaaatttactcacattca

SEQ ID NO: 712947 - DNA, 25 bp, Artificial sequence
  Synthetic oligonucleotide
atttcttcatcgacattttccttcc

SEQ ID NO: 712948 - DNA, 25 bp, Artificial sequence
  Synthetic oligonucleotide
atttcttcatcgtcattttccttcc

SEQ ID NO: 712949 - DNA, 25 bp, Artificial sequence
  Synthetic oligonucleotide
atatgaatacgccaattctaccggg

SEQ ID NO: 712950 - DNA, 25 bp, Artificial sequence
  Synthetic oligonucleotide
gttgcaggcgaagttgattttgctt

SEQ ID NO: 712951 - DNA, 25 bp, Artificial sequence
  Synthetic oligonucleotide
ggagtgtatagatgcagccgttgca

SEQ ID NO: 712952 - DNA, 25 bp, Artificial sequence
  Synthetic oligonucleotide
atatgaatacgcgaattctaccggg

SEQ ID NO: 712953 - DNA, 25 bp, Artificial sequence
  Synthetic oligonucleotide
ctacatttacacttctagcagtcag

SEQ ID NO: 712954 - DNA, 25 bp, Artificial sequence
  Synthetic oligonucleotide
tcggttatttaggtccagcagctac

SEQ ID NO: 712955 - DNA, 25 bp, Artificial sequence
  Synthetic oligonucleotide
gttgcaggcgaacttgattttgctt

SEQ ID NO: 712956 - DNA, 25 bp, Artificial sequence
  Synthetic oligonucleotide
ggagtgtatagaagcagccgttgca

SEQ ID NO: 712957 - DNA, 25 bp, Artificial sequence
  Synthetic oligonucleotide
ctacatttacacatctagcagtcag

SEQ ID NO: 712958 - DNA, 25 bp, Artificial sequence
  Synthetic oligonucleotide
tacatttacacatctagcagtcagt

SEQ ID NO: 712959 - DNA, 25 bp, Artificial sequence
  Synthetic oligonucleotide
tacatttacacaactagcagtcagt

SEQ ID NO: 712960 - DNA, 25 bp, Artificial sequence
  Synthetic oligonucleotide
ccgaacatgttgcttaccgcaccat

SEQ ID NO: 712961 - DNA, 25 bp, Artificial sequence
  Synthetic oligonucleotide
ccgaacatgttggttaccgcaccat

SEQ ID NO: 712962 - DNA, 25 bp, Artificial sequence
  Synthetic oligonucleotide
gaacatgttgcttaccgcaccattc

SEQ ID NO: 712963 - DNA, 25 bp, Artificial sequence
  Synthetic oligonucleotide
gaacatgttgctaaccgcaccattc

SEQ ID NO: 712964 - DNA, 25 bp, Artificial sequence
  Synthetic oligonucleotide
tcggttatttagctccagcagctac

SEQ ID NO: 712965 - DNA, 25 bp, Artificial sequence
  Synthetic oligonucleotide
gaagggcgcataaggaacggctctc

SEQ ID NO: 712966 - DNA, 25 bp, Artificial sequence
  Synthetic oligonucleotide
ggattggccgctagtcgggaaaatc

SEQ ID NO: 712967 - DNA, 25 bp, Artificial sequence
  Synthetic oligonucleotide
acgcgagagacgagcttccgaagga

SEQ ID NO: 712968 - DNA, 25 bp, Artificial sequence
  Synthetic oligonucleotide
acgcgagagacgtgcttccgaagga

SEQ ID NO: 712969 - DNA, 25 bp, Artificial sequence
  Synthetic oligonucleotide
gacgtagtcgttgtcattccttttt

SEQ ID NO: 712970 - DNA, 25 bp, Artificial sequence
  Synthetic oligonucleotide
gaaggagtttccatatgccgatgcc

SEQ ID NO: 712971 - DNA, 25 bp, Artificial sequence
  Synthetic oligonucleotide
tcctcattgctgcgatcatgtccaa

SEQ ID NO: 712972 - DNA, 25 bp, Artificial sequence
  Synthetic oligonucleotide
gacgtagtcgttctcattccttttt

SEQ ID NO: 712973 - DNA, 25 bp, Artificial sequence
  Synthetic oligonucleotide
ggattggccgcttgtcgggaaaatc

SEQ ID NO: 712974 - DNA, 25 bp, Artificial sequence
  Synthetic oligonucleotide
gaaggatatgttgcatcagccgtac

SEQ ID NO: 712975 - DNA, 25 bp, Artificial sequence
  Synthetic oligonucleotide
gaaggatatgttccatcagccgtac

SEQ ID NO: 712976 - DNA, 25 bp, Artificial sequence
  Synthetic oligonucleotide
atgcttgtgcctgagctgtcaaaag

SEQ ID NO: 712977 - DNA, 25 bp, Artificial sequence
  Synthetic oligonucleotide
gaagggcgcatatggaacggctctc

SEQ ID NO: 712978 - DNA, 25 bp, Artificial sequence
  Synthetic oligonucleotide
aaagaacagctcccgcttcatttcc

SEQ ID NO: 712979 - DNA, 25 bp, Artificial sequence
  Synthetic oligonucleotide
aaagaacagctcgcgcttcatttcc

SEQ ID NO: 712980 - DNA, 25 bp, Artificial sequence
  Synthetic oligonucleotide
gacgagacccaaatgatccgcgtcc

SEQ ID NO: 712981 - DNA, 25 bp, Artificial sequence
  Synthetic oligonucleotide
gaaggagtttccttatgccgatgcc

SEQ ID NO: 712982 - DNA, 25 bp, Artificial sequence
  Synthetic oligonucleotide
atgcttgtgcctcagctgtcaaaag

SEQ ID NO: 712983 - DNA, 25 bp, Artificial sequence
  Synthetic oligonucleotide
tcctcattgctgggatcatgtccaa

SEQ ID NO: 712984 - DNA, 25 bp, Artificial sequence
  Synthetic oligonucleotide
gtgatcggcctggatgaggatgacg

SEQ ID NO: 712985 - DNA, 25 bp, Artificial sequence
  Synthetic oligonucleotide
gtgatcggcctgcatgaggatgacg

SEQ ID NO: 712986 - DNA, 25 bp, Artificial sequence
  Synthetic oligonucleotide
gacgagacccaattgatccgcgtcc

SEQ ID NO: 712987 - DNA, 25 bp, Artificial sequence
  Synthetic oligonucleotide
gaaatgcattgtcatcatcccgaac

SEQ ID NO: 712988 - DNA, 25 bp, Artificial sequence
  Synthetic oligonucleotide
aactcgctcaagctgtcatgtacgg

SEQ ID NO: 712989 - DNA, 25 bp, Artificial sequence
  Synthetic oligonucleotide
aactcgctcaaggtgtcatgtacgg

SEQ ID NO: 712990 - DNA, 25 bp, Artificial sequence
  Synthetic oligonucleotide
gacggaaactttcacgatgcgctta

SEQ ID NO: 712991 - DNA, 25 bp, Artificial sequence
  Synthetic oligonucleotide
gacggaaactttgacgatgcgctta

SEQ ID NO: 712992 - DNA, 25 bp, Artificial sequence
  Synthetic oligonucleotide
gatgcgcttaaatttgtccgttcca

SEQ ID NO: 712993 - DNA, 25 bp, Artificial sequence
  Synthetic oligonucleotide
gcatatgcagccggtgctaacatga

SEQ ID NO: 712994 - DNA, 25 bp, Artificial sequence
  Synthetic oligonucleotide
gtaacagatcaaacaccggcgctaa

SEQ ID NO: 712995 - DNA, 25 bp, Artificial sequence
  Synthetic oligonucleotide
gcatatgcagcccgtgctaacatga

SEQ ID NO: 712996 - DNA, 25 bp, Artificial sequence
  Synthetic oligonucleotide
gtcaacaggtaacacttccgctgct

SEQ ID NO: 712997 - DNA, 25 bp, Artificial sequence
  Synthetic oligonucleotide
gaaatgcattgtgatcatcccgaac

SEQ ID NO: 712998 - DNA, 25 bp, Artificial sequence
  Synthetic oligonucleotide
gtaacagatcaatcaccggcgctaa

SEQ ID NO: 712999 - DNA, 25 bp, Artificial sequence
  Synthetic oligonucleotide
caggccttccgaaaatgcgcggctt

SEQ ID NO: 713000 - DNA, 25 bp, Artificial sequence
  Synthetic oligonucleotide
caggccttccgataatgcgcggctt

SEQ ID NO: 713001 - DNA, 25 bp, Artificial sequence
  Synthetic oligonucleotide
agcgcctgatgttttagcgatcccg

SEQ ID NO: 713002 - DNA, 25 bp, Artificial sequence
  Synthetic oligonucleotide
agcgcctgatgtattagcgatcccg

SEQ ID NO: 713003 - DNA, 25 bp, Artificial sequence
  Synthetic oligonucleotide
aaactgctgcctacgaagtgtgcga

SEQ ID NO: 713004 - DNA, 25 bp, Artificial sequence
  Synthetic oligonucleotide
gatgcgcttaaaattgtccgttcca

SEQ ID NO: 713005 - DNA, 25 bp, Artificial sequence
  Synthetic oligonucleotide
aaactgctgccttcgaagtgtgcga

SEQ ID NO: 713006 - DNA, 25 bp, Artificial sequence
  Synthetic oligonucleotide
gtcaacccttaccgcattgaaggcc

SEQ ID NO: 713007 - DNA, 25 bp, Artificial sequence
  Synthetic oligonucleotide
gtcaacccttacggcattgaaggcc

SEQ ID NO: 713008 - DNA, 25 bp, Artificial sequence
  Synthetic oligonucleotide
gtcaacaggtaagacttccgctgct

SEQ ID NO: 713009 - DNA, 25 bp, Artificial sequence
  Synthetic oligonucleotide
agatccgaacacagcggtcgacatt

SEQ ID NO: 713010 - DNA, 25 bp, Artificial sequence
  Synthetic oligonucleotide
tatcagctgatcccccgtgtagaag

SEQ ID NO: 713011 - DNA, 25 bp, Artificial sequence
  Synthetic oligonucleotide
gttcttgcgcgtgtatcgcaggagt

SEQ ID NO: 713012 - DNA, 25 bp, Artificial sequence
  Synthetic oligonucleotide
tgaaatccttcacgcatatcagctg

SEQ ID NO: 713013 - DNA, 25 bp, Artificial sequence
  Synthetic oligonucleotide
tgaaatccttcaggcatatcagctg

SEQ ID NO: 713014 - DNA, 25 bp, Artificial sequence
  Synthetic oligonucleotide
gttcttgcgcgtctatcgcaggagt

SEQ ID NO: 713015 - DNA, 25 bp, Artificial sequence
  Synthetic oligonucleotide
tcagtcggaatgccgctcagcagat

SEQ ID NO: 713016 - DNA, 25 bp, Artificial sequence
  Synthetic oligonucleotide
tatcagctgatcgcccgtgtagaag

SEQ ID NO: 713017 - DNA, 25 bp, Artificial sequence
  Synthetic oligonucleotide
agatccgaacactgcggtcgacatt

SEQ ID NO: 713018 - DNA, 25 bp, Artificial sequence
  Synthetic oligonucleotide
tctgtcactgttgccggaagcacag

SEQ ID NO: 713019 - DNA, 25 bp, Artificial sequence
  Synthetic oligonucleotide
tctgtcactgttcccggaagcacag

SEQ ID NO: 713020 - DNA, 25 bp, Artificial sequence
  Synthetic oligonucleotide
gccccggctttgattcagtcggaat

SEQ ID NO: 713021 - DNA, 25 bp, Artificial sequence
  Synthetic oligonucleotide
tcagtcggaatggcgctcagcagat

SEQ ID NO: 713022 - DNA, 25 bp, Artificial sequence
  Synthetic oligonucleotide
gataacctgatcaaccaagtggcta

SEQ ID NO: 713023 - DNA, 25 bp, Artificial sequence
  Synthetic oligonucleotide
gataacctgatctaccaagtggcta

SEQ ID NO: 713024 - DNA, 25 bp, Artificial sequence
  Synthetic oligonucleotide
aaatgcctcctgaccatgtgaaggt

SEQ ID NO: 713025 - DNA, 25 bp, Artificial sequence
  Synthetic oligonucleotide
aaatgcctcctgtccatgtgaaggt

SEQ ID NO: 713026 - DNA, 25 bp, Artificial sequence
  Synthetic oligonucleotide
gaacgaagccgacatgctgttctct

SEQ ID NO: 713027 - DNA, 25 bp, Artificial sequence
  Synthetic oligonucleotide
gaacgaagccgagatgctgttctct

SEQ ID NO: 713028 - DNA, 25 bp, Artificial sequence
  Synthetic oligonucleotide
aaatcaagcctgacacattgccgac

SEQ ID NO: 713029 - DNA, 25 bp, Artificial sequence
  Synthetic oligonucleotide
aaatcaagcctgtcacattgccgac

SEQ ID NO: 713030 - DNA, 25 bp, Artificial sequence
  Synthetic oligonucleotide
gccccggctttgtttcagtcggaat

SEQ ID NO: 713031 - DNA, 25 bp, Artificial sequence
  Synthetic oligonucleotide
tatggcaggcgctaactcgattttc

SEQ ID NO: 713032 - DNA, 25 bp, Artificial sequence
  Synthetic oligonucleotide
gaacagactcaggcgatgtgcttta

SEQ ID NO: 713033 - DNA, 25 bp, Artificial sequence
  Synthetic oligonucleotide
tgccaacctcttacgtgcgcctttc

SEQ ID NO: 713034 - DNA, 25 bp, Artificial sequence
  Synthetic oligonucleotide
tgccaacctctttcgtgcgcctttc

SEQ ID NO: 713035 - DNA, 25 bp, Artificial sequence
  Synthetic oligonucleotide
caacctcttacgtgcgcctttctgc

SEQ ID NO: 713036 - DNA, 25 bp, Artificial sequence
  Synthetic oligonucleotide
caacctcttacgagcgcctttctgc

SEQ ID NO: 713037 - DNA, 25 bp, Artificial sequence
  Synthetic oligonucleotide
gcaaactggggctaaatccgcagca

SEQ ID NO: 713038 - DNA, 25 bp, Artificial sequence
  Synthetic oligonucleotide
acaacagcaacgtcttgaacaggcg

SEQ ID NO: 713039 - DNA, 25 bp, Artificial sequence
  Synthetic oligonucleotide
acaacagcaacgacttgaacaggcg

SEQ ID NO: 713040 - DNA, 25 bp, Artificial sequence
  Synthetic oligonucleotide
gggataacgaacaacagcaacgtct

SEQ ID NO: 713041 - DNA, 25 bp, Artificial sequence
  Synthetic oligonucleotide
gggataacgaactacagcaacgtct

SEQ ID NO: 713042 - DNA, 25 bp, Artificial sequence
  Synthetic oligonucleotide
actggggctaaaaccgcagcaaact

SEQ ID NO: 713043 - DNA, 25 bp, Artificial sequence
  Synthetic oligonucleotide
agactcaggcgatgtgctttatggc

SEQ ID NO: 713044 - DNA, 25 bp, Artificial sequence
  Synthetic oligonucleotide
gcaaactggggcaaaatccgcagca

SEQ ID NO: 713045 - DNA, 25 bp, Artificial sequence
  Synthetic oligonucleotide
gaacagactcagccgatgtgcttta

SEQ ID NO: 713046 - DNA, 25 bp, Artificial sequence
  Synthetic oligonucleotide
tttctacggttggaaactgctgacc

SEQ ID NO: 713047 - DNA, 25 bp, Artificial sequence
  Synthetic oligonucleotide
tttctacggttgcaaactgctgacc

SEQ ID NO: 713048 - DNA, 25 bp, Artificial sequence
  Synthetic oligonucleotide
gcaaactcgattatctacggttgca

SEQ ID NO: 713049 - DNA, 25 bp, Artificial sequence
  Synthetic oligonucleotide
gcaaactcgattttctacggttgca

SEQ ID NO: 713050 - DNA, 25 bp, Artificial sequence
  Synthetic oligonucleotide
tatggcaggcgcaaactcgattttc

SEQ ID NO: 713051 - DNA, 25 bp, Artificial sequence
  Synthetic oligonucleotide
agactcaggcgaagtgctttatggc

SEQ ID NO: 713052 - DNA, 25 bp, Artificial sequence
  Synthetic oligonucleotide
actggggctaaatccgcagcaaact

SEQ ID NO: 713053 - DNA, 25 bp, Artificial sequence
  Synthetic oligonucleotide
cgcgctacaaaaccgggctggaagc

SEQ ID NO: 713054 - DNA, 25 bp, Artificial sequence
  Synthetic oligonucleotide
cggcaggatcgacgcgcttctgtat

SEQ ID NO: 713055 - DNA, 25 bp, Artificial sequence
  Synthetic oligonucleotide
cggcaggatcgaggcgcttctgtat

SEQ ID NO: 713056 - DNA, 25 bp, Artificial sequence
  Synthetic oligonucleotide
gagcggttgatggaagttgaacagg

SEQ ID NO: 713057 - DNA, 25 bp, Artificial sequence
  Synthetic oligonucleotide
gagcggttgatgcaagttgaacagg

SEQ ID NO: 713058 - DNA, 25 bp, Artificial sequence
  Synthetic oligonucleotide
aagccgagcggtagatggaagttga

SEQ ID NO: 713059 - DNA, 25 bp, Artificial sequence
  Synthetic oligonucleotide
cgcgctacaaaagcgggctggaagc

SEQ ID NO: 713060 - DNA, 25 bp, Artificial sequence
  Synthetic oligonucleotide
tcgcgctacaaatccgggctggaag

SEQ ID NO: 713061 - DNA, 25 bp, Artificial sequence
  Synthetic oligonucleotide
tcgcgctacaaaaccgggctggaag

SEQ ID NO: 713062 - DNA, 25 bp, Artificial sequence
  Synthetic oligonucleotide
tcgatcctcgtctggtgcaggtcag

SEQ ID NO: 713063 - DNA, 25 bp, Artificial sequence
  Synthetic oligonucleotide
tcgatcctcgtcaggtgcaggtcag

SEQ ID NO: 713064 - DNA, 25 bp, Artificial sequence
  Synthetic oligonucleotide
gctggatctgctgtttgaagcgcag

SEQ ID NO: 713065 - DNA, 25 bp, Artificial sequence
  Synthetic oligonucleotide
aagccgagcggttgatggaagttga

SEQ ID NO: 713066 - DNA, 25 bp, Artificial sequence
  Synthetic oligonucleotide
gctggatctgctctttgaagcgcag

SEQ ID NO: 713067 - DNA, 25 bp, Artificial sequence
  Synthetic oligonucleotide
ttcgatcctcgtgaggtgcaggtca

SEQ ID NO: 713068 - DNA, 25 bp, Artificial sequence
  Synthetic oligonucleotide
ctggatctgctgtttgaagcgcagc

SEQ ID NO: 713069 - DNA, 25 bp, Artificial sequence
  Synthetic oligonucleotide
ctggatctgctgattgaagcgcagc

SEQ ID NO: 713070 - DNA, 25 bp, Artificial sequence
  Synthetic oligonucleotide
catttcgatcctcgtcaggtgcagg

SEQ ID NO: 713071 - DNA, 25 bp, Artificial sequence
  Synthetic oligonucleotide
catttcgatcctggtcaggtgcagg

SEQ ID NO: 713072 - DNA, 25 bp, Artificial sequence
  Synthetic oligonucleotide
tttcgatcctcgtcaggtgcaggtc

SEQ ID NO: 713073 - DNA, 25 bp, Artificial sequence
  Synthetic oligonucleotide
tttcgatcctcgacaggtgcaggtc

SEQ ID NO: 713074 - DNA, 25 bp, Artificial sequence
  Synthetic oligonucleotide
ttcgatcctcgtcaggtgcaggtca

SEQ ID NO: 713075 - DNA, 25 bp, Artificial sequence
  Synthetic oligonucleotide
gcattgtgggctaaggcgaaacggt

SEQ ID NO: 713076 - DNA, 25 bp, Artificial sequence
  Synthetic oligonucleotide
tgtatgacgctgcgcacgttgagtg

SEQ ID NO: 713077 - DNA, 25 bp, Artificial sequence
  Synthetic oligonucleotide
cggaaagcgtgccaatcaacatgct

SEQ ID NO: 713078 - DNA, 25 bp, Artificial sequence
  Synthetic oligonucleotide
ccggattattgctgcaactggcaaa

SEQ ID NO: 713079 - DNA, 25 bp, Artificial sequence
  Synthetic oligonucleotide
ccggattattgcagcaactggcaaa

SEQ ID NO: 713080 - DNA, 25 bp, Artificial sequence
  Synthetic oligonucleotide
agatcgcgccggtttattgctgcaa

SEQ ID NO: 713081 - DNA, 25 bp, Artificial sequence
  Synthetic oligonucleotide
agatcgcgccggattattgctgcaa

SEQ ID NO: 713082 - DNA, 25 bp, Artificial sequence
  Synthetic oligonucleotide
aaaagatcgcgccggattattgctg

SEQ ID NO: 713083 - DNA, 25 bp, Artificial sequence
  Synthetic oligonucleotide
aaaagatcgcgcgggattattgctg

SEQ ID NO: 713084 - DNA, 25 bp, Artificial sequence
  Synthetic oligonucleotide
gcattgtgggcttaggcgaaacggt

SEQ ID NO: 713085 - DNA, 25 bp, Artificial sequence
  Synthetic oligonucleotide
cggaaagcgtgcgaatcaacatgct

SEQ ID NO: 713086 - DNA, 25 bp, Artificial sequence
  Synthetic oligonucleotide
gctgggcacgttcagtgaatctcag

SEQ ID NO: 713087 - DNA, 25 bp, Artificial sequence
  Synthetic oligonucleotide
ccgggatcaaagtctgttctggcgg

SEQ ID NO: 713088 - DNA, 25 bp, Artificial sequence
  Synthetic oligonucleotide
ccgggatcaaagactgttctggcgg

SEQ ID NO: 713089 - DNA, 25 bp, Artificial sequence
  Synthetic oligonucleotide
tgccgggatcaatgtctgttctggc

SEQ ID NO: 713090 - DNA, 25 bp, Artificial sequence
  Synthetic oligonucleotide
tgccgggatcaaagtctgttctggc

SEQ ID NO: 713091 - DNA, 25 bp, Artificial sequence
  Synthetic oligonucleotide
cacgcacttatctggaacgcctcga

SEQ ID NO: 713092 - DNA, 25 bp, Artificial sequence
  Synthetic oligonucleotide
cacgcacttatcaggaacgcctcga

SEQ ID NO: 713093 - DNA, 25 bp, Artificial sequence
  Synthetic oligonucleotide
cgggatcaaagtctgttctggcggc

SEQ ID NO: 713094 - DNA, 25 bp, Artificial sequence
  Synthetic oligonucleotide
gctgggcacgttgagtgaatctcag

SEQ ID NO: 713095 - DNA, 25 bp, Artificial sequence
  Synthetic oligonucleotide
tgtatgacgctgggcacgttgagtg

SEQ ID NO: 713096 - DNA, 25 bp, Artificial sequence
  Synthetic oligonucleotide
cgggatcaaagtgtgttctggcggc

SEQ ID NO: 713097 - DNA, 25 bp, Artificial sequence
  Synthetic oligonucleotide
gtggacgagcgtgcgcatgctaatc

SEQ ID NO: 713098 - DNA, 25 bp, Artificial sequence
  Synthetic oligonucleotide
gtggacgagcgtccgcatgctaatc

SEQ ID NO: 713099 - DNA, 25 bp, Artificial sequence
  Synthetic oligonucleotide
cgctggtgcaggcatcgttacccga

SEQ ID NO: 713100 - DNA, 25 bp, Artificial sequence
  Synthetic oligonucleotide
cgctggtgcagggatcgttacccga

SEQ ID NO: 713101 - DNA, 25 bp, Artificial sequence
  Synthetic oligonucleotide
accgccagatgaaatcgaacagtcg

SEQ ID NO: 713102 - DNA, 25 bp, Artificial sequence
  Synthetic oligonucleotide
cacgctgtggtttgatgatgcgctc

SEQ ID NO: 713103 - DNA, 25 bp, Artificial sequence
  Synthetic oligonucleotide
cggtgccacgcaacttcatgaaggg

SEQ ID NO: 713104 - DNA, 25 bp, Artificial sequence
  Synthetic oligonucleotide
tcatattcagcccatcacgctgtgg

SEQ ID NO: 713105 - DNA, 25 bp, Artificial sequence
  Synthetic oligonucleotide
accgccagatgatatcgaacagtcg

SEQ ID NO: 713106 - DNA, 25 bp, Artificial sequence
  Synthetic oligonucleotide
cacgctgtggttagatgatgcgctc

SEQ ID NO: 713107 - DNA, 25 bp, Artificial sequence
  Synthetic oligonucleotide
agtgccatgcgttcgctgaaaggca

SEQ ID NO: 713108 - DNA, 25 bp, Artificial sequence
  Synthetic oligonucleotide
cggtgccacgcatcttcatgaaggg

SEQ ID NO: 713109 - DNA, 25 bp, Artificial sequence
  Synthetic oligonucleotide
tattaacgcgttcgcagttgcagcg

SEQ ID NO: 713110 - DNA, 25 bp, Artificial sequence
  Synthetic oligonucleotide
tattaacgcgttggcagttgcagcg

SEQ ID NO: 713111 - DNA, 25 bp, Artificial sequence
  Synthetic oligonucleotide
cagcgattgcaagtggcctggccgc

SEQ ID NO: 713112 - DNA, 25 bp, Artificial sequence
  Synthetic oligonucleotide
cagcgattgcaactggcctggccgc

SEQ ID NO: 713113 - DNA, 25 bp, Artificial sequence
  Synthetic oligonucleotide
tcatattcagccgatcacgctgtgg

SEQ ID NO: 713114 - DNA, 25 bp, Artificial sequence
  Synthetic oligonucleotide
atcaacatcataatcagcccatcac

SEQ ID NO: 713115 - DNA, 25 bp, Artificial sequence
  Synthetic oligonucleotide
atcaacatcatattcagcccatcac

SEQ ID NO: 713116 - DNA, 25 bp, Artificial sequence
  Synthetic oligonucleotide
gaacggcgtgcaatatcaacatcat

SEQ ID NO: 713117 - DNA, 25 bp, Artificial sequence
  Synthetic oligonucleotide
gaacggcgtgcattatcaacatcat

SEQ ID NO: 713118 - DNA, 25 bp, Artificial sequence
  Synthetic oligonucleotide
agtgccatgcgtacgctgaaaggca

SEQ ID NO: 713119 - DNA, 25 bp, Artificial sequence
  Synthetic oligonucleotide
ccagaaggatgcggcagaccattat

SEQ ID NO: 713120 - DNA, 25 bp, Artificial sequence
  Synthetic oligonucleotide
acgcgggttgtgcacctggctggat

SEQ ID NO: 713121 - DNA, 25 bp, Artificial sequence
  Synthetic oligonucleotide
atgcagatctactgcgccagagtgc

SEQ ID NO: 713122 - DNA, 25 bp, Artificial sequence
  Synthetic oligonucleotide
atgcagatctacagcgccagagtgc

SEQ ID NO: 713123 - DNA, 25 bp, Artificial sequence
  Synthetic oligonucleotide
gtaaatacaccctcgtactggacgc

SEQ ID NO: 713124 - DNA, 25 bp, Artificial sequence
  Synthetic oligonucleotide
gtaaatacacccacgtactggacgc

SEQ ID NO: 713125 - DNA, 25 bp, Artificial sequence
  Synthetic oligonucleotide
ctgccgttagcgactgcgacgttcg

SEQ ID NO: 713126 - DNA, 25 bp, Artificial sequence
  Synthetic oligonucleotide
cacggcactccgggagctgtatcgg

SEQ ID NO: 713127 - DNA, 25 bp, Artificial sequence
  Synthetic oligonucleotide
cacggcactccgcgagctgtatcgg

SEQ ID NO: 713128 - DNA, 25 bp, Artificial sequence
  Synthetic oligonucleotide
atggagcaatctcgcagtgcagtgg

SEQ ID NO: 713129 - DNA, 25 bp, Artificial sequence
  Synthetic oligonucleotide
atggagcaatctggcagtgcagtgg

SEQ ID NO: 713130 - DNA, 25 bp, Artificial sequence
  Synthetic oligonucleotide
gcatggagcaatctcgcagtgcagt

SEQ ID NO: 713131 - DNA, 25 bp, Artificial sequence
  Synthetic oligonucleotide
gcatggagcaatgtcgcagtgcagt

SEQ ID NO: 713132 - DNA, 25 bp, Artificial sequence
  Synthetic oligonucleotide
cgccgccaatgcttgttcaggcacg

SEQ ID NO: 713133 - DNA, 25 bp, Artificial sequence
  Synthetic oligonucleotide
acgttcgatcttccatggagcaatc

SEQ ID NO: 713134 - DNA, 25 bp, Artificial sequence
  Synthetic oligonucleotide
acgcgggttgtggacctggctggat

SEQ ID NO: 713135 - DNA, 25 bp, Artificial sequence
  Synthetic oligonucleotide
ctgccgttagcgtctgcgacgttcg

SEQ ID NO: 713136 - DNA, 25 bp, Artificial sequence
  Synthetic oligonucleotide
aggatgccgcagaccattatctggc

SEQ ID NO: 713137 - DNA, 25 bp, Artificial sequence
  Synthetic oligonucleotide
aggatgccgcagtccattatctggc

SEQ ID NO: 713138 - DNA, 25 bp, Artificial sequence
  Synthetic oligonucleotide
ccagaaggatgccgcagaccattat

SEQ ID NO: 713139 - DNA, 25 bp, Artificial sequence
  Synthetic oligonucleotide
cgccgccaatgcatgttcaggcacg

SEQ ID NO: 713140 - DNA, 25 bp, Artificial sequence
  Synthetic oligonucleotide
acgttcgatcttgcatggagcaatc

SEQ ID NO: 713141 - DNA, 25 bp, Artificial sequence
  Synthetic oligonucleotide
acttttgcagattgggtaacacagg

SEQ ID NO: 713142 - DNA, 25 bp, Artificial sequence
  Synthetic oligonucleotide
gccggtgatactcgtagttggtgtg

SEQ ID NO: 713143 - DNA, 25 bp, Artificial sequence
  Synthetic oligonucleotide
tgctgggagagatcccctggcttgc

SEQ ID NO: 713144 - DNA, 25 bp, Artificial sequence
  Synthetic oligonucleotide
tcacgctgaatatatgaccacgctc

SEQ ID NO: 713145 - DNA, 25 bp, Artificial sequence
  Synthetic oligonucleotide
tcacgctgaataaatgaccacgctc

SEQ ID NO: 713146 - DNA, 25 bp, Artificial sequence
  Synthetic oligonucleotide
gtcacgctgaatttatgaccacgct

SEQ ID NO: 713147 - DNA, 25 bp, Artificial sequence
  Synthetic oligonucleotide
gtcacgctgaatatatgaccacgct

SEQ ID NO: 713148 - DNA, 25 bp, Artificial sequence
  Synthetic oligonucleotide
acaacacgccggactgactctggcg

SEQ ID NO: 713149 - DNA, 25 bp, Artificial sequence
  Synthetic oligonucleotide
acaacacgccggtctgactctggcg

SEQ ID NO: 713150 - DNA, 25 bp, Artificial sequence
  Synthetic oligonucleotide
tgctgggagagaacccctggcttgc

SEQ ID NO: 713151 - DNA, 25 bp, Artificial sequence
  Synthetic oligonucleotide
aactcggctgtattaatcacgcgat

SEQ ID NO: 713152 - DNA, 25 bp, Artificial sequence
  Synthetic oligonucleotide
cacaggtaatactacacgccggact

SEQ ID NO: 713153 - DNA, 25 bp, Artificial sequence
  Synthetic oligonucleotide
gccggtgatactggtagttggtgtg

SEQ ID NO: 713154 - DNA, 25 bp, Artificial sequence
  Synthetic oligonucleotide
aacaactgccggagatactggtagt

SEQ ID NO: 713155 - DNA, 25 bp, Artificial sequence
  Synthetic oligonucleotide
acttttgcagatagggtaacacagg

SEQ ID NO: 713156 - DNA, 25 bp, Artificial sequence
  Synthetic oligonucleotide
tgacactttcacttttgcagattgg

SEQ ID NO: 713157 - DNA, 25 bp, Artificial sequence
  Synthetic oligonucleotide
tgacactttcacatttgcagattgg

SEQ ID NO: 713158 - DNA, 25 bp, Artificial sequence
  Synthetic oligonucleotide
ttctgacactttgacttttgcagat

SEQ ID NO: 713159 - DNA, 25 bp, Artificial sequence
  Synthetic oligonucleotide
ttctgacactttcacttttgcagat

SEQ ID NO: 713160 - DNA, 25 bp, Artificial sequence
  Synthetic oligonucleotide
aacaactgccggtgatactggtagt

SEQ ID NO: 713161 - DNA, 25 bp, Artificial sequence
  Synthetic oligonucleotide
cacaggtaatacaacacgccggact

SEQ ID NO: 713162 - DNA, 25 bp, Artificial sequence
  Synthetic oligonucleotide
aactcggctgtaataatcacgcgat

SEQ ID NO: 713163 - DNA, 25 bp, Artificial sequence
  Synthetic oligonucleotide
cctgcagctggattacgcaacagta

SEQ ID NO: 713164 - DNA, 25 bp, Artificial sequence
  Synthetic oligonucleotide
gaatcattggtaatgagcgccggat

SEQ ID NO: 713165 - DNA, 25 bp, Artificial sequence
  Synthetic oligonucleotide
gaatcattggtattgagcgccggat

SEQ ID NO: 713166 - DNA, 25 bp, Artificial sequence
  Synthetic oligonucleotide
gggcagaccgattgaatcattggta

SEQ ID NO: 713167 - DNA, 25 bp, Artificial sequence
  Synthetic oligonucleotide
gggcagaccgatagaatcattggta

SEQ ID NO: 713168 - DNA, 25 bp, Artificial sequence
  Synthetic oligonucleotide
cttacaccttcggagaacccacttc

SEQ ID NO: 713169 - DNA, 25 bp, Artificial sequence
  Synthetic oligonucleotide
cttacaccttcgcagaacccacttc

SEQ ID NO: 713170 - DNA, 25 bp, Artificial sequence
  Synthetic oligonucleotide
gtaaatccttacaccttcgcagaac

SEQ ID NO: 713171 - DNA, 25 bp, Artificial sequence
  Synthetic oligonucleotide
gtaaatccttactccttcgcagaac

SEQ ID NO: 713172 - DNA, 25 bp, Artificial sequence
  Synthetic oligonucleotide
cgcaacagtaaatccttacaccttc

SEQ ID NO: 713173 - DNA, 25 bp, Artificial sequence
  Synthetic oligonucleotide
cgcaacagtaaaaccttacaccttc

SEQ ID NO: 713174 - DNA, 25 bp, Artificial sequence
  Synthetic oligonucleotide
acgcaacagtaaatccttacacctt

SEQ ID NO: 713175 - DNA, 25 bp, Artificial sequence
  Synthetic oligonucleotide
cctgcagctggaatacgcaacagta

SEQ ID NO: 713176 - DNA, 25 bp, Artificial sequence
  Synthetic oligonucleotide
agcctgcagctggattacgcaacag

SEQ ID NO: 713177 - DNA, 25 bp, Artificial sequence
  Synthetic oligonucleotide
ctggcagcgaaatgaccccggaagg

SEQ ID NO: 713178 - DNA, 25 bp, Artificial sequence
  Synthetic oligonucleotide
ctggcagcgaaaagaccccggaagg

SEQ ID NO: 713179 - DNA, 25 bp, Artificial sequence
  Synthetic oligonucleotide
cctctggcagcgtaaagaccccgga

SEQ ID NO: 713180 - DNA, 25 bp, Artificial sequence
  Synthetic oligonucleotide
cctctggcagcgaaaagaccccgga

SEQ ID NO: 713181 - DNA, 25 bp, Artificial sequence
  Synthetic oligonucleotide
gcagcaggctaccggacggcaggtt

SEQ ID NO: 713182 - DNA, 25 bp, Artificial sequence
  Synthetic oligonucleotide
gcagcaggctacgggacggcaggtt

SEQ ID NO: 713183 - DNA, 25 bp, Artificial sequence
  Synthetic oligonucleotide
agcctgcagctgcattacgcaacag

SEQ ID NO: 713184 - DNA, 25 bp, Artificial sequence
  Synthetic oligonucleotide
acgcaacagtaattccttacacctt

SEQ ID NO: 713185 - DNA, 25 bp, Artificial sequence
  Synthetic oligonucleotide
cttccgccttaatacttcatttttg

SEQ ID NO: 713186 - DNA, 25 bp, Artificial sequence
  Synthetic oligonucleotide
tccaccccggggaaggtgacagcat

SEQ ID NO: 713187 - DNA, 25 bp, Artificial sequence
  Synthetic oligonucleotide
gccgccctaggcaccagggtgtgat

SEQ ID NO: 713188 - DNA, 25 bp, Artificial sequence
  Synthetic oligonucleotide
gcgacgatgctccccgggctgtatt

SEQ ID NO: 713189 - DNA, 25 bp, Artificial sequence
  Synthetic oligonucleotide
cgtgacatcaaagagaagctgtgct

SEQ ID NO: 713190 - DNA, 25 bp, Artificial sequence
  Synthetic oligonucleotide
agttcgccatggatgacgatatcgc

SEQ ID NO: 713191 - DNA, 25 bp, Artificial sequence
  Synthetic oligonucleotide
gtcgagtcgcgtccacccgcgagca

SEQ ID NO: 713192 - DNA, 25 bp, Artificial sequence
  Synthetic oligonucleotide
tacactgacttgagaccaataaaag

SEQ ID NO: 713193 - DNA, 25 bp, Artificial sequence
  Synthetic oligonucleotide
gggttgaggtgttgaggcagccagg

SEQ ID NO: 713194 - DNA, 25 bp, Artificial sequence
  Synthetic oligonucleotide
tgaatggcccaggtctgaggcctcc

SEQ ID NO: 713195 - DNA, 25 bp, Artificial sequence
  Synthetic oligonucleotide
tgtgtaaattatgtactgcaaaaat

SEQ ID NO: 713196 - DNA, 25 bp, Artificial sequence
  Synthetic oligonucleotide
cagaaggactcctatgtgggtgacg

SEQ ID NO: 713197 - DNA, 25 bp, Artificial sequence
  Synthetic oligonucleotide
gtcgacaacggctccggcatgtgca

SEQ ID NO: 713198 - DNA, 25 bp, Artificial sequence
  Synthetic oligonucleotide
ccccaacttgatgtatgaaggcttt

SEQ ID NO: 713199 - DNA, 25 bp, Artificial sequence
  Synthetic oligonucleotide
tgtacccaggcattgctgacaggat

SEQ ID NO: 713200 - DNA, 25 bp, Artificial sequence
  Synthetic oligonucleotide
tgttttgttttggcgcttttgactc

SEQ ID NO: 713201 - DNA, 25 bp, Artificial sequence
  Synthetic oligonucleotide
aaataagagacaacattggcatggc

SEQ ID NO: 713202 - DNA, 25 bp, Artificial sequence
  Synthetic oligonucleotide
ttctttgacaaaacctaacttgcgc

SEQ ID NO: 713203 - DNA, 25 bp, Artificial sequence
  Synthetic oligonucleotide
caagagaggtatcctgaccctgaag

SEQ ID NO: 713204 - DNA, 25 bp, Artificial sequence
  Synthetic oligonucleotide
tgagtccggcccctccatcgtgcac

SEQ ID NO: 713205 - DNA, 25 bp, Artificial sequence
  Synthetic oligonucleotide
ttgcagctccttcgttgccggtcca

SEQ ID NO: 713206 - DNA, 25 bp, Artificial sequence
  Synthetic oligonucleotide
tggatcggtggctccatcctggcct

SEQ ID NO: 713207 - DNA, 25 bp, Artificial sequence
  Synthetic oligonucleotide
aactggaacggtgaaggcgacagca

SEQ ID NO: 713208 - DNA, 25 bp, Artificial sequence
  Synthetic oligonucleotide
gagattactgctctggctcctagca

SEQ ID NO: 713209 - DNA, 25 bp, Artificial sequence
  Synthetic oligonucleotide
tctaggcggactgttactgagctgc

SEQ ID NO: 713210 - DNA, 25 bp, Artificial sequence
  Synthetic oligonucleotide
tctatgccaacacagtgctgtctgg

SEQ ID NO: 713211 - DNA, 25 bp, Artificial sequence
  Synthetic oligonucleotide
catcatgaagtgtgacgttgacatc

SEQ ID NO: 713212 - DNA, 25 bp, Artificial sequence
  Synthetic oligonucleotide
ggaatcctgtggcatccatgaaact

SEQ ID NO: 713213 - DNA, 25 bp, Artificial sequence
  Synthetic oligonucleotide
gatgccctgaggctcttttccagcc

SEQ ID NO: 713214 - DNA, 25 bp, Artificial sequence
  Synthetic oligonucleotide
caggtcatcactattggcaacgagc

SEQ ID NO: 713215 - DNA, 25 bp, Artificial sequence
  Synthetic oligonucleotide
tcctccctggagaagagctatgagc

SEQ ID NO: 713216 - DNA, 25 bp, Artificial sequence
  Synthetic oligonucleotide
gacttcgagcaggagatggccactg

SEQ ID NO: 713217 - DNA, 25 bp, Artificial sequence
  Synthetic oligonucleotide
aagatcattgctcctcctgagcgca

SEQ ID NO: 713218 - DNA, 25 bp, Artificial sequence
  Synthetic oligonucleotide
tgaggagcaccctgtgctgctcacc

SEQ ID NO: 713219 - DNA, 25 bp, Artificial sequence
  Synthetic oligonucleotide
catggcattgttaccaactgggacg

SEQ ID NO: 713220 - DNA, 25 bp, Artificial sequence
  Synthetic oligonucleotide
ttccagcagatgtggatcagcaagc

SEQ ID NO: 713221 - DNA, 25 bp, Artificial sequence
  Synthetic oligonucleotide
tggcaccacaccttctacaatgagc

SEQ ID NO: 713222 - DNA, 25 bp, Artificial sequence
  Synthetic oligonucleotide
tggagcaaacatcccccaaagttct

SEQ ID NO: 713223 - DNA, 25 bp, Artificial sequence
  Synthetic oligonucleotide
ccctaaggccaaccgtgaaaagatg

SEQ ID NO: 713224 - DNA, 25 bp, Artificial sequence
  Synthetic oligonucleotide
tgtttgagaccttcaacaccccagc

SEQ ID NO: 713225 - DNA, 25 bp, Artificial sequence
  Synthetic oligonucleotide
ccatccaggctgtgctgtccctgta

SEQ ID NO: 713226 - DNA, 25 bp, Artificial sequence
  Synthetic oligonucleotide
cacaggcattgtgatggactccgga

SEQ ID NO: 713227 - DNA, 25 bp, Artificial sequence
  Synthetic oligonucleotide
gccatcctgcgtctggacctggctg

SEQ ID NO: 713228 - DNA, 25 bp, Artificial sequence
  Synthetic oligonucleotide
gactacctcatgaagatcctgaccg

SEQ ID NO: 713229 - DNA, 25 bp, Artificial sequence
  Synthetic oligonucleotide
gcttcaccaccacagctgagaggga

SEQ ID NO: 713230 - DNA, 25 bp, Artificial sequence
  Synthetic oligonucleotide
gctgaggactttgtacattgttttg

SEQ ID NO: 713231 - DNA, 25 bp, Artificial sequence
  Synthetic oligonucleotide
ccccactcctaagaggaggatggtc

SEQ ID NO: 713232 - DNA, 25 bp, Artificial sequence
  Synthetic oligonucleotide
taagtggttacaggaagtccctcac

SEQ ID NO: 713233 - DNA, 25 bp, Artificial sequence
  Synthetic oligonucleotide
ttgtctttttttaatagtcattcca

SEQ ID NO: 713234 - DNA, 25 bp, Artificial sequence
  Synthetic oligonucleotide
cacactgtgcccatctacgagggct

SEQ ID NO: 713235 - DNA, 25 bp, Artificial sequence
  Synthetic oligonucleotide
aataaataaatcttagaactgccca

SEQ ID NO: 713236 - DNA, 25 bp, Artificial sequence
  Synthetic oligonucleotide
ggagcacagacttaggttaccccaa

SEQ ID NO: 713237 - DNA, 25 bp, Artificial sequence
  Synthetic oligonucleotide
gtttagtctggagcaaaatatgatt

SEQ ID NO: 713238 - DNA, 25 bp, Artificial sequence
  Synthetic oligonucleotide
aaagcacacctttcatctcaagagg

SEQ ID NO: 713239 - DNA, 25 bp, Artificial sequence
  Synthetic oligonucleotide
actgagggaaatagtcactgggaga

SEQ ID NO: 713240 - DNA, 25 bp, Artificial sequence
  Synthetic oligonucleotide
tggtggggtattgtgtaacccctga

SEQ ID NO: 713241 - DNA, 25 bp, Artificial sequence
  Synthetic oligonucleotide
ccctgcaggctcatgtactggaata

SEQ ID NO: 713242 - DNA, 25 bp, Artificial sequence
  Synthetic oligonucleotide
tgaagcattattccccatagacaag

SEQ ID NO: 713243 - DNA, 25 bp, Artificial sequence
  Synthetic oligonucleotide
ggaaacagtttcatgatttctatgg

SEQ ID NO: 713244 - DNA, 25 bp, Artificial sequence
  Synthetic oligonucleotide
caatttcacttctggacatagatcc

SEQ ID NO: 713245 - DNA, 25 bp, Artificial sequence
  Synthetic oligonucleotide
cccagtgtaccatgtggtactctag

SEQ ID NO: 713246 - DNA, 25 bp, Artificial sequence
  Synthetic oligonucleotide
aatcataaattaaggcaattttcct

SEQ ID NO: 713247 - DNA, 25 bp, Artificial sequence
  Synthetic oligonucleotide
gaagcaggacattaaagaaatctca

SEQ ID NO: 713248 - DNA, 25 bp, Artificial sequence
  Synthetic oligonucleotide
ggctctcacactctctcagctttag

SEQ ID NO: 713249 - DNA, 25 bp, Artificial sequence
  Synthetic oligonucleotide
gactatgagatgtataacagcaaac

SEQ ID NO: 713250 - DNA, 25 bp, Artificial sequence
  Synthetic oligonucleotide
caaacaatctcaagagctgctgcag

SEQ ID NO: 713251 - DNA, 25 bp, Artificial sequence
  Synthetic oligonucleotide
gaaaaatggaaggaagctgtcctgc

SEQ ID NO: 713252 - DNA, 25 bp, Artificial sequence
  Synthetic oligonucleotide
catagattcttcatgtaagctggaa

SEQ ID NO: 713253 - DNA, 25 bp, Artificial sequence
  Synthetic oligonucleotide
aatgtgaagctcattgtgaaaaacg

SEQ ID NO: 713254 - DNA, 25 bp, Artificial sequence
  Synthetic oligonucleotide
cctggctttccttctttcaatcata

SEQ ID NO: 713255 - DNA, 25 bp, Artificial sequence
  Synthetic oligonucleotide
cctcttcagaaaccagttggccctg

SEQ ID NO: 713256 - DNA, 25 bp, Artificial sequence
  Synthetic oligonucleotide
catgctcatctaggaactggtgatc

SEQ ID NO: 713257 - DNA, 25 bp, Artificial sequence
  Synthetic oligonucleotide
gagtatcacttcctgtcgccctatg

SEQ ID NO: 713258 - DNA, 25 bp, Artificial sequence
  Synthetic oligonucleotide
ttgtcatgagggaaatcaatgatcg

SEQ ID NO: 713259 - DNA, 25 bp, Artificial sequence
  Synthetic oligonucleotide
caactgattttcataatgctgagaa

SEQ ID NO: 713260 - DNA, 25 bp, Artificial sequence
  Synthetic oligonucleotide
tcgtggagactacttccgtgctact

SEQ ID NO: 713261 - DNA, 25 bp, Artificial sequence
  Synthetic oligonucleotide
gatatgggtctaagtctacagtggc

SEQ ID NO: 713262 - DNA, 25 bp, Artificial sequence
  Synthetic oligonucleotide
tatgaaggatctgaaccagttcaaa

SEQ ID NO: 713263 - DNA, 25 bp, Artificial sequence
  Synthetic oligonucleotide
tattcagggagtcgcaaatgccctc

SEQ ID NO: 713264 - DNA, 25 bp, Artificial sequence
  Synthetic oligonucleotide
gatgaacactatgtgaagattcaag

SEQ ID NO: 713265 - DNA, 25 bp, Artificial sequence
  Synthetic oligonucleotide
gaagaatacttaacatctttggagt

SEQ ID NO: 713266 - DNA, 25 bp, Artificial sequence
  Synthetic oligonucleotide
gacatttggaatattgacaatgagt

SEQ ID NO: 713267 - DNA, 25 bp, Artificial sequence
  Synthetic oligonucleotide
gactttgaagaactaagttattctg

SEQ ID NO: 713268 - DNA, 25 bp, Artificial sequence
  Synthetic oligonucleotide
aaactggtccatgctaattttggca

SEQ ID NO: 713269 - DNA, 25 bp, Artificial sequence
  Synthetic oligonucleotide
tatgtggcattcagtaaacctacag

SEQ ID NO: 713270 - DNA, 25 bp, Artificial sequence
  Synthetic oligonucleotide
ccatctcagtcatcagggttgccta

SEQ ID NO: 713271 - DNA, 25 bp, Artificial sequence
  Synthetic oligonucleotide
cagcattggtcaaaacatggtgacc

SEQ ID NO: 713272 - DNA, 25 bp, Artificial sequence
  Synthetic oligonucleotide
caagagagtctcctttccgacatat

SEQ ID NO: 713273 - DNA, 25 bp, Artificial sequence
  Synthetic oligonucleotide
tcagttccatgaatttaaattcagc

SEQ ID NO: 713274 - DNA, 25 bp, Artificial sequence
  Synthetic oligonucleotide
tctcaaaaagatgaaagtcttgcct

SEQ ID NO: 713275 - DNA, 25 bp, Artificial sequence
  Synthetic oligonucleotide
gatctttagtgattgttagagcagg

SEQ ID NO: 713276 - DNA, 25 bp, Artificial sequence
  Synthetic oligonucleotide
gcagaaaaggttgcaaatgcccaaa

SEQ ID NO: 713277 - DNA, 25 bp, Artificial sequence
  Synthetic oligonucleotide
aattggtgtcctcatatacatggac

SEQ ID NO: 713278 - DNA, 25 bp, Artificial sequence
  Synthetic oligonucleotide
ccccgttgttgaggcagaccttgca

SEQ ID NO: 713279 - DNA, 25 bp, Artificial sequence
  Synthetic oligonucleotide
aaatggtaacttagacccagtggag

SEQ ID NO: 713280 - DNA, 25 bp, Artificial sequence
  Synthetic oligonucleotide
ggagggatacctttcatctttgcat

SEQ ID NO: 713281 - DNA, 25 bp, Artificial sequence
  Synthetic oligonucleotide
ctggctgaaacggaggagacagaca

SEQ ID NO: 713282 - DNA, 25 bp, Artificial sequence
  Synthetic oligonucleotide
catggaaacagaggatgttcctaca

SEQ ID NO: 713283 - DNA, 25 bp, Artificial sequence
  Synthetic oligonucleotide
tattgggcagacctcaaaacactgt

SEQ ID NO: 713284 - DNA, 25 bp, Artificial sequence
  Synthetic oligonucleotide
aactccatagagtttgctgacacca

SEQ ID NO: 713285 - DNA, 25 bp, Artificial sequence
  Synthetic oligonucleotide
ttattaaacttacccatgacgttga

SEQ ID NO: 713286 - DNA, 25 bp, Artificial sequence
  Synthetic oligonucleotide
cacttatgggaaagataatgcaaga

SEQ ID NO: 713287 - DNA, 25 bp, Artificial sequence
  Synthetic oligonucleotide
tgtaagcgtgtagaacaaaaagagg

SEQ ID NO: 713288 - DNA, 25 bp, Artificial sequence
  Synthetic oligonucleotide
tatattaatttggataaagttgtcc

SEQ ID NO: 713289 - DNA, 25 bp, Artificial sequence
  Synthetic oligonucleotide
gccagaatacatacactcctcgtga

SEQ ID NO: 713290 - DNA, 25 bp, Artificial sequence
  Synthetic oligonucleotide
cgactttggagctgttggtgccact

SEQ ID NO: 713291 - DNA, 25 bp, Artificial sequence
  Synthetic oligonucleotide
gacccagcagaagtataatctttgc

SEQ ID NO: 713292 - DNA, 25 bp, Artificial sequence
  Synthetic oligonucleotide
ccaagtattctcagatatgatttca

SEQ ID NO: 713293 - DNA, 25 bp, Artificial sequence
  Synthetic oligonucleotide
tccagtgtgggaacaggtcttctgt

SEQ ID NO: 713294 - DNA, 25 bp, Artificial sequence
  Synthetic oligonucleotide
cagagagacgctttgggtgctggtg

SEQ ID NO: 713295 - DNA, 25 bp, Artificial sequence
  Synthetic oligonucleotide
tatgaggaaccagaccgttatgttg

SEQ ID NO: 713296 - DNA, 25 bp, Artificial sequence
  Synthetic oligonucleotide
gcttcgtcaaaaaaatattactgct

SEQ ID NO: 713297 - DNA, 25 bp, Artificial sequence
  Synthetic oligonucleotide
tatgaggcattgactcagaaagttc

SEQ ID NO: 713298 - DNA, 25 bp, Artificial sequence
  Synthetic oligonucleotide
taacttcaaagtttctgccagcccc

SEQ ID NO: 713299 - DNA, 25 bp, Artificial sequence
  Synthetic oligonucleotide
ccaaatggttcgtacagcagcggaa

SEQ ID NO: 713300 - DNA, 25 bp, Artificial sequence
  Synthetic oligonucleotide
tcttcttgattggattcatgagtgg

SEQ ID NO: 713301 - DNA, 25 bp, Artificial sequence
  Synthetic oligonucleotide
gcagactatccttatttgggcacta

SEQ ID NO: 713302 - DNA, 25 bp, Artificial sequence
  Synthetic oligonucleotide
tggaatcccagcagtttctttttgt

SEQ ID NO: 713303 - DNA, 25 bp, Artificial sequence
  Synthetic oligonucleotide
gacaatgctgcatatcctttccttg

SEQ ID NO: 713304 - DNA, 25 bp, Artificial sequence
  Synthetic oligonucleotide
cagcaattggattagcaaagttgag

SEQ ID NO: 713305 - DNA, 25 bp, Artificial sequence
  Synthetic oligonucleotide
gcatccagttgatggaaaatctcta

SEQ ID NO: 713306 - DNA, 25 bp, Artificial sequence
  Synthetic oligonucleotide
ggatcaagccagatcagcattctct

SEQ ID NO: 713307 - DNA, 25 bp, Artificial sequence
  Synthetic oligonucleotide
gaaccattgtcatacacccggttta

SEQ ID NO: 713308 - DNA, 25 bp, Artificial sequence
  Synthetic oligonucleotide
cggcaagtagatggagataacagtc

SEQ ID NO: 713309 - DNA, 25 bp, Artificial sequence
  Synthetic oligonucleotide
gaaactggctgcagatgaagaagaa

SEQ ID NO: 713310 - DNA, 25 bp, Artificial sequence
  Synthetic oligonucleotide
catgaaggctagtgtcagaaaaccc

SEQ ID NO: 713311 - DNA, 25 bp, Artificial sequence
  Synthetic oligonucleotide
taatggaagactctgctttgcagct

SEQ ID NO: 713312 - DNA, 25 bp, Artificial sequence
  Synthetic oligonucleotide
gttaatccatattggcagaacgaaa

SEQ ID NO: 713313 - DNA, 25 bp, Artificial sequence
  Synthetic oligonucleotide
ctgttttgccggctcagaaaaaatg

SEQ ID NO: 713314 - DNA, 25 bp, Artificial sequence
  Synthetic oligonucleotide
ataactacctgttttgccgggtcag

SEQ ID NO: 713315 - DNA, 25 bp, Artificial sequence
  Synthetic oligonucleotide
ataactacctgtattgccgggtcag

SEQ ID NO: 713316 - DNA, 25 bp, Artificial sequence
  Synthetic oligonucleotide
atgatccgaataactacctgttttg

SEQ ID NO: 713317 - DNA, 25 bp, Artificial sequence
  Synthetic oligonucleotide
tagctgatgatccgaataactacct

SEQ ID NO: 713318 - DNA, 25 bp, Artificial sequence
  Synthetic oligonucleotide
ggtcgagcgatggatttccgtctct

SEQ ID NO: 713319 - DNA, 25 bp, Artificial sequence
  Synthetic oligonucleotide
ggtcgagcgatgcatttccgtctct

SEQ ID NO: 713320 - DNA, 25 bp, Artificial sequence
  Synthetic oligonucleotide
cgctggttagcaccgcaggtgtaga

SEQ ID NO: 713321 - DNA, 25 bp, Artificial sequence
  Synthetic oligonucleotide
cgctggttagcagcgcaggtgtaga

SEQ ID NO: 713322 - DNA, 25 bp, Artificial sequence
  Synthetic oligonucleotide
aagatatctcacctactgacggtgg

SEQ ID NO: 713323 - DNA, 25 bp, Artificial sequence
  Synthetic oligonucleotide
aacgaaaacgctcgttagcaccgca

SEQ ID NO: 713324 - DNA, 25 bp, Artificial sequence
  Synthetic oligonucleotide
ctgttttgccgggtcagaaaaaatg

SEQ ID NO: 713325 - DNA, 25 bp, Artificial sequence
  Synthetic oligonucleotide
gttaatccatataggcagaacgaaa

SEQ ID NO: 713326 - DNA, 25 bp, Artificial sequence
  Synthetic oligonucleotide
aagatatctcacgtactgacggtgg

SEQ ID NO: 713327 - DNA, 25 bp, Artificial sequence
  Synthetic oligonucleotide
atgatccgaatatctacctgttttg

SEQ ID NO: 713328 - DNA, 25 bp, Artificial sequence
  Synthetic oligonucleotide
aacgaaaacgctggttagcaccgca

SEQ ID NO: 713329 - DNA, 25 bp, Artificial sequence
  Synthetic oligonucleotide
aaaaaatggtgttgccgcgccatct

SEQ ID NO: 713330 - DNA, 25 bp, Artificial sequence
  Synthetic oligonucleotide
ccagctatcaacacgcgccctggaa

SEQ ID NO: 713331 - DNA, 25 bp, Artificial sequence
  Synthetic oligonucleotide
aaaaaatggtgtagccgcgccatct

SEQ ID NO: 713332 - DNA, 25 bp, Artificial sequence
  Synthetic oligonucleotide
tagctgatgatcggaataactacct

SEQ ID NO: 713333 - DNA, 25 bp, Artificial sequence
  Synthetic oligonucleotide
ccagctatcaactcgcgccctggaa

SEQ ID NO: 713334 - DNA, 25 bp, Artificial sequence
  Synthetic oligonucleotide
ttgggccagctaaacatgcttcatc

SEQ ID NO: 713335 - DNA, 25 bp, Artificial sequence
  Synthetic oligonucleotide
cggaaatggtttcccgcagaacctg

SEQ ID NO: 713336 - DNA, 25 bp, Artificial sequence
  Synthetic oligonucleotide
cggaaatggtttgccgcagaacctg

SEQ ID NO: 713337 - DNA, 25 bp, Artificial sequence
  Synthetic oligonucleotide
tctgtccgtttgccggtcgtgggcg

SEQ ID NO: 713338 - DNA, 25 bp, Artificial sequence
  Synthetic oligonucleotide
tctgtccgtttggcggtcgtgggcg

SEQ ID NO: 713339 - DNA, 25 bp, Artificial sequence
  Synthetic oligonucleotide
gatcgccaggcgttttctgagcata

SEQ ID NO: 713340 - DNA, 25 bp, Artificial sequence
  Synthetic oligonucleotide
gatcgccaggcgatttctgagcata

SEQ ID NO: 713341 - DNA, 25 bp, Artificial sequence
  Synthetic oligonucleotide
gatgttcgcgataatcttctatatc

SEQ ID NO: 713342 - DNA, 25 bp, Artificial sequence
  Synthetic oligonucleotide
ttgggccagctatacatgcttcatc

SEQ ID NO: 713343 - DNA, 25 bp, Artificial sequence
  Synthetic oligonucleotide
gggattgcttataacaccctgttac

SEQ ID NO: 713344 - DNA, 25 bp, Artificial sequence
  Synthetic oligonucleotide
gggattgcttattacaccctgttac

SEQ ID NO: 713345 - DNA, 25 bp, Artificial sequence
  Synthetic oligonucleotide
atcgctgccaggttatacgtaatct

SEQ ID NO: 713346 - DNA, 25 bp, Artificial sequence
  Synthetic oligonucleotide
gatgttcgcgattatcttctatatc

SEQ ID NO: 713347 - DNA, 25 bp, Artificial sequence
  Synthetic oligonucleotide
gcactgatttcgtccaggttcgttc

SEQ ID NO: 713348 - DNA, 25 bp, Artificial sequence
  Synthetic oligonucleotide
gctgtttcactggttatgcggcgga

SEQ ID NO: 713349 - DNA, 25 bp, Artificial sequence
  Synthetic oligonucleotide
gcactgatttcgaccaggttcgttc

SEQ ID NO: 713350 - DNA, 25 bp, Artificial sequence
  Synthetic oligonucleotide
gcaaaacaggctctagcgttcgaac

SEQ ID NO: 713351 - DNA, 25 bp, Artificial sequence
  Synthetic oligonucleotide
gcaaaacaggctgtagcgttcgaac

SEQ ID NO: 713352 - DNA, 25 bp, Artificial sequence
  Synthetic oligonucleotide
gccggtgaacgtgcaaaacaggctc

SEQ ID NO: 713353 - DNA, 25 bp, Artificial sequence
  Synthetic oligonucleotide
gccggtgaacgtccaaaacaggctc

SEQ ID NO: 713354 - DNA, 25 bp, Artificial sequence
  Synthetic oligonucleotide
gctgtttcactgcttatgcggcgga

SEQ ID NO: 713355 - DNA, 25 bp, Artificial sequence
  Synthetic oligonucleotide
atcgctgccaggatatacgtaatct

SEQ ID NO: 713356 - DNA, 25 bp, Artificial sequence
  Synthetic oligonucleotide
tgtcgtatgggactttcaagtacct

SEQ ID NO: 713357 - DNA, 25 bp, Artificial sequence
  Synthetic oligonucleotide
ttctcgtgtagattatcagctaata

SEQ ID NO: 713358 - DNA, 25 bp, Artificial sequence
  Synthetic oligonucleotide
ccaatgaccataaacggcgtattaa

SEQ ID NO: 713359 - DNA, 25 bp, Artificial sequence
  Synthetic oligonucleotide
ccaatgaccatatacggcgtattaa

SEQ ID NO: 713360 - DNA, 25 bp, Artificial sequence
  Synthetic oligonucleotide
aacttgtcgtatgggactttcaagt

SEQ ID NO: 713361 - DNA, 25 bp, Artificial sequence
  Synthetic oligonucleotide
aacttgtcgtatcggactttcaagt

SEQ ID NO: 713362 - DNA, 25 bp, Artificial sequence
  Synthetic oligonucleotide
tgtcgtatgggagtttcaagtacct

SEQ ID NO: 713363 - DNA, 25 bp, Artificial sequence
  Synthetic oligonucleotide
tgacgttcgtcatgagtcgcataat

SEQ ID NO: 713364 - DNA, 25 bp, Artificial sequence
  Synthetic oligonucleotide
gttcacggctataaaacagcgtcat

SEQ ID NO: 713365 - DNA, 25 bp, Artificial sequence
  Synthetic oligonucleotide
gttcacggctattaaacagcgtcat

SEQ ID NO: 713366 - DNA, 25 bp, Artificial sequence
  Synthetic oligonucleotide
tcaagagtcgcataatctcagaatc

SEQ ID NO: 713367 - DNA, 25 bp, Artificial sequence
  Synthetic oligonucleotide
tctacgatggcatgtcgtgcctcgt

SEQ ID NO: 713368 - DNA, 25 bp, Artificial sequence
  Synthetic oligonucleotide
tgacgttcgtcaagagtcgcataat

SEQ ID NO: 713369 - DNA, 25 bp, Artificial sequence
  Synthetic oligonucleotide
atgacttatccatagtcctaagtcc

SEQ ID NO: 713370 - DNA, 25 bp, Artificial sequence
  Synthetic oligonucleotide
gtagaatatcaggtaatagggtcgg

SEQ ID NO: 713371 - DNA, 25 bp, Artificial sequence
  Synthetic oligonucleotide
gtagaatatcagctaatagggtcgg

SEQ ID NO: 713372 - DNA, 25 bp, Artificial sequence
  Synthetic oligonucleotide
ttctcgtgtagaatatcagctaata

SEQ ID NO: 713373 - DNA, 25 bp, Artificial sequence
  Synthetic oligonucleotide
tctacgatggcaagtcgtgcctcgt

SEQ ID NO: 713374 - DNA, 25 bp, Artificial sequence
  Synthetic oligonucleotide
ggttaagccgctattagcgtgtgtg

SEQ ID NO: 713375 - DNA, 25 bp, Artificial sequence
  Synthetic oligonucleotide
ggttaagccgcttttagcgtgtgtg

SEQ ID NO: 713376 - DNA, 25 bp, Artificial sequence
  Synthetic oligonucleotide
atgacttatccaaagtcctaagtcc

SEQ ID NO: 713377 - DNA, 25 bp, Artificial sequence
  Synthetic oligonucleotide
tcaagagtcgcaaaatctcagaatc

SEQ ID NO: 713378 - DNA, 25 bp, Artificial sequence
  Synthetic oligonucleotide
tgacgttcgtcaagagtcgcataat

SEQ ID NO: 713379 - DNA, 25 bp, Artificial sequence
  Synthetic oligonucleotide
tgtcgtatgggactttcaagtacct

SEQ ID NO: 713380 - DNA, 25 bp, Artificial sequence
  Synthetic oligonucleotide
ccaatgaccatatacggcgtattaa

SEQ ID NO: 713381 - DNA, 25 bp, Artificial sequence
  Synthetic oligonucleotide
ccaatgaccataaacggcgtattaa

SEQ ID NO: 713382 - DNA, 25 bp, Artificial sequence
  Synthetic oligonucleotide
aacttgtcgtatgggactttcaagt

SEQ ID NO: 713383 - DNA, 25 bp, Artificial sequence
  Synthetic oligonucleotide
aacttgtcgtatcggactttcaagt

SEQ ID NO: 713384 - DNA, 25 bp, Artificial sequence
  Synthetic oligonucleotide
tgtcgtatgggagtttcaagtacct

SEQ ID NO: 713385 - DNA, 25 bp, Artificial sequence
  Synthetic oligonucleotide
tcaagagtcgcaaaatctcagaatc

SEQ ID NO: 713386 - DNA, 25 bp, Artificial sequence
  Synthetic oligonucleotide
gttcacggctataaaacagcgtcat

SEQ ID NO: 713387 - DNA, 25 bp, Artificial sequence
  Synthetic oligonucleotide
gtagaatatcaggtaatagggtcgg

SEQ ID NO: 713388 - DNA, 25 bp, Artificial sequence
  Synthetic oligonucleotide
tcaagagtcgcataatctcagaatc

SEQ ID NO: 713389 - DNA, 25 bp, Artificial sequence
  Synthetic oligonucleotide
atgacttatccatagtcctaagtcc

SEQ ID NO: 713390 - DNA, 25 bp, Artificial sequence
  Synthetic oligonucleotide
tgacgttcgtcatgagtcgcataat

SEQ ID NO: 713391 - DNA, 25 bp, Artificial sequence
  Synthetic oligonucleotide
gtagaatatcagctaatagggtcgg

SEQ ID NO: 713392 - DNA, 25 bp, Artificial sequence
  Synthetic oligonucleotide
ttctcgtgtagaatatcagctaata

SEQ ID NO: 713393 - DNA, 25 bp, Artificial sequence
  Synthetic oligonucleotide
ttctcgtgtagattatcagctaata

SEQ ID NO: 713394 - DNA, 25 bp, Artificial sequence
  Synthetic oligonucleotide
gttcacggctattaaacagcgtcat

SEQ ID NO: 713395 - DNA, 25 bp, Artificial sequence
  Synthetic oligonucleotide
atgacttatccaaagtcctaagtcc

SEQ ID NO: 713396 - DNA, 25 bp, Artificial sequence
  Synthetic oligonucleotide
ggttaagccgctattagcgtgtgtg

SEQ ID NO: 713397 - DNA, 25 bp, Artificial sequence
  Synthetic oligonucleotide
ggttaagccgcttttagcgtgtgtg

SEQ ID NO: 713398 - DNA, 25 bp, Artificial sequence
  Synthetic oligonucleotide
tctacgatggcatgtcgtgcctcgt

SEQ ID NO: 713399 - DNA, 25 bp, Artificial sequence
  Synthetic oligonucleotide
tctacgatggcaagtcgtgcctcgt

SEQ ID NO: 713400 - DNA, 25 bp, Artificial sequence
  Synthetic oligonucleotide
acatatcctaattcaggcgcgacga

SEQ ID NO: 713401 - DNA, 25 bp, Artificial sequence
  Synthetic oligonucleotide
cgacgaaccttaaactcgatggaag

SEQ ID NO: 713402 - DNA, 25 bp, Artificial sequence
  Synthetic oligonucleotide
gaactagcatcttagcactcggctc

SEQ ID NO: 713403 - DNA, 25 bp, Artificial sequence
  Synthetic oligonucleotide
acatatcctaatacaggcgcgacga

SEQ ID NO: 713404 - DNA, 25 bp, Artificial sequence
  Synthetic oligonucleotide
ctcgatggaagagagttatacccat

SEQ ID NO: 713405 - DNA, 25 bp, Artificial sequence
  Synthetic oligonucleotide
cggtgcgattaactcgactgccgcg

SEQ ID NO: 713406 - DNA, 25 bp, Artificial sequence
  Synthetic oligonucleotide
cggtgcgattaagtcgactgccgcg

SEQ ID NO: 713407 - DNA, 25 bp, Artificial sequence
  Synthetic oligonucleotide
tattgaccaaactgcggtgcgatta

SEQ ID NO: 713408 - DNA, 25 bp, Artificial sequence
  Synthetic oligonucleotide
cgacgaaccttatactcgatggaag

SEQ ID NO: 713409 - DNA, 25 bp, Artificial sequence
  Synthetic oligonucleotide
ctcgatggaagacagttatacccat

SEQ ID NO: 713410 - DNA, 25 bp, Artificial sequence
  Synthetic oligonucleotide
tattgaccaaacagcggtgcgatta

SEQ ID NO: 713411 - DNA, 25 bp, Artificial sequence
  Synthetic oligonucleotide
actccgagaacttgcatctaagcac

SEQ ID NO: 713412 - DNA, 25 bp, Artificial sequence
  Synthetic oligonucleotide
gaactagcatctaagcactcggctc

SEQ ID NO: 713413 - DNA, 25 bp, Artificial sequence
  Synthetic oligonucleotide
tcggctctaatgttaagtgctcgac

SEQ ID NO: 713414 - DNA, 25 bp, Artificial sequence
  Synthetic oligonucleotide
tcggctctaatgataagtgctcgac

SEQ ID NO: 713415 - DNA, 25 bp, Artificial sequence
  Synthetic oligonucleotide
ttatttgggccgccagagttatgtt

SEQ ID NO: 713416 - DNA, 25 bp, Artificial sequence
  Synthetic oligonucleotide
ttatttgggccggcagagttatgtt

SEQ ID NO: 713417 - DNA, 25 bp, Artificial sequence
  Synthetic oligonucleotide
gtgccaagtacgttggctcacgtct

SEQ ID NO: 713418 - DNA, 25 bp, Artificial sequence
  Synthetic oligonucleotide
gtgccaagtacgatggctcacgtct

SEQ ID NO: 713419 - DNA, 25 bp, Artificial sequence
  Synthetic oligonucleotide
aatgttaagtgctcgaccacagatc

SEQ ID NO: 713420 - DNA, 25 bp, Artificial sequence
  Synthetic oligonucleotide
aatgttaagtgcacgaccacagatc

SEQ ID NO: 713421 - DNA, 25 bp, Artificial sequence
  Synthetic oligonucleotide
actccgagaactagcatctaagcac

SEQ ID NO: 713422 - DNA, 25 bp, Artificial sequence
  Synthetic oligonucleotide
cggtgcgattaagtcgactgccgcg

SEQ ID NO: 713423 - DNA, 25 bp, Artificial sequence
  Synthetic oligonucleotide
actccgagaactagcatctaagcac

SEQ ID NO: 713424 - DNA, 25 bp, Artificial sequence
  Synthetic oligonucleotide
ttatttgggccgccagagttatgtt

SEQ ID NO: 713425 - DNA, 25 bp, Artificial sequence
  Synthetic oligonucleotide
ttatttgggccggcagagttatgtt

SEQ ID NO: 713426 - DNA, 25 bp, Artificial sequence
  Synthetic oligonucleotide
gtgccaagtacgatggctcacgtct

SEQ ID NO: 713427 - DNA, 25 bp, Artificial sequence
  Synthetic oligonucleotide
gtgccaagtacgttggctcacgtct

SEQ ID NO: 713428 - DNA, 25 bp, Artificial sequence
  Synthetic oligonucleotide
aatgttaagtgcacgaccacagatc

SEQ ID NO: 713429 - DNA, 25 bp, Artificial sequence
  Synthetic oligonucleotide
aatgttaagtgctcgaccacagatc

SEQ ID NO: 713430 - DNA, 25 bp, Artificial sequence
  Synthetic oligonucleotide
tcggctctaatgttaagtgctcgac

SEQ ID NO: 713431 - DNA, 25 bp, Artificial sequence
  Synthetic oligonucleotide
tcggctctaatgataagtgctcgac

SEQ ID NO: 713432 - DNA, 25 bp, Artificial sequence
  Synthetic oligonucleotide
tattgaccaaacagcggtgcgatta

SEQ ID NO: 713433 - DNA, 25 bp, Artificial sequence
  Synthetic oligonucleotide
gaactagcatcttagcactcggctc

SEQ ID NO: 713434 - DNA, 25 bp, Artificial sequence
  Synthetic oligonucleotide
actccgagaacttgcatctaagcac

SEQ ID NO: 713435 - DNA, 25 bp, Artificial sequence
  Synthetic oligonucleotide
ctcgatggaagacagttatacccat

SEQ ID NO: 713436 - DNA, 25 bp, Artificial sequence
  Synthetic oligonucleotide
ctcgatggaagagagttatacccat

SEQ ID NO: 713437 - DNA, 25 bp, Artificial sequence
  Synthetic oligonucleotide
cgacgaaccttatactcgatggaag

SEQ ID NO: 713438 - DNA, 25 bp, Artificial sequence
  Synthetic oligonucleotide
cgacgaaccttaaactcgatggaag

SEQ ID NO: 713439 - DNA, 25 bp, Artificial sequence
  Synthetic oligonucleotide
acatatcctaattcaggcgcgacga

SEQ ID NO: 713440 - DNA, 25 bp, Artificial sequence
  Synthetic oligonucleotide
acatatcctaatacaggcgcgacga

SEQ ID NO: 713441 - DNA, 25 bp, Artificial sequence
  Synthetic oligonucleotide
cggtgcgattaactcgactgccgcg

SEQ ID NO: 713442 - DNA, 25 bp, Artificial sequence
  Synthetic oligonucleotide
tattgaccaaactgcggtgcgatta

SEQ ID NO: 713443 - DNA, 25 bp, Artificial sequence
  Synthetic oligonucleotide
gaactagcatctaagcactcggctc

SEQ ID NO: 713444 - DNA, 25 bp, Artificial sequence
  Synthetic oligonucleotide
ttacgcgacattctgcaaagttacg

SEQ ID NO: 713445 - DNA, 25 bp, Artificial sequence
  Synthetic oligonucleotide
atggctgtgcctaacgaatctggga

SEQ ID NO: 713446 - DNA, 25 bp, Artificial sequence
  Synthetic oligonucleotide
gtgataatttcgtcgaggcgttaca

SEQ ID NO: 713447 - DNA, 25 bp, Artificial sequence
  Synthetic oligonucleotide
ttcgacgaggcgatacatattctga

SEQ ID NO: 713448 - DNA, 25 bp, Artificial sequence
  Synthetic oligonucleotide
ttcgacgaggcgttacatattctga

SEQ ID NO: 713449 - DNA, 25 bp, Artificial sequence
  Synthetic oligonucleotide
tatatcgtggacccaaagtcgatac

SEQ ID NO: 713450 - DNA, 25 bp, Artificial sequence
  Synthetic oligonucleotide
tatatcgtggacgcaaagtcgatac

SEQ ID NO: 713451 - DNA, 25 bp, Artificial sequence
  Synthetic oligonucleotide
gtcgatacgtcccattaagcgacgt

SEQ ID NO: 713452 - DNA, 25 bp, Artificial sequence
  Synthetic oligonucleotide
gtcgatacgtccgattaagcgacgt

SEQ ID NO: 713453 - DNA, 25 bp, Artificial sequence
  Synthetic oligonucleotide
gtgataatttcgacgaggcgttaca

SEQ ID NO: 713454 - DNA, 25 bp, Artificial sequence
  Synthetic oligonucleotide
tataccctcgggttacgaattatgg

SEQ ID NO: 713455 - DNA, 25 bp, Artificial sequence
  Synthetic oligonucleotide
atggctgtgccttacgaatctggga

SEQ ID NO: 713456 - DNA, 25 bp, Artificial sequence
  Synthetic oligonucleotide
ccgtcctattggatactattccgtg

SEQ ID NO: 713457 - DNA, 25 bp, Artificial sequence
  Synthetic oligonucleotide
ccgtcactatgtaacgcttgacgta

SEQ ID NO: 713458 - DNA, 25 bp, Artificial sequence
  Synthetic oligonucleotide
ccgtcactatgttacgcttgacgta

SEQ ID NO: 713459 - DNA, 25 bp, Artificial sequence
  Synthetic oligonucleotide
ggttacgatgactgctaagccatta

SEQ ID NO: 713460 - DNA, 25 bp, Artificial sequence
  Synthetic oligonucleotide
ttacgcgacattgtgcaaagttacg

SEQ ID NO: 713461 - DNA, 25 bp, Artificial sequence
  Synthetic oligonucleotide
ggttacgatgacagctaagccatta

SEQ ID NO: 713462 - DNA, 25 bp, Artificial sequence
  Synthetic oligonucleotide
taggcttacgcggatgagctctagg

SEQ ID NO: 713463 - DNA, 25 bp, Artificial sequence
  Synthetic oligonucleotide
taggcttacgcgcatgagctctagg

SEQ ID NO: 713464 - DNA, 25 bp, Artificial sequence
  Synthetic oligonucleotide
tataccctcgggatacgaattatgg

SEQ ID NO: 713465 - DNA, 25 bp, Artificial sequence
  Synthetic oligonucleotide
ccgtcctattggttactattccgtg

SEQ ID NO: 713466 - DNA, 25 bp, Artificial sequence
  Synthetic oligonucleotide
gtgataatttcgacgaggcgttaca

SEQ ID NO: 713467 - DNA, 25 bp, Artificial sequence
  Synthetic oligonucleotide
gtgataatttcgtcgaggcgttaca

SEQ ID NO: 713468 - DNA, 25 bp, Artificial sequence
  Synthetic oligonucleotide
taggcttacgcggatgagctctagg

SEQ ID NO: 713469 - DNA, 25 bp, Artificial sequence
  Synthetic oligonucleotide
ttcgacgaggcgttacatattctga

SEQ ID NO: 713470 - DNA, 25 bp, Artificial sequence
  Synthetic oligonucleotide
ttcgacgaggcgatacatattctga

SEQ ID NO: 713471 - DNA, 25 bp, Artificial sequence
  Synthetic oligonucleotide
tatatcgtggacgcaaagtcgatac

SEQ ID NO: 713472 - DNA, 25 bp, Artificial sequence
  Synthetic oligonucleotide
tatatcgtggacccaaagtcgatac

SEQ ID NO: 713473 - DNA, 25 bp, Artificial sequence
  Synthetic oligonucleotide
gtcgatacgtcccattaagcgacgt

SEQ ID NO: 713474 - DNA, 25 bp, Artificial sequence
  Synthetic oligonucleotide
gtcgatacgtccgattaagcgacgt

SEQ ID NO: 713475 - DNA, 25 bp, Artificial sequence
  Synthetic oligonucleotide
tataccctcgggttacgaattatgg

SEQ ID NO: 713476 - DNA, 25 bp, Artificial sequence
  Synthetic oligonucleotide
tataccctcgggatacgaattatgg

SEQ ID NO: 713477 - DNA, 25 bp, Artificial sequence
  Synthetic oligonucleotide
ttacgcgacattgtgcaaagttacg

SEQ ID NO: 713478 - DNA, 25 bp, Artificial sequence
  Synthetic oligonucleotide
ttacgcgacattctgcaaagttacg

SEQ ID NO: 713479 - DNA, 25 bp, Artificial sequence
  Synthetic oligonucleotide
ggttacgatgactgctaagccatta

SEQ ID NO: 713480 - DNA, 25 bp, Artificial sequence
  Synthetic oligonucleotide
ggttacgatgacagctaagccatta

SEQ ID NO: 713481 - DNA, 25 bp, Artificial sequence
  Synthetic oligonucleotide
ccgtcactatgttacgcttgacgta

SEQ ID NO: 713482 - DNA, 25 bp, Artificial sequence
  Synthetic oligonucleotide
ccgtcactatgtaacgcttgacgta

SEQ ID NO: 713483 - DNA, 25 bp, Artificial sequence
  Synthetic oligonucleotide
ccgtcctattggttactattccgtg

SEQ ID NO: 713484 - DNA, 25 bp, Artificial sequence
  Synthetic oligonucleotide
atggctgtgcctaacgaatctggga

SEQ ID NO: 713485 - DNA, 25 bp, Artificial sequence
  Synthetic oligonucleotide
atggctgtgccttacgaatctggga

SEQ ID NO: 713486 - DNA, 25 bp, Artificial sequence
  Synthetic oligonucleotide
ccgtcctattggatactattccgtg

SEQ ID NO: 713487 - DNA, 25 bp, Artificial sequence
  Synthetic oligonucleotide
taggcttacgcgcatgagctctagg

SEQ ID NO: 713488 - DNA, 25 bp, Artificial sequence
  Synthetic oligonucleotide
cataggtaacctattcgtgactagc

SEQ ID NO: 713489 - DNA, 25 bp, Artificial sequence
  Synthetic oligonucleotide
aacgtatgccgcatattcggaacgt

SEQ ID NO: 713490 - DNA, 25 bp, Artificial sequence
  Synthetic oligonucleotide
aacgtatgccgcttattcggaacgt

SEQ ID NO: 713491 - DNA, 25 bp, Artificial sequence
  Synthetic oligonucleotide
gtatccgaagtcctagtgataatat

SEQ ID NO: 713492 - DNA, 25 bp, Artificial sequence
  Synthetic oligonucleotide
gtatccgaagtcgtagtgataatat

SEQ ID NO: 713493 - DNA, 25 bp, Artificial sequence
  Synthetic oligonucleotide
tatctaattcgtgagtcgggtacta

SEQ ID NO: 713494 - DNA, 25 bp, Artificial sequence
  Synthetic oligonucleotide
cataggtaaccttttcgtgactagc

SEQ ID NO: 713495 - DNA, 25 bp, Artificial sequence
  Synthetic oligonucleotide
ccacctagatcgtaattatcggaac

SEQ ID NO: 713496 - DNA, 25 bp, Artificial sequence
  Synthetic oligonucleotide
tcttattagcgaggagcatttcgtg

SEQ ID NO: 713497 - DNA, 25 bp, Artificial sequence
  Synthetic oligonucleotide
atgacgcggagtcaacctgataacc

SEQ ID NO: 713498 - DNA, 25 bp, Artificial sequence
  Synthetic oligonucleotide
tatctaattcgtcagtcgggtacta

SEQ ID NO: 713499 - DNA, 25 bp, Artificial sequence
  Synthetic oligonucleotide
ccacctagatcgaaattatcggaac

SEQ ID NO: 713500 - DNA, 25 bp, Artificial sequence
  Synthetic oligonucleotide
gaactcgtcgcttatttacgaacct

SEQ ID NO: 713501 - DNA, 25 bp, Artificial sequence
  Synthetic oligonucleotide
gaactcgtcgctaatttacgaacct

SEQ ID NO: 713502 - DNA, 25 bp, Artificial sequence
  Synthetic oligonucleotide
agtctggtttcttattagcgaggag

SEQ ID NO: 713503 - DNA, 25 bp, Artificial sequence
  Synthetic oligonucleotide
aatatcgtaagagatccgcgagcga

SEQ ID NO: 713504 - DNA, 25 bp, Artificial sequence
  Synthetic oligonucleotide
tcttattagcgacgagcatttcgtg

SEQ ID NO: 713505 - DNA, 25 bp, Artificial sequence
  Synthetic oligonucleotide
atactgagccgaatatcgtaagaca

SEQ ID NO: 713506 - DNA, 25 bp, Artificial sequence
  Synthetic oligonucleotide
atactgagccgattatcgtaagaca

SEQ ID NO: 713507 - DNA, 25 bp, Artificial sequence
  Synthetic oligonucleotide
aatatcgtaagacatccgcgagcga

SEQ ID NO: 713508 - DNA, 25 bp, Artificial sequence
  Synthetic oligonucleotide
atgacgcggagtgaacctgataacc

SEQ ID NO: 713509 - DNA, 25 bp, Artificial sequence
  Synthetic oligonucleotide
agtctggtttctaattagcgaggag

SEQ ID NO: 713510 - DNA, 25 bp, Artificial sequence
  Synthetic oligonucleotide
ccacctagatcgtaattatcggaac

SEQ ID NO: 713511 - DNA, 25 bp, Artificial sequence
  Synthetic oligonucleotide
atgacgcggagtgaacctgataacc

SEQ ID NO: 713512 - DNA, 25 bp, Artificial sequence
  Synthetic oligonucleotide
gaactcgtcgctaatttacgaacct

SEQ ID NO: 713513 - DNA, 25 bp, Artificial sequence
  Synthetic oligonucleotide
atgacgcggagtcaacctgataacc

SEQ ID NO: 713514 - DNA, 25 bp, Artificial sequence
  Synthetic oligonucleotide
aatatcgtaagacatccgcgagcga

SEQ ID NO: 713515 - DNA, 25 bp, Artificial sequence
  Synthetic oligonucleotide
cataggtaaccttttcgtgactagc

SEQ ID NO: 713516 - DNA, 25 bp, Artificial sequence
  Synthetic oligonucleotide
cataggtaacctattcgtgactagc

SEQ ID NO: 713517 - DNA, 25 bp, Artificial sequence
  Synthetic oligonucleotide
tatctaattcgtcagtcgggtacta

SEQ ID NO: 713518 - DNA, 25 bp, Artificial sequence
  Synthetic oligonucleotide
tatctaattcgtgagtcgggtacta

SEQ ID NO: 713519 - DNA, 25 bp, Artificial sequence
  Synthetic oligonucleotide
gtatccgaagtcctagtgataatat

SEQ ID NO: 713520 - DNA, 25 bp, Artificial sequence
  Synthetic oligonucleotide
gtatccgaagtcgtagtgataatat

SEQ ID NO: 713521 - DNA, 25 bp, Artificial sequence
  Synthetic oligonucleotide
aacgtatgccgcttattcggaacgt

SEQ ID NO: 713522 - DNA, 25 bp, Artificial sequence
  Synthetic oligonucleotide
aacgtatgccgcatattcggaacgt

SEQ ID NO: 713523 - DNA, 25 bp, Artificial sequence
  Synthetic oligonucleotide
atactgagccgattatcgtaagaca

SEQ ID NO: 713524 - DNA, 25 bp, Artificial sequence
  Synthetic oligonucleotide
atactgagccgaatatcgtaagaca

SEQ ID NO: 713525 - DNA, 25 bp, Artificial sequence
  Synthetic oligonucleotide
tcttattagcgaggagcatttcgtg

SEQ ID NO: 713526 - DNA, 25 bp, Artificial sequence
  Synthetic oligonucleotide
tcttattagcgacgagcatttcgtg

SEQ ID NO: 713527 - DNA, 25 bp, Artificial sequence
  Synthetic oligonucleotide
agtctggtttcttattagcgaggag

SEQ ID NO: 713528 - DNA, 25 bp, Artificial sequence
  Synthetic oligonucleotide
agtctggtttctaattagcgaggag

SEQ ID NO: 713529 - DNA, 25 bp, Artificial sequence
  Synthetic oligonucleotide
gaactcgtcgcttatttacgaacct

SEQ ID NO: 713530 - DNA, 25 bp, Artificial sequence
  Synthetic oligonucleotide
ccacctagatcgaaattatcggaac

SEQ ID NO: 713531 - DNA, 25 bp, Artificial sequence
  Synthetic oligonucleotide
aatatcgtaagagatccgcgagcga

SEQ ID NO: 713532 - DNA, 25 bp, Artificial sequence
  Synthetic oligonucleotide
tacggcggttgacttagttatgcga

SEQ ID NO: 713533 - DNA, 25 bp, Artificial sequence
  Synthetic oligonucleotide
gatccgattacacgccgatccatcg

SEQ ID NO: 713534 - DNA, 25 bp, Artificial sequence
  Synthetic oligonucleotide
cgaccatgtcgtgtagcttaatacc

SEQ ID NO: 713535 - DNA, 25 bp, Artificial sequence
  Synthetic oligonucleotide
ggttgacttagtaatgcgaggttcg

SEQ ID NO: 713536 - DNA, 25 bp, Artificial sequence
  Synthetic oligonucleotide
ggttgacttagttatgcgaggttcg

SEQ ID NO: 713537 - DNA, 25 bp, Artificial sequence
  Synthetic oligonucleotide
accgagctgacgacgcgttagacag

SEQ ID NO: 713538 - DNA, 25 bp, Artificial sequence
  Synthetic oligonucleotide
accgagctgacgtcgcgttagacag

SEQ ID NO: 713539 - DNA, 25 bp, Artificial sequence
  Synthetic oligonucleotide
gtcacgtttaggtctatgtcgaagc

SEQ ID NO: 713540 - DNA, 25 bp, Artificial sequence
  Synthetic oligonucleotide
gtcacgtttaggactatgtcgaagc

SEQ ID NO: 713541 - DNA, 25 bp, Artificial sequence
  Synthetic oligonucleotide
cgaccatgtcgtctagcttaatacc

SEQ ID NO: 713542 - DNA, 25 bp, Artificial sequence
  Synthetic oligonucleotide
tatacttacacaccaggcgatcacg

SEQ ID NO: 713543 - DNA, 25 bp, Artificial sequence
  Synthetic oligonucleotide
caggcgatcacgttagatccactgc

SEQ ID NO: 713544 - DNA, 25 bp, Artificial sequence
  Synthetic oligonucleotide
acatgatcgatccgattacaggccg

SEQ ID NO: 713545 - DNA, 25 bp, Artificial sequence
  Synthetic oligonucleotide
tcgacctagcgttaggatccacgat

SEQ ID NO: 713546 - DNA, 25 bp, Artificial sequence
  Synthetic oligonucleotide
gatccgattacaggccgatccatcg

SEQ ID NO: 713547 - DNA, 25 bp, Artificial sequence
  Synthetic oligonucleotide
tatacttacacagcaggcgatcacg

SEQ ID NO: 713548 - DNA, 25 bp, Artificial sequence
  Synthetic oligonucleotide
tcgctggagatccaatacgcccagc

SEQ ID NO: 713549 - DNA, 25 bp, Artificial sequence
  Synthetic oligonucleotide
tcgctggagatcgaatacgcccagc

SEQ ID NO: 713550 - DNA, 25 bp, Artificial sequence
  Synthetic oligonucleotide
tcgacctagcgtaaggatccacgat

SEQ ID NO: 713551 - DNA, 25 bp, Artificial sequence
  Synthetic oligonucleotide
tacggcggttgagttagttatgcga

SEQ ID NO: 713552 - DNA, 25 bp, Artificial sequence
  Synthetic oligonucleotide
acatgatcgatcggattacaggccg

SEQ ID NO: 713553 - DNA, 25 bp, Artificial sequence
  Synthetic oligonucleotide
caggcgatcacgatagatccactgc

SEQ ID NO: 713554 - DNA, 25 bp, Artificial sequence
  Synthetic oligonucleotide
ggttgacttagtaatgcgaggttcg

SEQ ID NO: 713555 - DNA, 25 bp, Artificial sequence
  Synthetic oligonucleotide
tacggcggttgacttagttatgcga

SEQ ID NO: 713556 - DNA, 25 bp, Artificial sequence
  Synthetic oligonucleotide
ggttgacttagttatgcgaggttcg

SEQ ID NO: 713557 - DNA, 25 bp, Artificial sequence
  Synthetic oligonucleotide
accgagctgacgacgcgttagacag

SEQ ID NO: 713558 - DNA, 25 bp, Artificial sequence
  Synthetic oligonucleotide
accgagctgacgtcgcgttagacag

SEQ ID NO: 713559 - DNA, 25 bp, Artificial sequence
  Synthetic oligonucleotide
gtcacgtttaggtctatgtcgaagc

SEQ ID NO: 713560 - DNA, 25 bp, Artificial sequence
  Synthetic oligonucleotide
gtcacgtttaggactatgtcgaagc

SEQ ID NO: 713561 - DNA, 25 bp, Artificial sequence
  Synthetic oligonucleotide
cgaccatgtcgtgtagcttaatacc

SEQ ID NO: 713562 - DNA, 25 bp, Artificial sequence
  Synthetic oligonucleotide
cgaccatgtcgtctagcttaatacc

SEQ ID NO: 713563 - DNA, 25 bp, Artificial sequence
  Synthetic oligonucleotide
tacggcggttgagttagttatgcga

SEQ ID NO: 713564 - DNA, 25 bp, Artificial sequence
  Synthetic oligonucleotide
gatccgattacacgccgatccatcg

SEQ ID NO: 713565 - DNA, 25 bp, Artificial sequence
  Synthetic oligonucleotide
tcgacctagcgttaggatccacgat

SEQ ID NO: 713566 - DNA, 25 bp, Artificial sequence
  Synthetic oligonucleotide
tatacttacacaccaggcgatcacg

SEQ ID NO: 713567 - DNA, 25 bp, Artificial sequence
  Synthetic oligonucleotide
tcgctggagatcgaatacgcccagc

SEQ ID NO: 713568 - DNA, 25 bp, Artificial sequence
  Synthetic oligonucleotide
tcgacctagcgtaaggatccacgat

SEQ ID NO: 713569 - DNA, 25 bp, Artificial sequence
  Synthetic oligonucleotide
gatccgattacaggccgatccatcg

SEQ ID NO: 713570 - DNA, 25 bp, Artificial sequence
  Synthetic oligonucleotide
acatgatcgatccgattacaggccg

SEQ ID NO: 713571 - DNA, 25 bp, Artificial sequence
  Synthetic oligonucleotide
acatgatcgatcggattacaggccg

SEQ ID NO: 713572 - DNA, 25 bp, Artificial sequence
  Synthetic oligonucleotide
caggcgatcacgttagatccactgc

SEQ ID NO: 713573 - DNA, 25 bp, Artificial sequence
  Synthetic oligonucleotide
caggcgatcacgatagatccactgc

SEQ ID NO: 713574 - DNA, 25 bp, Artificial sequence
  Synthetic oligonucleotide
tatacttacacagcaggcgatcacg

SEQ ID NO: 713575 - DNA, 25 bp, Artificial sequence
  Synthetic oligonucleotide
tcgctggagatccaatacgcccagc

SEQ ID NO: 713576 - DNA, 25 bp, Artificial sequence
  Synthetic oligonucleotide
ggcctggacgactataattcggcgg

SEQ ID NO: 713577 - DNA, 25 bp, Artificial sequence
  Synthetic oligonucleotide
ggcctggacgacaataattcggcgg

SEQ ID NO: 713578 - DNA, 25 bp, Artificial sequence
  Synthetic oligonucleotide
cggcctggacgacaataattcggcg

SEQ ID NO: 713579 - DNA, 25 bp, Artificial sequence
  Synthetic oligonucleotide
cggcctggacgagaataattcggcg

SEQ ID NO: 713580 - DNA, 25 bp, Artificial sequence
  Synthetic oligonucleotide
gacatggacgttaagtatccggcct

SEQ ID NO: 713581 - DNA, 25 bp, Artificial sequence
  Synthetic oligonucleotide
gacatggacgtttagtatccggcct

SEQ ID NO: 713582 - DNA, 25 bp, Artificial sequence
  Synthetic oligonucleotide
attagaccggatcacccggacatgg

SEQ ID NO: 713583 - DNA, 25 bp, Artificial sequence
  Synthetic oligonucleotide
gacgacaataatacggcggtgcctc

SEQ ID NO: 713584 - DNA, 25 bp, Artificial sequence
  Synthetic oligonucleotide
cgtgacgactgcatagtggtcggtc

SEQ ID NO: 713585 - DNA, 25 bp, Artificial sequence
  Synthetic oligonucleotide
tcgcctgttacttggttagacagtc

SEQ ID NO: 713586 - DNA, 25 bp, Artificial sequence
  Synthetic oligonucleotide
attagaccggatgacccggacatgg

SEQ ID NO: 713587 - DNA, 25 bp, Artificial sequence
  Synthetic oligonucleotide
gacgacaataattcggcggtgcctc

SEQ ID NO: 713588 - DNA, 25 bp, Artificial sequence
  Synthetic oligonucleotide
tcacaatattcccagaactctgcat

SEQ ID NO: 713589 - DNA, 25 bp, Artificial sequence
  Synthetic oligonucleotide
tcacaatattccgagaactctgcat

SEQ ID NO: 713590 - DNA, 25 bp, Artificial sequence
  Synthetic oligonucleotide
gtacatgagtcatagtccgaatagc

SEQ ID NO: 713591 - DNA, 25 bp, Artificial sequence
  Synthetic oligonucleotide
tcgcctgttactaggttagacagtc

SEQ ID NO: 713592 - DNA, 25 bp, Artificial sequence
  Synthetic oligonucleotide
ggttagactgatggtcaacgaccta

SEQ ID NO: 713593 - DNA, 25 bp, Artificial sequence
  Synthetic oligonucleotide
ggttagactgatcgtcaacgaccta

SEQ ID NO: 713594 - DNA, 25 bp, Artificial sequence
  Synthetic oligonucleotide
cgtgacgactgcttagtggtcggtc

SEQ ID NO: 713595 - DNA, 25 bp, Artificial sequence
  Synthetic oligonucleotide
ctagttatggcgtcggattagaccg

SEQ ID NO: 713596 - DNA, 25 bp, Artificial sequence
  Synthetic oligonucleotide
ctagttatggcgacggattagaccg

SEQ ID NO: 713597 - DNA, 25 bp, Artificial sequence
  Synthetic oligonucleotide
gtacatgagtcaaagtccgaatagc

SEQ ID NO: 713598 - DNA, 25 bp, Artificial sequence
  Synthetic oligonucleotide
cggcctggacgacaataattcggcg

SEQ ID NO: 713599 - DNA, 25 bp, Artificial sequence
  Synthetic oligonucleotide
cgtgacgactgcttagtggtcggtc

SEQ ID NO: 713600 - DNA, 25 bp, Artificial sequence
  Synthetic oligonucleotide
ctagttatggcgtcggattagaccg

SEQ ID NO: 713601 - DNA, 25 bp, Artificial sequence
  Synthetic oligonucleotide
attagaccggatgacccggacatgg

SEQ ID NO: 713602 - DNA, 25 bp, Artificial sequence
  Synthetic oligonucleotide
attagaccggatcacccggacatgg

SEQ ID NO: 713603 - DNA, 25 bp, Artificial sequence
  Synthetic oligonucleotide
gacatggacgtttagtatccggcct

SEQ ID NO: 713604 - DNA, 25 bp, Artificial sequence
  Synthetic oligonucleotide
ctagttatggcgacggattagaccg

SEQ ID NO: 713605 - DNA, 25 bp, Artificial sequence
  Synthetic oligonucleotide
cggcctggacgagaataattcggcg

SEQ ID NO: 713606 - DNA, 25 bp, Artificial sequence
  Synthetic oligonucleotide
ggcctggacgactataattcggcgg

SEQ ID NO: 713607 - DNA, 25 bp, Artificial sequence
  Synthetic oligonucleotide
ggcctggacgacaataattcggcgg

SEQ ID NO: 713608 - DNA, 25 bp, Artificial sequence
  Synthetic oligonucleotide
gacgacaataattcggcggtgcctc

SEQ ID NO: 713609 - DNA, 25 bp, Artificial sequence
  Synthetic oligonucleotide
ggttagactgatggtcaacgaccta

SEQ ID NO: 713610 - DNA, 25 bp, Artificial sequence
  Synthetic oligonucleotide
tcacaatattccgagaactctgcat

SEQ ID NO: 713611 - DNA, 25 bp, Artificial sequence
  Synthetic oligonucleotide
tcacaatattcccagaactctgcat

SEQ ID NO: 713612 - DNA, 25 bp, Artificial sequence
  Synthetic oligonucleotide
gtacatgagtcaaagtccgaatagc

SEQ ID NO: 713613 - DNA, 25 bp, Artificial sequence
  Synthetic oligonucleotide
gtacatgagtcatagtccgaatagc

SEQ ID NO: 713614 - DNA, 25 bp, Artificial sequence
  Synthetic oligonucleotide
tcgcctgttacttggttagacagtc

SEQ ID NO: 713615 - DNA, 25 bp, Artificial sequence
  Synthetic oligonucleotide
tcgcctgttactaggttagacagtc

SEQ ID NO: 713616 - DNA, 25 bp, Artificial sequence
  Synthetic oligonucleotide
ggttagactgatcgtcaacgaccta

SEQ ID NO: 713617 - DNA, 25 bp, Artificial sequence
  Synthetic oligonucleotide
gacgacaataatacggcggtgcctc

SEQ ID NO: 713618 - DNA, 25 bp, Artificial sequence
  Synthetic oligonucleotide
gacatggacgttaagtatccggcct

SEQ ID NO: 713619 - DNA, 25 bp, Artificial sequence
  Synthetic oligonucleotide
cgtgacgactgcatagtggtcggtc

SEQ ID NO: 713620 - DNA, 25 bp, Artificial sequence
  Synthetic oligonucleotide
ggctagtattgagatctacgggcgg

SEQ ID NO: 713621 - DNA, 25 bp, Artificial sequence
  Synthetic oligonucleotide
ggctagtattgacatctacgggcgg

SEQ ID NO: 713622 - DNA, 25 bp, Artificial sequence
  Synthetic oligonucleotide
ctaggctagtattgacatctacggg

SEQ ID NO: 713623 - DNA, 25 bp, Artificial sequence
  Synthetic oligonucleotide
ctaggctagtatagacatctacggg

SEQ ID NO: 713624 - DNA, 25 bp, Artificial sequence
  Synthetic oligonucleotide
gtgaagtgctagcctagtattgaca

SEQ ID NO: 713625 - DNA, 25 bp, Artificial sequence
  Synthetic oligonucleotide
gtgaagtgctaggctagtattgaca

SEQ ID NO: 713626 - DNA, 25 bp, Artificial sequence
  Synthetic oligonucleotide
tcgaatgtgtaaacgtcaactcgta

SEQ ID NO: 713627 - DNA, 25 bp, Artificial sequence
  Synthetic oligonucleotide
atgagactactctgtactagatggt

SEQ ID NO: 713628 - DNA, 25 bp, Artificial sequence
  Synthetic oligonucleotide
ccgaccatatatcggtcttgctgat

SEQ ID NO: 713629 - DNA, 25 bp, Artificial sequence
  Synthetic oligonucleotide
tcgaatgtgtaatcgtcaactcgta

SEQ ID NO: 713630 - DNA, 25 bp, Artificial sequence
  Synthetic oligonucleotide
ccgaccatatatgggtcttgctgat

SEQ ID NO: 713631 - DNA, 25 bp, Artificial sequence
  Synthetic oligonucleotide
actggtccacatatagacatacttc

SEQ ID NO: 713632 - DNA, 25 bp, Artificial sequence
  Synthetic oligonucleotide
actggtccacatttagacatacttc

SEQ ID NO: 713633 - DNA, 25 bp, Artificial sequence
  Synthetic oligonucleotide
agcgtgctcctagatagcacgagcg

SEQ ID NO: 713634 - DNA, 25 bp, Artificial sequence
  Synthetic oligonucleotide
agcgtgctcctacatagcacgagcg

SEQ ID NO: 713635 - DNA, 25 bp, Artificial sequence
  Synthetic oligonucleotide
tcttatcgctgattgtctaggattc

SEQ ID NO: 713636 - DNA, 25 bp, Artificial sequence
  Synthetic oligonucleotide
tcttatcgctgaatgtctaggattc

SEQ ID NO: 713637 - DNA, 25 bp, Artificial sequence
  Synthetic oligonucleotide
gattctcgtcaatgatctacgatcc

SEQ ID NO: 713638 - DNA, 25 bp, Artificial sequence
  Synthetic oligonucleotide
gattctcgtcaaagatctacgatcc

SEQ ID NO: 713639 - DNA, 25 bp, Artificial sequence
  Synthetic oligonucleotide
cctgaggatttaatcacctgactcg

SEQ ID NO: 713640 - DNA, 25 bp, Artificial sequence
  Synthetic oligonucleotide
atgagactactcagtactagatggt

SEQ ID NO: 713641 - DNA, 25 bp, Artificial sequence
  Synthetic oligonucleotide
cctgaggatttattcacctgactcg

SEQ ID NO: 713642 - DNA, 25 bp, Artificial sequence
  Synthetic oligonucleotide
ctaggctagtatagacatctacggg

SEQ ID NO: 713643 - DNA, 25 bp, Artificial sequence
  Synthetic oligonucleotide
atgagactactcagtactagatggt

SEQ ID NO: 713644 - DNA, 25 bp, Artificial sequence
  Synthetic oligonucleotide
cctgaggatttattcacctgactcg

SEQ ID NO: 713645 - DNA, 25 bp, Artificial sequence
  Synthetic oligonucleotide
atgagactactctgtactagatggt

SEQ ID NO: 713646 - DNA, 25 bp, Artificial sequence
  Synthetic oligonucleotide
tcgaatgtgtaaacgtcaactcgta

SEQ ID NO: 713647 - DNA, 25 bp, Artificial sequence
  Synthetic oligonucleotide
tcgaatgtgtaatcgtcaactcgta

SEQ ID NO: 713648 - DNA, 25 bp, Artificial sequence
  Synthetic oligonucleotide
gtgaagtgctaggctagtattgaca

SEQ ID NO: 713649 - DNA, 25 bp, Artificial sequence
  Synthetic oligonucleotide
ctaggctagtattgacatctacggg

SEQ ID NO: 713650 - DNA, 25 bp, Artificial sequence
  Synthetic oligonucleotide
ggctagtattgagatctacgggcgg

SEQ ID NO: 713651 - DNA, 25 bp, Artificial sequence
  Synthetic oligonucleotide
ggctagtattgacatctacgggcgg

SEQ ID NO: 713652 - DNA, 25 bp, Artificial sequence
  Synthetic oligonucleotide
ccgaccatatatcggtcttgctgat

SEQ ID NO: 713653 - DNA, 25 bp, Artificial sequence
  Synthetic oligonucleotide
gattctcgtcaatgatctacgatcc

SEQ ID NO: 713654 - DNA, 25 bp, Artificial sequence
  Synthetic oligonucleotide
gtgaagtgctagcctagtattgaca

SEQ ID NO: 713655 - DNA, 25 bp, Artificial sequence
  Synthetic oligonucleotide
cctgaggatttaatcacctgactcg

SEQ ID NO: 713656 - DNA, 25 bp, Artificial sequence
  Synthetic oligonucleotide
ccgaccatatatgggtcttgctgat

SEQ ID NO: 713657 - DNA, 25 bp, Artificial sequence
  Synthetic oligonucleotide
gattctcgtcaaagatctacgatcc

SEQ ID NO: 713658 - DNA, 25 bp, Artificial sequence
  Synthetic oligonucleotide
tcttatcgctgaatgtctaggattc

SEQ ID NO: 713659 - DNA, 25 bp, Artificial sequence
  Synthetic oligonucleotide
tcttatcgctgattgtctaggattc

SEQ ID NO: 713660 - DNA, 25 bp, Artificial sequence
  Synthetic oligonucleotide
agcgtgctcctacatagcacgagcg

SEQ ID NO: 713661 - DNA, 25 bp, Artificial sequence
  Synthetic oligonucleotide
agcgtgctcctagatagcacgagcg

SEQ ID NO: 713662 - DNA, 25 bp, Artificial sequence
  Synthetic oligonucleotide
actggtccacatatagacatacttc

SEQ ID NO: 713663 - DNA, 25 bp, Artificial sequence
  Synthetic oligonucleotide
actggtccacatttagacatacttc

SEQ ID NO: 713664 - DNA, 25 bp, Artificial sequence
  Synthetic oligonucleotide
tcttagagcttaacgccatgtctgt

SEQ ID NO: 713665 - DNA, 25 bp, Artificial sequence
  Synthetic oligonucleotide
aggcaatgtgtccgaacggcgagct

SEQ ID NO: 713666 - DNA, 25 bp, Artificial sequence
  Synthetic oligonucleotide
tcaggtcatatgacgcgggttctgc

SEQ ID NO: 713667 - DNA, 25 bp, Artificial sequence
  Synthetic oligonucleotide
tcaggtcatatgtcgcgggttctgc

SEQ ID NO: 713668 - DNA, 25 bp, Artificial sequence
  Synthetic oligonucleotide
cgctatctcgtaaggggtccgtctg

SEQ ID NO: 713669 - DNA, 25 bp, Artificial sequence
  Synthetic oligonucleotide
cgctatctcgtatggggtccgtctg

SEQ ID NO: 713670 - DNA, 25 bp, Artificial sequence
  Synthetic oligonucleotide
catatagccatctaagcgctcgata

SEQ ID NO: 713671 - DNA, 25 bp, Artificial sequence
  Synthetic oligonucleotide
catatagccatcaaagcgctcgata

SEQ ID NO: 713672 - DNA, 25 bp, Artificial sequence
  Synthetic oligonucleotide
atcgctcctcgaaatgtacggatag

SEQ ID NO: 713673 - DNA, 25 bp, Artificial sequence
  Synthetic oligonucleotide
atcgctcctcgatatgtacggatag

SEQ ID NO: 713674 - DNA, 25 bp, Artificial sequence
  Synthetic oligonucleotide
aggcaatgtgtcggaacggcgagct

SEQ ID NO: 713675 - DNA, 25 bp, Artificial sequence
  Synthetic oligonucleotide
gtacggataggccacggcatgtacg

SEQ ID NO: 713676 - DNA, 25 bp, Artificial sequence
  Synthetic oligonucleotide
gtacggataggcgacggcatgtacg

SEQ ID NO: 713677 - DNA, 25 bp, Artificial sequence
  Synthetic oligonucleotide
ataggccacggcttgtacgagcata

SEQ ID NO: 713678 - DNA, 25 bp, Artificial sequence
  Synthetic oligonucleotide
ataggccacggcatgtacgagcata

SEQ ID NO: 713679 - DNA, 25 bp, Artificial sequence
  Synthetic oligonucleotide
gcataagccgaagtgcacgagcata

SEQ ID NO: 713680 - DNA, 25 bp, Artificial sequence
  Synthetic oligonucleotide
gcataagccgaactgcacgagcata

SEQ ID NO: 713681 - DNA, 25 bp, Artificial sequence
  Synthetic oligonucleotide
gacactgatctgtgagtcgcttaaa

SEQ ID NO: 713682 - DNA, 25 bp, Artificial sequence
  Synthetic oligonucleotide
gacactgatctgagagtcgcttaaa

SEQ ID NO: 713683 - DNA, 25 bp, Artificial sequence
  Synthetic oligonucleotide
cgcttaaatcatctgcgtgtcttag

SEQ ID NO: 713684 - DNA, 25 bp, Artificial sequence
  Synthetic oligonucleotide
tcttagagcttatcgccatgtctgt

SEQ ID NO: 713685 - DNA, 25 bp, Artificial sequence
  Synthetic oligonucleotide
cgcttaaatcatgtgcgtgtcttag

SEQ ID NO: 713686 - DNA, 25 bp, Artificial sequence
  Synthetic oligonucleotide
gtacggataggcgacggcatgtacg

SEQ ID NO: 713687 - DNA, 25 bp, Artificial sequence
  Synthetic oligonucleotide
ataggccacggcttgtacgagcata

SEQ ID NO: 713688 - DNA, 25 bp, Artificial sequence
  Synthetic oligonucleotide
tcttagagcttaacgccatgtctgt

SEQ ID NO: 713689 - DNA, 25 bp, Artificial sequence
  Synthetic oligonucleotide
aggcaatgtgtcggaacggcgagct

SEQ ID NO: 713690 - DNA, 25 bp, Artificial sequence
  Synthetic oligonucleotide
aggcaatgtgtccgaacggcgagct

SEQ ID NO: 713691 - DNA, 25 bp, Artificial sequence
  Synthetic oligonucleotide
tcaggtcatatgacgcgggttctgc

SEQ ID NO: 713692 - DNA, 25 bp, Artificial sequence
  Synthetic oligonucleotide
tcaggtcatatgtcgcgggttctgc

SEQ ID NO: 713693 - DNA, 25 bp, Artificial sequence
  Synthetic oligonucleotide
cgctatctcgtatggggtccgtctg

SEQ ID NO: 713694 - DNA, 25 bp, Artificial sequence
  Synthetic oligonucleotide
cgctatctcgtaaggggtccgtctg

SEQ ID NO: 713695 - DNA, 25 bp, Artificial sequence
  Synthetic oligonucleotide
catatagccatcaaagcgctcgata

SEQ ID NO: 713696 - DNA, 25 bp, Artificial sequence
  Synthetic oligonucleotide
catatagccatctaagcgctcgata

SEQ ID NO: 713697 - DNA, 25 bp, Artificial sequence
  Synthetic oligonucleotide
atcgctcctcgatatgtacggatag

SEQ ID NO: 713698 - DNA, 25 bp, Artificial sequence
  Synthetic oligonucleotide
tcttagagcttatcgccatgtctgt

SEQ ID NO: 713699 - DNA, 25 bp, Artificial sequence
  Synthetic oligonucleotide
gtacggataggccacggcatgtacg

SEQ ID NO: 713700 - DNA, 25 bp, Artificial sequence
  Synthetic oligonucleotide
ataggccacggcatgtacgagcata

SEQ ID NO: 713701 - DNA, 25 bp, Artificial sequence
  Synthetic oligonucleotide
gcataagccgaactgcacgagcata

SEQ ID NO: 713702 - DNA, 25 bp, Artificial sequence
  Synthetic oligonucleotide
gcataagccgaagtgcacgagcata

SEQ ID NO: 713703 - DNA, 25 bp, Artificial sequence
  Synthetic oligonucleotide
gacactgatctgagagtcgcttaaa

SEQ ID NO: 713704 - DNA, 25 bp, Artificial sequence
  Synthetic oligonucleotide
gacactgatctgtgagtcgcttaaa

SEQ ID NO: 713705 - DNA, 25 bp, Artificial sequence
  Synthetic oligonucleotide
cgcttaaatcatgtgcgtgtcttag

SEQ ID NO: 713706 - DNA, 25 bp, Artificial sequence
  Synthetic oligonucleotide
cgcttaaatcatctgcgtgtcttag

SEQ ID NO: 713707 - DNA, 25 bp, Artificial sequence
  Synthetic oligonucleotide
atcgctcctcgaaatgtacggatag

SEQ ID NO: 713708 - DNA, 25 bp, Artificial sequence
  Synthetic oligonucleotide
gatcgctagtacgagttagagatgc

SEQ ID NO: 713709 - DNA, 25 bp, Artificial sequence
  Synthetic oligonucleotide
gatcgctagtaccagttagagatgc

SEQ ID NO: 713710 - DNA, 25 bp, Artificial sequence
  Synthetic oligonucleotide
gcagtctatcagttcgctagtacga

SEQ ID NO: 713711 - DNA, 25 bp, Artificial sequence
  Synthetic oligonucleotide
gcagtctatcagatcgctagtacga

SEQ ID NO: 713712 - DNA, 25 bp, Artificial sequence
  Synthetic oligonucleotide
ctaacgacgctgctagcagtctatc

SEQ ID NO: 713713 - DNA, 25 bp, Artificial sequence
  Synthetic oligonucleotide
ctaacgacgctggtagcagtctatc

SEQ ID NO: 713714 - DNA, 25 bp, Artificial sequence
  Synthetic oligonucleotide
gcactcgcgtaaagacgctgcatcg

SEQ ID NO: 713715 - DNA, 25 bp, Artificial sequence
  Synthetic oligonucleotide
tacggtataacaaggcgtgctacgg

SEQ ID NO: 713716 - DNA, 25 bp, Artificial sequence
  Synthetic oligonucleotide
gctctaaatcatgatgcgacagtct

SEQ ID NO: 713717 - DNA, 25 bp, Artificial sequence
  Synthetic oligonucleotide
tacggtataacatggcgtgctacgg

SEQ ID NO: 713718 - DNA, 25 bp, Artificial sequence
  Synthetic oligonucleotide
gcactcgcgtaatgacgctgcatcg

SEQ ID NO: 713719 - DNA, 25 bp, Artificial sequence
  Synthetic oligonucleotide
cgctcagtatgaaccatgagcgccg

SEQ ID NO: 713720 - DNA, 25 bp, Artificial sequence
  Synthetic oligonucleotide
cgctcagtatgatccatgagcgccg

SEQ ID NO: 713721 - DNA, 25 bp, Artificial sequence
  Synthetic oligonucleotide
tcacatgatacatcgctctaaatca

SEQ ID NO: 713722 - DNA, 25 bp, Artificial sequence
  Synthetic oligonucleotide
tctgagacactgttcgagcattaag

SEQ ID NO: 713723 - DNA, 25 bp, Artificial sequence
  Synthetic oligonucleotide
gctctaaatcatcatgcgacagtct

SEQ ID NO: 713724 - DNA, 25 bp, Artificial sequence
  Synthetic oligonucleotide
catgctcgactcagagacactgatc

SEQ ID NO: 713725 - DNA, 25 bp, Artificial sequence
  Synthetic oligonucleotide
catgctcgactctgagacactgatc

SEQ ID NO: 713726 - DNA, 25 bp, Artificial sequence
  Synthetic oligonucleotide
tggtgttcgatagccggatcgggtt

SEQ ID NO: 713727 - DNA, 25 bp, Artificial sequence
  Synthetic oligonucleotide
tggtgttcgatacccggatcgggtt

SEQ ID NO: 713728 - DNA, 25 bp, Artificial sequence
  Synthetic oligonucleotide
tcacatgatacaacgctctaaatca

SEQ ID NO: 713729 - DNA, 25 bp, Artificial sequence
  Synthetic oligonucleotide
tctgagacactgatcgagcattaag

SEQ ID NO: 713730 - DNA, 25 bp, Artificial sequence
  Synthetic oligonucleotide
tggtgttcgatagccggatcgggtt

SEQ ID NO: 713731 - DNA, 25 bp, Artificial sequence
  Synthetic oligonucleotide
tctgagacactgttcgagcattaag

SEQ ID NO: 713732 - DNA, 25 bp, Artificial sequence
  Synthetic oligonucleotide
tggtgttcgatacccggatcgggtt

SEQ ID NO: 713733 - DNA, 25 bp, Artificial sequence
  Synthetic oligonucleotide
tacggtataacatggcgtgctacgg

SEQ ID NO: 713734 - DNA, 25 bp, Artificial sequence
  Synthetic oligonucleotide
tacggtataacaaggcgtgctacgg

SEQ ID NO: 713735 - DNA, 25 bp, Artificial sequence
  Synthetic oligonucleotide
ctaacgacgctgctagcagtctatc

SEQ ID NO: 713736 - DNA, 25 bp, Artificial sequence
  Synthetic oligonucleotide
ctaacgacgctggtagcagtctatc

SEQ ID NO: 713737 - DNA, 25 bp, Artificial sequence
  Synthetic oligonucleotide
gcagtctatcagttcgctagtacga

SEQ ID NO: 713738 - DNA, 25 bp, Artificial sequence
  Synthetic oligonucleotide
gcagtctatcagatcgctagtacga

SEQ ID NO: 713739 - DNA, 25 bp, Artificial sequence
  Synthetic oligonucleotide
gatcgctagtacgagttagagatgc

SEQ ID NO: 713740 - DNA, 25 bp, Artificial sequence
  Synthetic oligonucleotide
gatcgctagtaccagttagagatgc

SEQ ID NO: 713741 - DNA, 25 bp, Artificial sequence
  Synthetic oligonucleotide
gctctaaatcatgatgcgacagtct

SEQ ID NO: 713742 - DNA, 25 bp, Artificial sequence
  Synthetic oligonucleotide
gcactcgcgtaatgacgctgcatcg

SEQ ID NO: 713743 - DNA, 25 bp, Artificial sequence
  Synthetic oligonucleotide
catgctcgactctgagacactgatc

SEQ ID NO: 713744 - DNA, 25 bp, Artificial sequence
  Synthetic oligonucleotide
tctgagacactgatcgagcattaag

SEQ ID NO: 713745 - DNA, 25 bp, Artificial sequence
  Synthetic oligonucleotide
gctctaaatcatcatgcgacagtct

SEQ ID NO: 713746 - DNA, 25 bp, Artificial sequence
  Synthetic oligonucleotide
tcacatgatacatcgctctaaatca

SEQ ID NO: 713747 - DNA, 25 bp, Artificial sequence
  Synthetic oligonucleotide
tcacatgatacaacgctctaaatca

SEQ ID NO: 713748 - DNA, 25 bp, Artificial sequence
  Synthetic oligonucleotide
cgctcagtatgaaccatgagcgccg

SEQ ID NO: 713749 - DNA, 25 bp, Artificial sequence
  Synthetic oligonucleotide
cgctcagtatgatccatgagcgccg

SEQ ID NO: 713750 - DNA, 25 bp, Artificial sequence
  Synthetic oligonucleotide
gcactcgcgtaaagacgctgcatcg

SEQ ID NO: 713751 - DNA, 25 bp, Artificial sequence
  Synthetic oligonucleotide
catgctcgactcagagacactgatc

SEQ ID NO: 713752 - DNA, 25 bp, Artificial sequence
  Synthetic oligonucleotide
ccaattcaagataagtccagctcgt

SEQ ID NO: 713753 - DNA, 25 bp, Artificial sequence
  Synthetic oligonucleotide
ccaattcaagattagtccagctcgt

SEQ ID NO: 713754 - DNA, 25 bp, Artificial sequence
  Synthetic oligonucleotide
gggcacgttgttaaactgttgccgc

SEQ ID NO: 713755 - DNA, 25 bp, Artificial sequence
  Synthetic oligonucleotide
gggcacgttgtttaactgttgccgc

SEQ ID NO: 713756 - DNA, 25 bp, Artificial sequence
  Synthetic oligonucleotide
gatacttcgataccgttgtgaatag

SEQ ID NO: 713757 - DNA, 25 bp, Artificial sequence
  Synthetic oligonucleotide
gatacttcgatagcgttgtgaatag

SEQ ID NO: 713758 - DNA, 25 bp, Artificial sequence
  Synthetic oligonucleotide
agtcatcgtgagaagtatgaacgtg

SEQ ID NO: 713759 - DNA, 25 bp, Artificial sequence
  Synthetic oligonucleotide
actcgttgatagtcaaccaagctcg

SEQ ID NO: 713760 - DNA, 25 bp, Artificial sequence
  Synthetic oligonucleotide
atgtactatggagcggtcaatgtca

SEQ ID NO: 713761 - DNA, 25 bp, Artificial sequence
  Synthetic oligonucleotide
ctacagtgatagcatatagggtacg

SEQ ID NO: 713762 - DNA, 25 bp, Artificial sequence
  Synthetic oligonucleotide
agtcatcgtgagtagtatgaacgtg

SEQ ID NO: 713763 - DNA, 25 bp, Artificial sequence
  Synthetic oligonucleotide
actcgttgatagacaaccaagctcg

SEQ ID NO: 713764 - DNA, 25 bp, Artificial sequence
  Synthetic oligonucleotide
tacgagatgagctacgtaactacag

SEQ ID NO: 713765 - DNA, 25 bp, Artificial sequence
  Synthetic oligonucleotide
tacgagatgagcaacgtaactacag

SEQ ID NO: 713766 - DNA, 25 bp, Artificial sequence
  Synthetic oligonucleotide
atgagctacgtaactacagtgatag

SEQ ID NO: 713767 - DNA, 25 bp, Artificial sequence
  Synthetic oligonucleotide
actagttgacttggagtatgccatg

SEQ ID NO: 713768 - DNA, 25 bp, Artificial sequence
  Synthetic oligonucleotide
ctacagtgataggatatagggtacg

SEQ ID NO: 713769 - DNA, 25 bp, Artificial sequence
  Synthetic oligonucleotide
aggtcgtagtcgtattagtcaggtt

SEQ ID NO: 713770 - DNA, 25 bp, Artificial sequence
  Synthetic oligonucleotide
aggtcgtagtcgaattagtcaggtt

SEQ ID NO: 713771 - DNA, 25 bp, Artificial sequence
  Synthetic oligonucleotide
actagttgacttcgagtatgccatg

SEQ ID NO: 713772 - DNA, 25 bp, Artificial sequence
  Synthetic oligonucleotide
atgtactatggaccggtcaatgtca

SEQ ID NO: 713773 - DNA, 25 bp, Artificial sequence
  Synthetic oligonucleotide
atgagctacgtatctacagtgatag

SEQ ID NO: 713774 - DNA, 25 bp, Artificial sequence
  Synthetic oligonucleotide
gggcacgttgttaaactgttgccgc

SEQ ID NO: 713775 - DNA, 25 bp, Artificial sequence
  Synthetic oligonucleotide
atgtactatggaccggtcaatgtca

SEQ ID NO: 713776 - DNA, 25 bp, Artificial sequence
  Synthetic oligonucleotide
actagttgacttggagtatgccatg

SEQ ID NO: 713777 - DNA, 25 bp, Artificial sequence
  Synthetic oligonucleotide
agtcatcgtgagtagtatgaacgtg

SEQ ID NO: 713778 - DNA, 25 bp, Artificial sequence
  Synthetic oligonucleotide
agtcatcgtgagaagtatgaacgtg

SEQ ID NO: 713779 - DNA, 25 bp, Artificial sequence
  Synthetic oligonucleotide
gatacttcgatagcgttgtgaatag

SEQ ID NO: 713780 - DNA, 25 bp, Artificial sequence
  Synthetic oligonucleotide
atgtactatggagcggtcaatgtca

SEQ ID NO: 713781 - DNA, 25 bp, Artificial sequence
  Synthetic oligonucleotide
gggcacgttgtttaactgttgccgc

SEQ ID NO: 713782 - DNA, 25 bp, Artificial sequence
  Synthetic oligonucleotide
ccaattcaagattagtccagctcgt

SEQ ID NO: 713783 - DNA, 25 bp, Artificial sequence
  Synthetic oligonucleotide
ccaattcaagataagtccagctcgt

SEQ ID NO: 713784 - DNA, 25 bp, Artificial sequence
  Synthetic oligonucleotide
actcgttgatagtcaaccaagctcg

SEQ ID NO: 713785 - DNA, 25 bp, Artificial sequence
  Synthetic oligonucleotide
aggtcgtagtcgaattagtcaggtt

SEQ ID NO: 713786 - DNA, 25 bp, Artificial sequence
  Synthetic oligonucleotide
tacgagatgagcaacgtaactacag

SEQ ID NO: 713787 - DNA, 25 bp, Artificial sequence
  Synthetic oligonucleotide
tacgagatgagctacgtaactacag

SEQ ID NO: 713788 - DNA, 25 bp, Artificial sequence
  Synthetic oligonucleotide
atgagctacgtaactacagtgatag

SEQ ID NO: 713789 - DNA, 25 bp, Artificial sequence
  Synthetic oligonucleotide
atgagctacgtatctacagtgatag

SEQ ID NO: 713790 - DNA, 25 bp, Artificial sequence
  Synthetic oligonucleotide
ctacagtgatagcatatagggtacg

SEQ ID NO: 713791 - DNA, 25 bp, Artificial sequence
  Synthetic oligonucleotide
ctacagtgataggatatagggtacg

SEQ ID NO: 713792 - DNA, 25 bp, Artificial sequence
  Synthetic oligonucleotide
aggtcgtagtcgtattagtcaggtt

SEQ ID NO: 713793 - DNA, 25 bp, Artificial sequence
  Synthetic oligonucleotide
actcgttgatagacaaccaagctcg

SEQ ID NO: 713794 - DNA, 25 bp, Artificial sequence
  Synthetic oligonucleotide
gatacttcgataccgttgtgaatag

SEQ ID NO: 713795 - DNA, 25 bp, Artificial sequence
  Synthetic oligonucleotide
actagttgacttcgagtatgccatg

SEQ ID NO: 713796 - DNA, 25 bp, Artificial sequence
  Synthetic oligonucleotide
cttacttacgaggctactattcgat

SEQ ID NO: 713797 - DNA, 25 bp, Artificial sequence
  Synthetic oligonucleotide
cttacttacgagcctactattcgat

SEQ ID NO: 713798 - DNA, 25 bp, Artificial sequence
  Synthetic oligonucleotide
tgctacatcagtggcgatgttcgta

SEQ ID NO: 713799 - DNA, 25 bp, Artificial sequence
  Synthetic oligonucleotide
tgctacatcagtcgcgatgttcgta

SEQ ID NO: 713800 - DNA, 25 bp, Artificial sequence
  Synthetic oligonucleotide
tgctcgatacgggaaatatagctcc

SEQ ID NO: 713801 - DNA, 25 bp, Artificial sequence
  Synthetic oligonucleotide
tgctcgatacggcaaatatagctcc

SEQ ID NO: 713802 - DNA, 25 bp, Artificial sequence
  Synthetic oligonucleotide
gatacgggcgatttaatgctcgata

SEQ ID NO: 713803 - DNA, 25 bp, Artificial sequence
  Synthetic oligonucleotide
ggtgtctaatacatcgtgatacggg

SEQ ID NO: 713804 - DNA, 25 bp, Artificial sequence
  Synthetic oligonucleotide
ctatctggtaattactgcggtgatc

SEQ ID NO: 713805 - DNA, 25 bp, Artificial sequence
  Synthetic oligonucleotide
gatacgggcgatataatgctcgata

SEQ ID NO: 713806 - DNA, 25 bp, Artificial sequence
  Synthetic oligonucleotide
ctatctggtaataactgcggtgatc

SEQ ID NO: 713807 - DNA, 25 bp, Artificial sequence
  Synthetic oligonucleotide
atctggtaataagtgcggtgatctg

SEQ ID NO: 713808 - DNA, 25 bp, Artificial sequence
  Synthetic oligonucleotide
atctggtaataactgcggtgatctg

SEQ ID NO: 713809 - DNA, 25 bp, Artificial sequence
  Synthetic oligonucleotide
cctggtagcaaatacggcgagctgg

SEQ ID NO: 713810 - DNA, 25 bp, Artificial sequence
  Synthetic oligonucleotide
cctggtagcaaaaacggcgagctgg

SEQ ID NO: 713811 - DNA, 25 bp, Artificial sequence
  Synthetic oligonucleotide
caatataacacgcagtcgtcaatca

SEQ ID NO: 713812 - DNA, 25 bp, Artificial sequence
  Synthetic oligonucleotide
caatataacacggagtcgtcaatca

SEQ ID NO: 713813 - DNA, 25 bp, Artificial sequence
  Synthetic oligonucleotide
ccacctctggtcaaatatagcgccc

SEQ ID NO: 713814 - DNA, 25 bp, Artificial sequence
  Synthetic oligonucleotide
ccacctctggtctaatatagcgccc

SEQ ID NO: 713815 - DNA, 25 bp, Artificial sequence
  Synthetic oligonucleotide
ccctgtggtcgtttaatcgagcgcg

SEQ ID NO: 713816 - DNA, 25 bp, Artificial sequence
  Synthetic oligonucleotide
ggtgtctaatacttcgtgatacggg

SEQ ID NO: 713817 - DNA, 25 bp, Artificial sequence
  Synthetic oligonucleotide
ccctgtggtcgtataatcgagcgcg

SEQ ID NO: 713818 - DNA, 25 bp, Artificial sequence
  Synthetic oligonucleotide
tgctacatcagtggcgatgttcgta

SEQ ID NO: 713819 - DNA, 25 bp, Artificial sequence
  Synthetic oligonucleotide
ccctgtggtcgtataatcgagcgcg

SEQ ID NO: 713820 - DNA, 25 bp, Artificial sequence
  Synthetic oligonucleotide
ggtgtctaatacatcgtgatacggg

SEQ ID NO: 713821 - DNA, 25 bp, Artificial sequence
  Synthetic oligonucleotide
ggtgtctaatacttcgtgatacggg

SEQ ID NO: 713822 - DNA, 25 bp, Artificial sequence
  Synthetic oligonucleotide
gatacgggcgatataatgctcgata

SEQ ID NO: 713823 - DNA, 25 bp, Artificial sequence
  Synthetic oligonucleotide
gatacgggcgatttaatgctcgata

SEQ ID NO: 713824 - DNA, 25 bp, Artificial sequence
  Synthetic oligonucleotide
tgctcgatacgggaaatatagctcc

SEQ ID NO: 713825 - DNA, 25 bp, Artificial sequence
  Synthetic oligonucleotide
tgctacatcagtcgcgatgttcgta

SEQ ID NO: 713826 - DNA, 25 bp, Artificial sequence
  Synthetic oligonucleotide
cttacttacgaggctactattcgat

SEQ ID NO: 713827 - DNA, 25 bp, Artificial sequence
  Synthetic oligonucleotide
cttacttacgagcctactattcgat

SEQ ID NO: 713828 - DNA, 25 bp, Artificial sequence
  Synthetic oligonucleotide
ctatctggtaataactgcggtgatc

SEQ ID NO: 713829 - DNA, 25 bp, Artificial sequence
  Synthetic oligonucleotide
ccacctctggtcaaatatagcgccc

SEQ ID NO: 713830 - DNA, 25 bp, Artificial sequence
  Synthetic oligonucleotide
ccctgtggtcgtttaatcgagcgcg

SEQ ID NO: 713831 - DNA, 25 bp, Artificial sequence
  Synthetic oligonucleotide
tgctcgatacggcaaatatagctcc

SEQ ID NO: 713832 - DNA, 25 bp, Artificial sequence
  Synthetic oligonucleotide
ccacctctggtctaatatagcgccc

SEQ ID NO: 713833 - DNA, 25 bp, Artificial sequence
  Synthetic oligonucleotide
ctatctggtaattactgcggtgatc

SEQ ID NO: 713834 - DNA, 25 bp, Artificial sequence
  Synthetic oligonucleotide
caatataacacggagtcgtcaatca

SEQ ID NO: 713835 - DNA, 25 bp, Artificial sequence
  Synthetic oligonucleotide
caatataacacgcagtcgtcaatca

SEQ ID NO: 713836 - DNA, 25 bp, Artificial sequence
  Synthetic oligonucleotide
cctggtagcaaatacggcgagctgg

SEQ ID NO: 713837 - DNA, 25 bp, Artificial sequence
  Synthetic oligonucleotide
cctggtagcaaaaacggcgagctgg

SEQ ID NO: 713838 - DNA, 25 bp, Artificial sequence
  Synthetic oligonucleotide
atctggtaataagtgcggtgatctg

SEQ ID NO: 713839 - DNA, 25 bp, Artificial sequence
  Synthetic oligonucleotide
atctggtaataactgcggtgatctg

SEQ ID NO: 713840 - DNA, 25 bp, Artificial sequence
  Synthetic oligonucleotide
tcatcggtccgatcaattagtctag

SEQ ID NO: 713841 - DNA, 25 bp, Artificial sequence
  Synthetic oligonucleotide
cacgactgaatcgagcttaagagcc

SEQ ID NO: 713842 - DNA, 25 bp, Artificial sequence
  Synthetic oligonucleotide
tgtcgtccatgtttagacagtgcgc

SEQ ID NO: 713843 - DNA, 25 bp, Artificial sequence
  Synthetic oligonucleotide
tgtcgtccatgtatagacagtgcgc

SEQ ID NO: 713844 - DNA, 25 bp, Artificial sequence
  Synthetic oligonucleotide
atcatataggatccggcgatctcat

SEQ ID NO: 713845 - DNA, 25 bp, Artificial sequence
  Synthetic oligonucleotide
atcatataggatgcggcgatctcat

SEQ ID NO: 713846 - DNA, 25 bp, Artificial sequence
  Synthetic oligonucleotide
ctcatacagcgtaacggtcgctgcg

SEQ ID NO: 713847 - DNA, 25 bp, Artificial sequence
  Synthetic oligonucleotide
ctcatacagcgttacggtcgctgcg

SEQ ID NO: 713848 - DNA, 25 bp, Artificial sequence
  Synthetic oligonucleotide
tcatcggtccgaacaattagtctag

SEQ ID NO: 713849 - DNA, 25 bp, Artificial sequence
  Synthetic oligonucleotide
tgtatatcgaggtgagtctatctgg

SEQ ID NO: 713850 - DNA, 25 bp, Artificial sequence
  Synthetic oligonucleotide
atcgagtgagtacatgattcgtcag

SEQ ID NO: 713851 - DNA, 25 bp, Artificial sequence
  Synthetic oligonucleotide
atcgagtgagtagatgattcgtcag

SEQ ID NO: 713852 - DNA, 25 bp, Artificial sequence
  Synthetic oligonucleotide
tgtggatcaattacagttaggccgc

SEQ ID NO: 713853 - DNA, 25 bp, Artificial sequence
  Synthetic oligonucleotide
tgtggatcaatttcagttaggccgc

SEQ ID NO: 713854 - DNA, 25 bp, Artificial sequence
  Synthetic oligonucleotide
ccgctgacacattagtaacgtcggc

SEQ ID NO: 713855 - DNA, 25 bp, Artificial sequence
  Synthetic oligonucleotide
ccgctgacacataagtaacgtcggc

SEQ ID NO: 713856 - DNA, 25 bp, Artificial sequence
  Synthetic oligonucleotide
tgtgattctcgagcgatttatacat

SEQ ID NO: 713857 - DNA, 25 bp, Artificial sequence
  Synthetic oligonucleotide
tgtgattctcgaccgatttatacat

SEQ ID NO: 713858 - DNA, 25 bp, Artificial sequence
  Synthetic oligonucleotide
ctgacagactggatggttatccaat

SEQ ID NO: 713859 - DNA, 25 bp, Artificial sequence
  Synthetic oligonucleotide
cacgactgaatccagcttaagagcc

SEQ ID NO: 713860 - DNA, 25 bp, Artificial sequence
  Synthetic oligonucleotide
tgtatatcgaggagagtctatctgg

SEQ ID NO: 713861 - DNA, 25 bp, Artificial sequence
  Synthetic oligonucleotide
ctgacagactggttggttatccaat

SEQ ID NO: 713862 - DNA, 25 bp, Artificial sequence
  Synthetic oligonucleotide
atcatataggatccggcgatctcat

SEQ ID NO: 713863 - DNA, 25 bp, Artificial sequence
  Synthetic oligonucleotide
cacgactgaatccagcttaagagcc

SEQ ID NO: 713864 - DNA, 25 bp, Artificial sequence
  Synthetic oligonucleotide
cacgactgaatcgagcttaagagcc

SEQ ID NO: 713865 - DNA, 25 bp, Artificial sequence
  Synthetic oligonucleotide
tgtatatcgaggagagtctatctgg

SEQ ID NO: 713866 - DNA, 25 bp, Artificial sequence
  Synthetic oligonucleotide
tgtatatcgaggtgagtctatctgg

SEQ ID NO: 713867 - DNA, 25 bp, Artificial sequence
  Synthetic oligonucleotide
tgtcgtccatgtttagacagtgcgc

SEQ ID NO: 713868 - DNA, 25 bp, Artificial sequence
  Synthetic oligonucleotide
atcatataggatgcggcgatctcat

SEQ ID NO: 713869 - DNA, 25 bp, Artificial sequence
  Synthetic oligonucleotide
ctcatacagcgtaacggtcgctgcg

SEQ ID NO: 713870 - DNA, 25 bp, Artificial sequence
  Synthetic oligonucleotide
ctcatacagcgttacggtcgctgcg

SEQ ID NO: 713871 - DNA, 25 bp, Artificial sequence
  Synthetic oligonucleotide
tcatcggtccgatcaattagtctag

SEQ ID NO: 713872 - DNA, 25 bp, Artificial sequence
  Synthetic oligonucleotide
tcatcggtccgaacaattagtctag

SEQ ID NO: 713873 - DNA, 25 bp, Artificial sequence
  Synthetic oligonucleotide
ctgacagactggatggttatccaat

SEQ ID NO: 713874 - DNA, 25 bp, Artificial sequence
  Synthetic oligonucleotide
tgtcgtccatgtatagacagtgcgc

SEQ ID NO: 713875 - DNA, 25 bp, Artificial sequence
  Synthetic oligonucleotide
ctgacagactggttggttatccaat

SEQ ID NO: 713876 - DNA, 25 bp, Artificial sequence
  Synthetic oligonucleotide
atcgagtgagtagatgattcgtcag

SEQ ID NO: 713877 - DNA, 25 bp, Artificial sequence
  Synthetic oligonucleotide
tgtgattctcgaccgatttatacat

SEQ ID NO: 713878 - DNA, 25 bp, Artificial sequence
  Synthetic oligonucleotide
tgtgattctcgagcgatttatacat

SEQ ID NO: 713879 - DNA, 25 bp, Artificial sequence
  Synthetic oligonucleotide
ccgctgacacataagtaacgtcggc

SEQ ID NO: 713880 - DNA, 25 bp, Artificial sequence
  Synthetic oligonucleotide
ccgctgacacattagtaacgtcggc

SEQ ID NO: 713881 - DNA, 25 bp, Artificial sequence
  Synthetic oligonucleotide
tgtggatcaatttcagttaggccgc

SEQ ID NO: 713882 - DNA, 25 bp, Artificial sequence
  Synthetic oligonucleotide
tgtggatcaattacagttaggccgc

SEQ ID NO: 713883 - DNA, 25 bp, Artificial sequence
  Synthetic oligonucleotide
atcgagtgagtacatgattcgtcag

SEQ ID NO: 713884 - DNA, 25 bp, Artificial sequence
  Synthetic oligonucleotide
gtatgtaacgctttggcgtgctagt

SEQ ID NO: 713885 - DNA, 25 bp, Artificial sequence
  Synthetic oligonucleotide
cagtacatggtagttcagccaatag

SEQ ID NO: 713886 - DNA, 25 bp, Artificial sequence
  Synthetic oligonucleotide
agaaggtgtgcaccctatatgatac

SEQ ID NO: 713887 - DNA, 25 bp, Artificial sequence
  Synthetic oligonucleotide
gaactgtcgatgttggtcacgactc

SEQ ID NO: 713888 - DNA, 25 bp, Artificial sequence
  Synthetic oligonucleotide
gaactgtcgatgatggtcacgactc

SEQ ID NO: 713889 - DNA, 25 bp, Artificial sequence
  Synthetic oligonucleotide
tatcatgttatagggctgcgaactg

SEQ ID NO: 713890 - DNA, 25 bp, Artificial sequence
  Synthetic oligonucleotide
tatcatgttatacggctgcgaactg

SEQ ID NO: 713891 - DNA, 25 bp, Artificial sequence
  Synthetic oligonucleotide
ctgatgacctcgaatcatgttatag

SEQ ID NO: 713892 - DNA, 25 bp, Artificial sequence
  Synthetic oligonucleotide
ctgatgacctcgtatcatgttatag

SEQ ID NO: 713893 - DNA, 25 bp, Artificial sequence
  Synthetic oligonucleotide
gtatgtaacgctatggcgtgctagt

SEQ ID NO: 713894 - DNA, 25 bp, Artificial sequence
  Synthetic oligonucleotide
agaaggtgtgcagcctatatgatac

SEQ ID NO: 713895 - DNA, 25 bp, Artificial sequence
  Synthetic oligonucleotide
tggctgagtatgtaacgctatggcg

SEQ ID NO: 713896 - DNA, 25 bp, Artificial sequence
  Synthetic oligonucleotide
tggctgagtatgaaacgctatggcg

SEQ ID NO: 713897 - DNA, 25 bp, Artificial sequence
  Synthetic oligonucleotide
aatgtatgtgctcttatcgaagcct

SEQ ID NO: 713898 - DNA, 25 bp, Artificial sequence
  Synthetic oligonucleotide
aatgtatgtgctgttatcgaagcct

SEQ ID NO: 713899 - DNA, 25 bp, Artificial sequence
  Synthetic oligonucleotide
atgtgacgcagcacttagcgcaatg

SEQ ID NO: 713900 - DNA, 25 bp, Artificial sequence
  Synthetic oligonucleotide
atgtgacgcagctcttagcgcaatg

SEQ ID NO: 713901 - DNA, 25 bp, Artificial sequence
  Synthetic oligonucleotide
ctgatcggcttaagacgtatgtgac

SEQ ID NO: 713902 - DNA, 25 bp, Artificial sequence
  Synthetic oligonucleotide
ctgatcggcttatgacgtatgtgac

SEQ ID NO: 713903 - DNA, 25 bp, Artificial sequence
  Synthetic oligonucleotide
tcagccaatagatgcctagtacgct

SEQ ID NO: 713904 - DNA, 25 bp, Artificial sequence
  Synthetic oligonucleotide
cagtacatggtacttcagccaatag

SEQ ID NO: 713905 - DNA, 25 bp, Artificial sequence
  Synthetic oligonucleotide
tcagccaatagaagcctagtacgct

SEQ ID NO: 713906 - DNA, 25 bp, Artificial sequence
  Synthetic oligonucleotide
agaaggtgtgcaccctatatgatac

SEQ ID NO: 713907 - DNA, 25 bp, Artificial sequence
  Synthetic oligonucleotide
agaaggtgtgcagcctatatgatac

SEQ ID NO: 713908 - DNA, 25 bp, Artificial sequence
  Synthetic oligonucleotide
gaactgtcgatgttggtcacgactc

SEQ ID NO: 713909 - DNA, 25 bp, Artificial sequence
  Synthetic oligonucleotide
gaactgtcgatgatggtcacgactc

SEQ ID NO: 713910 - DNA, 25 bp, Artificial sequence
  Synthetic oligonucleotide
tatcatgttatacggctgcgaactg

SEQ ID NO: 713911 - DNA, 25 bp, Artificial sequence
  Synthetic oligonucleotide
tatcatgttatagggctgcgaactg

SEQ ID NO: 713912 - DNA, 25 bp, Artificial sequence
  Synthetic oligonucleotide
ctgatgacctcgaatcatgttatag

SEQ ID NO: 713913 - DNA, 25 bp, Artificial sequence
  Synthetic oligonucleotide
ctgatgacctcgtatcatgttatag

SEQ ID NO: 713914 - DNA, 25 bp, Artificial sequence
  Synthetic oligonucleotide
gtatgtaacgctttggcgtgctagt

SEQ ID NO: 713915 - DNA, 25 bp, Artificial sequence
  Synthetic oligonucleotide
gtatgtaacgctatggcgtgctagt

SEQ ID NO: 713916 - DNA, 25 bp, Artificial sequence
  Synthetic oligonucleotide
tggctgagtatgaaacgctatggcg

SEQ ID NO: 713917 - DNA, 25 bp, Artificial sequence
  Synthetic oligonucleotide
cagtacatggtacttcagccaatag

SEQ ID NO: 713918 - DNA, 25 bp, Artificial sequence
  Synthetic oligonucleotide
aatgtatgtgctcttatcgaagcct

SEQ ID NO: 713919 - DNA, 25 bp, Artificial sequence
  Synthetic oligonucleotide
aatgtatgtgctgttatcgaagcct

SEQ ID NO: 713920 - DNA, 25 bp, Artificial sequence
  Synthetic oligonucleotide
atgtgacgcagcacttagcgcaatg

SEQ ID NO: 713921 - DNA, 25 bp, Artificial sequence
  Synthetic oligonucleotide
atgtgacgcagctcttagcgcaatg

SEQ ID NO: 713922 - DNA, 25 bp, Artificial sequence
  Synthetic oligonucleotide
ctgatcggcttaagacgtatgtgac

SEQ ID NO: 713923 - DNA, 25 bp, Artificial sequence
  Synthetic oligonucleotide
ctgatcggcttatgacgtatgtgac

SEQ ID NO: 713924 - DNA, 25 bp, Artificial sequence
  Synthetic oligonucleotide
tcagccaatagaagcctagtacgct

SEQ ID NO: 713925 - DNA, 25 bp, Artificial sequence
  Synthetic oligonucleotide
tcagccaatagatgcctagtacgct

SEQ ID NO: 713926 - DNA, 25 bp, Artificial sequence
  Synthetic oligonucleotide
cagtacatggtagttcagccaatag

SEQ ID NO: 713927 - DNA, 25 bp, Artificial sequence
  Synthetic oligonucleotide
tggctgagtatgtaacgctatggcg

SEQ ID NO: 713928 - DNA, 25 bp, Artificial sequence
  Synthetic oligonucleotide
ctgtctagcactctagctggtgcat

SEQ ID NO: 713929 - DNA, 25 bp, Artificial sequence
  Synthetic oligonucleotide
ctgtctagcactgtagctggtgcat

SEQ ID NO: 713930 - DNA, 25 bp, Artificial sequence
  Synthetic oligonucleotide
cgcctaaactgggtgtctagcactg

SEQ ID NO: 713931 - DNA, 25 bp, Artificial sequence
  Synthetic oligonucleotide
cgcctaaactggctgtctagcactg

SEQ ID NO: 713932 - DNA, 25 bp, Artificial sequence
  Synthetic oligonucleotide
cgagtgctacgcctaaactggctgt

SEQ ID NO: 713933 - DNA, 25 bp, Artificial sequence
  Synthetic oligonucleotide
cgagtgctacgcgtaaactggctgt

SEQ ID NO: 713934 - DNA, 25 bp, Artificial sequence
  Synthetic oligonucleotide
gcgtataggctgatacattagctcg

SEQ ID NO: 713935 - DNA, 25 bp, Artificial sequence
  Synthetic oligonucleotide
tcggctataacaccgagtgctacgc

SEQ ID NO: 713936 - DNA, 25 bp, Artificial sequence
  Synthetic oligonucleotide
tgcgcctattatatgcctgacgcgg

SEQ ID NO: 713937 - DNA, 25 bp, Artificial sequence
  Synthetic oligonucleotide
tcggctataacagcgagtgctacgc

SEQ ID NO: 713938 - DNA, 25 bp, Artificial sequence
  Synthetic oligonucleotide
gcgtataggctgttacattagctcg

SEQ ID NO: 713939 - DNA, 25 bp, Artificial sequence
  Synthetic oligonucleotide
tgatacattagctcggatgctatca

SEQ ID NO: 713940 - DNA, 25 bp, Artificial sequence
  Synthetic oligonucleotide
tgatacattagcacggatgctatca

SEQ ID NO: 713941 - DNA, 25 bp, Artificial sequence
  Synthetic oligonucleotide
gctatcagcttgggcctattatatg

SEQ ID NO: 713942 - DNA, 25 bp, Artificial sequence
  Synthetic oligonucleotide
tgcgcctattatttgcctgacgcgg

SEQ ID NO: 713943 - DNA, 25 bp, Artificial sequence
  Synthetic oligonucleotide
gccgtgatcgttatatgacgagact

SEQ ID NO: 713944 - DNA, 25 bp, Artificial sequence
  Synthetic oligonucleotide
gccgtgatcgttttatgacgagact

SEQ ID NO: 713945 - DNA, 25 bp, Artificial sequence
  Synthetic oligonucleotide
atatgacgagactgtgcgctcatag

SEQ ID NO: 713946 - DNA, 25 bp, Artificial sequence
  Synthetic oligonucleotide
cagtgatacacggtgatgcacgtag

SEQ ID NO: 713947 - DNA, 25 bp, Artificial sequence
  Synthetic oligonucleotide
cagtgatacacgctgatgcacgtag

SEQ ID NO: 713948 - DNA, 25 bp, Artificial sequence
  Synthetic oligonucleotide
gctatcagcttgcgcctattatatg

SEQ ID NO: 713949 - DNA, 25 bp, Artificial sequence
  Synthetic oligonucleotide
atatgacgagacagtgcgctcatag

SEQ ID NO: 713950 - DNA, 25 bp, Artificial sequence
  Synthetic oligonucleotide
cagtgatacacgctgatgcacgtag

SEQ ID NO: 713951 - DNA, 25 bp, Artificial sequence
  Synthetic oligonucleotide
atatgacgagactgtgcgctcatag

SEQ ID NO: 713952 - DNA, 25 bp, Artificial sequence
  Synthetic oligonucleotide
cagtgatacacggtgatgcacgtag

SEQ ID NO: 713953 - DNA, 25 bp, Artificial sequence
  Synthetic oligonucleotide
tcggctataacagcgagtgctacgc

SEQ ID NO: 713954 - DNA, 25 bp, Artificial sequence
  Synthetic oligonucleotide
tcggctataacaccgagtgctacgc

SEQ ID NO: 713955 - DNA, 25 bp, Artificial sequence
  Synthetic oligonucleotide
cgagtgctacgcctaaactggctgt

SEQ ID NO: 713956 - DNA, 25 bp, Artificial sequence
  Synthetic oligonucleotide
cgagtgctacgcgtaaactggctgt

SEQ ID NO: 713957 - DNA, 25 bp, Artificial sequence
  Synthetic oligonucleotide
cgcctaaactggctgtctagcactg

SEQ ID NO: 713958 - DNA, 25 bp, Artificial sequence
  Synthetic oligonucleotide
cgcctaaactgggtgtctagcactg

SEQ ID NO: 713959 - DNA, 25 bp, Artificial sequence
  Synthetic oligonucleotide
ctgtctagcactgtagctggtgcat

SEQ ID NO: 713960 - DNA, 25 bp, Artificial sequence
  Synthetic oligonucleotide
ctgtctagcactctagctggtgcat

SEQ ID NO: 713961 - DNA, 25 bp, Artificial sequence
  Synthetic oligonucleotide
tgcgcctattatttgcctgacgcgg

SEQ ID NO: 713962 - DNA, 25 bp, Artificial sequence
  Synthetic oligonucleotide
gcgtataggctgatacattagctcg

SEQ ID NO: 713963 - DNA, 25 bp, Artificial sequence
  Synthetic oligonucleotide
gccgtgatcgttatatgacgagact

SEQ ID NO: 713964 - DNA, 25 bp, Artificial sequence
  Synthetic oligonucleotide
atatgacgagacagtgcgctcatag

SEQ ID NO: 713965 - DNA, 25 bp, Artificial sequence
  Synthetic oligonucleotide
tgcgcctattatatgcctgacgcgg

SEQ ID NO: 713966 - DNA, 25 bp, Artificial sequence
  Synthetic oligonucleotide
gctatcagcttgcgcctattatatg

SEQ ID NO: 713967 - DNA, 25 bp, Artificial sequence
  Synthetic oligonucleotide
gctatcagcttgggcctattatatg

SEQ ID NO: 713968 - DNA, 25 bp, Artificial sequence
  Synthetic oligonucleotide
tgatacattagcacggatgctatca

SEQ ID NO: 713969 - DNA, 25 bp, Artificial sequence
  Synthetic oligonucleotide
tgatacattagctcggatgctatca

SEQ ID NO: 713970 - DNA, 25 bp, Artificial sequence
  Synthetic oligonucleotide
gcgtataggctgttacattagctcg

SEQ ID NO: 713971 - DNA, 25 bp, Artificial sequence
  Synthetic oligonucleotide
gccgtgatcgttttatgacgagact

SEQ ID NO: 713972 - DNA, 25 bp, Artificial sequence
  Synthetic oligonucleotide
cttctagagtatgagccgcaatgca

SEQ ID NO: 713973 - DNA, 25 bp, Artificial sequence
  Synthetic oligonucleotide
cttctagagtatcagccgcaatgca

SEQ ID NO: 713974 - DNA, 25 bp, Artificial sequence
  Synthetic oligonucleotide
tgcgcagacgctagaaacgatgtga

SEQ ID NO: 713975 - DNA, 25 bp, Artificial sequence
  Synthetic oligonucleotide
tgcgcagacgcttgaaacgatgtga

SEQ ID NO: 713976 - DNA, 25 bp, Artificial sequence
  Synthetic oligonucleotide
acactgataactatgcgcagacgct

SEQ ID NO: 713977 - DNA, 25 bp, Artificial sequence
  Synthetic oligonucleotide
acactgataactttgcgcagacgct

SEQ ID NO: 713978 - DNA, 25 bp, Artificial sequence
  Synthetic oligonucleotide
ctatgaccgcgtgatgctaactgat

SEQ ID NO: 713979 - DNA, 25 bp, Artificial sequence
  Synthetic oligonucleotide
tatgagccgcaaagcacgactgata

SEQ ID NO: 713980 - DNA, 25 bp, Artificial sequence
  Synthetic oligonucleotide
tggtggagctatttaagccgctgtt

SEQ ID NO: 713981 - DNA, 25 bp, Artificial sequence
  Synthetic oligonucleotide
acgctcgcatgaaatgtattgcgct

SEQ ID NO: 713982 - DNA, 25 bp, Artificial sequence
  Synthetic oligonucleotide
ctatgaccgcgtcatgctaactgat

SEQ ID NO: 713983 - DNA, 25 bp, Artificial sequence
  Synthetic oligonucleotide
tatgagccgcaatgcacgactgata

SEQ ID NO: 713984 - DNA, 25 bp, Artificial sequence
  Synthetic oligonucleotide
tgcaatgcttgctgtatgtatcctg

SEQ ID NO: 713985 - DNA, 25 bp, Artificial sequence
  Synthetic oligonucleotide
tgcaatgcttgcagtatgtatcctg

SEQ ID NO: 713986 - DNA, 25 bp, Artificial sequence
  Synthetic oligonucleotide
tgcgatgtctgataatacgctcgca

SEQ ID NO: 713987 - DNA, 25 bp, Artificial sequence
  Synthetic oligonucleotide
catgatatgtatagcgctcagatgc

SEQ ID NO: 713988 - DNA, 25 bp, Artificial sequence
  Synthetic oligonucleotide
acgctcgcatgatatgtattgcgct

SEQ ID NO: 713989 - DNA, 25 bp, Artificial sequence
  Synthetic oligonucleotide
ctcgcatgatatgtattgcgctcag

SEQ ID NO: 713990 - DNA, 25 bp, Artificial sequence
  Synthetic oligonucleotide
ctcgcatgatatctattgcgctcag

SEQ ID NO: 713991 - DNA, 25 bp, Artificial sequence
  Synthetic oligonucleotide
catgatatgtattgcgctcagatgc

SEQ ID NO: 713992 - DNA, 25 bp, Artificial sequence
  Synthetic oligonucleotide
tggtggagctatataagccgctgtt

SEQ ID NO: 713993 - DNA, 25 bp, Artificial sequence
  Synthetic oligonucleotide
tgcgatgtctgaaaatacgctcgca

SEQ ID NO: 713994 - DNA, 25 bp, Artificial sequence
  Synthetic oligonucleotide
tgcgcagacgcttgaaacgatgtga

SEQ ID NO: 713995 - DNA, 25 bp, Artificial sequence
  Synthetic oligonucleotide
tggtggagctatttaagccgctgtt

SEQ ID NO: 713996 - DNA, 25 bp, Artificial sequence
  Synthetic oligonucleotide
catgatatgtatagcgctcagatgc

SEQ ID NO: 713997 - DNA, 25 bp, Artificial sequence
  Synthetic oligonucleotide
ctatgaccgcgtgatgctaactgat

SEQ ID NO: 713998 - DNA, 25 bp, Artificial sequence
  Synthetic oligonucleotide
ctatgaccgcgtcatgctaactgat

SEQ ID NO: 713999 - DNA, 25 bp, Artificial sequence
  Synthetic oligonucleotide
acactgataactttgcgcagacgct

SEQ ID NO: 714000 - DNA, 25 bp, Artificial sequence
  Synthetic oligonucleotide
tggtggagctatataagccgctgtt

SEQ ID NO: 714001 - DNA, 25 bp, Artificial sequence
  Synthetic oligonucleotide
tgcgcagacgctagaaacgatgtga

SEQ ID NO: 714002 - DNA, 25 bp, Artificial sequence
  Synthetic oligonucleotide
cttctagagtatgagccgcaatgca

SEQ ID NO: 714003 - DNA, 25 bp, Artificial sequence
  Synthetic oligonucleotide
cttctagagtatcagccgcaatgca

SEQ ID NO: 714004 - DNA, 25 bp, Artificial sequence
  Synthetic oligonucleotide
tatgagccgcaatgcacgactgata

SEQ ID NO: 714005 - DNA, 25 bp, Artificial sequence
  Synthetic oligonucleotide
ctcgcatgatatgtattgcgctcag

SEQ ID NO: 714006 - DNA, 25 bp, Artificial sequence
  Synthetic oligonucleotide
acactgataactatgcgcagacgct

SEQ ID NO: 714007 - DNA, 25 bp, Artificial sequence
  Synthetic oligonucleotide
catgatatgtattgcgctcagatgc

SEQ ID NO: 714008 - DNA, 25 bp, Artificial sequence
  Synthetic oligonucleotide
tatgagccgcaaagcacgactgata

SEQ ID NO: 714009 - DNA, 25 bp, Artificial sequence
  Synthetic oligonucleotide
ctcgcatgatatctattgcgctcag

SEQ ID NO: 714010 - DNA, 25 bp, Artificial sequence
  Synthetic oligonucleotide
acgctcgcatgaaatgtattgcgct

SEQ ID NO: 714011 - DNA, 25 bp, Artificial sequence
  Synthetic oligonucleotide
acgctcgcatgatatgtattgcgct

SEQ ID NO: 714012 - DNA, 25 bp, Artificial sequence
  Synthetic oligonucleotide
tgcgatgtctgataatacgctcgca

SEQ ID NO: 714013 - DNA, 25 bp, Artificial sequence
  Synthetic oligonucleotide
tgcgatgtctgaaaatacgctcgca

SEQ ID NO: 714014 - DNA, 25 bp, Artificial sequence
  Synthetic oligonucleotide
tgcaatgcttgcagtatgtatcctg

SEQ ID NO: 714015 - DNA, 25 bp, Artificial sequence
  Synthetic oligonucleotide
tgcaatgcttgctgtatgtatcctg

SEQ ID NO: 714016 - DNA, 25 bp, Artificial sequence
  Synthetic oligonucleotide
cattagagtgatcttctcggatcga

SEQ ID NO: 714017 - DNA, 25 bp, Artificial sequence
  Synthetic oligonucleotide
cgagtcgtatgtatcatgtcgggct

SEQ ID NO: 714018 - DNA, 25 bp, Artificial sequence
  Synthetic oligonucleotide
attagcgagtcgaatgtatcatgtc

SEQ ID NO: 714019 - DNA, 25 bp, Artificial sequence
  Synthetic oligonucleotide
attagcgagtcgtatgtatcatgtc

SEQ ID NO: 714020 - DNA, 25 bp, Artificial sequence
  Synthetic oligonucleotide
taacatggagcaacgttatctaaag

SEQ ID NO: 714021 - DNA, 25 bp, Artificial sequence
  Synthetic oligonucleotide
taacatggagcatcgttatctaaag

SEQ ID NO: 714022 - DNA, 25 bp, Artificial sequence
  Synthetic oligonucleotide
cattagagtgatgttctcggatcga

SEQ ID NO: 714023 - DNA, 25 bp, Artificial sequence
  Synthetic oligonucleotide
attcactaacatcgagcatcgttat

SEQ ID NO: 714024 - DNA, 25 bp, Artificial sequence
  Synthetic oligonucleotide
cgagtcgtatgtttcatgtcgggct

SEQ ID NO: 714025 - DNA, 25 bp, Artificial sequence
  Synthetic oligonucleotide
agaggatggcacacgtcattagagt

SEQ ID NO: 714026 - DNA, 25 bp, Artificial sequence
  Synthetic oligonucleotide
attcactaacatggagcatcgttat

SEQ ID NO: 714027 - DNA, 25 bp, Artificial sequence
  Synthetic oligonucleotide
cgtagccacaaaagtcgttaggtag

SEQ ID NO: 714028 - DNA, 25 bp, Artificial sequence
  Synthetic oligonucleotide
cgtagccacaaatgtcgttaggtag

SEQ ID NO: 714029 - DNA, 25 bp, Artificial sequence
  Synthetic oligonucleotide
gatgtcaacgcgtgttagaccgtat

SEQ ID NO: 714030 - DNA, 25 bp, Artificial sequence
  Synthetic oligonucleotide
gatgtcaacgcgagttagaccgtat

SEQ ID NO: 714031 - DNA, 25 bp, Artificial sequence
  Synthetic oligonucleotide
tggcgtacttctcaaacgtgatggg

SEQ ID NO: 714032 - DNA, 25 bp, Artificial sequence
  Synthetic oligonucleotide
tggcgtacttctgaaacgtgatggg

SEQ ID NO: 714033 - DNA, 25 bp, Artificial sequence
  Synthetic oligonucleotide
ttgggcgttgttgacccgaattcgg

SEQ ID NO: 714034 - DNA, 25 bp, Artificial sequence
  Synthetic oligonucleotide
ttgggcgttgttcacccgaattcgg

SEQ ID NO: 714035 - DNA, 25 bp, Artificial sequence
  Synthetic oligonucleotide
acgtcgtctgctttaggcaaacgtc

SEQ ID NO: 714036 - DNA, 25 bp, Artificial sequence
  Synthetic oligonucleotide
acgtcgtctgctataggcaaacgtc

SEQ ID NO: 714037 - DNA, 25 bp, Artificial sequence
  Synthetic oligonucleotide
agaggatggcactcgtcattagagt

SEQ ID NO: 714038 - DNA, 25 bp, Artificial sequence
  Synthetic oligonucleotide
attcactaacatcgagcatcgttat

SEQ ID NO: 714039 - DNA, 25 bp, Artificial sequence
  Synthetic oligonucleotide
agaggatggcacacgtcattagagt

SEQ ID NO: 714040 - DNA, 25 bp, Artificial sequence
  Synthetic oligonucleotide
taacatggagcatcgttatctaaag

SEQ ID NO: 714041 - DNA, 25 bp, Artificial sequence
  Synthetic oligonucleotide
acgtcgtctgctttaggcaaacgtc

SEQ ID NO: 714042 - DNA, 25 bp, Artificial sequence
  Synthetic oligonucleotide
cattagagtgatgttctcggatcga

SEQ ID NO: 714043 - DNA, 25 bp, Artificial sequence
  Synthetic oligonucleotide
cattagagtgatcttctcggatcga

SEQ ID NO: 714044 - DNA, 25 bp, Artificial sequence
  Synthetic oligonucleotide
attcactaacatggagcatcgttat

SEQ ID NO: 714045 - DNA, 25 bp, Artificial sequence
  Synthetic oligonucleotide
taacatggagcaacgttatctaaag

SEQ ID NO: 714046 - DNA, 25 bp, Artificial sequence
  Synthetic oligonucleotide
agaggatggcactcgtcattagagt

SEQ ID NO: 714047 - DNA, 25 bp, Artificial sequence
  Synthetic oligonucleotide
attagcgagtcgaatgtatcatgtc

SEQ ID NO: 714048 - DNA, 25 bp, Artificial sequence
  Synthetic oligonucleotide
attagcgagtcgtatgtatcatgtc

SEQ ID NO: 714049 - DNA, 25 bp, Artificial sequence
  Synthetic oligonucleotide
cgagtcgtatgtatcatgtcgggct

SEQ ID NO: 714050 - DNA, 25 bp, Artificial sequence
  Synthetic oligonucleotide
ttgggcgttgttgacccgaattcgg

SEQ ID NO: 714051 - DNA, 25 bp, Artificial sequence
  Synthetic oligonucleotide
cgtagccacaaatgtcgttaggtag

SEQ ID NO: 714052 - DNA, 25 bp, Artificial sequence
  Synthetic oligonucleotide
cgtagccacaaaagtcgttaggtag

SEQ ID NO: 714053 - DNA, 25 bp, Artificial sequence
  Synthetic oligonucleotide
gatgtcaacgcgtgttagaccgtat

SEQ ID NO: 714054 - DNA, 25 bp, Artificial sequence
  Synthetic oligonucleotide
gatgtcaacgcgagttagaccgtat

SEQ ID NO: 714055 - DNA, 25 bp, Artificial sequence
  Synthetic oligonucleotide
tggcgtacttctcaaacgtgatggg

SEQ ID NO: 714056 - DNA, 25 bp, Artificial sequence
  Synthetic oligonucleotide
tggcgtacttctgaaacgtgatggg

SEQ ID NO: 714057 - DNA, 25 bp, Artificial sequence
  Synthetic oligonucleotide
cgagtcgtatgtttcatgtcgggct

SEQ ID NO: 714058 - DNA, 25 bp, Artificial sequence
  Synthetic oligonucleotide
acgtcgtctgctataggcaaacgtc

SEQ ID NO: 714059 - DNA, 25 bp, Artificial sequence
  Synthetic oligonucleotide
ttgggcgttgttcacccgaattcgg

SEQ ID NO: 714060 - DNA, 25 bp, Artificial sequence
  Synthetic oligonucleotide
gcgatactgaagatgcaccgctata

SEQ ID NO: 714061 - DNA, 25 bp, Artificial sequence
  Synthetic oligonucleotide
ctgcgatactgaagatgcaccgcta

SEQ ID NO: 714062 - DNA, 25 bp, Artificial sequence
  Synthetic oligonucleotide
accatcctgcgatactgaagatgca

SEQ ID NO: 714063 - DNA, 25 bp, Artificial sequence
  Synthetic oligonucleotide
aacctcagctcaacatgtatgatgc

SEQ ID NO: 714064 - DNA, 25 bp, Artificial sequence
  Synthetic oligonucleotide
aacctcagctcatcatgtatgatgc

SEQ ID NO: 714065 - DNA, 25 bp, Artificial sequence
  Synthetic oligonucleotide
tacagcgatataccctggattgtga

SEQ ID NO: 714066 - DNA, 25 bp, Artificial sequence
  Synthetic oligonucleotide
attgtgagcgtaattgctgtcagaa

SEQ ID NO: 714067 - DNA, 25 bp, Artificial sequence
  Synthetic oligonucleotide
gcgatactgaagttgcaccgctata

SEQ ID NO: 714068 - DNA, 25 bp, Artificial sequence
  Synthetic oligonucleotide
attgtgagcgtatttgctgtcagaa

SEQ ID NO: 714069 - DNA, 25 bp, Artificial sequence
  Synthetic oligonucleotide
gctgctcgttctcaatgcgagcgag

SEQ ID NO: 714070 - DNA, 25 bp, Artificial sequence
  Synthetic oligonucleotide
gctgctcgttctgaatgcgagcgag

SEQ ID NO: 714071 - DNA, 25 bp, Artificial sequence
  Synthetic oligonucleotide
cctctacattgaaagcagatagtct

SEQ ID NO: 714072 - DNA, 25 bp, Artificial sequence
  Synthetic oligonucleotide
cctctacattgatagcagatagtct

SEQ ID NO: 714073 - DNA, 25 bp, Artificial sequence
  Synthetic oligonucleotide
atagcagatagtgtaacgggatagc

SEQ ID NO: 714074 - DNA, 25 bp, Artificial sequence
  Synthetic oligonucleotide
atagcagatagtctaacgggatagc

SEQ ID NO: 714075 - DNA, 25 bp, Artificial sequence
  Synthetic oligonucleotide
gatagtctaacgggatagcataggt

SEQ ID NO: 714076 - DNA, 25 bp, Artificial sequence
  Synthetic oligonucleotide
tacagcgatatagcctggattgtga

SEQ ID NO: 714077 - DNA, 25 bp, Artificial sequence
  Synthetic oligonucleotide
gcataggtgcaaggctcctagcatg

SEQ ID NO: 714078 - DNA, 25 bp, Artificial sequence
  Synthetic oligonucleotide
accatcctgcgaaactgaagatgca

SEQ ID NO: 714079 - DNA, 25 bp, Artificial sequence
  Synthetic oligonucleotide
gcataggtgcaacgctcctagcatg

SEQ ID NO: 714080 - DNA, 25 bp, Artificial sequence
  Synthetic oligonucleotide
gatagtctaacgcgatagcataggt

SEQ ID NO: 714081 - DNA, 25 bp, Artificial sequence
  Synthetic oligonucleotide
ctgcgatactgatgatgcaccgcta

SEQ ID NO: 714082 - DNA, 25 bp, Artificial sequence
  Synthetic oligonucleotide
accatcctgcgatactgaagatgca

SEQ ID NO: 714083 - DNA, 25 bp, Artificial sequence
  Synthetic oligonucleotide
gcataggtgcaaggctcctagcatg

SEQ ID NO: 714084 - DNA, 25 bp, Artificial sequence
  Synthetic oligonucleotide
tacagcgatataccctggattgtga

SEQ ID NO: 714085 - DNA, 25 bp, Artificial sequence
  Synthetic oligonucleotide
tacagcgatatagcctggattgtga

SEQ ID NO: 714086 - DNA, 25 bp, Artificial sequence
  Synthetic oligonucleotide
attgtgagcgtatttgctgtcagaa

SEQ ID NO: 714087 - DNA, 25 bp, Artificial sequence
  Synthetic oligonucleotide
attgtgagcgtaattgctgtcagaa

SEQ ID NO: 714088 - DNA, 25 bp, Artificial sequence
  Synthetic oligonucleotide
aacctcagctcaacatgtatgatgc

SEQ ID NO: 714089 - DNA, 25 bp, Artificial sequence
  Synthetic oligonucleotide
accatcctgcgaaactgaagatgca

SEQ ID NO: 714090 - DNA, 25 bp, Artificial sequence
  Synthetic oligonucleotide
ctgcgatactgatgatgcaccgcta

SEQ ID NO: 714091 - DNA, 25 bp, Artificial sequence
  Synthetic oligonucleotide
ctgcgatactgaagatgcaccgcta

SEQ ID NO: 714092 - DNA, 25 bp, Artificial sequence
  Synthetic oligonucleotide
atagcagatagtctaacgggatagc

SEQ ID NO: 714093 - DNA, 25 bp, Artificial sequence
  Synthetic oligonucleotide
gcataggtgcaacgctcctagcatg

SEQ ID NO: 714094 - DNA, 25 bp, Artificial sequence
  Synthetic oligonucleotide
aacctcagctcatcatgtatgatgc

SEQ ID NO: 714095 - DNA, 25 bp, Artificial sequence
  Synthetic oligonucleotide
gatagtctaacgcgatagcataggt

SEQ ID NO: 714096 - DNA, 25 bp, Artificial sequence
  Synthetic oligonucleotide
gcgatactgaagatgcaccgctata

SEQ ID NO: 714097 - DNA, 25 bp, Artificial sequence
  Synthetic oligonucleotide
atagcagatagtgtaacgggatagc

SEQ ID NO: 714098 - DNA, 25 bp, Artificial sequence
  Synthetic oligonucleotide
cctctacattgatagcagatagtct

SEQ ID NO: 714099 - DNA, 25 bp, Artificial sequence
  Synthetic oligonucleotide
cctctacattgaaagcagatagtct

SEQ ID NO: 714100 - DNA, 25 bp, Artificial sequence
  Synthetic oligonucleotide
gctgctcgttctgaatgcgagcgag

SEQ ID NO: 714101 - DNA, 25 bp, Artificial sequence
  Synthetic oligonucleotide
gctgctcgttctcaatgcgagcgag

SEQ ID NO: 714102 - DNA, 25 bp, Artificial sequence
  Synthetic oligonucleotide
gcgatactgaagttgcaccgctata

SEQ ID NO: 714103 - DNA, 25 bp, Artificial sequence
  Synthetic oligonucleotide
gatagtctaacgggatagcataggt

SEQ ID NO: 714104 - DNA, 25 bp, Artificial sequence
  Synthetic oligonucleotide
aaaatgcaacgacgagaggttcgcg

SEQ ID NO: 714105 - DNA, 25 bp, Artificial sequence
  Synthetic oligonucleotide
tattgattggattagggtggaattg

SEQ ID NO: 714106 - DNA, 25 bp, Artificial sequence
  Synthetic oligonucleotide
atcattttcttcataatttttttgg

SEQ ID NO: 714107 - DNA, 25 bp, Artificial sequence
  Synthetic oligonucleotide
tggacaacgaagtggctcgtcatgg

SEQ ID NO: 714108 - DNA, 25 bp, Artificial sequence
  Synthetic oligonucleotide
tggacaacgaagaggctcgtcatgg

SEQ ID NO: 714109 - DNA, 25 bp, Artificial sequence
  Synthetic oligonucleotide
tgagcttaaccgcaaagtagaagcg

SEQ ID NO: 714110 - DNA, 25 bp, Artificial sequence
  Synthetic oligonucleotide
tgagcttaaccggaaagtagaagcg

SEQ ID NO: 714111 - DNA, 25 bp, Artificial sequence
  Synthetic oligonucleotide
atcattttcttcttaatttttttgg

SEQ ID NO: 714112 - DNA, 25 bp, Artificial sequence
  Synthetic oligonucleotide
aaaatgcaacgaggagaggttcgcg

SEQ ID NO: 714113 - DNA, 25 bp, Artificial sequence
  Synthetic oligonucleotide
caatacacgacattaacaagttaac

SEQ ID NO: 714114 - DNA, 25 bp, Artificial sequence
  Synthetic oligonucleotide
caatacacgacaataacaagttaac

SEQ ID NO: 714115 - DNA, 25 bp, Artificial sequence
  Synthetic oligonucleotide
gtcacggataaacaaaatctctgct

SEQ ID NO: 714116 - DNA, 25 bp, Artificial sequence
  Synthetic oligonucleotide
tattgattggataagggtggaattg

SEQ ID NO: 714117 - DNA, 25 bp, Artificial sequence
  Synthetic oligonucleotide
tagtgatatttcttcttcgttaaca

SEQ ID NO: 714118 - DNA, 25 bp, Artificial sequence
  Synthetic oligonucleotide
tagtgatatttcatcttcgttaaca

SEQ ID NO: 714119 - DNA, 25 bp, Artificial sequence
  Synthetic oligonucleotide
aaggtgaagaagctgaaagtgtcac

SEQ ID NO: 714120 - DNA, 25 bp, Artificial sequence
  Synthetic oligonucleotide
gcgttgagagttccgaaaccgaaac

SEQ ID NO: 714121 - DNA, 25 bp, Artificial sequence
  Synthetic oligonucleotide
ttgaatagatattttctcctctgcg

SEQ ID NO: 714122 - DNA, 25 bp, Artificial sequence
  Synthetic oligonucleotide
ttgaatagatatattctcctctgcg

SEQ ID NO: 714123 - DNA, 25 bp, Artificial sequence
  Synthetic oligonucleotide
gtcacggataaagaaaatctctgct

SEQ ID NO: 714124 - DNA, 25 bp, Artificial sequence
  Synthetic oligonucleotide
aggcaacaagtcaacgcttccgttg

SEQ ID NO: 714125 - DNA, 25 bp, Artificial sequence
  Synthetic oligonucleotide
gacttagattaaggagaaaaatctc

SEQ ID NO: 714126 - DNA, 25 bp, Artificial sequence
  Synthetic oligonucleotide
caaagatattagttaatgggaacac

SEQ ID NO: 714127 - DNA, 25 bp, Artificial sequence
  Synthetic oligonucleotide
caccagcaggtaatttaatttagat

SEQ ID NO: 714128 - DNA, 25 bp, Artificial sequence
  Synthetic oligonucleotide
taaggtgacgtcttccgaatttaga

SEQ ID NO: 714129 - DNA, 25 bp, Artificial sequence
  Synthetic oligonucleotide
taaggtgacgtcatccgaatttaga

SEQ ID NO: 714130 - DNA, 25 bp, Artificial sequence
  Synthetic oligonucleotide
taatttcgtaatatttcagaaagga

SEQ ID NO: 714131 - DNA, 25 bp, Artificial sequence
  Synthetic oligonucleotide
taatttcgtaatttttcagaaagga

SEQ ID NO: 714132 - DNA, 25 bp, Artificial sequence
  Synthetic oligonucleotide
gcgttgagagttgcgaaaccgaaac

SEQ ID NO: 714133 - DNA, 25 bp, Artificial sequence
  Synthetic oligonucleotide
cgttagagaatacgtggaagatgat

SEQ ID NO: 714134 - DNA, 25 bp, Artificial sequence
  Synthetic oligonucleotide
aggcaacaagtctacgcttccgttg

SEQ ID NO: 714135 - DNA, 25 bp, Artificial sequence
  Synthetic oligonucleotide
aaggtgaagaaggtgaaagtgtcac

SEQ ID NO: 714136 - DNA, 25 bp, Artificial sequence
  Synthetic oligonucleotide
tattacaagagacccgacacgttcg

SEQ ID NO: 714137 - DNA, 25 bp, Artificial sequence
  Synthetic oligonucleotide
tattacaagagagccgacacgttcg

SEQ ID NO: 714138 - DNA, 25 bp, Artificial sequence
  Synthetic oligonucleotide
gcgaagagacaaaacaatcaggtgt

SEQ ID NO: 714139 - DNA, 25 bp, Artificial sequence
  Synthetic oligonucleotide
gcgaagagacaatacaatcaggtgt

SEQ ID NO: 714140 - DNA, 25 bp, Artificial sequence
  Synthetic oligonucleotide
aatcggagacgtatagtgacagaac

SEQ ID NO: 714141 - DNA, 25 bp, Artificial sequence
  Synthetic oligonucleotide
aatcggagacgtttagtgacagaac

SEQ ID NO: 714142 - DNA, 25 bp, Artificial sequence
  Synthetic oligonucleotide
ttaccagtctctgccgccgccacct

SEQ ID NO: 714143 - DNA, 25 bp, Artificial sequence
  Synthetic oligonucleotide
ttaccagtctctcccgccgccacct

SEQ ID NO: 714144 - DNA, 25 bp, Artificial sequence
  Synthetic oligonucleotide
cgttagagaataggtggaagatgat

SEQ ID NO: 714145 - DNA, 25 bp, Artificial sequence
  Synthetic oligonucleotide
tatgcacattacaaaaatcctagac

SEQ ID NO: 714146 - DNA, 25 bp, Artificial sequence
  Synthetic oligonucleotide
caagctctaaacggttttcgttcgc

SEQ ID NO: 714147 - DNA, 25 bp, Artificial sequence
  Synthetic oligonucleotide
taagaatggaacaaggcgaaaaatt

SEQ ID NO: 714148 - DNA, 25 bp, Artificial sequence
  Synthetic oligonucleotide
taagaatggaactaggcgaaaaatt

SEQ ID NO: 714149 - DNA, 25 bp, Artificial sequence
  Synthetic oligonucleotide
ttaaacttgacccaatgtagcagtg

SEQ ID NO: 714150 - DNA, 25 bp, Artificial sequence
  Synthetic oligonucleotide
ttaaacttgaccgaatgtagcagtg

SEQ ID NO: 714151 - DNA, 25 bp, Artificial sequence
  Synthetic oligonucleotide
tattgagatgagacttttttgtgtc

SEQ ID NO: 714152 - DNA, 25 bp, Artificial sequence
  Synthetic oligonucleotide
tattgagatgagtcttttttgtgtc

SEQ ID NO: 714153 - DNA, 25 bp, Artificial sequence
  Synthetic oligonucleotide
caagctctaaaccgttttcgttcgc

SEQ ID NO: 714154 - DNA, 25 bp, Artificial sequence
  Synthetic oligonucleotide
ggactattccctctgcaacacataa

SEQ ID NO: 714155 - DNA, 25 bp, Artificial sequence
  Synthetic oligonucleotide
tatgcacattactaaaatcctagac

SEQ ID NO: 714156 - DNA, 25 bp, Artificial sequence
  Synthetic oligonucleotide
gacttaattaatgccaatcccacca

SEQ ID NO: 714157 - DNA, 25 bp, Artificial sequence
  Synthetic oligonucleotide
aaaccttcagctgtcaactaaatag

SEQ ID NO: 714158 - DNA, 25 bp, Artificial sequence
  Synthetic oligonucleotide
aaaccttcagctctcaactaaatag

SEQ ID NO: 714159 - DNA, 25 bp, Artificial sequence
  Synthetic oligonucleotide
tctgttgttgaggtggcaaagctac

SEQ ID NO: 714160 - DNA, 25 bp, Artificial sequence
  Synthetic oligonucleotide
tctgttgttgagctggcaaagctac

SEQ ID NO: 714161 - DNA, 25 bp, Artificial sequence
  Synthetic oligonucleotide
aaagtagtcctggaaaccttaatgg

SEQ ID NO: 714162 - DNA, 25 bp, Artificial sequence
  Synthetic oligonucleotide
aaagtagtcctgcaaaccttaatgg

SEQ ID NO: 714163 - DNA, 25 bp, Artificial sequence
  Synthetic oligonucleotide
caccagcaggtattttaatttagat

SEQ ID NO: 714164 - DNA, 25 bp, Artificial sequence
  Synthetic oligonucleotide
gaagaagtgtataattgtggtgagc

SEQ ID NO: 714165 - DNA, 25 bp, Artificial sequence
  Synthetic oligonucleotide
gacttagattaacgagaaaaatctc

SEQ ID NO: 714166 - DNA, 25 bp, Artificial sequence
  Synthetic oligonucleotide
tctcatcttagcttcagtttctcca

SEQ ID NO: 714167 - DNA, 25 bp, Artificial sequence
  Synthetic oligonucleotide
caatctactttaaaatgctctttct

SEQ ID NO: 714168 - DNA, 25 bp, Artificial sequence
  Synthetic oligonucleotide
caatctactttataatgctctttct

SEQ ID NO: 714169 - DNA, 25 bp, Artificial sequence
  Synthetic oligonucleotide
aacaaataaacataggtacattatc

SEQ ID NO: 714170 - DNA, 25 bp, Artificial sequence
  Synthetic oligonucleotide
aacaaataaacaaaggtacattatc

SEQ ID NO: 714171 - DNA, 25 bp, Artificial sequence
  Synthetic oligonucleotide
tagtggtaacattacaacattaaca

SEQ ID NO: 714172 - DNA, 25 bp, Artificial sequence
  Synthetic oligonucleotide
tagtggtaacataacaacattaaca

SEQ ID NO: 714173 - DNA, 25 bp, Artificial sequence
  Synthetic oligonucleotide
aaagaagaagataagatcttctctg

SEQ ID NO: 714174 - DNA, 25 bp, Artificial sequence
  Synthetic oligonucleotide
aaagaagaagattagatcttctctg

SEQ ID NO: 714175 - DNA, 25 bp, Artificial sequence
  Synthetic oligonucleotide
ggactattccctgtgcaacacataa

SEQ ID NO: 714176 - DNA, 25 bp, Artificial sequence
  Synthetic oligonucleotide
gaaagagtctgctctctcagaatca

SEQ ID NO: 714177 - DNA, 25 bp, Artificial sequence
  Synthetic oligonucleotide
caaagatattagataatgggaacac

SEQ ID NO: 714178 - DNA, 25 bp, Artificial sequence
  Synthetic oligonucleotide
tctcatcttagcatcagtttctcca

SEQ ID NO: 714179 - DNA, 25 bp, Artificial sequence
  Synthetic oligonucleotide
cgtgaaaagcgtactgttgaatgat

SEQ ID NO: 714180 - DNA, 25 bp, Artificial sequence
  Synthetic oligonucleotide
cgtgaaaagcgttctgttgaatgat

SEQ ID NO: 714181 - DNA, 25 bp, Artificial sequence
  Synthetic oligonucleotide
tcatctcaagacatacaagcacatt

SEQ ID NO: 714182 - DNA, 25 bp, Artificial sequence
  Synthetic oligonucleotide
tcatctcaagacttacaagcacatt

SEQ ID NO: 714183 - DNA, 25 bp, Artificial sequence
  Synthetic oligonucleotide
aagctgatccacgtccaaccagaaa

SEQ ID NO: 714184 - DNA, 25 bp, Artificial sequence
  Synthetic oligonucleotide
aagctgatccacctccaaccagaaa

SEQ ID NO: 714185 - DNA, 25 bp, Artificial sequence
  Synthetic oligonucleotide
gacttaattaatcccaatcccacca

SEQ ID NO: 714186 - DNA, 25 bp, Artificial sequence
  Synthetic oligonucleotide
gaaagagtctgcactctcagaatca

SEQ ID NO: 714187 - DNA, 25 bp, Artificial sequence
  Synthetic oligonucleotide
gaattattatttgacgtatataaga

SEQ ID NO: 714188 - DNA, 25 bp, Artificial sequence
  Synthetic oligonucleotide
gtaattagttatcaattcgctcaaa

SEQ ID NO: 714189 - DNA, 25 bp, Artificial sequence
  Synthetic oligonucleotide
ttgtctaaaattaacataaaaccca

SEQ ID NO: 714190 - DNA, 25 bp, Artificial sequence
  Synthetic oligonucleotide
ttgtctaaaatttacataaaaccca

SEQ ID NO: 714191 - DNA, 25 bp, Artificial sequence
  Synthetic oligonucleotide
taaaagtaaacatacatgcaaggct

SEQ ID NO: 714192 - DNA, 25 bp, Artificial sequence
  Synthetic oligonucleotide
taaaagtaaacaaacatgcaaggct

SEQ ID NO: 714193 - DNA, 25 bp, Artificial sequence
  Synthetic oligonucleotide
gcataacgtgtgtttgggaaaccat

SEQ ID NO: 714194 - DNA, 25 bp, Artificial sequence
  Synthetic oligonucleotide
gcataacgtgtgattgggaaaccat

SEQ ID NO: 714195 - DNA, 25 bp, Artificial sequence
  Synthetic oligonucleotide
tctactcttgttatgtttatacaag

SEQ ID NO: 714196 - DNA, 25 bp, Artificial sequence
  Synthetic oligonucleotide
ggaattataacgaatggccatacta

SEQ ID NO: 714197 - DNA, 25 bp, Artificial sequence
  Synthetic oligonucleotide
taatctataaaacaacatataaact

SEQ ID NO: 714198 - DNA, 25 bp, Artificial sequence
  Synthetic oligonucleotide
gaattattatttcacgtatataaga

SEQ ID NO: 714199 - DNA, 25 bp, Artificial sequence
  Synthetic oligonucleotide
caattatgggattaaattaagagac

SEQ ID NO: 714200 - DNA, 25 bp, Artificial sequence
  Synthetic oligonucleotide
caattatgggataaaattaagagac

SEQ ID NO: 714201 - DNA, 25 bp, Artificial sequence
  Synthetic oligonucleotide
cacgtgaagctttgagtacgtgtca

SEQ ID NO: 714202 - DNA, 25 bp, Artificial sequence
  Synthetic oligonucleotide
cacgtgaagcttagagtacgtgtca

SEQ ID NO: 714203 - DNA, 25 bp, Artificial sequence
  Synthetic oligonucleotide
aataagacataaacaacaacaaaaa

SEQ ID NO: 714204 - DNA, 25 bp, Artificial sequence
  Synthetic oligonucleotide
aataagacataatcaacaacaaaaa

SEQ ID NO: 714205 - DNA, 25 bp, Artificial sequence
  Synthetic oligonucleotide
tctactcttgttttgtttatacaag

SEQ ID NO: 714206 - DNA, 25 bp, Artificial sequence
  Synthetic oligonucleotide
ggaattataacgtatggccatacta

SEQ ID NO: 714207 - DNA, 25 bp, Artificial sequence
  Synthetic oligonucleotide
tttctaaaaacatttcaatgatatg

SEQ ID NO: 714208 - DNA, 25 bp, Artificial sequence
  Synthetic oligonucleotide
taggatcggccataagaaaccggtg

SEQ ID NO: 714209 - DNA, 25 bp, Artificial sequence
  Synthetic oligonucleotide
gattaatttgttttgtggtaggata

SEQ ID NO: 714210 - DNA, 25 bp, Artificial sequence
  Synthetic oligonucleotide
tatgagtaaaatacttaacaattta

SEQ ID NO: 714211 - DNA, 25 bp, Artificial sequence
  Synthetic oligonucleotide
tatgagtaaaattcttaacaattta

SEQ ID NO: 714212 - DNA, 25 bp, Artificial sequence
  Synthetic oligonucleotide
gaatttaatgtctttttcttgtaac

SEQ ID NO: 714213 - DNA, 25 bp, Artificial sequence
  Synthetic oligonucleotide
gaatttaatgtcattttcttgtaac

SEQ ID NO: 714214 - DNA, 25 bp, Artificial sequence
  Synthetic oligonucleotide
caactagagattatacactataaac

SEQ ID NO: 714215 - DNA, 25 bp, Artificial sequence
  Synthetic oligonucleotide
caactagagattttacactataaac

SEQ ID NO: 714216 - DNA, 25 bp, Artificial sequence
  Synthetic oligonucleotide
gtaattagttatgaattcgctcaaa

SEQ ID NO: 714217 - DNA, 25 bp, Artificial sequence
  Synthetic oligonucleotide
caagccgttttttaaattatgtgag

SEQ ID NO: 714218 - DNA, 25 bp, Artificial sequence
  Synthetic oligonucleotide
taatctataaaagaacatataaact

SEQ ID NO: 714219 - DNA, 25 bp, Artificial sequence
  Synthetic oligonucleotide
tttctaaaaacaattcaatgatatg

SEQ ID NO: 714220 - DNA, 25 bp, Artificial sequence
  Synthetic oligonucleotide
tacttgattgtcgttatataaacca

SEQ ID NO: 714221 - DNA, 25 bp, Artificial sequence
  Synthetic oligonucleotide
tacttgattgtccttatataaacca

SEQ ID NO: 714222 - DNA, 25 bp, Artificial sequence
  Synthetic oligonucleotide
tactatactttattacttgttaagt

SEQ ID NO: 714223 - DNA, 25 bp, Artificial sequence
  Synthetic oligonucleotide
tccatcttagatattttacaactct

SEQ ID NO: 714224 - DNA, 25 bp, Artificial sequence
  Synthetic oligonucleotide
ggtttttaacaaggctttacatcca

SEQ ID NO: 714225 - DNA, 25 bp, Artificial sequence
  Synthetic oligonucleotide
ggtttttaacaacgctttacatcca

SEQ ID NO: 714226 - DNA, 25 bp, Artificial sequence
  Synthetic oligonucleotide
tccatcttagattttttacaactct

SEQ ID NO: 714227 - DNA, 25 bp, Artificial sequence
  Synthetic oligonucleotide
caagccgtttttaaaattatgtgag

SEQ ID NO: 714228 - DNA, 25 bp, Artificial sequence
  Synthetic oligonucleotide
aagagaaggagaggccggcgacggt

SEQ ID NO: 714229 - DNA, 25 bp, Artificial sequence
  Synthetic oligonucleotide
tgtcggagtttcctaccggattact

SEQ ID NO: 714230 - DNA, 25 bp, Artificial sequence
  Synthetic oligonucleotide
tgtcggagtttcgtaccggattact

SEQ ID NO: 714231 - DNA, 25 bp, Artificial sequence
  Synthetic oligonucleotide
cacgtcgacggctaagactatgagg

SEQ ID NO: 714232 - DNA, 25 bp, Artificial sequence
  Synthetic oligonucleotide
cacgtcgacggcaaagactatgagg

SEQ ID NO: 714233 - DNA, 25 bp, Artificial sequence
  Synthetic oligonucleotide
ggcgacaataagtttcagactgatc

SEQ ID NO: 714234 - DNA, 25 bp, Artificial sequence
  Synthetic oligonucleotide
ggcgacaataagattcagactgatc

SEQ ID NO: 714235 - DNA, 25 bp, Artificial sequence
  Synthetic oligonucleotide
tccaagaagctcgtctaaggcgacg

SEQ ID NO: 714236 - DNA, 25 bp, Artificial sequence
  Synthetic oligonucleotide
tccaagaagctcctctaaggcgacg

SEQ ID NO: 714237 - DNA, 25 bp, Artificial sequence
  Synthetic oligonucleotide
ccgtatctttacgtcatcactaacg

SEQ ID NO: 714238 - DNA, 25 bp, Artificial sequence
  Synthetic oligonucleotide
tgcagatcgttaaggagccggaggt

SEQ ID NO: 714239 - DNA, 25 bp, Artificial sequence
  Synthetic oligonucleotide
gatgcggattttggtttcatcggca

SEQ ID NO: 714240 - DNA, 25 bp, Artificial sequence
  Synthetic oligonucleotide
aagagaaggagacgccggcgacggt

SEQ ID NO: 714241 - DNA, 25 bp, Artificial sequence
  Synthetic oligonucleotide
gaagaagtgtattattgtggtgagc

SEQ ID NO: 714242 - DNA, 25 bp, Artificial sequence
  Synthetic oligonucleotide
tcaacctccggtcgagaagcctctt

SEQ ID NO: 714243 - DNA, 25 bp, Artificial sequence
  Synthetic oligonucleotide
tcaacctccggtggagaagcctctt

SEQ ID NO: 714244 - DNA, 25 bp, Artificial sequence
  Synthetic oligonucleotide
gattaatttgttatgtggtaggata

SEQ ID NO: 714245 - DNA, 25 bp, Artificial sequence
  Synthetic oligonucleotide
taggatcggccaaaagaaaccggtg

SEQ ID NO: 714246 - DNA, 25 bp, Artificial sequence
  Synthetic oligonucleotide
atctactgccccaaaacaatcctga

SEQ ID NO: 714247 - DNA, 25 bp, Artificial sequence
  Synthetic oligonucleotide
tactatactttaatacttgttaagt

SEQ ID NO: 714248 - DNA, 25 bp, Artificial sequence
  Synthetic oligonucleotide
gatgcggattttcgtttcatcggca

SEQ ID NO: 714249 - DNA, 25 bp, Artificial sequence
  Synthetic oligonucleotide
gcgtcacaacaaaatcacactcaga

SEQ ID NO: 714250 - DNA, 25 bp, Artificial sequence
  Synthetic oligonucleotide
atctactgcccctaaacaatcctga

SEQ ID NO: 714251 - DNA, 25 bp, Artificial sequence
  Synthetic oligonucleotide
tctattcttagaaccaacggtatgt

SEQ ID NO: 714252 - DNA, 25 bp, Artificial sequence
  Synthetic oligonucleotide
tgcagatcgttatggagccggaggt

SEQ ID NO: 714253 - DNA, 25 bp, Artificial sequence
  Synthetic oligonucleotide
ccgtatctttacctcatcactaacg

SEQ ID NO: 714254 - DNA, 25 bp, Artificial sequence
  Synthetic oligonucleotide
tctattcttagatccaacggtatgt

SEQ ID NO: 714255 - DNA, 25 bp, Artificial sequence
  Synthetic oligonucleotide
cattgtcccctcacatagctttcta

SEQ ID NO: 714256 - DNA, 25 bp, Artificial sequence
  Synthetic oligonucleotide
cattgtcccctctcatagctttcta

SEQ ID NO: 714257 - DNA, 25 bp, Artificial sequence
  Synthetic oligonucleotide
gaaagaataatacagtcagagctaa

SEQ ID NO: 714258 - DNA, 25 bp, Artificial sequence
  Synthetic oligonucleotide
gcgtcacaacaatatcacactcaga

SEQ ID NO: 714259 - DNA, 25 bp, Artificial sequence
  Synthetic oligonucleotide
caagagatagagtgagtaacagtga

SEQ ID NO: 714260 - DNA, 25 bp, Artificial sequence
  Synthetic oligonucleotide
tattgttcctgtggctatggatttc

SEQ ID NO: 714261 - DNA, 25 bp, Artificial sequence
  Synthetic oligonucleotide
cgagaaaatggcgtcgtggatgaaa

SEQ ID NO: 714262 - DNA, 25 bp, Artificial sequence
  Synthetic oligonucleotide
cgagaaaatggcctcgtggatgaaa

SEQ ID NO: 714263 - DNA, 25 bp, Artificial sequence
  Synthetic oligonucleotide
tctactggcgtcctagccacggcta

SEQ ID NO: 714264 - DNA, 25 bp, Artificial sequence
  Synthetic oligonucleotide
tctactggcgtcgtagccacggcta

SEQ ID NO: 714265 - DNA, 25 bp, Artificial sequence
  Synthetic oligonucleotide
caagagatagagagagtaacagtga

SEQ ID NO: 714266 - DNA, 25 bp, Artificial sequence
  Synthetic oligonucleotide
tattttgagctctttcctcacgtgg

SEQ ID NO: 714267 - DNA, 25 bp, Artificial sequence
  Synthetic oligonucleotide
gaaagaataatagagtcagagctaa

SEQ ID NO: 714268 - DNA, 25 bp, Artificial sequence
  Synthetic oligonucleotide
tattgttcctgtcgctatggatttc

SEQ ID NO: 714269 - DNA, 25 bp, Artificial sequence
  Synthetic oligonucleotide
tattttgagctcattcctcacgtgg

SEQ ID NO: 714270 - DNA, 25 bp, Artificial sequence
  Synthetic oligonucleotide
ccaatctggtttttgatttgtcgga

SEQ ID NO: 714271 - DNA, 25 bp, Artificial sequence
  Synthetic oligonucleotide
ggtatttgttcttcctcacattact

SEQ ID NO: 714272 - DNA, 25 bp, Artificial sequence
  Synthetic oligonucleotide
ggtatttgttctacctcacattact

SEQ ID NO: 714273 - DNA, 25 bp, Artificial sequence
  Synthetic oligonucleotide
caacagtggctgagagatatgtact

SEQ ID NO: 714274 - DNA, 25 bp, Artificial sequence
  Synthetic oligonucleotide
caacagtggctgtgagatatgtact

SEQ ID NO: 714275 - DNA, 25 bp, Artificial sequence
  Synthetic oligonucleotide
tgaagaccatatccacaaaacatgg

SEQ ID NO: 714276 - DNA, 25 bp, Artificial sequence
  Synthetic oligonucleotide
tgagagttacataacagatggttga

SEQ ID NO: 714277 - DNA, 25 bp, Artificial sequence
  Synthetic oligonucleotide
tgagagttacattacagatggttga

SEQ ID NO: 714278 - DNA, 25 bp, Artificial sequence
  Synthetic oligonucleotide
ccaatctggtttatgatttgtcgga

SEQ ID NO: 714279 - DNA, 25 bp, Artificial sequence
  Synthetic oligonucleotide
tctccaagtgataggtgactgcgga

SEQ ID NO: 714280 - DNA, 25 bp, Artificial sequence
  Synthetic oligonucleotide
gggtggaatctatttcaaggtttac

SEQ ID NO: 714281 - DNA, 25 bp, Artificial sequence
  Synthetic oligonucleotide
gggtggaatctaattcaaggtttac

SEQ ID NO: 714282 - DNA, 25 bp, Artificial sequence
  Synthetic oligonucleotide
tgaagaccatatgcacaaaacatgg

SEQ ID NO: 714283 - DNA, 25 bp, Artificial sequence
  Synthetic oligonucleotide
tatcatctcagcaaggagttggtgg

SEQ ID NO: 714284 - DNA, 25 bp, Artificial sequence
  Synthetic oligonucleotide
tatcatctcagctaggagttggtgg

SEQ ID NO: 714285 - DNA, 25 bp, Artificial sequence
  Synthetic oligonucleotide
tgagactcgggttagcggaacacat

SEQ ID NO: 714286 - DNA, 25 bp, Artificial sequence
  Synthetic oligonucleotide
tgagactcgggtaagcggaacacat

SEQ ID NO: 714287 - DNA, 25 bp, Artificial sequence
  Synthetic oligonucleotide
gctatattctcaatggtattggatg

SEQ ID NO: 714288 - DNA, 25 bp, Artificial sequence
  Synthetic oligonucleotide
gctatattctcattggtattggatg

SEQ ID NO: 714289 - DNA, 25 bp, Artificial sequence
  Synthetic oligonucleotide
taatagcatacaagaggttaccaag

SEQ ID NO: 714290 - DNA, 25 bp, Artificial sequence
  Synthetic oligonucleotide
tctccaagtgattggtgactgcgga

SEQ ID NO: 714291 - DNA, 25 bp, Artificial sequence
  Synthetic oligonucleotide
tgcatgatcatcgtactttgtactg

SEQ ID NO: 714292 - DNA, 25 bp, Artificial sequence
  Synthetic oligonucleotide
tgtcagcccgatctccgaacattat

SEQ ID NO: 714293 - DNA, 25 bp, Artificial sequence
  Synthetic oligonucleotide
ccgacgtatatgatgtgtagctatg

SEQ ID NO: 714294 - DNA, 25 bp, Artificial sequence
  Synthetic oligonucleotide
ccgacgtatatgttgtgtagctatg

SEQ ID NO: 714295 - DNA, 25 bp, Artificial sequence
  Synthetic oligonucleotide
taatagcatacatgaggttaccaag

SEQ ID NO: 714296 - DNA, 25 bp, Artificial sequence
  Synthetic oligonucleotide
ttttgatttctcactttaaaactga

SEQ ID NO: 714297 - DNA, 25 bp, Artificial sequence
  Synthetic oligonucleotide
tataattcaacagaaaactcatgat

SEQ ID NO: 714298 - DNA, 25 bp, Artificial sequence
  Synthetic oligonucleotide
tgtatacaatatcatcaactcatgt

SEQ ID NO: 714299 - DNA, 25 bp, Artificial sequence
  Synthetic oligonucleotide
tgactaattttgttacagagagact

SEQ ID NO: 714300 - DNA, 25 bp, Artificial sequence
  Synthetic oligonucleotide
agaatggaatccgtgtcgttagcaa

SEQ ID NO: 714301 - DNA, 25 bp, Artificial sequence
  Synthetic oligonucleotide
agaatggaatccctgtcgttagcaa

SEQ ID NO: 714302 - DNA, 25 bp, Artificial sequence
  Synthetic oligonucleotide
tgtcagcccgatgtccgaacattat

SEQ ID NO: 714303 - DNA, 25 bp, Artificial sequence
  Synthetic oligonucleotide
ttttttttgtaattctctaactctc

SEQ ID NO: 714304 - DNA, 25 bp, Artificial sequence
  Synthetic oligonucleotide
ttccaggtgcaacactccatcgtag

SEQ ID NO: 714305 - DNA, 25 bp, Artificial sequence
  Synthetic oligonucleotide
ttccaggtgcaagactccatcgtag

SEQ ID NO: 714306 - DNA, 25 bp, Artificial sequence
  Synthetic oligonucleotide
tcaacagagaatcgctcagctttgc

SEQ ID NO: 714307 - DNA, 25 bp, Artificial sequence
  Synthetic oligonucleotide
tcaacagagaatggctcagctttgc

SEQ ID NO: 714308 - DNA, 25 bp, Artificial sequence
  Synthetic oligonucleotide
ttttttttgtaaatctctaactctc

SEQ ID NO: 714309 - DNA, 25 bp, Artificial sequence
  Synthetic oligonucleotide
gggtcaaacttataacgtaattata

SEQ ID NO: 714310 - DNA, 25 bp, Artificial sequence
  Synthetic oligonucleotide
tgcatgatcatcctactttgtactg

SEQ ID NO: 714311 - DNA, 25 bp, Artificial sequence
  Synthetic oligonucleotide
ttttgatttctctctttaaaactga

SEQ ID NO: 714312 - DNA, 25 bp, Artificial sequence
  Synthetic oligonucleotide
catcgttggtctttgtgtgtagata

SEQ ID NO: 714313 - DNA, 25 bp, Artificial sequence
  Synthetic oligonucleotide
catcgttggtctatgtgtgtagata

SEQ ID NO: 714314 - DNA, 25 bp, Artificial sequence
  Synthetic oligonucleotide
agttatgggtggtctcttgtcagag

SEQ ID NO: 714315 - DNA, 25 bp, Artificial sequence
  Synthetic oligonucleotide
agttatgggtggactcttgtcagag

SEQ ID NO: 714316 - DNA, 25 bp, Artificial sequence
  Synthetic oligonucleotide
caatctaacaatgccttttgctggc

SEQ ID NO: 714317 - DNA, 25 bp, Artificial sequence
  Synthetic oligonucleotide
caatctaacaatcccttttgctggc

SEQ ID NO: 714318 - DNA, 25 bp, Artificial sequence
  Synthetic oligonucleotide
catctctccaaatatacaaaagggt

SEQ ID NO: 714319 - DNA, 25 bp, Artificial sequence
  Synthetic oligonucleotide
catctctccaaaaatacaaaagggt

SEQ ID NO: 714320 - DNA, 25 bp, Artificial sequence
  Synthetic oligonucleotide
caatggccgttcatgttttatgagt

SEQ ID NO: 714321 - DNA, 25 bp, Artificial sequence
  Synthetic oligonucleotide
caatggccgttcttgttttatgagt

SEQ ID NO: 714322 - DNA, 25 bp, Artificial sequence
  Synthetic oligonucleotide
gggtcaaacttaaaacgtaattata

SEQ ID NO: 714323 - DNA, 25 bp, Artificial sequence
  Synthetic oligonucleotide
tataattcaacacaaaactcatgat

SEQ ID NO: 714324 - DNA, 25 bp, Artificial sequence
  Synthetic oligonucleotide
agtgtgattctaggcttttttcatc

SEQ ID NO: 714325 - DNA, 25 bp, Artificial sequence
  Synthetic oligonucleotide
gaccaacaggtttcctcgatgtcga

SEQ ID NO: 714326 - DNA, 25 bp, Artificial sequence
  Synthetic oligonucleotide
gaccaacaggttacctcgatgtcga

SEQ ID NO: 714327 - DNA, 25 bp, Artificial sequence
  Synthetic oligonucleotide
catggcctatgtaaagcaggagcgg

SEQ ID NO: 714328 - DNA, 25 bp, Artificial sequence
  Synthetic oligonucleotide
catggcctatgttaagcaggagcgg

SEQ ID NO: 714329 - DNA, 25 bp, Artificial sequence
  Synthetic oligonucleotide
gatgattatgtggacaagagcacta

SEQ ID NO: 714330 - DNA, 25 bp, Artificial sequence
  Synthetic oligonucleotide
gatgattatgtgcacaagagcacta

SEQ ID NO: 714331 - DNA, 25 bp, Artificial sequence
  Synthetic oligonucleotide
catatttgatttaatacagaagaaa

SEQ ID NO: 714332 - DNA, 25 bp, Artificial sequence
  Synthetic oligonucleotide
catatttgattttatacagaagaaa

SEQ ID NO: 714333 - DNA, 25 bp, Artificial sequence
  Synthetic oligonucleotide
ggaacattggtttaaaatacacgca

SEQ ID NO: 714334 - DNA, 25 bp, Artificial sequence
  Synthetic oligonucleotide
ggaacattggttaaaaatacacgca

SEQ ID NO: 714335 - DNA, 25 bp, Artificial sequence
  Synthetic oligonucleotide
acaatgtatacctcttgtttgaggg

SEQ ID NO: 714336 - DNA, 25 bp, Artificial sequence
  Synthetic oligonucleotide
tgactaattttgatacagagagact

SEQ ID NO: 714337 - DNA, 25 bp, Artificial sequence
  Synthetic oligonucleotide
gaatccagaatagacctgttcaact

SEQ ID NO: 714338 - DNA, 25 bp, Artificial sequence
  Synthetic oligonucleotide
ggcaccaaatttctatattttctct

SEQ ID NO: 714339 - DNA, 25 bp, Artificial sequence
  Synthetic oligonucleotide
caatttatgcttttaatcacgagta

SEQ ID NO: 714340 - DNA, 25 bp, Artificial sequence
  Synthetic oligonucleotide
caatttatgcttataatcacgagta

SEQ ID NO: 714341 - DNA, 25 bp, Artificial sequence
  Synthetic oligonucleotide
ggcaccaaatttgtatattttctct

SEQ ID NO: 714342 - DNA, 25 bp, Artificial sequence
  Synthetic oligonucleotide
tctcgcatgtacctacgccaagaaa

SEQ ID NO: 714343 - DNA, 25 bp, Artificial sequence
  Synthetic oligonucleotide
cgagaatggagctgcctacttcatt

SEQ ID NO: 714344 - DNA, 25 bp, Artificial sequence
  Synthetic oligonucleotide
cgagaatggagcagcctacttcatt

SEQ ID NO: 714345 - DNA, 25 bp, Artificial sequence
  Synthetic oligonucleotide
cgtaaaacttaaggtgcaccattct

SEQ ID NO: 714346 - DNA, 25 bp, Artificial sequence
  Synthetic oligonucleotide
cgtaaaacttaacgtgcaccattct

SEQ ID NO: 714347 - DNA, 25 bp, Artificial sequence
  Synthetic oligonucleotide
cattgtatttaaaatcactcccaca

SEQ ID NO: 714348 - DNA, 25 bp, Artificial sequence
  Synthetic oligonucleotide
cattgtatttaatatcactcccaca

SEQ ID NO: 714349 - DNA, 25 bp, Artificial sequence
  Synthetic oligonucleotide
agtgtgattctacgcttttttcatc

SEQ ID NO: 714350 - DNA, 25 bp, Artificial sequence
  Synthetic oligonucleotide
ggcaaataccacttcttattgaaaa

SEQ ID NO: 714351 - DNA, 25 bp, Artificial sequence
  Synthetic oligonucleotide
ttatgtgtagaggaatcatttttac

SEQ ID NO: 714352 - DNA, 25 bp, Artificial sequence
  Synthetic oligonucleotide
ttatgtgtagagcaatcatttttac

SEQ ID NO: 714353 - DNA, 25 bp, Artificial sequence
  Synthetic oligonucleotide
gacttctctggctttatttcttttg

SEQ ID NO: 714354 - DNA, 25 bp, Artificial sequence
  Synthetic oligonucleotide
gacttctctggcattatttcttttg

SEQ ID NO: 714355 - DNA, 25 bp, Artificial sequence
  Synthetic oligonucleotide
gcatgtttggagtgacaatactaat

SEQ ID NO: 714356 - DNA, 25 bp, Artificial sequence
  Synthetic oligonucleotide
gcatgtttggagagacaatactaat

SEQ ID NO: 714357 - DNA, 25 bp, Artificial sequence
  Synthetic oligonucleotide
gctacatgtaagctatagagtaaac

SEQ ID NO: 714358 - DNA, 25 bp, Artificial sequence
  Synthetic oligonucleotide
gctacatgtaaggtatagagtaaac

SEQ ID NO: 714359 - DNA, 25 bp, Artificial sequence
  Synthetic oligonucleotide
aaggtaagtaaacatagttttatca

SEQ ID NO: 714360 - DNA, 25 bp, Artificial sequence
  Synthetic oligonucleotide
aaggtaagtaaagatagttttatca

SEQ ID NO: 714361 - DNA, 25 bp, Artificial sequence
  Synthetic oligonucleotide
acttagcaattctttgattcaaagg

SEQ ID NO: 714362 - DNA, 25 bp, Artificial sequence
  Synthetic oligonucleotide
acaatgtataccacttgtttgaggg

SEQ ID NO: 714363 - DNA, 25 bp, Artificial sequence
  Synthetic oligonucleotide
ggcaaataccacatcttattgaaaa

SEQ ID NO: 714364 - DNA, 25 bp, Artificial sequence
  Synthetic oligonucleotide
tgtatacaatatgatcaactcatgt

SEQ ID NO: 714365 - DNA, 25 bp, Artificial sequence
  Synthetic oligonucleotide
taattattcagacgacatgaccaag

SEQ ID NO: 714366 - DNA, 25 bp, Artificial sequence
  Synthetic oligonucleotide
taattattcagaggacatgaccaag

SEQ ID NO: 714367 - DNA, 25 bp, Artificial sequence
  Synthetic oligonucleotide
tgaaaacaaaatatatgaaaagaaa

SEQ ID NO: 714368 - DNA, 25 bp, Artificial sequence
  Synthetic oligonucleotide
tgaaaacaaaatttatgaaaagaaa

SEQ ID NO: 714369 - DNA, 25 bp, Artificial sequence
  Synthetic oligonucleotide
tagctcccagcagatcttcttttgg

SEQ ID NO: 714370 - DNA, 25 bp, Artificial sequence
  Synthetic oligonucleotide
tagctcccagcacatcttcttttgg

SEQ ID NO: 714371 - DNA, 25 bp, Artificial sequence
  Synthetic oligonucleotide
cagactacttcagagctggctttga

SEQ ID NO: 714372 - DNA, 25 bp, Artificial sequence
  Synthetic oligonucleotide
cagactacttcacagctggctttga

SEQ ID NO: 714373 - DNA, 25 bp, Artificial sequence
  Synthetic oligonucleotide
ggaacatactcatacaaatttggca

SEQ ID NO: 714374 - DNA, 25 bp, Artificial sequence
  Synthetic oligonucleotide
ggaacatactcaaacaaatttggca

SEQ ID NO: 714375 - DNA, 25 bp, Artificial sequence
  Synthetic oligonucleotide
gaatccagaatacacctgttcaact

SEQ ID NO: 714376 - DNA, 25 bp, Artificial sequence
  Synthetic oligonucleotide
acttagcaattcattgattcaaagg

SEQ ID NO: 714377 - DNA, 25 bp, Artificial sequence
  Synthetic oligonucleotide
caagatactctacatatttgctttt

SEQ ID NO: 714378 - DNA, 25 bp, Artificial sequence
  Synthetic oligonucleotide
gaacctagccactacactatcatcg

SEQ ID NO: 714379 - DNA, 25 bp, Artificial sequence
  Synthetic oligonucleotide
tcgttcaaaaacagtaatatctatt

SEQ ID NO: 714380 - DNA, 25 bp, Artificial sequence
  Synthetic oligonucleotide
tcgttcaaaaactgtaatatctatt

SEQ ID NO: 714381 - DNA, 25 bp, Artificial sequence
  Synthetic oligonucleotide
aaaaatagaacattatgcggcgaac

SEQ ID NO: 714382 - DNA, 25 bp, Artificial sequence
  Synthetic oligonucleotide
aaaaatagaacaatatgcggcgaac

SEQ ID NO: 714383 - DNA, 25 bp, Artificial sequence
  Synthetic oligonucleotide
caacgtaaagataaatttggtatgc

SEQ ID NO: 714384 - DNA, 25 bp, Artificial sequence
  Synthetic oligonucleotide
caacgtaaagattaatttggtatgc

SEQ ID NO: 714385 - DNA, 25 bp, Artificial sequence
  Synthetic oligonucleotide
tgcatactccaaaaataaaatggtt

SEQ ID NO: 714386 - DNA, 25 bp, Artificial sequence
  Synthetic oligonucleotide
tgcatactccaataataaaatggtt

SEQ ID NO: 714387 - DNA, 25 bp, Artificial sequence
  Synthetic oligonucleotide
gatgtttagtcctttttgcacacag

SEQ ID NO: 714388 - DNA, 25 bp, Artificial sequence
  Synthetic oligonucleotide
gatgtttagtccattttgcacacag

SEQ ID NO: 714389 - DNA, 25 bp, Artificial sequence
  Synthetic oligonucleotide
tacaaatctgtttgagatttagacc

SEQ ID NO: 714390 - DNA, 25 bp, Artificial sequence
  Synthetic oligonucleotide
cctaaagttacacatatagaaagcg

SEQ ID NO: 714391 - DNA, 25 bp, Artificial sequence
  Synthetic oligonucleotide
tacttaaacttccaatgattgtggc

SEQ ID NO: 714392 - DNA, 25 bp, Artificial sequence
  Synthetic oligonucleotide
caagatactctagatatttgctttt

SEQ ID NO: 714393 - DNA, 25 bp, Artificial sequence
  Synthetic oligonucleotide
caatcggcagttagagttttgaggt

SEQ ID NO: 714394 - DNA, 25 bp, Artificial sequence
  Synthetic oligonucleotide
caatcggcagtttgagttttgaggt

SEQ ID NO: 714395 - DNA, 25 bp, Artificial sequence
  Synthetic oligonucleotide
tcgaagcgtggacggtctaaattaa

SEQ ID NO: 714396 - DNA, 25 bp, Artificial sequence
  Synthetic oligonucleotide
tcgaagcgtggagggtctaaattaa

SEQ ID NO: 714397 - DNA, 25 bp, Artificial sequence
  Synthetic oligonucleotide
gaattagaggcccataagccacaga

SEQ ID NO: 714398 - DNA, 25 bp, Artificial sequence
  Synthetic oligonucleotide
gaattagaggccgataagccacaga

SEQ ID NO: 714399 - DNA, 25 bp, Artificial sequence
  Synthetic oligonucleotide
ttttcctcttccaccgagagagaag

SEQ ID NO: 714400 - DNA, 25 bp, Artificial sequence
  Synthetic oligonucleotide
ttttcctcttcctccgagagagaag

SEQ ID NO: 714401 - DNA, 25 bp, Artificial sequence
  Synthetic oligonucleotide
gaggccatgcctgtgtccgtacatt

SEQ ID NO: 714402 - DNA, 25 bp, Artificial sequence
  Synthetic oligonucleotide
gaggccatgcctctgtccgtacatt

SEQ ID NO: 714403 - DNA, 25 bp, Artificial sequence
  Synthetic oligonucleotide
cctaaagttacagatatagaaagcg

SEQ ID NO: 714404 - DNA, 25 bp, Artificial sequence
  Synthetic oligonucleotide
tacatgaccaactttttgaaagaac

SEQ ID NO: 714405 - DNA, 25 bp, Artificial sequence
  Synthetic oligonucleotide
tctcgcatgtacgtacgccaagaaa

SEQ ID NO: 714406 - DNA, 25 bp, Artificial sequence
  Synthetic oligonucleotide
tattgaaatgctatcagggaaaatc

SEQ ID NO: 714407 - DNA, 25 bp, Artificial sequence
  Synthetic oligonucleotide
caattcgtatctattttaaagttaa

SEQ ID NO: 714408 - DNA, 25 bp, Artificial sequence
  Synthetic oligonucleotide
tagtaaaaattaaggaataaagcta

SEQ ID NO: 714409 - DNA, 25 bp, Artificial sequence
  Synthetic oligonucleotide
tagtaaaaattatggaataaagcta

SEQ ID NO: 714410 - DNA, 25 bp, Artificial sequence
  Synthetic oligonucleotide
ccatagtagtattatacttttaaaa

SEQ ID NO: 714411 - DNA, 25 bp, Artificial sequence
  Synthetic oligonucleotide
tttccaaataaaaacatatgttttc

SEQ ID NO: 714412 - DNA, 25 bp, Artificial sequence
  Synthetic oligonucleotide
gataatttagaaatcagaaaaatca

SEQ ID NO: 714413 - DNA, 25 bp, Artificial sequence
  Synthetic oligonucleotide
caattcgtatcttttttaaagttaa

SEQ ID NO: 714414 - DNA, 25 bp, Artificial sequence
  Synthetic oligonucleotide
gataatttagaattcagaaaaatca

SEQ ID NO: 714415 - DNA, 25 bp, Artificial sequence
  Synthetic oligonucleotide
taaaaatgttactgccttacagtct

SEQ ID NO: 714416 - DNA, 25 bp, Artificial sequence
  Synthetic oligonucleotide
tacaaatctgttagagatttagacc

SEQ ID NO: 714417 - DNA, 25 bp, Artificial sequence
  Synthetic oligonucleotide
tacatgaccaacattttgaaagaac

SEQ ID NO: 714418 - DNA, 25 bp, Artificial sequence
  Synthetic oligonucleotide
tttccaaataaatacatatgttttc

SEQ ID NO: 714419 - DNA, 25 bp, Artificial sequence
  Synthetic oligonucleotide
aatattgcaatgttttacatcagcg

SEQ ID NO: 714420 - DNA, 25 bp, Artificial sequence
  Synthetic oligonucleotide
aatattgcaatgatttacatcagcg

SEQ ID NO: 714421 - DNA, 25 bp, Artificial sequence
  Synthetic oligonucleotide
gaaagaaaaacacattgaagattag

SEQ ID NO: 714422 - DNA, 25 bp, Artificial sequence
  Synthetic oligonucleotide
gaaagaaaaacagattgaagattag

SEQ ID NO: 714423 - DNA, 25 bp, Artificial sequence
  Synthetic oligonucleotide
tgacaaatttagtttaacaaatagg

SEQ ID NO: 714424 - DNA, 25 bp, Artificial sequence
  Synthetic oligonucleotide
tgacaaatttagattaacaaatagg

SEQ ID NO: 714425 - DNA, 25 bp, Artificial sequence
  Synthetic oligonucleotide
caaacataccttttttctaaatgta

SEQ ID NO: 714426 - DNA, 25 bp, Artificial sequence
  Synthetic oligonucleotide
caaacataccttatttctaaatgta

SEQ ID NO: 714427 - DNA, 25 bp, Artificial sequence
  Synthetic oligonucleotide
gtggttctaaaacaacaatctcaag

SEQ ID NO: 714428 - DNA, 25 bp, Artificial sequence
  Synthetic oligonucleotide
gtggttctaaaagaacaatctcaag

SEQ ID NO: 714429 - DNA, 25 bp, Artificial sequence
  Synthetic oligonucleotide
tacttaaacttcgaatgattgtggc

SEQ ID NO: 714430 - DNA, 25 bp, Artificial sequence
  Synthetic oligonucleotide
taaaaatgttacagccttacagtct

SEQ ID NO: 714431 - DNA, 25 bp, Artificial sequence
  Synthetic oligonucleotide
ggtgtgtgttactctcgtcgcttaa

SEQ ID NO: 714432 - DNA, 25 bp, Artificial sequence
  Synthetic oligonucleotide
cttggagaagataaaagggtaagca

SEQ ID NO: 714433 - DNA, 25 bp, Artificial sequence
  Synthetic oligonucleotide
cttggagaagattaaagggtaagca

SEQ ID NO: 714434 - DNA, 25 bp, Artificial sequence
  Synthetic oligonucleotide
gattagaatttgaataagatatggt

SEQ ID NO: 714435 - DNA, 25 bp, Artificial sequence
  Synthetic oligonucleotide
gattagaatttgtataagatatggt

SEQ ID NO: 714436 - DNA, 25 bp, Artificial sequence
  Synthetic oligonucleotide
aatggttaggctttatttaatgatg

SEQ ID NO: 714437 - DNA, 25 bp, Artificial sequence
  Synthetic oligonucleotide
aatggttaggctatatttaatgatg

SEQ ID NO: 714438 - DNA, 25 bp, Artificial sequence
  Synthetic oligonucleotide
tgggtgcctcctccaataaagatga

SEQ ID NO: 714439 - DNA, 25 bp, Artificial sequence
  Synthetic oligonucleotide
tgggtgcctcctgcaataaagatga

SEQ ID NO: 714440 - DNA, 25 bp, Artificial sequence
  Synthetic oligonucleotide
gttcgtcagaacttcgatatatcga

SEQ ID NO: 714441 - DNA, 25 bp, Artificial sequence
  Synthetic oligonucleotide
gttcgtcagaacatcgatatatcga

SEQ ID NO: 714442 - DNA, 25 bp, Artificial sequence
  Synthetic oligonucleotide
gatgtggctgctgttgatatgcttc

SEQ ID NO: 714443 - DNA, 25 bp, Artificial sequence
  Synthetic oligonucleotide
caatagagttcgacgagagcgtcca

SEQ ID NO: 714444 - DNA, 25 bp, Artificial sequence
  Synthetic oligonucleotide
ggtgtgtgttacactcgtcgcttaa

SEQ ID NO: 714445 - DNA, 25 bp, Artificial sequence
  Synthetic oligonucleotide
tgcactgaaacatctcacagacttg

SEQ ID NO: 714446 - DNA, 25 bp, Artificial sequence
  Synthetic oligonucleotide
gacgtttcctatcttcttgctaaag

SEQ ID NO: 714447 - DNA, 25 bp, Artificial sequence
  Synthetic oligonucleotide
gacgtttcctatgttcttgctaaag

SEQ ID NO: 714448 - DNA, 25 bp, Artificial sequence
  Synthetic oligonucleotide
gaataggtgggaatatgcgaatgac

SEQ ID NO: 714449 - DNA, 25 bp, Artificial sequence
  Synthetic oligonucleotide
gaataggtgggattatgcgaatgac

SEQ ID NO: 714450 - DNA, 25 bp, Artificial sequence
  Synthetic oligonucleotide
tgcactgaaacaactcacagacttg

SEQ ID NO: 714451 - DNA, 25 bp, Artificial sequence
  Synthetic oligonucleotide
gcgagaggggctttatctttctcct

SEQ ID NO: 714452 - DNA, 25 bp, Artificial sequence
  Synthetic oligonucleotide
gcgagaggggctatatctttctcct

SEQ ID NO: 714453 - DNA, 25 bp, Artificial sequence
  Synthetic oligonucleotide
tctatttgtttaactattgggctgc

SEQ ID NO: 714454 - DNA, 25 bp, Artificial sequence
  Synthetic oligonucleotide
tattgaaatgctttcagggaaaatc

SEQ ID NO: 714455 - DNA, 25 bp, Artificial sequence
  Synthetic oligonucleotide
tctatttgtttatctattgggctgc

SEQ ID NO: 714456 - DNA, 25 bp, Artificial sequence
  Synthetic oligonucleotide
gaacctagccacaacactatcatcg

SEQ ID NO: 714457 - DNA, 25 bp, Artificial sequence
  Synthetic oligonucleotide
ccatagtagtataatacttttaaaa

SEQ ID NO: 714458 - DNA, 25 bp, Artificial sequence
  Synthetic oligonucleotide
gatgtggctgctcttgatatgcttc

SEQ ID NO: 714459 - DNA, 25 bp, Artificial sequence
  Synthetic oligonucleotide
tcggtgaaactgtagaacgggaacg

SEQ ID NO: 714460 - DNA, 25 bp, Artificial sequence
  Synthetic oligonucleotide
gtttctcgccgttgaactatctcca

SEQ ID NO: 714461 - DNA, 25 bp, Artificial sequence
  Synthetic oligonucleotide
gtttctcgccgtagaactatctcca

SEQ ID NO: 714462 - DNA, 25 bp, Artificial sequence
  Synthetic oligonucleotide
caatagagttcgtcgagagcgtcca

SEQ ID NO: 714463 - DNA, 25 bp, Artificial sequence
  Synthetic oligonucleotide
tgaattgttcggaggagattacgga

SEQ ID NO: 714464 - DNA, 25 bp, Artificial sequence
  Synthetic oligonucleotide
tgaattgttcggtggagattacgga

SEQ ID NO: 714465 - DNA, 25 bp, Artificial sequence
  Synthetic oligonucleotide
tcggtgaaactgaagaacgggaacg

SEQ ID NO: 714466 - DNA, 25 bp, Artificial sequence
  Synthetic oligonucleotide
tatgcagagttctcaacgggatgtg

SEQ ID NO: 714467 - DNA, 25 bp, Artificial sequence
  Synthetic oligonucleotide
tatgcagagttcacaacgggatgtg

SEQ ID NO: 714468 - DNA, 25 bp, Artificial sequence
  Synthetic oligonucleotide
atgggggaagatagatcgaaacgac

SEQ ID NO: 714469 - DNA, 25 bp, Artificial sequence
  Synthetic oligonucleotide
atgggggaagattgatcgaaacgac

SEQ ID NO: 714470 - DNA, 25 bp, Artificial sequence
  Synthetic oligonucleotide
caatgcttcgttacgccgatgctgg

SEQ ID NO: 714471 - DNA, 25 bp, Artificial sequence
  Synthetic oligonucleotide
caatgcttcgtttcgccgatgctgg

SEQ ID NO: 714472 - DNA, 25 bp, Artificial sequence
  Synthetic oligonucleotide
tcgatatggctgatcactgtaagta

SEQ ID NO: 714473 - DNA, 25 bp, Artificial sequence
  Synthetic oligonucleotide
cttgatgaccttcaatgtgtggagc

SEQ ID NO: 714474 - DNA, 25 bp, Artificial sequence
  Synthetic oligonucleotide
agagttgtgcttagtttgttttcta

SEQ ID NO: 714475 - DNA, 25 bp, Artificial sequence
  Synthetic oligonucleotide
cacagaagaattcaattgtgtggag

SEQ ID NO: 714476 - DNA, 25 bp, Artificial sequence
  Synthetic oligonucleotide
tcgatatggctgttcactgtaagta

SEQ ID NO: 714477 - DNA, 25 bp, Artificial sequence
  Synthetic oligonucleotide
gatggtcctgctcaagatctttacg

SEQ ID NO: 714478 - DNA, 25 bp, Artificial sequence
  Synthetic oligonucleotide
cacagaagaattgaattgtgtggag

SEQ ID NO: 714479 - DNA, 25 bp, Artificial sequence
  Synthetic oligonucleotide
agagttgtgctttgtttgttttcta

SEQ ID NO: 714480 - DNA, 25 bp, Artificial sequence
  Synthetic oligonucleotide
gatggtcctgctgaagatctttacg

SEQ ID NO: 714481 - DNA, 25 bp, Artificial sequence
  Synthetic oligonucleotide
gtggagattagttatagaactgtgc

SEQ ID NO: 714482 - DNA, 25 bp, Artificial sequence
  Synthetic oligonucleotide
gtggagattagtaatagaactgtgc

SEQ ID NO: 714483 - DNA, 25 bp, Artificial sequence
  Synthetic oligonucleotide
aattgaatattcagaattgacttga

SEQ ID NO: 714484 - DNA, 25 bp, Artificial sequence
  Synthetic oligonucleotide
aattgaatattctgaattgacttga

SEQ ID NO: 714485 - DNA, 25 bp, Artificial sequence
  Synthetic oligonucleotide
cttgatgaccttgaatgtgtggagc

SEQ ID NO: 714486 - DNA, 25 bp, Artificial sequence
  Synthetic oligonucleotide
tttgagaggatgttgagaggacaga

SEQ ID NO: 714487 - DNA, 25 bp, Artificial sequence
  Synthetic oligonucleotide
tttgagaggatgatgagaggacaga

SEQ ID NO: 714488 - DNA, 25 bp, Artificial sequence
  Synthetic oligonucleotide
gaacgaatgggttggatctatagga

SEQ ID NO: 714489 - DNA, 25 bp, Artificial sequence
  Synthetic oligonucleotide
gaacgaatgggtaggatctatagga

SEQ ID NO: 714490 - DNA, 25 bp, Artificial sequence
  Synthetic oligonucleotide
tgttgaatctggagaagaaggttga

SEQ ID NO: 714491 - DNA, 25 bp, Artificial sequence
  Synthetic oligonucleotide
tgttgaatctggtgaagaaggttga

SEQ ID NO: 714492 - DNA, 25 bp, Artificial sequence
  Synthetic oligonucleotide
tgtgtagctctgatgttatggataa

SEQ ID NO: 714493 - DNA, 25 bp, Artificial sequence
  Synthetic oligonucleotide
cgtgcgggtcacaagcccataaggt

SEQ ID NO: 714494 - DNA, 25 bp, Artificial sequence
  Synthetic oligonucleotide
cgtgcgggtcactagcccataaggt

SEQ ID NO: 714495 - DNA, 25 bp, Artificial sequence
  Synthetic oligonucleotide
tgtgtagctctgttgttatggataa

SEQ ID NO: 714496 - DNA, 25 bp, Artificial sequence
  Synthetic oligonucleotide
tcagatggcgaatttgacaatggag

SEQ ID NO: 714497 - DNA, 25 bp, Artificial sequence
  Synthetic oligonucleotide
tcagatggcgaaattgacaatggag

SEQ ID NO: 714498 - DNA, 25 bp, Artificial sequence
  Synthetic oligonucleotide
tagttgaggccaataaaacttagct

SEQ ID NO: 714499 - DNA, 25 bp, Artificial sequence
  Synthetic oligonucleotide
atgggtgctttagccgttgggccaa

SEQ ID NO: 714500 - DNA, 25 bp, Artificial sequence
  Synthetic oligonucleotide
catgcaataggtagtgtctatcacc

SEQ ID NO: 714501 - DNA, 25 bp, Artificial sequence
  Synthetic oligonucleotide
catgcaataggttgtgtctatcacc

SEQ ID NO: 714502 - DNA, 25 bp, Artificial sequence
  Synthetic oligonucleotide
tacgtgcttcctttaactgagaact

SEQ ID NO: 714503 - DNA, 25 bp, Artificial sequence
  Synthetic oligonucleotide
tacgtgcttcctataactgagaact

SEQ ID NO: 714504 - DNA, 25 bp, Artificial sequence
  Synthetic oligonucleotide
taggaagaatcacgatagaagagtg

SEQ ID NO: 714505 - DNA, 25 bp, Artificial sequence
  Synthetic oligonucleotide
tacccatgttcagacagcgatgcct

SEQ ID NO: 714506 - DNA, 25 bp, Artificial sequence
  Synthetic oligonucleotide
tagttgaggccattaaaacttagct

SEQ ID NO: 714507 - DNA, 25 bp, Artificial sequence
  Synthetic oligonucleotide
tgatgttcaactagtattgttttgg

SEQ ID NO: 714508 - DNA, 25 bp, Artificial sequence
  Synthetic oligonucleotide
tgatgttcaacttgtattgttttgg

SEQ ID NO: 714509 - DNA, 25 bp, Artificial sequence
  Synthetic oligonucleotide
atgggtgctttacccgttgggccaa

SEQ ID NO: 714510 - DNA, 25 bp, Artificial sequence
  Synthetic oligonucleotide
tacccatgttcacacagcgatgcct

SEQ ID NO: 714511 - DNA, 25 bp, Artificial sequence
  Synthetic oligonucleotide
ttacagtctacagaagccttcaact

SEQ ID NO: 714512 - DNA, 25 bp, Artificial sequence
  Synthetic oligonucleotide
ttacagtctacacaagccttcaact

SEQ ID NO: 714513 - DNA, 25 bp, Artificial sequence
  Synthetic oligonucleotide
cgatgtaccctaaatatagttccaa

SEQ ID NO: 714514 - DNA, 25 bp, Artificial sequence
  Synthetic oligonucleotide
ttggaccatatatgtaaaacagagc

SEQ ID NO: 714515 - DNA, 25 bp, Artificial sequence
  Synthetic oligonucleotide
gctgagttaagagcgaagacgcgca

SEQ ID NO: 714516 - DNA, 25 bp, Artificial sequence
  Synthetic oligonucleotide
tgttcacgcagcagcgataccttct

SEQ ID NO: 714517 - DNA, 25 bp, Artificial sequence
  Synthetic oligonucleotide
tgttcacgcagctgcgataccttct

SEQ ID NO: 714518 - DNA, 25 bp, Artificial sequence
  Synthetic oligonucleotide
tgaacattacagactactcaagcct

SEQ ID NO: 714519 - DNA, 25 bp, Artificial sequence
  Synthetic oligonucleotide
tgaacattacagtctactcaagcct

SEQ ID NO: 714520 - DNA, 25 bp, Artificial sequence
  Synthetic oligonucleotide
gaacattgcactttgcagaagcctg

SEQ ID NO: 714521 - DNA, 25 bp, Artificial sequence
  Synthetic oligonucleotide
cacaagctgaggaaagaacgttgac

SEQ ID NO: 714522 - DNA, 25 bp, Artificial sequence
  Synthetic oligonucleotide
taggaagaatcaggatagaagagtg

SEQ ID NO: 714523 - DNA, 25 bp, Artificial sequence
  Synthetic oligonucleotide
gctgagttaagaccgaagacgcgca

SEQ ID NO: 714524 - DNA, 25 bp, Artificial sequence
  Synthetic oligonucleotide
gaacattgcactatgcagaagcctg

SEQ ID NO: 714525 - DNA, 25 bp, Artificial sequence
  Synthetic oligonucleotide
tcgcaagctgaatctagtcgtgttc

SEQ ID NO: 714526 - DNA, 25 bp, Artificial sequence
  Synthetic oligonucleotide
tcgcaagctgaaactagtcgtgttc

SEQ ID NO: 714527 - DNA, 25 bp, Artificial sequence
  Synthetic oligonucleotide
gaacctgaggcctgtcctgatttca

SEQ ID NO: 714528 - DNA, 25 bp, Artificial sequence
  Synthetic oligonucleotide
gaacctgaggccagtcctgatttca

SEQ ID NO: 714529 - DNA, 25 bp, Artificial sequence
  Synthetic oligonucleotide
aaaccggagatagttatgagtcgca

SEQ ID NO: 714530 - DNA, 25 bp, Artificial sequence
  Synthetic oligonucleotide
aaaccggagatacttatgagtcgca

SEQ ID NO: 714531 - DNA, 25 bp, Artificial sequence
  Synthetic oligonucleotide
ggaaagctccagcaccaaagagatc

SEQ ID NO: 714532 - DNA, 25 bp, Artificial sequence
  Synthetic oligonucleotide
ggaaagctccaggaccaaagagatc

SEQ ID NO: 714533 - DNA, 25 bp, Artificial sequence
  Synthetic oligonucleotide
cacaagctgaggtaagaacgttgac

SEQ ID NO: 714534 - DNA, 25 bp, Artificial sequence
  Synthetic oligonucleotide
tacctataaaaaaggcggccgcaaa

SEQ ID NO: 714535 - DNA, 25 bp, Artificial sequence
  Synthetic oligonucleotide
aaaaacattttatttgagttgtcgc

SEQ ID NO: 714536 - DNA, 25 bp, Artificial sequence
  Synthetic oligonucleotide
tatcccatcaactacaactattatg

SEQ ID NO: 714537 - DNA, 25 bp, Artificial sequence
  Synthetic oligonucleotide
tatcccatcaacaacaactattatg

SEQ ID NO: 714538 - DNA, 25 bp, Artificial sequence
  Synthetic oligonucleotide
agtaaaagaaacaaatcttatctgg

SEQ ID NO: 714539 - DNA, 25 bp, Artificial sequence
  Synthetic oligonucleotide
agtaaaagaaactaatcttatctgg

SEQ ID NO: 714540 - DNA, 25 bp, Artificial sequence
  Synthetic oligonucleotide
tgcacacagaccaatggacgtagag

SEQ ID NO: 714541 - DNA, 25 bp, Artificial sequence
  Synthetic oligonucleotide
tgcacacagacctatggacgtagag

SEQ ID NO: 714542 - DNA, 25 bp, Artificial sequence
  Synthetic oligonucleotide
cgagccagatgtgaggtaccttgag

SEQ ID NO: 714543 - DNA, 25 bp, Artificial sequence
  Synthetic oligonucleotide
cgagccagatgtcaggtaccttgag

SEQ ID NO: 714544 - DNA, 25 bp, Artificial sequence
  Synthetic oligonucleotide
gtcacattgaggtatctttggcggg

SEQ ID NO: 714545 - DNA, 25 bp, Artificial sequence
  Synthetic oligonucleotide
aaaaacattttaattgagttgtcgc

SEQ ID NO: 714546 - DNA, 25 bp, Artificial sequence
  Synthetic oligonucleotide
tacctataaaaatggcggccgcaaa

SEQ ID NO: 714547 - DNA, 25 bp, Artificial sequence
  Synthetic oligonucleotide
ccttcataaaaaatgaaacatatta

SEQ ID NO: 714548 - DNA, 25 bp, Artificial sequence
  Synthetic oligonucleotide
ctccgatgtttctatcgtgaaatcg

SEQ ID NO: 714549 - DNA, 25 bp, Artificial sequence
  Synthetic oligonucleotide
ctccgatgtttcaatcgtgaaatcg

SEQ ID NO: 714550 - DNA, 25 bp, Artificial sequence
  Synthetic oligonucleotide
taaaaaaagaaaaaagaggaggcga

SEQ ID NO: 714551 - DNA, 25 bp, Artificial sequence
  Synthetic oligonucleotide
taaaaaaagaaataagaggaggcga

SEQ ID NO: 714552 - DNA, 25 bp, Artificial sequence
  Synthetic oligonucleotide
acctgacggcgaggaccggtgattc

SEQ ID NO: 714553 - DNA, 25 bp, Artificial sequence
  Synthetic oligonucleotide
acctgacggcgacgaccggtgattc

SEQ ID NO: 714554 - DNA, 25 bp, Artificial sequence
  Synthetic oligonucleotide
tttaataaaatctccgccgtctgaa

SEQ ID NO: 714555 - DNA, 25 bp, Artificial sequence
  Synthetic oligonucleotide
agcagcgatgccatctcttcctgta

SEQ ID NO: 714556 - DNA, 25 bp, Artificial sequence
  Synthetic oligonucleotide
taagagagtctaatgcggatactca

SEQ ID NO: 714557 - DNA, 25 bp, Artificial sequence
  Synthetic oligonucleotide
tttaataaaatcaccgccgtctgaa

SEQ ID NO: 714558 - DNA, 25 bp, Artificial sequence
  Synthetic oligonucleotide
gtcacattgaggaatctttggcggg

SEQ ID NO: 714559 - DNA, 25 bp, Artificial sequence
  Synthetic oligonucleotide
agtagaaacactagaaccctaattc

SEQ ID NO: 714560 - DNA, 25 bp, Artificial sequence
  Synthetic oligonucleotide
gtttgatgtgatgattgcatcgtgc

SEQ ID NO: 714561 - DNA, 25 bp, Artificial sequence
  Synthetic oligonucleotide
gtttgatgtgatcattgcatcgtgc

SEQ ID NO: 714562 - DNA, 25 bp, Artificial sequence
  Synthetic oligonucleotide
atttggggatcagtcgtctattagc

SEQ ID NO: 714563 - DNA, 25 bp, Artificial sequence
  Synthetic oligonucleotide
atttggggatcactcgtctattagc

SEQ ID NO: 714564 - DNA, 25 bp, Artificial sequence
  Synthetic oligonucleotide
aatatcattataatgcttcttcttc

SEQ ID NO: 714565 - DNA, 25 bp, Artificial sequence
  Synthetic oligonucleotide
aatatcattatattgcttcttcttc

SEQ ID NO: 714566 - DNA, 25 bp, Artificial sequence
  Synthetic oligonucleotide
cactaaaggatctagaaccagaaac

SEQ ID NO: 714567 - DNA, 25 bp, Artificial sequence
  Synthetic oligonucleotide
cactaaaggatcaagaaccagaaac

SEQ ID NO: 714568 - DNA, 25 bp, Artificial sequence
  Synthetic oligonucleotide
ccaaaattcaggataatcattatag

SEQ ID NO: 714569 - DNA, 25 bp, Artificial sequence
  Synthetic oligonucleotide
ccaaaattcaggttaatcattatag

SEQ ID NO: 714570 - DNA, 25 bp, Artificial sequence
  Synthetic oligonucleotide
cgatgtaccctatatatagttccaa

SEQ ID NO: 714571 - DNA, 25 bp, Artificial sequence
  Synthetic oligonucleotide
tggaaacgtatgcaatgactaaaca

SEQ ID NO: 714572 - DNA, 25 bp, Artificial sequence
  Synthetic oligonucleotide
ttggaccatataagtaaaacagagc

SEQ ID NO: 714573 - DNA, 25 bp, Artificial sequence
  Synthetic oligonucleotide
agtagaaacacttgaaccctaattc

SEQ ID NO: 714574 - DNA, 25 bp, Artificial sequence
  Synthetic oligonucleotide
cataaatctttctatttgagtggaa

SEQ ID NO: 714575 - DNA, 25 bp, Artificial sequence
  Synthetic oligonucleotide
cataaatctttcaatttgagtggaa

SEQ ID NO: 714576 - DNA, 25 bp, Artificial sequence
  Synthetic oligonucleotide
cttgattcccctaacttgaaagtaa

SEQ ID NO: 714577 - DNA, 25 bp, Artificial sequence
  Synthetic oligonucleotide
cttgattccccttacttgaaagtaa

SEQ ID NO: 714578 - DNA, 25 bp, Artificial sequence
  Synthetic oligonucleotide
gaatgtaagaataaaaaaaagcgta

SEQ ID NO: 714579 - DNA, 25 bp, Artificial sequence
  Synthetic oligonucleotide
gaatgtaagaattaaaaaaagcgta

SEQ ID NO: 714580 - DNA, 25 bp, Artificial sequence
  Synthetic oligonucleotide
tatcacgactaaaacatgctagttg

SEQ ID NO: 714581 - DNA, 25 bp, Artificial sequence
  Synthetic oligonucleotide
tatcacgactaatacatgctagttg

SEQ ID NO: 714582 - DNA, 25 bp, Artificial sequence
  Synthetic oligonucleotide
ccttcataaaaattgaaacatatta

SEQ ID NO: 714583 - DNA, 25 bp, Artificial sequence
  Synthetic oligonucleotide
tggaaacgtatggaatgactaaaca

SEQ ID NO: 714584 - DNA, 25 bp, Artificial sequence
  Synthetic oligonucleotide
tagggtttgatcctctctctttcaa

SEQ ID NO: 714585 - DNA, 25 bp, Artificial sequence
  Synthetic oligonucleotide
ttaacaatcgaaacaaaacaaaatg

SEQ ID NO: 714586 - DNA, 25 bp, Artificial sequence
  Synthetic oligonucleotide
aaaagatttggtccggtcggagaga

SEQ ID NO: 714587 - DNA, 25 bp, Artificial sequence
  Synthetic oligonucleotide
aaaagatttggtgcggtcggagaga

SEQ ID NO: 714588 - DNA, 25 bp, Artificial sequence
  Synthetic oligonucleotide
gaaagtcatcgtcactcccagaaag

SEQ ID NO: 714589 - DNA, 25 bp, Artificial sequence
  Synthetic oligonucleotide
gaaagtcatcgtgactcccagaaag

SEQ ID NO: 714590 - DNA, 25 bp, Artificial sequence
  Synthetic oligonucleotide
caaaggtatgagtagactatccgac

SEQ ID NO: 714591 - DNA, 25 bp, Artificial sequence
  Synthetic oligonucleotide
caaaggtatgagaagactatccgac

SEQ ID NO: 714592 - DNA, 25 bp, Artificial sequence
  Synthetic oligonucleotide
tctggatacgaattgtttctccact

SEQ ID NO: 714593 - DNA, 25 bp, Artificial sequence
  Synthetic oligonucleotide
tctggatacgaaatgtttctccact

SEQ ID NO: 714594 - DNA, 25 bp, Artificial sequence
  Synthetic oligonucleotide
gaacatgtttttgttcttcttgtga

SEQ ID NO: 714595 - DNA, 25 bp, Artificial sequence
  Synthetic oligonucleotide
tctccgtctgctaagaaaataaaac

SEQ ID NO: 714596 - DNA, 25 bp, Artificial sequence
  Synthetic oligonucleotide
cacaaaaagttttaataatgttgtc

SEQ ID NO: 714597 - DNA, 25 bp, Artificial sequence
  Synthetic oligonucleotide
tagggtttgatcgtctctctttcaa

SEQ ID NO: 714598 - DNA, 25 bp, Artificial sequence
  Synthetic oligonucleotide
tactggtagtttcgattgtaatatc

SEQ ID NO: 714599 - DNA, 25 bp, Artificial sequence
  Synthetic oligonucleotide
tactggtagtttggattgtaatatc

SEQ ID NO: 714600 - DNA, 25 bp, Artificial sequence
  Synthetic oligonucleotide
ccgcggattatagtaagattacaag

SEQ ID NO: 714601 - DNA, 25 bp, Artificial sequence
  Synthetic oligonucleotide
ccgcggattatactaagattacaag

SEQ ID NO: 714602 - DNA, 25 bp, Artificial sequence
  Synthetic oligonucleotide
gattcattcactgcaaatttccttc

SEQ ID NO: 714603 - DNA, 25 bp, Artificial sequence
  Synthetic oligonucleotide
gattcattcactccaaatttccttc

SEQ ID NO: 714604 - DNA, 25 bp, Artificial sequence
  Synthetic oligonucleotide
cttggaaacttctgataacaaatcg

SEQ ID NO: 714605 - DNA, 25 bp, Artificial sequence
  Synthetic oligonucleotide
cttggaaacttcagataacaaatcg

SEQ ID NO: 714606 - DNA, 25 bp, Artificial sequence
  Synthetic oligonucleotide
gaacatgtttttcttcttcttgtga

SEQ ID NO: 714607 - DNA, 25 bp, Artificial sequence
  Synthetic oligonucleotide
tctccgtctgcttagaaaataaaac

SEQ ID NO: 714608 - DNA, 25 bp, Artificial sequence
  Synthetic oligonucleotide
tactagtatattataattgaaaaga

SEQ ID NO: 714609 - DNA, 25 bp, Artificial sequence
  Synthetic oligonucleotide
ctcaaatttgtgatactgtaatggc

SEQ ID NO: 714610 - DNA, 25 bp, Artificial sequence
  Synthetic oligonucleotide
ctcaaatttgtgttactgtaatggc

SEQ ID NO: 714611 - DNA, 25 bp, Artificial sequence
  Synthetic oligonucleotide
tgtttagagatctatatttggagaa

SEQ ID NO: 714612 - DNA, 25 bp, Artificial sequence
  Synthetic oligonucleotide
cctcttcaaacacagatttcttctc

SEQ ID NO: 714613 - DNA, 25 bp, Artificial sequence
  Synthetic oligonucleotide
tttttgttaagaatacggattgtat

SEQ ID NO: 714614 - DNA, 25 bp, Artificial sequence
  Synthetic oligonucleotide
agcagcgatgccttctcttcctgta

SEQ ID NO: 714615 - DNA, 25 bp, Artificial sequence
  Synthetic oligonucleotide
tttataatttgttgtatggattaca

SEQ ID NO: 714616 - DNA, 25 bp, Artificial sequence
  Synthetic oligonucleotide
tttataatttgtagtatggattaca

SEQ ID NO: 714617 - DNA, 25 bp, Artificial sequence
  Synthetic oligonucleotide
ctgtgtatttaaaattttgtttaga

SEQ ID NO: 714618 - DNA, 25 bp, Artificial sequence
  Synthetic oligonucleotide
ctgtgtatttaatattttgtttaga

SEQ ID NO: 714619 - DNA, 25 bp, Artificial sequence
  Synthetic oligonucleotide
ttaacaatcgaatcaaaacaaaatg

SEQ ID NO: 714620 - DNA, 25 bp, Artificial sequence
  Synthetic oligonucleotide
aacttattggtaaataagttatatc

SEQ ID NO: 714621 - DNA, 25 bp, Artificial sequence
  Synthetic oligonucleotide
cacaaaaagtttaaataatgttgtc

SEQ ID NO: 714622 - DNA, 25 bp, Artificial sequence
  Synthetic oligonucleotide
tactagtatattttaattgaaaaga

SEQ ID NO: 714623 - DNA, 25 bp, Artificial sequence
  Synthetic oligonucleotide
tatgttttctgcaatctcggagaga

SEQ ID NO: 714624 - DNA, 25 bp, Artificial sequence
  Synthetic oligonucleotide
tatgttttctgctatctcggagaga

SEQ ID NO: 714625 - DNA, 25 bp, Artificial sequence
  Synthetic oligonucleotide
ttaggtaaacgaaatttaagatgct

SEQ ID NO: 714626 - DNA, 25 bp, Artificial sequence
  Synthetic oligonucleotide
ttaggtaaacgatatttaagatgct

SEQ ID NO: 714627 - DNA, 25 bp, Artificial sequence
  Synthetic oligonucleotide
aaaactgcaaaatgtattattcgta

SEQ ID NO: 714628 - DNA, 25 bp, Artificial sequence
  Synthetic oligonucleotide
aaaactgcaaaaagtattattcgta

SEQ ID NO: 714629 - DNA, 25 bp, Artificial sequence
  Synthetic oligonucleotide
taggtaaatgaatctctaataaatt

SEQ ID NO: 714630 - DNA, 25 bp, Artificial sequence
  Synthetic oligonucleotide
taggtaaatgaaactctaataaatt

SEQ ID NO: 714631 - DNA, 25 bp, Artificial sequence
  Synthetic oligonucleotide
tttttgttaagattacggattgtat

SEQ ID NO: 714632 - DNA, 25 bp, Artificial sequence
  Synthetic oligonucleotide
aacttattggtatataagttatatc

SEQ ID NO: 714633 - DNA, 25 bp, Artificial sequence
  Synthetic oligonucleotide
cctcttcaaacagagatttcttctc

SEQ ID NO: 714634 - DNA, 25 bp, Artificial sequence
  Synthetic oligonucleotide
tcctctacctgatcaattcattttg

SEQ ID NO: 714635 - DNA, 25 bp, Artificial sequence
  Synthetic oligonucleotide
tcctctacctgaacaattcattttg

SEQ ID NO: 714636 - DNA, 25 bp, Artificial sequence
  Synthetic oligonucleotide
tctcattcgcaagttcagttcagag

SEQ ID NO: 714637 - DNA, 25 bp, Artificial sequence
  Synthetic oligonucleotide
tctcattcgcaacttcagttcagag

SEQ ID NO: 714638 - DNA, 25 bp, Artificial sequence
  Synthetic oligonucleotide
tgcgaatacgcataaaactactcct

SEQ ID NO: 714639 - DNA, 25 bp, Artificial sequence
  Synthetic oligonucleotide
tgcgaatacgcaaaaaactactcct

SEQ ID NO: 714640 - DNA, 25 bp, Artificial sequence
  Synthetic oligonucleotide
ggtgcattctcttccggtaactgaa

SEQ ID NO: 714641 - DNA, 25 bp, Artificial sequence
  Synthetic oligonucleotide
ggtgcattctctaccggtaactgaa

SEQ ID NO: 714642 - DNA, 25 bp, Artificial sequence
  Synthetic oligonucleotide
gcagaagcctacttcttcccagtca

SEQ ID NO: 714643 - DNA, 25 bp, Artificial sequence
  Synthetic oligonucleotide
taccactcctgtacccactgtggtg

SEQ ID NO: 714644 - DNA, 25 bp, Artificial sequence
  Synthetic oligonucleotide
taagagagtctattgcggatactca

SEQ ID NO: 714645 - DNA, 25 bp, Artificial sequence
  Synthetic oligonucleotide
gcagaagcctgcaacttctcaatca

SEQ ID NO: 714646 - DNA, 25 bp, Artificial sequence
  Synthetic oligonucleotide
caacacttcgttttgcagaagcccg

SEQ ID NO: 714647 - DNA, 25 bp, Artificial sequence
  Synthetic oligonucleotide
caacacttcgttatgcagaagcccg

SEQ ID NO: 714648 - DNA, 25 bp, Artificial sequence
  Synthetic oligonucleotide
tcacaagcggatacacacgaaacta

SEQ ID NO: 714649 - DNA, 25 bp, Artificial sequence
  Synthetic oligonucleotide
tcacaagcggattcacacgaaacta

SEQ ID NO: 714650 - DNA, 25 bp, Artificial sequence
  Synthetic oligonucleotide
tactgccttctcatcctgtacctga

SEQ ID NO: 714651 - DNA, 25 bp, Artificial sequence
  Synthetic oligonucleotide
tactgccttctcttcctgtacctga

SEQ ID NO: 714652 - DNA, 25 bp, Artificial sequence
  Synthetic oligonucleotide
gcagaagcctgctacttctcaatca

SEQ ID NO: 714653 - DNA, 25 bp, Artificial sequence
  Synthetic oligonucleotide
taagagcgaatacgcgcaaagctac

SEQ ID NO: 714654 - DNA, 25 bp, Artificial sequence
  Synthetic oligonucleotide
agcatacttctcgaattctctttgg

SEQ ID NO: 714655 - DNA, 25 bp, Artificial sequence
  Synthetic oligonucleotide
tgtttagagatcaatatttggagaa

SEQ ID NO: 714656 - DNA, 25 bp, Artificial sequence
  Synthetic oligonucleotide
gcagaagcctacatcttcccagtca

SEQ ID NO: 714657 - DNA, 25 bp, Artificial sequence
  Synthetic oligonucleotide
gaactgagcaagtctgttccttcca

SEQ ID NO: 714658 - DNA, 25 bp, Artificial sequence
  Synthetic oligonucleotide
taagagcgaataggcgcaaagctac

SEQ ID NO: 714659 - DNA, 25 bp, Artificial sequence
  Synthetic oligonucleotide
ccttgtgattttagaataaattgtg

SEQ ID NO: 714660 - DNA, 25 bp, Artificial sequence
  Synthetic oligonucleotide
agcatacttctccaattctctttgg

SEQ ID NO: 714661 - DNA, 25 bp, Artificial sequence
  Synthetic oligonucleotide
tggtttcctttttgcttgatgttgt

SEQ ID NO: 714662 - DNA, 25 bp, Artificial sequence
  Synthetic oligonucleotide
tggtttccttttagcttgatgttgt

SEQ ID NO: 714663 - DNA, 25 bp, Artificial sequence
  Synthetic oligonucleotide
tcaggttacaatcgcgaagctaagg

SEQ ID NO: 714664 - DNA, 25 bp, Artificial sequence
  Synthetic oligonucleotide
taccactcctgttcccactgtggtg

SEQ ID NO: 714665 - DNA, 25 bp, Artificial sequence
  Synthetic oligonucleotide
gaactgagcaagactgttccttcca

SEQ ID NO: 714666 - DNA, 25 bp, Artificial sequence
  Synthetic oligonucleotide
ccttgtgatttttgaataaattgtg

SEQ ID NO: 714667 - DNA, 25 bp, Artificial sequence
  Synthetic oligonucleotide
ttttgatggagatgaagacgcttgg

SEQ ID NO: 714668 - DNA, 25 bp, Artificial sequence
  Synthetic oligonucleotide
ttttgatggagaagaagacgcttgg

SEQ ID NO: 714669 - DNA, 25 bp, Artificial sequence
  Synthetic oligonucleotide
ggtgccttctcttcctctgcctgaa

SEQ ID NO: 714670 - DNA, 25 bp, Artificial sequence
  Synthetic oligonucleotide
cacaagctgagttaagagacgctct

SEQ ID NO: 714671 - DNA, 25 bp, Artificial sequence
  Synthetic oligonucleotide
tcaggttacaatggcgaagctaagg

SEQ ID NO: 714672 - DNA, 25 bp, Artificial sequence
  Synthetic oligonucleotide
cacaagctgagtaaagagacgctct

SEQ ID NO: 714673 - DNA, 25 bp, Artificial sequence
  Synthetic oligonucleotide
agcagaaaatcttcattgtcttgcc

SEQ ID NO: 714674 - DNA, 25 bp, Artificial sequence
  Synthetic oligonucleotide
ggtgccttctctacctctgcctgaa

SEQ ID NO: 714675 - DNA, 25 bp, Artificial sequence
  Synthetic oligonucleotide
gaggttacgcaagatagtacctttg

SEQ ID NO: 714676 - DNA, 25 bp, Artificial sequence
  Synthetic oligonucleotide
gaggttacgcaacatagtacctttg

SEQ ID NO: 714677 - DNA, 25 bp, Artificial sequence
  Synthetic oligonucleotide
tctcctcaattacaagctgggttta

SEQ ID NO: 714678 - DNA, 25 bp, Artificial sequence
  Synthetic oligonucleotide
tctcctcaattagaagctgggttta

SEQ ID NO: 714679 - DNA, 25 bp, Artificial sequence
  Synthetic oligonucleotide
caacaacagcatatcactttggaga

SEQ ID NO: 714680 - DNA, 25 bp, Artificial sequence
  Synthetic oligonucleotide
caacaacagcatttcactttggaga

SEQ ID NO: 714681 - DNA, 25 bp, Artificial sequence
  Synthetic oligonucleotide
agcagaaaatctacattgtcttgcc

SEQ ID NO: 714682 - DNA, 25 bp, Artificial sequence
  Synthetic oligonucleotide
gggattggaccggttaacgaattgc

SEQ ID NO: 714683 - DNA, 25 bp, Artificial sequence
  Synthetic oligonucleotide
tgaaagaagagcaagcgacgtggcc

SEQ ID NO: 714684 - DNA, 25 bp, Artificial sequence
  Synthetic oligonucleotide
ttttatccatccatgttcctttttc

SEQ ID NO: 714685 - DNA, 25 bp, Artificial sequence
  Synthetic oligonucleotide
cgagaacacgtatatggctgacaat

SEQ ID NO: 714686 - DNA, 25 bp, Artificial sequence
  Synthetic oligonucleotide
cgagaacacgtaaatggctgacaat

SEQ ID NO: 714687 - DNA, 25 bp, Artificial sequence
  Synthetic oligonucleotide
tagagagttgcacgcacccttggat

SEQ ID NO: 714688 - DNA, 25 bp, Artificial sequence
  Synthetic oligonucleotide
tagagagttgcaggcacccttggat

SEQ ID NO: 714689 - DNA, 25 bp, Artificial sequence
  Synthetic oligonucleotide
tgaaagaagagctagcgacgtggcc

SEQ ID NO: 714690 - DNA, 25 bp, Artificial sequence
  Synthetic oligonucleotide
tggtggaaggattctgtaaatggca

SEQ ID NO: 714691 - DNA, 25 bp, Artificial sequence
  Synthetic oligonucleotide
tggtggaaggatactgtaaatggca

SEQ ID NO: 714692 - DNA, 25 bp, Artificial sequence
  Synthetic oligonucleotide
taaaggagaggagataactggtgaa

SEQ ID NO: 714693 - DNA, 25 bp, Artificial sequence
  Synthetic oligonucleotide
taaaggagaggacataactggtgaa

SEQ ID NO: 714694 - DNA, 25 bp, Artificial sequence
  Synthetic oligonucleotide
caaatgtgcataaacctctgagcgt

SEQ ID NO: 714695 - DNA, 25 bp, Artificial sequence
  Synthetic oligonucleotide
caaatgtgcatatacctctgagcgt

SEQ ID NO: 714696 - DNA, 25 bp, Artificial sequence
  Synthetic oligonucleotide
aagtcttatgcatggataatctctt

SEQ ID NO: 714697 - DNA, 25 bp, Artificial sequence
  Synthetic oligonucleotide
aagtcttatgcaaggataatctctt

SEQ ID NO: 714698 - DNA, 25 bp, Artificial sequence
  Synthetic oligonucleotide
ggtttatgtaaagcggcaatgtacg

SEQ ID NO: 714699 - DNA, 25 bp, Artificial sequence
  Synthetic oligonucleotide
taatagtttcgaagatttaaagttc

SEQ ID NO: 714700 - DNA, 25 bp, Artificial sequence
  Synthetic oligonucleotide
agacagtcagggaggctgcagcgag

SEQ ID NO: 714701 - DNA, 25 bp, Artificial sequence
  Synthetic oligonucleotide
tattttcacatagctgtcttcacca

SEQ ID NO: 714702 - DNA, 25 bp, Artificial sequence
  Synthetic oligonucleotide
taatagtttcgatgatttaaagttc

SEQ ID NO: 714703 - DNA, 25 bp, Artificial sequence
  Synthetic oligonucleotide
agacagtcagggtggctgcagcgag

SEQ ID NO: 714704 - DNA, 25 bp, Artificial sequence
  Synthetic oligonucleotide
cggttcagtaaaaccagaaaccata

SEQ ID NO: 714705 - DNA, 25 bp, Artificial sequence
  Synthetic oligonucleotide
tattttcacatacctgtcttcacca

SEQ ID NO: 714706 - DNA, 25 bp, Artificial sequence
  Synthetic oligonucleotide
tgttgatgatcagctcgtctagtgg

SEQ ID NO: 714707 - DNA, 25 bp, Artificial sequence
  Synthetic oligonucleotide
tgttgatgatcacctcgtctagtgg

SEQ ID NO: 714708 - DNA, 25 bp, Artificial sequence
  Synthetic oligonucleotide
tttcccaaggtacaaagcaaacgct

SEQ ID NO: 714709 - DNA, 25 bp, Artificial sequence
  Synthetic oligonucleotide
tttcccaaggtagaaagcaaacgct

SEQ ID NO: 714710 - DNA, 25 bp, Artificial sequence
  Synthetic oligonucleotide
tgcttttgcctttgtttggaaacaa

SEQ ID NO: 714711 - DNA, 25 bp, Artificial sequence
  Synthetic oligonucleotide
tgcttttgccttagtttggaaacaa

SEQ ID NO: 714712 - DNA, 25 bp, Artificial sequence
  Synthetic oligonucleotide
aagaagcaggagaccgtgggattct

SEQ ID NO: 714713 - DNA, 25 bp, Artificial sequence
  Synthetic oligonucleotide
ccgatgattcatttagggaggatgg

SEQ ID NO: 714714 - DNA, 25 bp, Artificial sequence
  Synthetic oligonucleotide
ggtttatgtaaaccggcaatgtacg

SEQ ID NO: 714715 - DNA, 25 bp, Artificial sequence
  Synthetic oligonucleotide
aagaagcaggagtccgtgggattct

SEQ ID NO: 714716 - DNA, 25 bp, Artificial sequence
  Synthetic oligonucleotide
ttcacgcataccgtgtaagtgcagc

SEQ ID NO: 714717 - DNA, 25 bp, Artificial sequence
  Synthetic oligonucleotide
ttcacgcataccctgtaagtgcagc

SEQ ID NO: 714718 - DNA, 25 bp, Artificial sequence
  Synthetic oligonucleotide
taagcctggtgctgagaatgtcgaa

SEQ ID NO: 714719 - DNA, 25 bp, Artificial sequence
  Synthetic oligonucleotide
taagcctggtgcagagaatgtcgaa

SEQ ID NO: 714720 - DNA, 25 bp, Artificial sequence
  Synthetic oligonucleotide
ggaactttgcaggattttttgggga

SEQ ID NO: 714721 - DNA, 25 bp, Artificial sequence
  Synthetic oligonucleotide
ggaactttgcagcattttttgggga

SEQ ID NO: 714722 - DNA, 25 bp, Artificial sequence
  Synthetic oligonucleotide
caagagcaaatcacaccaagatgag

SEQ ID NO: 714723 - DNA, 25 bp, Artificial sequence
  Synthetic oligonucleotide
caagagcaaatctcaccaagatgag

SEQ ID NO: 714724 - DNA, 25 bp, Artificial sequence
  Synthetic oligonucleotide
ccgatgattcatatagggaggatgg

SEQ ID NO: 714725 - DNA, 25 bp, Artificial sequence
  Synthetic oligonucleotide
tgacgacaacgattccgggatccga

SEQ ID NO: 714726 - DNA, 25 bp, Artificial sequence
  Synthetic oligonucleotide
cggttcagtaaatccagaaaccata

SEQ ID NO: 714727 - DNA, 25 bp, Artificial sequence
  Synthetic oligonucleotide
acatgacgtcgtcaaagggccaccg

SEQ ID NO: 714728 - DNA, 25 bp, Artificial sequence
  Synthetic oligonucleotide
acatgacgtcgtgaaagggccaccg

SEQ ID NO: 714729 - DNA, 25 bp, Artificial sequence
  Synthetic oligonucleotide
ggttgtcactaatcgacgtagcttc

SEQ ID NO: 714730 - DNA, 25 bp, Artificial sequence
  Synthetic oligonucleotide
ggttgtcactaaacgacgtagcttc

SEQ ID NO: 714731 - DNA, 25 bp, Artificial sequence
  Synthetic oligonucleotide
gaaaacccgttgcaatacgcccaca

SEQ ID NO: 714732 - DNA, 25 bp, Artificial sequence
  Synthetic oligonucleotide
gaaaacccgttggaatacgcccaca

SEQ ID NO: 714733 - DNA, 25 bp, Artificial sequence
  Synthetic oligonucleotide
ggctaatatccaaatgtcccacaaa

SEQ ID NO: 714734 - DNA, 25 bp, Artificial sequence
  Synthetic oligonucleotide
gatacaacgaacaagagcaacagca

SEQ ID NO: 714735 - DNA, 25 bp, Artificial sequence
  Synthetic oligonucleotide
tgacgacaacgaatccgggatccga

SEQ ID NO: 714736 - DNA, 25 bp, Artificial sequence
  Synthetic oligonucleotide
tctgaaagacgatgaaatgaaaagc

SEQ ID NO: 714737 - DNA, 25 bp, Artificial sequence
  Synthetic oligonucleotide
tattgtgtgacacatcaagcgaaac

SEQ ID NO: 714738 - DNA, 25 bp, Artificial sequence
  Synthetic oligonucleotide
tattgtgtgacagatcaagcgaaac

SEQ ID NO: 714739 - DNA, 25 bp, Artificial sequence
  Synthetic oligonucleotide
cgtcgggtatagatccttccaacgc

SEQ ID NO: 714740 - DNA, 25 bp, Artificial sequence
  Synthetic oligonucleotide
cgtcgggtatagttccttccaacgc

SEQ ID NO: 714741 - DNA, 25 bp, Artificial sequence
  Synthetic oligonucleotide
tcaaattggcaacatctaaaccgga

SEQ ID NO: 714742 - DNA, 25 bp, Artificial sequence
  Synthetic oligonucleotide
tcaaattggcaagatctaaaccgga

SEQ ID NO: 714743 - DNA, 25 bp, Artificial sequence
  Synthetic oligonucleotide
gggattggaccgcttaacgaattgc

SEQ ID NO: 714744 - DNA, 25 bp, Artificial sequence
  Synthetic oligonucleotide
caaagatggtaattctgaatctggg

SEQ ID NO: 714745 - DNA, 25 bp, Artificial sequence
  Synthetic oligonucleotide
ggctaatatccatatgtcccacaaa

SEQ ID NO: 714746 - DNA, 25 bp, Artificial sequence
  Synthetic oligonucleotide
gaatcagaatggtatgggcattgtg

SEQ ID NO: 714747 - DNA, 25 bp, Artificial sequence
  Synthetic oligonucleotide
tatggaaaatgagagctcttgagcc

SEQ ID NO: 714748 - DNA, 25 bp, Artificial sequence
  Synthetic oligonucleotide
gcgatttataattgtgggttgagaa

SEQ ID NO: 714749 - DNA, 25 bp, Artificial sequence
  Synthetic oligonucleotide
gcgatttataatagtgggttgagaa

SEQ ID NO: 714750 - DNA, 25 bp, Artificial sequence
  Synthetic oligonucleotide
tcttgtgaaagaaattatttgtttg

SEQ ID NO: 714751 - DNA, 25 bp, Artificial sequence
  Synthetic oligonucleotide
tcttgtgaaagatattatttgtttg

SEQ ID NO: 714752 - DNA, 25 bp, Artificial sequence
  Synthetic oligonucleotide
catatttctattaagcggtattaac

SEQ ID NO: 714753 - DNA, 25 bp, Artificial sequence
  Synthetic oligonucleotide
catatttctatttagcggtattaac

SEQ ID NO: 714754 - DNA, 25 bp, Artificial sequence
  Synthetic oligonucleotide
catatataactttgctatccttaag

SEQ ID NO: 714755 - DNA, 25 bp, Artificial sequence
  Synthetic oligonucleotide
gatacaacgaactagagcaacagca

SEQ ID NO: 714756 - DNA, 25 bp, Artificial sequence
  Synthetic oligonucleotide
gaatcagaatggaatgggcattgtg

SEQ ID NO: 714757 - DNA, 25 bp, Artificial sequence
  Synthetic oligonucleotide
tctgaaagacgaagaaatgaaaagc

SEQ ID NO: 714758 - DNA, 25 bp, Artificial sequence
  Synthetic oligonucleotide
agtcatggccatttctagatcttga

SEQ ID NO: 714759 - DNA, 25 bp, Artificial sequence
  Synthetic oligonucleotide
agtcatggccatatctagatcttga

SEQ ID NO: 714760 - DNA, 25 bp, Artificial sequence
  Synthetic oligonucleotide
cattgcttttgaatttacatccgga

SEQ ID NO: 714761 - DNA, 25 bp, Artificial sequence
  Synthetic oligonucleotide
cattgcttttgattttacatccgga

SEQ ID NO: 714762 - DNA, 25 bp, Artificial sequence
  Synthetic oligonucleotide
tagaccgcaaacgatattggatcgg

SEQ ID NO: 714763 - DNA, 25 bp, Artificial sequence
  Synthetic oligonucleotide
tagaccgcaaaccatattggatcgg

SEQ ID NO: 714764 - DNA, 25 bp, Artificial sequence
  Synthetic oligonucleotide
tccgttgccagtaacatatcttagc

SEQ ID NO: 714765 - DNA, 25 bp, Artificial sequence
  Synthetic oligonucleotide
tccgttgccagttacatatcttagc

SEQ ID NO: 714766 - DNA, 25 bp, Artificial sequence
  Synthetic oligonucleotide
tatggaaaatgacagctcttgagcc

SEQ ID NO: 714767 - DNA, 25 bp, Artificial sequence
  Synthetic oligonucleotide
catatataacttagctatccttaag

SEQ ID NO: 714768 - DNA, 25 bp, Artificial sequence
  Synthetic oligonucleotide
taacccacgtgagatgctgactgtg

SEQ ID NO: 714769 - DNA, 25 bp, Artificial sequence
  Synthetic oligonucleotide
gctaacgtaaattcaaaatctttgg

SEQ ID NO: 714770 - DNA, 25 bp, Artificial sequence
  Synthetic oligonucleotide
gctaacgtaaatacaaaatctttgg

SEQ ID NO: 714771 - DNA, 25 bp, Artificial sequence
  Synthetic oligonucleotide
gttcatctcaaaaatccgaaactcg

SEQ ID NO: 714772 - DNA, 25 bp, Artificial sequence
  Synthetic oligonucleotide
gttcatctcaaatatccgaaactcg

SEQ ID NO: 714773 - DNA, 25 bp, Artificial sequence
  Synthetic oligonucleotide
tgttagatgtatcacttgaaatgcc

SEQ ID NO: 714774 - DNA, 25 bp, Artificial sequence
  Synthetic oligonucleotide
tgttagatgtatgacttgaaatgcc

SEQ ID NO: 714775 - DNA, 25 bp, Artificial sequence
  Synthetic oligonucleotide
gagtcttgataagctcacgaaccaa

SEQ ID NO: 714776 - DNA, 25 bp, Artificial sequence
  Synthetic oligonucleotide
gagtcttgataacctcacgaaccaa

SEQ ID NO: 714777 - DNA, 25 bp, Artificial sequence
  Synthetic oligonucleotide
aaatctgtatctgcgtctttgatcc

SEQ ID NO: 714778 - DNA, 25 bp, Artificial sequence
  Synthetic oligonucleotide
gaaaaacaaaagaatgggcccaata

SEQ ID NO: 714779 - DNA, 25 bp, Artificial sequence
  Synthetic oligonucleotide
gcggttgattgaaagttaatggctc

SEQ ID NO: 714780 - DNA, 25 bp, Artificial sequence
  Synthetic oligonucleotide
taacccacgtgacatgctgactgtg

SEQ ID NO: 714781 - DNA, 25 bp, Artificial sequence
  Synthetic oligonucleotide
tcatcacgctcagggtttgctcctt

SEQ ID NO: 714782 - DNA, 25 bp, Artificial sequence
  Synthetic oligonucleotide
tcatcacgctcacggtttgctcctt

SEQ ID NO: 714783 - DNA, 25 bp, Artificial sequence
  Synthetic oligonucleotide
ttattattacatattgtttttcgtc

SEQ ID NO: 714784 - DNA, 25 bp, Artificial sequence
  Synthetic oligonucleotide
ttattattacattttgtttttcgtc

SEQ ID NO: 714785 - DNA, 25 bp, Artificial sequence
  Synthetic oligonucleotide
tgttgacccaccgaacaaccaaaaa

SEQ ID NO: 714786 - DNA, 25 bp, Artificial sequence
  Synthetic oligonucleotide
tgttgacccacccaacaaccaaaaa

SEQ ID NO: 714787 - DNA, 25 bp, Artificial sequence
  Synthetic oligonucleotide
aaatctgtatctccgtctttgatcc

SEQ ID NO: 714788 - DNA, 25 bp, Artificial sequence
  Synthetic oligonucleotide
gaaaaacaaaagtatgggcccaata

SEQ ID NO: 714789 - DNA, 25 bp, Artificial sequence
  Synthetic oligonucleotide
aacggttcattcttacaatattatg

SEQ ID NO: 714790 - DNA, 25 bp, Artificial sequence
  Synthetic oligonucleotide
caaagatggtaaatctgaatctggg

SEQ ID NO: 714791 - DNA, 25 bp, Artificial sequence
  Synthetic oligonucleotide
tctgcgtttgtaacgcctctttgaa

SEQ ID NO: 714792 - DNA, 25 bp, Artificial sequence
  Synthetic oligonucleotide
gaatctaaatcacggagacatgttt

SEQ ID NO: 714793 - DNA, 25 bp, Artificial sequence
  Synthetic oligonucleotide
gaatctaaatcagggagacatgttt

SEQ ID NO: 714794 - DNA, 25 bp, Artificial sequence
  Synthetic oligonucleotide
ccccttgttctattatttcctagat

SEQ ID NO: 714795 - DNA, 25 bp, Artificial sequence
  Synthetic oligonucleotide
ccccttgttctaatatttcctagat

SEQ ID NO: 714796 - DNA, 25 bp, Artificial sequence
  Synthetic oligonucleotide
tcttcatttagttctatataggtcc

SEQ ID NO: 714797 - DNA, 25 bp, Artificial sequence
  Synthetic oligonucleotide
tcttcatttagtactatataggtcc

SEQ ID NO: 714798 - DNA, 25 bp, Artificial sequence
  Synthetic oligonucleotide
gcccatagactaaagagtaagagta

SEQ ID NO: 714799 - DNA, 25 bp, Artificial sequence
  Synthetic oligonucleotide
gggattgtcctaagttacaattgga

SEQ ID NO: 714800 - DNA, 25 bp, Artificial sequence
  Synthetic oligonucleotide
gcccatagactatagagtaagagta

SEQ ID NO: 714801 - DNA, 25 bp, Artificial sequence
  Synthetic oligonucleotide
aacggttcattcatacaatattatg

SEQ ID NO: 714802 - DNA, 25 bp, Artificial sequence
  Synthetic oligonucleotide
tcagacatgaataatactaccgtac

SEQ ID NO: 714803 - DNA, 25 bp, Artificial sequence
  Synthetic oligonucleotide
tcagacatgaattatactaccgtac

SEQ ID NO: 714804 - DNA, 25 bp, Artificial sequence
  Synthetic oligonucleotide
tgtatgtgctacaataattggtcaa

SEQ ID NO: 714805 - DNA, 25 bp, Artificial sequence
  Synthetic oligonucleotide
tgtatgtgctactataattggtcaa

SEQ ID NO: 714806 - DNA, 25 bp, Artificial sequence
  Synthetic oligonucleotide
cagtatctaatgaattttatgctag

SEQ ID NO: 714807 - DNA, 25 bp, Artificial sequence
  Synthetic oligonucleotide
cagtatctaatgtattttatgctag

SEQ ID NO: 714808 - DNA, 25 bp, Artificial sequence
  Synthetic oligonucleotide
tactgttcgactgtaacggtgttaa

SEQ ID NO: 714809 - DNA, 25 bp, Artificial sequence
  Synthetic oligonucleotide
gcggttgattgatagttaatggctc

SEQ ID NO: 714810 - DNA, 25 bp, Artificial sequence
  Synthetic oligonucleotide
gggattgtcctatgttacaattgga

SEQ ID NO: 714811 - DNA, 25 bp, Artificial sequence
  Synthetic oligonucleotide
agacttgttttgattgtatctgatc

SEQ ID NO: 714812 - DNA, 25 bp, Artificial sequence
  Synthetic oligonucleotide
actgttgggaatatgttttcatgga

SEQ ID NO: 714813 - DNA, 25 bp, Artificial sequence
  Synthetic oligonucleotide
ccctgtattgaagtgattgctttga

SEQ ID NO: 714814 - DNA, 25 bp, Artificial sequence
  Synthetic oligonucleotide
ccctgtattgaactgattgctttga

SEQ ID NO: 714815 - DNA, 25 bp, Artificial sequence
  Synthetic oligonucleotide
tatctgcttcgtgattaattgggca

SEQ ID NO: 714816 - DNA, 25 bp, Artificial sequence
  Synthetic oligonucleotide
tatctgcttcgtcattaattgggca

SEQ ID NO: 714817 - DNA, 25 bp, Artificial sequence
  Synthetic oligonucleotide
tgaggtgttatgactgtaattgcaa

SEQ ID NO: 714818 - DNA, 25 bp, Artificial sequence
  Synthetic oligonucleotide
tgaggtgttatgtctgtaattgcaa

SEQ ID NO: 714819 - DNA, 25 bp, Artificial sequence
  Synthetic oligonucleotide
acgtcaccttatggaatcatgtttg

SEQ ID NO: 714820 - DNA, 25 bp, Artificial sequence
  Synthetic oligonucleotide
actgttgggaatttgttttcatgga

SEQ ID NO: 714821 - DNA, 25 bp, Artificial sequence
  Synthetic oligonucleotide
agacttgttttgtttgtatctgatc

SEQ ID NO: 714822 - DNA, 25 bp, Artificial sequence
  Synthetic oligonucleotide
acgtcaccttatcgaatcatgtttg

SEQ ID NO: 714823 - DNA, 25 bp, Artificial sequence
  Synthetic oligonucleotide
gatgaccatgtcactttaattttgt

SEQ ID NO: 714824 - DNA, 25 bp, Artificial sequence
  Synthetic oligonucleotide
gatgaccatgtctctttaattttgt

SEQ ID NO: 714825 - DNA, 25 bp, Artificial sequence
  Synthetic oligonucleotide
gatggaccttgcttaacaagttcaa

SEQ ID NO: 714826 - DNA, 25 bp, Artificial sequence
  Synthetic oligonucleotide
gatggaccttgcataacaagttcaa

SEQ ID NO: 714827 - DNA, 25 bp, Artificial sequence
  Synthetic oligonucleotide
atagacagacacacccaaaccctag

SEQ ID NO: 714828 - DNA, 25 bp, Artificial sequence
  Synthetic oligonucleotide
tactgttcgactctaacggtgttaa

SEQ ID NO: 714829 - DNA, 25 bp, Artificial sequence
  Synthetic oligonucleotide
tataggtgtattgcgtttaggtatg

SEQ ID NO: 714830 - DNA, 25 bp, Artificial sequence
  Synthetic oligonucleotide
tataggtgtattccgtttaggtatg

SEQ ID NO: 714831 - DNA, 25 bp, Artificial sequence
  Synthetic oligonucleotide
tttagagtcatgatttgaaaagagg

SEQ ID NO: 714832 - DNA, 25 bp, Artificial sequence
  Synthetic oligonucleotide
actaatcgaatctcctactctaaag

SEQ ID NO: 714833 - DNA, 25 bp, Artificial sequence
  Synthetic oligonucleotide
gccgtcagatcacattgatcgggca

SEQ ID NO: 714834 - DNA, 25 bp, Artificial sequence
  Synthetic oligonucleotide
tttagagtcatgttttgaaaagagg

SEQ ID NO: 714835 - DNA, 25 bp, Artificial sequence
  Synthetic oligonucleotide
cgaaaattgtggttgcgattgatta

SEQ ID NO: 714836 - DNA, 25 bp, Artificial sequence
  Synthetic oligonucleotide
ccgttggaatcaagcaatggtagag

SEQ ID NO: 714837 - DNA, 25 bp, Artificial sequence
  Synthetic oligonucleotide
tatttgtgggtatctagaagaggcg

SEQ ID NO: 714838 - DNA, 25 bp, Artificial sequence
  Synthetic oligonucleotide
tatttgtgggtaactagaagaggcg

SEQ ID NO: 714839 - DNA, 25 bp, Artificial sequence
  Synthetic oligonucleotide
tctccaagctgggtgttttttcatc

SEQ ID NO: 714840 - DNA, 25 bp, Artificial sequence
  Synthetic oligonucleotide
ccgttggaatcatgcaatggtagag

SEQ ID NO: 714841 - DNA, 25 bp, Artificial sequence
  Synthetic oligonucleotide
actaatcgaatcacctactctaaag

SEQ ID NO: 714842 - DNA, 25 bp, Artificial sequence
  Synthetic oligonucleotide
gccgtcagatcagattgatcgggca

SEQ ID NO: 714843 - DNA, 25 bp, Artificial sequence
  Synthetic oligonucleotide
tctgtcatgtgtcatttggtcgcgc

SEQ ID NO: 714844 - DNA, 25 bp, Artificial sequence
  Synthetic oligonucleotide
ggtttatgtaatgtgaatctttctc

SEQ ID NO: 714845 - DNA, 25 bp, Artificial sequence
  Synthetic oligonucleotide
tctgtcatgtgtgatttggtcgcgc

SEQ ID NO: 714846 - DNA, 25 bp, Artificial sequence
  Synthetic oligonucleotide
tccagcagcggtacgaggatggctc

SEQ ID NO: 714847 - DNA, 25 bp, Artificial sequence
  Synthetic oligonucleotide
tccagcagcggttcgaggatggctc

SEQ ID NO: 714848 - DNA, 25 bp, Artificial sequence
  Synthetic oligonucleotide
ttttatccatccttgttcctttttc

SEQ ID NO: 714849 - DNA, 25 bp, Artificial sequence
  Synthetic oligonucleotide
tctgcgtttgtatcgcctctttgaa

SEQ ID NO: 714850 - DNA, 25 bp, Artificial sequence
  Synthetic oligonucleotide
ggtttatgtaatctgaatctttctc

SEQ ID NO: 714851 - DNA, 25 bp, Artificial sequence
  Synthetic oligonucleotide
atagacagacactcccaaaccctag

SEQ ID NO: 714852 - DNA, 25 bp, Artificial sequence
  Synthetic oligonucleotide
tctccaagctggctgttttttcatc

SEQ ID NO: 714853 - DNA, 25 bp, Artificial sequence
  Synthetic oligonucleotide
cgaaaattgtggatgcgattgatta

SEQ ID NO: 714854 - DNA, 25 bp, Artificial sequence
  Synthetic oligonucleotide
gatgatcgccaagttgacggtcgaa

SEQ ID NO: 714855 - DNA, 25 bp, Artificial sequence
  Synthetic oligonucleotide
tatttcctgactcgaacgttgttcc

SEQ ID NO: 714856 - DNA, 25 bp, Artificial sequence
  Synthetic oligonucleotide
tatttcctgactggaacgttgttcc

SEQ ID NO: 714857 - DNA, 25 bp, Artificial sequence
  Synthetic oligonucleotide
agttgagccaagatggagcctgcga

SEQ ID NO: 714858 - DNA, 25 bp, Artificial sequence
  Synthetic oligonucleotide
agttgagccaagttggagcctgcga

SEQ ID NO: 714859 - DNA, 25 bp, Artificial sequence
  Synthetic oligonucleotide
caactacttatcatctatatatgca

SEQ ID NO: 714860 - DNA, 25 bp, Artificial sequence
  Synthetic oligonucleotide
catttatcaattcgtgcaaaaaggg

SEQ ID NO: 714861 - DNA, 25 bp, Artificial sequence
  Synthetic oligonucleotide
caactacttatcttctatatatgca

SEQ ID NO: 714862 - DNA, 25 bp, Artificial sequence
  Synthetic oligonucleotide
gatgatcgccaacttgacggtcgaa

SEQ ID NO: 714863 - DNA, 25 bp, Artificial sequence
  Synthetic oligonucleotide
catttatcaattggtgcaaaaaggg

SEQ ID NO: 714864 - DNA, 25 bp, Artificial sequence
  Synthetic oligonucleotide
tctcgccaaactatgtcctataaaa

SEQ ID NO: 714865 - DNA, 25 bp, Artificial sequence
  Synthetic oligonucleotide
tctcgccaaactttgtcctataaaa

SEQ ID NO: 714866 - DNA, 25 bp, Artificial sequence
  Synthetic oligonucleotide
cactaaattttataatgtatgaaca

SEQ ID NO: 714867 - DNA, 25 bp, Artificial sequence
  Synthetic oligonucleotide
cactaaattttaaaatgtatgaaca

SEQ ID NO: 714868 - DNA, 25 bp, Artificial sequence
  Synthetic oligonucleotide
gatgcaacttggatctagttcctgg

SEQ ID NO: 714869 - DNA, 25 bp, Artificial sequence
  Synthetic oligonucleotide
gatgcaacttggttctagttcctgg

SEQ ID NO: 714870 - DNA, 25 bp, Artificial sequence
  Synthetic oligonucleotide
caaattcagaacttttcaacccata

SEQ ID NO: 714871 - DNA, 25 bp, Artificial sequence
  Synthetic oligonucleotide
gatgatggctcttgtcccctcgagt

SEQ ID NO: 714872 - DNA, 25 bp, Artificial sequence
  Synthetic oligonucleotide
gatgatggctctagtcccctcgagt

SEQ ID NO: 714873 - DNA, 25 bp, Artificial sequence
  Synthetic oligonucleotide
tgaggtatgtaatgaatttcttttc

SEQ ID NO: 714874 - DNA, 25 bp, Artificial sequence
  Synthetic oligonucleotide
tattcaattggtaactaaatggtgc

SEQ ID NO: 714875 - DNA, 25 bp, Artificial sequence
  Synthetic oligonucleotide
tctgatgaatagaactaatttttat

SEQ ID NO: 714876 - DNA, 25 bp, Artificial sequence
  Synthetic oligonucleotide
tctgatgaatagtactaatttttat

SEQ ID NO: 714877 - DNA, 25 bp, Artificial sequence
  Synthetic oligonucleotide
caaattcagaacatttcaacccata

SEQ ID NO: 714878 - DNA, 25 bp, Artificial sequence
  Synthetic oligonucleotide
tggttcgttttcttttataatcaaa

SEQ ID NO: 714879 - DNA, 25 bp, Artificial sequence
  Synthetic oligonucleotide
tagacaagacgaacataaacccatg

SEQ ID NO: 714880 - DNA, 25 bp, Artificial sequence
  Synthetic oligonucleotide
tatatacacataagttaatatcagt

SEQ ID NO: 714881 - DNA, 25 bp, Artificial sequence
  Synthetic oligonucleotide
ttccaaattaaattagtagaaagct

SEQ ID NO: 714882 - DNA, 25 bp, Artificial sequence
  Synthetic oligonucleotide
ccagtcttatggtgtacttataaca

SEQ ID NO: 714883 - DNA, 25 bp, Artificial sequence
  Synthetic oligonucleotide
ccagtcttatggagtacttataaca

SEQ ID NO: 714884 - DNA, 25 bp, Artificial sequence
  Synthetic oligonucleotide
tattcaattggttactaaatggtgc

SEQ ID NO: 714885 - DNA, 25 bp, Artificial sequence
  Synthetic oligonucleotide
taaccaaccaatgatgtgtggtggg

SEQ ID NO: 714886 - DNA, 25 bp, Artificial sequence
  Synthetic oligonucleotide
cttaagaaagatggaggcaaagccg

SEQ ID NO: 714887 - DNA, 25 bp, Artificial sequence
  Synthetic oligonucleotide
cttaagaaagatcgaggcaaagccg

SEQ ID NO: 714888 - DNA, 25 bp, Artificial sequence
  Synthetic oligonucleotide
tatacactatgcagatttgcattcc

SEQ ID NO: 714889 - DNA, 25 bp, Artificial sequence
  Synthetic oligonucleotide
taaccaaccaatcatgtgtggtggg

SEQ ID NO: 714890 - DNA, 25 bp, Artificial sequence
  Synthetic oligonucleotide
tggttcgttttcatttataatcaaa

SEQ ID NO: 714891 - DNA, 25 bp, Artificial sequence
  Synthetic oligonucleotide
tgaggtatgtaaagaatttcttttc

SEQ ID NO: 714892 - DNA, 25 bp, Artificial sequence
  Synthetic oligonucleotide
catggtttgtgaccaaatagttatt

SEQ ID NO: 714893 - DNA, 25 bp, Artificial sequence
  Synthetic oligonucleotide
catggtttgtgagcaaatagttatt

SEQ ID NO: 714894 - DNA, 25 bp, Artificial sequence
  Synthetic oligonucleotide
gacacttttatcattcctatgaatc

SEQ ID NO: 714895 - DNA, 25 bp, Artificial sequence
  Synthetic oligonucleotide
gacacttttatctttcctatgaatc

SEQ ID NO: 714896 - DNA, 25 bp, Artificial sequence
  Synthetic oligonucleotide
ttgatattctcaatcactaatggtg

SEQ ID NO: 714897 - DNA, 25 bp, Artificial sequence
  Synthetic oligonucleotide
ttgatattctcattcactaatggtg

SEQ ID NO: 714898 - DNA, 25 bp, Artificial sequence
  Synthetic oligonucleotide
ggtccatacagagttcagtttcaag

SEQ ID NO: 714899 - DNA, 25 bp, Artificial sequence
  Synthetic oligonucleotide
ggtccatacagacttcagtttcaag

SEQ ID NO: 714900 - DNA, 25 bp, Artificial sequence
  Synthetic oligonucleotide
gcgatggcaaaacaaacctattgag

SEQ ID NO: 714901 - DNA, 25 bp, Artificial sequence
  Synthetic oligonucleotide
gcgatggcaaaagaaacctattgag

SEQ ID NO: 714902 - DNA, 25 bp, Artificial sequence
  Synthetic oligonucleotide
tatacactatgctgatttgcattcc

SEQ ID NO: 714903 - DNA, 25 bp, Artificial sequence
  Synthetic oligonucleotide
tgatcctaaaaaatcctgtaaaaag

SEQ ID NO: 714904 - DNA, 25 bp, Artificial sequence
  Synthetic oligonucleotide
ttcttttaaaaaaatattgaacata

SEQ ID NO: 714905 - DNA, 25 bp, Artificial sequence
  Synthetic oligonucleotide
gtcaaagagaatcccagcgccaact

SEQ ID NO: 714906 - DNA, 25 bp, Artificial sequence
  Synthetic oligonucleotide
tatcaatcgtgttgtgtcctctcgt

SEQ ID NO: 714907 - DNA, 25 bp, Artificial sequence
  Synthetic oligonucleotide
cctgatggattggaatacattgaga

SEQ ID NO: 714908 - DNA, 25 bp, Artificial sequence
  Synthetic oligonucleotide
cctgatggattgcaatacattgaga

SEQ ID NO: 714909 - DNA, 25 bp, Artificial sequence
  Synthetic oligonucleotide
catcgccagcctaaacctctgcatt

SEQ ID NO: 714910 - DNA, 25 bp, Artificial sequence
  Synthetic oligonucleotide
catcgccagccttaacctctgcatt

SEQ ID NO: 714911 - DNA, 25 bp, Artificial sequence
  Synthetic oligonucleotide
gatgcgatcatcgatccggcgacgt

SEQ ID NO: 714912 - DNA, 25 bp, Artificial sequence
  Synthetic oligonucleotide
gatgcgatcatccatccggcgacgt

SEQ ID NO: 714913 - DNA, 25 bp, Artificial sequence
  Synthetic oligonucleotide
gaagaacgacacctttccgaccgga

SEQ ID NO: 714914 - DNA, 25 bp, Artificial sequence
  Synthetic oligonucleotide
ttgctcatctctacgtacttcccgg

SEQ ID NO: 714915 - DNA, 25 bp, Artificial sequence
  Synthetic oligonucleotide
tgatcctaaaaattcctgtaaaaag

SEQ ID NO: 714916 - DNA, 25 bp, Artificial sequence
  Synthetic oligonucleotide
aaatcaaactactacgagtattccg

SEQ ID NO: 714917 - DNA, 25 bp, Artificial sequence
  Synthetic oligonucleotide
ttcttttaaaaatatattgaacata

SEQ ID NO: 714918 - DNA, 25 bp, Artificial sequence
  Synthetic oligonucleotide
ttccaaattaaaatagtagaaagct

SEQ ID NO: 714919 - DNA, 25 bp, Artificial sequence
  Synthetic oligonucleotide
tagacaagacgatcataaacccatg

SEQ ID NO: 714920 - DNA, 25 bp, Artificial sequence
  Synthetic oligonucleotide
gtcaaagagaatgccagcgccaact

SEQ ID NO: 714921 - DNA, 25 bp, Artificial sequence
  Synthetic oligonucleotide
cacaaaagtaaaagtaaatgaaaca

SEQ ID NO: 714922 - DNA, 25 bp, Artificial sequence
  Synthetic oligonucleotide
cacaaaagtaaatgtaaatgaaaca

SEQ ID NO: 714923 - DNA, 25 bp, Artificial sequence
  Synthetic oligonucleotide
tcaagggagtacaaattagcagccc

SEQ ID NO: 714924 - DNA, 25 bp, Artificial sequence
  Synthetic oligonucleotide
tcaagggagtactaattagcagccc

SEQ ID NO: 714925 - DNA, 25 bp, Artificial sequence
  Synthetic oligonucleotide
ctttttgcatattagaaagagtcca

SEQ ID NO: 714926 - DNA, 25 bp, Artificial sequence
  Synthetic oligonucleotide
ctttttgcatataagaaagagtcca

SEQ ID NO: 714927 - DNA, 25 bp, Artificial sequence
  Synthetic oligonucleotide
gaagaacgacacgtttccgaccgga

SEQ ID NO: 714928 - DNA, 25 bp, Artificial sequence
  Synthetic oligonucleotide
cacgtacacatttagtaattaggtt

SEQ ID NO: 714929 - DNA, 25 bp, Artificial sequence
  Synthetic oligonucleotide
taaatgtgttagttaagagcttcac

SEQ ID NO: 714930 - DNA, 25 bp, Artificial sequence
  Synthetic oligonucleotide
taaatgtgttagataagagcttcac

SEQ ID NO: 714931 - DNA, 25 bp, Artificial sequence
  Synthetic oligonucleotide
ggtttttagccagccaatattataa

SEQ ID NO: 714932 - DNA, 25 bp, Artificial sequence
  Synthetic oligonucleotide
ggtttttagccacccaatattataa

SEQ ID NO: 714933 - DNA, 25 bp, Artificial sequence
  Synthetic oligonucleotide
gatctatttatttgttgaactaaca

SEQ ID NO: 714934 - DNA, 25 bp, Artificial sequence
  Synthetic oligonucleotide
gatctatttattagttgaactaaca

SEQ ID NO: 714935 - DNA, 25 bp, Artificial sequence
  Synthetic oligonucleotide
gactactatattggagaacttttca

SEQ ID NO: 714936 - DNA, 25 bp, Artificial sequence
  Synthetic oligonucleotide
gactactatattcgagaacttttca

SEQ ID NO: 714937 - DNA, 25 bp, Artificial sequence
  Synthetic oligonucleotide
tgcataaattagatatacgaagacc

SEQ ID NO: 714938 - DNA, 25 bp, Artificial sequence
  Synthetic oligonucleotide
tgcataaattagttatacgaagacc

SEQ ID NO: 714939 - DNA, 25 bp, Artificial sequence
  Synthetic oligonucleotide
ttgctcatctcttcgtacttcccgg

SEQ ID NO: 714940 - DNA, 25 bp, Artificial sequence
  Synthetic oligonucleotide
taccatttaaaatactcaatgaggc

SEQ ID NO: 714941 - DNA, 25 bp, Artificial sequence
  Synthetic oligonucleotide
tatatacacatatgttaatatcagt

SEQ ID NO: 714942 - DNA, 25 bp, Artificial sequence
  Synthetic oligonucleotide
cacgtacacattaagtaattaggtt

SEQ ID NO: 714943 - DNA, 25 bp, Artificial sequence
  Synthetic oligonucleotide
caattagaaccaattaatagaaact

SEQ ID NO: 714944 - DNA, 25 bp, Artificial sequence
  Synthetic oligonucleotide
caattagaaccatttaatagaaact

SEQ ID NO: 714945 - DNA, 25 bp, Artificial sequence
  Synthetic oligonucleotide
tcattaaacttcaactaaatgtgtt

SEQ ID NO: 714946 - DNA, 25 bp, Artificial sequence
  Synthetic oligonucleotide
tcattaaacttctactaaatgtgtt

SEQ ID NO: 714947 - DNA, 25 bp, Artificial sequence
  Synthetic oligonucleotide
gttttaagaagatatagatttagtg

SEQ ID NO: 714948 - DNA, 25 bp, Artificial sequence
  Synthetic oligonucleotide
gttttaagaagaaatagatttagtg

SEQ ID NO: 714949 - DNA, 25 bp, Artificial sequence
  Synthetic oligonucleotide
aaaaaaatagatttaagtgactaga

SEQ ID NO: 714950 - DNA, 25 bp, Artificial sequence
  Synthetic oligonucleotide
aaaaaaatagatataagtgactaga

SEQ ID NO: 714951 - DNA, 25 bp, Artificial sequence
  Synthetic oligonucleotide
aaatcaaactacaacgagtattccg

SEQ ID NO: 714952 - DNA, 25 bp, Artificial sequence
  Synthetic oligonucleotide
taccatttaaaaaactcaatgaggc

SEQ ID NO: 714953 - DNA, 25 bp, Artificial sequence
  Synthetic oligonucleotide
tcttggaaagttaacaaatcacccc

SEQ ID NO: 714954 - DNA, 25 bp, Artificial sequence
  Synthetic oligonucleotide
gtgtaagaaaaatattctatagtag

SEQ ID NO: 714955 - DNA, 25 bp, Artificial sequence
  Synthetic oligonucleotide
tagtactagttgtgatgacagagac

SEQ ID NO: 714956 - DNA, 25 bp, Artificial sequence
  Synthetic oligonucleotide
tagtactagttgagatgacagagac

SEQ ID NO: 714957 - DNA, 25 bp, Artificial sequence
  Synthetic oligonucleotide
tcttttttgtggttcacgggactac

SEQ ID NO: 714958 - DNA, 25 bp, Artificial sequence
  Synthetic oligonucleotide
tcttttttgtggatcacgggactac

SEQ ID NO: 714959 - DNA, 25 bp, Artificial sequence
  Synthetic oligonucleotide
tttggaaagagacgataagatggtt

SEQ ID NO: 714960 - DNA, 25 bp, Artificial sequence
  Synthetic oligonucleotide
tttggaaagagaggataagatggtt

SEQ ID NO: 714961 - DNA, 25 bp, Artificial sequence
  Synthetic oligonucleotide
gccaatttgggggagttatctaaaa

SEQ ID NO: 714962 - DNA, 25 bp, Artificial sequence
  Synthetic oligonucleotide
gccaatttggggcagttatctaaaa

SEQ ID NO: 714963 - DNA, 25 bp, Artificial sequence
  Synthetic oligonucleotide
caatttttcgagatgttttgctgaa

SEQ ID NO: 714964 - DNA, 25 bp, Artificial sequence
  Synthetic oligonucleotide
taagggtcggtcatttttgtatgct

SEQ ID NO: 714965 - DNA, 25 bp, Artificial sequence
  Synthetic oligonucleotide
tcttggaaagtttacaaatcacccc

SEQ ID NO: 714966 - DNA, 25 bp, Artificial sequence
  Synthetic oligonucleotide
tactagtagtattaatatgttaata

SEQ ID NO: 714967 - DNA, 25 bp, Artificial sequence
  Synthetic oligonucleotide
gctttcaaacaaatgggctcattga

SEQ ID NO: 714968 - DNA, 25 bp, Artificial sequence
  Synthetic oligonucleotide
gctttcaaacaattgggctcattga

SEQ ID NO: 714969 - DNA, 25 bp, Artificial sequence
  Synthetic oligonucleotide
gcttattttggttttgagcccattc

SEQ ID NO: 714970 - DNA, 25 bp, Artificial sequence
  Synthetic oligonucleotide
gcttattttggtattgagcccattc

SEQ ID NO: 714971 - DNA, 25 bp, Artificial sequence
  Synthetic oligonucleotide
cattaaaggaaaaatcccaagagtg

SEQ ID NO: 714972 - DNA, 25 bp, Artificial sequence
  Synthetic oligonucleotide
cattaaaggaaatatcccaagagtg

SEQ ID NO: 714973 - DNA, 25 bp, Artificial sequence
  Synthetic oligonucleotide
gttccatagaccatacatttcaaat

SEQ ID NO: 714974 - DNA, 25 bp, Artificial sequence
  Synthetic oligonucleotide
gttccatagaccttacatttcaaat

SEQ ID NO: 714975 - DNA, 25 bp, Artificial sequence
  Synthetic oligonucleotide
tgtctctatgatacttaagtctttg

SEQ ID NO: 714976 - DNA, 25 bp, Artificial sequence
  Synthetic oligonucleotide
tgtctctatgattcttaagtctttg

SEQ ID NO: 714977 - DNA, 25 bp, Artificial sequence
  Synthetic oligonucleotide
caatttttcgagttgttttgctgaa

SEQ ID NO: 714978 - DNA, 25 bp, Artificial sequence
  Synthetic oligonucleotide
aagcttttggtgatgggtgaatgaa

SEQ ID NO: 714979 - DNA, 25 bp, Artificial sequence
  Synthetic oligonucleotide
tatcaatcgtgtagtgtcctctcgt

SEQ ID NO: 714980 - DNA, 25 bp, Artificial sequence
  Synthetic oligonucleotide
taattatttctaagtgtggcttgca

SEQ ID NO: 714981 - DNA, 25 bp, Artificial sequence
  Synthetic oligonucleotide
gacaaaacgacaccaacagctccaa

SEQ ID NO: 714982 - DNA, 25 bp, Artificial sequence
  Synthetic oligonucleotide
gacaaaacgacagcaacagctccaa

SEQ ID NO: 714983 - DNA, 25 bp, Artificial sequence
  Synthetic oligonucleotide
ttccattctctcacccaccaaacta

SEQ ID NO: 714984 - DNA, 25 bp, Artificial sequence
  Synthetic oligonucleotide
tcttcttcaccatcacatcagataa

SEQ ID NO: 714985 - DNA, 25 bp, Artificial sequence
  Synthetic oligonucleotide
ctgtaatctccctccgtcgctgcag

SEQ ID NO: 714986 - DNA, 25 bp, Artificial sequence
  Synthetic oligonucleotide
ctgtaatctcccaccgtcgctgcag

SEQ ID NO: 714987 - DNA, 25 bp, Artificial sequence
  Synthetic oligonucleotide
ggtgacatctctgttcaaacccttt

SEQ ID NO: 714988 - DNA, 25 bp, Artificial sequence
  Synthetic oligonucleotide
ggtgacatctctcttcaaacccttt

SEQ ID NO: 714989 - DNA, 25 bp, Artificial sequence
  Synthetic oligonucleotide
taagggtcggtcttttttgtatgct

SEQ ID NO: 714990 - DNA, 25 bp, Artificial sequence
  Synthetic oligonucleotide
caacaacgagacaaggaggcttgaa

SEQ ID NO: 714991 - DNA, 25 bp, Artificial sequence
  Synthetic oligonucleotide
tcttcttcaccaacacatcagataa

SEQ ID NO: 714992 - DNA, 25 bp, Artificial sequence
  Synthetic oligonucleotide
aagcttttggtgttgggtgaatgaa

SEQ ID NO: 714993 - DNA, 25 bp, Artificial sequence
  Synthetic oligonucleotide
caatgacggtgtagctgtgttcaaa

SEQ ID NO: 714994 - DNA, 25 bp, Artificial sequence
  Synthetic oligonucleotide
caatgacggtgttgctgtgttcaaa

SEQ ID NO: 714995 - DNA, 25 bp, Artificial sequence
  Synthetic oligonucleotide
taacgatggtgatcagaggaaaacg

SEQ ID NO: 714996 - DNA, 25 bp, Artificial sequence
  Synthetic oligonucleotide
taacgatggtgaacagaggaaaacg

SEQ ID NO: 714997 - DNA, 25 bp, Artificial sequence
  Synthetic oligonucleotide
tgttagaagagatgccattatcgat

SEQ ID NO: 714998 - DNA, 25 bp, Artificial sequence
  Synthetic oligonucleotide
tgttagaagagaagccattatcgat

SEQ ID NO: 714999 - DNA, 25 bp, Artificial sequence
  Synthetic oligonucleotide
gaaagaaggaagtgaagaggcttaa

SEQ ID NO: 715000 - DNA, 25 bp, Artificial sequence
  Synthetic oligonucleotide
gaaagaaggaagagaagaggcttaa

SEQ ID NO: 715001 - DNA, 25 bp, Artificial sequence
  Synthetic oligonucleotide
tactagtagtataaatatgttaata

SEQ ID NO: 715002 - DNA, 25 bp, Artificial sequence
  Synthetic oligonucleotide
caacaacgagactaggaggcttgaa

SEQ ID NO: 715003 - DNA, 25 bp, Artificial sequence
  Synthetic oligonucleotide
gggttgctttcatcggtgagtttct

SEQ ID NO: 715004 - DNA, 25 bp, Artificial sequence
  Synthetic oligonucleotide
tagatacaagctaccttcatgggcc

SEQ ID NO: 715005 - DNA, 25 bp, Artificial sequence
  Synthetic oligonucleotide
tagatacaagcttccttcatgggcc

SEQ ID NO: 715006 - DNA, 25 bp, Artificial sequence
  Synthetic oligonucleotide
gggtactgctcctgtgtactggaaa

SEQ ID NO: 715007 - DNA, 25 bp, Artificial sequence
  Synthetic oligonucleotide
gggtactgctccagtgtactggaaa

SEQ ID NO: 715008 - DNA, 25 bp, Artificial sequence
  Synthetic oligonucleotide
tggtcttccacctacctcagtaagt

SEQ ID NO: 715009 - DNA, 25 bp, Artificial sequence
  Synthetic oligonucleotide
tggtcttccaccaacctcagtaagt

SEQ ID NO: 715010 - DNA, 25 bp, Artificial sequence
  Synthetic oligonucleotide
ttcaagtgttgacgctctttaactc

SEQ ID NO: 715011 - DNA, 25 bp, Artificial sequence
  Synthetic oligonucleotide
ttcaagtgttgaggctctttaactc

SEQ ID NO: 715012 - DNA, 25 bp, Artificial sequence
  Synthetic oligonucleotide
tttttggattagggtgaaaagttga

SEQ ID NO: 715013 - DNA, 25 bp, Artificial sequence
  Synthetic oligonucleotide
tttttggattagcgtgaaaagttga

SEQ ID NO: 715014 - DNA, 25 bp, Artificial sequence
  Synthetic oligonucleotide
taataataaacaaagttcatgattg

SEQ ID NO: 715015 - DNA, 25 bp, Artificial sequence
  Synthetic oligonucleotide
taatccagctgctagcaaactcact

SEQ ID NO: 715016 - DNA, 25 bp, Artificial sequence
  Synthetic oligonucleotide
ggctaccacatactgtataattgtt

SEQ ID NO: 715017 - DNA, 25 bp, Artificial sequence
  Synthetic oligonucleotide
gggttgctttcaacggtgagtttct

SEQ ID NO: 715018 - DNA, 25 bp, Artificial sequence
  Synthetic oligonucleotide
taattaaattaacttgtattccgag

SEQ ID NO: 715019 - DNA, 25 bp, Artificial sequence
  Synthetic oligonucleotide
taattaaattaagttgtattccgag

SEQ ID NO: 715020 - DNA, 25 bp, Artificial sequence
  Synthetic oligonucleotide
agttggcgcggtaagggcggctgtt

SEQ ID NO: 715021 - DNA, 25 bp, Artificial sequence
  Synthetic oligonucleotide
agttggcgcggttagggcggctgtt

SEQ ID NO: 715022 - DNA, 25 bp, Artificial sequence
  Synthetic oligonucleotide
ggctaccacatagtgtataattgtt

SEQ ID NO: 715023 - DNA, 25 bp, Artificial sequence
  Synthetic oligonucleotide
ttatagttagcagtctaatcgtggg

SEQ ID NO: 715024 - DNA, 25 bp, Artificial sequence
  Synthetic oligonucleotide
taattatttctatgtgtggcttgca

SEQ ID NO: 715025 - DNA, 25 bp, Artificial sequence
  Synthetic oligonucleotide
ttatagttagcactctaatcgtggg

SEQ ID NO: 715026 - DNA, 25 bp, Artificial sequence
  Synthetic oligonucleotide
gtgtaagaaaaaaattctatagtag

SEQ ID NO: 715027 - DNA, 25 bp, Artificial sequence
  Synthetic oligonucleotide
ttccattctctctcccaccaaacta

SEQ ID NO: 715028 - DNA, 25 bp, Artificial sequence
  Synthetic oligonucleotide
taatccagctgcaagcaaactcact

SEQ ID NO: 715029 - DNA, 25 bp, Artificial sequence
  Synthetic oligonucleotide
cgcagcctttatgctcgaaacgtag

SEQ ID NO: 715030 - DNA, 25 bp, Artificial sequence
  Synthetic oligonucleotide
tcaattacttacttatttttctcct

SEQ ID NO: 715031 - DNA, 25 bp, Artificial sequence
  Synthetic oligonucleotide
tcaattacttacatatttttctcct

SEQ ID NO: 715032 - DNA, 25 bp, Artificial sequence
  Synthetic oligonucleotide
tgtggtgtgaaaaatccttatcttg

SEQ ID NO: 715033 - DNA, 25 bp, Artificial sequence
  Synthetic oligonucleotide
caaaaaaggtttgtcattagatcgg

SEQ ID NO: 715034 - DNA, 25 bp, Artificial sequence
  Synthetic oligonucleotide
tgtggtgtgaaatatccttatcttg

SEQ ID NO: 715035 - DNA, 25 bp, Artificial sequence
  Synthetic oligonucleotide
taataataaacatagttcatgattg

SEQ ID NO: 715036 - DNA, 25 bp, Artificial sequence
  Synthetic oligonucleotide
gctgccgctaatacctccgccgttt

SEQ ID NO: 715037 - DNA, 25 bp, Artificial sequence
  Synthetic oligonucleotide
caaaaaaggtttctcattagatcgg

SEQ ID NO: 715038 - DNA, 25 bp, Artificial sequence
  Synthetic oligonucleotide
cgcagcctttatcctcgaaacgtag

SEQ ID NO: 715039 - DNA, 25 bp, Artificial sequence
  Synthetic oligonucleotide
taagtattttcagtcaaattcttga

SEQ ID NO: 715040 - DNA, 25 bp, Artificial sequence
  Synthetic oligonucleotide
taagtattttcactcaaattcttga

SEQ ID NO: 715041 - DNA, 25 bp, Artificial sequence
  Synthetic oligonucleotide
tctccaagttaatgctgttgccacg

SEQ ID NO: 715042 - DNA, 25 bp, Artificial sequence
  Synthetic oligonucleotide
catcgtgttgctttggtcgatataa

SEQ ID NO: 715043 - DNA, 25 bp, Artificial sequence
  Synthetic oligonucleotide
catcgtgttgctatggtcgatataa

SEQ ID NO: 715044 - DNA, 25 bp, Artificial sequence
  Synthetic oligonucleotide
gctgccgctaattcctccgccgttt

SEQ ID NO: 715045 - DNA, 25 bp, Artificial sequence
  Synthetic oligonucleotide
tctataatactacctatataacgag

SEQ ID NO: 715046 - DNA, 25 bp, Artificial sequence
  Synthetic oligonucleotide
tctcgaagagatgaaagagtctgtc

SEQ ID NO: 715047 - DNA, 25 bp, Artificial sequence
  Synthetic oligonucleotide
tctcgaagagatcaaagagtctgtc

SEQ ID NO: 715048 - DNA, 25 bp, Artificial sequence
  Synthetic oligonucleotide
tctccaagttaaagctgttgccacg

SEQ ID NO: 715049 - DNA, 25 bp, Artificial sequence
  Synthetic oligonucleotide
tccaatactaagcagatttccgagg

SEQ ID NO: 715050 - DNA, 25 bp, Artificial sequence
  Synthetic oligonucleotide
tccaatactaaggagatttccgagg

SEQ ID NO: 715051 - DNA, 25 bp, Artificial sequence
  Synthetic oligonucleotide
gctaatgaatgaaacagtgtacagt

SEQ ID NO: 715052 - DNA, 25 bp, Artificial sequence
  Synthetic oligonucleotide
gctaatgaatgatacagtgtacagt

SEQ ID NO: 715053 - DNA, 25 bp, Artificial sequence
  Synthetic oligonucleotide
tctataatactagctatataacgag

SEQ ID NO: 715054 - DNA, 25 bp, Artificial sequence
  Synthetic oligonucleotide
tttttaacgtaagaattatcattgg

SEQ ID NO: 715055 - DNA, 25 bp, Artificial sequence
  Synthetic oligonucleotide
tgatgaattcttgtaaactttaatc

SEQ ID NO: 715056 - DNA, 25 bp, Artificial sequence
  Synthetic oligonucleotide
tgatgaattcttctaaactttaatc

SEQ ID NO: 715057 - DNA, 25 bp, Artificial sequence
  Synthetic oligonucleotide
tctaagtgaaatatctagtgactaa

SEQ ID NO: 715058 - DNA, 25 bp, Artificial sequence
  Synthetic oligonucleotide
tttttaacgtaacaattatcattgg

SEQ ID NO: 715059 - DNA, 25 bp, Artificial sequence
  Synthetic oligonucleotide
ttttttgaataaacacttgtctttg

SEQ ID NO: 715060 - DNA, 25 bp, Artificial sequence
  Synthetic oligonucleotide
caaacatttaagtttgtggttacac

SEQ ID NO: 715061 - DNA, 25 bp, Artificial sequence
  Synthetic oligonucleotide
caaacatttaagattgtggttacac

SEQ ID NO: 715062 - DNA, 25 bp, Artificial sequence
  Synthetic oligonucleotide
ttttttgaataatcacttgtctttg

SEQ ID NO: 715063 - DNA, 25 bp, Artificial sequence
  Synthetic oligonucleotide
tctaagtgaaatttctagtgactaa

SEQ ID NO: 715064 - DNA, 25 bp, Artificial sequence
  Synthetic oligonucleotide
tgaaacaggataataatgggaagcg

SEQ ID NO: 715065 - DNA, 25 bp, Artificial sequence
  Synthetic oligonucleotide
tgaaacaggatattaatgggaagcg

SEQ ID NO: 715066 - DNA, 25 bp, Artificial sequence
  Synthetic oligonucleotide
tttgtgatccaagacgcgccttgcc

SEQ ID NO: 715067 - DNA, 25 bp, Artificial sequence
  Synthetic oligonucleotide
tttgtgatccaacacgcgccttgcc

SEQ ID NO: 715068 - DNA, 25 bp, Artificial sequence
  Synthetic oligonucleotide
tgtcaaggataacgaataaacgatt

SEQ ID NO: 715069 - DNA, 25 bp, Artificial sequence
  Synthetic oligonucleotide
tgtcaaggataaggaataaacgatt

SEQ ID NO: 715070 - DNA, 25 bp, Artificial sequence
  Synthetic oligonucleotide
ctgtctttatcttataagtcctacc

SEQ ID NO: 715071 - DNA, 25 bp, Artificial sequence
  Synthetic oligonucleotide
tcatcgcaatttttgctttttagtt

SEQ ID NO: 715072 - DNA, 25 bp, Artificial sequence
  Synthetic oligonucleotide
tacttttgaggaatatggtaaattc

SEQ ID NO: 715073 - DNA, 25 bp, Artificial sequence
  Synthetic oligonucleotide
tcatcgcaatttatgctttttagtt

SEQ ID NO: 715074 - DNA, 25 bp, Artificial sequence
  Synthetic oligonucleotide
gaatctttatgtaggttttatttgt

SEQ ID NO: 715075 - DNA, 25 bp, Artificial sequence
  Synthetic oligonucleotide
ctgtctttatctaataagtcctacc

SEQ ID NO: 715076 - DNA, 25 bp, Artificial sequence
  Synthetic oligonucleotide
tatttttgtctttttggtctatcta

SEQ ID NO: 715077 - DNA, 25 bp, Artificial sequence
  Synthetic oligonucleotide
tgtgagatacaaaagggccattgat

SEQ ID NO: 715078 - DNA, 25 bp, Artificial sequence
  Synthetic oligonucleotide
caaagtaaagtgaaatatcagaacc

SEQ ID NO: 715079 - DNA, 25 bp, Artificial sequence
  Synthetic oligonucleotide
gaatctttatgttggttttatttgt

SEQ ID NO: 715080 - DNA, 25 bp, Artificial sequence
  Synthetic oligonucleotide
ggtgttggaacatatccatgattaa

SEQ ID NO: 715081 - DNA, 25 bp, Artificial sequence
  Synthetic oligonucleotide
ctcgttacctaaattaaggcaatgt

SEQ ID NO: 715082 - DNA, 25 bp, Artificial sequence
  Synthetic oligonucleotide
ctcgttacctaatttaaggcaatgt

SEQ ID NO: 715083 - DNA, 25 bp, Artificial sequence
  Synthetic oligonucleotide
caatggctttgattttgaatccgtg

SEQ ID NO: 715084 - DNA, 25 bp, Artificial sequence
  Synthetic oligonucleotide
caatggctttgaatttgaatccgtg

SEQ ID NO: 715085 - DNA, 25 bp, Artificial sequence
  Synthetic oligonucleotide
gacaattacttcacaacgaaatgga

SEQ ID NO: 715086 - DNA, 25 bp, Artificial sequence
  Synthetic oligonucleotide
aaaccatctcgctttactttgaaca

SEQ ID NO: 715087 - DNA, 25 bp, Artificial sequence
  Synthetic oligonucleotide
aactttgaatttagtctttatttca

SEQ ID NO: 715088 - DNA, 25 bp, Artificial sequence
  Synthetic oligonucleotide
tatttttgtcttattggtctatcta

SEQ ID NO: 715089 - DNA, 25 bp, Artificial sequence
  Synthetic oligonucleotide
tacttttgaggattatggtaaattc

SEQ ID NO: 715090 - DNA, 25 bp, Artificial sequence
  Synthetic oligonucleotide
ggtgttggaacaaatccatgattaa

SEQ ID NO: 715091 - DNA, 25 bp, Artificial sequence
  Synthetic oligonucleotide
gacaattacttctcaacgaaatgga

SEQ ID NO: 715092 - DNA, 25 bp, Artificial sequence
  Synthetic oligonucleotide
ctagttgaaaatgacaatggtaggt

SEQ ID NO: 715093 - DNA, 25 bp, Artificial sequence
  Synthetic oligonucleotide
ctagttgaaaatcacaatggtaggt

SEQ ID NO: 715094 - DNA, 25 bp, Artificial sequence
  Synthetic oligonucleotide
gctttagctatggattaggttttag

SEQ ID NO: 715095 - DNA, 25 bp, Artificial sequence
  Synthetic oligonucleotide
gctttagctatgcattaggttttag

SEQ ID NO: 715096 - DNA, 25 bp, Artificial sequence
  Synthetic oligonucleotide
aactttgaattttgtctttatttca

SEQ ID NO: 715097 - DNA, 25 bp, Artificial sequence
  Synthetic oligonucleotide
aaaccatctcgcattactttgaaca

SEQ ID NO: 715098 - DNA, 25 bp, Artificial sequence
  Synthetic oligonucleotide
gtctgtctctctttggttttcatcc

SEQ ID NO: 715099 - DNA, 25 bp, Artificial sequence
  Synthetic oligonucleotide
tatacgggccggagggattgaaacc

SEQ ID NO: 715100 - DNA, 25 bp, Artificial sequence
  Synthetic oligonucleotide
ttcaacggaaactgagcaaaaactt

SEQ ID NO: 715101 - DNA, 25 bp, Artificial sequence
  Synthetic oligonucleotide
ttcaacggaaacagagcaaaaactt

SEQ ID NO: 715102 - DNA, 25 bp, Artificial sequence
  Synthetic oligonucleotide
gaacgcaatccggttctgtaacgaa

SEQ ID NO: 715103 - DNA, 25 bp, Artificial sequence
  Synthetic oligonucleotide
gaacgcaatccgcttctgtaacgaa

SEQ ID NO: 715104 - DNA, 25 bp, Artificial sequence
  Synthetic oligonucleotide
taaccgattttgtttagtccttgaa

SEQ ID NO: 715105 - DNA, 25 bp, Artificial sequence
  Synthetic oligonucleotide
taaccgattttgattagtccttgaa

SEQ ID NO: 715106 - DNA, 25 bp, Artificial sequence
  Synthetic oligonucleotide
tagtttatgccaaaccctctgccca

SEQ ID NO: 715107 - DNA, 25 bp, Artificial sequence
  Synthetic oligonucleotide
tagtttatgccataccctctgccca

SEQ ID NO: 715108 - DNA, 25 bp, Artificial sequence
  Synthetic oligonucleotide
gaaagtttagaacatcatcaagaca

SEQ ID NO: 715109 - DNA, 25 bp, Artificial sequence
  Synthetic oligonucleotide
ttcaacacaatacatagacagagcc

SEQ ID NO: 715110 - DNA, 25 bp, Artificial sequence
  Synthetic oligonucleotide
gaaagtttagaagatcatcaagaca

SEQ ID NO: 715111 - DNA, 25 bp, Artificial sequence
  Synthetic oligonucleotide
gtctgtctctctatggttttcatcc

SEQ ID NO: 715112 - DNA, 25 bp, Artificial sequence
  Synthetic oligonucleotide
tacttatgtaattaacttgtggtac

SEQ ID NO: 715113 - DNA, 25 bp, Artificial sequence
  Synthetic oligonucleotide
tacttatgtaataaacttgtggtac

SEQ ID NO: 715114 - DNA, 25 bp, Artificial sequence
  Synthetic oligonucleotide
gaataaattcgaccttcttctcaga

SEQ ID NO: 715115 - DNA, 25 bp, Artificial sequence
  Synthetic oligonucleotide
gaataaattcgagcttcttctcaga

SEQ ID NO: 715116 - DNA, 25 bp, Artificial sequence
  Synthetic oligonucleotide
catattcaattcacctataaggcta

SEQ ID NO: 715117 - DNA, 25 bp, Artificial sequence
  Synthetic oligonucleotide
catattcaattctcctataaggcta

SEQ ID NO: 715118 - DNA, 25 bp, Artificial sequence
  Synthetic oligonucleotide
tgtgagatacaatagggccattgat

SEQ ID NO: 715119 - DNA, 25 bp, Artificial sequence
  Synthetic oligonucleotide
gagattatggagtaatacggtgtca

SEQ ID NO: 715120 - DNA, 25 bp, Artificial sequence
  Synthetic oligonucleotide
ttcaacacaatagatagacagagcc

SEQ ID NO: 715121 - DNA, 25 bp, Artificial sequence
  Synthetic oligonucleotide
cattgatcattgactaaatattaga

SEQ ID NO: 715122 - DNA, 25 bp, Artificial sequence
  Synthetic oligonucleotide
aaaaagaacccagagtgttttcatc

SEQ ID NO: 715123 - DNA, 25 bp, Artificial sequence
  Synthetic oligonucleotide
gagagtttcttgcttatttgtttca

SEQ ID NO: 715124 - DNA, 25 bp, Artificial sequence
  Synthetic oligonucleotide
gagagtttcttggttatttgtttca

SEQ ID NO: 715125 - DNA, 25 bp, Artificial sequence
  Synthetic oligonucleotide
tgtgttttgctggaatcactccatg

SEQ ID NO: 715126 - DNA, 25 bp, Artificial sequence
  Synthetic oligonucleotide
tgtgttttgctgcaatcactccatg

SEQ ID NO: 715127 - DNA, 25 bp, Artificial sequence
  Synthetic oligonucleotide
tgaacatgtggtcggctcgattaaa

SEQ ID NO: 715128 - DNA, 25 bp, Artificial sequence
  Synthetic oligonucleotide
tgaacatgtggtgggctcgattaaa

SEQ ID NO: 715129 - DNA, 25 bp, Artificial sequence
  Synthetic oligonucleotide
tccaatatattgcttaaaaataagt

SEQ ID NO: 715130 - DNA, 25 bp, Artificial sequence
  Synthetic oligonucleotide
tccaatatattggttaaaaataagt

SEQ ID NO: 715131 - DNA, 25 bp, Artificial sequence
  Synthetic oligonucleotide
tatacgggccggtgggattgaaacc

SEQ ID NO: 715132 - DNA, 25 bp, Artificial sequence
  Synthetic oligonucleotide
cagatttcacatgggcaggttggat

SEQ ID NO: 715133 - DNA, 25 bp, Artificial sequence
  Synthetic oligonucleotide
caaagtaaagtgtaatatcagaacc

SEQ ID NO: 715134 - DNA, 25 bp, Artificial sequence
  Synthetic oligonucleotide
cattgatcattgtctaaatattaga

SEQ ID NO: 715135 - DNA, 25 bp, Artificial sequence
  Synthetic oligonucleotide
cttaaggaaaaattctacagaaaga

SEQ ID NO: 715136 - DNA, 25 bp, Artificial sequence
  Synthetic oligonucleotide
cttaaggaaaaaatctacagaaaga

SEQ ID NO: 715137 - DNA, 25 bp, Artificial sequence
  Synthetic oligonucleotide
tttttttaataaatagatagatcac

SEQ ID NO: 715138 - DNA, 25 bp, Artificial sequence
  Synthetic oligonucleotide
tttttttaataattagatagatcac

SEQ ID NO: 715139 - DNA, 25 bp, Artificial sequence
  Synthetic oligonucleotide
tatttattttgcacgatccatttcg

SEQ ID NO: 715140 - DNA, 25 bp, Artificial sequence
  Synthetic oligonucleotide
tatttattttgctcgatccatttcg

SEQ ID NO: 715141 - DNA, 25 bp, Artificial sequence
  Synthetic oligonucleotide
aacttactagaatcagagacccaag

SEQ ID NO: 715142 - DNA, 25 bp, Artificial sequence
  Synthetic oligonucleotide
aacttactagaaacagagacccaag

SEQ ID NO: 715143 - DNA, 25 bp, Artificial sequence
  Synthetic oligonucleotide
aaaaagaacccacagtgttttcatc

SEQ ID NO: 715144 - DNA, 25 bp, Artificial sequence
  Synthetic oligonucleotide
cagatttcacatcggcaggttggat

SEQ ID NO: 715145 - DNA, 25 bp, Artificial sequence
  Synthetic oligonucleotide
gacaaaaatgattcgttaaatgaat

SEQ ID NO: 715146 - DNA, 25 bp, Artificial sequence
  Synthetic oligonucleotide
ggtaatactaaccaaagacatctga

SEQ ID NO: 715147 - DNA, 25 bp, Artificial sequence
  Synthetic oligonucleotide
cttgtgctacttctttattagcgga

SEQ ID NO: 715148 - DNA, 25 bp, Artificial sequence
  Synthetic oligonucleotide
cttgtgctacttgtttattagcgga

SEQ ID NO: 715149 - DNA, 25 bp, Artificial sequence
  Synthetic oligonucleotide
caacttacaaaagatatcaatatat

SEQ ID NO: 715150 - DNA, 25 bp, Artificial sequence
  Synthetic oligonucleotide
caacttacaaaacatatcaatatat

SEQ ID NO: 715151 - DNA, 25 bp, Artificial sequence
  Synthetic oligonucleotide
gccatcaatttgttggatccaaaca

SEQ ID NO: 715152 - DNA, 25 bp, Artificial sequence
  Synthetic oligonucleotide
gccatcaatttgatggatccaaaca

SEQ ID NO: 715153 - DNA, 25 bp, Artificial sequence
  Synthetic oligonucleotide
gagataaaagtttaagcaattacta

SEQ ID NO: 715154 - DNA, 25 bp, Artificial sequence
  Synthetic oligonucleotide
tactttagcttgctaccgtacgatt

SEQ ID NO: 715155 - DNA, 25 bp, Artificial sequence
  Synthetic oligonucleotide
gacaaaaatgatacgttaaatgaat

SEQ ID NO: 715156 - DNA, 25 bp, Artificial sequence
  Synthetic oligonucleotide
catttacaattaaattcactgccag

SEQ ID NO: 715157 - DNA, 25 bp, Artificial sequence
  Synthetic oligonucleotide
tacaagtttgtaggtaattggattc

SEQ ID NO: 715158 - DNA, 25 bp, Artificial sequence
  Synthetic oligonucleotide
tacaagtttgtacgtaattggattc

SEQ ID NO: 715159 - DNA, 25 bp, Artificial sequence
  Synthetic oligonucleotide
tacgggttctaatgaaacaattatg

SEQ ID NO: 715160 - DNA, 25 bp, Artificial sequence
  Synthetic oligonucleotide
tacgggttctaaagaaacaattatg

SEQ ID NO: 715161 - DNA, 25 bp, Artificial sequence
  Synthetic oligonucleotide
gaagatctcattttcgttatgtcgg

SEQ ID NO: 715162 - DNA, 25 bp, Artificial sequence
  Synthetic oligonucleotide
gaagatctcattatcgttatgtcgg

SEQ ID NO: 715163 - DNA, 25 bp, Artificial sequence
  Synthetic oligonucleotide
gaaataattattataaagaaacaaa

SEQ ID NO: 715164 - DNA, 25 bp, Artificial sequence
  Synthetic oligonucleotide
gaaataattattttaaagaaacaaa

SEQ ID NO: 715165 - DNA, 25 bp, Artificial sequence
  Synthetic oligonucleotide
tactttagcttggtaccgtacgatt

SEQ ID NO: 715166 - DNA, 25 bp, Artificial sequence
  Synthetic oligonucleotide
gagataaaagttaaagcaattacta

SEQ ID NO: 715167 - DNA, 25 bp, Artificial sequence
  Synthetic oligonucleotide
cacgacaatgatggcaaaaattaag

SEQ ID NO: 715168 - DNA, 25 bp, Artificial sequence
  Synthetic oligonucleotide
aaaacaggaattcattaatatgaag

SEQ ID NO: 715169 - DNA, 25 bp, Artificial sequence
  Synthetic oligonucleotide
aaaacaggaattgattaatatgaag

SEQ ID NO: 715170 - DNA, 25 bp, Artificial sequence
  Synthetic oligonucleotide
gaaaaatgtctatatcttgcttggg

SEQ ID NO: 715171 - DNA, 25 bp, Artificial sequence
  Synthetic oligonucleotide
gaaaaatgtctaaatcttgcttggg

SEQ ID NO: 715172 - DNA, 25 bp, Artificial sequence
  Synthetic oligonucleotide
gaggacatcgctaccaataaagaaa

SEQ ID NO: 715173 - DNA, 25 bp, Artificial sequence
  Synthetic oligonucleotide
gaggacatcgcttccaataaagaaa

SEQ ID NO: 715174 - DNA, 25 bp, Artificial sequence
  Synthetic oligonucleotide
gagtacctcgatgttttctagtttg

SEQ ID NO: 715175 - DNA, 25 bp, Artificial sequence
  Synthetic oligonucleotide
gagtacctcgatcttttctagtttg

SEQ ID NO: 715176 - DNA, 25 bp, Artificial sequence
  Synthetic oligonucleotide
aaggcagcccaaaattcgataaaag

SEQ ID NO: 715177 - DNA, 25 bp, Artificial sequence
  Synthetic oligonucleotide
ggtaatactaacgaaagacatctga

SEQ ID NO: 715178 - DNA, 25 bp, Artificial sequence
  Synthetic oligonucleotide
cacgacaatgatcgcaaaaattaag

SEQ ID NO: 715179 - DNA, 25 bp, Artificial sequence
  Synthetic oligonucleotide
catttacaattatattcactgccag

SEQ ID NO: 715180 - DNA, 25 bp, Artificial sequence
  Synthetic oligonucleotide
catgtcttgatatgctcgacactgg

SEQ ID NO: 715181 - DNA, 25 bp, Artificial sequence
  Synthetic oligonucleotide
catttttcttctacttgatagtaga

SEQ ID NO: 715182 - DNA, 25 bp, Artificial sequence
  Synthetic oligonucleotide
actgtttagtattgctgtatatgaa

SEQ ID NO: 715183 - DNA, 25 bp, Artificial sequence
  Synthetic oligonucleotide
gtttctttttctatttacatataca

SEQ ID NO: 715184 - DNA, 25 bp, Artificial sequence
  Synthetic oligonucleotide
tttaatcctatcatcaaacgtgcaa

SEQ ID NO: 715185 - DNA, 25 bp, Artificial sequence
  Synthetic oligonucleotide
tttaatcctatcttcaaacgtgcaa

SEQ ID NO: 715186 - DNA, 25 bp, Artificial sequence
  Synthetic oligonucleotide
tcacatgtcgatcctaatccaacgg

SEQ ID NO: 715187 - DNA, 25 bp, Artificial sequence
  Synthetic oligonucleotide
tcacatgtcgatgctaatccaacgg

SEQ ID NO: 715188 - DNA, 25 bp, Artificial sequence
  Synthetic oligonucleotide
gtttctttttctttttacatataca

SEQ ID NO: 715189 - DNA, 25 bp, Artificial sequence
  Synthetic oligonucleotide
aaggcagcccaatattcgataaaag

SEQ ID NO: 715190 - DNA, 25 bp, Artificial sequence
  Synthetic oligonucleotide
tatactggggagttgcaagagagaa

SEQ ID NO: 715191 - DNA, 25 bp, Artificial sequence
  Synthetic oligonucleotide
tgcagctctcataccgttggcagag

SEQ ID NO: 715192 - DNA, 25 bp, Artificial sequence
  Synthetic oligonucleotide
tgcagctctcattccgttggcagag

SEQ ID NO: 715193 - DNA, 25 bp, Artificial sequence
  Synthetic oligonucleotide
gagattatggagaaatacggtgtca

SEQ ID NO: 715194 - DNA, 25 bp, Artificial sequence
  Synthetic oligonucleotide
catgtcttgataagctcgacactgg

SEQ ID NO: 715195 - DNA, 25 bp, Artificial sequence
  Synthetic oligonucleotide
gaaagaggtttttatccgaatcaac

SEQ ID NO: 715196 - DNA, 25 bp, Artificial sequence
  Synthetic oligonucleotide
gaaagaggttttaatccgaatcaac

SEQ ID NO: 715197 - DNA, 25 bp, Artificial sequence
  Synthetic oligonucleotide
tgttcaaagactgtttggcaaagac

SEQ ID NO: 715198 - DNA, 25 bp, Artificial sequence
  Synthetic oligonucleotide
tgttcaaagactctttggcaaagac

SEQ ID NO: 715199 - DNA, 25 bp, Artificial sequence
  Synthetic oligonucleotide
ggttttgttgaattaaaaaggtgca

SEQ ID NO: 715200 - DNA, 25 bp, Artificial sequence
  Synthetic oligonucleotide
gatctgtcggtttaatccggtttaa

SEQ ID NO: 715201 - DNA, 25 bp, Artificial sequence
  Synthetic oligonucleotide
tatactggggagatgcaagagagaa

SEQ ID NO: 715202 - DNA, 25 bp, Artificial sequence
  Synthetic oligonucleotide
gctgttaaagatgttaaactcgatt

SEQ ID NO: 715203 - DNA, 25 bp, Artificial sequence
  Synthetic oligonucleotide
gctgttaaagatcttaaactcgatt

SEQ ID NO: 715204 - DNA, 25 bp, Artificial sequence
  Synthetic oligonucleotide
gaagcagaggactcagtgctcttca

SEQ ID NO: 715205 - DNA, 25 bp, Artificial sequence
  Synthetic oligonucleotide
tgctctctttttgttttttatgtaa

SEQ ID NO: 715206 - DNA, 25 bp, Artificial sequence
  Synthetic oligonucleotide
tgctctctttttcttttttatgtaa

SEQ ID NO: 715207 - DNA, 25 bp, Artificial sequence
  Synthetic oligonucleotide
tattcttgccaaaatgccattattg

SEQ ID NO: 715208 - DNA, 25 bp, Artificial sequence
  Synthetic oligonucleotide
tattcttgccaatatgccattattg

SEQ ID NO: 715209 - DNA, 25 bp, Artificial sequence
  Synthetic oligonucleotide
actgtttagtatagctgtatatgaa

SEQ ID NO: 715210 - DNA, 25 bp, Artificial sequence
  Synthetic oligonucleotide
cggttgagatgataacaaatgggtc

SEQ ID NO: 715211 - DNA, 25 bp, Artificial sequence
  Synthetic oligonucleotide
catttttcttcttcttgatagtaga

SEQ ID NO: 715212 - DNA, 25 bp, Artificial sequence
  Synthetic oligonucleotide
ggttttgttgaaataaaaaggtgca

SEQ ID NO: 715213 - DNA, 25 bp, Artificial sequence
  Synthetic oligonucleotide
gaaaatatcagataaacaaaaccat

SEQ ID NO: 715214 - DNA, 25 bp, Artificial sequence
  Synthetic oligonucleotide
cggttgagatgaaaacaaatgggtc

SEQ ID NO: 715215 - DNA, 25 bp, Artificial sequence
  Synthetic oligonucleotide
tcctgcatcagatgaagcatcaacg

SEQ ID NO: 715216 - DNA, 25 bp, Artificial sequence
  Synthetic oligonucleotide
gaagcagaggacacagtgctcttca

SEQ ID NO: 715217 - DNA, 25 bp, Artificial sequence
  Synthetic oligonucleotide
gatctgtcggttaaatccggtttaa

SEQ ID NO: 715218 - DNA, 25 bp, Artificial sequence
  Synthetic oligonucleotide
tcctgcatcagaagaagcatcaacg

SEQ ID NO: 715219 - DNA, 25 bp, Artificial sequence
  Synthetic oligonucleotide
tatataacttctgacaagtcaccac

SEQ ID NO: 715220 - DNA, 25 bp, Artificial sequence
  Synthetic oligonucleotide
gaaaatatcagaaaaacaaaaccat

SEQ ID NO: 715221 - DNA, 25 bp, Artificial sequence
  Synthetic oligonucleotide
ttcttgagaagataaaaagggtcaa

SEQ ID NO: 715222 - DNA, 25 bp, Artificial sequence
  Synthetic oligonucleotide
ttcttgagaagaaaaaaagggtcaa

SEQ ID NO: 715223 - DNA, 25 bp, Artificial sequence
  Synthetic oligonucleotide
taaagacaggaaaatcggaatcgcc

SEQ ID NO: 715224 - DNA, 25 bp, Artificial sequence
  Synthetic oligonucleotide
acactctaccacactctggcgatga

SEQ ID NO: 715225 - DNA, 25 bp, Artificial sequence
  Synthetic oligonucleotide
ccctctggttcatatccggttctcg

SEQ ID NO: 715226 - DNA, 25 bp, Artificial sequence
  Synthetic oligonucleotide
tatataacttctcacaagtcaccac

SEQ ID NO: 715227 - DNA, 25 bp, Artificial sequence
  Synthetic oligonucleotide
tcttcttatggtttggattctgaaa

SEQ ID NO: 715228 - DNA, 25 bp, Artificial sequence
  Synthetic oligonucleotide
taaagacaggaatatcggaatcgcc

SEQ ID NO: 715229 - DNA, 25 bp, Artificial sequence
  Synthetic oligonucleotide
tcttcttatggtatggattctgaaa

SEQ ID NO: 715230 - DNA, 25 bp, Artificial sequence
  Synthetic oligonucleotide
acactctaccactctctggcgatga

SEQ ID NO: 715231 - DNA, 25 bp, Artificial sequence
  Synthetic oligonucleotide
ccctctggttcaaatccggttctcg

SEQ ID NO: 715232 - DNA, 25 bp, Artificial sequence
  Synthetic oligonucleotide
cgagaacttagcagacaaaggagac

SEQ ID NO: 715233 - DNA, 25 bp, Artificial sequence
  Synthetic oligonucleotide
cgagaacttagctgacaaaggagac

SEQ ID NO: 715234 - DNA, 25 bp, Artificial sequence
  Synthetic oligonucleotide
ttctcagagagctgcaagaacgctc

SEQ ID NO: 715235 - DNA, 25 bp, Artificial sequence
  Synthetic oligonucleotide
ttctcagagagcagcaagaacgctc

SEQ ID NO: 715236 - DNA, 25 bp, Artificial sequence
  Synthetic oligonucleotide
tgtaaaatatgatccagaaacgatg

SEQ ID NO: 715237 - DNA, 25 bp, Artificial sequence
  Synthetic oligonucleotide
tgtaaaatatgaaccagaaacgatg

SEQ ID NO: 715238 - DNA, 25 bp, Artificial sequence
  Synthetic oligonucleotide
tttttatgtataaatgtctttgacc

SEQ ID NO: 715239 - DNA, 25 bp, Artificial sequence
  Synthetic oligonucleotide
gatacttacataaaaccaaacgacg

SEQ ID NO: 715240 - DNA, 25 bp, Artificial sequence
  Synthetic oligonucleotide
tgaatatgtaaatgtccttgaacga

SEQ ID NO: 715241 - DNA, 25 bp, Artificial sequence
  Synthetic oligonucleotide
tttttatgtatatatgtctttgacc

SEQ ID NO: 715242 - DNA, 25 bp, Artificial sequence
  Synthetic oligonucleotide
tgaatatgtaaaagtccttgaacga

SEQ ID NO: 715243 - DNA, 25 bp, Artificial sequence
  Synthetic oligonucleotide
gtataaaaataaaaatgtaattcac

SEQ ID NO: 715244 - DNA, 25 bp, Artificial sequence
  Synthetic oligonucleotide
gaagtttgatttctggcttggtcga

SEQ ID NO: 715245 - DNA, 25 bp, Artificial sequence
  Synthetic oligonucleotide
gaagtttgatttgtggcttggtcga

SEQ ID NO: 715246 - DNA, 25 bp, Artificial sequence
  Synthetic oligonucleotide
gatacttacatataaccaaacgacg

SEQ ID NO: 715247 - DNA, 25 bp, Artificial sequence
  Synthetic oligonucleotide
ggattatctcataccttctaacaaa

SEQ ID NO: 715248 - DNA, 25 bp, Artificial sequence
  Synthetic oligonucleotide
gaataatatttgataatcaccttga

SEQ ID NO: 715249 - DNA, 25 bp, Artificial sequence
  Synthetic oligonucleotide
gaataatatttgttaatcaccttga

SEQ ID NO: 715250 - DNA, 25 bp, Artificial sequence
  Synthetic oligonucleotide
gtataaaaataataatgtaattcac

SEQ ID NO: 715251 - DNA, 25 bp, Artificial sequence
  Synthetic oligonucleotide
taaatctcaaaagactggaaacgac

SEQ ID NO: 715252 - DNA, 25 bp, Artificial sequence
  Synthetic oligonucleotide
taaatctcaaaacactggaaacgac

SEQ ID NO: 715253 - DNA, 25 bp, Artificial sequence
  Synthetic oligonucleotide
ccgtgacctggttaccggagcgtaa

SEQ ID NO: 715254 - DNA, 25 bp, Artificial sequence
  Synthetic oligonucleotide
ccgtgacctggtaaccggagcgtaa

SEQ ID NO: 715255 - DNA, 25 bp, Artificial sequence
  Synthetic oligonucleotide
aattggacaattatgagaaagacgg

SEQ ID NO: 715256 - DNA, 25 bp, Artificial sequence
  Synthetic oligonucleotide
aattggacaattttgagaaagacgg

SEQ ID NO: 715257 - DNA, 25 bp, Artificial sequence
  Synthetic oligonucleotide
ggaagctccatcactaccatttcaa

SEQ ID NO: 715258 - DNA, 25 bp, Artificial sequence
  Synthetic oligonucleotide
ggaagctccatctctaccatttcaa

SEQ ID NO: 715259 - DNA, 25 bp, Artificial sequence
  Synthetic oligonucleotide
tctcgttccaggttttaattttgag

SEQ ID NO: 715260 - DNA, 25 bp, Artificial sequence
  Synthetic oligonucleotide
ggattatctcattccttctaacaaa

SEQ ID NO: 715261 - DNA, 25 bp, Artificial sequence
  Synthetic oligonucleotide
caatttgtttttatggtttgcagtc

SEQ ID NO: 715262 - DNA, 25 bp, Artificial sequence
  Synthetic oligonucleotide
gcatttctacctggccgtggatcgt

SEQ ID NO: 715263 - DNA, 25 bp, Artificial sequence
  Synthetic oligonucleotide
cctcttacggcttagtataaatcaa

SEQ ID NO: 715264 - DNA, 25 bp, Artificial sequence
  Synthetic oligonucleotide
catagatttcgaggaatttgtgcat

SEQ ID NO: 715265 - DNA, 25 bp, Artificial sequence
  Synthetic oligonucleotide
tctcgttccaggatttaattttgag

SEQ ID NO: 715266 - DNA, 25 bp, Artificial sequence
  Synthetic oligonucleotide
gtttgactggacaacttttggaatg

SEQ ID NO: 715267 - DNA, 25 bp, Artificial sequence
  Synthetic oligonucleotide
gcatttctacctcgccgtggatcgt

SEQ ID NO: 715268 - DNA, 25 bp, Artificial sequence
  Synthetic oligonucleotide
catggtttagatcattgtacgtaga

SEQ ID NO: 715269 - DNA, 25 bp, Artificial sequence
  Synthetic oligonucleotide
catggtttagatgattgtacgtaga

SEQ ID NO: 715270 - DNA, 25 bp, Artificial sequence
  Synthetic oligonucleotide
tagtttggtcatgttcattgttgca

SEQ ID NO: 715271 - DNA, 25 bp, Artificial sequence
  Synthetic oligonucleotide
tagtttggtcatcttcattgttgca

SEQ ID NO: 715272 - DNA, 25 bp, Artificial sequence
  Synthetic oligonucleotide
ttgatggcagaactagataaaaacc

SEQ ID NO: 715273 - DNA, 25 bp, Artificial sequence
  Synthetic oligonucleotide
ttgatggcagaagtagataaaaacc

SEQ ID NO: 715274 - DNA, 25 bp, Artificial sequence
  Synthetic oligonucleotide
catagatttcgacgaatttgtgcat

SEQ ID NO: 715275 - DNA, 25 bp, Artificial sequence
  Synthetic oligonucleotide
caaattcggagaacgagactccata

SEQ ID NO: 715276 - DNA, 25 bp, Artificial sequence
  Synthetic oligonucleotide
taaggcgtttaagatcattgaccac

SEQ ID NO: 715277 - DNA, 25 bp, Artificial sequence
  Synthetic oligonucleotide
taaggcgtttaacatcattgaccac

SEQ ID NO: 715278 - DNA, 25 bp, Artificial sequence
  Synthetic oligonucleotide
tgtgaataaatctaaacctgtcatt

SEQ ID NO: 715279 - DNA, 25 bp, Artificial sequence
  Synthetic oligonucleotide
tgtgaataaatcaaaacctgtcatt

SEQ ID NO: 715280 - DNA, 25 bp, Artificial sequence
  Synthetic oligonucleotide
caaattcggagatcgagactccata

SEQ ID NO: 715281 - DNA, 25 bp, Artificial sequence
  Synthetic oligonucleotide
gatcgaagaagctgaccgtgacagt

SEQ ID NO: 715282 - DNA, 25 bp, Artificial sequence
  Synthetic oligonucleotide
taacttggaggagttcatgaagatg

SEQ ID NO: 715283 - DNA, 25 bp, Artificial sequence
  Synthetic oligonucleotide
taacttggaggacttcatgaagatg

SEQ ID NO: 715284 - DNA, 25 bp, Artificial sequence
  Synthetic oligonucleotide
catgtttttgccttaacctacgcag

SEQ ID NO: 715285 - DNA, 25 bp, Artificial sequence
  Synthetic oligonucleotide
catgtttttgccataacctacgcag

SEQ ID NO: 715286 - DNA, 25 bp, Artificial sequence
  Synthetic oligonucleotide
taattttgcgttttatctataatcg

SEQ ID NO: 715287 - DNA, 25 bp, Artificial sequence
  Synthetic oligonucleotide
tattatctttttatgtttggattga

SEQ ID NO: 715288 - DNA, 25 bp, Artificial sequence
  Synthetic oligonucleotide
gatcgaagaagcagaccgtgacagt

SEQ ID NO: 715289 - DNA, 25 bp, Artificial sequence
  Synthetic oligonucleotide
tattatctttttttgtttggattga

SEQ ID NO: 715290 - DNA, 25 bp, Artificial sequence
  Synthetic oligonucleotide
gggagaaaatttcacagataatgat

SEQ ID NO: 715291 - DNA, 25 bp, Artificial sequence
  Synthetic oligonucleotide
gggagaaaatttgacagataatgat

SEQ ID NO: 715292 - DNA, 25 bp, Artificial sequence
  Synthetic oligonucleotide
cacctcgtgatataaagatgattgc

SEQ ID NO: 715293 - DNA, 25 bp, Artificial sequence
  Synthetic oligonucleotide
cacctcgtgataaaaagatgattgc

SEQ ID NO: 715294 - DNA, 25 bp, Artificial sequence
  Synthetic oligonucleotide
gtttgactggactacttttggaatg

SEQ ID NO: 715295 - DNA, 25 bp, Artificial sequence
  Synthetic oligonucleotide
cctcttacggctaagtataaatcaa

SEQ ID NO: 715296 - DNA, 25 bp, Artificial sequence
  Synthetic oligonucleotide
taattttgcgttatatctataatcg

SEQ ID NO: 715297 - DNA, 25 bp, Artificial sequence
  Synthetic oligonucleotide
tcaaagccaaacttattgtaaaacc

SEQ ID NO: 715298 - DNA, 25 bp, Artificial sequence
  Synthetic oligonucleotide
gagaaaaaaggaaatccctaacaca

SEQ ID NO: 715299 - DNA, 25 bp, Artificial sequence
  Synthetic oligonucleotide
gtaccgttacgctgaaccctaatca

SEQ ID NO: 715300 - DNA, 25 bp, Artificial sequence
  Synthetic oligonucleotide
gtaccgttacgcagaaccctaatca

SEQ ID NO: 715301 - DNA, 25 bp, Artificial sequence
  Synthetic oligonucleotide
gaaaaaggaaactacgcataagagt

SEQ ID NO: 715302 - DNA, 25 bp, Artificial sequence
  Synthetic oligonucleotide
gaaaaaggaaacaacgcataagagt

SEQ ID NO: 715303 - DNA, 25 bp, Artificial sequence
  Synthetic oligonucleotide
ggtttagtacgttattaccaaatca

SEQ ID NO: 715304 - DNA, 25 bp, Artificial sequence
  Synthetic oligonucleotide
ggtttagtacgtaattaccaaatca

SEQ ID NO: 715305 - DNA, 25 bp, Artificial sequence
  Synthetic oligonucleotide
tgcaattttcttttgtagctcccta

SEQ ID NO: 715306 - DNA, 25 bp, Artificial sequence
  Synthetic oligonucleotide
tgcaattttcttatgtagctcccta

SEQ ID NO: 715307 - DNA, 25 bp, Artificial sequence
  Synthetic oligonucleotide
ctttctcttgtgtatattatcaaca

SEQ ID NO: 715308 - DNA, 25 bp, Artificial sequence
  Synthetic oligonucleotide
ctttctcttgtgaatattatcaaca

SEQ ID NO: 715309 - DNA, 25 bp, Artificial sequence
  Synthetic oligonucleotide
tatattattaaagaatgttgaaacg

SEQ ID NO: 715310 - DNA, 25 bp, Artificial sequence
  Synthetic oligonucleotide
tgtatacagtagaaccaatcaatca

SEQ ID NO: 715311 - DNA, 25 bp, Artificial sequence
  Synthetic oligonucleotide
tcaaagccaaacatattgtaaaacc

SEQ ID NO: 715312 - DNA, 25 bp, Artificial sequence
  Synthetic oligonucleotide
tatagaatagcctcatcgtttaagt

SEQ ID NO: 715313 - DNA, 25 bp, Artificial sequence
  Synthetic oligonucleotide
gattgtatccagttgtctcttgacc

SEQ ID NO: 715314 - DNA, 25 bp, Artificial sequence
  Synthetic oligonucleotide
gattgtatccagatgtctcttgacc

SEQ ID NO: 715315 - DNA, 25 bp, Artificial sequence
  Synthetic oligonucleotide
gagatgaatggtggattgataacgc

SEQ ID NO: 715316 - DNA, 25 bp, Artificial sequence
  Synthetic oligonucleotide
gagatgaatggtcgattgataacgc

SEQ ID NO: 715317 - DNA, 25 bp, Artificial sequence
  Synthetic oligonucleotide
gggttaatggctgttaagccttttg

SEQ ID NO: 715318 - DNA, 25 bp, Artificial sequence
  Synthetic oligonucleotide
gggttaatggctcttaagccttttg

SEQ ID NO: 715319 - DNA, 25 bp, Artificial sequence
  Synthetic oligonucleotide
tataacaacacaaggatctccgatc

SEQ ID NO: 715320 - DNA, 25 bp, Artificial sequence
  Synthetic oligonucleotide
tataacaacacatggatctccgatc

SEQ ID NO: 715321 - DNA, 25 bp, Artificial sequence
  Synthetic oligonucleotide
tcaaatgtgcttacttattgcagat

SEQ ID NO: 715322 - DNA, 25 bp, Artificial sequence
  Synthetic oligonucleotide
tcaaatgtgctttcttattgcagat

SEQ ID NO: 715323 - DNA, 25 bp, Artificial sequence
  Synthetic oligonucleotide
aacattctgctgtttttatcttagg

SEQ ID NO: 715324 - DNA, 25 bp, Artificial sequence
  Synthetic oligonucleotide
aacattctgctgattttatcttagg

SEQ ID NO: 715325 - DNA, 25 bp, Artificial sequence
  Synthetic oligonucleotide
tatattattaaacaatgttgaaacg

SEQ ID NO: 715326 - DNA, 25 bp, Artificial sequence
  Synthetic oligonucleotide
agagggaagattgatgaggattcat

SEQ ID NO: 715327 - DNA, 25 bp, Artificial sequence
  Synthetic oligonucleotide
caatttgtttttttggtttgcagtc

SEQ ID NO: 715328 - DNA, 25 bp, Artificial sequence
  Synthetic oligonucleotide
gagtgacgatccagaagttaaagaa

SEQ ID NO: 715329 - DNA, 25 bp, Artificial sequence
  Synthetic oligonucleotide
gagtgacgatcctgaagttaaagaa

SEQ ID NO: 715330 - DNA, 25 bp, Artificial sequence
  Synthetic oligonucleotide
gagaatcgttccaaaaattacagcg

SEQ ID NO: 715331 - DNA, 25 bp, Artificial sequence
  Synthetic oligonucleotide
gagaatcgttcctaaaattacagcg

SEQ ID NO: 715332 - DNA, 25 bp, Artificial sequence
  Synthetic oligonucleotide
gatgactcttcttcgaccaagatga

SEQ ID NO: 715333 - DNA, 25 bp, Artificial sequence
  Synthetic oligonucleotide
gatgactcttctacgaccaagatga

SEQ ID NO: 715334 - DNA, 25 bp, Artificial sequence
  Synthetic oligonucleotide
cgaacgagaaaccaacgtgatggaa

SEQ ID NO: 715335 - DNA, 25 bp, Artificial sequence
  Synthetic oligonucleotide
cgaacgagaaacgaacgtgatggaa

SEQ ID NO: 715336 - DNA, 25 bp, Artificial sequence
  Synthetic oligonucleotide
tgatttgttgatatgcagtcgctct

SEQ ID NO: 715337 - DNA, 25 bp, Artificial sequence
  Synthetic oligonucleotide
tgatttgttgatttgcagtcgctct

SEQ ID NO: 715338 - DNA, 25 bp, Artificial sequence
  Synthetic oligonucleotide
tcttcgttagccgttacgctccaaa

SEQ ID NO: 715339 - DNA, 25 bp, Artificial sequence
  Synthetic oligonucleotide
gagaaaaaaggatatccctaacaca

SEQ ID NO: 715340 - DNA, 25 bp, Artificial sequence
  Synthetic oligonucleotide
tgagtaaccgttggttatcgttgac

SEQ ID NO: 715341 - DNA, 25 bp, Artificial sequence
  Synthetic oligonucleotide
tatagaatagccacatcgtttaagt

SEQ ID NO: 715342 - DNA, 25 bp, Artificial sequence
  Synthetic oligonucleotide
tgggtgataaaaacggcaattgacg

SEQ ID NO: 715343 - DNA, 25 bp, Artificial sequence
  Synthetic oligonucleotide
tgggtgataaaatcggcaattgacg

SEQ ID NO: 715344 - DNA, 25 bp, Artificial sequence
  Synthetic oligonucleotide
tctgttcgcttagccgttacgaaga

SEQ ID NO: 715345 - DNA, 25 bp, Artificial sequence
  Synthetic oligonucleotide
tctgttcgcttacccgttacgaaga

SEQ ID NO: 715346 - DNA, 25 bp, Artificial sequence
  Synthetic oligonucleotide
ttcgtttagaatgattacgctagcc

SEQ ID NO: 715347 - DNA, 25 bp, Artificial sequence
  Synthetic oligonucleotide
ttcgtttagaatcattacgctagcc

SEQ ID NO: 715348 - DNA, 25 bp, Artificial sequence
  Synthetic oligonucleotide
aatttcatgctcactgatttctccg

SEQ ID NO: 715349 - DNA, 25 bp, Artificial sequence
  Synthetic oligonucleotide
aatttcatgctctctgatttctccg

SEQ ID NO: 715350 - DNA, 25 bp, Artificial sequence
  Synthetic oligonucleotide
tacagagagagagagggctatagat

SEQ ID NO: 715351 - DNA, 25 bp, Artificial sequence
  Synthetic oligonucleotide
tacagagagagacagggctatagat

SEQ ID NO: 715352 - DNA, 25 bp, Artificial sequence
  Synthetic oligonucleotide
gatcatcacaaacaaaaacctagag

SEQ ID NO: 715353 - DNA, 25 bp, Artificial sequence
  Synthetic oligonucleotide
gatcatcacaaagaaaaacctagag

SEQ ID NO: 715354 - DNA, 25 bp, Artificial sequence
  Synthetic oligonucleotide
agagggaagattcatgaggattcat

SEQ ID NO: 715355 - DNA, 25 bp, Artificial sequence
  Synthetic oligonucleotide
tcttcgttagcccttacgctccaaa

SEQ ID NO: 715356 - DNA, 25 bp, Artificial sequence
  Synthetic oligonucleotide
ccttagccgctttggtatctctctc

SEQ ID NO: 715357 - DNA, 25 bp, Artificial sequence
  Synthetic oligonucleotide
tgttcaacgtcttttgtgtctacag

SEQ ID NO: 715358 - DNA, 25 bp, Artificial sequence
  Synthetic oligonucleotide
tgttcaacgtctattgtgtctacag

SEQ ID NO: 715359 - DNA, 25 bp, Artificial sequence
  Synthetic oligonucleotide
tggtattaactttcatgttcttccc

SEQ ID NO: 715360 - DNA, 25 bp, Artificial sequence
  Synthetic oligonucleotide
tggtattaacttacatgttcttccc

SEQ ID NO: 715361 - DNA, 25 bp, Artificial sequence
  Synthetic oligonucleotide
cgtttgttattgatcttgttgtacc

SEQ ID NO: 715362 - DNA, 25 bp, Artificial sequence
  Synthetic oligonucleotide
cgtttgttattgttcttgttgtacc

SEQ ID NO: 715363 - DNA, 25 bp, Artificial sequence
  Synthetic oligonucleotide
ttcattgtttgaatgatatcatcgg

SEQ ID NO: 715364 - DNA, 25 bp, Artificial sequence
  Synthetic oligonucleotide
ttcattgtttgattgatatcatcgg

SEQ ID NO: 715365 - DNA, 25 bp, Artificial sequence
  Synthetic oligonucleotide
gattcacttgctaggttcatcatga

SEQ ID NO: 715366 - DNA, 25 bp, Artificial sequence
  Synthetic oligonucleotide
gattcacttgcttggttcatcatga

SEQ ID NO: 715367 - DNA, 25 bp, Artificial sequence
  Synthetic oligonucleotide
ctttggtatttgatttgaaaagacc

SEQ ID NO: 715368 - DNA, 25 bp, Artificial sequence
  Synthetic oligonucleotide
ctttggtatttgttttgaaaagacc

SEQ ID NO: 715369 - DNA, 25 bp, Artificial sequence
  Synthetic oligonucleotide
gcagatagagaacgagctatggtta

SEQ ID NO: 715370 - DNA, 25 bp, Artificial sequence
  Synthetic oligonucleotide
tttaactttcattgctgaggcatgt

SEQ ID NO: 715371 - DNA, 25 bp, Artificial sequence
  Synthetic oligonucleotide
tagtctgttgcacctctcgtgacga

SEQ ID NO: 715372 - DNA, 25 bp, Artificial sequence
  Synthetic oligonucleotide
ccttagccgcttaggtatctctctc

SEQ ID NO: 715373 - DNA, 25 bp, Artificial sequence
  Synthetic oligonucleotide
gtctgttcttccatatccactcttc

SEQ ID NO: 715374 - DNA, 25 bp, Artificial sequence
  Synthetic oligonucleotide
gtctgttcttccttatccactcttc

SEQ ID NO: 715375 - DNA, 25 bp, Artificial sequence
  Synthetic oligonucleotide
tagtctgttgcagctctcgtgacga

SEQ ID NO: 715376 - DNA, 25 bp, Artificial sequence
  Synthetic oligonucleotide
tattaggcgttctaggtcgtcgtcc

SEQ ID NO: 715377 - DNA, 25 bp, Artificial sequence
  Synthetic oligonucleotide
aactttggatgtcggcacaggagac

SEQ ID NO: 715378 - DNA, 25 bp, Artificial sequence
  Synthetic oligonucleotide
aactttggatgtgggcacaggagac

SEQ ID NO: 715379 - DNA, 25 bp, Artificial sequence
  Synthetic oligonucleotide
tcatcaagactgtgattctgaatcg

SEQ ID NO: 715380 - DNA, 25 bp, Artificial sequence
  Synthetic oligonucleotide
tcatcaagactgagattctgaatcg

SEQ ID NO: 715381 - DNA, 25 bp, Artificial sequence
  Synthetic oligonucleotide
caaaatggtaagaaaattgtatcaa

SEQ ID NO: 715382 - DNA, 25 bp, Artificial sequence
  Synthetic oligonucleotide
caaaatggtaagtaaattgtatcaa

SEQ ID NO: 715383 - DNA, 25 bp, Artificial sequence
  Synthetic oligonucleotide
tgtatacagtagtaccaatcaatca

SEQ ID NO: 715384 - DNA, 25 bp, Artificial sequence
  Synthetic oligonucleotide
tgagtaaccgttcgttatcgttgac

SEQ ID NO: 715385 - DNA, 25 bp, Artificial sequence
  Synthetic oligonucleotide
tttaactttcatagctgaggcatgt

SEQ ID NO: 715386 - DNA, 25 bp, Artificial sequence
  Synthetic oligonucleotide
caaactctttttcttcatcaaacaa

SEQ ID NO: 715387 - DNA, 25 bp, Artificial sequence
  Synthetic oligonucleotide
gaaagcagtggcatactcatcgctg

SEQ ID NO: 715388 - DNA, 25 bp, Artificial sequence
  Synthetic oligonucleotide
gaaagcagtggcttactcatcgctg

SEQ ID NO: 715389 - DNA, 25 bp, Artificial sequence
  Synthetic oligonucleotide
tattaggcgttcaaggtcgtcgtcc

SEQ ID NO: 715390 - DNA, 25 bp, Artificial sequence
  Synthetic oligonucleotide
gcagatagagaaggagctatggtta

SEQ ID NO: 715391 - DNA, 25 bp, Artificial sequence
  Synthetic oligonucleotide
tgttggaggtgatgtaacgactctc

SEQ ID NO: 715392 - DNA, 25 bp, Artificial sequence
  Synthetic oligonucleotide
tgttggaggtgaagtaacgactctc

SEQ ID NO: 715393 - DNA, 25 bp, Artificial sequence
  Synthetic oligonucleotide
gagacttttctcttaaggtggaata

SEQ ID NO: 715394 - DNA, 25 bp, Artificial sequence
  Synthetic oligonucleotide
caaactctttttgttcatcaaacaa

SEQ ID NO: 715395 - DNA, 25 bp, Artificial sequence
  Synthetic oligonucleotide
acttgcttagctacaggttcttttt

SEQ ID NO: 715396 - DNA, 25 bp, Artificial sequence
  Synthetic oligonucleotide
acttgcttagcttcaggttcttttt

SEQ ID NO: 715397 - DNA, 25 bp, Artificial sequence
  Synthetic oligonucleotide
gtttcaggaaacttatacaaggcgt

SEQ ID NO: 715398 - DNA, 25 bp, Artificial sequence
  Synthetic oligonucleotide
gtttcaggaaacatatacaaggcgt

SEQ ID NO: 715399 - DNA, 25 bp, Artificial sequence
  Synthetic oligonucleotide
gaaccttcctcttattcactacttg

SEQ ID NO: 715400 - DNA, 25 bp, Artificial sequence
  Synthetic oligonucleotide
gaaccttcctctaattcactacttg

SEQ ID NO: 715401 - DNA, 25 bp, Artificial sequence
  Synthetic oligonucleotide
tgaccgatgtttgccttccgttact

SEQ ID NO: 715402 - DNA, 25 bp, Artificial sequence
  Synthetic oligonucleotide
ctctgtggtagatgaaggtttggaa

SEQ ID NO: 715403 - DNA, 25 bp, Artificial sequence
  Synthetic oligonucleotide
gagacttttctcataaggtggaata

SEQ ID NO: 715404 - DNA, 25 bp, Artificial sequence
  Synthetic oligonucleotide
ggcaagcaacaatcaactggaacca

SEQ ID NO: 715405 - DNA, 25 bp, Artificial sequence
  Synthetic oligonucleotide
cggaaaagaagataagacatctcat

SEQ ID NO: 715406 - DNA, 25 bp, Artificial sequence
  Synthetic oligonucleotide
cggaaaagaagaaaagacatctcat

SEQ ID NO: 715407 - DNA, 25 bp, Artificial sequence
  Synthetic oligonucleotide
ctctgtggtagaagaaggtttggaa

SEQ ID NO: 715408 - DNA, 25 bp, Artificial sequence
  Synthetic oligonucleotide
ggcaagcaacaaacaactggaacca

SEQ ID NO: 715409 - DNA, 25 bp, Artificial sequence
  Synthetic oligonucleotide
tacgagcttccttcaaagaaggttg

SEQ ID NO: 715410 - DNA, 25 bp, Artificial sequence
  Synthetic oligonucleotide
taatcaatctgctattgtcaagtca

SEQ ID NO: 715411 - DNA, 25 bp, Artificial sequence
  Synthetic oligonucleotide
tgaccgatgtttcccttccgttact

SEQ ID NO: 715412 - DNA, 25 bp, Artificial sequence
  Synthetic oligonucleotide
taatcaatctgcaattgtcaagtca

SEQ ID NO: 715413 - DNA, 25 bp, Artificial sequence
  Synthetic oligonucleotide
ggagaatcttctctatccgcacgcg

SEQ ID NO: 715414 - DNA, 25 bp, Artificial sequence
  Synthetic oligonucleotide
tacgagcttcctacaaagaaggttg

SEQ ID NO: 715415 - DNA, 25 bp, Artificial sequence
  Synthetic oligonucleotide
ggagaatcttctgtatccgcacgcg

SEQ ID NO: 715416 - DNA, 25 bp, Artificial sequence
  Synthetic oligonucleotide
tagcccaagatgctcgttttcgaga

SEQ ID NO: 715417 - DNA, 25 bp, Artificial sequence
  Synthetic oligonucleotide
gagcatccctgcgatggcttagtag

SEQ ID NO: 715418 - DNA, 25 bp, Artificial sequence
  Synthetic oligonucleotide
caatccaatctcaccaaactctcct

SEQ ID NO: 715419 - DNA, 25 bp, Artificial sequence
  Synthetic oligonucleotide
gccatattcggcaaccgggtttcca

SEQ ID NO: 715420 - DNA, 25 bp, Artificial sequence
  Synthetic oligonucleotide
gccatattcggctaccgggtttcca

SEQ ID NO: 715421 - DNA, 25 bp, Artificial sequence
  Synthetic oligonucleotide
tcccggttcaccaccgagtagagcg

SEQ ID NO: 715422 - DNA, 25 bp, Artificial sequence
  Synthetic oligonucleotide
tcatcatcgtcgtcttcccgtggtt

SEQ ID NO: 715423 - DNA, 25 bp, Artificial sequence
  Synthetic oligonucleotide
tagcccaagatggtcgttttcgaga

SEQ ID NO: 715424 - DNA, 25 bp, Artificial sequence
  Synthetic oligonucleotide
tcatcatcgtcgacttcccgtggtt

SEQ ID NO: 715425 - DNA, 25 bp, Artificial sequence
  Synthetic oligonucleotide
caatccaatctctccaaactctcct

SEQ ID NO: 715426 - DNA, 25 bp, Artificial sequence
  Synthetic oligonucleotide
aaatttggactcaactcgcctgcag

SEQ ID NO: 715427 - DNA, 25 bp, Artificial sequence
  Synthetic oligonucleotide
aaatttggactctactcgcctgcag

SEQ ID NO: 715428 - DNA, 25 bp, Artificial sequence
  Synthetic oligonucleotide
gatttgattgcttgaaccgtgaccg

SEQ ID NO: 715429 - DNA, 25 bp, Artificial sequence
  Synthetic oligonucleotide
gagcatccctgccatggcttagtag

SEQ ID NO: 715430 - DNA, 25 bp, Artificial sequence
  Synthetic oligonucleotide
gctgcaactattactactaccattt

SEQ ID NO: 715431 - DNA, 25 bp, Artificial sequence
  Synthetic oligonucleotide
aaacaagtgtacttagagattccgg

SEQ ID NO: 715432 - DNA, 25 bp, Artificial sequence
  Synthetic oligonucleotide
aaacaagtgtacatagagattccgg

SEQ ID NO: 715433 - DNA, 25 bp, Artificial sequence
  Synthetic oligonucleotide
tcccggttcacctccgagtagagcg

SEQ ID NO: 715434 - DNA, 25 bp, Artificial sequence
  Synthetic oligonucleotide
tgtgattctaaacctggtgctgagc

SEQ ID NO: 715435 - DNA, 25 bp, Artificial sequence
  Synthetic oligonucleotide
cgccaatgcctatcagaggaggatt

SEQ ID NO: 715436 - DNA, 25 bp, Artificial sequence
  Synthetic oligonucleotide
cgccaatgcctaacagaggaggatt

SEQ ID NO: 715437 - DNA, 25 bp, Artificial sequence
  Synthetic oligonucleotide
gctgcaactatttctactaccattt

SEQ ID NO: 715438 - DNA, 25 bp, Artificial sequence
  Synthetic oligonucleotide
gatttgattgctagaaccgtgaccg

SEQ ID NO: 715439 - DNA, 25 bp, Artificial sequence
  Synthetic oligonucleotide
cattcgtagaaaggtatgcttttga

SEQ ID NO: 715440 - DNA, 25 bp, Artificial sequence
  Synthetic oligonucleotide
aacgttattcgtcctcttagattac

SEQ ID NO: 715441 - DNA, 25 bp, Artificial sequence
  Synthetic oligonucleotide
aacgttattcgtgctcttagattac

SEQ ID NO: 715442 - DNA, 25 bp, Artificial sequence
  Synthetic oligonucleotide
catgtaggtggccatcatatttgca

SEQ ID NO: 715443 - DNA, 25 bp, Artificial sequence
  Synthetic oligonucleotide
tatgtttttgtttttcatcttctcc

SEQ ID NO: 715444 - DNA, 25 bp, Artificial sequence
  Synthetic oligonucleotide
ggtgatttaaatcatcctcctttaa

SEQ ID NO: 715445 - DNA, 25 bp, Artificial sequence
  Synthetic oligonucleotide
ggtgatttaaatgatcctcctttaa

SEQ ID NO: 715446 - DNA, 25 bp, Artificial sequence
  Synthetic oligonucleotide
ccagtgattagatacaaaagtgttt

SEQ ID NO: 715447 - DNA, 25 bp, Artificial sequence
  Synthetic oligonucleotide
ccagtgattagaaacaaaagtgttt

SEQ ID NO: 715448 - DNA, 25 bp, Artificial sequence
  Synthetic oligonucleotide
tgctatctgtagtcaagctgcagcc

SEQ ID NO: 715449 - DNA, 25 bp, Artificial sequence
  Synthetic oligonucleotide
cattcgtagaaacgtatgcttttga

SEQ ID NO: 715450 - DNA, 25 bp, Artificial sequence
  Synthetic oligonucleotide
tgtgattctaaagctggtgctgagc

SEQ ID NO: 715451 - DNA, 25 bp, Artificial sequence
  Synthetic oligonucleotide
aatagggcagttactatcatcatcc

SEQ ID NO: 715452 - DNA, 25 bp, Artificial sequence
  Synthetic oligonucleotide
cacttcaggctagatgttgtgatag

SEQ ID NO: 715453 - DNA, 25 bp, Artificial sequence
  Synthetic oligonucleotide
cacttcaggctacatgttgtgatag

SEQ ID NO: 715454 - DNA, 25 bp, Artificial sequence
  Synthetic oligonucleotide
tgattaacttttctacacctcaagt

SEQ ID NO: 715455 - DNA, 25 bp, Artificial sequence
  Synthetic oligonucleotide
tgattaacttttgtacacctcaagt

SEQ ID NO: 715456 - DNA, 25 bp, Artificial sequence
  Synthetic oligonucleotide
tctgcctctgcttcagaagattctg

SEQ ID NO: 715457 - DNA, 25 bp, Artificial sequence
  Synthetic oligonucleotide
tctgcctctgctacagaagattctg

SEQ ID NO: 715458 - DNA, 25 bp, Artificial sequence
  Synthetic oligonucleotide
actttgctgtgatctctttaggagg

SEQ ID NO: 715459 - DNA, 25 bp, Artificial sequence
  Synthetic oligonucleotide
actttgctgtgaactctttaggagg

SEQ ID NO: 715460 - DNA, 25 bp, Artificial sequence
  Synthetic oligonucleotide
aatagggcagtttctatcatcatcc

SEQ ID NO: 715461 - DNA, 25 bp, Artificial sequence
  Synthetic oligonucleotide
tgctatctgtagacaagctgcagcc

SEQ ID NO: 715462 - DNA, 25 bp, Artificial sequence
  Synthetic oligonucleotide
tatgaaacagttgcatttgatccac

SEQ ID NO: 715463 - DNA, 25 bp, Artificial sequence
  Synthetic oligonucleotide
tcgtgaaccccctccgtattgcaat

SEQ ID NO: 715464 - DNA, 25 bp, Artificial sequence
  Synthetic oligonucleotide
ggtgaatatatgttgttgggtacaa

SEQ ID NO: 715465 - DNA, 25 bp, Artificial sequence
  Synthetic oligonucleotide
ggtgaatatatgatgttgggtacaa

SEQ ID NO: 715466 - DNA, 25 bp, Artificial sequence
  Synthetic oligonucleotide
tcgtgaacccccaccgtattgcaat

SEQ ID NO: 715467 - DNA, 25 bp, Artificial sequence
  Synthetic oligonucleotide
catgtaggtggcgatcatatttgca

SEQ ID NO: 715468 - DNA, 25 bp, Artificial sequence
  Synthetic oligonucleotide
gtatcacgtccaacaacttattgtt

SEQ ID NO: 715469 - DNA, 25 bp, Artificial sequence
  Synthetic oligonucleotide
gtatcacgtccatcaacttattgtt

SEQ ID NO: 715470 - DNA, 25 bp, Artificial sequence
  Synthetic oligonucleotide
tgttggtcagcaattccaaacacca

SEQ ID NO: 715471 - DNA, 25 bp, Artificial sequence
  Synthetic oligonucleotide
tgttggtcagcatttccaaacacca

SEQ ID NO: 715472 - DNA, 25 bp, Artificial sequence
  Synthetic oligonucleotide
ttaaactttgtttaccactcgaaca

SEQ ID NO: 715473 - DNA, 25 bp, Artificial sequence
  Synthetic oligonucleotide
gtttatccacaccatacacatttcg

SEQ ID NO: 715474 - DNA, 25 bp, Artificial sequence
  Synthetic oligonucleotide
caatcatatatgttgtcttacaaga

SEQ ID NO: 715475 - DNA, 25 bp, Artificial sequence
  Synthetic oligonucleotide
tatgaaacagttccatttgatccac

SEQ ID NO: 715476 - DNA, 25 bp, Artificial sequence
  Synthetic oligonucleotide
tcttccaattaacagagatgtttcg

SEQ ID NO: 715477 - DNA, 25 bp, Artificial sequence
  Synthetic oligonucleotide
tcttccaattaagagagatgtttcg

SEQ ID NO: 715478 - DNA, 25 bp, Artificial sequence
  Synthetic oligonucleotide
gttccagtcatcatccattttttcg

SEQ ID NO: 715479 - DNA, 25 bp, Artificial sequence
  Synthetic oligonucleotide
gttccagtcatcttccattttttcg

SEQ ID NO: 715480 - DNA, 25 bp, Artificial sequence
  Synthetic oligonucleotide
aaatcagttatgacaatggtccatg

SEQ ID NO: 715481 - DNA, 25 bp, Artificial sequence
  Synthetic oligonucleotide
aaatcagttatgtcaatggtccatg

SEQ ID NO: 715482 - DNA, 25 bp, Artificial sequence
  Synthetic oligonucleotide
tttgtcctaagcgtcgacgtgttgg

SEQ ID NO: 715483 - DNA, 25 bp, Artificial sequence
  Synthetic oligonucleotide
gaatgatctactttttcttcctcac

SEQ ID NO: 715484 - DNA, 25 bp, Artificial sequence
  Synthetic oligonucleotide
gtttatccacacgatacacatttcg

SEQ ID NO: 715485 - DNA, 25 bp, Artificial sequence
  Synthetic oligonucleotide
gaagctgtaaaaatttcttgggaag

SEQ ID NO: 715486 - DNA, 25 bp, Artificial sequence
  Synthetic oligonucleotide
gagagggaagagcaaggaggaagat

SEQ ID NO: 715487 - DNA, 25 bp, Artificial sequence
  Synthetic oligonucleotide
gagagggaagaggaaggaggaagat

SEQ ID NO: 715488 - DNA, 25 bp, Artificial sequence
  Synthetic oligonucleotide
ggtcaccgtttaactgttttattca

SEQ ID NO: 715489 - DNA, 25 bp, Artificial sequence
  Synthetic oligonucleotide
ggtcaccgtttatctgttttattca

SEQ ID NO: 715490 - DNA, 25 bp, Artificial sequence
  Synthetic oligonucleotide
taaagatgcagtatttaaaagaaga

SEQ ID NO: 715491 - DNA, 25 bp, Artificial sequence
  Synthetic oligonucleotide
taaagatgcagtttttaaaagaaga

SEQ ID NO: 715492 - DNA, 25 bp, Artificial sequence
  Synthetic oligonucleotide
tattcgtttggtctttttctgggtc

SEQ ID NO: 715493 - DNA, 25 bp, Artificial sequence
  Synthetic oligonucleotide
tattcgtttggtgtttttctgggtc

SEQ ID NO: 715494 - DNA, 25 bp, Artificial sequence
  Synthetic oligonucleotide
actgtttcatatataactaagaggg

SEQ ID NO: 715495 - DNA, 25 bp, Artificial sequence
  Synthetic oligonucleotide
ttaaactttgttaaccactcgaaca

SEQ ID NO: 715496 - DNA, 25 bp, Artificial sequence
  Synthetic oligonucleotide
gaagctgtaaaattttcttgggaag

SEQ ID NO: 715497 - DNA, 25 bp, Artificial sequence
  Synthetic oligonucleotide
tatgtttttgttattcatcttctcc

SEQ ID NO: 715498 - DNA, 25 bp, Artificial sequence
  Synthetic oligonucleotide
ctggtttctatcttctcgttgtaat

SEQ ID NO: 715499 - DNA, 25 bp, Artificial sequence
  Synthetic oligonucleotide
ctggtttctatcatctcgttgtaat

SEQ ID NO: 715500 - DNA, 25 bp, Artificial sequence
  Synthetic oligonucleotide
caacttggatttttcttctttcaga

SEQ ID NO: 715501 - DNA, 25 bp, Artificial sequence
  Synthetic oligonucleotide
caacttggatttatcttctttcaga

SEQ ID NO: 715502 - DNA, 25 bp, Artificial sequence
  Synthetic oligonucleotide
tagtaatgtttatttttcttggtga

SEQ ID NO: 715503 - DNA, 25 bp, Artificial sequence
  Synthetic oligonucleotide
tagtaatgtttaattttcttggtga

SEQ ID NO: 715504 - DNA, 25 bp, Artificial sequence
  Synthetic oligonucleotide
tctctcacctttgtatatcaatgct

SEQ ID NO: 715505 - DNA, 25 bp, Artificial sequence
  Synthetic oligonucleotide
tctctcacctttctatatcaatgct

SEQ ID NO: 715506 - DNA, 25 bp, Artificial sequence
  Synthetic oligonucleotide
caatcatatatgatgtcttacaaga

SEQ ID NO: 715507 - DNA, 25 bp, Artificial sequence
  Synthetic oligonucleotide
actgtttcatatttaactaagaggg

SEQ ID NO: 715508 - DNA, 25 bp, Artificial sequence
  Synthetic oligonucleotide
tagtatacaattatataggtgcaat

SEQ ID NO: 715509 - DNA, 25 bp, Artificial sequence
  Synthetic oligonucleotide
taaaccctagattcccatgtgaatg

SEQ ID NO: 715510 - DNA, 25 bp, Artificial sequence
  Synthetic oligonucleotide
taaaccctagatacccatgtgaatg

SEQ ID NO: 715511 - DNA, 25 bp, Artificial sequence
  Synthetic oligonucleotide
cctatagtaagtaatataaggaatg

SEQ ID NO: 715512 - DNA, 25 bp, Artificial sequence
  Synthetic oligonucleotide
cctatagtaagttatataaggaatg

SEQ ID NO: 715513 - DNA, 25 bp, Artificial sequence
  Synthetic oligonucleotide
tatatatgtatatttgtttggtacg

SEQ ID NO: 715514 - DNA, 25 bp, Artificial sequence
  Synthetic oligonucleotide
tatatatgtataattgtttggtacg

SEQ ID NO: 715515 - DNA, 25 bp, Artificial sequence
  Synthetic oligonucleotide
tcatggctccaatcaatattatagg

SEQ ID NO: 715516 - DNA, 25 bp, Artificial sequence
  Synthetic oligonucleotide
tcatggctccaaacaatattatagg

SEQ ID NO: 715517 - DNA, 25 bp, Artificial sequence
  Synthetic oligonucleotide
ttgtcaaacttattctttttaattc

SEQ ID NO: 715518 - DNA, 25 bp, Artificial sequence
  Synthetic oligonucleotide
cattagtaatgttgaccaatagaat

SEQ ID NO: 715519 - DNA, 25 bp, Artificial sequence
  Synthetic oligonucleotide
tagtatacaattttataggtgcaat

SEQ ID NO: 715520 - DNA, 25 bp, Artificial sequence
  Synthetic oligonucleotide
aagacaaataaataaaaatagaatc

SEQ ID NO: 715521 - DNA, 25 bp, Artificial sequence
  Synthetic oligonucleotide
ttaccaaacaaatacaataattatg

SEQ ID NO: 715522 - DNA, 25 bp, Artificial sequence
  Synthetic oligonucleotide
ttaccaaacaaaaacaataattatg

SEQ ID NO: 715523 - DNA, 25 bp, Artificial sequence
  Synthetic oligonucleotide
ggaatgatatcttatgttagaggaa

SEQ ID NO: 715524 - DNA, 25 bp, Artificial sequence
  Synthetic oligonucleotide
ggaatgatatctaatgttagaggaa

SEQ ID NO: 715525 - DNA, 25 bp, Artificial sequence
  Synthetic oligonucleotide
caccaaaaaaagagaaaacaagaga

SEQ ID NO: 715526 - DNA, 25 bp, Artificial sequence
  Synthetic oligonucleotide
caccaaaaaaagtgaaaacaagaga

SEQ ID NO: 715527 - DNA, 25 bp, Artificial sequence
  Synthetic oligonucleotide
tctgatgttaaaaactaaaaagaga

SEQ ID NO: 715528 - DNA, 25 bp, Artificial sequence
  Synthetic oligonucleotide
tctgatgttaaatactaaaaagaga

SEQ ID NO: 715529 - DNA, 25 bp, Artificial sequence
  Synthetic oligonucleotide
cattagtaatgtagaccaatagaat

SEQ ID NO: 715530 - DNA, 25 bp, Artificial sequence
  Synthetic oligonucleotide
ttgtcaaacttaatctttttaattc

SEQ ID NO: 715531 - DNA, 25 bp, Artificial sequence
  Synthetic oligonucleotide
caactatgatagaataactatttgc

SEQ ID NO: 715532 - DNA, 25 bp, Artificial sequence
  Synthetic oligonucleotide
caagttcacaatatttattgataaa

SEQ ID NO: 715533 - DNA, 25 bp, Artificial sequence
  Synthetic oligonucleotide
gaatttggctaataaatcaaagagg

SEQ ID NO: 715534 - DNA, 25 bp, Artificial sequence
  Synthetic oligonucleotide
tacacagttagatcaaatcttgttt

SEQ ID NO: 715535 - DNA, 25 bp, Artificial sequence
  Synthetic oligonucleotide
tttgtcctaagcctcgacgtgttgg

SEQ ID NO: 715536 - DNA, 25 bp, Artificial sequence
  Synthetic oligonucleotide
gcgaaaatctctaatctttaaaatt

SEQ ID NO: 715537 - DNA, 25 bp, Artificial sequence
  Synthetic oligonucleotide
gcgaaaatctcttatctttaaaatt

SEQ ID NO: 715538 - DNA, 25 bp, Artificial sequence
  Synthetic oligonucleotide
taagcgagttaggattcactggaaa

SEQ ID NO: 715539 - DNA, 25 bp, Artificial sequence
  Synthetic oligonucleotide
taagcgagttagcattcactggaaa

SEQ ID NO: 715540 - DNA, 25 bp, Artificial sequence
  Synthetic oligonucleotide
aattaaaaacaaagatgccattccg

SEQ ID NO: 715541 - DNA, 25 bp, Artificial sequence
  Synthetic oligonucleotide
aggatctactagtaaaaaataatag

SEQ ID NO: 715542 - DNA, 25 bp, Artificial sequence
  Synthetic oligonucleotide
caactatgatagtataactatttgc

SEQ ID NO: 715543 - DNA, 25 bp, Artificial sequence
  Synthetic oligonucleotide
aggatctactagaaaaaaataatag

SEQ ID NO: 715544 - DNA, 25 bp, Artificial sequence
  Synthetic oligonucleotide
gacacgtttctaaggaagccagcaa

SEQ ID NO: 715545 - DNA, 25 bp, Artificial sequence
  Synthetic oligonucleotide
gacacgtttctatggaagccagcaa

SEQ ID NO: 715546 - DNA, 25 bp, Artificial sequence
  Synthetic oligonucleotide
tgaataaagaaaacatcggagccgg

SEQ ID NO: 715547 - DNA, 25 bp, Artificial sequence
  Synthetic oligonucleotide
tgaataaagaaatcatcggagccgg

SEQ ID NO: 715548 - DNA, 25 bp, Artificial sequence
  Synthetic oligonucleotide
tctggtcaaaatgtcaaacttcact

SEQ ID NO: 715549 - DNA, 25 bp, Artificial sequence
  Synthetic oligonucleotide
tctggtcaaaatctcaaacttcact

SEQ ID NO: 715550 - DNA, 25 bp, Artificial sequence
  Synthetic oligonucleotide
gccacacaagcatgcgtttttaata

SEQ ID NO: 715551 - DNA, 25 bp, Artificial sequence
  Synthetic oligonucleotide
gccacacaagcaagcgtttttaata

SEQ ID NO: 715552 - DNA, 25 bp, Artificial sequence
  Synthetic oligonucleotide
aagacaaataaaaaaaaatagaatc

SEQ ID NO: 715553 - DNA, 25 bp, Artificial sequence
  Synthetic oligonucleotide
tacacagttagaacaaatcttgttt

SEQ ID NO: 715554 - DNA, 25 bp, Artificial sequence
  Synthetic oligonucleotide
aattaaaaacaatgatgccattccg

SEQ ID NO: 715555 - DNA, 25 bp, Artificial sequence
  Synthetic oligonucleotide
gagaatttctcagatcttataaagt

SEQ ID NO: 715556 - DNA, 25 bp, Artificial sequence
  Synthetic oligonucleotide
cgtatgaattttcaattttctcgga

SEQ ID NO: 715557 - DNA, 25 bp, Artificial sequence
  Synthetic oligonucleotide
cgtatgaattttgaattttctcgga

SEQ ID NO: 715558 - DNA, 25 bp, Artificial sequence
  Synthetic oligonucleotide
ggcttagccatagggtcaaacttca

SEQ ID NO: 715559 - DNA, 25 bp, Artificial sequence
  Synthetic oligonucleotide
ggcttagccatacggtcaaacttca

SEQ ID NO: 715560 - DNA, 25 bp, Artificial sequence
  Synthetic oligonucleotide
tttcaaaaatcctttttatagccga

SEQ ID NO: 715561 - DNA, 25 bp, Artificial sequence
  Synthetic oligonucleotide
tttcaaaaatccattttatagccga

SEQ ID NO: 715562 - DNA, 25 bp, Artificial sequence
  Synthetic oligonucleotide
gaatgatctactatttcttcctcac

SEQ ID NO: 715563 - DNA, 25 bp, Artificial sequence
  Synthetic oligonucleotide
gaatttggctaaaaaatcaaagagg

SEQ ID NO: 715564 - DNA, 25 bp, Artificial sequence
  Synthetic oligonucleotide
tcaaaacttctctgtgttgttctat

SEQ ID NO: 715565 - DNA, 25 bp, Artificial sequence
  Synthetic oligonucleotide
gaattcagatcccttgttttcttcg

SEQ ID NO: 715566 - DNA, 25 bp, Artificial sequence
  Synthetic oligonucleotide
gaatcattgcaagcttcagcagaac

SEQ ID NO: 715567 - DNA, 25 bp, Artificial sequence
  Synthetic oligonucleotide
gagaatttctcacatcttataaagt

SEQ ID NO: 715568 - DNA, 25 bp, Artificial sequence
  Synthetic oligonucleotide
tgctctgtgatggatctgatctgat

SEQ ID NO: 715569 - DNA, 25 bp, Artificial sequence
  Synthetic oligonucleotide
tgctctgtgatgcatctgatctgat

SEQ ID NO: 715570 - DNA, 25 bp, Artificial sequence
  Synthetic oligonucleotide
tcaggcgttcttctgtggatcagag

SEQ ID NO: 715571 - DNA, 25 bp, Artificial sequence
  Synthetic oligonucleotide
tcaggcgttcttgtgtggatcagag

SEQ ID NO: 715572 - DNA, 25 bp, Artificial sequence
  Synthetic oligonucleotide
gaatcattgcaaccttcagcagaac

SEQ ID NO: 715573 - DNA, 25 bp, Artificial sequence
  Synthetic oligonucleotide
aggagatgatggcatttgaccgtaa

SEQ ID NO: 715574 - DNA, 25 bp, Artificial sequence
  Synthetic oligonucleotide
tacttataaaaattagaaatgcatg

SEQ ID NO: 715575 - DNA, 25 bp, Artificial sequence
  Synthetic oligonucleotide
caagttcacaatttttattgataaa

SEQ ID NO: 715576 - DNA, 25 bp, Artificial sequence
  Synthetic oligonucleotide
gaattcagatccgttgttttcttcg

SEQ ID NO: 715577 - DNA, 25 bp, Artificial sequence
  Synthetic oligonucleotide
ggtctcatccttatataaaatcccc

SEQ ID NO: 715578 - DNA, 25 bp, Artificial sequence
  Synthetic oligonucleotide
aggagatgatgggatttgaccgtaa

SEQ ID NO: 715579 - DNA, 25 bp, Artificial sequence
  Synthetic oligonucleotide
caaatatcactaatacgacgccgag

SEQ ID NO: 715580 - DNA, 25 bp, Artificial sequence
  Synthetic oligonucleotide
caactttccagtatgatatactatt

SEQ ID NO: 715581 - DNA, 25 bp, Artificial sequence
  Synthetic oligonucleotide
caactttccagtttgatatactatt

SEQ ID NO: 715582 - DNA, 25 bp, Artificial sequence
  Synthetic oligonucleotide
gcaaaaattccctattccacgaaac

SEQ ID NO: 715583 - DNA, 25 bp, Artificial sequence
  Synthetic oligonucleotide
gcaaaaattcccaattccacgaaac

SEQ ID NO: 715584 - DNA, 25 bp, Artificial sequence
  Synthetic oligonucleotide
tcaaaacttctcagtgttgttctat

SEQ ID NO: 715585 - DNA, 25 bp, Artificial sequence
  Synthetic oligonucleotide
ttcatgttgtcttcaacctcaccca

SEQ ID NO: 715586 - DNA, 25 bp, Artificial sequence
  Synthetic oligonucleotide
caaatatcactattacgacgccgag

SEQ ID NO: 715587 - DNA, 25 bp, Artificial sequence
  Synthetic oligonucleotide
ggtctcatccttttataaaatcccc

SEQ ID NO: 715588 - DNA, 25 bp, Artificial sequence
  Synthetic oligonucleotide
ccggagattttttctcaggtacatc

SEQ ID NO: 715589 - DNA, 25 bp, Artificial sequence
  Synthetic oligonucleotide
tctcatagatgttagatctgtgctt

SEQ ID NO: 715590 - DNA, 25 bp, Artificial sequence
  Synthetic oligonucleotide
tacttataaaaaatagaaatgcatg

SEQ ID NO: 715591 - DNA, 25 bp, Artificial sequence
  Synthetic oligonucleotide
gtttcttaagttcctttcatggcgg

SEQ ID NO: 715592 - DNA, 25 bp, Artificial sequence
  Synthetic oligonucleotide
gtttcttaagttgctttcatggcgg

SEQ ID NO: 715593 - DNA, 25 bp, Artificial sequence
  Synthetic oligonucleotide
gaagttactttagcttttgttcatc

SEQ ID NO: 715594 - DNA, 25 bp, Artificial sequence
  Synthetic oligonucleotide
gaagttactttaccttttgttcatc

SEQ ID NO: 715595 - DNA, 25 bp, Artificial sequence
  Synthetic oligonucleotide
tctcatagatgtaagatctgtgctt

SEQ ID NO: 715596 - DNA, 25 bp, Artificial sequence
  Synthetic oligonucleotide
ccggagatttttactcaggtacatc

SEQ ID NO: 715597 - DNA, 25 bp, Artificial sequence
  Synthetic oligonucleotide
catcgttttttgtgtcttggttgaa

SEQ ID NO: 715598 - DNA, 25 bp, Artificial sequence
  Synthetic oligonucleotide
ttcatgttgtctacaacctcaccca

SEQ ID NO: 715599 - DNA, 25 bp, Artificial sequence
  Synthetic oligonucleotide
catcgttttttgagtcttggttgaa

SEQ ID NO: 715600 - DNA, 25 bp, Artificial sequence
  Synthetic oligonucleotide
taaactagtgccaaggaagaaatgg

SEQ ID NO: 715601 - DNA, 25 bp, Artificial sequence
  Synthetic oligonucleotide
caagttcacaccagaaataaagttg

SEQ ID NO: 715602 - DNA, 25 bp, Artificial sequence
  Synthetic oligonucleotide
caagttcacacctgaaataaagttg

SEQ ID NO: 715603 - DNA, 25 bp, Artificial sequence
  Synthetic oligonucleotide
tcttcaaggataaacaaactcgaat

SEQ ID NO: 715604 - DNA, 25 bp, Artificial sequence
  Synthetic oligonucleotide
taagaaaaggtggacccaagagact

SEQ ID NO: 715605 - DNA, 25 bp, Artificial sequence
  Synthetic oligonucleotide
tgaaaacattatgtcgggacctgag

SEQ ID NO: 715606 - DNA, 25 bp, Artificial sequence
  Synthetic oligonucleotide
gtaatgagtgatcttgacattctga

SEQ ID NO: 715607 - DNA, 25 bp, Artificial sequence
  Synthetic oligonucleotide
tgaaaacattatctcgggacctgag

SEQ ID NO: 715608 - DNA, 25 bp, Artificial sequence
  Synthetic oligonucleotide
taaactagtgcctaggaagaaatgg

SEQ ID NO: 715609 - DNA, 25 bp, Artificial sequence
  Synthetic oligonucleotide
ccagaataaggatagcgaagaagcg

SEQ ID NO: 715610 - DNA, 25 bp, Artificial sequence
  Synthetic oligonucleotide
ccagaataaggaaagcgaagaagcg

SEQ ID NO: 715611 - DNA, 25 bp, Artificial sequence
  Synthetic oligonucleotide
cacgctagttcaacgatttcgatag

SEQ ID NO: 715612 - DNA, 25 bp, Artificial sequence
  Synthetic oligonucleotide
cacgctagttcatcgatttcgatag

SEQ ID NO: 715613 - DNA, 25 bp, Artificial sequence
  Synthetic oligonucleotide
gagtccattcatactttcaaacgat

SEQ ID NO: 715614 - DNA, 25 bp, Artificial sequence
  Synthetic oligonucleotide
gagtccattcattctttcaaacgat

SEQ ID NO: 715615 - DNA, 25 bp, Artificial sequence
  Synthetic oligonucleotide
tcaaatccatttctttaaactaatc

SEQ ID NO: 715616 - DNA, 25 bp, Artificial sequence
  Synthetic oligonucleotide
gaatgatctttgaaggtttaaagca

SEQ ID NO: 715617 - DNA, 25 bp, Artificial sequence
  Synthetic oligonucleotide
cacgcccgaacgaggcatctgataa

SEQ ID NO: 715618 - DNA, 25 bp, Artificial sequence
  Synthetic oligonucleotide
gaatgatctttgtaggtttaaagca

SEQ ID NO: 715619 - DNA, 25 bp, Artificial sequence
  Synthetic oligonucleotide
gaacaccaaacaccctccaaaaata

SEQ ID NO: 715620 - DNA, 25 bp, Artificial sequence
  Synthetic oligonucleotide
tcaaatccatttgtttaaactaatc

SEQ ID NO: 715621 - DNA, 25 bp, Artificial sequence
  Synthetic oligonucleotide
cacgcccgaacgtggcatctgataa

SEQ ID NO: 715622 - DNA, 25 bp, Artificial sequence
  Synthetic oligonucleotide
caagaaagcggaagaaaccgtcttg

SEQ ID NO: 715623 - DNA, 25 bp, Artificial sequence
  Synthetic oligonucleotide
gaaagctagacatcaagctaaggat

SEQ ID NO: 715624 - DNA, 25 bp, Artificial sequence
  Synthetic oligonucleotide
gcttaattggtcgattatacctatt

SEQ ID NO: 715625 - DNA, 25 bp, Artificial sequence
  Synthetic oligonucleotide
gaacaccaaacagcctccaaaaata

SEQ ID NO: 715626 - DNA, 25 bp, Artificial sequence
  Synthetic oligonucleotide
gaaagctagacaacaagctaaggat

SEQ ID NO: 715627 - DNA, 25 bp, Artificial sequence
  Synthetic oligonucleotide
caaattgatggagatgatagtgatg

SEQ ID NO: 715628 - DNA, 25 bp, Artificial sequence
  Synthetic oligonucleotide
caaattgatggacatgatagtgatg

SEQ ID NO: 715629 - DNA, 25 bp, Artificial sequence
  Synthetic oligonucleotide
ggtcaggaagtgttgaggaaaaaac

SEQ ID NO: 715630 - DNA, 25 bp, Artificial sequence
  Synthetic oligonucleotide
ggtcaggaagtgatgaggaaaaaac

SEQ ID NO: 715631 - DNA, 25 bp, Artificial sequence
  Synthetic oligonucleotide
gttgtttgagttagaggagaaacca

SEQ ID NO: 715632 - DNA, 25 bp, Artificial sequence
  Synthetic oligonucleotide
cgatgaaggtgaagatgacgacgat

SEQ ID NO: 715633 - DNA, 25 bp, Artificial sequence
  Synthetic oligonucleotide
gtaatgagtgatgttgacattctga

SEQ ID NO: 715634 - DNA, 25 bp, Artificial sequence
  Synthetic oligonucleotide
gttgtttgagtttgaggagaaacca

SEQ ID NO: 715635 - DNA, 25 bp, Artificial sequence
  Synthetic oligonucleotide
caatctcagagtagttgaaatctga

SEQ ID NO: 715636 - DNA, 25 bp, Artificial sequence
  Synthetic oligonucleotide
caatctcagagttgttgaaatctga

SEQ ID NO: 715637 - DNA, 25 bp, Artificial sequence
  Synthetic oligonucleotide
cctgaggagcttacacccggtaaaa

SEQ ID NO: 715638 - DNA, 25 bp, Artificial sequence
  Synthetic oligonucleotide
cctgaggagctttcacccggtaaaa

SEQ ID NO: 715639 - DNA, 25 bp, Artificial sequence
  Synthetic oligonucleotide
agcttgctgttgagaacgcgttgaa

SEQ ID NO: 715640 - DNA, 25 bp, Artificial sequence
  Synthetic oligonucleotide
agcttgctgttgtgaacgcgttgaa

SEQ ID NO: 715641 - DNA, 25 bp, Artificial sequence
  Synthetic oligonucleotide
aaagggcctgatcggcgctacacaa

SEQ ID NO: 715642 - DNA, 25 bp, Artificial sequence
  Synthetic oligonucleotide
aaagggcctgatgggcgctacacaa

SEQ ID NO: 715643 - DNA, 25 bp, Artificial sequence
  Synthetic oligonucleotide
cgatgaaggtgatgatgacgacgat

SEQ ID NO: 715644 - DNA, 25 bp, Artificial sequence
  Synthetic oligonucleotide
aacaagcggcgtcgacgttgtcgtc

SEQ ID NO: 715645 - DNA, 25 bp, Artificial sequence
  Synthetic oligonucleotide
tcttggacaaaaagtattgttcgaa

SEQ ID NO: 715646 - DNA, 25 bp, Artificial sequence
  Synthetic oligonucleotide
tcttggacaaaatgtattgttcgaa

SEQ ID NO: 715647 - DNA, 25 bp, Artificial sequence
  Synthetic oligonucleotide
catcaaatagataccggtgttgtct

SEQ ID NO: 715648 - DNA, 25 bp, Artificial sequence
  Synthetic oligonucleotide
catcaaatagattccggtgttgtct

SEQ ID NO: 715649 - DNA, 25 bp, Artificial sequence
  Synthetic oligonucleotide
tacaaagttcctacattaccttttg

SEQ ID NO: 715650 - DNA, 25 bp, Artificial sequence
  Synthetic oligonucleotide
tacaaagttccttcattaccttttg

SEQ ID NO: 715651 - DNA, 25 bp, Artificial sequence
  Synthetic oligonucleotide
aaagtatacaaattacaaaatggag

SEQ ID NO: 715652 - DNA, 25 bp, Artificial sequence
  Synthetic oligonucleotide
aaagtatacaaaatacaaaatggag

SEQ ID NO: 715653 - DNA, 25 bp, Artificial sequence
  Synthetic oligonucleotide
catgtcctatagtaattagacaaac

SEQ ID NO: 715654 - DNA, 25 bp, Artificial sequence
  Synthetic oligonucleotide
taatcttttggtaggttggctcaca

SEQ ID NO: 715655 - DNA, 25 bp, Artificial sequence
  Synthetic oligonucleotide
gcttaattggtccattatacctatt

SEQ ID NO: 715656 - DNA, 25 bp, Artificial sequence
  Synthetic oligonucleotide
aacaagcggcgtggacgttgtcgtc

SEQ ID NO: 715657 - DNA, 25 bp, Artificial sequence
  Synthetic oligonucleotide
cgtaattttcctcgggagcgtttgc

SEQ ID NO: 715658 - DNA, 25 bp, Artificial sequence
  Synthetic oligonucleotide
cgtaattttcctggggagcgtttgc

SEQ ID NO: 715659 - DNA, 25 bp, Artificial sequence
  Synthetic oligonucleotide
aaacgattgagtcggattacggatg

SEQ ID NO: 715660 - DNA, 25 bp, Artificial sequence
  Synthetic oligonucleotide
aaacgattgagtgggattacggatg

SEQ ID NO: 715661 - DNA, 25 bp, Artificial sequence
  Synthetic oligonucleotide
cacgtttatcgtacatgccaggagc

SEQ ID NO: 715662 - DNA, 25 bp, Artificial sequence
  Synthetic oligonucleotide
cacgtttatcgttcatgccaggagc

SEQ ID NO: 715663 - DNA, 25 bp, Artificial sequence
  Synthetic oligonucleotide
caagaaagcggatgaaaccgtcttg

SEQ ID NO: 715664 - DNA, 25 bp, Artificial sequence
  Synthetic oligonucleotide
taagaaaaggtgcacccaagagact

SEQ ID NO: 715665 - DNA, 25 bp, Artificial sequence
  Synthetic oligonucleotide
taatcttttggttggttggctcaca

SEQ ID NO: 715666 - DNA, 25 bp, Artificial sequence
  Synthetic oligonucleotide
tgtgacactctcatgccctttgaag

SEQ ID NO: 715667 - DNA, 25 bp, Artificial sequence
  Synthetic oligonucleotide
tatttcatcgtaaatttgtaatgcg

SEQ ID NO: 715668 - DNA, 25 bp, Artificial sequence
  Synthetic oligonucleotide
aaacagctttccattaccgtgattc

SEQ ID NO: 715669 - DNA, 25 bp, Artificial sequence
  Synthetic oligonucleotide
aaacagctttcctttaccgtgattc

SEQ ID NO: 715670 - DNA, 25 bp, Artificial sequence
  Synthetic oligonucleotide
gattccttcttcaaaagaaagaagc

SEQ ID NO: 715671 - DNA, 25 bp, Artificial sequence
  Synthetic oligonucleotide
gattccttcttctaaagaaagaagc

SEQ ID NO: 715672 - DNA, 25 bp, Artificial sequence
  Synthetic oligonucleotide
gctaaagatgctatggtccctcttg

SEQ ID NO: 715673 - DNA, 25 bp, Artificial sequence
  Synthetic oligonucleotide
gctaaagatgctttggtccctcttg

SEQ ID NO: 715674 - DNA, 25 bp, Artificial sequence
  Synthetic oligonucleotide
gggaagaagaattcagctttttgca

SEQ ID NO: 715675 - DNA, 25 bp, Artificial sequence
  Synthetic oligonucleotide
gggaagaagaatacagctttttgca

SEQ ID NO: 715676 - DNA, 25 bp, Artificial sequence
  Synthetic oligonucleotide
gattctacatagcttatggttattg

SEQ ID NO: 715677 - DNA, 25 bp, Artificial sequence
  Synthetic oligonucleotide
ttcctttggtgtaaaaaagattgga

SEQ ID NO: 715678 - DNA, 25 bp, Artificial sequence
  Synthetic oligonucleotide
gattctacataggttatggttattg

SEQ ID NO: 715679 - DNA, 25 bp, Artificial sequence
  Synthetic oligonucleotide
tgtgacactctcttgccctttgaag

SEQ ID NO: 715680 - DNA, 25 bp, Artificial sequence
  Synthetic oligonucleotide
aatagtaaaaatcaagcaatttgcc

SEQ ID NO: 715681 - DNA, 25 bp, Artificial sequence
  Synthetic oligonucleotide
aatagtaaaaatgaagcaatttgcc

SEQ ID NO: 715682 - DNA, 25 bp, Artificial sequence
  Synthetic oligonucleotide
cacatgattctgatttttgggtctc

SEQ ID NO: 715683 - DNA, 25 bp, Artificial sequence
  Synthetic oligonucleotide
cacatgattctgttttttgggtctc

SEQ ID NO: 715684 - DNA, 25 bp, Artificial sequence
  Synthetic oligonucleotide
ttttattaatgtatgattattgtca

SEQ ID NO: 715685 - DNA, 25 bp, Artificial sequence
  Synthetic oligonucleotide
ttttattaatgtttgattattgtca

SEQ ID NO: 715686 - DNA, 25 bp, Artificial sequence
  Synthetic oligonucleotide
catgtcctatagaaattagacaaac

SEQ ID NO: 715687 - DNA, 25 bp, Artificial sequence
  Synthetic oligonucleotide
tatttcatcgtatatttgtaatgcg

SEQ ID NO: 715688 - DNA, 25 bp, Artificial sequence
  Synthetic oligonucleotide
ttcctttggtgttaaaaagattgga

SEQ ID NO: 715689 - DNA, 25 bp, Artificial sequence
  Synthetic oligonucleotide
caatttgatttagttgatgtgtacc

SEQ ID NO: 715690 - DNA, 25 bp, Artificial sequence
  Synthetic oligonucleotide
gatgaattatttttagaacacgaga

SEQ ID NO: 715691 - DNA, 25 bp, Artificial sequence
  Synthetic oligonucleotide
gatctattcccatttgactttcttg

SEQ ID NO: 715692 - DNA, 25 bp, Artificial sequence
  Synthetic oligonucleotide
aatcatgctttgtatttgcttgaca

SEQ ID NO: 715693 - DNA, 25 bp, Artificial sequence
  Synthetic oligonucleotide
aatcatgctttgaatttgcttgaca

SEQ ID NO: 715694 - DNA, 25 bp, Artificial sequence
  Synthetic oligonucleotide
cactttttagatttatgtgatcaca

SEQ ID NO: 715695 - DNA, 25 bp, Artificial sequence
  Synthetic oligonucleotide
cactttttagatatatgtgatcaca

SEQ ID NO: 715696 - DNA, 25 bp, Artificial sequence
  Synthetic oligonucleotide
aagtccagaattagtatccgttata

SEQ ID NO: 715697 - DNA, 25 bp, Artificial sequence
  Synthetic oligonucleotide
aagtccagaatttgtatccgttata

SEQ ID NO: 715698 - DNA, 25 bp, Artificial sequence
  Synthetic oligonucleotide
tatgttaaaattcatactttgtttc

SEQ ID NO: 715699 - DNA, 25 bp, Artificial sequence
  Synthetic oligonucleotide
gggtcatccggccagaaaagtttat

SEQ ID NO: 715700 - DNA, 25 bp, Artificial sequence
  Synthetic oligonucleotide
caatttgatttacttgatgtgtacc

SEQ ID NO: 715701 - DNA, 25 bp, Artificial sequence
  Synthetic oligonucleotide
gggtcatccggcgagaaaagtttat

SEQ ID NO: 715702 - DNA, 25 bp, Artificial sequence
  Synthetic oligonucleotide
tgttttgtaataaacttgtgcaagc

SEQ ID NO: 715703 - DNA, 25 bp, Artificial sequence
  Synthetic oligonucleotide
tgttttgtaatatacttgtgcaagc

SEQ ID NO: 715704 - DNA, 25 bp, Artificial sequence
  Synthetic oligonucleotide
catgaaagatatacttatgattgag

SEQ ID NO: 715705 - DNA, 25 bp, Artificial sequence
  Synthetic oligonucleotide
catgaaagatattcttatgattgag

SEQ ID NO: 715706 - DNA, 25 bp, Artificial sequence
  Synthetic oligonucleotide
gctgcatcgtaaaaccctaaatctt

SEQ ID NO: 715707 - DNA, 25 bp, Artificial sequence
  Synthetic oligonucleotide
gctgcatcgtaataccctaaatctt

SEQ ID NO: 715708 - DNA, 25 bp, Artificial sequence
  Synthetic oligonucleotide
tccaatccattgtataacgagtaag

SEQ ID NO: 715709 - DNA, 25 bp, Artificial sequence
  Synthetic oligonucleotide
tccaatccattgaataacgagtaag

SEQ ID NO: 715710 - DNA, 25 bp, Artificial sequence
  Synthetic oligonucleotide
gatgaattatttatagaacacgaga

SEQ ID NO: 715711 - DNA, 25 bp, Artificial sequence
  Synthetic oligonucleotide
tatgttaaaattgatactttgtttc

SEQ ID NO: 715712 - DNA, 25 bp, Artificial sequence
  Synthetic oligonucleotide
aaaaaactacatcgatcatcgataa

SEQ ID NO: 715713 - DNA, 25 bp, Artificial sequence
  Synthetic oligonucleotide
tagtaacaggcccacataataaccc

SEQ ID NO: 715714 - DNA, 25 bp, Artificial sequence
  Synthetic oligonucleotide
tggtcaggaagtcaagacgaaagca

SEQ ID NO: 715715 - DNA, 25 bp, Artificial sequence
  Synthetic oligonucleotide
tagtaacaggccgacataataaccc

SEQ ID NO: 715716 - DNA, 25 bp, Artificial sequence
  Synthetic oligonucleotide
gattaaaaatagaaacacactgacc

SEQ ID NO: 715717 - DNA, 25 bp, Artificial sequence
  Synthetic oligonucleotide
gattaaaaatagtaacacactgacc

SEQ ID NO: 715718 - DNA, 25 bp, Artificial sequence
  Synthetic oligonucleotide
caagaaagatattaaaaaaactcat

SEQ ID NO: 715719 - DNA, 25 bp, Artificial sequence
  Synthetic oligonucleotide
caagaaagatataaaaaaaactcat

SEQ ID NO: 715720 - DNA, 25 bp, Artificial sequence
  Synthetic oligonucleotide
gtctctataaaagatccaactctca

SEQ ID NO: 715721 - DNA, 25 bp, Artificial sequence
  Synthetic oligonucleotide
gtctctataaaacatccaactctca

SEQ ID NO: 715722 - DNA, 25 bp, Artificial sequence
  Synthetic oligonucleotide
gatctattcccaattgactttcttg

SEQ ID NO: 715723 - DNA, 25 bp, Artificial sequence
  Synthetic oligonucleotide
aaatcacatttcgactctccttgaa

SEQ ID NO: 715724 - DNA, 25 bp, Artificial sequence
  Synthetic oligonucleotide
tacagtgcggaacaagacaaaaccc

SEQ ID NO: 715725 - DNA, 25 bp, Artificial sequence
  Synthetic oligonucleotide
aaaaaactacatggatcatcgataa

SEQ ID NO: 715726 - DNA, 25 bp, Artificial sequence
  Synthetic oligonucleotide
tactatattctctaaacgatggtgt

SEQ ID NO: 715727 - DNA, 25 bp, Artificial sequence
  Synthetic oligonucleotide
tacagtgcggaagaagacaaaaccc

SEQ ID NO: 715728 - DNA, 25 bp, Artificial sequence
  Synthetic oligonucleotide
gcaaagtggttggaccaactttagg

SEQ ID NO: 715729 - DNA, 25 bp, Artificial sequence
  Synthetic oligonucleotide
gcaaagtggttgcaccaactttagg

SEQ ID NO: 715730 - DNA, 25 bp, Artificial sequence
  Synthetic oligonucleotide
tgataaccggaatcatcgagtggcc

SEQ ID NO: 715731 - DNA, 25 bp, Artificial sequence
  Synthetic oligonucleotide
tgataaccggaaacatcgagtggcc

SEQ ID NO: 715732 - DNA, 25 bp, Artificial sequence
  Synthetic oligonucleotide
tgtatatctttaaacacgccaaggg

SEQ ID NO: 715733 - DNA, 25 bp, Artificial sequence
  Synthetic oligonucleotide
tgtatatctttatacacgccaaggg

SEQ ID NO: 715734 - DNA, 25 bp, Artificial sequence
  Synthetic oligonucleotide
aaatcacatttccactctccttgaa

SEQ ID NO: 715735 - DNA, 25 bp, Artificial sequence
  Synthetic oligonucleotide
gatattgtttaatagtagagtctca

SEQ ID NO: 715736 - DNA, 25 bp, Artificial sequence
  Synthetic oligonucleotide
taagcctctatgatatctccgagcc

SEQ ID NO: 715737 - DNA, 25 bp, Artificial sequence
  Synthetic oligonucleotide
taagcctctatgttatctccgagcc

SEQ ID NO: 715738 - DNA, 25 bp, Artificial sequence
  Synthetic oligonucleotide
tatattggtgtctttagtttttttg

SEQ ID NO: 715739 - DNA, 25 bp, Artificial sequence
  Synthetic oligonucleotide
tatattggtgtcattagtttttttg

SEQ ID NO: 715740 - DNA, 25 bp, Artificial sequence
  Synthetic oligonucleotide
tccaagtagtagtccaggtgttcgt

SEQ ID NO: 715741 - DNA, 25 bp, Artificial sequence
  Synthetic oligonucleotide
tccaagtagtagaccaggtgttcgt

SEQ ID NO: 715742 - DNA, 25 bp, Artificial sequence
  Synthetic oligonucleotide
ccgcagagagtttatttgttcatga

SEQ ID NO: 715743 - DNA, 25 bp, Artificial sequence
  Synthetic oligonucleotide
ccgcagagagttaatttgttcatga

SEQ ID NO: 715744 - DNA, 25 bp, Artificial sequence
  Synthetic oligonucleotide
caaggtttcattattctccaacatg

SEQ ID NO: 715745 - DNA, 25 bp, Artificial sequence
  Synthetic oligonucleotide
tttttttggaattgagtacacactg

SEQ ID NO: 715746 - DNA, 25 bp, Artificial sequence
  Synthetic oligonucleotide
gatattgtttaaaagtagagtctca

SEQ ID NO: 715747 - DNA, 25 bp, Artificial sequence
  Synthetic oligonucleotide
acttcggttgtttcaatgtgttgca

SEQ ID NO: 715748 - DNA, 25 bp, Artificial sequence
  Synthetic oligonucleotide
tatgcaagtggatgaggaaaagact

SEQ ID NO: 715749 - DNA, 25 bp, Artificial sequence
  Synthetic oligonucleotide
tatgcaagtggaagaggaaaagact

SEQ ID NO: 715750 - DNA, 25 bp, Artificial sequence
  Synthetic oligonucleotide
taatgtgaaacctggtgatgatgac

SEQ ID NO: 715751 - DNA, 25 bp, Artificial sequence
  Synthetic oligonucleotide
taatgtgaaaccaggtgatgatgac

SEQ ID NO: 715752 - DNA, 25 bp, Artificial sequence
  Synthetic oligonucleotide
aacatgggagaaagaaatggaggat

SEQ ID NO: 715753 - DNA, 25 bp, Artificial sequence
  Synthetic oligonucleotide
aacatgggagaatgaaatggaggat

SEQ ID NO: 715754 - DNA, 25 bp, Artificial sequence
  Synthetic oligonucleotide
tttgttctaacgaaacagaactgag

SEQ ID NO: 715755 - DNA, 25 bp, Artificial sequence
  Synthetic oligonucleotide
tactatattctcaaaacgatggtgt

SEQ ID NO: 715756 - DNA, 25 bp, Artificial sequence
  Synthetic oligonucleotide
tttttttggaatagagtacacactg

SEQ ID NO: 715757 - DNA, 25 bp, Artificial sequence
  Synthetic oligonucleotide
taaaagagaaaacgatgttcgcgcg

SEQ ID NO: 715758 - DNA, 25 bp, Artificial sequence
  Synthetic oligonucleotide
tttgttctaacgtaacagaactgag

SEQ ID NO: 715759 - DNA, 25 bp, Artificial sequence
  Synthetic oligonucleotide
gggagaaaccaatcaaattccatgt

SEQ ID NO: 715760 - DNA, 25 bp, Artificial sequence
  Synthetic oligonucleotide
acttcggttgttacaatgtgttgca

SEQ ID NO: 715761 - DNA, 25 bp, Artificial sequence
  Synthetic oligonucleotide
caaggtttcatttttctccaacatg

SEQ ID NO: 715762 - DNA, 25 bp, Artificial sequence
  Synthetic oligonucleotide
gggagaaaccaaacaaattccatgt

SEQ ID NO: 715763 - DNA, 25 bp, Artificial sequence
  Synthetic oligonucleotide
tttttaccgcggtaagtattgaata

SEQ ID NO: 715764 - DNA, 25 bp, Artificial sequence
  Synthetic oligonucleotide
tttttaccgcggaaagtattgaata

SEQ ID NO: 715765 - DNA, 25 bp, Artificial sequence
  Synthetic oligonucleotide
ttgcttcataaattaggattcgatc

SEQ ID NO: 715766 - DNA, 25 bp, Artificial sequence
  Synthetic oligonucleotide
taaaagagaaaaggatgttcgcgcg

SEQ ID NO: 715767 - DNA, 25 bp, Artificial sequence
  Synthetic oligonucleotide
tctattctctatcgtaaccaaaagg

SEQ ID NO: 715768 - DNA, 25 bp, Artificial sequence
  Synthetic oligonucleotide
tctattctctatggtaaccaaaagg

SEQ ID NO: 715769 - DNA, 25 bp, Artificial sequence
  Synthetic oligonucleotide
tacgaagctgatgtagtttctctgt

SEQ ID NO: 715770 - DNA, 25 bp, Artificial sequence
  Synthetic oligonucleotide
ttgcttcataaaataggattcgatc

SEQ ID NO: 715771 - DNA, 25 bp, Artificial sequence
  Synthetic oligonucleotide
tgaaaattccataaaacagcaccaa

SEQ ID NO: 715772 - DNA, 25 bp, Artificial sequence
  Synthetic oligonucleotide
caaagtcgcttggtttcgtgtccga

SEQ ID NO: 715773 - DNA, 25 bp, Artificial sequence
  Synthetic oligonucleotide
tggtcaggaagtgaagacgaaagca

SEQ ID NO: 715774 - DNA, 25 bp, Artificial sequence
  Synthetic oligonucleotide
caaagtcgcttgctttcgtgtccga

SEQ ID NO: 715775 - DNA, 25 bp, Artificial sequence
  Synthetic oligonucleotide
aattgggtatttcctgagtttcgtc

SEQ ID NO: 715776 - DNA, 25 bp, Artificial sequence
  Synthetic oligonucleotide
tcttcaaggatatacaaactcgaat

SEQ ID NO: 715777 - DNA, 25 bp, Artificial sequence
  Synthetic oligonucleotide
aattgggtatttgctgagtttcgtc

SEQ ID NO: 715778 - DNA, 25 bp, Artificial sequence
  Synthetic oligonucleotide
tgaaaattccattaaacagcaccaa

SEQ ID NO: 715779 - DNA, 25 bp, Artificial sequence
  Synthetic oligonucleotide
tacgaagctgatctagtttctctgt

SEQ ID NO: 715780 - DNA, 25 bp, Artificial sequence
  Synthetic oligonucleotide
gcgatgtgctatttgtattggtttg

SEQ ID NO: 715781 - DNA, 25 bp, Artificial sequence
  Synthetic oligonucleotide
cgaggctgactgaagaactgggcga

SEQ ID NO: 715782 - DNA, 25 bp, Artificial sequence
  Synthetic oligonucleotide
tcatgcataaatttaatacaagaga

SEQ ID NO: 715783 - DNA, 25 bp, Artificial sequence
  Synthetic oligonucleotide
cgaggctgactgtagaactgggcga

SEQ ID NO: 715784 - DNA, 25 bp, Artificial sequence
  Synthetic oligonucleotide
aagtgaatcacccttatggagaaaa

SEQ ID NO: 715785 - DNA, 25 bp, Artificial sequence
  Synthetic oligonucleotide
aagtgaatcaccgttatggagaaaa

SEQ ID NO: 715786 - DNA, 25 bp, Artificial sequence
  Synthetic oligonucleotide
ctcttgatatctctttagaggaagc

SEQ ID NO: 715787 - DNA, 25 bp, Artificial sequence
  Synthetic oligonucleotide
cgactgaagatgttaaaagcatgga

SEQ ID NO: 715788 - DNA, 25 bp, Artificial sequence
  Synthetic oligonucleotide
gcgatgtgctatatgtattggtttg

SEQ ID NO: 715789 - DNA, 25 bp, Artificial sequence
  Synthetic oligonucleotide
ctcttgatatctgtttagaggaagc

SEQ ID NO: 715790 - DNA, 25 bp, Artificial sequence
  Synthetic oligonucleotide
cgactgaagatgataaaagcatgga

SEQ ID NO: 715791 - DNA, 25 bp, Artificial sequence
  Synthetic oligonucleotide
ttaaagaaggatattttagcccgct

SEQ ID NO: 715792 - DNA, 25 bp, Artificial sequence
  Synthetic oligonucleotide
ttaaagaaggattttttagcccgct

SEQ ID NO: 715793 - DNA, 25 bp, Artificial sequence
  Synthetic oligonucleotide
acatacaggctgtagtagaccgtta

SEQ ID NO: 715794 - DNA, 25 bp, Artificial sequence
  Synthetic oligonucleotide
acatacaggctgaagtagaccgtta

SEQ ID NO: 715795 - DNA, 25 bp, Artificial sequence
  Synthetic oligonucleotide
ggaggtttcgttgagtgagtgataa

SEQ ID NO: 715796 - DNA, 25 bp, Artificial sequence
  Synthetic oligonucleotide
ggaggtttcgttcagtgagtgataa

SEQ ID NO: 715797 - DNA, 25 bp, Artificial sequence
  Synthetic oligonucleotide
acgtatctgaataagctaacatgta

SEQ ID NO: 715798 - DNA, 25 bp, Artificial sequence
  Synthetic oligonucleotide
acgtatctgaattagctaacatgta

SEQ ID NO: 715799 - DNA, 25 bp, Artificial sequence
  Synthetic oligonucleotide
aaaagaaaacagcaaacgtgcttaa

SEQ ID NO: 715800 - DNA, 25 bp, Artificial sequence
  Synthetic oligonucleotide
aaaagaaaacaggaaacgtgcttaa

SEQ ID NO: 715801 - DNA, 25 bp, Artificial sequence
  Synthetic oligonucleotide
ccttccattagatagcgtttatatt

SEQ ID NO: 715802 - DNA, 25 bp, Artificial sequence
  Synthetic oligonucleotide
atctaatttctcgaagcatcacaca

SEQ ID NO: 715803 - DNA, 25 bp, Artificial sequence
  Synthetic oligonucleotide
atctaatttctccaagcatcacaca

SEQ ID NO: 715804 - DNA, 25 bp, Artificial sequence
  Synthetic oligonucleotide
ttgccgctccgaataaaataaaaaa

SEQ ID NO: 715805 - DNA, 25 bp, Artificial sequence
  Synthetic oligonucleotide
ccttccattagaaagcgtttatatt

SEQ ID NO: 715806 - DNA, 25 bp, Artificial sequence
  Synthetic oligonucleotide
tgtcttgattgaattaacaacgccc

SEQ ID NO: 715807 - DNA, 25 bp, Artificial sequence
  Synthetic oligonucleotide
tgcgatactgatgatgaaattttca

SEQ ID NO: 715808 - DNA, 25 bp, Artificial sequence
  Synthetic oligonucleotide
tgcgatactgatcatgaaattttca

SEQ ID NO: 715809 - DNA, 25 bp, Artificial sequence
  Synthetic oligonucleotide
cgtagcgcctttagcagcgtatccg

SEQ ID NO: 715810 - DNA, 25 bp, Artificial sequence
  Synthetic oligonucleotide
ttgccgctccgattaaaataaaaaa

SEQ ID NO: 715811 - DNA, 25 bp, Artificial sequence
  Synthetic oligonucleotide
gatcggagccatgatcgcgccaaat

SEQ ID NO: 715812 - DNA, 25 bp, Artificial sequence
  Synthetic oligonucleotide
gatcggagccatcatcgcgccaaat

SEQ ID NO: 715813 - DNA, 25 bp, Artificial sequence
  Synthetic oligonucleotide
tttaaaagagctgacatctttaaca

SEQ ID NO: 715814 - DNA, 25 bp, Artificial sequence
  Synthetic oligonucleotide
tttaaaagagctcacatctttaaca

SEQ ID NO: 715815 - DNA, 25 bp, Artificial sequence
  Synthetic oligonucleotide
tccagttgtcggaacaaccggtttc

SEQ ID NO: 715816 - DNA, 25 bp, Artificial sequence
  Synthetic oligonucleotide
tccagttgtcggtacaaccggtttc

SEQ ID NO: 715817 - DNA, 25 bp, Artificial sequence
  Synthetic oligonucleotide
agtacatacaaatattgcattagag

SEQ ID NO: 715818 - DNA, 25 bp, Artificial sequence
  Synthetic oligonucleotide
tgtgatgcctgtagagtcagatgct

SEQ ID NO: 715819 - DNA, 25 bp, Artificial sequence
  Synthetic oligonucleotide
tgtcttgattgatttaacaacgccc

SEQ ID NO: 715820 - DNA, 25 bp, Artificial sequence
  Synthetic oligonucleotide
tcatgcataaatataatacaagaga

SEQ ID NO: 715821 - DNA, 25 bp, Artificial sequence
  Synthetic oligonucleotide
agatatccatgcctgttttacagaa

SEQ ID NO: 715822 - DNA, 25 bp, Artificial sequence
  Synthetic oligonucleotide
agatatccatgcgtgttttacagaa

SEQ ID NO: 715823 - DNA, 25 bp, Artificial sequence
  Synthetic oligonucleotide
catagaccatacttacgatcagcaa

SEQ ID NO: 715824 - DNA, 25 bp, Artificial sequence
  Synthetic oligonucleotide
ggcagaacgaactccacattttgac

SEQ ID NO: 715825 - DNA, 25 bp, Artificial sequence
  Synthetic oligonucleotide
ggcagaacgaacaccacattttgac

SEQ ID NO: 715826 - DNA, 25 bp, Artificial sequence
  Synthetic oligonucleotide
accgcgtggaagtatggggcaggaa

SEQ ID NO: 715827 - DNA, 25 bp, Artificial sequence
  Synthetic oligonucleotide
accgcgtggaagaatggggcaggaa

SEQ ID NO: 715828 - DNA, 25 bp, Artificial sequence
  Synthetic oligonucleotide
gatgtcaaacgatacaattaaatta

SEQ ID NO: 715829 - DNA, 25 bp, Artificial sequence
  Synthetic oligonucleotide
gatgtcaaacgaaacaattaaatta

SEQ ID NO: 715830 - DNA, 25 bp, Artificial sequence
  Synthetic oligonucleotide
ggaccagaaaagtagaaggaaagta

SEQ ID NO: 715831 - DNA, 25 bp, Artificial sequence
  Synthetic oligonucleotide
ggaccagaaaagaagaaggaaagta

SEQ ID NO: 715832 - DNA, 25 bp, Artificial sequence
  Synthetic oligonucleotide
agtacatacaaaaattgcattagag

SEQ ID NO: 715833 - DNA, 25 bp, Artificial sequence
  Synthetic oligonucleotide
cagccgccttttatctattacatgt

SEQ ID NO: 715834 - DNA, 25 bp, Artificial sequence
  Synthetic oligonucleotide
ctttttctgaatgaggtcgtttttc

SEQ ID NO: 715835 - DNA, 25 bp, Artificial sequence
  Synthetic oligonucleotide
caaaatggtgaccccccgttccatt

SEQ ID NO: 715836 - DNA, 25 bp, Artificial sequence
  Synthetic oligonucleotide
caaaatggtgacgccccgttccatt

SEQ ID NO: 715837 - DNA, 25 bp, Artificial sequence
  Synthetic oligonucleotide
atctatatcctcatttgtgtaggaa

SEQ ID NO: 715838 - DNA, 25 bp, Artificial sequence
  Synthetic oligonucleotide
atctatatcctcttttgtgtaggaa

SEQ ID NO: 715839 - DNA, 25 bp, Artificial sequence
  Synthetic oligonucleotide
caccaattcatttttcggcaccaca

SEQ ID NO: 715840 - DNA, 25 bp, Artificial sequence
  Synthetic oligonucleotide
caccaattcattattcggcaccaca

SEQ ID NO: 715841 - DNA, 25 bp, Artificial sequence
  Synthetic oligonucleotide
atggggatcaatcgagttaatcacg

SEQ ID NO: 715842 - DNA, 25 bp, Artificial sequence
  Synthetic oligonucleotide
atggggatcaatggagttaatcacg

SEQ ID NO: 715843 - DNA, 25 bp, Artificial sequence
  Synthetic oligonucleotide
gagcacatcgtgtacatcgcttacc

SEQ ID NO: 715844 - DNA, 25 bp, Artificial sequence
  Synthetic oligonucleotide
gagcacatcgtgaacatcgcttacc

SEQ ID NO: 715845 - DNA, 25 bp, Artificial sequence
  Synthetic oligonucleotide
aaaatcgattaatcttgccgctaca

SEQ ID NO: 715846 - DNA, 25 bp, Artificial sequence
  Synthetic oligonucleotide
cggatttttattatcatcaagcgta

SEQ ID NO: 715847 - DNA, 25 bp, Artificial sequence
  Synthetic oligonucleotide
aaaatcgattaaacttgccgctaca

SEQ ID NO: 715848 - DNA, 25 bp, Artificial sequence
  Synthetic oligonucleotide
cagccgccttttttctattacatgt

SEQ ID NO: 715849 - DNA, 25 bp, Artificial sequence
  Synthetic oligonucleotide
aagggactaccctaaataaggatga

SEQ ID NO: 715850 - DNA, 25 bp, Artificial sequence
  Synthetic oligonucleotide
aagggactacccaaaataaggatga

SEQ ID NO: 715851 - DNA, 25 bp, Artificial sequence
  Synthetic oligonucleotide
ttacagaaagtagaaggcggaaaaa

SEQ ID NO: 715852 - DNA, 25 bp, Artificial sequence
  Synthetic oligonucleotide
ttacagaaagtacaaggcggaaaaa

SEQ ID NO: 715853 - DNA, 25 bp, Artificial sequence
  Synthetic oligonucleotide
cggcagtatcatgattactgctctt

SEQ ID NO: 715854 - DNA, 25 bp, Artificial sequence
  Synthetic oligonucleotide
cggcagtatcatcattactgctctt

SEQ ID NO: 715855 - DNA, 25 bp, Artificial sequence
  Synthetic oligonucleotide
tgccgatccgtcattactctgggtg

SEQ ID NO: 715856 - DNA, 25 bp, Artificial sequence
  Synthetic oligonucleotide
tgccgatccgtctttactctgggtg

SEQ ID NO: 715857 - DNA, 25 bp, Artificial sequence
  Synthetic oligonucleotide
tgtgatgcctgttgagtcagatgct

SEQ ID NO: 715858 - DNA, 25 bp, Artificial sequence
  Synthetic oligonucleotide
caactattttgaggatgttgagatt

SEQ ID NO: 715859 - DNA, 25 bp, Artificial sequence
  Synthetic oligonucleotide
cggatttttattttcatcaagcgta

SEQ ID NO: 715860 - DNA, 25 bp, Artificial sequence
  Synthetic oligonucleotide
ccggcaaataaagcggcgagcgcta

SEQ ID NO: 715861 - DNA, 25 bp, Artificial sequence
  Synthetic oligonucleotide
tctgcatattgaaatgaaccaagcc

SEQ ID NO: 715862 - DNA, 25 bp, Artificial sequence
  Synthetic oligonucleotide
gtgtaatacctgaaaaaccgccctc

SEQ ID NO: 715863 - DNA, 25 bp, Artificial sequence
  Synthetic oligonucleotide
gtgtaatacctgtaaaaccgccctc

SEQ ID NO: 715864 - DNA, 25 bp, Artificial sequence
  Synthetic oligonucleotide
atagaggggctgttgtggaaaaggg

SEQ ID NO: 715865 - DNA, 25 bp, Artificial sequence
  Synthetic oligonucleotide
atagaggggctgatgtggaaaaggg

SEQ ID NO: 715866 - DNA, 25 bp, Artificial sequence
  Synthetic oligonucleotide
ataaaaaaaatcggaatgttcaaca

SEQ ID NO: 715867 - DNA, 25 bp, Artificial sequence
  Synthetic oligonucleotide
ataaaaaaaatccgaatgttcaaca

SEQ ID NO: 715868 - DNA, 25 bp, Artificial sequence
  Synthetic oligonucleotide
taaacaaacattctcctgccgagca

SEQ ID NO: 715869 - DNA, 25 bp, Artificial sequence
  Synthetic oligonucleotide
taaacaaacattgtcctgccgagca

SEQ ID NO: 715870 - DNA, 25 bp, Artificial sequence
  Synthetic oligonucleotide
aggaacaaagacaaggctacagtgc

SEQ ID NO: 715871 - DNA, 25 bp, Artificial sequence
  Synthetic oligonucleotide
aggaacaaagactaggctacagtgc

SEQ ID NO: 715872 - DNA, 25 bp, Artificial sequence
  Synthetic oligonucleotide
ctttttctgaatcaggtcgtttttc

SEQ ID NO: 715873 - DNA, 25 bp, Artificial sequence
  Synthetic oligonucleotide
aggggcatatggttttcatatcgct

SEQ ID NO: 715874 - DNA, 25 bp, Artificial sequence
  Synthetic oligonucleotide
cgtagcgccttttgcagcgtatccg

SEQ ID NO: 715875 - DNA, 25 bp, Artificial sequence
  Synthetic oligonucleotide
ccggcaaataaaccggcgagcgcta

SEQ ID NO: 715876 - DNA, 25 bp, Artificial sequence
  Synthetic oligonucleotide
ttaaaaataatagccagtccggctc

SEQ ID NO: 715877 - DNA, 25 bp, Artificial sequence
  Synthetic oligonucleotide
ttaaaaataatacccagtccggctc

SEQ ID NO: 715878 - DNA, 25 bp, Artificial sequence
  Synthetic oligonucleotide
attcactaaacgtgcgatgatatca

SEQ ID NO: 715879 - DNA, 25 bp, Artificial sequence
  Synthetic oligonucleotide
attcactaaacgagcgatgatatca

SEQ ID NO: 715880 - DNA, 25 bp, Artificial sequence
  Synthetic oligonucleotide
aaacatcgttctccccatcggaatc

SEQ ID NO: 715881 - DNA, 25 bp, Artificial sequence
  Synthetic oligonucleotide
aaacatcgttctgcccatcggaatc

SEQ ID NO: 715882 - DNA, 25 bp, Artificial sequence
  Synthetic oligonucleotide
aagcaaagacaatatgatgacgcag

SEQ ID NO: 715883 - DNA, 25 bp, Artificial sequence
  Synthetic oligonucleotide
aagcaaagacaaaatgatgacgcag

SEQ ID NO: 715884 - DNA, 25 bp, Artificial sequence
  Synthetic oligonucleotide
cagcgtatacatggcttctttatag

SEQ ID NO: 715885 - DNA, 25 bp, Artificial sequence
  Synthetic oligonucleotide
cagcgtatacatcgcttctttatag

SEQ ID NO: 715886 - DNA, 25 bp, Artificial sequence
  Synthetic oligonucleotide
tctgcatattgatatgaaccaagcc

SEQ ID NO: 715887 - DNA, 25 bp, Artificial sequence
  Synthetic oligonucleotide
aggggcatatggatttcatatcgct

SEQ ID NO: 715888 - DNA, 25 bp, Artificial sequence
  Synthetic oligonucleotide
aaagagaaacatcgaattttaccag

SEQ ID NO: 715889 - DNA, 25 bp, Artificial sequence
  Synthetic oligonucleotide
cggtgttaggttatgatccgtctct

SEQ ID NO: 715890 - DNA, 25 bp, Artificial sequence
  Synthetic oligonucleotide
tccgttttgctattgagtcatcaga

SEQ ID NO: 715891 - DNA, 25 bp, Artificial sequence
  Synthetic oligonucleotide
tccgttttgctaatgagtcatcaga

SEQ ID NO: 715892 - DNA, 25 bp, Artificial sequence
  Synthetic oligonucleotide
ccgtctcctcagcgcttgcggctga

SEQ ID NO: 715893 - DNA, 25 bp, Artificial sequence
  Synthetic oligonucleotide
ccgtctcctcagggcttgcggctga

SEQ ID NO: 715894 - DNA, 25 bp, Artificial sequence
  Synthetic oligonucleotide
gagaaaaaaattcaaacgatttata

SEQ ID NO: 715895 - DNA, 25 bp, Artificial sequence
  Synthetic oligonucleotide
gagaaaaaaattgaaacgatttata

SEQ ID NO: 715896 - DNA, 25 bp, Artificial sequence
  Synthetic oligonucleotide
ggtccggagaaatcgacagcctgcg

SEQ ID NO: 715897 - DNA, 25 bp, Artificial sequence
  Synthetic oligonucleotide
gagcgcgtgtatgtgaagaaaaaca

SEQ ID NO: 715898 - DNA, 25 bp, Artificial sequence
  Synthetic oligonucleotide
tcggcattgttagcactttgcatgg

SEQ ID NO: 715899 - DNA, 25 bp, Artificial sequence
  Synthetic oligonucleotide
aaagagaaacatggaattttaccag

SEQ ID NO: 715900 - DNA, 25 bp, Artificial sequence
  Synthetic oligonucleotide
gtcatccatgtgtccaacttcagaa

SEQ ID NO: 715901 - DNA, 25 bp, Artificial sequence
  Synthetic oligonucleotide
gtcatccatgtgaccaacttcagaa

SEQ ID NO: 715902 - DNA, 25 bp, Artificial sequence
  Synthetic oligonucleotide
gtgcaggatgtcttccgtgtgttcc

SEQ ID NO: 715903 - DNA, 25 bp, Artificial sequence
  Synthetic oligonucleotide
gtgcaggatgtcatccgtgtgttcc

SEQ ID NO: 715904 - DNA, 25 bp, Artificial sequence
  Synthetic oligonucleotide
ggcaaaacgaaaccgaagctgcttt

SEQ ID NO: 715905 - DNA, 25 bp, Artificial sequence
  Synthetic oligonucleotide
ggcaaaacgaaagcgaagctgcttt

SEQ ID NO: 715906 - DNA, 25 bp, Artificial sequence
  Synthetic oligonucleotide
gatgtgcttgggcgcgaacaatgag

SEQ ID NO: 715907 - DNA, 25 bp, Artificial sequence
  Synthetic oligonucleotide
gagcgcgtgtatctgaagaaaaaca

SEQ ID NO: 715908 - DNA, 25 bp, Artificial sequence
  Synthetic oligonucleotide
ttaagtatcctcggtatgatttgac

SEQ ID NO: 715909 - DNA, 25 bp, Artificial sequence
  Synthetic oligonucleotide
taggaatcacatcctatccgagcgt

SEQ ID NO: 715910 - DNA, 25 bp, Artificial sequence
  Synthetic oligonucleotide
taggaatcacatgctatccgagcgt

SEQ ID NO: 715911 - DNA, 25 bp, Artificial sequence
  Synthetic oligonucleotide
gtatcattgcgagagaactggggaa

SEQ ID NO: 715912 - DNA, 25 bp, Artificial sequence
  Synthetic oligonucleotide
gtatcattgcgacagaactggggaa

SEQ ID NO: 715913 - DNA, 25 bp, Artificial sequence
  Synthetic oligonucleotide
aaaagggacatgtaatccatttcat

SEQ ID NO: 715914 - DNA, 25 bp, Artificial sequence
  Synthetic oligonucleotide
aaaagggacatgaaatccatttcat

SEQ ID NO: 715915 - DNA, 25 bp, Artificial sequence
  Synthetic oligonucleotide
ttccgtttagactgaatacatatca

SEQ ID NO: 715916 - DNA, 25 bp, Artificial sequence
  Synthetic oligonucleotide
ttccgtttagacagaatacatatca

SEQ ID NO: 715917 - DNA, 25 bp, Artificial sequence
  Synthetic oligonucleotide
cggtgttaggttttgatccgtctct

SEQ ID NO: 715918 - DNA, 25 bp, Artificial sequence
  Synthetic oligonucleotide
attttcatgaagttgaggttaatca

SEQ ID NO: 715919 - DNA, 25 bp, Artificial sequence
  Synthetic oligonucleotide
tcggcattgttaccactttgcatgg

SEQ ID NO: 715920 - DNA, 25 bp, Artificial sequence
  Synthetic oligonucleotide
ttaagtatcctccgtatgatttgac

SEQ ID NO: 715921 - DNA, 25 bp, Artificial sequence
  Synthetic oligonucleotide
aaatcgctgaggaggcggaacggga

SEQ ID NO: 715922 - DNA, 25 bp, Artificial sequence
  Synthetic oligonucleotide
aaatcgctgaggtggcggaacggga

SEQ ID NO: 715923 - DNA, 25 bp, Artificial sequence
  Synthetic oligonucleotide
ttatccatgctctctatgctctccc

SEQ ID NO: 715924 - DNA, 25 bp, Artificial sequence
  Synthetic oligonucleotide
ttatccatgctcactatgctctccc

SEQ ID NO: 715925 - DNA, 25 bp, Artificial sequence
  Synthetic oligonucleotide
gcgcctatcttggaaaacaaatgct

SEQ ID NO: 715926 - DNA, 25 bp, Artificial sequence
  Synthetic oligonucleotide
gcgcctatcttgcaaaacaaatgct

SEQ ID NO: 715927 - DNA, 25 bp, Artificial sequence
  Synthetic oligonucleotide
aaatatggcttgcaagaccaagtct

SEQ ID NO: 715928 - DNA, 25 bp, Artificial sequence
  Synthetic oligonucleotide
attttcatgaagatgaggttaatca

SEQ ID NO: 715929 - DNA, 25 bp, Artificial sequence
  Synthetic oligonucleotide
caaagagcacgggaccattattgtg

SEQ ID NO: 715930 - DNA, 25 bp, Artificial sequence
  Synthetic oligonucleotide
aatcgaagcggggcatcaggcttat

SEQ ID NO: 715931 - DNA, 25 bp, Artificial sequence
  Synthetic oligonucleotide
aatcgaagcgggccatcaggcttat

SEQ ID NO: 715932 - DNA, 25 bp, Artificial sequence
  Synthetic oligonucleotide
cgcagttcgtgacagctatatgaaa

SEQ ID NO: 715933 - DNA, 25 bp, Artificial sequence
  Synthetic oligonucleotide
cgcagttcgtgagagctatatgaaa

SEQ ID NO: 715934 - DNA, 25 bp, Artificial sequence
  Synthetic oligonucleotide
agatgtcgatatggcgacagatgcg

SEQ ID NO: 715935 - DNA, 25 bp, Artificial sequence
  Synthetic oligonucleotide
agatgtcgatatcgcgacagatgcg

SEQ ID NO: 715936 - DNA, 25 bp, Artificial sequence
  Synthetic oligonucleotide
agtagaacggctgtttcagcggact

SEQ ID NO: 715937 - DNA, 25 bp, Artificial sequence
  Synthetic oligonucleotide
ggtccggagaaaacgacagcctgcg

SEQ ID NO: 715938 - DNA, 25 bp, Artificial sequence
  Synthetic oligonucleotide
caaagagcacggcaccattattgtg

SEQ ID NO: 715939 - DNA, 25 bp, Artificial sequence
  Synthetic oligonucleotide
tatgccgatttaccagaaccggagt

SEQ ID NO: 715940 - DNA, 25 bp, Artificial sequence
  Synthetic oligonucleotide
tgaaacctatgatgtcacgacattc

SEQ ID NO: 715941 - DNA, 25 bp, Artificial sequence
  Synthetic oligonucleotide
tgaaacctatgaagtcacgacattc

SEQ ID NO: 715942 - DNA, 25 bp, Artificial sequence
  Synthetic oligonucleotide
tgattatgttgaattcagaagaccg

SEQ ID NO: 715943 - DNA, 25 bp, Artificial sequence
  Synthetic oligonucleotide
tgattatgttgatttcagaagaccg

SEQ ID NO: 715944 - DNA, 25 bp, Artificial sequence
  Synthetic oligonucleotide
atttatctcatcattagaagaggat

SEQ ID NO: 715945 - DNA, 25 bp, Artificial sequence
  Synthetic oligonucleotide
atttatctcatctttagaagaggat

SEQ ID NO: 715946 - DNA, 25 bp, Artificial sequence
  Synthetic oligonucleotide
caactattttgacgatgttgagatt

SEQ ID NO: 715947 - DNA, 25 bp, Artificial sequence
  Synthetic oligonucleotide
catagaccatacatacgatcagcaa

SEQ ID NO: 715948 - DNA, 25 bp, Artificial sequence
  Synthetic oligonucleotide
agtagaacggctctttcagcggact

SEQ ID NO: 715949 - DNA, 25 bp, Artificial sequence
  Synthetic oligonucleotide
gttataaaaaactatgtgagcggat

SEQ ID NO: 715950 - DNA, 25 bp, Artificial sequence
  Synthetic oligonucleotide
aaatatggcttggaagaccaagtct

SEQ ID NO: 715951 - DNA, 25 bp, Artificial sequence
  Synthetic oligonucleotide
aatcaagaccgtgttgaagatcttt

SEQ ID NO: 715952 - DNA, 25 bp, Artificial sequence
  Synthetic oligonucleotide
aatcaagaccgtcttgaagatcttt

SEQ ID NO: 715953 - DNA, 25 bp, Artificial sequence
  Synthetic oligonucleotide
gatttgaagctgctgctatctgaaa

SEQ ID NO: 715954 - DNA, 25 bp, Artificial sequence
  Synthetic oligonucleotide
gatttgaagctggtgctatctgaaa

SEQ ID NO: 715955 - DNA, 25 bp, Artificial sequence
  Synthetic oligonucleotide
ggccttgtcctggttgaagcgatgg

SEQ ID NO: 715956 - DNA, 25 bp, Artificial sequence
  Synthetic oligonucleotide
ggccttgtcctgcttgaagcgatgg

SEQ ID NO: 715957 - DNA, 25 bp, Artificial sequence
  Synthetic oligonucleotide
ccttgtattggaacaaacattggcg

SEQ ID NO: 715958 - DNA, 25 bp, Artificial sequence
  Synthetic oligonucleotide
agtttttatcaaagcacttcccgtg

SEQ ID NO: 715959 - DNA, 25 bp, Artificial sequence
  Synthetic oligonucleotide
gttataaaaaacaatgtgagcggat

SEQ ID NO: 715960 - DNA, 25 bp, Artificial sequence
  Synthetic oligonucleotide
agtttttatcaatgcacttcccgtg

SEQ ID NO: 715961 - DNA, 25 bp, Artificial sequence
  Synthetic oligonucleotide
gtcggtgatgtttcggccgcaacag

SEQ ID NO: 715962 - DNA, 25 bp, Artificial sequence
  Synthetic oligonucleotide
agcattttagaacatgaacagctaa

SEQ ID NO: 715963 - DNA, 25 bp, Artificial sequence
  Synthetic oligonucleotide
acaaaggcggcattagagatgcttg

SEQ ID NO: 715964 - DNA, 25 bp, Artificial sequence
  Synthetic oligonucleotide
acaaaggcggcaatagagatgcttg

SEQ ID NO: 715965 - DNA, 25 bp, Artificial sequence
  Synthetic oligonucleotide
tcttctaaaaaatttgtcagccagt

SEQ ID NO: 715966 - DNA, 25 bp, Artificial sequence
  Synthetic oligonucleotide
tcttctaaaaaaattgtcagccagt

SEQ ID NO: 715967 - DNA, 25 bp, Artificial sequence
  Synthetic oligonucleotide
tatgccgatttagcagaaccggagt

SEQ ID NO: 715968 - DNA, 25 bp, Artificial sequence
  Synthetic oligonucleotide
gtcggtgatgttacggccgcaacag

SEQ ID NO: 715969 - DNA, 25 bp, Artificial sequence
  Synthetic oligonucleotide
ccttgtattggatcaaacattggcg

SEQ ID NO: 715970 - DNA, 25 bp, Artificial sequence
  Synthetic oligonucleotide
gtgcactgatcggtgccaatgcact

SEQ ID NO: 715971 - DNA, 25 bp, Artificial sequence
  Synthetic oligonucleotide
tgctttgatcgcgcatgacaagaaa

SEQ ID NO: 715972 - DNA, 25 bp, Artificial sequence
  Synthetic oligonucleotide
ggttcaatttacgactgcctatcgg

SEQ ID NO: 715973 - DNA, 25 bp, Artificial sequence
  Synthetic oligonucleotide
ggttcaatttaccactgcctatcgg

SEQ ID NO: 715974 - DNA, 25 bp, Artificial sequence
  Synthetic oligonucleotide
gaatcatgatctttacgcaaccgga

SEQ ID NO: 715975 - DNA, 25 bp, Artificial sequence
  Synthetic oligonucleotide
gaatcatgatctatacgcaaccgga

SEQ ID NO: 715976 - DNA, 25 bp, Artificial sequence
  Synthetic oligonucleotide
gaaaattcatgacgcgacaggtctt

SEQ ID NO: 715977 - DNA, 25 bp, Artificial sequence
  Synthetic oligonucleotide
gaaaattcatgaggcgacaggtctt

SEQ ID NO: 715978 - DNA, 25 bp, Artificial sequence
  Synthetic oligonucleotide
cggaaattcttgagcgcacacttga

SEQ ID NO: 715979 - DNA, 25 bp, Artificial sequence
  Synthetic oligonucleotide
ttcaatccggccctttagggggaga

SEQ ID NO: 715980 - DNA, 25 bp, Artificial sequence
  Synthetic oligonucleotide
tatcattgattagacggggggataa

SEQ ID NO: 715981 - DNA, 25 bp, Artificial sequence
  Synthetic oligonucleotide
gtgcactgatcgctgccaatgcact

SEQ ID NO: 715982 - DNA, 25 bp, Artificial sequence
  Synthetic oligonucleotide
tttttttgcgcgacccgctgaccgc

SEQ ID NO: 715983 - DNA, 25 bp, Artificial sequence
  Synthetic oligonucleotide
tttttttgcgcgtcccgctgaccgc

SEQ ID NO: 715984 - DNA, 25 bp, Artificial sequence
  Synthetic oligonucleotide
aaccggatgtctgggcattaatccg

SEQ ID NO: 715985 - DNA, 25 bp, Artificial sequence
  Synthetic oligonucleotide
aaccggatgtctcggcattaatccg

SEQ ID NO: 715986 - DNA, 25 bp, Artificial sequence
  Synthetic oligonucleotide
tgtattccattccgctcgccacaaa

SEQ ID NO: 715987 - DNA, 25 bp, Artificial sequence
  Synthetic oligonucleotide
tgtattccattcggctcgccacaaa

SEQ ID NO: 715988 - DNA, 25 bp, Artificial sequence
  Synthetic oligonucleotide
cggaaattcttgtgcgcacacttga

SEQ ID NO: 715989 - DNA, 25 bp, Artificial sequence
  Synthetic oligonucleotide
ttcaatccggccgtttagggggaga

SEQ ID NO: 715990 - DNA, 25 bp, Artificial sequence
  Synthetic oligonucleotide
tcgcttgcacagcgtccgtcttccg

SEQ ID NO: 715991 - DNA, 25 bp, Artificial sequence
  Synthetic oligonucleotide
tcatgaccagaagcttgacgcacca

SEQ ID NO: 715992 - DNA, 25 bp, Artificial sequence
  Synthetic oligonucleotide
tcatgaccagaaccttgacgcacca

SEQ ID NO: 715993 - DNA, 25 bp, Artificial sequence
  Synthetic oligonucleotide
agcattttagaagatgaacagctaa

SEQ ID NO: 715994 - DNA, 25 bp, Artificial sequence
  Synthetic oligonucleotide
gatgtgcttgggggcgaacaatgag

SEQ ID NO: 715995 - DNA, 25 bp, Artificial sequence
  Synthetic oligonucleotide
gcttaaaacagccgaaatgatttca

SEQ ID NO: 715996 - DNA, 25 bp, Artificial sequence
  Synthetic oligonucleotide
gcttaaaacagcggaaatgatttca

SEQ ID NO: 715997 - DNA, 25 bp, Artificial sequence
  Synthetic oligonucleotide
agaaaagcagcatggacatccggat

SEQ ID NO: 715998 - DNA, 25 bp, Artificial sequence
  Synthetic oligonucleotide
agaaaagcagcaaggacatccggat

SEQ ID NO: 715999 - DNA, 25 bp, Artificial sequence
  Synthetic oligonucleotide
tgctttgatcgcccatgacaagaaa

SEQ ID NO: 716000 - DNA, 25 bp, Artificial sequence
  Synthetic oligonucleotide
tctcccaggagctagaggagcggag

SEQ ID NO: 716001 - DNA, 25 bp, Artificial sequence
  Synthetic oligonucleotide
tatcattgattacacggggggataa

SEQ ID NO: 716002 - DNA, 25 bp, Artificial sequence
  Synthetic oligonucleotide
tcgcttgcacagggtccgtcttccg

SEQ ID NO: 716003 - DNA, 25 bp, Artificial sequence
  Synthetic oligonucleotide
gcatcaggaggtcatgttcggcatg

SEQ ID NO: 716004 - DNA, 25 bp, Artificial sequence
  Synthetic oligonucleotide
gcatcaggaggtgatgttcggcatg

SEQ ID NO: 716005 - DNA, 25 bp, Artificial sequence
  Synthetic oligonucleotide
gcttcagatacgccatgattcttat

SEQ ID NO: 716006 - DNA, 25 bp, Artificial sequence
  Synthetic oligonucleotide
tttcatgtcaggggttaaactgtca

SEQ ID NO: 716007 - DNA, 25 bp, Artificial sequence
  Synthetic oligonucleotide
catgaagattgaacagcttgtgtat

SEQ ID NO: 716008 - DNA, 25 bp, Artificial sequence
  Synthetic oligonucleotide
catgaagattgatcagcttgtgtat

SEQ ID NO: 716009 - DNA, 25 bp, Artificial sequence
  Synthetic oligonucleotide
tttcatgtcaggcgttaaactgtca

SEQ ID NO: 716010 - DNA, 25 bp, Artificial sequence
  Synthetic oligonucleotide
tctcccaggagcaagaggagcggag

SEQ ID NO: 716011 - DNA, 25 bp, Artificial sequence
  Synthetic oligonucleotide
caaagaaacaaagcctcaacgccta

SEQ ID NO: 716012 - DNA, 25 bp, Artificial sequence
  Synthetic oligonucleotide
gccatccggatcacggcaatgcggc

SEQ ID NO: 716013 - DNA, 25 bp, Artificial sequence
  Synthetic oligonucleotide
gccatccggatctcggcaatgcggc

SEQ ID NO: 716014 - DNA, 25 bp, Artificial sequence
  Synthetic oligonucleotide
aagaagcgatcttttccgccggaat

SEQ ID NO: 716015 - DNA, 25 bp, Artificial sequence
  Synthetic oligonucleotide
aagaagcgatctattccgccggaat

SEQ ID NO: 716016 - DNA, 25 bp, Artificial sequence
  Synthetic oligonucleotide
agtttcttttccaaacggatgctga

SEQ ID NO: 716017 - DNA, 25 bp, Artificial sequence
  Synthetic oligonucleotide
aagacgaaaaaagccttccggcgca

SEQ ID NO: 716018 - DNA, 25 bp, Artificial sequence
  Synthetic oligonucleotide
aagacgaaaaaacccttccggcgca

SEQ ID NO: 716019 - DNA, 25 bp, Artificial sequence
  Synthetic oligonucleotide
aggtttactattttatgataaatgg

SEQ ID NO: 716020 - DNA, 25 bp, Artificial sequence
  Synthetic oligonucleotide
ggccaaaagcggattttatgccgta

SEQ ID NO: 716021 - DNA, 25 bp, Artificial sequence
  Synthetic oligonucleotide
cggattttgttaatgatatctcgga

SEQ ID NO: 716022 - DNA, 25 bp, Artificial sequence
  Synthetic oligonucleotide
cggattttgttattgatatctcgga

SEQ ID NO: 716023 - DNA, 25 bp, Artificial sequence
  Synthetic oligonucleotide
ttatcccgtcaaaggattccgtttc

SEQ ID NO: 716024 - DNA, 25 bp, Artificial sequence
  Synthetic oligonucleotide
ttatcccgtcaatggattccgtttc

SEQ ID NO: 716025 - DNA, 25 bp, Artificial sequence
  Synthetic oligonucleotide
cgaatgggtataatgaaatcgttga

SEQ ID NO: 716026 - DNA, 25 bp, Artificial sequence
  Synthetic oligonucleotide
cgaatgggtatattgaaatcgttga

SEQ ID NO: 716027 - DNA, 25 bp, Artificial sequence
  Synthetic oligonucleotide
tcgaattccgtgtccttcttcgggg

SEQ ID NO: 716028 - DNA, 25 bp, Artificial sequence
  Synthetic oligonucleotide
gcttcagatacggcatgattcttat

SEQ ID NO: 716029 - DNA, 25 bp, Artificial sequence
  Synthetic oligonucleotide
gctttacggtaaagaagcgggcgtg

SEQ ID NO: 716030 - DNA, 25 bp, Artificial sequence
  Synthetic oligonucleotide
gctttacggtaatgaagcgggcgtg

SEQ ID NO: 716031 - DNA, 25 bp, Artificial sequence
  Synthetic oligonucleotide
aggtttactattatatgataaatgg

SEQ ID NO: 716032 - DNA, 25 bp, Artificial sequence
  Synthetic oligonucleotide
tgcgatttgacagaagcggaactct

SEQ ID NO: 716033 - DNA, 25 bp, Artificial sequence
  Synthetic oligonucleotide
atgtataatgctcacgttcttgctt

SEQ ID NO: 716034 - DNA, 25 bp, Artificial sequence
  Synthetic oligonucleotide
atgtataatgctgacgttcttgctt

SEQ ID NO: 716035 - DNA, 25 bp, Artificial sequence
  Synthetic oligonucleotide
tcgaattccgtgaccttcttcgggg

SEQ ID NO: 716036 - DNA, 25 bp, Artificial sequence
  Synthetic oligonucleotide
agtgatgatgtccagatcggaatgg

SEQ ID NO: 716037 - DNA, 25 bp, Artificial sequence
  Synthetic oligonucleotide
caaagaaacaaaccctcaacgccta

SEQ ID NO: 716038 - DNA, 25 bp, Artificial sequence
  Synthetic oligonucleotide
ggccaaaagcggtttttatgccgta

SEQ ID NO: 716039 - DNA, 25 bp, Artificial sequence
  Synthetic oligonucleotide
agtgatgatgtcgagatcggaatgg

SEQ ID NO: 716040 - DNA, 25 bp, Artificial sequence
  Synthetic oligonucleotide
gcgaagtttgtctaacaggaaaaaa

SEQ ID NO: 716041 - DNA, 25 bp, Artificial sequence
  Synthetic oligonucleotide
tgcgatttgacacaagcggaactct

SEQ ID NO: 716042 - DNA, 25 bp, Artificial sequence
  Synthetic oligonucleotide
acggtcagtttgcgtaaagaagaag

SEQ ID NO: 716043 - DNA, 25 bp, Artificial sequence
  Synthetic oligonucleotide
gcccgcatattacgcgcagataaaa

SEQ ID NO: 716044 - DNA, 25 bp, Artificial sequence
  Synthetic oligonucleotide
acggtcagtttgggtaaagaagaag

SEQ ID NO: 716045 - DNA, 25 bp, Artificial sequence
  Synthetic oligonucleotide
gcaattcggtcaattgtcactgtca

SEQ ID NO: 716046 - DNA, 25 bp, Artificial sequence
  Synthetic oligonucleotide
gcccgcatattaggcgcagataaaa

SEQ ID NO: 716047 - DNA, 25 bp, Artificial sequence
  Synthetic oligonucleotide
agtttcttttcctaacggatgctga

SEQ ID NO: 716048 - DNA, 25 bp, Artificial sequence
  Synthetic oligonucleotide
gcaattcggtcatttgtcactgtca

SEQ ID NO: 716049 - DNA, 25 bp, Artificial sequence
  Synthetic oligonucleotide
acgcttccagaccgcggcctaataa

SEQ ID NO: 716050 - DNA, 25 bp, Artificial sequence
  Synthetic oligonucleotide
acgcttccagacggcggcctaataa

SEQ ID NO: 716051 - DNA, 25 bp, Artificial sequence
  Synthetic oligonucleotide
gcgaagtttgtcaaacaggaaaaaa

SEQ ID NO: 716052 - DNA, 25 bp, Artificial sequence
  Synthetic oligonucleotide
gcttatggatactgcatggccaaca

SEQ ID NO: 716053 - DNA, 25 bp, Artificial sequence
  Synthetic oligonucleotide
aaagaaggcgatgttcttgccgttt

SEQ ID NO: 716054 - DNA, 25 bp, Artificial sequence
  Synthetic oligonucleotide
attcgtcctgcgctttaccaagcta

SEQ ID NO: 716055 - DNA, 25 bp, Artificial sequence
  Synthetic oligonucleotide
aaagaaggcgatcttcttgccgttt

SEQ ID NO: 716056 - DNA, 25 bp, Artificial sequence
  Synthetic oligonucleotide
gatatgctgatttgggatattgacc

SEQ ID NO: 716057 - DNA, 25 bp, Artificial sequence
  Synthetic oligonucleotide
gcggcagccaacaggatcggagaag

SEQ ID NO: 716058 - DNA, 25 bp, Artificial sequence
  Synthetic oligonucleotide
acggtatcaattcccggaaagtgct

SEQ ID NO: 716059 - DNA, 25 bp, Artificial sequence
  Synthetic oligonucleotide
gcggcagccaactggatcggagaag

SEQ ID NO: 716060 - DNA, 25 bp, Artificial sequence
  Synthetic oligonucleotide
gcttatggatacagcatggccaaca

SEQ ID NO: 716061 - DNA, 25 bp, Artificial sequence
  Synthetic oligonucleotide
gtaaagcaataaaagaaacgccgat

SEQ ID NO: 716062 - DNA, 25 bp, Artificial sequence
  Synthetic oligonucleotide
acggtatcaattgccggaaagtgct

SEQ ID NO: 716063 - DNA, 25 bp, Artificial sequence
  Synthetic oligonucleotide
gatatgctgattagggatattgacc

SEQ ID NO: 716064 - DNA, 25 bp, Artificial sequence
  Synthetic oligonucleotide
attccgagacccgccgttgtatttg

SEQ ID NO: 716065 - DNA, 25 bp, Artificial sequence
  Synthetic oligonucleotide
attccgagaccccccgttgtatttg

SEQ ID NO: 716066 - DNA, 25 bp, Artificial sequence
  Synthetic oligonucleotide
gaggctcatttagtcgtgaagcgag

SEQ ID NO: 716067 - DNA, 25 bp, Artificial sequence
  Synthetic oligonucleotide
gaggctcatttactcgtgaagcgag

SEQ ID NO: 716068 - DNA, 25 bp, Artificial sequence
  Synthetic oligonucleotide
gatattgtaaaacttgatctgccat

SEQ ID NO: 716069 - DNA, 25 bp, Artificial sequence
  Synthetic oligonucleotide
gtaaagcaataatagaaacgccgat

SEQ ID NO: 716070 - DNA, 25 bp, Artificial sequence
  Synthetic oligonucleotide
tttcttatttgattatagatacaat

SEQ ID NO: 716071 - DNA, 25 bp, Artificial sequence
  Synthetic oligonucleotide
tttcttatttgaatatagatacaat

SEQ ID NO: 716072 - DNA, 25 bp, Artificial sequence
  Synthetic oligonucleotide
tagatacgaagaaatcaatgacttt

SEQ ID NO: 716073 - DNA, 25 bp, Artificial sequence
  Synthetic oligonucleotide
attcgtcctgcggtttaccaagcta

SEQ ID NO: 716074 - DNA, 25 bp, Artificial sequence
  Synthetic oligonucleotide
atcggctcgcaaatctttgatacgg

SEQ ID NO: 716075 - DNA, 25 bp, Artificial sequence
  Synthetic oligonucleotide
tagatacgaagatatcaatgacttt

SEQ ID NO: 716076 - DNA, 25 bp, Artificial sequence
  Synthetic oligonucleotide
ttttgccttcatctgattctatgaa

SEQ ID NO: 716077 - DNA, 25 bp, Artificial sequence
  Synthetic oligonucleotide
gatattgtaaaagttgatctgccat

SEQ ID NO: 716078 - DNA, 25 bp, Artificial sequence
  Synthetic oligonucleotide
aatcttggaggaggtttcggcattc

SEQ ID NO: 716079 - DNA, 25 bp, Artificial sequence
  Synthetic oligonucleotide
gtagaagcgcatacgcatgactaca

SEQ ID NO: 716080 - DNA, 25 bp, Artificial sequence
  Synthetic oligonucleotide
gtagaagcgcattcgcatgactaca

SEQ ID NO: 716081 - DNA, 25 bp, Artificial sequence
  Synthetic oligonucleotide
caactgcggcatgcgcgagactgac

SEQ ID NO: 716082 - DNA, 25 bp, Artificial sequence
  Synthetic oligonucleotide
ttttgccttcatgtgattctatgaa

SEQ ID NO: 716083 - DNA, 25 bp, Artificial sequence
  Synthetic oligonucleotide
caggaagattcaaagtttggtttcg

SEQ ID NO: 716084 - DNA, 25 bp, Artificial sequence
  Synthetic oligonucleotide
caggaagattcatagtttggtttcg

SEQ ID NO: 716085 - DNA, 25 bp, Artificial sequence
  Synthetic oligonucleotide
ggacaaactgaaggggccattgaac

SEQ ID NO: 716086 - DNA, 25 bp, Artificial sequence
  Synthetic oligonucleotide
ggacaaactgaacgggccattgaac

SEQ ID NO: 716087 - DNA, 25 bp, Artificial sequence
  Synthetic oligonucleotide
tcggaacacattcagctgctgggtg

SEQ ID NO: 716088 - DNA, 25 bp, Artificial sequence
  Synthetic oligonucleotide
tcggaacacattgagctgctgggtg

SEQ ID NO: 716089 - DNA, 25 bp, Artificial sequence
  Synthetic oligonucleotide
atcggctcgcaattctttgatacgg

SEQ ID NO: 716090 - DNA, 25 bp, Artificial sequence
  Synthetic oligonucleotide
ttagcagcggaataaatcttcaaaa

SEQ ID NO: 716091 - DNA, 25 bp, Artificial sequence
  Synthetic oligonucleotide
ttagcagcggaaaaaatcttcaaaa

SEQ ID NO: 716092 - DNA, 25 bp, Artificial sequence
  Synthetic oligonucleotide
tggagagattcatattcatttgtat

SEQ ID NO: 716093 - DNA, 25 bp, Artificial sequence
  Synthetic oligonucleotide
caatatgtggctctagacggaggca

SEQ ID NO: 716094 - DNA, 25 bp, Artificial sequence
  Synthetic oligonucleotide
aatcttggaggacgtttcggcattc

SEQ ID NO: 716095 - DNA, 25 bp, Artificial sequence
  Synthetic oligonucleotide
gatgatgaaccggttcatgccactg

SEQ ID NO: 716096 - DNA, 25 bp, Artificial sequence
  Synthetic oligonucleotide
gatgatgaaccgcttcatgccactg

SEQ ID NO: 716097 - DNA, 25 bp, Artificial sequence
  Synthetic oligonucleotide
aaaattatcgaagctgtgaaagaaa

SEQ ID NO: 716098 - DNA, 25 bp, Artificial sequence
  Synthetic oligonucleotide
aaaattatcgaacctgtgaaagaaa

SEQ ID NO: 716099 - DNA, 25 bp, Artificial sequence
  Synthetic oligonucleotide
ggttttgacattccggaaatttgga

SEQ ID NO: 716100 - DNA, 25 bp, Artificial sequence
  Synthetic oligonucleotide
ggttttgacattgcggaaatttgga

SEQ ID NO: 716101 - DNA, 25 bp, Artificial sequence
  Synthetic oligonucleotide
cgttctctcgtgcgagacgcaggca

SEQ ID NO: 716102 - DNA, 25 bp, Artificial sequence
  Synthetic oligonucleotide
cgttctctcgtgggagacgcaggca

SEQ ID NO: 716103 - DNA, 25 bp, Artificial sequence
  Synthetic oligonucleotide
acggttggctctgaaaaagaagtgc

SEQ ID NO: 716104 - DNA, 25 bp, Artificial sequence
  Synthetic oligonucleotide
acggttggctctcaaaaagaagtgc

SEQ ID NO: 716105 - DNA, 25 bp, Artificial sequence
  Synthetic oligonucleotide
caatatgtggctgtagacggaggca

SEQ ID NO: 716106 - DNA, 25 bp, Artificial sequence
  Synthetic oligonucleotide
tggagagattcaaattcatttgtat

SEQ ID NO: 716107 - DNA, 25 bp, Artificial sequence
  Synthetic oligonucleotide
cacaagcagctggatagtgctgctt

SEQ ID NO: 716108 - DNA, 25 bp, Artificial sequence
  Synthetic oligonucleotide
acgatgaagaaatcgctctcgatcc

SEQ ID NO: 716109 - DNA, 25 bp, Artificial sequence
  Synthetic oligonucleotide
tcgatatatattatcctaaatattc

SEQ ID NO: 716110 - DNA, 25 bp, Artificial sequence
  Synthetic oligonucleotide
tcgatatatattttcctaaatattc

SEQ ID NO: 716111 - DNA, 25 bp, Artificial sequence
  Synthetic oligonucleotide
tattggtcacggttaccgttgtggc

SEQ ID NO: 716112 - DNA, 25 bp, Artificial sequence
  Synthetic oligonucleotide
tattggtcacggataccgttgtggc

SEQ ID NO: 716113 - DNA, 25 bp, Artificial sequence
  Synthetic oligonucleotide
cattcatttcatcaagcactttttg

SEQ ID NO: 716114 - DNA, 25 bp, Artificial sequence
  Synthetic oligonucleotide
cattcatttcatgaagcactttttg

SEQ ID NO: 716115 - DNA, 25 bp, Artificial sequence
  Synthetic oligonucleotide
ctgacaaatcagcacccagtgttac

SEQ ID NO: 716116 - DNA, 25 bp, Artificial sequence
  Synthetic oligonucleotide
caactgcggcatccgcgagactgac

SEQ ID NO: 716117 - DNA, 25 bp, Artificial sequence
  Synthetic oligonucleotide
tcagcagcaaaagggccgctgccag

SEQ ID NO: 716118 - DNA, 25 bp, Artificial sequence
  Synthetic oligonucleotide
tcagcagcaaaacggccgctgccag

SEQ ID NO: 716119 - DNA, 25 bp, Artificial sequence
  Synthetic oligonucleotide
ctgacaaatcaggacccagtgttac

SEQ ID NO: 716120 - DNA, 25 bp, Artificial sequence
  Synthetic oligonucleotide
aaattttcttcatagcagtttgacc

SEQ ID NO: 716121 - DNA, 25 bp, Artificial sequence
  Synthetic oligonucleotide
cattcaatccggtgccttttttggc

SEQ ID NO: 716122 - DNA, 25 bp, Artificial sequence
  Synthetic oligonucleotide
cacaagcagctgcatagtgctgctt

SEQ ID NO: 716123 - DNA, 25 bp, Artificial sequence
  Synthetic oligonucleotide
gaatcatgaaaattacagttccgtt

SEQ ID NO: 716124 - DNA, 25 bp, Artificial sequence
  Synthetic oligonucleotide
gaatcatgaaaaatacagttccgtt

SEQ ID NO: 716125 - DNA, 25 bp, Artificial sequence
  Synthetic oligonucleotide
agataaagagatacaggtttcattt

SEQ ID NO: 716126 - DNA, 25 bp, Artificial sequence
  Synthetic oligonucleotide
agataaagagattcaggtttcattt

SEQ ID NO: 716127 - DNA, 25 bp, Artificial sequence
  Synthetic oligonucleotide
taaagctcgggagattcgttttccc

SEQ ID NO: 716128 - DNA, 25 bp, Artificial sequence
  Synthetic oligonucleotide
taaagctcgggacattcgttttccc

SEQ ID NO: 716129 - DNA, 25 bp, Artificial sequence
  Synthetic oligonucleotide
ggtataatagccccgacaaggagag

SEQ ID NO: 716130 - DNA, 25 bp, Artificial sequence
  Synthetic oligonucleotide
ggtataatagccgcgacaaggagag

SEQ ID NO: 716131 - DNA, 25 bp, Artificial sequence
  Synthetic oligonucleotide
cactccatcgatgttcttcttcgga

SEQ ID NO: 716132 - DNA, 25 bp, Artificial sequence
  Synthetic oligonucleotide
ttaaataaagatacgcatatcccga

SEQ ID NO: 716133 - DNA, 25 bp, Artificial sequence
  Synthetic oligonucleotide
aaattttcttcaaagcagtttgacc

SEQ ID NO: 716134 - DNA, 25 bp, Artificial sequence
  Synthetic oligonucleotide
atgtcgtgacaagctcttggttggc

SEQ ID NO: 716135 - DNA, 25 bp, Artificial sequence
  Synthetic oligonucleotide
tatctttcgcttaatctagctggtc

SEQ ID NO: 716136 - DNA, 25 bp, Artificial sequence
  Synthetic oligonucleotide
cccagtcaatgtgagcgtttttcat

SEQ ID NO: 716137 - DNA, 25 bp, Artificial sequence
  Synthetic oligonucleotide
cccagtcaatgtcagcgtttttcat

SEQ ID NO: 716138 - DNA, 25 bp, Artificial sequence
  Synthetic oligonucleotide
gggagacaagctgattcttttggct

SEQ ID NO: 716139 - DNA, 25 bp, Artificial sequence
  Synthetic oligonucleotide
gggagacaagctcattcttttggct

SEQ ID NO: 716140 - DNA, 25 bp, Artificial sequence
  Synthetic oligonucleotide
tgacgtttaaatcagaagctgcgtc

SEQ ID NO: 716141 - DNA, 25 bp, Artificial sequence
  Synthetic oligonucleotide
tgacgtttaaatgagaagctgcgtc

SEQ ID NO: 716142 - DNA, 25 bp, Artificial sequence
  Synthetic oligonucleotide
tttcgatgtcaggtttattatcagg

SEQ ID NO: 716143 - DNA, 25 bp, Artificial sequence
  Synthetic oligonucleotide
tttcgatgtcagctttattatcagg

SEQ ID NO: 716144 - DNA, 25 bp, Artificial sequence
  Synthetic oligonucleotide
tagcaaactcttctttgatttttgc

SEQ ID NO: 716145 - DNA, 25 bp, Artificial sequence
  Synthetic oligonucleotide
tagcaaactcttgtttgatttttgc

SEQ ID NO: 716146 - DNA, 25 bp, Artificial sequence
  Synthetic oligonucleotide
acgatgaagaaaacgctctcgatcc

SEQ ID NO: 716147 - DNA, 25 bp, Artificial sequence
  Synthetic oligonucleotide
ccgcattttcgtaaccgattttgtc

SEQ ID NO: 716148 - DNA, 25 bp, Artificial sequence
  Synthetic oligonucleotide
cattcaatccggagccttttttggc

SEQ ID NO: 716149 - DNA, 25 bp, Artificial sequence
  Synthetic oligonucleotide
atgtcgtgacaacctcttggttggc

SEQ ID NO: 716150 - DNA, 25 bp, Artificial sequence
  Synthetic oligonucleotide
catcctccgagatcgcttcgtcaga

SEQ ID NO: 716151 - DNA, 25 bp, Artificial sequence
  Synthetic oligonucleotide
catcctccgagaacgcttcgtcaga

SEQ ID NO: 716152 - DNA, 25 bp, Artificial sequence
  Synthetic oligonucleotide
acgccttaatcattccagttaaagc

SEQ ID NO: 716153 - DNA, 25 bp, Artificial sequence
  Synthetic oligonucleotide
acgccttaatcaatccagttaaagc

SEQ ID NO: 716154 - DNA, 25 bp, Artificial sequence
  Synthetic oligonucleotide
atacttcaaacggtgctgtaacata

SEQ ID NO: 716155 - DNA, 25 bp, Artificial sequence
  Synthetic oligonucleotide
atacttcaaacgctgctgtaacata

SEQ ID NO: 716156 - DNA, 25 bp, Artificial sequence
  Synthetic oligonucleotide
ctttaacaccggctgtcatcagtgc

SEQ ID NO: 716157 - DNA, 25 bp, Artificial sequence
  Synthetic oligonucleotide
ctttaacaccgggtgtcatcagtgc

SEQ ID NO: 716158 - DNA, 25 bp, Artificial sequence
  Synthetic oligonucleotide
tttcatctgtgaagccgctgatatt

SEQ ID NO: 716159 - DNA, 25 bp, Artificial sequence
  Synthetic oligonucleotide
tttcatctgtgatgccgctgatatt

SEQ ID NO: 716160 - DNA, 25 bp, Artificial sequence
  Synthetic oligonucleotide
tatctttcgctttatctagctggtc

SEQ ID NO: 716161 - DNA, 25 bp, Artificial sequence
  Synthetic oligonucleotide
ccgcattttcgttaccgattttgtc

SEQ ID NO: 716162 - DNA, 25 bp, Artificial sequence
  Synthetic oligonucleotide
cattatagtggacacatcgccgagt

SEQ ID NO: 716163 - DNA, 25 bp, Artificial sequence
  Synthetic oligonucleotide
atatttttagctgacttaggaatcg

SEQ ID NO: 716164 - DNA, 25 bp, Artificial sequence
  Synthetic oligonucleotide
ggatttaagcatatgttatatagaa

SEQ ID NO: 716165 - DNA, 25 bp, Artificial sequence
  Synthetic oligonucleotide
cactccatcgatcttcttcttcgga

SEQ ID NO: 716166 - DNA, 25 bp, Artificial sequence
  Synthetic oligonucleotide
tccggatctggttgagatcgtagaa

SEQ ID NO: 716167 - DNA, 25 bp, Artificial sequence
  Synthetic oligonucleotide
atccattgatgtcgatggattaaca

SEQ ID NO: 716168 - DNA, 25 bp, Artificial sequence
  Synthetic oligonucleotide
atccattgatgtggatggattaaca

SEQ ID NO: 716169 - DNA, 25 bp, Artificial sequence
  Synthetic oligonucleotide
aactgtcgaggaattcattgttaat

SEQ ID NO: 716170 - DNA, 25 bp, Artificial sequence
  Synthetic oligonucleotide
aactgtcgaggatttcattgttaat

SEQ ID NO: 716171 - DNA, 25 bp, Artificial sequence
  Synthetic oligonucleotide
tccttttccgctggtgcgctataca

SEQ ID NO: 716172 - DNA, 25 bp, Artificial sequence
  Synthetic oligonucleotide
tccttttccgctcgtgcgctataca

SEQ ID NO: 716173 - DNA, 25 bp, Artificial sequence
  Synthetic oligonucleotide
tgtggccgcaaatcatgttctagaa

SEQ ID NO: 716174 - DNA, 25 bp, Artificial sequence
  Synthetic oligonucleotide
atatttttagctcacttaggaatcg

SEQ ID NO: 716175 - DNA, 25 bp, Artificial sequence
  Synthetic oligonucleotide
cattatagtggagacatcgccgagt

SEQ ID NO: 716176 - DNA, 25 bp, Artificial sequence
  Synthetic oligonucleotide
ccttctcagaaggcggatcagagac

SEQ ID NO: 716177 - DNA, 25 bp, Artificial sequence
  Synthetic oligonucleotide
cccgacgactttatttcaccatgtg

SEQ ID NO: 716178 - DNA, 25 bp, Artificial sequence
  Synthetic oligonucleotide
cccgacgactttttttcaccatgtg

SEQ ID NO: 716179 - DNA, 25 bp, Artificial sequence
  Synthetic oligonucleotide
agaatataggcaggcgccttcagtc

SEQ ID NO: 716180 - DNA, 25 bp, Artificial sequence
  Synthetic oligonucleotide
agaatataggcacgcgccttcagtc

SEQ ID NO: 716181 - DNA, 25 bp, Artificial sequence
  Synthetic oligonucleotide
agatgggtaagatttttcggtattc

SEQ ID NO: 716182 - DNA, 25 bp, Artificial sequence
  Synthetic oligonucleotide
agatgggtaagaattttcggtattc

SEQ ID NO: 716183 - DNA, 25 bp, Artificial sequence
  Synthetic oligonucleotide
ttatttcttccgttctggtttctct

SEQ ID NO: 716184 - DNA, 25 bp, Artificial sequence
  Synthetic oligonucleotide
ttatttcttccgatctggtttctct

SEQ ID NO: 716185 - DNA, 25 bp, Artificial sequence
  Synthetic oligonucleotide
cctgatctgctcccggacaacatga

SEQ ID NO: 716186 - DNA, 25 bp, Artificial sequence
  Synthetic oligonucleotide
cctgatctgctcgcggacaacatga

SEQ ID NO: 716187 - DNA, 25 bp, Artificial sequence
  Synthetic oligonucleotide
ttaaataaagattcgcatatcccga

SEQ ID NO: 716188 - DNA, 25 bp, Artificial sequence
  Synthetic oligonucleotide
tgtggccgcaaaacatgttctagaa

SEQ ID NO: 716189 - DNA, 25 bp, Artificial sequence
  Synthetic oligonucleotide
gctgcttaacgcccaggtcgaaaaa

SEQ ID NO: 716190 - DNA, 25 bp, Artificial sequence
  Synthetic oligonucleotide
agctaaaaatgaagagtatttcaaa

SEQ ID NO: 716191 - DNA, 25 bp, Artificial sequence
  Synthetic oligonucleotide
agctaaaaatgatgagtatttcaaa

SEQ ID NO: 716192 - DNA, 25 bp, Artificial sequence
  Synthetic oligonucleotide
gatggggacgagctatgatgtaggt

SEQ ID NO: 716193 - DNA, 25 bp, Artificial sequence
  Synthetic oligonucleotide
gatggggacgaggtatgatgtaggt

SEQ ID NO: 716194 - DNA, 25 bp, Artificial sequence
  Synthetic oligonucleotide
cacgattttagaaaaagagatccag

SEQ ID NO: 716195 - DNA, 25 bp, Artificial sequence
  Synthetic oligonucleotide
cacgattttagataaagagatccag

SEQ ID NO: 716196 - DNA, 25 bp, Artificial sequence
  Synthetic oligonucleotide
aaatggattatgggatacagcctat

SEQ ID NO: 716197 - DNA, 25 bp, Artificial sequence
  Synthetic oligonucleotide
aaatggattatgcgatacagcctat

SEQ ID NO: 716198 - DNA, 25 bp, Artificial sequence
  Synthetic oligonucleotide
aatgagagagcttgttgccattaac

SEQ ID NO: 716199 - DNA, 25 bp, Artificial sequence
  Synthetic oligonucleotide
aatgagagagctagttgccattaac

SEQ ID NO: 716200 - DNA, 25 bp, Artificial sequence
  Synthetic oligonucleotide
agaccctgatgagctggtcgacatc

SEQ ID NO: 716201 - DNA, 25 bp, Artificial sequence
  Synthetic oligonucleotide
agtcaagatgactaaagttggtgag

SEQ ID NO: 716202 - DNA, 25 bp, Artificial sequence
  Synthetic oligonucleotide
gctgcttaacgcgcaggtcgaaaaa

SEQ ID NO: 716203 - DNA, 25 bp, Artificial sequence
  Synthetic oligonucleotide
agtcaagatgacaaaagttggtgag

SEQ ID NO: 716204 - DNA, 25 bp, Artificial sequence
  Synthetic oligonucleotide
ggatgaaaccaccgaccaagtgctg

SEQ ID NO: 716205 - DNA, 25 bp, Artificial sequence
  Synthetic oligonucleotide
ggatgaaaccacggaccaagtgctg

SEQ ID NO: 716206 - DNA, 25 bp, Artificial sequence
  Synthetic oligonucleotide
cgctgtcattgttgaaggtgcaggc

SEQ ID NO: 716207 - DNA, 25 bp, Artificial sequence
  Synthetic oligonucleotide
cgctgtcattgtagaaggtgcaggc

SEQ ID NO: 716208 - DNA, 25 bp, Artificial sequence
  Synthetic oligonucleotide
aattgatgtcagaagctatccgggc

SEQ ID NO: 716209 - DNA, 25 bp, Artificial sequence
  Synthetic oligonucleotide
aattgatgtcagtagctatccgggc

SEQ ID NO: 716210 - DNA, 25 bp, Artificial sequence
  Synthetic oligonucleotide
agaacctgatacggaaaaggtggtc

SEQ ID NO: 716211 - DNA, 25 bp, Artificial sequence
  Synthetic oligonucleotide
agaacctgataccgaaaaggtggtc

SEQ ID NO: 716212 - DNA, 25 bp, Artificial sequence
  Synthetic oligonucleotide
agacggatttgttgaaaatatcgtc

SEQ ID NO: 716213 - DNA, 25 bp, Artificial sequence
  Synthetic oligonucleotide
agacggatttgtagaaaatatcgtc

SEQ ID NO: 716214 - DNA, 25 bp, Artificial sequence
  Synthetic oligonucleotide
ccttctcagaagccggatcagagac

SEQ ID NO: 716215 - DNA, 25 bp, Artificial sequence
  Synthetic oligonucleotide
tccggatctggtagagatcgtagaa

SEQ ID NO: 716216 - DNA, 25 bp, Artificial sequence
  Synthetic oligonucleotide
agaccctgatgacctggtcgacatc

SEQ ID NO: 716217 - DNA, 25 bp, Artificial sequence
  Synthetic oligonucleotide
ctcgctgaggaacagggactttctt

SEQ ID NO: 716218 - DNA, 25 bp, Artificial sequence
  Synthetic oligonucleotide
ccataagcggagaaagagggaatga

SEQ ID NO: 716219 - DNA, 25 bp, Artificial sequence
  Synthetic oligonucleotide
cacggcacaagctgacaaaatcaac

SEQ ID NO: 716220 - DNA, 25 bp, Artificial sequence
  Synthetic oligonucleotide
cacggcacaagcagacaaaatcaac

SEQ ID NO: 716221 - DNA, 25 bp, Artificial sequence
  Synthetic oligonucleotide
gaaatcggaggtctggatgctctct

SEQ ID NO: 716222 - DNA, 25 bp, Artificial sequence
  Synthetic oligonucleotide
gaaatcggaggtgtggatgctctct

SEQ ID NO: 716223 - DNA, 25 bp, Artificial sequence
  Synthetic oligonucleotide
aaatatggtacacctctttacgtat

SEQ ID NO: 716224 - DNA, 25 bp, Artificial sequence
  Synthetic oligonucleotide
aaatatggtacagctctttacgtat

SEQ ID NO: 716225 - DNA, 25 bp, Artificial sequence
  Synthetic oligonucleotide
ttaatacgtgagcgtgctaaaagct

SEQ ID NO: 716226 - DNA, 25 bp, Artificial sequence
  Synthetic oligonucleotide
ttaatacgtgagggtgctaaaagct

SEQ ID NO: 716227 - DNA, 25 bp, Artificial sequence
  Synthetic oligonucleotide
tttatttctgcacggctgaaagcac

SEQ ID NO: 716228 - DNA, 25 bp, Artificial sequence
  Synthetic oligonucleotide
tttatttctgcagggctgaaagcac

SEQ ID NO: 716229 - DNA, 25 bp, Artificial sequence
  Synthetic oligonucleotide
ccataagcggagtaagagggaatga

SEQ ID NO: 716230 - DNA, 25 bp, Artificial sequence
  Synthetic oligonucleotide
gcgagcaaagcaatctcatcagtcg

SEQ ID NO: 716231 - DNA, 25 bp, Artificial sequence
  Synthetic oligonucleotide
aagagcagggaacaactgcggatgg

SEQ ID NO: 716232 - DNA, 25 bp, Artificial sequence
  Synthetic oligonucleotide
ctcgctgaggaagagggactttctt

SEQ ID NO: 716233 - DNA, 25 bp, Artificial sequence
  Synthetic oligonucleotide
tccggaggagagctatatacggctg

SEQ ID NO: 716234 - DNA, 25 bp, Artificial sequence
  Synthetic oligonucleotide
tccggaggagaggtatatacggctg

SEQ ID NO: 716235 - DNA, 25 bp, Artificial sequence
  Synthetic oligonucleotide
tttccggcagaacgcatccactttc

SEQ ID NO: 716236 - DNA, 25 bp, Artificial sequence
  Synthetic oligonucleotide
tttccggcagaaggcatccactttc

SEQ ID NO: 716237 - DNA, 25 bp, Artificial sequence
  Synthetic oligonucleotide
atggctgccattgacacaccgacgg

SEQ ID NO: 716238 - DNA, 25 bp, Artificial sequence
  Synthetic oligonucleotide
aagagcagggaagaactgcggatgg

SEQ ID NO: 716239 - DNA, 25 bp, Artificial sequence
  Synthetic oligonucleotide
ggatttaagcatttgttatatagaa

SEQ ID NO: 716240 - DNA, 25 bp, Artificial sequence
  Synthetic oligonucleotide
cgcatcggctgctttgtggtggata

SEQ ID NO: 716241 - DNA, 25 bp, Artificial sequence
  Synthetic oligonucleotide
atcgcgcttcttcaagacctatgta

SEQ ID NO: 716242 - DNA, 25 bp, Artificial sequence
  Synthetic oligonucleotide
atcgcgcttcttgaagacctatgta

SEQ ID NO: 716243 - DNA, 25 bp, Artificial sequence
  Synthetic oligonucleotide
gcgagcaaagcattctcatcagtcg

SEQ ID NO: 716244 - DNA, 25 bp, Artificial sequence
  Synthetic oligonucleotide
attgcgattgaggtcgggctttttt

SEQ ID NO: 716245 - DNA, 25 bp, Artificial sequence
  Synthetic oligonucleotide
cgcatcggctgcattgtggtggata

SEQ ID NO: 716246 - DNA, 25 bp, Artificial sequence
  Synthetic oligonucleotide
attatgaagggagagtccataaaac

SEQ ID NO: 716247 - DNA, 25 bp, Artificial sequence
  Synthetic oligonucleotide
atggctgccattcacacaccgacgg

SEQ ID NO: 716248 - DNA, 25 bp, Artificial sequence
  Synthetic oligonucleotide
gcaatgggtttaattgccgctgttc

SEQ ID NO: 716249 - DNA, 25 bp, Artificial sequence
  Synthetic oligonucleotide
attgcgattgagctcgggctttttt

SEQ ID NO: 716250 - DNA, 25 bp, Artificial sequence
  Synthetic oligonucleotide
attctgtacgtcacacttgcggcga

SEQ ID NO: 716251 - DNA, 25 bp, Artificial sequence
  Synthetic oligonucleotide
attctgtacgtctcacttgcggcga

SEQ ID NO: 716252 - DNA, 25 bp, Artificial sequence
  Synthetic oligonucleotide
acgacgcctagttatgaattaagct

SEQ ID NO: 716253 - DNA, 25 bp, Artificial sequence
  Synthetic oligonucleotide
acgacgcctagtaatgaattaagct

SEQ ID NO: 716254 - DNA, 25 bp, Artificial sequence
  Synthetic oligonucleotide
gagccgtcttgtcctcatgatactc

SEQ ID NO: 716255 - DNA, 25 bp, Artificial sequence
  Synthetic oligonucleotide
gagccgtcttgtgctcatgatactc

SEQ ID NO: 716256 - DNA, 25 bp, Artificial sequence
  Synthetic oligonucleotide
tcatataaaagggctcgtcatcgga

SEQ ID NO: 716257 - DNA, 25 bp, Artificial sequence
  Synthetic oligonucleotide
tcatataaaaggcctcgtcatcgga

SEQ ID NO: 716258 - DNA, 25 bp, Artificial sequence
  Synthetic oligonucleotide
aattatgccatggcaagcatcaaat

SEQ ID NO: 716259 - DNA, 25 bp, Artificial sequence
  Synthetic oligonucleotide
ggcgcaaaagtaagacccagcatcg

SEQ ID NO: 716260 - DNA, 25 bp, Artificial sequence
  Synthetic oligonucleotide
ccgtacttatgggcgctgattccct

SEQ ID NO: 716261 - DNA, 25 bp, Artificial sequence
  Synthetic oligonucleotide
ccgtacttatggccgctgattccct

SEQ ID NO: 716262 - DNA, 25 bp, Artificial sequence
  Synthetic oligonucleotide
gcgctgtggcagcttcttgtccgca

SEQ ID NO: 716263 - DNA, 25 bp, Artificial sequence
  Synthetic oligonucleotide
gcgctgtggcaggttcttgtccgca

SEQ ID NO: 716264 - DNA, 25 bp, Artificial sequence
  Synthetic oligonucleotide
tgaaactgactgaagagtatgataa

SEQ ID NO: 716265 - DNA, 25 bp, Artificial sequence
  Synthetic oligonucleotide
ggcgcaaaagtatgacccagcatcg

SEQ ID NO: 716266 - DNA, 25 bp, Artificial sequence
  Synthetic oligonucleotide
aatcgcttaagggagcctaccaatt

SEQ ID NO: 716267 - DNA, 25 bp, Artificial sequence
  Synthetic oligonucleotide
aattatgccatgccaagcatcaaat

SEQ ID NO: 716268 - DNA, 25 bp, Artificial sequence
  Synthetic oligonucleotide
tgaaactgactgtagagtatgataa

SEQ ID NO: 716269 - DNA, 25 bp, Artificial sequence
  Synthetic oligonucleotide
aatcgcttaaggcagcctaccaatt

SEQ ID NO: 716270 - DNA, 25 bp, Artificial sequence
  Synthetic oligonucleotide
gcaatgggtttatttgccgctgttc

SEQ ID NO: 716271 - DNA, 25 bp, Artificial sequence
  Synthetic oligonucleotide
attatgaagggacagtccataaaac

SEQ ID NO: 716272 - DNA, 25 bp, Artificial sequence
  Synthetic oligonucleotide
ggcgcgacttcgctttcggcgttcg

SEQ ID NO: 716273 - DNA, 25 bp, Artificial sequence
  Synthetic oligonucleotide
gtgccgctgccagcggcgcgacttc

SEQ ID NO: 716274 - DNA, 25 bp, Artificial sequence
  Synthetic oligonucleotide
tgccagcggcgcgacttcgctttcg

SEQ ID NO: 716275 - DNA, 25 bp, Artificial sequence
  Synthetic oligonucleotide
acttcgctttcggcgttcgccacgg

SEQ ID NO: 716276 - DNA, 25 bp, Artificial sequence
  Synthetic oligonucleotide
gctttcggcgttcgccacggcgctg

SEQ ID NO: 716277 - DNA, 25 bp, Artificial sequence
  Synthetic oligonucleotide
cgccacggcgctgcccagggccttc

SEQ ID NO: 716278 - DNA, 25 bp, Artificial sequence
  Synthetic oligonucleotide
gccagcgcggcgcgatagtcgcgtg

SEQ ID NO: 716279 - DNA, 25 bp, Artificial sequence
  Synthetic oligonucleotide
gcgctgcccagggccttctcggcgg

SEQ ID NO: 716280 - DNA, 25 bp, Artificial sequence
  Synthetic oligonucleotide
cccagggccttctcggcggcttcca

SEQ ID NO: 716281 - DNA, 25 bp, Artificial sequence
  Synthetic oligonucleotide
gccttctcggcggcttccaccagca

SEQ ID NO: 716282 - DNA, 25 bp, Artificial sequence
  Synthetic oligonucleotide
ggcgttcgccacggcgctgcccagg

SEQ ID NO: 716283 - DNA, 25 bp, Artificial sequence
  Synthetic oligonucleotide
gtcgcgtgccgctgccagcggcgcg

SEQ ID NO: 716284 - DNA, 25 bp, Artificial sequence
  Synthetic oligonucleotide
gcgatagtcgcgtgccgctgccagc

SEQ ID NO: 716285 - DNA, 25 bp, Artificial sequence
  Synthetic oligonucleotide
cactcgaccagtgcagtcacttcgt

SEQ ID NO: 716286 - DNA, 25 bp, Artificial sequence
  Synthetic oligonucleotide
accagtgcagtcacttcgtcgagca

SEQ ID NO: 716287 - DNA, 25 bp, Artificial sequence
  Synthetic oligonucleotide
aggcgggccagcgcggcgcgatagt

SEQ ID NO: 716288 - DNA, 25 bp, Artificial sequence
  Synthetic oligonucleotide
gccgccaggcgggccagcgcggcgc

SEQ ID NO: 716289 - DNA, 25 bp, Artificial sequence
  Synthetic oligonucleotide
cgcaaggccgccaggcgggccagcg

SEQ ID NO: 716290 - DNA, 25 bp, Artificial sequence
  Synthetic oligonucleotide
tcggcggcttccaccagcaggctgg

SEQ ID NO: 716291 - DNA, 25 bp, Artificial sequence
  Synthetic oligonucleotide
gcggccagggcctcggcttcaggca

SEQ ID NO: 716292 - DNA, 25 bp, Artificial sequence
  Synthetic oligonucleotide
tccaccggctcgcgcaaggccgcca

SEQ ID NO: 716293 - DNA, 25 bp, Artificial sequence
  Synthetic oligonucleotide
ggctcgcgcaaggccgccaggcggg

SEQ ID NO: 716294 - DNA, 25 bp, Artificial sequence
  Synthetic oligonucleotide
gcggcgcgatagtcgcgtgccgctg

SEQ ID NO: 716295 - DNA, 25 bp, Artificial sequence
  Synthetic oligonucleotide
tcgacacccgtttgttcgccgcggc

SEQ ID NO: 716296 - DNA, 25 bp, Artificial sequence
  Synthetic oligonucleotide
aacgtatccaccggctcgcgcaagg

SEQ ID NO: 716297 - DNA, 25 bp, Artificial sequence
  Synthetic oligonucleotide
gcgcatagcggttggcgcgcaccgc

SEQ ID NO: 716298 - DNA, 25 bp, Artificial sequence
  Synthetic oligonucleotide
cgctggtcgaagtccagcggcgagc

SEQ ID NO: 716299 - DNA, 25 bp, Artificial sequence
  Synthetic oligonucleotide
ctgtacgcgctggtcgaagtccagc

SEQ ID NO: 716300 - DNA, 25 bp, Artificial sequence
  Synthetic oligonucleotide
gacggcctgtacgcgctggtcgaag

SEQ ID NO: 716301 - DNA, 25 bp, Artificial sequence
  Synthetic oligonucleotide
ggcctggacggcctgtacgcgctgg

SEQ ID NO: 716302 - DNA, 25 bp, Artificial sequence
  Synthetic oligonucleotide
gcggaaggcctggacggcctgtacg

SEQ ID NO: 716303 - DNA, 25 bp, Artificial sequence
  Synthetic oligonucleotide
caactggcggaaggcctggacggcc

SEQ ID NO: 716304 - DNA, 25 bp, Artificial sequence
  Synthetic oligonucleotide
ttcaggcaactggcggaaggcctgg

SEQ ID NO: 716305 - DNA, 25 bp, Artificial sequence
  Synthetic oligonucleotide
tcggcttcaggcaactggcggaagg

SEQ ID NO: 716306 - DNA, 25 bp, Artificial sequence
  Synthetic oligonucleotide
cgtttgttcgccgcggccagggcct

SEQ ID NO: 716307 - DNA, 25 bp, Artificial sequence
  Synthetic oligonucleotide
ttcgccgcggccagggcctcggctt

SEQ ID NO: 716308 - DNA, 25 bp, Artificial sequence
  Synthetic oligonucleotide
gcttccaccagcaggctggcatcca

SEQ ID NO: 716309 - DNA, 25 bp, Artificial sequence
  Synthetic oligonucleotide
gaatattcgacacccgtttgttcgc

SEQ ID NO: 716310 - DNA, 25 bp, Artificial sequence
  Synthetic oligonucleotide
tggcgagaatattcgacacccgttt

SEQ ID NO: 716311 - DNA, 25 bp, Artificial sequence
  Synthetic oligonucleotide
cggacttggcgagaatattcgacac

SEQ ID NO: 716312 - DNA, 25 bp, Artificial sequence
  Synthetic oligonucleotide
cgtcctcggacttggcgagaatatt

SEQ ID NO: 716313 - DNA, 25 bp, Artificial sequence
  Synthetic oligonucleotide
gaacctcgtcctcggacttggcgag

SEQ ID NO: 716314 - DNA, 25 bp, Artificial sequence
  Synthetic oligonucleotide
cggcggaacctcgtcctcggacttg

SEQ ID NO: 716315 - DNA, 25 bp, Artificial sequence
  Synthetic oligonucleotide
cacgttcggcggaacctcgtcctcg

SEQ ID NO: 716316 - DNA, 25 bp, Artificial sequence
  Synthetic oligonucleotide
ggcatccacgttcggcggaacctcg

SEQ ID NO: 716317 - DNA, 25 bp, Artificial sequence
  Synthetic oligonucleotide
aggctggcatccacgttcggcggaa

SEQ ID NO: 716318 - DNA, 25 bp, Artificial sequence
  Synthetic oligonucleotide
ccagcaggctggcatccacgttcgg

SEQ ID NO: 716319 - DNA, 25 bp, Artificial sequence
  Synthetic oligonucleotide
agggcctcggcttcaggcaactggc

SEQ ID NO: 716320 - DNA, 25 bp, Artificial sequence
  Synthetic oligonucleotide
agggtatcgagcttgtcggccaccg

SEQ ID NO: 716321 - DNA, 25 bp, Artificial sequence
  Synthetic oligonucleotide
gcggccaggccggagacgcgctggg

SEQ ID NO: 716322 - DNA, 25 bp, Artificial sequence
  Synthetic oligonucleotide
ccttgctgccggtgggaagcatgcc

SEQ ID NO: 716323 - DNA, 25 bp, Artificial sequence
  Synthetic oligonucleotide
tgccggtgggaagcatgccgatgcc

SEQ ID NO: 716324 - DNA, 25 bp, Artificial sequence
  Synthetic oligonucleotide
gggaagcatgccgatgccgaagata

SEQ ID NO: 716325 - DNA, 25 bp, Artificial sequence
  Synthetic oligonucleotide
atgccgatgccgaagataccgacca

SEQ ID NO: 716326 - DNA, 25 bp, Artificial sequence
  Synthetic oligonucleotide
atgccgaagataccgaccagggtat

SEQ ID NO: 716327 - DNA, 25 bp, Artificial sequence
  Synthetic oligonucleotide
gcgcgtaggggtccttgctgccggt

SEQ ID NO: 716328 - DNA, 25 bp, Artificial sequence
  Synthetic oligonucleotide
ccgaccagggtatcgagcttgtcgg

SEQ ID NO: 716329 - DNA, 25 bp, Artificial sequence
  Synthetic oligonucleotide
ggcgcagcgcgtaggggtccttgct

SEQ ID NO: 716330 - DNA, 25 bp, Artificial sequence
  Synthetic oligonucleotide
tcgagcttgtcggccaccgccacgg

SEQ ID NO: 716331 - DNA, 25 bp, Artificial sequence
  Synthetic oligonucleotide
ttgtcggccaccgccacggcggcgc

SEQ ID NO: 716332 - DNA, 25 bp, Artificial sequence
  Synthetic oligonucleotide
gccaccgccacggcggcgccggtca

SEQ ID NO: 716333 - DNA, 25 bp, Artificial sequence
  Synthetic oligonucleotide
gccacggcggcgccggtcagggtcg

SEQ ID NO: 716334 - DNA, 25 bp, Artificial sequence
  Synthetic oligonucleotide
gcggcgccggtcagggtcgagggta

SEQ ID NO: 716335 - DNA, 25 bp, Artificial sequence
  Synthetic oligonucleotide
ccggtcagggtcgagggtagctcgg

SEQ ID NO: 716336 - DNA, 25 bp, Artificial sequence
  Synthetic oligonucleotide
agggtcgagggtagctcggcgccgg

SEQ ID NO: 716337 - DNA, 25 bp, Artificial sequence
  Synthetic oligonucleotide
aagataccgaccagggtatcgagct

SEQ ID NO: 716338 - DNA, 25 bp, Artificial sequence
  Synthetic oligonucleotide
aggtcgagctgcttctcgatgagga

SEQ ID NO: 716339 - DNA, 25 bp, Artificial sequence
  Synthetic oligonucleotide
ttgtcgccgtattgctcgacggcgg

SEQ ID NO: 716340 - DNA, 25 bp, Artificial sequence
  Synthetic oligonucleotide
ccgtattgctcgacggcggcgttga

SEQ ID NO: 716341 - DNA, 25 bp, Artificial sequence
  Synthetic oligonucleotide
tgctcgacggcggcgttgaccgcgg

SEQ ID NO: 716342 - DNA, 25 bp, Artificial sequence
  Synthetic oligonucleotide
acggcggcgttgaccgcggctacca

SEQ ID NO: 716343 - DNA, 25 bp, Artificial sequence
  Synthetic oligonucleotide
cgttgaccgcggctaccaggtccag

SEQ ID NO: 716344 - DNA, 25 bp, Artificial sequence
  Synthetic oligonucleotide
accgcggctaccaggtccaggtcga

SEQ ID NO: 716345 - DNA, 25 bp, Artificial sequence
  Synthetic oligonucleotide
aggggtccttgctgccggtgggaag

SEQ ID NO: 716346 - DNA, 25 bp, Artificial sequence
  Synthetic oligonucleotide
aggtccaggtcgagctgcttctcga

SEQ ID NO: 716347 - DNA, 25 bp, Artificial sequence
  Synthetic oligonucleotide
gcgccggcgccgcgcggcatgtact

SEQ ID NO: 716348 - DNA, 25 bp, Artificial sequence
  Synthetic oligonucleotide
agctgcttctcgatgaggatgcgca

SEQ ID NO: 716349 - DNA, 25 bp, Artificial sequence
  Synthetic oligonucleotide
ttctcgatgaggatgcgcagcacgc

SEQ ID NO: 716350 - DNA, 25 bp, Artificial sequence
  Synthetic oligonucleotide
atgaggatgcgcagcacgcccagcg

SEQ ID NO: 716351 - DNA, 25 bp, Artificial sequence
  Synthetic oligonucleotide
atgcgcagcacgcccagcgcagcgc

SEQ ID NO: 716352 - DNA, 25 bp, Artificial sequence
  Synthetic oligonucleotide
agcacgcccagcgcagcgcggcgca

SEQ ID NO: 716353 - DNA, 25 bp, Artificial sequence
  Synthetic oligonucleotide
ccagcgcagcgcggcgcagcgcgta

SEQ ID NO: 716354 - DNA, 25 bp, Artificial sequence
  Synthetic oligonucleotide
cagcgcggcgcagcgcgtaggggtc

SEQ ID NO: 716355 - DNA, 25 bp, Artificial sequence
  Synthetic oligonucleotide
gctaccaggtccaggtcgagctgct

SEQ ID NO: 716356 - DNA, 25 bp, Artificial sequence
  Synthetic oligonucleotide
cgcgcgaggcgttctgcgcattgcc

SEQ ID NO: 716357 - DNA, 25 bp, Artificial sequence
  Synthetic oligonucleotide
actcgccgaccatctcggtcgccag

SEQ ID NO: 716358 - DNA, 25 bp, Artificial sequence
  Synthetic oligonucleotide
cgaccatctcggtcgccaggtcaca

SEQ ID NO: 716359 - DNA, 25 bp, Artificial sequence
  Synthetic oligonucleotide
tctcggtcgccaggtcacacttgga

SEQ ID NO: 716360 - DNA, 25 bp, Artificial sequence
  Synthetic oligonucleotide
tcgccaggtcacacttggacaggat

SEQ ID NO: 716361 - DNA, 25 bp, Artificial sequence
  Synthetic oligonucleotide
ggtcacacttggacaggatgccggc

SEQ ID NO: 716362 - DNA, 25 bp, Artificial sequence
  Synthetic oligonucleotide
acttggacaggatgccggcgcgcga

SEQ ID NO: 716363 - DNA, 25 bp, Artificial sequence
  Synthetic oligonucleotide
gagggtagctcggcgccggcgccgc

SEQ ID NO: 716364 - DNA, 25 bp, Artificial sequence
  Synthetic oligonucleotide
tgccggcgcgcgaggcgttctgcgc

SEQ ID NO: 716365 - DNA, 25 bp, Artificial sequence
  Synthetic oligonucleotide
tgccctgcatttcggggaactcgcc

SEQ ID NO: 716366 - DNA, 25 bp, Artificial sequence
  Synthetic oligonucleotide
aggcgttctgcgcattgccgcctat

SEQ ID NO: 716367 - DNA, 25 bp, Artificial sequence
  Synthetic oligonucleotide
tctgcgcattgccgcctatacgttc

SEQ ID NO: 716368 - DNA, 25 bp, Artificial sequence
  Synthetic oligonucleotide
cattgccgcctatacgttcggcgat

SEQ ID NO: 716369 - DNA, 25 bp, Artificial sequence
  Synthetic oligonucleotide
cgcctatacgttcggcgatgtaggc

SEQ ID NO: 716370 - DNA, 25 bp, Artificial sequence
  Synthetic oligonucleotide
tacgttcggcgatgtaggcggccag

SEQ ID NO: 716371 - DNA, 25 bp, Artificial sequence
  Synthetic oligonucleotide
tcggcgatgtaggcggccaggccgg

SEQ ID NO: 716372 - DNA, 25 bp, Artificial sequence
  Synthetic oligonucleotide
tcgagcactgccaggtcgtaatagc

SEQ ID NO: 716373 - DNA, 25 bp, Artificial sequence
  Synthetic oligonucleotide
acaggatgccggcgcgcgaggcgtt

SEQ ID NO: 716374 - DNA, 25 bp, Artificial sequence
  Synthetic oligonucleotide
tccgcttcgccgccgtgggtggcgt

SEQ ID NO: 716375 - DNA, 25 bp, Artificial sequence
  Synthetic oligonucleotide
aggccggcggccttgaccttgtcgc

SEQ ID NO: 716376 - DNA, 25 bp, Artificial sequence
  Synthetic oligonucleotide
gcgccgcgcggcatgtactgctcgt

SEQ ID NO: 716377 - DNA, 25 bp, Artificial sequence
  Synthetic oligonucleotide
cgcggcatgtactgctcgttgaggg

SEQ ID NO: 716378 - DNA, 25 bp, Artificial sequence
  Synthetic oligonucleotide
catgtactgctcgttgagggccagg

SEQ ID NO: 716379 - DNA, 25 bp, Artificial sequence
  Synthetic oligonucleotide
actgctcgttgagggccagggcgac

SEQ ID NO: 716380 - DNA, 25 bp, Artificial sequence
  Synthetic oligonucleotide
cgttgagggccagggcgacgtcttc

SEQ ID NO: 716381 - DNA, 25 bp, Artificial sequence
  Synthetic oligonucleotide
agggccagggcgacgtcttccgctt

SEQ ID NO: 716382 - DNA, 25 bp, Artificial sequence
  Synthetic oligonucleotide
cggggaactcgccgaccatctcggt

SEQ ID NO: 716383 - DNA, 25 bp, Artificial sequence
  Synthetic oligonucleotide
acgtcttccgcttcgccgccgtggg

SEQ ID NO: 716384 - DNA, 25 bp, Artificial sequence
  Synthetic oligonucleotide
gcatttcggggaactcgccgaccat

SEQ ID NO: 716385 - DNA, 25 bp, Artificial sequence
  Synthetic oligonucleotide
tcgccgccgtgggtggcgtagtagt

SEQ ID NO: 716386 - DNA, 25 bp, Artificial sequence
  Synthetic oligonucleotide
ccgtgggtggcgtagtagtagccgg

SEQ ID NO: 716387 - DNA, 25 bp, Artificial sequence
  Synthetic oligonucleotide
gtggcgtagtagtagccggcgatgc

SEQ ID NO: 716388 - DNA, 25 bp, Artificial sequence
  Synthetic oligonucleotide
gtagtagtagccggcgatgccctgc

SEQ ID NO: 716389 - DNA, 25 bp, Artificial sequence
  Synthetic oligonucleotide
gtagccggcgatgccctgcatttcg

SEQ ID NO: 716390 - DNA, 25 bp, Artificial sequence
  Synthetic oligonucleotide
ggcgatgccctgcatttcggggaac

SEQ ID NO: 716391 - DNA, 25 bp, Artificial sequence
  Synthetic oligonucleotide
agctcggcgccggcgccgcgcggca

SEQ ID NO: 716392 - DNA, 25 bp, Artificial sequence
  Synthetic oligonucleotide
agggcgacgtcttccgcttcgccgc

SEQ ID NO: 716393 - DNA, 25 bp, Artificial sequence
  Synthetic oligonucleotide
cgacgaaccagatacccgacagatc

SEQ ID NO: 716394 - DNA, 25 bp, Artificial sequence
  Synthetic oligonucleotide
tgccgcagcatacccggcttcggct

SEQ ID NO: 716395 - DNA, 25 bp, Artificial sequence
  Synthetic oligonucleotide
cgatctgccgcagcatacccggctt

SEQ ID NO: 716396 - DNA, 25 bp, Artificial sequence
  Synthetic oligonucleotide
gctcgccgatctgccgcagcatacc

SEQ ID NO: 716397 - DNA, 25 bp, Artificial sequence
  Synthetic oligonucleotide
cgtagtgctcgccgatctgccgcag

SEQ ID NO: 716398 - DNA, 25 bp, Artificial sequence
  Synthetic oligonucleotide
tcgaccccgtagtgctcgccgatct

SEQ ID NO: 716399 - DNA, 25 bp, Artificial sequence
  Synthetic oligonucleotide
gacagatcgaccccgtagtgctcgc

SEQ ID NO: 716400 - DNA, 25 bp, Artificial sequence
  Synthetic oligonucleotide
cggctgacaatcgacggcccgcgcc

SEQ ID NO: 716401 - DNA, 25 bp, Artificial sequence
  Synthetic oligonucleotide
accagatacccgacagatcgacccc

SEQ ID NO: 716402 - DNA, 25 bp, Artificial sequence
  Synthetic oligonucleotide
tcggcttgcggcagtcgcaaccgtc

SEQ ID NO: 716403 - DNA, 25 bp, Artificial sequence
  Synthetic oligonucleotide
tgtcgccgacgaaccagatacccga

SEQ ID NO: 716404 - DNA, 25 bp, Artificial sequence
  Synthetic oligonucleotide
ccgatgctgtcgccgacgaaccaga

SEQ ID NO: 716405 - DNA, 25 bp, Artificial sequence
  Synthetic oligonucleotide
aggtcaccgatgctgtcgccgacga

SEQ ID NO: 716406 - DNA, 25 bp, Artificial sequence
  Synthetic oligonucleotide
cgcctccaggtcaccgatgctgtcg

SEQ ID NO: 716407 - DNA, 25 bp, Artificial sequence
  Synthetic oligonucleotide
ccgcgccgcctccaggtcaccgatg

SEQ ID NO: 716408 - DNA, 25 bp, Artificial sequence
  Synthetic oligonucleotide
gacggcccgcgccgcctccaggtca

SEQ ID NO: 716409 - DNA, 25 bp, Artificial sequence
  Synthetic oligonucleotide
ttgaccttgtcgccgtattgctcga

SEQ ID NO: 716410 - DNA, 25 bp, Artificial sequence
  Synthetic oligonucleotide
tacccgacagatcgaccccgtagtg

SEQ ID NO: 716411 - DNA, 25 bp, Artificial sequence
  Synthetic oligonucleotide
aatagacgatgaggccgacctcgcc

SEQ ID NO: 716412 - DNA, 25 bp, Artificial sequence
  Synthetic oligonucleotide
atggcctcgagcactgccaggtcgt

SEQ ID NO: 716413 - DNA, 25 bp, Artificial sequence
  Synthetic oligonucleotide
gcatgcatggcctcgagcactgcca

SEQ ID NO: 716414 - DNA, 25 bp, Artificial sequence
  Synthetic oligonucleotide
caagcgcgcatgcatggcctcgagc

SEQ ID NO: 716415 - DNA, 25 bp, Artificial sequence
  Synthetic oligonucleotide
ttcgcgcaagcgcgcatgcatggcc

SEQ ID NO: 716416 - DNA, 25 bp, Artificial sequence
  Synthetic oligonucleotide
gaccagttcgcgcaagcgcgcatgc

SEQ ID NO: 716417 - DNA, 25 bp, Artificial sequence
  Synthetic oligonucleotide
gccctgctccgcgaccagttcgcgc

SEQ ID NO: 716418 - DNA, 25 bp, Artificial sequence
  Synthetic oligonucleotide
acctggtgctttgggacactccgct

SEQ ID NO: 716419 - DNA, 25 bp, Artificial sequence
  Synthetic oligonucleotide
agcatacccggcttcggcttgcggc

SEQ ID NO: 716420 - DNA, 25 bp, Artificial sequence
  Synthetic oligonucleotide
cgatgaggccgacctcgccgccctg

SEQ ID NO: 716421 - DNA, 25 bp, Artificial sequence
  Synthetic oligonucleotide
ccggcttcggcttgcggcagtcgca

SEQ ID NO: 716422 - DNA, 25 bp, Artificial sequence
  Synthetic oligonucleotide
cggacaatagacgatgaggccgacc

SEQ ID NO: 716423 - DNA, 25 bp, Artificial sequence
  Synthetic oligonucleotide
gtccatgcggacaatagacgatgag

SEQ ID NO: 716424 - DNA, 25 bp, Artificial sequence
  Synthetic oligonucleotide
cgtccggtccatgcggacaatagac

SEQ ID NO: 716425 - DNA, 25 bp, Artificial sequence
  Synthetic oligonucleotide
aaccgtcgtccggtccatgcggaca

SEQ ID NO: 716426 - DNA, 25 bp, Artificial sequence
  Synthetic oligonucleotide
agtcgcaaccgtcgtccggtccatg

SEQ ID NO: 716427 - DNA, 25 bp, Artificial sequence
  Synthetic oligonucleotide
tgcggcagtcgcaaccgtcgtccgg

SEQ ID NO: 716428 - DNA, 25 bp, Artificial sequence
  Synthetic oligonucleotide
caataccggctgacaatcgacggcc

SEQ ID NO: 716429 - DNA, 25 bp, Artificial sequence
  Synthetic oligonucleotide
ggccgacctcgccgccctgctccgc

SEQ ID NO: 716430 - DNA, 25 bp, Artificial sequence
  Synthetic oligonucleotide
gcaggcggtcgaacacgaagtccag

SEQ ID NO: 716431 - DNA, 25 bp, Artificial sequence
  Synthetic oligonucleotide
accgactggtacacggccacgtcca

SEQ ID NO: 716432 - DNA, 25 bp, Artificial sequence
  Synthetic oligonucleotide
tggtacacggccacgtccacgcctt

SEQ ID NO: 716433 - DNA, 25 bp, Artificial sequence
  Synthetic oligonucleotide
acggccacgtccacgccttcgtcct

SEQ ID NO: 716434 - DNA, 25 bp, Artificial sequence
  Synthetic oligonucleotide
acgtccacgccttcgtcctcgtagc

SEQ ID NO: 716435 - DNA, 25 bp, Artificial sequence
  Synthetic oligonucleotide
acgccttcgtcctcgtagcgcgcgc

SEQ ID NO: 716436 - DNA, 25 bp, Artificial sequence
  Synthetic oligonucleotide
ttcgtcctcgtagcgcgcgcgcagg

SEQ ID NO: 716437 - DNA, 25 bp, Artificial sequence
  Synthetic oligonucleotide
acaatcgacggcccgcgccgcctcc

SEQ ID NO: 716438 - DNA, 25 bp, Artificial sequence
  Synthetic oligonucleotide
cgcgcgcgcaggcggtcgaacacga

SEQ ID NO: 716439 - DNA, 25 bp, Artificial sequence
  Synthetic oligonucleotide
cttggcttgagcgcgcgcaccgact

SEQ ID NO: 716440 - DNA, 25 bp, Artificial sequence
  Synthetic oligonucleotide
ggtcgaacacgaagtccagcacctg

SEQ ID NO: 716441 - DNA, 25 bp, Artificial sequence
  Synthetic oligonucleotide
aacacgaagtccagcacctgctcgg

SEQ ID NO: 716442 - DNA, 25 bp, Artificial sequence
  Synthetic oligonucleotide
gaagtccagcacctgctcggccagg

SEQ ID NO: 716443 - DNA, 25 bp, Artificial sequence
  Synthetic oligonucleotide
cagcacctgctcggccaggccggcg

SEQ ID NO: 716444 - DNA, 25 bp, Artificial sequence
  Synthetic oligonucleotide
cctgctcggccaggccggcggcctt

SEQ ID NO: 716445 - DNA, 25 bp, Artificial sequence
  Synthetic oligonucleotide
tcggccaggccggcggccttgacct

SEQ ID NO: 716446 - DNA, 25 bp, Artificial sequence
  Synthetic oligonucleotide
aggccggagacgcgctgggccttct

SEQ ID NO: 716447 - DNA, 25 bp, Artificial sequence
  Synthetic oligonucleotide
tcgtagcgcgcgcgcaggcggtcga

SEQ ID NO: 716448 - DNA, 25 bp, Artificial sequence
  Synthetic oligonucleotide
tgccgccagatcgtcgaatatcagg

SEQ ID NO: 716449 - DNA, 25 bp, Artificial sequence
  Synthetic oligonucleotide
ctttaccaataccggctgacaatcg

SEQ ID NO: 716450 - DNA, 25 bp, Artificial sequence
  Synthetic oligonucleotide
tccggtctttaccaataccggctga

SEQ ID NO: 716451 - DNA, 25 bp, Artificial sequence
  Synthetic oligonucleotide
ttgcccagcgtacgtacaccttttc

SEQ ID NO: 716452 - DNA, 25 bp, Artificial sequence
  Synthetic oligonucleotide
aagggcttgcccagcgtacgtacac

SEQ ID NO: 716453 - DNA, 25 bp, Artificial sequence
  Synthetic oligonucleotide
tctggcaagggcttgcccagcgtac

SEQ ID NO: 716454 - DNA, 25 bp, Artificial sequence
  Synthetic oligonucleotide
gtgccctctggcaagggcttgccca

SEQ ID NO: 716455 - DNA, 25 bp, Artificial sequence
  Synthetic oligonucleotide
atcagggtgccctctggcaagggct

SEQ ID NO: 716456 - DNA, 25 bp, Artificial sequence
  Synthetic oligonucleotide
gcgcgcaccgactggtacacggcca

SEQ ID NO: 716457 - DNA, 25 bp, Artificial sequence
  Synthetic oligonucleotide
cagatcgtcgaatatcagggtgccc

SEQ ID NO: 716458 - DNA, 25 bp, Artificial sequence
  Synthetic oligonucleotide
ttgagcgcgcgcaccgactggtaca

SEQ ID NO: 716459 - DNA, 25 bp, Artificial sequence
  Synthetic oligonucleotide
ggcgactgccgccagatcgtcgaat

SEQ ID NO: 716460 - DNA, 25 bp, Artificial sequence
  Synthetic oligonucleotide
tgcgctggcgactgccgccagatcg

SEQ ID NO: 716461 - DNA, 25 bp, Artificial sequence
  Synthetic oligonucleotide
agtaatgcgctggcgactgccgcca

SEQ ID NO: 716462 - DNA, 25 bp, Artificial sequence
  Synthetic oligonucleotide
tactgaagtaatgcgctggcgactg

SEQ ID NO: 716463 - DNA, 25 bp, Artificial sequence
  Synthetic oligonucleotide
tccagcggcgagcttggcttgagcg

SEQ ID NO: 716464 - DNA, 25 bp, Artificial sequence
  Synthetic oligonucleotide
ggcgagcttggcttgagcgcgcgca

SEQ ID NO: 716465 - DNA, 25 bp, Artificial sequence
  Synthetic oligonucleotide
gcggccttgaccttgtcgccgtatt

SEQ ID NO: 716466 - DNA, 25 bp, Artificial sequence
  Synthetic oligonucleotide
tcgaatatcagggtgccctctggca

SEQ ID NO: 716467 - DNA, 25 bp, Artificial sequence
  Synthetic oligonucleotide
tcaaggacctggtgctttgggacac

SEQ ID NO: 716468 - DNA, 25 bp, Artificial sequence
  Synthetic oligonucleotide
atgtaggcggccaggccggagacgc

SEQ ID NO: 716469 - DNA, 25 bp, Artificial sequence
  Synthetic oligonucleotide
accgacgaaggtggctgcgtggagt

SEQ ID NO: 716470 - DNA, 25 bp, Artificial sequence
  Synthetic oligonucleotide
gaaggtggctgcgtggagtgccacg

SEQ ID NO: 716471 - DNA, 25 bp, Artificial sequence
  Synthetic oligonucleotide
ggctgcgtggagtgccacggcatcc

SEQ ID NO: 716472 - DNA, 25 bp, Artificial sequence
  Synthetic oligonucleotide
gtggagtgccacggcatccggatca

SEQ ID NO: 716473 - DNA, 25 bp, Artificial sequence
  Synthetic oligonucleotide
gtgccacggcatccggatcaaggac

SEQ ID NO: 716474 - DNA, 25 bp, Artificial sequence
  Synthetic oligonucleotide
ttcgcccgcaagaccgacgaaggtg

SEQ ID NO: 716475 - DNA, 25 bp, Artificial sequence
  Synthetic oligonucleotide
tccggatcaaggacctggtgctttg

SEQ ID NO: 716476 - DNA, 25 bp, Artificial sequence
  Synthetic oligonucleotide
ctgatcttcgcccgcaagaccgacg

SEQ ID NO: 716477 - DNA, 25 bp, Artificial sequence
  Synthetic oligonucleotide
gaaacccggcaactgctgaccgcct

SEQ ID NO: 716478 - DNA, 25 bp, Artificial sequence
  Synthetic oligonucleotide
accgacgaaacccggcaactgctga

SEQ ID NO: 716479 - DNA, 25 bp, Artificial sequence
  Synthetic oligonucleotide
gtgatgaccgacgaaacccggcaac

SEQ ID NO: 716480 - DNA, 25 bp, Artificial sequence
  Synthetic oligonucleotide
gaaagcgtgatgaccgacgaaaccc

SEQ ID NO: 716481 - DNA, 25 bp, Artificial sequence
  Synthetic oligonucleotide
aagccggaaagcgtgatgaccgacg

SEQ ID NO: 716482 - DNA, 25 bp, Artificial sequence
  Synthetic oligonucleotide
gcggtcaagccggaaagcgtgatga

SEQ ID NO: 716483 - DNA, 25 bp, Artificial sequence
  Synthetic oligonucleotide
gcggcggcggtcaagccggaaagcg

SEQ ID NO: 716484 - DNA, 25 bp, Artificial sequence
  Synthetic oligonucleotide
acggcatccggatcaaggacctggt

SEQ ID NO: 716485 - DNA, 25 bp, Artificial sequence
  Synthetic oligonucleotide
cgaagtggccctgggcggtggacaa

SEQ ID NO: 716486 - DNA, 25 bp, Artificial sequence
  Synthetic oligonucleotide
cacgggctgggcaagctggaagacc

SEQ ID NO: 716487 - DNA, 25 bp, Artificial sequence
  Synthetic oligonucleotide
ctgggcaagctggaagacctgatca

SEQ ID NO: 716488 - DNA, 25 bp, Artificial sequence
  Synthetic oligonucleotide
aagctggaagacctgatcaagaaga

SEQ ID NO: 716489 - DNA, 25 bp, Artificial sequence
  Synthetic oligonucleotide
gaagacctgatcaagaagatcggcc

SEQ ID NO: 716490 - DNA, 25 bp, Artificial sequence
  Synthetic oligonucleotide
ctgatcaagaagatcggcccgccga

SEQ ID NO: 716491 - DNA, 25 bp, Artificial sequence
  Synthetic oligonucleotide
aagaagatcggcccgccgaagtggc

SEQ ID NO: 716492 - DNA, 25 bp, Artificial sequence
  Synthetic oligonucleotide
cgcaagaccgacgaaggtggctgcg

SEQ ID NO: 716493 - DNA, 25 bp, Artificial sequence
  Synthetic oligonucleotide
cccgccgaagtggccctgggcggtg

SEQ ID NO: 716494 - DNA, 25 bp, Artificial sequence
  Synthetic oligonucleotide
gagaagcacgatgccaaggcggcgg

SEQ ID NO: 716495 - DNA, 25 bp, Artificial sequence
  Synthetic oligonucleotide
ggccctgggcggtggacaagcacct

SEQ ID NO: 716496 - DNA, 25 bp, Artificial sequence
  Synthetic oligonucleotide
gggcggtggacaagcacctggccag

SEQ ID NO: 716497 - DNA, 25 bp, Artificial sequence
  Synthetic oligonucleotide
tggacaagcacctggccaggaaagg

SEQ ID NO: 716498 - DNA, 25 bp, Artificial sequence
  Synthetic oligonucleotide
agcacctggccaggaaaggcgcgct

SEQ ID NO: 716499 - DNA, 25 bp, Artificial sequence
  Synthetic oligonucleotide
tggccaggaaaggcgcgctgatctt

SEQ ID NO: 716500 - DNA, 25 bp, Artificial sequence
  Synthetic oligonucleotide
ggaaaggcgcgctgatcttcgcccg

SEQ ID NO: 716501 - DNA, 25 bp, Artificial sequence
  Synthetic oligonucleotide
ggcgcgctgatcttcgcccgcaaga

SEQ ID NO: 716502 - DNA, 25 bp, Artificial sequence
  Synthetic oligonucleotide
atcggcccgccgaagtggccctggg

SEQ ID NO: 716503 - DNA, 25 bp, Artificial sequence
  Synthetic oligonucleotide
gccagcacgccatcctcgatggcca

SEQ ID NO: 716504 - DNA, 25 bp, Artificial sequence
  Synthetic oligonucleotide
tggagggcgcgcggatgccgttcgg

SEQ ID NO: 716505 - DNA, 25 bp, Artificial sequence
  Synthetic oligonucleotide
gcgtgatggagggcgcgcggatgcc

SEQ ID NO: 716506 - DNA, 25 bp, Artificial sequence
  Synthetic oligonucleotide
agaccggcgtgatggagggcgcgcg

SEQ ID NO: 716507 - DNA, 25 bp, Artificial sequence
  Synthetic oligonucleotide
aggtgcagaccggcgtgatggaggg

SEQ ID NO: 716508 - DNA, 25 bp, Artificial sequence
  Synthetic oligonucleotide
atggccaggtgcagaccggcgtgat

SEQ ID NO: 716509 - DNA, 25 bp, Artificial sequence
  Synthetic oligonucleotide
tcctcgatggccaggtgcagaccgg

SEQ ID NO: 716510 - DNA, 25 bp, Artificial sequence
  Synthetic oligonucleotide
gccaaggcggcggcggtcaagccgg

SEQ ID NO: 716511 - DNA, 25 bp, Artificial sequence
  Synthetic oligonucleotide
tcgaagtccagcggcgagcttggct

SEQ ID NO: 716512 - DNA, 25 bp, Artificial sequence
  Synthetic oligonucleotide
ttcggccagccgctgaaggcgaccg

SEQ ID NO: 716513 - DNA, 25 bp, Artificial sequence
  Synthetic oligonucleotide
acagccgccagcacgccatcctcga

SEQ ID NO: 716514 - DNA, 25 bp, Artificial sequence
  Synthetic oligonucleotide
gcagcgacagccgccagcacgccat

SEQ ID NO: 716515 - DNA, 25 bp, Artificial sequence
  Synthetic oligonucleotide
acgtcggcagcgacagccgccagca

SEQ ID NO: 716516 - DNA, 25 bp, Artificial sequence
  Synthetic oligonucleotide
tgagggacgtcggcagcgacagccg

SEQ ID NO: 716517 - DNA, 25 bp, Artificial sequence
  Synthetic oligonucleotide
ctccgctgagggacgtcggcagcga

SEQ ID NO: 716518 - DNA, 25 bp, Artificial sequence
  Synthetic oligonucleotide
gggacactccgctgagggacgtcgg

SEQ ID NO: 716519 - DNA, 25 bp, Artificial sequence
  Synthetic oligonucleotide
tgctttgggacactccgctgaggga

SEQ ID NO: 716520 - DNA, 25 bp, Artificial sequence
  Synthetic oligonucleotide
acgccatcctcgatggccaggtgca

SEQ ID NO: 716521 - DNA, 25 bp, Artificial sequence
  Synthetic oligonucleotide
ctcgccgtagcggtggccggttcga

SEQ ID NO: 716522 - DNA, 25 bp, Artificial sequence
  Synthetic oligonucleotide
atcaactcggccaacttccacgggc

SEQ ID NO: 716523 - DNA, 25 bp, Artificial sequence
  Synthetic oligonucleotide
tcggtgagaagcacgatgccaaggc

SEQ ID NO: 716524 - DNA, 25 bp, Artificial sequence
  Synthetic oligonucleotide
gatcctcggtgagaagcacgatgcc

SEQ ID NO: 716525 - DNA, 25 bp, Artificial sequence
  Synthetic oligonucleotide
cgtgccgatcctcggtgagaagcac

SEQ ID NO: 716526 - DNA, 25 bp, Artificial sequence
  Synthetic oligonucleotide
gcacttcgtgccgatcctcggtgag

SEQ ID NO: 716527 - DNA, 25 bp, Artificial sequence
  Synthetic oligonucleotide
cctgcagcacttcgtgccgatcctc

SEQ ID NO: 716528 - DNA, 25 bp, Artificial sequence
  Synthetic oligonucleotide
gttcgatcctgcagcacttcgtgcc

SEQ ID NO: 716529 - DNA, 25 bp, Artificial sequence
  Synthetic oligonucleotide
cgcgcggatgccgttcggccagccg

SEQ ID NO: 716530 - DNA, 25 bp, Artificial sequence
  Synthetic oligonucleotide
tagcggtggccggttcgatcctgca

SEQ ID NO: 716531 - DNA, 25 bp, Artificial sequence
  Synthetic oligonucleotide
atgccgttcggccagccgctgaagg

SEQ ID NO: 716532 - DNA, 25 bp, Artificial sequence
  Synthetic oligonucleotide
gatgtactcgccgtagcggtggccg

SEQ ID NO: 716533 - DNA, 25 bp, Artificial sequence
  Synthetic oligonucleotide
gccttcgatgtactcgccgtagcgg

SEQ ID NO: 716534 - DNA, 25 bp, Artificial sequence
  Synthetic oligonucleotide
gacggagccttcgatgtactcgccg

SEQ ID NO: 716535 - DNA, 25 bp, Artificial sequence
  Synthetic oligonucleotide
gcgaccgacggagccttcgatgtac

SEQ ID NO: 716536 - DNA, 25 bp, Artificial sequence
  Synthetic oligonucleotide
ctgaaggcgaccgacggagccttcg

SEQ ID NO: 716537 - DNA, 25 bp, Artificial sequence
  Synthetic oligonucleotide
cagccgctgaaggcgaccgacggag

SEQ ID NO: 716538 - DNA, 25 bp, Artificial sequence
  Synthetic oligonucleotide
cacgatgccaaggcggcggcggtca

SEQ ID NO: 716539 - DNA, 25 bp, Artificial sequence
  Synthetic oligonucleotide
tggccggttcgatcctgcagcactt

SEQ ID NO: 716540 - DNA, 25 bp, Artificial sequence
  Synthetic oligonucleotide
cgatgttctccggcgccttgctctc

SEQ ID NO: 716541 - DNA, 25 bp, Artificial sequence
  Synthetic oligonucleotide
ttggcgcgcaccgccgcgtcgtcga

SEQ ID NO: 716542 - DNA, 25 bp, Artificial sequence
  Synthetic oligonucleotide
gcgtcggtgaggcgcgggcgaacca

SEQ ID NO: 716543 - DNA, 25 bp, Artificial sequence
  Synthetic oligonucleotide
gcgaagaacgtatccaccggctcgc

SEQ ID NO: 716544 - DNA, 25 bp, Artificial sequence
  Synthetic oligonucleotide
tgaggcgcgggcgaaccaccttctc

SEQ ID NO: 716545 - DNA, 25 bp, Artificial sequence
  Synthetic oligonucleotide
gcgaaccaccttctcgttaccgctg

SEQ ID NO: 716546 - DNA, 25 bp, Artificial sequence
  Synthetic oligonucleotide
caccttctcgttaccgctgacgatg

SEQ ID NO: 716547 - DNA, 25 bp, Artificial sequence
  Synthetic oligonucleotide
gaggcagcagcttgccgttggcgtc

SEQ ID NO: 716548 - DNA, 25 bp, Artificial sequence
  Synthetic oligonucleotide
cgctgacgatgttctccggcgcctt

SEQ ID NO: 716549 - DNA, 25 bp, Artificial sequence
  Synthetic oligonucleotide
tgcttgaagaagaactcggcgtcgg

SEQ ID NO: 716550 - DNA, 25 bp, Artificial sequence
  Synthetic oligonucleotide
tctccggcgccttgctctcgacgtt

SEQ ID NO: 716551 - DNA, 25 bp, Artificial sequence
  Synthetic oligonucleotide
gcgccttgctctcgacgttggcgac

SEQ ID NO: 716552 - DNA, 25 bp, Artificial sequence
  Synthetic oligonucleotide
tgctctcgacgttggcgacggtgat

SEQ ID NO: 716553 - DNA, 25 bp, Artificial sequence
  Synthetic oligonucleotide
cgacgttggcgacggtgatgaagcg

SEQ ID NO: 716554 - DNA, 25 bp, Artificial sequence
  Synthetic oligonucleotide
tggcgacggtgatgaagcgaggcag

SEQ ID NO: 716555 - DNA, 25 bp, Artificial sequence
  Synthetic oligonucleotide
cggtgatgaagcgaggcagcagctt

SEQ ID NO: 716556 - DNA, 25 bp, Artificial sequence
  Synthetic oligonucleotide
caacttccacgggctgggcaagctg

SEQ ID NO: 716557 - DNA, 25 bp, Artificial sequence
  Synthetic oligonucleotide
tcgttaccgctgacgatgttctccg

SEQ ID NO: 716558 - DNA, 25 bp, Artificial sequence
  Synthetic oligonucleotide
tgcgcaggcgctcattgaagctttc

SEQ ID NO: 716559 - DNA, 25 bp, Artificial sequence
  Synthetic oligonucleotide
gagacgcgctgggccttctcgaaca

SEQ ID NO: 716560 - DNA, 25 bp, Artificial sequence
  Synthetic oligonucleotide
cgctgggccttctcgaacacggtgc

SEQ ID NO: 716561 - DNA, 25 bp, Artificial sequence
  Synthetic oligonucleotide
gccttctcgaacacggtgccgagct

SEQ ID NO: 716562 - DNA, 25 bp, Artificial sequence
  Synthetic oligonucleotide
tcgaacacggtgccgagctgggcct

SEQ ID NO: 716563 - DNA, 25 bp, Artificial sequence
  Synthetic oligonucleotide
acggtgccgagctgggcctggaaca

SEQ ID NO: 716564 - DNA, 25 bp, Artificial sequence
  Synthetic oligonucleotide
ccgagctgggcctggaacactacgt

SEQ ID NO: 716565 - DNA, 25 bp, Artificial sequence
  Synthetic oligonucleotide
tgggcctggaacactacgttgcgca

SEQ ID NO: 716566 - DNA, 25 bp, Artificial sequence
  Synthetic oligonucleotide
aactcggcgtcggtgaggcgcgggc

SEQ ID NO: 716567 - DNA, 25 bp, Artificial sequence
  Synthetic oligonucleotide
actacgttgcgcaggcgctcattga

SEQ ID NO: 716568 - DNA, 25 bp, Artificial sequence
  Synthetic oligonucleotide
aagaagaactcggcgtcggtgaggc

SEQ ID NO: 716569 - DNA, 25 bp, Artificial sequence
  Synthetic oligonucleotide
ggcgctcattgaagctttcgagcgg

SEQ ID NO: 716570 - DNA, 25 bp, Artificial sequence
  Synthetic oligonucleotide
cattgaagctttcgagcggctgctt

SEQ ID NO: 716571 - DNA, 25 bp, Artificial sequence
  Synthetic oligonucleotide
gctttcgagcggctgcttcttgtcc

SEQ ID NO: 716572 - DNA, 25 bp, Artificial sequence
  Synthetic oligonucleotide
gagcggctgcttcttgtcctgcttg

SEQ ID NO: 716573 - DNA, 25 bp, Artificial sequence
  Synthetic oligonucleotide
ctgcttcttgtcctgcttgaagaag

SEQ ID NO: 716574 - DNA, 25 bp, Artificial sequence
  Synthetic oligonucleotide
ttgtcctgcttgaagaagaactcgg

SEQ ID NO: 716575 - DNA, 25 bp, Artificial sequence
  Synthetic oligonucleotide
gcagcttgccgttggcgtccagcag

SEQ ID NO: 716576 - DNA, 25 bp, Artificial sequence
  Synthetic oligonucleotide
tggaacactacgttgcgcaggcgct

SEQ ID NO: 716577 - DNA, 25 bp, Artificial sequence
  Synthetic oligonucleotide
gaagagcaagttccacctgctgggc

SEQ ID NO: 716578 - DNA, 25 bp, Artificial sequence
  Synthetic oligonucleotide
accggccactcgaccagtgcagtca

SEQ ID NO: 716579 - DNA, 25 bp, Artificial sequence
  Synthetic oligonucleotide
gcaatgtcggcgaggtctacggggt

SEQ ID NO: 716580 - DNA, 25 bp, Artificial sequence
  Synthetic oligonucleotide
tcggcgaggtctacggggtgttcgc

SEQ ID NO: 716581 - DNA, 25 bp, Artificial sequence
  Synthetic oligonucleotide
tctacggggtgttcgccaccttcca

SEQ ID NO: 716582 - DNA, 25 bp, Artificial sequence
  Synthetic oligonucleotide
gggtgttcgccaccttccacccgca

SEQ ID NO: 716583 - DNA, 25 bp, Artificial sequence
  Synthetic oligonucleotide
tcgccaccttccacccgcagaagag

SEQ ID NO: 716584 - DNA, 25 bp, Artificial sequence
  Synthetic oligonucleotide
tgaagcgaggcagcagcttgccgtt

SEQ ID NO: 716585 - DNA, 25 bp, Artificial sequence
  Synthetic oligonucleotide
cccgcagaagagcaagttccacctg

SEQ ID NO: 716586 - DNA, 25 bp, Artificial sequence
  Synthetic oligonucleotide
aaggagcagaccagcggcaccggcc

SEQ ID NO: 716587 - DNA, 25 bp, Artificial sequence
  Synthetic oligonucleotide
caagttccacctgctgggcatggac

SEQ ID NO: 716588 - DNA, 25 bp, Artificial sequence
  Synthetic oligonucleotide
ccacctgctgggcatggactacctg

SEQ ID NO: 716589 - DNA, 25 bp, Artificial sequence
  Synthetic oligonucleotide
gctgggcatggactacctgaagatc

SEQ ID NO: 716590 - DNA, 25 bp, Artificial sequence
  Synthetic oligonucleotide
catggactacctgaagatcaactcg

SEQ ID NO: 716591 - DNA, 25 bp, Artificial sequence
  Synthetic oligonucleotide
ctacctgaagatcaactcggccaac

SEQ ID NO: 716592 - DNA, 25 bp, Artificial sequence
  Synthetic oligonucleotide
tgaagatcaactcggccaacttcca

SEQ ID NO: 716593 - DNA, 25 bp, Artificial sequence
  Synthetic oligonucleotide
ctccgcgaccagttcgcgcaagcgc

SEQ ID NO: 716594 - DNA, 25 bp, Artificial sequence
  Synthetic oligonucleotide
ccttccacccgcagaagagcaagtt

SEQ ID NO: 716595 - DNA, 25 bp, Artificial sequence
  Synthetic oligonucleotide
tgatcagggcttcctgcgggacctc

SEQ ID NO: 716596 - DNA, 25 bp, Artificial sequence
  Synthetic oligonucleotide
ttgccgttggcgtccagcaggcaga

SEQ ID NO: 716597 - DNA, 25 bp, Artificial sequence
  Synthetic oligonucleotide
ttggcgtccagcaggcagaagtatt

SEQ ID NO: 716598 - DNA, 25 bp, Artificial sequence
  Synthetic oligonucleotide
tccagcaggcagaagtatttctggt

SEQ ID NO: 716599 - DNA, 25 bp, Artificial sequence
  Synthetic oligonucleotide
aggcagaagtatttctggttgtcct

SEQ ID NO: 716600 - DNA, 25 bp, Artificial sequence
  Synthetic oligonucleotide
aagtatttctggttgtcctgcatgg

SEQ ID NO: 716601 - DNA, 25 bp, Artificial sequence
  Synthetic oligonucleotide
ttctggttgtcctgcatggtggtga

SEQ ID NO: 716602 - DNA, 25 bp, Artificial sequence
  Synthetic oligonucleotide
ttgtcctgcatggtggtgatcaggg

SEQ ID NO: 716603 - DNA, 25 bp, Artificial sequence
  Synthetic oligonucleotide
agcggcaccggccactcgaccagtg

SEQ ID NO: 716604 - DNA, 25 bp, Artificial sequence
  Synthetic oligonucleotide
ggtggtgatcagggcttcctgcggg

SEQ ID NO: 716605 - DNA, 25 bp, Artificial sequence
  Synthetic oligonucleotide
cagaccagcggcaccggccactcga

SEQ ID NO: 716606 - DNA, 25 bp, Artificial sequence
  Synthetic oligonucleotide
gggcttcctgcgggacctcgaggaa

SEQ ID NO: 716607 - DNA, 25 bp, Artificial sequence
  Synthetic oligonucleotide
tcctgcgggacctcgaggaagcgct

SEQ ID NO: 716608 - DNA, 25 bp, Artificial sequence
  Synthetic oligonucleotide
gggacctcgaggaagcgctcctcga

SEQ ID NO: 716609 - DNA, 25 bp, Artificial sequence
  Synthetic oligonucleotide
tcgaggaagcgctcctcgaaggagc

SEQ ID NO: 716610 - DNA, 25 bp, Artificial sequence
  Synthetic oligonucleotide
aagcgctcctcgaaggagcagacca

SEQ ID NO: 716611 - DNA, 25 bp, Artificial sequence
  Synthetic oligonucleotide
tcctcgaaggagcagaccagcggca

SEQ ID NO: 716612 - DNA, 25 bp, Artificial sequence
  Synthetic oligonucleotide
tcggccaacttccacgggctgggca

SEQ ID NO: 716613 - DNA, 25 bp, Artificial sequence
  Synthetic oligonucleotide
tgcatggtggtgatcagggcttcct

SEQ ID NO: 716614 - DNA, 25 bp, Artificial sequence
  Synthetic oligonucleotide
accgggctggatatcggcaccgcgc

SEQ ID NO: 716615 - DNA, 25 bp, Artificial sequence
  Synthetic oligonucleotide
ttccagaagccggtgcgtacccagg

SEQ ID NO: 716616 - DNA, 25 bp, Artificial sequence
  Synthetic oligonucleotide
atcaaggcggccgatgcgccggtgc

SEQ ID NO: 716617 - DNA, 25 bp, Artificial sequence
  Synthetic oligonucleotide
cgacaacatcaaggcggccgatgcg

SEQ ID NO: 716618 - DNA, 25 bp, Artificial sequence
  Synthetic oligonucleotide
attcccgacaacatcaaggcggccg

SEQ ID NO: 716619 - DNA, 25 bp, Artificial sequence
  Synthetic oligonucleotide
tacctgattcccgacaacatcaagg

SEQ ID NO: 716620 - DNA, 25 bp, Artificial sequence
  Synthetic oligonucleotide
ccgccctacctgattcccgacaaca

SEQ ID NO: 716621 - DNA, 25 bp, Artificial sequence
  Synthetic oligonucleotide
accgcgccgccctacctgattcccg

SEQ ID NO: 716622 - DNA, 25 bp, Artificial sequence
  Synthetic oligonucleotide
gatgcgccggtgcgctatccgttcc

SEQ ID NO: 716623 - DNA, 25 bp, Artificial sequence
  Synthetic oligonucleotide
ctggatatcggcaccgcgccgccct

SEQ ID NO: 716624 - DNA, 25 bp, Artificial sequence
  Synthetic oligonucleotide
ccggtgcgctatccgttcctgtgga

SEQ ID NO: 716625 - DNA, 25 bp, Artificial sequence
  Synthetic oligonucleotide
cgccttaccgggctggatatcggca

SEQ ID NO: 716626 - DNA, 25 bp, Artificial sequence
  Synthetic oligonucleotide
cttcaaccgccttaccgggctggat

SEQ ID NO: 716627 - DNA, 25 bp, Artificial sequence
  Synthetic oligonucleotide
gatgatcttcaaccgccttaccggg

SEQ ID NO: 716628 - DNA, 25 bp, Artificial sequence
  Synthetic oligonucleotide
ggtatcgatgatcttcaaccgcctt

SEQ ID NO: 716629 - DNA, 25 bp, Artificial sequence
  Synthetic oligonucleotide
ggacgcggtatcgatgatcttcaac

SEQ ID NO: 716630 - DNA, 25 bp, Artificial sequence
  Synthetic oligonucleotide
gcggctggacgcggtatcgatgatc

SEQ ID NO: 716631 - DNA, 25 bp, Artificial sequence
  Synthetic oligonucleotide
gaccggcgcggctggacgcggtatc

SEQ ID NO: 716632 - DNA, 25 bp, Artificial sequence
  Synthetic oligonucleotide
atcggcaccgcgccgccctacctga

SEQ ID NO: 716633 - DNA, 25 bp, Artificial sequence
  Synthetic oligonucleotide
cagtggcccggcttcgccgccaacg

SEQ ID NO: 716634 - DNA, 25 bp, Artificial sequence
  Synthetic oligonucleotide
tgcctatcggatcgacggcggtccg

SEQ ID NO: 716635 - DNA, 25 bp, Artificial sequence
  Synthetic oligonucleotide
tgctgaccgccttccagaagccggt

SEQ ID NO: 716636 - DNA, 25 bp, Artificial sequence
  Synthetic oligonucleotide
ggcaactgctgaccgccttccagaa

SEQ ID NO: 716637 - DNA, 25 bp, Artificial sequence
  Synthetic oligonucleotide
tcggcctggcgcgcaatgtcggcga

SEQ ID NO: 716638 - DNA, 25 bp, Artificial sequence
  Synthetic oligonucleotide
acctgctcggcctggcgcgcaatgt

SEQ ID NO: 716639 - DNA, 25 bp, Artificial sequence
  Synthetic oligonucleotide
gcaacgacctgctcggcctggcgcg

SEQ ID NO: 716640 - DNA, 25 bp, Artificial sequence
  Synthetic oligonucleotide
ccaacggcaacgacctgctcggcct

SEQ ID NO: 716641 - DNA, 25 bp, Artificial sequence
  Synthetic oligonucleotide
gcggccgatgcgccggtgcgctatc

SEQ ID NO: 716642 - DNA, 25 bp, Artificial sequence
  Synthetic oligonucleotide
ccggcttcgccgccaacggcaacga

SEQ ID NO: 716643 - DNA, 25 bp, Artificial sequence
  Synthetic oligonucleotide
ctgcccaaggacacctggggaccgg

SEQ ID NO: 716644 - DNA, 25 bp, Artificial sequence
  Synthetic oligonucleotide
aagacccagtggcccggcttcgccg

SEQ ID NO: 716645 - DNA, 25 bp, Artificial sequence
  Synthetic oligonucleotide
cagaacaagacccagtggcccggct

SEQ ID NO: 716646 - DNA, 25 bp, Artificial sequence
  Synthetic oligonucleotide
gcgcggcagaacaagacccagtggc

SEQ ID NO: 716647 - DNA, 25 bp, Artificial sequence
  Synthetic oligonucleotide
aacgcggcgcggcagaacaagaccc

SEQ ID NO: 716648 - DNA, 25 bp, Artificial sequence
  Synthetic oligonucleotide
ctgtggaacgcggcgcggcagaaca

SEQ ID NO: 716649 - DNA, 25 bp, Artificial sequence
  Synthetic oligonucleotide
ccgttcctgtggaacgcggcgcggc

SEQ ID NO: 716650 - DNA, 25 bp, Artificial sequence
  Synthetic oligonucleotide
cgctatccgttcctgtggaacgcgg

SEQ ID NO: 716651 - DNA, 25 bp, Artificial sequence
  Synthetic oligonucleotide
tcgccgccaacggcaacgacctgct

SEQ ID NO: 716652 - DNA, 25 bp, Artificial sequence
  Synthetic oligonucleotide
tcctcgccgacctcgatcgggccgt

SEQ ID NO: 716653 - DNA, 25 bp, Artificial sequence
  Synthetic oligonucleotide
ccttcgacgccttcgccaagccgat

SEQ ID NO: 716654 - DNA, 25 bp, Artificial sequence
  Synthetic oligonucleotide
acgccgccttcgacgccttcgccaa

SEQ ID NO: 716655 - DNA, 25 bp, Artificial sequence
  Synthetic oligonucleotide
gcgatgacgccgccttcgacgcctt

SEQ ID NO: 716656 - DNA, 25 bp, Artificial sequence
  Synthetic oligonucleotide
tgaccagcgatgacgccgccttcga

SEQ ID NO: 716657 - DNA, 25 bp, Artificial sequence
  Synthetic oligonucleotide
gaccgctgaccagcgatgacgccgc

SEQ ID NO: 716658 - DNA, 25 bp, Artificial sequence
  Synthetic oligonucleotide
cgtgggaccgctgaccagcgatgac

SEQ ID NO: 716659 - DNA, 25 bp, Artificial sequence
  Synthetic oligonucleotide
cgggccgtgggaccgctgaccagcg

SEQ ID NO: 716660 - DNA, 25 bp, Artificial sequence
  Synthetic oligonucleotide
cctggggaccggcgcggctggacgc

SEQ ID NO: 716661 - DNA, 25 bp, Artificial sequence
  Synthetic oligonucleotide
gccgacctcgatcgggccgtgggac

SEQ ID NO: 716662 - DNA, 25 bp, Artificial sequence
  Synthetic oligonucleotide
agccgatcctcggggccaatccgcc

SEQ ID NO: 716663 - DNA, 25 bp, Artificial sequence
  Synthetic oligonucleotide
aggcattcctcgccgacctcgatcg

SEQ ID NO: 716664 - DNA, 25 bp, Artificial sequence
  Synthetic oligonucleotide
acttccaggcattcctcgccgacct

SEQ ID NO: 716665 - DNA, 25 bp, Artificial sequence
  Synthetic oligonucleotide
tcgtcgacttccaggcattcctcgc

SEQ ID NO: 716666 - DNA, 25 bp, Artificial sequence
  Synthetic oligonucleotide
cggcgatcgtcgacttccaggcatt

SEQ ID NO: 716667 - DNA, 25 bp, Artificial sequence
  Synthetic oligonucleotide
gcggtccggcgatcgtcgacttcca

SEQ ID NO: 716668 - DNA, 25 bp, Artificial sequence
  Synthetic oligonucleotide
tcgacggcggtccggcgatcgtcga

SEQ ID NO: 716669 - DNA, 25 bp, Artificial sequence
  Synthetic oligonucleotide
cctcgccgccctgctccgcgaccag

SEQ ID NO: 716670 - DNA, 25 bp, Artificial sequence
  Synthetic oligonucleotide
ctcgatcgggccgtgggaccgctga

SEQ ID NO: 716671 - DNA, 25 bp, Artificial sequence
  Synthetic oligonucleotide
ctcgcggcggtgaaggaatggtacg

SEQ ID NO: 716672 - DNA, 25 bp, Artificial sequence
  Synthetic oligonucleotide
gaagccggtgcgtacccaggccgac

SEQ ID NO: 716673 - DNA, 25 bp, Artificial sequence
  Synthetic oligonucleotide
cgcgcgctgcccaaggacacctggg

SEQ ID NO: 716674 - DNA, 25 bp, Artificial sequence
  Synthetic oligonucleotide
atcgagcgcgcgctgcccaaggaca

SEQ ID NO: 716675 - DNA, 25 bp, Artificial sequence
  Synthetic oligonucleotide
cgctgatcgagcgcgcgctgcccaa

SEQ ID NO: 716676 - DNA, 25 bp, Artificial sequence
  Synthetic oligonucleotide
atcacacgctgatcgagcgcgcgct

SEQ ID NO: 716677 - DNA, 25 bp, Artificial sequence
  Synthetic oligonucleotide
agccctatcacacgctgatcgagcg

SEQ ID NO: 716678 - DNA, 25 bp, Artificial sequence
  Synthetic oligonucleotide
ggtacgagccctatcacacgctgat

SEQ ID NO: 716679 - DNA, 25 bp, Artificial sequence
  Synthetic oligonucleotide
acgccttcgccaagccgatcctcgg

SEQ ID NO: 716680 - DNA, 25 bp, Artificial sequence
  Synthetic oligonucleotide
cggtgaaggaatggtacgagcccta

SEQ ID NO: 716681 - DNA, 25 bp, Artificial sequence
  Synthetic oligonucleotide
tcgccaagccgatcctcggggccaa

SEQ ID NO: 716682 - DNA, 25 bp, Artificial sequence
  Synthetic oligonucleotide
gctctgctcgcggcggtgaaggaat

SEQ ID NO: 716683 - DNA, 25 bp, Artificial sequence
  Synthetic oligonucleotide
gcgacgctctgctcgcggcggtgaa

SEQ ID NO: 716684 - DNA, 25 bp, Artificial sequence
  Synthetic oligonucleotide
gtgcgcgcgacgctctgctcgcggc

SEQ ID NO: 716685 - DNA, 25 bp, Artificial sequence
  Synthetic oligonucleotide
ctcccggtgcgcgcgacgctctgct

SEQ ID NO: 716686 - DNA, 25 bp, Artificial sequence
  Synthetic oligonucleotide
atccgcctcccggtgcgcgcgacgc

SEQ ID NO: 716687 - DNA, 25 bp, Artificial sequence
  Synthetic oligonucleotide
gggccaatccgcctcccggtgcgcg

SEQ ID NO: 716688 - DNA, 25 bp, Artificial sequence
  Synthetic oligonucleotide
atcctcggggccaatccgcctcccg

SEQ ID NO: 716689 - DNA, 25 bp, Artificial sequence
  Synthetic oligonucleotide
aggacacctggggaccggcgcggct

SEQ ID NO: 716690 - DNA, 25 bp, Artificial sequence
  Synthetic oligonucleotide
aggaatggtacgagccctatcacac

SEQ ID NO: 716691 - DNA, 25 bp, Artificial sequence
  Synthetic oligonucleotide
ctgctggagtatctgaaggtcctgt

SEQ ID NO: 716692 - DNA, 25 bp, Artificial sequence
  Synthetic oligonucleotide
accgccttccagaagccggtgcgta

SEQ ID NO: 716693 - DNA, 25 bp, Artificial sequence
  Synthetic oligonucleotide
tcttcgaggcgggactggctcagcc

SEQ ID NO: 716694 - DNA, 25 bp, Artificial sequence
  Synthetic oligonucleotide
gccttttcttcgaggcgggactggc

SEQ ID NO: 716695 - DNA, 25 bp, Artificial sequence
  Synthetic oligonucleotide
cggtgtcgcgaggacgccgggcctt

SEQ ID NO: 716696 - DNA, 25 bp, Artificial sequence
  Synthetic oligonucleotide
aaggcccggtgtcgcgaggacgccg

SEQ ID NO: 716697 - DNA, 25 bp, Artificial sequence
  Synthetic oligonucleotide
tgaaaaaggcccggtgtcgcgagga

SEQ ID NO: 716698 - DNA, 25 bp, Artificial sequence
  Synthetic oligonucleotide
ctgtagtgaaaaaggcccggtgtcg

SEQ ID NO: 716699 - DNA, 25 bp, Artificial sequence
  Synthetic oligonucleotide
ggactggctcagccgagcagcgaga

SEQ ID NO: 716700 - DNA, 25 bp, Artificial sequence
  Synthetic oligonucleotide
gagtatctgaaggtcctgtagtgaa

SEQ ID NO: 716701 - DNA, 25 bp, Artificial sequence
  Synthetic oligonucleotide
gctcagccgagcagcgagatgtccg

SEQ ID NO: 716702 - DNA, 25 bp, Artificial sequence
  Synthetic oligonucleotide
cgtgcgctgctggagtatctgaagg

SEQ ID NO: 716703 - DNA, 25 bp, Artificial sequence
  Synthetic oligonucleotide
gagaagcgtgcgctgctggagtatc

SEQ ID NO: 716704 - DNA, 25 bp, Artificial sequence
  Synthetic oligonucleotide
ggccgaggagaagcgtgcgctgctg

SEQ ID NO: 716705 - DNA, 25 bp, Artificial sequence
  Synthetic oligonucleotide
cctgtcggccgaggagaagcgtgcg

SEQ ID NO: 716706 - DNA, 25 bp, Artificial sequence
  Synthetic oligonucleotide
caccagcctgtcggccgaggagaag

SEQ ID NO: 716707 - DNA, 25 bp, Artificial sequence
  Synthetic oligonucleotide
tacggcaccagcctgtcggccgagg

SEQ ID NO: 716708 - DNA, 25 bp, Artificial sequence
  Synthetic oligonucleotide
catgagtacggcaccagcctgtcgg

SEQ ID NO: 716709 - DNA, 25 bp, Artificial sequence
  Synthetic oligonucleotide
ctgaaggtcctgtagtgaaaaaggc

SEQ ID NO: 716710 - DNA, 25 bp, Artificial sequence
  Synthetic oligonucleotide
gcttggccagcagcgcatagcggtt

SEQ ID NO: 716711 - DNA, 25 bp, Artificial sequence
  Synthetic oligonucleotide
acatcggcgaagaacgtatccaccg

SEQ ID NO: 716712 - DNA, 25 bp, Artificial sequence
  Synthetic oligonucleotide
accatcacatcggcgaagaacgtat

SEQ ID NO: 716713 - DNA, 25 bp, Artificial sequence
  Synthetic oligonucleotide
acattgaccatcacatcggcgaaga

SEQ ID NO: 716714 - DNA, 25 bp, Artificial sequence
  Synthetic oligonucleotide
tcgtcgacattgaccatcacatcgg

SEQ ID NO: 716715 - DNA, 25 bp, Artificial sequence
  Synthetic oligonucleotide
gccgcgtcgtcgacattgaccatca

SEQ ID NO: 716716 - DNA, 25 bp, Artificial sequence
  Synthetic oligonucleotide
cgcaccgccgcgtcgtcgacattga

SEQ ID NO: 716717 - DNA, 25 bp, Artificial sequence
  Synthetic oligonucleotide
tagcggttggcgcgcaccgccgcgt

SEQ ID NO: 716718 - DNA, 25 bp, Artificial sequence
  Synthetic oligonucleotide
gaggcgggactggctcagccgagca

SEQ ID NO: 716719 - DNA, 25 bp, Artificial sequence
  Synthetic oligonucleotide
ccagcagcgcatagcggttggcgcg

SEQ ID NO: 716720 - DNA, 25 bp, Artificial sequence
  Synthetic oligonucleotide
ggcaacagccgctgcggccatgagt

SEQ ID NO: 716721 - DNA, 25 bp, Artificial sequence
  Synthetic oligonucleotide
cgcgcagcttggccagcagcgcata

SEQ ID NO: 716722 - DNA, 25 bp, Artificial sequence
  Synthetic oligonucleotide
aacgacccgcgcagcttggccagca

SEQ ID NO: 716723 - DNA, 25 bp, Artificial sequence
  Synthetic oligonucleotide
ccgaggaacgacccgcgcagcttgg

SEQ ID NO: 716724 - DNA, 25 bp, Artificial sequence
  Synthetic oligonucleotide
gccaccccgaggaacgacccgcgca

SEQ ID NO: 716725 - DNA, 25 bp, Artificial sequence
  Synthetic oligonucleotide
agatgtccgccaccccgaggaacga

SEQ ID NO: 716726 - DNA, 25 bp, Artificial sequence
  Synthetic oligonucleotide
cagcgagatgtccgccaccccgagg

SEQ ID NO: 716727 - DNA, 25 bp, Artificial sequence
  Synthetic oligonucleotide
gccgagcagcgagatgtccgccacc

SEQ ID NO: 716728 - DNA, 25 bp, Artificial sequence
  Synthetic oligonucleotide
tggcgcgcaatgtcggcgaggtcta

SEQ ID NO: 716729 - DNA, 25 bp, Artificial sequence
  Synthetic oligonucleotide
gcgccgtacctgcacaacggctcgg

SEQ ID NO: 716730 - DNA, 25 bp, Artificial sequence
  Synthetic oligonucleotide
cggccgcggagcgggtggaatcctt

SEQ ID NO: 716731 - DNA, 25 bp, Artificial sequence
  Synthetic oligonucleotide
tgaagccggccgcggagcgggtgga

SEQ ID NO: 716732 - DNA, 25 bp, Artificial sequence
  Synthetic oligonucleotide
agttgctgaagccggccgcggagcg

SEQ ID NO: 716733 - DNA, 25 bp, Artificial sequence
  Synthetic oligonucleotide
tggaagagttgctgaagccggccgc

SEQ ID NO: 716734 - DNA, 25 bp, Artificial sequence
  Synthetic oligonucleotide
cgaccctggaagagttgctgaagcc

SEQ ID NO: 716735 - DNA, 25 bp, Artificial sequence
  Synthetic oligonucleotide
cggtgccgaccctggaagagttgct

SEQ ID NO: 716736 - DNA, 25 bp, Artificial sequence
  Synthetic oligonucleotide
acggctcggtgccgaccctggaaga

SEQ ID NO: 716737 - DNA, 25 bp, Artificial sequence
  Synthetic oligonucleotide
tgcggccatgagtacggcaccagcc

SEQ ID NO: 716738 - DNA, 25 bp, Artificial sequence
  Synthetic oligonucleotide
gtacctgcacaacggctcggtgccg

SEQ ID NO: 716739 - DNA, 25 bp, Artificial sequence
  Synthetic oligonucleotide
tgggctcggcctacgacgtggacaa

SEQ ID NO: 716740 - DNA, 25 bp, Artificial sequence
  Synthetic oligonucleotide
gcagcggcgccgtacctgcacaacg

SEQ ID NO: 716741 - DNA, 25 bp, Artificial sequence
  Synthetic oligonucleotide
atctgggcagcggcgccgtacctgc

SEQ ID NO: 716742 - DNA, 25 bp, Artificial sequence
  Synthetic oligonucleotide
aggggatctgggcagcggcgccgta

SEQ ID NO: 716743 - DNA, 25 bp, Artificial sequence
  Synthetic oligonucleotide
gtcctgcaggggatctgggcagcgg

SEQ ID NO: 716744 - DNA, 25 bp, Artificial sequence
  Synthetic oligonucleotide
tcgcgggtcctgcaggggatctggg

SEQ ID NO: 716745 - DNA, 25 bp, Artificial sequence
  Synthetic oligonucleotide
tacgagtcgcgggtcctgcagggga

SEQ ID NO: 716746 - DNA, 25 bp, Artificial sequence
  Synthetic oligonucleotide
ctacccctacgagtcgcgggtcctg

SEQ ID NO: 716747 - DNA, 25 bp, Artificial sequence
  Synthetic oligonucleotide
tgcacaacggctcggtgccgaccct

SEQ ID NO: 716748 - DNA, 25 bp, Artificial sequence
  Synthetic oligonucleotide
acccaattcggcagctatgtgctga

SEQ ID NO: 716749 - DNA, 25 bp, Artificial sequence
  Synthetic oligonucleotide
gggcactgcctatcggatcgacggc

SEQ ID NO: 716750 - DNA, 25 bp, Artificial sequence
  Synthetic oligonucleotide
tgattccggcaacagccgctgcggc

SEQ ID NO: 716751 - DNA, 25 bp, Artificial sequence
  Synthetic oligonucleotide
cagcgtgattccggcaacagccgct

SEQ ID NO: 716752 - DNA, 25 bp, Artificial sequence
  Synthetic oligonucleotide
tgcgagcagcgtgattccggcaaca

SEQ ID NO: 716753 - DNA, 25 bp, Artificial sequence
  Synthetic oligonucleotide
accggctgcgagcagcgtgattccg

SEQ ID NO: 716754 - DNA, 25 bp, Artificial sequence
  Synthetic oligonucleotide
aagaccaccggctgcgagcagcgtg

SEQ ID NO: 716755 - DNA, 25 bp, Artificial sequence
  Synthetic oligonucleotide
gtgctgaagaccaccggctgcgagc

SEQ ID NO: 716756 - DNA, 25 bp, Artificial sequence
  Synthetic oligonucleotide
tggaatccttcccggtgggctcggc

SEQ ID NO: 716757 - DNA, 25 bp, Artificial sequence
  Synthetic oligonucleotide
ttcggcagctatgtgctgaagacca

SEQ ID NO: 716758 - DNA, 25 bp, Artificial sequence
  Synthetic oligonucleotide
cccggtgggctcggcctacgacgtg

SEQ ID NO: 716759 - DNA, 25 bp, Artificial sequence
  Synthetic oligonucleotide
cagcagacccaattcggcagctatg

SEQ ID NO: 716760 - DNA, 25 bp, Artificial sequence
  Synthetic oligonucleotide
gccgcccagcagacccaattcggca

SEQ ID NO: 716761 - DNA, 25 bp, Artificial sequence
  Synthetic oligonucleotide
ggcctcgccgcccagcagacccaat

SEQ ID NO: 716762 - DNA, 25 bp, Artificial sequence
  Synthetic oligonucleotide
caaggtcggcctcgccgcccagcag

SEQ ID NO: 716763 - DNA, 25 bp, Artificial sequence
  Synthetic oligonucleotide
cgtggacaaggtcggcctcgccgcc

SEQ ID NO: 716764 - DNA, 25 bp, Artificial sequence
  Synthetic oligonucleotide
tacgacgtggacaaggtcggcctcg

SEQ ID NO: 716765 - DNA, 25 bp, Artificial sequence
  Synthetic oligonucleotide
tcggcctacgacgtggacaaggtcg

SEQ ID NO: 716766 - DNA, 25 bp, Artificial sequence
  Synthetic oligonucleotide
agccgctgcggccatgagtacggca

SEQ ID NO: 716767 - DNA, 25 bp, Artificial sequence
  Synthetic oligonucleotide
agctatgtgctgaagaccaccggct

SEQ ID NO: 716768 - DNA, 25 bp, Artificial sequence
  Synthetic oligonucleotide
gcggatggatcgacgagccccctac

SEQ ID NO: 716769 - DNA, 25 bp, Artificial sequence
  Synthetic oligonucleotide
aataatggcaatggaatggcaatcc

SEQ ID NO: 716770 - DNA, 25 bp, Artificial sequence
  Synthetic oligonucleotide
agattcaataatggcaatggaatgg

SEQ ID NO: 716771 - DNA, 25 bp, Artificial sequence
  Synthetic oligonucleotide
tgtactagattcaataatggcaatg

SEQ ID NO: 716772 - DNA, 25 bp, Artificial sequence
  Synthetic oligonucleotide
acaatctgtactagattcaataatg

SEQ ID NO: 716773 - DNA, 25 bp, Artificial sequence
  Synthetic oligonucleotide
cgctggacaatctgtactagattca

SEQ ID NO: 716774 - DNA, 25 bp, Artificial sequence
  Synthetic oligonucleotide
cccctacgctggacaatctgtacta

SEQ ID NO: 716775 - DNA, 25 bp, Artificial sequence
  Synthetic oligonucleotide
gcgcctatcgcatgccagcacggcc

SEQ ID NO: 716776 - DNA, 25 bp, Artificial sequence
  Synthetic oligonucleotide
ggatcgacgagccccctacgctgga

SEQ ID NO: 716777 - DNA, 25 bp, Artificial sequence
  Synthetic oligonucleotide
ggcaatcccaggccagggagtcatt

SEQ ID NO: 716778 - DNA, 25 bp, Artificial sequence
  Synthetic oligonucleotide
agcatcgcggatggatcgacgagcc

SEQ ID NO: 716779 - DNA, 25 bp, Artificial sequence
  Synthetic oligonucleotide
cagccggagcatcgcggatggatcg

SEQ ID NO: 716780 - DNA, 25 bp, Artificial sequence
  Synthetic oligonucleotide
ctcagccagccggagcatcgcggat

SEQ ID NO: 716781 - DNA, 25 bp, Artificial sequence
  Synthetic oligonucleotide
attctacctcagccagccggagcat

SEQ ID NO: 716782 - DNA, 25 bp, Artificial sequence
  Synthetic oligonucleotide
ggatcgattctacctcagccagccg

SEQ ID NO: 716783 - DNA, 25 bp, Artificial sequence
  Synthetic oligonucleotide
cggaaaggatcgattctacctcagc

SEQ ID NO: 716784 - DNA, 25 bp, Artificial sequence
  Synthetic oligonucleotide
acgagccccctacgctggacaatct

SEQ ID NO: 716785 - DNA, 25 bp, Artificial sequence
  Synthetic oligonucleotide
gtgtctcggagtacgtgcgaacccc

SEQ ID NO: 716786 - DNA, 25 bp, Artificial sequence
  Synthetic oligonucleotide
cagtaagcgcctatcgcatgccagc

SEQ ID NO: 716787 - DNA, 25 bp, Artificial sequence
  Synthetic oligonucleotide
gtaacgcagtaagcgcctatcgcat

SEQ ID NO: 716788 - DNA, 25 bp, Artificial sequence
  Synthetic oligonucleotide
accggagtaacgcagtaagcgccta

SEQ ID NO: 716789 - DNA, 25 bp, Artificial sequence
  Synthetic oligonucleotide
tggatcaccggagtaacgcagtaag

SEQ ID NO: 716790 - DNA, 25 bp, Artificial sequence
  Synthetic oligonucleotide
ggcgggtggatcaccggagtaacgc

SEQ ID NO: 716791 - DNA, 25 bp, Artificial sequence
  Synthetic oligonucleotide
actgccaggtcgtaatagccacggg

SEQ ID NO: 716792 - DNA, 25 bp, Artificial sequence
  Synthetic oligonucleotide
tggcaatggaatggcaatcccaggc

SEQ ID NO: 716793 - DNA, 25 bp, Artificial sequence
  Synthetic oligonucleotide
atcggatcgacggcggtccggcgat

SEQ ID NO: 716794 - DNA, 25 bp, Artificial sequence
  Synthetic oligonucleotide
tggaatggcaatcccaggccaggga

SEQ ID NO: 716795 - DNA, 25 bp, Artificial sequence
  Synthetic oligonucleotide
cagtgggtgtctcggagtacgtgcg

SEQ ID NO: 716796 - DNA, 25 bp, Artificial sequence
  Synthetic oligonucleotide
cgcagcagtgggtgtctcggagtac

SEQ ID NO: 716797 - DNA, 25 bp, Artificial sequence
  Synthetic oligonucleotide
ttggcacgcagcagtgggtgtctcg

SEQ ID NO: 716798 - DNA, 25 bp, Artificial sequence
  Synthetic oligonucleotide
agtcatttggcacgcagcagtgggt

SEQ ID NO: 716799 - DNA, 25 bp, Artificial sequence
  Synthetic oligonucleotide
ccagggagtcatttggcacgcagca

SEQ ID NO: 716800 - DNA, 25 bp, Artificial sequence
  Synthetic oligonucleotide
cccaggccagggagtcatttggcac

SEQ ID NO: 716801 - DNA, 25 bp, Artificial sequence
  Synthetic oligonucleotide
tgcgcagttggccatgaacggaaag

SEQ ID NO: 716802 - DNA, 25 bp, Artificial sequence
  Synthetic oligonucleotide
cgtgcgaaccccttggcgggtggat

SEQ ID NO: 716803 - DNA, 25 bp, Artificial sequence
  Synthetic oligonucleotide
ccaccgcgacggtccagccggcctg

SEQ ID NO: 716804 - DNA, 25 bp, Artificial sequence
  Synthetic oligonucleotide
catgaacggaaaggatcgattctac

SEQ ID NO: 716805 - DNA, 25 bp, Artificial sequence
  Synthetic oligonucleotide
tggcctcgatcgagctggggatggg

SEQ ID NO: 716806 - DNA, 25 bp, Artificial sequence
  Synthetic oligonucleotide
gggcgatggcctcgatcgagctggg

SEQ ID NO: 716807 - DNA, 25 bp, Artificial sequence
  Synthetic oligonucleotide
caggcgggcgatggcctcgatcgag

SEQ ID NO: 716808 - DNA, 25 bp, Artificial sequence
  Synthetic oligonucleotide
tggctcaggcgggcgatggcctcga

SEQ ID NO: 716809 - DNA, 25 bp, Artificial sequence
  Synthetic oligonucleotide
ccggcctggctcaggcgggcgatgg

SEQ ID NO: 716810 - DNA, 25 bp, Artificial sequence
  Synthetic oligonucleotide
gagctggggatggggatccactcgt

SEQ ID NO: 716811 - DNA, 25 bp, Artificial sequence
  Synthetic oligonucleotide
cgacggtccagccggcctggctcag

SEQ ID NO: 716812 - DNA, 25 bp, Artificial sequence
  Synthetic oligonucleotide
ggatggggatccactcgtcgagggt

SEQ ID NO: 716813 - DNA, 25 bp, Artificial sequence
  Synthetic oligonucleotide
tggtagccaccgcgacggtccagcc

SEQ ID NO: 716814 - DNA, 25 bp, Artificial sequence
  Synthetic oligonucleotide
actggttggtagccaccgcgacggt

SEQ ID NO: 716815 - DNA, 25 bp, Artificial sequence
  Synthetic oligonucleotide
tgccggactggttggtagccaccgc

SEQ ID NO: 716816 - DNA, 25 bp, Artificial sequence
  Synthetic oligonucleotide
ggcgatgccggactggttggtagcc

SEQ ID NO: 716817 - DNA, 25 bp, Artificial sequence
  Synthetic oligonucleotide
gccacgggcgatgccggactggttg

SEQ ID NO: 716818 - DNA, 25 bp, Artificial sequence
  Synthetic oligonucleotide
gtaatagccacgggcgatgccggac

SEQ ID NO: 716819 - DNA, 25 bp, Artificial sequence
  Synthetic oligonucleotide
caggtcgtaatagccacgggcgatg

SEQ ID NO: 716820 - DNA, 25 bp, Artificial sequence
  Synthetic oligonucleotide
gtccagccggcctggctcaggcggg

SEQ ID NO: 716821 - DNA, 25 bp, Artificial sequence
  Synthetic oligonucleotide
ggttgatgactccatcgcggtcgag

SEQ ID NO: 716822 - DNA, 25 bp, Artificial sequence
  Synthetic oligonucleotide
ccccttggcgggtggatcaccggag

SEQ ID NO: 716823 - DNA, 25 bp, Artificial sequence
  Synthetic oligonucleotide
catcgatgcgcagttggccatgaac

SEQ ID NO: 716824 - DNA, 25 bp, Artificial sequence
  Synthetic oligonucleotide
acgggacatcgatgcgcagttggcc

SEQ ID NO: 716825 - DNA, 25 bp, Artificial sequence
  Synthetic oligonucleotide
cagggaacgggacatcgatgcgcag

SEQ ID NO: 716826 - DNA, 25 bp, Artificial sequence
  Synthetic oligonucleotide
aatcagcagggaacgggacatcgat

SEQ ID NO: 716827 - DNA, 25 bp, Artificial sequence
  Synthetic oligonucleotide
gtcgagaatcagcagggaacgggac

SEQ ID NO: 716828 - DNA, 25 bp, Artificial sequence
  Synthetic oligonucleotide
tcgatcgagctggggatggggatcc

SEQ ID NO: 716829 - DNA, 25 bp, Artificial sequence
  Synthetic oligonucleotide
gactccatcgcggtcgagaatcagc

SEQ ID NO: 716830 - DNA, 25 bp, Artificial sequence
  Synthetic oligonucleotide
gttggccatgaacggaaaggatcga

SEQ ID NO: 716831 - DNA, 25 bp, Artificial sequence
  Synthetic oligonucleotide
agtcgaggttgatgactccatcgcg

SEQ ID NO: 716832 - DNA, 25 bp, Artificial sequence
  Synthetic oligonucleotide
cgtcggagtcgaggttgatgactcc

SEQ ID NO: 716833 - DNA, 25 bp, Artificial sequence
  Synthetic oligonucleotide
tgtaatcgtcggagtcgaggttgat

SEQ ID NO: 716834 - DNA, 25 bp, Artificial sequence
  Synthetic oligonucleotide
tcttgatgtaatcgtcggagtcgag

SEQ ID NO: 716835 - DNA, 25 bp, Artificial sequence
  Synthetic oligonucleotide
cgagggtcttgatgtaatcgtcgga

SEQ ID NO: 716836 - DNA, 25 bp, Artificial sequence
  Synthetic oligonucleotide
actcgtcgagggtcttgatgtaatc

SEQ ID NO: 716837 - DNA, 25 bp, Artificial sequence
  Synthetic oligonucleotide
ggatccactcgtcgagggtcttgat

SEQ ID NO: 716838 - DNA, 25 bp, Artificial sequence
  Synthetic oligonucleotide
atcgcggtcgagaatcagcagggaa

SEQ ID NO: 716839 - DNA, 25 bp, Artificial sequence
  Synthetic oligonucleotide
tgccctggctcaaggcgttgcgaca

SEQ ID NO: 716840 - DNA, 25 bp, Artificial sequence
  Synthetic oligonucleotide
gaaagccaccgccaggacttctaca

SEQ ID NO: 716841 - DNA, 25 bp, Artificial sequence
  Synthetic oligonucleotide
cctggcccgctacggctatttgccc

SEQ ID NO: 716842 - DNA, 25 bp, Artificial sequence
  Synthetic oligonucleotide
ccgacagcctggcccgctacggcta

SEQ ID NO: 716843 - DNA, 25 bp, Artificial sequence
  Synthetic oligonucleotide
tcctcgccgacagcctggcccgcta

SEQ ID NO: 716844 - DNA, 25 bp, Artificial sequence
  Synthetic oligonucleotide
cgcctttcctcgccgacagcctggc

SEQ ID NO: 716845 - DNA, 25 bp, Artificial sequence
  Synthetic oligonucleotide
atggaacgcctttcctcgccgacag

SEQ ID NO: 716846 - DNA, 25 bp, Artificial sequence
  Synthetic oligonucleotide
agccggatggaacgcctttcctcgc

SEQ ID NO: 716847 - DNA, 25 bp, Artificial sequence
  Synthetic oligonucleotide
gcgacagccggatggaacgcctttc

SEQ ID NO: 716848 - DNA, 25 bp, Artificial sequence
  Synthetic oligonucleotide
ggctatttgcccaaccccaaggcgc

SEQ ID NO: 716849 - DNA, 25 bp, Artificial sequence
  Synthetic oligonucleotide
gctcaaggcgttgcgacagccggat

SEQ ID NO: 716850 - DNA, 25 bp, Artificial sequence
  Synthetic oligonucleotide
tgcccaaccccaaggcgcccgcgga

SEQ ID NO: 716851 - DNA, 25 bp, Artificial sequence
  Synthetic oligonucleotide
tgcccctgccctggctcaaggcgtt

SEQ ID NO: 716852 - DNA, 25 bp, Artificial sequence
  Synthetic oligonucleotide
aggtgatgcccctgccctggctcaa

SEQ ID NO: 716853 - DNA, 25 bp, Artificial sequence
  Synthetic oligonucleotide
gctcgcaggtgatgcccctgccctg

SEQ ID NO: 716854 - DNA, 25 bp, Artificial sequence
  Synthetic oligonucleotide
accagggctcgcaggtgatgcccct

SEQ ID NO: 716855 - DNA, 25 bp, Artificial sequence
  Synthetic oligonucleotide
agccgcgaccagggctcgcaggtga

SEQ ID NO: 716856 - DNA, 25 bp, Artificial sequence
  Synthetic oligonucleotide
ttctacagccgcgaccagggctcgc

SEQ ID NO: 716857 - DNA, 25 bp, Artificial sequence
  Synthetic oligonucleotide
caggacttctacagccgcgaccagg

SEQ ID NO: 716858 - DNA, 25 bp, Artificial sequence
  Synthetic oligonucleotide
cggagtacgtgcgaaccccttggcg

SEQ ID NO: 716859 - DNA, 25 bp, Artificial sequence
  Synthetic oligonucleotide
ggcgttgcgacagccggatggaacg

SEQ ID NO: 716860 - DNA, 25 bp, Artificial sequence
  Synthetic oligonucleotide
acgggcgcccggcagatggtcggca

SEQ ID NO: 716861 - DNA, 25 bp, Artificial sequence
  Synthetic oligonucleotide
ggtgaagggcactgcctatcggatc

SEQ ID NO: 716862 - DNA, 25 bp, Artificial sequence
  Synthetic oligonucleotide
gatcgaggtgaagggcactgcctat

SEQ ID NO: 716863 - DNA, 25 bp, Artificial sequence
  Synthetic oligonucleotide
cggcagatcgaggtgaagggcactg

SEQ ID NO: 716864 - DNA, 25 bp, Artificial sequence
  Synthetic oligonucleotide
ccatacccggcagatcgaggtgaag

SEQ ID NO: 716865 - DNA, 25 bp, Artificial sequence
  Synthetic oligonucleotide
gcctgccatacccggcagatcgagg

SEQ ID NO: 716866 - DNA, 25 bp, Artificial sequence
  Synthetic oligonucleotide
tgttcggcctgccatacccggcaga

SEQ ID NO: 716867 - DNA, 25 bp, Artificial sequence
  Synthetic oligonucleotide
atgacctgttcggcctgccataccc

SEQ ID NO: 716868 - DNA, 25 bp, Artificial sequence
  Synthetic oligonucleotide
gtcggcatgacctgttcggcctgcc

SEQ ID NO: 716869 - DNA, 25 bp, Artificial sequence
  Synthetic oligonucleotide
cgctacggctatttgcccaacccca

SEQ ID NO: 716870 - DNA, 25 bp, Artificial sequence
  Synthetic oligonucleotide
gcccggcagatggtcggcatgacct

SEQ ID NO: 716871 - DNA, 25 bp, Artificial sequence
  Synthetic oligonucleotide
tggaccgaaagccaccgccaggact

SEQ ID NO: 716872 - DNA, 25 bp, Artificial sequence
  Synthetic oligonucleotide
agccggcacgggcgcccggcagatg

SEQ ID NO: 716873 - DNA, 25 bp, Artificial sequence
  Synthetic oligonucleotide
caccgtagccggcacgggcgcccgg

SEQ ID NO: 716874 - DNA, 25 bp, Artificial sequence
  Synthetic oligonucleotide
gggcttcaccgtagccggcacgggc

SEQ ID NO: 716875 - DNA, 25 bp, Artificial sequence
  Synthetic oligonucleotide
ccggtgggcttcaccgtagccggca

SEQ ID NO: 716876 - DNA, 25 bp, Artificial sequence
  Synthetic oligonucleotide
aggcctgccggtgggcttcaccgta

SEQ ID NO: 716877 - DNA, 25 bp, Artificial sequence
  Synthetic oligonucleotide
cgcggaaggcctgccggtgggcttc

SEQ ID NO: 716878 - DNA, 25 bp, Artificial sequence
  Synthetic oligonucleotide
ggcgcccgcggaaggcctgccggtg

SEQ ID NO: 716879 - DNA, 25 bp, Artificial sequence
  Synthetic oligonucleotide
ccccaaggcgcccgcggaaggcctg

SEQ ID NO: 716880 - DNA, 25 bp, Artificial sequence
  Synthetic oligonucleotide
cagatggtcggcatgacctgttcgg

SEQ ID NO: 716881 - DNA, 25 bp, Artificial sequence
  Synthetic oligonucleotide
caccacaggtggagcgggcgtgacg

SEQ ID NO: 716882 - DNA, 25 bp, Artificial sequence
  Synthetic oligonucleotide
tttcaagcttgtccctcgcttccct

SEQ ID NO: 716883 - DNA, 25 bp, Artificial sequence
  Synthetic oligonucleotide
gcttgtccctcgcttccctggctct

SEQ ID NO: 716884 - DNA, 25 bp, Artificial sequence
  Synthetic oligonucleotide
ccctcgcttccctggctctttcttc

SEQ ID NO: 716885 - DNA, 25 bp, Artificial sequence
  Synthetic oligonucleotide
cttccctggctctttcttccgccgc

SEQ ID NO: 716886 - DNA, 25 bp, Artificial sequence
  Synthetic oligonucleotide
tggctctttcttccgccgccctggc

SEQ ID NO: 716887 - DNA, 25 bp, Artificial sequence
  Synthetic oligonucleotide
agacactgcacctttcaagcttgtc

SEQ ID NO: 716888 - DNA, 25 bp, Artificial sequence
  Synthetic oligonucleotide
caccgccaggacttctacagccgcg

SEQ ID NO: 716889 - DNA, 25 bp, Artificial sequence
  Synthetic oligonucleotide
tgaaaaagacactgcacctttcaag

SEQ ID NO: 716890 - DNA, 25 bp, Artificial sequence
  Synthetic oligonucleotide
atcgcatgccagcacggccgaccgg

SEQ ID NO: 716891 - DNA, 25 bp, Artificial sequence
  Synthetic oligonucleotide
aacgcctgaaaaagacactgcacct

SEQ ID NO: 716892 - DNA, 25 bp, Artificial sequence
  Synthetic oligonucleotide
ccgtgaaacgcctgaaaaagacact

SEQ ID NO: 716893 - DNA, 25 bp, Artificial sequence
  Synthetic oligonucleotide
gagcgggcgtgacgacggggagttc

SEQ ID NO: 716894 - DNA, 25 bp, Artificial sequence
  Synthetic oligonucleotide
tgcacctttcaagcttgtccctcgc

SEQ ID NO: 716895 - DNA, 25 bp, Artificial sequence
  Synthetic oligonucleotide
caggtggagcgggcgtgacgacggg

SEQ ID NO: 716896 - DNA, 25 bp, Artificial sequence
  Synthetic oligonucleotide
tgtttccaccacaggtggagcgggc

SEQ ID NO: 716897 - DNA, 25 bp, Artificial sequence
  Synthetic oligonucleotide
cggccgtgtttccaccacaggtgga

SEQ ID NO: 716898 - DNA, 25 bp, Artificial sequence
  Synthetic oligonucleotide
gccgaccggccgtgtttccaccaca

SEQ ID NO: 716899 - DNA, 25 bp, Artificial sequence
  Synthetic oligonucleotide
tttcttccgccgccctggcggccgc

SEQ ID NO: 716900 - DNA, 25 bp, Artificial sequence
  Synthetic oligonucleotide
tccgccgccctggcggccgctccgg

SEQ ID NO: 716901 - DNA, 25 bp, Artificial sequence
  Synthetic oligonucleotide
ccctggcggccgctccggtcatgct

SEQ ID NO: 716902 - DNA, 25 bp, Artificial sequence
  Synthetic oligonucleotide
cggccgctccggtcatgctcgacca

SEQ ID NO: 716903 - DNA, 25 bp, Artificial sequence
  Synthetic oligonucleotide
ctccggtcatgctcgaccagggcaa

SEQ ID NO: 716904 - DNA, 25 bp, Artificial sequence
  Synthetic oligonucleotide
tcatgctcgaccagggcaaggaatg

SEQ ID NO: 716905 - DNA, 25 bp, Artificial sequence
  Synthetic oligonucleotide
tcgaccagggcaaggaatggaccga

SEQ ID NO: 716906 - DNA, 25 bp, Artificial sequence
  Synthetic oligonucleotide
gccagcacggccgaccggccgtgtt

SEQ ID NO: 716907 - DNA, 25 bp, Artificial sequence
  Synthetic oligonucleotide
agggcaaggaatggaccgaaagcca

SEQ ID NO: 716908 - DNA, 25 bp, Artificial sequence
  Synthetic oligonucleotide
aggaatggaccgaaagccaccgcca

SEQ ID NO: 716909 - DNA, 25 bp, Artificial sequence
  Synthetic oligonucleotide
ccgagcgtgaccaggatgtgcgcca

SEQ ID NO: 716910 - DNA, 25 bp, Artificial sequence
  Synthetic oligonucleotide
gccctgtccgcacttcgatcctttc

SEQ ID NO: 716911 - DNA, 25 bp, Artificial sequence
  Synthetic oligonucleotide
cgcccagccctgtccgcacttcgat

SEQ ID NO: 716912 - DNA, 25 bp, Artificial sequence
  Synthetic oligonucleotide
tgggaacgcccagccctgtccgcac

SEQ ID NO: 716913 - DNA, 25 bp, Artificial sequence
  Synthetic oligonucleotide
gctgaatgggaacgcccagccctgt

SEQ ID NO: 716914 - DNA, 25 bp, Artificial sequence
  Synthetic oligonucleotide
cacgcgctgaatgggaacgcccagc

SEQ ID NO: 716915 - DNA, 25 bp, Artificial sequence
  Synthetic oligonucleotide
tgcgccacgcgctgaatgggaacgc

SEQ ID NO: 716916 - DNA, 25 bp, Artificial sequence
  Synthetic oligonucleotide
gtagagaatcgcttgctcgtatggg

SEQ ID NO: 716917 - DNA, 25 bp, Artificial sequence
  Synthetic oligonucleotide
gtgaccaggatgtgcgccacgcgct

SEQ ID NO: 716918 - DNA, 25 bp, Artificial sequence
  Synthetic oligonucleotide
gatcctttccaaggcatggaggagg

SEQ ID NO: 716919 - DNA, 25 bp, Artificial sequence
  Synthetic oligonucleotide
tcgccgccgagcgtgaccaggatgt

SEQ ID NO: 716920 - DNA, 25 bp, Artificial sequence
  Synthetic oligonucleotide
agggcatcgccgccgagcgtgacca

SEQ ID NO: 716921 - DNA, 25 bp, Artificial sequence
  Synthetic oligonucleotide
agcgtcagggcatcgccgccgagcg

SEQ ID NO: 716922 - DNA, 25 bp, Artificial sequence
  Synthetic oligonucleotide
gtgagcagcgtcagggcatcgccgc

SEQ ID NO: 716923 - DNA, 25 bp, Artificial sequence
  Synthetic oligonucleotide
gcggccgtgagcagcgtcagggcat

SEQ ID NO: 716924 - DNA, 25 bp, Artificial sequence
  Synthetic oligonucleotide
cggtgcgcggccgtgagcagcgtca

SEQ ID NO: 716925 - DNA, 25 bp, Artificial sequence
  Synthetic oligonucleotide
aggatgtgcgccacgcgctgaatgg

SEQ ID NO: 716926 - DNA, 25 bp, Artificial sequence
  Synthetic oligonucleotide
aggcgctcctgtacggattcgagca

SEQ ID NO: 716927 - DNA, 25 bp, Artificial sequence
  Synthetic oligonucleotide
ttggcgagctgatggcgcagacacg

SEQ ID NO: 716928 - DNA, 25 bp, Artificial sequence
  Synthetic oligonucleotide
gttccggtgaacgtagagaatcgct

SEQ ID NO: 716929 - DNA, 25 bp, Artificial sequence
  Synthetic oligonucleotide
ggaggcgttccggtgaacgtagaga

SEQ ID NO: 716930 - DNA, 25 bp, Artificial sequence
  Synthetic oligonucleotide
attggcggaggcgttccggtgaacg

SEQ ID NO: 716931 - DNA, 25 bp, Artificial sequence
  Synthetic oligonucleotide
atctcattggcggaggcgttccggt

SEQ ID NO: 716932 - DNA, 25 bp, Artificial sequence
  Synthetic oligonucleotide
tcgagcatctcattggcggaggcgt

SEQ ID NO: 716933 - DNA, 25 bp, Artificial sequence
  Synthetic oligonucleotide
gtccgcacttcgatcctttccaagg

SEQ ID NO: 716934 - DNA, 25 bp, Artificial sequence
  Synthetic oligonucleotide
tcctgtacggattcgagcatctcat

SEQ ID NO: 716935 - DNA, 25 bp, Artificial sequence
  Synthetic oligonucleotide
acttcgatcctttccaaggcatgga

SEQ ID NO: 716936 - DNA, 25 bp, Artificial sequence
  Synthetic oligonucleotide
gccctgaggcgctcctgtacggatt

SEQ ID NO: 716937 - DNA, 25 bp, Artificial sequence
  Synthetic oligonucleotide
aggagagccctgaggcgctcctgta

SEQ ID NO: 716938 - DNA, 25 bp, Artificial sequence
  Synthetic oligonucleotide
aggccgaggagagccctgaggcgct

SEQ ID NO: 716939 - DNA, 25 bp, Artificial sequence
  Synthetic oligonucleotide
ggaggaggccgaggagagccctgag

SEQ ID NO: 716940 - DNA, 25 bp, Artificial sequence
  Synthetic oligonucleotide
aggcatggaggaggccgaggagagc

SEQ ID NO: 716941 - DNA, 25 bp, Artificial sequence
  Synthetic oligonucleotide
ttccaaggcatggaggaggccgagg

SEQ ID NO: 716942 - DNA, 25 bp, Artificial sequence
  Synthetic oligonucleotide
tcaggaggtggtagcccggtgcgcg

SEQ ID NO: 716943 - DNA, 25 bp, Artificial sequence
  Synthetic oligonucleotide
acggattcgagcatctcattggcgg

SEQ ID NO: 716944 - DNA, 25 bp, Artificial sequence
  Synthetic oligonucleotide
tgagtatcagccttctgctgttcgt

SEQ ID NO: 716945 - DNA, 25 bp, Artificial sequence
  Synthetic oligonucleotide
gtagcccggtgcgcggccgtgagca

SEQ ID NO: 716946 - DNA, 25 bp, Artificial sequence
  Synthetic oligonucleotide
actcaacggcatcctgaagatgctg

SEQ ID NO: 716947 - DNA, 25 bp, Artificial sequence
  Synthetic oligonucleotide
catgctactcaacggcatcctgaag

SEQ ID NO: 716948 - DNA, 25 bp, Artificial sequence
  Synthetic oligonucleotide
ctacggcatgctactcaacggcatc

SEQ ID NO: 716949 - DNA, 25 bp, Artificial sequence
  Synthetic oligonucleotide
gccgctctacggcatgctactcaac

SEQ ID NO: 716950 - DNA, 25 bp, Artificial sequence
  Synthetic oligonucleotide
tgttcgtgccgctctacggcatgct

SEQ ID NO: 716951 - DNA, 25 bp, Artificial sequence
  Synthetic oligonucleotide
tcctgaagatgctgccggggcggcc

SEQ ID NO: 716952 - DNA, 25 bp, Artificial sequence
  Synthetic oligonucleotide
tcagccttctgctgttcgtgccgct

SEQ ID NO: 716953 - DNA, 25 bp, Artificial sequence
  Synthetic oligonucleotide
agatgctgccggggcggccgcagag

SEQ ID NO: 716954 - DNA, 25 bp, Artificial sequence
  Synthetic oligonucleotide
tgaagctgagtatcagccttctgct

SEQ ID NO: 716955 - DNA, 25 bp, Artificial sequence
  Synthetic oligonucleotide
acggagtgaagctgagtatcagcct

SEQ ID NO: 716956 - DNA, 25 bp, Artificial sequence
  Synthetic oligonucleotide
tggactacggagtgaagctgagtat

SEQ ID NO: 716957 - DNA, 25 bp, Artificial sequence
  Synthetic oligonucleotide
ccacggtggactacggagtgaagct

SEQ ID NO: 716958 - DNA, 25 bp, Artificial sequence
  Synthetic oligonucleotide
gaaatcgccacggtggactacggag

SEQ ID NO: 716959 - DNA, 25 bp, Artificial sequence
  Synthetic oligonucleotide
ctgggtggaaatcgccacggtggac

SEQ ID NO: 716960 - DNA, 25 bp, Artificial sequence
  Synthetic oligonucleotide
gcagcactgggtggaaatcgccacg

SEQ ID NO: 716961 - DNA, 25 bp, Artificial sequence
  Synthetic oligonucleotide
ttctgctgttcgtgccgctctacgg

SEQ ID NO: 716962 - DNA, 25 bp, Artificial sequence
  Synthetic oligonucleotide
aatctggaggaagggcgcaacggcc

SEQ ID NO: 716963 - DNA, 25 bp, Artificial sequence
  Synthetic oligonucleotide
aatcgcttgctcgtatgggtattcg

SEQ ID NO: 716964 - DNA, 25 bp, Artificial sequence
  Synthetic oligonucleotide
cttcattcaggaggtggtagcccgg

SEQ ID NO: 716965 - DNA, 25 bp, Artificial sequence
  Synthetic oligonucleotide
gcccttcttcattcaggaggtggta

SEQ ID NO: 716966 - DNA, 25 bp, Artificial sequence
  Synthetic oligonucleotide
ccgttgcgcccttcttcattcagga

SEQ ID NO: 716967 - DNA, 25 bp, Artificial sequence
  Synthetic oligonucleotide
ccgtgaccgttgcgcccttcttcat

SEQ ID NO: 716968 - DNA, 25 bp, Artificial sequence
  Synthetic oligonucleotide
caacggccgtgaccgttgcgccctt

SEQ ID NO: 716969 - DNA, 25 bp, Artificial sequence
  Synthetic oligonucleotide
acggcatcctgaagatgctgccggg

SEQ ID NO: 716970 - DNA, 25 bp, Artificial sequence
  Synthetic oligonucleotide
gaggaagggcgcaacggccgtgacc

SEQ ID NO: 716971 - DNA, 25 bp, Artificial sequence
  Synthetic oligonucleotide
aggtggtagcccggtgcgcggccgt

SEQ ID NO: 716972 - DNA, 25 bp, Artificial sequence
  Synthetic oligonucleotide
cgaggcaatctggaggaagggcgca

SEQ ID NO: 716973 - DNA, 25 bp, Artificial sequence
  Synthetic oligonucleotide
gcttatcgaggcaatctggaggaag

SEQ ID NO: 716974 - DNA, 25 bp, Artificial sequence
  Synthetic oligonucleotide
cttgaggcttatcgaggcaatctgg

SEQ ID NO: 716975 - DNA, 25 bp, Artificial sequence
  Synthetic oligonucleotide
caacgcttgaggcttatcgaggcaa

SEQ ID NO: 716976 - DNA, 25 bp, Artificial sequence
  Synthetic oligonucleotide
cgcagagcaacgcttgaggcttatc

SEQ ID NO: 716977 - DNA, 25 bp, Artificial sequence
  Synthetic oligonucleotide
ggcggccgcagagcaacgcttgagg

SEQ ID NO: 716978 - DNA, 25 bp, Artificial sequence
  Synthetic oligonucleotide
tgccggggcggccgcagagcaacgc

SEQ ID NO: 716979 - DNA, 25 bp, Artificial sequence
  Synthetic oligonucleotide
gggcgcaacggccgtgaccgttgcg

SEQ ID NO: 716980 - DNA, 25 bp, Artificial sequence
  Synthetic oligonucleotide
ttctgccagcgctcgatgagcacgc

SEQ ID NO: 716981 - DNA, 25 bp, Artificial sequence
  Synthetic oligonucleotide
gcgagaacgcgctgcgcaagccttg

SEQ ID NO: 716982 - DNA, 25 bp, Artificial sequence
  Synthetic oligonucleotide
gcgggtggcgagaacgcgctgcgca

SEQ ID NO: 716983 - DNA, 25 bp, Artificial sequence
  Synthetic oligonucleotide
cggccggcgggtggcgagaacgcgc

SEQ ID NO: 716984 - DNA, 25 bp, Artificial sequence
  Synthetic oligonucleotide
gaactccggccggcgggtggcgaga

SEQ ID NO: 716985 - DNA, 25 bp, Artificial sequence
  Synthetic oligonucleotide
ccgtctgccggaactccggccggcg

SEQ ID NO: 716986 - DNA, 25 bp, Artificial sequence
  Synthetic oligonucleotide
agcacgcccgacccgtctgccggaa

SEQ ID NO: 716987 - DNA, 25 bp, Artificial sequence
  Synthetic oligonucleotide
gtgaacgtagagaatcgcttgctcg

SEQ ID NO: 716988 - DNA, 25 bp, Artificial sequence
  Synthetic oligonucleotide
cagcgctcgatgagcacgcccgacc

SEQ ID NO: 716989 - DNA, 25 bp, Artificial sequence
  Synthetic oligonucleotide
agccttggccggacgctcaggttct

SEQ ID NO: 716990 - DNA, 25 bp, Artificial sequence
  Synthetic oligonucleotide
aaccgttctgccagcgctcgatgag

SEQ ID NO: 716991 - DNA, 25 bp, Artificial sequence
  Synthetic oligonucleotide
gctcgaaccgttctgccagcgctcg

SEQ ID NO: 716992 - DNA, 25 bp, Artificial sequence
  Synthetic oligonucleotide
gggcgtgctcgaaccgttctgccag

SEQ ID NO: 716993 - DNA, 25 bp, Artificial sequence
  Synthetic oligonucleotide
tcgtcggggcgtgctcgaaccgttc

SEQ ID NO: 716994 - DNA, 25 bp, Artificial sequence
  Synthetic oligonucleotide
aagtgtcgtcggggcgtgctcgaac

SEQ ID NO: 716995 - DNA, 25 bp, Artificial sequence
  Synthetic oligonucleotide
ttgtaaaagtgtcgtcggggcgtgc

SEQ ID NO: 716996 - DNA, 25 bp, Artificial sequence
  Synthetic oligonucleotide
tcgatgagcacgcccgacccgtctg

SEQ ID NO: 716997 - DNA, 25 bp, Artificial sequence
  Synthetic oligonucleotide
gcaggaacaccgtcatttccttttc

SEQ ID NO: 716998 - DNA, 25 bp, Artificial sequence
  Synthetic oligonucleotide
cgcggcagttgccaggccctgctcc

SEQ ID NO: 716999 - DNA, 25 bp, Artificial sequence
  Synthetic oligonucleotide
atgcgtcgcggcagttgccaggccc

SEQ ID NO: 717000 - DNA, 25 bp, Artificial sequence
  Synthetic oligonucleotide
gtcgccatgcgtcgcggcagttgcc

SEQ ID NO: 717001 - DNA, 25 bp, Artificial sequence
  Synthetic oligonucleotide
tgcttgtcgccatgcgtcgcggcag

SEQ ID NO: 717002 - DNA, 25 bp, Artificial sequence
  Synthetic oligonucleotide
tcggcctgcttgtcgccatgcgtcg

SEQ ID NO: 717003 - DNA, 25 bp, Artificial sequence
  Synthetic oligonucleotide
ccttttcggcctgcttgtcgccatg

SEQ ID NO: 717004 - DNA, 25 bp, Artificial sequence
  Synthetic oligonucleotide
acgcgctgcgcaagccttggccgga

SEQ ID NO: 717005 - DNA, 25 bp, Artificial sequence
  Synthetic oligonucleotide
acaccgtcatttccttttcggcctg

SEQ ID NO: 717006 - DNA, 25 bp, Artificial sequence
  Synthetic oligonucleotide
tgcgcaagccttggccggacgctca

SEQ ID NO: 717007 - DNA, 25 bp, Artificial sequence
  Synthetic oligonucleotide
gcttgcgcaggaacaccgtcatttc

SEQ ID NO: 717008 - DNA, 25 bp, Artificial sequence
  Synthetic oligonucleotide
tgtcgagcttgcgcaggaacaccgt

SEQ ID NO: 717009 - DNA, 25 bp, Artificial sequence
  Synthetic oligonucleotide
tcgccctgtcgagcttgcgcaggaa

SEQ ID NO: 717010 - DNA, 25 bp, Artificial sequence
  Synthetic oligonucleotide
aggttctcgccctgtcgagcttgcg

SEQ ID NO: 717011 - DNA, 25 bp, Artificial sequence
  Synthetic oligonucleotide
acgctcaggttctcgccctgtcgag

SEQ ID NO: 717012 - DNA, 25 bp, Artificial sequence
  Synthetic oligonucleotide
ggccggacgctcaggttctcgccct

SEQ ID NO: 717013 - DNA, 25 bp, Artificial sequence
  Synthetic oligonucleotide
atgtgtggaacaggtctttgtaaaa

SEQ ID NO: 717014 - DNA, 25 bp, Artificial sequence
  Synthetic oligonucleotide
tcatttccttttcggcctgcttgtc

SEQ ID NO: 717015 - DNA, 25 bp, Artificial sequence
  Synthetic oligonucleotide
tgcttcgacatgttggctccggaaa

SEQ ID NO: 717016 - DNA, 25 bp, Artificial sequence
  Synthetic oligonucleotide
caggtctttgtaaaagtgtcgtcgg

SEQ ID NO: 717017 - DNA, 25 bp, Artificial sequence
  Synthetic oligonucleotide
tcgcgttcgggctttgaccgaagcg

SEQ ID NO: 717018 - DNA, 25 bp, Artificial sequence
  Synthetic oligonucleotide
tcaggtgtcgcgttcgggctttgac

SEQ ID NO: 717019 - DNA, 25 bp, Artificial sequence
  Synthetic oligonucleotide
ttgaagtcaggtgtcgcgttcgggc

SEQ ID NO: 717020 - DNA, 25 bp, Artificial sequence
  Synthetic oligonucleotide
aagtagttgaagtcaggtgtcgcgt

SEQ ID NO: 717021 - DNA, 25 bp, Artificial sequence
  Synthetic oligonucleotide
cggaaaagtagttgaagtcaggtgt

SEQ ID NO: 717022 - DNA, 25 bp, Artificial sequence
  Synthetic oligonucleotide
ttgaccgaagcgatgagtcgaagct

SEQ ID NO: 717023 - DNA, 25 bp, Artificial sequence
  Synthetic oligonucleotide
gacatgttggctccggaaaagtagt

SEQ ID NO: 717024 - DNA, 25 bp, Artificial sequence
  Synthetic oligonucleotide
gaagcgatgagtcgaagctagaggg

SEQ ID NO: 717025 - DNA, 25 bp, Artificial sequence
  Synthetic oligonucleotide
cgctcttgcttcgacatgttggctc

SEQ ID NO: 717026 - DNA, 25 bp, Artificial sequence
  Synthetic oligonucleotide
actgaacgctcttgcttcgacatgt

SEQ ID NO: 717027 - DNA, 25 bp, Artificial sequence
  Synthetic oligonucleotide
gacgggactgaacgctcttgcttcg

SEQ ID NO: 717028 - DNA, 25 bp, Artificial sequence
  Synthetic oligonucleotide
acataggacgggactgaacgctctt

SEQ ID NO: 717029 - DNA, 25 bp, Artificial sequence
  Synthetic oligonucleotide
tattcgacataggacgggactgaac

SEQ ID NO: 717030 - DNA, 25 bp, Artificial sequence
  Synthetic oligonucleotide
tatgggtattcgacataggacggga

SEQ ID NO: 717031 - DNA, 25 bp, Artificial sequence
  Synthetic oligonucleotide
ttgctcgtatgggtattcgacatag

SEQ ID NO: 717032 - DNA, 25 bp, Artificial sequence
  Synthetic oligonucleotide
tggctccggaaaagtagttgaagtc

SEQ ID NO: 717033 - DNA, 25 bp, Artificial sequence
  Synthetic oligonucleotide
tgttgggcgttcgggatgcaggcta

SEQ ID NO: 717034 - DNA, 25 bp, Artificial sequence
  Synthetic oligonucleotide
agcgacaatccgttcatggcgcagc

SEQ ID NO: 717035 - DNA, 25 bp, Artificial sequence
  Synthetic oligonucleotide
ctacgaatgtgtggaacaggtcttt

SEQ ID NO: 717036 - DNA, 25 bp, Artificial sequence
  Synthetic oligonucleotide
agttgcctacgaatgtgtggaacag

SEQ ID NO: 717037 - DNA, 25 bp, Artificial sequence
  Synthetic oligonucleotide
gacagaagttgcctacgaatgtgtg

SEQ ID NO: 717038 - DNA, 25 bp, Artificial sequence
  Synthetic oligonucleotide
catcgttgacagaagttgcctacga

SEQ ID NO: 717039 - DNA, 25 bp, Artificial sequence
  Synthetic oligonucleotide
aggctacatcgttgacagaagttgc

SEQ ID NO: 717040 - DNA, 25 bp, Artificial sequence
  Synthetic oligonucleotide
cgggctttgaccgaagcgatgagtc

SEQ ID NO: 717041 - DNA, 25 bp, Artificial sequence
  Synthetic oligonucleotide
cgttcgggatgcaggctacatcgtt

SEQ ID NO: 717042 - DNA, 25 bp, Artificial sequence
  Synthetic oligonucleotide
tggaacaggtctttgtaaaagtgtc

SEQ ID NO: 717043 - DNA, 25 bp, Artificial sequence
  Synthetic oligonucleotide
atggggtgttgggcgttcgggatgc

SEQ ID NO: 717044 - DNA, 25 bp, Artificial sequence
  Synthetic oligonucleotide
cgctcaatggggtgttgggcgttcg

SEQ ID NO: 717045 - DNA, 25 bp, Artificial sequence
  Synthetic oligonucleotide
agtggtcgctcaatggggtgttggg

SEQ ID NO: 717046 - DNA, 25 bp, Artificial sequence
  Synthetic oligonucleotide
gccggcagtggtcgctcaatggggt

SEQ ID NO: 717047 - DNA, 25 bp, Artificial sequence
  Synthetic oligonucleotide
tagagggccggcagtggtcgctcaa

SEQ ID NO: 717048 - DNA, 25 bp, Artificial sequence
  Synthetic oligonucleotide
cgaagctagagggccggcagtggtc

SEQ ID NO: 717049 - DNA, 25 bp, Artificial sequence
  Synthetic oligonucleotide
atgagtcgaagctagagggccggca

SEQ ID NO: 717050 - DNA, 25 bp, Artificial sequence
  Synthetic oligonucleotide
ggatgcaggctacatcgttgacaga

SEQ ID NO: 717051 - DNA, 25 bp, Artificial sequence
  Synthetic oligonucleotide
accgctgccggttatcggctagaat

SEQ ID NO: 717052 - DNA, 25 bp, Artificial sequence
  Synthetic oligonucleotide
ggcatgggttccctcaccccatcgc

SEQ ID NO: 717053 - DNA, 25 bp, Artificial sequence
  Synthetic oligonucleotide
tgccgggcatgggttccctcacccc

SEQ ID NO: 717054 - DNA, 25 bp, Artificial sequence
  Synthetic oligonucleotide
gcatggtgccgggcatgggttccct

SEQ ID NO: 717055 - DNA, 25 bp, Artificial sequence
  Synthetic oligonucleotide
cgctcggcatggtgccgggcatggg

SEQ ID NO: 717056 - DNA, 25 bp, Artificial sequence
  Synthetic oligonucleotide
gcgcgccgctcggcatggtgccggg

SEQ ID NO: 717057 - DNA, 25 bp, Artificial sequence
  Synthetic oligonucleotide
tagaatgcgcgccgctcggcatggt

SEQ ID NO: 717058 - DNA, 25 bp, Artificial sequence
  Synthetic oligonucleotide
tcatggcgcagcactgggtggaaat

SEQ ID NO: 717059 - DNA, 25 bp, Artificial sequence
  Synthetic oligonucleotide
ccggttatcggctagaatgcgcgcc

SEQ ID NO: 717060 - DNA, 25 bp, Artificial sequence
  Synthetic oligonucleotide
catcgcgcaaaaaggacagcacatg

SEQ ID NO: 717061 - DNA, 25 bp, Artificial sequence
  Synthetic oligonucleotide
ggcgaaaccgctgccggttatcggc

SEQ ID NO: 717062 - DNA, 25 bp, Artificial sequence
  Synthetic oligonucleotide
cagagtgggcgaaaccgctgccggt

SEQ ID NO: 717063 - DNA, 25 bp, Artificial sequence
  Synthetic oligonucleotide
tgatcacagagtgggcgaaaccgct

SEQ ID NO: 717064 - DNA, 25 bp, Artificial sequence
  Synthetic oligonucleotide
agccactgatcacagagtgggcgaa

SEQ ID NO: 717065 - DNA, 25 bp, Artificial sequence
  Synthetic oligonucleotide
ggcatgagccactgatcacagagtg

SEQ ID NO: 717066 - DNA, 25 bp, Artificial sequence
  Synthetic oligonucleotide
aaccccaggcatgagccactgatca

SEQ ID NO: 717067 - DNA, 25 bp, Artificial sequence
  Synthetic oligonucleotide
atcggctagaatgcgcgccgctcgg

SEQ ID NO: 717068 - DNA, 25 bp, Artificial sequence
  Synthetic oligonucleotide
cggcctggcgcggcaccctggccgg

SEQ ID NO: 717069 - DNA, 25 bp, Artificial sequence
  Synthetic oligonucleotide
catcatcgccagcaactacctggtg

SEQ ID NO: 717070 - DNA, 25 bp, Artificial sequence
  Synthetic oligonucleotide
tcttcatcatcatcgccagcaacta

SEQ ID NO: 717071 - DNA, 25 bp, Artificial sequence
  Synthetic oligonucleotide
tccacatcttcatcatcatcgccag

SEQ ID NO: 717072 - DNA, 25 bp, Artificial sequence
  Synthetic oligonucleotide
tcgccttccacatcttcatcatcat

SEQ ID NO: 717073 - DNA, 25 bp, Artificial sequence
  Synthetic oligonucleotide
gcctgatcgccttccacatcttcat

SEQ ID NO: 717074 - DNA, 25 bp, Artificial sequence
  Synthetic oligonucleotide
tggccggcctgatcgccttccacat

SEQ ID NO: 717075 - DNA, 25 bp, Artificial sequence
  Synthetic oligonucleotide
gttccctcaccccatcgcgcaaaaa

SEQ ID NO: 717076 - DNA, 25 bp, Artificial sequence
  Synthetic oligonucleotide
ggcgcggcaccctggccggcctgat

SEQ ID NO: 717077 - DNA, 25 bp, Artificial sequence
  Synthetic oligonucleotide
tcaccccatcgcgcaaaaaggacag

SEQ ID NO: 717078 - DNA, 25 bp, Artificial sequence
  Synthetic oligonucleotide
ctccggcggcctggcgcggcaccct

SEQ ID NO: 717079 - DNA, 25 bp, Artificial sequence
  Synthetic oligonucleotide
ctcttctccggcggcctggcgcggc

SEQ ID NO: 717080 - DNA, 25 bp, Artificial sequence
  Synthetic oligonucleotide
gtcagcctcttctccggcggcctgg

SEQ ID NO: 717081 - DNA, 25 bp, Artificial sequence
  Synthetic oligonucleotide
gcacatgtcagcctcttctccggcg

SEQ ID NO: 717082 - DNA, 25 bp, Artificial sequence
  Synthetic oligonucleotide
aggacagcacatgtcagcctcttct

SEQ ID NO: 717083 - DNA, 25 bp, Artificial sequence
  Synthetic oligonucleotide
gcaaaaaggacagcacatgtcagcc

SEQ ID NO: 717084 - DNA, 25 bp, Artificial sequence
  Synthetic oligonucleotide
cggtgatgttccacgtggaacccca

SEQ ID NO: 717085 - DNA, 25 bp, Artificial sequence
  Synthetic oligonucleotide
gcaccctggccggcctgatcgcctt

SEQ ID NO: 717086 - DNA, 25 bp, Artificial sequence
  Synthetic oligonucleotide
atgtcaaacacccggatctgaccca

SEQ ID NO: 717087 - DNA, 25 bp, Artificial sequence
  Synthetic oligonucleotide
acgtggaaccccaggcatgagccac

SEQ ID NO: 717088 - DNA, 25 bp, Artificial sequence
  Synthetic oligonucleotide
gtcgttactggccaggtacaggatc

SEQ ID NO: 717089 - DNA, 25 bp, Artificial sequence
  Synthetic oligonucleotide
ggcagtgtcgttactggccaggtac

SEQ ID NO: 717090 - DNA, 25 bp, Artificial sequence
  Synthetic oligonucleotide
ccaacaggcagtgtcgttactggcc

SEQ ID NO: 717091 - DNA, 25 bp, Artificial sequence
  Synthetic oligonucleotide
cagctcccaacaggcagtgtcgtta

SEQ ID NO: 717092 - DNA, 25 bp, Artificial sequence
  Synthetic oligonucleotide
tgacccagctcccaacaggcagtgt

SEQ ID NO: 717093 - DNA, 25 bp, Artificial sequence
  Synthetic oligonucleotide
caggtacaggatctgccgatcgacg

SEQ ID NO: 717094 - DNA, 25 bp, Artificial sequence
  Synthetic oligonucleotide
aacacccggatctgacccagctccc

SEQ ID NO: 717095 - DNA, 25 bp, Artificial sequence
  Synthetic oligonucleotide
caggatctgccgatcgacgcgccga

SEQ ID NO: 717096 - DNA, 25 bp, Artificial sequence
  Synthetic oligonucleotide
gggtctatgtcaaacacccggatct

SEQ ID NO: 717097 - DNA, 25 bp, Artificial sequence
  Synthetic oligonucleotide
gacaccggggtctatgtcaaacacc

SEQ ID NO: 717098 - DNA, 25 bp, Artificial sequence
  Synthetic oligonucleotide
tctccgacaccggggtctatgtcaa

SEQ ID NO: 717099 - DNA, 25 bp, Artificial sequence
  Synthetic oligonucleotide
cgcgacctctccgacaccggggtct

SEQ ID NO: 717100 - DNA, 25 bp, Artificial sequence
  Synthetic oligonucleotide
cagacacgcgacctctccgacaccg

SEQ ID NO: 717101 - DNA, 25 bp, Artificial sequence
  Synthetic oligonucleotide
atggcgcagacacgcgacctctccg

SEQ ID NO: 717102 - DNA, 25 bp, Artificial sequence
  Synthetic oligonucleotide
agctgatggcgcagacacgcgacct

SEQ ID NO: 717103 - DNA, 25 bp, Artificial sequence
  Synthetic oligonucleotide
cggatctgacccagctcccaacagg

SEQ ID NO: 717104 - DNA, 25 bp, Artificial sequence
  Synthetic oligonucleotide
agtcgatgcggaaggcgtcggcctg

SEQ ID NO: 717105 - DNA, 25 bp, Artificial sequence
  Synthetic oligonucleotide
cctggtgcagttgccgatcaccctg

SEQ ID NO: 717106 - DNA, 25 bp, Artificial sequence
  Synthetic oligonucleotide
gcctgaacggtgatgttccacgtgg

SEQ ID NO: 717107 - DNA, 25 bp, Artificial sequence
  Synthetic oligonucleotide
agcgaagcctgaacggtgatgttcc

SEQ ID NO: 717108 - DNA, 25 bp, Artificial sequence
  Synthetic oligonucleotide
tttctcagcgaagcctgaacggtga

SEQ ID NO: 717109 - DNA, 25 bp, Artificial sequence
  Synthetic oligonucleotide
tgcgctttctcagcgaagcctgaac

SEQ ID NO: 717110 - DNA, 25 bp, Artificial sequence
  Synthetic oligonucleotide
tcggcctgcgctttctcagcgaagc

SEQ ID NO: 717111 - DNA, 25 bp, Artificial sequence
  Synthetic oligonucleotide
actggccaggtacaggatctgccga

SEQ ID NO: 717112 - DNA, 25 bp, Artificial sequence
  Synthetic oligonucleotide
tgcggaaggcgtcggcctgcgcttt

SEQ ID NO: 717113 - DNA, 25 bp, Artificial sequence
  Synthetic oligonucleotide
tgttccacgtggaaccccaggcatg

SEQ ID NO: 717114 - DNA, 25 bp, Artificial sequence
  Synthetic oligonucleotide
cgtgcgagtcgatgcggaaggcgtc

SEQ ID NO: 717115 - DNA, 25 bp, Artificial sequence
  Synthetic oligonucleotide
ggaagtcgtgcgagtcgatgcggaa

SEQ ID NO: 717116 - DNA, 25 bp, Artificial sequence
  Synthetic oligonucleotide
gcagatggaagtcgtgcgagtcgat

SEQ ID NO: 717117 - DNA, 25 bp, Artificial sequence
  Synthetic oligonucleotide
gatcctgcagatggaagtcgtgcga

SEQ ID NO: 717118 - DNA, 25 bp, Artificial sequence
  Synthetic oligonucleotide
cgcgccgatcctgcagatggaagtc

SEQ ID NO: 717119 - DNA, 25 bp, Artificial sequence
  Synthetic oligonucleotide
gatcgacgcgccgatcctgcagatg

SEQ ID NO: 717120 - DNA, 25 bp, Artificial sequence
  Synthetic oligonucleotide
tctgccgatcgacgcgccgatcctg

SEQ ID NO: 717121 - DNA, 25 bp, Artificial sequence
  Synthetic oligonucleotide
aaggcgtcggcctgcgctttctcag

SEQ ID NO: 717122 - DNA, 25 bp, Artificial sequence
  Synthetic oligonucleotide
aagcttcctcgcctatgtgctcggg

SEQ ID NO: 717123 - DNA, 25 bp, Artificial sequence
  Synthetic oligonucleotide
ttctccgcgctgctggagttcaaca

SEQ ID NO: 717124 - DNA, 25 bp, Artificial sequence
  Synthetic oligonucleotide
caggtattcgaccgcctccgtcgtt

SEQ ID NO: 717125 - DNA, 25 bp, Artificial sequence
  Synthetic oligonucleotide
acatccaggtattcgaccgcctccg

SEQ ID NO: 717126 - DNA, 25 bp, Artificial sequence
  Synthetic oligonucleotide
tcctcgacatccaggtattcgaccg

SEQ ID NO: 717127 - DNA, 25 bp, Artificial sequence
  Synthetic oligonucleotide
ggcagatcctcgacatccaggtatt

SEQ ID NO: 717128 - DNA, 25 bp, Artificial sequence
  Synthetic oligonucleotide
tgctcgggcagatcctcgacatcca

SEQ ID NO: 717129 - DNA, 25 bp, Artificial sequence
  Synthetic oligonucleotide
gcctccgtcgttcccggcactggtg

SEQ ID NO: 717130 - DNA, 25 bp, Artificial sequence
  Synthetic oligonucleotide
tcctcgcctatgtgctcgggcagat

SEQ ID NO: 717131 - DNA, 25 bp, Artificial sequence
  Synthetic oligonucleotide
tcgttcccggcactggtggaccgcg

SEQ ID NO: 717132 - DNA, 25 bp, Artificial sequence
  Synthetic oligonucleotide
cctggcaagcttcctcgcctatgtg

SEQ ID NO: 717133 - DNA, 25 bp, Artificial sequence
  Synthetic oligonucleotide
ggatatccctggcaagcttcctcgc

SEQ ID NO: 717134 - DNA, 25 bp, Artificial sequence
  Synthetic oligonucleotide
gtcgcacggatatccctggcaagct

SEQ ID NO: 717135 - DNA, 25 bp, Artificial sequence
  Synthetic oligonucleotide
accttcgtcgcacggatatccctgg

SEQ ID NO: 717136 - DNA, 25 bp, Artificial sequence
  Synthetic oligonucleotide
ttcaacaccttcgtcgcacggatat

SEQ ID NO: 717137 - DNA, 25 bp, Artificial sequence
  Synthetic oligonucleotide
ctggagttcaacaccttcgtcgcac

SEQ ID NO: 717138 - DNA, 25 bp, Artificial sequence
  Synthetic oligonucleotide
cgccagcaactacctggtgcagttg

SEQ ID NO: 717139 - DNA, 25 bp, Artificial sequence
  Synthetic oligonucleotide
cctatgtgctcgggcagatcctcga

SEQ ID NO: 717140 - DNA, 25 bp, Artificial sequence
  Synthetic oligonucleotide
gcaacctgctggacaccttcacctt

SEQ ID NO: 717141 - DNA, 25 bp, Artificial sequence
  Synthetic oligonucleotide
ctgctcccaggcctgccgggcgccc

SEQ ID NO: 717142 - DNA, 25 bp, Artificial sequence
  Synthetic oligonucleotide
tggcgtagcgacaatccgttcatgg

SEQ ID NO: 717143 - DNA, 25 bp, Artificial sequence
  Synthetic oligonucleotide
gcgttctggcgtagcgacaatccgt

SEQ ID NO: 717144 - DNA, 25 bp, Artificial sequence
  Synthetic oligonucleotide
ttcgtggcgttctggcgtagcgaca

SEQ ID NO: 717145 - DNA, 25 bp, Artificial sequence
  Synthetic oligonucleotide
ttcttcttcgtggcgttctggcgta

SEQ ID NO: 717146 - DNA, 25 bp, Artificial sequence
  Synthetic oligonucleotide
ttcaccttcttcttcgtggcgttct

SEQ ID NO: 717147 - DNA, 25 bp, Artificial sequence
  Synthetic oligonucleotide
tcgaccgcctccgtcgttcccggca

SEQ ID NO: 717148 - DNA, 25 bp, Artificial sequence
  Synthetic oligonucleotide
tgctggacaccttcaccttcttctt

SEQ ID NO: 717149 - DNA, 25 bp, Artificial sequence
  Synthetic oligonucleotide
cgtggtttctccgcgctgctggagt

SEQ ID NO: 717150 - DNA, 25 bp, Artificial sequence
  Synthetic oligonucleotide
tcctcggcaacctgctggacacctt

SEQ ID NO: 717151 - DNA, 25 bp, Artificial sequence
  Synthetic oligonucleotide
cgaccatcctcggcaacctgctgga

SEQ ID NO: 717152 - DNA, 25 bp, Artificial sequence
  Synthetic oligonucleotide
cgcctcgaccatcctcggcaacctg

SEQ ID NO: 717153 - DNA, 25 bp, Artificial sequence
  Synthetic oligonucleotide
gccagtcgcctcgaccatcctcggc

SEQ ID NO: 717154 - DNA, 25 bp, Artificial sequence
  Synthetic oligonucleotide
gaccgcgccagtcgcctcgaccatc

SEQ ID NO: 717155 - DNA, 25 bp, Artificial sequence
  Synthetic oligonucleotide
ctggtggaccgcgccagtcgcctcg

SEQ ID NO: 717156 - DNA, 25 bp, Artificial sequence
  Synthetic oligonucleotide
ccggcactggtggaccgcgccagtc

SEQ ID NO: 717157 - DNA, 25 bp, Artificial sequence
  Synthetic oligonucleotide
gacaccttcaccttcttcttcgtgg

SEQ ID NO: 717158 - DNA, 25 bp, Artificial sequence
  Synthetic oligonucleotide
acctggggcgccttcagctttccgt

SEQ ID NO: 717159 - DNA, 25 bp, Artificial sequence
  Synthetic oligonucleotide
gcgctgctggagttcaacaccttcg

SEQ ID NO: 717160 - DNA, 25 bp, Artificial sequence
  Synthetic oligonucleotide
gacctcaccgtgcgcttgctgggca

SEQ ID NO: 717161 - DNA, 25 bp, Artificial sequence
  Synthetic oligonucleotide
gctaccgacctcaccgtgcgcttgc

SEQ ID NO: 717162 - DNA, 25 bp, Artificial sequence
  Synthetic oligonucleotide
ttcctggctaccgacctcaccgtgc

SEQ ID NO: 717163 - DNA, 25 bp, Artificial sequence
  Synthetic oligonucleotide
gttcatcttcctggctaccgacctc

SEQ ID NO: 717164 - DNA, 25 bp, Artificial sequence
  Synthetic oligonucleotide
tttccgttcatcttcctggctaccg

SEQ ID NO: 717165 - DNA, 25 bp, Artificial sequence
  Synthetic oligonucleotide
cgcttgctgggcaagggccctgccc

SEQ ID NO: 717166 - DNA, 25 bp, Artificial sequence
  Synthetic oligonucleotide
ggcgccttcagctttccgttcatct

SEQ ID NO: 717167 - DNA, 25 bp, Artificial sequence
  Synthetic oligonucleotide
tgggcaagggccctgcccggctggt

SEQ ID NO: 717168 - DNA, 25 bp, Artificial sequence
  Synthetic oligonucleotide
cacaccacctggggcgccttcagct

SEQ ID NO: 717169 - DNA, 25 bp, Artificial sequence
  Synthetic oligonucleotide
ggctggcacaccacctggggcgcct

SEQ ID NO: 717170 - DNA, 25 bp, Artificial sequence
  Synthetic oligonucleotide
ctgtttggctggcacaccacctggg

SEQ ID NO: 717171 - DNA, 25 bp, Artificial sequence
  Synthetic oligonucleotide
atcaccctgtttggctggcacacca

SEQ ID NO: 717172 - DNA, 25 bp, Artificial sequence
  Synthetic oligonucleotide
tgccgatcaccctgtttggctggca

SEQ ID NO: 717173 - DNA, 25 bp, Artificial sequence
  Synthetic oligonucleotide
tgcagttgccgatcaccctgtttgg

SEQ ID NO: 717174 - DNA, 25 bp, Artificial sequence
  Synthetic oligonucleotide
aatccgttcatggcgcagcactggg

SEQ ID NO: 717175 - DNA, 25 bp, Artificial sequence
  Synthetic oligonucleotide
ttcagctttccgttcatcttcctgg

SEQ ID NO: 717176 - DNA, 25 bp, Artificial sequence
  Synthetic oligonucleotide
cgttgatcgcctcctacgtggtctc

SEQ ID NO: 717177 - DNA, 25 bp, Artificial sequence
  Synthetic oligonucleotide
cgttccgtggtttctccgcgctgct

SEQ ID NO: 717178 - DNA, 25 bp, Artificial sequence
  Synthetic oligonucleotide
agcggcgttccgtggtttctccgcg

SEQ ID NO: 717179 - DNA, 25 bp, Artificial sequence
  Synthetic oligonucleotide
caggaagcggcgttccgtggtttct

SEQ ID NO: 717180 - DNA, 25 bp, Artificial sequence
  Synthetic oligonucleotide
ttgttccaggaagcggcgttccgtg

SEQ ID NO: 717181 - DNA, 25 bp, Artificial sequence
  Synthetic oligonucleotide
cggtgttgttccaggaagcggcgtt

SEQ ID NO: 717182 - DNA, 25 bp, Artificial sequence
  Synthetic oligonucleotide
tggtctcggtgttgttccaggaagc

SEQ ID NO: 717183 - DNA, 25 bp, Artificial sequence
  Synthetic oligonucleotide
accgtgcgcttgctgggcaagggcc

SEQ ID NO: 717184 - DNA, 25 bp, Artificial sequence
  Synthetic oligonucleotide
tcgcctcctacgtggtctcggtgtt

SEQ ID NO: 717185 - DNA, 25 bp, Artificial sequence
  Synthetic oligonucleotide
caactacctggtgcagttgccgatc

SEQ ID NO: 717186 - DNA, 25 bp, Artificial sequence
  Synthetic oligonucleotide
tcccggcgttgatcgcctcctacgt

SEQ ID NO: 717187 - DNA, 25 bp, Artificial sequence
  Synthetic oligonucleotide
tcatgatcccggcgttgatcgcctc

SEQ ID NO: 717188 - DNA, 25 bp, Artificial sequence
  Synthetic oligonucleotide
cccgggtcatgatcccggcgttgat

SEQ ID NO: 717189 - DNA, 25 bp, Artificial sequence
  Synthetic oligonucleotide
tcatcgcccgggtcatgatcccggc

SEQ ID NO: 717190 - DNA, 25 bp, Artificial sequence
  Synthetic oligonucleotide
ggctggtcatcgcccgggtcatgat

SEQ ID NO: 717191 - DNA, 25 bp, Artificial sequence
  Synthetic oligonucleotide
ctgcccggctggtcatcgcccgggt

SEQ ID NO: 717192 - DNA, 25 bp, Artificial sequence
  Synthetic oligonucleotide
agggccctgcccggctggtcatcgc

SEQ ID NO: 717193 - DNA, 25 bp, Artificial sequence
  Synthetic oligonucleotide
cctacgtggtctcggtgttgttcca

SEQ ID NO: 717194 - DNA, 25 bp, Artificial sequence
  Synthetic oligonucleotide
tcggcctcgatcaccgtgtcgccct

SEQ ID NO: 717195 - DNA, 25 bp, Artificial sequence
  Synthetic oligonucleotide
cggtagatcgcggcgacgcgggtat

SEQ ID NO: 717196 - DNA, 25 bp, Artificial sequence
  Synthetic oligonucleotide
ttgcggcggtagatcgcggcgacgc

SEQ ID NO: 717197 - DNA, 25 bp, Artificial sequence
  Synthetic oligonucleotide
ggccggttgcggcggtagatcgcgg

SEQ ID NO: 717198 - DNA, 25 bp, Artificial sequence
  Synthetic oligonucleotide
atgatcggccggttgcggcggtaga

SEQ ID NO: 717199 - DNA, 25 bp, Artificial sequence
  Synthetic oligonucleotide
tggggaatgatcggccggttgcggc

SEQ ID NO: 717200 - DNA, 25 bp, Artificial sequence
  Synthetic oligonucleotide
tcgccctggggaatgatcggccggt

SEQ ID NO: 717201 - DNA, 25 bp, Artificial sequence
  Synthetic oligonucleotide
ttttcctccagcagcaggtcgcggt

SEQ ID NO: 717202 - DNA, 25 bp, Artificial sequence
  Synthetic oligonucleotide
tcgatcaccgtgtcgccctggggaa

SEQ ID NO: 717203 - DNA, 25 bp, Artificial sequence
  Synthetic oligonucleotide
gggtatccacgttcggcatgtgctc

SEQ ID NO: 717204 - DNA, 25 bp, Artificial sequence
  Synthetic oligonucleotide
tcgtcgtcggcctcgatcaccgtgt

SEQ ID NO: 717205 - DNA, 25 bp, Artificial sequence
  Synthetic oligonucleotide
aagacttcgtcgtcggcctcgatca

SEQ ID NO: 717206 - DNA, 25 bp, Artificial sequence
  Synthetic oligonucleotide
atgaagaagacttcgtcgtcggcct

SEQ ID NO: 717207 - DNA, 25 bp, Artificial sequence
  Synthetic oligonucleotide
gcggcgatgaagaagacttcgtcgt

SEQ ID NO: 717208 - DNA, 25 bp, Artificial sequence
  Synthetic oligonucleotide
gccttggcggcgatgaagaagactt

SEQ ID NO: 717209 - DNA, 25 bp, Artificial sequence
  Synthetic oligonucleotide
gatatgggccttggcggcgatgaag

SEQ ID NO: 717210 - DNA, 25 bp, Artificial sequence
  Synthetic oligonucleotide
accgtgtcgccctggggaatgatcg

SEQ ID NO: 717211 - DNA, 25 bp, Artificial sequence
  Synthetic oligonucleotide
ctcctgccctaccagagggccgccg

SEQ ID NO: 717212 - DNA, 25 bp, Artificial sequence
  Synthetic oligonucleotide
tgcgccttgccctcggcgaagtcga

SEQ ID NO: 717213 - DNA, 25 bp, Artificial sequence
  Synthetic oligonucleotide
gaccaactgcgccttgccctcggcg

SEQ ID NO: 717214 - DNA, 25 bp, Artificial sequence
  Synthetic oligonucleotide
gatcccgaccaactgcgccttgccc

SEQ ID NO: 717215 - DNA, 25 bp, Artificial sequence
  Synthetic oligonucleotide
ggccttgatcccgaccaactgcgcc

SEQ ID NO: 717216 - DNA, 25 bp, Artificial sequence
  Synthetic oligonucleotide
gtagtaggccttgatcccgaccaac

SEQ ID NO: 717217 - DNA, 25 bp, Artificial sequence
  Synthetic oligonucleotide
gccgccgtagtaggccttgatcccg

SEQ ID NO: 717218 - DNA, 25 bp, Artificial sequence
  Synthetic oligonucleotide
tcgcggcgacgcgggtatccacgtt

SEQ ID NO: 717219 - DNA, 25 bp, Artificial sequence
  Synthetic oligonucleotide
ccctaccagagggccgccgtagtag

SEQ ID NO: 717220 - DNA, 25 bp, Artificial sequence
  Synthetic oligonucleotide
cgacgcgggtatccacgttcggcat

SEQ ID NO: 717221 - DNA, 25 bp, Artificial sequence
  Synthetic oligonucleotide
gcgcagctcctgccctaccagaggg

SEQ ID NO: 717222 - DNA, 25 bp, Artificial sequence
  Synthetic oligonucleotide
cagctggcgcagctcctgccctacc

SEQ ID NO: 717223 - DNA, 25 bp, Artificial sequence
  Synthetic oligonucleotide
ctcgcgcagctggcgcagctcctgc

SEQ ID NO: 717224 - DNA, 25 bp, Artificial sequence
  Synthetic oligonucleotide
atgtgctcgcgcagctggcgcagct

SEQ ID NO: 717225 - DNA, 25 bp, Artificial sequence
  Synthetic oligonucleotide
ttcggcatgtgctcgcgcagctggc

SEQ ID NO: 717226 - DNA, 25 bp, Artificial sequence
  Synthetic oligonucleotide
ccacgttcggcatgtgctcgcgcag

SEQ ID NO: 717227 - DNA, 25 bp, Artificial sequence
  Synthetic oligonucleotide
tctcgcccattaccgcgcggatatg

SEQ ID NO: 717228 - DNA, 25 bp, Artificial sequence
  Synthetic oligonucleotide
cagagggccgccgtagtaggccttg

SEQ ID NO: 717229 - DNA, 25 bp, Artificial sequence
  Synthetic oligonucleotide
tggtgctgtccagggtatccgagag

SEQ ID NO: 717230 - DNA, 25 bp, Artificial sequence
  Synthetic oligonucleotide
cgcgcggatatgggccttggcggcg

SEQ ID NO: 717231 - DNA, 25 bp, Artificial sequence
  Synthetic oligonucleotide
gctgcgctcgatgatctttacctgg

SEQ ID NO: 717232 - DNA, 25 bp, Artificial sequence
  Synthetic oligonucleotide
cagcgggctgcgctcgatgatcttt

SEQ ID NO: 717233 - DNA, 25 bp, Artificial sequence
  Synthetic oligonucleotide
ggcagcgcagcgggctgcgctcgat

SEQ ID NO: 717234 - DNA, 25 bp, Artificial sequence
  Synthetic oligonucleotide
aggtgccggcagcgcagcgggctgc

SEQ ID NO: 717235 - DNA, 25 bp, Artificial sequence
  Synthetic oligonucleotide
tccgagaggtgccggcagcgcagcg

SEQ ID NO: 717236 - DNA, 25 bp, Artificial sequence
  Synthetic oligonucleotide
gatctttacctggtagcggctctcg

SEQ ID NO: 717237 - DNA, 25 bp, Artificial sequence
  Synthetic oligonucleotide
ctgtccagggtatccgagaggtgcc

SEQ ID NO: 717238 - DNA, 25 bp, Artificial sequence
  Synthetic oligonucleotide
tacctggtagcggctctcgatggcc

SEQ ID NO: 717239 - DNA, 25 bp, Artificial sequence
  Synthetic oligonucleotide
gcacgatggtgctgtccagggtatc

SEQ ID NO: 717240 - DNA, 25 bp, Artificial sequence
  Synthetic oligonucleotide
cgttgagcacgatggtgctgtccag

SEQ ID NO: 717241 - DNA, 25 bp, Artificial sequence
  Synthetic oligonucleotide
cgctgccgttgagcacgatggtgct

SEQ ID NO: 717242 - DNA, 25 bp, Artificial sequence
  Synthetic oligonucleotide
tcggaagcgctgccgttgagcacga

SEQ ID NO: 717243 - DNA, 25 bp, Artificial sequence
  Synthetic oligonucleotide
tcgcggtcggaagcgctgccgttga

SEQ ID NO: 717244 - DNA, 25 bp, Artificial sequence
  Synthetic oligonucleotide
agcaggtcgcggtcggaagcgctgc

SEQ ID NO: 717245 - DNA, 25 bp, Artificial sequence
  Synthetic oligonucleotide
agttgccaggccctgctcccaggcc

SEQ ID NO: 717246 - DNA, 25 bp, Artificial sequence
  Synthetic oligonucleotide
agggtatccgagaggtgccggcagc

SEQ ID NO: 717247 - DNA, 25 bp, Artificial sequence
  Synthetic oligonucleotide
cgccgccggcgatgatgatccgctt

SEQ ID NO: 717248 - DNA, 25 bp, Artificial sequence
  Synthetic oligonucleotide
aagtcgatgacttgcagcgcgccgg

SEQ ID NO: 717249 - DNA, 25 bp, Artificial sequence
  Synthetic oligonucleotide
tgcgcatctcgcccattaccgcgcg

SEQ ID NO: 717250 - DNA, 25 bp, Artificial sequence
  Synthetic oligonucleotide
cgagcctgcgcatctcgcccattac

SEQ ID NO: 717251 - DNA, 25 bp, Artificial sequence
  Synthetic oligonucleotide
tgtcgtcgagcctgcgcatctcgcc

SEQ ID NO: 717252 - DNA, 25 bp, Artificial sequence
  Synthetic oligonucleotide
tgtagctgtcgtcgagcctgcgcat

SEQ ID NO: 717253 - DNA, 25 bp, Artificial sequence
  Synthetic oligonucleotide
tccgcttgtagctgtcgtcgagcct

SEQ ID NO: 717254 - DNA, 25 bp, Artificial sequence
  Synthetic oligonucleotide
ctcgatgatctttacctggtagcgg

SEQ ID NO: 717255 - DNA, 25 bp, Artificial sequence
  Synthetic oligonucleotide
cggcgatgatgatccgcttgtagct

SEQ ID NO: 717256 - DNA, 25 bp, Artificial sequence
  Synthetic oligonucleotide
cattaccgcgcggatatgggccttg

SEQ ID NO: 717257 - DNA, 25 bp, Artificial sequence
  Synthetic oligonucleotide
acattgccgccgccggcgatgatga

SEQ ID NO: 717258 - DNA, 25 bp, Artificial sequence
  Synthetic oligonucleotide
tcgccgacattgccgccgccggcga

SEQ ID NO: 717259 - DNA, 25 bp, Artificial sequence
  Synthetic oligonucleotide
aggcgctcgccgacattgccgccgc

SEQ ID NO: 717260 - DNA, 25 bp, Artificial sequence
  Synthetic oligonucleotide
tcggccaggcgctcgccgacattgc

SEQ ID NO: 717261 - DNA, 25 bp, Artificial sequence
  Synthetic oligonucleotide
atggcctcggccaggcgctcgccga

SEQ ID NO: 717262 - DNA, 25 bp, Artificial sequence
  Synthetic oligonucleotide
ctctcgatggcctcggccaggcgct

SEQ ID NO: 717263 - DNA, 25 bp, Artificial sequence
  Synthetic oligonucleotide
gtagcggctctcgatggcctcggcc

SEQ ID NO: 717264 - DNA, 25 bp, Artificial sequence
  Synthetic oligonucleotide
tgatgatccgcttgtagctgtcgtc

SEQ ID NO: 717265 - DNA, 25 bp, Artificial sequence
  Synthetic oligonucleotide
cgcagcaccgtggggaacgaggcct

SEQ ID NO: 717266 - DNA, 25 bp, Artificial sequence
  Synthetic oligonucleotide
gctattggtcaccgccaccagcatg

SEQ ID NO: 717267 - DNA, 25 bp, Artificial sequence
  Synthetic oligonucleotide
tgtcgaggcggtcgccgaggtcgcg

SEQ ID NO: 717268 - DNA, 25 bp, Artificial sequence
  Synthetic oligonucleotide
tgcggatgtcgaggcggtcgccgag

SEQ ID NO: 717269 - DNA, 25 bp, Artificial sequence
  Synthetic oligonucleotide
gcacggtgcggatgtcgaggcggtc

SEQ ID NO: 717270 - DNA, 25 bp, Artificial sequence
  Synthetic oligonucleotide
tgccttgcacggtgcggatgtcgag

SEQ ID NO: 717271 - DNA, 25 bp, Artificial sequence
  Synthetic oligonucleotide
aggccttgccttgcacggtgcggat

SEQ ID NO: 717272 - DNA, 25 bp, Artificial sequence
  Synthetic oligonucleotide
gccgaggtcgcgcaggcggtcgccg

SEQ ID NO: 717273 - DNA, 25 bp, Artificial sequence
  Synthetic oligonucleotide
ccgtggggaacgaggccttgccttg

SEQ ID NO: 717274 - DNA, 25 bp, Artificial sequence
  Synthetic oligonucleotide
gtcgcgcaggcggtcgccgtcggtg

SEQ ID NO: 717275 - DNA, 25 bp, Artificial sequence
  Synthetic oligonucleotide
gcctggcgcagcaccgtggggaacg

SEQ ID NO: 717276 - DNA, 25 bp, Artificial sequence
  Synthetic oligonucleotide
gcgccggcctggcgcagcaccgtgg

SEQ ID NO: 717277 - DNA, 25 bp, Artificial sequence
  Synthetic oligonucleotide
tcgtcggcgccggcctggcgcagca

SEQ ID NO: 717278 - DNA, 25 bp, Artificial sequence
  Synthetic oligonucleotide
tcggcgtcgtcggcgccggcctggc

SEQ ID NO: 717279 - DNA, 25 bp, Artificial sequence
  Synthetic oligonucleotide
agcatgtcggcgtcgtcggcgccgg

SEQ ID NO: 717280 - DNA, 25 bp, Artificial sequence
  Synthetic oligonucleotide
gccaccagcatgtcggcgtcgtcgg

SEQ ID NO: 717281 - DNA, 25 bp, Artificial sequence
  Synthetic oligonucleotide
ttgccctcggcgaagtcgatgactt

SEQ ID NO: 717282 - DNA, 25 bp, Artificial sequence
  Synthetic oligonucleotide
ggaacgaggccttgccttgcacggt

SEQ ID NO: 717283 - DNA, 25 bp, Artificial sequence
  Synthetic oligonucleotide
gcttcgctggccaggtgctcggcca

SEQ ID NO: 717284 - DNA, 25 bp, Artificial sequence
  Synthetic oligonucleotide
gcagtcacttcgtcgagcaggctcg

SEQ ID NO: 717285 - DNA, 25 bp, Artificial sequence
  Synthetic oligonucleotide
ggccggcaccgaggatgatgatttt

SEQ ID NO: 717286 - DNA, 25 bp, Artificial sequence
  Synthetic oligonucleotide
cgacctggccggcaccgaggatgat

SEQ ID NO: 717287 - DNA, 25 bp, Artificial sequence
  Synthetic oligonucleotide
tgccgccgacctggccggcaccgag

SEQ ID NO: 717288 - DNA, 25 bp, Artificial sequence
  Synthetic oligonucleotide
cagtgtgccgccgacctggccggca

SEQ ID NO: 717289 - DNA, 25 bp, Artificial sequence
  Synthetic oligonucleotide
ctcggccagtgtgccgccgacctgg

SEQ ID NO: 717290 - DNA, 25 bp, Artificial sequence
  Synthetic oligonucleotide
ggcggtcgccgaggtcgcgcaggcg

SEQ ID NO: 717291 - DNA, 25 bp, Artificial sequence
  Synthetic oligonucleotide
ctggccaggtgctcggccagtgtgc

SEQ ID NO: 717292 - DNA, 25 bp, Artificial sequence
  Synthetic oligonucleotide
ctcgtcgctattggtcaccgccacc

SEQ ID NO: 717293 - DNA, 25 bp, Artificial sequence
  Synthetic oligonucleotide
cgttggcttcgctggccaggtgctc

SEQ ID NO: 717294 - DNA, 25 bp, Artificial sequence
  Synthetic oligonucleotide
gatgtcgttggcttcgctggccagg

SEQ ID NO: 717295 - DNA, 25 bp, Artificial sequence
  Synthetic oligonucleotide
cacggtgatgtcgttggcttcgctg

SEQ ID NO: 717296 - DNA, 25 bp, Artificial sequence
  Synthetic oligonucleotide
tcgaccacggtgatgtcgttggctt

SEQ ID NO: 717297 - DNA, 25 bp, Artificial sequence
  Synthetic oligonucleotide
tcggtgtcgaccacggtgatgtcgt

SEQ ID NO: 717298 - DNA, 25 bp, Artificial sequence
  Synthetic oligonucleotide
gtcgccgtcggtgtcgaccacggtg

SEQ ID NO: 717299 - DNA, 25 bp, Artificial sequence
  Synthetic oligonucleotide
caggcggtcgccgtcggtgtcgacc

SEQ ID NO: 717300 - DNA, 25 bp, Artificial sequence
  Synthetic oligonucleotide
aggtgctcggccagtgtgccgccga

SEQ ID NO: 717301 - DNA, 25 bp, Artificial sequence
  Synthetic oligonucleotide
tgatgtagttggtgaccacctgctc

SEQ ID NO: 717302 - DNA, 25 bp, Artificial sequence
  Synthetic oligonucleotide
ggtcaccgccaccagcatgtcggcg

SEQ ID NO: 717303 - DNA, 25 bp, Artificial sequence
  Synthetic oligonucleotide
caccgggatcgcctcgttgtcgaac

SEQ ID NO: 717304 - DNA, 25 bp, Artificial sequence
  Synthetic oligonucleotide
cacgtccaccgggatcgcctcgttg

SEQ ID NO: 717305 - DNA, 25 bp, Artificial sequence
  Synthetic oligonucleotide
tgatcagcacgtccaccgggatcgc

SEQ ID NO: 717306 - DNA, 25 bp, Artificial sequence
  Synthetic oligonucleotide
ccgggctgatcagcacgtccaccgg

SEQ ID NO: 717307 - DNA, 25 bp, Artificial sequence
  Synthetic oligonucleotide
cctgctccgggctgatcagcacgtc

SEQ ID NO: 717308 - DNA, 25 bp, Artificial sequence
  Synthetic oligonucleotide
cctcgttgtcgaacagcccggtacg

SEQ ID NO: 717309 - DNA, 25 bp, Artificial sequence
  Synthetic oligonucleotide
agttggtgaccacctgctccgggct

SEQ ID NO: 717310 - DNA, 25 bp, Artificial sequence
  Synthetic oligonucleotide
tgtcgaacagcccggtacgggtcag

SEQ ID NO: 717311 - DNA, 25 bp, Artificial sequence
  Synthetic oligonucleotide
ggcgcttgatgtagttggtgaccac

SEQ ID NO: 717312 - DNA, 25 bp, Artificial sequence
  Synthetic oligonucleotide
cgatcaggcgcttgatgtagttggt

SEQ ID NO: 717313 - DNA, 25 bp, Artificial sequence
  Synthetic oligonucleotide
ggtgttcgatcaggcgcttgatgta

SEQ ID NO: 717314 - DNA, 25 bp, Artificial sequence
  Synthetic oligonucleotide
gcgccggggtgttcgatcaggcgct

SEQ ID NO: 717315 - DNA, 25 bp, Artificial sequence
  Synthetic oligonucleotide
tgcagcgcgccggggtgttcgatca

SEQ ID NO: 717316 - DNA, 25 bp, Artificial sequence
  Synthetic oligonucleotide
atgacttgcagcgcgccggggtgtt

SEQ ID NO: 717317 - DNA, 25 bp, Artificial sequence
  Synthetic oligonucleotide
cgatgttttcctccagcagcaggtc

SEQ ID NO: 717318 - DNA, 25 bp, Artificial sequence
  Synthetic oligonucleotide
tgaccacctgctccgggctgatcag

SEQ ID NO: 717319 - DNA, 25 bp, Artificial sequence
  Synthetic oligonucleotide
tggtcggggtgttgaacagggtgta

SEQ ID NO: 717320 - DNA, 25 bp, Artificial sequence
  Synthetic oligonucleotide
ttggtctcgtcgctattggtcaccg

SEQ ID NO: 717321 - DNA, 25 bp, Artificial sequence
  Synthetic oligonucleotide
accatgttggtctcgtcgctattgg

SEQ ID NO: 717322 - DNA, 25 bp, Artificial sequence
  Synthetic oligonucleotide
caggcgaccatgttggtctcgtcgc

SEQ ID NO: 717323 - DNA, 25 bp, Artificial sequence
  Synthetic oligonucleotide
cctggcaggcgaccatgttggtctc

SEQ ID NO: 717324 - DNA, 25 bp, Artificial sequence
  Synthetic oligonucleotide
aggcgacctggcaggcgaccatgtt

SEQ ID NO: 717325 - DNA, 25 bp, Artificial sequence
  Synthetic oligonucleotide
gggtgtaggcgacctggcaggcgac

SEQ ID NO: 717326 - DNA, 25 bp, Artificial sequence
  Synthetic oligonucleotide
ggatcgcctcgttgtcgaacagccc

SEQ ID NO: 717327 - DNA, 25 bp, Artificial sequence
  Synthetic oligonucleotide
gggtgttgaacagggtgtaggcgac

SEQ ID NO: 717328 - DNA, 25 bp, Artificial sequence
  Synthetic oligonucleotide
tcggcgaagtcgatgacttgcagcg

SEQ ID NO: 717329 - DNA, 25 bp, Artificial sequence
  Synthetic oligonucleotide
gatcttggtcggggtgttgaacagg

SEQ ID NO: 717330 - DNA, 25 bp, Artificial sequence
  Synthetic oligonucleotide
gcgggcgatcttggtcggggtgttg

SEQ ID NO: 717331 - DNA, 25 bp, Artificial sequence
  Synthetic oligonucleotide
gcggacgcgggcgatcttggtcggg

SEQ ID NO: 717332 - DNA, 25 bp, Artificial sequence
  Synthetic oligonucleotide
cggctcgcggacgcgggcgatcttg

SEQ ID NO: 717333 - DNA, 25 bp, Artificial sequence
  Synthetic oligonucleotide
gtaggccggctcgcggacgcgggcg

SEQ ID NO: 717334 - DNA, 25 bp, Artificial sequence
  Synthetic oligonucleotide
gtcaggtaggccggctcgcggacgc

SEQ ID NO: 717335 - DNA, 25 bp, Artificial sequence
  Synthetic oligonucleotide
gtacgggtcaggtaggccggctcgc

SEQ ID NO: 717336 - DNA, 25 bp, Artificial sequence
  Synthetic oligonucleotide
tgaacagggtgtaggcgacctggca

SEQ ID NO: 717337 - DNA, 25 bp, Artificial sequence
  Synthetic oligonucleotide
cattgtgcccggctccggccaggct

SEQ ID NO: 717338 - DNA, 25 bp, Artificial sequence
  Synthetic oligonucleotide
ccgttgcgaaggaggcacgcggccc

SEQ ID NO: 717339 - DNA, 25 bp, Artificial sequence
  Synthetic oligonucleotide
ttcggccgttgcgaaggaggcacgc

SEQ ID NO: 717340 - DNA, 25 bp, Artificial sequence
  Synthetic oligonucleotide
gagggattcggccgttgcgaaggag

SEQ ID NO: 717341 - DNA, 25 bp, Artificial sequence
  Synthetic oligonucleotide
ggaacagagggattcggccgttgcg

SEQ ID NO: 717342 - DNA, 25 bp, Artificial sequence
  Synthetic oligonucleotide
ttgcacggaacagagggattcggcc

SEQ ID NO: 717343 - DNA, 25 bp, Artificial sequence
  Synthetic oligonucleotide
caggctttgcacggaacagagggat

SEQ ID NO: 717344 - DNA, 25 bp, Artificial sequence
  Synthetic oligonucleotide
tccagcagcaggtcgcggtcggaag

SEQ ID NO: 717345 - DNA, 25 bp, Artificial sequence
  Synthetic oligonucleotide
cccggctccggccaggctttgcacg

SEQ ID NO: 717346 - DNA, 25 bp, Artificial sequence
  Synthetic oligonucleotide
cttggtgttcgtaggccgaagccct

SEQ ID NO: 717347 - DNA, 25 bp, Artificial sequence
  Synthetic oligonucleotide
tgtcggccattgtgcccggctccgg

SEQ ID NO: 717348 - DNA, 25 bp, Artificial sequence
  Synthetic oligonucleotide
aacgatgtcggccattgtgcccggc

SEQ ID NO: 717349 - DNA, 25 bp, Artificial sequence
  Synthetic oligonucleotide
ctcttccaacgatgtcggccattgt

SEQ ID NO: 717350 - DNA, 25 bp, Artificial sequence
  Synthetic oligonucleotide
cctgccctcttccaacgatgtcggc

SEQ ID NO: 717351 - DNA, 25 bp, Artificial sequence
  Synthetic oligonucleotide
catcatcctgccctcttccaacgat

SEQ ID NO: 717352 - DNA, 25 bp, Artificial sequence
  Synthetic oligonucleotide
cttcgatcatcatcctgccctcttc

SEQ ID NO: 717353 - DNA, 25 bp, Artificial sequence
  Synthetic oligonucleotide
tccggccaggctttgcacggaacag

SEQ ID NO: 717354 - DNA, 25 bp, Artificial sequence
  Synthetic oligonucleotide
agggcgtgcctcagaagaacgtcag

SEQ ID NO: 717355 - DNA, 25 bp, Artificial sequence
  Synthetic oligonucleotide
acgtctcggatgtatttcttgtcga

SEQ ID NO: 717356 - DNA, 25 bp, Artificial sequence
  Synthetic oligonucleotide
cgctcgacgtctcggatgtatttct

SEQ ID NO: 717357 - DNA, 25 bp, Artificial sequence
  Synthetic oligonucleotide
aacagtcgctcgacgtctcggatgt

SEQ ID NO: 717358 - DNA, 25 bp, Artificial sequence
  Synthetic oligonucleotide
gcctggaacagtcgctcgacgtctc

SEQ ID NO: 717359 - DNA, 25 bp, Artificial sequence
  Synthetic oligonucleotide
aggccggcctggaacagtcgctcga

SEQ ID NO: 717360 - DNA, 25 bp, Artificial sequence
  Synthetic oligonucleotide
aacgtcaggccggcctggaacagtc

SEQ ID NO: 717361 - DNA, 25 bp, Artificial sequence
  Synthetic oligonucleotide
cgaaggaggcacgcggccccttggt

SEQ ID NO: 717362 - DNA, 25 bp, Artificial sequence
  Synthetic oligonucleotide
tgcctcagaagaacgtcaggccggc

SEQ ID NO: 717363 - DNA, 25 bp, Artificial sequence
  Synthetic oligonucleotide
ggcacgcggccccttggtgttcgta

SEQ ID NO: 717364 - DNA, 25 bp, Artificial sequence
  Synthetic oligonucleotide
gcgatagggcgtgcctcagaagaac

SEQ ID NO: 717365 - DNA, 25 bp, Artificial sequence
  Synthetic oligonucleotide
ccgttcgcgatagggcgtgcctcag

SEQ ID NO: 717366 - DNA, 25 bp, Artificial sequence
  Synthetic oligonucleotide
ctatcgccgttcgcgatagggcgtg

SEQ ID NO: 717367 - DNA, 25 bp, Artificial sequence
  Synthetic oligonucleotide
gaagccctatcgccgttcgcgatag

SEQ ID NO: 717368 - DNA, 25 bp, Artificial sequence
  Synthetic oligonucleotide
taggccgaagccctatcgccgttcg

SEQ ID NO: 717369 - DNA, 25 bp, Artificial sequence
  Synthetic oligonucleotide
gttcgtaggccgaagccctatcgcc

SEQ ID NO: 717370 - DNA, 25 bp, Artificial sequence
  Synthetic oligonucleotide
gccagcatcttttccagaccttcga

SEQ ID NO: 717371 - DNA, 25 bp, Artificial sequence
  Synthetic oligonucleotide
agaagaacgtcaggccggcctggaa

SEQ ID NO: 717372 - DNA, 25 bp, Artificial sequence
  Synthetic oligonucleotide
ctggcgcgccttgcccagcagcttc

SEQ ID NO: 717373 - DNA, 25 bp, Artificial sequence
  Synthetic oligonucleotide
ccagaccttcgatcatcatcctgcc

SEQ ID NO: 717374 - DNA, 25 bp, Artificial sequence
  Synthetic oligonucleotide
tcgggtcctgctctacgcagcgctg

SEQ ID NO: 717375 - DNA, 25 bp, Artificial sequence
  Synthetic oligonucleotide
aatacttcgggtcctgctctacgca

SEQ ID NO: 717376 - DNA, 25 bp, Artificial sequence
  Synthetic oligonucleotide
cggcggaatacttcgggtcctgctc

SEQ ID NO: 717377 - DNA, 25 bp, Artificial sequence
  Synthetic oligonucleotide
tccagccggcggaatacttcgggtc

SEQ ID NO: 717378 - DNA, 25 bp, Artificial sequence
  Synthetic oligonucleotide
gcagcttccagccggcggaatactt

SEQ ID NO: 717379 - DNA, 25 bp, Artificial sequence
  Synthetic oligonucleotide
ctacgcagcgctggaggtgttccgc

SEQ ID NO: 717380 - DNA, 25 bp, Artificial sequence
  Synthetic oligonucleotide
cgccttgcccagcagcttccagccg

SEQ ID NO: 717381 - DNA, 25 bp, Artificial sequence
  Synthetic oligonucleotide
agcgctggaggtgttccgccgcgcg

SEQ ID NO: 717382 - DNA, 25 bp, Artificial sequence
  Synthetic oligonucleotide
gcagcctggcgcgccttgcccagca

SEQ ID NO: 717383 - DNA, 25 bp, Artificial sequence
  Synthetic oligonucleotide
tcgccggcagcctggcgcgccttgc

SEQ ID NO: 717384 - DNA, 25 bp, Artificial sequence
  Synthetic oligonucleotide
gcgagatcgccggcagcctggcgcg

SEQ ID NO: 717385 - DNA, 25 bp, Artificial sequence
  Synthetic oligonucleotide
gcgcccgcgagatcgccggcagcct

SEQ ID NO: 717386 - DNA, 25 bp, Artificial sequence
  Synthetic oligonucleotide
ctgccgggcgcccgcgagatcgccg

SEQ ID NO: 717387 - DNA, 25 bp, Artificial sequence
  Synthetic oligonucleotide
ccaggcctgccgggcgcccgcgaga

SEQ ID NO: 717388 - DNA, 25 bp, Artificial sequence
  Synthetic oligonucleotide
cgctctcgatgcgggtgtcgccatg

SEQ ID NO: 717389 - DNA, 25 bp, Artificial sequence
  Synthetic oligonucleotide
gcccagcagcttccagccggcggaa

SEQ ID NO: 717390 - DNA, 25 bp, Artificial sequence
  Synthetic oligonucleotide
agcccttgcccaggccgaagcgcag

SEQ ID NO: 717391 - DNA, 25 bp, Artificial sequence
  Synthetic oligonucleotide
ttgtcgaccaggaacagcagcacgt

SEQ ID NO: 717392 - DNA, 25 bp, Artificial sequence
  Synthetic oligonucleotide
cctttggccagcatcttttccagac

SEQ ID NO: 717393 - DNA, 25 bp, Artificial sequence
  Synthetic oligonucleotide
tccacgcctttggccagcatctttt

SEQ ID NO: 717394 - DNA, 25 bp, Artificial sequence
  Synthetic oligonucleotide
gcattgtccacgcctttggccagca

SEQ ID NO: 717395 - DNA, 25 bp, Artificial sequence
  Synthetic oligonucleotide
agcagcgcattgtccacgcctttgg

SEQ ID NO: 717396 - DNA, 25 bp, Artificial sequence
  Synthetic oligonucleotide
gaagcgcagcagcgcattgtccacg

SEQ ID NO: 717397 - DNA, 25 bp, Artificial sequence
  Synthetic oligonucleotide
cctgctctacgcagcgctggaggtg

SEQ ID NO: 717398 - DNA, 25 bp, Artificial sequence
  Synthetic oligonucleotide
ttgcccaggccgaagcgcagcagcg

SEQ ID NO: 717399 - DNA, 25 bp, Artificial sequence
  Synthetic oligonucleotide
tcttttccagaccttcgatcatcat

SEQ ID NO: 717400 - DNA, 25 bp, Artificial sequence
  Synthetic oligonucleotide
caggtagcccttgcccaggccgaag

SEQ ID NO: 717401 - DNA, 25 bp, Artificial sequence
  Synthetic oligonucleotide
cgcgtccaggtagcccttgcccagg

SEQ ID NO: 717402 - DNA, 25 bp, Artificial sequence
  Synthetic oligonucleotide
gtcgcccgcgtccaggtagcccttg

SEQ ID NO: 717403 - DNA, 25 bp, Artificial sequence
  Synthetic oligonucleotide
ttcggcgtcgcccgcgtccaggtag

SEQ ID NO: 717404 - DNA, 25 bp, Artificial sequence
  Synthetic oligonucleotide
cgcgcgttcggcgtcgcccgcgtcc

SEQ ID NO: 717405 - DNA, 25 bp, Artificial sequence
  Synthetic oligonucleotide
ttccgccgcgcgttcggcgtcgccc

SEQ ID NO: 717406 - DNA, 25 bp, Artificial sequence
  Synthetic oligonucleotide
ggaggtgttccgccgcgcgttcggc

SEQ ID NO: 717407 - DNA, 25 bp, Artificial sequence
  Synthetic oligonucleotide
aggccgaagcgcagcagcgcattgt

SEQ ID NO: 717408 - DNA, 25 bp, Artificial sequence
  Synthetic oligonucleotide
gggctgatggcgatgtcgatctcgc

SEQ ID NO: 717409 - DNA, 25 bp, Artificial sequence
  Synthetic oligonucleotide
tcgccgcggcgaacgtgggccagca

SEQ ID NO: 717410 - DNA, 25 bp, Artificial sequence
  Synthetic oligonucleotide
gacataggccgggttgttgatcagg

SEQ ID NO: 717411 - DNA, 25 bp, Artificial sequence
  Synthetic oligonucleotide
caggtcgacataggccgggttgttg

SEQ ID NO: 717412 - DNA, 25 bp, Artificial sequence
  Synthetic oligonucleotide
tgcaccaggtcgacataggccgggt

SEQ ID NO: 717413 - DNA, 25 bp, Artificial sequence
  Synthetic oligonucleotide
ccgccttgcaccaggtcgacatagg

SEQ ID NO: 717414 - DNA, 25 bp, Artificial sequence
  Synthetic oligonucleotide
atctcgccgccttgcaccaggtcga

SEQ ID NO: 717415 - DNA, 25 bp, Artificial sequence
  Synthetic oligonucleotide
ttgttgatcagggtcatcactttgc

SEQ ID NO: 717416 - DNA, 25 bp, Artificial sequence
  Synthetic oligonucleotide
atggcgatgtcgatctcgccgcctt

SEQ ID NO: 717417 - DNA, 25 bp, Artificial sequence
  Synthetic oligonucleotide
atcagggtcatcactttgctcgcgc

SEQ ID NO: 717418 - DNA, 25 bp, Artificial sequence
  Synthetic oligonucleotide
agttgcgggctgatggcgatgtcga

SEQ ID NO: 717419 - DNA, 25 bp, Artificial sequence
  Synthetic oligonucleotide
gtcgccagttgcgggctgatggcga

SEQ ID NO: 717420 - DNA, 25 bp, Artificial sequence
  Synthetic oligonucleotide
ccgatggtcgccagttgcgggctga

SEQ ID NO: 717421 - DNA, 25 bp, Artificial sequence
  Synthetic oligonucleotide
agggtgccgatggtcgccagttgcg

SEQ ID NO: 717422 - DNA, 25 bp, Artificial sequence
  Synthetic oligonucleotide
gccagcagggtgccgatggtcgcca

SEQ ID NO: 717423 - DNA, 25 bp, Artificial sequence
  Synthetic oligonucleotide
acgtgggccagcagggtgccgatgg

SEQ ID NO: 717424 - DNA, 25 bp, Artificial sequence
  Synthetic oligonucleotide
cggatgtatttcttgtcgaccagga

SEQ ID NO: 717425 - DNA, 25 bp, Artificial sequence
  Synthetic oligonucleotide
atgtcgatctcgccgccttgcacca

SEQ ID NO: 717426 - DNA, 25 bp, Artificial sequence
  Synthetic oligonucleotide
catgatgttggcctcgtcgtcgttg

SEQ ID NO: 717427 - DNA, 25 bp, Artificial sequence
  Synthetic oligonucleotide
tctcgccgatgttttcctccagcag

SEQ ID NO: 717428 - DNA, 25 bp, Artificial sequence
  Synthetic oligonucleotide
cgtcggtctcgccgatgttttcctc

SEQ ID NO: 717429 - DNA, 25 bp, Artificial sequence
  Synthetic oligonucleotide
ggaacacgtcggtctcgccgatgtt

SEQ ID NO: 717430 - DNA, 25 bp, Artificial sequence
  Synthetic oligonucleotide
gggcgaggaacacgtcggtctcgcc

SEQ ID NO: 717431 - DNA, 25 bp, Artificial sequence
  Synthetic oligonucleotide
tggtcagggcgaggaacacgtcggt

SEQ ID NO: 717432 - DNA, 25 bp, Artificial sequence
  Synthetic oligonucleotide
cgtcgttggtcagggcgaggaacac

SEQ ID NO: 717433 - DNA, 25 bp, Artificial sequence
  Synthetic oligonucleotide
gccgggttgttgatcagggtcatca

SEQ ID NO: 717434 - DNA, 25 bp, Artificial sequence
  Synthetic oligonucleotide
gttggcctcgtcgtcgttggtcagg

SEQ ID NO: 717435 - DNA, 25 bp, Artificial sequence
  Synthetic oligonucleotide
tcgatgtcgccgcggcgaacgtggg

SEQ ID NO: 717436 - DNA, 25 bp, Artificial sequence
  Synthetic oligonucleotide
gcgaggacatgatgttggcctcgtc

SEQ ID NO: 717437 - DNA, 25 bp, Artificial sequence
  Synthetic oligonucleotide
ccagcagcgaggacatgatgttggc

SEQ ID NO: 717438 - DNA, 25 bp, Artificial sequence
  Synthetic oligonucleotide
gcttggccagcagcgaggacatgat

SEQ ID NO: 717439 - DNA, 25 bp, Artificial sequence
  Synthetic oligonucleotide
cgagccgcttggccagcagcgagga

SEQ ID NO: 717440 - DNA, 25 bp, Artificial sequence
  Synthetic oligonucleotide
ctcgcgccgagccgcttggccagca

SEQ ID NO: 717441 - DNA, 25 bp, Artificial sequence
  Synthetic oligonucleotide
actttgctcgcgccgagccgcttgg

SEQ ID NO: 717442 - DNA, 25 bp, Artificial sequence
  Synthetic oligonucleotide
gtcatcactttgctcgcgccgagcc

SEQ ID NO: 717443 - DNA, 25 bp, Artificial sequence
  Synthetic oligonucleotide
ctcgtcgtcgttggtcagggcgagg

SEQ ID NO: 717444 - DNA, 25 bp, Artificial sequence
  Synthetic oligonucleotide
tgggcgatcagcacttcctcgtcgc

SEQ ID NO: 717445 - DNA, 25 bp, Artificial sequence
  Synthetic oligonucleotide
cggcgaacgtgggccagcagggtgc

SEQ ID NO: 717446 - DNA, 25 bp, Artificial sequence
  Synthetic oligonucleotide
tggtgcccggcggcagcttgatctc

SEQ ID NO: 717447 - DNA, 25 bp, Artificial sequence
  Synthetic oligonucleotide
ccgatggtggtgcccggcggcagct

SEQ ID NO: 717448 - DNA, 25 bp, Artificial sequence
  Synthetic oligonucleotide
agcgcgccgatggtggtgcccggcg

SEQ ID NO: 717449 - DNA, 25 bp, Artificial sequence
  Synthetic oligonucleotide
cgcaccagcgcgccgatggtggtgc

SEQ ID NO: 717450 - DNA, 25 bp, Artificial sequence
  Synthetic oligonucleotide
tcgtcgcgcaccagcgcgccgatgg

SEQ ID NO: 717451 - DNA, 25 bp, Artificial sequence
  Synthetic oligonucleotide
gcagcttgatctcgttgatcgagcg

SEQ ID NO: 717452 - DNA, 25 bp, Artificial sequence
  Synthetic oligonucleotide
atcagcacttcctcgtcgcgcacca

SEQ ID NO: 717453 - DNA, 25 bp, Artificial sequence
  Synthetic oligonucleotide
tgatctcgttgatcgagcgaccgat

SEQ ID NO: 717454 - DNA, 25 bp, Artificial sequence
  Synthetic oligonucleotide
tcgccatgggcgatcagcacttcct

SEQ ID NO: 717455 - DNA, 25 bp, Artificial sequence
  Synthetic oligonucleotide
cgatgcgggtgtcgccatgggcgat

SEQ ID NO: 717456 - DNA, 25 bp, Artificial sequence
  Synthetic oligonucleotide
tggtcgccgctctcgatgcgggtgt

SEQ ID NO: 717457 - DNA, 25 bp, Artificial sequence
  Synthetic oligonucleotide
agcacgtggtcgccgctctcgatgc

SEQ ID NO: 717458 - DNA, 25 bp, Artificial sequence
  Synthetic oligonucleotide
aacagcagcacgtggtcgccgctct

SEQ ID NO: 717459 - DNA, 25 bp, Artificial sequence
  Synthetic oligonucleotide
accaggaacagcagcacgtggtcgc

SEQ ID NO: 717460 - DNA, 25 bp, Artificial sequence
  Synthetic oligonucleotide
caggccctgctcccaggcctgccgg

SEQ ID NO: 717461 - DNA, 25 bp, Artificial sequence
  Synthetic oligonucleotide
acttcctcgtcgcgcaccagcgcgc

SEQ ID NO: 717462 - DNA, 25 bp, Artificial sequence
  Synthetic oligonucleotide
catgggctaccacttcgatcgcttc

SEQ ID NO: 717463 - DNA, 25 bp, Artificial sequence
  Synthetic oligonucleotide
acgctctcgatgtcgccgcggcgaa

SEQ ID NO: 717464 - DNA, 25 bp, Artificial sequence
  Synthetic oligonucleotide
gagtgtacgctctcgatgtcgccgc

SEQ ID NO: 717465 - DNA, 25 bp, Artificial sequence
  Synthetic oligonucleotide
cgcagcgagtgtacgctctcgatgt

SEQ ID NO: 717466 - DNA, 25 bp, Artificial sequence
  Synthetic oligonucleotide
ccgcggcgcagcgagtgtacgctct

SEQ ID NO: 717467 - DNA, 25 bp, Artificial sequence
  Synthetic oligonucleotide
ggctgcgccgcggcgcagcgagtgt

SEQ ID NO: 717468 - DNA, 25 bp, Artificial sequence
  Synthetic oligonucleotide
cgcttcggctgcgccgcggcgcagc

SEQ ID NO: 717469 - DNA, 25 bp, Artificial sequence
  Synthetic oligonucleotide
ccggcggcagcttgatctcgttgat

SEQ ID NO: 717470 - DNA, 25 bp, Artificial sequence
  Synthetic oligonucleotide
taccacttcgatcgcttcggctgcg

SEQ ID NO: 717471 - DNA, 25 bp, Artificial sequence
  Synthetic oligonucleotide
tatttcttgtcgaccaggaacagca

SEQ ID NO: 717472 - DNA, 25 bp, Artificial sequence
  Synthetic oligonucleotide
cgtcgccatgggctaccacttcgat

SEQ ID NO: 717473 - DNA, 25 bp, Artificial sequence
  Synthetic oligonucleotide
gacttggcgtcgccatgggctacca

SEQ ID NO: 717474 - DNA, 25 bp, Artificial sequence
  Synthetic oligonucleotide
ttgctcgacttggcgtcgccatggg

SEQ ID NO: 717475 - DNA, 25 bp, Artificial sequence
  Synthetic oligonucleotide
tcaccttgctcgacttggcgtcgcc

SEQ ID NO: 717476 - DNA, 25 bp, Artificial sequence
  Synthetic oligonucleotide
gaccgatcaccttgctcgacttggc

SEQ ID NO: 717477 - DNA, 25 bp, Artificial sequence
  Synthetic oligonucleotide
tcgagcgaccgatcaccttgctcga

SEQ ID NO: 717478 - DNA, 25 bp, Artificial sequence
  Synthetic oligonucleotide
cgttgatcgagcgaccgatcacctt

SEQ ID NO: 717479 - DNA, 25 bp, Artificial sequence
  Synthetic oligonucleotide
ttcgatcgcttcggctgcgccgcgg

SEQ ID NO: 717480 - DNA, 25 bp, Artificial sequence
  Synthetic oligonucleotide
ggtcgtagaccgagtccacgccctg

SEQ ID NO: 717481 - DNA, 25 bp, Artificial sequence
  Synthetic oligonucleotide
ggccgtaggtgatctcgccggtgac

SEQ ID NO: 717482 - DNA, 25 bp, Artificial sequence
  Synthetic oligonucleotide
gctccaggccgtaggtgatctcgcc

SEQ ID NO: 717483 - DNA, 25 bp, Artificial sequence
  Synthetic oligonucleotide
ccaggcgctccaggccgtaggtgat

SEQ ID NO: 717484 - DNA, 25 bp, Artificial sequence
  Synthetic oligonucleotide
tacatggccaggcgctccaggccgt

SEQ ID NO: 717485 - DNA, 25 bp, Artificial sequence
  Synthetic oligonucleotide
tgcaggtacatggccaggcgctcca

SEQ ID NO: 717486 - DNA, 25 bp, Artificial sequence
  Synthetic oligonucleotide
cgccctgcaggtacatggccaggcg

SEQ ID NO: 717487 - DNA, 25 bp, Artificial sequence
  Synthetic oligonucleotide
ggcgctcggtgaccgagatggcgcg

SEQ ID NO: 717488 - DNA, 25 bp, Artificial sequence
  Synthetic oligonucleotide
agaccgagtccacgccctgcaggta

SEQ ID NO: 717489 - DNA, 25 bp, Artificial sequence
  Synthetic oligonucleotide
cggtgaccggatagcactcgatgcc

SEQ ID NO: 717490 - DNA, 25 bp, Artificial sequence
  Synthetic oligonucleotide
agaccaggtcgtagaccgagtccac

SEQ ID NO: 717491 - DNA, 25 bp, Artificial sequence
  Synthetic oligonucleotide
cggtccagaccaggtcgtagaccga

SEQ ID NO: 717492 - DNA, 25 bp, Artificial sequence
  Synthetic oligonucleotide
ggccgtcggtccagaccaggtcgta

SEQ ID NO: 717493 - DNA, 25 bp, Artificial sequence
  Synthetic oligonucleotide
cgaacgggccgtcggtccagaccag

SEQ ID NO: 717494 - DNA, 25 bp, Artificial sequence
  Synthetic oligonucleotide
cttgccgaacgggccgtcggtccag

SEQ ID NO: 717495 - DNA, 25 bp, Artificial sequence
  Synthetic oligonucleotide
ataggtgaccttgccgaacgggccg

SEQ ID NO: 717496 - DNA, 25 bp, Artificial sequence
  Synthetic oligonucleotide
agtccacgccctgcaggtacatggc

SEQ ID NO: 717497 - DNA, 25 bp, Artificial sequence
  Synthetic oligonucleotide
aggtgaactgggtgacttccatgcc

SEQ ID NO: 717498 - DNA, 25 bp, Artificial sequence
  Synthetic oligonucleotide
cccaggccccaggcgccgagggtcg

SEQ ID NO: 717499 - DNA, 25 bp, Artificial sequence
  Synthetic oligonucleotide
tcccaacccaggccccaggcgccga

SEQ ID NO: 717500 - DNA, 25 bp, Artificial sequence
  Synthetic oligonucleotide
ccagatttcccaacccaggccccag

SEQ ID NO: 717501 - DNA, 25 bp, Artificial sequence
  Synthetic oligonucleotide
gttcagccagatttcccaacccagg

SEQ ID NO: 717502 - DNA, 25 bp, Artificial sequence
  Synthetic oligonucleotide
acttcgtcgagcaggctcggcggca

SEQ ID NO: 717503 - DNA, 25 bp, Artificial sequence
  Synthetic oligonucleotide
ccatgccgttcagccagatttccca

SEQ ID NO: 717504 - DNA, 25 bp, Artificial sequence
  Synthetic oligonucleotide
aggtgatctcgccggtgaccggata

SEQ ID NO: 717505 - DNA, 25 bp, Artificial sequence
  Synthetic oligonucleotide
actgggtgacttccatgccgttcag

SEQ ID NO: 717506 - DNA, 25 bp, Artificial sequence
  Synthetic oligonucleotide
tctcgccggtgaccggatagcactc

SEQ ID NO: 717507 - DNA, 25 bp, Artificial sequence
  Synthetic oligonucleotide
ggaagtaggtgaactgggtgacttc

SEQ ID NO: 717508 - DNA, 25 bp, Artificial sequence
  Synthetic oligonucleotide
acctgctggaagtaggtgaactggg

SEQ ID NO: 717509 - DNA, 25 bp, Artificial sequence
  Synthetic oligonucleotide
ccgccgacctgctggaagtaggtga

SEQ ID NO: 717510 - DNA, 25 bp, Artificial sequence
  Synthetic oligonucleotide
tcgatgccgccgacctgctggaagt

SEQ ID NO: 717511 - DNA, 25 bp, Artificial sequence
  Synthetic oligonucleotide
atagcactcgatgccgccgacctgc

SEQ ID NO: 717512 - DNA, 25 bp, Artificial sequence
  Synthetic oligonucleotide
accggatagcactcgatgccgccga

SEQ ID NO: 717513 - DNA, 25 bp, Artificial sequence
  Synthetic oligonucleotide
tggtggaacacgtcgccataggtga

SEQ ID NO: 717514 - DNA, 25 bp, Artificial sequence
  Synthetic oligonucleotide
tgacttccatgccgttcagccagat

SEQ ID NO: 717515 - DNA, 25 bp, Artificial sequence
  Synthetic oligonucleotide
tatgcgaagccttgaggaccatctc

SEQ ID NO: 717516 - DNA, 25 bp, Artificial sequence
  Synthetic oligonucleotide
tcgccataggtgaccttgccgaacg

SEQ ID NO: 717517 - DNA, 25 bp, Artificial sequence
  Synthetic oligonucleotide
agctccagcgcgatcaggcggttgg

SEQ ID NO: 717518 - DNA, 25 bp, Artificial sequence
  Synthetic oligonucleotide
aacggcagctccagcgcgatcaggc

SEQ ID NO: 717519 - DNA, 25 bp, Artificial sequence
  Synthetic oligonucleotide
tcggcaacggcagctccagcgcgat

SEQ ID NO: 717520 - DNA, 25 bp, Artificial sequence
  Synthetic oligonucleotide
cgtaggtcggcaacggcagctccag

SEQ ID NO: 717521 - DNA, 25 bp, Artificial sequence
  Synthetic oligonucleotide
ccatctcgtaggtcggcaacggcag

SEQ ID NO: 717522 - DNA, 25 bp, Artificial sequence
  Synthetic oligonucleotide
gatcaggcggttggcttcgctttcg

SEQ ID NO: 717523 - DNA, 25 bp, Artificial sequence
  Synthetic oligonucleotide
aagccttgaggaccatctcgtaggt

SEQ ID NO: 717524 - DNA, 25 bp, Artificial sequence
  Synthetic oligonucleotide
gcggttggcttcgctttcgtagaag

SEQ ID NO: 717525 - DNA, 25 bp, Artificial sequence
  Synthetic oligonucleotide
tgaaggtatgcgaagccttgaggac

SEQ ID NO: 717526 - DNA, 25 bp, Artificial sequence
  Synthetic oligonucleotide
gcaggttgaaggtatgcgaagcctt

SEQ ID NO: 717527 - DNA, 25 bp, Artificial sequence
  Synthetic oligonucleotide
catccagcaggttgaaggtatgcga

SEQ ID NO: 717528 - DNA, 25 bp, Artificial sequence
  Synthetic oligonucleotide
gccgcgcatccagcaggttgaaggt

SEQ ID NO: 717529 - DNA, 25 bp, Artificial sequence
  Synthetic oligonucleotide
tggcgcgccgcgcatccagcaggtt

SEQ ID NO: 717530 - DNA, 25 bp, Artificial sequence
  Synthetic oligonucleotide
ccgagatggcgcgccgcgcatccag

SEQ ID NO: 717531 - DNA, 25 bp, Artificial sequence
  Synthetic oligonucleotide
cccgattcccgcgccgcctcgcccg

SEQ ID NO: 717532 - DNA, 25 bp, Artificial sequence
  Synthetic oligonucleotide
tgaggaccatctcgtaggtcggcaa

SEQ ID NO: 717533 - DNA, 25 bp, Artificial sequence
  Synthetic oligonucleotide
cacgttggcgtgctcgaagttgaaa

SEQ ID NO: 717534 - DNA, 25 bp, Artificial sequence
  Synthetic oligonucleotide
gggtcggcgactcccagttgtcctc

SEQ ID NO: 717535 - DNA, 25 bp, Artificial sequence
  Synthetic oligonucleotide
cgttctggtggaacacgtcgccata

SEQ ID NO: 717536 - DNA, 25 bp, Artificial sequence
  Synthetic oligonucleotide
ccacctcgttctggtggaacacgtc

SEQ ID NO: 717537 - DNA, 25 bp, Artificial sequence
  Synthetic oligonucleotide
ttgctccacctcgttctggtggaac

SEQ ID NO: 717538 - DNA, 25 bp, Artificial sequence
  Synthetic oligonucleotide
agtggattgctccacctcgttctgg

SEQ ID NO: 717539 - DNA, 25 bp, Artificial sequence
  Synthetic oligonucleotide
gttgaaagtggattgctccacctcg

SEQ ID NO: 717540 - DNA, 25 bp, Artificial sequence
  Synthetic oligonucleotide
cagcgcgatcaggcggttggcttcg

SEQ ID NO: 717541 - DNA, 25 bp, Artificial sequence
  Synthetic oligonucleotide
ggcgtgctcgaagttgaaagtggat

SEQ ID NO: 717542 - DNA, 25 bp, Artificial sequence
  Synthetic oligonucleotide
aacacgtcgccataggtgaccttgc

SEQ ID NO: 717543 - DNA, 25 bp, Artificial sequence
  Synthetic oligonucleotide
cttcggcacgttggcgtgctcgaag

SEQ ID NO: 717544 - DNA, 25 bp, Artificial sequence
  Synthetic oligonucleotide
gaacagcttcggcacgttggcgtgc

SEQ ID NO: 717545 - DNA, 25 bp, Artificial sequence
  Synthetic oligonucleotide
cagttcgaacagcttcggcacgttg

SEQ ID NO: 717546 - DNA, 25 bp, Artificial sequence
  Synthetic oligonucleotide
gtcgaacagttcgaacagcttcggc

SEQ ID NO: 717547 - DNA, 25 bp, Artificial sequence
  Synthetic oligonucleotide
gtagaagtcgaacagttcgaacagc

SEQ ID NO: 717548 - DNA, 25 bp, Artificial sequence
  Synthetic oligonucleotide
gctttcgtagaagtcgaacagttcg

SEQ ID NO: 717549 - DNA, 25 bp, Artificial sequence
  Synthetic oligonucleotide
ggcttcgctttcgtagaagtcgaac

SEQ ID NO: 717550 - DNA, 25 bp, Artificial sequence
  Synthetic oligonucleotide
ctcgaagttgaaagtggattgctcc

SEQ ID NO: 717551 - DNA, 25 bp, Artificial sequence
  Synthetic oligonucleotide
aaggtgccggcgcccacttccatgt

SEQ ID NO: 717552 - DNA, 25 bp, Artificial sequence
  Synthetic oligonucleotide
cggcgttccaggtctccgggccgat

SEQ ID NO: 717553 - DNA, 25 bp, Artificial sequence
  Synthetic oligonucleotide
acgcagccctgctctgcccagtagt

SEQ ID NO: 717554 - DNA, 25 bp, Artificial sequence
  Synthetic oligonucleotide
agcaccacgcagccctgctctgccc

SEQ ID NO: 717555 - DNA, 25 bp, Artificial sequence
  Synthetic oligonucleotide
ggctgcagcaccacgcagccctgct

SEQ ID NO: 717556 - DNA, 25 bp, Artificial sequence
  Synthetic oligonucleotide
tcgtagggctgcagcaccacgcagc

SEQ ID NO: 717557 - DNA, 25 bp, Artificial sequence
  Synthetic oligonucleotide
tccatgtcgtagggctgcagcacca

SEQ ID NO: 717558 - DNA, 25 bp, Artificial sequence
  Synthetic oligonucleotide
ctgcccagtagttctgcagggcgag

SEQ ID NO: 717559 - DNA, 25 bp, Artificial sequence
  Synthetic oligonucleotide
cggcgcccacttccatgtcgtaggg

SEQ ID NO: 717560 - DNA, 25 bp, Artificial sequence
  Synthetic oligonucleotide
agtagttctgcagggcgagaatcag

SEQ ID NO: 717561 - DNA, 25 bp, Artificial sequence
  Synthetic oligonucleotide
ggtgtggaaggtgccggcgcccact

SEQ ID NO: 717562 - DNA, 25 bp, Artificial sequence
  Synthetic oligonucleotide
ggtggcggtgtggaaggtgccggcg

SEQ ID NO: 717563 - DNA, 25 bp, Artificial sequence
  Synthetic oligonucleotide
gaggaaggtggcggtgtggaaggtg

SEQ ID NO: 717564 - DNA, 25 bp, Artificial sequence
  Synthetic oligonucleotide
tggcgcggaggaaggtggcggtgtg

SEQ ID NO: 717565 - DNA, 25 bp, Artificial sequence
  Synthetic oligonucleotide
ggccgatggcgcggaggaaggtggc

SEQ ID NO: 717566 - DNA, 25 bp, Artificial sequence
  Synthetic oligonucleotide
gtctccgggccgatggcgcggagga

SEQ ID NO: 717567 - DNA, 25 bp, Artificial sequence
  Synthetic oligonucleotide
ccccaggcgccgagggtcggcgact

SEQ ID NO: 717568 - DNA, 25 bp, Artificial sequence
  Synthetic oligonucleotide
ccacttccatgtcgtagggctgcag

SEQ ID NO: 717569 - DNA, 25 bp, Artificial sequence
  Synthetic oligonucleotide
gcgtagtctggctcacgaaattcac

SEQ ID NO: 717570 - DNA, 25 bp, Artificial sequence
  Synthetic oligonucleotide
agtatacccgattcccgcgccgcct

SEQ ID NO: 717571 - DNA, 25 bp, Artificial sequence
  Synthetic oligonucleotide
cgcggaagtatacccgattcccgcg

SEQ ID NO: 717572 - DNA, 25 bp, Artificial sequence
  Synthetic oligonucleotide
ttcgatacaaaacgcggaagtatac

SEQ ID NO: 717573 - DNA, 25 bp, Artificial sequence
  Synthetic oligonucleotide
tgaggcttcgatacaaaacgcggaa

SEQ ID NO: 717574 - DNA, 25 bp, Artificial sequence
  Synthetic oligonucleotide
ctgtgctgaggcttcgatacaaaac

SEQ ID NO: 717575 - DNA, 25 bp, Artificial sequence
  Synthetic oligonucleotide
aattcacctgtgctgaggcttcgat

SEQ ID NO: 717576 - DNA, 25 bp, Artificial sequence
  Synthetic oligonucleotide
cctgctctgcccagtagttctgcag

SEQ ID NO: 717577 - DNA, 25 bp, Artificial sequence
  Synthetic oligonucleotide
tctggctcacgaaattcacctgtgc

SEQ ID NO: 717578 - DNA, 25 bp, Artificial sequence
  Synthetic oligonucleotide
acgtaggcggcgttccaggtctccg

SEQ ID NO: 717579 - DNA, 25 bp, Artificial sequence
  Synthetic oligonucleotide
cggcgggcgtagtctggctcacgaa

SEQ ID NO: 717580 - DNA, 25 bp, Artificial sequence
  Synthetic oligonucleotide
tgcgcacggcgggcgtagtctggct

SEQ ID NO: 717581 - DNA, 25 bp, Artificial sequence
  Synthetic oligonucleotide
tggaaggtgcgcacggcgggcgtag

SEQ ID NO: 717582 - DNA, 25 bp, Artificial sequence
  Synthetic oligonucleotide
aggtcttggaaggtgcgcacggcgg

SEQ ID NO: 717583 - DNA, 25 bp, Artificial sequence
  Synthetic oligonucleotide
gaatcaggtcttggaaggtgcgcac

SEQ ID NO: 717584 - DNA, 25 bp, Artificial sequence
  Synthetic oligonucleotide
gggcgagaatcaggtcttggaaggt

SEQ ID NO: 717585 - DNA, 25 bp, Artificial sequence
  Synthetic oligonucleotide
tctgcagggcgagaatcaggtcttg

SEQ ID NO: 717586 - DNA, 25 bp, Artificial sequence
  Synthetic oligonucleotide
tcacgaaattcacctgtgctgaggc

SEQ ID NO: 717587 - DNA, 25 bp, Artificial sequence
  Synthetic oligonucleotide
tggaccagcgggtcgatgccgatgg

SEQ ID NO: 717588 - DNA, 25 bp, Artificial sequence
  Synthetic oligonucleotide
ttccaggtctccgggccgatggcgc

SEQ ID NO: 717589 - DNA, 25 bp, Artificial sequence
  Synthetic oligonucleotide
ggtacagctcctggaagttctccgg

SEQ ID NO: 717590 - DNA, 25 bp, Artificial sequence
  Synthetic oligonucleotide
agccgaggtacagctcctggaagtt

SEQ ID NO: 717591 - DNA, 25 bp, Artificial sequence
  Synthetic oligonucleotide
tcagcgagccgaggtacagctcctg

SEQ ID NO: 717592 - DNA, 25 bp, Artificial sequence
  Synthetic oligonucleotide
tggctttcagcgagccgaggtacag

SEQ ID NO: 717593 - DNA, 25 bp, Artificial sequence
  Synthetic oligonucleotide
tgccgatggctttcagcgagccgag

SEQ ID NO: 717594 - DNA, 25 bp, Artificial sequence
  Synthetic oligonucleotide
tggaagttctccgggttcggcttca

SEQ ID NO: 717595 - DNA, 25 bp, Artificial sequence
  Synthetic oligonucleotide
cagcgggtcgatgccgatggctttc

SEQ ID NO: 717596 - DNA, 25 bp, Artificial sequence
  Synthetic oligonucleotide
ttctccgggttcggcttcaggacca

SEQ ID NO: 717597 - DNA, 25 bp, Artificial sequence
  Synthetic oligonucleotide
atgtcgtggaccagcgggtcgatgc

SEQ ID NO: 717598 - DNA, 25 bp, Artificial sequence
  Synthetic oligonucleotide
aagcggatgtcgtggaccagcgggt

SEQ ID NO: 717599 - DNA, 25 bp, Artificial sequence
  Synthetic oligonucleotide
tcgacgaagcggatgtcgtggacca

SEQ ID NO: 717600 - DNA, 25 bp, Artificial sequence
  Synthetic oligonucleotide
ttgtcctcgacgaagcggatgtcgt

SEQ ID NO: 717601 - DNA, 25 bp, Artificial sequence
  Synthetic oligonucleotide
cccagttgtcctcgacgaagcggat

SEQ ID NO: 717602 - DNA, 25 bp, Artificial sequence
  Synthetic oligonucleotide
gcgactcccagttgtcctcgacgaa

SEQ ID NO: 717603 - DNA, 25 bp, Artificial sequence
  Synthetic oligonucleotide
agcgctggcgctcggtgaccgagat

SEQ ID NO: 717604 - DNA, 25 bp, Artificial sequence
  Synthetic oligonucleotide
gtcgatgccgatggctttcagcgag

SEQ ID NO: 717605 - DNA, 25 bp, Artificial sequence
  Synthetic oligonucleotide
caggcggttggggttctcgccgtag

SEQ ID NO: 717606 - DNA, 25 bp, Artificial sequence
  Synthetic oligonucleotide
gctggacgtaggcggcgttccaggt

SEQ ID NO: 717607 - DNA, 25 bp, Artificial sequence
  Synthetic oligonucleotide
cggctcggctggacgtaggcggcgt

SEQ ID NO: 717608 - DNA, 25 bp, Artificial sequence
  Synthetic oligonucleotide
gggcggcggctcggctggacgtagg

SEQ ID NO: 717609 - DNA, 25 bp, Artificial sequence
  Synthetic oligonucleotide
tcggtggggcggcggctcggctgga

SEQ ID NO: 717610 - DNA, 25 bp, Artificial sequence
  Synthetic oligonucleotide
cgaccgtcggtggggcggcggctcg

SEQ ID NO: 717611 - DNA, 25 bp, Artificial sequence
  Synthetic oligonucleotide
cgtagcgaccgtcggtggggcggcg

SEQ ID NO: 717612 - DNA, 25 bp, Artificial sequence
  Synthetic oligonucleotide
agctcctggaagttctccgggttcg

SEQ ID NO: 717613 - DNA, 25 bp, Artificial sequence
  Synthetic oligonucleotide
tggggttctcgccgtagcgaccgtc

SEQ ID NO: 717614 - DNA, 25 bp, Artificial sequence
  Synthetic oligonucleotide
cgccgagggtcggcgactcccagtt

SEQ ID NO: 717615 - DNA, 25 bp, Artificial sequence
  Synthetic oligonucleotide
gtgctgcaggcggttggggttctcg

SEQ ID NO: 717616 - DNA, 25 bp, Artificial sequence
  Synthetic oligonucleotide
gtagtagtgctgcaggcggttgggg

SEQ ID NO: 717617 - DNA, 25 bp, Artificial sequence
  Synthetic oligonucleotide
aactggtagtagtgctgcaggcggt

SEQ ID NO: 717618 - DNA, 25 bp, Artificial sequence
  Synthetic oligonucleotide
acctgaaactggtagtagtgctgca

SEQ ID NO: 717619 - DNA, 25 bp, Artificial sequence
  Synthetic oligonucleotide
aggaccacctgaaactggtagtagt

SEQ ID NO: 717620 - DNA, 25 bp, Artificial sequence
  Synthetic oligonucleotide
ggcttcaggaccacctgaaactggt

SEQ ID NO: 717621 - DNA, 25 bp, Artificial sequence
  Synthetic oligonucleotide
gggttcggcttcaggaccacctgaa

SEQ ID NO: 717622 - DNA, 25 bp, Artificial sequence
  Synthetic oligonucleotide
tctcgccgtagcgaccgtcggtggg

SEQ ID NO: 717623 - DNA, 25 bp, Artificial sequence
  Synthetic oligonucleotide
ccgaacagcatcaccagccattggg

SEQ ID NO: 717624 - DNA, 25 bp, Artificial sequence
  Synthetic oligonucleotide
cgagctgcccagcgcatccgcttgg

SEQ ID NO: 717625 - DNA, 25 bp, Artificial sequence
  Synthetic oligonucleotide
tcgcggcgagctgcccagcgcatcc

SEQ ID NO: 717626 - DNA, 25 bp, Artificial sequence
  Synthetic oligonucleotide
actcctcgcggcgagctgcccagcg

SEQ ID NO: 717627 - DNA, 25 bp, Artificial sequence
  Synthetic oligonucleotide
cgcacgaactcctcgcggcgagctg

SEQ ID NO: 717628 - DNA, 25 bp, Artificial sequence
  Synthetic oligonucleotide
gtcggacgcacgaactcctcgcggc

SEQ ID NO: 717629 - DNA, 25 bp, Artificial sequence
  Synthetic oligonucleotide
cattgggtcggacgcacgaactcct

SEQ ID NO: 717630 - DNA, 25 bp, Artificial sequence
  Synthetic oligonucleotide
cggtgaccgagatggcgcgccgcgc

SEQ ID NO: 717631 - DNA, 25 bp, Artificial sequence
  Synthetic oligonucleotide
agcatcaccagccattgggtcggac

SEQ ID NO: 717632 - DNA, 25 bp, Artificial sequence
  Synthetic oligonucleotide
ccgcttgggaatcggcagttcgttc

SEQ ID NO: 717633 - DNA, 25 bp, Artificial sequence
  Synthetic oligonucleotide
tcgtcgccgaacagcatcaccagcc

SEQ ID NO: 717634 - DNA, 25 bp, Artificial sequence
  Synthetic oligonucleotide
accacatcgtcgccgaacagcatca

SEQ ID NO: 717635 - DNA, 25 bp, Artificial sequence
  Synthetic oligonucleotide
cactcgaccacatcgtcgccgaaca

SEQ ID NO: 717636 - DNA, 25 bp, Artificial sequence
  Synthetic oligonucleotide
atctcgcactcgaccacatcgtcgc

SEQ ID NO: 717637 - DNA, 25 bp, Artificial sequence
  Synthetic oligonucleotide
gcgaggatctcgcactcgaccacat

SEQ ID NO: 717638 - DNA, 25 bp, Artificial sequence
  Synthetic oligonucleotide
ttctgggcgaggatctcgcactcga

SEQ ID NO: 717639 - DNA, 25 bp, Artificial sequence
  Synthetic oligonucleotide
accagccattgggtcggacgcacga

SEQ ID NO: 717640 - DNA, 25 bp, Artificial sequence
  Synthetic oligonucleotide
gcccggcagcaggccggcggccggt

SEQ ID NO: 717641 - DNA, 25 bp, Artificial sequence
  Synthetic oligonucleotide
gcagcttcggaccgctcttgtcgat

SEQ ID NO: 717642 - DNA, 25 bp, Artificial sequence
  Synthetic oligonucleotide
tgaagcgcagcttcggaccgctctt

SEQ ID NO: 717643 - DNA, 25 bp, Artificial sequence
  Synthetic oligonucleotide
tctggatgaagcgcagcttcggacc

SEQ ID NO: 717644 - DNA, 25 bp, Artificial sequence
  Synthetic oligonucleotide
cgatggtctggatgaagcgcagctt

SEQ ID NO: 717645 - DNA, 25 bp, Artificial sequence
  Synthetic oligonucleotide
tggccggcgatggtctggatgaagc

SEQ ID NO: 717646 - DNA, 25 bp, Artificial sequence
  Synthetic oligonucleotide
gccggttggccggcgatggtctgga

SEQ ID NO: 717647 - DNA, 25 bp, Artificial sequence
  Synthetic oligonucleotide
tgcccagcgcatccgcttgggaatc

SEQ ID NO: 717648 - DNA, 25 bp, Artificial sequence
  Synthetic oligonucleotide
agcaggccggcggccggttggccgg

SEQ ID NO: 717649 - DNA, 25 bp, Artificial sequence
  Synthetic oligonucleotide
gcgcatccgcttgggaatcggcagt

SEQ ID NO: 717650 - DNA, 25 bp, Artificial sequence
  Synthetic oligonucleotide
gacgatgcccggcagcaggccggcg

SEQ ID NO: 717651 - DNA, 25 bp, Artificial sequence
  Synthetic oligonucleotide
aggcctcgacgatgcccggcagcag

SEQ ID NO: 717652 - DNA, 25 bp, Artificial sequence
  Synthetic oligonucleotide
tcaacgaggcctcgacgatgcccgg

SEQ ID NO: 717653 - DNA, 25 bp, Artificial sequence
  Synthetic oligonucleotide
ttcgttcaacgaggcctcgacgatg

SEQ ID NO: 717654 - DNA, 25 bp, Artificial sequence
  Synthetic oligonucleotide
cggcagttcgttcaacgaggcctcg

SEQ ID NO: 717655 - DNA, 25 bp, Artificial sequence
  Synthetic oligonucleotide
gggaatcggcagttcgttcaacgag

SEQ ID NO: 717656 - DNA, 25 bp, Artificial sequence
  Synthetic oligonucleotide
cgggattcgcgcccggctttctggg

SEQ ID NO: 717657 - DNA, 25 bp, Artificial sequence
  Synthetic oligonucleotide
ccggcggccggttggccggcgatgg

SEQ ID NO: 717658 - DNA, 25 bp, Artificial sequence
  Synthetic oligonucleotide
ctgttgctcggcggccagttcggcc

SEQ ID NO: 717659 - DNA, 25 bp, Artificial sequence
  Synthetic oligonucleotide
ccggctttctgggcgaggatctcgc

SEQ ID NO: 717660 - DNA, 25 bp, Artificial sequence
  Synthetic oligonucleotide
gctcgcggcgctcggcgaaatcggc

SEQ ID NO: 717661 - DNA, 25 bp, Artificial sequence
  Synthetic oligonucleotide
gatcagctcgcggcgctcggcgaaa

SEQ ID NO: 717662 - DNA, 25 bp, Artificial sequence
  Synthetic oligonucleotide
cttggcgatcagctcgcggcgctcg

SEQ ID NO: 717663 - DNA, 25 bp, Artificial sequence
  Synthetic oligonucleotide
acgcgcttggcgatcagctcgcggc

SEQ ID NO: 717664 - DNA, 25 bp, Artificial sequence
  Synthetic oligonucleotide
tcggccacgcgcttggcgatcagct

SEQ ID NO: 717665 - DNA, 25 bp, Artificial sequence
  Synthetic oligonucleotide
cggcgaaatcggccagcacatgagc

SEQ ID NO: 717666 - DNA, 25 bp, Artificial sequence
  Synthetic oligonucleotide
ctcggcggccagttcggccacgcgc

SEQ ID NO: 717667 - DNA, 25 bp, Artificial sequence
  Synthetic oligonucleotide
aatcggccagcacatgagcgccgcg

SEQ ID NO: 717668 - DNA, 25 bp, Artificial sequence
  Synthetic oligonucleotide
cgctgccctgttgctcggcggccag

SEQ ID NO: 717669 - DNA, 25 bp, Artificial sequence
  Synthetic oligonucleotide
acgatggcgctgccctgttgctcgg

SEQ ID NO: 717670 - DNA, 25 bp, Artificial sequence
  Synthetic oligonucleotide
ggcggcacgatggcgctgccctgtt

SEQ ID NO: 717671 - DNA, 25 bp, Artificial sequence
  Synthetic oligonucleotide
caggctcggcggcacgatggcgctg

SEQ ID NO: 717672 - DNA, 25 bp, Artificial sequence
  Synthetic oligonucleotide
gtcgagcaggctcggcggcacgatg

SEQ ID NO: 717673 - DNA, 25 bp, Artificial sequence
  Synthetic oligonucleotide
cgttatttggcgagctgatggcgca

SEQ ID NO: 717674 - DNA, 25 bp, Artificial sequence
  Synthetic oligonucleotide
gggtgtcgccatgggcgatcagcac

SEQ ID NO: 717675 - DNA, 25 bp, Artificial sequence
  Synthetic oligonucleotide
gccagttcggccacgcgcttggcga

SEQ ID NO: 717676 - DNA, 25 bp, Artificial sequence
  Synthetic oligonucleotide
gggctggaaatacgcacattgtccg

SEQ ID NO: 717677 - DNA, 25 bp, Artificial sequence
  Synthetic oligonucleotide
tgtcgatctgctgcagatccacgcc

SEQ ID NO: 717678 - DNA, 25 bp, Artificial sequence
  Synthetic oligonucleotide
tggccacgggattcgcgcccggctt

SEQ ID NO: 717679 - DNA, 25 bp, Artificial sequence
  Synthetic oligonucleotide
aagcggtggccacgggattcgcgcc

SEQ ID NO: 717680 - DNA, 25 bp, Artificial sequence
  Synthetic oligonucleotide
tgtggaagcggtggccacgggattc

SEQ ID NO: 717681 - DNA, 25 bp, Artificial sequence
  Synthetic oligonucleotide
cggattgtggaagcggtggccacgg

SEQ ID NO: 717682 - DNA, 25 bp, Artificial sequence
  Synthetic oligonucleotide
ttgtccggattgtggaagcggtggc

SEQ ID NO: 717683 - DNA, 25 bp, Artificial sequence
  Synthetic oligonucleotide
ggcgctcggcgaaatcggccagcac

SEQ ID NO: 717684 - DNA, 25 bp, Artificial sequence
  Synthetic oligonucleotide
gaaatacgcacattgtccggattgt

SEQ ID NO: 717685 - DNA, 25 bp, Artificial sequence
  Synthetic oligonucleotide
tcgcgcccggctttctgggcgagga

SEQ ID NO: 717686 - DNA, 25 bp, Artificial sequence
  Synthetic oligonucleotide
gctgccgggctggaaatacgcacat

SEQ ID NO: 717687 - DNA, 25 bp, Artificial sequence
  Synthetic oligonucleotide
agatacgctgccgggctggaaatac

SEQ ID NO: 717688 - DNA, 25 bp, Artificial sequence
  Synthetic oligonucleotide
tcttccagatacgctgccgggctgg

SEQ ID NO: 717689 - DNA, 25 bp, Artificial sequence
  Synthetic oligonucleotide
cgcaggtcttccagatacgctgccg

SEQ ID NO: 717690 - DNA, 25 bp, Artificial sequence
  Synthetic oligonucleotide
gcgccgcgcaggtcttccagatacg

SEQ ID NO: 717691 - DNA, 25 bp, Artificial sequence
  Synthetic oligonucleotide
acatgagcgccgcgcaggtcttcca

SEQ ID NO: 717692 - DNA, 25 bp, Artificial sequence
  Synthetic oligonucleotide
gccagcacatgagcgccgcgcaggt

SEQ ID NO: 717693 - DNA, 25 bp, Artificial sequence
  Synthetic oligonucleotide
cgcacattgtccggattgtggaagc

SEQ ID NO: 717694 - DNA, 25 bp, Artificial sequence
  Synthetic oligonucleotide
ccagttcgaccaggaaatccttggc

SEQ ID NO: 717695 - DNA, 25 bp, Artificial sequence
  Synthetic oligonucleotide
aggcttcgccgaggctgttgagggc

SEQ ID NO: 717696 - DNA, 25 bp, Artificial sequence
  Synthetic oligonucleotide
cagcttggccagtacttcgtcacgc

SEQ ID NO: 717697 - DNA, 25 bp, Artificial sequence
  Synthetic oligonucleotide
ctccttcagcttggccagtacttcg

SEQ ID NO: 717698 - DNA, 25 bp, Artificial sequence
  Synthetic oligonucleotide
ttcggcctccttcagcttggccagt

SEQ ID NO: 717699 - DNA, 25 bp, Artificial sequence
  Synthetic oligonucleotide
tcatcattcggcctccttcagcttg

SEQ ID NO: 717700 - DNA, 25 bp, Artificial sequence
  Synthetic oligonucleotide
ttggcgctcatcattcggcctcctt

SEQ ID NO: 717701 - DNA, 25 bp, Artificial sequence
  Synthetic oligonucleotide
tacttcgtcacgcaattcgggggtg

SEQ ID NO: 717702 - DNA, 25 bp, Artificial sequence
  Synthetic oligonucleotide
cgaccaggaaatccttggcgctcat

SEQ ID NO: 717703 - DNA, 25 bp, Artificial sequence
  Synthetic oligonucleotide
cgtcacgcaattcgggggtggccat

SEQ ID NO: 717704 - DNA, 25 bp, Artificial sequence
  Synthetic oligonucleotide
cggtgcccagttcgaccaggaaatc

SEQ ID NO: 717705 - DNA, 25 bp, Artificial sequence
  Synthetic oligonucleotide
gctcttcggtgcccagttcgaccag

SEQ ID NO: 717706 - DNA, 25 bp, Artificial sequence
  Synthetic oligonucleotide
gcggcagctcttcggtgcccagttc

SEQ ID NO: 717707 - DNA, 25 bp, Artificial sequence
  Synthetic oligonucleotide
cttttggcggcagctcttcggtgcc

SEQ ID NO: 717708 - DNA, 25 bp, Artificial sequence
  Synthetic oligonucleotide
tgagggcttttggcggcagctcttc

SEQ ID NO: 717709 - DNA, 25 bp, Artificial sequence
  Synthetic oligonucleotide
gctgttgagggcttttggcggcagc

SEQ ID NO: 717710 - DNA, 25 bp, Artificial sequence
  Synthetic oligonucleotide
tcggaccgctcttgtcgatctgctg

SEQ ID NO: 717711 - DNA, 25 bp, Artificial sequence
  Synthetic oligonucleotide
gaaatccttggcgctcatcattcgg

SEQ ID NO: 717712 - DNA, 25 bp, Artificial sequence
  Synthetic oligonucleotide
tgcaggtagctctgcgccacggcgc

SEQ ID NO: 717713 - DNA, 25 bp, Artificial sequence
  Synthetic oligonucleotide
gatgtagcgctggcgctcggtgacc

SEQ ID NO: 717714 - DNA, 25 bp, Artificial sequence
  Synthetic oligonucleotide
gcgaaggatgtagcgctggcgctcg

SEQ ID NO: 717715 - DNA, 25 bp, Artificial sequence
  Synthetic oligonucleotide
cgcacgcgaaggatgtagcgctggc

SEQ ID NO: 717716 - DNA, 25 bp, Artificial sequence
  Synthetic oligonucleotide
agggtacgcacgcgaaggatgtagc

SEQ ID NO: 717717 - DNA, 25 bp, Artificial sequence
  Synthetic oligonucleotide
cgggccagggtacgcacgcgaagga

SEQ ID NO: 717718 - DNA, 25 bp, Artificial sequence
  Synthetic oligonucleotide
acggcgcgggccagggtacgcacgc

SEQ ID NO: 717719 - DNA, 25 bp, Artificial sequence
  Synthetic oligonucleotide
ggccagtacttcgtcacgcaattcg

SEQ ID NO: 717720 - DNA, 25 bp, Artificial sequence
  Synthetic oligonucleotide
tagctctgcgccacggcgcgggcca

SEQ ID NO: 717721 - DNA, 25 bp, Artificial sequence
  Synthetic oligonucleotide
taccgctgaggaaggcttcgccgag

SEQ ID NO: 717722 - DNA, 25 bp, Artificial sequence
  Synthetic oligonucleotide
cgggcctgcaggtagctctgcgcca

SEQ ID NO: 717723 - DNA, 25 bp, Artificial sequence
  Synthetic oligonucleotide
gcgcgcgcgggcctgcaggtagctc

SEQ ID NO: 717724 - DNA, 25 bp, Artificial sequence
  Synthetic oligonucleotide
agccgaggcgcgcgcgggcctgcag

SEQ ID NO: 717725 - DNA, 25 bp, Artificial sequence
  Synthetic oligonucleotide
tggggaagccgaggcgcgcgcgggc

SEQ ID NO: 717726 - DNA, 25 bp, Artificial sequence
  Synthetic oligonucleotide
tggccatggggaagccgaggcgcgc

SEQ ID NO: 717727 - DNA, 25 bp, Artificial sequence
  Synthetic oligonucleotide
cgggggtggccatggggaagccgag

SEQ ID NO: 717728 - DNA, 25 bp, Artificial sequence
  Synthetic oligonucleotide
gcaattcgggggtggccatggggaa

SEQ ID NO: 717729 - DNA, 25 bp, Artificial sequence
  Synthetic oligonucleotide
tgcgccacggcgcgggccagggtac

SEQ ID NO: 717730 - DNA, 25 bp, Artificial sequence
  Synthetic oligonucleotide
ctgggtcgggttaccgctggcgtcg

SEQ ID NO: 717731 - DNA, 25 bp, Artificial sequence
  Synthetic oligonucleotide
cgccgaggctgttgagggcttttgg

SEQ ID NO: 717732 - DNA, 25 bp, Artificial sequence
  Synthetic oligonucleotide
ctaggttgacggtacggtcgggctg

SEQ ID NO: 717733 - DNA, 25 bp, Artificial sequence
  Synthetic oligonucleotide
agcggcggaccgtctaggttgacgg

SEQ ID NO: 717734 - DNA, 25 bp, Artificial sequence
  Synthetic oligonucleotide
cctgtagcggcggaccgtctaggtt

SEQ ID NO: 717735 - DNA, 25 bp, Artificial sequence
  Synthetic oligonucleotide
aaggcggcctgtagcggcggaccgt

SEQ ID NO: 717736 - DNA, 25 bp, Artificial sequence
  Synthetic oligonucleotide
ggcgtcgaaggcggcctgtagcggc

SEQ ID NO: 717737 - DNA, 25 bp, Artificial sequence
  Synthetic oligonucleotide
gtacggtcgggctgctgcacggcga

SEQ ID NO: 717738 - DNA, 25 bp, Artificial sequence
  Synthetic oligonucleotide
cgggttaccgctggcgtcgaaggcg

SEQ ID NO: 717739 - DNA, 25 bp, Artificial sequence
  Synthetic oligonucleotide
tcgggctgctgcacggcgagttgct

SEQ ID NO: 717740 - DNA, 25 bp, Artificial sequence
  Synthetic oligonucleotide
tggcgaagcccagggcggcctgggt

SEQ ID NO: 717741 - DNA, 25 bp, Artificial sequence
  Synthetic oligonucleotide
acttcttggcgaagcccagggcggc

SEQ ID NO: 717742 - DNA, 25 bp, Artificial sequence
  Synthetic oligonucleotide
gccgcacttcttggcgaagcccagg

SEQ ID NO: 717743 - DNA, 25 bp, Artificial sequence
  Synthetic oligonucleotide
tccacgccgcacttcttggcgaagc

SEQ ID NO: 717744 - DNA, 25 bp, Artificial sequence
  Synthetic oligonucleotide
tgcagatccacgccgcacttcttgg

SEQ ID NO: 717745 - DNA, 25 bp, Artificial sequence
  Synthetic oligonucleotide
tctgctgcagatccacgccgcactt

SEQ ID NO: 717746 - DNA, 25 bp, Artificial sequence
  Synthetic oligonucleotide
tgaggaaggcttcgccgaggctgtt

SEQ ID NO: 717747 - DNA, 25 bp, Artificial sequence
  Synthetic oligonucleotide
accgctggcgtcgaaggcggcctgt

SEQ ID NO: 717748 - DNA, 25 bp, Artificial sequence
  Synthetic oligonucleotide
gcgccgcatagaaacgcgcagcggc

SEQ ID NO: 717749 - DNA, 25 bp, Artificial sequence
  Synthetic oligonucleotide
gcccttctcgataccgctgaggaag

SEQ ID NO: 717750 - DNA, 25 bp, Artificial sequence
  Synthetic oligonucleotide
cttgaggcccttctcgataccgctg

SEQ ID NO: 717751 - DNA, 25 bp, Artificial sequence
  Synthetic oligonucleotide
cggcagccttgaggcccttctcgat

SEQ ID NO: 717752 - DNA, 25 bp, Artificial sequence
  Synthetic oligonucleotide
tcagaccggcagccttgaggccctt

SEQ ID NO: 717753 - DNA, 25 bp, Artificial sequence
  Synthetic oligonucleotide
catagctcagaccggcagccttgag

SEQ ID NO: 717754 - DNA, 25 bp, Artificial sequence
  Synthetic oligonucleotide
cagcggcatagctcagaccggcagc

SEQ ID NO: 717755 - DNA, 25 bp, Artificial sequence
  Synthetic oligonucleotide
ttgacggtacggtcgggctgctgca

SEQ ID NO: 717756 - DNA, 25 bp, Artificial sequence
  Synthetic oligonucleotide
catagaaacgcgcagcggcatagct

SEQ ID NO: 717757 - DNA, 25 bp, Artificial sequence
  Synthetic oligonucleotide
cgctcttgtcgatctgctgcagatc

SEQ ID NO: 717758 - DNA, 25 bp, Artificial sequence
  Synthetic oligonucleotide
ggcgcggcgccgcatagaaacgcgc

SEQ ID NO: 717759 - DNA, 25 bp, Artificial sequence
  Synthetic oligonucleotide
gcgagacggcgcggcgccgcataga

SEQ ID NO: 717760 - DNA, 25 bp, Artificial sequence
  Synthetic oligonucleotide
agcacggcgagacggcgcggcgccg

SEQ ID NO: 717761 - DNA, 25 bp, Artificial sequence
  Synthetic oligonucleotide
tcgaccagcacggcgagacggcgcg

SEQ ID NO: 717762 - DNA, 25 bp, Artificial sequence
  Synthetic oligonucleotide
agttgctcgaccagcacggcgagac

SEQ ID NO: 717763 - DNA, 25 bp, Artificial sequence
  Synthetic oligonucleotide
acggcgagttgctcgaccagcacgg

SEQ ID NO: 717764 - DNA, 25 bp, Artificial sequence
  Synthetic oligonucleotide
tgctgcacggcgagttgctcgacca

SEQ ID NO: 717765 - DNA, 25 bp, Artificial sequence
  Synthetic oligonucleotide
aacgcgcagcggcatagctcagacc

SEQ ID NO: 717766 - DNA, 25 bp, Artificial sequence
  Synthetic oligonucleotide
caagccgatcatcttctatcgtccg

SEQ ID NO: 717767 - DNA, 25 bp, Artificial sequence
  Synthetic oligonucleotide
gttgctgaagaagcaacgcgtgcaa

SEQ ID NO: 717768 - DNA, 25 bp, Artificial sequence
  Synthetic oligonucleotide
ggacgagttgctgaagaagcaacgc

SEQ ID NO: 717769 - DNA, 25 bp, Artificial sequence
  Synthetic oligonucleotide
ggcagtggacgagttgctgaagaag

SEQ ID NO: 717770 - DNA, 25 bp, Artificial sequence
  Synthetic oligonucleotide
gctgaaggcagtggacgagttgctg

SEQ ID NO: 717771 - DNA, 25 bp, Artificial sequence
  Synthetic oligonucleotide
gcccaagctgaaggcagtggacgag

SEQ ID NO: 717772 - DNA, 25 bp, Artificial sequence
  Synthetic oligonucleotide
tcgtccgcccaagctgaaggcagtg

SEQ ID NO: 717773 - DNA, 25 bp, Artificial sequence
  Synthetic oligonucleotide
tgtccaagtgcttccccgagttgtc

SEQ ID NO: 717774 - DNA, 25 bp, Artificial sequence
  Synthetic oligonucleotide
gatcatcttctatcgtccgcccaag

SEQ ID NO: 717775 - DNA, 25 bp, Artificial sequence
  Synthetic oligonucleotide
gtgcaattgggcaatcgcgtcgcac

SEQ ID NO: 717776 - DNA, 25 bp, Artificial sequence
  Synthetic oligonucleotide
cctacgccaagccgatcatcttcta

SEQ ID NO: 717777 - DNA, 25 bp, Artificial sequence
  Synthetic oligonucleotide
attgctcctacgccaagccgatcat

SEQ ID NO: 717778 - DNA, 25 bp, Artificial sequence
  Synthetic oligonucleotide
acttctattgctcctacgccaagcc

SEQ ID NO: 717779 - DNA, 25 bp, Artificial sequence
  Synthetic oligonucleotide
tcaaccacttctattgctcctacgc

SEQ ID NO: 717780 - DNA, 25 bp, Artificial sequence
  Synthetic oligonucleotide
aagtactcaaccacttctattgctc

SEQ ID NO: 717781 - DNA, 25 bp, Artificial sequence
  Synthetic oligonucleotide
actgggaagtactcaaccacttcta

SEQ ID NO: 717782 - DNA, 25 bp, Artificial sequence
  Synthetic oligonucleotide
ttctatcgtccgcccaagctgaagg

SEQ ID NO: 717783 - DNA, 25 bp, Artificial sequence
  Synthetic oligonucleotide
atcctcagtgtcatcaaggaagtga

SEQ ID NO: 717784 - DNA, 25 bp, Artificial sequence
  Synthetic oligonucleotide
gtaccgctgggctcttcgtgcccta

SEQ ID NO: 717785 - DNA, 25 bp, Artificial sequence
  Synthetic oligonucleotide
cgcgcgtaccgctgggctcttcgtg

SEQ ID NO: 717786 - DNA, 25 bp, Artificial sequence
  Synthetic oligonucleotide
cgagcccgcgcgtaccgctgggctc

SEQ ID NO: 717787 - DNA, 25 bp, Artificial sequence
  Synthetic oligonucleotide
cgaccccgagcccgcgcgtaccgct

SEQ ID NO: 717788 - DNA, 25 bp, Artificial sequence
  Synthetic oligonucleotide
gcggttgcgtagggattcccgccga

SEQ ID NO: 717789 - DNA, 25 bp, Artificial sequence
  Synthetic oligonucleotide
gaagtgaagaaaggcggttgcgtag

SEQ ID NO: 717790 - DNA, 25 bp, Artificial sequence
  Synthetic oligonucleotide
aagaagcaacgcgtgcaattgggca

SEQ ID NO: 717791 - DNA, 25 bp, Artificial sequence
  Synthetic oligonucleotide
agtgtcatcaaggaagtgaagaaag

SEQ ID NO: 717792 - DNA, 25 bp, Artificial sequence
  Synthetic oligonucleotide
caacgcgtgcaattgggcaatcgcg

SEQ ID NO: 717793 - DNA, 25 bp, Artificial sequence
  Synthetic oligonucleotide
gagggtatcctcagtgtcatcaagg

SEQ ID NO: 717794 - DNA, 25 bp, Artificial sequence
  Synthetic oligonucleotide
actccggagggtatcctcagtgtca

SEQ ID NO: 717795 - DNA, 25 bp, Artificial sequence
  Synthetic oligonucleotide
ccttccactccggagggtatcctca

SEQ ID NO: 717796 - DNA, 25 bp, Artificial sequence
  Synthetic oligonucleotide
gtcgcaccttccactccggagggta

SEQ ID NO: 717797 - DNA, 25 bp, Artificial sequence
  Synthetic oligonucleotide
aatcgcgtcgcaccttccactccgg

SEQ ID NO: 717798 - DNA, 25 bp, Artificial sequence
  Synthetic oligonucleotide
ttgggcaatcgcgtcgcaccttcca

SEQ ID NO: 717799 - DNA, 25 bp, Artificial sequence
  Synthetic oligonucleotide
taccagtcacctgggaaactgggaa

SEQ ID NO: 717800 - DNA, 25 bp, Artificial sequence
  Synthetic oligonucleotide
atcaaggaagtgaagaaaggcggtt

SEQ ID NO: 717801 - DNA, 25 bp, Artificial sequence
  Synthetic oligonucleotide
tcggacaaagcctgatggatattgg

SEQ ID NO: 717802 - DNA, 25 bp, Artificial sequence
  Synthetic oligonucleotide
tgggaaactgggaagtactcaacca

SEQ ID NO: 717803 - DNA, 25 bp, Artificial sequence
  Synthetic oligonucleotide
agtgcctgcgcctggatctggccgc

SEQ ID NO: 717804 - DNA, 25 bp, Artificial sequence
  Synthetic oligonucleotide
ccgaaagtgcctgcgcctggatctg

SEQ ID NO: 717805 - DNA, 25 bp, Artificial sequence
  Synthetic oligonucleotide
ccctcaccgaaagtgcctgcgcctg

SEQ ID NO: 717806 - DNA, 25 bp, Artificial sequence
  Synthetic oligonucleotide
gccggaccctcaccgaaagtgcctg

SEQ ID NO: 717807 - DNA, 25 bp, Artificial sequence
  Synthetic oligonucleotide
gatattggccggaccctcaccgaaa

SEQ ID NO: 717808 - DNA, 25 bp, Artificial sequence
  Synthetic oligonucleotide
ggatctggccgcctgaaaagtcgct

SEQ ID NO: 717809 - DNA, 25 bp, Artificial sequence
  Synthetic oligonucleotide
aaagcctgatggatattggccggac

SEQ ID NO: 717810 - DNA, 25 bp, Artificial sequence
  Synthetic oligonucleotide
ggccgcctgaaaagtcgctgagata

SEQ ID NO: 717811 - DNA, 25 bp, Artificial sequence
  Synthetic oligonucleotide
agctggtcggacaaagcctgatgga

SEQ ID NO: 717812 - DNA, 25 bp, Artificial sequence
  Synthetic oligonucleotide
tggaaaagctggtcggacaaagcct

SEQ ID NO: 717813 - DNA, 25 bp, Artificial sequence
  Synthetic oligonucleotide
cgaactggaaaagctggtcggacaa

SEQ ID NO: 717814 - DNA, 25 bp, Artificial sequence
  Synthetic oligonucleotide
tgaaaccgaactggaaaagctggtc

SEQ ID NO: 717815 - DNA, 25 bp, Artificial sequence
  Synthetic oligonucleotide
ttgtctgaaaccgaactggaaaagc

SEQ ID NO: 717816 - DNA, 25 bp, Artificial sequence
  Synthetic oligonucleotide
ccccgagttgtctgaaaccgaactg

SEQ ID NO: 717817 - DNA, 25 bp, Artificial sequence
  Synthetic oligonucleotide
agtgcttccccgagttgtctgaaac

SEQ ID NO: 717818 - DNA, 25 bp, Artificial sequence
  Synthetic oligonucleotide
ctgatggatattggccggaccctca

SEQ ID NO: 717819 - DNA, 25 bp, Artificial sequence
  Synthetic oligonucleotide
ggaggtgctggaggaagcgctggct

SEQ ID NO: 717820 - DNA, 25 bp, Artificial sequence
  Synthetic oligonucleotide
tgccctacctgggcaccactgcatt

SEQ ID NO: 717821 - DNA, 25 bp, Artificial sequence
  Synthetic oligonucleotide
ggcattaccagtcacctgggaaact

SEQ ID NO: 717822 - DNA, 25 bp, Artificial sequence
  Synthetic oligonucleotide
ctggtcggcattaccagtcacctgg

SEQ ID NO: 717823 - DNA, 25 bp, Artificial sequence
  Synthetic oligonucleotide
gatggcctggtcggcattaccagtc

SEQ ID NO: 717824 - DNA, 25 bp, Artificial sequence
  Synthetic oligonucleotide
tccggcgatggcctggtcggcatta

SEQ ID NO: 717825 - DNA, 25 bp, Artificial sequence
  Synthetic oligonucleotide
ctggcttccggcgatggcctggtcg

SEQ ID NO: 717826 - DNA, 25 bp, Artificial sequence
  Synthetic oligonucleotide
tgcgcctggatctggccgcctgaaa

SEQ ID NO: 717827 - DNA, 25 bp, Artificial sequence
  Synthetic oligonucleotide
gctggaggaagcgctggcttccggc

SEQ ID NO: 717828 - DNA, 25 bp, Artificial sequence
  Synthetic oligonucleotide
tcacctgggaaactgggaagtactc

SEQ ID NO: 717829 - DNA, 25 bp, Artificial sequence
  Synthetic oligonucleotide
aggcatggaggtgctggaggaagcg

SEQ ID NO: 717830 - DNA, 25 bp, Artificial sequence
  Synthetic oligonucleotide
ggtcgaaggcatggaggtgctggag

SEQ ID NO: 717831 - DNA, 25 bp, Artificial sequence
  Synthetic oligonucleotide
cgcgaggtcgaaggcatggaggtgc

SEQ ID NO: 717832 - DNA, 25 bp, Artificial sequence
  Synthetic oligonucleotide
acatccgcgaggtcgaaggcatgga

SEQ ID NO: 717833 - DNA, 25 bp, Artificial sequence
  Synthetic oligonucleotide
tgagatacatccgcgaggtcgaagg

SEQ ID NO: 717834 - DNA, 25 bp, Artificial sequence
  Synthetic oligonucleotide
agtcgctgagatacatccgcgaggt

SEQ ID NO: 717835 - DNA, 25 bp, Artificial sequence
  Synthetic oligonucleotide
ctgaaaagtcgctgagatacatccg

SEQ ID NO: 717836 - DNA, 25 bp, Artificial sequence
  Synthetic oligonucleotide
ggaagcgctggcttccggcgatggc

SEQ ID NO: 717837 - DNA, 25 bp, Artificial sequence
  Synthetic oligonucleotide
gcgagaaaaaatggtattgaggaaa

SEQ ID NO: 717838 - DNA, 25 bp, Artificial sequence
  Synthetic oligonucleotide
cagccagtacatgtggagcatgaag

SEQ ID NO: 717839 - DNA, 25 bp, Artificial sequence
  Synthetic oligonucleotide
atccgggtactatgctcagctctgc

SEQ ID NO: 717840 - DNA, 25 bp, Artificial sequence
  Synthetic oligonucleotide
tttcatatccgggtactatgctcag

SEQ ID NO: 717841 - DNA, 25 bp, Artificial sequence
  Synthetic oligonucleotide
cgcctttttcatatccgggtactat

SEQ ID NO: 717842 - DNA, 25 bp, Artificial sequence
  Synthetic oligonucleotide
cggaagacgcctttttcatatccgg

SEQ ID NO: 717843 - DNA, 25 bp, Artificial sequence
  Synthetic oligonucleotide
ggcgtcggaagacgcctttttcata

SEQ ID NO: 717844 - DNA, 25 bp, Artificial sequence
  Synthetic oligonucleotide
atgctcagctctgccgcctcctccg

SEQ ID NO: 717845 - DNA, 25 bp, Artificial sequence
  Synthetic oligonucleotide
aaatggtattgaggaaagggcgtcg

SEQ ID NO: 717846 - DNA, 25 bp, Artificial sequence
  Synthetic oligonucleotide
agctctgccgcctcctccgcaggtc

SEQ ID NO: 717847 - DNA, 25 bp, Artificial sequence
  Synthetic oligonucleotide
cggatggcgagaaaaaatggtattg

SEQ ID NO: 717848 - DNA, 25 bp, Artificial sequence
  Synthetic oligonucleotide
accgcccggatggcgagaaaaaatg

SEQ ID NO: 717849 - DNA, 25 bp, Artificial sequence
  Synthetic oligonucleotide
caagaaccgcccggatggcgagaaa

SEQ ID NO: 717850 - DNA, 25 bp, Artificial sequence
  Synthetic oligonucleotide
gcgcttcaagaaccgcccggatggc

SEQ ID NO: 717851 - DNA, 25 bp, Artificial sequence
  Synthetic oligonucleotide
catgaagcgcttcaagaaccgcccg

SEQ ID NO: 717852 - DNA, 25 bp, Artificial sequence
  Synthetic oligonucleotide
gtggagcatgaagcgcttcaagaac

SEQ ID NO: 717853 - DNA, 25 bp, Artificial sequence
  Synthetic oligonucleotide
ctgggctcttcgtgccctacctggg

SEQ ID NO: 717854 - DNA, 25 bp, Artificial sequence
  Synthetic oligonucleotide
tattgaggaaagggcgtcggaagac

SEQ ID NO: 717855 - DNA, 25 bp, Artificial sequence
  Synthetic oligonucleotide
tacccacgaaccccgctcaagtgcc

SEQ ID NO: 717856 - DNA, 25 bp, Artificial sequence
  Synthetic oligonucleotide
tcacccgttatttggcgagctgatg

SEQ ID NO: 717857 - DNA, 25 bp, Artificial sequence
  Synthetic oligonucleotide
tatcagtcacccgttatttggcgag

SEQ ID NO: 717858 - DNA, 25 bp, Artificial sequence
  Synthetic oligonucleotide
ctcgataccgctgaggaaggcttcg

SEQ ID NO: 717859 - DNA, 25 bp, Artificial sequence
  Synthetic oligonucleotide
ctggaaaaccacggaaagccttatg

SEQ ID NO: 717860 - DNA, 25 bp, Artificial sequence
  Synthetic oligonucleotide
aatccgtatcagtcacccgttattt

SEQ ID NO: 717861 - DNA, 25 bp, Artificial sequence
  Synthetic oligonucleotide
gtgccgaatccgtatcagtcacccg

SEQ ID NO: 717862 - DNA, 25 bp, Artificial sequence
  Synthetic oligonucleotide
ggtactatgctcagctctgccgcct

SEQ ID NO: 717863 - DNA, 25 bp, Artificial sequence
  Synthetic oligonucleotide
cgaaccccgctcaagtgccgaatcc

SEQ ID NO: 717864 - DNA, 25 bp, Artificial sequence
  Synthetic oligonucleotide
ctatcccagccagtacatgtggagc

SEQ ID NO: 717865 - DNA, 25 bp, Artificial sequence
  Synthetic oligonucleotide
cgacaatacccacgaaccccgctca

SEQ ID NO: 717866 - DNA, 25 bp, Artificial sequence
  Synthetic oligonucleotide
tggataatcaacgacaatacccacg

SEQ ID NO: 717867 - DNA, 25 bp, Artificial sequence
  Synthetic oligonucleotide
actcgatggataatcaacgacaata

SEQ ID NO: 717868 - DNA, 25 bp, Artificial sequence
  Synthetic oligonucleotide
cgagggactcgatggataatcaacg

SEQ ID NO: 717869 - DNA, 25 bp, Artificial sequence
  Synthetic oligonucleotide
aggtcccgagggactcgatggataa

SEQ ID NO: 717870 - DNA, 25 bp, Artificial sequence
  Synthetic oligonucleotide
ctccgcaggtcccgagggactcgat

SEQ ID NO: 717871 - DNA, 25 bp, Artificial sequence
  Synthetic oligonucleotide
ccgcctcctccgcaggtcccgaggg

SEQ ID NO: 717872 - DNA, 25 bp, Artificial sequence
  Synthetic oligonucleotide
cgctcaagtgccgaatccgtatcag

SEQ ID NO: 717873 - DNA, 25 bp, Artificial sequence
  Synthetic oligonucleotide
cgcagttgctttcacgcggcaaggc

SEQ ID NO: 717874 - DNA, 25 bp, Artificial sequence
  Synthetic oligonucleotide
gtacatgtggagcatgaagcgcttc

SEQ ID NO: 717875 - DNA, 25 bp, Artificial sequence
  Synthetic oligonucleotide
cggtgcgcctgcccgatggtagcgg

SEQ ID NO: 717876 - DNA, 25 bp, Artificial sequence
  Synthetic oligonucleotide
gtgttcttccatgcggtgcgcctgc

SEQ ID NO: 717877 - DNA, 25 bp, Artificial sequence
  Synthetic oligonucleotide
cgtggagtgttcttccatgcggtgc

SEQ ID NO: 717878 - DNA, 25 bp, Artificial sequence
  Synthetic oligonucleotide
aggcgcgtggagtgttcttccatgc

SEQ ID NO: 717879 - DNA, 25 bp, Artificial sequence
  Synthetic oligonucleotide
cggcaaggcgcgtggagtgttcttc

SEQ ID NO: 717880 - DNA, 25 bp, Artificial sequence
  Synthetic oligonucleotide
gtagcggttacaaggtgatcctcga

SEQ ID NO: 717881 - DNA, 25 bp, Artificial sequence
  Synthetic oligonucleotide
ttgctttcacgcggcaaggcgcgtg

SEQ ID NO: 717882 - DNA, 25 bp, Artificial sequence
  Synthetic oligonucleotide
gttacaaggtgatcctcgaagcggc

SEQ ID NO: 717883 - DNA, 25 bp, Artificial sequence
  Synthetic oligonucleotide
tcgtcccgcagttgctttcacgcgg

SEQ ID NO: 717884 - DNA, 25 bp, Artificial sequence
  Synthetic oligonucleotide
gcaagttcgtcccgcagttgctttc

SEQ ID NO: 717885 - DNA, 25 bp, Artificial sequence
  Synthetic oligonucleotide
tgatcagcaagttcgtcccgcagtt

SEQ ID NO: 717886 - DNA, 25 bp, Artificial sequence
  Synthetic oligonucleotide
ctgcattgatcagcaagttcgtccc

SEQ ID NO: 717887 - DNA, 25 bp, Artificial sequence
  Synthetic oligonucleotide
gcaccactgcattgatcagcaagtt

SEQ ID NO: 717888 - DNA, 25 bp, Artificial sequence
  Synthetic oligonucleotide
acctgggcaccactgcattgatcag

SEQ ID NO: 717889 - DNA, 25 bp, Artificial sequence
  Synthetic oligonucleotide
tccatgcggtgcgcctgcccgatgg

SEQ ID NO: 717890 - DNA, 25 bp, Artificial sequence
  Synthetic oligonucleotide
ttcacgcggcaaggcgcgtggagtg

SEQ ID NO: 717891 - DNA, 25 bp, Artificial sequence
  Synthetic oligonucleotide
cctggaagtgtctgtagcagccatg

SEQ ID NO: 717892 - DNA, 25 bp, Artificial sequence
  Synthetic oligonucleotide
acgagcctatcccagccagtacatg

SEQ ID NO: 717893 - DNA, 25 bp, Artificial sequence
  Synthetic oligonucleotide
gtatgtacgagcctatcccagccag

SEQ ID NO: 717894 - DNA, 25 bp, Artificial sequence
  Synthetic oligonucleotide
ggcgaagtatgtacgagcctatccc

SEQ ID NO: 717895 - DNA, 25 bp, Artificial sequence
  Synthetic oligonucleotide
cgagttggcgaagtatgtacgagcc

SEQ ID NO: 717896 - DNA, 25 bp, Artificial sequence
  Synthetic oligonucleotide
tgagccgcgagttggcgaagtatgt

SEQ ID NO: 717897 - DNA, 25 bp, Artificial sequence
  Synthetic oligonucleotide
cagccatgagccgcgagttggcgaa

SEQ ID NO: 717898 - DNA, 25 bp, Artificial sequence
  Synthetic oligonucleotide
ccgatggtagcggttacaaggtgat

SEQ ID NO: 717899 - DNA, 25 bp, Artificial sequence
  Synthetic oligonucleotide
agtgtctgtagcagccatgagccgc

SEQ ID NO: 717900 - DNA, 25 bp, Artificial sequence
  Synthetic oligonucleotide
tcttcgtgccctacctgggcaccac

SEQ ID NO: 717901 - DNA, 25 bp, Artificial sequence
  Synthetic oligonucleotide
caaggacctggaagtgtctgtagca

SEQ ID NO: 717902 - DNA, 25 bp, Artificial sequence
  Synthetic oligonucleotide
gtacgacaaggacctggaagtgtct

SEQ ID NO: 717903 - DNA, 25 bp, Artificial sequence
  Synthetic oligonucleotide
ggacatgtacgacaaggacctggaa

SEQ ID NO: 717904 - DNA, 25 bp, Artificial sequence
  Synthetic oligonucleotide
tccggcggacatgtacgacaaggac

SEQ ID NO: 717905 - DNA, 25 bp, Artificial sequence
  Synthetic oligonucleotide
agcggctccggcggacatgtacgac

SEQ ID NO: 717906 - DNA, 25 bp, Artificial sequence
  Synthetic oligonucleotide
tcctcgaagcggctccggcggacat

SEQ ID NO: 717907 - DNA, 25 bp, Artificial sequence
  Synthetic oligonucleotide
aggtgatcctcgaagcggctccggc

SEQ ID NO: 717908 - DNA, 25 bp, Artificial sequence
  Synthetic oligonucleotide
tgtagcagccatgagccgcgagttg

SEQ ID NO: 717909 - DNA, 25 bp, Artificial sequence
  Synthetic oligonucleotide
cggcatcattcgcaatcgggccaag

SEQ ID NO: 717910 - DNA, 25 bp, Artificial sequence
  Synthetic oligonucleotide
aggccatgagcaaggcgctgcgcaa

SEQ ID NO: 717911 - DNA, 25 bp, Artificial sequence
  Synthetic oligonucleotide
gcagaacgcccaggcctggctggag

SEQ ID NO: 717912 - DNA, 25 bp, Artificial sequence
  Synthetic oligonucleotide
tgcgcggcagaacgcccaggcctgg

SEQ ID NO: 717913 - DNA, 25 bp, Artificial sequence
  Synthetic oligonucleotide
aacgctgcgcggcagaacgcccagg

SEQ ID NO: 717914 - DNA, 25 bp, Artificial sequence
  Synthetic oligonucleotide
aagctcaacgctgcgcggcagaacg

SEQ ID NO: 717915 - DNA, 25 bp, Artificial sequence
  Synthetic oligonucleotide
gggccaagctcaacgctgcgcggca

SEQ ID NO: 717916 - DNA, 25 bp, Artificial sequence
  Synthetic oligonucleotide
aggcctggctggagctggacgaccc

SEQ ID NO: 717917 - DNA, 25 bp, Artificial sequence
  Synthetic oligonucleotide
tcattcgcaatcgggccaagctcaa

SEQ ID NO: 717918 - DNA, 25 bp, Artificial sequence
  Synthetic oligonucleotide
ggctggagctggacgacccggctgg

SEQ ID NO: 717919 - DNA, 25 bp, Artificial sequence
  Synthetic oligonucleotide
tcgaccccggcatcattcgcaatcg

SEQ ID NO: 717920 - DNA, 25 bp, Artificial sequence
  Synthetic oligonucleotide
tgatgctcgaccccggcatcattcg

SEQ ID NO: 717921 - DNA, 25 bp, Artificial sequence
  Synthetic oligonucleotide
acgaactgatgctcgaccccggcat

SEQ ID NO: 717922 - DNA, 25 bp, Artificial sequence
  Synthetic oligonucleotide
agatcgacgaactgatgctcgaccc

SEQ ID NO: 717923 - DNA, 25 bp, Artificial sequence
  Synthetic oligonucleotide
acgcggagatcgacgaactgatgct

SEQ ID NO: 717924 - DNA, 25 bp, Artificial sequence
  Synthetic oligonucleotide
tgagcgacgcggagatcgacgaact

SEQ ID NO: 717925 - DNA, 25 bp, Artificial sequence
  Synthetic oligonucleotide
cacagatgagcgacgcggagatcga

SEQ ID NO: 717926 - DNA, 25 bp, Artificial sequence
  Synthetic oligonucleotide
gcaatcgggccaagctcaacgctgc

SEQ ID NO: 717927 - DNA, 25 bp, Artificial sequence
  Synthetic oligonucleotide
agccgaagatcaaccatttcgccgg

SEQ ID NO: 717928 - DNA, 25 bp, Artificial sequence
  Synthetic oligonucleotide
aagccgaggccatgagcaaggcgct

SEQ ID NO: 717929 - DNA, 25 bp, Artificial sequence
  Synthetic oligonucleotide
cccggaagccgaggccatgagcaag

SEQ ID NO: 717930 - DNA, 25 bp, Artificial sequence
  Synthetic oligonucleotide
cgattaccccggaagccgaggccat

SEQ ID NO: 717931 - DNA, 25 bp, Artificial sequence
  Synthetic oligonucleotide
tgccggcgattaccccggaagccga

SEQ ID NO: 717932 - DNA, 25 bp, Artificial sequence
  Synthetic oligonucleotide
gtcgcgccgaggtgccggcgattac

SEQ ID NO: 717933 - DNA, 25 bp, Artificial sequence
  Synthetic oligonucleotide
tcgccggtcgcgccgaggtgccggc

SEQ ID NO: 717934 - DNA, 25 bp, Artificial sequence
  Synthetic oligonucleotide
acgcccaggcctggctggagctgga

SEQ ID NO: 717935 - DNA, 25 bp, Artificial sequence
  Synthetic oligonucleotide
aagatcaaccatttcgccggtcgcg

SEQ ID NO: 717936 - DNA, 25 bp, Artificial sequence
  Synthetic oligonucleotide
tcgacgtgcagcgggtggcacagat

SEQ ID NO: 717937 - DNA, 25 bp, Artificial sequence
  Synthetic oligonucleotide
gcggccagccgaagatcaaccattt

SEQ ID NO: 717938 - DNA, 25 bp, Artificial sequence
  Synthetic oligonucleotide
tcgtcggcggccagccgaagatcaa

SEQ ID NO: 717939 - DNA, 25 bp, Artificial sequence
  Synthetic oligonucleotide
ggtccttcgtcggcggccagccgaa

SEQ ID NO: 717940 - DNA, 25 bp, Artificial sequence
  Synthetic oligonucleotide
cctctggtccttcgtcggcggccag

SEQ ID NO: 717941 - DNA, 25 bp, Artificial sequence
  Synthetic oligonucleotide
tgggttcctctggtccttcgtcggc

SEQ ID NO: 717942 - DNA, 25 bp, Artificial sequence
  Synthetic oligonucleotide
ccggctgggttcctctggtccttcg

SEQ ID NO: 717943 - DNA, 25 bp, Artificial sequence
  Synthetic oligonucleotide
agctggacgacccggctgggttcct

SEQ ID NO: 717944 - DNA, 25 bp, Artificial sequence
  Synthetic oligonucleotide
accatttcgccggtcgcgccgaggt

SEQ ID NO: 717945 - DNA, 25 bp, Artificial sequence
  Synthetic oligonucleotide
tctggtgcaacgacgatcccctcta

SEQ ID NO: 717946 - DNA, 25 bp, Artificial sequence
  Synthetic oligonucleotide
gtggggtgtgccgcagcgcgatccc

SEQ ID NO: 717947 - DNA, 25 bp, Artificial sequence
  Synthetic oligonucleotide
tgaggagtggggtgtgccgcagcgc

SEQ ID NO: 717948 - DNA, 25 bp, Artificial sequence
  Synthetic oligonucleotide
ccacgatgaggagtggggtgtgccg

SEQ ID NO: 717949 - DNA, 25 bp, Artificial sequence
  Synthetic oligonucleotide
ggcctaccacgatgaggagtggggt

SEQ ID NO: 717950 - DNA, 25 bp, Artificial sequence
  Synthetic oligonucleotide
ctacatggcctaccacgatgaggag

SEQ ID NO: 717951 - DNA, 25 bp, Artificial sequence
  Synthetic oligonucleotide
tcccctctacatggcctaccacgat

SEQ ID NO: 717952 - DNA, 25 bp, Artificial sequence
  Synthetic oligonucleotide
gggtggcacagatgagcgacgcgga

SEQ ID NO: 717953 - DNA, 25 bp, Artificial sequence
  Synthetic oligonucleotide
tgcaacgacgatcccctctacatgg

SEQ ID NO: 717954 - DNA, 25 bp, Artificial sequence
  Synthetic oligonucleotide
atcccgacgcgctgttcgaacttct

SEQ ID NO: 717955 - DNA, 25 bp, Artificial sequence
  Synthetic oligonucleotide
gctgcttctggtgcaacgacgatcc

SEQ ID NO: 717956 - DNA, 25 bp, Artificial sequence
  Synthetic oligonucleotide
tcaacctgtccaagtgcttccccga

SEQ ID NO: 717957 - DNA, 25 bp, Artificial sequence
  Synthetic oligonucleotide
gcctgcccgatggtagcggttacaa

SEQ ID NO: 717958 - DNA, 25 bp, Artificial sequence
  Synthetic oligonucleotide
tgccacgctgcttctggtgcaacga

SEQ ID NO: 717959 - DNA, 25 bp, Artificial sequence
  Synthetic oligonucleotide
gccttatgccacgctgcttctggtg

SEQ ID NO: 717960 - DNA, 25 bp, Artificial sequence
  Synthetic oligonucleotide
cggaaagccttatgccacgctgctt

SEQ ID NO: 717961 - DNA, 25 bp, Artificial sequence
  Synthetic oligonucleotide
aaaccacggaaagccttatgccacg

SEQ ID NO: 717962 - DNA, 25 bp, Artificial sequence
  Synthetic oligonucleotide
gacgatcccctctacatggcctacc

SEQ ID NO: 717963 - DNA, 25 bp, Artificial sequence
  Synthetic oligonucleotide
aggccggattgtcctggatcaccgt

SEQ ID NO: 717964 - DNA, 25 bp, Artificial sequence
  Synthetic oligonucleotide
gcgaggtgctgttcggcttcgacgt

SEQ ID NO: 717965 - DNA, 25 bp, Artificial sequence
  Synthetic oligonucleotide
tcggcttcgacgtgcagcgggtggc

SEQ ID NO: 717966 - DNA, 25 bp, Artificial sequence
  Synthetic oligonucleotide
tgctgttcggcttcgacgtgcagcg

SEQ ID NO: 717967 - DNA, 25 bp, Artificial sequence
  Synthetic oligonucleotide
gctaccgcgaggtgctgttcggctt

SEQ ID NO: 717968 - DNA, 25 bp, Artificial sequence
  Synthetic oligonucleotide
agaagcgcgagcgctaccgcgaggt

SEQ ID NO: 717969 - DNA, 25 bp, Artificial sequence
  Synthetic oligonucleotide
tgctgaagaagcgcgagcgctaccg

SEQ ID NO: 717970 - DNA, 25 bp, Artificial sequence
  Synthetic oligonucleotide
tcaccgtgctgaagaagcgcgagcg

SEQ ID NO: 717971 - DNA, 25 bp, Artificial sequence
  Synthetic oligonucleotide
gtgccgcagcgcgatcccgacgcgc

SEQ ID NO: 717972 - DNA, 25 bp, Artificial sequence
  Synthetic oligonucleotide
gattgtcctggatcaccgtgctgaa

SEQ ID NO: 717973 - DNA, 25 bp, Artificial sequence
  Synthetic oligonucleotide
agcgcgatcccgacgcgctgttcga

SEQ ID NO: 717974 - DNA, 25 bp, Artificial sequence
  Synthetic oligonucleotide
gcttccaggccggattgtcctggat

SEQ ID NO: 717975 - DNA, 25 bp, Artificial sequence
  Synthetic oligonucleotide
tggagggcttccaggccggattgtc

SEQ ID NO: 717976 - DNA, 25 bp, Artificial sequence
  Synthetic oligonucleotide
tgctgctggagggcttccaggccgg

SEQ ID NO: 717977 - DNA, 25 bp, Artificial sequence
  Synthetic oligonucleotide
aacttctgctgctggagggcttcca

SEQ ID NO: 717978 - DNA, 25 bp, Artificial sequence
  Synthetic oligonucleotide
tgttcgaacttctgctgctggaggg

SEQ ID NO: 717979 - DNA, 25 bp, Artificial sequence
  Synthetic oligonucleotide
acgcgctgttcgaacttctgctgct

SEQ ID NO: 717980 - DNA, 25 bp, Artificial sequence
  Synthetic oligonucleotide
tgcagcgggtggcacagatgagcga

SEQ ID NO: 717981 - DNA, 25 bp, Artificial sequence
  Synthetic oligonucleotide
cctggatcaccgtgctgaagaagcg

SEQ ID NO: 717982 - DNA, 25 bp, Artificial sequence
  Synthetic oligonucleotide
ttcgagtcgagcgaggagtgtttcg

SEQ ID NO: 717983 - DNA, 25 bp, Artificial sequence
  Synthetic oligonucleotide
ggccctacgcctgttcgcgttattg

SEQ ID NO: 717984 - DNA, 25 bp, Artificial sequence
  Synthetic oligonucleotide
tgccctggtggtgggggccctacgc

SEQ ID NO: 717985 - DNA, 25 bp, Artificial sequence
  Synthetic oligonucleotide
tcaaaggtgccctggtggtgggggc

SEQ ID NO: 717986 - DNA, 25 bp, Artificial sequence
  Synthetic oligonucleotide
gaaattcaaaggtgccctggtggtg

SEQ ID NO: 717987 - DNA, 25 bp, Artificial sequence
  Synthetic oligonucleotide
gtggagaaattcaaaggtgccctgg

SEQ ID NO: 717988 - DNA, 25 bp, Artificial sequence
  Synthetic oligonucleotide
tgtttcgtggagaaattcaaaggtg

SEQ ID NO: 717989 - DNA, 25 bp, Artificial sequence
  Synthetic oligonucleotide
cgcttccttggctgccgccctcgca

SEQ ID NO: 717990 - DNA, 25 bp, Artificial sequence
  Synthetic oligonucleotide
tcgagcgaggagtgtttcgtggaga

SEQ ID NO: 717991 - DNA, 25 bp, Artificial sequence
  Synthetic oligonucleotide
ttgccctggcgtgccgtgcaaggcg

SEQ ID NO: 717992 - DNA, 25 bp, Artificial sequence
  Synthetic oligonucleotide
tgcgcgttcgagtcgagcgaggagt

SEQ ID NO: 717993 - DNA, 25 bp, Artificial sequence
  Synthetic oligonucleotide
gtacaatgcgcgttcgagtcgagcg

SEQ ID NO: 717994 - DNA, 25 bp, Artificial sequence
  Synthetic oligonucleotide
cctggcgtacaatgcgcgttcgagt

SEQ ID NO: 717995 - DNA, 25 bp, Artificial sequence
  Synthetic oligonucleotide
attcttcctggcgtacaatgcgcgt

SEQ ID NO: 717996 - DNA, 25 bp, Artificial sequence
  Synthetic oligonucleotide
cctcgcattcttcctggcgtacaat

SEQ ID NO: 717997 - DNA, 25 bp, Artificial sequence
  Synthetic oligonucleotide
tgccgccctcgcattcttcctggcg

SEQ ID NO: 717998 - DNA, 25 bp, Artificial sequence
  Synthetic oligonucleotide
ttggctgccgccctcgcattcttcc

SEQ ID NO: 717999 - DNA, 25 bp, Artificial sequence
  Synthetic oligonucleotide
gaggagtgtttcgtggagaaattca

SEQ ID NO: 718000 - DNA, 25 bp, Artificial sequence
  Synthetic oligonucleotide
gctggctgatgtggaaattgccgaa

SEQ ID NO: 718001 - DNA, 25 bp, Artificial sequence
  Synthetic oligonucleotide
cccgcgaggtagtgcggatcaacct

SEQ ID NO: 718002 - DNA, 25 bp, Artificial sequence
  Synthetic oligonucleotide
atcgatcccgcgaggtagtgcggat

SEQ ID NO: 718003 - DNA, 25 bp, Artificial sequence
  Synthetic oligonucleotide
tgccgaatcgatcccgcgaggtagt

SEQ ID NO: 718004 - DNA, 25 bp, Artificial sequence
  Synthetic oligonucleotide
gaaattgccgaatcgatcccgcgag

SEQ ID NO: 718005 - DNA, 25 bp, Artificial sequence
  Synthetic oligonucleotide
gcgagcgctaccgcgaggtgctgtt

SEQ ID NO: 718006 - DNA, 25 bp, Artificial sequence
  Synthetic oligonucleotide
tgagcaaggcgctgcgcaaggccgg

SEQ ID NO: 718007 - DNA, 25 bp, Artificial sequence
  Synthetic oligonucleotide
aggtagtgcggatcaacctgtccaa

SEQ ID NO: 718008 - DNA, 25 bp, Artificial sequence
  Synthetic oligonucleotide
gttcgcgttattgccctggcgtgcc

SEQ ID NO: 718009 - DNA, 25 bp, Artificial sequence
  Synthetic oligonucleotide
gatgtggaaattgccgaatcgatcc

SEQ ID NO: 718010 - DNA, 25 bp, Artificial sequence
  Synthetic oligonucleotide
cgttattgccctggcgtgccgtgca

SEQ ID NO: 718011 - DNA, 25 bp, Artificial sequence
  Synthetic oligonucleotide
gcataggctggctgatgtggaaatt

SEQ ID NO: 718012 - DNA, 25 bp, Artificial sequence
  Synthetic oligonucleotide
ggggccggcataggctggctgatgt

SEQ ID NO: 718013 - DNA, 25 bp, Artificial sequence
  Synthetic oligonucleotide
gcgtcggggccggcataggctggct

SEQ ID NO: 718014 - DNA, 25 bp, Artificial sequence
  Synthetic oligonucleotide
tgcaaggcgtcggggccggcatagg

SEQ ID NO: 718015 - DNA, 25 bp, Artificial sequence
  Synthetic oligonucleotide
gtgccgtgcaaggcgtcggggccgg

SEQ ID NO: 718016 - DNA, 25 bp, Artificial sequence
  Synthetic oligonucleotide
ctggcgtgccgtgcaaggcgtcggg

SEQ ID NO: 718017 - DNA, 25 bp, Artificial sequence
  Synthetic oligonucleotide
tggtgggggccctacgcctgttcgc

SEQ ID NO: 718018 - DNA, 25 bp, Artificial sequence
  Synthetic oligonucleotide
tgcggatcaacctgtccaagtgctt

SEQ ID NO: 718019 - DNA, 25 bp, Artificial sequence
  Synthetic oligonucleotide
gccagcggcatggtcatggaccata

SEQ ID NO: 718020 - DNA, 25 bp, Artificial sequence
  Synthetic oligonucleotide
ccgttacgcccaactcgtcggctag

SEQ ID NO: 718021 - DNA, 25 bp, Artificial sequence
  Synthetic oligonucleotide
actgcgaccgttacgcccaactcgt

SEQ ID NO: 718022 - DNA, 25 bp, Artificial sequence
  Synthetic oligonucleotide
gcgcaaggccggcttcaacttcgtc

SEQ ID NO: 718023 - DNA, 25 bp, Artificial sequence
  Synthetic oligonucleotide
cccaggactgcgaccgttacgccca

SEQ ID NO: 718024 - DNA, 25 bp, Artificial sequence
  Synthetic oligonucleotide
gggccgaccatctgctacgccttca

SEQ ID NO: 718025 - DNA, 25 bp, Artificial sequence
  Synthetic oligonucleotide
gtcatggaccatacccaggactgcg

SEQ ID NO: 718026 - DNA, 25 bp, Artificial sequence
  Synthetic oligonucleotide
ggcgctgcgcaaggccggcttcaac

SEQ ID NO: 718027 - DNA, 25 bp, Artificial sequence
  Synthetic oligonucleotide
ggcatggtcatggaccatacccagg

SEQ ID NO: 718028 - DNA, 25 bp, Artificial sequence
  Synthetic oligonucleotide
accatacccaggactgcgaccgtta

SEQ ID NO: 718029 - DNA, 25 bp, Artificial sequence
  Synthetic oligonucleotide
atgcaggccagcggcatggtcatgg

SEQ ID NO: 718030 - DNA, 25 bp, Artificial sequence
  Synthetic oligonucleotide
gccttcatgcaggccagcggcatgg

SEQ ID NO: 718031 - DNA, 25 bp, Artificial sequence
  Synthetic oligonucleotide
tgctacgccttcatgcaggccagcg

SEQ ID NO: 718032 - DNA, 25 bp, Artificial sequence
  Synthetic oligonucleotide
gaccatctgctacgccttcatgcag

SEQ ID NO: 718033 - DNA, 25 bp, Artificial sequence
  Synthetic oligonucleotide
acgcctgttcgcgttattgccctgg

SEQ ID NO: 718034 - DNA, 25 bp, Artificial sequence
  Synthetic oligonucleotide
ttcgtcgggccgaccatctgctacg

SEQ ID NO: 718035 - DNA, 25 bp, Artificial sequence
  Synthetic oligonucleotide
ttcaacttcgtcgggccgaccatct

SEQ ID NO: 718036 - DNA, 25 bp, Artificial sequence
  Synthetic oligonucleotide
gccggcttcaacttcgtcgggccga

SEQ ID NO: 718037 - DNA, 25 bp, Artificial sequence
  Synthetic oligonucleotide
aacatcggcgcgcagcatagctggt

SEQ ID NO: 718038 - DNA, 25 bp, Artificial sequence
  Synthetic oligonucleotide
agctggtcgccccgcttccttggct

SEQ ID NO: 718039 - DNA, 25 bp, Artificial sequence
  Synthetic oligonucleotide
cgcccaactcgtcggctagccgggc

SEQ ID NO: 718040 - DNA, 25 bp, Artificial sequence
  Synthetic oligonucleotide
ggcgcgcagcatagctggtcgcccc

SEQ ID NO: 718041 - DNA, 25 bp, Artificial sequence
  Synthetic oligonucleotide
cagcatagctggtcgccccgcttcc

SEQ ID NO: 718042 - DNA, 25 bp, Artificial sequence
  Synthetic oligonucleotide
acgtggaacatcggcgcgcagcata

SEQ ID NO: 718043 - DNA, 25 bp, Artificial sequence
  Synthetic oligonucleotide
tgttccacgtggaacatcggcgcgc

SEQ ID NO: 718044 - DNA, 25 bp, Artificial sequence
  Synthetic oligonucleotide
ttcggatgttccacgtggaacatcg

SEQ ID NO: 718045 - DNA, 25 bp, Artificial sequence
  Synthetic oligonucleotide
tcggctagccgggcgctccctgacg

SEQ ID NO: 718046 - DNA, 25 bp, Artificial sequence
  Synthetic oligonucleotide
ctgacggatgcgttcggatgttcca

SEQ ID NO: 718047 - DNA, 25 bp, Artificial sequence
  Synthetic oligonucleotide
cgctccctgacggatgcgttcggat

SEQ ID NO: 718048 - DNA, 25 bp, Artificial sequence
  Synthetic oligonucleotide
gccgggcgctccctgacggatgcgt

SEQ ID NO: 718049 - DNA, 25 bp, Artificial sequence
  Synthetic oligonucleotide
tcgccccgcttccttggctgccgcc

SEQ ID NO: 718050 - DNA, 25 bp, Artificial sequence
  Synthetic oligonucleotide
actcgtcggctagccgggcgctccc

SEQ ID NO: 718051 - DNA, 25 bp, Artificial sequence
  Synthetic oligonucleotide
gatgcgttcggatgttccacgtgga

SEQ ID NO: 718052 - DNA, 25 bp, Artificial sequence
  Synthetic oligonucleotide
cacatgttcgtggtcggcatcccgg

SEQ ID NO: 718053 - DNA, 25 bp, Artificial sequence
  Synthetic oligonucleotide
cggggtgaaggtgttcaactgggtg

SEQ ID NO: 718054 - DNA, 25 bp, Artificial sequence
  Synthetic oligonucleotide
gcgcaccacatgttcgtggtcggca

SEQ ID NO: 718055 - DNA, 25 bp, Artificial sequence
  Synthetic oligonucleotide
gtctgggcgcaccacatgttcgtgg

SEQ ID NO: 718056 - DNA, 25 bp, Artificial sequence
  Synthetic oligonucleotide
agcatcgccttcctctccttcgtgg

SEQ ID NO: 718057 - DNA, 25 bp, Artificial sequence
  Synthetic oligonucleotide
tctccttcgtggtctgggcgcacca

SEQ ID NO: 718058 - DNA, 25 bp, Artificial sequence
  Synthetic oligonucleotide
gccttcctctccttcgtggtctggg

SEQ ID NO: 718059 - DNA, 25 bp, Artificial sequence
  Synthetic oligonucleotide
ttcgtggtcggcatcccggtcaccg

SEQ ID NO: 718060 - DNA, 25 bp, Artificial sequence
  Synthetic oligonucleotide
ttcgtggtctgggcgcaccacatgt

SEQ ID NO: 718061 - DNA, 25 bp, Artificial sequence
  Synthetic oligonucleotide
gtcggcatcccggtcaccggcgagc

SEQ ID NO: 718062 - DNA, 25 bp, Artificial sequence
  Synthetic oligonucleotide
atcccggtcaccggcgagctgttct

SEQ ID NO: 718063 - DNA, 25 bp, Artificial sequence
  Synthetic oligonucleotide
gtcaccggcgagctgttcttcatgt

SEQ ID NO: 718064 - DNA, 25 bp, Artificial sequence
  Synthetic oligonucleotide
ggcgagctgttcttcatgtacgcca

SEQ ID NO: 718065 - DNA, 25 bp, Artificial sequence
  Synthetic oligonucleotide
accatgctgatcgcggtgcccaccg

SEQ ID NO: 718066 - DNA, 25 bp, Artificial sequence
  Synthetic oligonucleotide
ttcatgtacgccaccatgctgatcg

SEQ ID NO: 718067 - DNA, 25 bp, Artificial sequence
  Synthetic oligonucleotide
tacgccaccatgctgatcgcggtgc

SEQ ID NO: 718068 - DNA, 25 bp, Artificial sequence
  Synthetic oligonucleotide
tgcccaccggggtgaaggtgttcaa

SEQ ID NO: 718069 - DNA, 25 bp, Artificial sequence
  Synthetic oligonucleotide
cgcggtgcccaccggggtgaaggtg

SEQ ID NO: 718070 - DNA, 25 bp, Artificial sequence
  Synthetic oligonucleotide
ctgatcgcggtgcccaccggggtga

SEQ ID NO: 718071 - DNA, 25 bp, Artificial sequence
  Synthetic oligonucleotide
ctgttcttcatgtacgccaccatgc

SEQ ID NO: 718072 - DNA, 25 bp, Artificial sequence
  Synthetic oligonucleotide
gcggtcagtgcgatcatcccgacct

SEQ ID NO: 718073 - DNA, 25 bp, Artificial sequence
  Synthetic oligonucleotide
gccaccccgaggtgtacatcatgat

SEQ ID NO: 718074 - DNA, 25 bp, Artificial sequence
  Synthetic oligonucleotide
tgtacatcatgatcctgcccgcctt

SEQ ID NO: 718075 - DNA, 25 bp, Artificial sequence
  Synthetic oligonucleotide
atcatgatcctgcccgccttcggtg

SEQ ID NO: 718076 - DNA, 25 bp, Artificial sequence
  Synthetic oligonucleotide
tgctggtgcccggcgcgatcttcgg

SEQ ID NO: 718077 - DNA, 25 bp, Artificial sequence
  Synthetic oligonucleotide
gaaggtgttcaactgggtgaccacc

SEQ ID NO: 718078 - DNA, 25 bp, Artificial sequence
  Synthetic oligonucleotide
tcttcggccaccccgaggtgtacat

SEQ ID NO: 718079 - DNA, 25 bp, Artificial sequence
  Synthetic oligonucleotide
ctggttcttcggccaccccgaggtg

SEQ ID NO: 718080 - DNA, 25 bp, Artificial sequence
  Synthetic oligonucleotide
atcctgcccgccttcggtgcggtca

SEQ ID NO: 718081 - DNA, 25 bp, Artificial sequence
  Synthetic oligonucleotide
cccgccttcggtgcggtcagtgcga

SEQ ID NO: 718082 - DNA, 25 bp, Artificial sequence
  Synthetic oligonucleotide
agtgcgatcatcccgaccttcgcgc

SEQ ID NO: 718083 - DNA, 25 bp, Artificial sequence
  Synthetic oligonucleotide
ccgaggtgtacatcatgatcctgcc

SEQ ID NO: 718084 - DNA, 25 bp, Artificial sequence
  Synthetic oligonucleotide
accgccagcatcgccttcctctcct

SEQ ID NO: 718085 - DNA, 25 bp, Artificial sequence
  Synthetic oligonucleotide
atcatcccgaccttcgcgcgcaagc

SEQ ID NO: 718086 - DNA, 25 bp, Artificial sequence
  Synthetic oligonucleotide
ccgaccttcgcgcgcaagccgctgt

SEQ ID NO: 718087 - DNA, 25 bp, Artificial sequence
  Synthetic oligonucleotide
cacgtgttctggttcttcggccacc

SEQ ID NO: 718088 - DNA, 25 bp, Artificial sequence
  Synthetic oligonucleotide
ttcgcgcgcaagccgctgttcggct

SEQ ID NO: 718089 - DNA, 25 bp, Artificial sequence
  Synthetic oligonucleotide
cgcaagccgctgttcggctacacct

SEQ ID NO: 718090 - DNA, 25 bp, Artificial sequence
  Synthetic oligonucleotide
ccgctgttcggctacacctcgatgg

SEQ ID NO: 718091 - DNA, 25 bp, Artificial sequence
  Synthetic oligonucleotide
ttcggctacacctcgatggtctacg

SEQ ID NO: 718092 - DNA, 25 bp, Artificial sequence
  Synthetic oligonucleotide
acacctcgatggtctacgccaccgc

SEQ ID NO: 718093 - DNA, 25 bp, Artificial sequence
  Synthetic oligonucleotide
gatggtctacgccaccgccagcatc

SEQ ID NO: 718094 - DNA, 25 bp, Artificial sequence
  Synthetic oligonucleotide
ctacgccaccgccagcatcgccttc

SEQ ID NO: 718095 - DNA, 25 bp, Artificial sequence
  Synthetic oligonucleotide
ttcggtgcggtcagtgcgatcatcc

SEQ ID NO: 718096 - DNA, 25 bp, Artificial sequence
  Synthetic oligonucleotide
tactactggctgccgaagtggaccg

SEQ ID NO: 718097 - DNA, 25 bp, Artificial sequence
  Synthetic oligonucleotide
acttccactacgtgctggtgcccgg

SEQ ID NO: 718098 - DNA, 25 bp, Artificial sequence
  Synthetic oligonucleotide
cctacttcgtggtcgcccacttcca

SEQ ID NO: 718099 - DNA, 25 bp, Artificial sequence
  Synthetic oligonucleotide
tcgtggtcgcccacttccactacgt

SEQ ID NO: 718100 - DNA, 25 bp, Artificial sequence
  Synthetic oligonucleotide
tcgcccacttccactacgtgctggt

SEQ ID NO: 718101 - DNA, 25 bp, Artificial sequence
  Synthetic oligonucleotide
actacgtgctggtgcccggcgcgat

SEQ ID NO: 718102 - DNA, 25 bp, Artificial sequence
  Synthetic oligonucleotide
tgcccggcgcgatcttcggcatctt

SEQ ID NO: 718103 - DNA, 25 bp, Artificial sequence
  Synthetic oligonucleotide
cgcgatcttcggcatcttcgcctcg

SEQ ID NO: 718104 - DNA, 25 bp, Artificial sequence
  Synthetic oligonucleotide
tcttcggcatcttcgcctcggctta

SEQ ID NO: 718105 - DNA, 25 bp, Artificial sequence
  Synthetic oligonucleotide
gcatcttcgcctcggcttactactg

SEQ ID NO: 718106 - DNA, 25 bp, Artificial sequence
  Synthetic oligonucleotide
cagtaccacgacacctacttcgtgg

SEQ ID NO: 718107 - DNA, 25 bp, Artificial sequence
  Synthetic oligonucleotide
tcggcttactactggctgccgaagt

SEQ ID NO: 718108 - DNA, 25 bp, Artificial sequence
  Synthetic oligonucleotide
gacttccagtaccacgacacctact

SEQ ID NO: 718109 - DNA, 25 bp, Artificial sequence
  Synthetic oligonucleotide
tggctgccgaagtggaccggccaca

SEQ ID NO: 718110 - DNA, 25 bp, Artificial sequence
  Synthetic oligonucleotide
ccgaagtggaccggccacatgtacg

SEQ ID NO: 718111 - DNA, 25 bp, Artificial sequence
  Synthetic oligonucleotide
tccagcacgtgttctggttcttcgg

SEQ ID NO: 718112 - DNA, 25 bp, Artificial sequence
  Synthetic oligonucleotide
acatggccctgccgcggatgaacaa

SEQ ID NO: 718113 - DNA, 25 bp, Artificial sequence
  Synthetic oligonucleotide
accctcggcaagctgcacttctgga

SEQ ID NO: 718114 - DNA, 25 bp, Artificial sequence
  Synthetic oligonucleotide
gacgagaccctcggcaagctgcact

SEQ ID NO: 718115 - DNA, 25 bp, Artificial sequence
  Synthetic oligonucleotide
tggaccggccacatgtacgacgaga

SEQ ID NO: 718116 - DNA, 25 bp, Artificial sequence
  Synthetic oligonucleotide
ggccacatgtacgacgagaccctcg

SEQ ID NO: 718117 - DNA, 25 bp, Artificial sequence
  Synthetic oligonucleotide
atgtacgacgagaccctcggcaagc

SEQ ID NO: 718118 - DNA, 25 bp, Artificial sequence
  Synthetic oligonucleotide
ttcgcctcggcttactactggctgc

SEQ ID NO: 718119 - DNA, 25 bp, Artificial sequence
  Synthetic oligonucleotide
tcgtcatcctgttcaccatcggcgg

SEQ ID NO: 718120 - DNA, 25 bp, Artificial sequence
  Synthetic oligonucleotide
ctgggtgaccaccatgtgggagggt

SEQ ID NO: 718121 - DNA, 25 bp, Artificial sequence
  Synthetic oligonucleotide
accaccatgtgggagggttcgctga

SEQ ID NO: 718122 - DNA, 25 bp, Artificial sequence
  Synthetic oligonucleotide
atgtgggagggttcgctgaccttcg

SEQ ID NO: 718123 - DNA, 25 bp, Artificial sequence
  Synthetic oligonucleotide
gagggttcgctgaccttcgagacgc

SEQ ID NO: 718124 - DNA, 25 bp, Artificial sequence
  Synthetic oligonucleotide
ttcgctgaccttcgagacgccgatg

SEQ ID NO: 718125 - DNA, 25 bp, Artificial sequence
  Synthetic oligonucleotide
tgaccttcgagacgccgatgctgtt

SEQ ID NO: 718126 - DNA, 25 bp, Artificial sequence
  Synthetic oligonucleotide
tcgagacgccgatgctgttcgccgt

SEQ ID NO: 718127 - DNA, 25 bp, Artificial sequence
  Synthetic oligonucleotide
cgccgatgctgttcgccgtggcctt

SEQ ID NO: 718128 - DNA, 25 bp, Artificial sequence
  Synthetic oligonucleotide
tgctgttcgccgtggccttcgtcat

SEQ ID NO: 718129 - DNA, 25 bp, Artificial sequence
  Synthetic oligonucleotide
cacgacacctacttcgtggtcgccc

SEQ ID NO: 718130 - DNA, 25 bp, Artificial sequence
  Synthetic oligonucleotide
tggccttcgtcatcctgttcaccat

SEQ ID NO: 718131 - DNA, 25 bp, Artificial sequence
  Synthetic oligonucleotide
gttcaactgggtgaccaccatgtgg

SEQ ID NO: 718132 - DNA, 25 bp, Artificial sequence
  Synthetic oligonucleotide
atcctgttcaccatcggcggcttct

SEQ ID NO: 718133 - DNA, 25 bp, Artificial sequence
  Synthetic oligonucleotide
ttcaccatcggcggcttctccggac

SEQ ID NO: 718134 - DNA, 25 bp, Artificial sequence
  Synthetic oligonucleotide
atcggcggcttctccggactgatgc

SEQ ID NO: 718135 - DNA, 25 bp, Artificial sequence
  Synthetic oligonucleotide
gcttctccggactgatgctggcgat

SEQ ID NO: 718136 - DNA, 25 bp, Artificial sequence
  Synthetic oligonucleotide
tccggactgatgctggcgatcgccc

SEQ ID NO: 718137 - DNA, 25 bp, Artificial sequence
  Synthetic oligonucleotide
ctgatgctggcgatcgccccggcag

SEQ ID NO: 718138 - DNA, 25 bp, Artificial sequence
  Synthetic oligonucleotide
ctggcgatcgccccggcagacttcc

SEQ ID NO: 718139 - DNA, 25 bp, Artificial sequence
  Synthetic oligonucleotide
atcgccccggcagacttccagtacc

SEQ ID NO: 718140 - DNA, 25 bp, Artificial sequence
  Synthetic oligonucleotide
ccggcagacttccagtaccacgaca

SEQ ID NO: 718141 - DNA, 25 bp, Artificial sequence
  Synthetic oligonucleotide
tcgccgtggccttcgtcatcctgtt

SEQ ID NO: 718142 - DNA, 25 bp, Artificial sequence
  Synthetic oligonucleotide
ccttgttcatgcccggcggcggccc

SEQ ID NO: 718143 - DNA, 25 bp, Artificial sequence
  Synthetic oligonucleotide
ccctgccgcggatgaacaacttcag

SEQ ID NO: 718144 - DNA, 25 bp, Artificial sequence
  Synthetic oligonucleotide
tgaacaacttcagcttctggctgct

SEQ ID NO: 718145 - DNA, 25 bp, Artificial sequence
  Synthetic oligonucleotide
aacttcagcttctggctgctgccgg

SEQ ID NO: 718146 - DNA, 25 bp, Artificial sequence
  Synthetic oligonucleotide
gcttctggctgctgccggcggcctt

SEQ ID NO: 718147 - DNA, 25 bp, Artificial sequence
  Synthetic oligonucleotide
tggctgctgccggcggccttcggcc

SEQ ID NO: 718148 - DNA, 25 bp, Artificial sequence
  Synthetic oligonucleotide
tgccggcggccttcggcctgctggt

SEQ ID NO: 718149 - DNA, 25 bp, Artificial sequence
  Synthetic oligonucleotide
cggccttcggcctgctggtcagcac

SEQ ID NO: 718150 - DNA, 25 bp, Artificial sequence
  Synthetic oligonucleotide
tcggcctgctggtcagcaccttgtt

SEQ ID NO: 718151 - DNA, 25 bp, Artificial sequence
  Synthetic oligonucleotide
cgcggatgaacaacttcagcttctg

SEQ ID NO: 718152 - DNA, 25 bp, Artificial sequence
  Synthetic oligonucleotide
tcagcaccttgttcatgcccggcgg

SEQ ID NO: 718153 - DNA, 25 bp, Artificial sequence
  Synthetic oligonucleotide
tgatgatcggcgcgccggacatggc

SEQ ID NO: 718154 - DNA, 25 bp, Artificial sequence
  Synthetic oligonucleotide
tcatgcccggcggcggccccaactt

SEQ ID NO: 718155 - DNA, 25 bp, Artificial sequence
  Synthetic oligonucleotide
cggcggcggccccaacttcggctgg

SEQ ID NO: 718156 - DNA, 25 bp, Artificial sequence
  Synthetic oligonucleotide
gccccaacttcggctggaccttcta

SEQ ID NO: 718157 - DNA, 25 bp, Artificial sequence
  Synthetic oligonucleotide
acttcggctggaccttctatgcgcc

SEQ ID NO: 718158 - DNA, 25 bp, Artificial sequence
  Synthetic oligonucleotide
gctggaccttctatgcgccgctgtc

SEQ ID NO: 718159 - DNA, 25 bp, Artificial sequence
  Synthetic oligonucleotide
ccttctatgcgccgctgtcgaccac

SEQ ID NO: 718160 - DNA, 25 bp, Artificial sequence
  Synthetic oligonucleotide
atgcgccgctgtcgaccaccttcgc

SEQ ID NO: 718161 - DNA, 25 bp, Artificial sequence
  Synthetic oligonucleotide
cgctgtcgaccaccttcgccccgca

SEQ ID NO: 718162 - DNA, 25 bp, Artificial sequence
  Synthetic oligonucleotide
cgaccaccttcgccccgcacagcgt

SEQ ID NO: 718163 - DNA, 25 bp, Artificial sequence
  Synthetic oligonucleotide
tgctggtcagcaccttgttcatgcc

SEQ ID NO: 718164 - DNA, 25 bp, Artificial sequence
  Synthetic oligonucleotide
tcttcggcgcggtgatgccggcctt

SEQ ID NO: 718165 - DNA, 25 bp, Artificial sequence
  Synthetic oligonucleotide
agccggcgttcttcaaccagatgac

SEQ ID NO: 718166 - DNA, 25 bp, Artificial sequence
  Synthetic oligonucleotide
cgttcttcaaccagatgaccaccat

SEQ ID NO: 718167 - DNA, 25 bp, Artificial sequence
  Synthetic oligonucleotide
tcgtcgagccggcgttcttcaacca

SEQ ID NO: 718168 - DNA, 25 bp, Artificial sequence
  Synthetic oligonucleotide
ttgcgggacgataaggagaacaaca

SEQ ID NO: 718169 - DNA, 25 bp, Artificial sequence
  Synthetic oligonucleotide
ggcaagctgcacttctggatgagct

SEQ ID NO: 718170 - DNA, 25 bp, Artificial sequence
  Synthetic oligonucleotide
tcaaccagatgaccaccatgcacgg

SEQ ID NO: 718171 - DNA, 25 bp, Artificial sequence
  Synthetic oligonucleotide
agatgaccaccatgcacggcctgat

SEQ ID NO: 718172 - DNA, 25 bp, Artificial sequence
  Synthetic oligonucleotide
caccatgcacggcctgatcatggtc

SEQ ID NO: 718173 - DNA, 25 bp, Artificial sequence
  Synthetic oligonucleotide
gcacggcctgatcatggtcttcggc

SEQ ID NO: 718174 - DNA, 25 bp, Artificial sequence
  Synthetic oligonucleotide
gccggacatggccctgccgcggatg

SEQ ID NO: 718175 - DNA, 25 bp, Artificial sequence
  Synthetic oligonucleotide
catggtcttcggcgcggtgatgccg

SEQ ID NO: 718176 - DNA, 25 bp, Artificial sequence
  Synthetic oligonucleotide
tcggcgcgccggacatggccctgcc

SEQ ID NO: 718177 - DNA, 25 bp, Artificial sequence
  Synthetic oligonucleotide
gcgcggtgatgccggccttcgtcgg

SEQ ID NO: 718178 - DNA, 25 bp, Artificial sequence
  Synthetic oligonucleotide
tgatgccggccttcgtcggcctggc

SEQ ID NO: 718179 - DNA, 25 bp, Artificial sequence
  Synthetic oligonucleotide
cggccttcgtcggcctggccaactg

SEQ ID NO: 718180 - DNA, 25 bp, Artificial sequence
  Synthetic oligonucleotide
cgtcggcctggccaactggatgatc

SEQ ID NO: 718181 - DNA, 25 bp, Artificial sequence
  Synthetic oligonucleotide
cctggccaactggatgatcccgctg

SEQ ID NO: 718182 - DNA, 25 bp, Artificial sequence
  Synthetic oligonucleotide
caactggatgatcccgctgatgatc

SEQ ID NO: 718183 - DNA, 25 bp, Artificial sequence
  Synthetic oligonucleotide
gatgatcccgctgatgatcggcgcg

SEQ ID NO: 718184 - DNA, 25 bp, Artificial sequence
  Synthetic oligonucleotide
tcccgctgatgatcggcgcgccgga

SEQ ID NO: 718185 - DNA, 25 bp, Artificial sequence
  Synthetic oligonucleotide
acagcgtgaccttcttcatcttcgc

SEQ ID NO: 718186 - DNA, 25 bp, Artificial sequence
  Synthetic oligonucleotide
ctgatcatggtcttcggcgcggtga

SEQ ID NO: 718187 - DNA, 25 bp, Artificial sequence
  Synthetic oligonucleotide
tgctgatggacatccacttcggcac

SEQ ID NO: 718188 - DNA, 25 bp, Artificial sequence
  Synthetic oligonucleotide
ccttcgccccgcacagcgtgacctt

SEQ ID NO: 718189 - DNA, 25 bp, Artificial sequence
  Synthetic oligonucleotide
tgatcaccgcgttccttttgatcgc

SEQ ID NO: 718190 - DNA, 25 bp, Artificial sequence
  Synthetic oligonucleotide
ccgcgttccttttgatcgcggtgat

SEQ ID NO: 718191 - DNA, 25 bp, Artificial sequence
  Synthetic oligonucleotide
tccttttgatcgcggtgatgcctgt

SEQ ID NO: 718192 - DNA, 25 bp, Artificial sequence
  Synthetic oligonucleotide
tgatcgcggtgatgcctgtgctggc

SEQ ID NO: 718193 - DNA, 25 bp, Artificial sequence
  Synthetic oligonucleotide
cggtgatgcctgtgctggccggcgt

SEQ ID NO: 718194 - DNA, 25 bp, Artificial sequence
  Synthetic oligonucleotide
tgcctgtgctggccggcgtggtgac

SEQ ID NO: 718195 - DNA, 25 bp, Artificial sequence
  Synthetic oligonucleotide
tgctggccggcgtggtgaccatgat

SEQ ID NO: 718196 - DNA, 25 bp, Artificial sequence
  Synthetic oligonucleotide
ccggcgtggtgaccatgatgctgat

SEQ ID NO: 718197 - DNA, 25 bp, Artificial sequence
  Synthetic oligonucleotide
tctggacctggctgatcaccgcgtt

SEQ ID NO: 718198 - DNA, 25 bp, Artificial sequence
  Synthetic oligonucleotide
ccatgatgctgatggacatccactt

SEQ ID NO: 718199 - DNA, 25 bp, Artificial sequence
  Synthetic oligonucleotide
tgttcgtctggacctggctgatcac

SEQ ID NO: 718200 - DNA, 25 bp, Artificial sequence
  Synthetic oligonucleotide
tggacatccacttcggcaccagctt

SEQ ID NO: 718201 - DNA, 25 bp, Artificial sequence
  Synthetic oligonucleotide
tccacttcggcaccagcttcttcag

SEQ ID NO: 718202 - DNA, 25 bp, Artificial sequence
  Synthetic oligonucleotide
tcggcaccagcttcttcagcgccgc

SEQ ID NO: 718203 - DNA, 25 bp, Artificial sequence
  Synthetic oligonucleotide
ccagcttcttcagcgccgccggcgg

SEQ ID NO: 718204 - DNA, 25 bp, Artificial sequence
  Synthetic oligonucleotide
tcttcagcgccgccggcggcggcga

SEQ ID NO: 718205 - DNA, 25 bp, Artificial sequence
  Synthetic oligonucleotide
agcgccgccggcggcggcgacccgg

SEQ ID NO: 718206 - DNA, 25 bp, Artificial sequence
  Synthetic oligonucleotide
ccggcggcggcgacccggtgctgtt

SEQ ID NO: 718207 - DNA, 25 bp, Artificial sequence
  Synthetic oligonucleotide
gcggcgacccggtgctgttccagca

SEQ ID NO: 718208 - DNA, 25 bp, Artificial sequence
  Synthetic oligonucleotide
acccggtgctgttccagcacgtgtt

SEQ ID NO: 718209 - DNA, 25 bp, Artificial sequence
  Synthetic oligonucleotide
tggtgaccatgatgctgatggacat

SEQ ID NO: 718210 - DNA, 25 bp, Artificial sequence
  Synthetic oligonucleotide
cgtgatcgccaccatcctcaacctg

SEQ ID NO: 718211 - DNA, 25 bp, Artificial sequence
  Synthetic oligonucleotide
tgctgttccagcacgtgttctggtt

SEQ ID NO: 718212 - DNA, 25 bp, Artificial sequence
  Synthetic oligonucleotide
tgaccttcttcatcttcgccatcca

SEQ ID NO: 718213 - DNA, 25 bp, Artificial sequence
  Synthetic oligonucleotide
tcttcatcttcgccatccacctggc

SEQ ID NO: 718214 - DNA, 25 bp, Artificial sequence
  Synthetic oligonucleotide
tcttcgccatccacctggccgggat

SEQ ID NO: 718215 - DNA, 25 bp, Artificial sequence
  Synthetic oligonucleotide
catccacctggccgggatcagctcg

SEQ ID NO: 718216 - DNA, 25 bp, Artificial sequence
  Synthetic oligonucleotide
cctggccgggatcagctcgatcatg

SEQ ID NO: 718217 - DNA, 25 bp, Artificial sequence
  Synthetic oligonucleotide
cgggatcagctcgatcatgggcgcg

SEQ ID NO: 718218 - DNA, 25 bp, Artificial sequence
  Synthetic oligonucleotide
cagctcgatcatgggcgcgatcaac

SEQ ID NO: 718219 - DNA, 25 bp, Artificial sequence
  Synthetic oligonucleotide
gatcatgggcgcgatcaacgtgatc

SEQ ID NO: 718220 - DNA, 25 bp, Artificial sequence
  Synthetic oligonucleotide
cctggctgatcaccgcgttcctttt

SEQ ID NO: 718221 - DNA, 25 bp, Artificial sequence
  Synthetic oligonucleotide
gatcaacgtgatcgccaccatcctc

SEQ ID NO: 718222 - DNA, 25 bp, Artificial sequence
  Synthetic oligonucleotide
ccccgcacagcgtgaccttcttcat

SEQ ID NO: 718223 - DNA, 25 bp, Artificial sequence
  Synthetic oligonucleotide
cgccaccatcctcaacctgcgcgcc

SEQ ID NO: 718224 - DNA, 25 bp, Artificial sequence
  Synthetic oligonucleotide
ccatcctcaacctgcgcgccccggg

SEQ ID NO: 718225 - DNA, 25 bp, Artificial sequence
  Synthetic oligonucleotide
tcaacctgcgcgccccgggcatgac

SEQ ID NO: 718226 - DNA, 25 bp, Artificial sequence
  Synthetic oligonucleotide
tgcgcgccccgggcatgaccctgat

SEQ ID NO: 718227 - DNA, 25 bp, Artificial sequence
  Synthetic oligonucleotide
ccccgggcatgaccctgatgaagat

SEQ ID NO: 718228 - DNA, 25 bp, Artificial sequence
  Synthetic oligonucleotide
gcatgaccctgatgaagatgccgct

SEQ ID NO: 718229 - DNA, 25 bp, Artificial sequence
  Synthetic oligonucleotide
ccctgatgaagatgccgctgttcgt

SEQ ID NO: 718230 - DNA, 25 bp, Artificial sequence
  Synthetic oligonucleotide
tgaagatgccgctgttcgtctggac

SEQ ID NO: 718231 - DNA, 25 bp, Artificial sequence
  Synthetic oligonucleotide
tgccgctgttcgtctggacctggct

SEQ ID NO: 718232 - DNA, 25 bp, Artificial sequence
  Synthetic oligonucleotide
gggcgcgatcaacgtgatcgccacc

SEQ ID NO: 718233 - DNA, 25 bp, Artificial sequence
  Synthetic oligonucleotide
gagcatcgagatgccggtgcgcttc

SEQ ID NO: 718234 - DNA, 25 bp, Artificial sequence
  Synthetic oligonucleotide
gcctacttccacaagaccgaatgct

SEQ ID NO: 718235 - DNA, 25 bp, Artificial sequence
  Synthetic oligonucleotide
ttccacaagaccgaatgcttctgtt

SEQ ID NO: 718236 - DNA, 25 bp, Artificial sequence
  Synthetic oligonucleotide
aagaccgaatgcttctgtttcaccc

SEQ ID NO: 718237 - DNA, 25 bp, Artificial sequence
  Synthetic oligonucleotide
gaatgcttctgtttcacccagcagg

SEQ ID NO: 718238 - DNA, 25 bp, Artificial sequence
  Synthetic oligonucleotide
ttctgtttcacccagcaggtgctgc

SEQ ID NO: 718239 - DNA, 25 bp, Artificial sequence
  Synthetic oligonucleotide
ttcacccagcaggtgctgcaacccg

SEQ ID NO: 718240 - DNA, 25 bp, Artificial sequence
  Synthetic oligonucleotide
cagcaggtgctgcaacccggcgaga

SEQ ID NO: 718241 - DNA, 25 bp, Artificial sequence
  Synthetic oligonucleotide
gtgctgcaacccggcgagagcatcg

SEQ ID NO: 718242 - DNA, 25 bp, Artificial sequence
  Synthetic oligonucleotide
atggtctgggagttccgctccgccg

SEQ ID NO: 718243 - DNA, 25 bp, Artificial sequence
  Synthetic oligonucleotide
ggcgagagcatcgagatgccggtgc

SEQ ID NO: 718244 - DNA, 25 bp, Artificial sequence
  Synthetic oligonucleotide
gccccggccgaggccgcagcctact

SEQ ID NO: 718245 - DNA, 25 bp, Artificial sequence
  Synthetic oligonucleotide
cgagatgccggtgcgcttcatcgtc

SEQ ID NO: 718246 - DNA, 25 bp, Artificial sequence
  Synthetic oligonucleotide
gccggtgcgcttcatcgtcgaccgt

SEQ ID NO: 718247 - DNA, 25 bp, Artificial sequence
  Synthetic oligonucleotide
gcgcttcatcgtcgaccgtgatctg

SEQ ID NO: 718248 - DNA, 25 bp, Artificial sequence
  Synthetic oligonucleotide
catcgtcgaccgtgatctgcccaag

SEQ ID NO: 718249 - DNA, 25 bp, Artificial sequence
  Synthetic oligonucleotide
cgaccgtgatctgcccaaggatgtg

SEQ ID NO: 718250 - DNA, 25 bp, Artificial sequence
  Synthetic oligonucleotide
tgatctgcccaaggatgtgcggcac

SEQ ID NO: 718251 - DNA, 25 bp, Artificial sequence
  Synthetic oligonucleotide
tgcccaaggatgtgcggcacgtgac

SEQ ID NO: 718252 - DNA, 25 bp, Artificial sequence
  Synthetic oligonucleotide
aggatgtgcggcacgtgacgctggc

SEQ ID NO: 718253 - DNA, 25 bp, Artificial sequence
  Synthetic oligonucleotide
tgcggcacgtgacgctggcctacac

SEQ ID NO: 718254 - DNA, 25 bp, Artificial sequence
  Synthetic oligonucleotide
caacccggcgagagcatcgagatgc

SEQ ID NO: 718255 - DNA, 25 bp, Artificial sequence
  Synthetic oligonucleotide
ctacgcgcgcaacccgagcgacaag

SEQ ID NO: 718256 - DNA, 25 bp, Artificial sequence
  Synthetic oligonucleotide
atcactgcgcggaagccgcccgtac

SEQ ID NO: 718257 - DNA, 25 bp, Artificial sequence
  Synthetic oligonucleotide
ttccgctccgccggcgaccagttgg

SEQ ID NO: 718258 - DNA, 25 bp, Artificial sequence
  Synthetic oligonucleotide
tccgccggcgaccagttggtggtgc

SEQ ID NO: 718259 - DNA, 25 bp, Artificial sequence
  Synthetic oligonucleotide
ggcgaccagttggtggtgcatcccg

SEQ ID NO: 718260 - DNA, 25 bp, Artificial sequence
  Synthetic oligonucleotide
cagttggtggtgcatcccggcgcgg

SEQ ID NO: 718261 - DNA, 25 bp, Artificial sequence
  Synthetic oligonucleotide
gtggtgcatcccggcgcggtgaacc

SEQ ID NO: 718262 - DNA, 25 bp, Artificial sequence
  Synthetic oligonucleotide
catcccggcgcggtgaaccagatgg

SEQ ID NO: 718263 - DNA, 25 bp, Artificial sequence
  Synthetic oligonucleotide
ggcgcggtgaaccagatggtgttct

SEQ ID NO: 718264 - DNA, 25 bp, Artificial sequence
  Synthetic oligonucleotide
gtgaaccagatggtgttctacgcgc

SEQ ID NO: 718265 - DNA, 25 bp, Artificial sequence
  Synthetic oligonucleotide
gccgcagcctacttccacaagaccg

SEQ ID NO: 718266 - DNA, 25 bp, Artificial sequence
  Synthetic oligonucleotide
gtgttctacgcgcgcaacccgagcg

SEQ ID NO: 718267 - DNA, 25 bp, Artificial sequence
  Synthetic oligonucleotide
gccgaggccgcagcctacttccaca

SEQ ID NO: 718268 - DNA, 25 bp, Artificial sequence
  Synthetic oligonucleotide
gcgcaacccgagcgacaagccgatg

SEQ ID NO: 718269 - DNA, 25 bp, Artificial sequence
  Synthetic oligonucleotide
cccgagcgacaagccgatgaccgcg

SEQ ID NO: 718270 - DNA, 25 bp, Artificial sequence
  Synthetic oligonucleotide
gcgacaagccgatgaccgcgcaggc

SEQ ID NO: 718271 - DNA, 25 bp, Artificial sequence
  Synthetic oligonucleotide
agccgatgaccgcgcaggccatccc

SEQ ID NO: 718272 - DNA, 25 bp, Artificial sequence
  Synthetic oligonucleotide
tgaccgcgcaggccatcccgagcat

SEQ ID NO: 718273 - DNA, 25 bp, Artificial sequence
  Synthetic oligonucleotide
gcaggccatcccgagcatcgccccg

SEQ ID NO: 718274 - DNA, 25 bp, Artificial sequence
  Synthetic oligonucleotide
catcccgagcatcgccccggccgag

SEQ ID NO: 718275 - DNA, 25 bp, Artificial sequence
  Synthetic oligonucleotide
agcatcgccccggccgaggccgcag

SEQ ID NO: 718276 - DNA, 25 bp, Artificial sequence
  Synthetic oligonucleotide
cctacaccctcttcgatatcactgc

SEQ ID NO: 718277 - DNA, 25 bp, Artificial sequence
  Synthetic oligonucleotide
cagatggtgttctacgcgcgcaacc

SEQ ID NO: 718278 - DNA, 25 bp, Artificial sequence
  Synthetic oligonucleotide
atcatcgcctacatgctgttcggct

SEQ ID NO: 718279 - DNA, 25 bp, Artificial sequence
  Synthetic oligonucleotide
acgtgacgctggcctacaccctctt

SEQ ID NO: 718280 - DNA, 25 bp, Artificial sequence
  Synthetic oligonucleotide
gacctcaccgccggccacaaggaat

SEQ ID NO: 718281 - DNA, 25 bp, Artificial sequence
  Synthetic oligonucleotide
accgccggccacaaggaatcccatg

SEQ ID NO: 718282 - DNA, 25 bp, Artificial sequence
  Synthetic oligonucleotide
ggccacaaggaatcccatggcccgt

SEQ ID NO: 718283 - DNA, 25 bp, Artificial sequence
  Synthetic oligonucleotide
aaggaatcccatggcccgtggatct

SEQ ID NO: 718284 - DNA, 25 bp, Artificial sequence
  Synthetic oligonucleotide
tcccatggcccgtggatcttcttcg

SEQ ID NO: 718285 - DNA, 25 bp, Artificial sequence
  Synthetic oligonucleotide
ggcccgtggatcttcttcgtcggcg

SEQ ID NO: 718286 - DNA, 25 bp, Artificial sequence
  Synthetic oligonucleotide
tggatcttcttcgtcggcgggctga

SEQ ID NO: 718287 - DNA, 25 bp, Artificial sequence
  Synthetic oligonucleotide
ttcttcgtcggcgggctgatcatcg

SEQ ID NO: 718288 - DNA, 25 bp, Artificial sequence
  Synthetic oligonucleotide
acctggttcaacgacctcaccgccg

SEQ ID NO: 718289 - DNA, 25 bp, Artificial sequence
  Synthetic oligonucleotide
gggctgatcatcgcctacatgctgt

SEQ ID NO: 718290 - DNA, 25 bp, Artificial sequence
  Synthetic oligonucleotide
ctgggtacctggttcaacgacctca

SEQ ID NO: 718291 - DNA, 25 bp, Artificial sequence
  Synthetic oligonucleotide
gcctacatgctgttcggctggttcg

SEQ ID NO: 718292 - DNA, 25 bp, Artificial sequence
  Synthetic oligonucleotide
atgctgttcggctggttcggcaacg

SEQ ID NO: 718293 - DNA, 25 bp, Artificial sequence
  Synthetic oligonucleotide
ttcggctggttcggcaacgtcatcc

SEQ ID NO: 718294 - DNA, 25 bp, Artificial sequence
  Synthetic oligonucleotide
tggttcggcaacgtcatccgcgaga

SEQ ID NO: 718295 - DNA, 25 bp, Artificial sequence
  Synthetic oligonucleotide
cggcaacgtcatccgcgagagtcgc

SEQ ID NO: 718296 - DNA, 25 bp, Artificial sequence
  Synthetic oligonucleotide
acgtcatccgcgagagtcgcgccgg

SEQ ID NO: 718297 - DNA, 25 bp, Artificial sequence
  Synthetic oligonucleotide
tgcagatcgtcgagccggcgttctt

SEQ ID NO: 718298 - DNA, 25 bp, Artificial sequence
  Synthetic oligonucleotide
tggatgagttcacggagggcagcgg

SEQ ID NO: 718299 - DNA, 25 bp, Artificial sequence
  Synthetic oligonucleotide
atccgcgagagtcgcgccggactct

SEQ ID NO: 718300 - DNA, 25 bp, Artificial sequence
  Synthetic oligonucleotide
gtcggcgggctgatcatcgcctaca

SEQ ID NO: 718301 - DNA, 25 bp, Artificial sequence
  Synthetic oligonucleotide
tccccgcccagagcaagtggccgat

SEQ ID NO: 718302 - DNA, 25 bp, Artificial sequence
  Synthetic oligonucleotide
atcgacatggtctgggagttccgct

SEQ ID NO: 718303 - DNA, 25 bp, Artificial sequence
  Synthetic oligonucleotide
ccctcttcgatatcactgcgcggaa

SEQ ID NO: 718304 - DNA, 25 bp, Artificial sequence
  Synthetic oligonucleotide
ttcgatatcactgcgcggaagccgc

SEQ ID NO: 718305 - DNA, 25 bp, Artificial sequence
  Synthetic oligonucleotide
taccggttgcgggacgataaggaga

SEQ ID NO: 718306 - DNA, 25 bp, Artificial sequence
  Synthetic oligonucleotide
gacgataaggagaacaacatggcaa

SEQ ID NO: 718307 - DNA, 25 bp, Artificial sequence
  Synthetic oligonucleotide
aaggagaacaacatggcaagccacg

SEQ ID NO: 718308 - DNA, 25 bp, Artificial sequence
  Synthetic oligonucleotide
aacaacatggcaagccacgaacact

SEQ ID NO: 718309 - DNA, 25 bp, Artificial sequence
  Synthetic oligonucleotide
atggcaagccacgaacactattacg

SEQ ID NO: 718310 - DNA, 25 bp, Artificial sequence
  Synthetic oligonucleotide
agccacgaacactattacgtccccg

SEQ ID NO: 718311 - DNA, 25 bp, Artificial sequence
  Synthetic oligonucleotide
ttcaacgacctcaccgccggccaca

SEQ ID NO: 718312 - DNA, 25 bp, Artificial sequence
  Synthetic oligonucleotide
attacgtccccgcccagagcaagtg

SEQ ID NO: 718313 - DNA, 25 bp, Artificial sequence
  Synthetic oligonucleotide
cgctggcctacaccctcttcgatat

SEQ ID NO: 718314 - DNA, 25 bp, Artificial sequence
  Synthetic oligonucleotide
gcccagagcaagtggccgatcatcg

SEQ ID NO: 718315 - DNA, 25 bp, Artificial sequence
  Synthetic oligonucleotide
agcaagtggccgatcatcgccagca

SEQ ID NO: 718316 - DNA, 25 bp, Artificial sequence
  Synthetic oligonucleotide
gtggccgatcatcgccagcatcggc

SEQ ID NO: 718317 - DNA, 25 bp, Artificial sequence
  Synthetic oligonucleotide
gatcatcgccagcatcggcctgctg

SEQ ID NO: 718318 - DNA, 25 bp, Artificial sequence
  Synthetic oligonucleotide
gccagcatcggcctgctggtgacgg

SEQ ID NO: 718319 - DNA, 25 bp, Artificial sequence
  Synthetic oligonucleotide
catcggcctgctggtgacggtgttc

SEQ ID NO: 718320 - DNA, 25 bp, Artificial sequence
  Synthetic oligonucleotide
cctgctggtgacggtgttcggcctg

SEQ ID NO: 718321 - DNA, 25 bp, Artificial sequence
  Synthetic oligonucleotide
tggtgacggtgttcggcctgggtac

SEQ ID NO: 718322 - DNA, 25 bp, Artificial sequence
  Synthetic oligonucleotide
gtgttcggcctgggtacctggttca

SEQ ID NO: 718323 - DNA, 25 bp, Artificial sequence
  Synthetic oligonucleotide
gaacactattacgtccccgcccaga

SEQ ID NO: 718324 - DNA, 25 bp, Artificial sequence
  Synthetic oligonucleotide
ggcaagccggcccctgccaagccct

SEQ ID NO: 718325 - DNA, 25 bp, Artificial sequence
  Synthetic oligonucleotide
tcatgttcggcaccacccagctgct

SEQ ID NO: 718326 - DNA, 25 bp, Artificial sequence
  Synthetic oligonucleotide
tcggcaccacccagctgctgttcct

SEQ ID NO: 718327 - DNA, 25 bp, Artificial sequence
  Synthetic oligonucleotide
ccacccagctgctgttcctgttcat

SEQ ID NO: 718328 - DNA, 25 bp, Artificial sequence
  Synthetic oligonucleotide
agctgctgttcctgttcatcgtcat

SEQ ID NO: 718329 - DNA, 25 bp, Artificial sequence
  Synthetic oligonucleotide
tgttcctgttcatcgtcatcaagtg

SEQ ID NO: 718330 - DNA, 25 bp, Artificial sequence
  Synthetic oligonucleotide
tgttcatcgtcatcaagtgcatccg

SEQ ID NO: 718331 - DNA, 25 bp, Artificial sequence
  Synthetic oligonucleotide
tcgtcatcaagtgcatccgcggcgg

SEQ ID NO: 718332 - DNA, 25 bp, Artificial sequence
  Synthetic oligonucleotide
atcaagtgcatccgcggcggcaagc

SEQ ID NO: 718333 - DNA, 25 bp, Artificial sequence
  Synthetic oligonucleotide
tgggagttccgctccgccggcgacc

SEQ ID NO: 718334 - DNA, 25 bp, Artificial sequence
  Synthetic oligonucleotide
cgcggcggcaagccggcccctgcca

SEQ ID NO: 718335 - DNA, 25 bp, Artificial sequence
  Synthetic oligonucleotide
tctcgtcgatcggcgccttcatgtt

SEQ ID NO: 718336 - DNA, 25 bp, Artificial sequence
  Synthetic oligonucleotide
ccggcccctgccaagccctgggacg

SEQ ID NO: 718337 - DNA, 25 bp, Artificial sequence
  Synthetic oligonucleotide
cctgccaagccctgggacggcgccg

SEQ ID NO: 718338 - DNA, 25 bp, Artificial sequence
  Synthetic oligonucleotide
caagccctgggacggcgccgagggc

SEQ ID NO: 718339 - DNA, 25 bp, Artificial sequence
  Synthetic oligonucleotide
tgggacggcgccgagggcctggagt

SEQ ID NO: 718340 - DNA, 25 bp, Artificial sequence
  Synthetic oligonucleotide
ggcgccgagggcctggagtggagca

SEQ ID NO: 718341 - DNA, 25 bp, Artificial sequence
  Synthetic oligonucleotide
gagggcctggagtggagcatcccct

SEQ ID NO: 718342 - DNA, 25 bp, Artificial sequence
  Synthetic oligonucleotide
ctggagtggagcatcccctcgccgg

SEQ ID NO: 718343 - DNA, 25 bp, Artificial sequence
  Synthetic oligonucleotide
tggagcatcccctcgccggcgccct

SEQ ID NO: 718344 - DNA, 25 bp, Artificial sequence
  Synthetic oligonucleotide
atcccctcgccggcgccctaccaca

SEQ ID NO: 718345 - DNA, 25 bp, Artificial sequence
  Synthetic oligonucleotide
tgcatccgcggcggcaagccggccc

SEQ ID NO: 718346 - DNA, 25 bp, Artificial sequence
  Synthetic oligonucleotide
gcatgccgcgacggatccccgacta

SEQ ID NO: 718347 - DNA, 25 bp, Artificial sequence
  Synthetic oligonucleotide
ttctggatgagcttcatcggcatga

SEQ ID NO: 718348 - DNA, 25 bp, Artificial sequence
  Synthetic oligonucleotide
gatgagcttcatcggcatgaacctg

SEQ ID NO: 718349 - DNA, 25 bp, Artificial sequence
  Synthetic oligonucleotide
cttcatcggcatgaacctggcgttc

SEQ ID NO: 718350 - DNA, 25 bp, Artificial sequence
  Synthetic oligonucleotide
tcggcatgaacctggcgttcttccc

SEQ ID NO: 718351 - DNA, 25 bp, Artificial sequence
  Synthetic oligonucleotide
tgaacctggcgttcttcccgatgca

SEQ ID NO: 718352 - DNA, 25 bp, Artificial sequence
  Synthetic oligonucleotide
tggcgttcttcccgatgcacttcgt

SEQ ID NO: 718353 - DNA, 25 bp, Artificial sequence
  Synthetic oligonucleotide
tcttcccgatgcacttcgtcggcct

SEQ ID NO: 718354 - DNA, 25 bp, Artificial sequence
  Synthetic oligonucleotide
cgatgcacttcgtcggcctcgccgg

SEQ ID NO: 718355 - DNA, 25 bp, Artificial sequence
  Synthetic oligonucleotide
acttcgtcggcctcgccggcatgcc

SEQ ID NO: 718356 - DNA, 25 bp, Artificial sequence
  Synthetic oligonucleotide
gcgccttcatgttcggcaccaccca

SEQ ID NO: 718357 - DNA, 25 bp, Artificial sequence
  Synthetic oligonucleotide
tcgccggcatgccgcgacggatccc

SEQ ID NO: 718358 - DNA, 25 bp, Artificial sequence
  Synthetic oligonucleotide
cgatcggcgccttcatgttcggcac

SEQ ID NO: 718359 - DNA, 25 bp, Artificial sequence
  Synthetic oligonucleotide
cgcgacggatccccgactacaacct

SEQ ID NO: 718360 - DNA, 25 bp, Artificial sequence
  Synthetic oligonucleotide
ggatccccgactacaacctgcagtt

SEQ ID NO: 718361 - DNA, 25 bp, Artificial sequence
  Synthetic oligonucleotide
ccgactacaacctgcagttcgccga

SEQ ID NO: 718362 - DNA, 25 bp, Artificial sequence
  Synthetic oligonucleotide
acaacctgcagttcgccgacttcaa

SEQ ID NO: 718363 - DNA, 25 bp, Artificial sequence
  Synthetic oligonucleotide
tgcagttcgccgacttcaacatggt

SEQ ID NO: 718364 - DNA, 25 bp, Artificial sequence
  Synthetic oligonucleotide
tcgccgacttcaacatggtctcgtc

SEQ ID NO: 718365 - DNA, 25 bp, Artificial sequence
  Synthetic oligonucleotide
acttcaacatggtctcgtcgatcgg

SEQ ID NO: 718366 - DNA, 25 bp, Artificial sequence
  Synthetic oligonucleotide
acatggtctcgtcgatcggcgcctt

SEQ ID NO: 718367 - DNA, 25 bp, Artificial sequence
  Synthetic oligonucleotide
taccacaccttcagcaccccgcccg

SEQ ID NO: 718368 - DNA, 25 bp, Artificial sequence
  Synthetic oligonucleotide
tcggcctcgccggcatgccgcgacg

SEQ ID NO: 718369 - DNA, 25 bp, Artificial sequence
  Synthetic oligonucleotide
gcgaacagcaggtggatgtcgggcg

SEQ ID NO: 718370 - DNA, 25 bp, Artificial sequence
  Synthetic oligonucleotide
tcgccggcgccctaccacaccttca

SEQ ID NO: 718371 - DNA, 25 bp, Artificial sequence
  Synthetic oligonucleotide
tatgacgtgatgtgccgcgccctgg

SEQ ID NO: 718372 - DNA, 25 bp, Artificial sequence
  Synthetic oligonucleotide
tgatgtgccgcgccctggggatcaa

SEQ ID NO: 718373 - DNA, 25 bp, Artificial sequence
  Synthetic oligonucleotide
ccgcgccctggggatcaacggcaag

SEQ ID NO: 718374 - DNA, 25 bp, Artificial sequence
  Synthetic oligonucleotide
cctggggatcaacggcaagaccgcc

SEQ ID NO: 718375 - DNA, 25 bp, Artificial sequence
  Synthetic oligonucleotide
ggatcaacggcaagaccgccggcag

SEQ ID NO: 718376 - DNA, 25 bp, Artificial sequence
  Synthetic oligonucleotide
cggcaagaccgccggcagcgcctac

SEQ ID NO: 718377 - DNA, 25 bp, Artificial sequence
  Synthetic oligonucleotide
agaccgccggcagcgcctacagcgg

SEQ ID NO: 718378 - DNA, 25 bp, Artificial sequence
  Synthetic oligonucleotide
ccggcagcgcctacagcggcgaaca

SEQ ID NO: 718379 - DNA, 25 bp, Artificial sequence
  Synthetic oligonucleotide
tggtgccgctctatgacgtgatgtg

SEQ ID NO: 718380 - DNA, 25 bp, Artificial sequence
  Synthetic oligonucleotide
acagcggcgaacagcaggtggatgt

SEQ ID NO: 718381 - DNA, 25 bp, Artificial sequence
  Synthetic oligonucleotide
tcgccctggtgccgctctatgacgt

SEQ ID NO: 718382 - DNA, 25 bp, Artificial sequence
  Synthetic oligonucleotide
cagcaggtggatgtcgggcgcgagg

SEQ ID NO: 718383 - DNA, 25 bp, Artificial sequence
  Synthetic oligonucleotide
gtggatgtcgggcgcgaggtgaagg

SEQ ID NO: 718384 - DNA, 25 bp, Artificial sequence
  Synthetic oligonucleotide
gtcgggcgcgaggtgaaggtgcagt

SEQ ID NO: 718385 - DNA, 25 bp, Artificial sequence
  Synthetic oligonucleotide
cgcgaggtgaaggtgcagttcatga

SEQ ID NO: 718386 - DNA, 25 bp, Artificial sequence
  Synthetic oligonucleotide
gtgaaggtgcagttcatgacctcga

SEQ ID NO: 718387 - DNA, 25 bp, Artificial sequence
  Synthetic oligonucleotide
gtgcagttcatgacctcgaacaata

SEQ ID NO: 718388 - DNA, 25 bp, Artificial sequence
  Synthetic oligonucleotide
ttcatgacctcgaacaatatcgaca

SEQ ID NO: 718389 - DNA, 25 bp, Artificial sequence
  Synthetic oligonucleotide
acctcgaacaatatcgacatggtct

SEQ ID NO: 718390 - DNA, 25 bp, Artificial sequence
  Synthetic oligonucleotide
aacaatatcgacatggtctgggagt

SEQ ID NO: 718391 - DNA, 25 bp, Artificial sequence
  Synthetic oligonucleotide
gcgcctacagcggcgaacagcaggt

SEQ ID NO: 718392 - DNA, 25 bp, Artificial sequence
  Synthetic oligonucleotide
tacccgccgcctggtcggccgcctg

SEQ ID NO: 718393 - DNA, 25 bp, Artificial sequence
  Synthetic oligonucleotide
ctgcacttctggatgagcttcatcg

SEQ ID NO: 718394 - DNA, 25 bp, Artificial sequence
  Synthetic oligonucleotide
accttcagcaccccgcccgaggtca

SEQ ID NO: 718395 - DNA, 25 bp, Artificial sequence
  Synthetic oligonucleotide
agcaccccgcccgaggtcaagtgag

SEQ ID NO: 718396 - DNA, 25 bp, Artificial sequence
  Synthetic oligonucleotide
ccgcccgaggtcaagtgaggagcgc

SEQ ID NO: 718397 - DNA, 25 bp, Artificial sequence
  Synthetic oligonucleotide
gaggtcaagtgaggagcgcgtcatg

SEQ ID NO: 718398 - DNA, 25 bp, Artificial sequence
  Synthetic oligonucleotide
aagtgaggagcgcgtcatgagcgat

SEQ ID NO: 718399 - DNA, 25 bp, Artificial sequence
  Synthetic oligonucleotide
ggagcgcgtcatgagcgatgccaag

SEQ ID NO: 718400 - DNA, 25 bp, Artificial sequence
  Synthetic oligonucleotide
cgtcatgagcgatgccaaggtcgat

SEQ ID NO: 718401 - DNA, 25 bp, Artificial sequence
  Synthetic oligonucleotide
gagcgatgccaaggtcgatacccgc

SEQ ID NO: 718402 - DNA, 25 bp, Artificial sequence
  Synthetic oligonucleotide
cgctctatgacgtgatgtgccgcgc

SEQ ID NO: 718403 - DNA, 25 bp, Artificial sequence
  Synthetic oligonucleotide
ggtcgatacccgccgcctggtcggc

SEQ ID NO: 718404 - DNA, 25 bp, Artificial sequence
  Synthetic oligonucleotide
gcgccctaccacaccttcagcaccc

SEQ ID NO: 718405 - DNA, 25 bp, Artificial sequence
  Synthetic oligonucleotide
gccgcctggtcggccgcctgctgct

SEQ ID NO: 718406 - DNA, 25 bp, Artificial sequence
  Synthetic oligonucleotide
tggtcggccgcctgctgctggtgac

SEQ ID NO: 718407 - DNA, 25 bp, Artificial sequence
  Synthetic oligonucleotide
gccgcctgctgctggtgaccgtgct

SEQ ID NO: 718408 - DNA, 25 bp, Artificial sequence
  Synthetic oligonucleotide
tgctgctggtgaccgtgctgatgtt

SEQ ID NO: 718409 - DNA, 25 bp, Artificial sequence
  Synthetic oligonucleotide
tggtgaccgtgctgatgttcgcctt

SEQ ID NO: 718410 - DNA, 25 bp, Artificial sequence
  Synthetic oligonucleotide
ccgtgctgatgttcgccttcggctt

SEQ ID NO: 718411 - DNA, 25 bp, Artificial sequence
  Synthetic oligonucleotide
tgatgttcgccttcggcttcgccct

SEQ ID NO: 718412 - DNA, 25 bp, Artificial sequence
  Synthetic oligonucleotide
tcgccttcggcttcgccctggtgcc

SEQ ID NO: 718413 - DNA, 25 bp, Artificial sequence
  Synthetic oligonucleotide
tcggcttcgccctggtgccgctcta

SEQ ID NO: 718414 - DNA, 25 bp, Artificial sequence
  Synthetic oligonucleotide
tgccaaggtcgatacccgccgcctg

SEQ ID NO: 718415 - DNA, 25 bp, Artificial sequence
  Synthetic oligonucleotide
atgaacccggcctgccttgctgtgt

SEQ ID NO: 718416 - DNA, 25 bp, Artificial sequence
  Synthetic oligonucleotide
tacgctgcgttgttatgtcgcagcc

SEQ ID NO: 718417 - DNA, 25 bp, Artificial sequence
  Synthetic oligonucleotide
gcgttgttatgtcgcagccgctgtc

SEQ ID NO: 718418 - DNA, 25 bp, Artificial sequence
  Synthetic oligonucleotide
ttatgtcgcagccgctgtctatact

SEQ ID NO: 718419 - DNA, 25 bp, Artificial sequence
  Synthetic oligonucleotide
cgcagccgctgtctatactcccact

SEQ ID NO: 718420 - DNA, 25 bp, Artificial sequence
  Synthetic oligonucleotide
cgctgtctatactcccactcgaatg

SEQ ID NO: 718421 - DNA, 25 bp, Artificial sequence
  Synthetic oligonucleotide
ctatactcccactcgaatgctgaac

SEQ ID NO: 718422 - DNA, 25 bp, Artificial sequence
  Synthetic oligonucleotide
tcccactcgaatgctgaacctgatg

SEQ ID NO: 718423 - DNA, 25 bp, Artificial sequence
  Synthetic oligonucleotide
tcgaatgctgaacctgatgaacccg

SEQ ID NO: 718424 - DNA, 25 bp, Artificial sequence
  Synthetic oligonucleotide
ggcgcgcgccggctaagacgcgatt

SEQ ID NO: 718425 - DNA, 25 bp, Artificial sequence
  Synthetic oligonucleotide
aacctgatgaacccggcctgccttg

SEQ ID NO: 718426 - DNA, 25 bp, Artificial sequence
  Synthetic oligonucleotide
actttccagcgacgtttttacgctg

SEQ ID NO: 718427 - DNA, 25 bp, Artificial sequence
  Synthetic oligonucleotide
ccggcctgccttgctgtgtgccgag

SEQ ID NO: 718428 - DNA, 25 bp, Artificial sequence
  Synthetic oligonucleotide
tgccttgctgtgtgccgaggtgcga

SEQ ID NO: 718429 - DNA, 25 bp, Artificial sequence
  Synthetic oligonucleotide
gctgtgtgccgaggtgcgacggtca

SEQ ID NO: 718430 - DNA, 25 bp, Artificial sequence
  Synthetic oligonucleotide
tgccgaggtgcgacggtcaaagttc

SEQ ID NO: 718431 - DNA, 25 bp, Artificial sequence
  Synthetic oligonucleotide
ggtgcgacggtcaaagttcgttgtc

SEQ ID NO: 718432 - DNA, 25 bp, Artificial sequence
  Synthetic oligonucleotide
acggtcaaagttcgttgtcttggcg

SEQ ID NO: 718433 - DNA, 25 bp, Artificial sequence
  Synthetic oligonucleotide
caaagttcgttgtcttggcggtcca

SEQ ID NO: 718434 - DNA, 25 bp, Artificial sequence
  Synthetic oligonucleotide
cgttgtcttggcggtccaccccttg

SEQ ID NO: 718435 - DNA, 25 bp, Artificial sequence
  Synthetic oligonucleotide
tccaccccttggccgttggcgtctg

SEQ ID NO: 718436 - DNA, 25 bp, Artificial sequence
  Synthetic oligonucleotide
tgctgaacctgatgaacccggcctg

SEQ ID NO: 718437 - DNA, 25 bp, Artificial sequence
  Synthetic oligonucleotide
ccaccattcgcctgcaaagccacgc

SEQ ID NO: 718438 - DNA, 25 bp, Artificial sequence
  Synthetic oligonucleotide
acttccacgagagcaccacggtgga

SEQ ID NO: 718439 - DNA, 25 bp, Artificial sequence
  Synthetic oligonucleotide
ctaagacgcgattgtcataatcgct

SEQ ID NO: 718440 - DNA, 25 bp, Artificial sequence
  Synthetic oligonucleotide
cgcgattgtcataatcgcttcgtgg

SEQ ID NO: 718441 - DNA, 25 bp, Artificial sequence
  Synthetic oligonucleotide
tgtcataatcgcttcgtggttatgc

SEQ ID NO: 718442 - DNA, 25 bp, Artificial sequence
  Synthetic oligonucleotide
aatcgcttcgtggttatgcgaggat

SEQ ID NO: 718443 - DNA, 25 bp, Artificial sequence
  Synthetic oligonucleotide
cttcgtggttatgcgaggatgatat

SEQ ID NO: 718444 - DNA, 25 bp, Artificial sequence
  Synthetic oligonucleotide
ggttatgcgaggatgatatatcagg

SEQ ID NO: 718445 - DNA, 25 bp, Artificial sequence
  Synthetic oligonucleotide
gcgaggatgatatatcaggcggcca

SEQ ID NO: 718446 - DNA, 25 bp, Artificial sequence
  Synthetic oligonucleotide
gatgatatatcaggcggccaccatt

SEQ ID NO: 718447 - DNA, 25 bp, Artificial sequence
  Synthetic oligonucleotide
cgtttttacgctgcgttgttatgtc

SEQ ID NO: 718448 - DNA, 25 bp, Artificial sequence
  Synthetic oligonucleotide
aggcggccaccattcgcctgcaaag

SEQ ID NO: 718449 - DNA, 25 bp, Artificial sequence
  Synthetic oligonucleotide
cagcgacgtttttacgctgcgttgt

SEQ ID NO: 718450 - DNA, 25 bp, Artificial sequence
  Synthetic oligonucleotide
ttcgcctgcaaagccacgccgctcg

SEQ ID NO: 718451 - DNA, 25 bp, Artificial sequence
  Synthetic oligonucleotide
tgcaaagccacgccgctcgcggctt

SEQ ID NO: 718452 - DNA, 25 bp, Artificial sequence
  Synthetic oligonucleotide
agccacgccgctcgcggcttttaga

SEQ ID NO: 718453 - DNA, 25 bp, Artificial sequence
  Synthetic oligonucleotide
gccgctcgcggcttttagagaagaa

SEQ ID NO: 718454 - DNA, 25 bp, Artificial sequence
  Synthetic oligonucleotide
cgcggcttttagagaagaatcggca

SEQ ID NO: 718455 - DNA, 25 bp, Artificial sequence
  Synthetic oligonucleotide
ttttagagaagaatcggcactttcc

SEQ ID NO: 718456 - DNA, 25 bp, Artificial sequence
  Synthetic oligonucleotide
agaagaatcggcactttccagcgac

SEQ ID NO: 718457 - DNA, 25 bp, Artificial sequence
  Synthetic oligonucleotide
atcggcactttccagcgacgttttt

SEQ ID NO: 718458 - DNA, 25 bp, Artificial sequence
  Synthetic oligonucleotide
tggcgtctgccggcgggataaaaac

SEQ ID NO: 718459 - DNA, 25 bp, Artificial sequence
  Synthetic oligonucleotide
atatcaggcggccaccattcgcctg

SEQ ID NO: 718460 - DNA, 25 bp, Artificial sequence
  Synthetic oligonucleotide
ttcggcgcgatgttctggtcgatga

SEQ ID NO: 718461 - DNA, 25 bp, Artificial sequence
  Synthetic oligonucleotide
cccttggccgttggcgtctgccggc

SEQ ID NO: 718462 - DNA, 25 bp, Artificial sequence
  Synthetic oligonucleotide
ccgtcttcgacctgcacatgaccat

SEQ ID NO: 718463 - DNA, 25 bp, Artificial sequence
  Synthetic oligonucleotide
tcgacctgcacatgaccatcttctg

SEQ ID NO: 718464 - DNA, 25 bp, Artificial sequence
  Synthetic oligonucleotide
tgcacatgaccatcttctggatctg

SEQ ID NO: 718465 - DNA, 25 bp, Artificial sequence
  Synthetic oligonucleotide
tgaccatcttctggatctgcgtggt

SEQ ID NO: 718466 - DNA, 25 bp, Artificial sequence
  Synthetic oligonucleotide
tcttctggatctgcgtggtgatcgg

SEQ ID NO: 718467 - DNA, 25 bp, Artificial sequence
  Synthetic oligonucleotide
ggatctgcgtggtgatcggcgtgct

SEQ ID NO: 718468 - DNA, 25 bp, Artificial sequence
  Synthetic oligonucleotide
gcgtggtgatcggcgtgctggtctt

SEQ ID NO: 718469 - DNA, 25 bp, Artificial sequence
  Synthetic oligonucleotide
gtgatcggcgtgctggtcttcggcg

SEQ ID NO: 718470 - DNA, 25 bp, Artificial sequence
  Synthetic oligonucleotide
aggtgagccggtccgtcttcgacct

SEQ ID NO: 718471 - DNA, 25 bp, Artificial sequence
  Synthetic oligonucleotide
ctggtcttcggcgcgatgttctggt

SEQ ID NO: 718472 - DNA, 25 bp, Artificial sequence
  Synthetic oligonucleotide
ctaccgaggtgagccggtccgtctt

SEQ ID NO: 718473 - DNA, 25 bp, Artificial sequence
  Synthetic oligonucleotide
gcgatgttctggtcgatgatcgtcc

SEQ ID NO: 718474 - DNA, 25 bp, Artificial sequence
  Synthetic oligonucleotide
ttctggtcgatgatcgtccaccgcc

SEQ ID NO: 718475 - DNA, 25 bp, Artificial sequence
  Synthetic oligonucleotide
tcgatgatcgtccaccgccgctcca

SEQ ID NO: 718476 - DNA, 25 bp, Artificial sequence
  Synthetic oligonucleotide
atcgtccaccgccgctccaccggcc

SEQ ID NO: 718477 - DNA, 25 bp, Artificial sequence
  Synthetic oligonucleotide
caccgccgctccaccggccagcagc

SEQ ID NO: 718478 - DNA, 25 bp, Artificial sequence
  Synthetic oligonucleotide
cgctccaccggccagcagccggcgc

SEQ ID NO: 718479 - DNA, 25 bp, Artificial sequence
  Synthetic oligonucleotide
accggccagcagccggcgcacttcc

SEQ ID NO: 718480 - DNA, 25 bp, Artificial sequence
  Synthetic oligonucleotide
agcagccggcgcacttccacgagag

SEQ ID NO: 718481 - DNA, 25 bp, Artificial sequence
  Synthetic oligonucleotide
ggagggcagcggtgttcatggggtc

SEQ ID NO: 718482 - DNA, 25 bp, Artificial sequence
  Synthetic oligonucleotide
ggcgtgctggtcttcggcgcgatgt

SEQ ID NO: 718483 - DNA, 25 bp, Artificial sequence
  Synthetic oligonucleotide
tttgctctcggcgatcagccaggcg

SEQ ID NO: 718484 - DNA, 25 bp, Artificial sequence
  Synthetic oligonucleotide
gccggcggcgcgcgccggctaagac

SEQ ID NO: 718485 - DNA, 25 bp, Artificial sequence
  Synthetic oligonucleotide
tctgccggcgggataaaaacaacga

SEQ ID NO: 718486 - DNA, 25 bp, Artificial sequence
  Synthetic oligonucleotide
caacgataaggggaacccgaatgct

SEQ ID NO: 718487 - DNA, 25 bp, Artificial sequence
  Synthetic oligonucleotide
taaggggaacccgaatgctgcgaca

SEQ ID NO: 718488 - DNA, 25 bp, Artificial sequence
  Synthetic oligonucleotide
gaacccgaatgctgcgacatccacg

SEQ ID NO: 718489 - DNA, 25 bp, Artificial sequence
  Synthetic oligonucleotide
gaatgctgcgacatccacgagtctg

SEQ ID NO: 718490 - DNA, 25 bp, Artificial sequence
  Synthetic oligonucleotide
tgcgacatccacgagtctggatggg

SEQ ID NO: 718491 - DNA, 25 bp, Artificial sequence
  Synthetic oligonucleotide
atccacgagtctggatgggcttcct

SEQ ID NO: 718492 - DNA, 25 bp, Artificial sequence
  Synthetic oligonucleotide
gagtctggatgggcttccttttgct

SEQ ID NO: 718493 - DNA, 25 bp, Artificial sequence
  Synthetic oligonucleotide
gccggtccgtcttcgacctgcacat

SEQ ID NO: 718494 - DNA, 25 bp, Artificial sequence
  Synthetic oligonucleotide
gcttccttttgctctcggcgatcag

SEQ ID NO: 718495 - DNA, 25 bp, Artificial sequence
  Synthetic oligonucleotide
gccgttggcgtctgccggcgggata

SEQ ID NO: 718496 - DNA, 25 bp, Artificial sequence
  Synthetic oligonucleotide
tctcggcgatcagccaggcgaatgc

SEQ ID NO: 718497 - DNA, 25 bp, Artificial sequence
  Synthetic oligonucleotide
gatcagccaggcgaatgccgcctgg

SEQ ID NO: 718498 - DNA, 25 bp, Artificial sequence
  Synthetic oligonucleotide
ccaggcgaatgccgcctggacggtc

SEQ ID NO: 718499 - DNA, 25 bp, Artificial sequence
  Synthetic oligonucleotide
gaatgccgcctggacggtcaacatg

SEQ ID NO: 718500 - DNA, 25 bp, Artificial sequence
  Synthetic oligonucleotide
gcctggacggtcaacatggccccgg

SEQ ID NO: 718501 - DNA, 25 bp, Artificial sequence
  Synthetic oligonucleotide
gacggtcaacatggccccgggcgct

SEQ ID NO: 718502 - DNA, 25 bp, Artificial sequence
  Synthetic oligonucleotide
aacatggccccgggcgctaccgagg

SEQ ID NO: 718503 - DNA, 25 bp, Artificial sequence
  Synthetic oligonucleotide
ggccccgggcgctaccgaggtgagc

SEQ ID NO: 718504 - DNA, 25 bp, Artificial sequence
  Synthetic oligonucleotide
gggcgctaccgaggtgagccggtcc

SEQ ID NO: 718505 - DNA, 25 bp, Artificial sequence
  Synthetic oligonucleotide
ggatgggcttccttttgctctcggc

SEQ ID NO: 718506 - DNA, 25 bp, Artificial sequence
  Synthetic oligonucleotide
gtggccggcgagcaacgccggcggg

SEQ ID NO: 718507 - DNA, 25 bp, Artificial sequence
  Synthetic oligonucleotide
cacttcttccaccaggcggtgcgcc

SEQ ID NO: 718508 - DNA, 25 bp, Artificial sequence
  Synthetic oligonucleotide
tccaccaggcggtgcgccaggtagg

SEQ ID NO: 718509 - DNA, 25 bp, Artificial sequence
  Synthetic oligonucleotide
aggcggtgcgccaggtaggcttcgt

SEQ ID NO: 718510 - DNA, 25 bp, Artificial sequence
  Synthetic oligonucleotide
tgcgccaggtaggcttcgtcgagca

SEQ ID NO: 718511 - DNA, 25 bp, Artificial sequence
  Synthetic oligonucleotide
aggtaggcttcgtcgagcagggcgt

SEQ ID NO: 718512 - DNA, 25 bp, Artificial sequence
  Synthetic oligonucleotide
gcttcgtcgagcagggcgtcgaggc

SEQ ID NO: 718513 - DNA, 25 bp, Artificial sequence
  Synthetic oligonucleotide
tcgagcagggcgtcgaggccgtcgt

SEQ ID NO: 718514 - DNA, 25 bp, Artificial sequence
  Synthetic oligonucleotide
agggcgtcgaggccgtcgtggccgg

SEQ ID NO: 718515 - DNA, 25 bp, Artificial sequence
  Synthetic oligonucleotide
cgccggctaagacgcgattgtcata

SEQ ID NO: 718516 - DNA, 25 bp, Artificial sequence
  Synthetic oligonucleotide
ccgtcgtggccggcgagcaacgccg

SEQ ID NO: 718517 - DNA, 25 bp, Artificial sequence
  Synthetic oligonucleotide
gcgatgtagcggtcgttcacttctt

SEQ ID NO: 718518 - DNA, 25 bp, Artificial sequence
  Synthetic oligonucleotide
ggcgagcaacgccggcggggtgagg

SEQ ID NO: 718519 - DNA, 25 bp, Artificial sequence
  Synthetic oligonucleotide
gcaacgccggcggggtgaggaagaa

SEQ ID NO: 718520 - DNA, 25 bp, Artificial sequence
  Synthetic oligonucleotide
ccggcggggtgaggaagaactgctc

SEQ ID NO: 718521 - DNA, 25 bp, Artificial sequence
  Synthetic oligonucleotide
ggtgaggaagaactgctcggcgacc

SEQ ID NO: 718522 - DNA, 25 bp, Artificial sequence
  Synthetic oligonucleotide
ggaagaactgctcggcgaccttcag

SEQ ID NO: 718523 - DNA, 25 bp, Artificial sequence
  Synthetic oligonucleotide
actgctcggcgaccttcagcaccgg

SEQ ID NO: 718524 - DNA, 25 bp, Artificial sequence
  Synthetic oligonucleotide
cggcgaccttcagcaccggcttgat

SEQ ID NO: 718525 - DNA, 25 bp, Artificial sequence
  Synthetic oligonucleotide
ccttcagcaccggcttgatccgttc

SEQ ID NO: 718526 - DNA, 25 bp, Artificial sequence
  Synthetic oligonucleotide
gcaccggcttgatccgttcctcgat

SEQ ID NO: 718527 - DNA, 25 bp, Artificial sequence
  Synthetic oligonucleotide
tcgaggccgtcgtggccggcgagca

SEQ ID NO: 718528 - DNA, 25 bp, Artificial sequence
  Synthetic oligonucleotide
ccaccaggttggctacggtggtgtc

SEQ ID NO: 718529 - DNA, 25 bp, Artificial sequence
  Synthetic oligonucleotide
gactctacagcgcgcagatggaccg

SEQ ID NO: 718530 - DNA, 25 bp, Artificial sequence
  Synthetic oligonucleotide
gcgccggactctacagcgcgcagat

SEQ ID NO: 718531 - DNA, 25 bp, Artificial sequence
  Synthetic oligonucleotide
tggtggacggcttcgtccagccggt

SEQ ID NO: 718532 - DNA, 25 bp, Artificial sequence
  Synthetic oligonucleotide
acggcttcgtccagccggttggcga

SEQ ID NO: 718533 - DNA, 25 bp, Artificial sequence
  Synthetic oligonucleotide
tcgtccagccggttggcgaagggct

SEQ ID NO: 718534 - DNA, 25 bp, Artificial sequence
  Synthetic oligonucleotide
cagccggttggcgaagggctcgccg

SEQ ID NO: 718535 - DNA, 25 bp, Artificial sequence
  Synthetic oligonucleotide
ttggcgaagggctcgccgatcaact

SEQ ID NO: 718536 - DNA, 25 bp, Artificial sequence
  Synthetic oligonucleotide
aagggctcgccgatcaactggtggg

SEQ ID NO: 718537 - DNA, 25 bp, Artificial sequence
  Synthetic oligonucleotide
tcgccgatcaactggtgggccacca

SEQ ID NO: 718538 - DNA, 25 bp, Artificial sequence
  Synthetic oligonucleotide
tcgttcacttcttccaccaggcggt

SEQ ID NO: 718539 - DNA, 25 bp, Artificial sequence
  Synthetic oligonucleotide
tggtgggccaccaggttggctacgg

SEQ ID NO: 718540 - DNA, 25 bp, Artificial sequence
  Synthetic oligonucleotide
tagcggtcgttcacttcttccacca

SEQ ID NO: 718541 - DNA, 25 bp, Artificial sequence
  Synthetic oligonucleotide
gttggctacggtggtgtccagtggg

SEQ ID NO: 718542 - DNA, 25 bp, Artificial sequence
  Synthetic oligonucleotide
tacggtggtgtccagtgggatcagt

SEQ ID NO: 718543 - DNA, 25 bp, Artificial sequence
  Synthetic oligonucleotide
tggtgtccagtgggatcagtgcctg

SEQ ID NO: 718544 - DNA, 25 bp, Artificial sequence
  Synthetic oligonucleotide
ccagtgggatcagtgcctggccgaa

SEQ ID NO: 718545 - DNA, 25 bp, Artificial sequence
  Synthetic oligonucleotide
ggatcagtgcctggccgaagtgggc

SEQ ID NO: 718546 - DNA, 25 bp, Artificial sequence
  Synthetic oligonucleotide
gtgcctggccgaagtgggcgatgta

SEQ ID NO: 718547 - DNA, 25 bp, Artificial sequence
  Synthetic oligonucleotide
tggccgaagtgggcgatgtagcggt

SEQ ID NO: 718548 - DNA, 25 bp, Artificial sequence
  Synthetic oligonucleotide
aagtgggcgatgtagcggtcgttca

SEQ ID NO: 718549 - DNA, 25 bp, Artificial sequence
  Synthetic oligonucleotide
cctcgatgccggcttcgcgggccac

SEQ ID NO: 718550 - DNA, 25 bp, Artificial sequence
  Synthetic oligonucleotide
atcaactggtgggccaccaggttgg

SEQ ID NO: 718551 - DNA, 25 bp, Artificial sequence
  Synthetic oligonucleotide
cagcggtgttcatggggtctcccat

SEQ ID NO: 718552 - DNA, 25 bp, Artificial sequence
  Synthetic oligonucleotide
gcttgatccgttcctcgatgccggc

SEQ ID NO: 718553 - DNA, 25 bp, Artificial sequence
  Synthetic oligonucleotide
tggctatcagatcagccaggtgacc

SEQ ID NO: 718554 - DNA, 25 bp, Artificial sequence
  Synthetic oligonucleotide
tcagatcagccaggtgaccgtggcg

SEQ ID NO: 718555 - DNA, 25 bp, Artificial sequence
  Synthetic oligonucleotide
tcagccaggtgaccgtggcgggctt

SEQ ID NO: 718556 - DNA, 25 bp, Artificial sequence
  Synthetic oligonucleotide
aggtgaccgtggcgggcttcgctga

SEQ ID NO: 718557 - DNA, 25 bp, Artificial sequence
  Synthetic oligonucleotide
ccgtggcgggcttcgctgaggtgcg

SEQ ID NO: 718558 - DNA, 25 bp, Artificial sequence
  Synthetic oligonucleotide
cgggcttcgctgaggtgcgcctgct

SEQ ID NO: 718559 - DNA, 25 bp, Artificial sequence
  Synthetic oligonucleotide
tcgctgaggtgcgcctgctggatga

SEQ ID NO: 718560 - DNA, 25 bp, Artificial sequence
  Synthetic oligonucleotide
aggtgcgcctgctggatgagttcac

SEQ ID NO: 718561 - DNA, 25 bp, Artificial sequence
  Synthetic oligonucleotide
gggcaggcggctggctatcagatca

SEQ ID NO: 718562 - DNA, 25 bp, Artificial sequence
  Synthetic oligonucleotide
agttcacggagggcagcggtgttca

SEQ ID NO: 718563 - DNA, 25 bp, Artificial sequence
  Synthetic oligonucleotide
gcaggtggggcaggcggctggctat

SEQ ID NO: 718564 - DNA, 25 bp, Artificial sequence
  Synthetic oligonucleotide
tgttcatggggtctcccatacaacg

SEQ ID NO: 718565 - DNA, 25 bp, Artificial sequence
  Synthetic oligonucleotide
tggggtctcccatacaacggggatg

SEQ ID NO: 718566 - DNA, 25 bp, Artificial sequence
  Synthetic oligonucleotide
tctcccatacaacggggatggtgaa

SEQ ID NO: 718567 - DNA, 25 bp, Artificial sequence
  Synthetic oligonucleotide
catacaacggggatggtgaagaaga

SEQ ID NO: 718568 - DNA, 25 bp, Artificial sequence
  Synthetic oligonucleotide
acggggatggtgaagaagaggagaa

SEQ ID NO: 718569 - DNA, 25 bp, Artificial sequence
  Synthetic oligonucleotide
atggtgaagaagaggagaaacatag

SEQ ID NO: 718570 - DNA, 25 bp, Artificial sequence
  Synthetic oligonucleotide
agaagaggagaaacatagccggcgg

SEQ ID NO: 718571 - DNA, 25 bp, Artificial sequence
  Synthetic oligonucleotide
aggagaaacatagccggcggcgcgc

SEQ ID NO: 718572 - DNA, 25 bp, Artificial sequence
  Synthetic oligonucleotide
aacatagccggcggcgcgcgccggc

SEQ ID NO: 718573 - DNA, 25 bp, Artificial sequence
  Synthetic oligonucleotide
gcctgctggatgagttcacggaggg

SEQ ID NO: 718574 - DNA, 25 bp, Artificial sequence
  Synthetic oligonucleotide
tggacgaagcgggtgagtatgtctt

SEQ ID NO: 718575 - DNA, 25 bp, Artificial sequence
  Synthetic oligonucleotide
acgagagcaccacggtggaaatcct

SEQ ID NO: 718576 - DNA, 25 bp, Artificial sequence
  Synthetic oligonucleotide
tgccggcttcgcgggccacgctgtt

SEQ ID NO: 718577 - DNA, 25 bp, Artificial sequence
  Synthetic oligonucleotide
cttcgcgggccacgctgttggcggc

SEQ ID NO: 718578 - DNA, 25 bp, Artificial sequence
  Synthetic oligonucleotide
gggccacgctgttggcggcgtcgag

SEQ ID NO: 718579 - DNA, 25 bp, Artificial sequence
  Synthetic oligonucleotide
gctgttggcggcgtcgagcaggtcc

SEQ ID NO: 718580 - DNA, 25 bp, Artificial sequence
  Synthetic oligonucleotide
gcggcgtcgagcaggtccggtacct

SEQ ID NO: 718581 - DNA, 25 bp, Artificial sequence
  Synthetic oligonucleotide
cgagcaggtccggtacctgttcgac

SEQ ID NO: 718582 - DNA, 25 bp, Artificial sequence
  Synthetic oligonucleotide
ccggtacctgttcgacgtaggcgtg

SEQ ID NO: 718583 - DNA, 25 bp, Artificial sequence
  Synthetic oligonucleotide
cctgttcgacgtaggcgtggacgaa

SEQ ID NO: 718584 - DNA, 25 bp, Artificial sequence
  Synthetic oligonucleotide
ggcggctggctatcagatcagccag

SEQ ID NO: 718585 - DNA, 25 bp, Artificial sequence
  Synthetic oligonucleotide
taggcgtggacgaagcgggtgagta

SEQ ID NO: 718586 - DNA, 25 bp, Artificial sequence
  Synthetic oligonucleotide
tccgttcctcgatgccggcttcgcg

SEQ ID NO: 718587 - DNA, 25 bp, Artificial sequence
  Synthetic oligonucleotide
aagcgggtgagtatgtcttccgtgt

SEQ ID NO: 718588 - DNA, 25 bp, Artificial sequence
  Synthetic oligonucleotide
gtgagtatgtcttccgtgttctcgc

SEQ ID NO: 718589 - DNA, 25 bp, Artificial sequence
  Synthetic oligonucleotide
atgtcttccgtgttctcgccttgcg

SEQ ID NO: 718590 - DNA, 25 bp, Artificial sequence
  Synthetic oligonucleotide
tccgtgttctcgccttgcggctgga

SEQ ID NO: 718591 - DNA, 25 bp, Artificial sequence
  Synthetic oligonucleotide
ttctcgccttgcggctggatggtgc

SEQ ID NO: 718592 - DNA, 25 bp, Artificial sequence
  Synthetic oligonucleotide
ccttgcggctggatggtgcgatgca

SEQ ID NO: 718593 - DNA, 25 bp, Artificial sequence
  Synthetic oligonucleotide
cggctggatggtgcgatgcaggtgg

SEQ ID NO: 718594 - DNA, 25 bp, Artificial sequence
  Synthetic oligonucleotide
gatggtgcgatgcaggtggggcagg

SEQ ID NO: 718595 - DNA, 25 bp, Artificial sequence
  Synthetic oligonucleotide
tgcgatgcaggtggggcaggcggct

SEQ ID NO: 718596 - DNA, 25 bp, Artificial sequence
  Synthetic oligonucleotide
tcgacgtaggcgtggacgaagcggg

SEQ ID NO: 718597 - DNA, 25 bp, Artificial sequence
  Synthetic oligonucleotide
atggcggccttcggcaagcagctca

SEQ ID NO: 718598 - DNA, 25 bp, Artificial sequence
  Synthetic oligonucleotide
gtcaccgggcccaaggagcaccacc

SEQ ID NO: 718599 - DNA, 25 bp, Artificial sequence
  Synthetic oligonucleotide
ggcccaaggagcaccacctggaagt

SEQ ID NO: 718600 - DNA, 25 bp, Artificial sequence
  Synthetic oligonucleotide
aggagcaccacctggaagtggtctt

SEQ ID NO: 718601 - DNA, 25 bp, Artificial sequence
  Synthetic oligonucleotide
accacctggaagtggtcttcaacgg

SEQ ID NO: 718602 - DNA, 25 bp, Artificial sequence
  Synthetic oligonucleotide
tggaagtggtcttcaacggcgtgcc

SEQ ID NO: 718603 - DNA, 25 bp, Artificial sequence
  Synthetic oligonucleotide
gtggtcttcaacggcgtgcccggca

SEQ ID NO: 718604 - DNA, 25 bp, Artificial sequence
  Synthetic oligonucleotide
ttcaacggcgtgcccggcaccgcca

SEQ ID NO: 718605 - DNA, 25 bp, Artificial sequence
  Synthetic oligonucleotide
ggcgtgcccggcaccgccatggcgg

SEQ ID NO: 718606 - DNA, 25 bp, Artificial sequence
  Synthetic oligonucleotide
aaggaactgaccagcaaggagtgga

SEQ ID NO: 718607 - DNA, 25 bp, Artificial sequence
  Synthetic oligonucleotide
accgccatggcggccttcggcaagc

SEQ ID NO: 718608 - DNA, 25 bp, Artificial sequence
  Synthetic oligonucleotide
tgaagggttcgaagatcgtcaccgg

SEQ ID NO: 718609 - DNA, 25 bp, Artificial sequence
  Synthetic oligonucleotide
gccttcggcaagcagctcaacgagg

SEQ ID NO: 718610 - DNA, 25 bp, Artificial sequence
  Synthetic oligonucleotide
ggcaagcagctcaacgaggtcgacc

SEQ ID NO: 718611 - DNA, 25 bp, Artificial sequence
  Synthetic oligonucleotide
cagctcaacgaggtcgacctggccg

SEQ ID NO: 718612 - DNA, 25 bp, Artificial sequence
  Synthetic oligonucleotide
aacgaggtcgacctggccgcggtga

SEQ ID NO: 718613 - DNA, 25 bp, Artificial sequence
  Synthetic oligonucleotide
gtcgacctggccgcggtgatcacct

SEQ ID NO: 718614 - DNA, 25 bp, Artificial sequence
  Synthetic oligonucleotide
tggccgcggtgatcacctacgagcg

SEQ ID NO: 718615 - DNA, 25 bp, Artificial sequence
  Synthetic oligonucleotide
cggtgatcacctacgagcgcaacgc

SEQ ID NO: 718616 - DNA, 25 bp, Artificial sequence
  Synthetic oligonucleotide
atcacctacgagcgcaacgcctggg

SEQ ID NO: 718617 - DNA, 25 bp, Artificial sequence
  Synthetic oligonucleotide
tacgagcgcaacgcctggggcaacg

SEQ ID NO: 718618 - DNA, 25 bp, Artificial sequence
  Synthetic oligonucleotide
cccggcaccgccatggcggccttcg

SEQ ID NO: 718619 - DNA, 25 bp, Artificial sequence
  Synthetic oligonucleotide
tgcgccgcctgccaccaggccgaag

SEQ ID NO: 718620 - DNA, 25 bp, Artificial sequence
  Synthetic oligonucleotide
cggcgcacttccacgagagcaccac

SEQ ID NO: 718621 - DNA, 25 bp, Artificial sequence
  Synthetic oligonucleotide
agcaaggagtggaccaaggaagagt

SEQ ID NO: 718622 - DNA, 25 bp, Artificial sequence
  Synthetic oligonucleotide
gagtggaccaaggaagagttggttg

SEQ ID NO: 718623 - DNA, 25 bp, Artificial sequence
  Synthetic oligonucleotide
accaaggaagagttggttgcgcgcg

SEQ ID NO: 718624 - DNA, 25 bp, Artificial sequence
  Synthetic oligonucleotide
gaagagttggttgcgcgcggcgaca

SEQ ID NO: 718625 - DNA, 25 bp, Artificial sequence
  Synthetic oligonucleotide
ttggttgcgcgcggcgacaaggtct

SEQ ID NO: 718626 - DNA, 25 bp, Artificial sequence
  Synthetic oligonucleotide
gcgcgcggcgacaaggtctaccaca

SEQ ID NO: 718627 - DNA, 25 bp, Artificial sequence
  Synthetic oligonucleotide
ggcgacaaggtctaccacaccatct

SEQ ID NO: 718628 - DNA, 25 bp, Artificial sequence
  Synthetic oligonucleotide
aaggtctaccacaccatctgcgccg

SEQ ID NO: 718629 - DNA, 25 bp, Artificial sequence
  Synthetic oligonucleotide
aagatcgtcaccgggcccaaggagc

SEQ ID NO: 718630 - DNA, 25 bp, Artificial sequence
  Synthetic oligonucleotide
caccatctgcgccgcctgccaccag

SEQ ID NO: 718631 - DNA, 25 bp, Artificial sequence
  Synthetic oligonucleotide
gttcgaagatcgtcaccgggcccaa

SEQ ID NO: 718632 - DNA, 25 bp, Artificial sequence
  Synthetic oligonucleotide
gcctgccaccaggccgaaggccagg

SEQ ID NO: 718633 - DNA, 25 bp, Artificial sequence
  Synthetic oligonucleotide
caccaggccgaaggccagggcatgc

SEQ ID NO: 718634 - DNA, 25 bp, Artificial sequence
  Synthetic oligonucleotide
ccgaaggccagggcatgccgccgat

SEQ ID NO: 718635 - DNA, 25 bp, Artificial sequence
  Synthetic oligonucleotide
gccagggcatgccgccgatgttccc

SEQ ID NO: 718636 - DNA, 25 bp, Artificial sequence
  Synthetic oligonucleotide
gcatgccgccgatgttcccggcgct

SEQ ID NO: 718637 - DNA, 25 bp, Artificial sequence
  Synthetic oligonucleotide
cgccgatgttcccggcgctgaaggg

SEQ ID NO: 718638 - DNA, 25 bp, Artificial sequence
  Synthetic oligonucleotide
tgttcccggcgctgaagggttcgaa

SEQ ID NO: 718639 - DNA, 25 bp, Artificial sequence
  Synthetic oligonucleotide
cggcgctgaagggttcgaagatcgt

SEQ ID NO: 718640 - DNA, 25 bp, Artificial sequence
  Synthetic oligonucleotide
gcaacgacgatggcgacatggtcac

SEQ ID NO: 718641 - DNA, 25 bp, Artificial sequence
  Synthetic oligonucleotide
ctaccacaccatctgcgccgcctgc

SEQ ID NO: 718642 - DNA, 25 bp, Artificial sequence
  Synthetic oligonucleotide
tcatgatgttcctgctcggcggctc

SEQ ID NO: 718643 - DNA, 25 bp, Artificial sequence
  Synthetic oligonucleotide
cgcaacgcctggggcaacgacgatg

SEQ ID NO: 718644 - DNA, 25 bp, Artificial sequence
  Synthetic oligonucleotide
gctgggtgctgacgaccaaccacaa

SEQ ID NO: 718645 - DNA, 25 bp, Artificial sequence
  Synthetic oligonucleotide
tgctgacgaccaaccacaaggacat

SEQ ID NO: 718646 - DNA, 25 bp, Artificial sequence
  Synthetic oligonucleotide
acgaccaaccacaaggacatcggca

SEQ ID NO: 718647 - DNA, 25 bp, Artificial sequence
  Synthetic oligonucleotide
aaccacaaggacatcggcaccctct

SEQ ID NO: 718648 - DNA, 25 bp, Artificial sequence
  Synthetic oligonucleotide
aaggacatcggcaccctctacctgt

SEQ ID NO: 718649 - DNA, 25 bp, Artificial sequence
  Synthetic oligonucleotide
atcggcaccctctacctgtggttca

SEQ ID NO: 718650 - DNA, 25 bp, Artificial sequence
  Synthetic oligonucleotide
accctctacctgtggttcagcttca

SEQ ID NO: 718651 - DNA, 25 bp, Artificial sequence
  Synthetic oligonucleotide
tacctgtggttcagcttcatgatgt

SEQ ID NO: 718652 - DNA, 25 bp, Artificial sequence
  Synthetic oligonucleotide
agggcctgatgcgctgggtgctgac

SEQ ID NO: 718653 - DNA, 25 bp, Artificial sequence
  Synthetic oligonucleotide
cagcttcatgatgttcctgctcggc

SEQ ID NO: 718654 - DNA, 25 bp, Artificial sequence
  Synthetic oligonucleotide
cggccaagggcctgatgcgctgggt

SEQ ID NO: 718655 - DNA, 25 bp, Artificial sequence
  Synthetic oligonucleotide
tgttcctgctcggcggctcgatggc

SEQ ID NO: 718656 - DNA, 25 bp, Artificial sequence
  Synthetic oligonucleotide
tgctcggcggctcgatggccatggt

SEQ ID NO: 718657 - DNA, 25 bp, Artificial sequence
  Synthetic oligonucleotide
cggctcgatggccatggtgatccgc

SEQ ID NO: 718658 - DNA, 25 bp, Artificial sequence
  Synthetic oligonucleotide
gatggccatggtgatccgcgccgag

SEQ ID NO: 718659 - DNA, 25 bp, Artificial sequence
  Synthetic oligonucleotide
catggtgatccgcgccgagctgttc

SEQ ID NO: 718660 - DNA, 25 bp, Artificial sequence
  Synthetic oligonucleotide
gatccgcgccgagctgttccagccc

SEQ ID NO: 718661 - DNA, 25 bp, Artificial sequence
  Synthetic oligonucleotide
cgccgagctgttccagcccggcctg

SEQ ID NO: 718662 - DNA, 25 bp, Artificial sequence
  Synthetic oligonucleotide
agctgttccagcccggcctgcagat

SEQ ID NO: 718663 - DNA, 25 bp, Artificial sequence
  Synthetic oligonucleotide
tccagcccggcctgcagatcgtcga

SEQ ID NO: 718664 - DNA, 25 bp, Artificial sequence
  Synthetic oligonucleotide
gtggttcagcttcatgatgttcctg

SEQ ID NO: 718665 - DNA, 25 bp, Artificial sequence
  Synthetic oligonucleotide
accgccatgagtgctgtgatcgata

SEQ ID NO: 718666 - DNA, 25 bp, Artificial sequence
  Synthetic oligonucleotide
aaggtcaaggaactgaccagcaagg

SEQ ID NO: 718667 - DNA, 25 bp, Artificial sequence
  Synthetic oligonucleotide
acgatggcgacatggtcaccccgaa

SEQ ID NO: 718668 - DNA, 25 bp, Artificial sequence
  Synthetic oligonucleotide
gcgacatggtcaccccgaaagacgt

SEQ ID NO: 718669 - DNA, 25 bp, Artificial sequence
  Synthetic oligonucleotide
tggtcaccccgaaagacgtcgtcgc

SEQ ID NO: 718670 - DNA, 25 bp, Artificial sequence
  Synthetic oligonucleotide
cccgaaagacgtcgtcgcctacaag

SEQ ID NO: 718671 - DNA, 25 bp, Artificial sequence
  Synthetic oligonucleotide
agacgtcgtcgcctacaagcagaaa

SEQ ID NO: 718672 - DNA, 25 bp, Artificial sequence
  Synthetic oligonucleotide
cgtcgcctacaagcagaaacaacaa

SEQ ID NO: 718673 - DNA, 25 bp, Artificial sequence
  Synthetic oligonucleotide
ctacaagcagaaacaacaataggag

SEQ ID NO: 718674 - DNA, 25 bp, Artificial sequence
  Synthetic oligonucleotide
gcagaaacaacaataggagaccgcc

SEQ ID NO: 718675 - DNA, 25 bp, Artificial sequence
  Synthetic oligonucleotide
tgatgcgctgggtgctgacgaccaa

SEQ ID NO: 718676 - DNA, 25 bp, Artificial sequence
  Synthetic oligonucleotide
taggagaccgccatgagtgctgtga

SEQ ID NO: 718677 - DNA, 25 bp, Artificial sequence
  Synthetic oligonucleotide
cctggggcaacgacgatggcgacat

SEQ ID NO: 718678 - DNA, 25 bp, Artificial sequence
  Synthetic oligonucleotide
atgagtgctgtgatcgatacgcccg

SEQ ID NO: 718679 - DNA, 25 bp, Artificial sequence
  Synthetic oligonucleotide
tgctgtgatcgatacgcccgaccac

SEQ ID NO: 718680 - DNA, 25 bp, Artificial sequence
  Synthetic oligonucleotide
atcgatacgcccgaccaccatgccg

SEQ ID NO: 718681 - DNA, 25 bp, Artificial sequence
  Synthetic oligonucleotide
acgcccgaccaccatgccggcgacc

SEQ ID NO: 718682 - DNA, 25 bp, Artificial sequence
  Synthetic oligonucleotide
gaccaccatgccggcgaccaccacc

SEQ ID NO: 718683 - DNA, 25 bp, Artificial sequence
  Synthetic oligonucleotide
catgccggcgaccaccaccacggac

SEQ ID NO: 718684 - DNA, 25 bp, Artificial sequence
  Synthetic oligonucleotide
ggcgaccaccaccacggaccggcca

SEQ ID NO: 718685 - DNA, 25 bp, Artificial sequence
  Synthetic oligonucleotide
ccaccacggaccggccaagggcctg

SEQ ID NO: 718686 - DNA, 25 bp, Artificial sequence
  Synthetic oligonucleotide
cggaccggccaagggcctgatgcgc

SEQ ID NO: 718687 - DNA, 25 bp, Artificial sequence
  Synthetic oligonucleotide
acaacaataggagaccgccatgagt

SEQ ID NO: 718688 - DNA, 25 bp, Artificial sequence
  Synthetic oligonucleotide
cgcaggatcagatccacaaccggca

SEQ ID NO: 718689 - DNA, 25 bp, Artificial sequence
  Synthetic oligonucleotide
tggaagtggcagtacaagtacctgg

SEQ ID NO: 718690 - DNA, 25 bp, Artificial sequence
  Synthetic oligonucleotide
tggcagtacaagtacctgggccagg

SEQ ID NO: 718691 - DNA, 25 bp, Artificial sequence
  Synthetic oligonucleotide
tacaagtacctgggccaggacgtcg

SEQ ID NO: 718692 - DNA, 25 bp, Artificial sequence
  Synthetic oligonucleotide
tacctgggccaggacgtcgagtact

SEQ ID NO: 718693 - DNA, 25 bp, Artificial sequence
  Synthetic oligonucleotide
ggccaggacgtcgagtacttcagca

SEQ ID NO: 718694 - DNA, 25 bp, Artificial sequence
  Synthetic oligonucleotide
gacgtcgagtacttcagcaacctgg

SEQ ID NO: 718695 - DNA, 25 bp, Artificial sequence
  Synthetic oligonucleotide
gagtacttcagcaacctggccaccc

SEQ ID NO: 718696 - DNA, 25 bp, Artificial sequence
  Synthetic oligonucleotide
ttcagcaacctggccaccccgcagg

SEQ ID NO: 718697 - DNA, 25 bp, Artificial sequence
  Synthetic oligonucleotide
ctgaccagcaaggagtggaccaagg

SEQ ID NO: 718698 - DNA, 25 bp, Artificial sequence
  Synthetic oligonucleotide
gccaccccgcaggatcagatccaca

SEQ ID NO: 718699 - DNA, 25 bp, Artificial sequence
  Synthetic oligonucleotide
aggtcaccggctaccagtggaagtg

SEQ ID NO: 718700 - DNA, 25 bp, Artificial sequence
  Synthetic oligonucleotide
atcagatccacaaccggcaggcgaa

SEQ ID NO: 718701 - DNA, 25 bp, Artificial sequence
  Synthetic oligonucleotide
tccacaaccggcaggcgaaggacga

SEQ ID NO: 718702 - DNA, 25 bp, Artificial sequence
  Synthetic oligonucleotide
accggcaggcgaaggacgagcatta

SEQ ID NO: 718703 - DNA, 25 bp, Artificial sequence
  Synthetic oligonucleotide
aggcgaaggacgagcattacctgct

SEQ ID NO: 718704 - DNA, 25 bp, Artificial sequence
  Synthetic oligonucleotide
aggacgagcattacctgctggaggt

SEQ ID NO: 718705 - DNA, 25 bp, Artificial sequence
  Synthetic oligonucleotide
agcattacctgctggaggtggacga

SEQ ID NO: 718706 - DNA, 25 bp, Artificial sequence
  Synthetic oligonucleotide
acctgctggaggtggacgagccgct

SEQ ID NO: 718707 - DNA, 25 bp, Artificial sequence
  Synthetic oligonucleotide
tggaggtggacgagccgctggtgct

SEQ ID NO: 718708 - DNA, 25 bp, Artificial sequence
  Synthetic oligonucleotide
tggacgagccgctggtgctgccggt

SEQ ID NO: 718709 - DNA, 25 bp, Artificial sequence
  Synthetic oligonucleotide
aacctggccaccccgcaggatcaga

SEQ ID NO: 718710 - DNA, 25 bp, Artificial sequence
  Synthetic oligonucleotide
cacccgcaccctgatccacatctac

SEQ ID NO: 718711 - DNA, 25 bp, Artificial sequence
  Synthetic oligonucleotide
gcaccacggtggaaatcctctggac

SEQ ID NO: 718712 - DNA, 25 bp, Artificial sequence
  Synthetic oligonucleotide
cggtggaaatcctctggacggtggt

SEQ ID NO: 718713 - DNA, 25 bp, Artificial sequence
  Synthetic oligonucleotide
aaatcctctggacggtggtgccgtt

SEQ ID NO: 718714 - DNA, 25 bp, Artificial sequence
  Synthetic oligonucleotide
tctggacggtggtgccgttcgtgat

SEQ ID NO: 718715 - DNA, 25 bp, Artificial sequence
  Synthetic oligonucleotide
cggtggtgccgttcgtgatcctggt

SEQ ID NO: 718716 - DNA, 25 bp, Artificial sequence
  Synthetic oligonucleotide
tgccgttcgtgatcctggtggtgat

SEQ ID NO: 718717 - DNA, 25 bp, Artificial sequence
  Synthetic oligonucleotide
tcgtgatcctggtggtgatggcggt

SEQ ID NO: 718718 - DNA, 25 bp, Artificial sequence
  Synthetic oligonucleotide
tcctggtggtgatggcggtgcccgc

SEQ ID NO: 718719 - DNA, 25 bp, Artificial sequence
  Synthetic oligonucleotide
tggtgatggcggtgcccgccacccg

SEQ ID NO: 718720 - DNA, 25 bp, Artificial sequence
  Synthetic oligonucleotide
accagtggaagtggcagtacaagta

SEQ ID NO: 718721 - DNA, 25 bp, Artificial sequence
  Synthetic oligonucleotide
gcccgccacccgcaccctgatccac

SEQ ID NO: 718722 - DNA, 25 bp, Artificial sequence
  Synthetic oligonucleotide
ccggctaccagtggaagtggcagta

SEQ ID NO: 718723 - DNA, 25 bp, Artificial sequence
  Synthetic oligonucleotide
caccctgatccacatctacgacact

SEQ ID NO: 718724 - DNA, 25 bp, Artificial sequence
  Synthetic oligonucleotide
gatccacatctacgacacttccgag

SEQ ID NO: 718725 - DNA, 25 bp, Artificial sequence
  Synthetic oligonucleotide
catctacgacacttccgagccggag

SEQ ID NO: 718726 - DNA, 25 bp, Artificial sequence
  Synthetic oligonucleotide
acgacacttccgagccggagctgga

SEQ ID NO: 718727 - DNA, 25 bp, Artificial sequence
  Synthetic oligonucleotide
cttccgagccggagctggacgtgca

SEQ ID NO: 718728 - DNA, 25 bp, Artificial sequence
  Synthetic oligonucleotide
agccggagctggacgtgcaggtcac

SEQ ID NO: 718729 - DNA, 25 bp, Artificial sequence
  Synthetic oligonucleotide
agctggacgtgcaggtcaccggcta

SEQ ID NO: 718730 - DNA, 25 bp, Artificial sequence
  Synthetic oligonucleotide
acgtgcaggtcaccggctaccagtg

SEQ ID NO: 718731 - DNA, 25 bp, Artificial sequence
  Synthetic oligonucleotide
tgccggtgggcaccaaggtgcgctt

SEQ ID NO: 718732 - DNA, 25 bp, Artificial sequence
  Synthetic oligonucleotide
tggcggtgcccgccacccgcaccct

SEQ ID NO: 718733 - DNA, 25 bp, Artificial sequence
  Synthetic oligonucleotide
gtcgacgtcaagcccaaggccgagt

SEQ ID NO: 718734 - DNA, 25 bp, Artificial sequence
  Synthetic oligonucleotide
agccgctggtgctgccggtgggcac

SEQ ID NO: 718735 - DNA, 25 bp, Artificial sequence
  Synthetic oligonucleotide
tctatcgcggccagtgcgccgagct

SEQ ID NO: 718736 - DNA, 25 bp, Artificial sequence
  Synthetic oligonucleotide
cggccagtgcgccgagctgtgcggc

SEQ ID NO: 718737 - DNA, 25 bp, Artificial sequence
  Synthetic oligonucleotide
gtgcgccgagctgtgcggcaaggac

SEQ ID NO: 718738 - DNA, 25 bp, Artificial sequence
  Synthetic oligonucleotide
cgagctgtgcggcaaggaccacggc

SEQ ID NO: 718739 - DNA, 25 bp, Artificial sequence
  Synthetic oligonucleotide
tgtgcggcaaggaccacggcttcat

SEQ ID NO: 718740 - DNA, 25 bp, Artificial sequence
  Synthetic oligonucleotide
gcaaggaccacggcttcatgccgat

SEQ ID NO: 718741 - DNA, 25 bp, Artificial sequence
  Synthetic oligonucleotide
accacggcttcatgccgatcgtggt

SEQ ID NO: 718742 - DNA, 25 bp, Artificial sequence
  Synthetic oligonucleotide
gcttcatgccgatcgtggtcgacgt

SEQ ID NO: 718743 - DNA, 25 bp, Artificial sequence
  Synthetic oligonucleotide
acgagcccggcatctatcgcggcca

SEQ ID NO: 718744 - DNA, 25 bp, Artificial sequence
  Synthetic oligonucleotide
tcgtggtcgacgtcaagcccaaggc

SEQ ID NO: 718745 - DNA, 25 bp, Artificial sequence
  Synthetic oligonucleotide
aggtcgacgagcccggcatctatcg

SEQ ID NO: 718746 - DNA, 25 bp, Artificial sequence
  Synthetic oligonucleotide
gtcaagcccaaggccgagttcgacc

SEQ ID NO: 718747 - DNA, 25 bp, Artificial sequence
  Synthetic oligonucleotide
cccaaggccgagttcgaccagtggc

SEQ ID NO: 718748 - DNA, 25 bp, Artificial sequence
  Synthetic oligonucleotide
ccgagttcgaccagtggctggccaa

SEQ ID NO: 718749 - DNA, 25 bp, Artificial sequence
  Synthetic oligonucleotide
tcgaccagtggctggccaagcgcaa

SEQ ID NO: 718750 - DNA, 25 bp, Artificial sequence
  Synthetic oligonucleotide
agtggctggccaagcgcaaggaaga

SEQ ID NO: 718751 - DNA, 25 bp, Artificial sequence
  Synthetic oligonucleotide
tggccaagcgcaaggaagaggcggc

SEQ ID NO: 718752 - DNA, 25 bp, Artificial sequence
  Synthetic oligonucleotide
agcgcaaggaagaggcggcgaaggt

SEQ ID NO: 718753 - DNA, 25 bp, Artificial sequence
  Synthetic oligonucleotide
ggaagaggcggcgaaggtcaaggaa

SEQ ID NO: 718754 - DNA, 25 bp, Artificial sequence
  Synthetic oligonucleotide
gcggcgaaggtcaaggaactgacca

SEQ ID NO: 718755 - DNA, 25 bp, Artificial sequence
  Synthetic oligonucleotide
tgccgatcgtggtcgacgtcaagcc

SEQ ID NO: 718756 - DNA, 25 bp, Artificial sequence
  Synthetic oligonucleotide
gccggccttcgcggtcaagcgcgac

SEQ ID NO: 718757 - DNA, 25 bp, Artificial sequence
  Synthetic oligonucleotide
ccggcctgcagatcgtcgagccggc

SEQ ID NO: 718758 - DNA, 25 bp, Artificial sequence
  Synthetic oligonucleotide
tgggcaccaaggtgcgcttcctgat

SEQ ID NO: 718759 - DNA, 25 bp, Artificial sequence
  Synthetic oligonucleotide
accaaggtgcgcttcctgatcacct

SEQ ID NO: 718760 - DNA, 25 bp, Artificial sequence
  Synthetic oligonucleotide
gtgcgcttcctgatcacctccagcg

SEQ ID NO: 718761 - DNA, 25 bp, Artificial sequence
  Synthetic oligonucleotide
ttcctgatcacctccagcgacgtga

SEQ ID NO: 718762 - DNA, 25 bp, Artificial sequence
  Synthetic oligonucleotide
atcacctccagcgacgtgatccatt

SEQ ID NO: 718763 - DNA, 25 bp, Artificial sequence
  Synthetic oligonucleotide
tccagcgacgtgatccattcctggt

SEQ ID NO: 718764 - DNA, 25 bp, Artificial sequence
  Synthetic oligonucleotide
gacgtgatccattcctggtgggtgc

SEQ ID NO: 718765 - DNA, 25 bp, Artificial sequence
  Synthetic oligonucleotide
atccattcctggtgggtgccggcct

SEQ ID NO: 718766 - DNA, 25 bp, Artificial sequence
  Synthetic oligonucleotide
ccggcatctatcgcggccagtgcgc

SEQ ID NO: 718767 - DNA, 25 bp, Artificial sequence
  Synthetic oligonucleotide
gtgggtgccggccttcgcggtcaag

SEQ ID NO: 718768 - DNA, 25 bp, Artificial sequence
  Synthetic oligonucleotide
tggtgctgccggtgggcaccaaggt

SEQ ID NO: 718769 - DNA, 25 bp, Artificial sequence
  Synthetic oligonucleotide
cttcgcggtcaagcgcgacgccatc

SEQ ID NO: 718770 - DNA, 25 bp, Artificial sequence
  Synthetic oligonucleotide
ggtcaagcgcgacgccatccccggc

SEQ ID NO: 718771 - DNA, 25 bp, Artificial sequence
  Synthetic oligonucleotide
gcgcgacgccatccccggcttcgtc

SEQ ID NO: 718772 - DNA, 25 bp, Artificial sequence
  Synthetic oligonucleotide
cgccatccccggcttcgtcaacgag

SEQ ID NO: 718773 - DNA, 25 bp, Artificial sequence
  Synthetic oligonucleotide
cccggcttcgtcaacgaggcctgga

SEQ ID NO: 718774 - DNA, 25 bp, Artificial sequence
  Synthetic oligonucleotide
cttcgtcaacgaggcctggaccaag

SEQ ID NO: 718775 - DNA, 25 bp, Artificial sequence
  Synthetic oligonucleotide
caacgaggcctggaccaaggtcgac

SEQ ID NO: 718776 - DNA, 25 bp, Artificial sequence
  Synthetic oligonucleotide
aggcctggaccaaggtcgacgagcc

SEQ ID NO: 718777 - DNA, 25 bp, Artificial sequence
  Synthetic oligonucleotide
ggaccaaggtcgacgagcccggcat

SEQ ID NO: 718778 - DNA, 25 bp, Artificial sequence
  Synthetic oligonucleotide
ttcctggtgggtgccggccttcgcg

SEQ ID NO: 718779 - DNA, 25 bp, Artificial sequence
  Synthetic oligonucleotide
aggagtacgtgcacgcctacaacga

SEQ ID NO: 718780 - DNA, 25 bp, Artificial sequence
  Synthetic oligonucleotide
agcgcggcccgctcaaggcctggct

SEQ ID NO: 718781 - DNA, 25 bp, Artificial sequence
  Synthetic oligonucleotide
atgctcaccggcttccacggcgccc

SEQ ID NO: 718782 - DNA, 25 bp, Artificial sequence
  Synthetic oligonucleotide
ttcttcatgctcaccggcttccacg

SEQ ID NO: 718783 - DNA, 25 bp, Artificial sequence
  Synthetic oligonucleotide
tcgaccttcttcatgctcaccggct

SEQ ID NO: 718784 - DNA, 25 bp, Artificial sequence
  Synthetic oligonucleotide
tacggctcgaccttcttcatgctca

SEQ ID NO: 718785 - DNA, 25 bp, Artificial sequence
  Synthetic oligonucleotide
gcatctacggctcgaccttcttcat

SEQ ID NO: 718786 - DNA, 25 bp, Artificial sequence
  Synthetic oligonucleotide
cgccggcatctacggctcgaccttc

SEQ ID NO: 718787 - DNA, 25 bp, Artificial sequence
  Synthetic oligonucleotide
cctcggcgccggcatctacggctcg

SEQ ID NO: 718788 - DNA, 25 bp, Artificial sequence
  Synthetic oligonucleotide
gcctgaccctcggcgccggcatcta

SEQ ID NO: 718789 - DNA, 25 bp, Artificial sequence
  Synthetic oligonucleotide
agctgggcctgaccctcggcgccgg

SEQ ID NO: 718790 - DNA, 25 bp, Artificial sequence
  Synthetic oligonucleotide
acaacgagctgggcctgaccctcgg

SEQ ID NO: 718791 - DNA, 25 bp, Artificial sequence
  Synthetic oligonucleotide
ttccacggcgcccacgtgaccctcg

SEQ ID NO: 718792 - DNA, 25 bp, Artificial sequence
  Synthetic oligonucleotide
acgtgcacgcctacaacgagctggg

SEQ ID NO: 718793 - DNA, 25 bp, Artificial sequence
  Synthetic oligonucleotide
ggcgcccacgtgaccctcggcgcgc

SEQ ID NO: 718794 - DNA, 25 bp, Artificial sequence
  Synthetic oligonucleotide
aggccgaggagtacgtgcacgccta

SEQ ID NO: 718795 - DNA, 25 bp, Artificial sequence
  Synthetic oligonucleotide
tcctgcaggccgaggagtacgtgca

SEQ ID NO: 718796 - DNA, 25 bp, Artificial sequence
  Synthetic oligonucleotide
tcctgatcctgcaggccgaggagta

SEQ ID NO: 718797 - DNA, 25 bp, Artificial sequence
  Synthetic oligonucleotide
tcgccttcctgatcctgcaggccga

SEQ ID NO: 718798 - DNA, 25 bp, Artificial sequence
  Synthetic oligonucleotide
tggggatcgccttcctgatcctgca

SEQ ID NO: 718799 - DNA, 25 bp, Artificial sequence
  Synthetic oligonucleotide
tgctgctggggatcgccttcctgat

SEQ ID NO: 718800 - DNA, 25 bp, Artificial sequence
  Synthetic oligonucleotide
tgaccgtgctgctggggatcgcctt

SEQ ID NO: 718801 - DNA, 25 bp, Artificial sequence
  Synthetic oligonucleotide
tggcgctgaccgtgctgctggggat

SEQ ID NO: 718802 - DNA, 25 bp, Artificial sequence
  Synthetic oligonucleotide
cctggctggcgctgaccgtgctgct

SEQ ID NO: 718803 - DNA, 25 bp, Artificial sequence
  Synthetic oligonucleotide
tcaaggcctggctggcgctgaccgt

SEQ ID NO: 718804 - DNA, 25 bp, Artificial sequence
  Synthetic oligonucleotide
cccgctcaaggcctggctggcgctg

SEQ ID NO: 718805 - DNA, 25 bp, Artificial sequence
  Synthetic oligonucleotide
acgcctacaacgagctgggcctgac

SEQ ID NO: 718806 - DNA, 25 bp, Artificial sequence
  Synthetic oligonucleotide
ttcggcttcgaggccgccagttggt

SEQ ID NO: 718807 - DNA, 25 bp, Artificial sequence
  Synthetic oligonucleotide
gagagtcgcgccggactctacagcg

SEQ ID NO: 718808 - DNA, 25 bp, Artificial sequence
  Synthetic oligonucleotide
gtgatctgaccgccaccgggggaat

SEQ ID NO: 718809 - DNA, 25 bp, Artificial sequence
  Synthetic oligonucleotide
gtctacgtgatctgaccgccaccgg

SEQ ID NO: 718810 - DNA, 25 bp, Artificial sequence
  Synthetic oligonucleotide
catcttcgtctacgtgatctgaccg

SEQ ID NO: 718811 - DNA, 25 bp, Artificial sequence
  Synthetic oligonucleotide
gcctgttcatcttcgtctacgtgat

SEQ ID NO: 718812 - DNA, 25 bp, Artificial sequence
  Synthetic oligonucleotide
ggatcggcctgttcatcttcgtcta

SEQ ID NO: 718813 - DNA, 25 bp, Artificial sequence
  Synthetic oligonucleotide
tggtctggatcggcctgttcatctt

SEQ ID NO: 718814 - DNA, 25 bp, Artificial sequence
  Synthetic oligonucleotide
tcgacgtggtctggatcggcctgtt

SEQ ID NO: 718815 - DNA, 25 bp, Artificial sequence
  Synthetic oligonucleotide
cacttcgtcgacgtggtctggatcg

SEQ ID NO: 718816 - DNA, 25 bp, Artificial sequence
  Synthetic oligonucleotide
tactggcacttcgtcgacgtggtct

SEQ ID NO: 718817 - DNA, 25 bp, Artificial sequence
  Synthetic oligonucleotide
agttggtactggcacttcgtcgacg

SEQ ID NO: 718818 - DNA, 25 bp, Artificial sequence
  Synthetic oligonucleotide
accggcttccacggcgcccacgtga

SEQ ID NO: 718819 - DNA, 25 bp, Artificial sequence
  Synthetic oligonucleotide
ttcgaggccgccagttggtactggc

SEQ ID NO: 718820 - DNA, 25 bp, Artificial sequence
  Synthetic oligonucleotide
tgatccgcatcctgcgcggtcactt

SEQ ID NO: 718821 - DNA, 25 bp, Artificial sequence
  Synthetic oligonucleotide
caccacttcggcttcgaggccgcca

SEQ ID NO: 718822 - DNA, 25 bp, Artificial sequence
  Synthetic oligonucleotide
gccgagcaccacttcggcttcgagg

SEQ ID NO: 718823 - DNA, 25 bp, Artificial sequence
  Synthetic oligonucleotide
tcgatgccgagcaccacttcggctt

SEQ ID NO: 718824 - DNA, 25 bp, Artificial sequence
  Synthetic oligonucleotide
gtcacttcgatgccgagcaccactt

SEQ ID NO: 718825 - DNA, 25 bp, Artificial sequence
  Synthetic oligonucleotide
gcatcctgcgcggtcacttcgatgc

SEQ ID NO: 718826 - DNA, 25 bp, Artificial sequence
  Synthetic oligonucleotide
catgctgatccgcatcctgcgcggt

SEQ ID NO: 718827 - DNA, 25 bp, Artificial sequence
  Synthetic oligonucleotide
tcggcatcatgctgatccgcatcct

SEQ ID NO: 718828 - DNA, 25 bp, Artificial sequence
  Synthetic oligonucleotide
ctgatcctcggcatcatgctgatcc

SEQ ID NO: 718829 - DNA, 25 bp, Artificial sequence
  Synthetic oligonucleotide
ggcgcgctgatcctcggcatcatgc

SEQ ID NO: 718830 - DNA, 25 bp, Artificial sequence
  Synthetic oligonucleotide
accctcggcgcgctgatcctcggca

SEQ ID NO: 718831 - DNA, 25 bp, Artificial sequence
  Synthetic oligonucleotide
cacgtgaccctcggcgcgctgatcc

SEQ ID NO: 718832 - DNA, 25 bp, Artificial sequence
  Synthetic oligonucleotide
gccgccagttggtactggcacttcg

SEQ ID NO: 718833 - DNA, 25 bp, Artificial sequence
  Synthetic oligonucleotide
tgatgttcttcgccgccttcttcgg

SEQ ID NO: 718834 - DNA, 25 bp, Artificial sequence
  Synthetic oligonucleotide
gtggcgcacatgctctggccgaact

SEQ ID NO: 718835 - DNA, 25 bp, Artificial sequence
  Synthetic oligonucleotide
aagggcgtggcgcacatgctctggc

SEQ ID NO: 718836 - DNA, 25 bp, Artificial sequence
  Synthetic oligonucleotide
ggtgccaagggcgtggcgcacatgc

SEQ ID NO: 718837 - DNA, 25 bp, Artificial sequence
  Synthetic oligonucleotide
cggcgagggtgccaagggcgtggcg

SEQ ID NO: 718838 - DNA, 25 bp, Artificial sequence
  Synthetic oligonucleotide
ggctcggcggcgagggtgccaaggg

SEQ ID NO: 718839 - DNA, 25 bp, Artificial sequence
  Synthetic oligonucleotide
gtccctggctcggcggcgagggtgc

SEQ ID NO: 718840 - DNA, 25 bp, Artificial sequence
  Synthetic oligonucleotide
tcgccggtccctggctcggcggcga

SEQ ID NO: 718841 - DNA, 25 bp, Artificial sequence
  Synthetic oligonucleotide
gccacttcgccggtccctggctcgg

SEQ ID NO: 718842 - DNA, 25 bp, Artificial sequence
  Synthetic oligonucleotide
acgtccgccacttcgccggtccctg

SEQ ID NO: 718843 - DNA, 25 bp, Artificial sequence
  Synthetic oligonucleotide
tgttctacgtccgccacttcgccgg

SEQ ID NO: 718844 - DNA, 25 bp, Artificial sequence
  Synthetic oligonucleotide
gcgcgctgttctacgtccgccactt

SEQ ID NO: 718845 - DNA, 25 bp, Artificial sequence
  Synthetic oligonucleotide
cacatgctctggccgaacttccagt

SEQ ID NO: 718846 - DNA, 25 bp, Artificial sequence
  Synthetic oligonucleotide
ccgccttcttcggcgcgctgttcta

SEQ ID NO: 718847 - DNA, 25 bp, Artificial sequence
  Synthetic oligonucleotide
tcttcgccgccttcttcggcgcgct

SEQ ID NO: 718848 - DNA, 25 bp, Artificial sequence
  Synthetic oligonucleotide
tcttctccgaggtgatgttcttcgc

SEQ ID NO: 718849 - DNA, 25 bp, Artificial sequence
  Synthetic oligonucleotide
ggttcatcttctccgaggtgatgtt

SEQ ID NO: 718850 - DNA, 25 bp, Artificial sequence
  Synthetic oligonucleotide
gagctggttcatcttctccgaggtg

SEQ ID NO: 718851 - DNA, 25 bp, Artificial sequence
  Synthetic oligonucleotide
gggcatgagctggttcatcttctcc

SEQ ID NO: 718852 - DNA, 25 bp, Artificial sequence
  Synthetic oligonucleotide
ccgctggggcatgagctggttcatc

SEQ ID NO: 718853 - DNA, 25 bp, Artificial sequence
  Synthetic oligonucleotide
ctcgttccgctggggcatgagctgg

SEQ ID NO: 718854 - DNA, 25 bp, Artificial sequence
  Synthetic oligonucleotide
ggaccgctcgttccgctggggcatg

SEQ ID NO: 718855 - DNA, 25 bp, Artificial sequence
  Synthetic oligonucleotide
gcagatggaccgctcgttccgctgg

SEQ ID NO: 718856 - DNA, 25 bp, Artificial sequence
  Synthetic oligonucleotide
aagaacaagcgcggcccgctcaagg

SEQ ID NO: 718857 - DNA, 25 bp, Artificial sequence
  Synthetic oligonucleotide
tgcgcggtcacttcgatgccgagca

SEQ ID NO: 718858 - DNA, 25 bp, Artificial sequence
  Synthetic oligonucleotide
acagcgcgcagatggaccgctcgtt

SEQ ID NO: 718859 - DNA, 25 bp, Artificial sequence
  Synthetic oligonucleotide
tcttcggcgcgctgttctacgtccg

SEQ ID NO: 718860 - DNA, 25 bp, Artificial sequence
  Synthetic oligonucleotide
acaccatcctgctggtcacctccag

SEQ ID NO: 718861 - DNA, 25 bp, Artificial sequence
  Synthetic oligonucleotide
tgaagaagaacaagcgcggcccgct

SEQ ID NO: 718862 - DNA, 25 bp, Artificial sequence
  Synthetic oligonucleotide
acgccctgaagaagaacaagcgcgg

SEQ ID NO: 718863 - DNA, 25 bp, Artificial sequence
  Synthetic oligonucleotide
cccaccacgccctgaagaagaacaa

SEQ ID NO: 718864 - DNA, 25 bp, Artificial sequence
  Synthetic oligonucleotide
ccgaggtgatgttcttcgccgcctt

SEQ ID NO: 718865 - DNA, 25 bp, Artificial sequence
  Synthetic oligonucleotide
ctctggccgaacttccagtacagct

SEQ ID NO: 718866 - DNA, 25 bp, Artificial sequence
  Synthetic oligonucleotide
ccttcgcccaccacgccctgaagaa

SEQ ID NO: 718867 - DNA, 25 bp, Artificial sequence
  Synthetic oligonucleotide
ccgtgaccttcgcccaccacgccct

SEQ ID NO: 718868 - DNA, 25 bp, Artificial sequence
  Synthetic oligonucleotide
gcttcaccgtgaccttcgcccacca

SEQ ID NO: 718869 - DNA, 25 bp, Artificial sequence
  Synthetic oligonucleotide
cctccagcttcaccgtgaccttcgc

SEQ ID NO: 718870 - DNA, 25 bp, Artificial sequence
  Synthetic oligonucleotide
tcctgctggtcacctccagcttcac

SEQ ID NO: 718871 - DNA, 25 bp, Artificial sequence
  Synthetic oligonucleotide
tgatcaacaccatcctgctggtcac

SEQ ID NO: 718872 - DNA, 25 bp, Artificial sequence
  Synthetic oligonucleotide
tgccgctgatcaacaccatcctgct

SEQ ID NO: 718873 - DNA, 25 bp, Artificial sequence
  Synthetic oligonucleotide
ggaagctgccgctgatcaacaccat

SEQ ID NO: 718874 - DNA, 25 bp, Artificial sequence
  Synthetic oligonucleotide
agccgtggaagctgccgctgatcaa

SEQ ID NO: 718875 - DNA, 25 bp, Artificial sequence
  Synthetic oligonucleotide
aagctgttcccgccgccgagcgcgg

SEQ ID NO: 718876 - DNA, 25 bp, Artificial sequence
  Synthetic oligonucleotide
gcgcggtgatcgagccgtggaagct

SEQ ID NO: 718877 - DNA, 25 bp, Artificial sequence
  Synthetic oligonucleotide
tggccgctgctgcagaccccggacc

SEQ ID NO: 718878 - DNA, 25 bp, Artificial sequence
  Synthetic oligonucleotide
cgccgagcgcggtgatcgagccgtg

SEQ ID NO: 718879 - DNA, 25 bp, Artificial sequence
  Synthetic oligonucleotide
tggtcacctccagcttcaccgtgac

SEQ ID NO: 718880 - DNA, 25 bp, Artificial sequence
  Synthetic oligonucleotide
ttcccgccgccgagcgcggtgatcg

SEQ ID NO: 718881 - DNA, 25 bp, Artificial sequence
  Synthetic oligonucleotide
cgaacttccagtacagctggccgct

SEQ ID NO: 718882 - DNA, 25 bp, Artificial sequence
  Synthetic oligonucleotide
ctgctgcagaccccggacccgaagc

SEQ ID NO: 718883 - DNA, 25 bp, Artificial sequence
  Synthetic oligonucleotide
tgatcgagccgtggaagctgccgct

SEQ ID NO: 718884 - DNA, 25 bp, Artificial sequence
  Synthetic oligonucleotide
tacagctggccgctgctgcagaccc

SEQ ID NO: 718885 - DNA, 25 bp, Artificial sequence
  Synthetic oligonucleotide
gacccgaagctgttcccgccgccga

SEQ ID NO: 718886 - DNA, 25 bp, Artificial sequence
  Synthetic oligonucleotide
gcagaccccggacccgaagctgttc

SEQ ID NO: 718887 - DNA, 25 bp, Artificial sequence
  Synthetic oligonucleotide
ttccagtacagctggccgctgctgc

SEQ ID NO: 718888 - DNA, 25 bp, Artificial sequence
  Synthetic oligonucleotide
tttcagccggtttccagtgtccgga

SEQ ID NO: 718889 - DNA, 25 bp, Artificial sequence
  Synthetic oligonucleotide
agtgtccggaaatacactggcaaga

SEQ ID NO: 718890 - DNA, 25 bp, Artificial sequence
  Synthetic oligonucleotide
cggaaatacactggcaagacttccc

SEQ ID NO: 718891 - DNA, 25 bp, Artificial sequence
  Synthetic oligonucleotide
tacactggcaagacttcccgacgcc

SEQ ID NO: 718892 - DNA, 25 bp, Artificial sequence
  Synthetic oligonucleotide
tggcaagacttcccgacgccgaact

SEQ ID NO: 718893 - DNA, 25 bp, Artificial sequence
  Synthetic oligonucleotide
gtttccagtgtccggaaatacactg

SEQ ID NO: 718894 - DNA, 25 bp, Artificial sequence
  Synthetic oligonucleotide
gactgcgtttcagccggtttccagt

SEQ ID NO: 718895 - DNA, 25 bp, Artificial sequence
  Synthetic oligonucleotide
gagtccgactgcgtttcagccggtt

SEQ ID NO: 718896 - DNA, 25 bp, Artificial sequence
  Synthetic oligonucleotide
ctttcaatagaagagtccgactgcg

SEQ ID NO: 718897 - DNA, 25 bp, Artificial sequence
  Synthetic oligonucleotide
aagagactttcaatagaagagtccg

SEQ ID NO: 718898 - DNA, 25 bp, Artificial sequence
  Synthetic oligonucleotide
gaaagcctaaagcccgatgagtcga

SEQ ID NO: 718899 - DNA, 25 bp, Artificial sequence
  Synthetic oligonucleotide
acttcccgacgccgaactttgattg

SEQ ID NO: 718900 - DNA, 25 bp, Artificial sequence
  Synthetic oligonucleotide
ctaaagcccgatgagtcgaagagac

SEQ ID NO: 718901 - DNA, 25 bp, Artificial sequence
  Synthetic oligonucleotide
ccccatgggagcgatcgcccgcgcg

SEQ ID NO: 718902 - DNA, 25 bp, Artificial sequence
  Synthetic oligonucleotide
gagtcgaagagactttcaatagaag

SEQ ID NO: 718903 - DNA, 25 bp, Artificial sequence
  Synthetic oligonucleotide
cccgatgagtcgaagagactttcaa

SEQ ID NO: 718904 - DNA, 25 bp, Artificial sequence
  Synthetic oligonucleotide
atagaagagtccgactgcgtttcag

SEQ ID NO: 718905 - DNA, 25 bp, Artificial sequence
  Synthetic oligonucleotide
tttcgggttgcgcccggctgggcgc

SEQ ID NO: 718906 - DNA, 25 bp, Artificial sequence
  Synthetic oligonucleotide
acgccagcagaagcgtcgccgggaa

SEQ ID NO: 718907 - DNA, 25 bp, Artificial sequence
  Synthetic oligonucleotide
gcgcgacgccagcagaagcgtcgcc

SEQ ID NO: 718908 - DNA, 25 bp, Artificial sequence
  Synthetic oligonucleotide
atgatatgcggcgttttttttgcct

SEQ ID NO: 718909 - DNA, 25 bp, Artificial sequence
  Synthetic oligonucleotide
gacgtggaaagcctaaagcccgatg

SEQ ID NO: 718910 - DNA, 25 bp, Artificial sequence
  Synthetic oligonucleotide
atcgcccgcgcgacgccagcagaag

SEQ ID NO: 718911 - DNA, 25 bp, Artificial sequence
  Synthetic oligonucleotide
ggagcgatcgcccgcgcgacgccag

SEQ ID NO: 718912 - DNA, 25 bp, Artificial sequence
  Synthetic oligonucleotide
ccggctgggcgccccatgggagcga

SEQ ID NO: 718913 - DNA, 25 bp, Artificial sequence
  Synthetic oligonucleotide
gttgcgcccggctgggcgccccatg

SEQ ID NO: 718914 - DNA, 25 bp, Artificial sequence
  Synthetic oligonucleotide
cgacgccgaactttgattgctccta

SEQ ID NO: 718915 - DNA, 25 bp, Artificial sequence
  Synthetic oligonucleotide
ccgctgataccagcggccttttttt

SEQ ID NO: 718916 - DNA, 25 bp, Artificial sequence
  Synthetic oligonucleotide
tcaaggccgctgataccagcggcct

SEQ ID NO: 718917 - DNA, 25 bp, Artificial sequence
  Synthetic oligonucleotide
gtcttctcaaggccgctgataccag

SEQ ID NO: 718918 - DNA, 25 bp, Artificial sequence
  Synthetic oligonucleotide
attcgacgtcttctcaaggccgctg

SEQ ID NO: 718919 - DNA, 25 bp, Artificial sequence
  Synthetic oligonucleotide
gctcctattcgacgtcttctcaagg

SEQ ID NO: 718920 - DNA, 25 bp, Artificial sequence
  Synthetic oligonucleotide
ttgattgctcctattcgacgtcttc

SEQ ID NO: 718921 - DNA, 25 bp, Artificial sequence
  Synthetic oligonucleotide
cgaactttgattgctcctattcgac

SEQ ID NO: 718922 - DNA, 25 bp, Artificial sequence
  Synthetic oligonucleotide
tgggcgccccatgggagcgatcgcc

SEQ ID NO: 718923 - DNA, 25 bp, Artificial sequence
  Synthetic oligonucleotide
cttgcgccgcatatgatatgcggcg

SEQ ID NO: 718924 - DNA, 25 bp, Artificial sequence
  Synthetic oligonucleotide
gaatatgtaaaagactttcgttgga

SEQ ID NO: 718925 - DNA, 25 bp, Artificial sequence
  Synthetic oligonucleotide
cttgcagaatatgtaaaagactttc

SEQ ID NO: 718926 - DNA, 25 bp, Artificial sequence
  Synthetic oligonucleotide
acaattcttgcagaatatgtaaaag

SEQ ID NO: 718927 - DNA, 25 bp, Artificial sequence
  Synthetic oligonucleotide
gctcggacaattcttgcagaatatg

SEQ ID NO: 718928 - DNA, 25 bp, Artificial sequence
  Synthetic oligonucleotide
ctgaccgctcggacaattcttgcag

SEQ ID NO: 718929 - DNA, 25 bp, Artificial sequence
  Synthetic oligonucleotide
tgccttcctgaccgctcggacaatt

SEQ ID NO: 718930 - DNA, 25 bp, Artificial sequence
  Synthetic oligonucleotide
ttttttgccttcctgaccgctcgga

SEQ ID NO: 718931 - DNA, 25 bp, Artificial sequence
  Synthetic oligonucleotide
ccgcatatgatatgcggcgtttttt

SEQ ID NO: 718932 - DNA, 25 bp, Artificial sequence
  Synthetic oligonucleotide
tttccgatagtggcaaaaaaatata

SEQ ID NO: 718933 - DNA, 25 bp, Artificial sequence
  Synthetic oligonucleotide
cctgtccttgcgccgcatatgatat

SEQ ID NO: 718934 - DNA, 25 bp, Artificial sequence
  Synthetic oligonucleotide
tgggtaccctgtccttgcgccgcat

SEQ ID NO: 718935 - DNA, 25 bp, Artificial sequence
  Synthetic oligonucleotide
tgagcctgggtaccctgtccttgcg

SEQ ID NO: 718936 - DNA, 25 bp, Artificial sequence
  Synthetic oligonucleotide
gaagcgtgagcctgggtaccctgtc

SEQ ID NO: 718937 - DNA, 25 bp, Artificial sequence
  Synthetic oligonucleotide
actcgggaagcgtgagcctgggtac

SEQ ID NO: 718938 - DNA, 25 bp, Artificial sequence
  Synthetic oligonucleotide
agcagaagcgtcgccgggaacgaca

SEQ ID NO: 718939 - DNA, 25 bp, Artificial sequence
  Synthetic oligonucleotide
tgctcgggctgaagctcgacggcgg

SEQ ID NO: 718940 - DNA, 25 bp, Artificial sequence
  Synthetic oligonucleotide
atgcggcgttttttttgccttcctg

SEQ ID NO: 718941 - DNA, 25 bp, Artificial sequence
  Synthetic oligonucleotide
gataattgtcgctggctgtcgacga

SEQ ID NO: 718942 - DNA, 25 bp, Artificial sequence
  Synthetic oligonucleotide
tgcaagagcgggacgtggaaagcct

SEQ ID NO: 718943 - DNA, 25 bp, Artificial sequence
  Synthetic oligonucleotide
tcgccatgcaagagcgggacgtgga

SEQ ID NO: 718944 - DNA, 25 bp, Artificial sequence
  Synthetic oligonucleotide
tcgatctcgccatgcaagagcggga

SEQ ID NO: 718945 - DNA, 25 bp, Artificial sequence
  Synthetic oligonucleotide
tcttcatcgatctcgccatgcaaga

SEQ ID NO: 718946 - DNA, 25 bp, Artificial sequence
  Synthetic oligonucleotide
gttctgtcttcatcgatctcgccat

SEQ ID NO: 718947 - DNA, 25 bp, Artificial sequence
  Synthetic oligonucleotide
atattcgttctgtcttcatcgatct

SEQ ID NO: 718948 - DNA, 25 bp, Artificial sequence
  Synthetic oligonucleotide
tcgacgatattcgttctgtcttcat

SEQ ID NO: 718949 - DNA, 25 bp, Artificial sequence
  Synthetic oligonucleotide
tgtaaaagactttcgttggatatcg

SEQ ID NO: 718950 - DNA, 25 bp, Artificial sequence
  Synthetic oligonucleotide
tgtcgctggctgtcgacgatattcg

SEQ ID NO: 718951 - DNA, 25 bp, Artificial sequence
  Synthetic oligonucleotide
tggatatcgggtttttccgatagtg

SEQ ID NO: 718952 - DNA, 25 bp, Artificial sequence
  Synthetic oligonucleotide
tcaatggataattgtcgctggctgt

SEQ ID NO: 718953 - DNA, 25 bp, Artificial sequence
  Synthetic oligonucleotide
gccagctcaatggataattgtcgct

SEQ ID NO: 718954 - DNA, 25 bp, Artificial sequence
  Synthetic oligonucleotide
aatcgcgccagctcaatggataatt

SEQ ID NO: 718955 - DNA, 25 bp, Artificial sequence
  Synthetic oligonucleotide
aaatataatcgcgccagctcaatgg

SEQ ID NO: 718956 - DNA, 25 bp, Artificial sequence
  Synthetic oligonucleotide
gcaaaaaaatataatcgcgccagct

SEQ ID NO: 718957 - DNA, 25 bp, Artificial sequence
  Synthetic oligonucleotide
atagtggcaaaaaaatataatcgcg

SEQ ID NO: 718958 - DNA, 25 bp, Artificial sequence
  Synthetic oligonucleotide
gagcgggacgtggaaagcctaaagc

SEQ ID NO: 718959 - DNA, 25 bp, Artificial sequence
  Synthetic oligonucleotide
tggctgtcgacgatattcgttctgt

SEQ ID NO: 718960 - DNA, 25 bp, Artificial sequence
  Synthetic oligonucleotide
ttcagtccggctacacgcccggcgt

SEQ ID NO: 718961 - DNA, 25 bp, Artificial sequence
  Synthetic oligonucleotide
acgcctacggcatgctcgggctgaa

SEQ ID NO: 718962 - DNA, 25 bp, Artificial sequence
  Synthetic oligonucleotide
ccgggtactcgggaagcgtgagcct

SEQ ID NO: 718963 - DNA, 25 bp, Artificial sequence
  Synthetic oligonucleotide
gcgtcgacgcctacggcatgctcgg

SEQ ID NO: 718964 - DNA, 25 bp, Artificial sequence
  Synthetic oligonucleotide
gcttcggcgtcgacgcctacggcat

SEQ ID NO: 718965 - DNA, 25 bp, Artificial sequence
  Synthetic oligonucleotide
tggtcggcttcggcgtcgacgccta

SEQ ID NO: 718966 - DNA, 25 bp, Artificial sequence
  Synthetic oligonucleotide
cggcgtggtcggcttcggcgtcgac

SEQ ID NO: 718967 - DNA, 25 bp, Artificial sequence
  Synthetic oligonucleotide
tgtgcacagtgaaggattgttgtta

SEQ ID NO: 718968 - DNA, 25 bp, Artificial sequence
  Synthetic oligonucleotide
ccggctacacgcccggcgtggtcgg

SEQ ID NO: 718969 - DNA, 25 bp, Artificial sequence
  Synthetic oligonucleotide
ggctgaagctcgacggcggcggcgg

SEQ ID NO: 718970 - DNA, 25 bp, Artificial sequence
  Synthetic oligonucleotide
ccacctttcagtccggctacacgcc

SEQ ID NO: 718971 - DNA, 25 bp, Artificial sequence
  Synthetic oligonucleotide
catcgccacctttcagtccggctac

SEQ ID NO: 718972 - DNA, 25 bp, Artificial sequence
  Synthetic oligonucleotide
aggcttcatcgccacctttcagtcc

SEQ ID NO: 718973 - DNA, 25 bp, Artificial sequence
  Synthetic oligonucleotide
ggcgcaaggcttcatcgccaccttt

SEQ ID NO: 718974 - DNA, 25 bp, Artificial sequence
  Synthetic oligonucleotide
ggaatgggcgcaaggcttcatcgcc

SEQ ID NO: 718975 - DNA, 25 bp, Artificial sequence
  Synthetic oligonucleotide
cagcaaggaatgggcgcaaggcttc

SEQ ID NO: 718976 - DNA, 25 bp, Artificial sequence
  Synthetic oligonucleotide
gcacgacagcaaggaatgggcgcaa

SEQ ID NO: 718977 - DNA, 25 bp, Artificial sequence
  Synthetic oligonucleotide
acacgcccggcgtggtcggcttcgg

SEQ ID NO: 718978 - DNA, 25 bp, Artificial sequence
  Synthetic oligonucleotide
gatcacctcgccgagcaaggaaggc

SEQ ID NO: 718979 - DNA, 25 bp, Artificial sequence
  Synthetic oligonucleotide
gagttctccagtggcggggcggcgc

SEQ ID NO: 718980 - DNA, 25 bp, Artificial sequence
  Synthetic oligonucleotide
gcccgatgagttctccagtggcggg

SEQ ID NO: 718981 - DNA, 25 bp, Artificial sequence
  Synthetic oligonucleotide
aaggcgcccgatgagttctccagtg

SEQ ID NO: 718982 - DNA, 25 bp, Artificial sequence
  Synthetic oligonucleotide
tccggcaaggcgcccgatgagttct

SEQ ID NO: 718983 - DNA, 25 bp, Artificial sequence
  Synthetic oligonucleotide
ctacgaatccggcaaggcgcccgat

SEQ ID NO: 718984 - DNA, 25 bp, Artificial sequence
  Synthetic oligonucleotide
aggaaggctacgaatccggcaaggc

SEQ ID NO: 718985 - DNA, 25 bp, Artificial sequence
  Synthetic oligonucleotide
acggcatgctcgggctgaagctcga

SEQ ID NO: 718986 - DNA, 25 bp, Artificial sequence
  Synthetic oligonucleotide
ctcgccgagcaaggaaggctacgaa

SEQ ID NO: 718987 - DNA, 25 bp, Artificial sequence
  Synthetic oligonucleotide
accgccggcacgcttccgggcacga

SEQ ID NO: 718988 - DNA, 25 bp, Artificial sequence
  Synthetic oligonucleotide
cctgccgatcacctcgccgagcaag

SEQ ID NO: 718989 - DNA, 25 bp, Artificial sequence
  Synthetic oligonucleotide
cagcatcctgccgatcacctcgccg

SEQ ID NO: 718990 - DNA, 25 bp, Artificial sequence
  Synthetic oligonucleotide
gcggcaccagcatcctgccgatcac

SEQ ID NO: 718991 - DNA, 25 bp, Artificial sequence
  Synthetic oligonucleotide
gtaccggcggcaccagcatcctgcc

SEQ ID NO: 718992 - DNA, 25 bp, Artificial sequence
  Synthetic oligonucleotide
gcggcggtaccggcggcaccagcat

SEQ ID NO: 718993 - DNA, 25 bp, Artificial sequence
  Synthetic oligonucleotide
gacggcggcggcggtaccggcggca

SEQ ID NO: 718994 - DNA, 25 bp, Artificial sequence
  Synthetic oligonucleotide
agctcgacggcggcggcggtaccgg

SEQ ID NO: 718995 - DNA, 25 bp, Artificial sequence
  Synthetic oligonucleotide
gagcaaggaaggctacgaatccggc

SEQ ID NO: 718996 - DNA, 25 bp, Artificial sequence
  Synthetic oligonucleotide
ttcaccacgctgtaagaaggagcaa

SEQ ID NO: 718997 - DNA, 25 bp, Artificial sequence
  Synthetic oligonucleotide
ttgacgccgatggcgctggcgctgt

SEQ ID NO: 718998 - DNA, 25 bp, Artificial sequence
  Synthetic oligonucleotide
ttcgccttgacgccgatggcgctgg

SEQ ID NO: 718999 - DNA, 25 bp, Artificial sequence
  Synthetic oligonucleotide
aatctgttcgccttgacgccgatgg

SEQ ID NO: 719000 - DNA, 25 bp, Artificial sequence
  Synthetic oligonucleotide
atgaggaatctgttcgccttgacgc

SEQ ID NO: 719001 - DNA, 25 bp, Artificial sequence
  Synthetic oligonucleotide
accgcaatgaggaatctgttcgcct

SEQ ID NO: 719002 - DNA, 25 bp, Artificial sequence
  Synthetic oligonucleotide
ggagcaaccgcaatgaggaatctgt

SEQ ID NO: 719003 - DNA, 25 bp, Artificial sequence
  Synthetic oligonucleotide
cttccgggcacgacagcaaggaatg

SEQ ID NO: 719004 - DNA, 25 bp, Artificial sequence
  Synthetic oligonucleotide
acgctgtaagaaggagcaaccgcaa

SEQ ID NO: 719005 - DNA, 25 bp, Artificial sequence
  Synthetic oligonucleotide
ctggcgctgtgcaccgcgtccgccg

SEQ ID NO: 719006 - DNA, 25 bp, Artificial sequence
  Synthetic oligonucleotide
ccggatttcaccacgctgtaagaag

SEQ ID NO: 719007 - DNA, 25 bp, Artificial sequence
  Synthetic oligonucleotide
gccttgccggatttcaccacgctgt

SEQ ID NO: 719008 - DNA, 25 bp, Artificial sequence
  Synthetic oligonucleotide
tttccggccttgccggatttcacca

SEQ ID NO: 719009 - DNA, 25 bp, Artificial sequence
  Synthetic oligonucleotide
cacgctttccggccttgccggattt

SEQ ID NO: 719010 - DNA, 25 bp, Artificial sequence
  Synthetic oligonucleotide
ccacaacacgctttccggccttgcc

SEQ ID NO: 719011 - DNA, 25 bp, Artificial sequence
  Synthetic oligonucleotide
acgacaccacaacacgctttccggc

SEQ ID NO: 719012 - DNA, 25 bp, Artificial sequence
  Synthetic oligonucleotide
ccgggaacgacaccacaacacgctt

SEQ ID NO: 719013 - DNA, 25 bp, Artificial sequence
  Synthetic oligonucleotide
taagaaggagcaaccgcaatgagga

SEQ ID NO: 719014 - DNA, 25 bp, Artificial sequence
  Synthetic oligonucleotide
ttcatcgaaggctccagcctccaat

SEQ ID NO: 719015 - DNA, 25 bp, Artificial sequence
  Synthetic oligonucleotide
agcgtcgccgggaacgacaccacaa

SEQ ID NO: 719016 - DNA, 25 bp, Artificial sequence
  Synthetic oligonucleotide
accatgaccgccggcacgcttccgg

SEQ ID NO: 719017 - DNA, 25 bp, Artificial sequence
  Synthetic oligonucleotide
acttcaaccatgaccgccggcacgc

SEQ ID NO: 719018 - DNA, 25 bp, Artificial sequence
  Synthetic oligonucleotide
actactacttcaaccatgaccgccg

SEQ ID NO: 719019 - DNA, 25 bp, Artificial sequence
  Synthetic oligonucleotide
cccgcaactactacttcaaccatga

SEQ ID NO: 719020 - DNA, 25 bp, Artificial sequence
  Synthetic oligonucleotide
tgctgacccgcaactactacttcaa

SEQ ID NO: 719021 - DNA, 25 bp, Artificial sequence
  Synthetic oligonucleotide
tccaattgctgacccgcaactacta

SEQ ID NO: 719022 - DNA, 25 bp, Artificial sequence
  Synthetic oligonucleotide
gccgatggcgctggcgctgtgcacc

SEQ ID NO: 719023 - DNA, 25 bp, Artificial sequence
  Synthetic oligonucleotide
gaaggctccagcctccaattgctga

SEQ ID NO: 719024 - DNA, 25 bp, Artificial sequence
  Synthetic oligonucleotide
tggcgctggcgctgtgcaccgcgtc

SEQ ID NO: 719025 - DNA, 25 bp, Artificial sequence
  Synthetic oligonucleotide
agaaggcttcatcgaaggctccagc

SEQ ID NO: 719026 - DNA, 25 bp, Artificial sequence
  Synthetic oligonucleotide
agccaaagaaggcttcatcgaaggc

SEQ ID NO: 719027 - DNA, 25 bp, Artificial sequence
  Synthetic oligonucleotide
agggggaagccaaagaaggcttcat

SEQ ID NO: 719028 - DNA, 25 bp, Artificial sequence
  Synthetic oligonucleotide
cctgggccgatgagggggaagccaa

SEQ ID NO: 719029 - DNA, 25 bp, Artificial sequence
  Synthetic oligonucleotide
accgcgtccgccgcctgggccgatg

SEQ ID NO: 719030 - DNA, 25 bp, Artificial sequence
  Synthetic oligonucleotide
ctgtgcaccgcgtccgccgcctggg

SEQ ID NO: 719031 - DNA, 25 bp, Artificial sequence
  Synthetic oligonucleotide
ggcacgcttccgggcacgacagcaa

SEQ ID NO: 719032 - DNA, 25 bp, Artificial sequence
  Synthetic oligonucleotide
tccagcctccaattgctgacccgca

SEQ ID NO: 719033 - DNA, 25 bp, Artificial sequence
  Synthetic oligonucleotide
agaacaccttcatggtcaatgtcgc

SEQ ID NO: 719034 - DNA, 25 bp, Artificial sequence
  Synthetic oligonucleotide
tgtatccctcgcggcgttacctgga

SEQ ID NO: 719035 - DNA, 25 bp, Artificial sequence
  Synthetic oligonucleotide
cggccaaggccgacctcggcatcgc

SEQ ID NO: 719036 - DNA, 25 bp, Artificial sequence
  Synthetic oligonucleotide
cccaggcggccaaggccgacctcgg

SEQ ID NO: 719037 - DNA, 25 bp, Artificial sequence
  Synthetic oligonucleotide
tcatggcccaggcggccaaggccga

SEQ ID NO: 719038 - DNA, 25 bp, Artificial sequence
  Synthetic oligonucleotide
ccgaggtcatggcccaggcggccaa

SEQ ID NO: 719039 - DNA, 25 bp, Artificial sequence
  Synthetic oligonucleotide
atgtcgccgaggtcatggcccaggc

SEQ ID NO: 719040 - DNA, 25 bp, Artificial sequence
  Synthetic oligonucleotide
ctcggcatcgccctgctgcccagct

SEQ ID NO: 719041 - DNA, 25 bp, Artificial sequence
  Synthetic oligonucleotide
ccttcatggtcaatgtcgccgaggt

SEQ ID NO: 719042 - DNA, 25 bp, Artificial sequence
  Synthetic oligonucleotide
atcgccctgctgcccagctacgtgg

SEQ ID NO: 719043 - DNA, 25 bp, Artificial sequence
  Synthetic oligonucleotide
gcccgcagaacaccttcatggtcaa

SEQ ID NO: 719044 - DNA, 25 bp, Artificial sequence
  Synthetic oligonucleotide
ccgtcagcccgcagaacaccttcat

SEQ ID NO: 719045 - DNA, 25 bp, Artificial sequence
  Synthetic oligonucleotide
agcgcaccgtcagcccgcagaacac

SEQ ID NO: 719046 - DNA, 25 bp, Artificial sequence
  Synthetic oligonucleotide
agggcgagcgcaccgtcagcccgca

SEQ ID NO: 719047 - DNA, 25 bp, Artificial sequence
  Synthetic oligonucleotide
acgagcagggcgagcgcaccgtcag

SEQ ID NO: 719048 - DNA, 25 bp, Artificial sequence
  Synthetic oligonucleotide
tcgccgacgagcagggcgagcgcac

SEQ ID NO: 719049 - DNA, 25 bp, Artificial sequence
  Synthetic oligonucleotide
ggatcttcgccgacgagcagggcga

SEQ ID NO: 719050 - DNA, 25 bp, Artificial sequence
  Synthetic oligonucleotide
tggtcaatgtcgccgaggtcatggc

SEQ ID NO: 719051 - DNA, 25 bp, Artificial sequence
  Synthetic oligonucleotide
agctgctacgggtgttgcccggcca

SEQ ID NO: 719052 - DNA, 25 bp, Artificial sequence
  Synthetic oligonucleotide
aggattgttgttattgaggtaatac

SEQ ID NO: 719053 - DNA, 25 bp, Artificial sequence
  Synthetic oligonucleotide
ccatctatgcgctgtatccctcgcg

SEQ ID NO: 719054 - DNA, 25 bp, Artificial sequence
  Synthetic oligonucleotide
agcggaccatctatgcgctgtatcc

SEQ ID NO: 719055 - DNA, 25 bp, Artificial sequence
  Synthetic oligonucleotide
tgcaccagcggaccatctatgcgct

SEQ ID NO: 719056 - DNA, 25 bp, Artificial sequence
  Synthetic oligonucleotide
atgccatgcaccagcggaccatcta

SEQ ID NO: 719057 - DNA, 25 bp, Artificial sequence
  Synthetic oligonucleotide
ccggccatgccatgcaccagcggac

SEQ ID NO: 719058 - DNA, 25 bp, Artificial sequence
  Synthetic oligonucleotide
ggccgacctcggcatcgccctgctg

SEQ ID NO: 719059 - DNA, 25 bp, Artificial sequence
  Synthetic oligonucleotide
tacgggtgttgcccggccatgccat

SEQ ID NO: 719060 - DNA, 25 bp, Artificial sequence
  Synthetic oligonucleotide
ccggcctacccggagggctggatct

SEQ ID NO: 719061 - DNA, 25 bp, Artificial sequence
  Synthetic oligonucleotide
aacggcgagctgctacgggtgttgc

SEQ ID NO: 719062 - DNA, 25 bp, Artificial sequence
  Synthetic oligonucleotide
ctgcgcaacggcgagctgctacggg

SEQ ID NO: 719063 - DNA, 25 bp, Artificial sequence
  Synthetic oligonucleotide
cgcggcgctgcgcaacggcgagctg

SEQ ID NO: 719064 - DNA, 25 bp, Artificial sequence
  Synthetic oligonucleotide
tggcggccgcggcgctgcgcaacgg

SEQ ID NO: 719065 - DNA, 25 bp, Artificial sequence
  Synthetic oligonucleotide
gctacgtggcggccgcggcgctgcg

SEQ ID NO: 719066 - DNA, 25 bp, Artificial sequence
  Synthetic oligonucleotide
gcccagctacgtggcggccgcggcg

SEQ ID NO: 719067 - DNA, 25 bp, Artificial sequence
  Synthetic oligonucleotide
ctgctgcccagctacgtggcggccg

SEQ ID NO: 719068 - DNA, 25 bp, Artificial sequence
  Synthetic oligonucleotide
tgttgcccggccatgccatgcacca

SEQ ID NO: 719069 - DNA, 25 bp, Artificial sequence
  Synthetic oligonucleotide
gtgctgatcaccggcgagcgccagt

SEQ ID NO: 719070 - DNA, 25 bp, Artificial sequence
  Synthetic oligonucleotide
cagcgcctgggcagcatccacagcg

SEQ ID NO: 719071 - DNA, 25 bp, Artificial sequence
  Synthetic oligonucleotide
gtcgcccagcgcctgggcagcatcc

SEQ ID NO: 719072 - DNA, 25 bp, Artificial sequence
  Synthetic oligonucleotide
gagttcgtcgcccagcgcctgggca

SEQ ID NO: 719073 - DNA, 25 bp, Artificial sequence
  Synthetic oligonucleotide
gactcggagttcgtcgcccagcgcc

SEQ ID NO: 719074 - DNA, 25 bp, Artificial sequence
  Synthetic oligonucleotide
tgcccgactcggagttcgtcgccca

SEQ ID NO: 719075 - DNA, 25 bp, Artificial sequence
  Synthetic oligonucleotide
gccagttgcccgactcggagttcgt

SEQ ID NO: 719076 - DNA, 25 bp, Artificial sequence
  Synthetic oligonucleotide
agggctggatcttcgccgacgagca

SEQ ID NO: 719077 - DNA, 25 bp, Artificial sequence
  Synthetic oligonucleotide
atcaccggcgagcgccagttgcccg

SEQ ID NO: 719078 - DNA, 25 bp, Artificial sequence
  Synthetic oligonucleotide
cacagcgtgctctgcgccagtcccg

SEQ ID NO: 719079 - DNA, 25 bp, Artificial sequence
  Synthetic oligonucleotide
caggatgtgctgatcaccggcgagc

SEQ ID NO: 719080 - DNA, 25 bp, Artificial sequence
  Synthetic oligonucleotide
gaaggccaggatgtgctgatcaccg

SEQ ID NO: 719081 - DNA, 25 bp, Artificial sequence
  Synthetic oligonucleotide
ctcgaggaaggccaggatgtgctga

SEQ ID NO: 719082 - DNA, 25 bp, Artificial sequence
  Synthetic oligonucleotide
gacatgctcgaggaaggccaggatg

SEQ ID NO: 719083 - DNA, 25 bp, Artificial sequence
  Synthetic oligonucleotide
aacccggacatgctcgaggaaggcc

SEQ ID NO: 719084 - DNA, 25 bp, Artificial sequence
  Synthetic oligonucleotide
cagcgcaacccggacatgctcgagg

SEQ ID NO: 719085 - DNA, 25 bp, Artificial sequence
  Synthetic oligonucleotide
cctgtcccagcgcaacccggacatg

SEQ ID NO: 719086 - DNA, 25 bp, Artificial sequence
  Synthetic oligonucleotide
gcgagcgccagttgcccgactcgga

SEQ ID NO: 719087 - DNA, 25 bp, Artificial sequence
  Synthetic oligonucleotide
acggcgtgccacgctcggtggacga

SEQ ID NO: 719088 - DNA, 25 bp, Artificial sequence
  Synthetic oligonucleotide
cctcgcggcgttacctggacgcgaa

SEQ ID NO: 719089 - DNA, 25 bp, Artificial sequence
  Synthetic oligonucleotide
gcctgcaggacccggcctacccgga

SEQ ID NO: 719090 - DNA, 25 bp, Artificial sequence
  Synthetic oligonucleotide
gcctgcgcctgcaggacccggccta

SEQ ID NO: 719091 - DNA, 25 bp, Artificial sequence
  Synthetic oligonucleotide
acgtctgcctgcgcctgcaggaccc

SEQ ID NO: 719092 - DNA, 25 bp, Artificial sequence
  Synthetic oligonucleotide
agcgccacgtctgcctgcgcctgca

SEQ ID NO: 719093 - DNA, 25 bp, Artificial sequence
  Synthetic oligonucleotide
acctggagcgccacgtctgcctgcg

SEQ ID NO: 719094 - DNA, 25 bp, Artificial sequence
  Synthetic oligonucleotide
tggacgacctggagcgccacgtctg

SEQ ID NO: 719095 - DNA, 25 bp, Artificial sequence
  Synthetic oligonucleotide
ctgggcagcatccacagcgtgctct

SEQ ID NO: 719096 - DNA, 25 bp, Artificial sequence
  Synthetic oligonucleotide
tgccacgctcggtggacgacctgga

SEQ ID NO: 719097 - DNA, 25 bp, Artificial sequence
  Synthetic oligonucleotide
agcatccacagcgtgctctgcgcca

SEQ ID NO: 719098 - DNA, 25 bp, Artificial sequence
  Synthetic oligonucleotide
agcagcacggcgtgccacgctcggt

SEQ ID NO: 719099 - DNA, 25 bp, Artificial sequence
  Synthetic oligonucleotide
cctgcagcagcacggcgtgccacgc

SEQ ID NO: 719100 - DNA, 25 bp, Artificial sequence
  Synthetic oligonucleotide
cggctacctgcagcagcacggcgtg

SEQ ID NO: 719101 - DNA, 25 bp, Artificial sequence
  Synthetic oligonucleotide
cagtcccggctacctgcagcagcac

SEQ ID NO: 719102 - DNA, 25 bp, Artificial sequence
  Synthetic oligonucleotide
ctgcgccagtcccggctacctgcag

SEQ ID NO: 719103 - DNA, 25 bp, Artificial sequence
  Synthetic oligonucleotide
gtgctctgcgccagtcccggctacc

SEQ ID NO: 719104 - DNA, 25 bp, Artificial sequence
  Synthetic oligonucleotide
tacccggagggctggatcttcgccg

SEQ ID NO: 719105 - DNA, 25 bp, Artificial sequence
  Synthetic oligonucleotide
gctcggtggacgacctggagcgcca

SEQ ID NO: 719106 - DNA, 25 bp, Artificial sequence
  Synthetic oligonucleotide
tgttttccctcgcattttcccaggc

SEQ ID NO: 719107 - DNA, 25 bp, Artificial sequence
  Synthetic oligonucleotide
tatgcgctgtatccctcgcggcgtt

SEQ ID NO: 719108 - DNA, 25 bp, Artificial sequence
  Synthetic oligonucleotide
tgaccaaccgcatggtcgacgccaa

SEQ ID NO: 719109 - DNA, 25 bp, Artificial sequence
  Synthetic oligonucleotide
cgctgatgaccaaccgcatggtcga

SEQ ID NO: 719110 - DNA, 25 bp, Artificial sequence
  Synthetic oligonucleotide
agtcctcgctgatgaccaaccgcat

SEQ ID NO: 719111 - DNA, 25 bp, Artificial sequence
  Synthetic oligonucleotide
ccgaagagtcctcgctgatgaccaa

SEQ ID NO: 719112 - DNA, 25 bp, Artificial sequence
  Synthetic oligonucleotide
gtttcgccgaagagtcctcgctgat

SEQ ID NO: 719113 - DNA, 25 bp, Artificial sequence
  Synthetic oligonucleotide
tggtcgacgccaaccagcaggccat

SEQ ID NO: 719114 - DNA, 25 bp, Artificial sequence
  Synthetic oligonucleotide
ctcgcattttcccaggccggtttcg

SEQ ID NO: 719115 - DNA, 25 bp, Artificial sequence
  Synthetic oligonucleotide
acgccaaccagcaggccatcgagca

SEQ ID NO: 719116 - DNA, 25 bp, Artificial sequence
  Synthetic oligonucleotide
actcagtttgttttccctcgcattt

SEQ ID NO: 719117 - DNA, 25 bp, Artificial sequence
  Synthetic oligonucleotide
cgccatactcagtttgttttccctc

SEQ ID NO: 719118 - DNA, 25 bp, Artificial sequence
  Synthetic oligonucleotide
tgctgccgccatactcagtttgttt

SEQ ID NO: 719119 - DNA, 25 bp, Artificial sequence
  Synthetic oligonucleotide
gatccttgctgccgccatactcagt

SEQ ID NO: 719120 - DNA, 25 bp, Artificial sequence
  Synthetic oligonucleotide
cgccagatccttgctgccgccatac

SEQ ID NO: 719121 - DNA, 25 bp, Artificial sequence
  Synthetic oligonucleotide
atgaatcgccagatccttgctgccg

SEQ ID NO: 719122 - DNA, 25 bp, Artificial sequence
  Synthetic oligonucleotide
cccgccatgaatcgccagatccttg

SEQ ID NO: 719123 - DNA, 25 bp, Artificial sequence
  Synthetic oligonucleotide
caggccggtttcgccgaagagtcct

SEQ ID NO: 719124 - DNA, 25 bp, Artificial sequence
  Synthetic oligonucleotide
ccgcgcaggccggggcccgcagcga

SEQ ID NO: 719125 - DNA, 25 bp, Artificial sequence
  Synthetic oligonucleotide
cagccgcgccatggcttcccccggg

SEQ ID NO: 719126 - DNA, 25 bp, Artificial sequence
  Synthetic oligonucleotide
tggcgccagccgcgccatggcttcc

SEQ ID NO: 719127 - DNA, 25 bp, Artificial sequence
  Synthetic oligonucleotide
agcgcatggcgccagccgcgccatg

SEQ ID NO: 719128 - DNA, 25 bp, Artificial sequence
  Synthetic oligonucleotide
tgatctagcgcatggcgccagccgc

SEQ ID NO: 719129 - DNA, 25 bp, Artificial sequence
  Synthetic oligonucleotide
actcctgatctagcgcatggcgcca

SEQ ID NO: 719130 - DNA, 25 bp, Artificial sequence
  Synthetic oligonucleotide
gcagcgactcctgatctagcgcatg

SEQ ID NO: 719131 - DNA, 25 bp, Artificial sequence
  Synthetic oligonucleotide
accgcatggtcgacgccaaccagca

SEQ ID NO: 719132 - DNA, 25 bp, Artificial sequence
  Synthetic oligonucleotide
ggccggggcccgcagcgactcctga

SEQ ID NO: 719133 - DNA, 25 bp, Artificial sequence
  Synthetic oligonucleotide
acagggtgtcatcggagacccgcca

SEQ ID NO: 719134 - DNA, 25 bp, Artificial sequence
  Synthetic oligonucleotide
cctccgccgcgcaggccggggcccg

SEQ ID NO: 719135 - DNA, 25 bp, Artificial sequence
  Synthetic oligonucleotide
tttccgcctccgccgcgcaggccgg

SEQ ID NO: 719136 - DNA, 25 bp, Artificial sequence
  Synthetic oligonucleotide
aggaactttccgcctccgccgcgca

SEQ ID NO: 719137 - DNA, 25 bp, Artificial sequence
  Synthetic oligonucleotide
accagcaggaactttccgcctccgc

SEQ ID NO: 719138 - DNA, 25 bp, Artificial sequence
  Synthetic oligonucleotide
tcgagcaccagcaggaactttccgc

SEQ ID NO: 719139 - DNA, 25 bp, Artificial sequence
  Synthetic oligonucleotide
aggccatcgagcaccagcaggaact

SEQ ID NO: 719140 - DNA, 25 bp, Artificial sequence
  Synthetic oligonucleotide
accagcaggccatcgagcaccagca

SEQ ID NO: 719141 - DNA, 25 bp, Artificial sequence
  Synthetic oligonucleotide
gggcccgcagcgactcctgatctag

SEQ ID NO: 719142 - DNA, 25 bp, Artificial sequence
  Synthetic oligonucleotide
gcaacaggaacttccccaggcattc

SEQ ID NO: 719143 - DNA, 25 bp, Artificial sequence
  Synthetic oligonucleotide
agttcaagttactgtgcacagtgaa

SEQ ID NO: 719144 - DNA, 25 bp, Artificial sequence
  Synthetic oligonucleotide
atgcaaagttcaagttactgtgcac

SEQ ID NO: 719145 - DNA, 25 bp, Artificial sequence
  Synthetic oligonucleotide
actaccatgcaaagttcaagttact

SEQ ID NO: 719146 - DNA, 25 bp, Artificial sequence
  Synthetic oligonucleotide
gacgaaactaccatgcaaagttcaa

SEQ ID NO: 719147 - DNA, 25 bp, Artificial sequence
  Synthetic oligonucleotide
gcccgcgacgaaactaccatgcaaa

SEQ ID NO: 719148 - DNA, 25 bp, Artificial sequence
  Synthetic oligonucleotide
gcattcgcccgcgacgaaactacca

SEQ ID NO: 719149 - DNA, 25 bp, Artificial sequence
  Synthetic oligonucleotide
cggagacccgccatgaatcgccaga

SEQ ID NO: 719150 - DNA, 25 bp, Artificial sequence
  Synthetic oligonucleotide
ggaacttccccaggcattcgcccgc

SEQ ID NO: 719151 - DNA, 25 bp, Artificial sequence
  Synthetic oligonucleotide
cagtgaaggattgttgttattgagg

SEQ ID NO: 719152 - DNA, 25 bp, Artificial sequence
  Synthetic oligonucleotide
tctgttgcaacaggaacttccccag

SEQ ID NO: 719153 - DNA, 25 bp, Artificial sequence
  Synthetic oligonucleotide
ggtcgatctgttgcaacaggaactt

SEQ ID NO: 719154 - DNA, 25 bp, Artificial sequence
  Synthetic oligonucleotide
cacctgggtcgatctgttgcaacag

SEQ ID NO: 719155 - DNA, 25 bp, Artificial sequence
  Synthetic oligonucleotide
gatccgcacctgggtcgatctgttg

SEQ ID NO: 719156 - DNA, 25 bp, Artificial sequence
  Synthetic oligonucleotide
cgcgaagatccgcacctgggtcgat

SEQ ID NO: 719157 - DNA, 25 bp, Artificial sequence
  Synthetic oligonucleotide
acctggacgcgaagatccgcacctg

SEQ ID NO: 719158 - DNA, 25 bp, Artificial sequence
  Synthetic oligonucleotide
ggcgttacctggacgcgaagatccg

SEQ ID NO: 719159 - DNA, 25 bp, Artificial sequence
  Synthetic oligonucleotide
tccccaggcattcgcccgcgacgaa

SEQ ID NO: 719160 - DNA, 25 bp, Artificial sequence
  Synthetic oligonucleotide
gtttggctatttttccgagcatggc

SEQ ID NO: 719161 - DNA, 25 bp, Artificial sequence
  Synthetic oligonucleotide
gcgccatggcttcccccgggtactc

SEQ ID NO: 719162 - DNA, 25 bp, Artificial sequence
  Synthetic oligonucleotide
aagtgaacagggtgtcatcggagac

SEQ ID NO: 719163 - DNA, 25 bp, Artificial sequence
  Synthetic oligonucleotide
ctgtcccaagtgaacagggtgtcat

SEQ ID NO: 719164 - DNA, 25 bp, Artificial sequence
  Synthetic oligonucleotide
tggcgcctgtcccaagtgaacaggg

SEQ ID NO: 719165 - DNA, 25 bp, Artificial sequence
  Synthetic oligonucleotide
ctaatatggcgcctgtcccaagtga

SEQ ID NO: 719166 - DNA, 25 bp, Artificial sequence
  Synthetic oligonucleotide
ggttaactaatatggcgcctgtccc

SEQ ID NO: 719167 - DNA, 25 bp, Artificial sequence
  Synthetic oligonucleotide
catggcggttaactaatatggcgcc

SEQ ID NO: 719168 - DNA, 25 bp, Artificial sequence
  Synthetic oligonucleotide
agttactgtgcacagtgaaggattg

SEQ ID NO: 719169 - DNA, 25 bp, Artificial sequence
  Synthetic oligonucleotide
ctatttttccgagcatggcggttaa

SEQ ID NO: 719170 - DNA, 25 bp, Artificial sequence
  Synthetic oligonucleotide
agaacgtctggaagcagtactacgc

SEQ ID NO: 719171 - DNA, 25 bp, Artificial sequence
  Synthetic oligonucleotide
tcgtctgtttggctatttttccgag

SEQ ID NO: 719172 - DNA, 25 bp, Artificial sequence
  Synthetic oligonucleotide
actctctcgtctgtttggctatttt

SEQ ID NO: 719173 - DNA, 25 bp, Artificial sequence
  Synthetic oligonucleotide
gtaatactctctcgtctgtttggct

SEQ ID NO: 719174 - DNA, 25 bp, Artificial sequence
  Synthetic oligonucleotide
attgaggtaatactctctcgtctgt

SEQ ID NO: 719175 - DNA, 25 bp, Artificial sequence
  Synthetic oligonucleotide
gttgttattgaggtaatactctctc

SEQ ID NO: 719176 - DNA, 25 bp, Artificial sequence
  Synthetic oligonucleotide
tccagtggcggggcggcgctgaaga

SEQ ID NO: 719177 - DNA, 25 bp, Artificial sequence
  Synthetic oligonucleotide
tgtcatcggagacccgccatgaatc

SEQ ID NO: 719178 - DNA, 25 bp, Artificial sequence
  Synthetic oligonucleotide
tccgagcatggcggttaactaatat

SEQ ID NO: 719179 - DNA, 25 bp, Artificial sequence
  Synthetic oligonucleotide
ggtagttcatcccggtctcgcgctg

SEQ ID NO: 719180 - DNA, 25 bp, Artificial sequence
  Synthetic oligonucleotide
cgacctccggcagcagccgcaactg

SEQ ID NO: 719181 - DNA, 25 bp, Artificial sequence
  Synthetic oligonucleotide
gtcttttccgaggtgcccaggcgct

SEQ ID NO: 719182 - DNA, 25 bp, Artificial sequence
  Synthetic oligonucleotide
gacagggtcttttccgaggtgccca

SEQ ID NO: 719183 - DNA, 25 bp, Artificial sequence
  Synthetic oligonucleotide
aggcgcgacagggtcttttccgagg

SEQ ID NO: 719184 - DNA, 25 bp, Artificial sequence
  Synthetic oligonucleotide
ggaacaggcgcgacagggtcttttc

SEQ ID NO: 719185 - DNA, 25 bp, Artificial sequence
  Synthetic oligonucleotide
cgcgctggaacaggcgcgacagggt

SEQ ID NO: 719186 - DNA, 25 bp, Artificial sequence
  Synthetic oligonucleotide
ggtgcccaggcgctgcgcccagtcg

SEQ ID NO: 719187 - DNA, 25 bp, Artificial sequence
  Synthetic oligonucleotide
tcatcccggtctcgcgctggaacag

SEQ ID NO: 719188 - DNA, 25 bp, Artificial sequence
  Synthetic oligonucleotide
aggcgctgcgcccagtcgcccatgg

SEQ ID NO: 719189 - DNA, 25 bp, Artificial sequence
  Synthetic oligonucleotide
agagccggtagttcatcccggtctc

SEQ ID NO: 719190 - DNA, 25 bp, Artificial sequence
  Synthetic oligonucleotide
ggcgccagagccggtagttcatccc

SEQ ID NO: 719191 - DNA, 25 bp, Artificial sequence
  Synthetic oligonucleotide
tggcgttggcgccagagccggtagt

SEQ ID NO: 719192 - DNA, 25 bp, Artificial sequence
  Synthetic oligonucleotide
aggcgctggcgttggcgccagagcc

SEQ ID NO: 719193 - DNA, 25 bp, Artificial sequence
  Synthetic oligonucleotide
gcgagcaggcgctggcgttggcgcc

SEQ ID NO: 719194 - DNA, 25 bp, Artificial sequence
  Synthetic oligonucleotide
agcgaggcgagcaggcgctggcgtt

SEQ ID NO: 719195 - DNA, 25 bp, Artificial sequence
  Synthetic oligonucleotide
gcgttgagcgaggcgagcaggcgct

SEQ ID NO: 719196 - DNA, 25 bp, Artificial sequence
  Synthetic oligonucleotide
cggtctcgcgctggaacaggcgcga

SEQ ID NO: 719197 - DNA, 25 bp, Artificial sequence
  Synthetic oligonucleotide
cagtgcctggcacagccgcagcagg

SEQ ID NO: 719198 - DNA, 25 bp, Artificial sequence
  Synthetic oligonucleotide
ccgccgaactgcagaacgtctggaa

SEQ ID NO: 719199 - DNA, 25 bp, Artificial sequence
  Synthetic oligonucleotide
cagggagaaggcgacctccggcagc

SEQ ID NO: 719200 - DNA, 25 bp, Artificial sequence
  Synthetic oligonucleotide
catcggcagggagaaggcgacctcc

SEQ ID NO: 719201 - DNA, 25 bp, Artificial sequence
  Synthetic oligonucleotide
gcgcggcatcggcagggagaaggcg

SEQ ID NO: 719202 - DNA, 25 bp, Artificial sequence
  Synthetic oligonucleotide
gcggctcgcgcggcatcggcaggga

SEQ ID NO: 719203 - DNA, 25 bp, Artificial sequence
  Synthetic oligonucleotide
agcaggcgcggctcgcgcggcatcg

SEQ ID NO: 719204 - DNA, 25 bp, Artificial sequence
  Synthetic oligonucleotide
ttccgaggtgcccaggcgctgcgcc

SEQ ID NO: 719205 - DNA, 25 bp, Artificial sequence
  Synthetic oligonucleotide
tggcacagccgcagcaggcgcggct

SEQ ID NO: 719206 - DNA, 25 bp, Artificial sequence
  Synthetic oligonucleotide
ctgtcgccggcctccagcgcgttga

SEQ ID NO: 719207 - DNA, 25 bp, Artificial sequence
  Synthetic oligonucleotide
cgtcgatcagtgcctggcacagccg

SEQ ID NO: 719208 - DNA, 25 bp, Artificial sequence
  Synthetic oligonucleotide
tcggttcgtcgatcagtgcctggca

SEQ ID NO: 719209 - DNA, 25 bp, Artificial sequence
  Synthetic oligonucleotide
tctgggtcggttcgtcgatcagtgc

SEQ ID NO: 719210 - DNA, 25 bp, Artificial sequence
  Synthetic oligonucleotide
tcaggctctgggtcggttcgtcgat

SEQ ID NO: 719211 - DNA, 25 bp, Artificial sequence
  Synthetic oligonucleotide
ccatggtcaggctctgggtcggttc

SEQ ID NO: 719212 - DNA, 25 bp, Artificial sequence
  Synthetic oligonucleotide
cagtcgcccatggtcaggctctggg

SEQ ID NO: 719213 - DNA, 25 bp, Artificial sequence
  Synthetic oligonucleotide
tgcgcccagtcgcccatggtcaggc

SEQ ID NO: 719214 - DNA, 25 bp, Artificial sequence
  Synthetic oligonucleotide
agccgcagcaggcgcggctcgcgcg

SEQ ID NO: 719215 - DNA, 25 bp, Artificial sequence
  Synthetic oligonucleotide
cgactatcccatcgacgtgttctga

SEQ ID NO: 719216 - DNA, 25 bp, Artificial sequence
  Synthetic oligonucleotide
gggctcagcgctggcggaacagttc

SEQ ID NO: 719217 - DNA, 25 bp, Artificial sequence
  Synthetic oligonucleotide
ttcgccgggctcagcgctggcggaa

SEQ ID NO: 719218 - DNA, 25 bp, Artificial sequence
  Synthetic oligonucleotide
gggcccttcgccgggctcagcgctg

SEQ ID NO: 719219 - DNA, 25 bp, Artificial sequence
  Synthetic oligonucleotide
cgcgctgggcccttcgccgggctca

SEQ ID NO: 719220 - DNA, 25 bp, Artificial sequence
  Synthetic oligonucleotide
gccccgcgcgctgggcccttcgccg

SEQ ID NO: 719221 - DNA, 25 bp, Artificial sequence
  Synthetic oligonucleotide
ttctgagccccgcgcgctgggccct

SEQ ID NO: 719222 - DNA, 25 bp, Artificial sequence
  Synthetic oligonucleotide
tccagcgcgttgagcgaggcgagca

SEQ ID NO: 719223 - DNA, 25 bp, Artificial sequence
  Synthetic oligonucleotide
tcccatcgacgtgttctgagccccg

SEQ ID NO: 719224 - DNA, 25 bp, Artificial sequence
  Synthetic oligonucleotide
aacagttcgccgggagtgaagccga

SEQ ID NO: 719225 - DNA, 25 bp, Artificial sequence
  Synthetic oligonucleotide
gatcgtcgactatcccatcgacgtg

SEQ ID NO: 719226 - DNA, 25 bp, Artificial sequence
  Synthetic oligonucleotide
ccgggtgatcgtcgactatcccatc

SEQ ID NO: 719227 - DNA, 25 bp, Artificial sequence
  Synthetic oligonucleotide
cgaataccgggtgatcgtcgactat

SEQ ID NO: 719228 - DNA, 25 bp, Artificial sequence
  Synthetic oligonucleotide
catcgacgaataccgggtgatcgtc

SEQ ID NO: 719229 - DNA, 25 bp, Artificial sequence
  Synthetic oligonucleotide
aatgacatcgacgaataccgggtga

SEQ ID NO: 719230 - DNA, 25 bp, Artificial sequence
  Synthetic oligonucleotide
gtggacaatgacatcgacgaatacc

SEQ ID NO: 719231 - DNA, 25 bp, Artificial sequence
  Synthetic oligonucleotide
agcgcggtggacaatgacatcgacg

SEQ ID NO: 719232 - DNA, 25 bp, Artificial sequence
  Synthetic oligonucleotide
cgacgtgttctgagccccgcgcgct

SEQ ID NO: 719233 - DNA, 25 bp, Artificial sequence
  Synthetic oligonucleotide
cgatataggccgaggtcgagtcgta

SEQ ID NO: 719234 - DNA, 25 bp, Artificial sequence
  Synthetic oligonucleotide
tccggcagcagccgcaactggtcca

SEQ ID NO: 719235 - DNA, 25 bp, Artificial sequence
  Synthetic oligonucleotide
gtgacgctgtcgccggcctccagcg

SEQ ID NO: 719236 - DNA, 25 bp, Artificial sequence
  Synthetic oligonucleotide
gcgccggtgacgctgtcgccggcct

SEQ ID NO: 719237 - DNA, 25 bp, Artificial sequence
  Synthetic oligonucleotide
agggcggcgccggtgacgctgtcgc

SEQ ID NO: 719238 - DNA, 25 bp, Artificial sequence
  Synthetic oligonucleotide
gctgtccagggcggcgccggtgacg

SEQ ID NO: 719239 - DNA, 25 bp, Artificial sequence
  Synthetic oligonucleotide
tagccgctgtccagggcggcgccgg

SEQ ID NO: 719240 - DNA, 25 bp, Artificial sequence
  Synthetic oligonucleotide
agtcgtagccgctgtccagggcggc

SEQ ID NO: 719241 - DNA, 25 bp, Artificial sequence
  Synthetic oligonucleotide
agcgctggcggaacagttcgccggg

SEQ ID NO: 719242 - DNA, 25 bp, Artificial sequence
  Synthetic oligonucleotide
aggccgaggtcgagtcgtagccgct

SEQ ID NO: 719243 - DNA, 25 bp, Artificial sequence
  Synthetic oligonucleotide
ggcggaacagttcgccgggagtgaa

SEQ ID NO: 719244 - DNA, 25 bp, Artificial sequence
  Synthetic oligonucleotide
aaggcggcgatataggccgaggtcg

SEQ ID NO: 719245 - DNA, 25 bp, Artificial sequence
  Synthetic oligonucleotide
cccttgaaggcggcgatataggccg

SEQ ID NO: 719246 - DNA, 25 bp, Artificial sequence
  Synthetic oligonucleotide
aagagtcccttgaaggcggcgatat

SEQ ID NO: 719247 - DNA, 25 bp, Artificial sequence
  Synthetic oligonucleotide
aagccgaagagtcccttgaaggcgg

SEQ ID NO: 719248 - DNA, 25 bp, Artificial sequence
  Synthetic oligonucleotide
ggagtgaagccgaagagtcccttga

SEQ ID NO: 719249 - DNA, 25 bp, Artificial sequence
  Synthetic oligonucleotide
tcgccgggagtgaagccgaagagtc

SEQ ID NO: 719250 - DNA, 25 bp, Artificial sequence
  Synthetic oligonucleotide
ccggcctccagcgcgttgagcgagg

SEQ ID NO: 719251 - DNA, 25 bp, Artificial sequence
  Synthetic oligonucleotide
aggtcgagtcgtagccgctgtccag

SEQ ID NO: 719252 - DNA, 25 bp, Artificial sequence
  Synthetic oligonucleotide
tgccctcggcggtatgtacgccgag

SEQ ID NO: 719253 - DNA, 25 bp, Artificial sequence
  Synthetic oligonucleotide
agaaggcgacctccggcagcagccg

SEQ ID NO: 719254 - DNA, 25 bp, Artificial sequence
  Synthetic oligonucleotide
taggaaagctgtacccaggcgtgcc

SEQ ID NO: 719255 - DNA, 25 bp, Artificial sequence
  Synthetic oligonucleotide
atggcgtaggaaagctgtacccagg

SEQ ID NO: 719256 - DNA, 25 bp, Artificial sequence
  Synthetic oligonucleotide
ccgctgatggcgtaggaaagctgta

SEQ ID NO: 719257 - DNA, 25 bp, Artificial sequence
  Synthetic oligonucleotide
agcacgccgctgatggcgtaggaaa

SEQ ID NO: 719258 - DNA, 25 bp, Artificial sequence
  Synthetic oligonucleotide
acgccgagcacgccgctgatggcgt

SEQ ID NO: 719259 - DNA, 25 bp, Artificial sequence
  Synthetic oligonucleotide
acccaggcgtgccggtggcgcgagg

SEQ ID NO: 719260 - DNA, 25 bp, Artificial sequence
  Synthetic oligonucleotide
tcggcggtatgtacgccgagcacgc

SEQ ID NO: 719261 - DNA, 25 bp, Artificial sequence
  Synthetic oligonucleotide
cgtgccggtggcgcgaggtccaaga

SEQ ID NO: 719262 - DNA, 25 bp, Artificial sequence
  Synthetic oligonucleotide
agaagctgccctcggcggtatgtac

SEQ ID NO: 719263 - DNA, 25 bp, Artificial sequence
  Synthetic oligonucleotide
gggcgaagaagctgccctcggcggt

SEQ ID NO: 719264 - DNA, 25 bp, Artificial sequence
  Synthetic oligonucleotide
tgcggcggggcgaagaagctgccct

SEQ ID NO: 719265 - DNA, 25 bp, Artificial sequence
  Synthetic oligonucleotide
gcccgctgcggcggggcgaagaagc

SEQ ID NO: 719266 - DNA, 25 bp, Artificial sequence
  Synthetic oligonucleotide
cagatcgcccgctgcggcggggcga

SEQ ID NO: 719267 - DNA, 25 bp, Artificial sequence
  Synthetic oligonucleotide
ggaatccagatcgcccgctgcggcg

SEQ ID NO: 719268 - DNA, 25 bp, Artificial sequence
  Synthetic oligonucleotide
gcgccggaatccagatcgcccgctg

SEQ ID NO: 719269 - DNA, 25 bp, Artificial sequence
  Synthetic oligonucleotide
gtatgtacgccgagcacgccgctga

SEQ ID NO: 719270 - DNA, 25 bp, Artificial sequence
  Synthetic oligonucleotide
gcgcgtagaccggccgtggcaggcg

SEQ ID NO: 719271 - DNA, 25 bp, Artificial sequence
  Synthetic oligonucleotide
agttccgcaggctgtccgttcatcg

SEQ ID NO: 719272 - DNA, 25 bp, Artificial sequence
  Synthetic oligonucleotide
cggtgcagttccgcaggctgtccgt

SEQ ID NO: 719273 - DNA, 25 bp, Artificial sequence
  Synthetic oligonucleotide
aatcgggcggtgcagttccgcaggc

SEQ ID NO: 719274 - DNA, 25 bp, Artificial sequence
  Synthetic oligonucleotide
ggtgggaatcgggcggtgcagttcc

SEQ ID NO: 719275 - DNA, 25 bp, Artificial sequence
  Synthetic oligonucleotide
ggcgagggtgggaatcgggcggtgc

SEQ ID NO: 719276 - DNA, 25 bp, Artificial sequence
  Synthetic oligonucleotide
tggcaggcgggcgagggtgggaatc

SEQ ID NO: 719277 - DNA, 25 bp, Artificial sequence
  Synthetic oligonucleotide
aagctgtacccaggcgtgccggtgg

SEQ ID NO: 719278 - DNA, 25 bp, Artificial sequence
  Synthetic oligonucleotide
tagaccggccgtggcaggcgggcga

SEQ ID NO: 719279 - DNA, 25 bp, Artificial sequence
  Synthetic oligonucleotide
cacctcgtgttccagttgcgccgga

SEQ ID NO: 719280 - DNA, 25 bp, Artificial sequence
  Synthetic oligonucleotide
tcggcgcgcgcgtagaccggccgtg

SEQ ID NO: 719281 - DNA, 25 bp, Artificial sequence
  Synthetic oligonucleotide
aggctttcggcgcgcgcgtagaccg

SEQ ID NO: 719282 - DNA, 25 bp, Artificial sequence
  Synthetic oligonucleotide
gcgcgcaggctttcggcgcgcgcgt

SEQ ID NO: 719283 - DNA, 25 bp, Artificial sequence
  Synthetic oligonucleotide
gagccggcgcgcaggctttcggcgc

SEQ ID NO: 719284 - DNA, 25 bp, Artificial sequence
  Synthetic oligonucleotide
gtccaagagccggcgcgcaggcttt

SEQ ID NO: 719285 - DNA, 25 bp, Artificial sequence
  Synthetic oligonucleotide
gcgaggtccaagagccggcgcgcag

SEQ ID NO: 719286 - DNA, 25 bp, Artificial sequence
  Synthetic oligonucleotide
ggtggcgcgaggtccaagagccggc

SEQ ID NO: 719287 - DNA, 25 bp, Artificial sequence
  Synthetic oligonucleotide
cggccgtggcaggcgggcgagggtg

SEQ ID NO: 719288 - DNA, 25 bp, Artificial sequence
  Synthetic oligonucleotide
tcggcgctgtcgccctccgggtagt

SEQ ID NO: 719289 - DNA, 25 bp, Artificial sequence
  Synthetic oligonucleotide
tgatcagctcgcgcgccagcggcgt

SEQ ID NO: 719290 - DNA, 25 bp, Artificial sequence
  Synthetic oligonucleotide
actcttgatcagctcgcgcgccagc

SEQ ID NO: 719291 - DNA, 25 bp, Artificial sequence
  Synthetic oligonucleotide
cagaaactcttgatcagctcgcgcg

SEQ ID NO: 719292 - DNA, 25 bp, Artificial sequence
  Synthetic oligonucleotide
aactcgcagaaactcttgatcagct

SEQ ID NO: 719293 - DNA, 25 bp, Artificial sequence
  Synthetic oligonucleotide
accggcaactcgcagaaactcttga

SEQ ID NO: 719294 - DNA, 25 bp, Artificial sequence
  Synthetic oligonucleotide
gtagtccaccggcaactcgcagaaa

SEQ ID NO: 719295 - DNA, 25 bp, Artificial sequence
  Synthetic oligonucleotide
ccagttgcgccggaatccagatcgc

SEQ ID NO: 719296 - DNA, 25 bp, Artificial sequence
  Synthetic oligonucleotide
ctgtcgccctccgggtagtccaccg

SEQ ID NO: 719297 - DNA, 25 bp, Artificial sequence
  Synthetic oligonucleotide
gcggcgtcacctccagcacccggca

SEQ ID NO: 719298 - DNA, 25 bp, Artificial sequence
  Synthetic oligonucleotide
cgcgattcggcgctgtcgccctccg

SEQ ID NO: 719299 - DNA, 25 bp, Artificial sequence
  Synthetic oligonucleotide
accagccgcgattcggcgctgtcgc

SEQ ID NO: 719300 - DNA, 25 bp, Artificial sequence
  Synthetic oligonucleotide
acctgcaccagccgcgattcggcgc

SEQ ID NO: 719301 - DNA, 25 bp, Artificial sequence
  Synthetic oligonucleotide
agcagcacctgcaccagccgcgatt

SEQ ID NO: 719302 - DNA, 25 bp, Artificial sequence
  Synthetic oligonucleotide
tggtccagcagcacctgcaccagcc

SEQ ID NO: 719303 - DNA, 25 bp, Artificial sequence
  Synthetic oligonucleotide
cgcaactggtccagcagcacctgca

SEQ ID NO: 719304 - DNA, 25 bp, Artificial sequence
  Synthetic oligonucleotide
agcagccgcaactggtccagcagca

SEQ ID NO: 719305 - DNA, 25 bp, Artificial sequence
  Synthetic oligonucleotide
ctccgggtagtccaccggcaactcg

SEQ ID NO: 719306 - DNA, 25 bp, Artificial sequence
  Synthetic oligonucleotide
gcgcaggcgtcgccacggatgtaca

SEQ ID NO: 719307 - DNA, 25 bp, Artificial sequence
  Synthetic oligonucleotide
cgcggcaccggcggctacagcgcgg

SEQ ID NO: 719308 - DNA, 25 bp, Artificial sequence
  Synthetic oligonucleotide
ggtgaccacctcgtgttccagttgc

SEQ ID NO: 719309 - DNA, 25 bp, Artificial sequence
  Synthetic oligonucleotide
ggtggaggtgaccacctcgtgttcc

SEQ ID NO: 719310 - DNA, 25 bp, Artificial sequence
  Synthetic oligonucleotide
cggcgcgggtggaggtgaccacctc

SEQ ID NO: 719311 - DNA, 25 bp, Artificial sequence
  Synthetic oligonucleotide
gcatctcggcgcgggtggaggtgac

SEQ ID NO: 719312 - DNA, 25 bp, Artificial sequence
  Synthetic oligonucleotide
aggctgcgcatctcggcgcgggtgg

SEQ ID NO: 719313 - DNA, 25 bp, Artificial sequence
  Synthetic oligonucleotide
atgtacaggctgcgcatctcggcgc

SEQ ID NO: 719314 - DNA, 25 bp, Artificial sequence
  Synthetic oligonucleotide
gctcgcgcgccagcggcgtcacctc

SEQ ID NO: 719315 - DNA, 25 bp, Artificial sequence
  Synthetic oligonucleotide
gcgtcgccacggatgtacaggctgc

SEQ ID NO: 719316 - DNA, 25 bp, Artificial sequence
  Synthetic oligonucleotide
gcgccagcggcgtcacctccagcac

SEQ ID NO: 719317 - DNA, 25 bp, Artificial sequence
  Synthetic oligonucleotide
gcccaggcgcaggcgtcgccacgga

SEQ ID NO: 719318 - DNA, 25 bp, Artificial sequence
  Synthetic oligonucleotide
gtcggcgcccaggcgcaggcgtcgc

SEQ ID NO: 719319 - DNA, 25 bp, Artificial sequence
  Synthetic oligonucleotide
aacgcgtcggcgcccaggcgcaggc

SEQ ID NO: 719320 - DNA, 25 bp, Artificial sequence
  Synthetic oligonucleotide
cccggcaacgcgtcggcgcccaggc

SEQ ID NO: 719321 - DNA, 25 bp, Artificial sequence
  Synthetic oligonucleotide
ccagcacccggcaacgcgtcggcgc

SEQ ID NO: 719322 - DNA, 25 bp, Artificial sequence
  Synthetic oligonucleotide
tcacctccagcacccggcaacgcgt

SEQ ID NO: 719323 - DNA, 25 bp, Artificial sequence
  Synthetic oligonucleotide
cgtgttccagttgcgccggaatcca

SEQ ID NO: 719324 - DNA, 25 bp, Artificial sequence
  Synthetic oligonucleotide
ccacggatgtacaggctgcgcatct

SEQ ID NO: 719325 - DNA, 25 bp, Artificial sequence
  Synthetic oligonucleotide
tgggcggcacctggggcggcatcga

SEQ ID NO: 719326 - DNA, 25 bp, Artificial sequence
  Synthetic oligonucleotide
ggctacagcgcggtggacaatgaca

SEQ ID NO: 719327 - DNA, 25 bp, Artificial sequence
  Synthetic oligonucleotide
tgtacgccgccgaactgcagaacgt

SEQ ID NO: 719328 - DNA, 25 bp, Artificial sequence
  Synthetic oligonucleotide
gcagcctgtacgccgccgaactgca

SEQ ID NO: 719329 - DNA, 25 bp, Artificial sequence
  Synthetic oligonucleotide
tcaccagcagcctgtacgccgccga

SEQ ID NO: 719330 - DNA, 25 bp, Artificial sequence
  Synthetic oligonucleotide
gggcttcaccagcagcctgtacgcc

SEQ ID NO: 719331 - DNA, 25 bp, Artificial sequence
  Synthetic oligonucleotide
catcgagggcttcaccagcagcctg

SEQ ID NO: 719332 - DNA, 25 bp, Artificial sequence
  Synthetic oligonucleotide
aactgcagaacgtctggaagcagta

SEQ ID NO: 719333 - DNA, 25 bp, Artificial sequence
  Synthetic oligonucleotide
gcacctggggcggcatcgagggctt

SEQ ID NO: 719334 - DNA, 25 bp, Artificial sequence
  Synthetic oligonucleotide
tccgccgcctgggccgatgaggggg

SEQ ID NO: 719335 - DNA, 25 bp, Artificial sequence
  Synthetic oligonucleotide
ctggctgggcggcacctggggcggc

SEQ ID NO: 719336 - DNA, 25 bp, Artificial sequence
  Synthetic oligonucleotide
tctcagctggctgggcggcacctgg

SEQ ID NO: 719337 - DNA, 25 bp, Artificial sequence
  Synthetic oligonucleotide
catcatctcagctggctgggcggca

SEQ ID NO: 719338 - DNA, 25 bp, Artificial sequence
  Synthetic oligonucleotide
gacagccatcatctcagctggctgg

SEQ ID NO: 719339 - DNA, 25 bp, Artificial sequence
  Synthetic oligonucleotide
gaccgcgacagccatcatctcagct

SEQ ID NO: 719340 - DNA, 25 bp, Artificial sequence
  Synthetic oligonucleotide
gccgggcgaccgcgacagccatcat

SEQ ID NO: 719341 - DNA, 25 bp, Artificial sequence
  Synthetic oligonucleotide
cgaactgccgggcgaccgcgacagc

SEQ ID NO: 719342 - DNA, 25 bp, Artificial sequence
  Synthetic oligonucleotide
gggcggcatcgagggcttcaccagc

SEQ ID NO: 719343 - DNA, 25 bp, Artificial sequence
  Synthetic oligonucleotide
tcgacgacaactggtcgctgaaccc

SEQ ID NO: 719344 - DNA, 25 bp, Artificial sequence
  Synthetic oligonucleotide
gtcgacagcggcgactcgttgctcg

SEQ ID NO: 719345 - DNA, 25 bp, Artificial sequence
  Synthetic oligonucleotide
aagaccgtcgacagcggcgactcgt

SEQ ID NO: 719346 - DNA, 25 bp, Artificial sequence
  Synthetic oligonucleotide
tactacaagaccgtcgacagcggcg

SEQ ID NO: 719347 - DNA, 25 bp, Artificial sequence
  Synthetic oligonucleotide
gcgcactactacaagaccgtcgaca

SEQ ID NO: 719348 - DNA, 25 bp, Artificial sequence
  Synthetic oligonucleotide
cccggcgcgcactactacaagaccg

SEQ ID NO: 719349 - DNA, 25 bp, Artificial sequence
  Synthetic oligonucleotide
ctgaaccccggcgcgcactactaca

SEQ ID NO: 719350 - DNA, 25 bp, Artificial sequence
  Synthetic oligonucleotide
agctgaccctgtcccagcgcaaccc

SEQ ID NO: 719351 - DNA, 25 bp, Artificial sequence
  Synthetic oligonucleotide
gacaactggtcgctgaaccccggcg

SEQ ID NO: 719352 - DNA, 25 bp, Artificial sequence
  Synthetic oligonucleotide
gcctcggctcgtactacggcgaact

SEQ ID NO: 719353 - DNA, 25 bp, Artificial sequence
  Synthetic oligonucleotide
acgagatcgacgacaactggtcgct

SEQ ID NO: 719354 - DNA, 25 bp, Artificial sequence
  Synthetic oligonucleotide
acacctacgagatcgacgacaactg

SEQ ID NO: 719355 - DNA, 25 bp, Artificial sequence
  Synthetic oligonucleotide
tcgactacacctacgagatcgacga

SEQ ID NO: 719356 - DNA, 25 bp, Artificial sequence
  Synthetic oligonucleotide
ccgacgtcgactacacctacgagat

SEQ ID NO: 719357 - DNA, 25 bp, Artificial sequence
  Synthetic oligonucleotide
actacgccgacgtcgactacaccta

SEQ ID NO: 719358 - DNA, 25 bp, Artificial sequence
  Synthetic oligonucleotide
agcagtactacgccgacgtcgacta

SEQ ID NO: 719359 - DNA, 25 bp, Artificial sequence
  Synthetic oligonucleotide
tctggaagcagtactacgccgacgt

SEQ ID NO: 719360 - DNA, 25 bp, Artificial sequence
  Synthetic oligonucleotide
tggtcgctgaaccccggcgcgcact

SEQ ID NO: 719361 - DNA, 25 bp, Artificial sequence
  Synthetic oligonucleotide
gcgaccagttcctcagcaacccggt

SEQ ID NO: 719362 - DNA, 25 bp, Artificial sequence
  Synthetic oligonucleotide
tgctgccgcagaccttccgcggtgt

SEQ ID NO: 719363 - DNA, 25 bp, Artificial sequence
  Synthetic oligonucleotide
cgcgcatgctgccgcagaccttccg

SEQ ID NO: 719364 - DNA, 25 bp, Artificial sequence
  Synthetic oligonucleotide
gcgagtcgcgcatgctgccgcagac

SEQ ID NO: 719365 - DNA, 25 bp, Artificial sequence
  Synthetic oligonucleotide
ccggcggcgagtcgcgcatgctgcc

SEQ ID NO: 719366 - DNA, 25 bp, Artificial sequence
  Synthetic oligonucleotide
tggtcgccggcggcgagtcgcgcat

SEQ ID NO: 719367 - DNA, 25 bp, Artificial sequence
  Synthetic oligonucleotide
cccggtggtcgccggcggcgagtcg

SEQ ID NO: 719368 - DNA, 25 bp, Artificial sequence
  Synthetic oligonucleotide
actacggcgaactgccgggcgaccg

SEQ ID NO: 719369 - DNA, 25 bp, Artificial sequence
  Synthetic oligonucleotide
agttcctcagcaacccggtggtcgc

SEQ ID NO: 719370 - DNA, 25 bp, Artificial sequence
  Synthetic oligonucleotide
gcggtgtgagcctgaccaacaacag

SEQ ID NO: 719371 - DNA, 25 bp, Artificial sequence
  Synthetic oligonucleotide
agctgggcgaccagttcctcagcaa

SEQ ID NO: 719372 - DNA, 25 bp, Artificial sequence
  Synthetic oligonucleotide
agctgaagctgggcgaccagttcct

SEQ ID NO: 719373 - DNA, 25 bp, Artificial sequence
  Synthetic oligonucleotide
acaccgagctgaagctgggcgacca

SEQ ID NO: 719374 - DNA, 25 bp, Artificial sequence
  Synthetic oligonucleotide
ccttcgacaccgagctgaagctggg

SEQ ID NO: 719375 - DNA, 25 bp, Artificial sequence
  Synthetic oligonucleotide
tccgcgccttcgacaccgagctgaa

SEQ ID NO: 719376 - DNA, 25 bp, Artificial sequence
  Synthetic oligonucleotide
tgaagatccgcgccttcgacaccga

SEQ ID NO: 719377 - DNA, 25 bp, Artificial sequence
  Synthetic oligonucleotide
gcggcgctgaagatccgcgccttcg

SEQ ID NO: 719378 - DNA, 25 bp, Artificial sequence
  Synthetic oligonucleotide
tcagcaacccggtggtcgccggcgg

SEQ ID NO: 719379 - DNA, 25 bp, Artificial sequence
  Synthetic oligonucleotide
tcacggctggccaggtcagtttcac

SEQ ID NO: 719380 - DNA, 25 bp, Artificial sequence
  Synthetic oligonucleotide
ttgctcggccggatcgacaacaaca

SEQ ID NO: 719381 - DNA, 25 bp, Artificial sequence
  Synthetic oligonucleotide
accgtcgcctcggctcgtactacgg

SEQ ID NO: 719382 - DNA, 25 bp, Artificial sequence
  Synthetic oligonucleotide
gtggccaccgtcgcctcggctcgta

SEQ ID NO: 719383 - DNA, 25 bp, Artificial sequence
  Synthetic oligonucleotide
accagagtggccaccgtcgcctcgg

SEQ ID NO: 719384 - DNA, 25 bp, Artificial sequence
  Synthetic oligonucleotide
actacaaccagagtggccaccgtcg

SEQ ID NO: 719385 - DNA, 25 bp, Artificial sequence
  Synthetic oligonucleotide
ccaagtactacaaccagagtggcca

SEQ ID NO: 719386 - DNA, 25 bp, Artificial sequence
  Synthetic oligonucleotide
gtttcaccaagtactacaaccagag

SEQ ID NO: 719387 - DNA, 25 bp, Artificial sequence
  Synthetic oligonucleotide
cgcagaccttccgcggtgtgagcct

SEQ ID NO: 719388 - DNA, 25 bp, Artificial sequence
  Synthetic oligonucleotide
ctggccaggtcagtttcaccaagta

SEQ ID NO: 719389 - DNA, 25 bp, Artificial sequence
  Synthetic oligonucleotide
ccttccgcggtgtgagcctgaccaa

SEQ ID NO: 719390 - DNA, 25 bp, Artificial sequence
  Synthetic oligonucleotide
tgaccctcacggctggccaggtcag

SEQ ID NO: 719391 - DNA, 25 bp, Artificial sequence
  Synthetic oligonucleotide
gaggacctgaccctcacggctggcc

SEQ ID NO: 719392 - DNA, 25 bp, Artificial sequence
  Synthetic oligonucleotide
agtttcgaggacctgaccctcacgg

SEQ ID NO: 719393 - DNA, 25 bp, Artificial sequence
  Synthetic oligonucleotide
acaacagtttcgaggacctgaccct

SEQ ID NO: 719394 - DNA, 25 bp, Artificial sequence
  Synthetic oligonucleotide
tgaccaacaacagtttcgaggacct

SEQ ID NO: 719395 - DNA, 25 bp, Artificial sequence
  Synthetic oligonucleotide
tgagcctgaccaacaacagtttcga

SEQ ID NO: 719396 - DNA, 25 bp, Artificial sequence
  Synthetic oligonucleotide
gctcgtactacggcgaactgccggg

SEQ ID NO: 719397 - DNA, 25 bp, Artificial sequence
  Synthetic oligonucleotide
aggtcagtttcaccaagtactacaa

SEQ ID NO: 719398 - DNA, 25 bp, Artificial sequence
  Synthetic oligonucleotide
agctggacctgacccgggtcgatcc

SEQ ID NO: 719399 - DNA, 25 bp, Artificial sequence
  Synthetic oligonucleotide
cagcgccgacggcaagaacgccaag

SEQ ID NO: 719400 - DNA, 25 bp, Artificial sequence
  Synthetic oligonucleotide
ctggtacagcgccgacggcaagaac

SEQ ID NO: 719401 - DNA, 25 bp, Artificial sequence
  Synthetic oligonucleotide
cggcggctggtacagcgccgacggc

SEQ ID NO: 719402 - DNA, 25 bp, Artificial sequence
  Synthetic oligonucleotide
cggctacggcggctggtacagcgcc

SEQ ID NO: 719403 - DNA, 25 bp, Artificial sequence
  Synthetic oligonucleotide
acagccccggctacggcggctggta

SEQ ID NO: 719404 - DNA, 25 bp, Artificial sequence
  Synthetic oligonucleotide
gatccggacagccccggctacggcg

SEQ ID NO: 719405 - DNA, 25 bp, Artificial sequence
  Synthetic oligonucleotide
ccctcggcctacccggcctgagcgc

SEQ ID NO: 719406 - DNA, 25 bp, Artificial sequence
  Synthetic oligonucleotide
acctgacccgggtcgatccggacag

SEQ ID NO: 719407 - DNA, 25 bp, Artificial sequence
  Synthetic oligonucleotide
acgccaagcactgggaacgcgacct

SEQ ID NO: 719408 - DNA, 25 bp, Artificial sequence
  Synthetic oligonucleotide
gcggcaagctggacctgacccgggt

SEQ ID NO: 719409 - DNA, 25 bp, Artificial sequence
  Synthetic oligonucleotide
actcgcgcggcaagctggacctgac

SEQ ID NO: 719410 - DNA, 25 bp, Artificial sequence
  Synthetic oligonucleotide
ctcgtactcgcgcggcaagctggac

SEQ ID NO: 719411 - DNA, 25 bp, Artificial sequence
  Synthetic oligonucleotide
ctcggcctcgtactcgcgcggcaag

SEQ ID NO: 719412 - DNA, 25 bp, Artificial sequence
  Synthetic oligonucleotide
gagcgcctcggcctcgtactcgcgc

SEQ ID NO: 719413 - DNA, 25 bp, Artificial sequence
  Synthetic oligonucleotide
cggcctgagcgcctcggcctcgtac

SEQ ID NO: 719414 - DNA, 25 bp, Artificial sequence
  Synthetic oligonucleotide
agcggcgactcgttgctcggccgga

SEQ ID NO: 719415 - DNA, 25 bp, Artificial sequence
  Synthetic oligonucleotide
cgggtcgatccggacagccccggct

SEQ ID NO: 719416 - DNA, 25 bp, Artificial sequence
  Synthetic oligonucleotide
cagggcggtccggccaaggacctct

SEQ ID NO: 719417 - DNA, 25 bp, Artificial sequence
  Synthetic oligonucleotide
ggcggggcggcgctgaagatccgcg

SEQ ID NO: 719418 - DNA, 25 bp, Artificial sequence
  Synthetic oligonucleotide
acccaccgcggcaccggcggctaca

SEQ ID NO: 719419 - DNA, 25 bp, Artificial sequence
  Synthetic oligonucleotide
tgggccacccaccgcggcaccggcg

SEQ ID NO: 719420 - DNA, 25 bp, Artificial sequence
  Synthetic oligonucleotide
tgcgctgggccacccaccgcggcac

SEQ ID NO: 719421 - DNA, 25 bp, Artificial sequence
  Synthetic oligonucleotide
tgcgcctgcgctgggccacccaccg

SEQ ID NO: 719422 - DNA, 25 bp, Artificial sequence
  Synthetic oligonucleotide
ctcgctgcgcctgcgctgggccacc

SEQ ID NO: 719423 - DNA, 25 bp, Artificial sequence
  Synthetic oligonucleotide
ggacctctcgctgcgcctgcgctgg

SEQ ID NO: 719424 - DNA, 25 bp, Artificial sequence
  Synthetic oligonucleotide
cgacggcaagaacgccaagcactgg

SEQ ID NO: 719425 - DNA, 25 bp, Artificial sequence
  Synthetic oligonucleotide
ggtccggccaaggacctctcgctgc

SEQ ID NO: 719426 - DNA, 25 bp, Artificial sequence
  Synthetic oligonucleotide
caagaacgccaagcactgggaacgc

SEQ ID NO: 719427 - DNA, 25 bp, Artificial sequence
  Synthetic oligonucleotide
tacgtggtccagggcggtccggcca

SEQ ID NO: 719428 - DNA, 25 bp, Artificial sequence
  Synthetic oligonucleotide
ctgcagtacgtggtccagggcggtc

SEQ ID NO: 719429 - DNA, 25 bp, Artificial sequence
  Synthetic oligonucleotide
ctcgacctgcagtacgtggtccagg

SEQ ID NO: 719430 - DNA, 25 bp, Artificial sequence
  Synthetic oligonucleotide
cgcgacctcgacctgcagtacgtgg

SEQ ID NO: 719431 - DNA, 25 bp, Artificial sequence
  Synthetic oligonucleotide
tgggaacgcgacctcgacctgcagt

SEQ ID NO: 719432 - DNA, 25 bp, Artificial sequence
  Synthetic oligonucleotide
aagcactgggaacgcgacctcgacc

SEQ ID NO: 719433 - DNA, 25 bp, Artificial sequence
  Synthetic oligonucleotide
cgtcgccctcggcctacccggcctg

SEQ ID NO: 719434 - DNA, 25 bp, Artificial sequence
  Synthetic oligonucleotide
gccaaggacctctcgctgcgcctgc

SEQ ID NO: 719435 - DNA, 25 bp, Artificial sequence
  Synthetic oligonucleotide
gcggtcggctacaggcagcacaccg

SEQ ID NO: 719436 - DNA, 25 bp, Artificial sequence
  Synthetic oligonucleotide
acggcaacacgccgttcgactacat

SEQ ID NO: 719437 - DNA, 25 bp, Artificial sequence
  Synthetic oligonucleotide
aggtcaacggcaacacgccgttcga

SEQ ID NO: 719438 - DNA, 25 bp, Artificial sequence
  Synthetic oligonucleotide
tgcagaaggtcaacggcaacacgcc

SEQ ID NO: 719439 - DNA, 25 bp, Artificial sequence
  Synthetic oligonucleotide
cggtgctgcagaaggtcaacggcaa

SEQ ID NO: 719440 - DNA, 25 bp, Artificial sequence
  Synthetic oligonucleotide
tcaccgcggtgctgcagaaggtcaa

SEQ ID NO: 719441 - DNA, 25 bp, Artificial sequence
  Synthetic oligonucleotide
cacaccgtcaccgcggtgctgcaga

SEQ ID NO: 719442 - DNA, 25 bp, Artificial sequence
  Synthetic oligonucleotide
gcctacccggcctgagcgcctcggc

SEQ ID NO: 719443 - DNA, 25 bp, Artificial sequence
  Synthetic oligonucleotide
ggctacaggcagcacaccgtcaccg

SEQ ID NO: 719444 - DNA, 25 bp, Artificial sequence
  Synthetic oligonucleotide
actacatcaaccagggcgacagcat

SEQ ID NO: 719445 - DNA, 25 bp, Artificial sequence
  Synthetic oligonucleotide
catttcgcggtcggctacaggcagc

SEQ ID NO: 719446 - DNA, 25 bp, Artificial sequence
  Synthetic oligonucleotide
agcctgcatttcgcggtcggctaca

SEQ ID NO: 719447 - DNA, 25 bp, Artificial sequence
  Synthetic oligonucleotide
acctacagcctgcatttcgcggtcg

SEQ ID NO: 719448 - DNA, 25 bp, Artificial sequence
  Synthetic oligonucleotide
aacaacacctacagcctgcatttcg

SEQ ID NO: 719449 - DNA, 25 bp, Artificial sequence
  Synthetic oligonucleotide
gatcgacaacaacacctacagcctg

SEQ ID NO: 719450 - DNA, 25 bp, Artificial sequence
  Synthetic oligonucleotide
ggccggatcgacaacaacacctaca

SEQ ID NO: 719451 - DNA, 25 bp, Artificial sequence
  Synthetic oligonucleotide
accggcggctacagcgcggtggaca

SEQ ID NO: 719452 - DNA, 25 bp, Artificial sequence
  Synthetic oligonucleotide
aggcagcacaccgtcaccgcggtgc

SEQ ID NO: 719453 - DNA, 25 bp, Artificial sequence
  Synthetic oligonucleotide
agcagtattccgacttcaacggtcc

SEQ ID NO: 719454 - DNA, 25 bp, Artificial sequence
  Synthetic oligonucleotide
tacgacttcgtcgccctcggcctac

SEQ ID NO: 719455 - DNA, 25 bp, Artificial sequence
  Synthetic oligonucleotide
acgactacgacttcgtcgccctcgg

SEQ ID NO: 719456 - DNA, 25 bp, Artificial sequence
  Synthetic oligonucleotide
tgcaatacgactacgacttcgtcgc

SEQ ID NO: 719457 - DNA, 25 bp, Artificial sequence
  Synthetic oligonucleotide
ggaagctgcaatacgactacgactt

SEQ ID NO: 719458 - DNA, 25 bp, Artificial sequence
  Synthetic oligonucleotide
agtcctggaagctgcaatacgacta

SEQ ID NO: 719459 - DNA, 25 bp, Artificial sequence
  Synthetic oligonucleotide
acgagaagtcctggaagctgcaata

SEQ ID NO: 719460 - DNA, 25 bp, Artificial sequence
  Synthetic oligonucleotide
gtcccaacgagaagtcctggaagct

SEQ ID NO: 719461 - DNA, 25 bp, Artificial sequence
  Synthetic oligonucleotide
acacgccgttcgactacatcaacca

SEQ ID NO: 719462 - DNA, 25 bp, Artificial sequence
  Synthetic oligonucleotide
tccgacttcaacggtcccaacgaga

SEQ ID NO: 719463 - DNA, 25 bp, Artificial sequence
  Synthetic oligonucleotide
cgttcgactacatcaaccagggcga

SEQ ID NO: 719464 - DNA, 25 bp, Artificial sequence
  Synthetic oligonucleotide
actcgcagcagtattccgacttcaa

SEQ ID NO: 719465 - DNA, 25 bp, Artificial sequence
  Synthetic oligonucleotide
tcgacaactcgcagcagtattccga

SEQ ID NO: 719466 - DNA, 25 bp, Artificial sequence
  Synthetic oligonucleotide
tcttcctcgacaactcgcagcagta

SEQ ID NO: 719467 - DNA, 25 bp, Artificial sequence
  Synthetic oligonucleotide
acagcatcttcctcgacaactcgca

SEQ ID NO: 719468 - DNA, 25 bp, Artificial sequence
  Synthetic oligonucleotide
agggcgacagcatcttcctcgacaa

SEQ ID NO: 719469 - DNA, 25 bp, Artificial sequence
  Synthetic oligonucleotide
tcaaccagggcgacagcatcttcct

SEQ ID NO: 719470 - DNA, 25 bp, Artificial sequence
  Synthetic oligonucleotide
gactcgttgctcggccggatcgaca

SEQ ID NO: 719471 - DNA, 25 bp, Artificial sequence
  Synthetic oligonucleotide
tcaacggtcccaacgagaagtcctg

SEQ ID NO: 719472 - DNA, 25 bp, Artificial sequence
  Synthetic oligonucleotide
tcgccctcggcctgctggtggacga

SEQ ID NO: 719473 - DNA, 25 bp, Artificial sequence
  Synthetic oligonucleotide
atcgggctcaacgccagctccgccg

SEQ ID NO: 719474 - DNA, 25 bp, Artificial sequence
  Synthetic oligonucleotide
ggagatgatgatcacgcgcctcgaa

SEQ ID NO: 719475 - DNA, 25 bp, Artificial sequence
  Synthetic oligonucleotide
caccgtggagatgatgatcacgcgc

SEQ ID NO: 719476 - DNA, 25 bp, Artificial sequence
  Synthetic oligonucleotide
catgatcaccgtggagatgatgatc

SEQ ID NO: 719477 - DNA, 25 bp, Artificial sequence
  Synthetic oligonucleotide
cgatgccatgatcaccgtggagatg

SEQ ID NO: 719478 - DNA, 25 bp, Artificial sequence
  Synthetic oligonucleotide
gtggacgatgccatgatcaccgtgg

SEQ ID NO: 719479 - DNA, 25 bp, Artificial sequence
  Synthetic oligonucleotide
acgcgcctcgaactgggcgactcgc

SEQ ID NO: 719480 - DNA, 25 bp, Artificial sequence
  Synthetic oligonucleotide
ctcggcctgctggtggacgatgcca

SEQ ID NO: 719481 - DNA, 25 bp, Artificial sequence
  Synthetic oligonucleotide
tcgaactgggcgactcgctacacga

SEQ ID NO: 719482 - DNA, 25 bp, Artificial sequence
  Synthetic oligonucleotide
tgatcatcgccctcggcctgctggt

SEQ ID NO: 719483 - DNA, 25 bp, Artificial sequence
  Synthetic oligonucleotide
gcgcgctgatcatcgccctcggcct

SEQ ID NO: 719484 - DNA, 25 bp, Artificial sequence
  Synthetic oligonucleotide
ccctcggcgcgctgatcatcgccct

SEQ ID NO: 719485 - DNA, 25 bp, Artificial sequence
  Synthetic oligonucleotide
gggtttccctcggcgcgctgatcat

SEQ ID NO: 719486 - DNA, 25 bp, Artificial sequence
  Synthetic oligonucleotide
atgcagcgggtttccctcggcgcgc

SEQ ID NO: 719487 - DNA, 25 bp, Artificial sequence
  Synthetic oligonucleotide
tcaccatgcagcgggtttccctcgg

SEQ ID NO: 719488 - DNA, 25 bp, Artificial sequence
  Synthetic oligonucleotide
ccgacatcaccatgcagcgggtttc

SEQ ID NO: 719489 - DNA, 25 bp, Artificial sequence
  Synthetic oligonucleotide
ctgctggtggacgatgccatgatca

SEQ ID NO: 719490 - DNA, 25 bp, Artificial sequence
  Synthetic oligonucleotide
gacggccttcccgatgctcaccggg

SEQ ID NO: 719491 - DNA, 25 bp, Artificial sequence
  Synthetic oligonucleotide
atccgcttctacctgccgctggacc

SEQ ID NO: 719492 - DNA, 25 bp, Artificial sequence
  Synthetic oligonucleotide
ggcttcgtacccatcgggctcaacg

SEQ ID NO: 719493 - DNA, 25 bp, Artificial sequence
  Synthetic oligonucleotide
tggccggcttcgtacccatcgggct

SEQ ID NO: 719494 - DNA, 25 bp, Artificial sequence
  Synthetic oligonucleotide
gtgacggtggccggcttcgtaccca

SEQ ID NO: 719495 - DNA, 25 bp, Artificial sequence
  Synthetic oligonucleotide
gaccctggtgacggtggccggcttc

SEQ ID NO: 719496 - DNA, 25 bp, Artificial sequence
  Synthetic oligonucleotide
tcaccgggaccctggtgacggtggc

SEQ ID NO: 719497 - DNA, 25 bp, Artificial sequence
  Synthetic oligonucleotide
atgatcacgcgcctcgaactgggcg

SEQ ID NO: 719498 - DNA, 25 bp, Artificial sequence
  Synthetic oligonucleotide
cttcccgatgctcaccgggaccctg

SEQ ID NO: 719499 - DNA, 25 bp, Artificial sequence
  Synthetic oligonucleotide
cgtgttcatggaatacaccgacatc

SEQ ID NO: 719500 - DNA, 25 bp, Artificial sequence
  Synthetic oligonucleotide
cacctcgacggccttcccgatgctc

SEQ ID NO: 719501 - DNA, 25 bp, Artificial sequence
  Synthetic oligonucleotide
cgcctacacctcgacggccttcccg

SEQ ID NO: 719502 - DNA, 25 bp, Artificial sequence
  Synthetic oligonucleotide
gacctacgcctacacctcgacggcc

SEQ ID NO: 719503 - DNA, 25 bp, Artificial sequence
  Synthetic oligonucleotide
ctcggcgacctacgcctacacctcg

SEQ ID NO: 719504 - DNA, 25 bp, Artificial sequence
  Synthetic oligonucleotide
acacgactcggcgacctacgcctac

SEQ ID NO: 719505 - DNA, 25 bp, Artificial sequence
  Synthetic oligonucleotide
actcgctacacgactcggcgaccta

SEQ ID NO: 719506 - DNA, 25 bp, Artificial sequence
  Synthetic oligonucleotide
tgggcgactcgctacacgactcggc

SEQ ID NO: 719507 - DNA, 25 bp, Artificial sequence
  Synthetic oligonucleotide
gatgctcaccgggaccctggtgacg

SEQ ID NO: 719508 - DNA, 25 bp, Artificial sequence
  Synthetic oligonucleotide
tgcaccaggtgtcgaaccaggccca

SEQ ID NO: 719509 - DNA, 25 bp, Artificial sequence
  Synthetic oligonucleotide
gggcgctgttcgaggcggtggtgat

SEQ ID NO: 719510 - DNA, 25 bp, Artificial sequence
  Synthetic oligonucleotide
tcacccgggcgctgttcgaggcggt

SEQ ID NO: 719511 - DNA, 25 bp, Artificial sequence
  Synthetic oligonucleotide
gcggtttcacccgggcgctgttcga

SEQ ID NO: 719512 - DNA, 25 bp, Artificial sequence
  Synthetic oligonucleotide
tgaagaaggcggtcggcggtttcac

SEQ ID NO: 719513 - DNA, 25 bp, Artificial sequence
  Synthetic oligonucleotide
aggtggtgaagaaggcggtcggcgg

SEQ ID NO: 719514 - DNA, 25 bp, Artificial sequence
  Synthetic oligonucleotide
aggcccaggtggtgaagaaggcggt

SEQ ID NO: 719515 - DNA, 25 bp, Artificial sequence
  Synthetic oligonucleotide
aatacaccgacatcaccatgcagcg

SEQ ID NO: 719516 - DNA, 25 bp, Artificial sequence
  Synthetic oligonucleotide
aggtgtcgaaccaggcccaggtggt

SEQ ID NO: 719517 - DNA, 25 bp, Artificial sequence
  Synthetic oligonucleotide
tggtgatcgtcctcatcgtcagctt

SEQ ID NO: 719518 - DNA, 25 bp, Artificial sequence
  Synthetic oligonucleotide
cggcgtgcaccaggtgtcgaaccag

SEQ ID NO: 719519 - DNA, 25 bp, Artificial sequence
  Synthetic oligonucleotide
tggcgtcggcgtgcaccaggtgtcg

SEQ ID NO: 719520 - DNA, 25 bp, Artificial sequence
  Synthetic oligonucleotide
gccggttggcgtcggcgtgcaccag

SEQ ID NO: 719521 - DNA, 25 bp, Artificial sequence
  Synthetic oligonucleotide
cgaactgccggttggcgtcggcgtg

SEQ ID NO: 719522 - DNA, 25 bp, Artificial sequence
  Synthetic oligonucleotide
caccggcgaactgccggttggcgtc

SEQ ID NO: 719523 - DNA, 25 bp, Artificial sequence
  Synthetic oligonucleotide
gagatcaccggcgaactgccggttg

SEQ ID NO: 719524 - DNA, 25 bp, Artificial sequence
  Synthetic oligonucleotide
catgcaggagatcaccggcgaactg

SEQ ID NO: 719525 - DNA, 25 bp, Artificial sequence
  Synthetic oligonucleotide
cgaaccaggcccaggtggtgaagaa

SEQ ID NO: 719526 - DNA, 25 bp, Artificial sequence
  Synthetic oligonucleotide
cgcgccgggctggtggtggcctgct

SEQ ID NO: 719527 - DNA, 25 bp, Artificial sequence
  Synthetic oligonucleotide
ctcaacgccagctccgccggcgagt

SEQ ID NO: 719528 - DNA, 25 bp, Artificial sequence
  Synthetic oligonucleotide
ggtcttcgtgttcatggaatacacc

SEQ ID NO: 719529 - DNA, 25 bp, Artificial sequence
  Synthetic oligonucleotide
ggcgatggtcttcgtgttcatggaa

SEQ ID NO: 719530 - DNA, 25 bp, Artificial sequence
  Synthetic oligonucleotide
ggtgctggcgatggtcttcgtgttc

SEQ ID NO: 719531 - DNA, 25 bp, Artificial sequence
  Synthetic oligonucleotide
cccgctggtgctggcgatggtcttc

SEQ ID NO: 719532 - DNA, 25 bp, Artificial sequence
  Synthetic oligonucleotide
ctcgatcccgctggtgctggcgatg

SEQ ID NO: 719533 - DNA, 25 bp, Artificial sequence
  Synthetic oligonucleotide
tggcctgctcgatcccgctggtgct

SEQ ID NO: 719534 - DNA, 25 bp, Artificial sequence
  Synthetic oligonucleotide
tgttcgaggcggtggtgatcgtcct

SEQ ID NO: 719535 - DNA, 25 bp, Artificial sequence
  Synthetic oligonucleotide
cgggctggtggtggcctgctcgatc

SEQ ID NO: 719536 - DNA, 25 bp, Artificial sequence
  Synthetic oligonucleotide
aggcggtggtgatcgtcctcatcgt

SEQ ID NO: 719537 - DNA, 25 bp, Artificial sequence
  Synthetic oligonucleotide
ggcctgcgcgccgggctggtggtgg

SEQ ID NO: 719538 - DNA, 25 bp, Artificial sequence
  Synthetic oligonucleotide
agcctcggcctgcgcgccgggctgg

SEQ ID NO: 719539 - DNA, 25 bp, Artificial sequence
  Synthetic oligonucleotide
ttcgtcagcctcggcctgcgcgccg

SEQ ID NO: 719540 - DNA, 25 bp, Artificial sequence
  Synthetic oligonucleotide
gtcagcttcgtcagcctcggcctgc

SEQ ID NO: 719541 - DNA, 25 bp, Artificial sequence
  Synthetic oligonucleotide
tcatcgtcagcttcgtcagcctcgg

SEQ ID NO: 719542 - DNA, 25 bp, Artificial sequence
  Synthetic oligonucleotide
tcgtcctcatcgtcagcttcgtcag

SEQ ID NO: 719543 - DNA, 25 bp, Artificial sequence
  Synthetic oligonucleotide
tcatggaatacaccgacatcaccat

SEQ ID NO: 719544 - DNA, 25 bp, Artificial sequence
  Synthetic oligonucleotide
tggtggtggcctgctcgatcccgct

SEQ ID NO: 719545 - DNA, 25 bp, Artificial sequence
  Synthetic oligonucleotide
gtccagcaccagttcttcccgtctt

SEQ ID NO: 719546 - DNA, 25 bp, Artificial sequence
  Synthetic oligonucleotide
gtacccatcgggctcaacgccagct

SEQ ID NO: 719547 - DNA, 25 bp, Artificial sequence
  Synthetic oligonucleotide
acctcaacctgccgcagaacagcag

SEQ ID NO: 719548 - DNA, 25 bp, Artificial sequence
  Synthetic oligonucleotide
tggtcgacctcaacctgccgcagaa

SEQ ID NO: 719549 - DNA, 25 bp, Artificial sequence
  Synthetic oligonucleotide
aactgctggtcgacctcaacctgcc

SEQ ID NO: 719550 - DNA, 25 bp, Artificial sequence
  Synthetic oligonucleotide
gtccggaactgctggtcgacctcaa

SEQ ID NO: 719551 - DNA, 25 bp, Artificial sequence
  Synthetic oligonucleotide
ccgaccgtccggaactgctggtcga

SEQ ID NO: 719552 - DNA, 25 bp, Artificial sequence
  Synthetic oligonucleotide
gcagaacagcagcatccacgagacc

SEQ ID NO: 719553 - DNA, 25 bp, Artificial sequence
  Synthetic oligonucleotide
gcaccagttcttcccgtcttccgac

SEQ ID NO: 719554 - DNA, 25 bp, Artificial sequence
  Synthetic oligonucleotide
cagcagcatccacgagaccagggcg

SEQ ID NO: 719555 - DNA, 25 bp, Artificial sequence
  Synthetic oligonucleotide
aagttcgtccagcaccagttcttcc

SEQ ID NO: 719556 - DNA, 25 bp, Artificial sequence
  Synthetic oligonucleotide
tgatgaagttcgtccagcaccagtt

SEQ ID NO: 719557 - DNA, 25 bp, Artificial sequence
  Synthetic oligonucleotide
tgttcctgatgaagttcgtccagca

SEQ ID NO: 719558 - DNA, 25 bp, Artificial sequence
  Synthetic oligonucleotide
tgtcgctgttcctgatgaagttcgt

SEQ ID NO: 719559 - DNA, 25 bp, Artificial sequence
  Synthetic oligonucleotide
tcggcgtgtcgctgttcctgatgaa

SEQ ID NO: 719560 - DNA, 25 bp, Artificial sequence
  Synthetic oligonucleotide
tgctgttcggcgtgtcgctgttcct

SEQ ID NO: 719561 - DNA, 25 bp, Artificial sequence
  Synthetic oligonucleotide
accgcgctgctgttcggcgtgtcgc

SEQ ID NO: 719562 - DNA, 25 bp, Artificial sequence
  Synthetic oligonucleotide
cgtcttccgaccgtccggaactgct

SEQ ID NO: 719563 - DNA, 25 bp, Artificial sequence
  Synthetic oligonucleotide
cgctgaaggacgacgaggacatcga

SEQ ID NO: 719564 - DNA, 25 bp, Artificial sequence
  Synthetic oligonucleotide
ggcgcgatccgcttctacctgccgc

SEQ ID NO: 719565 - DNA, 25 bp, Artificial sequence
  Synthetic oligonucleotide
ggcgaaggcgcgatccgcttctacc

SEQ ID NO: 719566 - DNA, 25 bp, Artificial sequence
  Synthetic oligonucleotide
tacgtcggcgaaggcgcgatccgct

SEQ ID NO: 719567 - DNA, 25 bp, Artificial sequence
  Synthetic oligonucleotide
agcgcctacgtcggcgaaggcgcga

SEQ ID NO: 719568 - DNA, 25 bp, Artificial sequence
  Synthetic oligonucleotide
cactggagcgcctacgtcggcgaag

SEQ ID NO: 719569 - DNA, 25 bp, Artificial sequence
  Synthetic oligonucleotide
atcgaccactggagcgcctacgtcg

SEQ ID NO: 719570 - DNA, 25 bp, Artificial sequence
  Synthetic oligonucleotide
acctgccgcagaacagcagcatcca

SEQ ID NO: 719571 - DNA, 25 bp, Artificial sequence
  Synthetic oligonucleotide
ggacgacgaggacatcgaccactgg

SEQ ID NO: 719572 - DNA, 25 bp, Artificial sequence
  Synthetic oligonucleotide
tggacgaccatcttcctcaccgcgc

SEQ ID NO: 719573 - DNA, 25 bp, Artificial sequence
  Synthetic oligonucleotide
agcgacgctgaaggacgacgaggac

SEQ ID NO: 719574 - DNA, 25 bp, Artificial sequence
  Synthetic oligonucleotide
cctggaagcgacgctgaaggacgac

SEQ ID NO: 719575 - DNA, 25 bp, Artificial sequence
  Synthetic oligonucleotide
ggaccgcctggaagcgacgctgaag

SEQ ID NO: 719576 - DNA, 25 bp, Artificial sequence
  Synthetic oligonucleotide
gtgatggaccgcctggaagcgacgc

SEQ ID NO: 719577 - DNA, 25 bp, Artificial sequence
  Synthetic oligonucleotide
cagggcggtgatggaccgcctggaa

SEQ ID NO: 719578 - DNA, 25 bp, Artificial sequence
  Synthetic oligonucleotide
cgagaccagggcggtgatggaccgc

SEQ ID NO: 719579 - DNA, 25 bp, Artificial sequence
  Synthetic oligonucleotide
catccacgagaccagggcggtgatg

SEQ ID NO: 719580 - DNA, 25 bp, Artificial sequence
  Synthetic oligonucleotide
cgaggacatcgaccactggagcgcc

SEQ ID NO: 719581 - DNA, 25 bp, Artificial sequence
  Synthetic oligonucleotide
tcgccgtggcgctgctgctgtcgtg

SEQ ID NO: 719582 - DNA, 25 bp, Artificial sequence
  Synthetic oligonucleotide
cggtgatcgccgtgcacatcctgcc

SEQ ID NO: 719583 - DNA, 25 bp, Artificial sequence
  Synthetic oligonucleotide
tcgccccggtgatcgccgtgcacat

SEQ ID NO: 719584 - DNA, 25 bp, Artificial sequence
  Synthetic oligonucleotide
tgctgttcgccccggtgatcgccgt

SEQ ID NO: 719585 - DNA, 25 bp, Artificial sequence
  Synthetic oligonucleotide
tcgcggtgctgttcgccccggtgat

SEQ ID NO: 719586 - DNA, 25 bp, Artificial sequence
  Synthetic oligonucleotide
ggatcgtcgcggtgctgttcgcccc

SEQ ID NO: 719587 - DNA, 25 bp, Artificial sequence
  Synthetic oligonucleotide
tgtcgtggatcgtcgcggtgctgtt

SEQ ID NO: 719588 - DNA, 25 bp, Artificial sequence
  Synthetic oligonucleotide
ttcctcaccgcgctgctgttcggcg

SEQ ID NO: 719589 - DNA, 25 bp, Artificial sequence
  Synthetic oligonucleotide
tggcgctgctgctgtcgtggatcgt

SEQ ID NO: 719590 - DNA, 25 bp, Artificial sequence
  Synthetic oligonucleotide
atcctgccgaagactctcaagcaca

SEQ ID NO: 719591 - DNA, 25 bp, Artificial sequence
  Synthetic oligonucleotide
cagtgatcgccgtggcgctgctgct

SEQ ID NO: 719592 - DNA, 25 bp, Artificial sequence
  Synthetic oligonucleotide
tgttcgcagtgatcgccgtggcgct

SEQ ID NO: 719593 - DNA, 25 bp, Artificial sequence
  Synthetic oligonucleotide
tcaccctgttcgcagtgatcgccgt

SEQ ID NO: 719594 - DNA, 25 bp, Artificial sequence
  Synthetic oligonucleotide
tacaccttcaccctgttcgcagtga

SEQ ID NO: 719595 - DNA, 25 bp, Artificial sequence
  Synthetic oligonucleotide
ggcgagtacaccttcaccctgttcg

SEQ ID NO: 719596 - DNA, 25 bp, Artificial sequence
  Synthetic oligonucleotide
tccgccggcgagtacaccttcaccc

SEQ ID NO: 719597 - DNA, 25 bp, Artificial sequence
  Synthetic oligonucleotide
gccagctccgccggcgagtacacct

SEQ ID NO: 719598 - DNA, 25 bp, Artificial sequence
  Synthetic oligonucleotide
tgctgctgtcgtggatcgtcgcggt

SEQ ID NO: 719599 - DNA, 25 bp, Artificial sequence
  Synthetic oligonucleotide
ggccgcattgccgagcgtttcgaca

SEQ ID NO: 719600 - DNA, 25 bp, Artificial sequence
  Synthetic oligonucleotide
ctcgagttcggcgaggcgctcaatg

SEQ ID NO: 719601 - DNA, 25 bp, Artificial sequence
  Synthetic oligonucleotide
cggcgctggacgaccatcttcctca

SEQ ID NO: 719602 - DNA, 25 bp, Artificial sequence
  Synthetic oligonucleotide
atgcgccggcgctggacgaccatct

SEQ ID NO: 719603 - DNA, 25 bp, Artificial sequence
  Synthetic oligonucleotide
ctggcgatgcgccggcgctggacga

SEQ ID NO: 719604 - DNA, 25 bp, Artificial sequence
  Synthetic oligonucleotide
ctgcacctggcgatgcgccggcgct

SEQ ID NO: 719605 - DNA, 25 bp, Artificial sequence
  Synthetic oligonucleotide
agcctgctgcacctggcgatgcgcc

SEQ ID NO: 719606 - DNA, 25 bp, Artificial sequence
  Synthetic oligonucleotide
ttcgacagcctgctgcacctggcga

SEQ ID NO: 719607 - DNA, 25 bp, Artificial sequence
  Synthetic oligonucleotide
atcgccgtgcacatcctgccgaaga

SEQ ID NO: 719608 - DNA, 25 bp, Artificial sequence
  Synthetic oligonucleotide
attgccgagcgtttcgacagcctgc

SEQ ID NO: 719609 - DNA, 25 bp, Artificial sequence
  Synthetic oligonucleotide
gtgcacatcctgccgaagactctca

SEQ ID NO: 719610 - DNA, 25 bp, Artificial sequence
  Synthetic oligonucleotide
gaagaagggccgcattgccgagcgt

SEQ ID NO: 719611 - DNA, 25 bp, Artificial sequence
  Synthetic oligonucleotide
cggagcagaagaagggccgcattgc

SEQ ID NO: 719612 - DNA, 25 bp, Artificial sequence
  Synthetic oligonucleotide
acaagtcggagcagaagaagggccg

SEQ ID NO: 719613 - DNA, 25 bp, Artificial sequence
  Synthetic oligonucleotide
tcaagcacaagtcggagcagaagaa

SEQ ID NO: 719614 - DNA, 25 bp, Artificial sequence
  Synthetic oligonucleotide
gactctcaagcacaagtcggagcag

SEQ ID NO: 719615 - DNA, 25 bp, Artificial sequence
  Synthetic oligonucleotide
gccgaagactctcaagcacaagtcg

SEQ ID NO: 719616 - DNA, 25 bp, Artificial sequence
  Synthetic oligonucleotide
accatcttcctcaccgcgctgctgt

SEQ ID NO: 719617 - DNA, 25 bp, Artificial sequence
  Synthetic oligonucleotide
gagcgtttcgacagcctgctgcacc

SEQ ID NO: 719618 - DNA, 25 bp, Artificial sequence
  Synthetic oligonucleotide
aagagctacacgcgacccggcgaat

SEQ ID NO: 719619 - DNA, 25 bp, Artificial sequence
  Synthetic oligonucleotide
ctcaatgcgcgcatgcaggagatca

SEQ ID NO: 719620 - DNA, 25 bp, Artificial sequence
  Synthetic oligonucleotide
tcaaggacaccaccaaggccggcga

SEQ ID NO: 719621 - DNA, 25 bp, Artificial sequence
  Synthetic oligonucleotide
gtctacctcaaggacaccaccaagg

SEQ ID NO: 719622 - DNA, 25 bp, Artificial sequence
  Synthetic oligonucleotide
gtcttcgtctacctcaaggacacca

SEQ ID NO: 719623 - DNA, 25 bp, Artificial sequence
  Synthetic oligonucleotide
tcgacggtcttcgtctacctcaagg

SEQ ID NO: 719624 - DNA, 25 bp, Artificial sequence
  Synthetic oligonucleotide
ggcgaatcgacggtcttcgtctacc

SEQ ID NO: 719625 - DNA, 25 bp, Artificial sequence
  Synthetic oligonucleotide
ccaaggccggcgacatcccggatat

SEQ ID NO: 719626 - DNA, 25 bp, Artificial sequence
  Synthetic oligonucleotide
tacacgcgacccggcgaatcgacgg

SEQ ID NO: 719627 - DNA, 25 bp, Artificial sequence
  Synthetic oligonucleotide
ccggcgacatcccggatatctggta

SEQ ID NO: 719628 - DNA, 25 bp, Artificial sequence
  Synthetic oligonucleotide
tacgtgaagagctacacgcgacccg

SEQ ID NO: 719629 - DNA, 25 bp, Artificial sequence
  Synthetic oligonucleotide
ctggattacgtgaagagctacacgc

SEQ ID NO: 719630 - DNA, 25 bp, Artificial sequence
  Synthetic oligonucleotide
gactcgctggattacgtgaagagct

SEQ ID NO: 719631 - DNA, 25 bp, Artificial sequence
  Synthetic oligonucleotide
gagctggactcgctggattacgtga

SEQ ID NO: 719632 - DNA, 25 bp, Artificial sequence
  Synthetic oligonucleotide
gctcgaggagctggactcgctggat

SEQ ID NO: 719633 - DNA, 25 bp, Artificial sequence
  Synthetic oligonucleotide
aagaagctcgaggagctggactcgc

SEQ ID NO: 719634 - DNA, 25 bp, Artificial sequence
  Synthetic oligonucleotide
catcgagaagaagctcgaggagctg

SEQ ID NO: 719635 - DNA, 25 bp, Artificial sequence
  Synthetic oligonucleotide
cgacccggcgaatcgacggtcttcg

SEQ ID NO: 719636 - DNA, 25 bp, Artificial sequence
  Synthetic oligonucleotide
acatccagggcgaattcccccaggg

SEQ ID NO: 719637 - DNA, 25 bp, Artificial sequence
  Synthetic oligonucleotide
tcggcagcgtctacgccttcaccgc

SEQ ID NO: 719638 - DNA, 25 bp, Artificial sequence
  Synthetic oligonucleotide
gacgtgttcggcagcgtctacgcct

SEQ ID NO: 719639 - DNA, 25 bp, Artificial sequence
  Synthetic oligonucleotide
ttcggcgacgtgttcggcagcgtct

SEQ ID NO: 719640 - DNA, 25 bp, Artificial sequence
  Synthetic oligonucleotide
gacgagttcggcgacgtgttcggca

SEQ ID NO: 719641 - DNA, 25 bp, Artificial sequence
  Synthetic oligonucleotide
tttcaacgacgagttcggcgacgtg

SEQ ID NO: 719642 - DNA, 25 bp, Artificial sequence
  Synthetic oligonucleotide
cagggcatccagggaccgggtttca

SEQ ID NO: 719643 - DNA, 25 bp, Artificial sequence
  Synthetic oligonucleotide
acaccaccaaggccggcgacatccc

SEQ ID NO: 719644 - DNA, 25 bp, Artificial sequence
  Synthetic oligonucleotide
agggcgaattcccccagggcatcca

SEQ ID NO: 719645 - DNA, 25 bp, Artificial sequence
  Synthetic oligonucleotide
tggagcaggtcaccgaccgcatcga

SEQ ID NO: 719646 - DNA, 25 bp, Artificial sequence
  Synthetic oligonucleotide
tatccgacatccagggcgaattccc

SEQ ID NO: 719647 - DNA, 25 bp, Artificial sequence
  Synthetic oligonucleotide
agaagatatccgacatccagggcga

SEQ ID NO: 719648 - DNA, 25 bp, Artificial sequence
  Synthetic oligonucleotide
tgcgcaagaagatatccgacatcca

SEQ ID NO: 719649 - DNA, 25 bp, Artificial sequence
  Synthetic oligonucleotide
accaggtgcgcaagaagatatccga

SEQ ID NO: 719650 - DNA, 25 bp, Artificial sequence
  Synthetic oligonucleotide
tctggtaccaggtgcgcaagaagat

SEQ ID NO: 719651 - DNA, 25 bp, Artificial sequence
  Synthetic oligonucleotide
cggatatctggtaccaggtgcgcaa

SEQ ID NO: 719652 - DNA, 25 bp, Artificial sequence
  Synthetic oligonucleotide
acatcccggatatctggtaccaggt

SEQ ID NO: 719653 - DNA, 25 bp, Artificial sequence
  Synthetic oligonucleotide
gaattcccccagggcatccagggac

SEQ ID NO: 719654 - DNA, 25 bp, Artificial sequence
  Synthetic oligonucleotide
gggccctgcgccaccagtccctggt

SEQ ID NO: 719655 - DNA, 25 bp, Artificial sequence
  Synthetic oligonucleotide
tggtgatgggcgtgttctcctacct

SEQ ID NO: 719656 - DNA, 25 bp, Artificial sequence
  Synthetic oligonucleotide
tatcgctggtgatgggcgtgttctc

SEQ ID NO: 719657 - DNA, 25 bp, Artificial sequence
  Synthetic oligonucleotide
tggcggtatcgctggtgatgggcgt

SEQ ID NO: 719658 - DNA, 25 bp, Artificial sequence
  Synthetic oligonucleotide
acctgatggcggtatcgctggtgat

SEQ ID NO: 719659 - DNA, 25 bp, Artificial sequence
  Synthetic oligonucleotide
tctggtacctgatggcggtatcgct

SEQ ID NO: 719660 - DNA, 25 bp, Artificial sequence
  Synthetic oligonucleotide
ccctggtctggtacctgatggcggt

SEQ ID NO: 719661 - DNA, 25 bp, Artificial sequence
  Synthetic oligonucleotide
gaccgcatcgagaagaagctcgagg

SEQ ID NO: 719662 - DNA, 25 bp, Artificial sequence
  Synthetic oligonucleotide
tgcgccaccagtccctggtctggta

SEQ ID NO: 719663 - DNA, 25 bp, Artificial sequence
  Synthetic oligonucleotide
cctacctcaacctggggcgcgagga

SEQ ID NO: 719664 - DNA, 25 bp, Artificial sequence
  Synthetic oligonucleotide
cggactgggccctgcgccaccagtc

SEQ ID NO: 719665 - DNA, 25 bp, Artificial sequence
  Synthetic oligonucleotide
acctgtcggactgggccctgcgcca

SEQ ID NO: 719666 - DNA, 25 bp, Artificial sequence
  Synthetic oligonucleotide
tttcaacctgtcggactgggccctg

SEQ ID NO: 719667 - DNA, 25 bp, Artificial sequence
  Synthetic oligonucleotide
agggcggtttcaacctgtcggactg

SEQ ID NO: 719668 - DNA, 25 bp, Artificial sequence
  Synthetic oligonucleotide
gatgaagggcggtttcaacctgtcg

SEQ ID NO: 719669 - DNA, 25 bp, Artificial sequence
  Synthetic oligonucleotide
tgatcgagctgaccctgtcccagcg

SEQ ID NO: 719670 - DNA, 25 bp, Artificial sequence
  Synthetic oligonucleotide
ccgatgagggggaagccaaagaagg

SEQ ID NO: 719671 - DNA, 25 bp, Artificial sequence
  Synthetic oligonucleotide
accagtccctggtctggtacctgat

SEQ ID NO: 719672 - DNA, 25 bp, Artificial sequence
  Synthetic oligonucleotide
tcaagaccatggtcatccagacccg

SEQ ID NO: 719673 - DNA, 25 bp, Artificial sequence
  Synthetic oligonucleotide
ttcaccgccgatggcctggacttcc

SEQ ID NO: 719674 - DNA, 25 bp, Artificial sequence
  Synthetic oligonucleotide
acaccctggagcaggtcaccgaccg

SEQ ID NO: 719675 - DNA, 25 bp, Artificial sequence
  Synthetic oligonucleotide
tggacgacaccctggagcaggtcac

SEQ ID NO: 719676 - DNA, 25 bp, Artificial sequence
  Synthetic oligonucleotide
cacggtggacgacaccctggagcag

SEQ ID NO: 719677 - DNA, 25 bp, Artificial sequence
  Synthetic oligonucleotide
gggcgccacggtggacgacaccctg

SEQ ID NO: 719678 - DNA, 25 bp, Artificial sequence
  Synthetic oligonucleotide
ctggccgggcgccacggtggacgac

SEQ ID NO: 719679 - DNA, 25 bp, Artificial sequence
  Synthetic oligonucleotide
gacccgctggccgggcgccacggtg

SEQ ID NO: 719680 - DNA, 25 bp, Artificial sequence
  Synthetic oligonucleotide
tgggcgtgttctcctacctcaacct

SEQ ID NO: 719681 - DNA, 25 bp, Artificial sequence
  Synthetic oligonucleotide
ccatggtcatccagacccgctggcc

SEQ ID NO: 719682 - DNA, 25 bp, Artificial sequence
  Synthetic oligonucleotide
tgttctcctacctcaacctggggcg

SEQ ID NO: 719683 - DNA, 25 bp, Artificial sequence
  Synthetic oligonucleotide
tcgccatcaagaccatggtcatcca

SEQ ID NO: 719684 - DNA, 25 bp, Artificial sequence
  Synthetic oligonucleotide
cctcgttcgccatcaagaccatggt

SEQ ID NO: 719685 - DNA, 25 bp, Artificial sequence
  Synthetic oligonucleotide
aggatccctcgttcgccatcaagac

SEQ ID NO: 719686 - DNA, 25 bp, Artificial sequence
  Synthetic oligonucleotide
gcgaggaggatccctcgttcgccat

SEQ ID NO: 719687 - DNA, 25 bp, Artificial sequence
  Synthetic oligonucleotide
tggggcgcgaggaggatccctcgtt

SEQ ID NO: 719688 - DNA, 25 bp, Artificial sequence
  Synthetic oligonucleotide
tcaacctggggcgcgaggaggatcc

SEQ ID NO: 719689 - DNA, 25 bp, Artificial sequence
  Synthetic oligonucleotide
ggtcaccgaccgcatcgagaagaag

SEQ ID NO: 719690 - DNA, 25 bp, Artificial sequence
  Synthetic oligonucleotide
catccagacccgctggccgggcgcc

SEQ ID NO: 719691 - DNA, 25 bp, Artificial sequence
  Synthetic oligonucleotide
ctgcaggcggtcaacctgcgggtca

SEQ ID NO: 719692 - DNA, 25 bp, Artificial sequence
  Synthetic oligonucleotide
ccgacctggccagcatcagccgcga

SEQ ID NO: 719693 - DNA, 25 bp, Artificial sequence
  Synthetic oligonucleotide
ggctgtccgacctggccagcatcag

SEQ ID NO: 719694 - DNA, 25 bp, Artificial sequence
  Synthetic oligonucleotide
ttctaccggctgtccgacctggcca

SEQ ID NO: 719695 - DNA, 25 bp, Artificial sequence
  Synthetic oligonucleotide
gatcgtttctaccggctgtccgacc

SEQ ID NO: 719696 - DNA, 25 bp, Artificial sequence
  Synthetic oligonucleotide
tcaacgatcgtttctaccggctgtc

SEQ ID NO: 719697 - DNA, 25 bp, Artificial sequence
  Synthetic oligonucleotide
tgcgggtcaacgatcgtttctaccg

SEQ ID NO: 719698 - DNA, 25 bp, Artificial sequence
  Synthetic oligonucleotide
ggccggccccgagcgcatctcggtg

SEQ ID NO: 719699 - DNA, 25 bp, Artificial sequence
  Synthetic oligonucleotide
ggcggtcaacctgcgggtcaacgat

SEQ ID NO: 719700 - DNA, 25 bp, Artificial sequence
  Synthetic oligonucleotide
gccgcgatttcgtcgacccgccgac

SEQ ID NO: 719701 - DNA, 25 bp, Artificial sequence
  Synthetic oligonucleotide
aaaggacctgcaggcggtcaacctg

SEQ ID NO: 719702 - DNA, 25 bp, Artificial sequence
  Synthetic oligonucleotide
ttcggaaaaggacctgcaggcggtc

SEQ ID NO: 719703 - DNA, 25 bp, Artificial sequence
  Synthetic oligonucleotide
cttccgttcggaaaaggacctgcag

SEQ ID NO: 719704 - DNA, 25 bp, Artificial sequence
  Synthetic oligonucleotide
gcgcacctccggcaacttccgttcg

SEQ ID NO: 719705 - DNA, 25 bp, Artificial sequence
  Synthetic oligonucleotide
ctcggtgcgcacctccggcaacttc

SEQ ID NO: 719706 - DNA, 25 bp, Artificial sequence
  Synthetic oligonucleotide
gcgcatctcggtgcgcacctccggc

SEQ ID NO: 719707 - DNA, 25 bp, Artificial sequence
  Synthetic oligonucleotide
gcgtctacgccttcaccgccgatgg

SEQ ID NO: 719708 - DNA, 25 bp, Artificial sequence
  Synthetic oligonucleotide
caacctgcgggtcaacgatcgtttc

SEQ ID NO: 719709 - DNA, 25 bp, Artificial sequence
  Synthetic oligonucleotide
agggcgagccggccatcggcctggc

SEQ ID NO: 719710 - DNA, 25 bp, Artificial sequence
  Synthetic oligonucleotide
tgcgcgcatgcaggagatcaccggc

SEQ ID NO: 719711 - DNA, 25 bp, Artificial sequence
  Synthetic oligonucleotide
caatatcctcgagttcggcgaggcg

SEQ ID NO: 719712 - DNA, 25 bp, Artificial sequence
  Synthetic oligonucleotide
gggcggcaatatcctcgagttcggc

SEQ ID NO: 719713 - DNA, 25 bp, Artificial sequence
  Synthetic oligonucleotide
gaaggagggcggcaatatcctcgag

SEQ ID NO: 719714 - DNA, 25 bp, Artificial sequence
  Synthetic oligonucleotide
ggcgatgaaggagggcggcaatatc

SEQ ID NO: 719715 - DNA, 25 bp, Artificial sequence
  Synthetic oligonucleotide
ggcggtggcgatgaaggagggcggc

SEQ ID NO: 719716 - DNA, 25 bp, Artificial sequence
  Synthetic oligonucleotide
cggcctggcggtggcgatgaaggag

SEQ ID NO: 719717 - DNA, 25 bp, Artificial sequence
  Synthetic oligonucleotide
tggccagcatcagccgcgatttcgt

SEQ ID NO: 719718 - DNA, 25 bp, Artificial sequence
  Synthetic oligonucleotide
gagccggccatcggcctggcggtgg

SEQ ID NO: 719719 - DNA, 25 bp, Artificial sequence
  Synthetic oligonucleotide
gcatcagccgcgatttcgtcgaccc

SEQ ID NO: 719720 - DNA, 25 bp, Artificial sequence
  Synthetic oligonucleotide
gctacaagggcgagccggccatcgg

SEQ ID NO: 719721 - DNA, 25 bp, Artificial sequence
  Synthetic oligonucleotide
tgttccgctacaagggcgagccggc

SEQ ID NO: 719722 - DNA, 25 bp, Artificial sequence
  Synthetic oligonucleotide
ctcgctgttccgctacaagggcgag

SEQ ID NO: 719723 - DNA, 25 bp, Artificial sequence
  Synthetic oligonucleotide
cgccgacctcgctgttccgctacaa

SEQ ID NO: 719724 - DNA, 25 bp, Artificial sequence
  Synthetic oligonucleotide
tcgacccgccgacctcgctgttccg

SEQ ID NO: 719725 - DNA, 25 bp, Artificial sequence
  Synthetic oligonucleotide
atttcgtcgacccgccgacctcgct

SEQ ID NO: 719726 - DNA, 25 bp, Artificial sequence
  Synthetic oligonucleotide
ggtcgaggccggccccgagcgcatc

SEQ ID NO: 719727 - DNA, 25 bp, Artificial sequence
  Synthetic oligonucleotide
ggccatcggcctggcggtggcgatg

SEQ ID NO: 719728 - DNA, 25 bp, Artificial sequence
  Synthetic oligonucleotide
gtggagaaggtgcgcctggacatcc

SEQ ID NO: 719729 - DNA, 25 bp, Artificial sequence
  Synthetic oligonucleotide
tgatcggtgcgcagaacgaggtcat

SEQ ID NO: 719730 - DNA, 25 bp, Artificial sequence
  Synthetic oligonucleotide
tgcagatgatcggtgcgcagaacga

SEQ ID NO: 719731 - DNA, 25 bp, Artificial sequence
  Synthetic oligonucleotide
caaggtgcagatgatcggtgcgcag

SEQ ID NO: 719732 - DNA, 25 bp, Artificial sequence
  Synthetic oligonucleotide
cctgggcaaggtgcagatgatcggt

SEQ ID NO: 719733 - DNA, 25 bp, Artificial sequence
  Synthetic oligonucleotide
gaaagacctgggcaaggtgcagatg

SEQ ID NO: 719734 - DNA, 25 bp, Artificial sequence
  Synthetic oligonucleotide
gacatccgctcggtgaaagacctgg

SEQ ID NO: 719735 - DNA, 25 bp, Artificial sequence
  Synthetic oligonucleotide
ccccgagcgcatctcggtgcgcacc

SEQ ID NO: 719736 - DNA, 25 bp, Artificial sequence
  Synthetic oligonucleotide
aaggtgcgcctggacatccgctcgg

SEQ ID NO: 719737 - DNA, 25 bp, Artificial sequence
  Synthetic oligonucleotide
aggtcatctacctcaacttctctac

SEQ ID NO: 719738 - DNA, 25 bp, Artificial sequence
  Synthetic oligonucleotide
gactacgtggagaaggtgcgcctgg

SEQ ID NO: 719739 - DNA, 25 bp, Artificial sequence
  Synthetic oligonucleotide
ctgcgcgactacgtggagaaggtgc

SEQ ID NO: 719740 - DNA, 25 bp, Artificial sequence
  Synthetic oligonucleotide
cgccagctgcgcgactacgtggaga

SEQ ID NO: 719741 - DNA, 25 bp, Artificial sequence
  Synthetic oligonucleotide
gacttccgccagctgcgcgactacg

SEQ ID NO: 719742 - DNA, 25 bp, Artificial sequence
  Synthetic oligonucleotide
ggcctggacttccgccagctgcgcg

SEQ ID NO: 719743 - DNA, 25 bp, Artificial sequence
  Synthetic oligonucleotide
gccgatggcctggacttccgccagc

SEQ ID NO: 719744 - DNA, 25 bp, Artificial sequence
  Synthetic oligonucleotide
ttcggcgaggcgctcaatgcgcgca

SEQ ID NO: 719745 - DNA, 25 bp, Artificial sequence
  Synthetic oligonucleotide
cgcctggacatccgctcggtgaaag

SEQ ID NO: 719746 - DNA, 25 bp, Artificial sequence
  Synthetic oligonucleotide
tcggtctcgaccagcgccaggtcgt

SEQ ID NO: 719747 - DNA, 25 bp, Artificial sequence
  Synthetic oligonucleotide
cggcgtggtcgaggccggccccgag

SEQ ID NO: 719748 - DNA, 25 bp, Artificial sequence
  Synthetic oligonucleotide
tgaccccgtccggcgtggtcgaggc

SEQ ID NO: 719749 - DNA, 25 bp, Artificial sequence
  Synthetic oligonucleotide
cagaacgcggtgaccccgtccggcg

SEQ ID NO: 719750 - DNA, 25 bp, Artificial sequence
  Synthetic oligonucleotide
aggcgcagaacgcggtgaccccgtc

SEQ ID NO: 719751 - DNA, 25 bp, Artificial sequence
  Synthetic oligonucleotide
gcctgcaggcgcagaacgcggtgac

SEQ ID NO: 719752 - DNA, 25 bp, Artificial sequence
  Synthetic oligonucleotide
tgcagagcctgcaggcgcagaacgc

SEQ ID NO: 719753 - DNA, 25 bp, Artificial sequence
  Synthetic oligonucleotide
aggtcgtgcagagcctgcaggcgca

SEQ ID NO: 719754 - DNA, 25 bp, Artificial sequence
  Synthetic oligonucleotide
gtgcgcagaacgaggtcatctacct

SEQ ID NO: 719755 - DNA, 25 bp, Artificial sequence
  Synthetic oligonucleotide
tcgaccagcgccaggtcgtgcagag

SEQ ID NO: 719756 - DNA, 25 bp, Artificial sequence
  Synthetic oligonucleotide
agaacgaggtcatctacctcaactt

SEQ ID NO: 719757 - DNA, 25 bp, Artificial sequence
  Synthetic oligonucleotide
ccgccctcggtctcgaccagcgcca

SEQ ID NO: 719758 - DNA, 25 bp, Artificial sequence
  Synthetic oligonucleotide
agctggccgccctcggtctcgacca

SEQ ID NO: 719759 - DNA, 25 bp, Artificial sequence
  Synthetic oligonucleotide
cccgcaagctggccgccctcggtct

SEQ ID NO: 719760 - DNA, 25 bp, Artificial sequence
  Synthetic oligonucleotide
tctctacccgcaagctggccgccct

SEQ ID NO: 719761 - DNA, 25 bp, Artificial sequence
  Synthetic oligonucleotide
tcaacttctctacccgcaagctggc

SEQ ID NO: 719762 - DNA, 25 bp, Artificial sequence
  Synthetic oligonucleotide
tctacctcaacttctctacccgcaa

SEQ ID NO: 719763 - DNA, 25 bp, Artificial sequence
  Synthetic oligonucleotide
acgccttcaccgccgatggcctgga

SEQ ID NO: 719764 - DNA, 25 bp, Artificial sequence
  Synthetic oligonucleotide
gcgccaggtcgtgcagagcctgcag

SEQ ID NO: 719765 - DNA, 25 bp, Artificial sequence
  Synthetic oligonucleotide
gtcgccgccacgctgctcacgctga

SEQ ID NO: 719766 - DNA, 25 bp, Artificial sequence
  Synthetic oligonucleotide
cgttgctgccgaccggcacgccgat

SEQ ID NO: 719767 - DNA, 25 bp, Artificial sequence
  Synthetic oligonucleotide
cggattccggaaccgggacgctgag

SEQ ID NO: 719768 - DNA, 25 bp, Artificial sequence
  Synthetic oligonucleotide
gcgctgtacgtcgcctggtaccgga

SEQ ID NO: 719769 - DNA, 25 bp, Artificial sequence
  Synthetic oligonucleotide
ctgccggcgctgtacgtcgcctggt

SEQ ID NO: 719770 - DNA, 25 bp, Artificial sequence
  Synthetic oligonucleotide
atcttcctgccggcgctgtacgtcg

SEQ ID NO: 719771 - DNA, 25 bp, Artificial sequence
  Synthetic oligonucleotide
acgctgatcttcctgccggcgctgt

SEQ ID NO: 719772 - DNA, 25 bp, Artificial sequence
  Synthetic oligonucleotide
ccgggacgctgagcgcggcgtaagg

SEQ ID NO: 719773 - DNA, 25 bp, Artificial sequence
  Synthetic oligonucleotide
gccacgctgctcacgctgatcttcc

SEQ ID NO: 719774 - DNA, 25 bp, Artificial sequence
  Synthetic oligonucleotide
gctgagcgcggcgtaaggggaaggg

SEQ ID NO: 719775 - DNA, 25 bp, Artificial sequence
  Synthetic oligonucleotide
ggcatcgtcgccgccacgctgctca

SEQ ID NO: 719776 - DNA, 25 bp, Artificial sequence
  Synthetic oligonucleotide
atcggcggcatcgtcgccgccacgc

SEQ ID NO: 719777 - DNA, 25 bp, Artificial sequence
  Synthetic oligonucleotide
gcgatgatcggcggcatcgtcgccg

SEQ ID NO: 719778 - DNA, 25 bp, Artificial sequence
  Synthetic oligonucleotide
gcctatgcgatgatcggcggcatcg

SEQ ID NO: 719779 - DNA, 25 bp, Artificial sequence
  Synthetic oligonucleotide
ccgatggcctatgcgatgatcggcg

SEQ ID NO: 719780 - DNA, 25 bp, Artificial sequence
  Synthetic oligonucleotide
tgggggccgatggcctatgcgatga

SEQ ID NO: 719781 - DNA, 25 bp, Artificial sequence
  Synthetic oligonucleotide
gtgttctgggggccgatggcctatg

SEQ ID NO: 719782 - DNA, 25 bp, Artificial sequence
  Synthetic oligonucleotide
ctgctcacgctgatcttcctgccgg

SEQ ID NO: 719783 - DNA, 25 bp, Artificial sequence
  Synthetic oligonucleotide
agcggacggcgggtgggccatccgc

SEQ ID NO: 719784 - DNA, 25 bp, Artificial sequence
  Synthetic oligonucleotide
cgttgctacggcgacggcggccagt

SEQ ID NO: 719785 - DNA, 25 bp, Artificial sequence
  Synthetic oligonucleotide
tccccgacgtggtgatcgagctgac

SEQ ID NO: 719786 - DNA, 25 bp, Artificial sequence
  Synthetic oligonucleotide
agggtatgcccggcgttgctacggc

SEQ ID NO: 719787 - DNA, 25 bp, Artificial sequence
  Synthetic oligonucleotide
ccgggcagggtatgcccggcgttgc

SEQ ID NO: 719788 - DNA, 25 bp, Artificial sequence
  Synthetic oligonucleotide
ccgacgccgggcagggtatgcccgg

SEQ ID NO: 719789 - DNA, 25 bp, Artificial sequence
  Synthetic oligonucleotide
ccgccccgacgccgggcagggtatg

SEQ ID NO: 719790 - DNA, 25 bp, Artificial sequence
  Synthetic oligonucleotide
ccggaaccgggacgctgagcgcggc

SEQ ID NO: 719791 - DNA, 25 bp, Artificial sequence
  Synthetic oligonucleotide
gcgggtgggccatccgccccgacgc

SEQ ID NO: 719792 - DNA, 25 bp, Artificial sequence
  Synthetic oligonucleotide
atccccatcgcccgcgaagtgttct

SEQ ID NO: 719793 - DNA, 25 bp, Artificial sequence
  Synthetic oligonucleotide
gaaggagagcggacggcgggtgggc

SEQ ID NO: 719794 - DNA, 25 bp, Artificial sequence
  Synthetic oligonucleotide
tgcggggggaaggagagcggacggc

SEQ ID NO: 719795 - DNA, 25 bp, Artificial sequence
  Synthetic oligonucleotide
gagtctgtgcggggggaaggagagc

SEQ ID NO: 719796 - DNA, 25 bp, Artificial sequence
  Synthetic oligonucleotide
tagcagagtctgtgcggggggaagg

SEQ ID NO: 719797 - DNA, 25 bp, Artificial sequence
  Synthetic oligonucleotide
cgccgtagcagagtctgtgcggggg

SEQ ID NO: 719798 - DNA, 25 bp, Artificial sequence
  Synthetic oligonucleotide
gggcgccgccgtagcagagtctgtg

SEQ ID NO: 719799 - DNA, 25 bp, Artificial sequence
  Synthetic oligonucleotide
gggaagggggcgccgccgtagcaga

SEQ ID NO: 719800 - DNA, 25 bp, Artificial sequence
  Synthetic oligonucleotide
gggccatccgccccgacgccgggca

SEQ ID NO: 719801 - DNA, 25 bp, Artificial sequence
  Synthetic oligonucleotide
ttctcgcgctgatcggcatcatcat

SEQ ID NO: 719802 - DNA, 25 bp, Artificial sequence
  Synthetic oligonucleotide
ccagatcgatgccttcgagaaagac

SEQ ID NO: 719803 - DNA, 25 bp, Artificial sequence
  Synthetic oligonucleotide
tggtgacccagatcgatgccttcga

SEQ ID NO: 719804 - DNA, 25 bp, Artificial sequence
  Synthetic oligonucleotide
tgatcctggtgacccagatcgatgc

SEQ ID NO: 719805 - DNA, 25 bp, Artificial sequence
  Synthetic oligonucleotide
actcggtgatcctggtgacccagat

SEQ ID NO: 719806 - DNA, 25 bp, Artificial sequence
  Synthetic oligonucleotide
tccgcaactcggtgatcctggtgac

SEQ ID NO: 719807 - DNA, 25 bp, Artificial sequence
  Synthetic oligonucleotide
tcatcatccgcaactcggtgatcct

SEQ ID NO: 719808 - DNA, 25 bp, Artificial sequence
  Synthetic oligonucleotide
cgcgaagtgttctgggggccgatgg

SEQ ID NO: 719809 - DNA, 25 bp, Artificial sequence
  Synthetic oligonucleotide
cgctgatcggcatcatcatccgcaa

SEQ ID NO: 719810 - DNA, 25 bp, Artificial sequence
  Synthetic oligonucleotide
gaaagacggcaagacgccctgggaa

SEQ ID NO: 719811 - DNA, 25 bp, Artificial sequence
  Synthetic oligonucleotide
tcgggattctcgcgctgatcggcat

SEQ ID NO: 719812 - DNA, 25 bp, Artificial sequence
  Synthetic oligonucleotide
cgatcctcgggattctcgcgctgat

SEQ ID NO: 719813 - DNA, 25 bp, Artificial sequence
  Synthetic oligonucleotide
tcgtggcgatcctcgggattctcgc

SEQ ID NO: 719814 - DNA, 25 bp, Artificial sequence
  Synthetic oligonucleotide
gggcttcgtggcgatcctcgggatt

SEQ ID NO: 719815 - DNA, 25 bp, Artificial sequence
  Synthetic oligonucleotide
cgccgatgggcttcgtggcgatcct

SEQ ID NO: 719816 - DNA, 25 bp, Artificial sequence
  Synthetic oligonucleotide
ccggcacgccgatgggcttcgtggc

SEQ ID NO: 719817 - DNA, 25 bp, Artificial sequence
  Synthetic oligonucleotide
tgccgaccggcacgccgatgggctt

SEQ ID NO: 719818 - DNA, 25 bp, Artificial sequence
  Synthetic oligonucleotide
tcggcatcatcatccgcaactcggt

SEQ ID NO: 719819 - DNA, 25 bp, Artificial sequence
  Synthetic oligonucleotide
ccaccaccgcacccggccgatcctg

SEQ ID NO: 719820 - DNA, 25 bp, Artificial sequence
  Synthetic oligonucleotide
ataggcagcccggcgtcagggaaaa

SEQ ID NO: 719821 - DNA, 25 bp, Artificial sequence
  Synthetic oligonucleotide
gggatgatccccatcgcccgcgaag

SEQ ID NO: 719822 - DNA, 25 bp, Artificial sequence
  Synthetic oligonucleotide
cagcctggggatgatccccatcgcc

SEQ ID NO: 719823 - DNA, 25 bp, Artificial sequence
  Synthetic oligonucleotide
ggcggccagcctggggatgatcccc

SEQ ID NO: 719824 - DNA, 25 bp, Artificial sequence
  Synthetic oligonucleotide
ggcggcggcggccagcctggggatg

SEQ ID NO: 719825 - DNA, 25 bp, Artificial sequence
  Synthetic oligonucleotide
tgctgacggcggcggcggccagcct

SEQ ID NO: 719826 - DNA, 25 bp, Artificial sequence
  Synthetic oligonucleotide
cgatcctgctgacggcggcggcggc

SEQ ID NO: 719827 - DNA, 25 bp, Artificial sequence
  Synthetic oligonucleotide
cgatgccttcgagaaagacggcaag

SEQ ID NO: 719828 - DNA, 25 bp, Artificial sequence
  Synthetic oligonucleotide
accgcacccggccgatcctgctgac

SEQ ID NO: 719829 - DNA, 25 bp, Artificial sequence
  Synthetic oligonucleotide
cttcgagaaagacggcaagacgccc

SEQ ID NO: 719830 - DNA, 25 bp, Artificial sequence
  Synthetic oligonucleotide
agccacccaccaccgcacccggccg

SEQ ID NO: 719831 - DNA, 25 bp, Artificial sequence
  Synthetic oligonucleotide
ctggaagccacccaccaccgcaccc

SEQ ID NO: 719832 - DNA, 25 bp, Artificial sequence
  Synthetic oligonucleotide
gccgtgctggaagccacccaccacc

SEQ ID NO: 719833 - DNA, 25 bp, Artificial sequence
  Synthetic oligonucleotide
ctgggaagccgtgctggaagccacc

SEQ ID NO: 719834 - DNA, 25 bp, Artificial sequence
  Synthetic oligonucleotide
gacgccctgggaagccgtgctggaa

SEQ ID NO: 719835 - DNA, 25 bp, Artificial sequence
  Synthetic oligonucleotide
cggcaagacgccctgggaagccgtg

SEQ ID NO: 719836 - DNA, 25 bp, Artificial sequence
  Synthetic oligonucleotide
atcgcccgcgaagtgttctgggggc

SEQ ID NO: 719837 - DNA, 25 bp, Artificial sequence
  Synthetic oligonucleotide
ccggccgatcctgctgacggcggcg

SEQ ID NO: 719838 - DNA, 25 bp, Artificial sequence
  Synthetic oligonucleotide
aacggtgccgcgggatcctcgagga

SEQ ID NO: 719839 - DNA, 25 bp, Artificial sequence
  Synthetic oligonucleotide
ccgccggcgcgcacatccgcccctg

SEQ ID NO: 719840 - DNA, 25 bp, Artificial sequence
  Synthetic oligonucleotide
ccgaagccgccggcgcgcacatccg

SEQ ID NO: 719841 - DNA, 25 bp, Artificial sequence
  Synthetic oligonucleotide
ccgaggccgaagccgccggcgcgca

SEQ ID NO: 719842 - DNA, 25 bp, Artificial sequence
  Synthetic oligonucleotide
aggtcgccgaggccgaagccgccgg

SEQ ID NO: 719843 - DNA, 25 bp, Artificial sequence
  Synthetic oligonucleotide
acatcgaggtcgccgaggccgaagc

SEQ ID NO: 719844 - DNA, 25 bp, Artificial sequence
  Synthetic oligonucleotide
tcgaggacatcgaggtcgccgaggc

SEQ ID NO: 719845 - DNA, 25 bp, Artificial sequence
  Synthetic oligonucleotide
gcaccacccggcgcctggccctgac

SEQ ID NO: 719846 - DNA, 25 bp, Artificial sequence
  Synthetic oligonucleotide
gccgcgggatcctcgaggacatcga

SEQ ID NO: 719847 - DNA, 25 bp, Artificial sequence
  Synthetic oligonucleotide
gcccctgcggccgcttgcgcgtgca

SEQ ID NO: 719848 - DNA, 25 bp, Artificial sequence
  Synthetic oligonucleotide
acctggaacggtgccgcgggatcct

SEQ ID NO: 719849 - DNA, 25 bp, Artificial sequence
  Synthetic oligonucleotide
agcgttacctggaacggtgccgcgg

SEQ ID NO: 719850 - DNA, 25 bp, Artificial sequence
  Synthetic oligonucleotide
ccggcgagcgttacctggaacggtg

SEQ ID NO: 719851 - DNA, 25 bp, Artificial sequence
  Synthetic oligonucleotide
ccgaagccggcgagcgttacctgga

SEQ ID NO: 719852 - DNA, 25 bp, Artificial sequence
  Synthetic oligonucleotide
cctgaccgaagccggcgagcgttac

SEQ ID NO: 719853 - DNA, 25 bp, Artificial sequence
  Synthetic oligonucleotide
gcctggccctgaccgaagccggcga

SEQ ID NO: 719854 - DNA, 25 bp, Artificial sequence
  Synthetic oligonucleotide
gacggcggccagtataggcagcccg

SEQ ID NO: 719855 - DNA, 25 bp, Artificial sequence
  Synthetic oligonucleotide
ggatcctcgaggacatcgaggtcgc

SEQ ID NO: 719856 - DNA, 25 bp, Artificial sequence
  Synthetic oligonucleotide
agcatcacctggtgccgatgatcgc

SEQ ID NO: 719857 - DNA, 25 bp, Artificial sequence
  Synthetic oligonucleotide
acgtggtgatcgagctgaccctgtc

SEQ ID NO: 719858 - DNA, 25 bp, Artificial sequence
  Synthetic oligonucleotide
gaggcgctcaatgcgcgcatgcagg

SEQ ID NO: 719859 - DNA, 25 bp, Artificial sequence
  Synthetic oligonucleotide
ttctacctgccgctggaccagcagt

SEQ ID NO: 719860 - DNA, 25 bp, Artificial sequence
  Synthetic oligonucleotide
cactgttccccgacgtggtgatcga

SEQ ID NO: 719861 - DNA, 25 bp, Artificial sequence
  Synthetic oligonucleotide
acggcgcactgttccccgacgtggt

SEQ ID NO: 719862 - DNA, 25 bp, Artificial sequence
  Synthetic oligonucleotide
cccgctacggcgcactgttccccga

SEQ ID NO: 719863 - DNA, 25 bp, Artificial sequence
  Synthetic oligonucleotide
tgatcgcccgctacggcgcactgtt

SEQ ID NO: 719864 - DNA, 25 bp, Artificial sequence
  Synthetic oligonucleotide
ggcgcgcacatccgcccctgcggcc

SEQ ID NO: 719865 - DNA, 25 bp, Artificial sequence
  Synthetic oligonucleotide
acctggtgccgatgatcgcccgcta

SEQ ID NO: 719866 - DNA, 25 bp, Artificial sequence
  Synthetic oligonucleotide
cacatccgcccctgcggccgcttgc

SEQ ID NO: 719867 - DNA, 25 bp, Artificial sequence
  Synthetic oligonucleotide
tgggccagcatcacctggtgccgat

SEQ ID NO: 719868 - DNA, 25 bp, Artificial sequence
  Synthetic oligonucleotide
tgggcatgggccagcatcacctggt

SEQ ID NO: 719869 - DNA, 25 bp, Artificial sequence
  Synthetic oligonucleotide
tcgctgatgggcatgggccagcatc

SEQ ID NO: 719870 - DNA, 25 bp, Artificial sequence
  Synthetic oligonucleotide
cgtgcagtcgctgatgggcatgggc

SEQ ID NO: 719871 - DNA, 25 bp, Artificial sequence
  Synthetic oligonucleotide
cttgcgcgtgcagtcgctgatgggc

SEQ ID NO: 719872 - DNA, 25 bp, Artificial sequence
  Synthetic oligonucleotide
cggccgcttgcgcgtgcagtcgctg

SEQ ID NO: 719873 - DNA, 25 bp, Artificial sequence
  Synthetic oligonucleotide
tgcaccgcaccacccggcgcctggc

SEQ ID NO: 719874 - DNA, 25 bp, Artificial sequence
  Synthetic oligonucleotide
tgccgatgatcgcccgctacggcgc

SEQ ID NO: 719875 - DNA, 25 bp, Artificial sequence
  Synthetic oligonucleotide
gttttgcaaccgaggtaatagtgga

SEQ ID NO: 719876 - DNA, 25 bp, Artificial sequence
  Synthetic oligonucleotide
tgttcgccagggtggtggacagcgg

SEQ ID NO: 719877 - DNA, 25 bp, Artificial sequence
  Synthetic oligonucleotide
gcgcgtgttcgccagggtggtggac

SEQ ID NO: 719878 - DNA, 25 bp, Artificial sequence
  Synthetic oligonucleotide
aggcatgcgcgtgttcgccagggtg

SEQ ID NO: 719879 - DNA, 25 bp, Artificial sequence
  Synthetic oligonucleotide
attgcaaggcatgcgcgtgttcgcc

SEQ ID NO: 719880 - DNA, 25 bp, Artificial sequence
  Synthetic oligonucleotide
gacacattgcaaggcatgcgcgtgt

SEQ ID NO: 719881 - DNA, 25 bp, Artificial sequence
  Synthetic oligonucleotide
atagtggacacattgcaaggcatgc

SEQ ID NO: 719882 - DNA, 25 bp, Artificial sequence
  Synthetic oligonucleotide
cccggcgcctggccctgaccgaagc

SEQ ID NO: 719883 - DNA, 25 bp, Artificial sequence
  Synthetic oligonucleotide
gcaaccgaggtaatagtggacacat

SEQ ID NO: 719884 - DNA, 25 bp, Artificial sequence
  Synthetic oligonucleotide
acagcggcagcttcacttccgccgc

SEQ ID NO: 719885 - DNA, 25 bp, Artificial sequence
  Synthetic oligonucleotide
gaatctgttttgcaaccgaggtaat

SEQ ID NO: 719886 - DNA, 25 bp, Artificial sequence
  Synthetic oligonucleotide
atttacgaatctgttttgcaaccga

SEQ ID NO: 719887 - DNA, 25 bp, Artificial sequence
  Synthetic oligonucleotide
cgaccaatttacgaatctgttttgc

SEQ ID NO: 719888 - DNA, 25 bp, Artificial sequence
  Synthetic oligonucleotide
aaaatccgaccaatttacgaatctg

SEQ ID NO: 719889 - DNA, 25 bp, Artificial sequence
  Synthetic oligonucleotide
cggcgtcagggaaaatccgaccaat

SEQ ID NO: 719890 - DNA, 25 bp, Artificial sequence
  Synthetic oligonucleotide
cagcccggcgtcagggaaaatccga

SEQ ID NO: 719891 - DNA, 25 bp, Artificial sequence
  Synthetic oligonucleotide
tgcccggcgttgctacggcgacggc

SEQ ID NO: 719892 - DNA, 25 bp, Artificial sequence
  Synthetic oligonucleotide
gaggtaatagtggacacattgcaag

SEQ ID NO: 719893 - DNA, 25 bp, Artificial sequence
  Synthetic oligonucleotide
ccaccgcgcaggtatcgcggctgat

SEQ ID NO: 719894 - DNA, 25 bp, Artificial sequence
  Synthetic oligonucleotide
gcctgctgcaccgcaccacccggcg

SEQ ID NO: 719895 - DNA, 25 bp, Artificial sequence
  Synthetic oligonucleotide
agacgcgcctgctgcaccgcaccac

SEQ ID NO: 719896 - DNA, 25 bp, Artificial sequence
  Synthetic oligonucleotide
acctgcagacgcgcctgctgcaccg

SEQ ID NO: 719897 - DNA, 25 bp, Artificial sequence
  Synthetic oligonucleotide
aggcgcacctgcagacgcgcctgct

SEQ ID NO: 719898 - DNA, 25 bp, Artificial sequence
  Synthetic oligonucleotide
acctggaggcgcacctgcagacgcg

SEQ ID NO: 719899 - DNA, 25 bp, Artificial sequence
  Synthetic oligonucleotide
tctccgacctggaggcgcacctgca

SEQ ID NO: 719900 - DNA, 25 bp, Artificial sequence
  Synthetic oligonucleotide
ggctgatctccgacctggaggcgca

SEQ ID NO: 719901 - DNA, 25 bp, Artificial sequence
  Synthetic oligonucleotide
ccagggtggtggacagcggcagctt

SEQ ID NO: 719902 - DNA, 25 bp, Artificial sequence
  Synthetic oligonucleotide
cgcaggtatcgcggctgatctccga

SEQ ID NO: 719903 - DNA, 25 bp, Artificial sequence
  Synthetic oligonucleotide
tggtggacagcggcagcttcacttc

SEQ ID NO: 719904 - DNA, 25 bp, Artificial sequence
  Synthetic oligonucleotide
acctgtccaccgcgcaggtatcgcg

SEQ ID NO: 719905 - DNA, 25 bp, Artificial sequence
  Synthetic oligonucleotide
ccctggacctgtccaccgcgcaggt

SEQ ID NO: 719906 - DNA, 25 bp, Artificial sequence
  Synthetic oligonucleotide
cccaggccctggacctgtccaccgc

SEQ ID NO: 719907 - DNA, 25 bp, Artificial sequence
  Synthetic oligonucleotide
ccgccgcccaggccctggacctgtc

SEQ ID NO: 719908 - DNA, 25 bp, Artificial sequence
  Synthetic oligonucleotide
tcacttccgccgcccaggccctgga

SEQ ID NO: 719909 - DNA, 25 bp, Artificial sequence
  Synthetic oligonucleotide
gcagcttcacttccgccgcccaggc

SEQ ID NO: 719910 - DNA, 25 bp, Artificial sequence
  Synthetic oligonucleotide
gccagtataggcagcccggcgtcag

SEQ ID NO: 719911 - DNA, 25 bp, Artificial sequence
  Synthetic oligonucleotide
tatcgcggctgatctccgacctgga

SEQ ID NO: 719912 - DNA, 25 bp, Artificial sequence
  Synthetic oligonucleotide
gcgatatcgtctacgactggaacga

SEQ ID NO: 719913 - DNA, 25 bp, Artificial sequence
  Synthetic oligonucleotide
catcgcccaggacaaggcgcgccag

SEQ ID NO: 719914 - DNA, 25 bp, Artificial sequence
  Synthetic oligonucleotide
gatcgacatcgcccaggacaaggcg

SEQ ID NO: 719915 - DNA, 25 bp, Artificial sequence
  Synthetic oligonucleotide
gctcaagatcgacatcgcccaggac

SEQ ID NO: 719916 - DNA, 25 bp, Artificial sequence
  Synthetic oligonucleotide
gaagatgctcaagatcgacatcgcc

SEQ ID NO: 719917 - DNA, 25 bp, Artificial sequence
  Synthetic oligonucleotide
gcccgggaagatgctcaagatcgac

SEQ ID NO: 719918 - DNA, 25 bp, Artificial sequence
  Synthetic oligonucleotide
gaacgagcccgggaagatgctcaag

SEQ ID NO: 719919 - DNA, 25 bp, Artificial sequence
  Synthetic oligonucleotide
tcatcggccgcgccgaggatagcga

SEQ ID NO: 719920 - DNA, 25 bp, Artificial sequence
  Synthetic oligonucleotide
tcgtctacgactggaacgagcccgg

SEQ ID NO: 719921 - DNA, 25 bp, Artificial sequence
  Synthetic oligonucleotide
gccagctcgggctttcctccgagga

SEQ ID NO: 719922 - DNA, 25 bp, Artificial sequence
  Synthetic oligonucleotide
acatcggcgatatcgtctacgactg

SEQ ID NO: 719923 - DNA, 25 bp, Artificial sequence
  Synthetic oligonucleotide
acccgaacatcggcgatatcgtcta

SEQ ID NO: 719924 - DNA, 25 bp, Artificial sequence
  Synthetic oligonucleotide
acggcaacccgaacatcggcgatat

SEQ ID NO: 719925 - DNA, 25 bp, Artificial sequence
  Synthetic oligonucleotide
tgctcgacggcaacccgaacatcgg

SEQ ID NO: 719926 - DNA, 25 bp, Artificial sequence
  Synthetic oligonucleotide
ccggcgtgctcgacggcaacccgaa

SEQ ID NO: 719927 - DNA, 25 bp, Artificial sequence
  Synthetic oligonucleotide
gcctggccggcgtgctcgacggcaa

SEQ ID NO: 719928 - DNA, 25 bp, Artificial sequence
  Synthetic oligonucleotide
ccatgggcctggccggcgtgctcga

SEQ ID NO: 719929 - DNA, 25 bp, Artificial sequence
  Synthetic oligonucleotide
acgactggaacgagcccgggaagat

SEQ ID NO: 719930 - DNA, 25 bp, Artificial sequence
  Synthetic oligonucleotide
acagcgtggtgaccggcagcgcggt

SEQ ID NO: 719931 - DNA, 25 bp, Artificial sequence
  Synthetic oligonucleotide
tgaacgtcatcggccgcgccgagga

SEQ ID NO: 719932 - DNA, 25 bp, Artificial sequence
  Synthetic oligonucleotide
acctggtgaacgtcatcggccgcgc

SEQ ID NO: 719933 - DNA, 25 bp, Artificial sequence
  Synthetic oligonucleotide
acatctacctggtgaacgtcatcgg

SEQ ID NO: 719934 - DNA, 25 bp, Artificial sequence
  Synthetic oligonucleotide
gcgacgacatctacctggtgaacgt

SEQ ID NO: 719935 - DNA, 25 bp, Artificial sequence
  Synthetic oligonucleotide
aggtgcgcgacgacatctacctggt

SEQ ID NO: 719936 - DNA, 25 bp, Artificial sequence
  Synthetic oligonucleotide
tgacccaggtgcgcgacgacatcta

SEQ ID NO: 719937 - DNA, 25 bp, Artificial sequence
  Synthetic oligonucleotide
gcgcggtgacccaggtgcgcgacga

SEQ ID NO: 719938 - DNA, 25 bp, Artificial sequence
  Synthetic oligonucleotide
caggacaaggcgcgccagctcgggc

SEQ ID NO: 719939 - DNA, 25 bp, Artificial sequence
  Synthetic oligonucleotide
tggtgaccggcagcgcggtgaccca

SEQ ID NO: 719940 - DNA, 25 bp, Artificial sequence
  Synthetic oligonucleotide
aaggcgcgccagctcgggctttcct

SEQ ID NO: 719941 - DNA, 25 bp, Artificial sequence
  Synthetic oligonucleotide
catgaacagcgtggtgaccggcagc

SEQ ID NO: 719942 - DNA, 25 bp, Artificial sequence
  Synthetic oligonucleotide
gcagatcatgaacagcgtggtgacc

SEQ ID NO: 719943 - DNA, 25 bp, Artificial sequence
  Synthetic oligonucleotide
cgtggcgcagatcatgaacagcgtg

SEQ ID NO: 719944 - DNA, 25 bp, Artificial sequence
  Synthetic oligonucleotide
cgaggacgtggcgcagatcatgaac

SEQ ID NO: 719945 - DNA, 25 bp, Artificial sequence
  Synthetic oligonucleotide
tttcctccgaggacgtggcgcagat

SEQ ID NO: 719946 - DNA, 25 bp, Artificial sequence
  Synthetic oligonucleotide
tcgggctttcctccgaggacgtggc

SEQ ID NO: 719947 - DNA, 25 bp, Artificial sequence
  Synthetic oligonucleotide
gacaaggtccgcgagtacgccatgg

SEQ ID NO: 719948 - DNA, 25 bp, Artificial sequence
  Synthetic oligonucleotide
ccggcagcgcggtgacccaggtgcg

SEQ ID NO: 719949 - DNA, 25 bp, Artificial sequence
  Synthetic oligonucleotide
ggccagctggtgatcgtcaccaagg

SEQ ID NO: 719950 - DNA, 25 bp, Artificial sequence
  Synthetic oligonucleotide
gagtacgccatgggcctggccggcg

SEQ ID NO: 719951 - DNA, 25 bp, Artificial sequence
  Synthetic oligonucleotide
gccgcacgcctgcgcgatcgcttgc

SEQ ID NO: 719952 - DNA, 25 bp, Artificial sequence
  Synthetic oligonucleotide
gcgcgtcgccgcacgcctgcgcgat

SEQ ID NO: 719953 - DNA, 25 bp, Artificial sequence
  Synthetic oligonucleotide
cccgcgagcgcgtcgccgcacgcct

SEQ ID NO: 719954 - DNA, 25 bp, Artificial sequence
  Synthetic oligonucleotide
tggaggcccgcgagcgcgtcgccgc

SEQ ID NO: 719955 - DNA, 25 bp, Artificial sequence
  Synthetic oligonucleotide
aggacctggaggcccgcgagcgcgt

SEQ ID NO: 719956 - DNA, 25 bp, Artificial sequence
  Synthetic oligonucleotide
tcaccaaggacctggaggcccgcga

SEQ ID NO: 719957 - DNA, 25 bp, Artificial sequence
  Synthetic oligonucleotide
gcgcgatcgcttgcgcaaggactac

SEQ ID NO: 719958 - DNA, 25 bp, Artificial sequence
  Synthetic oligonucleotide
ctggtgatcgtcaccaaggacctgg

SEQ ID NO: 719959 - DNA, 25 bp, Artificial sequence
  Synthetic oligonucleotide
tcgcttgcgcaaggactacgtcggc

SEQ ID NO: 719960 - DNA, 25 bp, Artificial sequence
  Synthetic oligonucleotide
ttctatggccagctggtgatcgtca

SEQ ID NO: 719961 - DNA, 25 bp, Artificial sequence
  Synthetic oligonucleotide
aacaacttctatggccagctggtga

SEQ ID NO: 719962 - DNA, 25 bp, Artificial sequence
  Synthetic oligonucleotide
tcgcggcgttgctgccgaccggcac

SEQ ID NO: 719963 - DNA, 25 bp, Artificial sequence
  Synthetic oligonucleotide
cagcagttgcagaacaacttctatg

SEQ ID NO: 719964 - DNA, 25 bp, Artificial sequence
  Synthetic oligonucleotide
tacggcgacggcggccagtataggc

SEQ ID NO: 719965 - DNA, 25 bp, Artificial sequence
  Synthetic oligonucleotide
ctggaccagcagttgcagaacaact

SEQ ID NO: 719966 - DNA, 25 bp, Artificial sequence
  Synthetic oligonucleotide
ctgccgctggaccagcagttgcaga

SEQ ID NO: 719967 - DNA, 25 bp, Artificial sequence
  Synthetic oligonucleotide
gatcgtcaccaaggacctggaggcc

SEQ ID NO: 719968 - DNA, 25 bp, Artificial sequence
  Synthetic oligonucleotide
tggagatggggccgccggtgggacg

SEQ ID NO: 719969 - DNA, 25 bp, Artificial sequence
  Synthetic oligonucleotide
ttgcagaacaacttctatggccagc

SEQ ID NO: 719970 - DNA, 25 bp, Artificial sequence
  Synthetic oligonucleotide
gcagatcgacaaggtccgcgagtac

SEQ ID NO: 719971 - DNA, 25 bp, Artificial sequence
  Synthetic oligonucleotide
cggaccgcagatcgacaaggtccgc

SEQ ID NO: 719972 - DNA, 25 bp, Artificial sequence
  Synthetic oligonucleotide
ggtcagcggaccgcagatcgacaag

SEQ ID NO: 719973 - DNA, 25 bp, Artificial sequence
  Synthetic oligonucleotide
agtaccgggtcagcggaccgcagat

SEQ ID NO: 719974 - DNA, 25 bp, Artificial sequence
  Synthetic oligonucleotide
gatccagtaccgggtcagcggaccg

SEQ ID NO: 719975 - DNA, 25 bp, Artificial sequence
  Synthetic oligonucleotide
gacggccgatccagtaccgggtcag

SEQ ID NO: 719976 - DNA, 25 bp, Artificial sequence
  Synthetic oligonucleotide
acgcctgcgcgatcgcttgcgcaag

SEQ ID NO: 719977 - DNA, 25 bp, Artificial sequence
  Synthetic oligonucleotide
ggccgccggtgggacggccgatcca

SEQ ID NO: 719978 - DNA, 25 bp, Artificial sequence
  Synthetic oligonucleotide
gtccgcgagtacgccatgggcctgg

SEQ ID NO: 719979 - DNA, 25 bp, Artificial sequence
  Synthetic oligonucleotide
agccgctggagatggggccgccggt

SEQ ID NO: 719980 - DNA, 25 bp, Artificial sequence
  Synthetic oligonucleotide
acgtgcagccgctggagatggggcc

SEQ ID NO: 719981 - DNA, 25 bp, Artificial sequence
  Synthetic oligonucleotide
gcacctacgtgcagccgctggagat

SEQ ID NO: 719982 - DNA, 25 bp, Artificial sequence
  Synthetic oligonucleotide
gcatcagcacctacgtgcagccgct

SEQ ID NO: 719983 - DNA, 25 bp, Artificial sequence
  Synthetic oligonucleotide
cgtcggcatcagcacctacgtgcag

SEQ ID NO: 719984 - DNA, 25 bp, Artificial sequence
  Synthetic oligonucleotide
ggactacgtcggcatcagcacctac

SEQ ID NO: 719985 - DNA, 25 bp, Artificial sequence
  Synthetic oligonucleotide
gcgcaaggactacgtcggcatcagc

SEQ ID NO: 719986 - DNA, 25 bp, Artificial sequence
  Synthetic oligonucleotide
cggtgggacggccgatccagtaccg

SEQ ID NO: 719987 - DNA, 25 bp, Artificial sequence
  Synthetic oligonucleotide
atcgaagtgggcggcacggtggagg

SEQ ID NO: 719988 - DNA, 25 bp, Artificial sequence
  Synthetic oligonucleotide
gcgccggaggtcaagcgcttcgccg

SEQ ID NO: 719989 - DNA, 25 bp, Artificial sequence
  Synthetic oligonucleotide
gcccgatcgccaaggtggtgccgct

SEQ ID NO: 719990 - DNA, 25 bp, Artificial sequence
  Synthetic oligonucleotide
ccgagggcccgatcgccaaggtggt

SEQ ID NO: 719991 - DNA, 25 bp, Artificial sequence
  Synthetic oligonucleotide
gcaaggccgagggcccgatcgccaa

SEQ ID NO: 719992 - DNA, 25 bp, Artificial sequence
  Synthetic oligonucleotide
gagagcggcaaggccgagggcccga

SEQ ID NO: 719993 - DNA, 25 bp, Artificial sequence
  Synthetic oligonucleotide
gtggaggagagcggcaaggccgagg

SEQ ID NO: 719994 - DNA, 25 bp, Artificial sequence
  Synthetic oligonucleotide
aggtggtgccgctgatgctgttcct

SEQ ID NO: 719995 - DNA, 25 bp, Artificial sequence
  Synthetic oligonucleotide
gtgggcggcacggtggaggagagcg

SEQ ID NO: 719996 - DNA, 25 bp, Artificial sequence
  Synthetic oligonucleotide
tgccgctgatgctgttcctcatggc

SEQ ID NO: 719997 - DNA, 25 bp, Artificial sequence
  Synthetic oligonucleotide
taccggatcgaagtgggcggcacgg

SEQ ID NO: 719998 - DNA, 25 bp, Artificial sequence
  Synthetic oligonucleotide
gcgaactaccggatcgaagtgggcg

SEQ ID NO: 719999 - DNA, 25 bp, Artificial sequence
  Synthetic oligonucleotide
ctgccggcgaactaccggatcgaag

SEQ ID NO: 720000 - DNA, 25 bp, Artificial sequence
  Synthetic oligonucleotide
gacggcctgccggcgaactaccgga

SEQ ID NO: 720001 - DNA, 25 bp, Artificial sequence
  Synthetic oligonucleotide
ttcgccgacggcctgccggcgaact

SEQ ID NO: 720002 - DNA, 25 bp, Artificial sequence
  Synthetic oligonucleotide
aagcgcttcgccgacggcctgccgg

SEQ ID NO: 720003 - DNA, 25 bp, Artificial sequence
  Synthetic oligonucleotide
gaggtcaagcgcttcgccgacggcc

SEQ ID NO: 720004 - DNA, 25 bp, Artificial sequence
  Synthetic oligonucleotide
ggcacggtggaggagagcggcaagg

SEQ ID NO: 720005 - DNA, 25 bp, Artificial sequence
  Synthetic oligonucleotide
gagcgtgcagaagctattcctggtg

SEQ ID NO: 720006 - DNA, 25 bp, Artificial sequence
  Synthetic oligonucleotide
ggtggtcgcggcgttgctgccgacc

SEQ ID NO: 720007 - DNA, 25 bp, Artificial sequence
  Synthetic oligonucleotide
tggggctgatcggggtggtcgcggc

SEQ ID NO: 720008 - DNA, 25 bp, Artificial sequence
  Synthetic oligonucleotide
cgccgctggggctgatcggggtggt

SEQ ID NO: 720009 - DNA, 25 bp, Artificial sequence
  Synthetic oligonucleotide
gcgtcgcgccgctggggctgatcgg

SEQ ID NO: 720010 - DNA, 25 bp, Artificial sequence
  Synthetic oligonucleotide
tggccagcgtcgcgccgctggggct

SEQ ID NO: 720011 - DNA, 25 bp, Artificial sequence
  Synthetic oligonucleotide
tcctggtggccagcgtcgcgccgct

SEQ ID NO: 720012 - DNA, 25 bp, Artificial sequence
  Synthetic oligonucleotide
tcgccaaggtggtgccgctgatgct

SEQ ID NO: 720013 - DNA, 25 bp, Artificial sequence
  Synthetic oligonucleotide
gcagaagctattcctggtggccagc

SEQ ID NO: 720014 - DNA, 25 bp, Artificial sequence
  Synthetic oligonucleotide
tgatcggggtggtcgcggcgttgct

SEQ ID NO: 720015 - DNA, 25 bp, Artificial sequence
  Synthetic oligonucleotide
gttgcagagcgtgcagaagctattc

SEQ ID NO: 720016 - DNA, 25 bp, Artificial sequence
  Synthetic oligonucleotide
gatccagttgcagagcgtgcagaag

SEQ ID NO: 720017 - DNA, 25 bp, Artificial sequence
  Synthetic oligonucleotide
cctgatgatccagttgcagagcgtg

SEQ ID NO: 720018 - DNA, 25 bp, Artificial sequence
  Synthetic oligonucleotide
gaccttcctgatgatccagttgcag

SEQ ID NO: 720019 - DNA, 25 bp, Artificial sequence
  Synthetic oligonucleotide
catggcgaccttcctgatgatccag

SEQ ID NO: 720020 - DNA, 25 bp, Artificial sequence
  Synthetic oligonucleotide
gttcctcatggcgaccttcctgatg

SEQ ID NO: 720021 - DNA, 25 bp, Artificial sequence
  Synthetic oligonucleotide
tgatgctgttcctcatggcgacctt

SEQ ID NO: 720022 - DNA, 25 bp, Artificial sequence
  Synthetic oligonucleotide
gctattcctggtggccagcgtcgcg

SEQ ID NO: 720023 - DNA, 25 bp, Artificial sequence
  Synthetic oligonucleotide
agagcctgcagatcgtcacgcccag

SEQ ID NO: 720024 - DNA, 25 bp, Artificial sequence
  Synthetic oligonucleotide
ttcgccaaggtcagctacgagctgg

SEQ ID NO: 720025 - DNA, 25 bp, Artificial sequence
  Synthetic oligonucleotide
aaggcgttcgccaaggtcagctacg

SEQ ID NO: 720026 - DNA, 25 bp, Artificial sequence
  Synthetic oligonucleotide
ccgctcaaggcgttcgccaaggtca

SEQ ID NO: 720027 - DNA, 25 bp, Artificial sequence
  Synthetic oligonucleotide
ctcgatcccgctcaaggcgttcgcc

SEQ ID NO: 720028 - DNA, 25 bp, Artificial sequence
  Synthetic oligonucleotide
cggcacctcgatcccgctcaaggcg

SEQ ID NO: 720029 - DNA, 25 bp, Artificial sequence
  Synthetic oligonucleotide
gcccagcggcacctcgatcccgctc

SEQ ID NO: 720030 - DNA, 25 bp, Artificial sequence
  Synthetic oligonucleotide
aaggtcagctacgagctggagcagc

SEQ ID NO: 720031 - DNA, 25 bp, Artificial sequence
  Synthetic oligonucleotide
tgcagatcgtcacgcccagcggcac

SEQ ID NO: 720032 - DNA, 25 bp, Artificial sequence
  Synthetic oligonucleotide
ccgaggatagcgagcgcggctcgct

SEQ ID NO: 720033 - DNA, 25 bp, Artificial sequence
  Synthetic oligonucleotide
ccctggagagcctgcagatcgtcac

SEQ ID NO: 720034 - DNA, 25 bp, Artificial sequence
  Synthetic oligonucleotide
tggagaccctggagagcctgcagat

SEQ ID NO: 720035 - DNA, 25 bp, Artificial sequence
  Synthetic oligonucleotide
gctcgctggagaccctggagagcct

SEQ ID NO: 720036 - DNA, 25 bp, Artificial sequence
  Synthetic oligonucleotide
gcgcggctcgctggagaccctggag

SEQ ID NO: 720037 - DNA, 25 bp, Artificial sequence
  Synthetic oligonucleotide
tagcgagcgcggctcgctggagacc

SEQ ID NO: 720038 - DNA, 25 bp, Artificial sequence
  Synthetic oligonucleotide
gccgcgccgaggatagcgagcgcgg

SEQ ID NO: 720039 - DNA, 25 bp, Artificial sequence
  Synthetic oligonucleotide
cggctggcgccggaggtcaagcgct

SEQ ID NO: 720040 - DNA, 25 bp, Artificial sequence
  Synthetic oligonucleotide
tcgtcacgcccagcggcacctcgat

SEQ ID NO: 720041 - DNA, 25 bp, Artificial sequence
  Synthetic oligonucleotide
gaaggcgtcgctgcgcggcgagatc

SEQ ID NO: 720042 - DNA, 25 bp, Artificial sequence
  Synthetic oligonucleotide
ggtcgcccggctggcgccggaggtc

SEQ ID NO: 720043 - DNA, 25 bp, Artificial sequence
  Synthetic oligonucleotide
agcccaccgacctggtcgcccggct

SEQ ID NO: 720044 - DNA, 25 bp, Artificial sequence
  Synthetic oligonucleotide
agatccagcccaccgacctggtcgc

SEQ ID NO: 720045 - DNA, 25 bp, Artificial sequence
  Synthetic oligonucleotide
agctacgagctggagcagccgctgg

SEQ ID NO: 720046 - DNA, 25 bp, Artificial sequence
  Synthetic oligonucleotide
tcgctgcgcggcgagatccagccca

SEQ ID NO: 720047 - DNA, 25 bp, Artificial sequence
  Synthetic oligonucleotide
ccgacctggtcgcccggctggcgcc

SEQ ID NO: 720048 - DNA, 25 bp, Artificial sequence
  Synthetic oligonucleotide
acggtgaaggcgtcgctgcgcggcg

SEQ ID NO: 720049 - DNA, 25 bp, Artificial sequence
  Synthetic oligonucleotide
acgatcacggtgaaggcgtcgctgc

SEQ ID NO: 720050 - DNA, 25 bp, Artificial sequence
  Synthetic oligonucleotide
aagccgacgatcacggtgaaggcgt

SEQ ID NO: 720051 - DNA, 25 bp, Artificial sequence
  Synthetic oligonucleotide
accgcaagccgacgatcacggtgaa

SEQ ID NO: 720052 - DNA, 25 bp, Artificial sequence
  Synthetic oligonucleotide
gccgcgaccgcaagccgacgatcac

SEQ ID NO: 720053 - DNA, 25 bp, Artificial sequence
  Synthetic oligonucleotide
tgtggcgccgcgaccgcaagccgac

SEQ ID NO: 720054 - DNA, 25 bp, Artificial sequence
  Synthetic oligonucleotide
cgctggtgtggcgccgcgaccgcaa

SEQ ID NO: 720055 - DNA, 25 bp, Artificial sequence
  Synthetic oligonucleotide
gagcagccgctggtgtggcgccgcg

SEQ ID NO: 720056 - DNA, 25 bp, Artificial sequence
  Synthetic oligonucleotide
gagctggagcagccgctggtgtggc

SEQ ID NO: 720057 - DNA, 25 bp, Artificial sequence
  Synthetic oligonucleotide
gcggcgagatccagcccaccgacct

SEQ ID NO: 720058 - DNA, 25 bp, Artificial sequence
  Synthetic oligonucleotide
ccggactctcaaccctgaggtcttt

SEQ ID NO: 720059 - DNA, 25 bp, Artificial sequence
  Synthetic oligonucleotide
tctcaaccctgaggtctttatgact

SEQ ID NO: 720060 - DNA, 25 bp, Artificial sequence
  Synthetic oligonucleotide
ccctgaggtctttatgactaccaag

SEQ ID NO: 720061 - DNA, 25 bp, Artificial sequence
  Synthetic oligonucleotide
ggtctttatgactaccaagttagac

SEQ ID NO: 720062 - DNA, 25 bp, Artificial sequence
  Synthetic oligonucleotide
tatgactaccaagttagaccagctg

SEQ ID NO: 720063 - DNA, 25 bp, Artificial sequence
  Synthetic oligonucleotide
taccaagttagaccagctgaccagc

SEQ ID NO: 720064 - DNA, 25 bp, Artificial sequence
  Synthetic oligonucleotide
gttagaccagctgaccagctggctg

SEQ ID NO: 720065 - DNA, 25 bp, Artificial sequence
  Synthetic oligonucleotide
cagctgaccagctggctgaaggaac

SEQ ID NO: 720066 - DNA, 25 bp, Artificial sequence
  Synthetic oligonucleotide
accagctggctgaaggaacgcaaga

SEQ ID NO: 720067 - DNA, 25 bp, Artificial sequence
  Synthetic oligonucleotide
tggctgaaggaacgcaagatcaccg

SEQ ID NO: 720068 - DNA, 25 bp, Artificial sequence
  Synthetic oligonucleotide
aaggaacgcaagatcaccgaagtgg

SEQ ID NO: 720069 - DNA, 25 bp, Artificial sequence
  Synthetic oligonucleotide
cgcaagatcaccgaagtggaatgcc

SEQ ID NO: 720070 - DNA, 25 bp, Artificial sequence
  Synthetic oligonucleotide
atcaccgaagtggaatgcctgattt

SEQ ID NO: 720071 - DNA, 25 bp, Artificial sequence
  Synthetic oligonucleotide
gaatgcctgatttccgatctgacag

SEQ ID NO: 720072 - DNA, 25 bp, Artificial sequence
  Synthetic oligonucleotide
aggctttcggtaaggcctgcagcaa

SEQ ID NO: 720073 - DNA, 25 bp, Artificial sequence
  Synthetic oligonucleotide
ctgatttccgatctgacaggcatcg

SEQ ID NO: 720074 - DNA, 25 bp, Artificial sequence
  Synthetic oligonucleotide
gaagtggaatgcctgatttccgatc

SEQ ID NO: 720075 - DNA, 25 bp, Artificial sequence
  Synthetic oligonucleotide
tcggtaaggcctgcagcaagagggc

SEQ ID NO: 720076 - DNA, 25 bp, Artificial sequence
  Synthetic oligonucleotide
cacccggagtggcaggttctgacga

SEQ ID NO: 720077 - DNA, 25 bp, Artificial sequence
  Synthetic oligonucleotide
tggaagacgacatttactacgacct

SEQ ID NO: 720078 - DNA, 25 bp, Artificial sequence
  Synthetic oligonucleotide
tccgatctgacaggcatcgcccgcg

SEQ ID NO: 720079 - DNA, 25 bp, Artificial sequence
  Synthetic oligonucleotide
caggttctgacgaaccccaactatc

SEQ ID NO: 720080 - DNA, 25 bp, Artificial sequence
  Synthetic oligonucleotide
tgacgaaccccaactatctcgctat

SEQ ID NO: 720081 - DNA, 25 bp, Artificial sequence
  Synthetic oligonucleotide
accccaactatctcgctatcttcca

SEQ ID NO: 720082 - DNA, 25 bp, Artificial sequence
  Synthetic oligonucleotide
actatctcgctatcttccaggcttt

SEQ ID NO: 720083 - DNA, 25 bp, Artificial sequence
  Synthetic oligonucleotide
aggcctgcagcaagagggcggggca

SEQ ID NO: 720084 - DNA, 25 bp, Artificial sequence
  Synthetic oligonucleotide
tcttccaggctttcggtaaggcctg

SEQ ID NO: 720085 - DNA, 25 bp, Artificial sequence
  Synthetic oligonucleotide
ttggggccggactctcaaccctgag

SEQ ID NO: 720086 - DNA, 25 bp, Artificial sequence
  Synthetic oligonucleotide
gagtggcaggttctgacgaacccca

SEQ ID NO: 720087 - DNA, 25 bp, Artificial sequence
  Synthetic oligonucleotide
gcagcaagagggcggggcaacgttg

SEQ ID NO: 720088 - DNA, 25 bp, Artificial sequence
  Synthetic oligonucleotide
agagggcggggcaacgttgagtccg

SEQ ID NO: 720089 - DNA, 25 bp, Artificial sequence
  Synthetic oligonucleotide
cggggcaacgttgagtccggctgtt

SEQ ID NO: 720090 - DNA, 25 bp, Artificial sequence
  Synthetic oligonucleotide
caacgttgagtccggctgttggggc

SEQ ID NO: 720091 - DNA, 25 bp, Artificial sequence
  Synthetic oligonucleotide
tgagtccggctgttggggccggact

SEQ ID NO: 720092 - DNA, 25 bp, Artificial sequence
  Synthetic oligonucleotide
cggctgttggggccggactctcaac

SEQ ID NO: 720093 - DNA, 25 bp, Artificial sequence
  Synthetic oligonucleotide
tcgctatcttccaggctttcggtaa

SEQ ID NO: 720094 - DNA, 25 bp, Artificial sequence
  Synthetic oligonucleotide
gagaatgccgtgttcctcgtcccct

SEQ ID NO: 720095 - DNA, 25 bp, Artificial sequence
  Synthetic oligonucleotide
tacgacctgctcgacccggccgaca

SEQ ID NO: 720096 - DNA, 25 bp, Artificial sequence
  Synthetic oligonucleotide
tgctcgacccggccgacatcgatat

SEQ ID NO: 720097 - DNA, 25 bp, Artificial sequence
  Synthetic oligonucleotide
acccggccgacatcgatatggtctg

SEQ ID NO: 720098 - DNA, 25 bp, Artificial sequence
  Synthetic oligonucleotide
gccgacatcgatatggtctgccgcc

SEQ ID NO: 720099 - DNA, 25 bp, Artificial sequence
  Synthetic oligonucleotide
atcgatatggtctgccgcccggacg

SEQ ID NO: 720100 - DNA, 25 bp, Artificial sequence
  Synthetic oligonucleotide
atggtctgccgcccggacgagaatg

SEQ ID NO: 720101 - DNA, 25 bp, Artificial sequence
  Synthetic oligonucleotide
ccggcgactacgtggaagacgacat

SEQ ID NO: 720102 - DNA, 25 bp, Artificial sequence
  Synthetic oligonucleotide
ccggacgagaatgccgtgttcctcg

SEQ ID NO: 720103 - DNA, 25 bp, Artificial sequence
  Synthetic oligonucleotide
actacgtggaagacgacatttacta

SEQ ID NO: 720104 - DNA, 25 bp, Artificial sequence
  Synthetic oligonucleotide
gccgtgttcctcgtcccctgggcca

SEQ ID NO: 720105 - DNA, 25 bp, Artificial sequence
  Synthetic oligonucleotide
ttcctcgtcccctgggccatcgagc

SEQ ID NO: 720106 - DNA, 25 bp, Artificial sequence
  Synthetic oligonucleotide
cgtcccctgggccatcgagcccacc

SEQ ID NO: 720107 - DNA, 25 bp, Artificial sequence
  Synthetic oligonucleotide
ctgggccatcgagcccaccgcgatg

SEQ ID NO: 720108 - DNA, 25 bp, Artificial sequence
  Synthetic oligonucleotide
caatggcacccggagtggcaggttc

SEQ ID NO: 720109 - DNA, 25 bp, Artificial sequence
  Synthetic oligonucleotide
cgaccagccgctcgaggttcagtac

SEQ ID NO: 720110 - DNA, 25 bp, Artificial sequence
  Synthetic oligonucleotide
agcccaccgcgatggtgatccacga

SEQ ID NO: 720111 - DNA, 25 bp, Artificial sequence
  Synthetic oligonucleotide
tgccgcccggacgagaatgccgtgt

SEQ ID NO: 720112 - DNA, 25 bp, Artificial sequence
  Synthetic oligonucleotide
catgcgcctgccggagagcgttctg

SEQ ID NO: 720113 - DNA, 25 bp, Artificial sequence
  Synthetic oligonucleotide
aggcatcgcccgcggcaagatctcg

SEQ ID NO: 720114 - DNA, 25 bp, Artificial sequence
  Synthetic oligonucleotide
cgcccgcggcaagatctcgccgacc

SEQ ID NO: 720115 - DNA, 25 bp, Artificial sequence
  Synthetic oligonucleotide
gcggcaagatctcgccgaccaacaa

SEQ ID NO: 720116 - DNA, 25 bp, Artificial sequence
  Synthetic oligonucleotide
agatctcgccgaccaacaaattcat

SEQ ID NO: 720117 - DNA, 25 bp, Artificial sequence
  Synthetic oligonucleotide
cgccgaccaacaaattcatcgcgga

SEQ ID NO: 720118 - DNA, 25 bp, Artificial sequence
  Synthetic oligonucleotide
ccaacaaattcatcgcggaaaaggg

SEQ ID NO: 720119 - DNA, 25 bp, Artificial sequence
  Synthetic oligonucleotide
aattcatcgcggaaaagggcatgcg

SEQ ID NO: 720120 - DNA, 25 bp, Artificial sequence
  Synthetic oligonucleotide
atttactacgacctgctcgacccgg

SEQ ID NO: 720121 - DNA, 25 bp, Artificial sequence
  Synthetic oligonucleotide
aaaagggcatgcgcctgccggagag

SEQ ID NO: 720122 - DNA, 25 bp, Artificial sequence
  Synthetic oligonucleotide
acgacatttactacgacctgctcga

SEQ ID NO: 720123 - DNA, 25 bp, Artificial sequence
  Synthetic oligonucleotide
ctgccggagagcgttctgctgcaga

SEQ ID NO: 720124 - DNA, 25 bp, Artificial sequence
  Synthetic oligonucleotide
gagagcgttctgctgcagaccgtca

SEQ ID NO: 720125 - DNA, 25 bp, Artificial sequence
  Synthetic oligonucleotide
gttctgctgcagaccgtcaccggcg

SEQ ID NO: 720126 - DNA, 25 bp, Artificial sequence
  Synthetic oligonucleotide
tgcagaccgtcaccggcgactacgt

SEQ ID NO: 720127 - DNA, 25 bp, Artificial sequence
  Synthetic oligonucleotide
ccgtcaccggcgactacgtggaaga

SEQ ID NO: 720128 - DNA, 25 bp, Artificial sequence
  Synthetic oligonucleotide
catcgagcccaccgcgatggtgatc

SEQ ID NO: 720129 - DNA, 25 bp, Artificial sequence
  Synthetic oligonucleotide
tctgacaggcatcgcccgcggcaag

SEQ ID NO: 720130 - DNA, 25 bp, Artificial sequence
  Synthetic oligonucleotide
tcgcggaaaagggcatgcgcctgcc

SEQ ID NO: 720131 - DNA, 25 bp, Artificial sequence
  Synthetic oligonucleotide
agcctgcaccagaaggtgcacgagg

SEQ ID NO: 720132 - DNA, 25 bp, Artificial sequence
  Synthetic oligonucleotide
ggcatctgccgcggtttccaggaaa

SEQ ID NO: 720133 - DNA, 25 bp, Artificial sequence
  Synthetic oligonucleotide
tgccgcggtttccaggaaatgaacg

SEQ ID NO: 720134 - DNA, 25 bp, Artificial sequence
  Synthetic oligonucleotide
cggtttccaggaaatgaacgtggct

SEQ ID NO: 720135 - DNA, 25 bp, Artificial sequence
  Synthetic oligonucleotide
ccaggaaatgaacgtggctttcggc

SEQ ID NO: 720136 - DNA, 25 bp, Artificial sequence
  Synthetic oligonucleotide
aatgaacgtggctttcggcggcagc

SEQ ID NO: 720137 - DNA, 25 bp, Artificial sequence
  Synthetic oligonucleotide
acgtggctttcggcggcagcctgca

SEQ ID NO: 720138 - DNA, 25 bp, Artificial sequence
  Synthetic oligonucleotide
gccggccgaccagccgctcgaggtt

SEQ ID NO: 720139 - DNA, 25 bp, Artificial sequence
  Synthetic oligonucleotide
ggcggcagcctgcaccagaaggtgc

SEQ ID NO: 720140 - DNA, 25 bp, Artificial sequence
  Synthetic oligonucleotide
gccggcattccggtcctcggcatct

SEQ ID NO: 720141 - DNA, 25 bp, Artificial sequence
  Synthetic oligonucleotide
accagaaggtgcacgaggtcggaac

SEQ ID NO: 720142 - DNA, 25 bp, Artificial sequence
  Synthetic oligonucleotide
aggtgcacgaggtcggaaccttcat

SEQ ID NO: 720143 - DNA, 25 bp, Artificial sequence
  Synthetic oligonucleotide
acgaggtcggaaccttcatggacca

SEQ ID NO: 720144 - DNA, 25 bp, Artificial sequence
  Synthetic oligonucleotide
tcggaaccttcatggaccaccgcga

SEQ ID NO: 720145 - DNA, 25 bp, Artificial sequence
  Synthetic oligonucleotide
ccttcatggaccaccgcgagccggc

SEQ ID NO: 720146 - DNA, 25 bp, Artificial sequence
  Synthetic oligonucleotide
tggaccaccgcgagccggccgacca

SEQ ID NO: 720147 - DNA, 25 bp, Artificial sequence
  Synthetic oligonucleotide
cgaggttcagtacgcgccgcgccat

SEQ ID NO: 720148 - DNA, 25 bp, Artificial sequence
  Synthetic oligonucleotide
ctttcggcggcagcctgcaccagaa

SEQ ID NO: 720149 - DNA, 25 bp, Artificial sequence
  Synthetic oligonucleotide
ccgcgacgccactacgttgccgctg

SEQ ID NO: 720150 - DNA, 25 bp, Artificial sequence
  Synthetic oligonucleotide
cgtcgagccccgtcattatagtgga

SEQ ID NO: 720151 - DNA, 25 bp, Artificial sequence
  Synthetic oligonucleotide
gccccgtcattatagtggaccggcg

SEQ ID NO: 720152 - DNA, 25 bp, Artificial sequence
  Synthetic oligonucleotide
tcattatagtggaccggcgagcgag

SEQ ID NO: 720153 - DNA, 25 bp, Artificial sequence
  Synthetic oligonucleotide
accggcgagcgagcccggcaccctc

SEQ ID NO: 720154 - DNA, 25 bp, Artificial sequence
  Synthetic oligonucleotide
gagcgagcccggcaccctccacgac

SEQ ID NO: 720155 - DNA, 25 bp, Artificial sequence
  Synthetic oligonucleotide
gcccggcaccctccacgactccgac

SEQ ID NO: 720156 - DNA, 25 bp, Artificial sequence
  Synthetic oligonucleotide
caccctccacgactccgaccgcgac

SEQ ID NO: 720157 - DNA, 25 bp, Artificial sequence
  Synthetic oligonucleotide
ggtcctcggcatctgccgcggtttc

SEQ ID NO: 720158 - DNA, 25 bp, Artificial sequence
  Synthetic oligonucleotide
ctccgaccgcgacgccactacgttg

SEQ ID NO: 720159 - DNA, 25 bp, Artificial sequence
  Synthetic oligonucleotide
attccggtcctcggcatctgccgcg

SEQ ID NO: 720160 - DNA, 25 bp, Artificial sequence
  Synthetic oligonucleotide
cgccactacgttgccgctggtccgc

SEQ ID NO: 720161 - DNA, 25 bp, Artificial sequence
  Synthetic oligonucleotide
tacgttgccgctggtccgcgccgcc

SEQ ID NO: 720162 - DNA, 25 bp, Artificial sequence
  Synthetic oligonucleotide
gccgctggtccgcgccgccatcgac

SEQ ID NO: 720163 - DNA, 25 bp, Artificial sequence
  Synthetic oligonucleotide
gtccgcgccgccatcgacgccggca

SEQ ID NO: 720164 - DNA, 25 bp, Artificial sequence
  Synthetic oligonucleotide
gccgccatcgacgccggcattccgg

SEQ ID NO: 720165 - DNA, 25 bp, Artificial sequence
  Synthetic oligonucleotide
atcgacgccggcattccggtcctcg

SEQ ID NO: 720166 - DNA, 25 bp, Artificial sequence
  Synthetic oligonucleotide
ccgcgatggtgatccacgacacctt

SEQ ID NO: 720167 - DNA, 25 bp, Artificial sequence
  Synthetic oligonucleotide
ccacgactccgaccgcgacgccact

SEQ ID NO: 720168 - DNA, 25 bp, Artificial sequence
  Synthetic oligonucleotide
cgggttggtcgaagccatctccgta

SEQ ID NO: 720169 - DNA, 25 bp, Artificial sequence
  Synthetic oligonucleotide
gttgatcgtctggcgccgggccttc

SEQ ID NO: 720170 - DNA, 25 bp, Artificial sequence
  Synthetic oligonucleotide
tcgtctggcgccgggccttcgagta

SEQ ID NO: 720171 - DNA, 25 bp, Artificial sequence
  Synthetic oligonucleotide
ggcgccgggccttcgagtagaagca

SEQ ID NO: 720172 - DNA, 25 bp, Artificial sequence
  Synthetic oligonucleotide
ggccttcgagtagaagcactggcgc

SEQ ID NO: 720173 - DNA, 25 bp, Artificial sequence
  Synthetic oligonucleotide
tcgagtagaagcactggcgcctgac

SEQ ID NO: 720174 - DNA, 25 bp, Artificial sequence
  Synthetic oligonucleotide
agaagcactggcgcctgacgggttg

SEQ ID NO: 720175 - DNA, 25 bp, Artificial sequence
  Synthetic oligonucleotide
ccgcgagccggccgaccagccgctc

SEQ ID NO: 720176 - DNA, 25 bp, Artificial sequence
  Synthetic oligonucleotide
gcctgacgggttggtcgaagccatc

SEQ ID NO: 720177 - DNA, 25 bp, Artificial sequence
  Synthetic oligonucleotide
ccatccatggccagggcgttgatcg

SEQ ID NO: 720178 - DNA, 25 bp, Artificial sequence
  Synthetic oligonucleotide
ggtcgaagccatctccgtagaaggt

SEQ ID NO: 720179 - DNA, 25 bp, Artificial sequence
  Synthetic oligonucleotide
gccatctccgtagaaggtgcaaaag

SEQ ID NO: 720180 - DNA, 25 bp, Artificial sequence
  Synthetic oligonucleotide
tccgtagaaggtgcaaaagccttcg

SEQ ID NO: 720181 - DNA, 25 bp, Artificial sequence
  Synthetic oligonucleotide
gaaggtgcaaaagccttcgctcttg

SEQ ID NO: 720182 - DNA, 25 bp, Artificial sequence
  Synthetic oligonucleotide
caaaagccttcgctcttggtgtgca

SEQ ID NO: 720183 - DNA, 25 bp, Artificial sequence
  Synthetic oligonucleotide
ccttcgctcttggtgtgcaatggca

SEQ ID NO: 720184 - DNA, 25 bp, Artificial sequence
  Synthetic oligonucleotide
gctcttggtgtgcaatggcacccgg

SEQ ID NO: 720185 - DNA, 25 bp, Artificial sequence
  Synthetic oligonucleotide
actggcgcctgacgggttggtcgaa

SEQ ID NO: 720186 - DNA, 25 bp, Artificial sequence
  Synthetic oligonucleotide
gtgctcgccggtatcggcttgccga

SEQ ID NO: 720187 - DNA, 25 bp, Artificial sequence
  Synthetic oligonucleotide
gccgctcgaggttcagtacgcgccg

SEQ ID NO: 720188 - DNA, 25 bp, Artificial sequence
  Synthetic oligonucleotide
tagtggaccggcgagcgagcccggc

SEQ ID NO: 720189 - DNA, 25 bp, Artificial sequence
  Synthetic oligonucleotide
tcagtacgcgccgcgccatgccatg

SEQ ID NO: 720190 - DNA, 25 bp, Artificial sequence
  Synthetic oligonucleotide
cgcgccgcgccatgccatgcatgtg

SEQ ID NO: 720191 - DNA, 25 bp, Artificial sequence
  Synthetic oligonucleotide
gcgccatgccatgcatgtgcagccg

SEQ ID NO: 720192 - DNA, 25 bp, Artificial sequence
  Synthetic oligonucleotide
tgccatgcatgtgcagccgggcgga

SEQ ID NO: 720193 - DNA, 25 bp, Artificial sequence
  Synthetic oligonucleotide
gcatgtgcagccgggcggagtgctc

SEQ ID NO: 720194 - DNA, 25 bp, Artificial sequence
  Synthetic oligonucleotide
agggcgttgatcgtctggcgccggg

SEQ ID NO: 720195 - DNA, 25 bp, Artificial sequence
  Synthetic oligonucleotide
ggcggagtgctcgccggtatcggct

SEQ ID NO: 720196 - DNA, 25 bp, Artificial sequence
  Synthetic oligonucleotide
atggccagggcgttgatcgtctggc

SEQ ID NO: 720197 - DNA, 25 bp, Artificial sequence
  Synthetic oligonucleotide
ccggtatcggcttgccgagcgagtt

SEQ ID NO: 720198 - DNA, 25 bp, Artificial sequence
  Synthetic oligonucleotide
tcggcttgccgagcgagttccaggt

SEQ ID NO: 720199 - DNA, 25 bp, Artificial sequence
  Synthetic oligonucleotide
tgccgagcgagttccaggtcaattc

SEQ ID NO: 720200 - DNA, 25 bp, Artificial sequence
  Synthetic oligonucleotide
gcgagttccaggtcaattccatcca

SEQ ID NO: 720201 - DNA, 25 bp, Artificial sequence
  Synthetic oligonucleotide
tccaggtcaattccatccatggcca

SEQ ID NO: 720202 - DNA, 25 bp, Artificial sequence
  Synthetic oligonucleotide
tcaattccatccatggccagggcgt

SEQ ID NO: 720203 - DNA, 25 bp, Artificial sequence
  Synthetic oligonucleotide
ggtgtgcaatggcacccggagtggc

SEQ ID NO: 720204 - DNA, 25 bp, Artificial sequence
  Synthetic oligonucleotide
cagccgggcggagtgctcgccggta

SEQ ID NO: 720205 - DNA, 25 bp, Artificial sequence
  Synthetic oligonucleotide
ccgctgttcgcgcccaacgtgaact

SEQ ID NO: 720206 - DNA, 25 bp, Artificial sequence
  Synthetic oligonucleotide
tcctgcaccatatcggcggcctgca

SEQ ID NO: 720207 - DNA, 25 bp, Artificial sequence
  Synthetic oligonucleotide
accatatcggcggcctgcagaagtt

SEQ ID NO: 720208 - DNA, 25 bp, Artificial sequence
  Synthetic oligonucleotide
atcggcggcctgcagaagttcatcc

SEQ ID NO: 720209 - DNA, 25 bp, Artificial sequence
  Synthetic oligonucleotide
ggcctgcagaagttcatcccggaag

SEQ ID NO: 720210 - DNA, 25 bp, Artificial sequence
  Synthetic oligonucleotide
cagaagttcatcccggaagtgctgc

SEQ ID NO: 720211 - DNA, 25 bp, Artificial sequence
  Synthetic oligonucleotide
ttcatcccggaagtgctgccgctgt

SEQ ID NO: 720212 - DNA, 25 bp, Artificial sequence
  Synthetic oligonucleotide
atacctcggcgccggtgaacgtcga

SEQ ID NO: 720213 - DNA, 25 bp, Artificial sequence
  Synthetic oligonucleotide
gtgctgccgctgttcgcgcccaacg

SEQ ID NO: 720214 - DNA, 25 bp, Artificial sequence
  Synthetic oligonucleotide
ggcaccatgagcgagctgttcctgc

SEQ ID NO: 720215 - DNA, 25 bp, Artificial sequence
  Synthetic oligonucleotide
gttcgcgcccaacgtgaactcgttc

SEQ ID NO: 720216 - DNA, 25 bp, Artificial sequence
  Synthetic oligonucleotide
gcccaacgtgaactcgttccgccgc

SEQ ID NO: 720217 - DNA, 25 bp, Artificial sequence
  Synthetic oligonucleotide
acgtgaactcgttccgccgcttcct

SEQ ID NO: 720218 - DNA, 25 bp, Artificial sequence
  Synthetic oligonucleotide
ctcgttccgccgcttcctgcccgat

SEQ ID NO: 720219 - DNA, 25 bp, Artificial sequence
  Synthetic oligonucleotide
ccgccgcttcctgcccgatacctcg

SEQ ID NO: 720220 - DNA, 25 bp, Artificial sequence
  Synthetic oligonucleotide
cttcctgcccgatacctcggcgccg

SEQ ID NO: 720221 - DNA, 25 bp, Artificial sequence
  Synthetic oligonucleotide
ttcatggccaagccgatgaccggcg

SEQ ID NO: 720222 - DNA, 25 bp, Artificial sequence
  Synthetic oligonucleotide
ccggaagtgctgccgctgttcgcgc

SEQ ID NO: 720223 - DNA, 25 bp, Artificial sequence
  Synthetic oligonucleotide
gtcgacgtgaagaccggcaagaaca

SEQ ID NO: 720224 - DNA, 25 bp, Artificial sequence
  Synthetic oligonucleotide
atgaacgccgcaacctgcgcctgcc

SEQ ID NO: 720225 - DNA, 25 bp, Artificial sequence
  Synthetic oligonucleotide
ccgatgaccggcgagccgggcagcg

SEQ ID NO: 720226 - DNA, 25 bp, Artificial sequence
  Synthetic oligonucleotide
gaccggcgagccgggcagcgcgatg

SEQ ID NO: 720227 - DNA, 25 bp, Artificial sequence
  Synthetic oligonucleotide
cgagccgggcagcgcgatgcacctg

SEQ ID NO: 720228 - DNA, 25 bp, Artificial sequence
  Synthetic oligonucleotide
ggcagcgcgatgcacctgcaccaga

SEQ ID NO: 720229 - DNA, 25 bp, Artificial sequence
  Synthetic oligonucleotide
gcgatgcacctgcaccagagcatcg

SEQ ID NO: 720230 - DNA, 25 bp, Artificial sequence
  Synthetic oligonucleotide
cacctgcaccagagcatcgtcgacg

SEQ ID NO: 720231 - DNA, 25 bp, Artificial sequence
  Synthetic oligonucleotide
agctgttcctgcaccatatcggcgg

SEQ ID NO: 720232 - DNA, 25 bp, Artificial sequence
  Synthetic oligonucleotide
agcatcgtcgacgtgaagaccggca

SEQ ID NO: 720233 - DNA, 25 bp, Artificial sequence
  Synthetic oligonucleotide
atgagcgagctgttcctgcaccata

SEQ ID NO: 720234 - DNA, 25 bp, Artificial sequence
  Synthetic oligonucleotide
gtgaagaccggcaagaacatcttct

SEQ ID NO: 720235 - DNA, 25 bp, Artificial sequence
  Synthetic oligonucleotide
accggcaagaacatcttctccaatg

SEQ ID NO: 720236 - DNA, 25 bp, Artificial sequence
  Synthetic oligonucleotide
aagaacatcttctccaatgccgacg

SEQ ID NO: 720237 - DNA, 25 bp, Artificial sequence
  Synthetic oligonucleotide
atcttctccaatgccgacggcacca

SEQ ID NO: 720238 - DNA, 25 bp, Artificial sequence
  Synthetic oligonucleotide
tccaatgccgacggcaccatgagcg

SEQ ID NO: 720239 - DNA, 25 bp, Artificial sequence
  Synthetic oligonucleotide
gccgacggcaccatgagcgagctgt

SEQ ID NO: 720240 - DNA, 25 bp, Artificial sequence
  Synthetic oligonucleotide
tcggcgccggtgaacgtcgagtggg

SEQ ID NO: 720241 - DNA, 25 bp, Artificial sequence
  Synthetic oligonucleotide
caccagagcatcgtcgacgtgaaga

SEQ ID NO: 720242 - DNA, 25 bp, Artificial sequence
  Synthetic oligonucleotide
agcgcccaggtcaaaggtcgcggct

SEQ ID NO: 720243 - DNA, 25 bp, Artificial sequence
  Synthetic oligonucleotide
gccagcctgctgtgcggctacatcg

SEQ ID NO: 720244 - DNA, 25 bp, Artificial sequence
  Synthetic oligonucleotide
ctgctgtgcggctacatcggcatgg

SEQ ID NO: 720245 - DNA, 25 bp, Artificial sequence
  Synthetic oligonucleotide
tgcggctacatcggcatggtcgaag

SEQ ID NO: 720246 - DNA, 25 bp, Artificial sequence
  Synthetic oligonucleotide
tacatcggcatggtcgaaggcatca

SEQ ID NO: 720247 - DNA, 25 bp, Artificial sequence
  Synthetic oligonucleotide
ggcatggtcgaaggcatcaagccga

SEQ ID NO: 720248 - DNA, 25 bp, Artificial sequence
  Synthetic oligonucleotide
gtcgaaggcatcaagccgagcgccc

SEQ ID NO: 720249 - DNA, 25 bp, Artificial sequence
  Synthetic oligonucleotide
tgcccgatacctcggcgccggtgaa

SEQ ID NO: 720250 - DNA, 25 bp, Artificial sequence
  Synthetic oligonucleotide
aagccgagcgcccaggtcaaaggtc

SEQ ID NO: 720251 - DNA, 25 bp, Artificial sequence
  Synthetic oligonucleotide
ttacctggcgctggctgccagcctg

SEQ ID NO: 720252 - DNA, 25 bp, Artificial sequence
  Synthetic oligonucleotide
caggtcaaaggtcgcggctatgaac

SEQ ID NO: 720253 - DNA, 25 bp, Artificial sequence
  Synthetic oligonucleotide
aaggtcgcggctatgaacgccgcaa

SEQ ID NO: 720254 - DNA, 25 bp, Artificial sequence
  Synthetic oligonucleotide
gcggctatgaacgccgcaacctgcg

SEQ ID NO: 720255 - DNA, 25 bp, Artificial sequence
  Synthetic oligonucleotide
gccgcaacctgcgcctgccgctgac

SEQ ID NO: 720256 - DNA, 25 bp, Artificial sequence
  Synthetic oligonucleotide
cgtcgaacgtcgagccccgtcatta

SEQ ID NO: 720257 - DNA, 25 bp, Artificial sequence
  Synthetic oligonucleotide
atgcaggtaccagttgtactcgagg

SEQ ID NO: 720258 - DNA, 25 bp, Artificial sequence
  Synthetic oligonucleotide
acctgcgcctgccgctgacgatcga

SEQ ID NO: 720259 - DNA, 25 bp, Artificial sequence
  Synthetic oligonucleotide
aggcatcaagccgagcgcccaggtc

SEQ ID NO: 720260 - DNA, 25 bp, Artificial sequence
  Synthetic oligonucleotide
cgccgggtcgagaaccgtctcgccg

SEQ ID NO: 720261 - DNA, 25 bp, Artificial sequence
  Synthetic oligonucleotide
ccggtgaacgtcgagtggggcgaag

SEQ ID NO: 720262 - DNA, 25 bp, Artificial sequence
  Synthetic oligonucleotide
acgtcgagtggggcgaagagaaccg

SEQ ID NO: 720263 - DNA, 25 bp, Artificial sequence
  Synthetic oligonucleotide
cgaagagaaccgtaccgtcggcctg

SEQ ID NO: 720264 - DNA, 25 bp, Artificial sequence
  Synthetic oligonucleotide
agaaccgtaccgtcggcctgcgcgt

SEQ ID NO: 720265 - DNA, 25 bp, Artificial sequence
  Synthetic oligonucleotide
gtaccgtcggcctgcgcgtgccgga

SEQ ID NO: 720266 - DNA, 25 bp, Artificial sequence
  Synthetic oligonucleotide
tcggcctgcgcgtgccggactccag

SEQ ID NO: 720267 - DNA, 25 bp, Artificial sequence
  Synthetic oligonucleotide
tgcgcgtgccggactccagcccgga

SEQ ID NO: 720268 - DNA, 25 bp, Artificial sequence
  Synthetic oligonucleotide
tggctgccagcctgctgtgcggcta

SEQ ID NO: 720269 - DNA, 25 bp, Artificial sequence
  Synthetic oligonucleotide
cagcccggagaaccgccgggtcgag

SEQ ID NO: 720270 - DNA, 25 bp, Artificial sequence
  Synthetic oligonucleotide
ggcgctggctgccagcctgctgtgc

SEQ ID NO: 720271 - DNA, 25 bp, Artificial sequence
  Synthetic oligonucleotide
gtcgagaaccgtctcgccggcgccg

SEQ ID NO: 720272 - DNA, 25 bp, Artificial sequence
  Synthetic oligonucleotide
aaccgtctcgccggcgccgacgcca

SEQ ID NO: 720273 - DNA, 25 bp, Artificial sequence
  Synthetic oligonucleotide
ctcgccggcgccgacgccaaccctt

SEQ ID NO: 720274 - DNA, 25 bp, Artificial sequence
  Synthetic oligonucleotide
gcgccgacgccaacccttacctggc

SEQ ID NO: 720275 - DNA, 25 bp, Artificial sequence
  Synthetic oligonucleotide
acgccaacccttacctggcgctggc

SEQ ID NO: 720276 - DNA, 25 bp, Artificial sequence
  Synthetic oligonucleotide
aacccttacctggcgctggctgcca

SEQ ID NO: 720277 - DNA, 25 bp, Artificial sequence
  Synthetic oligonucleotide
gcgaccttcatggccaagccgatga

SEQ ID NO: 720278 - DNA, 25 bp, Artificial sequence
  Synthetic oligonucleotide
tgccggactccagcccggagaaccg

SEQ ID NO: 720279 - DNA, 25 bp, Artificial sequence
  Synthetic oligonucleotide
ccgttgcaggccccggtgggccgct

SEQ ID NO: 720280 - DNA, 25 bp, Artificial sequence
  Synthetic oligonucleotide
cagagatggagttctacctgaccaa

SEQ ID NO: 720281 - DNA, 25 bp, Artificial sequence
  Synthetic oligonucleotide
tggagttctacctgaccaagcgcag

SEQ ID NO: 720282 - DNA, 25 bp, Artificial sequence
  Synthetic oligonucleotide
tctacctgaccaagcgcagcgacga

SEQ ID NO: 720283 - DNA, 25 bp, Artificial sequence
  Synthetic oligonucleotide
tgaccaagcgcagcgacgaccccga

SEQ ID NO: 720284 - DNA, 25 bp, Artificial sequence
  Synthetic oligonucleotide
agcgcagcgacgaccccgactatcc

SEQ ID NO: 720285 - DNA, 25 bp, Artificial sequence
  Synthetic oligonucleotide
gcgacgaccccgactatccgttgca

SEQ ID NO: 720286 - DNA, 25 bp, Artificial sequence
  Synthetic oligonucleotide
tcgttctccatcgacgccgccaacg

SEQ ID NO: 720287 - DNA, 25 bp, Artificial sequence
  Synthetic oligonucleotide
actatccgttgcaggccccggtggg

SEQ ID NO: 720288 - DNA, 25 bp, Artificial sequence
  Synthetic oligonucleotide
tggcggccgatcgtggcgccagaga

SEQ ID NO: 720289 - DNA, 25 bp, Artificial sequence
  Synthetic oligonucleotide
gcaggccccggtgggccgctccgga

SEQ ID NO: 720290 - DNA, 25 bp, Artificial sequence
  Synthetic oligonucleotide
cccggtgggccgctccggacgccag

SEQ ID NO: 720291 - DNA, 25 bp, Artificial sequence
  Synthetic oligonucleotide
tgggccgctccggacgccaggaaac

SEQ ID NO: 720292 - DNA, 25 bp, Artificial sequence
  Synthetic oligonucleotide
cggacgccaggaaaccgggcgtcag

SEQ ID NO: 720293 - DNA, 25 bp, Artificial sequence
  Synthetic oligonucleotide
caggaaaccgggcgtcagtcgttct

SEQ ID NO: 720294 - DNA, 25 bp, Artificial sequence
  Synthetic oligonucleotide
accgggcgtcagtcgttctccatcg

SEQ ID NO: 720295 - DNA, 25 bp, Artificial sequence
  Synthetic oligonucleotide
gccaagccgatgaccggcgagccgg

SEQ ID NO: 720296 - DNA, 25 bp, Artificial sequence
  Synthetic oligonucleotide
gaccccgactatccgttgcaggccc

SEQ ID NO: 720297 - DNA, 25 bp, Artificial sequence
  Synthetic oligonucleotide
acatcctcaagcgcgtgttgaagat

SEQ ID NO: 720298 - DNA, 25 bp, Artificial sequence
  Synthetic oligonucleotide
tccacgacaccttcgacaagctcgg

SEQ ID NO: 720299 - DNA, 25 bp, Artificial sequence
  Synthetic oligonucleotide
gacaccttcgacaagctcggcaatc

SEQ ID NO: 720300 - DNA, 25 bp, Artificial sequence
  Synthetic oligonucleotide
cttcgacaagctcggcaatcccatc

SEQ ID NO: 720301 - DNA, 25 bp, Artificial sequence
  Synthetic oligonucleotide
acaagctcggcaatcccatcgagct

SEQ ID NO: 720302 - DNA, 25 bp, Artificial sequence
  Synthetic oligonucleotide
tcggcaatcccatcgagctgtcgcc

SEQ ID NO: 720303 - DNA, 25 bp, Artificial sequence
  Synthetic oligonucleotide
atcccatcgagctgtcgccgcgcaa

SEQ ID NO: 720304 - DNA, 25 bp, Artificial sequence
  Synthetic oligonucleotide
tcgagctgtcgccgcgcaacatcct

SEQ ID NO: 720305 - DNA, 25 bp, Artificial sequence
  Synthetic oligonucleotide
tggcgccagagatggagttctacct

SEQ ID NO: 720306 - DNA, 25 bp, Artificial sequence
  Synthetic oligonucleotide
cgcgcaacatcctcaagcgcgtgtt

SEQ ID NO: 720307 - DNA, 25 bp, Artificial sequence
  Synthetic oligonucleotide
cgatcgtggcgccagagatggagtt

SEQ ID NO: 720308 - DNA, 25 bp, Artificial sequence
  Synthetic oligonucleotide
tcaagcgcgtgttgaagatgtatgc

SEQ ID NO: 720309 - DNA, 25 bp, Artificial sequence
  Synthetic oligonucleotide
gcgtgttgaagatgtatgccgacaa

SEQ ID NO: 720310 - DNA, 25 bp, Artificial sequence
  Synthetic oligonucleotide
ttgaagatgtatgccgacaagggct

SEQ ID NO: 720311 - DNA, 25 bp, Artificial sequence
  Synthetic oligonucleotide
atgtatgccgacaagggctggcggc

SEQ ID NO: 720312 - DNA, 25 bp, Artificial sequence
  Synthetic oligonucleotide
gccgacaagggctggcggccgatcg

SEQ ID NO: 720313 - DNA, 25 bp, Artificial sequence
  Synthetic oligonucleotide
aagggctggcggccgatcgtggcgc

SEQ ID NO: 720314 - DNA, 25 bp, Artificial sequence
  Synthetic oligonucleotide
ccatcgacgccgccaacgagttcga

SEQ ID NO: 720315 - DNA, 25 bp, Artificial sequence
  Synthetic oligonucleotide
tgtcgccgcgcaacatcctcaagcg

SEQ ID NO: 720316 - DNA, 25 bp, Artificial sequence
  Synthetic oligonucleotide
gtgttcaagcgcaccatgcgcgagg

SEQ ID NO: 720317 - DNA, 25 bp, Artificial sequence
  Synthetic oligonucleotide
aacttccgtcatggcgacgccctcg

SEQ ID NO: 720318 - DNA, 25 bp, Artificial sequence
  Synthetic oligonucleotide
ccgtcatggcgacgccctcgacctg

SEQ ID NO: 720319 - DNA, 25 bp, Artificial sequence
  Synthetic oligonucleotide
tggcgacgccctcgacctggccgac

SEQ ID NO: 720320 - DNA, 25 bp, Artificial sequence
  Synthetic oligonucleotide
cgccctcgacctggccgaccagatc

SEQ ID NO: 720321 - DNA, 25 bp, Artificial sequence
  Synthetic oligonucleotide
cgacctggccgaccagatcctggtg

SEQ ID NO: 720322 - DNA, 25 bp, Artificial sequence
  Synthetic oligonucleotide
ggccgaccagatcctggtgttcaag

SEQ ID NO: 720323 - DNA, 25 bp, Artificial sequence
  Synthetic oligonucleotide
cgtcagtcgttctccatcgacgccg

SEQ ID NO: 720324 - DNA, 25 bp, Artificial sequence
  Synthetic oligonucleotide
tcctggtgttcaagcgcaccatgcg

SEQ ID NO: 720325 - DNA, 25 bp, Artificial sequence
  Synthetic oligonucleotide
ccgcgcagatggagatcaacttccg

SEQ ID NO: 720326 - DNA, 25 bp, Artificial sequence
  Synthetic oligonucleotide
caagcgcaccatgcgcgaggccgcg

SEQ ID NO: 720327 - DNA, 25 bp, Artificial sequence
  Synthetic oligonucleotide
caccatgcgcgaggccgcgctcaag

SEQ ID NO: 720328 - DNA, 25 bp, Artificial sequence
  Synthetic oligonucleotide
cgcgaggccgcgctcaagcacaacg

SEQ ID NO: 720329 - DNA, 25 bp, Artificial sequence
  Synthetic oligonucleotide
gccgcgctcaagcacaacgtcgccg

SEQ ID NO: 720330 - DNA, 25 bp, Artificial sequence
  Synthetic oligonucleotide
ctcaagcacaacgtcgccgcgacct

SEQ ID NO: 720331 - DNA, 25 bp, Artificial sequence
  Synthetic oligonucleotide
cacaacgtcgccgcgaccttcatgg

SEQ ID NO: 720332 - DNA, 25 bp, Artificial sequence
  Synthetic oligonucleotide
gtcgccgcgaccttcatggccaagc

SEQ ID NO: 720333 - DNA, 25 bp, Artificial sequence
  Synthetic oligonucleotide
accagatcctggtgttcaagcgcac

SEQ ID NO: 720334 - DNA, 25 bp, Artificial sequence
  Synthetic oligonucleotide
cccagggccttgacctggatacgct

SEQ ID NO: 720335 - DNA, 25 bp, Artificial sequence
  Synthetic oligonucleotide
acgccgccaacgagttcgacccgct

SEQ ID NO: 720336 - DNA, 25 bp, Artificial sequence
  Synthetic oligonucleotide
ccaacgagttcgacccgctgttcga

SEQ ID NO: 720337 - DNA, 25 bp, Artificial sequence
  Synthetic oligonucleotide
agttcgacccgctgttcgaggacat

SEQ ID NO: 720338 - DNA, 25 bp, Artificial sequence
  Synthetic oligonucleotide
acccgctgttcgaggacatgtacga

SEQ ID NO: 720339 - DNA, 25 bp, Artificial sequence
  Synthetic oligonucleotide
tgttcgaggacatgtacgactggtg

SEQ ID NO: 720340 - DNA, 25 bp, Artificial sequence
  Synthetic oligonucleotide
aggacatgtacgactggtgcgaggc

SEQ ID NO: 720341 - DNA, 25 bp, Artificial sequence
  Synthetic oligonucleotide
tgtacgactggtgcgaggcccaggg

SEQ ID NO: 720342 - DNA, 25 bp, Artificial sequence
  Synthetic oligonucleotide
agatcaacttccgtcatggcgacgc

SEQ ID NO: 720343 - DNA, 25 bp, Artificial sequence
  Synthetic oligonucleotide
gcgaggcccagggccttgacctgga

SEQ ID NO: 720344 - DNA, 25 bp, Artificial sequence
  Synthetic oligonucleotide
agatggagatcaacttccgtcatgg

SEQ ID NO: 720345 - DNA, 25 bp, Artificial sequence
  Synthetic oligonucleotide
gccttgacctggatacgctgatcca

SEQ ID NO: 720346 - DNA, 25 bp, Artificial sequence
  Synthetic oligonucleotide
acctggatacgctgatccacgagga

SEQ ID NO: 720347 - DNA, 25 bp, Artificial sequence
  Synthetic oligonucleotide
atacgctgatccacgaggaaggcac

SEQ ID NO: 720348 - DNA, 25 bp, Artificial sequence
  Synthetic oligonucleotide
tgatccacgaggaaggcaccgcgca

SEQ ID NO: 720349 - DNA, 25 bp, Artificial sequence
  Synthetic oligonucleotide
cacgaggaaggcaccgcgcagatgg

SEQ ID NO: 720350 - DNA, 25 bp, Artificial sequence
  Synthetic oligonucleotide
aaggcaccgcgcagatggagatcaa

SEQ ID NO: 720351 - DNA, 25 bp, Artificial sequence
  Synthetic oligonucleotide
tggtgatccacgacaccttcgacaa

SEQ ID NO: 720352 - DNA, 25 bp, Artificial sequence
  Synthetic oligonucleotide
actggtgcgaggcccagggccttga

SEQ ID NO: 720353 - DNA, 25 bp, Artificial sequence
  Synthetic oligonucleotide
gtggtcgtaggcgatgttcttgacc

SEQ ID NO: 720354 - DNA, 25 bp, Artificial sequence
  Synthetic oligonucleotide
cccggcctggcccggatagggcttg

SEQ ID NO: 720355 - DNA, 25 bp, Artificial sequence
  Synthetic oligonucleotide
cctggcccggatagggcttggccat

SEQ ID NO: 720356 - DNA, 25 bp, Artificial sequence
  Synthetic oligonucleotide
ccggatagggcttggccatgaaggt

SEQ ID NO: 720357 - DNA, 25 bp, Artificial sequence
  Synthetic oligonucleotide
agggcttggccatgaaggtggtgtc

SEQ ID NO: 720358 - DNA, 25 bp, Artificial sequence
  Synthetic oligonucleotide
tggccatgaaggtggtgtccatctc

SEQ ID NO: 720359 - DNA, 25 bp, Artificial sequence
  Synthetic oligonucleotide
tgaaggtggtgtccatctcgtggtc

SEQ ID NO: 720360 - DNA, 25 bp, Artificial sequence
  Synthetic oligonucleotide
tggtcgcaggccttgagggcgtcgt

SEQ ID NO: 720361 - DNA, 25 bp, Artificial sequence
  Synthetic oligonucleotide
ccatctcgtggtcgtaggcgatgtt

SEQ ID NO: 720362 - DNA, 25 bp, Artificial sequence
  Synthetic oligonucleotide
agcgagatatgcacgtgcagtccgt

SEQ ID NO: 720363 - DNA, 25 bp, Artificial sequence
  Synthetic oligonucleotide
cgtaggcgatgttcttgaccaggcg

SEQ ID NO: 720364 - DNA, 25 bp, Artificial sequence
  Synthetic oligonucleotide
cgatgttcttgaccaggcgcttgag

SEQ ID NO: 720365 - DNA, 25 bp, Artificial sequence
  Synthetic oligonucleotide
tcttgaccaggcgcttgagcagcac

SEQ ID NO: 720366 - DNA, 25 bp, Artificial sequence
  Synthetic oligonucleotide
accaggcgcttgagcagcaccgcgt

SEQ ID NO: 720367 - DNA, 25 bp, Artificial sequence
  Synthetic oligonucleotide
cgcttgagcagcaccgcgtggtcgc

SEQ ID NO: 720368 - DNA, 25 bp, Artificial sequence
  Synthetic oligonucleotide
agcagcaccgcgtggtcgcaggcct

SEQ ID NO: 720369 - DNA, 25 bp, Artificial sequence
  Synthetic oligonucleotide
aggccggcagggtctcgagcacacc

SEQ ID NO: 720370 - DNA, 25 bp, Artificial sequence
  Synthetic oligonucleotide
tggtgtccatctcgtggtcgtaggc

SEQ ID NO: 720371 - DNA, 25 bp, Artificial sequence
  Synthetic oligonucleotide
ggatcctcgctggtgaagatgttgt

SEQ ID NO: 720372 - DNA, 25 bp, Artificial sequence
  Synthetic oligonucleotide
cgttcacgttctcctggtcgatcag

SEQ ID NO: 720373 - DNA, 25 bp, Artificial sequence
  Synthetic oligonucleotide
gtctcgagcacaccgccgatcgcat

SEQ ID NO: 720374 - DNA, 25 bp, Artificial sequence
  Synthetic oligonucleotide
agcacaccgccgatcgcatggcgca

SEQ ID NO: 720375 - DNA, 25 bp, Artificial sequence
  Synthetic oligonucleotide
ccgccgatcgcatggcgcaatgcgg

SEQ ID NO: 720376 - DNA, 25 bp, Artificial sequence
  Synthetic oligonucleotide
atcgcatggcgcaatgcggcgttct

SEQ ID NO: 720377 - DNA, 25 bp, Artificial sequence
  Synthetic oligonucleotide
tggcgcaatgcggcgttctgctcgg

SEQ ID NO: 720378 - DNA, 25 bp, Artificial sequence
  Synthetic oligonucleotide
aatgcggcgttctgctcgggatcct

SEQ ID NO: 720379 - DNA, 25 bp, Artificial sequence
  Synthetic oligonucleotide
cacgtgcagtccgttcccggcctgg

SEQ ID NO: 720380 - DNA, 25 bp, Artificial sequence
  Synthetic oligonucleotide
tgctcgggatcctcgctggtgaaga

SEQ ID NO: 720381 - DNA, 25 bp, Artificial sequence
  Synthetic oligonucleotide
atatgcacgtgcagtccgttcccgg

SEQ ID NO: 720382 - DNA, 25 bp, Artificial sequence
  Synthetic oligonucleotide
tcgctggtgaagatgttgttgccat

SEQ ID NO: 720383 - DNA, 25 bp, Artificial sequence
  Synthetic oligonucleotide
gtgaagatgttgttgccatgcttgt

SEQ ID NO: 720384 - DNA, 25 bp, Artificial sequence
  Synthetic oligonucleotide
atgttgttgccatgcttgtcgagca

SEQ ID NO: 720385 - DNA, 25 bp, Artificial sequence
  Synthetic oligonucleotide
ttgccatgcttgtcgagcagcgaga

SEQ ID NO: 720386 - DNA, 25 bp, Artificial sequence
  Synthetic oligonucleotide
tgcttgtcgagcagcgagatatgca

SEQ ID NO: 720387 - DNA, 25 bp, Artificial sequence
  Synthetic oligonucleotide
tcgagcagcgagatatgcacgtgca

SEQ ID NO: 720388 - DNA, 25 bp, Artificial sequence
  Synthetic oligonucleotide
caggccttgagggcgtcgttgacgt

SEQ ID NO: 720389 - DNA, 25 bp, Artificial sequence
  Synthetic oligonucleotide
gcgttctgctcgggatcctcgctgg

SEQ ID NO: 720390 - DNA, 25 bp, Artificial sequence
  Synthetic oligonucleotide
actgcggacgtttgccggagatcgg

SEQ ID NO: 720391 - DNA, 25 bp, Artificial sequence
  Synthetic oligonucleotide
aggcactcgacgtattcgtcgaggt

SEQ ID NO: 720392 - DNA, 25 bp, Artificial sequence
  Synthetic oligonucleotide
tcgacgtattcgtcgaggtcgtcga

SEQ ID NO: 720393 - DNA, 25 bp, Artificial sequence
  Synthetic oligonucleotide
tattcgtcgaggtcgtcgatggagt

SEQ ID NO: 720394 - DNA, 25 bp, Artificial sequence
  Synthetic oligonucleotide
tcgaggtcgtcgatggagtacacct

SEQ ID NO: 720395 - DNA, 25 bp, Artificial sequence
  Synthetic oligonucleotide
tcgtcgatggagtacacctgcaccg

SEQ ID NO: 720396 - DNA, 25 bp, Artificial sequence
  Synthetic oligonucleotide
atggagtacacctgcaccgactgcg

SEQ ID NO: 720397 - DNA, 25 bp, Artificial sequence
  Synthetic oligonucleotide
accgcgtggtcgcaggccttgaggg

SEQ ID NO: 720398 - DNA, 25 bp, Artificial sequence
  Synthetic oligonucleotide
gcaccgactgcggacgtttgccgga

SEQ ID NO: 720399 - DNA, 25 bp, Artificial sequence
  Synthetic oligonucleotide
gccgtcgatgatgtcctggaggcac

SEQ ID NO: 720400 - DNA, 25 bp, Artificial sequence
  Synthetic oligonucleotide
gacgtttgccggagatcggcgagcg

SEQ ID NO: 720401 - DNA, 25 bp, Artificial sequence
  Synthetic oligonucleotide
ttgccggagatcggcgagcgcggcg

SEQ ID NO: 720402 - DNA, 25 bp, Artificial sequence
  Synthetic oligonucleotide
gagatcggcgagcgcggcggttgcg

SEQ ID NO: 720403 - DNA, 25 bp, Artificial sequence
  Synthetic oligonucleotide
ggcgagcgcggcggttgcggccggc

SEQ ID NO: 720404 - DNA, 25 bp, Artificial sequence
  Synthetic oligonucleotide
cgcggcggttgcggccggccgttca

SEQ ID NO: 720405 - DNA, 25 bp, Artificial sequence
  Synthetic oligonucleotide
gttgcggccggccgttcacgttctc

SEQ ID NO: 720406 - DNA, 25 bp, Artificial sequence
  Synthetic oligonucleotide
ttgtactcgaggtcggagatcgagt

SEQ ID NO: 720407 - DNA, 25 bp, Artificial sequence
  Synthetic oligonucleotide
acacctgcaccgactgcggacgttt

SEQ ID NO: 720408 - DNA, 25 bp, Artificial sequence
  Synthetic oligonucleotide
ttcggcgacgatggcgtcggccggg

SEQ ID NO: 720409 - DNA, 25 bp, Artificial sequence
  Synthetic oligonucleotide
ttgagggcgtcgttgacgtggttga

SEQ ID NO: 720410 - DNA, 25 bp, Artificial sequence
  Synthetic oligonucleotide
gcgtcgttgacgtggttgaggttga

SEQ ID NO: 720411 - DNA, 25 bp, Artificial sequence
  Synthetic oligonucleotide
ttgacgtggttgaggttgacctcga

SEQ ID NO: 720412 - DNA, 25 bp, Artificial sequence
  Synthetic oligonucleotide
tggttgaggttgacctcgaactgcg

SEQ ID NO: 720413 - DNA, 25 bp, Artificial sequence
  Synthetic oligonucleotide
aggttgacctcgaactgcgccggtg

SEQ ID NO: 720414 - DNA, 25 bp, Artificial sequence
  Synthetic oligonucleotide
acctcgaactgcgccggtgcggatt

SEQ ID NO: 720415 - DNA, 25 bp, Artificial sequence
  Synthetic oligonucleotide
aactgcgccggtgcggattcggcga

SEQ ID NO: 720416 - DNA, 25 bp, Artificial sequence
  Synthetic oligonucleotide
tcctggaggcactcgacgtattcgt

SEQ ID NO: 720417 - DNA, 25 bp, Artificial sequence
  Synthetic oligonucleotide
gcggattcggcgacgatggcgtcgg

SEQ ID NO: 720418 - DNA, 25 bp, Artificial sequence
  Synthetic oligonucleotide
gatgatgtcctggaggcactcgacg

SEQ ID NO: 720419 - DNA, 25 bp, Artificial sequence
  Synthetic oligonucleotide
cgacgatggcgtcggccgggatgcc

SEQ ID NO: 720420 - DNA, 25 bp, Artificial sequence
  Synthetic oligonucleotide
tggcgtcggccgggatgccctgggc

SEQ ID NO: 720421 - DNA, 25 bp, Artificial sequence
  Synthetic oligonucleotide
ggccgggatgccctgggcgcgggcg

SEQ ID NO: 720422 - DNA, 25 bp, Artificial sequence
  Synthetic oligonucleotide
gatgccctgggcgcgggcgccgtcg

SEQ ID NO: 720423 - DNA, 25 bp, Artificial sequence
  Synthetic oligonucleotide
ctgggcgcgggcgccgtcgatgatg

SEQ ID NO: 720424 - DNA, 25 bp, Artificial sequence
  Synthetic oligonucleotide
gcgggcgccgtcgatgatgtcctgg

SEQ ID NO: 720425 - DNA, 25 bp, Artificial sequence
  Synthetic oligonucleotide
catggaggccggcagggtctcgagc

SEQ ID NO: 720426 - DNA, 25 bp, Artificial sequence
  Synthetic oligonucleotide
gccggtgcggattcggcgacgatgg

SEQ ID NO: 720427 - DNA, 25 bp, Artificial sequence
  Synthetic oligonucleotide
catctgctcgtaggagttgccttcg

SEQ ID NO: 720428 - DNA, 25 bp, Artificial sequence
  Synthetic oligonucleotide
tcgctttcgtccagctcgcgcaggg

SEQ ID NO: 720429 - DNA, 25 bp, Artificial sequence
  Synthetic oligonucleotide
tcgtccagctcgcgcagggcgtcgc

SEQ ID NO: 720430 - DNA, 25 bp, Artificial sequence
  Synthetic oligonucleotide
gctcgcgcagggcgtcgcgcaggtt

SEQ ID NO: 720431 - DNA, 25 bp, Artificial sequence
  Synthetic oligonucleotide
cagggcgtcgcgcaggttgttcggc

SEQ ID NO: 720432 - DNA, 25 bp, Artificial sequence
  Synthetic oligonucleotide
gtcgcgcaggttgttcggcaggctc

SEQ ID NO: 720433 - DNA, 25 bp, Artificial sequence
  Synthetic oligonucleotide
aggttgttcggcaggctcggctcca

SEQ ID NO: 720434 - DNA, 25 bp, Artificial sequence
  Synthetic oligonucleotide
tgttggtcagcccgtgatgaacgcc

SEQ ID NO: 720435 - DNA, 25 bp, Artificial sequence
  Synthetic oligonucleotide
gcaggctcggctccatctgctcgta

SEQ ID NO: 720436 - DNA, 25 bp, Artificial sequence
  Synthetic oligonucleotide
gatgtacttcgccatgatctcgctt

SEQ ID NO: 720437 - DNA, 25 bp, Artificial sequence
  Synthetic oligonucleotide
ctcgtaggagttgccttcgatcggc

SEQ ID NO: 720438 - DNA, 25 bp, Artificial sequence
  Synthetic oligonucleotide
ggagttgccttcgatcggcgcgccc

SEQ ID NO: 720439 - DNA, 25 bp, Artificial sequence
  Synthetic oligonucleotide
tgccttcgatcggcgcgcccggctc

SEQ ID NO: 720440 - DNA, 25 bp, Artificial sequence
  Synthetic oligonucleotide
cgatcggcgcgcccggctcgacctt

SEQ ID NO: 720441 - DNA, 25 bp, Artificial sequence
  Synthetic oligonucleotide
gcgcgcccggctcgaccttgttggt

SEQ ID NO: 720442 - DNA, 25 bp, Artificial sequence
  Synthetic oligonucleotide
ccggctcgaccttgttggtcagccc

SEQ ID NO: 720443 - DNA, 25 bp, Artificial sequence
  Synthetic oligonucleotide
gcagggtctcgagcacaccgccgat

SEQ ID NO: 720444 - DNA, 25 bp, Artificial sequence
  Synthetic oligonucleotide
gttcggcaggctcggctccatctgc

SEQ ID NO: 720445 - DNA, 25 bp, Artificial sequence
  Synthetic oligonucleotide
cgctttccttgcaggcgacgaagat

SEQ ID NO: 720446 - DNA, 25 bp, Artificial sequence
  Synthetic oligonucleotide
cgcctgccgctgacgatcgaagcgg

SEQ ID NO: 720447 - DNA, 25 bp, Artificial sequence
  Synthetic oligonucleotide
gacggtatgcaggtaccagttgtac

SEQ ID NO: 720448 - DNA, 25 bp, Artificial sequence
  Synthetic oligonucleotide
taccagttgtactcgaggtcggaga

SEQ ID NO: 720449 - DNA, 25 bp, Artificial sequence
  Synthetic oligonucleotide
tcgaggtcggagatcgagtgctcga

SEQ ID NO: 720450 - DNA, 25 bp, Artificial sequence
  Synthetic oligonucleotide
tcggagatcgagtgctcgaactcct

SEQ ID NO: 720451 - DNA, 25 bp, Artificial sequence
  Synthetic oligonucleotide
atcgagtgctcgaactcctccagct

SEQ ID NO: 720452 - DNA, 25 bp, Artificial sequence
  Synthetic oligonucleotide
tgctcgaactcctccagctcgcttt

SEQ ID NO: 720453 - DNA, 25 bp, Artificial sequence
  Synthetic oligonucleotide
atgatctcgctttcgtccagctcgc

SEQ ID NO: 720454 - DNA, 25 bp, Artificial sequence
  Synthetic oligonucleotide
ccagctcgctttccttgcaggcgac

SEQ ID NO: 720455 - DNA, 25 bp, Artificial sequence
  Synthetic oligonucleotide
ttcgccatgatctcgctttcgtcca

SEQ ID NO: 720456 - DNA, 25 bp, Artificial sequence
  Synthetic oligonucleotide
ccttgcaggcgacgaagatgtcgat

SEQ ID NO: 720457 - DNA, 25 bp, Artificial sequence
  Synthetic oligonucleotide
aggcgacgaagatgtcgatgtactt

SEQ ID NO: 720458 - DNA, 25 bp, Artificial sequence
  Synthetic oligonucleotide
cgaagatgtcgatgtacttcgggtc

SEQ ID NO: 720459 - DNA, 25 bp, Artificial sequence
  Synthetic oligonucleotide
tgtcgatgtacttcgggtcgatgta

SEQ ID NO: 720460 - DNA, 25 bp, Artificial sequence
  Synthetic oligonucleotide
tgtacttcgggtcgatgtacttcgc

SEQ ID NO: 720461 - DNA, 25 bp, Artificial sequence
  Synthetic oligonucleotide
tcgggtcgatgtacttcgccatgat

SEQ ID NO: 720462 - DNA, 25 bp, Artificial sequence
  Synthetic oligonucleotide
gtcagcccgtgatgaacgcctgcca

SEQ ID NO: 720463 - DNA, 25 bp, Artificial sequence
  Synthetic oligonucleotide
aactcctccagctcgctttccttgc

SEQ ID NO: 720464 - DNA, 25 bp, Artificial sequence
  Synthetic oligonucleotide
ctgcgaaccgaagcggcggtaggag

SEQ ID NO: 720465 - DNA, 25 bp, Artificial sequence
  Synthetic oligonucleotide
acggtgcggttgtccaggccccagc

SEQ ID NO: 720466 - DNA, 25 bp, Artificial sequence
  Synthetic oligonucleotide
cggttgtccaggccccagctcggcg

SEQ ID NO: 720467 - DNA, 25 bp, Artificial sequence
  Synthetic oligonucleotide
tccaggccccagctcggcgcgttcg

SEQ ID NO: 720468 - DNA, 25 bp, Artificial sequence
  Synthetic oligonucleotide
ccccagctcggcgcgttcggcacgt

SEQ ID NO: 720469 - DNA, 25 bp, Artificial sequence
  Synthetic oligonucleotide
ctcggcgcgttcggcacgtagaact

SEQ ID NO: 720470 - DNA, 25 bp, Artificial sequence
  Synthetic oligonucleotide
gcgttcggcacgtagaactgcgaac

SEQ ID NO: 720471 - DNA, 25 bp, Artificial sequence
  Synthetic oligonucleotide
cgaccttgttggtcagcccgtgatg

SEQ ID NO: 720472 - DNA, 25 bp, Artificial sequence
  Synthetic oligonucleotide
tagaactgcgaaccgaagcggcggt

SEQ ID NO: 720473 - DNA, 25 bp, Artificial sequence
  Synthetic oligonucleotide
gtgggcacgcgcagggccacggtgc

SEQ ID NO: 720474 - DNA, 25 bp, Artificial sequence
  Synthetic oligonucleotide
accgaagcggcggtaggagttgacg

SEQ ID NO: 720475 - DNA, 25 bp, Artificial sequence
  Synthetic oligonucleotide
agcggcggtaggagttgacgttcgg

SEQ ID NO: 720476 - DNA, 25 bp, Artificial sequence
  Synthetic oligonucleotide
ggtaggagttgacgttcgggcagag

SEQ ID NO: 720477 - DNA, 25 bp, Artificial sequence
  Synthetic oligonucleotide
agttgacgttcgggcagaggaaggc

SEQ ID NO: 720478 - DNA, 25 bp, Artificial sequence
  Synthetic oligonucleotide
cgttcgggcagaggaaggccatgga

SEQ ID NO: 720479 - DNA, 25 bp, Artificial sequence
  Synthetic oligonucleotide
gcagaggaaggccatggaggccggc

SEQ ID NO: 720480 - DNA, 25 bp, Artificial sequence
  Synthetic oligonucleotide
gaaggccatggaggccggcagggtc

SEQ ID NO: 720481 - DNA, 25 bp, Artificial sequence
  Synthetic oligonucleotide
ggcacgtagaactgcgaaccgaagc

SEQ ID NO: 720482 - DNA, 25 bp, Artificial sequence
  Synthetic oligonucleotide
ccggccacgcggtgttccaggcgta

SEQ ID NO: 720483 - DNA, 25 bp, Artificial sequence
  Synthetic oligonucleotide
ccgtgatgaacgcctgccagcaccg

SEQ ID NO: 720484 - DNA, 25 bp, Artificial sequence
  Synthetic oligonucleotide
tgaacgcctgccagcaccgctgcca

SEQ ID NO: 720485 - DNA, 25 bp, Artificial sequence
  Synthetic oligonucleotide
ctgccagcaccgctgccagtagcag

SEQ ID NO: 720486 - DNA, 25 bp, Artificial sequence
  Synthetic oligonucleotide
gcaccgctgccagtagcaggtaggg

SEQ ID NO: 720487 - DNA, 25 bp, Artificial sequence
  Synthetic oligonucleotide
ctgccagtagcaggtaggggttggc

SEQ ID NO: 720488 - DNA, 25 bp, Artificial sequence
  Synthetic oligonucleotide
tagcaggtaggggttggcgtcggcg

SEQ ID NO: 720489 - DNA, 25 bp, Artificial sequence
  Synthetic oligonucleotide
taggggttggcgtcggcgccggcca

SEQ ID NO: 720490 - DNA, 25 bp, Artificial sequence
  Synthetic oligonucleotide
agggccacggtgcggttgtccaggc

SEQ ID NO: 720491 - DNA, 25 bp, Artificial sequence
  Synthetic oligonucleotide
tcggcgccggccacgcggtgttcca

SEQ ID NO: 720492 - DNA, 25 bp, Artificial sequence
  Synthetic oligonucleotide
acgcgcagggccacggtgcggttgt

SEQ ID NO: 720493 - DNA, 25 bp, Artificial sequence
  Synthetic oligonucleotide
acgcggtgttccaggcgtaccgcgt

SEQ ID NO: 720494 - DNA, 25 bp, Artificial sequence
  Synthetic oligonucleotide
tgttccaggcgtaccgcgtccgggc

SEQ ID NO: 720495 - DNA, 25 bp, Artificial sequence
  Synthetic oligonucleotide
aggcgtaccgcgtccgggctgccgg

SEQ ID NO: 720496 - DNA, 25 bp, Artificial sequence
  Synthetic oligonucleotide
accgcgtccgggctgccggtgggca

SEQ ID NO: 720497 - DNA, 25 bp, Artificial sequence
  Synthetic oligonucleotide
tccgggctgccggtgggcacgcgca

SEQ ID NO: 720498 - DNA, 25 bp, Artificial sequence
  Synthetic oligonucleotide
ctgccggtgggcacgcgcagggcca

SEQ ID NO: 720499 - DNA, 25 bp, Artificial sequence
  Synthetic oligonucleotide
cgttctcctggtcgatcaggtagaa

SEQ ID NO: 720500 - DNA, 25 bp, Artificial sequence
  Synthetic oligonucleotide
ttggcgtcggcgccggccacgcggt

SEQ ID NO: 720501 - DNA, 25 bp, Artificial sequence
  Synthetic oligonucleotide
gcctattgtgtaaaaaaatgaacaa

SEQ ID NO: 720502 - DNA, 25 bp, Artificial sequence
  Synthetic oligonucleotide
aaacctcgcgtcgaagggtgttcag

SEQ ID NO: 720503 - DNA, 25 bp, Artificial sequence
  Synthetic oligonucleotide
cgcgtcgaagggtgttcaggagtgc

SEQ ID NO: 720504 - DNA, 25 bp, Artificial sequence
  Synthetic oligonucleotide
gaagggtgttcaggagtgcgtgttc

SEQ ID NO: 720505 - DNA, 25 bp, Artificial sequence
  Synthetic oligonucleotide
tgttcaggagtgcgtgttcaatttt

SEQ ID NO: 720506 - DNA, 25 bp, Artificial sequence
  Synthetic oligonucleotide
ggagtgcgtgttcaattttttacag

SEQ ID NO: 720507 - DNA, 25 bp, Artificial sequence
  Synthetic oligonucleotide
cgtgttcaattttttacaggcctat

SEQ ID NO: 720508 - DNA, 25 bp, Artificial sequence
  Synthetic oligonucleotide
taacatctacaaacaacgggtgtct

SEQ ID NO: 720509 - DNA, 25 bp, Artificial sequence
  Synthetic oligonucleotide
tacaggcctattgtgtaaaaaaatg

SEQ ID NO: 720510 - DNA, 25 bp, Artificial sequence
  Synthetic oligonucleotide
gaggccgttttcagggcattttcgc

SEQ ID NO: 720511 - DNA, 25 bp, Artificial sequence
  Synthetic oligonucleotide
tgtgtaaaaaaatgaacaacgctaa

SEQ ID NO: 720512 - DNA, 25 bp, Artificial sequence
  Synthetic oligonucleotide
aaaaaatgaacaacgctaagctcgg

SEQ ID NO: 720513 - DNA, 25 bp, Artificial sequence
  Synthetic oligonucleotide
tgaacaacgctaagctcggccaaac

SEQ ID NO: 720514 - DNA, 25 bp, Artificial sequence
  Synthetic oligonucleotide
acgctaagctcggccaaaccccata

SEQ ID NO: 720515 - DNA, 25 bp, Artificial sequence
  Synthetic oligonucleotide
agctcggccaaaccccataacatct

SEQ ID NO: 720516 - DNA, 25 bp, Artificial sequence
  Synthetic oligonucleotide
ggccaaaccccataacatctacaaa

SEQ ID NO: 720517 - DNA, 25 bp, Artificial sequence
  Synthetic oligonucleotide
tgatgcaacaccttttttgttaaaa

SEQ ID NO: 720518 - DNA, 25 bp, Artificial sequence
  Synthetic oligonucleotide
caattttttacaggcctattgtgta

SEQ ID NO: 720519 - DNA, 25 bp, Artificial sequence
  Synthetic oligonucleotide
gtgggatgtcaatagccgccaaaaa

SEQ ID NO: 720520 - DNA, 25 bp, Artificial sequence
  Synthetic oligonucleotide
gccggccgttcacgttctcctggtc

SEQ ID NO: 720521 - DNA, 25 bp, Artificial sequence
  Synthetic oligonucleotide
aaaatttcaatcatgcggggggtag

SEQ ID NO: 720522 - DNA, 25 bp, Artificial sequence
  Synthetic oligonucleotide
ttcaatcatgcggggggtaggctat

SEQ ID NO: 720523 - DNA, 25 bp, Artificial sequence
  Synthetic oligonucleotide
catgcggggggtaggctatgagtca

SEQ ID NO: 720524 - DNA, 25 bp, Artificial sequence
  Synthetic oligonucleotide
ggggtaggctatgagtcaatccgaa

SEQ ID NO: 720525 - DNA, 25 bp, Artificial sequence
  Synthetic oligonucleotide
ggctatgagtcaatccgaaagcctg

SEQ ID NO: 720526 - DNA, 25 bp, Artificial sequence
  Synthetic oligonucleotide
gagtcaatccgaaagcctgtgggat

SEQ ID NO: 720527 - DNA, 25 bp, Artificial sequence
  Synthetic oligonucleotide
gcattttcgccggacgaaaagccga

SEQ ID NO: 720528 - DNA, 25 bp, Artificial sequence
  Synthetic oligonucleotide
aagcctgtgggatgtcaatagccgc

SEQ ID NO: 720529 - DNA, 25 bp, Artificial sequence
  Synthetic oligonucleotide
ttttcagggcattttcgccggacga

SEQ ID NO: 720530 - DNA, 25 bp, Artificial sequence
  Synthetic oligonucleotide
tgtcaatagccgccaaaaacgccct

SEQ ID NO: 720531 - DNA, 25 bp, Artificial sequence
  Synthetic oligonucleotide
tagccgccaaaaacgccctcttgtg

SEQ ID NO: 720532 - DNA, 25 bp, Artificial sequence
  Synthetic oligonucleotide
aaacgccctcttgtggggcgttgag

SEQ ID NO: 720533 - DNA, 25 bp, Artificial sequence
  Synthetic oligonucleotide
cctcttgtggggcgttgaggccgtt

SEQ ID NO: 720534 - DNA, 25 bp, Artificial sequence
  Synthetic oligonucleotide
tgtggggcgttgaggccgttttcag

SEQ ID NO: 720535 - DNA, 25 bp, Artificial sequence
  Synthetic oligonucleotide
gcgttgaggccgttttcagggcatt

SEQ ID NO: 720536 - DNA, 25 bp, Artificial sequence
  Synthetic oligonucleotide
tacaaacaacgggtgtctcatgtct

SEQ ID NO: 720537 - DNA, 25 bp, Artificial sequence
  Synthetic oligonucleotide
atccgaaagcctgtgggatgtcaat

SEQ ID NO: 720538 - DNA, 25 bp, Artificial sequence
  Synthetic oligonucleotide
tcgaccaggcagccctgctggacag

SEQ ID NO: 720539 - DNA, 25 bp, Artificial sequence
  Synthetic oligonucleotide
acggcgctggcggtctcccgctgat

SEQ ID NO: 720540 - DNA, 25 bp, Artificial sequence
  Synthetic oligonucleotide
gctggcggtctcccgctgatcattc

SEQ ID NO: 720541 - DNA, 25 bp, Artificial sequence
  Synthetic oligonucleotide
ggtctcccgctgatcattcctgcgc

SEQ ID NO: 720542 - DNA, 25 bp, Artificial sequence
  Synthetic oligonucleotide
ccgctgatcattcctgcgctgggcg

SEQ ID NO: 720543 - DNA, 25 bp, Artificial sequence
  Synthetic oligonucleotide
atcattcctgcgctgggcgagtcga

SEQ ID NO: 720544 - DNA, 25 bp, Artificial sequence
  Synthetic oligonucleotide
ctgcgctgggcgagtcgatcgacca

SEQ ID NO: 720545 - DNA, 25 bp, Artificial sequence
  Synthetic oligonucleotide
accccataacatctacaaacaacgg

SEQ ID NO: 720546 - DNA, 25 bp, Artificial sequence
  Synthetic oligonucleotide
agtcgatcgaccaggcagccctgct

SEQ ID NO: 720547 - DNA, 25 bp, Artificial sequence
  Synthetic oligonucleotide
atctgcgtgccgtcgtcaacggcgc

SEQ ID NO: 720548 - DNA, 25 bp, Artificial sequence
  Synthetic oligonucleotide
aggcagccctgctggacagcgtcga

SEQ ID NO: 720549 - DNA, 25 bp, Artificial sequence
  Synthetic oligonucleotide
ccctgctggacagcgtcgacggctt

SEQ ID NO: 720550 - DNA, 25 bp, Artificial sequence
  Synthetic oligonucleotide
tggacagcgtcgacggcttgctctt

SEQ ID NO: 720551 - DNA, 25 bp, Artificial sequence
  Synthetic oligonucleotide
gcgtcgacggcttgctcttcactgg

SEQ ID NO: 720552 - DNA, 25 bp, Artificial sequence
  Synthetic oligonucleotide
gacggcttgctcttcactggctcgc

SEQ ID NO: 720553 - DNA, 25 bp, Artificial sequence
  Synthetic oligonucleotide
ttgctcttcactggctcgccgtcga

SEQ ID NO: 720554 - DNA, 25 bp, Artificial sequence
  Synthetic oligonucleotide
ttcactggctcgccgtcgaacgtcg

SEQ ID NO: 720555 - DNA, 25 bp, Artificial sequence
  Synthetic oligonucleotide
tgggcgagtcgatcgaccaggcagc

SEQ ID NO: 720556 - DNA, 25 bp, Artificial sequence
  Synthetic oligonucleotide
aagcagatcggtcttcatccctacc

SEQ ID NO: 720557 - DNA, 25 bp, Artificial sequence
  Synthetic oligonucleotide
caacgggtgtctcatgtctcgcctg

SEQ ID NO: 720558 - DNA, 25 bp, Artificial sequence
  Synthetic oligonucleotide
gtgtctcatgtctcgcctgccgtta

SEQ ID NO: 720559 - DNA, 25 bp, Artificial sequence
  Synthetic oligonucleotide
tcatgtctcgcctgccgttaatcgg

SEQ ID NO: 720560 - DNA, 25 bp, Artificial sequence
  Synthetic oligonucleotide
tctcgcctgccgttaatcggcgtca

SEQ ID NO: 720561 - DNA, 25 bp, Artificial sequence
  Synthetic oligonucleotide
ctgccgttaatcggcgtcaccgcct

SEQ ID NO: 720562 - DNA, 25 bp, Artificial sequence
  Synthetic oligonucleotide
ttaatcggcgtcaccgcctgcacca

SEQ ID NO: 720563 - DNA, 25 bp, Artificial sequence
  Synthetic oligonucleotide
ggcgtcaccgcctgcaccaagcaga

SEQ ID NO: 720564 - DNA, 25 bp, Artificial sequence
  Synthetic oligonucleotide
tcgtcaacggcgctggcggtctccc

SEQ ID NO: 720565 - DNA, 25 bp, Artificial sequence
  Synthetic oligonucleotide
tgcaccaagcagatcggtcttcatc

SEQ ID NO: 720566 - DNA, 25 bp, Artificial sequence
  Synthetic oligonucleotide
gtgccgtcgtcaacggcgctggcgg

SEQ ID NO: 720567 - DNA, 25 bp, Artificial sequence
  Synthetic oligonucleotide
atcggtcttcatccctaccatattg

SEQ ID NO: 720568 - DNA, 25 bp, Artificial sequence
  Synthetic oligonucleotide
ttcatccctaccatattgccggcga

SEQ ID NO: 720569 - DNA, 25 bp, Artificial sequence
  Synthetic oligonucleotide
cctaccatattgccggcgacaaata

SEQ ID NO: 720570 - DNA, 25 bp, Artificial sequence
  Synthetic oligonucleotide
atattgccggcgacaaatatctgcg

SEQ ID NO: 720571 - DNA, 25 bp, Artificial sequence
  Synthetic oligonucleotide
ccggcgacaaatatctgcgtgccgt

SEQ ID NO: 720572 - DNA, 25 bp, Artificial sequence
  Synthetic oligonucleotide
acaaatatctgcgtgccgtcgtcaa

SEQ ID NO: 720573 - DNA, 25 bp, Artificial sequence
  Synthetic oligonucleotide
cgacatgatgcaacaccttttttgt

SEQ ID NO: 720574 - DNA, 25 bp, Artificial sequence
  Synthetic oligonucleotide
accgcctgcaccaagcagatcggtc

SEQ ID NO: 720575 - DNA, 25 bp, Artificial sequence
  Synthetic oligonucleotide
agggttccatggagagggtgccggg

SEQ ID NO: 720576 - DNA, 25 bp, Artificial sequence
  Synthetic oligonucleotide
ccagttcgtgcatggtcatcagcag

SEQ ID NO: 720577 - DNA, 25 bp, Artificial sequence
  Synthetic oligonucleotide
cgtgcatggtcatcagcagttgcgc

SEQ ID NO: 720578 - DNA, 25 bp, Artificial sequence
  Synthetic oligonucleotide
tggtcatcagcagttgcgcggtcgg

SEQ ID NO: 720579 - DNA, 25 bp, Artificial sequence
  Synthetic oligonucleotide
tcagcagttgcgcggtcgggcgctt

SEQ ID NO: 720580 - DNA, 25 bp, Artificial sequence
  Synthetic oligonucleotide
gttgcgcggtcgggcgcttctgcca

SEQ ID NO: 720581 - DNA, 25 bp, Artificial sequence
  Synthetic oligonucleotide
cggtcgggcgcttctgccagggttc

SEQ ID NO: 720582 - DNA, 25 bp, Artificial sequence
  Synthetic oligonucleotide
gtcgccgatgtcgagacccaggccg

SEQ ID NO: 720583 - DNA, 25 bp, Artificial sequence
  Synthetic oligonucleotide
tctgccagggttccatggagagggt

SEQ ID NO: 720584 - DNA, 25 bp, Artificial sequence
  Synthetic oligonucleotide
cgaagaacggctcgccttccagttc

SEQ ID NO: 720585 - DNA, 25 bp, Artificial sequence
  Synthetic oligonucleotide
ccatggagagggtgccggggatcgg

SEQ ID NO: 720586 - DNA, 25 bp, Artificial sequence
  Synthetic oligonucleotide
gagggtgccggggatcgggtagcag

SEQ ID NO: 720587 - DNA, 25 bp, Artificial sequence
  Synthetic oligonucleotide
gccggggatcgggtagcagatccgg

SEQ ID NO: 720588 - DNA, 25 bp, Artificial sequence
  Synthetic oligonucleotide
gatcgggtagcagatccggtcggcg

SEQ ID NO: 720589 - DNA, 25 bp, Artificial sequence
  Synthetic oligonucleotide
gtagcagatccggtcggcgtcgccg

SEQ ID NO: 720590 - DNA, 25 bp, Artificial sequence
  Synthetic oligonucleotide
gatccggtcggcgtcgccgatgtcg

SEQ ID NO: 720591 - DNA, 25 bp, Artificial sequence
  Synthetic oligonucleotide
tttttgttaaaaatttcaatcatgc

SEQ ID NO: 720592 - DNA, 25 bp, Artificial sequence
  Synthetic oligonucleotide
ggcgcttctgccagggttccatgga

SEQ ID NO: 720593 - DNA, 25 bp, Artificial sequence
  Synthetic oligonucleotide
tctcggtgaacctggccaccacctg

SEQ ID NO: 720594 - DNA, 25 bp, Artificial sequence
  Synthetic oligonucleotide
cctggtcgatcaggtagaactccag

SEQ ID NO: 720595 - DNA, 25 bp, Artificial sequence
  Synthetic oligonucleotide
cgatcaggtagaactccagctcgaa

SEQ ID NO: 720596 - DNA, 25 bp, Artificial sequence
  Synthetic oligonucleotide
ggtagaactccagctcgaaggcggc

SEQ ID NO: 720597 - DNA, 25 bp, Artificial sequence
  Synthetic oligonucleotide
actccagctcgaaggcggcgacgat

SEQ ID NO: 720598 - DNA, 25 bp, Artificial sequence
  Synthetic oligonucleotide
ctcgaaggcggcgacgatggtcagt

SEQ ID NO: 720599 - DNA, 25 bp, Artificial sequence
  Synthetic oligonucleotide
ggcggcgacgatggtcagttccatc

SEQ ID NO: 720600 - DNA, 25 bp, Artificial sequence
  Synthetic oligonucleotide
gacgatggtcagttccatctcggtg

SEQ ID NO: 720601 - DNA, 25 bp, Artificial sequence
  Synthetic oligonucleotide
cgccttccagttcgtgcatggtcat

SEQ ID NO: 720602 - DNA, 25 bp, Artificial sequence
  Synthetic oligonucleotide
gttccatctcggtgaacctggccac

SEQ ID NO: 720603 - DNA, 25 bp, Artificial sequence
  Synthetic oligonucleotide
acggctcgccttccagttcgtgcat

SEQ ID NO: 720604 - DNA, 25 bp, Artificial sequence
  Synthetic oligonucleotide
tgaacctggccaccacctggcgcag

SEQ ID NO: 720605 - DNA, 25 bp, Artificial sequence
  Synthetic oligonucleotide
tggccaccacctggcgcaggacttc

SEQ ID NO: 720606 - DNA, 25 bp, Artificial sequence
  Synthetic oligonucleotide
accacctggcgcaggacttcgcggg

SEQ ID NO: 720607 - DNA, 25 bp, Artificial sequence
  Synthetic oligonucleotide
tggcgcaggacttcgcgggggtcgg

SEQ ID NO: 720608 - DNA, 25 bp, Artificial sequence
  Synthetic oligonucleotide
caggacttcgcgggggtcggcgaag

SEQ ID NO: 720609 - DNA, 25 bp, Artificial sequence
  Synthetic oligonucleotide
ggtcggcgaagaacggctcgccttc

SEQ ID NO: 720610 - DNA, 25 bp, Artificial sequence
  Synthetic oligonucleotide
gatgtcgagacccaggccggtactc

SEQ ID NO: 720611 - DNA, 25 bp, Artificial sequence
  Synthetic oligonucleotide
ggtcagttccatctcggtgaacctg

SEQ ID NO: 720612 - DNA, 25 bp, Artificial sequence
  Synthetic oligonucleotide
ttccttgaggaactcgctcggttca

SEQ ID NO: 720613 - DNA, 25 bp, Artificial sequence
  Synthetic oligonucleotide
ccattcatgtctgcaataaggaggt

SEQ ID NO: 720614 - DNA, 25 bp, Artificial sequence
  Synthetic oligonucleotide
atgtctgcaataaggaggtcgacga

SEQ ID NO: 720615 - DNA, 25 bp, Artificial sequence
  Synthetic oligonucleotide
gcaataaggaggtcgacgaactgga

SEQ ID NO: 720616 - DNA, 25 bp, Artificial sequence
  Synthetic oligonucleotide
aaggaggtcgacgaactggacctcg

SEQ ID NO: 720617 - DNA, 25 bp, Artificial sequence
  Synthetic oligonucleotide
gtcgacgaactggacctcgggatgt

SEQ ID NO: 720618 - DNA, 25 bp, Artificial sequence
  Synthetic oligonucleotide
gaactggacctcgggatgttccttg

SEQ ID NO: 720619 - DNA, 25 bp, Artificial sequence
  Synthetic oligonucleotide
gtcggcgtcgccgatgtcgagaccc

SEQ ID NO: 720620 - DNA, 25 bp, Artificial sequence
  Synthetic oligonucleotide
gggatgttccttgaggaactcgctc

SEQ ID NO: 720621 - DNA, 25 bp, Artificial sequence
  Synthetic oligonucleotide
ccgcttgccgcgaaccacgccattc

SEQ ID NO: 720622 - DNA, 25 bp, Artificial sequence
  Synthetic oligonucleotide
gaggaactcgctcggttcagtgagc

SEQ ID NO: 720623 - DNA, 25 bp, Artificial sequence
  Synthetic oligonucleotide
ctcgctcggttcagtgagctgaacg

SEQ ID NO: 720624 - DNA, 25 bp, Artificial sequence
  Synthetic oligonucleotide
ggttcagtgagctgaacggcacgct

SEQ ID NO: 720625 - DNA, 25 bp, Artificial sequence
  Synthetic oligonucleotide
tgagctgaacggcacgctggggtac

SEQ ID NO: 720626 - DNA, 25 bp, Artificial sequence
  Synthetic oligonucleotide
gaacggcacgctggggtaccgacat

SEQ ID NO: 720627 - DNA, 25 bp, Artificial sequence
  Synthetic oligonucleotide
cacgctggggtaccgacatgatgca

SEQ ID NO: 720628 - DNA, 25 bp, Artificial sequence
  Synthetic oligonucleotide
gggtaccgacatgatgcaacacctt

SEQ ID NO: 720629 - DNA, 25 bp, Artificial sequence
  Synthetic oligonucleotide
gacctcgggatgttccttgaggaac

SEQ ID NO: 720630 - DNA, 25 bp, Artificial sequence
  Synthetic oligonucleotide
cagggaagcgggaaggttgatacct

SEQ ID NO: 720631 - DNA, 25 bp, Artificial sequence
  Synthetic oligonucleotide
agacccaggccggtactctctacgg

SEQ ID NO: 720632 - DNA, 25 bp, Artificial sequence
  Synthetic oligonucleotide
aggccggtactctctacggtggagc

SEQ ID NO: 720633 - DNA, 25 bp, Artificial sequence
  Synthetic oligonucleotide
gtactctctacggtggagccggtga

SEQ ID NO: 720634 - DNA, 25 bp, Artificial sequence
  Synthetic oligonucleotide
ctctacggtggagccggtgatatcg

SEQ ID NO: 720635 - DNA, 25 bp, Artificial sequence
  Synthetic oligonucleotide
ggtggagccggtgatatcgagggcg

SEQ ID NO: 720636 - DNA, 25 bp, Artificial sequence
  Synthetic oligonucleotide
gccggtgatatcgagggcgaacagg

SEQ ID NO: 720637 - DNA, 25 bp, Artificial sequence
  Synthetic oligonucleotide
gatatcgagggcgaacagggaagcg

SEQ ID NO: 720638 - DNA, 25 bp, Artificial sequence
  Synthetic oligonucleotide
aaccacgccattcatgtctgcaata

SEQ ID NO: 720639 - DNA, 25 bp, Artificial sequence
  Synthetic oligonucleotide
gcgaacagggaagcgggaaggttga

SEQ ID NO: 720640 - DNA, 25 bp, Artificial sequence
  Synthetic oligonucleotide
gccgcgaaccacgccattcatgtct

SEQ ID NO: 720641 - DNA, 25 bp, Artificial sequence
  Synthetic oligonucleotide
ctttttcgaagactttgttcagact

SEQ ID NO: 720642 - DNA, 25 bp, Artificial sequence
  Synthetic oligonucleotide
cgaagactttgttcagactgttgcg

SEQ ID NO: 720643 - DNA, 25 bp, Artificial sequence
  Synthetic oligonucleotide
tttgttcagactgttgcgttcgatc

SEQ ID NO: 720644 - DNA, 25 bp, Artificial sequence
  Synthetic oligonucleotide
cagactgttgcgttcgatccgcttg

SEQ ID NO: 720645 - DNA, 25 bp, Artificial sequence
  Synthetic oligonucleotide
gttgcgttcgatccgcttgccgcga

SEQ ID NO: 720646 - DNA, 25 bp, Artificial sequence
  Synthetic oligonucleotide
ttcgatccgcttgccgcgaaccacg

SEQ ID NO: 720647 - DNA, 25 bp, Artificial sequence
  Synthetic oligonucleotide
ggctcgccgtcgaacgtcgagcccc

SEQ ID NO: 720648 - DNA, 25 bp, Artificial sequence
  Synthetic oligonucleotide
cgagggcgaacagggaagcgggaag

SEQ ID NO: 720649 - DNA, 25 bp, Artificial sequence
  Synthetic oligonucleotide
agttcaaattccgcccggtagcgtg

SEQ ID NO: 720650 - DNA, 25 bp, Artificial sequence
  Synthetic oligonucleotide
agttcgacgagacgctggcggtgga

SEQ ID NO: 720651 - DNA, 25 bp, Artificial sequence
  Synthetic oligonucleotide
cttgggagttgtggtaatggcgata

SEQ ID NO: 720652 - DNA, 25 bp, Artificial sequence
  Synthetic oligonucleotide
caacgacttgggagttgtggtaatg

SEQ ID NO: 720653 - DNA, 25 bp, Artificial sequence
  Synthetic oligonucleotide
cgggctcaacgacttgggagttgtg

SEQ ID NO: 720654 - DNA, 25 bp, Artificial sequence
  Synthetic oligonucleotide
gtgaccgggctcaacgacttgggag

SEQ ID NO: 720655 - DNA, 25 bp, Artificial sequence
  Synthetic oligonucleotide
ggtaatggcgatagcctccggtgcc

SEQ ID NO: 720656 - DNA, 25 bp, Artificial sequence
  Synthetic oligonucleotide
tccgcccggtagcgtgaccgggctc

SEQ ID NO: 720657 - DNA, 25 bp, Artificial sequence
  Synthetic oligonucleotide
tggcgatagcctccggtgcctacaa

SEQ ID NO: 720658 - DNA, 25 bp, Artificial sequence
  Synthetic oligonucleotide
caagaccggcaaataagttcaaatt

SEQ ID NO: 720659 - DNA, 25 bp, Artificial sequence
  Synthetic oligonucleotide
cggatcaagaccggcaaataagttc

SEQ ID NO: 720660 - DNA, 25 bp, Artificial sequence
  Synthetic oligonucleotide
tggacccggatcaagaccggcaaat

SEQ ID NO: 720661 - DNA, 25 bp, Artificial sequence
  Synthetic oligonucleotide
cgtacctggacccggatcaagaccg

SEQ ID NO: 720662 - DNA, 25 bp, Artificial sequence
  Synthetic oligonucleotide
cctgcagacccgtacctggacccgg

SEQ ID NO: 720663 - DNA, 25 bp, Artificial sequence
  Synthetic oligonucleotide
gctgcgcctgcagacccgtacctgg

SEQ ID NO: 720664 - DNA, 25 bp, Artificial sequence
  Synthetic oligonucleotide
ggtagcgtgaccgggctcaacgact

SEQ ID NO: 720665 - DNA, 25 bp, Artificial sequence
  Synthetic oligonucleotide
accagcagccgaaagaggtgctggt

SEQ ID NO: 720666 - DNA, 25 bp, Artificial sequence
  Synthetic oligonucleotide
gccaaggccgccgataacgcctacg

SEQ ID NO: 720667 - DNA, 25 bp, Artificial sequence
  Synthetic oligonucleotide
gggtaaccaagcagttcgacgagac

SEQ ID NO: 720668 - DNA, 25 bp, Artificial sequence
  Synthetic oligonucleotide
tcgaccgggtaaccaagcagttcga

SEQ ID NO: 720669 - DNA, 25 bp, Artificial sequence
  Synthetic oligonucleotide
taaagatcgaccgggtaaccaagca

SEQ ID NO: 720670 - DNA, 25 bp, Artificial sequence
  Synthetic oligonucleotide
tgctggtaaagatcgaccgggtaac

SEQ ID NO: 720671 - DNA, 25 bp, Artificial sequence
  Synthetic oligonucleotide
agttgtggtaatggcgatagcctcc

SEQ ID NO: 720672 - DNA, 25 bp, Artificial sequence
  Synthetic oligonucleotide
agccgaaagaggtgctggtaaagat

SEQ ID NO: 720673 - DNA, 25 bp, Artificial sequence
  Synthetic oligonucleotide
cgtgttgccggccaaggtgctgcgc

SEQ ID NO: 720674 - DNA, 25 bp, Artificial sequence
  Synthetic oligonucleotide
agggcaaccagcagccgaaagaggt

SEQ ID NO: 720675 - DNA, 25 bp, Artificial sequence
  Synthetic oligonucleotide
ccctagagggcaaccagcagccgaa

SEQ ID NO: 720676 - DNA, 25 bp, Artificial sequence
  Synthetic oligonucleotide
agaaagccctagagggcaaccagca

SEQ ID NO: 720677 - DNA, 25 bp, Artificial sequence
  Synthetic oligonucleotide
gcctacaagaaagccctagagggca

SEQ ID NO: 720678 - DNA, 25 bp, Artificial sequence
  Synthetic oligonucleotide
ccggtgcctacaagaaagccctaga

SEQ ID NO: 720679 - DNA, 25 bp, Artificial sequence
  Synthetic oligonucleotide
tagcctccggtgcctacaagaaagc

SEQ ID NO: 720680 - DNA, 25 bp, Artificial sequence
  Synthetic oligonucleotide
aagaggtgctggtaaagatcgaccg

SEQ ID NO: 720681 - DNA, 25 bp, Artificial sequence
  Synthetic oligonucleotide
ctgcgtccggaggtgatcgccaagg

SEQ ID NO: 720682 - DNA, 25 bp, Artificial sequence
  Synthetic oligonucleotide
gctacgccaacgcgataccgggggc

SEQ ID NO: 720683 - DNA, 25 bp, Artificial sequence
  Synthetic oligonucleotide
acgtcggctacgccaacgcgatacc

SEQ ID NO: 720684 - DNA, 25 bp, Artificial sequence
  Synthetic oligonucleotide
gcgactacgtcggctacgccaacgc

SEQ ID NO: 720685 - DNA, 25 bp, Artificial sequence
  Synthetic oligonucleotide
aggtcagcgactacgtcggctacgc

SEQ ID NO: 720686 - DNA, 25 bp, Artificial sequence
  Synthetic oligonucleotide
tcgccaaggtcagcgactacgtcgg

SEQ ID NO: 720687 - DNA, 25 bp, Artificial sequence
  Synthetic oligonucleotide
caaggtgctgcgcctgcagacccgt

SEQ ID NO: 720688 - DNA, 25 bp, Artificial sequence
  Synthetic oligonucleotide
tccggaggtgatcgccaaggtcagc

SEQ ID NO: 720689 - DNA, 25 bp, Artificial sequence
  Synthetic oligonucleotide
gcccgcccgctgatggacaagagcg

SEQ ID NO: 720690 - DNA, 25 bp, Artificial sequence
  Synthetic oligonucleotide
tacctgctgcgtccggaggtgatcg

SEQ ID NO: 720691 - DNA, 25 bp, Artificial sequence
  Synthetic oligonucleotide
atcgactacctgctgcgtccggagg

SEQ ID NO: 720692 - DNA, 25 bp, Artificial sequence
  Synthetic oligonucleotide
gcgttcatcgactacctgctgcgtc

SEQ ID NO: 720693 - DNA, 25 bp, Artificial sequence
  Synthetic oligonucleotide
gcctacgcgttcatcgactacctgc

SEQ ID NO: 720694 - DNA, 25 bp, Artificial sequence
  Synthetic oligonucleotide
gataacgcctacgcgttcatcgact

SEQ ID NO: 720695 - DNA, 25 bp, Artificial sequence
  Synthetic oligonucleotide
agacactgctggtagccgctctggc

SEQ ID NO: 720696 - DNA, 25 bp, Artificial sequence
  Synthetic oligonucleotide
ggtgatcgccaaggtcagcgactac

SEQ ID NO: 720697 - DNA, 25 bp, Artificial sequence
  Synthetic oligonucleotide
aggaggtgtatccgccgcaggccgt

SEQ ID NO: 720698 - DNA, 25 bp, Artificial sequence
  Synthetic oligonucleotide
acgagacgctggcggtggacaccgt

SEQ ID NO: 720699 - DNA, 25 bp, Artificial sequence
  Synthetic oligonucleotide
ttccgccgtgttgccggccaaggtg

SEQ ID NO: 720700 - DNA, 25 bp, Artificial sequence
  Synthetic oligonucleotide
tctacgtttccgccgtgttgccggc

SEQ ID NO: 720701 - DNA, 25 bp, Artificial sequence
  Synthetic oligonucleotide
acaagctctacgtttccgccgtgtt

SEQ ID NO: 720702 - DNA, 25 bp, Artificial sequence
  Synthetic oligonucleotide
tgctcgacaagctctacgtttccgc

SEQ ID NO: 720703 - DNA, 25 bp, Artificial sequence
  Synthetic oligonucleotide
aggccgtgctcgacaagctctacgt

SEQ ID NO: 720704 - DNA, 25 bp, Artificial sequence
  Synthetic oligonucleotide
cgcgataccgggggcccgcccgctg

SEQ ID NO: 720705 - DNA, 25 bp, Artificial sequence
  Synthetic oligonucleotide
tgtatccgccgcaggccgtgctcga

SEQ ID NO: 720706 - DNA, 25 bp, Artificial sequence
  Synthetic oligonucleotide
ccgggggcccgcccgctgatggaca

SEQ ID NO: 720707 - DNA, 25 bp, Artificial sequence
  Synthetic oligonucleotide
acagcgaggaggtgtatccgccgca

SEQ ID NO: 720708 - DNA, 25 bp, Artificial sequence
  Synthetic oligonucleotide
tcagcgacagcgaggaggtgtatcc

SEQ ID NO: 720709 - DNA, 25 bp, Artificial sequence
  Synthetic oligonucleotide
aagagcgtcagcgacagcgaggagg

SEQ ID NO: 720710 - DNA, 25 bp, Artificial sequence
  Synthetic oligonucleotide
atggacaagagcgtcagcgacagcg

SEQ ID NO: 720711 - DNA, 25 bp, Artificial sequence
  Synthetic oligonucleotide
ccgctgatggacaagagcgtcagcg

SEQ ID NO: 720712 - DNA, 25 bp, Artificial sequence
  Synthetic oligonucleotide
tgccggccaaggtgctgcgcctgca

SEQ ID NO: 720713 - DNA, 25 bp, Artificial sequence
  Synthetic oligonucleotide
cgccgcaggccgtgctcgacaagct

SEQ ID NO: 720714 - DNA, 25 bp, Artificial sequence
  Synthetic oligonucleotide
ggcgcagaacatcgccttcggcctc

SEQ ID NO: 720715 - DNA, 25 bp, Artificial sequence
  Synthetic oligonucleotide
ccaagcagttcgacgagacgctggc

SEQ ID NO: 720716 - DNA, 25 bp, Artificial sequence
  Synthetic oligonucleotide
gcctgcccaaggccgagatcgacga

SEQ ID NO: 720717 - DNA, 25 bp, Artificial sequence
  Synthetic oligonucleotide
caggacggcctgcccaaggccgaga

SEQ ID NO: 720718 - DNA, 25 bp, Artificial sequence
  Synthetic oligonucleotide
ctcaagcaggacggcctgcccaagg

SEQ ID NO: 720719 - DNA, 25 bp, Artificial sequence
  Synthetic oligonucleotide
ttcggcctcaagcaggacggcctgc

SEQ ID NO: 720720 - DNA, 25 bp, Artificial sequence
  Synthetic oligonucleotide
ccgagatcgacgagcgcgtggccga

SEQ ID NO: 720721 - DNA, 25 bp, Artificial sequence
  Synthetic oligonucleotide
gaacatcgccttcggcctcaagcag

SEQ ID NO: 720722 - DNA, 25 bp, Artificial sequence
  Synthetic oligonucleotide
tcgacgagcgcgtggccgagatgct

SEQ ID NO: 720723 - DNA, 25 bp, Artificial sequence
  Synthetic oligonucleotide
agcgtggcgcagaacatcgccttcg

SEQ ID NO: 720724 - DNA, 25 bp, Artificial sequence
  Synthetic oligonucleotide
cacatgagcgtggcgcagaacatcg

SEQ ID NO: 720725 - DNA, 25 bp, Artificial sequence
  Synthetic oligonucleotide
ttcccgcacatgagcgtggcgcaga

SEQ ID NO: 720726 - DNA, 25 bp, Artificial sequence
  Synthetic oligonucleotide
gcgctgttcccgcacatgagcgtgg

SEQ ID NO: 720727 - DNA, 25 bp, Artificial sequence
  Synthetic oligonucleotide
tcctatgcgctgttcccgcacatga

SEQ ID NO: 720728 - DNA, 25 bp, Artificial sequence
  Synthetic oligonucleotide
gttccagtcctatgcgctgttcccg

SEQ ID NO: 720729 - DNA, 25 bp, Artificial sequence
  Synthetic oligonucleotide
tcgccttcggcctcaagcaggacgg

SEQ ID NO: 720730 - DNA, 25 bp, Artificial sequence
  Synthetic oligonucleotide
cccagtacgccaagcgcaagccgca

SEQ ID NO: 720731 - DNA, 25 bp, Artificial sequence
  Synthetic oligonucleotide
agcgccagcgggtggccctggctcg

SEQ ID NO: 720732 - DNA, 25 bp, Artificial sequence
  Synthetic oligonucleotide
ggcggccagcgccagcgggtggccc

SEQ ID NO: 720733 - DNA, 25 bp, Artificial sequence
  Synthetic oligonucleotide
ctctccggcggccagcgccagcggg

SEQ ID NO: 720734 - DNA, 25 bp, Artificial sequence
  Synthetic oligonucleotide
caccagctctccggcggccagcgcc

SEQ ID NO: 720735 - DNA, 25 bp, Artificial sequence
  Synthetic oligonucleotide
aagccgcaccagctctccggcggcc

SEQ ID NO: 720736 - DNA, 25 bp, Artificial sequence
  Synthetic oligonucleotide
ccaaggccgagatcgacgagcgcgt

SEQ ID NO: 720737 - DNA, 25 bp, Artificial sequence
  Synthetic oligonucleotide
tacgccaagcgcaagccgcaccagc

SEQ ID NO: 720738 - DNA, 25 bp, Artificial sequence
  Synthetic oligonucleotide
gcggccgatcaacatgatgttccag

SEQ ID NO: 720739 - DNA, 25 bp, Artificial sequence
  Synthetic oligonucleotide
acatgacccagtacgccaagcgcaa

SEQ ID NO: 720740 - DNA, 25 bp, Artificial sequence
  Synthetic oligonucleotide
tggtgcacatgacccagtacgccaa

SEQ ID NO: 720741 - DNA, 25 bp, Artificial sequence
  Synthetic oligonucleotide
tcaagctggtgcacatgacccagta

SEQ ID NO: 720742 - DNA, 25 bp, Artificial sequence
  Synthetic oligonucleotide
agatgctcaagctggtgcacatgac

SEQ ID NO: 720743 - DNA, 25 bp, Artificial sequence
  Synthetic oligonucleotide
tggccgagatgctcaagctggtgca

SEQ ID NO: 720744 - DNA, 25 bp, Artificial sequence
  Synthetic oligonucleotide
agcgcgtggccgagatgctcaagct

SEQ ID NO: 720745 - DNA, 25 bp, Artificial sequence
  Synthetic oligonucleotide
aagcgcaagccgcaccagctctccg

SEQ ID NO: 720746 - DNA, 25 bp, Artificial sequence
  Synthetic oligonucleotide
agggcgagatcttcgccctgctcgg

SEQ ID NO: 720747 - DNA, 25 bp, Artificial sequence
  Synthetic oligonucleotide
aaatccaccctgttacgcatgctcg

SEQ ID NO: 720748 - DNA, 25 bp, Artificial sequence
  Synthetic oligonucleotide
tcgggtaaatccaccctgttacgca

SEQ ID NO: 720749 - DNA, 25 bp, Artificial sequence
  Synthetic oligonucleotide
ctccggctcgggtaaatccaccctg

SEQ ID NO: 720750 - DNA, 25 bp, Artificial sequence
  Synthetic oligonucleotide
ggcggctccggctcgggtaaatcca

SEQ ID NO: 720751 - DNA, 25 bp, Artificial sequence
  Synthetic oligonucleotide
ctgctcggcggctccggctcgggta

SEQ ID NO: 720752 - DNA, 25 bp, Artificial sequence
  Synthetic oligonucleotide
catgatgttccagtcctatgcgctg

SEQ ID NO: 720753 - DNA, 25 bp, Artificial sequence
  Synthetic oligonucleotide
gagatcttcgccctgctcggcggct

SEQ ID NO: 720754 - DNA, 25 bp, Artificial sequence
  Synthetic oligonucleotide
catgctcgccggtttcgagcggccc

SEQ ID NO: 720755 - DNA, 25 bp, Artificial sequence
  Synthetic oligonucleotide
tcaacaagggcgagatcttcgccct

SEQ ID NO: 720756 - DNA, 25 bp, Artificial sequence
  Synthetic oligonucleotide
tgaccatcaacaagggcgagatctt

SEQ ID NO: 720757 - DNA, 25 bp, Artificial sequence
  Synthetic oligonucleotide
tgtccctgaccatcaacaagggcga

SEQ ID NO: 720758 - DNA, 25 bp, Artificial sequence
  Synthetic oligonucleotide
acaccgtgtccctgaccatcaacaa

SEQ ID NO: 720759 - DNA, 25 bp, Artificial sequence
  Synthetic oligonucleotide
cggtggacaccgtgtccctgaccat

SEQ ID NO: 720760 - DNA, 25 bp, Artificial sequence
  Synthetic oligonucleotide
cgctggcggtggacaccgtgtccct

SEQ ID NO: 720761 - DNA, 25 bp, Artificial sequence
  Synthetic oligonucleotide
ttcgccctgctcggcggctccggct

SEQ ID NO: 720762 - DNA, 25 bp, Artificial sequence
  Synthetic oligonucleotide
ggatcttcctcgatggccaggacat

SEQ ID NO: 720763 - DNA, 25 bp, Artificial sequence
  Synthetic oligonucleotide
gccgatgccaaggccgccgataacg

SEQ ID NO: 720764 - DNA, 25 bp, Artificial sequence
  Synthetic oligonucleotide
ctacgagcggccgatcaacatgatg

SEQ ID NO: 720765 - DNA, 25 bp, Artificial sequence
  Synthetic oligonucleotide
gccgccctacgagcggccgatcaac

SEQ ID NO: 720766 - DNA, 25 bp, Artificial sequence
  Synthetic oligonucleotide
gacctgccgccctacgagcggccga

SEQ ID NO: 720767 - DNA, 25 bp, Artificial sequence
  Synthetic oligonucleotide
atcaccgacctgccgccctacgagc

SEQ ID NO: 720768 - DNA, 25 bp, Artificial sequence
  Synthetic oligonucleotide
caggacatcaccgacctgccgccct

SEQ ID NO: 720769 - DNA, 25 bp, Artificial sequence
  Synthetic oligonucleotide
accctgttacgcatgctcgccggtt

SEQ ID NO: 720770 - DNA, 25 bp, Artificial sequence
  Synthetic oligonucleotide
tcctcgatggccaggacatcaccga

SEQ ID NO: 720771 - DNA, 25 bp, Artificial sequence
  Synthetic oligonucleotide
gttacgcatgctcgccggtttcgag

SEQ ID NO: 720772 - DNA, 25 bp, Artificial sequence
  Synthetic oligonucleotide
aggggcggatcttcctcgatggcca

SEQ ID NO: 720773 - DNA, 25 bp, Artificial sequence
  Synthetic oligonucleotide
caccgaggggcggatcttcctcgat

SEQ ID NO: 720774 - DNA, 25 bp, Artificial sequence
  Synthetic oligonucleotide
gcggcccaccgaggggcggatcttc

SEQ ID NO: 720775 - DNA, 25 bp, Artificial sequence
  Synthetic oligonucleotide
ttcgagcggcccaccgaggggcgga

SEQ ID NO: 720776 - DNA, 25 bp, Artificial sequence
  Synthetic oligonucleotide
cgccggtttcgagcggcccaccgag

SEQ ID NO: 720777 - DNA, 25 bp, Artificial sequence
  Synthetic oligonucleotide
gatcaacatgatgttccagtcctat

SEQ ID NO: 720778 - DNA, 25 bp, Artificial sequence
  Synthetic oligonucleotide
gatggccaggacatcaccgacctgc

SEQ ID NO: 720779 - DNA, 25 bp, Artificial sequence
  Synthetic oligonucleotide
caagcagatccaggccggtgccttc

SEQ ID NO: 720780 - DNA, 25 bp, Artificial sequence
  Synthetic oligonucleotide
tacaacgtggccaaggtcaaggaag

SEQ ID NO: 720781 - DNA, 25 bp, Artificial sequence
  Synthetic oligonucleotide
acaagagcaagctgccgaactggaa

SEQ ID NO: 720782 - DNA, 25 bp, Artificial sequence
  Synthetic oligonucleotide
agctggacaagagcaagctgccgaa

SEQ ID NO: 720783 - DNA, 25 bp, Artificial sequence
  Synthetic oligonucleotide
tccagaagctggacaagagcaagct

SEQ ID NO: 720784 - DNA, 25 bp, Artificial sequence
  Synthetic oligonucleotide
gtgccttccagaagctggacaagag

SEQ ID NO: 720785 - DNA, 25 bp, Artificial sequence
  Synthetic oligonucleotide
tgccgaactggaagaacctcgatcc

SEQ ID NO: 720786 - DNA, 25 bp, Artificial sequence
  Synthetic oligonucleotide
gatccaggccggtgccttccagaag

SEQ ID NO: 720787 - DNA, 25 bp, Artificial sequence
  Synthetic oligonucleotide
actggaagaacctcgatccggcgct

SEQ ID NO: 720788 - DNA, 25 bp, Artificial sequence
  Synthetic oligonucleotide
ctcggcaagcagatccaggccggtg

SEQ ID NO: 720789 - DNA, 25 bp, Artificial sequence
  Synthetic oligonucleotide
caacttcctcggcaagcagatccag

SEQ ID NO: 720790 - DNA, 25 bp, Artificial sequence
  Synthetic oligonucleotide
gtcgaacaacttcctcggcaagcag

SEQ ID NO: 720791 - DNA, 25 bp, Artificial sequence
  Synthetic oligonucleotide
ggtgccgtcgaacaacttcctcggc

SEQ ID NO: 720792 - DNA, 25 bp, Artificial sequence
  Synthetic oligonucleotide
catcgtggtgccgtcgaacaacttc

SEQ ID NO: 720793 - DNA, 25 bp, Artificial sequence
  Synthetic oligonucleotide
ctatgacatcgtggtgccgtcgaac

SEQ ID NO: 720794 - DNA, 25 bp, Artificial sequence
  Synthetic oligonucleotide
aggccggtgccttccagaagctgga

SEQ ID NO: 720795 - DNA, 25 bp, Artificial sequence
  Synthetic oligonucleotide
tcagcgacccgggcaaccagtacgc

SEQ ID NO: 720796 - DNA, 25 bp, Artificial sequence
  Synthetic oligonucleotide
gccgccgataacgcctacgcgttca

SEQ ID NO: 720797 - DNA, 25 bp, Artificial sequence
  Synthetic oligonucleotide
aacggcatcggttacaacgtggcca

SEQ ID NO: 720798 - DNA, 25 bp, Artificial sequence
  Synthetic oligonucleotide
ggcaccaacggcatcggttacaacg

SEQ ID NO: 720799 - DNA, 25 bp, Artificial sequence
  Synthetic oligonucleotide
ctgtggggcaccaacggcatcggtt

SEQ ID NO: 720800 - DNA, 25 bp, Artificial sequence
  Synthetic oligonucleotide
tccctacctgtggggcaccaacggc

SEQ ID NO: 720801 - DNA, 25 bp, Artificial sequence
  Synthetic oligonucleotide
gcaagctgccgaactggaagaacct

SEQ ID NO: 720802 - DNA, 25 bp, Artificial sequence
  Synthetic oligonucleotide
caaccagtacgcggttccctacctg

SEQ ID NO: 720803 - DNA, 25 bp, Artificial sequence
  Synthetic oligonucleotide
tggtctccggccactccggctatga

SEQ ID NO: 720804 - DNA, 25 bp, Artificial sequence
  Synthetic oligonucleotide
tggaggtcagcgacccgggcaacca

SEQ ID NO: 720805 - DNA, 25 bp, Artificial sequence
  Synthetic oligonucleotide
aagcaactggaggtcagcgacccgg

SEQ ID NO: 720806 - DNA, 25 bp, Artificial sequence
  Synthetic oligonucleotide
tgctcaagcaactggaggtcagcga

SEQ ID NO: 720807 - DNA, 25 bp, Artificial sequence
  Synthetic oligonucleotide
cggcgctgctcaagcaactggaggt

SEQ ID NO: 720808 - DNA, 25 bp, Artificial sequence
  Synthetic oligonucleotide
tcgatccggcgctgctcaagcaact

SEQ ID NO: 720809 - DNA, 25 bp, Artificial sequence
  Synthetic oligonucleotide
aagaacctcgatccggcgctgctca

SEQ ID NO: 720810 - DNA, 25 bp, Artificial sequence
  Synthetic oligonucleotide
tacgcggttccctacctgtggggca

SEQ ID NO: 720811 - DNA, 25 bp, Artificial sequence
  Synthetic oligonucleotide
cgtgcaggcggagaagaagagcctg

SEQ ID NO: 720812 - DNA, 25 bp, Artificial sequence
  Synthetic oligonucleotide
gaccgattacatcgctcccaccacc

SEQ ID NO: 720813 - DNA, 25 bp, Artificial sequence
  Synthetic oligonucleotide
aactggaccgattacatcgctccca

SEQ ID NO: 720814 - DNA, 25 bp, Artificial sequence
  Synthetic oligonucleotide
tctataactggaccgattacatcgc

SEQ ID NO: 720815 - DNA, 25 bp, Artificial sequence
  Synthetic oligonucleotide
gcacatctataactggaccgattac

SEQ ID NO: 720816 - DNA, 25 bp, Artificial sequence
  Synthetic oligonucleotide
gagcctgcacatctataactggacc

SEQ ID NO: 720817 - DNA, 25 bp, Artificial sequence
  Synthetic oligonucleotide
ctccggctatgacatcgtggtgccg

SEQ ID NO: 720818 - DNA, 25 bp, Artificial sequence
  Synthetic oligonucleotide
ggcggagaagaagagcctgcacatc

SEQ ID NO: 720819 - DNA, 25 bp, Artificial sequence
  Synthetic oligonucleotide
accaccctcaaggacttcaccaagg

SEQ ID NO: 720820 - DNA, 25 bp, Artificial sequence
  Synthetic oligonucleotide
gggccccgtgcaggcggagaagaag

SEQ ID NO: 720821 - DNA, 25 bp, Artificial sequence
  Synthetic oligonucleotide
gatcgcgggccccgtgcaggcggag

SEQ ID NO: 720822 - DNA, 25 bp, Artificial sequence
  Synthetic oligonucleotide
tacggcgatcgcgggccccgtgcag

SEQ ID NO: 720823 - DNA, 25 bp, Artificial sequence
  Synthetic oligonucleotide
tctggctacggcgatcgcgggcccc

SEQ ID NO: 720824 - DNA, 25 bp, Artificial sequence
  Synthetic oligonucleotide
tagccgctctggctacggcgatcgc

SEQ ID NO: 720825 - DNA, 25 bp, Artificial sequence
  Synthetic oligonucleotide
tgctggtagccgctctggctacggc

SEQ ID NO: 720826 - DNA, 25 bp, Artificial sequence
  Synthetic oligonucleotide
gaagaagagcctgcacatctataac

SEQ ID NO: 720827 - DNA, 25 bp, Artificial sequence
  Synthetic oligonucleotide
acgtcagctacgacgtcttcgactc

SEQ ID NO: 720828 - DNA, 25 bp, Artificial sequence
  Synthetic oligonucleotide
gtggccaaggtcaaggaagtcctcg

SEQ ID NO: 720829 - DNA, 25 bp, Artificial sequence
  Synthetic oligonucleotide
gcaagctggtctccggccactccgg

SEQ ID NO: 720830 - DNA, 25 bp, Artificial sequence
  Synthetic oligonucleotide
tcgagggcaagctggtctccggcca

SEQ ID NO: 720831 - DNA, 25 bp, Artificial sequence
  Synthetic oligonucleotide
gagaccctcgagggcaagctggtct

SEQ ID NO: 720832 - DNA, 25 bp, Artificial sequence
  Synthetic oligonucleotide
tccaacgagaccctcgagggcaagc

SEQ ID NO: 720833 - DNA, 25 bp, Artificial sequence
  Synthetic oligonucleotide
tcgactccaacgagaccctcgaggg

SEQ ID NO: 720834 - DNA, 25 bp, Artificial sequence
  Synthetic oligonucleotide
ttacatcgctcccaccaccctcaag

SEQ ID NO: 720835 - DNA, 25 bp, Artificial sequence
  Synthetic oligonucleotide
gctacgacgtcttcgactccaacga

SEQ ID NO: 720836 - DNA, 25 bp, Artificial sequence
  Synthetic oligonucleotide
gctcccaccaccctcaaggacttca

SEQ ID NO: 720837 - DNA, 25 bp, Artificial sequence
  Synthetic oligonucleotide
ggatcgacgtcagctacgacgtctt

SEQ ID NO: 720838 - DNA, 25 bp, Artificial sequence
  Synthetic oligonucleotide
agagcgggatcgacgtcagctacga

SEQ ID NO: 720839 - DNA, 25 bp, Artificial sequence
  Synthetic oligonucleotide
accaaggagagcgggatcgacgtca

SEQ ID NO: 720840 - DNA, 25 bp, Artificial sequence
  Synthetic oligonucleotide
gacttcaccaaggagagcgggatcg

SEQ ID NO: 720841 - DNA, 25 bp, Artificial sequence
  Synthetic oligonucleotide
ctcaaggacttcaccaaggagagcg

SEQ ID NO: 720842 - DNA, 25 bp, Artificial sequence
  Synthetic oligonucleotide
cggccactccggctatgacatcgtg
